United States Patent 10,611,818 (MHC MULTIMERS IN TUBERCULOSIS DIAGNOSTICS, VACCINE AND THERAPEUTICS) - sequence listing, part 3

SEQ ID NO: 46378 - protein, 9 aa, Mycobacterium tuberculosis
CQGFITQLG

SEQ ID NO: 46379 - protein, 9 aa, Mycobacterium tuberculosis
QGFITQLGR

SEQ ID NO: 46380 - protein, 9 aa, Mycobacterium tuberculosis
GFITQLGRN

SEQ ID NO: 46381 - protein, 9 aa, Mycobacterium tuberculosis
FITQLGRNF

SEQ ID NO: 46382 - protein, 9 aa, Mycobacterium tuberculosis
ITQLGRNFQ

SEQ ID NO: 46383 - protein, 9 aa, Mycobacterium tuberculosis
TQLGRNFQV

SEQ ID NO: 46384 - protein, 9 aa, Mycobacterium tuberculosis
QLGRNFQVI

SEQ ID NO: 46385 - protein, 9 aa, Mycobacterium tuberculosis
LGRNFQVIY

SEQ ID NO: 46386 - protein, 9 aa, Mycobacterium tuberculosis
GRNFQVIYE

SEQ ID NO: 46387 - protein, 9 aa, Mycobacterium tuberculosis
RNFQVIYEQ

SEQ ID NO: 46388 - protein, 9 aa, Mycobacterium tuberculosis
NFQVIYEQA

SEQ ID NO: 46389 - protein, 9 aa, Mycobacterium tuberculosis
FQVIYEQAN

SEQ ID NO: 46390 - protein, 9 aa, Mycobacterium tuberculosis
QVIYEQANA

SEQ ID NO: 46391 - protein, 9 aa, Mycobacterium tuberculosis
VIYEQANAH

SEQ ID NO: 46392 - protein, 9 aa, Mycobacterium tuberculosis
IYEQANAHG

SEQ ID NO: 46393 - protein, 9 aa, Mycobacterium tuberculosis
YEQANAHGQ

SEQ ID NO: 46394 - protein, 9 aa, Mycobacterium tuberculosis
EQANAHGQK

SEQ ID NO: 46395 - protein, 9 aa, Mycobacterium tuberculosis
QANAHGQKV

SEQ ID NO: 46396 - protein, 9 aa, Mycobacterium tuberculosis
ANAHGQKVQ

SEQ ID NO: 46397 - protein, 9 aa, Mycobacterium tuberculosis
NAHGQKVQA

SEQ ID NO: 46398 - protein, 9 aa, Mycobacterium tuberculosis
AHGQKVQAA

SEQ ID NO: 46399 - protein, 9 aa, Mycobacterium tuberculosis
HGQKVQAAG

SEQ ID NO: 46400 - protein, 9 aa, Mycobacterium tuberculosis
GQKVQAAGN

SEQ ID NO: 46401 - protein, 9 aa, Mycobacterium tuberculosis
QKVQAAGNN

SEQ ID NO: 46402 - protein, 9 aa, Mycobacterium tuberculosis
KVQAAGNNM

SEQ ID NO: 46403 - protein, 9 aa, Mycobacterium tuberculosis
VQAAGNNMA

SEQ ID NO: 46404 - protein, 9 aa, Mycobacterium tuberculosis
QAAGNNMAQ

SEQ ID NO: 46405 - protein, 9 aa, Mycobacterium tuberculosis
AAGNNMAQT

SEQ ID NO: 46406 - protein, 9 aa, Mycobacterium tuberculosis
AGNNMAQTD

SEQ ID NO: 46407 - protein, 9 aa, Mycobacterium tuberculosis
GNNMAQTDS

SEQ ID NO: 46408 - protein, 9 aa, Mycobacterium tuberculosis
NNMAQTDSA

SEQ ID NO: 46409 - protein, 9 aa, Mycobacterium tuberculosis
NMAQTDSAV

SEQ ID NO: 46410 - protein, 9 aa, Mycobacterium tuberculosis
MAQTDSAVG

SEQ ID NO: 46411 - protein, 9 aa, Mycobacterium tuberculosis
AQTDSAVGS

SEQ ID NO: 46412 - protein, 9 aa, Mycobacterium tuberculosis
QTDSAVGSS

SEQ ID NO: 46413 - protein, 9 aa, Mycobacterium tuberculosis
TDSAVGSSW

SEQ ID NO: 46414 - protein, 9 aa, Mycobacterium tuberculosis
DSAVGSSWA

SEQ ID NO: 46415 - protein, 10 aa, Mycobacterium tuberculosis
MTINYQFGDV

SEQ ID NO: 46416 - protein, 10 aa, Mycobacterium tuberculosis
TINYQFGDVD

SEQ ID NO: 46417 - protein, 10 aa, Mycobacterium tuberculosis
INYQFGDVDA

SEQ ID NO: 46418 - protein, 10 aa, Mycobacterium tuberculosis
NYQFGDVDAH

SEQ ID NO: 46419 - protein, 10 aa, Mycobacterium tuberculosis
YQFGDVDAHG

SEQ ID NO: 46420 - protein, 10 aa, Mycobacterium tuberculosis
QFGDVDAHGA

SEQ ID NO: 46421 - protein, 10 aa, Mycobacterium tuberculosis
FGDVDAHGAM

SEQ ID NO: 46422 - protein, 10 aa, Mycobacterium tuberculosis
GDVDAHGAMI

SEQ ID NO: 46423 - protein, 10 aa, Mycobacterium tuberculosis
DVDAHGAMIR

SEQ ID NO: 46424 - protein, 10 aa, Mycobacterium tuberculosis
VDAHGAMIRA

SEQ ID NO: 46425 - protein, 10 aa, Mycobacterium tuberculosis
DAHGAMIRAQ

SEQ ID NO: 46426 - protein, 10 aa, Mycobacterium tuberculosis
AHGAMIRAQA

SEQ ID NO: 46427 - protein, 10 aa, Mycobacterium tuberculosis
HGAMIRAQAG

SEQ ID NO: 46428 - protein, 10 aa, Mycobacterium tuberculosis
GAMIRAQAGS

SEQ ID NO: 46429 - protein, 10 aa, Mycobacterium tuberculosis
AMIRAQAGSL

SEQ ID NO: 46430 - protein, 10 aa, Mycobacterium tuberculosis
MIRAQAGSLE

SEQ ID NO: 46431 - protein, 10 aa, Mycobacterium tuberculosis
IRAQAGSLEA

SEQ ID NO: 46432 - protein, 10 aa, Mycobacterium tuberculosis
RAQAGSLEAE

SEQ ID NO: 46433 - protein, 10 aa, Mycobacterium tuberculosis
AQAGSLEAEH

SEQ ID NO: 46434 - protein, 10 aa, Mycobacterium tuberculosis
QAGSLEAEHQ

SEQ ID NO: 46435 - protein, 10 aa, Mycobacterium tuberculosis
AGSLEAEHQA

SEQ ID NO: 46436 - protein, 10 aa, Mycobacterium tuberculosis
GSLEAEHQAI

SEQ ID NO: 46437 - protein, 10 aa, Mycobacterium tuberculosis
SLEAEHQAII

SEQ ID NO: 46438 - protein, 10 aa, Mycobacterium tuberculosis
LEAEHQAIIS

SEQ ID NO: 46439 - protein, 10 aa, Mycobacterium tuberculosis
EAEHQAIISD

SEQ ID NO: 46440 - protein, 10 aa, Mycobacterium tuberculosis
AEHQAIISDV

SEQ ID NO: 46441 - protein, 10 aa, Mycobacterium tuberculosis
EHQAIISDVL

SEQ ID NO: 46442 - protein, 10 aa, Mycobacterium tuberculosis
HQAIISDVLT

SEQ ID NO: 46443 - protein, 10 aa, Mycobacterium tuberculosis
QAIISDVLTA

SEQ ID NO: 46444 - protein, 10 aa, Mycobacterium tuberculosis
AIISDVLTAS

SEQ ID NO: 46445 - protein, 10 aa, Mycobacterium tuberculosis
IISDVLTASD

SEQ ID NO: 46446 - protein, 10 aa, Mycobacterium tuberculosis
ISDVLTASDF

SEQ ID NO: 46447 - protein, 10 aa, Mycobacterium tuberculosis
SDVLTASDFW

SEQ ID NO: 46448 - protein, 10 aa, Mycobacterium tuberculosis
DVLTASDFWG

SEQ ID NO: 46449 - protein, 10 aa, Mycobacterium tuberculosis
VLTASDFWGG

SEQ ID NO: 46450 - protein, 10 aa, Mycobacterium tuberculosis
LTASDFWGGA

SEQ ID NO: 46451 - protein, 10 aa, Mycobacterium tuberculosis
TASDFWGGAG

SEQ ID NO: 46452 - protein, 10 aa, Mycobacterium tuberculosis
ASDFWGGAGS

SEQ ID NO: 46453 - protein, 10 aa, Mycobacterium tuberculosis
SDFWGGAGSA

SEQ ID NO: 46454 - protein, 10 aa, Mycobacterium tuberculosis
DFWGGAGSAA

SEQ ID NO: 46455 - protein, 10 aa, Mycobacterium tuberculosis
FWGGAGSAAC

SEQ ID NO: 46456 - protein, 10 aa, Mycobacterium tuberculosis
WGGAGSAACQ

SEQ ID NO: 46457 - protein, 10 aa, Mycobacterium tuberculosis
GGAGSAACQG

SEQ ID NO: 46458 - protein, 10 aa, Mycobacterium tuberculosis
GAGSAACQGF

SEQ ID NO: 46459 - protein, 10 aa, Mycobacterium tuberculosis
AGSAACQGFI

SEQ ID NO: 46460 - protein, 10 aa, Mycobacterium tuberculosis
GSAACQGFIT

SEQ ID NO: 46461 - protein, 10 aa, Mycobacterium tuberculosis
SAACQGFITQ

SEQ ID NO: 46462 - protein, 10 aa, Mycobacterium tuberculosis
AACQGFITQL

SEQ ID NO: 46463 - protein, 10 aa, Mycobacterium tuberculosis
ACQGFITQLG

SEQ ID NO: 46464 - protein, 10 aa, Mycobacterium tuberculosis
CQGFITQLGR

SEQ ID NO: 46465 - protein, 10 aa, Mycobacterium tuberculosis
QGFITQLGRN

SEQ ID NO: 46466 - protein, 10 aa, Mycobacterium tuberculosis
GFITQLGRNF

SEQ ID NO: 46467 - protein, 10 aa, Mycobacterium tuberculosis
FITQLGRNFQ

SEQ ID NO: 46468 - protein, 10 aa, Mycobacterium tuberculosis
ITQLGRNFQV

SEQ ID NO: 46469 - protein, 10 aa, Mycobacterium tuberculosis
TQLGRNFQVI

SEQ ID NO: 46470 - protein, 10 aa, Mycobacterium tuberculosis
QLGRNFQVIY

SEQ ID NO: 46471 - protein, 10 aa, Mycobacterium tuberculosis
LGRNFQVIYE

SEQ ID NO: 46472 - protein, 10 aa, Mycobacterium tuberculosis
GRNFQVIYEQ

SEQ ID NO: 46473 - protein, 10 aa, Mycobacterium tuberculosis
RNFQVIYEQA

SEQ ID NO: 46474 - protein, 10 aa, Mycobacterium tuberculosis
NFQVIYEQAN

SEQ ID NO: 46475 - protein, 10 aa, Mycobacterium tuberculosis
FQVIYEQANA

SEQ ID NO: 46476 - protein, 10 aa, Mycobacterium tuberculosis
QVIYEQANAH

SEQ ID NO: 46477 - protein, 10 aa, Mycobacterium tuberculosis
VIYEQANAHG

SEQ ID NO: 46478 - protein, 10 aa, Mycobacterium tuberculosis
IYEQANAHGQ

SEQ ID NO: 46479 - protein, 10 aa, Mycobacterium tuberculosis
YEQANAHGQK

SEQ ID NO: 46480 - protein, 10 aa, Mycobacterium tuberculosis
EQANAHGQKV

SEQ ID NO: 46481 - protein, 10 aa, Mycobacterium tuberculosis
QANAHGQKVQ

SEQ ID NO: 46482 - protein, 10 aa, Mycobacterium tuberculosis
ANAHGQKVQA

SEQ ID NO: 46483 - protein, 10 aa, Mycobacterium tuberculosis
NAHGQKVQAA

SEQ ID NO: 46484 - protein, 10 aa, Mycobacterium tuberculosis
AHGQKVQAAG

SEQ ID NO: 46485 - protein, 10 aa, Mycobacterium tuberculosis
HGQKVQAAGN

SEQ ID NO: 46486 - protein, 10 aa, Mycobacterium tuberculosis
GQKVQAAGNN

SEQ ID NO: 46487 - protein, 10 aa, Mycobacterium tuberculosis
QKVQAAGNNM

SEQ ID NO: 46488 - protein, 10 aa, Mycobacterium tuberculosis
KVQAAGNNMA

SEQ ID NO: 46489 - protein, 10 aa, Mycobacterium tuberculosis
VQAAGNNMAQ

SEQ ID NO: 46490 - protein, 10 aa, Mycobacterium tuberculosis
QAAGNNMAQT

SEQ ID NO: 46491 - protein, 10 aa, Mycobacterium tuberculosis
AAGNNMAQTD

SEQ ID NO: 46492 - protein, 10 aa, Mycobacterium tuberculosis
AGNNMAQTDS

SEQ ID NO: 46493 - protein, 10 aa, Mycobacterium tuberculosis
GNNMAQTDSA

SEQ ID NO: 46494 - protein, 10 aa, Mycobacterium tuberculosis
NNMAQTDSAV

SEQ ID NO: 46495 - protein, 10 aa, Mycobacterium tuberculosis
NMAQTDSAVG

SEQ ID NO: 46496 - protein, 10 aa, Mycobacterium tuberculosis
MAQTDSAVGS

SEQ ID NO: 46497 - protein, 10 aa, Mycobacterium tuberculosis
AQTDSAVGSS

SEQ ID NO: 46498 - protein, 10 aa, Mycobacterium tuberculosis
QTDSAVGSSW

SEQ ID NO: 46499 - protein, 10 aa, Mycobacterium tuberculosis
TDSAVGSSWA

SEQ ID NO: 46500 - protein, 11 aa, Mycobacterium tuberculosis
MTINYQFGDVD

SEQ ID NO: 46501 - protein, 11 aa, Mycobacterium tuberculosis
TINYQFGDVDA

SEQ ID NO: 46502 - protein, 11 aa, Mycobacterium tuberculosis
INYQFGDVDAH

SEQ ID NO: 46503 - protein, 11 aa, Mycobacterium tuberculosis
NYQFGDVDAHG

SEQ ID NO: 46504 - protein, 11 aa, Mycobacterium tuberculosis
YQFGDVDAHGA

SEQ ID NO: 46505 - protein, 11 aa, Mycobacterium tuberculosis
QFGDVDAHGAM

SEQ ID NO: 46506 - protein, 11 aa, Mycobacterium tuberculosis
FGDVDAHGAMI

SEQ ID NO: 46507 - protein, 11 aa, Mycobacterium tuberculosis
GDVDAHGAMIR

SEQ ID NO: 46508 - protein, 11 aa, Mycobacterium tuberculosis
DVDAHGAMIRA

SEQ ID NO: 46509 - protein, 11 aa, Mycobacterium tuberculosis
VDAHGAMIRAQ

SEQ ID NO: 46510 - protein, 11 aa, Mycobacterium tuberculosis
DAHGAMIRAQA

SEQ ID NO: 46511 - protein, 11 aa, Mycobacterium tuberculosis
AHGAMIRAQAG

SEQ ID NO: 46512 - protein, 11 aa, Mycobacterium tuberculosis
HGAMIRAQAGS

SEQ ID NO: 46513 - protein, 11 aa, Mycobacterium tuberculosis
GAMIRAQAGSL

SEQ ID NO: 46514 - protein, 11 aa, Mycobacterium tuberculosis
AMIRAQAGSLE

SEQ ID NO: 46515 - protein, 11 aa, Mycobacterium tuberculosis
MIRAQAGSLEA

SEQ ID NO: 46516 - protein, 11 aa, Mycobacterium tuberculosis
IRAQAGSLEAE

SEQ ID NO: 46517 - protein, 11 aa, Mycobacterium tuberculosis
RAQAGSLEAEH

SEQ ID NO: 46518 - protein, 11 aa, Mycobacterium tuberculosis
AQAGSLEAEHQ

SEQ ID NO: 46519 - protein, 11 aa, Mycobacterium tuberculosis
QAGSLEAEHQA

SEQ ID NO: 46520 - protein, 11 aa, Mycobacterium tuberculosis
AGSLEAEHQAI

SEQ ID NO: 46521 - protein, 11 aa, Mycobacterium tuberculosis
GSLEAEHQAII

SEQ ID NO: 46522 - protein, 11 aa, Mycobacterium tuberculosis
SLEAEHQAIIS

SEQ ID NO: 46523 - protein, 11 aa, Mycobacterium tuberculosis
LEAEHQAIISD

SEQ ID NO: 46524 - protein, 11 aa, Mycobacterium tuberculosis
EAEHQAIISDV

SEQ ID NO: 46525 - protein, 11 aa, Mycobacterium tuberculosis
AEHQAIISDVL

SEQ ID NO: 46526 - protein, 11 aa, Mycobacterium tuberculosis
EHQAIISDVLT

SEQ ID NO: 46527 - protein, 11 aa, Mycobacterium tuberculosis
HQAIISDVLTA

SEQ ID NO: 46528 - protein, 11 aa, Mycobacterium tuberculosis
QAIISDVLTAS

SEQ ID NO: 46529 - protein, 11 aa, Mycobacterium tuberculosis
AIISDVLTASD

SEQ ID NO: 46530 - protein, 11 aa, Mycobacterium tuberculosis
IISDVLTASDF

SEQ ID NO: 46531 - protein, 11 aa, Mycobacterium tuberculosis
ISDVLTASDFW

SEQ ID NO: 46532 - protein, 11 aa, Mycobacterium tuberculosis
SDVLTASDFWG

SEQ ID NO: 46533 - protein, 11 aa, Mycobacterium tuberculosis
DVLTASDFWGG

SEQ ID NO: 46534 - protein, 11 aa, Mycobacterium tuberculosis
VLTASDFWGGA

SEQ ID NO: 46535 - protein, 11 aa, Mycobacterium tuberculosis
LTASDFWGGAG

SEQ ID NO: 46536 - protein, 11 aa, Mycobacterium tuberculosis
TASDFWGGAGS

SEQ ID NO: 46537 - protein, 11 aa, Mycobacterium tuberculosis
ASDFWGGAGSA

SEQ ID NO: 46538 - protein, 11 aa, Mycobacterium tuberculosis
SDFWGGAGSAA

SEQ ID NO: 46539 - protein, 11 aa, Mycobacterium tuberculosis
DFWGGAGSAAC

SEQ ID NO: 46540 - protein, 11 aa, Mycobacterium tuberculosis
FWGGAGSAACQ

SEQ ID NO: 46541 - protein, 11 aa, Mycobacterium tuberculosis
WGGAGSAACQG

SEQ ID NO: 46542 - protein, 11 aa, Mycobacterium tuberculosis
GGAGSAACQGF

SEQ ID NO: 46543 - protein, 11 aa, Mycobacterium tuberculosis
GAGSAACQGFI

SEQ ID NO: 46544 - protein, 11 aa, Mycobacterium tuberculosis
AGSAACQGFIT

SEQ ID NO: 46545 - protein, 11 aa, Mycobacterium tuberculosis
GSAACQGFITQ

SEQ ID NO: 46546 - protein, 11 aa, Mycobacterium tuberculosis
SAACQGFITQL

SEQ ID NO: 46547 - protein, 11 aa, Mycobacterium tuberculosis
AACQGFITQLG

SEQ ID NO: 46548 - protein, 11 aa, Mycobacterium tuberculosis
ACQGFITQLGR

SEQ ID NO: 46549 - protein, 11 aa, Mycobacterium tuberculosis
CQGFITQLGRN

SEQ ID NO: 46550 - protein, 11 aa, Mycobacterium tuberculosis
QGFITQLGRNF

SEQ ID NO: 46551 - protein, 11 aa, Mycobacterium tuberculosis
GFITQLGRNFQ

SEQ ID NO: 46552 - protein, 11 aa, Mycobacterium tuberculosis
FITQLGRNFQV

SEQ ID NO: 46553 - protein, 11 aa, Mycobacterium tuberculosis
ITQLGRNFQVI

SEQ ID NO: 46554 - protein, 11 aa, Mycobacterium tuberculosis
TQLGRNFQVIY

SEQ ID NO: 46555 - protein, 11 aa, Mycobacterium tuberculosis
QLGRNFQVIYE

SEQ ID NO: 46556 - protein, 11 aa, Mycobacterium tuberculosis
LGRNFQVIYEQ

SEQ ID NO: 46557 - protein, 11 aa, Mycobacterium tuberculosis
GRNFQVIYEQA

SEQ ID NO: 46558 - protein, 11 aa, Mycobacterium tuberculosis
RNFQVIYEQAN

SEQ ID NO: 46559 - protein, 11 aa, Mycobacterium tuberculosis
NFQVIYEQANA

SEQ ID NO: 46560 - protein, 11 aa, Mycobacterium tuberculosis
FQVIYEQANAH

SEQ ID NO: 46561 - protein, 11 aa, Mycobacterium tuberculosis
QVIYEQANAHG

SEQ ID NO: 46562 - protein, 11 aa, Mycobacterium tuberculosis
VIYEQANAHGQ

SEQ ID NO: 46563 - protein, 11 aa, Mycobacterium tuberculosis
IYEQANAHGQK

SEQ ID NO: 46564 - protein, 11 aa, Mycobacterium tuberculosis
YEQANAHGQKV

SEQ ID NO: 46565 - protein, 11 aa, Mycobacterium tuberculosis
EQANAHGQKVQ

SEQ ID NO: 46566 - protein, 11 aa, Mycobacterium tuberculosis
QANAHGQKVQA

SEQ ID NO: 46567 - protein, 11 aa, Mycobacterium tuberculosis
ANAHGQKVQAA

SEQ ID NO: 46568 - protein, 11 aa, Mycobacterium tuberculosis
NAHGQKVQAAG

SEQ ID NO: 46569 - protein, 11 aa, Mycobacterium tuberculosis
AHGQKVQAAGN

SEQ ID NO: 46570 - protein, 11 aa, Mycobacterium tuberculosis
HGQKVQAAGNN

SEQ ID NO: 46571 - protein, 11 aa, Mycobacterium tuberculosis
GQKVQAAGNNM

SEQ ID NO: 46572 - protein, 11 aa, Mycobacterium tuberculosis
QKVQAAGNNMA

SEQ ID NO: 46573 - protein, 11 aa, Mycobacterium tuberculosis
KVQAAGNNMAQ

SEQ ID NO: 46574 - protein, 11 aa, Mycobacterium tuberculosis
VQAAGNNMAQT

SEQ ID NO: 46575 - protein, 11 aa, Mycobacterium tuberculosis
QAAGNNMAQTD

SEQ ID NO: 46576 - protein, 11 aa, Mycobacterium tuberculosis
AAGNNMAQTDS

SEQ ID NO: 46577 - protein, 11 aa, Mycobacterium tuberculosis
AGNNMAQTDSA

SEQ ID NO: 46578 - protein, 11 aa, Mycobacterium tuberculosis
GNNMAQTDSAV

SEQ ID NO: 46579 - protein, 11 aa, Mycobacterium tuberculosis
NNMAQTDSAVG

SEQ ID NO: 46580 - protein, 11 aa, Mycobacterium tuberculosis
NMAQTDSAVGS

SEQ ID NO: 46581 - protein, 11 aa, Mycobacterium tuberculosis
MAQTDSAVGSS

SEQ ID NO: 46582 - protein, 11 aa, Mycobacterium tuberculosis
AQTDSAVGSSW

SEQ ID NO: 46583 - protein, 11 aa, Mycobacterium tuberculosis
QTDSAVGSSWA

SEQ ID NO: 46584 - protein, 8 aa, Mycobacterium tuberculosis
MTSRFMTD

SEQ ID NO: 46585 - protein, 8 aa, Mycobacterium tuberculosis
TSRFMTDP

SEQ ID NO: 46586 - protein, 8 aa, Mycobacterium tuberculosis
SRFMTDPH

SEQ ID NO: 46587 - protein, 8 aa, Mycobacterium tuberculosis
RFMTDPHA

SEQ ID NO: 46588 - protein, 8 aa, Mycobacterium tuberculosis
FMTDPHAM

SEQ ID NO: 46589 - protein, 8 aa, Mycobacterium tuberculosis
MTDPHAMR

SEQ ID NO: 46590 - protein, 8 aa, Mycobacterium tuberculosis
TDPHAMRD

SEQ ID NO: 46591 - protein, 8 aa, Mycobacterium tuberculosis
DPHAMRDM

SEQ ID NO: 46592 - protein, 8 aa, Mycobacterium tuberculosis
PHAMRDMA

SEQ ID NO: 46593 - protein, 8 aa, Mycobacterium tuberculosis
HAMRDMAG

SEQ ID NO: 46594 - protein, 8 aa, Mycobacterium tuberculosis
AMRDMAGR

SEQ ID NO: 46595 - protein, 8 aa, Mycobacterium tuberculosis
MRDMAGRF

SEQ ID NO: 46596 - protein, 8 aa, Mycobacterium tuberculosis
RDMAGRFE

SEQ ID NO: 46597 - protein, 8 aa, Mycobacterium tuberculosis
DMAGRFEV

SEQ ID NO: 46598 - protein, 8 aa, Mycobacterium tuberculosis
MAGRFEVH

SEQ ID NO: 46599 - protein, 8 aa, Mycobacterium tuberculosis
AGRFEVHA

SEQ ID NO: 46600 - protein, 8 aa, Mycobacterium tuberculosis
GRFEVHAQ

SEQ ID NO: 46601 - protein, 8 aa, Mycobacterium tuberculosis
RFEVHAQT

SEQ ID NO: 46602 - protein, 8 aa, Mycobacterium tuberculosis
FEVHAQTV

SEQ ID NO: 46603 - protein, 8 aa, Mycobacterium tuberculosis
EVHAQTVE

SEQ ID NO: 46604 - protein, 8 aa, Mycobacterium tuberculosis
VHAQTVED

SEQ ID NO: 46605 - protein, 8 aa, Mycobacterium tuberculosis
HAQTVEDE

SEQ ID NO: 46606 - protein, 8 aa, Mycobacterium tuberculosis
AQTVEDEA

SEQ ID NO: 46607 - protein, 8 aa, Mycobacterium tuberculosis
QTVEDEAR

SEQ ID NO: 46608 - protein, 8 aa, Mycobacterium tuberculosis
TVEDEARR

SEQ ID NO: 46609 - protein, 8 aa, Mycobacterium tuberculosis
VEDEARRM

SEQ ID NO: 46610 - protein, 8 aa, Mycobacterium tuberculosis
EDEARRMW

SEQ ID NO: 46611 - protein, 8 aa, Mycobacterium tuberculosis
DEARRMWA

SEQ ID NO: 46612 - protein, 8 aa, Mycobacterium tuberculosis
EARRMWAS

SEQ ID NO: 46613 - protein, 8 aa, Mycobacterium tuberculosis
ARRMWASA

SEQ ID NO: 46614 - protein, 8 aa, Mycobacterium tuberculosis
RRMWASAQ

SEQ ID NO: 46615 - protein, 8 aa, Mycobacterium tuberculosis
RMWASAQN

SEQ ID NO: 46616 - protein, 8 aa, Mycobacterium tuberculosis
MWASAQNI

SEQ ID NO: 46617 - protein, 8 aa, Mycobacterium tuberculosis
WASAQNIS

SEQ ID NO: 46618 - protein, 8 aa, Mycobacterium tuberculosis
ASAQNISG

SEQ ID NO: 46619 - protein, 8 aa, Mycobacterium tuberculosis
SAQNISGA

SEQ ID NO: 46620 - protein, 8 aa, Mycobacterium tuberculosis
AQNISGAG

SEQ ID NO: 46621 - protein, 8 aa, Mycobacterium tuberculosis
QNISGAGW

SEQ ID NO: 46622 - protein, 8 aa, Mycobacterium tuberculosis
NISGAGWS

SEQ ID NO: 46623 - protein, 8 aa, Mycobacterium tuberculosis
ISGAGWSG

SEQ ID NO: 46624 - protein, 8 aa, Mycobacterium tuberculosis
SGAGWSGM

SEQ ID NO: 46625 - protein, 8 aa, Mycobacterium tuberculosis
GAGWSGMA

SEQ ID NO: 46626 - protein, 8 aa, Mycobacterium tuberculosis
AGWSGMAE

SEQ ID NO: 46627 - protein, 8 aa, Mycobacterium tuberculosis
GWSGMAEA

SEQ ID NO: 46628 - protein, 8 aa, Mycobacterium tuberculosis
WSGMAEAT

SEQ ID NO: 46629 - protein, 8 aa, Mycobacterium tuberculosis
SGMAEATS

SEQ ID NO: 46630 - protein, 8 aa, Mycobacterium tuberculosis
GMAEATSL

SEQ ID NO: 46631 - protein, 8 aa, Mycobacterium tuberculosis
MAEATSLD

SEQ ID NO: 46632 - protein, 8 aa, Mycobacterium tuberculosis
AEATSLDT

SEQ ID NO: 46633 - protein, 8 aa, Mycobacterium tuberculosis
EATSLDTM

SEQ ID NO: 46634 - protein, 8 aa, Mycobacterium tuberculosis
ATSLDTMT

SEQ ID NO: 46635 - protein, 8 aa, Mycobacterium tuberculosis
TSLDTMTQ

SEQ ID NO: 46636 - protein, 8 aa, Mycobacterium tuberculosis
SLDTMTQM

SEQ ID NO: 46637 - protein, 8 aa, Mycobacterium tuberculosis
LDTMTQMN

SEQ ID NO: 46638 - protein, 8 aa, Mycobacterium tuberculosis
DTMTQMNQ

SEQ ID NO: 46639 - protein, 8 aa, Mycobacterium tuberculosis
TMTQMNQA

SEQ ID NO: 46640 - protein, 8 aa, Mycobacterium tuberculosis
MTQMNQAF

SEQ ID NO: 46641 - protein, 8 aa, Mycobacterium tuberculosis
TQMNQAFR

SEQ ID NO: 46642 - protein, 8 aa, Mycobacterium tuberculosis
QMNQAFRN

SEQ ID NO: 46643 - protein, 8 aa, Mycobacterium tuberculosis
MNQAFRNI

SEQ ID NO: 46644 - protein, 8 aa, Mycobacterium tuberculosis
NQAFRNIV

SEQ ID NO: 46645 - protein, 8 aa, Mycobacterium tuberculosis
QAFRNIVN

SEQ ID NO: 46646 - protein, 8 aa, Mycobacterium tuberculosis
AFRNIVNM

SEQ ID NO: 46647 - protein, 8 aa, Mycobacterium tuberculosis
FRNIVNML

SEQ ID NO: 46648 - protein, 8 aa, Mycobacterium tuberculosis
RNIVNMLH

SEQ ID NO: 46649 - protein, 8 aa, Mycobacterium tuberculosis
NIVNMLHG

SEQ ID NO: 46650 - protein, 8 aa, Mycobacterium tuberculosis
IVNMLHGV

SEQ ID NO: 46651 - protein, 8 aa, Mycobacterium tuberculosis
VNMLHGVR

SEQ ID NO: 46652 - protein, 8 aa, Mycobacterium tuberculosis
NMLHGVRD

SEQ ID NO: 46653 - protein, 8 aa, Mycobacterium tuberculosis
MLHGVRDG

SEQ ID NO: 46654 - protein, 8 aa, Mycobacterium tuberculosis
LHGVRDGL

SEQ ID NO: 46655 - protein, 8 aa, Mycobacterium tuberculosis
HGVRDGLV

SEQ ID NO: 46656 - protein, 8 aa, Mycobacterium tuberculosis
GVRDGLVR

SEQ ID NO: 46657 - protein, 8 aa, Mycobacterium tuberculosis
VRDGLVRD

SEQ ID NO: 46658 - protein, 8 aa, Mycobacterium tuberculosis
RDGLVRDA

SEQ ID NO: 46659 - protein, 8 aa, Mycobacterium tuberculosis
DGLVRDAN

SEQ ID NO: 46660 - protein, 8 aa, Mycobacterium tuberculosis
GLVRDANN

SEQ ID NO: 46661 - protein, 8 aa, Mycobacterium tuberculosis
LVRDANNY

SEQ ID NO: 46662 - protein, 8 aa, Mycobacterium tuberculosis
VRDANNYE

SEQ ID NO: 46663 - protein, 8 aa, Mycobacterium tuberculosis
RDANNYEQ

SEQ ID NO: 46664 - protein, 8 aa, Mycobacterium tuberculosis
DANNYEQQ

SEQ ID NO: 46665 - protein, 8 aa, Mycobacterium tuberculosis
ANNYEQQE

SEQ ID NO: 46666 - protein, 8 aa, Mycobacterium tuberculosis
NNYEQQEQ

SEQ ID NO: 46667 - protein, 8 aa, Mycobacterium tuberculosis
NYEQQEQA

SEQ ID NO: 46668 - protein, 8 aa, Mycobacterium tuberculosis
YEQQEQAS

SEQ ID NO: 46669 - protein, 8 aa, Mycobacterium tuberculosis
EQQEQASQ

SEQ ID NO: 46670 - protein, 8 aa, Mycobacterium tuberculosis
QQEQASQQ

SEQ ID NO: 46671 - protein, 8 aa, Mycobacterium tuberculosis
QEQASQQI

SEQ ID NO: 46672 - protein, 8 aa, Mycobacterium tuberculosis
EQASQQIL

SEQ ID NO: 46673 - protein, 8 aa, Mycobacterium tuberculosis
QASQQILS

SEQ ID NO: 46674 - protein, 8 aa, Mycobacterium tuberculosis
ASQQILSS

SEQ ID NO: 46675 - protein, 9 aa, Mycobacterium tuberculosis
MTSRFMTDP

SEQ ID NO: 46676 - protein, 9 aa, Mycobacterium tuberculosis
TSRFMTDPH

SEQ ID NO: 46677 - protein, 9 aa, Mycobacterium tuberculosis
SRFMTDPHA

SEQ ID NO: 46678 - protein, 9 aa, Mycobacterium tuberculosis
RFMTDPHAM

SEQ ID NO: 46679 - protein, 9 aa, Mycobacterium tuberculosis
FMTDPHAMR

SEQ ID NO: 46680 - protein, 9 aa, Mycobacterium tuberculosis
MTDPHAMRD

SEQ ID NO: 46681 - protein, 9 aa, Mycobacterium tuberculosis
TDPHAMRDM

SEQ ID NO: 46682 - protein, 9 aa, Mycobacterium tuberculosis
DPHAMRDMA

SEQ ID NO: 46683 - protein, 9 aa, Mycobacterium tuberculosis
PHAMRDMAG

SEQ ID NO: 46684 - protein, 9 aa, Mycobacterium tuberculosis
HAMRDMAGR

SEQ ID NO: 46685 - protein, 9 aa, Mycobacterium tuberculosis
AMRDMAGRF

SEQ ID NO: 46686 - protein, 9 aa, Mycobacterium tuberculosis
MRDMAGRFE

SEQ ID NO: 46687 - protein, 9 aa, Mycobacterium tuberculosis
RDMAGRFEV

SEQ ID NO: 46688 - protein, 9 aa, Mycobacterium tuberculosis
DMAGRFEVH

SEQ ID NO: 46689 - protein, 9 aa, Mycobacterium tuberculosis
MAGRFEVHA

SEQ ID NO: 46690 - protein, 9 aa, Mycobacterium tuberculosis
AGRFEVHAQ

SEQ ID NO: 46691 - protein, 9 aa, Mycobacterium tuberculosis
GRFEVHAQT

SEQ ID NO: 46692 - protein, 9 aa, Mycobacterium tuberculosis
RFEVHAQTV

SEQ ID NO: 46693 - protein, 9 aa, Mycobacterium tuberculosis
FEVHAQTVE

SEQ ID NO: 46694 - protein, 9 aa, Mycobacterium tuberculosis
EVHAQTVED

SEQ ID NO: 46695 - protein, 9 aa, Mycobacterium tuberculosis
VHAQTVEDE

SEQ ID NO: 46696 - protein, 9 aa, Mycobacterium tuberculosis
HAQTVEDEA

SEQ ID NO: 46697 - protein, 9 aa, Mycobacterium tuberculosis
AQTVEDEAR

SEQ ID NO: 46698 - protein, 9 aa, Mycobacterium tuberculosis
QTVEDEARR

SEQ ID NO: 46699 - protein, 9 aa, Mycobacterium tuberculosis
TVEDEARRM

SEQ ID NO: 46700 - protein, 9 aa, Mycobacterium tuberculosis
VEDEARRMW

SEQ ID NO: 46701 - protein, 9 aa, Mycobacterium tuberculosis
EDEARRMWA

SEQ ID NO: 46702 - protein, 9 aa, Mycobacterium tuberculosis
DEARRMWAS

SEQ ID NO: 46703 - protein, 9 aa, Mycobacterium tuberculosis
EARRMWASA

SEQ ID NO: 46704 - protein, 9 aa, Mycobacterium tuberculosis
ARRMWASAQ

SEQ ID NO: 46705 - protein, 9 aa, Mycobacterium tuberculosis
RRMWASAQN

SEQ ID NO: 46706 - protein, 9 aa, Mycobacterium tuberculosis
RMWASAQNI

SEQ ID NO: 46707 - protein, 9 aa, Mycobacterium tuberculosis
MWASAQNIS

SEQ ID NO: 46708 - protein, 9 aa, Mycobacterium tuberculosis
WASAQNISG

SEQ ID NO: 46709 - protein, 9 aa, Mycobacterium tuberculosis
ASAQNISGA

SEQ ID NO: 46710 - protein, 9 aa, Mycobacterium tuberculosis
SAQNISGAG

SEQ ID NO: 46711 - protein, 9 aa, Mycobacterium tuberculosis
AQNISGAGW

SEQ ID NO: 46712 - protein, 9 aa, Mycobacterium tuberculosis
QNISGAGWS

SEQ ID NO: 46713 - protein, 9 aa, Mycobacterium tuberculosis
NISGAGWSG

SEQ ID NO: 46714 - protein, 9 aa, Mycobacterium tuberculosis
ISGAGWSGM

SEQ ID NO: 46715 - protein, 9 aa, Mycobacterium tuberculosis
SGAGWSGMA

SEQ ID NO: 46716 - protein, 9 aa, Mycobacterium tuberculosis
GAGWSGMAE

SEQ ID NO: 46717 - protein, 9 aa, Mycobacterium tuberculosis
AGWSGMAEA

SEQ ID NO: 46718 - protein, 9 aa, Mycobacterium tuberculosis
GWSGMAEAT

SEQ ID NO: 46719 - protein, 9 aa, Mycobacterium tuberculosis
WSGMAEATS

SEQ ID NO: 46720 - protein, 9 aa, Mycobacterium tuberculosis
SGMAEATSL

SEQ ID NO: 46721 - protein, 9 aa, Mycobacterium tuberculosis
GMAEATSLD

SEQ ID NO: 46722 - protein, 9 aa, Mycobacterium tuberculosis
MAEATSLDT

SEQ ID NO: 46723 - protein, 9 aa, Mycobacterium tuberculosis
AEATSLDTM

SEQ ID NO: 46724 - protein, 9 aa, Mycobacterium tuberculosis
EATSLDTMT

SEQ ID NO: 46725 - protein, 9 aa, Mycobacterium tuberculosis
ATSLDTMTQ

SEQ ID NO: 46726 - protein, 9 aa, Mycobacterium tuberculosis
TSLDTMTQM

SEQ ID NO: 46727 - protein, 9 aa, Mycobacterium tuberculosis
SLDTMTQMN

SEQ ID NO: 46728 - protein, 9 aa, Mycobacterium tuberculosis
LDTMTQMNQ

SEQ ID NO: 46729 - protein, 9 aa, Mycobacterium tuberculosis
DTMTQMNQA

SEQ ID NO: 46730 - protein, 9 aa, Mycobacterium tuberculosis
TMTQMNQAF

SEQ ID NO: 46731 - protein, 9 aa, Mycobacterium tuberculosis
MTQMNQAFR

SEQ ID NO: 46732 - protein, 9 aa, Mycobacterium tuberculosis
TQMNQAFRN

SEQ ID NO: 46733 - protein, 9 aa, Mycobacterium tuberculosis
QMNQAFRNI

SEQ ID NO: 46734 - protein, 9 aa, Mycobacterium tuberculosis
MNQAFRNIV

SEQ ID NO: 46735 - protein, 9 aa, Mycobacterium tuberculosis
NQAFRNIVN

SEQ ID NO: 46736 - protein, 9 aa, Mycobacterium tuberculosis
QAFRNIVNM

SEQ ID NO: 46737 - protein, 9 aa, Mycobacterium tuberculosis
AFRNIVNML

SEQ ID NO: 46738 - protein, 9 aa, Mycobacterium tuberculosis
FRNIVNMLH

SEQ ID NO: 46739 - protein, 9 aa, Mycobacterium tuberculosis
RNIVNMLHG

SEQ ID NO: 46740 - protein, 9 aa, Mycobacterium tuberculosis
NIVNMLHGV

SEQ ID NO: 46741 - protein, 9 aa, Mycobacterium tuberculosis
IVNMLHGVR

SEQ ID NO: 46742 - protein, 9 aa, Mycobacterium tuberculosis
VNMLHGVRD

SEQ ID NO: 46743 - protein, 9 aa, Mycobacterium tuberculosis
NMLHGVRDG

SEQ ID NO: 46744 - protein, 9 aa, Mycobacterium tuberculosis
MLHGVRDGL

SEQ ID NO: 46745 - protein, 9 aa, Mycobacterium tuberculosis
LHGVRDGLV

SEQ ID NO: 46746 - protein, 9 aa, Mycobacterium tuberculosis
HGVRDGLVR

SEQ ID NO: 46747 - protein, 9 aa, Mycobacterium tuberculosis
GVRDGLVRD

SEQ ID NO: 46748 - protein, 9 aa, Mycobacterium tuberculosis
VRDGLVRDA

SEQ ID NO: 46749 - protein, 9 aa, Mycobacterium tuberculosis
RDGLVRDAN

SEQ ID NO: 46750 - protein, 9 aa, Mycobacterium tuberculosis
DGLVRDANN

SEQ ID NO: 46751 - protein, 9 aa, Mycobacterium tuberculosis
GLVRDANNY

SEQ ID NO: 46752 - protein, 9 aa, Mycobacterium tuberculosis
LVRDANNYE

SEQ ID NO: 46753 - protein, 9 aa, Mycobacterium tuberculosis
VRDANNYEQ

SEQ ID NO: 46754 - protein, 9 aa, Mycobacterium tuberculosis
RDANNYEQQ

SEQ ID NO: 46755 - protein, 9 aa, Mycobacterium tuberculosis
DANNYEQQE

SEQ ID NO: 46756 - protein, 9 aa, Mycobacterium tuberculosis
ANNYEQQEQ

SEQ ID NO: 46757 - protein, 9 aa, Mycobacterium tuberculosis
NNYEQQEQA

SEQ ID NO: 46758 - protein, 9 aa, Mycobacterium tuberculosis
NYEQQEQAS

SEQ ID NO: 46759 - protein, 9 aa, Mycobacterium tuberculosis
YEQQEQASQ

SEQ ID NO: 46760 - protein, 9 aa, Mycobacterium tuberculosis
EQQEQASQQ

SEQ ID NO: 46761 - protein, 9 aa, Mycobacterium tuberculosis
QQEQASQQI

SEQ ID NO: 46762 - protein, 9 aa, Mycobacterium tuberculosis
QEQASQQIL

SEQ ID NO: 46763 - protein, 9 aa, Mycobacterium tuberculosis
EQASQQILS

SEQ ID NO: 46764 - protein, 9 aa, Mycobacterium tuberculosis
QASQQILSS

SEQ ID NO: 46765 - protein, 10 aa, Mycobacterium tuberculosis
MTSRFMTDPH

SEQ ID NO: 46766 - protein, 10 aa, Mycobacterium tuberculosis
TSRFMTDPHA

SEQ ID NO: 46767 - protein, 10 aa, Mycobacterium tuberculosis
SRFMTDPHAM

SEQ ID NO: 46768 - protein, 10 aa, Mycobacterium tuberculosis
RFMTDPHAMR

SEQ ID NO: 46769 - protein, 10 aa, Mycobacterium tuberculosis
FMTDPHAMRD

SEQ ID NO: 46770 - protein, 10 aa, Mycobacterium tuberculosis
MTDPHAMRDM

SEQ ID NO: 46771 - protein, 10 aa, Mycobacterium tuberculosis
TDPHAMRDMA

SEQ ID NO: 46772 - protein, 10 aa, Mycobacterium tuberculosis
DPHAMRDMAG

SEQ ID NO: 46773 - protein, 10 aa, Mycobacterium tuberculosis
PHAMRDMAGR

SEQ ID NO: 46774 - protein, 10 aa, Mycobacterium tuberculosis
HAMRDMAGRF

SEQ ID NO: 46775 - protein, 10 aa, Mycobacterium tuberculosis
AMRDMAGRFE

SEQ ID NO: 46776 - protein, 10 aa, Mycobacterium tuberculosis
MRDMAGRFEV

SEQ ID NO: 46777 - protein, 10 aa, Mycobacterium tuberculosis
RDMAGRFEVH

SEQ ID NO: 46778 - protein, 10 aa, Mycobacterium tuberculosis
DMAGRFEVHA

SEQ ID NO: 46779 - protein, 10 aa, Mycobacterium tuberculosis
MAGRFEVHAQ

SEQ ID NO: 46780 - protein, 10 aa, Mycobacterium tuberculosis
AGRFEVHAQT

SEQ ID NO: 46781 - protein, 10 aa, Mycobacterium tuberculosis
GRFEVHAQTV

SEQ ID NO: 46782 - protein, 10 aa, Mycobacterium tuberculosis
RFEVHAQTVE

SEQ ID NO: 46783 - protein, 10 aa, Mycobacterium tuberculosis
FEVHAQTVED

SEQ ID NO: 46784 - protein, 10 aa, Mycobacterium tuberculosis
EVHAQTVEDE

SEQ ID NO: 46785 - protein, 10 aa, Mycobacterium tuberculosis
VHAQTVEDEA

SEQ ID NO: 46786 - protein, 10 aa, Mycobacterium tuberculosis
HAQTVEDEAR

SEQ ID NO: 46787 - protein, 10 aa, Mycobacterium tuberculosis
AQTVEDEARR

SEQ ID NO: 46788 - protein, 10 aa, Mycobacterium tuberculosis
QTVEDEARRM

SEQ ID NO: 46789 - protein, 10 aa, Mycobacterium tuberculosis
TVEDEARRMW

SEQ ID NO: 46790 - protein, 10 aa, Mycobacterium tuberculosis
VEDEARRMWA

SEQ ID NO: 46791 - protein, 10 aa, Mycobacterium tuberculosis
EDEARRMWAS

SEQ ID NO: 46792 - protein, 10 aa, Mycobacterium tuberculosis
DEARRMWASA

SEQ ID NO: 46793 - protein, 10 aa, Mycobacterium tuberculosis
EARRMWASAQ

SEQ ID NO: 46794 - protein, 10 aa, Mycobacterium tuberculosis
ARRMWASAQN

SEQ ID NO: 46795 - protein, 10 aa, Mycobacterium tuberculosis
RRMWASAQNI

SEQ ID NO: 46796 - protein, 10 aa, Mycobacterium tuberculosis
RMWASAQNIS

SEQ ID NO: 46797 - protein, 10 aa, Mycobacterium tuberculosis
MWASAQNISG

SEQ ID NO: 46798 - protein, 10 aa, Mycobacterium tuberculosis
WASAQNISGA

SEQ ID NO: 46799 - protein, 10 aa, Mycobacterium tuberculosis
ASAQNISGAG

SEQ ID NO: 46800 - protein, 10 aa, Mycobacterium tuberculosis
SAQNISGAGW

SEQ ID NO: 46801 - protein, 10 aa, Mycobacterium tuberculosis
AQNISGAGWS

SEQ ID NO: 46802 - protein, 10 aa, Mycobacterium tuberculosis
QNISGAGWSG

SEQ ID NO: 46803 - protein, 10 aa, Mycobacterium tuberculosis
NISGAGWSGM

SEQ ID NO: 46804 - protein, 10 aa, Mycobacterium tuberculosis
ISGAGWSGMA

SEQ ID NO: 46805 - protein, 10 aa, Mycobacterium tuberculosis
SGAGWSGMAE

SEQ ID NO: 46806 - protein, 10 aa, Mycobacterium tuberculosis
GAGWSGMAEA

SEQ ID NO: 46807 - protein, 10 aa, Mycobacterium tuberculosis
AGWSGMAEAT

SEQ ID NO: 46808 - protein, 10 aa, Mycobacterium tuberculosis
GWSGMAEATS

SEQ ID NO: 46809 - protein, 10 aa, Mycobacterium tuberculosis
WSGMAEATSL

SEQ ID NO: 46810 - protein, 10 aa, Mycobacterium tuberculosis
SGMAEATSLD

SEQ ID NO: 46811 - protein, 10 aa, Mycobacterium tuberculosis
GMAEATSLDT

SEQ ID NO: 46812 - protein, 10 aa, Mycobacterium tuberculosis
MAEATSLDTM

SEQ ID NO: 46813 - protein, 10 aa, Mycobacterium tuberculosis
AEATSLDTMT

SEQ ID NO: 46814 - protein, 10 aa, Mycobacterium tuberculosis
EATSLDTMTQ

SEQ ID NO: 46815 - protein, 10 aa, Mycobacterium tuberculosis
ATSLDTMTQM

SEQ ID NO: 46816 - protein, 10 aa, Mycobacterium tuberculosis
TSLDTMTQMN

SEQ ID NO: 46817 - protein, 10 aa, Mycobacterium tuberculosis
SLDTMTQMNQ

SEQ ID NO: 46818 - protein, 10 aa, Mycobacterium tuberculosis
LDTMTQMNQA

SEQ ID NO: 46819 - protein, 10 aa, Mycobacterium tuberculosis
DTMTQMNQAF

SEQ ID NO: 46820 - protein, 10 aa, Mycobacterium tuberculosis
TMTQMNQAFR

SEQ ID NO: 46821 - protein, 10 aa, Mycobacterium tuberculosis
MTQMNQAFRN

SEQ ID NO: 46822 - protein, 10 aa, Mycobacterium tuberculosis
TQMNQAFRNI

SEQ ID NO: 46823 - protein, 10 aa, Mycobacterium tuberculosis
QMNQAFRNIV

SEQ ID NO: 46824 - protein, 10 aa, Mycobacterium tuberculosis
MNQAFRNIVN

SEQ ID NO: 46825 - protein, 10 aa, Mycobacterium tuberculosis
NQAFRNIVNM

SEQ ID NO: 46826 - protein, 10 aa, Mycobacterium tuberculosis
QAFRNIVNML

SEQ ID NO: 46827 - protein, 10 aa, Mycobacterium tuberculosis
AFRNIVNMLH

SEQ ID NO: 46828 - protein, 10 aa, Mycobacterium tuberculosis
FRNIVNMLHG

SEQ ID NO: 46829 - protein, 10 aa, Mycobacterium tuberculosis
RNIVNMLHGV

SEQ ID NO: 46830 - protein, 10 aa, Mycobacterium tuberculosis
NIVNMLHGVR

SEQ ID NO: 46831 - protein, 10 aa, Mycobacterium tuberculosis
IVNMLHGVRD

SEQ ID NO: 46832 - protein, 10 aa, Mycobacterium tuberculosis
VNMLHGVRDG

SEQ ID NO: 46833 - protein, 10 aa, Mycobacterium tuberculosis
NMLHGVRDGL

SEQ ID NO: 46834 - protein, 10 aa, Mycobacterium tuberculosis
MLHGVRDGLV

SEQ ID NO: 46835 - protein, 10 aa, Mycobacterium tuberculosis
LHGVRDGLVR

SEQ ID NO: 46836 - protein, 10 aa, Mycobacterium tuberculosis
HGVRDGLVRD

SEQ ID NO: 46837 - protein, 10 aa, Mycobacterium tuberculosis
GVRDGLVRDA

SEQ ID NO: 46838 - protein, 10 aa, Mycobacterium tuberculosis
VRDGLVRDAN

SEQ ID NO: 46839 - protein, 10 aa, Mycobacterium tuberculosis
RDGLVRDANN

SEQ ID NO: 46840 - protein, 10 aa, Mycobacterium tuberculosis
DGLVRDANNY

SEQ ID NO: 46841 - protein, 10 aa, Mycobacterium tuberculosis
GLVRDANNYE

SEQ ID NO: 46842 - protein, 10 aa, Mycobacterium tuberculosis
LVRDANNYEQ

SEQ ID NO: 46843 - protein, 10 aa, Mycobacterium tuberculosis
VRDANNYEQQ

SEQ ID NO: 46844 - protein, 10 aa, Mycobacterium tuberculosis
RDANNYEQQE

SEQ ID NO: 46845 - protein, 10 aa, Mycobacterium tuberculosis
DANNYEQQEQ

SEQ ID NO: 46846 - protein, 10 aa, Mycobacterium tuberculosis
ANNYEQQEQA

SEQ ID NO: 46847 - protein, 10 aa, Mycobacterium tuberculosis
NNYEQQEQAS

SEQ ID NO: 46848 - protein, 10 aa, Mycobacterium tuberculosis
NYEQQEQASQ

SEQ ID NO: 46849 - protein, 10 aa, Mycobacterium tuberculosis
YEQQEQASQQ

SEQ ID NO: 46850 - protein, 10 aa, Mycobacterium tuberculosis
EQQEQASQQI

SEQ ID NO: 46851 - protein, 10 aa, Mycobacterium tuberculosis
QQEQASQQIL

SEQ ID NO: 46852 - protein, 10 aa, Mycobacterium tuberculosis
QEQASQQILS

SEQ ID NO: 46853 - protein, 10 aa, Mycobacterium tuberculosis
EQASQQILSS

SEQ ID NO: 46854 - protein, 11 aa, Mycobacterium tuberculosis
MTSRFMTDPHA

SEQ ID NO: 46855 - protein, 11 aa, Mycobacterium tuberculosis
TSRFMTDPHAM

SEQ ID NO: 46856 - protein, 11 aa, Mycobacterium tuberculosis
SRFMTDPHAMR

SEQ ID NO: 46857 - protein, 11 aa, Mycobacterium tuberculosis
RFMTDPHAMRD

SEQ ID NO: 46858 - protein, 11 aa, Mycobacterium tuberculosis
FMTDPHAMRDM

SEQ ID NO: 46859 - protein, 11 aa, Mycobacterium tuberculosis
MTDPHAMRDMA

SEQ ID NO: 46860 - protein, 11 aa, Mycobacterium tuberculosis
TDPHAMRDMAG

SEQ ID NO: 46861 - protein, 11 aa, Mycobacterium tuberculosis
DPHAMRDMAGR

SEQ ID NO: 46862 - protein, 11 aa, Mycobacterium tuberculosis
PHAMRDMAGRF

SEQ ID NO: 46863 - protein, 11 aa, Mycobacterium tuberculosis
HAMRDMAGRFE

SEQ ID NO: 46864 - protein, 11 aa, Mycobacterium tuberculosis
AMRDMAGRFEV

SEQ ID NO: 46865 - protein, 11 aa, Mycobacterium tuberculosis
MRDMAGRFEVH

SEQ ID NO: 46866 - protein, 11 aa, Mycobacterium tuberculosis
RDMAGRFEVHA

SEQ ID NO: 46867 - protein, 11 aa, Mycobacterium tuberculosis
DMAGRFEVHAQ

SEQ ID NO: 46868 - protein, 11 aa, Mycobacterium tuberculosis
MAGRFEVHAQT

SEQ ID NO: 46869 - protein, 11 aa, Mycobacterium tuberculosis
AGRFEVHAQTV

SEQ ID NO: 46870 - protein, 11 aa, Mycobacterium tuberculosis
GRFEVHAQTVE

SEQ ID NO: 46871 - protein, 11 aa, Mycobacterium tuberculosis
RFEVHAQTVED

SEQ ID NO: 46872 - protein, 11 aa, Mycobacterium tuberculosis
FEVHAQTVEDE

SEQ ID NO: 46873 - protein, 11 aa, Mycobacterium tuberculosis
EVHAQTVEDEA

SEQ ID NO: 46874 - protein, 11 aa, Mycobacterium tuberculosis
VHAQTVEDEAR

SEQ ID NO: 46875 - protein, 11 aa, Mycobacterium tuberculosis
HAQTVEDEARR

SEQ ID NO: 46876 - protein, 11 aa, Mycobacterium tuberculosis
AQTVEDEARRM

SEQ ID NO: 46877 - protein, 11 aa, Mycobacterium tuberculosis
QTVEDEARRMW

SEQ ID NO: 46878 - protein, 11 aa, Mycobacterium tuberculosis
TVEDEARRMWA

SEQ ID NO: 46879 - protein, 11 aa, Mycobacterium tuberculosis
VEDEARRMWAS

SEQ ID NO: 46880 - protein, 11 aa, Mycobacterium tuberculosis
EDEARRMWASA

SEQ ID NO: 46881 - protein, 11 aa, Mycobacterium tuberculosis
DEARRMWASAQ

SEQ ID NO: 46882 - protein, 11 aa, Mycobacterium tuberculosis
EARRMWASAQN

SEQ ID NO: 46883 - protein, 11 aa, Mycobacterium tuberculosis
ARRMWASAQNI

SEQ ID NO: 46884 - protein, 11 aa, Mycobacterium tuberculosis
RRMWASAQNIS

SEQ ID NO: 46885 - protein, 11 aa, Mycobacterium tuberculosis
RMWASAQNISG

SEQ ID NO: 46886 - protein, 11 aa, Mycobacterium tuberculosis
MWASAQNISGA

SEQ ID NO: 46887 - protein, 11 aa, Mycobacterium tuberculosis
WASAQNISGAG

SEQ ID NO: 46888 - protein, 11 aa, Mycobacterium tuberculosis
ASAQNISGAGW

SEQ ID NO: 46889 - protein, 11 aa, Mycobacterium tuberculosis
SAQNISGAGWS

SEQ ID NO: 46890 - protein, 11 aa, Mycobacterium tuberculosis
AQNISGAGWSG

SEQ ID NO: 46891 - protein, 11 aa, Mycobacterium tuberculosis
QNISGAGWSGM

SEQ ID NO: 46892 - protein, 11 aa, Mycobacterium tuberculosis
NISGAGWSGMA

SEQ ID NO: 46893 - protein, 11 aa, Mycobacterium tuberculosis
ISGAGWSGMAE

SEQ ID NO: 46894 - protein, 11 aa, Mycobacterium tuberculosis
SGAGWSGMAEA

SEQ ID NO: 46895 - protein, 11 aa, Mycobacterium tuberculosis
GAGWSGMAEAT

SEQ ID NO: 46896 - protein, 11 aa, Mycobacterium tuberculosis
AGWSGMAEATS

SEQ ID NO: 46897 - protein, 11 aa, Mycobacterium tuberculosis
GWSGMAEATSL

SEQ ID NO: 46898 - protein, 11 aa, Mycobacterium tuberculosis
WSGMAEATSLD

SEQ ID NO: 46899 - protein, 11 aa, Mycobacterium tuberculosis
SGMAEATSLDT

SEQ ID NO: 46900 - protein, 11 aa, Mycobacterium tuberculosis
GMAEATSLDTM

SEQ ID NO: 46901 - protein, 11 aa, Mycobacterium tuberculosis
MAEATSLDTMT

SEQ ID NO: 46902 - protein, 11 aa, Mycobacterium tuberculosis
AEATSLDTMTQ

SEQ ID NO: 46903 - protein, 11 aa, Mycobacterium tuberculosis
EATSLDTMTQM

SEQ ID NO: 46904 - protein, 11 aa, Mycobacterium tuberculosis
ATSLDTMTQMN

SEQ ID NO: 46905 - protein, 11 aa, Mycobacterium tuberculosis
TSLDTMTQMNQ

SEQ ID NO: 46906 - protein, 11 aa, Mycobacterium tuberculosis
SLDTMTQMNQA

SEQ ID NO: 46907 - protein, 11 aa, Mycobacterium tuberculosis
LDTMTQMNQAF

SEQ ID NO: 46908 - protein, 11 aa, Mycobacterium tuberculosis
DTMTQMNQAFR

SEQ ID NO: 46909 - protein, 11 aa, Mycobacterium tuberculosis
TMTQMNQAFRN

SEQ ID NO: 46910 - protein, 11 aa, Mycobacterium tuberculosis
MTQMNQAFRNI

SEQ ID NO: 46911 - protein, 11 aa, Mycobacterium tuberculosis
TQMNQAFRNIV

SEQ ID NO: 46912 - protein, 11 aa, Mycobacterium tuberculosis
QMNQAFRNIVN

SEQ ID NO: 46913 - protein, 11 aa, Mycobacterium tuberculosis
MNQAFRNIVNM

SEQ ID NO: 46914 - protein, 11 aa, Mycobacterium tuberculosis
NQAFRNIVNML

SEQ ID NO: 46915 - protein, 11 aa, Mycobacterium tuberculosis
QAFRNIVNMLH

SEQ ID NO: 46916 - protein, 11 aa, Mycobacterium tuberculosis
AFRNIVNMLHG

SEQ ID NO: 46917 - protein, 11 aa, Mycobacterium tuberculosis
FRNIVNMLHGV

SEQ ID NO: 46918 - protein, 11 aa, Mycobacterium tuberculosis
RNIVNMLHGVR

SEQ ID NO: 46919 - protein, 11 aa, Mycobacterium tuberculosis
NIVNMLHGVRD

SEQ ID NO: 46920 - protein, 11 aa, Mycobacterium tuberculosis
IVNMLHGVRDG

SEQ ID NO: 46921 - protein, 11 aa, Mycobacterium tuberculosis
VNMLHGVRDGL

SEQ ID NO: 46922 - protein, 11 aa, Mycobacterium tuberculosis
NMLHGVRDGLV

SEQ ID NO: 46923 - protein, 11 aa, Mycobacterium tuberculosis
MLHGVRDGLVR

SEQ ID NO: 46924 - protein, 11 aa, Mycobacterium tuberculosis
LHGVRDGLVRD

SEQ ID NO: 46925 - protein, 11 aa, Mycobacterium tuberculosis
HGVRDGLVRDA

SEQ ID NO: 46926 - protein, 11 aa, Mycobacterium tuberculosis
GVRDGLVRDAN

SEQ ID NO: 46927 - protein, 11 aa, Mycobacterium tuberculosis
VRDGLVRDANN

SEQ ID NO: 46928 - protein, 11 aa, Mycobacterium tuberculosis
RDGLVRDANNY

SEQ ID NO: 46929 - protein, 11 aa, Mycobacterium tuberculosis
DGLVRDANNYE

SEQ ID NO: 46930 - protein, 11 aa, Mycobacterium tuberculosis
GLVRDANNYEQ

SEQ ID NO: 46931 - protein, 11 aa, Mycobacterium tuberculosis
LVRDANNYEQQ

SEQ ID NO: 46932 - protein, 11 aa, Mycobacterium tuberculosis
VRDANNYEQQE

SEQ ID NO: 46933 - protein, 11 aa, Mycobacterium tuberculosis
RDANNYEQQEQ

SEQ ID NO: 46934 - protein, 11 aa, Mycobacterium tuberculosis
DANNYEQQEQA

SEQ ID NO: 46935 - protein, 11 aa, Mycobacterium tuberculosis
ANNYEQQEQAS

SEQ ID NO: 46936 - protein, 11 aa, Mycobacterium tuberculosis
NNYEQQEQASQ

SEQ ID NO: 46937 - protein, 11 aa, Mycobacterium tuberculosis
NYEQQEQASQQ

SEQ ID NO: 46938 - protein, 11 aa, Mycobacterium tuberculosis
YEQQEQASQQI

SEQ ID NO: 46939 - protein, 11 aa, Mycobacterium tuberculosis
EQQEQASQQIL

SEQ ID NO: 46940 - protein, 11 aa, Mycobacterium tuberculosis
QQEQASQQILS

SEQ ID NO: 46941 - protein, 11 aa, Mycobacterium tuberculosis
QEQASQQILSS

SEQ ID NO: 46942 - protein, 8 aa, Mycobacterium tuberculosis
MFTLLVSW

SEQ ID NO: 46943 - protein, 8 aa, Mycobacterium tuberculosis
FTLLVSWL

SEQ ID NO: 46944 - protein, 8 aa, Mycobacterium tuberculosis
TLLVSWLL

SEQ ID NO: 46945 - protein, 8 aa, Mycobacterium tuberculosis
LLVSWLLV

SEQ ID NO: 46946 - protein, 8 aa, Mycobacterium tuberculosis
LVSWLLVA

SEQ ID NO: 46947 - protein, 8 aa, Mycobacterium tuberculosis
VSWLLVAC

SEQ ID NO: 46948 - protein, 8 aa, Mycobacterium tuberculosis
SWLLVACV

SEQ ID NO: 46949 - protein, 8 aa, Mycobacterium tuberculosis
WLLVACVP

SEQ ID NO: 46950 - protein, 8 aa, Mycobacterium tuberculosis
LLVACVPG

SEQ ID NO: 46951 - protein, 8 aa, Mycobacterium tuberculosis
LVACVPGL

SEQ ID NO: 46952 - protein, 8 aa, Mycobacterium tuberculosis
VACVPGLL

SEQ ID NO: 46953 - protein, 8 aa, Mycobacterium tuberculosis
ACVPGLLM

SEQ ID NO: 46954 - protein, 8 aa, Mycobacterium tuberculosis
CVPGLLML

SEQ ID NO: 46955 - protein, 8 aa, Mycobacterium tuberculosis
VPGLLMLA

SEQ ID NO: 46956 - protein, 8 aa, Mycobacterium tuberculosis
PGLLMLAT

SEQ ID NO: 46957 - protein, 8 aa, Mycobacterium tuberculosis
GLLMLATL

SEQ ID NO: 46958 - protein, 8 aa, Mycobacterium tuberculosis
LLMLATLG

SEQ ID NO: 46959 - protein, 8 aa, Mycobacterium tuberculosis
LMLATLGL

SEQ ID NO: 46960 - protein, 8 aa, Mycobacterium tuberculosis
MLATLGLG

SEQ ID NO: 46961 - protein, 8 aa, Mycobacterium tuberculosis
LATLGLGR

SEQ ID NO: 46962 - protein, 8 aa, Mycobacterium tuberculosis
ATLGLGRL

SEQ ID NO: 46963 - protein, 8 aa, Mycobacterium tuberculosis
TLGLGRLE

SEQ ID NO: 46964 - protein, 8 aa, Mycobacterium tuberculosis
LGLGRLER

SEQ ID NO: 46965 - protein, 8 aa, Mycobacterium tuberculosis
GLGRLERF

SEQ ID NO: 46966 - protein, 8 aa, Mycobacterium tuberculosis
LGRLERFL

SEQ ID NO: 46967 - protein, 8 aa, Mycobacterium tuberculosis
GRLERFLA

SEQ ID NO: 46968 - protein, 8 aa, Mycobacterium tuberculosis
RLERFLAR

SEQ ID NO: 46969 - protein, 8 aa, Mycobacterium tuberculosis
LERFLARD

SEQ ID NO: 46970 - protein, 8 aa, Mycobacterium tuberculosis
ERFLARDT

SEQ ID NO: 46971 - protein, 8 aa, Mycobacterium tuberculosis
RFLARDTV

SEQ ID NO: 46972 - protein, 8 aa, Mycobacterium tuberculosis
FLARDTVT

SEQ ID NO: 46973 - protein, 8 aa, Mycobacterium tuberculosis
LARDTVTA

SEQ ID NO: 46974 - protein, 8 aa, Mycobacterium tuberculosis
ARDTVTAT

SEQ ID NO: 46975 - protein, 8 aa, Mycobacterium tuberculosis
RDTVTATD

SEQ ID NO: 46976 - protein, 8 aa, Mycobacterium tuberculosis
DTVTATDV

SEQ ID NO: 46977 - protein, 8 aa, Mycobacterium tuberculosis
TVTATDVA

SEQ ID NO: 46978 - protein, 8 aa, Mycobacterium tuberculosis
VTATDVAE

SEQ ID NO: 46979 - protein, 8 aa, Mycobacterium tuberculosis
TATDVAEF

SEQ ID NO: 46980 - protein, 8 aa, Mycobacterium tuberculosis
ATDVAEFL

SEQ ID NO: 46981 - protein, 8 aa, Mycobacterium tuberculosis
TDVAEFLE

SEQ ID NO: 46982 - protein, 8 aa, Mycobacterium tuberculosis
DVAEFLEQ

SEQ ID NO: 46983 - protein, 8 aa, Mycobacterium tuberculosis
VAEFLEQA

SEQ ID NO: 46984 - protein, 8 aa, Mycobacterium tuberculosis
AEFLEQAE

SEQ ID NO: 46985 - protein, 8 aa, Mycobacterium tuberculosis
EFLEQAEA

SEQ ID NO: 46986 - protein, 8 aa, Mycobacterium tuberculosis
FLEQAEAV

SEQ ID NO: 46987 - protein, 8 aa, Mycobacterium tuberculosis
LEQAEAVD

SEQ ID NO: 46988 - protein, 8 aa, Mycobacterium tuberculosis
EQAEAVDV

SEQ ID NO: 46989 - protein, 8 aa, Mycobacterium tuberculosis
QAEAVDVH

SEQ ID NO: 46990 - protein, 8 aa, Mycobacterium tuberculosis
AEAVDVHT

SEQ ID NO: 46991 - protein, 8 aa, Mycobacterium tuberculosis
EAVDVHTL

SEQ ID NO: 46992 - protein, 8 aa, Mycobacterium tuberculosis
AVDVHTLA

SEQ ID NO: 46993 - protein, 8 aa, Mycobacterium tuberculosis
VDVHTLAR

SEQ ID NO: 46994 - protein, 8 aa, Mycobacterium tuberculosis
DVHTLARN

SEQ ID NO: 46995 - protein, 8 aa, Mycobacterium tuberculosis
VHTLARNG

SEQ ID NO: 46996 - protein, 8 aa, Mycobacterium tuberculosis
HTLARNGM

SEQ ID NO: 46997 - protein, 8 aa, Mycobacterium tuberculosis
TLARNGMP

SEQ ID NO: 46998 - protein, 8 aa, Mycobacterium tuberculosis
LARNGMPE

SEQ ID NO: 46999 - protein, 8 aa, Mycobacterium tuberculosis
ARNGMPEA

SEQ ID NO: 47000 - protein, 8 aa, Mycobacterium tuberculosis
RNGMPEAL

SEQ ID NO: 47001 - protein, 8 aa, Mycobacterium tuberculosis
NGMPEALD

SEQ ID NO: 47002 - protein, 8 aa, Mycobacterium tuberculosis
GMPEALDY

SEQ ID NO: 47003 - protein, 8 aa, Mycobacterium tuberculosis
MPEALDYL

SEQ ID NO: 47004 - protein, 8 aa, Mycobacterium tuberculosis
PEALDYLH

SEQ ID NO: 47005 - protein, 8 aa, Mycobacterium tuberculosis
EALDYLHR

SEQ ID NO: 47006 - protein, 8 aa, Mycobacterium tuberculosis
ALDYLHRR

SEQ ID NO: 47007 - protein, 8 aa, Mycobacterium tuberculosis
LDYLHRRQ

SEQ ID NO: 47008 - protein, 8 aa, Mycobacterium tuberculosis
DYLHRRQA

SEQ ID NO: 47009 - protein, 8 aa, Mycobacterium tuberculosis
YLHRRQAR

SEQ ID NO: 47010 - protein, 8 aa, Mycobacterium tuberculosis
LHRRQARR

SEQ ID NO: 47011 - protein, 8 aa, Mycobacterium tuberculosis
HRRQARRI

SEQ ID NO: 47012 - protein, 8 aa, Mycobacterium tuberculosis
RRQARRIT

SEQ ID NO: 47013 - protein, 8 aa, Mycobacterium tuberculosis
RQARRITD

SEQ ID NO: 47014 - protein, 8 aa, Mycobacterium tuberculosis
QARRITDS

SEQ ID NO: 47015 - protein, 8 aa, Mycobacterium tuberculosis
ARRITDSP

SEQ ID NO: 47016 - protein, 8 aa, Mycobacterium tuberculosis
RRITDSPP

SEQ ID NO: 47017 - protein, 8 aa, Mycobacterium tuberculosis
RITDSPPL

SEQ ID NO: 47018 - protein, 8 aa, Mycobacterium tuberculosis
ITDSPPLG

SEQ ID NO: 47019 - protein, 8 aa, Mycobacterium tuberculosis
TDSPPLGS

SEQ ID NO: 47020 - protein, 8 aa, Mycobacterium tuberculosis
DSPPLGSG

SEQ ID NO: 47021 - protein, 8 aa, Mycobacterium tuberculosis
SPPLGSGA

SEQ ID NO: 47022 - protein, 8 aa, Mycobacterium tuberculosis
PPLGSGAG

SEQ ID NO: 47023 - protein, 8 aa, Mycobacterium tuberculosis
PLGSGAGP

SEQ ID NO: 47024 - protein, 8 aa, Mycobacterium tuberculosis
LGSGAGPR

SEQ ID NO: 47025 - protein, 8 aa, Mycobacterium tuberculosis
GSGAGPRY

SEQ ID NO: 47026 - protein, 8 aa, Mycobacterium tuberculosis
SGAGPRYA

SEQ ID NO: 47027 - protein, 8 aa, Mycobacterium tuberculosis
GAGPRYAG

SEQ ID NO: 47028 - protein, 8 aa, Mycobacterium tuberculosis
AGPRYAGP

SEQ ID NO: 47029 - protein, 8 aa, Mycobacterium tuberculosis
GPRYAGPL

SEQ ID NO: 47030 - protein, 8 aa, Mycobacterium tuberculosis
PRYAGPLF

SEQ ID NO: 47031 - protein, 8 aa, Mycobacterium tuberculosis
RYAGPLFV

SEQ ID NO: 47032 - protein, 8 aa, Mycobacterium tuberculosis
YAGPLFVT

SEQ ID NO: 47033 - protein, 8 aa, Mycobacterium tuberculosis
AGPLFVTD

SEQ ID NO: 47034 - protein, 8 aa, Mycobacterium tuberculosis
GPLFVTDL

SEQ ID NO: 47035 - protein, 8 aa, Mycobacterium tuberculosis
PLFVTDLD

SEQ ID NO: 47036 - protein, 8 aa, Mycobacterium tuberculosis
LFVTDLDS

SEQ ID NO: 47037 - protein, 8 aa, Mycobacterium tuberculosis
FVTDLDSP

SEQ ID NO: 47038 - protein, 8 aa, Mycobacterium tuberculosis
VTDLDSPV

SEQ ID NO: 47039 - protein, 8 aa, Mycobacterium tuberculosis
TDLDSPVE

SEQ ID NO: 47040 - protein, 8 aa, Mycobacterium tuberculosis
DLDSPVEP

SEQ ID NO: 47041 - protein, 8 aa, Mycobacterium tuberculosis
LDSPVEPP

SEQ ID NO: 47042 - protein, 8 aa, Mycobacterium tuberculosis
DSPVEPPR

SEQ ID NO: 47043 - protein, 8 aa, Mycobacterium tuberculosis
SPVEPPRH

SEQ ID NO: 47044 - protein, 8 aa, Mycobacterium tuberculosis
PVEPPRHG

SEQ ID NO: 47045 - protein, 8 aa, Mycobacterium tuberculosis
VEPPRHGQ

SEQ ID NO: 47046 - protein, 8 aa, Mycobacterium tuberculosis
EPPRHGQP

SEQ ID NO: 47047 - protein, 8 aa, Mycobacterium tuberculosis
PPRHGQPN

SEQ ID NO: 47048 - protein, 8 aa, Mycobacterium tuberculosis
PRHGQPNP

SEQ ID NO: 47049 - protein, 8 aa, Mycobacterium tuberculosis
RHGQPNPQ

SEQ ID NO: 47050 - protein, 8 aa, Mycobacterium tuberculosis
HGQPNPQF

SEQ ID NO: 47051 - protein, 8 aa, Mycobacterium tuberculosis
GQPNPQFR

SEQ ID NO: 47052 - protein, 8 aa, Mycobacterium tuberculosis
QPNPQFRT

SEQ ID NO: 47053 - protein, 8 aa, Mycobacterium tuberculosis
PNPQFRTA

SEQ ID NO: 47054 - protein, 8 aa, Mycobacterium tuberculosis
NPQFRTAR

SEQ ID NO: 47055 - protein, 8 aa, Mycobacterium tuberculosis
PQFRTARH

SEQ ID NO: 47056 - protein, 8 aa, Mycobacterium tuberculosis
QFRTARHA

SEQ ID NO: 47057 - protein, 8 aa, Mycobacterium tuberculosis
FRTARHAN

SEQ ID NO: 47058 - protein, 8 aa, Mycobacterium tuberculosis
RTARHANH

SEQ ID NO: 47059 - protein, 8 aa, Mycobacterium tuberculosis
TARHANHV

SEQ ID NO: 47060 - protein, 9 aa, Mycobacterium tuberculosis
MFTLLVSWL

SEQ ID NO: 47061 - protein, 9 aa, Mycobacterium tuberculosis
FTLLVSWLL

SEQ ID NO: 47062 - protein, 9 aa, Mycobacterium tuberculosis
TLLVSWLLV

SEQ ID NO: 47063 - protein, 9 aa, Mycobacterium tuberculosis
LLVSWLLVA

SEQ ID NO: 47064 - protein, 9 aa, Mycobacterium tuberculosis
LVSWLLVAC

SEQ ID NO: 47065 - protein, 9 aa, Mycobacterium tuberculosis
VSWLLVACV

SEQ ID NO: 47066 - protein, 9 aa, Mycobacterium tuberculosis
SWLLVACVP

SEQ ID NO: 47067 - protein, 9 aa, Mycobacterium tuberculosis
WLLVACVPG

SEQ ID NO: 47068 - protein, 9 aa, Mycobacterium tuberculosis
LLVACVPGL

SEQ ID NO: 47069 - protein, 9 aa, Mycobacterium tuberculosis
LVACVPGLL

SEQ ID NO: 47070 - protein, 9 aa, Mycobacterium tuberculosis
VACVPGLLM

SEQ ID NO: 47071 - protein, 9 aa, Mycobacterium tuberculosis
ACVPGLLML

SEQ ID NO: 47072 - protein, 9 aa, Mycobacterium tuberculosis
CVPGLLMLA

SEQ ID NO: 47073 - protein, 9 aa, Mycobacterium tuberculosis
VPGLLMLAT

SEQ ID NO: 47074 - protein, 9 aa, Mycobacterium tuberculosis
PGLLMLATL

SEQ ID NO: 47075 - protein, 9 aa, Mycobacterium tuberculosis
GLLMLATLG

SEQ ID NO: 47076 - protein, 9 aa, Mycobacterium tuberculosis
LLMLATLGL

SEQ ID NO: 47077 - protein, 9 aa, Mycobacterium tuberculosis
LMLATLGLG

SEQ ID NO: 47078 - protein, 9 aa, Mycobacterium tuberculosis
MLATLGLGR

SEQ ID NO: 47079 - protein, 9 aa, Mycobacterium tuberculosis
LATLGLGRL

SEQ ID NO: 47080 - protein, 9 aa, Mycobacterium tuberculosis
ATLGLGRLE

SEQ ID NO: 47081 - protein, 9 aa, Mycobacterium tuberculosis
TLGLGRLER

SEQ ID NO: 47082 - protein, 9 aa, Mycobacterium tuberculosis
LGLGRLERF

SEQ ID NO: 47083 - protein, 9 aa, Mycobacterium tuberculosis
GLGRLERFL

SEQ ID NO: 47084 - protein, 9 aa, Mycobacterium tuberculosis
LGRLERFLA

SEQ ID NO: 47085 - protein, 9 aa, Mycobacterium tuberculosis
GRLERFLAR

SEQ ID NO: 47086 - protein, 9 aa, Mycobacterium tuberculosis
RLERFLARD

SEQ ID NO: 47087 - protein, 9 aa, Mycobacterium tuberculosis
LERFLARDT

SEQ ID NO: 47088 - protein, 9 aa, Mycobacterium tuberculosis
ERFLARDTV

SEQ ID NO: 47089 - protein, 9 aa, Mycobacterium tuberculosis
RFLARDTVT

SEQ ID NO: 47090 - protein, 9 aa, Mycobacterium tuberculosis
FLARDTVTA

SEQ ID NO: 47091 - protein, 9 aa, Mycobacterium tuberculosis
LARDTVTAT

SEQ ID NO: 47092 - protein, 9 aa, Mycobacterium tuberculosis
ARDTVTATD

SEQ ID NO: 47093 - protein, 9 aa, Mycobacterium tuberculosis
RDTVTATDV

SEQ ID NO: 47094 - protein, 9 aa, Mycobacterium tuberculosis
DTVTATDVA

SEQ ID NO: 47095 - protein, 9 aa, Mycobacterium tuberculosis
TVTATDVAE

SEQ ID NO: 47096 - protein, 9 aa, Mycobacterium tuberculosis
VTATDVAEF

SEQ ID NO: 47097 - protein, 9 aa, Mycobacterium tuberculosis
TATDVAEFL

SEQ ID NO: 47098 - protein, 9 aa, Mycobacterium tuberculosis
ATDVAEFLE

SEQ ID NO: 47099 - protein, 9 aa, Mycobacterium tuberculosis
TDVAEFLEQ

SEQ ID NO: 47100 - protein, 9 aa, Mycobacterium tuberculosis
DVAEFLEQA

SEQ ID NO: 47101 - protein, 9 aa, Mycobacterium tuberculosis
VAEFLEQAE

SEQ ID NO: 47102 - protein, 9 aa, Mycobacterium tuberculosis
AEFLEQAEA

SEQ ID NO: 47103 - protein, 9 aa, Mycobacterium tuberculosis
EFLEQAEAV

SEQ ID NO: 47104 - protein, 9 aa, Mycobacterium tuberculosis
FLEQAEAVD

SEQ ID NO: 47105 - protein, 9 aa, Mycobacterium tuberculosis
LEQAEAVDV

SEQ ID NO: 47106 - protein, 9 aa, Mycobacterium tuberculosis
EQAEAVDVH

SEQ ID NO: 47107 - protein, 9 aa, Mycobacterium tuberculosis
QAEAVDVHT

SEQ ID NO: 47108 - protein, 9 aa, Mycobacterium tuberculosis
AEAVDVHTL

SEQ ID NO: 47109 - protein, 9 aa, Mycobacterium tuberculosis
EAVDVHTLA

SEQ ID NO: 47110 - protein, 9 aa, Mycobacterium tuberculosis
AVDVHTLAR

SEQ ID NO: 47111 - protein, 9 aa, Mycobacterium tuberculosis
VDVHTLARN

SEQ ID NO: 47112 - protein, 9 aa, Mycobacterium tuberculosis
DVHTLARNG

SEQ ID NO: 47113 - protein, 9 aa, Mycobacterium tuberculosis
VHTLARNGM

SEQ ID NO: 47114 - protein, 9 aa, Mycobacterium tuberculosis
HTLARNGMP

SEQ ID NO: 47115 - protein, 9 aa, Mycobacterium tuberculosis
TLARNGMPE

SEQ ID NO: 47116 - protein, 9 aa, Mycobacterium tuberculosis
LARNGMPEA

SEQ ID NO: 47117 - protein, 9 aa, Mycobacterium tuberculosis
ARNGMPEAL

SEQ ID NO: 47118 - protein, 9 aa, Mycobacterium tuberculosis
RNGMPEALD

SEQ ID NO: 47119 - protein, 9 aa, Mycobacterium tuberculosis
NGMPEALDY

SEQ ID NO: 47120 - protein, 9 aa, Mycobacterium tuberculosis
GMPEALDYL

SEQ ID NO: 47121 - protein, 9 aa, Mycobacterium tuberculosis
MPEALDYLH

SEQ ID NO: 47122 - protein, 9 aa, Mycobacterium tuberculosis
PEALDYLHR

SEQ ID NO: 47123 - protein, 9 aa, Mycobacterium tuberculosis
EALDYLHRR

SEQ ID NO: 47124 - protein, 9 aa, Mycobacterium tuberculosis
ALDYLHRRQ

SEQ ID NO: 47125 - protein, 9 aa, Mycobacterium tuberculosis
LDYLHRRQA

SEQ ID NO: 47126 - protein, 9 aa, Mycobacterium tuberculosis
DYLHRRQAR

SEQ ID NO: 47127 - protein, 9 aa, Mycobacterium tuberculosis
YLHRRQARR

SEQ ID NO: 47128 - protein, 9 aa, Mycobacterium tuberculosis
LHRRQARRI

SEQ ID NO: 47129 - protein, 9 aa, Mycobacterium tuberculosis
HRRQARRIT

SEQ ID NO: 47130 - protein, 9 aa, Mycobacterium tuberculosis
RRQARRITD

SEQ ID NO: 47131 - protein, 9 aa, Mycobacterium tuberculosis
RQARRITDS

SEQ ID NO: 47132 - protein, 9 aa, Mycobacterium tuberculosis
QARRITDSP

SEQ ID NO: 47133 - protein, 9 aa, Mycobacterium tuberculosis
ARRITDSPP

SEQ ID NO: 47134 - protein, 9 aa, Mycobacterium tuberculosis
RRITDSPPL

SEQ ID NO: 47135 - protein, 9 aa, Mycobacterium tuberculosis
RITDSPPLG

SEQ ID NO: 47136 - protein, 9 aa, Mycobacterium tuberculosis
ITDSPPLGS

SEQ ID NO: 47137 - protein, 9 aa, Mycobacterium tuberculosis
TDSPPLGSG

SEQ ID NO: 47138 - protein, 9 aa, Mycobacterium tuberculosis
DSPPLGSGA

SEQ ID NO: 47139 - protein, 9 aa, Mycobacterium tuberculosis
SPPLGSGAG

SEQ ID NO: 47140 - protein, 9 aa, Mycobacterium tuberculosis
PPLGSGAGP

SEQ ID NO: 47141 - protein, 9 aa, Mycobacterium tuberculosis
PLGSGAGPR

SEQ ID NO: 47142 - protein, 9 aa, Mycobacterium tuberculosis
LGSGAGPRY

SEQ ID NO: 47143 - protein, 9 aa, Mycobacterium tuberculosis
GSGAGPRYA

SEQ ID NO: 47144 - protein, 9 aa, Mycobacterium tuberculosis
SGAGPRYAG

SEQ ID NO: 47145 - protein, 9 aa, Mycobacterium tuberculosis
GAGPRYAGP

SEQ ID NO: 47146 - protein, 9 aa, Mycobacterium tuberculosis
AGPRYAGPL

SEQ ID NO: 47147 - protein, 9 aa, Mycobacterium tuberculosis
GPRYAGPLF

SEQ ID NO: 47148 - protein, 9 aa, Mycobacterium tuberculosis
PRYAGPLFV

SEQ ID NO: 47149 - protein, 9 aa, Mycobacterium tuberculosis
RYAGPLFVT

SEQ ID NO: 47150 - protein, 9 aa, Mycobacterium tuberculosis
YAGPLFVTD

SEQ ID NO: 47151 - protein, 9 aa, Mycobacterium tuberculosis
AGPLFVTDL

SEQ ID NO: 47152 - protein, 9 aa, Mycobacterium tuberculosis
GPLFVTDLD

SEQ ID NO: 47153 - protein, 9 aa, Mycobacterium tuberculosis
PLFVTDLDS

SEQ ID NO: 47154 - protein, 9 aa, Mycobacterium tuberculosis
LFVTDLDSP

SEQ ID NO: 47155 - protein, 9 aa, Mycobacterium tuberculosis
FVTDLDSPV

SEQ ID NO: 47156 - protein, 9 aa, Mycobacterium tuberculosis
VTDLDSPVE

SEQ ID NO: 47157 - protein, 9 aa, Mycobacterium tuberculosis
TDLDSPVEP

SEQ ID NO: 47158 - protein, 9 aa, Mycobacterium tuberculosis
DLDSPVEPP

SEQ ID NO: 47159 - protein, 9 aa, Mycobacterium tuberculosis
LDSPVEPPR

SEQ ID NO: 47160 - protein, 9 aa, Mycobacterium tuberculosis
DSPVEPPRH

SEQ ID NO: 47161 - protein, 9 aa, Mycobacterium tuberculosis
SPVEPPRHG

SEQ ID NO: 47162 - protein, 9 aa, Mycobacterium tuberculosis
PVEPPRHGQ

SEQ ID NO: 47163 - protein, 9 aa, Mycobacterium tuberculosis
VEPPRHGQP

SEQ ID NO: 47164 - protein, 9 aa, Mycobacterium tuberculosis
EPPRHGQPN

SEQ ID NO: 47165 - protein, 9 aa, Mycobacterium tuberculosis
PPRHGQPNP

SEQ ID NO: 47166 - protein, 9 aa, Mycobacterium tuberculosis
PRHGQPNPQ

SEQ ID NO: 47167 - protein, 9 aa, Mycobacterium tuberculosis
RHGQPNPQF

SEQ ID NO: 47168 - protein, 9 aa, Mycobacterium tuberculosis
HGQPNPQFR

SEQ ID NO: 47169 - protein, 9 aa, Mycobacterium tuberculosis
GQPNPQFRT

SEQ ID NO: 47170 - protein, 9 aa, Mycobacterium tuberculosis
QPNPQFRTA

SEQ ID NO: 47171 - protein, 9 aa, Mycobacterium tuberculosis
PNPQFRTAR

SEQ ID NO: 47172 - protein, 9 aa, Mycobacterium tuberculosis
NPQFRTARH

SEQ ID NO: 47173 - protein, 9 aa, Mycobacterium tuberculosis
PQFRTARHA

SEQ ID NO: 47174 - protein, 9 aa, Mycobacterium tuberculosis
QFRTARHAN

SEQ ID NO: 47175 - protein, 9 aa, Mycobacterium tuberculosis
FRTARHANH

SEQ ID NO: 47176 - protein, 9 aa, Mycobacterium tuberculosis
RTARHANHV

SEQ ID NO: 47177 - protein, 10 aa, Mycobacterium tuberculosis
MFTLLVSWLL

SEQ ID NO: 47178 - protein, 10 aa, Mycobacterium tuberculosis
FTLLVSWLLV

SEQ ID NO: 47179 - protein, 10 aa, Mycobacterium tuberculosis
TLLVSWLLVA

SEQ ID NO: 47180 - protein, 10 aa, Mycobacterium tuberculosis
LLVSWLLVAC

SEQ ID NO: 47181 - protein, 10 aa, Mycobacterium tuberculosis
LVSWLLVACV

SEQ ID NO: 47182 - protein, 10 aa, Mycobacterium tuberculosis
VSWLLVACVP

SEQ ID NO: 47183 - protein, 10 aa, Mycobacterium tuberculosis
SWLLVACVPG

SEQ ID NO: 47184 - protein, 10 aa, Mycobacterium tuberculosis
WLLVACVPGL

SEQ ID NO: 47185 - protein, 10 aa, Mycobacterium tuberculosis
LLVACVPGLL

SEQ ID NO: 47186 - protein, 10 aa, Mycobacterium tuberculosis
LVACVPGLLM

SEQ ID NO: 47187 - protein, 10 aa, Mycobacterium tuberculosis
VACVPGLLML

SEQ ID NO: 47188 - protein, 10 aa, Mycobacterium tuberculosis
ACVPGLLMLA

SEQ ID NO: 47189 - protein, 10 aa, Mycobacterium tuberculosis
CVPGLLMLAT

SEQ ID NO: 47190 - protein, 10 aa, Mycobacterium tuberculosis
VPGLLMLATL

SEQ ID NO: 47191 - protein, 10 aa, Mycobacterium tuberculosis
PGLLMLATLG

SEQ ID NO: 47192 - protein, 10 aa, Mycobacterium tuberculosis
GLLMLATLGL

SEQ ID NO: 47193 - protein, 10 aa, Mycobacterium tuberculosis
LLMLATLGLG

SEQ ID NO: 47194 - protein, 10 aa, Mycobacterium tuberculosis
LMLATLGLGR

SEQ ID NO: 47195 - protein, 10 aa, Mycobacterium tuberculosis
MLATLGLGRL

SEQ ID NO: 47196 - protein, 10 aa, Mycobacterium tuberculosis
LATLGLGRLE

SEQ ID NO: 47197 - protein, 10 aa, Mycobacterium tuberculosis
ATLGLGRLER

SEQ ID NO: 47198 - protein, 10 aa, Mycobacterium tuberculosis
TLGLGRLERF

SEQ ID NO: 47199 - protein, 10 aa, Mycobacterium tuberculosis
LGLGRLERFL

SEQ ID NO: 47200 - protein, 10 aa, Mycobacterium tuberculosis
GLGRLERFLA

SEQ ID NO: 47201 - protein, 10 aa, Mycobacterium tuberculosis
LGRLERFLAR

SEQ ID NO: 47202 - protein, 10 aa, Mycobacterium tuberculosis
GRLERFLARD

SEQ ID NO: 47203 - protein, 10 aa, Mycobacterium tuberculosis
RLERFLARDT

SEQ ID NO: 47204 - protein, 10 aa, Mycobacterium tuberculosis
LERFLARDTV

SEQ ID NO: 47205 - protein, 10 aa, Mycobacterium tuberculosis
ERFLARDTVT

SEQ ID NO: 47206 - protein, 10 aa, Mycobacterium tuberculosis
RFLARDTVTA

SEQ ID NO: 47207 - protein, 10 aa, Mycobacterium tuberculosis
FLARDTVTAT

SEQ ID NO: 47208 - protein, 10 aa, Mycobacterium tuberculosis
LARDTVTATD

SEQ ID NO: 47209 - protein, 10 aa, Mycobacterium tuberculosis
ARDTVTATDV

SEQ ID NO: 47210 - protein, 10 aa, Mycobacterium tuberculosis
RDTVTATDVA

SEQ ID NO: 47211 - protein, 10 aa, Mycobacterium tuberculosis
DTVTATDVAE

SEQ ID NO: 47212 - protein, 10 aa, Mycobacterium tuberculosis
TVTATDVAEF

SEQ ID NO: 47213 - protein, 10 aa, Mycobacterium tuberculosis
VTATDVAEFL

SEQ ID NO: 47214 - protein, 10 aa, Mycobacterium tuberculosis
TATDVAEFLE

SEQ ID NO: 47215 - protein, 10 aa, Mycobacterium tuberculosis
ATDVAEFLEQ

SEQ ID NO: 47216 - protein, 10 aa, Mycobacterium tuberculosis
TDVAEFLEQA

SEQ ID NO: 47217 - protein, 10 aa, Mycobacterium tuberculosis
DVAEFLEQAE

SEQ ID NO: 47218 - protein, 10 aa, Mycobacterium tuberculosis
VAEFLEQAEA

SEQ ID NO: 47219 - protein, 10 aa, Mycobacterium tuberculosis
AEFLEQAEAV

SEQ ID NO: 47220 - protein, 10 aa, Mycobacterium tuberculosis
EFLEQAEAVD

SEQ ID NO: 47221 - protein, 10 aa, Mycobacterium tuberculosis
FLEQAEAVDV

SEQ ID NO: 47222 - protein, 10 aa, Mycobacterium tuberculosis
LEQAEAVDVH

SEQ ID NO: 47223 - protein, 10 aa, Mycobacterium tuberculosis
EQAEAVDVHT

SEQ ID NO: 47224 - protein, 10 aa, Mycobacterium tuberculosis
QAEAVDVHTL

SEQ ID NO: 47225 - protein, 10 aa, Mycobacterium tuberculosis
AEAVDVHTLA

SEQ ID NO: 47226 - protein, 10 aa, Mycobacterium tuberculosis
EAVDVHTLAR

SEQ ID NO: 47227 - protein, 10 aa, Mycobacterium tuberculosis
AVDVHTLARN

SEQ ID NO: 47228 - protein, 10 aa, Mycobacterium tuberculosis
VDVHTLARNG

SEQ ID NO: 47229 - protein, 10 aa, Mycobacterium tuberculosis
DVHTLARNGM

SEQ ID NO: 47230 - protein, 10 aa, Mycobacterium tuberculosis
VHTLARNGMP

SEQ ID NO: 47231 - protein, 10 aa, Mycobacterium tuberculosis
HTLARNGMPE

SEQ ID NO: 47232 - protein, 10 aa, Mycobacterium tuberculosis
TLARNGMPEA

SEQ ID NO: 47233 - protein, 10 aa, Mycobacterium tuberculosis
LARNGMPEAL

SEQ ID NO: 47234 - protein, 10 aa, Mycobacterium tuberculosis
ARNGMPEALD

SEQ ID NO: 47235 - protein, 10 aa, Mycobacterium tuberculosis
RNGMPEALDY

SEQ ID NO: 47236 - protein, 10 aa, Mycobacterium tuberculosis
NGMPEALDYL

SEQ ID NO: 47237 - protein, 10 aa, Mycobacterium tuberculosis
GMPEALDYLH

SEQ ID NO: 47238 - protein, 10 aa, Mycobacterium tuberculosis
MPEALDYLHR

SEQ ID NO: 47239 - protein, 10 aa, Mycobacterium tuberculosis
PEALDYLHRR

SEQ ID NO: 47240 - protein, 10 aa, Mycobacterium tuberculosis
EALDYLHRRQ

SEQ ID NO: 47241 - protein, 10 aa, Mycobacterium tuberculosis
ALDYLHRRQA

SEQ ID NO: 47242 - protein, 10 aa, Mycobacterium tuberculosis
LDYLHRRQAR

SEQ ID NO: 47243 - protein, 10 aa, Mycobacterium tuberculosis
DYLHRRQARR

SEQ ID NO: 47244 - protein, 10 aa, Mycobacterium tuberculosis
YLHRRQARRI

SEQ ID NO: 47245 - protein, 10 aa, Mycobacterium tuberculosis
LHRRQARRIT

SEQ ID NO: 47246 - protein, 10 aa, Mycobacterium tuberculosis
HRRQARRITD

SEQ ID NO: 47247 - protein, 10 aa, Mycobacterium tuberculosis
RRQARRITDS

SEQ ID NO: 47248 - protein, 10 aa, Mycobacterium tuberculosis
RQARRITDSP

SEQ ID NO: 47249 - protein, 10 aa, Mycobacterium tuberculosis
QARRITDSPP

SEQ ID NO: 47250 - protein, 10 aa, Mycobacterium tuberculosis
ARRITDSPPL

SEQ ID NO: 47251 - protein, 10 aa, Mycobacterium tuberculosis
RRITDSPPLG

SEQ ID NO: 47252 - protein, 10 aa, Mycobacterium tuberculosis
RITDSPPLGS

SEQ ID NO: 47253 - protein, 10 aa, Mycobacterium tuberculosis
ITDSPPLGSG

SEQ ID NO: 47254 - protein, 10 aa, Mycobacterium tuberculosis
TDSPPLGSGA

SEQ ID NO: 47255 - protein, 10 aa, Mycobacterium tuberculosis
DSPPLGSGAG

SEQ ID NO: 47256 - protein, 10 aa, Mycobacterium tuberculosis
SPPLGSGAGP

SEQ ID NO: 47257 - protein, 10 aa, Mycobacterium tuberculosis
PPLGSGAGPR

SEQ ID NO: 47258 - protein, 10 aa, Mycobacterium tuberculosis
PLGSGAGPRY

SEQ ID NO: 47259 - protein, 10 aa, Mycobacterium tuberculosis
LGSGAGPRYA

SEQ ID NO: 47260 - protein, 10 aa, Mycobacterium tuberculosis
GSGAGPRYAG

SEQ ID NO: 47261 - protein, 10 aa, Mycobacterium tuberculosis
SGAGPRYAGP

SEQ ID NO: 47262 - protein, 10 aa, Mycobacterium tuberculosis
GAGPRYAGPL

SEQ ID NO: 47263 - protein, 10 aa, Mycobacterium tuberculosis
AGPRYAGPLF

SEQ ID NO: 47264 - protein, 10 aa, Mycobacterium tuberculosis
GPRYAGPLFV

SEQ ID NO: 47265 - protein, 10 aa, Mycobacterium tuberculosis
PRYAGPLFVT

SEQ ID NO: 47266 - protein, 10 aa, Mycobacterium tuberculosis
RYAGPLFVTD

SEQ ID NO: 47267 - protein, 10 aa, Mycobacterium tuberculosis
YAGPLFVTDL

SEQ ID NO: 47268 - protein, 10 aa, Mycobacterium tuberculosis
AGPLFVTDLD

SEQ ID NO: 47269 - protein, 10 aa, Mycobacterium tuberculosis
GPLFVTDLDS

SEQ ID NO: 47270 - protein, 10 aa, Mycobacterium tuberculosis
PLFVTDLDSP

SEQ ID NO: 47271 - protein, 10 aa, Mycobacterium tuberculosis
LFVTDLDSPV

SEQ ID NO: 47272 - protein, 10 aa, Mycobacterium tuberculosis
FVTDLDSPVE

SEQ ID NO: 47273 - protein, 10 aa, Mycobacterium tuberculosis
VTDLDSPVEP

SEQ ID NO: 47274 - protein, 10 aa, Mycobacterium tuberculosis
TDLDSPVEPP

SEQ ID NO: 47275 - protein, 10 aa, Mycobacterium tuberculosis
DLDSPVEPPR

SEQ ID NO: 47276 - protein, 10 aa, Mycobacterium tuberculosis
LDSPVEPPRH

SEQ ID NO: 47277 - protein, 10 aa, Mycobacterium tuberculosis
DSPVEPPRHG

SEQ ID NO: 47278 - protein, 10 aa, Mycobacterium tuberculosis
SPVEPPRHGQ

SEQ ID NO: 47279 - protein, 10 aa, Mycobacterium tuberculosis
PVEPPRHGQP

SEQ ID NO: 47280 - protein, 10 aa, Mycobacterium tuberculosis
VEPPRHGQPN

SEQ ID NO: 47281 - protein, 10 aa, Mycobacterium tuberculosis
EPPRHGQPNP

SEQ ID NO: 47282 - protein, 10 aa, Mycobacterium tuberculosis
PPRHGQPNPQ

SEQ ID NO: 47283 - protein, 10 aa, Mycobacterium tuberculosis
PRHGQPNPQF

SEQ ID NO: 47284 - protein, 10 aa, Mycobacterium tuberculosis
RHGQPNPQFR

SEQ ID NO: 47285 - protein, 10 aa, Mycobacterium tuberculosis
HGQPNPQFRT

SEQ ID NO: 47286 - protein, 10 aa, Mycobacterium tuberculosis
GQPNPQFRTA

SEQ ID NO: 47287 - protein, 10 aa, Mycobacterium tuberculosis
QPNPQFRTAR

SEQ ID NO: 47288 - protein, 10 aa, Mycobacterium tuberculosis
PNPQFRTARH

SEQ ID NO: 47289 - protein, 10 aa, Mycobacterium tuberculosis
NPQFRTARHA

SEQ ID NO: 47290 - protein, 10 aa, Mycobacterium tuberculosis
PQFRTARHAN

SEQ ID NO: 47291 - protein, 10 aa, Mycobacterium tuberculosis
QFRTARHANH

SEQ ID NO: 47292 - protein, 10 aa, Mycobacterium tuberculosis
FRTARHANHV

SEQ ID NO: 47293 - protein, 11 aa, Mycobacterium tuberculosis
MFTLLVSWLLV

SEQ ID NO: 47294 - protein, 11 aa, Mycobacterium tuberculosis
FTLLVSWLLVA

SEQ ID NO: 47295 - protein, 11 aa, Mycobacterium tuberculosis
TLLVSWLLVAC

SEQ ID NO: 47296 - protein, 11 aa, Mycobacterium tuberculosis
LLVSWLLVACV

SEQ ID NO: 47297 - protein, 11 aa, Mycobacterium tuberculosis
LVSWLLVACVP

SEQ ID NO: 47298 - protein, 11 aa, Mycobacterium tuberculosis
VSWLLVACVPG

SEQ ID NO: 47299 - protein, 11 aa, Mycobacterium tuberculosis
SWLLVACVPGL

SEQ ID NO: 47300 - protein, 11 aa, Mycobacterium tuberculosis
WLLVACVPGLL

SEQ ID NO: 47301 - protein, 11 aa, Mycobacterium tuberculosis
LLVACVPGLLM

SEQ ID NO: 47302 - protein, 11 aa, Mycobacterium tuberculosis
LVACVPGLLML

SEQ ID NO: 47303 - protein, 11 aa, Mycobacterium tuberculosis
VACVPGLLMLA

SEQ ID NO: 47304 - protein, 11 aa, Mycobacterium tuberculosis
ACVPGLLMLAT

SEQ ID NO: 47305 - protein, 11 aa, Mycobacterium tuberculosis
CVPGLLMLATL

SEQ ID NO: 47306 - protein, 11 aa, Mycobacterium tuberculosis
VPGLLMLATLG

SEQ ID NO: 47307 - protein, 11 aa, Mycobacterium tuberculosis
PGLLMLATLGL

SEQ ID NO: 47308 - protein, 11 aa, Mycobacterium tuberculosis
GLLMLATLGLG

SEQ ID NO: 47309 - protein, 11 aa, Mycobacterium tuberculosis
LLMLATLGLGR

SEQ ID NO: 47310 - protein, 11 aa, Mycobacterium tuberculosis
LMLATLGLGRL

SEQ ID NO: 47311 - protein, 11 aa, Mycobacterium tuberculosis
MLATLGLGRLE

SEQ ID NO: 47312 - protein, 11 aa, Mycobacterium tuberculosis
LATLGLGRLER

SEQ ID NO: 47313 - protein, 11 aa, Mycobacterium tuberculosis
ATLGLGRLERF

SEQ ID NO: 47314 - protein, 11 aa, Mycobacterium tuberculosis
TLGLGRLERFL

SEQ ID NO: 47315 - protein, 11 aa, Mycobacterium tuberculosis
LGLGRLERFLA

SEQ ID NO: 47316 - protein, 11 aa, Mycobacterium tuberculosis
GLGRLERFLAR

SEQ ID NO: 47317 - protein, 11 aa, Mycobacterium tuberculosis
LGRLERFLARD

SEQ ID NO: 47318 - protein, 11 aa, Mycobacterium tuberculosis
GRLERFLARDT

SEQ ID NO: 47319 - protein, 11 aa, Mycobacterium tuberculosis
RLERFLARDTV

SEQ ID NO: 47320 - protein, 11 aa, Mycobacterium tuberculosis
LERFLARDTVT

SEQ ID NO: 47321 - protein, 11 aa, Mycobacterium tuberculosis
ERFLARDTVTA

SEQ ID NO: 47322 - protein, 11 aa, Mycobacterium tuberculosis
RFLARDTVTAT

SEQ ID NO: 47323 - protein, 11 aa, Mycobacterium tuberculosis
FLARDTVTATD

SEQ ID NO: 47324 - protein, 11 aa, Mycobacterium tuberculosis
LARDTVTATDV

SEQ ID NO: 47325 - protein, 11 aa, Mycobacterium tuberculosis
ARDTVTATDVA

SEQ ID NO: 47326 - protein, 11 aa, Mycobacterium tuberculosis
RDTVTATDVAE

SEQ ID NO: 47327 - protein, 11 aa, Mycobacterium tuberculosis
DTVTATDVAEF

SEQ ID NO: 47328 - protein, 11 aa, Mycobacterium tuberculosis
TVTATDVAEFL

SEQ ID NO: 47329 - protein, 11 aa, Mycobacterium tuberculosis
VTATDVAEFLE

SEQ ID NO: 47330 - protein, 11 aa, Mycobacterium tuberculosis
TATDVAEFLEQ

SEQ ID NO: 47331 - protein, 11 aa, Mycobacterium tuberculosis
ATDVAEFLEQA

SEQ ID NO: 47332 - protein, 11 aa, Mycobacterium tuberculosis
TDVAEFLEQAE

SEQ ID NO: 47333 - protein, 11 aa, Mycobacterium tuberculosis
DVAEFLEQAEA

SEQ ID NO: 47334 - protein, 11 aa, Mycobacterium tuberculosis
VAEFLEQAEAV

SEQ ID NO: 47335 - protein, 11 aa, Mycobacterium tuberculosis
AEFLEQAEAVD

SEQ ID NO: 47336 - protein, 11 aa, Mycobacterium tuberculosis
EFLEQAEAVDV

SEQ ID NO: 47337 - protein, 11 aa, Mycobacterium tuberculosis
FLEQAEAVDVH

SEQ ID NO: 47338 - protein, 11 aa, Mycobacterium tuberculosis
LEQAEAVDVHT

SEQ ID NO: 47339 - protein, 11 aa, Mycobacterium tuberculosis
EQAEAVDVHTL

SEQ ID NO: 47340 - protein, 11 aa, Mycobacterium tuberculosis
QAEAVDVHTLA

SEQ ID NO: 47341 - protein, 11 aa, Mycobacterium tuberculosis
AEAVDVHTLAR

SEQ ID NO: 47342 - protein, 11 aa, Mycobacterium tuberculosis
EAVDVHTLARN

SEQ ID NO: 47343 - protein, 11 aa, Mycobacterium tuberculosis
AVDVHTLARNG

SEQ ID NO: 47344 - protein, 11 aa, Mycobacterium tuberculosis
VDVHTLARNGM

SEQ ID NO: 47345 - protein, 11 aa, Mycobacterium tuberculosis
DVHTLARNGMP

SEQ ID NO: 47346 - protein, 11 aa, Mycobacterium tuberculosis
VHTLARNGMPE

SEQ ID NO: 47347 - protein, 11 aa, Mycobacterium tuberculosis
HTLARNGMPEA

SEQ ID NO: 47348 - protein, 11 aa, Mycobacterium tuberculosis
TLARNGMPEAL

SEQ ID NO: 47349 - protein, 11 aa, Mycobacterium tuberculosis
LARNGMPEALD

SEQ ID NO: 47350 - protein, 11 aa, Mycobacterium tuberculosis
ARNGMPEALDY

SEQ ID NO: 47351 - protein, 11 aa, Mycobacterium tuberculosis
RNGMPEALDYL

SEQ ID NO: 47352 - protein, 11 aa, Mycobacterium tuberculosis
NGMPEALDYLH

SEQ ID NO: 47353 - protein, 11 aa, Mycobacterium tuberculosis
GMPEALDYLHR

SEQ ID NO: 47354 - protein, 11 aa, Mycobacterium tuberculosis
MPEALDYLHRR

SEQ ID NO: 47355 - protein, 11 aa, Mycobacterium tuberculosis
PEALDYLHRRQ

SEQ ID NO: 47356 - protein, 11 aa, Mycobacterium tuberculosis
EALDYLHRRQA

SEQ ID NO: 47357 - protein, 11 aa, Mycobacterium tuberculosis
ALDYLHRRQAR

SEQ ID NO: 47358 - protein, 11 aa, Mycobacterium tuberculosis
LDYLHRRQARR

SEQ ID NO: 47359 - protein, 11 aa, Mycobacterium tuberculosis
DYLHRRQARRI

SEQ ID NO: 47360 - protein, 11 aa, Mycobacterium tuberculosis
YLHRRQARRIT

SEQ ID NO: 47361 - protein, 11 aa, Mycobacterium tuberculosis
LHRRQARRITD

SEQ ID NO: 47362 - protein, 11 aa, Mycobacterium tuberculosis
HRRQARRITDS

SEQ ID NO: 47363 - protein, 11 aa, Mycobacterium tuberculosis
RRQARRITDSP

SEQ ID NO: 47364 - protein, 11 aa, Mycobacterium tuberculosis
RQARRITDSPP

SEQ ID NO: 47365 - protein, 11 aa, Mycobacterium tuberculosis
QARRITDSPPL

SEQ ID NO: 47366 - protein, 11 aa, Mycobacterium tuberculosis
ARRITDSPPLG

SEQ ID NO: 47367 - protein, 11 aa, Mycobacterium tuberculosis
RRITDSPPLGS

SEQ ID NO: 47368 - protein, 11 aa, Mycobacterium tuberculosis
RITDSPPLGSG

SEQ ID NO: 47369 - protein, 11 aa, Mycobacterium tuberculosis
ITDSPPLGSGA

SEQ ID NO: 47370 - protein, 11 aa, Mycobacterium tuberculosis
TDSPPLGSGAG

SEQ ID NO: 47371 - protein, 11 aa, Mycobacterium tuberculosis
DSPPLGSGAGP

SEQ ID NO: 47372 - protein, 11 aa, Mycobacterium tuberculosis
SPPLGSGAGPR

SEQ ID NO: 47373 - protein, 11 aa, Mycobacterium tuberculosis
PPLGSGAGPRY

SEQ ID NO: 47374 - protein, 11 aa, Mycobacterium tuberculosis
PLGSGAGPRYA

SEQ ID NO: 47375 - protein, 11 aa, Mycobacterium tuberculosis
LGSGAGPRYAG

SEQ ID NO: 47376 - protein, 11 aa, Mycobacterium tuberculosis
GSGAGPRYAGP

SEQ ID NO: 47377 - protein, 11 aa, Mycobacterium tuberculosis
SGAGPRYAGPL

SEQ ID NO: 47378 - protein, 11 aa, Mycobacterium tuberculosis
GAGPRYAGPLF

SEQ ID NO: 47379 - protein, 11 aa, Mycobacterium tuberculosis
AGPRYAGPLFV

SEQ ID NO: 47380 - protein, 11 aa, Mycobacterium tuberculosis
GPRYAGPLFVT

SEQ ID NO: 47381 - protein, 11 aa, Mycobacterium tuberculosis
PRYAGPLFVTD

SEQ ID NO: 47382 - protein, 11 aa, Mycobacterium tuberculosis
RYAGPLFVTDL

SEQ ID NO: 47383 - protein, 11 aa, Mycobacterium tuberculosis
YAGPLFVTDLD

SEQ ID NO: 47384 - protein, 11 aa, Mycobacterium tuberculosis
AGPLFVTDLDS

SEQ ID NO: 47385 - protein, 11 aa, Mycobacterium tuberculosis
GPLFVTDLDSP

SEQ ID NO: 47386 - protein, 11 aa, Mycobacterium tuberculosis
PLFVTDLDSPV

SEQ ID NO: 47387 - protein, 11 aa, Mycobacterium tuberculosis
LFVTDLDSPVE

SEQ ID NO: 47388 - protein, 11 aa, Mycobacterium tuberculosis
FVTDLDSPVEP

SEQ ID NO: 47389 - protein, 11 aa, Mycobacterium tuberculosis
VTDLDSPVEPP

SEQ ID NO: 47390 - protein, 11 aa, Mycobacterium tuberculosis
TDLDSPVEPPR

SEQ ID NO: 47391 - protein, 11 aa, Mycobacterium tuberculosis
DLDSPVEPPRH

SEQ ID NO: 47392 - protein, 11 aa, Mycobacterium tuberculosis
LDSPVEPPRHG

SEQ ID NO: 47393 - protein, 11 aa, Mycobacterium tuberculosis
DSPVEPPRHGQ

SEQ ID NO: 47394 - protein, 11 aa, Mycobacterium tuberculosis
SPVEPPRHGQP

SEQ ID NO: 47395 - protein, 11 aa, Mycobacterium tuberculosis
PVEPPRHGQPN

SEQ ID NO: 47396 - protein, 11 aa, Mycobacterium tuberculosis
VEPPRHGQPNP

SEQ ID NO: 47397 - protein, 11 aa, Mycobacterium tuberculosis
EPPRHGQPNPQ

SEQ ID NO: 47398 - protein, 11 aa, Mycobacterium tuberculosis
PPRHGQPNPQF

SEQ ID NO: 47399 - protein, 11 aa, Mycobacterium tuberculosis
PRHGQPNPQFR

SEQ ID NO: 47400 - protein, 11 aa, Mycobacterium tuberculosis
RHGQPNPQFRT

SEQ ID NO: 47401 - protein, 11 aa, Mycobacterium tuberculosis
HGQPNPQFRTA

SEQ ID NO: 47402 - protein, 11 aa, Mycobacterium tuberculosis
GQPNPQFRTAR

SEQ ID NO: 47403 - protein, 11 aa, Mycobacterium tuberculosis
QPNPQFRTARH

SEQ ID NO: 47404 - protein, 11 aa, Mycobacterium tuberculosis
PNPQFRTARHA

SEQ ID NO: 47405 - protein, 11 aa, Mycobacterium tuberculosis
NPQFRTARHAN

SEQ ID NO: 47406 - protein, 11 aa, Mycobacterium tuberculosis
PQFRTARHANH

SEQ ID NO: 47407 - protein, 11 aa, Mycobacterium tuberculosis
QFRTARHANHV

SEQ ID NO: 47408 - protein, 8 aa, Mycobacterium tuberculosis
MSLAWDVV

SEQ ID NO: 47409 - protein, 8 aa, Mycobacterium tuberculosis
SLAWDVVS

SEQ ID NO: 47410 - protein, 8 aa, Mycobacterium tuberculosis
LAWDVVSV

SEQ ID NO: 47411 - protein, 8 aa, Mycobacterium tuberculosis
AWDVVSVD

SEQ ID NO: 47412 - protein, 8 aa, Mycobacterium tuberculosis
WDVVSVDK

SEQ ID NO: 47413 - protein, 8 aa, Mycobacterium tuberculosis
DVVSVDKP

SEQ ID NO: 47414 - protein, 8 aa, Mycobacterium tuberculosis
VVSVDKPD

SEQ ID NO: 47415 - protein, 8 aa, Mycobacterium tuberculosis
VSVDKPDD

SEQ ID NO: 47416 - protein, 8 aa, Mycobacterium tuberculosis
SVDKPDDV

SEQ ID NO: 47417 - protein, 8 aa, Mycobacterium tuberculosis
VDKPDDVN

SEQ ID NO: 47418 - protein, 8 aa, Mycobacterium tuberculosis
DKPDDVNV

SEQ ID NO: 47419 - protein, 8 aa, Mycobacterium tuberculosis
KPDDVNVV

SEQ ID NO: 47420 - protein, 8 aa, Mycobacterium tuberculosis
PDDVNVVI

SEQ ID NO: 47421 - protein, 8 aa, Mycobacterium tuberculosis
DDVNVVIG

SEQ ID NO: 47422 - protein, 8 aa, Mycobacterium tuberculosis
DVNVVIGQ

SEQ ID NO: 47423 - protein, 8 aa, Mycobacterium tuberculosis
VNVVIGQA

SEQ ID NO: 47424 - protein, 8 aa, Mycobacterium tuberculosis
NVVIGQAH

SEQ ID NO: 47425 - protein, 8 aa, Mycobacterium tuberculosis
VVIGQAHF

SEQ ID NO: 47426 - protein, 8 aa, Mycobacterium tuberculosis
VIGQAHFI

SEQ ID NO: 47427 - protein, 8 aa, Mycobacterium tuberculosis
IGQAHFIK

SEQ ID NO: 47428 - protein, 8 aa, Mycobacterium tuberculosis
GQAHFIKA

SEQ ID NO: 47429 - protein, 8 aa, Mycobacterium tuberculosis
QAHFIKAV

SEQ ID NO: 47430 - protein, 8 aa, Mycobacterium tuberculosis
AHFIKAVE

SEQ ID NO: 47431 - protein, 8 aa, Mycobacterium tuberculosis
HFIKAVED

SEQ ID NO: 47432 - protein, 8 aa, Mycobacterium tuberculosis
FIKAVEDL

SEQ ID NO: 47433 - protein, 8 aa, Mycobacterium tuberculosis
IKAVEDLH

SEQ ID NO: 47434 - protein, 8 aa, Mycobacterium tuberculosis
KAVEDLHE

SEQ ID NO: 47435 - protein, 8 aa, Mycobacterium tuberculosis
AVEDLHEA

SEQ ID NO: 47436 - protein, 8 aa, Mycobacterium tuberculosis
VEDLHEAM

SEQ ID NO: 47437 - protein, 8 aa, Mycobacterium tuberculosis
EDLHEAMV

SEQ ID NO: 47438 - protein, 8 aa, Mycobacterium tuberculosis
DLHEAMVG

SEQ ID NO: 47439 - protein, 8 aa, Mycobacterium tuberculosis
LHEAMVGV

SEQ ID NO: 47440 - protein, 8 aa, Mycobacterium tuberculosis
HEAMVGVS

SEQ ID NO: 47441 - protein, 8 aa, Mycobacterium tuberculosis
EAMVGVSP

SEQ ID NO: 47442 - protein, 8 aa, Mycobacterium tuberculosis
AMVGVSPS

SEQ ID NO: 47443 - protein, 8 aa, Mycobacterium tuberculosis
MVGVSPSL

SEQ ID NO: 47444 - protein, 8 aa, Mycobacterium tuberculosis
VGVSPSLR

SEQ ID NO: 47445 - protein, 8 aa, Mycobacterium tuberculosis
GVSPSLRF

SEQ ID NO: 47446 - protein, 8 aa, Mycobacterium tuberculosis
VSPSLRFG

SEQ ID NO: 47447 - protein, 8 aa, Mycobacterium tuberculosis
SPSLRFGL

SEQ ID NO: 47448 - protein, 8 aa, Mycobacterium tuberculosis
PSLRFGLA

SEQ ID NO: 47449 - protein, 8 aa, Mycobacterium tuberculosis
SLRFGLAF

SEQ ID NO: 47450 - protein, 8 aa, Mycobacterium tuberculosis
LRFGLAFC

SEQ ID NO: 47451 - protein, 8 aa, Mycobacterium tuberculosis
RFGLAFCE

SEQ ID NO: 47452 - protein, 8 aa, Mycobacterium tuberculosis
FGLAFCEA

SEQ ID NO: 47453 - protein, 8 aa, Mycobacterium tuberculosis
GLAFCEAS

SEQ ID NO: 47454 - protein, 8 aa, Mycobacterium tuberculosis
LAFCEASG

SEQ ID NO: 47455 - protein, 8 aa, Mycobacterium tuberculosis
AFCEASGP

SEQ ID NO: 47456 - protein, 8 aa, Mycobacterium tuberculosis
FCEASGPR

SEQ ID NO: 47457 - protein, 8 aa, Mycobacterium tuberculosis
CEASGPRL

SEQ ID NO: 47458 - protein, 8 aa, Mycobacterium tuberculosis
EASGPRLV

SEQ ID NO: 47459 - protein, 8 aa, Mycobacterium tuberculosis
ASGPRLVR

SEQ ID NO: 47460 - protein, 8 aa, Mycobacterium tuberculosis
SGPRLVRH

SEQ ID NO: 47461 - protein, 8 aa, Mycobacterium tuberculosis
GPRLVRHT

SEQ ID NO: 47462 - protein, 8 aa, Mycobacterium tuberculosis
PRLVRHTG

SEQ ID NO: 47463 - protein, 8 aa, Mycobacterium tuberculosis
RLVRHTGN

SEQ ID NO: 47464 - protein, 8 aa, Mycobacterium tuberculosis
LVRHTGND

SEQ ID NO: 47465 - protein, 8 aa, Mycobacterium tuberculosis
VRHTGNDG

SEQ ID NO: 47466 - protein, 8 aa, Mycobacterium tuberculosis
RHTGNDGD

SEQ ID NO: 47467 - protein, 8 aa, Mycobacterium tuberculosis
HTGNDGDL

SEQ ID NO: 47468 - protein, 8 aa, Mycobacterium tuberculosis
TGNDGDLV

SEQ ID NO: 47469 - protein, 8 aa, Mycobacterium tuberculosis
GNDGDLVE

SEQ ID NO: 47470 - protein, 8 aa, Mycobacterium tuberculosis
NDGDLVEL

SEQ ID NO: 47471 - protein, 8 aa, Mycobacterium tuberculosis
DGDLVELA

SEQ ID NO: 47472 - protein, 8 aa, Mycobacterium tuberculosis
GDLVELAT

SEQ ID NO: 47473 - protein, 8 aa, Mycobacterium tuberculosis
DLVELATR

SEQ ID NO: 47474 - protein, 8 aa, Mycobacterium tuberculosis
LVELATRT

SEQ ID NO: 47475 - protein, 8 aa, Mycobacterium tuberculosis
VELATRTA

SEQ ID NO: 47476 - protein, 8 aa, Mycobacterium tuberculosis
ELATRTAL

SEQ ID NO: 47477 - protein, 8 aa, Mycobacterium tuberculosis
LATRTALA

SEQ ID NO: 47478 - protein, 8 aa, Mycobacterium tuberculosis
ATRTALAI

SEQ ID NO: 47479 - protein, 8 aa, Mycobacterium tuberculosis
TRTALAIA

SEQ ID NO: 47480 - protein, 8 aa, Mycobacterium tuberculosis
RTALAIAA

SEQ ID NO: 47481 - protein, 8 aa, Mycobacterium tuberculosis
TALAIAAG

SEQ ID NO: 47482 - protein, 8 aa, Mycobacterium tuberculosis
ALAIAAGH

SEQ ID NO: 47483 - protein, 8 aa, Mycobacterium tuberculosis
LAIAAGHS

SEQ ID NO: 47484 - protein, 8 aa, Mycobacterium tuberculosis
AIAAGHSF

SEQ ID NO: 47485 - protein, 8 aa, Mycobacterium tuberculosis
IAAGHSFV

SEQ ID NO: 47486 - protein, 8 aa, Mycobacterium tuberculosis
AAGHSFVI

SEQ ID NO: 47487 - protein, 8 aa, Mycobacterium tuberculosis
AGHSFVIF

SEQ ID NO: 47488 - protein, 8 aa, Mycobacterium tuberculosis
GHSFVIFL

SEQ ID NO: 47489 - protein, 8 aa, Mycobacterium tuberculosis
HSFVIFLR

SEQ ID NO: 47490 - protein, 8 aa, Mycobacterium tuberculosis
SFVIFLRE

SEQ ID NO: 47491 - protein, 8 aa, Mycobacterium tuberculosis
FVIFLREG

SEQ ID NO: 47492 - protein, 8 aa, Mycobacterium tuberculosis
VIFLREGF

SEQ ID NO: 47493 - protein, 8 aa, Mycobacterium tuberculosis
IFLREGFP

SEQ ID NO: 47494 - protein, 8 aa, Mycobacterium tuberculosis
FLREGFPI

SEQ ID NO: 47495 - protein, 8 aa, Mycobacterium tuberculosis
LREGFPIN

SEQ ID NO: 47496 - protein, 8 aa, Mycobacterium tuberculosis
REGFPINI

SEQ ID NO: 47497 - protein, 8 aa, Mycobacterium tuberculosis
EGFPINIL

SEQ ID NO: 47498 - protein, 8 aa, Mycobacterium tuberculosis
GFPINILN

SEQ ID NO: 47499 - protein, 8 aa, Mycobacterium tuberculosis
FPINILNP

SEQ ID NO: 47500 - protein, 8 aa, Mycobacterium tuberculosis
PINILNPV

SEQ ID NO: 47501 - protein, 8 aa, Mycobacterium tuberculosis
INILNPVQ

SEQ ID NO: 47502 - protein, 8 aa, Mycobacterium tuberculosis
NILNPVQA

SEQ ID NO: 47503 - protein, 8 aa, Mycobacterium tuberculosis
ILNPVQAV

SEQ ID NO: 47504 - protein, 8 aa, Mycobacterium tuberculosis
LNPVQAVP

SEQ ID NO: 47505 - protein, 8 aa, Mycobacterium tuberculosis
NPVQAVPE

SEQ ID NO: 47506 - protein, 8 aa, Mycobacterium tuberculosis
PVQAVPEV

SEQ ID NO: 47507 - protein, 8 aa, Mycobacterium tuberculosis
VQAVPEVC

SEQ ID NO: 47508 - protein, 8 aa, Mycobacterium tuberculosis
QAVPEVCT

SEQ ID NO: 47509 - protein, 8 aa, Mycobacterium tuberculosis
AVPEVCTI

SEQ ID NO: 47510 - protein, 8 aa, Mycobacterium tuberculosis
VPEVCTIY

SEQ ID NO: 47511 - protein, 8 aa, Mycobacterium tuberculosis
PEVCTIYC

SEQ ID NO: 47512 - protein, 8 aa, Mycobacterium tuberculosis
EVCTIYCA

SEQ ID NO: 47513 - protein, 8 aa, Mycobacterium tuberculosis
VCTIYCAT

SEQ ID NO: 47514 - protein, 8 aa, Mycobacterium tuberculosis
CTIYCATA

SEQ ID NO: 47515 - protein, 8 aa, Mycobacterium tuberculosis
TIYCATAN

SEQ ID NO: 47516 - protein, 8 aa, Mycobacterium tuberculosis
IYCATANP

SEQ ID NO: 47517 - protein, 8 aa, Mycobacterium tuberculosis
YCATANPV

SEQ ID NO: 47518 - protein, 8 aa, Mycobacterium tuberculosis
CATANPVD

SEQ ID NO: 47519 - protein, 8 aa, Mycobacterium tuberculosis
ATANPVDV

SEQ ID NO: 47520 - protein, 8 aa, Mycobacterium tuberculosis
TANPVDVV

SEQ ID NO: 47521 - protein, 8 aa, Mycobacterium tuberculosis
ANPVDVVV

SEQ ID NO: 47522 - protein, 8 aa, Mycobacterium tuberculosis
NPVDVVVA

SEQ ID NO: 47523 - protein, 8 aa, Mycobacterium tuberculosis
PVDVVVAV

SEQ ID NO: 47524 - protein, 8 aa, Mycobacterium tuberculosis
VDVVVAVT

SEQ ID NO: 47525 - protein, 8 aa, Mycobacterium tuberculosis
DVVVAVTP

SEQ ID NO: 47526 - protein, 8 aa, Mycobacterium tuberculosis
VVVAVTPH

SEQ ID NO: 47527 - protein, 8 aa, Mycobacterium tuberculosis
VVAVTPHG

SEQ ID NO: 47528 - protein, 8 aa, Mycobacterium tuberculosis
VAVTPHGR

SEQ ID NO: 47529 - protein, 8 aa, Mycobacterium tuberculosis
AVTPHGRG

SEQ ID NO: 47530 - protein, 8 aa, Mycobacterium tuberculosis
VTPHGRGI

SEQ ID NO: 47531 - protein, 8 aa, Mycobacterium tuberculosis
TPHGRGIV

SEQ ID NO: 47532 - protein, 8 aa, Mycobacterium tuberculosis
PHGRGIVG

SEQ ID NO: 47533 - protein, 8 aa, Mycobacterium tuberculosis
HGRGIVGV

SEQ ID NO: 47534 - protein, 8 aa, Mycobacterium tuberculosis
GRGIVGVV

SEQ ID NO: 47535 - protein, 8 aa, Mycobacterium tuberculosis
RGIVGVVD

SEQ ID NO: 47536 - protein, 8 aa, Mycobacterium tuberculosis
GIVGVVDG

SEQ ID NO: 47537 - protein, 8 aa, Mycobacterium tuberculosis
IVGVVDGQ

SEQ ID NO: 47538 - protein, 8 aa, Mycobacterium tuberculosis
VGVVDGQT

SEQ ID NO: 47539 - protein, 8 aa, Mycobacterium tuberculosis
GVVDGQTP

SEQ ID NO: 47540 - protein, 8 aa, Mycobacterium tuberculosis
VVDGQTPL

SEQ ID NO: 47541 - protein, 8 aa, Mycobacterium tuberculosis
VDGQTPLG

SEQ ID NO: 47542 - protein, 8 aa, Mycobacterium tuberculosis
DGQTPLGV

SEQ ID NO: 47543 - protein, 8 aa, Mycobacterium tuberculosis
GQTPLGVE

SEQ ID NO: 47544 - protein, 8 aa, Mycobacterium tuberculosis
QTPLGVET

SEQ ID NO: 47545 - protein, 8 aa, Mycobacterium tuberculosis
TPLGVETD

SEQ ID NO: 47546 - protein, 8 aa, Mycobacterium tuberculosis
PLGVETDR

SEQ ID NO: 47547 - protein, 8 aa, Mycobacterium tuberculosis
LGVETDRD

SEQ ID NO: 47548 - protein, 8 aa, Mycobacterium tuberculosis
GVETDRDI

SEQ ID NO: 47549 - protein, 8 aa, Mycobacterium tuberculosis
VETDRDIA

SEQ ID NO: 47550 - protein, 8 aa, Mycobacterium tuberculosis
ETDRDIAQ

SEQ ID NO: 47551 - protein, 8 aa, Mycobacterium tuberculosis
TDRDIAQR

SEQ ID NO: 47552 - protein, 8 aa, Mycobacterium tuberculosis
DRDIAQRR

SEQ ID NO: 47553 - protein, 8 aa, Mycobacterium tuberculosis
RDIAQRRD

SEQ ID NO: 47554 - protein, 8 aa, Mycobacterium tuberculosis
DIAQRRDL

SEQ ID NO: 47555 - protein, 8 aa, Mycobacterium tuberculosis
IAQRRDLL

SEQ ID NO: 47556 - protein, 8 aa, Mycobacterium tuberculosis
AQRRDLLR

SEQ ID NO: 47557 - protein, 8 aa, Mycobacterium tuberculosis
QRRDLLRA

SEQ ID NO: 47558 - protein, 8 aa, Mycobacterium tuberculosis
RRDLLRAI

SEQ ID NO: 47559 - protein, 8 aa, Mycobacterium tuberculosis
RDLLRAIG

SEQ ID NO: 47560 - protein, 8 aa, Mycobacterium tuberculosis
DLLRAIGY

SEQ ID NO: 47561 - protein, 8 aa, Mycobacterium tuberculosis
LLRAIGYK

SEQ ID NO: 47562 - protein, 8 aa, Mycobacterium tuberculosis
LRAIGYKL

SEQ ID NO: 47563 - protein, 9 aa, Mycobacterium tuberculosis
MSLAWDVVS

SEQ ID NO: 47564 - protein, 9 aa, Mycobacterium tuberculosis
SLAWDVVSV

SEQ ID NO: 47565 - protein, 9 aa, Mycobacterium tuberculosis
LAWDVVSVD

SEQ ID NO: 47566 - protein, 9 aa, Mycobacterium tuberculosis
AWDVVSVDK

SEQ ID NO: 47567 - protein, 9 aa, Mycobacterium tuberculosis
WDVVSVDKP

SEQ ID NO: 47568 - protein, 9 aa, Mycobacterium tuberculosis
DVVSVDKPD

SEQ ID NO: 47569 - protein, 9 aa, Mycobacterium tuberculosis
VVSVDKPDD

SEQ ID NO: 47570 - protein, 9 aa, Mycobacterium tuberculosis
VSVDKPDDV

SEQ ID NO: 47571 - protein, 9 aa, Mycobacterium tuberculosis
SVDKPDDVN

SEQ ID NO: 47572 - protein, 9 aa, Mycobacterium tuberculosis
VDKPDDVNV

SEQ ID NO: 47573 - protein, 9 aa, Mycobacterium tuberculosis
DKPDDVNVV

SEQ ID NO: 47574 - protein, 9 aa, Mycobacterium tuberculosis
KPDDVNVVI

SEQ ID NO: 47575 - protein, 9 aa, Mycobacterium tuberculosis
PDDVNVVIG

SEQ ID NO: 47576 - protein, 9 aa, Mycobacterium tuberculosis
DDVNVVIGQ

SEQ ID NO: 47577 - protein, 9 aa, Mycobacterium tuberculosis
DVNVVIGQA

SEQ ID NO: 47578 - protein, 9 aa, Mycobacterium tuberculosis
VNVVIGQAH

SEQ ID NO: 47579 - protein, 9 aa, Mycobacterium tuberculosis
NVVIGQAHF

SEQ ID NO: 47580 - protein, 9 aa, Mycobacterium tuberculosis
VVIGQAHFI

SEQ ID NO: 47581 - protein, 9 aa, Mycobacterium tuberculosis
VIGQAHFIK

SEQ ID NO: 47582 - protein, 9 aa, Mycobacterium tuberculosis
IGQAHFIKA

SEQ ID NO: 47583 - protein, 9 aa, Mycobacterium tuberculosis
GQAHFIKAV

SEQ ID NO: 47584 - protein, 9 aa, Mycobacterium tuberculosis
QAHFIKAVE

SEQ ID NO: 47585 - protein, 9 aa, Mycobacterium tuberculosis
AHFIKAVED

SEQ ID NO: 47586 - protein, 9 aa, Mycobacterium tuberculosis
HFIKAVEDL

SEQ ID NO: 47587 - protein, 9 aa, Mycobacterium tuberculosis
FIKAVEDLH

SEQ ID NO: 47588 - protein, 9 aa, Mycobacterium tuberculosis
IKAVEDLHE

SEQ ID NO: 47589 - protein, 9 aa, Mycobacterium tuberculosis
KAVEDLHEA

SEQ ID NO: 47590 - protein, 9 aa, Mycobacterium tuberculosis
AVEDLHEAM

SEQ ID NO: 47591 - protein, 9 aa, Mycobacterium tuberculosis
VEDLHEAMV

SEQ ID NO: 47592 - protein, 9 aa, Mycobacterium tuberculosis
EDLHEAMVG

SEQ ID NO: 47593 - protein, 9 aa, Mycobacterium tuberculosis
DLHEAMVGV

SEQ ID NO: 47594 - protein, 9 aa, Mycobacterium tuberculosis
LHEAMVGVS

SEQ ID NO: 47595 - protein, 9 aa, Mycobacterium tuberculosis
HEAMVGVSP

SEQ ID NO: 47596 - protein, 9 aa, Mycobacterium tuberculosis
EAMVGVSPS

SEQ ID NO: 47597 - protein, 9 aa, Mycobacterium tuberculosis
AMVGVSPSL

SEQ ID NO: 47598 - protein, 9 aa, Mycobacterium tuberculosis
MVGVSPSLR

SEQ ID NO: 47599 - protein, 9 aa, Mycobacterium tuberculosis
VGVSPSLRF

SEQ ID NO: 47600 - protein, 9 aa, Mycobacterium tuberculosis
GVSPSLRFG

SEQ ID NO: 47601 - protein, 9 aa, Mycobacterium tuberculosis
VSPSLRFGL

SEQ ID NO: 47602 - protein, 9 aa, Mycobacterium tuberculosis
SPSLRFGLA

SEQ ID NO: 47603 - protein, 9 aa, Mycobacterium tuberculosis
PSLRFGLAF

SEQ ID NO: 47604 - protein, 9 aa, Mycobacterium tuberculosis
SLRFGLAFC

SEQ ID NO: 47605 - protein, 9 aa, Mycobacterium tuberculosis
LRFGLAFCE

SEQ ID NO: 47606 - protein, 9 aa, Mycobacterium tuberculosis
RFGLAFCEA

SEQ ID NO: 47607 - protein, 9 aa, Mycobacterium tuberculosis
FGLAFCEAS

SEQ ID NO: 47608 - protein, 9 aa, Mycobacterium tuberculosis
GLAFCEASG

SEQ ID NO: 47609 - protein, 9 aa, Mycobacterium tuberculosis
LAFCEASGP

SEQ ID NO: 47610 - protein, 9 aa, Mycobacterium tuberculosis
AFCEASGPR

SEQ ID NO: 47611 - protein, 9 aa, Mycobacterium tuberculosis
FCEASGPRL

SEQ ID NO: 47612 - protein, 9 aa, Mycobacterium tuberculosis
CEASGPRLV

SEQ ID NO: 47613 - protein, 9 aa, Mycobacterium tuberculosis
EASGPRLVR

SEQ ID NO: 47614 - protein, 9 aa, Mycobacterium tuberculosis
ASGPRLVRH

SEQ ID NO: 47615 - protein, 9 aa, Mycobacterium tuberculosis
SGPRLVRHT

SEQ ID NO: 47616 - protein, 9 aa, Mycobacterium tuberculosis
GPRLVRHTG

SEQ ID NO: 47617 - protein, 9 aa, Mycobacterium tuberculosis
PRLVRHTGN

SEQ ID NO: 47618 - protein, 9 aa, Mycobacterium tuberculosis
RLVRHTGND

SEQ ID NO: 47619 - protein, 9 aa, Mycobacterium tuberculosis
LVRHTGNDG

SEQ ID NO: 47620 - protein, 9 aa, Mycobacterium tuberculosis
VRHTGNDGD

SEQ ID NO: 47621 - protein, 9 aa, Mycobacterium tuberculosis
RHTGNDGDL

SEQ ID NO: 47622 - protein, 9 aa, Mycobacterium tuberculosis
HTGNDGDLV

SEQ ID NO: 47623 - protein, 9 aa, Mycobacterium tuberculosis
TGNDGDLVE

SEQ ID NO: 47624 - protein, 9 aa, Mycobacterium tuberculosis
GNDGDLVEL

SEQ ID NO: 47625 - protein, 9 aa, Mycobacterium tuberculosis
NDGDLVELA

SEQ ID NO: 47626 - protein, 9 aa, Mycobacterium tuberculosis
DGDLVELAT

SEQ ID NO: 47627 - protein, 9 aa, Mycobacterium tuberculosis
GDLVELATR

SEQ ID NO: 47628 - protein, 9 aa, Mycobacterium tuberculosis
DLVELATRT

SEQ ID NO: 47629 - protein, 9 aa, Mycobacterium tuberculosis
LVELATRTA

SEQ ID NO: 47630 - protein, 9 aa, Mycobacterium tuberculosis
VELATRTAL

SEQ ID NO: 47631 - protein, 9 aa, Mycobacterium tuberculosis
ELATRTALA

SEQ ID NO: 47632 - protein, 9 aa, Mycobacterium tuberculosis
LATRTALAI

SEQ ID NO: 47633 - protein, 9 aa, Mycobacterium tuberculosis
ATRTALAIA

SEQ ID NO: 47634 - protein, 9 aa, Mycobacterium tuberculosis
TRTALAIAA

SEQ ID NO: 47635 - protein, 9 aa, Mycobacterium tuberculosis
RTALAIAAG

SEQ ID NO: 47636 - protein, 9 aa, Mycobacterium tuberculosis
TALAIAAGH

SEQ ID NO: 47637 - protein, 9 aa, Mycobacterium tuberculosis
ALAIAAGHS

SEQ ID NO: 47638 - protein, 9 aa, Mycobacterium tuberculosis
LAIAAGHSF

SEQ ID NO: 47639 - protein, 9 aa, Mycobacterium tuberculosis
AIAAGHSFV

SEQ ID NO: 47640 - protein, 9 aa, Mycobacterium tuberculosis
IAAGHSFVI

SEQ ID NO: 47641 - protein, 9 aa, Mycobacterium tuberculosis
AAGHSFVIF

SEQ ID NO: 47642 - protein, 9 aa, Mycobacterium tuberculosis
AGHSFVIFL

SEQ ID NO: 47643 - protein, 9 aa, Mycobacterium tuberculosis
GHSFVIFLR

SEQ ID NO: 47644 - protein, 9 aa, Mycobacterium tuberculosis
HSFVIFLRE

SEQ ID NO: 47645 - protein, 9 aa, Mycobacterium tuberculosis
SFVIFLREG

SEQ ID NO: 47646 - protein, 9 aa, Mycobacterium tuberculosis
FVIFLREGF

SEQ ID NO: 47647 - protein, 9 aa, Mycobacterium tuberculosis
VIFLREGFP

SEQ ID NO: 47648 - protein, 9 aa, Mycobacterium tuberculosis
IFLREGFPI

SEQ ID NO: 47649 - protein, 9 aa, Mycobacterium tuberculosis
FLREGFPIN

SEQ ID NO: 47650 - protein, 9 aa, Mycobacterium tuberculosis
LREGFPINI

SEQ ID NO: 47651 - protein, 9 aa, Mycobacterium tuberculosis
REGFPINIL

SEQ ID NO: 47652 - protein, 9 aa, Mycobacterium tuberculosis
EGFPINILN

SEQ ID NO: 47653 - protein, 9 aa, Mycobacterium tuberculosis
GFPINILNP

SEQ ID NO: 47654 - protein, 9 aa, Mycobacterium tuberculosis
FPINILNPV

SEQ ID NO: 47655 - protein, 9 aa, Mycobacterium tuberculosis
PINILNPVQ

SEQ ID NO: 47656 - protein, 9 aa, Mycobacterium tuberculosis
INILNPVQA

SEQ ID NO: 47657 - protein, 9 aa, Mycobacterium tuberculosis
NILNPVQAV

SEQ ID NO: 47658 - protein, 9 aa, Mycobacterium tuberculosis
ILNPVQAVP

SEQ ID NO: 47659 - protein, 9 aa, Mycobacterium tuberculosis
LNPVQAVPE

SEQ ID NO: 47660 - protein, 9 aa, Mycobacterium tuberculosis
NPVQAVPEV

SEQ ID NO: 47661 - protein, 9 aa, Mycobacterium tuberculosis
PVQAVPEVC

SEQ ID NO: 47662 - protein, 9 aa, Mycobacterium tuberculosis
VQAVPEVCT

SEQ ID NO: 47663 - protein, 9 aa, Mycobacterium tuberculosis
QAVPEVCTI

SEQ ID NO: 47664 - protein, 9 aa, Mycobacterium tuberculosis
AVPEVCTIY

SEQ ID NO: 47665 - protein, 9 aa, Mycobacterium tuberculosis
VPEVCTIYC

SEQ ID NO: 47666 - protein, 9 aa, Mycobacterium tuberculosis
PEVCTIYCA

SEQ ID NO: 47667 - protein, 9 aa, Mycobacterium tuberculosis
EVCTIYCAT

SEQ ID NO: 47668 - protein, 9 aa, Mycobacterium tuberculosis
VCTIYCATA

SEQ ID NO: 47669 - protein, 9 aa, Mycobacterium tuberculosis
CTIYCATAN

SEQ ID NO: 47670 - protein, 9 aa, Mycobacterium tuberculosis
TIYCATANP

SEQ ID NO: 47671 - protein, 9 aa, Mycobacterium tuberculosis
IYCATANPV

SEQ ID NO: 47672 - protein, 9 aa, Mycobacterium tuberculosis
YCATANPVD

SEQ ID NO: 47673 - protein, 9 aa, Mycobacterium tuberculosis
CATANPVDV

SEQ ID NO: 47674 - protein, 9 aa, Mycobacterium tuberculosis
ATANPVDVV

SEQ ID NO: 47675 - protein, 9 aa, Mycobacterium tuberculosis
TANPVDVVV

SEQ ID NO: 47676 - protein, 9 aa, Mycobacterium tuberculosis
ANPVDVVVA

SEQ ID NO: 47677 - protein, 9 aa, Mycobacterium tuberculosis
NPVDVVVAV

SEQ ID NO: 47678 - protein, 9 aa, Mycobacterium tuberculosis
PVDVVVAVT

SEQ ID NO: 47679 - protein, 9 aa, Mycobacterium tuberculosis
VDVVVAVTP

SEQ ID NO: 47680 - protein, 9 aa, Mycobacterium tuberculosis
DVVVAVTPH

SEQ ID NO: 47681 - protein, 9 aa, Mycobacterium tuberculosis
VVVAVTPHG

SEQ ID NO: 47682 - protein, 9 aa, Mycobacterium tuberculosis
VVAVTPHGR

SEQ ID NO: 47683 - protein, 9 aa, Mycobacterium tuberculosis
VAVTPHGRG

SEQ ID NO: 47684 - protein, 9 aa, Mycobacterium tuberculosis
AVTPHGRGI

SEQ ID NO: 47685 - protein, 9 aa, Mycobacterium tuberculosis
VTPHGRGIV

SEQ ID NO: 47686 - protein, 9 aa, Mycobacterium tuberculosis
TPHGRGIVG

SEQ ID NO: 47687 - protein, 9 aa, Mycobacterium tuberculosis
PHGRGIVGV

SEQ ID NO: 47688 - protein, 9 aa, Mycobacterium tuberculosis
HGRGIVGVV

SEQ ID NO: 47689 - protein, 9 aa, Mycobacterium tuberculosis
GRGIVGVVD

SEQ ID NO: 47690 - protein, 9 aa, Mycobacterium tuberculosis
RGIVGVVDG

SEQ ID NO: 47691 - protein, 9 aa, Mycobacterium tuberculosis
GIVGVVDGQ

SEQ ID NO: 47692 - protein, 9 aa, Mycobacterium tuberculosis
IVGVVDGQT

SEQ ID NO: 47693 - protein, 9 aa, Mycobacterium tuberculosis
VGVVDGQTP

SEQ ID NO: 47694 - protein, 9 aa, Mycobacterium tuberculosis
GVVDGQTPL

SEQ ID NO: 47695 - protein, 9 aa, Mycobacterium tuberculosis
VVDGQTPLG

SEQ ID NO: 47696 - protein, 9 aa, Mycobacterium tuberculosis
VDGQTPLGV

SEQ ID NO: 47697 - protein, 9 aa, Mycobacterium tuberculosis
DGQTPLGVE

SEQ ID NO: 47698 - protein, 9 aa, Mycobacterium tuberculosis
GQTPLGVET

SEQ ID NO: 47699 - protein, 9 aa, Mycobacterium tuberculosis
QTPLGVETD

SEQ ID NO: 47700 - protein, 9 aa, Mycobacterium tuberculosis
TPLGVETDR

SEQ ID NO: 47701 - protein, 9 aa, Mycobacterium tuberculosis
PLGVETDRD

SEQ ID NO: 47702 - protein, 9 aa, Mycobacterium tuberculosis
LGVETDRDI

SEQ ID NO: 47703 - protein, 9 aa, Mycobacterium tuberculosis
GVETDRDIA

SEQ ID NO: 47704 - protein, 9 aa, Mycobacterium tuberculosis
VETDRDIAQ

SEQ ID NO: 47705 - protein, 9 aa, Mycobacterium tuberculosis
ETDRDIAQR

SEQ ID NO: 47706 - protein, 9 aa, Mycobacterium tuberculosis
TDRDIAQRR

SEQ ID NO: 47707 - protein, 9 aa, Mycobacterium tuberculosis
DRDIAQRRD

SEQ ID NO: 47708 - protein, 9 aa, Mycobacterium tuberculosis
RDIAQRRDL

SEQ ID NO: 47709 - protein, 9 aa, Mycobacterium tuberculosis
DIAQRRDLL

SEQ ID NO: 47710 - protein, 9 aa, Mycobacterium tuberculosis
IAQRRDLLR

SEQ ID NO: 47711 - protein, 9 aa, Mycobacterium tuberculosis
AQRRDLLRA

SEQ ID NO: 47712 - protein, 9 aa, Mycobacterium tuberculosis
QRRDLLRAI

SEQ ID NO: 47713 - protein, 9 aa, Mycobacterium tuberculosis
RRDLLRAIG

SEQ ID NO: 47714 - protein, 9 aa, Mycobacterium tuberculosis
RDLLRAIGY

SEQ ID NO: 47715 - protein, 9 aa, Mycobacterium tuberculosis
DLLRAIGYK

SEQ ID NO: 47716 - protein, 9 aa, Mycobacterium tuberculosis
LLRAIGYKL

SEQ ID NO: 47717 - protein, 10 aa, Mycobacterium tuberculosis
MSLAWDVVSV

SEQ ID NO: 47718 - protein, 10 aa, Mycobacterium tuberculosis
SLAWDVVSVD

SEQ ID NO: 47719 - protein, 10 aa, Mycobacterium tuberculosis
LAWDVVSVDK

SEQ ID NO: 47720 - protein, 10 aa, Mycobacterium tuberculosis
AWDVVSVDKP

SEQ ID NO: 47721 - protein, 10 aa, Mycobacterium tuberculosis
WDVVSVDKPD

SEQ ID NO: 47722 - protein, 10 aa, Mycobacterium tuberculosis
DVVSVDKPDD

SEQ ID NO: 47723 - protein, 10 aa, Mycobacterium tuberculosis
VVSVDKPDDV

SEQ ID NO: 47724 - protein, 10 aa, Mycobacterium tuberculosis
VSVDKPDDVN

SEQ ID NO: 47725 - protein, 10 aa, Mycobacterium tuberculosis
SVDKPDDVNV

SEQ ID NO: 47726 - protein, 10 aa, Mycobacterium tuberculosis
VDKPDDVNVV

SEQ ID NO: 47727 - protein, 10 aa, Mycobacterium tuberculosis
DKPDDVNVVI

SEQ ID NO: 47728 - protein, 10 aa, Mycobacterium tuberculosis
KPDDVNVVIG

SEQ ID NO: 47729 - protein, 10 aa, Mycobacterium tuberculosis
PDDVNVVIGQ

SEQ ID NO: 47730 - protein, 10 aa, Mycobacterium tuberculosis
DDVNVVIGQA

SEQ ID NO: 47731 - protein, 10 aa, Mycobacterium tuberculosis
DVNVVIGQAH

SEQ ID NO: 47732 - protein, 10 aa, Mycobacterium tuberculosis
VNVVIGQAHF

SEQ ID NO: 47733 - protein, 10 aa, Mycobacterium tuberculosis
NVVIGQAHFI

SEQ ID NO: 47734 - protein, 10 aa, Mycobacterium tuberculosis
VVIGQAHFIK

SEQ ID NO: 47735 - protein, 10 aa, Mycobacterium tuberculosis
VIGQAHFIKA

SEQ ID NO: 47736 - protein, 10 aa, Mycobacterium tuberculosis
IGQAHFIKAV

SEQ ID NO: 47737 - protein, 10 aa, Mycobacterium tuberculosis
GQAHFIKAVE

SEQ ID NO: 47738 - protein, 10 aa, Mycobacterium tuberculosis
QAHFIKAVED

SEQ ID NO: 47739 - protein, 10 aa, Mycobacterium tuberculosis
AHFIKAVEDL

SEQ ID NO: 47740 - protein, 10 aa, Mycobacterium tuberculosis
HFIKAVEDLH

SEQ ID NO: 47741 - protein, 10 aa, Mycobacterium tuberculosis
FIKAVEDLHE

SEQ ID NO: 47742 - protein, 10 aa, Mycobacterium tuberculosis
IKAVEDLHEA

SEQ ID NO: 47743 - protein, 10 aa, Mycobacterium tuberculosis
KAVEDLHEAM

SEQ ID NO: 47744 - protein, 10 aa, Mycobacterium tuberculosis
AVEDLHEAMV

SEQ ID NO: 47745 - protein, 10 aa, Mycobacterium tuberculosis
VEDLHEAMVG

SEQ ID NO: 47746 - protein, 10 aa, Mycobacterium tuberculosis
EDLHEAMVGV

SEQ ID NO: 47747 - protein, 10 aa, Mycobacterium tuberculosis
DLHEAMVGVS

SEQ ID NO: 47748 - protein, 10 aa, Mycobacterium tuberculosis
LHEAMVGVSP

SEQ ID NO: 47749 - protein, 10 aa, Mycobacterium tuberculosis
HEAMVGVSPS

SEQ ID NO: 47750 - protein, 10 aa, Mycobacterium tuberculosis
EAMVGVSPSL

SEQ ID NO: 47751 - protein, 10 aa, Mycobacterium tuberculosis
AMVGVSPSLR

SEQ ID NO: 47752 - protein, 10 aa, Mycobacterium tuberculosis
MVGVSPSLRF

SEQ ID NO: 47753 - protein, 10 aa, Mycobacterium tuberculosis
VGVSPSLRFG

SEQ ID NO: 47754 - protein, 10 aa, Mycobacterium tuberculosis
GVSPSLRFGL

SEQ ID NO: 47755 - protein, 10 aa, Mycobacterium tuberculosis
VSPSLRFGLA

SEQ ID NO: 47756 - protein, 10 aa, Mycobacterium tuberculosis
SPSLRFGLAF

SEQ ID NO: 47757 - protein, 10 aa, Mycobacterium tuberculosis
PSLRFGLAFC

SEQ ID NO: 47758 - protein, 10 aa, Mycobacterium tuberculosis
SLRFGLAFCE

SEQ ID NO: 47759 - protein, 10 aa, Mycobacterium tuberculosis
LRFGLAFCEA

SEQ ID NO: 47760 - protein, 10 aa, Mycobacterium tuberculosis
RFGLAFCEAS

SEQ ID NO: 47761 - protein, 10 aa, Mycobacterium tuberculosis
FGLAFCEASG

SEQ ID NO: 47762 - protein, 10 aa, Mycobacterium tuberculosis
GLAFCEASGP

SEQ ID NO: 47763 - protein, 10 aa, Mycobacterium tuberculosis
LAFCEASGPR

SEQ ID NO: 47764 - protein, 10 aa, Mycobacterium tuberculosis
AFCEASGPRL

SEQ ID NO: 47765 - protein, 10 aa, Mycobacterium tuberculosis
FCEASGPRLV

SEQ ID NO: 47766 - protein, 10 aa, Mycobacterium tuberculosis
CEASGPRLVR

SEQ ID NO: 47767 - protein, 10 aa, Mycobacterium tuberculosis
EASGPRLVRH

SEQ ID NO: 47768 - protein, 10 aa, Mycobacterium tuberculosis
ASGPRLVRHT

SEQ ID NO: 47769 - protein, 10 aa, Mycobacterium tuberculosis
SGPRLVRHTG

SEQ ID NO: 47770 - protein, 10 aa, Mycobacterium tuberculosis
GPRLVRHTGN

SEQ ID NO: 47771 - protein, 10 aa, Mycobacterium tuberculosis
PRLVRHTGND

SEQ ID NO: 47772 - protein, 10 aa, Mycobacterium tuberculosis
RLVRHTGNDG

SEQ ID NO: 47773 - protein, 10 aa, Mycobacterium tuberculosis
LVRHTGNDGD

SEQ ID NO: 47774 - protein, 10 aa, Mycobacterium tuberculosis
VRHTGNDGDL

SEQ ID NO: 47775 - protein, 10 aa, Mycobacterium tuberculosis
RHTGNDGDLV

SEQ ID NO: 47776 - protein, 10 aa, Mycobacterium tuberculosis
HTGNDGDLVE

SEQ ID NO: 47777 - protein, 10 aa, Mycobacterium tuberculosis
TGNDGDLVEL

SEQ ID NO: 47778 - protein, 10 aa, Mycobacterium tuberculosis
GNDGDLVELA

SEQ ID NO: 47779 - protein, 10 aa, Mycobacterium tuberculosis
NDGDLVELAT

SEQ ID NO: 47780 - protein, 10 aa, Mycobacterium tuberculosis
DGDLVELATR

SEQ ID NO: 47781 - protein, 10 aa, Mycobacterium tuberculosis
GDLVELATRT

SEQ ID NO: 47782 - protein, 10 aa, Mycobacterium tuberculosis
DLVELATRTA

SEQ ID NO: 47783 - protein, 10 aa, Mycobacterium tuberculosis
LVELATRTAL

SEQ ID NO: 47784 - protein, 10 aa, Mycobacterium tuberculosis
VELATRTALA

SEQ ID NO: 47785 - protein, 10 aa, Mycobacterium tuberculosis
ELATRTALAI

SEQ ID NO: 47786 - protein, 10 aa, Mycobacterium tuberculosis
LATRTALAIA

SEQ ID NO: 47787 - protein, 10 aa, Mycobacterium tuberculosis
ATRTALAIAA

SEQ ID NO: 47788 - protein, 10 aa, Mycobacterium tuberculosis
TRTALAIAAG

SEQ ID NO: 47789 - protein, 10 aa, Mycobacterium tuberculosis
RTALAIAAGH

SEQ ID NO: 47790 - protein, 10 aa, Mycobacterium tuberculosis
TALAIAAGHS

SEQ ID NO: 47791 - protein, 10 aa, Mycobacterium tuberculosis
ALAIAAGHSF

SEQ ID NO: 47792 - protein, 10 aa, Mycobacterium tuberculosis
LAIAAGHSFV

SEQ ID NO: 47793 - protein, 10 aa, Mycobacterium tuberculosis
AIAAGHSFVI

SEQ ID NO: 47794 - protein, 10 aa, Mycobacterium tuberculosis
IAAGHSFVIF

SEQ ID NO: 47795 - protein, 10 aa, Mycobacterium tuberculosis
AAGHSFVIFL

SEQ ID NO: 47796 - protein, 10 aa, Mycobacterium tuberculosis
AGHSFVIFLR

SEQ ID NO: 47797 - protein, 10 aa, Mycobacterium tuberculosis
GHSFVIFLRE

SEQ ID NO: 47798 - protein, 10 aa, Mycobacterium tuberculosis
HSFVIFLREG

SEQ ID NO: 47799 - protein, 10 aa, Mycobacterium tuberculosis
SFVIFLREGF

SEQ ID NO: 47800 - protein, 10 aa, Mycobacterium tuberculosis
FVIFLREGFP

SEQ ID NO: 47801 - protein, 10 aa, Mycobacterium tuberculosis
VIFLREGFPI

SEQ ID NO: 47802 - protein, 10 aa, Mycobacterium tuberculosis
IFLREGFPIN

SEQ ID NO: 47803 - protein, 10 aa, Mycobacterium tuberculosis
FLREGFPINI

SEQ ID NO: 47804 - protein, 10 aa, Mycobacterium tuberculosis
LREGFPINIL

SEQ ID NO: 47805 - protein, 10 aa, Mycobacterium tuberculosis
REGFPINILN

SEQ ID NO: 47806 - protein, 10 aa, Mycobacterium tuberculosis
EGFPINILNP

SEQ ID NO: 47807 - protein, 10 aa, Mycobacterium tuberculosis
GFPINILNPV

SEQ ID NO: 47808 - protein, 10 aa, Mycobacterium tuberculosis
FPINILNPVQ

SEQ ID NO: 47809 - protein, 10 aa, Mycobacterium tuberculosis
PINILNPVQA

SEQ ID NO: 47810 - protein, 10 aa, Mycobacterium tuberculosis
INILNPVQAV

SEQ ID NO: 47811 - protein, 10 aa, Mycobacterium tuberculosis
NILNPVQAVP

SEQ ID NO: 47812 - protein, 10 aa, Mycobacterium tuberculosis
ILNPVQAVPE

SEQ ID NO: 47813 - protein, 10 aa, Mycobacterium tuberculosis
LNPVQAVPEV

SEQ ID NO: 47814 - protein, 10 aa, Mycobacterium tuberculosis
NPVQAVPEVC

SEQ ID NO: 47815 - protein, 10 aa, Mycobacterium tuberculosis
PVQAVPEVCT

SEQ ID NO: 47816 - protein, 10 aa, Mycobacterium tuberculosis
VQAVPEVCTI

SEQ ID NO: 47817 - protein, 10 aa, Mycobacterium tuberculosis
QAVPEVCTIY

SEQ ID NO: 47818 - protein, 10 aa, Mycobacterium tuberculosis
AVPEVCTIYC

SEQ ID NO: 47819 - protein, 10 aa, Mycobacterium tuberculosis
VPEVCTIYCA

SEQ ID NO: 47820 - protein, 10 aa, Mycobacterium tuberculosis
PEVCTIYCAT

SEQ ID NO: 47821 - protein, 10 aa, Mycobacterium tuberculosis
EVCTIYCATA

SEQ ID NO: 47822 - protein, 10 aa, Mycobacterium tuberculosis
VCTIYCATAN

SEQ ID NO: 47823 - protein, 10 aa, Mycobacterium tuberculosis
CTIYCATANP

SEQ ID NO: 47824 - protein, 10 aa, Mycobacterium tuberculosis
TIYCATANPV

SEQ ID NO: 47825 - protein, 10 aa, Mycobacterium tuberculosis
IYCATANPVD

SEQ ID NO: 47826 - protein, 10 aa, Mycobacterium tuberculosis
YCATANPVDV

SEQ ID NO: 47827 - protein, 10 aa, Mycobacterium tuberculosis
CATANPVDVV

SEQ ID NO: 47828 - protein, 10 aa, Mycobacterium tuberculosis
ATANPVDVVV

SEQ ID NO: 47829 - protein, 10 aa, Mycobacterium tuberculosis
TANPVDVVVA

SEQ ID NO: 47830 - protein, 10 aa, Mycobacterium tuberculosis
ANPVDVVVAV

SEQ ID NO: 47831 - protein, 10 aa, Mycobacterium tuberculosis
NPVDVVVAVT

SEQ ID NO: 47832 - protein, 10 aa, Mycobacterium tuberculosis
PVDVVVAVTP

SEQ ID NO: 47833 - protein, 10 aa, Mycobacterium tuberculosis
VDVVVAVTPH

SEQ ID NO: 47834 - protein, 10 aa, Mycobacterium tuberculosis
DVVVAVTPHG

SEQ ID NO: 47835 - protein, 10 aa, Mycobacterium tuberculosis
VVVAVTPHGR

SEQ ID NO: 47836 - protein, 10 aa, Mycobacterium tuberculosis
VVAVTPHGRG

SEQ ID NO: 47837 - protein, 10 aa, Mycobacterium tuberculosis
VAVTPHGRGI

SEQ ID NO: 47838 - protein, 10 aa, Mycobacterium tuberculosis
AVTPHGRGIV

SEQ ID NO: 47839 - protein, 10 aa, Mycobacterium tuberculosis
VTPHGRGIVG

SEQ ID NO: 47840 - protein, 10 aa, Mycobacterium tuberculosis
TPHGRGIVGV

SEQ ID NO: 47841 - protein, 10 aa, Mycobacterium tuberculosis
PHGRGIVGVV

SEQ ID NO: 47842 - protein, 10 aa, Mycobacterium tuberculosis
HGRGIVGVVD

SEQ ID NO: 47843 - protein, 10 aa, Mycobacterium tuberculosis
GRGIVGVVDG

SEQ ID NO: 47844 - protein, 10 aa, Mycobacterium tuberculosis
RGIVGVVDGQ

SEQ ID NO: 47845 - protein, 10 aa, Mycobacterium tuberculosis
GIVGVVDGQT

SEQ ID NO: 47846 - protein, 10 aa, Mycobacterium tuberculosis
IVGVVDGQTP

SEQ ID NO: 47847 - protein, 10 aa, Mycobacterium tuberculosis
VGVVDGQTPL

SEQ ID NO: 47848 - protein, 10 aa, Mycobacterium tuberculosis
GVVDGQTPLG

SEQ ID NO: 47849 - protein, 10 aa, Mycobacterium tuberculosis
VVDGQTPLGV

SEQ ID NO: 47850 - protein, 10 aa, Mycobacterium tuberculosis
VDGQTPLGVE

SEQ ID NO: 47851 - protein, 10 aa, Mycobacterium tuberculosis
DGQTPLGVET

SEQ ID NO: 47852 - protein, 10 aa, Mycobacterium tuberculosis
GQTPLGVETD

SEQ ID NO: 47853 - protein, 10 aa, Mycobacterium tuberculosis
QTPLGVETDR

SEQ ID NO: 47854 - protein, 10 aa, Mycobacterium tuberculosis
TPLGVETDRD

SEQ ID NO: 47855 - protein, 10 aa, Mycobacterium tuberculosis
PLGVETDRDI

SEQ ID NO: 47856 - protein, 10 aa, Mycobacterium tuberculosis
LGVETDRDIA

SEQ ID NO: 47857 - protein, 10 aa, Mycobacterium tuberculosis
GVETDRDIAQ

SEQ ID NO: 47858 - protein, 10 aa, Mycobacterium tuberculosis
VETDRDIAQR

SEQ ID NO: 47859 - protein, 10 aa, Mycobacterium tuberculosis
ETDRDIAQRR

SEQ ID NO: 47860 - protein, 10 aa, Mycobacterium tuberculosis
TDRDIAQRRD

SEQ ID NO: 47861 - protein, 10 aa, Mycobacterium tuberculosis
DRDIAQRRDL

SEQ ID NO: 47862 - protein, 10 aa, Mycobacterium tuberculosis
RDIAQRRDLL

SEQ ID NO: 47863 - protein, 10 aa, Mycobacterium tuberculosis
DIAQRRDLLR

SEQ ID NO: 47864 - protein, 10 aa, Mycobacterium tuberculosis
IAQRRDLLRA

SEQ ID NO: 47865 - protein, 10 aa, Mycobacterium tuberculosis
AQRRDLLRAI

SEQ ID NO: 47866 - protein, 10 aa, Mycobacterium tuberculosis
QRRDLLRAIG

SEQ ID NO: 47867 - protein, 10 aa, Mycobacterium tuberculosis
RRDLLRAIGY

SEQ ID NO: 47868 - protein, 10 aa, Mycobacterium tuberculosis
RDLLRAIGYK

SEQ ID NO: 47869 - protein, 10 aa, Mycobacterium tuberculosis
DLLRAIGYKL

SEQ ID NO: 47870 - protein, 11 aa, Mycobacterium tuberculosis
MSLAWDVVSVD

SEQ ID NO: 47871 - protein, 11 aa, Mycobacterium tuberculosis
SLAWDVVSVDK

SEQ ID NO: 47872 - protein, 11 aa, Mycobacterium tuberculosis
LAWDVVSVDKP

SEQ ID NO: 47873 - protein, 11 aa, Mycobacterium tuberculosis
AWDVVSVDKPD

SEQ ID NO: 47874 - protein, 11 aa, Mycobacterium tuberculosis
WDVVSVDKPDD

SEQ ID NO: 47875 - protein, 11 aa, Mycobacterium tuberculosis
DVVSVDKPDDV

SEQ ID NO: 47876 - protein, 11 aa, Mycobacterium tuberculosis
VVSVDKPDDVN

SEQ ID NO: 47877 - protein, 11 aa, Mycobacterium tuberculosis
VSVDKPDDVNV

SEQ ID NO: 47878 - protein, 11 aa, Mycobacterium tuberculosis
SVDKPDDVNVV

SEQ ID NO: 47879 - protein, 11 aa, Mycobacterium tuberculosis
VDKPDDVNVVI

SEQ ID NO: 47880 - protein, 11 aa, Mycobacterium tuberculosis
DKPDDVNVVIG

SEQ ID NO: 47881 - protein, 11 aa, Mycobacterium tuberculosis
KPDDVNVVIGQ

SEQ ID NO: 47882 - protein, 11 aa, Mycobacterium tuberculosis
PDDVNVVIGQA

SEQ ID NO: 47883 - protein, 11 aa, Mycobacterium tuberculosis
DDVNVVIGQAH

SEQ ID NO: 47884 - protein, 11 aa, Mycobacterium tuberculosis
DVNVVIGQAHF

SEQ ID NO: 47885 - protein, 11 aa, Mycobacterium tuberculosis
VNVVIGQAHFI

SEQ ID NO: 47886 - protein, 11 aa, Mycobacterium tuberculosis
NVVIGQAHFIK

SEQ ID NO: 47887 - protein, 11 aa, Mycobacterium tuberculosis
VVIGQAHFIKA

SEQ ID NO: 47888 - protein, 11 aa, Mycobacterium tuberculosis
VIGQAHFIKAV

SEQ ID NO: 47889 - protein, 11 aa, Mycobacterium tuberculosis
IGQAHFIKAVE

SEQ ID NO: 47890 - protein, 11 aa, Mycobacterium tuberculosis
GQAHFIKAVED

SEQ ID NO: 47891 - protein, 11 aa, Mycobacterium tuberculosis
QAHFIKAVEDL

SEQ ID NO: 47892 - protein, 11 aa, Mycobacterium tuberculosis
AHFIKAVEDLH

SEQ ID NO: 47893 - protein, 11 aa, Mycobacterium tuberculosis
HFIKAVEDLHE

SEQ ID NO: 47894 - protein, 11 aa, Mycobacterium tuberculosis
FIKAVEDLHEA

SEQ ID NO: 47895 - protein, 11 aa, Mycobacterium tuberculosis
IKAVEDLHEAM

SEQ ID NO: 47896 - protein, 11 aa, Mycobacterium tuberculosis
KAVEDLHEAMV

SEQ ID NO: 47897 - protein, 11 aa, Mycobacterium tuberculosis
AVEDLHEAMVG

SEQ ID NO: 47898 - protein, 11 aa, Mycobacterium tuberculosis
VEDLHEAMVGV

SEQ ID NO: 47899 - protein, 11 aa, Mycobacterium tuberculosis
EDLHEAMVGVS

SEQ ID NO: 47900 - protein, 11 aa, Mycobacterium tuberculosis
DLHEAMVGVSP

SEQ ID NO: 47901 - protein, 11 aa, Mycobacterium tuberculosis
LHEAMVGVSPS

SEQ ID NO: 47902 - protein, 11 aa, Mycobacterium tuberculosis
HEAMVGVSPSL

SEQ ID NO: 47903 - protein, 11 aa, Mycobacterium tuberculosis
EAMVGVSPSLR

SEQ ID NO: 47904 - protein, 11 aa, Mycobacterium tuberculosis
AMVGVSPSLRF

SEQ ID NO: 47905 - protein, 11 aa, Mycobacterium tuberculosis
MVGVSPSLRFG

SEQ ID NO: 47906 - protein, 11 aa, Mycobacterium tuberculosis
VGVSPSLRFGL

SEQ ID NO: 47907 - protein, 11 aa, Mycobacterium tuberculosis
GVSPSLRFGLA

SEQ ID NO: 47908 - protein, 11 aa, Mycobacterium tuberculosis
VSPSLRFGLAF

SEQ ID NO: 47909 - protein, 11 aa, Mycobacterium tuberculosis
SPSLRFGLAFC

SEQ ID NO: 47910 - protein, 11 aa, Mycobacterium tuberculosis
PSLRFGLAFCE

SEQ ID NO: 47911 - protein, 11 aa, Mycobacterium tuberculosis
SLRFGLAFCEA

SEQ ID NO: 47912 - protein, 11 aa, Mycobacterium tuberculosis
LRFGLAFCEAS

SEQ ID NO: 47913 - protein, 11 aa, Mycobacterium tuberculosis
RFGLAFCEASG

SEQ ID NO: 47914 - protein, 11 aa, Mycobacterium tuberculosis
FGLAFCEASGP

SEQ ID NO: 47915 - protein, 11 aa, Mycobacterium tuberculosis
GLAFCEASGPR

SEQ ID NO: 47916 - protein, 11 aa, Mycobacterium tuberculosis
LAFCEASGPRL

SEQ ID NO: 47917 - protein, 11 aa, Mycobacterium tuberculosis
AFCEASGPRLV

SEQ ID NO: 47918 - protein, 11 aa, Mycobacterium tuberculosis
FCEASGPRLVR

SEQ ID NO: 47919 - protein, 11 aa, Mycobacterium tuberculosis
CEASGPRLVRH

SEQ ID NO: 47920 - protein, 11 aa, Mycobacterium tuberculosis
EASGPRLVRHT

SEQ ID NO: 47921 - protein, 11 aa, Mycobacterium tuberculosis
ASGPRLVRHTG

SEQ ID NO: 47922 - protein, 11 aa, Mycobacterium tuberculosis
SGPRLVRHTGN

SEQ ID NO: 47923 - protein, 11 aa, Mycobacterium tuberculosis
GPRLVRHTGND

SEQ ID NO: 47924 - protein, 11 aa, Mycobacterium tuberculosis
PRLVRHTGNDG

SEQ ID NO: 47925 - protein, 11 aa, Mycobacterium tuberculosis
RLVRHTGNDGD

SEQ ID NO: 47926 - protein, 11 aa, Mycobacterium tuberculosis
LVRHTGNDGDL

SEQ ID NO: 47927 - protein, 11 aa, Mycobacterium tuberculosis
VRHTGNDGDLV

SEQ ID NO: 47928 - protein, 11 aa, Mycobacterium tuberculosis
RHTGNDGDLVE

SEQ ID NO: 47929 - protein, 11 aa, Mycobacterium tuberculosis
HTGNDGDLVEL

SEQ ID NO: 47930 - protein, 11 aa, Mycobacterium tuberculosis
TGNDGDLVELA

SEQ ID NO: 47931 - protein, 11 aa, Mycobacterium tuberculosis
GNDGDLVELAT

SEQ ID NO: 47932 - protein, 11 aa, Mycobacterium tuberculosis
NDGDLVELATR

SEQ ID NO: 47933 - protein, 11 aa, Mycobacterium tuberculosis
DGDLVELATRT

SEQ ID NO: 47934 - protein, 11 aa, Mycobacterium tuberculosis
GDLVELATRTA

SEQ ID NO: 47935 - protein, 11 aa, Mycobacterium tuberculosis
DLVELATRTAL

SEQ ID NO: 47936 - protein, 11 aa, Mycobacterium tuberculosis
LVELATRTALA

SEQ ID NO: 47937 - protein, 11 aa, Mycobacterium tuberculosis
VELATRTALAI

SEQ ID NO: 47938 - protein, 11 aa, Mycobacterium tuberculosis
ELATRTALAIA

SEQ ID NO: 47939 - protein, 11 aa, Mycobacterium tuberculosis
LATRTALAIAA

SEQ ID NO: 47940 - protein, 11 aa, Mycobacterium tuberculosis
ATRTALAIAAG

SEQ ID NO: 47941 - protein, 11 aa, Mycobacterium tuberculosis
TRTALAIAAGH

SEQ ID NO: 47942 - protein, 11 aa, Mycobacterium tuberculosis
RTALAIAAGHS

SEQ ID NO: 47943 - protein, 11 aa, Mycobacterium tuberculosis
TALAIAAGHSF

SEQ ID NO: 47944 - protein, 11 aa, Mycobacterium tuberculosis
ALAIAAGHSFV

SEQ ID NO: 47945 - protein, 11 aa, Mycobacterium tuberculosis
LAIAAGHSFVI

SEQ ID NO: 47946 - protein, 11 aa, Mycobacterium tuberculosis
AIAAGHSFVIF

SEQ ID NO: 47947 - protein, 11 aa, Mycobacterium tuberculosis
IAAGHSFVIFL

SEQ ID NO: 47948 - protein, 11 aa, Mycobacterium tuberculosis
AAGHSFVIFLR

SEQ ID NO: 47949 - protein, 11 aa, Mycobacterium tuberculosis
AGHSFVIFLRE

SEQ ID NO: 47950 - protein, 11 aa, Mycobacterium tuberculosis
GHSFVIFLREG

SEQ ID NO: 47951 - protein, 11 aa, Mycobacterium tuberculosis
HSFVIFLREGF

SEQ ID NO: 47952 - protein, 11 aa, Mycobacterium tuberculosis
SFVIFLREGFP

SEQ ID NO: 47953 - protein, 11 aa, Mycobacterium tuberculosis
FVIFLREGFPI

SEQ ID NO: 47954 - protein, 11 aa, Mycobacterium tuberculosis
VIFLREGFPIN

SEQ ID NO: 47955 - protein, 11 aa, Mycobacterium tuberculosis
IFLREGFPINI

SEQ ID NO: 47956 - protein, 11 aa, Mycobacterium tuberculosis
FLREGFPINIL

SEQ ID NO: 47957 - protein, 11 aa, Mycobacterium tuberculosis
LREGFPINILN

SEQ ID NO: 47958 - protein, 11 aa, Mycobacterium tuberculosis
REGFPINILNP

SEQ ID NO: 47959 - protein, 11 aa, Mycobacterium tuberculosis
EGFPINILNPV

SEQ ID NO: 47960 - protein, 11 aa, Mycobacterium tuberculosis
GFPINILNPVQ

SEQ ID NO: 47961 - protein, 11 aa, Mycobacterium tuberculosis
FPINILNPVQA

SEQ ID NO: 47962 - protein, 11 aa, Mycobacterium tuberculosis
PINILNPVQAV

SEQ ID NO: 47963 - protein, 11 aa, Mycobacterium tuberculosis
INILNPVQAVP

SEQ ID NO: 47964 - protein, 11 aa, Mycobacterium tuberculosis
NILNPVQAVPE

SEQ ID NO: 47965 - protein, 11 aa, Mycobacterium tuberculosis
ILNPVQAVPEV

SEQ ID NO: 47966 - protein, 11 aa, Mycobacterium tuberculosis
LNPVQAVPEVC

SEQ ID NO: 47967 - protein, 11 aa, Mycobacterium tuberculosis
NPVQAVPEVCT

SEQ ID NO: 47968 - protein, 11 aa, Mycobacterium tuberculosis
PVQAVPEVCTI

SEQ ID NO: 47969 - protein, 11 aa, Mycobacterium tuberculosis
VQAVPEVCTIY

SEQ ID NO: 47970 - protein, 11 aa, Mycobacterium tuberculosis
QAVPEVCTIYC

SEQ ID NO: 47971 - protein, 11 aa, Mycobacterium tuberculosis
AVPEVCTIYCA

SEQ ID NO: 47972 - protein, 11 aa, Mycobacterium tuberculosis
VPEVCTIYCAT

SEQ ID NO: 47973 - protein, 11 aa, Mycobacterium tuberculosis
PEVCTIYCATA

SEQ ID NO: 47974 - protein, 11 aa, Mycobacterium tuberculosis
EVCTIYCATAN

SEQ ID NO: 47975 - protein, 11 aa, Mycobacterium tuberculosis
VCTIYCATANP

SEQ ID NO: 47976 - protein, 11 aa, Mycobacterium tuberculosis
CTIYCATANPV

SEQ ID NO: 47977 - protein, 11 aa, Mycobacterium tuberculosis
TIYCATANPVD

SEQ ID NO: 47978 - protein, 11 aa, Mycobacterium tuberculosis
IYCATANPVDV

SEQ ID NO: 47979 - protein, 11 aa, Mycobacterium tuberculosis
YCATANPVDVV

SEQ ID NO: 47980 - protein, 11 aa, Mycobacterium tuberculosis
CATANPVDVVV

SEQ ID NO: 47981 - protein, 11 aa, Mycobacterium tuberculosis
ATANPVDVVVA

SEQ ID NO: 47982 - protein, 11 aa, Mycobacterium tuberculosis
TANPVDVVVAV

SEQ ID NO: 47983 - protein, 11 aa, Mycobacterium tuberculosis
ANPVDVVVAVT

SEQ ID NO: 47984 - protein, 11 aa, Mycobacterium tuberculosis
NPVDVVVAVTP

SEQ ID NO: 47985 - protein, 11 aa, Mycobacterium tuberculosis
PVDVVVAVTPH

SEQ ID NO: 47986 - protein, 11 aa, Mycobacterium tuberculosis
VDVVVAVTPHG

SEQ ID NO: 47987 - protein, 11 aa, Mycobacterium tuberculosis
DVVVAVTPHGR

SEQ ID NO: 47988 - protein, 11 aa, Mycobacterium tuberculosis
VVVAVTPHGRG

SEQ ID NO: 47989 - protein, 11 aa, Mycobacterium tuberculosis
VVAVTPHGRGI

SEQ ID NO: 47990 - protein, 11 aa, Mycobacterium tuberculosis
VAVTPHGRGIV

SEQ ID NO: 47991 - protein, 11 aa, Mycobacterium tuberculosis
AVTPHGRGIVG

SEQ ID NO: 47992 - protein, 11 aa, Mycobacterium tuberculosis
VTPHGRGIVGV

SEQ ID NO: 47993 - protein, 11 aa, Mycobacterium tuberculosis
TPHGRGIVGVV

SEQ ID NO: 47994 - protein, 11 aa, Mycobacterium tuberculosis
PHGRGIVGVVD

SEQ ID NO: 47995 - protein, 11 aa, Mycobacterium tuberculosis
HGRGIVGVVDG

SEQ ID NO: 47996 - protein, 11 aa, Mycobacterium tuberculosis
GRGIVGVVDGQ

SEQ ID NO: 47997 - protein, 11 aa, Mycobacterium tuberculosis
RGIVGVVDGQT

SEQ ID NO: 47998 - protein, 11 aa, Mycobacterium tuberculosis
GIVGVVDGQTP

SEQ ID NO: 47999 - protein, 11 aa, Mycobacterium tuberculosis
IVGVVDGQTPL

SEQ ID NO: 48000 - protein, 11 aa, Mycobacterium tuberculosis
VGVVDGQTPLG

SEQ ID NO: 48001 - protein, 11 aa, Mycobacterium tuberculosis
GVVDGQTPLGV

SEQ ID NO: 48002 - protein, 11 aa, Mycobacterium tuberculosis
VVDGQTPLGVE

SEQ ID NO: 48003 - protein, 11 aa, Mycobacterium tuberculosis
VDGQTPLGVET

SEQ ID NO: 48004 - protein, 11 aa, Mycobacterium tuberculosis
DGQTPLGVETD

SEQ ID NO: 48005 - protein, 11 aa, Mycobacterium tuberculosis
GQTPLGVETDR

SEQ ID NO: 48006 - protein, 11 aa, Mycobacterium tuberculosis
QTPLGVETDRD

SEQ ID NO: 48007 - protein, 11 aa, Mycobacterium tuberculosis
TPLGVETDRDI

SEQ ID NO: 48008 - protein, 11 aa, Mycobacterium tuberculosis
PLGVETDRDIA

SEQ ID NO: 48009 - protein, 11 aa, Mycobacterium tuberculosis
LGVETDRDIAQ

SEQ ID NO: 48010 - protein, 11 aa, Mycobacterium tuberculosis
GVETDRDIAQR

SEQ ID NO: 48011 - protein, 11 aa, Mycobacterium tuberculosis
VETDRDIAQRR

SEQ ID NO: 48012 - protein, 11 aa, Mycobacterium tuberculosis
ETDRDIAQRRD

SEQ ID NO: 48013 - protein, 11 aa, Mycobacterium tuberculosis
TDRDIAQRRDL

SEQ ID NO: 48014 - protein, 11 aa, Mycobacterium tuberculosis
DRDIAQRRDLL

SEQ ID NO: 48015 - protein, 11 aa, Mycobacterium tuberculosis
RDIAQRRDLLR

SEQ ID NO: 48016 - protein, 11 aa, Mycobacterium tuberculosis
DIAQRRDLLRA

SEQ ID NO: 48017 - protein, 11 aa, Mycobacterium tuberculosis
IAQRRDLLRAI

SEQ ID NO: 48018 - protein, 11 aa, Mycobacterium tuberculosis
AQRRDLLRAIG

SEQ ID NO: 48019 - protein, 11 aa, Mycobacterium tuberculosis
QRRDLLRAIGY

SEQ ID NO: 48020 - protein, 11 aa, Mycobacterium tuberculosis
RRDLLRAIGYK

SEQ ID NO: 48021 - protein, 11 aa, Mycobacterium tuberculosis
RDLLRAIGYKL

SEQ ID NO: 48022 - protein, 8 aa, Mycobacterium tuberculosis
MPNRRRRK

SEQ ID NO: 48023 - protein, 8 aa, Mycobacterium tuberculosis
PNRRRRKL

SEQ ID NO: 48024 - protein, 8 aa, Mycobacterium tuberculosis
NRRRRKLS

SEQ ID NO: 48025 - protein, 8 aa, Mycobacterium tuberculosis
RRRRKLST

SEQ ID NO: 48026 - protein, 8 aa, Mycobacterium tuberculosis
RRRKLSTA

SEQ ID NO: 48027 - protein, 8 aa, Mycobacterium tuberculosis
RRKLSTAM

SEQ ID NO: 48028 - protein, 8 aa, Mycobacterium tuberculosis
RKLSTAMS

SEQ ID NO: 48029 - protein, 8 aa, Mycobacterium tuberculosis
KLSTAMSA

SEQ ID NO: 48030 - protein, 8 aa, Mycobacterium tuberculosis
LSTAMSAV

SEQ ID NO: 48031 - protein, 8 aa, Mycobacterium tuberculosis
STAMSAVA

SEQ ID NO: 48032 - protein, 8 aa, Mycobacterium tuberculosis
TAMSAVAA

SEQ ID NO: 48033 - protein, 8 aa, Mycobacterium tuberculosis
AMSAVAAL

SEQ ID NO: 48034 - protein, 8 aa, Mycobacterium tuberculosis
MSAVAALA

SEQ ID NO: 48035 - protein, 8 aa, Mycobacterium tuberculosis
SAVAALAV

SEQ ID NO: 48036 - protein, 8 aa, Mycobacterium tuberculosis
AVAALAVA

SEQ ID NO: 48037 - protein, 8 aa, Mycobacterium tuberculosis
VAALAVAS

SEQ ID NO: 48038 - protein, 8 aa, Mycobacterium tuberculosis
AALAVASP

SEQ ID NO: 48039 - protein, 8 aa, Mycobacterium tuberculosis
ALAVASPC

SEQ ID NO: 48040 - protein, 8 aa, Mycobacterium tuberculosis
LAVASPCA

SEQ ID NO: 48041 - protein, 8 aa, Mycobacterium tuberculosis
AVASPCAY

SEQ ID NO: 48042 - protein, 8 aa, Mycobacterium tuberculosis
VASPCAYF

SEQ ID NO: 48043 - protein, 8 aa, Mycobacterium tuberculosis
ASPCAYFL

SEQ ID NO: 48044 - protein, 8 aa, Mycobacterium tuberculosis
SPCAYFLV

SEQ ID NO: 48045 - protein, 8 aa, Mycobacterium tuberculosis
PCAYFLVY

SEQ ID NO: 48046 - protein, 8 aa, Mycobacterium tuberculosis
CAYFLVYE

SEQ ID NO: 48047 - protein, 8 aa, Mycobacterium tuberculosis
AYFLVYES

SEQ ID NO: 48048 - protein, 8 aa, Mycobacterium tuberculosis
YFLVYEST

SEQ ID NO: 48049 - protein, 8 aa, Mycobacterium tuberculosis
FLVYESTE

SEQ ID NO: 48050 - protein, 8 aa, Mycobacterium tuberculosis
LVYESTET

SEQ ID NO: 48051 - protein, 8 aa, Mycobacterium tuberculosis
VYESTETT

SEQ ID NO: 48052 - protein, 8 aa, Mycobacterium tuberculosis
YESTETTE

SEQ ID NO: 48053 - protein, 8 aa, Mycobacterium tuberculosis
ESTETTER

SEQ ID NO: 48054 - protein, 8 aa, Mycobacterium tuberculosis
STETTERP

SEQ ID NO: 48055 - protein, 8 aa, Mycobacterium tuberculosis
TETTERPE

SEQ ID NO: 48056 - protein, 8 aa, Mycobacterium tuberculosis
ETTERPEH

SEQ ID NO: 48057 - protein, 8 aa, Mycobacterium tuberculosis
TTERPEHH

SEQ ID NO: 48058 - protein, 8 aa, Mycobacterium tuberculosis
TERPEHHE

SEQ ID NO: 48059 - protein, 8 aa, Mycobacterium tuberculosis
ERPEHHEF

SEQ ID NO: 48060 - protein, 8 aa, Mycobacterium tuberculosis
RPEHHEFK

SEQ ID NO: 48061 - protein, 8 aa, Mycobacterium tuberculosis
PEHHEFKQ

SEQ ID NO: 48062 - protein, 8 aa, Mycobacterium tuberculosis
EHHEFKQA

SEQ ID NO: 48063 - protein, 8 aa, Mycobacterium tuberculosis
HHEFKQAA

SEQ ID NO: 48064 - protein, 8 aa, Mycobacterium tuberculosis
HEFKQAAV

SEQ ID NO: 48065 - protein, 8 aa, Mycobacterium tuberculosis
EFKQAAVL

SEQ ID NO: 48066 - protein, 8 aa, Mycobacterium tuberculosis
FKQAAVLT

SEQ ID NO: 48067 - protein, 8 aa, Mycobacterium tuberculosis
KQAAVLTD

SEQ ID NO: 48068 - protein, 8 aa, Mycobacterium tuberculosis
QAAVLTDL

SEQ ID NO: 48069 - protein, 8 aa, Mycobacterium tuberculosis
AAVLTDLP

SEQ ID NO: 48070 - protein, 8 aa, Mycobacterium tuberculosis
AVLTDLPG

SEQ ID NO: 48071 - protein, 8 aa, Mycobacterium tuberculosis
VLTDLPGE

SEQ ID NO: 48072 - protein, 8 aa, Mycobacterium tuberculosis
LTDLPGEL

SEQ ID NO: 48073 - protein, 8 aa, Mycobacterium tuberculosis
TDLPGELM

SEQ ID NO: 48074 - protein, 8 aa, Mycobacterium tuberculosis
DLPGELMS

SEQ ID NO: 48075 - protein, 8 aa, Mycobacterium tuberculosis
LPGELMSA

SEQ ID NO: 48076 - protein, 8 aa, Mycobacterium tuberculosis
PGELMSAL

SEQ ID NO: 48077 - protein, 8 aa, Mycobacterium tuberculosis
GELMSALS

SEQ ID NO: 48078 - protein, 8 aa, Mycobacterium tuberculosis
ELMSALSQ

SEQ ID NO: 48079 - protein, 8 aa, Mycobacterium tuberculosis
LMSALSQG

SEQ ID NO: 48080 - protein, 8 aa, Mycobacterium tuberculosis
MSALSQGL

SEQ ID NO: 48081 - protein, 8 aa, Mycobacterium tuberculosis
SALSQGLS

SEQ ID NO: 48082 - protein, 8 aa, Mycobacterium tuberculosis
ALSQGLSQ

SEQ ID NO: 48083 - protein, 8 aa, Mycobacterium tuberculosis
LSQGLSQF

SEQ ID NO: 48084 - protein, 8 aa, Mycobacterium tuberculosis
SQGLSQFG

SEQ ID NO: 48085 - protein, 8 aa, Mycobacterium tuberculosis
QGLSQFGI

SEQ ID NO: 48086 - protein, 8 aa, Mycobacterium tuberculosis
GLSQFGIN

SEQ ID NO: 48087 - protein, 8 aa, Mycobacterium tuberculosis
LSQFGINI

SEQ ID NO: 48088 - protein, 8 aa, Mycobacterium tuberculosis
SQFGINIP

SEQ ID NO: 48089 - protein, 8 aa, Mycobacterium tuberculosis
QFGINIPP

SEQ ID NO: 48090 - protein, 8 aa, Mycobacterium tuberculosis
FGINIPPV

SEQ ID NO: 48091 - protein, 8 aa, Mycobacterium tuberculosis
GINIPPVP

SEQ ID NO: 48092 - protein, 8 aa, Mycobacterium tuberculosis
INIPPVPS

SEQ ID NO: 48093 - protein, 8 aa, Mycobacterium tuberculosis
NIPPVPSL

SEQ ID NO: 48094 - protein, 8 aa, Mycobacterium tuberculosis
IPPVPSLT

SEQ ID NO: 48095 - protein, 8 aa, Mycobacterium tuberculosis
PPVPSLTG

SEQ ID NO: 48096 - protein, 8 aa, Mycobacterium tuberculosis
PVPSLTGS

SEQ ID NO: 48097 - protein, 8 aa, Mycobacterium tuberculosis
VPSLTGSG

SEQ ID NO: 48098 - protein, 8 aa, Mycobacterium tuberculosis
PSLTGSGD

SEQ ID NO: 48099 - protein, 8 aa, Mycobacterium tuberculosis
SLTGSGDA

SEQ ID NO: 48100 - protein, 8 aa, Mycobacterium tuberculosis
LTGSGDAS

SEQ ID NO: 48101 - protein, 8 aa, Mycobacterium tuberculosis
TGSGDAST

SEQ ID NO: 48102 - protein, 8 aa, Mycobacterium tuberculosis
GSGDASTG

SEQ ID NO: 48103 - protein, 8 aa, Mycobacterium tuberculosis
SGDASTGL

SEQ ID NO: 48104 - protein, 8 aa, Mycobacterium tuberculosis
GDASTGLT

SEQ ID NO: 48105 - protein, 8 aa, Mycobacterium tuberculosis
DASTGLTG

SEQ ID NO: 48106 - protein, 8 aa, Mycobacterium tuberculosis
ASTGLTGP

SEQ ID NO: 48107 - protein, 8 aa, Mycobacterium tuberculosis
STGLTGPG

SEQ ID NO: 48108 - protein, 8 aa, Mycobacterium tuberculosis
TGLTGPGL

SEQ ID NO: 48109 - protein, 8 aa, Mycobacterium tuberculosis
GLTGPGLT

SEQ ID NO: 48110 - protein, 8 aa, Mycobacterium tuberculosis
LTGPGLTS

SEQ ID NO: 48111 - protein, 8 aa, Mycobacterium tuberculosis
TGPGLTSP

SEQ ID NO: 48112 - protein, 8 aa, Mycobacterium tuberculosis
GPGLTSPG

SEQ ID NO: 48113 - protein, 8 aa, Mycobacterium tuberculosis
PGLTSPGL

SEQ ID NO: 48114 - protein, 8 aa, Mycobacterium tuberculosis
GLTSPGLT

SEQ ID NO: 48115 - protein, 8 aa, Mycobacterium tuberculosis
LTSPGLTS

SEQ ID NO: 48116 - protein, 8 aa, Mycobacterium tuberculosis
TSPGLTSP

SEQ ID NO: 48117 - protein, 8 aa, Mycobacterium tuberculosis
SPGLTSPG

SEQ ID NO: 48118 - protein, 8 aa, Mycobacterium tuberculosis
PGLTSPGL

SEQ ID NO: 48119 - protein, 8 aa, Mycobacterium tuberculosis
GLTSPGLT

SEQ ID NO: 48120 - protein, 8 aa, Mycobacterium tuberculosis
LTSPGLTS

SEQ ID NO: 48121 - protein, 8 aa, Mycobacterium tuberculosis
TSPGLTSP

SEQ ID NO: 48122 - protein, 8 aa, Mycobacterium tuberculosis
SPGLTSPG

SEQ ID NO: 48123 - protein, 8 aa, Mycobacterium tuberculosis
PGLTSPGL

SEQ ID NO: 48124 - protein, 8 aa, Mycobacterium tuberculosis
GLTSPGLT

SEQ ID NO: 48125 - protein, 8 aa, Mycobacterium tuberculosis
LTSPGLTD

SEQ ID NO: 48126 - protein, 8 aa, Mycobacterium tuberculosis
TSPGLTDP

SEQ ID NO: 48127 - protein, 8 aa, Mycobacterium tuberculosis
SPGLTDPA

SEQ ID NO: 48128 - protein, 8 aa, Mycobacterium tuberculosis
PGLTDPAL

SEQ ID NO: 48129 - protein, 8 aa, Mycobacterium tuberculosis
GLTDPALT

SEQ ID NO: 48130 - protein, 8 aa, Mycobacterium tuberculosis
LTDPALTS

SEQ ID NO: 48131 - protein, 8 aa, Mycobacterium tuberculosis
TDPALTSP

SEQ ID NO: 48132 - protein, 8 aa, Mycobacterium tuberculosis
DPALTSPG

SEQ ID NO: 48133 - protein, 8 aa, Mycobacterium tuberculosis
PALTSPGL

SEQ ID NO: 48134 - protein, 8 aa, Mycobacterium tuberculosis
ALTSPGLT

SEQ ID NO: 48135 - protein, 8 aa, Mycobacterium tuberculosis
LTSPGLTP

SEQ ID NO: 48136 - protein, 8 aa, Mycobacterium tuberculosis
TSPGLTPT

SEQ ID NO: 48137 - protein, 8 aa, Mycobacterium tuberculosis
SPGLTPTL

SEQ ID NO: 48138 - protein, 8 aa, Mycobacterium tuberculosis
PGLTPTLP

SEQ ID NO: 48139 - protein, 8 aa, Mycobacterium tuberculosis
GLTPTLPG

SEQ ID NO: 48140 - protein, 8 aa, Mycobacterium tuberculosis
LTPTLPGS

SEQ ID NO: 48141 - protein, 8 aa, Mycobacterium tuberculosis
TPTLPGSL

SEQ ID NO: 48142 - protein, 8 aa, Mycobacterium tuberculosis
PTLPGSLA

SEQ ID NO: 48143 - protein, 8 aa, Mycobacterium tuberculosis
TLPGSLAA

SEQ ID NO: 48144 - protein, 8 aa, Mycobacterium tuberculosis
LPGSLAAP

SEQ ID NO: 48145 - protein, 8 aa, Mycobacterium tuberculosis
PGSLAAPG

SEQ ID NO: 48146 - protein, 8 aa, Mycobacterium tuberculosis
GSLAAPGT

SEQ ID NO: 48147 - protein, 8 aa, Mycobacterium tuberculosis
SLAAPGTT

SEQ ID NO: 48148 - protein, 8 aa, Mycobacterium tuberculosis
LAAPGTTL

SEQ ID NO: 48149 - protein, 8 aa, Mycobacterium tuberculosis
AAPGTTLA

SEQ ID NO: 48150 - protein, 8 aa, Mycobacterium tuberculosis
APGTTLAP

SEQ ID NO: 48151 - protein, 8 aa, Mycobacterium tuberculosis
PGTTLAPT

SEQ ID NO: 48152 - protein, 8 aa, Mycobacterium tuberculosis
GTTLAPTP

SEQ ID NO: 48153 - protein, 8 aa, Mycobacterium tuberculosis
TTLAPTPG

SEQ ID NO: 48154 - protein, 8 aa, Mycobacterium tuberculosis
TLAPTPGV

SEQ ID NO: 48155 - protein, 8 aa, Mycobacterium tuberculosis
LAPTPGVG

SEQ ID NO: 48156 - protein, 8 aa, Mycobacterium tuberculosis
APTPGVGA

SEQ ID NO: 48157 - protein, 8 aa, Mycobacterium tuberculosis
PTPGVGAN

SEQ ID NO: 48158 - protein, 8 aa, Mycobacterium tuberculosis
TPGVGANP

SEQ ID NO: 48159 - protein, 8 aa, Mycobacterium tuberculosis
PGVGANPA

SEQ ID NO: 48160 - protein, 8 aa, Mycobacterium tuberculosis
GVGANPAL

SEQ ID NO: 48161 - protein, 8 aa, Mycobacterium tuberculosis
VGANPALT

SEQ ID NO: 48162 - protein, 8 aa, Mycobacterium tuberculosis
GANPALTN

SEQ ID NO: 48163 - protein, 8 aa, Mycobacterium tuberculosis
ANPALTNP

SEQ ID NO: 48164 - protein, 8 aa, Mycobacterium tuberculosis
NPALTNPA

SEQ ID NO: 48165 - protein, 8 aa, Mycobacterium tuberculosis
PALTNPAL

SEQ ID NO: 48166 - protein, 8 aa, Mycobacterium tuberculosis
ALTNPALT

SEQ ID NO: 48167 - protein, 8 aa, Mycobacterium tuberculosis
LTNPALTS

SEQ ID NO: 48168 - protein, 8 aa, Mycobacterium tuberculosis
TNPALTSP

SEQ ID NO: 48169 - protein, 8 aa, Mycobacterium tuberculosis
NPALTSPT

SEQ ID NO: 48170 - protein, 8 aa, Mycobacterium tuberculosis
PALTSPTG

SEQ ID NO: 48171 - protein, 8 aa, Mycobacterium tuberculosis
ALTSPTGA

SEQ ID NO: 48172 - protein, 8 aa, Mycobacterium tuberculosis
LTSPTGAT

SEQ ID NO: 48173 - protein, 8 aa, Mycobacterium tuberculosis
TSPTGATP

SEQ ID NO: 48174 - protein, 8 aa, Mycobacterium tuberculosis
SPTGATPG

SEQ ID NO: 48175 - protein, 8 aa, Mycobacterium tuberculosis
PTGATPGL

SEQ ID NO: 48176 - protein, 8 aa, Mycobacterium tuberculosis
TGATPGLT

SEQ ID NO: 48177 - protein, 8 aa, Mycobacterium tuberculosis
GATPGLTS

SEQ ID NO: 48178 - protein, 8 aa, Mycobacterium tuberculosis
ATPGLTSP

SEQ ID NO: 48179 - protein, 8 aa, Mycobacterium tuberculosis
TPGLTSPT

SEQ ID NO: 48180 - protein, 8 aa, Mycobacterium tuberculosis
PGLTSPTG

SEQ ID NO: 48181 - protein, 8 aa, Mycobacterium tuberculosis
GLTSPTGL

SEQ ID NO: 48182 - protein, 8 aa, Mycobacterium tuberculosis
LTSPTGLD

SEQ ID NO: 48183 - protein, 8 aa, Mycobacterium tuberculosis
TSPTGLDP

SEQ ID NO: 48184 - protein, 8 aa, Mycobacterium tuberculosis
SPTGLDPA

SEQ ID NO: 48185 - protein, 8 aa, Mycobacterium tuberculosis
PTGLDPAL

SEQ ID NO: 48186 - protein, 8 aa, Mycobacterium tuberculosis
TGLDPALG

SEQ ID NO: 48187 - protein, 8 aa, Mycobacterium tuberculosis
GLDPALGG

SEQ ID NO: 48188 - protein, 8 aa, Mycobacterium tuberculosis
LDPALGGA

SEQ ID NO: 48189 - protein, 8 aa, Mycobacterium tuberculosis
DPALGGAN

SEQ ID NO: 48190 - protein, 8 aa, Mycobacterium tuberculosis
PALGGANE

SEQ ID NO: 48191 - protein, 8 aa, Mycobacterium tuberculosis
ALGGANEI

SEQ ID NO: 48192 - protein, 8 aa, Mycobacterium tuberculosis
LGGANEIP

SEQ ID NO: 48193 - protein, 8 aa, Mycobacterium tuberculosis
GGANEIPI

SEQ ID NO: 48194 - protein, 8 aa, Mycobacterium tuberculosis
GANEIPIT

SEQ ID NO: 48195 - protein, 8 aa, Mycobacterium tuberculosis
ANEIPITT

SEQ ID NO: 48196 - protein, 8 aa, Mycobacterium tuberculosis
NEIPITTP

SEQ ID NO: 48197 - protein, 8 aa, Mycobacterium tuberculosis
EIPITTPV

SEQ ID NO: 48198 - protein, 8 aa, Mycobacterium tuberculosis
IPITTPVG

SEQ ID NO: 48199 - protein, 8 aa, Mycobacterium tuberculosis
PITTPVGL

SEQ ID NO: 48200 - protein, 8 aa, Mycobacterium tuberculosis
ITTPVGLD

SEQ ID NO: 48201 - protein, 8 aa, Mycobacterium tuberculosis
TTPVGLDP

SEQ ID NO: 48202 - protein, 8 aa, Mycobacterium tuberculosis
TPVGLDPG

SEQ ID NO: 48203 - protein, 8 aa, Mycobacterium tuberculosis
PVGLDPGA

SEQ ID NO: 48204 - protein, 8 aa, Mycobacterium tuberculosis
VGLDPGAD

SEQ ID NO: 48205 - protein, 8 aa, Mycobacterium tuberculosis
GLDPGADG

SEQ ID NO: 48206 - protein, 8 aa, Mycobacterium tuberculosis
LDPGADGT

SEQ ID NO: 48207 - protein, 8 aa, Mycobacterium tuberculosis
DPGADGTY

SEQ ID NO: 48208 - protein, 8 aa, Mycobacterium tuberculosis
PGADGTYP

SEQ ID NO: 48209 - protein, 8 aa, Mycobacterium tuberculosis
GADGTYPI

SEQ ID NO: 48210 - protein, 8 aa, Mycobacterium tuberculosis
ADGTYPIL

SEQ ID NO: 48211 - protein, 8 aa, Mycobacterium tuberculosis
DGTYPILG

SEQ ID NO: 48212 - protein, 8 aa, Mycobacterium tuberculosis
GTYPILGD

SEQ ID NO: 48213 - protein, 8 aa, Mycobacterium tuberculosis
TYPILGDP

SEQ ID NO: 48214 - protein, 8 aa, Mycobacterium tuberculosis
YPILGDPT

SEQ ID NO: 48215 - protein, 8 aa, Mycobacterium tuberculosis
PILGDPTL

SEQ ID NO: 48216 - protein, 8 aa, Mycobacterium tuberculosis
ILGDPTLG

SEQ ID NO: 48217 - protein, 8 aa, Mycobacterium tuberculosis
LGDPTLGT

SEQ ID NO: 48218 - protein, 8 aa, Mycobacterium tuberculosis
GDPTLGTI

SEQ ID NO: 48219 - protein, 8 aa, Mycobacterium tuberculosis
DPTLGTIP

SEQ ID NO: 48220 - protein, 8 aa, Mycobacterium tuberculosis
PTLGTIPS

SEQ ID NO: 48221 - protein, 8 aa, Mycobacterium tuberculosis
TLGTIPSS

SEQ ID NO: 48222 - protein, 8 aa, Mycobacterium tuberculosis
LGTIPSSP

SEQ ID NO: 48223 - protein, 8 aa, Mycobacterium tuberculosis
GTIPSSPA

SEQ ID NO: 48224 - protein, 8 aa, Mycobacterium tuberculosis
TIPSSPAT

SEQ ID NO: 48225 - protein, 8 aa, Mycobacterium tuberculosis
IPSSPATT

SEQ ID NO: 48226 - protein, 8 aa, Mycobacterium tuberculosis
PSSPATTS

SEQ ID NO: 48227 - protein, 8 aa, Mycobacterium tuberculosis
SSPATTST

SEQ ID NO: 48228 - protein, 8 aa, Mycobacterium tuberculosis
SPATTSTG

SEQ ID NO: 48229 - protein, 8 aa, Mycobacterium tuberculosis
PATTSTGG

SEQ ID NO: 48230 - protein, 8 aa, Mycobacterium tuberculosis
ATTSTGGG

SEQ ID NO: 48231 - protein, 8 aa, Mycobacterium tuberculosis
TTSTGGGG

SEQ ID NO: 48232 - protein, 8 aa, Mycobacterium tuberculosis
TSTGGGGL

SEQ ID NO: 48233 - protein, 8 aa, Mycobacterium tuberculosis
STGGGGLV

SEQ ID NO: 48234 - protein, 8 aa, Mycobacterium tuberculosis
TGGGGLVN

SEQ ID NO: 48235 - protein, 8 aa, Mycobacterium tuberculosis
GGGGLVND

SEQ ID NO: 48236 - protein, 8 aa, Mycobacterium tuberculosis
GGGLVNDV

SEQ ID NO: 48237 - protein, 8 aa, Mycobacterium tuberculosis
GGLVNDVM

SEQ ID NO: 48238 - protein, 8 aa, Mycobacterium tuberculosis
GLVNDVMQ

SEQ ID NO: 48239 - protein, 8 aa, Mycobacterium tuberculosis
LVNDVMQV

SEQ ID NO: 48240 - protein, 8 aa, Mycobacterium tuberculosis
VNDVMQVA

SEQ ID NO: 48241 - protein, 8 aa, Mycobacterium tuberculosis
NDVMQVAN

SEQ ID NO: 48242 - protein, 8 aa, Mycobacterium tuberculosis
DVMQVANE

SEQ ID NO: 48243 - protein, 8 aa, Mycobacterium tuberculosis
VMQVANEL

SEQ ID NO: 48244 - protein, 8 aa, Mycobacterium tuberculosis
MQVANELG

SEQ ID NO: 48245 - protein, 8 aa, Mycobacterium tuberculosis
QVANELGA

SEQ ID NO: 48246 - protein, 8 aa, Mycobacterium tuberculosis
VANELGAS

SEQ ID NO: 48247 - protein, 8 aa, Mycobacterium tuberculosis
ANELGASQ

SEQ ID NO: 48248 - protein, 8 aa, Mycobacterium tuberculosis
NELGASQA

SEQ ID NO: 48249 - protein, 8 aa, Mycobacterium tuberculosis
ELGASQAI

SEQ ID NO: 48250 - protein, 8 aa, Mycobacterium tuberculosis
LGASQAID

SEQ ID NO: 48251 - protein, 8 aa, Mycobacterium tuberculosis
GASQAIDL

SEQ ID NO: 48252 - protein, 8 aa, Mycobacterium tuberculosis
ASQAIDLL

SEQ ID NO: 48253 - protein, 8 aa, Mycobacterium tuberculosis
SQAIDLLK

SEQ ID NO: 48254 - protein, 8 aa, Mycobacterium tuberculosis
QAIDLLKG

SEQ ID NO: 48255 - protein, 8 aa, Mycobacterium tuberculosis
AIDLLKGV

SEQ ID NO: 48256 - protein, 8 aa, Mycobacterium tuberculosis
IDLLKGVL

SEQ ID NO: 48257 - protein, 8 aa, Mycobacterium tuberculosis
DLLKGVLM

SEQ ID NO: 48258 - protein, 8 aa, Mycobacterium tuberculosis
LLKGVLMP

SEQ ID NO: 48259 - protein, 8 aa, Mycobacterium tuberculosis
LKGVLMPS

SEQ ID NO: 48260 - protein, 8 aa, Mycobacterium tuberculosis
KGVLMPSI

SEQ ID NO: 48261 - protein, 8 aa, Mycobacterium tuberculosis
GVLMPSIM

SEQ ID NO: 48262 - protein, 8 aa, Mycobacterium tuberculosis
VLMPSIMQ

SEQ ID NO: 48263 - protein, 8 aa, Mycobacterium tuberculosis
LMPSIMQA

SEQ ID NO: 48264 - protein, 8 aa, Mycobacterium tuberculosis
MPSIMQAV

SEQ ID NO: 48265 - protein, 8 aa, Mycobacterium tuberculosis
PSIMQAVQ

SEQ ID NO: 48266 - protein, 8 aa, Mycobacterium tuberculosis
SIMQAVQN

SEQ ID NO: 48267 - protein, 8 aa, Mycobacterium tuberculosis
IMQAVQNG

SEQ ID NO: 48268 - protein, 8 aa, Mycobacterium tuberculosis
MQAVQNGG

SEQ ID NO: 48269 - protein, 8 aa, Mycobacterium tuberculosis
QAVQNGGA

SEQ ID NO: 48270 - protein, 8 aa, Mycobacterium tuberculosis
AVQNGGAA

SEQ ID NO: 48271 - protein, 8 aa, Mycobacterium tuberculosis
VQNGGAAA

SEQ ID NO: 48272 - protein, 8 aa, Mycobacterium tuberculosis
QNGGAAAP

SEQ ID NO: 48273 - protein, 8 aa, Mycobacterium tuberculosis
NGGAAAPA

SEQ ID NO: 48274 - protein, 8 aa, Mycobacterium tuberculosis
GGAAAPAA

SEQ ID NO: 48275 - protein, 8 aa, Mycobacterium tuberculosis
GAAAPAAS

SEQ ID NO: 48276 - protein, 8 aa, Mycobacterium tuberculosis
AAAPAASP

SEQ ID NO: 48277 - protein, 8 aa, Mycobacterium tuberculosis
AAPAASPP

SEQ ID NO: 48278 - protein, 8 aa, Mycobacterium tuberculosis
APAASPPV

SEQ ID NO: 48279 - protein, 8 aa, Mycobacterium tuberculosis
PAASPPVP

SEQ ID NO: 48280 - protein, 8 aa, Mycobacterium tuberculosis
AASPPVPP

SEQ ID NO: 48281 - protein, 8 aa, Mycobacterium tuberculosis
ASPPVPPI

SEQ ID NO: 48282 - protein, 8 aa, Mycobacterium tuberculosis
SPPVPPIP

SEQ ID NO: 48283 - protein, 8 aa, Mycobacterium tuberculosis
PPVPPIPA

SEQ ID NO: 48284 - protein, 8 aa, Mycobacterium tuberculosis
PVPPIPAA

SEQ ID NO: 48285 - protein, 8 aa, Mycobacterium tuberculosis
VPPIPAAA

SEQ ID NO: 48286 - protein, 8 aa, Mycobacterium tuberculosis
PPIPAAAA

SEQ ID NO: 48287 - protein, 8 aa, Mycobacterium tuberculosis
PIPAAAAV

SEQ ID NO: 48288 - protein, 8 aa, Mycobacterium tuberculosis
IPAAAAVP

SEQ ID NO: 48289 - protein, 8 aa, Mycobacterium tuberculosis
PAAAAVPP

SEQ ID NO: 48290 - protein, 8 aa, Mycobacterium tuberculosis
AAAAVPPT

SEQ ID NO: 48291 - protein, 8 aa, Mycobacterium tuberculosis
AAAVPPTD

SEQ ID NO: 48292 - protein, 8 aa, Mycobacterium tuberculosis
AAVPPTDP

SEQ ID NO: 48293 - protein, 8 aa, Mycobacterium tuberculosis
AVPPTDPI

SEQ ID NO: 48294 - protein, 8 aa, Mycobacterium tuberculosis
VPPTDPIT

SEQ ID NO: 48295 - protein, 8 aa, Mycobacterium tuberculosis
PPTDPITV

SEQ ID NO: 48296 - protein, 8 aa, Mycobacterium tuberculosis
PTDPITVP

SEQ ID NO: 48297 - protein, 8 aa, Mycobacterium tuberculosis
TDPITVPV

SEQ ID NO: 48298 - protein, 8 aa, Mycobacterium tuberculosis
DPITVPVA

SEQ ID NO: 48299 - protein, 9 aa, Mycobacterium tuberculosis
MPNRRRRKL

SEQ ID NO: 48300 - protein, 9 aa, Mycobacterium tuberculosis
PNRRRRKLS

SEQ ID NO: 48301 - protein, 9 aa, Mycobacterium tuberculosis
NRRRRKLST

SEQ ID NO: 48302 - protein, 9 aa, Mycobacterium tuberculosis
RRRRKLSTA

SEQ ID NO: 48303 - protein, 9 aa, Mycobacterium tuberculosis
RRRKLSTAM

SEQ ID NO: 48304 - protein, 9 aa, Mycobacterium tuberculosis
RRKLSTAMS

SEQ ID NO: 48305 - protein, 9 aa, Mycobacterium tuberculosis
RKLSTAMSA

SEQ ID NO: 48306 - protein, 9 aa, Mycobacterium tuberculosis
KLSTAMSAV

SEQ ID NO: 48307 - protein, 9 aa, Mycobacterium tuberculosis
LSTAMSAVA

SEQ ID NO: 48308 - protein, 9 aa, Mycobacterium tuberculosis
STAMSAVAA

SEQ ID NO: 48309 - protein, 9 aa, Mycobacterium tuberculosis
TAMSAVAAL

SEQ ID NO: 48310 - protein, 9 aa, Mycobacterium tuberculosis
AMSAVAALA

SEQ ID NO: 48311 - protein, 9 aa, Mycobacterium tuberculosis
MSAVAALAV

SEQ ID NO: 48312 - protein, 9 aa, Mycobacterium tuberculosis
SAVAALAVA

SEQ ID NO: 48313 - protein, 9 aa, Mycobacterium tuberculosis
AVAALAVAS

SEQ ID NO: 48314 - protein, 9 aa, Mycobacterium tuberculosis
VAALAVASP

SEQ ID NO: 48315 - protein, 9 aa, Mycobacterium tuberculosis
AALAVASPC

SEQ ID NO: 48316 - protein, 9 aa, Mycobacterium tuberculosis
ALAVASPCA

SEQ ID NO: 48317 - protein, 9 aa, Mycobacterium tuberculosis
LAVASPCAY

SEQ ID NO: 48318 - protein, 9 aa, Mycobacterium tuberculosis
AVASPCAYF

SEQ ID NO: 48319 - protein, 9 aa, Mycobacterium tuberculosis
VASPCAYFL

SEQ ID NO: 48320 - protein, 9 aa, Mycobacterium tuberculosis
ASPCAYFLV

SEQ ID NO: 48321 - protein, 9 aa, Mycobacterium tuberculosis
SPCAYFLVY

SEQ ID NO: 48322 - protein, 9 aa, Mycobacterium tuberculosis
PCAYFLVYE

SEQ ID NO: 48323 - protein, 9 aa, Mycobacterium tuberculosis
CAYFLVYES

SEQ ID NO: 48324 - protein, 9 aa, Mycobacterium tuberculosis
AYFLVYEST

SEQ ID NO: 48325 - protein, 9 aa, Mycobacterium tuberculosis
YFLVYESTE

SEQ ID NO: 48326 - protein, 9 aa, Mycobacterium tuberculosis
FLVYESTET

SEQ ID NO: 48327 - protein, 9 aa, Mycobacterium tuberculosis
LVYESTETT

SEQ ID NO: 48328 - protein, 9 aa, Mycobacterium tuberculosis
VYESTETTE

SEQ ID NO: 48329 - protein, 9 aa, Mycobacterium tuberculosis
YESTETTER

SEQ ID NO: 48330 - protein, 9 aa, Mycobacterium tuberculosis
ESTETTERP

SEQ ID NO: 48331 - protein, 9 aa, Mycobacterium tuberculosis
STETTERPE

SEQ ID NO: 48332 - protein, 9 aa, Mycobacterium tuberculosis
TETTERPEH

SEQ ID NO: 48333 - protein, 9 aa, Mycobacterium tuberculosis
ETTERPEHH

SEQ ID NO: 48334 - protein, 9 aa, Mycobacterium tuberculosis
TTERPEHHE

SEQ ID NO: 48335 - protein, 9 aa, Mycobacterium tuberculosis
TERPEHHEF

SEQ ID NO: 48336 - protein, 9 aa, Mycobacterium tuberculosis
ERPEHHEFK

SEQ ID NO: 48337 - protein, 9 aa, Mycobacterium tuberculosis
RPEHHEFKQ

SEQ ID NO: 48338 - protein, 9 aa, Mycobacterium tuberculosis
PEHHEFKQA

SEQ ID NO: 48339 - protein, 9 aa, Mycobacterium tuberculosis
EHHEFKQAA

SEQ ID NO: 48340 - protein, 9 aa, Mycobacterium tuberculosis
HHEFKQAAV

SEQ ID NO: 48341 - protein, 9 aa, Mycobacterium tuberculosis
HEFKQAAVL

SEQ ID NO: 48342 - protein, 9 aa, Mycobacterium tuberculosis
EFKQAAVLT

SEQ ID NO: 48343 - protein, 9 aa, Mycobacterium tuberculosis
FKQAAVLTD

SEQ ID NO: 48344 - protein, 9 aa, Mycobacterium tuberculosis
KQAAVLTDL

SEQ ID NO: 48345 - protein, 9 aa, Mycobacterium tuberculosis
QAAVLTDLP

SEQ ID NO: 48346 - protein, 9 aa, Mycobacterium tuberculosis
AAVLTDLPG

SEQ ID NO: 48347 - protein, 9 aa, Mycobacterium tuberculosis
AVLTDLPGE

SEQ ID NO: 48348 - protein, 9 aa, Mycobacterium tuberculosis
VLTDLPGEL

SEQ ID NO: 48349 - protein, 9 aa, Mycobacterium tuberculosis
LTDLPGELM

SEQ ID NO: 48350 - protein, 9 aa, Mycobacterium tuberculosis
TDLPGELMS

SEQ ID NO: 48351 - protein, 9 aa, Mycobacterium tuberculosis
DLPGELMSA

SEQ ID NO: 48352 - protein, 9 aa, Mycobacterium tuberculosis
LPGELMSAL

SEQ ID NO: 48353 - protein, 9 aa, Mycobacterium tuberculosis
PGELMSALS

SEQ ID NO: 48354 - protein, 9 aa, Mycobacterium tuberculosis
GELMSALSQ

SEQ ID NO: 48355 - protein, 9 aa, Mycobacterium tuberculosis
ELMSALSQG

SEQ ID NO: 48356 - protein, 9 aa, Mycobacterium tuberculosis
LMSALSQGL

SEQ ID NO: 48357 - protein, 9 aa, Mycobacterium tuberculosis
MSALSQGLS

SEQ ID NO: 48358 - protein, 9 aa, Mycobacterium tuberculosis
SALSQGLSQ

SEQ ID NO: 48359 - protein, 9 aa, Mycobacterium tuberculosis
ALSQGLSQF

SEQ ID NO: 48360 - protein, 9 aa, Mycobacterium tuberculosis
LSQGLSQFG

SEQ ID NO: 48361 - protein, 9 aa, Mycobacterium tuberculosis
SQGLSQFGI

SEQ ID NO: 48362 - protein, 9 aa, Mycobacterium tuberculosis
QGLSQFGIN

SEQ ID NO: 48363 - protein, 9 aa, Mycobacterium tuberculosis
GLSQFGINI

SEQ ID NO: 48364 - protein, 9 aa, Mycobacterium tuberculosis
LSQFGINIP

SEQ ID NO: 48365 - protein, 9 aa, Mycobacterium tuberculosis
SQFGINIPP

SEQ ID NO: 48366 - protein, 9 aa, Mycobacterium tuberculosis
QFGINIPPV

SEQ ID NO: 48367 - protein, 9 aa, Mycobacterium tuberculosis
FGINIPPVP

SEQ ID NO: 48368 - protein, 9 aa, Mycobacterium tuberculosis
GINIPPVPS

SEQ ID NO: 48369 - protein, 9 aa, Mycobacterium tuberculosis
INIPPVPSL

SEQ ID NO: 48370 - protein, 9 aa, Mycobacterium tuberculosis
NIPPVPSLT

SEQ ID NO: 48371 - protein, 9 aa, Mycobacterium tuberculosis
IPPVPSLTG

SEQ ID NO: 48372 - protein, 9 aa, Mycobacterium tuberculosis
PPVPSLTGS

SEQ ID NO: 48373 - protein, 9 aa, Mycobacterium tuberculosis
PVPSLTGSG

SEQ ID NO: 48374 - protein, 9 aa, Mycobacterium tuberculosis
VPSLTGSGD

SEQ ID NO: 48375 - protein, 9 aa, Mycobacterium tuberculosis
PSLTGSGDA

SEQ ID NO: 48376 - protein, 9 aa, Mycobacterium tuberculosis
SLTGSGDAS

SEQ ID NO: 48377 - protein, 9 aa, Mycobacterium tuberculosis
LTGSGDAST

SEQ ID NO: 48378 - protein, 9 aa, Mycobacterium tuberculosis
TGSGDASTG

SEQ ID NO: 48379 - protein, 9 aa, Mycobacterium tuberculosis
GSGDASTGL

SEQ ID NO: 48380 - protein, 9 aa, Mycobacterium tuberculosis
SGDASTGLT

SEQ ID NO: 48381 - protein, 9 aa, Mycobacterium tuberculosis
GDASTGLTG

SEQ ID NO: 48382 - protein, 9 aa, Mycobacterium tuberculosis
DASTGLTGP

SEQ ID NO: 48383 - protein, 9 aa, Mycobacterium tuberculosis
ASTGLTGPG

SEQ ID NO: 48384 - protein, 9 aa, Mycobacterium tuberculosis
STGLTGPGL

SEQ ID NO: 48385 - protein, 9 aa, Mycobacterium tuberculosis
TGLTGPGLT

SEQ ID NO: 48386 - protein, 9 aa, Mycobacterium tuberculosis
GLTGPGLTS

SEQ ID NO: 48387 - protein, 9 aa, Mycobacterium tuberculosis
LTGPGLTSP

SEQ ID NO: 48388 - protein, 9 aa, Mycobacterium tuberculosis
TGPGLTSPG

SEQ ID NO: 48389 - protein, 9 aa, Mycobacterium tuberculosis
GPGLTSPGL

SEQ ID NO: 48390 - protein, 9 aa, Mycobacterium tuberculosis
PGLTSPGLT

SEQ ID NO: 48391 - protein, 9 aa, Mycobacterium tuberculosis
GLTSPGLTS

SEQ ID NO: 48392 - protein, 9 aa, Mycobacterium tuberculosis
LTSPGLTSP

SEQ ID NO: 48393 - protein, 9 aa, Mycobacterium tuberculosis
TSPGLTSPG

SEQ ID NO: 48394 - protein, 9 aa, Mycobacterium tuberculosis
SPGLTSPGL

SEQ ID NO: 48395 - protein, 9 aa, Mycobacterium tuberculosis
PGLTSPGLT

SEQ ID NO: 48396 - protein, 9 aa, Mycobacterium tuberculosis
GLTSPGLTS

SEQ ID NO: 48397 - protein, 9 aa, Mycobacterium tuberculosis
LTSPGLTSP

SEQ ID NO: 48398 - protein, 9 aa, Mycobacterium tuberculosis
TSPGLTSPG

SEQ ID NO: 48399 - protein, 9 aa, Mycobacterium tuberculosis
SPGLTSPGL

SEQ ID NO: 48400 - protein, 9 aa, Mycobacterium tuberculosis
PGLTSPGLT

SEQ ID NO: 48401 - protein, 9 aa, Mycobacterium tuberculosis
GLTSPGLTD

SEQ ID NO: 48402 - protein, 9 aa, Mycobacterium tuberculosis
LTSPGLTDP

SEQ ID NO: 48403 - protein, 9 aa, Mycobacterium tuberculosis
TSPGLTDPA

SEQ ID NO: 48404 - protein, 9 aa, Mycobacterium tuberculosis
SPGLTDPAL

SEQ ID NO: 48405 - protein, 9 aa, Mycobacterium tuberculosis
PGLTDPALT

SEQ ID NO: 48406 - protein, 9 aa, Mycobacterium tuberculosis
GLTDPALTS

SEQ ID NO: 48407 - protein, 9 aa, Mycobacterium tuberculosis
LTDPALTSP

SEQ ID NO: 48408 - protein, 9 aa, Mycobacterium tuberculosis
TDPALTSPG

SEQ ID NO: 48409 - protein, 9 aa, Mycobacterium tuberculosis
DPALTSPGL

SEQ ID NO: 48410 - protein, 9 aa, Mycobacterium tuberculosis
PALTSPGLT

SEQ ID NO: 48411 - protein, 9 aa, Mycobacterium tuberculosis
ALTSPGLTP

SEQ ID NO: 48412 - protein, 9 aa, Mycobacterium tuberculosis
LTSPGLTPT

SEQ ID NO: 48413 - protein, 9 aa, Mycobacterium tuberculosis
TSPGLTPTL

SEQ ID NO: 48414 - protein, 9 aa, Mycobacterium tuberculosis
SPGLTPTLP

SEQ ID NO: 48415 - protein, 9 aa, Mycobacterium tuberculosis
PGLTPTLPG

SEQ ID NO: 48416 - protein, 9 aa, Mycobacterium tuberculosis
GLTPTLPGS

SEQ ID NO: 48417 - protein, 9 aa, Mycobacterium tuberculosis
LTPTLPGSL

SEQ ID NO: 48418 - protein, 9 aa, Mycobacterium tuberculosis
TPTLPGSLA

SEQ ID NO: 48419 - protein, 9 aa, Mycobacterium tuberculosis
PTLPGSLAA

SEQ ID NO: 48420 - protein, 9 aa, Mycobacterium tuberculosis
TLPGSLAAP

SEQ ID NO: 48421 - protein, 9 aa, Mycobacterium tuberculosis
LPGSLAAPG

SEQ ID NO: 48422 - protein, 9 aa, Mycobacterium tuberculosis
PGSLAAPGT

SEQ ID NO: 48423 - protein, 9 aa, Mycobacterium tuberculosis
GSLAAPGTT

SEQ ID NO: 48424 - protein, 9 aa, Mycobacterium tuberculosis
SLAAPGTTL

SEQ ID NO: 48425 - protein, 9 aa, Mycobacterium tuberculosis
LAAPGTTLA

SEQ ID NO: 48426 - protein, 9 aa, Mycobacterium tuberculosis
AAPGTTLAP

SEQ ID NO: 48427 - protein, 9 aa, Mycobacterium tuberculosis
APGTTLAPT

SEQ ID NO: 48428 - protein, 9 aa, Mycobacterium tuberculosis
PGTTLAPTP

SEQ ID NO: 48429 - protein, 9 aa, Mycobacterium tuberculosis
GTTLAPTPG

SEQ ID NO: 48430 - protein, 9 aa, Mycobacterium tuberculosis
TTLAPTPGV

SEQ ID NO: 48431 - protein, 9 aa, Mycobacterium tuberculosis
TLAPTPGVG

SEQ ID NO: 48432 - protein, 9 aa, Mycobacterium tuberculosis
LAPTPGVGA

SEQ ID NO: 48433 - protein, 9 aa, Mycobacterium tuberculosis
APTPGVGAN

SEQ ID NO: 48434 - protein, 9 aa, Mycobacterium tuberculosis
PTPGVGANP

SEQ ID NO: 48435 - protein, 9 aa, Mycobacterium tuberculosis
TPGVGANPA

SEQ ID NO: 48436 - protein, 9 aa, Mycobacterium tuberculosis
PGVGANPAL

SEQ ID NO: 48437 - protein, 9 aa, Mycobacterium tuberculosis
GVGANPALT

SEQ ID NO: 48438 - protein, 9 aa, Mycobacterium tuberculosis
VGANPALTN

SEQ ID NO: 48439 - protein, 9 aa, Mycobacterium tuberculosis
GANPALTNP

SEQ ID NO: 48440 - protein, 9 aa, Mycobacterium tuberculosis
ANPALTNPA

SEQ ID NO: 48441 - protein, 9 aa, Mycobacterium tuberculosis
NPALTNPAL

SEQ ID NO: 48442 - protein, 9 aa, Mycobacterium tuberculosis
PALTNPALT

SEQ ID NO: 48443 - protein, 9 aa, Mycobacterium tuberculosis
ALTNPALTS

SEQ ID NO: 48444 - protein, 9 aa, Mycobacterium tuberculosis
LTNPALTSP

SEQ ID NO: 48445 - protein, 9 aa, Mycobacterium tuberculosis
TNPALTSPT

SEQ ID NO: 48446 - protein, 9 aa, Mycobacterium tuberculosis
NPALTSPTG

SEQ ID NO: 48447 - protein, 9 aa, Mycobacterium tuberculosis
PALTSPTGA

SEQ ID NO: 48448 - protein, 9 aa, Mycobacterium tuberculosis
ALTSPTGAT

SEQ ID NO: 48449 - protein, 9 aa, Mycobacterium tuberculosis
LTSPTGATP

SEQ ID NO: 48450 - protein, 9 aa, Mycobacterium tuberculosis
TSPTGATPG

SEQ ID NO: 48451 - protein, 9 aa, Mycobacterium tuberculosis
SPTGATPGL

SEQ ID NO: 48452 - protein, 9 aa, Mycobacterium tuberculosis
PTGATPGLT

SEQ ID NO: 48453 - protein, 9 aa, Mycobacterium tuberculosis
TGATPGLTS

SEQ ID NO: 48454 - protein, 9 aa, Mycobacterium tuberculosis
GATPGLTSP

SEQ ID NO: 48455 - protein, 9 aa, Mycobacterium tuberculosis
ATPGLTSPT

SEQ ID NO: 48456 - protein, 9 aa, Mycobacterium tuberculosis
TPGLTSPTG

SEQ ID NO: 48457 - protein, 9 aa, Mycobacterium tuberculosis
PGLTSPTGL

SEQ ID NO: 48458 - protein, 9 aa, Mycobacterium tuberculosis
GLTSPTGLD

SEQ ID NO: 48459 - protein, 9 aa, Mycobacterium tuberculosis
LTSPTGLDP

SEQ ID NO: 48460 - protein, 9 aa, Mycobacterium tuberculosis
TSPTGLDPA

SEQ ID NO: 48461 - protein, 9 aa, Mycobacterium tuberculosis
SPTGLDPAL

SEQ ID NO: 48462 - protein, 9 aa, Mycobacterium tuberculosis
PTGLDPALG

SEQ ID NO: 48463 - protein, 9 aa, Mycobacterium tuberculosis
TGLDPALGG

SEQ ID NO: 48464 - protein, 9 aa, Mycobacterium tuberculosis
GLDPALGGA

SEQ ID NO: 48465 - protein, 9 aa, Mycobacterium tuberculosis
LDPALGGAN

SEQ ID NO: 48466 - protein, 9 aa, Mycobacterium tuberculosis
DPALGGANE

SEQ ID NO: 48467 - protein, 9 aa, Mycobacterium tuberculosis
PALGGANEI

SEQ ID NO: 48468 - protein, 9 aa, Mycobacterium tuberculosis
ALGGANEIP

SEQ ID NO: 48469 - protein, 9 aa, Mycobacterium tuberculosis
LGGANEIPI

SEQ ID NO: 48470 - protein, 9 aa, Mycobacterium tuberculosis
GGANEIPIT

SEQ ID NO: 48471 - protein, 9 aa, Mycobacterium tuberculosis
GANEIPITT

SEQ ID NO: 48472 - protein, 9 aa, Mycobacterium tuberculosis
ANEIPITTP

SEQ ID NO: 48473 - protein, 9 aa, Mycobacterium tuberculosis
NEIPITTPV

SEQ ID NO: 48474 - protein, 9 aa, Mycobacterium tuberculosis
EIPITTPVG

SEQ ID NO: 48475 - protein, 9 aa, Mycobacterium tuberculosis
IPITTPVGL

SEQ ID NO: 48476 - protein, 9 aa, Mycobacterium tuberculosis
PITTPVGLD

SEQ ID NO: 48477 - protein, 9 aa, Mycobacterium tuberculosis
ITTPVGLDP

SEQ ID NO: 48478 - protein, 9 aa, Mycobacterium tuberculosis
TTPVGLDPG

SEQ ID NO: 48479 - protein, 9 aa, Mycobacterium tuberculosis
TPVGLDPGA

SEQ ID NO: 48480 - protein, 9 aa, Mycobacterium tuberculosis
PVGLDPGAD

SEQ ID NO: 48481 - protein, 9 aa, Mycobacterium tuberculosis
VGLDPGADG

SEQ ID NO: 48482 - protein, 9 aa, Mycobacterium tuberculosis
GLDPGADGT

SEQ ID NO: 48483 - protein, 9 aa, Mycobacterium tuberculosis
LDPGADGTY

SEQ ID NO: 48484 - protein, 9 aa, Mycobacterium tuberculosis
DPGADGTYP

SEQ ID NO: 48485 - protein, 9 aa, Mycobacterium tuberculosis
PGADGTYPI

SEQ ID NO: 48486 - protein, 9 aa, Mycobacterium tuberculosis
GADGTYPIL

SEQ ID NO: 48487 - protein, 9 aa, Mycobacterium tuberculosis
ADGTYPILG

SEQ ID NO: 48488 - protein, 9 aa, Mycobacterium tuberculosis
DGTYPILGD

SEQ ID NO: 48489 - protein, 9 aa, Mycobacterium tuberculosis
GTYPILGDP

SEQ ID NO: 48490 - protein, 9 aa, Mycobacterium tuberculosis
TYPILGDPT

SEQ ID NO: 48491 - protein, 9 aa, Mycobacterium tuberculosis
YPILGDPTL

SEQ ID NO: 48492 - protein, 9 aa, Mycobacterium tuberculosis
PILGDPTLG

SEQ ID NO: 48493 - protein, 9 aa, Mycobacterium tuberculosis
ILGDPTLGT

SEQ ID NO: 48494 - protein, 9 aa, Mycobacterium tuberculosis
LGDPTLGTI

SEQ ID NO: 48495 - protein, 9 aa, Mycobacterium tuberculosis
GDPTLGTIP

SEQ ID NO: 48496 - protein, 9 aa, Mycobacterium tuberculosis
DPTLGTIPS

SEQ ID NO: 48497 - protein, 9 aa, Mycobacterium tuberculosis
PTLGTIPSS

SEQ ID NO: 48498 - protein, 9 aa, Mycobacterium tuberculosis
TLGTIPSSP

SEQ ID NO: 48499 - protein, 9 aa, Mycobacterium tuberculosis
LGTIPSSPA

SEQ ID NO: 48500 - protein, 9 aa, Mycobacterium tuberculosis
GTIPSSPAT

SEQ ID NO: 48501 - protein, 9 aa, Mycobacterium tuberculosis
TIPSSPATT

SEQ ID NO: 48502 - protein, 9 aa, Mycobacterium tuberculosis
IPSSPATTS

SEQ ID NO: 48503 - protein, 9 aa, Mycobacterium tuberculosis
PSSPATTST

SEQ ID NO: 48504 - protein, 9 aa, Mycobacterium tuberculosis
SSPATTSTG

SEQ ID NO: 48505 - protein, 9 aa, Mycobacterium tuberculosis
SPATTSTGG

SEQ ID NO: 48506 - protein, 9 aa, Mycobacterium tuberculosis
PATTSTGGG

SEQ ID NO: 48507 - protein, 9 aa, Mycobacterium tuberculosis
ATTSTGGGG

SEQ ID NO: 48508 - protein, 9 aa, Mycobacterium tuberculosis
TTSTGGGGL

SEQ ID NO: 48509 - protein, 9 aa, Mycobacterium tuberculosis
TSTGGGGLV

SEQ ID NO: 48510 - protein, 9 aa, Mycobacterium tuberculosis
STGGGGLVN

SEQ ID NO: 48511 - protein, 9 aa, Mycobacterium tuberculosis
TGGGGLVND

SEQ ID NO: 48512 - protein, 9 aa, Mycobacterium tuberculosis
GGGGLVNDV

SEQ ID NO: 48513 - protein, 9 aa, Mycobacterium tuberculosis
GGGLVNDVM

SEQ ID NO: 48514 - protein, 9 aa, Mycobacterium tuberculosis
GGLVNDVMQ

SEQ ID NO: 48515 - protein, 9 aa, Mycobacterium tuberculosis
GLVNDVMQV

SEQ ID NO: 48516 - protein, 9 aa, Mycobacterium tuberculosis
LVNDVMQVA

SEQ ID NO: 48517 - protein, 9 aa, Mycobacterium tuberculosis
VNDVMQVAN

SEQ ID NO: 48518 - protein, 9 aa, Mycobacterium tuberculosis
NDVMQVANE

SEQ ID NO: 48519 - protein, 9 aa, Mycobacterium tuberculosis
DVMQVANEL

SEQ ID NO: 48520 - protein, 9 aa, Mycobacterium tuberculosis
VMQVANELG

SEQ ID NO: 48521 - protein, 9 aa, Mycobacterium tuberculosis
MQVANELGA

SEQ ID NO: 48522 - protein, 9 aa, Mycobacterium tuberculosis
QVANELGAS

SEQ ID NO: 48523 - protein, 9 aa, Mycobacterium tuberculosis
VANELGASQ

SEQ ID NO: 48524 - protein, 9 aa, Mycobacterium tuberculosis
ANELGASQA

SEQ ID NO: 48525 - protein, 9 aa, Mycobacterium tuberculosis
NELGASQAI

SEQ ID NO: 48526 - protein, 9 aa, Mycobacterium tuberculosis
ELGASQAID

SEQ ID NO: 48527 - protein, 9 aa, Mycobacterium tuberculosis
LGASQAIDL

SEQ ID NO: 48528 - protein, 9 aa, Mycobacterium tuberculosis
GASQAIDLL

SEQ ID NO: 48529 - protein, 9 aa, Mycobacterium tuberculosis
ASQAIDLLK

SEQ ID NO: 48530 - protein, 9 aa, Mycobacterium tuberculosis
SQAIDLLKG

SEQ ID NO: 48531 - protein, 9 aa, Mycobacterium tuberculosis
QAIDLLKGV

SEQ ID NO: 48532 - protein, 9 aa, Mycobacterium tuberculosis
AIDLLKGVL

SEQ ID NO: 48533 - protein, 9 aa, Mycobacterium tuberculosis
IDLLKGVLM

SEQ ID NO: 48534 - protein, 9 aa, Mycobacterium tuberculosis
DLLKGVLMP

SEQ ID NO: 48535 - protein, 9 aa, Mycobacterium tuberculosis
LLKGVLMPS

SEQ ID NO: 48536 - protein, 9 aa, Mycobacterium tuberculosis
LKGVLMPSI

SEQ ID NO: 48537 - protein, 9 aa, Mycobacterium tuberculosis
KGVLMPSIM

SEQ ID NO: 48538 - protein, 9 aa, Mycobacterium tuberculosis
GVLMPSIMQ

SEQ ID NO: 48539 - protein, 9 aa, Mycobacterium tuberculosis
VLMPSIMQA

SEQ ID NO: 48540 - protein, 9 aa, Mycobacterium tuberculosis
LMPSIMQAV

SEQ ID NO: 48541 - protein, 9 aa, Mycobacterium tuberculosis
MPSIMQAVQ

SEQ ID NO: 48542 - protein, 9 aa, Mycobacterium tuberculosis
PSIMQAVQN

SEQ ID NO: 48543 - protein, 9 aa, Mycobacterium tuberculosis
SIMQAVQNG

SEQ ID NO: 48544 - protein, 9 aa, Mycobacterium tuberculosis
IMQAVQNGG

SEQ ID NO: 48545 - protein, 9 aa, Mycobacterium tuberculosis
MQAVQNGGA

SEQ ID NO: 48546 - protein, 9 aa, Mycobacterium tuberculosis
QAVQNGGAA

SEQ ID NO: 48547 - protein, 9 aa, Mycobacterium tuberculosis
AVQNGGAAA

SEQ ID NO: 48548 - protein, 9 aa, Mycobacterium tuberculosis
VQNGGAAAP

SEQ ID NO: 48549 - protein, 9 aa, Mycobacterium tuberculosis
QNGGAAAPA

SEQ ID NO: 48550 - protein, 9 aa, Mycobacterium tuberculosis
NGGAAAPAA

SEQ ID NO: 48551 - protein, 9 aa, Mycobacterium tuberculosis
GGAAAPAAS

SEQ ID NO: 48552 - protein, 9 aa, Mycobacterium tuberculosis
GAAAPAASP

SEQ ID NO: 48553 - protein, 9 aa, Mycobacterium tuberculosis
AAAPAASPP

SEQ ID NO: 48554 - protein, 9 aa, Mycobacterium tuberculosis
AAPAASPPV

SEQ ID NO: 48555 - protein, 9 aa, Mycobacterium tuberculosis
APAASPPVP

SEQ ID NO: 48556 - protein, 9 aa, Mycobacterium tuberculosis
PAASPPVPP

SEQ ID NO: 48557 - protein, 9 aa, Mycobacterium tuberculosis
AASPPVPPI

SEQ ID NO: 48558 - protein, 9 aa, Mycobacterium tuberculosis
ASPPVPPIP

SEQ ID NO: 48559 - protein, 9 aa, Mycobacterium tuberculosis
SPPVPPIPA

SEQ ID NO: 48560 - protein, 9 aa, Mycobacterium tuberculosis
PPVPPIPAA

SEQ ID NO: 48561 - protein, 9 aa, Mycobacterium tuberculosis
PVPPIPAAA

SEQ ID NO: 48562 - protein, 9 aa, Mycobacterium tuberculosis
VPPIPAAAA

SEQ ID NO: 48563 - protein, 9 aa, Mycobacterium tuberculosis
PPIPAAAAV

SEQ ID NO: 48564 - protein, 9 aa, Mycobacterium tuberculosis
PIPAAAAVP

SEQ ID NO: 48565 - protein, 9 aa, Mycobacterium tuberculosis
IPAAAAVPP

SEQ ID NO: 48566 - protein, 9 aa, Mycobacterium tuberculosis
PAAAAVPPT

SEQ ID NO: 48567 - protein, 9 aa, Mycobacterium tuberculosis
AAAAVPPTD

SEQ ID NO: 48568 - protein, 9 aa, Mycobacterium tuberculosis
AAAVPPTDP

SEQ ID NO: 48569 - protein, 9 aa, Mycobacterium tuberculosis
AAVPPTDPI

SEQ ID NO: 48570 - protein, 9 aa, Mycobacterium tuberculosis
AVPPTDPIT

SEQ ID NO: 48571 - protein, 9 aa, Mycobacterium tuberculosis
VPPTDPITV

SEQ ID NO: 48572 - protein, 9 aa, Mycobacterium tuberculosis
PPTDPITVP

SEQ ID NO: 48573 - protein, 9 aa, Mycobacterium tuberculosis
PTDPITVPV

SEQ ID NO: 48574 - protein, 9 aa, Mycobacterium tuberculosis
TDPITVPVA

SEQ ID NO: 48575 - protein, 10 aa, Mycobacterium tuberculosis
MPNRRRRKLS

SEQ ID NO: 48576 - protein, 10 aa, Mycobacterium tuberculosis
PNRRRRKLST

SEQ ID NO: 48577 - protein, 10 aa, Mycobacterium tuberculosis
NRRRRKLSTA

SEQ ID NO: 48578 - protein, 10 aa, Mycobacterium tuberculosis
RRRRKLSTAM

SEQ ID NO: 48579 - protein, 10 aa, Mycobacterium tuberculosis
RRRKLSTAMS

SEQ ID NO: 48580 - protein, 10 aa, Mycobacterium tuberculosis
RRKLSTAMSA

SEQ ID NO: 48581 - protein, 10 aa, Mycobacterium tuberculosis
RKLSTAMSAV

SEQ ID NO: 48582 - protein, 10 aa, Mycobacterium tuberculosis
KLSTAMSAVA

SEQ ID NO: 48583 - protein, 10 aa, Mycobacterium tuberculosis
LSTAMSAVAA

SEQ ID NO: 48584 - protein, 10 aa, Mycobacterium tuberculosis
STAMSAVAAL

SEQ ID NO: 48585 - protein, 10 aa, Mycobacterium tuberculosis
TAMSAVAALA

SEQ ID NO: 48586 - protein, 10 aa, Mycobacterium tuberculosis
AMSAVAALAV

SEQ ID NO: 48587 - protein, 10 aa, Mycobacterium tuberculosis
MSAVAALAVA

SEQ ID NO: 48588 - protein, 10 aa, Mycobacterium tuberculosis
SAVAALAVAS

SEQ ID NO: 48589 - protein, 10 aa, Mycobacterium tuberculosis
AVAALAVASP

SEQ ID NO: 48590 - protein, 10 aa, Mycobacterium tuberculosis
VAALAVASPC

SEQ ID NO: 48591 - protein, 10 aa, Mycobacterium tuberculosis
AALAVASPCA

SEQ ID NO: 48592 - protein, 10 aa, Mycobacterium tuberculosis
ALAVASPCAY

SEQ ID NO: 48593 - protein, 10 aa, Mycobacterium tuberculosis
LAVASPCAYF

SEQ ID NO: 48594 - protein, 10 aa, Mycobacterium tuberculosis
AVASPCAYFL

SEQ ID NO: 48595 - protein, 10 aa, Mycobacterium tuberculosis
VASPCAYFLV

SEQ ID NO: 48596 - protein, 10 aa, Mycobacterium tuberculosis
ASPCAYFLVY

SEQ ID NO: 48597 - protein, 10 aa, Mycobacterium tuberculosis
SPCAYFLVYE

SEQ ID NO: 48598 - protein, 10 aa, Mycobacterium tuberculosis
PCAYFLVYES

SEQ ID NO: 48599 - protein, 10 aa, Mycobacterium tuberculosis
CAYFLVYEST

SEQ ID NO: 48600 - protein, 10 aa, Mycobacterium tuberculosis
AYFLVYESTE

SEQ ID NO: 48601 - protein, 10 aa, Mycobacterium tuberculosis
YFLVYESTET

SEQ ID NO: 48602 - protein, 10 aa, Mycobacterium tuberculosis
FLVYESTETT

SEQ ID NO: 48603 - protein, 10 aa, Mycobacterium tuberculosis
LVYESTETTE

SEQ ID NO: 48604 - protein, 10 aa, Mycobacterium tuberculosis
VYESTETTER

SEQ ID NO: 48605 - protein, 10 aa, Mycobacterium tuberculosis
YESTETTERP

SEQ ID NO: 48606 - protein, 10 aa, Mycobacterium tuberculosis
ESTETTERPE

SEQ ID NO: 48607 - protein, 10 aa, Mycobacterium tuberculosis
STETTERPEH

SEQ ID NO: 48608 - protein, 10 aa, Mycobacterium tuberculosis
TETTERPEHH

SEQ ID NO: 48609 - protein, 10 aa, Mycobacterium tuberculosis
ETTERPEHHE

SEQ ID NO: 48610 - protein, 10 aa, Mycobacterium tuberculosis
TTERPEHHEF

SEQ ID NO: 48611 - protein, 10 aa, Mycobacterium tuberculosis
TERPEHHEFK

SEQ ID NO: 48612 - protein, 10 aa, Mycobacterium tuberculosis
ERPEHHEFKQ

SEQ ID NO: 48613 - protein, 10 aa, Mycobacterium tuberculosis
RPEHHEFKQA

SEQ ID NO: 48614 - protein, 10 aa, Mycobacterium tuberculosis
PEHHEFKQAA

SEQ ID NO: 48615 - protein, 10 aa, Mycobacterium tuberculosis
EHHEFKQAAV

SEQ ID NO: 48616 - protein, 10 aa, Mycobacterium tuberculosis
HHEFKQAAVL

SEQ ID NO: 48617 - protein, 10 aa, Mycobacterium tuberculosis
HEFKQAAVLT

SEQ ID NO: 48618 - protein, 10 aa, Mycobacterium tuberculosis
EFKQAAVLTD

SEQ ID NO: 48619 - protein, 10 aa, Mycobacterium tuberculosis
FKQAAVLTDL

SEQ ID NO: 48620 - protein, 10 aa, Mycobacterium tuberculosis
KQAAVLTDLP

SEQ ID NO: 48621 - protein, 10 aa, Mycobacterium tuberculosis
QAAVLTDLPG

SEQ ID NO: 48622 - protein, 10 aa, Mycobacterium tuberculosis
AAVLTDLPGE

SEQ ID NO: 48623 - protein, 10 aa, Mycobacterium tuberculosis
AVLTDLPGEL

SEQ ID NO: 48624 - protein, 10 aa, Mycobacterium tuberculosis
VLTDLPGELM

SEQ ID NO: 48625 - protein, 10 aa, Mycobacterium tuberculosis
LTDLPGELMS

SEQ ID NO: 48626 - protein, 10 aa, Mycobacterium tuberculosis
TDLPGELMSA

SEQ ID NO: 48627 - protein, 10 aa, Mycobacterium tuberculosis
DLPGELMSAL

SEQ ID NO: 48628 - protein, 10 aa, Mycobacterium tuberculosis
LPGELMSALS

SEQ ID NO: 48629 - protein, 10 aa, Mycobacterium tuberculosis
PGELMSALSQ

SEQ ID NO: 48630 - protein, 10 aa, Mycobacterium tuberculosis
GELMSALSQG

SEQ ID NO: 48631 - protein, 10 aa, Mycobacterium tuberculosis
ELMSALSQGL

SEQ ID NO: 48632 - protein, 10 aa, Mycobacterium tuberculosis
LMSALSQGLS

SEQ ID NO: 48633 - protein, 10 aa, Mycobacterium tuberculosis
MSALSQGLSQ

SEQ ID NO: 48634 - protein, 10 aa, Mycobacterium tuberculosis
SALSQGLSQF

SEQ ID NO: 48635 - protein, 10 aa, Mycobacterium tuberculosis
ALSQGLSQFG

SEQ ID NO: 48636 - protein, 10 aa, Mycobacterium tuberculosis
LSQGLSQFGI

SEQ ID NO: 48637 - protein, 10 aa, Mycobacterium tuberculosis
SQGLSQFGIN

SEQ ID NO: 48638 - protein, 10 aa, Mycobacterium tuberculosis
QGLSQFGINI

SEQ ID NO: 48639 - protein, 10 aa, Mycobacterium tuberculosis
GLSQFGINIP

SEQ ID NO: 48640 - protein, 10 aa, Mycobacterium tuberculosis
LSQFGINIPP

SEQ ID NO: 48641 - protein, 10 aa, Mycobacterium tuberculosis
SQFGINIPPV

SEQ ID NO: 48642 - protein, 10 aa, Mycobacterium tuberculosis
QFGINIPPVP

SEQ ID NO: 48643 - protein, 10 aa, Mycobacterium tuberculosis
FGINIPPVPS

SEQ ID NO: 48644 - protein, 10 aa, Mycobacterium tuberculosis
GINIPPVPSL

SEQ ID NO: 48645 - protein, 10 aa, Mycobacterium tuberculosis
INIPPVPSLT

SEQ ID NO: 48646 - protein, 10 aa, Mycobacterium tuberculosis
NIPPVPSLTG

SEQ ID NO: 48647 - protein, 10 aa, Mycobacterium tuberculosis
IPPVPSLTGS

SEQ ID NO: 48648 - protein, 10 aa, Mycobacterium tuberculosis
PPVPSLTGSG

SEQ ID NO: 48649 - protein, 10 aa, Mycobacterium tuberculosis
PVPSLTGSGD

SEQ ID NO: 48650 - protein, 10 aa, Mycobacterium tuberculosis
VPSLTGSGDA

SEQ ID NO: 48651 - protein, 10 aa, Mycobacterium tuberculosis
PSLTGSGDAS

SEQ ID NO: 48652 - protein, 10 aa, Mycobacterium tuberculosis
SLTGSGDAST

SEQ ID NO: 48653 - protein, 10 aa, Mycobacterium tuberculosis
LTGSGDASTG

SEQ ID NO: 48654 - protein, 10 aa, Mycobacterium tuberculosis
TGSGDASTGL

SEQ ID NO: 48655 - protein, 10 aa, Mycobacterium tuberculosis
GSGDASTGLT

SEQ ID NO: 48656 - protein, 10 aa, Mycobacterium tuberculosis
SGDASTGLTG

SEQ ID NO: 48657 - protein, 10 aa, Mycobacterium tuberculosis
GDASTGLTGP

SEQ ID NO: 48658 - protein, 10 aa, Mycobacterium tuberculosis
DASTGLTGPG

SEQ ID NO: 48659 - protein, 10 aa, Mycobacterium tuberculosis
ASTGLTGPGL

SEQ ID NO: 48660 - protein, 10 aa, Mycobacterium tuberculosis
STGLTGPGLT

SEQ ID NO: 48661 - protein, 10 aa, Mycobacterium tuberculosis
TGLTGPGLTS

SEQ ID NO: 48662 - protein, 10 aa, Mycobacterium tuberculosis
GLTGPGLTSP

SEQ ID NO: 48663 - protein, 10 aa, Mycobacterium tuberculosis
LTGPGLTSPG

SEQ ID NO: 48664 - protein, 10 aa, Mycobacterium tuberculosis
TGPGLTSPGL

SEQ ID NO: 48665 - protein, 10 aa, Mycobacterium tuberculosis
GPGLTSPGLT

SEQ ID NO: 48666 - protein, 10 aa, Mycobacterium tuberculosis
PGLTSPGLTS

SEQ ID NO: 48667 - protein, 10 aa, Mycobacterium tuberculosis
GLTSPGLTSP

SEQ ID NO: 48668 - protein, 10 aa, Mycobacterium tuberculosis
LTSPGLTSPG

SEQ ID NO: 48669 - protein, 10 aa, Mycobacterium tuberculosis
TSPGLTSPGL

SEQ ID NO: 48670 - protein, 10 aa, Mycobacterium tuberculosis
SPGLTSPGLT

SEQ ID NO: 48671 - protein, 10 aa, Mycobacterium tuberculosis
PGLTSPGLTS

SEQ ID NO: 48672 - protein, 10 aa, Mycobacterium tuberculosis
GLTSPGLTSP

SEQ ID NO: 48673 - protein, 10 aa, Mycobacterium tuberculosis
LTSPGLTSPG

SEQ ID NO: 48674 - protein, 10 aa, Mycobacterium tuberculosis
TSPGLTSPGL

SEQ ID NO: 48675 - protein, 10 aa, Mycobacterium tuberculosis
SPGLTSPGLT

SEQ ID NO: 48676 - protein, 10 aa, Mycobacterium tuberculosis
PGLTSPGLTD

SEQ ID NO: 48677 - protein, 10 aa, Mycobacterium tuberculosis
GLTSPGLTDP

SEQ ID NO: 48678 - protein, 10 aa, Mycobacterium tuberculosis
LTSPGLTDPA

SEQ ID NO: 48679 - protein, 10 aa, Mycobacterium tuberculosis
TSPGLTDPAL

SEQ ID NO: 48680 - protein, 10 aa, Mycobacterium tuberculosis
SPGLTDPALT

SEQ ID NO: 48681 - protein, 10 aa, Mycobacterium tuberculosis
PGLTDPALTS

SEQ ID NO: 48682 - protein, 10 aa, Mycobacterium tuberculosis
GLTDPALTSP

SEQ ID NO: 48683 - protein, 10 aa, Mycobacterium tuberculosis
LTDPALTSPG

SEQ ID NO: 48684 - protein, 10 aa, Mycobacterium tuberculosis
TDPALTSPGL

SEQ ID NO: 48685 - protein, 10 aa, Mycobacterium tuberculosis
DPALTSPGLT

SEQ ID NO: 48686 - protein, 10 aa, Mycobacterium tuberculosis
PALTSPGLTP

SEQ ID NO: 48687 - protein, 10 aa, Mycobacterium tuberculosis
ALTSPGLTPT

SEQ ID NO: 48688 - protein, 10 aa, Mycobacterium tuberculosis
LTSPGLTPTL

SEQ ID NO: 48689 - protein, 10 aa, Mycobacterium tuberculosis
TSPGLTPTLP

SEQ ID NO: 48690 - protein, 10 aa, Mycobacterium tuberculosis
SPGLTPTLPG

SEQ ID NO: 48691 - protein, 10 aa, Mycobacterium tuberculosis
PGLTPTLPGS

SEQ ID NO: 48692 - protein, 10 aa, Mycobacterium tuberculosis
GLTPTLPGSL

SEQ ID NO: 48693 - protein, 10 aa, Mycobacterium tuberculosis
LTPTLPGSLA

SEQ ID NO: 48694 - protein, 10 aa, Mycobacterium tuberculosis
TPTLPGSLAA

SEQ ID NO: 48695 - protein, 10 aa, Mycobacterium tuberculosis
PTLPGSLAAP

SEQ ID NO: 48696 - protein, 10 aa, Mycobacterium tuberculosis
TLPGSLAAPG

SEQ ID NO: 48697 - protein, 10 aa, Mycobacterium tuberculosis
LPGSLAAPGT

SEQ ID NO: 48698 - protein, 10 aa, Mycobacterium tuberculosis
PGSLAAPGTT

SEQ ID NO: 48699 - protein, 10 aa, Mycobacterium tuberculosis
GSLAAPGTTL

SEQ ID NO: 48700 - protein, 10 aa, Mycobacterium tuberculosis
SLAAPGTTLA

SEQ ID NO: 48701 - protein, 10 aa, Mycobacterium tuberculosis
LAAPGTTLAP

SEQ ID NO: 48702 - protein, 10 aa, Mycobacterium tuberculosis
AAPGTTLAPT

SEQ ID NO: 48703 - protein, 10 aa, Mycobacterium tuberculosis
APGTTLAPTP

SEQ ID NO: 48704 - protein, 10 aa, Mycobacterium tuberculosis
PGTTLAPTPG

SEQ ID NO: 48705 - protein, 10 aa, Mycobacterium tuberculosis
GTTLAPTPGV

SEQ ID NO: 48706 - protein, 10 aa, Mycobacterium tuberculosis
TTLAPTPGVG

SEQ ID NO: 48707 - protein, 10 aa, Mycobacterium tuberculosis
TLAPTPGVGA

SEQ ID NO: 48708 - protein, 10 aa, Mycobacterium tuberculosis
LAPTPGVGAN

SEQ ID NO: 48709 - protein, 10 aa, Mycobacterium tuberculosis
APTPGVGANP

SEQ ID NO: 48710 - protein, 10 aa, Mycobacterium tuberculosis
PTPGVGANPA

SEQ ID NO: 48711 - protein, 10 aa, Mycobacterium tuberculosis
TPGVGANPAL

SEQ ID NO: 48712 - protein, 10 aa, Mycobacterium tuberculosis
PGVGANPALT

SEQ ID NO: 48713 - protein, 10 aa, Mycobacterium tuberculosis
GVGANPALTN

SEQ ID NO: 48714 - protein, 10 aa, Mycobacterium tuberculosis
VGANPALTNP

SEQ ID NO: 48715 - protein, 10 aa, Mycobacterium tuberculosis
GANPALTNPA

SEQ ID NO: 48716 - protein, 10 aa, Mycobacterium tuberculosis
ANPALTNPAL

SEQ ID NO: 48717 - protein, 10 aa, Mycobacterium tuberculosis
NPALTNPALT

SEQ ID NO: 48718 - protein, 10 aa, Mycobacterium tuberculosis
PALTNPALTS

SEQ ID NO: 48719 - protein, 10 aa, Mycobacterium tuberculosis
ALTNPALTSP

SEQ ID NO: 48720 - protein, 10 aa, Mycobacterium tuberculosis
LTNPALTSPT

SEQ ID NO: 48721 - protein, 10 aa, Mycobacterium tuberculosis
TNPALTSPTG

SEQ ID NO: 48722 - protein, 10 aa, Mycobacterium tuberculosis
NPALTSPTGA

SEQ ID NO: 48723 - protein, 10 aa, Mycobacterium tuberculosis
PALTSPTGAT

SEQ ID NO: 48724 - protein, 10 aa, Mycobacterium tuberculosis
ALTSPTGATP

SEQ ID NO: 48725 - protein, 10 aa, Mycobacterium tuberculosis
LTSPTGATPG

SEQ ID NO: 48726 - protein, 10 aa, Mycobacterium tuberculosis
TSPTGATPGL

SEQ ID NO: 48727 - protein, 10 aa, Mycobacterium tuberculosis
SPTGATPGLT

SEQ ID NO: 48728 - protein, 10 aa, Mycobacterium tuberculosis
PTGATPGLTS

SEQ ID NO: 48729 - protein, 10 aa, Mycobacterium tuberculosis
TGATPGLTSP

SEQ ID NO: 48730 - protein, 10 aa, Mycobacterium tuberculosis
GATPGLTSPT

SEQ ID NO: 48731 - protein, 10 aa, Mycobacterium tuberculosis
ATPGLTSPTG

SEQ ID NO: 48732 - protein, 10 aa, Mycobacterium tuberculosis
TPGLTSPTGL

SEQ ID NO: 48733 - protein, 10 aa, Mycobacterium tuberculosis
PGLTSPTGLD

SEQ ID NO: 48734 - protein, 10 aa, Mycobacterium tuberculosis
GLTSPTGLDP

SEQ ID NO: 48735 - protein, 10 aa, Mycobacterium tuberculosis
LTSPTGLDPA

SEQ ID NO: 48736 - protein, 10 aa, Mycobacterium tuberculosis
TSPTGLDPAL

SEQ ID NO: 48737 - protein, 10 aa, Mycobacterium tuberculosis
SPTGLDPALG

SEQ ID NO: 48738 - protein, 10 aa, Mycobacterium tuberculosis
PTGLDPALGG

SEQ ID NO: 48739 - protein, 10 aa, Mycobacterium tuberculosis
TGLDPALGGA

SEQ ID NO: 48740 - protein, 10 aa, Mycobacterium tuberculosis
GLDPALGGAN

SEQ ID NO: 48741 - protein, 10 aa, Mycobacterium tuberculosis
LDPALGGANE

SEQ ID NO: 48742 - protein, 10 aa, Mycobacterium tuberculosis
DPALGGANEI

SEQ ID NO: 48743 - protein, 10 aa, Mycobacterium tuberculosis
PALGGANEIP

SEQ ID NO: 48744 - protein, 10 aa, Mycobacterium tuberculosis
ALGGANEIPI

SEQ ID NO: 48745 - protein, 10 aa, Mycobacterium tuberculosis
LGGANEIPIT

SEQ ID NO: 48746 - protein, 10 aa, Mycobacterium tuberculosis
GGANEIPITT

SEQ ID NO: 48747 - protein, 10 aa, Mycobacterium tuberculosis
GANEIPITTP

SEQ ID NO: 48748 - protein, 10 aa, Mycobacterium tuberculosis
ANEIPITTPV

SEQ ID NO: 48749 - protein, 10 aa, Mycobacterium tuberculosis
NEIPITTPVG

SEQ ID NO: 48750 - protein, 10 aa, Mycobacterium tuberculosis
EIPITTPVGL

SEQ ID NO: 48751 - protein, 10 aa, Mycobacterium tuberculosis
IPITTPVGLD

SEQ ID NO: 48752 - protein, 10 aa, Mycobacterium tuberculosis
PITTPVGLDP

SEQ ID NO: 48753 - protein, 10 aa, Mycobacterium tuberculosis
ITTPVGLDPG

SEQ ID NO: 48754 - protein, 10 aa, Mycobacterium tuberculosis
TTPVGLDPGA

SEQ ID NO: 48755 - protein, 10 aa, Mycobacterium tuberculosis
TPVGLDPGAD

SEQ ID NO: 48756 - protein, 10 aa, Mycobacterium tuberculosis
PVGLDPGADG

SEQ ID NO: 48757 - protein, 10 aa, Mycobacterium tuberculosis
VGLDPGADGT

SEQ ID NO: 48758 - protein, 10 aa, Mycobacterium tuberculosis
GLDPGADGTY

SEQ ID NO: 48759 - protein, 10 aa, Mycobacterium tuberculosis
LDPGADGTYP

SEQ ID NO: 48760 - protein, 10 aa, Mycobacterium tuberculosis
DPGADGTYPI

SEQ ID NO: 48761 - protein, 10 aa, Mycobacterium tuberculosis
PGADGTYPIL

SEQ ID NO: 48762 - protein, 10 aa, Mycobacterium tuberculosis
GADGTYPILG

SEQ ID NO: 48763 - protein, 10 aa, Mycobacterium tuberculosis
ADGTYPILGD

SEQ ID NO: 48764 - protein, 10 aa, Mycobacterium tuberculosis
DGTYPILGDP

SEQ ID NO: 48765 - protein, 10 aa, Mycobacterium tuberculosis
GTYPILGDPT

SEQ ID NO: 48766 - protein, 10 aa, Mycobacterium tuberculosis
TYPILGDPTL

SEQ ID NO: 48767 - protein, 10 aa, Mycobacterium tuberculosis
YPILGDPTLG

SEQ ID NO: 48768 - protein, 10 aa, Mycobacterium tuberculosis
PILGDPTLGT

SEQ ID NO: 48769 - protein, 10 aa, Mycobacterium tuberculosis
ILGDPTLGTI

SEQ ID NO: 48770 - protein, 10 aa, Mycobacterium tuberculosis
LGDPTLGTIP

SEQ ID NO: 48771 - protein, 10 aa, Mycobacterium tuberculosis
GDPTLGTIPS

SEQ ID NO: 48772 - protein, 10 aa, Mycobacterium tuberculosis
DPTLGTIPSS

SEQ ID NO: 48773 - protein, 10 aa, Mycobacterium tuberculosis
PTLGTIPSSP

SEQ ID NO: 48774 - protein, 10 aa, Mycobacterium tuberculosis
TLGTIPSSPA

SEQ ID NO: 48775 - protein, 10 aa, Mycobacterium tuberculosis
LGTIPSSPAT

SEQ ID NO: 48776 - protein, 10 aa, Mycobacterium tuberculosis
GTIPSSPATT

SEQ ID NO: 48777 - protein, 10 aa, Mycobacterium tuberculosis
TIPSSPATTS

SEQ ID NO: 48778 - protein, 10 aa, Mycobacterium tuberculosis
IPSSPATTST

SEQ ID NO: 48779 - protein, 10 aa, Mycobacterium tuberculosis
PSSPATTSTG

SEQ ID NO: 48780 - protein, 10 aa, Mycobacterium tuberculosis
SSPATTSTGG

SEQ ID NO: 48781 - protein, 10 aa, Mycobacterium tuberculosis
SPATTSTGGG

SEQ ID NO: 48782 - protein, 10 aa, Mycobacterium tuberculosis
PATTSTGGGG

SEQ ID NO: 48783 - protein, 10 aa, Mycobacterium tuberculosis
ATTSTGGGGL

SEQ ID NO: 48784 - protein, 10 aa, Mycobacterium tuberculosis
TTSTGGGGLV

SEQ ID NO: 48785 - protein, 10 aa, Mycobacterium tuberculosis
TSTGGGGLVN

SEQ ID NO: 48786 - protein, 10 aa, Mycobacterium tuberculosis
STGGGGLVND

SEQ ID NO: 48787 - protein, 10 aa, Mycobacterium tuberculosis
TGGGGLVNDV

SEQ ID NO: 48788 - protein, 10 aa, Mycobacterium tuberculosis
GGGGLVNDVM

SEQ ID NO: 48789 - protein, 10 aa, Mycobacterium tuberculosis
GGGLVNDVMQ

SEQ ID NO: 48790 - protein, 10 aa, Mycobacterium tuberculosis
GGLVNDVMQV

SEQ ID NO: 48791 - protein, 10 aa, Mycobacterium tuberculosis
GLVNDVMQVA

SEQ ID NO: 48792 - protein, 10 aa, Mycobacterium tuberculosis
LVNDVMQVAN

SEQ ID NO: 48793 - protein, 10 aa, Mycobacterium tuberculosis
VNDVMQVANE

SEQ ID NO: 48794 - protein, 10 aa, Mycobacterium tuberculosis
NDVMQVANEL

SEQ ID NO: 48795 - protein, 10 aa, Mycobacterium tuberculosis
DVMQVANELG

SEQ ID NO: 48796 - protein, 10 aa, Mycobacterium tuberculosis
VMQVANELGA

SEQ ID NO: 48797 - protein, 10 aa, Mycobacterium tuberculosis
MQVANELGAS

SEQ ID NO: 48798 - protein, 10 aa, Mycobacterium tuberculosis
QVANELGASQ

SEQ ID NO: 48799 - protein, 10 aa, Mycobacterium tuberculosis
VANELGASQA

SEQ ID NO: 48800 - protein, 10 aa, Mycobacterium tuberculosis
ANELGASQAI

SEQ ID NO: 48801 - protein, 10 aa, Mycobacterium tuberculosis
NELGASQAID

SEQ ID NO: 48802 - protein, 10 aa, Mycobacterium tuberculosis
ELGASQAIDL

SEQ ID NO: 48803 - protein, 10 aa, Mycobacterium tuberculosis
LGASQAIDLL

SEQ ID NO: 48804 - protein, 10 aa, Mycobacterium tuberculosis
GASQAIDLLK

SEQ ID NO: 48805 - protein, 10 aa, Mycobacterium tuberculosis
ASQAIDLLKG

SEQ ID NO: 48806 - protein, 10 aa, Mycobacterium tuberculosis
SQAIDLLKGV

SEQ ID NO: 48807 - protein, 10 aa, Mycobacterium tuberculosis
QAIDLLKGVL

SEQ ID NO: 48808 - protein, 10 aa, Mycobacterium tuberculosis
AIDLLKGVLM

SEQ ID NO: 48809 - protein, 10 aa, Mycobacterium tuberculosis
IDLLKGVLMP

SEQ ID NO: 48810 - protein, 10 aa, Mycobacterium tuberculosis
DLLKGVLMPS

SEQ ID NO: 48811 - protein, 10 aa, Mycobacterium tuberculosis
LLKGVLMPSI

SEQ ID NO: 48812 - protein, 10 aa, Mycobacterium tuberculosis
LKGVLMPSIM

SEQ ID NO: 48813 - protein, 10 aa, Mycobacterium tuberculosis
KGVLMPSIMQ

SEQ ID NO: 48814 - protein, 10 aa, Mycobacterium tuberculosis
GVLMPSIMQA

SEQ ID NO: 48815 - protein, 10 aa, Mycobacterium tuberculosis
VLMPSIMQAV

SEQ ID NO: 48816 - protein, 10 aa, Mycobacterium tuberculosis
LMPSIMQAVQ

SEQ ID NO: 48817 - protein, 10 aa, Mycobacterium tuberculosis
MPSIMQAVQN

SEQ ID NO: 48818 - protein, 10 aa, Mycobacterium tuberculosis
PSIMQAVQNG

SEQ ID NO: 48819 - protein, 10 aa, Mycobacterium tuberculosis
SIMQAVQNGG

SEQ ID NO: 48820 - protein, 10 aa, Mycobacterium tuberculosis
IMQAVQNGGA

SEQ ID NO: 48821 - protein, 10 aa, Mycobacterium tuberculosis
MQAVQNGGAA

SEQ ID NO: 48822 - protein, 10 aa, Mycobacterium tuberculosis
QAVQNGGAAA

SEQ ID NO: 48823 - protein, 10 aa, Mycobacterium tuberculosis
AVQNGGAAAP

SEQ ID NO: 48824 - protein, 10 aa, Mycobacterium tuberculosis
VQNGGAAAPA

SEQ ID NO: 48825 - protein, 10 aa, Mycobacterium tuberculosis
QNGGAAAPAA

SEQ ID NO: 48826 - protein, 10 aa, Mycobacterium tuberculosis
NGGAAAPAAS

SEQ ID NO: 48827 - protein, 10 aa, Mycobacterium tuberculosis
GGAAAPAASP

SEQ ID NO: 48828 - protein, 10 aa, Mycobacterium tuberculosis
GAAAPAASPP

SEQ ID NO: 48829 - protein, 10 aa, Mycobacterium tuberculosis
AAAPAASPPV

SEQ ID NO: 48830 - protein, 10 aa, Mycobacterium tuberculosis
AAPAASPPVP

SEQ ID NO: 48831 - protein, 10 aa, Mycobacterium tuberculosis
APAASPPVPP

SEQ ID NO: 48832 - protein, 10 aa, Mycobacterium tuberculosis
PAASPPVPPI

SEQ ID NO: 48833 - protein, 10 aa, Mycobacterium tuberculosis
AASPPVPPIP

SEQ ID NO: 48834 - protein, 10 aa, Mycobacterium tuberculosis
ASPPVPPIPA

SEQ ID NO: 48835 - protein, 10 aa, Mycobacterium tuberculosis
SPPVPPIPAA

SEQ ID NO: 48836 - protein, 10 aa, Mycobacterium tuberculosis
PPVPPIPAAA

SEQ ID NO: 48837 - protein, 10 aa, Mycobacterium tuberculosis
PVPPIPAAAA

SEQ ID NO: 48838 - protein, 10 aa, Mycobacterium tuberculosis
VPPIPAAAAV

SEQ ID NO: 48839 - protein, 10 aa, Mycobacterium tuberculosis
PPIPAAAAVP

SEQ ID NO: 48840 - protein, 10 aa, Mycobacterium tuberculosis
PIPAAAAVPP

SEQ ID NO: 48841 - protein, 10 aa, Mycobacterium tuberculosis
IPAAAAVPPT

SEQ ID NO: 48842 - protein, 10 aa, Mycobacterium tuberculosis
PAAAAVPPTD

SEQ ID NO: 48843 - protein, 10 aa, Mycobacterium tuberculosis
AAAAVPPTDP

SEQ ID NO: 48844 - protein, 10 aa, Mycobacterium tuberculosis
AAAVPPTDPI

SEQ ID NO: 48845 - protein, 10 aa, Mycobacterium tuberculosis
AAVPPTDPIT

SEQ ID NO: 48846 - protein, 10 aa, Mycobacterium tuberculosis
AVPPTDPITV

SEQ ID NO: 48847 - protein, 10 aa, Mycobacterium tuberculosis
VPPTDPITVP

SEQ ID NO: 48848 - protein, 10 aa, Mycobacterium tuberculosis
PPTDPITVPV

SEQ ID NO: 48849 - protein, 10 aa, Mycobacterium tuberculosis
PTDPITVPVA

SEQ ID NO: 48850 - protein, 11 aa, Mycobacterium tuberculosis
MPNRRRRKLST

SEQ ID NO: 48851 - protein, 11 aa, Mycobacterium tuberculosis
PNRRRRKLSTA

SEQ ID NO: 48852 - protein, 11 aa, Mycobacterium tuberculosis
NRRRRKLSTAM

SEQ ID NO: 48853 - protein, 11 aa, Mycobacterium tuberculosis
RRRRKLSTAMS

SEQ ID NO: 48854 - protein, 11 aa, Mycobacterium tuberculosis
RRRKLSTAMSA

SEQ ID NO: 48855 - protein, 11 aa, Mycobacterium tuberculosis
RRKLSTAMSAV

SEQ ID NO: 48856 - protein, 11 aa, Mycobacterium tuberculosis
RKLSTAMSAVA

SEQ ID NO: 48857 - protein, 11 aa, Mycobacterium tuberculosis
KLSTAMSAVAA

SEQ ID NO: 48858 - protein, 11 aa, Mycobacterium tuberculosis
LSTAMSAVAAL

SEQ ID NO: 48859 - protein, 11 aa, Mycobacterium tuberculosis
STAMSAVAALA

SEQ ID NO: 48860 - protein, 11 aa, Mycobacterium tuberculosis
TAMSAVAALAV

SEQ ID NO: 48861 - protein, 11 aa, Mycobacterium tuberculosis
AMSAVAALAVA

SEQ ID NO: 48862 - protein, 11 aa, Mycobacterium tuberculosis
MSAVAALAVAS

SEQ ID NO: 48863 - protein, 11 aa, Mycobacterium tuberculosis
SAVAALAVASP

SEQ ID NO: 48864 - protein, 11 aa, Mycobacterium tuberculosis
AVAALAVASPC

SEQ ID NO: 48865 - protein, 11 aa, Mycobacterium tuberculosis
VAALAVASPCA

SEQ ID NO: 48866 - protein, 11 aa, Mycobacterium tuberculosis
AALAVASPCAY

SEQ ID NO: 48867 - protein, 11 aa, Mycobacterium tuberculosis
ALAVASPCAYF

SEQ ID NO: 48868 - protein, 11 aa, Mycobacterium tuberculosis
LAVASPCAYFL

SEQ ID NO: 48869 - protein, 11 aa, Mycobacterium tuberculosis
AVASPCAYFLV

SEQ ID NO: 48870 - protein, 11 aa, Mycobacterium tuberculosis
VASPCAYFLVY

SEQ ID NO: 48871 - protein, 11 aa, Mycobacterium tuberculosis
ASPCAYFLVYE

SEQ ID NO: 48872 - protein, 11 aa, Mycobacterium tuberculosis
SPCAYFLVYES

SEQ ID NO: 48873 - protein, 11 aa, Mycobacterium tuberculosis
PCAYFLVYEST

SEQ ID NO: 48874 - protein, 11 aa, Mycobacterium tuberculosis
CAYFLVYESTE

SEQ ID NO: 48875 - protein, 11 aa, Mycobacterium tuberculosis
AYFLVYESTET

SEQ ID NO: 48876 - protein, 11 aa, Mycobacterium tuberculosis
YFLVYESTETT

SEQ ID NO: 48877 - protein, 11 aa, Mycobacterium tuberculosis
FLVYESTETTE

SEQ ID NO: 48878 - protein, 11 aa, Mycobacterium tuberculosis
LVYESTETTER

SEQ ID NO: 48879 - protein, 11 aa, Mycobacterium tuberculosis
VYESTETTERP

SEQ ID NO: 48880 - protein, 11 aa, Mycobacterium tuberculosis
YESTETTERPE

SEQ ID NO: 48881 - protein, 11 aa, Mycobacterium tuberculosis
ESTETTERPEH

SEQ ID NO: 48882 - protein, 11 aa, Mycobacterium tuberculosis
STETTERPEHH

SEQ ID NO: 48883 - protein, 11 aa, Mycobacterium tuberculosis
TETTERPEHHE

SEQ ID NO: 48884 - protein, 11 aa, Mycobacterium tuberculosis
ETTERPEHHEF

SEQ ID NO: 48885 - protein, 11 aa, Mycobacterium tuberculosis
TTERPEHHEFK

SEQ ID NO: 48886 - protein, 11 aa, Mycobacterium tuberculosis
TERPEHHEFKQ

SEQ ID NO: 48887 - protein, 11 aa, Mycobacterium tuberculosis
ERPEHHEFKQA

SEQ ID NO: 48888 - protein, 11 aa, Mycobacterium tuberculosis
RPEHHEFKQAA

SEQ ID NO: 48889 - protein, 11 aa, Mycobacterium tuberculosis
PEHHEFKQAAV

SEQ ID NO: 48890 - protein, 11 aa, Mycobacterium tuberculosis
EHHEFKQAAVL

SEQ ID NO: 48891 - protein, 11 aa, Mycobacterium tuberculosis
HHEFKQAAVLT

SEQ ID NO: 48892 - protein, 11 aa, Mycobacterium tuberculosis
HEFKQAAVLTD

SEQ ID NO: 48893 - protein, 11 aa, Mycobacterium tuberculosis
EFKQAAVLTDL

SEQ ID NO: 48894 - protein, 11 aa, Mycobacterium tuberculosis
FKQAAVLTDLP

SEQ ID NO: 48895 - protein, 11 aa, Mycobacterium tuberculosis
KQAAVLTDLPG

SEQ ID NO: 48896 - protein, 11 aa, Mycobacterium tuberculosis
QAAVLTDLPGE

SEQ ID NO: 48897 - protein, 11 aa, Mycobacterium tuberculosis
AAVLTDLPGEL

SEQ ID NO: 48898 - protein, 11 aa, Mycobacterium tuberculosis
AVLTDLPGELM

SEQ ID NO: 48899 - protein, 11 aa, Mycobacterium tuberculosis
VLTDLPGELMS

SEQ ID NO: 48900 - protein, 11 aa, Mycobacterium tuberculosis
LTDLPGELMSA

SEQ ID NO: 48901 - protein, 11 aa, Mycobacterium tuberculosis
TDLPGELMSAL

SEQ ID NO: 48902 - protein, 11 aa, Mycobacterium tuberculosis
DLPGELMSALS

SEQ ID NO: 48903 - protein, 11 aa, Mycobacterium tuberculosis
LPGELMSALSQ

SEQ ID NO: 48904 - protein, 11 aa, Mycobacterium tuberculosis
PGELMSALSQG

SEQ ID NO: 48905 - protein, 11 aa, Mycobacterium tuberculosis
GELMSALSQGL

SEQ ID NO: 48906 - protein, 11 aa, Mycobacterium tuberculosis
ELMSALSQGLS

SEQ ID NO: 48907 - protein, 11 aa, Mycobacterium tuberculosis
LMSALSQGLSQ

SEQ ID NO: 48908 - protein, 11 aa, Mycobacterium tuberculosis
MSALSQGLSQF

SEQ ID NO: 48909 - protein, 11 aa, Mycobacterium tuberculosis
SALSQGLSQFG

SEQ ID NO: 48910 - protein, 11 aa, Mycobacterium tuberculosis
ALSQGLSQFGI

SEQ ID NO: 48911 - protein, 11 aa, Mycobacterium tuberculosis
LSQGLSQFGIN

SEQ ID NO: 48912 - protein, 11 aa, Mycobacterium tuberculosis
SQGLSQFGINI

SEQ ID NO: 48913 - protein, 11 aa, Mycobacterium tuberculosis
QGLSQFGINIP

SEQ ID NO: 48914 - protein, 11 aa, Mycobacterium tuberculosis
GLSQFGINIPP

SEQ ID NO: 48915 - protein, 11 aa, Mycobacterium tuberculosis
LSQFGINIPPV

SEQ ID NO: 48916 - protein, 11 aa, Mycobacterium tuberculosis
SQFGINIPPVP

SEQ ID NO: 48917 - protein, 11 aa, Mycobacterium tuberculosis
QFGINIPPVPS

SEQ ID NO: 48918 - protein, 11 aa, Mycobacterium tuberculosis
FGINIPPVPSL

SEQ ID NO: 48919 - protein, 11 aa, Mycobacterium tuberculosis
GINIPPVPSLT

SEQ ID NO: 48920 - protein, 11 aa, Mycobacterium tuberculosis
INIPPVPSLTG

SEQ ID NO: 48921 - protein, 11 aa, Mycobacterium tuberculosis
NIPPVPSLTGS

SEQ ID NO: 48922 - protein, 11 aa, Mycobacterium tuberculosis
IPPVPSLTGSG

SEQ ID NO: 48923 - protein, 11 aa, Mycobacterium tuberculosis
PPVPSLTGSGD

SEQ ID NO: 48924 - protein, 11 aa, Mycobacterium tuberculosis
PVPSLTGSGDA

SEQ ID NO: 48925 - protein, 11 aa, Mycobacterium tuberculosis
VPSLTGSGDAS

SEQ ID NO: 48926 - protein, 11 aa, Mycobacterium tuberculosis
PSLTGSGDAST

SEQ ID NO: 48927 - protein, 11 aa, Mycobacterium tuberculosis
SLTGSGDASTG

SEQ ID NO: 48928 - protein, 11 aa, Mycobacterium tuberculosis
LTGSGDASTGL

SEQ ID NO: 48929 - protein, 11 aa, Mycobacterium tuberculosis
TGSGDASTGLT

SEQ ID NO: 48930 - protein, 11 aa, Mycobacterium tuberculosis
GSGDASTGLTG

SEQ ID NO: 48931 - protein, 11 aa, Mycobacterium tuberculosis
SGDASTGLTGP

SEQ ID NO: 48932 - protein, 11 aa, Mycobacterium tuberculosis
GDASTGLTGPG

SEQ ID NO: 48933 - protein, 11 aa, Mycobacterium tuberculosis
DASTGLTGPGL

SEQ ID NO: 48934 - protein, 11 aa, Mycobacterium tuberculosis
ASTGLTGPGLT

SEQ ID NO: 48935 - protein, 11 aa, Mycobacterium tuberculosis
STGLTGPGLTS

SEQ ID NO: 48936 - protein, 11 aa, Mycobacterium tuberculosis
TGLTGPGLTSP

SEQ ID NO: 48937 - protein, 11 aa, Mycobacterium tuberculosis
GLTGPGLTSPG

SEQ ID NO: 48938 - protein, 11 aa, Mycobacterium tuberculosis
LTGPGLTSPGL

SEQ ID NO: 48939 - protein, 11 aa, Mycobacterium tuberculosis
TGPGLTSPGLT

SEQ ID NO: 48940 - protein, 11 aa, Mycobacterium tuberculosis
GPGLTSPGLTS

SEQ ID NO: 48941 - protein, 11 aa, Mycobacterium tuberculosis
PGLTSPGLTSP

SEQ ID NO: 48942 - protein, 11 aa, Mycobacterium tuberculosis
GLTSPGLTSPG

SEQ ID NO: 48943 - protein, 11 aa, Mycobacterium tuberculosis
LTSPGLTSPGL

SEQ ID NO: 48944 - protein, 11 aa, Mycobacterium tuberculosis
TSPGLTSPGLT

SEQ ID NO: 48945 - protein, 11 aa, Mycobacterium tuberculosis
SPGLTSPGLTS

SEQ ID NO: 48946 - protein, 11 aa, Mycobacterium tuberculosis
PGLTSPGLTSP

SEQ ID NO: 48947 - protein, 11 aa, Mycobacterium tuberculosis
GLTSPGLTSPG

SEQ ID NO: 48948 - protein, 11 aa, Mycobacterium tuberculosis
LTSPGLTSPGL

SEQ ID NO: 48949 - protein, 11 aa, Mycobacterium tuberculosis
TSPGLTSPGLT

SEQ ID NO: 48950 - protein, 11 aa, Mycobacterium tuberculosis
SPGLTSPGLTD

SEQ ID NO: 48951 - protein, 11 aa, Mycobacterium tuberculosis
PGLTSPGLTDP

SEQ ID NO: 48952 - protein, 11 aa, Mycobacterium tuberculosis
GLTSPGLTDPA

SEQ ID NO: 48953 - protein, 11 aa, Mycobacterium tuberculosis
LTSPGLTDPAL

SEQ ID NO: 48954 - protein, 11 aa, Mycobacterium tuberculosis
TSPGLTDPALT

SEQ ID NO: 48955 - protein, 11 aa, Mycobacterium tuberculosis
SPGLTDPALTS

SEQ ID NO: 48956 - protein, 11 aa, Mycobacterium tuberculosis
PGLTDPALTSP

SEQ ID NO: 48957 - protein, 11 aa, Mycobacterium tuberculosis
GLTDPALTSPG

SEQ ID NO: 48958 - protein, 11 aa, Mycobacterium tuberculosis
LTDPALTSPGL

SEQ ID NO: 48959 - protein, 11 aa, Mycobacterium tuberculosis
TDPALTSPGLT

SEQ ID NO: 48960 - protein, 11 aa, Mycobacterium tuberculosis
DPALTSPGLTP

SEQ ID NO: 48961 - protein, 11 aa, Mycobacterium tuberculosis
PALTSPGLTPT

SEQ ID NO: 48962 - protein, 11 aa, Mycobacterium tuberculosis
ALTSPGLTPTL

SEQ ID NO: 48963 - protein, 11 aa, Mycobacterium tuberculosis
LTSPGLTPTLP

SEQ ID NO: 48964 - protein, 11 aa, Mycobacterium tuberculosis
TSPGLTPTLPG

SEQ ID NO: 48965 - protein, 11 aa, Mycobacterium tuberculosis
SPGLTPTLPGS

SEQ ID NO: 48966 - protein, 11 aa, Mycobacterium tuberculosis
PGLTPTLPGSL

SEQ ID NO: 48967 - protein, 11 aa, Mycobacterium tuberculosis
GLTPTLPGSLA

SEQ ID NO: 48968 - protein, 11 aa, Mycobacterium tuberculosis
LTPTLPGSLAA

SEQ ID NO: 48969 - protein, 11 aa, Mycobacterium tuberculosis
TPTLPGSLAAP

SEQ ID NO: 48970 - protein, 11 aa, Mycobacterium tuberculosis
PTLPGSLAAPG

SEQ ID NO: 48971 - protein, 11 aa, Mycobacterium tuberculosis
TLPGSLAAPGT

SEQ ID NO: 48972 - protein, 11 aa, Mycobacterium tuberculosis
LPGSLAAPGTT

SEQ ID NO: 48973 - protein, 11 aa, Mycobacterium tuberculosis
PGSLAAPGTTL

SEQ ID NO: 48974 - protein, 11 aa, Mycobacterium tuberculosis
GSLAAPGTTLA

SEQ ID NO: 48975 - protein, 11 aa, Mycobacterium tuberculosis
SLAAPGTTLAP

SEQ ID NO: 48976 - protein, 11 aa, Mycobacterium tuberculosis
LAAPGTTLAPT

SEQ ID NO: 48977 - protein, 11 aa, Mycobacterium tuberculosis
AAPGTTLAPTP

SEQ ID NO: 48978 - protein, 11 aa, Mycobacterium tuberculosis
APGTTLAPTPG

SEQ ID NO: 48979 - protein, 11 aa, Mycobacterium tuberculosis
PGTTLAPTPGV

SEQ ID NO: 48980 - protein, 11 aa, Mycobacterium tuberculosis
GTTLAPTPGVG

SEQ ID NO: 48981 - protein, 11 aa, Mycobacterium tuberculosis
TTLAPTPGVGA

SEQ ID NO: 48982 - protein, 11 aa, Mycobacterium tuberculosis
TLAPTPGVGAN

SEQ ID NO: 48983 - protein, 11 aa, Mycobacterium tuberculosis
LAPTPGVGANP

SEQ ID NO: 48984 - protein, 11 aa, Mycobacterium tuberculosis
APTPGVGANPA

SEQ ID NO: 48985 - protein, 11 aa, Mycobacterium tuberculosis
PTPGVGANPAL

SEQ ID NO: 48986 - protein, 11 aa, Mycobacterium tuberculosis
TPGVGANPALT

SEQ ID NO: 48987 - protein, 11 aa, Mycobacterium tuberculosis
PGVGANPALTN

SEQ ID NO: 48988 - protein, 11 aa, Mycobacterium tuberculosis
GVGANPALTNP

SEQ ID NO: 48989 - protein, 11 aa, Mycobacterium tuberculosis
VGANPALTNPA

SEQ ID NO: 48990 - protein, 11 aa, Mycobacterium tuberculosis
GANPALTNPAL

SEQ ID NO: 48991 - protein, 11 aa, Mycobacterium tuberculosis
ANPALTNPALT

SEQ ID NO: 48992 - protein, 11 aa, Mycobacterium tuberculosis
NPALTNPALTS

SEQ ID NO: 48993 - protein, 11 aa, Mycobacterium tuberculosis
PALTNPALTSP

SEQ ID NO: 48994 - protein, 11 aa, Mycobacterium tuberculosis
ALTNPALTSPT

SEQ ID NO: 48995 - protein, 11 aa, Mycobacterium tuberculosis
LTNPALTSPTG

SEQ ID NO: 48996 - protein, 11 aa, Mycobacterium tuberculosis
TNPALTSPTGA

SEQ ID NO: 48997 - protein, 11 aa, Mycobacterium tuberculosis
NPALTSPTGAT

SEQ ID NO: 48998 - protein, 11 aa, Mycobacterium tuberculosis
PALTSPTGATP

SEQ ID NO: 48999 - protein, 11 aa, Mycobacterium tuberculosis
ALTSPTGATPG

SEQ ID NO: 49000 - protein, 11 aa, Mycobacterium tuberculosis
LTSPTGATPGL

SEQ ID NO: 49001 - protein, 11 aa, Mycobacterium tuberculosis
TSPTGATPGLT

SEQ ID NO: 49002 - protein, 11 aa, Mycobacterium tuberculosis
SPTGATPGLTS

SEQ ID NO: 49003 - protein, 11 aa, Mycobacterium tuberculosis
PTGATPGLTSP

SEQ ID NO: 49004 - protein, 11 aa, Mycobacterium tuberculosis
TGATPGLTSPT

SEQ ID NO: 49005 - protein, 11 aa, Mycobacterium tuberculosis
GATPGLTSPTG

SEQ ID NO: 49006 - protein, 11 aa, Mycobacterium tuberculosis
ATPGLTSPTGL

SEQ ID NO: 49007 - protein, 11 aa, Mycobacterium tuberculosis
TPGLTSPTGLD

SEQ ID NO: 49008 - protein, 11 aa, Mycobacterium tuberculosis
PGLTSPTGLDP

SEQ ID NO: 49009 - protein, 11 aa, Mycobacterium tuberculosis
GLTSPTGLDPA

SEQ ID NO: 49010 - protein, 11 aa, Mycobacterium tuberculosis
LTSPTGLDPAL

SEQ ID NO: 49011 - protein, 11 aa, Mycobacterium tuberculosis
TSPTGLDPALG

SEQ ID NO: 49012 - protein, 11 aa, Mycobacterium tuberculosis
SPTGLDPALGG

SEQ ID NO: 49013 - protein, 11 aa, Mycobacterium tuberculosis
PTGLDPALGGA

SEQ ID NO: 49014 - protein, 11 aa, Mycobacterium tuberculosis
TGLDPALGGAN

SEQ ID NO: 49015 - protein, 11 aa, Mycobacterium tuberculosis
GLDPALGGANE

SEQ ID NO: 49016 - protein, 11 aa, Mycobacterium tuberculosis
LDPALGGANEI

SEQ ID NO: 49017 - protein, 11 aa, Mycobacterium tuberculosis
DPALGGANEIP

SEQ ID NO: 49018 - protein, 11 aa, Mycobacterium tuberculosis
PALGGANEIPI

SEQ ID NO: 49019 - protein, 11 aa, Mycobacterium tuberculosis
ALGGANEIPIT

SEQ ID NO: 49020 - protein, 11 aa, Mycobacterium tuberculosis
LGGANEIPITT

SEQ ID NO: 49021 - protein, 11 aa, Mycobacterium tuberculosis
GGANEIPITTP

SEQ ID NO: 49022 - protein, 11 aa, Mycobacterium tuberculosis
GANEIPITTPV

SEQ ID NO: 49023 - protein, 11 aa, Mycobacterium tuberculosis
ANEIPITTPVG

SEQ ID NO: 49024 - protein, 11 aa, Mycobacterium tuberculosis
NEIPITTPVGL

SEQ ID NO: 49025 - protein, 11 aa, Mycobacterium tuberculosis
EIPITTPVGLD

SEQ ID NO: 49026 - protein, 11 aa, Mycobacterium tuberculosis
IPITTPVGLDP

SEQ ID NO: 49027 - protein, 11 aa, Mycobacterium tuberculosis
PITTPVGLDPG

SEQ ID NO: 49028 - protein, 11 aa, Mycobacterium tuberculosis
ITTPVGLDPGA

SEQ ID NO: 49029 - protein, 11 aa, Mycobacterium tuberculosis
TTPVGLDPGAD

SEQ ID NO: 49030 - protein, 11 aa, Mycobacterium tuberculosis
TPVGLDPGADG

SEQ ID NO: 49031 - protein, 11 aa, Mycobacterium tuberculosis
PVGLDPGADGT

SEQ ID NO: 49032 - protein, 11 aa, Mycobacterium tuberculosis
VGLDPGADGTY

SEQ ID NO: 49033 - protein, 11 aa, Mycobacterium tuberculosis
GLDPGADGTYP

SEQ ID NO: 49034 - protein, 11 aa, Mycobacterium tuberculosis
LDPGADGTYPI

SEQ ID NO: 49035 - protein, 11 aa, Mycobacterium tuberculosis
DPGADGTYPIL

SEQ ID NO: 49036 - protein, 11 aa, Mycobacterium tuberculosis
PGADGTYPILG

SEQ ID NO: 49037 - protein, 11 aa, Mycobacterium tuberculosis
GADGTYPILGD

SEQ ID NO: 49038 - protein, 11 aa, Mycobacterium tuberculosis
ADGTYPILGDP

SEQ ID NO: 49039 - protein, 11 aa, Mycobacterium tuberculosis
DGTYPILGDPT

SEQ ID NO: 49040 - protein, 11 aa, Mycobacterium tuberculosis
GTYPILGDPTL

SEQ ID NO: 49041 - protein, 11 aa, Mycobacterium tuberculosis
TYPILGDPTLG

SEQ ID NO: 49042 - protein, 11 aa, Mycobacterium tuberculosis
YPILGDPTLGT

SEQ ID NO: 49043 - protein, 11 aa, Mycobacterium tuberculosis
PILGDPTLGTI

SEQ ID NO: 49044 - protein, 11 aa, Mycobacterium tuberculosis
ILGDPTLGTIP

SEQ ID NO: 49045 - protein, 11 aa, Mycobacterium tuberculosis
LGDPTLGTIPS

SEQ ID NO: 49046 - protein, 11 aa, Mycobacterium tuberculosis
GDPTLGTIPSS

SEQ ID NO: 49047 - protein, 11 aa, Mycobacterium tuberculosis
DPTLGTIPSSP

SEQ ID NO: 49048 - protein, 11 aa, Mycobacterium tuberculosis
PTLGTIPSSPA

SEQ ID NO: 49049 - protein, 11 aa, Mycobacterium tuberculosis
TLGTIPSSPAT

SEQ ID NO: 49050 - protein, 11 aa, Mycobacterium tuberculosis
LGTIPSSPATT

SEQ ID NO: 49051 - protein, 11 aa, Mycobacterium tuberculosis
GTIPSSPATTS

SEQ ID NO: 49052 - protein, 11 aa, Mycobacterium tuberculosis
TIPSSPATTST

SEQ ID NO: 49053 - protein, 11 aa, Mycobacterium tuberculosis
IPSSPATTSTG

SEQ ID NO: 49054 - protein, 11 aa, Mycobacterium tuberculosis
PSSPATTSTGG

SEQ ID NO: 49055 - protein, 11 aa, Mycobacterium tuberculosis
SSPATTSTGGG

SEQ ID NO: 49056 - protein, 11 aa, Mycobacterium tuberculosis
SPATTSTGGGG

SEQ ID NO: 49057 - protein, 11 aa, Mycobacterium tuberculosis
PATTSTGGGGL

SEQ ID NO: 49058 - protein, 11 aa, Mycobacterium tuberculosis
ATTSTGGGGLV

SEQ ID NO: 49059 - protein, 11 aa, Mycobacterium tuberculosis
TTSTGGGGLVN

SEQ ID NO: 49060 - protein, 11 aa, Mycobacterium tuberculosis
TSTGGGGLVND

SEQ ID NO: 49061 - protein, 11 aa, Mycobacterium tuberculosis
STGGGGLVNDV

SEQ ID NO: 49062 - protein, 11 aa, Mycobacterium tuberculosis
TGGGGLVNDVM

SEQ ID NO: 49063 - protein, 11 aa, Mycobacterium tuberculosis
GGGGLVNDVMQ

SEQ ID NO: 49064 - protein, 11 aa, Mycobacterium tuberculosis
GGGLVNDVMQV

SEQ ID NO: 49065 - protein, 11 aa, Mycobacterium tuberculosis
GGLVNDVMQVA

SEQ ID NO: 49066 - protein, 11 aa, Mycobacterium tuberculosis
GLVNDVMQVAN

SEQ ID NO: 49067 - protein, 11 aa, Mycobacterium tuberculosis
LVNDVMQVANE

SEQ ID NO: 49068 - protein, 11 aa, Mycobacterium tuberculosis
VNDVMQVANEL

SEQ ID NO: 49069 - protein, 11 aa, Mycobacterium tuberculosis
NDVMQVANELG

SEQ ID NO: 49070 - protein, 11 aa, Mycobacterium tuberculosis
DVMQVANELGA

SEQ ID NO: 49071 - protein, 11 aa, Mycobacterium tuberculosis
VMQVANELGAS

SEQ ID NO: 49072 - protein, 11 aa, Mycobacterium tuberculosis
MQVANELGASQ

SEQ ID NO: 49073 - protein, 11 aa, Mycobacterium tuberculosis
QVANELGASQA

SEQ ID NO: 49074 - protein, 11 aa, Mycobacterium tuberculosis
VANELGASQAI

SEQ ID NO: 49075 - protein, 11 aa, Mycobacterium tuberculosis
ANELGASQAID

SEQ ID NO: 49076 - protein, 11 aa, Mycobacterium tuberculosis
NELGASQAIDL

SEQ ID NO: 49077 - protein, 11 aa, Mycobacterium tuberculosis
ELGASQAIDLL

SEQ ID NO: 49078 - protein, 11 aa, Mycobacterium tuberculosis
LGASQAIDLLK

SEQ ID NO: 49079 - protein, 11 aa, Mycobacterium tuberculosis
GASQAIDLLKG

SEQ ID NO: 49080 - protein, 11 aa, Mycobacterium tuberculosis
ASQAIDLLKGV

SEQ ID NO: 49081 - protein, 11 aa, Mycobacterium tuberculosis
SQAIDLLKGVL

SEQ ID NO: 49082 - protein, 11 aa, Mycobacterium tuberculosis
QAIDLLKGVLM

SEQ ID NO: 49083 - protein, 11 aa, Mycobacterium tuberculosis
AIDLLKGVLMP

SEQ ID NO: 49084 - protein, 11 aa, Mycobacterium tuberculosis
IDLLKGVLMPS

SEQ ID NO: 49085 - protein, 11 aa, Mycobacterium tuberculosis
DLLKGVLMPSI

SEQ ID NO: 49086 - protein, 11 aa, Mycobacterium tuberculosis
LLKGVLMPSIM

SEQ ID NO: 49087 - protein, 11 aa, Mycobacterium tuberculosis
LKGVLMPSIMQ

SEQ ID NO: 49088 - protein, 11 aa, Mycobacterium tuberculosis
KGVLMPSIMQA

SEQ ID NO: 49089 - protein, 11 aa, Mycobacterium tuberculosis
GVLMPSIMQAV

SEQ ID NO: 49090 - protein, 11 aa, Mycobacterium tuberculosis
VLMPSIMQAVQ

SEQ ID NO: 49091 - protein, 11 aa, Mycobacterium tuberculosis
LMPSIMQAVQN

SEQ ID NO: 49092 - protein, 11 aa, Mycobacterium tuberculosis
MPSIMQAVQNG

SEQ ID NO: 49093 - protein, 11 aa, Mycobacterium tuberculosis
PSIMQAVQNGG

SEQ ID NO: 49094 - protein, 11 aa, Mycobacterium tuberculosis
SIMQAVQNGGA

SEQ ID NO: 49095 - protein, 11 aa, Mycobacterium tuberculosis
IMQAVQNGGAA

SEQ ID NO: 49096 - protein, 11 aa, Mycobacterium tuberculosis
MQAVQNGGAAA

SEQ ID NO: 49097 - protein, 11 aa, Mycobacterium tuberculosis
QAVQNGGAAAP

SEQ ID NO: 49098 - protein, 11 aa, Mycobacterium tuberculosis
AVQNGGAAAPA

SEQ ID NO: 49099 - protein, 11 aa, Mycobacterium tuberculosis
VQNGGAAAPAA

SEQ ID NO: 49100 - protein, 11 aa, Mycobacterium tuberculosis
QNGGAAAPAAS

SEQ ID NO: 49101 - protein, 11 aa, Mycobacterium tuberculosis
NGGAAAPAASP

SEQ ID NO: 49102 - protein, 11 aa, Mycobacterium tuberculosis
GGAAAPAASPP

SEQ ID NO: 49103 - protein, 11 aa, Mycobacterium tuberculosis
GAAAPAASPPV

SEQ ID NO: 49104 - protein, 11 aa, Mycobacterium tuberculosis
AAAPAASPPVP

SEQ ID NO: 49105 - protein, 11 aa, Mycobacterium tuberculosis
AAPAASPPVPP

SEQ ID NO: 49106 - protein, 11 aa, Mycobacterium tuberculosis
APAASPPVPPI

SEQ ID NO: 49107 - protein, 11 aa, Mycobacterium tuberculosis
PAASPPVPPIP

SEQ ID NO: 49108 - protein, 11 aa, Mycobacterium tuberculosis
AASPPVPPIPA

SEQ ID NO: 49109 - protein, 11 aa, Mycobacterium tuberculosis
ASPPVPPIPAA

SEQ ID NO: 49110 - protein, 11 aa, Mycobacterium tuberculosis
SPPVPPIPAAA

SEQ ID NO: 49111 - protein, 11 aa, Mycobacterium tuberculosis
PPVPPIPAAAA

SEQ ID NO: 49112 - protein, 11 aa, Mycobacterium tuberculosis
PVPPIPAAAAV

SEQ ID NO: 49113 - protein, 11 aa, Mycobacterium tuberculosis
VPPIPAAAAVP

SEQ ID NO: 49114 - protein, 11 aa, Mycobacterium tuberculosis
PPIPAAAAVPP

SEQ ID NO: 49115 - protein, 11 aa, Mycobacterium tuberculosis
PIPAAAAVPPT

SEQ ID NO: 49116 - protein, 11 aa, Mycobacterium tuberculosis
IPAAAAVPPTD

SEQ ID NO: 49117 - protein, 11 aa, Mycobacterium tuberculosis
PAAAAVPPTDP

SEQ ID NO: 49118 - protein, 11 aa, Mycobacterium tuberculosis
AAAAVPPTDPI

SEQ ID NO: 49119 - protein, 11 aa, Mycobacterium tuberculosis
AAAVPPTDPIT

SEQ ID NO: 49120 - protein, 11 aa, Mycobacterium tuberculosis
AAVPPTDPITV

SEQ ID NO: 49121 - protein, 11 aa, Mycobacterium tuberculosis
AVPPTDPITVP

SEQ ID NO: 49122 - protein, 11 aa, Mycobacterium tuberculosis
VPPTDPITVPV

SEQ ID NO: 49123 - protein, 11 aa, Mycobacterium tuberculosis
PPTDPITVPVA

SEQ ID NO: 49124 - protein, 8 aa, Mycobacterium tuberculosis
MLWHAMPP

SEQ ID NO: 49125 - protein, 8 aa, Mycobacterium tuberculosis
LWHAMPPE

SEQ ID NO: 49126 - protein, 8 aa, Mycobacterium tuberculosis
WHAMPPEL

SEQ ID NO: 49127 - protein, 8 aa, Mycobacterium tuberculosis
HAMPPELN

SEQ ID NO: 49128 - protein, 8 aa, Mycobacterium tuberculosis
AMPPELNT

SEQ ID NO: 49129 - protein, 8 aa, Mycobacterium tuberculosis
MPPELNTA

SEQ ID NO: 49130 - protein, 8 aa, Mycobacterium tuberculosis
PPELNTAR

SEQ ID NO: 49131 - protein, 8 aa, Mycobacterium tuberculosis
PELNTARL

SEQ ID NO: 49132 - protein, 8 aa, Mycobacterium tuberculosis
ELNTARLM

SEQ ID NO: 49133 - protein, 8 aa, Mycobacterium tuberculosis
LNTARLMA

SEQ ID NO: 49134 - protein, 8 aa, Mycobacterium tuberculosis
NTARLMAG

SEQ ID NO: 49135 - protein, 8 aa, Mycobacterium tuberculosis
TARLMAGA

SEQ ID NO: 49136 - protein, 8 aa, Mycobacterium tuberculosis
ARLMAGAG

SEQ ID NO: 49137 - protein, 8 aa, Mycobacterium tuberculosis
RLMAGAGP

SEQ ID NO: 49138 - protein, 8 aa, Mycobacterium tuberculosis
LMAGAGPA

SEQ ID NO: 49139 - protein, 8 aa, Mycobacterium tuberculosis
MAGAGPAP

SEQ ID NO: 49140 - protein, 8 aa, Mycobacterium tuberculosis
AGAGPAPM

SEQ ID NO: 49141 - protein, 8 aa, Mycobacterium tuberculosis
GAGPAPML

SEQ ID NO: 49142 - protein, 8 aa, Mycobacterium tuberculosis
AGPAPMLA

SEQ ID NO: 49143 - protein, 8 aa, Mycobacterium tuberculosis
GPAPMLAA

SEQ ID NO: 49144 - protein, 8 aa, Mycobacterium tuberculosis
PAPMLAAA

SEQ ID NO: 49145 - protein, 8 aa, Mycobacterium tuberculosis
APMLAAAA

SEQ ID NO: 49146 - protein, 8 aa, Mycobacterium tuberculosis
PMLAAAAG

SEQ ID NO: 49147 - protein, 8 aa, Mycobacterium tuberculosis
MLAAAAGW

SEQ ID NO: 49148 - protein, 8 aa, Mycobacterium tuberculosis
LAAAAGWQ

SEQ ID NO: 49149 - protein, 8 aa, Mycobacterium tuberculosis
AAAAGWQT

SEQ ID NO: 49150 - protein, 8 aa, Mycobacterium tuberculosis
AAAGWQTL

SEQ ID NO: 49151 - protein, 8 aa, Mycobacterium tuberculosis
AAGWQTLS

SEQ ID NO: 49152 - protein, 8 aa, Mycobacterium tuberculosis
AGWQTLSA

SEQ ID NO: 49153 - protein, 8 aa, Mycobacterium tuberculosis
GWQTLSAA

SEQ ID NO: 49154 - protein, 8 aa, Mycobacterium tuberculosis
WQTLSAAL

SEQ ID NO: 49155 - protein, 8 aa, Mycobacterium tuberculosis
QTLSAALD

SEQ ID NO: 49156 - protein, 8 aa, Mycobacterium tuberculosis
TLSAALDA

SEQ ID NO: 49157 - protein, 8 aa, Mycobacterium tuberculosis
LSAALDAQ

SEQ ID NO: 49158 - protein, 8 aa, Mycobacterium tuberculosis
SAALDAQA

SEQ ID NO: 49159 - protein, 8 aa, Mycobacterium tuberculosis
AALDAQAV

SEQ ID NO: 49160 - protein, 8 aa, Mycobacterium tuberculosis
ALDAQAVE

SEQ ID NO: 49161 - protein, 8 aa, Mycobacterium tuberculosis
LDAQAVEL

SEQ ID NO: 49162 - protein, 8 aa, Mycobacterium tuberculosis
DAQAVELT

SEQ ID NO: 49163 - protein, 8 aa, Mycobacterium tuberculosis
AQAVELTA

SEQ ID NO: 49164 - protein, 8 aa, Mycobacterium tuberculosis
QAVELTAR

SEQ ID NO: 49165 - protein, 8 aa, Mycobacterium tuberculosis
AVELTARL

SEQ ID NO: 49166 - protein, 8 aa, Mycobacterium tuberculosis
VELTARLN

SEQ ID NO: 49167 - protein, 8 aa, Mycobacterium tuberculosis
ELTARLNS

SEQ ID NO: 49168 - protein, 8 aa, Mycobacterium tuberculosis
LTARLNSL

SEQ ID NO: 49169 - protein, 8 aa, Mycobacterium tuberculosis
TARLNSLG

SEQ ID NO: 49170 - protein, 8 aa, Mycobacterium tuberculosis
ARLNSLGE

SEQ ID NO: 49171 - protein, 8 aa, Mycobacterium tuberculosis
RLNSLGEA

SEQ ID NO: 49172 - protein, 8 aa, Mycobacterium tuberculosis
LNSLGEAW

SEQ ID NO: 49173 - protein, 8 aa, Mycobacterium tuberculosis
NSLGEAWT

SEQ ID NO: 49174 - protein, 8 aa, Mycobacterium tuberculosis
SLGEAWTG

SEQ ID NO: 49175 - protein, 8 aa, Mycobacterium tuberculosis
LGEAWTGG

SEQ ID NO: 49176 - protein, 8 aa, Mycobacterium tuberculosis
GEAWTGGG

SEQ ID NO: 49177 - protein, 8 aa, Mycobacterium tuberculosis
EAWTGGGS

SEQ ID NO: 49178 - protein, 8 aa, Mycobacterium tuberculosis
AWTGGGSD

SEQ ID NO: 49179 - protein, 8 aa, Mycobacterium tuberculosis
WTGGGSDK

SEQ ID NO: 49180 - protein, 8 aa, Mycobacterium tuberculosis
TGGGSDKA

SEQ ID NO: 49181 - protein, 8 aa, Mycobacterium tuberculosis
GGGSDKAL

SEQ ID NO: 49182 - protein, 8 aa, Mycobacterium tuberculosis
GGSDKALA

SEQ ID NO: 49183 - protein, 8 aa, Mycobacterium tuberculosis
GSDKALAA

SEQ ID NO: 49184 - protein, 8 aa, Mycobacterium tuberculosis
SDKALAAA

SEQ ID NO: 49185 - protein, 8 aa, Mycobacterium tuberculosis
DKALAAAT

SEQ ID NO: 49186 - protein, 8 aa, Mycobacterium tuberculosis
KALAAATP

SEQ ID NO: 49187 - protein, 8 aa, Mycobacterium tuberculosis
ALAAATPM

SEQ ID NO: 49188 - protein, 8 aa, Mycobacterium tuberculosis
LAAATPMV

SEQ ID NO: 49189 - protein, 8 aa, Mycobacterium tuberculosis
AAATPMVV

SEQ ID NO: 49190 - protein, 8 aa, Mycobacterium tuberculosis
AATPMVVW

SEQ ID NO: 49191 - protein, 8 aa, Mycobacterium tuberculosis
ATPMVVWL

SEQ ID NO: 49192 - protein, 8 aa, Mycobacterium tuberculosis
TPMVVWLQ

SEQ ID NO: 49193 - protein, 8 aa, Mycobacterium tuberculosis
PMVVWLQT

SEQ ID NO: 49194 - protein, 8 aa, Mycobacterium tuberculosis
MVVWLQTA

SEQ ID NO: 49195 - protein, 8 aa, Mycobacterium tuberculosis
VVWLQTAS

SEQ ID NO: 49196 - protein, 8 aa, Mycobacterium tuberculosis
VWLQTAST

SEQ ID NO: 49197 - protein, 8 aa, Mycobacterium tuberculosis
WLQTASTQ

SEQ ID NO: 49198 - protein, 8 aa, Mycobacterium tuberculosis
LQTASTQA

SEQ ID NO: 49199 - protein, 8 aa, Mycobacterium tuberculosis
QTASTQAK

SEQ ID NO: 49200 - protein, 8 aa, Mycobacterium tuberculosis
TASTQAKT

SEQ ID NO: 49201 - protein, 8 aa, Mycobacterium tuberculosis
ASTQAKTR

SEQ ID NO: 49202 - protein, 8 aa, Mycobacterium tuberculosis
STQAKTRA

SEQ ID NO: 49203 - protein, 8 aa, Mycobacterium tuberculosis
TQAKTRAM

SEQ ID NO: 49204 - protein, 8 aa, Mycobacterium tuberculosis
QAKTRAMQ

SEQ ID NO: 49205 - protein, 8 aa, Mycobacterium tuberculosis
AKTRAMQA

SEQ ID NO: 49206 - protein, 8 aa, Mycobacterium tuberculosis
KTRAMQAT

SEQ ID NO: 49207 - protein, 8 aa, Mycobacterium tuberculosis
TRAMQATA

SEQ ID NO: 49208 - protein, 8 aa, Mycobacterium tuberculosis
RAMQATAQ

SEQ ID NO: 49209 - protein, 8 aa, Mycobacterium tuberculosis
AMQATAQA

SEQ ID NO: 49210 - protein, 8 aa, Mycobacterium tuberculosis
MQATAQAA

SEQ ID NO: 49211 - protein, 8 aa, Mycobacterium tuberculosis
QATAQAAA

SEQ ID NO: 49212 - protein, 8 aa, Mycobacterium tuberculosis
ATAQAAAY

SEQ ID NO: 49213 - protein, 8 aa, Mycobacterium tuberculosis
TAQAAAYT

SEQ ID NO: 49214 - protein, 8 aa, Mycobacterium tuberculosis
AQAAAYTQ

SEQ ID NO: 49215 - protein, 8 aa, Mycobacterium tuberculosis
QAAAYTQA

SEQ ID NO: 49216 - protein, 8 aa, Mycobacterium tuberculosis
AAAYTQAM

SEQ ID NO: 49217 - protein, 8 aa, Mycobacterium tuberculosis
AAYTQAMA

SEQ ID NO: 49218 - protein, 8 aa, Mycobacterium tuberculosis
AYTQAMAT

SEQ ID NO: 49219 - protein, 8 aa, Mycobacterium tuberculosis
YTQAMATT

SEQ ID NO: 49220 - protein, 8 aa, Mycobacterium tuberculosis
TQAMATTP

SEQ ID NO: 49221 - protein, 8 aa, Mycobacterium tuberculosis
QAMATTPS

SEQ ID NO: 49222 - protein, 8 aa, Mycobacterium tuberculosis
AMATTPSL

SEQ ID NO: 49223 - protein, 8 aa, Mycobacterium tuberculosis
MATTPSLP

SEQ ID NO: 49224 - protein, 8 aa, Mycobacterium tuberculosis
ATTPSLPE

SEQ ID NO: 49225 - protein, 8 aa, Mycobacterium tuberculosis
TTPSLPEI

SEQ ID NO: 49226 - protein, 8 aa, Mycobacterium tuberculosis
TPSLPEIA

SEQ ID NO: 49227 - protein, 8 aa, Mycobacterium tuberculosis
PSLPEIAA

SEQ ID NO: 49228 - protein, 8 aa, Mycobacterium tuberculosis
SLPEIAAN

SEQ ID NO: 49229 - protein, 8 aa, Mycobacterium tuberculosis
LPEIAANH

SEQ ID NO: 49230 - protein, 8 aa, Mycobacterium tuberculosis
PEIAANHI

SEQ ID NO: 49231 - protein, 8 aa, Mycobacterium tuberculosis
EIAANHIT

SEQ ID NO: 49232 - protein, 8 aa, Mycobacterium tuberculosis
IAANHITQ

SEQ ID NO: 49233 - protein, 8 aa, Mycobacterium tuberculosis
AANHITQA

SEQ ID NO: 49234 - protein, 8 aa, Mycobacterium tuberculosis
ANHITQAV

SEQ ID NO: 49235 - protein, 8 aa, Mycobacterium tuberculosis
NHITQAVL

SEQ ID NO: 49236 - protein, 8 aa, Mycobacterium tuberculosis
HITQAVLT

SEQ ID NO: 49237 - protein, 8 aa, Mycobacterium tuberculosis
ITQAVLTA

SEQ ID NO: 49238 - protein, 8 aa, Mycobacterium tuberculosis
TQAVLTAT

SEQ ID NO: 49239 - protein, 8 aa, Mycobacterium tuberculosis
QAVLTATN

SEQ ID NO: 49240 - protein, 8 aa, Mycobacterium tuberculosis
AVLTATNF

SEQ ID NO: 49241 - protein, 8 aa, Mycobacterium tuberculosis
VLTATNFF

SEQ ID NO: 49242 - protein, 8 aa, Mycobacterium tuberculosis
LTATNFFG

SEQ ID NO: 49243 - protein, 8 aa, Mycobacterium tuberculosis
TATNFFGI

SEQ ID NO: 49244 - protein, 8 aa, Mycobacterium tuberculosis
ATNFFGIN

SEQ ID NO: 49245 - protein, 8 aa, Mycobacterium tuberculosis
TNFFGINT

SEQ ID NO: 49246 - protein, 8 aa, Mycobacterium tuberculosis
NFFGINTI

SEQ ID NO: 49247 - protein, 8 aa, Mycobacterium tuberculosis
FFGINTIP

SEQ ID NO: 49248 - protein, 8 aa, Mycobacterium tuberculosis
FGINTIPI

SEQ ID NO: 49249 - protein, 8 aa, Mycobacterium tuberculosis
GINTIPIA

SEQ ID NO: 49250 - protein, 8 aa, Mycobacterium tuberculosis
INTIPIAL

SEQ ID NO: 49251 - protein, 8 aa, Mycobacterium tuberculosis
NTIPIALT

SEQ ID NO: 49252 - protein, 8 aa, Mycobacterium tuberculosis
TIPIALTE

SEQ ID NO: 49253 - protein, 8 aa, Mycobacterium tuberculosis
IPIALTEM

SEQ ID NO: 49254 - protein, 8 aa, Mycobacterium tuberculosis
PIALTEMD

SEQ ID NO: 49255 - protein, 8 aa, Mycobacterium tuberculosis
IALTEMDY

SEQ ID NO: 49256 - protein, 8 aa, Mycobacterium tuberculosis
ALTEMDYF

SEQ ID NO: 49257 - protein, 8 aa, Mycobacterium tuberculosis
LTEMDYFI

SEQ ID NO: 49258 - protein, 8 aa, Mycobacterium tuberculosis
TEMDYFIR

SEQ ID NO: 49259 - protein, 8 aa, Mycobacterium tuberculosis
EMDYFIRM

SEQ ID NO: 49260 - protein, 8 aa, Mycobacterium tuberculosis
MDYFIRMW

SEQ ID NO: 49261 - protein, 8 aa, Mycobacterium tuberculosis
DYFIRMWN

SEQ ID NO: 49262 - protein, 8 aa, Mycobacterium tuberculosis
YFIRMWNQ

SEQ ID NO: 49263 - protein, 8 aa, Mycobacterium tuberculosis
FIRMWNQA

SEQ ID NO: 49264 - protein, 8 aa, Mycobacterium tuberculosis
IRMWNQAA

SEQ ID NO: 49265 - protein, 8 aa, Mycobacterium tuberculosis
RMWNQAAL

SEQ ID NO: 49266 - protein, 8 aa, Mycobacterium tuberculosis
MWNQAALA

SEQ ID NO: 49267 - protein, 8 aa, Mycobacterium tuberculosis
WNQAALAM

SEQ ID NO: 49268 - protein, 8 aa, Mycobacterium tuberculosis
NQAALAME

SEQ ID NO: 49269 - protein, 8 aa, Mycobacterium tuberculosis
QAALAMEV

SEQ ID NO: 49270 - protein, 8 aa, Mycobacterium tuberculosis
AALAMEVY

SEQ ID NO: 49271 - protein, 8 aa, Mycobacterium tuberculosis
ALAMEVYQ

SEQ ID NO: 49272 - protein, 8 aa, Mycobacterium tuberculosis
LAMEVYQA

SEQ ID NO: 49273 - protein, 8 aa, Mycobacterium tuberculosis
AMEVYQAE

SEQ ID NO: 49274 - protein, 8 aa, Mycobacterium tuberculosis
MEVYQAET

SEQ ID NO: 49275 - protein, 8 aa, Mycobacterium tuberculosis
EVYQAETA

SEQ ID NO: 49276 - protein, 8 aa, Mycobacterium tuberculosis
VYQAETAV

SEQ ID NO: 49277 - protein, 8 aa, Mycobacterium tuberculosis
YQAETAVN

SEQ ID NO: 49278 - protein, 8 aa, Mycobacterium tuberculosis
QAETAVNT

SEQ ID NO: 49279 - protein, 8 aa, Mycobacterium tuberculosis
AETAVNTL

SEQ ID NO: 49280 - protein, 8 aa, Mycobacterium tuberculosis
ETAVNTLF

SEQ ID NO: 49281 - protein, 8 aa, Mycobacterium tuberculosis
TAVNTLFE

SEQ ID NO: 49282 - protein, 8 aa, Mycobacterium tuberculosis
AVNTLFEK

SEQ ID NO: 49283 - protein, 8 aa, Mycobacterium tuberculosis
VNTLFEKL

SEQ ID NO: 49284 - protein, 8 aa, Mycobacterium tuberculosis
NTLFEKLE

SEQ ID NO: 49285 - protein, 8 aa, Mycobacterium tuberculosis
TLFEKLEP

SEQ ID NO: 49286 - protein, 8 aa, Mycobacterium tuberculosis
LFEKLEPM

SEQ ID NO: 49287 - protein, 8 aa, Mycobacterium tuberculosis
FEKLEPMA

SEQ ID NO: 49288 - protein, 8 aa, Mycobacterium tuberculosis
EKLEPMAS

SEQ ID NO: 49289 - protein, 8 aa, Mycobacterium tuberculosis
KLEPMASI

SEQ ID NO: 49290 - protein, 8 aa, Mycobacterium tuberculosis
LEPMASIL

SEQ ID NO: 49291 - protein, 8 aa, Mycobacterium tuberculosis
EPMASILD

SEQ ID NO: 49292 - protein, 8 aa, Mycobacterium tuberculosis
PMASILDP

SEQ ID NO: 49293 - protein, 8 aa, Mycobacterium tuberculosis
MASILDPG

SEQ ID NO: 49294 - protein, 8 aa, Mycobacterium tuberculosis
ASILDPGA

SEQ ID NO: 49295 - protein, 8 aa, Mycobacterium tuberculosis
SILDPGAS

SEQ ID NO: 49296 - protein, 8 aa, Mycobacterium tuberculosis
ILDPGASQ

SEQ ID NO: 49297 - protein, 8 aa, Mycobacterium tuberculosis
LDPGASQS

SEQ ID NO: 49298 - protein, 8 aa, Mycobacterium tuberculosis
DPGASQST

SEQ ID NO: 49299 - protein, 8 aa, Mycobacterium tuberculosis
PGASQSTT

SEQ ID NO: 49300 - protein, 8 aa, Mycobacterium tuberculosis
GASQSTTN

SEQ ID NO: 49301 - protein, 8 aa, Mycobacterium tuberculosis
ASQSTTNP

SEQ ID NO: 49302 - protein, 8 aa, Mycobacterium tuberculosis
SQSTTNPI

SEQ ID NO: 49303 - protein, 8 aa, Mycobacterium tuberculosis
QSTTNPIF

SEQ ID NO: 49304 - protein, 8 aa, Mycobacterium tuberculosis
STTNPIFG

SEQ ID NO: 49305 - protein, 8 aa, Mycobacterium tuberculosis
TTNPIFGM

SEQ ID NO: 49306 - protein, 8 aa, Mycobacterium tuberculosis
TNPIFGMP

SEQ ID NO: 49307 - protein, 8 aa, Mycobacterium tuberculosis
NPIFGMPS

SEQ ID NO: 49308 - protein, 8 aa, Mycobacterium tuberculosis
PIFGMPSP

SEQ ID NO: 49309 - protein, 8 aa, Mycobacterium tuberculosis
IFGMPSPG

SEQ ID NO: 49310 - protein, 8 aa, Mycobacterium tuberculosis
FGMPSPGS

SEQ ID NO: 49311 - protein, 8 aa, Mycobacterium tuberculosis
GMPSPGSS

SEQ ID NO: 49312 - protein, 8 aa, Mycobacterium tuberculosis
MPSPGSST

SEQ ID NO: 49313 - protein, 8 aa, Mycobacterium tuberculosis
PSPGSSTP

SEQ ID NO: 49314 - protein, 8 aa, Mycobacterium tuberculosis
SPGSSTPV

SEQ ID NO: 49315 - protein, 8 aa, Mycobacterium tuberculosis
PGSSTPVG

SEQ ID NO: 49316 - protein, 8 aa, Mycobacterium tuberculosis
GSSTPVGQ

SEQ ID NO: 49317 - protein, 8 aa, Mycobacterium tuberculosis
SSTPVGQL

SEQ ID NO: 49318 - protein, 8 aa, Mycobacterium tuberculosis
STPVGQLP

SEQ ID NO: 49319 - protein, 8 aa, Mycobacterium tuberculosis
TPVGQLPP

SEQ ID NO: 49320 - protein, 8 aa, Mycobacterium tuberculosis
PVGQLPPA

SEQ ID NO: 49321 - protein, 8 aa, Mycobacterium tuberculosis
VGQLPPAA

SEQ ID NO: 49322 - protein, 8 aa, Mycobacterium tuberculosis
GQLPPAAT

SEQ ID NO: 49323 - protein, 8 aa, Mycobacterium tuberculosis
QLPPAATQ

SEQ ID NO: 49324 - protein, 8 aa, Mycobacterium tuberculosis
LPPAATQT

SEQ ID NO: 49325 - protein, 8 aa, Mycobacterium tuberculosis
PPAATQTL

SEQ ID NO: 49326 - protein, 8 aa, Mycobacterium tuberculosis
PAATQTLG

SEQ ID NO: 49327 - protein, 8 aa, Mycobacterium tuberculosis
AATQTLGQ

SEQ ID NO: 49328 - protein, 8 aa, Mycobacterium tuberculosis
ATQTLGQL

SEQ ID NO: 49329 - protein, 8 aa, Mycobacterium tuberculosis
TQTLGQLG

SEQ ID NO: 49330 - protein, 8 aa, Mycobacterium tuberculosis
QTLGQLGE

SEQ ID NO: 49331 - protein, 8 aa, Mycobacterium tuberculosis
TLGQLGEM

SEQ ID NO: 49332 - protein, 8 aa, Mycobacterium tuberculosis
LGQLGEMS

SEQ ID NO: 49333 - protein, 8 aa, Mycobacterium tuberculosis
GQLGEMSG

SEQ ID NO: 49334 - protein, 8 aa, Mycobacterium tuberculosis
QLGEMSGP

SEQ ID NO: 49335 - protein, 8 aa, Mycobacterium tuberculosis
LGEMSGPM

SEQ ID NO: 49336 - protein, 8 aa, Mycobacterium tuberculosis
GEMSGPMQ

SEQ ID NO: 49337 - protein, 8 aa, Mycobacterium tuberculosis
EMSGPMQQ

SEQ ID NO: 49338 - protein, 8 aa, Mycobacterium tuberculosis
MSGPMQQL

SEQ ID NO: 49339 - protein, 8 aa, Mycobacterium tuberculosis
SGPMQQLT

SEQ ID NO: 49340 - protein, 8 aa, Mycobacterium tuberculosis
GPMQQLTQ

SEQ ID NO: 49341 - protein, 8 aa, Mycobacterium tuberculosis
PMQQLTQP

SEQ ID NO: 49342 - protein, 8 aa, Mycobacterium tuberculosis
MQQLTQPL

SEQ ID NO: 49343 - protein, 8 aa, Mycobacterium tuberculosis
QQLTQPLQ

SEQ ID NO: 49344 - protein, 8 aa, Mycobacterium tuberculosis
QLTQPLQQ

SEQ ID NO: 49345 - protein, 8 aa, Mycobacterium tuberculosis
LTQPLQQV

SEQ ID NO: 49346 - protein, 8 aa, Mycobacterium tuberculosis
TQPLQQVT

SEQ ID NO: 49347 - protein, 8 aa, Mycobacterium tuberculosis
QPLQQVTS

SEQ ID NO: 49348 - protein, 8 aa, Mycobacterium tuberculosis
PLQQVTSL

SEQ ID NO: 49349 - protein, 8 aa, Mycobacterium tuberculosis
LQQVTSLF

SEQ ID NO: 49350 - protein, 8 aa, Mycobacterium tuberculosis
QQVTSLFS

SEQ ID NO: 49351 - protein, 8 aa, Mycobacterium tuberculosis
QVTSLFSQ

SEQ ID NO: 49352 - protein, 8 aa, Mycobacterium tuberculosis
VTSLFSQV

SEQ ID NO: 49353 - protein, 8 aa, Mycobacterium tuberculosis
TSLFSQVG

SEQ ID NO: 49354 - protein, 8 aa, Mycobacterium tuberculosis
SLFSQVGG

SEQ ID NO: 49355 - protein, 8 aa, Mycobacterium tuberculosis
LFSQVGGT

SEQ ID NO: 49356 - protein, 8 aa, Mycobacterium tuberculosis
FSQVGGTG

SEQ ID NO: 49357 - protein, 8 aa, Mycobacterium tuberculosis
SQVGGTGG

SEQ ID NO: 49358 - protein, 8 aa, Mycobacterium tuberculosis
QVGGTGGG

SEQ ID NO: 49359 - protein, 8 aa, Mycobacterium tuberculosis
VGGTGGGN

SEQ ID NO: 49360 - protein, 8 aa, Mycobacterium tuberculosis
GGTGGGNP

SEQ ID NO: 49361 - protein, 8 aa, Mycobacterium tuberculosis
GTGGGNPA

SEQ ID NO: 49362 - protein, 8 aa, Mycobacterium tuberculosis
TGGGNPAD

SEQ ID NO: 49363 - protein, 8 aa, Mycobacterium tuberculosis
GGGNPADE

SEQ ID NO: 49364 - protein, 8 aa, Mycobacterium tuberculosis
GGNPADEE

SEQ ID NO: 49365 - protein, 8 aa, Mycobacterium tuberculosis
GNPADEEA

SEQ ID NO: 49366 - protein, 8 aa, Mycobacterium tuberculosis
NPADEEAA

SEQ ID NO: 49367 - protein, 8 aa, Mycobacterium tuberculosis
PADEEAAQ

SEQ ID NO: 49368 - protein, 8 aa, Mycobacterium tuberculosis
ADEEAAQM

SEQ ID NO: 49369 - protein, 8 aa, Mycobacterium tuberculosis
DEEAAQMG

SEQ ID NO: 49370 - protein, 8 aa, Mycobacterium tuberculosis
EEAAQMGL

SEQ ID NO: 49371 - protein, 8 aa, Mycobacterium tuberculosis
EAAQMGLL

SEQ ID NO: 49372 - protein, 8 aa, Mycobacterium tuberculosis
AAQMGLLG

SEQ ID NO: 49373 - protein, 8 aa, Mycobacterium tuberculosis
AQMGLLGT

SEQ ID NO: 49374 - protein, 8 aa, Mycobacterium tuberculosis
QMGLLGTS

SEQ ID NO: 49375 - protein, 8 aa, Mycobacterium tuberculosis
MGLLGTSP

SEQ ID NO: 49376 - protein, 8 aa, Mycobacterium tuberculosis
GLLGTSPL

SEQ ID NO: 49377 - protein, 8 aa, Mycobacterium tuberculosis
LLGTSPLS

SEQ ID NO: 49378 - protein, 8 aa, Mycobacterium tuberculosis
LGTSPLSN

SEQ ID NO: 49379 - protein, 8 aa, Mycobacterium tuberculosis
GTSPLSNH

SEQ ID NO: 49380 - protein, 8 aa, Mycobacterium tuberculosis
TSPLSNHP

SEQ ID NO: 49381 - protein, 8 aa, Mycobacterium tuberculosis
SPLSNHPL

SEQ ID NO: 49382 - protein, 8 aa, Mycobacterium tuberculosis
PLSNHPLA

SEQ ID NO: 49383 - protein, 8 aa, Mycobacterium tuberculosis
LSNHPLAG

SEQ ID NO: 49384 - protein, 8 aa, Mycobacterium tuberculosis
SNHPLAGG

SEQ ID NO: 49385 - protein, 8 aa, Mycobacterium tuberculosis
NHPLAGGS

SEQ ID NO: 49386 - protein, 8 aa, Mycobacterium tuberculosis
HPLAGGSG

SEQ ID NO: 49387 - protein, 8 aa, Mycobacterium tuberculosis
PLAGGSGP

SEQ ID NO: 49388 - protein, 8 aa, Mycobacterium tuberculosis
LAGGSGPS

SEQ ID NO: 49389 - protein, 8 aa, Mycobacterium tuberculosis
AGGSGPSA

SEQ ID NO: 49390 - protein, 8 aa, Mycobacterium tuberculosis
GGSGPSAG

SEQ ID NO: 49391 - protein, 8 aa, Mycobacterium tuberculosis
GSGPSAGA

SEQ ID NO: 49392 - protein, 8 aa, Mycobacterium tuberculosis
SGPSAGAG

SEQ ID NO: 49393 - protein, 8 aa, Mycobacterium tuberculosis
GPSAGAGL

SEQ ID NO: 49394 - protein, 8 aa, Mycobacterium tuberculosis
PSAGAGLL

SEQ ID NO: 49395 - protein, 8 aa, Mycobacterium tuberculosis
SAGAGLLR

SEQ ID NO: 49396 - protein, 8 aa, Mycobacterium tuberculosis
AGAGLLRA

SEQ ID NO: 49397 - protein, 8 aa, Mycobacterium tuberculosis
GAGLLRAE

SEQ ID NO: 49398 - protein, 8 aa, Mycobacterium tuberculosis
AGLLRAES

SEQ ID NO: 49399 - protein, 8 aa, Mycobacterium tuberculosis
GLLRAESL

SEQ ID NO: 49400 - protein, 8 aa, Mycobacterium tuberculosis
LLRAESLP

SEQ ID NO: 49401 - protein, 8 aa, Mycobacterium tuberculosis
LRAESLPG

SEQ ID NO: 49402 - protein, 8 aa, Mycobacterium tuberculosis
RAESLPGA

SEQ ID NO: 49403 - protein, 8 aa, Mycobacterium tuberculosis
AESLPGAG

SEQ ID NO: 49404 - protein, 8 aa, Mycobacterium tuberculosis
ESLPGAGG

SEQ ID NO: 49405 - protein, 8 aa, Mycobacterium tuberculosis
SLPGAGGS

SEQ ID NO: 49406 - protein, 8 aa, Mycobacterium tuberculosis
LPGAGGSL

SEQ ID NO: 49407 - protein, 8 aa, Mycobacterium tuberculosis
PGAGGSLT

SEQ ID NO: 49408 - protein, 8 aa, Mycobacterium tuberculosis
GAGGSLTR

SEQ ID NO: 49409 - protein, 8 aa, Mycobacterium tuberculosis
AGGSLTRT

SEQ ID NO: 49410 - protein, 8 aa, Mycobacterium tuberculosis
GGSLTRTP

SEQ ID NO: 49411 - protein, 8 aa, Mycobacterium tuberculosis
GSLTRTPL

SEQ ID NO: 49412 - protein, 8 aa, Mycobacterium tuberculosis
SLTRTPLM

SEQ ID NO: 49413 - protein, 8 aa, Mycobacterium tuberculosis
LTRTPLMS

SEQ ID NO: 49414 - protein, 8 aa, Mycobacterium tuberculosis
TRTPLMSQ

SEQ ID NO: 49415 - protein, 8 aa, Mycobacterium tuberculosis
RTPLMSQL

SEQ ID NO: 49416 - protein, 8 aa, Mycobacterium tuberculosis
TPLMSQLI

SEQ ID NO: 49417 - protein, 8 aa, Mycobacterium tuberculosis
PLMSQLIE

SEQ ID NO: 49418 - protein, 8 aa, Mycobacterium tuberculosis
LMSQLIEK

SEQ ID NO: 49419 - protein, 8 aa, Mycobacterium tuberculosis
MSQLIEKP

SEQ ID NO: 49420 - protein, 8 aa, Mycobacterium tuberculosis
SQLIEKPV

SEQ ID NO: 49421 - protein, 8 aa, Mycobacterium tuberculosis
QLIEKPVA

SEQ ID NO: 49422 - protein, 8 aa, Mycobacterium tuberculosis
LIEKPVAP

SEQ ID NO: 49423 - protein, 8 aa, Mycobacterium tuberculosis
IEKPVAPS

SEQ ID NO: 49424 - protein, 8 aa, Mycobacterium tuberculosis
EKPVAPSV

SEQ ID NO: 49425 - protein, 8 aa, Mycobacterium tuberculosis
KPVAPSVM

SEQ ID NO: 49426 - protein, 8 aa, Mycobacterium tuberculosis
PVAPSVMP

SEQ ID NO: 49427 - protein, 8 aa, Mycobacterium tuberculosis
VAPSVMPA

SEQ ID NO: 49428 - protein, 8 aa, Mycobacterium tuberculosis
APSVMPAA

SEQ ID NO: 49429 - protein, 8 aa, Mycobacterium tuberculosis
PSVMPAAA

SEQ ID NO: 49430 - protein, 8 aa, Mycobacterium tuberculosis
SVMPAAAA

SEQ ID NO: 49431 - protein, 8 aa, Mycobacterium tuberculosis
VMPAAAAG

SEQ ID NO: 49432 - protein, 8 aa, Mycobacterium tuberculosis
MPAAAAGS

SEQ ID NO: 49433 - protein, 8 aa, Mycobacterium tuberculosis
PAAAAGSS

SEQ ID NO: 49434 - protein, 8 aa, Mycobacterium tuberculosis
AAAAGSSA

SEQ ID NO: 49435 - protein, 8 aa, Mycobacterium tuberculosis
AAAGSSAT

SEQ ID NO: 49436 - protein, 8 aa, Mycobacterium tuberculosis
AAGSSATG

SEQ ID NO: 49437 - protein, 8 aa, Mycobacterium tuberculosis
AGSSATGG

SEQ ID NO: 49438 - protein, 8 aa, Mycobacterium tuberculosis
GSSATGGA

SEQ ID NO: 49439 - protein, 8 aa, Mycobacterium tuberculosis
SSATGGAA

SEQ ID NO: 49440 - protein, 8 aa, Mycobacterium tuberculosis
SATGGAAP

SEQ ID NO: 49441 - protein, 8 aa, Mycobacterium tuberculosis
ATGGAAPV

SEQ ID NO: 49442 - protein, 8 aa, Mycobacterium tuberculosis
TGGAAPVG

SEQ ID NO: 49443 - protein, 8 aa, Mycobacterium tuberculosis
GGAAPVGA

SEQ ID NO: 49444 - protein, 8 aa, Mycobacterium tuberculosis
GAAPVGAG

SEQ ID NO: 49445 - protein, 8 aa, Mycobacterium tuberculosis
AAPVGAGA

SEQ ID NO: 49446 - protein, 8 aa, Mycobacterium tuberculosis
APVGAGAM

SEQ ID NO: 49447 - protein, 8 aa, Mycobacterium tuberculosis
PVGAGAMG

SEQ ID NO: 49448 - protein, 8 aa, Mycobacterium tuberculosis
VGAGAMGQ

SEQ ID NO: 49449 - protein, 8 aa, Mycobacterium tuberculosis
GAGAMGQG

SEQ ID NO: 49450 - protein, 8 aa, Mycobacterium tuberculosis
AGAMGQGA

SEQ ID NO: 49451 - protein, 8 aa, Mycobacterium tuberculosis
GAMGQGAQ

SEQ ID NO: 49452 - protein, 8 aa, Mycobacterium tuberculosis
AMGQGAQS

SEQ ID NO: 49453 - protein, 8 aa, Mycobacterium tuberculosis
MGQGAQSG

SEQ ID NO: 49454 - protein, 8 aa, Mycobacterium tuberculosis
GQGAQSGG

SEQ ID NO: 49455 - protein, 8 aa, Mycobacterium tuberculosis
QGAQSGGS

SEQ ID NO: 49456 - protein, 8 aa, Mycobacterium tuberculosis
GAQSGGST

SEQ ID NO: 49457 - protein, 8 aa, Mycobacterium tuberculosis
AQSGGSTR

SEQ ID NO: 49458 - protein, 8 aa, Mycobacterium tuberculosis
QSGGSTRP

SEQ ID NO: 49459 - protein, 8 aa, Mycobacterium tuberculosis
SGGSTRPG

SEQ ID NO: 49460 - protein, 8 aa, Mycobacterium tuberculosis
GGSTRPGL

SEQ ID NO: 49461 - protein, 8 aa, Mycobacterium tuberculosis
GSTRPGLV

SEQ ID NO: 49462 - protein, 8 aa, Mycobacterium tuberculosis
STRPGLVA

SEQ ID NO: 49463 - protein, 8 aa, Mycobacterium tuberculosis
TRPGLVAP

SEQ ID NO: 49464 - protein, 8 aa, Mycobacterium tuberculosis
RPGLVAPA

SEQ ID NO: 49465 - protein, 8 aa, Mycobacterium tuberculosis
PGLVAPAP

SEQ ID NO: 49466 - protein, 8 aa, Mycobacterium tuberculosis
GLVAPAPL

SEQ ID NO: 49467 - protein, 8 aa, Mycobacterium tuberculosis
LVAPAPLA

SEQ ID NO: 49468 - protein, 8 aa, Mycobacterium tuberculosis
VAPAPLAQ

SEQ ID NO: 49469 - protein, 8 aa, Mycobacterium tuberculosis
APAPLAQE

SEQ ID NO: 49470 - protein, 8 aa, Mycobacterium tuberculosis
PAPLAQER

SEQ ID NO: 49471 - protein, 8 aa, Mycobacterium tuberculosis
APLAQERE

SEQ ID NO: 49472 - protein, 8 aa, Mycobacterium tuberculosis
PLAQEREE

SEQ ID NO: 49473 - protein, 8 aa, Mycobacterium tuberculosis
LAQEREED

SEQ ID NO: 49474 - protein, 8 aa, Mycobacterium tuberculosis
AQEREEDD

SEQ ID NO: 49475 - protein, 8 aa, Mycobacterium tuberculosis
QEREEDDE

SEQ ID NO: 49476 - protein, 8 aa, Mycobacterium tuberculosis
EREEDDED

SEQ ID NO: 49477 - protein, 8 aa, Mycobacterium tuberculosis
REEDDEDD

SEQ ID NO: 49478 - protein, 8 aa, Mycobacterium tuberculosis
EEDDEDDW

SEQ ID NO: 49479 - protein, 8 aa, Mycobacterium tuberculosis
EDDEDDWD

SEQ ID NO: 49480 - protein, 8 aa, Mycobacterium tuberculosis
DDEDDWDE

SEQ ID NO: 49481 - protein, 8 aa, Mycobacterium tuberculosis
DEDDWDEE

SEQ ID NO: 49482 - protein, 8 aa, Mycobacterium tuberculosis
EDDWDEED

SEQ ID NO: 49483 - protein, 8 aa, Mycobacterium tuberculosis
DDWDEEDD

SEQ ID NO: 49484 - protein, 8 aa, Mycobacterium tuberculosis
DWDEEDDW

SEQ ID NO: 49485 - protein, 9 aa, Mycobacterium tuberculosis
MLWHAMPPE

SEQ ID NO: 49486 - protein, 9 aa, Mycobacterium tuberculosis
LWHAMPPEL

SEQ ID NO: 49487 - protein, 9 aa, Mycobacterium tuberculosis
WHAMPPELN

SEQ ID NO: 49488 - protein, 9 aa, Mycobacterium tuberculosis
HAMPPELNT

SEQ ID NO: 49489 - protein, 9 aa, Mycobacterium tuberculosis
AMPPELNTA

SEQ ID NO: 49490 - protein, 9 aa, Mycobacterium tuberculosis
MPPELNTAR

SEQ ID NO: 49491 - protein, 9 aa, Mycobacterium tuberculosis
PPELNTARL

SEQ ID NO: 49492 - protein, 9 aa, Mycobacterium tuberculosis
PELNTARLM

SEQ ID NO: 49493 - protein, 9 aa, Mycobacterium tuberculosis
ELNTARLMA

SEQ ID NO: 49494 - protein, 9 aa, Mycobacterium tuberculosis
LNTARLMAG

SEQ ID NO: 49495 - protein, 9 aa, Mycobacterium tuberculosis
NTARLMAGA

SEQ ID NO: 49496 - protein, 9 aa, Mycobacterium tuberculosis
TARLMAGAG

SEQ ID NO: 49497 - protein, 9 aa, Mycobacterium tuberculosis
ARLMAGAGP

SEQ ID NO: 49498 - protein, 9 aa, Mycobacterium tuberculosis
RLMAGAGPA

SEQ ID NO: 49499 - protein, 9 aa, Mycobacterium tuberculosis
LMAGAGPAP

SEQ ID NO: 49500 - protein, 9 aa, Mycobacterium tuberculosis
MAGAGPAPM

SEQ ID NO: 49501 - protein, 9 aa, Mycobacterium tuberculosis
AGAGPAPML

SEQ ID NO: 49502 - protein, 9 aa, Mycobacterium tuberculosis
GAGPAPMLA

SEQ ID NO: 49503 - protein, 9 aa, Mycobacterium tuberculosis
AGPAPMLAA

SEQ ID NO: 49504 - protein, 9 aa, Mycobacterium tuberculosis
GPAPMLAAA

SEQ ID NO: 49505 - protein, 9 aa, Mycobacterium tuberculosis
PAPMLAAAA

SEQ ID NO: 49506 - protein, 9 aa, Mycobacterium tuberculosis
APMLAAAAG

SEQ ID NO: 49507 - protein, 9 aa, Mycobacterium tuberculosis
PMLAAAAGW

SEQ ID NO: 49508 - protein, 9 aa, Mycobacterium tuberculosis
MLAAAAGWQ

SEQ ID NO: 49509 - protein, 9 aa, Mycobacterium tuberculosis
LAAAAGWQT

SEQ ID NO: 49510 - protein, 9 aa, Mycobacterium tuberculosis
AAAAGWQTL

SEQ ID NO: 49511 - protein, 9 aa, Mycobacterium tuberculosis
AAAGWQTLS

SEQ ID NO: 49512 - protein, 9 aa, Mycobacterium tuberculosis
AAGWQTLSA

SEQ ID NO: 49513 - protein, 9 aa, Mycobacterium tuberculosis
AGWQTLSAA

SEQ ID NO: 49514 - protein, 9 aa, Mycobacterium tuberculosis
GWQTLSAAL

SEQ ID NO: 49515 - protein, 9 aa, Mycobacterium tuberculosis
WQTLSAALD

SEQ ID NO: 49516 - protein, 9 aa, Mycobacterium tuberculosis
QTLSAALDA

SEQ ID NO: 49517 - protein, 9 aa, Mycobacterium tuberculosis
TLSAALDAQ

SEQ ID NO: 49518 - protein, 9 aa, Mycobacterium tuberculosis
LSAALDAQA

SEQ ID NO: 49519 - protein, 9 aa, Mycobacterium tuberculosis
SAALDAQAV

SEQ ID NO: 49520 - protein, 9 aa, Mycobacterium tuberculosis
AALDAQAVE

SEQ ID NO: 49521 - protein, 9 aa, Mycobacterium tuberculosis
ALDAQAVEL

SEQ ID NO: 49522 - protein, 9 aa, Mycobacterium tuberculosis
LDAQAVELT

SEQ ID NO: 49523 - protein, 9 aa, Mycobacterium tuberculosis
DAQAVELTA

SEQ ID NO: 49524 - protein, 9 aa, Mycobacterium tuberculosis
AQAVELTAR

SEQ ID NO: 49525 - protein, 9 aa, Mycobacterium tuberculosis
QAVELTARL

SEQ ID NO: 49526 - protein, 9 aa, Mycobacterium tuberculosis
AVELTARLN

SEQ ID NO: 49527 - protein, 9 aa, Mycobacterium tuberculosis
VELTARLNS

SEQ ID NO: 49528 - protein, 9 aa, Mycobacterium tuberculosis
ELTARLNSL

SEQ ID NO: 49529 - protein, 9 aa, Mycobacterium tuberculosis
LTARLNSLG

SEQ ID NO: 49530 - protein, 9 aa, Mycobacterium tuberculosis
TARLNSLGE

SEQ ID NO: 49531 - protein, 9 aa, Mycobacterium tuberculosis
ARLNSLGEA

SEQ ID NO: 49532 - protein, 9 aa, Mycobacterium tuberculosis
RLNSLGEAW

SEQ ID NO: 49533 - protein, 9 aa, Mycobacterium tuberculosis
LNSLGEAWT

SEQ ID NO: 49534 - protein, 9 aa, Mycobacterium tuberculosis
NSLGEAWTG

SEQ ID NO: 49535 - protein, 9 aa, Mycobacterium tuberculosis
SLGEAWTGG

SEQ ID NO: 49536 - protein, 9 aa, Mycobacterium tuberculosis
LGEAWTGGG

SEQ ID NO: 49537 - protein, 9 aa, Mycobacterium tuberculosis
GEAWTGGGS

SEQ ID NO: 49538 - protein, 9 aa, Mycobacterium tuberculosis
EAWTGGGSD

SEQ ID NO: 49539 - protein, 9 aa, Mycobacterium tuberculosis
AWTGGGSDK

SEQ ID NO: 49540 - protein, 9 aa, Mycobacterium tuberculosis
WTGGGSDKA

SEQ ID NO: 49541 - protein, 9 aa, Mycobacterium tuberculosis
TGGGSDKAL

SEQ ID NO: 49542 - protein, 9 aa, Mycobacterium tuberculosis
GGGSDKALA

SEQ ID NO: 49543 - protein, 9 aa, Mycobacterium tuberculosis
GGSDKALAA

SEQ ID NO: 49544 - protein, 9 aa, Mycobacterium tuberculosis
GSDKALAAA

SEQ ID NO: 49545 - protein, 9 aa, Mycobacterium tuberculosis
SDKALAAAT

SEQ ID NO: 49546 - protein, 9 aa, Mycobacterium tuberculosis
DKALAAATP

SEQ ID NO: 49547 - protein, 9 aa, Mycobacterium tuberculosis
KALAAATPM

SEQ ID NO: 49548 - protein, 9 aa, Mycobacterium tuberculosis
ALAAATPMV

SEQ ID NO: 49549 - protein, 9 aa, Mycobacterium tuberculosis
LAAATPMVV

SEQ ID NO: 49550 - protein, 9 aa, Mycobacterium tuberculosis
AAATPMVVW

SEQ ID NO: 49551 - protein, 9 aa, Mycobacterium tuberculosis
AATPMVVWL

SEQ ID NO: 49552 - protein, 9 aa, Mycobacterium tuberculosis
ATPMVVWLQ

SEQ ID NO: 49553 - protein, 9 aa, Mycobacterium tuberculosis
TPMVVWLQT

SEQ ID NO: 49554 - protein, 9 aa, Mycobacterium tuberculosis
PMVVWLQTA

SEQ ID NO: 49555 - protein, 9 aa, Mycobacterium tuberculosis
MVVWLQTAS

SEQ ID NO: 49556 - protein, 9 aa, Mycobacterium tuberculosis
VVWLQTAST

SEQ ID NO: 49557 - protein, 9 aa, Mycobacterium tuberculosis
VWLQTASTQ

SEQ ID NO: 49558 - protein, 9 aa, Mycobacterium tuberculosis
WLQTASTQA

SEQ ID NO: 49559 - protein, 9 aa, Mycobacterium tuberculosis
LQTASTQAK

SEQ ID NO: 49560 - protein, 9 aa, Mycobacterium tuberculosis
QTASTQAKT

SEQ ID NO: 49561 - protein, 9 aa, Mycobacterium tuberculosis
TASTQAKTR

SEQ ID NO: 49562 - protein, 9 aa, Mycobacterium tuberculosis
ASTQAKTRA

SEQ ID NO: 49563 - protein, 9 aa, Mycobacterium tuberculosis
STQAKTRAM

SEQ ID NO: 49564 - protein, 9 aa, Mycobacterium tuberculosis
TQAKTRAMQ

SEQ ID NO: 49565 - protein, 9 aa, Mycobacterium tuberculosis
QAKTRAMQA

SEQ ID NO: 49566 - protein, 9 aa, Mycobacterium tuberculosis
AKTRAMQAT

SEQ ID NO: 49567 - protein, 9 aa, Mycobacterium tuberculosis
KTRAMQATA

SEQ ID NO: 49568 - protein, 9 aa, Mycobacterium tuberculosis
TRAMQATAQ

SEQ ID NO: 49569 - protein, 9 aa, Mycobacterium tuberculosis
RAMQATAQA

SEQ ID NO: 49570 - protein, 9 aa, Mycobacterium tuberculosis
AMQATAQAA

SEQ ID NO: 49571 - protein, 9 aa, Mycobacterium tuberculosis
MQATAQAAA

SEQ ID NO: 49572 - protein, 9 aa, Mycobacterium tuberculosis
QATAQAAAY

SEQ ID NO: 49573 - protein, 9 aa, Mycobacterium tuberculosis
ATAQAAAYT

SEQ ID NO: 49574 - protein, 9 aa, Mycobacterium tuberculosis
TAQAAAYTQ

SEQ ID NO: 49575 - protein, 9 aa, Mycobacterium tuberculosis
AQAAAYTQA

SEQ ID NO: 49576 - protein, 9 aa, Mycobacterium tuberculosis
QAAAYTQAM

SEQ ID NO: 49577 - protein, 9 aa, Mycobacterium tuberculosis
AAAYTQAMA

SEQ ID NO: 49578 - protein, 9 aa, Mycobacterium tuberculosis
AAYTQAMAT

SEQ ID NO: 49579 - protein, 9 aa, Mycobacterium tuberculosis
AYTQAMATT

SEQ ID NO: 49580 - protein, 9 aa, Mycobacterium tuberculosis
YTQAMATTP

SEQ ID NO: 49581 - protein, 9 aa, Mycobacterium tuberculosis
TQAMATTPS

SEQ ID NO: 49582 - protein, 9 aa, Mycobacterium tuberculosis
QAMATTPSL

SEQ ID NO: 49583 - protein, 9 aa, Mycobacterium tuberculosis
AMATTPSLP

SEQ ID NO: 49584 - protein, 9 aa, Mycobacterium tuberculosis
MATTPSLPE

SEQ ID NO: 49585 - protein, 9 aa, Mycobacterium tuberculosis
ATTPSLPEI

SEQ ID NO: 49586 - protein, 9 aa, Mycobacterium tuberculosis
TTPSLPEIA

SEQ ID NO: 49587 - protein, 9 aa, Mycobacterium tuberculosis
TPSLPEIAA

SEQ ID NO: 49588 - protein, 9 aa, Mycobacterium tuberculosis
PSLPEIAAN

SEQ ID NO: 49589 - protein, 9 aa, Mycobacterium tuberculosis
SLPEIAANH

SEQ ID NO: 49590 - protein, 9 aa, Mycobacterium tuberculosis
LPEIAANHI

SEQ ID NO: 49591 - protein, 9 aa, Mycobacterium tuberculosis
PEIAANHIT

SEQ ID NO: 49592 - protein, 9 aa, Mycobacterium tuberculosis
EIAANHITQ

SEQ ID NO: 49593 - protein, 9 aa, Mycobacterium tuberculosis
IAANHITQA

SEQ ID NO: 49594 - protein, 9 aa, Mycobacterium tuberculosis
AANHITQAV

SEQ ID NO: 49595 - protein, 9 aa, Mycobacterium tuberculosis
ANHITQAVL

SEQ ID NO: 49596 - protein, 9 aa, Mycobacterium tuberculosis
NHITQAVLT

SEQ ID NO: 49597 - protein, 9 aa, Mycobacterium tuberculosis
HITQAVLTA

SEQ ID NO: 49598 - protein, 9 aa, Mycobacterium tuberculosis
ITQAVLTAT

SEQ ID NO: 49599 - protein, 9 aa, Mycobacterium tuberculosis
TQAVLTATN

SEQ ID NO: 49600 - protein, 9 aa, Mycobacterium tuberculosis
QAVLTATNF

SEQ ID NO: 49601 - protein, 9 aa, Mycobacterium tuberculosis
AVLTATNFF

SEQ ID NO: 49602 - protein, 9 aa, Mycobacterium tuberculosis
VLTATNFFG

SEQ ID NO: 49603 - protein, 9 aa, Mycobacterium tuberculosis
LTATNFFGI

SEQ ID NO: 49604 - protein, 9 aa, Mycobacterium tuberculosis
TATNFFGIN

SEQ ID NO: 49605 - protein, 9 aa, Mycobacterium tuberculosis
ATNFFGINT

SEQ ID NO: 49606 - protein, 9 aa, Mycobacterium tuberculosis
TNFFGINTI

SEQ ID NO: 49607 - protein, 9 aa, Mycobacterium tuberculosis
NFFGINTIP

SEQ ID NO: 49608 - protein, 9 aa, Mycobacterium tuberculosis
FFGINTIPI

SEQ ID NO: 49609 - protein, 9 aa, Mycobacterium tuberculosis
FGINTIPIA

SEQ ID NO: 49610 - protein, 9 aa, Mycobacterium tuberculosis
GINTIPIAL

SEQ ID NO: 49611 - protein, 9 aa, Mycobacterium tuberculosis
INTIPIALT

SEQ ID NO: 49612 - protein, 9 aa, Mycobacterium tuberculosis
NTIPIALTE

SEQ ID NO: 49613 - protein, 9 aa, Mycobacterium tuberculosis
TIPIALTEM

SEQ ID NO: 49614 - protein, 9 aa, Mycobacterium tuberculosis
IPIALTEMD

SEQ ID NO: 49615 - protein, 9 aa, Mycobacterium tuberculosis
PIALTEMDY

SEQ ID NO: 49616 - protein, 9 aa, Mycobacterium tuberculosis
IALTEMDYF

SEQ ID NO: 49617 - protein, 9 aa, Mycobacterium tuberculosis
ALTEMDYFI

SEQ ID NO: 49618 - protein, 9 aa, Mycobacterium tuberculosis
LTEMDYFIR

SEQ ID NO: 49619 - protein, 9 aa, Mycobacterium tuberculosis
TEMDYFIRM

SEQ ID NO: 49620 - protein, 9 aa, Mycobacterium tuberculosis
EMDYFIRMW

SEQ ID NO: 49621 - protein, 9 aa, Mycobacterium tuberculosis
MDYFIRMWN

SEQ ID NO: 49622 - protein, 9 aa, Mycobacterium tuberculosis
DYFIRMWNQ

SEQ ID NO: 49623 - protein, 9 aa, Mycobacterium tuberculosis
YFIRMWNQA

SEQ ID NO: 49624 - protein, 9 aa, Mycobacterium tuberculosis
FIRMWNQAA

SEQ ID NO: 49625 - protein, 9 aa, Mycobacterium tuberculosis
IRMWNQAAL

SEQ ID NO: 49626 - protein, 9 aa, Mycobacterium tuberculosis
RMWNQAALA

SEQ ID NO: 49627 - protein, 9 aa, Mycobacterium tuberculosis
MWNQAALAM

SEQ ID NO: 49628 - protein, 9 aa, Mycobacterium tuberculosis
WNQAALAME

SEQ ID NO: 49629 - protein, 9 aa, Mycobacterium tuberculosis
NQAALAMEV

SEQ ID NO: 49630 - protein, 9 aa, Mycobacterium tuberculosis
QAALAMEVY

SEQ ID NO: 49631 - protein, 9 aa, Mycobacterium tuberculosis
AALAMEVYQ

SEQ ID NO: 49632 - protein, 9 aa, Mycobacterium tuberculosis
ALAMEVYQA

SEQ ID NO: 49633 - protein, 9 aa, Mycobacterium tuberculosis
LAMEVYQAE

SEQ ID NO: 49634 - protein, 9 aa, Mycobacterium tuberculosis
AMEVYQAET

SEQ ID NO: 49635 - protein, 9 aa, Mycobacterium tuberculosis
MEVYQAETA

SEQ ID NO: 49636 - protein, 9 aa, Mycobacterium tuberculosis
EVYQAETAV

SEQ ID NO: 49637 - protein, 9 aa, Mycobacterium tuberculosis
VYQAETAVN

SEQ ID NO: 49638 - protein, 9 aa, Mycobacterium tuberculosis
YQAETAVNT

SEQ ID NO: 49639 - protein, 9 aa, Mycobacterium tuberculosis
QAETAVNTL

SEQ ID NO: 49640 - protein, 9 aa, Mycobacterium tuberculosis
AETAVNTLF

SEQ ID NO: 49641 - protein, 9 aa, Mycobacterium tuberculosis
ETAVNTLFE

SEQ ID NO: 49642 - protein, 9 aa, Mycobacterium tuberculosis
TAVNTLFEK

SEQ ID NO: 49643 - protein, 9 aa, Mycobacterium tuberculosis
AVNTLFEKL

SEQ ID NO: 49644 - protein, 9 aa, Mycobacterium tuberculosis
VNTLFEKLE

SEQ ID NO: 49645 - protein, 9 aa, Mycobacterium tuberculosis
NTLFEKLEP

SEQ ID NO: 49646 - protein, 9 aa, Mycobacterium tuberculosis
TLFEKLEPM

SEQ ID NO: 49647 - protein, 9 aa, Mycobacterium tuberculosis
LFEKLEPMA

SEQ ID NO: 49648 - protein, 9 aa, Mycobacterium tuberculosis
FEKLEPMAS

SEQ ID NO: 49649 - protein, 9 aa, Mycobacterium tuberculosis
EKLEPMASI

SEQ ID NO: 49650 - protein, 9 aa, Mycobacterium tuberculosis
KLEPMASIL

SEQ ID NO: 49651 - protein, 9 aa, Mycobacterium tuberculosis
LEPMASILD

SEQ ID NO: 49652 - protein, 9 aa, Mycobacterium tuberculosis
EPMASILDP

SEQ ID NO: 49653 - protein, 9 aa, Mycobacterium tuberculosis
PMASILDPG

SEQ ID NO: 49654 - protein, 9 aa, Mycobacterium tuberculosis
MASILDPGA

SEQ ID NO: 49655 - protein, 9 aa, Mycobacterium tuberculosis
ASILDPGAS

SEQ ID NO: 49656 - protein, 9 aa, Mycobacterium tuberculosis
SILDPGASQ

SEQ ID NO: 49657 - protein, 9 aa, Mycobacterium tuberculosis
ILDPGASQS

SEQ ID NO: 49658 - protein, 9 aa, Mycobacterium tuberculosis
LDPGASQST

SEQ ID NO: 49659 - protein, 9 aa, Mycobacterium tuberculosis
DPGASQSTT

SEQ ID NO: 49660 - protein, 9 aa, Mycobacterium tuberculosis
PGASQSTTN

SEQ ID NO: 49661 - protein, 9 aa, Mycobacterium tuberculosis
GASQSTTNP

SEQ ID NO: 49662 - protein, 9 aa, Mycobacterium tuberculosis
ASQSTTNPI

SEQ ID NO: 49663 - protein, 9 aa, Mycobacterium tuberculosis
SQSTTNPIF

SEQ ID NO: 49664 - protein, 9 aa, Mycobacterium tuberculosis
QSTTNPIFG

SEQ ID NO: 49665 - protein, 9 aa, Mycobacterium tuberculosis
STTNPIFGM

SEQ ID NO: 49666 - protein, 9 aa, Mycobacterium tuberculosis
TTNPIFGMP

SEQ ID NO: 49667 - protein, 9 aa, Mycobacterium tuberculosis
TNPIFGMPS

SEQ ID NO: 49668 - protein, 9 aa, Mycobacterium tuberculosis
NPIFGMPSP

SEQ ID NO: 49669 - protein, 9 aa, Mycobacterium tuberculosis
PIFGMPSPG

SEQ ID NO: 49670 - protein, 9 aa, Mycobacterium tuberculosis
IFGMPSPGS

SEQ ID NO: 49671 - protein, 9 aa, Mycobacterium tuberculosis
FGMPSPGSS

SEQ ID NO: 49672 - protein, 9 aa, Mycobacterium tuberculosis
GMPSPGSST

SEQ ID NO: 49673 - protein, 9 aa, Mycobacterium tuberculosis
MPSPGSSTP

SEQ ID NO: 49674 - protein, 9 aa, Mycobacterium tuberculosis
PSPGSSTPV

SEQ ID NO: 49675 - protein, 9 aa, Mycobacterium tuberculosis
SPGSSTPVG

SEQ ID NO: 49676 - protein, 9 aa, Mycobacterium tuberculosis
PGSSTPVGQ

SEQ ID NO: 49677 - protein, 9 aa, Mycobacterium tuberculosis
GSSTPVGQL

SEQ ID NO: 49678 - protein, 9 aa, Mycobacterium tuberculosis
SSTPVGQLP

SEQ ID NO: 49679 - protein, 9 aa, Mycobacterium tuberculosis
STPVGQLPP

SEQ ID NO: 49680 - protein, 9 aa, Mycobacterium tuberculosis
TPVGQLPPA

SEQ ID NO: 49681 - protein, 9 aa, Mycobacterium tuberculosis
PVGQLPPAA

SEQ ID NO: 49682 - protein, 9 aa, Mycobacterium tuberculosis
VGQLPPAAT

SEQ ID NO: 49683 - protein, 9 aa, Mycobacterium tuberculosis
GQLPPAATQ

SEQ ID NO: 49684 - protein, 9 aa, Mycobacterium tuberculosis
QLPPAATQT

SEQ ID NO: 49685 - protein, 9 aa, Mycobacterium tuberculosis
LPPAATQTL

SEQ ID NO: 49686 - protein, 9 aa, Mycobacterium tuberculosis
PPAATQTLG

SEQ ID NO: 49687 - protein, 9 aa, Mycobacterium tuberculosis
PAATQTLGQ

SEQ ID NO: 49688 - protein, 9 aa, Mycobacterium tuberculosis
AATQTLGQL

SEQ ID NO: 49689 - protein, 9 aa, Mycobacterium tuberculosis
ATQTLGQLG

SEQ ID NO: 49690 - protein, 9 aa, Mycobacterium tuberculosis
TQTLGQLGE

SEQ ID NO: 49691 - protein, 9 aa, Mycobacterium tuberculosis
QTLGQLGEM

SEQ ID NO: 49692 - protein, 9 aa, Mycobacterium tuberculosis
TLGQLGEMS

SEQ ID NO: 49693 - protein, 9 aa, Mycobacterium tuberculosis
LGQLGEMSG

SEQ ID NO: 49694 - protein, 9 aa, Mycobacterium tuberculosis
GQLGEMSGP

SEQ ID NO: 49695 - protein, 9 aa, Mycobacterium tuberculosis
QLGEMSGPM

SEQ ID NO: 49696 - protein, 9 aa, Mycobacterium tuberculosis
LGEMSGPMQ

SEQ ID NO: 49697 - protein, 9 aa, Mycobacterium tuberculosis
GEMSGPMQQ

SEQ ID NO: 49698 - protein, 9 aa, Mycobacterium tuberculosis
EMSGPMQQL

SEQ ID NO: 49699 - protein, 9 aa, Mycobacterium tuberculosis
MSGPMQQLT

SEQ ID NO: 49700 - protein, 9 aa, Mycobacterium tuberculosis
SGPMQQLTQ

SEQ ID NO: 49701 - protein, 9 aa, Mycobacterium tuberculosis
GPMQQLTQP

SEQ ID NO: 49702 - protein, 9 aa, Mycobacterium tuberculosis
PMQQLTQPL

SEQ ID NO: 49703 - protein, 9 aa, Mycobacterium tuberculosis
MQQLTQPLQ

SEQ ID NO: 49704 - protein, 9 aa, Mycobacterium tuberculosis
QQLTQPLQQ

SEQ ID NO: 49705 - protein, 9 aa, Mycobacterium tuberculosis
QLTQPLQQV

SEQ ID NO: 49706 - protein, 9 aa, Mycobacterium tuberculosis
LTQPLQQVT

SEQ ID NO: 49707 - protein, 9 aa, Mycobacterium tuberculosis
TQPLQQVTS

SEQ ID NO: 49708 - protein, 9 aa, Mycobacterium tuberculosis
QPLQQVTSL

SEQ ID NO: 49709 - protein, 9 aa, Mycobacterium tuberculosis
PLQQVTSLF

SEQ ID NO: 49710 - protein, 9 aa, Mycobacterium tuberculosis
LQQVTSLFS

SEQ ID NO: 49711 - protein, 9 aa, Mycobacterium tuberculosis
QQVTSLFSQ

SEQ ID NO: 49712 - protein, 9 aa, Mycobacterium tuberculosis
QVTSLFSQV

SEQ ID NO: 49713 - protein, 9 aa, Mycobacterium tuberculosis
VTSLFSQVG

SEQ ID NO: 49714 - protein, 9 aa, Mycobacterium tuberculosis
TSLFSQVGG

SEQ ID NO: 49715 - protein, 9 aa, Mycobacterium tuberculosis
SLFSQVGGT

SEQ ID NO: 49716 - protein, 9 aa, Mycobacterium tuberculosis
LFSQVGGTG

SEQ ID NO: 49717 - protein, 9 aa, Mycobacterium tuberculosis
FSQVGGTGG

SEQ ID NO: 49718 - protein, 9 aa, Mycobacterium tuberculosis
SQVGGTGGG

SEQ ID NO: 49719 - protein, 9 aa, Mycobacterium tuberculosis
QVGGTGGGN

SEQ ID NO: 49720 - protein, 9 aa, Mycobacterium tuberculosis
VGGTGGGNP

SEQ ID NO: 49721 - protein, 9 aa, Mycobacterium tuberculosis
GGTGGGNPA

SEQ ID NO: 49722 - protein, 9 aa, Mycobacterium tuberculosis
GTGGGNPAD

SEQ ID NO: 49723 - protein, 9 aa, Mycobacterium tuberculosis
TGGGNPADE

SEQ ID NO: 49724 - protein, 9 aa, Mycobacterium tuberculosis
GGGNPADEE

SEQ ID NO: 49725 - protein, 9 aa, Mycobacterium tuberculosis
GGNPADEEA

SEQ ID NO: 49726 - protein, 9 aa, Mycobacterium tuberculosis
GNPADEEAA

SEQ ID NO: 49727 - protein, 9 aa, Mycobacterium tuberculosis
NPADEEAAQ

SEQ ID NO: 49728 - protein, 9 aa, Mycobacterium tuberculosis
PADEEAAQM

SEQ ID NO: 49729 - protein, 9 aa, Mycobacterium tuberculosis
ADEEAAQMG

SEQ ID NO: 49730 - protein, 9 aa, Mycobacterium tuberculosis
DEEAAQMGL

SEQ ID NO: 49731 - protein, 9 aa, Mycobacterium tuberculosis
EEAAQMGLL

SEQ ID NO: 49732 - protein, 9 aa, Mycobacterium tuberculosis
EAAQMGLLG

SEQ ID NO: 49733 - protein, 9 aa, Mycobacterium tuberculosis
AAQMGLLGT

SEQ ID NO: 49734 - protein, 9 aa, Mycobacterium tuberculosis
AQMGLLGTS

SEQ ID NO: 49735 - protein, 9 aa, Mycobacterium tuberculosis
QMGLLGTSP

SEQ ID NO: 49736 - protein, 9 aa, Mycobacterium tuberculosis
MGLLGTSPL

SEQ ID NO: 49737 - protein, 9 aa, Mycobacterium tuberculosis
GLLGTSPLS

SEQ ID NO: 49738 - protein, 9 aa, Mycobacterium tuberculosis
LLGTSPLSN

SEQ ID NO: 49739 - protein, 9 aa, Mycobacterium tuberculosis
LGTSPLSNH

SEQ ID NO: 49740 - protein, 9 aa, Mycobacterium tuberculosis
GTSPLSNHP

SEQ ID NO: 49741 - protein, 9 aa, Mycobacterium tuberculosis
TSPLSNHPL

SEQ ID NO: 49742 - protein, 9 aa, Mycobacterium tuberculosis
SPLSNHPLA

SEQ ID NO: 49743 - protein, 9 aa, Mycobacterium tuberculosis
PLSNHPLAG

SEQ ID NO: 49744 - protein, 9 aa, Mycobacterium tuberculosis
LSNHPLAGG

SEQ ID NO: 49745 - protein, 9 aa, Mycobacterium tuberculosis
SNHPLAGGS

SEQ ID NO: 49746 - protein, 9 aa, Mycobacterium tuberculosis
NHPLAGGSG

SEQ ID NO: 49747 - protein, 9 aa, Mycobacterium tuberculosis
HPLAGGSGP

SEQ ID NO: 49748 - protein, 9 aa, Mycobacterium tuberculosis
PLAGGSGPS

SEQ ID NO: 49749 - protein, 9 aa, Mycobacterium tuberculosis
LAGGSGPSA

SEQ ID NO: 49750 - protein, 9 aa, Mycobacterium tuberculosis
AGGSGPSAG

SEQ ID NO: 49751 - protein, 9 aa, Mycobacterium tuberculosis
GGSGPSAGA

SEQ ID NO: 49752 - protein, 9 aa, Mycobacterium tuberculosis
GSGPSAGAG

SEQ ID NO: 49753 - protein, 9 aa, Mycobacterium tuberculosis
SGPSAGAGL

SEQ ID NO: 49754 - protein, 9 aa, Mycobacterium tuberculosis
GPSAGAGLL

SEQ ID NO: 49755 - protein, 9 aa, Mycobacterium tuberculosis
PSAGAGLLR

SEQ ID NO: 49756 - protein, 9 aa, Mycobacterium tuberculosis
SAGAGLLRA

SEQ ID NO: 49757 - protein, 9 aa, Mycobacterium tuberculosis
AGAGLLRAE

SEQ ID NO: 49758 - protein, 9 aa, Mycobacterium tuberculosis
GAGLLRAES

SEQ ID NO: 49759 - protein, 9 aa, Mycobacterium tuberculosis
AGLLRAESL

SEQ ID NO: 49760 - protein, 9 aa, Mycobacterium tuberculosis
GLLRAESLP

SEQ ID NO: 49761 - protein, 9 aa, Mycobacterium tuberculosis
LLRAESLPG

SEQ ID NO: 49762 - protein, 9 aa, Mycobacterium tuberculosis
LRAESLPGA

SEQ ID NO: 49763 - protein, 9 aa, Mycobacterium tuberculosis
RAESLPGAG

SEQ ID NO: 49764 - protein, 9 aa, Mycobacterium tuberculosis
AESLPGAGG

SEQ ID NO: 49765 - protein, 9 aa, Mycobacterium tuberculosis
ESLPGAGGS

SEQ ID NO: 49766 - protein, 9 aa, Mycobacterium tuberculosis
SLPGAGGSL

SEQ ID NO: 49767 - protein, 9 aa, Mycobacterium tuberculosis
LPGAGGSLT

SEQ ID NO: 49768 - protein, 9 aa, Mycobacterium tuberculosis
PGAGGSLTR

SEQ ID NO: 49769 - protein, 9 aa, Mycobacterium tuberculosis
GAGGSLTRT

SEQ ID NO: 49770 - protein, 9 aa, Mycobacterium tuberculosis
AGGSLTRTP

SEQ ID NO: 49771 - protein, 9 aa, Mycobacterium tuberculosis
GGSLTRTPL

SEQ ID NO: 49772 - protein, 9 aa, Mycobacterium tuberculosis
GSLTRTPLM

SEQ ID NO: 49773 - protein, 9 aa, Mycobacterium tuberculosis
SLTRTPLMS

SEQ ID NO: 49774 - protein, 9 aa, Mycobacterium tuberculosis
LTRTPLMSQ

SEQ ID NO: 49775 - protein, 9 aa, Mycobacterium tuberculosis
TRTPLMSQL

SEQ ID NO: 49776 - protein, 9 aa, Mycobacterium tuberculosis
RTPLMSQLI

SEQ ID NO: 49777 - protein, 9 aa, Mycobacterium tuberculosis
TPLMSQLIE

SEQ ID NO: 49778 - protein, 9 aa, Mycobacterium tuberculosis
PLMSQLIEK

SEQ ID NO: 49779 - protein, 9 aa, Mycobacterium tuberculosis
LMSQLIEKP

SEQ ID NO: 49780 - protein, 9 aa, Mycobacterium tuberculosis
MSQLIEKPV

SEQ ID NO: 49781 - protein, 9 aa, Mycobacterium tuberculosis
SQLIEKPVA

SEQ ID NO: 49782 - protein, 9 aa, Mycobacterium tuberculosis
QLIEKPVAP

SEQ ID NO: 49783 - protein, 9 aa, Mycobacterium tuberculosis
LIEKPVAPS

SEQ ID NO: 49784 - protein, 9 aa, Mycobacterium tuberculosis
IEKPVAPSV

SEQ ID NO: 49785 - protein, 9 aa, Mycobacterium tuberculosis
EKPVAPSVM

SEQ ID NO: 49786 - protein, 9 aa, Mycobacterium tuberculosis
KPVAPSVMP

SEQ ID NO: 49787 - protein, 9 aa, Mycobacterium tuberculosis
PVAPSVMPA

SEQ ID NO: 49788 - protein, 9 aa, Mycobacterium tuberculosis
VAPSVMPAA

SEQ ID NO: 49789 - protein, 9 aa, Mycobacterium tuberculosis
APSVMPAAA

SEQ ID NO: 49790 - protein, 9 aa, Mycobacterium tuberculosis
PSVMPAAAA

SEQ ID NO: 49791 - protein, 9 aa, Mycobacterium tuberculosis
SVMPAAAAG

SEQ ID NO: 49792 - protein, 9 aa, Mycobacterium tuberculosis
VMPAAAAGS

SEQ ID NO: 49793 - protein, 9 aa, Mycobacterium tuberculosis
MPAAAAGSS

SEQ ID NO: 49794 - protein, 9 aa, Mycobacterium tuberculosis
PAAAAGSSA

SEQ ID NO: 49795 - protein, 9 aa, Mycobacterium tuberculosis
AAAAGSSAT

SEQ ID NO: 49796 - protein, 9 aa, Mycobacterium tuberculosis
AAAGSSATG

SEQ ID NO: 49797 - protein, 9 aa, Mycobacterium tuberculosis
AAGSSATGG

SEQ ID NO: 49798 - protein, 9 aa, Mycobacterium tuberculosis
AGSSATGGA

SEQ ID NO: 49799 - protein, 9 aa, Mycobacterium tuberculosis
GSSATGGAA

SEQ ID NO: 49800 - protein, 9 aa, Mycobacterium tuberculosis
SSATGGAAP

SEQ ID NO: 49801 - protein, 9 aa, Mycobacterium tuberculosis
SATGGAAPV

SEQ ID NO: 49802 - protein, 9 aa, Mycobacterium tuberculosis
ATGGAAPVG

SEQ ID NO: 49803 - protein, 9 aa, Mycobacterium tuberculosis
TGGAAPVGA

SEQ ID NO: 49804 - protein, 9 aa, Mycobacterium tuberculosis
GGAAPVGAG

SEQ ID NO: 49805 - protein, 9 aa, Mycobacterium tuberculosis
GAAPVGAGA

SEQ ID NO: 49806 - protein, 9 aa, Mycobacterium tuberculosis
AAPVGAGAM

SEQ ID NO: 49807 - protein, 9 aa, Mycobacterium tuberculosis
APVGAGAMG

SEQ ID NO: 49808 - protein, 9 aa, Mycobacterium tuberculosis
PVGAGAMGQ

SEQ ID NO: 49809 - protein, 9 aa, Mycobacterium tuberculosis
VGAGAMGQG

SEQ ID NO: 49810 - protein, 9 aa, Mycobacterium tuberculosis
GAGAMGQGA

SEQ ID NO: 49811 - protein, 9 aa, Mycobacterium tuberculosis
AGAMGQGAQ

SEQ ID NO: 49812 - protein, 9 aa, Mycobacterium tuberculosis
GAMGQGAQS

SEQ ID NO: 49813 - protein, 9 aa, Mycobacterium tuberculosis
AMGQGAQSG

SEQ ID NO: 49814 - protein, 9 aa, Mycobacterium tuberculosis
MGQGAQSGG

SEQ ID NO: 49815 - protein, 9 aa, Mycobacterium tuberculosis
GQGAQSGGS

SEQ ID NO: 49816 - protein, 9 aa, Mycobacterium tuberculosis
QGAQSGGST

SEQ ID NO: 49817 - protein, 9 aa, Mycobacterium tuberculosis
GAQSGGSTR

SEQ ID NO: 49818 - protein, 9 aa, Mycobacterium tuberculosis
AQSGGSTRP

SEQ ID NO: 49819 - protein, 9 aa, Mycobacterium tuberculosis
QSGGSTRPG

SEQ ID NO: 49820 - protein, 9 aa, Mycobacterium tuberculosis
SGGSTRPGL

SEQ ID NO: 49821 - protein, 9 aa, Mycobacterium tuberculosis
GGSTRPGLV

SEQ ID NO: 49822 - protein, 9 aa, Mycobacterium tuberculosis
GSTRPGLVA

SEQ ID NO: 49823 - protein, 9 aa, Mycobacterium tuberculosis
STRPGLVAP

SEQ ID NO: 49824 - protein, 9 aa, Mycobacterium tuberculosis
TRPGLVAPA

SEQ ID NO: 49825 - protein, 9 aa, Mycobacterium tuberculosis
RPGLVAPAP

SEQ ID NO: 49826 - protein, 9 aa, Mycobacterium tuberculosis
PGLVAPAPL

SEQ ID NO: 49827 - protein, 9 aa, Mycobacterium tuberculosis
GLVAPAPLA

SEQ ID NO: 49828 - protein, 9 aa, Mycobacterium tuberculosis
LVAPAPLAQ

SEQ ID NO: 49829 - protein, 9 aa, Mycobacterium tuberculosis
VAPAPLAQE

SEQ ID NO: 49830 - protein, 9 aa, Mycobacterium tuberculosis
APAPLAQER

SEQ ID NO: 49831 - protein, 9 aa, Mycobacterium tuberculosis
PAPLAQERE

SEQ ID NO: 49832 - protein, 9 aa, Mycobacterium tuberculosis
APLAQEREE

SEQ ID NO: 49833 - protein, 9 aa, Mycobacterium tuberculosis
PLAQEREED

SEQ ID NO: 49834 - protein, 9 aa, Mycobacterium tuberculosis
LAQEREEDD

SEQ ID NO: 49835 - protein, 9 aa, Mycobacterium tuberculosis
AQEREEDDE

SEQ ID NO: 49836 - protein, 9 aa, Mycobacterium tuberculosis
QEREEDDED

SEQ ID NO: 49837 - protein, 9 aa, Mycobacterium tuberculosis
EREEDDEDD

SEQ ID NO: 49838 - protein, 9 aa, Mycobacterium tuberculosis
REEDDEDDW

SEQ ID NO: 49839 - protein, 9 aa, Mycobacterium tuberculosis
EEDDEDDWD

SEQ ID NO: 49840 - protein, 9 aa, Mycobacterium tuberculosis
EDDEDDWDE

SEQ ID NO: 49841 - protein, 9 aa, Mycobacterium tuberculosis
DDEDDWDEE

SEQ ID NO: 49842 - protein, 9 aa, Mycobacterium tuberculosis
DEDDWDEED

SEQ ID NO: 49843 - protein, 9 aa, Mycobacterium tuberculosis
EDDWDEEDD

SEQ ID NO: 49844 - protein, 9 aa, Mycobacterium tuberculosis
DDWDEEDDW

SEQ ID NO: 49845 - protein, 10 aa, Mycobacterium tuberculosis
MLWHAMPPEL

SEQ ID NO: 49846 - protein, 10 aa, Mycobacterium tuberculosis
LWHAMPPELN

SEQ ID NO: 49847 - protein, 10 aa, Mycobacterium tuberculosis
WHAMPPELNT

SEQ ID NO: 49848 - protein, 10 aa, Mycobacterium tuberculosis
HAMPPELNTA

SEQ ID NO: 49849 - protein, 10 aa, Mycobacterium tuberculosis
AMPPELNTAR

SEQ ID NO: 49850 - protein, 10 aa, Mycobacterium tuberculosis
MPPELNTARL

SEQ ID NO: 49851 - protein, 10 aa, Mycobacterium tuberculosis
PPELNTARLM

SEQ ID NO: 49852 - protein, 10 aa, Mycobacterium tuberculosis
PELNTARLMA

SEQ ID NO: 49853 - protein, 10 aa, Mycobacterium tuberculosis
ELNTARLMAG

SEQ ID NO: 49854 - protein, 10 aa, Mycobacterium tuberculosis
LNTARLMAGA

SEQ ID NO: 49855 - protein, 10 aa, Mycobacterium tuberculosis
NTARLMAGAG

SEQ ID NO: 49856 - protein, 10 aa, Mycobacterium tuberculosis
TARLMAGAGP

SEQ ID NO: 49857 - protein, 10 aa, Mycobacterium tuberculosis
ARLMAGAGPA

SEQ ID NO: 49858 - protein, 10 aa, Mycobacterium tuberculosis
RLMAGAGPAP

SEQ ID NO: 49859 - protein, 10 aa, Mycobacterium tuberculosis
LMAGAGPAPM

SEQ ID NO: 49860 - protein, 10 aa, Mycobacterium tuberculosis
MAGAGPAPML

SEQ ID NO: 49861 - protein, 10 aa, Mycobacterium tuberculosis
AGAGPAPMLA

SEQ ID NO: 49862 - protein, 10 aa, Mycobacterium tuberculosis
GAGPAPMLAA

SEQ ID NO: 49863 - protein, 10 aa, Mycobacterium tuberculosis
AGPAPMLAAA

SEQ ID NO: 49864 - protein, 10 aa, Mycobacterium tuberculosis
GPAPMLAAAA

SEQ ID NO: 49865 - protein, 10 aa, Mycobacterium tuberculosis
PAPMLAAAAG

SEQ ID NO: 49866 - protein, 10 aa, Mycobacterium tuberculosis
APMLAAAAGW

SEQ ID NO: 49867 - protein, 10 aa, Mycobacterium tuberculosis
PMLAAAAGWQ

SEQ ID NO: 49868 - protein, 10 aa, Mycobacterium tuberculosis
MLAAAAGWQT

SEQ ID NO: 49869 - protein, 10 aa, Mycobacterium tuberculosis
LAAAAGWQTL

SEQ ID NO: 49870 - protein, 10 aa, Mycobacterium tuberculosis
AAAAGWQTLS

SEQ ID NO: 49871 - protein, 10 aa, Mycobacterium tuberculosis
AAAGWQTLSA

SEQ ID NO: 49872 - protein, 10 aa, Mycobacterium tuberculosis
AAGWQTLSAA

SEQ ID NO: 49873 - protein, 10 aa, Mycobacterium tuberculosis
AGWQTLSAAL

SEQ ID NO: 49874 - protein, 10 aa, Mycobacterium tuberculosis
GWQTLSAALD

SEQ ID NO: 49875 - protein, 10 aa, Mycobacterium tuberculosis
WQTLSAALDA

SEQ ID NO: 49876 - protein, 10 aa, Mycobacterium tuberculosis
QTLSAALDAQ

SEQ ID NO: 49877 - protein, 10 aa, Mycobacterium tuberculosis
TLSAALDAQA

SEQ ID NO: 49878 - protein, 10 aa, Mycobacterium tuberculosis
LSAALDAQAV

SEQ ID NO: 49879 - protein, 10 aa, Mycobacterium tuberculosis
SAALDAQAVE

SEQ ID NO: 49880 - protein, 10 aa, Mycobacterium tuberculosis
AALDAQAVEL

SEQ ID NO: 49881 - protein, 10 aa, Mycobacterium tuberculosis
ALDAQAVELT

SEQ ID NO: 49882 - protein, 10 aa, Mycobacterium tuberculosis
LDAQAVELTA

SEQ ID NO: 49883 - protein, 10 aa, Mycobacterium tuberculosis
DAQAVELTAR

SEQ ID NO: 49884 - protein, 10 aa, Mycobacterium tuberculosis
AQAVELTARL

SEQ ID NO: 49885 - protein, 10 aa, Mycobacterium tuberculosis
QAVELTARLN

SEQ ID NO: 49886 - protein, 10 aa, Mycobacterium tuberculosis
AVELTARLNS

SEQ ID NO: 49887 - protein, 10 aa, Mycobacterium tuberculosis
VELTARLNSL

SEQ ID NO: 49888 - protein, 10 aa, Mycobacterium tuberculosis
ELTARLNSLG

SEQ ID NO: 49889 - protein, 10 aa, Mycobacterium tuberculosis
LTARLNSLGE

SEQ ID NO: 49890 - protein, 10 aa, Mycobacterium tuberculosis
TARLNSLGEA

SEQ ID NO: 49891 - protein, 10 aa, Mycobacterium tuberculosis
ARLNSLGEAW

SEQ ID NO: 49892 - protein, 10 aa, Mycobacterium tuberculosis
RLNSLGEAWT

SEQ ID NO: 49893 - protein, 10 aa, Mycobacterium tuberculosis
LNSLGEAWTG

SEQ ID NO: 49894 - protein, 10 aa, Mycobacterium tuberculosis
NSLGEAWTGG

SEQ ID NO: 49895 - protein, 10 aa, Mycobacterium tuberculosis
SLGEAWTGGG

SEQ ID NO: 49896 - protein, 10 aa, Mycobacterium tuberculosis
LGEAWTGGGS

SEQ ID NO: 49897 - protein, 10 aa, Mycobacterium tuberculosis
GEAWTGGGSD

SEQ ID NO: 49898 - protein, 10 aa, Mycobacterium tuberculosis
EAWTGGGSDK

SEQ ID NO: 49899 - protein, 10 aa, Mycobacterium tuberculosis
AWTGGGSDKA

SEQ ID NO: 49900 - protein, 10 aa, Mycobacterium tuberculosis
WTGGGSDKAL

SEQ ID NO: 49901 - protein, 10 aa, Mycobacterium tuberculosis
TGGGSDKALA

SEQ ID NO: 49902 - protein, 10 aa, Mycobacterium tuberculosis
GGGSDKALAA

SEQ ID NO: 49903 - protein, 10 aa, Mycobacterium tuberculosis
GGSDKALAAA

SEQ ID NO: 49904 - protein, 10 aa, Mycobacterium tuberculosis
GSDKALAAAT

SEQ ID NO: 49905 - protein, 10 aa, Mycobacterium tuberculosis
SDKALAAATP

SEQ ID NO: 49906 - protein, 10 aa, Mycobacterium tuberculosis
DKALAAATPM

SEQ ID NO: 49907 - protein, 10 aa, Mycobacterium tuberculosis
KALAAATPMV

SEQ ID NO: 49908 - protein, 10 aa, Mycobacterium tuberculosis
ALAAATPMVV

SEQ ID NO: 49909 - protein, 10 aa, Mycobacterium tuberculosis
LAAATPMVVW

SEQ ID NO: 49910 - protein, 10 aa, Mycobacterium tuberculosis
AAATPMVVWL

SEQ ID NO: 49911 - protein, 10 aa, Mycobacterium tuberculosis
AATPMVVWLQ

SEQ ID NO: 49912 - protein, 10 aa, Mycobacterium tuberculosis
ATPMVVWLQT

SEQ ID NO: 49913 - protein, 10 aa, Mycobacterium tuberculosis
TPMVVWLQTA

SEQ ID NO: 49914 - protein, 10 aa, Mycobacterium tuberculosis
PMVVWLQTAS

SEQ ID NO: 49915 - protein, 10 aa, Mycobacterium tuberculosis
MVVWLQTAST

SEQ ID NO: 49916 - protein, 10 aa, Mycobacterium tuberculosis
VVWLQTASTQ

SEQ ID NO: 49917 - protein, 10 aa, Mycobacterium tuberculosis
VWLQTASTQA

SEQ ID NO: 49918 - protein, 10 aa, Mycobacterium tuberculosis
WLQTASTQAK

SEQ ID NO: 49919 - protein, 10 aa, Mycobacterium tuberculosis
LQTASTQAKT

SEQ ID NO: 49920 - protein, 10 aa, Mycobacterium tuberculosis
QTASTQAKTR

SEQ ID NO: 49921 - protein, 10 aa, Mycobacterium tuberculosis
TASTQAKTRA

SEQ ID NO: 49922 - protein, 10 aa, Mycobacterium tuberculosis
ASTQAKTRAM

SEQ ID NO: 49923 - protein, 10 aa, Mycobacterium tuberculosis
STQAKTRAMQ

SEQ ID NO: 49924 - protein, 10 aa, Mycobacterium tuberculosis
TQAKTRAMQA

SEQ ID NO: 49925 - protein, 10 aa, Mycobacterium tuberculosis
QAKTRAMQAT

SEQ ID NO: 49926 - protein, 10 aa, Mycobacterium tuberculosis
AKTRAMQATA

SEQ ID NO: 49927 - protein, 10 aa, Mycobacterium tuberculosis
KTRAMQATAQ

SEQ ID NO: 49928 - protein, 10 aa, Mycobacterium tuberculosis
TRAMQATAQA

SEQ ID NO: 49929 - protein, 10 aa, Mycobacterium tuberculosis
RAMQATAQAA

SEQ ID NO: 49930 - protein, 10 aa, Mycobacterium tuberculosis
AMQATAQAAA

SEQ ID NO: 49931 - protein, 10 aa, Mycobacterium tuberculosis
MQATAQAAAY

SEQ ID NO: 49932 - protein, 10 aa, Mycobacterium tuberculosis
QATAQAAAYT

SEQ ID NO: 49933 - protein, 10 aa, Mycobacterium tuberculosis
ATAQAAAYTQ

SEQ ID NO: 49934 - protein, 10 aa, Mycobacterium tuberculosis
TAQAAAYTQA

SEQ ID NO: 49935 - protein, 10 aa, Mycobacterium tuberculosis
AQAAAYTQAM

SEQ ID NO: 49936 - protein, 10 aa, Mycobacterium tuberculosis
QAAAYTQAMA

SEQ ID NO: 49937 - protein, 10 aa, Mycobacterium tuberculosis
AAAYTQAMAT

SEQ ID NO: 49938 - protein, 10 aa, Mycobacterium tuberculosis
AAYTQAMATT

SEQ ID NO: 49939 - protein, 10 aa, Mycobacterium tuberculosis
AYTQAMATTP

SEQ ID NO: 49940 - protein, 10 aa, Mycobacterium tuberculosis
YTQAMATTPS

SEQ ID NO: 49941 - protein, 10 aa, Mycobacterium tuberculosis
TQAMATTPSL

SEQ ID NO: 49942 - protein, 10 aa, Mycobacterium tuberculosis
QAMATTPSLP

SEQ ID NO: 49943 - protein, 10 aa, Mycobacterium tuberculosis
AMATTPSLPE

SEQ ID NO: 49944 - protein, 10 aa, Mycobacterium tuberculosis
MATTPSLPEI

SEQ ID NO: 49945 - protein, 10 aa, Mycobacterium tuberculosis
ATTPSLPEIA

SEQ ID NO: 49946 - protein, 10 aa, Mycobacterium tuberculosis
TTPSLPEIAA

SEQ ID NO: 49947 - protein, 10 aa, Mycobacterium tuberculosis
TPSLPEIAAN

SEQ ID NO: 49948 - protein, 10 aa, Mycobacterium tuberculosis
PSLPEIAANH

SEQ ID NO: 49949 - protein, 10 aa, Mycobacterium tuberculosis
SLPEIAANHI

SEQ ID NO: 49950 - protein, 10 aa, Mycobacterium tuberculosis
LPEIAANHIT

SEQ ID NO: 49951 - protein, 10 aa, Mycobacterium tuberculosis
PEIAANHITQ

SEQ ID NO: 49952 - protein, 10 aa, Mycobacterium tuberculosis
EIAANHITQA

SEQ ID NO: 49953 - protein, 10 aa, Mycobacterium tuberculosis
IAANHITQAV

SEQ ID NO: 49954 - protein, 10 aa, Mycobacterium tuberculosis
AANHITQAVL

SEQ ID NO: 49955 - protein, 10 aa, Mycobacterium tuberculosis
ANHITQAVLT

SEQ ID NO: 49956 - protein, 10 aa, Mycobacterium tuberculosis
NHITQAVLTA

SEQ ID NO: 49957 - protein, 10 aa, Mycobacterium tuberculosis
HITQAVLTAT

SEQ ID NO: 49958 - protein, 10 aa, Mycobacterium tuberculosis
ITQAVLTATN

SEQ ID NO: 49959 - protein, 10 aa, Mycobacterium tuberculosis
TQAVLTATNF

SEQ ID NO: 49960 - protein, 10 aa, Mycobacterium tuberculosis
QAVLTATNFF

SEQ ID NO: 49961 - protein, 10 aa, Mycobacterium tuberculosis
AVLTATNFFG

SEQ ID NO: 49962 - protein, 10 aa, Mycobacterium tuberculosis
VLTATNFFGI

SEQ ID NO: 49963 - protein, 10 aa, Mycobacterium tuberculosis
LTATNFFGIN

SEQ ID NO: 49964 - protein, 10 aa, Mycobacterium tuberculosis
TATNFFGINT

SEQ ID NO: 49965 - protein, 10 aa, Mycobacterium tuberculosis
ATNFFGINTI

SEQ ID NO: 49966 - protein, 10 aa, Mycobacterium tuberculosis
TNFFGINTIP

SEQ ID NO: 49967 - protein, 10 aa, Mycobacterium tuberculosis
NFFGINTIPI

SEQ ID NO: 49968 - protein, 10 aa, Mycobacterium tuberculosis
FFGINTIPIA

SEQ ID NO: 49969 - protein, 10 aa, Mycobacterium tuberculosis
FGINTIPIAL

SEQ ID NO: 49970 - protein, 10 aa, Mycobacterium tuberculosis
GINTIPIALT

SEQ ID NO: 49971 - protein, 10 aa, Mycobacterium tuberculosis
INTIPIALTE

SEQ ID NO: 49972 - protein, 10 aa, Mycobacterium tuberculosis
NTIPIALTEM

SEQ ID NO: 49973 - protein, 10 aa, Mycobacterium tuberculosis
TIPIALTEMD

SEQ ID NO: 49974 - protein, 10 aa, Mycobacterium tuberculosis
IPIALTEMDY

SEQ ID NO: 49975 - protein, 10 aa, Mycobacterium tuberculosis
PIALTEMDYF

SEQ ID NO: 49976 - protein, 10 aa, Mycobacterium tuberculosis
IALTEMDYFI

SEQ ID NO: 49977 - protein, 10 aa, Mycobacterium tuberculosis
ALTEMDYFIR

SEQ ID NO: 49978 - protein, 10 aa, Mycobacterium tuberculosis
LTEMDYFIRM

SEQ ID NO: 49979 - protein, 10 aa, Mycobacterium tuberculosis
TEMDYFIRMW

SEQ ID NO: 49980 - protein, 10 aa, Mycobacterium tuberculosis
EMDYFIRMWN

SEQ ID NO: 49981 - protein, 10 aa, Mycobacterium tuberculosis
MDYFIRMWNQ

SEQ ID NO: 49982 - protein, 10 aa, Mycobacterium tuberculosis
DYFIRMWNQA

SEQ ID NO: 49983 - protein, 10 aa, Mycobacterium tuberculosis
YFIRMWNQAA

SEQ ID NO: 49984 - protein, 10 aa, Mycobacterium tuberculosis
FIRMWNQAAL

SEQ ID NO: 49985 - protein, 10 aa, Mycobacterium tuberculosis
IRMWNQAALA

SEQ ID NO: 49986 - protein, 10 aa, Mycobacterium tuberculosis
RMWNQAALAM

SEQ ID NO: 49987 - protein, 10 aa, Mycobacterium tuberculosis
MWNQAALAME

SEQ ID NO: 49988 - protein, 10 aa, Mycobacterium tuberculosis
WNQAALAMEV

SEQ ID NO: 49989 - protein, 10 aa, Mycobacterium tuberculosis
NQAALAMEVY

SEQ ID NO: 49990 - protein, 10 aa, Mycobacterium tuberculosis
QAALAMEVYQ

SEQ ID NO: 49991 - protein, 10 aa, Mycobacterium tuberculosis
AALAMEVYQA

SEQ ID NO: 49992 - protein, 10 aa, Mycobacterium tuberculosis
ALAMEVYQAE

SEQ ID NO: 49993 - protein, 10 aa, Mycobacterium tuberculosis
LAMEVYQAET

SEQ ID NO: 49994 - protein, 10 aa, Mycobacterium tuberculosis
AMEVYQAETA

SEQ ID NO: 49995 - protein, 10 aa, Mycobacterium tuberculosis
MEVYQAETAV

SEQ ID NO: 49996 - protein, 10 aa, Mycobacterium tuberculosis
EVYQAETAVN

SEQ ID NO: 49997 - protein, 10 aa, Mycobacterium tuberculosis
VYQAETAVNT

SEQ ID NO: 49998 - protein, 10 aa, Mycobacterium tuberculosis
YQAETAVNTL

SEQ ID NO: 49999 - protein, 10 aa, Mycobacterium tuberculosis
QAETAVNTLF

SEQ ID NO: 50000 - protein, 10 aa, Mycobacterium tuberculosis
AETAVNTLFE

SEQ ID NO: 50001 - protein, 10 aa, Mycobacterium tuberculosis
ETAVNTLFEK

SEQ ID NO: 50002 - protein, 10 aa, Mycobacterium tuberculosis
TAVNTLFEKL

SEQ ID NO: 50003 - protein, 10 aa, Mycobacterium tuberculosis
AVNTLFEKLE

SEQ ID NO: 50004 - protein, 10 aa, Mycobacterium tuberculosis
VNTLFEKLEP

SEQ ID NO: 50005 - protein, 10 aa, Mycobacterium tuberculosis
NTLFEKLEPM

SEQ ID NO: 50006 - protein, 10 aa, Mycobacterium tuberculosis
TLFEKLEPMA

SEQ ID NO: 50007 - protein, 10 aa, Mycobacterium tuberculosis
LFEKLEPMAS

SEQ ID NO: 50008 - protein, 10 aa, Mycobacterium tuberculosis
FEKLEPMASI

SEQ ID NO: 50009 - protein, 10 aa, Mycobacterium tuberculosis
EKLEPMASIL

SEQ ID NO: 50010 - protein, 10 aa, Mycobacterium tuberculosis
KLEPMASILD

SEQ ID NO: 50011 - protein, 10 aa, Mycobacterium tuberculosis
LEPMASILDP

SEQ ID NO: 50012 - protein, 10 aa, Mycobacterium tuberculosis
EPMASILDPG

SEQ ID NO: 50013 - protein, 10 aa, Mycobacterium tuberculosis
PMASILDPGA

SEQ ID NO: 50014 - protein, 10 aa, Mycobacterium tuberculosis
MASILDPGAS

SEQ ID NO: 50015 - protein, 10 aa, Mycobacterium tuberculosis
ASILDPGASQ

SEQ ID NO: 50016 - protein, 10 aa, Mycobacterium tuberculosis
SILDPGASQS

SEQ ID NO: 50017 - protein, 10 aa, Mycobacterium tuberculosis
ILDPGASQST

SEQ ID NO: 50018 - protein, 10 aa, Mycobacterium tuberculosis
LDPGASQSTT

SEQ ID NO: 50019 - protein, 10 aa, Mycobacterium tuberculosis
DPGASQSTTN

SEQ ID NO: 50020 - protein, 10 aa, Mycobacterium tuberculosis
PGASQSTTNP

SEQ ID NO: 50021 - protein, 10 aa, Mycobacterium tuberculosis
GASQSTTNPI

SEQ ID NO: 50022 - protein, 10 aa, Mycobacterium tuberculosis
ASQSTTNPIF

SEQ ID NO: 50023 - protein, 10 aa, Mycobacterium tuberculosis
SQSTTNPIFG

SEQ ID NO: 50024 - protein, 10 aa, Mycobacterium tuberculosis
QSTTNPIFGM

SEQ ID NO: 50025 - protein, 10 aa, Mycobacterium tuberculosis
STTNPIFGMP

SEQ ID NO: 50026 - protein, 10 aa, Mycobacterium tuberculosis
TTNPIFGMPS

SEQ ID NO: 50027 - protein, 10 aa, Mycobacterium tuberculosis
TNPIFGMPSP

SEQ ID NO: 50028 - protein, 10 aa, Mycobacterium tuberculosis
NPIFGMPSPG

SEQ ID NO: 50029 - protein, 10 aa, Mycobacterium tuberculosis
PIFGMPSPGS

SEQ ID NO: 50030 - protein, 10 aa, Mycobacterium tuberculosis
IFGMPSPGSS

SEQ ID NO: 50031 - protein, 10 aa, Mycobacterium tuberculosis
FGMPSPGSST

SEQ ID NO: 50032 - protein, 10 aa, Mycobacterium tuberculosis
GMPSPGSSTP

SEQ ID NO: 50033 - protein, 10 aa, Mycobacterium tuberculosis
MPSPGSSTPV

SEQ ID NO: 50034 - protein, 10 aa, Mycobacterium tuberculosis
PSPGSSTPVG

SEQ ID NO: 50035 - protein, 10 aa, Mycobacterium tuberculosis
SPGSSTPVGQ

SEQ ID NO: 50036 - protein, 10 aa, Mycobacterium tuberculosis
PGSSTPVGQL

SEQ ID NO: 50037 - protein, 10 aa, Mycobacterium tuberculosis
GSSTPVGQLP

SEQ ID NO: 50038 - protein, 10 aa, Mycobacterium tuberculosis
SSTPVGQLPP

SEQ ID NO: 50039 - protein, 10 aa, Mycobacterium tuberculosis
STPVGQLPPA

SEQ ID NO: 50040 - protein, 10 aa, Mycobacterium tuberculosis
TPVGQLPPAA

SEQ ID NO: 50041 - protein, 10 aa, Mycobacterium tuberculosis
PVGQLPPAAT

SEQ ID NO: 50042 - protein, 10 aa, Mycobacterium tuberculosis
VGQLPPAATQ

SEQ ID NO: 50043 - protein, 10 aa, Mycobacterium tuberculosis
GQLPPAATQT

SEQ ID NO: 50044 - protein, 10 aa, Mycobacterium tuberculosis
QLPPAATQTL

SEQ ID NO: 50045 - protein, 10 aa, Mycobacterium tuberculosis
LPPAATQTLG

SEQ ID NO: 50046 - protein, 10 aa, Mycobacterium tuberculosis
PPAATQTLGQ

SEQ ID NO: 50047 - protein, 10 aa, Mycobacterium tuberculosis
PAATQTLGQL

SEQ ID NO: 50048 - protein, 10 aa, Mycobacterium tuberculosis
AATQTLGQLG

SEQ ID NO: 50049 - protein, 10 aa, Mycobacterium tuberculosis
ATQTLGQLGE

SEQ ID NO: 50050 - protein, 10 aa, Mycobacterium tuberculosis
TQTLGQLGEM

SEQ ID NO: 50051 - protein, 10 aa, Mycobacterium tuberculosis
QTLGQLGEMS

SEQ ID NO: 50052 - protein, 10 aa, Mycobacterium tuberculosis
TLGQLGEMSG

SEQ ID NO: 50053 - protein, 10 aa, Mycobacterium tuberculosis
LGQLGEMSGP

SEQ ID NO: 50054 - protein, 10 aa, Mycobacterium tuberculosis
GQLGEMSGPM

SEQ ID NO: 50055 - protein, 10 aa, Mycobacterium tuberculosis
QLGEMSGPMQ

SEQ ID NO: 50056 - protein, 10 aa, Mycobacterium tuberculosis
LGEMSGPMQQ

SEQ ID NO: 50057 - protein, 10 aa, Mycobacterium tuberculosis
GEMSGPMQQL

SEQ ID NO: 50058 - protein, 10 aa, Mycobacterium tuberculosis
EMSGPMQQLT

SEQ ID NO: 50059 - protein, 10 aa, Mycobacterium tuberculosis
MSGPMQQLTQ

SEQ ID NO: 50060 - protein, 10 aa, Mycobacterium tuberculosis
SGPMQQLTQP

SEQ ID NO: 50061 - protein, 10 aa, Mycobacterium tuberculosis
GPMQQLTQPL

SEQ ID NO: 50062 - protein, 10 aa, Mycobacterium tuberculosis
PMQQLTQPLQ

SEQ ID NO: 50063 - protein, 10 aa, Mycobacterium tuberculosis
MQQLTQPLQQ

SEQ ID NO: 50064 - protein, 10 aa, Mycobacterium tuberculosis
QQLTQPLQQV

SEQ ID NO: 50065 - protein, 10 aa, Mycobacterium tuberculosis
QLTQPLQQVT

SEQ ID NO: 50066 - protein, 10 aa, Mycobacterium tuberculosis
LTQPLQQVTS

SEQ ID NO: 50067 - protein, 10 aa, Mycobacterium tuberculosis
TQPLQQVTSL

SEQ ID NO: 50068 - protein, 10 aa, Mycobacterium tuberculosis
QPLQQVTSLF

SEQ ID NO: 50069 - protein, 10 aa, Mycobacterium tuberculosis
PLQQVTSLFS

SEQ ID NO: 50070 - protein, 10 aa, Mycobacterium tuberculosis
LQQVTSLFSQ

SEQ ID NO: 50071 - protein, 10 aa, Mycobacterium tuberculosis
QQVTSLFSQV

SEQ ID NO: 50072 - protein, 10 aa, Mycobacterium tuberculosis
QVTSLFSQVG

SEQ ID NO: 50073 - protein, 10 aa, Mycobacterium tuberculosis
VTSLFSQVGG

SEQ ID NO: 50074 - protein, 10 aa, Mycobacterium tuberculosis
TSLFSQVGGT

SEQ ID NO: 50075 - protein, 10 aa, Mycobacterium tuberculosis
SLFSQVGGTG

SEQ ID NO: 50076 - protein, 10 aa, Mycobacterium tuberculosis
LFSQVGGTGG

SEQ ID NO: 50077 - protein, 10 aa, Mycobacterium tuberculosis
FSQVGGTGGG

SEQ ID NO: 50078 - protein, 10 aa, Mycobacterium tuberculosis
SQVGGTGGGN

SEQ ID NO: 50079 - protein, 10 aa, Mycobacterium tuberculosis
QVGGTGGGNP

SEQ ID NO: 50080 - protein, 10 aa, Mycobacterium tuberculosis
VGGTGGGNPA

SEQ ID NO: 50081 - protein, 10 aa, Mycobacterium tuberculosis
GGTGGGNPAD

SEQ ID NO: 50082 - protein, 10 aa, Mycobacterium tuberculosis
GTGGGNPADE

SEQ ID NO: 50083 - protein, 10 aa, Mycobacterium tuberculosis
TGGGNPADEE

SEQ ID NO: 50084 - protein, 10 aa, Mycobacterium tuberculosis
GGGNPADEEA

SEQ ID NO: 50085 - protein, 10 aa, Mycobacterium tuberculosis
GGNPADEEAA

SEQ ID NO: 50086 - protein, 10 aa, Mycobacterium tuberculosis
GNPADEEAAQ

SEQ ID NO: 50087 - protein, 10 aa, Mycobacterium tuberculosis
NPADEEAAQM

SEQ ID NO: 50088 - protein, 10 aa, Mycobacterium tuberculosis
PADEEAAQMG

SEQ ID NO: 50089 - protein, 10 aa, Mycobacterium tuberculosis
ADEEAAQMGL

SEQ ID NO: 50090 - protein, 10 aa, Mycobacterium tuberculosis
DEEAAQMGLL

SEQ ID NO: 50091 - protein, 10 aa, Mycobacterium tuberculosis
EEAAQMGLLG

SEQ ID NO: 50092 - protein, 10 aa, Mycobacterium tuberculosis
EAAQMGLLGT

SEQ ID NO: 50093 - protein, 10 aa, Mycobacterium tuberculosis
AAQMGLLGTS

SEQ ID NO: 50094 - protein, 10 aa, Mycobacterium tuberculosis
AQMGLLGTSP

SEQ ID NO: 50095 - protein, 10 aa, Mycobacterium tuberculosis
QMGLLGTSPL

SEQ ID NO: 50096 - protein, 10 aa, Mycobacterium tuberculosis
MGLLGTSPLS

SEQ ID NO: 50097 - protein, 10 aa, Mycobacterium tuberculosis
GLLGTSPLSN

SEQ ID NO: 50098 - protein, 10 aa, Mycobacterium tuberculosis
LLGTSPLSNH

SEQ ID NO: 50099 - protein, 10 aa, Mycobacterium tuberculosis
LGTSPLSNHP

SEQ ID NO: 50100 - protein, 10 aa, Mycobacterium tuberculosis
GTSPLSNHPL

SEQ ID NO: 50101 - protein, 10 aa, Mycobacterium tuberculosis
TSPLSNHPLA

SEQ ID NO: 50102 - protein, 10 aa, Mycobacterium tuberculosis
SPLSNHPLAG

SEQ ID NO: 50103 - protein, 10 aa, Mycobacterium tuberculosis
PLSNHPLAGG

SEQ ID NO: 50104 - protein, 10 aa, Mycobacterium tuberculosis
LSNHPLAGGS

SEQ ID NO: 50105 - protein, 10 aa, Mycobacterium tuberculosis
SNHPLAGGSG

SEQ ID NO: 50106 - protein, 10 aa, Mycobacterium tuberculosis
NHPLAGGSGP

SEQ ID NO: 50107 - protein, 10 aa, Mycobacterium tuberculosis
HPLAGGSGPS

SEQ ID NO: 50108 - protein, 10 aa, Mycobacterium tuberculosis
PLAGGSGPSA

SEQ ID NO: 50109 - protein, 10 aa, Mycobacterium tuberculosis
LAGGSGPSAG

SEQ ID NO: 50110 - protein, 10 aa, Mycobacterium tuberculosis
AGGSGPSAGA

SEQ ID NO: 50111 - protein, 10 aa, Mycobacterium tuberculosis
GGSGPSAGAG

SEQ ID NO: 50112 - protein, 10 aa, Mycobacterium tuberculosis
GSGPSAGAGL

SEQ ID NO: 50113 - protein, 10 aa, Mycobacterium tuberculosis
SGPSAGAGLL

SEQ ID NO: 50114 - protein, 10 aa, Mycobacterium tuberculosis
GPSAGAGLLR

SEQ ID NO: 50115 - protein, 10 aa, Mycobacterium tuberculosis
PSAGAGLLRA

SEQ ID NO: 50116 - protein, 10 aa, Mycobacterium tuberculosis
SAGAGLLRAE

SEQ ID NO: 50117 - protein, 10 aa, Mycobacterium tuberculosis
AGAGLLRAES

SEQ ID NO: 50118 - protein, 10 aa, Mycobacterium tuberculosis
GAGLLRAESL

SEQ ID NO: 50119 - protein, 10 aa, Mycobacterium tuberculosis
AGLLRAESLP

SEQ ID NO: 50120 - protein, 10 aa, Mycobacterium tuberculosis
GLLRAESLPG

SEQ ID NO: 50121 - protein, 10 aa, Mycobacterium tuberculosis
LLRAESLPGA

SEQ ID NO: 50122 - protein, 10 aa, Mycobacterium tuberculosis
LRAESLPGAG

SEQ ID NO: 50123 - protein, 10 aa, Mycobacterium tuberculosis
RAESLPGAGG

SEQ ID NO: 50124 - protein, 10 aa, Mycobacterium tuberculosis
AESLPGAGGS

SEQ ID NO: 50125 - protein, 10 aa, Mycobacterium tuberculosis
ESLPGAGGSL

SEQ ID NO: 50126 - protein, 10 aa, Mycobacterium tuberculosis
SLPGAGGSLT

SEQ ID NO: 50127 - protein, 10 aa, Mycobacterium tuberculosis
LPGAGGSLTR

SEQ ID NO: 50128 - protein, 10 aa, Mycobacterium tuberculosis
PGAGGSLTRT

SEQ ID NO: 50129 - protein, 10 aa, Mycobacterium tuberculosis
GAGGSLTRTP

SEQ ID NO: 50130 - protein, 10 aa, Mycobacterium tuberculosis
AGGSLTRTPL

SEQ ID NO: 50131 - protein, 10 aa, Mycobacterium tuberculosis
GGSLTRTPLM

SEQ ID NO: 50132 - protein, 10 aa, Mycobacterium tuberculosis
GSLTRTPLMS

SEQ ID NO: 50133 - protein, 10 aa, Mycobacterium tuberculosis
SLTRTPLMSQ

SEQ ID NO: 50134 - protein, 10 aa, Mycobacterium tuberculosis
LTRTPLMSQL

SEQ ID NO: 50135 - protein, 10 aa, Mycobacterium tuberculosis
TRTPLMSQLI

SEQ ID NO: 50136 - protein, 10 aa, Mycobacterium tuberculosis
RTPLMSQLIE

SEQ ID NO: 50137 - protein, 10 aa, Mycobacterium tuberculosis
TPLMSQLIEK

SEQ ID NO: 50138 - protein, 10 aa, Mycobacterium tuberculosis
PLMSQLIEKP

SEQ ID NO: 50139 - protein, 10 aa, Mycobacterium tuberculosis
LMSQLIEKPV

SEQ ID NO: 50140 - protein, 10 aa, Mycobacterium tuberculosis
MSQLIEKPVA

SEQ ID NO: 50141 - protein, 10 aa, Mycobacterium tuberculosis
SQLIEKPVAP

SEQ ID NO: 50142 - protein, 10 aa, Mycobacterium tuberculosis
QLIEKPVAPS

SEQ ID NO: 50143 - protein, 10 aa, Mycobacterium tuberculosis
LIEKPVAPSV

SEQ ID NO: 50144 - protein, 10 aa, Mycobacterium tuberculosis
IEKPVAPSVM

SEQ ID NO: 50145 - protein, 10 aa, Mycobacterium tuberculosis
EKPVAPSVMP

SEQ ID NO: 50146 - protein, 10 aa, Mycobacterium tuberculosis
KPVAPSVMPA

SEQ ID NO: 50147 - protein, 10 aa, Mycobacterium tuberculosis
PVAPSVMPAA

SEQ ID NO: 50148 - protein, 10 aa, Mycobacterium tuberculosis
VAPSVMPAAA

SEQ ID NO: 50149 - protein, 10 aa, Mycobacterium tuberculosis
APSVMPAAAA

SEQ ID NO: 50150 - protein, 10 aa, Mycobacterium tuberculosis
PSVMPAAAAG

SEQ ID NO: 50151 - protein, 10 aa, Mycobacterium tuberculosis
SVMPAAAAGS

SEQ ID NO: 50152 - protein, 10 aa, Mycobacterium tuberculosis
VMPAAAAGSS

SEQ ID NO: 50153 - protein, 10 aa, Mycobacterium tuberculosis
MPAAAAGSSA

SEQ ID NO: 50154 - protein, 10 aa, Mycobacterium tuberculosis
PAAAAGSSAT

SEQ ID NO: 50155 - protein, 10 aa, Mycobacterium tuberculosis
AAAAGSSATG

SEQ ID NO: 50156 - protein, 10 aa, Mycobacterium tuberculosis
AAAGSSATGG

SEQ ID NO: 50157 - protein, 10 aa, Mycobacterium tuberculosis
AAGSSATGGA

SEQ ID NO: 50158 - protein, 10 aa, Mycobacterium tuberculosis
AGSSATGGAA

SEQ ID NO: 50159 - protein, 10 aa, Mycobacterium tuberculosis
GSSATGGAAP

SEQ ID NO: 50160 - protein, 10 aa, Mycobacterium tuberculosis
SSATGGAAPV

SEQ ID NO: 50161 - protein, 10 aa, Mycobacterium tuberculosis
SATGGAAPVG

SEQ ID NO: 50162 - protein, 10 aa, Mycobacterium tuberculosis
ATGGAAPVGA

SEQ ID NO: 50163 - protein, 10 aa, Mycobacterium tuberculosis
TGGAAPVGAG

SEQ ID NO: 50164 - protein, 10 aa, Mycobacterium tuberculosis
GGAAPVGAGA

SEQ ID NO: 50165 - protein, 10 aa, Mycobacterium tuberculosis
GAAPVGAGAM

SEQ ID NO: 50166 - protein, 10 aa, Mycobacterium tuberculosis
AAPVGAGAMG

SEQ ID NO: 50167 - protein, 10 aa, Mycobacterium tuberculosis
APVGAGAMGQ

SEQ ID NO: 50168 - protein, 10 aa, Mycobacterium tuberculosis
PVGAGAMGQG

SEQ ID NO: 50169 - protein, 10 aa, Mycobacterium tuberculosis
VGAGAMGQGA

SEQ ID NO: 50170 - protein, 10 aa, Mycobacterium tuberculosis
GAGAMGQGAQ

SEQ ID NO: 50171 - protein, 10 aa, Mycobacterium tuberculosis
AGAMGQGAQS

SEQ ID NO: 50172 - protein, 10 aa, Mycobacterium tuberculosis
GAMGQGAQSG

SEQ ID NO: 50173 - protein, 10 aa, Mycobacterium tuberculosis
AMGQGAQSGG

SEQ ID NO: 50174 - protein, 10 aa, Mycobacterium tuberculosis
MGQGAQSGGS

SEQ ID NO: 50175 - protein, 10 aa, Mycobacterium tuberculosis
GQGAQSGGST

SEQ ID NO: 50176 - protein, 10 aa, Mycobacterium tuberculosis
QGAQSGGSTR

SEQ ID NO: 50177 - protein, 10 aa, Mycobacterium tuberculosis
GAQSGGSTRP

SEQ ID NO: 50178 - protein, 10 aa, Mycobacterium tuberculosis
AQSGGSTRPG

SEQ ID NO: 50179 - protein, 10 aa, Mycobacterium tuberculosis
QSGGSTRPGL

SEQ ID NO: 50180 - protein, 10 aa, Mycobacterium tuberculosis
SGGSTRPGLV

SEQ ID NO: 50181 - protein, 10 aa, Mycobacterium tuberculosis
GGSTRPGLVA

SEQ ID NO: 50182 - protein, 10 aa, Mycobacterium tuberculosis
GSTRPGLVAP

SEQ ID NO: 50183 - protein, 10 aa, Mycobacterium tuberculosis
STRPGLVAPA

SEQ ID NO: 50184 - protein, 10 aa, Mycobacterium tuberculosis
TRPGLVAPAP

SEQ ID NO: 50185 - protein, 10 aa, Mycobacterium tuberculosis
RPGLVAPAPL

SEQ ID NO: 50186 - protein, 10 aa, Mycobacterium tuberculosis
PGLVAPAPLA

SEQ ID NO: 50187 - protein, 10 aa, Mycobacterium tuberculosis
GLVAPAPLAQ

SEQ ID NO: 50188 - protein, 10 aa, Mycobacterium tuberculosis
LVAPAPLAQE

SEQ ID NO: 50189 - protein, 10 aa, Mycobacterium tuberculosis
VAPAPLAQER

SEQ ID NO: 50190 - protein, 10 aa, Mycobacterium tuberculosis
APAPLAQERE

SEQ ID NO: 50191 - protein, 10 aa, Mycobacterium tuberculosis
PAPLAQEREE

SEQ ID NO: 50192 - protein, 10 aa, Mycobacterium tuberculosis
APLAQEREED

SEQ ID NO: 50193 - protein, 10 aa, Mycobacterium tuberculosis
PLAQEREEDD

SEQ ID NO: 50194 - protein, 10 aa, Mycobacterium tuberculosis
LAQEREEDDE

SEQ ID NO: 50195 - protein, 10 aa, Mycobacterium tuberculosis
AQEREEDDED

SEQ ID NO: 50196 - protein, 10 aa, Mycobacterium tuberculosis
QEREEDDEDD

SEQ ID NO: 50197 - protein, 10 aa, Mycobacterium tuberculosis
EREEDDEDDW

SEQ ID NO: 50198 - protein, 10 aa, Mycobacterium tuberculosis
REEDDEDDWD

SEQ ID NO: 50199 - protein, 10 aa, Mycobacterium tuberculosis
EEDDEDDWDE

SEQ ID NO: 50200 - protein, 10 aa, Mycobacterium tuberculosis
EDDEDDWDEE

SEQ ID NO: 50201 - protein, 10 aa, Mycobacterium tuberculosis
DDEDDWDEED

SEQ ID NO: 50202 - protein, 10 aa, Mycobacterium tuberculosis
DEDDWDEEDD

SEQ ID NO: 50203 - protein, 10 aa, Mycobacterium tuberculosis
EDDWDEEDDW

SEQ ID NO: 50204 - protein, 11 aa, Mycobacterium tuberculosis
MLWHAMPPELN

SEQ ID NO: 50205 - protein, 11 aa, Mycobacterium tuberculosis
LWHAMPPELNT

SEQ ID NO: 50206 - protein, 11 aa, Mycobacterium tuberculosis
WHAMPPELNTA

SEQ ID NO: 50207 - protein, 11 aa, Mycobacterium tuberculosis
HAMPPELNTAR

SEQ ID NO: 50208 - protein, 11 aa, Mycobacterium tuberculosis
AMPPELNTARL

SEQ ID NO: 50209 - protein, 11 aa, Mycobacterium tuberculosis
MPPELNTARLM

SEQ ID NO: 50210 - protein, 11 aa, Mycobacterium tuberculosis
PPELNTARLMA

SEQ ID NO: 50211 - protein, 11 aa, Mycobacterium tuberculosis
PELNTARLMAG

SEQ ID NO: 50212 - protein, 11 aa, Mycobacterium tuberculosis
ELNTARLMAGA

SEQ ID NO: 50213 - protein, 11 aa, Mycobacterium tuberculosis
LNTARLMAGAG

SEQ ID NO: 50214 - protein, 11 aa, Mycobacterium tuberculosis
NTARLMAGAGP

SEQ ID NO: 50215 - protein, 11 aa, Mycobacterium tuberculosis
TARLMAGAGPA

SEQ ID NO: 50216 - protein, 11 aa, Mycobacterium tuberculosis
ARLMAGAGPAP

SEQ ID NO: 50217 - protein, 11 aa, Mycobacterium tuberculosis
RLMAGAGPAPM

SEQ ID NO: 50218 - protein, 11 aa, Mycobacterium tuberculosis
LMAGAGPAPML

SEQ ID NO: 50219 - protein, 11 aa, Mycobacterium tuberculosis
MAGAGPAPMLA

SEQ ID NO: 50220 - protein, 11 aa, Mycobacterium tuberculosis
AGAGPAPMLAA

SEQ ID NO: 50221 - protein, 11 aa, Mycobacterium tuberculosis
GAGPAPMLAAA

SEQ ID NO: 50222 - protein, 11 aa, Mycobacterium tuberculosis
AGPAPMLAAAA

SEQ ID NO: 50223 - protein, 11 aa, Mycobacterium tuberculosis
GPAPMLAAAAG

SEQ ID NO: 50224 - protein, 11 aa, Mycobacterium tuberculosis
PAPMLAAAAGW

SEQ ID NO: 50225 - protein, 11 aa, Mycobacterium tuberculosis
APMLAAAAGWQ

SEQ ID NO: 50226 - protein, 11 aa, Mycobacterium tuberculosis
PMLAAAAGWQT

SEQ ID NO: 50227 - protein, 11 aa, Mycobacterium tuberculosis
MLAAAAGWQTL

SEQ ID NO: 50228 - protein, 11 aa, Mycobacterium tuberculosis
LAAAAGWQTLS

SEQ ID NO: 50229 - protein, 11 aa, Mycobacterium tuberculosis
AAAAGWQTLSA

SEQ ID NO: 50230 - protein, 11 aa, Mycobacterium tuberculosis
AAAGWQTLSAA

SEQ ID NO: 50231 - protein, 11 aa, Mycobacterium tuberculosis
AAGWQTLSAAL

SEQ ID NO: 50232 - protein, 11 aa, Mycobacterium tuberculosis
AGWQTLSAALD

SEQ ID NO: 50233 - protein, 11 aa, Mycobacterium tuberculosis
GWQTLSAALDA

SEQ ID NO: 50234 - protein, 11 aa, Mycobacterium tuberculosis
WQTLSAALDAQ

SEQ ID NO: 50235 - protein, 11 aa, Mycobacterium tuberculosis
QTLSAALDAQA

SEQ ID NO: 50236 - protein, 11 aa, Mycobacterium tuberculosis
TLSAALDAQAV

SEQ ID NO: 50237 - protein, 11 aa, Mycobacterium tuberculosis
LSAALDAQAVE

SEQ ID NO: 50238 - protein, 11 aa, Mycobacterium tuberculosis
SAALDAQAVEL

SEQ ID NO: 50239 - protein, 11 aa, Mycobacterium tuberculosis
AALDAQAVELT

SEQ ID NO: 50240 - protein, 11 aa, Mycobacterium tuberculosis
ALDAQAVELTA

SEQ ID NO: 50241 - protein, 11 aa, Mycobacterium tuberculosis
LDAQAVELTAR

SEQ ID NO: 50242 - protein, 11 aa, Mycobacterium tuberculosis
DAQAVELTARL

SEQ ID NO: 50243 - protein, 11 aa, Mycobacterium tuberculosis
AQAVELTARLN

SEQ ID NO: 50244 - protein, 11 aa, Mycobacterium tuberculosis
QAVELTARLNS

SEQ ID NO: 50245 - protein, 11 aa, Mycobacterium tuberculosis
AVELTARLNSL

SEQ ID NO: 50246 - protein, 11 aa, Mycobacterium tuberculosis
VELTARLNSLG

SEQ ID NO: 50247 - protein, 11 aa, Mycobacterium tuberculosis
ELTARLNSLGE

SEQ ID NO: 50248 - protein, 11 aa, Mycobacterium tuberculosis
LTARLNSLGEA

SEQ ID NO: 50249 - protein, 11 aa, Mycobacterium tuberculosis
TARLNSLGEAW

SEQ ID NO: 50250 - protein, 11 aa, Mycobacterium tuberculosis
ARLNSLGEAWT

SEQ ID NO: 50251 - protein, 11 aa, Mycobacterium tuberculosis
RLNSLGEAWTG

SEQ ID NO: 50252 - protein, 11 aa, Mycobacterium tuberculosis
LNSLGEAWTGG

SEQ ID NO: 50253 - protein, 11 aa, Mycobacterium tuberculosis
NSLGEAWTGGG

SEQ ID NO: 50254 - protein, 11 aa, Mycobacterium tuberculosis
SLGEAWTGGGS

SEQ ID NO: 50255 - protein, 11 aa, Mycobacterium tuberculosis
LGEAWTGGGSD

SEQ ID NO: 50256 - protein, 11 aa, Mycobacterium tuberculosis
GEAWTGGGSDK

SEQ ID NO: 50257 - protein, 11 aa, Mycobacterium tuberculosis
EAWTGGGSDKA

SEQ ID NO: 50258 - protein, 11 aa, Mycobacterium tuberculosis
AWTGGGSDKAL

SEQ ID NO: 50259 - protein, 11 aa, Mycobacterium tuberculosis
WTGGGSDKALA

SEQ ID NO: 50260 - protein, 11 aa, Mycobacterium tuberculosis
TGGGSDKALAA

SEQ ID NO: 50261 - protein, 11 aa, Mycobacterium tuberculosis
GGGSDKALAAA

SEQ ID NO: 50262 - protein, 11 aa, Mycobacterium tuberculosis
GGSDKALAAAT

SEQ ID NO: 50263 - protein, 11 aa, Mycobacterium tuberculosis
GSDKALAAATP

SEQ ID NO: 50264 - protein, 11 aa, Mycobacterium tuberculosis
SDKALAAATPM

SEQ ID NO: 50265 - protein, 11 aa, Mycobacterium tuberculosis
DKALAAATPMV

SEQ ID NO: 50266 - protein, 11 aa, Mycobacterium tuberculosis
KALAAATPMVV

SEQ ID NO: 50267 - protein, 11 aa, Mycobacterium tuberculosis
ALAAATPMVVW

SEQ ID NO: 50268 - protein, 11 aa, Mycobacterium tuberculosis
LAAATPMVVWL

SEQ ID NO: 50269 - protein, 11 aa, Mycobacterium tuberculosis
AAATPMVVWLQ

SEQ ID NO: 50270 - protein, 11 aa, Mycobacterium tuberculosis
AATPMVVWLQT

SEQ ID NO: 50271 - protein, 11 aa, Mycobacterium tuberculosis
ATPMVVWLQTA

SEQ ID NO: 50272 - protein, 11 aa, Mycobacterium tuberculosis
TPMVVWLQTAS

SEQ ID NO: 50273 - protein, 11 aa, Mycobacterium tuberculosis
PMVVWLQTAST

SEQ ID NO: 50274 - protein, 11 aa, Mycobacterium tuberculosis
MVVWLQTASTQ

SEQ ID NO: 50275 - protein, 11 aa, Mycobacterium tuberculosis
VVWLQTASTQA

SEQ ID NO: 50276 - protein, 11 aa, Mycobacterium tuberculosis
VWLQTASTQAK

SEQ ID NO: 50277 - protein, 11 aa, Mycobacterium tuberculosis
WLQTASTQAKT

SEQ ID NO: 50278 - protein, 11 aa, Mycobacterium tuberculosis
LQTASTQAKTR

SEQ ID NO: 50279 - protein, 11 aa, Mycobacterium tuberculosis
QTASTQAKTRA

SEQ ID NO: 50280 - protein, 11 aa, Mycobacterium tuberculosis
TASTQAKTRAM

SEQ ID NO: 50281 - protein, 11 aa, Mycobacterium tuberculosis
ASTQAKTRAMQ

SEQ ID NO: 50282 - protein, 11 aa, Mycobacterium tuberculosis
STQAKTRAMQA

SEQ ID NO: 50283 - protein, 11 aa, Mycobacterium tuberculosis
TQAKTRAMQAT

SEQ ID NO: 50284 - protein, 11 aa, Mycobacterium tuberculosis
QAKTRAMQATA

SEQ ID NO: 50285 - protein, 11 aa, Mycobacterium tuberculosis
AKTRAMQATAQ

SEQ ID NO: 50286 - protein, 11 aa, Mycobacterium tuberculosis
KTRAMQATAQA

SEQ ID NO: 50287 - protein, 11 aa, Mycobacterium tuberculosis
TRAMQATAQAA

SEQ ID NO: 50288 - protein, 11 aa, Mycobacterium tuberculosis
RAMQATAQAAA

SEQ ID NO: 50289 - protein, 11 aa, Mycobacterium tuberculosis
AMQATAQAAAY

SEQ ID NO: 50290 - protein, 11 aa, Mycobacterium tuberculosis
MQATAQAAAYT

SEQ ID NO: 50291 - protein, 11 aa, Mycobacterium tuberculosis
QATAQAAAYTQ

SEQ ID NO: 50292 - protein, 11 aa, Mycobacterium tuberculosis
ATAQAAAYTQA

SEQ ID NO: 50293 - protein, 11 aa, Mycobacterium tuberculosis
TAQAAAYTQAM

SEQ ID NO: 50294 - protein, 11 aa, Mycobacterium tuberculosis
AQAAAYTQAMA

SEQ ID NO: 50295 - protein, 11 aa, Mycobacterium tuberculosis
QAAAYTQAMAT

SEQ ID NO: 50296 - protein, 11 aa, Mycobacterium tuberculosis
AAAYTQAMATT

SEQ ID NO: 50297 - protein, 11 aa, Mycobacterium tuberculosis
AAYTQAMATTP

SEQ ID NO: 50298 - protein, 11 aa, Mycobacterium tuberculosis
AYTQAMATTPS

SEQ ID NO: 50299 - protein, 11 aa, Mycobacterium tuberculosis
YTQAMATTPSL

SEQ ID NO: 50300 - protein, 11 aa, Mycobacterium tuberculosis
TQAMATTPSLP

SEQ ID NO: 50301 - protein, 11 aa, Mycobacterium tuberculosis
QAMATTPSLPE

SEQ ID NO: 50302 - protein, 11 aa, Mycobacterium tuberculosis
AMATTPSLPEI

SEQ ID NO: 50303 - protein, 11 aa, Mycobacterium tuberculosis
MATTPSLPEIA

SEQ ID NO: 50304 - protein, 11 aa, Mycobacterium tuberculosis
ATTPSLPEIAA

SEQ ID NO: 50305 - protein, 11 aa, Mycobacterium tuberculosis
TTPSLPEIAAN

SEQ ID NO: 50306 - protein, 11 aa, Mycobacterium tuberculosis
TPSLPEIAANH

SEQ ID NO: 50307 - protein, 11 aa, Mycobacterium tuberculosis
PSLPEIAANHI

SEQ ID NO: 50308 - protein, 11 aa, Mycobacterium tuberculosis
SLPEIAANHIT

SEQ ID NO: 50309 - protein, 11 aa, Mycobacterium tuberculosis
LPEIAANHITQ

SEQ ID NO: 50310 - protein, 11 aa, Mycobacterium tuberculosis
PEIAANHITQA

SEQ ID NO: 50311 - protein, 11 aa, Mycobacterium tuberculosis
EIAANHITQAV

SEQ ID NO: 50312 - protein, 11 aa, Mycobacterium tuberculosis
IAANHITQAVL

SEQ ID NO: 50313 - protein, 11 aa, Mycobacterium tuberculosis
AANHITQAVLT

SEQ ID NO: 50314 - protein, 11 aa, Mycobacterium tuberculosis
ANHITQAVLTA

SEQ ID NO: 50315 - protein, 11 aa, Mycobacterium tuberculosis
NHITQAVLTAT

SEQ ID NO: 50316 - protein, 11 aa, Mycobacterium tuberculosis
HITQAVLTATN

SEQ ID NO: 50317 - protein, 11 aa, Mycobacterium tuberculosis
ITQAVLTATNF

SEQ ID NO: 50318 - protein, 11 aa, Mycobacterium tuberculosis
TQAVLTATNFF

SEQ ID NO: 50319 - protein, 11 aa, Mycobacterium tuberculosis
QAVLTATNFFG

SEQ ID NO: 50320 - protein, 11 aa, Mycobacterium tuberculosis
AVLTATNFFGI

SEQ ID NO: 50321 - protein, 11 aa, Mycobacterium tuberculosis
VLTATNFFGIN

SEQ ID NO: 50322 - protein, 11 aa, Mycobacterium tuberculosis
LTATNFFGINT

SEQ ID NO: 50323 - protein, 11 aa, Mycobacterium tuberculosis
TATNFFGINTI

SEQ ID NO: 50324 - protein, 11 aa, Mycobacterium tuberculosis
ATNFFGINTIP

SEQ ID NO: 50325 - protein, 11 aa, Mycobacterium tuberculosis
TNFFGINTIPI

SEQ ID NO: 50326 - protein, 11 aa, Mycobacterium tuberculosis
NFFGINTIPIA

SEQ ID NO: 50327 - protein, 11 aa, Mycobacterium tuberculosis
FFGINTIPIAL

SEQ ID NO: 50328 - protein, 11 aa, Mycobacterium tuberculosis
FGINTIPIALT

SEQ ID NO: 50329 - protein, 11 aa, Mycobacterium tuberculosis
GINTIPIALTE

SEQ ID NO: 50330 - protein, 11 aa, Mycobacterium tuberculosis
INTIPIALTEM

SEQ ID NO: 50331 - protein, 11 aa, Mycobacterium tuberculosis
NTIPIALTEMD

SEQ ID NO: 50332 - protein, 11 aa, Mycobacterium tuberculosis
TIPIALTEMDY

SEQ ID NO: 50333 - protein, 11 aa, Mycobacterium tuberculosis
IPIALTEMDYF

SEQ ID NO: 50334 - protein, 11 aa, Mycobacterium tuberculosis
PIALTEMDYFI

SEQ ID NO: 50335 - protein, 11 aa, Mycobacterium tuberculosis
IALTEMDYFIR

SEQ ID NO: 50336 - protein, 11 aa, Mycobacterium tuberculosis
ALTEMDYFIRM

SEQ ID NO: 50337 - protein, 11 aa, Mycobacterium tuberculosis
LTEMDYFIRMW

SEQ ID NO: 50338 - protein, 11 aa, Mycobacterium tuberculosis
TEMDYFIRMWN

SEQ ID NO: 50339 - protein, 11 aa, Mycobacterium tuberculosis
EMDYFIRMWNQ

SEQ ID NO: 50340 - protein, 11 aa, Mycobacterium tuberculosis
MDYFIRMWNQA

SEQ ID NO: 50341 - protein, 11 aa, Mycobacterium tuberculosis
DYFIRMWNQAA

SEQ ID NO: 50342 - protein, 11 aa, Mycobacterium tuberculosis
YFIRMWNQAAL

SEQ ID NO: 50343 - protein, 11 aa, Mycobacterium tuberculosis
FIRMWNQAALA

SEQ ID NO: 50344 - protein, 11 aa, Mycobacterium tuberculosis
IRMWNQAALAM

SEQ ID NO: 50345 - protein, 11 aa, Mycobacterium tuberculosis
RMWNQAALAME

SEQ ID NO: 50346 - protein, 11 aa, Mycobacterium tuberculosis
MWNQAALAMEV

SEQ ID NO: 50347 - protein, 11 aa, Mycobacterium tuberculosis
WNQAALAMEVY

SEQ ID NO: 50348 - protein, 11 aa, Mycobacterium tuberculosis
NQAALAMEVYQ

SEQ ID NO: 50349 - protein, 11 aa, Mycobacterium tuberculosis
QAALAMEVYQA

SEQ ID NO: 50350 - protein, 11 aa, Mycobacterium tuberculosis
AALAMEVYQAE

SEQ ID NO: 50351 - protein, 11 aa, Mycobacterium tuberculosis
ALAMEVYQAET

SEQ ID NO: 50352 - protein, 11 aa, Mycobacterium tuberculosis
LAMEVYQAETA

SEQ ID NO: 50353 - protein, 11 aa, Mycobacterium tuberculosis
AMEVYQAETAV

SEQ ID NO: 50354 - protein, 11 aa, Mycobacterium tuberculosis
MEVYQAETAVN

SEQ ID NO: 50355 - protein, 11 aa, Mycobacterium tuberculosis
EVYQAETAVNT

SEQ ID NO: 50356 - protein, 11 aa, Mycobacterium tuberculosis
VYQAETAVNTL

SEQ ID NO: 50357 - protein, 11 aa, Mycobacterium tuberculosis
YQAETAVNTLF

SEQ ID NO: 50358 - protein, 11 aa, Mycobacterium tuberculosis
QAETAVNTLFE

SEQ ID NO: 50359 - protein, 11 aa, Mycobacterium tuberculosis
AETAVNTLFEK

SEQ ID NO: 50360 - protein, 11 aa, Mycobacterium tuberculosis
ETAVNTLFEKL

SEQ ID NO: 50361 - protein, 11 aa, Mycobacterium tuberculosis
TAVNTLFEKLE

SEQ ID NO: 50362 - protein, 11 aa, Mycobacterium tuberculosis
AVNTLFEKLEP

SEQ ID NO: 50363 - protein, 11 aa, Mycobacterium tuberculosis
VNTLFEKLEPM

SEQ ID NO: 50364 - protein, 11 aa, Mycobacterium tuberculosis
NTLFEKLEPMA

SEQ ID NO: 50365 - protein, 11 aa, Mycobacterium tuberculosis
TLFEKLEPMAS

SEQ ID NO: 50366 - protein, 11 aa, Mycobacterium tuberculosis
LFEKLEPMASI

SEQ ID NO: 50367 - protein, 11 aa, Mycobacterium tuberculosis
FEKLEPMASIL

SEQ ID NO: 50368 - protein, 11 aa, Mycobacterium tuberculosis
EKLEPMASILD

SEQ ID NO: 50369 - protein, 11 aa, Mycobacterium tuberculosis
KLEPMASILDP

SEQ ID NO: 50370 - protein, 11 aa, Mycobacterium tuberculosis
LEPMASILDPG

SEQ ID NO: 50371 - protein, 11 aa, Mycobacterium tuberculosis
EPMASILDPGA

SEQ ID NO: 50372 - protein, 11 aa, Mycobacterium tuberculosis
PMASILDPGAS

SEQ ID NO: 50373 - protein, 11 aa, Mycobacterium tuberculosis
MASILDPGASQ

SEQ ID NO: 50374 - protein, 11 aa, Mycobacterium tuberculosis
ASILDPGASQS

SEQ ID NO: 50375 - protein, 11 aa, Mycobacterium tuberculosis
SILDPGASQST

SEQ ID NO: 50376 - protein, 11 aa, Mycobacterium tuberculosis
ILDPGASQSTT

SEQ ID NO: 50377 - protein, 11 aa, Mycobacterium tuberculosis
LDPGASQSTTN

SEQ ID NO: 50378 - protein, 11 aa, Mycobacterium tuberculosis
DPGASQSTTNP

SEQ ID NO: 50379 - protein, 11 aa, Mycobacterium tuberculosis
PGASQSTTNPI

SEQ ID NO: 50380 - protein, 11 aa, Mycobacterium tuberculosis
GASQSTTNPIF

SEQ ID NO: 50381 - protein, 11 aa, Mycobacterium tuberculosis
ASQSTTNPIFG

SEQ ID NO: 50382 - protein, 11 aa, Mycobacterium tuberculosis
SQSTTNPIFGM

SEQ ID NO: 50383 - protein, 11 aa, Mycobacterium tuberculosis
QSTTNPIFGMP

SEQ ID NO: 50384 - protein, 11 aa, Mycobacterium tuberculosis
STTNPIFGMPS

SEQ ID NO: 50385 - protein, 11 aa, Mycobacterium tuberculosis
TTNPIFGMPSP

SEQ ID NO: 50386 - protein, 11 aa, Mycobacterium tuberculosis
TNPIFGMPSPG

SEQ ID NO: 50387 - protein, 11 aa, Mycobacterium tuberculosis
NPIFGMPSPGS

SEQ ID NO: 50388 - protein, 11 aa, Mycobacterium tuberculosis
PIFGMPSPGSS

SEQ ID NO: 50389 - protein, 11 aa, Mycobacterium tuberculosis
IFGMPSPGSST

SEQ ID NO: 50390 - protein, 11 aa, Mycobacterium tuberculosis
FGMPSPGSSTP

SEQ ID NO: 50391 - protein, 11 aa, Mycobacterium tuberculosis
GMPSPGSSTPV

SEQ ID NO: 50392 - protein, 11 aa, Mycobacterium tuberculosis
MPSPGSSTPVG

SEQ ID NO: 50393 - protein, 11 aa, Mycobacterium tuberculosis
PSPGSSTPVGQ

SEQ ID NO: 50394 - protein, 11 aa, Mycobacterium tuberculosis
SPGSSTPVGQL

SEQ ID NO: 50395 - protein, 11 aa, Mycobacterium tuberculosis
PGSSTPVGQLP

SEQ ID NO: 50396 - protein, 11 aa, Mycobacterium tuberculosis
GSSTPVGQLPP

SEQ ID NO: 50397 - protein, 11 aa, Mycobacterium tuberculosis
SSTPVGQLPPA

SEQ ID NO: 50398 - protein, 11 aa, Mycobacterium tuberculosis
STPVGQLPPAA

SEQ ID NO: 50399 - protein, 11 aa, Mycobacterium tuberculosis
TPVGQLPPAAT

SEQ ID NO: 50400 - protein, 11 aa, Mycobacterium tuberculosis
PVGQLPPAATQ

SEQ ID NO: 50401 - protein, 11 aa, Mycobacterium tuberculosis
VGQLPPAATQT

SEQ ID NO: 50402 - protein, 11 aa, Mycobacterium tuberculosis
GQLPPAATQTL

SEQ ID NO: 50403 - protein, 11 aa, Mycobacterium tuberculosis
QLPPAATQTLG

SEQ ID NO: 50404 - protein, 11 aa, Mycobacterium tuberculosis
LPPAATQTLGQ

SEQ ID NO: 50405 - protein, 11 aa, Mycobacterium tuberculosis
PPAATQTLGQL

SEQ ID NO: 50406 - protein, 11 aa, Mycobacterium tuberculosis
PAATQTLGQLG

SEQ ID NO: 50407 - protein, 11 aa, Mycobacterium tuberculosis
AATQTLGQLGE

SEQ ID NO: 50408 - protein, 11 aa, Mycobacterium tuberculosis
ATQTLGQLGEM

SEQ ID NO: 50409 - protein, 11 aa, Mycobacterium tuberculosis
TQTLGQLGEMS

SEQ ID NO: 50410 - protein, 11 aa, Mycobacterium tuberculosis
QTLGQLGEMSG

SEQ ID NO: 50411 - protein, 11 aa, Mycobacterium tuberculosis
TLGQLGEMSGP

SEQ ID NO: 50412 - protein, 11 aa, Mycobacterium tuberculosis
LGQLGEMSGPM

SEQ ID NO: 50413 - protein, 11 aa, Mycobacterium tuberculosis
GQLGEMSGPMQ

SEQ ID NO: 50414 - protein, 11 aa, Mycobacterium tuberculosis
QLGEMSGPMQQ

SEQ ID NO: 50415 - protein, 11 aa, Mycobacterium tuberculosis
LGEMSGPMQQL

SEQ ID NO: 50416 - protein, 11 aa, Mycobacterium tuberculosis
GEMSGPMQQLT

SEQ ID NO: 50417 - protein, 11 aa, Mycobacterium tuberculosis
EMSGPMQQLTQ

SEQ ID NO: 50418 - protein, 11 aa, Mycobacterium tuberculosis
MSGPMQQLTQP

SEQ ID NO: 50419 - protein, 11 aa, Mycobacterium tuberculosis
SGPMQQLTQPL

SEQ ID NO: 50420 - protein, 11 aa, Mycobacterium tuberculosis
GPMQQLTQPLQ

SEQ ID NO: 50421 - protein, 11 aa, Mycobacterium tuberculosis
PMQQLTQPLQQ

SEQ ID NO: 50422 - protein, 11 aa, Mycobacterium tuberculosis
MQQLTQPLQQV

SEQ ID NO: 50423 - protein, 11 aa, Mycobacterium tuberculosis
QQLTQPLQQVT

SEQ ID NO: 50424 - protein, 11 aa, Mycobacterium tuberculosis
QLTQPLQQVTS

SEQ ID NO: 50425 - protein, 11 aa, Mycobacterium tuberculosis
LTQPLQQVTSL

SEQ ID NO: 50426 - protein, 11 aa, Mycobacterium tuberculosis
TQPLQQVTSLF

SEQ ID NO: 50427 - protein, 11 aa, Mycobacterium tuberculosis
QPLQQVTSLFS

SEQ ID NO: 50428 - protein, 11 aa, Mycobacterium tuberculosis
PLQQVTSLFSQ

SEQ ID NO: 50429 - protein, 11 aa, Mycobacterium tuberculosis
LQQVTSLFSQV

SEQ ID NO: 50430 - protein, 11 aa, Mycobacterium tuberculosis
QQVTSLFSQVG

SEQ ID NO: 50431 - protein, 11 aa, Mycobacterium tuberculosis
QVTSLFSQVGG

SEQ ID NO: 50432 - protein, 11 aa, Mycobacterium tuberculosis
VTSLFSQVGGT

SEQ ID NO: 50433 - protein, 11 aa, Mycobacterium tuberculosis
TSLFSQVGGTG

SEQ ID NO: 50434 - protein, 11 aa, Mycobacterium tuberculosis
SLFSQVGGTGG

SEQ ID NO: 50435 - protein, 11 aa, Mycobacterium tuberculosis
LFSQVGGTGGG

SEQ ID NO: 50436 - protein, 11 aa, Mycobacterium tuberculosis
FSQVGGTGGGN

SEQ ID NO: 50437 - protein, 11 aa, Mycobacterium tuberculosis
SQVGGTGGGNP

SEQ ID NO: 50438 - protein, 11 aa, Mycobacterium tuberculosis
QVGGTGGGNPA

SEQ ID NO: 50439 - protein, 11 aa, Mycobacterium tuberculosis
VGGTGGGNPAD

SEQ ID NO: 50440 - protein, 11 aa, Mycobacterium tuberculosis
GGTGGGNPADE

SEQ ID NO: 50441 - protein, 11 aa, Mycobacterium tuberculosis
GTGGGNPADEE

SEQ ID NO: 50442 - protein, 11 aa, Mycobacterium tuberculosis
TGGGNPADEEA

SEQ ID NO: 50443 - protein, 11 aa, Mycobacterium tuberculosis
GGGNPADEEAA

SEQ ID NO: 50444 - protein, 11 aa, Mycobacterium tuberculosis
GGNPADEEAAQ

SEQ ID NO: 50445 - protein, 11 aa, Mycobacterium tuberculosis
GNPADEEAAQM

SEQ ID NO: 50446 - protein, 11 aa, Mycobacterium tuberculosis
NPADEEAAQMG

SEQ ID NO: 50447 - protein, 11 aa, Mycobacterium tuberculosis
PADEEAAQMGL

SEQ ID NO: 50448 - protein, 11 aa, Mycobacterium tuberculosis
ADEEAAQMGLL

SEQ ID NO: 50449 - protein, 11 aa, Mycobacterium tuberculosis
DEEAAQMGLLG

SEQ ID NO: 50450 - protein, 11 aa, Mycobacterium tuberculosis
EEAAQMGLLGT

SEQ ID NO: 50451 - protein, 11 aa, Mycobacterium tuberculosis
EAAQMGLLGTS

SEQ ID NO: 50452 - protein, 11 aa, Mycobacterium tuberculosis
AAQMGLLGTSP

SEQ ID NO: 50453 - protein, 11 aa, Mycobacterium tuberculosis
AQMGLLGTSPL

SEQ ID NO: 50454 - protein, 11 aa, Mycobacterium tuberculosis
QMGLLGTSPLS

SEQ ID NO: 50455 - protein, 11 aa, Mycobacterium tuberculosis
MGLLGTSPLSN

SEQ ID NO: 50456 - protein, 11 aa, Mycobacterium tuberculosis
GLLGTSPLSNH

SEQ ID NO: 50457 - protein, 11 aa, Mycobacterium tuberculosis
LLGTSPLSNHP

SEQ ID NO: 50458 - protein, 11 aa, Mycobacterium tuberculosis
LGTSPLSNHPL

SEQ ID NO: 50459 - protein, 11 aa, Mycobacterium tuberculosis
GTSPLSNHPLA

SEQ ID NO: 50460 - protein, 11 aa, Mycobacterium tuberculosis
TSPLSNHPLAG

SEQ ID NO: 50461 - protein, 11 aa, Mycobacterium tuberculosis
SPLSNHPLAGG

SEQ ID NO: 50462 - protein, 11 aa, Mycobacterium tuberculosis
PLSNHPLAGGS

SEQ ID NO: 50463 - protein, 11 aa, Mycobacterium tuberculosis
LSNHPLAGGSG

SEQ ID NO: 50464 - protein, 11 aa, Mycobacterium tuberculosis
SNHPLAGGSGP

SEQ ID NO: 50465 - protein, 11 aa, Mycobacterium tuberculosis
NHPLAGGSGPS

SEQ ID NO: 50466 - protein, 11 aa, Mycobacterium tuberculosis
HPLAGGSGPSA

SEQ ID NO: 50467 - protein, 11 aa, Mycobacterium tuberculosis
PLAGGSGPSAG

SEQ ID NO: 50468 - protein, 11 aa, Mycobacterium tuberculosis
LAGGSGPSAGA

SEQ ID NO: 50469 - protein, 11 aa, Mycobacterium tuberculosis
AGGSGPSAGAG

SEQ ID NO: 50470 - protein, 11 aa, Mycobacterium tuberculosis
GGSGPSAGAGL

SEQ ID NO: 50471 - protein, 11 aa, Mycobacterium tuberculosis
GSGPSAGAGLL

SEQ ID NO: 50472 - protein, 11 aa, Mycobacterium tuberculosis
SGPSAGAGLLR

SEQ ID NO: 50473 - protein, 11 aa, Mycobacterium tuberculosis
GPSAGAGLLRA

SEQ ID NO: 50474 - protein, 11 aa, Mycobacterium tuberculosis
PSAGAGLLRAE

SEQ ID NO: 50475 - protein, 11 aa, Mycobacterium tuberculosis
SAGAGLLRAES

SEQ ID NO: 50476 - protein, 11 aa, Mycobacterium tuberculosis
AGAGLLRAESL

SEQ ID NO: 50477 - protein, 11 aa, Mycobacterium tuberculosis
GAGLLRAESLP

SEQ ID NO: 50478 - protein, 11 aa, Mycobacterium tuberculosis
AGLLRAESLPG

SEQ ID NO: 50479 - protein, 11 aa, Mycobacterium tuberculosis
GLLRAESLPGA

SEQ ID NO: 50480 - protein, 11 aa, Mycobacterium tuberculosis
LLRAESLPGAG

SEQ ID NO: 50481 - protein, 11 aa, Mycobacterium tuberculosis
LRAESLPGAGG

SEQ ID NO: 50482 - protein, 11 aa, Mycobacterium tuberculosis
RAESLPGAGGS

SEQ ID NO: 50483 - protein, 11 aa, Mycobacterium tuberculosis
AESLPGAGGSL

SEQ ID NO: 50484 - protein, 11 aa, Mycobacterium tuberculosis
ESLPGAGGSLT

SEQ ID NO: 50485 - protein, 11 aa, Mycobacterium tuberculosis
SLPGAGGSLTR

SEQ ID NO: 50486 - protein, 11 aa, Mycobacterium tuberculosis
LPGAGGSLTRT

SEQ ID NO: 50487 - protein, 11 aa, Mycobacterium tuberculosis
PGAGGSLTRTP

SEQ ID NO: 50488 - protein, 11 aa, Mycobacterium tuberculosis
GAGGSLTRTPL

SEQ ID NO: 50489 - protein, 11 aa, Mycobacterium tuberculosis
AGGSLTRTPLM

SEQ ID NO: 50490 - protein, 11 aa, Mycobacterium tuberculosis
GGSLTRTPLMS

SEQ ID NO: 50491 - protein, 11 aa, Mycobacterium tuberculosis
GSLTRTPLMSQ

SEQ ID NO: 50492 - protein, 11 aa, Mycobacterium tuberculosis
SLTRTPLMSQL

SEQ ID NO: 50493 - protein, 11 aa, Mycobacterium tuberculosis
LTRTPLMSQLI

SEQ ID NO: 50494 - protein, 11 aa, Mycobacterium tuberculosis
TRTPLMSQLIE

SEQ ID NO: 50495 - protein, 11 aa, Mycobacterium tuberculosis
RTPLMSQLIEK

SEQ ID NO: 50496 - protein, 11 aa, Mycobacterium tuberculosis
TPLMSQLIEKP

SEQ ID NO: 50497 - protein, 11 aa, Mycobacterium tuberculosis
PLMSQLIEKPV

SEQ ID NO: 50498 - protein, 11 aa, Mycobacterium tuberculosis
LMSQLIEKPVA

SEQ ID NO: 50499 - protein, 11 aa, Mycobacterium tuberculosis
MSQLIEKPVAP

SEQ ID NO: 50500 - protein, 11 aa, Mycobacterium tuberculosis
SQLIEKPVAPS

SEQ ID NO: 50501 - protein, 11 aa, Mycobacterium tuberculosis
QLIEKPVAPSV

SEQ ID NO: 50502 - protein, 11 aa, Mycobacterium tuberculosis
LIEKPVAPSVM

SEQ ID NO: 50503 - protein, 11 aa, Mycobacterium tuberculosis
IEKPVAPSVMP

SEQ ID NO: 50504 - protein, 11 aa, Mycobacterium tuberculosis
EKPVAPSVMPA

SEQ ID NO: 50505 - protein, 11 aa, Mycobacterium tuberculosis
KPVAPSVMPAA

SEQ ID NO: 50506 - protein, 11 aa, Mycobacterium tuberculosis
PVAPSVMPAAA

SEQ ID NO: 50507 - protein, 11 aa, Mycobacterium tuberculosis
VAPSVMPAAAA

SEQ ID NO: 50508 - protein, 11 aa, Mycobacterium tuberculosis
APSVMPAAAAG

SEQ ID NO: 50509 - protein, 11 aa, Mycobacterium tuberculosis
PSVMPAAAAGS

SEQ ID NO: 50510 - protein, 11 aa, Mycobacterium tuberculosis
SVMPAAAAGSS

SEQ ID NO: 50511 - protein, 11 aa, Mycobacterium tuberculosis
VMPAAAAGSSA

SEQ ID NO: 50512 - protein, 11 aa, Mycobacterium tuberculosis
MPAAAAGSSAT

SEQ ID NO: 50513 - protein, 11 aa, Mycobacterium tuberculosis
PAAAAGSSATG

SEQ ID NO: 50514 - protein, 11 aa, Mycobacterium tuberculosis
AAAAGSSATGG

SEQ ID NO: 50515 - protein, 11 aa, Mycobacterium tuberculosis
AAAGSSATGGA

SEQ ID NO: 50516 - protein, 11 aa, Mycobacterium tuberculosis
AAGSSATGGAA

SEQ ID NO: 50517 - protein, 11 aa, Mycobacterium tuberculosis
AGSSATGGAAP

SEQ ID NO: 50518 - protein, 11 aa, Mycobacterium tuberculosis
GSSATGGAAPV

SEQ ID NO: 50519 - protein, 11 aa, Mycobacterium tuberculosis
SSATGGAAPVG

SEQ ID NO: 50520 - protein, 11 aa, Mycobacterium tuberculosis
SATGGAAPVGA

SEQ ID NO: 50521 - protein, 11 aa, Mycobacterium tuberculosis
ATGGAAPVGAG

SEQ ID NO: 50522 - protein, 11 aa, Mycobacterium tuberculosis
TGGAAPVGAGA

SEQ ID NO: 50523 - protein, 11 aa, Mycobacterium tuberculosis
GGAAPVGAGAM

SEQ ID NO: 50524 - protein, 11 aa, Mycobacterium tuberculosis
GAAPVGAGAMG

SEQ ID NO: 50525 - protein, 11 aa, Mycobacterium tuberculosis
AAPVGAGAMGQ

SEQ ID NO: 50526 - protein, 11 aa, Mycobacterium tuberculosis
APVGAGAMGQG

SEQ ID NO: 50527 - protein, 11 aa, Mycobacterium tuberculosis
PVGAGAMGQGA

SEQ ID NO: 50528 - protein, 11 aa, Mycobacterium tuberculosis
VGAGAMGQGAQ

SEQ ID NO: 50529 - protein, 11 aa, Mycobacterium tuberculosis
GAGAMGQGAQS

SEQ ID NO: 50530 - protein, 11 aa, Mycobacterium tuberculosis
AGAMGQGAQSG

SEQ ID NO: 50531 - protein, 11 aa, Mycobacterium tuberculosis
GAMGQGAQSGG

SEQ ID NO: 50532 - protein, 11 aa, Mycobacterium tuberculosis
AMGQGAQSGGS

SEQ ID NO: 50533 - protein, 11 aa, Mycobacterium tuberculosis
MGQGAQSGGST

SEQ ID NO: 50534 - protein, 11 aa, Mycobacterium tuberculosis
GQGAQSGGSTR

SEQ ID NO: 50535 - protein, 11 aa, Mycobacterium tuberculosis
QGAQSGGSTRP

SEQ ID NO: 50536 - protein, 11 aa, Mycobacterium tuberculosis
GAQSGGSTRPG

SEQ ID NO: 50537 - protein, 11 aa, Mycobacterium tuberculosis
AQSGGSTRPGL

SEQ ID NO: 50538 - protein, 11 aa, Mycobacterium tuberculosis
QSGGSTRPGLV

SEQ ID NO: 50539 - protein, 11 aa, Mycobacterium tuberculosis
SGGSTRPGLVA

SEQ ID NO: 50540 - protein, 11 aa, Mycobacterium tuberculosis
GGSTRPGLVAP

SEQ ID NO: 50541 - protein, 11 aa, Mycobacterium tuberculosis
GSTRPGLVAPA

SEQ ID NO: 50542 - protein, 11 aa, Mycobacterium tuberculosis
STRPGLVAPAP

SEQ ID NO: 50543 - protein, 11 aa, Mycobacterium tuberculosis
TRPGLVAPAPL

SEQ ID NO: 50544 - protein, 11 aa, Mycobacterium tuberculosis
RPGLVAPAPLA

SEQ ID NO: 50545 - protein, 11 aa, Mycobacterium tuberculosis
PGLVAPAPLAQ

SEQ ID NO: 50546 - protein, 11 aa, Mycobacterium tuberculosis
GLVAPAPLAQE

SEQ ID NO: 50547 - protein, 11 aa, Mycobacterium tuberculosis
LVAPAPLAQER

SEQ ID NO: 50548 - protein, 11 aa, Mycobacterium tuberculosis
VAPAPLAQERE

SEQ ID NO: 50549 - protein, 11 aa, Mycobacterium tuberculosis
APAPLAQEREE

SEQ ID NO: 50550 - protein, 11 aa, Mycobacterium tuberculosis
PAPLAQEREED

SEQ ID NO: 50551 - protein, 11 aa, Mycobacterium tuberculosis
APLAQEREEDD

SEQ ID NO: 50552 - protein, 11 aa, Mycobacterium tuberculosis
PLAQEREEDDE

SEQ ID NO: 50553 - protein, 11 aa, Mycobacterium tuberculosis
LAQEREEDDED

SEQ ID NO: 50554 - protein, 11 aa, Mycobacterium tuberculosis
AQEREEDDEDD

SEQ ID NO: 50555 - protein, 11 aa, Mycobacterium tuberculosis
QEREEDDEDDW

SEQ ID NO: 50556 - protein, 11 aa, Mycobacterium tuberculosis
EREEDDEDDWD

SEQ ID NO: 50557 - protein, 11 aa, Mycobacterium tuberculosis
REEDDEDDWDE

SEQ ID NO: 50558 - protein, 11 aa, Mycobacterium tuberculosis
EEDDEDDWDEE

SEQ ID NO: 50559 - protein, 11 aa, Mycobacterium tuberculosis
EDDEDDWDEED

SEQ ID NO: 50560 - protein, 11 aa, Mycobacterium tuberculosis
DDEDDWDEEDD

SEQ ID NO: 50561 - protein, 11 aa, Mycobacterium tuberculosis
DEDDWDEEDDW

SEQ ID NO: 50562 - protein, 8 aa, Mycobacterium tuberculosis
MAEMKTDA

SEQ ID NO: 50563 - protein, 8 aa, Mycobacterium tuberculosis
AEMKTDAA

SEQ ID NO: 50564 - protein, 8 aa, Mycobacterium tuberculosis
EMKTDAAT

SEQ ID NO: 50565 - protein, 8 aa, Mycobacterium tuberculosis
MKTDAATL

SEQ ID NO: 50566 - protein, 8 aa, Mycobacterium tuberculosis
KTDAATLA

SEQ ID NO: 50567 - protein, 8 aa, Mycobacterium tuberculosis
TDAATLAQ

SEQ ID NO: 50568 - protein, 8 aa, Mycobacterium tuberculosis
DAATLAQE

SEQ ID NO: 50569 - protein, 8 aa, Mycobacterium tuberculosis
AATLAQEA

SEQ ID NO: 50570 - protein, 8 aa, Mycobacterium tuberculosis
ATLAQEAG

SEQ ID NO: 50571 - protein, 8 aa, Mycobacterium tuberculosis
TLAQEAGN

SEQ ID NO: 50572 - protein, 8 aa, Mycobacterium tuberculosis
LAQEAGNF

SEQ ID NO: 50573 - protein, 8 aa, Mycobacterium tuberculosis
AQEAGNFE

SEQ ID NO: 50574 - protein, 8 aa, Mycobacterium tuberculosis
QEAGNFER

SEQ ID NO: 50575 - protein, 8 aa, Mycobacterium tuberculosis
EAGNFERI

SEQ ID NO: 50576 - protein, 8 aa, Mycobacterium tuberculosis
AGNFERIS

SEQ ID NO: 50577 - protein, 8 aa, Mycobacterium tuberculosis
GNFERISG

SEQ ID NO: 50578 - protein, 8 aa, Mycobacterium tuberculosis
NFERISGD

SEQ ID NO: 50579 - protein, 8 aa, Mycobacterium tuberculosis
FERISGDL

SEQ ID NO: 50580 - protein, 8 aa, Mycobacterium tuberculosis
ERISGDLK

SEQ ID NO: 50581 - protein, 8 aa, Mycobacterium tuberculosis
RISGDLKT

SEQ ID NO: 50582 - protein, 8 aa, Mycobacterium tuberculosis
ISGDLKTQ

SEQ ID NO: 50583 - protein, 8 aa, Mycobacterium tuberculosis
SGDLKTQI

SEQ ID NO: 50584 - protein, 8 aa, Mycobacterium tuberculosis
GDLKTQID

SEQ ID NO: 50585 - protein, 8 aa, Mycobacterium tuberculosis
DLKTQIDQ

SEQ ID NO: 50586 - protein, 8 aa, Mycobacterium tuberculosis
LKTQIDQV

SEQ ID NO: 50587 - protein, 8 aa, Mycobacterium tuberculosis
KTQIDQVE

SEQ ID NO: 50588 - protein, 8 aa, Mycobacterium tuberculosis
TQIDQVES

SEQ ID NO: 50589 - protein, 8 aa, Mycobacterium tuberculosis
QIDQVEST

SEQ ID NO: 50590 - protein, 8 aa, Mycobacterium tuberculosis
IDQVESTA

SEQ ID NO: 50591 - protein, 8 aa, Mycobacterium tuberculosis
DQVESTAG

SEQ ID NO: 50592 - protein, 8 aa, Mycobacterium tuberculosis
QVESTAGS

SEQ ID NO: 50593 - protein, 8 aa, Mycobacterium tuberculosis
VESTAGSL

SEQ ID NO: 50594 - protein, 8 aa, Mycobacterium tuberculosis
ESTAGSLQ

SEQ ID NO: 50595 - protein, 8 aa, Mycobacterium tuberculosis
STAGSLQG

SEQ ID NO: 50596 - protein, 8 aa, Mycobacterium tuberculosis
TAGSLQGQ

SEQ ID NO: 50597 - protein, 8 aa, Mycobacterium tuberculosis
AGSLQGQW

SEQ ID NO: 50598 - protein, 8 aa, Mycobacterium tuberculosis
GSLQGQWR

SEQ ID NO: 50599 - protein, 8 aa, Mycobacterium tuberculosis
SLQGQWRG

SEQ ID NO: 50600 - protein, 8 aa, Mycobacterium tuberculosis
LQGQWRGA

SEQ ID NO: 50601 - protein, 8 aa, Mycobacterium tuberculosis
QGQWRGAA

SEQ ID NO: 50602 - protein, 8 aa, Mycobacterium tuberculosis
GQWRGAAG

SEQ ID NO: 50603 - protein, 8 aa, Mycobacterium tuberculosis
QWRGAAGT

SEQ ID NO: 50604 - protein, 8 aa, Mycobacterium tuberculosis
WRGAAGTA

SEQ ID NO: 50605 - protein, 8 aa, Mycobacterium tuberculosis
RGAAGTAA

SEQ ID NO: 50606 - protein, 8 aa, Mycobacterium tuberculosis
GAAGTAAQ

SEQ ID NO: 50607 - protein, 8 aa, Mycobacterium tuberculosis
AAGTAAQA

SEQ ID NO: 50608 - protein, 8 aa, Mycobacterium tuberculosis
AGTAAQAA

SEQ ID NO: 50609 - protein, 8 aa, Mycobacterium tuberculosis
GTAAQAAV

SEQ ID NO: 50610 - protein, 8 aa, Mycobacterium tuberculosis
TAAQAAVV

SEQ ID NO: 50611 - protein, 8 aa, Mycobacterium tuberculosis
AAQAAVVR

SEQ ID NO: 50612 - protein, 8 aa, Mycobacterium tuberculosis
AQAAVVRF

SEQ ID NO: 50613 - protein, 8 aa, Mycobacterium tuberculosis
QAAVVRFQ

SEQ ID NO: 50614 - protein, 8 aa, Mycobacterium tuberculosis
AAVVRFQE

SEQ ID NO: 50615 - protein, 8 aa, Mycobacterium tuberculosis
AVVRFQEA

SEQ ID NO: 50616 - protein, 8 aa, Mycobacterium tuberculosis
VVRFQEAA

SEQ ID NO: 50617 - protein, 8 aa, Mycobacterium tuberculosis
VRFQEAAN

SEQ ID NO: 50618 - protein, 8 aa, Mycobacterium tuberculosis
RFQEAANK

SEQ ID NO: 50619 - protein, 8 aa, Mycobacterium tuberculosis
FQEAANKQ

SEQ ID NO: 50620 - protein, 8 aa, Mycobacterium tuberculosis
QEAANKQK

SEQ ID NO: 50621 - protein, 8 aa, Mycobacterium tuberculosis
EAANKQKQ

SEQ ID NO: 50622 - protein, 8 aa, Mycobacterium tuberculosis
AANKQKQE

SEQ ID NO: 50623 - protein, 8 aa, Mycobacterium tuberculosis
ANKQKQEL

SEQ ID NO: 50624 - protein, 8 aa, Mycobacterium tuberculosis
NKQKQELD

SEQ ID NO: 50625 - protein, 8 aa, Mycobacterium tuberculosis
KQKQELDE

SEQ ID NO: 50626 - protein, 8 aa, Mycobacterium tuberculosis
QKQELDEI

SEQ ID NO: 50627 - protein, 8 aa, Mycobacterium tuberculosis
KQELDEIS

SEQ ID NO: 50628 - protein, 8 aa, Mycobacterium tuberculosis
QELDEIST

SEQ ID NO: 50629 - protein, 8 aa, Mycobacterium tuberculosis
ELDEISTN

SEQ ID NO: 50630 - protein, 8 aa, Mycobacterium tuberculosis
LDEISTNI

SEQ ID NO: 50631 - protein, 8 aa, Mycobacterium tuberculosis
DEISTNIR

SEQ ID NO: 50632 - protein, 8 aa, Mycobacterium tuberculosis
EISTNIRQ

SEQ ID NO: 50633 - protein, 8 aa, Mycobacterium tuberculosis
ISTNIRQA

SEQ ID NO: 50634 - protein, 8 aa, Mycobacterium tuberculosis
STNIRQAG

SEQ ID NO: 50635 - protein, 8 aa, Mycobacterium tuberculosis
TNIRQAGV

SEQ ID NO: 50636 - protein, 8 aa, Mycobacterium tuberculosis
NIRQAGVQ

SEQ ID NO: 50637 - protein, 8 aa, Mycobacterium tuberculosis
IRQAGVQY

SEQ ID NO: 50638 - protein, 8 aa, Mycobacterium tuberculosis
RQAGVQYS

SEQ ID NO: 50639 - protein, 8 aa, Mycobacterium tuberculosis
QAGVQYSR

SEQ ID NO: 50640 - protein, 8 aa, Mycobacterium tuberculosis
AGVQYSRA

SEQ ID NO: 50641 - protein, 8 aa, Mycobacterium tuberculosis
GVQYSRAD

SEQ ID NO: 50642 - protein, 8 aa, Mycobacterium tuberculosis
VQYSRADE

SEQ ID NO: 50643 - protein, 8 aa, Mycobacterium tuberculosis
QYSRADEE

SEQ ID NO: 50644 - protein, 8 aa, Mycobacterium tuberculosis
YSRADEEQ

SEQ ID NO: 50645 - protein, 8 aa, Mycobacterium tuberculosis
SRADEEQQ

SEQ ID NO: 50646 - protein, 8 aa, Mycobacterium tuberculosis
RADEEQQQ

SEQ ID NO: 50647 - protein, 8 aa, Mycobacterium tuberculosis
ADEEQQQA

SEQ ID NO: 50648 - protein, 8 aa, Mycobacterium tuberculosis
DEEQQQAL

SEQ ID NO: 50649 - protein, 8 aa, Mycobacterium tuberculosis
EEQQQALS

SEQ ID NO: 50650 - protein, 8 aa, Mycobacterium tuberculosis
EQQQALSS

SEQ ID NO: 50651 - protein, 8 aa, Mycobacterium tuberculosis
QQQALSSQ

SEQ ID NO: 50652 - protein, 8 aa, Mycobacterium tuberculosis
QQALSSQM

SEQ ID NO: 50653 - protein, 8 aa, Mycobacterium tuberculosis
QALSSQMG

SEQ ID NO: 50654 - protein, 8 aa, Mycobacterium tuberculosis
ALSSQMGF

SEQ ID NO: 50655 - protein, 9 aa, Mycobacterium tuberculosis
MAEMKTDAA

SEQ ID NO: 50656 - protein, 9 aa, Mycobacterium tuberculosis
AEMKTDAAT

SEQ ID NO: 50657 - protein, 9 aa, Mycobacterium tuberculosis
EMKTDAATL

SEQ ID NO: 50658 - protein, 9 aa, Mycobacterium tuberculosis
MKTDAATLA

SEQ ID NO: 50659 - protein, 9 aa, Mycobacterium tuberculosis
KTDAATLAQ

SEQ ID NO: 50660 - protein, 9 aa, Mycobacterium tuberculosis
TDAATLAQE

SEQ ID NO: 50661 - protein, 9 aa, Mycobacterium tuberculosis
DAATLAQEA

SEQ ID NO: 50662 - protein, 9 aa, Mycobacterium tuberculosis
AATLAQEAG

SEQ ID NO: 50663 - protein, 9 aa, Mycobacterium tuberculosis
ATLAQEAGN

SEQ ID NO: 50664 - protein, 9 aa, Mycobacterium tuberculosis
TLAQEAGNF

SEQ ID NO: 50665 - protein, 9 aa, Mycobacterium tuberculosis
LAQEAGNFE

SEQ ID NO: 50666 - protein, 9 aa, Mycobacterium tuberculosis
AQEAGNFER

SEQ ID NO: 50667 - protein, 9 aa, Mycobacterium tuberculosis
QEAGNFERI

SEQ ID NO: 50668 - protein, 9 aa, Mycobacterium tuberculosis
EAGNFERIS

SEQ ID NO: 50669 - protein, 9 aa, Mycobacterium tuberculosis
AGNFERISG

SEQ ID NO: 50670 - protein, 9 aa, Mycobacterium tuberculosis
GNFERISGD

SEQ ID NO: 50671 - protein, 9 aa, Mycobacterium tuberculosis
NFERISGDL

SEQ ID NO: 50672 - protein, 9 aa, Mycobacterium tuberculosis
FERISGDLK

SEQ ID NO: 50673 - protein, 9 aa, Mycobacterium tuberculosis
ERISGDLKT

SEQ ID NO: 50674 - protein, 9 aa, Mycobacterium tuberculosis
RISGDLKTQ

SEQ ID NO: 50675 - protein, 9 aa, Mycobacterium tuberculosis
ISGDLKTQI

SEQ ID NO: 50676 - protein, 9 aa, Mycobacterium tuberculosis
SGDLKTQID

SEQ ID NO: 50677 - protein, 9 aa, Mycobacterium tuberculosis
GDLKTQIDQ

SEQ ID NO: 50678 - protein, 9 aa, Mycobacterium tuberculosis
DLKTQIDQV

SEQ ID NO: 50679 - protein, 9 aa, Mycobacterium tuberculosis
LKTQIDQVE

SEQ ID NO: 50680 - protein, 9 aa, Mycobacterium tuberculosis
KTQIDQVES

SEQ ID NO: 50681 - protein, 9 aa, Mycobacterium tuberculosis
TQIDQVEST

SEQ ID NO: 50682 - protein, 9 aa, Mycobacterium tuberculosis
QIDQVESTA

SEQ ID NO: 50683 - protein, 9 aa, Mycobacterium tuberculosis
IDQVESTAG

SEQ ID NO: 50684 - protein, 9 aa, Mycobacterium tuberculosis
DQVESTAGS

SEQ ID NO: 50685 - protein, 9 aa, Mycobacterium tuberculosis
QVESTAGSL

SEQ ID NO: 50686 - protein, 9 aa, Mycobacterium tuberculosis
VESTAGSLQ

SEQ ID NO: 50687 - protein, 9 aa, Mycobacterium tuberculosis
ESTAGSLQG

SEQ ID NO: 50688 - protein, 9 aa, Mycobacterium tuberculosis
STAGSLQGQ

SEQ ID NO: 50689 - protein, 9 aa, Mycobacterium tuberculosis
TAGSLQGQW

SEQ ID NO: 50690 - protein, 9 aa, Mycobacterium tuberculosis
AGSLQGQWR

SEQ ID NO: 50691 - protein, 9 aa, Mycobacterium tuberculosis
GSLQGQWRG

SEQ ID NO: 50692 - protein, 9 aa, Mycobacterium tuberculosis
SLQGQWRGA

SEQ ID NO: 50693 - protein, 9 aa, Mycobacterium tuberculosis
LQGQWRGAA

SEQ ID NO: 50694 - protein, 9 aa, Mycobacterium tuberculosis
QGQWRGAAG

SEQ ID NO: 50695 - protein, 9 aa, Mycobacterium tuberculosis
GQWRGAAGT

SEQ ID NO: 50696 - protein, 9 aa, Mycobacterium tuberculosis
QWRGAAGTA

SEQ ID NO: 50697 - protein, 9 aa, Mycobacterium tuberculosis
WRGAAGTAA

SEQ ID NO: 50698 - protein, 9 aa, Mycobacterium tuberculosis
RGAAGTAAQ

SEQ ID NO: 50699 - protein, 9 aa, Mycobacterium tuberculosis
GAAGTAAQA

SEQ ID NO: 50700 - protein, 9 aa, Mycobacterium tuberculosis
AAGTAAQAA

SEQ ID NO: 50701 - protein, 9 aa, Mycobacterium tuberculosis
AGTAAQAAV

SEQ ID NO: 50702 - protein, 9 aa, Mycobacterium tuberculosis
GTAAQAAVV

SEQ ID NO: 50703 - protein, 9 aa, Mycobacterium tuberculosis
TAAQAAVVR

SEQ ID NO: 50704 - protein, 9 aa, Mycobacterium tuberculosis
AAQAAVVRF

SEQ ID NO: 50705 - protein, 9 aa, Mycobacterium tuberculosis
AQAAVVRFQ

SEQ ID NO: 50706 - protein, 9 aa, Mycobacterium tuberculosis
QAAVVRFQE

SEQ ID NO: 50707 - protein, 9 aa, Mycobacterium tuberculosis
AAVVRFQEA

SEQ ID NO: 50708 - protein, 9 aa, Mycobacterium tuberculosis
AVVRFQEAA

SEQ ID NO: 50709 - protein, 9 aa, Mycobacterium tuberculosis
VVRFQEAAN

SEQ ID NO: 50710 - protein, 9 aa, Mycobacterium tuberculosis
VRFQEAANK

SEQ ID NO: 50711 - protein, 9 aa, Mycobacterium tuberculosis
RFQEAANKQ

SEQ ID NO: 50712 - protein, 9 aa, Mycobacterium tuberculosis
FQEAANKQK

SEQ ID NO: 50713 - protein, 9 aa, Mycobacterium tuberculosis
QEAANKQKQ

SEQ ID NO: 50714 - protein, 9 aa, Mycobacterium tuberculosis
EAANKQKQE

SEQ ID NO: 50715 - protein, 9 aa, Mycobacterium tuberculosis
AANKQKQEL

SEQ ID NO: 50716 - protein, 9 aa, Mycobacterium tuberculosis
ANKQKQELD

SEQ ID NO: 50717 - protein, 9 aa, Mycobacterium tuberculosis
NKQKQELDE

SEQ ID NO: 50718 - protein, 9 aa, Mycobacterium tuberculosis
KQKQELDEI

SEQ ID NO: 50719 - protein, 9 aa, Mycobacterium tuberculosis
QKQELDEIS

SEQ ID NO: 50720 - protein, 9 aa, Mycobacterium tuberculosis
KQELDEIST

SEQ ID NO: 50721 - protein, 9 aa, Mycobacterium tuberculosis
QELDEISTN

SEQ ID NO: 50722 - protein, 9 aa, Mycobacterium tuberculosis
ELDEISTNI

SEQ ID NO: 50723 - protein, 9 aa, Mycobacterium tuberculosis
LDEISTNIR

SEQ ID NO: 50724 - protein, 9 aa, Mycobacterium tuberculosis
DEISTNIRQ

SEQ ID NO: 50725 - protein, 9 aa, Mycobacterium tuberculosis
EISTNIRQA

SEQ ID NO: 50726 - protein, 9 aa, Mycobacterium tuberculosis
ISTNIRQAG

SEQ ID NO: 50727 - protein, 9 aa, Mycobacterium tuberculosis
STNIRQAGV

SEQ ID NO: 50728 - protein, 9 aa, Mycobacterium tuberculosis
TNIRQAGVQ

SEQ ID NO: 50729 - protein, 9 aa, Mycobacterium tuberculosis
NIRQAGVQY

SEQ ID NO: 50730 - protein, 9 aa, Mycobacterium tuberculosis
IRQAGVQYS

SEQ ID NO: 50731 - protein, 9 aa, Mycobacterium tuberculosis
RQAGVQYSR

SEQ ID NO: 50732 - protein, 9 aa, Mycobacterium tuberculosis
QAGVQYSRA

SEQ ID NO: 50733 - protein, 9 aa, Mycobacterium tuberculosis
AGVQYSRAD

SEQ ID NO: 50734 - protein, 9 aa, Mycobacterium tuberculosis
GVQYSRADE

SEQ ID NO: 50735 - protein, 9 aa, Mycobacterium tuberculosis
VQYSRADEE

SEQ ID NO: 50736 - protein, 9 aa, Mycobacterium tuberculosis
QYSRADEEQ

SEQ ID NO: 50737 - protein, 9 aa, Mycobacterium tuberculosis
YSRADEEQQ

SEQ ID NO: 50738 - protein, 9 aa, Mycobacterium tuberculosis
SRADEEQQQ

SEQ ID NO: 50739 - protein, 9 aa, Mycobacterium tuberculosis
RADEEQQQA

SEQ ID NO: 50740 - protein, 9 aa, Mycobacterium tuberculosis
ADEEQQQAL

SEQ ID NO: 50741 - protein, 9 aa, Mycobacterium tuberculosis
DEEQQQALS

SEQ ID NO: 50742 - protein, 9 aa, Mycobacterium tuberculosis
EEQQQALSS

SEQ ID NO: 50743 - protein, 9 aa, Mycobacterium tuberculosis
EQQQALSSQ

SEQ ID NO: 50744 - protein, 9 aa, Mycobacterium tuberculosis
QQQALSSQM

SEQ ID NO: 50745 - protein, 9 aa, Mycobacterium tuberculosis
QQALSSQMG

SEQ ID NO: 50746 - protein, 9 aa, Mycobacterium tuberculosis
QALSSQMGF

SEQ ID NO: 50747 - protein, 10 aa, Mycobacterium tuberculosis
MAEMKTDAAT

SEQ ID NO: 50748 - protein, 10 aa, Mycobacterium tuberculosis
AEMKTDAATL

SEQ ID NO: 50749 - protein, 10 aa, Mycobacterium tuberculosis
EMKTDAATLA

SEQ ID NO: 50750 - protein, 10 aa, Mycobacterium tuberculosis
MKTDAATLAQ

SEQ ID NO: 50751 - protein, 10 aa, Mycobacterium tuberculosis
KTDAATLAQE

SEQ ID NO: 50752 - protein, 10 aa, Mycobacterium tuberculosis
TDAATLAQEA

SEQ ID NO: 50753 - protein, 10 aa, Mycobacterium tuberculosis
DAATLAQEAG

SEQ ID NO: 50754 - protein, 10 aa, Mycobacterium tuberculosis
AATLAQEAGN

SEQ ID NO: 50755 - protein, 10 aa, Mycobacterium tuberculosis
ATLAQEAGNF

SEQ ID NO: 50756 - protein, 10 aa, Mycobacterium tuberculosis
TLAQEAGNFE

SEQ ID NO: 50757 - protein, 10 aa, Mycobacterium tuberculosis
LAQEAGNFER

SEQ ID NO: 50758 - protein, 10 aa, Mycobacterium tuberculosis
AQEAGNFERI

SEQ ID NO: 50759 - protein, 10 aa, Mycobacterium tuberculosis
QEAGNFERIS

SEQ ID NO: 50760 - protein, 10 aa, Mycobacterium tuberculosis
EAGNFERISG

SEQ ID NO: 50761 - protein, 10 aa, Mycobacterium tuberculosis
AGNFERISGD

SEQ ID NO: 50762 - protein, 10 aa, Mycobacterium tuberculosis
GNFERISGDL

SEQ ID NO: 50763 - protein, 10 aa, Mycobacterium tuberculosis
NFERISGDLK

SEQ ID NO: 50764 - protein, 10 aa, Mycobacterium tuberculosis
FERISGDLKT

SEQ ID NO: 50765 - protein, 10 aa, Mycobacterium tuberculosis
ERISGDLKTQ

SEQ ID NO: 50766 - protein, 10 aa, Mycobacterium tuberculosis
RISGDLKTQI

SEQ ID NO: 50767 - protein, 10 aa, Mycobacterium tuberculosis
ISGDLKTQID

SEQ ID NO: 50768 - protein, 10 aa, Mycobacterium tuberculosis
SGDLKTQIDQ

SEQ ID NO: 50769 - protein, 10 aa, Mycobacterium tuberculosis
GDLKTQIDQV

SEQ ID NO: 50770 - protein, 10 aa, Mycobacterium tuberculosis
DLKTQIDQVE

SEQ ID NO: 50771 - protein, 10 aa, Mycobacterium tuberculosis
LKTQIDQVES

SEQ ID NO: 50772 - protein, 10 aa, Mycobacterium tuberculosis
KTQIDQVEST

SEQ ID NO: 50773 - protein, 10 aa, Mycobacterium tuberculosis
TQIDQVESTA

SEQ ID NO: 50774 - protein, 10 aa, Mycobacterium tuberculosis
QIDQVESTAG

SEQ ID NO: 50775 - protein, 10 aa, Mycobacterium tuberculosis
IDQVESTAGS

SEQ ID NO: 50776 - protein, 10 aa, Mycobacterium tuberculosis
DQVESTAGSL

SEQ ID NO: 50777 - protein, 10 aa, Mycobacterium tuberculosis
QVESTAGSLQ

SEQ ID NO: 50778 - protein, 10 aa, Mycobacterium tuberculosis
VESTAGSLQG

SEQ ID NO: 50779 - protein, 10 aa, Mycobacterium tuberculosis
ESTAGSLQGQ

SEQ ID NO: 50780 - protein, 10 aa, Mycobacterium tuberculosis
STAGSLQGQW

SEQ ID NO: 50781 - protein, 10 aa, Mycobacterium tuberculosis
TAGSLQGQWR

SEQ ID NO: 50782 - protein, 10 aa, Mycobacterium tuberculosis
AGSLQGQWRG

SEQ ID NO: 50783 - protein, 10 aa, Mycobacterium tuberculosis
GSLQGQWRGA

SEQ ID NO: 50784 - protein, 10 aa, Mycobacterium tuberculosis
SLQGQWRGAA

SEQ ID NO: 50785 - protein, 10 aa, Mycobacterium tuberculosis
LQGQWRGAAG

SEQ ID NO: 50786 - protein, 10 aa, Mycobacterium tuberculosis
QGQWRGAAGT

SEQ ID NO: 50787 - protein, 10 aa, Mycobacterium tuberculosis
GQWRGAAGTA

SEQ ID NO: 50788 - protein, 10 aa, Mycobacterium tuberculosis
QWRGAAGTAA

SEQ ID NO: 50789 - protein, 10 aa, Mycobacterium tuberculosis
WRGAAGTAAQ

SEQ ID NO: 50790 - protein, 10 aa, Mycobacterium tuberculosis
RGAAGTAAQA

SEQ ID NO: 50791 - protein, 10 aa, Mycobacterium tuberculosis
GAAGTAAQAA

SEQ ID NO: 50792 - protein, 10 aa, Mycobacterium tuberculosis
AAGTAAQAAV

SEQ ID NO: 50793 - protein, 10 aa, Mycobacterium tuberculosis
AGTAAQAAVV

SEQ ID NO: 50794 - protein, 10 aa, Mycobacterium tuberculosis
GTAAQAAVVR

SEQ ID NO: 50795 - protein, 10 aa, Mycobacterium tuberculosis
TAAQAAVVRF

SEQ ID NO: 50796 - protein, 10 aa, Mycobacterium tuberculosis
AAQAAVVRFQ

SEQ ID NO: 50797 - protein, 10 aa, Mycobacterium tuberculosis
AQAAVVRFQE

SEQ ID NO: 50798 - protein, 10 aa, Mycobacterium tuberculosis
QAAVVRFQEA

SEQ ID NO: 50799 - protein, 10 aa, Mycobacterium tuberculosis
AAVVRFQEAA

SEQ ID NO: 50800 - protein, 10 aa, Mycobacterium tuberculosis
AVVRFQEAAN

SEQ ID NO: 50801 - protein, 10 aa, Mycobacterium tuberculosis
VVRFQEAANK

SEQ ID NO: 50802 - protein, 10 aa, Mycobacterium tuberculosis
VRFQEAANKQ

SEQ ID NO: 50803 - protein, 10 aa, Mycobacterium tuberculosis
RFQEAANKQK

SEQ ID NO: 50804 - protein, 10 aa, Mycobacterium tuberculosis
FQEAANKQKQ

SEQ ID NO: 50805 - protein, 10 aa, Mycobacterium tuberculosis
QEAANKQKQE

SEQ ID NO: 50806 - protein, 10 aa, Mycobacterium tuberculosis
EAANKQKQEL

SEQ ID NO: 50807 - protein, 10 aa, Mycobacterium tuberculosis
AANKQKQELD

SEQ ID NO: 50808 - protein, 10 aa, Mycobacterium tuberculosis
ANKQKQELDE

SEQ ID NO: 50809 - protein, 10 aa, Mycobacterium tuberculosis
NKQKQELDEI

SEQ ID NO: 50810 - protein, 10 aa, Mycobacterium tuberculosis
KQKQELDEIS

SEQ ID NO: 50811 - protein, 10 aa, Mycobacterium tuberculosis
QKQELDEIST

SEQ ID NO: 50812 - protein, 10 aa, Mycobacterium tuberculosis
KQELDEISTN

SEQ ID NO: 50813 - protein, 10 aa, Mycobacterium tuberculosis
QELDEISTNI

SEQ ID NO: 50814 - protein, 10 aa, Mycobacterium tuberculosis
ELDEISTNIR

SEQ ID NO: 50815 - protein, 10 aa, Mycobacterium tuberculosis
LDEISTNIRQ

SEQ ID NO: 50816 - protein, 10 aa, Mycobacterium tuberculosis
DEISTNIRQA

SEQ ID NO: 50817 - protein, 10 aa, Mycobacterium tuberculosis
EISTNIRQAG

SEQ ID NO: 50818 - protein, 10 aa, Mycobacterium tuberculosis
ISTNIRQAGV

SEQ ID NO: 50819 - protein, 10 aa, Mycobacterium tuberculosis
STNIRQAGVQ

SEQ ID NO: 50820 - protein, 10 aa, Mycobacterium tuberculosis
TNIRQAGVQY

SEQ ID NO: 50821 - protein, 10 aa, Mycobacterium tuberculosis
NIRQAGVQYS

SEQ ID NO: 50822 - protein, 10 aa, Mycobacterium tuberculosis
IRQAGVQYSR

SEQ ID NO: 50823 - protein, 10 aa, Mycobacterium tuberculosis
RQAGVQYSRA

SEQ ID NO: 50824 - protein, 10 aa, Mycobacterium tuberculosis
QAGVQYSRAD

SEQ ID NO: 50825 - protein, 10 aa, Mycobacterium tuberculosis
AGVQYSRADE

SEQ ID NO: 50826 - protein, 10 aa, Mycobacterium tuberculosis
GVQYSRADEE

SEQ ID NO: 50827 - protein, 10 aa, Mycobacterium tuberculosis
VQYSRADEEQ

SEQ ID NO: 50828 - protein, 10 aa, Mycobacterium tuberculosis
QYSRADEEQQ

SEQ ID NO: 50829 - protein, 10 aa, Mycobacterium tuberculosis
YSRADEEQQQ

SEQ ID NO: 50830 - protein, 10 aa, Mycobacterium tuberculosis
SRADEEQQQA

SEQ ID NO: 50831 - protein, 10 aa, Mycobacterium tuberculosis
RADEEQQQAL

SEQ ID NO: 50832 - protein, 10 aa, Mycobacterium tuberculosis
ADEEQQQALS

SEQ ID NO: 50833 - protein, 10 aa, Mycobacterium tuberculosis
DEEQQQALSS

SEQ ID NO: 50834 - protein, 10 aa, Mycobacterium tuberculosis
EEQQQALSSQ

SEQ ID NO: 50835 - protein, 10 aa, Mycobacterium tuberculosis
EQQQALSSQM

SEQ ID NO: 50836 - protein, 10 aa, Mycobacterium tuberculosis
QQQALSSQMG

SEQ ID NO: 50837 - protein, 10 aa, Mycobacterium tuberculosis
QQALSSQMGF

SEQ ID NO: 50838 - protein, 11 aa, Mycobacterium tuberculosis
MAEMKTDAATL

SEQ ID NO: 50839 - protein, 11 aa, Mycobacterium tuberculosis
AEMKTDAATLA

SEQ ID NO: 50840 - protein, 11 aa, Mycobacterium tuberculosis
EMKTDAATLAQ

SEQ ID NO: 50841 - protein, 11 aa, Mycobacterium tuberculosis
MKTDAATLAQE

SEQ ID NO: 50842 - protein, 11 aa, Mycobacterium tuberculosis
KTDAATLAQEA

SEQ ID NO: 50843 - protein, 11 aa, Mycobacterium tuberculosis
TDAATLAQEAG

SEQ ID NO: 50844 - protein, 11 aa, Mycobacterium tuberculosis
DAATLAQEAGN

SEQ ID NO: 50845 - protein, 11 aa, Mycobacterium tuberculosis
AATLAQEAGNF

SEQ ID NO: 50846 - protein, 11 aa, Mycobacterium tuberculosis
ATLAQEAGNFE

SEQ ID NO: 50847 - protein, 11 aa, Mycobacterium tuberculosis
TLAQEAGNFER

SEQ ID NO: 50848 - protein, 11 aa, Mycobacterium tuberculosis
LAQEAGNFERI

SEQ ID NO: 50849 - protein, 11 aa, Mycobacterium tuberculosis
AQEAGNFERIS

SEQ ID NO: 50850 - protein, 11 aa, Mycobacterium tuberculosis
QEAGNFERISG

SEQ ID NO: 50851 - protein, 11 aa, Mycobacterium tuberculosis
EAGNFERISGD

SEQ ID NO: 50852 - protein, 11 aa, Mycobacterium tuberculosis
AGNFERISGDL

SEQ ID NO: 50853 - protein, 11 aa, Mycobacterium tuberculosis
GNFERISGDLK

SEQ ID NO: 50854 - protein, 11 aa, Mycobacterium tuberculosis
NFERISGDLKT

SEQ ID NO: 50855 - protein, 11 aa, Mycobacterium tuberculosis
FERISGDLKTQ

SEQ ID NO: 50856 - protein, 11 aa, Mycobacterium tuberculosis
ERISGDLKTQI

SEQ ID NO: 50857 - protein, 11 aa, Mycobacterium tuberculosis
RISGDLKTQID

SEQ ID NO: 50858 - protein, 11 aa, Mycobacterium tuberculosis
ISGDLKTQIDQ

SEQ ID NO: 50859 - protein, 11 aa, Mycobacterium tuberculosis
SGDLKTQIDQV

SEQ ID NO: 50860 - protein, 11 aa, Mycobacterium tuberculosis
GDLKTQIDQVE

SEQ ID NO: 50861 - protein, 11 aa, Mycobacterium tuberculosis
DLKTQIDQVES

SEQ ID NO: 50862 - protein, 11 aa, Mycobacterium tuberculosis
LKTQIDQVEST

SEQ ID NO: 50863 - protein, 11 aa, Mycobacterium tuberculosis
KTQIDQVESTA

SEQ ID NO: 50864 - protein, 11 aa, Mycobacterium tuberculosis
TQIDQVESTAG

SEQ ID NO: 50865 - protein, 11 aa, Mycobacterium tuberculosis
QIDQVESTAGS

SEQ ID NO: 50866 - protein, 11 aa, Mycobacterium tuberculosis
IDQVESTAGSL

SEQ ID NO: 50867 - protein, 11 aa, Mycobacterium tuberculosis
DQVESTAGSLQ

SEQ ID NO: 50868 - protein, 11 aa, Mycobacterium tuberculosis
QVESTAGSLQG

SEQ ID NO: 50869 - protein, 11 aa, Mycobacterium tuberculosis
VESTAGSLQGQ

SEQ ID NO: 50870 - protein, 11 aa, Mycobacterium tuberculosis
ESTAGSLQGQW

SEQ ID NO: 50871 - protein, 11 aa, Mycobacterium tuberculosis
STAGSLQGQWR

SEQ ID NO: 50872 - protein, 11 aa, Mycobacterium tuberculosis
TAGSLQGQWRG

SEQ ID NO: 50873 - protein, 11 aa, Mycobacterium tuberculosis
AGSLQGQWRGA

SEQ ID NO: 50874 - protein, 11 aa, Mycobacterium tuberculosis
GSLQGQWRGAA

SEQ ID NO: 50875 - protein, 11 aa, Mycobacterium tuberculosis
SLQGQWRGAAG

SEQ ID NO: 50876 - protein, 11 aa, Mycobacterium tuberculosis
LQGQWRGAAGT

SEQ ID NO: 50877 - protein, 11 aa, Mycobacterium tuberculosis
QGQWRGAAGTA

SEQ ID NO: 50878 - protein, 11 aa, Mycobacterium tuberculosis
GQWRGAAGTAA

SEQ ID NO: 50879 - protein, 11 aa, Mycobacterium tuberculosis
QWRGAAGTAAQ

SEQ ID NO: 50880 - protein, 11 aa, Mycobacterium tuberculosis
WRGAAGTAAQA

SEQ ID NO: 50881 - protein, 11 aa, Mycobacterium tuberculosis
RGAAGTAAQAA

SEQ ID NO: 50882 - protein, 11 aa, Mycobacterium tuberculosis
GAAGTAAQAAV

SEQ ID NO: 50883 - protein, 11 aa, Mycobacterium tuberculosis
AAGTAAQAAVV

SEQ ID NO: 50884 - protein, 11 aa, Mycobacterium tuberculosis
AGTAAQAAVVR

SEQ ID NO: 50885 - protein, 11 aa, Mycobacterium tuberculosis
GTAAQAAVVRF

SEQ ID NO: 50886 - protein, 11 aa, Mycobacterium tuberculosis
TAAQAAVVRFQ

SEQ ID NO: 50887 - protein, 11 aa, Mycobacterium tuberculosis
AAQAAVVRFQE

SEQ ID NO: 50888 - protein, 11 aa, Mycobacterium tuberculosis
AQAAVVRFQEA

SEQ ID NO: 50889 - protein, 11 aa, Mycobacterium tuberculosis
QAAVVRFQEAA

SEQ ID NO: 50890 - protein, 11 aa, Mycobacterium tuberculosis
AAVVRFQEAAN

SEQ ID NO: 50891 - protein, 11 aa, Mycobacterium tuberculosis
AVVRFQEAANK

SEQ ID NO: 50892 - protein, 11 aa, Mycobacterium tuberculosis
VVRFQEAANKQ

SEQ ID NO: 50893 - protein, 11 aa, Mycobacterium tuberculosis
VRFQEAANKQK

SEQ ID NO: 50894 - protein, 11 aa, Mycobacterium tuberculosis
RFQEAANKQKQ

SEQ ID NO: 50895 - protein, 11 aa, Mycobacterium tuberculosis
FQEAANKQKQE

SEQ ID NO: 50896 - protein, 11 aa, Mycobacterium tuberculosis
QEAANKQKQEL

SEQ ID NO: 50897 - protein, 11 aa, Mycobacterium tuberculosis
EAANKQKQELD

SEQ ID NO: 50898 - protein, 11 aa, Mycobacterium tuberculosis
AANKQKQELDE

SEQ ID NO: 50899 - protein, 11 aa, Mycobacterium tuberculosis
ANKQKQELDEI

SEQ ID NO: 50900 - protein, 11 aa, Mycobacterium tuberculosis
NKQKQELDEIS

SEQ ID NO: 50901 - protein, 11 aa, Mycobacterium tuberculosis
KQKQELDEIST

SEQ ID NO: 50902 - protein, 11 aa, Mycobacterium tuberculosis
QKQELDEISTN

SEQ ID NO: 50903 - protein, 11 aa, Mycobacterium tuberculosis
KQELDEISTNI

SEQ ID NO: 50904 - protein, 11 aa, Mycobacterium tuberculosis
QELDEISTNIR

SEQ ID NO: 50905 - protein, 11 aa, Mycobacterium tuberculosis
ELDEISTNIRQ

SEQ ID NO: 50906 - protein, 11 aa, Mycobacterium tuberculosis
LDEISTNIRQA

SEQ ID NO: 50907 - protein, 11 aa, Mycobacterium tuberculosis
DEISTNIRQAG

SEQ ID NO: 50908 - protein, 11 aa, Mycobacterium tuberculosis
EISTNIRQAGV

SEQ ID NO: 50909 - protein, 11 aa, Mycobacterium tuberculosis
ISTNIRQAGVQ

SEQ ID NO: 50910 - protein, 11 aa, Mycobacterium tuberculosis
STNIRQAGVQY

SEQ ID NO: 50911 - protein, 11 aa, Mycobacterium tuberculosis
TNIRQAGVQYS

SEQ ID NO: 50912 - protein, 11 aa, Mycobacterium tuberculosis
NIRQAGVQYSR

SEQ ID NO: 50913 - protein, 11 aa, Mycobacterium tuberculosis
IRQAGVQYSRA

SEQ ID NO: 50914 - protein, 11 aa, Mycobacterium tuberculosis
RQAGVQYSRAD

SEQ ID NO: 50915 - protein, 11 aa, Mycobacterium tuberculosis
QAGVQYSRADE

SEQ ID NO: 50916 - protein, 11 aa, Mycobacterium tuberculosis
AGVQYSRADEE

SEQ ID NO: 50917 - protein, 11 aa, Mycobacterium tuberculosis
GVQYSRADEEQ

SEQ ID NO: 50918 - protein, 11 aa, Mycobacterium tuberculosis
VQYSRADEEQQ

SEQ ID NO: 50919 - protein, 11 aa, Mycobacterium tuberculosis
QYSRADEEQQQ

SEQ ID NO: 50920 - protein, 11 aa, Mycobacterium tuberculosis
YSRADEEQQQA

SEQ ID NO: 50921 - protein, 11 aa, Mycobacterium tuberculosis
SRADEEQQQAL

SEQ ID NO: 50922 - protein, 11 aa, Mycobacterium tuberculosis
RADEEQQQALS

SEQ ID NO: 50923 - protein, 11 aa, Mycobacterium tuberculosis
ADEEQQQALSS

SEQ ID NO: 50924 - protein, 11 aa, Mycobacterium tuberculosis
DEEQQQALSSQ

SEQ ID NO: 50925 - protein, 11 aa, Mycobacterium tuberculosis
EEQQQALSSQM

SEQ ID NO: 50926 - protein, 11 aa, Mycobacterium tuberculosis
EQQQALSSQMG

SEQ ID NO: 50927 - protein, 11 aa, Mycobacterium tuberculosis
QQQALSSQMGF

SEQ ID NO: 50928 - protein, 8 aa, Mycobacterium tuberculosis
MTEQQWNF

SEQ ID NO: 50929 - protein, 8 aa, Mycobacterium tuberculosis
TEQQWNFA

SEQ ID NO: 50930 - protein, 8 aa, Mycobacterium tuberculosis
EQQWNFAG

SEQ ID NO: 50931 - protein, 8 aa, Mycobacterium tuberculosis
QQWNFAGI

SEQ ID NO: 50932 - protein, 8 aa, Mycobacterium tuberculosis
QWNFAGIE

SEQ ID NO: 50933 - protein, 8 aa, Mycobacterium tuberculosis
WNFAGIEA

SEQ ID NO: 50934 - protein, 8 aa, Mycobacterium tuberculosis
NFAGIEAA

SEQ ID NO: 50935 - protein, 8 aa, Mycobacterium tuberculosis
FAGIEAAA

SEQ ID NO: 50936 - protein, 8 aa, Mycobacterium tuberculosis
AGIEAAAS

SEQ ID NO: 50937 - protein, 8 aa, Mycobacterium tuberculosis
GIEAAASA

SEQ ID NO: 50938 - protein, 8 aa, Mycobacterium tuberculosis
IEAAASAI

SEQ ID NO: 50939 - protein, 8 aa, Mycobacterium tuberculosis
EAAASAIQ

SEQ ID NO: 50940 - protein, 8 aa, Mycobacterium tuberculosis
AAASAIQG

SEQ ID NO: 50941 - protein, 8 aa, Mycobacterium tuberculosis
AASAIQGN

SEQ ID NO: 50942 - protein, 8 aa, Mycobacterium tuberculosis
ASAIQGNV

SEQ ID NO: 50943 - protein, 8 aa, Mycobacterium tuberculosis
SAIQGNVT

SEQ ID NO: 50944 - protein, 8 aa, Mycobacterium tuberculosis
AIQGNVTS

SEQ ID NO: 50945 - protein, 8 aa, Mycobacterium tuberculosis
IQGNVTSI

SEQ ID NO: 50946 - protein, 8 aa, Mycobacterium tuberculosis
QGNVTSIH

SEQ ID NO: 50947 - protein, 8 aa, Mycobacterium tuberculosis
GNVTSIHS

SEQ ID NO: 50948 - protein, 8 aa, Mycobacterium tuberculosis
NVTSIHSL

SEQ ID NO: 50949 - protein, 8 aa, Mycobacterium tuberculosis
VTSIHSLL

SEQ ID NO: 50950 - protein, 8 aa, Mycobacterium tuberculosis
TSIHSLLD

SEQ ID NO: 50951 - protein, 8 aa, Mycobacterium tuberculosis
SIHSLLDE

SEQ ID NO: 50952 - protein, 8 aa, Mycobacterium tuberculosis
IHSLLDEG

SEQ ID NO: 50953 - protein, 8 aa, Mycobacterium tuberculosis
HSLLDEGK

SEQ ID NO: 50954 - protein, 8 aa, Mycobacterium tuberculosis
SLLDEGKQ

SEQ ID NO: 50955 - protein, 8 aa, Mycobacterium tuberculosis
LLDEGKQS

SEQ ID NO: 50956 - protein, 8 aa, Mycobacterium tuberculosis
LDEGKQSL

SEQ ID NO: 50957 - protein, 8 aa, Mycobacterium tuberculosis
DEGKQSLT

SEQ ID NO: 50958 - protein, 8 aa, Mycobacterium tuberculosis
EGKQSLTK

SEQ ID NO: 50959 - protein, 8 aa, Mycobacterium tuberculosis
GKQSLTKL

SEQ ID NO: 50960 - protein, 8 aa, Mycobacterium tuberculosis
KQSLTKLA

SEQ ID NO: 50961 - protein, 8 aa, Mycobacterium tuberculosis
QSLTKLAA

SEQ ID NO: 50962 - protein, 8 aa, Mycobacterium tuberculosis
SLTKLAAA

SEQ ID NO: 50963 - protein, 8 aa, Mycobacterium tuberculosis
LTKLAAAW

SEQ ID NO: 50964 - protein, 8 aa, Mycobacterium tuberculosis
TKLAAAWG

SEQ ID NO: 50965 - protein, 8 aa, Mycobacterium tuberculosis
KLAAAWGG

SEQ ID NO: 50966 - protein, 8 aa, Mycobacterium tuberculosis
LAAAWGGS

SEQ ID NO: 50967 - protein, 8 aa, Mycobacterium tuberculosis
AAAWGGSG

SEQ ID NO: 50968 - protein, 8 aa, Mycobacterium tuberculosis
AAWGGSGS

SEQ ID NO: 50969 - protein, 8 aa, Mycobacterium tuberculosis
AWGGSGSE

SEQ ID NO: 50970 - protein, 8 aa, Mycobacterium tuberculosis
WGGSGSEA

SEQ ID NO: 50971 - protein, 8 aa, Mycobacterium tuberculosis
GGSGSEAY

SEQ ID NO: 50972 - protein, 8 aa, Mycobacterium tuberculosis
GSGSEAYQ

SEQ ID NO: 50973 - protein, 8 aa, Mycobacterium tuberculosis
SGSEAYQG

SEQ ID NO: 50974 - protein, 8 aa, Mycobacterium tuberculosis
GSEAYQGV

SEQ ID NO: 50975 - protein, 8 aa, Mycobacterium tuberculosis
SEAYQGVQ

SEQ ID NO: 50976 - protein, 8 aa, Mycobacterium tuberculosis
EAYQGVQQ

SEQ ID NO: 50977 - protein, 8 aa, Mycobacterium tuberculosis
AYQGVQQK

SEQ ID NO: 50978 - protein, 8 aa, Mycobacterium tuberculosis
YQGVQQKW

SEQ ID NO: 50979 - protein, 8 aa, Mycobacterium tuberculosis
QGVQQKWD

SEQ ID NO: 50980 - protein, 8 aa, Mycobacterium tuberculosis
GVQQKWDA

SEQ ID NO: 50981 - protein, 8 aa, Mycobacterium tuberculosis
VQQKWDAT

SEQ ID NO: 50982 - protein, 8 aa, Mycobacterium tuberculosis
QQKWDATA

SEQ ID NO: 50983 - protein, 8 aa, Mycobacterium tuberculosis
QKWDATAT

SEQ ID NO: 50984 - protein, 8 aa, Mycobacterium tuberculosis
KWDATATE

SEQ ID NO: 50985 - protein, 8 aa, Mycobacterium tuberculosis
WDATATEL

SEQ ID NO: 50986 - protein, 8 aa, Mycobacterium tuberculosis
DATATELN

SEQ ID NO: 50987 - protein, 8 aa, Mycobacterium tuberculosis
ATATELNN

SEQ ID NO: 50988 - protein, 8 aa, Mycobacterium tuberculosis
TATELNNA

SEQ ID NO: 50989 - protein, 8 aa, Mycobacterium tuberculosis
ATELNNAL

SEQ ID NO: 50990 - protein, 8 aa, Mycobacterium tuberculosis
TELNNALQ

SEQ ID NO: 50991 - protein, 8 aa, Mycobacterium tuberculosis
ELNNALQN

SEQ ID NO: 50992 - protein, 8 aa, Mycobacterium tuberculosis
LNNALQNL

SEQ ID NO: 50993 - protein, 8 aa, Mycobacterium tuberculosis
NNALQNLA

SEQ ID NO: 50994 - protein, 8 aa, Mycobacterium tuberculosis
NALQNLAR

SEQ ID NO: 50995 - protein, 8 aa, Mycobacterium tuberculosis
ALQNLART

SEQ ID NO: 50996 - protein, 8 aa, Mycobacterium tuberculosis
LQNLARTI

SEQ ID NO: 50997 - protein, 8 aa, Mycobacterium tuberculosis
QNLARTIS

SEQ ID NO: 50998 - protein, 8 aa, Mycobacterium tuberculosis
NLARTISE

SEQ ID NO: 50999 - protein, 8 aa, Mycobacterium tuberculosis
LARTISEA

SEQ ID NO: 51000 - protein, 8 aa, Mycobacterium tuberculosis
ARTISEAG

SEQ ID NO: 51001 - protein, 8 aa, Mycobacterium tuberculosis
RTISEAGQ

SEQ ID NO: 51002 - protein, 8 aa, Mycobacterium tuberculosis
TISEAGQA

SEQ ID NO: 51003 - protein, 8 aa, Mycobacterium tuberculosis
ISEAGQAM

SEQ ID NO: 51004 - protein, 8 aa, Mycobacterium tuberculosis
SEAGQAMA

SEQ ID NO: 51005 - protein, 8 aa, Mycobacterium tuberculosis
EAGQAMAS

SEQ ID NO: 51006 - protein, 8 aa, Mycobacterium tuberculosis
AGQAMAST

SEQ ID NO: 51007 - protein, 8 aa, Mycobacterium tuberculosis
GQAMASTE

SEQ ID NO: 51008 - protein, 8 aa, Mycobacterium tuberculosis
QAMASTEG

SEQ ID NO: 51009 - protein, 8 aa, Mycobacterium tuberculosis
AMASTEGN

SEQ ID NO: 51010 - protein, 8 aa, Mycobacterium tuberculosis
MASTEGNV

SEQ ID NO: 51011 - protein, 8 aa, Mycobacterium tuberculosis
ASTEGNVT

SEQ ID NO: 51012 - protein, 8 aa, Mycobacterium tuberculosis
STEGNVTG

SEQ ID NO: 51013 - protein, 8 aa, Mycobacterium tuberculosis
TEGNVTGM

SEQ ID NO: 51014 - protein, 8 aa, Mycobacterium tuberculosis
EGNVTGMF

SEQ ID NO: 51015 - protein, 8 aa, Mycobacterium tuberculosis
GNVTGMFA

SEQ ID NO: 51016 - protein, 9 aa, Mycobacterium tuberculosis
MTEQQWNFA

SEQ ID NO: 51017 - protein, 9 aa, Mycobacterium tuberculosis
TEQQWNFAG

SEQ ID NO: 51018 - protein, 9 aa, Mycobacterium tuberculosis
EQQWNFAGI

SEQ ID NO: 51019 - protein, 9 aa, Mycobacterium tuberculosis
QQWNFAGIE

SEQ ID NO: 51020 - protein, 9 aa, Mycobacterium tuberculosis
QWNFAGIEA

SEQ ID NO: 51021 - protein, 9 aa, Mycobacterium tuberculosis
WNFAGIEAA

SEQ ID NO: 51022 - protein, 9 aa, Mycobacterium tuberculosis
NFAGIEAAA

SEQ ID NO: 51023 - protein, 9 aa, Mycobacterium tuberculosis
FAGIEAAAS

SEQ ID NO: 51024 - protein, 9 aa, Mycobacterium tuberculosis
AGIEAAASA

SEQ ID NO: 51025 - protein, 9 aa, Mycobacterium tuberculosis
GIEAAASAI

SEQ ID NO: 51026 - protein, 9 aa, Mycobacterium tuberculosis
IEAAASAIQ

SEQ ID NO: 51027 - protein, 9 aa, Mycobacterium tuberculosis
EAAASAIQG

SEQ ID NO: 51028 - protein, 9 aa, Mycobacterium tuberculosis
AAASAIQGN

SEQ ID NO: 51029 - protein, 9 aa, Mycobacterium tuberculosis
AASAIQGNV

SEQ ID NO: 51030 - protein, 9 aa, Mycobacterium tuberculosis
ASAIQGNVT

SEQ ID NO: 51031 - protein, 9 aa, Mycobacterium tuberculosis
SAIQGNVTS

SEQ ID NO: 51032 - protein, 9 aa, Mycobacterium tuberculosis
AIQGNVTSI

SEQ ID NO: 51033 - protein, 9 aa, Mycobacterium tuberculosis
IQGNVTSIH

SEQ ID NO: 51034 - protein, 9 aa, Mycobacterium tuberculosis
QGNVTSIHS

SEQ ID NO: 51035 - protein, 9 aa, Mycobacterium tuberculosis
GNVTSIHSL

SEQ ID NO: 51036 - protein, 9 aa, Mycobacterium tuberculosis
NVTSIHSLL

SEQ ID NO: 51037 - protein, 9 aa, Mycobacterium tuberculosis
VTSIHSLLD

SEQ ID NO: 51038 - protein, 9 aa, Mycobacterium tuberculosis
TSIHSLLDE

SEQ ID NO: 51039 - protein, 9 aa, Mycobacterium tuberculosis
SIHSLLDEG

SEQ ID NO: 51040 - protein, 9 aa, Mycobacterium tuberculosis
IHSLLDEGK

SEQ ID NO: 51041 - protein, 9 aa, Mycobacterium tuberculosis
HSLLDEGKQ

SEQ ID NO: 51042 - protein, 9 aa, Mycobacterium tuberculosis
SLLDEGKQS

SEQ ID NO: 51043 - protein, 9 aa, Mycobacterium tuberculosis
LLDEGKQSL

SEQ ID NO: 51044 - protein, 9 aa, Mycobacterium tuberculosis
LDEGKQSLT

SEQ ID NO: 51045 - protein, 9 aa, Mycobacterium tuberculosis
DEGKQSLTK

SEQ ID NO: 51046 - protein, 9 aa, Mycobacterium tuberculosis
EGKQSLTKL

SEQ ID NO: 51047 - protein, 9 aa, Mycobacterium tuberculosis
GKQSLTKLA

SEQ ID NO: 51048 - protein, 9 aa, Mycobacterium tuberculosis
KQSLTKLAA

SEQ ID NO: 51049 - protein, 9 aa, Mycobacterium tuberculosis
QSLTKLAAA

SEQ ID NO: 51050 - protein, 9 aa, Mycobacterium tuberculosis
SLTKLAAAW

SEQ ID NO: 51051 - protein, 9 aa, Mycobacterium tuberculosis
LTKLAAAWG

SEQ ID NO: 51052 - protein, 9 aa, Mycobacterium tuberculosis
TKLAAAWGG

SEQ ID NO: 51053 - protein, 9 aa, Mycobacterium tuberculosis
KLAAAWGGS

SEQ ID NO: 51054 - protein, 9 aa, Mycobacterium tuberculosis
LAAAWGGSG

SEQ ID NO: 51055 - protein, 9 aa, Mycobacterium tuberculosis
AAAWGGSGS

SEQ ID NO: 51056 - protein, 9 aa, Mycobacterium tuberculosis
AAWGGSGSE

SEQ ID NO: 51057 - protein, 9 aa, Mycobacterium tuberculosis
AWGGSGSEA

SEQ ID NO: 51058 - protein, 9 aa, Mycobacterium tuberculosis
WGGSGSEAY

SEQ ID NO: 51059 - protein, 9 aa, Mycobacterium tuberculosis
GGSGSEAYQ

SEQ ID NO: 51060 - protein, 9 aa, Mycobacterium tuberculosis
GSGSEAYQG

SEQ ID NO: 51061 - protein, 9 aa, Mycobacterium tuberculosis
SGSEAYQGV

SEQ ID NO: 51062 - protein, 9 aa, Mycobacterium tuberculosis
GSEAYQGVQ

SEQ ID NO: 51063 - protein, 9 aa, Mycobacterium tuberculosis
SEAYQGVQQ

SEQ ID NO: 51064 - protein, 9 aa, Mycobacterium tuberculosis
EAYQGVQQK

SEQ ID NO: 51065 - protein, 9 aa, Mycobacterium tuberculosis
AYQGVQQKW

SEQ ID NO: 51066 - protein, 9 aa, Mycobacterium tuberculosis
YQGVQQKWD

SEQ ID NO: 51067 - protein, 9 aa, Mycobacterium tuberculosis
QGVQQKWDA

SEQ ID NO: 51068 - protein, 9 aa, Mycobacterium tuberculosis
GVQQKWDAT

SEQ ID NO: 51069 - protein, 9 aa, Mycobacterium tuberculosis
VQQKWDATA

SEQ ID NO: 51070 - protein, 9 aa, Mycobacterium tuberculosis
QQKWDATAT

SEQ ID NO: 51071 - protein, 9 aa, Mycobacterium tuberculosis
QKWDATATE

SEQ ID NO: 51072 - protein, 9 aa, Mycobacterium tuberculosis
KWDATATEL

SEQ ID NO: 51073 - protein, 9 aa, Mycobacterium tuberculosis
WDATATELN

SEQ ID NO: 51074 - protein, 9 aa, Mycobacterium tuberculosis
DATATELNN

SEQ ID NO: 51075 - protein, 9 aa, Mycobacterium tuberculosis
ATATELNNA

SEQ ID NO: 51076 - protein, 9 aa, Mycobacterium tuberculosis
TATELNNAL

SEQ ID NO: 51077 - protein, 9 aa, Mycobacterium tuberculosis
ATELNNALQ

SEQ ID NO: 51078 - protein, 9 aa, Mycobacterium tuberculosis
TELNNALQN

SEQ ID NO: 51079 - protein, 9 aa, Mycobacterium tuberculosis
ELNNALQNL

SEQ ID NO: 51080 - protein, 9 aa, Mycobacterium tuberculosis
LNNALQNLA

SEQ ID NO: 51081 - protein, 9 aa, Mycobacterium tuberculosis
NNALQNLAR

SEQ ID NO: 51082 - protein, 9 aa, Mycobacterium tuberculosis
NALQNLART

SEQ ID NO: 51083 - protein, 9 aa, Mycobacterium tuberculosis
ALQNLARTI

SEQ ID NO: 51084 - protein, 9 aa, Mycobacterium tuberculosis
LQNLARTIS

SEQ ID NO: 51085 - protein, 9 aa, Mycobacterium tuberculosis
QNLARTISE

SEQ ID NO: 51086 - protein, 9 aa, Mycobacterium tuberculosis
NLARTISEA

SEQ ID NO: 51087 - protein, 9 aa, Mycobacterium tuberculosis
LARTISEAG

SEQ ID NO: 51088 - protein, 9 aa, Mycobacterium tuberculosis
ARTISEAGQ

SEQ ID NO: 51089 - protein, 9 aa, Mycobacterium tuberculosis
RTISEAGQA

SEQ ID NO: 51090 - protein, 9 aa, Mycobacterium tuberculosis
TISEAGQAM

SEQ ID NO: 51091 - protein, 9 aa, Mycobacterium tuberculosis
ISEAGQAMA

SEQ ID NO: 51092 - protein, 9 aa, Mycobacterium tuberculosis
SEAGQAMAS

SEQ ID NO: 51093 - protein, 9 aa, Mycobacterium tuberculosis
EAGQAMAST

SEQ ID NO: 51094 - protein, 9 aa, Mycobacterium tuberculosis
AGQAMASTE

SEQ ID NO: 51095 - protein, 9 aa, Mycobacterium tuberculosis
GQAMASTEG

SEQ ID NO: 51096 - protein, 9 aa, Mycobacterium tuberculosis
QAMASTEGN

SEQ ID NO: 51097 - protein, 9 aa, Mycobacterium tuberculosis
AMASTEGNV

SEQ ID NO: 51098 - protein, 9 aa, Mycobacterium tuberculosis
MASTEGNVT

SEQ ID NO: 51099 - protein, 9 aa, Mycobacterium tuberculosis
ASTEGNVTG

SEQ ID NO: 51100 - protein, 9 aa, Mycobacterium tuberculosis
STEGNVTGM

SEQ ID NO: 51101 - protein, 9 aa, Mycobacterium tuberculosis
TEGNVTGMF

SEQ ID NO: 51102 - protein, 9 aa, Mycobacterium tuberculosis
EGNVTGMFA

SEQ ID NO: 51103 - protein, 10 aa, Mycobacterium tuberculosis
MTEQQWNFAG

SEQ ID NO: 51104 - protein, 10 aa, Mycobacterium tuberculosis
TEQQWNFAGI

SEQ ID NO: 51105 - protein, 10 aa, Mycobacterium tuberculosis
EQQWNFAGIE

SEQ ID NO: 51106 - protein, 10 aa, Mycobacterium tuberculosis
QQWNFAGIEA

SEQ ID NO: 51107 - protein, 10 aa, Mycobacterium tuberculosis
QWNFAGIEAA

SEQ ID NO: 51108 - protein, 10 aa, Mycobacterium tuberculosis
WNFAGIEAAA

SEQ ID NO: 51109 - protein, 10 aa, Mycobacterium tuberculosis
NFAGIEAAAS

SEQ ID NO: 51110 - protein, 10 aa, Mycobacterium tuberculosis
FAGIEAAASA

SEQ ID NO: 51111 - protein, 10 aa, Mycobacterium tuberculosis
AGIEAAASAI

SEQ ID NO: 51112 - protein, 10 aa, Mycobacterium tuberculosis
GIEAAASAIQ

SEQ ID NO: 51113 - protein, 10 aa, Mycobacterium tuberculosis
IEAAASAIQG

SEQ ID NO: 51114 - protein, 10 aa, Mycobacterium tuberculosis
EAAASAIQGN

SEQ ID NO: 51115 - protein, 10 aa, Mycobacterium tuberculosis
AAASAIQGNV

SEQ ID NO: 51116 - protein, 10 aa, Mycobacterium tuberculosis
AASAIQGNVT

SEQ ID NO: 51117 - protein, 10 aa, Mycobacterium tuberculosis
ASAIQGNVTS

SEQ ID NO: 51118 - protein, 10 aa, Mycobacterium tuberculosis
SAIQGNVTSI

SEQ ID NO: 51119 - protein, 10 aa, Mycobacterium tuberculosis
AIQGNVTSIH

SEQ ID NO: 51120 - protein, 10 aa, Mycobacterium tuberculosis
IQGNVTSIHS

SEQ ID NO: 51121 - protein, 10 aa, Mycobacterium tuberculosis
QGNVTSIHSL

SEQ ID NO: 51122 - protein, 10 aa, Mycobacterium tuberculosis
GNVTSIHSLL

SEQ ID NO: 51123 - protein, 10 aa, Mycobacterium tuberculosis
NVTSIHSLLD

SEQ ID NO: 51124 - protein, 10 aa, Mycobacterium tuberculosis
VTSIHSLLDE

SEQ ID NO: 51125 - protein, 10 aa, Mycobacterium tuberculosis
TSIHSLLDEG

SEQ ID NO: 51126 - protein, 10 aa, Mycobacterium tuberculosis
SIHSLLDEGK

SEQ ID NO: 51127 - protein, 10 aa, Mycobacterium tuberculosis
IHSLLDEGKQ

SEQ ID NO: 51128 - protein, 10 aa, Mycobacterium tuberculosis
HSLLDEGKQS

SEQ ID NO: 51129 - protein, 10 aa, Mycobacterium tuberculosis
SLLDEGKQSL

SEQ ID NO: 51130 - protein, 10 aa, Mycobacterium tuberculosis
LLDEGKQSLT

SEQ ID NO: 51131 - protein, 10 aa, Mycobacterium tuberculosis
LDEGKQSLTK

SEQ ID NO: 51132 - protein, 10 aa, Mycobacterium tuberculosis
DEGKQSLTKL

SEQ ID NO: 51133 - protein, 10 aa, Mycobacterium tuberculosis
EGKQSLTKLA

SEQ ID NO: 51134 - protein, 10 aa, Mycobacterium tuberculosis
GKQSLTKLAA

SEQ ID NO: 51135 - protein, 10 aa, Mycobacterium tuberculosis
KQSLTKLAAA

SEQ ID NO: 51136 - protein, 10 aa, Mycobacterium tuberculosis
QSLTKLAAAW

SEQ ID NO: 51137 - protein, 10 aa, Mycobacterium tuberculosis
SLTKLAAAWG

SEQ ID NO: 51138 - protein, 10 aa, Mycobacterium tuberculosis
LTKLAAAWGG

SEQ ID NO: 51139 - protein, 10 aa, Mycobacterium tuberculosis
TKLAAAWGGS

SEQ ID NO: 51140 - protein, 10 aa, Mycobacterium tuberculosis
KLAAAWGGSG

SEQ ID NO: 51141 - protein, 10 aa, Mycobacterium tuberculosis
LAAAWGGSGS

SEQ ID NO: 51142 - protein, 10 aa, Mycobacterium tuberculosis
AAAWGGSGSE

SEQ ID NO: 51143 - protein, 10 aa, Mycobacterium tuberculosis
AAWGGSGSEA

SEQ ID NO: 51144 - protein, 10 aa, Mycobacterium tuberculosis
AWGGSGSEAY

SEQ ID NO: 51145 - protein, 10 aa, Mycobacterium tuberculosis
WGGSGSEAYQ

SEQ ID NO: 51146 - protein, 10 aa, Mycobacterium tuberculosis
GGSGSEAYQG

SEQ ID NO: 51147 - protein, 10 aa, Mycobacterium tuberculosis
GSGSEAYQGV

SEQ ID NO: 51148 - protein, 10 aa, Mycobacterium tuberculosis
SGSEAYQGVQ

SEQ ID NO: 51149 - protein, 10 aa, Mycobacterium tuberculosis
GSEAYQGVQQ

SEQ ID NO: 51150 - protein, 10 aa, Mycobacterium tuberculosis
SEAYQGVQQK

SEQ ID NO: 51151 - protein, 10 aa, Mycobacterium tuberculosis
EAYQGVQQKW

SEQ ID NO: 51152 - protein, 10 aa, Mycobacterium tuberculosis
AYQGVQQKWD

SEQ ID NO: 51153 - protein, 10 aa, Mycobacterium tuberculosis
YQGVQQKWDA

SEQ ID NO: 51154 - protein, 10 aa, Mycobacterium tuberculosis
QGVQQKWDAT

SEQ ID NO: 51155 - protein, 10 aa, Mycobacterium tuberculosis
GVQQKWDATA

SEQ ID NO: 51156 - protein, 10 aa, Mycobacterium tuberculosis
VQQKWDATAT

SEQ ID NO: 51157 - protein, 10 aa, Mycobacterium tuberculosis
QQKWDATATE

SEQ ID NO: 51158 - protein, 10 aa, Mycobacterium tuberculosis
QKWDATATEL

SEQ ID NO: 51159 - protein, 10 aa, Mycobacterium tuberculosis
KWDATATELN

SEQ ID NO: 51160 - protein, 10 aa, Mycobacterium tuberculosis
WDATATELNN

SEQ ID NO: 51161 - protein, 10 aa, Mycobacterium tuberculosis
DATATELNNA

SEQ ID NO: 51162 - protein, 10 aa, Mycobacterium tuberculosis
ATATELNNAL

SEQ ID NO: 51163 - protein, 10 aa, Mycobacterium tuberculosis
TATELNNALQ

SEQ ID NO: 51164 - protein, 10 aa, Mycobacterium tuberculosis
ATELNNALQN

SEQ ID NO: 51165 - protein, 10 aa, Mycobacterium tuberculosis
TELNNALQNL

SEQ ID NO: 51166 - protein, 10 aa, Mycobacterium tuberculosis
ELNNALQNLA

SEQ ID NO: 51167 - protein, 10 aa, Mycobacterium tuberculosis
LNNALQNLAR

SEQ ID NO: 51168 - protein, 10 aa, Mycobacterium tuberculosis
NNALQNLART

SEQ ID NO: 51169 - protein, 10 aa, Mycobacterium tuberculosis
NALQNLARTI

SEQ ID NO: 51170 - protein, 10 aa, Mycobacterium tuberculosis
ALQNLARTIS

SEQ ID NO: 51171 - protein, 10 aa, Mycobacterium tuberculosis
LQNLARTISE

SEQ ID NO: 51172 - protein, 10 aa, Mycobacterium tuberculosis
QNLARTISEA

SEQ ID NO: 51173 - protein, 10 aa, Mycobacterium tuberculosis
NLARTISEAG

SEQ ID NO: 51174 - protein, 10 aa, Mycobacterium tuberculosis
LARTISEAGQ

SEQ ID NO: 51175 - protein, 10 aa, Mycobacterium tuberculosis
ARTISEAGQA

SEQ ID NO: 51176 - protein, 10 aa, Mycobacterium tuberculosis
RTISEAGQAM

SEQ ID NO: 51177 - protein, 10 aa, Mycobacterium tuberculosis
TISEAGQAMA

SEQ ID NO: 51178 - protein, 10 aa, Mycobacterium tuberculosis
ISEAGQAMAS

SEQ ID NO: 51179 - protein, 10 aa, Mycobacterium tuberculosis
SEAGQAMAST

SEQ ID NO: 51180 - protein, 10 aa, Mycobacterium tuberculosis
EAGQAMASTE

SEQ ID NO: 51181 - protein, 10 aa, Mycobacterium tuberculosis
AGQAMASTEG

SEQ ID NO: 51182 - protein, 10 aa, Mycobacterium tuberculosis
GQAMASTEGN

SEQ ID NO: 51183 - protein, 10 aa, Mycobacterium tuberculosis
QAMASTEGNV

SEQ ID NO: 51184 - protein, 10 aa, Mycobacterium tuberculosis
AMASTEGNVT

SEQ ID NO: 51185 - protein, 10 aa, Mycobacterium tuberculosis
MASTEGNVTG

SEQ ID NO: 51186 - protein, 10 aa, Mycobacterium tuberculosis
ASTEGNVTGM

SEQ ID NO: 51187 - protein, 10 aa, Mycobacterium tuberculosis
STEGNVTGMF

SEQ ID NO: 51188 - protein, 10 aa, Mycobacterium tuberculosis
TEGNVTGMFA

SEQ ID NO: 51189 - protein, 11 aa, Mycobacterium tuberculosis
MTEQQWNFAGI

SEQ ID NO: 51190 - protein, 11 aa, Mycobacterium tuberculosis
TEQQWNFAGIE

SEQ ID NO: 51191 - protein, 11 aa, Mycobacterium tuberculosis
EQQWNFAGIEA

SEQ ID NO: 51192 - protein, 11 aa, Mycobacterium tuberculosis
QQWNFAGIEAA

SEQ ID NO: 51193 - protein, 11 aa, Mycobacterium tuberculosis
QWNFAGIEAAA

SEQ ID NO: 51194 - protein, 11 aa, Mycobacterium tuberculosis
WNFAGIEAAAS

SEQ ID NO: 51195 - protein, 11 aa, Mycobacterium tuberculosis
NFAGIEAAASA

SEQ ID NO: 51196 - protein, 11 aa, Mycobacterium tuberculosis
FAGIEAAASAI

SEQ ID NO: 51197 - protein, 11 aa, Mycobacterium tuberculosis
AGIEAAASAIQ

SEQ ID NO: 51198 - protein, 11 aa, Mycobacterium tuberculosis
GIEAAASAIQG

SEQ ID NO: 51199 - protein, 11 aa, Mycobacterium tuberculosis
IEAAASAIQGN

SEQ ID NO: 51200 - protein, 11 aa, Mycobacterium tuberculosis
EAAASAIQGNV

SEQ ID NO: 51201 - protein, 11 aa, Mycobacterium tuberculosis
AAASAIQGNVT

SEQ ID NO: 51202 - protein, 11 aa, Mycobacterium tuberculosis
AASAIQGNVTS

SEQ ID NO: 51203 - protein, 11 aa, Mycobacterium tuberculosis
ASAIQGNVTSI

SEQ ID NO: 51204 - protein, 11 aa, Mycobacterium tuberculosis
SAIQGNVTSIH

SEQ ID NO: 51205 - protein, 11 aa, Mycobacterium tuberculosis
AIQGNVTSIHS

SEQ ID NO: 51206 - protein, 11 aa, Mycobacterium tuberculosis
IQGNVTSIHSL

SEQ ID NO: 51207 - protein, 11 aa, Mycobacterium tuberculosis
QGNVTSIHSLL

SEQ ID NO: 51208 - protein, 11 aa, Mycobacterium tuberculosis
GNVTSIHSLLD

SEQ ID NO: 51209 - protein, 11 aa, Mycobacterium tuberculosis
NVTSIHSLLDE

SEQ ID NO: 51210 - protein, 11 aa, Mycobacterium tuberculosis
VTSIHSLLDEG

SEQ ID NO: 51211 - protein, 11 aa, Mycobacterium tuberculosis
TSIHSLLDEGK

SEQ ID NO: 51212 - protein, 11 aa, Mycobacterium tuberculosis
SIHSLLDEGKQ

SEQ ID NO: 51213 - protein, 11 aa, Mycobacterium tuberculosis
IHSLLDEGKQS

SEQ ID NO: 51214 - protein, 11 aa, Mycobacterium tuberculosis
HSLLDEGKQSL

SEQ ID NO: 51215 - protein, 11 aa, Mycobacterium tuberculosis
SLLDEGKQSLT

SEQ ID NO: 51216 - protein, 11 aa, Mycobacterium tuberculosis
LLDEGKQSLTK

SEQ ID NO: 51217 - protein, 11 aa, Mycobacterium tuberculosis
LDEGKQSLTKL

SEQ ID NO: 51218 - protein, 11 aa, Mycobacterium tuberculosis
DEGKQSLTKLA

SEQ ID NO: 51219 - protein, 11 aa, Mycobacterium tuberculosis
EGKQSLTKLAA

SEQ ID NO: 51220 - protein, 11 aa, Mycobacterium tuberculosis
GKQSLTKLAAA

SEQ ID NO: 51221 - protein, 11 aa, Mycobacterium tuberculosis
KQSLTKLAAAW

SEQ ID NO: 51222 - protein, 11 aa, Mycobacterium tuberculosis
QSLTKLAAAWG

SEQ ID NO: 51223 - protein, 11 aa, Mycobacterium tuberculosis
SLTKLAAAWGG

SEQ ID NO: 51224 - protein, 11 aa, Mycobacterium tuberculosis
LTKLAAAWGGS

SEQ ID NO: 51225 - protein, 11 aa, Mycobacterium tuberculosis
TKLAAAWGGSG

SEQ ID NO: 51226 - protein, 11 aa, Mycobacterium tuberculosis
KLAAAWGGSGS

SEQ ID NO: 51227 - protein, 11 aa, Mycobacterium tuberculosis
LAAAWGGSGSE

SEQ ID NO: 51228 - protein, 11 aa, Mycobacterium tuberculosis
AAAWGGSGSEA

SEQ ID NO: 51229 - protein, 11 aa, Mycobacterium tuberculosis
AAWGGSGSEAY

SEQ ID NO: 51230 - protein, 11 aa, Mycobacterium tuberculosis
AWGGSGSEAYQ

SEQ ID NO: 51231 - protein, 11 aa, Mycobacterium tuberculosis
WGGSGSEAYQG

SEQ ID NO: 51232 - protein, 11 aa, Mycobacterium tuberculosis
GGSGSEAYQGV

SEQ ID NO: 51233 - protein, 11 aa, Mycobacterium tuberculosis
GSGSEAYQGVQ

SEQ ID NO: 51234 - protein, 11 aa, Mycobacterium tuberculosis
SGSEAYQGVQQ

SEQ ID NO: 51235 - protein, 11 aa, Mycobacterium tuberculosis
GSEAYQGVQQK

SEQ ID NO: 51236 - protein, 11 aa, Mycobacterium tuberculosis
SEAYQGVQQKW

SEQ ID NO: 51237 - protein, 11 aa, Mycobacterium tuberculosis
EAYQGVQQKWD

SEQ ID NO: 51238 - protein, 11 aa, Mycobacterium tuberculosis
AYQGVQQKWDA

SEQ ID NO: 51239 - protein, 11 aa, Mycobacterium tuberculosis
YQGVQQKWDAT

SEQ ID NO: 51240 - protein, 11 aa, Mycobacterium tuberculosis
QGVQQKWDATA

SEQ ID NO: 51241 - protein, 11 aa, Mycobacterium tuberculosis
GVQQKWDATAT

SEQ ID NO: 51242 - protein, 11 aa, Mycobacterium tuberculosis
VQQKWDATATE

SEQ ID NO: 51243 - protein, 11 aa, Mycobacterium tuberculosis
QQKWDATATEL

SEQ ID NO: 51244 - protein, 11 aa, Mycobacterium tuberculosis
QKWDATATELN

SEQ ID NO: 51245 - protein, 11 aa, Mycobacterium tuberculosis
KWDATATELNN

SEQ ID NO: 51246 - protein, 11 aa, Mycobacterium tuberculosis
WDATATELNNA

SEQ ID NO: 51247 - protein, 11 aa, Mycobacterium tuberculosis
DATATELNNAL

SEQ ID NO: 51248 - protein, 11 aa, Mycobacterium tuberculosis
ATATELNNALQ

SEQ ID NO: 51249 - protein, 11 aa, Mycobacterium tuberculosis
TATELNNALQN

SEQ ID NO: 51250 - protein, 11 aa, Mycobacterium tuberculosis
ATELNNALQNL

SEQ ID NO: 51251 - protein, 11 aa, Mycobacterium tuberculosis
TELNNALQNLA

SEQ ID NO: 51252 - protein, 11 aa, Mycobacterium tuberculosis
ELNNALQNLAR

SEQ ID NO: 51253 - protein, 11 aa, Mycobacterium tuberculosis
LNNALQNLART

SEQ ID NO: 51254 - protein, 11 aa, Mycobacterium tuberculosis
NNALQNLARTI

SEQ ID NO: 51255 - protein, 11 aa, Mycobacterium tuberculosis
NALQNLARTIS

SEQ ID NO: 51256 - protein, 11 aa, Mycobacterium tuberculosis
ALQNLARTISE

SEQ ID NO: 51257 - protein, 11 aa, Mycobacterium tuberculosis
LQNLARTISEA

SEQ ID NO: 51258 - protein, 11 aa, Mycobacterium tuberculosis
QNLARTISEAG

SEQ ID NO: 51259 - protein, 11 aa, Mycobacterium tuberculosis
NLARTISEAGQ

SEQ ID NO: 51260 - protein, 11 aa, Mycobacterium tuberculosis
LARTISEAGQA

SEQ ID NO: 51261 - protein, 11 aa, Mycobacterium tuberculosis
ARTISEAGQAM

SEQ ID NO: 51262 - protein, 11 aa, Mycobacterium tuberculosis
RTISEAGQAMA

SEQ ID NO: 51263 - protein, 11 aa, Mycobacterium tuberculosis
TISEAGQAMAS

SEQ ID NO: 51264 - protein, 11 aa, Mycobacterium tuberculosis
ISEAGQAMAST

SEQ ID NO: 51265 - protein, 11 aa, Mycobacterium tuberculosis
SEAGQAMASTE

SEQ ID NO: 51266 - protein, 11 aa, Mycobacterium tuberculosis
EAGQAMASTEG

SEQ ID NO: 51267 - protein, 11 aa, Mycobacterium tuberculosis
AGQAMASTEGN

SEQ ID NO: 51268 - protein, 11 aa, Mycobacterium tuberculosis
GQAMASTEGNV

SEQ ID NO: 51269 - protein, 11 aa, Mycobacterium tuberculosis
QAMASTEGNVT

SEQ ID NO: 51270 - protein, 11 aa, Mycobacterium tuberculosis
AMASTEGNVTG

SEQ ID NO: 51271 - protein, 11 aa, Mycobacterium tuberculosis
MASTEGNVTGM

SEQ ID NO: 51272 - protein, 11 aa, Mycobacterium tuberculosis
ASTEGNVTGMF

SEQ ID NO: 51273 - protein, 11 aa, Mycobacterium tuberculosis
STEGNVTGMFA

SEQ ID NO: 51274 - protein, 8 aa, Mycobacterium tuberculosis
MAEPLAVD

SEQ ID NO: 51275 - protein, 8 aa, Mycobacterium tuberculosis
AEPLAVDP

SEQ ID NO: 51276 - protein, 8 aa, Mycobacterium tuberculosis
EPLAVDPT

SEQ ID NO: 51277 - protein, 8 aa, Mycobacterium tuberculosis
PLAVDPTG

SEQ ID NO: 51278 - protein, 8 aa, Mycobacterium tuberculosis
LAVDPTGL

SEQ ID NO: 51279 - protein, 8 aa, Mycobacterium tuberculosis
AVDPTGLS

SEQ ID NO: 51280 - protein, 8 aa, Mycobacterium tuberculosis
VDPTGLSA

SEQ ID NO: 51281 - protein, 8 aa, Mycobacterium tuberculosis
DPTGLSAA

SEQ ID NO: 51282 - protein, 8 aa, Mycobacterium tuberculosis
PTGLSAAA

SEQ ID NO: 51283 - protein, 8 aa, Mycobacterium tuberculosis
TGLSAAAA

SEQ ID NO: 51284 - protein, 8 aa, Mycobacterium tuberculosis
GLSAAAAK

SEQ ID NO: 51285 - protein, 8 aa, Mycobacterium tuberculosis
LSAAAAKL

SEQ ID NO: 51286 - protein, 8 aa, Mycobacterium tuberculosis
SAAAAKLA

SEQ ID NO: 51287 - protein, 8 aa, Mycobacterium tuberculosis
AAAAKLAG

SEQ ID NO: 51288 - protein, 8 aa, Mycobacterium tuberculosis
AAAKLAGL

SEQ ID NO: 51289 - protein, 8 aa, Mycobacterium tuberculosis
AAKLAGLV

SEQ ID NO: 51290 - protein, 8 aa, Mycobacterium tuberculosis
AKLAGLVF

SEQ ID NO: 51291 - protein, 8 aa, Mycobacterium tuberculosis
KLAGLVFP

SEQ ID NO: 51292 - protein, 8 aa, Mycobacterium tuberculosis
LAGLVFPQ

SEQ ID NO: 51293 - protein, 8 aa, Mycobacterium tuberculosis
AGLVFPQP

SEQ ID NO: 51294 - protein, 8 aa, Mycobacterium tuberculosis
GLVFPQPP

SEQ ID NO: 51295 - protein, 8 aa, Mycobacterium tuberculosis
LVFPQPPA

SEQ ID NO: 51296 - protein, 8 aa, Mycobacterium tuberculosis
VFPQPPAP

SEQ ID NO: 51297 - protein, 8 aa, Mycobacterium tuberculosis
FPQPPAPI

SEQ ID NO: 51298 - protein, 8 aa, Mycobacterium tuberculosis
PQPPAPIA

SEQ ID NO: 51299 - protein, 8 aa, Mycobacterium tuberculosis
QPPAPIAV

SEQ ID NO: 51300 - protein, 8 aa, Mycobacterium tuberculosis
PPAPIAVS

SEQ ID NO: 51301 - protein, 8 aa, Mycobacterium tuberculosis
PAPIAVSG

SEQ ID NO: 51302 - protein, 8 aa, Mycobacterium tuberculosis
APIAVSGT

SEQ ID NO: 51303 - protein, 8 aa, Mycobacterium tuberculosis
PIAVSGTD

SEQ ID NO: 51304 - protein, 8 aa, Mycobacterium tuberculosis
IAVSGTDS

SEQ ID NO: 51305 - protein, 8 aa, Mycobacterium tuberculosis
AVSGTDSV

SEQ ID NO: 51306 - protein, 8 aa, Mycobacterium tuberculosis
VSGTDSVV

SEQ ID NO: 51307 - protein, 8 aa, Mycobacterium tuberculosis
SGTDSVVA

SEQ ID NO: 51308 - protein, 8 aa, Mycobacterium tuberculosis
GTDSVVAA

SEQ ID NO: 51309 - protein, 8 aa, Mycobacterium tuberculosis
TDSVVAAI

SEQ ID NO: 51310 - protein, 8 aa, Mycobacterium tuberculosis
DSVVAAIN

SEQ ID NO: 51311 - protein, 8 aa, Mycobacterium tuberculosis
SVVAAINE

SEQ ID NO: 51312 - protein, 8 aa, Mycobacterium tuberculosis
VVAAINET

SEQ ID NO: 51313 - protein, 8 aa, Mycobacterium tuberculosis
VAAINETM

SEQ ID NO: 51314 - protein, 8 aa, Mycobacterium tuberculosis
AAINETMP

SEQ ID NO: 51315 - protein, 8 aa, Mycobacterium tuberculosis
AINETMPS

SEQ ID NO: 51316 - protein, 8 aa, Mycobacterium tuberculosis
INETMPSI

SEQ ID NO: 51317 - protein, 8 aa, Mycobacterium tuberculosis
NETMPSIE

SEQ ID NO: 51318 - protein, 8 aa, Mycobacterium tuberculosis
ETMPSIES

SEQ ID NO: 51319 - protein, 8 aa, Mycobacterium tuberculosis
TMPSIESL

SEQ ID NO: 51320 - protein, 8 aa, Mycobacterium tuberculosis
MPSIESLV

SEQ ID NO: 51321 - protein, 8 aa, Mycobacterium tuberculosis
PSIESLVS

SEQ ID NO: 51322 - protein, 8 aa, Mycobacterium tuberculosis
SIESLVSD

SEQ ID NO: 51323 - protein, 8 aa, Mycobacterium tuberculosis
IESLVSDG

SEQ ID NO: 51324 - protein, 8 aa, Mycobacterium tuberculosis
ESLVSDGL

SEQ ID NO: 51325 - protein, 8 aa, Mycobacterium tuberculosis
SLVSDGLP

SEQ ID NO: 51326 - protein, 8 aa, Mycobacterium tuberculosis
LVSDGLPG

SEQ ID NO: 51327 - protein, 8 aa, Mycobacterium tuberculosis
VSDGLPGV

SEQ ID NO: 51328 - protein, 8 aa, Mycobacterium tuberculosis
SDGLPGVK

SEQ ID NO: 51329 - protein, 8 aa, Mycobacterium tuberculosis
DGLPGVKA

SEQ ID NO: 51330 - protein, 8 aa, Mycobacterium tuberculosis
GLPGVKAA

SEQ ID NO: 51331 - protein, 8 aa, Mycobacterium tuberculosis
LPGVKAAL

SEQ ID NO: 51332 - protein, 8 aa, Mycobacterium tuberculosis
PGVKAALT

SEQ ID NO: 51333 - protein, 8 aa, Mycobacterium tuberculosis
GVKAALTR

SEQ ID NO: 51334 - protein, 8 aa, Mycobacterium tuberculosis
VKAALTRT

SEQ ID NO: 51335 - protein, 8 aa, Mycobacterium tuberculosis
KAALTRTA

SEQ ID NO: 51336 - protein, 8 aa, Mycobacterium tuberculosis
AALTRTAS

SEQ ID NO: 51337 - protein, 8 aa, Mycobacterium tuberculosis
ALTRTASN

SEQ ID NO: 51338 - protein, 8 aa, Mycobacterium tuberculosis
LTRTASNM

SEQ ID NO: 51339 - protein, 8 aa, Mycobacterium tuberculosis
TRTASNMN

SEQ ID NO: 51340 - protein, 8 aa, Mycobacterium tuberculosis
RTASNMNA

SEQ ID NO: 51341 - protein, 8 aa, Mycobacterium tuberculosis
TASNMNAA

SEQ ID NO: 51342 - protein, 8 aa, Mycobacterium tuberculosis
ASNMNAAA

SEQ ID NO: 51343 - protein, 8 aa, Mycobacterium tuberculosis
SNMNAAAD

SEQ ID NO: 51344 - protein, 8 aa, Mycobacterium tuberculosis
NMNAAADV

SEQ ID NO: 51345 - protein, 8 aa, Mycobacterium tuberculosis
MNAAADVY

SEQ ID NO: 51346 - protein, 8 aa, Mycobacterium tuberculosis
NAAADVYA

SEQ ID NO: 51347 - protein, 8 aa, Mycobacterium tuberculosis
AAADVYAK

SEQ ID NO: 51348 - protein, 8 aa, Mycobacterium tuberculosis
AADVYAKT

SEQ ID NO: 51349 - protein, 8 aa, Mycobacterium tuberculosis
ADVYAKTD

SEQ ID NO: 51350 - protein, 8 aa, Mycobacterium tuberculosis
DVYAKTDQ

SEQ ID NO: 51351 - protein, 8 aa, Mycobacterium tuberculosis
VYAKTDQS

SEQ ID NO: 51352 - protein, 8 aa, Mycobacterium tuberculosis
YAKTDQSL

SEQ ID NO: 51353 - protein, 8 aa, Mycobacterium tuberculosis
AKTDQSLG

SEQ ID NO: 51354 - protein, 8 aa, Mycobacterium tuberculosis
KTDQSLGT

SEQ ID NO: 51355 - protein, 8 aa, Mycobacterium tuberculosis
TDQSLGTS

SEQ ID NO: 51356 - protein, 8 aa, Mycobacterium tuberculosis
DQSLGTSL

SEQ ID NO: 51357 - protein, 8 aa, Mycobacterium tuberculosis
QSLGTSLS

SEQ ID NO: 51358 - protein, 8 aa, Mycobacterium tuberculosis
SLGTSLSQ

SEQ ID NO: 51359 - protein, 8 aa, Mycobacterium tuberculosis
LGTSLSQY

SEQ ID NO: 51360 - protein, 8 aa, Mycobacterium tuberculosis
GTSLSQYA

SEQ ID NO: 51361 - protein, 8 aa, Mycobacterium tuberculosis
TSLSQYAF

SEQ ID NO: 51362 - protein, 8 aa, Mycobacterium tuberculosis
SLSQYAFG

SEQ ID NO: 51363 - protein, 8 aa, Mycobacterium tuberculosis
LSQYAFGS

SEQ ID NO: 51364 - protein, 8 aa, Mycobacterium tuberculosis
SQYAFGSS

SEQ ID NO: 51365 - protein, 8 aa, Mycobacterium tuberculosis
QYAFGSSG

SEQ ID NO: 51366 - protein, 8 aa, Mycobacterium tuberculosis
YAFGSSGE

SEQ ID NO: 51367 - protein, 8 aa, Mycobacterium tuberculosis
AFGSSGEG

SEQ ID NO: 51368 - protein, 8 aa, Mycobacterium tuberculosis
FGSSGEGL

SEQ ID NO: 51369 - protein, 8 aa, Mycobacterium tuberculosis
GSSGEGLA

SEQ ID NO: 51370 - protein, 8 aa, Mycobacterium tuberculosis
SSGEGLAG

SEQ ID NO: 51371 - protein, 8 aa, Mycobacterium tuberculosis
SGEGLAGV

SEQ ID NO: 51372 - protein, 8 aa, Mycobacterium tuberculosis
GEGLAGVA

SEQ ID NO: 51373 - protein, 8 aa, Mycobacterium tuberculosis
EGLAGVAS

SEQ ID NO: 51374 - protein, 8 aa, Mycobacterium tuberculosis
GLAGVASV

SEQ ID NO: 51375 - protein, 8 aa, Mycobacterium tuberculosis
LAGVASVG

SEQ ID NO: 51376 - protein, 8 aa, Mycobacterium tuberculosis
AGVASVGG

SEQ ID NO: 51377 - protein, 8 aa, Mycobacterium tuberculosis
GVASVGGQ

SEQ ID NO: 51378 - protein, 8 aa, Mycobacterium tuberculosis
VASVGGQP

SEQ ID NO: 51379 - protein, 8 aa, Mycobacterium tuberculosis
ASVGGQPS

SEQ ID NO: 51380 - protein, 8 aa, Mycobacterium tuberculosis
SVGGQPSQ

SEQ ID NO: 51381 - protein, 8 aa, Mycobacterium tuberculosis
VGGQPSQA

SEQ ID NO: 51382 - protein, 8 aa, Mycobacterium tuberculosis
GGQPSQAT

SEQ ID NO: 51383 - protein, 8 aa, Mycobacterium tuberculosis
GQPSQATQ

SEQ ID NO: 51384 - protein, 8 aa, Mycobacterium tuberculosis
QPSQATQL

SEQ ID NO: 51385 - protein, 8 aa, Mycobacterium tuberculosis
PSQATQLL

SEQ ID NO: 51386 - protein, 8 aa, Mycobacterium tuberculosis
SQATQLLS

SEQ ID NO: 51387 - protein, 8 aa, Mycobacterium tuberculosis
QATQLLST

SEQ ID NO: 51388 - protein, 8 aa, Mycobacterium tuberculosis
ATQLLSTP

SEQ ID NO: 51389 - protein, 8 aa, Mycobacterium tuberculosis
TQLLSTPV

SEQ ID NO: 51390 - protein, 8 aa, Mycobacterium tuberculosis
QLLSTPVS

SEQ ID NO: 51391 - protein, 8 aa, Mycobacterium tuberculosis
LLSTPVSQ

SEQ ID NO: 51392 - protein, 8 aa, Mycobacterium tuberculosis
LSTPVSQV

SEQ ID NO: 51393 - protein, 8 aa, Mycobacterium tuberculosis
STPVSQVT

SEQ ID NO: 51394 - protein, 8 aa, Mycobacterium tuberculosis
TPVSQVTT

SEQ ID NO: 51395 - protein, 8 aa, Mycobacterium tuberculosis
PVSQVTTQ

SEQ ID NO: 51396 - protein, 8 aa, Mycobacterium tuberculosis
VSQVTTQL

SEQ ID NO: 51397 - protein, 8 aa, Mycobacterium tuberculosis
SQVTTQLG

SEQ ID NO: 51398 - protein, 8 aa, Mycobacterium tuberculosis
QVTTQLGE

SEQ ID NO: 51399 - protein, 8 aa, Mycobacterium tuberculosis
VTTQLGET

SEQ ID NO: 51400 - protein, 8 aa, Mycobacterium tuberculosis
TTQLGETA

SEQ ID NO: 51401 - protein, 8 aa, Mycobacterium tuberculosis
TQLGETAA

SEQ ID NO: 51402 - protein, 8 aa, Mycobacterium tuberculosis
QLGETAAE

SEQ ID NO: 51403 - protein, 8 aa, Mycobacterium tuberculosis
LGETAAEL

SEQ ID NO: 51404 - protein, 8 aa, Mycobacterium tuberculosis
GETAAELA

SEQ ID NO: 51405 - protein, 8 aa, Mycobacterium tuberculosis
ETAAELAP

SEQ ID NO: 51406 - protein, 8 aa, Mycobacterium tuberculosis
TAAELAPR

SEQ ID NO: 51407 - protein, 8 aa, Mycobacterium tuberculosis
AAELAPRV

SEQ ID NO: 51408 - protein, 8 aa, Mycobacterium tuberculosis
AELAPRVV

SEQ ID NO: 51409 - protein, 8 aa, Mycobacterium tuberculosis
ELAPRVVA

SEQ ID NO: 51410 - protein, 8 aa, Mycobacterium tuberculosis
LAPRVVAT

SEQ ID NO: 51411 - protein, 8 aa, Mycobacterium tuberculosis
APRVVATV

SEQ ID NO: 51412 - protein, 8 aa, Mycobacterium tuberculosis
PRVVATVP

SEQ ID NO: 51413 - protein, 8 aa, Mycobacterium tuberculosis
RVVATVPQ

SEQ ID NO: 51414 - protein, 8 aa, Mycobacterium tuberculosis
VVATVPQL

SEQ ID NO: 51415 - protein, 8 aa, Mycobacterium tuberculosis
VATVPQLV

SEQ ID NO: 51416 - protein, 8 aa, Mycobacterium tuberculosis
ATVPQLVQ

SEQ ID NO: 51417 - protein, 8 aa, Mycobacterium tuberculosis
TVPQLVQL

SEQ ID NO: 51418 - protein, 8 aa, Mycobacterium tuberculosis
VPQLVQLA

SEQ ID NO: 51419 - protein, 8 aa, Mycobacterium tuberculosis
PQLVQLAP

SEQ ID NO: 51420 - protein, 8 aa, Mycobacterium tuberculosis
QLVQLAPH

SEQ ID NO: 51421 - protein, 8 aa, Mycobacterium tuberculosis
LVQLAPHA

SEQ ID NO: 51422 - protein, 8 aa, Mycobacterium tuberculosis
VQLAPHAV

SEQ ID NO: 51423 - protein, 8 aa, Mycobacterium tuberculosis
QLAPHAVQ

SEQ ID NO: 51424 - protein, 8 aa, Mycobacterium tuberculosis
LAPHAVQM

SEQ ID NO: 51425 - protein, 8 aa, Mycobacterium tuberculosis
APHAVQMS

SEQ ID NO: 51426 - protein, 8 aa, Mycobacterium tuberculosis
PHAVQMSQ

SEQ ID NO: 51427 - protein, 8 aa, Mycobacterium tuberculosis
HAVQMSQN

SEQ ID NO: 51428 - protein, 8 aa, Mycobacterium tuberculosis
AVQMSQNA

SEQ ID NO: 51429 - protein, 8 aa, Mycobacterium tuberculosis
VQMSQNAS

SEQ ID NO: 51430 - protein, 8 aa, Mycobacterium tuberculosis
QMSQNASP

SEQ ID NO: 51431 - protein, 8 aa, Mycobacterium tuberculosis
MSQNASPI

SEQ ID NO: 51432 - protein, 8 aa, Mycobacterium tuberculosis
SQNASPIA

SEQ ID NO: 51433 - protein, 8 aa, Mycobacterium tuberculosis
QNASPIAQ

SEQ ID NO: 51434 - protein, 8 aa, Mycobacterium tuberculosis
NASPIAQT

SEQ ID NO: 51435 - protein, 8 aa, Mycobacterium tuberculosis
ASPIAQTI

SEQ ID NO: 51436 - protein, 8 aa, Mycobacterium tuberculosis
SPIAQTIS

SEQ ID NO: 51437 - protein, 8 aa, Mycobacterium tuberculosis
PIAQTISQ

SEQ ID NO: 51438 - protein, 8 aa, Mycobacterium tuberculosis
IAQTISQT

SEQ ID NO: 51439 - protein, 8 aa, Mycobacterium tuberculosis
AQTISQTA

SEQ ID NO: 51440 - protein, 8 aa, Mycobacterium tuberculosis
QTISQTAQ

SEQ ID NO: 51441 - protein, 8 aa, Mycobacterium tuberculosis
TISQTAQQ

SEQ ID NO: 51442 - protein, 8 aa, Mycobacterium tuberculosis
ISQTAQQA

SEQ ID NO: 51443 - protein, 8 aa, Mycobacterium tuberculosis
SQTAQQAA

SEQ ID NO: 51444 - protein, 8 aa, Mycobacterium tuberculosis
QTAQQAAQ

SEQ ID NO: 51445 - protein, 8 aa, Mycobacterium tuberculosis
TAQQAAQS

SEQ ID NO: 51446 - protein, 8 aa, Mycobacterium tuberculosis
AQQAAQSA

SEQ ID NO: 51447 - protein, 8 aa, Mycobacterium tuberculosis
QQAAQSAQ

SEQ ID NO: 51448 - protein, 8 aa, Mycobacterium tuberculosis
QAAQSAQG

SEQ ID NO: 51449 - protein, 8 aa, Mycobacterium tuberculosis
AAQSAQGG

SEQ ID NO: 51450 - protein, 8 aa, Mycobacterium tuberculosis
AQSAQGGS

SEQ ID NO: 51451 - protein, 8 aa, Mycobacterium tuberculosis
QSAQGGSG

SEQ ID NO: 51452 - protein, 8 aa, Mycobacterium tuberculosis
SAQGGSGP

SEQ ID NO: 51453 - protein, 8 aa, Mycobacterium tuberculosis
AQGGSGPM

SEQ ID NO: 51454 - protein, 8 aa, Mycobacterium tuberculosis
QGGSGPMP

SEQ ID NO: 51455 - protein, 8 aa, Mycobacterium tuberculosis
GGSGPMPA

SEQ ID NO: 51456 - protein, 8 aa, Mycobacterium tuberculosis
GSGPMPAQ

SEQ ID NO: 51457 - protein, 8 aa, Mycobacterium tuberculosis
SGPMPAQL

SEQ ID NO: 51458 - protein, 8 aa, Mycobacterium tuberculosis
GPMPAQLA

SEQ ID NO: 51459 - protein, 8 aa, Mycobacterium tuberculosis
PMPAQLAS

SEQ ID NO: 51460 - protein, 8 aa, Mycobacterium tuberculosis
MPAQLASA

SEQ ID NO: 51461 - protein, 8 aa, Mycobacterium tuberculosis
PAQLASAE

SEQ ID NO: 51462 - protein, 8 aa, Mycobacterium tuberculosis
AQLASAEK

SEQ ID NO: 51463 - protein, 8 aa, Mycobacterium tuberculosis
QLASAEKP

SEQ ID NO: 51464 - protein, 8 aa, Mycobacterium tuberculosis
LASAEKPA

SEQ ID NO: 51465 - protein, 8 aa, Mycobacterium tuberculosis
ASAEKPAT

SEQ ID NO: 51466 - protein, 8 aa, Mycobacterium tuberculosis
SAEKPATE

SEQ ID NO: 51467 - protein, 8 aa, Mycobacterium tuberculosis
AEKPATEQ

SEQ ID NO: 51468 - protein, 8 aa, Mycobacterium tuberculosis
EKPATEQA

SEQ ID NO: 51469 - protein, 8 aa, Mycobacterium tuberculosis
KPATEQAE

SEQ ID NO: 51470 - protein, 8 aa, Mycobacterium tuberculosis
PATEQAEP

SEQ ID NO: 51471 - protein, 8 aa, Mycobacterium tuberculosis
ATEQAEPV

SEQ ID NO: 51472 - protein, 8 aa, Mycobacterium tuberculosis
TEQAEPVH

SEQ ID NO: 51473 - protein, 8 aa, Mycobacterium tuberculosis
EQAEPVHE

SEQ ID NO: 51474 - protein, 8 aa, Mycobacterium tuberculosis
QAEPVHEV

SEQ ID NO: 51475 - protein, 8 aa, Mycobacterium tuberculosis
AEPVHEVT

SEQ ID NO: 51476 - protein, 8 aa, Mycobacterium tuberculosis
EPVHEVTN

SEQ ID NO: 51477 - protein, 8 aa, Mycobacterium tuberculosis
PVHEVTND

SEQ ID NO: 51478 - protein, 8 aa, Mycobacterium tuberculosis
VHEVTNDD

SEQ ID NO: 51479 - protein, 8 aa, Mycobacterium tuberculosis
HEVTNDDQ

SEQ ID NO: 51480 - protein, 8 aa, Mycobacterium tuberculosis
EVTNDDQG

SEQ ID NO: 51481 - protein, 8 aa, Mycobacterium tuberculosis
VTNDDQGD

SEQ ID NO: 51482 - protein, 8 aa, Mycobacterium tuberculosis
TNDDQGDQ

SEQ ID NO: 51483 - protein, 8 aa, Mycobacterium tuberculosis
NDDQGDQG

SEQ ID NO: 51484 - protein, 8 aa, Mycobacterium tuberculosis
DDQGDQGD

SEQ ID NO: 51485 - protein, 8 aa, Mycobacterium tuberculosis
DQGDQGDV

SEQ ID NO: 51486 - protein, 8 aa, Mycobacterium tuberculosis
QGDQGDVQ

SEQ ID NO: 51487 - protein, 8 aa, Mycobacterium tuberculosis
GDQGDVQP

SEQ ID NO: 51488 - protein, 8 aa, Mycobacterium tuberculosis
DQGDVQPA

SEQ ID NO: 51489 - protein, 8 aa, Mycobacterium tuberculosis
QGDVQPAE

SEQ ID NO: 51490 - protein, 8 aa, Mycobacterium tuberculosis
GDVQPAEV

SEQ ID NO: 51491 - protein, 8 aa, Mycobacterium tuberculosis
DVQPAEVV

SEQ ID NO: 51492 - protein, 8 aa, Mycobacterium tuberculosis
VQPAEVVA

SEQ ID NO: 51493 - protein, 8 aa, Mycobacterium tuberculosis
QPAEVVAA

SEQ ID NO: 51494 - protein, 8 aa, Mycobacterium tuberculosis
PAEVVAAA

SEQ ID NO: 51495 - protein, 8 aa, Mycobacterium tuberculosis
AEVVAAAR

SEQ ID NO: 51496 - protein, 8 aa, Mycobacterium tuberculosis
EVVAAARD

SEQ ID NO: 51497 - protein, 8 aa, Mycobacterium tuberculosis
VVAAARDE

SEQ ID NO: 51498 - protein, 8 aa, Mycobacterium tuberculosis
VAAARDEG

SEQ ID NO: 51499 - protein, 8 aa, Mycobacterium tuberculosis
AAARDEGA

SEQ ID NO: 51500 - protein, 8 aa, Mycobacterium tuberculosis
AARDEGAG

SEQ ID NO: 51501 - protein, 8 aa, Mycobacterium tuberculosis
ARDEGAGA

SEQ ID NO: 51502 - protein, 8 aa, Mycobacterium tuberculosis
RDEGAGAS

SEQ ID NO: 51503 - protein, 8 aa, Mycobacterium tuberculosis
DEGAGASP

SEQ ID NO: 51504 - protein, 8 aa, Mycobacterium tuberculosis
EGAGASPG

SEQ ID NO: 51505 - protein, 8 aa, Mycobacterium tuberculosis
GAGASPGQ

SEQ ID NO: 51506 - protein, 8 aa, Mycobacterium tuberculosis
AGASPGQQ

SEQ ID NO: 51507 - protein, 8 aa, Mycobacterium tuberculosis
GASPGQQP

SEQ ID NO: 51508 - protein, 8 aa, Mycobacterium tuberculosis
ASPGQQPG

SEQ ID NO: 51509 - protein, 8 aa, Mycobacterium tuberculosis
SPGQQPGG

SEQ ID NO: 51510 - protein, 8 aa, Mycobacterium tuberculosis
PGQQPGGG

SEQ ID NO: 51511 - protein, 8 aa, Mycobacterium tuberculosis
GQQPGGGV

SEQ ID NO: 51512 - protein, 8 aa, Mycobacterium tuberculosis
QQPGGGVP

SEQ ID NO: 51513 - protein, 8 aa, Mycobacterium tuberculosis
QPGGGVPA

SEQ ID NO: 51514 - protein, 8 aa, Mycobacterium tuberculosis
PGGGVPAQ

SEQ ID NO: 51515 - protein, 8 aa, Mycobacterium tuberculosis
GGGVPAQA

SEQ ID NO: 51516 - protein, 8 aa, Mycobacterium tuberculosis
GGVPAQAM

SEQ ID NO: 51517 - protein, 8 aa, Mycobacterium tuberculosis
GVPAQAMD

SEQ ID NO: 51518 - protein, 8 aa, Mycobacterium tuberculosis
VPAQAMDT

SEQ ID NO: 51519 - protein, 8 aa, Mycobacterium tuberculosis
PAQAMDTG

SEQ ID NO: 51520 - protein, 8 aa, Mycobacterium tuberculosis
AQAMDTGA

SEQ ID NO: 51521 - protein, 8 aa, Mycobacterium tuberculosis
QAMDTGAG

SEQ ID NO: 51522 - protein, 8 aa, Mycobacterium tuberculosis
AMDTGAGA

SEQ ID NO: 51523 - protein, 8 aa, Mycobacterium tuberculosis
MDTGAGAR

SEQ ID NO: 51524 - protein, 8 aa, Mycobacterium tuberculosis
DTGAGARP

SEQ ID NO: 51525 - protein, 8 aa, Mycobacterium tuberculosis
TGAGARPA

SEQ ID NO: 51526 - protein, 8 aa, Mycobacterium tuberculosis
GAGARPAA

SEQ ID NO: 51527 - protein, 8 aa, Mycobacterium tuberculosis
AGARPAAS

SEQ ID NO: 51528 - protein, 8 aa, Mycobacterium tuberculosis
GARPAASP

SEQ ID NO: 51529 - protein, 8 aa, Mycobacterium tuberculosis
ARPAASPL

SEQ ID NO: 51530 - protein, 8 aa, Mycobacterium tuberculosis
RPAASPLA

SEQ ID NO: 51531 - protein, 8 aa, Mycobacterium tuberculosis
PAASPLAA

SEQ ID NO: 51532 - protein, 8 aa, Mycobacterium tuberculosis
AASPLAAP

SEQ ID NO: 51533 - protein, 8 aa, Mycobacterium tuberculosis
ASPLAAPV

SEQ ID NO: 51534 - protein, 8 aa, Mycobacterium tuberculosis
SPLAAPVD

SEQ ID NO: 51535 - protein, 8 aa, Mycobacterium tuberculosis
PLAAPVDP

SEQ ID NO: 51536 - protein, 8 aa, Mycobacterium tuberculosis
LAAPVDPS

SEQ ID NO: 51537 - protein, 8 aa, Mycobacterium tuberculosis
AAPVDPST

SEQ ID NO: 51538 - protein, 8 aa, Mycobacterium tuberculosis
APVDPSTP

SEQ ID NO: 51539 - protein, 8 aa, Mycobacterium tuberculosis
PVDPSTPA

SEQ ID NO: 51540 - protein, 8 aa, Mycobacterium tuberculosis
VDPSTPAP

SEQ ID NO: 51541 - protein, 8 aa, Mycobacterium tuberculosis
DPSTPAPS

SEQ ID NO: 51542 - protein, 8 aa, Mycobacterium tuberculosis
PSTPAPST

SEQ ID NO: 51543 - protein, 8 aa, Mycobacterium tuberculosis
STPAPSTT

SEQ ID NO: 51544 - protein, 8 aa, Mycobacterium tuberculosis
TPAPSTTT

SEQ ID NO: 51545 - protein, 8 aa, Mycobacterium tuberculosis
PAPSTTTT

SEQ ID NO: 51546 - protein, 8 aa, Mycobacterium tuberculosis
APSTTTTL

SEQ ID NO: 51547 - protein, 9 aa, Mycobacterium tuberculosis
MAEPLAVDP

SEQ ID NO: 51548 - protein, 9 aa, Mycobacterium tuberculosis
AEPLAVDPT

SEQ ID NO: 51549 - protein, 9 aa, Mycobacterium tuberculosis
EPLAVDPTG

SEQ ID NO: 51550 - protein, 9 aa, Mycobacterium tuberculosis
PLAVDPTGL

SEQ ID NO: 51551 - protein, 9 aa, Mycobacterium tuberculosis
LAVDPTGLS

SEQ ID NO: 51552 - protein, 9 aa, Mycobacterium tuberculosis
AVDPTGLSA

SEQ ID NO: 51553 - protein, 9 aa, Mycobacterium tuberculosis
VDPTGLSAA

SEQ ID NO: 51554 - protein, 9 aa, Mycobacterium tuberculosis
DPTGLSAAA

SEQ ID NO: 51555 - protein, 9 aa, Mycobacterium tuberculosis
PTGLSAAAA

SEQ ID NO: 51556 - protein, 9 aa, Mycobacterium tuberculosis
TGLSAAAAK

SEQ ID NO: 51557 - protein, 9 aa, Mycobacterium tuberculosis
GLSAAAAKL

SEQ ID NO: 51558 - protein, 9 aa, Mycobacterium tuberculosis
LSAAAAKLA

SEQ ID NO: 51559 - protein, 9 aa, Mycobacterium tuberculosis
SAAAAKLAG

SEQ ID NO: 51560 - protein, 9 aa, Mycobacterium tuberculosis
AAAAKLAGL

SEQ ID NO: 51561 - protein, 9 aa, Mycobacterium tuberculosis
AAAKLAGLV

SEQ ID NO: 51562 - protein, 9 aa, Mycobacterium tuberculosis
AAKLAGLVF

SEQ ID NO: 51563 - protein, 9 aa, Mycobacterium tuberculosis
AKLAGLVFP

SEQ ID NO: 51564 - protein, 9 aa, Mycobacterium tuberculosis
KLAGLVFPQ

SEQ ID NO: 51565 - protein, 9 aa, Mycobacterium tuberculosis
LAGLVFPQP

SEQ ID NO: 51566 - protein, 9 aa, Mycobacterium tuberculosis
AGLVFPQPP

SEQ ID NO: 51567 - protein, 9 aa, Mycobacterium tuberculosis
GLVFPQPPA

SEQ ID NO: 51568 - protein, 9 aa, Mycobacterium tuberculosis
LVFPQPPAP

SEQ ID NO: 51569 - protein, 9 aa, Mycobacterium tuberculosis
VFPQPPAPI

SEQ ID NO: 51570 - protein, 9 aa, Mycobacterium tuberculosis
FPQPPAPIA

SEQ ID NO: 51571 - protein, 9 aa, Mycobacterium tuberculosis
PQPPAPIAV

SEQ ID NO: 51572 - protein, 9 aa, Mycobacterium tuberculosis
QPPAPIAVS

SEQ ID NO: 51573 - protein, 9 aa, Mycobacterium tuberculosis
PPAPIAVSG

SEQ ID NO: 51574 - protein, 9 aa, Mycobacterium tuberculosis
PAPIAVSGT

SEQ ID NO: 51575 - protein, 9 aa, Mycobacterium tuberculosis
APIAVSGTD

SEQ ID NO: 51576 - protein, 9 aa, Mycobacterium tuberculosis
PIAVSGTDS

SEQ ID NO: 51577 - protein, 9 aa, Mycobacterium tuberculosis
IAVSGTDSV

SEQ ID NO: 51578 - protein, 9 aa, Mycobacterium tuberculosis
AVSGTDSVV

SEQ ID NO: 51579 - protein, 9 aa, Mycobacterium tuberculosis
VSGTDSVVA

SEQ ID NO: 51580 - protein, 9 aa, Mycobacterium tuberculosis
SGTDSVVAA

SEQ ID NO: 51581 - protein, 9 aa, Mycobacterium tuberculosis
GTDSVVAAI

SEQ ID NO: 51582 - protein, 9 aa, Mycobacterium tuberculosis
TDSVVAAIN

SEQ ID NO: 51583 - protein, 9 aa, Mycobacterium tuberculosis
DSVVAAINE

SEQ ID NO: 51584 - protein, 9 aa, Mycobacterium tuberculosis
SVVAAINET

SEQ ID NO: 51585 - protein, 9 aa, Mycobacterium tuberculosis
VVAAINETM

SEQ ID NO: 51586 - protein, 9 aa, Mycobacterium tuberculosis
VAAINETMP

SEQ ID NO: 51587 - protein, 9 aa, Mycobacterium tuberculosis
AAINETMPS

SEQ ID NO: 51588 - protein, 9 aa, Mycobacterium tuberculosis
AINETMPSI

SEQ ID NO: 51589 - protein, 9 aa, Mycobacterium tuberculosis
INETMPSIE

SEQ ID NO: 51590 - protein, 9 aa, Mycobacterium tuberculosis
NETMPSIES

SEQ ID NO: 51591 - protein, 9 aa, Mycobacterium tuberculosis
ETMPSIESL

SEQ ID NO: 51592 - protein, 9 aa, Mycobacterium tuberculosis
TMPSIESLV

SEQ ID NO: 51593 - protein, 9 aa, Mycobacterium tuberculosis
MPSIESLVS

SEQ ID NO: 51594 - protein, 9 aa, Mycobacterium tuberculosis
PSIESLVSD

SEQ ID NO: 51595 - protein, 9 aa, Mycobacterium tuberculosis
SIESLVSDG

SEQ ID NO: 51596 - protein, 9 aa, Mycobacterium tuberculosis
IESLVSDGL

SEQ ID NO: 51597 - protein, 9 aa, Mycobacterium tuberculosis
ESLVSDGLP

SEQ ID NO: 51598 - protein, 9 aa, Mycobacterium tuberculosis
SLVSDGLPG

SEQ ID NO: 51599 - protein, 9 aa, Mycobacterium tuberculosis
LVSDGLPGV

SEQ ID NO: 51600 - protein, 9 aa, Mycobacterium tuberculosis
VSDGLPGVK

SEQ ID NO: 51601 - protein, 9 aa, Mycobacterium tuberculosis
SDGLPGVKA

SEQ ID NO: 51602 - protein, 9 aa, Mycobacterium tuberculosis
DGLPGVKAA

SEQ ID NO: 51603 - protein, 9 aa, Mycobacterium tuberculosis
GLPGVKAAL

SEQ ID NO: 51604 - protein, 9 aa, Mycobacterium tuberculosis
LPGVKAALT

SEQ ID NO: 51605 - protein, 9 aa, Mycobacterium tuberculosis
PGVKAALTR

SEQ ID NO: 51606 - protein, 9 aa, Mycobacterium tuberculosis
GVKAALTRT

SEQ ID NO: 51607 - protein, 9 aa, Mycobacterium tuberculosis
VKAALTRTA

SEQ ID NO: 51608 - protein, 9 aa, Mycobacterium tuberculosis
KAALTRTAS

SEQ ID NO: 51609 - protein, 9 aa, Mycobacterium tuberculosis
AALTRTASN

SEQ ID NO: 51610 - protein, 9 aa, Mycobacterium tuberculosis
ALTRTASNM

SEQ ID NO: 51611 - protein, 9 aa, Mycobacterium tuberculosis
LTRTASNMN

SEQ ID NO: 51612 - protein, 9 aa, Mycobacterium tuberculosis
TRTASNMNA

SEQ ID NO: 51613 - protein, 9 aa, Mycobacterium tuberculosis
RTASNMNAA

SEQ ID NO: 51614 - protein, 9 aa, Mycobacterium tuberculosis
TASNMNAAA

SEQ ID NO: 51615 - protein, 9 aa, Mycobacterium tuberculosis
ASNMNAAAD

SEQ ID NO: 51616 - protein, 9 aa, Mycobacterium tuberculosis
SNMNAAADV

SEQ ID NO: 51617 - protein, 9 aa, Mycobacterium tuberculosis
NMNAAADVY

SEQ ID NO: 51618 - protein, 9 aa, Mycobacterium tuberculosis
MNAAADVYA

SEQ ID NO: 51619 - protein, 9 aa, Mycobacterium tuberculosis
NAAADVYAK

SEQ ID NO: 51620 - protein, 9 aa, Mycobacterium tuberculosis
AAADVYAKT

SEQ ID NO: 51621 - protein, 9 aa, Mycobacterium tuberculosis
AADVYAKTD

SEQ ID NO: 51622 - protein, 9 aa, Mycobacterium tuberculosis
ADVYAKTDQ

SEQ ID NO: 51623 - protein, 9 aa, Mycobacterium tuberculosis
DVYAKTDQS

SEQ ID NO: 51624 - protein, 9 aa, Mycobacterium tuberculosis
VYAKTDQSL

SEQ ID NO: 51625 - protein, 9 aa, Mycobacterium tuberculosis
YAKTDQSLG

SEQ ID NO: 51626 - protein, 9 aa, Mycobacterium tuberculosis
AKTDQSLGT

SEQ ID NO: 51627 - protein, 9 aa, Mycobacterium tuberculosis
KTDQSLGTS

SEQ ID NO: 51628 - protein, 9 aa, Mycobacterium tuberculosis
TDQSLGTSL

SEQ ID NO: 51629 - protein, 9 aa, Mycobacterium tuberculosis
DQSLGTSLS

SEQ ID NO: 51630 - protein, 9 aa, Mycobacterium tuberculosis
QSLGTSLSQ

SEQ ID NO: 51631 - protein, 9 aa, Mycobacterium tuberculosis
SLGTSLSQY

SEQ ID NO: 51632 - protein, 9 aa, Mycobacterium tuberculosis
LGTSLSQYA

SEQ ID NO: 51633 - protein, 9 aa, Mycobacterium tuberculosis
GTSLSQYAF

SEQ ID NO: 51634 - protein, 9 aa, Mycobacterium tuberculosis
TSLSQYAFG

SEQ ID NO: 51635 - protein, 9 aa, Mycobacterium tuberculosis
SLSQYAFGS

SEQ ID NO: 51636 - protein, 9 aa, Mycobacterium tuberculosis
LSQYAFGSS

SEQ ID NO: 51637 - protein, 9 aa, Mycobacterium tuberculosis
SQYAFGSSG

SEQ ID NO: 51638 - protein, 9 aa, Mycobacterium tuberculosis
QYAFGSSGE

SEQ ID NO: 51639 - protein, 9 aa, Mycobacterium tuberculosis
YAFGSSGEG

SEQ ID NO: 51640 - protein, 9 aa, Mycobacterium tuberculosis
AFGSSGEGL

SEQ ID NO: 51641 - protein, 9 aa, Mycobacterium tuberculosis
FGSSGEGLA

SEQ ID NO: 51642 - protein, 9 aa, Mycobacterium tuberculosis
GSSGEGLAG

SEQ ID NO: 51643 - protein, 9 aa, Mycobacterium tuberculosis
SSGEGLAGV

SEQ ID NO: 51644 - protein, 9 aa, Mycobacterium tuberculosis
SGEGLAGVA

SEQ ID NO: 51645 - protein, 9 aa, Mycobacterium tuberculosis
GEGLAGVAS

SEQ ID NO: 51646 - protein, 9 aa, Mycobacterium tuberculosis
EGLAGVASV

SEQ ID NO: 51647 - protein, 9 aa, Mycobacterium tuberculosis
GLAGVASVG

SEQ ID NO: 51648 - protein, 9 aa, Mycobacterium tuberculosis
LAGVASVGG

SEQ ID NO: 51649 - protein, 9 aa, Mycobacterium tuberculosis
AGVASVGGQ

SEQ ID NO: 51650 - protein, 9 aa, Mycobacterium tuberculosis
GVASVGGQP

SEQ ID NO: 51651 - protein, 9 aa, Mycobacterium tuberculosis
VASVGGQPS

SEQ ID NO: 51652 - protein, 9 aa, Mycobacterium tuberculosis
ASVGGQPSQ

SEQ ID NO: 51653 - protein, 9 aa, Mycobacterium tuberculosis
SVGGQPSQA

SEQ ID NO: 51654 - protein, 9 aa, Mycobacterium tuberculosis
VGGQPSQAT

SEQ ID NO: 51655 - protein, 9 aa, Mycobacterium tuberculosis
GGQPSQATQ

SEQ ID NO: 51656 - protein, 9 aa, Mycobacterium tuberculosis
GQPSQATQL

SEQ ID NO: 51657 - protein, 9 aa, Mycobacterium tuberculosis
QPSQATQLL

SEQ ID NO: 51658 - protein, 9 aa, Mycobacterium tuberculosis
PSQATQLLS

SEQ ID NO: 51659 - protein, 9 aa, Mycobacterium tuberculosis
SQATQLLST

SEQ ID NO: 51660 - protein, 9 aa, Mycobacterium tuberculosis
QATQLLSTP

SEQ ID NO: 51661 - protein, 9 aa, Mycobacterium tuberculosis
ATQLLSTPV

SEQ ID NO: 51662 - protein, 9 aa, Mycobacterium tuberculosis
TQLLSTPVS

SEQ ID NO: 51663 - protein, 9 aa, Mycobacterium tuberculosis
QLLSTPVSQ

SEQ ID NO: 51664 - protein, 9 aa, Mycobacterium tuberculosis
LLSTPVSQV

SEQ ID NO: 51665 - protein, 9 aa, Mycobacterium tuberculosis
LSTPVSQVT

SEQ ID NO: 51666 - protein, 9 aa, Mycobacterium tuberculosis
STPVSQVTT

SEQ ID NO: 51667 - protein, 9 aa, Mycobacterium tuberculosis
TPVSQVTTQ

SEQ ID NO: 51668 - protein, 9 aa, Mycobacterium tuberculosis
PVSQVTTQL

SEQ ID NO: 51669 - protein, 9 aa, Mycobacterium tuberculosis
VSQVTTQLG

SEQ ID NO: 51670 - protein, 9 aa, Mycobacterium tuberculosis
SQVTTQLGE

SEQ ID NO: 51671 - protein, 9 aa, Mycobacterium tuberculosis
QVTTQLGET

SEQ ID NO: 51672 - protein, 9 aa, Mycobacterium tuberculosis
VTTQLGETA

SEQ ID NO: 51673 - protein, 9 aa, Mycobacterium tuberculosis
TTQLGETAA

SEQ ID NO: 51674 - protein, 9 aa, Mycobacterium tuberculosis
TQLGETAAE

SEQ ID NO: 51675 - protein, 9 aa, Mycobacterium tuberculosis
QLGETAAEL

SEQ ID NO: 51676 - protein, 9 aa, Mycobacterium tuberculosis
LGETAAELA

SEQ ID NO: 51677 - protein, 9 aa, Mycobacterium tuberculosis
GETAAELAP

SEQ ID NO: 51678 - protein, 9 aa, Mycobacterium tuberculosis
ETAAELAPR

SEQ ID NO: 51679 - protein, 9 aa, Mycobacterium tuberculosis
TAAELAPRV

SEQ ID NO: 51680 - protein, 9 aa, Mycobacterium tuberculosis
AAELAPRVV

SEQ ID NO: 51681 - protein, 9 aa, Mycobacterium tuberculosis
AELAPRVVA

SEQ ID NO: 51682 - protein, 9 aa, Mycobacterium tuberculosis
ELAPRVVAT

SEQ ID NO: 51683 - protein, 9 aa, Mycobacterium tuberculosis
LAPRVVATV

SEQ ID NO: 51684 - protein, 9 aa, Mycobacterium tuberculosis
APRVVATVP

SEQ ID NO: 51685 - protein, 9 aa, Mycobacterium tuberculosis
PRVVATVPQ

SEQ ID NO: 51686 - protein, 9 aa, Mycobacterium tuberculosis
RVVATVPQL

SEQ ID NO: 51687 - protein, 9 aa, Mycobacterium tuberculosis
VVATVPQLV

SEQ ID NO: 51688 - protein, 9 aa, Mycobacterium tuberculosis
VATVPQLVQ

SEQ ID NO: 51689 - protein, 9 aa, Mycobacterium tuberculosis
ATVPQLVQL

SEQ ID NO: 51690 - protein, 9 aa, Mycobacterium tuberculosis
TVPQLVQLA

SEQ ID NO: 51691 - protein, 9 aa, Mycobacterium tuberculosis
VPQLVQLAP

SEQ ID NO: 51692 - protein, 9 aa, Mycobacterium tuberculosis
PQLVQLAPH

SEQ ID NO: 51693 - protein, 9 aa, Mycobacterium tuberculosis
QLVQLAPHA

SEQ ID NO: 51694 - protein, 9 aa, Mycobacterium tuberculosis
LVQLAPHAV

SEQ ID NO: 51695 - protein, 9 aa, Mycobacterium tuberculosis
VQLAPHAVQ

SEQ ID NO: 51696 - protein, 9 aa, Mycobacterium tuberculosis
QLAPHAVQM

SEQ ID NO: 51697 - protein, 9 aa, Mycobacterium tuberculosis
LAPHAVQMS

SEQ ID NO: 51698 - protein, 9 aa, Mycobacterium tuberculosis
APHAVQMSQ

SEQ ID NO: 51699 - protein, 9 aa, Mycobacterium tuberculosis
PHAVQMSQN

SEQ ID NO: 51700 - protein, 9 aa, Mycobacterium tuberculosis
HAVQMSQNA

SEQ ID NO: 51701 - protein, 9 aa, Mycobacterium tuberculosis
AVQMSQNAS

SEQ ID NO: 51702 - protein, 9 aa, Mycobacterium tuberculosis
VQMSQNASP

SEQ ID NO: 51703 - protein, 9 aa, Mycobacterium tuberculosis
QMSQNASPI

SEQ ID NO: 51704 - protein, 9 aa, Mycobacterium tuberculosis
MSQNASPIA

SEQ ID NO: 51705 - protein, 9 aa, Mycobacterium tuberculosis
SQNASPIAQ

SEQ ID NO: 51706 - protein, 9 aa, Mycobacterium tuberculosis
QNASPIAQT

SEQ ID NO: 51707 - protein, 9 aa, Mycobacterium tuberculosis
NASPIAQTI

SEQ ID NO: 51708 - protein, 9 aa, Mycobacterium tuberculosis
ASPIAQTIS

SEQ ID NO: 51709 - protein, 9 aa, Mycobacterium tuberculosis
SPIAQTISQ

SEQ ID NO: 51710 - protein, 9 aa, Mycobacterium tuberculosis
PIAQTISQT

SEQ ID NO: 51711 - protein, 9 aa, Mycobacterium tuberculosis
IAQTISQTA

SEQ ID NO: 51712 - protein, 9 aa, Mycobacterium tuberculosis
AQTISQTAQ

SEQ ID NO: 51713 - protein, 9 aa, Mycobacterium tuberculosis
QTISQTAQQ

SEQ ID NO: 51714 - protein, 9 aa, Mycobacterium tuberculosis
TISQTAQQA

SEQ ID NO: 51715 - protein, 9 aa, Mycobacterium tuberculosis
ISQTAQQAA

SEQ ID NO: 51716 - protein, 9 aa, Mycobacterium tuberculosis
SQTAQQAAQ

SEQ ID NO: 51717 - protein, 9 aa, Mycobacterium tuberculosis
QTAQQAAQS

SEQ ID NO: 51718 - protein, 9 aa, Mycobacterium tuberculosis
TAQQAAQSA

SEQ ID NO: 51719 - protein, 9 aa, Mycobacterium tuberculosis
AQQAAQSAQ

SEQ ID NO: 51720 - protein, 9 aa, Mycobacterium tuberculosis
QQAAQSAQG

SEQ ID NO: 51721 - protein, 9 aa, Mycobacterium tuberculosis
QAAQSAQGG

SEQ ID NO: 51722 - protein, 9 aa, Mycobacterium tuberculosis
AAQSAQGGS

SEQ ID NO: 51723 - protein, 9 aa, Mycobacterium tuberculosis
AQSAQGGSG

SEQ ID NO: 51724 - protein, 9 aa, Mycobacterium tuberculosis
QSAQGGSGP

SEQ ID NO: 51725 - protein, 9 aa, Mycobacterium tuberculosis
SAQGGSGPM

SEQ ID NO: 51726 - protein, 9 aa, Mycobacterium tuberculosis
AQGGSGPMP

SEQ ID NO: 51727 - protein, 9 aa, Mycobacterium tuberculosis
QGGSGPMPA

SEQ ID NO: 51728 - protein, 9 aa, Mycobacterium tuberculosis
GGSGPMPAQ

SEQ ID NO: 51729 - protein, 9 aa, Mycobacterium tuberculosis
GSGPMPAQL

SEQ ID NO: 51730 - protein, 9 aa, Mycobacterium tuberculosis
SGPMPAQLA

SEQ ID NO: 51731 - protein, 9 aa, Mycobacterium tuberculosis
GPMPAQLAS

SEQ ID NO: 51732 - protein, 9 aa, Mycobacterium tuberculosis
PMPAQLASA

SEQ ID NO: 51733 - protein, 9 aa, Mycobacterium tuberculosis
MPAQLASAE

SEQ ID NO: 51734 - protein, 9 aa, Mycobacterium tuberculosis
PAQLASAEK

SEQ ID NO: 51735 - protein, 9 aa, Mycobacterium tuberculosis
AQLASAEKP

SEQ ID NO: 51736 - protein, 9 aa, Mycobacterium tuberculosis
QLASAEKPA

SEQ ID NO: 51737 - protein, 9 aa, Mycobacterium tuberculosis
LASAEKPAT

SEQ ID NO: 51738 - protein, 9 aa, Mycobacterium tuberculosis
ASAEKPATE

SEQ ID NO: 51739 - protein, 9 aa, Mycobacterium tuberculosis
SAEKPATEQ

SEQ ID NO: 51740 - protein, 9 aa, Mycobacterium tuberculosis
AEKPATEQA

SEQ ID NO: 51741 - protein, 9 aa, Mycobacterium tuberculosis
EKPATEQAE

SEQ ID NO: 51742 - protein, 9 aa, Mycobacterium tuberculosis
KPATEQAEP

SEQ ID NO: 51743 - protein, 9 aa, Mycobacterium tuberculosis
PATEQAEPV

SEQ ID NO: 51744 - protein, 9 aa, Mycobacterium tuberculosis
ATEQAEPVH

SEQ ID NO: 51745 - protein, 9 aa, Mycobacterium tuberculosis
TEQAEPVHE

SEQ ID NO: 51746 - protein, 9 aa, Mycobacterium tuberculosis
EQAEPVHEV

SEQ ID NO: 51747 - protein, 9 aa, Mycobacterium tuberculosis
QAEPVHEVT

SEQ ID NO: 51748 - protein, 9 aa, Mycobacterium tuberculosis
AEPVHEVTN

SEQ ID NO: 51749 - protein, 9 aa, Mycobacterium tuberculosis
EPVHEVTND

SEQ ID NO: 51750 - protein, 9 aa, Mycobacterium tuberculosis
PVHEVTNDD

SEQ ID NO: 51751 - protein, 9 aa, Mycobacterium tuberculosis
VHEVTNDDQ

SEQ ID NO: 51752 - protein, 9 aa, Mycobacterium tuberculosis
HEVTNDDQG

SEQ ID NO: 51753 - protein, 9 aa, Mycobacterium tuberculosis
EVTNDDQGD

SEQ ID NO: 51754 - protein, 9 aa, Mycobacterium tuberculosis
VTNDDQGDQ

SEQ ID NO: 51755 - protein, 9 aa, Mycobacterium tuberculosis
TNDDQGDQG

SEQ ID NO: 51756 - protein, 9 aa, Mycobacterium tuberculosis
NDDQGDQGD

SEQ ID NO: 51757 - protein, 9 aa, Mycobacterium tuberculosis
DDQGDQGDV

SEQ ID NO: 51758 - protein, 9 aa, Mycobacterium tuberculosis
DQGDQGDVQ

SEQ ID NO: 51759 - protein, 9 aa, Mycobacterium tuberculosis
QGDQGDVQP

SEQ ID NO: 51760 - protein, 9 aa, Mycobacterium tuberculosis
GDQGDVQPA

SEQ ID NO: 51761 - protein, 9 aa, Mycobacterium tuberculosis
DQGDVQPAE

SEQ ID NO: 51762 - protein, 9 aa, Mycobacterium tuberculosis
QGDVQPAEV

SEQ ID NO: 51763 - protein, 9 aa, Mycobacterium tuberculosis
GDVQPAEVV

SEQ ID NO: 51764 - protein, 9 aa, Mycobacterium tuberculosis
DVQPAEVVA

SEQ ID NO: 51765 - protein, 9 aa, Mycobacterium tuberculosis
VQPAEVVAA

SEQ ID NO: 51766 - protein, 9 aa, Mycobacterium tuberculosis
QPAEVVAAA

SEQ ID NO: 51767 - protein, 9 aa, Mycobacterium tuberculosis
PAEVVAAAR

SEQ ID NO: 51768 - protein, 9 aa, Mycobacterium tuberculosis
AEVVAAARD

SEQ ID NO: 51769 - protein, 9 aa, Mycobacterium tuberculosis
EVVAAARDE

SEQ ID NO: 51770 - protein, 9 aa, Mycobacterium tuberculosis
VVAAARDEG

SEQ ID NO: 51771 - protein, 9 aa, Mycobacterium tuberculosis
VAAARDEGA

SEQ ID NO: 51772 - protein, 9 aa, Mycobacterium tuberculosis
AAARDEGAG

SEQ ID NO: 51773 - protein, 9 aa, Mycobacterium tuberculosis
AARDEGAGA

SEQ ID NO: 51774 - protein, 9 aa, Mycobacterium tuberculosis
ARDEGAGAS

SEQ ID NO: 51775 - protein, 9 aa, Mycobacterium tuberculosis
RDEGAGASP

SEQ ID NO: 51776 - protein, 9 aa, Mycobacterium tuberculosis
DEGAGASPG

SEQ ID NO: 51777 - protein, 9 aa, Mycobacterium tuberculosis
EGAGASPGQ

SEQ ID NO: 51778 - protein, 9 aa, Mycobacterium tuberculosis
GAGASPGQQ

SEQ ID NO: 51779 - protein, 9 aa, Mycobacterium tuberculosis
AGASPGQQP

SEQ ID NO: 51780 - protein, 9 aa, Mycobacterium tuberculosis
GASPGQQPG

SEQ ID NO: 51781 - protein, 9 aa, Mycobacterium tuberculosis
ASPGQQPGG

SEQ ID NO: 51782 - protein, 9 aa, Mycobacterium tuberculosis
SPGQQPGGG

SEQ ID NO: 51783 - protein, 9 aa, Mycobacterium tuberculosis
PGQQPGGGV

SEQ ID NO: 51784 - protein, 9 aa, Mycobacterium tuberculosis
GQQPGGGVP

SEQ ID NO: 51785 - protein, 9 aa, Mycobacterium tuberculosis
QQPGGGVPA

SEQ ID NO: 51786 - protein, 9 aa, Mycobacterium tuberculosis
QPGGGVPAQ

SEQ ID NO: 51787 - protein, 9 aa, Mycobacterium tuberculosis
PGGGVPAQA

SEQ ID NO: 51788 - protein, 9 aa, Mycobacterium tuberculosis
GGGVPAQAM

SEQ ID NO: 51789 - protein, 9 aa, Mycobacterium tuberculosis
GGVPAQAMD

SEQ ID NO: 51790 - protein, 9 aa, Mycobacterium tuberculosis
GVPAQAMDT

SEQ ID NO: 51791 - protein, 9 aa, Mycobacterium tuberculosis
VPAQAMDTG

SEQ ID NO: 51792 - protein, 9 aa, Mycobacterium tuberculosis
PAQAMDTGA

SEQ ID NO: 51793 - protein, 9 aa, Mycobacterium tuberculosis
AQAMDTGAG

SEQ ID NO: 51794 - protein, 9 aa, Mycobacterium tuberculosis
QAMDTGAGA

SEQ ID NO: 51795 - protein, 9 aa, Mycobacterium tuberculosis
AMDTGAGAR

SEQ ID NO: 51796 - protein, 9 aa, Mycobacterium tuberculosis
MDTGAGARP

SEQ ID NO: 51797 - protein, 9 aa, Mycobacterium tuberculosis
DTGAGARPA

SEQ ID NO: 51798 - protein, 9 aa, Mycobacterium tuberculosis
TGAGARPAA

SEQ ID NO: 51799 - protein, 9 aa, Mycobacterium tuberculosis
GAGARPAAS

SEQ ID NO: 51800 - protein, 9 aa, Mycobacterium tuberculosis
AGARPAASP

SEQ ID NO: 51801 - protein, 9 aa, Mycobacterium tuberculosis
GARPAASPL

SEQ ID NO: 51802 - protein, 9 aa, Mycobacterium tuberculosis
ARPAASPLA

SEQ ID NO: 51803 - protein, 9 aa, Mycobacterium tuberculosis
RPAASPLAA

SEQ ID NO: 51804 - protein, 9 aa, Mycobacterium tuberculosis
PAASPLAAP

SEQ ID NO: 51805 - protein, 9 aa, Mycobacterium tuberculosis
AASPLAAPV

SEQ ID NO: 51806 - protein, 9 aa, Mycobacterium tuberculosis
ASPLAAPVD

SEQ ID NO: 51807 - protein, 9 aa, Mycobacterium tuberculosis
SPLAAPVDP

SEQ ID NO: 51808 - protein, 9 aa, Mycobacterium tuberculosis
PLAAPVDPS

SEQ ID NO: 51809 - protein, 9 aa, Mycobacterium tuberculosis
LAAPVDPST

SEQ ID NO: 51810 - protein, 9 aa, Mycobacterium tuberculosis
AAPVDPSTP

SEQ ID NO: 51811 - protein, 9 aa, Mycobacterium tuberculosis
APVDPSTPA

SEQ ID NO: 51812 - protein, 9 aa, Mycobacterium tuberculosis
PVDPSTPAP

SEQ ID NO: 51813 - protein, 9 aa, Mycobacterium tuberculosis
VDPSTPAPS

SEQ ID NO: 51814 - protein, 9 aa, Mycobacterium tuberculosis
DPSTPAPST

SEQ ID NO: 51815 - protein, 9 aa, Mycobacterium tuberculosis
PSTPAPSTT

SEQ ID NO: 51816 - protein, 9 aa, Mycobacterium tuberculosis
STPAPSTTT

SEQ ID NO: 51817 - protein, 9 aa, Mycobacterium tuberculosis
TPAPSTTTT

SEQ ID NO: 51818 - protein, 9 aa, Mycobacterium tuberculosis
PAPSTTTTL

SEQ ID NO: 51819 - protein, 10 aa, Mycobacterium tuberculosis
MAEPLAVDPT

SEQ ID NO: 51820 - protein, 10 aa, Mycobacterium tuberculosis
AEPLAVDPTG

SEQ ID NO: 51821 - protein, 10 aa, Mycobacterium tuberculosis
EPLAVDPTGL

SEQ ID NO: 51822 - protein, 10 aa, Mycobacterium tuberculosis
PLAVDPTGLS

SEQ ID NO: 51823 - protein, 10 aa, Mycobacterium tuberculosis
LAVDPTGLSA

SEQ ID NO: 51824 - protein, 10 aa, Mycobacterium tuberculosis
AVDPTGLSAA

SEQ ID NO: 51825 - protein, 10 aa, Mycobacterium tuberculosis
VDPTGLSAAA

SEQ ID NO: 51826 - protein, 10 aa, Mycobacterium tuberculosis
DPTGLSAAAA

SEQ ID NO: 51827 - protein, 10 aa, Mycobacterium tuberculosis
PTGLSAAAAK

SEQ ID NO: 51828 - protein, 10 aa, Mycobacterium tuberculosis
TGLSAAAAKL

SEQ ID NO: 51829 - protein, 10 aa, Mycobacterium tuberculosis
GLSAAAAKLA

SEQ ID NO: 51830 - protein, 10 aa, Mycobacterium tuberculosis
LSAAAAKLAG

SEQ ID NO: 51831 - protein, 10 aa, Mycobacterium tuberculosis
SAAAAKLAGL

SEQ ID NO: 51832 - protein, 10 aa, Mycobacterium tuberculosis
AAAAKLAGLV

SEQ ID NO: 51833 - protein, 10 aa, Mycobacterium tuberculosis
AAAKLAGLVF

SEQ ID NO: 51834 - protein, 10 aa, Mycobacterium tuberculosis
AAKLAGLVFP

SEQ ID NO: 51835 - protein, 10 aa, Mycobacterium tuberculosis
AKLAGLVFPQ

SEQ ID NO: 51836 - protein, 10 aa, Mycobacterium tuberculosis
KLAGLVFPQP

SEQ ID NO: 51837 - protein, 10 aa, Mycobacterium tuberculosis
LAGLVFPQPP

SEQ ID NO: 51838 - protein, 10 aa, Mycobacterium tuberculosis
AGLVFPQPPA

SEQ ID NO: 51839 - protein, 10 aa, Mycobacterium tuberculosis
GLVFPQPPAP

SEQ ID NO: 51840 - protein, 10 aa, Mycobacterium tuberculosis
LVFPQPPAPI

SEQ ID NO: 51841 - protein, 10 aa, Mycobacterium tuberculosis
VFPQPPAPIA

SEQ ID NO: 51842 - protein, 10 aa, Mycobacterium tuberculosis
FPQPPAPIAV

SEQ ID NO: 51843 - protein, 10 aa, Mycobacterium tuberculosis
PQPPAPIAVS

SEQ ID NO: 51844 - protein, 10 aa, Mycobacterium tuberculosis
QPPAPIAVSG

SEQ ID NO: 51845 - protein, 10 aa, Mycobacterium tuberculosis
PPAPIAVSGT

SEQ ID NO: 51846 - protein, 10 aa, Mycobacterium tuberculosis
PAPIAVSGTD

SEQ ID NO: 51847 - protein, 10 aa, Mycobacterium tuberculosis
APIAVSGTDS

SEQ ID NO: 51848 - protein, 10 aa, Mycobacterium tuberculosis
PIAVSGTDSV

SEQ ID NO: 51849 - protein, 10 aa, Mycobacterium tuberculosis
IAVSGTDSVV

SEQ ID NO: 51850 - protein, 10 aa, Mycobacterium tuberculosis
AVSGTDSVVA

SEQ ID NO: 51851 - protein, 10 aa, Mycobacterium tuberculosis
VSGTDSVVAA

SEQ ID NO: 51852 - protein, 10 aa, Mycobacterium tuberculosis
SGTDSVVAAI

SEQ ID NO: 51853 - protein, 10 aa, Mycobacterium tuberculosis
GTDSVVAAIN

SEQ ID NO: 51854 - protein, 10 aa, Mycobacterium tuberculosis
TDSVVAAINE

SEQ ID NO: 51855 - protein, 10 aa, Mycobacterium tuberculosis
DSVVAAINET

SEQ ID NO: 51856 - protein, 10 aa, Mycobacterium tuberculosis
SVVAAINETM

SEQ ID NO: 51857 - protein, 10 aa, Mycobacterium tuberculosis
VVAAINETMP

SEQ ID NO: 51858 - protein, 10 aa, Mycobacterium tuberculosis
VAAINETMPS

SEQ ID NO: 51859 - protein, 10 aa, Mycobacterium tuberculosis
AAINETMPSI

SEQ ID NO: 51860 - protein, 10 aa, Mycobacterium tuberculosis
AINETMPSIE

SEQ ID NO: 51861 - protein, 10 aa, Mycobacterium tuberculosis
INETMPSIES

SEQ ID NO: 51862 - protein, 10 aa, Mycobacterium tuberculosis
NETMPSIESL

SEQ ID NO: 51863 - protein, 10 aa, Mycobacterium tuberculosis
ETMPSIESLV

SEQ ID NO: 51864 - protein, 10 aa, Mycobacterium tuberculosis
TMPSIESLVS

SEQ ID NO: 51865 - protein, 10 aa, Mycobacterium tuberculosis
MPSIESLVSD

SEQ ID NO: 51866 - protein, 10 aa, Mycobacterium tuberculosis
PSIESLVSDG

SEQ ID NO: 51867 - protein, 10 aa, Mycobacterium tuberculosis
SIESLVSDGL

SEQ ID NO: 51868 - protein, 10 aa, Mycobacterium tuberculosis
IESLVSDGLP

SEQ ID NO: 51869 - protein, 10 aa, Mycobacterium tuberculosis
ESLVSDGLPG

SEQ ID NO: 51870 - protein, 10 aa, Mycobacterium tuberculosis
SLVSDGLPGV

SEQ ID NO: 51871 - protein, 10 aa, Mycobacterium tuberculosis
LVSDGLPGVK

SEQ ID NO: 51872 - protein, 10 aa, Mycobacterium tuberculosis
VSDGLPGVKA

SEQ ID NO: 51873 - protein, 10 aa, Mycobacterium tuberculosis
SDGLPGVKAA

SEQ ID NO: 51874 - protein, 10 aa, Mycobacterium tuberculosis
DGLPGVKAAL

SEQ ID NO: 51875 - protein, 10 aa, Mycobacterium tuberculosis
GLPGVKAALT

SEQ ID NO: 51876 - protein, 10 aa, Mycobacterium tuberculosis
LPGVKAALTR

SEQ ID NO: 51877 - protein, 10 aa, Mycobacterium tuberculosis
PGVKAALTRT

SEQ ID NO: 51878 - protein, 10 aa, Mycobacterium tuberculosis
GVKAALTRTA

SEQ ID NO: 51879 - protein, 10 aa, Mycobacterium tuberculosis
VKAALTRTAS

SEQ ID NO: 51880 - protein, 10 aa, Mycobacterium tuberculosis
KAALTRTASN

SEQ ID NO: 51881 - protein, 10 aa, Mycobacterium tuberculosis
AALTRTASNM

SEQ ID NO: 51882 - protein, 10 aa, Mycobacterium tuberculosis
ALTRTASNMN

SEQ ID NO: 51883 - protein, 10 aa, Mycobacterium tuberculosis
LTRTASNMNA

SEQ ID NO: 51884 - protein, 10 aa, Mycobacterium tuberculosis
TRTASNMNAA

SEQ ID NO: 51885 - protein, 10 aa, Mycobacterium tuberculosis
RTASNMNAAA

SEQ ID NO: 51886 - protein, 10 aa, Mycobacterium tuberculosis
TASNMNAAAD

SEQ ID NO: 51887 - protein, 10 aa, Mycobacterium tuberculosis
ASNMNAAADV

SEQ ID NO: 51888 - protein, 10 aa, Mycobacterium tuberculosis
SNMNAAADVY

SEQ ID NO: 51889 - protein, 10 aa, Mycobacterium tuberculosis
NMNAAADVYA

SEQ ID NO: 51890 - protein, 10 aa, Mycobacterium tuberculosis
MNAAADVYAK

SEQ ID NO: 51891 - protein, 10 aa, Mycobacterium tuberculosis
NAAADVYAKT

SEQ ID NO: 51892 - protein, 10 aa, Mycobacterium tuberculosis
AAADVYAKTD

SEQ ID NO: 51893 - protein, 10 aa, Mycobacterium tuberculosis
AADVYAKTDQ

SEQ ID NO: 51894 - protein, 10 aa, Mycobacterium tuberculosis
ADVYAKTDQS

SEQ ID NO: 51895 - protein, 10 aa, Mycobacterium tuberculosis
DVYAKTDQSL

SEQ ID NO: 51896 - protein, 10 aa, Mycobacterium tuberculosis
VYAKTDQSLG

SEQ ID NO: 51897 - protein, 10 aa, Mycobacterium tuberculosis
YAKTDQSLGT

SEQ ID NO: 51898 - protein, 10 aa, Mycobacterium tuberculosis
AKTDQSLGTS

SEQ ID NO: 51899 - protein, 10 aa, Mycobacterium tuberculosis
KTDQSLGTSL

SEQ ID NO: 51900 - protein, 10 aa, Mycobacterium tuberculosis
TDQSLGTSLS

SEQ ID NO: 51901 - protein, 10 aa, Mycobacterium tuberculosis
DQSLGTSLSQ

SEQ ID NO: 51902 - protein, 10 aa, Mycobacterium tuberculosis
QSLGTSLSQY

SEQ ID NO: 51903 - protein, 10 aa, Mycobacterium tuberculosis
SLGTSLSQYA

SEQ ID NO: 51904 - protein, 10 aa, Mycobacterium tuberculosis
LGTSLSQYAF

SEQ ID NO: 51905 - protein, 10 aa, Mycobacterium tuberculosis
GTSLSQYAFG

SEQ ID NO: 51906 - protein, 10 aa, Mycobacterium tuberculosis
TSLSQYAFGS

SEQ ID NO: 51907 - protein, 10 aa, Mycobacterium tuberculosis
SLSQYAFGSS

SEQ ID NO: 51908 - protein, 10 aa, Mycobacterium tuberculosis
LSQYAFGSSG

SEQ ID NO: 51909 - protein, 10 aa, Mycobacterium tuberculosis
SQYAFGSSGE

SEQ ID NO: 51910 - protein, 10 aa, Mycobacterium tuberculosis
QYAFGSSGEG

SEQ ID NO: 51911 - protein, 10 aa, Mycobacterium tuberculosis
YAFGSSGEGL

SEQ ID NO: 51912 - protein, 10 aa, Mycobacterium tuberculosis
AFGSSGEGLA

SEQ ID NO: 51913 - protein, 10 aa, Mycobacterium tuberculosis
FGSSGEGLAG

SEQ ID NO: 51914 - protein, 10 aa, Mycobacterium tuberculosis
GSSGEGLAGV

SEQ ID NO: 51915 - protein, 10 aa, Mycobacterium tuberculosis
SSGEGLAGVA

SEQ ID NO: 51916 - protein, 10 aa, Mycobacterium tuberculosis
SGEGLAGVAS

SEQ ID NO: 51917 - protein, 10 aa, Mycobacterium tuberculosis
GEGLAGVASV

SEQ ID NO: 51918 - protein, 10 aa, Mycobacterium tuberculosis
EGLAGVASVG

SEQ ID NO: 51919 - protein, 10 aa, Mycobacterium tuberculosis
GLAGVASVGG

SEQ ID NO: 51920 - protein, 10 aa, Mycobacterium tuberculosis
LAGVASVGGQ

SEQ ID NO: 51921 - protein, 10 aa, Mycobacterium tuberculosis
AGVASVGGQP

SEQ ID NO: 51922 - protein, 10 aa, Mycobacterium tuberculosis
GVASVGGQPS

SEQ ID NO: 51923 - protein, 10 aa, Mycobacterium tuberculosis
VASVGGQPSQ

SEQ ID NO: 51924 - protein, 10 aa, Mycobacterium tuberculosis
ASVGGQPSQA

SEQ ID NO: 51925 - protein, 10 aa, Mycobacterium tuberculosis
SVGGQPSQAT

SEQ ID NO: 51926 - protein, 10 aa, Mycobacterium tuberculosis
VGGQPSQATQ

SEQ ID NO: 51927 - protein, 10 aa, Mycobacterium tuberculosis
GGQPSQATQL

SEQ ID NO: 51928 - protein, 10 aa, Mycobacterium tuberculosis
GQPSQATQLL

SEQ ID NO: 51929 - protein, 10 aa, Mycobacterium tuberculosis
QPSQATQLLS

SEQ ID NO: 51930 - protein, 10 aa, Mycobacterium tuberculosis
PSQATQLLST

SEQ ID NO: 51931 - protein, 10 aa, Mycobacterium tuberculosis
SQATQLLSTP

SEQ ID NO: 51932 - protein, 10 aa, Mycobacterium tuberculosis
QATQLLSTPV

SEQ ID NO: 51933 - protein, 10 aa, Mycobacterium tuberculosis
ATQLLSTPVS

SEQ ID NO: 51934 - protein, 10 aa, Mycobacterium tuberculosis
TQLLSTPVSQ

SEQ ID NO: 51935 - protein, 10 aa, Mycobacterium tuberculosis
QLLSTPVSQV

SEQ ID NO: 51936 - protein, 10 aa, Mycobacterium tuberculosis
LLSTPVSQVT

SEQ ID NO: 51937 - protein, 10 aa, Mycobacterium tuberculosis
LSTPVSQVTT

SEQ ID NO: 51938 - protein, 10 aa, Mycobacterium tuberculosis
STPVSQVTTQ

SEQ ID NO: 51939 - protein, 10 aa, Mycobacterium tuberculosis
TPVSQVTTQL

SEQ ID NO: 51940 - protein, 10 aa, Mycobacterium tuberculosis
PVSQVTTQLG

SEQ ID NO: 51941 - protein, 10 aa, Mycobacterium tuberculosis
VSQVTTQLGE

SEQ ID NO: 51942 - protein, 10 aa, Mycobacterium tuberculosis
SQVTTQLGET

SEQ ID NO: 51943 - protein, 10 aa, Mycobacterium tuberculosis
QVTTQLGETA

SEQ ID NO: 51944 - protein, 10 aa, Mycobacterium tuberculosis
VTTQLGETAA

SEQ ID NO: 51945 - protein, 10 aa, Mycobacterium tuberculosis
TTQLGETAAE

SEQ ID NO: 51946 - protein, 10 aa, Mycobacterium tuberculosis
TQLGETAAEL

SEQ ID NO: 51947 - protein, 10 aa, Mycobacterium tuberculosis
QLGETAAELA

SEQ ID NO: 51948 - protein, 10 aa, Mycobacterium tuberculosis
LGETAAELAP

SEQ ID NO: 51949 - protein, 10 aa, Mycobacterium tuberculosis
GETAAELAPR

SEQ ID NO: 51950 - protein, 10 aa, Mycobacterium tuberculosis
ETAAELAPRV

SEQ ID NO: 51951 - protein, 10 aa, Mycobacterium tuberculosis
TAAELAPRVV

SEQ ID NO: 51952 - protein, 10 aa, Mycobacterium tuberculosis
AAELAPRVVA

SEQ ID NO: 51953 - protein, 10 aa, Mycobacterium tuberculosis
AELAPRVVAT

SEQ ID NO: 51954 - protein, 10 aa, Mycobacterium tuberculosis
ELAPRVVATV

SEQ ID NO: 51955 - protein, 10 aa, Mycobacterium tuberculosis
LAPRVVATVP

SEQ ID NO: 51956 - protein, 10 aa, Mycobacterium tuberculosis
APRVVATVPQ

SEQ ID NO: 51957 - protein, 10 aa, Mycobacterium tuberculosis
PRVVATVPQL

SEQ ID NO: 51958 - protein, 10 aa, Mycobacterium tuberculosis
RVVATVPQLV

SEQ ID NO: 51959 - protein, 10 aa, Mycobacterium tuberculosis
VVATVPQLVQ

SEQ ID NO: 51960 - protein, 10 aa, Mycobacterium tuberculosis
VATVPQLVQL

SEQ ID NO: 51961 - protein, 10 aa, Mycobacterium tuberculosis
ATVPQLVQLA

SEQ ID NO: 51962 - protein, 10 aa, Mycobacterium tuberculosis
TVPQLVQLAP

SEQ ID NO: 51963 - protein, 10 aa, Mycobacterium tuberculosis
VPQLVQLAPH

SEQ ID NO: 51964 - protein, 10 aa, Mycobacterium tuberculosis
PQLVQLAPHA

SEQ ID NO: 51965 - protein, 10 aa, Mycobacterium tuberculosis
QLVQLAPHAV

SEQ ID NO: 51966 - protein, 10 aa, Mycobacterium tuberculosis
LVQLAPHAVQ

SEQ ID NO: 51967 - protein, 10 aa, Mycobacterium tuberculosis
VQLAPHAVQM

SEQ ID NO: 51968 - protein, 10 aa, Mycobacterium tuberculosis
QLAPHAVQMS

SEQ ID NO: 51969 - protein, 10 aa, Mycobacterium tuberculosis
LAPHAVQMSQ

SEQ ID NO: 51970 - protein, 10 aa, Mycobacterium tuberculosis
APHAVQMSQN

SEQ ID NO: 51971 - protein, 10 aa, Mycobacterium tuberculosis
PHAVQMSQNA

SEQ ID NO: 51972 - protein, 10 aa, Mycobacterium tuberculosis
HAVQMSQNAS

SEQ ID NO: 51973 - protein, 10 aa, Mycobacterium tuberculosis
AVQMSQNASP

SEQ ID NO: 51974 - protein, 10 aa, Mycobacterium tuberculosis
VQMSQNASPI

SEQ ID NO: 51975 - protein, 10 aa, Mycobacterium tuberculosis
QMSQNASPIA

SEQ ID NO: 51976 - protein, 10 aa, Mycobacterium tuberculosis
MSQNASPIAQ

SEQ ID NO: 51977 - protein, 10 aa, Mycobacterium tuberculosis
SQNASPIAQT

SEQ ID NO: 51978 - protein, 10 aa, Mycobacterium tuberculosis
QNASPIAQTI

SEQ ID NO: 51979 - protein, 10 aa, Mycobacterium tuberculosis
NASPIAQTIS

SEQ ID NO: 51980 - protein, 10 aa, Mycobacterium tuberculosis
ASPIAQTISQ

SEQ ID NO: 51981 - protein, 10 aa, Mycobacterium tuberculosis
SPIAQTISQT

SEQ ID NO: 51982 - protein, 10 aa, Mycobacterium tuberculosis
PIAQTISQTA

SEQ ID NO: 51983 - protein, 10 aa, Mycobacterium tuberculosis
IAQTISQTAQ

SEQ ID NO: 51984 - protein, 10 aa, Mycobacterium tuberculosis
AQTISQTAQQ

SEQ ID NO: 51985 - protein, 10 aa, Mycobacterium tuberculosis
QTISQTAQQA

SEQ ID NO: 51986 - protein, 10 aa, Mycobacterium tuberculosis
TISQTAQQAA

SEQ ID NO: 51987 - protein, 10 aa, Mycobacterium tuberculosis
ISQTAQQAAQ

SEQ ID NO: 51988 - protein, 10 aa, Mycobacterium tuberculosis
SQTAQQAAQS

SEQ ID NO: 51989 - protein, 10 aa, Mycobacterium tuberculosis
QTAQQAAQSA

SEQ ID NO: 51990 - protein, 10 aa, Mycobacterium tuberculosis
TAQQAAQSAQ

SEQ ID NO: 51991 - protein, 10 aa, Mycobacterium tuberculosis
AQQAAQSAQG

SEQ ID NO: 51992 - protein, 10 aa, Mycobacterium tuberculosis
QQAAQSAQGG

SEQ ID NO: 51993 - protein, 10 aa, Mycobacterium tuberculosis
QAAQSAQGGS

SEQ ID NO: 51994 - protein, 10 aa, Mycobacterium tuberculosis
AAQSAQGGSG

SEQ ID NO: 51995 - protein, 10 aa, Mycobacterium tuberculosis
AQSAQGGSGP

SEQ ID NO: 51996 - protein, 10 aa, Mycobacterium tuberculosis
QSAQGGSGPM

SEQ ID NO: 51997 - protein, 10 aa, Mycobacterium tuberculosis
SAQGGSGPMP

SEQ ID NO: 51998 - protein, 10 aa, Mycobacterium tuberculosis
AQGGSGPMPA

SEQ ID NO: 51999 - protein, 10 aa, Mycobacterium tuberculosis
QGGSGPMPAQ

SEQ ID NO: 52000 - protein, 10 aa, Mycobacterium tuberculosis
GGSGPMPAQL

SEQ ID NO: 52001 - protein, 10 aa, Mycobacterium tuberculosis
GSGPMPAQLA

SEQ ID NO: 52002 - protein, 10 aa, Mycobacterium tuberculosis
SGPMPAQLAS

SEQ ID NO: 52003 - protein, 10 aa, Mycobacterium tuberculosis
GPMPAQLASA

SEQ ID NO: 52004 - protein, 10 aa, Mycobacterium tuberculosis
PMPAQLASAE

SEQ ID NO: 52005 - protein, 10 aa, Mycobacterium tuberculosis
MPAQLASAEK

SEQ ID NO: 52006 - protein, 10 aa, Mycobacterium tuberculosis
PAQLASAEKP

SEQ ID NO: 52007 - protein, 10 aa, Mycobacterium tuberculosis
AQLASAEKPA

SEQ ID NO: 52008 - protein, 10 aa, Mycobacterium tuberculosis
QLASAEKPAT

SEQ ID NO: 52009 - protein, 10 aa, Mycobacterium tuberculosis
LASAEKPATE

SEQ ID NO: 52010 - protein, 10 aa, Mycobacterium tuberculosis
ASAEKPATEQ

SEQ ID NO: 52011 - protein, 10 aa, Mycobacterium tuberculosis
SAEKPATEQA

SEQ ID NO: 52012 - protein, 10 aa, Mycobacterium tuberculosis
AEKPATEQAE

SEQ ID NO: 52013 - protein, 10 aa, Mycobacterium tuberculosis
EKPATEQAEP

SEQ ID NO: 52014 - protein, 10 aa, Mycobacterium tuberculosis
KPATEQAEPV

SEQ ID NO: 52015 - protein, 10 aa, Mycobacterium tuberculosis
PATEQAEPVH

SEQ ID NO: 52016 - protein, 10 aa, Mycobacterium tuberculosis
ATEQAEPVHE

SEQ ID NO: 52017 - protein, 10 aa, Mycobacterium tuberculosis
TEQAEPVHEV

SEQ ID NO: 52018 - protein, 10 aa, Mycobacterium tuberculosis
EQAEPVHEVT

SEQ ID NO: 52019 - protein, 10 aa, Mycobacterium tuberculosis
QAEPVHEVTN

SEQ ID NO: 52020 - protein, 10 aa, Mycobacterium tuberculosis
AEPVHEVTND

SEQ ID NO: 52021 - protein, 10 aa, Mycobacterium tuberculosis
EPVHEVTNDD

SEQ ID NO: 52022 - protein, 10 aa, Mycobacterium tuberculosis
PVHEVTNDDQ

SEQ ID NO: 52023 - protein, 10 aa, Mycobacterium tuberculosis
VHEVTNDDQG

SEQ ID NO: 52024 - protein, 10 aa, Mycobacterium tuberculosis
HEVTNDDQGD

SEQ ID NO: 52025 - protein, 10 aa, Mycobacterium tuberculosis
EVTNDDQGDQ

SEQ ID NO: 52026 - protein, 10 aa, Mycobacterium tuberculosis
VTNDDQGDQG

SEQ ID NO: 52027 - protein, 10 aa, Mycobacterium tuberculosis
TNDDQGDQGD

SEQ ID NO: 52028 - protein, 10 aa, Mycobacterium tuberculosis
NDDQGDQGDV

SEQ ID NO: 52029 - protein, 10 aa, Mycobacterium tuberculosis
DDQGDQGDVQ

SEQ ID NO: 52030 - protein, 10 aa, Mycobacterium tuberculosis
DQGDQGDVQP

SEQ ID NO: 52031 - protein, 10 aa, Mycobacterium tuberculosis
QGDQGDVQPA

SEQ ID NO: 52032 - protein, 10 aa, Mycobacterium tuberculosis
GDQGDVQPAE

SEQ ID NO: 52033 - protein, 10 aa, Mycobacterium tuberculosis
DQGDVQPAEV

SEQ ID NO: 52034 - protein, 10 aa, Mycobacterium tuberculosis
QGDVQPAEVV

SEQ ID NO: 52035 - protein, 10 aa, Mycobacterium tuberculosis
GDVQPAEVVA

SEQ ID NO: 52036 - protein, 10 aa, Mycobacterium tuberculosis
DVQPAEVVAA

SEQ ID NO: 52037 - protein, 10 aa, Mycobacterium tuberculosis
VQPAEVVAAA

SEQ ID NO: 52038 - protein, 10 aa, Mycobacterium tuberculosis
QPAEVVAAAR

SEQ ID NO: 52039 - protein, 10 aa, Mycobacterium tuberculosis
PAEVVAAARD

SEQ ID NO: 52040 - protein, 10 aa, Mycobacterium tuberculosis
AEVVAAARDE

SEQ ID NO: 52041 - protein, 10 aa, Mycobacterium tuberculosis
EVVAAARDEG

SEQ ID NO: 52042 - protein, 10 aa, Mycobacterium tuberculosis
VVAAARDEGA

SEQ ID NO: 52043 - protein, 10 aa, Mycobacterium tuberculosis
VAAARDEGAG

SEQ ID NO: 52044 - protein, 10 aa, Mycobacterium tuberculosis
AAARDEGAGA

SEQ ID NO: 52045 - protein, 10 aa, Mycobacterium tuberculosis
AARDEGAGAS

SEQ ID NO: 52046 - protein, 10 aa, Mycobacterium tuberculosis
ARDEGAGASP

SEQ ID NO: 52047 - protein, 10 aa, Mycobacterium tuberculosis
RDEGAGASPG

SEQ ID NO: 52048 - protein, 10 aa, Mycobacterium tuberculosis
DEGAGASPGQ

SEQ ID NO: 52049 - protein, 10 aa, Mycobacterium tuberculosis
EGAGASPGQQ

SEQ ID NO: 52050 - protein, 10 aa, Mycobacterium tuberculosis
GAGASPGQQP

SEQ ID NO: 52051 - protein, 10 aa, Mycobacterium tuberculosis
AGASPGQQPG

SEQ ID NO: 52052 - protein, 10 aa, Mycobacterium tuberculosis
GASPGQQPGG

SEQ ID NO: 52053 - protein, 10 aa, Mycobacterium tuberculosis
ASPGQQPGGG

SEQ ID NO: 52054 - protein, 10 aa, Mycobacterium tuberculosis
SPGQQPGGGV

SEQ ID NO: 52055 - protein, 10 aa, Mycobacterium tuberculosis
PGQQPGGGVP

SEQ ID NO: 52056 - protein, 10 aa, Mycobacterium tuberculosis
GQQPGGGVPA

SEQ ID NO: 52057 - protein, 10 aa, Mycobacterium tuberculosis
QQPGGGVPAQ

SEQ ID NO: 52058 - protein, 10 aa, Mycobacterium tuberculosis
QPGGGVPAQA

SEQ ID NO: 52059 - protein, 10 aa, Mycobacterium tuberculosis
PGGGVPAQAM

SEQ ID NO: 52060 - protein, 10 aa, Mycobacterium tuberculosis
GGGVPAQAMD

SEQ ID NO: 52061 - protein, 10 aa, Mycobacterium tuberculosis
GGVPAQAMDT

SEQ ID NO: 52062 - protein, 10 aa, Mycobacterium tuberculosis
GVPAQAMDTG

SEQ ID NO: 52063 - protein, 10 aa, Mycobacterium tuberculosis
VPAQAMDTGA

SEQ ID NO: 52064 - protein, 10 aa, Mycobacterium tuberculosis
PAQAMDTGAG

SEQ ID NO: 52065 - protein, 10 aa, Mycobacterium tuberculosis
AQAMDTGAGA

SEQ ID NO: 52066 - protein, 10 aa, Mycobacterium tuberculosis
QAMDTGAGAR

SEQ ID NO: 52067 - protein, 10 aa, Mycobacterium tuberculosis
AMDTGAGARP

SEQ ID NO: 52068 - protein, 10 aa, Mycobacterium tuberculosis
MDTGAGARPA

SEQ ID NO: 52069 - protein, 10 aa, Mycobacterium tuberculosis
DTGAGARPAA

SEQ ID NO: 52070 - protein, 10 aa, Mycobacterium tuberculosis
TGAGARPAAS

SEQ ID NO: 52071 - protein, 10 aa, Mycobacterium tuberculosis
GAGARPAASP

SEQ ID NO: 52072 - protein, 10 aa, Mycobacterium tuberculosis
AGARPAASPL

SEQ ID NO: 52073 - protein, 10 aa, Mycobacterium tuberculosis
GARPAASPLA

SEQ ID NO: 52074 - protein, 10 aa, Mycobacterium tuberculosis
ARPAASPLAA

SEQ ID NO: 52075 - protein, 10 aa, Mycobacterium tuberculosis
RPAASPLAAP

SEQ ID NO: 52076 - protein, 10 aa, Mycobacterium tuberculosis
PAASPLAAPV

SEQ ID NO: 52077 - protein, 10 aa, Mycobacterium tuberculosis
AASPLAAPVD

SEQ ID NO: 52078 - protein, 10 aa, Mycobacterium tuberculosis
ASPLAAPVDP

SEQ ID NO: 52079 - protein, 10 aa, Mycobacterium tuberculosis
SPLAAPVDPS

SEQ ID NO: 52080 - protein, 10 aa, Mycobacterium tuberculosis
PLAAPVDPST

SEQ ID NO: 52081 - protein, 10 aa, Mycobacterium tuberculosis
LAAPVDPSTP

SEQ ID NO: 52082 - protein, 10 aa, Mycobacterium tuberculosis
AAPVDPSTPA

SEQ ID NO: 52083 - protein, 10 aa, Mycobacterium tuberculosis
APVDPSTPAP

SEQ ID NO: 52084 - protein, 10 aa, Mycobacterium tuberculosis
PVDPSTPAPS

SEQ ID NO: 52085 - protein, 10 aa, Mycobacterium tuberculosis
VDPSTPAPST

SEQ ID NO: 52086 - protein, 10 aa, Mycobacterium tuberculosis
DPSTPAPSTT

SEQ ID NO: 52087 - protein, 10 aa, Mycobacterium tuberculosis
PSTPAPSTTT

SEQ ID NO: 52088 - protein, 10 aa, Mycobacterium tuberculosis
STPAPSTTTT

SEQ ID NO: 52089 - protein, 10 aa, Mycobacterium tuberculosis
TPAPSTTTTL

SEQ ID NO: 52090 - protein, 11 aa, Mycobacterium tuberculosis
MAEPLAVDPTG

SEQ ID NO: 52091 - protein, 11 aa, Mycobacterium tuberculosis
AEPLAVDPTGL

SEQ ID NO: 52092 - protein, 11 aa, Mycobacterium tuberculosis
EPLAVDPTGLS

SEQ ID NO: 52093 - protein, 11 aa, Mycobacterium tuberculosis
PLAVDPTGLSA

SEQ ID NO: 52094 - protein, 11 aa, Mycobacterium tuberculosis
LAVDPTGLSAA

SEQ ID NO: 52095 - protein, 11 aa, Mycobacterium tuberculosis
AVDPTGLSAAA

SEQ ID NO: 52096 - protein, 11 aa, Mycobacterium tuberculosis
VDPTGLSAAAA

SEQ ID NO: 52097 - protein, 11 aa, Mycobacterium tuberculosis
DPTGLSAAAAK

SEQ ID NO: 52098 - protein, 11 aa, Mycobacterium tuberculosis
PTGLSAAAAKL

SEQ ID NO: 52099 - protein, 11 aa, Mycobacterium tuberculosis
TGLSAAAAKLA

SEQ ID NO: 52100 - protein, 11 aa, Mycobacterium tuberculosis
GLSAAAAKLAG

SEQ ID NO: 52101 - protein, 11 aa, Mycobacterium tuberculosis
LSAAAAKLAGL

SEQ ID NO: 52102 - protein, 11 aa, Mycobacterium tuberculosis
SAAAAKLAGLV

SEQ ID NO: 52103 - protein, 11 aa, Mycobacterium tuberculosis
AAAAKLAGLVF

SEQ ID NO: 52104 - protein, 11 aa, Mycobacterium tuberculosis
AAAKLAGLVFP

SEQ ID NO: 52105 - protein, 11 aa, Mycobacterium tuberculosis
AAKLAGLVFPQ

SEQ ID NO: 52106 - protein, 11 aa, Mycobacterium tuberculosis
AKLAGLVFPQP

SEQ ID NO: 52107 - protein, 11 aa, Mycobacterium tuberculosis
KLAGLVFPQPP

SEQ ID NO: 52108 - protein, 11 aa, Mycobacterium tuberculosis
LAGLVFPQPPA

SEQ ID NO: 52109 - protein, 11 aa, Mycobacterium tuberculosis
AGLVFPQPPAP

SEQ ID NO: 52110 - protein, 11 aa, Mycobacterium tuberculosis
GLVFPQPPAPI

SEQ ID NO: 52111 - protein, 11 aa, Mycobacterium tuberculosis
LVFPQPPAPIA

SEQ ID NO: 52112 - protein, 11 aa, Mycobacterium tuberculosis
VFPQPPAPIAV

SEQ ID NO: 52113 - protein, 11 aa, Mycobacterium tuberculosis
FPQPPAPIAVS

SEQ ID NO: 52114 - protein, 11 aa, Mycobacterium tuberculosis
PQPPAPIAVSG

SEQ ID NO: 52115 - protein, 11 aa, Mycobacterium tuberculosis
QPPAPIAVSGT

SEQ ID NO: 52116 - protein, 11 aa, Mycobacterium tuberculosis
PPAPIAVSGTD

SEQ ID NO: 52117 - protein, 11 aa, Mycobacterium tuberculosis
PAPIAVSGTDS

SEQ ID NO: 52118 - protein, 11 aa, Mycobacterium tuberculosis
APIAVSGTDSV

SEQ ID NO: 52119 - protein, 11 aa, Mycobacterium tuberculosis
PIAVSGTDSVV

SEQ ID NO: 52120 - protein, 11 aa, Mycobacterium tuberculosis
IAVSGTDSVVA

SEQ ID NO: 52121 - protein, 11 aa, Mycobacterium tuberculosis
AVSGTDSVVAA

SEQ ID NO: 52122 - protein, 11 aa, Mycobacterium tuberculosis
VSGTDSVVAAI

SEQ ID NO: 52123 - protein, 11 aa, Mycobacterium tuberculosis
SGTDSVVAAIN

SEQ ID NO: 52124 - protein, 11 aa, Mycobacterium tuberculosis
GTDSVVAAINE

SEQ ID NO: 52125 - protein, 11 aa, Mycobacterium tuberculosis
TDSVVAAINET

SEQ ID NO: 52126 - protein, 11 aa, Mycobacterium tuberculosis
DSVVAAINETM

SEQ ID NO: 52127 - protein, 11 aa, Mycobacterium tuberculosis
SVVAAINETMP

SEQ ID NO: 52128 - protein, 11 aa, Mycobacterium tuberculosis
VVAAINETMPS

SEQ ID NO: 52129 - protein, 11 aa, Mycobacterium tuberculosis
VAAINETMPSI

SEQ ID NO: 52130 - protein, 11 aa, Mycobacterium tuberculosis
AAINETMPSIE

SEQ ID NO: 52131 - protein, 11 aa, Mycobacterium tuberculosis
AINETMPSIES

SEQ ID NO: 52132 - protein, 11 aa, Mycobacterium tuberculosis
INETMPSIESL

SEQ ID NO: 52133 - protein, 11 aa, Mycobacterium tuberculosis
NETMPSIESLV

SEQ ID NO: 52134 - protein, 11 aa, Mycobacterium tuberculosis
ETMPSIESLVS

SEQ ID NO: 52135 - protein, 11 aa, Mycobacterium tuberculosis
TMPSIESLVSD

SEQ ID NO: 52136 - protein, 11 aa, Mycobacterium tuberculosis
MPSIESLVSDG

SEQ ID NO: 52137 - protein, 11 aa, Mycobacterium tuberculosis
PSIESLVSDGL

SEQ ID NO: 52138 - protein, 11 aa, Mycobacterium tuberculosis
SIESLVSDGLP

SEQ ID NO: 52139 - protein, 11 aa, Mycobacterium tuberculosis
IESLVSDGLPG

SEQ ID NO: 52140 - protein, 11 aa, Mycobacterium tuberculosis
ESLVSDGLPGV

SEQ ID NO: 52141 - protein, 11 aa, Mycobacterium tuberculosis
SLVSDGLPGVK

SEQ ID NO: 52142 - protein, 11 aa, Mycobacterium tuberculosis
LVSDGLPGVKA

SEQ ID NO: 52143 - protein, 11 aa, Mycobacterium tuberculosis
VSDGLPGVKAA

SEQ ID NO: 52144 - protein, 11 aa, Mycobacterium tuberculosis
SDGLPGVKAAL

SEQ ID NO: 52145 - protein, 11 aa, Mycobacterium tuberculosis
DGLPGVKAALT

SEQ ID NO: 52146 - protein, 11 aa, Mycobacterium tuberculosis
GLPGVKAALTR

SEQ ID NO: 52147 - protein, 11 aa, Mycobacterium tuberculosis
LPGVKAALTRT

SEQ ID NO: 52148 - protein, 11 aa, Mycobacterium tuberculosis
PGVKAALTRTA

SEQ ID NO: 52149 - protein, 11 aa, Mycobacterium tuberculosis
GVKAALTRTAS

SEQ ID NO: 52150 - protein, 11 aa, Mycobacterium tuberculosis
VKAALTRTASN

SEQ ID NO: 52151 - protein, 11 aa, Mycobacterium tuberculosis
KAALTRTASNM

SEQ ID NO: 52152 - protein, 11 aa, Mycobacterium tuberculosis
AALTRTASNMN

SEQ ID NO: 52153 - protein, 11 aa, Mycobacterium tuberculosis
ALTRTASNMNA

SEQ ID NO: 52154 - protein, 11 aa, Mycobacterium tuberculosis
LTRTASNMNAA

SEQ ID NO: 52155 - protein, 11 aa, Mycobacterium tuberculosis
TRTASNMNAAA

SEQ ID NO: 52156 - protein, 11 aa, Mycobacterium tuberculosis
RTASNMNAAAD

SEQ ID NO: 52157 - protein, 11 aa, Mycobacterium tuberculosis
TASNMNAAADV

SEQ ID NO: 52158 - protein, 11 aa, Mycobacterium tuberculosis
ASNMNAAADVY

SEQ ID NO: 52159 - protein, 11 aa, Mycobacterium tuberculosis
SNMNAAADVYA

SEQ ID NO: 52160 - protein, 11 aa, Mycobacterium tuberculosis
NMNAAADVYAK

SEQ ID NO: 52161 - protein, 11 aa, Mycobacterium tuberculosis
MNAAADVYAKT

SEQ ID NO: 52162 - protein, 11 aa, Mycobacterium tuberculosis
NAAADVYAKTD

SEQ ID NO: 52163 - protein, 11 aa, Mycobacterium tuberculosis
AAADVYAKTDQ

SEQ ID NO: 52164 - protein, 11 aa, Mycobacterium tuberculosis
AADVYAKTDQS

SEQ ID NO: 52165 - protein, 11 aa, Mycobacterium tuberculosis
ADVYAKTDQSL

SEQ ID NO: 52166 - protein, 11 aa, Mycobacterium tuberculosis
DVYAKTDQSLG

SEQ ID NO: 52167 - protein, 11 aa, Mycobacterium tuberculosis
VYAKTDQSLGT

SEQ ID NO: 52168 - protein, 11 aa, Mycobacterium tuberculosis
YAKTDQSLGTS

SEQ ID NO: 52169 - protein, 11 aa, Mycobacterium tuberculosis
AKTDQSLGTSL

SEQ ID NO: 52170 - protein, 11 aa, Mycobacterium tuberculosis
KTDQSLGTSLS

SEQ ID NO: 52171 - protein, 11 aa, Mycobacterium tuberculosis
TDQSLGTSLSQ

SEQ ID NO: 52172 - protein, 11 aa, Mycobacterium tuberculosis
DQSLGTSLSQY

SEQ ID NO: 52173 - protein, 11 aa, Mycobacterium tuberculosis
QSLGTSLSQYA

SEQ ID NO: 52174 - protein, 11 aa, Mycobacterium tuberculosis
SLGTSLSQYAF

SEQ ID NO: 52175 - protein, 11 aa, Mycobacterium tuberculosis
LGTSLSQYAFG

SEQ ID NO: 52176 - protein, 11 aa, Mycobacterium tuberculosis
GTSLSQYAFGS

SEQ ID NO: 52177 - protein, 11 aa, Mycobacterium tuberculosis
TSLSQYAFGSS

SEQ ID NO: 52178 - protein, 11 aa, Mycobacterium tuberculosis
SLSQYAFGSSG

SEQ ID NO: 52179 - protein, 11 aa, Mycobacterium tuberculosis
LSQYAFGSSGE

SEQ ID NO: 52180 - protein, 11 aa, Mycobacterium tuberculosis
SQYAFGSSGEG

SEQ ID NO: 52181 - protein, 11 aa, Mycobacterium tuberculosis
QYAFGSSGEGL

SEQ ID NO: 52182 - protein, 11 aa, Mycobacterium tuberculosis
YAFGSSGEGLA

SEQ ID NO: 52183 - protein, 11 aa, Mycobacterium tuberculosis
AFGSSGEGLAG

SEQ ID NO: 52184 - protein, 11 aa, Mycobacterium tuberculosis
FGSSGEGLAGV

SEQ ID NO: 52185 - protein, 11 aa, Mycobacterium tuberculosis
GSSGEGLAGVA

SEQ ID NO: 52186 - protein, 11 aa, Mycobacterium tuberculosis
SSGEGLAGVAS

SEQ ID NO: 52187 - protein, 11 aa, Mycobacterium tuberculosis
SGEGLAGVASV

SEQ ID NO: 52188 - protein, 11 aa, Mycobacterium tuberculosis
GEGLAGVASVG

SEQ ID NO: 52189 - protein, 11 aa, Mycobacterium tuberculosis
EGLAGVASVGG

SEQ ID NO: 52190 - protein, 11 aa, Mycobacterium tuberculosis
GLAGVASVGGQ

SEQ ID NO: 52191 - protein, 11 aa, Mycobacterium tuberculosis
LAGVASVGGQP

SEQ ID NO: 52192 - protein, 11 aa, Mycobacterium tuberculosis
AGVASVGGQPS

SEQ ID NO: 52193 - protein, 11 aa, Mycobacterium tuberculosis
GVASVGGQPSQ

SEQ ID NO: 52194 - protein, 11 aa, Mycobacterium tuberculosis
VASVGGQPSQA

SEQ ID NO: 52195 - protein, 11 aa, Mycobacterium tuberculosis
ASVGGQPSQAT

SEQ ID NO: 52196 - protein, 11 aa, Mycobacterium tuberculosis
SVGGQPSQATQ

SEQ ID NO: 52197 - protein, 11 aa, Mycobacterium tuberculosis
VGGQPSQATQL

SEQ ID NO: 52198 - protein, 11 aa, Mycobacterium tuberculosis
GGQPSQATQLL

SEQ ID NO: 52199 - protein, 11 aa, Mycobacterium tuberculosis
GQPSQATQLLS

SEQ ID NO: 52200 - protein, 11 aa, Mycobacterium tuberculosis
QPSQATQLLST

SEQ ID NO: 52201 - protein, 11 aa, Mycobacterium tuberculosis
PSQATQLLSTP

SEQ ID NO: 52202 - protein, 11 aa, Mycobacterium tuberculosis
SQATQLLSTPV

SEQ ID NO: 52203 - protein, 11 aa, Mycobacterium tuberculosis
QATQLLSTPVS

SEQ ID NO: 52204 - protein, 11 aa, Mycobacterium tuberculosis
ATQLLSTPVSQ

SEQ ID NO: 52205 - protein, 11 aa, Mycobacterium tuberculosis
TQLLSTPVSQV

SEQ ID NO: 52206 - protein, 11 aa, Mycobacterium tuberculosis
QLLSTPVSQVT

SEQ ID NO: 52207 - protein, 11 aa, Mycobacterium tuberculosis
LLSTPVSQVTT

SEQ ID NO: 52208 - protein, 11 aa, Mycobacterium tuberculosis
LSTPVSQVTTQ

SEQ ID NO: 52209 - protein, 11 aa, Mycobacterium tuberculosis
STPVSQVTTQL

SEQ ID NO: 52210 - protein, 11 aa, Mycobacterium tuberculosis
TPVSQVTTQLG

SEQ ID NO: 52211 - protein, 11 aa, Mycobacterium tuberculosis
PVSQVTTQLGE

SEQ ID NO: 52212 - protein, 11 aa, Mycobacterium tuberculosis
VSQVTTQLGET

SEQ ID NO: 52213 - protein, 11 aa, Mycobacterium tuberculosis
SQVTTQLGETA

SEQ ID NO: 52214 - protein, 11 aa, Mycobacterium tuberculosis
QVTTQLGETAA

SEQ ID NO: 52215 - protein, 11 aa, Mycobacterium tuberculosis
VTTQLGETAAE

SEQ ID NO: 52216 - protein, 11 aa, Mycobacterium tuberculosis
TTQLGETAAEL

SEQ ID NO: 52217 - protein, 11 aa, Mycobacterium tuberculosis
TQLGETAAELA

SEQ ID NO: 52218 - protein, 11 aa, Mycobacterium tuberculosis
QLGETAAELAP

SEQ ID NO: 52219 - protein, 11 aa, Mycobacterium tuberculosis
LGETAAELAPR

SEQ ID NO: 52220 - protein, 11 aa, Mycobacterium tuberculosis
GETAAELAPRV

SEQ ID NO: 52221 - protein, 11 aa, Mycobacterium tuberculosis
ETAAELAPRVV

SEQ ID NO: 52222 - protein, 11 aa, Mycobacterium tuberculosis
TAAELAPRVVA

SEQ ID NO: 52223 - protein, 11 aa, Mycobacterium tuberculosis
AAELAPRVVAT

SEQ ID NO: 52224 - protein, 11 aa, Mycobacterium tuberculosis
AELAPRVVATV

SEQ ID NO: 52225 - protein, 11 aa, Mycobacterium tuberculosis
ELAPRVVATVP

SEQ ID NO: 52226 - protein, 11 aa, Mycobacterium tuberculosis
LAPRVVATVPQ

SEQ ID NO: 52227 - protein, 11 aa, Mycobacterium tuberculosis
APRVVATVPQL

SEQ ID NO: 52228 - protein, 11 aa, Mycobacterium tuberculosis
PRVVATVPQLV

SEQ ID NO: 52229 - protein, 11 aa, Mycobacterium tuberculosis
RVVATVPQLVQ

SEQ ID NO: 52230 - protein, 11 aa, Mycobacterium tuberculosis
VVATVPQLVQL

SEQ ID NO: 52231 - protein, 11 aa, Mycobacterium tuberculosis
VATVPQLVQLA

SEQ ID NO: 52232 - protein, 11 aa, Mycobacterium tuberculosis
ATVPQLVQLAP

SEQ ID NO: 52233 - protein, 11 aa, Mycobacterium tuberculosis
TVPQLVQLAPH

SEQ ID NO: 52234 - protein, 11 aa, Mycobacterium tuberculosis
VPQLVQLAPHA

SEQ ID NO: 52235 - protein, 11 aa, Mycobacterium tuberculosis
PQLVQLAPHAV

SEQ ID NO: 52236 - protein, 11 aa, Mycobacterium tuberculosis
QLVQLAPHAVQ

SEQ ID NO: 52237 - protein, 11 aa, Mycobacterium tuberculosis
LVQLAPHAVQM

SEQ ID NO: 52238 - protein, 11 aa, Mycobacterium tuberculosis
VQLAPHAVQMS

SEQ ID NO: 52239 - protein, 11 aa, Mycobacterium tuberculosis
QLAPHAVQMSQ

SEQ ID NO: 52240 - protein, 11 aa, Mycobacterium tuberculosis
LAPHAVQMSQN

SEQ ID NO: 52241 - protein, 11 aa, Mycobacterium tuberculosis
APHAVQMSQNA

SEQ ID NO: 52242 - protein, 11 aa, Mycobacterium tuberculosis
PHAVQMSQNAS

SEQ ID NO: 52243 - protein, 11 aa, Mycobacterium tuberculosis
HAVQMSQNASP

SEQ ID NO: 52244 - protein, 11 aa, Mycobacterium tuberculosis
AVQMSQNASPI

SEQ ID NO: 52245 - protein, 11 aa, Mycobacterium tuberculosis
VQMSQNASPIA

SEQ ID NO: 52246 - protein, 11 aa, Mycobacterium tuberculosis
QMSQNASPIAQ

SEQ ID NO: 52247 - protein, 11 aa, Mycobacterium tuberculosis
MSQNASPIAQT

SEQ ID NO: 52248 - protein, 11 aa, Mycobacterium tuberculosis
SQNASPIAQTI

SEQ ID NO: 52249 - protein, 11 aa, Mycobacterium tuberculosis
QNASPIAQTIS

SEQ ID NO: 52250 - protein, 11 aa, Mycobacterium tuberculosis
NASPIAQTISQ

SEQ ID NO: 52251 - protein, 11 aa, Mycobacterium tuberculosis
ASPIAQTISQT

SEQ ID NO: 52252 - protein, 11 aa, Mycobacterium tuberculosis
SPIAQTISQTA

SEQ ID NO: 52253 - protein, 11 aa, Mycobacterium tuberculosis
PIAQTISQTAQ

SEQ ID NO: 52254 - protein, 11 aa, Mycobacterium tuberculosis
IAQTISQTAQQ

SEQ ID NO: 52255 - protein, 11 aa, Mycobacterium tuberculosis
AQTISQTAQQA

SEQ ID NO: 52256 - protein, 11 aa, Mycobacterium tuberculosis
QTISQTAQQAA

SEQ ID NO: 52257 - protein, 11 aa, Mycobacterium tuberculosis
TISQTAQQAAQ

SEQ ID NO: 52258 - protein, 11 aa, Mycobacterium tuberculosis
ISQTAQQAAQS

SEQ ID NO: 52259 - protein, 11 aa, Mycobacterium tuberculosis
SQTAQQAAQSA

SEQ ID NO: 52260 - protein, 11 aa, Mycobacterium tuberculosis
QTAQQAAQSAQ

SEQ ID NO: 52261 - protein, 11 aa, Mycobacterium tuberculosis
TAQQAAQSAQG

SEQ ID NO: 52262 - protein, 11 aa, Mycobacterium tuberculosis
AQQAAQSAQGG

SEQ ID NO: 52263 - protein, 11 aa, Mycobacterium tuberculosis
QQAAQSAQGGS

SEQ ID NO: 52264 - protein, 11 aa, Mycobacterium tuberculosis
QAAQSAQGGSG

SEQ ID NO: 52265 - protein, 11 aa, Mycobacterium tuberculosis
AAQSAQGGSGP

SEQ ID NO: 52266 - protein, 11 aa, Mycobacterium tuberculosis
AQSAQGGSGPM

SEQ ID NO: 52267 - protein, 11 aa, Mycobacterium tuberculosis
QSAQGGSGPMP

SEQ ID NO: 52268 - protein, 11 aa, Mycobacterium tuberculosis
SAQGGSGPMPA

SEQ ID NO: 52269 - protein, 11 aa, Mycobacterium tuberculosis
AQGGSGPMPAQ

SEQ ID NO: 52270 - protein, 11 aa, Mycobacterium tuberculosis
QGGSGPMPAQL

SEQ ID NO: 52271 - protein, 11 aa, Mycobacterium tuberculosis
GGSGPMPAQLA

SEQ ID NO: 52272 - protein, 11 aa, Mycobacterium tuberculosis
GSGPMPAQLAS

SEQ ID NO: 52273 - protein, 11 aa, Mycobacterium tuberculosis
SGPMPAQLASA

SEQ ID NO: 52274 - protein, 11 aa, Mycobacterium tuberculosis
GPMPAQLASAE

SEQ ID NO: 52275 - protein, 11 aa, Mycobacterium tuberculosis
PMPAQLASAEK

SEQ ID NO: 52276 - protein, 11 aa, Mycobacterium tuberculosis
MPAQLASAEKP

SEQ ID NO: 52277 - protein, 11 aa, Mycobacterium tuberculosis
PAQLASAEKPA

SEQ ID NO: 52278 - protein, 11 aa, Mycobacterium tuberculosis
AQLASAEKPAT

SEQ ID NO: 52279 - protein, 11 aa, Mycobacterium tuberculosis
QLASAEKPATE

SEQ ID NO: 52280 - protein, 11 aa, Mycobacterium tuberculosis
LASAEKPATEQ

SEQ ID NO: 52281 - protein, 11 aa, Mycobacterium tuberculosis
ASAEKPATEQA

SEQ ID NO: 52282 - protein, 11 aa, Mycobacterium tuberculosis
SAEKPATEQAE

SEQ ID NO: 52283 - protein, 11 aa, Mycobacterium tuberculosis
AEKPATEQAEP

SEQ ID NO: 52284 - protein, 11 aa, Mycobacterium tuberculosis
EKPATEQAEPV

SEQ ID NO: 52285 - protein, 11 aa, Mycobacterium tuberculosis
KPATEQAEPVH

SEQ ID NO: 52286 - protein, 11 aa, Mycobacterium tuberculosis
PATEQAEPVHE

SEQ ID NO: 52287 - protein, 11 aa, Mycobacterium tuberculosis
ATEQAEPVHEV

SEQ ID NO: 52288 - protein, 11 aa, Mycobacterium tuberculosis
TEQAEPVHEVT

SEQ ID NO: 52289 - protein, 11 aa, Mycobacterium tuberculosis
EQAEPVHEVTN

SEQ ID NO: 52290 - protein, 11 aa, Mycobacterium tuberculosis
QAEPVHEVTND

SEQ ID NO: 52291 - protein, 11 aa, Mycobacterium tuberculosis
AEPVHEVTNDD

SEQ ID NO: 52292 - protein, 11 aa, Mycobacterium tuberculosis
EPVHEVTNDDQ

SEQ ID NO: 52293 - protein, 11 aa, Mycobacterium tuberculosis
PVHEVTNDDQG

SEQ ID NO: 52294 - protein, 11 aa, Mycobacterium tuberculosis
VHEVTNDDQGD

SEQ ID NO: 52295 - protein, 11 aa, Mycobacterium tuberculosis
HEVTNDDQGDQ

SEQ ID NO: 52296 - protein, 11 aa, Mycobacterium tuberculosis
EVTNDDQGDQG

SEQ ID NO: 52297 - protein, 11 aa, Mycobacterium tuberculosis
VTNDDQGDQGD

SEQ ID NO: 52298 - protein, 11 aa, Mycobacterium tuberculosis
TNDDQGDQGDV

SEQ ID NO: 52299 - protein, 11 aa, Mycobacterium tuberculosis
NDDQGDQGDVQ

SEQ ID NO: 52300 - protein, 11 aa, Mycobacterium tuberculosis
DDQGDQGDVQP

SEQ ID NO: 52301 - protein, 11 aa, Mycobacterium tuberculosis
DQGDQGDVQPA

SEQ ID NO: 52302 - protein, 11 aa, Mycobacterium tuberculosis
QGDQGDVQPAE

SEQ ID NO: 52303 - protein, 11 aa, Mycobacterium tuberculosis
GDQGDVQPAEV

SEQ ID NO: 52304 - protein, 11 aa, Mycobacterium tuberculosis
DQGDVQPAEVV

SEQ ID NO: 52305 - protein, 11 aa, Mycobacterium tuberculosis
QGDVQPAEVVA

SEQ ID NO: 52306 - protein, 11 aa, Mycobacterium tuberculosis
GDVQPAEVVAA

SEQ ID NO: 52307 - protein, 11 aa, Mycobacterium tuberculosis
DVQPAEVVAAA

SEQ ID NO: 52308 - protein, 11 aa, Mycobacterium tuberculosis
VQPAEVVAAAR

SEQ ID NO: 52309 - protein, 11 aa, Mycobacterium tuberculosis
QPAEVVAAARD

SEQ ID NO: 52310 - protein, 11 aa, Mycobacterium tuberculosis
PAEVVAAARDE

SEQ ID NO: 52311 - protein, 11 aa, Mycobacterium tuberculosis
AEVVAAARDEG

SEQ ID NO: 52312 - protein, 11 aa, Mycobacterium tuberculosis
EVVAAARDEGA

SEQ ID NO: 52313 - protein, 11 aa, Mycobacterium tuberculosis
VVAAARDEGAG

SEQ ID NO: 52314 - protein, 11 aa, Mycobacterium tuberculosis
VAAARDEGAGA

SEQ ID NO: 52315 - protein, 11 aa, Mycobacterium tuberculosis
AAARDEGAGAS

SEQ ID NO: 52316 - protein, 11 aa, Mycobacterium tuberculosis
AARDEGAGASP

SEQ ID NO: 52317 - protein, 11 aa, Mycobacterium tuberculosis
ARDEGAGASPG

SEQ ID NO: 52318 - protein, 11 aa, Mycobacterium tuberculosis
RDEGAGASPGQ

SEQ ID NO: 52319 - protein, 11 aa, Mycobacterium tuberculosis
DEGAGASPGQQ

SEQ ID NO: 52320 - protein, 11 aa, Mycobacterium tuberculosis
EGAGASPGQQP

SEQ ID NO: 52321 - protein, 11 aa, Mycobacterium tuberculosis
GAGASPGQQPG

SEQ ID NO: 52322 - protein, 11 aa, Mycobacterium tuberculosis
AGASPGQQPGG

SEQ ID NO: 52323 - protein, 11 aa, Mycobacterium tuberculosis
GASPGQQPGGG

SEQ ID NO: 52324 - protein, 11 aa, Mycobacterium tuberculosis
ASPGQQPGGGV

SEQ ID NO: 52325 - protein, 11 aa, Mycobacterium tuberculosis
SPGQQPGGGVP

SEQ ID NO: 52326 - protein, 11 aa, Mycobacterium tuberculosis
PGQQPGGGVPA

SEQ ID NO: 52327 - protein, 11 aa, Mycobacterium tuberculosis
GQQPGGGVPAQ

SEQ ID NO: 52328 - protein, 11 aa, Mycobacterium tuberculosis
QQPGGGVPAQA

SEQ ID NO: 52329 - protein, 11 aa, Mycobacterium tuberculosis
QPGGGVPAQAM

SEQ ID NO: 52330 - protein, 11 aa, Mycobacterium tuberculosis
PGGGVPAQAMD

SEQ ID NO: 52331 - protein, 11 aa, Mycobacterium tuberculosis
GGGVPAQAMDT

SEQ ID NO: 52332 - protein, 11 aa, Mycobacterium tuberculosis
GGVPAQAMDTG

SEQ ID NO: 52333 - protein, 11 aa, Mycobacterium tuberculosis
GVPAQAMDTGA

SEQ ID NO: 52334 - protein, 11 aa, Mycobacterium tuberculosis
VPAQAMDTGAG

SEQ ID NO: 52335 - protein, 11 aa, Mycobacterium tuberculosis
PAQAMDTGAGA

SEQ ID NO: 52336 - protein, 11 aa, Mycobacterium tuberculosis
AQAMDTGAGAR

SEQ ID NO: 52337 - protein, 11 aa, Mycobacterium tuberculosis
QAMDTGAGARP

SEQ ID NO: 52338 - protein, 11 aa, Mycobacterium tuberculosis
AMDTGAGARPA

SEQ ID NO: 52339 - protein, 11 aa, Mycobacterium tuberculosis
MDTGAGARPAA

SEQ ID NO: 52340 - protein, 11 aa, Mycobacterium tuberculosis
DTGAGARPAAS

SEQ ID NO: 52341 - protein, 11 aa, Mycobacterium tuberculosis
TGAGARPAASP

SEQ ID NO: 52342 - protein, 11 aa, Mycobacterium tuberculosis
GAGARPAASPL

SEQ ID NO: 52343 - protein, 11 aa, Mycobacterium tuberculosis
AGARPAASPLA

SEQ ID NO: 52344 - protein, 11 aa, Mycobacterium tuberculosis
GARPAASPLAA

SEQ ID NO: 52345 - protein, 11 aa, Mycobacterium tuberculosis
ARPAASPLAAP

SEQ ID NO: 52346 - protein, 11 aa, Mycobacterium tuberculosis
RPAASPLAAPV

SEQ ID NO: 52347 - protein, 11 aa, Mycobacterium tuberculosis
PAASPLAAPVD

SEQ ID NO: 52348 - protein, 11 aa, Mycobacterium tuberculosis
AASPLAAPVDP

SEQ ID NO: 52349 - protein, 11 aa, Mycobacterium tuberculosis
ASPLAAPVDPS

SEQ ID NO: 52350 - protein, 11 aa, Mycobacterium tuberculosis
SPLAAPVDPST

SEQ ID NO: 52351 - protein, 11 aa, Mycobacterium tuberculosis
PLAAPVDPSTP

SEQ ID NO: 52352 - protein, 11 aa, Mycobacterium tuberculosis
LAAPVDPSTPA

SEQ ID NO: 52353 - protein, 11 aa, Mycobacterium tuberculosis
AAPVDPSTPAP

SEQ ID NO: 52354 - protein, 11 aa, Mycobacterium tuberculosis
APVDPSTPAPS

SEQ ID NO: 52355 - protein, 11 aa, Mycobacterium tuberculosis
PVDPSTPAPST

SEQ ID NO: 52356 - protein, 11 aa, Mycobacterium tuberculosis
VDPSTPAPSTT

SEQ ID NO: 52357 - protein, 11 aa, Mycobacterium tuberculosis
DPSTPAPSTTT

SEQ ID NO: 52358 - protein, 11 aa, Mycobacterium tuberculosis
PSTPAPSTTTT

SEQ ID NO: 52359 - protein, 11 aa, Mycobacterium tuberculosis
STPAPSTTTTL

SEQ ID NO: 52360 - protein, 8 aa, Mycobacterium tuberculosis
MSITRPTG

SEQ ID NO: 52361 - protein, 8 aa, Mycobacterium tuberculosis
SITRPTGS

SEQ ID NO: 52362 - protein, 8 aa, Mycobacterium tuberculosis
ITRPTGSY

SEQ ID NO: 52363 - protein, 8 aa, Mycobacterium tuberculosis
TRPTGSYA

SEQ ID NO: 52364 - protein, 8 aa, Mycobacterium tuberculosis
RPTGSYAR

SEQ ID NO: 52365 - protein, 8 aa, Mycobacterium tuberculosis
PTGSYARQ

SEQ ID NO: 52366 - protein, 8 aa, Mycobacterium tuberculosis
TGSYARQM

SEQ ID NO: 52367 - protein, 8 aa, Mycobacterium tuberculosis
GSYARQML

SEQ ID NO: 52368 - protein, 8 aa, Mycobacterium tuberculosis
SYARQMLD

SEQ ID NO: 52369 - protein, 8 aa, Mycobacterium tuberculosis
YARQMLDP

SEQ ID NO: 52370 - protein, 8 aa, Mycobacterium tuberculosis
ARQMLDPG

SEQ ID NO: 52371 - protein, 8 aa, Mycobacterium tuberculosis
RQMLDPGG

SEQ ID NO: 52372 - protein, 8 aa, Mycobacterium tuberculosis
QMLDPGGW

SEQ ID NO: 52373 - protein, 8 aa, Mycobacterium tuberculosis
MLDPGGWV

SEQ ID NO: 52374 - protein, 8 aa, Mycobacterium tuberculosis
LDPGGWVE

SEQ ID NO: 52375 - protein, 8 aa, Mycobacterium tuberculosis
DPGGWVEA

SEQ ID NO: 52376 - protein, 8 aa, Mycobacterium tuberculosis
PGGWVEAD

SEQ ID NO: 52377 - protein, 8 aa, Mycobacterium tuberculosis
GGWVEADE

SEQ ID NO: 52378 - protein, 8 aa, Mycobacterium tuberculosis
GWVEADED

SEQ ID NO: 52379 - protein, 8 aa, Mycobacterium tuberculosis
WVEADEDT

SEQ ID NO: 52380 - protein, 8 aa, Mycobacterium tuberculosis
VEADEDTF

SEQ ID NO: 52381 - protein, 8 aa, Mycobacterium tuberculosis
EADEDTFY

SEQ ID NO: 52382 - protein, 8 aa, Mycobacterium tuberculosis
ADEDTFYD

SEQ ID NO: 52383 - protein, 8 aa, Mycobacterium tuberculosis
DEDTFYDR

SEQ ID NO: 52384 - protein, 8 aa, Mycobacterium tuberculosis
EDTFYDRA

SEQ ID NO: 52385 - protein, 8 aa, Mycobacterium tuberculosis
DTFYDRAQ

SEQ ID NO: 52386 - protein, 8 aa, Mycobacterium tuberculosis
TFYDRAQE

SEQ ID NO: 52387 - protein, 8 aa, Mycobacterium tuberculosis
FYDRAQEY

SEQ ID NO: 52388 - protein, 8 aa, Mycobacterium tuberculosis
YDRAQEYS

SEQ ID NO: 52389 - protein, 8 aa, Mycobacterium tuberculosis
DRAQEYSQ

SEQ ID NO: 52390 - protein, 8 aa, Mycobacterium tuberculosis
RAQEYSQV

SEQ ID NO: 52391 - protein, 8 aa, Mycobacterium tuberculosis
AQEYSQVL

SEQ ID NO: 52392 - protein, 8 aa, Mycobacterium tuberculosis
QEYSQVLQ

SEQ ID NO: 52393 - protein, 8 aa, Mycobacterium tuberculosis
EYSQVLQR

SEQ ID NO: 52394 - protein, 8 aa, Mycobacterium tuberculosis
YSQVLQRV

SEQ ID NO: 52395 - protein, 8 aa, Mycobacterium tuberculosis
SQVLQRVT

SEQ ID NO: 52396 - protein, 8 aa, Mycobacterium tuberculosis
QVLQRVTD

SEQ ID NO: 52397 - protein, 8 aa, Mycobacterium tuberculosis
VLQRVTDV

SEQ ID NO: 52398 - protein, 8 aa, Mycobacterium tuberculosis
LQRVTDVL

SEQ ID NO: 52399 - protein, 8 aa, Mycobacterium tuberculosis
QRVTDVLD

SEQ ID NO: 52400 - protein, 8 aa, Mycobacterium tuberculosis
RVTDVLDT

SEQ ID NO: 52401 - protein, 8 aa, Mycobacterium tuberculosis
VTDVLDTC

SEQ ID NO: 52402 - protein, 8 aa, Mycobacterium tuberculosis
TDVLDTCR

SEQ ID NO: 52403 - protein, 8 aa, Mycobacterium tuberculosis
DVLDTCRQ

SEQ ID NO: 52404 - protein, 8 aa, Mycobacterium tuberculosis
VLDTCRQQ

SEQ ID NO: 52405 - protein, 8 aa, Mycobacterium tuberculosis
LDTCRQQK

SEQ ID NO: 52406 - protein, 8 aa, Mycobacterium tuberculosis
DTCRQQKG

SEQ ID NO: 52407 - protein, 8 aa, Mycobacterium tuberculosis
TCRQQKGH

SEQ ID NO: 52408 - protein, 8 aa, Mycobacterium tuberculosis
CRQQKGHV

SEQ ID NO: 52409 - protein, 8 aa, Mycobacterium tuberculosis
RQQKGHVF

SEQ ID NO: 52410 - protein, 8 aa, Mycobacterium tuberculosis
QQKGHVFE

SEQ ID NO: 52411 - protein, 8 aa, Mycobacterium tuberculosis
QKGHVFEG

SEQ ID NO: 52412 - protein, 8 aa, Mycobacterium tuberculosis
KGHVFEGG

SEQ ID NO: 52413 - protein, 8 aa, Mycobacterium tuberculosis
GHVFEGGL

SEQ ID NO: 52414 - protein, 8 aa, Mycobacterium tuberculosis
HVFEGGLW

SEQ ID NO: 52415 - protein, 8 aa, Mycobacterium tuberculosis
VFEGGLWS

SEQ ID NO: 52416 - protein, 8 aa, Mycobacterium tuberculosis
FEGGLWSG

SEQ ID NO: 52417 - protein, 8 aa, Mycobacterium tuberculosis
EGGLWSGG

SEQ ID NO: 52418 - protein, 8 aa, Mycobacterium tuberculosis
GGLWSGGA

SEQ ID NO: 52419 - protein, 8 aa, Mycobacterium tuberculosis
GLWSGGAA

SEQ ID NO: 52420 - protein, 8 aa, Mycobacterium tuberculosis
LWSGGAAN

SEQ ID NO: 52421 - protein, 8 aa, Mycobacterium tuberculosis
WSGGAANA

SEQ ID NO: 52422 - protein, 8 aa, Mycobacterium tuberculosis
SGGAANAA

SEQ ID NO: 52423 - protein, 8 aa, Mycobacterium tuberculosis
GGAANAAN

SEQ ID NO: 52424 - protein, 8 aa, Mycobacterium tuberculosis
GAANAANG

SEQ ID NO: 52425 - protein, 8 aa, Mycobacterium tuberculosis
AANAANGA

SEQ ID NO: 52426 - protein, 8 aa, Mycobacterium tuberculosis
ANAANGAL

SEQ ID NO: 52427 - protein, 8 aa, Mycobacterium tuberculosis
NAANGALG

SEQ ID NO: 52428 - protein, 8 aa, Mycobacterium tuberculosis
AANGALGA

SEQ ID NO: 52429 - protein, 8 aa, Mycobacterium tuberculosis
ANGALGAN

SEQ ID NO: 52430 - protein, 8 aa, Mycobacterium tuberculosis
NGALGANI

SEQ ID NO: 52431 - protein, 8 aa, Mycobacterium tuberculosis
GALGANIN

SEQ ID NO: 52432 - protein, 8 aa, Mycobacterium tuberculosis
ALGANINQ

SEQ ID NO: 52433 - protein, 8 aa, Mycobacterium tuberculosis
LGANINQL

SEQ ID NO: 52434 - protein, 8 aa, Mycobacterium tuberculosis
GANINQLM

SEQ ID NO: 52435 - protein, 8 aa, Mycobacterium tuberculosis
ANINQLMT

SEQ ID NO: 52436 - protein, 8 aa, Mycobacterium tuberculosis
NINQLMTL

SEQ ID NO: 52437 - protein, 8 aa, Mycobacterium tuberculosis
INQLMTLQ

SEQ ID NO: 52438 - protein, 8 aa, Mycobacterium tuberculosis
NQLMTLQD

SEQ ID NO: 52439 - protein, 8 aa, Mycobacterium tuberculosis
QLMTLQDY

SEQ ID NO: 52440 - protein, 8 aa, Mycobacterium tuberculosis
LMTLQDYL

SEQ ID NO: 52441 - protein, 8 aa, Mycobacterium tuberculosis
MTLQDYLA

SEQ ID NO: 52442 - protein, 8 aa, Mycobacterium tuberculosis
TLQDYLAT

SEQ ID NO: 52443 - protein, 8 aa, Mycobacterium tuberculosis
LQDYLATV

SEQ ID NO: 52444 - protein, 8 aa, Mycobacterium tuberculosis
QDYLATVI

SEQ ID NO: 52445 - protein, 8 aa, Mycobacterium tuberculosis
DYLATVIT

SEQ ID NO: 52446 - protein, 8 aa, Mycobacterium tuberculosis
YLATVITW

SEQ ID NO: 52447 - protein, 8 aa, Mycobacterium tuberculosis
LATVITWH

SEQ ID NO: 52448 - protein, 8 aa, Mycobacterium tuberculosis
ATVITWHR

SEQ ID NO: 52449 - protein, 8 aa, Mycobacterium tuberculosis
TVITWHRH

SEQ ID NO: 52450 - protein, 8 aa, Mycobacterium tuberculosis
VITWHRHI

SEQ ID NO: 52451 - protein, 8 aa, Mycobacterium tuberculosis
ITWHRHIA

SEQ ID NO: 52452 - protein, 8 aa, Mycobacterium tuberculosis
TWHRHIAG

SEQ ID NO: 52453 - protein, 8 aa, Mycobacterium tuberculosis
WHRHIAGL

SEQ ID NO: 52454 - protein, 8 aa, Mycobacterium tuberculosis
HRHIAGLI

SEQ ID NO: 52455 - protein, 8 aa, Mycobacterium tuberculosis
RHIAGLIE

SEQ ID NO: 52456 - protein, 8 aa, Mycobacterium tuberculosis
HIAGLIEQ

SEQ ID NO: 52457 - protein, 8 aa, Mycobacterium tuberculosis
IAGLIEQA

SEQ ID NO: 52458 - protein, 8 aa, Mycobacterium tuberculosis
AGLIEQAK

SEQ ID NO: 52459 - protein, 8 aa, Mycobacterium tuberculosis
GLIEQAKS

SEQ ID NO: 52460 - protein, 8 aa, Mycobacterium tuberculosis
LIEQAKSD

SEQ ID NO: 52461 - protein, 8 aa, Mycobacterium tuberculosis
IEQAKSDI

SEQ ID NO: 52462 - protein, 8 aa, Mycobacterium tuberculosis
EQAKSDIG

SEQ ID NO: 52463 - protein, 8 aa, Mycobacterium tuberculosis
QAKSDIGN

SEQ ID NO: 52464 - protein, 8 aa, Mycobacterium tuberculosis
AKSDIGNN

SEQ ID NO: 52465 - protein, 8 aa, Mycobacterium tuberculosis
KSDIGNNV

SEQ ID NO: 52466 - protein, 8 aa, Mycobacterium tuberculosis
SDIGNNVD

SEQ ID NO: 52467 - protein, 8 aa, Mycobacterium tuberculosis
DIGNNVDG

SEQ ID NO: 52468 - protein, 8 aa, Mycobacterium tuberculosis
IGNNVDGA

SEQ ID NO: 52469 - protein, 8 aa, Mycobacterium tuberculosis
GNNVDGAQ

SEQ ID NO: 52470 - protein, 8 aa, Mycobacterium tuberculosis
NNVDGAQR

SEQ ID NO: 52471 - protein, 8 aa, Mycobacterium tuberculosis
NVDGAQRE

SEQ ID NO: 52472 - protein, 8 aa, Mycobacterium tuberculosis
VDGAQREI

SEQ ID NO: 52473 - protein, 8 aa, Mycobacterium tuberculosis
DGAQREID

SEQ ID NO: 52474 - protein, 8 aa, Mycobacterium tuberculosis
GAQREIDI

SEQ ID NO: 52475 - protein, 8 aa, Mycobacterium tuberculosis
AQREIDIL

SEQ ID NO: 52476 - protein, 8 aa, Mycobacterium tuberculosis
QREIDILE

SEQ ID NO: 52477 - protein, 8 aa, Mycobacterium tuberculosis
REIDILEN

SEQ ID NO: 52478 - protein, 8 aa, Mycobacterium tuberculosis
EIDILEND

SEQ ID NO: 52479 - protein, 8 aa, Mycobacterium tuberculosis
IDILENDP

SEQ ID NO: 52480 - protein, 8 aa, Mycobacterium tuberculosis
DILENDPS

SEQ ID NO: 52481 - protein, 8 aa, Mycobacterium tuberculosis
ILENDPSL

SEQ ID NO: 52482 - protein, 8 aa, Mycobacterium tuberculosis
LENDPSLD

SEQ ID NO: 52483 - protein, 8 aa, Mycobacterium tuberculosis
ENDPSLDA

SEQ ID NO: 52484 - protein, 8 aa, Mycobacterium tuberculosis
NDPSLDAD

SEQ ID NO: 52485 - protein, 8 aa, Mycobacterium tuberculosis
DPSLDADE

SEQ ID NO: 52486 - protein, 8 aa, Mycobacterium tuberculosis
PSLDADER

SEQ ID NO: 52487 - protein, 8 aa, Mycobacterium tuberculosis
SLDADERH

SEQ ID NO: 52488 - protein, 8 aa, Mycobacterium tuberculosis
LDADERHT

SEQ ID NO: 52489 - protein, 8 aa, Mycobacterium tuberculosis
DADERHTA

SEQ ID NO: 52490 - protein, 8 aa, Mycobacterium tuberculosis
ADERHTAI

SEQ ID NO: 52491 - protein, 8 aa, Mycobacterium tuberculosis
DERHTAIN

SEQ ID NO: 52492 - protein, 8 aa, Mycobacterium tuberculosis
ERHTAINS

SEQ ID NO: 52493 - protein, 8 aa, Mycobacterium tuberculosis
RHTAINSL

SEQ ID NO: 52494 - protein, 8 aa, Mycobacterium tuberculosis
HTAINSLV

SEQ ID NO: 52495 - protein, 8 aa, Mycobacterium tuberculosis
TAINSLVT

SEQ ID NO: 52496 - protein, 8 aa, Mycobacterium tuberculosis
AINSLVTA

SEQ ID NO: 52497 - protein, 8 aa, Mycobacterium tuberculosis
INSLVTAT

SEQ ID NO: 52498 - protein, 8 aa, Mycobacterium tuberculosis
NSLVTATH

SEQ ID NO: 52499 - protein, 8 aa, Mycobacterium tuberculosis
SLVTATHG

SEQ ID NO: 52500 - protein, 8 aa, Mycobacterium tuberculosis
LVTATHGA

SEQ ID NO: 52501 - protein, 8 aa, Mycobacterium tuberculosis
VTATHGAN

SEQ ID NO: 52502 - protein, 8 aa, Mycobacterium tuberculosis
TATHGANV

SEQ ID NO: 52503 - protein, 8 aa, Mycobacterium tuberculosis
ATHGANVS

SEQ ID NO: 52504 - protein, 8 aa, Mycobacterium tuberculosis
THGANVSL

SEQ ID NO: 52505 - protein, 8 aa, Mycobacterium tuberculosis
HGANVSLV

SEQ ID NO: 52506 - protein, 8 aa, Mycobacterium tuberculosis
GANVSLVA

SEQ ID NO: 52507 - protein, 8 aa, Mycobacterium tuberculosis
ANVSLVAE

SEQ ID NO: 52508 - protein, 8 aa, Mycobacterium tuberculosis
NVSLVAET

SEQ ID NO: 52509 - protein, 8 aa, Mycobacterium tuberculosis
VSLVAETA

SEQ ID NO: 52510 - protein, 8 aa, Mycobacterium tuberculosis
SLVAETAE

SEQ ID NO: 52511 - protein, 8 aa, Mycobacterium tuberculosis
LVAETAER

SEQ ID NO: 52512 - protein, 8 aa, Mycobacterium tuberculosis
VAETAERV

SEQ ID NO: 52513 - protein, 8 aa, Mycobacterium tuberculosis
AETAERVL

SEQ ID NO: 52514 - protein, 8 aa, Mycobacterium tuberculosis
ETAERVLE

SEQ ID NO: 52515 - protein, 8 aa, Mycobacterium tuberculosis
TAERVLES

SEQ ID NO: 52516 - protein, 8 aa, Mycobacterium tuberculosis
AERVLESK

SEQ ID NO: 52517 - protein, 8 aa, Mycobacterium tuberculosis
ERVLESKN

SEQ ID NO: 52518 - protein, 8 aa, Mycobacterium tuberculosis
RVLESKNW

SEQ ID NO: 52519 - protein, 8 aa, Mycobacterium tuberculosis
VLESKNWK

SEQ ID NO: 52520 - protein, 8 aa, Mycobacterium tuberculosis
LESKNWKP

SEQ ID NO: 52521 - protein, 8 aa, Mycobacterium tuberculosis
ESKNWKPP

SEQ ID NO: 52522 - protein, 8 aa, Mycobacterium tuberculosis
SKNWKPPK

SEQ ID NO: 52523 - protein, 8 aa, Mycobacterium tuberculosis
KNWKPPKN

SEQ ID NO: 52524 - protein, 8 aa, Mycobacterium tuberculosis
NWKPPKNA

SEQ ID NO: 52525 - protein, 8 aa, Mycobacterium tuberculosis
WKPPKNAL

SEQ ID NO: 52526 - protein, 8 aa, Mycobacterium tuberculosis
KPPKNALE

SEQ ID NO: 52527 - protein, 8 aa, Mycobacterium tuberculosis
PPKNALED

SEQ ID NO: 52528 - protein, 8 aa, Mycobacterium tuberculosis
PKNALEDL

SEQ ID NO: 52529 - protein, 8 aa, Mycobacterium tuberculosis
KNALEDLL

SEQ ID NO: 52530 - protein, 8 aa, Mycobacterium tuberculosis
NALEDLLQ

SEQ ID NO: 52531 - protein, 8 aa, Mycobacterium tuberculosis
ALEDLLQQ

SEQ ID NO: 52532 - protein, 8 aa, Mycobacterium tuberculosis
LEDLLQQK

SEQ ID NO: 52533 - protein, 8 aa, Mycobacterium tuberculosis
EDLLQQKS

SEQ ID NO: 52534 - protein, 8 aa, Mycobacterium tuberculosis
DLLQQKSP

SEQ ID NO: 52535 - protein, 8 aa, Mycobacterium tuberculosis
LLQQKSPP

SEQ ID NO: 52536 - protein, 8 aa, Mycobacterium tuberculosis
LQQKSPPP

SEQ ID NO: 52537 - protein, 8 aa, Mycobacterium tuberculosis
QQKSPPPP

SEQ ID NO: 52538 - protein, 8 aa, Mycobacterium tuberculosis
QKSPPPPD

SEQ ID NO: 52539 - protein, 8 aa, Mycobacterium tuberculosis
KSPPPPDV

SEQ ID NO: 52540 - protein, 8 aa, Mycobacterium tuberculosis
SPPPPDVP

SEQ ID NO: 52541 - protein, 8 aa, Mycobacterium tuberculosis
PPPPDVPT

SEQ ID NO: 52542 - protein, 8 aa, Mycobacterium tuberculosis
PPPDVPTL

SEQ ID NO: 52543 - protein, 8 aa, Mycobacterium tuberculosis
PPDVPTLV

SEQ ID NO: 52544 - protein, 8 aa, Mycobacterium tuberculosis
PDVPTLVV

SEQ ID NO: 52545 - protein, 8 aa, Mycobacterium tuberculosis
DVPTLVVP

SEQ ID NO: 52546 - protein, 8 aa, Mycobacterium tuberculosis
VPTLVVPS

SEQ ID NO: 52547 - protein, 8 aa, Mycobacterium tuberculosis
PTLVVPSP

SEQ ID NO: 52548 - protein, 8 aa, Mycobacterium tuberculosis
TLVVPSPG

SEQ ID NO: 52549 - protein, 8 aa, Mycobacterium tuberculosis
LVVPSPGT

SEQ ID NO: 52550 - protein, 8 aa, Mycobacterium tuberculosis
VVPSPGTP

SEQ ID NO: 52551 - protein, 8 aa, Mycobacterium tuberculosis
VPSPGTPG

SEQ ID NO: 52552 - protein, 8 aa, Mycobacterium tuberculosis
PSPGTPGT

SEQ ID NO: 52553 - protein, 8 aa, Mycobacterium tuberculosis
SPGTPGTP

SEQ ID NO: 52554 - protein, 8 aa, Mycobacterium tuberculosis
PGTPGTPG

SEQ ID NO: 52555 - protein, 8 aa, Mycobacterium tuberculosis
GTPGTPGT

SEQ ID NO: 52556 - protein, 8 aa, Mycobacterium tuberculosis
TPGTPGTP

SEQ ID NO: 52557 - protein, 8 aa, Mycobacterium tuberculosis
PGTPGTPI

SEQ ID NO: 52558 - protein, 8 aa, Mycobacterium tuberculosis
GTPGTPIT

SEQ ID NO: 52559 - protein, 8 aa, Mycobacterium tuberculosis
TPGTPITP

SEQ ID NO: 52560 - protein, 8 aa, Mycobacterium tuberculosis
PGTPITPG

SEQ ID NO: 52561 - protein, 8 aa, Mycobacterium tuberculosis
GTPITPGT

SEQ ID NO: 52562 - protein, 8 aa, Mycobacterium tuberculosis
TPITPGTP

SEQ ID NO: 52563 - protein, 8 aa, Mycobacterium tuberculosis
PITPGTPI

SEQ ID NO: 52564 - protein, 8 aa, Mycobacterium tuberculosis
ITPGTPIT

SEQ ID NO: 52565 - protein, 8 aa, Mycobacterium tuberculosis
TPGTPITP

SEQ ID NO: 52566 - protein, 8 aa, Mycobacterium tuberculosis
PGTPITPG

SEQ ID NO: 52567 - protein, 8 aa, Mycobacterium tuberculosis
GTPITPGT

SEQ ID NO: 52568 - protein, 8 aa, Mycobacterium tuberculosis
TPITPGTP

SEQ ID NO: 52569 - protein, 8 aa, Mycobacterium tuberculosis
PITPGTPI

SEQ ID NO: 52570 - protein, 8 aa, Mycobacterium tuberculosis
ITPGTPIT

SEQ ID NO: 52571 - protein, 8 aa, Mycobacterium tuberculosis
TPGTPITP

SEQ ID NO: 52572 - protein, 8 aa, Mycobacterium tuberculosis
PGTPITPI

SEQ ID NO: 52573 - protein, 8 aa, Mycobacterium tuberculosis
GTPITPIP

SEQ ID NO: 52574 - protein, 8 aa, Mycobacterium tuberculosis
TPITPIPG

SEQ ID NO: 52575 - protein, 8 aa, Mycobacterium tuberculosis
PITPIPGA

SEQ ID NO: 52576 - protein, 8 aa, Mycobacterium tuberculosis
ITPIPGAP

SEQ ID NO: 52577 - protein, 8 aa, Mycobacterium tuberculosis
TPIPGAPV

SEQ ID NO: 52578 - protein, 8 aa, Mycobacterium tuberculosis
PIPGAPVT

SEQ ID NO: 52579 - protein, 8 aa, Mycobacterium tuberculosis
IPGAPVTP

SEQ ID NO: 52580 - protein, 8 aa, Mycobacterium tuberculosis
PGAPVTPI

SEQ ID NO: 52581 - protein, 8 aa, Mycobacterium tuberculosis
GAPVTPIT

SEQ ID NO: 52582 - protein, 8 aa, Mycobacterium tuberculosis
APVTPITP

SEQ ID NO: 52583 - protein, 8 aa, Mycobacterium tuberculosis
PVTPITPT

SEQ ID NO: 52584 - protein, 8 aa, Mycobacterium tuberculosis
VTPITPTP

SEQ ID NO: 52585 - protein, 8 aa, Mycobacterium tuberculosis
TPITPTPG

SEQ ID NO: 52586 - protein, 8 aa, Mycobacterium tuberculosis
PITPTPGT

SEQ ID NO: 52587 - protein, 8 aa, Mycobacterium tuberculosis
ITPTPGTP

SEQ ID NO: 52588 - protein, 8 aa, Mycobacterium tuberculosis
TPTPGTPV

SEQ ID NO: 52589 - protein, 8 aa, Mycobacterium tuberculosis
PTPGTPVT

SEQ ID NO: 52590 - protein, 8 aa, Mycobacterium tuberculosis
TPGTPVTP

SEQ ID NO: 52591 - protein, 8 aa, Mycobacterium tuberculosis
PGTPVTPV

SEQ ID NO: 52592 - protein, 8 aa, Mycobacterium tuberculosis
GTPVTPVT

SEQ ID NO: 52593 - protein, 8 aa, Mycobacterium tuberculosis
TPVTPVTP

SEQ ID NO: 52594 - protein, 8 aa, Mycobacterium tuberculosis
PVTPVTPG

SEQ ID NO: 52595 - protein, 8 aa, Mycobacterium tuberculosis
VTPVTPGK

SEQ ID NO: 52596 - protein, 8 aa, Mycobacterium tuberculosis
TPVTPGKP

SEQ ID NO: 52597 - protein, 8 aa, Mycobacterium tuberculosis
PVTPGKPV

SEQ ID NO: 52598 - protein, 8 aa, Mycobacterium tuberculosis
VTPGKPVT

SEQ ID NO: 52599 - protein, 8 aa, Mycobacterium tuberculosis
TPGKPVTP

SEQ ID NO: 52600 - protein, 8 aa, Mycobacterium tuberculosis
PGKPVTPV

SEQ ID NO: 52601 - protein, 8 aa, Mycobacterium tuberculosis
GKPVTPVT

SEQ ID NO: 52602 - protein, 8 aa, Mycobacterium tuberculosis
KPVTPVTP

SEQ ID NO: 52603 - protein, 8 aa, Mycobacterium tuberculosis
PVTPVTPV

SEQ ID NO: 52604 - protein, 8 aa, Mycobacterium tuberculosis
VTPVTPVK

SEQ ID NO: 52605 - protein, 8 aa, Mycobacterium tuberculosis
TPVTPVKP

SEQ ID NO: 52606 - protein, 8 aa, Mycobacterium tuberculosis
PVTPVKPG

SEQ ID NO: 52607 - protein, 8 aa, Mycobacterium tuberculosis
VTPVKPGT

SEQ ID NO: 52608 - protein, 8 aa, Mycobacterium tuberculosis
TPVKPGTP

SEQ ID NO: 52609 - protein, 8 aa, Mycobacterium tuberculosis
PVKPGTPG

SEQ ID NO: 52610 - protein, 8 aa, Mycobacterium tuberculosis
VKPGTPGE

SEQ ID NO: 52611 - protein, 8 aa, Mycobacterium tuberculosis
KPGTPGEP

SEQ ID NO: 52612 - protein, 8 aa, Mycobacterium tuberculosis
PGTPGEPT

SEQ ID NO: 52613 - protein, 8 aa, Mycobacterium tuberculosis
GTPGEPTP

SEQ ID NO: 52614 - protein, 8 aa, Mycobacterium tuberculosis
TPGEPTPI

SEQ ID NO: 52615 - protein, 8 aa, Mycobacterium tuberculosis
PGEPTPIT

SEQ ID NO: 52616 - protein, 8 aa, Mycobacterium tuberculosis
GEPTPITP

SEQ ID NO: 52617 - protein, 8 aa, Mycobacterium tuberculosis
EPTPITPV

SEQ ID NO: 52618 - protein, 8 aa, Mycobacterium tuberculosis
PTPITPVT

SEQ ID NO: 52619 - protein, 8 aa, Mycobacterium tuberculosis
TPITPVTP

SEQ ID NO: 52620 - protein, 8 aa, Mycobacterium tuberculosis
PITPVTPP

SEQ ID NO: 52621 - protein, 8 aa, Mycobacterium tuberculosis
ITPVTPPV

SEQ ID NO: 52622 - protein, 8 aa, Mycobacterium tuberculosis
TPVTPPVA

SEQ ID NO: 52623 - protein, 8 aa, Mycobacterium tuberculosis
PVTPPVAP

SEQ ID NO: 52624 - protein, 8 aa, Mycobacterium tuberculosis
VTPPVAPA

SEQ ID NO: 52625 - protein, 8 aa, Mycobacterium tuberculosis
TPPVAPAT

SEQ ID NO: 52626 - protein, 8 aa, Mycobacterium tuberculosis
PPVAPATP

SEQ ID NO: 52627 - protein, 8 aa, Mycobacterium tuberculosis
PVAPATPA

SEQ ID NO: 52628 - protein, 8 aa, Mycobacterium tuberculosis
VAPATPAT

SEQ ID NO: 52629 - protein, 8 aa, Mycobacterium tuberculosis
APATPATP

SEQ ID NO: 52630 - protein, 8 aa, Mycobacterium tuberculosis
PATPATPA

SEQ ID NO: 52631 - protein, 8 aa, Mycobacterium tuberculosis
ATPATPAT

SEQ ID NO: 52632 - protein, 8 aa, Mycobacterium tuberculosis
TPATPATP

SEQ ID NO: 52633 - protein, 8 aa, Mycobacterium tuberculosis
PATPATPV

SEQ ID NO: 52634 - protein, 8 aa, Mycobacterium tuberculosis
ATPATPVT

SEQ ID NO: 52635 - protein, 8 aa, Mycobacterium tuberculosis
TPATPVTP

SEQ ID NO: 52636 - protein, 8 aa, Mycobacterium tuberculosis
PATPVTPA

SEQ ID NO: 52637 - protein, 8 aa, Mycobacterium tuberculosis
ATPVTPAP

SEQ ID NO: 52638 - protein, 8 aa, Mycobacterium tuberculosis
TPVTPAPA

SEQ ID NO: 52639 - protein, 8 aa, Mycobacterium tuberculosis
PVTPAPAP

SEQ ID NO: 52640 - protein, 8 aa, Mycobacterium tuberculosis
VTPAPAPH

SEQ ID NO: 52641 - protein, 8 aa, Mycobacterium tuberculosis
TPAPAPHP

SEQ ID NO: 52642 - protein, 8 aa, Mycobacterium tuberculosis
PAPAPHPQ

SEQ ID NO: 52643 - protein, 8 aa, Mycobacterium tuberculosis
APAPHPQP

SEQ ID NO: 52644 - protein, 8 aa, Mycobacterium tuberculosis
PAPHPQPA

SEQ ID NO: 52645 - protein, 8 aa, Mycobacterium tuberculosis
APHPQPAP

SEQ ID NO: 52646 - protein, 8 aa, Mycobacterium tuberculosis
PHPQPAPA

SEQ ID NO: 52647 - protein, 8 aa, Mycobacterium tuberculosis
HPQPAPAP

SEQ ID NO: 52648 - protein, 8 aa, Mycobacterium tuberculosis
PQPAPAPA

SEQ ID NO: 52649 - protein, 8 aa, Mycobacterium tuberculosis
QPAPAPAP

SEQ ID NO: 52650 - protein, 8 aa, Mycobacterium tuberculosis
PAPAPAPS

SEQ ID NO: 52651 - protein, 8 aa, Mycobacterium tuberculosis
APAPAPSP

SEQ ID NO: 52652 - protein, 8 aa, Mycobacterium tuberculosis
PAPAPSPG

SEQ ID NO: 52653 - protein, 8 aa, Mycobacterium tuberculosis
APAPSPGP

SEQ ID NO: 52654 - protein, 8 aa, Mycobacterium tuberculosis
PAPSPGPQ

SEQ ID NO: 52655 - protein, 8 aa, Mycobacterium tuberculosis
APSPGPQP

SEQ ID NO: 52656 - protein, 8 aa, Mycobacterium tuberculosis
PSPGPQPV

SEQ ID NO: 52657 - protein, 8 aa, Mycobacterium tuberculosis
SPGPQPVT

SEQ ID NO: 52658 - protein, 8 aa, Mycobacterium tuberculosis
PGPQPVTP

SEQ ID NO: 52659 - protein, 8 aa, Mycobacterium tuberculosis
GPQPVTPA

SEQ ID NO: 52660 - protein, 8 aa, Mycobacterium tuberculosis
PQPVTPAT

SEQ ID NO: 52661 - protein, 8 aa, Mycobacterium tuberculosis
QPVTPATP

SEQ ID NO: 52662 - protein, 8 aa, Mycobacterium tuberculosis
PVTPATPG

SEQ ID NO: 52663 - protein, 8 aa, Mycobacterium tuberculosis
VTPATPGP

SEQ ID NO: 52664 - protein, 8 aa, Mycobacterium tuberculosis
TPATPGPS

SEQ ID NO: 52665 - protein, 8 aa, Mycobacterium tuberculosis
PATPGPSG

SEQ ID NO: 52666 - protein, 8 aa, Mycobacterium tuberculosis
ATPGPSGP

SEQ ID NO: 52667 - protein, 8 aa, Mycobacterium tuberculosis
TPGPSGPA

SEQ ID NO: 52668 - protein, 8 aa, Mycobacterium tuberculosis
PGPSGPAT

SEQ ID NO: 52669 - protein, 8 aa, Mycobacterium tuberculosis
GPSGPATP

SEQ ID NO: 52670 - protein, 8 aa, Mycobacterium tuberculosis
PSGPATPG

SEQ ID NO: 52671 - protein, 8 aa, Mycobacterium tuberculosis
SGPATPGT

SEQ ID NO: 52672 - protein, 8 aa, Mycobacterium tuberculosis
GPATPGTP

SEQ ID NO: 52673 - protein, 8 aa, Mycobacterium tuberculosis
PATPGTPG

SEQ ID NO: 52674 - protein, 8 aa, Mycobacterium tuberculosis
ATPGTPGG

SEQ ID NO: 52675 - protein, 8 aa, Mycobacterium tuberculosis
TPGTPGGE

SEQ ID NO: 52676 - protein, 8 aa, Mycobacterium tuberculosis
PGTPGGEP

SEQ ID NO: 52677 - protein, 8 aa, Mycobacterium tuberculosis
GTPGGEPA

SEQ ID NO: 52678 - protein, 8 aa, Mycobacterium tuberculosis
TPGGEPAP

SEQ ID NO: 52679 - protein, 8 aa, Mycobacterium tuberculosis
PGGEPAPH

SEQ ID NO: 52680 - protein, 8 aa, Mycobacterium tuberculosis
GGEPAPHV

SEQ ID NO: 52681 - protein, 8 aa, Mycobacterium tuberculosis
GEPAPHVK

SEQ ID NO: 52682 - protein, 8 aa, Mycobacterium tuberculosis
EPAPHVKP

SEQ ID NO: 52683 - protein, 8 aa, Mycobacterium tuberculosis
PAPHVKPA

SEQ ID NO: 52684 - protein, 8 aa, Mycobacterium tuberculosis
APHVKPAA

SEQ ID NO: 52685 - protein, 8 aa, Mycobacterium tuberculosis
PHVKPAAL

SEQ ID NO: 52686 - protein, 8 aa, Mycobacterium tuberculosis
HVKPAALA

SEQ ID NO: 52687 - protein, 8 aa, Mycobacterium tuberculosis
VKPAALAE

SEQ ID NO: 52688 - protein, 8 aa, Mycobacterium tuberculosis
KPAALAEQ

SEQ ID NO: 52689 - protein, 8 aa, Mycobacterium tuberculosis
PAALAEQP

SEQ ID NO: 52690 - protein, 8 aa, Mycobacterium tuberculosis
AALAEQPG

SEQ ID NO: 52691 - protein, 8 aa, Mycobacterium tuberculosis
ALAEQPGV

SEQ ID NO: 52692 - protein, 8 aa, Mycobacterium tuberculosis
LAEQPGVP

SEQ ID NO: 52693 - protein, 8 aa, Mycobacterium tuberculosis
AEQPGVPG

SEQ ID NO: 52694 - protein, 8 aa, Mycobacterium tuberculosis
EQPGVPGQ

SEQ ID NO: 52695 - protein, 8 aa, Mycobacterium tuberculosis
QPGVPGQH

SEQ ID NO: 52696 - protein, 8 aa, Mycobacterium tuberculosis
PGVPGQHA

SEQ ID NO: 52697 - protein, 8 aa, Mycobacterium tuberculosis
GVPGQHAG

SEQ ID NO: 52698 - protein, 8 aa, Mycobacterium tuberculosis
VPGQHAGG

SEQ ID NO: 52699 - protein, 8 aa, Mycobacterium tuberculosis
PGQHAGGG

SEQ ID NO: 52700 - protein, 8 aa, Mycobacterium tuberculosis
GQHAGGGT

SEQ ID NO: 52701 - protein, 8 aa, Mycobacterium tuberculosis
QHAGGGTQ

SEQ ID NO: 52702 - protein, 8 aa, Mycobacterium tuberculosis
HAGGGTQS

SEQ ID NO: 52703 - protein, 8 aa, Mycobacterium tuberculosis
AGGGTQSG

SEQ ID NO: 52704 - protein, 8 aa, Mycobacterium tuberculosis
GGGTQSGP

SEQ ID NO: 52705 - protein, 8 aa, Mycobacterium tuberculosis
GGTQSGPA

SEQ ID NO: 52706 - protein, 8 aa, Mycobacterium tuberculosis
GTQSGPAH

SEQ ID NO: 52707 - protein, 8 aa, Mycobacterium tuberculosis
TQSGPAHA

SEQ ID NO: 52708 - protein, 8 aa, Mycobacterium tuberculosis
QSGPAHAD

SEQ ID NO: 52709 - protein, 8 aa, Mycobacterium tuberculosis
SGPAHADE

SEQ ID NO: 52710 - protein, 8 aa, Mycobacterium tuberculosis
GPAHADES

SEQ ID NO: 52711 - protein, 8 aa, Mycobacterium tuberculosis
PAHADESA

SEQ ID NO: 52712 - protein, 8 aa, Mycobacterium tuberculosis
AHADESAA

SEQ ID NO: 52713 - protein, 8 aa, Mycobacterium tuberculosis
HADESAAS

SEQ ID NO: 52714 - protein, 8 aa, Mycobacterium tuberculosis
ADESAASV

SEQ ID NO: 52715 - protein, 8 aa, Mycobacterium tuberculosis
DESAASVT

SEQ ID NO: 52716 - protein, 8 aa, Mycobacterium tuberculosis
ESAASVTP

SEQ ID NO: 52717 - protein, 8 aa, Mycobacterium tuberculosis
SAASVTPA

SEQ ID NO: 52718 - protein, 8 aa, Mycobacterium tuberculosis
AASVTPAA

SEQ ID NO: 52719 - protein, 8 aa, Mycobacterium tuberculosis
ASVTPAAA

SEQ ID NO: 52720 - protein, 8 aa, Mycobacterium tuberculosis
SVTPAAAS

SEQ ID NO: 52721 - protein, 8 aa, Mycobacterium tuberculosis
VTPAAASG

SEQ ID NO: 52722 - protein, 8 aa, Mycobacterium tuberculosis
TPAAASGV

SEQ ID NO: 52723 - protein, 8 aa, Mycobacterium tuberculosis
PAAASGVP

SEQ ID NO: 52724 - protein, 8 aa, Mycobacterium tuberculosis
AAASGVPG

SEQ ID NO: 52725 - protein, 8 aa, Mycobacterium tuberculosis
AASGVPGA

SEQ ID NO: 52726 - protein, 8 aa, Mycobacterium tuberculosis
ASGVPGAR

SEQ ID NO: 52727 - protein, 8 aa, Mycobacterium tuberculosis
SGVPGARA

SEQ ID NO: 52728 - protein, 8 aa, Mycobacterium tuberculosis
GVPGARAA

SEQ ID NO: 52729 - protein, 8 aa, Mycobacterium tuberculosis
VPGARAAA

SEQ ID NO: 52730 - protein, 8 aa, Mycobacterium tuberculosis
PGARAAAA

SEQ ID NO: 52731 - protein, 8 aa, Mycobacterium tuberculosis
GARAAAAA

SEQ ID NO: 52732 - protein, 8 aa, Mycobacterium tuberculosis
ARAAAAAP

SEQ ID NO: 52733 - protein, 8 aa, Mycobacterium tuberculosis
RAAAAAPS

SEQ ID NO: 52734 - protein, 8 aa, Mycobacterium tuberculosis
AAAAAPSG

SEQ ID NO: 52735 - protein, 8 aa, Mycobacterium tuberculosis
AAAAPSGT

SEQ ID NO: 52736 - protein, 8 aa, Mycobacterium tuberculosis
AAAPSGTA

SEQ ID NO: 52737 - protein, 8 aa, Mycobacterium tuberculosis
AAPSGTAV

SEQ ID NO: 52738 - protein, 8 aa, Mycobacterium tuberculosis
APSGTAVG

SEQ ID NO: 52739 - protein, 8 aa, Mycobacterium tuberculosis
PSGTAVGA

SEQ ID NO: 52740 - protein, 8 aa, Mycobacterium tuberculosis
SGTAVGAG

SEQ ID NO: 52741 - protein, 8 aa, Mycobacterium tuberculosis
GTAVGAGA

SEQ ID NO: 52742 - protein, 8 aa, Mycobacterium tuberculosis
TAVGAGAR

SEQ ID NO: 52743 - protein, 8 aa, Mycobacterium tuberculosis
AVGAGARS

SEQ ID NO: 52744 - protein, 8 aa, Mycobacterium tuberculosis
VGAGARSS

SEQ ID NO: 52745 - protein, 8 aa, Mycobacterium tuberculosis
GAGARSSV

SEQ ID NO: 52746 - protein, 8 aa, Mycobacterium tuberculosis
AGARSSVG

SEQ ID NO: 52747 - protein, 8 aa, Mycobacterium tuberculosis
GARSSVGT

SEQ ID NO: 52748 - protein, 8 aa, Mycobacterium tuberculosis
ARSSVGTA

SEQ ID NO: 52749 - protein, 8 aa, Mycobacterium tuberculosis
RSSVGTAA

SEQ ID NO: 52750 - protein, 8 aa, Mycobacterium tuberculosis
SSVGTAAA

SEQ ID NO: 52751 - protein, 8 aa, Mycobacterium tuberculosis
SVGTAAAS

SEQ ID NO: 52752 - protein, 8 aa, Mycobacterium tuberculosis
VGTAAASG

SEQ ID NO: 52753 - protein, 8 aa, Mycobacterium tuberculosis
GTAAASGA

SEQ ID NO: 52754 - protein, 8 aa, Mycobacterium tuberculosis
TAAASGAG

SEQ ID NO: 52755 - protein, 8 aa, Mycobacterium tuberculosis
AAASGAGS

SEQ ID NO: 52756 - protein, 8 aa, Mycobacterium tuberculosis
AASGAGSH

SEQ ID NO: 52757 - protein, 8 aa, Mycobacterium tuberculosis
ASGAGSHA

SEQ ID NO: 52758 - protein, 8 aa, Mycobacterium tuberculosis
SGAGSHAA

SEQ ID NO: 52759 - protein, 8 aa, Mycobacterium tuberculosis
GAGSHAAT

SEQ ID NO: 52760 - protein, 8 aa, Mycobacterium tuberculosis
AGSHAATG

SEQ ID NO: 52761 - protein, 8 aa, Mycobacterium tuberculosis
GSHAATGR

SEQ ID NO: 52762 - protein, 8 aa, Mycobacterium tuberculosis
SHAATGRA

SEQ ID NO: 52763 - protein, 8 aa, Mycobacterium tuberculosis
HAATGRAP

SEQ ID NO: 52764 - protein, 8 aa, Mycobacterium tuberculosis
AATGRAPV

SEQ ID NO: 52765 - protein, 8 aa, Mycobacterium tuberculosis
ATGRAPVA

SEQ ID NO: 52766 - protein, 8 aa, Mycobacterium tuberculosis
TGRAPVAT

SEQ ID NO: 52767 - protein, 8 aa, Mycobacterium tuberculosis
GRAPVATS

SEQ ID NO: 52768 - protein, 8 aa, Mycobacterium tuberculosis
RAPVATSD

SEQ ID NO: 52769 - protein, 8 aa, Mycobacterium tuberculosis
APVATSDK

SEQ ID NO: 52770 - protein, 8 aa, Mycobacterium tuberculosis
PVATSDKA

SEQ ID NO: 52771 - protein, 8 aa, Mycobacterium tuberculosis
VATSDKAA

SEQ ID NO: 52772 - protein, 8 aa, Mycobacterium tuberculosis
ATSDKAAA

SEQ ID NO: 52773 - protein, 8 aa, Mycobacterium tuberculosis
TSDKAAAP

SEQ ID NO: 52774 - protein, 8 aa, Mycobacterium tuberculosis
SDKAAAPS

SEQ ID NO: 52775 - protein, 8 aa, Mycobacterium tuberculosis
DKAAAPST

SEQ ID NO: 52776 - protein, 8 aa, Mycobacterium tuberculosis
KAAAPSTR

SEQ ID NO: 52777 - protein, 8 aa, Mycobacterium tuberculosis
AAAPSTRA

SEQ ID NO: 52778 - protein, 8 aa, Mycobacterium tuberculosis
AAPSTRAA

SEQ ID NO: 52779 - protein, 8 aa, Mycobacterium tuberculosis
APSTRAAS

SEQ ID NO: 52780 - protein, 8 aa, Mycobacterium tuberculosis
PSTRAASA

SEQ ID NO: 52781 - protein, 8 aa, Mycobacterium tuberculosis
STRAASAR

SEQ ID NO: 52782 - protein, 8 aa, Mycobacterium tuberculosis
TRAASART

SEQ ID NO: 52783 - protein, 8 aa, Mycobacterium tuberculosis
RAASARTA

SEQ ID NO: 52784 - protein, 8 aa, Mycobacterium tuberculosis
AASARTAP

SEQ ID NO: 52785 - protein, 8 aa, Mycobacterium tuberculosis
ASARTAPP

SEQ ID NO: 52786 - protein, 8 aa, Mycobacterium tuberculosis
SARTAPPA

SEQ ID NO: 52787 - protein, 8 aa, Mycobacterium tuberculosis
ARTAPPAR

SEQ ID NO: 52788 - protein, 8 aa, Mycobacterium tuberculosis
RTAPPARP

SEQ ID NO: 52789 - protein, 8 aa, Mycobacterium tuberculosis
TAPPARPP

SEQ ID NO: 52790 - protein, 8 aa, Mycobacterium tuberculosis
APPARPPS

SEQ ID NO: 52791 - protein, 8 aa, Mycobacterium tuberculosis
PPARPPST

SEQ ID NO: 52792 - protein, 8 aa, Mycobacterium tuberculosis
PARPPSTD

SEQ ID NO: 52793 - protein, 8 aa, Mycobacterium tuberculosis
ARPPSTDH

SEQ ID NO: 52794 - protein, 8 aa, Mycobacterium tuberculosis
RPPSTDHI

SEQ ID NO: 52795 - protein, 8 aa, Mycobacterium tuberculosis
PPSTDHID

SEQ ID NO: 52796 - protein, 8 aa, Mycobacterium tuberculosis
PSTDHIDK

SEQ ID NO: 52797 - protein, 8 aa, Mycobacterium tuberculosis
STDHIDKP

SEQ ID NO: 52798 - protein, 8 aa, Mycobacterium tuberculosis
TDHIDKPD

SEQ ID NO: 52799 - protein, 8 aa, Mycobacterium tuberculosis
DHIDKPDR

SEQ ID NO: 52800 - protein, 8 aa, Mycobacterium tuberculosis
HIDKPDRS

SEQ ID NO: 52801 - protein, 8 aa, Mycobacterium tuberculosis
IDKPDRSE

SEQ ID NO: 52802 - protein, 8 aa, Mycobacterium tuberculosis
DKPDRSES

SEQ ID NO: 52803 - protein, 8 aa, Mycobacterium tuberculosis
KPDRSESA

SEQ ID NO: 52804 - protein, 8 aa, Mycobacterium tuberculosis
PDRSESAD

SEQ ID NO: 52805 - protein, 8 aa, Mycobacterium tuberculosis
DRSESADD

SEQ ID NO: 52806 - protein, 8 aa, Mycobacterium tuberculosis
RSESADDG

SEQ ID NO: 52807 - protein, 8 aa, Mycobacterium tuberculosis
SESADDGT

SEQ ID NO: 52808 - protein, 8 aa, Mycobacterium tuberculosis
ESADDGTP

SEQ ID NO: 52809 - protein, 8 aa, Mycobacterium tuberculosis
SADDGTPV

SEQ ID NO: 52810 - protein, 8 aa, Mycobacterium tuberculosis
ADDGTPVS

SEQ ID NO: 52811 - protein, 8 aa, Mycobacterium tuberculosis
DDGTPVSM

SEQ ID NO: 52812 - protein, 8 aa, Mycobacterium tuberculosis
DGTPVSMI

SEQ ID NO: 52813 - protein, 8 aa, Mycobacterium tuberculosis
GTPVSMIP

SEQ ID NO: 52814 - protein, 8 aa, Mycobacterium tuberculosis
TPVSMIPV

SEQ ID NO: 52815 - protein, 8 aa, Mycobacterium tuberculosis
PVSMIPVS

SEQ ID NO: 52816 - protein, 8 aa, Mycobacterium tuberculosis
VSMIPVSA

SEQ ID NO: 52817 - protein, 8 aa, Mycobacterium tuberculosis
SMIPVSAA

SEQ ID NO: 52818 - protein, 8 aa, Mycobacterium tuberculosis
MIPVSAAR

SEQ ID NO: 52819 - protein, 8 aa, Mycobacterium tuberculosis
IPVSAARA

SEQ ID NO: 52820 - protein, 8 aa, Mycobacterium tuberculosis
PVSAARAA

SEQ ID NO: 52821 - protein, 8 aa, Mycobacterium tuberculosis
VSAARAAR

SEQ ID NO: 52822 - protein, 8 aa, Mycobacterium tuberculosis
SAARAARD

SEQ ID NO: 52823 - protein, 8 aa, Mycobacterium tuberculosis
AARAARDA

SEQ ID NO: 52824 - protein, 8 aa, Mycobacterium tuberculosis
ARAARDAA

SEQ ID NO: 52825 - protein, 8 aa, Mycobacterium tuberculosis
RAARDAAT

SEQ ID NO: 52826 - protein, 8 aa, Mycobacterium tuberculosis
AARDAATA

SEQ ID NO: 52827 - protein, 8 aa, Mycobacterium tuberculosis
ARDAATAA

SEQ ID NO: 52828 - protein, 8 aa, Mycobacterium tuberculosis
RDAATAAA

SEQ ID NO: 52829 - protein, 8 aa, Mycobacterium tuberculosis
DAATAAAS

SEQ ID NO: 52830 - protein, 8 aa, Mycobacterium tuberculosis
AATAAASA

SEQ ID NO: 52831 - protein, 8 aa, Mycobacterium tuberculosis
ATAAASAR

SEQ ID NO: 52832 - protein, 8 aa, Mycobacterium tuberculosis
TAAASARQ

SEQ ID NO: 52833 - protein, 8 aa, Mycobacterium tuberculosis
AAASARQR

SEQ ID NO: 52834 - protein, 8 aa, Mycobacterium tuberculosis
AASARQRG

SEQ ID NO: 52835 - protein, 8 aa, Mycobacterium tuberculosis
ASARQRGR

SEQ ID NO: 52836 - protein, 8 aa, Mycobacterium tuberculosis
SARQRGRG

SEQ ID NO: 52837 - protein, 8 aa, Mycobacterium tuberculosis
ARQRGRGD

SEQ ID NO: 52838 - protein, 8 aa, Mycobacterium tuberculosis
RQRGRGDA

SEQ ID NO: 52839 - protein, 8 aa, Mycobacterium tuberculosis
QRGRGDAL

SEQ ID NO: 52840 - protein, 8 aa, Mycobacterium tuberculosis
RGRGDALR

SEQ ID NO: 52841 - protein, 8 aa, Mycobacterium tuberculosis
GRGDALRL

SEQ ID NO: 52842 - protein, 8 aa, Mycobacterium tuberculosis
RGDALRLA

SEQ ID NO: 52843 - protein, 8 aa, Mycobacterium tuberculosis
GDALRLAR

SEQ ID NO: 52844 - protein, 8 aa, Mycobacterium tuberculosis
DALRLARR

SEQ ID NO: 52845 - protein, 8 aa, Mycobacterium tuberculosis
ALRLARRI

SEQ ID NO: 52846 - protein, 8 aa, Mycobacterium tuberculosis
LRLARRIA

SEQ ID NO: 52847 - protein, 8 aa, Mycobacterium tuberculosis
RLARRIAA

SEQ ID NO: 52848 - protein, 8 aa, Mycobacterium tuberculosis
LARRIAAA

SEQ ID NO: 52849 - protein, 8 aa, Mycobacterium tuberculosis
ARRIAAAL

SEQ ID NO: 52850 - protein, 8 aa, Mycobacterium tuberculosis
RRIAAALN

SEQ ID NO: 52851 - protein, 8 aa, Mycobacterium tuberculosis
RIAAALNA

SEQ ID NO: 52852 - protein, 8 aa, Mycobacterium tuberculosis
IAAALNAS

SEQ ID NO: 52853 - protein, 8 aa, Mycobacterium tuberculosis
AAALNASD

SEQ ID NO: 52854 - protein, 8 aa, Mycobacterium tuberculosis
AALNASDN

SEQ ID NO: 52855 - protein, 8 aa, Mycobacterium tuberculosis
ALNASDNN

SEQ ID NO: 52856 - protein, 8 aa, Mycobacterium tuberculosis
LNASDNNA

SEQ ID NO: 52857 - protein, 8 aa, Mycobacterium tuberculosis
NASDNNAG

SEQ ID NO: 52858 - protein, 8 aa, Mycobacterium tuberculosis
ASDNNAGD

SEQ ID NO: 52859 - protein, 8 aa, Mycobacterium tuberculosis
SDNNAGDY

SEQ ID NO: 52860 - protein, 8 aa, Mycobacterium tuberculosis
DNNAGDYG

SEQ ID NO: 52861 - protein, 8 aa, Mycobacterium tuberculosis
NNAGDYGF

SEQ ID NO: 52862 - protein, 8 aa, Mycobacterium tuberculosis
NAGDYGFF

SEQ ID NO: 52863 - protein, 8 aa, Mycobacterium tuberculosis
AGDYGFFW

SEQ ID NO: 52864 - protein, 8 aa, Mycobacterium tuberculosis
GDYGFFWI

SEQ ID NO: 52865 - protein, 8 aa, Mycobacterium tuberculosis
DYGFFWIT

SEQ ID NO: 52866 - protein, 8 aa, Mycobacterium tuberculosis
YGFFWITA

SEQ ID NO: 52867 - protein, 8 aa, Mycobacterium tuberculosis
GFFWITAV

SEQ ID NO: 52868 - protein, 8 aa, Mycobacterium tuberculosis
FFWITAVT

SEQ ID NO: 52869 - protein, 8 aa, Mycobacterium tuberculosis
FWITAVTT

SEQ ID NO: 52870 - protein, 8 aa, Mycobacterium tuberculosis
WITAVTTD

SEQ ID NO: 52871 - protein, 8 aa, Mycobacterium tuberculosis
ITAVTTDG

SEQ ID NO: 52872 - protein, 8 aa, Mycobacterium tuberculosis
TAVTTDGS

SEQ ID NO: 52873 - protein, 8 aa, Mycobacterium tuberculosis
AVTTDGSI

SEQ ID NO: 52874 - protein, 8 aa, Mycobacterium tuberculosis
VTTDGSIV

SEQ ID NO: 52875 - protein, 8 aa, Mycobacterium tuberculosis
TTDGSIVV

SEQ ID NO: 52876 - protein, 8 aa, Mycobacterium tuberculosis
TDGSIVVA

SEQ ID NO: 52877 - protein, 8 aa, Mycobacterium tuberculosis
DGSIVVAN

SEQ ID NO: 52878 - protein, 8 aa, Mycobacterium tuberculosis
GSIVVANS

SEQ ID NO: 52879 - protein, 8 aa, Mycobacterium tuberculosis
SIVVANSY

SEQ ID NO: 52880 - protein, 8 aa, Mycobacterium tuberculosis
IVVANSYG

SEQ ID NO: 52881 - protein, 8 aa, Mycobacterium tuberculosis
VVANSYGL

SEQ ID NO: 52882 - protein, 8 aa, Mycobacterium tuberculosis
VANSYGLA

SEQ ID NO: 52883 - protein, 8 aa, Mycobacterium tuberculosis
ANSYGLAY

SEQ ID NO: 52884 - protein, 8 aa, Mycobacterium tuberculosis
NSYGLAYI

SEQ ID NO: 52885 - protein, 8 aa, Mycobacterium tuberculosis
SYGLAYIP

SEQ ID NO: 52886 - protein, 8 aa, Mycobacterium tuberculosis
YGLAYIPD

SEQ ID NO: 52887 - protein, 8 aa, Mycobacterium tuberculosis
GLAYIPDG

SEQ ID NO: 52888 - protein, 8 aa, Mycobacterium tuberculosis
LAYIPDGM

SEQ ID NO: 52889 - protein, 8 aa, Mycobacterium tuberculosis
AYIPDGME

SEQ ID NO: 52890 - protein, 8 aa, Mycobacterium tuberculosis
YIPDGMEL

SEQ ID NO: 52891 - protein, 8 aa, Mycobacterium tuberculosis
IPDGMELP

SEQ ID NO: 52892 - protein, 8 aa, Mycobacterium tuberculosis
PDGMELPN

SEQ ID NO: 52893 - protein, 8 aa, Mycobacterium tuberculosis
DGMELPNK

SEQ ID NO: 52894 - protein, 8 aa, Mycobacterium tuberculosis
GMELPNKV

SEQ ID NO: 52895 - protein, 8 aa, Mycobacterium tuberculosis
MELPNKVY

SEQ ID NO: 52896 - protein, 8 aa, Mycobacterium tuberculosis
ELPNKVYL

SEQ ID NO: 52897 - protein, 8 aa, Mycobacterium tuberculosis
LPNKVYLA

SEQ ID NO: 52898 - protein, 8 aa, Mycobacterium tuberculosis
PNKVYLAS

SEQ ID NO: 52899 - protein, 8 aa, Mycobacterium tuberculosis
NKVYLASA

SEQ ID NO: 52900 - protein, 8 aa, Mycobacterium tuberculosis
KVYLASAD

SEQ ID NO: 52901 - protein, 8 aa, Mycobacterium tuberculosis
VYLASADH

SEQ ID NO: 52902 - protein, 8 aa, Mycobacterium tuberculosis
YLASADHA

SEQ ID NO: 52903 - protein, 8 aa, Mycobacterium tuberculosis
LASADHAI

SEQ ID NO: 52904 - protein, 8 aa, Mycobacterium tuberculosis
ASADHAIP

SEQ ID NO: 52905 - protein, 8 aa, Mycobacterium tuberculosis
SADHAIPV

SEQ ID NO: 52906 - protein, 8 aa, Mycobacterium tuberculosis
ADHAIPVD

SEQ ID NO: 52907 - protein, 8 aa, Mycobacterium tuberculosis
DHAIPVDE

SEQ ID NO: 52908 - protein, 8 aa, Mycobacterium tuberculosis
HAIPVDEI

SEQ ID NO: 52909 - protein, 8 aa, Mycobacterium tuberculosis
AIPVDEIA

SEQ ID NO: 52910 - protein, 8 aa, Mycobacterium tuberculosis
IPVDEIAR

SEQ ID NO: 52911 - protein, 8 aa, Mycobacterium tuberculosis
PVDEIARC

SEQ ID NO: 52912 - protein, 8 aa, Mycobacterium tuberculosis
VDEIARCA

SEQ ID NO: 52913 - protein, 8 aa, Mycobacterium tuberculosis
DEIARCAT

SEQ ID NO: 52914 - protein, 8 aa, Mycobacterium tuberculosis
EIARCATY

SEQ ID NO: 52915 - protein, 8 aa, Mycobacterium tuberculosis
IARCATYP

SEQ ID NO: 52916 - protein, 8 aa, Mycobacterium tuberculosis
ARCATYPV

SEQ ID NO: 52917 - protein, 8 aa, Mycobacterium tuberculosis
RCATYPVL

SEQ ID NO: 52918 - protein, 8 aa, Mycobacterium tuberculosis
CATYPVLA

SEQ ID NO: 52919 - protein, 8 aa, Mycobacterium tuberculosis
ATYPVLAV

SEQ ID NO: 52920 - protein, 8 aa, Mycobacterium tuberculosis
TYPVLAVQ

SEQ ID NO: 52921 - protein, 8 aa, Mycobacterium tuberculosis
YPVLAVQA

SEQ ID NO: 52922 - protein, 8 aa, Mycobacterium tuberculosis
PVLAVQAW

SEQ ID NO: 52923 - protein, 8 aa, Mycobacterium tuberculosis
VLAVQAWA

SEQ ID NO: 52924 - protein, 8 aa, Mycobacterium tuberculosis
LAVQAWAA

SEQ ID NO: 52925 - protein, 8 aa, Mycobacterium tuberculosis
AVQAWAAF

SEQ ID NO: 52926 - protein, 8 aa, Mycobacterium tuberculosis
VQAWAAFH

SEQ ID NO: 52927 - protein, 8 aa, Mycobacterium tuberculosis
QAWAAFHD

SEQ ID NO: 52928 - protein, 8 aa, Mycobacterium tuberculosis
AWAAFHDM

SEQ ID NO: 52929 - protein, 8 aa, Mycobacterium tuberculosis
WAAFHDMT

SEQ ID NO: 52930 - protein, 8 aa, Mycobacterium tuberculosis
AAFHDMTL

SEQ ID NO: 52931 - protein, 8 aa, Mycobacterium tuberculosis
AFHDMTLR

SEQ ID NO: 52932 - protein, 8 aa, Mycobacterium tuberculosis
FHDMTLRA

SEQ ID NO: 52933 - protein, 8 aa, Mycobacterium tuberculosis
HDMTLRAV

SEQ ID NO: 52934 - protein, 8 aa, Mycobacterium tuberculosis
DMTLRAVI

SEQ ID NO: 52935 - protein, 8 aa, Mycobacterium tuberculosis
MTLRAVIG

SEQ ID NO: 52936 - protein, 8 aa, Mycobacterium tuberculosis
TLRAVIGT

SEQ ID NO: 52937 - protein, 8 aa, Mycobacterium tuberculosis
LRAVIGTA

SEQ ID NO: 52938 - protein, 8 aa, Mycobacterium tuberculosis
RAVIGTAE

SEQ ID NO: 52939 - protein, 8 aa, Mycobacterium tuberculosis
AVIGTAEQ

SEQ ID NO: 52940 - protein, 8 aa, Mycobacterium tuberculosis
VIGTAEQL

SEQ ID NO: 52941 - protein, 8 aa, Mycobacterium tuberculosis
IGTAEQLA

SEQ ID NO: 52942 - protein, 8 aa, Mycobacterium tuberculosis
GTAEQLAS

SEQ ID NO: 52943 - protein, 8 aa, Mycobacterium tuberculosis
TAEQLASS

SEQ ID NO: 52944 - protein, 8 aa, Mycobacterium tuberculosis
AEQLASSD

SEQ ID NO: 52945 - protein, 8 aa, Mycobacterium tuberculosis
EQLASSDP

SEQ ID NO: 52946 - protein, 8 aa, Mycobacterium tuberculosis
QLASSDPG

SEQ ID NO: 52947 - protein, 8 aa, Mycobacterium tuberculosis
LASSDPGV

SEQ ID NO: 52948 - protein, 8 aa, Mycobacterium tuberculosis
ASSDPGVA

SEQ ID NO: 52949 - protein, 8 aa, Mycobacterium tuberculosis
SSDPGVAK

SEQ ID NO: 52950 - protein, 8 aa, Mycobacterium tuberculosis
SDPGVAKI

SEQ ID NO: 52951 - protein, 8 aa, Mycobacterium tuberculosis
DPGVAKIV

SEQ ID NO: 52952 - protein, 8 aa, Mycobacterium tuberculosis
PGVAKIVL

SEQ ID NO: 52953 - protein, 8 aa, Mycobacterium tuberculosis
GVAKIVLE

SEQ ID NO: 52954 - protein, 8 aa, Mycobacterium tuberculosis
VAKIVLEP

SEQ ID NO: 52955 - protein, 8 aa, Mycobacterium tuberculosis
AKIVLEPD

SEQ ID NO: 52956 - protein, 8 aa, Mycobacterium tuberculosis
KIVLEPDD

SEQ ID NO: 52957 - protein, 8 aa, Mycobacterium tuberculosis
IVLEPDDI

SEQ ID NO: 52958 - protein, 8 aa, Mycobacterium tuberculosis
VLEPDDIP

SEQ ID NO: 52959 - protein, 8 aa, Mycobacterium tuberculosis
LEPDDIPE

SEQ ID NO: 52960 - protein, 8 aa, Mycobacterium tuberculosis
EPDDIPES

SEQ ID NO: 52961 - protein, 8 aa, Mycobacterium tuberculosis
PDDIPESG

SEQ ID NO: 52962 - protein, 8 aa, Mycobacterium tuberculosis
DDIPESGK

SEQ ID NO: 52963 - protein, 8 aa, Mycobacterium tuberculosis
DIPESGKM

SEQ ID NO: 52964 - protein, 8 aa, Mycobacterium tuberculosis
IPESGKMT

SEQ ID NO: 52965 - protein, 8 aa, Mycobacterium tuberculosis
PESGKMTG

SEQ ID NO: 52966 - protein, 8 aa, Mycobacterium tuberculosis
ESGKMTGR

SEQ ID NO: 52967 - protein, 8 aa, Mycobacterium tuberculosis
SGKMTGRS

SEQ ID NO: 52968 - protein, 8 aa, Mycobacterium tuberculosis
GKMTGRSR

SEQ ID NO: 52969 - protein, 8 aa, Mycobacterium tuberculosis
KMTGRSRL

SEQ ID NO: 52970 - protein, 8 aa, Mycobacterium tuberculosis
MTGRSRLE

SEQ ID NO: 52971 - protein, 8 aa, Mycobacterium tuberculosis
TGRSRLEV

SEQ ID NO: 52972 - protein, 8 aa, Mycobacterium tuberculosis
GRSRLEVV

SEQ ID NO: 52973 - protein, 8 aa, Mycobacterium tuberculosis
RSRLEVVD

SEQ ID NO: 52974 - protein, 8 aa, Mycobacterium tuberculosis
SRLEVVDP

SEQ ID NO: 52975 - protein, 8 aa, Mycobacterium tuberculosis
RLEVVDPS

SEQ ID NO: 52976 - protein, 8 aa, Mycobacterium tuberculosis
LEVVDPSA

SEQ ID NO: 52977 - protein, 8 aa, Mycobacterium tuberculosis
EVVDPSAA

SEQ ID NO: 52978 - protein, 8 aa, Mycobacterium tuberculosis
VVDPSAAA

SEQ ID NO: 52979 - protein, 8 aa, Mycobacterium tuberculosis
VDPSAAAQ

SEQ ID NO: 52980 - protein, 8 aa, Mycobacterium tuberculosis
DPSAAAQL

SEQ ID NO: 52981 - protein, 8 aa, Mycobacterium tuberculosis
PSAAAQLA

SEQ ID NO: 52982 - protein, 8 aa, Mycobacterium tuberculosis
SAAAQLAD

SEQ ID NO: 52983 - protein, 8 aa, Mycobacterium tuberculosis
AAAQLADT

SEQ ID NO: 52984 - protein, 8 aa, Mycobacterium tuberculosis
AAQLADTT

SEQ ID NO: 52985 - protein, 8 aa, Mycobacterium tuberculosis
AQLADTTD

SEQ ID NO: 52986 - protein, 8 aa, Mycobacterium tuberculosis
QLADTTDQ

SEQ ID NO: 52987 - protein, 8 aa, Mycobacterium tuberculosis
LADTTDQR

SEQ ID NO: 52988 - protein, 8 aa, Mycobacterium tuberculosis
ADTTDQRL

SEQ ID NO: 52989 - protein, 8 aa, Mycobacterium tuberculosis
DTTDQRLL

SEQ ID NO: 52990 - protein, 8 aa, Mycobacterium tuberculosis
TTDQRLLD

SEQ ID NO: 52991 - protein, 8 aa, Mycobacterium tuberculosis
TDQRLLDL

SEQ ID NO: 52992 - protein, 8 aa, Mycobacterium tuberculosis
DQRLLDLL

SEQ ID NO: 52993 - protein, 8 aa, Mycobacterium tuberculosis
QRLLDLLP

SEQ ID NO: 52994 - protein, 8 aa, Mycobacterium tuberculosis
RLLDLLPP

SEQ ID NO: 52995 - protein, 8 aa, Mycobacterium tuberculosis
LLDLLPPA

SEQ ID NO: 52996 - protein, 8 aa, Mycobacterium tuberculosis
LDLLPPAP

SEQ ID NO: 52997 - protein, 8 aa, Mycobacterium tuberculosis
DLLPPAPV

SEQ ID NO: 52998 - protein, 8 aa, Mycobacterium tuberculosis
LLPPAPVD

SEQ ID NO: 52999 - protein, 8 aa, Mycobacterium tuberculosis
LPPAPVDV

SEQ ID NO: 53000 - protein, 8 aa, Mycobacterium tuberculosis
PPAPVDVN

SEQ ID NO: 53001 - protein, 8 aa, Mycobacterium tuberculosis
PAPVDVNP

SEQ ID NO: 53002 - protein, 8 aa, Mycobacterium tuberculosis
APVDVNPP

SEQ ID NO: 53003 - protein, 8 aa, Mycobacterium tuberculosis
PVDVNPPG

SEQ ID NO: 53004 - protein, 8 aa, Mycobacterium tuberculosis
VDVNPPGD

SEQ ID NO: 53005 - protein, 8 aa, Mycobacterium tuberculosis
DVNPPGDE

SEQ ID NO: 53006 - protein, 8 aa, Mycobacterium tuberculosis
VNPPGDER

SEQ ID NO: 53007 - protein, 8 aa, Mycobacterium tuberculosis
NPPGDERH

SEQ ID NO: 53008 - protein, 8 aa, Mycobacterium tuberculosis
PPGDERHM

SEQ ID NO: 53009 - protein, 8 aa, Mycobacterium tuberculosis
PGDERHML

SEQ ID NO: 53010 - protein, 8 aa, Mycobacterium tuberculosis
GDERHMLW

SEQ ID NO: 53011 - protein, 8 aa, Mycobacterium tuberculosis
DERHMLWF

SEQ ID NO: 53012 - protein, 8 aa, Mycobacterium tuberculosis
ERHMLWFE

SEQ ID NO: 53013 - protein, 8 aa, Mycobacterium tuberculosis
RHMLWFEL

SEQ ID NO: 53014 - protein, 8 aa, Mycobacterium tuberculosis
HMLWFELM

SEQ ID NO: 53015 - protein, 8 aa, Mycobacterium tuberculosis
MLWFELMK

SEQ ID NO: 53016 - protein, 8 aa, Mycobacterium tuberculosis
LWFELMKP

SEQ ID NO: 53017 - protein, 8 aa, Mycobacterium tuberculosis
WFELMKPM

SEQ ID NO: 53018 - protein, 8 aa, Mycobacterium tuberculosis
FELMKPMT

SEQ ID NO: 53019 - protein, 8 aa, Mycobacterium tuberculosis
ELMKPMTS

SEQ ID NO: 53020 - protein, 8 aa, Mycobacterium tuberculosis
LMKPMTST

SEQ ID NO: 53021 - protein, 8 aa, Mycobacterium tuberculosis
MKPMTSTA

SEQ ID NO: 53022 - protein, 8 aa, Mycobacterium tuberculosis
KPMTSTAT

SEQ ID NO: 53023 - protein, 8 aa, Mycobacterium tuberculosis
PMTSTATG

SEQ ID NO: 53024 - protein, 8 aa, Mycobacterium tuberculosis
MTSTATGR

SEQ ID NO: 53025 - protein, 8 aa, Mycobacterium tuberculosis
TSTATGRE

SEQ ID NO: 53026 - protein, 8 aa, Mycobacterium tuberculosis
STATGREA

SEQ ID NO: 53027 - protein, 8 aa, Mycobacterium tuberculosis
TATGREAA

SEQ ID NO: 53028 - protein, 8 aa, Mycobacterium tuberculosis
ATGREAAH

SEQ ID NO: 53029 - protein, 8 aa, Mycobacterium tuberculosis
TGREAAHL

SEQ ID NO: 53030 - protein, 8 aa, Mycobacterium tuberculosis
GREAAHLR

SEQ ID NO: 53031 - protein, 8 aa, Mycobacterium tuberculosis
REAAHLRA

SEQ ID NO: 53032 - protein, 8 aa, Mycobacterium tuberculosis
EAAHLRAF

SEQ ID NO: 53033 - protein, 8 aa, Mycobacterium tuberculosis
AAHLRAFR

SEQ ID NO: 53034 - protein, 8 aa, Mycobacterium tuberculosis
AHLRAFRA

SEQ ID NO: 53035 - protein, 8 aa, Mycobacterium tuberculosis
HLRAFRAY

SEQ ID NO: 53036 - protein, 8 aa, Mycobacterium tuberculosis
LRAFRAYA

SEQ ID NO: 53037 - protein, 8 aa, Mycobacterium tuberculosis
RAFRAYAA

SEQ ID NO: 53038 - protein, 8 aa, Mycobacterium tuberculosis
AFRAYAAH

SEQ ID NO: 53039 - protein, 8 aa, Mycobacterium tuberculosis
FRAYAAHS

SEQ ID NO: 53040 - protein, 8 aa, Mycobacterium tuberculosis
RAYAAHSQ

SEQ ID NO: 53041 - protein, 8 aa, Mycobacterium tuberculosis
AYAAHSQE

SEQ ID NO: 53042 - protein, 8 aa, Mycobacterium tuberculosis
YAAHSQEI

SEQ ID NO: 53043 - protein, 8 aa, Mycobacterium tuberculosis
AAHSQEIA

SEQ ID NO: 53044 - protein, 8 aa, Mycobacterium tuberculosis
AHSQEIAL

SEQ ID NO: 53045 - protein, 8 aa, Mycobacterium tuberculosis
HSQEIALH

SEQ ID NO: 53046 - protein, 8 aa, Mycobacterium tuberculosis
SQEIALHQ

SEQ ID NO: 53047 - protein, 8 aa, Mycobacterium tuberculosis
QEIALHQA

SEQ ID NO: 53048 - protein, 8 aa, Mycobacterium tuberculosis
EIALHQAH

SEQ ID NO: 53049 - protein, 8 aa, Mycobacterium tuberculosis
IALHQAHT

SEQ ID NO: 53050 - protein, 8 aa, Mycobacterium tuberculosis
ALHQAHTA

SEQ ID NO: 53051 - protein, 8 aa, Mycobacterium tuberculosis
LHQAHTAT

SEQ ID NO: 53052 - protein, 8 aa, Mycobacterium tuberculosis
HQAHTATD

SEQ ID NO: 53053 - protein, 8 aa, Mycobacterium tuberculosis
QAHTATDA

SEQ ID NO: 53054 - protein, 8 aa, Mycobacterium tuberculosis
AHTATDAA

SEQ ID NO: 53055 - protein, 8 aa, Mycobacterium tuberculosis
HTATDAAV

SEQ ID NO: 53056 - protein, 8 aa, Mycobacterium tuberculosis
TATDAAVQ

SEQ ID NO: 53057 - protein, 8 aa, Mycobacterium tuberculosis
ATDAAVQR

SEQ ID NO: 53058 - protein, 8 aa, Mycobacterium tuberculosis
TDAAVQRV

SEQ ID NO: 53059 - protein, 8 aa, Mycobacterium tuberculosis
DAAVQRVA

SEQ ID NO: 53060 - protein, 8 aa, Mycobacterium tuberculosis
AAVQRVAV

SEQ ID NO: 53061 - protein, 8 aa, Mycobacterium tuberculosis
AVQRVAVA

SEQ ID NO: 53062 - protein, 8 aa, Mycobacterium tuberculosis
VQRVAVAD

SEQ ID NO: 53063 - protein, 8 aa, Mycobacterium tuberculosis
QRVAVADW

SEQ ID NO: 53064 - protein, 8 aa, Mycobacterium tuberculosis
RVAVADWL

SEQ ID NO: 53065 - protein, 8 aa, Mycobacterium tuberculosis
VAVADWLY

SEQ ID NO: 53066 - protein, 8 aa, Mycobacterium tuberculosis
AVADWLYW

SEQ ID NO: 53067 - protein, 8 aa, Mycobacterium tuberculosis
VADWLYWQ

SEQ ID NO: 53068 - protein, 8 aa, Mycobacterium tuberculosis
ADWLYWQY

SEQ ID NO: 53069 - protein, 8 aa, Mycobacterium tuberculosis
DWLYWQYV

SEQ ID NO: 53070 - protein, 8 aa, Mycobacterium tuberculosis
WLYWQYVT

SEQ ID NO: 53071 - protein, 8 aa, Mycobacterium tuberculosis
LYWQYVTG

SEQ ID NO: 53072 - protein, 8 aa, Mycobacterium tuberculosis
YWQYVTGL

SEQ ID NO: 53073 - protein, 8 aa, Mycobacterium tuberculosis
WQYVTGLL

SEQ ID NO: 53074 - protein, 8 aa, Mycobacterium tuberculosis
QYVTGLLD

SEQ ID NO: 53075 - protein, 8 aa, Mycobacterium tuberculosis
YVTGLLDR

SEQ ID NO: 53076 - protein, 8 aa, Mycobacterium tuberculosis
VTGLLDRA

SEQ ID NO: 53077 - protein, 8 aa, Mycobacterium tuberculosis
TGLLDRAL

SEQ ID NO: 53078 - protein, 8 aa, Mycobacterium tuberculosis
GLLDRALA

SEQ ID NO: 53079 - protein, 8 aa, Mycobacterium tuberculosis
LLDRALAA

SEQ ID NO: 53080 - protein, 8 aa, Mycobacterium tuberculosis
LDRALAAA

SEQ ID NO: 53081 - protein, 8 aa, Mycobacterium tuberculosis
DRALAAAC

SEQ ID NO: 53082 - protein, 9 aa, Mycobacterium tuberculosis
MSITRPTGS

SEQ ID NO: 53083 - protein, 9 aa, Mycobacterium tuberculosis
SITRPTGSY

SEQ ID NO: 53084 - protein, 9 aa, Mycobacterium tuberculosis
ITRPTGSYA

SEQ ID NO: 53085 - protein, 9 aa, Mycobacterium tuberculosis
TRPTGSYAR

SEQ ID NO: 53086 - protein, 9 aa, Mycobacterium tuberculosis
RPTGSYARQ

SEQ ID NO: 53087 - protein, 9 aa, Mycobacterium tuberculosis
PTGSYARQM

SEQ ID NO: 53088 - protein, 9 aa, Mycobacterium tuberculosis
TGSYARQML

SEQ ID NO: 53089 - protein, 9 aa, Mycobacterium tuberculosis
GSYARQMLD

SEQ ID NO: 53090 - protein, 9 aa, Mycobacterium tuberculosis
SYARQMLDP

SEQ ID NO: 53091 - protein, 9 aa, Mycobacterium tuberculosis
YARQMLDPG

SEQ ID NO: 53092 - protein, 9 aa, Mycobacterium tuberculosis
ARQMLDPGG

SEQ ID NO: 53093 - protein, 9 aa, Mycobacterium tuberculosis
RQMLDPGGW

SEQ ID NO: 53094 - protein, 9 aa, Mycobacterium tuberculosis
QMLDPGGWV

SEQ ID NO: 53095 - protein, 9 aa, Mycobacterium tuberculosis
MLDPGGWVE

SEQ ID NO: 53096 - protein, 9 aa, Mycobacterium tuberculosis
LDPGGWVEA

SEQ ID NO: 53097 - protein, 9 aa, Mycobacterium tuberculosis
DPGGWVEAD

SEQ ID NO: 53098 - protein, 9 aa, Mycobacterium tuberculosis
PGGWVEADE

SEQ ID NO: 53099 - protein, 9 aa, Mycobacterium tuberculosis
GGWVEADED

SEQ ID NO: 53100 - protein, 9 aa, Mycobacterium tuberculosis
GWVEADEDT

SEQ ID NO: 53101 - protein, 9 aa, Mycobacterium tuberculosis
WVEADEDTF

SEQ ID NO: 53102 - protein, 9 aa, Mycobacterium tuberculosis
VEADEDTFY

SEQ ID NO: 53103 - protein, 9 aa, Mycobacterium tuberculosis
EADEDTFYD

SEQ ID NO: 53104 - protein, 9 aa, Mycobacterium tuberculosis
ADEDTFYDR

SEQ ID NO: 53105 - protein, 9 aa, Mycobacterium tuberculosis
DEDTFYDRA

SEQ ID NO: 53106 - protein, 9 aa, Mycobacterium tuberculosis
EDTFYDRAQ

SEQ ID NO: 53107 - protein, 9 aa, Mycobacterium tuberculosis
DTFYDRAQE

SEQ ID NO: 53108 - protein, 9 aa, Mycobacterium tuberculosis
TFYDRAQEY

SEQ ID NO: 53109 - protein, 9 aa, Mycobacterium tuberculosis
FYDRAQEYS

SEQ ID NO: 53110 - protein, 9 aa, Mycobacterium tuberculosis
YDRAQEYSQ

SEQ ID NO: 53111 - protein, 9 aa, Mycobacterium tuberculosis
DRAQEYSQV

SEQ ID NO: 53112 - protein, 9 aa, Mycobacterium tuberculosis
RAQEYSQVL

SEQ ID NO: 53113 - protein, 9 aa, Mycobacterium tuberculosis
AQEYSQVLQ

SEQ ID NO: 53114 - protein, 9 aa, Mycobacterium tuberculosis
QEYSQVLQR

SEQ ID NO: 53115 - protein, 9 aa, Mycobacterium tuberculosis
EYSQVLQRV

SEQ ID NO: 53116 - protein, 9 aa, Mycobacterium tuberculosis
YSQVLQRVT

SEQ ID NO: 53117 - protein, 9 aa, Mycobacterium tuberculosis
SQVLQRVTD

SEQ ID NO: 53118 - protein, 9 aa, Mycobacterium tuberculosis
QVLQRVTDV

SEQ ID NO: 53119 - protein, 9 aa, Mycobacterium tuberculosis
VLQRVTDVL

SEQ ID NO: 53120 - protein, 9 aa, Mycobacterium tuberculosis
LQRVTDVLD

SEQ ID NO: 53121 - protein, 9 aa, Mycobacterium tuberculosis
QRVTDVLDT

SEQ ID NO: 53122 - protein, 9 aa, Mycobacterium tuberculosis
RVTDVLDTC

SEQ ID NO: 53123 - protein, 9 aa, Mycobacterium tuberculosis
VTDVLDTCR

SEQ ID NO: 53124 - protein, 9 aa, Mycobacterium tuberculosis
TDVLDTCRQ

SEQ ID NO: 53125 - protein, 9 aa, Mycobacterium tuberculosis
DVLDTCRQQ

SEQ ID NO: 53126 - protein, 9 aa, Mycobacterium tuberculosis
VLDTCRQQK

SEQ ID NO: 53127 - protein, 9 aa, Mycobacterium tuberculosis
LDTCRQQKG

SEQ ID NO: 53128 - protein, 9 aa, Mycobacterium tuberculosis
DTCRQQKGH

SEQ ID NO: 53129 - protein, 9 aa, Mycobacterium tuberculosis
TCRQQKGHV

SEQ ID NO: 53130 - protein, 9 aa, Mycobacterium tuberculosis
CRQQKGHVF

SEQ ID NO: 53131 - protein, 9 aa, Mycobacterium tuberculosis
RQQKGHVFE

SEQ ID NO: 53132 - protein, 9 aa, Mycobacterium tuberculosis
QQKGHVFEG

SEQ ID NO: 53133 - protein, 9 aa, Mycobacterium tuberculosis
QKGHVFEGG

SEQ ID NO: 53134 - protein, 9 aa, Mycobacterium tuberculosis
KGHVFEGGL

SEQ ID NO: 53135 - protein, 9 aa, Mycobacterium tuberculosis
GHVFEGGLW

SEQ ID NO: 53136 - protein, 9 aa, Mycobacterium tuberculosis
HVFEGGLWS

SEQ ID NO: 53137 - protein, 9 aa, Mycobacterium tuberculosis
VFEGGLWSG

SEQ ID NO: 53138 - protein, 9 aa, Mycobacterium tuberculosis
FEGGLWSGG

SEQ ID NO: 53139 - protein, 9 aa, Mycobacterium tuberculosis
EGGLWSGGA

SEQ ID NO: 53140 - protein, 9 aa, Mycobacterium tuberculosis
GGLWSGGAA

SEQ ID NO: 53141 - protein, 9 aa, Mycobacterium tuberculosis
GLWSGGAAN

SEQ ID NO: 53142 - protein, 9 aa, Mycobacterium tuberculosis
LWSGGAANA

SEQ ID NO: 53143 - protein, 9 aa, Mycobacterium tuberculosis
WSGGAANAA

SEQ ID NO: 53144 - protein, 9 aa, Mycobacterium tuberculosis
SGGAANAAN

SEQ ID NO: 53145 - protein, 9 aa, Mycobacterium tuberculosis
GGAANAANG

SEQ ID NO: 53146 - protein, 9 aa, Mycobacterium tuberculosis
GAANAANGA

SEQ ID NO: 53147 - protein, 9 aa, Mycobacterium tuberculosis
AANAANGAL

SEQ ID NO: 53148 - protein, 9 aa, Mycobacterium tuberculosis
ANAANGALG

SEQ ID NO: 53149 - protein, 9 aa, Mycobacterium tuberculosis
NAANGALGA

SEQ ID NO: 53150 - protein, 9 aa, Mycobacterium tuberculosis
AANGALGAN

SEQ ID NO: 53151 - protein, 9 aa, Mycobacterium tuberculosis
ANGALGANI

SEQ ID NO: 53152 - protein, 9 aa, Mycobacterium tuberculosis
NGALGANIN

SEQ ID NO: 53153 - protein, 9 aa, Mycobacterium tuberculosis
GALGANINQ

SEQ ID NO: 53154 - protein, 9 aa, Mycobacterium tuberculosis
ALGANINQL

SEQ ID NO: 53155 - protein, 9 aa, Mycobacterium tuberculosis
LGANINQLM

SEQ ID NO: 53156 - protein, 9 aa, Mycobacterium tuberculosis
GANINQLMT

SEQ ID NO: 53157 - protein, 9 aa, Mycobacterium tuberculosis
ANINQLMTL

SEQ ID NO: 53158 - protein, 9 aa, Mycobacterium tuberculosis
NINQLMTLQ

SEQ ID NO: 53159 - protein, 9 aa, Mycobacterium tuberculosis
INQLMTLQD

SEQ ID NO: 53160 - protein, 9 aa, Mycobacterium tuberculosis
NQLMTLQDY

SEQ ID NO: 53161 - protein, 9 aa, Mycobacterium tuberculosis
QLMTLQDYL

SEQ ID NO: 53162 - protein, 9 aa, Mycobacterium tuberculosis
LMTLQDYLA

SEQ ID NO: 53163 - protein, 9 aa, Mycobacterium tuberculosis
MTLQDYLAT

SEQ ID NO: 53164 - protein, 9 aa, Mycobacterium tuberculosis
TLQDYLATV

SEQ ID NO: 53165 - protein, 9 aa, Mycobacterium tuberculosis
LQDYLATVI

SEQ ID NO: 53166 - protein, 9 aa, Mycobacterium tuberculosis
QDYLATVIT

SEQ ID NO: 53167 - protein, 9 aa, Mycobacterium tuberculosis
DYLATVITW

SEQ ID NO: 53168 - protein, 9 aa, Mycobacterium tuberculosis
YLATVITWH

SEQ ID NO: 53169 - protein, 9 aa, Mycobacterium tuberculosis
LATVITWHR

SEQ ID NO: 53170 - protein, 9 aa, Mycobacterium tuberculosis
ATVITWHRH

SEQ ID NO: 53171 - protein, 9 aa, Mycobacterium tuberculosis
TVITWHRHI

SEQ ID NO: 53172 - protein, 9 aa, Mycobacterium tuberculosis
VITWHRHIA

SEQ ID NO: 53173 - protein, 9 aa, Mycobacterium tuberculosis
ITWHRHIAG

SEQ ID NO: 53174 - protein, 9 aa, Mycobacterium tuberculosis
TWHRHIAGL

SEQ ID NO: 53175 - protein, 9 aa, Mycobacterium tuberculosis
WHRHIAGLI

SEQ ID NO: 53176 - protein, 9 aa, Mycobacterium tuberculosis
HRHIAGLIE

SEQ ID NO: 53177 - protein, 9 aa, Mycobacterium tuberculosis
RHIAGLIEQ

SEQ ID NO: 53178 - protein, 9 aa, Mycobacterium tuberculosis
HIAGLIEQA

SEQ ID NO: 53179 - protein, 9 aa, Mycobacterium tuberculosis
IAGLIEQAK

SEQ ID NO: 53180 - protein, 9 aa, Mycobacterium tuberculosis
AGLIEQAKS

SEQ ID NO: 53181 - protein, 9 aa, Mycobacterium tuberculosis
GLIEQAKSD

SEQ ID NO: 53182 - protein, 9 aa, Mycobacterium tuberculosis
LIEQAKSDI

SEQ ID NO: 53183 - protein, 9 aa, Mycobacterium tuberculosis
IEQAKSDIG

SEQ ID NO: 53184 - protein, 9 aa, Mycobacterium tuberculosis
EQAKSDIGN

SEQ ID NO: 53185 - protein, 9 aa, Mycobacterium tuberculosis
QAKSDIGNN

SEQ ID NO: 53186 - protein, 9 aa, Mycobacterium tuberculosis
AKSDIGNNV

SEQ ID NO: 53187 - protein, 9 aa, Mycobacterium tuberculosis
KSDIGNNVD

SEQ ID NO: 53188 - protein, 9 aa, Mycobacterium tuberculosis
SDIGNNVDG

SEQ ID NO: 53189 - protein, 9 aa, Mycobacterium tuberculosis
DIGNNVDGA

SEQ ID NO: 53190 - protein, 9 aa, Mycobacterium tuberculosis
IGNNVDGAQ

SEQ ID NO: 53191 - protein, 9 aa, Mycobacterium tuberculosis
GNNVDGAQR

SEQ ID NO: 53192 - protein, 9 aa, Mycobacterium tuberculosis
NNVDGAQRE

SEQ ID NO: 53193 - protein, 9 aa, Mycobacterium tuberculosis
NVDGAQREI

SEQ ID NO: 53194 - protein, 9 aa, Mycobacterium tuberculosis
VDGAQREID

SEQ ID NO: 53195 - protein, 9 aa, Mycobacterium tuberculosis
DGAQREIDI

SEQ ID NO: 53196 - protein, 9 aa, Mycobacterium tuberculosis
GAQREIDIL

SEQ ID NO: 53197 - protein, 9 aa, Mycobacterium tuberculosis
AQREIDILE

SEQ ID NO: 53198 - protein, 9 aa, Mycobacterium tuberculosis
QREIDILEN

SEQ ID NO: 53199 - protein, 9 aa, Mycobacterium tuberculosis
REIDILEND

SEQ ID NO: 53200 - protein, 9 aa, Mycobacterium tuberculosis
EIDILENDP

SEQ ID NO: 53201 - protein, 9 aa, Mycobacterium tuberculosis
IDILENDPS

SEQ ID NO: 53202 - protein, 9 aa, Mycobacterium tuberculosis
DILENDPSL

SEQ ID NO: 53203 - protein, 9 aa, Mycobacterium tuberculosis
ILENDPSLD

SEQ ID NO: 53204 - protein, 9 aa, Mycobacterium tuberculosis
LENDPSLDA

SEQ ID NO: 53205 - protein, 9 aa, Mycobacterium tuberculosis
ENDPSLDAD

SEQ ID NO: 53206 - protein, 9 aa, Mycobacterium tuberculosis
NDPSLDADE

SEQ ID NO: 53207 - protein, 9 aa, Mycobacterium tuberculosis
DPSLDADER

SEQ ID NO: 53208 - protein, 9 aa, Mycobacterium tuberculosis
PSLDADERH

SEQ ID NO: 53209 - protein, 9 aa, Mycobacterium tuberculosis
SLDADERHT

SEQ ID NO: 53210 - protein, 9 aa, Mycobacterium tuberculosis
LDADERHTA

SEQ ID NO: 53211 - protein, 9 aa, Mycobacterium tuberculosis
DADERHTAI

SEQ ID NO: 53212 - protein, 9 aa, Mycobacterium tuberculosis
ADERHTAIN

SEQ ID NO: 53213 - protein, 9 aa, Mycobacterium tuberculosis
DERHTAINS

SEQ ID NO: 53214 - protein, 9 aa, Mycobacterium tuberculosis
ERHTAINSL

SEQ ID NO: 53215 - protein, 9 aa, Mycobacterium tuberculosis
RHTAINSLV

SEQ ID NO: 53216 - protein, 9 aa, Mycobacterium tuberculosis
HTAINSLVT

SEQ ID NO: 53217 - protein, 9 aa, Mycobacterium tuberculosis
TAINSLVTA

SEQ ID NO: 53218 - protein, 9 aa, Mycobacterium tuberculosis
AINSLVTAT

SEQ ID NO: 53219 - protein, 9 aa, Mycobacterium tuberculosis
INSLVTATH

SEQ ID NO: 53220 - protein, 9 aa, Mycobacterium tuberculosis
NSLVTATHG

SEQ ID NO: 53221 - protein, 9 aa, Mycobacterium tuberculosis
SLVTATHGA

SEQ ID NO: 53222 - protein, 9 aa, Mycobacterium tuberculosis
LVTATHGAN

SEQ ID NO: 53223 - protein, 9 aa, Mycobacterium tuberculosis
VTATHGANV

SEQ ID NO: 53224 - protein, 9 aa, Mycobacterium tuberculosis
TATHGANVS

SEQ ID NO: 53225 - protein, 9 aa, Mycobacterium tuberculosis
ATHGANVSL

SEQ ID NO: 53226 - protein, 9 aa, Mycobacterium tuberculosis
THGANVSLV

SEQ ID NO: 53227 - protein, 9 aa, Mycobacterium tuberculosis
HGANVSLVA

SEQ ID NO: 53228 - protein, 9 aa, Mycobacterium tuberculosis
GANVSLVAE

SEQ ID NO: 53229 - protein, 9 aa, Mycobacterium tuberculosis
ANVSLVAET

SEQ ID NO: 53230 - protein, 9 aa, Mycobacterium tuberculosis
NVSLVAETA

SEQ ID NO: 53231 - protein, 9 aa, Mycobacterium tuberculosis
VSLVAETAE

SEQ ID NO: 53232 - protein, 9 aa, Mycobacterium tuberculosis
SLVAETAER

SEQ ID NO: 53233 - protein, 9 aa, Mycobacterium tuberculosis
LVAETAERV

SEQ ID NO: 53234 - protein, 9 aa, Mycobacterium tuberculosis
VAETAERVL

SEQ ID NO: 53235 - protein, 9 aa, Mycobacterium tuberculosis
AETAERVLE

SEQ ID NO: 53236 - protein, 9 aa, Mycobacterium tuberculosis
ETAERVLES

SEQ ID NO: 53237 - protein, 9 aa, Mycobacterium tuberculosis
TAERVLESK

SEQ ID NO: 53238 - protein, 9 aa, Mycobacterium tuberculosis
AERVLESKN

SEQ ID NO: 53239 - protein, 9 aa, Mycobacterium tuberculosis
ERVLESKNW

SEQ ID NO: 53240 - protein, 9 aa, Mycobacterium tuberculosis
RVLESKNWK

SEQ ID NO: 53241 - protein, 9 aa, Mycobacterium tuberculosis
VLESKNWKP

SEQ ID NO: 53242 - protein, 9 aa, Mycobacterium tuberculosis
LESKNWKPP

SEQ ID NO: 53243 - protein, 9 aa, Mycobacterium tuberculosis
ESKNWKPPK

SEQ ID NO: 53244 - protein, 9 aa, Mycobacterium tuberculosis
SKNWKPPKN

SEQ ID NO: 53245 - protein, 9 aa, Mycobacterium tuberculosis
KNWKPPKNA

SEQ ID NO: 53246 - protein, 9 aa, Mycobacterium tuberculosis
NWKPPKNAL

SEQ ID NO: 53247 - protein, 9 aa, Mycobacterium tuberculosis
WKPPKNALE

SEQ ID NO: 53248 - protein, 9 aa, Mycobacterium tuberculosis
KPPKNALED

SEQ ID NO: 53249 - protein, 9 aa, Mycobacterium tuberculosis
PPKNALEDL

SEQ ID NO: 53250 - protein, 9 aa, Mycobacterium tuberculosis
PKNALEDLL

SEQ ID NO: 53251 - protein, 9 aa, Mycobacterium tuberculosis
KNALEDLLQ

SEQ ID NO: 53252 - protein, 9 aa, Mycobacterium tuberculosis
NALEDLLQQ

SEQ ID NO: 53253 - protein, 9 aa, Mycobacterium tuberculosis
ALEDLLQQK

SEQ ID NO: 53254 - protein, 9 aa, Mycobacterium tuberculosis
LEDLLQQKS

SEQ ID NO: 53255 - protein, 9 aa, Mycobacterium tuberculosis
EDLLQQKSP

SEQ ID NO: 53256 - protein, 9 aa, Mycobacterium tuberculosis
DLLQQKSPP

SEQ ID NO: 53257 - protein, 9 aa, Mycobacterium tuberculosis
LLQQKSPPP

SEQ ID NO: 53258 - protein, 9 aa, Mycobacterium tuberculosis
LQQKSPPPP

SEQ ID NO: 53259 - protein, 9 aa, Mycobacterium tuberculosis
QQKSPPPPD

SEQ ID NO: 53260 - protein, 9 aa, Mycobacterium tuberculosis
QKSPPPPDV

SEQ ID NO: 53261 - protein, 9 aa, Mycobacterium tuberculosis
KSPPPPDVP

SEQ ID NO: 53262 - protein, 9 aa, Mycobacterium tuberculosis
SPPPPDVPT

SEQ ID NO: 53263 - protein, 9 aa, Mycobacterium tuberculosis
PPPPDVPTL

SEQ ID NO: 53264 - protein, 9 aa, Mycobacterium tuberculosis
PPPDVPTLV

SEQ ID NO: 53265 - protein, 9 aa, Mycobacterium tuberculosis
PPDVPTLVV

SEQ ID NO: 53266 - protein, 9 aa, Mycobacterium tuberculosis
PDVPTLVVP

SEQ ID NO: 53267 - protein, 9 aa, Mycobacterium tuberculosis
DVPTLVVPS

SEQ ID NO: 53268 - protein, 9 aa, Mycobacterium tuberculosis
VPTLVVPSP

SEQ ID NO: 53269 - protein, 9 aa, Mycobacterium tuberculosis
PTLVVPSPG

SEQ ID NO: 53270 - protein, 9 aa, Mycobacterium tuberculosis
TLVVPSPGT

SEQ ID NO: 53271 - protein, 9 aa, Mycobacterium tuberculosis
LVVPSPGTP

SEQ ID NO: 53272 - protein, 9 aa, Mycobacterium tuberculosis
VVPSPGTPG

SEQ ID NO: 53273 - protein, 9 aa, Mycobacterium tuberculosis
VPSPGTPGT

SEQ ID NO: 53274 - protein, 9 aa, Mycobacterium tuberculosis
PSPGTPGTP

SEQ ID NO: 53275 - protein, 9 aa, Mycobacterium tuberculosis
SPGTPGTPG

SEQ ID NO: 53276 - protein, 9 aa, Mycobacterium tuberculosis
PGTPGTPGT

SEQ ID NO: 53277 - protein, 9 aa, Mycobacterium tuberculosis
GTPGTPGTP

SEQ ID NO: 53278 - protein, 9 aa, Mycobacterium tuberculosis
TPGTPGTPI

SEQ ID NO: 53279 - protein, 9 aa, Mycobacterium tuberculosis
PGTPGTPIT

SEQ ID NO: 53280 - protein, 9 aa, Mycobacterium tuberculosis
GTPGTPITP

SEQ ID NO: 53281 - protein, 9 aa, Mycobacterium tuberculosis
TPGTPITPG

SEQ ID NO: 53282 - protein, 9 aa, Mycobacterium tuberculosis
PGTPITPGT

SEQ ID NO: 53283 - protein, 9 aa, Mycobacterium tuberculosis
GTPITPGTP

SEQ ID NO: 53284 - protein, 9 aa, Mycobacterium tuberculosis
TPITPGTPI

SEQ ID NO: 53285 - protein, 9 aa, Mycobacterium tuberculosis
PITPGTPIT

SEQ ID NO: 53286 - protein, 9 aa, Mycobacterium tuberculosis
ITPGTPITP

SEQ ID NO: 53287 - protein, 9 aa, Mycobacterium tuberculosis
TPGTPITPG

SEQ ID NO: 53288 - protein, 9 aa, Mycobacterium tuberculosis
PGTPITPGT

SEQ ID NO: 53289 - protein, 9 aa, Mycobacterium tuberculosis
GTPITPGTP

SEQ ID NO: 53290 - protein, 9 aa, Mycobacterium tuberculosis
TPITPGTPI

SEQ ID NO: 53291 - protein, 9 aa, Mycobacterium tuberculosis
PITPGTPIT

SEQ ID NO: 53292 - protein, 9 aa, Mycobacterium tuberculosis
ITPGTPITP

SEQ ID NO: 53293 - protein, 9 aa, Mycobacterium tuberculosis
TPGTPITPI

SEQ ID NO: 53294 - protein, 9 aa, Mycobacterium tuberculosis
PGTPITPIP

SEQ ID NO: 53295 - protein, 9 aa, Mycobacterium tuberculosis
GTPITPIPG

SEQ ID NO: 53296 - protein, 9 aa, Mycobacterium tuberculosis
TPITPIPGA

SEQ ID NO: 53297 - protein, 9 aa, Mycobacterium tuberculosis
PITPIPGAP

SEQ ID NO: 53298 - protein, 9 aa, Mycobacterium tuberculosis
ITPIPGAPV

SEQ ID NO: 53299 - protein, 9 aa, Mycobacterium tuberculosis
TPIPGAPVT

SEQ ID NO: 53300 - protein, 9 aa, Mycobacterium tuberculosis
PIPGAPVTP

SEQ ID NO: 53301 - protein, 9 aa, Mycobacterium tuberculosis
IPGAPVTPI

SEQ ID NO: 53302 - protein, 9 aa, Mycobacterium tuberculosis
PGAPVTPIT

SEQ ID NO: 53303 - protein, 9 aa, Mycobacterium tuberculosis
GAPVTPITP

SEQ ID NO: 53304 - protein, 9 aa, Mycobacterium tuberculosis
APVTPITPT

SEQ ID NO: 53305 - protein, 9 aa, Mycobacterium tuberculosis
PVTPITPTP

SEQ ID NO: 53306 - protein, 9 aa, Mycobacterium tuberculosis
VTPITPTPG

SEQ ID NO: 53307 - protein, 9 aa, Mycobacterium tuberculosis
TPITPTPGT

SEQ ID NO: 53308 - protein, 9 aa, Mycobacterium tuberculosis
PITPTPGTP

SEQ ID NO: 53309 - protein, 9 aa, Mycobacterium tuberculosis
ITPTPGTPV

SEQ ID NO: 53310 - protein, 9 aa, Mycobacterium tuberculosis
TPTPGTPVT

SEQ ID NO: 53311 - protein, 9 aa, Mycobacterium tuberculosis
PTPGTPVTP

SEQ ID NO: 53312 - protein, 9 aa, Mycobacterium tuberculosis
TPGTPVTPV

SEQ ID NO: 53313 - protein, 9 aa, Mycobacterium tuberculosis
PGTPVTPVT

SEQ ID NO: 53314 - protein, 9 aa, Mycobacterium tuberculosis
GTPVTPVTP

SEQ ID NO: 53315 - protein, 9 aa, Mycobacterium tuberculosis
TPVTPVTPG

SEQ ID NO: 53316 - protein, 9 aa, Mycobacterium tuberculosis
PVTPVTPGK

SEQ ID NO: 53317 - protein, 9 aa, Mycobacterium tuberculosis
VTPVTPGKP

SEQ ID NO: 53318 - protein, 9 aa, Mycobacterium tuberculosis
TPVTPGKPV

SEQ ID NO: 53319 - protein, 9 aa, Mycobacterium tuberculosis
PVTPGKPVT

SEQ ID NO: 53320 - protein, 9 aa, Mycobacterium tuberculosis
VTPGKPVTP

SEQ ID NO: 53321 - protein, 9 aa, Mycobacterium tuberculosis
TPGKPVTPV

SEQ ID NO: 53322 - protein, 9 aa, Mycobacterium tuberculosis
PGKPVTPVT

SEQ ID NO: 53323 - protein, 9 aa, Mycobacterium tuberculosis
GKPVTPVTP

SEQ ID NO: 53324 - protein, 9 aa, Mycobacterium tuberculosis
KPVTPVTPV

SEQ ID NO: 53325 - protein, 9 aa, Mycobacterium tuberculosis
PVTPVTPVK

SEQ ID NO: 53326 - protein, 9 aa, Mycobacterium tuberculosis
VTPVTPVKP

SEQ ID NO: 53327 - protein, 9 aa, Mycobacterium tuberculosis
TPVTPVKPG

SEQ ID NO: 53328 - protein, 9 aa, Mycobacterium tuberculosis
PVTPVKPGT

SEQ ID NO: 53329 - protein, 9 aa, Mycobacterium tuberculosis
VTPVKPGTP

SEQ ID NO: 53330 - protein, 9 aa, Mycobacterium tuberculosis
TPVKPGTPG

SEQ ID NO: 53331 - protein, 9 aa, Mycobacterium tuberculosis
PVKPGTPGE

SEQ ID NO: 53332 - protein, 9 aa, Mycobacterium tuberculosis
VKPGTPGEP

SEQ ID NO: 53333 - protein, 9 aa, Mycobacterium tuberculosis
KPGTPGEPT

SEQ ID NO: 53334 - protein, 9 aa, Mycobacterium tuberculosis
PGTPGEPTP

SEQ ID NO: 53335 - protein, 9 aa, Mycobacterium tuberculosis
GTPGEPTPI

SEQ ID NO: 53336 - protein, 9 aa, Mycobacterium tuberculosis
TPGEPTPIT

SEQ ID NO: 53337 - protein, 9 aa, Mycobacterium tuberculosis
PGEPTPITP

SEQ ID NO: 53338 - protein, 9 aa, Mycobacterium tuberculosis
GEPTPITPV

SEQ ID NO: 53339 - protein, 9 aa, Mycobacterium tuberculosis
EPTPITPVT

SEQ ID NO: 53340 - protein, 9 aa, Mycobacterium tuberculosis
PTPITPVTP

SEQ ID NO: 53341 - protein, 9 aa, Mycobacterium tuberculosis
TPITPVTPP

SEQ ID NO: 53342 - protein, 9 aa, Mycobacterium tuberculosis
PITPVTPPV

SEQ ID NO: 53343 - protein, 9 aa, Mycobacterium tuberculosis
ITPVTPPVA

SEQ ID NO: 53344 - protein, 9 aa, Mycobacterium tuberculosis
TPVTPPVAP

SEQ ID NO: 53345 - protein, 9 aa, Mycobacterium tuberculosis
PVTPPVAPA

SEQ ID NO: 53346 - protein, 9 aa, Mycobacterium tuberculosis
VTPPVAPAT

SEQ ID NO: 53347 - protein, 9 aa, Mycobacterium tuberculosis
TPPVAPATP

SEQ ID NO: 53348 - protein, 9 aa, Mycobacterium tuberculosis
PPVAPATPA

SEQ ID NO: 53349 - protein, 9 aa, Mycobacterium tuberculosis
PVAPATPAT

SEQ ID NO: 53350 - protein, 9 aa, Mycobacterium tuberculosis
VAPATPATP

SEQ ID NO: 53351 - protein, 9 aa, Mycobacterium tuberculosis
APATPATPA

SEQ ID NO: 53352 - protein, 9 aa, Mycobacterium tuberculosis
PATPATPAT

SEQ ID NO: 53353 - protein, 9 aa, Mycobacterium tuberculosis
ATPATPATP

SEQ ID NO: 53354 - protein, 9 aa, Mycobacterium tuberculosis
TPATPATPV

SEQ ID NO: 53355 - protein, 9 aa, Mycobacterium tuberculosis
PATPATPVT

SEQ ID NO: 53356 - protein, 9 aa, Mycobacterium tuberculosis
ATPATPVTP

SEQ ID NO: 53357 - protein, 9 aa, Mycobacterium tuberculosis
TPATPVTPA

SEQ ID NO: 53358 - protein, 9 aa, Mycobacterium tuberculosis
PATPVTPAP

SEQ ID NO: 53359 - protein, 9 aa, Mycobacterium tuberculosis
ATPVTPAPA

SEQ ID NO: 53360 - protein, 9 aa, Mycobacterium tuberculosis
TPVTPAPAP

SEQ ID NO: 53361 - protein, 9 aa, Mycobacterium tuberculosis
PVTPAPAPH

SEQ ID NO: 53362 - protein, 9 aa, Mycobacterium tuberculosis
VTPAPAPHP

SEQ ID NO: 53363 - protein, 9 aa, Mycobacterium tuberculosis
TPAPAPHPQ

SEQ ID NO: 53364 - protein, 9 aa, Mycobacterium tuberculosis
PAPAPHPQP

SEQ ID NO: 53365 - protein, 9 aa, Mycobacterium tuberculosis
APAPHPQPA

SEQ ID NO: 53366 - protein, 9 aa, Mycobacterium tuberculosis
PAPHPQPAP

SEQ ID NO: 53367 - protein, 9 aa, Mycobacterium tuberculosis
APHPQPAPA

SEQ ID NO: 53368 - protein, 9 aa, Mycobacterium tuberculosis
PHPQPAPAP

SEQ ID NO: 53369 - protein, 9 aa, Mycobacterium tuberculosis
HPQPAPAPA

SEQ ID NO: 53370 - protein, 9 aa, Mycobacterium tuberculosis
PQPAPAPAP

SEQ ID NO: 53371 - protein, 9 aa, Mycobacterium tuberculosis
QPAPAPAPS

SEQ ID NO: 53372 - protein, 9 aa, Mycobacterium tuberculosis
PAPAPAPSP

SEQ ID NO: 53373 - protein, 9 aa, Mycobacterium tuberculosis
APAPAPSPG

SEQ ID NO: 53374 - protein, 9 aa, Mycobacterium tuberculosis
PAPAPSPGP

SEQ ID NO: 53375 - protein, 9 aa, Mycobacterium tuberculosis
APAPSPGPQ

SEQ ID NO: 53376 - protein, 9 aa, Mycobacterium tuberculosis
PAPSPGPQP

SEQ ID NO: 53377 - protein, 9 aa, Mycobacterium tuberculosis
APSPGPQPV

SEQ ID NO: 53378 - protein, 9 aa, Mycobacterium tuberculosis
PSPGPQPVT

SEQ ID NO: 53379 - protein, 9 aa, Mycobacterium tuberculosis
SPGPQPVTP

SEQ ID NO: 53380 - protein, 9 aa, Mycobacterium tuberculosis
PGPQPVTPA

SEQ ID NO: 53381 - protein, 9 aa, Mycobacterium tuberculosis
GPQPVTPAT

SEQ ID NO: 53382 - protein, 9 aa, Mycobacterium tuberculosis
PQPVTPATP

SEQ ID NO: 53383 - protein, 9 aa, Mycobacterium tuberculosis
QPVTPATPG

SEQ ID NO: 53384 - protein, 9 aa, Mycobacterium tuberculosis
PVTPATPGP

SEQ ID NO: 53385 - protein, 9 aa, Mycobacterium tuberculosis
VTPATPGPS

SEQ ID NO: 53386 - protein, 9 aa, Mycobacterium tuberculosis
TPATPGPSG

SEQ ID NO: 53387 - protein, 9 aa, Mycobacterium tuberculosis
PATPGPSGP

SEQ ID NO: 53388 - protein, 9 aa, Mycobacterium tuberculosis
ATPGPSGPA

SEQ ID NO: 53389 - protein, 9 aa, Mycobacterium tuberculosis
TPGPSGPAT

SEQ ID NO: 53390 - protein, 9 aa, Mycobacterium tuberculosis
PGPSGPATP

SEQ ID NO: 53391 - protein, 9 aa, Mycobacterium tuberculosis
GPSGPATPG

SEQ ID NO: 53392 - protein, 9 aa, Mycobacterium tuberculosis
PSGPATPGT

SEQ ID NO: 53393 - protein, 9 aa, Mycobacterium tuberculosis
SGPATPGTP

SEQ ID NO: 53394 - protein, 9 aa, Mycobacterium tuberculosis
GPATPGTPG

SEQ ID NO: 53395 - protein, 9 aa, Mycobacterium tuberculosis
PATPGTPGG

SEQ ID NO: 53396 - protein, 9 aa, Mycobacterium tuberculosis
ATPGTPGGE

SEQ ID NO: 53397 - protein, 9 aa, Mycobacterium tuberculosis
TPGTPGGEP

SEQ ID NO: 53398 - protein, 9 aa, Mycobacterium tuberculosis
PGTPGGEPA

SEQ ID NO: 53399 - protein, 9 aa, Mycobacterium tuberculosis
GTPGGEPAP

SEQ ID NO: 53400 - protein, 9 aa, Mycobacterium tuberculosis
TPGGEPAPH

SEQ ID NO: 53401 - protein, 9 aa, Mycobacterium tuberculosis
PGGEPAPHV

SEQ ID NO: 53402 - protein, 9 aa, Mycobacterium tuberculosis
GGEPAPHVK

SEQ ID NO: 53403 - protein, 9 aa, Mycobacterium tuberculosis
GEPAPHVKP

SEQ ID NO: 53404 - protein, 9 aa, Mycobacterium tuberculosis
EPAPHVKPA

SEQ ID NO: 53405 - protein, 9 aa, Mycobacterium tuberculosis
PAPHVKPAA

SEQ ID NO: 53406 - protein, 9 aa, Mycobacterium tuberculosis
APHVKPAAL

SEQ ID NO: 53407 - protein, 9 aa, Mycobacterium tuberculosis
PHVKPAALA

SEQ ID NO: 53408 - protein, 9 aa, Mycobacterium tuberculosis
HVKPAALAE

SEQ ID NO: 53409 - protein, 9 aa, Mycobacterium tuberculosis
VKPAALAEQ

SEQ ID NO: 53410 - protein, 9 aa, Mycobacterium tuberculosis
KPAALAEQP

SEQ ID NO: 53411 - protein, 9 aa, Mycobacterium tuberculosis
PAALAEQPG

SEQ ID NO: 53412 - protein, 9 aa, Mycobacterium tuberculosis
AALAEQPGV

SEQ ID NO: 53413 - protein, 9 aa, Mycobacterium tuberculosis
ALAEQPGVP

SEQ ID NO: 53414 - protein, 9 aa, Mycobacterium tuberculosis
LAEQPGVPG

SEQ ID NO: 53415 - protein, 9 aa, Mycobacterium tuberculosis
AEQPGVPGQ

SEQ ID NO: 53416 - protein, 9 aa, Mycobacterium tuberculosis
EQPGVPGQH

SEQ ID NO: 53417 - protein, 9 aa, Mycobacterium tuberculosis
QPGVPGQHA

SEQ ID NO: 53418 - protein, 9 aa, Mycobacterium tuberculosis
PGVPGQHAG

SEQ ID NO: 53419 - protein, 9 aa, Mycobacterium tuberculosis
GVPGQHAGG

SEQ ID NO: 53420 - protein, 9 aa, Mycobacterium tuberculosis
VPGQHAGGG

SEQ ID NO: 53421 - protein, 9 aa, Mycobacterium tuberculosis
PGQHAGGGT

SEQ ID NO: 53422 - protein, 9 aa, Mycobacterium tuberculosis
GQHAGGGTQ

SEQ ID NO: 53423 - protein, 9 aa, Mycobacterium tuberculosis
QHAGGGTQS

SEQ ID NO: 53424 - protein, 9 aa, Mycobacterium tuberculosis
HAGGGTQSG

SEQ ID NO: 53425 - protein, 9 aa, Mycobacterium tuberculosis
AGGGTQSGP

SEQ ID NO: 53426 - protein, 9 aa, Mycobacterium tuberculosis
GGGTQSGPA

SEQ ID NO: 53427 - protein, 9 aa, Mycobacterium tuberculosis
GGTQSGPAH

SEQ ID NO: 53428 - protein, 9 aa, Mycobacterium tuberculosis
GTQSGPAHA

SEQ ID NO: 53429 - protein, 9 aa, Mycobacterium tuberculosis
TQSGPAHAD

SEQ ID NO: 53430 - protein, 9 aa, Mycobacterium tuberculosis
QSGPAHADE

SEQ ID NO: 53431 - protein, 9 aa, Mycobacterium tuberculosis
SGPAHADES

SEQ ID NO: 53432 - protein, 9 aa, Mycobacterium tuberculosis
GPAHADESA

SEQ ID NO: 53433 - protein, 9 aa, Mycobacterium tuberculosis
PAHADESAA

SEQ ID NO: 53434 - protein, 9 aa, Mycobacterium tuberculosis
AHADESAAS

SEQ ID NO: 53435 - protein, 9 aa, Mycobacterium tuberculosis
HADESAASV

SEQ ID NO: 53436 - protein, 9 aa, Mycobacterium tuberculosis
ADESAASVT

SEQ ID NO: 53437 - protein, 9 aa, Mycobacterium tuberculosis
DESAASVTP

SEQ ID NO: 53438 - protein, 9 aa, Mycobacterium tuberculosis
ESAASVTPA

SEQ ID NO: 53439 - protein, 9 aa, Mycobacterium tuberculosis
SAASVTPAA

SEQ ID NO: 53440 - protein, 9 aa, Mycobacterium tuberculosis
AASVTPAAA

SEQ ID NO: 53441 - protein, 9 aa, Mycobacterium tuberculosis
ASVTPAAAS

SEQ ID NO: 53442 - protein, 9 aa, Mycobacterium tuberculosis
SVTPAAASG

SEQ ID NO: 53443 - protein, 9 aa, Mycobacterium tuberculosis
VTPAAASGV

SEQ ID NO: 53444 - protein, 9 aa, Mycobacterium tuberculosis
TPAAASGVP

SEQ ID NO: 53445 - protein, 9 aa, Mycobacterium tuberculosis
PAAASGVPG

SEQ ID NO: 53446 - protein, 9 aa, Mycobacterium tuberculosis
AAASGVPGA

SEQ ID NO: 53447 - protein, 9 aa, Mycobacterium tuberculosis
AASGVPGAR

SEQ ID NO: 53448 - protein, 9 aa, Mycobacterium tuberculosis
ASGVPGARA

SEQ ID NO: 53449 - protein, 9 aa, Mycobacterium tuberculosis
SGVPGARAA

SEQ ID NO: 53450 - protein, 9 aa, Mycobacterium tuberculosis
GVPGARAAA

SEQ ID NO: 53451 - protein, 9 aa, Mycobacterium tuberculosis
VPGARAAAA

SEQ ID NO: 53452 - protein, 9 aa, Mycobacterium tuberculosis
PGARAAAAA

SEQ ID NO: 53453 - protein, 9 aa, Mycobacterium tuberculosis
GARAAAAAP

SEQ ID NO: 53454 - protein, 9 aa, Mycobacterium tuberculosis
ARAAAAAPS

SEQ ID NO: 53455 - protein, 9 aa, Mycobacterium tuberculosis
RAAAAAPSG

SEQ ID NO: 53456 - protein, 9 aa, Mycobacterium tuberculosis
AAAAAPSGT

SEQ ID NO: 53457 - protein, 9 aa, Mycobacterium tuberculosis
AAAAPSGTA

SEQ ID NO: 53458 - protein, 9 aa, Mycobacterium tuberculosis
AAAPSGTAV

SEQ ID NO: 53459 - protein, 9 aa, Mycobacterium tuberculosis
AAPSGTAVG

SEQ ID NO: 53460 - protein, 9 aa, Mycobacterium tuberculosis
APSGTAVGA

SEQ ID NO: 53461 - protein, 9 aa, Mycobacterium tuberculosis
PSGTAVGAG

SEQ ID NO: 53462 - protein, 9 aa, Mycobacterium tuberculosis
SGTAVGAGA

SEQ ID NO: 53463 - protein, 9 aa, Mycobacterium tuberculosis
GTAVGAGAR

SEQ ID NO: 53464 - protein, 9 aa, Mycobacterium tuberculosis
TAVGAGARS

SEQ ID NO: 53465 - protein, 9 aa, Mycobacterium tuberculosis
AVGAGARSS

SEQ ID NO: 53466 - protein, 9 aa, Mycobacterium tuberculosis
VGAGARSSV

SEQ ID NO: 53467 - protein, 9 aa, Mycobacterium tuberculosis
GAGARSSVG

SEQ ID NO: 53468 - protein, 9 aa, Mycobacterium tuberculosis
AGARSSVGT

SEQ ID NO: 53469 - protein, 9 aa, Mycobacterium tuberculosis
GARSSVGTA

SEQ ID NO: 53470 - protein, 9 aa, Mycobacterium tuberculosis
ARSSVGTAA

SEQ ID NO: 53471 - protein, 9 aa, Mycobacterium tuberculosis
RSSVGTAAA

SEQ ID NO: 53472 - protein, 9 aa, Mycobacterium tuberculosis
SSVGTAAAS

SEQ ID NO: 53473 - protein, 9 aa, Mycobacterium tuberculosis
SVGTAAASG

SEQ ID NO: 53474 - protein, 9 aa, Mycobacterium tuberculosis
VGTAAASGA

SEQ ID NO: 53475 - protein, 9 aa, Mycobacterium tuberculosis
GTAAASGAG

SEQ ID NO: 53476 - protein, 9 aa, Mycobacterium tuberculosis
TAAASGAGS

SEQ ID NO: 53477 - protein, 9 aa, Mycobacterium tuberculosis
AAASGAGSH

SEQ ID NO: 53478 - protein, 9 aa, Mycobacterium tuberculosis
AASGAGSHA

SEQ ID NO: 53479 - protein, 9 aa, Mycobacterium tuberculosis
ASGAGSHAA

SEQ ID NO: 53480 - protein, 9 aa, Mycobacterium tuberculosis
SGAGSHAAT

SEQ ID NO: 53481 - protein, 9 aa, Mycobacterium tuberculosis
GAGSHAATG

SEQ ID NO: 53482 - protein, 9 aa, Mycobacterium tuberculosis
AGSHAATGR

SEQ ID NO: 53483 - protein, 9 aa, Mycobacterium tuberculosis
GSHAATGRA

SEQ ID NO: 53484 - protein, 9 aa, Mycobacterium tuberculosis
SHAATGRAP

SEQ ID NO: 53485 - protein, 9 aa, Mycobacterium tuberculosis
HAATGRAPV

SEQ ID NO: 53486 - protein, 9 aa, Mycobacterium tuberculosis
AATGRAPVA

SEQ ID NO: 53487 - protein, 9 aa, Mycobacterium tuberculosis
ATGRAPVAT

SEQ ID NO: 53488 - protein, 9 aa, Mycobacterium tuberculosis
TGRAPVATS

SEQ ID NO: 53489 - protein, 9 aa, Mycobacterium tuberculosis
GRAPVATSD

SEQ ID NO: 53490 - protein, 9 aa, Mycobacterium tuberculosis
RAPVATSDK

SEQ ID NO: 53491 - protein, 9 aa, Mycobacterium tuberculosis
APVATSDKA

SEQ ID NO: 53492 - protein, 9 aa, Mycobacterium tuberculosis
PVATSDKAA

SEQ ID NO: 53493 - protein, 9 aa, Mycobacterium tuberculosis
VATSDKAAA

SEQ ID NO: 53494 - protein, 9 aa, Mycobacterium tuberculosis
ATSDKAAAP

SEQ ID NO: 53495 - protein, 9 aa, Mycobacterium tuberculosis
TSDKAAAPS

SEQ ID NO: 53496 - protein, 9 aa, Mycobacterium tuberculosis
SDKAAAPST

SEQ ID NO: 53497 - protein, 9 aa, Mycobacterium tuberculosis
DKAAAPSTR

SEQ ID NO: 53498 - protein, 9 aa, Mycobacterium tuberculosis
KAAAPSTRA

SEQ ID NO: 53499 - protein, 9 aa, Mycobacterium tuberculosis
AAAPSTRAA

SEQ ID NO: 53500 - protein, 9 aa, Mycobacterium tuberculosis
AAPSTRAAS

SEQ ID NO: 53501 - protein, 9 aa, Mycobacterium tuberculosis
APSTRAASA

SEQ ID NO: 53502 - protein, 9 aa, Mycobacterium tuberculosis
PSTRAASAR

SEQ ID NO: 53503 - protein, 9 aa, Mycobacterium tuberculosis
STRAASART

SEQ ID NO: 53504 - protein, 9 aa, Mycobacterium tuberculosis
TRAASARTA

SEQ ID NO: 53505 - protein, 9 aa, Mycobacterium tuberculosis
RAASARTAP

SEQ ID NO: 53506 - protein, 9 aa, Mycobacterium tuberculosis
AASARTAPP

SEQ ID NO: 53507 - protein, 9 aa, Mycobacterium tuberculosis
ASARTAPPA

SEQ ID NO: 53508 - protein, 9 aa, Mycobacterium tuberculosis
SARTAPPAR

SEQ ID NO: 53509 - protein, 9 aa, Mycobacterium tuberculosis
ARTAPPARP

SEQ ID NO: 53510 - protein, 9 aa, Mycobacterium tuberculosis
RTAPPARPP

SEQ ID NO: 53511 - protein, 9 aa, Mycobacterium tuberculosis
TAPPARPPS

SEQ ID NO: 53512 - protein, 9 aa, Mycobacterium tuberculosis
APPARPPST

SEQ ID NO: 53513 - protein, 9 aa, Mycobacterium tuberculosis
PPARPPSTD

SEQ ID NO: 53514 - protein, 9 aa, Mycobacterium tuberculosis
PARPPSTDH

SEQ ID NO: 53515 - protein, 9 aa, Mycobacterium tuberculosis
ARPPSTDHI

SEQ ID NO: 53516 - protein, 9 aa, Mycobacterium tuberculosis
RPPSTDHID

SEQ ID NO: 53517 - protein, 9 aa, Mycobacterium tuberculosis
PPSTDHIDK

SEQ ID NO: 53518 - protein, 9 aa, Mycobacterium tuberculosis
PSTDHIDKP

SEQ ID NO: 53519 - protein, 9 aa, Mycobacterium tuberculosis
STDHIDKPD

SEQ ID NO: 53520 - protein, 9 aa, Mycobacterium tuberculosis
TDHIDKPDR

SEQ ID NO: 53521 - protein, 9 aa, Mycobacterium tuberculosis
DHIDKPDRS

SEQ ID NO: 53522 - protein, 9 aa, Mycobacterium tuberculosis
HIDKPDRSE

SEQ ID NO: 53523 - protein, 9 aa, Mycobacterium tuberculosis
IDKPDRSES

SEQ ID NO: 53524 - protein, 9 aa, Mycobacterium tuberculosis
DKPDRSESA

SEQ ID NO: 53525 - protein, 9 aa, Mycobacterium tuberculosis
KPDRSESAD

SEQ ID NO: 53526 - protein, 9 aa, Mycobacterium tuberculosis
PDRSESADD

SEQ ID NO: 53527 - protein, 9 aa, Mycobacterium tuberculosis
DRSESADDG

SEQ ID NO: 53528 - protein, 9 aa, Mycobacterium tuberculosis
RSESADDGT

SEQ ID NO: 53529 - protein, 9 aa, Mycobacterium tuberculosis
SESADDGTP

SEQ ID NO: 53530 - protein, 9 aa, Mycobacterium tuberculosis
ESADDGTPV

SEQ ID NO: 53531 - protein, 9 aa, Mycobacterium tuberculosis
SADDGTPVS

SEQ ID NO: 53532 - protein, 9 aa, Mycobacterium tuberculosis
ADDGTPVSM

SEQ ID NO: 53533 - protein, 9 aa, Mycobacterium tuberculosis
DDGTPVSMI

SEQ ID NO: 53534 - protein, 9 aa, Mycobacterium tuberculosis
DGTPVSMIP

SEQ ID NO: 53535 - protein, 9 aa, Mycobacterium tuberculosis
GTPVSMIPV

SEQ ID NO: 53536 - protein, 9 aa, Mycobacterium tuberculosis
TPVSMIPVS

SEQ ID NO: 53537 - protein, 9 aa, Mycobacterium tuberculosis
PVSMIPVSA

SEQ ID NO: 53538 - protein, 9 aa, Mycobacterium tuberculosis
VSMIPVSAA

SEQ ID NO: 53539 - protein, 9 aa, Mycobacterium tuberculosis
SMIPVSAAR

SEQ ID NO: 53540 - protein, 9 aa, Mycobacterium tuberculosis
MIPVSAARA

SEQ ID NO: 53541 - protein, 9 aa, Mycobacterium tuberculosis
IPVSAARAA

SEQ ID NO: 53542 - protein, 9 aa, Mycobacterium tuberculosis
PVSAARAAR

SEQ ID NO: 53543 - protein, 9 aa, Mycobacterium tuberculosis
VSAARAARD

SEQ ID NO: 53544 - protein, 9 aa, Mycobacterium tuberculosis
SAARAARDA

SEQ ID NO: 53545 - protein, 9 aa, Mycobacterium tuberculosis
AARAARDAA

SEQ ID NO: 53546 - protein, 9 aa, Mycobacterium tuberculosis
ARAARDAAT

SEQ ID NO: 53547 - protein, 9 aa, Mycobacterium tuberculosis
RAARDAATA

SEQ ID NO: 53548 - protein, 9 aa, Mycobacterium tuberculosis
AARDAATAA

SEQ ID NO: 53549 - protein, 9 aa, Mycobacterium tuberculosis
ARDAATAAA

SEQ ID NO: 53550 - protein, 9 aa, Mycobacterium tuberculosis
RDAATAAAS

SEQ ID NO: 53551 - protein, 9 aa, Mycobacterium tuberculosis
DAATAAASA

SEQ ID NO: 53552 - protein, 9 aa, Mycobacterium tuberculosis
AATAAASAR

SEQ ID NO: 53553 - protein, 9 aa, Mycobacterium tuberculosis
ATAAASARQ

SEQ ID NO: 53554 - protein, 9 aa, Mycobacterium tuberculosis
TAAASARQR

SEQ ID NO: 53555 - protein, 9 aa, Mycobacterium tuberculosis
AAASARQRG

SEQ ID NO: 53556 - protein, 9 aa, Mycobacterium tuberculosis
AASARQRGR

SEQ ID NO: 53557 - protein, 9 aa, Mycobacterium tuberculosis
ASARQRGRG

SEQ ID NO: 53558 - protein, 9 aa, Mycobacterium tuberculosis
SARQRGRGD

SEQ ID NO: 53559 - protein, 9 aa, Mycobacterium tuberculosis
ARQRGRGDA

SEQ ID NO: 53560 - protein, 9 aa, Mycobacterium tuberculosis
RQRGRGDAL

SEQ ID NO: 53561 - protein, 9 aa, Mycobacterium tuberculosis
QRGRGDALR

SEQ ID NO: 53562 - protein, 9 aa, Mycobacterium tuberculosis
RGRGDALRL

SEQ ID NO: 53563 - protein, 9 aa, Mycobacterium tuberculosis
GRGDALRLA

SEQ ID NO: 53564 - protein, 9 aa, Mycobacterium tuberculosis
RGDALRLAR

SEQ ID NO: 53565 - protein, 9 aa, Mycobacterium tuberculosis
GDALRLARR

SEQ ID NO: 53566 - protein, 9 aa, Mycobacterium tuberculosis
DALRLARRI

SEQ ID NO: 53567 - protein, 9 aa, Mycobacterium tuberculosis
ALRLARRIA

SEQ ID NO: 53568 - protein, 9 aa, Mycobacterium tuberculosis
LRLARRIAA

SEQ ID NO: 53569 - protein, 9 aa, Mycobacterium tuberculosis
RLARRIAAA

SEQ ID NO: 53570 - protein, 9 aa, Mycobacterium tuberculosis
LARRIAAAL

SEQ ID NO: 53571 - protein, 9 aa, Mycobacterium tuberculosis
ARRIAAALN

SEQ ID NO: 53572 - protein, 9 aa, Mycobacterium tuberculosis
RRIAAALNA

SEQ ID NO: 53573 - protein, 9 aa, Mycobacterium tuberculosis
RIAAALNAS

SEQ ID NO: 53574 - protein, 9 aa, Mycobacterium tuberculosis
IAAALNASD

SEQ ID NO: 53575 - protein, 9 aa, Mycobacterium tuberculosis
AAALNASDN

SEQ ID NO: 53576 - protein, 9 aa, Mycobacterium tuberculosis
AALNASDNN

SEQ ID NO: 53577 - protein, 9 aa, Mycobacterium tuberculosis
ALNASDNNA

SEQ ID NO: 53578 - protein, 9 aa, Mycobacterium tuberculosis
LNASDNNAG

SEQ ID NO: 53579 - protein, 9 aa, Mycobacterium tuberculosis
NASDNNAGD

SEQ ID NO: 53580 - protein, 9 aa, Mycobacterium tuberculosis
ASDNNAGDY

SEQ ID NO: 53581 - protein, 9 aa, Mycobacterium tuberculosis
SDNNAGDYG

SEQ ID NO: 53582 - protein, 9 aa, Mycobacterium tuberculosis
DNNAGDYGF

SEQ ID NO: 53583 - protein, 9 aa, Mycobacterium tuberculosis
NNAGDYGFF

SEQ ID NO: 53584 - protein, 9 aa, Mycobacterium tuberculosis
NAGDYGFFW

SEQ ID NO: 53585 - protein, 9 aa, Mycobacterium tuberculosis
AGDYGFFWI

SEQ ID NO: 53586 - protein, 9 aa, Mycobacterium tuberculosis
GDYGFFWIT

SEQ ID NO: 53587 - protein, 9 aa, Mycobacterium tuberculosis
DYGFFWITA

SEQ ID NO: 53588 - protein, 9 aa, Mycobacterium tuberculosis
YGFFWITAV

SEQ ID NO: 53589 - protein, 9 aa, Mycobacterium tuberculosis
GFFWITAVT

SEQ ID NO: 53590 - protein, 9 aa, Mycobacterium tuberculosis
FFWITAVTT

SEQ ID NO: 53591 - protein, 9 aa, Mycobacterium tuberculosis
FWITAVTTD

SEQ ID NO: 53592 - protein, 9 aa, Mycobacterium tuberculosis
WITAVTTDG

SEQ ID NO: 53593 - protein, 9 aa, Mycobacterium tuberculosis
ITAVTTDGS

SEQ ID NO: 53594 - protein, 9 aa, Mycobacterium tuberculosis
TAVTTDGSI

SEQ ID NO: 53595 - protein, 9 aa, Mycobacterium tuberculosis
AVTTDGSIV

SEQ ID NO: 53596 - protein, 9 aa, Mycobacterium tuberculosis
VTTDGSIVV

SEQ ID NO: 53597 - protein, 9 aa, Mycobacterium tuberculosis
TTDGSIVVA

SEQ ID NO: 53598 - protein, 9 aa, Mycobacterium tuberculosis
TDGSIVVAN

SEQ ID NO: 53599 - protein, 9 aa, Mycobacterium tuberculosis
DGSIVVANS

SEQ ID NO: 53600 - protein, 9 aa, Mycobacterium tuberculosis
GSIVVANSY

SEQ ID NO: 53601 - protein, 9 aa, Mycobacterium tuberculosis
SIVVANSYG

SEQ ID NO: 53602 - protein, 9 aa, Mycobacterium tuberculosis
IVVANSYGL

SEQ ID NO: 53603 - protein, 9 aa, Mycobacterium tuberculosis
VVANSYGLA

SEQ ID NO: 53604 - protein, 9 aa, Mycobacterium tuberculosis
VANSYGLAY

SEQ ID NO: 53605 - protein, 9 aa, Mycobacterium tuberculosis
ANSYGLAYI

SEQ ID NO: 53606 - protein, 9 aa, Mycobacterium tuberculosis
NSYGLAYIP

SEQ ID NO: 53607 - protein, 9 aa, Mycobacterium tuberculosis
SYGLAYIPD

SEQ ID NO: 53608 - protein, 9 aa, Mycobacterium tuberculosis
YGLAYIPDG

SEQ ID NO: 53609 - protein, 9 aa, Mycobacterium tuberculosis
GLAYIPDGM

SEQ ID NO: 53610 - protein, 9 aa, Mycobacterium tuberculosis
LAYIPDGME

SEQ ID NO: 53611 - protein, 9 aa, Mycobacterium tuberculosis
AYIPDGMEL

SEQ ID NO: 53612 - protein, 9 aa, Mycobacterium tuberculosis
YIPDGMELP

SEQ ID NO: 53613 - protein, 9 aa, Mycobacterium tuberculosis
IPDGMELPN

SEQ ID NO: 53614 - protein, 9 aa, Mycobacterium tuberculosis
PDGMELPNK

SEQ ID NO: 53615 - protein, 9 aa, Mycobacterium tuberculosis
DGMELPNKV

SEQ ID NO: 53616 - protein, 9 aa, Mycobacterium tuberculosis
GMELPNKVY

SEQ ID NO: 53617 - protein, 9 aa, Mycobacterium tuberculosis
MELPNKVYL

SEQ ID NO: 53618 - protein, 9 aa, Mycobacterium tuberculosis
ELPNKVYLA

SEQ ID NO: 53619 - protein, 9 aa, Mycobacterium tuberculosis
LPNKVYLAS

SEQ ID NO: 53620 - protein, 9 aa, Mycobacterium tuberculosis
PNKVYLASA

SEQ ID NO: 53621 - protein, 9 aa, Mycobacterium tuberculosis
NKVYLASAD

SEQ ID NO: 53622 - protein, 9 aa, Mycobacterium tuberculosis
KVYLASADH

SEQ ID NO: 53623 - protein, 9 aa, Mycobacterium tuberculosis
VYLASADHA

SEQ ID NO: 53624 - protein, 9 aa, Mycobacterium tuberculosis
YLASADHAI

SEQ ID NO: 53625 - protein, 9 aa, Mycobacterium tuberculosis
LASADHAIP

SEQ ID NO: 53626 - protein, 9 aa, Mycobacterium tuberculosis
ASADHAIPV

SEQ ID NO: 53627 - protein, 9 aa, Mycobacterium tuberculosis
SADHAIPVD

SEQ ID NO: 53628 - protein, 9 aa, Mycobacterium tuberculosis
ADHAIPVDE

SEQ ID NO: 53629 - protein, 9 aa, Mycobacterium tuberculosis
DHAIPVDEI

SEQ ID NO: 53630 - protein, 9 aa, Mycobacterium tuberculosis
HAIPVDEIA

SEQ ID NO: 53631 - protein, 9 aa, Mycobacterium tuberculosis
AIPVDEIAR

SEQ ID NO: 53632 - protein, 9 aa, Mycobacterium tuberculosis
IPVDEIARC

SEQ ID NO: 53633 - protein, 9 aa, Mycobacterium tuberculosis
PVDEIARCA

SEQ ID NO: 53634 - protein, 9 aa, Mycobacterium tuberculosis
VDEIARCAT

SEQ ID NO: 53635 - protein, 9 aa, Mycobacterium tuberculosis
DEIARCATY

SEQ ID NO: 53636 - protein, 9 aa, Mycobacterium tuberculosis
EIARCATYP

SEQ ID NO: 53637 - protein, 9 aa, Mycobacterium tuberculosis
IARCATYPV

SEQ ID NO: 53638 - protein, 9 aa, Mycobacterium tuberculosis
ARCATYPVL

SEQ ID NO: 53639 - protein, 9 aa, Mycobacterium tuberculosis
RCATYPVLA

SEQ ID NO: 53640 - protein, 9 aa, Mycobacterium tuberculosis
CATYPVLAV

SEQ ID NO: 53641 - protein, 9 aa, Mycobacterium tuberculosis
ATYPVLAVQ

SEQ ID NO: 53642 - protein, 9 aa, Mycobacterium tuberculosis
TYPVLAVQA

SEQ ID NO: 53643 - protein, 9 aa, Mycobacterium tuberculosis
YPVLAVQAW

SEQ ID NO: 53644 - protein, 9 aa, Mycobacterium tuberculosis
PVLAVQAWA

SEQ ID NO: 53645 - protein, 9 aa, Mycobacterium tuberculosis
VLAVQAWAA

SEQ ID NO: 53646 - protein, 9 aa, Mycobacterium tuberculosis
LAVQAWAAF

SEQ ID NO: 53647 - protein, 9 aa, Mycobacterium tuberculosis
AVQAWAAFH

SEQ ID NO: 53648 - protein, 9 aa, Mycobacterium tuberculosis
VQAWAAFHD

SEQ ID NO: 53649 - protein, 9 aa, Mycobacterium tuberculosis
QAWAAFHDM

SEQ ID NO: 53650 - protein, 9 aa, Mycobacterium tuberculosis
AWAAFHDMT

SEQ ID NO: 53651 - protein, 9 aa, Mycobacterium tuberculosis
WAAFHDMTL

SEQ ID NO: 53652 - protein, 9 aa, Mycobacterium tuberculosis
AAFHDMTLR

SEQ ID NO: 53653 - protein, 9 aa, Mycobacterium tuberculosis
AFHDMTLRA

SEQ ID NO: 53654 - protein, 9 aa, Mycobacterium tuberculosis
FHDMTLRAV

SEQ ID NO: 53655 - protein, 9 aa, Mycobacterium tuberculosis
HDMTLRAVI

SEQ ID NO: 53656 - protein, 9 aa, Mycobacterium tuberculosis
DMTLRAVIG

SEQ ID NO: 53657 - protein, 9 aa, Mycobacterium tuberculosis
MTLRAVIGT

SEQ ID NO: 53658 - protein, 9 aa, Mycobacterium tuberculosis
TLRAVIGTA

SEQ ID NO: 53659 - protein, 9 aa, Mycobacterium tuberculosis
LRAVIGTAE

SEQ ID NO: 53660 - protein, 9 aa, Mycobacterium tuberculosis
RAVIGTAEQ

SEQ ID NO: 53661 - protein, 9 aa, Mycobacterium tuberculosis
AVIGTAEQL

SEQ ID NO: 53662 - protein, 9 aa, Mycobacterium tuberculosis
VIGTAEQLA

SEQ ID NO: 53663 - protein, 9 aa, Mycobacterium tuberculosis
IGTAEQLAS

SEQ ID NO: 53664 - protein, 9 aa, Mycobacterium tuberculosis
GTAEQLASS

SEQ ID NO: 53665 - protein, 9 aa, Mycobacterium tuberculosis
TAEQLASSD

SEQ ID NO: 53666 - protein, 9 aa, Mycobacterium tuberculosis
AEQLASSDP

SEQ ID NO: 53667 - protein, 9 aa, Mycobacterium tuberculosis
EQLASSDPG

SEQ ID NO: 53668 - protein, 9 aa, Mycobacterium tuberculosis
QLASSDPGV

SEQ ID NO: 53669 - protein, 9 aa, Mycobacterium tuberculosis
LASSDPGVA

SEQ ID NO: 53670 - protein, 9 aa, Mycobacterium tuberculosis
ASSDPGVAK

SEQ ID NO: 53671 - protein, 9 aa, Mycobacterium tuberculosis
SSDPGVAKI

SEQ ID NO: 53672 - protein, 9 aa, Mycobacterium tuberculosis
SDPGVAKIV

SEQ ID NO: 53673 - protein, 9 aa, Mycobacterium tuberculosis
DPGVAKIVL

SEQ ID NO: 53674 - protein, 9 aa, Mycobacterium tuberculosis
PGVAKIVLE

SEQ ID NO: 53675 - protein, 9 aa, Mycobacterium tuberculosis
GVAKIVLEP

SEQ ID NO: 53676 - protein, 9 aa, Mycobacterium tuberculosis
VAKIVLEPD

SEQ ID NO: 53677 - protein, 9 aa, Mycobacterium tuberculosis
AKIVLEPDD

SEQ ID NO: 53678 - protein, 9 aa, Mycobacterium tuberculosis
KIVLEPDDI

SEQ ID NO: 53679 - protein, 9 aa, Mycobacterium tuberculosis
IVLEPDDIP

SEQ ID NO: 53680 - protein, 9 aa, Mycobacterium tuberculosis
VLEPDDIPE

SEQ ID NO: 53681 - protein, 9 aa, Mycobacterium tuberculosis
LEPDDIPES

SEQ ID NO: 53682 - protein, 9 aa, Mycobacterium tuberculosis
EPDDIPESG

SEQ ID NO: 53683 - protein, 9 aa, Mycobacterium tuberculosis
PDDIPESGK

SEQ ID NO: 53684 - protein, 9 aa, Mycobacterium tuberculosis
DDIPESGKM

SEQ ID NO: 53685 - protein, 9 aa, Mycobacterium tuberculosis
DIPESGKMT

SEQ ID NO: 53686 - protein, 9 aa, Mycobacterium tuberculosis
IPESGKMTG

SEQ ID NO: 53687 - protein, 9 aa, Mycobacterium tuberculosis
PESGKMTGR

SEQ ID NO: 53688 - protein, 9 aa, Mycobacterium tuberculosis
ESGKMTGRS

SEQ ID NO: 53689 - protein, 9 aa, Mycobacterium tuberculosis
SGKMTGRSR

SEQ ID NO: 53690 - protein, 9 aa, Mycobacterium tuberculosis
GKMTGRSRL

SEQ ID NO: 53691 - protein, 9 aa, Mycobacterium tuberculosis
KMTGRSRLE

SEQ ID NO: 53692 - protein, 9 aa, Mycobacterium tuberculosis
MTGRSRLEV

SEQ ID NO: 53693 - protein, 9 aa, Mycobacterium tuberculosis
TGRSRLEVV

SEQ ID NO: 53694 - protein, 9 aa, Mycobacterium tuberculosis
GRSRLEVVD

SEQ ID NO: 53695 - protein, 9 aa, Mycobacterium tuberculosis
RSRLEVVDP

SEQ ID NO: 53696 - protein, 9 aa, Mycobacterium tuberculosis
SRLEVVDPS

SEQ ID NO: 53697 - protein, 9 aa, Mycobacterium tuberculosis
RLEVVDPSA

SEQ ID NO: 53698 - protein, 9 aa, Mycobacterium tuberculosis
LEVVDPSAA

SEQ ID NO: 53699 - protein, 9 aa, Mycobacterium tuberculosis
EVVDPSAAA

SEQ ID NO: 53700 - protein, 9 aa, Mycobacterium tuberculosis
VVDPSAAAQ

SEQ ID NO: 53701 - protein, 9 aa, Mycobacterium tuberculosis
VDPSAAAQL

SEQ ID NO: 53702 - protein, 9 aa, Mycobacterium tuberculosis
DPSAAAQLA

SEQ ID NO: 53703 - protein, 9 aa, Mycobacterium tuberculosis
PSAAAQLAD

SEQ ID NO: 53704 - protein, 9 aa, Mycobacterium tuberculosis
SAAAQLADT

SEQ ID NO: 53705 - protein, 9 aa, Mycobacterium tuberculosis
AAAQLADTT

SEQ ID NO: 53706 - protein, 9 aa, Mycobacterium tuberculosis
AAQLADTTD

SEQ ID NO: 53707 - protein, 9 aa, Mycobacterium tuberculosis
AQLADTTDQ

SEQ ID NO: 53708 - protein, 9 aa, Mycobacterium tuberculosis
QLADTTDQR

SEQ ID NO: 53709 - protein, 9 aa, Mycobacterium tuberculosis
LADTTDQRL

SEQ ID NO: 53710 - protein, 9 aa, Mycobacterium tuberculosis
ADTTDQRLL

SEQ ID NO: 53711 - protein, 9 aa, Mycobacterium tuberculosis
DTTDQRLLD

SEQ ID NO: 53712 - protein, 9 aa, Mycobacterium tuberculosis
TTDQRLLDL

SEQ ID NO: 53713 - protein, 9 aa, Mycobacterium tuberculosis
TDQRLLDLL

SEQ ID NO: 53714 - protein, 9 aa, Mycobacterium tuberculosis
DQRLLDLLP

SEQ ID NO: 53715 - protein, 9 aa, Mycobacterium tuberculosis
QRLLDLLPP

SEQ ID NO: 53716 - protein, 9 aa, Mycobacterium tuberculosis
RLLDLLPPA

SEQ ID NO: 53717 - protein, 9 aa, Mycobacterium tuberculosis
LLDLLPPAP

SEQ ID NO: 53718 - protein, 9 aa, Mycobacterium tuberculosis
LDLLPPAPV

SEQ ID NO: 53719 - protein, 9 aa, Mycobacterium tuberculosis
DLLPPAPVD

SEQ ID NO: 53720 - protein, 9 aa, Mycobacterium tuberculosis
LLPPAPVDV

SEQ ID NO: 53721 - protein, 9 aa, Mycobacterium tuberculosis
LPPAPVDVN

SEQ ID NO: 53722 - protein, 9 aa, Mycobacterium tuberculosis
PPAPVDVNP

SEQ ID NO: 53723 - protein, 9 aa, Mycobacterium tuberculosis
PAPVDVNPP

SEQ ID NO: 53724 - protein, 9 aa, Mycobacterium tuberculosis
APVDVNPPG

SEQ ID NO: 53725 - protein, 9 aa, Mycobacterium tuberculosis
PVDVNPPGD

SEQ ID NO: 53726 - protein, 9 aa, Mycobacterium tuberculosis
VDVNPPGDE

SEQ ID NO: 53727 - protein, 9 aa, Mycobacterium tuberculosis
DVNPPGDER

SEQ ID NO: 53728 - protein, 9 aa, Mycobacterium tuberculosis
VNPPGDERH

SEQ ID NO: 53729 - protein, 9 aa, Mycobacterium tuberculosis
NPPGDERHM

SEQ ID NO: 53730 - protein, 9 aa, Mycobacterium tuberculosis
PPGDERHML

SEQ ID NO: 53731 - protein, 9 aa, Mycobacterium tuberculosis
PGDERHMLW

SEQ ID NO: 53732 - protein, 9 aa, Mycobacterium tuberculosis
GDERHMLWF

SEQ ID NO: 53733 - protein, 9 aa, Mycobacterium tuberculosis
DERHMLWFE

SEQ ID NO: 53734 - protein, 9 aa, Mycobacterium tuberculosis
ERHMLWFEL

SEQ ID NO: 53735 - protein, 9 aa, Mycobacterium tuberculosis
RHMLWFELM

SEQ ID NO: 53736 - protein, 9 aa, Mycobacterium tuberculosis
HMLWFELMK

SEQ ID NO: 53737 - protein, 9 aa, Mycobacterium tuberculosis
MLWFELMKP

SEQ ID NO: 53738 - protein, 9 aa, Mycobacterium tuberculosis
LWFELMKPM

SEQ ID NO: 53739 - protein, 9 aa, Mycobacterium tuberculosis
WFELMKPMT

SEQ ID NO: 53740 - protein, 9 aa, Mycobacterium tuberculosis
FELMKPMTS

SEQ ID NO: 53741 - protein, 9 aa, Mycobacterium tuberculosis
ELMKPMTST

SEQ ID NO: 53742 - protein, 9 aa, Mycobacterium tuberculosis
LMKPMTSTA

SEQ ID NO: 53743 - protein, 9 aa, Mycobacterium tuberculosis
MKPMTSTAT

SEQ ID NO: 53744 - protein, 9 aa, Mycobacterium tuberculosis
KPMTSTATG

SEQ ID NO: 53745 - protein, 9 aa, Mycobacterium tuberculosis
PMTSTATGR

SEQ ID NO: 53746 - protein, 9 aa, Mycobacterium tuberculosis
MTSTATGRE

SEQ ID NO: 53747 - protein, 9 aa, Mycobacterium tuberculosis
TSTATGREA

SEQ ID NO: 53748 - protein, 9 aa, Mycobacterium tuberculosis
STATGREAA

SEQ ID NO: 53749 - protein, 9 aa, Mycobacterium tuberculosis
TATGREAAH

SEQ ID NO: 53750 - protein, 9 aa, Mycobacterium tuberculosis
ATGREAAHL

SEQ ID NO: 53751 - protein, 9 aa, Mycobacterium tuberculosis
TGREAAHLR

SEQ ID NO: 53752 - protein, 9 aa, Mycobacterium tuberculosis
GREAAHLRA

SEQ ID NO: 53753 - protein, 9 aa, Mycobacterium tuberculosis
REAAHLRAF

SEQ ID NO: 53754 - protein, 9 aa, Mycobacterium tuberculosis
EAAHLRAFR

SEQ ID NO: 53755 - protein, 9 aa, Mycobacterium tuberculosis
AAHLRAFRA

SEQ ID NO: 53756 - protein, 9 aa, Mycobacterium tuberculosis
AHLRAFRAY

SEQ ID NO: 53757 - protein, 9 aa, Mycobacterium tuberculosis
HLRAFRAYA

SEQ ID NO: 53758 - protein, 9 aa, Mycobacterium tuberculosis
LRAFRAYAA

SEQ ID NO: 53759 - protein, 9 aa, Mycobacterium tuberculosis
RAFRAYAAH

SEQ ID NO: 53760 - protein, 9 aa, Mycobacterium tuberculosis
AFRAYAAHS

SEQ ID NO: 53761 - protein, 9 aa, Mycobacterium tuberculosis
FRAYAAHSQ

SEQ ID NO: 53762 - protein, 9 aa, Mycobacterium tuberculosis
RAYAAHSQE

SEQ ID NO: 53763 - protein, 9 aa, Mycobacterium tuberculosis
AYAAHSQEI

SEQ ID NO: 53764 - protein, 9 aa, Mycobacterium tuberculosis
YAAHSQEIA

SEQ ID NO: 53765 - protein, 9 aa, Mycobacterium tuberculosis
AAHSQEIAL

SEQ ID NO: 53766 - protein, 9 aa, Mycobacterium tuberculosis
AHSQEIALH

SEQ ID NO: 53767 - protein, 9 aa, Mycobacterium tuberculosis
HSQEIALHQ

SEQ ID NO: 53768 - protein, 9 aa, Mycobacterium tuberculosis
SQEIALHQA

SEQ ID NO: 53769 - protein, 9 aa, Mycobacterium tuberculosis
QEIALHQAH

SEQ ID NO: 53770 - protein, 9 aa, Mycobacterium tuberculosis
EIALHQAHT

SEQ ID NO: 53771 - protein, 9 aa, Mycobacterium tuberculosis
IALHQAHTA

SEQ ID NO: 53772 - protein, 9 aa, Mycobacterium tuberculosis
ALHQAHTAT

SEQ ID NO: 53773 - protein, 9 aa, Mycobacterium tuberculosis
LHQAHTATD

SEQ ID NO: 53774 - protein, 9 aa, Mycobacterium tuberculosis
HQAHTATDA

SEQ ID NO: 53775 - protein, 9 aa, Mycobacterium tuberculosis
QAHTATDAA

SEQ ID NO: 53776 - protein, 9 aa, Mycobacterium tuberculosis
AHTATDAAV

SEQ ID NO: 53777 - protein, 9 aa, Mycobacterium tuberculosis
HTATDAAVQ

SEQ ID NO: 53778 - protein, 9 aa, Mycobacterium tuberculosis
TATDAAVQR

SEQ ID NO: 53779 - protein, 9 aa, Mycobacterium tuberculosis
ATDAAVQRV

SEQ ID NO: 53780 - protein, 9 aa, Mycobacterium tuberculosis
TDAAVQRVA

SEQ ID NO: 53781 - protein, 9 aa, Mycobacterium tuberculosis
DAAVQRVAV

SEQ ID NO: 53782 - protein, 9 aa, Mycobacterium tuberculosis
AAVQRVAVA

SEQ ID NO: 53783 - protein, 9 aa, Mycobacterium tuberculosis
AVQRVAVAD

SEQ ID NO: 53784 - protein, 9 aa, Mycobacterium tuberculosis
VQRVAVADW

SEQ ID NO: 53785 - protein, 9 aa, Mycobacterium tuberculosis
QRVAVADWL

SEQ ID NO: 53786 - protein, 9 aa, Mycobacterium tuberculosis
RVAVADWLY

SEQ ID NO: 53787 - protein, 9 aa, Mycobacterium tuberculosis
VAVADWLYW

SEQ ID NO: 53788 - protein, 9 aa, Mycobacterium tuberculosis
AVADWLYWQ

SEQ ID NO: 53789 - protein, 9 aa, Mycobacterium tuberculosis
VADWLYWQY

SEQ ID NO: 53790 - protein, 9 aa, Mycobacterium tuberculosis
ADWLYWQYV

SEQ ID NO: 53791 - protein, 9 aa, Mycobacterium tuberculosis
DWLYWQYVT

SEQ ID NO: 53792 - protein, 9 aa, Mycobacterium tuberculosis
WLYWQYVTG

SEQ ID NO: 53793 - protein, 9 aa, Mycobacterium tuberculosis
LYWQYVTGL

SEQ ID NO: 53794 - protein, 9 aa, Mycobacterium tuberculosis
YWQYVTGLL

SEQ ID NO: 53795 - protein, 9 aa, Mycobacterium tuberculosis
WQYVTGLLD

SEQ ID NO: 53796 - protein, 9 aa, Mycobacterium tuberculosis
QYVTGLLDR

SEQ ID NO: 53797 - protein, 9 aa, Mycobacterium tuberculosis
YVTGLLDRA

SEQ ID NO: 53798 - protein, 9 aa, Mycobacterium tuberculosis
VTGLLDRAL

SEQ ID NO: 53799 - protein, 9 aa, Mycobacterium tuberculosis
TGLLDRALA

SEQ ID NO: 53800 - protein, 9 aa, Mycobacterium tuberculosis
GLLDRALAA

SEQ ID NO: 53801 - protein, 9 aa, Mycobacterium tuberculosis
LLDRALAAA

SEQ ID NO: 53802 - protein, 9 aa, Mycobacterium tuberculosis
LDRALAAAC

SEQ ID NO: 53803 - protein, 10 aa, Mycobacterium tuberculosis
MSITRPTGSY

SEQ ID NO: 53804 - protein, 10 aa, Mycobacterium tuberculosis
SITRPTGSYA

SEQ ID NO: 53805 - protein, 10 aa, Mycobacterium tuberculosis
ITRPTGSYAR

SEQ ID NO: 53806 - protein, 10 aa, Mycobacterium tuberculosis
TRPTGSYARQ

SEQ ID NO: 53807 - protein, 10 aa, Mycobacterium tuberculosis
RPTGSYARQM

SEQ ID NO: 53808 - protein, 10 aa, Mycobacterium tuberculosis
PTGSYARQML

SEQ ID NO: 53809 - protein, 10 aa, Mycobacterium tuberculosis
TGSYARQMLD

SEQ ID NO: 53810 - protein, 10 aa, Mycobacterium tuberculosis
GSYARQMLDP

SEQ ID NO: 53811 - protein, 10 aa, Mycobacterium tuberculosis
SYARQMLDPG

SEQ ID NO: 53812 - protein, 10 aa, Mycobacterium tuberculosis
YARQMLDPGG

SEQ ID NO: 53813 - protein, 10 aa, Mycobacterium tuberculosis
ARQMLDPGGW

SEQ ID NO: 53814 - protein, 10 aa, Mycobacterium tuberculosis
RQMLDPGGWV

SEQ ID NO: 53815 - protein, 10 aa, Mycobacterium tuberculosis
QMLDPGGWVE

SEQ ID NO: 53816 - protein, 10 aa, Mycobacterium tuberculosis
MLDPGGWVEA

SEQ ID NO: 53817 - protein, 10 aa, Mycobacterium tuberculosis
LDPGGWVEAD

SEQ ID NO: 53818 - protein, 10 aa, Mycobacterium tuberculosis
DPGGWVEADE

SEQ ID NO: 53819 - protein, 10 aa, Mycobacterium tuberculosis
PGGWVEADED

SEQ ID NO: 53820 - protein, 10 aa, Mycobacterium tuberculosis
GGWVEADEDT

SEQ ID NO: 53821 - protein, 10 aa, Mycobacterium tuberculosis
GWVEADEDTF

SEQ ID NO: 53822 - protein, 10 aa, Mycobacterium tuberculosis
WVEADEDTFY

SEQ ID NO: 53823 - protein, 10 aa, Mycobacterium tuberculosis
VEADEDTFYD

SEQ ID NO: 53824 - protein, 10 aa, Mycobacterium tuberculosis
EADEDTFYDR

SEQ ID NO: 53825 - protein, 10 aa, Mycobacterium tuberculosis
ADEDTFYDRA

SEQ ID NO: 53826 - protein, 10 aa, Mycobacterium tuberculosis
DEDTFYDRAQ

SEQ ID NO: 53827 - protein, 10 aa, Mycobacterium tuberculosis
EDTFYDRAQE

SEQ ID NO: 53828 - protein, 10 aa, Mycobacterium tuberculosis
DTFYDRAQEY

SEQ ID NO: 53829 - protein, 10 aa, Mycobacterium tuberculosis
TFYDRAQEYS

SEQ ID NO: 53830 - protein, 10 aa, Mycobacterium tuberculosis
FYDRAQEYSQ

SEQ ID NO: 53831 - protein, 10 aa, Mycobacterium tuberculosis
YDRAQEYSQV

SEQ ID NO: 53832 - protein, 10 aa, Mycobacterium tuberculosis
DRAQEYSQVL

SEQ ID NO: 53833 - protein, 10 aa, Mycobacterium tuberculosis
RAQEYSQVLQ

SEQ ID NO: 53834 - protein, 10 aa, Mycobacterium tuberculosis
AQEYSQVLQR

SEQ ID NO: 53835 - protein, 10 aa, Mycobacterium tuberculosis
QEYSQVLQRV

SEQ ID NO: 53836 - protein, 10 aa, Mycobacterium tuberculosis
EYSQVLQRVT

SEQ ID NO: 53837 - protein, 10 aa, Mycobacterium tuberculosis
YSQVLQRVTD

SEQ ID NO: 53838 - protein, 10 aa, Mycobacterium tuberculosis
SQVLQRVTDV

SEQ ID NO: 53839 - protein, 10 aa, Mycobacterium tuberculosis
QVLQRVTDVL

SEQ ID NO: 53840 - protein, 10 aa, Mycobacterium tuberculosis
VLQRVTDVLD

SEQ ID NO: 53841 - protein, 10 aa, Mycobacterium tuberculosis
LQRVTDVLDT

SEQ ID NO: 53842 - protein, 10 aa, Mycobacterium tuberculosis
QRVTDVLDTC

SEQ ID NO: 53843 - protein, 10 aa, Mycobacterium tuberculosis
RVTDVLDTCR

SEQ ID NO: 53844 - protein, 10 aa, Mycobacterium tuberculosis
VTDVLDTCRQ

SEQ ID NO: 53845 - protein, 10 aa, Mycobacterium tuberculosis
TDVLDTCRQQ

SEQ ID NO: 53846 - protein, 10 aa, Mycobacterium tuberculosis
DVLDTCRQQK

SEQ ID NO: 53847 - protein, 10 aa, Mycobacterium tuberculosis
VLDTCRQQKG

SEQ ID NO: 53848 - protein, 10 aa, Mycobacterium tuberculosis
LDTCRQQKGH

SEQ ID NO: 53849 - protein, 10 aa, Mycobacterium tuberculosis
DTCRQQKGHV

SEQ ID NO: 53850 - protein, 10 aa, Mycobacterium tuberculosis
TCRQQKGHVF

SEQ ID NO: 53851 - protein, 10 aa, Mycobacterium tuberculosis
CRQQKGHVFE

SEQ ID NO: 53852 - protein, 10 aa, Mycobacterium tuberculosis
RQQKGHVFEG

SEQ ID NO: 53853 - protein, 10 aa, Mycobacterium tuberculosis
QQKGHVFEGG

SEQ ID NO: 53854 - protein, 10 aa, Mycobacterium tuberculosis
QKGHVFEGGL

SEQ ID NO: 53855 - protein, 10 aa, Mycobacterium tuberculosis
KGHVFEGGLW

SEQ ID NO: 53856 - protein, 10 aa, Mycobacterium tuberculosis
GHVFEGGLWS

SEQ ID NO: 53857 - protein, 10 aa, Mycobacterium tuberculosis
HVFEGGLWSG

SEQ ID NO: 53858 - protein, 10 aa, Mycobacterium tuberculosis
VFEGGLWSGG

SEQ ID NO: 53859 - protein, 10 aa, Mycobacterium tuberculosis
FEGGLWSGGA

SEQ ID NO: 53860 - protein, 10 aa, Mycobacterium tuberculosis
EGGLWSGGAA

SEQ ID NO: 53861 - protein, 10 aa, Mycobacterium tuberculosis
GGLWSGGAAN

SEQ ID NO: 53862 - protein, 10 aa, Mycobacterium tuberculosis
GLWSGGAANA

SEQ ID NO: 53863 - protein, 10 aa, Mycobacterium tuberculosis
LWSGGAANAA

SEQ ID NO: 53864 - protein, 10 aa, Mycobacterium tuberculosis
WSGGAANAAN

SEQ ID NO: 53865 - protein, 10 aa, Mycobacterium tuberculosis
SGGAANAANG

SEQ ID NO: 53866 - protein, 10 aa, Mycobacterium tuberculosis
GGAANAANGA

SEQ ID NO: 53867 - protein, 10 aa, Mycobacterium tuberculosis
GAANAANGAL

SEQ ID NO: 53868 - protein, 10 aa, Mycobacterium tuberculosis
AANAANGALG

SEQ ID NO: 53869 - protein, 10 aa, Mycobacterium tuberculosis
ANAANGALGA

SEQ ID NO: 53870 - protein, 10 aa, Mycobacterium tuberculosis
NAANGALGAN

SEQ ID NO: 53871 - protein, 10 aa, Mycobacterium tuberculosis
AANGALGANI

SEQ ID NO: 53872 - protein, 10 aa, Mycobacterium tuberculosis
ANGALGANIN

SEQ ID NO: 53873 - protein, 10 aa, Mycobacterium tuberculosis
NGALGANINQ

SEQ ID NO: 53874 - protein, 10 aa, Mycobacterium tuberculosis
GALGANINQL

SEQ ID NO: 53875 - protein, 10 aa, Mycobacterium tuberculosis
ALGANINQLM

SEQ ID NO: 53876 - protein, 10 aa, Mycobacterium tuberculosis
LGANINQLMT

SEQ ID NO: 53877 - protein, 10 aa, Mycobacterium tuberculosis
GANINQLMTL

SEQ ID NO: 53878 - protein, 10 aa, Mycobacterium tuberculosis
ANINQLMTLQ

SEQ ID NO: 53879 - protein, 10 aa, Mycobacterium tuberculosis
NINQLMTLQD

SEQ ID NO: 53880 - protein, 10 aa, Mycobacterium tuberculosis
INQLMTLQDY

SEQ ID NO: 53881 - protein, 10 aa, Mycobacterium tuberculosis
NQLMTLQDYL

SEQ ID NO: 53882 - protein, 10 aa, Mycobacterium tuberculosis
QLMTLQDYLA

SEQ ID NO: 53883 - protein, 10 aa, Mycobacterium tuberculosis
LMTLQDYLAT

SEQ ID NO: 53884 - protein, 10 aa, Mycobacterium tuberculosis
MTLQDYLATV

SEQ ID NO: 53885 - protein, 10 aa, Mycobacterium tuberculosis
TLQDYLATVI

SEQ ID NO: 53886 - protein, 10 aa, Mycobacterium tuberculosis
LQDYLATVIT

SEQ ID NO: 53887 - protein, 10 aa, Mycobacterium tuberculosis
QDYLATVITW

SEQ ID NO: 53888 - protein, 10 aa, Mycobacterium tuberculosis
DYLATVITWH

SEQ ID NO: 53889 - protein, 10 aa, Mycobacterium tuberculosis
YLATVITWHR

SEQ ID NO: 53890 - protein, 10 aa, Mycobacterium tuberculosis
LATVITWHRH

SEQ ID NO: 53891 - protein, 10 aa, Mycobacterium tuberculosis
ATVITWHRHI

SEQ ID NO: 53892 - protein, 10 aa, Mycobacterium tuberculosis
TVITWHRHIA

SEQ ID NO: 53893 - protein, 10 aa, Mycobacterium tuberculosis
VITWHRHIAG

SEQ ID NO: 53894 - protein, 10 aa, Mycobacterium tuberculosis
ITWHRHIAGL

SEQ ID NO: 53895 - protein, 10 aa, Mycobacterium tuberculosis
TWHRHIAGLI

SEQ ID NO: 53896 - protein, 10 aa, Mycobacterium tuberculosis
WHRHIAGLIE

SEQ ID NO: 53897 - protein, 10 aa, Mycobacterium tuberculosis
HRHIAGLIEQ

SEQ ID NO: 53898 - protein, 10 aa, Mycobacterium tuberculosis
RHIAGLIEQA

SEQ ID NO: 53899 - protein, 10 aa, Mycobacterium tuberculosis
HIAGLIEQAK

SEQ ID NO: 53900 - protein, 10 aa, Mycobacterium tuberculosis
IAGLIEQAKS

SEQ ID NO: 53901 - protein, 10 aa, Mycobacterium tuberculosis
AGLIEQAKSD

SEQ ID NO: 53902 - protein, 10 aa, Mycobacterium tuberculosis
GLIEQAKSDI

SEQ ID NO: 53903 - protein, 10 aa, Mycobacterium tuberculosis
LIEQAKSDIG

SEQ ID NO: 53904 - protein, 10 aa, Mycobacterium tuberculosis
IEQAKSDIGN

SEQ ID NO: 53905 - protein, 10 aa, Mycobacterium tuberculosis
EQAKSDIGNN

SEQ ID NO: 53906 - protein, 10 aa, Mycobacterium tuberculosis
QAKSDIGNNV

SEQ ID NO: 53907 - protein, 10 aa, Mycobacterium tuberculosis
AKSDIGNNVD

SEQ ID NO: 53908 - protein, 10 aa, Mycobacterium tuberculosis
KSDIGNNVDG

SEQ ID NO: 53909 - protein, 10 aa, Mycobacterium tuberculosis
SDIGNNVDGA

SEQ ID NO: 53910 - protein, 10 aa, Mycobacterium tuberculosis
DIGNNVDGAQ

SEQ ID NO: 53911 - protein, 10 aa, Mycobacterium tuberculosis
IGNNVDGAQR

SEQ ID NO: 53912 - protein, 10 aa, Mycobacterium tuberculosis
GNNVDGAQRE

SEQ ID NO: 53913 - protein, 10 aa, Mycobacterium tuberculosis
NNVDGAQREI

SEQ ID NO: 53914 - protein, 10 aa, Mycobacterium tuberculosis
NVDGAQREID

SEQ ID NO: 53915 - protein, 10 aa, Mycobacterium tuberculosis
VDGAQREIDI

SEQ ID NO: 53916 - protein, 10 aa, Mycobacterium tuberculosis
DGAQREIDIL

SEQ ID NO: 53917 - protein, 10 aa, Mycobacterium tuberculosis
GAQREIDILE

SEQ ID NO: 53918 - protein, 10 aa, Mycobacterium tuberculosis
AQREIDILEN

SEQ ID NO: 53919 - protein, 10 aa, Mycobacterium tuberculosis
QREIDILEND

SEQ ID NO: 53920 - protein, 10 aa, Mycobacterium tuberculosis
REIDILENDP

SEQ ID NO: 53921 - protein, 10 aa, Mycobacterium tuberculosis
EIDILENDPS

SEQ ID NO: 53922 - protein, 10 aa, Mycobacterium tuberculosis
IDILENDPSL

SEQ ID NO: 53923 - protein, 10 aa, Mycobacterium tuberculosis
DILENDPSLD

SEQ ID NO: 53924 - protein, 10 aa, Mycobacterium tuberculosis
ILENDPSLDA

SEQ ID NO: 53925 - protein, 10 aa, Mycobacterium tuberculosis
LENDPSLDAD

SEQ ID NO: 53926 - protein, 10 aa, Mycobacterium tuberculosis
ENDPSLDADE

SEQ ID NO: 53927 - protein, 10 aa, Mycobacterium tuberculosis
NDPSLDADER

SEQ ID NO: 53928 - protein, 10 aa, Mycobacterium tuberculosis
DPSLDADERH

SEQ ID NO: 53929 - protein, 10 aa, Mycobacterium tuberculosis
PSLDADERHT

SEQ ID NO: 53930 - protein, 10 aa, Mycobacterium tuberculosis
SLDADERHTA

SEQ ID NO: 53931 - protein, 10 aa, Mycobacterium tuberculosis
LDADERHTAI

SEQ ID NO: 53932 - protein, 10 aa, Mycobacterium tuberculosis
DADERHTAIN

SEQ ID NO: 53933 - protein, 10 aa, Mycobacterium tuberculosis
ADERHTAINS

SEQ ID NO: 53934 - protein, 10 aa, Mycobacterium tuberculosis
DERHTAINSL

SEQ ID NO: 53935 - protein, 10 aa, Mycobacterium tuberculosis
ERHTAINSLV

SEQ ID NO: 53936 - protein, 10 aa, Mycobacterium tuberculosis
RHTAINSLVT

SEQ ID NO: 53937 - protein, 10 aa, Mycobacterium tuberculosis
HTAINSLVTA

SEQ ID NO: 53938 - protein, 10 aa, Mycobacterium tuberculosis
TAINSLVTAT

SEQ ID NO: 53939 - protein, 10 aa, Mycobacterium tuberculosis
AINSLVTATH

SEQ ID NO: 53940 - protein, 10 aa, Mycobacterium tuberculosis
INSLVTATHG

SEQ ID NO: 53941 - protein, 10 aa, Mycobacterium tuberculosis
NSLVTATHGA

SEQ ID NO: 53942 - protein, 10 aa, Mycobacterium tuberculosis
SLVTATHGAN

SEQ ID NO: 53943 - protein, 10 aa, Mycobacterium tuberculosis
LVTATHGANV

SEQ ID NO: 53944 - protein, 10 aa, Mycobacterium tuberculosis
VTATHGANVS

SEQ ID NO: 53945 - protein, 10 aa, Mycobacterium tuberculosis
TATHGANVSL

SEQ ID NO: 53946 - protein, 10 aa, Mycobacterium tuberculosis
ATHGANVSLV

SEQ ID NO: 53947 - protein, 10 aa, Mycobacterium tuberculosis
THGANVSLVA

SEQ ID NO: 53948 - protein, 10 aa, Mycobacterium tuberculosis
HGANVSLVAE

SEQ ID NO: 53949 - protein, 10 aa, Mycobacterium tuberculosis
GANVSLVAET

SEQ ID NO: 53950 - protein, 10 aa, Mycobacterium tuberculosis
ANVSLVAETA

SEQ ID NO: 53951 - protein, 10 aa, Mycobacterium tuberculosis
NVSLVAETAE

SEQ ID NO: 53952 - protein, 10 aa, Mycobacterium tuberculosis
VSLVAETAER

SEQ ID NO: 53953 - protein, 10 aa, Mycobacterium tuberculosis
SLVAETAERV

SEQ ID NO: 53954 - protein, 10 aa, Mycobacterium tuberculosis
LVAETAERVL

SEQ ID NO: 53955 - protein, 10 aa, Mycobacterium tuberculosis
VAETAERVLE

SEQ ID NO: 53956 - protein, 10 aa, Mycobacterium tuberculosis
AETAERVLES

SEQ ID NO: 53957 - protein, 10 aa, Mycobacterium tuberculosis
ETAERVLESK

SEQ ID NO: 53958 - protein, 10 aa, Mycobacterium tuberculosis
TAERVLESKN

SEQ ID NO: 53959 - protein, 10 aa, Mycobacterium tuberculosis
AERVLESKNW

SEQ ID NO: 53960 - protein, 10 aa, Mycobacterium tuberculosis
ERVLESKNWK

SEQ ID NO: 53961 - protein, 10 aa, Mycobacterium tuberculosis
RVLESKNWKP

SEQ ID NO: 53962 - protein, 10 aa, Mycobacterium tuberculosis
VLESKNWKPP

SEQ ID NO: 53963 - protein, 10 aa, Mycobacterium tuberculosis
LESKNWKPPK

SEQ ID NO: 53964 - protein, 10 aa, Mycobacterium tuberculosis
ESKNWKPPKN

SEQ ID NO: 53965 - protein, 10 aa, Mycobacterium tuberculosis
SKNWKPPKNA

SEQ ID NO: 53966 - protein, 10 aa, Mycobacterium tuberculosis
KNWKPPKNAL

SEQ ID NO: 53967 - protein, 10 aa, Mycobacterium tuberculosis
NWKPPKNALE

SEQ ID NO: 53968 - protein, 10 aa, Mycobacterium tuberculosis
WKPPKNALED

SEQ ID NO: 53969 - protein, 10 aa, Mycobacterium tuberculosis
KPPKNALEDL

SEQ ID NO: 53970 - protein, 10 aa, Mycobacterium tuberculosis
PPKNALEDLL

SEQ ID NO: 53971 - protein, 10 aa, Mycobacterium tuberculosis
PKNALEDLLQ

SEQ ID NO: 53972 - protein, 10 aa, Mycobacterium tuberculosis
KNALEDLLQQ

SEQ ID NO: 53973 - protein, 10 aa, Mycobacterium tuberculosis
NALEDLLQQK

SEQ ID NO: 53974 - protein, 10 aa, Mycobacterium tuberculosis
ALEDLLQQKS

SEQ ID NO: 53975 - protein, 10 aa, Mycobacterium tuberculosis
LEDLLQQKSP

SEQ ID NO: 53976 - protein, 10 aa, Mycobacterium tuberculosis
EDLLQQKSPP

SEQ ID NO: 53977 - protein, 10 aa, Mycobacterium tuberculosis
DLLQQKSPPP

SEQ ID NO: 53978 - protein, 10 aa, Mycobacterium tuberculosis
LLQQKSPPPP

SEQ ID NO: 53979 - protein, 10 aa, Mycobacterium tuberculosis
LQQKSPPPPD

SEQ ID NO: 53980 - protein, 10 aa, Mycobacterium tuberculosis
QQKSPPPPDV

SEQ ID NO: 53981 - protein, 10 aa, Mycobacterium tuberculosis
QKSPPPPDVP

SEQ ID NO: 53982 - protein, 10 aa, Mycobacterium tuberculosis
KSPPPPDVPT

SEQ ID NO: 53983 - protein, 10 aa, Mycobacterium tuberculosis
SPPPPDVPTL

SEQ ID NO: 53984 - protein, 10 aa, Mycobacterium tuberculosis
PPPPDVPTLV

SEQ ID NO: 53985 - protein, 10 aa, Mycobacterium tuberculosis
PPPDVPTLVV

SEQ ID NO: 53986 - protein, 10 aa, Mycobacterium tuberculosis
PPDVPTLVVP

SEQ ID NO: 53987 - protein, 10 aa, Mycobacterium tuberculosis
PDVPTLVVPS

SEQ ID NO: 53988 - protein, 10 aa, Mycobacterium tuberculosis
DVPTLVVPSP

SEQ ID NO: 53989 - protein, 10 aa, Mycobacterium tuberculosis
VPTLVVPSPG

SEQ ID NO: 53990 - protein, 10 aa, Mycobacterium tuberculosis
PTLVVPSPGT

SEQ ID NO: 53991 - protein, 10 aa, Mycobacterium tuberculosis
TLVVPSPGTP

SEQ ID NO: 53992 - protein, 10 aa, Mycobacterium tuberculosis
LVVPSPGTPG

SEQ ID NO: 53993 - protein, 10 aa, Mycobacterium tuberculosis
VVPSPGTPGT

SEQ ID NO: 53994 - protein, 10 aa, Mycobacterium tuberculosis
VPSPGTPGTP

SEQ ID NO: 53995 - protein, 10 aa, Mycobacterium tuberculosis
PSPGTPGTPG

SEQ ID NO: 53996 - protein, 10 aa, Mycobacterium tuberculosis
SPGTPGTPGT

SEQ ID NO: 53997 - protein, 10 aa, Mycobacterium tuberculosis
PGTPGTPGTP

SEQ ID NO: 53998 - protein, 10 aa, Mycobacterium tuberculosis
GTPGTPGTPI

SEQ ID NO: 53999 - protein, 10 aa, Mycobacterium tuberculosis
TPGTPGTPIT

SEQ ID NO: 54000 - protein, 10 aa, Mycobacterium tuberculosis
PGTPGTPITP

SEQ ID NO: 54001 - protein, 10 aa, Mycobacterium tuberculosis
GTPGTPITPG

SEQ ID NO: 54002 - protein, 10 aa, Mycobacterium tuberculosis
TPGTPITPGT

SEQ ID NO: 54003 - protein, 10 aa, Mycobacterium tuberculosis
PGTPITPGTP

SEQ ID NO: 54004 - protein, 10 aa, Mycobacterium tuberculosis
GTPITPGTPI

SEQ ID NO: 54005 - protein, 10 aa, Mycobacterium tuberculosis
TPITPGTPIT

SEQ ID NO: 54006 - protein, 10 aa, Mycobacterium tuberculosis
PITPGTPITP

SEQ ID NO: 54007 - protein, 10 aa, Mycobacterium tuberculosis
ITPGTPITPG

SEQ ID NO: 54008 - protein, 10 aa, Mycobacterium tuberculosis
TPGTPITPGT

SEQ ID NO: 54009 - protein, 10 aa, Mycobacterium tuberculosis
PGTPITPGTP

SEQ ID NO: 54010 - protein, 10 aa, Mycobacterium tuberculosis
GTPITPGTPI

SEQ ID NO: 54011 - protein, 10 aa, Mycobacterium tuberculosis
TPITPGTPIT

SEQ ID NO: 54012 - protein, 10 aa, Mycobacterium tuberculosis
PITPGTPITP

SEQ ID NO: 54013 - protein, 10 aa, Mycobacterium tuberculosis
ITPGTPITPI

SEQ ID NO: 54014 - protein, 10 aa, Mycobacterium tuberculosis
TPGTPITPIP

SEQ ID NO: 54015 - protein, 10 aa, Mycobacterium tuberculosis
PGTPITPIPG

SEQ ID NO: 54016 - protein, 10 aa, Mycobacterium tuberculosis
GTPITPIPGA

SEQ ID NO: 54017 - protein, 10 aa, Mycobacterium tuberculosis
TPITPIPGAP

SEQ ID NO: 54018 - protein, 10 aa, Mycobacterium tuberculosis
PITPIPGAPV

SEQ ID NO: 54019 - protein, 10 aa, Mycobacterium tuberculosis
ITPIPGAPVT

SEQ ID NO: 54020 - protein, 10 aa, Mycobacterium tuberculosis
TPIPGAPVTP

SEQ ID NO: 54021 - protein, 10 aa, Mycobacterium tuberculosis
PIPGAPVTPI

SEQ ID NO: 54022 - protein, 10 aa, Mycobacterium tuberculosis
IPGAPVTPIT

SEQ ID NO: 54023 - protein, 10 aa, Mycobacterium tuberculosis
PGAPVTPITP

SEQ ID NO: 54024 - protein, 10 aa, Mycobacterium tuberculosis
GAPVTPITPT

SEQ ID NO: 54025 - protein, 10 aa, Mycobacterium tuberculosis
APVTPITPTP

SEQ ID NO: 54026 - protein, 10 aa, Mycobacterium tuberculosis
PVTPITPTPG

SEQ ID NO: 54027 - protein, 10 aa, Mycobacterium tuberculosis
VTPITPTPGT

SEQ ID NO: 54028 - protein, 10 aa, Mycobacterium tuberculosis
TPITPTPGTP

SEQ ID NO: 54029 - protein, 10 aa, Mycobacterium tuberculosis
PITPTPGTPV

SEQ ID NO: 54030 - protein, 10 aa, Mycobacterium tuberculosis
ITPTPGTPVT

SEQ ID NO: 54031 - protein, 10 aa, Mycobacterium tuberculosis
TPTPGTPVTP

SEQ ID NO: 54032 - protein, 10 aa, Mycobacterium tuberculosis
PTPGTPVTPV

SEQ ID NO: 54033 - protein, 10 aa, Mycobacterium tuberculosis
TPGTPVTPVT

SEQ ID NO: 54034 - protein, 10 aa, Mycobacterium tuberculosis
PGTPVTPVTP

SEQ ID NO: 54035 - protein, 10 aa, Mycobacterium tuberculosis
GTPVTPVTPG

SEQ ID NO: 54036 - protein, 10 aa, Mycobacterium tuberculosis
TPVTPVTPGK

SEQ ID NO: 54037 - protein, 10 aa, Mycobacterium tuberculosis
PVTPVTPGKP

SEQ ID NO: 54038 - protein, 10 aa, Mycobacterium tuberculosis
VTPVTPGKPV

SEQ ID NO: 54039 - protein, 10 aa, Mycobacterium tuberculosis
TPVTPGKPVT

SEQ ID NO: 54040 - protein, 10 aa, Mycobacterium tuberculosis
PVTPGKPVTP

SEQ ID NO: 54041 - protein, 10 aa, Mycobacterium tuberculosis
VTPGKPVTPV

SEQ ID NO: 54042 - protein, 10 aa, Mycobacterium tuberculosis
TPGKPVTPVT

SEQ ID NO: 54043 - protein, 10 aa, Mycobacterium tuberculosis
PGKPVTPVTP

SEQ ID NO: 54044 - protein, 10 aa, Mycobacterium tuberculosis
GKPVTPVTPV

SEQ ID NO: 54045 - protein, 10 aa, Mycobacterium tuberculosis
KPVTPVTPVK

SEQ ID NO: 54046 - protein, 10 aa, Mycobacterium tuberculosis
PVTPVTPVKP

SEQ ID NO: 54047 - protein, 10 aa, Mycobacterium tuberculosis
VTPVTPVKPG

SEQ ID NO: 54048 - protein, 10 aa, Mycobacterium tuberculosis
TPVTPVKPGT

SEQ ID NO: 54049 - protein, 10 aa, Mycobacterium tuberculosis
PVTPVKPGTP

SEQ ID NO: 54050 - protein, 10 aa, Mycobacterium tuberculosis
VTPVKPGTPG

SEQ ID NO: 54051 - protein, 10 aa, Mycobacterium tuberculosis
TPVKPGTPGE

SEQ ID NO: 54052 - protein, 10 aa, Mycobacterium tuberculosis
PVKPGTPGEP

SEQ ID NO: 54053 - protein, 10 aa, Mycobacterium tuberculosis
VKPGTPGEPT

SEQ ID NO: 54054 - protein, 10 aa, Mycobacterium tuberculosis
KPGTPGEPTP

SEQ ID NO: 54055 - protein, 10 aa, Mycobacterium tuberculosis
PGTPGEPTPI

SEQ ID NO: 54056 - protein, 10 aa, Mycobacterium tuberculosis
GTPGEPTPIT

SEQ ID NO: 54057 - protein, 10 aa, Mycobacterium tuberculosis
TPGEPTPITP

SEQ ID NO: 54058 - protein, 10 aa, Mycobacterium tuberculosis
PGEPTPITPV

SEQ ID NO: 54059 - protein, 10 aa, Mycobacterium tuberculosis
GEPTPITPVT

SEQ ID NO: 54060 - protein, 10 aa, Mycobacterium tuberculosis
EPTPITPVTP

SEQ ID NO: 54061 - protein, 10 aa, Mycobacterium tuberculosis
PTPITPVTPP

SEQ ID NO: 54062 - protein, 10 aa, Mycobacterium tuberculosis
TPITPVTPPV

SEQ ID NO: 54063 - protein, 10 aa, Mycobacterium tuberculosis
PITPVTPPVA

SEQ ID NO: 54064 - protein, 10 aa, Mycobacterium tuberculosis
ITPVTPPVAP

SEQ ID NO: 54065 - protein, 10 aa, Mycobacterium tuberculosis
TPVTPPVAPA

SEQ ID NO: 54066 - protein, 10 aa, Mycobacterium tuberculosis
PVTPPVAPAT

SEQ ID NO: 54067 - protein, 10 aa, Mycobacterium tuberculosis
VTPPVAPATP

SEQ ID NO: 54068 - protein, 10 aa, Mycobacterium tuberculosis
TPPVAPATPA

SEQ ID NO: 54069 - protein, 10 aa, Mycobacterium tuberculosis
PPVAPATPAT

SEQ ID NO: 54070 - protein, 10 aa, Mycobacterium tuberculosis
PVAPATPATP

SEQ ID NO: 54071 - protein, 10 aa, Mycobacterium tuberculosis
VAPATPATPA

SEQ ID NO: 54072 - protein, 10 aa, Mycobacterium tuberculosis
APATPATPAT

SEQ ID NO: 54073 - protein, 10 aa, Mycobacterium tuberculosis
PATPATPATP

SEQ ID NO: 54074 - protein, 10 aa, Mycobacterium tuberculosis
ATPATPATPV

SEQ ID NO: 54075 - protein, 10 aa, Mycobacterium tuberculosis
TPATPATPVT

SEQ ID NO: 54076 - protein, 10 aa, Mycobacterium tuberculosis
PATPATPVTP

SEQ ID NO: 54077 - protein, 10 aa, Mycobacterium tuberculosis
ATPATPVTPA

SEQ ID NO: 54078 - protein, 10 aa, Mycobacterium tuberculosis
TPATPVTPAP

SEQ ID NO: 54079 - protein, 10 aa, Mycobacterium tuberculosis
PATPVTPAPA

SEQ ID NO: 54080 - protein, 10 aa, Mycobacterium tuberculosis
ATPVTPAPAP

SEQ ID NO: 54081 - protein, 10 aa, Mycobacterium tuberculosis
TPVTPAPAPH

SEQ ID NO: 54082 - protein, 10 aa, Mycobacterium tuberculosis
PVTPAPAPHP

SEQ ID NO: 54083 - protein, 10 aa, Mycobacterium tuberculosis
VTPAPAPHPQ

SEQ ID NO: 54084 - protein, 10 aa, Mycobacterium tuberculosis
TPAPAPHPQP

SEQ ID NO: 54085 - protein, 10 aa, Mycobacterium tuberculosis
PAPAPHPQPA

SEQ ID NO: 54086 - protein, 10 aa, Mycobacterium tuberculosis
APAPHPQPAP

SEQ ID NO: 54087 - protein, 10 aa, Mycobacterium tuberculosis
PAPHPQPAPA

SEQ ID NO: 54088 - protein, 10 aa, Mycobacterium tuberculosis
APHPQPAPAP

SEQ ID NO: 54089 - protein, 10 aa, Mycobacterium tuberculosis
PHPQPAPAPA

SEQ ID NO: 54090 - protein, 10 aa, Mycobacterium tuberculosis
HPQPAPAPAP

SEQ ID NO: 54091 - protein, 10 aa, Mycobacterium tuberculosis
PQPAPAPAPS

SEQ ID NO: 54092 - protein, 10 aa, Mycobacterium tuberculosis
QPAPAPAPSP

SEQ ID NO: 54093 - protein, 10 aa, Mycobacterium tuberculosis
PAPAPAPSPG

SEQ ID NO: 54094 - protein, 10 aa, Mycobacterium tuberculosis
APAPAPSPGP

SEQ ID NO: 54095 - protein, 10 aa, Mycobacterium tuberculosis
PAPAPSPGPQ

SEQ ID NO: 54096 - protein, 10 aa, Mycobacterium tuberculosis
APAPSPGPQP

SEQ ID NO: 54097 - protein, 10 aa, Mycobacterium tuberculosis
PAPSPGPQPV

SEQ ID NO: 54098 - protein, 10 aa, Mycobacterium tuberculosis
APSPGPQPVT

SEQ ID NO: 54099 - protein, 10 aa, Mycobacterium tuberculosis
PSPGPQPVTP

SEQ ID NO: 54100 - protein, 10 aa, Mycobacterium tuberculosis
SPGPQPVTPA

SEQ ID NO: 54101 - protein, 10 aa, Mycobacterium tuberculosis
PGPQPVTPAT

SEQ ID NO: 54102 - protein, 10 aa, Mycobacterium tuberculosis
GPQPVTPATP

SEQ ID NO: 54103 - protein, 10 aa, Mycobacterium tuberculosis
PQPVTPATPG

SEQ ID NO: 54104 - protein, 10 aa, Mycobacterium tuberculosis
QPVTPATPGP

SEQ ID NO: 54105 - protein, 10 aa, Mycobacterium tuberculosis
PVTPATPGPS

SEQ ID NO: 54106 - protein, 10 aa, Mycobacterium tuberculosis
VTPATPGPSG

SEQ ID NO: 54107 - protein, 10 aa, Mycobacterium tuberculosis
TPATPGPSGP

SEQ ID NO: 54108 - protein, 10 aa, Mycobacterium tuberculosis
PATPGPSGPA

SEQ ID NO: 54109 - protein, 10 aa, Mycobacterium tuberculosis
ATPGPSGPAT

SEQ ID NO: 54110 - protein, 10 aa, Mycobacterium tuberculosis
TPGPSGPATP

SEQ ID NO: 54111 - protein, 10 aa, Mycobacterium tuberculosis
PGPSGPATPG

SEQ ID NO: 54112 - protein, 10 aa, Mycobacterium tuberculosis
GPSGPATPGT

SEQ ID NO: 54113 - protein, 10 aa, Mycobacterium tuberculosis
PSGPATPGTP

SEQ ID NO: 54114 - protein, 10 aa, Mycobacterium tuberculosis
SGPATPGTPG

SEQ ID NO: 54115 - protein, 10 aa, Mycobacterium tuberculosis
GPATPGTPGG

SEQ ID NO: 54116 - protein, 10 aa, Mycobacterium tuberculosis
PATPGTPGGE

SEQ ID NO: 54117 - protein, 10 aa, Mycobacterium tuberculosis
ATPGTPGGEP

SEQ ID NO: 54118 - protein, 10 aa, Mycobacterium tuberculosis
TPGTPGGEPA

SEQ ID NO: 54119 - protein, 10 aa, Mycobacterium tuberculosis
PGTPGGEPAP

SEQ ID NO: 54120 - protein, 10 aa, Mycobacterium tuberculosis
GTPGGEPAPH

SEQ ID NO: 54121 - protein, 10 aa, Mycobacterium tuberculosis
TPGGEPAPHV

SEQ ID NO: 54122 - protein, 10 aa, Mycobacterium tuberculosis
PGGEPAPHVK

SEQ ID NO: 54123 - protein, 10 aa, Mycobacterium tuberculosis
GGEPAPHVKP

SEQ ID NO: 54124 - protein, 10 aa, Mycobacterium tuberculosis
GEPAPHVKPA

SEQ ID NO: 54125 - protein, 10 aa, Mycobacterium tuberculosis
EPAPHVKPAA

SEQ ID NO: 54126 - protein, 10 aa, Mycobacterium tuberculosis
PAPHVKPAAL

SEQ ID NO: 54127 - protein, 10 aa, Mycobacterium tuberculosis
APHVKPAALA

SEQ ID NO: 54128 - protein, 10 aa, Mycobacterium tuberculosis
PHVKPAALAE

SEQ ID NO: 54129 - protein, 10 aa, Mycobacterium tuberculosis
HVKPAALAEQ

SEQ ID NO: 54130 - protein, 10 aa, Mycobacterium tuberculosis
VKPAALAEQP

SEQ ID NO: 54131 - protein, 10 aa, Mycobacterium tuberculosis
KPAALAEQPG

SEQ ID NO: 54132 - protein, 10 aa, Mycobacterium tuberculosis
PAALAEQPGV

SEQ ID NO: 54133 - protein, 10 aa, Mycobacterium tuberculosis
AALAEQPGVP

SEQ ID NO: 54134 - protein, 10 aa, Mycobacterium tuberculosis
ALAEQPGVPG

SEQ ID NO: 54135 - protein, 10 aa, Mycobacterium tuberculosis
LAEQPGVPGQ

SEQ ID NO: 54136 - protein, 10 aa, Mycobacterium tuberculosis
AEQPGVPGQH

SEQ ID NO: 54137 - protein, 10 aa, Mycobacterium tuberculosis
EQPGVPGQHA

SEQ ID NO: 54138 - protein, 10 aa, Mycobacterium tuberculosis
QPGVPGQHAG

SEQ ID NO: 54139 - protein, 10 aa, Mycobacterium tuberculosis
PGVPGQHAGG

SEQ ID NO: 54140 - protein, 10 aa, Mycobacterium tuberculosis
GVPGQHAGGG

SEQ ID NO: 54141 - protein, 10 aa, Mycobacterium tuberculosis
VPGQHAGGGT

SEQ ID NO: 54142 - protein, 10 aa, Mycobacterium tuberculosis
PGQHAGGGTQ

SEQ ID NO: 54143 - protein, 10 aa, Mycobacterium tuberculosis
GQHAGGGTQS

SEQ ID NO: 54144 - protein, 10 aa, Mycobacterium tuberculosis
QHAGGGTQSG

SEQ ID NO: 54145 - protein, 10 aa, Mycobacterium tuberculosis
HAGGGTQSGP

SEQ ID NO: 54146 - protein, 10 aa, Mycobacterium tuberculosis
AGGGTQSGPA

SEQ ID NO: 54147 - protein, 10 aa, Mycobacterium tuberculosis
GGGTQSGPAH

SEQ ID NO: 54148 - protein, 10 aa, Mycobacterium tuberculosis
GGTQSGPAHA

SEQ ID NO: 54149 - protein, 10 aa, Mycobacterium tuberculosis
GTQSGPAHAD

SEQ ID NO: 54150 - protein, 10 aa, Mycobacterium tuberculosis
TQSGPAHADE

SEQ ID NO: 54151 - protein, 10 aa, Mycobacterium tuberculosis
QSGPAHADES

SEQ ID NO: 54152 - protein, 10 aa, Mycobacterium tuberculosis
SGPAHADESA

SEQ ID NO: 54153 - protein, 10 aa, Mycobacterium tuberculosis
GPAHADESAA

SEQ ID NO: 54154 - protein, 10 aa, Mycobacterium tuberculosis
PAHADESAAS

SEQ ID NO: 54155 - protein, 10 aa, Mycobacterium tuberculosis
AHADESAASV

SEQ ID NO: 54156 - protein, 10 aa, Mycobacterium tuberculosis
HADESAASVT

SEQ ID NO: 54157 - protein, 10 aa, Mycobacterium tuberculosis
ADESAASVTP

SEQ ID NO: 54158 - protein, 10 aa, Mycobacterium tuberculosis
DESAASVTPA

SEQ ID NO: 54159 - protein, 10 aa, Mycobacterium tuberculosis
ESAASVTPAA

SEQ ID NO: 54160 - protein, 10 aa, Mycobacterium tuberculosis
SAASVTPAAA

SEQ ID NO: 54161 - protein, 10 aa, Mycobacterium tuberculosis
AASVTPAAAS

SEQ ID NO: 54162 - protein, 10 aa, Mycobacterium tuberculosis
ASVTPAAASG

SEQ ID NO: 54163 - protein, 10 aa, Mycobacterium tuberculosis
SVTPAAASGV

SEQ ID NO: 54164 - protein, 10 aa, Mycobacterium tuberculosis
VTPAAASGVP

SEQ ID NO: 54165 - protein, 10 aa, Mycobacterium tuberculosis
TPAAASGVPG

SEQ ID NO: 54166 - protein, 10 aa, Mycobacterium tuberculosis
PAAASGVPGA

SEQ ID NO: 54167 - protein, 10 aa, Mycobacterium tuberculosis
AAASGVPGAR

SEQ ID NO: 54168 - protein, 10 aa, Mycobacterium tuberculosis
AASGVPGARA

SEQ ID NO: 54169 - protein, 10 aa, Mycobacterium tuberculosis
ASGVPGARAA

SEQ ID NO: 54170 - protein, 10 aa, Mycobacterium tuberculosis
SGVPGARAAA

SEQ ID NO: 54171 - protein, 10 aa, Mycobacterium tuberculosis
GVPGARAAAA

SEQ ID NO: 54172 - protein, 10 aa, Mycobacterium tuberculosis
VPGARAAAAA

SEQ ID NO: 54173 - protein, 10 aa, Mycobacterium tuberculosis
PGARAAAAAP

SEQ ID NO: 54174 - protein, 10 aa, Mycobacterium tuberculosis
GARAAAAAPS

SEQ ID NO: 54175 - protein, 10 aa, Mycobacterium tuberculosis
ARAAAAAPSG

SEQ ID NO: 54176 - protein, 10 aa, Mycobacterium tuberculosis
RAAAAAPSGT

SEQ ID NO: 54177 - protein, 10 aa, Mycobacterium tuberculosis
AAAAAPSGTA

SEQ ID NO: 54178 - protein, 10 aa, Mycobacterium tuberculosis
AAAAPSGTAV

SEQ ID NO: 54179 - protein, 10 aa, Mycobacterium tuberculosis
AAAPSGTAVG

SEQ ID NO: 54180 - protein, 10 aa, Mycobacterium tuberculosis
AAPSGTAVGA

SEQ ID NO: 54181 - protein, 10 aa, Mycobacterium tuberculosis
APSGTAVGAG

SEQ ID NO: 54182 - protein, 10 aa, Mycobacterium tuberculosis
PSGTAVGAGA

SEQ ID NO: 54183 - protein, 10 aa, Mycobacterium tuberculosis
SGTAVGAGAR

SEQ ID NO: 54184 - protein, 10 aa, Mycobacterium tuberculosis
GTAVGAGARS

SEQ ID NO: 54185 - protein, 10 aa, Mycobacterium tuberculosis
TAVGAGARSS

SEQ ID NO: 54186 - protein, 10 aa, Mycobacterium tuberculosis
AVGAGARSSV

SEQ ID NO: 54187 - protein, 10 aa, Mycobacterium tuberculosis
VGAGARSSVG

SEQ ID NO: 54188 - protein, 10 aa, Mycobacterium tuberculosis
GAGARSSVGT

SEQ ID NO: 54189 - protein, 10 aa, Mycobacterium tuberculosis
AGARSSVGTA

SEQ ID NO: 54190 - protein, 10 aa, Mycobacterium tuberculosis
GARSSVGTAA

SEQ ID NO: 54191 - protein, 10 aa, Mycobacterium tuberculosis
ARSSVGTAAA

SEQ ID NO: 54192 - protein, 10 aa, Mycobacterium tuberculosis
RSSVGTAAAS

SEQ ID NO: 54193 - protein, 10 aa, Mycobacterium tuberculosis
SSVGTAAASG

SEQ ID NO: 54194 - protein, 10 aa, Mycobacterium tuberculosis
SVGTAAASGA

SEQ ID NO: 54195 - protein, 10 aa, Mycobacterium tuberculosis
VGTAAASGAG

SEQ ID NO: 54196 - protein, 10 aa, Mycobacterium tuberculosis
GTAAASGAGS

SEQ ID NO: 54197 - protein, 10 aa, Mycobacterium tuberculosis
TAAASGAGSH

SEQ ID NO: 54198 - protein, 10 aa, Mycobacterium tuberculosis
AAASGAGSHA

SEQ ID NO: 54199 - protein, 10 aa, Mycobacterium tuberculosis
AASGAGSHAA

SEQ ID NO: 54200 - protein, 10 aa, Mycobacterium tuberculosis
ASGAGSHAAT

SEQ ID NO: 54201 - protein, 10 aa, Mycobacterium tuberculosis
SGAGSHAATG

SEQ ID NO: 54202 - protein, 10 aa, Mycobacterium tuberculosis
GAGSHAATGR

SEQ ID NO: 54203 - protein, 10 aa, Mycobacterium tuberculosis
AGSHAATGRA

SEQ ID NO: 54204 - protein, 10 aa, Mycobacterium tuberculosis
GSHAATGRAP

SEQ ID NO: 54205 - protein, 10 aa, Mycobacterium tuberculosis
SHAATGRAPV

SEQ ID NO: 54206 - protein, 10 aa, Mycobacterium tuberculosis
HAATGRAPVA

SEQ ID NO: 54207 - protein, 10 aa, Mycobacterium tuberculosis
AATGRAPVAT

SEQ ID NO: 54208 - protein, 10 aa, Mycobacterium tuberculosis
ATGRAPVATS

SEQ ID NO: 54209 - protein, 10 aa, Mycobacterium tuberculosis
TGRAPVATSD

SEQ ID NO: 54210 - protein, 10 aa, Mycobacterium tuberculosis
GRAPVATSDK

SEQ ID NO: 54211 - protein, 10 aa, Mycobacterium tuberculosis
RAPVATSDKA

SEQ ID NO: 54212 - protein, 10 aa, Mycobacterium tuberculosis
APVATSDKAA

SEQ ID NO: 54213 - protein, 10 aa, Mycobacterium tuberculosis
PVATSDKAAA

SEQ ID NO: 54214 - protein, 10 aa, Mycobacterium tuberculosis
VATSDKAAAP

SEQ ID NO: 54215 - protein, 10 aa, Mycobacterium tuberculosis
ATSDKAAAPS

SEQ ID NO: 54216 - protein, 10 aa, Mycobacterium tuberculosis
TSDKAAAPST

SEQ ID NO: 54217 - protein, 10 aa, Mycobacterium tuberculosis
SDKAAAPSTR

SEQ ID NO: 54218 - protein, 10 aa, Mycobacterium tuberculosis
DKAAAPSTRA

SEQ ID NO: 54219 - protein, 10 aa, Mycobacterium tuberculosis
KAAAPSTRAA

SEQ ID NO: 54220 - protein, 10 aa, Mycobacterium tuberculosis
AAAPSTRAAS

SEQ ID NO: 54221 - protein, 10 aa, Mycobacterium tuberculosis
AAPSTRAASA

SEQ ID NO: 54222 - protein, 10 aa, Mycobacterium tuberculosis
APSTRAASAR

SEQ ID NO: 54223 - protein, 10 aa, Mycobacterium tuberculosis
PSTRAASART

SEQ ID NO: 54224 - protein, 10 aa, Mycobacterium tuberculosis
STRAASARTA

SEQ ID NO: 54225 - protein, 10 aa, Mycobacterium tuberculosis
TRAASARTAP

SEQ ID NO: 54226 - protein, 10 aa, Mycobacterium tuberculosis
RAASARTAPP

SEQ ID NO: 54227 - protein, 10 aa, Mycobacterium tuberculosis
AASARTAPPA

SEQ ID NO: 54228 - protein, 10 aa, Mycobacterium tuberculosis
ASARTAPPAR

SEQ ID NO: 54229 - protein, 10 aa, Mycobacterium tuberculosis
SARTAPPARP

SEQ ID NO: 54230 - protein, 10 aa, Mycobacterium tuberculosis
ARTAPPARPP

SEQ ID NO: 54231 - protein, 10 aa, Mycobacterium tuberculosis
RTAPPARPPS

SEQ ID NO: 54232 - protein, 10 aa, Mycobacterium tuberculosis
TAPPARPPST

SEQ ID NO: 54233 - protein, 10 aa, Mycobacterium tuberculosis
APPARPPSTD

SEQ ID NO: 54234 - protein, 10 aa, Mycobacterium tuberculosis
PPARPPSTDH

SEQ ID NO: 54235 - protein, 10 aa, Mycobacterium tuberculosis
PARPPSTDHI

SEQ ID NO: 54236 - protein, 10 aa, Mycobacterium tuberculosis
ARPPSTDHID

SEQ ID NO: 54237 - protein, 10 aa, Mycobacterium tuberculosis
RPPSTDHIDK

SEQ ID NO: 54238 - protein, 10 aa, Mycobacterium tuberculosis
PPSTDHIDKP

SEQ ID NO: 54239 - protein, 10 aa, Mycobacterium tuberculosis
PSTDHIDKPD

SEQ ID NO: 54240 - protein, 10 aa, Mycobacterium tuberculosis
STDHIDKPDR

SEQ ID NO: 54241 - protein, 10 aa, Mycobacterium tuberculosis
TDHIDKPDRS

SEQ ID NO: 54242 - protein, 10 aa, Mycobacterium tuberculosis
DHIDKPDRSE

SEQ ID NO: 54243 - protein, 10 aa, Mycobacterium tuberculosis
HIDKPDRSES

SEQ ID NO: 54244 - protein, 10 aa, Mycobacterium tuberculosis
IDKPDRSESA

SEQ ID NO: 54245 - protein, 10 aa, Mycobacterium tuberculosis
DKPDRSESAD

SEQ ID NO: 54246 - protein, 10 aa, Mycobacterium tuberculosis
KPDRSESADD

SEQ ID NO: 54247 - protein, 10 aa, Mycobacterium tuberculosis
PDRSESADDG

SEQ ID NO: 54248 - protein, 10 aa, Mycobacterium tuberculosis
DRSESADDGT

SEQ ID NO: 54249 - protein, 10 aa, Mycobacterium tuberculosis
RSESADDGTP

SEQ ID NO: 54250 - protein, 10 aa, Mycobacterium tuberculosis
SESADDGTPV

SEQ ID NO: 54251 - protein, 10 aa, Mycobacterium tuberculosis
ESADDGTPVS

SEQ ID NO: 54252 - protein, 10 aa, Mycobacterium tuberculosis
SADDGTPVSM

SEQ ID NO: 54253 - protein, 10 aa, Mycobacterium tuberculosis
ADDGTPVSMI

SEQ ID NO: 54254 - protein, 10 aa, Mycobacterium tuberculosis
DDGTPVSMIP

SEQ ID NO: 54255 - protein, 10 aa, Mycobacterium tuberculosis
DGTPVSMIPV

SEQ ID NO: 54256 - protein, 10 aa, Mycobacterium tuberculosis
GTPVSMIPVS

SEQ ID NO: 54257 - protein, 10 aa, Mycobacterium tuberculosis
TPVSMIPVSA

SEQ ID NO: 54258 - protein, 10 aa, Mycobacterium tuberculosis
PVSMIPVSAA

SEQ ID NO: 54259 - protein, 10 aa, Mycobacterium tuberculosis
VSMIPVSAAR

SEQ ID NO: 54260 - protein, 10 aa, Mycobacterium tuberculosis
SMIPVSAARA

SEQ ID NO: 54261 - protein, 10 aa, Mycobacterium tuberculosis
MIPVSAARAA

SEQ ID NO: 54262 - protein, 10 aa, Mycobacterium tuberculosis
IPVSAARAAR

SEQ ID NO: 54263 - protein, 10 aa, Mycobacterium tuberculosis
PVSAARAARD

SEQ ID NO: 54264 - protein, 10 aa, Mycobacterium tuberculosis
VSAARAARDA

SEQ ID NO: 54265 - protein, 10 aa, Mycobacterium tuberculosis
SAARAARDAA

SEQ ID NO: 54266 - protein, 10 aa, Mycobacterium tuberculosis
AARAARDAAT

SEQ ID NO: 54267 - protein, 10 aa, Mycobacterium tuberculosis
ARAARDAATA

SEQ ID NO: 54268 - protein, 10 aa, Mycobacterium tuberculosis
RAARDAATAA

SEQ ID NO: 54269 - protein, 10 aa, Mycobacterium tuberculosis
AARDAATAAA

SEQ ID NO: 54270 - protein, 10 aa, Mycobacterium tuberculosis
ARDAATAAAS

SEQ ID NO: 54271 - protein, 10 aa, Mycobacterium tuberculosis
RDAATAAASA

SEQ ID NO: 54272 - protein, 10 aa, Mycobacterium tuberculosis
DAATAAASAR

SEQ ID NO: 54273 - protein, 10 aa, Mycobacterium tuberculosis
AATAAASARQ

SEQ ID NO: 54274 - protein, 10 aa, Mycobacterium tuberculosis
ATAAASARQR

SEQ ID NO: 54275 - protein, 10 aa, Mycobacterium tuberculosis
TAAASARQRG

SEQ ID NO: 54276 - protein, 10 aa, Mycobacterium tuberculosis
AAASARQRGR

SEQ ID NO: 54277 - protein, 10 aa, Mycobacterium tuberculosis
AASARQRGRG

SEQ ID NO: 54278 - protein, 10 aa, Mycobacterium tuberculosis
ASARQRGRGD

SEQ ID NO: 54279 - protein, 10 aa, Mycobacterium tuberculosis
SARQRGRGDA

SEQ ID NO: 54280 - protein, 10 aa, Mycobacterium tuberculosis
ARQRGRGDAL

SEQ ID NO: 54281 - protein, 10 aa, Mycobacterium tuberculosis
RQRGRGDALR

SEQ ID NO: 54282 - protein, 10 aa, Mycobacterium tuberculosis
QRGRGDALRL

SEQ ID NO: 54283 - protein, 10 aa, Mycobacterium tuberculosis
RGRGDALRLA

SEQ ID NO: 54284 - protein, 10 aa, Mycobacterium tuberculosis
GRGDALRLAR

SEQ ID NO: 54285 - protein, 10 aa, Mycobacterium tuberculosis
RGDALRLARR

SEQ ID NO: 54286 - protein, 10 aa, Mycobacterium tuberculosis
GDALRLARRI

SEQ ID NO: 54287 - protein, 10 aa, Mycobacterium tuberculosis
DALRLARRIA

SEQ ID NO: 54288 - protein, 10 aa, Mycobacterium tuberculosis
ALRLARRIAA

SEQ ID NO: 54289 - protein, 10 aa, Mycobacterium tuberculosis
LRLARRIAAA

SEQ ID NO: 54290 - protein, 10 aa, Mycobacterium tuberculosis
RLARRIAAAL

SEQ ID NO: 54291 - protein, 10 aa, Mycobacterium tuberculosis
LARRIAAALN

SEQ ID NO: 54292 - protein, 10 aa, Mycobacterium tuberculosis
ARRIAAALNA

SEQ ID NO: 54293 - protein, 10 aa, Mycobacterium tuberculosis
RRIAAALNAS

SEQ ID NO: 54294 - protein, 10 aa, Mycobacterium tuberculosis
RIAAALNASD

SEQ ID NO: 54295 - protein, 10 aa, Mycobacterium tuberculosis
IAAALNASDN

SEQ ID NO: 54296 - protein, 10 aa, Mycobacterium tuberculosis
AAALNASDNN

SEQ ID NO: 54297 - protein, 10 aa, Mycobacterium tuberculosis
AALNASDNNA

SEQ ID NO: 54298 - protein, 10 aa, Mycobacterium tuberculosis
ALNASDNNAG

SEQ ID NO: 54299 - protein, 10 aa, Mycobacterium tuberculosis
LNASDNNAGD

SEQ ID NO: 54300 - protein, 10 aa, Mycobacterium tuberculosis
NASDNNAGDY

SEQ ID NO: 54301 - protein, 10 aa, Mycobacterium tuberculosis
ASDNNAGDYG

SEQ ID NO: 54302 - protein, 10 aa, Mycobacterium tuberculosis
SDNNAGDYGF

SEQ ID NO: 54303 - protein, 10 aa, Mycobacterium tuberculosis
DNNAGDYGFF

SEQ ID NO: 54304 - protein, 10 aa, Mycobacterium tuberculosis
NNAGDYGFFW

SEQ ID NO: 54305 - protein, 10 aa, Mycobacterium tuberculosis
NAGDYGFFWI

SEQ ID NO: 54306 - protein, 10 aa, Mycobacterium tuberculosis
AGDYGFFWIT

SEQ ID NO: 54307 - protein, 10 aa, Mycobacterium tuberculosis
GDYGFFWITA

SEQ ID NO: 54308 - protein, 10 aa, Mycobacterium tuberculosis
DYGFFWITAV

SEQ ID NO: 54309 - protein, 10 aa, Mycobacterium tuberculosis
YGFFWITAVT

SEQ ID NO: 54310 - protein, 10 aa, Mycobacterium tuberculosis
GFFWITAVTT

SEQ ID NO: 54311 - protein, 10 aa, Mycobacterium tuberculosis
FFWITAVTTD

SEQ ID NO: 54312 - protein, 10 aa, Mycobacterium tuberculosis
FWITAVTTDG

SEQ ID NO: 54313 - protein, 10 aa, Mycobacterium tuberculosis
WITAVTTDGS

SEQ ID NO: 54314 - protein, 10 aa, Mycobacterium tuberculosis
ITAVTTDGSI

SEQ ID NO: 54315 - protein, 10 aa, Mycobacterium tuberculosis
TAVTTDGSIV

SEQ ID NO: 54316 - protein, 10 aa, Mycobacterium tuberculosis
AVTTDGSIVV

SEQ ID NO: 54317 - protein, 10 aa, Mycobacterium tuberculosis
VTTDGSIVVA

SEQ ID NO: 54318 - protein, 10 aa, Mycobacterium tuberculosis
TTDGSIVVAN

SEQ ID NO: 54319 - protein, 10 aa, Mycobacterium tuberculosis
TDGSIVVANS

SEQ ID NO: 54320 - protein, 10 aa, Mycobacterium tuberculosis
DGSIVVANSY

SEQ ID NO: 54321 - protein, 10 aa, Mycobacterium tuberculosis
GSIVVANSYG

SEQ ID NO: 54322 - protein, 10 aa, Mycobacterium tuberculosis
SIVVANSYGL

SEQ ID NO: 54323 - protein, 10 aa, Mycobacterium tuberculosis
IVVANSYGLA

SEQ ID NO: 54324 - protein, 10 aa, Mycobacterium tuberculosis
VVANSYGLAY

SEQ ID NO: 54325 - protein, 10 aa, Mycobacterium tuberculosis
VANSYGLAYI

SEQ ID NO: 54326 - protein, 10 aa, Mycobacterium tuberculosis
ANSYGLAYIP

SEQ ID NO: 54327 - protein, 10 aa, Mycobacterium tuberculosis
NSYGLAYIPD

SEQ ID NO: 54328 - protein, 10 aa, Mycobacterium tuberculosis
SYGLAYIPDG

SEQ ID NO: 54329 - protein, 10 aa, Mycobacterium tuberculosis
YGLAYIPDGM

SEQ ID NO: 54330 - protein, 10 aa, Mycobacterium tuberculosis
GLAYIPDGME

SEQ ID NO: 54331 - protein, 10 aa, Mycobacterium tuberculosis
LAYIPDGMEL

SEQ ID NO: 54332 - protein, 10 aa, Mycobacterium tuberculosis
AYIPDGMELP

SEQ ID NO: 54333 - protein, 10 aa, Mycobacterium tuberculosis
YIPDGMELPN

SEQ ID NO: 54334 - protein, 10 aa, Mycobacterium tuberculosis
IPDGMELPNK

SEQ ID NO: 54335 - protein, 10 aa, Mycobacterium tuberculosis
PDGMELPNKV

SEQ ID NO: 54336 - protein, 10 aa, Mycobacterium tuberculosis
DGMELPNKVY

SEQ ID NO: 54337 - protein, 10 aa, Mycobacterium tuberculosis
GMELPNKVYL

SEQ ID NO: 54338 - protein, 10 aa, Mycobacterium tuberculosis
MELPNKVYLA

SEQ ID NO: 54339 - protein, 10 aa, Mycobacterium tuberculosis
ELPNKVYLAS

SEQ ID NO: 54340 - protein, 10 aa, Mycobacterium tuberculosis
LPNKVYLASA

SEQ ID NO: 54341 - protein, 10 aa, Mycobacterium tuberculosis
PNKVYLASAD

SEQ ID NO: 54342 - protein, 10 aa, Mycobacterium tuberculosis
NKVYLASADH

SEQ ID NO: 54343 - protein, 10 aa, Mycobacterium tuberculosis
KVYLASADHA

SEQ ID NO: 54344 - protein, 10 aa, Mycobacterium tuberculosis
VYLASADHAI

SEQ ID NO: 54345 - protein, 10 aa, Mycobacterium tuberculosis
YLASADHAIP

SEQ ID NO: 54346 - protein, 10 aa, Mycobacterium tuberculosis
LASADHAIPV

SEQ ID NO: 54347 - protein, 10 aa, Mycobacterium tuberculosis
ASADHAIPVD

SEQ ID NO: 54348 - protein, 10 aa, Mycobacterium tuberculosis
SADHAIPVDE

SEQ ID NO: 54349 - protein, 10 aa, Mycobacterium tuberculosis
ADHAIPVDEI

SEQ ID NO: 54350 - protein, 10 aa, Mycobacterium tuberculosis
DHAIPVDEIA

SEQ ID NO: 54351 - protein, 10 aa, Mycobacterium tuberculosis
HAIPVDEIAR

SEQ ID NO: 54352 - protein, 10 aa, Mycobacterium tuberculosis
AIPVDEIARC

SEQ ID NO: 54353 - protein, 10 aa, Mycobacterium tuberculosis
IPVDEIARCA

SEQ ID NO: 54354 - protein, 10 aa, Mycobacterium tuberculosis
PVDEIARCAT

SEQ ID NO: 54355 - protein, 10 aa, Mycobacterium tuberculosis
VDEIARCATY

SEQ ID NO: 54356 - protein, 10 aa, Mycobacterium tuberculosis
DEIARCATYP

SEQ ID NO: 54357 - protein, 10 aa, Mycobacterium tuberculosis
EIARCATYPV

SEQ ID NO: 54358 - protein, 10 aa, Mycobacterium tuberculosis
IARCATYPVL

SEQ ID NO: 54359 - protein, 10 aa, Mycobacterium tuberculosis
ARCATYPVLA

SEQ ID NO: 54360 - protein, 10 aa, Mycobacterium tuberculosis
RCATYPVLAV

SEQ ID NO: 54361 - protein, 10 aa, Mycobacterium tuberculosis
CATYPVLAVQ

SEQ ID NO: 54362 - protein, 10 aa, Mycobacterium tuberculosis
ATYPVLAVQA

SEQ ID NO: 54363 - protein, 10 aa, Mycobacterium tuberculosis
TYPVLAVQAW

SEQ ID NO: 54364 - protein, 10 aa, Mycobacterium tuberculosis
YPVLAVQAWA

SEQ ID NO: 54365 - protein, 10 aa, Mycobacterium tuberculosis
PVLAVQAWAA

SEQ ID NO: 54366 - protein, 10 aa, Mycobacterium tuberculosis
VLAVQAWAAF

SEQ ID NO: 54367 - protein, 10 aa, Mycobacterium tuberculosis
LAVQAWAAFH

SEQ ID NO: 54368 - protein, 10 aa, Mycobacterium tuberculosis
AVQAWAAFHD

SEQ ID NO: 54369 - protein, 10 aa, Mycobacterium tuberculosis
VQAWAAFHDM

SEQ ID NO: 54370 - protein, 10 aa, Mycobacterium tuberculosis
QAWAAFHDMT

SEQ ID NO: 54371 - protein, 10 aa, Mycobacterium tuberculosis
AWAAFHDMTL

SEQ ID NO: 54372 - protein, 10 aa, Mycobacterium tuberculosis
WAAFHDMTLR

SEQ ID NO: 54373 - protein, 10 aa, Mycobacterium tuberculosis
AAFHDMTLRA

SEQ ID NO: 54374 - protein, 10 aa, Mycobacterium tuberculosis
AFHDMTLRAV

SEQ ID NO: 54375 - protein, 10 aa, Mycobacterium tuberculosis
FHDMTLRAVI

SEQ ID NO: 54376 - protein, 10 aa, Mycobacterium tuberculosis
HDMTLRAVIG

SEQ ID NO: 54377 - protein, 10 aa, Mycobacterium tuberculosis
DMTLRAVIGT

SEQ ID NO: 54378 - protein, 10 aa, Mycobacterium tuberculosis
MTLRAVIGTA

SEQ ID NO: 54379 - protein, 10 aa, Mycobacterium tuberculosis
TLRAVIGTAE

SEQ ID NO: 54380 - protein, 10 aa, Mycobacterium tuberculosis
LRAVIGTAEQ

SEQ ID NO: 54381 - protein, 10 aa, Mycobacterium tuberculosis
RAVIGTAEQL

SEQ ID NO: 54382 - protein, 10 aa, Mycobacterium tuberculosis
AVIGTAEQLA

SEQ ID NO: 54383 - protein, 10 aa, Mycobacterium tuberculosis
VIGTAEQLAS

SEQ ID NO: 54384 - protein, 10 aa, Mycobacterium tuberculosis
IGTAEQLASS

SEQ ID NO: 54385 - protein, 10 aa, Mycobacterium tuberculosis
GTAEQLASSD

SEQ ID NO: 54386 - protein, 10 aa, Mycobacterium tuberculosis
TAEQLASSDP

SEQ ID NO: 54387 - protein, 10 aa, Mycobacterium tuberculosis
AEQLASSDPG

SEQ ID NO: 54388 - protein, 10 aa, Mycobacterium tuberculosis
EQLASSDPGV

SEQ ID NO: 54389 - protein, 10 aa, Mycobacterium tuberculosis
QLASSDPGVA

SEQ ID NO: 54390 - protein, 10 aa, Mycobacterium tuberculosis
LASSDPGVAK

SEQ ID NO: 54391 - protein, 10 aa, Mycobacterium tuberculosis
ASSDPGVAKI

SEQ ID NO: 54392 - protein, 10 aa, Mycobacterium tuberculosis
SSDPGVAKIV

SEQ ID NO: 54393 - protein, 10 aa, Mycobacterium tuberculosis
SDPGVAKIVL

SEQ ID NO: 54394 - protein, 10 aa, Mycobacterium tuberculosis
DPGVAKIVLE

SEQ ID NO: 54395 - protein, 10 aa, Mycobacterium tuberculosis
PGVAKIVLEP

SEQ ID NO: 54396 - protein, 10 aa, Mycobacterium tuberculosis
GVAKIVLEPD

SEQ ID NO: 54397 - protein, 10 aa, Mycobacterium tuberculosis
VAKIVLEPDD

SEQ ID NO: 54398 - protein, 10 aa, Mycobacterium tuberculosis
AKIVLEPDDI

SEQ ID NO: 54399 - protein, 10 aa, Mycobacterium tuberculosis
KIVLEPDDIP

SEQ ID NO: 54400 - protein, 10 aa, Mycobacterium tuberculosis
IVLEPDDIPE

SEQ ID NO: 54401 - protein, 10 aa, Mycobacterium tuberculosis
VLEPDDIPES

SEQ ID NO: 54402 - protein, 10 aa, Mycobacterium tuberculosis
LEPDDIPESG

SEQ ID NO: 54403 - protein, 10 aa, Mycobacterium tuberculosis
EPDDIPESGK

SEQ ID NO: 54404 - protein, 10 aa, Mycobacterium tuberculosis
PDDIPESGKM

SEQ ID NO: 54405 - protein, 10 aa, Mycobacterium tuberculosis
DDIPESGKMT

SEQ ID NO: 54406 - protein, 10 aa, Mycobacterium tuberculosis
DIPESGKMTG

SEQ ID NO: 54407 - protein, 10 aa, Mycobacterium tuberculosis
IPESGKMTGR

SEQ ID NO: 54408 - protein, 10 aa, Mycobacterium tuberculosis
PESGKMTGRS

SEQ ID NO: 54409 - protein, 10 aa, Mycobacterium tuberculosis
ESGKMTGRSR

SEQ ID NO: 54410 - protein, 10 aa, Mycobacterium tuberculosis
SGKMTGRSRL

SEQ ID NO: 54411 - protein, 10 aa, Mycobacterium tuberculosis
GKMTGRSRLE

SEQ ID NO: 54412 - protein, 10 aa, Mycobacterium tuberculosis
KMTGRSRLEV

SEQ ID NO: 54413 - protein, 10 aa, Mycobacterium tuberculosis
MTGRSRLEVV

SEQ ID NO: 54414 - protein, 10 aa, Mycobacterium tuberculosis
TGRSRLEVVD

SEQ ID NO: 54415 - protein, 10 aa, Mycobacterium tuberculosis
GRSRLEVVDP

SEQ ID NO: 54416 - protein, 10 aa, Mycobacterium tuberculosis
RSRLEVVDPS

SEQ ID NO: 54417 - protein, 10 aa, Mycobacterium tuberculosis
SRLEVVDPSA

SEQ ID NO: 54418 - protein, 10 aa, Mycobacterium tuberculosis
RLEVVDPSAA

SEQ ID NO: 54419 - protein, 10 aa, Mycobacterium tuberculosis
LEVVDPSAAA

SEQ ID NO: 54420 - protein, 10 aa, Mycobacterium tuberculosis
EVVDPSAAAQ

SEQ ID NO: 54421 - protein, 10 aa, Mycobacterium tuberculosis
VVDPSAAAQL

SEQ ID NO: 54422 - protein, 10 aa, Mycobacterium tuberculosis
VDPSAAAQLA

SEQ ID NO: 54423 - protein, 10 aa, Mycobacterium tuberculosis
DPSAAAQLAD

SEQ ID NO: 54424 - protein, 10 aa, Mycobacterium tuberculosis
PSAAAQLADT

SEQ ID NO: 54425 - protein, 10 aa, Mycobacterium tuberculosis
SAAAQLADTT

SEQ ID NO: 54426 - protein, 10 aa, Mycobacterium tuberculosis
AAAQLADTTD

SEQ ID NO: 54427 - protein, 10 aa, Mycobacterium tuberculosis
AAQLADTTDQ

SEQ ID NO: 54428 - protein, 10 aa, Mycobacterium tuberculosis
AQLADTTDQR

SEQ ID NO: 54429 - protein, 10 aa, Mycobacterium tuberculosis
QLADTTDQRL

SEQ ID NO: 54430 - protein, 10 aa, Mycobacterium tuberculosis
LADTTDQRLL

SEQ ID NO: 54431 - protein, 10 aa, Mycobacterium tuberculosis
ADTTDQRLLD

SEQ ID NO: 54432 - protein, 10 aa, Mycobacterium tuberculosis
DTTDQRLLDL

SEQ ID NO: 54433 - protein, 10 aa, Mycobacterium tuberculosis
TTDQRLLDLL

SEQ ID NO: 54434 - protein, 10 aa, Mycobacterium tuberculosis
TDQRLLDLLP

SEQ ID NO: 54435 - protein, 10 aa, Mycobacterium tuberculosis
DQRLLDLLPP

SEQ ID NO: 54436 - protein, 10 aa, Mycobacterium tuberculosis
QRLLDLLPPA

SEQ ID NO: 54437 - protein, 10 aa, Mycobacterium tuberculosis
RLLDLLPPAP

SEQ ID NO: 54438 - protein, 10 aa, Mycobacterium tuberculosis
LLDLLPPAPV

SEQ ID NO: 54439 - protein, 10 aa, Mycobacterium tuberculosis
LDLLPPAPVD

SEQ ID NO: 54440 - protein, 10 aa, Mycobacterium tuberculosis
DLLPPAPVDV

SEQ ID NO: 54441 - protein, 10 aa, Mycobacterium tuberculosis
LLPPAPVDVN

SEQ ID NO: 54442 - protein, 10 aa, Mycobacterium tuberculosis
LPPAPVDVNP

SEQ ID NO: 54443 - protein, 10 aa, Mycobacterium tuberculosis
PPAPVDVNPP

SEQ ID NO: 54444 - protein, 10 aa, Mycobacterium tuberculosis
PAPVDVNPPG

SEQ ID NO: 54445 - protein, 10 aa, Mycobacterium tuberculosis
APVDVNPPGD

SEQ ID NO: 54446 - protein, 10 aa, Mycobacterium tuberculosis
PVDVNPPGDE

SEQ ID NO: 54447 - protein, 10 aa, Mycobacterium tuberculosis
VDVNPPGDER

SEQ ID NO: 54448 - protein, 10 aa, Mycobacterium tuberculosis
DVNPPGDERH

SEQ ID NO: 54449 - protein, 10 aa, Mycobacterium tuberculosis
VNPPGDERHM

SEQ ID NO: 54450 - protein, 10 aa, Mycobacterium tuberculosis
NPPGDERHML

SEQ ID NO: 54451 - protein, 10 aa, Mycobacterium tuberculosis
PPGDERHMLW

SEQ ID NO: 54452 - protein, 10 aa, Mycobacterium tuberculosis
PGDERHMLWF

SEQ ID NO: 54453 - protein, 10 aa, Mycobacterium tuberculosis
GDERHMLWFE

SEQ ID NO: 54454 - protein, 10 aa, Mycobacterium tuberculosis
DERHMLWFEL

SEQ ID NO: 54455 - protein, 10 aa, Mycobacterium tuberculosis
ERHMLWFELM

SEQ ID NO: 54456 - protein, 10 aa, Mycobacterium tuberculosis
RHMLWFELMK

SEQ ID NO: 54457 - protein, 10 aa, Mycobacterium tuberculosis
HMLWFELMKP

SEQ ID NO: 54458 - protein, 10 aa, Mycobacterium tuberculosis
MLWFELMKPM

SEQ ID NO: 54459 - protein, 10 aa, Mycobacterium tuberculosis
LWFELMKPMT

SEQ ID NO: 54460 - protein, 10 aa, Mycobacterium tuberculosis
WFELMKPMTS

SEQ ID NO: 54461 - protein, 10 aa, Mycobacterium tuberculosis
FELMKPMTST

SEQ ID NO: 54462 - protein, 10 aa, Mycobacterium tuberculosis
ELMKPMTSTA

SEQ ID NO: 54463 - protein, 10 aa, Mycobacterium tuberculosis
LMKPMTSTAT

SEQ ID NO: 54464 - protein, 10 aa, Mycobacterium tuberculosis
MKPMTSTATG

SEQ ID NO: 54465 - protein, 10 aa, Mycobacterium tuberculosis
KPMTSTATGR

SEQ ID NO: 54466 - protein, 10 aa, Mycobacterium tuberculosis
PMTSTATGRE

SEQ ID NO: 54467 - protein, 10 aa, Mycobacterium tuberculosis
MTSTATGREA

SEQ ID NO: 54468 - protein, 10 aa, Mycobacterium tuberculosis
TSTATGREAA

SEQ ID NO: 54469 - protein, 10 aa, Mycobacterium tuberculosis
STATGREAAH

SEQ ID NO: 54470 - protein, 10 aa, Mycobacterium tuberculosis
TATGREAAHL

SEQ ID NO: 54471 - protein, 10 aa, Mycobacterium tuberculosis
ATGREAAHLR

SEQ ID NO: 54472 - protein, 10 aa, Mycobacterium tuberculosis
TGREAAHLRA

SEQ ID NO: 54473 - protein, 10 aa, Mycobacterium tuberculosis
GREAAHLRAF

SEQ ID NO: 54474 - protein, 10 aa, Mycobacterium tuberculosis
REAAHLRAFR

SEQ ID NO: 54475 - protein, 10 aa, Mycobacterium tuberculosis
EAAHLRAFRA

SEQ ID NO: 54476 - protein, 10 aa, Mycobacterium tuberculosis
AAHLRAFRAY

SEQ ID NO: 54477 - protein, 10 aa, Mycobacterium tuberculosis
AHLRAFRAYA

SEQ ID NO: 54478 - protein, 10 aa, Mycobacterium tuberculosis
HLRAFRAYAA

SEQ ID NO: 54479 - protein, 10 aa, Mycobacterium tuberculosis
LRAFRAYAAH

SEQ ID NO: 54480 - protein, 10 aa, Mycobacterium tuberculosis
RAFRAYAAHS

SEQ ID NO: 54481 - protein, 10 aa, Mycobacterium tuberculosis
AFRAYAAHSQ

SEQ ID NO: 54482 - protein, 10 aa, Mycobacterium tuberculosis
FRAYAAHSQE

SEQ ID NO: 54483 - protein, 10 aa, Mycobacterium tuberculosis
RAYAAHSQEI

SEQ ID NO: 54484 - protein, 10 aa, Mycobacterium tuberculosis
AYAAHSQEIA

SEQ ID NO: 54485 - protein, 10 aa, Mycobacterium tuberculosis
YAAHSQEIAL

SEQ ID NO: 54486 - protein, 10 aa, Mycobacterium tuberculosis
AAHSQEIALH

SEQ ID NO: 54487 - protein, 10 aa, Mycobacterium tuberculosis
AHSQEIALHQ

SEQ ID NO: 54488 - protein, 10 aa, Mycobacterium tuberculosis
HSQEIALHQA

SEQ ID NO: 54489 - protein, 10 aa, Mycobacterium tuberculosis
SQEIALHQAH

SEQ ID NO: 54490 - protein, 10 aa, Mycobacterium tuberculosis
QEIALHQAHT

SEQ ID NO: 54491 - protein, 10 aa, Mycobacterium tuberculosis
EIALHQAHTA

SEQ ID NO: 54492 - protein, 10 aa, Mycobacterium tuberculosis
IALHQAHTAT

SEQ ID NO: 54493 - protein, 10 aa, Mycobacterium tuberculosis
ALHQAHTATD

SEQ ID NO: 54494 - protein, 10 aa, Mycobacterium tuberculosis
LHQAHTATDA

SEQ ID NO: 54495 - protein, 10 aa, Mycobacterium tuberculosis
HQAHTATDAA

SEQ ID NO: 54496 - protein, 10 aa, Mycobacterium tuberculosis
QAHTATDAAV

SEQ ID NO: 54497 - protein, 10 aa, Mycobacterium tuberculosis
AHTATDAAVQ

SEQ ID NO: 54498 - protein, 10 aa, Mycobacterium tuberculosis
HTATDAAVQR

SEQ ID NO: 54499 - protein, 10 aa, Mycobacterium tuberculosis
TATDAAVQRV

SEQ ID NO: 54500 - protein, 10 aa, Mycobacterium tuberculosis
ATDAAVQRVA

SEQ ID NO: 54501 - protein, 10 aa, Mycobacterium tuberculosis
TDAAVQRVAV

SEQ ID NO: 54502 - protein, 10 aa, Mycobacterium tuberculosis
DAAVQRVAVA

SEQ ID NO: 54503 - protein, 10 aa, Mycobacterium tuberculosis
AAVQRVAVAD

SEQ ID NO: 54504 - protein, 10 aa, Mycobacterium tuberculosis
AVQRVAVADW

SEQ ID NO: 54505 - protein, 10 aa, Mycobacterium tuberculosis
VQRVAVADWL

SEQ ID NO: 54506 - protein, 10 aa, Mycobacterium tuberculosis
QRVAVADWLY

SEQ ID NO: 54507 - protein, 10 aa, Mycobacterium tuberculosis
RVAVADWLYW

SEQ ID NO: 54508 - protein, 10 aa, Mycobacterium tuberculosis
VAVADWLYWQ

SEQ ID NO: 54509 - protein, 10 aa, Mycobacterium tuberculosis
AVADWLYWQY

SEQ ID NO: 54510 - protein, 10 aa, Mycobacterium tuberculosis
VADWLYWQYV

SEQ ID NO: 54511 - protein, 10 aa, Mycobacterium tuberculosis
ADWLYWQYVT

SEQ ID NO: 54512 - protein, 10 aa, Mycobacterium tuberculosis
DWLYWQYVTG

SEQ ID NO: 54513 - protein, 10 aa, Mycobacterium tuberculosis
WLYWQYVTGL

SEQ ID NO: 54514 - protein, 10 aa, Mycobacterium tuberculosis
LYWQYVTGLL

SEQ ID NO: 54515 - protein, 10 aa, Mycobacterium tuberculosis
YWQYVTGLLD

SEQ ID NO: 54516 - protein, 10 aa, Mycobacterium tuberculosis
WQYVTGLLDR

SEQ ID NO: 54517 - protein, 10 aa, Mycobacterium tuberculosis
QYVTGLLDRA

SEQ ID NO: 54518 - protein, 10 aa, Mycobacterium tuberculosis
YVTGLLDRAL

SEQ ID NO: 54519 - protein, 10 aa, Mycobacterium tuberculosis
VTGLLDRALA

SEQ ID NO: 54520 - protein, 10 aa, Mycobacterium tuberculosis
TGLLDRALAA

SEQ ID NO: 54521 - protein, 10 aa, Mycobacterium tuberculosis
GLLDRALAAA

SEQ ID NO: 54522 - protein, 10 aa, Mycobacterium tuberculosis
LLDRALAAAC

SEQ ID NO: 54523 - protein, 11 aa, Mycobacterium tuberculosis
MSITRPTGSYA

SEQ ID NO: 54524 - protein, 11 aa, Mycobacterium tuberculosis
SITRPTGSYAR

SEQ ID NO: 54525 - protein, 11 aa, Mycobacterium tuberculosis
ITRPTGSYARQ

SEQ ID NO: 54526 - protein, 11 aa, Mycobacterium tuberculosis
TRPTGSYARQM

SEQ ID NO: 54527 - protein, 11 aa, Mycobacterium tuberculosis
RPTGSYARQML

SEQ ID NO: 54528 - protein, 11 aa, Mycobacterium tuberculosis
PTGSYARQMLD

SEQ ID NO: 54529 - protein, 11 aa, Mycobacterium tuberculosis
TGSYARQMLDP

SEQ ID NO: 54530 - protein, 11 aa, Mycobacterium tuberculosis
GSYARQMLDPG

SEQ ID NO: 54531 - protein, 11 aa, Mycobacterium tuberculosis
SYARQMLDPGG

SEQ ID NO: 54532 - protein, 11 aa, Mycobacterium tuberculosis
YARQMLDPGGW

SEQ ID NO: 54533 - protein, 11 aa, Mycobacterium tuberculosis
ARQMLDPGGWV

SEQ ID NO: 54534 - protein, 11 aa, Mycobacterium tuberculosis
RQMLDPGGWVE

SEQ ID NO: 54535 - protein, 11 aa, Mycobacterium tuberculosis
QMLDPGGWVEA

SEQ ID NO: 54536 - protein, 11 aa, Mycobacterium tuberculosis
MLDPGGWVEAD

SEQ ID NO: 54537 - protein, 11 aa, Mycobacterium tuberculosis
LDPGGWVEADE

SEQ ID NO: 54538 - protein, 11 aa, Mycobacterium tuberculosis
DPGGWVEADED

SEQ ID NO: 54539 - protein, 11 aa, Mycobacterium tuberculosis
PGGWVEADEDT

SEQ ID NO: 54540 - protein, 11 aa, Mycobacterium tuberculosis
GGWVEADEDTF

SEQ ID NO: 54541 - protein, 11 aa, Mycobacterium tuberculosis
GWVEADEDTFY

SEQ ID NO: 54542 - protein, 11 aa, Mycobacterium tuberculosis
WVEADEDTFYD

SEQ ID NO: 54543 - protein, 11 aa, Mycobacterium tuberculosis
VEADEDTFYDR

SEQ ID NO: 54544 - protein, 11 aa, Mycobacterium tuberculosis
EADEDTFYDRA

SEQ ID NO: 54545 - protein, 11 aa, Mycobacterium tuberculosis
ADEDTFYDRAQ

SEQ ID NO: 54546 - protein, 11 aa, Mycobacterium tuberculosis
DEDTFYDRAQE

SEQ ID NO: 54547 - protein, 11 aa, Mycobacterium tuberculosis
EDTFYDRAQEY

SEQ ID NO: 54548 - protein, 11 aa, Mycobacterium tuberculosis
DTFYDRAQEYS

SEQ ID NO: 54549 - protein, 11 aa, Mycobacterium tuberculosis
TFYDRAQEYSQ

SEQ ID NO: 54550 - protein, 11 aa, Mycobacterium tuberculosis
FYDRAQEYSQV

SEQ ID NO: 54551 - protein, 11 aa, Mycobacterium tuberculosis
YDRAQEYSQVL

SEQ ID NO: 54552 - protein, 11 aa, Mycobacterium tuberculosis
DRAQEYSQVLQ

SEQ ID NO: 54553 - protein, 11 aa, Mycobacterium tuberculosis
RAQEYSQVLQR

SEQ ID NO: 54554 - protein, 11 aa, Mycobacterium tuberculosis
AQEYSQVLQRV

SEQ ID NO: 54555 - protein, 11 aa, Mycobacterium tuberculosis
QEYSQVLQRVT

SEQ ID NO: 54556 - protein, 11 aa, Mycobacterium tuberculosis
EYSQVLQRVTD

SEQ ID NO: 54557 - protein, 11 aa, Mycobacterium tuberculosis
YSQVLQRVTDV

SEQ ID NO: 54558 - protein, 11 aa, Mycobacterium tuberculosis
SQVLQRVTDVL

SEQ ID NO: 54559 - protein, 11 aa, Mycobacterium tuberculosis
QVLQRVTDVLD

SEQ ID NO: 54560 - protein, 11 aa, Mycobacterium tuberculosis
VLQRVTDVLDT

SEQ ID NO: 54561 - protein, 11 aa, Mycobacterium tuberculosis
LQRVTDVLDTC

SEQ ID NO: 54562 - protein, 11 aa, Mycobacterium tuberculosis
QRVTDVLDTCR

SEQ ID NO: 54563 - protein, 11 aa, Mycobacterium tuberculosis
RVTDVLDTCRQ

SEQ ID NO: 54564 - protein, 11 aa, Mycobacterium tuberculosis
VTDVLDTCRQQ

SEQ ID NO: 54565 - protein, 11 aa, Mycobacterium tuberculosis
TDVLDTCRQQK

SEQ ID NO: 54566 - protein, 11 aa, Mycobacterium tuberculosis
DVLDTCRQQKG

SEQ ID NO: 54567 - protein, 11 aa, Mycobacterium tuberculosis
VLDTCRQQKGH

SEQ ID NO: 54568 - protein, 11 aa, Mycobacterium tuberculosis
LDTCRQQKGHV

SEQ ID NO: 54569 - protein, 11 aa, Mycobacterium tuberculosis
DTCRQQKGHVF

SEQ ID NO: 54570 - protein, 11 aa, Mycobacterium tuberculosis
TCRQQKGHVFE

SEQ ID NO: 54571 - protein, 11 aa, Mycobacterium tuberculosis
CRQQKGHVFEG

SEQ ID NO: 54572 - protein, 11 aa, Mycobacterium tuberculosis
RQQKGHVFEGG

SEQ ID NO: 54573 - protein, 11 aa, Mycobacterium tuberculosis
QQKGHVFEGGL

SEQ ID NO: 54574 - protein, 11 aa, Mycobacterium tuberculosis
QKGHVFEGGLW

SEQ ID NO: 54575 - protein, 11 aa, Mycobacterium tuberculosis
KGHVFEGGLWS

SEQ ID NO: 54576 - protein, 11 aa, Mycobacterium tuberculosis
GHVFEGGLWSG

SEQ ID NO: 54577 - protein, 11 aa, Mycobacterium tuberculosis
HVFEGGLWSGG

SEQ ID NO: 54578 - protein, 11 aa, Mycobacterium tuberculosis
VFEGGLWSGGA

SEQ ID NO: 54579 - protein, 11 aa, Mycobacterium tuberculosis
FEGGLWSGGAA

SEQ ID NO: 54580 - protein, 11 aa, Mycobacterium tuberculosis
EGGLWSGGAAN

SEQ ID NO: 54581 - protein, 11 aa, Mycobacterium tuberculosis
GGLWSGGAANA

SEQ ID NO: 54582 - protein, 11 aa, Mycobacterium tuberculosis
GLWSGGAANAA

SEQ ID NO: 54583 - protein, 11 aa, Mycobacterium tuberculosis
LWSGGAANAAN

SEQ ID NO: 54584 - protein, 11 aa, Mycobacterium tuberculosis
WSGGAANAANG

SEQ ID NO: 54585 - protein, 11 aa, Mycobacterium tuberculosis
SGGAANAANGA

SEQ ID NO: 54586 - protein, 11 aa, Mycobacterium tuberculosis
GGAANAANGAL

SEQ ID NO: 54587 - protein, 11 aa, Mycobacterium tuberculosis
GAANAANGALG

SEQ ID NO: 54588 - protein, 11 aa, Mycobacterium tuberculosis
AANAANGALGA

SEQ ID NO: 54589 - protein, 11 aa, Mycobacterium tuberculosis
ANAANGALGAN

SEQ ID NO: 54590 - protein, 11 aa, Mycobacterium tuberculosis
NAANGALGANI

SEQ ID NO: 54591 - protein, 11 aa, Mycobacterium tuberculosis
AANGALGANIN

SEQ ID NO: 54592 - protein, 11 aa, Mycobacterium tuberculosis
ANGALGANINQ

SEQ ID NO: 54593 - protein, 11 aa, Mycobacterium tuberculosis
NGALGANINQL

SEQ ID NO: 54594 - protein, 11 aa, Mycobacterium tuberculosis
GALGANINQLM

SEQ ID NO: 54595 - protein, 11 aa, Mycobacterium tuberculosis
ALGANINQLMT

SEQ ID NO: 54596 - protein, 11 aa, Mycobacterium tuberculosis
LGANINQLMTL

SEQ ID NO: 54597 - protein, 11 aa, Mycobacterium tuberculosis
GANINQLMTLQ

SEQ ID NO: 54598 - protein, 11 aa, Mycobacterium tuberculosis
ANINQLMTLQD

SEQ ID NO: 54599 - protein, 11 aa, Mycobacterium tuberculosis
NINQLMTLQDY

SEQ ID NO: 54600 - protein, 11 aa, Mycobacterium tuberculosis
INQLMTLQDYL

SEQ ID NO: 54601 - protein, 11 aa, Mycobacterium tuberculosis
NQLMTLQDYLA

SEQ ID NO: 54602 - protein, 11 aa, Mycobacterium tuberculosis
QLMTLQDYLAT

SEQ ID NO: 54603 - protein, 11 aa, Mycobacterium tuberculosis
LMTLQDYLATV

SEQ ID NO: 54604 - protein, 11 aa, Mycobacterium tuberculosis
MTLQDYLATVI

SEQ ID NO: 54605 - protein, 11 aa, Mycobacterium tuberculosis
TLQDYLATVIT

SEQ ID NO: 54606 - protein, 11 aa, Mycobacterium tuberculosis
LQDYLATVITW

SEQ ID NO: 54607 - protein, 11 aa, Mycobacterium tuberculosis
QDYLATVITWH

SEQ ID NO: 54608 - protein, 11 aa, Mycobacterium tuberculosis
DYLATVITWHR

SEQ ID NO: 54609 - protein, 11 aa, Mycobacterium tuberculosis
YLATVITWHRH

SEQ ID NO: 54610 - protein, 11 aa, Mycobacterium tuberculosis
LATVITWHRHI

SEQ ID NO: 54611 - protein, 11 aa, Mycobacterium tuberculosis
ATVITWHRHIA

SEQ ID NO: 54612 - protein, 11 aa, Mycobacterium tuberculosis
TVITWHRHIAG

SEQ ID NO: 54613 - protein, 11 aa, Mycobacterium tuberculosis
VITWHRHIAGL

SEQ ID NO: 54614 - protein, 11 aa, Mycobacterium tuberculosis
ITWHRHIAGLI

SEQ ID NO: 54615 - protein, 11 aa, Mycobacterium tuberculosis
TWHRHIAGLIE

SEQ ID NO: 54616 - protein, 11 aa, Mycobacterium tuberculosis
WHRHIAGLIEQ

SEQ ID NO: 54617 - protein, 11 aa, Mycobacterium tuberculosis
HRHIAGLIEQA

SEQ ID NO: 54618 - protein, 11 aa, Mycobacterium tuberculosis
RHIAGLIEQAK

SEQ ID NO: 54619 - protein, 11 aa, Mycobacterium tuberculosis
HIAGLIEQAKS

SEQ ID NO: 54620 - protein, 11 aa, Mycobacterium tuberculosis
IAGLIEQAKSD

SEQ ID NO: 54621 - protein, 11 aa, Mycobacterium tuberculosis
AGLIEQAKSDI

SEQ ID NO: 54622 - protein, 11 aa, Mycobacterium tuberculosis
GLIEQAKSDIG

SEQ ID NO: 54623 - protein, 11 aa, Mycobacterium tuberculosis
LIEQAKSDIGN

SEQ ID NO: 54624 - protein, 11 aa, Mycobacterium tuberculosis
IEQAKSDIGNN

SEQ ID NO: 54625 - protein, 11 aa, Mycobacterium tuberculosis
EQAKSDIGNNV

SEQ ID NO: 54626 - protein, 11 aa, Mycobacterium tuberculosis
QAKSDIGNNVD

SEQ ID NO: 54627 - protein, 11 aa, Mycobacterium tuberculosis
AKSDIGNNVDG

SEQ ID NO: 54628 - protein, 11 aa, Mycobacterium tuberculosis
KSDIGNNVDGA

SEQ ID NO: 54629 - protein, 11 aa, Mycobacterium tuberculosis
SDIGNNVDGAQ

SEQ ID NO: 54630 - protein, 11 aa, Mycobacterium tuberculosis
DIGNNVDGAQR

SEQ ID NO: 54631 - protein, 11 aa, Mycobacterium tuberculosis
IGNNVDGAQRE

SEQ ID NO: 54632 - protein, 11 aa, Mycobacterium tuberculosis
GNNVDGAQREI

SEQ ID NO: 54633 - protein, 11 aa, Mycobacterium tuberculosis
NNVDGAQREID

SEQ ID NO: 54634 - protein, 11 aa, Mycobacterium tuberculosis
NVDGAQREIDI

SEQ ID NO: 54635 - protein, 11 aa, Mycobacterium tuberculosis
VDGAQREIDIL

SEQ ID NO: 54636 - protein, 11 aa, Mycobacterium tuberculosis
DGAQREIDILE

SEQ ID NO: 54637 - protein, 11 aa, Mycobacterium tuberculosis
GAQREIDILEN

SEQ ID NO: 54638 - protein, 11 aa, Mycobacterium tuberculosis
AQREIDILEND

SEQ ID NO: 54639 - protein, 11 aa, Mycobacterium tuberculosis
QREIDILENDP

SEQ ID NO: 54640 - protein, 11 aa, Mycobacterium tuberculosis
REIDILENDPS

SEQ ID NO: 54641 - protein, 11 aa, Mycobacterium tuberculosis
EIDILENDPSL

SEQ ID NO: 54642 - protein, 11 aa, Mycobacterium tuberculosis
IDILENDPSLD

SEQ ID NO: 54643 - protein, 11 aa, Mycobacterium tuberculosis
DILENDPSLDA

SEQ ID NO: 54644 - protein, 11 aa, Mycobacterium tuberculosis
ILENDPSLDAD

SEQ ID NO: 54645 - protein, 11 aa, Mycobacterium tuberculosis
LENDPSLDADE

SEQ ID NO: 54646 - protein, 11 aa, Mycobacterium tuberculosis
ENDPSLDADER

SEQ ID NO: 54647 - protein, 11 aa, Mycobacterium tuberculosis
NDPSLDADERH

SEQ ID NO: 54648 - protein, 11 aa, Mycobacterium tuberculosis
DPSLDADERHT

SEQ ID NO: 54649 - protein, 11 aa, Mycobacterium tuberculosis
PSLDADERHTA

SEQ ID NO: 54650 - protein, 11 aa, Mycobacterium tuberculosis
SLDADERHTAI

SEQ ID NO: 54651 - protein, 11 aa, Mycobacterium tuberculosis
LDADERHTAIN

SEQ ID NO: 54652 - protein, 11 aa, Mycobacterium tuberculosis
DADERHTAINS

SEQ ID NO: 54653 - protein, 11 aa, Mycobacterium tuberculosis
ADERHTAINSL

SEQ ID NO: 54654 - protein, 11 aa, Mycobacterium tuberculosis
DERHTAINSLV

SEQ ID NO: 54655 - protein, 11 aa, Mycobacterium tuberculosis
ERHTAINSLVT

SEQ ID NO: 54656 - protein, 11 aa, Mycobacterium tuberculosis
RHTAINSLVTA

SEQ ID NO: 54657 - protein, 11 aa, Mycobacterium tuberculosis
HTAINSLVTAT

SEQ ID NO: 54658 - protein, 11 aa, Mycobacterium tuberculosis
TAINSLVTATH

SEQ ID NO: 54659 - protein, 11 aa, Mycobacterium tuberculosis
AINSLVTATHG

SEQ ID NO: 54660 - protein, 11 aa, Mycobacterium tuberculosis
INSLVTATHGA

SEQ ID NO: 54661 - protein, 11 aa, Mycobacterium tuberculosis
NSLVTATHGAN

SEQ ID NO: 54662 - protein, 11 aa, Mycobacterium tuberculosis
SLVTATHGANV

SEQ ID NO: 54663 - protein, 11 aa, Mycobacterium tuberculosis
LVTATHGANVS

SEQ ID NO: 54664 - protein, 11 aa, Mycobacterium tuberculosis
VTATHGANVSL

SEQ ID NO: 54665 - protein, 11 aa, Mycobacterium tuberculosis
TATHGANVSLV

SEQ ID NO: 54666 - protein, 11 aa, Mycobacterium tuberculosis
ATHGANVSLVA

SEQ ID NO: 54667 - protein, 11 aa, Mycobacterium tuberculosis
THGANVSLVAE

SEQ ID NO: 54668 - protein, 11 aa, Mycobacterium tuberculosis
HGANVSLVAET

SEQ ID NO: 54669 - protein, 11 aa, Mycobacterium tuberculosis
GANVSLVAETA

SEQ ID NO: 54670 - protein, 11 aa, Mycobacterium tuberculosis
ANVSLVAETAE

SEQ ID NO: 54671 - protein, 11 aa, Mycobacterium tuberculosis
NVSLVAETAER

SEQ ID NO: 54672 - protein, 11 aa, Mycobacterium tuberculosis
VSLVAETAERV

SEQ ID NO: 54673 - protein, 11 aa, Mycobacterium tuberculosis
SLVAETAERVL

SEQ ID NO: 54674 - protein, 11 aa, Mycobacterium tuberculosis
LVAETAERVLE

SEQ ID NO: 54675 - protein, 11 aa, Mycobacterium tuberculosis
VAETAERVLES

SEQ ID NO: 54676 - protein, 11 aa, Mycobacterium tuberculosis
AETAERVLESK

SEQ ID NO: 54677 - protein, 11 aa, Mycobacterium tuberculosis
ETAERVLESKN

SEQ ID NO: 54678 - protein, 11 aa, Mycobacterium tuberculosis
TAERVLESKNW

SEQ ID NO: 54679 - protein, 11 aa, Mycobacterium tuberculosis
AERVLESKNWK

SEQ ID NO: 54680 - protein, 11 aa, Mycobacterium tuberculosis
ERVLESKNWKP

SEQ ID NO: 54681 - protein, 11 aa, Mycobacterium tuberculosis
RVLESKNWKPP

SEQ ID NO: 54682 - protein, 11 aa, Mycobacterium tuberculosis
VLESKNWKPPK

SEQ ID NO: 54683 - protein, 11 aa, Mycobacterium tuberculosis
LESKNWKPPKN

SEQ ID NO: 54684 - protein, 11 aa, Mycobacterium tuberculosis
ESKNWKPPKNA

SEQ ID NO: 54685 - protein, 11 aa, Mycobacterium tuberculosis
SKNWKPPKNAL

SEQ ID NO: 54686 - protein, 11 aa, Mycobacterium tuberculosis
KNWKPPKNALE

SEQ ID NO: 54687 - protein, 11 aa, Mycobacterium tuberculosis
NWKPPKNALED

SEQ ID NO: 54688 - protein, 11 aa, Mycobacterium tuberculosis
WKPPKNALEDL

SEQ ID NO: 54689 - protein, 11 aa, Mycobacterium tuberculosis
KPPKNALEDLL

SEQ ID NO: 54690 - protein, 11 aa, Mycobacterium tuberculosis
PPKNALEDLLQ

SEQ ID NO: 54691 - protein, 11 aa, Mycobacterium tuberculosis
PKNALEDLLQQ

SEQ ID NO: 54692 - protein, 11 aa, Mycobacterium tuberculosis
KNALEDLLQQK

SEQ ID NO: 54693 - protein, 11 aa, Mycobacterium tuberculosis
NALEDLLQQKS

SEQ ID NO: 54694 - protein, 11 aa, Mycobacterium tuberculosis
ALEDLLQQKSP

SEQ ID NO: 54695 - protein, 11 aa, Mycobacterium tuberculosis
LEDLLQQKSPP

SEQ ID NO: 54696 - protein, 11 aa, Mycobacterium tuberculosis
EDLLQQKSPPP

SEQ ID NO: 54697 - protein, 11 aa, Mycobacterium tuberculosis
DLLQQKSPPPP

SEQ ID NO: 54698 - protein, 11 aa, Mycobacterium tuberculosis
LLQQKSPPPPD

SEQ ID NO: 54699 - protein, 11 aa, Mycobacterium tuberculosis
LQQKSPPPPDV

SEQ ID NO: 54700 - protein, 11 aa, Mycobacterium tuberculosis
QQKSPPPPDVP

SEQ ID NO: 54701 - protein, 11 aa, Mycobacterium tuberculosis
QKSPPPPDVPT

SEQ ID NO: 54702 - protein, 11 aa, Mycobacterium tuberculosis
KSPPPPDVPTL

SEQ ID NO: 54703 - protein, 11 aa, Mycobacterium tuberculosis
SPPPPDVPTLV

SEQ ID NO: 54704 - protein, 11 aa, Mycobacterium tuberculosis
PPPPDVPTLVV

SEQ ID NO: 54705 - protein, 11 aa, Mycobacterium tuberculosis
PPPDVPTLVVP

SEQ ID NO: 54706 - protein, 11 aa, Mycobacterium tuberculosis
PPDVPTLVVPS

SEQ ID NO: 54707 - protein, 11 aa, Mycobacterium tuberculosis
PDVPTLVVPSP

SEQ ID NO: 54708 - protein, 11 aa, Mycobacterium tuberculosis
DVPTLVVPSPG

SEQ ID NO: 54709 - protein, 11 aa, Mycobacterium tuberculosis
VPTLVVPSPGT

SEQ ID NO: 54710 - protein, 11 aa, Mycobacterium tuberculosis
PTLVVPSPGTP

SEQ ID NO: 54711 - protein, 11 aa, Mycobacterium tuberculosis
TLVVPSPGTPG

SEQ ID NO: 54712 - protein, 11 aa, Mycobacterium tuberculosis
LVVPSPGTPGT

SEQ ID NO: 54713 - protein, 11 aa, Mycobacterium tuberculosis
VVPSPGTPGTP

SEQ ID NO: 54714 - protein, 11 aa, Mycobacterium tuberculosis
VPSPGTPGTPG

SEQ ID NO: 54715 - protein, 11 aa, Mycobacterium tuberculosis
PSPGTPGTPGT

SEQ ID NO: 54716 - protein, 11 aa, Mycobacterium tuberculosis
SPGTPGTPGTP

SEQ ID NO: 54717 - protein, 11 aa, Mycobacterium tuberculosis
PGTPGTPGTPI

SEQ ID NO: 54718 - protein, 11 aa, Mycobacterium tuberculosis
GTPGTPGTPIT

SEQ ID NO: 54719 - protein, 11 aa, Mycobacterium tuberculosis
TPGTPGTPITP

SEQ ID NO: 54720 - protein, 11 aa, Mycobacterium tuberculosis
PGTPGTPITPG

SEQ ID NO: 54721 - protein, 11 aa, Mycobacterium tuberculosis
GTPGTPITPGT

SEQ ID NO: 54722 - protein, 11 aa, Mycobacterium tuberculosis
TPGTPITPGTP

SEQ ID NO: 54723 - protein, 11 aa, Mycobacterium tuberculosis
PGTPITPGTPI

SEQ ID NO: 54724 - protein, 11 aa, Mycobacterium tuberculosis
GTPITPGTPIT

SEQ ID NO: 54725 - protein, 11 aa, Mycobacterium tuberculosis
TPITPGTPITP

SEQ ID NO: 54726 - protein, 11 aa, Mycobacterium tuberculosis
PITPGTPITPG

SEQ ID NO: 54727 - protein, 11 aa, Mycobacterium tuberculosis
ITPGTPITPGT

SEQ ID NO: 54728 - protein, 11 aa, Mycobacterium tuberculosis
TPGTPITPGTP

SEQ ID NO: 54729 - protein, 11 aa, Mycobacterium tuberculosis
PGTPITPGTPI

SEQ ID NO: 54730 - protein, 11 aa, Mycobacterium tuberculosis
GTPITPGTPIT

SEQ ID NO: 54731 - protein, 11 aa, Mycobacterium tuberculosis
TPITPGTPITP

SEQ ID NO: 54732 - protein, 11 aa, Mycobacterium tuberculosis
PITPGTPITPI

SEQ ID NO: 54733 - protein, 11 aa, Mycobacterium tuberculosis
ITPGTPITPIP

SEQ ID NO: 54734 - protein, 11 aa, Mycobacterium tuberculosis
TPGTPITPIPG

SEQ ID NO: 54735 - protein, 11 aa, Mycobacterium tuberculosis
PGTPITPIPGA

SEQ ID NO: 54736 - protein, 11 aa, Mycobacterium tuberculosis
GTPITPIPGAP

SEQ ID NO: 54737 - protein, 11 aa, Mycobacterium tuberculosis
TPITPIPGAPV

SEQ ID NO: 54738 - protein, 11 aa, Mycobacterium tuberculosis
PITPIPGAPVT

SEQ ID NO: 54739 - protein, 11 aa, Mycobacterium tuberculosis
ITPIPGAPVTP

SEQ ID NO: 54740 - protein, 11 aa, Mycobacterium tuberculosis
TPIPGAPVTPI

SEQ ID NO: 54741 - protein, 11 aa, Mycobacterium tuberculosis
PIPGAPVTPIT

SEQ ID NO: 54742 - protein, 11 aa, Mycobacterium tuberculosis
IPGAPVTPITP

SEQ ID NO: 54743 - protein, 11 aa, Mycobacterium tuberculosis
PGAPVTPITPT

SEQ ID NO: 54744 - protein, 11 aa, Mycobacterium tuberculosis
GAPVTPITPTP

SEQ ID NO: 54745 - protein, 11 aa, Mycobacterium tuberculosis
APVTPITPTPG

SEQ ID NO: 54746 - protein, 11 aa, Mycobacterium tuberculosis
PVTPITPTPGT

SEQ ID NO: 54747 - protein, 11 aa, Mycobacterium tuberculosis
VTPITPTPGTP

SEQ ID NO: 54748 - protein, 11 aa, Mycobacterium tuberculosis
TPITPTPGTPV

SEQ ID NO: 54749 - protein, 11 aa, Mycobacterium tuberculosis
PITPTPGTPVT

SEQ ID NO: 54750 - protein, 11 aa, Mycobacterium tuberculosis
ITPTPGTPVTP

SEQ ID NO: 54751 - protein, 11 aa, Mycobacterium tuberculosis
TPTPGTPVTPV

SEQ ID NO: 54752 - protein, 11 aa, Mycobacterium tuberculosis
PTPGTPVTPVT

SEQ ID NO: 54753 - protein, 11 aa, Mycobacterium tuberculosis
TPGTPVTPVTP

SEQ ID NO: 54754 - protein, 11 aa, Mycobacterium tuberculosis
PGTPVTPVTPG

SEQ ID NO: 54755 - protein, 11 aa, Mycobacterium tuberculosis
GTPVTPVTPGK

SEQ ID NO: 54756 - protein, 11 aa, Mycobacterium tuberculosis
TPVTPVTPGKP

SEQ ID NO: 54757 - protein, 11 aa, Mycobacterium tuberculosis
PVTPVTPGKPV

SEQ ID NO: 54758 - protein, 11 aa, Mycobacterium tuberculosis
VTPVTPGKPVT

SEQ ID NO: 54759 - protein, 11 aa, Mycobacterium tuberculosis
TPVTPGKPVTP

SEQ ID NO: 54760 - protein, 11 aa, Mycobacterium tuberculosis
PVTPGKPVTPV

SEQ ID NO: 54761 - protein, 11 aa, Mycobacterium tuberculosis
VTPGKPVTPVT

SEQ ID NO: 54762 - protein, 11 aa, Mycobacterium tuberculosis
TPGKPVTPVTP

SEQ ID NO: 54763 - protein, 11 aa, Mycobacterium tuberculosis
PGKPVTPVTPV

SEQ ID NO: 54764 - protein, 11 aa, Mycobacterium tuberculosis
GKPVTPVTPVK

SEQ ID NO: 54765 - protein, 11 aa, Mycobacterium tuberculosis
KPVTPVTPVKP

SEQ ID NO: 54766 - protein, 11 aa, Mycobacterium tuberculosis
PVTPVTPVKPG

SEQ ID NO: 54767 - protein, 11 aa, Mycobacterium tuberculosis
VTPVTPVKPGT

SEQ ID NO: 54768 - protein, 11 aa, Mycobacterium tuberculosis
TPVTPVKPGTP

SEQ ID NO: 54769 - protein, 11 aa, Mycobacterium tuberculosis
PVTPVKPGTPG

SEQ ID NO: 54770 - protein, 11 aa, Mycobacterium tuberculosis
VTPVKPGTPGE

SEQ ID NO: 54771 - protein, 11 aa, Mycobacterium tuberculosis
TPVKPGTPGEP

SEQ ID NO: 54772 - protein, 11 aa, Mycobacterium tuberculosis
PVKPGTPGEPT

SEQ ID NO: 54773 - protein, 11 aa, Mycobacterium tuberculosis
VKPGTPGEPTP

SEQ ID NO: 54774 - protein, 11 aa, Mycobacterium tuberculosis
KPGTPGEPTPI

SEQ ID NO: 54775 - protein, 11 aa, Mycobacterium tuberculosis
PGTPGEPTPIT

SEQ ID NO: 54776 - protein, 11 aa, Mycobacterium tuberculosis
GTPGEPTPITP

SEQ ID NO: 54777 - protein, 11 aa, Mycobacterium tuberculosis
TPGEPTPITPV

SEQ ID NO: 54778 - protein, 11 aa, Mycobacterium tuberculosis
PGEPTPITPVT

SEQ ID NO: 54779 - protein, 11 aa, Mycobacterium tuberculosis
GEPTPITPVTP

SEQ ID NO: 54780 - protein, 11 aa, Mycobacterium tuberculosis
EPTPITPVTPP

SEQ ID NO: 54781 - protein, 11 aa, Mycobacterium tuberculosis
PTPITPVTPPV

SEQ ID NO: 54782 - protein, 11 aa, Mycobacterium tuberculosis
TPITPVTPPVA

SEQ ID NO: 54783 - protein, 11 aa, Mycobacterium tuberculosis
PITPVTPPVAP

SEQ ID NO: 54784 - protein, 11 aa, Mycobacterium tuberculosis
ITPVTPPVAPA

SEQ ID NO: 54785 - protein, 11 aa, Mycobacterium tuberculosis
TPVTPPVAPAT

SEQ ID NO: 54786 - protein, 11 aa, Mycobacterium tuberculosis
PVTPPVAPATP

SEQ ID NO: 54787 - protein, 11 aa, Mycobacterium tuberculosis
VTPPVAPATPA

SEQ ID NO: 54788 - protein, 11 aa, Mycobacterium tuberculosis
TPPVAPATPAT

SEQ ID NO: 54789 - protein, 11 aa, Mycobacterium tuberculosis
PPVAPATPATP

SEQ ID NO: 54790 - protein, 11 aa, Mycobacterium tuberculosis
PVAPATPATPA

SEQ ID NO: 54791 - protein, 11 aa, Mycobacterium tuberculosis
VAPATPATPAT

SEQ ID NO: 54792 - protein, 11 aa, Mycobacterium tuberculosis
APATPATPATP

SEQ ID NO: 54793 - protein, 11 aa, Mycobacterium tuberculosis
PATPATPATPV

SEQ ID NO: 54794 - protein, 11 aa, Mycobacterium tuberculosis
ATPATPATPVT

SEQ ID NO: 54795 - protein, 11 aa, Mycobacterium tuberculosis
TPATPATPVTP

SEQ ID NO: 54796 - protein, 11 aa, Mycobacterium tuberculosis
PATPATPVTPA

SEQ ID NO: 54797 - protein, 11 aa, Mycobacterium tuberculosis
ATPATPVTPAP

SEQ ID NO: 54798 - protein, 11 aa, Mycobacterium tuberculosis
TPATPVTPAPA

SEQ ID NO: 54799 - protein, 11 aa, Mycobacterium tuberculosis
PATPVTPAPAP

SEQ ID NO: 54800 - protein, 11 aa, Mycobacterium tuberculosis
ATPVTPAPAPH

SEQ ID NO: 54801 - protein, 11 aa, Mycobacterium tuberculosis
TPVTPAPAPHP

SEQ ID NO: 54802 - protein, 11 aa, Mycobacterium tuberculosis
PVTPAPAPHPQ

SEQ ID NO: 54803 - protein, 11 aa, Mycobacterium tuberculosis
VTPAPAPHPQP

SEQ ID NO: 54804 - protein, 11 aa, Mycobacterium tuberculosis
TPAPAPHPQPA

SEQ ID NO: 54805 - protein, 11 aa, Mycobacterium tuberculosis
PAPAPHPQPAP

SEQ ID NO: 54806 - protein, 11 aa, Mycobacterium tuberculosis
APAPHPQPAPA

SEQ ID NO: 54807 - protein, 11 aa, Mycobacterium tuberculosis
PAPHPQPAPAP

SEQ ID NO: 54808 - protein, 11 aa, Mycobacterium tuberculosis
APHPQPAPAPA

SEQ ID NO: 54809 - protein, 11 aa, Mycobacterium tuberculosis
PHPQPAPAPAP

SEQ ID NO: 54810 - protein, 11 aa, Mycobacterium tuberculosis
HPQPAPAPAPS

SEQ ID NO: 54811 - protein, 11 aa, Mycobacterium tuberculosis
PQPAPAPAPSP

SEQ ID NO: 54812 - protein, 11 aa, Mycobacterium tuberculosis
QPAPAPAPSPG

SEQ ID NO: 54813 - protein, 11 aa, Mycobacterium tuberculosis
PAPAPAPSPGP

SEQ ID NO: 54814 - protein, 11 aa, Mycobacterium tuberculosis
APAPAPSPGPQ

SEQ ID NO: 54815 - protein, 11 aa, Mycobacterium tuberculosis
PAPAPSPGPQP

SEQ ID NO: 54816 - protein, 11 aa, Mycobacterium tuberculosis
APAPSPGPQPV

SEQ ID NO: 54817 - protein, 11 aa, Mycobacterium tuberculosis
PAPSPGPQPVT

SEQ ID NO: 54818 - protein, 11 aa, Mycobacterium tuberculosis
APSPGPQPVTP

SEQ ID NO: 54819 - protein, 11 aa, Mycobacterium tuberculosis
PSPGPQPVTPA

SEQ ID NO: 54820 - protein, 11 aa, Mycobacterium tuberculosis
SPGPQPVTPAT

SEQ ID NO: 54821 - protein, 11 aa, Mycobacterium tuberculosis
PGPQPVTPATP

SEQ ID NO: 54822 - protein, 11 aa, Mycobacterium tuberculosis
GPQPVTPATPG

SEQ ID NO: 54823 - protein, 11 aa, Mycobacterium tuberculosis
PQPVTPATPGP

SEQ ID NO: 54824 - protein, 11 aa, Mycobacterium tuberculosis
QPVTPATPGPS

SEQ ID NO: 54825 - protein, 11 aa, Mycobacterium tuberculosis
PVTPATPGPSG

SEQ ID NO: 54826 - protein, 11 aa, Mycobacterium tuberculosis
VTPATPGPSGP

SEQ ID NO: 54827 - protein, 11 aa, Mycobacterium tuberculosis
TPATPGPSGPA

SEQ ID NO: 54828 - protein, 11 aa, Mycobacterium tuberculosis
PATPGPSGPAT

SEQ ID NO: 54829 - protein, 11 aa, Mycobacterium tuberculosis
ATPGPSGPATP

SEQ ID NO: 54830 - protein, 11 aa, Mycobacterium tuberculosis
TPGPSGPATPG

SEQ ID NO: 54831 - protein, 11 aa, Mycobacterium tuberculosis
PGPSGPATPGT

SEQ ID NO: 54832 - protein, 11 aa, Mycobacterium tuberculosis
GPSGPATPGTP

SEQ ID NO: 54833 - protein, 11 aa, Mycobacterium tuberculosis
PSGPATPGTPG

SEQ ID NO: 54834 - protein, 11 aa, Mycobacterium tuberculosis
SGPATPGTPGG

SEQ ID NO: 54835 - protein, 11 aa, Mycobacterium tuberculosis
GPATPGTPGGE

SEQ ID NO: 54836 - protein, 11 aa, Mycobacterium tuberculosis
PATPGTPGGEP

SEQ ID NO: 54837 - protein, 11 aa, Mycobacterium tuberculosis
ATPGTPGGEPA

SEQ ID NO: 54838 - protein, 11 aa, Mycobacterium tuberculosis
TPGTPGGEPAP

SEQ ID NO: 54839 - protein, 11 aa, Mycobacterium tuberculosis
PGTPGGEPAPH

SEQ ID NO: 54840 - protein, 11 aa, Mycobacterium tuberculosis
GTPGGEPAPHV

SEQ ID NO: 54841 - protein, 11 aa, Mycobacterium tuberculosis
TPGGEPAPHVK

SEQ ID NO: 54842 - protein, 11 aa, Mycobacterium tuberculosis
PGGEPAPHVKP

SEQ ID NO: 54843 - protein, 11 aa, Mycobacterium tuberculosis
GGEPAPHVKPA

SEQ ID NO: 54844 - protein, 11 aa, Mycobacterium tuberculosis
GEPAPHVKPAA

SEQ ID NO: 54845 - protein, 11 aa, Mycobacterium tuberculosis
EPAPHVKPAAL

SEQ ID NO: 54846 - protein, 11 aa, Mycobacterium tuberculosis
PAPHVKPAALA

SEQ ID NO: 54847 - protein, 11 aa, Mycobacterium tuberculosis
APHVKPAALAE

SEQ ID NO: 54848 - protein, 11 aa, Mycobacterium tuberculosis
PHVKPAALAEQ

SEQ ID NO: 54849 - protein, 11 aa, Mycobacterium tuberculosis
HVKPAALAEQP

SEQ ID NO: 54850 - protein, 11 aa, Mycobacterium tuberculosis
VKPAALAEQPG

SEQ ID NO: 54851 - protein, 11 aa, Mycobacterium tuberculosis
KPAALAEQPGV

SEQ ID NO: 54852 - protein, 11 aa, Mycobacterium tuberculosis
PAALAEQPGVP

SEQ ID NO: 54853 - protein, 11 aa, Mycobacterium tuberculosis
AALAEQPGVPG

SEQ ID NO: 54854 - protein, 11 aa, Mycobacterium tuberculosis
ALAEQPGVPGQ

SEQ ID NO: 54855 - protein, 11 aa, Mycobacterium tuberculosis
LAEQPGVPGQH

SEQ ID NO: 54856 - protein, 11 aa, Mycobacterium tuberculosis
AEQPGVPGQHA

SEQ ID NO: 54857 - protein, 11 aa, Mycobacterium tuberculosis
EQPGVPGQHAG

SEQ ID NO: 54858 - protein, 11 aa, Mycobacterium tuberculosis
QPGVPGQHAGG

SEQ ID NO: 54859 - protein, 11 aa, Mycobacterium tuberculosis
PGVPGQHAGGG

SEQ ID NO: 54860 - protein, 11 aa, Mycobacterium tuberculosis
GVPGQHAGGGT

SEQ ID NO: 54861 - protein, 11 aa, Mycobacterium tuberculosis
VPGQHAGGGTQ

SEQ ID NO: 54862 - protein, 11 aa, Mycobacterium tuberculosis
PGQHAGGGTQS

SEQ ID NO: 54863 - protein, 11 aa, Mycobacterium tuberculosis
GQHAGGGTQSG

SEQ ID NO: 54864 - protein, 11 aa, Mycobacterium tuberculosis
QHAGGGTQSGP

SEQ ID NO: 54865 - protein, 11 aa, Mycobacterium tuberculosis
HAGGGTQSGPA

SEQ ID NO: 54866 - protein, 11 aa, Mycobacterium tuberculosis
AGGGTQSGPAH

SEQ ID NO: 54867 - protein, 11 aa, Mycobacterium tuberculosis
GGGTQSGPAHA

SEQ ID NO: 54868 - protein, 11 aa, Mycobacterium tuberculosis
GGTQSGPAHAD

SEQ ID NO: 54869 - protein, 11 aa, Mycobacterium tuberculosis
GTQSGPAHADE

SEQ ID NO: 54870 - protein, 11 aa, Mycobacterium tuberculosis
TQSGPAHADES

SEQ ID NO: 54871 - protein, 11 aa, Mycobacterium tuberculosis
QSGPAHADESA

SEQ ID NO: 54872 - protein, 11 aa, Mycobacterium tuberculosis
SGPAHADESAA

SEQ ID NO: 54873 - protein, 11 aa, Mycobacterium tuberculosis
GPAHADESAAS

SEQ ID NO: 54874 - protein, 11 aa, Mycobacterium tuberculosis
PAHADESAASV

SEQ ID NO: 54875 - protein, 11 aa, Mycobacterium tuberculosis
AHADESAASVT

SEQ ID NO: 54876 - protein, 11 aa, Mycobacterium tuberculosis
HADESAASVTP

SEQ ID NO: 54877 - protein, 11 aa, Mycobacterium tuberculosis
ADESAASVTPA

SEQ ID NO: 54878 - protein, 11 aa, Mycobacterium tuberculosis
DESAASVTPAA

SEQ ID NO: 54879 - protein, 11 aa, Mycobacterium tuberculosis
ESAASVTPAAA

SEQ ID NO: 54880 - protein, 11 aa, Mycobacterium tuberculosis
SAASVTPAAAS

SEQ ID NO: 54881 - protein, 11 aa, Mycobacterium tuberculosis
AASVTPAAASG

SEQ ID NO: 54882 - protein, 11 aa, Mycobacterium tuberculosis
ASVTPAAASGV

SEQ ID NO: 54883 - protein, 11 aa, Mycobacterium tuberculosis
SVTPAAASGVP

SEQ ID NO: 54884 - protein, 11 aa, Mycobacterium tuberculosis
VTPAAASGVPG

SEQ ID NO: 54885 - protein, 11 aa, Mycobacterium tuberculosis
TPAAASGVPGA

SEQ ID NO: 54886 - protein, 11 aa, Mycobacterium tuberculosis
PAAASGVPGAR

SEQ ID NO: 54887 - protein, 11 aa, Mycobacterium tuberculosis
AAASGVPGARA

SEQ ID NO: 54888 - protein, 11 aa, Mycobacterium tuberculosis
AASGVPGARAA

SEQ ID NO: 54889 - protein, 11 aa, Mycobacterium tuberculosis
ASGVPGARAAA

SEQ ID NO: 54890 - protein, 11 aa, Mycobacterium tuberculosis
SGVPGARAAAA

SEQ ID NO: 54891 - protein, 11 aa, Mycobacterium tuberculosis
GVPGARAAAAA

SEQ ID NO: 54892 - protein, 11 aa, Mycobacterium tuberculosis
VPGARAAAAAP

SEQ ID NO: 54893 - protein, 11 aa, Mycobacterium tuberculosis
PGARAAAAAPS

SEQ ID NO: 54894 - protein, 11 aa, Mycobacterium tuberculosis
GARAAAAAPSG

SEQ ID NO: 54895 - protein, 11 aa, Mycobacterium tuberculosis
ARAAAAAPSGT

SEQ ID NO: 54896 - protein, 11 aa, Mycobacterium tuberculosis
RAAAAAPSGTA

SEQ ID NO: 54897 - protein, 11 aa, Mycobacterium tuberculosis
AAAAAPSGTAV

SEQ ID NO: 54898 - protein, 11 aa, Mycobacterium tuberculosis
AAAAPSGTAVG

SEQ ID NO: 54899 - protein, 11 aa, Mycobacterium tuberculosis
AAAPSGTAVGA

SEQ ID NO: 54900 - protein, 11 aa, Mycobacterium tuberculosis
AAPSGTAVGAG

SEQ ID NO: 54901 - protein, 11 aa, Mycobacterium tuberculosis
APSGTAVGAGA

SEQ ID NO: 54902 - protein, 11 aa, Mycobacterium tuberculosis
PSGTAVGAGAR

SEQ ID NO: 54903 - protein, 11 aa, Mycobacterium tuberculosis
SGTAVGAGARS

SEQ ID NO: 54904 - protein, 11 aa, Mycobacterium tuberculosis
GTAVGAGARSS

SEQ ID NO: 54905 - protein, 11 aa, Mycobacterium tuberculosis
TAVGAGARSSV

SEQ ID NO: 54906 - protein, 11 aa, Mycobacterium tuberculosis
AVGAGARSSVG

SEQ ID NO: 54907 - protein, 11 aa, Mycobacterium tuberculosis
VGAGARSSVGT

SEQ ID NO: 54908 - protein, 11 aa, Mycobacterium tuberculosis
GAGARSSVGTA

SEQ ID NO: 54909 - protein, 11 aa, Mycobacterium tuberculosis
AGARSSVGTAA

SEQ ID NO: 54910 - protein, 11 aa, Mycobacterium tuberculosis
GARSSVGTAAA

SEQ ID NO: 54911 - protein, 11 aa, Mycobacterium tuberculosis
ARSSVGTAAAS

SEQ ID NO: 54912 - protein, 11 aa, Mycobacterium tuberculosis
RSSVGTAAASG

SEQ ID NO: 54913 - protein, 11 aa, Mycobacterium tuberculosis
SSVGTAAASGA

SEQ ID NO: 54914 - protein, 11 aa, Mycobacterium tuberculosis
SVGTAAASGAG

SEQ ID NO: 54915 - protein, 11 aa, Mycobacterium tuberculosis
VGTAAASGAGS

SEQ ID NO: 54916 - protein, 11 aa, Mycobacterium tuberculosis
GTAAASGAGSH

SEQ ID NO: 54917 - protein, 11 aa, Mycobacterium tuberculosis
TAAASGAGSHA

SEQ ID NO: 54918 - protein, 11 aa, Mycobacterium tuberculosis
AAASGAGSHAA

SEQ ID NO: 54919 - protein, 11 aa, Mycobacterium tuberculosis
AASGAGSHAAT

SEQ ID NO: 54920 - protein, 11 aa, Mycobacterium tuberculosis
ASGAGSHAATG

SEQ ID NO: 54921 - protein, 11 aa, Mycobacterium tuberculosis
SGAGSHAATGR

SEQ ID NO: 54922 - protein, 11 aa, Mycobacterium tuberculosis
GAGSHAATGRA

SEQ ID NO: 54923 - protein, 11 aa, Mycobacterium tuberculosis
AGSHAATGRAP

SEQ ID NO: 54924 - protein, 11 aa, Mycobacterium tuberculosis
GSHAATGRAPV

SEQ ID NO: 54925 - protein, 11 aa, Mycobacterium tuberculosis
SHAATGRAPVA

SEQ ID NO: 54926 - protein, 11 aa, Mycobacterium tuberculosis
HAATGRAPVAT

SEQ ID NO: 54927 - protein, 11 aa, Mycobacterium tuberculosis
AATGRAPVATS

SEQ ID NO: 54928 - protein, 11 aa, Mycobacterium tuberculosis
ATGRAPVATSD

SEQ ID NO: 54929 - protein, 11 aa, Mycobacterium tuberculosis
TGRAPVATSDK

SEQ ID NO: 54930 - protein, 11 aa, Mycobacterium tuberculosis
GRAPVATSDKA

SEQ ID NO: 54931 - protein, 11 aa, Mycobacterium tuberculosis
RAPVATSDKAA

SEQ ID NO: 54932 - protein, 11 aa, Mycobacterium tuberculosis
APVATSDKAAA

SEQ ID NO: 54933 - protein, 11 aa, Mycobacterium tuberculosis
PVATSDKAAAP

SEQ ID NO: 54934 - protein, 11 aa, Mycobacterium tuberculosis
VATSDKAAAPS

SEQ ID NO: 54935 - protein, 11 aa, Mycobacterium tuberculosis
ATSDKAAAPST

SEQ ID NO: 54936 - protein, 11 aa, Mycobacterium tuberculosis
TSDKAAAPSTR

SEQ ID NO: 54937 - protein, 11 aa, Mycobacterium tuberculosis
SDKAAAPSTRA

SEQ ID NO: 54938 - protein, 11 aa, Mycobacterium tuberculosis
DKAAAPSTRAA

SEQ ID NO: 54939 - protein, 11 aa, Mycobacterium tuberculosis
KAAAPSTRAAS

SEQ ID NO: 54940 - protein, 11 aa, Mycobacterium tuberculosis
AAAPSTRAASA

SEQ ID NO: 54941 - protein, 11 aa, Mycobacterium tuberculosis
AAPSTRAASAR

SEQ ID NO: 54942 - protein, 11 aa, Mycobacterium tuberculosis
APSTRAASART

SEQ ID NO: 54943 - protein, 11 aa, Mycobacterium tuberculosis
PSTRAASARTA

SEQ ID NO: 54944 - protein, 11 aa, Mycobacterium tuberculosis
STRAASARTAP

SEQ ID NO: 54945 - protein, 11 aa, Mycobacterium tuberculosis
TRAASARTAPP

SEQ ID NO: 54946 - protein, 11 aa, Mycobacterium tuberculosis
RAASARTAPPA

SEQ ID NO: 54947 - protein, 11 aa, Mycobacterium tuberculosis
AASARTAPPAR

SEQ ID NO: 54948 - protein, 11 aa, Mycobacterium tuberculosis
ASARTAPPARP

SEQ ID NO: 54949 - protein, 11 aa, Mycobacterium tuberculosis
SARTAPPARPP

SEQ ID NO: 54950 - protein, 11 aa, Mycobacterium tuberculosis
ARTAPPARPPS

SEQ ID NO: 54951 - protein, 11 aa, Mycobacterium tuberculosis
RTAPPARPPST

SEQ ID NO: 54952 - protein, 11 aa, Mycobacterium tuberculosis
TAPPARPPSTD

SEQ ID NO: 54953 - protein, 11 aa, Mycobacterium tuberculosis
APPARPPSTDH

SEQ ID NO: 54954 - protein, 11 aa, Mycobacterium tuberculosis
PPARPPSTDHI

SEQ ID NO: 54955 - protein, 11 aa, Mycobacterium tuberculosis
PARPPSTDHID

SEQ ID NO: 54956 - protein, 11 aa, Mycobacterium tuberculosis
ARPPSTDHIDK

SEQ ID NO: 54957 - protein, 11 aa, Mycobacterium tuberculosis
RPPSTDHIDKP

SEQ ID NO: 54958 - protein, 11 aa, Mycobacterium tuberculosis
PPSTDHIDKPD

SEQ ID NO: 54959 - protein, 11 aa, Mycobacterium tuberculosis
PSTDHIDKPDR

SEQ ID NO: 54960 - protein, 11 aa, Mycobacterium tuberculosis
STDHIDKPDRS

SEQ ID NO: 54961 - protein, 11 aa, Mycobacterium tuberculosis
TDHIDKPDRSE

SEQ ID NO: 54962 - protein, 11 aa, Mycobacterium tuberculosis
DHIDKPDRSES

SEQ ID NO: 54963 - protein, 11 aa, Mycobacterium tuberculosis
HIDKPDRSESA

SEQ ID NO: 54964 - protein, 11 aa, Mycobacterium tuberculosis
IDKPDRSESAD

SEQ ID NO: 54965 - protein, 11 aa, Mycobacterium tuberculosis
DKPDRSESADD

SEQ ID NO: 54966 - protein, 11 aa, Mycobacterium tuberculosis
KPDRSESADDG

SEQ ID NO: 54967 - protein, 11 aa, Mycobacterium tuberculosis
PDRSESADDGT

SEQ ID NO: 54968 - protein, 11 aa, Mycobacterium tuberculosis
DRSESADDGTP

SEQ ID NO: 54969 - protein, 11 aa, Mycobacterium tuberculosis
RSESADDGTPV

SEQ ID NO: 54970 - protein, 11 aa, Mycobacterium tuberculosis
SESADDGTPVS

SEQ ID NO: 54971 - protein, 11 aa, Mycobacterium tuberculosis
ESADDGTPVSM

SEQ ID NO: 54972 - protein, 11 aa, Mycobacterium tuberculosis
SADDGTPVSMI

SEQ ID NO: 54973 - protein, 11 aa, Mycobacterium tuberculosis
ADDGTPVSMIP

SEQ ID NO: 54974 - protein, 11 aa, Mycobacterium tuberculosis
DDGTPVSMIPV

SEQ ID NO: 54975 - protein, 11 aa, Mycobacterium tuberculosis
DGTPVSMIPVS

SEQ ID NO: 54976 - protein, 11 aa, Mycobacterium tuberculosis
GTPVSMIPVSA

SEQ ID NO: 54977 - protein, 11 aa, Mycobacterium tuberculosis
TPVSMIPVSAA

SEQ ID NO: 54978 - protein, 11 aa, Mycobacterium tuberculosis
PVSMIPVSAAR

SEQ ID NO: 54979 - protein, 11 aa, Mycobacterium tuberculosis
VSMIPVSAARA

SEQ ID NO: 54980 - protein, 11 aa, Mycobacterium tuberculosis
SMIPVSAARAA

SEQ ID NO: 54981 - protein, 11 aa, Mycobacterium tuberculosis
MIPVSAARAAR

SEQ ID NO: 54982 - protein, 11 aa, Mycobacterium tuberculosis
IPVSAARAARD

SEQ ID NO: 54983 - protein, 11 aa, Mycobacterium tuberculosis
PVSAARAARDA

SEQ ID NO: 54984 - protein, 11 aa, Mycobacterium tuberculosis
VSAARAARDAA

SEQ ID NO: 54985 - protein, 11 aa, Mycobacterium tuberculosis
SAARAARDAAT

SEQ ID NO: 54986 - protein, 11 aa, Mycobacterium tuberculosis
AARAARDAATA

SEQ ID NO: 54987 - protein, 11 aa, Mycobacterium tuberculosis
ARAARDAATAA

SEQ ID NO: 54988 - protein, 11 aa, Mycobacterium tuberculosis
RAARDAATAAA

SEQ ID NO: 54989 - protein, 11 aa, Mycobacterium tuberculosis
AARDAATAAAS

SEQ ID NO: 54990 - protein, 11 aa, Mycobacterium tuberculosis
ARDAATAAASA

SEQ ID NO: 54991 - protein, 11 aa, Mycobacterium tuberculosis
RDAATAAASAR

SEQ ID NO: 54992 - protein, 11 aa, Mycobacterium tuberculosis
DAATAAASARQ

SEQ ID NO: 54993 - protein, 11 aa, Mycobacterium tuberculosis
AATAAASARQR

SEQ ID NO: 54994 - protein, 11 aa, Mycobacterium tuberculosis
ATAAASARQRG

SEQ ID NO: 54995 - protein, 11 aa, Mycobacterium tuberculosis
TAAASARQRGR

SEQ ID NO: 54996 - protein, 11 aa, Mycobacterium tuberculosis
AAASARQRGRG

SEQ ID NO: 54997 - protein, 11 aa, Mycobacterium tuberculosis
AASARQRGRGD

SEQ ID NO: 54998 - protein, 11 aa, Mycobacterium tuberculosis
ASARQRGRGDA

SEQ ID NO: 54999 - protein, 11 aa, Mycobacterium tuberculosis
SARQRGRGDAL

SEQ ID NO: 55000 - protein, 11 aa, Mycobacterium tuberculosis
ARQRGRGDALR

SEQ ID NO: 55001 - protein, 11 aa, Mycobacterium tuberculosis
RQRGRGDALRL

SEQ ID NO: 55002 - protein, 11 aa, Mycobacterium tuberculosis
QRGRGDALRLA

SEQ ID NO: 55003 - protein, 11 aa, Mycobacterium tuberculosis
RGRGDALRLAR

SEQ ID NO: 55004 - protein, 11 aa, Mycobacterium tuberculosis
GRGDALRLARR

SEQ ID NO: 55005 - protein, 11 aa, Mycobacterium tuberculosis
RGDALRLARRI

SEQ ID NO: 55006 - protein, 11 aa, Mycobacterium tuberculosis
GDALRLARRIA

SEQ ID NO: 55007 - protein, 11 aa, Mycobacterium tuberculosis
DALRLARRIAA

SEQ ID NO: 55008 - protein, 11 aa, Mycobacterium tuberculosis
ALRLARRIAAA

SEQ ID NO: 55009 - protein, 11 aa, Mycobacterium tuberculosis
LRLARRIAAAL

SEQ ID NO: 55010 - protein, 11 aa, Mycobacterium tuberculosis
RLARRIAAALN

SEQ ID NO: 55011 - protein, 11 aa, Mycobacterium tuberculosis
LARRIAAALNA

SEQ ID NO: 55012 - protein, 11 aa, Mycobacterium tuberculosis
ARRIAAALNAS

SEQ ID NO: 55013 - protein, 11 aa, Mycobacterium tuberculosis
RRIAAALNASD

SEQ ID NO: 55014 - protein, 11 aa, Mycobacterium tuberculosis
RIAAALNASDN

SEQ ID NO: 55015 - protein, 11 aa, Mycobacterium tuberculosis
IAAALNASDNN

SEQ ID NO: 55016 - protein, 11 aa, Mycobacterium tuberculosis
AAALNASDNNA

SEQ ID NO: 55017 - protein, 11 aa, Mycobacterium tuberculosis
AALNASDNNAG

SEQ ID NO: 55018 - protein, 11 aa, Mycobacterium tuberculosis
ALNASDNNAGD

SEQ ID NO: 55019 - protein, 11 aa, Mycobacterium tuberculosis
LNASDNNAGDY

SEQ ID NO: 55020 - protein, 11 aa, Mycobacterium tuberculosis
NASDNNAGDYG

SEQ ID NO: 55021 - protein, 11 aa, Mycobacterium tuberculosis
ASDNNAGDYGF

SEQ ID NO: 55022 - protein, 11 aa, Mycobacterium tuberculosis
SDNNAGDYGFF

SEQ ID NO: 55023 - protein, 11 aa, Mycobacterium tuberculosis
DNNAGDYGFFW

SEQ ID NO: 55024 - protein, 11 aa, Mycobacterium tuberculosis
NNAGDYGFFWI

SEQ ID NO: 55025 - protein, 11 aa, Mycobacterium tuberculosis
NAGDYGFFWIT

SEQ ID NO: 55026 - protein, 11 aa, Mycobacterium tuberculosis
AGDYGFFWITA

SEQ ID NO: 55027 - protein, 11 aa, Mycobacterium tuberculosis
GDYGFFWITAV

SEQ ID NO: 55028 - protein, 11 aa, Mycobacterium tuberculosis
DYGFFWITAVT

SEQ ID NO: 55029 - protein, 11 aa, Mycobacterium tuberculosis
YGFFWITAVTT

SEQ ID NO: 55030 - protein, 11 aa, Mycobacterium tuberculosis
GFFWITAVTTD

SEQ ID NO: 55031 - protein, 11 aa, Mycobacterium tuberculosis
FFWITAVTTDG

SEQ ID NO: 55032 - protein, 11 aa, Mycobacterium tuberculosis
FWITAVTTDGS

SEQ ID NO: 55033 - protein, 11 aa, Mycobacterium tuberculosis
WITAVTTDGSI

SEQ ID NO: 55034 - protein, 11 aa, Mycobacterium tuberculosis
ITAVTTDGSIV

SEQ ID NO: 55035 - protein, 11 aa, Mycobacterium tuberculosis
TAVTTDGSIVV

SEQ ID NO: 55036 - protein, 11 aa, Mycobacterium tuberculosis
AVTTDGSIVVA

SEQ ID NO: 55037 - protein, 11 aa, Mycobacterium tuberculosis
VTTDGSIVVAN

SEQ ID NO: 55038 - protein, 11 aa, Mycobacterium tuberculosis
TTDGSIVVANS

SEQ ID NO: 55039 - protein, 11 aa, Mycobacterium tuberculosis
TDGSIVVANSY

SEQ ID NO: 55040 - protein, 11 aa, Mycobacterium tuberculosis
DGSIVVANSYG

SEQ ID NO: 55041 - protein, 11 aa, Mycobacterium tuberculosis
GSIVVANSYGL

SEQ ID NO: 55042 - protein, 11 aa, Mycobacterium tuberculosis
SIVVANSYGLA

SEQ ID NO: 55043 - protein, 11 aa, Mycobacterium tuberculosis
IVVANSYGLAY

SEQ ID NO: 55044 - protein, 11 aa, Mycobacterium tuberculosis
VVANSYGLAYI

SEQ ID NO: 55045 - protein, 11 aa, Mycobacterium tuberculosis
VANSYGLAYIP

SEQ ID NO: 55046 - protein, 11 aa, Mycobacterium tuberculosis
ANSYGLAYIPD

SEQ ID NO: 55047 - protein, 11 aa, Mycobacterium tuberculosis
NSYGLAYIPDG

SEQ ID NO: 55048 - protein, 11 aa, Mycobacterium tuberculosis
SYGLAYIPDGM

SEQ ID NO: 55049 - protein, 11 aa, Mycobacterium tuberculosis
YGLAYIPDGME

SEQ ID NO: 55050 - protein, 11 aa, Mycobacterium tuberculosis
GLAYIPDGMEL

SEQ ID NO: 55051 - protein, 11 aa, Mycobacterium tuberculosis
LAYIPDGMELP

SEQ ID NO: 55052 - protein, 11 aa, Mycobacterium tuberculosis
AYIPDGMELPN

SEQ ID NO: 55053 - protein, 11 aa, Mycobacterium tuberculosis
YIPDGMELPNK

SEQ ID NO: 55054 - protein, 11 aa, Mycobacterium tuberculosis
IPDGMELPNKV

SEQ ID NO: 55055 - protein, 11 aa, Mycobacterium tuberculosis
PDGMELPNKVY

SEQ ID NO: 55056 - protein, 11 aa, Mycobacterium tuberculosis
DGMELPNKVYL

SEQ ID NO: 55057 - protein, 11 aa, Mycobacterium tuberculosis
GMELPNKVYLA

SEQ ID NO: 55058 - protein, 11 aa, Mycobacterium tuberculosis
MELPNKVYLAS

SEQ ID NO: 55059 - protein, 11 aa, Mycobacterium tuberculosis
ELPNKVYLASA

SEQ ID NO: 55060 - protein, 11 aa, Mycobacterium tuberculosis
LPNKVYLASAD

SEQ ID NO: 55061 - protein, 11 aa, Mycobacterium tuberculosis
PNKVYLASADH

SEQ ID NO: 55062 - protein, 11 aa, Mycobacterium tuberculosis
NKVYLASADHA

SEQ ID NO: 55063 - protein, 11 aa, Mycobacterium tuberculosis
KVYLASADHAI

SEQ ID NO: 55064 - protein, 11 aa, Mycobacterium tuberculosis
VYLASADHAIP

SEQ ID NO: 55065 - protein, 11 aa, Mycobacterium tuberculosis
YLASADHAIPV

SEQ ID NO: 55066 - protein, 11 aa, Mycobacterium tuberculosis
LASADHAIPVD

SEQ ID NO: 55067 - protein, 11 aa, Mycobacterium tuberculosis
ASADHAIPVDE

SEQ ID NO: 55068 - protein, 11 aa, Mycobacterium tuberculosis
SADHAIPVDEI

SEQ ID NO: 55069 - protein, 11 aa, Mycobacterium tuberculosis
ADHAIPVDEIA

SEQ ID NO: 55070 - protein, 11 aa, Mycobacterium tuberculosis
DHAIPVDEIAR

SEQ ID NO: 55071 - protein, 11 aa, Mycobacterium tuberculosis
HAIPVDEIARC

SEQ ID NO: 55072 - protein, 11 aa, Mycobacterium tuberculosis
AIPVDEIARCA

SEQ ID NO: 55073 - protein, 11 aa, Mycobacterium tuberculosis
IPVDEIARCAT

SEQ ID NO: 55074 - protein, 11 aa, Mycobacterium tuberculosis
PVDEIARCATY

SEQ ID NO: 55075 - protein, 11 aa, Mycobacterium tuberculosis
VDEIARCATYP

SEQ ID NO: 55076 - protein, 11 aa, Mycobacterium tuberculosis
DEIARCATYPV

SEQ ID NO: 55077 - protein, 11 aa, Mycobacterium tuberculosis
EIARCATYPVL

SEQ ID NO: 55078 - protein, 11 aa, Mycobacterium tuberculosis
IARCATYPVLA

SEQ ID NO: 55079 - protein, 11 aa, Mycobacterium tuberculosis
ARCATYPVLAV

SEQ ID NO: 55080 - protein, 11 aa, Mycobacterium tuberculosis
RCATYPVLAVQ

SEQ ID NO: 55081 - protein, 11 aa, Mycobacterium tuberculosis
CATYPVLAVQA

SEQ ID NO: 55082 - protein, 11 aa, Mycobacterium tuberculosis
ATYPVLAVQAW

SEQ ID NO: 55083 - protein, 11 aa, Mycobacterium tuberculosis
TYPVLAVQAWA

SEQ ID NO: 55084 - protein, 11 aa, Mycobacterium tuberculosis
YPVLAVQAWAA

SEQ ID NO: 55085 - protein, 11 aa, Mycobacterium tuberculosis
PVLAVQAWAAF

SEQ ID NO: 55086 - protein, 11 aa, Mycobacterium tuberculosis
VLAVQAWAAFH

SEQ ID NO: 55087 - protein, 11 aa, Mycobacterium tuberculosis
LAVQAWAAFHD

SEQ ID NO: 55088 - protein, 11 aa, Mycobacterium tuberculosis
AVQAWAAFHDM

SEQ ID NO: 55089 - protein, 11 aa, Mycobacterium tuberculosis
VQAWAAFHDMT

SEQ ID NO: 55090 - protein, 11 aa, Mycobacterium tuberculosis
QAWAAFHDMTL

SEQ ID NO: 55091 - protein, 11 aa, Mycobacterium tuberculosis
AWAAFHDMTLR

SEQ ID NO: 55092 - protein, 11 aa, Mycobacterium tuberculosis
WAAFHDMTLRA

SEQ ID NO: 55093 - protein, 11 aa, Mycobacterium tuberculosis
AAFHDMTLRAV

SEQ ID NO: 55094 - protein, 11 aa, Mycobacterium tuberculosis
AFHDMTLRAVI

SEQ ID NO: 55095 - protein, 11 aa, Mycobacterium tuberculosis
FHDMTLRAVIG

SEQ ID NO: 55096 - protein, 11 aa, Mycobacterium tuberculosis
HDMTLRAVIGT

SEQ ID NO: 55097 - protein, 11 aa, Mycobacterium tuberculosis
DMTLRAVIGTA

SEQ ID NO: 55098 - protein, 11 aa, Mycobacterium tuberculosis
MTLRAVIGTAE

SEQ ID NO: 55099 - protein, 11 aa, Mycobacterium tuberculosis
TLRAVIGTAEQ

SEQ ID NO: 55100 - protein, 11 aa, Mycobacterium tuberculosis
LRAVIGTAEQL

SEQ ID NO: 55101 - protein, 11 aa, Mycobacterium tuberculosis
RAVIGTAEQLA

SEQ ID NO: 55102 - protein, 11 aa, Mycobacterium tuberculosis
AVIGTAEQLAS

SEQ ID NO: 55103 - protein, 11 aa, Mycobacterium tuberculosis
VIGTAEQLASS

SEQ ID NO: 55104 - protein, 11 aa, Mycobacterium tuberculosis
IGTAEQLASSD

SEQ ID NO: 55105 - protein, 11 aa, Mycobacterium tuberculosis
GTAEQLASSDP

SEQ ID NO: 55106 - protein, 11 aa, Mycobacterium tuberculosis
TAEQLASSDPG

SEQ ID NO: 55107 - protein, 11 aa, Mycobacterium tuberculosis
AEQLASSDPGV

SEQ ID NO: 55108 - protein, 11 aa, Mycobacterium tuberculosis
EQLASSDPGVA

SEQ ID NO: 55109 - protein, 11 aa, Mycobacterium tuberculosis
QLASSDPGVAK

SEQ ID NO: 55110 - protein, 11 aa, Mycobacterium tuberculosis
LASSDPGVAKI

SEQ ID NO: 55111 - protein, 11 aa, Mycobacterium tuberculosis
ASSDPGVAKIV

SEQ ID NO: 55112 - protein, 11 aa, Mycobacterium tuberculosis
SSDPGVAKIVL

SEQ ID NO: 55113 - protein, 11 aa, Mycobacterium tuberculosis
SDPGVAKIVLE

SEQ ID NO: 55114 - protein, 11 aa, Mycobacterium tuberculosis
DPGVAKIVLEP

SEQ ID NO: 55115 - protein, 11 aa, Mycobacterium tuberculosis
PGVAKIVLEPD

SEQ ID NO: 55116 - protein, 11 aa, Mycobacterium tuberculosis
GVAKIVLEPDD

SEQ ID NO: 55117 - protein, 11 aa, Mycobacterium tuberculosis
VAKIVLEPDDI

SEQ ID NO: 55118 - protein, 11 aa, Mycobacterium tuberculosis
AKIVLEPDDIP

SEQ ID NO: 55119 - protein, 11 aa, Mycobacterium tuberculosis
KIVLEPDDIPE

SEQ ID NO: 55120 - protein, 11 aa, Mycobacterium tuberculosis
IVLEPDDIPES

SEQ ID NO: 55121 - protein, 11 aa, Mycobacterium tuberculosis
VLEPDDIPESG

SEQ ID NO: 55122 - protein, 11 aa, Mycobacterium tuberculosis
LEPDDIPESGK

SEQ ID NO: 55123 - protein, 11 aa, Mycobacterium tuberculosis
EPDDIPESGKM

SEQ ID NO: 55124 - protein, 11 aa, Mycobacterium tuberculosis
PDDIPESGKMT

SEQ ID NO: 55125 - protein, 11 aa, Mycobacterium tuberculosis
DDIPESGKMTG

SEQ ID NO: 55126 - protein, 11 aa, Mycobacterium tuberculosis
DIPESGKMTGR

SEQ ID NO: 55127 - protein, 11 aa, Mycobacterium tuberculosis
IPESGKMTGRS

SEQ ID NO: 55128 - protein, 11 aa, Mycobacterium tuberculosis
PESGKMTGRSR

SEQ ID NO: 55129 - protein, 11 aa, Mycobacterium tuberculosis
ESGKMTGRSRL

SEQ ID NO: 55130 - protein, 11 aa, Mycobacterium tuberculosis
SGKMTGRSRLE

SEQ ID NO: 55131 - protein, 11 aa, Mycobacterium tuberculosis
GKMTGRSRLEV

SEQ ID NO: 55132 - protein, 11 aa, Mycobacterium tuberculosis
KMTGRSRLEVV

SEQ ID NO: 55133 - protein, 11 aa, Mycobacterium tuberculosis
MTGRSRLEVVD

SEQ ID NO: 55134 - protein, 11 aa, Mycobacterium tuberculosis
TGRSRLEVVDP

SEQ ID NO: 55135 - protein, 11 aa, Mycobacterium tuberculosis
GRSRLEVVDPS

SEQ ID NO: 55136 - protein, 11 aa, Mycobacterium tuberculosis
RSRLEVVDPSA

SEQ ID NO: 55137 - protein, 11 aa, Mycobacterium tuberculosis
SRLEVVDPSAA

SEQ ID NO: 55138 - protein, 11 aa, Mycobacterium tuberculosis
RLEVVDPSAAA

SEQ ID NO: 55139 - protein, 11 aa, Mycobacterium tuberculosis
LEVVDPSAAAQ

SEQ ID NO: 55140 - protein, 11 aa, Mycobacterium tuberculosis
EVVDPSAAAQL

SEQ ID NO: 55141 - protein, 11 aa, Mycobacterium tuberculosis
VVDPSAAAQLA

SEQ ID NO: 55142 - protein, 11 aa, Mycobacterium tuberculosis
VDPSAAAQLAD

SEQ ID NO: 55143 - protein, 11 aa, Mycobacterium tuberculosis
DPSAAAQLADT

SEQ ID NO: 55144 - protein, 11 aa, Mycobacterium tuberculosis
PSAAAQLADTT

SEQ ID NO: 55145 - protein, 11 aa, Mycobacterium tuberculosis
SAAAQLADTTD

SEQ ID NO: 55146 - protein, 11 aa, Mycobacterium tuberculosis
AAAQLADTTDQ

SEQ ID NO: 55147 - protein, 11 aa, Mycobacterium tuberculosis
AAQLADTTDQR

SEQ ID NO: 55148 - protein, 11 aa, Mycobacterium tuberculosis
AQLADTTDQRL

SEQ ID NO: 55149 - protein, 11 aa, Mycobacterium tuberculosis
QLADTTDQRLL

SEQ ID NO: 55150 - protein, 11 aa, Mycobacterium tuberculosis
LADTTDQRLLD

SEQ ID NO: 55151 - protein, 11 aa, Mycobacterium tuberculosis
ADTTDQRLLDL

SEQ ID NO: 55152 - protein, 11 aa, Mycobacterium tuberculosis
DTTDQRLLDLL

SEQ ID NO: 55153 - protein, 11 aa, Mycobacterium tuberculosis
TTDQRLLDLLP

SEQ ID NO: 55154 - protein, 11 aa, Mycobacterium tuberculosis
TDQRLLDLLPP

SEQ ID NO: 55155 - protein, 11 aa, Mycobacterium tuberculosis
DQRLLDLLPPA

SEQ ID NO: 55156 - protein, 11 aa, Mycobacterium tuberculosis
QRLLDLLPPAP

SEQ ID NO: 55157 - protein, 11 aa, Mycobacterium tuberculosis
RLLDLLPPAPV

SEQ ID NO: 55158 - protein, 11 aa, Mycobacterium tuberculosis
LLDLLPPAPVD

SEQ ID NO: 55159 - protein, 11 aa, Mycobacterium tuberculosis
LDLLPPAPVDV

SEQ ID NO: 55160 - protein, 11 aa, Mycobacterium tuberculosis
DLLPPAPVDVN

SEQ ID NO: 55161 - protein, 11 aa, Mycobacterium tuberculosis
LLPPAPVDVNP

SEQ ID NO: 55162 - protein, 11 aa, Mycobacterium tuberculosis
LPPAPVDVNPP

SEQ ID NO: 55163 - protein, 11 aa, Mycobacterium tuberculosis
PPAPVDVNPPG

SEQ ID NO: 55164 - protein, 11 aa, Mycobacterium tuberculosis
PAPVDVNPPGD

SEQ ID NO: 55165 - protein, 11 aa, Mycobacterium tuberculosis
APVDVNPPGDE

SEQ ID NO: 55166 - protein, 11 aa, Mycobacterium tuberculosis
PVDVNPPGDER

SEQ ID NO: 55167 - protein, 11 aa, Mycobacterium tuberculosis
VDVNPPGDERH

SEQ ID NO: 55168 - protein, 11 aa, Mycobacterium tuberculosis
DVNPPGDERHM

SEQ ID NO: 55169 - protein, 11 aa, Mycobacterium tuberculosis
VNPPGDERHML

SEQ ID NO: 55170 - protein, 11 aa, Mycobacterium tuberculosis
NPPGDERHMLW

SEQ ID NO: 55171 - protein, 11 aa, Mycobacterium tuberculosis
PPGDERHMLWF

SEQ ID NO: 55172 - protein, 11 aa, Mycobacterium tuberculosis
PGDERHMLWFE

SEQ ID NO: 55173 - protein, 11 aa, Mycobacterium tuberculosis
GDERHMLWFEL

SEQ ID NO: 55174 - protein, 11 aa, Mycobacterium tuberculosis
DERHMLWFELM

SEQ ID NO: 55175 - protein, 11 aa, Mycobacterium tuberculosis
ERHMLWFELMK

SEQ ID NO: 55176 - protein, 11 aa, Mycobacterium tuberculosis
RHMLWFELMKP

SEQ ID NO: 55177 - protein, 11 aa, Mycobacterium tuberculosis
HMLWFELMKPM

SEQ ID NO: 55178 - protein, 11 aa, Mycobacterium tuberculosis
MLWFELMKPMT

SEQ ID NO: 55179 - protein, 11 aa, Mycobacterium tuberculosis
LWFELMKPMTS

SEQ ID NO: 55180 - protein, 11 aa, Mycobacterium tuberculosis
WFELMKPMTST

SEQ ID NO: 55181 - protein, 11 aa, Mycobacterium tuberculosis
FELMKPMTSTA

SEQ ID NO: 55182 - protein, 11 aa, Mycobacterium tuberculosis
ELMKPMTSTAT

SEQ ID NO: 55183 - protein, 11 aa, Mycobacterium tuberculosis
LMKPMTSTATG

SEQ ID NO: 55184 - protein, 11 aa, Mycobacterium tuberculosis
MKPMTSTATGR

SEQ ID NO: 55185 - protein, 11 aa, Mycobacterium tuberculosis
KPMTSTATGRE

SEQ ID NO: 55186 - protein, 11 aa, Mycobacterium tuberculosis
PMTSTATGREA

SEQ ID NO: 55187 - protein, 11 aa, Mycobacterium tuberculosis
MTSTATGREAA

SEQ ID NO: 55188 - protein, 11 aa, Mycobacterium tuberculosis
TSTATGREAAH

SEQ ID NO: 55189 - protein, 11 aa, Mycobacterium tuberculosis
STATGREAAHL

SEQ ID NO: 55190 - protein, 11 aa, Mycobacterium tuberculosis
TATGREAAHLR

SEQ ID NO: 55191 - protein, 11 aa, Mycobacterium tuberculosis
ATGREAAHLRA

SEQ ID NO: 55192 - protein, 11 aa, Mycobacterium tuberculosis
TGREAAHLRAF

SEQ ID NO: 55193 - protein, 11 aa, Mycobacterium tuberculosis
GREAAHLRAFR

SEQ ID NO: 55194 - protein, 11 aa, Mycobacterium tuberculosis
REAAHLRAFRA

SEQ ID NO: 55195 - protein, 11 aa, Mycobacterium tuberculosis
EAAHLRAFRAY

SEQ ID NO: 55196 - protein, 11 aa, Mycobacterium tuberculosis
AAHLRAFRAYA

SEQ ID NO: 55197 - protein, 11 aa, Mycobacterium tuberculosis
AHLRAFRAYAA

SEQ ID NO: 55198 - protein, 11 aa, Mycobacterium tuberculosis
HLRAFRAYAAH

SEQ ID NO: 55199 - protein, 11 aa, Mycobacterium tuberculosis
LRAFRAYAAHS

SEQ ID NO: 55200 - protein, 11 aa, Mycobacterium tuberculosis
RAFRAYAAHSQ

SEQ ID NO: 55201 - protein, 11 aa, Mycobacterium tuberculosis
AFRAYAAHSQE

SEQ ID NO: 55202 - protein, 11 aa, Mycobacterium tuberculosis
FRAYAAHSQEI

SEQ ID NO: 55203 - protein, 11 aa, Mycobacterium tuberculosis
RAYAAHSQEIA

SEQ ID NO: 55204 - protein, 11 aa, Mycobacterium tuberculosis
AYAAHSQEIAL

SEQ ID NO: 55205 - protein, 11 aa, Mycobacterium tuberculosis
YAAHSQEIALH

SEQ ID NO: 55206 - protein, 11 aa, Mycobacterium tuberculosis
AAHSQEIALHQ

SEQ ID NO: 55207 - protein, 11 aa, Mycobacterium tuberculosis
AHSQEIALHQA

SEQ ID NO: 55208 - protein, 11 aa, Mycobacterium tuberculosis
HSQEIALHQAH

SEQ ID NO: 55209 - protein, 11 aa, Mycobacterium tuberculosis
SQEIALHQAHT

SEQ ID NO: 55210 - protein, 11 aa, Mycobacterium tuberculosis
QEIALHQAHTA

SEQ ID NO: 55211 - protein, 11 aa, Mycobacterium tuberculosis
EIALHQAHTAT

SEQ ID NO: 55212 - protein, 11 aa, Mycobacterium tuberculosis
IALHQAHTATD

SEQ ID NO: 55213 - protein, 11 aa, Mycobacterium tuberculosis
ALHQAHTATDA

SEQ ID NO: 55214 - protein, 11 aa, Mycobacterium tuberculosis
LHQAHTATDAA

SEQ ID NO: 55215 - protein, 11 aa, Mycobacterium tuberculosis
HQAHTATDAAV

SEQ ID NO: 55216 - protein, 11 aa, Mycobacterium tuberculosis
QAHTATDAAVQ

SEQ ID NO: 55217 - protein, 11 aa, Mycobacterium tuberculosis
AHTATDAAVQR

SEQ ID NO: 55218 - protein, 11 aa, Mycobacterium tuberculosis
HTATDAAVQRV

SEQ ID NO: 55219 - protein, 11 aa, Mycobacterium tuberculosis
TATDAAVQRVA

SEQ ID NO: 55220 - protein, 11 aa, Mycobacterium tuberculosis
ATDAAVQRVAV

SEQ ID NO: 55221 - protein, 11 aa, Mycobacterium tuberculosis
TDAAVQRVAVA

SEQ ID NO: 55222 - protein, 11 aa, Mycobacterium tuberculosis
DAAVQRVAVAD

SEQ ID NO: 55223 - protein, 11 aa, Mycobacterium tuberculosis
AAVQRVAVADW

SEQ ID NO: 55224 - protein, 11 aa, Mycobacterium tuberculosis
AVQRVAVADWL

SEQ ID NO: 55225 - protein, 11 aa, Mycobacterium tuberculosis
VQRVAVADWLY

SEQ ID NO: 55226 - protein, 11 aa, Mycobacterium tuberculosis
QRVAVADWLYW

SEQ ID NO: 55227 - protein, 11 aa, Mycobacterium tuberculosis
RVAVADWLYWQ

SEQ ID NO: 55228 - protein, 11 aa, Mycobacterium tuberculosis
VAVADWLYWQY

SEQ ID NO: 55229 - protein, 11 aa, Mycobacterium tuberculosis
AVADWLYWQYV

SEQ ID NO: 55230 - protein, 11 aa, Mycobacterium tuberculosis
VADWLYWQYVT

SEQ ID NO: 55231 - protein, 11 aa, Mycobacterium tuberculosis
ADWLYWQYVTG

SEQ ID NO: 55232 - protein, 11 aa, Mycobacterium tuberculosis
DWLYWQYVTGL

SEQ ID NO: 55233 - protein, 11 aa, Mycobacterium tuberculosis
WLYWQYVTGLL

SEQ ID NO: 55234 - protein, 11 aa, Mycobacterium tuberculosis
LYWQYVTGLLD

SEQ ID NO: 55235 - protein, 11 aa, Mycobacterium tuberculosis
YWQYVTGLLDR

SEQ ID NO: 55236 - protein, 11 aa, Mycobacterium tuberculosis
WQYVTGLLDRA

SEQ ID NO: 55237 - protein, 11 aa, Mycobacterium tuberculosis
QYVTGLLDRAL

SEQ ID NO: 55238 - protein, 11 aa, Mycobacterium tuberculosis
YVTGLLDRALA

SEQ ID NO: 55239 - protein, 11 aa, Mycobacterium tuberculosis
VTGLLDRALAA

SEQ ID NO: 55240 - protein, 11 aa, Mycobacterium tuberculosis
TGLLDRALAAA

SEQ ID NO: 55241 - protein, 11 aa, Mycobacterium tuberculosis
GLLDRALAAAC

SEQ ID NO: 55242 - protein, 8 aa, Mycobacterium tuberculosis
MSDQITYN

SEQ ID NO: 55243 - protein, 8 aa, Mycobacterium tuberculosis
SDQITYNP

SEQ ID NO: 55244 - protein, 8 aa, Mycobacterium tuberculosis
DQITYNPG

SEQ ID NO: 55245 - protein, 8 aa, Mycobacterium tuberculosis
QITYNPGA

SEQ ID NO: 55246 - protein, 8 aa, Mycobacterium tuberculosis
ITYNPGAV

SEQ ID NO: 55247 - protein, 8 aa, Mycobacterium tuberculosis
TYNPGAVS

SEQ ID NO: 55248 - protein, 8 aa, Mycobacterium tuberculosis
YNPGAVSD

SEQ ID NO: 55249 - protein, 8 aa, Mycobacterium tuberculosis
NPGAVSDF

SEQ ID NO: 55250 - protein, 8 aa, Mycobacterium tuberculosis
PGAVSDFA

SEQ ID NO: 55251 - protein, 8 aa, Mycobacterium tuberculosis
GAVSDFAS

SEQ ID NO: 55252 - protein, 8 aa, Mycobacterium tuberculosis
AVSDFASD

SEQ ID NO: 55253 - protein, 8 aa, Mycobacterium tuberculosis
VSDFASDV

SEQ ID NO: 55254 - protein, 8 aa, Mycobacterium tuberculosis
SDFASDVG

SEQ ID NO: 55255 - protein, 8 aa, Mycobacterium tuberculosis
DFASDVGS

SEQ ID NO: 55256 - protein, 8 aa, Mycobacterium tuberculosis
FASDVGSR

SEQ ID NO: 55257 - protein, 8 aa, Mycobacterium tuberculosis
ASDVGSRA

SEQ ID NO: 55258 - protein, 8 aa, Mycobacterium tuberculosis
SDVGSRAG

SEQ ID NO: 55259 - protein, 8 aa, Mycobacterium tuberculosis
DVGSRAGQ

SEQ ID NO: 55260 - protein, 8 aa, Mycobacterium tuberculosis
VGSRAGQL

SEQ ID NO: 55261 - protein, 8 aa, Mycobacterium tuberculosis
GSRAGQLH

SEQ ID NO: 55262 - protein, 8 aa, Mycobacterium tuberculosis
SRAGQLHM

SEQ ID NO: 55263 - protein, 8 aa, Mycobacterium tuberculosis
RAGQLHMI

SEQ ID NO: 55264 - protein, 8 aa, Mycobacterium tuberculosis
AGQLHMIY

SEQ ID NO: 55265 - protein, 8 aa, Mycobacterium tuberculosis
GQLHMIYE

SEQ ID NO: 55266 - protein, 8 aa, Mycobacterium tuberculosis
QLHMIYED

SEQ ID NO: 55267 - protein, 8 aa, Mycobacterium tuberculosis
LHMIYEDT

SEQ ID NO: 55268 - protein, 8 aa, Mycobacterium tuberculosis
HMIYEDTA

SEQ ID NO: 55269 - protein, 8 aa, Mycobacterium tuberculosis
MIYEDTAS

SEQ ID NO: 55270 - protein, 8 aa, Mycobacterium tuberculosis
IYEDTASK

SEQ ID NO: 55271 - protein, 8 aa, Mycobacterium tuberculosis
YEDTASKT

SEQ ID NO: 55272 - protein, 8 aa, Mycobacterium tuberculosis
EDTASKTN

SEQ ID NO: 55273 - protein, 8 aa, Mycobacterium tuberculosis
DTASKTNA

SEQ ID NO: 55274 - protein, 8 aa, Mycobacterium tuberculosis
TASKTNAL

SEQ ID NO: 55275 - protein, 8 aa, Mycobacterium tuberculosis
ASKTNALQ

SEQ ID NO: 55276 - protein, 8 aa, Mycobacterium tuberculosis
SKTNALQE

SEQ ID NO: 55277 - protein, 8 aa, Mycobacterium tuberculosis
KTNALQEF

SEQ ID NO: 55278 - protein, 8 aa, Mycobacterium tuberculosis
TNALQEFF

SEQ ID NO: 55279 - protein, 8 aa, Mycobacterium tuberculosis
NALQEFFA

SEQ ID NO: 55280 - protein, 8 aa, Mycobacterium tuberculosis
ALQEFFAG

SEQ ID NO: 55281 - protein, 8 aa, Mycobacterium tuberculosis
LQEFFAGH

SEQ ID NO: 55282 - protein, 8 aa, Mycobacterium tuberculosis
QEFFAGHG

SEQ ID NO: 55283 - protein, 8 aa, Mycobacterium tuberculosis
EFFAGHGA

SEQ ID NO: 55284 - protein, 8 aa, Mycobacterium tuberculosis
FFAGHGAQ

SEQ ID NO: 55285 - protein, 8 aa, Mycobacterium tuberculosis
FAGHGAQG

SEQ ID NO: 55286 - protein, 8 aa, Mycobacterium tuberculosis
AGHGAQGF

SEQ ID NO: 55287 - protein, 8 aa, Mycobacterium tuberculosis
GHGAQGFF

SEQ ID NO: 55288 - protein, 8 aa, Mycobacterium tuberculosis
HGAQGFFD

SEQ ID NO: 55289 - protein, 8 aa, Mycobacterium tuberculosis
GAQGFFDA

SEQ ID NO: 55290 - protein, 8 aa, Mycobacterium tuberculosis
AQGFFDAQ

SEQ ID NO: 55291 - protein, 8 aa, Mycobacterium tuberculosis
QGFFDAQA

SEQ ID NO: 55292 - protein, 8 aa, Mycobacterium tuberculosis
GFFDAQAQ

SEQ ID NO: 55293 - protein, 8 aa, Mycobacterium tuberculosis
FFDAQAQM

SEQ ID NO: 55294 - protein, 8 aa, Mycobacterium tuberculosis
FDAQAQML

SEQ ID NO: 55295 - protein, 8 aa, Mycobacterium tuberculosis
DAQAQMLS

SEQ ID NO: 55296 - protein, 8 aa, Mycobacterium tuberculosis
AQAQMLSG

SEQ ID NO: 55297 - protein, 8 aa, Mycobacterium tuberculosis
QAQMLSGL

SEQ ID NO: 55298 - protein, 8 aa, Mycobacterium tuberculosis
AQMLSGLQ

SEQ ID NO: 55299 - protein, 8 aa, Mycobacterium tuberculosis
QMLSGLQG

SEQ ID NO: 55300 - protein, 8 aa, Mycobacterium tuberculosis
MLSGLQGL

SEQ ID NO: 55301 - protein, 8 aa, Mycobacterium tuberculosis
LSGLQGLI

SEQ ID NO: 55302 - protein, 8 aa, Mycobacterium tuberculosis
SGLQGLIE

SEQ ID NO: 55303 - protein, 8 aa, Mycobacterium tuberculosis
GLQGLIET

SEQ ID NO: 55304 - protein, 8 aa, Mycobacterium tuberculosis
LQGLIETV

SEQ ID NO: 55305 - protein, 8 aa, Mycobacterium tuberculosis
QGLIETVG

SEQ ID NO: 55306 - protein, 8 aa, Mycobacterium tuberculosis
GLIETVGQ

SEQ ID NO: 55307 - protein, 8 aa, Mycobacterium tuberculosis
LIETVGQH

SEQ ID NO: 55308 - protein, 8 aa, Mycobacterium tuberculosis
IETVGQHG

SEQ ID NO: 55309 - protein, 8 aa, Mycobacterium tuberculosis
ETVGQHGT

SEQ ID NO: 55310 - protein, 8 aa, Mycobacterium tuberculosis
TVGQHGTT

SEQ ID NO: 55311 - protein, 8 aa, Mycobacterium tuberculosis
VGQHGTTT

SEQ ID NO: 55312 - protein, 8 aa, Mycobacterium tuberculosis
GQHGTTTG

SEQ ID NO: 55313 - protein, 8 aa, Mycobacterium tuberculosis
QHGTTTGH

SEQ ID NO: 55314 - protein, 8 aa, Mycobacterium tuberculosis
HGTTTGHV

SEQ ID NO: 55315 - protein, 8 aa, Mycobacterium tuberculosis
GTTTGHVL

SEQ ID NO: 55316 - protein, 8 aa, Mycobacterium tuberculosis
TTTGHVLD

SEQ ID NO: 55317 - protein, 8 aa, Mycobacterium tuberculosis
TTGHVLDN

SEQ ID NO: 55318 - protein, 8 aa, Mycobacterium tuberculosis
TGHVLDNA

SEQ ID NO: 55319 - protein, 8 aa, Mycobacterium tuberculosis
GHVLDNAI

SEQ ID NO: 55320 - protein, 8 aa, Mycobacterium tuberculosis
HVLDNAIG

SEQ ID NO: 55321 - protein, 8 aa, Mycobacterium tuberculosis
VLDNAIGT

SEQ ID NO: 55322 - protein, 8 aa, Mycobacterium tuberculosis
LDNAIGTD

SEQ ID NO: 55323 - protein, 8 aa, Mycobacterium tuberculosis
DNAIGTDQ

SEQ ID NO: 55324 - protein, 8 aa, Mycobacterium tuberculosis
NAIGTDQA

SEQ ID NO: 55325 - protein, 8 aa, Mycobacterium tuberculosis
AIGTDQAI

SEQ ID NO: 55326 - protein, 8 aa, Mycobacterium tuberculosis
IGTDQAIA

SEQ ID NO: 55327 - protein, 8 aa, Mycobacterium tuberculosis
GTDQAIAG

SEQ ID NO: 55328 - protein, 8 aa, Mycobacterium tuberculosis
TDQAIAGL

SEQ ID NO: 55329 - protein, 8 aa, Mycobacterium tuberculosis
DQAIAGLF

SEQ ID NO: 55330 - protein, 9 aa, Mycobacterium tuberculosis
MSDQITYNP

SEQ ID NO: 55331 - protein, 9 aa, Mycobacterium tuberculosis
SDQITYNPG

SEQ ID NO: 55332 - protein, 9 aa, Mycobacterium tuberculosis
DQITYNPGA

SEQ ID NO: 55333 - protein, 9 aa, Mycobacterium tuberculosis
QITYNPGAV

SEQ ID NO: 55334 - protein, 9 aa, Mycobacterium tuberculosis
ITYNPGAVS

SEQ ID NO: 55335 - protein, 9 aa, Mycobacterium tuberculosis
TYNPGAVSD

SEQ ID NO: 55336 - protein, 9 aa, Mycobacterium tuberculosis
YNPGAVSDF

SEQ ID NO: 55337 - protein, 9 aa, Mycobacterium tuberculosis
NPGAVSDFA

SEQ ID NO: 55338 - protein, 9 aa, Mycobacterium tuberculosis
PGAVSDFAS

SEQ ID NO: 55339 - protein, 9 aa, Mycobacterium tuberculosis
GAVSDFASD

SEQ ID NO: 55340 - protein, 9 aa, Mycobacterium tuberculosis
AVSDFASDV

SEQ ID NO: 55341 - protein, 9 aa, Mycobacterium tuberculosis
VSDFASDVG

SEQ ID NO: 55342 - protein, 9 aa, Mycobacterium tuberculosis
SDFASDVGS

SEQ ID NO: 55343 - protein, 9 aa, Mycobacterium tuberculosis
DFASDVGSR

SEQ ID NO: 55344 - protein, 9 aa, Mycobacterium tuberculosis
FASDVGSRA

SEQ ID NO: 55345 - protein, 9 aa, Mycobacterium tuberculosis
ASDVGSRAG

SEQ ID NO: 55346 - protein, 9 aa, Mycobacterium tuberculosis
SDVGSRAGQ

SEQ ID NO: 55347 - protein, 9 aa, Mycobacterium tuberculosis
DVGSRAGQL

SEQ ID NO: 55348 - protein, 9 aa, Mycobacterium tuberculosis
VGSRAGQLH

SEQ ID NO: 55349 - protein, 9 aa, Mycobacterium tuberculosis
GSRAGQLHM

SEQ ID NO: 55350 - protein, 9 aa, Mycobacterium tuberculosis
SRAGQLHMI

SEQ ID NO: 55351 - protein, 9 aa, Mycobacterium tuberculosis
RAGQLHMIY

SEQ ID NO: 55352 - protein, 9 aa, Mycobacterium tuberculosis
AGQLHMIYE

SEQ ID NO: 55353 - protein, 9 aa, Mycobacterium tuberculosis
GQLHMIYED

SEQ ID NO: 55354 - protein, 9 aa, Mycobacterium tuberculosis
QLHMIYEDT

SEQ ID NO: 55355 - protein, 9 aa, Mycobacterium tuberculosis
LHMIYEDTA

SEQ ID NO: 55356 - protein, 9 aa, Mycobacterium tuberculosis
HMIYEDTAS

SEQ ID NO: 55357 - protein, 9 aa, Mycobacterium tuberculosis
MIYEDTASK

SEQ ID NO: 55358 - protein, 9 aa, Mycobacterium tuberculosis
IYEDTASKT

SEQ ID NO: 55359 - protein, 9 aa, Mycobacterium tuberculosis
YEDTASKTN

SEQ ID NO: 55360 - protein, 9 aa, Mycobacterium tuberculosis
EDTASKTNA

SEQ ID NO: 55361 - protein, 9 aa, Mycobacterium tuberculosis
DTASKTNAL

SEQ ID NO: 55362 - protein, 9 aa, Mycobacterium tuberculosis
TASKTNALQ

SEQ ID NO: 55363 - protein, 9 aa, Mycobacterium tuberculosis
ASKTNALQE

SEQ ID NO: 55364 - protein, 9 aa, Mycobacterium tuberculosis
SKTNALQEF

SEQ ID NO: 55365 - protein, 9 aa, Mycobacterium tuberculosis
KTNALQEFF

SEQ ID NO: 55366 - protein, 9 aa, Mycobacterium tuberculosis
TNALQEFFA

SEQ ID NO: 55367 - protein, 9 aa, Mycobacterium tuberculosis
NALQEFFAG

SEQ ID NO: 55368 - protein, 9 aa, Mycobacterium tuberculosis
ALQEFFAGH

SEQ ID NO: 55369 - protein, 9 aa, Mycobacterium tuberculosis
LQEFFAGHG

SEQ ID NO: 55370 - protein, 9 aa, Mycobacterium tuberculosis
QEFFAGHGA

SEQ ID NO: 55371 - protein, 9 aa, Mycobacterium tuberculosis
EFFAGHGAQ

SEQ ID NO: 55372 - protein, 9 aa, Mycobacterium tuberculosis
FFAGHGAQG

SEQ ID NO: 55373 - protein, 9 aa, Mycobacterium tuberculosis
FAGHGAQGF

SEQ ID NO: 55374 - protein, 9 aa, Mycobacterium tuberculosis
AGHGAQGFF

SEQ ID NO: 55375 - protein, 9 aa, Mycobacterium tuberculosis
GHGAQGFFD

SEQ ID NO: 55376 - protein, 9 aa, Mycobacterium tuberculosis
HGAQGFFDA

SEQ ID NO: 55377 - protein, 9 aa, Mycobacterium tuberculosis
GAQGFFDAQ

SEQ ID NO: 55378 - protein, 9 aa, Mycobacterium tuberculosis
AQGFFDAQA

SEQ ID NO: 55379 - protein, 9 aa, Mycobacterium tuberculosis
QGFFDAQAQ

SEQ ID NO: 55380 - protein, 9 aa, Mycobacterium tuberculosis
GFFDAQAQM

SEQ ID NO: 55381 - protein, 9 aa, Mycobacterium tuberculosis
FFDAQAQML

SEQ ID NO: 55382 - protein, 9 aa, Mycobacterium tuberculosis
FDAQAQMLS

SEQ ID NO: 55383 - protein, 9 aa, Mycobacterium tuberculosis
DAQAQMLSG

SEQ ID NO: 55384 - protein, 9 aa, Mycobacterium tuberculosis
AQAQMLSGL

SEQ ID NO: 55385 - protein, 9 aa, Mycobacterium tuberculosis
QAQMLSGLQ

SEQ ID NO: 55386 - protein, 9 aa, Mycobacterium tuberculosis
AQMLSGLQG

SEQ ID NO: 55387 - protein, 9 aa, Mycobacterium tuberculosis
QMLSGLQGL

SEQ ID NO: 55388 - protein, 9 aa, Mycobacterium tuberculosis
MLSGLQGLI

SEQ ID NO: 55389 - protein, 9 aa, Mycobacterium tuberculosis
LSGLQGLIE

SEQ ID NO: 55390 - protein, 9 aa, Mycobacterium tuberculosis
SGLQGLIET

SEQ ID NO: 55391 - protein, 9 aa, Mycobacterium tuberculosis
GLQGLIETV

SEQ ID NO: 55392 - protein, 9 aa, Mycobacterium tuberculosis
LQGLIETVG

SEQ ID NO: 55393 - protein, 9 aa, Mycobacterium tuberculosis
QGLIETVGQ

SEQ ID NO: 55394 - protein, 9 aa, Mycobacterium tuberculosis
GLIETVGQH

SEQ ID NO: 55395 - protein, 9 aa, Mycobacterium tuberculosis
LIETVGQHG

SEQ ID NO: 55396 - protein, 9 aa, Mycobacterium tuberculosis
IETVGQHGT

SEQ ID NO: 55397 - protein, 9 aa, Mycobacterium tuberculosis
ETVGQHGTT

SEQ ID NO: 55398 - protein, 9 aa, Mycobacterium tuberculosis
TVGQHGTTT

SEQ ID NO: 55399 - protein, 9 aa, Mycobacterium tuberculosis
VGQHGTTTG

SEQ ID NO: 55400 - protein, 9 aa, Mycobacterium tuberculosis
GQHGTTTGH

SEQ ID NO: 55401 - protein, 9 aa, Mycobacterium tuberculosis
QHGTTTGHV

SEQ ID NO: 55402 - protein, 9 aa, Mycobacterium tuberculosis
HGTTTGHVL

SEQ ID NO: 55403 - protein, 9 aa, Mycobacterium tuberculosis
GTTTGHVLD

SEQ ID NO: 55404 - protein, 9 aa, Mycobacterium tuberculosis
TTTGHVLDN

SEQ ID NO: 55405 - protein, 9 aa, Mycobacterium tuberculosis
TTGHVLDNA

SEQ ID NO: 55406 - protein, 9 aa, Mycobacterium tuberculosis
TGHVLDNAI

SEQ ID NO: 55407 - protein, 9 aa, Mycobacterium tuberculosis
GHVLDNAIG

SEQ ID NO: 55408 - protein, 9 aa, Mycobacterium tuberculosis
HVLDNAIGT

SEQ ID NO: 55409 - protein, 9 aa, Mycobacterium tuberculosis
VLDNAIGTD

SEQ ID NO: 55410 - protein, 9 aa, Mycobacterium tuberculosis
LDNAIGTDQ

SEQ ID NO: 55411 - protein, 9 aa, Mycobacterium tuberculosis
DNAIGTDQA

SEQ ID NO: 55412 - protein, 9 aa, Mycobacterium tuberculosis
NAIGTDQAI

SEQ ID NO: 55413 - protein, 9 aa, Mycobacterium tuberculosis
AIGTDQAIA

SEQ ID NO: 55414 - protein, 9 aa, Mycobacterium tuberculosis
IGTDQAIAG

SEQ ID NO: 55415 - protein, 9 aa, Mycobacterium tuberculosis
GTDQAIAGL

SEQ ID NO: 55416 - protein, 9 aa, Mycobacterium tuberculosis
TDQAIAGLF

SEQ ID NO: 55417 - protein, 10 aa, Mycobacterium tuberculosis
MSDQITYNPG

SEQ ID NO: 55418 - protein, 10 aa, Mycobacterium tuberculosis
SDQITYNPGA

SEQ ID NO: 55419 - protein, 10 aa, Mycobacterium tuberculosis
DQITYNPGAV

SEQ ID NO: 55420 - protein, 10 aa, Mycobacterium tuberculosis
QITYNPGAVS

SEQ ID NO: 55421 - protein, 10 aa, Mycobacterium tuberculosis
ITYNPGAVSD

SEQ ID NO: 55422 - protein, 10 aa, Mycobacterium tuberculosis
TYNPGAVSDF

SEQ ID NO: 55423 - protein, 10 aa, Mycobacterium tuberculosis
YNPGAVSDFA

SEQ ID NO: 55424 - protein, 10 aa, Mycobacterium tuberculosis
NPGAVSDFAS

SEQ ID NO: 55425 - protein, 10 aa, Mycobacterium tuberculosis
PGAVSDFASD

SEQ ID NO: 55426 - protein, 10 aa, Mycobacterium tuberculosis
GAVSDFASDV

SEQ ID NO: 55427 - protein, 10 aa, Mycobacterium tuberculosis
AVSDFASDVG

SEQ ID NO: 55428 - protein, 10 aa, Mycobacterium tuberculosis
VSDFASDVGS

SEQ ID NO: 55429 - protein, 10 aa, Mycobacterium tuberculosis
SDFASDVGSR

SEQ ID NO: 55430 - protein, 10 aa, Mycobacterium tuberculosis
DFASDVGSRA

SEQ ID NO: 55431 - protein, 10 aa, Mycobacterium tuberculosis
FASDVGSRAG

SEQ ID NO: 55432 - protein, 10 aa, Mycobacterium tuberculosis
ASDVGSRAGQ

SEQ ID NO: 55433 - protein, 10 aa, Mycobacterium tuberculosis
SDVGSRAGQL

SEQ ID NO: 55434 - protein, 10 aa, Mycobacterium tuberculosis
DVGSRAGQLH

SEQ ID NO: 55435 - protein, 10 aa, Mycobacterium tuberculosis
VGSRAGQLHM

SEQ ID NO: 55436 - protein, 10 aa, Mycobacterium tuberculosis
GSRAGQLHMI

SEQ ID NO: 55437 - protein, 10 aa, Mycobacterium tuberculosis
SRAGQLHMIY

SEQ ID NO: 55438 - protein, 10 aa, Mycobacterium tuberculosis
RAGQLHMIYE

SEQ ID NO: 55439 - protein, 10 aa, Mycobacterium tuberculosis
AGQLHMIYED

SEQ ID NO: 55440 - protein, 10 aa, Mycobacterium tuberculosis
GQLHMIYEDT

SEQ ID NO: 55441 - protein, 10 aa, Mycobacterium tuberculosis
QLHMIYEDTA

SEQ ID NO: 55442 - protein, 10 aa, Mycobacterium tuberculosis
LHMIYEDTAS

SEQ ID NO: 55443 - protein, 10 aa, Mycobacterium tuberculosis
HMIYEDTASK

SEQ ID NO: 55444 - protein, 10 aa, Mycobacterium tuberculosis
MIYEDTASKT

SEQ ID NO: 55445 - protein, 10 aa, Mycobacterium tuberculosis
IYEDTASKTN

SEQ ID NO: 55446 - protein, 10 aa, Mycobacterium tuberculosis
YEDTASKTNA

SEQ ID NO: 55447 - protein, 10 aa, Mycobacterium tuberculosis
EDTASKTNAL

SEQ ID NO: 55448 - protein, 10 aa, Mycobacterium tuberculosis
DTASKTNALQ

SEQ ID NO: 55449 - protein, 10 aa, Mycobacterium tuberculosis
TASKTNALQE

SEQ ID NO: 55450 - protein, 10 aa, Mycobacterium tuberculosis
ASKTNALQEF

SEQ ID NO: 55451 - protein, 10 aa, Mycobacterium tuberculosis
SKTNALQEFF

SEQ ID NO: 55452 - protein, 10 aa, Mycobacterium tuberculosis
KTNALQEFFA

SEQ ID NO: 55453 - protein, 10 aa, Mycobacterium tuberculosis
TNALQEFFAG

SEQ ID NO: 55454 - protein, 10 aa, Mycobacterium tuberculosis
NALQEFFAGH

SEQ ID NO: 55455 - protein, 10 aa, Mycobacterium tuberculosis
ALQEFFAGHG

SEQ ID NO: 55456 - protein, 10 aa, Mycobacterium tuberculosis
LQEFFAGHGA

SEQ ID NO: 55457 - protein, 10 aa, Mycobacterium tuberculosis
QEFFAGHGAQ

SEQ ID NO: 55458 - protein, 10 aa, Mycobacterium tuberculosis
EFFAGHGAQG

SEQ ID NO: 55459 - protein, 10 aa, Mycobacterium tuberculosis
FFAGHGAQGF

SEQ ID NO: 55460 - protein, 10 aa, Mycobacterium tuberculosis
FAGHGAQGFF

SEQ ID NO: 55461 - protein, 10 aa, Mycobacterium tuberculosis
AGHGAQGFFD

SEQ ID NO: 55462 - protein, 10 aa, Mycobacterium tuberculosis
GHGAQGFFDA

SEQ ID NO: 55463 - protein, 10 aa, Mycobacterium tuberculosis
HGAQGFFDAQ

SEQ ID NO: 55464 - protein, 10 aa, Mycobacterium tuberculosis
GAQGFFDAQA

SEQ ID NO: 55465 - protein, 10 aa, Mycobacterium tuberculosis
AQGFFDAQAQ

SEQ ID NO: 55466 - protein, 10 aa, Mycobacterium tuberculosis
QGFFDAQAQM

SEQ ID NO: 55467 - protein, 10 aa, Mycobacterium tuberculosis
GFFDAQAQML

SEQ ID NO: 55468 - protein, 10 aa, Mycobacterium tuberculosis
FFDAQAQMLS

SEQ ID NO: 55469 - protein, 10 aa, Mycobacterium tuberculosis
FDAQAQMLSG

SEQ ID NO: 55470 - protein, 10 aa, Mycobacterium tuberculosis
DAQAQMLSGL

SEQ ID NO: 55471 - protein, 10 aa, Mycobacterium tuberculosis
AQAQMLSGLQ

SEQ ID NO: 55472 - protein, 10 aa, Mycobacterium tuberculosis
QAQMLSGLQG

SEQ ID NO: 55473 - protein, 10 aa, Mycobacterium tuberculosis
AQMLSGLQGL

SEQ ID NO: 55474 - protein, 10 aa, Mycobacterium tuberculosis
QMLSGLQGLI

SEQ ID NO: 55475 - protein, 10 aa, Mycobacterium tuberculosis
MLSGLQGLIE

SEQ ID NO: 55476 - protein, 10 aa, Mycobacterium tuberculosis
LSGLQGLIET

SEQ ID NO: 55477 - protein, 10 aa, Mycobacterium tuberculosis
SGLQGLIETV

SEQ ID NO: 55478 - protein, 10 aa, Mycobacterium tuberculosis
GLQGLIETVG

SEQ ID NO: 55479 - protein, 10 aa, Mycobacterium tuberculosis
LQGLIETVGQ

SEQ ID NO: 55480 - protein, 10 aa, Mycobacterium tuberculosis
QGLIETVGQH

SEQ ID NO: 55481 - protein, 10 aa, Mycobacterium tuberculosis
GLIETVGQHG

SEQ ID NO: 55482 - protein, 10 aa, Mycobacterium tuberculosis
LIETVGQHGT

SEQ ID NO: 55483 - protein, 10 aa, Mycobacterium tuberculosis
IETVGQHGTT

SEQ ID NO: 55484 - protein, 10 aa, Mycobacterium tuberculosis
ETVGQHGTTT

SEQ ID NO: 55485 - protein, 10 aa, Mycobacterium tuberculosis
TVGQHGTTTG

SEQ ID NO: 55486 - protein, 10 aa, Mycobacterium tuberculosis
VGQHGTTTGH

SEQ ID NO: 55487 - protein, 10 aa, Mycobacterium tuberculosis
GQHGTTTGHV

SEQ ID NO: 55488 - protein, 10 aa, Mycobacterium tuberculosis
QHGTTTGHVL

SEQ ID NO: 55489 - protein, 10 aa, Mycobacterium tuberculosis
HGTTTGHVLD

SEQ ID NO: 55490 - protein, 10 aa, Mycobacterium tuberculosis
GTTTGHVLDN

SEQ ID NO: 55491 - protein, 10 aa, Mycobacterium tuberculosis
TTTGHVLDNA

SEQ ID NO: 55492 - protein, 10 aa, Mycobacterium tuberculosis
TTGHVLDNAI

SEQ ID NO: 55493 - protein, 10 aa, Mycobacterium tuberculosis
TGHVLDNAIG

SEQ ID NO: 55494 - protein, 10 aa, Mycobacterium tuberculosis
GHVLDNAIGT

SEQ ID NO: 55495 - protein, 10 aa, Mycobacterium tuberculosis
HVLDNAIGTD

SEQ ID NO: 55496 - protein, 10 aa, Mycobacterium tuberculosis
VLDNAIGTDQ

SEQ ID NO: 55497 - protein, 10 aa, Mycobacterium tuberculosis
LDNAIGTDQA

SEQ ID NO: 55498 - protein, 10 aa, Mycobacterium tuberculosis
DNAIGTDQAI

SEQ ID NO: 55499 - protein, 10 aa, Mycobacterium tuberculosis
NAIGTDQAIA

SEQ ID NO: 55500 - protein, 10 aa, Mycobacterium tuberculosis
AIGTDQAIAG

SEQ ID NO: 55501 - protein, 10 aa, Mycobacterium tuberculosis
IGTDQAIAGL

SEQ ID NO: 55502 - protein, 10 aa, Mycobacterium tuberculosis
GTDQAIAGLF

SEQ ID NO: 55503 - protein, 11 aa, Mycobacterium tuberculosis
MSDQITYNPGA

SEQ ID NO: 55504 - protein, 11 aa, Mycobacterium tuberculosis
SDQITYNPGAV

SEQ ID NO: 55505 - protein, 11 aa, Mycobacterium tuberculosis
DQITYNPGAVS

SEQ ID NO: 55506 - protein, 11 aa, Mycobacterium tuberculosis
QITYNPGAVSD

SEQ ID NO: 55507 - protein, 11 aa, Mycobacterium tuberculosis
ITYNPGAVSDF

SEQ ID NO: 55508 - protein, 11 aa, Mycobacterium tuberculosis
TYNPGAVSDFA

SEQ ID NO: 55509 - protein, 11 aa, Mycobacterium tuberculosis
YNPGAVSDFAS

SEQ ID NO: 55510 - protein, 11 aa, Mycobacterium tuberculosis
NPGAVSDFASD

SEQ ID NO: 55511 - protein, 11 aa, Mycobacterium tuberculosis
PGAVSDFASDV

SEQ ID NO: 55512 - protein, 11 aa, Mycobacterium tuberculosis
GAVSDFASDVG

SEQ ID NO: 55513 - protein, 11 aa, Mycobacterium tuberculosis
AVSDFASDVGS

SEQ ID NO: 55514 - protein, 11 aa, Mycobacterium tuberculosis
VSDFASDVGSR

SEQ ID NO: 55515 - protein, 11 aa, Mycobacterium tuberculosis
SDFASDVGSRA

SEQ ID NO: 55516 - protein, 11 aa, Mycobacterium tuberculosis
DFASDVGSRAG

SEQ ID NO: 55517 - protein, 11 aa, Mycobacterium tuberculosis
FASDVGSRAGQ

SEQ ID NO: 55518 - protein, 11 aa, Mycobacterium tuberculosis
ASDVGSRAGQL

SEQ ID NO: 55519 - protein, 11 aa, Mycobacterium tuberculosis
SDVGSRAGQLH

SEQ ID NO: 55520 - protein, 11 aa, Mycobacterium tuberculosis
DVGSRAGQLHM

SEQ ID NO: 55521 - protein, 11 aa, Mycobacterium tuberculosis
VGSRAGQLHMI

SEQ ID NO: 55522 - protein, 11 aa, Mycobacterium tuberculosis
GSRAGQLHMIY

SEQ ID NO: 55523 - protein, 11 aa, Mycobacterium tuberculosis
SRAGQLHMIYE

SEQ ID NO: 55524 - protein, 11 aa, Mycobacterium tuberculosis
RAGQLHMIYED

SEQ ID NO: 55525 - protein, 11 aa, Mycobacterium tuberculosis
AGQLHMIYEDT

SEQ ID NO: 55526 - protein, 11 aa, Mycobacterium tuberculosis
GQLHMIYEDTA

SEQ ID NO: 55527 - protein, 11 aa, Mycobacterium tuberculosis
QLHMIYEDTAS

SEQ ID NO: 55528 - protein, 11 aa, Mycobacterium tuberculosis
LHMIYEDTASK

SEQ ID NO: 55529 - protein, 11 aa, Mycobacterium tuberculosis
HMIYEDTASKT

SEQ ID NO: 55530 - protein, 11 aa, Mycobacterium tuberculosis
MIYEDTASKTN

SEQ ID NO: 55531 - protein, 11 aa, Mycobacterium tuberculosis
IYEDTASKTNA

SEQ ID NO: 55532 - protein, 11 aa, Mycobacterium tuberculosis
YEDTASKTNAL

SEQ ID NO: 55533 - protein, 11 aa, Mycobacterium tuberculosis
EDTASKTNALQ

SEQ ID NO: 55534 - protein, 11 aa, Mycobacterium tuberculosis
DTASKTNALQE

SEQ ID NO: 55535 - protein, 11 aa, Mycobacterium tuberculosis
TASKTNALQEF

SEQ ID NO: 55536 - protein, 11 aa, Mycobacterium tuberculosis
ASKTNALQEFF

SEQ ID NO: 55537 - protein, 11 aa, Mycobacterium tuberculosis
SKTNALQEFFA

SEQ ID NO: 55538 - protein, 11 aa, Mycobacterium tuberculosis
KTNALQEFFAG

SEQ ID NO: 55539 - protein, 11 aa, Mycobacterium tuberculosis
TNALQEFFAGH

SEQ ID NO: 55540 - protein, 11 aa, Mycobacterium tuberculosis
NALQEFFAGHG

SEQ ID NO: 55541 - protein, 11 aa, Mycobacterium tuberculosis
ALQEFFAGHGA

SEQ ID NO: 55542 - protein, 11 aa, Mycobacterium tuberculosis
LQEFFAGHGAQ

SEQ ID NO: 55543 - protein, 11 aa, Mycobacterium tuberculosis
QEFFAGHGAQG

SEQ ID NO: 55544 - protein, 11 aa, Mycobacterium tuberculosis
EFFAGHGAQGF

SEQ ID NO: 55545 - protein, 11 aa, Mycobacterium tuberculosis
FFAGHGAQGFF

SEQ ID NO: 55546 - protein, 11 aa, Mycobacterium tuberculosis
FAGHGAQGFFD

SEQ ID NO: 55547 - protein, 11 aa, Mycobacterium tuberculosis
AGHGAQGFFDA

SEQ ID NO: 55548 - protein, 11 aa, Mycobacterium tuberculosis
GHGAQGFFDAQ

SEQ ID NO: 55549 - protein, 11 aa, Mycobacterium tuberculosis
HGAQGFFDAQA

SEQ ID NO: 55550 - protein, 11 aa, Mycobacterium tuberculosis
GAQGFFDAQAQ

SEQ ID NO: 55551 - protein, 11 aa, Mycobacterium tuberculosis
AQGFFDAQAQM

SEQ ID NO: 55552 - protein, 11 aa, Mycobacterium tuberculosis
QGFFDAQAQML

SEQ ID NO: 55553 - protein, 11 aa, Mycobacterium tuberculosis
GFFDAQAQMLS

SEQ ID NO: 55554 - protein, 11 aa, Mycobacterium tuberculosis
FFDAQAQMLSG

SEQ ID NO: 55555 - protein, 11 aa, Mycobacterium tuberculosis
FDAQAQMLSGL

SEQ ID NO: 55556 - protein, 11 aa, Mycobacterium tuberculosis
DAQAQMLSGLQ

SEQ ID NO: 55557 - protein, 11 aa, Mycobacterium tuberculosis
AQAQMLSGLQG

SEQ ID NO: 55558 - protein, 11 aa, Mycobacterium tuberculosis
QAQMLSGLQGL

SEQ ID NO: 55559 - protein, 11 aa, Mycobacterium tuberculosis
AQMLSGLQGLI

SEQ ID NO: 55560 - protein, 11 aa, Mycobacterium tuberculosis
QMLSGLQGLIE

SEQ ID NO: 55561 - protein, 11 aa, Mycobacterium tuberculosis
MLSGLQGLIET

SEQ ID NO: 55562 - protein, 11 aa, Mycobacterium tuberculosis
LSGLQGLIETV

SEQ ID NO: 55563 - protein, 11 aa, Mycobacterium tuberculosis
SGLQGLIETVG

SEQ ID NO: 55564 - protein, 11 aa, Mycobacterium tuberculosis
GLQGLIETVGQ

SEQ ID NO: 55565 - protein, 11 aa, Mycobacterium tuberculosis
LQGLIETVGQH

SEQ ID NO: 55566 - protein, 11 aa, Mycobacterium tuberculosis
QGLIETVGQHG

SEQ ID NO: 55567 - protein, 11 aa, Mycobacterium tuberculosis
GLIETVGQHGT

SEQ ID NO: 55568 - protein, 11 aa, Mycobacterium tuberculosis
LIETVGQHGTT

SEQ ID NO: 55569 - protein, 11 aa, Mycobacterium tuberculosis
IETVGQHGTTT

SEQ ID NO: 55570 - protein, 11 aa, Mycobacterium tuberculosis
ETVGQHGTTTG

SEQ ID NO: 55571 - protein, 11 aa, Mycobacterium tuberculosis
TVGQHGTTTGH

SEQ ID NO: 55572 - protein, 11 aa, Mycobacterium tuberculosis
VGQHGTTTGHV

SEQ ID NO: 55573 - protein, 11 aa, Mycobacterium tuberculosis
GQHGTTTGHVL

SEQ ID NO: 55574 - protein, 11 aa, Mycobacterium tuberculosis
QHGTTTGHVLD

SEQ ID NO: 55575 - protein, 11 aa, Mycobacterium tuberculosis
HGTTTGHVLDN

SEQ ID NO: 55576 - protein, 11 aa, Mycobacterium tuberculosis
GTTTGHVLDNA

SEQ ID NO: 55577 - protein, 11 aa, Mycobacterium tuberculosis
TTTGHVLDNAI

SEQ ID NO: 55578 - protein, 11 aa, Mycobacterium tuberculosis
TTGHVLDNAIG

SEQ ID NO: 55579 - protein, 11 aa, Mycobacterium tuberculosis
TGHVLDNAIGT

SEQ ID NO: 55580 - protein, 11 aa, Mycobacterium tuberculosis
GHVLDNAIGTD

SEQ ID NO: 55581 - protein, 11 aa, Mycobacterium tuberculosis
HVLDNAIGTDQ

SEQ ID NO: 55582 - protein, 11 aa, Mycobacterium tuberculosis
VLDNAIGTDQA

SEQ ID NO: 55583 - protein, 11 aa, Mycobacterium tuberculosis
LDNAIGTDQAI

SEQ ID NO: 55584 - protein, 11 aa, Mycobacterium tuberculosis
DNAIGTDQAIA

SEQ ID NO: 55585 - protein, 11 aa, Mycobacterium tuberculosis
NAIGTDQAIAG

SEQ ID NO: 55586 - protein, 11 aa, Mycobacterium tuberculosis
AIGTDQAIAGL

SEQ ID NO: 55587 - protein, 11 aa, Mycobacterium tuberculosis
IGTDQAIAGLF

SEQ ID NO: 55588 - protein, 8 aa, Mycobacterium tuberculosis
MADTIQVT

SEQ ID NO: 55589 - protein, 8 aa, Mycobacterium tuberculosis
ADTIQVTP

SEQ ID NO: 55590 - protein, 8 aa, Mycobacterium tuberculosis
DTIQVTPQ

SEQ ID NO: 55591 - protein, 8 aa, Mycobacterium tuberculosis
TIQVTPQM

SEQ ID NO: 55592 - protein, 8 aa, Mycobacterium tuberculosis
IQVTPQML

SEQ ID NO: 55593 - protein, 8 aa, Mycobacterium tuberculosis
QVTPQMLR

SEQ ID NO: 55594 - protein, 8 aa, Mycobacterium tuberculosis
VTPQMLRS

SEQ ID NO: 55595 - protein, 8 aa, Mycobacterium tuberculosis
TPQMLRST

SEQ ID NO: 55596 - protein, 8 aa, Mycobacterium tuberculosis
PQMLRSTA

SEQ ID NO: 55597 - protein, 8 aa, Mycobacterium tuberculosis
QMLRSTAN

SEQ ID NO: 55598 - protein, 8 aa, Mycobacterium tuberculosis
MLRSTAND

SEQ ID NO: 55599 - protein, 8 aa, Mycobacterium tuberculosis
LRSTANDI

SEQ ID NO: 55600 - protein, 8 aa, Mycobacterium tuberculosis
RSTANDIQ

SEQ ID NO: 55601 - protein, 8 aa, Mycobacterium tuberculosis
STANDIQA

SEQ ID NO: 55602 - protein, 8 aa, Mycobacterium tuberculosis
TANDIQAN

SEQ ID NO: 55603 - protein, 8 aa, Mycobacterium tuberculosis
ANDIQANM

SEQ ID NO: 55604 - protein, 8 aa, Mycobacterium tuberculosis
NDIQANME

SEQ ID NO: 55605 - protein, 8 aa, Mycobacterium tuberculosis
DIQANMEQ

SEQ ID NO: 55606 - protein, 8 aa, Mycobacterium tuberculosis
IQANMEQA

SEQ ID NO: 55607 - protein, 8 aa, Mycobacterium tuberculosis
QANMEQAM

SEQ ID NO: 55608 - protein, 8 aa, Mycobacterium tuberculosis
ANMEQAMG

SEQ ID NO: 55609 - protein, 8 aa, Mycobacterium tuberculosis
NMEQAMGI

SEQ ID NO: 55610 - protein, 8 aa, Mycobacterium tuberculosis
MEQAMGIA

SEQ ID NO: 55611 - protein, 8 aa, Mycobacterium tuberculosis
EQAMGIAK

SEQ ID NO: 55612 - protein, 8 aa, Mycobacterium tuberculosis
QAMGIAKG

SEQ ID NO: 55613 - protein, 8 aa, Mycobacterium tuberculosis
AMGIAKGY

SEQ ID NO: 55614 - protein, 8 aa, Mycobacterium tuberculosis
MGIAKGYL

SEQ ID NO: 55615 - protein, 8 aa, Mycobacterium tuberculosis
GIAKGYLA

SEQ ID NO: 55616 - protein, 8 aa, Mycobacterium tuberculosis
IAKGYLAN

SEQ ID NO: 55617 - protein, 8 aa, Mycobacterium tuberculosis
AKGYLANQ

SEQ ID NO: 55618 - protein, 8 aa, Mycobacterium tuberculosis
KGYLANQE

SEQ ID NO: 55619 - protein, 8 aa, Mycobacterium tuberculosis
GYLANQEN

SEQ ID NO: 55620 - protein, 8 aa, Mycobacterium tuberculosis
YLANQENV

SEQ ID NO: 55621 - protein, 8 aa, Mycobacterium tuberculosis
LANQENVM

SEQ ID NO: 55622 - protein, 8 aa, Mycobacterium tuberculosis
ANQENVMN

SEQ ID NO: 55623 - protein, 8 aa, Mycobacterium tuberculosis
NQENVMNP

SEQ ID NO: 55624 - protein, 8 aa, Mycobacterium tuberculosis
QENVMNPA

SEQ ID NO: 55625 - protein, 8 aa, Mycobacterium tuberculosis
ENVMNPAT

SEQ ID NO: 55626 - protein, 8 aa, Mycobacterium tuberculosis
NVMNPATW

SEQ ID NO: 55627 - protein, 8 aa, Mycobacterium tuberculosis
VMNPATWS

SEQ ID NO: 55628 - protein, 8 aa, Mycobacterium tuberculosis
MNPATWSG

SEQ ID NO: 55629 - protein, 8 aa, Mycobacterium tuberculosis
NPATWSGT

SEQ ID NO: 55630 - protein, 8 aa, Mycobacterium tuberculosis
PATWSGTG

SEQ ID NO: 55631 - protein, 8 aa, Mycobacterium tuberculosis
ATWSGTGV

SEQ ID NO: 55632 - protein, 8 aa, Mycobacterium tuberculosis
TWSGTGVV

SEQ ID NO: 55633 - protein, 8 aa, Mycobacterium tuberculosis
WSGTGVVA

SEQ ID NO: 55634 - protein, 8 aa, Mycobacterium tuberculosis
SGTGVVAS

SEQ ID NO: 55635 - protein, 8 aa, Mycobacterium tuberculosis
GTGVVASH

SEQ ID NO: 55636 - protein, 8 aa, Mycobacterium tuberculosis
TGVVASHM

SEQ ID NO: 55637 - protein, 8 aa, Mycobacterium tuberculosis
GVVASHMT

SEQ ID NO: 55638 - protein, 8 aa, Mycobacterium tuberculosis
VVASHMTA

SEQ ID NO: 55639 - protein, 8 aa, Mycobacterium tuberculosis
VASHMTAT

SEQ ID NO: 55640 - protein, 8 aa, Mycobacterium tuberculosis
ASHMTATE

SEQ ID NO: 55641 - protein, 8 aa, Mycobacterium tuberculosis
SHMTATEI

SEQ ID NO: 55642 - protein, 8 aa, Mycobacterium tuberculosis
HMTATEIT

SEQ ID NO: 55643 - protein, 8 aa, Mycobacterium tuberculosis
MTATEITN

SEQ ID NO: 55644 - protein, 8 aa, Mycobacterium tuberculosis
TATEITNE

SEQ ID NO: 55645 - protein, 8 aa, Mycobacterium tuberculosis
ATEITNEL

SEQ ID NO: 55646 - protein, 8 aa, Mycobacterium tuberculosis
TEITNELN

SEQ ID NO: 55647 - protein, 8 aa, Mycobacterium tuberculosis
EITNELNK

SEQ ID NO: 55648 - protein, 8 aa, Mycobacterium tuberculosis
ITNELNKV

SEQ ID NO: 55649 - protein, 8 aa, Mycobacterium tuberculosis
TNELNKVL

SEQ ID NO: 55650 - protein, 8 aa, Mycobacterium tuberculosis
NELNKVLT

SEQ ID NO: 55651 - protein, 8 aa, Mycobacterium tuberculosis
ELNKVLTG

SEQ ID NO: 55652 - protein, 8 aa, Mycobacterium tuberculosis
LNKVLTGG

SEQ ID NO: 55653 - protein, 8 aa, Mycobacterium tuberculosis
NKVLTGGT

SEQ ID NO: 55654 - protein, 8 aa, Mycobacterium tuberculosis
KVLTGGTR

SEQ ID NO: 55655 - protein, 8 aa, Mycobacterium tuberculosis
VLTGGTRL

SEQ ID NO: 55656 - protein, 8 aa, Mycobacterium tuberculosis
LTGGTRLA

SEQ ID NO: 55657 - protein, 8 aa, Mycobacterium tuberculosis
TGGTRLAE

SEQ ID NO: 55658 - protein, 8 aa, Mycobacterium tuberculosis
GGTRLAEG

SEQ ID NO: 55659 - protein, 8 aa, Mycobacterium tuberculosis
GTRLAEGL

SEQ ID NO: 55660 - protein, 8 aa, Mycobacterium tuberculosis
TRLAEGLV

SEQ ID NO: 55661 - protein, 8 aa, Mycobacterium tuberculosis
RLAEGLVQ

SEQ ID NO: 55662 - protein, 8 aa, Mycobacterium tuberculosis
LAEGLVQA

SEQ ID NO: 55663 - protein, 8 aa, Mycobacterium tuberculosis
AEGLVQAA

SEQ ID NO: 55664 - protein, 8 aa, Mycobacterium tuberculosis
EGLVQAAA

SEQ ID NO: 55665 - protein, 8 aa, Mycobacterium tuberculosis
GLVQAAAL

SEQ ID NO: 55666 - protein, 8 aa, Mycobacterium tuberculosis
LVQAAALM

SEQ ID NO: 55667 - protein, 8 aa, Mycobacterium tuberculosis
VQAAALME

SEQ ID NO: 55668 - protein, 8 aa, Mycobacterium tuberculosis
QAAALMEG

SEQ ID NO: 55669 - protein, 8 aa, Mycobacterium tuberculosis
AAALMEGH

SEQ ID NO: 55670 - protein, 8 aa, Mycobacterium tuberculosis
AALMEGHE

SEQ ID NO: 55671 - protein, 8 aa, Mycobacterium tuberculosis
ALMEGHEA

SEQ ID NO: 55672 - protein, 8 aa, Mycobacterium tuberculosis
LMEGHEAD

SEQ ID NO: 55673 - protein, 8 aa, Mycobacterium tuberculosis
MEGHEADS

SEQ ID NO: 55674 - protein, 8 aa, Mycobacterium tuberculosis
EGHEADSQ

SEQ ID NO: 55675 - protein, 8 aa, Mycobacterium tuberculosis
GHEADSQT

SEQ ID NO: 55676 - protein, 8 aa, Mycobacterium tuberculosis
HEADSQTA

SEQ ID NO: 55677 - protein, 8 aa, Mycobacterium tuberculosis
EADSQTAF

SEQ ID NO: 55678 - protein, 8 aa, Mycobacterium tuberculosis
ADSQTAFQ

SEQ ID NO: 55679 - protein, 8 aa, Mycobacterium tuberculosis
DSQTAFQA

SEQ ID NO: 55680 - protein, 8 aa, Mycobacterium tuberculosis
SQTAFQAL

SEQ ID NO: 55681 - protein, 8 aa, Mycobacterium tuberculosis
QTAFQALF

SEQ ID NO: 55682 - protein, 8 aa, Mycobacterium tuberculosis
TAFQALFG

SEQ ID NO: 55683 - protein, 8 aa, Mycobacterium tuberculosis
AFQALFGA

SEQ ID NO: 55684 - protein, 8 aa, Mycobacterium tuberculosis
FQALFGAS

SEQ ID NO: 55685 - protein, 8 aa, Mycobacterium tuberculosis
QALFGASH

SEQ ID NO: 55686 - protein, 8 aa, Mycobacterium tuberculosis
ALFGASHG

SEQ ID NO: 55687 - protein, 8 aa, Mycobacterium tuberculosis
LFGASHGS

SEQ ID NO: 55688 - protein, 9 aa, Mycobacterium tuberculosis
MADTIQVTP

SEQ ID NO: 55689 - protein, 9 aa, Mycobacterium tuberculosis
ADTIQVTPQ

SEQ ID NO: 55690 - protein, 9 aa, Mycobacterium tuberculosis
DTIQVTPQM

SEQ ID NO: 55691 - protein, 9 aa, Mycobacterium tuberculosis
TIQVTPQML

SEQ ID NO: 55692 - protein, 9 aa, Mycobacterium tuberculosis
IQVTPQMLR

SEQ ID NO: 55693 - protein, 9 aa, Mycobacterium tuberculosis
QVTPQMLRS

SEQ ID NO: 55694 - protein, 9 aa, Mycobacterium tuberculosis
VTPQMLRST

SEQ ID NO: 55695 - protein, 9 aa, Mycobacterium tuberculosis
TPQMLRSTA

SEQ ID NO: 55696 - protein, 9 aa, Mycobacterium tuberculosis
PQMLRSTAN

SEQ ID NO: 55697 - protein, 9 aa, Mycobacterium tuberculosis
QMLRSTAND

SEQ ID NO: 55698 - protein, 9 aa, Mycobacterium tuberculosis
MLRSTANDI

SEQ ID NO: 55699 - protein, 9 aa, Mycobacterium tuberculosis
LRSTANDIQ

SEQ ID NO: 55700 - protein, 9 aa, Mycobacterium tuberculosis
RSTANDIQA

SEQ ID NO: 55701 - protein, 9 aa, Mycobacterium tuberculosis
STANDIQAN

SEQ ID NO: 55702 - protein, 9 aa, Mycobacterium tuberculosis
TANDIQANM

SEQ ID NO: 55703 - protein, 9 aa, Mycobacterium tuberculosis
ANDIQANME

SEQ ID NO: 55704 - protein, 9 aa, Mycobacterium tuberculosis
NDIQANMEQ

SEQ ID NO: 55705 - protein, 9 aa, Mycobacterium tuberculosis
DIQANMEQA

SEQ ID NO: 55706 - protein, 9 aa, Mycobacterium tuberculosis
IQANMEQAM

SEQ ID NO: 55707 - protein, 9 aa, Mycobacterium tuberculosis
QANMEQAMG

SEQ ID NO: 55708 - protein, 9 aa, Mycobacterium tuberculosis
ANMEQAMGI

SEQ ID NO: 55709 - protein, 9 aa, Mycobacterium tuberculosis
NMEQAMGIA

SEQ ID NO: 55710 - protein, 9 aa, Mycobacterium tuberculosis
MEQAMGIAK

SEQ ID NO: 55711 - protein, 9 aa, Mycobacterium tuberculosis
EQAMGIAKG

SEQ ID NO: 55712 - protein, 9 aa, Mycobacterium tuberculosis
QAMGIAKGY

SEQ ID NO: 55713 - protein, 9 aa, Mycobacterium tuberculosis
AMGIAKGYL

SEQ ID NO: 55714 - protein, 9 aa, Mycobacterium tuberculosis
MGIAKGYLA

SEQ ID NO: 55715 - protein, 9 aa, Mycobacterium tuberculosis
GIAKGYLAN

SEQ ID NO: 55716 - protein, 9 aa, Mycobacterium tuberculosis
IAKGYLANQ

SEQ ID NO: 55717 - protein, 9 aa, Mycobacterium tuberculosis
AKGYLANQE

SEQ ID NO: 55718 - protein, 9 aa, Mycobacterium tuberculosis
KGYLANQEN

SEQ ID NO: 55719 - protein, 9 aa, Mycobacterium tuberculosis
GYLANQENV

SEQ ID NO: 55720 - protein, 9 aa, Mycobacterium tuberculosis
YLANQENVM

SEQ ID NO: 55721 - protein, 9 aa, Mycobacterium tuberculosis
LANQENVMN

SEQ ID NO: 55722 - protein, 9 aa, Mycobacterium tuberculosis
ANQENVMNP

SEQ ID NO: 55723 - protein, 9 aa, Mycobacterium tuberculosis
NQENVMNPA

SEQ ID NO: 55724 - protein, 9 aa, Mycobacterium tuberculosis
QENVMNPAT

SEQ ID NO: 55725 - protein, 9 aa, Mycobacterium tuberculosis
ENVMNPATW

SEQ ID NO: 55726 - protein, 9 aa, Mycobacterium tuberculosis
NVMNPATWS

SEQ ID NO: 55727 - protein, 9 aa, Mycobacterium tuberculosis
VMNPATWSG

SEQ ID NO: 55728 - protein, 9 aa, Mycobacterium tuberculosis
MNPATWSGT

SEQ ID NO: 55729 - protein, 9 aa, Mycobacterium tuberculosis
NPATWSGTG

SEQ ID NO: 55730 - protein, 9 aa, Mycobacterium tuberculosis
PATWSGTGV

SEQ ID NO: 55731 - protein, 9 aa, Mycobacterium tuberculosis
ATWSGTGVV

SEQ ID NO: 55732 - protein, 9 aa, Mycobacterium tuberculosis
TWSGTGVVA

SEQ ID NO: 55733 - protein, 9 aa, Mycobacterium tuberculosis
WSGTGVVAS

SEQ ID NO: 55734 - protein, 9 aa, Mycobacterium tuberculosis
SGTGVVASH

SEQ ID NO: 55735 - protein, 9 aa, Mycobacterium tuberculosis
GTGVVASHM

SEQ ID NO: 55736 - protein, 9 aa, Mycobacterium tuberculosis
TGVVASHMT

SEQ ID NO: 55737 - protein, 9 aa, Mycobacterium tuberculosis
GVVASHMTA

SEQ ID NO: 55738 - protein, 9 aa, Mycobacterium tuberculosis
VVASHMTAT

SEQ ID NO: 55739 - protein, 9 aa, Mycobacterium tuberculosis
VASHMTATE

SEQ ID NO: 55740 - protein, 9 aa, Mycobacterium tuberculosis
ASHMTATEI

SEQ ID NO: 55741 - protein, 9 aa, Mycobacterium tuberculosis
SHMTATEIT

SEQ ID NO: 55742 - protein, 9 aa, Mycobacterium tuberculosis
HMTATEITN

SEQ ID NO: 55743 - protein, 9 aa, Mycobacterium tuberculosis
MTATEITNE

SEQ ID NO: 55744 - protein, 9 aa, Mycobacterium tuberculosis
TATEITNEL

SEQ ID NO: 55745 - protein, 9 aa, Mycobacterium tuberculosis
ATEITNELN

SEQ ID NO: 55746 - protein, 9 aa, Mycobacterium tuberculosis
TEITNELNK

SEQ ID NO: 55747 - protein, 9 aa, Mycobacterium tuberculosis
EITNELNKV

SEQ ID NO: 55748 - protein, 9 aa, Mycobacterium tuberculosis
ITNELNKVL

SEQ ID NO: 55749 - protein, 9 aa, Mycobacterium tuberculosis
TNELNKVLT

SEQ ID NO: 55750 - protein, 9 aa, Mycobacterium tuberculosis
NELNKVLTG

SEQ ID NO: 55751 - protein, 9 aa, Mycobacterium tuberculosis
ELNKVLTGG

SEQ ID NO: 55752 - protein, 9 aa, Mycobacterium tuberculosis
LNKVLTGGT

SEQ ID NO: 55753 - protein, 9 aa, Mycobacterium tuberculosis
NKVLTGGTR

SEQ ID NO: 55754 - protein, 9 aa, Mycobacterium tuberculosis
KVLTGGTRL

SEQ ID NO: 55755 - protein, 9 aa, Mycobacterium tuberculosis
VLTGGTRLA

SEQ ID NO: 55756 - protein, 9 aa, Mycobacterium tuberculosis
LTGGTRLAE

SEQ ID NO: 55757 - protein, 9 aa, Mycobacterium tuberculosis
TGGTRLAEG

SEQ ID NO: 55758 - protein, 9 aa, Mycobacterium tuberculosis
GGTRLAEGL

SEQ ID NO: 55759 - protein, 9 aa, Mycobacterium tuberculosis
GTRLAEGLV

SEQ ID NO: 55760 - protein, 9 aa, Mycobacterium tuberculosis
TRLAEGLVQ

SEQ ID NO: 55761 - protein, 9 aa, Mycobacterium tuberculosis
RLAEGLVQA

SEQ ID NO: 55762 - protein, 9 aa, Mycobacterium tuberculosis
LAEGLVQAA

SEQ ID NO: 55763 - protein, 9 aa, Mycobacterium tuberculosis
AEGLVQAAA

SEQ ID NO: 55764 - protein, 9 aa, Mycobacterium tuberculosis
EGLVQAAAL

SEQ ID NO: 55765 - protein, 9 aa, Mycobacterium tuberculosis
GLVQAAALM

SEQ ID NO: 55766 - protein, 9 aa, Mycobacterium tuberculosis
LVQAAALME

SEQ ID NO: 55767 - protein, 9 aa, Mycobacterium tuberculosis
VQAAALMEG

SEQ ID NO: 55768 - protein, 9 aa, Mycobacterium tuberculosis
QAAALMEGH

SEQ ID NO: 55769 - protein, 9 aa, Mycobacterium tuberculosis
AAALMEGHE

SEQ ID NO: 55770 - protein, 9 aa, Mycobacterium tuberculosis
AALMEGHEA

SEQ ID NO: 55771 - protein, 9 aa, Mycobacterium tuberculosis
ALMEGHEAD

SEQ ID NO: 55772 - protein, 9 aa, Mycobacterium tuberculosis
LMEGHEADS

SEQ ID NO: 55773 - protein, 9 aa, Mycobacterium tuberculosis
MEGHEADSQ

SEQ ID NO: 55774 - protein, 9 aa, Mycobacterium tuberculosis
EGHEADSQT

SEQ ID NO: 55775 - protein, 9 aa, Mycobacterium tuberculosis
GHEADSQTA

SEQ ID NO: 55776 - protein, 9 aa, Mycobacterium tuberculosis
HEADSQTAF

SEQ ID NO: 55777 - protein, 9 aa, Mycobacterium tuberculosis
EADSQTAFQ

SEQ ID NO: 55778 - protein, 9 aa, Mycobacterium tuberculosis
ADSQTAFQA

SEQ ID NO: 55779 - protein, 9 aa, Mycobacterium tuberculosis
DSQTAFQAL

SEQ ID NO: 55780 - protein, 9 aa, Mycobacterium tuberculosis
SQTAFQALF

SEQ ID NO: 55781 - protein, 9 aa, Mycobacterium tuberculosis
QTAFQALFG

SEQ ID NO: 55782 - protein, 9 aa, Mycobacterium tuberculosis
TAFQALFGA

SEQ ID NO: 55783 - protein, 9 aa, Mycobacterium tuberculosis
AFQALFGAS

SEQ ID NO: 55784 - protein, 9 aa, Mycobacterium tuberculosis
FQALFGASH

SEQ ID NO: 55785 - protein, 9 aa, Mycobacterium tuberculosis
QALFGASHG

SEQ ID NO: 55786 - protein, 9 aa, Mycobacterium tuberculosis
ALFGASHGS

SEQ ID NO: 55787 - protein, 10 aa, Mycobacterium tuberculosis
MADTIQVTPQ

SEQ ID NO: 55788 - protein, 10 aa, Mycobacterium tuberculosis
ADTIQVTPQM

SEQ ID NO: 55789 - protein, 10 aa, Mycobacterium tuberculosis
DTIQVTPQML

SEQ ID NO: 55790 - protein, 10 aa, Mycobacterium tuberculosis
TIQVTPQMLR

SEQ ID NO: 55791 - protein, 10 aa, Mycobacterium tuberculosis
IQVTPQMLRS

SEQ ID NO: 55792 - protein, 10 aa, Mycobacterium tuberculosis
QVTPQMLRST

SEQ ID NO: 55793 - protein, 10 aa, Mycobacterium tuberculosis
VTPQMLRSTA

SEQ ID NO: 55794 - protein, 10 aa, Mycobacterium tuberculosis
TPQMLRSTAN

SEQ ID NO: 55795 - protein, 10 aa, Mycobacterium tuberculosis
PQMLRSTAND

SEQ ID NO: 55796 - protein, 10 aa, Mycobacterium tuberculosis
QMLRSTANDI

SEQ ID NO: 55797 - protein, 10 aa, Mycobacterium tuberculosis
MLRSTANDIQ

SEQ ID NO: 55798 - protein, 10 aa, Mycobacterium tuberculosis
LRSTANDIQA

SEQ ID NO: 55799 - protein, 10 aa, Mycobacterium tuberculosis
RSTANDIQAN

SEQ ID NO: 55800 - protein, 10 aa, Mycobacterium tuberculosis
STANDIQANM

SEQ ID NO: 55801 - protein, 10 aa, Mycobacterium tuberculosis
TANDIQANME

SEQ ID NO: 55802 - protein, 10 aa, Mycobacterium tuberculosis
ANDIQANMEQ

SEQ ID NO: 55803 - protein, 10 aa, Mycobacterium tuberculosis
NDIQANMEQA

SEQ ID NO: 55804 - protein, 10 aa, Mycobacterium tuberculosis
DIQANMEQAM

SEQ ID NO: 55805 - protein, 10 aa, Mycobacterium tuberculosis
IQANMEQAMG

SEQ ID NO: 55806 - protein, 10 aa, Mycobacterium tuberculosis
QANMEQAMGI

SEQ ID NO: 55807 - protein, 10 aa, Mycobacterium tuberculosis
ANMEQAMGIA

SEQ ID NO: 55808 - protein, 10 aa, Mycobacterium tuberculosis
NMEQAMGIAK

SEQ ID NO: 55809 - protein, 10 aa, Mycobacterium tuberculosis
MEQAMGIAKG

SEQ ID NO: 55810 - protein, 10 aa, Mycobacterium tuberculosis
EQAMGIAKGY

SEQ ID NO: 55811 - protein, 10 aa, Mycobacterium tuberculosis
QAMGIAKGYL

SEQ ID NO: 55812 - protein, 10 aa, Mycobacterium tuberculosis
AMGIAKGYLA

SEQ ID NO: 55813 - protein, 10 aa, Mycobacterium tuberculosis
MGIAKGYLAN

SEQ ID NO: 55814 - protein, 10 aa, Mycobacterium tuberculosis
GIAKGYLANQ

SEQ ID NO: 55815 - protein, 10 aa, Mycobacterium tuberculosis
IAKGYLANQE

SEQ ID NO: 55816 - protein, 10 aa, Mycobacterium tuberculosis
AKGYLANQEN

SEQ ID NO: 55817 - protein, 10 aa, Mycobacterium tuberculosis
KGYLANQENV

SEQ ID NO: 55818 - protein, 10 aa, Mycobacterium tuberculosis
GYLANQENVM

SEQ ID NO: 55819 - protein, 10 aa, Mycobacterium tuberculosis
YLANQENVMN

SEQ ID NO: 55820 - protein, 10 aa, Mycobacterium tuberculosis
LANQENVMNP

SEQ ID NO: 55821 - protein, 10 aa, Mycobacterium tuberculosis
ANQENVMNPA

SEQ ID NO: 55822 - protein, 10 aa, Mycobacterium tuberculosis
NQENVMNPAT

SEQ ID NO: 55823 - protein, 10 aa, Mycobacterium tuberculosis
QENVMNPATW

SEQ ID NO: 55824 - protein, 10 aa, Mycobacterium tuberculosis
ENVMNPATWS

SEQ ID NO: 55825 - protein, 10 aa, Mycobacterium tuberculosis
NVMNPATWSG

SEQ ID NO: 55826 - protein, 10 aa, Mycobacterium tuberculosis
VMNPATWSGT

SEQ ID NO: 55827 - protein, 10 aa, Mycobacterium tuberculosis
MNPATWSGTG

SEQ ID NO: 55828 - protein, 10 aa, Mycobacterium tuberculosis
NPATWSGTGV

SEQ ID NO: 55829 - protein, 10 aa, Mycobacterium tuberculosis
PATWSGTGVV

SEQ ID NO: 55830 - protein, 10 aa, Mycobacterium tuberculosis
ATWSGTGVVA

SEQ ID NO: 55831 - protein, 10 aa, Mycobacterium tuberculosis
TWSGTGVVAS

SEQ ID NO: 55832 - protein, 10 aa, Mycobacterium tuberculosis
WSGTGVVASH

SEQ ID NO: 55833 - protein, 10 aa, Mycobacterium tuberculosis
SGTGVVASHM

SEQ ID NO: 55834 - protein, 10 aa, Mycobacterium tuberculosis
GTGVVASHMT

SEQ ID NO: 55835 - protein, 10 aa, Mycobacterium tuberculosis
TGVVASHMTA

SEQ ID NO: 55836 - protein, 10 aa, Mycobacterium tuberculosis
GVVASHMTAT

SEQ ID NO: 55837 - protein, 10 aa, Mycobacterium tuberculosis
VVASHMTATE

SEQ ID NO: 55838 - protein, 10 aa, Mycobacterium tuberculosis
VASHMTATEI

SEQ ID NO: 55839 - protein, 10 aa, Mycobacterium tuberculosis
ASHMTATEIT

SEQ ID NO: 55840 - protein, 10 aa, Mycobacterium tuberculosis
SHMTATEITN

SEQ ID NO: 55841 - protein, 10 aa, Mycobacterium tuberculosis
HMTATEITNE

SEQ ID NO: 55842 - protein, 10 aa, Mycobacterium tuberculosis
MTATEITNEL

SEQ ID NO: 55843 - protein, 10 aa, Mycobacterium tuberculosis
TATEITNELN

SEQ ID NO: 55844 - protein, 10 aa, Mycobacterium tuberculosis
ATEITNELNK

SEQ ID NO: 55845 - protein, 10 aa, Mycobacterium tuberculosis
TEITNELNKV

SEQ ID NO: 55846 - protein, 10 aa, Mycobacterium tuberculosis
EITNELNKVL

SEQ ID NO: 55847 - protein, 10 aa, Mycobacterium tuberculosis
ITNELNKVLT

SEQ ID NO: 55848 - protein, 10 aa, Mycobacterium tuberculosis
TNELNKVLTG

SEQ ID NO: 55849 - protein, 10 aa, Mycobacterium tuberculosis
NELNKVLTGG

SEQ ID NO: 55850 - protein, 10 aa, Mycobacterium tuberculosis
ELNKVLTGGT

SEQ ID NO: 55851 - protein, 10 aa, Mycobacterium tuberculosis
LNKVLTGGTR

SEQ ID NO: 55852 - protein, 10 aa, Mycobacterium tuberculosis
NKVLTGGTRL

SEQ ID NO: 55853 - protein, 10 aa, Mycobacterium tuberculosis
KVLTGGTRLA

SEQ ID NO: 55854 - protein, 10 aa, Mycobacterium tuberculosis
VLTGGTRLAE

SEQ ID NO: 55855 - protein, 10 aa, Mycobacterium tuberculosis
LTGGTRLAEG

SEQ ID NO: 55856 - protein, 10 aa, Mycobacterium tuberculosis
TGGTRLAEGL

SEQ ID NO: 55857 - protein, 10 aa, Mycobacterium tuberculosis
GGTRLAEGLV

SEQ ID NO: 55858 - protein, 10 aa, Mycobacterium tuberculosis
GTRLAEGLVQ

SEQ ID NO: 55859 - protein, 10 aa, Mycobacterium tuberculosis
TRLAEGLVQA

SEQ ID NO: 55860 - protein, 10 aa, Mycobacterium tuberculosis
RLAEGLVQAA

SEQ ID NO: 55861 - protein, 10 aa, Mycobacterium tuberculosis
LAEGLVQAAA

SEQ ID NO: 55862 - protein, 10 aa, Mycobacterium tuberculosis
AEGLVQAAAL

SEQ ID NO: 55863 - protein, 10 aa, Mycobacterium tuberculosis
EGLVQAAALM

SEQ ID NO: 55864 - protein, 10 aa, Mycobacterium tuberculosis
GLVQAAALME

SEQ ID NO: 55865 - protein, 10 aa, Mycobacterium tuberculosis
LVQAAALMEG

SEQ ID NO: 55866 - protein, 10 aa, Mycobacterium tuberculosis
VQAAALMEGH

SEQ ID NO: 55867 - protein, 10 aa, Mycobacterium tuberculosis
QAAALMEGHE

SEQ ID NO: 55868 - protein, 10 aa, Mycobacterium tuberculosis
AAALMEGHEA

SEQ ID NO: 55869 - protein, 10 aa, Mycobacterium tuberculosis
AALMEGHEAD

SEQ ID NO: 55870 - protein, 10 aa, Mycobacterium tuberculosis
ALMEGHEADS

SEQ ID NO: 55871 - protein, 10 aa, Mycobacterium tuberculosis
LMEGHEADSQ

SEQ ID NO: 55872 - protein, 10 aa, Mycobacterium tuberculosis
MEGHEADSQT

SEQ ID NO: 55873 - protein, 10 aa, Mycobacterium tuberculosis
EGHEADSQTA

SEQ ID NO: 55874 - protein, 10 aa, Mycobacterium tuberculosis
GHEADSQTAF

SEQ ID NO: 55875 - protein, 10 aa, Mycobacterium tuberculosis
HEADSQTAFQ

SEQ ID NO: 55876 - protein, 10 aa, Mycobacterium tuberculosis
EADSQTAFQA

SEQ ID NO: 55877 - protein, 10 aa, Mycobacterium tuberculosis
ADSQTAFQAL

SEQ ID NO: 55878 - protein, 10 aa, Mycobacterium tuberculosis
DSQTAFQALF

SEQ ID NO: 55879 - protein, 10 aa, Mycobacterium tuberculosis
SQTAFQALFG

SEQ ID NO: 55880 - protein, 10 aa, Mycobacterium tuberculosis
QTAFQALFGA

SEQ ID NO: 55881 - protein, 10 aa, Mycobacterium tuberculosis
TAFQALFGAS

SEQ ID NO: 55882 - protein, 10 aa, Mycobacterium tuberculosis
AFQALFGASH

SEQ ID NO: 55883 - protein, 10 aa, Mycobacterium tuberculosis
FQALFGASHG

SEQ ID NO: 55884 - protein, 10 aa, Mycobacterium tuberculosis
QALFGASHGS

SEQ ID NO: 55885 - protein, 11 aa, Mycobacterium tuberculosis
MADTIQVTPQM

SEQ ID NO: 55886 - protein, 11 aa, Mycobacterium tuberculosis
ADTIQVTPQML

SEQ ID NO: 55887 - protein, 11 aa, Mycobacterium tuberculosis
DTIQVTPQMLR

SEQ ID NO: 55888 - protein, 11 aa, Mycobacterium tuberculosis
TIQVTPQMLRS

SEQ ID NO: 55889 - protein, 11 aa, Mycobacterium tuberculosis
IQVTPQMLRST

SEQ ID NO: 55890 - protein, 11 aa, Mycobacterium tuberculosis
QVTPQMLRSTA

SEQ ID NO: 55891 - protein, 11 aa, Mycobacterium tuberculosis
VTPQMLRSTAN

SEQ ID NO: 55892 - protein, 11 aa, Mycobacterium tuberculosis
TPQMLRSTAND

SEQ ID NO: 55893 - protein, 11 aa, Mycobacterium tuberculosis
PQMLRSTANDI

SEQ ID NO: 55894 - protein, 11 aa, Mycobacterium tuberculosis
QMLRSTANDIQ

SEQ ID NO: 55895 - protein, 11 aa, Mycobacterium tuberculosis
MLRSTANDIQA

SEQ ID NO: 55896 - protein, 11 aa, Mycobacterium tuberculosis
LRSTANDIQAN

SEQ ID NO: 55897 - protein, 11 aa, Mycobacterium tuberculosis
RSTANDIQANM

SEQ ID NO: 55898 - protein, 11 aa, Mycobacterium tuberculosis
STANDIQANME

SEQ ID NO: 55899 - protein, 11 aa, Mycobacterium tuberculosis
TANDIQANMEQ

SEQ ID NO: 55900 - protein, 11 aa, Mycobacterium tuberculosis
ANDIQANMEQA

SEQ ID NO: 55901 - protein, 11 aa, Mycobacterium tuberculosis
NDIQANMEQAM

SEQ ID NO: 55902 - protein, 11 aa, Mycobacterium tuberculosis
DIQANMEQAMG

SEQ ID NO: 55903 - protein, 11 aa, Mycobacterium tuberculosis
IQANMEQAMGI

SEQ ID NO: 55904 - protein, 11 aa, Mycobacterium tuberculosis
QANMEQAMGIA

SEQ ID NO: 55905 - protein, 11 aa, Mycobacterium tuberculosis
ANMEQAMGIAK

SEQ ID NO: 55906 - protein, 11 aa, Mycobacterium tuberculosis
NMEQAMGIAKG

SEQ ID NO: 55907 - protein, 11 aa, Mycobacterium tuberculosis
MEQAMGIAKGY

SEQ ID NO: 55908 - protein, 11 aa, Mycobacterium tuberculosis
EQAMGIAKGYL

SEQ ID NO: 55909 - protein, 11 aa, Mycobacterium tuberculosis
QAMGIAKGYLA

SEQ ID NO: 55910 - protein, 11 aa, Mycobacterium tuberculosis
AMGIAKGYLAN

SEQ ID NO: 55911 - protein, 11 aa, Mycobacterium tuberculosis
MGIAKGYLANQ

SEQ ID NO: 55912 - protein, 11 aa, Mycobacterium tuberculosis
GIAKGYLANQE

SEQ ID NO: 55913 - protein, 11 aa, Mycobacterium tuberculosis
IAKGYLANQEN

SEQ ID NO: 55914 - protein, 11 aa, Mycobacterium tuberculosis
AKGYLANQENV

SEQ ID NO: 55915 - protein, 11 aa, Mycobacterium tuberculosis
KGYLANQENVM

SEQ ID NO: 55916 - protein, 11 aa, Mycobacterium tuberculosis
GYLANQENVMN

SEQ ID NO: 55917 - protein, 11 aa, Mycobacterium tuberculosis
YLANQENVMNP

SEQ ID NO: 55918 - protein, 11 aa, Mycobacterium tuberculosis
LANQENVMNPA

SEQ ID NO: 55919 - protein, 11 aa, Mycobacterium tuberculosis
ANQENVMNPAT

SEQ ID NO: 55920 - protein, 11 aa, Mycobacterium tuberculosis
NQENVMNPATW

SEQ ID NO: 55921 - protein, 11 aa, Mycobacterium tuberculosis
QENVMNPATWS

SEQ ID NO: 55922 - protein, 11 aa, Mycobacterium tuberculosis
ENVMNPATWSG

SEQ ID NO: 55923 - protein, 11 aa, Mycobacterium tuberculosis
NVMNPATWSGT

SEQ ID NO: 55924 - protein, 11 aa, Mycobacterium tuberculosis
VMNPATWSGTG

SEQ ID NO: 55925 - protein, 11 aa, Mycobacterium tuberculosis
MNPATWSGTGV

SEQ ID NO: 55926 - protein, 11 aa, Mycobacterium tuberculosis
NPATWSGTGVV

SEQ ID NO: 55927 - protein, 11 aa, Mycobacterium tuberculosis
PATWSGTGVVA

SEQ ID NO: 55928 - protein, 11 aa, Mycobacterium tuberculosis
ATWSGTGVVAS

SEQ ID NO: 55929 - protein, 11 aa, Mycobacterium tuberculosis
TWSGTGVVASH

SEQ ID NO: 55930 - protein, 11 aa, Mycobacterium tuberculosis
WSGTGVVASHM

SEQ ID NO: 55931 - protein, 11 aa, Mycobacterium tuberculosis
SGTGVVASHMT

SEQ ID NO: 55932 - protein, 11 aa, Mycobacterium tuberculosis
GTGVVASHMTA

SEQ ID NO: 55933 - protein, 11 aa, Mycobacterium tuberculosis
TGVVASHMTAT

SEQ ID NO: 55934 - protein, 11 aa, Mycobacterium tuberculosis
GVVASHMTATE

SEQ ID NO: 55935 - protein, 11 aa, Mycobacterium tuberculosis
VVASHMTATEI

SEQ ID NO: 55936 - protein, 11 aa, Mycobacterium tuberculosis
VASHMTATEIT

SEQ ID NO: 55937 - protein, 11 aa, Mycobacterium tuberculosis
ASHMTATEITN

SEQ ID NO: 55938 - protein, 11 aa, Mycobacterium tuberculosis
SHMTATEITNE

SEQ ID NO: 55939 - protein, 11 aa, Mycobacterium tuberculosis
HMTATEITNEL

SEQ ID NO: 55940 - protein, 11 aa, Mycobacterium tuberculosis
MTATEITNELN

SEQ ID NO: 55941 - protein, 11 aa, Mycobacterium tuberculosis
TATEITNELNK

SEQ ID NO: 55942 - protein, 11 aa, Mycobacterium tuberculosis
ATEITNELNKV

SEQ ID NO: 55943 - protein, 11 aa, Mycobacterium tuberculosis
TEITNELNKVL

SEQ ID NO: 55944 - protein, 11 aa, Mycobacterium tuberculosis
EITNELNKVLT

SEQ ID NO: 55945 - protein, 11 aa, Mycobacterium tuberculosis
ITNELNKVLTG

SEQ ID NO: 55946 - protein, 11 aa, Mycobacterium tuberculosis
TNELNKVLTGG

SEQ ID NO: 55947 - protein, 11 aa, Mycobacterium tuberculosis
NELNKVLTGGT

SEQ ID NO: 55948 - protein, 11 aa, Mycobacterium tuberculosis
ELNKVLTGGTR

SEQ ID NO: 55949 - protein, 11 aa, Mycobacterium tuberculosis
LNKVLTGGTRL

SEQ ID NO: 55950 - protein, 11 aa, Mycobacterium tuberculosis
NKVLTGGTRLA

SEQ ID NO: 55951 - protein, 11 aa, Mycobacterium tuberculosis
KVLTGGTRLAE

SEQ ID NO: 55952 - protein, 11 aa, Mycobacterium tuberculosis
VLTGGTRLAEG

SEQ ID NO: 55953 - protein, 11 aa, Mycobacterium tuberculosis
LTGGTRLAEGL

SEQ ID NO: 55954 - protein, 11 aa, Mycobacterium tuberculosis
TGGTRLAEGLV

SEQ ID NO: 55955 - protein, 11 aa, Mycobacterium tuberculosis
GGTRLAEGLVQ

SEQ ID NO: 55956 - protein, 11 aa, Mycobacterium tuberculosis
GTRLAEGLVQA

SEQ ID NO: 55957 - protein, 11 aa, Mycobacterium tuberculosis
TRLAEGLVQAA

SEQ ID NO: 55958 - protein, 11 aa, Mycobacterium tuberculosis
RLAEGLVQAAA

SEQ ID NO: 55959 - protein, 11 aa, Mycobacterium tuberculosis
LAEGLVQAAAL

SEQ ID NO: 55960 - protein, 11 aa, Mycobacterium tuberculosis
AEGLVQAAALM

SEQ ID NO: 55961 - protein, 11 aa, Mycobacterium tuberculosis
EGLVQAAALME

SEQ ID NO: 55962 - protein, 11 aa, Mycobacterium tuberculosis
GLVQAAALMEG

SEQ ID NO: 55963 - protein, 11 aa, Mycobacterium tuberculosis
LVQAAALMEGH

SEQ ID NO: 55964 - protein, 11 aa, Mycobacterium tuberculosis
VQAAALMEGHE

SEQ ID NO: 55965 - protein, 11 aa, Mycobacterium tuberculosis
QAAALMEGHEA

SEQ ID NO: 55966 - protein, 11 aa, Mycobacterium tuberculosis
AAALMEGHEAD

SEQ ID NO: 55967 - protein, 11 aa, Mycobacterium tuberculosis
AALMEGHEADS

SEQ ID NO: 55968 - protein, 11 aa, Mycobacterium tuberculosis
ALMEGHEADSQ

SEQ ID NO: 55969 - protein, 11 aa, Mycobacterium tuberculosis
LMEGHEADSQT

SEQ ID NO: 55970 - protein, 11 aa, Mycobacterium tuberculosis
MEGHEADSQTA

SEQ ID NO: 55971 - protein, 11 aa, Mycobacterium tuberculosis
EGHEADSQTAF

SEQ ID NO: 55972 - protein, 11 aa, Mycobacterium tuberculosis
GHEADSQTAFQ

SEQ ID NO: 55973 - protein, 11 aa, Mycobacterium tuberculosis
HEADSQTAFQA

SEQ ID NO: 55974 - protein, 11 aa, Mycobacterium tuberculosis
EADSQTAFQAL

SEQ ID NO: 55975 - protein, 11 aa, Mycobacterium tuberculosis
ADSQTAFQALF

SEQ ID NO: 55976 - protein, 11 aa, Mycobacterium tuberculosis
DSQTAFQALFG

SEQ ID NO: 55977 - protein, 11 aa, Mycobacterium tuberculosis
SQTAFQALFGA

SEQ ID NO: 55978 - protein, 11 aa, Mycobacterium tuberculosis
QTAFQALFGAS

SEQ ID NO: 55979 - protein, 11 aa, Mycobacterium tuberculosis
TAFQALFGASH

SEQ ID NO: 55980 - protein, 11 aa, Mycobacterium tuberculosis
AFQALFGASHG

SEQ ID NO: 55981 - protein, 11 aa, Mycobacterium tuberculosis
FQALFGASHGS

SEQ ID NO: 55982 - protein, 8 aa, Mycobacterium tuberculosis
MDPTVLAD

SEQ ID NO: 55983 - protein, 8 aa, Mycobacterium tuberculosis
DPTVLADA

SEQ ID NO: 55984 - protein, 8 aa, Mycobacterium tuberculosis
PTVLADAV

SEQ ID NO: 55985 - protein, 8 aa, Mycobacterium tuberculosis
TVLADAVA

SEQ ID NO: 55986 - protein, 8 aa, Mycobacterium tuberculosis
VLADAVAR

SEQ ID NO: 55987 - protein, 8 aa, Mycobacterium tuberculosis
LADAVARM

SEQ ID NO: 55988 - protein, 8 aa, Mycobacterium tuberculosis
ADAVARMA

SEQ ID NO: 55989 - protein, 8 aa, Mycobacterium tuberculosis
DAVARMAE

SEQ ID NO: 55990 - protein, 8 aa, Mycobacterium tuberculosis
AVARMAEF

SEQ ID NO: 55991 - protein, 8 aa, Mycobacterium tuberculosis
VARMAEFG

SEQ ID NO: 55992 - protein, 8 aa, Mycobacterium tuberculosis
ARMAEFGR

SEQ ID NO: 55993 - protein, 8 aa, Mycobacterium tuberculosis
RMAEFGRH

SEQ ID NO: 55994 - protein, 8 aa, Mycobacterium tuberculosis
MAEFGRHV

SEQ ID NO: 55995 - protein, 8 aa, Mycobacterium tuberculosis
AEFGRHVE

SEQ ID NO: 55996 - protein, 8 aa, Mycobacterium tuberculosis
EFGRHVEE

SEQ ID NO: 55997 - protein, 8 aa, Mycobacterium tuberculosis
FGRHVEEL

SEQ ID NO: 55998 - protein, 8 aa, Mycobacterium tuberculosis
GRHVEELV

SEQ ID NO: 55999 - protein, 8 aa, Mycobacterium tuberculosis
RHVEELVA

SEQ ID NO: 56000 - protein, 8 aa, Mycobacterium tuberculosis
HVEELVAE

SEQ ID NO: 56001 - protein, 8 aa, Mycobacterium tuberculosis
VEELVAEI

SEQ ID NO: 56002 - protein, 8 aa, Mycobacterium tuberculosis
EELVAEIE

SEQ ID NO: 56003 - protein, 8 aa, Mycobacterium tuberculosis
ELVAEIES

SEQ ID NO: 56004 - protein, 8 aa, Mycobacterium tuberculosis
LVAEIESL

SEQ ID NO: 56005 - protein, 8 aa, Mycobacterium tuberculosis
VAEIESLV

SEQ ID NO: 56006 - protein, 8 aa, Mycobacterium tuberculosis
AEIESLVT

SEQ ID NO: 56007 - protein, 8 aa, Mycobacterium tuberculosis
EIESLVTR

SEQ ID NO: 56008 - protein, 8 aa, Mycobacterium tuberculosis
IESLVTRL

SEQ ID NO: 56009 - protein, 8 aa, Mycobacterium tuberculosis
ESLVTRLH

SEQ ID NO: 56010 - protein, 8 aa, Mycobacterium tuberculosis
SLVTRLHV

SEQ ID NO: 56011 - protein, 8 aa, Mycobacterium tuberculosis
LVTRLHVT

SEQ ID NO: 56012 - protein, 8 aa, Mycobacterium tuberculosis
VTRLHVTW

SEQ ID NO: 56013 - protein, 8 aa, Mycobacterium tuberculosis
TRLHVTWT

SEQ ID NO: 56014 - protein, 8 aa, Mycobacterium tuberculosis
RLHVTWTG

SEQ ID NO: 56015 - protein, 8 aa, Mycobacterium tuberculosis
LHVTWTGE

SEQ ID NO: 56016 - protein, 8 aa, Mycobacterium tuberculosis
HVTWTGEG

SEQ ID NO: 56017 - protein, 8 aa, Mycobacterium tuberculosis
VTWTGEGA

SEQ ID NO: 56018 - protein, 8 aa, Mycobacterium tuberculosis
TWTGEGAA

SEQ ID NO: 56019 - protein, 8 aa, Mycobacterium tuberculosis
WTGEGAAA

SEQ ID NO: 56020 - protein, 8 aa, Mycobacterium tuberculosis
TGEGAAAH

SEQ ID NO: 56021 - protein, 8 aa, Mycobacterium tuberculosis
GEGAAAHA

SEQ ID NO: 56022 - protein, 8 aa, Mycobacterium tuberculosis
EGAAAHAE

SEQ ID NO: 56023 - protein, 8 aa, Mycobacterium tuberculosis
GAAAHAEA

SEQ ID NO: 56024 - protein, 8 aa, Mycobacterium tuberculosis
AAAHAEAQ

SEQ ID NO: 56025 - protein, 8 aa, Mycobacterium tuberculosis
AAHAEAQR

SEQ ID NO: 56026 - protein, 8 aa, Mycobacterium tuberculosis
AHAEAQRH

SEQ ID NO: 56027 - protein, 8 aa, Mycobacterium tuberculosis
HAEAQRHW

SEQ ID NO: 56028 - protein, 8 aa, Mycobacterium tuberculosis
AEAQRHWA

SEQ ID NO: 56029 - protein, 8 aa, Mycobacterium tuberculosis
EAQRHWAA

SEQ ID NO: 56030 - protein, 8 aa, Mycobacterium tuberculosis
AQRHWAAG

SEQ ID NO: 56031 - protein, 8 aa, Mycobacterium tuberculosis
QRHWAAGE

SEQ ID NO: 56032 - protein, 8 aa, Mycobacterium tuberculosis
RHWAAGEA

SEQ ID NO: 56033 - protein, 8 aa, Mycobacterium tuberculosis
HWAAGEAM

SEQ ID NO: 56034 - protein, 8 aa, Mycobacterium tuberculosis
WAAGEAMM

SEQ ID NO: 56035 - protein, 8 aa, Mycobacterium tuberculosis
AAGEAMMR

SEQ ID NO: 56036 - protein, 8 aa, Mycobacterium tuberculosis
AGEAMMRQ

SEQ ID NO: 56037 - protein, 8 aa, Mycobacterium tuberculosis
GEAMMRQA

SEQ ID NO: 56038 - protein, 8 aa, Mycobacterium tuberculosis
EAMMRQAL

SEQ ID NO: 56039 - protein, 8 aa, Mycobacterium tuberculosis
AMMRQALA

SEQ ID NO: 56040 - protein, 8 aa, Mycobacterium tuberculosis
MMRQALAQ

SEQ ID NO: 56041 - protein, 8 aa, Mycobacterium tuberculosis
MRQALAQL

SEQ ID NO: 56042 - protein, 8 aa, Mycobacterium tuberculosis
RQALAQLT

SEQ ID NO: 56043 - protein, 8 aa, Mycobacterium tuberculosis
QALAQLTA

SEQ ID NO: 56044 - protein, 8 aa, Mycobacterium tuberculosis
ALAQLTAA

SEQ ID NO: 56045 - protein, 8 aa, Mycobacterium tuberculosis
LAQLTAAG

SEQ ID NO: 56046 - protein, 8 aa, Mycobacterium tuberculosis
AQLTAAGQ

SEQ ID NO: 56047 - protein, 8 aa, Mycobacterium tuberculosis
QLTAAGQS

SEQ ID NO: 56048 - protein, 8 aa, Mycobacterium tuberculosis
LTAAGQSA

SEQ ID NO: 56049 - protein, 8 aa, Mycobacterium tuberculosis
TAAGQSAH

SEQ ID NO: 56050 - protein, 8 aa, Mycobacterium tuberculosis
AAGQSAHA

SEQ ID NO: 56051 - protein, 8 aa, Mycobacterium tuberculosis
AGQSAHAN

SEQ ID NO: 56052 - protein, 8 aa, Mycobacterium tuberculosis
GQSAHANY

SEQ ID NO: 56053 - protein, 8 aa, Mycobacterium tuberculosis
QSAHANYT

SEQ ID NO: 56054 - protein, 8 aa, Mycobacterium tuberculosis
SAHANYTG

SEQ ID NO: 56055 - protein, 8 aa, Mycobacterium tuberculosis
AHANYTGA

SEQ ID NO: 56056 - protein, 8 aa, Mycobacterium tuberculosis
HANYTGAM

SEQ ID NO: 56057 - protein, 8 aa, Mycobacterium tuberculosis
ANYTGAMA

SEQ ID NO: 56058 - protein, 8 aa, Mycobacterium tuberculosis
NYTGAMAT

SEQ ID NO: 56059 - protein, 8 aa, Mycobacterium tuberculosis
YTGAMATN

SEQ ID NO: 56060 - protein, 8 aa, Mycobacterium tuberculosis
TGAMATNL

SEQ ID NO: 56061 - protein, 8 aa, Mycobacterium tuberculosis
GAMATNLG

SEQ ID NO: 56062 - protein, 8 aa, Mycobacterium tuberculosis
AMATNLGM

SEQ ID NO: 56063 - protein, 8 aa, Mycobacterium tuberculosis
MATNLGMW

SEQ ID NO: 56064 - protein, 8 aa, Mycobacterium tuberculosis
ATNLGMWS

SEQ ID NO: 56065 - protein, 9 aa, Mycobacterium tuberculosis
MDPTVLADA

SEQ ID NO: 56066 - protein, 9 aa, Mycobacterium tuberculosis
DPTVLADAV

SEQ ID NO: 56067 - protein, 9 aa, Mycobacterium tuberculosis
PTVLADAVA

SEQ ID NO: 56068 - protein, 9 aa, Mycobacterium tuberculosis
TVLADAVAR

SEQ ID NO: 56069 - protein, 9 aa, Mycobacterium tuberculosis
VLADAVARM

SEQ ID NO: 56070 - protein, 9 aa, Mycobacterium tuberculosis
LADAVARMA

SEQ ID NO: 56071 - protein, 9 aa, Mycobacterium tuberculosis
ADAVARMAE

SEQ ID NO: 56072 - protein, 9 aa, Mycobacterium tuberculosis
DAVARMAEF

SEQ ID NO: 56073 - protein, 9 aa, Mycobacterium tuberculosis
AVARMAEFG

SEQ ID NO: 56074 - protein, 9 aa, Mycobacterium tuberculosis
VARMAEFGR

SEQ ID NO: 56075 - protein, 9 aa, Mycobacterium tuberculosis
ARMAEFGRH

SEQ ID NO: 56076 - protein, 9 aa, Mycobacterium tuberculosis
RMAEFGRHV

SEQ ID NO: 56077 - protein, 9 aa, Mycobacterium tuberculosis
MAEFGRHVE

SEQ ID NO: 56078 - protein, 9 aa, Mycobacterium tuberculosis
AEFGRHVEE

SEQ ID NO: 56079 - protein, 9 aa, Mycobacterium tuberculosis
EFGRHVEEL

SEQ ID NO: 56080 - protein, 9 aa, Mycobacterium tuberculosis
FGRHVEELV

SEQ ID NO: 56081 - protein, 9 aa, Mycobacterium tuberculosis
GRHVEELVA

SEQ ID NO: 56082 - protein, 9 aa, Mycobacterium tuberculosis
RHVEELVAE

SEQ ID NO: 56083 - protein, 9 aa, Mycobacterium tuberculosis
HVEELVAEI

SEQ ID NO: 56084 - protein, 9 aa, Mycobacterium tuberculosis
VEELVAEIE

SEQ ID NO: 56085 - protein, 9 aa, Mycobacterium tuberculosis
EELVAEIES

SEQ ID NO: 56086 - protein, 9 aa, Mycobacterium tuberculosis
ELVAEIESL

SEQ ID NO: 56087 - protein, 9 aa, Mycobacterium tuberculosis
LVAEIESLV

SEQ ID NO: 56088 - protein, 9 aa, Mycobacterium tuberculosis
VAEIESLVT

SEQ ID NO: 56089 - protein, 9 aa, Mycobacterium tuberculosis
AEIESLVTR

SEQ ID NO: 56090 - protein, 9 aa, Mycobacterium tuberculosis
EIESLVTRL

SEQ ID NO: 56091 - protein, 9 aa, Mycobacterium tuberculosis
IESLVTRLH

SEQ ID NO: 56092 - protein, 9 aa, Mycobacterium tuberculosis
ESLVTRLHV

SEQ ID NO: 56093 - protein, 9 aa, Mycobacterium tuberculosis
SLVTRLHVT

SEQ ID NO: 56094 - protein, 9 aa, Mycobacterium tuberculosis
LVTRLHVTW

SEQ ID NO: 56095 - protein, 9 aa, Mycobacterium tuberculosis
VTRLHVTWT

SEQ ID NO: 56096 - protein, 9 aa, Mycobacterium tuberculosis
TRLHVTWTG

SEQ ID NO: 56097 - protein, 9 aa, Mycobacterium tuberculosis
RLHVTWTGE

SEQ ID NO: 56098 - protein, 9 aa, Mycobacterium tuberculosis
LHVTWTGEG

SEQ ID NO: 56099 - protein, 9 aa, Mycobacterium tuberculosis
HVTWTGEGA

SEQ ID NO: 56100 - protein, 9 aa, Mycobacterium tuberculosis
VTWTGEGAA

SEQ ID NO: 56101 - protein, 9 aa, Mycobacterium tuberculosis
TWTGEGAAA

SEQ ID NO: 56102 - protein, 9 aa, Mycobacterium tuberculosis
WTGEGAAAH

SEQ ID NO: 56103 - protein, 9 aa, Mycobacterium tuberculosis
TGEGAAAHA

SEQ ID NO: 56104 - protein, 9 aa, Mycobacterium tuberculosis
GEGAAAHAE

SEQ ID NO: 56105 - protein, 9 aa, Mycobacterium tuberculosis
EGAAAHAEA

SEQ ID NO: 56106 - protein, 9 aa, Mycobacterium tuberculosis
GAAAHAEAQ

SEQ ID NO: 56107 - protein, 9 aa, Mycobacterium tuberculosis
AAAHAEAQR

SEQ ID NO: 56108 - protein, 9 aa, Mycobacterium tuberculosis
AAHAEAQRH

SEQ ID NO: 56109 - protein, 9 aa, Mycobacterium tuberculosis
AHAEAQRHW

SEQ ID NO: 56110 - protein, 9 aa, Mycobacterium tuberculosis
HAEAQRHWA

SEQ ID NO: 56111 - protein, 9 aa, Mycobacterium tuberculosis
AEAQRHWAA

SEQ ID NO: 56112 - protein, 9 aa, Mycobacterium tuberculosis
EAQRHWAAG

SEQ ID NO: 56113 - protein, 9 aa, Mycobacterium tuberculosis
AQRHWAAGE

SEQ ID NO: 56114 - protein, 9 aa, Mycobacterium tuberculosis
QRHWAAGEA

SEQ ID NO: 56115 - protein, 9 aa, Mycobacterium tuberculosis
RHWAAGEAM

SEQ ID NO: 56116 - protein, 9 aa, Mycobacterium tuberculosis
HWAAGEAMM

SEQ ID NO: 56117 - protein, 9 aa, Mycobacterium tuberculosis
WAAGEAMMR

SEQ ID NO: 56118 - protein, 9 aa, Mycobacterium tuberculosis
AAGEAMMRQ

SEQ ID NO: 56119 - protein, 9 aa, Mycobacterium tuberculosis
AGEAMMRQA

SEQ ID NO: 56120 - protein, 9 aa, Mycobacterium tuberculosis
GEAMMRQAL

SEQ ID NO: 56121 - protein, 9 aa, Mycobacterium tuberculosis
EAMMRQALA

SEQ ID NO: 56122 - protein, 9 aa, Mycobacterium tuberculosis
AMMRQALAQ

SEQ ID NO: 56123 - protein, 9 aa, Mycobacterium tuberculosis
MMRQALAQL

SEQ ID NO: 56124 - protein, 9 aa, Mycobacterium tuberculosis
MRQALAQLT

SEQ ID NO: 56125 - protein, 9 aa, Mycobacterium tuberculosis
RQALAQLTA

SEQ ID NO: 56126 - protein, 9 aa, Mycobacterium tuberculosis
QALAQLTAA

SEQ ID NO: 56127 - protein, 9 aa, Mycobacterium tuberculosis
ALAQLTAAG

SEQ ID NO: 56128 - protein, 9 aa, Mycobacterium tuberculosis
LAQLTAAGQ

SEQ ID NO: 56129 - protein, 9 aa, Mycobacterium tuberculosis
AQLTAAGQS

SEQ ID NO: 56130 - protein, 9 aa, Mycobacterium tuberculosis
QLTAAGQSA

SEQ ID NO: 56131 - protein, 9 aa, Mycobacterium tuberculosis
LTAAGQSAH

SEQ ID NO: 56132 - protein, 9 aa, Mycobacterium tuberculosis
TAAGQSAHA

SEQ ID NO: 56133 - protein, 9 aa, Mycobacterium tuberculosis
AAGQSAHAN

SEQ ID NO: 56134 - protein, 9 aa, Mycobacterium tuberculosis
AGQSAHANY

SEQ ID NO: 56135 - protein, 9 aa, Mycobacterium tuberculosis
GQSAHANYT

SEQ ID NO: 56136 - protein, 9 aa, Mycobacterium tuberculosis
QSAHANYTG

SEQ ID NO: 56137 - protein, 9 aa, Mycobacterium tuberculosis
SAHANYTGA

SEQ ID NO: 56138 - protein, 9 aa, Mycobacterium tuberculosis
AHANYTGAM

SEQ ID NO: 56139 - protein, 9 aa, Mycobacterium tuberculosis
HANYTGAMA

SEQ ID NO: 56140 - protein, 9 aa, Mycobacterium tuberculosis
ANYTGAMAT

SEQ ID NO: 56141 - protein, 9 aa, Mycobacterium tuberculosis
NYTGAMATN

SEQ ID NO: 56142 - protein, 9 aa, Mycobacterium tuberculosis
YTGAMATNL

SEQ ID NO: 56143 - protein, 9 aa, Mycobacterium tuberculosis
TGAMATNLG

SEQ ID NO: 56144 - protein, 9 aa, Mycobacterium tuberculosis
GAMATNLGM

SEQ ID NO: 56145 - protein, 9 aa, Mycobacterium tuberculosis
AMATNLGMW

SEQ ID NO: 56146 - protein, 9 aa, Mycobacterium tuberculosis
MATNLGMWS

SEQ ID NO: 56147 - protein, 10 aa, Mycobacterium tuberculosis
MDPTVLADAV

SEQ ID NO: 56148 - protein, 10 aa, Mycobacterium tuberculosis
DPTVLADAVA

SEQ ID NO: 56149 - protein, 10 aa, Mycobacterium tuberculosis
PTVLADAVAR

SEQ ID NO: 56150 - protein, 10 aa, Mycobacterium tuberculosis
TVLADAVARM

SEQ ID NO: 56151 - protein, 10 aa, Mycobacterium tuberculosis
VLADAVARMA

SEQ ID NO: 56152 - protein, 10 aa, Mycobacterium tuberculosis
LADAVARMAE

SEQ ID NO: 56153 - protein, 10 aa, Mycobacterium tuberculosis
ADAVARMAEF

SEQ ID NO: 56154 - protein, 10 aa, Mycobacterium tuberculosis
DAVARMAEFG

SEQ ID NO: 56155 - protein, 10 aa, Mycobacterium tuberculosis
AVARMAEFGR

SEQ ID NO: 56156 - protein, 10 aa, Mycobacterium tuberculosis
VARMAEFGRH

SEQ ID NO: 56157 - protein, 10 aa, Mycobacterium tuberculosis
ARMAEFGRHV

SEQ ID NO: 56158 - protein, 10 aa, Mycobacterium tuberculosis
RMAEFGRHVE

SEQ ID NO: 56159 - protein, 10 aa, Mycobacterium tuberculosis
MAEFGRHVEE

SEQ ID NO: 56160 - protein, 10 aa, Mycobacterium tuberculosis
AEFGRHVEEL

SEQ ID NO: 56161 - protein, 10 aa, Mycobacterium tuberculosis
EFGRHVEELV

SEQ ID NO: 56162 - protein, 10 aa, Mycobacterium tuberculosis
FGRHVEELVA

SEQ ID NO: 56163 - protein, 10 aa, Mycobacterium tuberculosis
GRHVEELVAE

SEQ ID NO: 56164 - protein, 10 aa, Mycobacterium tuberculosis
RHVEELVAEI

SEQ ID NO: 56165 - protein, 10 aa, Mycobacterium tuberculosis
HVEELVAEIE

SEQ ID NO: 56166 - protein, 10 aa, Mycobacterium tuberculosis
VEELVAEIES

SEQ ID NO: 56167 - protein, 10 aa, Mycobacterium tuberculosis
EELVAEIESL

SEQ ID NO: 56168 - protein, 10 aa, Mycobacterium tuberculosis
ELVAEIESLV

SEQ ID NO: 56169 - protein, 10 aa, Mycobacterium tuberculosis
LVAEIESLVT

SEQ ID NO: 56170 - protein, 10 aa, Mycobacterium tuberculosis
VAEIESLVTR

SEQ ID NO: 56171 - protein, 10 aa, Mycobacterium tuberculosis
AEIESLVTRL

SEQ ID NO: 56172 - protein, 10 aa, Mycobacterium tuberculosis
EIESLVTRLH

SEQ ID NO: 56173 - protein, 10 aa, Mycobacterium tuberculosis
IESLVTRLHV

SEQ ID NO: 56174 - protein, 10 aa, Mycobacterium tuberculosis
ESLVTRLHVT

SEQ ID NO: 56175 - protein, 10 aa, Mycobacterium tuberculosis
SLVTRLHVTW

SEQ ID NO: 56176 - protein, 10 aa, Mycobacterium tuberculosis
LVTRLHVTWT

SEQ ID NO: 56177 - protein, 10 aa, Mycobacterium tuberculosis
VTRLHVTWTG

SEQ ID NO: 56178 - protein, 10 aa, Mycobacterium tuberculosis
TRLHVTWTGE

SEQ ID NO: 56179 - protein, 10 aa, Mycobacterium tuberculosis
RLHVTWTGEG

SEQ ID NO: 56180 - protein, 10 aa, Mycobacterium tuberculosis
LHVTWTGEGA

SEQ ID NO: 56181 - protein, 10 aa, Mycobacterium tuberculosis
HVTWTGEGAA

SEQ ID NO: 56182 - protein, 10 aa, Mycobacterium tuberculosis
VTWTGEGAAA

SEQ ID NO: 56183 - protein, 10 aa, Mycobacterium tuberculosis
TWTGEGAAAH

SEQ ID NO: 56184 - protein, 10 aa, Mycobacterium tuberculosis
WTGEGAAAHA

SEQ ID NO: 56185 - protein, 10 aa, Mycobacterium tuberculosis
TGEGAAAHAE

SEQ ID NO: 56186 - protein, 10 aa, Mycobacterium tuberculosis
GEGAAAHAEA

SEQ ID NO: 56187 - protein, 10 aa, Mycobacterium tuberculosis
EGAAAHAEAQ

SEQ ID NO: 56188 - protein, 10 aa, Mycobacterium tuberculosis
GAAAHAEAQR

SEQ ID NO: 56189 - protein, 10 aa, Mycobacterium tuberculosis
AAAHAEAQRH

SEQ ID NO: 56190 - protein, 10 aa, Mycobacterium tuberculosis
AAHAEAQRHW

SEQ ID NO: 56191 - protein, 10 aa, Mycobacterium tuberculosis
AHAEAQRHWA

SEQ ID NO: 56192 - protein, 10 aa, Mycobacterium tuberculosis
HAEAQRHWAA

SEQ ID NO: 56193 - protein, 10 aa, Mycobacterium tuberculosis
AEAQRHWAAG

SEQ ID NO: 56194 - protein, 10 aa, Mycobacterium tuberculosis
EAQRHWAAGE

SEQ ID NO: 56195 - protein, 10 aa, Mycobacterium tuberculosis
AQRHWAAGEA

SEQ ID NO: 56196 - protein, 10 aa, Mycobacterium tuberculosis
QRHWAAGEAM

SEQ ID NO: 56197 - protein, 10 aa, Mycobacterium tuberculosis
RHWAAGEAMM

SEQ ID NO: 56198 - protein, 10 aa, Mycobacterium tuberculosis
HWAAGEAMMR

SEQ ID NO: 56199 - protein, 10 aa, Mycobacterium tuberculosis
WAAGEAMMRQ

SEQ ID NO: 56200 - protein, 10 aa, Mycobacterium tuberculosis
AAGEAMMRQA

SEQ ID NO: 56201 - protein, 10 aa, Mycobacterium tuberculosis
AGEAMMRQAL

SEQ ID NO: 56202 - protein, 10 aa, Mycobacterium tuberculosis
GEAMMRQALA

SEQ ID NO: 56203 - protein, 10 aa, Mycobacterium tuberculosis
EAMMRQALAQ

SEQ ID NO: 56204 - protein, 10 aa, Mycobacterium tuberculosis
AMMRQALAQL

SEQ ID NO: 56205 - protein, 10 aa, Mycobacterium tuberculosis
MMRQALAQLT

SEQ ID NO: 56206 - protein, 10 aa, Mycobacterium tuberculosis
MRQALAQLTA

SEQ ID NO: 56207 - protein, 10 aa, Mycobacterium tuberculosis
RQALAQLTAA

SEQ ID NO: 56208 - protein, 10 aa, Mycobacterium tuberculosis
QALAQLTAAG

SEQ ID NO: 56209 - protein, 10 aa, Mycobacterium tuberculosis
ALAQLTAAGQ

SEQ ID NO: 56210 - protein, 10 aa, Mycobacterium tuberculosis
LAQLTAAGQS

SEQ ID NO: 56211 - protein, 10 aa, Mycobacterium tuberculosis
AQLTAAGQSA

SEQ ID NO: 56212 - protein, 10 aa, Mycobacterium tuberculosis
QLTAAGQSAH

SEQ ID NO: 56213 - protein, 10 aa, Mycobacterium tuberculosis
LTAAGQSAHA

SEQ ID NO: 56214 - protein, 10 aa, Mycobacterium tuberculosis
TAAGQSAHAN

SEQ ID NO: 56215 - protein, 10 aa, Mycobacterium tuberculosis
AAGQSAHANY

SEQ ID NO: 56216 - protein, 10 aa, Mycobacterium tuberculosis
AGQSAHANYT

SEQ ID NO: 56217 - protein, 10 aa, Mycobacterium tuberculosis
GQSAHANYTG

SEQ ID NO: 56218 - protein, 10 aa, Mycobacterium tuberculosis
QSAHANYTGA

SEQ ID NO: 56219 - protein, 10 aa, Mycobacterium tuberculosis
SAHANYTGAM

SEQ ID NO: 56220 - protein, 10 aa, Mycobacterium tuberculosis
AHANYTGAMA

SEQ ID NO: 56221 - protein, 10 aa, Mycobacterium tuberculosis
HANYTGAMAT

SEQ ID NO: 56222 - protein, 10 aa, Mycobacterium tuberculosis
ANYTGAMATN

SEQ ID NO: 56223 - protein, 10 aa, Mycobacterium tuberculosis
NYTGAMATNL

SEQ ID NO: 56224 - protein, 10 aa, Mycobacterium tuberculosis
YTGAMATNLG

SEQ ID NO: 56225 - protein, 10 aa, Mycobacterium tuberculosis
TGAMATNLGM

SEQ ID NO: 56226 - protein, 10 aa, Mycobacterium tuberculosis
GAMATNLGMW

SEQ ID NO: 56227 - protein, 10 aa, Mycobacterium tuberculosis
AMATNLGMWS

SEQ ID NO: 56228 - protein, 11 aa, Mycobacterium tuberculosis
MDPTVLADAVA

SEQ ID NO: 56229 - protein, 11 aa, Mycobacterium tuberculosis
DPTVLADAVAR

SEQ ID NO: 56230 - protein, 11 aa, Mycobacterium tuberculosis
PTVLADAVARM

SEQ ID NO: 56231 - protein, 11 aa, Mycobacterium tuberculosis
TVLADAVARMA

SEQ ID NO: 56232 - protein, 11 aa, Mycobacterium tuberculosis
VLADAVARMAE

SEQ ID NO: 56233 - protein, 11 aa, Mycobacterium tuberculosis
LADAVARMAEF

SEQ ID NO: 56234 - protein, 11 aa, Mycobacterium tuberculosis
ADAVARMAEFG

SEQ ID NO: 56235 - protein, 11 aa, Mycobacterium tuberculosis
DAVARMAEFGR

SEQ ID NO: 56236 - protein, 11 aa, Mycobacterium tuberculosis
AVARMAEFGRH

SEQ ID NO: 56237 - protein, 11 aa, Mycobacterium tuberculosis
VARMAEFGRHV

SEQ ID NO: 56238 - protein, 11 aa, Mycobacterium tuberculosis
ARMAEFGRHVE

SEQ ID NO: 56239 - protein, 11 aa, Mycobacterium tuberculosis
RMAEFGRHVEE

SEQ ID NO: 56240 - protein, 11 aa, Mycobacterium tuberculosis
MAEFGRHVEEL

SEQ ID NO: 56241 - protein, 11 aa, Mycobacterium tuberculosis
AEFGRHVEELV

SEQ ID NO: 56242 - protein, 11 aa, Mycobacterium tuberculosis
EFGRHVEELVA

SEQ ID NO: 56243 - protein, 11 aa, Mycobacterium tuberculosis
FGRHVEELVAE

SEQ ID NO: 56244 - protein, 11 aa, Mycobacterium tuberculosis
GRHVEELVAEI

SEQ ID NO: 56245 - protein, 11 aa, Mycobacterium tuberculosis
RHVEELVAEIE

SEQ ID NO: 56246 - protein, 11 aa, Mycobacterium tuberculosis
HVEELVAEIES

SEQ ID NO: 56247 - protein, 11 aa, Mycobacterium tuberculosis
VEELVAEIESL

SEQ ID NO: 56248 - protein, 11 aa, Mycobacterium tuberculosis
EELVAEIESLV

SEQ ID NO: 56249 - protein, 11 aa, Mycobacterium tuberculosis
ELVAEIESLVT

SEQ ID NO: 56250 - protein, 11 aa, Mycobacterium tuberculosis
LVAEIESLVTR

SEQ ID NO: 56251 - protein, 11 aa, Mycobacterium tuberculosis
VAEIESLVTRL

SEQ ID NO: 56252 - protein, 11 aa, Mycobacterium tuberculosis
AEIESLVTRLH

SEQ ID NO: 56253 - protein, 11 aa, Mycobacterium tuberculosis
EIESLVTRLHV

SEQ ID NO: 56254 - protein, 11 aa, Mycobacterium tuberculosis
IESLVTRLHVT

SEQ ID NO: 56255 - protein, 11 aa, Mycobacterium tuberculosis
ESLVTRLHVTW

SEQ ID NO: 56256 - protein, 11 aa, Mycobacterium tuberculosis
SLVTRLHVTWT

SEQ ID NO: 56257 - protein, 11 aa, Mycobacterium tuberculosis
LVTRLHVTWTG

SEQ ID NO: 56258 - protein, 11 aa, Mycobacterium tuberculosis
VTRLHVTWTGE

SEQ ID NO: 56259 - protein, 11 aa, Mycobacterium tuberculosis
TRLHVTWTGEG

SEQ ID NO: 56260 - protein, 11 aa, Mycobacterium tuberculosis
RLHVTWTGEGA

SEQ ID NO: 56261 - protein, 11 aa, Mycobacterium tuberculosis
LHVTWTGEGAA

SEQ ID NO: 56262 - protein, 11 aa, Mycobacterium tuberculosis
HVTWTGEGAAA

SEQ ID NO: 56263 - protein, 11 aa, Mycobacterium tuberculosis
VTWTGEGAAAH

SEQ ID NO: 56264 - protein, 11 aa, Mycobacterium tuberculosis
TWTGEGAAAHA

SEQ ID NO: 56265 - protein, 11 aa, Mycobacterium tuberculosis
WTGEGAAAHAE

SEQ ID NO: 56266 - protein, 11 aa, Mycobacterium tuberculosis
TGEGAAAHAEA

SEQ ID NO: 56267 - protein, 11 aa, Mycobacterium tuberculosis
GEGAAAHAEAQ

SEQ ID NO: 56268 - protein, 11 aa, Mycobacterium tuberculosis
EGAAAHAEAQR

SEQ ID NO: 56269 - protein, 11 aa, Mycobacterium tuberculosis
GAAAHAEAQRH

SEQ ID NO: 56270 - protein, 11 aa, Mycobacterium tuberculosis
AAAHAEAQRHW

SEQ ID NO: 56271 - protein, 11 aa, Mycobacterium tuberculosis
AAHAEAQRHWA

SEQ ID NO: 56272 - protein, 11 aa, Mycobacterium tuberculosis
AHAEAQRHWAA

SEQ ID NO: 56273 - protein, 11 aa, Mycobacterium tuberculosis
HAEAQRHWAAG

SEQ ID NO: 56274 - protein, 11 aa, Mycobacterium tuberculosis
AEAQRHWAAGE

SEQ ID NO: 56275 - protein, 11 aa, Mycobacterium tuberculosis
EAQRHWAAGEA

SEQ ID NO: 56276 - protein, 11 aa, Mycobacterium tuberculosis
AQRHWAAGEAM

SEQ ID NO: 56277 - protein, 11 aa, Mycobacterium tuberculosis
QRHWAAGEAMM

SEQ ID NO: 56278 - protein, 11 aa, Mycobacterium tuberculosis
RHWAAGEAMMR

SEQ ID NO: 56279 - protein, 11 aa, Mycobacterium tuberculosis
HWAAGEAMMRQ

SEQ ID NO: 56280 - protein, 11 aa, Mycobacterium tuberculosis
WAAGEAMMRQA

SEQ ID NO: 56281 - protein, 11 aa, Mycobacterium tuberculosis
AAGEAMMRQAL

SEQ ID NO: 56282 - protein, 11 aa, Mycobacterium tuberculosis
AGEAMMRQALA

SEQ ID NO: 56283 - protein, 11 aa, Mycobacterium tuberculosis
GEAMMRQALAQ

SEQ ID NO: 56284 - protein, 11 aa, Mycobacterium tuberculosis
EAMMRQALAQL

SEQ ID NO: 56285 - protein, 11 aa, Mycobacterium tuberculosis
AMMRQALAQLT

SEQ ID NO: 56286 - protein, 11 aa, Mycobacterium tuberculosis
MMRQALAQLTA

SEQ ID NO: 56287 - protein, 11 aa, Mycobacterium tuberculosis
MRQALAQLTAA

SEQ ID NO: 56288 - protein, 11 aa, Mycobacterium tuberculosis
RQALAQLTAAG

SEQ ID NO: 56289 - protein, 11 aa, Mycobacterium tuberculosis
QALAQLTAAGQ

SEQ ID NO: 56290 - protein, 11 aa, Mycobacterium tuberculosis
ALAQLTAAGQS

SEQ ID NO: 56291 - protein, 11 aa, Mycobacterium tuberculosis
LAQLTAAGQSA

SEQ ID NO: 56292 - protein, 11 aa, Mycobacterium tuberculosis
AQLTAAGQSAH

SEQ ID NO: 56293 - protein, 11 aa, Mycobacterium tuberculosis
QLTAAGQSAHA

SEQ ID NO: 56294 - protein, 11 aa, Mycobacterium tuberculosis
LTAAGQSAHAN

SEQ ID NO: 56295 - protein, 11 aa, Mycobacterium tuberculosis
TAAGQSAHANY

SEQ ID NO: 56296 - protein, 11 aa, Mycobacterium tuberculosis
AAGQSAHANYT

SEQ ID NO: 56297 - protein, 11 aa, Mycobacterium tuberculosis
AGQSAHANYTG

SEQ ID NO: 56298 - protein, 11 aa, Mycobacterium tuberculosis
GQSAHANYTGA

SEQ ID NO: 56299 - protein, 11 aa, Mycobacterium tuberculosis
QSAHANYTGAM

SEQ ID NO: 56300 - protein, 11 aa, Mycobacterium tuberculosis
SAHANYTGAMA

SEQ ID NO: 56301 - protein, 11 aa, Mycobacterium tuberculosis
AHANYTGAMAT

SEQ ID NO: 56302 - protein, 11 aa, Mycobacterium tuberculosis
HANYTGAMATN

SEQ ID NO: 56303 - protein, 11 aa, Mycobacterium tuberculosis
ANYTGAMATNL

SEQ ID NO: 56304 - protein, 11 aa, Mycobacterium tuberculosis
NYTGAMATNLG

SEQ ID NO: 56305 - protein, 11 aa, Mycobacterium tuberculosis
YTGAMATNLGM

SEQ ID NO: 56306 - protein, 11 aa, Mycobacterium tuberculosis
TGAMATNLGMW

SEQ ID NO: 56307 - protein, 11 aa, Mycobacterium tuberculosis
GAMATNLGMWS

SEQ ID NO: 56308 - protein, 90 aa, Mycobacterium tuberculosis; identical to SEQ ID NO: 78

SEQ ID NO: 56309 - protein, 8 aa, Mycobacterium tuberculosis
MGADDTLR

SEQ ID NO: 56310 - protein, 8 aa, Mycobacterium tuberculosis
GADDTLRV

SEQ ID NO: 56311 - protein, 8 aa, Mycobacterium tuberculosis
ADDTLRVE

SEQ ID NO: 56312 - protein, 8 aa, Mycobacterium tuberculosis
DDTLRVEP

SEQ ID NO: 56313 - protein, 8 aa, Mycobacterium tuberculosis
DTLRVEPA

SEQ ID NO: 56314 - protein, 8 aa, Mycobacterium tuberculosis
TLRVEPAV

SEQ ID NO: 56315 - protein, 8 aa, Mycobacterium tuberculosis
LRVEPAVM

SEQ ID NO: 56316 - protein, 8 aa, Mycobacterium tuberculosis
RVEPAVMQ

SEQ ID NO: 56317 - protein, 8 aa, Mycobacterium tuberculosis
VEPAVMQG

SEQ ID NO: 56318 - protein, 8 aa, Mycobacterium tuberculosis
EPAVMQGF

SEQ ID NO: 56319 - protein, 8 aa, Mycobacterium tuberculosis
PAVMQGFA

SEQ ID NO: 56320 - protein, 8 aa, Mycobacterium tuberculosis
AVMQGFAA

SEQ ID NO: 56321 - protein, 8 aa, Mycobacterium tuberculosis
VMQGFAAS

SEQ ID NO: 56322 - protein, 8 aa, Mycobacterium tuberculosis
MQGFAASL

SEQ ID NO: 56323 - protein, 8 aa, Mycobacterium tuberculosis
QGFAASLD

SEQ ID NO: 56324 - protein, 8 aa, Mycobacterium tuberculosis
GFAASLDG

SEQ ID NO: 56325 - protein, 8 aa, Mycobacterium tuberculosis
FAASLDGA

SEQ ID NO: 56326 - protein, 8 aa, Mycobacterium tuberculosis
AASLDGAA

SEQ ID NO: 56327 - protein, 8 aa, Mycobacterium tuberculosis
ASLDGAAE

SEQ ID NO: 56328 - protein, 8 aa, Mycobacterium tuberculosis
SLDGAAEH

SEQ ID NO: 56329 - protein, 8 aa, Mycobacterium tuberculosis
LDGAAEHL

SEQ ID NO: 56330 - protein, 8 aa, Mycobacterium tuberculosis
DGAAEHLA

SEQ ID NO: 56331 - protein, 8 aa, Mycobacterium tuberculosis
GAAEHLAV

SEQ ID NO: 56332 - protein, 8 aa, Mycobacterium tuberculosis
AAEHLAVQ

SEQ ID NO: 56333 - protein, 8 aa, Mycobacterium tuberculosis
AEHLAVQL

SEQ ID NO: 56334 - protein, 8 aa, Mycobacterium tuberculosis
EHLAVQLA

SEQ ID NO: 56335 - protein, 8 aa, Mycobacterium tuberculosis
HLAVQLAE

SEQ ID NO: 56336 - protein, 8 aa, Mycobacterium tuberculosis
LAVQLAEL

SEQ ID NO: 56337 - protein, 8 aa, Mycobacterium tuberculosis
AVQLAELD

SEQ ID NO: 56338 - protein, 8 aa, Mycobacterium tuberculosis
VQLAELDA

SEQ ID NO: 56339 - protein, 8 aa, Mycobacterium tuberculosis
QLAELDAQ

SEQ ID NO: 56340 - protein, 8 aa, Mycobacterium tuberculosis
LAELDAQV

SEQ ID NO: 56341 - protein, 8 aa, Mycobacterium tuberculosis
AELDAQVG

SEQ ID NO: 56342 - protein, 8 aa, Mycobacterium tuberculosis
ELDAQVGQ

SEQ ID NO: 56343 - protein, 8 aa, Mycobacterium tuberculosis
LDAQVGQM

SEQ ID NO: 56344 - protein, 8 aa, Mycobacterium tuberculosis
DAQVGQML

SEQ ID NO: 56345 - protein, 8 aa, Mycobacterium tuberculosis
AQVGQMLG

SEQ ID NO: 56346 - protein, 8 aa, Mycobacterium tuberculosis
QVGQMLGG

SEQ ID NO: 56347 - protein, 8 aa, Mycobacterium tuberculosis
VGQMLGGW

SEQ ID NO: 56348 - protein, 8 aa, Mycobacterium tuberculosis
GQMLGGWR

SEQ ID NO: 56349 - protein, 8 aa, Mycobacterium tuberculosis
QMLGGWRG

SEQ ID NO: 56350 - protein, 8 aa, Mycobacterium tuberculosis
MLGGWRGA

SEQ ID NO: 56351 - protein, 8 aa, Mycobacterium tuberculosis
LGGWRGAS

SEQ ID NO: 56352 - protein, 8 aa, Mycobacterium tuberculosis
GGWRGASG

SEQ ID NO: 56353 - protein, 8 aa, Mycobacterium tuberculosis
GWRGASGS

SEQ ID NO: 56354 - protein, 8 aa, Mycobacterium tuberculosis
WRGASGSA

SEQ ID NO: 56355 - protein, 8 aa, Mycobacterium tuberculosis
RGASGSAY

SEQ ID NO: 56356 - protein, 8 aa, Mycobacterium tuberculosis
GASGSAYG

SEQ ID NO: 56357 - protein, 8 aa, Mycobacterium tuberculosis
ASGSAYGS

SEQ ID NO: 56358 - protein, 8 aa, Mycobacterium tuberculosis
SGSAYGSA

SEQ ID NO: 56359 - protein, 8 aa, Mycobacterium tuberculosis
GSAYGSAW

SEQ ID NO: 56360 - protein, 8 aa, Mycobacterium tuberculosis
SAYGSAWE

SEQ ID NO: 56361 - protein, 8 aa, Mycobacterium tuberculosis
AYGSAWEL

SEQ ID NO: 56362 - protein, 8 aa, Mycobacterium tuberculosis
YGSAWELW

SEQ ID NO: 56363 - protein, 8 aa, Mycobacterium tuberculosis
GSAWELWH

SEQ ID NO: 56364 - protein, 8 aa, Mycobacterium tuberculosis
SAWELWHR

SEQ ID NO: 56365 - protein, 8 aa, Mycobacterium tuberculosis
AWELWHRG

SEQ ID NO: 56366 - protein, 8 aa, Mycobacterium tuberculosis
WELWHRGA

SEQ ID NO: 56367 - protein, 8 aa, Mycobacterium tuberculosis
ELWHRGAG

SEQ ID NO: 56368 - protein, 8 aa, Mycobacterium tuberculosis
LWHRGAGE

SEQ ID NO: 56369 - protein, 8 aa, Mycobacterium tuberculosis
WHRGAGEV

SEQ ID NO: 56370 - protein, 8 aa, Mycobacterium tuberculosis
HRGAGEVQ

SEQ ID NO: 56371 - protein, 8 aa, Mycobacterium tuberculosis
RGAGEVQL

SEQ ID NO: 56372 - protein, 8 aa, Mycobacterium tuberculosis
GAGEVQLG

SEQ ID NO: 56373 - protein, 8 aa, Mycobacterium tuberculosis
AGEVQLGL

SEQ ID NO: 56374 - protein, 8 aa, Mycobacterium tuberculosis
GEVQLGLS

SEQ ID NO: 56375 - protein, 8 aa, Mycobacterium tuberculosis
EVQLGLSM

SEQ ID NO: 56376 - protein, 8 aa, Mycobacterium tuberculosis
VQLGLSML

SEQ ID NO: 56377 - protein, 8 aa, Mycobacterium tuberculosis
QLGLSMLA

SEQ ID NO: 56378 - protein, 8 aa, Mycobacterium tuberculosis
LGLSMLAA

SEQ ID NO: 56379 - protein, 8 aa, Mycobacterium tuberculosis
GLSMLAAA

SEQ ID NO: 56380 - protein, 8 aa, Mycobacterium tuberculosis
LSMLAAAI

SEQ ID NO: 56381 - protein, 8 aa, Mycobacterium tuberculosis
SMLAAAIA

SEQ ID NO: 56382 - protein, 8 aa, Mycobacterium tuberculosis
MLAAAIAH

SEQ ID NO: 56383 - protein, 8 aa, Mycobacterium tuberculosis
LAAAIAHA

SEQ ID NO: 56384 - protein, 8 aa, Mycobacterium tuberculosis
AAAIAHAG

SEQ ID NO: 56385 - protein, 8 aa, Mycobacterium tuberculosis
AAIAHAGA

SEQ ID NO: 56386 - protein, 8 aa, Mycobacterium tuberculosis
AIAHAGAG

SEQ ID NO: 56387 - protein, 8 aa, Mycobacterium tuberculosis
IAHAGAGY

SEQ ID NO: 56388 - protein, 8 aa, Mycobacterium tuberculosis
AHAGAGYQ

SEQ ID NO: 56389 - protein, 8 aa, Mycobacterium tuberculosis
HAGAGYQH

SEQ ID NO: 56390 - protein, 8 aa, Mycobacterium tuberculosis
AGAGYQHN

SEQ ID NO: 56391 - protein, 8 aa, Mycobacterium tuberculosis
GAGYQHNE

SEQ ID NO: 56392 - protein, 8 aa, Mycobacterium tuberculosis
AGYQHNET

SEQ ID NO: 56393 - protein, 8 aa, Mycobacterium tuberculosis
GYQHNETA

SEQ ID NO: 56394 - protein, 8 aa, Mycobacterium tuberculosis
YQHNETAS

SEQ ID NO: 56395 - protein, 8 aa, Mycobacterium tuberculosis
QHNETASA

SEQ ID NO: 56396 - protein, 8 aa, Mycobacterium tuberculosis
HNETASAQ

SEQ ID NO: 56397 - protein, 8 aa, Mycobacterium tuberculosis
NETASAQV

SEQ ID NO: 56398 - protein, 8 aa, Mycobacterium tuberculosis
ETASAQVL

SEQ ID NO: 56399 - protein, 8 aa, Mycobacterium tuberculosis
TASAQVLR

SEQ ID NO: 56400 - protein, 8 aa, Mycobacterium tuberculosis
ASAQVLRE

SEQ ID NO: 56401 - protein, 8 aa, Mycobacterium tuberculosis
SAQVLREV

SEQ ID NO: 56402 - protein, 8 aa, Mycobacterium tuberculosis
AQVLREVG

SEQ ID NO: 56403 - protein, 8 aa, Mycobacterium tuberculosis
QVLREVGG

SEQ ID NO: 56404 - protein, 8 aa, Mycobacterium tuberculosis
VLREVGGG

SEQ ID NO: 56405 - protein, 9 aa, Mycobacterium tuberculosis
MGADDTLRV

SEQ ID NO: 56406 - protein, 9 aa, Mycobacterium tuberculosis
GADDTLRVE

SEQ ID NO: 56407 - protein, 9 aa, Mycobacterium tuberculosis
ADDTLRVEP

SEQ ID NO: 56408 - protein, 9 aa, Mycobacterium tuberculosis
DDTLRVEPA

SEQ ID NO: 56409 - protein, 9 aa, Mycobacterium tuberculosis
DTLRVEPAV

SEQ ID NO: 56410 - protein, 9 aa, Mycobacterium tuberculosis
TLRVEPAVM

SEQ ID NO: 56411 - protein, 9 aa, Mycobacterium tuberculosis
LRVEPAVMQ

SEQ ID NO: 56412 - protein, 9 aa, Mycobacterium tuberculosis
RVEPAVMQG

SEQ ID NO: 56413 - protein, 9 aa, Mycobacterium tuberculosis
VEPAVMQGF

SEQ ID NO: 56414 - protein, 9 aa, Mycobacterium tuberculosis
EPAVMQGFA

SEQ ID NO: 56415 - protein, 9 aa, Mycobacterium tuberculosis
PAVMQGFAA

SEQ ID NO: 56416 - protein, 9 aa, Mycobacterium tuberculosis
AVMQGFAAS

SEQ ID NO: 56417 - protein, 9 aa, Mycobacterium tuberculosis
VMQGFAASL

SEQ ID NO: 56418 - protein, 9 aa, Mycobacterium tuberculosis
MQGFAASLD

SEQ ID NO: 56419 - protein, 9 aa, Mycobacterium tuberculosis
QGFAASLDG

SEQ ID NO: 56420 - protein, 9 aa, Mycobacterium tuberculosis
GFAASLDGA

SEQ ID NO: 56421 - protein, 9 aa, Mycobacterium tuberculosis
FAASLDGAA

SEQ ID NO: 56422 - protein, 9 aa, Mycobacterium tuberculosis
AASLDGAAE

SEQ ID NO: 56423 - protein, 9 aa, Mycobacterium tuberculosis
ASLDGAAEH

SEQ ID NO: 56424 - protein, 9 aa, Mycobacterium tuberculosis
SLDGAAEHL

SEQ ID NO: 56425 - protein, 9 aa, Mycobacterium tuberculosis
LDGAAEHLA

SEQ ID NO: 56426 - protein, 9 aa, Mycobacterium tuberculosis
DGAAEHLAV

SEQ ID NO: 56427 - protein, 9 aa, Mycobacterium tuberculosis
GAAEHLAVQ

SEQ ID NO: 56428 - protein, 9 aa, Mycobacterium tuberculosis
AAEHLAVQL

SEQ ID NO: 56429 - protein, 9 aa, Mycobacterium tuberculosis
AEHLAVQLA

SEQ ID NO: 56430 - protein, 9 aa, Mycobacterium tuberculosis
EHLAVQLAE

SEQ ID NO: 56431 - protein, 9 aa, Mycobacterium tuberculosis
HLAVQLAEL

SEQ ID NO: 56432 - protein, 9 aa, Mycobacterium tuberculosis
LAVQLAELD

SEQ ID NO: 56433 - protein, 9 aa, Mycobacterium tuberculosis
AVQLAELDA

SEQ ID NO: 56434 - protein, 9 aa, Mycobacterium tuberculosis
VQLAELDAQ

SEQ ID NO: 56435 - protein, 9 aa, Mycobacterium tuberculosis
QLAELDAQV

SEQ ID NO: 56436 - protein, 9 aa, Mycobacterium tuberculosis
LAELDAQVG

SEQ ID NO: 56437 - protein, 9 aa, Mycobacterium tuberculosis
AELDAQVGQ

SEQ ID NO: 56438 - protein, 9 aa, Mycobacterium tuberculosis
ELDAQVGQM

SEQ ID NO: 56439 - protein, 9 aa, Mycobacterium tuberculosis
LDAQVGQML

SEQ ID NO: 56440 - protein, 9 aa, Mycobacterium tuberculosis
DAQVGQMLG

SEQ ID NO: 56441 - protein, 9 aa, Mycobacterium tuberculosis
AQVGQMLGG

SEQ ID NO: 56442 - protein, 9 aa, Mycobacterium tuberculosis
QVGQMLGGW

SEQ ID NO: 56443 - protein, 9 aa, Mycobacterium tuberculosis
VGQMLGGWR

SEQ ID NO: 56444 - protein, 9 aa, Mycobacterium tuberculosis
GQMLGGWRG

SEQ ID NO: 56445 - protein, 9 aa, Mycobacterium tuberculosis
QMLGGWRGA

SEQ ID NO: 56446 - protein, 9 aa, Mycobacterium tuberculosis
MLGGWRGAS

SEQ ID NO: 56447 - protein, 9 aa, Mycobacterium tuberculosis
LGGWRGASG

SEQ ID NO: 56448 - protein, 9 aa, Mycobacterium tuberculosis
GGWRGASGS

SEQ ID NO: 56449 - protein, 9 aa, Mycobacterium tuberculosis
GWRGASGSA

SEQ ID NO: 56450 - protein, 9 aa, Mycobacterium tuberculosis
WRGASGSAY

SEQ ID NO: 56451 - protein, 9 aa, Mycobacterium tuberculosis
RGASGSAYG

SEQ ID NO: 56452 - protein, 9 aa, Mycobacterium tuberculosis
GASGSAYGS

SEQ ID NO: 56453 - protein, 9 aa, Mycobacterium tuberculosis
ASGSAYGSA

SEQ ID NO: 56454 - protein, 9 aa, Mycobacterium tuberculosis
SGSAYGSAW

SEQ ID NO: 56455 - protein, 9 aa, Mycobacterium tuberculosis
GSAYGSAWE

SEQ ID NO: 56456 - protein, 9 aa, Mycobacterium tuberculosis
SAYGSAWEL

SEQ ID NO: 56457 - protein, 9 aa, Mycobacterium tuberculosis
AYGSAWELW

SEQ ID NO: 56458 - protein, 9 aa, Mycobacterium tuberculosis
YGSAWELWH

SEQ ID NO: 56459 - protein, 9 aa, Mycobacterium tuberculosis
GSAWELWHR

SEQ ID NO: 56460 - protein, 9 aa, Mycobacterium tuberculosis
SAWELWHRG

SEQ ID NO: 56461 - protein, 9 aa, Mycobacterium tuberculosis
AWELWHRGA

SEQ ID NO: 56462 - protein, 9 aa, Mycobacterium tuberculosis
WELWHRGAG

SEQ ID NO: 56463 - protein, 9 aa, Mycobacterium tuberculosis
ELWHRGAGE

SEQ ID NO: 56464 - protein, 9 aa, Mycobacterium tuberculosis
LWHRGAGEV

SEQ ID NO: 56465 - protein, 9 aa, Mycobacterium tuberculosis
WHRGAGEVQ

SEQ ID NO: 56466 - protein, 9 aa, Mycobacterium tuberculosis
HRGAGEVQL

SEQ ID NO: 56467 - protein, 9 aa, Mycobacterium tuberculosis
RGAGEVQLG

SEQ ID NO: 56468 - protein, 9 aa, Mycobacterium tuberculosis
GAGEVQLGL

SEQ ID NO: 56469 - protein, 9 aa, Mycobacterium tuberculosis
AGEVQLGLS

SEQ ID NO: 56470 - protein, 9 aa, Mycobacterium tuberculosis
GEVQLGLSM

SEQ ID NO: 56471 - protein, 9 aa, Mycobacterium tuberculosis
EVQLGLSML

SEQ ID NO: 56472 - protein, 9 aa, Mycobacterium tuberculosis
VQLGLSMLA

SEQ ID NO: 56473 - protein, 9 aa, Mycobacterium tuberculosis
QLGLSMLAA

SEQ ID NO: 56474 - protein, 9 aa, Mycobacterium tuberculosis
LGLSMLAAA

SEQ ID NO: 56475 - protein, 9 aa, Mycobacterium tuberculosis
GLSMLAAAI

SEQ ID NO: 56476 - protein, 9 aa, Mycobacterium tuberculosis
LSMLAAAIA

SEQ ID NO: 56477 - protein, 9 aa, Mycobacterium tuberculosis
SMLAAAIAH

SEQ ID NO: 56478 - protein, 9 aa, Mycobacterium tuberculosis
MLAAAIAHA

SEQ ID NO: 56479 - protein, 9 aa, Mycobacterium tuberculosis
LAAAIAHAG

SEQ ID NO: 56480 - protein, 9 aa, Mycobacterium tuberculosis
AAAIAHAGA

SEQ ID NO: 56481 - protein, 9 aa, Mycobacterium tuberculosis
AAIAHAGAG

SEQ ID NO: 56482 - protein, 9 aa, Mycobacterium tuberculosis
AIAHAGAGY

SEQ ID NO: 56483 - protein, 9 aa, Mycobacterium tuberculosis
IAHAGAGYQ

SEQ ID NO: 56484 - protein, 9 aa, Mycobacterium tuberculosis
AHAGAGYQH

SEQ ID NO: 56485 - protein, 9 aa, Mycobacterium tuberculosis
HAGAGYQHN

SEQ ID NO: 56486 - protein, 9 aa, Mycobacterium tuberculosis
AGAGYQHNE

SEQ ID NO: 56487 - protein, 9 aa, Mycobacterium tuberculosis
GAGYQHNET

SEQ ID NO: 56488 - protein, 9 aa, Mycobacterium tuberculosis
AGYQHNETA

SEQ ID NO: 56489 - protein, 9 aa, Mycobacterium tuberculosis
GYQHNETAS

SEQ ID NO: 56490 - protein, 9 aa, Mycobacterium tuberculosis
YQHNETASA

SEQ ID NO: 56491 - protein, 9 aa, Mycobacterium tuberculosis
QHNETASAQ

SEQ ID NO: 56492 - protein, 9 aa, Mycobacterium tuberculosis
HNETASAQV

SEQ ID NO: 56493 - protein, 9 aa, Mycobacterium tuberculosis
NETASAQVL

SEQ ID NO: 56494 - protein, 9 aa, Mycobacterium tuberculosis
ETASAQVLR

SEQ ID NO: 56495 - protein, 9 aa, Mycobacterium tuberculosis
TASAQVLRE

SEQ ID NO: 56496 - protein, 9 aa, Mycobacterium tuberculosis
ASAQVLREV

SEQ ID NO: 56497 - protein, 9 aa, Mycobacterium tuberculosis
SAQVLREVG

SEQ ID NO: 56498 - protein, 9 aa, Mycobacterium tuberculosis
AQVLREVGG

SEQ ID NO: 56499 - protein, 9 aa, Mycobacterium tuberculosis
QVLREVGGG

SEQ ID NO: 56500 - protein, 10 aa, Mycobacterium tuberculosis
MGADDTLRVE

SEQ ID NO: 56501 - protein, 10 aa, Mycobacterium tuberculosis
GADDTLRVEP

SEQ ID NO: 56502 - protein, 10 aa, Mycobacterium tuberculosis
ADDTLRVEPA

SEQ ID NO: 56503 - protein, 10 aa, Mycobacterium tuberculosis
DDTLRVEPAV

SEQ ID NO: 56504 - protein, 10 aa, Mycobacterium tuberculosis
DTLRVEPAVM

SEQ ID NO: 56505 - protein, 10 aa, Mycobacterium tuberculosis
TLRVEPAVMQ

SEQ ID NO: 56506 - protein, 10 aa, Mycobacterium tuberculosis
LRVEPAVMQG

SEQ ID NO: 56507 - protein, 10 aa, Mycobacterium tuberculosis
RVEPAVMQGF

SEQ ID NO: 56508 - protein, 10 aa, Mycobacterium tuberculosis
VEPAVMQGFA

SEQ ID NO: 56509 - protein, 10 aa, Mycobacterium tuberculosis
EPAVMQGFAA

SEQ ID NO: 56510 - protein, 10 aa, Mycobacterium tuberculosis
PAVMQGFAAS

SEQ ID NO: 56511 - protein, 10 aa, Mycobacterium tuberculosis
AVMQGFAASL

SEQ ID NO: 56512 - protein, 10 aa, Mycobacterium tuberculosis
VMQGFAASLD

SEQ ID NO: 56513 - protein, 10 aa, Mycobacterium tuberculosis
MQGFAASLDG

SEQ ID NO: 56514 - protein, 10 aa, Mycobacterium tuberculosis
QGFAASLDGA

SEQ ID NO: 56515 - protein, 10 aa, Mycobacterium tuberculosis
GFAASLDGAA

SEQ ID NO: 56516 - protein, 10 aa, Mycobacterium tuberculosis
FAASLDGAAE

SEQ ID NO: 56517 - protein, 10 aa, Mycobacterium tuberculosis
AASLDGAAEH

SEQ ID NO: 56518 - protein, 10 aa, Mycobacterium tuberculosis
ASLDGAAEHL

SEQ ID NO: 56519 - protein, 10 aa, Mycobacterium tuberculosis
SLDGAAEHLA

SEQ ID NO: 56520 - protein, 10 aa, Mycobacterium tuberculosis
LDGAAEHLAV

SEQ ID NO: 56521 - protein, 10 aa, Mycobacterium tuberculosis
DGAAEHLAVQ

SEQ ID NO: 56522 - protein, 10 aa, Mycobacterium tuberculosis
GAAEHLAVQL

SEQ ID NO: 56523 - protein, 10 aa, Mycobacterium tuberculosis
AAEHLAVQLA

SEQ ID NO: 56524 - protein, 10 aa, Mycobacterium tuberculosis
AEHLAVQLAE

SEQ ID NO: 56525 - protein, 10 aa, Mycobacterium tuberculosis
EHLAVQLAEL

SEQ ID NO: 56526 - protein, 10 aa, Mycobacterium tuberculosis
HLAVQLAELD

SEQ ID NO: 56527 - protein, 10 aa, Mycobacterium tuberculosis
LAVQLAELDA

SEQ ID NO: 56528 - protein, 10 aa, Mycobacterium tuberculosis
AVQLAELDAQ

SEQ ID NO: 56529 - protein, 10 aa, Mycobacterium tuberculosis
VQLAELDAQV

SEQ ID NO: 56530 - protein, 10 aa, Mycobacterium tuberculosis
QLAELDAQVG

SEQ ID NO: 56531 - protein, 10 aa, Mycobacterium tuberculosis
LAELDAQVGQ

SEQ ID NO: 56532 - protein, 10 aa, Mycobacterium tuberculosis
AELDAQVGQM

SEQ ID NO: 56533 - protein, 10 aa, Mycobacterium tuberculosis
ELDAQVGQML

SEQ ID NO: 56534 - protein, 10 aa, Mycobacterium tuberculosis
LDAQVGQMLG

SEQ ID NO: 56535 - protein, 10 aa, Mycobacterium tuberculosis
DAQVGQMLGG

SEQ ID NO: 56536 - protein, 10 aa, Mycobacterium tuberculosis
AQVGQMLGGW

SEQ ID NO: 56537 - protein, 10 aa, Mycobacterium tuberculosis
QVGQMLGGWR

SEQ ID NO: 56538 - protein, 10 aa, Mycobacterium tuberculosis
VGQMLGGWRG

SEQ ID NO: 56539 - protein, 10 aa, Mycobacterium tuberculosis
GQMLGGWRGA

SEQ ID NO: 56540 - protein, 10 aa, Mycobacterium tuberculosis
QMLGGWRGAS

SEQ ID NO: 56541 - protein, 10 aa, Mycobacterium tuberculosis
MLGGWRGASG

SEQ ID NO: 56542 - protein, 10 aa, Mycobacterium tuberculosis
LGGWRGASGS

SEQ ID NO: 56543 - protein, 10 aa, Mycobacterium tuberculosis
GGWRGASGSA

SEQ ID NO: 56544 - protein, 10 aa, Mycobacterium tuberculosis
GWRGASGSAY

SEQ ID NO: 56545 - protein, 10 aa, Mycobacterium tuberculosis
WRGASGSAYG

SEQ ID NO: 56546 - protein, 10 aa, Mycobacterium tuberculosis
RGASGSAYGS

SEQ ID NO: 56547 - protein, 10 aa, Mycobacterium tuberculosis
GASGSAYGSA

SEQ ID NO: 56548 - protein, 10 aa, Mycobacterium tuberculosis
ASGSAYGSAW

SEQ ID NO: 56549 - protein, 10 aa, Mycobacterium tuberculosis
SGSAYGSAWE

SEQ ID NO: 56550 - protein, 10 aa, Mycobacterium tuberculosis
GSAYGSAWEL

SEQ ID NO: 56551 - protein, 10 aa, Mycobacterium tuberculosis
SAYGSAWELW

SEQ ID NO: 56552 - protein, 10 aa, Mycobacterium tuberculosis
AYGSAWELWH

SEQ ID NO: 56553 - protein, 10 aa, Mycobacterium tuberculosis
YGSAWELWHR

SEQ ID NO: 56554 - protein, 10 aa, Mycobacterium tuberculosis
GSAWELWHRG

SEQ ID NO: 56555 - protein, 10 aa, Mycobacterium tuberculosis
SAWELWHRGA

SEQ ID NO: 56556 - protein, 10 aa, Mycobacterium tuberculosis
AWELWHRGAG

SEQ ID NO: 56557 - protein, 10 aa, Mycobacterium tuberculosis
WELWHRGAGE

SEQ ID NO: 56558 - protein, 10 aa, Mycobacterium tuberculosis
ELWHRGAGEV

SEQ ID NO: 56559 - protein, 10 aa, Mycobacterium tuberculosis
LWHRGAGEVQ

SEQ ID NO: 56560 - protein, 10 aa, Mycobacterium tuberculosis
WHRGAGEVQL

SEQ ID NO: 56561 - protein, 10 aa, Mycobacterium tuberculosis
HRGAGEVQLG

SEQ ID NO: 56562 - protein, 10 aa, Mycobacterium tuberculosis
RGAGEVQLGL

SEQ ID NO: 56563 - protein, 10 aa, Mycobacterium tuberculosis
GAGEVQLGLS

SEQ ID NO: 56564 - protein, 10 aa, Mycobacterium tuberculosis
AGEVQLGLSM

SEQ ID NO: 56565 - protein, 10 aa, Mycobacterium tuberculosis
GEVQLGLSML

SEQ ID NO: 56566 - protein, 10 aa, Mycobacterium tuberculosis
EVQLGLSMLA

SEQ ID NO: 56567 - protein, 10 aa, Mycobacterium tuberculosis
VQLGLSMLAA

SEQ ID NO: 56568 - protein, 10 aa, Mycobacterium tuberculosis
QLGLSMLAAA

SEQ ID NO: 56569 - protein, 10 aa, Mycobacterium tuberculosis
LGLSMLAAAI

SEQ ID NO: 56570 - protein, 10 aa, Mycobacterium tuberculosis
GLSMLAAAIA

SEQ ID NO: 56571 - protein, 10 aa, Mycobacterium tuberculosis
LSMLAAAIAH

SEQ ID NO: 56572 - protein, 10 aa, Mycobacterium tuberculosis
SMLAAAIAHA

SEQ ID NO: 56573 - protein, 10 aa, Mycobacterium tuberculosis
MLAAAIAHAG

SEQ ID NO: 56574 - protein, 10 aa, Mycobacterium tuberculosis
LAAAIAHAGA

SEQ ID NO: 56575 - protein, 10 aa, Mycobacterium tuberculosis
AAAIAHAGAG

SEQ ID NO: 56576 - protein, 10 aa, Mycobacterium tuberculosis
AAIAHAGAGY

SEQ ID NO: 56577 - protein, 10 aa, Mycobacterium tuberculosis
AIAHAGAGYQ

SEQ ID NO: 56578 - protein, 10 aa, Mycobacterium tuberculosis
IAHAGAGYQH

SEQ ID NO: 56579 - protein, 10 aa, Mycobacterium tuberculosis
AHAGAGYQHN

SEQ ID NO: 56580 - protein, 10 aa, Mycobacterium tuberculosis
HAGAGYQHNE

SEQ ID NO: 56581 - protein, 10 aa, Mycobacterium tuberculosis
AGAGYQHNET

SEQ ID NO: 56582 - protein, 10 aa, Mycobacterium tuberculosis
GAGYQHNETA

SEQ ID NO: 56583 - protein, 10 aa, Mycobacterium tuberculosis
AGYQHNETAS

SEQ ID NO: 56584 - protein, 10 aa, Mycobacterium tuberculosis
GYQHNETASA

SEQ ID NO: 56585 - protein, 10 aa, Mycobacterium tuberculosis
YQHNETASAQ

SEQ ID NO: 56586 - protein, 10 aa, Mycobacterium tuberculosis
QHNETASAQV

SEQ ID NO: 56587 - protein, 10 aa, Mycobacterium tuberculosis
HNETASAQVL

SEQ ID NO: 56588 - protein, 10 aa, Mycobacterium tuberculosis
NETASAQVLR

SEQ ID NO: 56589 - protein, 10 aa, Mycobacterium tuberculosis
ETASAQVLRE

SEQ ID NO: 56590 - protein, 10 aa, Mycobacterium tuberculosis
TASAQVLREV

SEQ ID NO: 56591 - protein, 10 aa, Mycobacterium tuberculosis
ASAQVLREVG

SEQ ID NO: 56592 - protein, 10 aa, Mycobacterium tuberculosis
SAQVLREVGG

SEQ ID NO: 56593 - protein, 10 aa, Mycobacterium tuberculosis
AQVLREVGGG

SEQ ID NO: 56594 - protein, 11 aa, Mycobacterium tuberculosis
MGADDTLRVEP

SEQ ID NO: 56595 - protein, 11 aa, Mycobacterium tuberculosis
GADDTLRVEPA

SEQ ID NO: 56596 - protein, 11 aa, Mycobacterium tuberculosis
ADDTLRVEPAV

SEQ ID NO: 56597 - protein, 11 aa, Mycobacterium tuberculosis
DDTLRVEPAVM

SEQ ID NO: 56598 - protein, 11 aa, Mycobacterium tuberculosis
DTLRVEPAVMQ

SEQ ID NO: 56599 - protein, 11 aa, Mycobacterium tuberculosis
TLRVEPAVMQG

SEQ ID NO: 56600 - protein, 11 aa, Mycobacterium tuberculosis
LRVEPAVMQGF

SEQ ID NO: 56601 - protein, 11 aa, Mycobacterium tuberculosis
RVEPAVMQGFA

SEQ ID NO: 56602 - protein, 11 aa, Mycobacterium tuberculosis
VEPAVMQGFAA

SEQ ID NO: 56603 - protein, 11 aa, Mycobacterium tuberculosis
EPAVMQGFAAS

SEQ ID NO: 56604 - protein, 11 aa, Mycobacterium tuberculosis
PAVMQGFAASL

SEQ ID NO: 56605 - protein, 11 aa, Mycobacterium tuberculosis
AVMQGFAASLD

SEQ ID NO: 56606 - protein, 11 aa, Mycobacterium tuberculosis
VMQGFAASLDG

SEQ ID NO: 56607 - protein, 11 aa, Mycobacterium tuberculosis
MQGFAASLDGA

SEQ ID NO: 56608 - protein, 11 aa, Mycobacterium tuberculosis
QGFAASLDGAA

SEQ ID NO: 56609 - protein, 11 aa, Mycobacterium tuberculosis
GFAASLDGAAE

SEQ ID NO: 56610 - protein, 11 aa, Mycobacterium tuberculosis
FAASLDGAAEH

SEQ ID NO: 56611 - protein, 11 aa, Mycobacterium tuberculosis
AASLDGAAEHL

SEQ ID NO: 56612 - protein, 11 aa, Mycobacterium tuberculosis
ASLDGAAEHLA

SEQ ID NO: 56613 - protein, 11 aa, Mycobacterium tuberculosis
SLDGAAEHLAV

SEQ ID NO: 56614 - protein, 11 aa, Mycobacterium tuberculosis
LDGAAEHLAVQ

SEQ ID NO: 56615 - protein, 11 aa, Mycobacterium tuberculosis
DGAAEHLAVQL

SEQ ID NO: 56616 - protein, 11 aa, Mycobacterium tuberculosis
GAAEHLAVQLA

SEQ ID NO: 56617 - protein, 11 aa, Mycobacterium tuberculosis
AAEHLAVQLAE

SEQ ID NO: 56618 - protein, 11 aa, Mycobacterium tuberculosis
AEHLAVQLAEL

SEQ ID NO: 56619 - protein, 11 aa, Mycobacterium tuberculosis
EHLAVQLAELD

SEQ ID NO: 56620 - protein, 11 aa, Mycobacterium tuberculosis
HLAVQLAELDA

SEQ ID NO: 56621 - protein, 11 aa, Mycobacterium tuberculosis
LAVQLAELDAQ

SEQ ID NO: 56622 - protein, 11 aa, Mycobacterium tuberculosis
AVQLAELDAQV

SEQ ID NO: 56623 - protein, 11 aa, Mycobacterium tuberculosis
VQLAELDAQVG

SEQ ID NO: 56624 - protein, 11 aa, Mycobacterium tuberculosis
QLAELDAQVGQ

SEQ ID NO: 56625 - protein, 11 aa, Mycobacterium tuberculosis
LAELDAQVGQM

SEQ ID NO: 56626 - protein, 11 aa, Mycobacterium tuberculosis
AELDAQVGQML

SEQ ID NO: 56627 - protein, 11 aa, Mycobacterium tuberculosis
ELDAQVGQMLG

SEQ ID NO: 56628 - protein, 11 aa, Mycobacterium tuberculosis
LDAQVGQMLGG

SEQ ID NO: 56629 - protein, 11 aa, Mycobacterium tuberculosis
DAQVGQMLGGW

SEQ ID NO: 56630 - protein, 11 aa, Mycobacterium tuberculosis
AQVGQMLGGWR

SEQ ID NO: 56631 - protein, 11 aa, Mycobacterium tuberculosis
QVGQMLGGWRG

SEQ ID NO: 56632 - protein, 11 aa, Mycobacterium tuberculosis
VGQMLGGWRGA

SEQ ID NO: 56633 - protein, 11 aa, Mycobacterium tuberculosis
GQMLGGWRGAS

SEQ ID NO: 56634 - protein, 11 aa, Mycobacterium tuberculosis
QMLGGWRGASG

SEQ ID NO: 56635 - protein, 11 aa, Mycobacterium tuberculosis
MLGGWRGASGS

SEQ ID NO: 56636 - protein, 11 aa, Mycobacterium tuberculosis
LGGWRGASGSA

SEQ ID NO: 56637 - protein, 11 aa, Mycobacterium tuberculosis
GGWRGASGSAY

SEQ ID NO: 56638 - protein, 11 aa, Mycobacterium tuberculosis
GWRGASGSAYG

SEQ ID NO: 56639 - protein, 11 aa, Mycobacterium tuberculosis
WRGASGSAYGS

SEQ ID NO: 56640 - protein, 11 aa, Mycobacterium tuberculosis
RGASGSAYGSA

SEQ ID NO: 56641 - protein, 11 aa, Mycobacterium tuberculosis
GASGSAYGSAW

SEQ ID NO: 56642 - protein, 11 aa, Mycobacterium tuberculosis
ASGSAYGSAWE

SEQ ID NO: 56643 - protein, 11 aa, Mycobacterium tuberculosis
SGSAYGSAWEL

SEQ ID NO: 56644 - protein, 11 aa, Mycobacterium tuberculosis
GSAYGSAWELW

SEQ ID NO: 56645 - protein, 11 aa, Mycobacterium tuberculosis
SAYGSAWELWH

SEQ ID NO: 56646 - protein, 11 aa, Mycobacterium tuberculosis
AYGSAWELWHR

SEQ ID NO: 56647 - protein, 11 aa, Mycobacterium tuberculosis
YGSAWELWHRG

SEQ ID NO: 56648 - protein, 11 aa, Mycobacterium tuberculosis
GSAWELWHRGA

SEQ ID NO: 56649 - protein, 11 aa, Mycobacterium tuberculosis
SAWELWHRGAG

SEQ ID NO: 56650 - protein, 11 aa, Mycobacterium tuberculosis
AWELWHRGAGE

SEQ ID NO: 56651 - protein, 11 aa, Mycobacterium tuberculosis
WELWHRGAGEV

SEQ ID NO: 56652 - protein, 11 aa, Mycobacterium tuberculosis
ELWHRGAGEVQ

SEQ ID NO: 56653 - protein, 11 aa, Mycobacterium tuberculosis
LWHRGAGEVQL

SEQ ID NO: 56654 - protein, 11 aa, Mycobacterium tuberculosis
WHRGAGEVQLG

SEQ ID NO: 56655 - protein, 11 aa, Mycobacterium tuberculosis
HRGAGEVQLGL

SEQ ID NO: 56656 - protein, 11 aa, Mycobacterium tuberculosis
RGAGEVQLGLS

SEQ ID NO: 56657 - protein, 11 aa, Mycobacterium tuberculosis
GAGEVQLGLSM

SEQ ID NO: 56658 - protein, 11 aa, Mycobacterium tuberculosis
AGEVQLGLSML

SEQ ID NO: 56659 - protein, 11 aa, Mycobacterium tuberculosis
GEVQLGLSMLA

SEQ ID NO: 56660 - protein, 11 aa, Mycobacterium tuberculosis
EVQLGLSMLAA

SEQ ID NO: 56661 - protein, 11 aa, Mycobacterium tuberculosis
VQLGLSMLAAA

SEQ ID NO: 56662 - protein, 11 aa, Mycobacterium tuberculosis
QLGLSMLAAAI

SEQ ID NO: 56663 - protein, 11 aa, Mycobacterium tuberculosis
LGLSMLAAAIA

SEQ ID NO: 56664 - protein, 11 aa, Mycobacterium tuberculosis
GLSMLAAAIAH

SEQ ID NO: 56665 - protein, 11 aa, Mycobacterium tuberculosis
LSMLAAAIAHA

SEQ ID NO: 56666 - protein, 11 aa, Mycobacterium tuberculosis
SMLAAAIAHAG

SEQ ID NO: 56667 - protein, 11 aa, Mycobacterium tuberculosis
MLAAAIAHAGA

SEQ ID NO: 56668 - protein, 11 aa, Mycobacterium tuberculosis
LAAAIAHAGAG

SEQ ID NO: 56669 - protein, 11 aa, Mycobacterium tuberculosis
AAAIAHAGAGY

SEQ ID NO: 56670 - protein, 11 aa, Mycobacterium tuberculosis
AAIAHAGAGYQ

SEQ ID NO: 56671 - protein, 11 aa, Mycobacterium tuberculosis
AIAHAGAGYQH

SEQ ID NO: 56672 - protein, 11 aa, Mycobacterium tuberculosis
IAHAGAGYQHN

SEQ ID NO: 56673 - protein, 11 aa, Mycobacterium tuberculosis
AHAGAGYQHNE

SEQ ID NO: 56674 - protein, 11 aa, Mycobacterium tuberculosis
HAGAGYQHNET

SEQ ID NO: 56675 - protein, 11 aa, Mycobacterium tuberculosis
AGAGYQHNETA

SEQ ID NO: 56676 - protein, 11 aa, Mycobacterium tuberculosis
GAGYQHNETAS

SEQ ID NO: 56677 - protein, 11 aa, Mycobacterium tuberculosis
AGYQHNETASA

SEQ ID NO: 56678 - protein, 11 aa, Mycobacterium tuberculosis
GYQHNETASAQ

SEQ ID NO: 56679 - protein, 11 aa, Mycobacterium tuberculosis
YQHNETASAQV

SEQ ID NO: 56680 - protein, 11 aa, Mycobacterium tuberculosis
QHNETASAQVL

SEQ ID NO: 56681 - protein, 11 aa, Mycobacterium tuberculosis
HNETASAQVLR

SEQ ID NO: 56682 - protein, 11 aa, Mycobacterium tuberculosis
NETASAQVLRE

SEQ ID NO: 56683 - protein, 11 aa, Mycobacterium tuberculosis
ETASAQVLREV

SEQ ID NO: 56684 - protein, 11 aa, Mycobacterium tuberculosis
TASAQVLREVG

SEQ ID NO: 56685 - protein, 11 aa, Mycobacterium tuberculosis
ASAQVLREVGG

SEQ ID NO: 56686 - protein, 11 aa, Mycobacterium tuberculosis
SAQVLREVGGG

SEQ ID NO: 56687 - protein, 8 aa, Mycobacterium tuberculosis
MSRQASRQ

SEQ ID NO: 56688 - protein, 8 aa, Mycobacterium tuberculosis
SRQASRQV

SEQ ID NO: 56689 - protein, 8 aa, Mycobacterium tuberculosis
RQASRQVS

SEQ ID NO: 56690 - protein, 8 aa, Mycobacterium tuberculosis
QASRQVSI

SEQ ID NO: 56691 - protein, 8 aa, Mycobacterium tuberculosis
ASRQVSII

SEQ ID NO: 56692 - protein, 8 aa, Mycobacterium tuberculosis
SRQVSIIR

SEQ ID NO: 56693 - protein, 8 aa, Mycobacterium tuberculosis
RQVSIIRS

SEQ ID NO: 56694 - protein, 8 aa, Mycobacterium tuberculosis
QVSIIRSA

SEQ ID NO: 56695 - protein, 8 aa, Mycobacterium tuberculosis
VSIIRSAG

SEQ ID NO: 56696 - protein, 8 aa, Mycobacterium tuberculosis
SIIRSAGD

SEQ ID NO: 56697 - protein, 8 aa, Mycobacterium tuberculosis
IIRSAGDG

SEQ ID NO: 56698 - protein, 8 aa, Mycobacterium tuberculosis
IRSAGDGN

SEQ ID NO: 56699 - protein, 8 aa, Mycobacterium tuberculosis
RSAGDGNR

SEQ ID NO: 56700 - protein, 8 aa, Mycobacterium tuberculosis
SAGDGNRS

SEQ ID NO: 56701 - protein, 8 aa, Mycobacterium tuberculosis
AGDGNRSC

SEQ ID NO: 56702 - protein, 8 aa, Mycobacterium tuberculosis
GDGNRSCG

SEQ ID NO: 56703 - protein, 8 aa, Mycobacterium tuberculosis
DGNRSCGC

SEQ ID NO: 56704 - protein, 8 aa, Mycobacterium tuberculosis
GNRSCGCV

SEQ ID NO: 56705 - protein, 8 aa, Mycobacterium tuberculosis
NRSCGCVT

SEQ ID NO: 56706 - protein, 8 aa, Mycobacterium tuberculosis
RSCGCVTP

SEQ ID NO: 56707 - protein, 8 aa, Mycobacterium tuberculosis
SCGCVTPK

SEQ ID NO: 56708 - protein, 8 aa, Mycobacterium tuberculosis
CGCVTPKE

SEQ ID NO: 56709 - protein, 8 aa, Mycobacterium tuberculosis
GCVTPKEG

SEQ ID NO: 56710 - protein, 8 aa, Mycobacterium tuberculosis
CVTPKEGV

SEQ ID NO: 56711 - protein, 8 aa, Mycobacterium tuberculosis
VTPKEGVW

SEQ ID NO: 56712 - protein, 8 aa, Mycobacterium tuberculosis
TPKEGVWV

SEQ ID NO: 56713 - protein, 8 aa, Mycobacterium tuberculosis
PKEGVWVV

SEQ ID NO: 56714 - protein, 8 aa, Mycobacterium tuberculosis
KEGVWVVT

SEQ ID NO: 56715 - protein, 8 aa, Mycobacterium tuberculosis
EGVWVVTL

SEQ ID NO: 56716 - protein, 8 aa, Mycobacterium tuberculosis
GVWVVTLR

SEQ ID NO: 56717 - protein, 8 aa, Mycobacterium tuberculosis
VWVVTLRV

SEQ ID NO: 56718 - protein, 8 aa, Mycobacterium tuberculosis
WVVTLRVV

SEQ ID NO: 56719 - protein, 8 aa, Mycobacterium tuberculosis
VVTLRVVP

SEQ ID NO: 56720 - protein, 8 aa, Mycobacterium tuberculosis
VTLRVVPE

SEQ ID NO: 56721 - protein, 8 aa, Mycobacterium tuberculosis
TLRVVPEG

SEQ ID NO: 56722 - protein, 8 aa, Mycobacterium tuberculosis
LRVVPEGL

SEQ ID NO: 56723 - protein, 8 aa, Mycobacterium tuberculosis
RVVPEGLA

SEQ ID NO: 56724 - protein, 8 aa, Mycobacterium tuberculosis
VVPEGLAA

SEQ ID NO: 56725 - protein, 8 aa, Mycobacterium tuberculosis
VPEGLAAA

SEQ ID NO: 56726 - protein, 8 aa, Mycobacterium tuberculosis
PEGLAAAS

SEQ ID NO: 56727 - protein, 8 aa, Mycobacterium tuberculosis
EGLAAASA

SEQ ID NO: 56728 - protein, 8 aa, Mycobacterium tuberculosis
GLAAASAA

SEQ ID NO: 56729 - protein, 8 aa, Mycobacterium tuberculosis
LAAASAAV

SEQ ID NO: 56730 - protein, 8 aa, Mycobacterium tuberculosis
AAASAAVE

SEQ ID NO: 56731 - protein, 8 aa, Mycobacterium tuberculosis
AASAAVEA

SEQ ID NO: 56732 - protein, 8 aa, Mycobacterium tuberculosis
ASAAVEAL

SEQ ID NO: 56733 - protein, 8 aa, Mycobacterium tuberculosis
SAAVEALT

SEQ ID NO: 56734 - protein, 8 aa, Mycobacterium tuberculosis
AAVEALTA

SEQ ID NO: 56735 - protein, 8 aa, Mycobacterium tuberculosis
AVEALTAR

SEQ ID NO: 56736 - protein, 8 aa, Mycobacterium tuberculosis
VEALTARL

SEQ ID NO: 56737 - protein, 8 aa, Mycobacterium tuberculosis
EALTARLA

SEQ ID NO: 56738 - protein, 8 aa, Mycobacterium tuberculosis
ALTARLAA

SEQ ID NO: 56739 - protein, 8 aa, Mycobacterium tuberculosis
LTARLAAA

SEQ ID NO: 56740 - protein, 8 aa, Mycobacterium tuberculosis
TARLAAAH

SEQ ID NO: 56741 - protein, 8 aa, Mycobacterium tuberculosis
ARLAAAHA

SEQ ID NO: 56742 - protein, 8 aa, Mycobacterium tuberculosis
RLAAAHAG

SEQ ID NO: 56743 - protein, 8 aa, Mycobacterium tuberculosis
LAAAHAGA

SEQ ID NO: 56744 - protein, 8 aa, Mycobacterium tuberculosis
AAAHAGAA

SEQ ID NO: 56745 - protein, 8 aa, Mycobacterium tuberculosis
AAHAGAAP

SEQ ID NO: 56746 - protein, 8 aa, Mycobacterium tuberculosis
AHAGAAPA

SEQ ID NO: 56747 - protein, 8 aa, Mycobacterium tuberculosis
HAGAAPAI

SEQ ID NO: 56748 - protein, 8 aa, Mycobacterium tuberculosis
AGAAPAIT

SEQ ID NO: 56749 - protein, 8 aa, Mycobacterium tuberculosis
GAAPAITA

SEQ ID NO: 56750 - protein, 8 aa, Mycobacterium tuberculosis
AAPAITAV

SEQ ID NO: 56751 - protein, 8 aa, Mycobacterium tuberculosis
APAITAVV

SEQ ID NO: 56752 - protein, 8 aa, Mycobacterium tuberculosis
PAITAVVA

SEQ ID NO: 56753 - protein, 8 aa, Mycobacterium tuberculosis
AITAVVAP

SEQ ID NO: 56754 - protein, 8 aa, Mycobacterium tuberculosis
ITAVVAPA

SEQ ID NO: 56755 - protein, 8 aa, Mycobacterium tuberculosis
TAVVAPAA

SEQ ID NO: 56756 - protein, 8 aa, Mycobacterium tuberculosis
AVVAPAAD

SEQ ID NO: 56757 - protein, 8 aa, Mycobacterium tuberculosis
VVAPAADP

SEQ ID NO: 56758 - protein, 8 aa, Mycobacterium tuberculosis
VAPAADPV

SEQ ID NO: 56759 - protein, 8 aa, Mycobacterium tuberculosis
APAADPVS

SEQ ID NO: 56760 - protein, 8 aa, Mycobacterium tuberculosis
PAADPVSL

SEQ ID NO: 56761 - protein, 8 aa, Mycobacterium tuberculosis
AADPVSLQ

SEQ ID NO: 56762 - protein, 8 aa, Mycobacterium tuberculosis
ADPVSLQS

SEQ ID NO: 56763 - protein, 8 aa, Mycobacterium tuberculosis
DPVSLQSA

SEQ ID NO: 56764 - protein, 8 aa, Mycobacterium tuberculosis
PVSLQSAV

SEQ ID NO: 56765 - protein, 8 aa, Mycobacterium tuberculosis
VSLQSAVG

SEQ ID NO: 56766 - protein, 8 aa, Mycobacterium tuberculosis
SLQSAVGF

SEQ ID NO: 56767 - protein, 8 aa, Mycobacterium tuberculosis
LQSAVGFS

SEQ ID NO: 56768 - protein, 8 aa, Mycobacterium tuberculosis
QSAVGFSA

SEQ ID NO: 56769 - protein, 8 aa, Mycobacterium tuberculosis
SAVGFSAL

SEQ ID NO: 56770 - protein, 8 aa, Mycobacterium tuberculosis
AVGFSALG

SEQ ID NO: 56771 - protein, 8 aa, Mycobacterium tuberculosis
VGFSALGS

SEQ ID NO: 56772 - protein, 8 aa, Mycobacterium tuberculosis
GFSALGSE

SEQ ID NO: 56773 - protein, 8 aa, Mycobacterium tuberculosis
FSALGSEH

SEQ ID NO: 56774 - protein, 8 aa, Mycobacterium tuberculosis
SALGSEHA

SEQ ID NO: 56775 - protein, 8 aa, Mycobacterium tuberculosis
ALGSEHAA

SEQ ID NO: 56776 - protein, 8 aa, Mycobacterium tuberculosis
LGSEHAAI

SEQ ID NO: 56777 - protein, 8 aa, Mycobacterium tuberculosis
GSEHAAIA

SEQ ID NO: 56778 - protein, 8 aa, Mycobacterium tuberculosis
SEHAAIAG

SEQ ID NO: 56779 - protein, 8 aa, Mycobacterium tuberculosis
EHAAIAGE

SEQ ID NO: 56780 - protein, 8 aa, Mycobacterium tuberculosis
HAAIAGEG

SEQ ID NO: 56781 - protein, 8 aa, Mycobacterium tuberculosis
AAIAGEGV

SEQ ID NO: 56782 - protein, 8 aa, Mycobacterium tuberculosis
AIAGEGVE

SEQ ID NO: 56783 - protein, 8 aa, Mycobacterium tuberculosis
IAGEGVEE

SEQ ID NO: 56784 - protein, 8 aa, Mycobacterium tuberculosis
AGEGVEEL

SEQ ID NO: 56785 - protein, 8 aa, Mycobacterium tuberculosis
GEGVEELG

SEQ ID NO: 56786 - protein, 8 aa, Mycobacterium tuberculosis
EGVEELGR

SEQ ID NO: 56787 - protein, 8 aa, Mycobacterium tuberculosis
GVEELGRS

SEQ ID NO: 56788 - protein, 8 aa, Mycobacterium tuberculosis
VEELGRSG

SEQ ID NO: 56789 - protein, 8 aa, Mycobacterium tuberculosis
EELGRSGV

SEQ ID NO: 56790 - protein, 8 aa, Mycobacterium tuberculosis
ELGRSGVA

SEQ ID NO: 56791 - protein, 8 aa, Mycobacterium tuberculosis
LGRSGVAV

SEQ ID NO: 56792 - protein, 8 aa, Mycobacterium tuberculosis
GRSGVAVG

SEQ ID NO: 56793 - protein, 8 aa, Mycobacterium tuberculosis
RSGVAVGE

SEQ ID NO: 56794 - protein, 8 aa, Mycobacterium tuberculosis
SGVAVGES

SEQ ID NO: 56795 - protein, 8 aa, Mycobacterium tuberculosis
GVAVGESG

SEQ ID NO: 56796 - protein, 8 aa, Mycobacterium tuberculosis
VAVGESGI

SEQ ID NO: 56797 - protein, 8 aa, Mycobacterium tuberculosis
AVGESGIG

SEQ ID NO: 56798 - protein, 8 aa, Mycobacterium tuberculosis
VGESGIGY

SEQ ID NO: 56799 - protein, 8 aa, Mycobacterium tuberculosis
GESGIGYA

SEQ ID NO: 56800 - protein, 8 aa, Mycobacterium tuberculosis
ESGIGYAA

SEQ ID NO: 56801 - protein, 8 aa, Mycobacterium tuberculosis
SGIGYAAG

SEQ ID NO: 56802 - protein, 8 aa, Mycobacterium tuberculosis
GIGYAAGD

SEQ ID NO: 56803 - protein, 8 aa, Mycobacterium tuberculosis
IGYAAGDA

SEQ ID NO: 56804 - protein, 8 aa, Mycobacterium tuberculosis
GYAAGDAV

SEQ ID NO: 56805 - protein, 8 aa, Mycobacterium tuberculosis
YAAGDAVA

SEQ ID NO: 56806 - protein, 8 aa, Mycobacterium tuberculosis
AAGDAVAA

SEQ ID NO: 56807 - protein, 8 aa, Mycobacterium tuberculosis
AGDAVAAA

SEQ ID NO: 56808 - protein, 8 aa, Mycobacterium tuberculosis
GDAVAAAT

SEQ ID NO: 56809 - protein, 8 aa, Mycobacterium tuberculosis
DAVAAATY

SEQ ID NO: 56810 - protein, 8 aa, Mycobacterium tuberculosis
AVAAATYL

SEQ ID NO: 56811 - protein, 8 aa, Mycobacterium tuberculosis
VAAATYLV

SEQ ID NO: 56812 - protein, 8 aa, Mycobacterium tuberculosis
AAATYLVS

SEQ ID NO: 56813 - protein, 8 aa, Mycobacterium tuberculosis
AATYLVSG

SEQ ID NO: 56814 - protein, 8 aa, Mycobacterium tuberculosis
ATYLVSGG

SEQ ID NO: 56815 - protein, 8 aa, Mycobacterium tuberculosis
TYLVSGGS

SEQ ID NO: 56816 - protein, 8 aa, Mycobacterium tuberculosis
YLVSGGSL

SEQ ID NO: 56817 - protein, 9 aa, Mycobacterium tuberculosis
MSRQASRQV

SEQ ID NO: 56818 - protein, 9 aa, Mycobacterium tuberculosis
SRQASRQVS

SEQ ID NO: 56819 - protein, 9 aa, Mycobacterium tuberculosis
RQASRQVSI

SEQ ID NO: 56820 - protein, 9 aa, Mycobacterium tuberculosis
QASRQVSII

SEQ ID NO: 56821 - protein, 9 aa, Mycobacterium tuberculosis
ASRQVSIIR

SEQ ID NO: 56822 - protein, 9 aa, Mycobacterium tuberculosis
SRQVSIIRS

SEQ ID NO: 56823 - protein, 9 aa, Mycobacterium tuberculosis
RQVSIIRSA

SEQ ID NO: 56824 - protein, 9 aa, Mycobacterium tuberculosis
QVSIIRSAG

SEQ ID NO: 56825 - protein, 9 aa, Mycobacterium tuberculosis
VSIIRSAGD

SEQ ID NO: 56826 - protein, 9 aa, Mycobacterium tuberculosis
SIIRSAGDG

SEQ ID NO: 56827 - protein, 9 aa, Mycobacterium tuberculosis
IIRSAGDGN

SEQ ID NO: 56828 - protein, 9 aa, Mycobacterium tuberculosis
IRSAGDGNR

SEQ ID NO: 56829 - protein, 9 aa, Mycobacterium tuberculosis
RSAGDGNRS

SEQ ID NO: 56830 - protein, 9 aa, Mycobacterium tuberculosis
SAGDGNRSC

SEQ ID NO: 56831 - protein, 9 aa, Mycobacterium tuberculosis
AGDGNRSCG

SEQ ID NO: 56832 - protein, 9 aa, Mycobacterium tuberculosis
GDGNRSCGC

SEQ ID NO: 56833 - protein, 9 aa, Mycobacterium tuberculosis
DGNRSCGCV

SEQ ID NO: 56834 - protein, 9 aa, Mycobacterium tuberculosis
GNRSCGCVT

SEQ ID NO: 56835 - protein, 9 aa, Mycobacterium tuberculosis
NRSCGCVTP

SEQ ID NO: 56836 - protein, 9 aa, Mycobacterium tuberculosis
RSCGCVTPK

SEQ ID NO: 56837 - protein, 9 aa, Mycobacterium tuberculosis
SCGCVTPKE

SEQ ID NO: 56838 - protein, 9 aa, Mycobacterium tuberculosis
CGCVTPKEG

SEQ ID NO: 56839 - protein, 9 aa, Mycobacterium tuberculosis
GCVTPKEGV

SEQ ID NO: 56840 - protein, 9 aa, Mycobacterium tuberculosis
CVTPKEGVW

SEQ ID NO: 56841 - protein, 9 aa, Mycobacterium tuberculosis
VTPKEGVWV

SEQ ID NO: 56842 - protein, 9 aa, Mycobacterium tuberculosis
TPKEGVWVV

SEQ ID NO: 56843 - protein, 9 aa, Mycobacterium tuberculosis
PKEGVWVVT

SEQ ID NO: 56844 - protein, 9 aa, Mycobacterium tuberculosis
KEGVWVVTL

SEQ ID NO: 56845 - protein, 9 aa, Mycobacterium tuberculosis
EGVWVVTLR

SEQ ID NO: 56846 - protein, 9 aa, Mycobacterium tuberculosis
GVWVVTLRV

SEQ ID NO: 56847 - protein, 9 aa, Mycobacterium tuberculosis
VWVVTLRVV

SEQ ID NO: 56848 - protein, 9 aa, Mycobacterium tuberculosis
WVVTLRVVP

SEQ ID NO: 56849 - protein, 9 aa, Mycobacterium tuberculosis
VVTLRVVPE

SEQ ID NO: 56850 - protein, 9 aa, Mycobacterium tuberculosis
VTLRVVPEG

SEQ ID NO: 56851 - protein, 9 aa, Mycobacterium tuberculosis
TLRVVPEGL

SEQ ID NO: 56852 - protein, 9 aa, Mycobacterium tuberculosis
LRVVPEGLA

SEQ ID NO: 56853 - protein, 9 aa, Mycobacterium tuberculosis
RVVPEGLAA

SEQ ID NO: 56854 - protein, 9 aa, Mycobacterium tuberculosis
VVPEGLAAA

SEQ ID NO: 56855 - protein, 9 aa, Mycobacterium tuberculosis
VPEGLAAAS

SEQ ID NO: 56856 - protein, 9 aa, Mycobacterium tuberculosis
PEGLAAASA

SEQ ID NO: 56857 - protein, 9 aa, Mycobacterium tuberculosis
EGLAAASAA

SEQ ID NO: 56858 - protein, 9 aa, Mycobacterium tuberculosis
GLAAASAAV

SEQ ID NO: 56859 - protein, 9 aa, Mycobacterium tuberculosis
LAAASAAVE

SEQ ID NO: 56860 - protein, 9 aa, Mycobacterium tuberculosis
AAASAAVEA

SEQ ID NO: 56861 - protein, 9 aa, Mycobacterium tuberculosis
AASAAVEAL

SEQ ID NO: 56862 - protein, 9 aa, Mycobacterium tuberculosis
ASAAVEALT

SEQ ID NO: 56863 - protein, 9 aa, Mycobacterium tuberculosis
SAAVEALTA

SEQ ID NO: 56864 - protein, 9 aa, Mycobacterium tuberculosis
AAVEALTAR

SEQ ID NO: 56865 - protein, 9 aa, Mycobacterium tuberculosis
AVEALTARL

SEQ ID NO: 56866 - protein, 9 aa, Mycobacterium tuberculosis
VEALTARLA

SEQ ID NO: 56867 - protein, 9 aa, Mycobacterium tuberculosis
EALTARLAA

SEQ ID NO: 56868 - protein, 9 aa, Mycobacterium tuberculosis
ALTARLAAA

SEQ ID NO: 56869 - protein, 9 aa, Mycobacterium tuberculosis
LTARLAAAH

SEQ ID NO: 56870 - protein, 9 aa, Mycobacterium tuberculosis
TARLAAAHA

SEQ ID NO: 56871 - protein, 9 aa, Mycobacterium tuberculosis
ARLAAAHAG

SEQ ID NO: 56872 - protein, 9 aa, Mycobacterium tuberculosis
RLAAAHAGA

SEQ ID NO: 56873 - protein, 9 aa, Mycobacterium tuberculosis
LAAAHAGAA

SEQ ID NO: 56874 - protein, 9 aa, Mycobacterium tuberculosis
AAAHAGAAP

SEQ ID NO: 56875 - protein, 9 aa, Mycobacterium tuberculosis
AAHAGAAPA

SEQ ID NO: 56876 - protein, 9 aa, Mycobacterium tuberculosis
AHAGAAPAI

SEQ ID NO: 56877 - protein, 9 aa, Mycobacterium tuberculosis
HAGAAPAIT

SEQ ID NO: 56878 - protein, 9 aa, Mycobacterium tuberculosis
AGAAPAITA

SEQ ID NO: 56879 - protein, 9 aa, Mycobacterium tuberculosis
GAAPAITAV

SEQ ID NO: 56880 - protein, 9 aa, Mycobacterium tuberculosis
AAPAITAVV

SEQ ID NO: 56881 - protein, 9 aa, Mycobacterium tuberculosis
APAITAVVA

SEQ ID NO: 56882 - protein, 9 aa, Mycobacterium tuberculosis
PAITAVVAP

SEQ ID NO: 56883 - protein, 9 aa, Mycobacterium tuberculosis
AITAVVAPA

SEQ ID NO: 56884 - protein, 9 aa, Mycobacterium tuberculosis
ITAVVAPAA

SEQ ID NO: 56885 - protein, 9 aa, Mycobacterium tuberculosis
TAVVAPAAD

SEQ ID NO: 56886 - protein, 9 aa, Mycobacterium tuberculosis
AVVAPAADP

SEQ ID NO: 56887 - protein, 9 aa, Mycobacterium tuberculosis
VVAPAADPV

SEQ ID NO: 56888 - protein, 9 aa, Mycobacterium tuberculosis
VAPAADPVS

SEQ ID NO: 56889 - protein, 9 aa, Mycobacterium tuberculosis
APAADPVSL

SEQ ID NO: 56890 - protein, 9 aa, Mycobacterium tuberculosis
PAADPVSLQ

SEQ ID NO: 56891 - protein, 9 aa, Mycobacterium tuberculosis
AADPVSLQS

SEQ ID NO: 56892 - protein, 9 aa, Mycobacterium tuberculosis
ADPVSLQSA

SEQ ID NO: 56893 - protein, 9 aa, Mycobacterium tuberculosis
DPVSLQSAV

SEQ ID NO: 56894 - protein, 9 aa, Mycobacterium tuberculosis
PVSLQSAVG

SEQ ID NO: 56895 - protein, 9 aa, Mycobacterium tuberculosis
VSLQSAVGF

SEQ ID NO: 56896 - protein, 9 aa, Mycobacterium tuberculosis
SLQSAVGFS

SEQ ID NO: 56897 - protein, 9 aa, Mycobacterium tuberculosis
LQSAVGFSA

SEQ ID NO: 56898 - protein, 9 aa, Mycobacterium tuberculosis
QSAVGFSAL

SEQ ID NO: 56899 - protein, 9 aa, Mycobacterium tuberculosis
SAVGFSALG

SEQ ID NO: 56900 - protein, 9 aa, Mycobacterium tuberculosis
AVGFSALGS

SEQ ID NO: 56901 - protein, 9 aa, Mycobacterium tuberculosis
VGFSALGSE

SEQ ID NO: 56902 - protein, 9 aa, Mycobacterium tuberculosis
GFSALGSEH

SEQ ID NO: 56903 - protein, 9 aa, Mycobacterium tuberculosis
FSALGSEHA

SEQ ID NO: 56904 - protein, 9 aa, Mycobacterium tuberculosis
SALGSEHAA

SEQ ID NO: 56905 - protein, 9 aa, Mycobacterium tuberculosis
ALGSEHAAI

SEQ ID NO: 56906 - protein, 9 aa, Mycobacterium tuberculosis
LGSEHAAIA

SEQ ID NO: 56907 - protein, 9 aa, Mycobacterium tuberculosis
GSEHAAIAG

SEQ ID NO: 56908 - protein, 9 aa, Mycobacterium tuberculosis
SEHAAIAGE

SEQ ID NO: 56909 - protein, 9 aa, Mycobacterium tuberculosis
EHAAIAGEG

SEQ ID NO: 56910 - protein, 9 aa, Mycobacterium tuberculosis
HAAIAGEGV

SEQ ID NO: 56911 - protein, 9 aa, Mycobacterium tuberculosis
AAIAGEGVE

SEQ ID NO: 56912 - protein, 9 aa, Mycobacterium tuberculosis
AIAGEGVEE

SEQ ID NO: 56913 - protein, 9 aa, Mycobacterium tuberculosis
IAGEGVEEL

SEQ ID NO: 56914 - protein, 9 aa, Mycobacterium tuberculosis
AGEGVEELG

SEQ ID NO: 56915 - protein, 9 aa, Mycobacterium tuberculosis
GEGVEELGR

SEQ ID NO: 56916 - protein, 9 aa, Mycobacterium tuberculosis
EGVEELGRS

SEQ ID NO: 56917 - protein, 9 aa, Mycobacterium tuberculosis
GVEELGRSG

SEQ ID NO: 56918 - protein, 9 aa, Mycobacterium tuberculosis
VEELGRSGV

SEQ ID NO: 56919 - protein, 9 aa, Mycobacterium tuberculosis
EELGRSGVA

SEQ ID NO: 56920 - protein, 9 aa, Mycobacterium tuberculosis
ELGRSGVAV

SEQ ID NO: 56921 - protein, 9 aa, Mycobacterium tuberculosis
LGRSGVAVG

SEQ ID NO: 56922 - protein, 9 aa, Mycobacterium tuberculosis
GRSGVAVGE

SEQ ID NO: 56923 - protein, 9 aa, Mycobacterium tuberculosis
RSGVAVGES

SEQ ID NO: 56924 - protein, 9 aa, Mycobacterium tuberculosis
SGVAVGESG

SEQ ID NO: 56925 - protein, 9 aa, Mycobacterium tuberculosis
GVAVGESGI

SEQ ID NO: 56926 - protein, 9 aa, Mycobacterium tuberculosis
VAVGESGIG

SEQ ID NO: 56927 - protein, 9 aa, Mycobacterium tuberculosis
AVGESGIGY

SEQ ID NO: 56928 - protein, 9 aa, Mycobacterium tuberculosis
VGESGIGYA

SEQ ID NO: 56929 - protein, 9 aa, Mycobacterium tuberculosis
GESGIGYAA

SEQ ID NO: 56930 - protein, 9 aa, Mycobacterium tuberculosis
ESGIGYAAG

SEQ ID NO: 56931 - protein, 9 aa, Mycobacterium tuberculosis
SGIGYAAGD

SEQ ID NO: 56932 - protein, 9 aa, Mycobacterium tuberculosis
GIGYAAGDA

SEQ ID NO: 56933 - protein, 9 aa, Mycobacterium tuberculosis
IGYAAGDAV

SEQ ID NO: 56934 - protein, 9 aa, Mycobacterium tuberculosis
GYAAGDAVA

SEQ ID NO: 56935 - protein, 9 aa, Mycobacterium tuberculosis
YAAGDAVAA

SEQ ID NO: 56936 - protein, 9 aa, Mycobacterium tuberculosis
AAGDAVAAA

SEQ ID NO: 56937 - protein, 9 aa, Mycobacterium tuberculosis
AGDAVAAAT

SEQ ID NO: 56938 - protein, 9 aa, Mycobacterium tuberculosis
GDAVAAATY

SEQ ID NO: 56939 - protein, 9 aa, Mycobacterium tuberculosis
DAVAAATYL

SEQ ID NO: 56940 - protein, 9 aa, Mycobacterium tuberculosis
AVAAATYLV

SEQ ID NO: 56941 - protein, 9 aa, Mycobacterium tuberculosis
VAAATYLVS

SEQ ID NO: 56942 - protein, 9 aa, Mycobacterium tuberculosis
AAATYLVSG

SEQ ID NO: 56943 - protein, 9 aa, Mycobacterium tuberculosis
AATYLVSGG

SEQ ID NO: 56944 - protein, 9 aa, Mycobacterium tuberculosis
ATYLVSGGS

SEQ ID NO: 56945 - protein, 9 aa, Mycobacterium tuberculosis
TYLVSGGSL

SEQ ID NO: 56946 - protein, 10 aa, Mycobacterium tuberculosis
MSRQASRQVS

SEQ ID NO: 56947 - protein, 10 aa, Mycobacterium tuberculosis
SRQASRQVSI

SEQ ID NO: 56948 - protein, 10 aa, Mycobacterium tuberculosis
RQASRQVSII

SEQ ID NO: 56949 - protein, 10 aa, Mycobacterium tuberculosis
QASRQVSIIR

SEQ ID NO: 56950 - protein, 10 aa, Mycobacterium tuberculosis
ASRQVSIIRS

SEQ ID NO: 56951 - protein, 10 aa, Mycobacterium tuberculosis
SRQVSIIRSA

SEQ ID NO: 56952 - protein, 10 aa, Mycobacterium tuberculosis
RQVSIIRSAG

SEQ ID NO: 56953 - protein, 10 aa, Mycobacterium tuberculosis
QVSIIRSAGD

SEQ ID NO: 56954 - protein, 10 aa, Mycobacterium tuberculosis
VSIIRSAGDG

SEQ ID NO: 56955 - protein, 10 aa, Mycobacterium tuberculosis
SIIRSAGDGN

SEQ ID NO: 56956 - protein, 10 aa, Mycobacterium tuberculosis
IIRSAGDGNR

SEQ ID NO: 56957 - protein, 10 aa, Mycobacterium tuberculosis
IRSAGDGNRS

SEQ ID NO: 56958 - protein, 10 aa, Mycobacterium tuberculosis
RSAGDGNRSC

SEQ ID NO: 56959 - protein, 10 aa, Mycobacterium tuberculosis
SAGDGNRSCG

SEQ ID NO: 56960 - protein, 10 aa, Mycobacterium tuberculosis
AGDGNRSCGC

SEQ ID NO: 56961 - protein, 10 aa, Mycobacterium tuberculosis
GDGNRSCGCV

SEQ ID NO: 56962 - protein, 10 aa, Mycobacterium tuberculosis
DGNRSCGCVT

SEQ ID NO: 56963 - protein, 10 aa, Mycobacterium tuberculosis
GNRSCGCVTP

SEQ ID NO: 56964 - protein, 10 aa, Mycobacterium tuberculosis
NRSCGCVTPK

SEQ ID NO: 56965 - protein, 10 aa, Mycobacterium tuberculosis
RSCGCVTPKE

SEQ ID NO: 56966 - protein, 10 aa, Mycobacterium tuberculosis
SCGCVTPKEG

SEQ ID NO: 56967 - protein, 10 aa, Mycobacterium tuberculosis
CGCVTPKEGV

SEQ ID NO: 56968 - protein, 10 aa, Mycobacterium tuberculosis
GCVTPKEGVW

SEQ ID NO: 56969 - protein, 10 aa, Mycobacterium tuberculosis
CVTPKEGVWV

SEQ ID NO: 56970 - protein, 10 aa, Mycobacterium tuberculosis
VTPKEGVWVV

SEQ ID NO: 56971 - protein, 10 aa, Mycobacterium tuberculosis
TPKEGVWVVT

SEQ ID NO: 56972 - protein, 10 aa, Mycobacterium tuberculosis
PKEGVWVVTL

SEQ ID NO: 56973 - protein, 10 aa, Mycobacterium tuberculosis
KEGVWVVTLR

SEQ ID NO: 56974 - protein, 10 aa, Mycobacterium tuberculosis
EGVWVVTLRV

SEQ ID NO: 56975 - protein, 10 aa, Mycobacterium tuberculosis
GVWVVTLRVV

SEQ ID NO: 56976 - protein, 10 aa, Mycobacterium tuberculosis
VWVVTLRVVP

SEQ ID NO: 56977 - protein, 10 aa, Mycobacterium tuberculosis
WVVTLRVVPE

SEQ ID NO: 56978 - protein, 10 aa, Mycobacterium tuberculosis
VVTLRVVPEG

SEQ ID NO: 56979 - protein, 10 aa, Mycobacterium tuberculosis
VTLRVVPEGL

SEQ ID NO: 56980 - protein, 10 aa, Mycobacterium tuberculosis
TLRVVPEGLA

SEQ ID NO: 56981 - protein, 10 aa, Mycobacterium tuberculosis
LRVVPEGLAA

SEQ ID NO: 56982 - protein, 10 aa, Mycobacterium tuberculosis
RVVPEGLAAA

SEQ ID NO: 56983 - protein, 10 aa, Mycobacterium tuberculosis
VVPEGLAAAS

SEQ ID NO: 56984 - protein, 10 aa, Mycobacterium tuberculosis
VPEGLAAASA

SEQ ID NO: 56985 - protein, 10 aa, Mycobacterium tuberculosis
PEGLAAASAA

SEQ ID NO: 56986 - protein, 10 aa, Mycobacterium tuberculosis
EGLAAASAAV

SEQ ID NO: 56987 - protein, 10 aa, Mycobacterium tuberculosis
GLAAASAAVE

SEQ ID NO: 56988 - protein, 10 aa, Mycobacterium tuberculosis
LAAASAAVEA

SEQ ID NO: 56989 - protein, 10 aa, Mycobacterium tuberculosis
AAASAAVEAL

SEQ ID NO: 56990 - protein, 10 aa, Mycobacterium tuberculosis
AASAAVEALT

SEQ ID NO: 56991 - protein, 10 aa, Mycobacterium tuberculosis
ASAAVEALTA

SEQ ID NO: 56992 - protein, 10 aa, Mycobacterium tuberculosis
SAAVEALTAR

SEQ ID NO: 56993 - protein, 10 aa, Mycobacterium tuberculosis
AAVEALTARL

SEQ ID NO: 56994 - protein, 10 aa, Mycobacterium tuberculosis
AVEALTARLA

SEQ ID NO: 56995 - protein, 10 aa, Mycobacterium tuberculosis
VEALTARLAA

SEQ ID NO: 56996 - protein, 10 aa, Mycobacterium tuberculosis
EALTARLAAA

SEQ ID NO: 56997 - protein, 10 aa, Mycobacterium tuberculosis
ALTARLAAAH

SEQ ID NO: 56998 - protein, 10 aa, Mycobacterium tuberculosis
LTARLAAAHA

SEQ ID NO: 56999 - protein, 10 aa, Mycobacterium tuberculosis
TARLAAAHAG

SEQ ID NO: 57000 - protein, 10 aa, Mycobacterium tuberculosis
ARLAAAHAGA

SEQ ID NO: 57001 - protein, 10 aa, Mycobacterium tuberculosis
RLAAAHAGAA

SEQ ID NO: 57002 - protein, 10 aa, Mycobacterium tuberculosis
LAAAHAGAAP

SEQ ID NO: 57003 - protein, 10 aa, Mycobacterium tuberculosis
AAAHAGAAPA

SEQ ID NO: 57004 - protein, 10 aa, Mycobacterium tuberculosis
AAHAGAAPAI

SEQ ID NO: 57005 - protein, 10 aa, Mycobacterium tuberculosis
AHAGAAPAIT

SEQ ID NO: 57006 - protein, 10 aa, Mycobacterium tuberculosis
HAGAAPAITA

SEQ ID NO: 57007 - protein, 10 aa, Mycobacterium tuberculosis
AGAAPAITAV

SEQ ID NO: 57008 - protein, 10 aa, Mycobacterium tuberculosis
GAAPAITAVV

SEQ ID NO: 57009 - protein, 10 aa, Mycobacterium tuberculosis
AAPAITAVVA

SEQ ID NO: 57010 - protein, 10 aa, Mycobacterium tuberculosis
APAITAVVAP

SEQ ID NO: 57011 - protein, 10 aa, Mycobacterium tuberculosis
PAITAVVAPA

SEQ ID NO: 57012 - protein, 10 aa, Mycobacterium tuberculosis
AITAVVAPAA

SEQ ID NO: 57013 - protein, 10 aa, Mycobacterium tuberculosis
ITAVVAPAAD

SEQ ID NO: 57014 - protein, 10 aa, Mycobacterium tuberculosis
TAVVAPAADP

SEQ ID NO: 57015 - protein, 10 aa, Mycobacterium tuberculosis
AVVAPAADPV

SEQ ID NO: 57016 - protein, 10 aa, Mycobacterium tuberculosis
VVAPAADPVS

SEQ ID NO: 57017 - protein, 10 aa, Mycobacterium tuberculosis
VAPAADPVSL

SEQ ID NO: 57018 - protein, 10 aa, Mycobacterium tuberculosis
APAADPVSLQ

SEQ ID NO: 57019 - protein, 10 aa, Mycobacterium tuberculosis
PAADPVSLQS

SEQ ID NO: 57020 - protein, 10 aa, Mycobacterium tuberculosis
AADPVSLQSA

SEQ ID NO: 57021 - protein, 10 aa, Mycobacterium tuberculosis
ADPVSLQSAV

SEQ ID NO: 57022 - protein, 10 aa, Mycobacterium tuberculosis
DPVSLQSAVG

SEQ ID NO: 57023 - protein, 10 aa, Mycobacterium tuberculosis
PVSLQSAVGF

SEQ ID NO: 57024 - protein, 10 aa, Mycobacterium tuberculosis
VSLQSAVGFS

SEQ ID NO: 57025 - protein, 10 aa, Mycobacterium tuberculosis
SLQSAVGFSA

SEQ ID NO: 57026 - protein, 10 aa, Mycobacterium tuberculosis
LQSAVGFSAL

SEQ ID NO: 57027 - protein, 10 aa, Mycobacterium tuberculosis
QSAVGFSALG

SEQ ID NO: 57028 - protein, 10 aa, Mycobacterium tuberculosis
SAVGFSALGS

SEQ ID NO: 57029 - protein, 10 aa, Mycobacterium tuberculosis
AVGFSALGSE

SEQ ID NO: 57030 - protein, 10 aa, Mycobacterium tuberculosis
VGFSALGSEH

SEQ ID NO: 57031 - protein, 10 aa, Mycobacterium tuberculosis
GFSALGSEHA

SEQ ID NO: 57032 - protein, 10 aa, Mycobacterium tuberculosis
FSALGSEHAA

SEQ ID NO: 57033 - protein, 10 aa, Mycobacterium tuberculosis
SALGSEHAAI

SEQ ID NO: 57034 - protein, 10 aa, Mycobacterium tuberculosis
ALGSEHAAIA

SEQ ID NO: 57035 - protein, 10 aa, Mycobacterium tuberculosis
LGSEHAAIAG

SEQ ID NO: 57036 - protein, 10 aa, Mycobacterium tuberculosis
GSEHAAIAGE

SEQ ID NO: 57037 - protein, 10 aa, Mycobacterium tuberculosis
SEHAAIAGEG

SEQ ID NO: 57038 - protein, 10 aa, Mycobacterium tuberculosis
EHAAIAGEGV

SEQ ID NO: 57039 - protein, 10 aa, Mycobacterium tuberculosis
HAAIAGEGVE

SEQ ID NO: 57040 - protein, 10 aa, Mycobacterium tuberculosis
AAIAGEGVEE

SEQ ID NO: 57041 - protein, 10 aa, Mycobacterium tuberculosis
AIAGEGVEEL

SEQ ID NO: 57042 - protein, 10 aa, Mycobacterium tuberculosis
IAGEGVEELG

SEQ ID NO: 57043 - protein, 10 aa, Mycobacterium tuberculosis
AGEGVEELGR

SEQ ID NO: 57044 - protein, 10 aa, Mycobacterium tuberculosis
GEGVEELGRS

SEQ ID NO: 57045 - protein, 10 aa, Mycobacterium tuberculosis
EGVEELGRSG

SEQ ID NO: 57046 - protein, 10 aa, Mycobacterium tuberculosis
GVEELGRSGV

SEQ ID NO: 57047 - protein, 10 aa, Mycobacterium tuberculosis
VEELGRSGVA

SEQ ID NO: 57048 - protein, 10 aa, Mycobacterium tuberculosis
EELGRSGVAV

SEQ ID NO: 57049 - protein, 10 aa, Mycobacterium tuberculosis
ELGRSGVAVG

SEQ ID NO: 57050 - protein, 10 aa, Mycobacterium tuberculosis
LGRSGVAVGE

SEQ ID NO: 57051 - protein, 10 aa, Mycobacterium tuberculosis
GRSGVAVGES

SEQ ID NO: 57052 - protein, 10 aa, Mycobacterium tuberculosis
RSGVAVGESG

SEQ ID NO: 57053 - protein, 10 aa, Mycobacterium tuberculosis
SGVAVGESGI

SEQ ID NO: 57054 - protein, 10 aa, Mycobacterium tuberculosis
GVAVGESGIG

SEQ ID NO: 57055 - protein, 10 aa, Mycobacterium tuberculosis
VAVGESGIGY

SEQ ID NO: 57056 - protein, 10 aa, Mycobacterium tuberculosis
AVGESGIGYA

SEQ ID NO: 57057 - protein, 10 aa, Mycobacterium tuberculosis
VGESGIGYAA

SEQ ID NO: 57058 - protein, 10 aa, Mycobacterium tuberculosis
GESGIGYAAG

SEQ ID NO: 57059 - protein, 10 aa, Mycobacterium tuberculosis
ESGIGYAAGD

SEQ ID NO: 57060 - protein, 10 aa, Mycobacterium tuberculosis
SGIGYAAGDA

SEQ ID NO: 57061 - protein, 10 aa, Mycobacterium tuberculosis
GIGYAAGDAV

SEQ ID NO: 57062 - protein, 10 aa, Mycobacterium tuberculosis
IGYAAGDAVA

SEQ ID NO: 57063 - protein, 10 aa, Mycobacterium tuberculosis
GYAAGDAVAA

SEQ ID NO: 57064 - protein, 10 aa, Mycobacterium tuberculosis
YAAGDAVAAA

SEQ ID NO: 57065 - protein, 10 aa, Mycobacterium tuberculosis
AAGDAVAAAT

SEQ ID NO: 57066 - protein, 10 aa, Mycobacterium tuberculosis
AGDAVAAATY

SEQ ID NO: 57067 - protein, 10 aa, Mycobacterium tuberculosis
GDAVAAATYL

SEQ ID NO: 57068 - protein, 10 aa, Mycobacterium tuberculosis
DAVAAATYLV

SEQ ID NO: 57069 - protein, 10 aa, Mycobacterium tuberculosis
AVAAATYLVS

SEQ ID NO: 57070 - protein, 10 aa, Mycobacterium tuberculosis
VAAATYLVSG

SEQ ID NO: 57071 - protein, 10 aa, Mycobacterium tuberculosis
AAATYLVSGG

SEQ ID NO: 57072 - protein, 10 aa, Mycobacterium tuberculosis
AATYLVSGGS

SEQ ID NO: 57073 - protein, 10 aa, Mycobacterium tuberculosis
ATYLVSGGSL

SEQ ID NO: 57074 - protein, 11 aa, Mycobacterium tuberculosis
MSRQASRQVSI

SEQ ID NO: 57075 - protein, 11 aa, Mycobacterium tuberculosis
SRQASRQVSII

SEQ ID NO: 57076 - protein, 11 aa, Mycobacterium tuberculosis
RQASRQVSIIR

SEQ ID NO: 57077 - protein, 11 aa, Mycobacterium tuberculosis
QASRQVSIIRS

SEQ ID NO: 57078 - protein, 11 aa, Mycobacterium tuberculosis
ASRQVSIIRSA

SEQ ID NO: 57079 - protein, 11 aa, Mycobacterium tuberculosis
SRQVSIIRSAG

SEQ ID NO: 57080 - protein, 11 aa, Mycobacterium tuberculosis
RQVSIIRSAGD

SEQ ID NO: 57081 - protein, 11 aa, Mycobacterium tuberculosis
QVSIIRSAGDG

SEQ ID NO: 57082 - protein, 11 aa, Mycobacterium tuberculosis
VSIIRSAGDGN

SEQ ID NO: 57083 - protein, 11 aa, Mycobacterium tuberculosis
SIIRSAGDGNR

SEQ ID NO: 57084 - protein, 11 aa, Mycobacterium tuberculosis
IIRSAGDGNRS

SEQ ID NO: 57085 - protein, 11 aa, Mycobacterium tuberculosis
IRSAGDGNRSC

SEQ ID NO: 57086 - protein, 11 aa, Mycobacterium tuberculosis
RSAGDGNRSCG

SEQ ID NO: 57087 - protein, 11 aa, Mycobacterium tuberculosis
SAGDGNRSCGC

SEQ ID NO: 57088 - protein, 11 aa, Mycobacterium tuberculosis
AGDGNRSCGCV

SEQ ID NO: 57089 - protein, 11 aa, Mycobacterium tuberculosis
GDGNRSCGCVT

SEQ ID NO: 57090 - protein, 11 aa, Mycobacterium tuberculosis
DGNRSCGCVTP

SEQ ID NO: 57091 - protein, 11 aa, Mycobacterium tuberculosis
GNRSCGCVTPK

SEQ ID NO: 57092 - protein, 11 aa, Mycobacterium tuberculosis
NRSCGCVTPKE

SEQ ID NO: 57093 - protein, 11 aa, Mycobacterium tuberculosis
RSCGCVTPKEG

SEQ ID NO: 57094 - protein, 11 aa, Mycobacterium tuberculosis
SCGCVTPKEGV

SEQ ID NO: 57095 - protein, 11 aa, Mycobacterium tuberculosis
CGCVTPKEGVW

SEQ ID NO: 57096 - protein, 11 aa, Mycobacterium tuberculosis
GCVTPKEGVWV

SEQ ID NO: 57097 - protein, 11 aa, Mycobacterium tuberculosis
CVTPKEGVWVV

SEQ ID NO: 57098 - protein, 11 aa, Mycobacterium tuberculosis
VTPKEGVWVVT

SEQ ID NO: 57099 - protein, 11 aa, Mycobacterium tuberculosis
TPKEGVWVVTL

SEQ ID NO: 57100 - protein, 11 aa, Mycobacterium tuberculosis
PKEGVWVVTLR

SEQ ID NO: 57101 - protein, 11 aa, Mycobacterium tuberculosis
KEGVWVVTLRV

SEQ ID NO: 57102 - protein, 11 aa, Mycobacterium tuberculosis
EGVWVVTLRVV

SEQ ID NO: 57103 - protein, 11 aa, Mycobacterium tuberculosis
GVWVVTLRVVP

SEQ ID NO: 57104 - protein, 11 aa, Mycobacterium tuberculosis
VWVVTLRVVPE

SEQ ID NO: 57105 - protein, 11 aa, Mycobacterium tuberculosis
WVVTLRVVPEG

SEQ ID NO: 57106 - protein, 11 aa, Mycobacterium tuberculosis
VVTLRVVPEGL

SEQ ID NO: 57107 - protein, 11 aa, Mycobacterium tuberculosis
VTLRVVPEGLA

SEQ ID NO: 57108 - protein, 11 aa, Mycobacterium tuberculosis
TLRVVPEGLAA

SEQ ID NO: 57109 - protein, 11 aa, Mycobacterium tuberculosis
LRVVPEGLAAA

SEQ ID NO: 57110 - protein, 11 aa, Mycobacterium tuberculosis
RVVPEGLAAAS

SEQ ID NO: 57111 - protein, 11 aa, Mycobacterium tuberculosis
VVPEGLAAASA

SEQ ID NO: 57112 - protein, 11 aa, Mycobacterium tuberculosis
VPEGLAAASAA

SEQ ID NO: 57113 - protein, 11 aa, Mycobacterium tuberculosis
PEGLAAASAAV

SEQ ID NO: 57114 - protein, 11 aa, Mycobacterium tuberculosis
EGLAAASAAVE

SEQ ID NO: 57115 - protein, 11 aa, Mycobacterium tuberculosis
GLAAASAAVEA

SEQ ID NO: 57116 - protein, 11 aa, Mycobacterium tuberculosis
LAAASAAVEAL

SEQ ID NO: 57117 - protein, 11 aa, Mycobacterium tuberculosis
AAASAAVEALT

SEQ ID NO: 57118 - protein, 11 aa, Mycobacterium tuberculosis
AASAAVEALTA

SEQ ID NO: 57119 - protein, 11 aa, Mycobacterium tuberculosis
ASAAVEALTAR

SEQ ID NO: 57120 - protein, 11 aa, Mycobacterium tuberculosis
SAAVEALTARL

SEQ ID NO: 57121 - protein, 11 aa, Mycobacterium tuberculosis
AAVEALTARLA

SEQ ID NO: 57122 - protein, 11 aa, Mycobacterium tuberculosis
AVEALTARLAA

SEQ ID NO: 57123 - protein, 11 aa, Mycobacterium tuberculosis
VEALTARLAAA

SEQ ID NO: 57124 - protein, 11 aa, Mycobacterium tuberculosis
EALTARLAAAH

SEQ ID NO: 57125 - protein, 11 aa, Mycobacterium tuberculosis
ALTARLAAAHA

SEQ ID NO: 57126 - protein, 11 aa, Mycobacterium tuberculosis
LTARLAAAHAG

SEQ ID NO: 57127 - protein, 11 aa, Mycobacterium tuberculosis
TARLAAAHAGA

SEQ ID NO: 57128 - protein, 11 aa, Mycobacterium tuberculosis
ARLAAAHAGAA

SEQ ID NO: 57129 - protein, 11 aa, Mycobacterium tuberculosis
RLAAAHAGAAP

SEQ ID NO: 57130 - protein, 11 aa, Mycobacterium tuberculosis
LAAAHAGAAPA

SEQ ID NO: 57131 - protein, 11 aa, Mycobacterium tuberculosis
AAAHAGAAPAI

SEQ ID NO: 57132 - protein, 11 aa, Mycobacterium tuberculosis
AAHAGAAPAIT

SEQ ID NO: 57133 - protein, 11 aa, Mycobacterium tuberculosis
AHAGAAPAITA

SEQ ID NO: 57134 - protein, 11 aa, Mycobacterium tuberculosis
HAGAAPAITAV

SEQ ID NO: 57135 - protein, 11 aa, Mycobacterium tuberculosis
AGAAPAITAVV

SEQ ID NO: 57136 - protein, 11 aa, Mycobacterium tuberculosis
GAAPAITAVVA

SEQ ID NO: 57137 - protein, 11 aa, Mycobacterium tuberculosis
AAPAITAVVAP

SEQ ID NO: 57138 - protein, 11 aa, Mycobacterium tuberculosis
APAITAVVAPA

SEQ ID NO: 57139 - protein, 11 aa, Mycobacterium tuberculosis
PAITAVVAPAA

SEQ ID NO: 57140 - protein, 11 aa, Mycobacterium tuberculosis
AITAVVAPAAD

SEQ ID NO: 57141 - protein, 11 aa, Mycobacterium tuberculosis
ITAVVAPAADP

SEQ ID NO: 57142 - protein, 11 aa, Mycobacterium tuberculosis
TAVVAPAADPV

SEQ ID NO: 57143 - protein, 11 aa, Mycobacterium tuberculosis
AVVAPAADPVS

SEQ ID NO: 57144 - protein, 11 aa, Mycobacterium tuberculosis
VVAPAADPVSL

SEQ ID NO: 57145 - protein, 11 aa, Mycobacterium tuberculosis
VAPAADPVSLQ

SEQ ID NO: 57146 - protein, 11 aa, Mycobacterium tuberculosis
APAADPVSLQS

SEQ ID NO: 57147 - protein, 11 aa, Mycobacterium tuberculosis
PAADPVSLQSA

SEQ ID NO: 57148 - protein, 11 aa, Mycobacterium tuberculosis
AADPVSLQSAV

SEQ ID NO: 57149 - protein, 11 aa, Mycobacterium tuberculosis
ADPVSLQSAVG

SEQ ID NO: 57150 - protein, 11 aa, Mycobacterium tuberculosis
DPVSLQSAVGF

SEQ ID NO: 57151 - protein, 11 aa, Mycobacterium tuberculosis
PVSLQSAVGFS

SEQ ID NO: 57152 - protein, 11 aa, Mycobacterium tuberculosis
VSLQSAVGFSA

SEQ ID NO: 57153 - protein, 11 aa, Mycobacterium tuberculosis
SLQSAVGFSAL

SEQ ID NO: 57154 - protein, 11 aa, Mycobacterium tuberculosis
LQSAVGFSALG

SEQ ID NO: 57155 - protein, 11 aa, Mycobacterium tuberculosis
QSAVGFSALGS

SEQ ID NO: 57156 - protein, 11 aa, Mycobacterium tuberculosis
SAVGFSALGSE

SEQ ID NO: 57157 - protein, 11 aa, Mycobacterium tuberculosis
AVGFSALGSEH

SEQ ID NO: 57158 - protein, 11 aa, Mycobacterium tuberculosis
VGFSALGSEHA

SEQ ID NO: 57159 - protein, 11 aa, Mycobacterium tuberculosis
GFSALGSEHAA

SEQ ID NO: 57160 - protein, 11 aa, Mycobacterium tuberculosis
FSALGSEHAAI

SEQ ID NO: 57161 - protein, 11 aa, Mycobacterium tuberculosis
SALGSEHAAIA

SEQ ID NO: 57162 - protein, 11 aa, Mycobacterium tuberculosis
ALGSEHAAIAG

SEQ ID NO: 57163 - protein, 11 aa, Mycobacterium tuberculosis
LGSEHAAIAGE

SEQ ID NO: 57164 - protein, 11 aa, Mycobacterium tuberculosis
GSEHAAIAGEG

SEQ ID NO: 57165 - protein, 11 aa, Mycobacterium tuberculosis
SEHAAIAGEGV

SEQ ID NO: 57166 - protein, 11 aa, Mycobacterium tuberculosis
EHAAIAGEGVE

SEQ ID NO: 57167 - protein, 11 aa, Mycobacterium tuberculosis
HAAIAGEGVEE

SEQ ID NO: 57168 - protein, 11 aa, Mycobacterium tuberculosis
AAIAGEGVEEL

SEQ ID NO: 57169 - protein, 11 aa, Mycobacterium tuberculosis
AIAGEGVEELG

SEQ ID NO: 57170 - protein, 11 aa, Mycobacterium tuberculosis
IAGEGVEELGR

SEQ ID NO: 57171 - protein, 11 aa, Mycobacterium tuberculosis
AGEGVEELGRS

SEQ ID NO: 57172 - protein, 11 aa, Mycobacterium tuberculosis
GEGVEELGRSG

SEQ ID NO: 57173 - protein, 11 aa, Mycobacterium tuberculosis
EGVEELGRSGV

SEQ ID NO: 57174 - protein, 11 aa, Mycobacterium tuberculosis
GVEELGRSGVA

SEQ ID NO: 57175 - protein, 11 aa, Mycobacterium tuberculosis
VEELGRSGVAV

SEQ ID NO: 57176 - protein, 11 aa, Mycobacterium tuberculosis
EELGRSGVAVG

SEQ ID NO: 57177 - protein, 11 aa, Mycobacterium tuberculosis
ELGRSGVAVGE

SEQ ID NO: 57178 - protein, 11 aa, Mycobacterium tuberculosis
LGRSGVAVGES

SEQ ID NO: 57179 - protein, 11 aa, Mycobacterium tuberculosis
GRSGVAVGESG

SEQ ID NO: 57180 - protein, 11 aa, Mycobacterium tuberculosis
RSGVAVGESGI

SEQ ID NO: 57181 - protein, 11 aa, Mycobacterium tuberculosis
SGVAVGESGIG

SEQ ID NO: 57182 - protein, 11 aa, Mycobacterium tuberculosis
GVAVGESGIGY

SEQ ID NO: 57183 - protein, 11 aa, Mycobacterium tuberculosis
VAVGESGIGYA

SEQ ID NO: 57184 - protein, 11 aa, Mycobacterium tuberculosis
AVGESGIGYAA

SEQ ID NO: 57185 - protein, 11 aa, Mycobacterium tuberculosis
VGESGIGYAAG

SEQ ID NO: 57186 - protein, 11 aa, Mycobacterium tuberculosis
GESGIGYAAGD

SEQ ID NO: 57187 - protein, 11 aa, Mycobacterium tuberculosis
ESGIGYAAGDA

SEQ ID NO: 57188 - protein, 11 aa, Mycobacterium tuberculosis
SGIGYAAGDAV

SEQ ID NO: 57189 - protein, 11 aa, Mycobacterium tuberculosis
GIGYAAGDAVA

SEQ ID NO: 57190 - protein, 11 aa, Mycobacterium tuberculosis
IGYAAGDAVAA

SEQ ID NO: 57191 - protein, 11 aa, Mycobacterium tuberculosis
GYAAGDAVAAA

SEQ ID NO: 57192 - protein, 11 aa, Mycobacterium tuberculosis
YAAGDAVAAAT

SEQ ID NO: 57193 - protein, 11 aa, Mycobacterium tuberculosis
AAGDAVAAATY

SEQ ID NO: 57194 - protein, 11 aa, Mycobacterium tuberculosis
AGDAVAAATYL

SEQ ID NO: 57195 - protein, 11 aa, Mycobacterium tuberculosis
GDAVAAATYLV

SEQ ID NO: 57196 - protein, 11 aa, Mycobacterium tuberculosis
DAVAAATYLVS

SEQ ID NO: 57197 - protein, 11 aa, Mycobacterium tuberculosis
AVAAATYLVSG

SEQ ID NO: 57198 - protein, 11 aa, Mycobacterium tuberculosis
VAAATYLVSGG

SEQ ID NO: 57199 - protein, 11 aa, Mycobacterium tuberculosis
AAATYLVSGGS

SEQ ID NO: 57200 - protein, 11 aa, Mycobacterium tuberculosis
AATYLVSGGSL

SEQ ID NO: 57201 - protein, 8 aa, Mycobacterium tuberculosis
MQLVDRVR

SEQ ID NO: 57202 - protein, 8 aa, Mycobacterium tuberculosis
QLVDRVRG

SEQ ID NO: 57203 - protein, 8 aa, Mycobacterium tuberculosis
LVDRVRGA

SEQ ID NO: 57204 - protein, 8 aa, Mycobacterium tuberculosis
VDRVRGAV

SEQ ID NO: 57205 - protein, 8 aa, Mycobacterium tuberculosis
DRVRGAVT

SEQ ID NO: 57206 - protein, 8 aa, Mycobacterium tuberculosis
RVRGAVTG

SEQ ID NO: 57207 - protein, 8 aa, Mycobacterium tuberculosis
VRGAVTGM

SEQ ID NO: 57208 - protein, 8 aa, Mycobacterium tuberculosis
RGAVTGMS

SEQ ID NO: 57209 - protein, 8 aa, Mycobacterium tuberculosis
GAVTGMSR

SEQ ID NO: 57210 - protein, 8 aa, Mycobacterium tuberculosis
AVTGMSRR

SEQ ID NO: 57211 - protein, 8 aa, Mycobacterium tuberculosis
VTGMSRRL

SEQ ID NO: 57212 - protein, 8 aa, Mycobacterium tuberculosis
TGMSRRLV

SEQ ID NO: 57213 - protein, 8 aa, Mycobacterium tuberculosis
GMSRRLVV

SEQ ID NO: 57214 - protein, 8 aa, Mycobacterium tuberculosis
MSRRLVVG

SEQ ID NO: 57215 - protein, 8 aa, Mycobacterium tuberculosis
SRRLVVGA

SEQ ID NO: 57216 - protein, 8 aa, Mycobacterium tuberculosis
RRLVVGAV

SEQ ID NO: 57217 - protein, 8 aa, Mycobacterium tuberculosis
RLVVGAVG

SEQ ID NO: 57218 - protein, 8 aa, Mycobacterium tuberculosis
LVVGAVGA

SEQ ID NO: 57219 - protein, 8 aa, Mycobacterium tuberculosis
VVGAVGAA

SEQ ID NO: 57220 - protein, 8 aa, Mycobacterium tuberculosis
VGAVGAAL

SEQ ID NO: 57221 - protein, 8 aa, Mycobacterium tuberculosis
GAVGAALV

SEQ ID NO: 57222 - protein, 8 aa, Mycobacterium tuberculosis
AVGAALVS

SEQ ID NO: 57223 - protein, 8 aa, Mycobacterium tuberculosis
VGAALVSG

SEQ ID NO: 57224 - protein, 8 aa, Mycobacterium tuberculosis
GAALVSGL

SEQ ID NO: 57225 - protein, 8 aa, Mycobacterium tuberculosis
AALVSGLV

SEQ ID NO: 57226 - protein, 8 aa, Mycobacterium tuberculosis
ALVSGLVG

SEQ ID NO: 57227 - protein, 8 aa, Mycobacterium tuberculosis
LVSGLVGA

SEQ ID NO: 57228 - protein, 8 aa, Mycobacterium tuberculosis
VSGLVGAV

SEQ ID NO: 57229 - protein, 8 aa, Mycobacterium tuberculosis
SGLVGAVG

SEQ ID NO: 57230 - protein, 8 aa, Mycobacterium tuberculosis
GLVGAVGG

SEQ ID NO: 57231 - protein, 8 aa, Mycobacterium tuberculosis
LVGAVGGT

SEQ ID NO: 57232 - protein, 8 aa, Mycobacterium tuberculosis
VGAVGGTA

SEQ ID NO: 57233 - protein, 8 aa, Mycobacterium tuberculosis
GAVGGTAT

SEQ ID NO: 57234 - protein, 8 aa, Mycobacterium tuberculosis
AVGGTATA

SEQ ID NO: 57235 - protein, 8 aa, Mycobacterium tuberculosis
VGGTATAG

SEQ ID NO: 57236 - protein, 8 aa, Mycobacterium tuberculosis
GGTATAGA

SEQ ID NO: 57237 - protein, 8 aa, Mycobacterium tuberculosis
GTATAGAF

SEQ ID NO: 57238 - protein, 8 aa, Mycobacterium tuberculosis
TATAGAFS

SEQ ID NO: 57239 - protein, 8 aa, Mycobacterium tuberculosis
ATAGAFSR

SEQ ID NO: 57240 - protein, 8 aa, Mycobacterium tuberculosis
TAGAFSRP

SEQ ID NO: 57241 - protein, 8 aa, Mycobacterium tuberculosis
AGAFSRPG

SEQ ID NO: 57242 - protein, 8 aa, Mycobacterium tuberculosis
GAFSRPGL

SEQ ID NO: 57243 - protein, 8 aa, Mycobacterium tuberculosis
AFSRPGLP

SEQ ID NO: 57244 - protein, 8 aa, Mycobacterium tuberculosis
FSRPGLPV

SEQ ID NO: 57245 - protein, 8 aa, Mycobacterium tuberculosis
SRPGLPVE

SEQ ID NO: 57246 - protein, 8 aa, Mycobacterium tuberculosis
RPGLPVEY

SEQ ID NO: 57247 - protein, 8 aa, Mycobacterium tuberculosis
PGLPVEYL

SEQ ID NO: 57248 - protein, 8 aa, Mycobacterium tuberculosis
GLPVEYLQ

SEQ ID NO: 57249 - protein, 8 aa, Mycobacterium tuberculosis
LPVEYLQV

SEQ ID NO: 57250 - protein, 8 aa, Mycobacterium tuberculosis
PVEYLQVP

SEQ ID NO: 57251 - protein, 8 aa, Mycobacterium tuberculosis
VEYLQVPS

SEQ ID NO: 57252 - protein, 8 aa, Mycobacterium tuberculosis
EYLQVPSP

SEQ ID NO: 57253 - protein, 8 aa, Mycobacterium tuberculosis
YLQVPSPS

SEQ ID NO: 57254 - protein, 8 aa, Mycobacterium tuberculosis
LQVPSPSM

SEQ ID NO: 57255 - protein, 8 aa, Mycobacterium tuberculosis
QVPSPSMG

SEQ ID NO: 57256 - protein, 8 aa, Mycobacterium tuberculosis
VPSPSMGR

SEQ ID NO: 57257 - protein, 8 aa, Mycobacterium tuberculosis
PSPSMGRD

SEQ ID NO: 57258 - protein, 8 aa, Mycobacterium tuberculosis
SPSMGRDI

SEQ ID NO: 57259 - protein, 8 aa, Mycobacterium tuberculosis
PSMGRDIK

SEQ ID NO: 57260 - protein, 8 aa, Mycobacterium tuberculosis
SMGRDIKV

SEQ ID NO: 57261 - protein, 8 aa, Mycobacterium tuberculosis
MGRDIKVQ

SEQ ID NO: 57262 - protein, 8 aa, Mycobacterium tuberculosis
GRDIKVQF

SEQ ID NO: 57263 - protein, 8 aa, Mycobacterium tuberculosis
RDIKVQFQ

SEQ ID NO: 57264 - protein, 8 aa, Mycobacterium tuberculosis
DIKVQFQS

SEQ ID NO: 57265 - protein, 8 aa, Mycobacterium tuberculosis
IKVQFQSG

SEQ ID NO: 57266 - protein, 8 aa, Mycobacterium tuberculosis
KVQFQSGG

SEQ ID NO: 57267 - protein, 8 aa, Mycobacterium tuberculosis
VQFQSGGA

SEQ ID NO: 57268 - protein, 8 aa, Mycobacterium tuberculosis
QFQSGGAN

SEQ ID NO: 57269 - protein, 8 aa, Mycobacterium tuberculosis
FQSGGANS

SEQ ID NO: 57270 - protein, 8 aa, Mycobacterium tuberculosis
QSGGANSP

SEQ ID NO: 57271 - protein, 8 aa, Mycobacterium tuberculosis
SGGANSPA

SEQ ID NO: 57272 - protein, 8 aa, Mycobacterium tuberculosis
GGANSPAL

SEQ ID NO: 57273 - protein, 8 aa, Mycobacterium tuberculosis
GANSPALY

SEQ ID NO: 57274 - protein, 8 aa, Mycobacterium tuberculosis
ANSPALYL

SEQ ID NO: 57275 - protein, 8 aa, Mycobacterium tuberculosis
NSPALYLL

SEQ ID NO: 57276 - protein, 8 aa, Mycobacterium tuberculosis
SPALYLLD

SEQ ID NO: 57277 - protein, 8 aa, Mycobacterium tuberculosis
PALYLLDG

SEQ ID NO: 57278 - protein, 8 aa, Mycobacterium tuberculosis
ALYLLDGL

SEQ ID NO: 57279 - protein, 8 aa, Mycobacterium tuberculosis
LYLLDGLR

SEQ ID NO: 57280 - protein, 8 aa, Mycobacterium tuberculosis
YLLDGLRA

SEQ ID NO: 57281 - protein, 8 aa, Mycobacterium tuberculosis
LLDGLRAQ

SEQ ID NO: 57282 - protein, 8 aa, Mycobacterium tuberculosis
LDGLRAQD

SEQ ID NO: 57283 - protein, 8 aa, Mycobacterium tuberculosis
DGLRAQDD

SEQ ID NO: 57284 - protein, 8 aa, Mycobacterium tuberculosis
GLRAQDDF

SEQ ID NO: 57285 - protein, 8 aa, Mycobacterium tuberculosis
LRAQDDFS

SEQ ID NO: 57286 - protein, 8 aa, Mycobacterium tuberculosis
RAQDDFSG

SEQ ID NO: 57287 - protein, 8 aa, Mycobacterium tuberculosis
AQDDFSGW

SEQ ID NO: 57288 - protein, 8 aa, Mycobacterium tuberculosis
QDDFSGWD

SEQ ID NO: 57289 - protein, 8 aa, Mycobacterium tuberculosis
DDFSGWDI

SEQ ID NO: 57290 - protein, 8 aa, Mycobacterium tuberculosis
DFSGWDIN

SEQ ID NO: 57291 - protein, 8 aa, Mycobacterium tuberculosis
FSGWDINT

SEQ ID NO: 57292 - protein, 8 aa, Mycobacterium tuberculosis
SGWDINTP

SEQ ID NO: 57293 - protein, 8 aa, Mycobacterium tuberculosis
GWDINTPA

SEQ ID NO: 57294 - protein, 8 aa, Mycobacterium tuberculosis
WDINTPAF

SEQ ID NO: 57295 - protein, 8 aa, Mycobacterium tuberculosis
DINTPAFE

SEQ ID NO: 57296 - protein, 8 aa, Mycobacterium tuberculosis
INTPAFEW

SEQ ID NO: 57297 - protein, 8 aa, Mycobacterium tuberculosis
NTPAFEWY

SEQ ID NO: 57298 - protein, 8 aa, Mycobacterium tuberculosis
TPAFEWYD

SEQ ID NO: 57299 - protein, 8 aa, Mycobacterium tuberculosis
PAFEWYDQ

SEQ ID NO: 57300 - protein, 8 aa, Mycobacterium tuberculosis
AFEWYDQS

SEQ ID NO: 57301 - protein, 8 aa, Mycobacterium tuberculosis
FEWYDQSG

SEQ ID NO: 57302 - protein, 8 aa, Mycobacterium tuberculosis
EWYDQSGL

SEQ ID NO: 57303 - protein, 8 aa, Mycobacterium tuberculosis
WYDQSGLS

SEQ ID NO: 57304 - protein, 8 aa, Mycobacterium tuberculosis
YDQSGLSV

SEQ ID NO: 57305 - protein, 8 aa, Mycobacterium tuberculosis
DQSGLSVV

SEQ ID NO: 57306 - protein, 8 aa, Mycobacterium tuberculosis
QSGLSVVM

SEQ ID NO: 57307 - protein, 8 aa, Mycobacterium tuberculosis
SGLSVVMP

SEQ ID NO: 57308 - protein, 8 aa, Mycobacterium tuberculosis
GLSVVMPV

SEQ ID NO: 57309 - protein, 8 aa, Mycobacterium tuberculosis
LSVVMPVG

SEQ ID NO: 57310 - protein, 8 aa, Mycobacterium tuberculosis
SVVMPVGG

SEQ ID NO: 57311 - protein, 8 aa, Mycobacterium tuberculosis
VVMPVGGQ

SEQ ID NO: 57312 - protein, 8 aa, Mycobacterium tuberculosis
VMPVGGQS

SEQ ID NO: 57313 - protein, 8 aa, Mycobacterium tuberculosis
MPVGGQSS

SEQ ID NO: 57314 - protein, 8 aa, Mycobacterium tuberculosis
PVGGQSSF

SEQ ID NO: 57315 - protein, 8 aa, Mycobacterium tuberculosis
VGGQSSFY

SEQ ID NO: 57316 - protein, 8 aa, Mycobacterium tuberculosis
GGQSSFYS

SEQ ID NO: 57317 - protein, 8 aa, Mycobacterium tuberculosis
GQSSFYSD

SEQ ID NO: 57318 - protein, 8 aa, Mycobacterium tuberculosis
QSSFYSDW

SEQ ID NO: 57319 - protein, 8 aa, Mycobacterium tuberculosis
SSFYSDWY

SEQ ID NO: 57320 - protein, 8 aa, Mycobacterium tuberculosis
SFYSDWYQ

SEQ ID NO: 57321 - protein, 8 aa, Mycobacterium tuberculosis
FYSDWYQP

SEQ ID NO: 57322 - protein, 8 aa, Mycobacterium tuberculosis
YSDWYQPA

SEQ ID NO: 57323 - protein, 8 aa, Mycobacterium tuberculosis
SDWYQPAC

SEQ ID NO: 57324 - protein, 8 aa, Mycobacterium tuberculosis
DWYQPACG

SEQ ID NO: 57325 - protein, 8 aa, Mycobacterium tuberculosis
WYQPACGK

SEQ ID NO: 57326 - protein, 8 aa, Mycobacterium tuberculosis
YQPACGKA

SEQ ID NO: 57327 - protein, 8 aa, Mycobacterium tuberculosis
QPACGKAG

SEQ ID NO: 57328 - protein, 8 aa, Mycobacterium tuberculosis
PACGKAGC

SEQ ID NO: 57329 - protein, 8 aa, Mycobacterium tuberculosis
ACGKAGCQ

SEQ ID NO: 57330 - protein, 8 aa, Mycobacterium tuberculosis
CGKAGCQT

SEQ ID NO: 57331 - protein, 8 aa, Mycobacterium tuberculosis
GKAGCQTY

SEQ ID NO: 57332 - protein, 8 aa, Mycobacterium tuberculosis
KAGCQTYK

SEQ ID NO: 57333 - protein, 8 aa, Mycobacterium tuberculosis
AGCQTYKW

SEQ ID NO: 57334 - protein, 8 aa, Mycobacterium tuberculosis
GCQTYKWE

SEQ ID NO: 57335 - protein, 8 aa, Mycobacterium tuberculosis
CQTYKWET

SEQ ID NO: 57336 - protein, 8 aa, Mycobacterium tuberculosis
QTYKWETF

SEQ ID NO: 57337 - protein, 8 aa, Mycobacterium tuberculosis
TYKWETFL

SEQ ID NO: 57338 - protein, 8 aa, Mycobacterium tuberculosis
YKWETFLT

SEQ ID NO: 57339 - protein, 8 aa, Mycobacterium tuberculosis
KWETFLTS

SEQ ID NO: 57340 - protein, 8 aa, Mycobacterium tuberculosis
WETFLTSE

SEQ ID NO: 57341 - protein, 8 aa, Mycobacterium tuberculosis
ETFLTSEL

SEQ ID NO: 57342 - protein, 8 aa, Mycobacterium tuberculosis
TFLTSELP

SEQ ID NO: 57343 - protein, 8 aa, Mycobacterium tuberculosis
FLTSELPG

SEQ ID NO: 57344 - protein, 8 aa, Mycobacterium tuberculosis
LTSELPGW

SEQ ID NO: 57345 - protein, 8 aa, Mycobacterium tuberculosis
TSELPGWL

SEQ ID NO: 57346 - protein, 8 aa, Mycobacterium tuberculosis
SELPGWLQ

SEQ ID NO: 57347 - protein, 8 aa, Mycobacterium tuberculosis
ELPGWLQA

SEQ ID NO: 57348 - protein, 8 aa, Mycobacterium tuberculosis
LPGWLQAN

SEQ ID NO: 57349 - protein, 8 aa, Mycobacterium tuberculosis
PGWLQANR

SEQ ID NO: 57350 - protein, 8 aa, Mycobacterium tuberculosis
GWLQANRH

SEQ ID NO: 57351 - protein, 8 aa, Mycobacterium tuberculosis
WLQANRHV

SEQ ID NO: 57352 - protein, 8 aa, Mycobacterium tuberculosis
LQANRHVK

SEQ ID NO: 57353 - protein, 8 aa, Mycobacterium tuberculosis
QANRHVKP

SEQ ID NO: 57354 - protein, 8 aa, Mycobacterium tuberculosis
ANRHVKPT

SEQ ID NO: 57355 - protein, 8 aa, Mycobacterium tuberculosis
NRHVKPTG

SEQ ID NO: 57356 - protein, 8 aa, Mycobacterium tuberculosis
RHVKPTGS

SEQ ID NO: 57357 - protein, 8 aa, Mycobacterium tuberculosis
HVKPTGSA

SEQ ID NO: 57358 - protein, 8 aa, Mycobacterium tuberculosis
VKPTGSAV

SEQ ID NO: 57359 - protein, 8 aa, Mycobacterium tuberculosis
KPTGSAVV

SEQ ID NO: 57360 - protein, 8 aa, Mycobacterium tuberculosis
PTGSAVVG

SEQ ID NO: 57361 - protein, 8 aa, Mycobacterium tuberculosis
TGSAVVGL

SEQ ID NO: 57362 - protein, 8 aa, Mycobacterium tuberculosis
GSAVVGLS

SEQ ID NO: 57363 - protein, 8 aa, Mycobacterium tuberculosis
SAVVGLSM

SEQ ID NO: 57364 - protein, 8 aa, Mycobacterium tuberculosis
AVVGLSMA

SEQ ID NO: 57365 - protein, 8 aa, Mycobacterium tuberculosis
VVGLSMAA

SEQ ID NO: 57366 - protein, 8 aa, Mycobacterium tuberculosis
VGLSMAAS

SEQ ID NO: 57367 - protein, 8 aa, Mycobacterium tuberculosis
GLSMAASS

SEQ ID NO: 57368 - protein, 8 aa, Mycobacterium tuberculosis
LSMAASSA

SEQ ID NO: 57369 - protein, 8 aa, Mycobacterium tuberculosis
SMAASSAL

SEQ ID NO: 57370 - protein, 8 aa, Mycobacterium tuberculosis
MAASSALT

SEQ ID NO: 57371 - protein, 8 aa, Mycobacterium tuberculosis
AASSALTL

SEQ ID NO: 57372 - protein, 8 aa, Mycobacterium tuberculosis
ASSALTLA

SEQ ID NO: 57373 - protein, 8 aa, Mycobacterium tuberculosis
SSALTLAI

SEQ ID NO: 57374 - protein, 8 aa, Mycobacterium tuberculosis
SALTLAIY

SEQ ID NO: 57375 - protein, 8 aa, Mycobacterium tuberculosis
ALTLAIYH

SEQ ID NO: 57376 - protein, 8 aa, Mycobacterium tuberculosis
LTLAIYHP

SEQ ID NO: 57377 - protein, 8 aa, Mycobacterium tuberculosis
TLAIYHPQ

SEQ ID NO: 57378 - protein, 8 aa, Mycobacterium tuberculosis
LAIYHPQQ

SEQ ID NO: 57379 - protein, 8 aa, Mycobacterium tuberculosis
AIYHPQQF

SEQ ID NO: 57380 - protein, 8 aa, Mycobacterium tuberculosis
IYHPQQFV

SEQ ID NO: 57381 - protein, 8 aa, Mycobacterium tuberculosis
YHPQQFVY

SEQ ID NO: 57382 - protein, 8 aa, Mycobacterium tuberculosis
HPQQFVYA

SEQ ID NO: 57383 - protein, 8 aa, Mycobacterium tuberculosis
PQQFVYAG

SEQ ID NO: 57384 - protein, 8 aa, Mycobacterium tuberculosis
QQFVYAGA

SEQ ID NO: 57385 - protein, 8 aa, Mycobacterium tuberculosis
QFVYAGAM

SEQ ID NO: 57386 - protein, 8 aa, Mycobacterium tuberculosis
FVYAGAMS

SEQ ID NO: 57387 - protein, 8 aa, Mycobacterium tuberculosis
VYAGAMSG

SEQ ID NO: 57388 - protein, 8 aa, Mycobacterium tuberculosis
YAGAMSGL

SEQ ID NO: 57389 - protein, 8 aa, Mycobacterium tuberculosis
AGAMSGLL

SEQ ID NO: 57390 - protein, 8 aa, Mycobacterium tuberculosis
GAMSGLLD

SEQ ID NO: 57391 - protein, 8 aa, Mycobacterium tuberculosis
AMSGLLDP

SEQ ID NO: 57392 - protein, 8 aa, Mycobacterium tuberculosis
MSGLLDPS

SEQ ID NO: 57393 - protein, 8 aa, Mycobacterium tuberculosis
SGLLDPSQ

SEQ ID NO: 57394 - protein, 8 aa, Mycobacterium tuberculosis
GLLDPSQA

SEQ ID NO: 57395 - protein, 8 aa, Mycobacterium tuberculosis
LLDPSQAM

SEQ ID NO: 57396 - protein, 8 aa, Mycobacterium tuberculosis
LDPSQAMG

SEQ ID NO: 57397 - protein, 8 aa, Mycobacterium tuberculosis
DPSQAMGP

SEQ ID NO: 57398 - protein, 8 aa, Mycobacterium tuberculosis
PSQAMGPT

SEQ ID NO: 57399 - protein, 8 aa, Mycobacterium tuberculosis
SQAMGPTL

SEQ ID NO: 57400 - protein, 8 aa, Mycobacterium tuberculosis
QAMGPTLI

SEQ ID NO: 57401 - protein, 8 aa, Mycobacterium tuberculosis
AMGPTLIG

SEQ ID NO: 57402 - protein, 8 aa, Mycobacterium tuberculosis
MGPTLIGL

SEQ ID NO: 57403 - protein, 8 aa, Mycobacterium tuberculosis
GPTLIGLA

SEQ ID NO: 57404 - protein, 8 aa, Mycobacterium tuberculosis
PTLIGLAM

SEQ ID NO: 57405 - protein, 8 aa, Mycobacterium tuberculosis
TLIGLAMG

SEQ ID NO: 57406 - protein, 8 aa, Mycobacterium tuberculosis
LIGLAMGD

SEQ ID NO: 57407 - protein, 8 aa, Mycobacterium tuberculosis
IGLAMGDA

SEQ ID NO: 57408 - protein, 8 aa, Mycobacterium tuberculosis
GLAMGDAG

SEQ ID NO: 57409 - protein, 8 aa, Mycobacterium tuberculosis
LAMGDAGG

SEQ ID NO: 57410 - protein, 8 aa, Mycobacterium tuberculosis
AMGDAGGY

SEQ ID NO: 57411 - protein, 8 aa, Mycobacterium tuberculosis
MGDAGGYK

SEQ ID NO: 57412 - protein, 8 aa, Mycobacterium tuberculosis
GDAGGYKA

SEQ ID NO: 57413 - protein, 8 aa, Mycobacterium tuberculosis
DAGGYKAS

SEQ ID NO: 57414 - protein, 8 aa, Mycobacterium tuberculosis
AGGYKASD

SEQ ID NO: 57415 - protein, 8 aa, Mycobacterium tuberculosis
GGYKASDM

SEQ ID NO: 57416 - protein, 8 aa, Mycobacterium tuberculosis
GYKASDMW

SEQ ID NO: 57417 - protein, 8 aa, Mycobacterium tuberculosis
YKASDMWG

SEQ ID NO: 57418 - protein, 8 aa, Mycobacterium tuberculosis
KASDMWGP

SEQ ID NO: 57419 - protein, 8 aa, Mycobacterium tuberculosis
ASDMWGPK

SEQ ID NO: 57420 - protein, 8 aa, Mycobacterium tuberculosis
SDMWGPKE

SEQ ID NO: 57421 - protein, 8 aa, Mycobacterium tuberculosis
DMWGPKED

SEQ ID NO: 57422 - protein, 8 aa, Mycobacterium tuberculosis
MWGPKEDP

SEQ ID NO: 57423 - protein, 8 aa, Mycobacterium tuberculosis
WGPKEDPA

SEQ ID NO: 57424 - protein, 8 aa, Mycobacterium tuberculosis
GPKEDPAW

SEQ ID NO: 57425 - protein, 8 aa, Mycobacterium tuberculosis
PKEDPAWQ

SEQ ID NO: 57426 - protein, 8 aa, Mycobacterium tuberculosis
KEDPAWQR

SEQ ID NO: 57427 - protein, 8 aa, Mycobacterium tuberculosis
EDPAWQRN

SEQ ID NO: 57428 - protein, 8 aa, Mycobacterium tuberculosis
DPAWQRND

SEQ ID NO: 57429 - protein, 8 aa, Mycobacterium tuberculosis
PAWQRNDP

SEQ ID NO: 57430 - protein, 8 aa, Mycobacterium tuberculosis
AWQRNDPL

SEQ ID NO: 57431 - protein, 8 aa, Mycobacterium tuberculosis
WQRNDPLL

SEQ ID NO: 57432 - protein, 8 aa, Mycobacterium tuberculosis
QRNDPLLN

SEQ ID NO: 57433 - protein, 8 aa, Mycobacterium tuberculosis
RNDPLLNV

SEQ ID NO: 57434 - protein, 8 aa, Mycobacterium tuberculosis
NDPLLNVG

SEQ ID NO: 57435 - protein, 8 aa, Mycobacterium tuberculosis
DPLLNVGK

SEQ ID NO: 57436 - protein, 8 aa, Mycobacterium tuberculosis
PLLNVGKL

SEQ ID NO: 57437 - protein, 8 aa, Mycobacterium tuberculosis
LLNVGKLI

SEQ ID NO: 57438 - protein, 8 aa, Mycobacterium tuberculosis
LNVGKLIA

SEQ ID NO: 57439 - protein, 8 aa, Mycobacterium tuberculosis
NVGKLIAN

SEQ ID NO: 57440 - protein, 8 aa, Mycobacterium tuberculosis
VGKLIANN

SEQ ID NO: 57441 - protein, 8 aa, Mycobacterium tuberculosis
GKLIANNT

SEQ ID NO: 57442 - protein, 8 aa, Mycobacterium tuberculosis
KLIANNTR

SEQ ID NO: 57443 - protein, 8 aa, Mycobacterium tuberculosis
LIANNTRV

SEQ ID NO: 57444 - protein, 8 aa, Mycobacterium tuberculosis
IANNTRVW

SEQ ID NO: 57445 - protein, 8 aa, Mycobacterium tuberculosis
ANNTRVWV

SEQ ID NO: 57446 - protein, 8 aa, Mycobacterium tuberculosis
NNTRVWVY

SEQ ID NO: 57447 - protein, 8 aa, Mycobacterium tuberculosis
NTRVWVYC

SEQ ID NO: 57448 - protein, 8 aa, Mycobacterium tuberculosis
TRVWVYCG

SEQ ID NO: 57449 - protein, 8 aa, Mycobacterium tuberculosis
RVWVYCGN

SEQ ID NO: 57450 - protein, 8 aa, Mycobacterium tuberculosis
VWVYCGNG

SEQ ID NO: 57451 - protein, 8 aa, Mycobacterium tuberculosis
WVYCGNGK

SEQ ID NO: 57452 - protein, 8 aa, Mycobacterium tuberculosis
VYCGNGKP

SEQ ID NO: 57453 - protein, 8 aa, Mycobacterium tuberculosis
YCGNGKPS

SEQ ID NO: 57454 - protein, 8 aa, Mycobacterium tuberculosis
CGNGKPSD

SEQ ID NO: 57455 - protein, 8 aa, Mycobacterium tuberculosis
GNGKPSDL

SEQ ID NO: 57456 - protein, 8 aa, Mycobacterium tuberculosis
NGKPSDLG

SEQ ID NO: 57457 - protein, 8 aa, Mycobacterium tuberculosis
GKPSDLGG

SEQ ID NO: 57458 - protein, 8 aa, Mycobacterium tuberculosis
KPSDLGGN

SEQ ID NO: 57459 - protein, 8 aa, Mycobacterium tuberculosis
PSDLGGNN

SEQ ID NO: 57460 - protein, 8 aa, Mycobacterium tuberculosis
SDLGGNNL

SEQ ID NO: 57461 - protein, 8 aa, Mycobacterium tuberculosis
DLGGNNLP

SEQ ID NO: 57462 - protein, 8 aa, Mycobacterium tuberculosis
LGGNNLPA

SEQ ID NO: 57463 - protein, 8 aa, Mycobacterium tuberculosis
GGNNLPAK

SEQ ID NO: 57464 - protein, 8 aa, Mycobacterium tuberculosis
GNNLPAKF

SEQ ID NO: 57465 - protein, 8 aa, Mycobacterium tuberculosis
NNLPAKFL

SEQ ID NO: 57466 - protein, 8 aa, Mycobacterium tuberculosis
NLPAKFLE

SEQ ID NO: 57467 - protein, 8 aa, Mycobacterium tuberculosis
LPAKFLEG

SEQ ID NO: 57468 - protein, 8 aa, Mycobacterium tuberculosis
PAKFLEGF

SEQ ID NO: 57469 - protein, 8 aa, Mycobacterium tuberculosis
AKFLEGFV

SEQ ID NO: 57470 - protein, 8 aa, Mycobacterium tuberculosis
KFLEGFVR

SEQ ID NO: 57471 - protein, 8 aa, Mycobacterium tuberculosis
FLEGFVRT

SEQ ID NO: 57472 - protein, 8 aa, Mycobacterium tuberculosis
LEGFVRTS

SEQ ID NO: 57473 - protein, 8 aa, Mycobacterium tuberculosis
EGFVRTSN

SEQ ID NO: 57474 - protein, 8 aa, Mycobacterium tuberculosis
GFVRTSNI

SEQ ID NO: 57475 - protein, 8 aa, Mycobacterium tuberculosis
FVRTSNIK

SEQ ID NO: 57476 - protein, 8 aa, Mycobacterium tuberculosis
VRTSNIKF

SEQ ID NO: 57477 - protein, 8 aa, Mycobacterium tuberculosis
RTSNIKFQ

SEQ ID NO: 57478 - protein, 8 aa, Mycobacterium tuberculosis
TSNIKFQD

SEQ ID NO: 57479 - protein, 8 aa, Mycobacterium tuberculosis
SNIKFQDA

SEQ ID NO: 57480 - protein, 8 aa, Mycobacterium tuberculosis
NIKFQDAY

SEQ ID NO: 57481 - protein, 8 aa, Mycobacterium tuberculosis
IKFQDAYN

SEQ ID NO: 57482 - protein, 8 aa, Mycobacterium tuberculosis
KFQDAYNA

SEQ ID NO: 57483 - protein, 8 aa, Mycobacterium tuberculosis
FQDAYNAG

SEQ ID NO: 57484 - protein, 8 aa, Mycobacterium tuberculosis
QDAYNAGG

SEQ ID NO: 57485 - protein, 8 aa, Mycobacterium tuberculosis
DAYNAGGG

SEQ ID NO: 57486 - protein, 8 aa, Mycobacterium tuberculosis
AYNAGGGH

SEQ ID NO: 57487 - protein, 8 aa, Mycobacterium tuberculosis
YNAGGGHN

SEQ ID NO: 57488 - protein, 8 aa, Mycobacterium tuberculosis
NAGGGHNG

SEQ ID NO: 57489 - protein, 8 aa, Mycobacterium tuberculosis
AGGGHNGV

SEQ ID NO: 57490 - protein, 8 aa, Mycobacterium tuberculosis
GGGHNGVF

SEQ ID NO: 57491 - protein, 8 aa, Mycobacterium tuberculosis
GGHNGVFD

SEQ ID NO: 57492 - protein, 8 aa, Mycobacterium tuberculosis
GHNGVFDF

SEQ ID NO: 57493 - protein, 8 aa, Mycobacterium tuberculosis
HNGVFDFP

SEQ ID NO: 57494 - protein, 8 aa, Mycobacterium tuberculosis
NGVFDFPD

SEQ ID NO: 57495 - protein, 8 aa, Mycobacterium tuberculosis
GVFDFPDS

SEQ ID NO: 57496 - protein, 8 aa, Mycobacterium tuberculosis
VFDFPDSG

SEQ ID NO: 57497 - protein, 8 aa, Mycobacterium tuberculosis
FDFPDSGT

SEQ ID NO: 57498 - protein, 8 aa, Mycobacterium tuberculosis
DFPDSGTH

SEQ ID NO: 57499 - protein, 8 aa, Mycobacterium tuberculosis
FPDSGTHS

SEQ ID NO: 57500 - protein, 8 aa, Mycobacterium tuberculosis
PDSGTHSW

SEQ ID NO: 57501 - protein, 8 aa, Mycobacterium tuberculosis
DSGTHSWE

SEQ ID NO: 57502 - protein, 8 aa, Mycobacterium tuberculosis
SGTHSWEY

SEQ ID NO: 57503 - protein, 8 aa, Mycobacterium tuberculosis
GTHSWEYW

SEQ ID NO: 57504 - protein, 8 aa, Mycobacterium tuberculosis
THSWEYWG

SEQ ID NO: 57505 - protein, 8 aa, Mycobacterium tuberculosis
HSWEYWGA

SEQ ID NO: 57506 - protein, 8 aa, Mycobacterium tuberculosis
SWEYWGAQ

SEQ ID NO: 57507 - protein, 8 aa, Mycobacterium tuberculosis
WEYWGAQL

SEQ ID NO: 57508 - protein, 8 aa, Mycobacterium tuberculosis
EYWGAQLN

SEQ ID NO: 57509 - protein, 8 aa, Mycobacterium tuberculosis
YWGAQLNA

SEQ ID NO: 57510 - protein, 8 aa, Mycobacterium tuberculosis
WGAQLNAM

SEQ ID NO: 57511 - protein, 8 aa, Mycobacterium tuberculosis
GAQLNAMK

SEQ ID NO: 57512 - protein, 8 aa, Mycobacterium tuberculosis
AQLNAMKP

SEQ ID NO: 57513 - protein, 8 aa, Mycobacterium tuberculosis
QLNAMKPD

SEQ ID NO: 57514 - protein, 8 aa, Mycobacterium tuberculosis
LNAMKPDL

SEQ ID NO: 57515 - protein, 8 aa, Mycobacterium tuberculosis
NAMKPDLQ

SEQ ID NO: 57516 - protein, 8 aa, Mycobacterium tuberculosis
AMKPDLQR

SEQ ID NO: 57517 - protein, 8 aa, Mycobacterium tuberculosis
MKPDLQRA

SEQ ID NO: 57518 - protein, 8 aa, Mycobacterium tuberculosis
KPDLQRAL

SEQ ID NO: 57519 - protein, 8 aa, Mycobacterium tuberculosis
PDLQRALG

SEQ ID NO: 57520 - protein, 8 aa, Mycobacterium tuberculosis
DLQRALGA

SEQ ID NO: 57521 - protein, 8 aa, Mycobacterium tuberculosis
LQRALGAT

SEQ ID NO: 57522 - protein, 8 aa, Mycobacterium tuberculosis
QRALGATP

SEQ ID NO: 57523 - protein, 8 aa, Mycobacterium tuberculosis
RALGATPN

SEQ ID NO: 57524 - protein, 8 aa, Mycobacterium tuberculosis
ALGATPNT

SEQ ID NO: 57525 - protein, 8 aa, Mycobacterium tuberculosis
LGATPNTG

SEQ ID NO: 57526 - protein, 8 aa, Mycobacterium tuberculosis
GATPNTGP

SEQ ID NO: 57527 - protein, 8 aa, Mycobacterium tuberculosis
ATPNTGPA

SEQ ID NO: 57528 - protein, 8 aa, Mycobacterium tuberculosis
TPNTGPAP

SEQ ID NO: 57529 - protein, 8 aa, Mycobacterium tuberculosis
PNTGPAPQ

SEQ ID NO: 57530 - protein, 8 aa, Mycobacterium tuberculosis
NTGPAPQG

SEQ ID NO: 57531 - protein, 8 aa, Mycobacterium tuberculosis
TGPAPQGA

SEQ ID NO: 57532 - protein, 9 aa, Mycobacterium tuberculosis
MQLVDRVRG

SEQ ID NO: 57533 - protein, 9 aa, Mycobacterium tuberculosis
QLVDRVRGA

SEQ ID NO: 57534 - protein, 9 aa, Mycobacterium tuberculosis
LVDRVRGAV

SEQ ID NO: 57535 - protein, 9 aa, Mycobacterium tuberculosis
VDRVRGAVT

SEQ ID NO: 57536 - protein, 9 aa, Mycobacterium tuberculosis
DRVRGAVTG

SEQ ID NO: 57537 - protein, 9 aa, Mycobacterium tuberculosis
RVRGAVTGM

SEQ ID NO: 57538 - protein, 9 aa, Mycobacterium tuberculosis
VRGAVTGMS

SEQ ID NO: 57539 - protein, 9 aa, Mycobacterium tuberculosis
RGAVTGMSR

SEQ ID NO: 57540 - protein, 9 aa, Mycobacterium tuberculosis
GAVTGMSRR

SEQ ID NO: 57541 - protein, 9 aa, Mycobacterium tuberculosis
AVTGMSRRL

SEQ ID NO: 57542 - protein, 9 aa, Mycobacterium tuberculosis
VTGMSRRLV

SEQ ID NO: 57543 - protein, 9 aa, Mycobacterium tuberculosis
TGMSRRLVV

SEQ ID NO: 57544 - protein, 9 aa, Mycobacterium tuberculosis
GMSRRLVVG

SEQ ID NO: 57545 - protein, 9 aa, Mycobacterium tuberculosis
MSRRLVVGA

SEQ ID NO: 57546 - protein, 9 aa, Mycobacterium tuberculosis
SRRLVVGAV

SEQ ID NO: 57547 - protein, 9 aa, Mycobacterium tuberculosis
RRLVVGAVG

SEQ ID NO: 57548 - protein, 9 aa, Mycobacterium tuberculosis
RLVVGAVGA

SEQ ID NO: 57549 - protein, 9 aa, Mycobacterium tuberculosis
LVVGAVGAA

SEQ ID NO: 57550 - protein, 9 aa, Mycobacterium tuberculosis
VVGAVGAAL

SEQ ID NO: 57551 - protein, 9 aa, Mycobacterium tuberculosis
VGAVGAALV

SEQ ID NO: 57552 - protein, 9 aa, Mycobacterium tuberculosis
GAVGAALVS

SEQ ID NO: 57553 - protein, 9 aa, Mycobacterium tuberculosis
AVGAALVSG

SEQ ID NO: 57554 - protein, 9 aa, Mycobacterium tuberculosis
VGAALVSGL

SEQ ID NO: 57555 - protein, 9 aa, Mycobacterium tuberculosis
GAALVSGLV

SEQ ID NO: 57556 - protein, 9 aa, Mycobacterium tuberculosis
AALVSGLVG

SEQ ID NO: 57557 - protein, 9 aa, Mycobacterium tuberculosis
ALVSGLVGA

SEQ ID NO: 57558 - protein, 9 aa, Mycobacterium tuberculosis
LVSGLVGAV

SEQ ID NO: 57559 - protein, 9 aa, Mycobacterium tuberculosis
VSGLVGAVG

SEQ ID NO: 57560 - protein, 9 aa, Mycobacterium tuberculosis
SGLVGAVGG

SEQ ID NO: 57561 - protein, 9 aa, Mycobacterium tuberculosis
GLVGAVGGT

SEQ ID NO: 57562 - protein, 9 aa, Mycobacterium tuberculosis
LVGAVGGTA

SEQ ID NO: 57563 - protein, 9 aa, Mycobacterium tuberculosis
VGAVGGTAT

SEQ ID NO: 57564 - protein, 9 aa, Mycobacterium tuberculosis
GAVGGTATA

SEQ ID NO: 57565 - protein, 9 aa, Mycobacterium tuberculosis
AVGGTATAG

SEQ ID NO: 57566 - protein, 9 aa, Mycobacterium tuberculosis
VGGTATAGA

SEQ ID NO: 57567 - protein, 9 aa, Mycobacterium tuberculosis
GGTATAGAF

SEQ ID NO: 57568 - protein, 9 aa, Mycobacterium tuberculosis
GTATAGAFS

SEQ ID NO: 57569 - protein, 9 aa, Mycobacterium tuberculosis
TATAGAFSR

SEQ ID NO: 57570 - protein, 9 aa, Mycobacterium tuberculosis
ATAGAFSRP

SEQ ID NO: 57571 - protein, 9 aa, Mycobacterium tuberculosis
TAGAFSRPG

SEQ ID NO: 57572 - protein, 9 aa, Mycobacterium tuberculosis
AGAFSRPGL

SEQ ID NO: 57573 - protein, 9 aa, Mycobacterium tuberculosis
GAFSRPGLP

SEQ ID NO: 57574 - protein, 9 aa, Mycobacterium tuberculosis
AFSRPGLPV

SEQ ID NO: 57575 - protein, 9 aa, Mycobacterium tuberculosis
FSRPGLPVE

SEQ ID NO: 57576 - protein, 9 aa, Mycobacterium tuberculosis
SRPGLPVEY

SEQ ID NO: 57577 - protein, 9 aa, Mycobacterium tuberculosis
RPGLPVEYL

SEQ ID NO: 57578 - protein, 9 aa, Mycobacterium tuberculosis
PGLPVEYLQ

SEQ ID NO: 57579 - protein, 9 aa, Mycobacterium tuberculosis
GLPVEYLQV

SEQ ID NO: 57580 - protein, 9 aa, Mycobacterium tuberculosis
LPVEYLQVP

SEQ ID NO: 57581 - protein, 9 aa, Mycobacterium tuberculosis
PVEYLQVPS

SEQ ID NO: 57582 - protein, 9 aa, Mycobacterium tuberculosis
VEYLQVPSP

SEQ ID NO: 57583 - protein, 9 aa, Mycobacterium tuberculosis
EYLQVPSPS

SEQ ID NO: 57584 - protein, 9 aa, Mycobacterium tuberculosis
YLQVPSPSM

SEQ ID NO: 57585 - protein, 9 aa, Mycobacterium tuberculosis
LQVPSPSMG

SEQ ID NO: 57586 - protein, 9 aa, Mycobacterium tuberculosis
QVPSPSMGR

SEQ ID NO: 57587 - protein, 9 aa, Mycobacterium tuberculosis
VPSPSMGRD

SEQ ID NO: 57588 - protein, 9 aa, Mycobacterium tuberculosis
PSPSMGRDI

SEQ ID NO: 57589 - protein, 9 aa, Mycobacterium tuberculosis
SPSMGRDIK

SEQ ID NO: 57590 - protein, 9 aa, Mycobacterium tuberculosis
PSMGRDIKV

SEQ ID NO: 57591 - protein, 9 aa, Mycobacterium tuberculosis
SMGRDIKVQ

SEQ ID NO: 57592 - protein, 9 aa, Mycobacterium tuberculosis
MGRDIKVQF

SEQ ID NO: 57593 - protein, 9 aa, Mycobacterium tuberculosis
GRDIKVQFQ

SEQ ID NO: 57594 - protein, 9 aa, Mycobacterium tuberculosis
RDIKVQFQS

SEQ ID NO: 57595 - protein, 9 aa, Mycobacterium tuberculosis
DIKVQFQSG

SEQ ID NO: 57596 - protein, 9 aa, Mycobacterium tuberculosis
IKVQFQSGG

SEQ ID NO: 57597 - protein, 9 aa, Mycobacterium tuberculosis
KVQFQSGGA

SEQ ID NO: 57598 - protein, 9 aa, Mycobacterium tuberculosis
VQFQSGGAN

SEQ ID NO: 57599 - protein, 9 aa, Mycobacterium tuberculosis
QFQSGGANS

SEQ ID NO: 57600 - protein, 9 aa, Mycobacterium tuberculosis
FQSGGANSP

SEQ ID NO: 57601 - protein, 9 aa, Mycobacterium tuberculosis
QSGGANSPA

SEQ ID NO: 57602 - protein, 9 aa, Mycobacterium tuberculosis
SGGANSPAL

SEQ ID NO: 57603 - protein, 9 aa, Mycobacterium tuberculosis
GGANSPALY

SEQ ID NO: 57604 - protein, 9 aa, Mycobacterium tuberculosis
GANSPALYL

SEQ ID NO: 57605 - protein, 9 aa, Mycobacterium tuberculosis
ANSPALYLL

SEQ ID NO: 57606 - protein, 9 aa, Mycobacterium tuberculosis
NSPALYLLD

SEQ ID NO: 57607 - protein, 9 aa, Mycobacterium tuberculosis
SPALYLLDG

SEQ ID NO: 57608 - protein, 9 aa, Mycobacterium tuberculosis
PALYLLDGL

SEQ ID NO: 57609 - protein, 9 aa, Mycobacterium tuberculosis
ALYLLDGLR

SEQ ID NO: 57610 - protein, 9 aa, Mycobacterium tuberculosis
LYLLDGLRA

SEQ ID NO: 57611 - protein, 9 aa, Mycobacterium tuberculosis
YLLDGLRAQ

SEQ ID NO: 57612 - protein, 9 aa, Mycobacterium tuberculosis
LLDGLRAQD

SEQ ID NO: 57613 - protein, 9 aa, Mycobacterium tuberculosis
LDGLRAQDD

SEQ ID NO: 57614 - protein, 9 aa, Mycobacterium tuberculosis
DGLRAQDDF

SEQ ID NO: 57615 - protein, 9 aa, Mycobacterium tuberculosis
GLRAQDDFS

SEQ ID NO: 57616 - protein, 9 aa, Mycobacterium tuberculosis
LRAQDDFSG

SEQ ID NO: 57617 - protein, 9 aa, Mycobacterium tuberculosis
RAQDDFSGW

SEQ ID NO: 57618 - protein, 9 aa, Mycobacterium tuberculosis
AQDDFSGWD

SEQ ID NO: 57619 - protein, 9 aa, Mycobacterium tuberculosis
QDDFSGWDI

SEQ ID NO: 57620 - protein, 9 aa, Mycobacterium tuberculosis
DDFSGWDIN

SEQ ID NO: 57621 - protein, 9 aa, Mycobacterium tuberculosis
DFSGWDINT

SEQ ID NO: 57622 - protein, 9 aa, Mycobacterium tuberculosis
FSGWDINTP

SEQ ID NO: 57623 - protein, 9 aa, Mycobacterium tuberculosis
SGWDINTPA

SEQ ID NO: 57624 - protein, 9 aa, Mycobacterium tuberculosis
GWDINTPAF

SEQ ID NO: 57625 - protein, 9 aa, Mycobacterium tuberculosis
WDINTPAFE

SEQ ID NO: 57626 - protein, 9 aa, Mycobacterium tuberculosis
DINTPAFEW

SEQ ID NO: 57627 - protein, 9 aa, Mycobacterium tuberculosis
INTPAFEWY

SEQ ID NO: 57628 - protein, 9 aa, Mycobacterium tuberculosis
NTPAFEWYD

SEQ ID NO: 57629 - protein, 9 aa, Mycobacterium tuberculosis
TPAFEWYDQ

SEQ ID NO: 57630 - protein, 9 aa, Mycobacterium tuberculosis
PAFEWYDQS

SEQ ID NO: 57631 - protein, 9 aa, Mycobacterium tuberculosis
AFEWYDQSG

SEQ ID NO: 57632 - protein, 9 aa, Mycobacterium tuberculosis
FEWYDQSGL

SEQ ID NO: 57633 - protein, 9 aa, Mycobacterium tuberculosis
EWYDQSGLS

SEQ ID NO: 57634 - protein, 9 aa, Mycobacterium tuberculosis
WYDQSGLSV

SEQ ID NO: 57635 - protein, 9 aa, Mycobacterium tuberculosis
YDQSGLSVV

SEQ ID NO: 57636 - protein, 9 aa, Mycobacterium tuberculosis
DQSGLSVVM

SEQ ID NO: 57637 - protein, 9 aa, Mycobacterium tuberculosis
QSGLSVVMP

SEQ ID NO: 57638 - protein, 9 aa, Mycobacterium tuberculosis
SGLSVVMPV

SEQ ID NO: 57639 - protein, 9 aa, Mycobacterium tuberculosis
GLSVVMPVG

SEQ ID NO: 57640 - protein, 9 aa, Mycobacterium tuberculosis
LSVVMPVGG

SEQ ID NO: 57641 - protein, 9 aa, Mycobacterium tuberculosis
SVVMPVGGQ

SEQ ID NO: 57642 - protein, 9 aa, Mycobacterium tuberculosis
VVMPVGGQS

SEQ ID NO: 57643 - protein, 9 aa, Mycobacterium tuberculosis
VMPVGGQSS

SEQ ID NO: 57644 - protein, 9 aa, Mycobacterium tuberculosis
MPVGGQSSF

SEQ ID NO: 57645 - protein, 9 aa, Mycobacterium tuberculosis
PVGGQSSFY

SEQ ID NO: 57646 - protein, 9 aa, Mycobacterium tuberculosis
VGGQSSFYS

SEQ ID NO: 57647 - protein, 9 aa, Mycobacterium tuberculosis
GGQSSFYSD

SEQ ID NO: 57648 - protein, 9 aa, Mycobacterium tuberculosis
GQSSFYSDW

SEQ ID NO: 57649 - protein, 9 aa, Mycobacterium tuberculosis
QSSFYSDWY

SEQ ID NO: 57650 - protein, 9 aa, Mycobacterium tuberculosis
SSFYSDWYQ

SEQ ID NO: 57651 - protein, 9 aa, Mycobacterium tuberculosis
SFYSDWYQP

SEQ ID NO: 57652 - protein, 9 aa, Mycobacterium tuberculosis
FYSDWYQPA

SEQ ID NO: 57653 - protein, 9 aa, Mycobacterium tuberculosis
YSDWYQPAC

SEQ ID NO: 57654 - protein, 9 aa, Mycobacterium tuberculosis
SDWYQPACG

SEQ ID NO: 57655 - protein, 9 aa, Mycobacterium tuberculosis
DWYQPACGK

SEQ ID NO: 57656 - protein, 9 aa, Mycobacterium tuberculosis
WYQPACGKA

SEQ ID NO: 57657 - protein, 9 aa, Mycobacterium tuberculosis
YQPACGKAG

SEQ ID NO: 57658 - protein, 9 aa, Mycobacterium tuberculosis
QPACGKAGC

SEQ ID NO: 57659 - protein, 9 aa, Mycobacterium tuberculosis
PACGKAGCQ

SEQ ID NO: 57660 - protein, 9 aa, Mycobacterium tuberculosis
ACGKAGCQT

SEQ ID NO: 57661 - protein, 9 aa, Mycobacterium tuberculosis
CGKAGCQTY

SEQ ID NO: 57662 - protein, 9 aa, Mycobacterium tuberculosis
GKAGCQTYK

SEQ ID NO: 57663 - protein, 9 aa, Mycobacterium tuberculosis
KAGCQTYKW

SEQ ID NO: 57664 - protein, 9 aa, Mycobacterium tuberculosis
AGCQTYKWE

SEQ ID NO: 57665 - protein, 9 aa, Mycobacterium tuberculosis
GCQTYKWET

SEQ ID NO: 57666 - protein, 9 aa, Mycobacterium tuberculosis
CQTYKWETF

SEQ ID NO: 57667 - protein, 9 aa, Mycobacterium tuberculosis
QTYKWETFL

SEQ ID NO: 57668 - protein, 9 aa, Mycobacterium tuberculosis
TYKWETFLT

SEQ ID NO: 57669 - protein, 9 aa, Mycobacterium tuberculosis
YKWETFLTS

SEQ ID NO: 57670 - protein, 9 aa, Mycobacterium tuberculosis
KWETFLTSE

SEQ ID NO: 57671 - protein, 9 aa, Mycobacterium tuberculosis
WETFLTSEL

SEQ ID NO: 57672 - protein, 9 aa, Mycobacterium tuberculosis
ETFLTSELP

SEQ ID NO: 57673 - protein, 9 aa, Mycobacterium tuberculosis
TFLTSELPG

SEQ ID NO: 57674 - protein, 9 aa, Mycobacterium tuberculosis
FLTSELPGW

SEQ ID NO: 57675 - protein, 9 aa, Mycobacterium tuberculosis
LTSELPGWL

SEQ ID NO: 57676 - protein, 9 aa, Mycobacterium tuberculosis
TSELPGWLQ

SEQ ID NO: 57677 - protein, 9 aa, Mycobacterium tuberculosis
SELPGWLQA

SEQ ID NO: 57678 - protein, 9 aa, Mycobacterium tuberculosis
ELPGWLQAN

SEQ ID NO: 57679 - protein, 9 aa, Mycobacterium tuberculosis
LPGWLQANR

SEQ ID NO: 57680 - protein, 9 aa, Mycobacterium tuberculosis
PGWLQANRH

SEQ ID NO: 57681 - protein, 9 aa, Mycobacterium tuberculosis
GWLQANRHV

SEQ ID NO: 57682 - protein, 9 aa, Mycobacterium tuberculosis
WLQANRHVK

SEQ ID NO: 57683 - protein, 9 aa, Mycobacterium tuberculosis
LQANRHVKP

SEQ ID NO: 57684 - protein, 9 aa, Mycobacterium tuberculosis
QANRHVKPT

SEQ ID NO: 57685 - protein, 9 aa, Mycobacterium tuberculosis
ANRHVKPTG

SEQ ID NO: 57686 - protein, 9 aa, Mycobacterium tuberculosis
NRHVKPTGS

SEQ ID NO: 57687 - protein, 9 aa, Mycobacterium tuberculosis
RHVKPTGSA

SEQ ID NO: 57688 - protein, 9 aa, Mycobacterium tuberculosis
HVKPTGSAV

SEQ ID NO: 57689 - protein, 9 aa, Mycobacterium tuberculosis
VKPTGSAVV

SEQ ID NO: 57690 - protein, 9 aa, Mycobacterium tuberculosis
KPTGSAVVG

SEQ ID NO: 57691 - protein, 9 aa, Mycobacterium tuberculosis
PTGSAVVGL

SEQ ID NO: 57692 - protein, 9 aa, Mycobacterium tuberculosis
TGSAVVGLS

SEQ ID NO: 57693 - protein, 9 aa, Mycobacterium tuberculosis
GSAVVGLSM

SEQ ID NO: 57694 - protein, 9 aa, Mycobacterium tuberculosis
SAVVGLSMA

SEQ ID NO: 57695 - protein, 9 aa, Mycobacterium tuberculosis
AVVGLSMAA

SEQ ID NO: 57696 - protein, 9 aa, Mycobacterium tuberculosis
VVGLSMAAS

SEQ ID NO: 57697 - protein, 9 aa, Mycobacterium tuberculosis
VGLSMAASS

SEQ ID NO: 57698 - protein, 9 aa, Mycobacterium tuberculosis
GLSMAASSA

SEQ ID NO: 57699 - protein, 9 aa, Mycobacterium tuberculosis
LSMAASSAL

SEQ ID NO: 57700 - protein, 9 aa, Mycobacterium tuberculosis
SMAASSALT

SEQ ID NO: 57701 - protein, 9 aa, Mycobacterium tuberculosis
MAASSALTL

SEQ ID NO: 57702 - protein, 9 aa, Mycobacterium tuberculosis
AASSALTLA

SEQ ID NO: 57703 - protein, 9 aa, Mycobacterium tuberculosis
ASSALTLAI

SEQ ID NO: 57704 - protein, 9 aa, Mycobacterium tuberculosis
SSALTLAIY

SEQ ID NO: 57705 - protein, 9 aa, Mycobacterium tuberculosis
SALTLAIYH

SEQ ID NO: 57706 - protein, 9 aa, Mycobacterium tuberculosis
ALTLAIYHP

SEQ ID NO: 57707 - protein, 9 aa, Mycobacterium tuberculosis
LTLAIYHPQ

SEQ ID NO: 57708 - protein, 9 aa, Mycobacterium tuberculosis
TLAIYHPQQ

SEQ ID NO: 57709 - protein, 9 aa, Mycobacterium tuberculosis
LAIYHPQQF

SEQ ID NO: 57710 - protein, 9 aa, Mycobacterium tuberculosis
AIYHPQQFV

SEQ ID NO: 57711 - protein, 9 aa, Mycobacterium tuberculosis
IYHPQQFVY

SEQ ID NO: 57712 - protein, 9 aa, Mycobacterium tuberculosis
YHPQQFVYA

SEQ ID NO: 57713 - protein, 9 aa, Mycobacterium tuberculosis
HPQQFVYAG

SEQ ID NO: 57714 - protein, 9 aa, Mycobacterium tuberculosis
PQQFVYAGA

SEQ ID NO: 57715 - protein, 9 aa, Mycobacterium tuberculosis
QQFVYAGAM

SEQ ID NO: 57716 - protein, 9 aa, Mycobacterium tuberculosis
QFVYAGAMS

SEQ ID NO: 57717 - protein, 9 aa, Mycobacterium tuberculosis
FVYAGAMSG

SEQ ID NO: 57718 - protein, 9 aa, Mycobacterium tuberculosis
VYAGAMSGL

SEQ ID NO: 57719 - protein, 9 aa, Mycobacterium tuberculosis
YAGAMSGLL

SEQ ID NO: 57720 - protein, 9 aa, Mycobacterium tuberculosis
AGAMSGLLD

SEQ ID NO: 57721 - protein, 9 aa, Mycobacterium tuberculosis
GAMSGLLDP

SEQ ID NO: 57722 - protein, 9 aa, Mycobacterium tuberculosis
AMSGLLDPS

SEQ ID NO: 57723 - protein, 9 aa, Mycobacterium tuberculosis
MSGLLDPSQ

SEQ ID NO: 57724 - protein, 9 aa, Mycobacterium tuberculosis
SGLLDPSQA

SEQ ID NO: 57725 - protein, 9 aa, Mycobacterium tuberculosis
GLLDPSQAM

SEQ ID NO: 57726 - protein, 9 aa, Mycobacterium tuberculosis
LLDPSQAMG

SEQ ID NO: 57727 - protein, 9 aa, Mycobacterium tuberculosis
LDPSQAMGP

SEQ ID NO: 57728 - protein, 9 aa, Mycobacterium tuberculosis
DPSQAMGPT

SEQ ID NO: 57729 - protein, 9 aa, Mycobacterium tuberculosis
PSQAMGPTL

SEQ ID NO: 57730 - protein, 9 aa, Mycobacterium tuberculosis
SQAMGPTLI

SEQ ID NO: 57731 - protein, 9 aa, Mycobacterium tuberculosis
QAMGPTLIG

SEQ ID NO: 57732 - protein, 9 aa, Mycobacterium tuberculosis
AMGPTLIGL

SEQ ID NO: 57733 - protein, 9 aa, Mycobacterium tuberculosis
MGPTLIGLA

SEQ ID NO: 57734 - protein, 9 aa, Mycobacterium tuberculosis
GPTLIGLAM

SEQ ID NO: 57735 - protein, 9 aa, Mycobacterium tuberculosis
PTLIGLAMG

SEQ ID NO: 57736 - protein, 9 aa, Mycobacterium tuberculosis
TLIGLAMGD

SEQ ID NO: 57737 - protein, 9 aa, Mycobacterium tuberculosis
LIGLAMGDA

SEQ ID NO: 57738 - protein, 9 aa, Mycobacterium tuberculosis
IGLAMGDAG

SEQ ID NO: 57739 - protein, 9 aa, Mycobacterium tuberculosis
GLAMGDAGG

SEQ ID NO: 57740 - protein, 9 aa, Mycobacterium tuberculosis
LAMGDAGGY

SEQ ID NO: 57741 - protein, 9 aa, Mycobacterium tuberculosis
AMGDAGGYK

SEQ ID NO: 57742 - protein, 9 aa, Mycobacterium tuberculosis
MGDAGGYKA

SEQ ID NO: 57743 - protein, 9 aa, Mycobacterium tuberculosis
GDAGGYKAS

SEQ ID NO: 57744 - protein, 9 aa, Mycobacterium tuberculosis
DAGGYKASD

SEQ ID NO: 57745 - protein, 9 aa, Mycobacterium tuberculosis
AGGYKASDM

SEQ ID NO: 57746 - protein, 9 aa, Mycobacterium tuberculosis
GGYKASDMW

SEQ ID NO: 57747 - protein, 9 aa, Mycobacterium tuberculosis
GYKASDMWG

SEQ ID NO: 57748 - protein, 9 aa, Mycobacterium tuberculosis
YKASDMWGP

SEQ ID NO: 57749 - protein, 9 aa, Mycobacterium tuberculosis
KASDMWGPK

SEQ ID NO: 57750 - protein, 9 aa, Mycobacterium tuberculosis
ASDMWGPKE

SEQ ID NO: 57751 - protein, 9 aa, Mycobacterium tuberculosis
SDMWGPKED

SEQ ID NO: 57752 - protein, 9 aa, Mycobacterium tuberculosis
DMWGPKEDP

SEQ ID NO: 57753 - protein, 9 aa, Mycobacterium tuberculosis
MWGPKEDPA

SEQ ID NO: 57754 - protein, 9 aa, Mycobacterium tuberculosis
WGPKEDPAW

SEQ ID NO: 57755 - protein, 9 aa, Mycobacterium tuberculosis
GPKEDPAWQ

SEQ ID NO: 57756 - protein, 9 aa, Mycobacterium tuberculosis
PKEDPAWQR

SEQ ID NO: 57757 - protein, 9 aa, Mycobacterium tuberculosis
KEDPAWQRN

SEQ ID NO: 57758 - protein, 9 aa, Mycobacterium tuberculosis
EDPAWQRND

SEQ ID NO: 57759 - protein, 9 aa, Mycobacterium tuberculosis
DPAWQRNDP

SEQ ID NO: 57760 - protein, 9 aa, Mycobacterium tuberculosis
PAWQRNDPL

SEQ ID NO: 57761 - protein, 9 aa, Mycobacterium tuberculosis
AWQRNDPLL

SEQ ID NO: 57762 - protein, 9 aa, Mycobacterium tuberculosis
WQRNDPLLN

SEQ ID NO: 57763 - protein, 9 aa, Mycobacterium tuberculosis
QRNDPLLNV

SEQ ID NO: 57764 - protein, 9 aa, Mycobacterium tuberculosis
RNDPLLNVG

SEQ ID NO: 57765 - protein, 9 aa, Mycobacterium tuberculosis
NDPLLNVGK

SEQ ID NO: 57766 - protein, 9 aa, Mycobacterium tuberculosis
DPLLNVGKL

SEQ ID NO: 57767 - protein, 9 aa, Mycobacterium tuberculosis
PLLNVGKLI

SEQ ID NO: 57768 - protein, 9 aa, Mycobacterium tuberculosis
LLNVGKLIA

SEQ ID NO: 57769 - protein, 9 aa, Mycobacterium tuberculosis
LNVGKLIAN

SEQ ID NO: 57770 - protein, 9 aa, Mycobacterium tuberculosis
NVGKLIANN

SEQ ID NO: 57771 - protein, 9 aa, Mycobacterium tuberculosis
VGKLIANNT

SEQ ID NO: 57772 - protein, 9 aa, Mycobacterium tuberculosis
GKLIANNTR

SEQ ID NO: 57773 - protein, 9 aa, Mycobacterium tuberculosis
KLIANNTRV

SEQ ID NO: 57774 - protein, 9 aa, Mycobacterium tuberculosis
LIANNTRVW

SEQ ID NO: 57775 - protein, 9 aa, Mycobacterium tuberculosis
IANNTRVWV

SEQ ID NO: 57776 - protein, 9 aa, Mycobacterium tuberculosis
ANNTRVWVY

SEQ ID NO: 57777 - protein, 9 aa, Mycobacterium tuberculosis
NNTRVWVYC

SEQ ID NO: 57778 - protein, 9 aa, Mycobacterium tuberculosis
NTRVWVYCG

SEQ ID NO: 57779 - protein, 9 aa, Mycobacterium tuberculosis
TRVWVYCGN

SEQ ID NO: 57780 - protein, 9 aa, Mycobacterium tuberculosis
RVWVYCGNG

SEQ ID NO: 57781 - protein, 9 aa, Mycobacterium tuberculosis
VWVYCGNGK

SEQ ID NO: 57782 - protein, 9 aa, Mycobacterium tuberculosis
WVYCGNGKP

SEQ ID NO: 57783 - protein, 9 aa, Mycobacterium tuberculosis
VYCGNGKPS

SEQ ID NO: 57784 - protein, 9 aa, Mycobacterium tuberculosis
YCGNGKPSD

SEQ ID NO: 57785 - protein, 9 aa, Mycobacterium tuberculosis
CGNGKPSDL

SEQ ID NO: 57786 - protein, 9 aa, Mycobacterium tuberculosis
GNGKPSDLG

SEQ ID NO: 57787 - protein, 9 aa, Mycobacterium tuberculosis
NGKPSDLGG

SEQ ID NO: 57788 - protein, 9 aa, Mycobacterium tuberculosis
GKPSDLGGN

SEQ ID NO: 57789 - protein, 9 aa, Mycobacterium tuberculosis
KPSDLGGNN

SEQ ID NO: 57790 - protein, 9 aa, Mycobacterium tuberculosis
PSDLGGNNL

SEQ ID NO: 57791 - protein, 9 aa, Mycobacterium tuberculosis
SDLGGNNLP

SEQ ID NO: 57792 - protein, 9 aa, Mycobacterium tuberculosis
DLGGNNLPA

SEQ ID NO: 57793 - protein, 9 aa, Mycobacterium tuberculosis
LGGNNLPAK

SEQ ID NO: 57794 - protein, 9 aa, Mycobacterium tuberculosis
GGNNLPAKF

SEQ ID NO: 57795 - protein, 9 aa, Mycobacterium tuberculosis
GNNLPAKFL

SEQ ID NO: 57796 - protein, 9 aa, Mycobacterium tuberculosis
NNLPAKFLE

SEQ ID NO: 57797 - protein, 9 aa, Mycobacterium tuberculosis
NLPAKFLEG

SEQ ID NO: 57798 - protein, 9 aa, Mycobacterium tuberculosis
LPAKFLEGF

SEQ ID NO: 57799 - protein, 9 aa, Mycobacterium tuberculosis
PAKFLEGFV

SEQ ID NO: 57800 - protein, 9 aa, Mycobacterium tuberculosis
AKFLEGFVR

SEQ ID NO: 57801 - protein, 9 aa, Mycobacterium tuberculosis
KFLEGFVRT

SEQ ID NO: 57802 - protein, 9 aa, Mycobacterium tuberculosis
FLEGFVRTS

SEQ ID NO: 57803 - protein, 9 aa, Mycobacterium tuberculosis
LEGFVRTSN

SEQ ID NO: 57804 - protein, 9 aa, Mycobacterium tuberculosis
EGFVRTSNI

SEQ ID NO: 57805 - protein, 9 aa, Mycobacterium tuberculosis
GFVRTSNIK

SEQ ID NO: 57806 - protein, 9 aa, Mycobacterium tuberculosis
FVRTSNIKF

SEQ ID NO: 57807 - protein, 9 aa, Mycobacterium tuberculosis
VRTSNIKFQ

SEQ ID NO: 57808 - protein, 9 aa, Mycobacterium tuberculosis
RTSNIKFQD

SEQ ID NO: 57809 - protein, 9 aa, Mycobacterium tuberculosis
TSNIKFQDA

SEQ ID NO: 57810 - protein, 9 aa, Mycobacterium tuberculosis
SNIKFQDAY

SEQ ID NO: 57811 - protein, 9 aa, Mycobacterium tuberculosis
NIKFQDAYN

SEQ ID NO: 57812 - protein, 9 aa, Mycobacterium tuberculosis
IKFQDAYNA

SEQ ID NO: 57813 - protein, 9 aa, Mycobacterium tuberculosis
KFQDAYNAG

SEQ ID NO: 57814 - protein, 9 aa, Mycobacterium tuberculosis
FQDAYNAGG

SEQ ID NO: 57815 - protein, 9 aa, Mycobacterium tuberculosis
QDAYNAGGG

SEQ ID NO: 57816 - protein, 9 aa, Mycobacterium tuberculosis
DAYNAGGGH

SEQ ID NO: 57817 - protein, 9 aa, Mycobacterium tuberculosis
AYNAGGGHN

SEQ ID NO: 57818 - protein, 9 aa, Mycobacterium tuberculosis
YNAGGGHNG

SEQ ID NO: 57819 - protein, 9 aa, Mycobacterium tuberculosis
NAGGGHNGV

SEQ ID NO: 57820 - protein, 9 aa, Mycobacterium tuberculosis
AGGGHNGVF

SEQ ID NO: 57821 - protein, 9 aa, Mycobacterium tuberculosis
GGGHNGVFD

SEQ ID NO: 57822 - protein, 9 aa, Mycobacterium tuberculosis
GGHNGVFDF

SEQ ID NO: 57823 - protein, 9 aa, Mycobacterium tuberculosis
GHNGVFDFP

SEQ ID NO: 57824 - protein, 9 aa, Mycobacterium tuberculosis
HNGVFDFPD

SEQ ID NO: 57825 - protein, 9 aa, Mycobacterium tuberculosis
NGVFDFPDS

SEQ ID NO: 57826 - protein, 9 aa, Mycobacterium tuberculosis
GVFDFPDSG

SEQ ID NO: 57827 - protein, 9 aa, Mycobacterium tuberculosis
VFDFPDSGT

SEQ ID NO: 57828 - protein, 9 aa, Mycobacterium tuberculosis
FDFPDSGTH

SEQ ID NO: 57829 - protein, 9 aa, Mycobacterium tuberculosis
DFPDSGTHS

SEQ ID NO: 57830 - protein, 9 aa, Mycobacterium tuberculosis
FPDSGTHSW

SEQ ID NO: 57831 - protein, 9 aa, Mycobacterium tuberculosis
PDSGTHSWE

SEQ ID NO: 57832 - protein, 9 aa, Mycobacterium tuberculosis
DSGTHSWEY

SEQ ID NO: 57833 - protein, 9 aa, Mycobacterium tuberculosis
SGTHSWEYW

SEQ ID NO: 57834 - protein, 9 aa, Mycobacterium tuberculosis
GTHSWEYWG

SEQ ID NO: 57835 - protein, 9 aa, Mycobacterium tuberculosis
THSWEYWGA

SEQ ID NO: 57836 - protein, 9 aa, Mycobacterium tuberculosis
HSWEYWGAQ

SEQ ID NO: 57837 - protein, 9 aa, Mycobacterium tuberculosis
SWEYWGAQL

SEQ ID NO: 57838 - protein, 9 aa, Mycobacterium tuberculosis
WEYWGAQLN

SEQ ID NO: 57839 - protein, 9 aa, Mycobacterium tuberculosis
EYWGAQLNA

SEQ ID NO: 57840 - protein, 9 aa, Mycobacterium tuberculosis
YWGAQLNAM

SEQ ID NO: 57841 - protein, 9 aa, Mycobacterium tuberculosis
WGAQLNAMK

SEQ ID NO: 57842 - protein, 9 aa, Mycobacterium tuberculosis
GAQLNAMKP

SEQ ID NO: 57843 - protein, 9 aa, Mycobacterium tuberculosis
AQLNAMKPD

SEQ ID NO: 57844 - protein, 9 aa, Mycobacterium tuberculosis
QLNAMKPDL

SEQ ID NO: 57845 - protein, 9 aa, Mycobacterium tuberculosis
LNAMKPDLQ

SEQ ID NO: 57846 - protein, 9 aa, Mycobacterium tuberculosis
NAMKPDLQR

SEQ ID NO: 57847 - protein, 9 aa, Mycobacterium tuberculosis
AMKPDLQRA

SEQ ID NO: 57848 - protein, 9 aa, Mycobacterium tuberculosis
MKPDLQRAL

SEQ ID NO: 57849 - protein, 9 aa, Mycobacterium tuberculosis
KPDLQRALG

SEQ ID NO: 57850 - protein, 9 aa, Mycobacterium tuberculosis
PDLQRALGA

SEQ ID NO: 57851 - protein, 9 aa, Mycobacterium tuberculosis
DLQRALGAT

SEQ ID NO: 57852 - protein, 9 aa, Mycobacterium tuberculosis
LQRALGATP

SEQ ID NO: 57853 - protein, 9 aa, Mycobacterium tuberculosis
QRALGATPN

SEQ ID NO: 57854 - protein, 9 aa, Mycobacterium tuberculosis
RALGATPNT

SEQ ID NO: 57855 - protein, 9 aa, Mycobacterium tuberculosis
ALGATPNTG

SEQ ID NO: 57856 - protein, 9 aa, Mycobacterium tuberculosis
LGATPNTGP

SEQ ID NO: 57857 - protein, 9 aa, Mycobacterium tuberculosis
GATPNTGPA

SEQ ID NO: 57858 - protein, 9 aa, Mycobacterium tuberculosis
ATPNTGPAP

SEQ ID NO: 57859 - protein, 9 aa, Mycobacterium tuberculosis
TPNTGPAPQ

SEQ ID NO: 57860 - protein, 9 aa, Mycobacterium tuberculosis
PNTGPAPQG

SEQ ID NO: 57861 - protein, 9 aa, Mycobacterium tuberculosis
NTGPAPQGA

SEQ ID NO: 57862 - protein, 10 aa, Mycobacterium tuberculosis
MQLVDRVRGA

SEQ ID NO: 57863 - protein, 10 aa, Mycobacterium tuberculosis
QLVDRVRGAV

SEQ ID NO: 57864 - protein, 10 aa, Mycobacterium tuberculosis
LVDRVRGAVT

SEQ ID NO: 57865 - protein, 10 aa, Mycobacterium tuberculosis
VDRVRGAVTG

SEQ ID NO: 57866 - protein, 10 aa, Mycobacterium tuberculosis
DRVRGAVTGM

SEQ ID NO: 57867 - protein, 10 aa, Mycobacterium tuberculosis
RVRGAVTGMS

SEQ ID NO: 57868 - protein, 10 aa, Mycobacterium tuberculosis
VRGAVTGMSR

SEQ ID NO: 57869 - protein, 10 aa, Mycobacterium tuberculosis
RGAVTGMSRR

SEQ ID NO: 57870 - protein, 10 aa, Mycobacterium tuberculosis
GAVTGMSRRL

SEQ ID NO: 57871 - protein, 10 aa, Mycobacterium tuberculosis
AVTGMSRRLV

SEQ ID NO: 57872 - protein, 10 aa, Mycobacterium tuberculosis
VTGMSRRLVV

SEQ ID NO: 57873 - protein, 10 aa, Mycobacterium tuberculosis
TGMSRRLVVG

SEQ ID NO: 57874 - protein, 10 aa, Mycobacterium tuberculosis
GMSRRLVVGA

SEQ ID NO: 57875 - protein, 10 aa, Mycobacterium tuberculosis
MSRRLVVGAV

SEQ ID NO: 57876 - protein, 10 aa, Mycobacterium tuberculosis
SRRLVVGAVG

SEQ ID NO: 57877 - protein, 10 aa, Mycobacterium tuberculosis
RRLVVGAVGA

SEQ ID NO: 57878 - protein, 10 aa, Mycobacterium tuberculosis
RLVVGAVGAA

SEQ ID NO: 57879 - protein, 10 aa, Mycobacterium tuberculosis
LVVGAVGAAL

SEQ ID NO: 57880 - protein, 10 aa, Mycobacterium tuberculosis
VVGAVGAALV

SEQ ID NO: 57881 - protein, 10 aa, Mycobacterium tuberculosis
VGAVGAALVS

SEQ ID NO: 57882 - protein, 10 aa, Mycobacterium tuberculosis
GAVGAALVSG

SEQ ID NO: 57883 - protein, 10 aa, Mycobacterium tuberculosis
AVGAALVSGL

SEQ ID NO: 57884 - protein, 10 aa, Mycobacterium tuberculosis
VGAALVSGLV

SEQ ID NO: 57885 - protein, 10 aa, Mycobacterium tuberculosis
GAALVSGLVG

SEQ ID NO: 57886 - protein, 10 aa, Mycobacterium tuberculosis
AALVSGLVGA

SEQ ID NO: 57887 - protein, 10 aa, Mycobacterium tuberculosis
ALVSGLVGAV

SEQ ID NO: 57888 - protein, 10 aa, Mycobacterium tuberculosis
LVSGLVGAVG

SEQ ID NO: 57889 - protein, 10 aa, Mycobacterium tuberculosis
VSGLVGAVGG

SEQ ID NO: 57890 - protein, 10 aa, Mycobacterium tuberculosis
SGLVGAVGGT

SEQ ID NO: 57891 - protein, 10 aa, Mycobacterium tuberculosis
GLVGAVGGTA

SEQ ID NO: 57892 - protein, 10 aa, Mycobacterium tuberculosis
LVGAVGGTAT

SEQ ID NO: 57893 - protein, 10 aa, Mycobacterium tuberculosis
VGAVGGTATA

SEQ ID NO: 57894 - protein, 10 aa, Mycobacterium tuberculosis
GAVGGTATAG

SEQ ID NO: 57895 - protein, 10 aa, Mycobacterium tuberculosis
AVGGTATAGA

SEQ ID NO: 57896 - protein, 10 aa, Mycobacterium tuberculosis
VGGTATAGAF

SEQ ID NO: 57897 - protein, 10 aa, Mycobacterium tuberculosis
GGTATAGAFS

SEQ ID NO: 57898 - protein, 10 aa, Mycobacterium tuberculosis
GTATAGAFSR

SEQ ID NO: 57899 - protein, 10 aa, Mycobacterium tuberculosis
TATAGAFSRP

SEQ ID NO: 57900 - protein, 10 aa, Mycobacterium tuberculosis
ATAGAFSRPG

SEQ ID NO: 57901 - protein, 10 aa, Mycobacterium tuberculosis
TAGAFSRPGL

SEQ ID NO: 57902 - protein, 10 aa, Mycobacterium tuberculosis
AGAFSRPGLP

SEQ ID NO: 57903 - protein, 10 aa, Mycobacterium tuberculosis
GAFSRPGLPV

SEQ ID NO: 57904 - protein, 10 aa, Mycobacterium tuberculosis
AFSRPGLPVE

SEQ ID NO: 57905 - protein, 10 aa, Mycobacterium tuberculosis
FSRPGLPVEY

SEQ ID NO: 57906 - protein, 10 aa, Mycobacterium tuberculosis
SRPGLPVEYL

SEQ ID NO: 57907 - protein, 10 aa, Mycobacterium tuberculosis
RPGLPVEYLQ

SEQ ID NO: 57908 - protein, 10 aa, Mycobacterium tuberculosis
PGLPVEYLQV

SEQ ID NO: 57909 - protein, 10 aa, Mycobacterium tuberculosis
GLPVEYLQVP

SEQ ID NO: 57910 - protein, 10 aa, Mycobacterium tuberculosis
LPVEYLQVPS

SEQ ID NO: 57911 - protein, 10 aa, Mycobacterium tuberculosis
PVEYLQVPSP

SEQ ID NO: 57912 - protein, 10 aa, Mycobacterium tuberculosis
VEYLQVPSPS

SEQ ID NO: 57913 - protein, 10 aa, Mycobacterium tuberculosis
EYLQVPSPSM

SEQ ID NO: 57914 - protein, 10 aa, Mycobacterium tuberculosis
YLQVPSPSMG

SEQ ID NO: 57915 - protein, 10 aa, Mycobacterium tuberculosis
LQVPSPSMGR

SEQ ID NO: 57916 - protein, 10 aa, Mycobacterium tuberculosis
QVPSPSMGRD

SEQ ID NO: 57917 - protein, 10 aa, Mycobacterium tuberculosis
VPSPSMGRDI

SEQ ID NO: 57918 - protein, 10 aa, Mycobacterium tuberculosis
PSPSMGRDIK

SEQ ID NO: 57919 - protein, 10 aa, Mycobacterium tuberculosis
SPSMGRDIKV

SEQ ID NO: 57920 - protein, 10 aa, Mycobacterium tuberculosis
PSMGRDIKVQ

SEQ ID NO: 57921 - protein, 10 aa, Mycobacterium tuberculosis
SMGRDIKVQF

SEQ ID NO: 57922 - protein, 10 aa, Mycobacterium tuberculosis
MGRDIKVQFQ

SEQ ID NO: 57923 - protein, 10 aa, Mycobacterium tuberculosis
GRDIKVQFQS

SEQ ID NO: 57924 - protein, 10 aa, Mycobacterium tuberculosis
RDIKVQFQSG

SEQ ID NO: 57925 - protein, 10 aa, Mycobacterium tuberculosis
DIKVQFQSGG

SEQ ID NO: 57926 - protein, 10 aa, Mycobacterium tuberculosis
IKVQFQSGGA

SEQ ID NO: 57927 - protein, 10 aa, Mycobacterium tuberculosis
KVQFQSGGAN

SEQ ID NO: 57928 - protein, 10 aa, Mycobacterium tuberculosis
VQFQSGGANS

SEQ ID NO: 57929 - protein, 10 aa, Mycobacterium tuberculosis
QFQSGGANSP

SEQ ID NO: 57930 - protein, 10 aa, Mycobacterium tuberculosis
FQSGGANSPA

SEQ ID NO: 57931 - protein, 10 aa, Mycobacterium tuberculosis
QSGGANSPAL

SEQ ID NO: 57932 - protein, 10 aa, Mycobacterium tuberculosis
SGGANSPALY

SEQ ID NO: 57933 - protein, 10 aa, Mycobacterium tuberculosis
GGANSPALYL

SEQ ID NO: 57934 - protein, 10 aa, Mycobacterium tuberculosis
GANSPALYLL

SEQ ID NO: 57935 - protein, 10 aa, Mycobacterium tuberculosis
ANSPALYLLD

SEQ ID NO: 57936 - protein, 10 aa, Mycobacterium tuberculosis
NSPALYLLDG

SEQ ID NO: 57937 - protein, 10 aa, Mycobacterium tuberculosis
SPALYLLDGL

SEQ ID NO: 57938 - protein, 10 aa, Mycobacterium tuberculosis
PALYLLDGLR

SEQ ID NO: 57939 - protein, 10 aa, Mycobacterium tuberculosis
ALYLLDGLRA

SEQ ID NO: 57940 - protein, 10 aa, Mycobacterium tuberculosis
LYLLDGLRAQ

SEQ ID NO: 57941 - protein, 10 aa, Mycobacterium tuberculosis
YLLDGLRAQD

SEQ ID NO: 57942 - protein, 10 aa, Mycobacterium tuberculosis
LLDGLRAQDD

SEQ ID NO: 57943 - protein, 10 aa, Mycobacterium tuberculosis
LDGLRAQDDF

SEQ ID NO: 57944 - protein, 10 aa, Mycobacterium tuberculosis
DGLRAQDDFS

SEQ ID NO: 57945 - protein, 10 aa, Mycobacterium tuberculosis
GLRAQDDFSG

SEQ ID NO: 57946 - protein, 10 aa, Mycobacterium tuberculosis
LRAQDDFSGW

SEQ ID NO: 57947 - protein, 10 aa, Mycobacterium tuberculosis
RAQDDFSGWD

SEQ ID NO: 57948 - protein, 10 aa, Mycobacterium tuberculosis
AQDDFSGWDI

SEQ ID NO: 57949 - protein, 10 aa, Mycobacterium tuberculosis
QDDFSGWDIN

SEQ ID NO: 57950 - protein, 10 aa, Mycobacterium tuberculosis
DDFSGWDINT

SEQ ID NO: 57951 - protein, 10 aa, Mycobacterium tuberculosis
DFSGWDINTP

SEQ ID NO: 57952 - protein, 10 aa, Mycobacterium tuberculosis
FSGWDINTPA

SEQ ID NO: 57953 - protein, 10 aa, Mycobacterium tuberculosis
SGWDINTPAF

SEQ ID NO: 57954 - protein, 10 aa, Mycobacterium tuberculosis
GWDINTPAFE

SEQ ID NO: 57955 - protein, 10 aa, Mycobacterium tuberculosis
WDINTPAFEW

SEQ ID NO: 57956 - protein, 10 aa, Mycobacterium tuberculosis
DINTPAFEWY

SEQ ID NO: 57957 - protein, 10 aa, Mycobacterium tuberculosis
INTPAFEWYD

SEQ ID NO: 57958 - protein, 10 aa, Mycobacterium tuberculosis
NTPAFEWYDQ

SEQ ID NO: 57959 - protein, 10 aa, Mycobacterium tuberculosis
TPAFEWYDQS

SEQ ID NO: 57960 - protein, 10 aa, Mycobacterium tuberculosis
PAFEWYDQSG

SEQ ID NO: 57961 - protein, 10 aa, Mycobacterium tuberculosis
AFEWYDQSGL

SEQ ID NO: 57962 - protein, 10 aa, Mycobacterium tuberculosis
FEWYDQSGLS

SEQ ID NO: 57963 - protein, 10 aa, Mycobacterium tuberculosis
EWYDQSGLSV

SEQ ID NO: 57964 - protein, 10 aa, Mycobacterium tuberculosis
WYDQSGLSVV

SEQ ID NO: 57965 - protein, 10 aa, Mycobacterium tuberculosis
YDQSGLSVVM

SEQ ID NO: 57966 - protein, 10 aa, Mycobacterium tuberculosis
DQSGLSVVMP

SEQ ID NO: 57967 - protein, 10 aa, Mycobacterium tuberculosis
QSGLSVVMPV

SEQ ID NO: 57968 - protein, 10 aa, Mycobacterium tuberculosis
SGLSVVMPVG

SEQ ID NO: 57969 - protein, 10 aa, Mycobacterium tuberculosis
GLSVVMPVGG

SEQ ID NO: 57970 - protein, 10 aa, Mycobacterium tuberculosis
LSVVMPVGGQ

SEQ ID NO: 57971 - protein, 10 aa, Mycobacterium tuberculosis
SVVMPVGGQS

SEQ ID NO: 57972 - protein, 10 aa, Mycobacterium tuberculosis
VVMPVGGQSS

SEQ ID NO: 57973 - protein, 10 aa, Mycobacterium tuberculosis
VMPVGGQSSF

SEQ ID NO: 57974 - protein, 10 aa, Mycobacterium tuberculosis
MPVGGQSSFY

SEQ ID NO: 57975 - protein, 10 aa, Mycobacterium tuberculosis
PVGGQSSFYS

SEQ ID NO: 57976 - protein, 10 aa, Mycobacterium tuberculosis
VGGQSSFYSD

SEQ ID NO: 57977 - protein, 10 aa, Mycobacterium tuberculosis
GGQSSFYSDW

SEQ ID NO: 57978 - protein, 10 aa, Mycobacterium tuberculosis
GQSSFYSDWY

SEQ ID NO: 57979 - protein, 10 aa, Mycobacterium tuberculosis
QSSFYSDWYQ

SEQ ID NO: 57980 - protein, 10 aa, Mycobacterium tuberculosis
SSFYSDWYQP

SEQ ID NO: 57981 - protein, 10 aa, Mycobacterium tuberculosis
SFYSDWYQPA

SEQ ID NO: 57982 - protein, 10 aa, Mycobacterium tuberculosis
FYSDWYQPAC

SEQ ID NO: 57983 - protein, 10 aa, Mycobacterium tuberculosis
YSDWYQPACG

SEQ ID NO: 57984 - protein, 10 aa, Mycobacterium tuberculosis
SDWYQPACGK

SEQ ID NO: 57985 - protein, 10 aa, Mycobacterium tuberculosis
DWYQPACGKA

SEQ ID NO: 57986 - protein, 10 aa, Mycobacterium tuberculosis
WYQPACGKAG

SEQ ID NO: 57987 - protein, 10 aa, Mycobacterium tuberculosis
YQPACGKAGC

SEQ ID NO: 57988 - protein, 10 aa, Mycobacterium tuberculosis
QPACGKAGCQ

SEQ ID NO: 57989 - protein, 10 aa, Mycobacterium tuberculosis
PACGKAGCQT

SEQ ID NO: 57990 - protein, 10 aa, Mycobacterium tuberculosis
ACGKAGCQTY

SEQ ID NO: 57991 - protein, 10 aa, Mycobacterium tuberculosis
CGKAGCQTYK

SEQ ID NO: 57992 - protein, 10 aa, Mycobacterium tuberculosis
GKAGCQTYKW

SEQ ID NO: 57993 - protein, 10 aa, Mycobacterium tuberculosis
KAGCQTYKWE

SEQ ID NO: 57994 - protein, 10 aa, Mycobacterium tuberculosis
AGCQTYKWET

SEQ ID NO: 57995 - protein, 10 aa, Mycobacterium tuberculosis
GCQTYKWETF

SEQ ID NO: 57996 - protein, 10 aa, Mycobacterium tuberculosis
CQTYKWETFL

SEQ ID NO: 57997 - protein, 10 aa, Mycobacterium tuberculosis
QTYKWETFLT

SEQ ID NO: 57998 - protein, 10 aa, Mycobacterium tuberculosis
TYKWETFLTS

SEQ ID NO: 57999 - protein, 10 aa, Mycobacterium tuberculosis
YKWETFLTSE

SEQ ID NO: 58000 - protein, 10 aa, Mycobacterium tuberculosis
KWETFLTSEL

SEQ ID NO: 58001 - protein, 10 aa, Mycobacterium tuberculosis
WETFLTSELP

SEQ ID NO: 58002 - protein, 10 aa, Mycobacterium tuberculosis
ETFLTSELPG

SEQ ID NO: 58003 - protein, 10 aa, Mycobacterium tuberculosis
TFLTSELPGW

SEQ ID NO: 58004 - protein, 10 aa, Mycobacterium tuberculosis
FLTSELPGWL

SEQ ID NO: 58005 - protein, 10 aa, Mycobacterium tuberculosis
LTSELPGWLQ

SEQ ID NO: 58006 - protein, 10 aa, Mycobacterium tuberculosis
TSELPGWLQA

SEQ ID NO: 58007 - protein, 10 aa, Mycobacterium tuberculosis
SELPGWLQAN

SEQ ID NO: 58008 - protein, 10 aa, Mycobacterium tuberculosis
ELPGWLQANR

SEQ ID NO: 58009 - protein, 10 aa, Mycobacterium tuberculosis
LPGWLQANRH

SEQ ID NO: 58010 - protein, 10 aa, Mycobacterium tuberculosis
PGWLQANRHV

SEQ ID NO: 58011 - protein, 10 aa, Mycobacterium tuberculosis
GWLQANRHVK

SEQ ID NO: 58012 - protein, 10 aa, Mycobacterium tuberculosis
WLQANRHVKP

SEQ ID NO: 58013 - protein, 10 aa, Mycobacterium tuberculosis
LQANRHVKPT

SEQ ID NO: 58014 - protein, 10 aa, Mycobacterium tuberculosis
QANRHVKPTG

SEQ ID NO: 58015 - protein, 10 aa, Mycobacterium tuberculosis
ANRHVKPTGS

SEQ ID NO: 58016 - protein, 10 aa, Mycobacterium tuberculosis
NRHVKPTGSA

SEQ ID NO: 58017 - protein, 10 aa, Mycobacterium tuberculosis
RHVKPTGSAV

SEQ ID NO: 58018 - protein, 10 aa, Mycobacterium tuberculosis
HVKPTGSAVV

SEQ ID NO: 58019 - protein, 10 aa, Mycobacterium tuberculosis
VKPTGSAVVG

SEQ ID NO: 58020 - protein, 10 aa, Mycobacterium tuberculosis
KPTGSAVVGL

SEQ ID NO: 58021 - protein, 10 aa, Mycobacterium tuberculosis
PTGSAVVGLS

SEQ ID NO: 58022 - protein, 10 aa, Mycobacterium tuberculosis
TGSAVVGLSM

SEQ ID NO: 58023 - protein, 10 aa, Mycobacterium tuberculosis
GSAVVGLSMA

SEQ ID NO: 58024 - protein, 10 aa, Mycobacterium tuberculosis
SAVVGLSMAA

SEQ ID NO: 58025 - protein, 10 aa, Mycobacterium tuberculosis
AVVGLSMAAS

SEQ ID NO: 58026 - protein, 10 aa, Mycobacterium tuberculosis
VVGLSMAASS

SEQ ID NO: 58027 - protein, 10 aa, Mycobacterium tuberculosis
VGLSMAASSA

SEQ ID NO: 58028 - protein, 10 aa, Mycobacterium tuberculosis
GLSMAASSAL

SEQ ID NO: 58029 - protein, 10 aa, Mycobacterium tuberculosis
LSMAASSALT

SEQ ID NO: 58030 - protein, 10 aa, Mycobacterium tuberculosis
SMAASSALTL

SEQ ID NO: 58031 - protein, 10 aa, Mycobacterium tuberculosis
MAASSALTLA

SEQ ID NO: 58032 - protein, 10 aa, Mycobacterium tuberculosis
AASSALTLAI

SEQ ID NO: 58033 - protein, 10 aa, Mycobacterium tuberculosis
ASSALTLAIY

SEQ ID NO: 58034 - protein, 10 aa, Mycobacterium tuberculosis
SSALTLAIYH

SEQ ID NO: 58035 - protein, 10 aa, Mycobacterium tuberculosis
SALTLAIYHP

SEQ ID NO: 58036 - protein, 10 aa, Mycobacterium tuberculosis
ALTLAIYHPQ

SEQ ID NO: 58037 - protein, 10 aa, Mycobacterium tuberculosis
LTLAIYHPQQ

SEQ ID NO: 58038 - protein, 10 aa, Mycobacterium tuberculosis
TLAIYHPQQF

SEQ ID NO: 58039 - protein, 10 aa, Mycobacterium tuberculosis
LAIYHPQQFV

SEQ ID NO: 58040 - protein, 10 aa, Mycobacterium tuberculosis
AIYHPQQFVY

SEQ ID NO: 58041 - protein, 10 aa, Mycobacterium tuberculosis
IYHPQQFVYA

SEQ ID NO: 58042 - protein, 10 aa, Mycobacterium tuberculosis
YHPQQFVYAG

SEQ ID NO: 58043 - protein, 10 aa, Mycobacterium tuberculosis
HPQQFVYAGA

SEQ ID NO: 58044 - protein, 10 aa, Mycobacterium tuberculosis
PQQFVYAGAM

SEQ ID NO: 58045 - protein, 10 aa, Mycobacterium tuberculosis
QQFVYAGAMS

SEQ ID NO: 58046 - protein, 10 aa, Mycobacterium tuberculosis
QFVYAGAMSG

SEQ ID NO: 58047 - protein, 10 aa, Mycobacterium tuberculosis
FVYAGAMSGL

SEQ ID NO: 58048 - protein, 10 aa, Mycobacterium tuberculosis
VYAGAMSGLL

SEQ ID NO: 58049 - protein, 10 aa, Mycobacterium tuberculosis
YAGAMSGLLD

SEQ ID NO: 58050 - protein, 10 aa, Mycobacterium tuberculosis
AGAMSGLLDP

SEQ ID NO: 58051 - protein, 10 aa, Mycobacterium tuberculosis
GAMSGLLDPS

SEQ ID NO: 58052 - protein, 10 aa, Mycobacterium tuberculosis
AMSGLLDPSQ

SEQ ID NO: 58053 - protein, 10 aa, Mycobacterium tuberculosis
MSGLLDPSQA

SEQ ID NO: 58054 - protein, 10 aa, Mycobacterium tuberculosis
SGLLDPSQAM

SEQ ID NO: 58055 - protein, 10 aa, Mycobacterium tuberculosis
GLLDPSQAMG

SEQ ID NO: 58056 - protein, 10 aa, Mycobacterium tuberculosis
LLDPSQAMGP

SEQ ID NO: 58057 - protein, 10 aa, Mycobacterium tuberculosis
LDPSQAMGPT

SEQ ID NO: 58058 - protein, 10 aa, Mycobacterium tuberculosis
DPSQAMGPTL

SEQ ID NO: 58059 - protein, 10 aa, Mycobacterium tuberculosis
PSQAMGPTLI

SEQ ID NO: 58060 - protein, 10 aa, Mycobacterium tuberculosis
SQAMGPTLIG

SEQ ID NO: 58061 - protein, 10 aa, Mycobacterium tuberculosis
QAMGPTLIGL

SEQ ID NO: 58062 - protein, 10 aa, Mycobacterium tuberculosis
AMGPTLIGLA

SEQ ID NO: 58063 - protein, 10 aa, Mycobacterium tuberculosis
MGPTLIGLAM

SEQ ID NO: 58064 - protein, 10 aa, Mycobacterium tuberculosis
GPTLIGLAMG

SEQ ID NO: 58065 - protein, 10 aa, Mycobacterium tuberculosis
PTLIGLAMGD

SEQ ID NO: 58066 - protein, 10 aa, Mycobacterium tuberculosis
TLIGLAMGDA

SEQ ID NO: 58067 - protein, 10 aa, Mycobacterium tuberculosis
LIGLAMGDAG

SEQ ID NO: 58068 - protein, 10 aa, Mycobacterium tuberculosis
IGLAMGDAGG

SEQ ID NO: 58069 - protein, 10 aa, Mycobacterium tuberculosis
GLAMGDAGGY

SEQ ID NO: 58070 - protein, 10 aa, Mycobacterium tuberculosis
LAMGDAGGYK

SEQ ID NO: 58071 - protein, 10 aa, Mycobacterium tuberculosis
AMGDAGGYKA

SEQ ID NO: 58072 - protein, 10 aa, Mycobacterium tuberculosis
MGDAGGYKAS

SEQ ID NO: 58073 - protein, 10 aa, Mycobacterium tuberculosis
GDAGGYKASD

SEQ ID NO: 58074 - protein, 10 aa, Mycobacterium tuberculosis
DAGGYKASDM

SEQ ID NO: 58075 - protein, 10 aa, Mycobacterium tuberculosis
AGGYKASDMW

SEQ ID NO: 58076 - protein, 10 aa, Mycobacterium tuberculosis
GGYKASDMWG

SEQ ID NO: 58077 - protein, 10 aa, Mycobacterium tuberculosis
GYKASDMWGP

SEQ ID NO: 58078 - protein, 10 aa, Mycobacterium tuberculosis
YKASDMWGPK

SEQ ID NO: 58079 - protein, 10 aa, Mycobacterium tuberculosis
KASDMWGPKE

SEQ ID NO: 58080 - protein, 10 aa, Mycobacterium tuberculosis
ASDMWGPKED

SEQ ID NO: 58081 - protein, 10 aa, Mycobacterium tuberculosis
SDMWGPKEDP

SEQ ID NO: 58082 - protein, 10 aa, Mycobacterium tuberculosis
DMWGPKEDPA

SEQ ID NO: 58083 - protein, 10 aa, Mycobacterium tuberculosis
MWGPKEDPAW

SEQ ID NO: 58084 - protein, 10 aa, Mycobacterium tuberculosis
WGPKEDPAWQ

SEQ ID NO: 58085 - protein, 10 aa, Mycobacterium tuberculosis
GPKEDPAWQR

SEQ ID NO: 58086 - protein, 10 aa, Mycobacterium tuberculosis
PKEDPAWQRN

SEQ ID NO: 58087 - protein, 10 aa, Mycobacterium tuberculosis
KEDPAWQRND

SEQ ID NO: 58088 - protein, 10 aa, Mycobacterium tuberculosis
EDPAWQRNDP

SEQ ID NO: 58089 - protein, 10 aa, Mycobacterium tuberculosis
DPAWQRNDPL

SEQ ID NO: 58090 - protein, 10 aa, Mycobacterium tuberculosis
PAWQRNDPLL

SEQ ID NO: 58091 - protein, 10 aa, Mycobacterium tuberculosis
AWQRNDPLLN

SEQ ID NO: 58092 - protein, 10 aa, Mycobacterium tuberculosis
WQRNDPLLNV

SEQ ID NO: 58093 - protein, 10 aa, Mycobacterium tuberculosis
QRNDPLLNVG

SEQ ID NO: 58094 - protein, 10 aa, Mycobacterium tuberculosis
RNDPLLNVGK

SEQ ID NO: 58095 - protein, 10 aa, Mycobacterium tuberculosis
NDPLLNVGKL

SEQ ID NO: 58096 - protein, 10 aa, Mycobacterium tuberculosis
DPLLNVGKLI

SEQ ID NO: 58097 - protein, 10 aa, Mycobacterium tuberculosis
PLLNVGKLIA

SEQ ID NO: 58098 - protein, 10 aa, Mycobacterium tuberculosis
LLNVGKLIAN

SEQ ID NO: 58099 - protein, 10 aa, Mycobacterium tuberculosis
LNVGKLIANN

SEQ ID NO: 58100 - protein, 10 aa, Mycobacterium tuberculosis
NVGKLIANNT

SEQ ID NO: 58101 - protein, 10 aa, Mycobacterium tuberculosis
VGKLIANNTR

SEQ ID NO: 58102 - protein, 10 aa, Mycobacterium tuberculosis
GKLIANNTRV

SEQ ID NO: 58103 - protein, 10 aa, Mycobacterium tuberculosis
KLIANNTRVW

SEQ ID NO: 58104 - protein, 10 aa, Mycobacterium tuberculosis
LIANNTRVWV

SEQ ID NO: 58105 - protein, 10 aa, Mycobacterium tuberculosis
IANNTRVWVY

SEQ ID NO: 58106 - protein, 10 aa, Mycobacterium tuberculosis
ANNTRVWVYC

SEQ ID NO: 58107 - protein, 10 aa, Mycobacterium tuberculosis
NNTRVWVYCG

SEQ ID NO: 58108 - protein, 10 aa, Mycobacterium tuberculosis
NTRVWVYCGN

SEQ ID NO: 58109 - protein, 10 aa, Mycobacterium tuberculosis
TRVWVYCGNG

SEQ ID NO: 58110 - protein, 10 aa, Mycobacterium tuberculosis
RVWVYCGNGK

SEQ ID NO: 58111 - protein, 10 aa, Mycobacterium tuberculosis
VWVYCGNGKP

SEQ ID NO: 58112 - protein, 10 aa, Mycobacterium tuberculosis
WVYCGNGKPS

SEQ ID NO: 58113 - protein, 10 aa, Mycobacterium tuberculosis
VYCGNGKPSD

SEQ ID NO: 58114 - protein, 10 aa, Mycobacterium tuberculosis
YCGNGKPSDL

SEQ ID NO: 58115 - protein, 10 aa, Mycobacterium tuberculosis
CGNGKPSDLG

SEQ ID NO: 58116 - protein, 10 aa, Mycobacterium tuberculosis
GNGKPSDLGG

SEQ ID NO: 58117 - protein, 10 aa, Mycobacterium tuberculosis
NGKPSDLGGN

SEQ ID NO: 58118 - protein, 10 aa, Mycobacterium tuberculosis
GKPSDLGGNN

SEQ ID NO: 58119 - protein, 10 aa, Mycobacterium tuberculosis
KPSDLGGNNL

SEQ ID NO: 58120 - protein, 10 aa, Mycobacterium tuberculosis
PSDLGGNNLP

SEQ ID NO: 58121 - protein, 10 aa, Mycobacterium tuberculosis
SDLGGNNLPA

SEQ ID NO: 58122 - protein, 10 aa, Mycobacterium tuberculosis
DLGGNNLPAK

SEQ ID NO: 58123 - protein, 10 aa, Mycobacterium tuberculosis
LGGNNLPAKF

SEQ ID NO: 58124 - protein, 10 aa, Mycobacterium tuberculosis
GGNNLPAKFL

SEQ ID NO: 58125 - protein, 10 aa, Mycobacterium tuberculosis
GNNLPAKFLE

SEQ ID NO: 58126 - protein, 10 aa, Mycobacterium tuberculosis
NNLPAKFLEG

SEQ ID NO: 58127 - protein, 10 aa, Mycobacterium tuberculosis
NLPAKFLEGF

SEQ ID NO: 58128 - protein, 10 aa, Mycobacterium tuberculosis
LPAKFLEGFV

SEQ ID NO: 58129 - protein, 10 aa, Mycobacterium tuberculosis
PAKFLEGFVR

SEQ ID NO: 58130 - protein, 10 aa, Mycobacterium tuberculosis
AKFLEGFVRT

SEQ ID NO: 58131 - protein, 10 aa, Mycobacterium tuberculosis
KFLEGFVRTS

SEQ ID NO: 58132 - protein, 10 aa, Mycobacterium tuberculosis
FLEGFVRTSN

SEQ ID NO: 58133 - protein, 10 aa, Mycobacterium tuberculosis
LEGFVRTSNI

SEQ ID NO: 58134 - protein, 10 aa, Mycobacterium tuberculosis
EGFVRTSNIK

SEQ ID NO: 58135 - protein, 10 aa, Mycobacterium tuberculosis
GFVRTSNIKF

SEQ ID NO: 58136 - protein, 10 aa, Mycobacterium tuberculosis
FVRTSNIKFQ

SEQ ID NO: 58137 - protein, 10 aa, Mycobacterium tuberculosis
VRTSNIKFQD

SEQ ID NO: 58138 - protein, 10 aa, Mycobacterium tuberculosis
RTSNIKFQDA

SEQ ID NO: 58139 - protein, 10 aa, Mycobacterium tuberculosis
TSNIKFQDAY

SEQ ID NO: 58140 - protein, 10 aa, Mycobacterium tuberculosis
SNIKFQDAYN

SEQ ID NO: 58141 - protein, 10 aa, Mycobacterium tuberculosis
NIKFQDAYNA

SEQ ID NO: 58142 - protein, 10 aa, Mycobacterium tuberculosis
IKFQDAYNAG

SEQ ID NO: 58143 - protein, 10 aa, Mycobacterium tuberculosis
KFQDAYNAGG

SEQ ID NO: 58144 - protein, 10 aa, Mycobacterium tuberculosis
FQDAYNAGGG

SEQ ID NO: 58145 - protein, 10 aa, Mycobacterium tuberculosis
QDAYNAGGGH

SEQ ID NO: 58146 - protein, 10 aa, Mycobacterium tuberculosis
DAYNAGGGHN

SEQ ID NO: 58147 - protein, 10 aa, Mycobacterium tuberculosis
AYNAGGGHNG

SEQ ID NO: 58148 - protein, 10 aa, Mycobacterium tuberculosis
YNAGGGHNGV

SEQ ID NO: 58149 - protein, 10 aa, Mycobacterium tuberculosis
NAGGGHNGVF

SEQ ID NO: 58150 - protein, 10 aa, Mycobacterium tuberculosis
AGGGHNGVFD

SEQ ID NO: 58151 - protein, 10 aa, Mycobacterium tuberculosis
GGGHNGVFDF

SEQ ID NO: 58152 - protein, 10 aa, Mycobacterium tuberculosis
GGHNGVFDFP

SEQ ID NO: 58153 - protein, 10 aa, Mycobacterium tuberculosis
GHNGVFDFPD

SEQ ID NO: 58154 - protein, 10 aa, Mycobacterium tuberculosis
HNGVFDFPDS

SEQ ID NO: 58155 - protein, 10 aa, Mycobacterium tuberculosis
NGVFDFPDSG

SEQ ID NO: 58156 - protein, 10 aa, Mycobacterium tuberculosis
GVFDFPDSGT

SEQ ID NO: 58157 - protein, 10 aa, Mycobacterium tuberculosis
VFDFPDSGTH

SEQ ID NO: 58158 - protein, 10 aa, Mycobacterium tuberculosis
FDFPDSGTHS

SEQ ID NO: 58159 - protein, 10 aa, Mycobacterium tuberculosis
DFPDSGTHSW

SEQ ID NO: 58160 - protein, 10 aa, Mycobacterium tuberculosis
FPDSGTHSWE

SEQ ID NO: 58161 - protein, 10 aa, Mycobacterium tuberculosis
PDSGTHSWEY

SEQ ID NO: 58162 - protein, 10 aa, Mycobacterium tuberculosis
DSGTHSWEYW

SEQ ID NO: 58163 - protein, 10 aa, Mycobacterium tuberculosis
SGTHSWEYWG

SEQ ID NO: 58164 - protein, 10 aa, Mycobacterium tuberculosis
GTHSWEYWGA

SEQ ID NO: 58165 - protein, 10 aa, Mycobacterium tuberculosis
THSWEYWGAQ

SEQ ID NO: 58166 - protein, 10 aa, Mycobacterium tuberculosis
HSWEYWGAQL

SEQ ID NO: 58167 - protein, 10 aa, Mycobacterium tuberculosis
SWEYWGAQLN

SEQ ID NO: 58168 - protein, 10 aa, Mycobacterium tuberculosis
WEYWGAQLNA

SEQ ID NO: 58169 - protein, 10 aa, Mycobacterium tuberculosis
EYWGAQLNAM

SEQ ID NO: 58170 - protein, 10 aa, Mycobacterium tuberculosis
YWGAQLNAMK

SEQ ID NO: 58171 - protein, 10 aa, Mycobacterium tuberculosis
WGAQLNAMKP

SEQ ID NO: 58172 - protein, 10 aa, Mycobacterium tuberculosis
GAQLNAMKPD

SEQ ID NO: 58173 - protein, 10 aa, Mycobacterium tuberculosis
AQLNAMKPDL

SEQ ID NO: 58174 - protein, 10 aa, Mycobacterium tuberculosis
QLNAMKPDLQ

SEQ ID NO: 58175 - protein, 10 aa, Mycobacterium tuberculosis
LNAMKPDLQR

SEQ ID NO: 58176 - protein, 10 aa, Mycobacterium tuberculosis
NAMKPDLQRA

SEQ ID NO: 58177 - protein, 10 aa, Mycobacterium tuberculosis
AMKPDLQRAL

SEQ ID NO: 58178 - protein, 10 aa, Mycobacterium tuberculosis
MKPDLQRALG

SEQ ID NO: 58179 - protein, 10 aa, Mycobacterium tuberculosis
KPDLQRALGA

SEQ ID NO: 58180 - protein, 10 aa, Mycobacterium tuberculosis
PDLQRALGAT

SEQ ID NO: 58181 - protein, 10 aa, Mycobacterium tuberculosis
DLQRALGATP

SEQ ID NO: 58182 - protein, 10 aa, Mycobacterium tuberculosis
LQRALGATPN

SEQ ID NO: 58183 - protein, 10 aa, Mycobacterium tuberculosis
QRALGATPNT

SEQ ID NO: 58184 - protein, 10 aa, Mycobacterium tuberculosis
RALGATPNTG

SEQ ID NO: 58185 - protein, 10 aa, Mycobacterium tuberculosis
ALGATPNTGP

SEQ ID NO: 58186 - protein, 10 aa, Mycobacterium tuberculosis
LGATPNTGPA

SEQ ID NO: 58187 - protein, 10 aa, Mycobacterium tuberculosis
GATPNTGPAP

SEQ ID NO: 58188 - protein, 10 aa, Mycobacterium tuberculosis
ATPNTGPAPQ

SEQ ID NO: 58189 - protein, 10 aa, Mycobacterium tuberculosis
TPNTGPAPQG

SEQ ID NO: 58190 - protein, 10 aa, Mycobacterium tuberculosis
PNTGPAPQGA

SEQ ID NO: 58191 - protein, 11 aa, Mycobacterium tuberculosis
MQLVDRVRGAV

SEQ ID NO: 58192 - protein, 11 aa, Mycobacterium tuberculosis
QLVDRVRGAVT

SEQ ID NO: 58193 - protein, 11 aa, Mycobacterium tuberculosis
LVDRVRGAVTG

SEQ ID NO: 58194 - protein, 11 aa, Mycobacterium tuberculosis
VDRVRGAVTGM

SEQ ID NO: 58195 - protein, 11 aa, Mycobacterium tuberculosis
DRVRGAVTGMS

SEQ ID NO: 58196 - protein, 11 aa, Mycobacterium tuberculosis
RVRGAVTGMSR

SEQ ID NO: 58197 - protein, 11 aa, Mycobacterium tuberculosis
VRGAVTGMSRR

SEQ ID NO: 58198 - protein, 11 aa, Mycobacterium tuberculosis
RGAVTGMSRRL

SEQ ID NO: 58199 - protein, 11 aa, Mycobacterium tuberculosis
GAVTGMSRRLV

SEQ ID NO: 58200 - protein, 11 aa, Mycobacterium tuberculosis
AVTGMSRRLVV

SEQ ID NO: 58201 - protein, 11 aa, Mycobacterium tuberculosis
VTGMSRRLVVG

SEQ ID NO: 58202 - protein, 11 aa, Mycobacterium tuberculosis
TGMSRRLVVGA

SEQ ID NO: 58203 - protein, 11 aa, Mycobacterium tuberculosis
GMSRRLVVGAV

SEQ ID NO: 58204 - protein, 11 aa, Mycobacterium tuberculosis
MSRRLVVGAVG

SEQ ID NO: 58205 - protein, 11 aa, Mycobacterium tuberculosis
SRRLVVGAVGA

SEQ ID NO: 58206 - protein, 11 aa, Mycobacterium tuberculosis
RRLVVGAVGAA

SEQ ID NO: 58207 - protein, 11 aa, Mycobacterium tuberculosis
RLVVGAVGAAL

SEQ ID NO: 58208 - protein, 11 aa, Mycobacterium tuberculosis
LVVGAVGAALV

SEQ ID NO: 58209 - protein, 11 aa, Mycobacterium tuberculosis
VVGAVGAALVS

SEQ ID NO: 58210 - protein, 11 aa, Mycobacterium tuberculosis
VGAVGAALVSG

SEQ ID NO: 58211 - protein, 11 aa, Mycobacterium tuberculosis
GAVGAALVSGL

SEQ ID NO: 58212 - protein, 11 aa, Mycobacterium tuberculosis
AVGAALVSGLV

SEQ ID NO: 58213 - protein, 11 aa, Mycobacterium tuberculosis
VGAALVSGLVG

SEQ ID NO: 58214 - protein, 11 aa, Mycobacterium tuberculosis
GAALVSGLVGA

SEQ ID NO: 58215 - protein, 11 aa, Mycobacterium tuberculosis
AALVSGLVGAV

SEQ ID NO: 58216 - protein, 11 aa, Mycobacterium tuberculosis
ALVSGLVGAVG

SEQ ID NO: 58217 - protein, 11 aa, Mycobacterium tuberculosis
LVSGLVGAVGG

SEQ ID NO: 58218 - protein, 11 aa, Mycobacterium tuberculosis
VSGLVGAVGGT

SEQ ID NO: 58219 - protein, 11 aa, Mycobacterium tuberculosis
SGLVGAVGGTA

SEQ ID NO: 58220 - protein, 11 aa, Mycobacterium tuberculosis
GLVGAVGGTAT

SEQ ID NO: 58221 - protein, 11 aa, Mycobacterium tuberculosis
LVGAVGGTATA

SEQ ID NO: 58222 - protein, 11 aa, Mycobacterium tuberculosis
VGAVGGTATAG

SEQ ID NO: 58223 - protein, 11 aa, Mycobacterium tuberculosis
GAVGGTATAGA

SEQ ID NO: 58224 - protein, 11 aa, Mycobacterium tuberculosis
AVGGTATAGAF

SEQ ID NO: 58225 - protein, 11 aa, Mycobacterium tuberculosis
VGGTATAGAFS

SEQ ID NO: 58226 - protein, 11 aa, Mycobacterium tuberculosis
GGTATAGAFSR

SEQ ID NO: 58227 - protein, 11 aa, Mycobacterium tuberculosis
GTATAGAFSRP

SEQ ID NO: 58228 - protein, 11 aa, Mycobacterium tuberculosis
TATAGAFSRPG

SEQ ID NO: 58229 - protein, 11 aa, Mycobacterium tuberculosis
ATAGAFSRPGL

SEQ ID NO: 58230 - protein, 11 aa, Mycobacterium tuberculosis
TAGAFSRPGLP

SEQ ID NO: 58231 - protein, 11 aa, Mycobacterium tuberculosis
AGAFSRPGLPV

SEQ ID NO: 58232 - protein, 11 aa, Mycobacterium tuberculosis
GAFSRPGLPVE

SEQ ID NO: 58233 - protein, 11 aa, Mycobacterium tuberculosis
AFSRPGLPVEY

SEQ ID NO: 58234 - protein, 11 aa, Mycobacterium tuberculosis
FSRPGLPVEYL

SEQ ID NO: 58235 - protein, 11 aa, Mycobacterium tuberculosis
SRPGLPVEYLQ

SEQ ID NO: 58236 - protein, 11 aa, Mycobacterium tuberculosis
RPGLPVEYLQV

SEQ ID NO: 58237 - protein, 11 aa, Mycobacterium tuberculosis
PGLPVEYLQVP

SEQ ID NO: 58238 - protein, 11 aa, Mycobacterium tuberculosis
GLPVEYLQVPS

SEQ ID NO: 58239 - protein, 11 aa, Mycobacterium tuberculosis
LPVEYLQVPSP

SEQ ID NO: 58240 - protein, 11 aa, Mycobacterium tuberculosis
PVEYLQVPSPS

SEQ ID NO: 58241 - protein, 11 aa, Mycobacterium tuberculosis
VEYLQVPSPSM

SEQ ID NO: 58242 - protein, 11 aa, Mycobacterium tuberculosis
EYLQVPSPSMG

SEQ ID NO: 58243 - protein, 11 aa, Mycobacterium tuberculosis
YLQVPSPSMGR

SEQ ID NO: 58244 - protein, 11 aa, Mycobacterium tuberculosis
LQVPSPSMGRD

SEQ ID NO: 58245 - protein, 11 aa, Mycobacterium tuberculosis
QVPSPSMGRDI

SEQ ID NO: 58246 - protein, 11 aa, Mycobacterium tuberculosis
VPSPSMGRDIK

SEQ ID NO: 58247 - protein, 11 aa, Mycobacterium tuberculosis
PSPSMGRDIKV

SEQ ID NO: 58248 - protein, 11 aa, Mycobacterium tuberculosis
SPSMGRDIKVQ

SEQ ID NO: 58249 - protein, 11 aa, Mycobacterium tuberculosis
PSMGRDIKVQF

SEQ ID NO: 58250 - protein, 11 aa, Mycobacterium tuberculosis
SMGRDIKVQFQ

SEQ ID NO: 58251 - protein, 11 aa, Mycobacterium tuberculosis
MGRDIKVQFQS

SEQ ID NO: 58252 - protein, 11 aa, Mycobacterium tuberculosis
GRDIKVQFQSG

SEQ ID NO: 58253 - protein, 11 aa, Mycobacterium tuberculosis
RDIKVQFQSGG

SEQ ID NO: 58254 - protein, 11 aa, Mycobacterium tuberculosis
DIKVQFQSGGA

SEQ ID NO: 58255 - protein, 11 aa, Mycobacterium tuberculosis
IKVQFQSGGAN

SEQ ID NO: 58256 - protein, 11 aa, Mycobacterium tuberculosis
KVQFQSGGANS

SEQ ID NO: 58257 - protein, 11 aa, Mycobacterium tuberculosis
VQFQSGGANSP

SEQ ID NO: 58258 - protein, 11 aa, Mycobacterium tuberculosis
QFQSGGANSPA

SEQ ID NO: 58259 - protein, 11 aa, Mycobacterium tuberculosis
FQSGGANSPAL

SEQ ID NO: 58260 - protein, 11 aa, Mycobacterium tuberculosis
QSGGANSPALY

SEQ ID NO: 58261 - protein, 11 aa, Mycobacterium tuberculosis
SGGANSPALYL

SEQ ID NO: 58262 - protein, 11 aa, Mycobacterium tuberculosis
GGANSPALYLL

SEQ ID NO: 58263 - protein, 11 aa, Mycobacterium tuberculosis
GANSPALYLLD

SEQ ID NO: 58264 - protein, 11 aa, Mycobacterium tuberculosis
ANSPALYLLDG

SEQ ID NO: 58265 - protein, 11 aa, Mycobacterium tuberculosis
NSPALYLLDGL

SEQ ID NO: 58266 - protein, 11 aa, Mycobacterium tuberculosis
SPALYLLDGLR

SEQ ID NO: 58267 - protein, 11 aa, Mycobacterium tuberculosis
PALYLLDGLRA

SEQ ID NO: 58268 - protein, 11 aa, Mycobacterium tuberculosis
ALYLLDGLRAQ

SEQ ID NO: 58269 - protein, 11 aa, Mycobacterium tuberculosis
LYLLDGLRAQD

SEQ ID NO: 58270 - protein, 11 aa, Mycobacterium tuberculosis
YLLDGLRAQDD

SEQ ID NO: 58271 - protein, 11 aa, Mycobacterium tuberculosis
LLDGLRAQDDF

SEQ ID NO: 58272 - protein, 11 aa, Mycobacterium tuberculosis
LDGLRAQDDFS

SEQ ID NO: 58273 - protein, 11 aa, Mycobacterium tuberculosis
DGLRAQDDFSG

SEQ ID NO: 58274 - protein, 11 aa, Mycobacterium tuberculosis
GLRAQDDFSGW

SEQ ID NO: 58275 - protein, 11 aa, Mycobacterium tuberculosis
LRAQDDFSGWD

SEQ ID NO: 58276 - protein, 11 aa, Mycobacterium tuberculosis
RAQDDFSGWDI

SEQ ID NO: 58277 - protein, 11 aa, Mycobacterium tuberculosis
AQDDFSGWDIN

SEQ ID NO: 58278 - protein, 11 aa, Mycobacterium tuberculosis
QDDFSGWDINT

SEQ ID NO: 58279 - protein, 11 aa, Mycobacterium tuberculosis
DDFSGWDINTP

SEQ ID NO: 58280 - protein, 11 aa, Mycobacterium tuberculosis
DFSGWDINTPA

SEQ ID NO: 58281 - protein, 11 aa, Mycobacterium tuberculosis
FSGWDINTPAF

SEQ ID NO: 58282 - protein, 11 aa, Mycobacterium tuberculosis
SGWDINTPAFE

SEQ ID NO: 58283 - protein, 11 aa, Mycobacterium tuberculosis
GWDINTPAFEW

SEQ ID NO: 58284 - protein, 11 aa, Mycobacterium tuberculosis
WDINTPAFEWY

SEQ ID NO: 58285 - protein, 11 aa, Mycobacterium tuberculosis
DINTPAFEWYD

SEQ ID NO: 58286 - protein, 11 aa, Mycobacterium tuberculosis
INTPAFEWYDQ

SEQ ID NO: 58287 - protein, 11 aa, Mycobacterium tuberculosis
NTPAFEWYDQS

SEQ ID NO: 58288 - protein, 11 aa, Mycobacterium tuberculosis
TPAFEWYDQSG

SEQ ID NO: 58289 - protein, 11 aa, Mycobacterium tuberculosis
PAFEWYDQSGL

SEQ ID NO: 58290 - protein, 11 aa, Mycobacterium tuberculosis
AFEWYDQSGLS

SEQ ID NO: 58291 - protein, 11 aa, Mycobacterium tuberculosis
FEWYDQSGLSV

SEQ ID NO: 58292 - protein, 11 aa, Mycobacterium tuberculosis
EWYDQSGLSVV

SEQ ID NO: 58293 - protein, 11 aa, Mycobacterium tuberculosis
WYDQSGLSVVM

SEQ ID NO: 58294 - protein, 11 aa, Mycobacterium tuberculosis
YDQSGLSVVMP

SEQ ID NO: 58295 - protein, 11 aa, Mycobacterium tuberculosis
DQSGLSVVMPV

SEQ ID NO: 58296 - protein, 11 aa, Mycobacterium tuberculosis
QSGLSVVMPVG

SEQ ID NO: 58297 - protein, 11 aa, Mycobacterium tuberculosis
SGLSVVMPVGG

SEQ ID NO: 58298 - protein, 11 aa, Mycobacterium tuberculosis
GLSVVMPVGGQ

SEQ ID NO: 58299 - protein, 11 aa, Mycobacterium tuberculosis
LSVVMPVGGQS

SEQ ID NO: 58300 - protein, 11 aa, Mycobacterium tuberculosis
SVVMPVGGQSS

SEQ ID NO: 58301 - protein, 11 aa, Mycobacterium tuberculosis
VVMPVGGQSSF

SEQ ID NO: 58302 - protein, 11 aa, Mycobacterium tuberculosis
VMPVGGQSSFY

SEQ ID NO: 58303 - protein, 11 aa, Mycobacterium tuberculosis
MPVGGQSSFYS

SEQ ID NO: 58304 - protein, 11 aa, Mycobacterium tuberculosis
PVGGQSSFYSD

SEQ ID NO: 58305 - protein, 11 aa, Mycobacterium tuberculosis
VGGQSSFYSDW

SEQ ID NO: 58306 - protein, 11 aa, Mycobacterium tuberculosis
GGQSSFYSDWY

SEQ ID NO: 58307 - protein, 11 aa, Mycobacterium tuberculosis
GQSSFYSDWYQ

SEQ ID NO: 58308 - protein, 11 aa, Mycobacterium tuberculosis
QSSFYSDWYQP

SEQ ID NO: 58309 - protein, 11 aa, Mycobacterium tuberculosis
SSFYSDWYQPA

SEQ ID NO: 58310 - protein, 11 aa, Mycobacterium tuberculosis
SFYSDWYQPAC

SEQ ID NO: 58311 - protein, 11 aa, Mycobacterium tuberculosis
FYSDWYQPACG

SEQ ID NO: 58312 - protein, 11 aa, Mycobacterium tuberculosis
YSDWYQPACGK

SEQ ID NO: 58313 - protein, 11 aa, Mycobacterium tuberculosis
SDWYQPACGKA

SEQ ID NO: 58314 - protein, 11 aa, Mycobacterium tuberculosis
DWYQPACGKAG

SEQ ID NO: 58315 - protein, 11 aa, Mycobacterium tuberculosis
WYQPACGKAGC

SEQ ID NO: 58316 - protein, 11 aa, Mycobacterium tuberculosis
YQPACGKAGCQ

SEQ ID NO: 58317 - protein, 11 aa, Mycobacterium tuberculosis
QPACGKAGCQT

SEQ ID NO: 58318 - protein, 11 aa, Mycobacterium tuberculosis
PACGKAGCQTY

SEQ ID NO: 58319 - protein, 11 aa, Mycobacterium tuberculosis
ACGKAGCQTYK

SEQ ID NO: 58320 - protein, 11 aa, Mycobacterium tuberculosis
CGKAGCQTYKW

SEQ ID NO: 58321 - protein, 11 aa, Mycobacterium tuberculosis
GKAGCQTYKWE

SEQ ID NO: 58322 - protein, 11 aa, Mycobacterium tuberculosis
KAGCQTYKWET

SEQ ID NO: 58323 - protein, 11 aa, Mycobacterium tuberculosis
AGCQTYKWETF

SEQ ID NO: 58324 - protein, 11 aa, Mycobacterium tuberculosis
GCQTYKWETFL

SEQ ID NO: 58325 - protein, 11 aa, Mycobacterium tuberculosis
CQTYKWETFLT

SEQ ID NO: 58326 - protein, 11 aa, Mycobacterium tuberculosis
QTYKWETFLTS

SEQ ID NO: 58327 - protein, 11 aa, Mycobacterium tuberculosis
TYKWETFLTSE

SEQ ID NO: 58328 - protein, 11 aa, Mycobacterium tuberculosis
YKWETFLTSEL

SEQ ID NO: 58329 - protein, 11 aa, Mycobacterium tuberculosis
KWETFLTSELP

SEQ ID NO: 58330 - protein, 11 aa, Mycobacterium tuberculosis
WETFLTSELPG

SEQ ID NO: 58331 - protein, 11 aa, Mycobacterium tuberculosis
ETFLTSELPGW

SEQ ID NO: 58332 - protein, 11 aa, Mycobacterium tuberculosis
TFLTSELPGWL

SEQ ID NO: 58333 - protein, 11 aa, Mycobacterium tuberculosis
FLTSELPGWLQ

SEQ ID NO: 58334 - protein, 11 aa, Mycobacterium tuberculosis
LTSELPGWLQA

SEQ ID NO: 58335 - protein, 11 aa, Mycobacterium tuberculosis
TSELPGWLQAN

SEQ ID NO: 58336 - protein, 11 aa, Mycobacterium tuberculosis
SELPGWLQANR

SEQ ID NO: 58337 - protein, 11 aa, Mycobacterium tuberculosis
ELPGWLQANRH

SEQ ID NO: 58338 - protein, 11 aa, Mycobacterium tuberculosis
LPGWLQANRHV

SEQ ID NO: 58339 - protein, 11 aa, Mycobacterium tuberculosis
PGWLQANRHVK

SEQ ID NO: 58340 - protein, 11 aa, Mycobacterium tuberculosis
GWLQANRHVKP

SEQ ID NO: 58341 - protein, 11 aa, Mycobacterium tuberculosis
WLQANRHVKPT

SEQ ID NO: 58342 - protein, 11 aa, Mycobacterium tuberculosis
LQANRHVKPTG

SEQ ID NO: 58343 - protein, 11 aa, Mycobacterium tuberculosis
QANRHVKPTGS

SEQ ID NO: 58344 - protein, 11 aa, Mycobacterium tuberculosis
ANRHVKPTGSA

SEQ ID NO: 58345 - protein, 11 aa, Mycobacterium tuberculosis
NRHVKPTGSAV

SEQ ID NO: 58346 - protein, 11 aa, Mycobacterium tuberculosis
RHVKPTGSAVV

SEQ ID NO: 58347 - protein, 11 aa, Mycobacterium tuberculosis
HVKPTGSAVVG

SEQ ID NO: 58348 - protein, 11 aa, Mycobacterium tuberculosis
VKPTGSAVVGL

SEQ ID NO: 58349 - protein, 11 aa, Mycobacterium tuberculosis
KPTGSAVVGLS

SEQ ID NO: 58350 - protein, 11 aa, Mycobacterium tuberculosis
PTGSAVVGLSM

SEQ ID NO: 58351 - protein, 11 aa, Mycobacterium tuberculosis
TGSAVVGLSMA

SEQ ID NO: 58352 - protein, 11 aa, Mycobacterium tuberculosis
GSAVVGLSMAA

SEQ ID NO: 58353 - protein, 11 aa, Mycobacterium tuberculosis
SAVVGLSMAAS

SEQ ID NO: 58354 - protein, 11 aa, Mycobacterium tuberculosis
AVVGLSMAASS

SEQ ID NO: 58355 - protein, 11 aa, Mycobacterium tuberculosis
VVGLSMAASSA

SEQ ID NO: 58356 - protein, 11 aa, Mycobacterium tuberculosis
VGLSMAASSAL

SEQ ID NO: 58357 - protein, 11 aa, Mycobacterium tuberculosis
GLSMAASSALT

SEQ ID NO: 58358 - protein, 11 aa, Mycobacterium tuberculosis
LSMAASSALTL

SEQ ID NO: 58359 - protein, 11 aa, Mycobacterium tuberculosis
SMAASSALTLA

SEQ ID NO: 58360 - protein, 11 aa, Mycobacterium tuberculosis
MAASSALTLAI

SEQ ID NO: 58361 - protein, 11 aa, Mycobacterium tuberculosis
AASSALTLAIY

SEQ ID NO: 58362 - protein, 11 aa, Mycobacterium tuberculosis
ASSALTLAIYH

SEQ ID NO: 58363 - protein, 11 aa, Mycobacterium tuberculosis
SSALTLAIYHP

SEQ ID NO: 58364 - protein, 11 aa, Mycobacterium tuberculosis
SALTLAIYHPQ

SEQ ID NO: 58365 - protein, 11 aa, Mycobacterium tuberculosis
ALTLAIYHPQQ

SEQ ID NO: 58366 - protein, 11 aa, Mycobacterium tuberculosis
LTLAIYHPQQF

SEQ ID NO: 58367 - protein, 11 aa, Mycobacterium tuberculosis
TLAIYHPQQFV

SEQ ID NO: 58368 - protein, 11 aa, Mycobacterium tuberculosis
LAIYHPQQFVY

SEQ ID NO: 58369 - protein, 11 aa, Mycobacterium tuberculosis
AIYHPQQFVYA

SEQ ID NO: 58370 - protein, 11 aa, Mycobacterium tuberculosis
IYHPQQFVYAG

SEQ ID NO: 58371 - protein, 11 aa, Mycobacterium tuberculosis
YHPQQFVYAGA

SEQ ID NO: 58372 - protein, 11 aa, Mycobacterium tuberculosis
HPQQFVYAGAM

SEQ ID NO: 58373 - protein, 11 aa, Mycobacterium tuberculosis
PQQFVYAGAMS

SEQ ID NO: 58374 - protein, 11 aa, Mycobacterium tuberculosis
QQFVYAGAMSG

SEQ ID NO: 58375 - protein, 11 aa, Mycobacterium tuberculosis
QFVYAGAMSGL

SEQ ID NO: 58376 - protein, 11 aa, Mycobacterium tuberculosis
FVYAGAMSGLL

SEQ ID NO: 58377 - protein, 11 aa, Mycobacterium tuberculosis
VYAGAMSGLLD

SEQ ID NO: 58378 - protein, 11 aa, Mycobacterium tuberculosis
YAGAMSGLLDP

SEQ ID NO: 58379 - protein, 11 aa, Mycobacterium tuberculosis
AGAMSGLLDPS

SEQ ID NO: 58380 - protein, 11 aa, Mycobacterium tuberculosis
GAMSGLLDPSQ

SEQ ID NO: 58381 - protein, 11 aa, Mycobacterium tuberculosis
AMSGLLDPSQA

SEQ ID NO: 58382 - protein, 11 aa, Mycobacterium tuberculosis
MSGLLDPSQAM

SEQ ID NO: 58383 - protein, 11 aa, Mycobacterium tuberculosis
SGLLDPSQAMG

SEQ ID NO: 58384 - protein, 11 aa, Mycobacterium tuberculosis
GLLDPSQAMGP

SEQ ID NO: 58385 - protein, 11 aa, Mycobacterium tuberculosis
LLDPSQAMGPT

SEQ ID NO: 58386 - protein, 11 aa, Mycobacterium tuberculosis
LDPSQAMGPTL

SEQ ID NO: 58387 - protein, 11 aa, Mycobacterium tuberculosis
DPSQAMGPTLI

SEQ ID NO: 58388 - protein, 11 aa, Mycobacterium tuberculosis
PSQAMGPTLIG

SEQ ID NO: 58389 - protein, 11 aa, Mycobacterium tuberculosis
SQAMGPTLIGL

SEQ ID NO: 58390 - protein, 11 aa, Mycobacterium tuberculosis
QAMGPTLIGLA

SEQ ID NO: 58391 - protein, 11 aa, Mycobacterium tuberculosis
AMGPTLIGLAM

SEQ ID NO: 58392 - protein, 11 aa, Mycobacterium tuberculosis
MGPTLIGLAMG

SEQ ID NO: 58393 - protein, 11 aa, Mycobacterium tuberculosis
GPTLIGLAMGD

SEQ ID NO: 58394 - protein, 11 aa, Mycobacterium tuberculosis
PTLIGLAMGDA

SEQ ID NO: 58395 - protein, 11 aa, Mycobacterium tuberculosis
TLIGLAMGDAG

SEQ ID NO: 58396 - protein, 11 aa, Mycobacterium tuberculosis
LIGLAMGDAGG

SEQ ID NO: 58397 - protein, 11 aa, Mycobacterium tuberculosis
IGLAMGDAGGY

SEQ ID NO: 58398 - protein, 11 aa, Mycobacterium tuberculosis
GLAMGDAGGYK

SEQ ID NO: 58399 - protein, 11 aa, Mycobacterium tuberculosis
LAMGDAGGYKA

SEQ ID NO: 58400 - protein, 11 aa, Mycobacterium tuberculosis
AMGDAGGYKAS

SEQ ID NO: 58401 - protein, 11 aa, Mycobacterium tuberculosis
MGDAGGYKASD

SEQ ID NO: 58402 - protein, 11 aa, Mycobacterium tuberculosis
GDAGGYKASDM

SEQ ID NO: 58403 - protein, 11 aa, Mycobacterium tuberculosis
DAGGYKASDMW

SEQ ID NO: 58404 - protein, 11 aa, Mycobacterium tuberculosis
AGGYKASDMWG

SEQ ID NO: 58405 - protein, 11 aa, Mycobacterium tuberculosis
GGYKASDMWGP

SEQ ID NO: 58406 - protein, 11 aa, Mycobacterium tuberculosis
GYKASDMWGPK

SEQ ID NO: 58407 - protein, 11 aa, Mycobacterium tuberculosis
YKASDMWGPKE

SEQ ID NO: 58408 - protein, 11 aa, Mycobacterium tuberculosis
KASDMWGPKED

SEQ ID NO: 58409 - protein, 11 aa, Mycobacterium tuberculosis
ASDMWGPKEDP

SEQ ID NO: 58410 - protein, 11 aa, Mycobacterium tuberculosis
SDMWGPKEDPA

SEQ ID NO: 58411 - protein, 11 aa, Mycobacterium tuberculosis
DMWGPKEDPAW

SEQ ID NO: 58412 - protein, 11 aa, Mycobacterium tuberculosis
MWGPKEDPAWQ

SEQ ID NO: 58413 - protein, 11 aa, Mycobacterium tuberculosis
WGPKEDPAWQR

SEQ ID NO: 58414 - protein, 11 aa, Mycobacterium tuberculosis
GPKEDPAWQRN

SEQ ID NO: 58415 - protein, 11 aa, Mycobacterium tuberculosis
PKEDPAWQRND

SEQ ID NO: 58416 - protein, 11 aa, Mycobacterium tuberculosis
KEDPAWQRNDP

SEQ ID NO: 58417 - protein, 11 aa, Mycobacterium tuberculosis
EDPAWQRNDPL

SEQ ID NO: 58418 - protein, 11 aa, Mycobacterium tuberculosis
DPAWQRNDPLL

SEQ ID NO: 58419 - protein, 11 aa, Mycobacterium tuberculosis
PAWQRNDPLLN

SEQ ID NO: 58420 - protein, 11 aa, Mycobacterium tuberculosis
AWQRNDPLLNV

SEQ ID NO: 58421 - protein, 11 aa, Mycobacterium tuberculosis
WQRNDPLLNVG

SEQ ID NO: 58422 - protein, 11 aa, Mycobacterium tuberculosis
QRNDPLLNVGK

SEQ ID NO: 58423 - protein, 11 aa, Mycobacterium tuberculosis
RNDPLLNVGKL

SEQ ID NO: 58424 - protein, 11 aa, Mycobacterium tuberculosis
NDPLLNVGKLI

SEQ ID NO: 58425 - protein, 11 aa, Mycobacterium tuberculosis
DPLLNVGKLIA

SEQ ID NO: 58426 - protein, 11 aa, Mycobacterium tuberculosis
PLLNVGKLIAN

SEQ ID NO: 58427 - protein, 11 aa, Mycobacterium tuberculosis
LLNVGKLIANN

SEQ ID NO: 58428 - protein, 11 aa, Mycobacterium tuberculosis
LNVGKLIANNT

SEQ ID NO: 58429 - protein, 11 aa, Mycobacterium tuberculosis
NVGKLIANNTR

SEQ ID NO: 58430 - protein, 11 aa, Mycobacterium tuberculosis
VGKLIANNTRV

SEQ ID NO: 58431 - protein, 11 aa, Mycobacterium tuberculosis
GKLIANNTRVW

SEQ ID NO: 58432 - protein, 11 aa, Mycobacterium tuberculosis
KLIANNTRVWV

SEQ ID NO: 58433 - protein, 11 aa, Mycobacterium tuberculosis
LIANNTRVWVY

SEQ ID NO: 58434 - protein, 11 aa, Mycobacterium tuberculosis
IANNTRVWVYC

SEQ ID NO: 58435 - protein, 11 aa, Mycobacterium tuberculosis
ANNTRVWVYCG

SEQ ID NO: 58436 - protein, 11 aa, Mycobacterium tuberculosis
NNTRVWVYCGN

SEQ ID NO: 58437 - protein, 11 aa, Mycobacterium tuberculosis
NTRVWVYCGNG

SEQ ID NO: 58438 - protein, 11 aa, Mycobacterium tuberculosis
TRVWVYCGNGK

SEQ ID NO: 58439 - protein, 11 aa, Mycobacterium tuberculosis
RVWVYCGNGKP

SEQ ID NO: 58440 - protein, 11 aa, Mycobacterium tuberculosis
VWVYCGNGKPS

SEQ ID NO: 58441 - protein, 11 aa, Mycobacterium tuberculosis
WVYCGNGKPSD

SEQ ID NO: 58442 - protein, 11 aa, Mycobacterium tuberculosis
VYCGNGKPSDL

SEQ ID NO: 58443 - protein, 11 aa, Mycobacterium tuberculosis
YCGNGKPSDLG

SEQ ID NO: 58444 - protein, 11 aa, Mycobacterium tuberculosis
CGNGKPSDLGG

SEQ ID NO: 58445 - protein, 11 aa, Mycobacterium tuberculosis
GNGKPSDLGGN

SEQ ID NO: 58446 - protein, 11 aa, Mycobacterium tuberculosis
NGKPSDLGGNN

SEQ ID NO: 58447 - protein, 11 aa, Mycobacterium tuberculosis
GKPSDLGGNNL

SEQ ID NO: 58448 - protein, 11 aa, Mycobacterium tuberculosis
KPSDLGGNNLP

SEQ ID NO: 58449 - protein, 11 aa, Mycobacterium tuberculosis
PSDLGGNNLPA

SEQ ID NO: 58450 - protein, 11 aa, Mycobacterium tuberculosis
SDLGGNNLPAK

SEQ ID NO: 58451 - protein, 11 aa, Mycobacterium tuberculosis
DLGGNNLPAKF

SEQ ID NO: 58452 - protein, 11 aa, Mycobacterium tuberculosis
LGGNNLPAKFL

SEQ ID NO: 58453 - protein, 11 aa, Mycobacterium tuberculosis
GGNNLPAKFLE

SEQ ID NO: 58454 - protein, 11 aa, Mycobacterium tuberculosis
GNNLPAKFLEG

SEQ ID NO: 58455 - protein, 11 aa, Mycobacterium tuberculosis
NNLPAKFLEGF

SEQ ID NO: 58456 - protein, 11 aa, Mycobacterium tuberculosis
NLPAKFLEGFV

SEQ ID NO: 58457 - protein, 11 aa, Mycobacterium tuberculosis
LPAKFLEGFVR

SEQ ID NO: 58458 - protein, 11 aa, Mycobacterium tuberculosis
PAKFLEGFVRT

SEQ ID NO: 58459 - protein, 11 aa, Mycobacterium tuberculosis
AKFLEGFVRTS

SEQ ID NO: 58460 - protein, 11 aa, Mycobacterium tuberculosis
KFLEGFVRTSN

SEQ ID NO: 58461 - protein, 11 aa, Mycobacterium tuberculosis
FLEGFVRTSNI

SEQ ID NO: 58462 - protein, 11 aa, Mycobacterium tuberculosis
LEGFVRTSNIK

SEQ ID NO: 58463 - protein, 11 aa, Mycobacterium tuberculosis
EGFVRTSNIKF

SEQ ID NO: 58464 - protein, 11 aa, Mycobacterium tuberculosis
GFVRTSNIKFQ

SEQ ID NO: 58465 - protein, 11 aa, Mycobacterium tuberculosis
FVRTSNIKFQD

SEQ ID NO: 58466 - protein, 11 aa, Mycobacterium tuberculosis
VRTSNIKFQDA

SEQ ID NO: 58467 - protein, 11 aa, Mycobacterium tuberculosis
RTSNIKFQDAY

SEQ ID NO: 58468 - protein, 11 aa, Mycobacterium tuberculosis
TSNIKFQDAYN

SEQ ID NO: 58469 - protein, 11 aa, Mycobacterium tuberculosis
SNIKFQDAYNA

SEQ ID NO: 58470 - protein, 11 aa, Mycobacterium tuberculosis
NIKFQDAYNAG

SEQ ID NO: 58471 - protein, 11 aa, Mycobacterium tuberculosis
IKFQDAYNAGG

SEQ ID NO: 58472 - protein, 11 aa, Mycobacterium tuberculosis
KFQDAYNAGGG

SEQ ID NO: 58473 - protein, 11 aa, Mycobacterium tuberculosis
FQDAYNAGGGH

SEQ ID NO: 58474 - protein, 11 aa, Mycobacterium tuberculosis
QDAYNAGGGHN

SEQ ID NO: 58475 - protein, 11 aa, Mycobacterium tuberculosis
DAYNAGGGHNG

SEQ ID NO: 58476 - protein, 11 aa, Mycobacterium tuberculosis
AYNAGGGHNGV

SEQ ID NO: 58477 - protein, 11 aa, Mycobacterium tuberculosis
YNAGGGHNGVF

SEQ ID NO: 58478 - protein, 11 aa, Mycobacterium tuberculosis
NAGGGHNGVFD

SEQ ID NO: 58479 - protein, 11 aa, Mycobacterium tuberculosis
AGGGHNGVFDF

SEQ ID NO: 58480 - protein, 11 aa, Mycobacterium tuberculosis
GGGHNGVFDFP

SEQ ID NO: 58481 - protein, 11 aa, Mycobacterium tuberculosis
GGHNGVFDFPD

SEQ ID NO: 58482 - protein, 11 aa, Mycobacterium tuberculosis
GHNGVFDFPDS

SEQ ID NO: 58483 - protein, 11 aa, Mycobacterium tuberculosis
HNGVFDFPDSG

SEQ ID NO: 58484 - protein, 11 aa, Mycobacterium tuberculosis
NGVFDFPDSGT

SEQ ID NO: 58485 - protein, 11 aa, Mycobacterium tuberculosis
GVFDFPDSGTH

SEQ ID NO: 58486 - protein, 11 aa, Mycobacterium tuberculosis
VFDFPDSGTHS

SEQ ID NO: 58487 - protein, 11 aa, Mycobacterium tuberculosis
FDFPDSGTHSW

SEQ ID NO: 58488 - protein, 11 aa, Mycobacterium tuberculosis
DFPDSGTHSWE

SEQ ID NO: 58489 - protein, 11 aa, Mycobacterium tuberculosis
FPDSGTHSWEY

SEQ ID NO: 58490 - protein, 11 aa, Mycobacterium tuberculosis
PDSGTHSWEYW

SEQ ID NO: 58491 - protein, 11 aa, Mycobacterium tuberculosis
DSGTHSWEYWG

SEQ ID NO: 58492 - protein, 11 aa, Mycobacterium tuberculosis
SGTHSWEYWGA

SEQ ID NO: 58493 - protein, 11 aa, Mycobacterium tuberculosis
GTHSWEYWGAQ

SEQ ID NO: 58494 - protein, 11 aa, Mycobacterium tuberculosis
THSWEYWGAQL

SEQ ID NO: 58495 - protein, 11 aa, Mycobacterium tuberculosis
HSWEYWGAQLN

SEQ ID NO: 58496 - protein, 11 aa, Mycobacterium tuberculosis
SWEYWGAQLNA

SEQ ID NO: 58497 - protein, 11 aa, Mycobacterium tuberculosis
WEYWGAQLNAM

SEQ ID NO: 58498 - protein, 11 aa, Mycobacterium tuberculosis
EYWGAQLNAMK

SEQ ID NO: 58499 - protein, 11 aa, Mycobacterium tuberculosis
YWGAQLNAMKP

SEQ ID NO: 58500 - protein, 11 aa, Mycobacterium tuberculosis
WGAQLNAMKPD

SEQ ID NO: 58501 - protein, 11 aa, Mycobacterium tuberculosis
GAQLNAMKPDL

SEQ ID NO: 58502 - protein, 11 aa, Mycobacterium tuberculosis
AQLNAMKPDLQ

SEQ ID NO: 58503 - protein, 11 aa, Mycobacterium tuberculosis
QLNAMKPDLQR

SEQ ID NO: 58504 - protein, 11 aa, Mycobacterium tuberculosis
LNAMKPDLQRA

SEQ ID NO: 58505 - protein, 11 aa, Mycobacterium tuberculosis
NAMKPDLQRAL

SEQ ID NO: 58506 - protein, 11 aa, Mycobacterium tuberculosis
AMKPDLQRALG

SEQ ID NO: 58507 - protein, 11 aa, Mycobacterium tuberculosis
MKPDLQRALGA

SEQ ID NO: 58508 - protein, 11 aa, Mycobacterium tuberculosis
KPDLQRALGAT

SEQ ID NO: 58509 - protein, 11 aa, Mycobacterium tuberculosis
PDLQRALGATP

SEQ ID NO: 58510 - protein, 11 aa, Mycobacterium tuberculosis
DLQRALGATPN

SEQ ID NO: 58511 - protein, 11 aa, Mycobacterium tuberculosis
LQRALGATPNT

SEQ ID NO: 58512 - protein, 11 aa, Mycobacterium tuberculosis
QRALGATPNTG

SEQ ID NO: 58513 - protein, 11 aa, Mycobacterium tuberculosis
RALGATPNTGP

SEQ ID NO: 58514 - protein, 11 aa, Mycobacterium tuberculosis
ALGATPNTGPA

SEQ ID NO: 58515 - protein, 11 aa, Mycobacterium tuberculosis
LGATPNTGPAP

SEQ ID NO: 58516 - protein, 11 aa, Mycobacterium tuberculosis
GATPNTGPAPQ

SEQ ID NO: 58517 - protein, 11 aa, Mycobacterium tuberculosis
ATPNTGPAPQG

SEQ ID NO: 58518 - protein, 11 aa, Mycobacterium tuberculosis
TPNTGPAPQGA

SEQ ID NO: 58519 - protein, 8 aa, Mycobacterium tuberculosis
MTDVSRKI

SEQ ID NO: 58520 - protein, 8 aa, Mycobacterium tuberculosis
TDVSRKIR

SEQ ID NO: 58521 - protein, 8 aa, Mycobacterium tuberculosis
DVSRKIRA

SEQ ID NO: 58522 - protein, 8 aa, Mycobacterium tuberculosis
VSRKIRAW

SEQ ID NO: 58523 - protein, 8 aa, Mycobacterium tuberculosis
SRKIRAWG

SEQ ID NO: 58524 - protein, 8 aa, Mycobacterium tuberculosis
RKIRAWGR

SEQ ID NO: 58525 - protein, 8 aa, Mycobacterium tuberculosis
KIRAWGRR

SEQ ID NO: 58526 - protein, 8 aa, Mycobacterium tuberculosis
IRAWGRRL

SEQ ID NO: 58527 - protein, 8 aa, Mycobacterium tuberculosis
RAWGRRLM

SEQ ID NO: 58528 - protein, 8 aa, Mycobacterium tuberculosis
AWGRRLMI

SEQ ID NO: 58529 - protein, 8 aa, Mycobacterium tuberculosis
WGRRLMIG

SEQ ID NO: 58530 - protein, 8 aa, Mycobacterium tuberculosis
GRRLMIGT

SEQ ID NO: 58531 - protein, 8 aa, Mycobacterium tuberculosis
RRLMIGTA

SEQ ID NO: 58532 - protein, 8 aa, Mycobacterium tuberculosis
RLMIGTAA

SEQ ID NO: 58533 - protein, 8 aa, Mycobacterium tuberculosis
LMIGTAAA

SEQ ID NO: 58534 - protein, 8 aa, Mycobacterium tuberculosis
MIGTAAAV

SEQ ID NO: 58535 - protein, 8 aa, Mycobacterium tuberculosis
IGTAAAVV

SEQ ID NO: 58536 - protein, 8 aa, Mycobacterium tuberculosis
GTAAAVVL

SEQ ID NO: 58537 - protein, 8 aa, Mycobacterium tuberculosis
TAAAVVLP

SEQ ID NO: 58538 - protein, 8 aa, Mycobacterium tuberculosis
AAAVVLPG

SEQ ID NO: 58539 - protein, 8 aa, Mycobacterium tuberculosis
AAVVLPGL

SEQ ID NO: 58540 - protein, 8 aa, Mycobacterium tuberculosis
AVVLPGLV

SEQ ID NO: 58541 - protein, 8 aa, Mycobacterium tuberculosis
VVLPGLVG

SEQ ID NO: 58542 - protein, 8 aa, Mycobacterium tuberculosis
VLPGLVGL

SEQ ID NO: 58543 - protein, 8 aa, Mycobacterium tuberculosis
LPGLVGLA

SEQ ID NO: 58544 - protein, 8 aa, Mycobacterium tuberculosis
PGLVGLAG

SEQ ID NO: 58545 - protein, 8 aa, Mycobacterium tuberculosis
GLVGLAGG

SEQ ID NO: 58546 - protein, 8 aa, Mycobacterium tuberculosis
LVGLAGGA

SEQ ID NO: 58547 - protein, 8 aa, Mycobacterium tuberculosis
VGLAGGAA

SEQ ID NO: 58548 - protein, 8 aa, Mycobacterium tuberculosis
GLAGGAAT

SEQ ID NO: 58549 - protein, 8 aa, Mycobacterium tuberculosis
LAGGAATA

SEQ ID NO: 58550 - protein, 8 aa, Mycobacterium tuberculosis
AGGAATAG

SEQ ID NO: 58551 - protein, 8 aa, Mycobacterium tuberculosis
GGAATAGA

SEQ ID NO: 58552 - protein, 8 aa, Mycobacterium tuberculosis
GAATAGAF

SEQ ID NO: 58553 - protein, 8 aa, Mycobacterium tuberculosis
AATAGAFS

SEQ ID NO: 58554 - protein, 8 aa, Mycobacterium tuberculosis
ATAGAFSR

SEQ ID NO: 58555 - protein, 8 aa, Mycobacterium tuberculosis
TAGAFSRP

SEQ ID NO: 58556 - protein, 8 aa, Mycobacterium tuberculosis
AGAFSRPG

SEQ ID NO: 58557 - protein, 8 aa, Mycobacterium tuberculosis
GAFSRPGL

SEQ ID NO: 58558 - protein, 8 aa, Mycobacterium tuberculosis
AFSRPGLP

SEQ ID NO: 58559 - protein, 8 aa, Mycobacterium tuberculosis
FSRPGLPV

SEQ ID NO: 58560 - protein, 8 aa, Mycobacterium tuberculosis
SRPGLPVE

SEQ ID NO: 58561 - protein, 8 aa, Mycobacterium tuberculosis
RPGLPVEY

SEQ ID NO: 58562 - protein, 8 aa, Mycobacterium tuberculosis
PGLPVEYL

SEQ ID NO: 58563 - protein, 8 aa, Mycobacterium tuberculosis
GLPVEYLQ

SEQ ID NO: 58564 - protein, 8 aa, Mycobacterium tuberculosis
LPVEYLQV

SEQ ID NO: 58565 - protein, 8 aa, Mycobacterium tuberculosis
PVEYLQVP

SEQ ID NO: 58566 - protein, 8 aa, Mycobacterium tuberculosis
VEYLQVPS

SEQ ID NO: 58567 - protein, 8 aa, Mycobacterium tuberculosis
EYLQVPSP

SEQ ID NO: 58568 - protein, 8 aa, Mycobacterium tuberculosis
YLQVPSPS

SEQ ID NO: 58569 - protein, 8 aa, Mycobacterium tuberculosis
LQVPSPSM

SEQ ID NO: 58570 - protein, 8 aa, Mycobacterium tuberculosis
QVPSPSMG

SEQ ID NO: 58571 - protein, 8 aa, Mycobacterium tuberculosis
VPSPSMGR

SEQ ID NO: 58572 - protein, 8 aa, Mycobacterium tuberculosis
PSPSMGRD

SEQ ID NO: 58573 - protein, 8 aa, Mycobacterium tuberculosis
SPSMGRDI

SEQ ID NO: 58574 - protein, 8 aa, Mycobacterium tuberculosis
PSMGRDIK

SEQ ID NO: 58575 - protein, 8 aa, Mycobacterium tuberculosis
SMGRDIKV

SEQ ID NO: 58576 - protein, 8 aa, Mycobacterium tuberculosis
MGRDIKVQ

SEQ ID NO: 58577 - protein, 8 aa, Mycobacterium tuberculosis
GRDIKVQF

SEQ ID NO: 58578 - protein, 8 aa, Mycobacterium tuberculosis
RDIKVQFQ

SEQ ID NO: 58579 - protein, 8 aa, Mycobacterium tuberculosis
DIKVQFQS

SEQ ID NO: 58580 - protein, 8 aa, Mycobacterium tuberculosis
IKVQFQSG

SEQ ID NO: 58581 - protein, 8 aa, Mycobacterium tuberculosis
KVQFQSGG

SEQ ID NO: 58582 - protein, 8 aa, Mycobacterium tuberculosis
VQFQSGGN

SEQ ID NO: 58583 - protein, 8 aa, Mycobacterium tuberculosis
QFQSGGNN

SEQ ID NO: 58584 - protein, 8 aa, Mycobacterium tuberculosis
FQSGGNNS

SEQ ID NO: 58585 - protein, 8 aa, Mycobacterium tuberculosis
QSGGNNSP

SEQ ID NO: 58586 - protein, 8 aa, Mycobacterium tuberculosis
SGGNNSPA

SEQ ID NO: 58587 - protein, 8 aa, Mycobacterium tuberculosis
GGNNSPAV

SEQ ID NO: 58588 - protein, 8 aa, Mycobacterium tuberculosis
GNNSPAVY

SEQ ID NO: 58589 - protein, 8 aa, Mycobacterium tuberculosis
NNSPAVYL

SEQ ID NO: 58590 - protein, 8 aa, Mycobacterium tuberculosis
NSPAVYLL

SEQ ID NO: 58591 - protein, 8 aa, Mycobacterium tuberculosis
SPAVYLLD

SEQ ID NO: 58592 - protein, 8 aa, Mycobacterium tuberculosis
PAVYLLDG

SEQ ID NO: 58593 - protein, 8 aa, Mycobacterium tuberculosis
AVYLLDGL

SEQ ID NO: 58594 - protein, 8 aa, Mycobacterium tuberculosis
VYLLDGLR

SEQ ID NO: 58595 - protein, 8 aa, Mycobacterium tuberculosis
YLLDGLRA

SEQ ID NO: 58596 - protein, 8 aa, Mycobacterium tuberculosis
LLDGLRAQ

SEQ ID NO: 58597 - protein, 8 aa, Mycobacterium tuberculosis
LDGLRAQD

SEQ ID NO: 58598 - protein, 8 aa, Mycobacterium tuberculosis
DGLRAQDD

SEQ ID NO: 58599 - protein, 8 aa, Mycobacterium tuberculosis
GLRAQDDY

SEQ ID NO: 58600 - protein, 8 aa, Mycobacterium tuberculosis
LRAQDDYN

SEQ ID NO: 58601 - protein, 8 aa, Mycobacterium tuberculosis
RAQDDYNG

SEQ ID NO: 58602 - protein, 8 aa, Mycobacterium tuberculosis
AQDDYNGW

SEQ ID NO: 58603 - protein, 8 aa, Mycobacterium tuberculosis
QDDYNGWD

SEQ ID NO: 58604 - protein, 8 aa, Mycobacterium tuberculosis
DDYNGWDI

SEQ ID NO: 58605 - protein, 8 aa, Mycobacterium tuberculosis
DYNGWDIN

SEQ ID NO: 58606 - protein, 8 aa, Mycobacterium tuberculosis
YNGWDINT

SEQ ID NO: 58607 - protein, 8 aa, Mycobacterium tuberculosis
NGWDINTP

SEQ ID NO: 58608 - protein, 8 aa, Mycobacterium tuberculosis
GWDINTPA

SEQ ID NO: 58609 - protein, 8 aa, Mycobacterium tuberculosis
WDINTPAF

SEQ ID NO: 58610 - protein, 8 aa, Mycobacterium tuberculosis
DINTPAFE

SEQ ID NO: 58611 - protein, 8 aa, Mycobacterium tuberculosis
INTPAFEW

SEQ ID NO: 58612 - protein, 8 aa, Mycobacterium tuberculosis
NTPAFEWY

SEQ ID NO: 58613 - protein, 8 aa, Mycobacterium tuberculosis
TPAFEWYY

SEQ ID NO: 58614 - protein, 8 aa, Mycobacterium tuberculosis
PAFEWYYQ

SEQ ID NO: 58615 - protein, 8 aa, Mycobacterium tuberculosis
AFEWYYQS

SEQ ID NO: 58616 - protein, 8 aa, Mycobacterium tuberculosis
FEWYYQSG

SEQ ID NO: 58617 - protein, 8 aa, Mycobacterium tuberculosis
EWYYQSGL

SEQ ID NO: 58618 - protein, 8 aa, Mycobacterium tuberculosis
WYYQSGLS

SEQ ID NO: 58619 - protein, 8 aa, Mycobacterium tuberculosis
YYQSGLSI

SEQ ID NO: 58620 - protein, 8 aa, Mycobacterium tuberculosis
YQSGLSIV

SEQ ID NO: 58621 - protein, 8 aa, Mycobacterium tuberculosis
QSGLSIVM

SEQ ID NO: 58622 - protein, 8 aa, Mycobacterium tuberculosis
SGLSIVMP

SEQ ID NO: 58623 - protein, 8 aa, Mycobacterium tuberculosis
GLSIVMPV

SEQ ID NO: 58624 - protein, 8 aa, Mycobacterium tuberculosis
LSIVMPVG

SEQ ID NO: 58625 - protein, 8 aa, Mycobacterium tuberculosis
SIVMPVGG

SEQ ID NO: 58626 - protein, 8 aa, Mycobacterium tuberculosis
IVMPVGGQ

SEQ ID NO: 58627 - protein, 8 aa, Mycobacterium tuberculosis
VMPVGGQS

SEQ ID NO: 58628 - protein, 8 aa, Mycobacterium tuberculosis
MPVGGQSS

SEQ ID NO: 58629 - protein, 8 aa, Mycobacterium tuberculosis
PVGGQSSF

SEQ ID NO: 58630 - protein, 8 aa, Mycobacterium tuberculosis
VGGQSSFY

SEQ ID NO: 58631 - protein, 8 aa, Mycobacterium tuberculosis
GGQSSFYS

SEQ ID NO: 58632 - protein, 8 aa, Mycobacterium tuberculosis
GQSSFYSD

SEQ ID NO: 58633 - protein, 8 aa, Mycobacterium tuberculosis
QSSFYSDW

SEQ ID NO: 58634 - protein, 8 aa, Mycobacterium tuberculosis
SSFYSDWY

SEQ ID NO: 58635 - protein, 8 aa, Mycobacterium tuberculosis
SFYSDWYS

SEQ ID NO: 58636 - protein, 8 aa, Mycobacterium tuberculosis
FYSDWYSP

SEQ ID NO: 58637 - protein, 8 aa, Mycobacterium tuberculosis
YSDWYSPA

SEQ ID NO: 58638 - protein, 8 aa, Mycobacterium tuberculosis
SDWYSPAC

SEQ ID NO: 58639 - protein, 8 aa, Mycobacterium tuberculosis
DWYSPACG

SEQ ID NO: 58640 - protein, 8 aa, Mycobacterium tuberculosis
WYSPACGK

SEQ ID NO: 58641 - protein, 8 aa, Mycobacterium tuberculosis
YSPACGKA

SEQ ID NO: 58642 - protein, 8 aa, Mycobacterium tuberculosis
SPACGKAG

SEQ ID NO: 58643 - protein, 8 aa, Mycobacterium tuberculosis
PACGKAGC

SEQ ID NO: 58644 - protein, 8 aa, Mycobacterium tuberculosis
ACGKAGCQ

SEQ ID NO: 58645 - protein, 8 aa, Mycobacterium tuberculosis
CGKAGCQT

SEQ ID NO: 58646 - protein, 8 aa, Mycobacterium tuberculosis
GKAGCQTY

SEQ ID NO: 58647 - protein, 8 aa, Mycobacterium tuberculosis
KAGCQTYK

SEQ ID NO: 58648 - protein, 8 aa, Mycobacterium tuberculosis
AGCQTYKW

SEQ ID NO: 58649 - protein, 8 aa, Mycobacterium tuberculosis
GCQTYKWE

SEQ ID NO: 58650 - protein, 8 aa, Mycobacterium tuberculosis
CQTYKWET

SEQ ID NO: 58651 - protein, 8 aa, Mycobacterium tuberculosis
QTYKWETF

SEQ ID NO: 58652 - protein, 8 aa, Mycobacterium tuberculosis
TYKWETFL

SEQ ID NO: 58653 - protein, 8 aa, Mycobacterium tuberculosis
YKWETFLT

SEQ ID NO: 58654 - protein, 8 aa, Mycobacterium tuberculosis
KWETFLTS

SEQ ID NO: 58655 - protein, 8 aa, Mycobacterium tuberculosis
WETFLTSE

SEQ ID NO: 58656 - protein, 8 aa, Mycobacterium tuberculosis
ETFLTSEL

SEQ ID NO: 58657 - protein, 8 aa, Mycobacterium tuberculosis
TFLTSELP

SEQ ID NO: 58658 - protein, 8 aa, Mycobacterium tuberculosis
FLTSELPQ

SEQ ID NO: 58659 - protein, 8 aa, Mycobacterium tuberculosis
LTSELPQW

SEQ ID NO: 58660 - protein, 8 aa, Mycobacterium tuberculosis
TSELPQWL

SEQ ID NO: 58661 - protein, 8 aa, Mycobacterium tuberculosis
SELPQWLS

SEQ ID NO: 58662 - protein, 8 aa, Mycobacterium tuberculosis
ELPQWLSA

SEQ ID NO: 58663 - protein, 8 aa, Mycobacterium tuberculosis
LPQWLSAN

SEQ ID NO: 58664 - protein, 8 aa, Mycobacterium tuberculosis
PQWLSANR

SEQ ID NO: 58665 - protein, 8 aa, Mycobacterium tuberculosis
QWLSANRA

SEQ ID NO: 58666 - protein, 8 aa, Mycobacterium tuberculosis
WLSANRAV

SEQ ID NO: 58667 - protein, 8 aa, Mycobacterium tuberculosis
LSANRAVK

SEQ ID NO: 58668 - protein, 8 aa, Mycobacterium tuberculosis
SANRAVKP

SEQ ID NO: 58669 - protein, 8 aa, Mycobacterium tuberculosis
ANRAVKPT

SEQ ID NO: 58670 - protein, 8 aa, Mycobacterium tuberculosis
NRAVKPTG

SEQ ID NO: 58671 - protein, 8 aa, Mycobacterium tuberculosis
RAVKPTGS

SEQ ID NO: 58672 - protein, 8 aa, Mycobacterium tuberculosis
AVKPTGSA

SEQ ID NO: 58673 - protein, 8 aa, Mycobacterium tuberculosis
VKPTGSAA

SEQ ID NO: 58674 - protein, 8 aa, Mycobacterium tuberculosis
KPTGSAAI

SEQ ID NO: 58675 - protein, 8 aa, Mycobacterium tuberculosis
PTGSAAIG

SEQ ID NO: 58676 - protein, 8 aa, Mycobacterium tuberculosis
TGSAAIGL

SEQ ID NO: 58677 - protein, 8 aa, Mycobacterium tuberculosis
GSAAIGLS

SEQ ID NO: 58678 - protein, 8 aa, Mycobacterium tuberculosis
SAAIGLSM

SEQ ID NO: 58679 - protein, 8 aa, Mycobacterium tuberculosis
AAIGLSMA

SEQ ID NO: 58680 - protein, 8 aa, Mycobacterium tuberculosis
AIGLSMAG

SEQ ID NO: 58681 - protein, 8 aa, Mycobacterium tuberculosis
IGLSMAGS

SEQ ID NO: 58682 - protein, 8 aa, Mycobacterium tuberculosis
GLSMAGSS

SEQ ID NO: 58683 - protein, 8 aa, Mycobacterium tuberculosis
LSMAGSSA

SEQ ID NO: 58684 - protein, 8 aa, Mycobacterium tuberculosis
SMAGSSAM

SEQ ID NO: 58685 - protein, 8 aa, Mycobacterium tuberculosis
MAGSSAMI

SEQ ID NO: 58686 - protein, 8 aa, Mycobacterium tuberculosis
AGSSAMIL

SEQ ID NO: 58687 - protein, 8 aa, Mycobacterium tuberculosis
GSSAMILA

SEQ ID NO: 58688 - protein, 8 aa, Mycobacterium tuberculosis
SSAMILAA

SEQ ID NO: 58689 - protein, 8 aa, Mycobacterium tuberculosis
SAMILAAY

SEQ ID NO: 58690 - protein, 8 aa, Mycobacterium tuberculosis
AMILAAYH

SEQ ID NO: 58691 - protein, 8 aa, Mycobacterium tuberculosis
MILAAYHP

SEQ ID NO: 58692 - protein, 8 aa, Mycobacterium tuberculosis
ILAAYHPQ

SEQ ID NO: 58693 - protein, 8 aa, Mycobacterium tuberculosis
LAAYHPQQ

SEQ ID NO: 58694 - protein, 8 aa, Mycobacterium tuberculosis
AAYHPQQF

SEQ ID NO: 58695 - protein, 8 aa, Mycobacterium tuberculosis
AYHPQQFI

SEQ ID NO: 58696 - protein, 8 aa, Mycobacterium tuberculosis
YHPQQFIY

SEQ ID NO: 58697 - protein, 8 aa, Mycobacterium tuberculosis
HPQQFIYA

SEQ ID NO: 58698 - protein, 8 aa, Mycobacterium tuberculosis
PQQFIYAG

SEQ ID NO: 58699 - protein, 8 aa, Mycobacterium tuberculosis
QQFIYAGS

SEQ ID NO: 58700 - protein, 8 aa, Mycobacterium tuberculosis
QFIYAGSL

SEQ ID NO: 58701 - protein, 8 aa, Mycobacterium tuberculosis
FIYAGSLS

SEQ ID NO: 58702 - protein, 8 aa, Mycobacterium tuberculosis
IYAGSLSA

SEQ ID NO: 58703 - protein, 8 aa, Mycobacterium tuberculosis
YAGSLSAL

SEQ ID NO: 58704 - protein, 8 aa, Mycobacterium tuberculosis
AGSLSALL

SEQ ID NO: 58705 - protein, 8 aa, Mycobacterium tuberculosis
GSLSALLD

SEQ ID NO: 58706 - protein, 8 aa, Mycobacterium tuberculosis
SLSALLDP

SEQ ID NO: 58707 - protein, 8 aa, Mycobacterium tuberculosis
LSALLDPS

SEQ ID NO: 58708 - protein, 8 aa, Mycobacterium tuberculosis
SALLDPSQ

SEQ ID NO: 58709 - protein, 8 aa, Mycobacterium tuberculosis
ALLDPSQG

SEQ ID NO: 58710 - protein, 8 aa, Mycobacterium tuberculosis
LLDPSQGM

SEQ ID NO: 58711 - protein, 8 aa, Mycobacterium tuberculosis
LDPSQGMG

SEQ ID NO: 58712 - protein, 8 aa, Mycobacterium tuberculosis
DPSQGMGP

SEQ ID NO: 58713 - protein, 8 aa, Mycobacterium tuberculosis
PSQGMGPS

SEQ ID NO: 58714 - protein, 8 aa, Mycobacterium tuberculosis
SQGMGPSL

SEQ ID NO: 58715 - protein, 8 aa, Mycobacterium tuberculosis
QGMGPSLI

SEQ ID NO: 58716 - protein, 8 aa, Mycobacterium tuberculosis
GMGPSLIG

SEQ ID NO: 58717 - protein, 8 aa, Mycobacterium tuberculosis
MGPSLIGL

SEQ ID NO: 58718 - protein, 8 aa, Mycobacterium tuberculosis
GPSLIGLA

SEQ ID NO: 58719 - protein, 8 aa, Mycobacterium tuberculosis
PSLIGLAM

SEQ ID NO: 58720 - protein, 8 aa, Mycobacterium tuberculosis
SLIGLAMG

SEQ ID NO: 58721 - protein, 8 aa, Mycobacterium tuberculosis
LIGLAMGD

SEQ ID NO: 58722 - protein, 8 aa, Mycobacterium tuberculosis
IGLAMGDA

SEQ ID NO: 58723 - protein, 8 aa, Mycobacterium tuberculosis
GLAMGDAG

SEQ ID NO: 58724 - protein, 8 aa, Mycobacterium tuberculosis
LAMGDAGG

SEQ ID NO: 58725 - protein, 8 aa, Mycobacterium tuberculosis
AMGDAGGY

SEQ ID NO: 58726 - protein, 8 aa, Mycobacterium tuberculosis
MGDAGGYK

SEQ ID NO: 58727 - protein, 8 aa, Mycobacterium tuberculosis
GDAGGYKA

SEQ ID NO: 58728 - protein, 8 aa, Mycobacterium tuberculosis
DAGGYKAA

SEQ ID NO: 58729 - protein, 8 aa, Mycobacterium tuberculosis
AGGYKAAD

SEQ ID NO: 58730 - protein, 8 aa, Mycobacterium tuberculosis
GGYKAADM

SEQ ID NO: 58731 - protein, 8 aa, Mycobacterium tuberculosis
GYKAADMW

SEQ ID NO: 58732 - protein, 8 aa, Mycobacterium tuberculosis
YKAADMWG

SEQ ID NO: 58733 - protein, 8 aa, Mycobacterium tuberculosis
KAADMWGP

SEQ ID NO: 58734 - protein, 8 aa, Mycobacterium tuberculosis
AADMWGPS

SEQ ID NO: 58735 - protein, 8 aa, Mycobacterium tuberculosis
ADMWGPSS

SEQ ID NO: 58736 - protein, 8 aa, Mycobacterium tuberculosis
DMWGPSSD

SEQ ID NO: 58737 - protein, 8 aa, Mycobacterium tuberculosis
MWGPSSDP

SEQ ID NO: 58738 - protein, 8 aa, Mycobacterium tuberculosis
WGPSSDPA

SEQ ID NO: 58739 - protein, 8 aa, Mycobacterium tuberculosis
GPSSDPAW

SEQ ID NO: 58740 - protein, 8 aa, Mycobacterium tuberculosis
PSSDPAWE

SEQ ID NO: 58741 - protein, 8 aa, Mycobacterium tuberculosis
SSDPAWER

SEQ ID NO: 58742 - protein, 8 aa, Mycobacterium tuberculosis
SDPAWERN

SEQ ID NO: 58743 - protein, 8 aa, Mycobacterium tuberculosis
DPAWERND

SEQ ID NO: 58744 - protein, 8 aa, Mycobacterium tuberculosis
PAWERNDP

SEQ ID NO: 58745 - protein, 8 aa, Mycobacterium tuberculosis
AWERNDPT

SEQ ID NO: 58746 - protein, 8 aa, Mycobacterium tuberculosis
WERNDPTQ

SEQ ID NO: 58747 - protein, 8 aa, Mycobacterium tuberculosis
ERNDPTQQ

SEQ ID NO: 58748 - protein, 8 aa, Mycobacterium tuberculosis
RNDPTQQI

SEQ ID NO: 58749 - protein, 8 aa, Mycobacterium tuberculosis
NDPTQQIP

SEQ ID NO: 58750 - protein, 8 aa, Mycobacterium tuberculosis
DPTQQIPK

SEQ ID NO: 58751 - protein, 8 aa, Mycobacterium tuberculosis
PTQQIPKL

SEQ ID NO: 58752 - protein, 8 aa, Mycobacterium tuberculosis
TQQIPKLV

SEQ ID NO: 58753 - protein, 8 aa, Mycobacterium tuberculosis
QQIPKLVA

SEQ ID NO: 58754 - protein, 8 aa, Mycobacterium tuberculosis
QIPKLVAN

SEQ ID NO: 58755 - protein, 8 aa, Mycobacterium tuberculosis
IPKLVANN

SEQ ID NO: 58756 - protein, 8 aa, Mycobacterium tuberculosis
PKLVANNT

SEQ ID NO: 58757 - protein, 8 aa, Mycobacterium tuberculosis
KLVANNTR

SEQ ID NO: 58758 - protein, 8 aa, Mycobacterium tuberculosis
LVANNTRL

SEQ ID NO: 58759 - protein, 8 aa, Mycobacterium tuberculosis
VANNTRLW

SEQ ID NO: 58760 - protein, 8 aa, Mycobacterium tuberculosis
ANNTRLWV

SEQ ID NO: 58761 - protein, 8 aa, Mycobacterium tuberculosis
NNTRLWVY

SEQ ID NO: 58762 - protein, 8 aa, Mycobacterium tuberculosis
NTRLWVYC

SEQ ID NO: 58763 - protein, 8 aa, Mycobacterium tuberculosis
TRLWVYCG

SEQ ID NO: 58764 - protein, 8 aa, Mycobacterium tuberculosis
RLWVYCGN

SEQ ID NO: 58765 - protein, 8 aa, Mycobacterium tuberculosis
LWVYCGNG

SEQ ID NO: 58766 - protein, 8 aa, Mycobacterium tuberculosis
WVYCGNGT

SEQ ID NO: 58767 - protein, 8 aa, Mycobacterium tuberculosis
VYCGNGTP

SEQ ID NO: 58768 - protein, 8 aa, Mycobacterium tuberculosis
YCGNGTPN

SEQ ID NO: 58769 - protein, 8 aa, Mycobacterium tuberculosis
CGNGTPNE

SEQ ID NO: 58770 - protein, 8 aa, Mycobacterium tuberculosis
GNGTPNEL

SEQ ID NO: 58771 - protein, 8 aa, Mycobacterium tuberculosis
NGTPNELG

SEQ ID NO: 58772 - protein, 8 aa, Mycobacterium tuberculosis
GTPNELGG

SEQ ID NO: 58773 - protein, 8 aa, Mycobacterium tuberculosis
TPNELGGA

SEQ ID NO: 58774 - protein, 8 aa, Mycobacterium tuberculosis
PNELGGAN

SEQ ID NO: 58775 - protein, 8 aa, Mycobacterium tuberculosis
NELGGANI

SEQ ID NO: 58776 - protein, 8 aa, Mycobacterium tuberculosis
ELGGANIP

SEQ ID NO: 58777 - protein, 8 aa, Mycobacterium tuberculosis
LGGANIPA

SEQ ID NO: 58778 - protein, 8 aa, Mycobacterium tuberculosis
GGANIPAE

SEQ ID NO: 58779 - protein, 8 aa, Mycobacterium tuberculosis
GANIPAEF

SEQ ID NO: 58780 - protein, 8 aa, Mycobacterium tuberculosis
ANIPAEFL

SEQ ID NO: 58781 - protein, 8 aa, Mycobacterium tuberculosis
NIPAEFLE

SEQ ID NO: 58782 - protein, 8 aa, Mycobacterium tuberculosis
IPAEFLEN

SEQ ID NO: 58783 - protein, 8 aa, Mycobacterium tuberculosis
PAEFLENF

SEQ ID NO: 58784 - protein, 8 aa, Mycobacterium tuberculosis
AEFLENFV

SEQ ID NO: 58785 - protein, 8 aa, Mycobacterium tuberculosis
EFLENFVR

SEQ ID NO: 58786 - protein, 8 aa, Mycobacterium tuberculosis
FLENFVRS

SEQ ID NO: 58787 - protein, 8 aa, Mycobacterium tuberculosis
LENFVRSS

SEQ ID NO: 58788 - protein, 8 aa, Mycobacterium tuberculosis
ENFVRSSN

SEQ ID NO: 58789 - protein, 8 aa, Mycobacterium tuberculosis
NFVRSSNL

SEQ ID NO: 58790 - protein, 8 aa, Mycobacterium tuberculosis
FVRSSNLK

SEQ ID NO: 58791 - protein, 8 aa, Mycobacterium tuberculosis
VRSSNLKF

SEQ ID NO: 58792 - protein, 8 aa, Mycobacterium tuberculosis
RSSNLKFQ

SEQ ID NO: 58793 - protein, 8 aa, Mycobacterium tuberculosis
SSNLKFQD

SEQ ID NO: 58794 - protein, 8 aa, Mycobacterium tuberculosis
SNLKFQDA

SEQ ID NO: 58795 - protein, 8 aa, Mycobacterium tuberculosis
NLKFQDAY

SEQ ID NO: 58796 - protein, 8 aa, Mycobacterium tuberculosis
LKFQDAYN

SEQ ID NO: 58797 - protein, 8 aa, Mycobacterium tuberculosis
KFQDAYNA

SEQ ID NO: 58798 - protein, 8 aa, Mycobacterium tuberculosis
FQDAYNAA

SEQ ID NO: 58799 - protein, 8 aa, Mycobacterium tuberculosis
QDAYNAAG

SEQ ID NO: 58800 - protein, 8 aa, Mycobacterium tuberculosis
DAYNAAGG

SEQ ID NO: 58801 - protein, 8 aa, Mycobacterium tuberculosis
AYNAAGGH

SEQ ID NO: 58802 - protein, 8 aa, Mycobacterium tuberculosis
YNAAGGHN

SEQ ID NO: 58803 - protein, 8 aa, Mycobacterium tuberculosis
NAAGGHNA

SEQ ID NO: 58804 - protein, 8 aa, Mycobacterium tuberculosis
AAGGHNAV

SEQ ID NO: 58805 - protein, 8 aa, Mycobacterium tuberculosis
AGGHNAVF

SEQ ID NO: 58806 - protein, 8 aa, Mycobacterium tuberculosis
GGHNAVFN

SEQ ID NO: 58807 - protein, 8 aa, Mycobacterium tuberculosis
GHNAVFNF

SEQ ID NO: 58808 - protein, 8 aa, Mycobacterium tuberculosis
HNAVFNFP

SEQ ID NO: 58809 - protein, 8 aa, Mycobacterium tuberculosis
NAVFNFPP

SEQ ID NO: 58810 - protein, 8 aa, Mycobacterium tuberculosis
AVFNFPPN

SEQ ID NO: 58811 - protein, 8 aa, Mycobacterium tuberculosis
VFNFPPNG

SEQ ID NO: 58812 - protein, 8 aa, Mycobacterium tuberculosis
FNFPPNGT

SEQ ID NO: 58813 - protein, 8 aa, Mycobacterium tuberculosis
NFPPNGTH

SEQ ID NO: 58814 - protein, 8 aa, Mycobacterium tuberculosis
FPPNGTHS

SEQ ID NO: 58815 - protein, 8 aa, Mycobacterium tuberculosis
PPNGTHSW

SEQ ID NO: 58816 - protein, 8 aa, Mycobacterium tuberculosis
PNGTHSWE

SEQ ID NO: 58817 - protein, 8 aa, Mycobacterium tuberculosis
NGTHSWEY

SEQ ID NO: 58818 - protein, 8 aa, Mycobacterium tuberculosis
GTHSWEYW

SEQ ID NO: 58819 - protein, 8 aa, Mycobacterium tuberculosis
THSWEYWG

SEQ ID NO: 58820 - protein, 8 aa, Mycobacterium tuberculosis
HSWEYWGA

SEQ ID NO: 58821 - protein, 8 aa, Mycobacterium tuberculosis
SWEYWGAQ

SEQ ID NO: 58822 - protein, 8 aa, Mycobacterium tuberculosis
WEYWGAQL

SEQ ID NO: 58823 - protein, 8 aa, Mycobacterium tuberculosis
EYWGAQLN

SEQ ID NO: 58824 - protein, 8 aa, Mycobacterium tuberculosis
YWGAQLNA

SEQ ID NO: 58825 - protein, 8 aa, Mycobacterium tuberculosis
WGAQLNAM

SEQ ID NO: 58826 - protein, 8 aa, Mycobacterium tuberculosis
GAQLNAMK

SEQ ID NO: 58827 - protein, 8 aa, Mycobacterium tuberculosis
AQLNAMKG

SEQ ID NO: 58828 - protein, 8 aa, Mycobacterium tuberculosis
QLNAMKGD

SEQ ID NO: 58829 - protein, 8 aa, Mycobacterium tuberculosis
LNAMKGDL

SEQ ID NO: 58830 - protein, 8 aa, Mycobacterium tuberculosis
NAMKGDLQ

SEQ ID NO: 58831 - protein, 8 aa, Mycobacterium tuberculosis
AMKGDLQS

SEQ ID NO: 58832 - protein, 8 aa, Mycobacterium tuberculosis
MKGDLQSS

SEQ ID NO: 58833 - protein, 8 aa, Mycobacterium tuberculosis
KGDLQSSL

SEQ ID NO: 58834 - protein, 8 aa, Mycobacterium tuberculosis
GDLQSSLG

SEQ ID NO: 58835 - protein, 8 aa, Mycobacterium tuberculosis
DLQSSLGA

SEQ ID NO: 58836 - protein, 8 aa, Mycobacterium tuberculosis
LQSSLGAG

SEQ ID NO: 58837 - protein, 9 aa, Mycobacterium tuberculosis
MTDVSRKIR

SEQ ID NO: 58838 - protein, 9 aa, Mycobacterium tuberculosis
TDVSRKIRA

SEQ ID NO: 58839 - protein, 9 aa, Mycobacterium tuberculosis
DVSRKIRAW

SEQ ID NO: 58840 - protein, 9 aa, Mycobacterium tuberculosis
VSRKIRAWG

SEQ ID NO: 58841 - protein, 9 aa, Mycobacterium tuberculosis
SRKIRAWGR

SEQ ID NO: 58842 - protein, 9 aa, Mycobacterium tuberculosis
RKIRAWGRR

SEQ ID NO: 58843 - protein, 9 aa, Mycobacterium tuberculosis
KIRAWGRRL

SEQ ID NO: 58844 - protein, 9 aa, Mycobacterium tuberculosis
IRAWGRRLM

SEQ ID NO: 58845 - protein, 9 aa, Mycobacterium tuberculosis
RAWGRRLMI

SEQ ID NO: 58846 - protein, 9 aa, Mycobacterium tuberculosis
AWGRRLMIG

SEQ ID NO: 58847 - protein, 9 aa, Mycobacterium tuberculosis
WGRRLMIGT

SEQ ID NO: 58848 - protein, 9 aa, Mycobacterium tuberculosis
GRRLMIGTA

SEQ ID NO: 58849 - protein, 9 aa, Mycobacterium tuberculosis
RRLMIGTAA

SEQ ID NO: 58850 - protein, 9 aa, Mycobacterium tuberculosis
RLMIGTAAA

SEQ ID NO: 58851 - protein, 9 aa, Mycobacterium tuberculosis
LMIGTAAAV

SEQ ID NO: 58852 - protein, 9 aa, Mycobacterium tuberculosis
MIGTAAAVV

SEQ ID NO: 58853 - protein, 9 aa, Mycobacterium tuberculosis
IGTAAAVVL

SEQ ID NO: 58854 - protein, 9 aa, Mycobacterium tuberculosis
GTAAAVVLP

SEQ ID NO: 58855 - protein, 9 aa, Mycobacterium tuberculosis
TAAAVVLPG

SEQ ID NO: 58856 - protein, 9 aa, Mycobacterium tuberculosis
AAAVVLPGL

SEQ ID NO: 58857 - protein, 9 aa, Mycobacterium tuberculosis
AAVVLPGLV

SEQ ID NO: 58858 - protein, 9 aa, Mycobacterium tuberculosis
AVVLPGLVG

SEQ ID NO: 58859 - protein, 9 aa, Mycobacterium tuberculosis
VVLPGLVGL

SEQ ID NO: 58860 - protein, 9 aa, Mycobacterium tuberculosis
VLPGLVGLA

SEQ ID NO: 58861 - protein, 9 aa, Mycobacterium tuberculosis
LPGLVGLAG

SEQ ID NO: 58862 - protein, 9 aa, Mycobacterium tuberculosis
PGLVGLAGG

SEQ ID NO: 58863 - protein, 9 aa, Mycobacterium tuberculosis
GLVGLAGGA

SEQ ID NO: 58864 - protein, 9 aa, Mycobacterium tuberculosis
LVGLAGGAA

SEQ ID NO: 58865 - protein, 9 aa, Mycobacterium tuberculosis
VGLAGGAAT

SEQ ID NO: 58866 - protein, 9 aa, Mycobacterium tuberculosis
GLAGGAATA

SEQ ID NO: 58867 - protein, 9 aa, Mycobacterium tuberculosis
LAGGAATAG

SEQ ID NO: 58868 - protein, 9 aa, Mycobacterium tuberculosis
AGGAATAGA

SEQ ID NO: 58869 - protein, 9 aa, Mycobacterium tuberculosis
GGAATAGAF

SEQ ID NO: 58870 - protein, 9 aa, Mycobacterium tuberculosis
GAATAGAFS

SEQ ID NO: 58871 - protein, 9 aa, Mycobacterium tuberculosis
AATAGAFSR

SEQ ID NO: 58872 - protein, 9 aa, Mycobacterium tuberculosis
ATAGAFSRP

SEQ ID NO: 58873 - protein, 9 aa, Mycobacterium tuberculosis
TAGAFSRPG

SEQ ID NO: 58874 - protein, 9 aa, Mycobacterium tuberculosis
AGAFSRPGL

SEQ ID NO: 58875 - protein, 9 aa, Mycobacterium tuberculosis
GAFSRPGLP

SEQ ID NO: 58876 - protein, 9 aa, Mycobacterium tuberculosis
AFSRPGLPV

SEQ ID NO: 58877 - protein, 9 aa, Mycobacterium tuberculosis
FSRPGLPVE

SEQ ID NO: 58878 - protein, 9 aa, Mycobacterium tuberculosis
SRPGLPVEY

SEQ ID NO: 58879 - protein, 9 aa, Mycobacterium tuberculosis
RPGLPVEYL

SEQ ID NO: 58880 - protein, 9 aa, Mycobacterium tuberculosis
PGLPVEYLQ

SEQ ID NO: 58881 - protein, 9 aa, Mycobacterium tuberculosis
GLPVEYLQV

SEQ ID NO: 58882 - protein, 9 aa, Mycobacterium tuberculosis
LPVEYLQVP

SEQ ID NO: 58883 - protein, 9 aa, Mycobacterium tuberculosis
PVEYLQVPS

SEQ ID NO: 58884 - protein, 9 aa, Mycobacterium tuberculosis
VEYLQVPSP

SEQ ID NO: 58885 - protein, 9 aa, Mycobacterium tuberculosis
EYLQVPSPS

SEQ ID NO: 58886 - protein, 9 aa, Mycobacterium tuberculosis
YLQVPSPSM

SEQ ID NO: 58887 - protein, 9 aa, Mycobacterium tuberculosis
LQVPSPSMG

SEQ ID NO: 58888 - protein, 9 aa, Mycobacterium tuberculosis
QVPSPSMGR

SEQ ID NO: 58889 - protein, 9 aa, Mycobacterium tuberculosis
VPSPSMGRD

SEQ ID NO: 58890 - protein, 9 aa, Mycobacterium tuberculosis
PSPSMGRDI

SEQ ID NO: 58891 - protein, 9 aa, Mycobacterium tuberculosis
SPSMGRDIK

SEQ ID NO: 58892 - protein, 9 aa, Mycobacterium tuberculosis
PSMGRDIKV

SEQ ID NO: 58893 - protein, 9 aa, Mycobacterium tuberculosis
SMGRDIKVQ

SEQ ID NO: 58894 - protein, 9 aa, Mycobacterium tuberculosis
MGRDIKVQF

SEQ ID NO: 58895 - protein, 9 aa, Mycobacterium tuberculosis
GRDIKVQFQ

SEQ ID NO: 58896 - protein, 9 aa, Mycobacterium tuberculosis
RDIKVQFQS

SEQ ID NO: 58897 - protein, 9 aa, Mycobacterium tuberculosis
DIKVQFQSG

SEQ ID NO: 58898 - protein, 9 aa, Mycobacterium tuberculosis
IKVQFQSGG

SEQ ID NO: 58899 - protein, 9 aa, Mycobacterium tuberculosis
KVQFQSGGN

SEQ ID NO: 58900 - protein, 9 aa, Mycobacterium tuberculosis
VQFQSGGNN

SEQ ID NO: 58901 - protein, 9 aa, Mycobacterium tuberculosis
QFQSGGNNS

SEQ ID NO: 58902 - protein, 9 aa, Mycobacterium tuberculosis
FQSGGNNSP

SEQ ID NO: 58903 - protein, 9 aa, Mycobacterium tuberculosis
QSGGNNSPA

SEQ ID NO: 58904 - protein, 9 aa, Mycobacterium tuberculosis
SGGNNSPAV

SEQ ID NO: 58905 - protein, 9 aa, Mycobacterium tuberculosis
GGNNSPAVY

SEQ ID NO: 58906 - protein, 9 aa, Mycobacterium tuberculosis
GNNSPAVYL

SEQ ID NO: 58907 - protein, 9 aa, Mycobacterium tuberculosis
NNSPAVYLL

SEQ ID NO: 58908 - protein, 9 aa, Mycobacterium tuberculosis
NSPAVYLLD

SEQ ID NO: 58909 - protein, 9 aa, Mycobacterium tuberculosis
SPAVYLLDG

SEQ ID NO: 58910 - protein, 9 aa, Mycobacterium tuberculosis
PAVYLLDGL

SEQ ID NO: 58911 - protein, 9 aa, Mycobacterium tuberculosis
AVYLLDGLR

SEQ ID NO: 58912 - protein, 9 aa, Mycobacterium tuberculosis
VYLLDGLRA

SEQ ID NO: 58913 - protein, 9 aa, Mycobacterium tuberculosis
YLLDGLRAQ

SEQ ID NO: 58914 - protein, 9 aa, Mycobacterium tuberculosis
LLDGLRAQD

SEQ ID NO: 58915 - protein, 9 aa, Mycobacterium tuberculosis
LDGLRAQDD

SEQ ID NO: 58916 - protein, 9 aa, Mycobacterium tuberculosis
DGLRAQDDY

SEQ ID NO: 58917 - protein, 9 aa, Mycobacterium tuberculosis
GLRAQDDYN

SEQ ID NO: 58918 - protein, 9 aa, Mycobacterium tuberculosis
LRAQDDYNG

SEQ ID NO: 58919 - protein, 9 aa, Mycobacterium tuberculosis
RAQDDYNGW

SEQ ID NO: 58920 - protein, 9 aa, Mycobacterium tuberculosis
AQDDYNGWD

SEQ ID NO: 58921 - protein, 9 aa, Mycobacterium tuberculosis
QDDYNGWDI

SEQ ID NO: 58922 - protein, 9 aa, Mycobacterium tuberculosis
DDYNGWDIN

SEQ ID NO: 58923 - protein, 9 aa, Mycobacterium tuberculosis
DYNGWDINT

SEQ ID NO: 58924 - protein, 9 aa, Mycobacterium tuberculosis
YNGWDINTP

SEQ ID NO: 58925 - protein, 9 aa, Mycobacterium tuberculosis
NGWDINTPA

SEQ ID NO: 58926 - protein, 9 aa, Mycobacterium tuberculosis
GWDINTPAF

SEQ ID NO: 58927 - protein, 9 aa, Mycobacterium tuberculosis
WDINTPAFE

SEQ ID NO: 58928 - protein, 9 aa, Mycobacterium tuberculosis
DINTPAFEW

SEQ ID NO: 58929 - protein, 9 aa, Mycobacterium tuberculosis
INTPAFEWY

SEQ ID NO: 58930 - protein, 9 aa, Mycobacterium tuberculosis
NTPAFEWYY

SEQ ID NO: 58931 - protein, 9 aa, Mycobacterium tuberculosis
TPAFEWYYQ

SEQ ID NO: 58932 - protein, 9 aa, Mycobacterium tuberculosis
PAFEWYYQS

SEQ ID NO: 58933 - protein, 9 aa, Mycobacterium tuberculosis
AFEWYYQSG

SEQ ID NO: 58934 - protein, 9 aa, Mycobacterium tuberculosis
FEWYYQSGL

SEQ ID NO: 58935 - protein, 9 aa, Mycobacterium tuberculosis
EWYYQSGLS

SEQ ID NO: 58936 - protein, 9 aa, Mycobacterium tuberculosis
WYYQSGLSI

SEQ ID NO: 58937 - protein, 9 aa, Mycobacterium tuberculosis
YYQSGLSIV

SEQ ID NO: 58938 - protein, 9 aa, Mycobacterium tuberculosis
YQSGLSIVM

SEQ ID NO: 58939 - protein, 9 aa, Mycobacterium tuberculosis
QSGLSIVMP

SEQ ID NO: 58940 - protein, 9 aa, Mycobacterium tuberculosis
SGLSIVMPV

SEQ ID NO: 58941 - protein, 9 aa, Mycobacterium tuberculosis
GLSIVMPVG

SEQ ID NO: 58942 - protein, 9 aa, Mycobacterium tuberculosis
LSIVMPVGG

SEQ ID NO: 58943 - protein, 9 aa, Mycobacterium tuberculosis
SIVMPVGGQ

SEQ ID NO: 58944 - protein, 9 aa, Mycobacterium tuberculosis
IVMPVGGQS

SEQ ID NO: 58945 - protein, 9 aa, Mycobacterium tuberculosis
VMPVGGQSS

SEQ ID NO: 58946 - protein, 9 aa, Mycobacterium tuberculosis
MPVGGQSSF

SEQ ID NO: 58947 - protein, 9 aa, Mycobacterium tuberculosis
PVGGQSSFY

SEQ ID NO: 58948 - protein, 9 aa, Mycobacterium tuberculosis
VGGQSSFYS

SEQ ID NO: 58949 - protein, 9 aa, Mycobacterium tuberculosis
GGQSSFYSD

SEQ ID NO: 58950 - protein, 9 aa, Mycobacterium tuberculosis
GQSSFYSDW

SEQ ID NO: 58951 - protein, 9 aa, Mycobacterium tuberculosis
QSSFYSDWY

SEQ ID NO: 58952 - protein, 9 aa, Mycobacterium tuberculosis
SSFYSDWYS

SEQ ID NO: 58953 - protein, 9 aa, Mycobacterium tuberculosis
SFYSDWYSP

SEQ ID NO: 58954 - protein, 9 aa, Mycobacterium tuberculosis
FYSDWYSPA

SEQ ID NO: 58955 - protein, 9 aa, Mycobacterium tuberculosis
YSDWYSPAC

SEQ ID NO: 58956 - protein, 9 aa, Mycobacterium tuberculosis
SDWYSPACG

SEQ ID NO: 58957 - protein, 9 aa, Mycobacterium tuberculosis
DWYSPACGK

SEQ ID NO: 58958 - protein, 9 aa, Mycobacterium tuberculosis
WYSPACGKA

SEQ ID NO: 58959 - protein, 9 aa, Mycobacterium tuberculosis
YSPACGKAG

SEQ ID NO: 58960 - protein, 9 aa, Mycobacterium tuberculosis
SPACGKAGC

SEQ ID NO: 58961 - protein, 9 aa, Mycobacterium tuberculosis
PACGKAGCQ

SEQ ID NO: 58962 - protein, 9 aa, Mycobacterium tuberculosis
ACGKAGCQT

SEQ ID NO: 58963 - protein, 9 aa, Mycobacterium tuberculosis
CGKAGCQTY

SEQ ID NO: 58964 - protein, 9 aa, Mycobacterium tuberculosis
GKAGCQTYK

SEQ ID NO: 58965 - protein, 9 aa, Mycobacterium tuberculosis
KAGCQTYKW

SEQ ID NO: 58966 - protein, 9 aa, Mycobacterium tuberculosis
AGCQTYKWE

SEQ ID NO: 58967 - protein, 9 aa, Mycobacterium tuberculosis
GCQTYKWET

SEQ ID NO: 58968 - protein, 9 aa, Mycobacterium tuberculosis
CQTYKWETF

SEQ ID NO: 58969 - protein, 9 aa, Mycobacterium tuberculosis
QTYKWETFL

SEQ ID NO: 58970 - protein, 9 aa, Mycobacterium tuberculosis
TYKWETFLT

SEQ ID NO: 58971 - protein, 9 aa, Mycobacterium tuberculosis
YKWETFLTS

SEQ ID NO: 58972 - protein, 9 aa, Mycobacterium tuberculosis
KWETFLTSE

SEQ ID NO: 58973 - protein, 9 aa, Mycobacterium tuberculosis
WETFLTSEL

SEQ ID NO: 58974 - protein, 9 aa, Mycobacterium tuberculosis
ETFLTSELP

SEQ ID NO: 58975 - protein, 9 aa, Mycobacterium tuberculosis
TFLTSELPQ

SEQ ID NO: 58976 - protein, 9 aa, Mycobacterium tuberculosis
FLTSELPQW

SEQ ID NO: 58977 - protein, 9 aa, Mycobacterium tuberculosis
LTSELPQWL

SEQ ID NO: 58978 - protein, 9 aa, Mycobacterium tuberculosis
TSELPQWLS

SEQ ID NO: 58979 - protein, 9 aa, Mycobacterium tuberculosis
SELPQWLSA

SEQ ID NO: 58980 - protein, 9 aa, Mycobacterium tuberculosis
ELPQWLSAN

SEQ ID NO: 58981 - protein, 9 aa, Mycobacterium tuberculosis
LPQWLSANR

SEQ ID NO: 58982 - protein, 9 aa, Mycobacterium tuberculosis
PQWLSANRA

SEQ ID NO: 58983 - protein, 9 aa, Mycobacterium tuberculosis
QWLSANRAV

SEQ ID NO: 58984 - protein, 9 aa, Mycobacterium tuberculosis
WLSANRAVK

SEQ ID NO: 58985 - protein, 9 aa, Mycobacterium tuberculosis
LSANRAVKP

SEQ ID NO: 58986 - protein, 9 aa, Mycobacterium tuberculosis
SANRAVKPT

SEQ ID NO: 58987 - protein, 9 aa, Mycobacterium tuberculosis
ANRAVKPTG

SEQ ID NO: 58988 - protein, 9 aa, Mycobacterium tuberculosis
NRAVKPTGS

SEQ ID NO: 58989 - protein, 9 aa, Mycobacterium tuberculosis
RAVKPTGSA

SEQ ID NO: 58990 - protein, 9 aa, Mycobacterium tuberculosis
AVKPTGSAA

SEQ ID NO: 58991 - protein, 9 aa, Mycobacterium tuberculosis
VKPTGSAAI

SEQ ID NO: 58992 - protein, 9 aa, Mycobacterium tuberculosis
KPTGSAAIG

SEQ ID NO: 58993 - protein, 9 aa, Mycobacterium tuberculosis
PTGSAAIGL

SEQ ID NO: 58994 - protein, 9 aa, Mycobacterium tuberculosis
TGSAAIGLS

SEQ ID NO: 58995 - protein, 9 aa, Mycobacterium tuberculosis
GSAAIGLSM

SEQ ID NO: 58996 - protein, 9 aa, Mycobacterium tuberculosis
SAAIGLSMA

SEQ ID NO: 58997 - protein, 9 aa, Mycobacterium tuberculosis
AAIGLSMAG

SEQ ID NO: 58998 - protein, 9 aa, Mycobacterium tuberculosis
AIGLSMAGS

SEQ ID NO: 58999 - protein, 9 aa, Mycobacterium tuberculosis
IGLSMAGSS

SEQ ID NO: 59000 - protein, 9 aa, Mycobacterium tuberculosis
GLSMAGSSA

SEQ ID NO: 59001 - protein, 9 aa, Mycobacterium tuberculosis
LSMAGSSAM

SEQ ID NO: 59002 - protein, 9 aa, Mycobacterium tuberculosis
SMAGSSAMI

SEQ ID NO: 59003 - protein, 9 aa, Mycobacterium tuberculosis
MAGSSAMIL

SEQ ID NO: 59004 - protein, 9 aa, Mycobacterium tuberculosis
AGSSAMILA

SEQ ID NO: 59005 - protein, 9 aa, Mycobacterium tuberculosis
GSSAMILAA

SEQ ID NO: 59006 - protein, 9 aa, Mycobacterium tuberculosis
SSAMILAAY

SEQ ID NO: 59007 - protein, 9 aa, Mycobacterium tuberculosis
SAMILAAYH

SEQ ID NO: 59008 - protein, 9 aa, Mycobacterium tuberculosis
AMILAAYHP

SEQ ID NO: 59009 - protein, 9 aa, Mycobacterium tuberculosis
MILAAYHPQ

SEQ ID NO: 59010 - protein, 9 aa, Mycobacterium tuberculosis
ILAAYHPQQ

SEQ ID NO: 59011 - protein, 9 aa, Mycobacterium tuberculosis
LAAYHPQQF

SEQ ID NO: 59012 - protein, 9 aa, Mycobacterium tuberculosis
AAYHPQQFI

SEQ ID NO: 59013 - protein, 9 aa, Mycobacterium tuberculosis
AYHPQQFIY

SEQ ID NO: 59014 - protein, 9 aa, Mycobacterium tuberculosis
YHPQQFIYA

SEQ ID NO: 59015 - protein, 9 aa, Mycobacterium tuberculosis
HPQQFIYAG

SEQ ID NO: 59016 - protein, 9 aa, Mycobacterium tuberculosis
PQQFIYAGS

SEQ ID NO: 59017 - protein, 9 aa, Mycobacterium tuberculosis
QQFIYAGSL

SEQ ID NO: 59018 - protein, 9 aa, Mycobacterium tuberculosis
QFIYAGSLS

SEQ ID NO: 59019 - protein, 9 aa, Mycobacterium tuberculosis
FIYAGSLSA

SEQ ID NO: 59020 - protein, 9 aa, Mycobacterium tuberculosis
IYAGSLSAL

SEQ ID NO: 59021 - protein, 9 aa, Mycobacterium tuberculosis
YAGSLSALL

SEQ ID NO: 59022 - protein, 9 aa, Mycobacterium tuberculosis
AGSLSALLD

SEQ ID NO: 59023 - protein, 9 aa, Mycobacterium tuberculosis
GSLSALLDP

SEQ ID NO: 59024 - protein, 9 aa, Mycobacterium tuberculosis
SLSALLDPS

SEQ ID NO: 59025 - protein, 9 aa, Mycobacterium tuberculosis
LSALLDPSQ

SEQ ID NO: 59026 - protein, 9 aa, Mycobacterium tuberculosis
SALLDPSQG

SEQ ID NO: 59027 - protein, 9 aa, Mycobacterium tuberculosis
ALLDPSQGM

SEQ ID NO: 59028 - protein, 9 aa, Mycobacterium tuberculosis
LLDPSQGMG

SEQ ID NO: 59029 - protein, 9 aa, Mycobacterium tuberculosis
LDPSQGMGP

SEQ ID NO: 59030 - protein, 9 aa, Mycobacterium tuberculosis
DPSQGMGPS

SEQ ID NO: 59031 - protein, 9 aa, Mycobacterium tuberculosis
PSQGMGPSL

SEQ ID NO: 59032 - protein, 9 aa, Mycobacterium tuberculosis
SQGMGPSLI

SEQ ID NO: 59033 - protein, 9 aa, Mycobacterium tuberculosis
QGMGPSLIG

SEQ ID NO: 59034 - protein, 9 aa, Mycobacterium tuberculosis
GMGPSLIGL

SEQ ID NO: 59035 - protein, 9 aa, Mycobacterium tuberculosis
MGPSLIGLA

SEQ ID NO: 59036 - protein, 9 aa, Mycobacterium tuberculosis
GPSLIGLAM

SEQ ID NO: 59037 - protein, 9 aa, Mycobacterium tuberculosis
PSLIGLAMG

SEQ ID NO: 59038 - protein, 9 aa, Mycobacterium tuberculosis
SLIGLAMGD

SEQ ID NO: 59039 - protein, 9 aa, Mycobacterium tuberculosis
LIGLAMGDA

SEQ ID NO: 59040 - protein, 9 aa, Mycobacterium tuberculosis
IGLAMGDAG

SEQ ID NO: 59041 - protein, 9 aa, Mycobacterium tuberculosis
GLAMGDAGG

SEQ ID NO: 59042 - protein, 9 aa, Mycobacterium tuberculosis
LAMGDAGGY

SEQ ID NO: 59043 - protein, 9 aa, Mycobacterium tuberculosis
AMGDAGGYK

SEQ ID NO: 59044 - protein, 9 aa, Mycobacterium tuberculosis
MGDAGGYKA

SEQ ID NO: 59045 - protein, 9 aa, Mycobacterium tuberculosis
GDAGGYKAA

SEQ ID NO: 59046 - protein, 9 aa, Mycobacterium tuberculosis
DAGGYKAAD

SEQ ID NO: 59047 - protein, 9 aa, Mycobacterium tuberculosis
AGGYKAADM

SEQ ID NO: 59048 - protein, 9 aa, Mycobacterium tuberculosis
GGYKAADMW

SEQ ID NO: 59049 - protein, 9 aa, Mycobacterium tuberculosis
GYKAADMWG

SEQ ID NO: 59050 - protein, 9 aa, Mycobacterium tuberculosis
YKAADMWGP

SEQ ID NO: 59051 - protein, 9 aa, Mycobacterium tuberculosis
KAADMWGPS

SEQ ID NO: 59052 - protein, 9 aa, Mycobacterium tuberculosis
AADMWGPSS

SEQ ID NO: 59053 - protein, 9 aa, Mycobacterium tuberculosis
ADMWGPSSD

SEQ ID NO: 59054 - protein, 9 aa, Mycobacterium tuberculosis
DMWGPSSDP

SEQ ID NO: 59055 - protein, 9 aa, Mycobacterium tuberculosis
MWGPSSDPA

SEQ ID NO: 59056 - protein, 9 aa, Mycobacterium tuberculosis
WGPSSDPAW

SEQ ID NO: 59057 - protein, 9 aa, Mycobacterium tuberculosis
GPSSDPAWE

SEQ ID NO: 59058 - protein, 9 aa, Mycobacterium tuberculosis
PSSDPAWER

SEQ ID NO: 59059 - protein, 9 aa, Mycobacterium tuberculosis
SSDPAWERN

SEQ ID NO: 59060 - protein, 9 aa, Mycobacterium tuberculosis
SDPAWERND

SEQ ID NO: 59061 - protein, 9 aa, Mycobacterium tuberculosis
DPAWERNDP

SEQ ID NO: 59062 - protein, 9 aa, Mycobacterium tuberculosis
PAWERNDPT

SEQ ID NO: 59063 - protein, 9 aa, Mycobacterium tuberculosis
AWERNDPTQ

SEQ ID NO: 59064 - protein, 9 aa, Mycobacterium tuberculosis
WERNDPTQQ

SEQ ID NO: 59065 - protein, 9 aa, Mycobacterium tuberculosis
ERNDPTQQI

SEQ ID NO: 59066 - protein, 9 aa, Mycobacterium tuberculosis
RNDPTQQIP

SEQ ID NO: 59067 - protein, 9 aa, Mycobacterium tuberculosis
NDPTQQIPK

SEQ ID NO: 59068 - protein, 9 aa, Mycobacterium tuberculosis
DPTQQIPKL

SEQ ID NO: 59069 - protein, 9 aa, Mycobacterium tuberculosis
PTQQIPKLV

SEQ ID NO: 59070 - protein, 9 aa, Mycobacterium tuberculosis
TQQIPKLVA

SEQ ID NO: 59071 - protein, 9 aa, Mycobacterium tuberculosis
QQIPKLVAN

SEQ ID NO: 59072 - protein, 9 aa, Mycobacterium tuberculosis
QIPKLVANN

SEQ ID NO: 59073 - protein, 9 aa, Mycobacterium tuberculosis
IPKLVANNT

SEQ ID NO: 59074 - protein, 9 aa, Mycobacterium tuberculosis
PKLVANNTR

SEQ ID NO: 59075 - protein, 9 aa, Mycobacterium tuberculosis
KLVANNTRL

SEQ ID NO: 59076 - protein, 9 aa, Mycobacterium tuberculosis
LVANNTRLW

SEQ ID NO: 59077 - protein, 9 aa, Mycobacterium tuberculosis
VANNTRLWV

SEQ ID NO: 59078 - protein, 9 aa, Mycobacterium tuberculosis
ANNTRLWVY

SEQ ID NO: 59079 - protein, 9 aa, Mycobacterium tuberculosis
NNTRLWVYC

SEQ ID NO: 59080 - protein, 9 aa, Mycobacterium tuberculosis
NTRLWVYCG

SEQ ID NO: 59081 - protein, 9 aa, Mycobacterium tuberculosis
TRLWVYCGN

SEQ ID NO: 59082 - protein, 9 aa, Mycobacterium tuberculosis
RLWVYCGNG

SEQ ID NO: 59083 - protein, 9 aa, Mycobacterium tuberculosis
LWVYCGNGT

SEQ ID NO: 59084 - protein, 9 aa, Mycobacterium tuberculosis
WVYCGNGTP

SEQ ID NO: 59085 - protein, 9 aa, Mycobacterium tuberculosis
VYCGNGTPN

SEQ ID NO: 59086 - protein, 9 aa, Mycobacterium tuberculosis
YCGNGTPNE

SEQ ID NO: 59087 - protein, 9 aa, Mycobacterium tuberculosis
CGNGTPNEL

SEQ ID NO: 59088 - protein, 9 aa, Mycobacterium tuberculosis
GNGTPNELG

SEQ ID NO: 59089 - protein, 9 aa, Mycobacterium tuberculosis
NGTPNELGG

SEQ ID NO: 59090 - protein, 9 aa, Mycobacterium tuberculosis
GTPNELGGA

SEQ ID NO: 59091 - protein, 9 aa, Mycobacterium tuberculosis
TPNELGGAN

SEQ ID NO: 59092 - protein, 9 aa, Mycobacterium tuberculosis
PNELGGANI

SEQ ID NO: 59093 - protein, 9 aa, Mycobacterium tuberculosis
NELGGANIP

SEQ ID NO: 59094 - protein, 9 aa, Mycobacterium tuberculosis
ELGGANIPA

SEQ ID NO: 59095 - protein, 9 aa, Mycobacterium tuberculosis
LGGANIPAE

SEQ ID NO: 59096 - protein, 9 aa, Mycobacterium tuberculosis
GGANIPAEF

SEQ ID NO: 59097 - protein, 9 aa, Mycobacterium tuberculosis
GANIPAEFL

SEQ ID NO: 59098 - protein, 9 aa, Mycobacterium tuberculosis
ANIPAEFLE

SEQ ID NO: 59099 - protein, 9 aa, Mycobacterium tuberculosis
NIPAEFLEN

SEQ ID NO: 59100 - protein, 9 aa, Mycobacterium tuberculosis
IPAEFLENF

SEQ ID NO: 59101 - protein, 9 aa, Mycobacterium tuberculosis
PAEFLENFV

SEQ ID NO: 59102 - protein, 9 aa, Mycobacterium tuberculosis
AEFLENFVR

SEQ ID NO: 59103 - protein, 9 aa, Mycobacterium tuberculosis
EFLENFVRS

SEQ ID NO: 59104 - protein, 9 aa, Mycobacterium tuberculosis
FLENFVRSS

SEQ ID NO: 59105 - protein, 9 aa, Mycobacterium tuberculosis
LENFVRSSN

SEQ ID NO: 59106 - protein, 9 aa, Mycobacterium tuberculosis
ENFVRSSNL

SEQ ID NO: 59107 - protein, 9 aa, Mycobacterium tuberculosis
NFVRSSNLK

SEQ ID NO: 59108 - protein, 9 aa, Mycobacterium tuberculosis
FVRSSNLKF

SEQ ID NO: 59109 - protein, 9 aa, Mycobacterium tuberculosis
VRSSNLKFQ

SEQ ID NO: 59110 - protein, 9 aa, Mycobacterium tuberculosis
RSSNLKFQD

SEQ ID NO: 59111 - protein, 9 aa, Mycobacterium tuberculosis
SSNLKFQDA

SEQ ID NO: 59112 - protein, 9 aa, Mycobacterium tuberculosis
SNLKFQDAY

SEQ ID NO: 59113 - protein, 9 aa, Mycobacterium tuberculosis
NLKFQDAYN

SEQ ID NO: 59114 - protein, 9 aa, Mycobacterium tuberculosis
LKFQDAYNA

SEQ ID NO: 59115 - protein, 9 aa, Mycobacterium tuberculosis
KFQDAYNAA

SEQ ID NO: 59116 - protein, 9 aa, Mycobacterium tuberculosis
FQDAYNAAG

SEQ ID NO: 59117 - protein, 9 aa, Mycobacterium tuberculosis
QDAYNAAGG

SEQ ID NO: 59118 - protein, 9 aa, Mycobacterium tuberculosis
DAYNAAGGH

SEQ ID NO: 59119 - protein, 9 aa, Mycobacterium tuberculosis
AYNAAGGHN

SEQ ID NO: 59120 - protein, 9 aa, Mycobacterium tuberculosis
YNAAGGHNA

SEQ ID NO: 59121 - protein, 9 aa, Mycobacterium tuberculosis
NAAGGHNAV

SEQ ID NO: 59122 - protein, 9 aa, Mycobacterium tuberculosis
AAGGHNAVF

SEQ ID NO: 59123 - protein, 9 aa, Mycobacterium tuberculosis
AGGHNAVFN

SEQ ID NO: 59124 - protein, 9 aa, Mycobacterium tuberculosis
GGHNAVFNF

SEQ ID NO: 59125 - protein, 9 aa, Mycobacterium tuberculosis
GHNAVFNFP

SEQ ID NO: 59126 - protein, 9 aa, Mycobacterium tuberculosis
HNAVFNFPP

SEQ ID NO: 59127 - protein, 9 aa, Mycobacterium tuberculosis
NAVFNFPPN

SEQ ID NO: 59128 - protein, 9 aa, Mycobacterium tuberculosis
AVFNFPPNG

SEQ ID NO: 59129 - protein, 9 aa, Mycobacterium tuberculosis
VFNFPPNGT

SEQ ID NO: 59130 - protein, 9 aa, Mycobacterium tuberculosis
FNFPPNGTH

SEQ ID NO: 59131 - protein, 9 aa, Mycobacterium tuberculosis
NFPPNGTHS

SEQ ID NO: 59132 - protein, 9 aa, Mycobacterium tuberculosis
FPPNGTHSW

SEQ ID NO: 59133 - protein, 9 aa, Mycobacterium tuberculosis
PPNGTHSWE

SEQ ID NO: 59134 - protein, 9 aa, Mycobacterium tuberculosis
PNGTHSWEY

SEQ ID NO: 59135 - protein, 9 aa, Mycobacterium tuberculosis
NGTHSWEYW

SEQ ID NO: 59136 - protein, 9 aa, Mycobacterium tuberculosis
GTHSWEYWG

SEQ ID NO: 59137 - protein, 9 aa, Mycobacterium tuberculosis
THSWEYWGA

SEQ ID NO: 59138 - protein, 9 aa, Mycobacterium tuberculosis
HSWEYWGAQ

SEQ ID NO: 59139 - protein, 9 aa, Mycobacterium tuberculosis
SWEYWGAQL

SEQ ID NO: 59140 - protein, 9 aa, Mycobacterium tuberculosis
WEYWGAQLN

SEQ ID NO: 59141 - protein, 9 aa, Mycobacterium tuberculosis
EYWGAQLNA

SEQ ID NO: 59142 - protein, 9 aa, Mycobacterium tuberculosis
YWGAQLNAM

SEQ ID NO: 59143 - protein, 9 aa, Mycobacterium tuberculosis
WGAQLNAMK

SEQ ID NO: 59144 - protein, 9 aa, Mycobacterium tuberculosis
GAQLNAMKG

SEQ ID NO: 59145 - protein, 9 aa, Mycobacterium tuberculosis
AQLNAMKGD

SEQ ID NO: 59146 - protein, 9 aa, Mycobacterium tuberculosis
QLNAMKGDL

SEQ ID NO: 59147 - protein, 9 aa, Mycobacterium tuberculosis
LNAMKGDLQ

SEQ ID NO: 59148 - protein, 9 aa, Mycobacterium tuberculosis
NAMKGDLQS

SEQ ID NO: 59149 - protein, 9 aa, Mycobacterium tuberculosis
AMKGDLQSS

SEQ ID NO: 59150 - protein, 9 aa, Mycobacterium tuberculosis
MKGDLQSSL

SEQ ID NO: 59151 - protein, 9 aa, Mycobacterium tuberculosis
KGDLQSSLG

SEQ ID NO: 59152 - protein, 9 aa, Mycobacterium tuberculosis
GDLQSSLGA

SEQ ID NO: 59153 - protein, 9 aa, Mycobacterium tuberculosis
DLQSSLGAG

SEQ ID NO: 59154 - protein, 10 aa, Mycobacterium tuberculosis
MTDVSRKIRA

SEQ ID NO: 59155 - protein, 10 aa, Mycobacterium tuberculosis
TDVSRKIRAW

SEQ ID NO: 59156 - protein, 10 aa, Mycobacterium tuberculosis
DVSRKIRAWG

SEQ ID NO: 59157 - protein, 10 aa, Mycobacterium tuberculosis
VSRKIRAWGR

SEQ ID NO: 59158 - protein, 10 aa, Mycobacterium tuberculosis
SRKIRAWGRR

SEQ ID NO: 59159 - protein, 10 aa, Mycobacterium tuberculosis
RKIRAWGRRL

SEQ ID NO: 59160 - protein, 10 aa, Mycobacterium tuberculosis
KIRAWGRRLM

SEQ ID NO: 59161 - protein, 10 aa, Mycobacterium tuberculosis
IRAWGRRLMI

SEQ ID NO: 59162 - protein, 10 aa, Mycobacterium tuberculosis
RAWGRRLMIG

SEQ ID NO: 59163 - protein, 10 aa, Mycobacterium tuberculosis
AWGRRLMIGT

SEQ ID NO: 59164 - protein, 10 aa, Mycobacterium tuberculosis
WGRRLMIGTA

SEQ ID NO: 59165 - protein, 10 aa, Mycobacterium tuberculosis
GRRLMIGTAA

SEQ ID NO: 59166 - protein, 10 aa, Mycobacterium tuberculosis
RRLMIGTAAA

SEQ ID NO: 59167 - protein, 10 aa, Mycobacterium tuberculosis
RLMIGTAAAV

SEQ ID NO: 59168 - protein, 10 aa, Mycobacterium tuberculosis
LMIGTAAAVV

SEQ ID NO: 59169 - protein, 10 aa, Mycobacterium tuberculosis
MIGTAAAVVL

SEQ ID NO: 59170 - protein, 10 aa, Mycobacterium tuberculosis
IGTAAAVVLP

SEQ ID NO: 59171 - protein, 10 aa, Mycobacterium tuberculosis
GTAAAVVLPG

SEQ ID NO: 59172 - protein, 10 aa, Mycobacterium tuberculosis
TAAAVVLPGL

SEQ ID NO: 59173 - protein, 10 aa, Mycobacterium tuberculosis
AAAVVLPGLV

SEQ ID NO: 59174 - protein, 10 aa, Mycobacterium tuberculosis
AAVVLPGLVG

SEQ ID NO: 59175 - protein, 10 aa, Mycobacterium tuberculosis
AVVLPGLVGL

SEQ ID NO: 59176 - protein, 10 aa, Mycobacterium tuberculosis
VVLPGLVGLA

SEQ ID NO: 59177 - protein, 10 aa, Mycobacterium tuberculosis
VLPGLVGLAG

SEQ ID NO: 59178 - protein, 10 aa, Mycobacterium tuberculosis
LPGLVGLAGG

SEQ ID NO: 59179 - protein, 10 aa, Mycobacterium tuberculosis
PGLVGLAGGA

SEQ ID NO: 59180 - protein, 10 aa, Mycobacterium tuberculosis
GLVGLAGGAA

SEQ ID NO: 59181 - protein, 10 aa, Mycobacterium tuberculosis
LVGLAGGAAT

SEQ ID NO: 59182 - protein, 10 aa, Mycobacterium tuberculosis
VGLAGGAATA

SEQ ID NO: 59183 - protein, 10 aa, Mycobacterium tuberculosis
GLAGGAATAG

SEQ ID NO: 59184 - protein, 10 aa, Mycobacterium tuberculosis
LAGGAATAGA

SEQ ID NO: 59185 - protein, 10 aa, Mycobacterium tuberculosis
AGGAATAGAF

SEQ ID NO: 59186 - protein, 10 aa, Mycobacterium tuberculosis
GGAATAGAFS

SEQ ID NO: 59187 - protein, 10 aa, Mycobacterium tuberculosis
GAATAGAFSR

SEQ ID NO: 59188 - protein, 10 aa, Mycobacterium tuberculosis
AATAGAFSRP

SEQ ID NO: 59189 - protein, 10 aa, Mycobacterium tuberculosis
ATAGAFSRPG

SEQ ID NO: 59190 - protein, 10 aa, Mycobacterium tuberculosis
TAGAFSRPGL

SEQ ID NO: 59191 - protein, 10 aa, Mycobacterium tuberculosis
AGAFSRPGLP

SEQ ID NO: 59192 - protein, 10 aa, Mycobacterium tuberculosis
GAFSRPGLPV

SEQ ID NO: 59193 - protein, 10 aa, Mycobacterium tuberculosis
AFSRPGLPVE

SEQ ID NO: 59194 - protein, 10 aa, Mycobacterium tuberculosis
FSRPGLPVEY

SEQ ID NO: 59195 - protein, 10 aa, Mycobacterium tuberculosis
SRPGLPVEYL

SEQ ID NO: 59196 - protein, 10 aa, Mycobacterium tuberculosis
RPGLPVEYLQ

SEQ ID NO: 59197 - protein, 10 aa, Mycobacterium tuberculosis
PGLPVEYLQV

SEQ ID NO: 59198 - protein, 10 aa, Mycobacterium tuberculosis
GLPVEYLQVP

SEQ ID NO: 59199 - protein, 10 aa, Mycobacterium tuberculosis
LPVEYLQVPS

SEQ ID NO: 59200 - protein, 10 aa, Mycobacterium tuberculosis
PVEYLQVPSP

SEQ ID NO: 59201 - protein, 10 aa, Mycobacterium tuberculosis
VEYLQVPSPS

SEQ ID NO: 59202 - protein, 10 aa, Mycobacterium tuberculosis
EYLQVPSPSM

SEQ ID NO: 59203 - protein, 10 aa, Mycobacterium tuberculosis
YLQVPSPSMG

SEQ ID NO: 59204 - protein, 10 aa, Mycobacterium tuberculosis
LQVPSPSMGR

SEQ ID NO: 59205 - protein, 10 aa, Mycobacterium tuberculosis
QVPSPSMGRD

SEQ ID NO: 59206 - protein, 10 aa, Mycobacterium tuberculosis
VPSPSMGRDI

SEQ ID NO: 59207 - protein, 10 aa, Mycobacterium tuberculosis
PSPSMGRDIK

SEQ ID NO: 59208 - protein, 10 aa, Mycobacterium tuberculosis
SPSMGRDIKV

SEQ ID NO: 59209 - protein, 10 aa, Mycobacterium tuberculosis
PSMGRDIKVQ

SEQ ID NO: 59210 - protein, 10 aa, Mycobacterium tuberculosis
SMGRDIKVQF

SEQ ID NO: 59211 - protein, 10 aa, Mycobacterium tuberculosis
MGRDIKVQFQ

SEQ ID NO: 59212 - protein, 10 aa, Mycobacterium tuberculosis
GRDIKVQFQS

SEQ ID NO: 59213 - protein, 10 aa, Mycobacterium tuberculosis
RDIKVQFQSG

SEQ ID NO: 59214 - protein, 10 aa, Mycobacterium tuberculosis
DIKVQFQSGG

SEQ ID NO: 59215 - protein, 10 aa, Mycobacterium tuberculosis
IKVQFQSGGN

SEQ ID NO: 59216 - protein, 10 aa, Mycobacterium tuberculosis
KVQFQSGGNN

SEQ ID NO: 59217 - protein, 10 aa, Mycobacterium tuberculosis
VQFQSGGNNS

SEQ ID NO: 59218 - protein, 10 aa, Mycobacterium tuberculosis
QFQSGGNNSP

SEQ ID NO: 59219 - protein, 10 aa, Mycobacterium tuberculosis
FQSGGNNSPA

SEQ ID NO: 59220 - protein, 10 aa, Mycobacterium tuberculosis
QSGGNNSPAV

SEQ ID NO: 59221 - protein, 10 aa, Mycobacterium tuberculosis
SGGNNSPAVY

SEQ ID NO: 59222 - protein, 10 aa, Mycobacterium tuberculosis
GGNNSPAVYL

SEQ ID NO: 59223 - protein, 10 aa, Mycobacterium tuberculosis
GNNSPAVYLL

SEQ ID NO: 59224 - protein, 10 aa, Mycobacterium tuberculosis
NNSPAVYLLD

SEQ ID NO: 59225 - protein, 10 aa, Mycobacterium tuberculosis
NSPAVYLLDG

SEQ ID NO: 59226 - protein, 10 aa, Mycobacterium tuberculosis
SPAVYLLDGL

SEQ ID NO: 59227 - protein, 10 aa, Mycobacterium tuberculosis
PAVYLLDGLR

SEQ ID NO: 59228 - protein, 10 aa, Mycobacterium tuberculosis
AVYLLDGLRA

SEQ ID NO: 59229 - protein, 10 aa, Mycobacterium tuberculosis
VYLLDGLRAQ

SEQ ID NO: 59230 - protein, 10 aa, Mycobacterium tuberculosis
YLLDGLRAQD

SEQ ID NO: 59231 - protein, 10 aa, Mycobacterium tuberculosis
LLDGLRAQDD

SEQ ID NO: 59232 - protein, 10 aa, Mycobacterium tuberculosis
LDGLRAQDDY

SEQ ID NO: 59233 - protein, 10 aa, Mycobacterium tuberculosis
DGLRAQDDYN

SEQ ID NO: 59234 - protein, 10 aa, Mycobacterium tuberculosis
GLRAQDDYNG

SEQ ID NO: 59235 - protein, 10 aa, Mycobacterium tuberculosis
LRAQDDYNGW

SEQ ID NO: 59236 - protein, 10 aa, Mycobacterium tuberculosis
RAQDDYNGWD

SEQ ID NO: 59237 - protein, 10 aa, Mycobacterium tuberculosis
AQDDYNGWDI

SEQ ID NO: 59238 - protein, 10 aa, Mycobacterium tuberculosis
QDDYNGWDIN

SEQ ID NO: 59239 - protein, 10 aa, Mycobacterium tuberculosis
DDYNGWDINT

SEQ ID NO: 59240 - protein, 10 aa, Mycobacterium tuberculosis
DYNGWDINTP

SEQ ID NO: 59241 - protein, 10 aa, Mycobacterium tuberculosis
YNGWDINTPA

SEQ ID NO: 59242 - protein, 10 aa, Mycobacterium tuberculosis
NGWDINTPAF

SEQ ID NO: 59243 - protein, 10 aa, Mycobacterium tuberculosis
GWDINTPAFE

SEQ ID NO: 59244 - protein, 10 aa, Mycobacterium tuberculosis
WDINTPAFEW

SEQ ID NO: 59245 - protein, 10 aa, Mycobacterium tuberculosis
DINTPAFEWY

SEQ ID NO: 59246 - protein, 10 aa, Mycobacterium tuberculosis
INTPAFEWYY

SEQ ID NO: 59247 - protein, 10 aa, Mycobacterium tuberculosis
NTPAFEWYYQ

SEQ ID NO: 59248 - protein, 10 aa, Mycobacterium tuberculosis
TPAFEWYYQS

SEQ ID NO: 59249 - protein, 10 aa, Mycobacterium tuberculosis
PAFEWYYQSG

SEQ ID NO: 59250 - protein, 10 aa, Mycobacterium tuberculosis
AFEWYYQSGL

SEQ ID NO: 59251 - protein, 10 aa, Mycobacterium tuberculosis
FEWYYQSGLS

SEQ ID NO: 59252 - protein, 10 aa, Mycobacterium tuberculosis
EWYYQSGLSI

SEQ ID NO: 59253 - protein, 10 aa, Mycobacterium tuberculosis
WYYQSGLSIV

SEQ ID NO: 59254 - protein, 10 aa, Mycobacterium tuberculosis
YYQSGLSIVM

SEQ ID NO: 59255 - protein, 10 aa, Mycobacterium tuberculosis
YQSGLSIVMP

SEQ ID NO: 59256 - protein, 10 aa, Mycobacterium tuberculosis
QSGLSIVMPV

SEQ ID NO: 59257 - protein, 10 aa, Mycobacterium tuberculosis
SGLSIVMPVG

SEQ ID NO: 59258 - protein, 10 aa, Mycobacterium tuberculosis
GLSIVMPVGG

SEQ ID NO: 59259 - protein, 10 aa, Mycobacterium tuberculosis
LSIVMPVGGQ

SEQ ID NO: 59260 - protein, 10 aa, Mycobacterium tuberculosis
SIVMPVGGQS

SEQ ID NO: 59261 - protein, 10 aa, Mycobacterium tuberculosis
IVMPVGGQSS

SEQ ID NO: 59262 - protein, 10 aa, Mycobacterium tuberculosis
VMPVGGQSSF

SEQ ID NO: 59263 - protein, 10 aa, Mycobacterium tuberculosis
MPVGGQSSFY

SEQ ID NO: 59264 - protein, 10 aa, Mycobacterium tuberculosis
PVGGQSSFYS

SEQ ID NO: 59265 - protein, 10 aa, Mycobacterium tuberculosis
VGGQSSFYSD

SEQ ID NO: 59266 - protein, 10 aa, Mycobacterium tuberculosis
GGQSSFYSDW

SEQ ID NO: 59267 - protein, 10 aa, Mycobacterium tuberculosis
GQSSFYSDWY

SEQ ID NO: 59268 - protein, 10 aa, Mycobacterium tuberculosis
QSSFYSDWYS

SEQ ID NO: 59269 - protein, 10 aa, Mycobacterium tuberculosis
SSFYSDWYSP

SEQ ID NO: 59270 - protein, 10 aa, Mycobacterium tuberculosis
SFYSDWYSPA

SEQ ID NO: 59271 - protein, 10 aa, Mycobacterium tuberculosis
FYSDWYSPAC

SEQ ID NO: 59272 - protein, 10 aa, Mycobacterium tuberculosis
YSDWYSPACG

SEQ ID NO: 59273 - protein, 10 aa, Mycobacterium tuberculosis
SDWYSPACGK

SEQ ID NO: 59274 - protein, 10 aa, Mycobacterium tuberculosis
DWYSPACGKA

SEQ ID NO: 59275 - protein, 10 aa, Mycobacterium tuberculosis
WYSPACGKAG

SEQ ID NO: 59276 - protein, 10 aa, Mycobacterium tuberculosis
YSPACGKAGC

SEQ ID NO: 59277 - protein, 10 aa, Mycobacterium tuberculosis
SPACGKAGCQ

SEQ ID NO: 59278 - protein, 10 aa, Mycobacterium tuberculosis
PACGKAGCQT

SEQ ID NO: 59279 - protein, 10 aa, Mycobacterium tuberculosis
ACGKAGCQTY

SEQ ID NO: 59280 - protein, 10 aa, Mycobacterium tuberculosis
CGKAGCQTYK

SEQ ID NO: 59281 - protein, 10 aa, Mycobacterium tuberculosis
GKAGCQTYKW

SEQ ID NO: 59282 - protein, 10 aa, Mycobacterium tuberculosis
KAGCQTYKWE

SEQ ID NO: 59283 - protein, 10 aa, Mycobacterium tuberculosis
AGCQTYKWET

SEQ ID NO: 59284 - protein, 10 aa, Mycobacterium tuberculosis
GCQTYKWETF

SEQ ID NO: 59285 - protein, 10 aa, Mycobacterium tuberculosis
CQTYKWETFL

SEQ ID NO: 59286 - protein, 10 aa, Mycobacterium tuberculosis
QTYKWETFLT

SEQ ID NO: 59287 - protein, 10 aa, Mycobacterium tuberculosis
TYKWETFLTS

SEQ ID NO: 59288 - protein, 10 aa, Mycobacterium tuberculosis
YKWETFLTSE

SEQ ID NO: 59289 - protein, 10 aa, Mycobacterium tuberculosis
KWETFLTSEL

SEQ ID NO: 59290 - protein, 10 aa, Mycobacterium tuberculosis
WETFLTSELP

SEQ ID NO: 59291 - protein, 10 aa, Mycobacterium tuberculosis
ETFLTSELPQ

SEQ ID NO: 59292 - protein, 10 aa, Mycobacterium tuberculosis
TFLTSELPQW

SEQ ID NO: 59293 - protein, 10 aa, Mycobacterium tuberculosis
FLTSELPQWL

SEQ ID NO: 59294 - protein, 10 aa, Mycobacterium tuberculosis
LTSELPQWLS

SEQ ID NO: 59295 - protein, 10 aa, Mycobacterium tuberculosis
TSELPQWLSA

SEQ ID NO: 59296 - protein, 10 aa, Mycobacterium tuberculosis
SELPQWLSAN

SEQ ID NO: 59297 - protein, 10 aa, Mycobacterium tuberculosis
ELPQWLSANR

SEQ ID NO: 59298 - protein, 10 aa, Mycobacterium tuberculosis
LPQWLSANRA

SEQ ID NO: 59299 - protein, 10 aa, Mycobacterium tuberculosis
PQWLSANRAV

SEQ ID NO: 59300 - protein, 10 aa, Mycobacterium tuberculosis
QWLSANRAVK

SEQ ID NO: 59301 - protein, 10 aa, Mycobacterium tuberculosis
WLSANRAVKP

SEQ ID NO: 59302 - protein, 10 aa, Mycobacterium tuberculosis
LSANRAVKPT

SEQ ID NO: 59303 - protein, 10 aa, Mycobacterium tuberculosis
SANRAVKPTG

SEQ ID NO: 59304 - protein, 10 aa, Mycobacterium tuberculosis
ANRAVKPTGS

SEQ ID NO: 59305 - protein, 10 aa, Mycobacterium tuberculosis
NRAVKPTGSA

SEQ ID NO: 59306 - protein, 10 aa, Mycobacterium tuberculosis
RAVKPTGSAA

SEQ ID NO: 59307 - protein, 10 aa, Mycobacterium tuberculosis
AVKPTGSAAI

SEQ ID NO: 59308 - protein, 10 aa, Mycobacterium tuberculosis
VKPTGSAAIG

SEQ ID NO: 59309 - protein, 10 aa, Mycobacterium tuberculosis
KPTGSAAIGL

SEQ ID NO: 59310 - protein, 10 aa, Mycobacterium tuberculosis
PTGSAAIGLS

SEQ ID NO: 59311 - protein, 10 aa, Mycobacterium tuberculosis
TGSAAIGLSM

SEQ ID NO: 59312 - protein, 10 aa, Mycobacterium tuberculosis
GSAAIGLSMA

SEQ ID NO: 59313 - protein, 10 aa, Mycobacterium tuberculosis
SAAIGLSMAG

SEQ ID NO: 59314 - protein, 10 aa, Mycobacterium tuberculosis
AAIGLSMAGS

SEQ ID NO: 59315 - protein, 10 aa, Mycobacterium tuberculosis
AIGLSMAGSS

SEQ ID NO: 59316 - protein, 10 aa, Mycobacterium tuberculosis
IGLSMAGSSA

SEQ ID NO: 59317 - protein, 10 aa, Mycobacterium tuberculosis
GLSMAGSSAM

SEQ ID NO: 59318 - protein, 10 aa, Mycobacterium tuberculosis
LSMAGSSAMI

SEQ ID NO: 59319 - protein, 10 aa, Mycobacterium tuberculosis
SMAGSSAMIL

SEQ ID NO: 59320 - protein, 10 aa, Mycobacterium tuberculosis
MAGSSAMILA

SEQ ID NO: 59321 - protein, 10 aa, Mycobacterium tuberculosis
AGSSAMILAA

SEQ ID NO: 59322 - protein, 10 aa, Mycobacterium tuberculosis
GSSAMILAAY

SEQ ID NO: 59323 - protein, 10 aa, Mycobacterium tuberculosis
SSAMILAAYH

SEQ ID NO: 59324 - protein, 10 aa, Mycobacterium tuberculosis
SAMILAAYHP

SEQ ID NO: 59325 - protein, 10 aa, Mycobacterium tuberculosis
AMILAAYHPQ

SEQ ID NO: 59326 - protein, 10 aa, Mycobacterium tuberculosis
MILAAYHPQQ

SEQ ID NO: 59327 - protein, 10 aa, Mycobacterium tuberculosis
ILAAYHPQQF

SEQ ID NO: 59328 - protein, 10 aa, Mycobacterium tuberculosis
LAAYHPQQFI

SEQ ID NO: 59329 - protein, 10 aa, Mycobacterium tuberculosis
AAYHPQQFIY

SEQ ID NO: 59330 - protein, 10 aa, Mycobacterium tuberculosis
AYHPQQFIYA

SEQ ID NO: 59331 - protein, 10 aa, Mycobacterium tuberculosis
YHPQQFIYAG

SEQ ID NO: 59332 - protein, 10 aa, Mycobacterium tuberculosis
HPQQFIYAGS

SEQ ID NO: 59333 - protein, 10 aa, Mycobacterium tuberculosis
PQQFIYAGSL

SEQ ID NO: 59334 - protein, 10 aa, Mycobacterium tuberculosis
QQFIYAGSLS

SEQ ID NO: 59335 - protein, 10 aa, Mycobacterium tuberculosis
QFIYAGSLSA

SEQ ID NO: 59336 - protein, 10 aa, Mycobacterium tuberculosis
FIYAGSLSAL

SEQ ID NO: 59337 - protein, 10 aa, Mycobacterium tuberculosis
IYAGSLSALL

SEQ ID NO: 59338 - protein, 10 aa, Mycobacterium tuberculosis
YAGSLSALLD

SEQ ID NO: 59339 - protein, 10 aa, Mycobacterium tuberculosis
AGSLSALLDP

SEQ ID NO: 59340 - protein, 10 aa, Mycobacterium tuberculosis
GSLSALLDPS

SEQ ID NO: 59341 - protein, 10 aa, Mycobacterium tuberculosis
SLSALLDPSQ

SEQ ID NO: 59342 - protein, 10 aa, Mycobacterium tuberculosis
LSALLDPSQG

SEQ ID NO: 59343 - protein, 10 aa, Mycobacterium tuberculosis
SALLDPSQGM

SEQ ID NO: 59344 - protein, 10 aa, Mycobacterium tuberculosis
ALLDPSQGMG

SEQ ID NO: 59345 - protein, 10 aa, Mycobacterium tuberculosis
LLDPSQGMGP

SEQ ID NO: 59346 - protein, 10 aa, Mycobacterium tuberculosis
LDPSQGMGPS

SEQ ID NO: 59347 - protein, 10 aa, Mycobacterium tuberculosis
DPSQGMGPSL

SEQ ID NO: 59348 - protein, 10 aa, Mycobacterium tuberculosis
PSQGMGPSLI

SEQ ID NO: 59349 - protein, 10 aa, Mycobacterium tuberculosis
SQGMGPSLIG

SEQ ID NO: 59350 - protein, 10 aa, Mycobacterium tuberculosis
QGMGPSLIGL

SEQ ID NO: 59351 - protein, 10 aa, Mycobacterium tuberculosis
GMGPSLIGLA

SEQ ID NO: 59352 - protein, 10 aa, Mycobacterium tuberculosis
MGPSLIGLAM

SEQ ID NO: 59353 - protein, 10 aa, Mycobacterium tuberculosis
GPSLIGLAMG

SEQ ID NO: 59354 - protein, 10 aa, Mycobacterium tuberculosis
PSLIGLAMGD

SEQ ID NO: 59355 - protein, 10 aa, Mycobacterium tuberculosis
SLIGLAMGDA

SEQ ID NO: 59356 - protein, 10 aa, Mycobacterium tuberculosis
LIGLAMGDAG

SEQ ID NO: 59357 - protein, 10 aa, Mycobacterium tuberculosis
IGLAMGDAGG

SEQ ID NO: 59358 - protein, 10 aa, Mycobacterium tuberculosis
GLAMGDAGGY

SEQ ID NO: 59359 - protein, 10 aa, Mycobacterium tuberculosis
LAMGDAGGYK

SEQ ID NO: 59360 - protein, 10 aa, Mycobacterium tuberculosis
AMGDAGGYKA

SEQ ID NO: 59361 - protein, 10 aa, Mycobacterium tuberculosis
MGDAGGYKAA

SEQ ID NO: 59362 - protein, 10 aa, Mycobacterium tuberculosis
GDAGGYKAAD

SEQ ID NO: 59363 - protein, 10 aa, Mycobacterium tuberculosis
DAGGYKAADM

SEQ ID NO: 59364 - protein, 10 aa, Mycobacterium tuberculosis
AGGYKAADMW

SEQ ID NO: 59365 - protein, 10 aa, Mycobacterium tuberculosis
GGYKAADMWG

SEQ ID NO: 59366 - protein, 10 aa, Mycobacterium tuberculosis
GYKAADMWGP

SEQ ID NO: 59367 - protein, 10 aa, Mycobacterium tuberculosis
YKAADMWGPS

SEQ ID NO: 59368 - protein, 10 aa, Mycobacterium tuberculosis
KAADMWGPSS

SEQ ID NO: 59369 - protein, 10 aa, Mycobacterium tuberculosis
AADMWGPSSD

SEQ ID NO: 59370 - protein, 10 aa, Mycobacterium tuberculosis
ADMWGPSSDP

SEQ ID NO: 59371 - protein, 10 aa, Mycobacterium tuberculosis
DMWGPSSDPA

SEQ ID NO: 59372 - protein, 10 aa, Mycobacterium tuberculosis
MWGPSSDPAW

SEQ ID NO: 59373 - protein, 10 aa, Mycobacterium tuberculosis
WGPSSDPAWE

SEQ ID NO: 59374 - protein, 10 aa, Mycobacterium tuberculosis
GPSSDPAWER

SEQ ID NO: 59375 - protein, 10 aa, Mycobacterium tuberculosis
PSSDPAWERN

SEQ ID NO: 59376 - protein, 10 aa, Mycobacterium tuberculosis
SSDPAWERND

SEQ ID NO: 59377 - protein, 10 aa, Mycobacterium tuberculosis
SDPAWERNDP

SEQ ID NO: 59378 - protein, 10 aa, Mycobacterium tuberculosis
DPAWERNDPT

SEQ ID NO: 59379 - protein, 10 aa, Mycobacterium tuberculosis
PAWERNDPTQ

SEQ ID NO: 59380 - protein, 10 aa, Mycobacterium tuberculosis
AWERNDPTQQ

SEQ ID NO: 59381 - protein, 10 aa, Mycobacterium tuberculosis
WERNDPTQQI

SEQ ID NO: 59382 - protein, 10 aa, Mycobacterium tuberculosis
ERNDPTQQIP

SEQ ID NO: 59383 - protein, 10 aa, Mycobacterium tuberculosis
RNDPTQQIPK

SEQ ID NO: 59384 - protein, 10 aa, Mycobacterium tuberculosis
NDPTQQIPKL

SEQ ID NO: 59385 - protein, 10 aa, Mycobacterium tuberculosis
DPTQQIPKLV

SEQ ID NO: 59386 - protein, 10 aa, Mycobacterium tuberculosis
PTQQIPKLVA

SEQ ID NO: 59387 - protein, 10 aa, Mycobacterium tuberculosis
TQQIPKLVAN

SEQ ID NO: 59388 - protein, 10 aa, Mycobacterium tuberculosis
QQIPKLVANN

SEQ ID NO: 59389 - protein, 10 aa, Mycobacterium tuberculosis
QIPKLVANNT

SEQ ID NO: 59390 - protein, 10 aa, Mycobacterium tuberculosis
IPKLVANNTR

SEQ ID NO: 59391 - protein, 10 aa, Mycobacterium tuberculosis
PKLVANNTRL

SEQ ID NO: 59392 - protein, 10 aa, Mycobacterium tuberculosis
KLVANNTRLW

SEQ ID NO: 59393 - protein, 10 aa, Mycobacterium tuberculosis
LVANNTRLWV

SEQ ID NO: 59394 - protein, 10 aa, Mycobacterium tuberculosis
VANNTRLWVY

SEQ ID NO: 59395 - protein, 10 aa, Mycobacterium tuberculosis
ANNTRLWVYC

SEQ ID NO: 59396 - protein, 10 aa, Mycobacterium tuberculosis
NNTRLWVYCG

SEQ ID NO: 59397 - protein, 10 aa, Mycobacterium tuberculosis
NTRLWVYCGN

SEQ ID NO: 59398 - protein, 10 aa, Mycobacterium tuberculosis
TRLWVYCGNG

SEQ ID NO: 59399 - protein, 10 aa, Mycobacterium tuberculosis
RLWVYCGNGT

SEQ ID NO: 59400 - protein, 10 aa, Mycobacterium tuberculosis
LWVYCGNGTP

SEQ ID NO: 59401 - protein, 10 aa, Mycobacterium tuberculosis
WVYCGNGTPN

SEQ ID NO: 59402 - protein, 10 aa, Mycobacterium tuberculosis
VYCGNGTPNE

SEQ ID NO: 59403 - protein, 10 aa, Mycobacterium tuberculosis
YCGNGTPNEL

SEQ ID NO: 59404 - protein, 10 aa, Mycobacterium tuberculosis
CGNGTPNELG

SEQ ID NO: 59405 - protein, 10 aa, Mycobacterium tuberculosis
GNGTPNELGG

SEQ ID NO: 59406 - protein, 10 aa, Mycobacterium tuberculosis
NGTPNELGGA

SEQ ID NO: 59407 - protein, 10 aa, Mycobacterium tuberculosis
GTPNELGGAN

SEQ ID NO: 59408 - protein, 10 aa, Mycobacterium tuberculosis
TPNELGGANI

SEQ ID NO: 59409 - protein, 10 aa, Mycobacterium tuberculosis
PNELGGANIP

SEQ ID NO: 59410 - protein, 10 aa, Mycobacterium tuberculosis
NELGGANIPA

SEQ ID NO: 59411 - protein, 10 aa, Mycobacterium tuberculosis
ELGGANIPAE

SEQ ID NO: 59412 - protein, 10 aa, Mycobacterium tuberculosis
LGGANIPAEF

SEQ ID NO: 59413 - protein, 10 aa, Mycobacterium tuberculosis
GGANIPAEFL

SEQ ID NO: 59414 - protein, 10 aa, Mycobacterium tuberculosis
GANIPAEFLE

SEQ ID NO: 59415 - protein, 10 aa, Mycobacterium tuberculosis
ANIPAEFLEN

SEQ ID NO: 59416 - protein, 10 aa, Mycobacterium tuberculosis
NIPAEFLENF

SEQ ID NO: 59417 - protein, 10 aa, Mycobacterium tuberculosis
IPAEFLENFV

SEQ ID NO: 59418 - protein, 10 aa, Mycobacterium tuberculosis
PAEFLENFVR

SEQ ID NO: 59419 - protein, 10 aa, Mycobacterium tuberculosis
AEFLENFVRS

SEQ ID NO: 59420 - protein, 10 aa, Mycobacterium tuberculosis
EFLENFVRSS

SEQ ID NO: 59421 - protein, 10 aa, Mycobacterium tuberculosis
FLENFVRSSN

SEQ ID NO: 59422 - protein, 10 aa, Mycobacterium tuberculosis
LENFVRSSNL

SEQ ID NO: 59423 - protein, 10 aa, Mycobacterium tuberculosis
ENFVRSSNLK

SEQ ID NO: 59424 - protein, 10 aa, Mycobacterium tuberculosis
NFVRSSNLKF

SEQ ID NO: 59425 - protein, 10 aa, Mycobacterium tuberculosis
FVRSSNLKFQ

SEQ ID NO: 59426 - protein, 10 aa, Mycobacterium tuberculosis
VRSSNLKFQD

SEQ ID NO: 59427 - protein, 10 aa, Mycobacterium tuberculosis
RSSNLKFQDA

SEQ ID NO: 59428 - protein, 10 aa, Mycobacterium tuberculosis
SSNLKFQDAY

SEQ ID NO: 59429 - protein, 10 aa, Mycobacterium tuberculosis
SNLKFQDAYN

SEQ ID NO: 59430 - protein, 10 aa, Mycobacterium tuberculosis
NLKFQDAYNA

SEQ ID NO: 59431 - protein, 10 aa, Mycobacterium tuberculosis
LKFQDAYNAA

SEQ ID NO: 59432 - protein, 10 aa, Mycobacterium tuberculosis
KFQDAYNAAG

SEQ ID NO: 59433 - protein, 10 aa, Mycobacterium tuberculosis
FQDAYNAAGG

SEQ ID NO: 59434 - protein, 10 aa, Mycobacterium tuberculosis
QDAYNAAGGH

SEQ ID NO: 59435 - protein, 10 aa, Mycobacterium tuberculosis
DAYNAAGGHN

SEQ ID NO: 59436 - protein, 10 aa, Mycobacterium tuberculosis
AYNAAGGHNA

SEQ ID NO: 59437 - protein, 10 aa, Mycobacterium tuberculosis
YNAAGGHNAV

SEQ ID NO: 59438 - protein, 10 aa, Mycobacterium tuberculosis
NAAGGHNAVF

SEQ ID NO: 59439 - protein, 10 aa, Mycobacterium tuberculosis
AAGGHNAVFN

SEQ ID NO: 59440 - protein, 10 aa, Mycobacterium tuberculosis
AGGHNAVFNF

SEQ ID NO: 59441 - protein, 10 aa, Mycobacterium tuberculosis
GGHNAVFNFP

SEQ ID NO: 59442 - protein, 10 aa, Mycobacterium tuberculosis
GHNAVFNFPP

SEQ ID NO: 59443 - protein, 10 aa, Mycobacterium tuberculosis
HNAVFNFPPN

SEQ ID NO: 59444 - protein, 10 aa, Mycobacterium tuberculosis
NAVFNFPPNG

SEQ ID NO: 59445 - protein, 10 aa, Mycobacterium tuberculosis
AVFNFPPNGT

SEQ ID NO: 59446 - protein, 10 aa, Mycobacterium tuberculosis
VFNFPPNGTH

SEQ ID NO: 59447 - protein, 10 aa, Mycobacterium tuberculosis
FNFPPNGTHS

SEQ ID NO: 59448 - protein, 10 aa, Mycobacterium tuberculosis
NFPPNGTHSW

SEQ ID NO: 59449 - protein, 10 aa, Mycobacterium tuberculosis
FPPNGTHSWE

SEQ ID NO: 59450 - protein, 10 aa, Mycobacterium tuberculosis
PPNGTHSWEY

SEQ ID NO: 59451 - protein, 10 aa, Mycobacterium tuberculosis
PNGTHSWEYW

SEQ ID NO: 59452 - protein, 10 aa, Mycobacterium tuberculosis
NGTHSWEYWG

SEQ ID NO: 59453 - protein, 10 aa, Mycobacterium tuberculosis
GTHSWEYWGA

SEQ ID NO: 59454 - protein, 10 aa, Mycobacterium tuberculosis
THSWEYWGAQ

SEQ ID NO: 59455 - protein, 10 aa, Mycobacterium tuberculosis
HSWEYWGAQL

SEQ ID NO: 59456 - protein, 10 aa, Mycobacterium tuberculosis
SWEYWGAQLN

SEQ ID NO: 59457 - protein, 10 aa, Mycobacterium tuberculosis
WEYWGAQLNA

SEQ ID NO: 59458 - protein, 10 aa, Mycobacterium tuberculosis
EYWGAQLNAM

SEQ ID NO: 59459 - protein, 10 aa, Mycobacterium tuberculosis
YWGAQLNAMK

SEQ ID NO: 59460 - protein, 10 aa, Mycobacterium tuberculosis
WGAQLNAMKG

SEQ ID NO: 59461 - protein, 10 aa, Mycobacterium tuberculosis
GAQLNAMKGD

SEQ ID NO: 59462 - protein, 10 aa, Mycobacterium tuberculosis
AQLNAMKGDL

SEQ ID NO: 59463 - protein, 10 aa, Mycobacterium tuberculosis
QLNAMKGDLQ

SEQ ID NO: 59464 - protein, 10 aa, Mycobacterium tuberculosis
LNAMKGDLQS

SEQ ID NO: 59465 - protein, 10 aa, Mycobacterium tuberculosis
NAMKGDLQSS

SEQ ID NO: 59466 - protein, 10 aa, Mycobacterium tuberculosis
AMKGDLQSSL

SEQ ID NO: 59467 - protein, 10 aa, Mycobacterium tuberculosis
MKGDLQSSLG

SEQ ID NO: 59468 - protein, 10 aa, Mycobacterium tuberculosis
KGDLQSSLGA

SEQ ID NO: 59469 - protein, 10 aa, Mycobacterium tuberculosis
GDLQSSLGAG

SEQ ID NO: 59470 - protein, 11 aa, Mycobacterium tuberculosis
MTDVSRKIRAW

SEQ ID NO: 59471 - protein, 11 aa, Mycobacterium tuberculosis
TDVSRKIRAWG

SEQ ID NO: 59472 - protein, 11 aa, Mycobacterium tuberculosis
DVSRKIRAWGR

SEQ ID NO: 59473 - protein, 11 aa, Mycobacterium tuberculosis
VSRKIRAWGRR

SEQ ID NO: 59474 - protein, 11 aa, Mycobacterium tuberculosis
SRKIRAWGRRL

SEQ ID NO: 59475 - protein, 11 aa, Mycobacterium tuberculosis
RKIRAWGRRLM

SEQ ID NO: 59476 - protein, 11 aa, Mycobacterium tuberculosis
KIRAWGRRLMI

SEQ ID NO: 59477 - protein, 11 aa, Mycobacterium tuberculosis
IRAWGRRLMIG

SEQ ID NO: 59478 - protein, 11 aa, Mycobacterium tuberculosis
RAWGRRLMIGT

SEQ ID NO: 59479 - protein, 11 aa, Mycobacterium tuberculosis
AWGRRLMIGTA

SEQ ID NO: 59480 - protein, 11 aa, Mycobacterium tuberculosis
WGRRLMIGTAA

SEQ ID NO: 59481 - protein, 11 aa, Mycobacterium tuberculosis
GRRLMIGTAAA

SEQ ID NO: 59482 - protein, 11 aa, Mycobacterium tuberculosis
RRLMIGTAAAV

SEQ ID NO: 59483 - protein, 11 aa, Mycobacterium tuberculosis
RLMIGTAAAVV

SEQ ID NO: 59484 - protein, 11 aa, Mycobacterium tuberculosis
LMIGTAAAVVL

SEQ ID NO: 59485 - protein, 11 aa, Mycobacterium tuberculosis
MIGTAAAVVLP

SEQ ID NO: 59486 - protein, 11 aa, Mycobacterium tuberculosis
IGTAAAVVLPG

SEQ ID NO: 59487 - protein, 11 aa, Mycobacterium tuberculosis
GTAAAVVLPGL

SEQ ID NO: 59488 - protein, 11 aa, Mycobacterium tuberculosis
TAAAVVLPGLV

SEQ ID NO: 59489 - protein, 11 aa, Mycobacterium tuberculosis
AAAVVLPGLVG

SEQ ID NO: 59490 - protein, 11 aa, Mycobacterium tuberculosis
AAVVLPGLVGL

SEQ ID NO: 59491 - protein, 11 aa, Mycobacterium tuberculosis
AVVLPGLVGLA

SEQ ID NO: 59492 - protein, 11 aa, Mycobacterium tuberculosis
VVLPGLVGLAG

SEQ ID NO: 59493 - protein, 11 aa, Mycobacterium tuberculosis
VLPGLVGLAGG

SEQ ID NO: 59494 - protein, 11 aa, Mycobacterium tuberculosis
LPGLVGLAGGA

SEQ ID NO: 59495 - protein, 11 aa, Mycobacterium tuberculosis
PGLVGLAGGAA

SEQ ID NO: 59496 - protein, 11 aa, Mycobacterium tuberculosis
GLVGLAGGAAT

SEQ ID NO: 59497 - protein, 11 aa, Mycobacterium tuberculosis
LVGLAGGAATA

SEQ ID NO: 59498 - protein, 11 aa, Mycobacterium tuberculosis
VGLAGGAATAG

SEQ ID NO: 59499 - protein, 11 aa, Mycobacterium tuberculosis
GLAGGAATAGA

SEQ ID NO: 59500 - protein, 11 aa, Mycobacterium tuberculosis
LAGGAATAGAF

SEQ ID NO: 59501 - protein, 11 aa, Mycobacterium tuberculosis
AGGAATAGAFS

SEQ ID NO: 59502 - protein, 11 aa, Mycobacterium tuberculosis
GGAATAGAFSR

SEQ ID NO: 59503 - protein, 11 aa, Mycobacterium tuberculosis
GAATAGAFSRP

SEQ ID NO: 59504 - protein, 11 aa, Mycobacterium tuberculosis
AATAGAFSRPG

SEQ ID NO: 59505 - protein, 11 aa, Mycobacterium tuberculosis
ATAGAFSRPGL

SEQ ID NO: 59506 - protein, 11 aa, Mycobacterium tuberculosis
TAGAFSRPGLP

SEQ ID NO: 59507 - protein, 11 aa, Mycobacterium tuberculosis
AGAFSRPGLPV

SEQ ID NO: 59508 - protein, 11 aa, Mycobacterium tuberculosis
GAFSRPGLPVE

SEQ ID NO: 59509 - protein, 11 aa, Mycobacterium tuberculosis
AFSRPGLPVEY

SEQ ID NO: 59510 - protein, 11 aa, Mycobacterium tuberculosis
FSRPGLPVEYL

SEQ ID NO: 59511 - protein, 11 aa, Mycobacterium tuberculosis
SRPGLPVEYLQ

SEQ ID NO: 59512 - protein, 11 aa, Mycobacterium tuberculosis
RPGLPVEYLQV

SEQ ID NO: 59513 - protein, 11 aa, Mycobacterium tuberculosis
PGLPVEYLQVP

SEQ ID NO: 59514 - protein, 11 aa, Mycobacterium tuberculosis
GLPVEYLQVPS

SEQ ID NO: 59515 - protein, 11 aa, Mycobacterium tuberculosis
LPVEYLQVPSP

SEQ ID NO: 59516 - protein, 11 aa, Mycobacterium tuberculosis
PVEYLQVPSPS

SEQ ID NO: 59517 - protein, 11 aa, Mycobacterium tuberculosis
VEYLQVPSPSM

SEQ ID NO: 59518 - protein, 11 aa, Mycobacterium tuberculosis
EYLQVPSPSMG

SEQ ID NO: 59519 - protein, 11 aa, Mycobacterium tuberculosis
YLQVPSPSMGR

SEQ ID NO: 59520 - protein, 11 aa, Mycobacterium tuberculosis
LQVPSPSMGRD

SEQ ID NO: 59521 - protein, 11 aa, Mycobacterium tuberculosis
QVPSPSMGRDI

SEQ ID NO: 59522 - protein, 11 aa, Mycobacterium tuberculosis
VPSPSMGRDIK

SEQ ID NO: 59523 - protein, 11 aa, Mycobacterium tuberculosis
PSPSMGRDIKV

SEQ ID NO: 59524 - protein, 11 aa, Mycobacterium tuberculosis
SPSMGRDIKVQ

SEQ ID NO: 59525 - protein, 11 aa, Mycobacterium tuberculosis
PSMGRDIKVQF

SEQ ID NO: 59526 - protein, 11 aa, Mycobacterium tuberculosis
SMGRDIKVQFQ

SEQ ID NO: 59527 - protein, 11 aa, Mycobacterium tuberculosis
MGRDIKVQFQS

SEQ ID NO: 59528 - protein, 11 aa, Mycobacterium tuberculosis
GRDIKVQFQSG

SEQ ID NO: 59529 - protein, 11 aa, Mycobacterium tuberculosis
RDIKVQFQSGG

SEQ ID NO: 59530 - protein, 11 aa, Mycobacterium tuberculosis
DIKVQFQSGGN

SEQ ID NO: 59531 - protein, 11 aa, Mycobacterium tuberculosis
IKVQFQSGGNN

SEQ ID NO: 59532 - protein, 11 aa, Mycobacterium tuberculosis
KVQFQSGGNNS

SEQ ID NO: 59533 - protein, 11 aa, Mycobacterium tuberculosis
VQFQSGGNNSP

SEQ ID NO: 59534 - protein, 11 aa, Mycobacterium tuberculosis
QFQSGGNNSPA

SEQ ID NO: 59535 - protein, 11 aa, Mycobacterium tuberculosis
FQSGGNNSPAV

SEQ ID NO: 59536 - protein, 11 aa, Mycobacterium tuberculosis
QSGGNNSPAVY

SEQ ID NO: 59537 - protein, 11 aa, Mycobacterium tuberculosis
SGGNNSPAVYL

SEQ ID NO: 59538 - protein, 11 aa, Mycobacterium tuberculosis
GGNNSPAVYLL

SEQ ID NO: 59539 - protein, 11 aa, Mycobacterium tuberculosis
GNNSPAVYLLD

SEQ ID NO: 59540 - protein, 11 aa, Mycobacterium tuberculosis
NNSPAVYLLDG

SEQ ID NO: 59541 - protein, 11 aa, Mycobacterium tuberculosis
NSPAVYLLDGL

SEQ ID NO: 59542 - protein, 11 aa, Mycobacterium tuberculosis
SPAVYLLDGLR

SEQ ID NO: 59543 - protein, 11 aa, Mycobacterium tuberculosis
PAVYLLDGLRA

SEQ ID NO: 59544 - protein, 11 aa, Mycobacterium tuberculosis
AVYLLDGLRAQ

SEQ ID NO: 59545 - protein, 11 aa, Mycobacterium tuberculosis
VYLLDGLRAQD

SEQ ID NO: 59546 - protein, 11 aa, Mycobacterium tuberculosis
YLLDGLRAQDD

SEQ ID NO: 59547 - protein, 11 aa, Mycobacterium tuberculosis
LLDGLRAQDDY

SEQ ID NO: 59548 - protein, 11 aa, Mycobacterium tuberculosis
LDGLRAQDDYN

SEQ ID NO: 59549 - protein, 11 aa, Mycobacterium tuberculosis
DGLRAQDDYNG

SEQ ID NO: 59550 - protein, 11 aa, Mycobacterium tuberculosis
GLRAQDDYNGW

SEQ ID NO: 59551 - protein, 11 aa, Mycobacterium tuberculosis
LRAQDDYNGWD

SEQ ID NO: 59552 - protein, 11 aa, Mycobacterium tuberculosis
RAQDDYNGWDI

SEQ ID NO: 59553 - protein, 11 aa, Mycobacterium tuberculosis
AQDDYNGWDIN

SEQ ID NO: 59554 - protein, 11 aa, Mycobacterium tuberculosis
QDDYNGWDINT

SEQ ID NO: 59555 - protein, 11 aa, Mycobacterium tuberculosis
DDYNGWDINTP

SEQ ID NO: 59556 - protein, 11 aa, Mycobacterium tuberculosis
DYNGWDINTPA

SEQ ID NO: 59557 - protein, 11 aa, Mycobacterium tuberculosis
YNGWDINTPAF

SEQ ID NO: 59558 - protein, 11 aa, Mycobacterium tuberculosis
NGWDINTPAFE

SEQ ID NO: 59559 - protein, 11 aa, Mycobacterium tuberculosis
GWDINTPAFEW

SEQ ID NO: 59560 - protein, 11 aa, Mycobacterium tuberculosis
WDINTPAFEWY

SEQ ID NO: 59561 - protein, 11 aa, Mycobacterium tuberculosis
DINTPAFEWYY

SEQ ID NO: 59562 - protein, 11 aa, Mycobacterium tuberculosis
INTPAFEWYYQ

SEQ ID NO: 59563 - protein, 11 aa, Mycobacterium tuberculosis
NTPAFEWYYQS

SEQ ID NO: 59564 - protein, 11 aa, Mycobacterium tuberculosis
TPAFEWYYQSG

SEQ ID NO: 59565 - protein, 11 aa, Mycobacterium tuberculosis
PAFEWYYQSGL

SEQ ID NO: 59566 - protein, 11 aa, Mycobacterium tuberculosis
AFEWYYQSGLS

SEQ ID NO: 59567 - protein, 11 aa, Mycobacterium tuberculosis
FEWYYQSGLSI

SEQ ID NO: 59568 - protein, 11 aa, Mycobacterium tuberculosis
EWYYQSGLSIV

SEQ ID NO: 59569 - protein, 11 aa, Mycobacterium tuberculosis
WYYQSGLSIVM

SEQ ID NO: 59570 - protein, 11 aa, Mycobacterium tuberculosis
YYQSGLSIVMP

SEQ ID NO: 59571 - protein, 11 aa, Mycobacterium tuberculosis
YQSGLSIVMPV

SEQ ID NO: 59572 - protein, 11 aa, Mycobacterium tuberculosis
QSGLSIVMPVG

SEQ ID NO: 59573 - protein, 11 aa, Mycobacterium tuberculosis
SGLSIVMPVGG

SEQ ID NO: 59574 - protein, 11 aa, Mycobacterium tuberculosis
GLSIVMPVGGQ

SEQ ID NO: 59575 - protein, 11 aa, Mycobacterium tuberculosis
LSIVMPVGGQS

SEQ ID NO: 59576 - protein, 11 aa, Mycobacterium tuberculosis
SIVMPVGGQSS

SEQ ID NO: 59577 - protein, 11 aa, Mycobacterium tuberculosis
IVMPVGGQSSF

SEQ ID NO: 59578 - protein, 11 aa, Mycobacterium tuberculosis
VMPVGGQSSFY

SEQ ID NO: 59579 - protein, 11 aa, Mycobacterium tuberculosis
MPVGGQSSFYS

SEQ ID NO: 59580 - protein, 11 aa, Mycobacterium tuberculosis
PVGGQSSFYSD

SEQ ID NO: 59581 - protein, 11 aa, Mycobacterium tuberculosis
VGGQSSFYSDW

SEQ ID NO: 59582 - protein, 11 aa, Mycobacterium tuberculosis
GGQSSFYSDWY

SEQ ID NO: 59583 - protein, 11 aa, Mycobacterium tuberculosis
GQSSFYSDWYS

SEQ ID NO: 59584 - protein, 11 aa, Mycobacterium tuberculosis
QSSFYSDWYSP

SEQ ID NO: 59585 - protein, 11 aa, Mycobacterium tuberculosis
SSFYSDWYSPA

SEQ ID NO: 59586 - protein, 11 aa, Mycobacterium tuberculosis
SFYSDWYSPAC

SEQ ID NO: 59587 - protein, 11 aa, Mycobacterium tuberculosis
FYSDWYSPACG

SEQ ID NO: 59588 - protein, 11 aa, Mycobacterium tuberculosis
YSDWYSPACGK

SEQ ID NO: 59589 - protein, 11 aa, Mycobacterium tuberculosis
SDWYSPACGKA

SEQ ID NO: 59590 - protein, 11 aa, Mycobacterium tuberculosis
DWYSPACGKAG

SEQ ID NO: 59591 - protein, 11 aa, Mycobacterium tuberculosis
WYSPACGKAGC

SEQ ID NO: 59592 - protein, 11 aa, Mycobacterium tuberculosis
YSPACGKAGCQ

SEQ ID NO: 59593 - protein, 11 aa, Mycobacterium tuberculosis
SPACGKAGCQT

SEQ ID NO: 59594 - protein, 11 aa, Mycobacterium tuberculosis
PACGKAGCQTY

SEQ ID NO: 59595 - protein, 11 aa, Mycobacterium tuberculosis
ACGKAGCQTYK

SEQ ID NO: 59596 - protein, 11 aa, Mycobacterium tuberculosis
CGKAGCQTYKW

SEQ ID NO: 59597 - protein, 11 aa, Mycobacterium tuberculosis
GKAGCQTYKWE

SEQ ID NO: 59598 - protein, 11 aa, Mycobacterium tuberculosis
KAGCQTYKWET

SEQ ID NO: 59599 - protein, 11 aa, Mycobacterium tuberculosis
AGCQTYKWETF

SEQ ID NO: 59600 - protein, 11 aa, Mycobacterium tuberculosis
GCQTYKWETFL

SEQ ID NO: 59601 - protein, 11 aa, Mycobacterium tuberculosis
CQTYKWETFLT

SEQ ID NO: 59602 - protein, 11 aa, Mycobacterium tuberculosis
QTYKWETFLTS

SEQ ID NO: 59603 - protein, 11 aa, Mycobacterium tuberculosis
TYKWETFLTSE

SEQ ID NO: 59604 - protein, 11 aa, Mycobacterium tuberculosis
YKWETFLTSEL

SEQ ID NO: 59605 - protein, 11 aa, Mycobacterium tuberculosis
KWETFLTSELP

SEQ ID NO: 59606 - protein, 11 aa, Mycobacterium tuberculosis
WETFLTSELPQ

SEQ ID NO: 59607 - protein, 11 aa, Mycobacterium tuberculosis
ETFLTSELPQW

SEQ ID NO: 59608 - protein, 11 aa, Mycobacterium tuberculosis
TFLTSELPQWL

SEQ ID NO: 59609 - protein, 11 aa, Mycobacterium tuberculosis
FLTSELPQWLS

SEQ ID NO: 59610 - protein, 11 aa, Mycobacterium tuberculosis
LTSELPQWLSA

SEQ ID NO: 59611 - protein, 11 aa, Mycobacterium tuberculosis
TSELPQWLSAN

SEQ ID NO: 59612 - protein, 11 aa, Mycobacterium tuberculosis
SELPQWLSANR

SEQ ID NO: 59613 - protein, 11 aa, Mycobacterium tuberculosis
ELPQWLSANRA

SEQ ID NO: 59614 - protein, 11 aa, Mycobacterium tuberculosis
LPQWLSANRAV

SEQ ID NO: 59615 - protein, 11 aa, Mycobacterium tuberculosis
PQWLSANRAVK

SEQ ID NO: 59616 - protein, 11 aa, Mycobacterium tuberculosis
QWLSANRAVKP

SEQ ID NO: 59617 - protein, 11 aa, Mycobacterium tuberculosis
WLSANRAVKPT

SEQ ID NO: 59618 - protein, 11 aa, Mycobacterium tuberculosis
LSANRAVKPTG

SEQ ID NO: 59619 - protein, 11 aa, Mycobacterium tuberculosis
SANRAVKPTGS

SEQ ID NO: 59620 - protein, 11 aa, Mycobacterium tuberculosis
ANRAVKPTGSA

SEQ ID NO: 59621 - protein, 11 aa, Mycobacterium tuberculosis
NRAVKPTGSAA

SEQ ID NO: 59622 - protein, 11 aa, Mycobacterium tuberculosis
RAVKPTGSAAI

SEQ ID NO: 59623 - protein, 11 aa, Mycobacterium tuberculosis
AVKPTGSAAIG

SEQ ID NO: 59624 - protein, 11 aa, Mycobacterium tuberculosis
VKPTGSAAIGL

SEQ ID NO: 59625 - protein, 11 aa, Mycobacterium tuberculosis
KPTGSAAIGLS

SEQ ID NO: 59626 - protein, 11 aa, Mycobacterium tuberculosis
PTGSAAIGLSM

SEQ ID NO: 59627 - protein, 11 aa, Mycobacterium tuberculosis
TGSAAIGLSMA

SEQ ID NO: 59628 - protein, 11 aa, Mycobacterium tuberculosis
GSAAIGLSMAG

SEQ ID NO: 59629 - protein, 11 aa, Mycobacterium tuberculosis
SAAIGLSMAGS

SEQ ID NO: 59630 - protein, 11 aa, Mycobacterium tuberculosis
AAIGLSMAGSS

SEQ ID NO: 59631 - protein, 11 aa, Mycobacterium tuberculosis
AIGLSMAGSSA

SEQ ID NO: 59632 - protein, 11 aa, Mycobacterium tuberculosis
IGLSMAGSSAM

SEQ ID NO: 59633 - protein, 11 aa, Mycobacterium tuberculosis
GLSMAGSSAMI

SEQ ID NO: 59634 - protein, 11 aa, Mycobacterium tuberculosis
LSMAGSSAMIL

SEQ ID NO: 59635 - protein, 11 aa, Mycobacterium tuberculosis
SMAGSSAMILA

SEQ ID NO: 59636 - protein, 11 aa, Mycobacterium tuberculosis
MAGSSAMILAA

SEQ ID NO: 59637 - protein, 11 aa, Mycobacterium tuberculosis
AGSSAMILAAY

SEQ ID NO: 59638 - protein, 11 aa, Mycobacterium tuberculosis
GSSAMILAAYH

SEQ ID NO: 59639 - protein, 11 aa, Mycobacterium tuberculosis
SSAMILAAYHP

SEQ ID NO: 59640 - protein, 11 aa, Mycobacterium tuberculosis
SAMILAAYHPQ

SEQ ID NO: 59641 - protein, 11 aa, Mycobacterium tuberculosis
AMILAAYHPQQ

SEQ ID NO: 59642 - protein, 11 aa, Mycobacterium tuberculosis
MILAAYHPQQF

SEQ ID NO: 59643 - protein, 11 aa, Mycobacterium tuberculosis
ILAAYHPQQFI

SEQ ID NO: 59644 - protein, 11 aa, Mycobacterium tuberculosis
LAAYHPQQFIY

SEQ ID NO: 59645 - protein, 11 aa, Mycobacterium tuberculosis
AAYHPQQFIYA

SEQ ID NO: 59646 - protein, 11 aa, Mycobacterium tuberculosis
AYHPQQFIYAG

SEQ ID NO: 59647 - protein, 11 aa, Mycobacterium tuberculosis
YHPQQFIYAGS

SEQ ID NO: 59648 - protein, 11 aa, Mycobacterium tuberculosis
HPQQFIYAGSL

SEQ ID NO: 59649 - protein, 11 aa, Mycobacterium tuberculosis
PQQFIYAGSLS

SEQ ID NO: 59650 - protein, 11 aa, Mycobacterium tuberculosis
QQFIYAGSLSA

SEQ ID NO: 59651 - protein, 11 aa, Mycobacterium tuberculosis
QFIYAGSLSAL

SEQ ID NO: 59652 - protein, 11 aa, Mycobacterium tuberculosis
FIYAGSLSALL

SEQ ID NO: 59653 - protein, 11 aa, Mycobacterium tuberculosis
IYAGSLSALLD

SEQ ID NO: 59654 - protein, 11 aa, Mycobacterium tuberculosis
YAGSLSALLDP

SEQ ID NO: 59655 - protein, 11 aa, Mycobacterium tuberculosis
AGSLSALLDPS

SEQ ID NO: 59656 - protein, 11 aa, Mycobacterium tuberculosis
GSLSALLDPSQ

SEQ ID NO: 59657 - protein, 11 aa, Mycobacterium tuberculosis
SLSALLDPSQG

SEQ ID NO: 59658 - protein, 11 aa, Mycobacterium tuberculosis
LSALLDPSQGM

SEQ ID NO: 59659 - protein, 11 aa, Mycobacterium tuberculosis
SALLDPSQGMG

SEQ ID NO: 59660 - protein, 11 aa, Mycobacterium tuberculosis
ALLDPSQGMGP

SEQ ID NO: 59661 - protein, 11 aa, Mycobacterium tuberculosis
LLDPSQGMGPS

SEQ ID NO: 59662 - protein, 11 aa, Mycobacterium tuberculosis
LDPSQGMGPSL

SEQ ID NO: 59663 - protein, 11 aa, Mycobacterium tuberculosis
DPSQGMGPSLI

SEQ ID NO: 59664 - protein, 11 aa, Mycobacterium tuberculosis
PSQGMGPSLIG

SEQ ID NO: 59665 - protein, 11 aa, Mycobacterium tuberculosis
SQGMGPSLIGL

SEQ ID NO: 59666 - protein, 11 aa, Mycobacterium tuberculosis
QGMGPSLIGLA

SEQ ID NO: 59667 - protein, 11 aa, Mycobacterium tuberculosis
GMGPSLIGLAM

SEQ ID NO: 59668 - protein, 11 aa, Mycobacterium tuberculosis
MGPSLIGLAMG

SEQ ID NO: 59669 - protein, 11 aa, Mycobacterium tuberculosis
GPSLIGLAMGD

SEQ ID NO: 59670 - protein, 11 aa, Mycobacterium tuberculosis
PSLIGLAMGDA

SEQ ID NO: 59671 - protein, 11 aa, Mycobacterium tuberculosis
SLIGLAMGDAG

SEQ ID NO: 59672 - protein, 11 aa, Mycobacterium tuberculosis
LIGLAMGDAGG

SEQ ID NO: 59673 - protein, 11 aa, Mycobacterium tuberculosis
IGLAMGDAGGY

SEQ ID NO: 59674 - protein, 11 aa, Mycobacterium tuberculosis
GLAMGDAGGYK

SEQ ID NO: 59675 - protein, 11 aa, Mycobacterium tuberculosis
LAMGDAGGYKA

SEQ ID NO: 59676 - protein, 11 aa, Mycobacterium tuberculosis
AMGDAGGYKAA

SEQ ID NO: 59677 - protein, 11 aa, Mycobacterium tuberculosis
MGDAGGYKAAD

SEQ ID NO: 59678 - protein, 11 aa, Mycobacterium tuberculosis
GDAGGYKAADM

SEQ ID NO: 59679 - protein, 11 aa, Mycobacterium tuberculosis
DAGGYKAADMW

SEQ ID NO: 59680 - protein, 11 aa, Mycobacterium tuberculosis
AGGYKAADMWG

SEQ ID NO: 59681 - protein, 11 aa, Mycobacterium tuberculosis
GGYKAADMWGP

SEQ ID NO: 59682 - protein, 11 aa, Mycobacterium tuberculosis
GYKAADMWGPS

SEQ ID NO: 59683 - protein, 11 aa, Mycobacterium tuberculosis
YKAADMWGPSS

SEQ ID NO: 59684 - protein, 11 aa, Mycobacterium tuberculosis
KAADMWGPSSD

SEQ ID NO: 59685 - protein, 11 aa, Mycobacterium tuberculosis
AADMWGPSSDP

SEQ ID NO: 59686 - protein, 11 aa, Mycobacterium tuberculosis
ADMWGPSSDPA

SEQ ID NO: 59687 - protein, 11 aa, Mycobacterium tuberculosis
DMWGPSSDPAW

SEQ ID NO: 59688 - protein, 11 aa, Mycobacterium tuberculosis
MWGPSSDPAWE

SEQ ID NO: 59689 - protein, 11 aa, Mycobacterium tuberculosis
WGPSSDPAWER

SEQ ID NO: 59690 - protein, 11 aa, Mycobacterium tuberculosis
GPSSDPAWERN

SEQ ID NO: 59691 - protein, 11 aa, Mycobacterium tuberculosis
PSSDPAWERND

SEQ ID NO: 59692 - protein, 11 aa, Mycobacterium tuberculosis
SSDPAWERNDP

SEQ ID NO: 59693 - protein, 11 aa, Mycobacterium tuberculosis
SDPAWERNDPT

SEQ ID NO: 59694 - protein, 11 aa, Mycobacterium tuberculosis
DPAWERNDPTQ

SEQ ID NO: 59695 - protein, 11 aa, Mycobacterium tuberculosis
PAWERNDPTQQ

SEQ ID NO: 59696 - protein, 11 aa, Mycobacterium tuberculosis
AWERNDPTQQI

SEQ ID NO: 59697 - protein, 11 aa, Mycobacterium tuberculosis
WERNDPTQQIP

SEQ ID NO: 59698 - protein, 11 aa, Mycobacterium tuberculosis
ERNDPTQQIPK

SEQ ID NO: 59699 - protein, 11 aa, Mycobacterium tuberculosis
RNDPTQQIPKL

SEQ ID NO: 59700 - protein, 11 aa, Mycobacterium tuberculosis
NDPTQQIPKLV

SEQ ID NO: 59701 - protein, 11 aa, Mycobacterium tuberculosis
DPTQQIPKLVA

SEQ ID NO: 59702 - protein, 11 aa, Mycobacterium tuberculosis
PTQQIPKLVAN

SEQ ID NO: 59703 - protein, 11 aa, Mycobacterium tuberculosis
TQQIPKLVANN

SEQ ID NO: 59704 - protein, 11 aa, Mycobacterium tuberculosis
QQIPKLVANNT

SEQ ID NO: 59705 - protein, 11 aa, Mycobacterium tuberculosis
QIPKLVANNTR

SEQ ID NO: 59706 - protein, 11 aa, Mycobacterium tuberculosis
IPKLVANNTRL

SEQ ID NO: 59707 - protein, 11 aa, Mycobacterium tuberculosis
PKLVANNTRLW

SEQ ID NO: 59708 - protein, 11 aa, Mycobacterium tuberculosis
KLVANNTRLWV

SEQ ID NO: 59709 - protein, 11 aa, Mycobacterium tuberculosis
LVANNTRLWVY

SEQ ID NO: 59710 - protein, 11 aa, Mycobacterium tuberculosis
VANNTRLWVYC

SEQ ID NO: 59711 - protein, 11 aa, Mycobacterium tuberculosis
ANNTRLWVYCG

SEQ ID NO: 59712 - protein, 11 aa, Mycobacterium tuberculosis
NNTRLWVYCGN

SEQ ID NO: 59713 - protein, 11 aa, Mycobacterium tuberculosis
NTRLWVYCGNG

SEQ ID NO: 59714 - protein, 11 aa, Mycobacterium tuberculosis
TRLWVYCGNGT

SEQ ID NO: 59715 - protein, 11 aa, Mycobacterium tuberculosis
RLWVYCGNGTP

SEQ ID NO: 59716 - protein, 11 aa, Mycobacterium tuberculosis
LWVYCGNGTPN

SEQ ID NO: 59717 - protein, 11 aa, Mycobacterium tuberculosis
WVYCGNGTPNE

SEQ ID NO: 59718 - protein, 11 aa, Mycobacterium tuberculosis
VYCGNGTPNEL

SEQ ID NO: 59719 - protein, 11 aa, Mycobacterium tuberculosis
YCGNGTPNELG

SEQ ID NO: 59720 - protein, 11 aa, Mycobacterium tuberculosis
CGNGTPNELGG

SEQ ID NO: 59721 - protein, 11 aa, Mycobacterium tuberculosis
GNGTPNELGGA

SEQ ID NO: 59722 - protein, 11 aa, Mycobacterium tuberculosis
NGTPNELGGAN

SEQ ID NO: 59723 - protein, 11 aa, Mycobacterium tuberculosis
GTPNELGGANI

SEQ ID NO: 59724 - protein, 11 aa, Mycobacterium tuberculosis
TPNELGGANIP

SEQ ID NO: 59725 - protein, 11 aa, Mycobacterium tuberculosis
PNELGGANIPA

SEQ ID NO: 59726 - protein, 11 aa, Mycobacterium tuberculosis
NELGGANIPAE

SEQ ID NO: 59727 - protein, 11 aa, Mycobacterium tuberculosis
ELGGANIPAEF

SEQ ID NO: 59728 - protein, 11 aa, Mycobacterium tuberculosis
LGGANIPAEFL

SEQ ID NO: 59729 - protein, 11 aa, Mycobacterium tuberculosis
GGANIPAEFLE

SEQ ID NO: 59730 - protein, 11 aa, Mycobacterium tuberculosis
GANIPAEFLEN

SEQ ID NO: 59731 - protein, 11 aa, Mycobacterium tuberculosis
ANIPAEFLENF

SEQ ID NO: 59732 - protein, 11 aa, Mycobacterium tuberculosis
NIPAEFLENFV

SEQ ID NO: 59733 - protein, 11 aa, Mycobacterium tuberculosis
IPAEFLENFVR

SEQ ID NO: 59734 - protein, 11 aa, Mycobacterium tuberculosis
PAEFLENFVRS

SEQ ID NO: 59735 - protein, 11 aa, Mycobacterium tuberculosis
AEFLENFVRSS

SEQ ID NO: 59736 - protein, 11 aa, Mycobacterium tuberculosis
EFLENFVRSSN

SEQ ID NO: 59737 - protein, 11 aa, Mycobacterium tuberculosis
FLENFVRSSNL

SEQ ID NO: 59738 - protein, 11 aa, Mycobacterium tuberculosis
LENFVRSSNLK

SEQ ID NO: 59739 - protein, 11 aa, Mycobacterium tuberculosis
ENFVRSSNLKF

SEQ ID NO: 59740 - protein, 11 aa, Mycobacterium tuberculosis
NFVRSSNLKFQ

SEQ ID NO: 59741 - protein, 11 aa, Mycobacterium tuberculosis
FVRSSNLKFQD

SEQ ID NO: 59742 - protein, 11 aa, Mycobacterium tuberculosis
VRSSNLKFQDA

SEQ ID NO: 59743 - protein, 11 aa, Mycobacterium tuberculosis
RSSNLKFQDAY

SEQ ID NO: 59744 - protein, 11 aa, Mycobacterium tuberculosis
SSNLKFQDAYN

SEQ ID NO: 59745 - protein, 11 aa, Mycobacterium tuberculosis
SNLKFQDAYNA

SEQ ID NO: 59746 - protein, 11 aa, Mycobacterium tuberculosis
NLKFQDAYNAA

SEQ ID NO: 59747 - protein, 11 aa, Mycobacterium tuberculosis
LKFQDAYNAAG

SEQ ID NO: 59748 - protein, 11 aa, Mycobacterium tuberculosis
KFQDAYNAAGG

SEQ ID NO: 59749 - protein, 11 aa, Mycobacterium tuberculosis
FQDAYNAAGGH

SEQ ID NO: 59750 - protein, 11 aa, Mycobacterium tuberculosis
QDAYNAAGGHN

SEQ ID NO: 59751 - protein, 11 aa, Mycobacterium tuberculosis
DAYNAAGGHNA

SEQ ID NO: 59752 - protein, 11 aa, Mycobacterium tuberculosis
AYNAAGGHNAV

SEQ ID NO: 59753 - protein, 11 aa, Mycobacterium tuberculosis
YNAAGGHNAVF

SEQ ID NO: 59754 - protein, 11 aa, Mycobacterium tuberculosis
NAAGGHNAVFN

SEQ ID NO: 59755 - protein, 11 aa, Mycobacterium tuberculosis
AAGGHNAVFNF

SEQ ID NO: 59756 - protein, 11 aa, Mycobacterium tuberculosis
AGGHNAVFNFP

SEQ ID NO: 59757 - protein, 11 aa, Mycobacterium tuberculosis
GGHNAVFNFPP

SEQ ID NO: 59758 - protein, 11 aa, Mycobacterium tuberculosis
GHNAVFNFPPN

SEQ ID NO: 59759 - protein, 11 aa, Mycobacterium tuberculosis
HNAVFNFPPNG

SEQ ID NO: 59760 - protein, 11 aa, Mycobacterium tuberculosis
NAVFNFPPNGT

SEQ ID NO: 59761 - protein, 11 aa, Mycobacterium tuberculosis
AVFNFPPNGTH

SEQ ID NO: 59762 - protein, 11 aa, Mycobacterium tuberculosis
VFNFPPNGTHS

SEQ ID NO: 59763 - protein, 11 aa, Mycobacterium tuberculosis
FNFPPNGTHSW

SEQ ID NO: 59764 - protein, 11 aa, Mycobacterium tuberculosis
NFPPNGTHSWE

SEQ ID NO: 59765 - protein, 11 aa, Mycobacterium tuberculosis
FPPNGTHSWEY

SEQ ID NO: 59766 - protein, 11 aa, Mycobacterium tuberculosis
PPNGTHSWEYW

SEQ ID NO: 59767 - protein, 11 aa, Mycobacterium tuberculosis
PNGTHSWEYWG

SEQ ID NO: 59768 - protein, 11 aa, Mycobacterium tuberculosis
NGTHSWEYWGA

SEQ ID NO: 59769 - protein, 11 aa, Mycobacterium tuberculosis
GTHSWEYWGAQ

SEQ ID NO: 59770 - protein, 11 aa, Mycobacterium tuberculosis
THSWEYWGAQL

SEQ ID NO: 59771 - protein, 11 aa, Mycobacterium tuberculosis
HSWEYWGAQLN

SEQ ID NO: 59772 - protein, 11 aa, Mycobacterium tuberculosis
SWEYWGAQLNA

SEQ ID NO: 59773 - protein, 11 aa, Mycobacterium tuberculosis
WEYWGAQLNAM

SEQ ID NO: 59774 - protein, 11 aa, Mycobacterium tuberculosis
EYWGAQLNAMK

SEQ ID NO: 59775 - protein, 11 aa, Mycobacterium tuberculosis
YWGAQLNAMKG

SEQ ID NO: 59776 - protein, 11 aa, Mycobacterium tuberculosis
WGAQLNAMKGD

SEQ ID NO: 59777 - protein, 11 aa, Mycobacterium tuberculosis
GAQLNAMKGDL

SEQ ID NO: 59778 - protein, 11 aa, Mycobacterium tuberculosis
AQLNAMKGDLQ

SEQ ID NO: 59779 - protein, 11 aa, Mycobacterium tuberculosis
QLNAMKGDLQS

SEQ ID NO: 59780 - protein, 11 aa, Mycobacterium tuberculosis
LNAMKGDLQSS

SEQ ID NO: 59781 - protein, 11 aa, Mycobacterium tuberculosis
NAMKGDLQSSL

SEQ ID NO: 59782 - protein, 11 aa, Mycobacterium tuberculosis
AMKGDLQSSLG

SEQ ID NO: 59783 - protein, 11 aa, Mycobacterium tuberculosis
MKGDLQSSLGA

SEQ ID NO: 59784 - protein, 11 aa, Mycobacterium tuberculosis
KGDLQSSLGAG

SEQ ID NO: 59785 - protein, 13 aa, Mycobacterium tuberculosis
MRRVVRYLSVVVA

SEQ ID NO: 59786 - protein, 13 aa, Mycobacterium tuberculosis
RRVVRYLSVVVAI

SEQ ID NO: 59787 - protein, 13 aa, Mycobacterium tuberculosis
RVVRYLSVVVAIT

SEQ ID NO: 59788 - protein, 13 aa, Mycobacterium tuberculosis
VVRYLSVVVAITL

SEQ ID NO: 59789 - protein, 13 aa, Mycobacterium tuberculosis
VRYLSVVVAITLM

SEQ ID NO: 59790 - protein, 13 aa, Mycobacterium tuberculosis
RYLSVVVAITLML

SEQ ID NO: 59791 - protein, 13 aa, Mycobacterium tuberculosis
YLSVVVAITLMLT

SEQ ID NO: 59792 - protein, 13 aa, Mycobacterium tuberculosis
LSVVVAITLMLTA

SEQ ID NO: 59793 - protein, 13 aa, Mycobacterium tuberculosis
SVVVAITLMLTAE

SEQ ID NO: 59794 - protein, 13 aa, Mycobacterium tuberculosis
VVVAITLMLTAES

SEQ ID NO: 59795 - protein, 13 aa, Mycobacterium tuberculosis
VVAITLMLTAESV

SEQ ID NO: 59796 - protein, 13 aa, Mycobacterium tuberculosis
VAITLMLTAESVS

SEQ ID NO: 59797 - protein, 13 aa, Mycobacterium tuberculosis
AITLMLTAESVSI

SEQ ID NO: 59798 - protein, 13 aa, Mycobacterium tuberculosis
ITLMLTAESVSIA

SEQ ID NO: 59799 - protein, 13 aa, Mycobacterium tuberculosis
TLMLTAESVSIAT

SEQ ID NO: 59800 - protein, 13 aa, Mycobacterium tuberculosis
LMLTAESVSIATA

SEQ ID NO: 59801 - protein, 13 aa, Mycobacterium tuberculosis
MLTAESVSIATAA

SEQ ID NO: 59802 - protein, 13 aa, Mycobacterium tuberculosis
LTAESVSIATAAV

SEQ ID NO: 59803 - protein, 13 aa, Mycobacterium tuberculosis
TAESVSIATAAVP

SEQ ID NO: 59804 - protein, 13 aa, Mycobacterium tuberculosis
AESVSIATAAVPP

SEQ ID NO: 59805 - protein, 13 aa, Mycobacterium tuberculosis
ESVSIATAAVPPL

SEQ ID NO: 59806 - protein, 13 aa, Mycobacterium tuberculosis
SVSIATAAVPPLQ

SEQ ID NO: 59807 - protein, 13 aa, Mycobacterium tuberculosis
VSIATAAVPPLQP

SEQ ID NO: 59808 - protein, 13 aa, Mycobacterium tuberculosis
SIATAAVPPLQPI

SEQ ID NO: 59809 - protein, 13 aa, Mycobacterium tuberculosis
IATAAVPPLQPIP

SEQ ID NO: 59810 - protein, 13 aa, Mycobacterium tuberculosis
ATAAVPPLQPIPG

SEQ ID NO: 59811 - protein, 13 aa, Mycobacterium tuberculosis
TAAVPPLQPIPGV

SEQ ID NO: 59812 - protein, 13 aa, Mycobacterium tuberculosis
AAVPPLQPIPGVA

SEQ ID NO: 59813 - protein, 13 aa, Mycobacterium tuberculosis
AVPPLQPIPGVAS

SEQ ID NO: 59814 - protein, 13 aa, Mycobacterium tuberculosis
VPPLQPIPGVASV

SEQ ID NO: 59815 - protein, 13 aa, Mycobacterium tuberculosis
PPLQPIPGVASVS

SEQ ID NO: 59816 - protein, 13 aa, Mycobacterium tuberculosis
PLQPIPGVASVSP

SEQ ID NO: 59817 - protein, 13 aa, Mycobacterium tuberculosis
LQPIPGVASVSPA

SEQ ID NO: 59818 - protein, 13 aa, Mycobacterium tuberculosis
QPIPGVASVSPAN

SEQ ID NO: 59819 - protein, 13 aa, Mycobacterium tuberculosis
PIPGVASVSPANG

SEQ ID NO: 59820 - protein, 13 aa, Mycobacterium tuberculosis
IPGVASVSPANGA

SEQ ID NO: 59821 - protein, 13 aa, Mycobacterium tuberculosis
PGVASVSPANGAV

SEQ ID NO: 59822 - protein, 13 aa, Mycobacterium tuberculosis
GVASVSPANGAVV

SEQ ID NO: 59823 - protein, 13 aa, Mycobacterium tuberculosis
VASVSPANGAVVG

SEQ ID NO: 59824 - protein, 13 aa, Mycobacterium tuberculosis
ASVSPANGAVVGV

SEQ ID NO: 59825 - protein, 13 aa, Mycobacterium tuberculosis
SVSPANGAVVGVA

SEQ ID NO: 59826 - protein, 13 aa, Mycobacterium tuberculosis
VSPANGAVVGVAH

SEQ ID NO: 59827 - protein, 13 aa, Mycobacterium tuberculosis
SPANGAVVGVAHP

SEQ ID NO: 59828 - protein, 13 aa, Mycobacterium tuberculosis
PANGAVVGVAHPV

SEQ ID NO: 59829 - protein, 13 aa, Mycobacterium tuberculosis
ANGAVVGVAHPVV

SEQ ID NO: 59830 - protein, 13 aa, Mycobacterium tuberculosis
NGAVVGVAHPVVV

SEQ ID NO: 59831 - protein, 13 aa, Mycobacterium tuberculosis
GAVVGVAHPVVVT

SEQ ID NO: 59832 - protein, 13 aa, Mycobacterium tuberculosis
AVVGVAHPVVVTF

SEQ ID NO: 59833 - protein, 13 aa, Mycobacterium tuberculosis
VVGVAHPVVVTFT

SEQ ID NO: 59834 - protein, 13 aa, Mycobacterium tuberculosis
VGVAHPVVVTFTT

SEQ ID NO: 59835 - protein, 13 aa, Mycobacterium tuberculosis
GVAHPVVVTFTTP

SEQ ID NO: 59836 - protein, 13 aa, Mycobacterium tuberculosis
VAHPVVVTFTTPV

SEQ ID NO: 59837 - protein, 13 aa, Mycobacterium tuberculosis
AHPVVVTFTTPVT

SEQ ID NO: 59838 - protein, 13 aa, Mycobacterium tuberculosis
HPVVVTFTTPVTD

SEQ ID NO: 59839 - protein, 13 aa, Mycobacterium tuberculosis
PVVVTFTTPVTDR

SEQ ID NO: 59840 - protein, 13 aa, Mycobacterium tuberculosis
VVVTFTTPVTDRR

SEQ ID NO: 59841 - protein, 13 aa, Mycobacterium tuberculosis
VVTFTTPVTDRRA

SEQ ID NO: 59842 - protein, 13 aa, Mycobacterium tuberculosis
VTFTTPVTDRRAV

SEQ ID NO: 59843 - protein, 13 aa, Mycobacterium tuberculosis
TFTTPVTDRRAVE

SEQ ID NO: 59844 - protein, 13 aa, Mycobacterium tuberculosis
FTTPVTDRRAVER

SEQ ID NO: 59845 - protein, 13 aa, Mycobacterium tuberculosis
TTPVTDRRAVERS

SEQ ID NO: 59846 - protein, 13 aa, Mycobacterium tuberculosis
TPVTDRRAVERSI

SEQ ID NO: 59847 - protein, 13 aa, Mycobacterium tuberculosis
PVTDRRAVERSIR

SEQ ID NO: 59848 - protein, 13 aa, Mycobacterium tuberculosis
VTDRRAVERSIRI

SEQ ID NO: 59849 - protein, 13 aa, Mycobacterium tuberculosis
TDRRAVERSIRIS

SEQ ID NO: 59850 - protein, 13 aa, Mycobacterium tuberculosis
DRRAVERSIRIST

SEQ ID NO: 59851 - protein, 13 aa, Mycobacterium tuberculosis
RRAVERSIRISTP

SEQ ID NO: 59852 - protein, 13 aa, Mycobacterium tuberculosis
RAVERSIRISTPH

SEQ ID NO: 59853 - protein, 13 aa, Mycobacterium tuberculosis
AVERSIRISTPHN

SEQ ID NO: 59854 - protein, 13 aa, Mycobacterium tuberculosis
VERSIRISTPHNT

SEQ ID NO: 59855 - protein, 13 aa, Mycobacterium tuberculosis
ERSIRISTPHNTT

SEQ ID NO: 59856 - protein, 13 aa, Mycobacterium tuberculosis
RSIRISTPHNTTG

SEQ ID NO: 59857 - protein, 13 aa, Mycobacterium tuberculosis
SIRISTPHNTTGH

SEQ ID NO: 59858 - protein, 13 aa, Mycobacterium tuberculosis
IRISTPHNTTGHF

SEQ ID NO: 59859 - protein, 13 aa, Mycobacterium tuberculosis
RISTPHNTTGHFE

SEQ ID NO: 59860 - protein, 13 aa, Mycobacterium tuberculosis
ISTPHNTTGHFEW

SEQ ID NO: 59861 - protein, 13 aa, Mycobacterium tuberculosis
STPHNTTGHFEWV

SEQ ID NO: 59862 - protein, 13 aa, Mycobacterium tuberculosis
TPHNTTGHFEWVA

SEQ ID NO: 59863 - protein, 13 aa, Mycobacterium tuberculosis
PHNTTGHFEWVAS

SEQ ID NO: 59864 - protein, 13 aa, Mycobacterium tuberculosis
HNTTGHFEWVASN

SEQ ID NO: 59865 - protein, 13 aa, Mycobacterium tuberculosis
NTTGHFEWVASNV

SEQ ID NO: 59866 - protein, 13 aa, Mycobacterium tuberculosis
TTGHFEWVASNVV

SEQ ID NO: 59867 - protein, 13 aa, Mycobacterium tuberculosis
TGHFEWVASNVVR

SEQ ID NO: 59868 - protein, 13 aa, Mycobacterium tuberculosis
GHFEWVASNVVRW

SEQ ID NO: 59869 - protein, 13 aa, Mycobacterium tuberculosis
HFEWVASNVVRWV

SEQ ID NO: 59870 - protein, 13 aa, Mycobacterium tuberculosis
FEWVASNVVRWVP

SEQ ID NO: 59871 - protein, 13 aa, Mycobacterium tuberculosis
EWVASNVVRWVPH

SEQ ID NO: 59872 - protein, 13 aa, Mycobacterium tuberculosis
WVASNVVRWVPHR

SEQ ID NO: 59873 - protein, 13 aa, Mycobacterium tuberculosis
VASNVVRWVPHRY

SEQ ID NO: 59874 - protein, 13 aa, Mycobacterium tuberculosis
ASNVVRWVPHRYW

SEQ ID NO: 59875 - protein, 13 aa, Mycobacterium tuberculosis
SNVVRWVPHRYWP

SEQ ID NO: 59876 - protein, 13 aa, Mycobacterium tuberculosis
NVVRWVPHRYWPP

SEQ ID NO: 59877 - protein, 13 aa, Mycobacterium tuberculosis
VVRWVPHRYWPPH

SEQ ID NO: 59878 - protein, 13 aa, Mycobacterium tuberculosis
VRWVPHRYWPPHT

SEQ ID NO: 59879 - protein, 13 aa, Mycobacterium tuberculosis
RWVPHRYWPPHTR

SEQ ID NO: 59880 - protein, 13 aa, Mycobacterium tuberculosis
WVPHRYWPPHTRV

SEQ ID NO: 59881 - protein, 13 aa, Mycobacterium tuberculosis
VPHRYWPPHTRVS

SEQ ID NO: 59882 - protein, 13 aa, Mycobacterium tuberculosis
PHRYWPPHTRVSV

SEQ ID NO: 59883 - protein, 13 aa, Mycobacterium tuberculosis
HRYWPPHTRVSVG

SEQ ID NO: 59884 - protein, 13 aa, Mycobacterium tuberculosis
RYWPPHTRVSVGV

SEQ ID NO: 59885 - protein, 13 aa, Mycobacterium tuberculosis
YWPPHTRVSVGVQ

SEQ ID NO: 59886 - protein, 13 aa, Mycobacterium tuberculosis
WPPHTRVSVGVQE

SEQ ID NO: 59887 - protein, 13 aa, Mycobacterium tuberculosis
PPHTRVSVGVQEL

SEQ ID NO: 59888 - protein, 13 aa, Mycobacterium tuberculosis
PHTRVSVGVQELT

SEQ ID NO: 59889 - protein, 13 aa, Mycobacterium tuberculosis
HTRVSVGVQELTE

SEQ ID NO: 59890 - protein, 13 aa, Mycobacterium tuberculosis
TRVSVGVQELTEG

SEQ ID NO: 59891 - protein, 13 aa, Mycobacterium tuberculosis
RVSVGVQELTEGF

SEQ ID NO: 59892 - protein, 13 aa, Mycobacterium tuberculosis
VSVGVQELTEGFE

SEQ ID NO: 59893 - protein, 13 aa, Mycobacterium tuberculosis
SVGVQELTEGFET

SEQ ID NO: 59894 - protein, 13 aa, Mycobacterium tuberculosis
VGVQELTEGFETG

SEQ ID NO: 59895 - protein, 13 aa, Mycobacterium tuberculosis
GVQELTEGFETGD

SEQ ID NO: 59896 - protein, 13 aa, Mycobacterium tuberculosis
VQELTEGFETGDA

SEQ ID NO: 59897 - protein, 13 aa, Mycobacterium tuberculosis
QELTEGFETGDAL

SEQ ID NO: 59898 - protein, 13 aa, Mycobacterium tuberculosis
ELTEGFETGDALI

SEQ ID NO: 59899 - protein, 13 aa, Mycobacterium tuberculosis
LTEGFETGDALIG

SEQ ID NO: 59900 - protein, 13 aa, Mycobacterium tuberculosis
TEGFETGDALIGV

SEQ ID NO: 59901 - protein, 13 aa, Mycobacterium tuberculosis
EGFETGDALIGVA

SEQ ID NO: 59902 - protein, 13 aa, Mycobacterium tuberculosis
GFETGDALIGVAS

SEQ ID NO: 59903 - protein, 13 aa, Mycobacterium tuberculosis
FETGDALIGVASI

SEQ ID NO: 59904 - protein, 13 aa, Mycobacterium tuberculosis
ETGDALIGVASIS

SEQ ID NO: 59905 - protein, 13 aa, Mycobacterium tuberculosis
TGDALIGVASISA

SEQ ID NO: 59906 - protein, 13 aa, Mycobacterium tuberculosis
GDALIGVASISAH

SEQ ID NO: 59907 - protein, 13 aa, Mycobacterium tuberculosis
DALIGVASISAHT

SEQ ID NO: 59908 - protein, 13 aa, Mycobacterium tuberculosis
ALIGVASISAHTF

SEQ ID NO: 59909 - protein, 13 aa, Mycobacterium tuberculosis
LIGVASISAHTFT

SEQ ID NO: 59910 - protein, 13 aa, Mycobacterium tuberculosis
IGVASISAHTFTV

SEQ ID NO: 59911 - protein, 13 aa, Mycobacterium tuberculosis
GVASISAHTFTVS

SEQ ID NO: 59912 - protein, 13 aa, Mycobacterium tuberculosis
VASISAHTFTVSR

SEQ ID NO: 59913 - protein, 13 aa, Mycobacterium tuberculosis
ASISAHTFTVSRN

SEQ ID NO: 59914 - protein, 13 aa, Mycobacterium tuberculosis
SISAHTFTVSRNG

SEQ ID NO: 59915 - protein, 13 aa, Mycobacterium tuberculosis
ISAHTFTVSRNGE

SEQ ID NO: 59916 - protein, 13 aa, Mycobacterium tuberculosis
SAHTFTVSRNGEV

SEQ ID NO: 59917 - protein, 13 aa, Mycobacterium tuberculosis
AHTFTVSRNGEVL

SEQ ID NO: 59918 - protein, 13 aa, Mycobacterium tuberculosis
HTFTVSRNGEVLR

SEQ ID NO: 59919 - protein, 13 aa, Mycobacterium tuberculosis
TFTVSRNGEVLRT

SEQ ID NO: 59920 - protein, 13 aa, Mycobacterium tuberculosis
FTVSRNGEVLRTM

SEQ ID NO: 59921 - protein, 13 aa, Mycobacterium tuberculosis
TVSRNGEVLRTMP

SEQ ID NO: 59922 - protein, 13 aa, Mycobacterium tuberculosis
VSRNGEVLRTMPA

SEQ ID NO: 59923 - protein, 13 aa, Mycobacterium tuberculosis
SRNGEVLRTMPAS

SEQ ID NO: 59924 - protein, 13 aa, Mycobacterium tuberculosis
RNGEVLRTMPASL

SEQ ID NO: 59925 - protein, 13 aa, Mycobacterium tuberculosis
NGEVLRTMPASLG

SEQ ID NO: 59926 - protein, 13 aa, Mycobacterium tuberculosis
GEVLRTMPASLGK

SEQ ID NO: 59927 - protein, 13 aa, Mycobacterium tuberculosis
EVLRTMPASLGKP

SEQ ID NO: 59928 - protein, 13 aa, Mycobacterium tuberculosis
VLRTMPASLGKPS

SEQ ID NO: 59929 - protein, 13 aa, Mycobacterium tuberculosis
LRTMPASLGKPSR

SEQ ID NO: 59930 - protein, 13 aa, Mycobacterium tuberculosis
RTMPASLGKPSRP

SEQ ID NO: 59931 - protein, 13 aa, Mycobacterium tuberculosis
TMPASLGKPSRPT

SEQ ID NO: 59932 - protein, 13 aa, Mycobacterium tuberculosis
MPASLGKPSRPTP

SEQ ID NO: 59933 - protein, 13 aa, Mycobacterium tuberculosis
PASLGKPSRPTPI

SEQ ID NO: 59934 - protein, 13 aa, Mycobacterium tuberculosis
ASLGKPSRPTPIG

SEQ ID NO: 59935 - protein, 13 aa, Mycobacterium tuberculosis
SLGKPSRPTPIGS

SEQ ID NO: 59936 - protein, 13 aa, Mycobacterium tuberculosis
LGKPSRPTPIGSF

SEQ ID NO: 59937 - protein, 13 aa, Mycobacterium tuberculosis
GKPSRPTPIGSFH

SEQ ID NO: 59938 - protein, 13 aa, Mycobacterium tuberculosis
KPSRPTPIGSFHA

SEQ ID NO: 59939 - protein, 13 aa, Mycobacterium tuberculosis
PSRPTPIGSFHAM

SEQ ID NO: 59940 - protein, 13 aa, Mycobacterium tuberculosis
SRPTPIGSFHAMS

SEQ ID NO: 59941 - protein, 13 aa, Mycobacterium tuberculosis
RPTPIGSFHAMSK

SEQ ID NO: 59942 - protein, 13 aa, Mycobacterium tuberculosis
PTPIGSFHAMSKE

SEQ ID NO: 59943 - protein, 13 aa, Mycobacterium tuberculosis
TPIGSFHAMSKER

SEQ ID NO: 59944 - protein, 13 aa, Mycobacterium tuberculosis
PIGSFHAMSKERT

SEQ ID NO: 59945 - protein, 13 aa, Mycobacterium tuberculosis
IGSFHAMSKERTV

SEQ ID NO: 59946 - protein, 13 aa, Mycobacterium tuberculosis
GSFHAMSKERTVV

SEQ ID NO: 59947 - protein, 13 aa, Mycobacterium tuberculosis
SFHAMSKERTVVM

SEQ ID NO: 59948 - protein, 13 aa, Mycobacterium tuberculosis
FHAMSKERTVVMD

SEQ ID NO: 59949 - protein, 13 aa, Mycobacterium tuberculosis
HAMSKERTVVMDS

SEQ ID NO: 59950 - protein, 13 aa, Mycobacterium tuberculosis
AMSKERTVVMDSR

SEQ ID NO: 59951 - protein, 13 aa, Mycobacterium tuberculosis
MSKERTVVMDSRT

SEQ ID NO: 59952 - protein, 13 aa, Mycobacterium tuberculosis
SKERTVVMDSRTI

SEQ ID NO: 59953 - protein, 13 aa, Mycobacterium tuberculosis
KERTVVMDSRTIG

SEQ ID NO: 59954 - protein, 13 aa, Mycobacterium tuberculosis
ERTVVMDSRTIGI

SEQ ID NO: 59955 - protein, 13 aa, Mycobacterium tuberculosis
RTVVMDSRTIGIP

SEQ ID NO: 59956 - protein, 13 aa, Mycobacterium tuberculosis
TVVMDSRTIGIPL

SEQ ID NO: 59957 - protein, 13 aa, Mycobacterium tuberculosis
VVMDSRTIGIPLN

SEQ ID NO: 59958 - protein, 13 aa, Mycobacterium tuberculosis
VMDSRTIGIPLNS

SEQ ID NO: 59959 - protein, 13 aa, Mycobacterium tuberculosis
MDSRTIGIPLNSS

SEQ ID NO: 59960 - protein, 13 aa, Mycobacterium tuberculosis
DSRTIGIPLNSSD

SEQ ID NO: 59961 - protein, 13 aa, Mycobacterium tuberculosis
SRTIGIPLNSSDG

SEQ ID NO: 59962 - protein, 13 aa, Mycobacterium tuberculosis
RTIGIPLNSSDGY

SEQ ID NO: 59963 - protein, 13 aa, Mycobacterium tuberculosis
TIGIPLNSSDGYL

SEQ ID NO: 59964 - protein, 13 aa, Mycobacterium tuberculosis
IGIPLNSSDGYLL

SEQ ID NO: 59965 - protein, 13 aa, Mycobacterium tuberculosis
GIPLNSSDGYLLT

SEQ ID NO: 59966 - protein, 13 aa, Mycobacterium tuberculosis
IPLNSSDGYLLTA

SEQ ID NO: 59967 - protein, 13 aa, Mycobacterium tuberculosis
PLNSSDGYLLTAH

SEQ ID NO: 59968 - protein, 13 aa, Mycobacterium tuberculosis
LNSSDGYLLTAHY

SEQ ID NO: 59969 - protein, 13 aa, Mycobacterium tuberculosis
NSSDGYLLTAHYA

SEQ ID NO: 59970 - protein, 13 aa, Mycobacterium tuberculosis
SSDGYLLTAHYAV

SEQ ID NO: 59971 - protein, 13 aa, Mycobacterium tuberculosis
SDGYLLTAHYAVR

SEQ ID NO: 59972 - protein, 13 aa, Mycobacterium tuberculosis
DGYLLTAHYAVRV

SEQ ID NO: 59973 - protein, 13 aa, Mycobacterium tuberculosis
GYLLTAHYAVRVT

SEQ ID NO: 59974 - protein, 13 aa, Mycobacterium tuberculosis
YLLTAHYAVRVTW

SEQ ID NO: 59975 - protein, 13 aa, Mycobacterium tuberculosis
LLTAHYAVRVTWS

SEQ ID NO: 59976 - protein, 13 aa, Mycobacterium tuberculosis
LTAHYAVRVTWSG

SEQ ID NO: 59977 - protein, 13 aa, Mycobacterium tuberculosis
TAHYAVRVTWSGV

SEQ ID NO: 59978 - protein, 13 aa, Mycobacterium tuberculosis
AHYAVRVTWSGVY

SEQ ID NO: 59979 - protein, 13 aa, Mycobacterium tuberculosis
HYAVRVTWSGVYV

SEQ ID NO: 59980 - protein, 13 aa, Mycobacterium tuberculosis
YAVRVTWSGVYVH

SEQ ID NO: 59981 - protein, 13 aa, Mycobacterium tuberculosis
AVRVTWSGVYVHS

SEQ ID NO: 59982 - protein, 13 aa, Mycobacterium tuberculosis
VRVTWSGVYVHSA

SEQ ID NO: 59983 - protein, 13 aa, Mycobacterium tuberculosis
RVTWSGVYVHSAP

SEQ ID NO: 59984 - protein, 13 aa, Mycobacterium tuberculosis
VTWSGVYVHSAPW

SEQ ID NO: 59985 - protein, 13 aa, Mycobacterium tuberculosis
TWSGVYVHSAPWS

SEQ ID NO: 59986 - protein, 13 aa, Mycobacterium tuberculosis
WSGVYVHSAPWSV

SEQ ID NO: 59987 - protein, 13 aa, Mycobacterium tuberculosis
SGVYVHSAPWSVN

SEQ ID NO: 59988 - protein, 13 aa, Mycobacterium tuberculosis
GVYVHSAPWSVNS

SEQ ID NO: 59989 - protein, 13 aa, Mycobacterium tuberculosis
VYVHSAPWSVNSQ

SEQ ID NO: 59990 - protein, 13 aa, Mycobacterium tuberculosis
YVHSAPWSVNSQG

SEQ ID NO: 59991 - protein, 13 aa, Mycobacterium tuberculosis
VHSAPWSVNSQGY

SEQ ID NO: 59992 - protein, 13 aa, Mycobacterium tuberculosis
HSAPWSVNSQGYA

SEQ ID NO: 59993 - protein, 13 aa, Mycobacterium tuberculosis
SAPWSVNSQGYAN

SEQ ID NO: 59994 - protein, 13 aa, Mycobacterium tuberculosis
APWSVNSQGYANV

SEQ ID NO: 59995 - protein, 13 aa, Mycobacterium tuberculosis
PWSVNSQGYANVS

SEQ ID NO: 59996 - protein, 13 aa, Mycobacterium tuberculosis
WSVNSQGYANVSH

SEQ ID NO: 59997 - protein, 13 aa, Mycobacterium tuberculosis
SVNSQGYANVSHG

SEQ ID NO: 59998 - protein, 13 aa, Mycobacterium tuberculosis
VNSQGYANVSHGC

SEQ ID NO: 59999 - protein, 13 aa, Mycobacterium tuberculosis
NSQGYANVSHGCI

SEQ ID NO: 60000 - protein, 13 aa, Mycobacterium tuberculosis
SQGYANVSHGCIN

SEQ ID NO: 60001 - protein, 13 aa, Mycobacterium tuberculosis
QGYANVSHGCINL

SEQ ID NO: 60002 - protein, 13 aa, Mycobacterium tuberculosis
GYANVSHGCINLS

SEQ ID NO: 60003 - protein, 13 aa, Mycobacterium tuberculosis
YANVSHGCINLSP

SEQ ID NO: 60004 - protein, 13 aa, Mycobacterium tuberculosis
ANVSHGCINLSPD

SEQ ID NO: 60005 - protein, 13 aa, Mycobacterium tuberculosis
NVSHGCINLSPDN

SEQ ID NO: 60006 - protein, 13 aa, Mycobacterium tuberculosis
VSHGCINLSPDNA

SEQ ID NO: 60007 - protein, 13 aa, Mycobacterium tuberculosis
SHGCINLSPDNAA

SEQ ID NO: 60008 - protein, 13 aa, Mycobacterium tuberculosis
HGCINLSPDNAAW

SEQ ID NO: 60009 - protein, 13 aa, Mycobacterium tuberculosis
GCINLSPDNAAWY

SEQ ID NO: 60010 - protein, 13 aa, Mycobacterium tuberculosis
CINLSPDNAAWYF

SEQ ID NO: 60011 - protein, 13 aa, Mycobacterium tuberculosis
INLSPDNAAWYFD

SEQ ID NO: 60012 - protein, 13 aa, Mycobacterium tuberculosis
NLSPDNAAWYFDA

SEQ ID NO: 60013 - protein, 13 aa, Mycobacterium tuberculosis
LSPDNAAWYFDAV

SEQ ID NO: 60014 - protein, 13 aa, Mycobacterium tuberculosis
SPDNAAWYFDAVT

SEQ ID NO: 60015 - protein, 13 aa, Mycobacterium tuberculosis
PDNAAWYFDAVTV

SEQ ID NO: 60016 - protein, 13 aa, Mycobacterium tuberculosis
DNAAWYFDAVTVG

SEQ ID NO: 60017 - protein, 13 aa, Mycobacterium tuberculosis
NAAWYFDAVTVGD

SEQ ID NO: 60018 - protein, 13 aa, Mycobacterium tuberculosis
AAWYFDAVTVGDP

SEQ ID NO: 60019 - protein, 13 aa, Mycobacterium tuberculosis
AWYFDAVTVGDPI

SEQ ID NO: 60020 - protein, 13 aa, Mycobacterium tuberculosis
WYFDAVTVGDPIE

SEQ ID NO: 60021 - protein, 13 aa, Mycobacterium tuberculosis
YFDAVTVGDPIEV

SEQ ID NO: 60022 - protein, 13 aa, Mycobacterium tuberculosis
FDAVTVGDPIEVV

SEQ ID NO: 60023 - protein, 13 aa, Mycobacterium tuberculosis
DAVTVGDPIEVVG

SEQ ID NO: 60024 - protein, 14 aa, Mycobacterium tuberculosis
MRRVVRYLSVVVAI

SEQ ID NO: 60025 - protein, 14 aa, Mycobacterium tuberculosis
RRVVRYLSVVVAIT

SEQ ID NO: 60026 - protein, 14 aa, Mycobacterium tuberculosis
RVVRYLSVVVAITL

SEQ ID NO: 60027 - protein, 14 aa, Mycobacterium tuberculosis
VVRYLSVVVAITLM

SEQ ID NO: 60028 - protein, 14 aa, Mycobacterium tuberculosis
VRYLSVVVAITLML

SEQ ID NO: 60029 - protein, 14 aa, Mycobacterium tuberculosis
RYLSVVVAITLMLT

SEQ ID NO: 60030 - protein, 14 aa, Mycobacterium tuberculosis
YLSVVVAITLMLTA

SEQ ID NO: 60031 - protein, 14 aa, Mycobacterium tuberculosis
LSVVVAITLMLTAE

SEQ ID NO: 60032 - protein, 14 aa, Mycobacterium tuberculosis
SVVVAITLMLTAES

SEQ ID NO: 60033 - protein, 14 aa, Mycobacterium tuberculosis
VVVAITLMLTAESV

SEQ ID NO: 60034 - protein, 14 aa, Mycobacterium tuberculosis
VVAITLMLTAESVS

SEQ ID NO: 60035 - protein, 14 aa, Mycobacterium tuberculosis
VAITLMLTAESVSI

SEQ ID NO: 60036 - protein, 14 aa, Mycobacterium tuberculosis
AITLMLTAESVSIA

SEQ ID NO: 60037 - protein, 14 aa, Mycobacterium tuberculosis
ITLMLTAESVSIAT

SEQ ID NO: 60038 - protein, 14 aa, Mycobacterium tuberculosis
TLMLTAESVSIATA

SEQ ID NO: 60039 - protein, 14 aa, Mycobacterium tuberculosis
LMLTAESVSIATAA

SEQ ID NO: 60040 - protein, 14 aa, Mycobacterium tuberculosis
MLTAESVSIATAAV

SEQ ID NO: 60041 - protein, 14 aa, Mycobacterium tuberculosis
LTAESVSIATAAVP

SEQ ID NO: 60042 - protein, 14 aa, Mycobacterium tuberculosis
TAESVSIATAAVPP

SEQ ID NO: 60043 - protein, 14 aa, Mycobacterium tuberculosis
AESVSIATAAVPPL

SEQ ID NO: 60044 - protein, 14 aa, Mycobacterium tuberculosis
ESVSIATAAVPPLQ

SEQ ID NO: 60045 - protein, 14 aa, Mycobacterium tuberculosis
SVSIATAAVPPLQP

SEQ ID NO: 60046 - protein, 14 aa, Mycobacterium tuberculosis
VSIATAAVPPLQPI

SEQ ID NO: 60047 - protein, 14 aa, Mycobacterium tuberculosis
SIATAAVPPLQPIP

SEQ ID NO: 60048 - protein, 14 aa, Mycobacterium tuberculosis
IATAAVPPLQPIPG

SEQ ID NO: 60049 - protein, 14 aa, Mycobacterium tuberculosis
ATAAVPPLQPIPGV

SEQ ID NO: 60050 - protein, 14 aa, Mycobacterium tuberculosis
TAAVPPLQPIPGVA

SEQ ID NO: 60051 - protein, 14 aa, Mycobacterium tuberculosis
AAVPPLQPIPGVAS

SEQ ID NO: 60052 - protein, 14 aa, Mycobacterium tuberculosis
AVPPLQPIPGVASV

SEQ ID NO: 60053 - protein, 14 aa, Mycobacterium tuberculosis
VPPLQPIPGVASVS

SEQ ID NO: 60054 - protein, 14 aa, Mycobacterium tuberculosis
PPLQPIPGVASVSP

SEQ ID NO: 60055 - protein, 14 aa, Mycobacterium tuberculosis
PLQPIPGVASVSPA

SEQ ID NO: 60056 - protein, 14 aa, Mycobacterium tuberculosis
LQPIPGVASVSPAN

SEQ ID NO: 60057 - protein, 14 aa, Mycobacterium tuberculosis
QPIPGVASVSPANG

SEQ ID NO: 60058 - protein, 14 aa, Mycobacterium tuberculosis
PIPGVASVSPANGA

SEQ ID NO: 60059 - protein, 14 aa, Mycobacterium tuberculosis
IPGVASVSPANGAV

SEQ ID NO: 60060 - protein, 14 aa, Mycobacterium tuberculosis
PGVASVSPANGAVV

SEQ ID NO: 60061 - protein, 14 aa, Mycobacterium tuberculosis
GVASVSPANGAVVG

SEQ ID NO: 60062 - protein, 14 aa, Mycobacterium tuberculosis
VASVSPANGAVVGV

SEQ ID NO: 60063 - protein, 14 aa, Mycobacterium tuberculosis
ASVSPANGAVVGVA

SEQ ID NO: 60064 - protein, 14 aa, Mycobacterium tuberculosis
SVSPANGAVVGVAH

SEQ ID NO: 60065 - protein, 14 aa, Mycobacterium tuberculosis
VSPANGAVVGVAHP

SEQ ID NO: 60066 - protein, 14 aa, Mycobacterium tuberculosis
SPANGAVVGVAHPV

SEQ ID NO: 60067 - protein, 14 aa, Mycobacterium tuberculosis
PANGAVVGVAHPVV

SEQ ID NO: 60068 - protein, 14 aa, Mycobacterium tuberculosis
ANGAVVGVAHPVVV

SEQ ID NO: 60069 - protein, 14 aa, Mycobacterium tuberculosis
NGAVVGVAHPVVVT

SEQ ID NO: 60070 - protein, 14 aa, Mycobacterium tuberculosis
GAVVGVAHPVVVTF

SEQ ID NO: 60071 - protein, 14 aa, Mycobacterium tuberculosis
AVVGVAHPVVVTFT

SEQ ID NO: 60072 - protein, 14 aa, Mycobacterium tuberculosis
VVGVAHPVVVTFTT

SEQ ID NO: 60073 - protein, 14 aa, Mycobacterium tuberculosis
VGVAHPVVVTFTTP

SEQ ID NO: 60074 - protein, 14 aa, Mycobacterium tuberculosis
GVAHPVVVTFTTPV

SEQ ID NO: 60075 - protein, 14 aa, Mycobacterium tuberculosis
VAHPVVVTFTTPVT

SEQ ID NO: 60076 - protein, 14 aa, Mycobacterium tuberculosis
AHPVVVTFTTPVTD

SEQ ID NO: 60077 - protein, 14 aa, Mycobacterium tuberculosis
HPVVVTFTTPVTDR

SEQ ID NO: 60078 - protein, 14 aa, Mycobacterium tuberculosis
PVVVTFTTPVTDRR

SEQ ID NO: 60079 - protein, 14 aa, Mycobacterium tuberculosis
VVVTFTTPVTDRRA

SEQ ID NO: 60080 - protein, 14 aa, Mycobacterium tuberculosis
VVTFTTPVTDRRAV

SEQ ID NO: 60081 - protein, 14 aa, Mycobacterium tuberculosis
VTFTTPVTDRRAVE

SEQ ID NO: 60082 - protein, 14 aa, Mycobacterium tuberculosis
TFTTPVTDRRAVER

SEQ ID NO: 60083 - protein, 14 aa, Mycobacterium tuberculosis
FTTPVTDRRAVERS

SEQ ID NO: 60084 - protein, 14 aa, Mycobacterium tuberculosis
TTPVTDRRAVERSI

SEQ ID NO: 60085 - protein, 14 aa, Mycobacterium tuberculosis
TPVTDRRAVERSIR

SEQ ID NO: 60086 - protein, 14 aa, Mycobacterium tuberculosis
PVTDRRAVERSIRI

SEQ ID NO: 60087 - protein, 14 aa, Mycobacterium tuberculosis
VTDRRAVERSIRIS

SEQ ID NO: 60088 - protein, 14 aa, Mycobacterium tuberculosis
TDRRAVERSIRIST

SEQ ID NO: 60089 - protein, 14 aa, Mycobacterium tuberculosis
DRRAVERSIRISTP

SEQ ID NO: 60090 - protein, 14 aa, Mycobacterium tuberculosis
RRAVERSIRISTPH

SEQ ID NO: 60091 - protein, 14 aa, Mycobacterium tuberculosis
RAVERSIRISTPHN

SEQ ID NO: 60092 - protein, 14 aa, Mycobacterium tuberculosis
AVERSIRISTPHNT

SEQ ID NO: 60093 - protein, 14 aa, Mycobacterium tuberculosis
VERSIRISTPHNTT

SEQ ID NO: 60094 - protein, 14 aa, Mycobacterium tuberculosis
ERSIRISTPHNTTG

SEQ ID NO: 60095 - protein, 14 aa, Mycobacterium tuberculosis
RSIRISTPHNTTGH

SEQ ID NO: 60096 - protein, 14 aa, Mycobacterium tuberculosis
SIRISTPHNTTGHF

SEQ ID NO: 60097 - protein, 14 aa, Mycobacterium tuberculosis
IRISTPHNTTGHFE

SEQ ID NO: 60098 - protein, 14 aa, Mycobacterium tuberculosis
RISTPHNTTGHFEW

SEQ ID NO: 60099 - protein, 14 aa, Mycobacterium tuberculosis
ISTPHNTTGHFEWV

SEQ ID NO: 60100 - protein, 14 aa, Mycobacterium tuberculosis
STPHNTTGHFEWVA

SEQ ID NO: 60101 - protein, 14 aa, Mycobacterium tuberculosis
TPHNTTGHFEWVAS

SEQ ID NO: 60102 - protein, 14 aa, Mycobacterium tuberculosis
PHNTTGHFEWVASN

SEQ ID NO: 60103 - protein, 14 aa, Mycobacterium tuberculosis
HNTTGHFEWVASNV

SEQ ID NO: 60104 - protein, 14 aa, Mycobacterium tuberculosis
NTTGHFEWVASNVV

SEQ ID NO: 60105 - protein, 14 aa, Mycobacterium tuberculosis
TTGHFEWVASNVVR

SEQ ID NO: 60106 - protein, 14 aa, Mycobacterium tuberculosis
TGHFEWVASNVVRW

SEQ ID NO: 60107 - protein, 14 aa, Mycobacterium tuberculosis
GHFEWVASNVVRWV

SEQ ID NO: 60108 - protein, 14 aa, Mycobacterium tuberculosis
HFEWVASNVVRWVP

SEQ ID NO: 60109 - protein, 14 aa, Mycobacterium tuberculosis
FEWVASNVVRWVPH

SEQ ID NO: 60110 - protein, 14 aa, Mycobacterium tuberculosis
EWVASNVVRWVPHR

SEQ ID NO: 60111 - protein, 14 aa, Mycobacterium tuberculosis
WVASNVVRWVPHRY

SEQ ID NO: 60112 - protein, 14 aa, Mycobacterium tuberculosis
VASNVVRWVPHRYW

SEQ ID NO: 60113 - protein, 14 aa, Mycobacterium tuberculosis
ASNVVRWVPHRYWP

SEQ ID NO: 60114 - protein, 14 aa, Mycobacterium tuberculosis
SNVVRWVPHRYWPP

SEQ ID NO: 60115 - protein, 14 aa, Mycobacterium tuberculosis
NVVRWVPHRYWPPH

SEQ ID NO: 60116 - protein, 14 aa, Mycobacterium tuberculosis
VVRWVPHRYWPPHT

SEQ ID NO: 60117 - protein, 14 aa, Mycobacterium tuberculosis
VRWVPHRYWPPHTR

SEQ ID NO: 60118 - protein, 14 aa, Mycobacterium tuberculosis
RWVPHRYWPPHTRV

SEQ ID NO: 60119 - protein, 14 aa, Mycobacterium tuberculosis
WVPHRYWPPHTRVS

SEQ ID NO: 60120 - protein, 14 aa, Mycobacterium tuberculosis
VPHRYWPPHTRVSV

SEQ ID NO: 60121 - protein, 14 aa, Mycobacterium tuberculosis
PHRYWPPHTRVSVG

SEQ ID NO: 60122 - protein, 14 aa, Mycobacterium tuberculosis
HRYWPPHTRVSVGV

SEQ ID NO: 60123 - protein, 14 aa, Mycobacterium tuberculosis
RYWPPHTRVSVGVQ

SEQ ID NO: 60124 - protein, 14 aa, Mycobacterium tuberculosis
YWPPHTRVSVGVQE

SEQ ID NO: 60125 - protein, 14 aa, Mycobacterium tuberculosis
WPPHTRVSVGVQEL

SEQ ID NO: 60126 - protein, 14 aa, Mycobacterium tuberculosis
PPHTRVSVGVQELT

SEQ ID NO: 60127 - protein, 14 aa, Mycobacterium tuberculosis
PHTRVSVGVQELTE

SEQ ID NO: 60128 - protein, 14 aa, Mycobacterium tuberculosis
HTRVSVGVQELTEG

SEQ ID NO: 60129 - protein, 14 aa, Mycobacterium tuberculosis
TRVSVGVQELTEGF

SEQ ID NO: 60130 - protein, 14 aa, Mycobacterium tuberculosis
RVSVGVQELTEGFE

SEQ ID NO: 60131 - protein, 14 aa, Mycobacterium tuberculosis
VSVGVQELTEGFET

SEQ ID NO: 60132 - protein, 14 aa, Mycobacterium tuberculosis
SVGVQELTEGFETG

SEQ ID NO: 60133 - protein, 14 aa, Mycobacterium tuberculosis
VGVQELTEGFETGD

SEQ ID NO: 60134 - protein, 14 aa, Mycobacterium tuberculosis
GVQELTEGFETGDA

SEQ ID NO: 60135 - protein, 14 aa, Mycobacterium tuberculosis
VQELTEGFETGDAL

SEQ ID NO: 60136 - protein, 14 aa, Mycobacterium tuberculosis
QELTEGFETGDALI

SEQ ID NO: 60137 - protein, 14 aa, Mycobacterium tuberculosis
ELTEGFETGDALIG

SEQ ID NO: 60138 - protein, 14 aa, Mycobacterium tuberculosis
LTEGFETGDALIGV

SEQ ID NO: 60139 - protein, 14 aa, Mycobacterium tuberculosis
TEGFETGDALIGVA

SEQ ID NO: 60140 - protein, 14 aa, Mycobacterium tuberculosis
EGFETGDALIGVAS

SEQ ID NO: 60141 - protein, 14 aa, Mycobacterium tuberculosis
GFETGDALIGVASI

SEQ ID NO: 60142 - protein, 14 aa, Mycobacterium tuberculosis
FETGDALIGVASIS

SEQ ID NO: 60143 - protein, 14 aa, Mycobacterium tuberculosis
ETGDALIGVASISA

SEQ ID NO: 60144 - protein, 14 aa, Mycobacterium tuberculosis
TGDALIGVASISAH

SEQ ID NO: 60145 - protein, 14 aa, Mycobacterium tuberculosis
GDALIGVASISAHT

SEQ ID NO: 60146 - protein, 14 aa, Mycobacterium tuberculosis
DALIGVASISAHTF

SEQ ID NO: 60147 - protein, 14 aa, Mycobacterium tuberculosis
ALIGVASISAHTFT

SEQ ID NO: 60148 - protein, 14 aa, Mycobacterium tuberculosis
LIGVASISAHTFTV

SEQ ID NO: 60149 - protein, 14 aa, Mycobacterium tuberculosis
IGVASISAHTFTVS

SEQ ID NO: 60150 - protein, 14 aa, Mycobacterium tuberculosis
GVASISAHTFTVSR

SEQ ID NO: 60151 - protein, 14 aa, Mycobacterium tuberculosis
VASISAHTFTVSRN

SEQ ID NO: 60152 - protein, 14 aa, Mycobacterium tuberculosis
ASISAHTFTVSRNG

SEQ ID NO: 60153 - protein, 14 aa, Mycobacterium tuberculosis
SISAHTFTVSRNGE

SEQ ID NO: 60154 - protein, 14 aa, Mycobacterium tuberculosis
ISAHTFTVSRNGEV

SEQ ID NO: 60155 - protein, 14 aa, Mycobacterium tuberculosis
SAHTFTVSRNGEVL

SEQ ID NO: 60156 - protein, 14 aa, Mycobacterium tuberculosis
AHTFTVSRNGEVLR

SEQ ID NO: 60157 - protein, 14 aa, Mycobacterium tuberculosis
HTFTVSRNGEVLRT

SEQ ID NO: 60158 - protein, 14 aa, Mycobacterium tuberculosis
TFTVSRNGEVLRTM

SEQ ID NO: 60159 - protein, 14 aa, Mycobacterium tuberculosis
FTVSRNGEVLRTMP

SEQ ID NO: 60160 - protein, 14 aa, Mycobacterium tuberculosis
TVSRNGEVLRTMPA

SEQ ID NO: 60161 - protein, 14 aa, Mycobacterium tuberculosis
VSRNGEVLRTMPAS

SEQ ID NO: 60162 - protein, 14 aa, Mycobacterium tuberculosis
SRNGEVLRTMPASL

SEQ ID NO: 60163 - protein, 14 aa, Mycobacterium tuberculosis
RNGEVLRTMPASLG

SEQ ID NO: 60164 - protein, 14 aa, Mycobacterium tuberculosis
NGEVLRTMPASLGK

SEQ ID NO: 60165 - protein, 14 aa, Mycobacterium tuberculosis
GEVLRTMPASLGKP

SEQ ID NO: 60166 - protein, 14 aa, Mycobacterium tuberculosis
EVLRTMPASLGKPS

SEQ ID NO: 60167 - protein, 14 aa, Mycobacterium tuberculosis
VLRTMPASLGKPSR

SEQ ID NO: 60168 - protein, 14 aa, Mycobacterium tuberculosis
LRTMPASLGKPSRP

SEQ ID NO: 60169 - protein, 14 aa, Mycobacterium tuberculosis
RTMPASLGKPSRPT

SEQ ID NO: 60170 - protein, 14 aa, Mycobacterium tuberculosis
TMPASLGKPSRPTP

SEQ ID NO: 60171 - protein, 14 aa, Mycobacterium tuberculosis
MPASLGKPSRPTPI

SEQ ID NO: 60172 - protein, 14 aa, Mycobacterium tuberculosis
PASLGKPSRPTPIG

SEQ ID NO: 60173 - protein, 14 aa, Mycobacterium tuberculosis
ASLGKPSRPTPIGS

SEQ ID NO: 60174 - protein, 14 aa, Mycobacterium tuberculosis
SLGKPSRPTPIGSF

SEQ ID NO: 60175 - protein, 14 aa, Mycobacterium tuberculosis
LGKPSRPTPIGSFH

SEQ ID NO: 60176 - protein, 14 aa, Mycobacterium tuberculosis
GKPSRPTPIGSFHA

SEQ ID NO: 60177 - protein, 14 aa, Mycobacterium tuberculosis
KPSRPTPIGSFHAM

SEQ ID NO: 60178 - protein, 14 aa, Mycobacterium tuberculosis
PSRPTPIGSFHAMS

SEQ ID NO: 60179 - protein, 14 aa, Mycobacterium tuberculosis
SRPTPIGSFHAMSK

SEQ ID NO: 60180 - protein, 14 aa, Mycobacterium tuberculosis
RPTPIGSFHAMSKE

SEQ ID NO: 60181 - protein, 14 aa, Mycobacterium tuberculosis
PTPIGSFHAMSKER

SEQ ID NO: 60182 - protein, 14 aa, Mycobacterium tuberculosis
TPIGSFHAMSKERT

SEQ ID NO: 60183 - protein, 14 aa, Mycobacterium tuberculosis
PIGSFHAMSKERTV

SEQ ID NO: 60184 - protein, 14 aa, Mycobacterium tuberculosis
IGSFHAMSKERTVV

SEQ ID NO: 60185 - protein, 14 aa, Mycobacterium tuberculosis
GSFHAMSKERTVVM

SEQ ID NO: 60186 - protein, 14 aa, Mycobacterium tuberculosis
SFHAMSKERTVVMD

SEQ ID NO: 60187 - protein, 14 aa, Mycobacterium tuberculosis
FHAMSKERTVVMDS

SEQ ID NO: 60188 - protein, 14 aa, Mycobacterium tuberculosis
HAMSKERTVVMDSR

SEQ ID NO: 60189 - protein, 14 aa, Mycobacterium tuberculosis
AMSKERTVVMDSRT

SEQ ID NO: 60190 - protein, 14 aa, Mycobacterium tuberculosis
MSKERTVVMDSRTI

SEQ ID NO: 60191 - protein, 14 aa, Mycobacterium tuberculosis
SKERTVVMDSRTIG

SEQ ID NO: 60192 - protein, 14 aa, Mycobacterium tuberculosis
KERTVVMDSRTIGI

SEQ ID NO: 60193 - protein, 14 aa, Mycobacterium tuberculosis
ERTVVMDSRTIGIP

SEQ ID NO: 60194 - protein, 14 aa, Mycobacterium tuberculosis
RTVVMDSRTIGIPL

SEQ ID NO: 60195 - protein, 14 aa, Mycobacterium tuberculosis
TVVMDSRTIGIPLN

SEQ ID NO: 60196 - protein, 14 aa, Mycobacterium tuberculosis
VVMDSRTIGIPLNS

SEQ ID NO: 60197 - protein, 14 aa, Mycobacterium tuberculosis
VMDSRTIGIPLNSS

SEQ ID NO: 60198 - protein, 14 aa, Mycobacterium tuberculosis
MDSRTIGIPLNSSD

SEQ ID NO: 60199 - protein, 14 aa, Mycobacterium tuberculosis
DSRTIGIPLNSSDG

SEQ ID NO: 60200 - protein, 14 aa, Mycobacterium tuberculosis
SRTIGIPLNSSDGY

SEQ ID NO: 60201 - protein, 14 aa, Mycobacterium tuberculosis
RTIGIPLNSSDGYL

SEQ ID NO: 60202 - protein, 14 aa, Mycobacterium tuberculosis
TIGIPLNSSDGYLL

SEQ ID NO: 60203 - protein, 14 aa, Mycobacterium tuberculosis
IGIPLNSSDGYLLT

SEQ ID NO: 60204 - protein, 14 aa, Mycobacterium tuberculosis
GIPLNSSDGYLLTA

SEQ ID NO: 60205 - protein, 14 aa, Mycobacterium tuberculosis
IPLNSSDGYLLTAH

SEQ ID NO: 60206 - protein, 14 aa, Mycobacterium tuberculosis
PLNSSDGYLLTAHY

SEQ ID NO: 60207 - protein, 14 aa, Mycobacterium tuberculosis
LNSSDGYLLTAHYA

SEQ ID NO: 60208 - protein, 14 aa, Mycobacterium tuberculosis
NSSDGYLLTAHYAV

SEQ ID NO: 60209 - protein, 14 aa, Mycobacterium tuberculosis
SSDGYLLTAHYAVR

SEQ ID NO: 60210 - protein, 14 aa, Mycobacterium tuberculosis
SDGYLLTAHYAVRV

SEQ ID NO: 60211 - protein, 14 aa, Mycobacterium tuberculosis
DGYLLTAHYAVRVT

SEQ ID NO: 60212 - protein, 14 aa, Mycobacterium tuberculosis
GYLLTAHYAVRVTW

SEQ ID NO: 60213 - protein, 14 aa, Mycobacterium tuberculosis
YLLTAHYAVRVTWS

SEQ ID NO: 60214 - protein, 14 aa, Mycobacterium tuberculosis
LLTAHYAVRVTWSG

SEQ ID NO: 60215 - protein, 14 aa, Mycobacterium tuberculosis
LTAHYAVRVTWSGV

SEQ ID NO: 60216 - protein, 14 aa, Mycobacterium tuberculosis
TAHYAVRVTWSGVY

SEQ ID NO: 60217 - protein, 14 aa, Mycobacterium tuberculosis
AHYAVRVTWSGVYV

SEQ ID NO: 60218 - protein, 14 aa, Mycobacterium tuberculosis
HYAVRVTWSGVYVH

SEQ ID NO: 60219 - protein, 14 aa, Mycobacterium tuberculosis
YAVRVTWSGVYVHS

SEQ ID NO: 60220 - protein, 14 aa, Mycobacterium tuberculosis
AVRVTWSGVYVHSA

SEQ ID NO: 60221 - protein, 14 aa, Mycobacterium tuberculosis
VRVTWSGVYVHSAP

SEQ ID NO: 60222 - protein, 14 aa, Mycobacterium tuberculosis
RVTWSGVYVHSAPW

SEQ ID NO: 60223 - protein, 14 aa, Mycobacterium tuberculosis
VTWSGVYVHSAPWS

SEQ ID NO: 60224 - protein, 14 aa, Mycobacterium tuberculosis
TWSGVYVHSAPWSV

SEQ ID NO: 60225 - protein, 14 aa, Mycobacterium tuberculosis
WSGVYVHSAPWSVN

SEQ ID NO: 60226 - protein, 14 aa, Mycobacterium tuberculosis
SGVYVHSAPWSVNS

SEQ ID NO: 60227 - protein, 14 aa, Mycobacterium tuberculosis
GVYVHSAPWSVNSQ

SEQ ID NO: 60228 - protein, 14 aa, Mycobacterium tuberculosis
VYVHSAPWSVNSQG

SEQ ID NO: 60229 - protein, 14 aa, Mycobacterium tuberculosis
YVHSAPWSVNSQGY

SEQ ID NO: 60230 - protein, 14 aa, Mycobacterium tuberculosis
VHSAPWSVNSQGYA

SEQ ID NO: 60231 - protein, 14 aa, Mycobacterium tuberculosis
HSAPWSVNSQGYAN

SEQ ID NO: 60232 - protein, 14 aa, Mycobacterium tuberculosis
SAPWSVNSQGYANV

SEQ ID NO: 60233 - protein, 14 aa, Mycobacterium tuberculosis
APWSVNSQGYANVS

SEQ ID NO: 60234 - protein, 14 aa, Mycobacterium tuberculosis
PWSVNSQGYANVSH

SEQ ID NO: 60235 - protein, 14 aa, Mycobacterium tuberculosis
WSVNSQGYANVSHG

SEQ ID NO: 60236 - protein, 14 aa, Mycobacterium tuberculosis
SVNSQGYANVSHGC

SEQ ID NO: 60237 - protein, 14 aa, Mycobacterium tuberculosis
VNSQGYANVSHGCI

SEQ ID NO: 60238 - protein, 14 aa, Mycobacterium tuberculosis
NSQGYANVSHGCIN

SEQ ID NO: 60239 - protein, 14 aa, Mycobacterium tuberculosis
SQGYANVSHGCINL

SEQ ID NO: 60240 - protein, 14 aa, Mycobacterium tuberculosis
QGYANVSHGCINLS

SEQ ID NO: 60241 - protein, 14 aa, Mycobacterium tuberculosis
GYANVSHGCINLSP

SEQ ID NO: 60242 - protein, 14 aa, Mycobacterium tuberculosis
YANVSHGCINLSPD

SEQ ID NO: 60243 - protein, 14 aa, Mycobacterium tuberculosis
ANVSHGCINLSPDN

SEQ ID NO: 60244 - protein, 14 aa, Mycobacterium tuberculosis
NVSHGCINLSPDNA

SEQ ID NO: 60245 - protein, 14 aa, Mycobacterium tuberculosis
VSHGCINLSPDNAA

SEQ ID NO: 60246 - protein, 14 aa, Mycobacterium tuberculosis
SHGCINLSPDNAAW

SEQ ID NO: 60247 - protein, 14 aa, Mycobacterium tuberculosis
HGCINLSPDNAAWY

SEQ ID NO: 60248 - protein, 14 aa, Mycobacterium tuberculosis
GCINLSPDNAAWYF

SEQ ID NO: 60249 - protein, 14 aa, Mycobacterium tuberculosis
CINLSPDNAAWYFD

SEQ ID NO: 60250 - protein, 14 aa, Mycobacterium tuberculosis
INLSPDNAAWYFDA

SEQ ID NO: 60251 - protein, 14 aa, Mycobacterium tuberculosis
NLSPDNAAWYFDAV

SEQ ID NO: 60252 - protein, 14 aa, Mycobacterium tuberculosis
LSPDNAAWYFDAVT

SEQ ID NO: 60253 - protein, 14 aa, Mycobacterium tuberculosis
SPDNAAWYFDAVTV

SEQ ID NO: 60254 - protein, 14 aa, Mycobacterium tuberculosis
PDNAAWYFDAVTVG

SEQ ID NO: 60255 - protein, 14 aa, Mycobacterium tuberculosis
DNAAWYFDAVTVGD

SEQ ID NO: 60256 - protein, 14 aa, Mycobacterium tuberculosis
NAAWYFDAVTVGDP

SEQ ID NO: 60257 - protein, 14 aa, Mycobacterium tuberculosis
AAWYFDAVTVGDPI

SEQ ID NO: 60258 - protein, 14 aa, Mycobacterium tuberculosis
AWYFDAVTVGDPIE

SEQ ID NO: 60259 - protein, 14 aa, Mycobacterium tuberculosis
WYFDAVTVGDPIEV

SEQ ID NO: 60260 - protein, 14 aa, Mycobacterium tuberculosis
YFDAVTVGDPIEVV

SEQ ID NO: 60261 - protein, 14 aa, Mycobacterium tuberculosis
FDAVTVGDPIEVVG

SEQ ID NO: 60262 - protein, 15 aa, Mycobacterium tuberculosis
MRRVVRYLSVVVAIT

SEQ ID NO: 60263 - protein, 15 aa, Mycobacterium tuberculosis
RRVVRYLSVVVAITL

SEQ ID NO: 60264 - protein, 15 aa, Mycobacterium tuberculosis
RVVRYLSVVVAITLM

SEQ ID NO: 60265 - protein, 15 aa, Mycobacterium tuberculosis
VVRYLSVVVAITLML

SEQ ID NO: 60266 - protein, 15 aa, Mycobacterium tuberculosis
VRYLSVVVAITLMLT

SEQ ID NO: 60267 - protein, 15 aa, Mycobacterium tuberculosis
RYLSVVVAITLMLTA

SEQ ID NO: 60268 - protein, 15 aa, Mycobacterium tuberculosis
YLSVVVAITLMLTAE

SEQ ID NO: 60269 - protein, 15 aa, Mycobacterium tuberculosis
LSVVVAITLMLTAES

SEQ ID NO: 60270 - protein, 15 aa, Mycobacterium tuberculosis
SVVVAITLMLTAESV

SEQ ID NO: 60271 - protein, 15 aa, Mycobacterium tuberculosis
VVVAITLMLTAESVS

SEQ ID NO: 60272 - protein, 15 aa, Mycobacterium tuberculosis
VVAITLMLTAESVSI

SEQ ID NO: 60273 - protein, 15 aa, Mycobacterium tuberculosis
VAITLMLTAESVSIA

SEQ ID NO: 60274 - protein, 15 aa, Mycobacterium tuberculosis
AITLMLTAESVSIAT

SEQ ID NO: 60275 - protein, 15 aa, Mycobacterium tuberculosis
ITLMLTAESVSIATA

SEQ ID NO: 60276 - protein, 15 aa, Mycobacterium tuberculosis
TLMLTAESVSIATAA

SEQ ID NO: 60277 - protein, 15 aa, Mycobacterium tuberculosis
LMLTAESVSIATAAV

SEQ ID NO: 60278 - protein, 15 aa, Mycobacterium tuberculosis
MLTAESVSIATAAVP

SEQ ID NO: 60279 - protein, 15 aa, Mycobacterium tuberculosis
LTAESVSIATAAVPP

SEQ ID NO: 60280 - protein, 15 aa, Mycobacterium tuberculosis
TAESVSIATAAVPPL

SEQ ID NO: 60281 - protein, 15 aa, Mycobacterium tuberculosis
AESVSIATAAVPPLQ

SEQ ID NO: 60282 - protein, 15 aa, Mycobacterium tuberculosis
ESVSIATAAVPPLQP

SEQ ID NO: 60283 - protein, 15 aa, Mycobacterium tuberculosis
SVSIATAAVPPLQPI

SEQ ID NO: 60284 - protein, 15 aa, Mycobacterium tuberculosis
VSIATAAVPPLQPIP

SEQ ID NO: 60285 - protein, 15 aa, Mycobacterium tuberculosis
SIATAAVPPLQPIPG

SEQ ID NO: 60286 - protein, 15 aa, Mycobacterium tuberculosis
IATAAVPPLQPIPGV

SEQ ID NO: 60287 - protein, 15 aa, Mycobacterium tuberculosis
ATAAVPPLQPIPGVA

SEQ ID NO: 60288 - protein, 15 aa, Mycobacterium tuberculosis
TAAVPPLQPIPGVAS

SEQ ID NO: 60289 - protein, 15 aa, Mycobacterium tuberculosis
AAVPPLQPIPGVASV

SEQ ID NO: 60290 - protein, 15 aa, Mycobacterium tuberculosis
AVPPLQPIPGVASVS

SEQ ID NO: 60291 - protein, 15 aa, Mycobacterium tuberculosis
VPPLQPIPGVASVSP

SEQ ID NO: 60292 - protein, 15 aa, Mycobacterium tuberculosis
PPLQPIPGVASVSPA

SEQ ID NO: 60293 - protein, 15 aa, Mycobacterium tuberculosis
PLQPIPGVASVSPAN

SEQ ID NO: 60294 - protein, 15 aa, Mycobacterium tuberculosis
LQPIPGVASVSPANG

SEQ ID NO: 60295 - protein, 15 aa, Mycobacterium tuberculosis
QPIPGVASVSPANGA

SEQ ID NO: 60296 - protein, 15 aa, Mycobacterium tuberculosis
PIPGVASVSPANGAV

SEQ ID NO: 60297 - protein, 15 aa, Mycobacterium tuberculosis
IPGVASVSPANGAVV

SEQ ID NO: 60298 - protein, 15 aa, Mycobacterium tuberculosis
PGVASVSPANGAVVG

SEQ ID NO: 60299 - protein, 15 aa, Mycobacterium tuberculosis
GVASVSPANGAVVGV

SEQ ID NO: 60300 - protein, 15 aa, Mycobacterium tuberculosis
VASVSPANGAVVGVA

SEQ ID NO: 60301 - protein, 15 aa, Mycobacterium tuberculosis
ASVSPANGAVVGVAH

SEQ ID NO: 60302 - protein, 15 aa, Mycobacterium tuberculosis
SVSPANGAVVGVAHP

SEQ ID NO: 60303 - protein, 15 aa, Mycobacterium tuberculosis
VSPANGAVVGVAHPV

SEQ ID NO: 60304 - protein, 15 aa, Mycobacterium tuberculosis
SPANGAVVGVAHPVV

SEQ ID NO: 60305 - protein, 15 aa, Mycobacterium tuberculosis
PANGAVVGVAHPVVV

SEQ ID NO: 60306 - protein, 15 aa, Mycobacterium tuberculosis
ANGAVVGVAHPVVVT

SEQ ID NO: 60307 - protein, 15 aa, Mycobacterium tuberculosis
NGAVVGVAHPVVVTF

SEQ ID NO: 60308 - protein, 15 aa, Mycobacterium tuberculosis
GAVVGVAHPVVVTFT

SEQ ID NO: 60309 - protein, 15 aa, Mycobacterium tuberculosis
AVVGVAHPVVVTFTT

SEQ ID NO: 60310 - protein, 15 aa, Mycobacterium tuberculosis
VVGVAHPVVVTFTTP

SEQ ID NO: 60311 - protein, 15 aa, Mycobacterium tuberculosis
VGVAHPVVVTFTTPV

SEQ ID NO: 60312 - protein, 15 aa, Mycobacterium tuberculosis
GVAHPVVVTFTTPVT

SEQ ID NO: 60313 - protein, 15 aa, Mycobacterium tuberculosis
VAHPVVVTFTTPVTD

SEQ ID NO: 60314 - protein, 15 aa, Mycobacterium tuberculosis
AHPVVVTFTTPVTDR

SEQ ID NO: 60315 - protein, 15 aa, Mycobacterium tuberculosis
HPVVVTFTTPVTDRR

SEQ ID NO: 60316 - protein, 15 aa, Mycobacterium tuberculosis
PVVVTFTTPVTDRRA

SEQ ID NO: 60317 - protein, 15 aa, Mycobacterium tuberculosis
VVVTFTTPVTDRRAV

SEQ ID NO: 60318 - protein, 15 aa, Mycobacterium tuberculosis
VVTFTTPVTDRRAVE

SEQ ID NO: 60319 - protein, 15 aa, Mycobacterium tuberculosis
VTFTTPVTDRRAVER

SEQ ID NO: 60320 - protein, 15 aa, Mycobacterium tuberculosis
TFTTPVTDRRAVERS

SEQ ID NO: 60321 - protein, 15 aa, Mycobacterium tuberculosis
FTTPVTDRRAVERSI

SEQ ID NO: 60322 - protein, 15 aa, Mycobacterium tuberculosis
TTPVTDRRAVERSIR

SEQ ID NO: 60323 - protein, 15 aa, Mycobacterium tuberculosis
TPVTDRRAVERSIRI

SEQ ID NO: 60324 - protein, 15 aa, Mycobacterium tuberculosis
PVTDRRAVERSIRIS

SEQ ID NO: 60325 - protein, 15 aa, Mycobacterium tuberculosis
VTDRRAVERSIRIST

SEQ ID NO: 60326 - protein, 15 aa, Mycobacterium tuberculosis
TDRRAVERSIRISTP

SEQ ID NO: 60327 - protein, 15 aa, Mycobacterium tuberculosis
DRRAVERSIRISTPH

SEQ ID NO: 60328 - protein, 15 aa, Mycobacterium tuberculosis
RRAVERSIRISTPHN

SEQ ID NO: 60329 - protein, 15 aa, Mycobacterium tuberculosis
RAVERSIRISTPHNT

SEQ ID NO: 60330 - protein, 15 aa, Mycobacterium tuberculosis
AVERSIRISTPHNTT

SEQ ID NO: 60331 - protein, 15 aa, Mycobacterium tuberculosis
VERSIRISTPHNTTG

SEQ ID NO: 60332 - protein, 15 aa, Mycobacterium tuberculosis
ERSIRISTPHNTTGH

SEQ ID NO: 60333 - protein, 15 aa, Mycobacterium tuberculosis
RSIRISTPHNTTGHF

SEQ ID NO: 60334 - protein, 15 aa, Mycobacterium tuberculosis
SIRISTPHNTTGHFE

SEQ ID NO: 60335 - protein, 15 aa, Mycobacterium tuberculosis
IRISTPHNTTGHFEW

SEQ ID NO: 60336 - protein, 15 aa, Mycobacterium tuberculosis
RISTPHNTTGHFEWV

SEQ ID NO: 60337 - protein, 15 aa, Mycobacterium tuberculosis
ISTPHNTTGHFEWVA

SEQ ID NO: 60338 - protein, 15 aa, Mycobacterium tuberculosis
STPHNTTGHFEWVAS

SEQ ID NO: 60339 - protein, 15 aa, Mycobacterium tuberculosis
TPHNTTGHFEWVASN

SEQ ID NO: 60340 - protein, 15 aa, Mycobacterium tuberculosis
PHNTTGHFEWVASNV

SEQ ID NO: 60341 - protein, 15 aa, Mycobacterium tuberculosis
HNTTGHFEWVASNVV

SEQ ID NO: 60342 - protein, 15 aa, Mycobacterium tuberculosis
NTTGHFEWVASNVVR

SEQ ID NO: 60343 - protein, 15 aa, Mycobacterium tuberculosis
TTGHFEWVASNVVRW

SEQ ID NO: 60344 - protein, 15 aa, Mycobacterium tuberculosis
TGHFEWVASNVVRWV

SEQ ID NO: 60345 - protein, 15 aa, Mycobacterium tuberculosis
GHFEWVASNVVRWVP

SEQ ID NO: 60346 - protein, 15 aa, Mycobacterium tuberculosis
HFEWVASNVVRWVPH

SEQ ID NO: 60347 - protein, 15 aa, Mycobacterium tuberculosis
FEWVASNVVRWVPHR

SEQ ID NO: 60348 - protein, 15 aa, Mycobacterium tuberculosis
EWVASNVVRWVPHRY

SEQ ID NO: 60349 - protein, 15 aa, Mycobacterium tuberculosis
WVASNVVRWVPHRYW

SEQ ID NO: 60350 - protein, 15 aa, Mycobacterium tuberculosis
VASNVVRWVPHRYWP

SEQ ID NO: 60351 - protein, 15 aa, Mycobacterium tuberculosis
ASNVVRWVPHRYWPP

SEQ ID NO: 60352 - protein, 15 aa, Mycobacterium tuberculosis
SNVVRWVPHRYWPPH

SEQ ID NO: 60353 - protein, 15 aa, Mycobacterium tuberculosis
NVVRWVPHRYWPPHT

SEQ ID NO: 60354 - protein, 15 aa, Mycobacterium tuberculosis
VVRWVPHRYWPPHTR

SEQ ID NO: 60355 - protein, 15 aa, Mycobacterium tuberculosis
VRWVPHRYWPPHTRV

SEQ ID NO: 60356 - protein, 15 aa, Mycobacterium tuberculosis
RWVPHRYWPPHTRVS

SEQ ID NO: 60357 - protein, 15 aa, Mycobacterium tuberculosis
WVPHRYWPPHTRVSV

SEQ ID NO: 60358 - protein, 15 aa, Mycobacterium tuberculosis
VPHRYWPPHTRVSVG

SEQ ID NO: 60359 - protein, 15 aa, Mycobacterium tuberculosis
PHRYWPPHTRVSVGV

SEQ ID NO: 60360 - protein, 15 aa, Mycobacterium tuberculosis
HRYWPPHTRVSVGVQ

SEQ ID NO: 60361 - protein, 15 aa, Mycobacterium tuberculosis
RYWPPHTRVSVGVQE

SEQ ID NO: 60362 - protein, 15 aa, Mycobacterium tuberculosis
YWPPHTRVSVGVQEL

SEQ ID NO: 60363 - protein, 15 aa, Mycobacterium tuberculosis
WPPHTRVSVGVQELT

SEQ ID NO: 60364 - protein, 15 aa, Mycobacterium tuberculosis
PPHTRVSVGVQELTE

SEQ ID NO: 60365 - protein, 15 aa, Mycobacterium tuberculosis
PHTRVSVGVQELTEG

SEQ ID NO: 60366 - protein, 15 aa, Mycobacterium tuberculosis
HTRVSVGVQELTEGF

SEQ ID NO: 60367 - protein, 15 aa, Mycobacterium tuberculosis
TRVSVGVQELTEGFE

SEQ ID NO: 60368 - protein, 15 aa, Mycobacterium tuberculosis
RVSVGVQELTEGFET

SEQ ID NO: 60369 - protein, 15 aa, Mycobacterium tuberculosis
VSVGVQELTEGFETG

SEQ ID NO: 60370 - protein, 15 aa, Mycobacterium tuberculosis
SVGVQELTEGFETGD

SEQ ID NO: 60371 - protein, 15 aa, Mycobacterium tuberculosis
VGVQELTEGFETGDA

SEQ ID NO: 60372 - protein, 15 aa, Mycobacterium tuberculosis
GVQELTEGFETGDAL

SEQ ID NO: 60373 - protein, 15 aa, Mycobacterium tuberculosis
VQELTEGFETGDALI

SEQ ID NO: 60374 - protein, 15 aa, Mycobacterium tuberculosis
QELTEGFETGDALIG

SEQ ID NO: 60375 - protein, 15 aa, Mycobacterium tuberculosis
ELTEGFETGDALIGV

SEQ ID NO: 60376 - protein, 15 aa, Mycobacterium tuberculosis
LTEGFETGDALIGVA

SEQ ID NO: 60377 - protein, 15 aa, Mycobacterium tuberculosis
TEGFETGDALIGVAS

SEQ ID NO: 60378 - protein, 15 aa, Mycobacterium tuberculosis
EGFETGDALIGVASI

SEQ ID NO: 60379 - protein, 15 aa, Mycobacterium tuberculosis
GFETGDALIGVASIS

SEQ ID NO: 60380 - protein, 15 aa, Mycobacterium tuberculosis
FETGDALIGVASISA

SEQ ID NO: 60381 - protein, 15 aa, Mycobacterium tuberculosis
ETGDALIGVASISAH

SEQ ID NO: 60382 - protein, 15 aa, Mycobacterium tuberculosis
TGDALIGVASISAHT

SEQ ID NO: 60383 - protein, 15 aa, Mycobacterium tuberculosis
GDALIGVASISAHTF

SEQ ID NO: 60384 - protein, 15 aa, Mycobacterium tuberculosis
DALIGVASISAHTFT

SEQ ID NO: 60385 - protein, 15 aa, Mycobacterium tuberculosis
ALIGVASISAHTFTV

SEQ ID NO: 60386 - protein, 15 aa, Mycobacterium tuberculosis
LIGVASISAHTFTVS

SEQ ID NO: 60387 - protein, 15 aa, Mycobacterium tuberculosis
IGVASISAHTFTVSR

SEQ ID NO: 60388 - protein, 15 aa, Mycobacterium tuberculosis
GVASISAHTFTVSRN

SEQ ID NO: 60389 - protein, 15 aa, Mycobacterium tuberculosis
VASISAHTFTVSRNG

SEQ ID NO: 60390 - protein, 15 aa, Mycobacterium tuberculosis
ASISAHTFTVSRNGE

SEQ ID NO: 60391 - protein, 15 aa, Mycobacterium tuberculosis
SISAHTFTVSRNGEV

SEQ ID NO: 60392 - protein, 15 aa, Mycobacterium tuberculosis
ISAHTFTVSRNGEVL

SEQ ID NO: 60393 - protein, 15 aa, Mycobacterium tuberculosis
SAHTFTVSRNGEVLR

SEQ ID NO: 60394 - protein, 15 aa, Mycobacterium tuberculosis
AHTFTVSRNGEVLRT

SEQ ID NO: 60395 - protein, 15 aa, Mycobacterium tuberculosis
HTFTVSRNGEVLRTM

SEQ ID NO: 60396 - protein, 15 aa, Mycobacterium tuberculosis
TFTVSRNGEVLRTMP

SEQ ID NO: 60397 - protein, 15 aa, Mycobacterium tuberculosis
FTVSRNGEVLRTMPA

SEQ ID NO: 60398 - protein, 15 aa, Mycobacterium tuberculosis
TVSRNGEVLRTMPAS

SEQ ID NO: 60399 - protein, 15 aa, Mycobacterium tuberculosis
VSRNGEVLRTMPASL

SEQ ID NO: 60400 - protein, 15 aa, Mycobacterium tuberculosis
SRNGEVLRTMPASLG

SEQ ID NO: 60401 - protein, 15 aa, Mycobacterium tuberculosis
RNGEVLRTMPASLGK

SEQ ID NO: 60402 - protein, 15 aa, Mycobacterium tuberculosis
NGEVLRTMPASLGKP

SEQ ID NO: 60403 - protein, 15 aa, Mycobacterium tuberculosis
GEVLRTMPASLGKPS

SEQ ID NO: 60404 - protein, 15 aa, Mycobacterium tuberculosis
EVLRTMPASLGKPSR

SEQ ID NO: 60405 - protein, 15 aa, Mycobacterium tuberculosis
VLRTMPASLGKPSRP

SEQ ID NO: 60406 - protein, 15 aa, Mycobacterium tuberculosis
LRTMPASLGKPSRPT

SEQ ID NO: 60407 - protein, 15 aa, Mycobacterium tuberculosis
RTMPASLGKPSRPTP

SEQ ID NO: 60408 - protein, 15 aa, Mycobacterium tuberculosis
TMPASLGKPSRPTPI

SEQ ID NO: 60409 - protein, 15 aa, Mycobacterium tuberculosis
MPASLGKPSRPTPIG

SEQ ID NO: 60410 - protein, 15 aa, Mycobacterium tuberculosis
PASLGKPSRPTPIGS

SEQ ID NO: 60411 - protein, 15 aa, Mycobacterium tuberculosis
ASLGKPSRPTPIGSF

SEQ ID NO: 60412 - protein, 15 aa, Mycobacterium tuberculosis
SLGKPSRPTPIGSFH

SEQ ID NO: 60413 - protein, 15 aa, Mycobacterium tuberculosis
LGKPSRPTPIGSFHA

SEQ ID NO: 60414 - protein, 15 aa, Mycobacterium tuberculosis
GKPSRPTPIGSFHAM

SEQ ID NO: 60415 - protein, 15 aa, Mycobacterium tuberculosis
KPSRPTPIGSFHAMS

SEQ ID NO: 60416 - protein, 15 aa, Mycobacterium tuberculosis
PSRPTPIGSFHAMSK

SEQ ID NO: 60417 - protein, 15 aa, Mycobacterium tuberculosis
SRPTPIGSFHAMSKE

SEQ ID NO: 60418 - protein, 15 aa, Mycobacterium tuberculosis
RPTPIGSFHAMSKER

SEQ ID NO: 60419 - protein, 15 aa, Mycobacterium tuberculosis
PTPIGSFHAMSKERT

SEQ ID NO: 60420 - protein, 15 aa, Mycobacterium tuberculosis
TPIGSFHAMSKERTV

SEQ ID NO: 60421 - protein, 15 aa, Mycobacterium tuberculosis
PIGSFHAMSKERTVV

SEQ ID NO: 60422 - protein, 15 aa, Mycobacterium tuberculosis
IGSFHAMSKERTVVM

SEQ ID NO: 60423 - protein, 15 aa, Mycobacterium tuberculosis
GSFHAMSKERTVVMD

SEQ ID NO: 60424 - protein, 15 aa, Mycobacterium tuberculosis
SFHAMSKERTVVMDS

SEQ ID NO: 60425 - protein, 15 aa, Mycobacterium tuberculosis
FHAMSKERTVVMDSR

SEQ ID NO: 60426 - protein, 15 aa, Mycobacterium tuberculosis
HAMSKERTVVMDSRT

SEQ ID NO: 60427 - protein, 15 aa, Mycobacterium tuberculosis
AMSKERTVVMDSRTI

SEQ ID NO: 60428 - protein, 15 aa, Mycobacterium tuberculosis
MSKERTVVMDSRTIG

SEQ ID NO: 60429 - protein, 15 aa, Mycobacterium tuberculosis
SKERTVVMDSRTIGI

SEQ ID NO: 60430 - protein, 15 aa, Mycobacterium tuberculosis
KERTVVMDSRTIGIP

SEQ ID NO: 60431 - protein, 15 aa, Mycobacterium tuberculosis
ERTVVMDSRTIGIPL

SEQ ID NO: 60432 - protein, 15 aa, Mycobacterium tuberculosis
RTVVMDSRTIGIPLN

SEQ ID NO: 60433 - protein, 15 aa, Mycobacterium tuberculosis
TVVMDSRTIGIPLNS

SEQ ID NO: 60434 - protein, 15 aa, Mycobacterium tuberculosis
VVMDSRTIGIPLNSS

SEQ ID NO: 60435 - protein, 15 aa, Mycobacterium tuberculosis
VMDSRTIGIPLNSSD

SEQ ID NO: 60436 - protein, 15 aa, Mycobacterium tuberculosis
MDSRTIGIPLNSSDG

SEQ ID NO: 60437 - protein, 15 aa, Mycobacterium tuberculosis
DSRTIGIPLNSSDGY

SEQ ID NO: 60438 - protein, 15 aa, Mycobacterium tuberculosis
SRTIGIPLNSSDGYL

SEQ ID NO: 60439 - protein, 15 aa, Mycobacterium tuberculosis
RTIGIPLNSSDGYLL

SEQ ID NO: 60440 - protein, 15 aa, Mycobacterium tuberculosis
TIGIPLNSSDGYLLT

SEQ ID NO: 60441 - protein, 15 aa, Mycobacterium tuberculosis
IGIPLNSSDGYLLTA

SEQ ID NO: 60442 - protein, 15 aa, Mycobacterium tuberculosis
GIPLNSSDGYLLTAH

SEQ ID NO: 60443 - protein, 15 aa, Mycobacterium tuberculosis
IPLNSSDGYLLTAHY

SEQ ID NO: 60444 - protein, 15 aa, Mycobacterium tuberculosis
PLNSSDGYLLTAHYA

SEQ ID NO: 60445 - protein, 15 aa, Mycobacterium tuberculosis
LNSSDGYLLTAHYAV

SEQ ID NO: 60446 - protein, 15 aa, Mycobacterium tuberculosis
NSSDGYLLTAHYAVR

SEQ ID NO: 60447 - protein, 15 aa, Mycobacterium tuberculosis
SSDGYLLTAHYAVRV

SEQ ID NO: 60448 - protein, 15 aa, Mycobacterium tuberculosis
SDGYLLTAHYAVRVT

SEQ ID NO: 60449 - protein, 15 aa, Mycobacterium tuberculosis
DGYLLTAHYAVRVTW

SEQ ID NO: 60450 - protein, 15 aa, Mycobacterium tuberculosis
GYLLTAHYAVRVTWS

SEQ ID NO: 60451 - protein, 15 aa, Mycobacterium tuberculosis
YLLTAHYAVRVTWSG

SEQ ID NO: 60452 - protein, 15 aa, Mycobacterium tuberculosis
LLTAHYAVRVTWSGV

SEQ ID NO: 60453 - protein, 15 aa, Mycobacterium tuberculosis
LTAHYAVRVTWSGVY

SEQ ID NO: 60454 - protein, 15 aa, Mycobacterium tuberculosis
TAHYAVRVTWSGVYV

SEQ ID NO: 60455 - protein, 15 aa, Mycobacterium tuberculosis
AHYAVRVTWSGVYVH

SEQ ID NO: 60456 - protein, 15 aa, Mycobacterium tuberculosis
HYAVRVTWSGVYVHS

SEQ ID NO: 60457 - protein, 15 aa, Mycobacterium tuberculosis
YAVRVTWSGVYVHSA

SEQ ID NO: 60458 - protein, 15 aa, Mycobacterium tuberculosis
AVRVTWSGVYVHSAP

SEQ ID NO: 60459 - protein, 15 aa, Mycobacterium tuberculosis
VRVTWSGVYVHSAPW

SEQ ID NO: 60460 - protein, 15 aa, Mycobacterium tuberculosis
RVTWSGVYVHSAPWS

SEQ ID NO: 60461 - protein, 15 aa, Mycobacterium tuberculosis
VTWSGVYVHSAPWSV

SEQ ID NO: 60462 - protein, 15 aa, Mycobacterium tuberculosis
TWSGVYVHSAPWSVN

SEQ ID NO: 60463 - protein, 15 aa, Mycobacterium tuberculosis
WSGVYVHSAPWSVNS

SEQ ID NO: 60464 - protein, 15 aa, Mycobacterium tuberculosis
SGVYVHSAPWSVNSQ

SEQ ID NO: 60465 - protein, 15 aa, Mycobacterium tuberculosis
GVYVHSAPWSVNSQG

SEQ ID NO: 60466 - protein, 15 aa, Mycobacterium tuberculosis
VYVHSAPWSVNSQGY

SEQ ID NO: 60467 - protein, 15 aa, Mycobacterium tuberculosis
YVHSAPWSVNSQGYA

SEQ ID NO: 60468 - protein, 15 aa, Mycobacterium tuberculosis
VHSAPWSVNSQGYAN

SEQ ID NO: 60469 - protein, 15 aa, Mycobacterium tuberculosis
HSAPWSVNSQGYANV

SEQ ID NO: 60470 - protein, 15 aa, Mycobacterium tuberculosis
SAPWSVNSQGYANVS

SEQ ID NO: 60471 - protein, 15 aa, Mycobacterium tuberculosis
APWSVNSQGYANVSH

SEQ ID NO: 60472 - protein, 15 aa, Mycobacterium tuberculosis
PWSVNSQGYANVSHG

SEQ ID NO: 60473 - protein, 15 aa, Mycobacterium tuberculosis
WSVNSQGYANVSHGC

SEQ ID NO: 60474 - protein, 15 aa, Mycobacterium tuberculosis
SVNSQGYANVSHGCI

SEQ ID NO: 60475 - protein, 15 aa, Mycobacterium tuberculosis
VNSQGYANVSHGCIN

SEQ ID NO: 60476 - protein, 15 aa, Mycobacterium tuberculosis
NSQGYANVSHGCINL

SEQ ID NO: 60477 - protein, 15 aa, Mycobacterium tuberculosis
SQGYANVSHGCINLS

SEQ ID NO: 60478 - protein, 15 aa, Mycobacterium tuberculosis
QGYANVSHGCINLSP

SEQ ID NO: 60479 - protein, 15 aa, Mycobacterium tuberculosis
GYANVSHGCINLSPD

SEQ ID NO: 60480 - protein, 15 aa, Mycobacterium tuberculosis
YANVSHGCINLSPDN

SEQ ID NO: 60481 - protein, 15 aa, Mycobacterium tuberculosis
ANVSHGCINLSPDNA

SEQ ID NO: 60482 - protein, 15 aa, Mycobacterium tuberculosis
NVSHGCINLSPDNAA

SEQ ID NO: 60483 - protein, 15 aa, Mycobacterium tuberculosis
VSHGCINLSPDNAAW

SEQ ID NO: 60484 - protein, 15 aa, Mycobacterium tuberculosis
SHGCINLSPDNAAWY

SEQ ID NO: 60485 - protein, 15 aa, Mycobacterium tuberculosis
HGCINLSPDNAAWYF

SEQ ID NO: 60486 - protein, 15 aa, Mycobacterium tuberculosis
GCINLSPDNAAWYFD

SEQ ID NO: 60487 - protein, 15 aa, Mycobacterium tuberculosis
CINLSPDNAAWYFDA

SEQ ID NO: 60488 - protein, 15 aa, Mycobacterium tuberculosis
INLSPDNAAWYFDAV

SEQ ID NO: 60489 - protein, 15 aa, Mycobacterium tuberculosis
NLSPDNAAWYFDAVT

SEQ ID NO: 60490 - protein, 15 aa, Mycobacterium tuberculosis
LSPDNAAWYFDAVTV

SEQ ID NO: 60491 - protein, 15 aa, Mycobacterium tuberculosis
SPDNAAWYFDAVTVG

SEQ ID NO: 60492 - protein, 15 aa, Mycobacterium tuberculosis
PDNAAWYFDAVTVGD

SEQ ID NO: 60493 - protein, 15 aa, Mycobacterium tuberculosis
DNAAWYFDAVTVGDP

SEQ ID NO: 60494 - protein, 15 aa, Mycobacterium tuberculosis
NAAWYFDAVTVGDPI

SEQ ID NO: 60495 - protein, 15 aa, Mycobacterium tuberculosis
AAWYFDAVTVGDPIE

SEQ ID NO: 60496 - protein, 15 aa, Mycobacterium tuberculosis
AWYFDAVTVGDPIEV

SEQ ID NO: 60497 - protein, 15 aa, Mycobacterium tuberculosis
WYFDAVTVGDPIEVV

SEQ ID NO: 60498 - protein, 15 aa, Mycobacterium tuberculosis
YFDAVTVGDPIEVVG

SEQ ID NO: 60499 - protein, 16 aa, Mycobacterium tuberculosis
MRRVVRYLSVVVAITL

SEQ ID NO: 60500 - protein, 16 aa, Mycobacterium tuberculosis
RRVVRYLSVVVAITLM

SEQ ID NO: 60501 - protein, 16 aa, Mycobacterium tuberculosis
RVVRYLSVVVAITLML

SEQ ID NO: 60502 - protein, 16 aa, Mycobacterium tuberculosis
VVRYLSVVVAITLMLT

SEQ ID NO: 60503 - protein, 16 aa, Mycobacterium tuberculosis
VRYLSVVVAITLMLTA

SEQ ID NO: 60504 - protein, 16 aa, Mycobacterium tuberculosis
RYLSVVVAITLMLTAE

SEQ ID NO: 60505 - protein, 16 aa, Mycobacterium tuberculosis
YLSVVVAITLMLTAES

SEQ ID NO: 60506 - protein, 16 aa, Mycobacterium tuberculosis
LSVVVAITLMLTAESV

SEQ ID NO: 60507 - protein, 16 aa, Mycobacterium tuberculosis
SVVVAITLMLTAESVS

SEQ ID NO: 60508 - protein, 16 aa, Mycobacterium tuberculosis
VVVAITLMLTAESVSI

SEQ ID NO: 60509 - protein, 16 aa, Mycobacterium tuberculosis
VVAITLMLTAESVSIA

SEQ ID NO: 60510 - protein, 16 aa, Mycobacterium tuberculosis
VAITLMLTAESVSIAT

SEQ ID NO: 60511 - protein, 16 aa, Mycobacterium tuberculosis
AITLMLTAESVSIATA

SEQ ID NO: 60512 - protein, 16 aa, Mycobacterium tuberculosis
ITLMLTAESVSIATAA

SEQ ID NO: 60513 - protein, 16 aa, Mycobacterium tuberculosis
TLMLTAESVSIATAAV

SEQ ID NO: 60514 - protein, 16 aa, Mycobacterium tuberculosis
LMLTAESVSIATAAVP

SEQ ID NO: 60515 - protein, 16 aa, Mycobacterium tuberculosis
MLTAESVSIATAAVPP

SEQ ID NO: 60516 - protein, 16 aa, Mycobacterium tuberculosis
LTAESVSIATAAVPPL

SEQ ID NO: 60517 - protein, 16 aa, Mycobacterium tuberculosis
TAESVSIATAAVPPLQ

SEQ ID NO: 60518 - protein, 16 aa, Mycobacterium tuberculosis
AESVSIATAAVPPLQP

SEQ ID NO: 60519 - protein, 16 aa, Mycobacterium tuberculosis
ESVSIATAAVPPLQPI

SEQ ID NO: 60520 - protein, 16 aa, Mycobacterium tuberculosis
SVSIATAAVPPLQPIP

SEQ ID NO: 60521 - protein, 16 aa, Mycobacterium tuberculosis
VSIATAAVPPLQPIPG

SEQ ID NO: 60522 - protein, 16 aa, Mycobacterium tuberculosis
SIATAAVPPLQPIPGV

SEQ ID NO: 60523 - protein, 16 aa, Mycobacterium tuberculosis
IATAAVPPLQPIPGVA

SEQ ID NO: 60524 - protein, 16 aa, Mycobacterium tuberculosis
ATAAVPPLQPIPGVAS

SEQ ID NO: 60525 - protein, 16 aa, Mycobacterium tuberculosis
TAAVPPLQPIPGVASV

SEQ ID NO: 60526 - protein, 16 aa, Mycobacterium tuberculosis
AAVPPLQPIPGVASVS

SEQ ID NO: 60527 - protein, 16 aa, Mycobacterium tuberculosis
AVPPLQPIPGVASVSP

SEQ ID NO: 60528 - protein, 16 aa, Mycobacterium tuberculosis
VPPLQPIPGVASVSPA

SEQ ID NO: 60529 - protein, 16 aa, Mycobacterium tuberculosis
PPLQPIPGVASVSPAN

SEQ ID NO: 60530 - protein, 16 aa, Mycobacterium tuberculosis
PLQPIPGVASVSPANG

SEQ ID NO: 60531 - protein, 16 aa, Mycobacterium tuberculosis
LQPIPGVASVSPANGA

SEQ ID NO: 60532 - protein, 16 aa, Mycobacterium tuberculosis
QPIPGVASVSPANGAV

SEQ ID NO: 60533 - protein, 16 aa, Mycobacterium tuberculosis
PIPGVASVSPANGAVV

SEQ ID NO: 60534 - protein, 16 aa, Mycobacterium tuberculosis
IPGVASVSPANGAVVG

SEQ ID NO: 60535 - protein, 16 aa, Mycobacterium tuberculosis
PGVASVSPANGAVVGV

SEQ ID NO: 60536 - protein, 16 aa, Mycobacterium tuberculosis
GVASVSPANGAVVGVA

SEQ ID NO: 60537 - protein, 16 aa, Mycobacterium tuberculosis
VASVSPANGAVVGVAH

SEQ ID NO: 60538 - protein, 16 aa, Mycobacterium tuberculosis
ASVSPANGAVVGVAHP

SEQ ID NO: 60539 - protein, 16 aa, Mycobacterium tuberculosis
SVSPANGAVVGVAHPV

SEQ ID NO: 60540 - protein, 16 aa, Mycobacterium tuberculosis
VSPANGAVVGVAHPVV

SEQ ID NO: 60541 - protein, 16 aa, Mycobacterium tuberculosis
SPANGAVVGVAHPVVV

SEQ ID NO: 60542 - protein, 16 aa, Mycobacterium tuberculosis
PANGAVVGVAHPVVVT

SEQ ID NO: 60543 - protein, 16 aa, Mycobacterium tuberculosis
ANGAVVGVAHPVVVTF

SEQ ID NO: 60544 - protein, 16 aa, Mycobacterium tuberculosis
NGAVVGVAHPVVVTFT

SEQ ID NO: 60545 - protein, 16 aa, Mycobacterium tuberculosis
GAVVGVAHPVVVTFTT

SEQ ID NO: 60546 - protein, 16 aa, Mycobacterium tuberculosis
AVVGVAHPVVVTFTTP

SEQ ID NO: 60547 - protein, 16 aa, Mycobacterium tuberculosis
VVGVAHPVVVTFTTPV

SEQ ID NO: 60548 - protein, 16 aa, Mycobacterium tuberculosis
VGVAHPVVVTFTTPVT

SEQ ID NO: 60549 - protein, 16 aa, Mycobacterium tuberculosis
GVAHPVVVTFTTPVTD

SEQ ID NO: 60550 - protein, 16 aa, Mycobacterium tuberculosis
VAHPVVVTFTTPVTDR

SEQ ID NO: 60551 - protein, 16 aa, Mycobacterium tuberculosis
AHPVVVTFTTPVTDRR

SEQ ID NO: 60552 - protein, 16 aa, Mycobacterium tuberculosis
HPVVVTFTTPVTDRRA

SEQ ID NO: 60553 - protein, 16 aa, Mycobacterium tuberculosis
PVVVTFTTPVTDRRAV

SEQ ID NO: 60554 - protein, 16 aa, Mycobacterium tuberculosis
VVVTFTTPVTDRRAVE

SEQ ID NO: 60555 - protein, 16 aa, Mycobacterium tuberculosis
VVTFTTPVTDRRAVER

SEQ ID NO: 60556 - protein, 16 aa, Mycobacterium tuberculosis
VTFTTPVTDRRAVERS

SEQ ID NO: 60557 - protein, 16 aa, Mycobacterium tuberculosis
TFTTPVTDRRAVERSI

SEQ ID NO: 60558 - protein, 16 aa, Mycobacterium tuberculosis
FTTPVTDRRAVERSIR

SEQ ID NO: 60559 - protein, 16 aa, Mycobacterium tuberculosis
TTPVTDRRAVERSIRI

SEQ ID NO: 60560 - protein, 16 aa, Mycobacterium tuberculosis
TPVTDRRAVERSIRIS

SEQ ID NO: 60561 - protein, 16 aa, Mycobacterium tuberculosis
PVTDRRAVERSIRIST

SEQ ID NO: 60562 - protein, 16 aa, Mycobacterium tuberculosis
VTDRRAVERSIRISTP

SEQ ID NO: 60563 - protein, 16 aa, Mycobacterium tuberculosis
TDRRAVERSIRISTPH

SEQ ID NO: 60564 - protein, 16 aa, Mycobacterium tuberculosis
DRRAVERSIRISTPHN

SEQ ID NO: 60565 - protein, 16 aa, Mycobacterium tuberculosis
RRAVERSIRISTPHNT

SEQ ID NO: 60566 - protein, 16 aa, Mycobacterium tuberculosis
RAVERSIRISTPHNTT

SEQ ID NO: 60567 - protein, 16 aa, Mycobacterium tuberculosis
AVERSIRISTPHNTTG

SEQ ID NO: 60568 - protein, 16 aa, Mycobacterium tuberculosis
VERSIRISTPHNTTGH

SEQ ID NO: 60569 - protein, 16 aa, Mycobacterium tuberculosis
ERSIRISTPHNTTGHF

SEQ ID NO: 60570 - protein, 16 aa, Mycobacterium tuberculosis
RSIRISTPHNTTGHFE

SEQ ID NO: 60571 - protein, 16 aa, Mycobacterium tuberculosis
SIRISTPHNTTGHFEW

SEQ ID NO: 60572 - protein, 16 aa, Mycobacterium tuberculosis
IRISTPHNTTGHFEWV

SEQ ID NO: 60573 - protein, 16 aa, Mycobacterium tuberculosis
RISTPHNTTGHFEWVA

SEQ ID NO: 60574 - protein, 16 aa, Mycobacterium tuberculosis
ISTPHNTTGHFEWVAS

SEQ ID NO: 60575 - protein, 16 aa, Mycobacterium tuberculosis
STPHNTTGHFEWVASN

SEQ ID NO: 60576 - protein, 16 aa, Mycobacterium tuberculosis
TPHNTTGHFEWVASNV

SEQ ID NO: 60577 - protein, 16 aa, Mycobacterium tuberculosis
PHNTTGHFEWVASNVV

SEQ ID NO: 60578 - protein, 16 aa, Mycobacterium tuberculosis
HNTTGHFEWVASNVVR

SEQ ID NO: 60579 - protein, 16 aa, Mycobacterium tuberculosis
NTTGHFEWVASNVVRW

SEQ ID NO: 60580 - protein, 16 aa, Mycobacterium tuberculosis
TTGHFEWVASNVVRWV

SEQ ID NO: 60581 - protein, 16 aa, Mycobacterium tuberculosis
TGHFEWVASNVVRWVP

SEQ ID NO: 60582 - protein, 16 aa, Mycobacterium tuberculosis
GHFEWVASNVVRWVPH

SEQ ID NO: 60583 - protein, 16 aa, Mycobacterium tuberculosis
HFEWVASNVVRWVPHR

SEQ ID NO: 60584 - protein, 16 aa, Mycobacterium tuberculosis
FEWVASNVVRWVPHRY

SEQ ID NO: 60585 - protein, 16 aa, Mycobacterium tuberculosis
EWVASNVVRWVPHRYW

SEQ ID NO: 60586 - protein, 16 aa, Mycobacterium tuberculosis
WVASNVVRWVPHRYWP

SEQ ID NO: 60587 - protein, 16 aa, Mycobacterium tuberculosis
VASNVVRWVPHRYWPP

SEQ ID NO: 60588 - protein, 16 aa, Mycobacterium tuberculosis
ASNVVRWVPHRYWPPH

SEQ ID NO: 60589 - protein, 16 aa, Mycobacterium tuberculosis
SNVVRWVPHRYWPPHT

SEQ ID NO: 60590 - protein, 16 aa, Mycobacterium tuberculosis
NVVRWVPHRYWPPHTR

SEQ ID NO: 60591 - protein, 16 aa, Mycobacterium tuberculosis
VVRWVPHRYWPPHTRV

SEQ ID NO: 60592 - protein, 16 aa, Mycobacterium tuberculosis
VRWVPHRYWPPHTRVS

SEQ ID NO: 60593 - protein, 16 aa, Mycobacterium tuberculosis
RWVPHRYWPPHTRVSV

SEQ ID NO: 60594 - protein, 16 aa, Mycobacterium tuberculosis
WVPHRYWPPHTRVSVG

SEQ ID NO: 60595 - protein, 16 aa, Mycobacterium tuberculosis
VPHRYWPPHTRVSVGV

SEQ ID NO: 60596 - protein, 16 aa, Mycobacterium tuberculosis
PHRYWPPHTRVSVGVQ

SEQ ID NO: 60597 - protein, 16 aa, Mycobacterium tuberculosis
HRYWPPHTRVSVGVQE

SEQ ID NO: 60598 - protein, 16 aa, Mycobacterium tuberculosis
RYWPPHTRVSVGVQEL

SEQ ID NO: 60599 - protein, 16 aa, Mycobacterium tuberculosis
YWPPHTRVSVGVQELT

SEQ ID NO: 60600 - protein, 16 aa, Mycobacterium tuberculosis
WPPHTRVSVGVQELTE

SEQ ID NO: 60601 - protein, 16 aa, Mycobacterium tuberculosis
PPHTRVSVGVQELTEG

SEQ ID NO: 60602 - protein, 16 aa, Mycobacterium tuberculosis
PHTRVSVGVQELTEGF

SEQ ID NO: 60603 - protein, 16 aa, Mycobacterium tuberculosis
HTRVSVGVQELTEGFE

SEQ ID NO: 60604 - protein, 16 aa, Mycobacterium tuberculosis
TRVSVGVQELTEGFET

SEQ ID NO: 60605 - protein, 16 aa, Mycobacterium tuberculosis
RVSVGVQELTEGFETG

SEQ ID NO: 60606 - protein, 16 aa, Mycobacterium tuberculosis
VSVGVQELTEGFETGD

SEQ ID NO: 60607 - protein, 16 aa, Mycobacterium tuberculosis
SVGVQELTEGFETGDA

SEQ ID NO: 60608 - protein, 16 aa, Mycobacterium tuberculosis
VGVQELTEGFETGDAL

SEQ ID NO: 60609 - protein, 16 aa, Mycobacterium tuberculosis
GVQELTEGFETGDALI

SEQ ID NO: 60610 - protein, 16 aa, Mycobacterium tuberculosis
VQELTEGFETGDALIG

SEQ ID NO: 60611 - protein, 16 aa, Mycobacterium tuberculosis
QELTEGFETGDALIGV

SEQ ID NO: 60612 - protein, 16 aa, Mycobacterium tuberculosis
ELTEGFETGDALIGVA

SEQ ID NO: 60613 - protein, 16 aa, Mycobacterium tuberculosis
LTEGFETGDALIGVAS

SEQ ID NO: 60614 - protein, 16 aa, Mycobacterium tuberculosis
TEGFETGDALIGVASI

SEQ ID NO: 60615 - protein, 16 aa, Mycobacterium tuberculosis
EGFETGDALIGVASIS

SEQ ID NO: 60616 - protein, 16 aa, Mycobacterium tuberculosis
GFETGDALIGVASISA

SEQ ID NO: 60617 - protein, 16 aa, Mycobacterium tuberculosis
FETGDALIGVASISAH

SEQ ID NO: 60618 - protein, 16 aa, Mycobacterium tuberculosis
ETGDALIGVASISAHT

SEQ ID NO: 60619 - protein, 16 aa, Mycobacterium tuberculosis
TGDALIGVASISAHTF

SEQ ID NO: 60620 - protein, 16 aa, Mycobacterium tuberculosis
GDALIGVASISAHTFT

SEQ ID NO: 60621 - protein, 16 aa, Mycobacterium tuberculosis
DALIGVASISAHTFTV

SEQ ID NO: 60622 - protein, 16 aa, Mycobacterium tuberculosis
ALIGVASISAHTFTVS

SEQ ID NO: 60623 - protein, 16 aa, Mycobacterium tuberculosis
LIGVASISAHTFTVSR

SEQ ID NO: 60624 - protein, 16 aa, Mycobacterium tuberculosis
IGVASISAHTFTVSRN

SEQ ID NO: 60625 - protein, 16 aa, Mycobacterium tuberculosis
GVASISAHTFTVSRNG

SEQ ID NO: 60626 - protein, 16 aa, Mycobacterium tuberculosis
VASISAHTFTVSRNGE

SEQ ID NO: 60627 - protein, 16 aa, Mycobacterium tuberculosis
ASISAHTFTVSRNGEV

SEQ ID NO: 60628 - protein, 16 aa, Mycobacterium tuberculosis
SISAHTFTVSRNGEVL

SEQ ID NO: 60629 - protein, 16 aa, Mycobacterium tuberculosis
ISAHTFTVSRNGEVLR

SEQ ID NO: 60630 - protein, 16 aa, Mycobacterium tuberculosis
SAHTFTVSRNGEVLRT

SEQ ID NO: 60631 - protein, 16 aa, Mycobacterium tuberculosis
AHTFTVSRNGEVLRTM

SEQ ID NO: 60632 - protein, 16 aa, Mycobacterium tuberculosis
HTFTVSRNGEVLRTMP

SEQ ID NO: 60633 - protein, 16 aa, Mycobacterium tuberculosis
TFTVSRNGEVLRTMPA

SEQ ID NO: 60634 - protein, 16 aa, Mycobacterium tuberculosis
FTVSRNGEVLRTMPAS

SEQ ID NO: 60635 - protein, 16 aa, Mycobacterium tuberculosis
TVSRNGEVLRTMPASL

SEQ ID NO: 60636 - protein, 16 aa, Mycobacterium tuberculosis
VSRNGEVLRTMPASLG

SEQ ID NO: 60637 - protein, 16 aa, Mycobacterium tuberculosis
SRNGEVLRTMPASLGK

SEQ ID NO: 60638 - protein, 16 aa, Mycobacterium tuberculosis
RNGEVLRTMPASLGKP

SEQ ID NO: 60639 - protein, 16 aa, Mycobacterium tuberculosis
NGEVLRTMPASLGKPS

SEQ ID NO: 60640 - protein, 16 aa, Mycobacterium tuberculosis
GEVLRTMPASLGKPSR

SEQ ID NO: 60641 - protein, 16 aa, Mycobacterium tuberculosis
EVLRTMPASLGKPSRP

SEQ ID NO: 60642 - protein, 16 aa, Mycobacterium tuberculosis
VLRTMPASLGKPSRPT

SEQ ID NO: 60643 - protein, 16 aa, Mycobacterium tuberculosis
LRTMPASLGKPSRPTP

SEQ ID NO: 60644 - protein, 16 aa, Mycobacterium tuberculosis
RTMPASLGKPSRPTPI

SEQ ID NO: 60645 - protein, 16 aa, Mycobacterium tuberculosis
TMPASLGKPSRPTPIG

SEQ ID NO: 60646 - protein, 16 aa, Mycobacterium tuberculosis
MPASLGKPSRPTPIGS

SEQ ID NO: 60647 - protein, 16 aa, Mycobacterium tuberculosis
PASLGKPSRPTPIGSF

SEQ ID NO: 60648 - protein, 16 aa, Mycobacterium tuberculosis
ASLGKPSRPTPIGSFH

SEQ ID NO: 60649 - protein, 16 aa, Mycobacterium tuberculosis
SLGKPSRPTPIGSFHA

SEQ ID NO: 60650 - protein, 16 aa, Mycobacterium tuberculosis
LGKPSRPTPIGSFHAM

SEQ ID NO: 60651 - protein, 16 aa, Mycobacterium tuberculosis
GKPSRPTPIGSFHAMS

SEQ ID NO: 60652 - protein, 16 aa, Mycobacterium tuberculosis
KPSRPTPIGSFHAMSK

SEQ ID NO: 60653 - protein, 16 aa, Mycobacterium tuberculosis
PSRPTPIGSFHAMSKE

SEQ ID NO: 60654 - protein, 16 aa, Mycobacterium tuberculosis
SRPTPIGSFHAMSKER

SEQ ID NO: 60655 - protein, 16 aa, Mycobacterium tuberculosis
RPTPIGSFHAMSKERT

SEQ ID NO: 60656 - protein, 16 aa, Mycobacterium tuberculosis
PTPIGSFHAMSKERTV

SEQ ID NO: 60657 - protein, 16 aa, Mycobacterium tuberculosis
TPIGSFHAMSKERTVV

SEQ ID NO: 60658 - protein, 16 aa, Mycobacterium tuberculosis
PIGSFHAMSKERTVVM

SEQ ID NO: 60659 - protein, 16 aa, Mycobacterium tuberculosis
IGSFHAMSKERTVVMD

SEQ ID NO: 60660 - protein, 16 aa, Mycobacterium tuberculosis
GSFHAMSKERTVVMDS

SEQ ID NO: 60661 - protein, 16 aa, Mycobacterium tuberculosis
SFHAMSKERTVVMDSR

SEQ ID NO: 60662 - protein, 16 aa, Mycobacterium tuberculosis
FHAMSKERTVVMDSRT

SEQ ID NO: 60663 - protein, 16 aa, Mycobacterium tuberculosis
HAMSKERTVVMDSRTI

SEQ ID NO: 60664 - protein, 16 aa, Mycobacterium tuberculosis
AMSKERTVVMDSRTIG

SEQ ID NO: 60665 - protein, 16 aa, Mycobacterium tuberculosis
MSKERTVVMDSRTIGI

SEQ ID NO: 60666 - protein, 16 aa, Mycobacterium tuberculosis
SKERTVVMDSRTIGIP

SEQ ID NO: 60667 - protein, 16 aa, Mycobacterium tuberculosis
KERTVVMDSRTIGIPL

SEQ ID NO: 60668 - protein, 16 aa, Mycobacterium tuberculosis
ERTVVMDSRTIGIPLN

SEQ ID NO: 60669 - protein, 16 aa, Mycobacterium tuberculosis
RTVVMDSRTIGIPLNS

SEQ ID NO: 60670 - protein, 16 aa, Mycobacterium tuberculosis
TVVMDSRTIGIPLNSS

SEQ ID NO: 60671 - protein, 16 aa, Mycobacterium tuberculosis
VVMDSRTIGIPLNSSD

SEQ ID NO: 60672 - protein, 16 aa, Mycobacterium tuberculosis
VMDSRTIGIPLNSSDG

SEQ ID NO: 60673 - protein, 16 aa, Mycobacterium tuberculosis
MDSRTIGIPLNSSDGY

SEQ ID NO: 60674 - protein, 16 aa, Mycobacterium tuberculosis
DSRTIGIPLNSSDGYL

SEQ ID NO: 60675 - protein, 16 aa, Mycobacterium tuberculosis
SRTIGIPLNSSDGYLL

SEQ ID NO: 60676 - protein, 16 aa, Mycobacterium tuberculosis
RTIGIPLNSSDGYLLT

SEQ ID NO: 60677 - protein, 16 aa, Mycobacterium tuberculosis
TIGIPLNSSDGYLLTA

SEQ ID NO: 60678 - protein, 16 aa, Mycobacterium tuberculosis
IGIPLNSSDGYLLTAH

SEQ ID NO: 60679 - protein, 16 aa, Mycobacterium tuberculosis
GIPLNSSDGYLLTAHY

SEQ ID NO: 60680 - protein, 16 aa, Mycobacterium tuberculosis
IPLNSSDGYLLTAHYA

SEQ ID NO: 60681 - protein, 16 aa, Mycobacterium tuberculosis
PLNSSDGYLLTAHYAV

SEQ ID NO: 60682 - protein, 16 aa, Mycobacterium tuberculosis
LNSSDGYLLTAHYAVR

SEQ ID NO: 60683 - protein, 16 aa, Mycobacterium tuberculosis
NSSDGYLLTAHYAVRV

SEQ ID NO: 60684 - protein, 16 aa, Mycobacterium tuberculosis
SSDGYLLTAHYAVRVT

SEQ ID NO: 60685 - protein, 16 aa, Mycobacterium tuberculosis
SDGYLLTAHYAVRVTW

SEQ ID NO: 60686 - protein, 16 aa, Mycobacterium tuberculosis
DGYLLTAHYAVRVTWS

SEQ ID NO: 60687 - protein, 16 aa, Mycobacterium tuberculosis
GYLLTAHYAVRVTWSG

SEQ ID NO: 60688 - protein, 16 aa, Mycobacterium tuberculosis
YLLTAHYAVRVTWSGV

SEQ ID NO: 60689 - protein, 16 aa, Mycobacterium tuberculosis
LLTAHYAVRVTWSGVY

SEQ ID NO: 60690 - protein, 16 aa, Mycobacterium tuberculosis
LTAHYAVRVTWSGVYV

SEQ ID NO: 60691 - protein, 16 aa, Mycobacterium tuberculosis
TAHYAVRVTWSGVYVH

SEQ ID NO: 60692 - protein, 16 aa, Mycobacterium tuberculosis
AHYAVRVTWSGVYVHS

SEQ ID NO: 60693 - protein, 16 aa, Mycobacterium tuberculosis
HYAVRVTWSGVYVHSA

SEQ ID NO: 60694 - protein, 16 aa, Mycobacterium tuberculosis
YAVRVTWSGVYVHSAP

SEQ ID NO: 60695 - protein, 16 aa, Mycobacterium tuberculosis
AVRVTWSGVYVHSAPW

SEQ ID NO: 60696 - protein, 16 aa, Mycobacterium tuberculosis
VRVTWSGVYVHSAPWS

SEQ ID NO: 60697 - protein, 16 aa, Mycobacterium tuberculosis
RVTWSGVYVHSAPWSV

SEQ ID NO: 60698 - protein, 16 aa, Mycobacterium tuberculosis
VTWSGVYVHSAPWSVN

SEQ ID NO: 60699 - protein, 16 aa, Mycobacterium tuberculosis
TWSGVYVHSAPWSVNS

SEQ ID NO: 60700 - protein, 16 aa, Mycobacterium tuberculosis
WSGVYVHSAPWSVNSQ

SEQ ID NO: 60701 - protein, 16 aa, Mycobacterium tuberculosis
SGVYVHSAPWSVNSQG

SEQ ID NO: 60702 - protein, 16 aa, Mycobacterium tuberculosis
GVYVHSAPWSVNSQGY

SEQ ID NO: 60703 - protein, 16 aa, Mycobacterium tuberculosis
VYVHSAPWSVNSQGYA

SEQ ID NO: 60704 - protein, 16 aa, Mycobacterium tuberculosis
YVHSAPWSVNSQGYAN

SEQ ID NO: 60705 - protein, 16 aa, Mycobacterium tuberculosis
VHSAPWSVNSQGYANV

SEQ ID NO: 60706 - protein, 16 aa, Mycobacterium tuberculosis
HSAPWSVNSQGYANVS

SEQ ID NO: 60707 - protein, 16 aa, Mycobacterium tuberculosis
SAPWSVNSQGYANVSH

SEQ ID NO: 60708 - protein, 16 aa, Mycobacterium tuberculosis
APWSVNSQGYANVSHG

SEQ ID NO: 60709 - protein, 16 aa, Mycobacterium tuberculosis
PWSVNSQGYANVSHGC

SEQ ID NO: 60710 - protein, 16 aa, Mycobacterium tuberculosis
WSVNSQGYANVSHGCI

SEQ ID NO: 60711 - protein, 16 aa, Mycobacterium tuberculosis
SVNSQGYANVSHGCIN

SEQ ID NO: 60712 - protein, 16 aa, Mycobacterium tuberculosis
VNSQGYANVSHGCINL

SEQ ID NO: 60713 - protein, 16 aa, Mycobacterium tuberculosis
NSQGYANVSHGCINLS

SEQ ID NO: 60714 - protein, 16 aa, Mycobacterium tuberculosis
SQGYANVSHGCINLSP

SEQ ID NO: 60715 - protein, 16 aa, Mycobacterium tuberculosis
QGYANVSHGCINLSPD

SEQ ID NO: 60716 - protein, 16 aa, Mycobacterium tuberculosis
GYANVSHGCINLSPDN

SEQ ID NO: 60717 - protein, 16 aa, Mycobacterium tuberculosis
YANVSHGCINLSPDNA

SEQ ID NO: 60718 - protein, 16 aa, Mycobacterium tuberculosis
ANVSHGCINLSPDNAA

SEQ ID NO: 60719 - protein, 16 aa, Mycobacterium tuberculosis
NVSHGCINLSPDNAAW

SEQ ID NO: 60720 - protein, 16 aa, Mycobacterium tuberculosis
VSHGCINLSPDNAAWY

SEQ ID NO: 60721 - protein, 16 aa, Mycobacterium tuberculosis
SHGCINLSPDNAAWYF

SEQ ID NO: 60722 - protein, 16 aa, Mycobacterium tuberculosis
HGCINLSPDNAAWYFD

SEQ ID NO: 60723 - protein, 16 aa, Mycobacterium tuberculosis
GCINLSPDNAAWYFDA

SEQ ID NO: 60724 - protein, 16 aa, Mycobacterium tuberculosis
CINLSPDNAAWYFDAV

SEQ ID NO: 60725 - protein, 16 aa, Mycobacterium tuberculosis
INLSPDNAAWYFDAVT

SEQ ID NO: 60726 - protein, 16 aa, Mycobacterium tuberculosis
NLSPDNAAWYFDAVTV

SEQ ID NO: 60727 - protein, 16 aa, Mycobacterium tuberculosis
LSPDNAAWYFDAVTVG

SEQ ID NO: 60728 - protein, 16 aa, Mycobacterium tuberculosis
SPDNAAWYFDAVTVGD

SEQ ID NO: 60729 - protein, 16 aa, Mycobacterium tuberculosis
PDNAAWYFDAVTVGDP

SEQ ID NO: 60730 - protein, 16 aa, Mycobacterium tuberculosis
DNAAWYFDAVTVGDPI

SEQ ID NO: 60731 - protein, 16 aa, Mycobacterium tuberculosis
NAAWYFDAVTVGDPIE

SEQ ID NO: 60732 - protein, 16 aa, Mycobacterium tuberculosis
AAWYFDAVTVGDPIEV

SEQ ID NO: 60733 - protein, 16 aa, Mycobacterium tuberculosis
AWYFDAVTVGDPIEVV

SEQ ID NO: 60734 - protein, 16 aa, Mycobacterium tuberculosis
WYFDAVTVGDPIEVVG

SEQ ID NO: 60735 - protein, 13 aa, Mycobacterium tuberculosis
MAGSVSAAAGIGW

SEQ ID NO: 60736 - protein, 13 aa, Mycobacterium tuberculosis
AGSVSAAAGIGWV

SEQ ID NO: 60737 - protein, 13 aa, Mycobacterium tuberculosis
GSVSAAAGIGWVG

SEQ ID NO: 60738 - protein, 13 aa, Mycobacterium tuberculosis
SVSAAAGIGWVGL

SEQ ID NO: 60739 - protein, 13 aa, Mycobacterium tuberculosis
VSAAAGIGWVGLN

SEQ ID NO: 60740 - protein, 13 aa, Mycobacterium tuberculosis
SAAAGIGWVGLNV

SEQ ID NO: 60741 - protein, 13 aa, Mycobacterium tuberculosis
AAAGIGWVGLNVT

SEQ ID NO: 60742 - protein, 13 aa, Mycobacterium tuberculosis
AAGIGWVGLNVTE

SEQ ID NO: 60743 - protein, 13 aa, Mycobacterium tuberculosis
AGIGWVGLNVTET

SEQ ID NO: 60744 - protein, 13 aa, Mycobacterium tuberculosis
GIGWVGLNVTETN

SEQ ID NO: 60745 - protein, 13 aa, Mycobacterium tuberculosis
IGWVGLNVTETNR

SEQ ID NO: 60746 - protein, 13 aa, Mycobacterium tuberculosis
GWVGLNVTETNRD

SEQ ID NO: 60747 - protein, 13 aa, Mycobacterium tuberculosis
WVGLNVTETNRDQ

SEQ ID NO: 60748 - protein, 13 aa, Mycobacterium tuberculosis
VGLNVTETNRDQC

SEQ ID NO: 60749 - protein, 13 aa, Mycobacterium tuberculosis
GLNVTETNRDQCY

SEQ ID NO: 60750 - protein, 13 aa, Mycobacterium tuberculosis
LNVTETNRDQCYR

SEQ ID NO: 60751 - protein, 13 aa, Mycobacterium tuberculosis
NVTETNRDQCYRV

SEQ ID NO: 60752 - protein, 13 aa, Mycobacterium tuberculosis
VTETNRDQCYRVE

SEQ ID NO: 60753 - protein, 13 aa, Mycobacterium tuberculosis
TETNRDQCYRVER

SEQ ID NO: 60754 - protein, 13 aa, Mycobacterium tuberculosis
ETNRDQCYRVERT

SEQ ID NO: 60755 - protein, 13 aa, Mycobacterium tuberculosis
TNRDQCYRVERTT

SEQ ID NO: 60756 - protein, 13 aa, Mycobacterium tuberculosis
NRDQCYRVERTTV

SEQ ID NO: 60757 - protein, 13 aa, Mycobacterium tuberculosis
RDQCYRVERTTVD

SEQ ID NO: 60758 - protein, 13 aa, Mycobacterium tuberculosis
DQCYRVERTTVDA

SEQ ID NO: 60759 - protein, 13 aa, Mycobacterium tuberculosis
QCYRVERTTVDAL

SEQ ID NO: 60760 - protein, 13 aa, Mycobacterium tuberculosis
CYRVERTTVDALT

SEQ ID NO: 60761 - protein, 13 aa, Mycobacterium tuberculosis
YRVERTTVDALTH

SEQ ID NO: 60762 - protein, 13 aa, Mycobacterium tuberculosis
RVERTTVDALTHP

SEQ ID NO: 60763 - protein, 13 aa, Mycobacterium tuberculosis
VERTTVDALTHPE

SEQ ID NO: 60764 - protein, 13 aa, Mycobacterium tuberculosis
ERTTVDALTHPEY

SEQ ID NO: 60765 - protein, 13 aa, Mycobacterium tuberculosis
RTTVDALTHPEYR

SEQ ID NO: 60766 - protein, 13 aa, Mycobacterium tuberculosis
TTVDALTHPEYRV

SEQ ID NO: 60767 - protein, 13 aa, Mycobacterium tuberculosis
TVDALTHPEYRVH

SEQ ID NO: 60768 - protein, 13 aa, Mycobacterium tuberculosis
VDALTHPEYRVHT

SEQ ID NO: 60769 - protein, 13 aa, Mycobacterium tuberculosis
DALTHPEYRVHTR

SEQ ID NO: 60770 - protein, 13 aa, Mycobacterium tuberculosis
ALTHPEYRVHTRG

SEQ ID NO: 60771 - protein, 13 aa, Mycobacterium tuberculosis
LTHPEYRVHTRGV

SEQ ID NO: 60772 - protein, 13 aa, Mycobacterium tuberculosis
THPEYRVHTRGVQ

SEQ ID NO: 60773 - protein, 13 aa, Mycobacterium tuberculosis
HPEYRVHTRGVQR

SEQ ID NO: 60774 - protein, 13 aa, Mycobacterium tuberculosis
PEYRVHTRGVQRV

SEQ ID NO: 60775 - protein, 13 aa, Mycobacterium tuberculosis
EYRVHTRGVQRVR

SEQ ID NO: 60776 - protein, 13 aa, Mycobacterium tuberculosis
YRVHTRGVQRVRV

SEQ ID NO: 60777 - protein, 13 aa, Mycobacterium tuberculosis
RVHTRGVQRVRVT

SEQ ID NO: 60778 - protein, 13 aa, Mycobacterium tuberculosis
VHTRGVQRVRVTR

SEQ ID NO: 60779 - protein, 13 aa, Mycobacterium tuberculosis
HTRGVQRVRVTRN

SEQ ID NO: 60780 - protein, 13 aa, Mycobacterium tuberculosis
TRGVQRVRVTRNA

SEQ ID NO: 60781 - protein, 13 aa, Mycobacterium tuberculosis
RGVQRVRVTRNAR

SEQ ID NO: 60782 - protein, 13 aa, Mycobacterium tuberculosis
GVQRVRVTRNARK

SEQ ID NO: 60783 - protein, 13 aa, Mycobacterium tuberculosis
VQRVRVTRNARKH

SEQ ID NO: 60784 - protein, 13 aa, Mycobacterium tuberculosis
QRVRVTRNARKHR

SEQ ID NO: 60785 - protein, 13 aa, Mycobacterium tuberculosis
RVRVTRNARKHRV

SEQ ID NO: 60786 - protein, 13 aa, Mycobacterium tuberculosis
VRVTRNARKHRVS

SEQ ID NO: 60787 - protein, 13 aa, Mycobacterium tuberculosis
RVTRNARKHRVSK

SEQ ID NO: 60788 - protein, 13 aa, Mycobacterium tuberculosis
VTRNARKHRVSKH

SEQ ID NO: 60789 - protein, 13 aa, Mycobacterium tuberculosis
TRNARKHRVSKHR

SEQ ID NO: 60790 - protein, 13 aa, Mycobacterium tuberculosis
RNARKHRVSKHRI

SEQ ID NO: 60791 - protein, 13 aa, Mycobacterium tuberculosis
NARKHRVSKHRIV

SEQ ID NO: 60792 - protein, 13 aa, Mycobacterium tuberculosis
ARKHRVSKHRIVA

SEQ ID NO: 60793 - protein, 13 aa, Mycobacterium tuberculosis
RKHRVSKHRIVAA

SEQ ID NO: 60794 - protein, 13 aa, Mycobacterium tuberculosis
KHRVSKHRIVAAM

SEQ ID NO: 60795 - protein, 13 aa, Mycobacterium tuberculosis
HRVSKHRIVAAMR

SEQ ID NO: 60796 - protein, 13 aa, Mycobacterium tuberculosis
RVSKHRIVAAMRH

SEQ ID NO: 60797 - protein, 13 aa, Mycobacterium tuberculosis
VSKHRIVAAMRHC

SEQ ID NO: 60798 - protein, 13 aa, Mycobacterium tuberculosis
SKHRIVAAMRHCG

SEQ ID NO: 60799 - protein, 13 aa, Mycobacterium tuberculosis
KHRIVAAMRHCGV

SEQ ID NO: 60800 - protein, 13 aa, Mycobacterium tuberculosis
HRIVAAMRHCGVP

SEQ ID NO: 60801 - protein, 13 aa, Mycobacterium tuberculosis
RIVAAMRHCGVPV

SEQ ID NO: 60802 - protein, 13 aa, Mycobacterium tuberculosis
IVAAMRHCGVPVI

SEQ ID NO: 60803 - protein, 13 aa, Mycobacterium tuberculosis
VAAMRHCGVPVIQ

SEQ ID NO: 60804 - protein, 13 aa, Mycobacterium tuberculosis
AAMRHCGVPVIQE

SEQ ID NO: 60805 - protein, 13 aa, Mycobacterium tuberculosis
AMRHCGVPVIQED

SEQ ID NO: 60806 - protein, 13 aa, Mycobacterium tuberculosis
MRHCGVPVIQEDG

SEQ ID NO: 60807 - protein, 13 aa, Mycobacterium tuberculosis
RHCGVPVIQEDGS

SEQ ID NO: 60808 - protein, 13 aa, Mycobacterium tuberculosis
HCGVPVIQEDGSL

SEQ ID NO: 60809 - protein, 13 aa, Mycobacterium tuberculosis
CGVPVIQEDGSLY

SEQ ID NO: 60810 - protein, 13 aa, Mycobacterium tuberculosis
GVPVIQEDGSLYY

SEQ ID NO: 60811 - protein, 13 aa, Mycobacterium tuberculosis
VPVIQEDGSLYYQ

SEQ ID NO: 60812 - protein, 13 aa, Mycobacterium tuberculosis
PVIQEDGSLYYQG

SEQ ID NO: 60813 - protein, 13 aa, Mycobacterium tuberculosis
VIQEDGSLYYQGR

SEQ ID NO: 60814 - protein, 13 aa, Mycobacterium tuberculosis
IQEDGSLYYQGRD

SEQ ID NO: 60815 - protein, 13 aa, Mycobacterium tuberculosis
QEDGSLYYQGRDT

SEQ ID NO: 60816 - protein, 13 aa, Mycobacterium tuberculosis
EDGSLYYQGRDTS

SEQ ID NO: 60817 - protein, 13 aa, Mycobacterium tuberculosis
DGSLYYQGRDTSG

SEQ ID NO: 60818 - protein, 13 aa, Mycobacterium tuberculosis
GSLYYQGRDTSGR

SEQ ID NO: 60819 - protein, 13 aa, Mycobacterium tuberculosis
SLYYQGRDTSGRL

SEQ ID NO: 60820 - protein, 13 aa, Mycobacterium tuberculosis
LYYQGRDTSGRLT

SEQ ID NO: 60821 - protein, 13 aa, Mycobacterium tuberculosis
YYQGRDTSGRLTE

SEQ ID NO: 60822 - protein, 13 aa, Mycobacterium tuberculosis
YQGRDTSGRLTEV

SEQ ID NO: 60823 - protein, 13 aa, Mycobacterium tuberculosis
QGRDTSGRLTEVV

SEQ ID NO: 60824 - protein, 13 aa, Mycobacterium tuberculosis
GRDTSGRLTEVVA

SEQ ID NO: 60825 - protein, 13 aa, Mycobacterium tuberculosis
RDTSGRLTEVVAV

SEQ ID NO: 60826 - protein, 13 aa, Mycobacterium tuberculosis
DTSGRLTEVVAVE

SEQ ID NO: 60827 - protein, 13 aa, Mycobacterium tuberculosis
TSGRLTEVVAVEA

SEQ ID NO: 60828 - protein, 13 aa, Mycobacterium tuberculosis
SGRLTEVVAVEAD

SEQ ID NO: 60829 - protein, 13 aa, Mycobacterium tuberculosis
GRLTEVVAVEADD

SEQ ID NO: 60830 - protein, 13 aa, Mycobacterium tuberculosis
RLTEVVAVEADDG

SEQ ID NO: 60831 - protein, 13 aa, Mycobacterium tuberculosis
LTEVVAVEADDGD

SEQ ID NO: 60832 - protein, 13 aa, Mycobacterium tuberculosis
TEVVAVEADDGDL

SEQ ID NO: 60833 - protein, 13 aa, Mycobacterium tuberculosis
EVVAVEADDGDLI

SEQ ID NO: 60834 - protein, 13 aa, Mycobacterium tuberculosis
VVAVEADDGDLII

SEQ ID NO: 60835 - protein, 13 aa, Mycobacterium tuberculosis
VAVEADDGDLIIT

SEQ ID NO: 60836 - protein, 13 aa, Mycobacterium tuberculosis
AVEADDGDLIITH

SEQ ID NO: 60837 - protein, 13 aa, Mycobacterium tuberculosis
VEADDGDLIITHA

SEQ ID NO: 60838 - protein, 13 aa, Mycobacterium tuberculosis
EADDGDLIITHAM

SEQ ID NO: 60839 - protein, 13 aa, Mycobacterium tuberculosis
ADDGDLIITHAMP

SEQ ID NO: 60840 - protein, 13 aa, Mycobacterium tuberculosis
DDGDLIITHAMPK

SEQ ID NO: 60841 - protein, 13 aa, Mycobacterium tuberculosis
DGDLIITHAMPKE

SEQ ID NO: 60842 - protein, 13 aa, Mycobacterium tuberculosis
GDLIITHAMPKEW

SEQ ID NO: 60843 - protein, 13 aa, Mycobacterium tuberculosis
DLIITHAMPKEWK

SEQ ID NO: 60844 - protein, 13 aa, Mycobacterium tuberculosis
LIITHAMPKEWKR

SEQ ID NO: 60845 - protein, 14 aa, Mycobacterium tuberculosis
MAGSVSAAAGIGWV

SEQ ID NO: 60846 - protein, 14 aa, Mycobacterium tuberculosis
AGSVSAAAGIGWVG

SEQ ID NO: 60847 - protein, 14 aa, Mycobacterium tuberculosis
GSVSAAAGIGWVGL

SEQ ID NO: 60848 - protein, 14 aa, Mycobacterium tuberculosis
SVSAAAGIGWVGLN

SEQ ID NO: 60849 - protein, 14 aa, Mycobacterium tuberculosis
VSAAAGIGWVGLNV

SEQ ID NO: 60850 - protein, 14 aa, Mycobacterium tuberculosis
SAAAGIGWVGLNVT

SEQ ID NO: 60851 - protein, 14 aa, Mycobacterium tuberculosis
AAAGIGWVGLNVTE

SEQ ID NO: 60852 - protein, 14 aa, Mycobacterium tuberculosis
AAGIGWVGLNVTET

SEQ ID NO: 60853 - protein, 14 aa, Mycobacterium tuberculosis
AGIGWVGLNVTETN

SEQ ID NO: 60854 - protein, 14 aa, Mycobacterium tuberculosis
GIGWVGLNVTETNR

SEQ ID NO: 60855 - protein, 14 aa, Mycobacterium tuberculosis
IGWVGLNVTETNRD

SEQ ID NO: 60856 - protein, 14 aa, Mycobacterium tuberculosis
GWVGLNVTETNRDQ

SEQ ID NO: 60857 - protein, 14 aa, Mycobacterium tuberculosis
WVGLNVTETNRDQC

SEQ ID NO: 60858 - protein, 14 aa, Mycobacterium tuberculosis
VGLNVTETNRDQCY

SEQ ID NO: 60859 - protein, 14 aa, Mycobacterium tuberculosis
GLNVTETNRDQCYR

SEQ ID NO: 60860 - protein, 14 aa, Mycobacterium tuberculosis
LNVTETNRDQCYRV

SEQ ID NO: 60861 - protein, 14 aa, Mycobacterium tuberculosis
NVTETNRDQCYRVE

SEQ ID NO: 60862 - protein, 14 aa, Mycobacterium tuberculosis
VTETNRDQCYRVER

SEQ ID NO: 60863 - protein, 14 aa, Mycobacterium tuberculosis
TETNRDQCYRVERT

SEQ ID NO: 60864 - protein, 14 aa, Mycobacterium tuberculosis
ETNRDQCYRVERTT

SEQ ID NO: 60865 - protein, 14 aa, Mycobacterium tuberculosis
TNRDQCYRVERTTV

SEQ ID NO: 60866 - protein, 14 aa, Mycobacterium tuberculosis
NRDQCYRVERTTVD

SEQ ID NO: 60867 - protein, 14 aa, Mycobacterium tuberculosis
RDQCYRVERTTVDA

SEQ ID NO: 60868 - protein, 14 aa, Mycobacterium tuberculosis
DQCYRVERTTVDAL

SEQ ID NO: 60869 - protein, 14 aa, Mycobacterium tuberculosis
QCYRVERTTVDALT

SEQ ID NO: 60870 - protein, 14 aa, Mycobacterium tuberculosis
CYRVERTTVDALTH

SEQ ID NO: 60871 - protein, 14 aa, Mycobacterium tuberculosis
YRVERTTVDALTHP

SEQ ID NO: 60872 - protein, 14 aa, Mycobacterium tuberculosis
RVERTTVDALTHPE

SEQ ID NO: 60873 - protein, 14 aa, Mycobacterium tuberculosis
VERTTVDALTHPEY

SEQ ID NO: 60874 - protein, 14 aa, Mycobacterium tuberculosis
ERTTVDALTHPEYR

SEQ ID NO: 60875 - protein, 14 aa, Mycobacterium tuberculosis
RTTVDALTHPEYRV

SEQ ID NO: 60876 - protein, 14 aa, Mycobacterium tuberculosis
TTVDALTHPEYRVH

SEQ ID NO: 60877 - protein, 14 aa, Mycobacterium tuberculosis
TVDALTHPEYRVHT

SEQ ID NO: 60878 - protein, 14 aa, Mycobacterium tuberculosis
VDALTHPEYRVHTR

SEQ ID NO: 60879 - protein, 14 aa, Mycobacterium tuberculosis
DALTHPEYRVHTRG

SEQ ID NO: 60880 - protein, 14 aa, Mycobacterium tuberculosis
ALTHPEYRVHTRGV

SEQ ID NO: 60881 - protein, 14 aa, Mycobacterium tuberculosis
LTHPEYRVHTRGVQ

SEQ ID NO: 60882 - protein, 14 aa, Mycobacterium tuberculosis
THPEYRVHTRGVQR

SEQ ID NO: 60883 - protein, 14 aa, Mycobacterium tuberculosis
HPEYRVHTRGVQRV

SEQ ID NO: 60884 - protein, 14 aa, Mycobacterium tuberculosis
PEYRVHTRGVQRVR

SEQ ID NO: 60885 - protein, 14 aa, Mycobacterium tuberculosis
EYRVHTRGVQRVRV

SEQ ID NO: 60886 - protein, 14 aa, Mycobacterium tuberculosis
YRVHTRGVQRVRVT

SEQ ID NO: 60887 - protein, 14 aa, Mycobacterium tuberculosis
RVHTRGVQRVRVTR

SEQ ID NO: 60888 - protein, 14 aa, Mycobacterium tuberculosis
VHTRGVQRVRVTRN

SEQ ID NO: 60889 - protein, 14 aa, Mycobacterium tuberculosis
HTRGVQRVRVTRNA

SEQ ID NO: 60890 - protein, 14 aa, Mycobacterium tuberculosis
TRGVQRVRVTRNAR

SEQ ID NO: 60891 - protein, 14 aa, Mycobacterium tuberculosis
RGVQRVRVTRNARK

SEQ ID NO: 60892 - protein, 14 aa, Mycobacterium tuberculosis
GVQRVRVTRNARKH

SEQ ID NO: 60893 - protein, 14 aa, Mycobacterium tuberculosis
VQRVRVTRNARKHR

SEQ ID NO: 60894 - protein, 14 aa, Mycobacterium tuberculosis
QRVRVTRNARKHRV

SEQ ID NO: 60895 - protein, 14 aa, Mycobacterium tuberculosis
RVRVTRNARKHRVS

SEQ ID NO: 60896 - protein, 14 aa, Mycobacterium tuberculosis
VRVTRNARKHRVSK

SEQ ID NO: 60897 - protein, 14 aa, Mycobacterium tuberculosis
RVTRNARKHRVSKH

SEQ ID NO: 60898 - protein, 14 aa, Mycobacterium tuberculosis
VTRNARKHRVSKHR

SEQ ID NO: 60899 - protein, 14 aa, Mycobacterium tuberculosis
TRNARKHRVSKHRI

SEQ ID NO: 60900 - protein, 14 aa, Mycobacterium tuberculosis
RNARKHRVSKHRIV

SEQ ID NO: 60901 - protein, 14 aa, Mycobacterium tuberculosis
NARKHRVSKHRIVA

SEQ ID NO: 60902 - protein, 14 aa, Mycobacterium tuberculosis
ARKHRVSKHRIVAA

SEQ ID NO: 60903 - protein, 14 aa, Mycobacterium tuberculosis
RKHRVSKHRIVAAM

SEQ ID NO: 60904 - protein, 14 aa, Mycobacterium tuberculosis
KHRVSKHRIVAAMR

SEQ ID NO: 60905 - protein, 14 aa, Mycobacterium tuberculosis
HRVSKHRIVAAMRH

SEQ ID NO: 60906 - protein, 14 aa, Mycobacterium tuberculosis
RVSKHRIVAAMRHC

SEQ ID NO: 60907 - protein, 14 aa, Mycobacterium tuberculosis
VSKHRIVAAMRHCG

SEQ ID NO: 60908 - protein, 14 aa, Mycobacterium tuberculosis
SKHRIVAAMRHCGV

SEQ ID NO: 60909 - protein, 14 aa, Mycobacterium tuberculosis
KHRIVAAMRHCGVP

SEQ ID NO: 60910 - protein, 14 aa, Mycobacterium tuberculosis
HRIVAAMRHCGVPV

SEQ ID NO: 60911 - protein, 14 aa, Mycobacterium tuberculosis
RIVAAMRHCGVPVI

SEQ ID NO: 60912 - protein, 14 aa, Mycobacterium tuberculosis
IVAAMRHCGVPVIQ

SEQ ID NO: 60913 - protein, 14 aa, Mycobacterium tuberculosis
VAAMRHCGVPVIQE

SEQ ID NO: 60914 - protein, 14 aa, Mycobacterium tuberculosis
AAMRHCGVPVIQED

SEQ ID NO: 60915 - protein, 14 aa, Mycobacterium tuberculosis
AMRHCGVPVIQEDG

SEQ ID NO: 60916 - protein, 14 aa, Mycobacterium tuberculosis
MRHCGVPVIQEDGS

SEQ ID NO: 60917 - protein, 14 aa, Mycobacterium tuberculosis
RHCGVPVIQEDGSL

SEQ ID NO: 60918 - protein, 14 aa, Mycobacterium tuberculosis
HCGVPVIQEDGSLY

SEQ ID NO: 60919 - protein, 14 aa, Mycobacterium tuberculosis
CGVPVIQEDGSLYY

SEQ ID NO: 60920 - protein, 14 aa, Mycobacterium tuberculosis
GVPVIQEDGSLYYQ

SEQ ID NO: 60921 - protein, 14 aa, Mycobacterium tuberculosis
VPVIQEDGSLYYQG

SEQ ID NO: 60922 - protein, 14 aa, Mycobacterium tuberculosis
PVIQEDGSLYYQGR

SEQ ID NO: 60923 - protein, 14 aa, Mycobacterium tuberculosis
VIQEDGSLYYQGRD

SEQ ID NO: 60924 - protein, 14 aa, Mycobacterium tuberculosis
IQEDGSLYYQGRDT

SEQ ID NO: 60925 - protein, 14 aa, Mycobacterium tuberculosis
QEDGSLYYQGRDTS

SEQ ID NO: 60926 - protein, 14 aa, Mycobacterium tuberculosis
EDGSLYYQGRDTSG

SEQ ID NO: 60927 - protein, 14 aa, Mycobacterium tuberculosis
DGSLYYQGRDTSGR

SEQ ID NO: 60928 - protein, 14 aa, Mycobacterium tuberculosis
GSLYYQGRDTSGRL

SEQ ID NO: 60929 - protein, 14 aa, Mycobacterium tuberculosis
SLYYQGRDTSGRLT

SEQ ID NO: 60930 - protein, 14 aa, Mycobacterium tuberculosis
LYYQGRDTSGRLTE

SEQ ID NO: 60931 - protein, 14 aa, Mycobacterium tuberculosis
YYQGRDTSGRLTEV

SEQ ID NO: 60932 - protein, 14 aa, Mycobacterium tuberculosis
YQGRDTSGRLTEVV

SEQ ID NO: 60933 - protein, 14 aa, Mycobacterium tuberculosis
QGRDTSGRLTEVVA

SEQ ID NO: 60934 - protein, 14 aa, Mycobacterium tuberculosis
GRDTSGRLTEVVAV

SEQ ID NO: 60935 - protein, 14 aa, Mycobacterium tuberculosis
RDTSGRLTEVVAVE

SEQ ID NO: 60936 - protein, 14 aa, Mycobacterium tuberculosis
DTSGRLTEVVAVEA

SEQ ID NO: 60937 - protein, 14 aa, Mycobacterium tuberculosis
TSGRLTEVVAVEAD

SEQ ID NO: 60938 - protein, 14 aa, Mycobacterium tuberculosis
SGRLTEVVAVEADD

SEQ ID NO: 60939 - protein, 14 aa, Mycobacterium tuberculosis
GRLTEVVAVEADDG

SEQ ID NO: 60940 - protein, 14 aa, Mycobacterium tuberculosis
RLTEVVAVEADDGD

SEQ ID NO: 60941 - protein, 14 aa, Mycobacterium tuberculosis
LTEVVAVEADDGDL

SEQ ID NO: 60942 - protein, 14 aa, Mycobacterium tuberculosis
TEVVAVEADDGDLI

SEQ ID NO: 60943 - protein, 14 aa, Mycobacterium tuberculosis
EVVAVEADDGDLII

SEQ ID NO: 60944 - protein, 14 aa, Mycobacterium tuberculosis
VVAVEADDGDLIIT

SEQ ID NO: 60945 - protein, 14 aa, Mycobacterium tuberculosis
VAVEADDGDLIITH

SEQ ID NO: 60946 - protein, 14 aa, Mycobacterium tuberculosis
AVEADDGDLIITHA

SEQ ID NO: 60947 - protein, 14 aa, Mycobacterium tuberculosis
VEADDGDLIITHAM

SEQ ID NO: 60948 - protein, 14 aa, Mycobacterium tuberculosis
EADDGDLIITHAMP

SEQ ID NO: 60949 - protein, 14 aa, Mycobacterium tuberculosis
ADDGDLIITHAMPK

SEQ ID NO: 60950 - protein, 14 aa, Mycobacterium tuberculosis
DDGDLIITHAMPKE

SEQ ID NO: 60951 - protein, 14 aa, Mycobacterium tuberculosis
DGDLIITHAMPKEW

SEQ ID NO: 60952 - protein, 14 aa, Mycobacterium tuberculosis
GDLIITHAMPKEWK

SEQ ID NO: 60953 - protein, 14 aa, Mycobacterium tuberculosis
DLIITHAMPKEWKR

SEQ ID NO: 60954 - protein, 15 aa, Mycobacterium tuberculosis
MAGSVSAAAGIGWVG

SEQ ID NO: 60955 - protein, 15 aa, Mycobacterium tuberculosis
AGSVSAAAGIGWVGL

SEQ ID NO: 60956 - protein, 15 aa, Mycobacterium tuberculosis
GSVSAAAGIGWVGLN

SEQ ID NO: 60957 - protein, 15 aa, Mycobacterium tuberculosis
SVSAAAGIGWVGLNV

SEQ ID NO: 60958 - protein, 15 aa, Mycobacterium tuberculosis
VSAAAGIGWVGLNVT

SEQ ID NO: 60959 - protein, 15 aa, Mycobacterium tuberculosis
SAAAGIGWVGLNVTE

SEQ ID NO: 60960 - protein, 15 aa, Mycobacterium tuberculosis
AAAGIGWVGLNVTET

SEQ ID NO: 60961 - protein, 15 aa, Mycobacterium tuberculosis
AAGIGWVGLNVTETN

SEQ ID NO: 60962 - protein, 15 aa, Mycobacterium tuberculosis
AGIGWVGLNVTETNR

SEQ ID NO: 60963 - protein, 15 aa, Mycobacterium tuberculosis
GIGWVGLNVTETNRD

SEQ ID NO: 60964 - protein, 15 aa, Mycobacterium tuberculosis
IGWVGLNVTETNRDQ

SEQ ID NO: 60965 - protein, 15 aa, Mycobacterium tuberculosis
GWVGLNVTETNRDQC

SEQ ID NO: 60966 - protein, 15 aa, Mycobacterium tuberculosis
WVGLNVTETNRDQCY

SEQ ID NO: 60967 - protein, 15 aa, Mycobacterium tuberculosis
VGLNVTETNRDQCYR

SEQ ID NO: 60968 - protein, 15 aa, Mycobacterium tuberculosis
GLNVTETNRDQCYRV

SEQ ID NO: 60969 - protein, 15 aa, Mycobacterium tuberculosis
LNVTETNRDQCYRVE

SEQ ID NO: 60970 - protein, 15 aa, Mycobacterium tuberculosis
NVTETNRDQCYRVER

SEQ ID NO: 60971 - protein, 15 aa, Mycobacterium tuberculosis
VTETNRDQCYRVERT

SEQ ID NO: 60972 - protein, 15 aa, Mycobacterium tuberculosis
TETNRDQCYRVERTT

SEQ ID NO: 60973 - protein, 15 aa, Mycobacterium tuberculosis
ETNRDQCYRVERTTV

SEQ ID NO: 60974 - protein, 15 aa, Mycobacterium tuberculosis
TNRDQCYRVERTTVD

SEQ ID NO: 60975 - protein, 15 aa, Mycobacterium tuberculosis
NRDQCYRVERTTVDA

SEQ ID NO: 60976 - protein, 15 aa, Mycobacterium tuberculosis
RDQCYRVERTTVDAL

SEQ ID NO: 60977 - protein, 15 aa, Mycobacterium tuberculosis
DQCYRVERTTVDALT

SEQ ID NO: 60978 - protein, 15 aa, Mycobacterium tuberculosis
QCYRVERTTVDALTH

SEQ ID NO: 60979 - protein, 15 aa, Mycobacterium tuberculosis
CYRVERTTVDALTHP

SEQ ID NO: 60980 - protein, 15 aa, Mycobacterium tuberculosis
YRVERTTVDALTHPE

SEQ ID NO: 60981 - protein, 15 aa, Mycobacterium tuberculosis
RVERTTVDALTHPEY

SEQ ID NO: 60982 - protein, 15 aa, Mycobacterium tuberculosis
VERTTVDALTHPEYR

SEQ ID NO: 60983 - protein, 15 aa, Mycobacterium tuberculosis
ERTTVDALTHPEYRV

SEQ ID NO: 60984 - protein, 15 aa, Mycobacterium tuberculosis
RTTVDALTHPEYRVH

SEQ ID NO: 60985 - protein, 15 aa, Mycobacterium tuberculosis
TTVDALTHPEYRVHT

SEQ ID NO: 60986 - protein, 15 aa, Mycobacterium tuberculosis
TVDALTHPEYRVHTR

SEQ ID NO: 60987 - protein, 15 aa, Mycobacterium tuberculosis
VDALTHPEYRVHTRG

SEQ ID NO: 60988 - protein, 15 aa, Mycobacterium tuberculosis
DALTHPEYRVHTRGV

SEQ ID NO: 60989 - protein, 15 aa, Mycobacterium tuberculosis
ALTHPEYRVHTRGVQ

SEQ ID NO: 60990 - protein, 15 aa, Mycobacterium tuberculosis
LTHPEYRVHTRGVQR

SEQ ID NO: 60991 - protein, 15 aa, Mycobacterium tuberculosis
THPEYRVHTRGVQRV

SEQ ID NO: 60992 - protein, 15 aa, Mycobacterium tuberculosis
HPEYRVHTRGVQRVR

SEQ ID NO: 60993 - protein, 15 aa, Mycobacterium tuberculosis
PEYRVHTRGVQRVRV

SEQ ID NO: 60994 - protein, 15 aa, Mycobacterium tuberculosis
EYRVHTRGVQRVRVT

SEQ ID NO: 60995 - protein, 15 aa, Mycobacterium tuberculosis
YRVHTRGVQRVRVTR

SEQ ID NO: 60996 - protein, 15 aa, Mycobacterium tuberculosis
RVHTRGVQRVRVTRN

SEQ ID NO: 60997 - protein, 15 aa, Mycobacterium tuberculosis
VHTRGVQRVRVTRNA

SEQ ID NO: 60998 - protein, 15 aa, Mycobacterium tuberculosis
HTRGVQRVRVTRNAR

SEQ ID NO: 60999 - protein, 15 aa, Mycobacterium tuberculosis
TRGVQRVRVTRNARK

SEQ ID NO: 61000 - protein, 15 aa, Mycobacterium tuberculosis
RGVQRVRVTRNARKH

SEQ ID NO: 61001 - protein, 15 aa, Mycobacterium tuberculosis
GVQRVRVTRNARKHR

SEQ ID NO: 61002 - protein, 15 aa, Mycobacterium tuberculosis
VQRVRVTRNARKHRV

SEQ ID NO: 61003 - protein, 15 aa, Mycobacterium tuberculosis
QRVRVTRNARKHRVS

SEQ ID NO: 61004 - protein, 15 aa, Mycobacterium tuberculosis
RVRVTRNARKHRVSK

SEQ ID NO: 61005 - protein, 15 aa, Mycobacterium tuberculosis
VRVTRNARKHRVSKH

SEQ ID NO: 61006 - protein, 15 aa, Mycobacterium tuberculosis
RVTRNARKHRVSKHR

SEQ ID NO: 61007 - protein, 15 aa, Mycobacterium tuberculosis
VTRNARKHRVSKHRI

SEQ ID NO: 61008 - protein, 15 aa, Mycobacterium tuberculosis
TRNARKHRVSKHRIV

SEQ ID NO: 61009 - protein, 15 aa, Mycobacterium tuberculosis
RNARKHRVSKHRIVA

SEQ ID NO: 61010 - protein, 15 aa, Mycobacterium tuberculosis
NARKHRVSKHRIVAA

SEQ ID NO: 61011 - protein, 15 aa, Mycobacterium tuberculosis
ARKHRVSKHRIVAAM

SEQ ID NO: 61012 - protein, 15 aa, Mycobacterium tuberculosis
RKHRVSKHRIVAAMR

SEQ ID NO: 61013 - protein, 15 aa, Mycobacterium tuberculosis
KHRVSKHRIVAAMRH

SEQ ID NO: 61014 - protein, 15 aa, Mycobacterium tuberculosis
HRVSKHRIVAAMRHC

SEQ ID NO: 61015 - protein, 15 aa, Mycobacterium tuberculosis
RVSKHRIVAAMRHCG

SEQ ID NO: 61016 - protein, 15 aa, Mycobacterium tuberculosis
VSKHRIVAAMRHCGV

SEQ ID NO: 61017 - protein, 15 aa, Mycobacterium tuberculosis
SKHRIVAAMRHCGVP

SEQ ID NO: 61018 - protein, 15 aa, Mycobacterium tuberculosis
KHRIVAAMRHCGVPV

SEQ ID NO: 61019 - protein, 15 aa, Mycobacterium tuberculosis
HRIVAAMRHCGVPVI

SEQ ID NO: 61020 - protein, 15 aa, Mycobacterium tuberculosis
RIVAAMRHCGVPVIQ

SEQ ID NO: 61021 - protein, 15 aa, Mycobacterium tuberculosis
IVAAMRHCGVPVIQE

SEQ ID NO: 61022 - protein, 15 aa, Mycobacterium tuberculosis
VAAMRHCGVPVIQED

SEQ ID NO: 61023 - protein, 15 aa, Mycobacterium tuberculosis
AAMRHCGVPVIQEDG

SEQ ID NO: 61024 - protein, 15 aa, Mycobacterium tuberculosis
AMRHCGVPVIQEDGS

SEQ ID NO: 61025 - protein, 15 aa, Mycobacterium tuberculosis
MRHCGVPVIQEDGSL

SEQ ID NO: 61026 - protein, 15 aa, Mycobacterium tuberculosis
RHCGVPVIQEDGSLY

SEQ ID NO: 61027 - protein, 15 aa, Mycobacterium tuberculosis
HCGVPVIQEDGSLYY

SEQ ID NO: 61028 - protein, 15 aa, Mycobacterium tuberculosis
CGVPVIQEDGSLYYQ

SEQ ID NO: 61029 - protein, 15 aa, Mycobacterium tuberculosis
GVPVIQEDGSLYYQG

SEQ ID NO: 61030 - protein, 15 aa, Mycobacterium tuberculosis
VPVIQEDGSLYYQGR

SEQ ID NO: 61031 - protein, 15 aa, Mycobacterium tuberculosis
PVIQEDGSLYYQGRD

SEQ ID NO: 61032 - protein, 15 aa, Mycobacterium tuberculosis
VIQEDGSLYYQGRDT

SEQ ID NO: 61033 - protein, 15 aa, Mycobacterium tuberculosis
IQEDGSLYYQGRDTS

SEQ ID NO: 61034 - protein, 15 aa, Mycobacterium tuberculosis
QEDGSLYYQGRDTSG

SEQ ID NO: 61035 - protein, 15 aa, Mycobacterium tuberculosis
EDGSLYYQGRDTSGR

SEQ ID NO: 61036 - protein, 15 aa, Mycobacterium tuberculosis
DGSLYYQGRDTSGRL

SEQ ID NO: 61037 - protein, 15 aa, Mycobacterium tuberculosis
GSLYYQGRDTSGRLT

SEQ ID NO: 61038 - protein, 15 aa, Mycobacterium tuberculosis
SLYYQGRDTSGRLTE

SEQ ID NO: 61039 - protein, 15 aa, Mycobacterium tuberculosis
LYYQGRDTSGRLTEV

SEQ ID NO: 61040 - protein, 15 aa, Mycobacterium tuberculosis
YYQGRDTSGRLTEVV

SEQ ID NO: 61041 - protein, 15 aa, Mycobacterium tuberculosis
YQGRDTSGRLTEVVA

SEQ ID NO: 61042 - protein, 15 aa, Mycobacterium tuberculosis
QGRDTSGRLTEVVAV

SEQ ID NO: 61043 - protein, 15 aa, Mycobacterium tuberculosis
GRDTSGRLTEVVAVE

SEQ ID NO: 61044 - protein, 15 aa, Mycobacterium tuberculosis
RDTSGRLTEVVAVEA

SEQ ID NO: 61045 - protein, 15 aa, Mycobacterium tuberculosis
DTSGRLTEVVAVEAD

SEQ ID NO: 61046 - protein, 15 aa, Mycobacterium tuberculosis
TSGRLTEVVAVEADD

SEQ ID NO: 61047 - protein, 15 aa, Mycobacterium tuberculosis
SGRLTEVVAVEADDG

SEQ ID NO: 61048 - protein, 15 aa, Mycobacterium tuberculosis
GRLTEVVAVEADDGD

SEQ ID NO: 61049 - protein, 15 aa, Mycobacterium tuberculosis
RLTEVVAVEADDGDL

SEQ ID NO: 61050 - protein, 15 aa, Mycobacterium tuberculosis
LTEVVAVEADDGDLI

SEQ ID NO: 61051 - protein, 15 aa, Mycobacterium tuberculosis
TEVVAVEADDGDLII

SEQ ID NO: 61052 - protein, 15 aa, Mycobacterium tuberculosis
EVVAVEADDGDLIIT

SEQ ID NO: 61053 - protein, 15 aa, Mycobacterium tuberculosis
VVAVEADDGDLIITH

SEQ ID NO: 61054 - protein, 15 aa, Mycobacterium tuberculosis
VAVEADDGDLIITHA

SEQ ID NO: 61055 - protein, 15 aa, Mycobacterium tuberculosis
AVEADDGDLIITHAM

SEQ ID NO: 61056 - protein, 15 aa, Mycobacterium tuberculosis
VEADDGDLIITHAMP

SEQ ID NO: 61057 - protein, 15 aa, Mycobacterium tuberculosis
EADDGDLIITHAMPK

SEQ ID NO: 61058 - protein, 15 aa, Mycobacterium tuberculosis
ADDGDLIITHAMPKE

SEQ ID NO: 61059 - protein, 15 aa, Mycobacterium tuberculosis
DDGDLIITHAMPKEW

SEQ ID NO: 61060 - protein, 15 aa, Mycobacterium tuberculosis
DGDLIITHAMPKEWK

SEQ ID NO: 61061 - protein, 15 aa, Mycobacterium tuberculosis
GDLIITHAMPKEWKR

SEQ ID NO: 61062 - protein, 16 aa, Mycobacterium tuberculosis
MAGSVSAAAGIGWVGL

SEQ ID NO: 61063 - protein, 16 aa, Mycobacterium tuberculosis
AGSVSAAAGIGWVGLN

SEQ ID NO: 61064 - protein, 16 aa, Mycobacterium tuberculosis
GSVSAAAGIGWVGLNV

SEQ ID NO: 61065 - protein, 16 aa, Mycobacterium tuberculosis
SVSAAAGIGWVGLNVT

SEQ ID NO: 61066 - protein, 16 aa, Mycobacterium tuberculosis
VSAAAGIGWVGLNVTE

SEQ ID NO: 61067 - protein, 16 aa, Mycobacterium tuberculosis
SAAAGIGWVGLNVTET

SEQ ID NO: 61068 - protein, 16 aa, Mycobacterium tuberculosis
AAAGIGWVGLNVTETN

SEQ ID NO: 61069 - protein, 16 aa, Mycobacterium tuberculosis
AAGIGWVGLNVTETNR

SEQ ID NO: 61070 - protein, 16 aa, Mycobacterium tuberculosis
AGIGWVGLNVTETNRD

SEQ ID NO: 61071 - protein, 16 aa, Mycobacterium tuberculosis
GIGWVGLNVTETNRDQ

SEQ ID NO: 61072 - protein, 16 aa, Mycobacterium tuberculosis
IGWVGLNVTETNRDQC

SEQ ID NO: 61073 - protein, 16 aa, Mycobacterium tuberculosis
GWVGLNVTETNRDQCY

SEQ ID NO: 61074 - protein, 16 aa, Mycobacterium tuberculosis
WVGLNVTETNRDQCYR

SEQ ID NO: 61075 - protein, 16 aa, Mycobacterium tuberculosis
VGLNVTETNRDQCYRV

SEQ ID NO: 61076 - protein, 16 aa, Mycobacterium tuberculosis
GLNVTETNRDQCYRVE

SEQ ID NO: 61077 - protein, 16 aa, Mycobacterium tuberculosis
LNVTETNRDQCYRVER

SEQ ID NO: 61078 - protein, 16 aa, Mycobacterium tuberculosis
NVTETNRDQCYRVERT

SEQ ID NO: 61079 - protein, 16 aa, Mycobacterium tuberculosis
VTETNRDQCYRVERTT

SEQ ID NO: 61080 - protein, 16 aa, Mycobacterium tuberculosis
TETNRDQCYRVERTTV

SEQ ID NO: 61081 - protein, 16 aa, Mycobacterium tuberculosis
ETNRDQCYRVERTTVD

SEQ ID NO: 61082 - protein, 16 aa, Mycobacterium tuberculosis
TNRDQCYRVERTTVDA

SEQ ID NO: 61083 - protein, 16 aa, Mycobacterium tuberculosis
NRDQCYRVERTTVDAL

SEQ ID NO: 61084 - protein, 16 aa, Mycobacterium tuberculosis
RDQCYRVERTTVDALT

SEQ ID NO: 61085 - protein, 16 aa, Mycobacterium tuberculosis
DQCYRVERTTVDALTH

SEQ ID NO: 61086 - protein, 16 aa, Mycobacterium tuberculosis
QCYRVERTTVDALTHP

SEQ ID NO: 61087 - protein, 16 aa, Mycobacterium tuberculosis
CYRVERTTVDALTHPE

SEQ ID NO: 61088 - protein, 16 aa, Mycobacterium tuberculosis
YRVERTTVDALTHPEY

SEQ ID NO: 61089 - protein, 16 aa, Mycobacterium tuberculosis
RVERTTVDALTHPEYR

SEQ ID NO: 61090 - protein, 16 aa, Mycobacterium tuberculosis
VERTTVDALTHPEYRV

SEQ ID NO: 61091 - protein, 16 aa, Mycobacterium tuberculosis
ERTTVDALTHPEYRVH

SEQ ID NO: 61092 - protein, 16 aa, Mycobacterium tuberculosis
RTTVDALTHPEYRVHT

SEQ ID NO: 61093 - protein, 16 aa, Mycobacterium tuberculosis
TTVDALTHPEYRVHTR

SEQ ID NO: 61094 - protein, 16 aa, Mycobacterium tuberculosis
TVDALTHPEYRVHTRG

SEQ ID NO: 61095 - protein, 16 aa, Mycobacterium tuberculosis
VDALTHPEYRVHTRGV

SEQ ID NO: 61096 - protein, 16 aa, Mycobacterium tuberculosis
DALTHPEYRVHTRGVQ

SEQ ID NO: 61097 - protein, 16 aa, Mycobacterium tuberculosis
ALTHPEYRVHTRGVQR

SEQ ID NO: 61098 - protein, 16 aa, Mycobacterium tuberculosis
LTHPEYRVHTRGVQRV

SEQ ID NO: 61099 - protein, 16 aa, Mycobacterium tuberculosis
THPEYRVHTRGVQRVR

SEQ ID NO: 61100 - protein, 16 aa, Mycobacterium tuberculosis
HPEYRVHTRGVQRVRV

SEQ ID NO: 61101 - protein, 16 aa, Mycobacterium tuberculosis
PEYRVHTRGVQRVRVT

SEQ ID NO: 61102 - protein, 16 aa, Mycobacterium tuberculosis
EYRVHTRGVQRVRVTR

SEQ ID NO: 61103 - protein, 16 aa, Mycobacterium tuberculosis
YRVHTRGVQRVRVTRN

SEQ ID NO: 61104 - protein, 16 aa, Mycobacterium tuberculosis
RVHTRGVQRVRVTRNA

SEQ ID NO: 61105 - protein, 16 aa, Mycobacterium tuberculosis
VHTRGVQRVRVTRNAR

SEQ ID NO: 61106 - protein, 16 aa, Mycobacterium tuberculosis
HTRGVQRVRVTRNARK

SEQ ID NO: 61107 - protein, 16 aa, Mycobacterium tuberculosis
TRGVQRVRVTRNARKH

SEQ ID NO: 61108 - protein, 16 aa, Mycobacterium tuberculosis
RGVQRVRVTRNARKHR

SEQ ID NO: 61109 - protein, 16 aa, Mycobacterium tuberculosis
GVQRVRVTRNARKHRV

SEQ ID NO: 61110 - protein, 16 aa, Mycobacterium tuberculosis
VQRVRVTRNARKHRVS

SEQ ID NO: 61111 - protein, 16 aa, Mycobacterium tuberculosis
QRVRVTRNARKHRVSK

SEQ ID NO: 61112 - protein, 16 aa, Mycobacterium tuberculosis
RVRVTRNARKHRVSKH

SEQ ID NO: 61113 - protein, 16 aa, Mycobacterium tuberculosis
VRVTRNARKHRVSKHR

SEQ ID NO: 61114 - protein, 16 aa, Mycobacterium tuberculosis
RVTRNARKHRVSKHRI

SEQ ID NO: 61115 - protein, 16 aa, Mycobacterium tuberculosis
VTRNARKHRVSKHRIV

SEQ ID NO: 61116 - protein, 16 aa, Mycobacterium tuberculosis
TRNARKHRVSKHRIVA

SEQ ID NO: 61117 - protein, 16 aa, Mycobacterium tuberculosis
RNARKHRVSKHRIVAA

SEQ ID NO: 61118 - protein, 16 aa, Mycobacterium tuberculosis
NARKHRVSKHRIVAAM

SEQ ID NO: 61119 - protein, 16 aa, Mycobacterium tuberculosis
ARKHRVSKHRIVAAMR

SEQ ID NO: 61120 - protein, 16 aa, Mycobacterium tuberculosis
RKHRVSKHRIVAAMRH

SEQ ID NO: 61121 - protein, 16 aa, Mycobacterium tuberculosis
KHRVSKHRIVAAMRHC

SEQ ID NO: 61122 - protein, 16 aa, Mycobacterium tuberculosis
HRVSKHRIVAAMRHCG

SEQ ID NO: 61123 - protein, 16 aa, Mycobacterium tuberculosis
RVSKHRIVAAMRHCGV

SEQ ID NO: 61124 - protein, 16 aa, Mycobacterium tuberculosis
VSKHRIVAAMRHCGVP

SEQ ID NO: 61125 - protein, 16 aa, Mycobacterium tuberculosis
SKHRIVAAMRHCGVPV

SEQ ID NO: 61126 - protein, 16 aa, Mycobacterium tuberculosis
KHRIVAAMRHCGVPVI

SEQ ID NO: 61127 - protein, 16 aa, Mycobacterium tuberculosis
HRIVAAMRHCGVPVIQ

SEQ ID NO: 61128 - protein, 16 aa, Mycobacterium tuberculosis
RIVAAMRHCGVPVIQE

SEQ ID NO: 61129 - protein, 16 aa, Mycobacterium tuberculosis
IVAAMRHCGVPVIQED

SEQ ID NO: 61130 - protein, 16 aa, Mycobacterium tuberculosis
VAAMRHCGVPVIQEDG

SEQ ID NO: 61131 - protein, 16 aa, Mycobacterium tuberculosis
AAMRHCGVPVIQEDGS

SEQ ID NO: 61132 - protein, 16 aa, Mycobacterium tuberculosis
AMRHCGVPVIQEDGSL

SEQ ID NO: 61133 - protein, 16 aa, Mycobacterium tuberculosis
MRHCGVPVIQEDGSLY

SEQ ID NO: 61134 - protein, 16 aa, Mycobacterium tuberculosis
RHCGVPVIQEDGSLYY

SEQ ID NO: 61135 - protein, 16 aa, Mycobacterium tuberculosis
HCGVPVIQEDGSLYYQ

SEQ ID NO: 61136 - protein, 16 aa, Mycobacterium tuberculosis
CGVPVIQEDGSLYYQG

SEQ ID NO: 61137 - protein, 16 aa, Mycobacterium tuberculosis
GVPVIQEDGSLYYQGR

SEQ ID NO: 61138 - protein, 16 aa, Mycobacterium tuberculosis
VPVIQEDGSLYYQGRD

SEQ ID NO: 61139 - protein, 16 aa, Mycobacterium tuberculosis
PVIQEDGSLYYQGRDT

SEQ ID NO: 61140 - protein, 16 aa, Mycobacterium tuberculosis
VIQEDGSLYYQGRDTS

SEQ ID NO: 61141 - protein, 16 aa, Mycobacterium tuberculosis
IQEDGSLYYQGRDTSG

SEQ ID NO: 61142 - protein, 16 aa, Mycobacterium tuberculosis
QEDGSLYYQGRDTSGR

SEQ ID NO: 61143 - protein, 16 aa, Mycobacterium tuberculosis
EDGSLYYQGRDTSGRL

SEQ ID NO: 61144 - protein, 16 aa, Mycobacterium tuberculosis
DGSLYYQGRDTSGRLT

SEQ ID NO: 61145 - protein, 16 aa, Mycobacterium tuberculosis
GSLYYQGRDTSGRLTE

SEQ ID NO: 61146 - protein, 16 aa, Mycobacterium tuberculosis
SLYYQGRDTSGRLTEV

SEQ ID NO: 61147 - protein, 16 aa, Mycobacterium tuberculosis
LYYQGRDTSGRLTEVV

SEQ ID NO: 61148 - protein, 16 aa, Mycobacterium tuberculosis
YYQGRDTSGRLTEVVA

SEQ ID NO: 61149 - protein, 16 aa, Mycobacterium tuberculosis
YQGRDTSGRLTEVVAV

SEQ ID NO: 61150 - protein, 16 aa, Mycobacterium tuberculosis
QGRDTSGRLTEVVAVE

SEQ ID NO: 61151 - protein, 16 aa, Mycobacterium tuberculosis
GRDTSGRLTEVVAVEA

SEQ ID NO: 61152 - protein, 16 aa, Mycobacterium tuberculosis
RDTSGRLTEVVAVEAD

SEQ ID NO: 61153 - protein, 16 aa, Mycobacterium tuberculosis
DTSGRLTEVVAVEADD

SEQ ID NO: 61154 - protein, 16 aa, Mycobacterium tuberculosis
TSGRLTEVVAVEADDG

SEQ ID NO: 61155 - protein, 16 aa, Mycobacterium tuberculosis
SGRLTEVVAVEADDGD

SEQ ID NO: 61156 - protein, 16 aa, Mycobacterium tuberculosis
GRLTEVVAVEADDGDL

SEQ ID NO: 61157 - protein, 16 aa, Mycobacterium tuberculosis
RLTEVVAVEADDGDLI

SEQ ID NO: 61158 - protein, 16 aa, Mycobacterium tuberculosis
LTEVVAVEADDGDLII

SEQ ID NO: 61159 - protein, 16 aa, Mycobacterium tuberculosis
TEVVAVEADDGDLIIT

SEQ ID NO: 61160 - protein, 16 aa, Mycobacterium tuberculosis
EVVAVEADDGDLIITH

SEQ ID NO: 61161 - protein, 16 aa, Mycobacterium tuberculosis
VVAVEADDGDLIITHA

SEQ ID NO: 61162 - protein, 16 aa, Mycobacterium tuberculosis
VAVEADDGDLIITHAM

SEQ ID NO: 61163 - protein, 16 aa, Mycobacterium tuberculosis
AVEADDGDLIITHAMP

SEQ ID NO: 61164 - protein, 16 aa, Mycobacterium tuberculosis
VEADDGDLIITHAMPK

SEQ ID NO: 61165 - protein, 16 aa, Mycobacterium tuberculosis
EADDGDLIITHAMPKE

SEQ ID NO: 61166 - protein, 16 aa, Mycobacterium tuberculosis
ADDGDLIITHAMPKEW

SEQ ID NO: 61167 - protein, 16 aa, Mycobacterium tuberculosis
DDGDLIITHAMPKEWK

SEQ ID NO: 61168 - protein, 16 aa, Mycobacterium tuberculosis
DGDLIITHAMPKEWKR

SEQ ID NO: 61169 - protein, 13 aa, Mycobacterium tuberculosis
MSTVHSSIDQHPD

SEQ ID NO: 61170 - protein, 13 aa, Mycobacterium tuberculosis
STVHSSIDQHPDL

SEQ ID NO: 61171 - protein, 13 aa, Mycobacterium tuberculosis
TVHSSIDQHPDLL

SEQ ID NO: 61172 - protein, 13 aa, Mycobacterium tuberculosis
VHSSIDQHPDLLA

SEQ ID NO: 61173 - protein, 13 aa, Mycobacterium tuberculosis
HSSIDQHPDLLAL

SEQ ID NO: 61174 - protein, 13 aa, Mycobacterium tuberculosis
SSIDQHPDLLALR

SEQ ID NO: 61175 - protein, 13 aa, Mycobacterium tuberculosis
SIDQHPDLLALRA

SEQ ID NO: 61176 - protein, 13 aa, Mycobacterium tuberculosis
IDQHPDLLALRAS

SEQ ID NO: 61177 - protein, 13 aa, Mycobacterium tuberculosis
DQHPDLLALRASF

SEQ ID NO: 61178 - protein, 13 aa, Mycobacterium tuberculosis
QHPDLLALRASFD

SEQ ID NO: 61179 - protein, 13 aa, Mycobacterium tuberculosis
HPDLLALRASFDR

SEQ ID NO: 61180 - protein, 13 aa, Mycobacterium tuberculosis
PDLLALRASFDRA

SEQ ID NO: 61181 - protein, 13 aa, Mycobacterium tuberculosis
DLLALRASFDRAA

SEQ ID NO: 61182 - protein, 13 aa, Mycobacterium tuberculosis
LLALRASFDRAAE

SEQ ID NO: 61183 - protein, 13 aa, Mycobacterium tuberculosis
LALRASFDRAAES

SEQ ID NO: 61184 - protein, 13 aa, Mycobacterium tuberculosis
ALRASFDRAAEST

SEQ ID NO: 61185 - protein, 13 aa, Mycobacterium tuberculosis
LRASFDRAAESTI

SEQ ID NO: 61186 - protein, 13 aa, Mycobacterium tuberculosis
RASFDRAAESTIA

SEQ ID NO: 61187 - protein, 13 aa, Mycobacterium tuberculosis
ASFDRAAESTIAH

SEQ ID NO: 61188 - protein, 13 aa, Mycobacterium tuberculosis
SFDRAAESTIAHF

SEQ ID NO: 61189 - protein, 13 aa, Mycobacterium tuberculosis
FDRAAESTIAHFT

SEQ ID NO: 61190 - protein, 13 aa, Mycobacterium tuberculosis
DRAAESTIAHFTF

SEQ ID NO: 61191 - protein, 13 aa, Mycobacterium tuberculosis
RAAESTIAHFTFG

SEQ ID NO: 61192 - protein, 13 aa, Mycobacterium tuberculosis
AAESTIAHFTFGL

SEQ ID NO: 61193 - protein, 13 aa, Mycobacterium tuberculosis
AESTIAHFTFGLA

SEQ ID NO: 61194 - protein, 13 aa, Mycobacterium tuberculosis
ESTIAHFTFGLAL

SEQ ID NO: 61195 - protein, 13 aa, Mycobacterium tuberculosis
STIAHFTFGLALL

SEQ ID NO: 61196 - protein, 13 aa, Mycobacterium tuberculosis
TIAHFTFGLALLA

SEQ ID NO: 61197 - protein, 13 aa, Mycobacterium tuberculosis
IAHFTFGLALLAG

SEQ ID NO: 61198 - protein, 13 aa, Mycobacterium tuberculosis
AHFTFGLALLAGL

SEQ ID NO: 61199 - protein, 13 aa, Mycobacterium tuberculosis
HFTFGLALLAGLY

SEQ ID NO: 61200 - protein, 13 aa, Mycobacterium tuberculosis
FTFGLALLAGLYV

SEQ ID NO: 61201 - protein, 13 aa, Mycobacterium tuberculosis
TFGLALLAGLYVA

SEQ ID NO: 61202 - protein, 13 aa, Mycobacterium tuberculosis
FGLALLAGLYVAA

SEQ ID NO: 61203 - protein, 13 aa, Mycobacterium tuberculosis
GLALLAGLYVAAS

SEQ ID NO: 61204 - protein, 13 aa, Mycobacterium tuberculosis
LALLAGLYVAASP

SEQ ID NO: 61205 - protein, 13 aa, Mycobacterium tuberculosis
ALLAGLYVAASPW

SEQ ID NO: 61206 - protein, 13 aa, Mycobacterium tuberculosis
LLAGLYVAASPWI

SEQ ID NO: 61207 - protein, 13 aa, Mycobacterium tuberculosis
LAGLYVAASPWIV

SEQ ID NO: 61208 - protein, 13 aa, Mycobacterium tuberculosis
AGLYVAASPWIVG

SEQ ID NO: 61209 - protein, 13 aa, Mycobacterium tuberculosis
GLYVAASPWIVGF

SEQ ID NO: 61210 - protein, 13 aa, Mycobacterium tuberculosis
LYVAASPWIVGFS

SEQ ID NO: 61211 - protein, 13 aa, Mycobacterium tuberculosis
YVAASPWIVGFSA

SEQ ID NO: 61212 - protein, 13 aa, Mycobacterium tuberculosis
VAASPWIVGFSAT

SEQ ID NO: 61213 - protein, 13 aa, Mycobacterium tuberculosis
AASPWIVGFSATR

SEQ ID NO: 61214 - protein, 13 aa, Mycobacterium tuberculosis
ASPWIVGFSATRG

SEQ ID NO: 61215 - protein, 13 aa, Mycobacterium tuberculosis
SPWIVGFSATRGL

SEQ ID NO: 61216 - protein, 13 aa, Mycobacterium tuberculosis
PWIVGFSATRGLP

SEQ ID NO: 61217 - protein, 13 aa, Mycobacterium tuberculosis
WIVGFSATRGLPT

SEQ ID NO: 61218 - protein, 13 aa, Mycobacterium tuberculosis
IVGFSATRGLPTC

SEQ ID NO: 61219 - protein, 13 aa, Mycobacterium tuberculosis
VGFSATRGLPTCD

SEQ ID NO: 61220 - protein, 13 aa, Mycobacterium tuberculosis
GFSATRGLPTCDL

SEQ ID NO: 61221 - protein, 13 aa, Mycobacterium tuberculosis
FSATRGLPTCDLI

SEQ ID NO: 61222 - protein, 13 aa, Mycobacterium tuberculosis
SATRGLPTCDLIV

SEQ ID NO: 61223 - protein, 13 aa, Mycobacterium tuberculosis
ATRGLPTCDLIVG

SEQ ID NO: 61224 - protein, 13 aa, Mycobacterium tuberculosis
TRGLPTCDLIVGI

SEQ ID NO: 61225 - protein, 13 aa, Mycobacterium tuberculosis
RGLPTCDLIVGIA

SEQ ID NO: 61226 - protein, 13 aa, Mycobacterium tuberculosis
GLPTCDLIVGIAV

SEQ ID NO: 61227 - protein, 13 aa, Mycobacterium tuberculosis
LPTCDLIVGIAVA

SEQ ID NO: 61228 - protein, 13 aa, Mycobacterium tuberculosis
PTCDLIVGIAVAY

SEQ ID NO: 61229 - protein, 13 aa, Mycobacterium tuberculosis
TCDLIVGIAVAYL

SEQ ID NO: 61230 - protein, 13 aa, Mycobacterium tuberculosis
CDLIVGIAVAYLA

SEQ ID NO: 61231 - protein, 13 aa, Mycobacterium tuberculosis
DLIVGIAVAYLAY

SEQ ID NO: 61232 - protein, 13 aa, Mycobacterium tuberculosis
LIVGIAVAYLAYG

SEQ ID NO: 61233 - protein, 13 aa, Mycobacterium tuberculosis
IVGIAVAYLAYGF

SEQ ID NO: 61234 - protein, 13 aa, Mycobacterium tuberculosis
VGIAVAYLAYGFA

SEQ ID NO: 61235 - protein, 13 aa, Mycobacterium tuberculosis
GIAVAYLAYGFAS

SEQ ID NO: 61236 - protein, 13 aa, Mycobacterium tuberculosis
IAVAYLAYGFASA

SEQ ID NO: 61237 - protein, 13 aa, Mycobacterium tuberculosis
AVAYLAYGFASAL

SEQ ID NO: 61238 - protein, 13 aa, Mycobacterium tuberculosis
VAYLAYGFASALD

SEQ ID NO: 61239 - protein, 13 aa, Mycobacterium tuberculosis
AYLAYGFASALDR

SEQ ID NO: 61240 - protein, 13 aa, Mycobacterium tuberculosis
YLAYGFASALDRT

SEQ ID NO: 61241 - protein, 13 aa, Mycobacterium tuberculosis
LAYGFASALDRTH

SEQ ID NO: 61242 - protein, 13 aa, Mycobacterium tuberculosis
AYGFASALDRTHG

SEQ ID NO: 61243 - protein, 13 aa, Mycobacterium tuberculosis
YGFASALDRTHGM

SEQ ID NO: 61244 - protein, 13 aa, Mycobacterium tuberculosis
GFASALDRTHGMT

SEQ ID NO: 61245 - protein, 13 aa, Mycobacterium tuberculosis
FASALDRTHGMTW

SEQ ID NO: 61246 - protein, 13 aa, Mycobacterium tuberculosis
ASALDRTHGMTWT

SEQ ID NO: 61247 - protein, 13 aa, Mycobacterium tuberculosis
SALDRTHGMTWTL

SEQ ID NO: 61248 - protein, 13 aa, Mycobacterium tuberculosis
ALDRTHGMTWTLP

SEQ ID NO: 61249 - protein, 13 aa, Mycobacterium tuberculosis
LDRTHGMTWTLPV

SEQ ID NO: 61250 - protein, 13 aa, Mycobacterium tuberculosis
DRTHGMTWTLPVL

SEQ ID NO: 61251 - protein, 13 aa, Mycobacterium tuberculosis
RTHGMTWTLPVLG

SEQ ID NO: 61252 - protein, 13 aa, Mycobacterium tuberculosis
THGMTWTLPVLGV

SEQ ID NO: 61253 - protein, 13 aa, Mycobacterium tuberculosis
HGMTWTLPVLGVW

SEQ ID NO: 61254 - protein, 13 aa, Mycobacterium tuberculosis
GMTWTLPVLGVWV

SEQ ID NO: 61255 - protein, 13 aa, Mycobacterium tuberculosis
MTWTLPVLGVWVI

SEQ ID NO: 61256 - protein, 13 aa, Mycobacterium tuberculosis
TWTLPVLGVWVIF

SEQ ID NO: 61257 - protein, 13 aa, Mycobacterium tuberculosis
WTLPVLGVWVIFS

SEQ ID NO: 61258 - protein, 13 aa, Mycobacterium tuberculosis
TLPVLGVWVIFSP

SEQ ID NO: 61259 - protein, 13 aa, Mycobacterium tuberculosis
LPVLGVWVIFSPW

SEQ ID NO: 61260 - protein, 13 aa, Mycobacterium tuberculosis
PVLGVWVIFSPWV

SEQ ID NO: 61261 - protein, 13 aa, Mycobacterium tuberculosis
VLGVWVIFSPWVL

SEQ ID NO: 61262 - protein, 13 aa, Mycobacterium tuberculosis
LGVWVIFSPWVLP

SEQ ID NO: 61263 - protein, 13 aa, Mycobacterium tuberculosis
GVWVIFSPWVLPG

SEQ ID NO: 61264 - protein, 13 aa, Mycobacterium tuberculosis
VWVIFSPWVLPGV

SEQ ID NO: 61265 - protein, 13 aa, Mycobacterium tuberculosis
WVIFSPWVLPGVA

SEQ ID NO: 61266 - protein, 13 aa, Mycobacterium tuberculosis
VIFSPWVLPGVAV

SEQ ID NO: 61267 - protein, 13 aa, Mycobacterium tuberculosis
IFSPWVLPGVAVT

SEQ ID NO: 61268 - protein, 13 aa, Mycobacterium tuberculosis
FSPWVLPGVAVTA

SEQ ID NO: 61269 - protein, 13 aa, Mycobacterium tuberculosis
SPWVLPGVAVTAG

SEQ ID NO: 61270 - protein, 13 aa, Mycobacterium tuberculosis
PWVLPGVAVTAGM

SEQ ID NO: 61271 - protein, 13 aa, Mycobacterium tuberculosis
WVLPGVAVTAGMM

SEQ ID NO: 61272 - protein, 13 aa, Mycobacterium tuberculosis
VLPGVAVTAGMMW

SEQ ID NO: 61273 - protein, 13 aa, Mycobacterium tuberculosis
LPGVAVTAGMMWS

SEQ ID NO: 61274 - protein, 13 aa, Mycobacterium tuberculosis
PGVAVTAGMMWSH

SEQ ID NO: 61275 - protein, 13 aa, Mycobacterium tuberculosis
GVAVTAGMMWSHI

SEQ ID NO: 61276 - protein, 13 aa, Mycobacterium tuberculosis
VAVTAGMMWSHII

SEQ ID NO: 61277 - protein, 13 aa, Mycobacterium tuberculosis
AVTAGMMWSHIIA

SEQ ID NO: 61278 - protein, 13 aa, Mycobacterium tuberculosis
VTAGMMWSHIIAG

SEQ ID NO: 61279 - protein, 13 aa, Mycobacterium tuberculosis
TAGMMWSHIIAGA

SEQ ID NO: 61280 - protein, 13 aa, Mycobacterium tuberculosis
AGMMWSHIIAGAV

SEQ ID NO: 61281 - protein, 13 aa, Mycobacterium tuberculosis
GMMWSHIIAGAVV

SEQ ID NO: 61282 - protein, 13 aa, Mycobacterium tuberculosis
MMWSHIIAGAVVA

SEQ ID NO: 61283 - protein, 13 aa, Mycobacterium tuberculosis
MWSHIIAGAVVAV

SEQ ID NO: 61284 - protein, 13 aa, Mycobacterium tuberculosis
WSHIIAGAVVAVL

SEQ ID NO: 61285 - protein, 13 aa, Mycobacterium tuberculosis
SHIIAGAVVAVLG

SEQ ID NO: 61286 - protein, 13 aa, Mycobacterium tuberculosis
HIIAGAVVAVLGF

SEQ ID NO: 61287 - protein, 13 aa, Mycobacterium tuberculosis
IIAGAVVAVLGFY

SEQ ID NO: 61288 - protein, 13 aa, Mycobacterium tuberculosis
IAGAVVAVLGFYF

SEQ ID NO: 61289 - protein, 13 aa, Mycobacterium tuberculosis
AGAVVAVLGFYFG

SEQ ID NO: 61290 - protein, 13 aa, Mycobacterium tuberculosis
GAVVAVLGFYFGM

SEQ ID NO: 61291 - protein, 13 aa, Mycobacterium tuberculosis
AVVAVLGFYFGMR

SEQ ID NO: 61292 - protein, 13 aa, Mycobacterium tuberculosis
VVAVLGFYFGMRT

SEQ ID NO: 61293 - protein, 13 aa, Mycobacterium tuberculosis
VAVLGFYFGMRTR

SEQ ID NO: 61294 - protein, 13 aa, Mycobacterium tuberculosis
AVLGFYFGMRTRA

SEQ ID NO: 61295 - protein, 13 aa, Mycobacterium tuberculosis
VLGFYFGMRTRAA

SEQ ID NO: 61296 - protein, 13 aa, Mycobacterium tuberculosis
LGFYFGMRTRAAA

SEQ ID NO: 61297 - protein, 13 aa, Mycobacterium tuberculosis
GFYFGMRTRAAAN

SEQ ID NO: 61298 - protein, 13 aa, Mycobacterium tuberculosis
FYFGMRTRAAANQ

SEQ ID NO: 61299 - protein, 13 aa, Mycobacterium tuberculosis
YFGMRTRAAANQG

SEQ ID NO: 61300 - protein, 14 aa, Mycobacterium tuberculosis
MSTVHSSIDQHPDL

SEQ ID NO: 61301 - protein, 14 aa, Mycobacterium tuberculosis
STVHSSIDQHPDLL

SEQ ID NO: 61302 - protein, 14 aa, Mycobacterium tuberculosis
TVHSSIDQHPDLLA

SEQ ID NO: 61303 - protein, 14 aa, Mycobacterium tuberculosis
VHSSIDQHPDLLAL

SEQ ID NO: 61304 - protein, 14 aa, Mycobacterium tuberculosis
HSSIDQHPDLLALR

SEQ ID NO: 61305 - protein, 14 aa, Mycobacterium tuberculosis
SSIDQHPDLLALRA

SEQ ID NO: 61306 - protein, 14 aa, Mycobacterium tuberculosis
SIDQHPDLLALRAS

SEQ ID NO: 61307 - protein, 14 aa, Mycobacterium tuberculosis
IDQHPDLLALRASF

SEQ ID NO: 61308 - protein, 14 aa, Mycobacterium tuberculosis
DQHPDLLALRASFD

SEQ ID NO: 61309 - protein, 14 aa, Mycobacterium tuberculosis
QHPDLLALRASFDR

SEQ ID NO: 61310 - protein, 14 aa, Mycobacterium tuberculosis
HPDLLALRASFDRA

SEQ ID NO: 61311 - protein, 14 aa, Mycobacterium tuberculosis
PDLLALRASFDRAA

SEQ ID NO: 61312 - protein, 14 aa, Mycobacterium tuberculosis
DLLALRASFDRAAE

SEQ ID NO: 61313 - protein, 14 aa, Mycobacterium tuberculosis
LLALRASFDRAAES

SEQ ID NO: 61314 - protein, 14 aa, Mycobacterium tuberculosis
LALRASFDRAAEST

SEQ ID NO: 61315 - protein, 14 aa, Mycobacterium tuberculosis
ALRASFDRAAESTI

SEQ ID NO: 61316 - protein, 14 aa, Mycobacterium tuberculosis
LRASFDRAAESTIA

SEQ ID NO: 61317 - protein, 14 aa, Mycobacterium tuberculosis
RASFDRAAESTIAH

SEQ ID NO: 61318 - protein, 14 aa, Mycobacterium tuberculosis
ASFDRAAESTIAHF

SEQ ID NO: 61319 - protein, 14 aa, Mycobacterium tuberculosis
SFDRAAESTIAHFT

SEQ ID NO: 61320 - protein, 14 aa, Mycobacterium tuberculosis
FDRAAESTIAHFTF

SEQ ID NO: 61321 - protein, 14 aa, Mycobacterium tuberculosis
DRAAESTIAHFTFG

SEQ ID NO: 61322 - protein, 14 aa, Mycobacterium tuberculosis
RAAESTIAHFTFGL

SEQ ID NO: 61323 - protein, 14 aa, Mycobacterium tuberculosis
AAESTIAHFTFGLA

SEQ ID NO: 61324 - protein, 14 aa, Mycobacterium tuberculosis
AESTIAHFTFGLAL

SEQ ID NO: 61325 - protein, 14 aa, Mycobacterium tuberculosis
ESTIAHFTFGLALL

SEQ ID NO: 61326 - protein, 14 aa, Mycobacterium tuberculosis
STIAHFTFGLALLA

SEQ ID NO: 61327 - protein, 14 aa, Mycobacterium tuberculosis
TIAHFTFGLALLAG

SEQ ID NO: 61328 - protein, 14 aa, Mycobacterium tuberculosis
IAHFTFGLALLAGL

SEQ ID NO: 61329 - protein, 14 aa, Mycobacterium tuberculosis
AHFTFGLALLAGLY

SEQ ID NO: 61330 - protein, 14 aa, Mycobacterium tuberculosis
HFTFGLALLAGLYV

SEQ ID NO: 61331 - protein, 14 aa, Mycobacterium tuberculosis
FTFGLALLAGLYVA

SEQ ID NO: 61332 - protein, 14 aa, Mycobacterium tuberculosis
TFGLALLAGLYVAA

SEQ ID NO: 61333 - protein, 14 aa, Mycobacterium tuberculosis
FGLALLAGLYVAAS

SEQ ID NO: 61334 - protein, 14 aa, Mycobacterium tuberculosis
GLALLAGLYVAASP

SEQ ID NO: 61335 - protein, 14 aa, Mycobacterium tuberculosis
LALLAGLYVAASPW

SEQ ID NO: 61336 - protein, 14 aa, Mycobacterium tuberculosis
ALLAGLYVAASPWI

SEQ ID NO: 61337 - protein, 14 aa, Mycobacterium tuberculosis
LLAGLYVAASPWIV

SEQ ID NO: 61338 - protein, 14 aa, Mycobacterium tuberculosis
LAGLYVAASPWIVG

SEQ ID NO: 61339 - protein, 14 aa, Mycobacterium tuberculosis
AGLYVAASPWIVGF

SEQ ID NO: 61340 - protein, 14 aa, Mycobacterium tuberculosis
GLYVAASPWIVGFS

SEQ ID NO: 61341 - protein, 14 aa, Mycobacterium tuberculosis
LYVAASPWIVGFSA

SEQ ID NO: 61342 - protein, 14 aa, Mycobacterium tuberculosis
YVAASPWIVGFSAT

SEQ ID NO: 61343 - protein, 14 aa, Mycobacterium tuberculosis
VAASPWIVGFSATR

SEQ ID NO: 61344 - protein, 14 aa, Mycobacterium tuberculosis
AASPWIVGFSATRG

SEQ ID NO: 61345 - protein, 14 aa, Mycobacterium tuberculosis
ASPWIVGFSATRGL

SEQ ID NO: 61346 - protein, 14 aa, Mycobacterium tuberculosis
SPWIVGFSATRGLP

SEQ ID NO: 61347 - protein, 14 aa, Mycobacterium tuberculosis
PWIVGFSATRGLPT

SEQ ID NO: 61348 - protein, 14 aa, Mycobacterium tuberculosis
WIVGFSATRGLPTC

SEQ ID NO: 61349 - protein, 14 aa, Mycobacterium tuberculosis
IVGFSATRGLPTCD

SEQ ID NO: 61350 - protein, 14 aa, Mycobacterium tuberculosis
VGFSATRGLPTCDL

SEQ ID NO: 61351 - protein, 14 aa, Mycobacterium tuberculosis
GFSATRGLPTCDLI

SEQ ID NO: 61352 - protein, 14 aa, Mycobacterium tuberculosis
FSATRGLPTCDLIV

SEQ ID NO: 61353 - protein, 14 aa, Mycobacterium tuberculosis
SATRGLPTCDLIVG

SEQ ID NO: 61354 - protein, 14 aa, Mycobacterium tuberculosis
ATRGLPTCDLIVGI

SEQ ID NO: 61355 - protein, 14 aa, Mycobacterium tuberculosis
TRGLPTCDLIVGIA

SEQ ID NO: 61356 - protein, 14 aa, Mycobacterium tuberculosis
RGLPTCDLIVGIAV

SEQ ID NO: 61357 - protein, 14 aa, Mycobacterium tuberculosis
GLPTCDLIVGIAVA

SEQ ID NO: 61358 - protein, 14 aa, Mycobacterium tuberculosis
LPTCDLIVGIAVAY

SEQ ID NO: 61359 - protein, 14 aa, Mycobacterium tuberculosis
PTCDLIVGIAVAYL

SEQ ID NO: 61360 - protein, 14 aa, Mycobacterium tuberculosis
TCDLIVGIAVAYLA

SEQ ID NO: 61361 - protein, 14 aa, Mycobacterium tuberculosis
CDLIVGIAVAYLAY

SEQ ID NO: 61362 - protein, 14 aa, Mycobacterium tuberculosis
DLIVGIAVAYLAYG

SEQ ID NO: 61363 - protein, 14 aa, Mycobacterium tuberculosis
LIVGIAVAYLAYGF

SEQ ID NO: 61364 - protein, 14 aa, Mycobacterium tuberculosis
IVGIAVAYLAYGFA

SEQ ID NO: 61365 - protein, 14 aa, Mycobacterium tuberculosis
VGIAVAYLAYGFAS

SEQ ID NO: 61366 - protein, 14 aa, Mycobacterium tuberculosis
GIAVAYLAYGFASA

SEQ ID NO: 61367 - protein, 14 aa, Mycobacterium tuberculosis
IAVAYLAYGFASAL

SEQ ID NO: 61368 - protein, 14 aa, Mycobacterium tuberculosis
AVAYLAYGFASALD

SEQ ID NO: 61369 - protein, 14 aa, Mycobacterium tuberculosis
VAYLAYGFASALDR

SEQ ID NO: 61370 - protein, 14 aa, Mycobacterium tuberculosis
AYLAYGFASALDRT

SEQ ID NO: 61371 - protein, 14 aa, Mycobacterium tuberculosis
YLAYGFASALDRTH

SEQ ID NO: 61372 - protein, 14 aa, Mycobacterium tuberculosis
LAYGFASALDRTHG

SEQ ID NO: 61373 - protein, 14 aa, Mycobacterium tuberculosis
AYGFASALDRTHGM

SEQ ID NO: 61374 - protein, 14 aa, Mycobacterium tuberculosis
YGFASALDRTHGMT

SEQ ID NO: 61375 - protein, 14 aa, Mycobacterium tuberculosis
GFASALDRTHGMTW

SEQ ID NO: 61376 - protein, 14 aa, Mycobacterium tuberculosis
FASALDRTHGMTWT

SEQ ID NO: 61377 - protein, 14 aa, Mycobacterium tuberculosis
ASALDRTHGMTWTL

SEQ ID NO: 61378 - protein, 14 aa, Mycobacterium tuberculosis
SALDRTHGMTWTLP

SEQ ID NO: 61379 - protein, 14 aa, Mycobacterium tuberculosis
ALDRTHGMTWTLPV

SEQ ID NO: 61380 - protein, 14 aa, Mycobacterium tuberculosis
LDRTHGMTWTLPVL

SEQ ID NO: 61381 - protein, 14 aa, Mycobacterium tuberculosis
DRTHGMTWTLPVLG

SEQ ID NO: 61382 - protein, 14 aa, Mycobacterium tuberculosis
RTHGMTWTLPVLGV

SEQ ID NO: 61383 - protein, 14 aa, Mycobacterium tuberculosis
THGMTWTLPVLGVW

SEQ ID NO: 61384 - protein, 14 aa, Mycobacterium tuberculosis
HGMTWTLPVLGVWV

SEQ ID NO: 61385 - protein, 14 aa, Mycobacterium tuberculosis
GMTWTLPVLGVWVI

SEQ ID NO: 61386 - protein, 14 aa, Mycobacterium tuberculosis
MTWTLPVLGVWVIF

SEQ ID NO: 61387 - protein, 14 aa, Mycobacterium tuberculosis
TWTLPVLGVWVIFS

SEQ ID NO: 61388 - protein, 14 aa, Mycobacterium tuberculosis
WTLPVLGVWVIFSP

SEQ ID NO: 61389 - protein, 14 aa, Mycobacterium tuberculosis
TLPVLGVWVIFSPW

SEQ ID NO: 61390 - protein, 14 aa, Mycobacterium tuberculosis
LPVLGVWVIFSPWV

SEQ ID NO: 61391 - protein, 14 aa, Mycobacterium tuberculosis
PVLGVWVIFSPWVL

SEQ ID NO: 61392 - protein, 14 aa, Mycobacterium tuberculosis
VLGVWVIFSPWVLP

SEQ ID NO: 61393 - protein, 14 aa, Mycobacterium tuberculosis
LGVWVIFSPWVLPG

SEQ ID NO: 61394 - protein, 14 aa, Mycobacterium tuberculosis
GVWVIFSPWVLPGV

SEQ ID NO: 61395 - protein, 14 aa, Mycobacterium tuberculosis
VWVIFSPWVLPGVA

SEQ ID NO: 61396 - protein, 14 aa, Mycobacterium tuberculosis
WVIFSPWVLPGVAV

SEQ ID NO: 61397 - protein, 14 aa, Mycobacterium tuberculosis
VIFSPWVLPGVAVT

SEQ ID NO: 61398 - protein, 14 aa, Mycobacterium tuberculosis
IFSPWVLPGVAVTA

SEQ ID NO: 61399 - protein, 14 aa, Mycobacterium tuberculosis
FSPWVLPGVAVTAG

SEQ ID NO: 61400 - protein, 14 aa, Mycobacterium tuberculosis
SPWVLPGVAVTAGM

SEQ ID NO: 61401 - protein, 14 aa, Mycobacterium tuberculosis
PWVLPGVAVTAGMM

SEQ ID NO: 61402 - protein, 14 aa, Mycobacterium tuberculosis
WVLPGVAVTAGMMW

SEQ ID NO: 61403 - protein, 14 aa, Mycobacterium tuberculosis
VLPGVAVTAGMMWS

SEQ ID NO: 61404 - protein, 14 aa, Mycobacterium tuberculosis
LPGVAVTAGMMWSH

SEQ ID NO: 61405 - protein, 14 aa, Mycobacterium tuberculosis
PGVAVTAGMMWSHI

SEQ ID NO: 61406 - protein, 14 aa, Mycobacterium tuberculosis
GVAVTAGMMWSHII

SEQ ID NO: 61407 - protein, 14 aa, Mycobacterium tuberculosis
VAVTAGMMWSHIIA

SEQ ID NO: 61408 - protein, 14 aa, Mycobacterium tuberculosis
AVTAGMMWSHIIAG

SEQ ID NO: 61409 - protein, 14 aa, Mycobacterium tuberculosis
VTAGMMWSHIIAGA

SEQ ID NO: 61410 - protein, 14 aa, Mycobacterium tuberculosis
TAGMMWSHIIAGAV

SEQ ID NO: 61411 - protein, 14 aa, Mycobacterium tuberculosis
AGMMWSHIIAGAVV

SEQ ID NO: 61412 - protein, 14 aa, Mycobacterium tuberculosis
GMMWSHIIAGAVVA

SEQ ID NO: 61413 - protein, 14 aa, Mycobacterium tuberculosis
MMWSHIIAGAVVAV

SEQ ID NO: 61414 - protein, 14 aa, Mycobacterium tuberculosis
MWSHIIAGAVVAVL

SEQ ID NO: 61415 - protein, 14 aa, Mycobacterium tuberculosis
WSHIIAGAVVAVLG

SEQ ID NO: 61416 - protein, 14 aa, Mycobacterium tuberculosis
SHIIAGAVVAVLGF

SEQ ID NO: 61417 - protein, 14 aa, Mycobacterium tuberculosis
HIIAGAVVAVLGFY

SEQ ID NO: 61418 - protein, 14 aa, Mycobacterium tuberculosis
IIAGAVVAVLGFYF

SEQ ID NO: 61419 - protein, 14 aa, Mycobacterium tuberculosis
IAGAVVAVLGFYFG

SEQ ID NO: 61420 - protein, 14 aa, Mycobacterium tuberculosis
AGAVVAVLGFYFGM

SEQ ID NO: 61421 - protein, 14 aa, Mycobacterium tuberculosis
GAVVAVLGFYFGMR

SEQ ID NO: 61422 - protein, 14 aa, Mycobacterium tuberculosis
AVVAVLGFYFGMRT

SEQ ID NO: 61423 - protein, 14 aa, Mycobacterium tuberculosis
VVAVLGFYFGMRTR

SEQ ID NO: 61424 - protein, 14 aa, Mycobacterium tuberculosis
VAVLGFYFGMRTRA

SEQ ID NO: 61425 - protein, 14 aa, Mycobacterium tuberculosis
AVLGFYFGMRTRAA

SEQ ID NO: 61426 - protein, 14 aa, Mycobacterium tuberculosis
VLGFYFGMRTRAAA

SEQ ID NO: 61427 - protein, 14 aa, Mycobacterium tuberculosis
LGFYFGMRTRAAAN

SEQ ID NO: 61428 - protein, 14 aa, Mycobacterium tuberculosis
GFYFGMRTRAAANQ

SEQ ID NO: 61429 - protein, 14 aa, Mycobacterium tuberculosis
FYFGMRTRAAANQG

SEQ ID NO: 61430 - protein, 15 aa, Mycobacterium tuberculosis
MSTVHSSIDQHPDLL

SEQ ID NO: 61431 - protein, 15 aa, Mycobacterium tuberculosis
STVHSSIDQHPDLLA

SEQ ID NO: 61432 - protein, 15 aa, Mycobacterium tuberculosis
TVHSSIDQHPDLLAL

SEQ ID NO: 61433 - protein, 15 aa, Mycobacterium tuberculosis
VHSSIDQHPDLLALR

SEQ ID NO: 61434 - protein, 15 aa, Mycobacterium tuberculosis
HSSIDQHPDLLALRA

SEQ ID NO: 61435 - protein, 15 aa, Mycobacterium tuberculosis
SSIDQHPDLLALRAS

SEQ ID NO: 61436 - protein, 15 aa, Mycobacterium tuberculosis
SIDQHPDLLALRASF

SEQ ID NO: 61437 - protein, 15 aa, Mycobacterium tuberculosis
IDQHPDLLALRASFD

SEQ ID NO: 61438 - protein, 15 aa, Mycobacterium tuberculosis
DQHPDLLALRASFDR

SEQ ID NO: 61439 - protein, 15 aa, Mycobacterium tuberculosis
QHPDLLALRASFDRA

SEQ ID NO: 61440 - protein, 15 aa, Mycobacterium tuberculosis
HPDLLALRASFDRAA

SEQ ID NO: 61441 - protein, 15 aa, Mycobacterium tuberculosis
PDLLALRASFDRAAE

SEQ ID NO: 61442 - protein, 15 aa, Mycobacterium tuberculosis
DLLALRASFDRAAES

SEQ ID NO: 61443 - protein, 15 aa, Mycobacterium tuberculosis
LLALRASFDRAAEST

SEQ ID NO: 61444 - protein, 15 aa, Mycobacterium tuberculosis
LALRASFDRAAESTI

SEQ ID NO: 61445 - protein, 15 aa, Mycobacterium tuberculosis
ALRASFDRAAESTIA

SEQ ID NO: 61446 - protein, 15 aa, Mycobacterium tuberculosis
LRASFDRAAESTIAH

SEQ ID NO: 61447 - protein, 15 aa, Mycobacterium tuberculosis
RASFDRAAESTIAHF

SEQ ID NO: 61448 - protein, 15 aa, Mycobacterium tuberculosis
ASFDRAAESTIAHFT

SEQ ID NO: 61449 - protein, 15 aa, Mycobacterium tuberculosis
SFDRAAESTIAHFTF

SEQ ID NO: 61450 - protein, 15 aa, Mycobacterium tuberculosis
FDRAAESTIAHFTFG

SEQ ID NO: 61451 - protein, 15 aa, Mycobacterium tuberculosis
DRAAESTIAHFTFGL

SEQ ID NO: 61452 - protein, 15 aa, Mycobacterium tuberculosis
RAAESTIAHFTFGLA

SEQ ID NO: 61453 - protein, 15 aa, Mycobacterium tuberculosis
AAESTIAHFTFGLAL

SEQ ID NO: 61454 - protein, 15 aa, Mycobacterium tuberculosis
AESTIAHFTFGLALL

SEQ ID NO: 61455 - protein, 15 aa, Mycobacterium tuberculosis
ESTIAHFTFGLALLA

SEQ ID NO: 61456 - protein, 15 aa, Mycobacterium tuberculosis
STIAHFTFGLALLAG

SEQ ID NO: 61457 - protein, 15 aa, Mycobacterium tuberculosis
TIAHFTFGLALLAGL

SEQ ID NO: 61458 - protein, 15 aa, Mycobacterium tuberculosis
IAHFTFGLALLAGLY

SEQ ID NO: 61459 - protein, 15 aa, Mycobacterium tuberculosis
AHFTFGLALLAGLYV

SEQ ID NO: 61460 - protein, 15 aa, Mycobacterium tuberculosis
HFTFGLALLAGLYVA

SEQ ID NO: 61461 - protein, 15 aa, Mycobacterium tuberculosis
FTFGLALLAGLYVAA

SEQ ID NO: 61462 - protein, 15 aa, Mycobacterium tuberculosis
TFGLALLAGLYVAAS

SEQ ID NO: 61463 - protein, 15 aa, Mycobacterium tuberculosis
FGLALLAGLYVAASP

SEQ ID NO: 61464 - protein, 15 aa, Mycobacterium tuberculosis
GLALLAGLYVAASPW

SEQ ID NO: 61465 - protein, 15 aa, Mycobacterium tuberculosis
LALLAGLYVAASPWI

SEQ ID NO: 61466 - protein, 15 aa, Mycobacterium tuberculosis
ALLAGLYVAASPWIV

SEQ ID NO: 61467 - protein, 15 aa, Mycobacterium tuberculosis
LLAGLYVAASPWIVG

SEQ ID NO: 61468 - protein, 15 aa, Mycobacterium tuberculosis
LAGLYVAASPWIVGF

SEQ ID NO: 61469 - protein, 15 aa, Mycobacterium tuberculosis
AGLYVAASPWIVGFS

SEQ ID NO: 61470 - protein, 15 aa, Mycobacterium tuberculosis
GLYVAASPWIVGFSA

SEQ ID NO: 61471 - protein, 15 aa, Mycobacterium tuberculosis
LYVAASPWIVGFSAT

SEQ ID NO: 61472 - protein, 15 aa, Mycobacterium tuberculosis
YVAASPWIVGFSATR

SEQ ID NO: 61473 - protein, 15 aa, Mycobacterium tuberculosis
VAASPWIVGFSATRG

SEQ ID NO: 61474 - protein, 15 aa, Mycobacterium tuberculosis
AASPWIVGFSATRGL

SEQ ID NO: 61475 - protein, 15 aa, Mycobacterium tuberculosis
ASPWIVGFSATRGLP

SEQ ID NO: 61476 - protein, 15 aa, Mycobacterium tuberculosis
SPWIVGFSATRGLPT

SEQ ID NO: 61477 - protein, 15 aa, Mycobacterium tuberculosis
PWIVGFSATRGLPTC

SEQ ID NO: 61478 - protein, 15 aa, Mycobacterium tuberculosis
WIVGFSATRGLPTCD

SEQ ID NO: 61479 - protein, 15 aa, Mycobacterium tuberculosis
IVGFSATRGLPTCDL

SEQ ID NO: 61480 - protein, 15 aa, Mycobacterium tuberculosis
VGFSATRGLPTCDLI

SEQ ID NO: 61481 - protein, 15 aa, Mycobacterium tuberculosis
GFSATRGLPTCDLIV

SEQ ID NO: 61482 - protein, 15 aa, Mycobacterium tuberculosis
FSATRGLPTCDLIVG

SEQ ID NO: 61483 - protein, 15 aa, Mycobacterium tuberculosis
SATRGLPTCDLIVGI

SEQ ID NO: 61484 - protein, 15 aa, Mycobacterium tuberculosis
ATRGLPTCDLIVGIA

SEQ ID NO: 61485 - protein, 15 aa, Mycobacterium tuberculosis
TRGLPTCDLIVGIAV

SEQ ID NO: 61486 - protein, 15 aa, Mycobacterium tuberculosis
RGLPTCDLIVGIAVA

SEQ ID NO: 61487 - protein, 15 aa, Mycobacterium tuberculosis
GLPTCDLIVGIAVAY

SEQ ID NO: 61488 - protein, 15 aa, Mycobacterium tuberculosis
LPTCDLIVGIAVAYL

SEQ ID NO: 61489 - protein, 15 aa, Mycobacterium tuberculosis
PTCDLIVGIAVAYLA

SEQ ID NO: 61490 - protein, 15 aa, Mycobacterium tuberculosis
TCDLIVGIAVAYLAY

SEQ ID NO: 61491 - protein, 15 aa, Mycobacterium tuberculosis
CDLIVGIAVAYLAYG

SEQ ID NO: 61492 - protein, 15 aa, Mycobacterium tuberculosis
DLIVGIAVAYLAYGF

SEQ ID NO: 61493 - protein, 15 aa, Mycobacterium tuberculosis
LIVGIAVAYLAYGFA

SEQ ID NO: 61494 - protein, 15 aa, Mycobacterium tuberculosis
IVGIAVAYLAYGFAS

SEQ ID NO: 61495 - protein, 15 aa, Mycobacterium tuberculosis
VGIAVAYLAYGFASA

SEQ ID NO: 61496 - protein, 15 aa, Mycobacterium tuberculosis
GIAVAYLAYGFASAL

SEQ ID NO: 61497 - protein, 15 aa, Mycobacterium tuberculosis
IAVAYLAYGFASALD

SEQ ID NO: 61498 - protein, 15 aa, Mycobacterium tuberculosis
AVAYLAYGFASALDR

SEQ ID NO: 61499 - protein, 15 aa, Mycobacterium tuberculosis
VAYLAYGFASALDRT

SEQ ID NO: 61500 - protein, 15 aa, Mycobacterium tuberculosis
AYLAYGFASALDRTH

SEQ ID NO: 61501 - protein, 15 aa, Mycobacterium tuberculosis
YLAYGFASALDRTHG

SEQ ID NO: 61502 - protein, 15 aa, Mycobacterium tuberculosis
LAYGFASALDRTHGM

SEQ ID NO: 61503 - protein, 15 aa, Mycobacterium tuberculosis
AYGFASALDRTHGMT

SEQ ID NO: 61504 - protein, 15 aa, Mycobacterium tuberculosis
YGFASALDRTHGMTW

SEQ ID NO: 61505 - protein, 15 aa, Mycobacterium tuberculosis
GFASALDRTHGMTWT

SEQ ID NO: 61506 - protein, 15 aa, Mycobacterium tuberculosis
FASALDRTHGMTWTL

SEQ ID NO: 61507 - protein, 15 aa, Mycobacterium tuberculosis
ASALDRTHGMTWTLP

SEQ ID NO: 61508 - protein, 15 aa, Mycobacterium tuberculosis
SALDRTHGMTWTLPV

SEQ ID NO: 61509 - protein, 15 aa, Mycobacterium tuberculosis
ALDRTHGMTWTLPVL

SEQ ID NO: 61510 - protein, 15 aa, Mycobacterium tuberculosis
LDRTHGMTWTLPVLG

SEQ ID NO: 61511 - protein, 15 aa, Mycobacterium tuberculosis
DRTHGMTWTLPVLGV

SEQ ID NO: 61512 - protein, 15 aa, Mycobacterium tuberculosis
RTHGMTWTLPVLGVW

SEQ ID NO: 61513 - protein, 15 aa, Mycobacterium tuberculosis
THGMTWTLPVLGVWV

SEQ ID NO: 61514 - protein, 15 aa, Mycobacterium tuberculosis
HGMTWTLPVLGVWVI

SEQ ID NO: 61515 - protein, 15 aa, Mycobacterium tuberculosis
GMTWTLPVLGVWVIF

SEQ ID NO: 61516 - protein, 15 aa, Mycobacterium tuberculosis
MTWTLPVLGVWVIFS

SEQ ID NO: 61517 - protein, 15 aa, Mycobacterium tuberculosis
TWTLPVLGVWVIFSP

SEQ ID NO: 61518 - protein, 15 aa, Mycobacterium tuberculosis
WTLPVLGVWVIFSPW

SEQ ID NO: 61519 - protein, 15 aa, Mycobacterium tuberculosis
TLPVLGVWVIFSPWV

SEQ ID NO: 61520 - protein, 15 aa, Mycobacterium tuberculosis
LPVLGVWVIFSPWVL

SEQ ID NO: 61521 - protein, 15 aa, Mycobacterium tuberculosis
PVLGVWVIFSPWVLP

SEQ ID NO: 61522 - protein, 15 aa, Mycobacterium tuberculosis
VLGVWVIFSPWVLPG

SEQ ID NO: 61523 - protein, 15 aa, Mycobacterium tuberculosis
LGVWVIFSPWVLPGV

SEQ ID NO: 61524 - protein, 15 aa, Mycobacterium tuberculosis
GVWVIFSPWVLPGVA

SEQ ID NO: 61525 - protein, 15 aa, Mycobacterium tuberculosis
VWVIFSPWVLPGVAV

SEQ ID NO: 61526 - protein, 15 aa, Mycobacterium tuberculosis
WVIFSPWVLPGVAVT

SEQ ID NO: 61527 - protein, 15 aa, Mycobacterium tuberculosis
VIFSPWVLPGVAVTA

SEQ ID NO: 61528 - protein, 15 aa, Mycobacterium tuberculosis
IFSPWVLPGVAVTAG

SEQ ID NO: 61529 - protein, 15 aa, Mycobacterium tuberculosis
FSPWVLPGVAVTAGM

SEQ ID NO: 61530 - protein, 15 aa, Mycobacterium tuberculosis
SPWVLPGVAVTAGMM

SEQ ID NO: 61531 - protein, 15 aa, Mycobacterium tuberculosis
PWVLPGVAVTAGMMW

SEQ ID NO: 61532 - protein, 15 aa, Mycobacterium tuberculosis
WVLPGVAVTAGMMWS

SEQ ID NO: 61533 - protein, 15 aa, Mycobacterium tuberculosis
VLPGVAVTAGMMWSH

SEQ ID NO: 61534 - protein, 15 aa, Mycobacterium tuberculosis
LPGVAVTAGMMWSHI

SEQ ID NO: 61535 - protein, 15 aa, Mycobacterium tuberculosis
PGVAVTAGMMWSHII

SEQ ID NO: 61536 - protein, 15 aa, Mycobacterium tuberculosis
GVAVTAGMMWSHIIA

SEQ ID NO: 61537 - protein, 15 aa, Mycobacterium tuberculosis
VAVTAGMMWSHIIAG

SEQ ID NO: 61538 - protein, 15 aa, Mycobacterium tuberculosis
AVTAGMMWSHIIAGA

SEQ ID NO: 61539 - protein, 15 aa, Mycobacterium tuberculosis
VTAGMMWSHIIAGAV

SEQ ID NO: 61540 - protein, 15 aa, Mycobacterium tuberculosis
TAGMMWSHIIAGAVV

SEQ ID NO: 61541 - protein, 15 aa, Mycobacterium tuberculosis
AGMMWSHIIAGAVVA

SEQ ID NO: 61542 - protein, 15 aa, Mycobacterium tuberculosis
GMMWSHIIAGAVVAV

SEQ ID NO: 61543 - protein, 15 aa, Mycobacterium tuberculosis
MMWSHIIAGAVVAVL

SEQ ID NO: 61544 - protein, 15 aa, Mycobacterium tuberculosis
MWSHIIAGAVVAVLG

SEQ ID NO: 61545 - protein, 15 aa, Mycobacterium tuberculosis
WSHIIAGAVVAVLGF

SEQ ID NO: 61546 - protein, 15 aa, Mycobacterium tuberculosis
SHIIAGAVVAVLGFY

SEQ ID NO: 61547 - protein, 15 aa, Mycobacterium tuberculosis
HIIAGAVVAVLGFYF

SEQ ID NO: 61548 - protein, 15 aa, Mycobacterium tuberculosis
IIAGAVVAVLGFYFG

SEQ ID NO: 61549 - protein, 15 aa, Mycobacterium tuberculosis
IAGAVVAVLGFYFGM

SEQ ID NO: 61550 - protein, 15 aa, Mycobacterium tuberculosis
AGAVVAVLGFYFGMR

SEQ ID NO: 61551 - protein, 15 aa, Mycobacterium tuberculosis
GAVVAVLGFYFGMRT

SEQ ID NO: 61552 - protein, 15 aa, Mycobacterium tuberculosis
AVVAVLGFYFGMRTR

SEQ ID NO: 61553 - protein, 15 aa, Mycobacterium tuberculosis
VVAVLGFYFGMRTRA

SEQ ID NO: 61554 - protein, 15 aa, Mycobacterium tuberculosis
VAVLGFYFGMRTRAA

SEQ ID NO: 61555 - protein, 15 aa, Mycobacterium tuberculosis
AVLGFYFGMRTRAAA

SEQ ID NO: 61556 - protein, 15 aa, Mycobacterium tuberculosis
VLGFYFGMRTRAAAN

SEQ ID NO: 61557 - protein, 15 aa, Mycobacterium tuberculosis
LGFYFGMRTRAAANQ

SEQ ID NO: 61558 - protein, 15 aa, Mycobacterium tuberculosis
GFYFGMRTRAAANQG

SEQ ID NO: 61559 - protein, 16 aa, Mycobacterium tuberculosis
MSTVHSSIDQHPDLLA

SEQ ID NO: 61560 - protein, 16 aa, Mycobacterium tuberculosis
STVHSSIDQHPDLLAL

SEQ ID NO: 61561 - protein, 16 aa, Mycobacterium tuberculosis
TVHSSIDQHPDLLALR

SEQ ID NO: 61562 - protein, 16 aa, Mycobacterium tuberculosis
VHSSIDQHPDLLALRA

SEQ ID NO: 61563 - protein, 16 aa, Mycobacterium tuberculosis
HSSIDQHPDLLALRAS

SEQ ID NO: 61564 - protein, 16 aa, Mycobacterium tuberculosis
SSIDQHPDLLALRASF

SEQ ID NO: 61565 - protein, 16 aa, Mycobacterium tuberculosis
SIDQHPDLLALRASFD

SEQ ID NO: 61566 - protein, 16 aa, Mycobacterium tuberculosis
IDQHPDLLALRASFDR

SEQ ID NO: 61567 - protein, 16 aa, Mycobacterium tuberculosis
DQHPDLLALRASFDRA

SEQ ID NO: 61568 - protein, 16 aa, Mycobacterium tuberculosis
QHPDLLALRASFDRAA

SEQ ID NO: 61569 - protein, 16 aa, Mycobacterium tuberculosis
HPDLLALRASFDRAAE

SEQ ID NO: 61570 - protein, 16 aa, Mycobacterium tuberculosis
PDLLALRASFDRAAES

SEQ ID NO: 61571 - protein, 16 aa, Mycobacterium tuberculosis
DLLALRASFDRAAEST

SEQ ID NO: 61572 - protein, 16 aa, Mycobacterium tuberculosis
LLALRASFDRAAESTI

SEQ ID NO: 61573 - protein, 16 aa, Mycobacterium tuberculosis
LALRASFDRAAESTIA

SEQ ID NO: 61574 - protein, 16 aa, Mycobacterium tuberculosis
ALRASFDRAAESTIAH

SEQ ID NO: 61575 - protein, 16 aa, Mycobacterium tuberculosis
LRASFDRAAESTIAHF

SEQ ID NO: 61576 - protein, 16 aa, Mycobacterium tuberculosis
RASFDRAAESTIAHFT

SEQ ID NO: 61577 - protein, 16 aa, Mycobacterium tuberculosis
ASFDRAAESTIAHFTF

SEQ ID NO: 61578 - protein, 16 aa, Mycobacterium tuberculosis
SFDRAAESTIAHFTFG

SEQ ID NO: 61579 - protein, 16 aa, Mycobacterium tuberculosis
FDRAAESTIAHFTFGL

SEQ ID NO: 61580 - protein, 16 aa, Mycobacterium tuberculosis
DRAAESTIAHFTFGLA

SEQ ID NO: 61581 - protein, 16 aa, Mycobacterium tuberculosis
RAAESTIAHFTFGLAL

SEQ ID NO: 61582 - protein, 16 aa, Mycobacterium tuberculosis
AAESTIAHFTFGLALL

SEQ ID NO: 61583 - protein, 16 aa, Mycobacterium tuberculosis
AESTIAHFTFGLALLA

SEQ ID NO: 61584 - protein, 16 aa, Mycobacterium tuberculosis
ESTIAHFTFGLALLAG

SEQ ID NO: 61585 - protein, 16 aa, Mycobacterium tuberculosis
STIAHFTFGLALLAGL

SEQ ID NO: 61586 - protein, 16 aa, Mycobacterium tuberculosis
TIAHFTFGLALLAGLY

SEQ ID NO: 61587 - protein, 16 aa, Mycobacterium tuberculosis
IAHFTFGLALLAGLYV

SEQ ID NO: 61588 - protein, 16 aa, Mycobacterium tuberculosis
AHFTFGLALLAGLYVA

SEQ ID NO: 61589 - protein, 16 aa, Mycobacterium tuberculosis
HFTFGLALLAGLYVAA

SEQ ID NO: 61590 - protein, 16 aa, Mycobacterium tuberculosis
FTFGLALLAGLYVAAS

SEQ ID NO: 61591 - protein, 16 aa, Mycobacterium tuberculosis
TFGLALLAGLYVAASP

SEQ ID NO: 61592 - protein, 16 aa, Mycobacterium tuberculosis
FGLALLAGLYVAASPW

SEQ ID NO: 61593 - protein, 16 aa, Mycobacterium tuberculosis
GLALLAGLYVAASPWI

SEQ ID NO: 61594 - protein, 16 aa, Mycobacterium tuberculosis
LALLAGLYVAASPWIV

SEQ ID NO: 61595 - protein, 16 aa, Mycobacterium tuberculosis
ALLAGLYVAASPWIVG

SEQ ID NO: 61596 - protein, 16 aa, Mycobacterium tuberculosis
LLAGLYVAASPWIVGF

SEQ ID NO: 61597 - protein, 16 aa, Mycobacterium tuberculosis
LAGLYVAASPWIVGFS

SEQ ID NO: 61598 - protein, 16 aa, Mycobacterium tuberculosis
AGLYVAASPWIVGFSA

SEQ ID NO: 61599 - protein, 16 aa, Mycobacterium tuberculosis
GLYVAASPWIVGFSAT

SEQ ID NO: 61600 - protein, 16 aa, Mycobacterium tuberculosis
LYVAASPWIVGFSATR

SEQ ID NO: 61601 - protein, 16 aa, Mycobacterium tuberculosis
YVAASPWIVGFSATRG

SEQ ID NO: 61602 - protein, 16 aa, Mycobacterium tuberculosis
VAASPWIVGFSATRGL

SEQ ID NO: 61603 - protein, 16 aa, Mycobacterium tuberculosis
AASPWIVGFSATRGLP

SEQ ID NO: 61604 - protein, 16 aa, Mycobacterium tuberculosis
ASPWIVGFSATRGLPT

SEQ ID NO: 61605 - protein, 16 aa, Mycobacterium tuberculosis
SPWIVGFSATRGLPTC

SEQ ID NO: 61606 - protein, 16 aa, Mycobacterium tuberculosis
PWIVGFSATRGLPTCD

SEQ ID NO: 61607 - protein, 16 aa, Mycobacterium tuberculosis
WIVGFSATRGLPTCDL

SEQ ID NO: 61608 - protein, 16 aa, Mycobacterium tuberculosis
IVGFSATRGLPTCDLI

SEQ ID NO: 61609 - protein, 16 aa, Mycobacterium tuberculosis
VGFSATRGLPTCDLIV

SEQ ID NO: 61610 - protein, 16 aa, Mycobacterium tuberculosis
GFSATRGLPTCDLIVG

SEQ ID NO: 61611 - protein, 16 aa, Mycobacterium tuberculosis
FSATRGLPTCDLIVGI

SEQ ID NO: 61612 - protein, 16 aa, Mycobacterium tuberculosis
SATRGLPTCDLIVGIA

SEQ ID NO: 61613 - protein, 16 aa, Mycobacterium tuberculosis
ATRGLPTCDLIVGIAV

SEQ ID NO: 61614 - protein, 16 aa, Mycobacterium tuberculosis
TRGLPTCDLIVGIAVA

SEQ ID NO: 61615 - protein, 16 aa, Mycobacterium tuberculosis
RGLPTCDLIVGIAVAY

SEQ ID NO: 61616 - protein, 16 aa, Mycobacterium tuberculosis
GLPTCDLIVGIAVAYL

SEQ ID NO: 61617 - protein, 16 aa, Mycobacterium tuberculosis
LPTCDLIVGIAVAYLA

SEQ ID NO: 61618 - protein, 16 aa, Mycobacterium tuberculosis
PTCDLIVGIAVAYLAY

SEQ ID NO: 61619 - protein, 16 aa, Mycobacterium tuberculosis
TCDLIVGIAVAYLAYG

SEQ ID NO: 61620 - protein, 16 aa, Mycobacterium tuberculosis
CDLIVGIAVAYLAYGF

SEQ ID NO: 61621 - protein, 16 aa, Mycobacterium tuberculosis
DLIVGIAVAYLAYGFA

SEQ ID NO: 61622 - protein, 16 aa, Mycobacterium tuberculosis
LIVGIAVAYLAYGFAS

SEQ ID NO: 61623 - protein, 16 aa, Mycobacterium tuberculosis
IVGIAVAYLAYGFASA

SEQ ID NO: 61624 - protein, 16 aa, Mycobacterium tuberculosis
VGIAVAYLAYGFASAL

SEQ ID NO: 61625 - protein, 16 aa, Mycobacterium tuberculosis
GIAVAYLAYGFASALD

SEQ ID NO: 61626 - protein, 16 aa, Mycobacterium tuberculosis
IAVAYLAYGFASALDR

SEQ ID NO: 61627 - protein, 16 aa, Mycobacterium tuberculosis
AVAYLAYGFASALDRT

SEQ ID NO: 61628 - protein, 16 aa, Mycobacterium tuberculosis
VAYLAYGFASALDRTH

SEQ ID NO: 61629 - protein, 16 aa, Mycobacterium tuberculosis
AYLAYGFASALDRTHG

SEQ ID NO: 61630 - protein, 16 aa, Mycobacterium tuberculosis
YLAYGFASALDRTHGM

SEQ ID NO: 61631 - protein, 16 aa, Mycobacterium tuberculosis
LAYGFASALDRTHGMT

SEQ ID NO: 61632 - protein, 16 aa, Mycobacterium tuberculosis
AYGFASALDRTHGMTW

SEQ ID NO: 61633 - protein, 16 aa, Mycobacterium tuberculosis
YGFASALDRTHGMTWT

SEQ ID NO: 61634 - protein, 16 aa, Mycobacterium tuberculosis
GFASALDRTHGMTWTL

SEQ ID NO: 61635 - protein, 16 aa, Mycobacterium tuberculosis
FASALDRTHGMTWTLP

SEQ ID NO: 61636 - protein, 16 aa, Mycobacterium tuberculosis
ASALDRTHGMTWTLPV

SEQ ID NO: 61637 - protein, 16 aa, Mycobacterium tuberculosis
SALDRTHGMTWTLPVL

SEQ ID NO: 61638 - protein, 16 aa, Mycobacterium tuberculosis
ALDRTHGMTWTLPVLG

SEQ ID NO: 61639 - protein, 16 aa, Mycobacterium tuberculosis
LDRTHGMTWTLPVLGV

SEQ ID NO: 61640 - protein, 16 aa, Mycobacterium tuberculosis
DRTHGMTWTLPVLGVW

SEQ ID NO: 61641 - protein, 16 aa, Mycobacterium tuberculosis
RTHGMTWTLPVLGVWV

SEQ ID NO: 61642 - protein, 16 aa, Mycobacterium tuberculosis
THGMTWTLPVLGVWVI

SEQ ID NO: 61643 - protein, 16 aa, Mycobacterium tuberculosis
HGMTWTLPVLGVWVIF

SEQ ID NO: 61644 - protein, 16 aa, Mycobacterium tuberculosis
GMTWTLPVLGVWVIFS

SEQ ID NO: 61645 - protein, 16 aa, Mycobacterium tuberculosis
MTWTLPVLGVWVIFSP

SEQ ID NO: 61646 - protein, 16 aa, Mycobacterium tuberculosis
TWTLPVLGVWVIFSPW

SEQ ID NO: 61647 - protein, 16 aa, Mycobacterium tuberculosis
WTLPVLGVWVIFSPWV

SEQ ID NO: 61648 - protein, 16 aa, Mycobacterium tuberculosis
TLPVLGVWVIFSPWVL

SEQ ID NO: 61649 - protein, 16 aa, Mycobacterium tuberculosis
LPVLGVWVIFSPWVLP

SEQ ID NO: 61650 - protein, 16 aa, Mycobacterium tuberculosis
PVLGVWVIFSPWVLPG

SEQ ID NO: 61651 - protein, 16 aa, Mycobacterium tuberculosis
VLGVWVIFSPWVLPGV

SEQ ID NO: 61652 - protein, 16 aa, Mycobacterium tuberculosis
LGVWVIFSPWVLPGVA

SEQ ID NO: 61653 - protein, 16 aa, Mycobacterium tuberculosis
GVWVIFSPWVLPGVAV

SEQ ID NO: 61654 - protein, 16 aa, Mycobacterium tuberculosis
VWVIFSPWVLPGVAVT

SEQ ID NO: 61655 - protein, 16 aa, Mycobacterium tuberculosis
WVIFSPWVLPGVAVTA

SEQ ID NO: 61656 - protein, 16 aa, Mycobacterium tuberculosis
VIFSPWVLPGVAVTAG

SEQ ID NO: 61657 - protein, 16 aa, Mycobacterium tuberculosis
IFSPWVLPGVAVTAGM

SEQ ID NO: 61658 - protein, 16 aa, Mycobacterium tuberculosis
FSPWVLPGVAVTAGMM

SEQ ID NO: 61659 - protein, 16 aa, Mycobacterium tuberculosis
SPWVLPGVAVTAGMMW

SEQ ID NO: 61660 - protein, 16 aa, Mycobacterium tuberculosis
PWVLPGVAVTAGMMWS

SEQ ID NO: 61661 - protein, 16 aa, Mycobacterium tuberculosis
WVLPGVAVTAGMMWSH

SEQ ID NO: 61662 - protein, 16 aa, Mycobacterium tuberculosis
VLPGVAVTAGMMWSHI

SEQ ID NO: 61663 - protein, 16 aa, Mycobacterium tuberculosis
LPGVAVTAGMMWSHII

SEQ ID NO: 61664 - protein, 16 aa, Mycobacterium tuberculosis
PGVAVTAGMMWSHIIA

SEQ ID NO: 61665 - protein, 16 aa, Mycobacterium tuberculosis
GVAVTAGMMWSHIIAG

SEQ ID NO: 61666 - protein, 16 aa, Mycobacterium tuberculosis
VAVTAGMMWSHIIAGA

SEQ ID NO: 61667 - protein, 16 aa, Mycobacterium tuberculosis
AVTAGMMWSHIIAGAV

SEQ ID NO: 61668 - protein, 16 aa, Mycobacterium tuberculosis
VTAGMMWSHIIAGAVV

SEQ ID NO: 61669 - protein, 16 aa, Mycobacterium tuberculosis
TAGMMWSHIIAGAVVA

SEQ ID NO: 61670 - protein, 16 aa, Mycobacterium tuberculosis
AGMMWSHIIAGAVVAV

SEQ ID NO: 61671 - protein, 16 aa, Mycobacterium tuberculosis
GMMWSHIIAGAVVAVL

SEQ ID NO: 61672 - protein, 16 aa, Mycobacterium tuberculosis
MMWSHIIAGAVVAVLG

SEQ ID NO: 61673 - protein, 16 aa, Mycobacterium tuberculosis
MWSHIIAGAVVAVLGF

SEQ ID NO: 61674 - protein, 16 aa, Mycobacterium tuberculosis
WSHIIAGAVVAVLGFY

SEQ ID NO: 61675 - protein, 16 aa, Mycobacterium tuberculosis
SHIIAGAVVAVLGFYF

SEQ ID NO: 61676 - protein, 16 aa, Mycobacterium tuberculosis
HIIAGAVVAVLGFYFG

SEQ ID NO: 61677 - protein, 16 aa, Mycobacterium tuberculosis
IIAGAVVAVLGFYFGM

SEQ ID NO: 61678 - protein, 16 aa, Mycobacterium tuberculosis
IAGAVVAVLGFYFGMR

SEQ ID NO: 61679 - protein, 16 aa, Mycobacterium tuberculosis
AGAVVAVLGFYFGMRT

SEQ ID NO: 61680 - protein, 16 aa, Mycobacterium tuberculosis
GAVVAVLGFYFGMRTR

SEQ ID NO: 61681 - protein, 16 aa, Mycobacterium tuberculosis
AVVAVLGFYFGMRTRA

SEQ ID NO: 61682 - protein, 16 aa, Mycobacterium tuberculosis
VVAVLGFYFGMRTRAA

SEQ ID NO: 61683 - protein, 16 aa, Mycobacterium tuberculosis
VAVLGFYFGMRTRAAA

SEQ ID NO: 61684 - protein, 16 aa, Mycobacterium tuberculosis
AVLGFYFGMRTRAAAN

SEQ ID NO: 61685 - protein, 16 aa, Mycobacterium tuberculosis
VLGFYFGMRTRAAANQ

SEQ ID NO: 61686 - protein, 16 aa, Mycobacterium tuberculosis
LGFYFGMRTRAAANQG

SEQ ID NO: 61687 - protein, 13 aa, Mycobacterium tuberculosis
MSRLIFEARRRLA

SEQ ID NO: 61688 - protein, 13 aa, Mycobacterium tuberculosis
SRLIFEARRRLAP

SEQ ID NO: 61689 - protein, 13 aa, Mycobacterium tuberculosis
RLIFEARRRLAPP

SEQ ID NO: 61690 - protein, 13 aa, Mycobacterium tuberculosis
LIFEARRRLAPPS

SEQ ID NO: 61691 - protein, 13 aa, Mycobacterium tuberculosis
IFEARRRLAPPSS

SEQ ID NO: 61692 - protein, 13 aa, Mycobacterium tuberculosis
FEARRRLAPPSSH

SEQ ID NO: 61693 - protein, 13 aa, Mycobacterium tuberculosis
EARRRLAPPSSHQ

SEQ ID NO: 61694 - protein, 13 aa, Mycobacterium tuberculosis
ARRRLAPPSSHQG

SEQ ID NO: 61695 - protein, 13 aa, Mycobacterium tuberculosis
RRRLAPPSSHQGT

SEQ ID NO: 61696 - protein, 13 aa, Mycobacterium tuberculosis
RRLAPPSSHQGTI

SEQ ID NO: 61697 - protein, 13 aa, Mycobacterium tuberculosis
RLAPPSSHQGTII

SEQ ID NO: 61698 - protein, 13 aa, Mycobacterium tuberculosis
LAPPSSHQGTIII

SEQ ID NO: 61699 - protein, 13 aa, Mycobacterium tuberculosis
APPSSHQGTIIIE

SEQ ID NO: 61700 - protein, 13 aa, Mycobacterium tuberculosis
PPSSHQGTIIIEA

SEQ ID NO: 61701 - protein, 13 aa, Mycobacterium tuberculosis
PSSHQGTIIIEAP

SEQ ID NO: 61702 - protein, 13 aa, Mycobacterium tuberculosis
SSHQGTIIIEAPP

SEQ ID NO: 61703 - protein, 13 aa, Mycobacterium tuberculosis
SHQGTIIIEAPPE

SEQ ID NO: 61704 - protein, 13 aa, Mycobacterium tuberculosis
HQGTIIIEAPPEL

SEQ ID NO: 61705 - protein, 13 aa, Mycobacterium tuberculosis
QGTIIIEAPPELP

SEQ ID NO: 61706 - protein, 13 aa, Mycobacterium tuberculosis
GTIIIEAPPELPR

SEQ ID NO: 61707 - protein, 13 aa, Mycobacterium tuberculosis
TIIIEAPPELPRV

SEQ ID NO: 61708 - protein, 13 aa, Mycobacterium tuberculosis
IIIEAPPELPRVI

SEQ ID NO: 61709 - protein, 13 aa, Mycobacterium tuberculosis
IIEAPPELPRVIP

SEQ ID NO: 61710 - protein, 13 aa, Mycobacterium tuberculosis
IEAPPELPRVIPP

SEQ ID NO: 61711 - protein, 13 aa, Mycobacterium tuberculosis
EAPPELPRVIPPS

SEQ ID NO: 61712 - protein, 13 aa, Mycobacterium tuberculosis
APPELPRVIPPSL

SEQ ID NO: 61713 - protein, 13 aa, Mycobacterium tuberculosis
PPELPRVIPPSLL

SEQ ID NO: 61714 - protein, 13 aa, Mycobacterium tuberculosis
PELPRVIPPSLLR

SEQ ID NO: 61715 - protein, 13 aa, Mycobacterium tuberculosis
ELPRVIPPSLLRR

SEQ ID NO: 61716 - protein, 13 aa, Mycobacterium tuberculosis
LPRVIPPSLLRRA

SEQ ID NO: 61717 - protein, 13 aa, Mycobacterium tuberculosis
PRVIPPSLLRRAL

SEQ ID NO: 61718 - protein, 13 aa, Mycobacterium tuberculosis
RVIPPSLLRRALP

SEQ ID NO: 61719 - protein, 13 aa, Mycobacterium tuberculosis
VIPPSLLRRALPY

SEQ ID NO: 61720 - protein, 13 aa, Mycobacterium tuberculosis
IPPSLLRRALPYL

SEQ ID NO: 61721 - protein, 13 aa, Mycobacterium tuberculosis
PPSLLRRALPYLI

SEQ ID NO: 61722 - protein, 13 aa, Mycobacterium tuberculosis
PSLLRRALPYLIG

SEQ ID NO: 61723 - protein, 13 aa, Mycobacterium tuberculosis
SLLRRALPYLIGI

SEQ ID NO: 61724 - protein, 13 aa, Mycobacterium tuberculosis
LLRRALPYLIGIL

SEQ ID NO: 61725 - protein, 13 aa, Mycobacterium tuberculosis
LRRALPYLIGILI

SEQ ID NO: 61726 - protein, 13 aa, Mycobacterium tuberculosis
RRALPYLIGILIV

SEQ ID NO: 61727 - protein, 13 aa, Mycobacterium tuberculosis
RALPYLIGILIVG

SEQ ID NO: 61728 - protein, 13 aa, Mycobacterium tuberculosis
ALPYLIGILIVGM

SEQ ID NO: 61729 - protein, 13 aa, Mycobacterium tuberculosis
LPYLIGILIVGMI

SEQ ID NO: 61730 - protein, 13 aa, Mycobacterium tuberculosis
PYLIGILIVGMIV

SEQ ID NO: 61731 - protein, 13 aa, Mycobacterium tuberculosis
YLIGILIVGMIVA

SEQ ID NO: 61732 - protein, 13 aa, Mycobacterium tuberculosis
LIGILIVGMIVAL

SEQ ID NO: 61733 - protein, 13 aa, Mycobacterium tuberculosis
IGILIVGMIVALV

SEQ ID NO: 61734 - protein, 13 aa, Mycobacterium tuberculosis
GILIVGMIVALVA

SEQ ID NO: 61735 - protein, 13 aa, Mycobacterium tuberculosis
ILIVGMIVALVAT

SEQ ID NO: 61736 - protein, 13 aa, Mycobacterium tuberculosis
LIVGMIVALVATG

SEQ ID NO: 61737 - protein, 13 aa, Mycobacterium tuberculosis
IVGMIVALVATGM

SEQ ID NO: 61738 - protein, 13 aa, Mycobacterium tuberculosis
VGMIVALVATGMR

SEQ ID NO: 61739 - protein, 13 aa, Mycobacterium tuberculosis
GMIVALVATGMRV

SEQ ID NO: 61740 - protein, 13 aa, Mycobacterium tuberculosis
MIVALVATGMRVI

SEQ ID NO: 61741 - protein, 13 aa, Mycobacterium tuberculosis
IVALVATGMRVIS

SEQ ID NO: 61742 - protein, 13 aa, Mycobacterium tuberculosis
VALVATGMRVISP

SEQ ID NO: 61743 - protein, 13 aa, Mycobacterium tuberculosis
ALVATGMRVISPQ

SEQ ID NO: 61744 - protein, 13 aa, Mycobacterium tuberculosis
LVATGMRVISPQT

SEQ ID NO: 61745 - protein, 13 aa, Mycobacterium tuberculosis
VATGMRVISPQTL

SEQ ID NO: 61746 - protein, 13 aa, Mycobacterium tuberculosis
ATGMRVISPQTLF

SEQ ID NO: 61747 - protein, 13 aa, Mycobacterium tuberculosis
TGMRVISPQTLFF

SEQ ID NO: 61748 - protein, 13 aa, Mycobacterium tuberculosis
GMRVISPQTLFFP

SEQ ID NO: 61749 - protein, 13 aa, Mycobacterium tuberculosis
MRVISPQTLFFPF

SEQ ID NO: 61750 - protein, 13 aa, Mycobacterium tuberculosis
RVISPQTLFFPFV

SEQ ID NO: 61751 - protein, 13 aa, Mycobacterium tuberculosis
VISPQTLFFPFVL

SEQ ID NO: 61752 - protein, 13 aa, Mycobacterium tuberculosis
ISPQTLFFPFVLL

SEQ ID NO: 61753 - protein, 13 aa, Mycobacterium tuberculosis
SPQTLFFPFVLLL

SEQ ID NO: 61754 - protein, 13 aa, Mycobacterium tuberculosis
PQTLFFPFVLLLA

SEQ ID NO: 61755 - protein, 13 aa, Mycobacterium tuberculosis
QTLFFPFVLLLAA

SEQ ID NO: 61756 - protein, 13 aa, Mycobacterium tuberculosis
TLFFPFVLLLAAT

SEQ ID NO: 61757 - protein, 13 aa, Mycobacterium tuberculosis
LFFPFVLLLAATA

SEQ ID NO: 61758 - protein, 13 aa, Mycobacterium tuberculosis
FFPFVLLLAATAL

SEQ ID NO: 61759 - protein, 13 aa, Mycobacterium tuberculosis
FPFVLLLAATALY

SEQ ID NO: 61760 - protein, 13 aa, Mycobacterium tuberculosis
PFVLLLAATALYR

SEQ ID NO: 61761 - protein, 13 aa, Mycobacterium tuberculosis
FVLLLAATALYRG

SEQ ID NO: 61762 - protein, 13 aa, Mycobacterium tuberculosis
VLLLAATALYRGN

SEQ ID NO: 61763 - protein, 13 aa, Mycobacterium tuberculosis
LLLAATALYRGND

SEQ ID NO: 61764 - protein, 13 aa, Mycobacterium tuberculosis
LLAATALYRGNDK

SEQ ID NO: 61765 - protein, 13 aa, Mycobacterium tuberculosis
LAATALYRGNDKK

SEQ ID NO: 61766 - protein, 13 aa, Mycobacterium tuberculosis
AATALYRGNDKKM

SEQ ID NO: 61767 - protein, 13 aa, Mycobacterium tuberculosis
ATALYRGNDKKMR

SEQ ID NO: 61768 - protein, 13 aa, Mycobacterium tuberculosis
TALYRGNDKKMRT

SEQ ID NO: 61769 - protein, 13 aa, Mycobacterium tuberculosis
ALYRGNDKKMRTE

SEQ ID NO: 61770 - protein, 13 aa, Mycobacterium tuberculosis
LYRGNDKKMRTEE

SEQ ID NO: 61771 - protein, 13 aa, Mycobacterium tuberculosis
YRGNDKKMRTEEV

SEQ ID NO: 61772 - protein, 13 aa, Mycobacterium tuberculosis
RGNDKKMRTEEVD

SEQ ID NO: 61773 - protein, 13 aa, Mycobacterium tuberculosis
GNDKKMRTEEVDA

SEQ ID NO: 61774 - protein, 13 aa, Mycobacterium tuberculosis
NDKKMRTEEVDAE

SEQ ID NO: 61775 - protein, 13 aa, Mycobacterium tuberculosis
DKKMRTEEVDAER

SEQ ID NO: 61776 - protein, 13 aa, Mycobacterium tuberculosis
KKMRTEEVDAERA

SEQ ID NO: 61777 - protein, 13 aa, Mycobacterium tuberculosis
KMRTEEVDAERAD

SEQ ID NO: 61778 - protein, 13 aa, Mycobacterium tuberculosis
MRTEEVDAERADY

SEQ ID NO: 61779 - protein, 13 aa, Mycobacterium tuberculosis
RTEEVDAERADYL

SEQ ID NO: 61780 - protein, 13 aa, Mycobacterium tuberculosis
TEEVDAERADYLR

SEQ ID NO: 61781 - protein, 13 aa, Mycobacterium tuberculosis
EEVDAERADYLRY

SEQ ID NO: 61782 - protein, 13 aa, Mycobacterium tuberculosis
EVDAERADYLRYL

SEQ ID NO: 61783 - protein, 13 aa, Mycobacterium tuberculosis
VDAERADYLRYLS

SEQ ID NO: 61784 - protein, 13 aa, Mycobacterium tuberculosis
DAERADYLRYLSV

SEQ ID NO: 61785 - protein, 13 aa, Mycobacterium tuberculosis
AERADYLRYLSVV

SEQ ID NO: 61786 - protein, 13 aa, Mycobacterium tuberculosis
ERADYLRYLSVVR

SEQ ID NO: 61787 - protein, 13 aa, Mycobacterium tuberculosis
RADYLRYLSVVRD

SEQ ID NO: 61788 - protein, 13 aa, Mycobacterium tuberculosis
ADYLRYLSVVRDN

SEQ ID NO: 61789 - protein, 13 aa, Mycobacterium tuberculosis
DYLRYLSVVRDNI

SEQ ID NO: 61790 - protein, 13 aa, Mycobacterium tuberculosis
YLRYLSVVRDNIR

SEQ ID NO: 61791 - protein, 13 aa, Mycobacterium tuberculosis
LRYLSVVRDNIRA

SEQ ID NO: 61792 - protein, 13 aa, Mycobacterium tuberculosis
RYLSVVRDNIRAQ

SEQ ID NO: 61793 - protein, 13 aa, Mycobacterium tuberculosis
YLSVVRDNIRAQA

SEQ ID NO: 61794 - protein, 13 aa, Mycobacterium tuberculosis
LSVVRDNIRAQAA

SEQ ID NO: 61795 - protein, 13 aa, Mycobacterium tuberculosis
SVVRDNIRAQAAE

SEQ ID NO: 61796 - protein, 13 aa, Mycobacterium tuberculosis
VVRDNIRAQAAEQ

SEQ ID NO: 61797 - protein, 13 aa, Mycobacterium tuberculosis
VRDNIRAQAAEQR

SEQ ID NO: 61798 - protein, 13 aa, Mycobacterium tuberculosis
RDNIRAQAAEQRA

SEQ ID NO: 61799 - protein, 13 aa, Mycobacterium tuberculosis
DNIRAQAAEQRAS

SEQ ID NO: 61800 - protein, 13 aa, Mycobacterium tuberculosis
NIRAQAAEQRASA

SEQ ID NO: 61801 - protein, 13 aa, Mycobacterium tuberculosis
IRAQAAEQRASAL

SEQ ID NO: 61802 - protein, 13 aa, Mycobacterium tuberculosis
RAQAAEQRASALW

SEQ ID NO: 61803 - protein, 13 aa, Mycobacterium tuberculosis
AQAAEQRASALWS

SEQ ID NO: 61804 - protein, 13 aa, Mycobacterium tuberculosis
QAAEQRASALWSH

SEQ ID NO: 61805 - protein, 13 aa, Mycobacterium tuberculosis
AAEQRASALWSHP

SEQ ID NO: 61806 - protein, 13 aa, Mycobacterium tuberculosis
AEQRASALWSHPD

SEQ ID NO: 61807 - protein, 13 aa, Mycobacterium tuberculosis
EQRASALWSHPDP

SEQ ID NO: 61808 - protein, 13 aa, Mycobacterium tuberculosis
QRASALWSHPDPT

SEQ ID NO: 61809 - protein, 13 aa, Mycobacterium tuberculosis
RASALWSHPDPTA

SEQ ID NO: 61810 - protein, 13 aa, Mycobacterium tuberculosis
ASALWSHPDPTAL

SEQ ID NO: 61811 - protein, 13 aa, Mycobacterium tuberculosis
SALWSHPDPTALA

SEQ ID NO: 61812 - protein, 13 aa, Mycobacterium tuberculosis
ALWSHPDPTALAS

SEQ ID NO: 61813 - protein, 13 aa, Mycobacterium tuberculosis
LWSHPDPTALASV

SEQ ID NO: 61814 - protein, 13 aa, Mycobacterium tuberculosis
WSHPDPTALASVP

SEQ ID NO: 61815 - protein, 13 aa, Mycobacterium tuberculosis
SHPDPTALASVPG

SEQ ID NO: 61816 - protein, 13 aa, Mycobacterium tuberculosis
HPDPTALASVPGS

SEQ ID NO: 61817 - protein, 13 aa, Mycobacterium tuberculosis
PDPTALASVPGSR

SEQ ID NO: 61818 - protein, 13 aa, Mycobacterium tuberculosis
DPTALASVPGSRR

SEQ ID NO: 61819 - protein, 13 aa, Mycobacterium tuberculosis
PTALASVPGSRRQ

SEQ ID NO: 61820 - protein, 13 aa, Mycobacterium tuberculosis
TALASVPGSRRQW

SEQ ID NO: 61821 - protein, 13 aa, Mycobacterium tuberculosis
ALASVPGSRRQWE

SEQ ID NO: 61822 - protein, 13 aa, Mycobacterium tuberculosis
LASVPGSRRQWER

SEQ ID NO: 61823 - protein, 13 aa, Mycobacterium tuberculosis
ASVPGSRRQWERD

SEQ ID NO: 61824 - protein, 13 aa, Mycobacterium tuberculosis
SVPGSRRQWERDP

SEQ ID NO: 61825 - protein, 13 aa, Mycobacterium tuberculosis
VPGSRRQWERDPH

SEQ ID NO: 61826 - protein, 13 aa, Mycobacterium tuberculosis
PGSRRQWERDPHD

SEQ ID NO: 61827 - protein, 13 aa, Mycobacterium tuberculosis
GSRRQWERDPHDP

SEQ ID NO: 61828 - protein, 13 aa, Mycobacterium tuberculosis
SRRQWERDPHDPD

SEQ ID NO: 61829 - protein, 13 aa, Mycobacterium tuberculosis
RRQWERDPHDPDF

SEQ ID NO: 61830 - protein, 13 aa, Mycobacterium tuberculosis
RQWERDPHDPDFL

SEQ ID NO: 61831 - protein, 13 aa, Mycobacterium tuberculosis
QWERDPHDPDFLV

SEQ ID NO: 61832 - protein, 13 aa, Mycobacterium tuberculosis
WERDPHDPDFLVL

SEQ ID NO: 61833 - protein, 13 aa, Mycobacterium tuberculosis
ERDPHDPDFLVLR

SEQ ID NO: 61834 - protein, 13 aa, Mycobacterium tuberculosis
RDPHDPDFLVLRA

SEQ ID NO: 61835 - protein, 13 aa, Mycobacterium tuberculosis
DPHDPDFLVLRAG

SEQ ID NO: 61836 - protein, 13 aa, Mycobacterium tuberculosis
PHDPDFLVLRAGR

SEQ ID NO: 61837 - protein, 13 aa, Mycobacterium tuberculosis
HDPDFLVLRAGRH

SEQ ID NO: 61838 - protein, 13 aa, Mycobacterium tuberculosis
DPDFLVLRAGRHT

SEQ ID NO: 61839 - protein, 13 aa, Mycobacterium tuberculosis
PDFLVLRAGRHTV

SEQ ID NO: 61840 - protein, 13 aa, Mycobacterium tuberculosis
DFLVLRAGRHTVP

SEQ ID NO: 61841 - protein, 13 aa, Mycobacterium tuberculosis
FLVLRAGRHTVPL

SEQ ID NO: 61842 - protein, 13 aa, Mycobacterium tuberculosis
LVLRAGRHTVPLA

SEQ ID NO: 61843 - protein, 13 aa, Mycobacterium tuberculosis
VLRAGRHTVPLAT

SEQ ID NO: 61844 - protein, 13 aa, Mycobacterium tuberculosis
LRAGRHTVPLATT

SEQ ID NO: 61845 - protein, 13 aa, Mycobacterium tuberculosis
RAGRHTVPLATTL

SEQ ID NO: 61846 - protein, 13 aa, Mycobacterium tuberculosis
AGRHTVPLATTLR

SEQ ID NO: 61847 - protein, 13 aa, Mycobacterium tuberculosis
GRHTVPLATTLRV

SEQ ID NO: 61848 - protein, 13 aa, Mycobacterium tuberculosis
RHTVPLATTLRVN

SEQ ID NO: 61849 - protein, 13 aa, Mycobacterium tuberculosis
HTVPLATTLRVND

SEQ ID NO: 61850 - protein, 13 aa, Mycobacterium tuberculosis
TVPLATTLRVNDT

SEQ ID NO: 61851 - protein, 13 aa, Mycobacterium tuberculosis
VPLATTLRVNDTA

SEQ ID NO: 61852 - protein, 13 aa, Mycobacterium tuberculosis
PLATTLRVNDTAD

SEQ ID NO: 61853 - protein, 13 aa, Mycobacterium tuberculosis
LATTLRVNDTADE

SEQ ID NO: 61854 - protein, 13 aa, Mycobacterium tuberculosis
ATTLRVNDTADEI

SEQ ID NO: 61855 - protein, 13 aa, Mycobacterium tuberculosis
TTLRVNDTADEID

SEQ ID NO: 61856 - protein, 13 aa, Mycobacterium tuberculosis
TLRVNDTADEIDL

SEQ ID NO: 61857 - protein, 13 aa, Mycobacterium tuberculosis
LRVNDTADEIDLE

SEQ ID NO: 61858 - protein, 13 aa, Mycobacterium tuberculosis
RVNDTADEIDLEP

SEQ ID NO: 61859 - protein, 13 aa, Mycobacterium tuberculosis
VNDTADEIDLEPV

SEQ ID NO: 61860 - protein, 13 aa, Mycobacterium tuberculosis
NDTADEIDLEPVS

SEQ ID NO: 61861 - protein, 13 aa, Mycobacterium tuberculosis
DTADEIDLEPVSH

SEQ ID NO: 61862 - protein, 13 aa, Mycobacterium tuberculosis
TADEIDLEPVSHS

SEQ ID NO: 61863 - protein, 13 aa, Mycobacterium tuberculosis
ADEIDLEPVSHSA

SEQ ID NO: 61864 - protein, 13 aa, Mycobacterium tuberculosis
DEIDLEPVSHSAL

SEQ ID NO: 61865 - protein, 13 aa, Mycobacterium tuberculosis
EIDLEPVSHSALR

SEQ ID NO: 61866 - protein, 13 aa, Mycobacterium tuberculosis
IDLEPVSHSALRS

SEQ ID NO: 61867 - protein, 13 aa, Mycobacterium tuberculosis
DLEPVSHSALRSL

SEQ ID NO: 61868 - protein, 13 aa, Mycobacterium tuberculosis
LEPVSHSALRSLL

SEQ ID NO: 61869 - protein, 13 aa, Mycobacterium tuberculosis
EPVSHSALRSLLD

SEQ ID NO: 61870 - protein, 13 aa, Mycobacterium tuberculosis
PVSHSALRSLLDT

SEQ ID NO: 61871 - protein, 13 aa, Mycobacterium tuberculosis
VSHSALRSLLDTQ

SEQ ID NO: 61872 - protein, 13 aa, Mycobacterium tuberculosis
SHSALRSLLDTQR

SEQ ID NO: 61873 - protein, 13 aa, Mycobacterium tuberculosis
HSALRSLLDTQRS

SEQ ID NO: 61874 - protein, 13 aa, Mycobacterium tuberculosis
SALRSLLDTQRSI

SEQ ID NO: 61875 - protein, 13 aa, Mycobacterium tuberculosis
ALRSLLDTQRSIG

SEQ ID NO: 61876 - protein, 13 aa, Mycobacterium tuberculosis
LRSLLDTQRSIGD

SEQ ID NO: 61877 - protein, 13 aa, Mycobacterium tuberculosis
RSLLDTQRSIGDV

SEQ ID NO: 61878 - protein, 13 aa, Mycobacterium tuberculosis
SLLDTQRSIGDVP

SEQ ID NO: 61879 - protein, 13 aa, Mycobacterium tuberculosis
LLDTQRSIGDVPT

SEQ ID NO: 61880 - protein, 13 aa, Mycobacterium tuberculosis
LDTQRSIGDVPTG

SEQ ID NO: 61881 - protein, 13 aa, Mycobacterium tuberculosis
DTQRSIGDVPTGI

SEQ ID NO: 61882 - protein, 13 aa, Mycobacterium tuberculosis
TQRSIGDVPTGID

SEQ ID NO: 61883 - protein, 13 aa, Mycobacterium tuberculosis
QRSIGDVPTGIDL

SEQ ID NO: 61884 - protein, 13 aa, Mycobacterium tuberculosis
RSIGDVPTGIDLT

SEQ ID NO: 61885 - protein, 13 aa, Mycobacterium tuberculosis
SIGDVPTGIDLTK

SEQ ID NO: 61886 - protein, 13 aa, Mycobacterium tuberculosis
IGDVPTGIDLTKV

SEQ ID NO: 61887 - protein, 13 aa, Mycobacterium tuberculosis
GDVPTGIDLTKVS

SEQ ID NO: 61888 - protein, 13 aa, Mycobacterium tuberculosis
DVPTGIDLTKVSP

SEQ ID NO: 61889 - protein, 13 aa, Mycobacterium tuberculosis
VPTGIDLTKVSPI

SEQ ID NO: 61890 - protein, 13 aa, Mycobacterium tuberculosis
PTGIDLTKVSPIT

SEQ ID NO: 61891 - protein, 13 aa, Mycobacterium tuberculosis
TGIDLTKVSPITV

SEQ ID NO: 61892 - protein, 13 aa, Mycobacterium tuberculosis
GIDLTKVSPITVL

SEQ ID NO: 61893 - protein, 13 aa, Mycobacterium tuberculosis
IDLTKVSPITVLG

SEQ ID NO: 61894 - protein, 13 aa, Mycobacterium tuberculosis
DLTKVSPITVLGE

SEQ ID NO: 61895 - protein, 13 aa, Mycobacterium tuberculosis
LTKVSPITVLGER

SEQ ID NO: 61896 - protein, 13 aa, Mycobacterium tuberculosis
TKVSPITVLGERA

SEQ ID NO: 61897 - protein, 13 aa, Mycobacterium tuberculosis
KVSPITVLGERAQ

SEQ ID NO: 61898 - protein, 13 aa, Mycobacterium tuberculosis
VSPITVLGERAQV

SEQ ID NO: 61899 - protein, 13 aa, Mycobacterium tuberculosis
SPITVLGERAQVR

SEQ ID NO: 61900 - protein, 13 aa, Mycobacterium tuberculosis
PITVLGERAQVRA

SEQ ID NO: 61901 - protein, 13 aa, Mycobacterium tuberculosis
ITVLGERAQVRAV

SEQ ID NO: 61902 - protein, 13 aa, Mycobacterium tuberculosis
TVLGERAQVRAVL

SEQ ID NO: 61903 - protein, 13 aa, Mycobacterium tuberculosis
VLGERAQVRAVLR

SEQ ID NO: 61904 - protein, 13 aa, Mycobacterium tuberculosis
LGERAQVRAVLRA

SEQ ID NO: 61905 - protein, 13 aa, Mycobacterium tuberculosis
GERAQVRAVLRAW

SEQ ID NO: 61906 - protein, 13 aa, Mycobacterium tuberculosis
ERAQVRAVLRAWI

SEQ ID NO: 61907 - protein, 13 aa, Mycobacterium tuberculosis
RAQVRAVLRAWIA

SEQ ID NO: 61908 - protein, 13 aa, Mycobacterium tuberculosis
AQVRAVLRAWIAQ

SEQ ID NO: 61909 - protein, 13 aa, Mycobacterium tuberculosis
QVRAVLRAWIAQA

SEQ ID NO: 61910 - protein, 13 aa, Mycobacterium tuberculosis
VRAVLRAWIAQAV

SEQ ID NO: 61911 - protein, 13 aa, Mycobacterium tuberculosis
RAVLRAWIAQAVT

SEQ ID NO: 61912 - protein, 13 aa, Mycobacterium tuberculosis
AVLRAWIAQAVTW

SEQ ID NO: 61913 - protein, 13 aa, Mycobacterium tuberculosis
VLRAWIAQAVTWH

SEQ ID NO: 61914 - protein, 13 aa, Mycobacterium tuberculosis
LRAWIAQAVTWHD

SEQ ID NO: 61915 - protein, 13 aa, Mycobacterium tuberculosis
RAWIAQAVTWHDP

SEQ ID NO: 61916 - protein, 13 aa, Mycobacterium tuberculosis
AWIAQAVTWHDPT

SEQ ID NO: 61917 - protein, 13 aa, Mycobacterium tuberculosis
WIAQAVTWHDPTV

SEQ ID NO: 61918 - protein, 13 aa, Mycobacterium tuberculosis
IAQAVTWHDPTVL

SEQ ID NO: 61919 - protein, 13 aa, Mycobacterium tuberculosis
AQAVTWHDPTVLG

SEQ ID NO: 61920 - protein, 13 aa, Mycobacterium tuberculosis
QAVTWHDPTVLGV

SEQ ID NO: 61921 - protein, 13 aa, Mycobacterium tuberculosis
AVTWHDPTVLGVA

SEQ ID NO: 61922 - protein, 13 aa, Mycobacterium tuberculosis
VTWHDPTVLGVAL

SEQ ID NO: 61923 - protein, 13 aa, Mycobacterium tuberculosis
TWHDPTVLGVALA

SEQ ID NO: 61924 - protein, 13 aa, Mycobacterium tuberculosis
WHDPTVLGVALAA

SEQ ID NO: 61925 - protein, 13 aa, Mycobacterium tuberculosis
HDPTVLGVALAAR

SEQ ID NO: 61926 - protein, 13 aa, Mycobacterium tuberculosis
DPTVLGVALAARD

SEQ ID NO: 61927 - protein, 13 aa, Mycobacterium tuberculosis
PTVLGVALAARDL

SEQ ID NO: 61928 - protein, 13 aa, Mycobacterium tuberculosis
TVLGVALAARDLE

SEQ ID NO: 61929 - protein, 13 aa, Mycobacterium tuberculosis
VLGVALAARDLEG

SEQ ID NO: 61930 - protein, 13 aa, Mycobacterium tuberculosis
LGVALAARDLEGR

SEQ ID NO: 61931 - protein, 13 aa, Mycobacterium tuberculosis
GVALAARDLEGRD

SEQ ID NO: 61932 - protein, 13 aa, Mycobacterium tuberculosis
VALAARDLEGRDW

SEQ ID NO: 61933 - protein, 13 aa, Mycobacterium tuberculosis
ALAARDLEGRDWN

SEQ ID NO: 61934 - protein, 13 aa, Mycobacterium tuberculosis
LAARDLEGRDWNW

SEQ ID NO: 61935 - protein, 13 aa, Mycobacterium tuberculosis
AARDLEGRDWNWL

SEQ ID NO: 61936 - protein, 13 aa, Mycobacterium tuberculosis
ARDLEGRDWNWLK

SEQ ID NO: 61937 - protein, 13 aa, Mycobacterium tuberculosis
RDLEGRDWNWLKW

SEQ ID NO: 61938 - protein, 13 aa, Mycobacterium tuberculosis
DLEGRDWNWLKWL

SEQ ID NO: 61939 - protein, 13 aa, Mycobacterium tuberculosis
LEGRDWNWLKWLP

SEQ ID NO: 61940 - protein, 13 aa, Mycobacterium tuberculosis
EGRDWNWLKWLPH

SEQ ID NO: 61941 - protein, 13 aa, Mycobacterium tuberculosis
GRDWNWLKWLPHV

SEQ ID NO: 61942 - protein, 13 aa, Mycobacterium tuberculosis
RDWNWLKWLPHVD

SEQ ID NO: 61943 - protein, 13 aa, Mycobacterium tuberculosis
DWNWLKWLPHVDI

SEQ ID NO: 61944 - protein, 13 aa, Mycobacterium tuberculosis
WNWLKWLPHVDIP

SEQ ID NO: 61945 - protein, 13 aa, Mycobacterium tuberculosis
NWLKWLPHVDIPG

SEQ ID NO: 61946 - protein, 13 aa, Mycobacterium tuberculosis
WLKWLPHVDIPGR

SEQ ID NO: 61947 - protein, 13 aa, Mycobacterium tuberculosis
LKWLPHVDIPGRL

SEQ ID NO: 61948 - protein, 13 aa, Mycobacterium tuberculosis
KWLPHVDIPGRLD

SEQ ID NO: 61949 - protein, 13 aa, Mycobacterium tuberculosis
WLPHVDIPGRLDA

SEQ ID NO: 61950 - protein, 13 aa, Mycobacterium tuberculosis
LPHVDIPGRLDAL

SEQ ID NO: 61951 - protein, 13 aa, Mycobacterium tuberculosis
PHVDIPGRLDALG

SEQ ID NO: 61952 - protein, 13 aa, Mycobacterium tuberculosis
HVDIPGRLDALGP

SEQ ID NO: 61953 - protein, 13 aa, Mycobacterium tuberculosis
VDIPGRLDALGPA

SEQ ID NO: 61954 - protein, 13 aa, Mycobacterium tuberculosis
DIPGRLDALGPAR

SEQ ID NO: 61955 - protein, 13 aa, Mycobacterium tuberculosis
IPGRLDALGPARN

SEQ ID NO: 61956 - protein, 13 aa, Mycobacterium tuberculosis
PGRLDALGPARNL

SEQ ID NO: 61957 - protein, 13 aa, Mycobacterium tuberculosis
GRLDALGPARNLS

SEQ ID NO: 61958 - protein, 13 aa, Mycobacterium tuberculosis
RLDALGPARNLST

SEQ ID NO: 61959 - protein, 13 aa, Mycobacterium tuberculosis
LDALGPARNLSTD

SEQ ID NO: 61960 - protein, 13 aa, Mycobacterium tuberculosis
DALGPARNLSTDP

SEQ ID NO: 61961 - protein, 13 aa, Mycobacterium tuberculosis
ALGPARNLSTDPD

SEQ ID NO: 61962 - protein, 13 aa, Mycobacterium tuberculosis
LGPARNLSTDPDE

SEQ ID NO: 61963 - protein, 13 aa, Mycobacterium tuberculosis
GPARNLSTDPDEL

SEQ ID NO: 61964 - protein, 13 aa, Mycobacterium tuberculosis
PARNLSTDPDELI

SEQ ID NO: 61965 - protein, 13 aa, Mycobacterium tuberculosis
ARNLSTDPDELIA

SEQ ID NO: 61966 - protein, 13 aa, Mycobacterium tuberculosis
RNLSTDPDELIAL

SEQ ID NO: 61967 - protein, 13 aa, Mycobacterium tuberculosis
NLSTDPDELIALL

SEQ ID NO: 61968 - protein, 13 aa, Mycobacterium tuberculosis
LSTDPDELIALLG

SEQ ID NO: 61969 - protein, 13 aa, Mycobacterium tuberculosis
STDPDELIALLGP

SEQ ID NO: 61970 - protein, 13 aa, Mycobacterium tuberculosis
TDPDELIALLGPV

SEQ ID NO: 61971 - protein, 13 aa, Mycobacterium tuberculosis
DPDELIALLGPVL

SEQ ID NO: 61972 - protein, 13 aa, Mycobacterium tuberculosis
PDELIALLGPVLA

SEQ ID NO: 61973 - protein, 13 aa, Mycobacterium tuberculosis
DELIALLGPVLAD

SEQ ID NO: 61974 - protein, 13 aa, Mycobacterium tuberculosis
ELIALLGPVLADR

SEQ ID NO: 61975 - protein, 13 aa, Mycobacterium tuberculosis
LIALLGPVLADRP

SEQ ID NO: 61976 - protein, 13 aa, Mycobacterium tuberculosis
IALLGPVLADRPA

SEQ ID NO: 61977 - protein, 13 aa, Mycobacterium tuberculosis
ALLGPVLADRPAF

SEQ ID NO: 61978 - protein, 13 aa, Mycobacterium tuberculosis
LLGPVLADRPAFT

SEQ ID NO: 61979 - protein, 13 aa, Mycobacterium tuberculosis
LGPVLADRPAFTG

SEQ ID NO: 61980 - protein, 13 aa, Mycobacterium tuberculosis
GPVLADRPAFTGQ

SEQ ID NO: 61981 - protein, 13 aa, Mycobacterium tuberculosis
PVLADRPAFTGQP

SEQ ID NO: 61982 - protein, 13 aa, Mycobacterium tuberculosis
VLADRPAFTGQPT

SEQ ID NO: 61983 - protein, 13 aa, Mycobacterium tuberculosis
LADRPAFTGQPTD

SEQ ID NO: 61984 - protein, 13 aa, Mycobacterium tuberculosis
ADRPAFTGQPTDA

SEQ ID NO: 61985 - protein, 13 aa, Mycobacterium tuberculosis
DRPAFTGQPTDAL

SEQ ID NO: 61986 - protein, 13 aa, Mycobacterium tuberculosis
RPAFTGQPTDALR

SEQ ID NO: 61987 - protein, 13 aa, Mycobacterium tuberculosis
PAFTGQPTDALRH

SEQ ID NO: 61988 - protein, 13 aa, Mycobacterium tuberculosis
AFTGQPTDALRHL

SEQ ID NO: 61989 - protein, 13 aa, Mycobacterium tuberculosis
FTGQPTDALRHLL

SEQ ID NO: 61990 - protein, 13 aa, Mycobacterium tuberculosis
TGQPTDALRHLLI

SEQ ID NO: 61991 - protein, 13 aa, Mycobacterium tuberculosis
GQPTDALRHLLIV

SEQ ID NO: 61992 - protein, 13 aa, Mycobacterium tuberculosis
QPTDALRHLLIVV

SEQ ID NO: 61993 - protein, 13 aa, Mycobacterium tuberculosis
PTDALRHLLIVVD

SEQ ID NO: 61994 - protein, 13 aa, Mycobacterium tuberculosis
TDALRHLLIVVDD

SEQ ID NO: 61995 - protein, 13 aa, Mycobacterium tuberculosis
DALRHLLIVVDDP

SEQ ID NO: 61996 - protein, 13 aa, Mycobacterium tuberculosis
ALRHLLIVVDDPD

SEQ ID NO: 61997 - protein, 13 aa, Mycobacterium tuberculosis
LRHLLIVVDDPDY

SEQ ID NO: 61998 - protein, 13 aa, Mycobacterium tuberculosis
RHLLIVVDDPDYD

SEQ ID NO: 61999 - protein, 13 aa, Mycobacterium tuberculosis
HLLIVVDDPDYDL

SEQ ID NO: 62000 - protein, 13 aa, Mycobacterium tuberculosis
LLIVVDDPDYDLG

SEQ ID NO: 62001 - protein, 13 aa, Mycobacterium tuberculosis
LIVVDDPDYDLGA

SEQ ID NO: 62002 - protein, 13 aa, Mycobacterium tuberculosis
IVVDDPDYDLGAS

SEQ ID NO: 62003 - protein, 13 aa, Mycobacterium tuberculosis
VVDDPDYDLGASP

SEQ ID NO: 62004 - protein, 13 aa, Mycobacterium tuberculosis
VDDPDYDLGASPL

SEQ ID NO: 62005 - protein, 13 aa, Mycobacterium tuberculosis
DDPDYDLGASPLA

SEQ ID NO: 62006 - protein, 13 aa, Mycobacterium tuberculosis
DPDYDLGASPLAV

SEQ ID NO: 62007 - protein, 13 aa, Mycobacterium tuberculosis
PDYDLGASPLAVG

SEQ ID NO: 62008 - protein, 13 aa, Mycobacterium tuberculosis
DYDLGASPLAVGR

SEQ ID NO: 62009 - protein, 13 aa, Mycobacterium tuberculosis
YDLGASPLAVGRA

SEQ ID NO: 62010 - protein, 13 aa, Mycobacterium tuberculosis
DLGASPLAVGRAG

SEQ ID NO: 62011 - protein, 13 aa, Mycobacterium tuberculosis
LGASPLAVGRAGV

SEQ ID NO: 62012 - protein, 13 aa, Mycobacterium tuberculosis
GASPLAVGRAGVT

SEQ ID NO: 62013 - protein, 13 aa, Mycobacterium tuberculosis
ASPLAVGRAGVTV

SEQ ID NO: 62014 - protein, 13 aa, Mycobacterium tuberculosis
SPLAVGRAGVTVV

SEQ ID NO: 62015 - protein, 13 aa, Mycobacterium tuberculosis
PLAVGRAGVTVVH

SEQ ID NO: 62016 - protein, 13 aa, Mycobacterium tuberculosis
LAVGRAGVTVVHC

SEQ ID NO: 62017 - protein, 13 aa, Mycobacterium tuberculosis
AVGRAGVTVVHCS

SEQ ID NO: 62018 - protein, 13 aa, Mycobacterium tuberculosis
VGRAGVTVVHCSA

SEQ ID NO: 62019 - protein, 13 aa, Mycobacterium tuberculosis
GRAGVTVVHCSAS

SEQ ID NO: 62020 - protein, 13 aa, Mycobacterium tuberculosis
RAGVTVVHCSASA

SEQ ID NO: 62021 - protein, 13 aa, Mycobacterium tuberculosis
AGVTVVHCSASAP

SEQ ID NO: 62022 - protein, 13 aa, Mycobacterium tuberculosis
GVTVVHCSASAPH

SEQ ID NO: 62023 - protein, 13 aa, Mycobacterium tuberculosis
VTVVHCSASAPHR

SEQ ID NO: 62024 - protein, 13 aa, Mycobacterium tuberculosis
TVVHCSASAPHRE

SEQ ID NO: 62025 - protein, 13 aa, Mycobacterium tuberculosis
VVHCSASAPHREQ

SEQ ID NO: 62026 - protein, 13 aa, Mycobacterium tuberculosis
VHCSASAPHREQY

SEQ ID NO: 62027 - protein, 13 aa, Mycobacterium tuberculosis
HCSASAPHREQYS

SEQ ID NO: 62028 - protein, 13 aa, Mycobacterium tuberculosis
CSASAPHREQYSD

SEQ ID NO: 62029 - protein, 13 aa, Mycobacterium tuberculosis
SASAPHREQYSDP

SEQ ID NO: 62030 - protein, 13 aa, Mycobacterium tuberculosis
ASAPHREQYSDPE

SEQ ID NO: 62031 - protein, 13 aa, Mycobacterium tuberculosis
SAPHREQYSDPEK

SEQ ID NO: 62032 - protein, 13 aa, Mycobacterium tuberculosis
APHREQYSDPEKP

SEQ ID NO: 62033 - protein, 13 aa, Mycobacterium tuberculosis
PHREQYSDPEKPI

SEQ ID NO: 62034 - protein, 13 aa, Mycobacterium tuberculosis
HREQYSDPEKPIL

SEQ ID NO: 62035 - protein, 13 aa, Mycobacterium tuberculosis
REQYSDPEKPILR

SEQ ID NO: 62036 - protein, 13 aa, Mycobacterium tuberculosis
EQYSDPEKPILRV

SEQ ID NO: 62037 - protein, 13 aa, Mycobacterium tuberculosis
QYSDPEKPILRVA

SEQ ID NO: 62038 - protein, 13 aa, Mycobacterium tuberculosis
YSDPEKPILRVAH

SEQ ID NO: 62039 - protein, 13 aa, Mycobacterium tuberculosis
SDPEKPILRVAHG

SEQ ID NO: 62040 - protein, 13 aa, Mycobacterium tuberculosis
DPEKPILRVAHGA

SEQ ID NO: 62041 - protein, 13 aa, Mycobacterium tuberculosis
PEKPILRVAHGAI

SEQ ID NO: 62042 - protein, 13 aa, Mycobacterium tuberculosis
EKPILRVAHGAIE

SEQ ID NO: 62043 - protein, 13 aa, Mycobacterium tuberculosis
KPILRVAHGAIER

SEQ ID NO: 62044 - protein, 13 aa, Mycobacterium tuberculosis
PILRVAHGAIERW

SEQ ID NO: 62045 - protein, 13 aa, Mycobacterium tuberculosis
ILRVAHGAIERWQ

SEQ ID NO: 62046 - protein, 13 aa, Mycobacterium tuberculosis
LRVAHGAIERWQT

SEQ ID NO: 62047 - protein, 13 aa, Mycobacterium tuberculosis
RVAHGAIERWQTG

SEQ ID NO: 62048 - protein, 13 aa, Mycobacterium tuberculosis
VAHGAIERWQTGG

SEQ ID NO: 62049 - protein, 13 aa, Mycobacterium tuberculosis
AHGAIERWQTGGW

SEQ ID NO: 62050 - protein, 13 aa, Mycobacterium tuberculosis
HGAIERWQTGGWQ

SEQ ID NO: 62051 - protein, 13 aa, Mycobacterium tuberculosis
GAIERWQTGGWQP

SEQ ID NO: 62052 - protein, 13 aa, Mycobacterium tuberculosis
AIERWQTGGWQPY

SEQ ID NO: 62053 - protein, 13 aa, Mycobacterium tuberculosis
IERWQTGGWQPYI

SEQ ID NO: 62054 - protein, 13 aa, Mycobacterium tuberculosis
ERWQTGGWQPYID

SEQ ID NO: 62055 - protein, 13 aa, Mycobacterium tuberculosis
RWQTGGWQPYIDA

SEQ ID NO: 62056 - protein, 13 aa, Mycobacterium tuberculosis
WQTGGWQPYIDAA

SEQ ID NO: 62057 - protein, 13 aa, Mycobacterium tuberculosis
QTGGWQPYIDAAD

SEQ ID NO: 62058 - protein, 13 aa, Mycobacterium tuberculosis
TGGWQPYIDAADQ

SEQ ID NO: 62059 - protein, 13 aa, Mycobacterium tuberculosis
GGWQPYIDAADQF

SEQ ID NO: 62060 - protein, 13 aa, Mycobacterium tuberculosis
GWQPYIDAADQFS

SEQ ID NO: 62061 - protein, 13 aa, Mycobacterium tuberculosis
WQPYIDAADQFSA

SEQ ID NO: 62062 - protein, 13 aa, Mycobacterium tuberculosis
QPYIDAADQFSAD

SEQ ID NO: 62063 - protein, 13 aa, Mycobacterium tuberculosis
PYIDAADQFSADE

SEQ ID NO: 62064 - protein, 13 aa, Mycobacterium tuberculosis
YIDAADQFSADEA

SEQ ID NO: 62065 - protein, 13 aa, Mycobacterium tuberculosis
IDAADQFSADEAA

SEQ ID NO: 62066 - protein, 13 aa, Mycobacterium tuberculosis
DAADQFSADEAAH

SEQ ID NO: 62067 - protein, 13 aa, Mycobacterium tuberculosis
AADQFSADEAAHL

SEQ ID NO: 62068 - protein, 13 aa, Mycobacterium tuberculosis
ADQFSADEAAHLA

SEQ ID NO: 62069 - protein, 13 aa, Mycobacterium tuberculosis
DQFSADEAAHLAR

SEQ ID NO: 62070 - protein, 13 aa, Mycobacterium tuberculosis
QFSADEAAHLARR

SEQ ID NO: 62071 - protein, 13 aa, Mycobacterium tuberculosis
FSADEAAHLARRL

SEQ ID NO: 62072 - protein, 13 aa, Mycobacterium tuberculosis
SADEAAHLARRLS

SEQ ID NO: 62073 - protein, 13 aa, Mycobacterium tuberculosis
ADEAAHLARRLSR

SEQ ID NO: 62074 - protein, 13 aa, Mycobacterium tuberculosis
DEAAHLARRLSRW

SEQ ID NO: 62075 - protein, 13 aa, Mycobacterium tuberculosis
EAAHLARRLSRWD

SEQ ID NO: 62076 - protein, 13 aa, Mycobacterium tuberculosis
AAHLARRLSRWDS

SEQ ID NO: 62077 - protein, 13 aa, Mycobacterium tuberculosis
AHLARRLSRWDSN

SEQ ID NO: 62078 - protein, 13 aa, Mycobacterium tuberculosis
HLARRLSRWDSNP

SEQ ID NO: 62079 - protein, 13 aa, Mycobacterium tuberculosis
LARRLSRWDSNPT

SEQ ID NO: 62080 - protein, 13 aa, Mycobacterium tuberculosis
ARRLSRWDSNPTH

SEQ ID NO: 62081 - protein, 13 aa, Mycobacterium tuberculosis
RRLSRWDSNPTHA

SEQ ID NO: 62082 - protein, 13 aa, Mycobacterium tuberculosis
RLSRWDSNPTHAG

SEQ ID NO: 62083 - protein, 13 aa, Mycobacterium tuberculosis
LSRWDSNPTHAGL

SEQ ID NO: 62084 - protein, 13 aa, Mycobacterium tuberculosis
SRWDSNPTHAGLR

SEQ ID NO: 62085 - protein, 13 aa, Mycobacterium tuberculosis
RWDSNPTHAGLRS

SEQ ID NO: 62086 - protein, 13 aa, Mycobacterium tuberculosis
WDSNPTHAGLRSA

SEQ ID NO: 62087 - protein, 13 aa, Mycobacterium tuberculosis
DSNPTHAGLRSAA

SEQ ID NO: 62088 - protein, 13 aa, Mycobacterium tuberculosis
SNPTHAGLRSAAT

SEQ ID NO: 62089 - protein, 13 aa, Mycobacterium tuberculosis
NPTHAGLRSAATR

SEQ ID NO: 62090 - protein, 13 aa, Mycobacterium tuberculosis
PTHAGLRSAATRG

SEQ ID NO: 62091 - protein, 13 aa, Mycobacterium tuberculosis
THAGLRSAATRGA

SEQ ID NO: 62092 - protein, 13 aa, Mycobacterium tuberculosis
HAGLRSAATRGAS

SEQ ID NO: 62093 - protein, 13 aa, Mycobacterium tuberculosis
AGLRSAATRGASF

SEQ ID NO: 62094 - protein, 13 aa, Mycobacterium tuberculosis
GLRSAATRGASFT

SEQ ID NO: 62095 - protein, 13 aa, Mycobacterium tuberculosis
LRSAATRGASFTT

SEQ ID NO: 62096 - protein, 13 aa, Mycobacterium tuberculosis
RSAATRGASFTTL

SEQ ID NO: 62097 - protein, 13 aa, Mycobacterium tuberculosis
SAATRGASFTTLL

SEQ ID NO: 62098 - protein, 13 aa, Mycobacterium tuberculosis
AATRGASFTTLLG

SEQ ID NO: 62099 - protein, 13 aa, Mycobacterium tuberculosis
ATRGASFTTLLGI

SEQ ID NO: 62100 - protein, 13 aa, Mycobacterium tuberculosis
TRGASFTTLLGIE

SEQ ID NO: 62101 - protein, 13 aa, Mycobacterium tuberculosis
RGASFTTLLGIED

SEQ ID NO: 62102 - protein, 13 aa, Mycobacterium tuberculosis
GASFTTLLGIEDA

SEQ ID NO: 62103 - protein, 13 aa, Mycobacterium tuberculosis
ASFTTLLGIEDAS

SEQ ID NO: 62104 - protein, 13 aa, Mycobacterium tuberculosis
SFTTLLGIEDASR

SEQ ID NO: 62105 - protein, 13 aa, Mycobacterium tuberculosis
FTTLLGIEDASRL

SEQ ID NO: 62106 - protein, 13 aa, Mycobacterium tuberculosis
TTLLGIEDASRLD

SEQ ID NO: 62107 - protein, 13 aa, Mycobacterium tuberculosis
TLLGIEDASRLDV

SEQ ID NO: 62108 - protein, 13 aa, Mycobacterium tuberculosis
LLGIEDASRLDVP

SEQ ID NO: 62109 - protein, 13 aa, Mycobacterium tuberculosis
LGIEDASRLDVPA

SEQ ID NO: 62110 - protein, 13 aa, Mycobacterium tuberculosis
GIEDASRLDVPAL

SEQ ID NO: 62111 - protein, 13 aa, Mycobacterium tuberculosis
IEDASRLDVPALW

SEQ ID NO: 62112 - protein, 13 aa, Mycobacterium tuberculosis
EDASRLDVPALWA

SEQ ID NO: 62113 - protein, 13 aa, Mycobacterium tuberculosis
DASRLDVPALWAP

SEQ ID NO: 62114 - protein, 13 aa, Mycobacterium tuberculosis
ASRLDVPALWAPR

SEQ ID NO: 62115 - protein, 13 aa, Mycobacterium tuberculosis
SRLDVPALWAPRR

SEQ ID NO: 62116 - protein, 13 aa, Mycobacterium tuberculosis
RLDVPALWAPRRR

SEQ ID NO: 62117 - protein, 13 aa, Mycobacterium tuberculosis
LDVPALWAPRRRD

SEQ ID NO: 62118 - protein, 13 aa, Mycobacterium tuberculosis
DVPALWAPRRRDE

SEQ ID NO: 62119 - protein, 13 aa, Mycobacterium tuberculosis
VPALWAPRRRDEE

SEQ ID NO: 62120 - protein, 13 aa, Mycobacterium tuberculosis
PALWAPRRRDEEL

SEQ ID NO: 62121 - protein, 13 aa, Mycobacterium tuberculosis
ALWAPRRRDEELR

SEQ ID NO: 62122 - protein, 13 aa, Mycobacterium tuberculosis
LWAPRRRDEELRV

SEQ ID NO: 62123 - protein, 13 aa, Mycobacterium tuberculosis
WAPRRRDEELRVP

SEQ ID NO: 62124 - protein, 13 aa, Mycobacterium tuberculosis
APRRRDEELRVPI

SEQ ID NO: 62125 - protein, 13 aa, Mycobacterium tuberculosis
PRRRDEELRVPIG

SEQ ID NO: 62126 - protein, 13 aa, Mycobacterium tuberculosis
RRRDEELRVPIGV

SEQ ID NO: 62127 - protein, 13 aa, Mycobacterium tuberculosis
RRDEELRVPIGVT

SEQ ID NO: 62128 - protein, 13 aa, Mycobacterium tuberculosis
RDEELRVPIGVTG

SEQ ID NO: 62129 - protein, 13 aa, Mycobacterium tuberculosis
DEELRVPIGVTGT

SEQ ID NO: 62130 - protein, 13 aa, Mycobacterium tuberculosis
EELRVPIGVTGTG

SEQ ID NO: 62131 - protein, 13 aa, Mycobacterium tuberculosis
ELRVPIGVTGTGE

SEQ ID NO: 62132 - protein, 13 aa, Mycobacterium tuberculosis
LRVPIGVTGTGEP

SEQ ID NO: 62133 - protein, 13 aa, Mycobacterium tuberculosis
RVPIGVTGTGEPL

SEQ ID NO: 62134 - protein, 13 aa, Mycobacterium tuberculosis
VPIGVTGTGEPLM

SEQ ID NO: 62135 - protein, 13 aa, Mycobacterium tuberculosis
PIGVTGTGEPLMF

SEQ ID NO: 62136 - protein, 13 aa, Mycobacterium tuberculosis
IGVTGTGEPLMFD

SEQ ID NO: 62137 - protein, 13 aa, Mycobacterium tuberculosis
GVTGTGEPLMFDL

SEQ ID NO: 62138 - protein, 13 aa, Mycobacterium tuberculosis
VTGTGEPLMFDLK

SEQ ID NO: 62139 - protein, 13 aa, Mycobacterium tuberculosis
TGTGEPLMFDLKD

SEQ ID NO: 62140 - protein, 13 aa, Mycobacterium tuberculosis
GTGEPLMFDLKDE

SEQ ID NO: 62141 - protein, 13 aa, Mycobacterium tuberculosis
TGEPLMFDLKDEA

SEQ ID NO: 62142 - protein, 13 aa, Mycobacterium tuberculosis
GEPLMFDLKDEAE

SEQ ID NO: 62143 - protein, 13 aa, Mycobacterium tuberculosis
EPLMFDLKDEAEG

SEQ ID NO: 62144 - protein, 13 aa, Mycobacterium tuberculosis
PLMFDLKDEAEGG

SEQ ID NO: 62145 - protein, 13 aa, Mycobacterium tuberculosis
LMFDLKDEAEGGM

SEQ ID NO: 62146 - protein, 13 aa, Mycobacterium tuberculosis
MFDLKDEAEGGMG

SEQ ID NO: 62147 - protein, 13 aa, Mycobacterium tuberculosis
FDLKDEAEGGMGP

SEQ ID NO: 62148 - protein, 13 aa, Mycobacterium tuberculosis
DLKDEAEGGMGPH

SEQ ID NO: 62149 - protein, 13 aa, Mycobacterium tuberculosis
LKDEAEGGMGPHG

SEQ ID NO: 62150 - protein, 13 aa, Mycobacterium tuberculosis
KDEAEGGMGPHGL

SEQ ID NO: 62151 - protein, 13 aa, Mycobacterium tuberculosis
DEAEGGMGPHGLM

SEQ ID NO: 62152 - protein, 13 aa, Mycobacterium tuberculosis
EAEGGMGPHGLMI

SEQ ID NO: 62153 - protein, 13 aa, Mycobacterium tuberculosis
AEGGMGPHGLMIG

SEQ ID NO: 62154 - protein, 13 aa, Mycobacterium tuberculosis
EGGMGPHGLMIGM

SEQ ID NO: 62155 - protein, 13 aa, Mycobacterium tuberculosis
GGMGPHGLMIGMT

SEQ ID NO: 62156 - protein, 13 aa, Mycobacterium tuberculosis
GMGPHGLMIGMTG

SEQ ID NO: 62157 - protein, 13 aa, Mycobacterium tuberculosis
MGPHGLMIGMTGS

SEQ ID NO: 62158 - protein, 13 aa, Mycobacterium tuberculosis
GPHGLMIGMTGSG

SEQ ID NO: 62159 - protein, 13 aa, Mycobacterium tuberculosis
PHGLMIGMTGSGK

SEQ ID NO: 62160 - protein, 13 aa, Mycobacterium tuberculosis
HGLMIGMTGSGKS

SEQ ID NO: 62161 - protein, 13 aa, Mycobacterium tuberculosis
GLMIGMTGSGKSQ

SEQ ID NO: 62162 - protein, 13 aa, Mycobacterium tuberculosis
LMIGMTGSGKSQT

SEQ ID NO: 62163 - protein, 13 aa, Mycobacterium tuberculosis
MIGMTGSGKSQTL

SEQ ID NO: 62164 - protein, 13 aa, Mycobacterium tuberculosis
IGMTGSGKSQTLM

SEQ ID NO: 62165 - protein, 13 aa, Mycobacterium tuberculosis
GMTGSGKSQTLMS

SEQ ID NO: 62166 - protein, 13 aa, Mycobacterium tuberculosis
MTGSGKSQTLMSI

SEQ ID NO: 62167 - protein, 13 aa, Mycobacterium tuberculosis
TGSGKSQTLMSIL

SEQ ID NO: 62168 - protein, 13 aa, Mycobacterium tuberculosis
GSGKSQTLMSILL

SEQ ID NO: 62169 - protein, 13 aa, Mycobacterium tuberculosis
SGKSQTLMSILLS

SEQ ID NO: 62170 - protein, 13 aa, Mycobacterium tuberculosis
GKSQTLMSILLSL

SEQ ID NO: 62171 - protein, 13 aa, Mycobacterium tuberculosis
KSQTLMSILLSLL

SEQ ID NO: 62172 - protein, 13 aa, Mycobacterium tuberculosis
SQTLMSILLSLLT

SEQ ID NO: 62173 - protein, 13 aa, Mycobacterium tuberculosis
QTLMSILLSLLTT

SEQ ID NO: 62174 - protein, 13 aa, Mycobacterium tuberculosis
TLMSILLSLLTTH

SEQ ID NO: 62175 - protein, 13 aa, Mycobacterium tuberculosis
LMSILLSLLTTHS

SEQ ID NO: 62176 - protein, 13 aa, Mycobacterium tuberculosis
MSILLSLLTTHSA

SEQ ID NO: 62177 - protein, 13 aa, Mycobacterium tuberculosis
SILLSLLTTHSAE

SEQ ID NO: 62178 - protein, 13 aa, Mycobacterium tuberculosis
ILLSLLTTHSAER

SEQ ID NO: 62179 - protein, 13 aa, Mycobacterium tuberculosis
LLSLLTTHSAERL

SEQ ID NO: 62180 - protein, 13 aa, Mycobacterium tuberculosis
LSLLTTHSAERLI

SEQ ID NO: 62181 - protein, 13 aa, Mycobacterium tuberculosis
SLLTTHSAERLIV

SEQ ID NO: 62182 - protein, 13 aa, Mycobacterium tuberculosis
LLTTHSAERLIVI

SEQ ID NO: 62183 - protein, 13 aa, Mycobacterium tuberculosis
LTTHSAERLIVIY

SEQ ID NO: 62184 - protein, 13 aa, Mycobacterium tuberculosis
TTHSAERLIVIYA

SEQ ID NO: 62185 - protein, 13 aa, Mycobacterium tuberculosis
THSAERLIVIYAD

SEQ ID NO: 62186 - protein, 13 aa, Mycobacterium tuberculosis
HSAERLIVIYADF

SEQ ID NO: 62187 - protein, 13 aa, Mycobacterium tuberculosis
SAERLIVIYADFK

SEQ ID NO: 62188 - protein, 13 aa, Mycobacterium tuberculosis
AERLIVIYADFKG

SEQ ID NO: 62189 - protein, 13 aa, Mycobacterium tuberculosis
ERLIVIYADFKGE

SEQ ID NO: 62190 - protein, 13 aa, Mycobacterium tuberculosis
RLIVIYADFKGEA

SEQ ID NO: 62191 - protein, 13 aa, Mycobacterium tuberculosis
LIVIYADFKGEAG

SEQ ID NO: 62192 - protein, 13 aa, Mycobacterium tuberculosis
IVIYADFKGEAGA

SEQ ID NO: 62193 - protein, 13 aa, Mycobacterium tuberculosis
VIYADFKGEAGAD

SEQ ID NO: 62194 - protein, 13 aa, Mycobacterium tuberculosis
IYADFKGEAGADS

SEQ ID NO: 62195 - protein, 13 aa, Mycobacterium tuberculosis
YADFKGEAGADSF

SEQ ID NO: 62196 - protein, 13 aa, Mycobacterium tuberculosis
ADFKGEAGADSFR

SEQ ID NO: 62197 - protein, 13 aa, Mycobacterium tuberculosis
DFKGEAGADSFRD

SEQ ID NO: 62198 - protein, 13 aa, Mycobacterium tuberculosis
FKGEAGADSFRDF

SEQ ID NO: 62199 - protein, 13 aa, Mycobacterium tuberculosis
KGEAGADSFRDFP

SEQ ID NO: 62200 - protein, 13 aa, Mycobacterium tuberculosis
GEAGADSFRDFPQ

SEQ ID NO: 62201 - protein, 13 aa, Mycobacterium tuberculosis
EAGADSFRDFPQV

SEQ ID NO: 62202 - protein, 13 aa, Mycobacterium tuberculosis
AGADSFRDFPQVV

SEQ ID NO: 62203 - protein, 13 aa, Mycobacterium tuberculosis
GADSFRDFPQVVA

SEQ ID NO: 62204 - protein, 13 aa, Mycobacterium tuberculosis
ADSFRDFPQVVAV

SEQ ID NO: 62205 - protein, 13 aa, Mycobacterium tuberculosis
DSFRDFPQVVAVI

SEQ ID NO: 62206 - protein, 13 aa, Mycobacterium tuberculosis
SFRDFPQVVAVIS

SEQ ID NO: 62207 - protein, 13 aa, Mycobacterium tuberculosis
FRDFPQVVAVISN

SEQ ID NO: 62208 - protein, 13 aa, Mycobacterium tuberculosis
RDFPQVVAVISNM

SEQ ID NO: 62209 - protein, 13 aa, Mycobacterium tuberculosis
DFPQVVAVISNMA

SEQ ID NO: 62210 - protein, 13 aa, Mycobacterium tuberculosis
FPQVVAVISNMAE

SEQ ID NO: 62211 - protein, 13 aa, Mycobacterium tuberculosis
PQVVAVISNMAEK

SEQ ID NO: 62212 - protein, 13 aa, Mycobacterium tuberculosis
QVVAVISNMAEKK

SEQ ID NO: 62213 - protein, 13 aa, Mycobacterium tuberculosis
VVAVISNMAEKKS

SEQ ID NO: 62214 - protein, 13 aa, Mycobacterium tuberculosis
VAVISNMAEKKSL

SEQ ID NO: 62215 - protein, 13 aa, Mycobacterium tuberculosis
AVISNMAEKKSLA

SEQ ID NO: 62216 - protein, 13 aa, Mycobacterium tuberculosis
VISNMAEKKSLAD

SEQ ID NO: 62217 - protein, 13 aa, Mycobacterium tuberculosis
ISNMAEKKSLADR

SEQ ID NO: 62218 - protein, 13 aa, Mycobacterium tuberculosis
SNMAEKKSLADRF

SEQ ID NO: 62219 - protein, 13 aa, Mycobacterium tuberculosis
NMAEKKSLADRFA

SEQ ID NO: 62220 - protein, 13 aa, Mycobacterium tuberculosis
MAEKKSLADRFAD

SEQ ID NO: 62221 - protein, 13 aa, Mycobacterium tuberculosis
AEKKSLADRFADT

SEQ ID NO: 62222 - protein, 13 aa, Mycobacterium tuberculosis
EKKSLADRFADTL

SEQ ID NO: 62223 - protein, 13 aa, Mycobacterium tuberculosis
KKSLADRFADTLR

SEQ ID NO: 62224 - protein, 13 aa, Mycobacterium tuberculosis
KSLADRFADTLRG

SEQ ID NO: 62225 - protein, 13 aa, Mycobacterium tuberculosis
SLADRFADTLRGE

SEQ ID NO: 62226 - protein, 13 aa, Mycobacterium tuberculosis
LADRFADTLRGEV

SEQ ID NO: 62227 - protein, 13 aa, Mycobacterium tuberculosis
ADRFADTLRGEVA

SEQ ID NO: 62228 - protein, 13 aa, Mycobacterium tuberculosis
DRFADTLRGEVAR

SEQ ID NO: 62229 - protein, 13 aa, Mycobacterium tuberculosis
RFADTLRGEVARR

SEQ ID NO: 62230 - protein, 13 aa, Mycobacterium tuberculosis
FADTLRGEVARRE

SEQ ID NO: 62231 - protein, 13 aa, Mycobacterium tuberculosis
ADTLRGEVARREM

SEQ ID NO: 62232 - protein, 13 aa, Mycobacterium tuberculosis
DTLRGEVARREML

SEQ ID NO: 62233 - protein, 13 aa, Mycobacterium tuberculosis
TLRGEVARREMLL

SEQ ID NO: 62234 - protein, 13 aa, Mycobacterium tuberculosis
LRGEVARREMLLR

SEQ ID NO: 62235 - protein, 13 aa, Mycobacterium tuberculosis
RGEVARREMLLRE

SEQ ID NO: 62236 - protein, 13 aa, Mycobacterium tuberculosis
GEVARREMLLREA

SEQ ID NO: 62237 - protein, 13 aa, Mycobacterium tuberculosis
EVARREMLLREAG

SEQ ID NO: 62238 - protein, 13 aa, Mycobacterium tuberculosis
VARREMLLREAGR

SEQ ID NO: 62239 - protein, 13 aa, Mycobacterium tuberculosis
ARREMLLREAGRK

SEQ ID NO: 62240 - protein, 13 aa, Mycobacterium tuberculosis
RREMLLREAGRKV

SEQ ID NO: 62241 - protein, 13 aa, Mycobacterium tuberculosis
REMLLREAGRKVQ

SEQ ID NO: 62242 - protein, 13 aa, Mycobacterium tuberculosis
EMLLREAGRKVQG

SEQ ID NO: 62243 - protein, 13 aa, Mycobacterium tuberculosis
MLLREAGRKVQGS

SEQ ID NO: 62244 - protein, 13 aa, Mycobacterium tuberculosis
LLREAGRKVQGSA

SEQ ID NO: 62245 - protein, 13 aa, Mycobacterium tuberculosis
LREAGRKVQGSAF

SEQ ID NO: 62246 - protein, 13 aa, Mycobacterium tuberculosis
REAGRKVQGSAFN

SEQ ID NO: 62247 - protein, 13 aa, Mycobacterium tuberculosis
EAGRKVQGSAFNS

SEQ ID NO: 62248 - protein, 13 aa, Mycobacterium tuberculosis
AGRKVQGSAFNSV

SEQ ID NO: 62249 - protein, 13 aa, Mycobacterium tuberculosis
GRKVQGSAFNSVL

SEQ ID NO: 62250 - protein, 13 aa, Mycobacterium tuberculosis
RKVQGSAFNSVLE

SEQ ID NO: 62251 - protein, 13 aa, Mycobacterium tuberculosis
KVQGSAFNSVLEY

SEQ ID NO: 62252 - protein, 13 aa, Mycobacterium tuberculosis
VQGSAFNSVLEYE

SEQ ID NO: 62253 - protein, 13 aa, Mycobacterium tuberculosis
QGSAFNSVLEYEN

SEQ ID NO: 62254 - protein, 13 aa, Mycobacterium tuberculosis
GSAFNSVLEYENA

SEQ ID NO: 62255 - protein, 13 aa, Mycobacterium tuberculosis
SAFNSVLEYENAI

SEQ ID NO: 62256 - protein, 13 aa, Mycobacterium tuberculosis
AFNSVLEYENAIA

SEQ ID NO: 62257 - protein, 13 aa, Mycobacterium tuberculosis
FNSVLEYENAIAA

SEQ ID NO: 62258 - protein, 13 aa, Mycobacterium tuberculosis
NSVLEYENAIAAG

SEQ ID NO: 62259 - protein, 13 aa, Mycobacterium tuberculosis
SVLEYENAIAAGH

SEQ ID NO: 62260 - protein, 13 aa, Mycobacterium tuberculosis
VLEYENAIAAGHS

SEQ ID NO: 62261 - protein, 13 aa, Mycobacterium tuberculosis
LEYENAIAAGHSL

SEQ ID NO: 62262 - protein, 13 aa, Mycobacterium tuberculosis
EYENAIAAGHSLP

SEQ ID NO: 62263 - protein, 13 aa, Mycobacterium tuberculosis
YENAIAAGHSLPP

SEQ ID NO: 62264 - protein, 13 aa, Mycobacterium tuberculosis
ENAIAAGHSLPPI

SEQ ID NO: 62265 - protein, 13 aa, Mycobacterium tuberculosis
NAIAAGHSLPPIP

SEQ ID NO: 62266 - protein, 13 aa, Mycobacterium tuberculosis
AIAAGHSLPPIPT

SEQ ID NO: 62267 - protein, 13 aa, Mycobacterium tuberculosis
IAAGHSLPPIPTL

SEQ ID NO: 62268 - protein, 13 aa, Mycobacterium tuberculosis
AAGHSLPPIPTLF

SEQ ID NO: 62269 - protein, 13 aa, Mycobacterium tuberculosis
AGHSLPPIPTLFV

SEQ ID NO: 62270 - protein, 13 aa, Mycobacterium tuberculosis
GHSLPPIPTLFVV

SEQ ID NO: 62271 - protein, 13 aa, Mycobacterium tuberculosis
HSLPPIPTLFVVA

SEQ ID NO: 62272 - protein, 13 aa, Mycobacterium tuberculosis
SLPPIPTLFVVAD

SEQ ID NO: 62273 - protein, 13 aa, Mycobacterium tuberculosis
LPPIPTLFVVADE

SEQ ID NO: 62274 - protein, 13 aa, Mycobacterium tuberculosis
PPIPTLFVVADEF

SEQ ID NO: 62275 - protein, 13 aa, Mycobacterium tuberculosis
PIPTLFVVADEFT

SEQ ID NO: 62276 - protein, 13 aa, Mycobacterium tuberculosis
IPTLFVVADEFTL

SEQ ID NO: 62277 - protein, 13 aa, Mycobacterium tuberculosis
PTLFVVADEFTLM

SEQ ID NO: 62278 - protein, 13 aa, Mycobacterium tuberculosis
TLFVVADEFTLML

SEQ ID NO: 62279 - protein, 13 aa, Mycobacterium tuberculosis
LFVVADEFTLMLA

SEQ ID NO: 62280 - protein, 13 aa, Mycobacterium tuberculosis
FVVADEFTLMLAD

SEQ ID NO: 62281 - protein, 13 aa, Mycobacterium tuberculosis
VVADEFTLMLADH

SEQ ID NO: 62282 - protein, 13 aa, Mycobacterium tuberculosis
VADEFTLMLADHP

SEQ ID NO: 62283 - protein, 13 aa, Mycobacterium tuberculosis
ADEFTLMLADHPE

SEQ ID NO: 62284 - protein, 13 aa, Mycobacterium tuberculosis
DEFTLMLADHPEY

SEQ ID NO: 62285 - protein, 13 aa, Mycobacterium tuberculosis
EFTLMLADHPEYA

SEQ ID NO: 62286 - protein, 13 aa, Mycobacterium tuberculosis
FTLMLADHPEYAE

SEQ ID NO: 62287 - protein, 13 aa, Mycobacterium tuberculosis
TLMLADHPEYAEL

SEQ ID NO: 62288 - protein, 13 aa, Mycobacterium tuberculosis
LMLADHPEYAELF

SEQ ID NO: 62289 - protein, 13 aa, Mycobacterium tuberculosis
MLADHPEYAELFD

SEQ ID NO: 62290 - protein, 13 aa, Mycobacterium tuberculosis
LADHPEYAELFDY

SEQ ID NO: 62291 - protein, 13 aa, Mycobacterium tuberculosis
ADHPEYAELFDYV

SEQ ID NO: 62292 - protein, 13 aa, Mycobacterium tuberculosis
DHPEYAELFDYVA

SEQ ID NO: 62293 - protein, 13 aa, Mycobacterium tuberculosis
HPEYAELFDYVAR

SEQ ID NO: 62294 - protein, 13 aa, Mycobacterium tuberculosis
PEYAELFDYVARK

SEQ ID NO: 62295 - protein, 13 aa, Mycobacterium tuberculosis
EYAELFDYVARKG

SEQ ID NO: 62296 - protein, 13 aa, Mycobacterium tuberculosis
YAELFDYVARKGR

SEQ ID NO: 62297 - protein, 13 aa, Mycobacterium tuberculosis
AELFDYVARKGRS

SEQ ID NO: 62298 - protein, 13 aa, Mycobacterium tuberculosis
ELFDYVARKGRSF

SEQ ID NO: 62299 - protein, 13 aa, Mycobacterium tuberculosis
LFDYVARKGRSFR

SEQ ID NO: 62300 - protein, 13 aa, Mycobacterium tuberculosis
FDYVARKGRSFRI

SEQ ID NO: 62301 - protein, 13 aa, Mycobacterium tuberculosis
DYVARKGRSFRIH

SEQ ID NO: 62302 - protein, 13 aa, Mycobacterium tuberculosis
YVARKGRSFRIHI

SEQ ID NO: 62303 - protein, 13 aa, Mycobacterium tuberculosis
VARKGRSFRIHIL

SEQ ID NO: 62304 - protein, 13 aa, Mycobacterium tuberculosis
ARKGRSFRIHILF

SEQ ID NO: 62305 - protein, 13 aa, Mycobacterium tuberculosis
RKGRSFRIHILFA

SEQ ID NO: 62306 - protein, 13 aa, Mycobacterium tuberculosis
KGRSFRIHILFAS

SEQ ID NO: 62307 - protein, 13 aa, Mycobacterium tuberculosis
GRSFRIHILFASQ

SEQ ID NO: 62308 - protein, 13 aa, Mycobacterium tuberculosis
RSFRIHILFASQT

SEQ ID NO: 62309 - protein, 13 aa, Mycobacterium tuberculosis
SFRIHILFASQTL

SEQ ID NO: 62310 - protein, 13 aa, Mycobacterium tuberculosis
FRIHILFASQTLD

SEQ ID NO: 62311 - protein, 13 aa, Mycobacterium tuberculosis
RIHILFASQTLDV

SEQ ID NO: 62312 - protein, 13 aa, Mycobacterium tuberculosis
IHILFASQTLDVG

SEQ ID NO: 62313 - protein, 13 aa, Mycobacterium tuberculosis
HILFASQTLDVGK

SEQ ID NO: 62314 - protein, 13 aa, Mycobacterium tuberculosis
ILFASQTLDVGKI

SEQ ID NO: 62315 - protein, 13 aa, Mycobacterium tuberculosis
LFASQTLDVGKIK

SEQ ID NO: 62316 - protein, 13 aa, Mycobacterium tuberculosis
FASQTLDVGKIKD

SEQ ID NO: 62317 - protein, 13 aa, Mycobacterium tuberculosis
ASQTLDVGKIKDI

SEQ ID NO: 62318 - protein, 13 aa, Mycobacterium tuberculosis
SQTLDVGKIKDID

SEQ ID NO: 62319 - protein, 13 aa, Mycobacterium tuberculosis
QTLDVGKIKDIDK

SEQ ID NO: 62320 - protein, 13 aa, Mycobacterium tuberculosis
TLDVGKIKDIDKN

SEQ ID NO: 62321 - protein, 13 aa, Mycobacterium tuberculosis
LDVGKIKDIDKNT

SEQ ID NO: 62322 - protein, 13 aa, Mycobacterium tuberculosis
DVGKIKDIDKNTA

SEQ ID NO: 62323 - protein, 13 aa, Mycobacterium tuberculosis
VGKIKDIDKNTAY

SEQ ID NO: 62324 - protein, 13 aa, Mycobacterium tuberculosis
GKIKDIDKNTAYR

SEQ ID NO: 62325 - protein, 13 aa, Mycobacterium tuberculosis
KIKDIDKNTAYRI

SEQ ID NO: 62326 - protein, 13 aa, Mycobacterium tuberculosis
IKDIDKNTAYRIG

SEQ ID NO: 62327 - protein, 13 aa, Mycobacterium tuberculosis
KDIDKNTAYRIGL

SEQ ID NO: 62328 - protein, 13 aa, Mycobacterium tuberculosis
DIDKNTAYRIGLK

SEQ ID NO: 62329 - protein, 13 aa, Mycobacterium tuberculosis
IDKNTAYRIGLKV

SEQ ID NO: 62330 - protein, 13 aa, Mycobacterium tuberculosis
DKNTAYRIGLKVA

SEQ ID NO: 62331 - protein, 13 aa, Mycobacterium tuberculosis
KNTAYRIGLKVAS

SEQ ID NO: 62332 - protein, 13 aa, Mycobacterium tuberculosis
NTAYRIGLKVASP

SEQ ID NO: 62333 - protein, 13 aa, Mycobacterium tuberculosis
TAYRIGLKVASPS

SEQ ID NO: 62334 - protein, 13 aa, Mycobacterium tuberculosis
AYRIGLKVASPSV

SEQ ID NO: 62335 - protein, 13 aa, Mycobacterium tuberculosis
YRIGLKVASPSVS

SEQ ID NO: 62336 - protein, 13 aa, Mycobacterium tuberculosis
RIGLKVASPSVSR

SEQ ID NO: 62337 - protein, 13 aa, Mycobacterium tuberculosis
IGLKVASPSVSRQ

SEQ ID NO: 62338 - protein, 13 aa, Mycobacterium tuberculosis
GLKVASPSVSRQI

SEQ ID NO: 62339 - protein, 13 aa, Mycobacterium tuberculosis
LKVASPSVSRQII

SEQ ID NO: 62340 - protein, 13 aa, Mycobacterium tuberculosis
KVASPSVSRQIIG

SEQ ID NO: 62341 - protein, 13 aa, Mycobacterium tuberculosis
VASPSVSRQIIGV

SEQ ID NO: 62342 - protein, 13 aa, Mycobacterium tuberculosis
ASPSVSRQIIGVE

SEQ ID NO: 62343 - protein, 13 aa, Mycobacterium tuberculosis
SPSVSRQIIGVED

SEQ ID NO: 62344 - protein, 13 aa, Mycobacterium tuberculosis
PSVSRQIIGVEDA

SEQ ID NO: 62345 - protein, 13 aa, Mycobacterium tuberculosis
SVSRQIIGVEDAY

SEQ ID NO: 62346 - protein, 13 aa, Mycobacterium tuberculosis
VSRQIIGVEDAYH

SEQ ID NO: 62347 - protein, 13 aa, Mycobacterium tuberculosis
SRQIIGVEDAYHI

SEQ ID NO: 62348 - protein, 13 aa, Mycobacterium tuberculosis
RQIIGVEDAYHIE

SEQ ID NO: 62349 - protein, 13 aa, Mycobacterium tuberculosis
QIIGVEDAYHIES

SEQ ID NO: 62350 - protein, 13 aa, Mycobacterium tuberculosis
IIGVEDAYHIESG

SEQ ID NO: 62351 - protein, 13 aa, Mycobacterium tuberculosis
IGVEDAYHIESGK

SEQ ID NO: 62352 - protein, 13 aa, Mycobacterium tuberculosis
GVEDAYHIESGKE

SEQ ID NO: 62353 - protein, 13 aa, Mycobacterium tuberculosis
VEDAYHIESGKEH

SEQ ID NO: 62354 - protein, 13 aa, Mycobacterium tuberculosis
EDAYHIESGKEHK

SEQ ID NO: 62355 - protein, 13 aa, Mycobacterium tuberculosis
DAYHIESGKEHKG

SEQ ID NO: 62356 - protein, 13 aa, Mycobacterium tuberculosis
AYHIESGKEHKGV

SEQ ID NO: 62357 - protein, 13 aa, Mycobacterium tuberculosis
YHIESGKEHKGVG

SEQ ID NO: 62358 - protein, 13 aa, Mycobacterium tuberculosis
HIESGKEHKGVGF

SEQ ID NO: 62359 - protein, 13 aa, Mycobacterium tuberculosis
IESGKEHKGVGFL

SEQ ID NO: 62360 - protein, 13 aa, Mycobacterium tuberculosis
ESGKEHKGVGFLV

SEQ ID NO: 62361 - protein, 13 aa, Mycobacterium tuberculosis
SGKEHKGVGFLVP

SEQ ID NO: 62362 - protein, 13 aa, Mycobacterium tuberculosis
GKEHKGVGFLVPA

SEQ ID NO: 62363 - protein, 13 aa, Mycobacterium tuberculosis
KEHKGVGFLVPAP

SEQ ID NO: 62364 - protein, 13 aa, Mycobacterium tuberculosis
EHKGVGFLVPAPG

SEQ ID NO: 62365 - protein, 13 aa, Mycobacterium tuberculosis
HKGVGFLVPAPGA

SEQ ID NO: 62366 - protein, 13 aa, Mycobacterium tuberculosis
KGVGFLVPAPGAT

SEQ ID NO: 62367 - protein, 13 aa, Mycobacterium tuberculosis
GVGFLVPAPGATP

SEQ ID NO: 62368 - protein, 13 aa, Mycobacterium tuberculosis
VGFLVPAPGATPI

SEQ ID NO: 62369 - protein, 13 aa, Mycobacterium tuberculosis
GFLVPAPGATPIR

SEQ ID NO: 62370 - protein, 13 aa, Mycobacterium tuberculosis
FLVPAPGATPIRF

SEQ ID NO: 62371 - protein, 13 aa, Mycobacterium tuberculosis
LVPAPGATPIRFR

SEQ ID NO: 62372 - protein, 13 aa, Mycobacterium tuberculosis
VPAPGATPIRFRS

SEQ ID NO: 62373 - protein, 13 aa, Mycobacterium tuberculosis
PAPGATPIRFRST

SEQ ID NO: 62374 - protein, 13 aa, Mycobacterium tuberculosis
APGATPIRFRSTY

SEQ ID NO: 62375 - protein, 13 aa, Mycobacterium tuberculosis
PGATPIRFRSTYV

SEQ ID NO: 62376 - protein, 13 aa, Mycobacterium tuberculosis
GATPIRFRSTYVD

SEQ ID NO: 62377 - protein, 13 aa, Mycobacterium tuberculosis
ATPIRFRSTYVDG

SEQ ID NO: 62378 - protein, 13 aa, Mycobacterium tuberculosis
TPIRFRSTYVDGI

SEQ ID NO: 62379 - protein, 13 aa, Mycobacterium tuberculosis
PIRFRSTYVDGIY

SEQ ID NO: 62380 - protein, 13 aa, Mycobacterium tuberculosis
IRFRSTYVDGIYE

SEQ ID NO: 62381 - protein, 13 aa, Mycobacterium tuberculosis
RFRSTYVDGIYEP

SEQ ID NO: 62382 - protein, 13 aa, Mycobacterium tuberculosis
FRSTYVDGIYEPP

SEQ ID NO: 62383 - protein, 13 aa, Mycobacterium tuberculosis
RSTYVDGIYEPPQ

SEQ ID NO: 62384 - protein, 13 aa, Mycobacterium tuberculosis
STYVDGIYEPPQT

SEQ ID NO: 62385 - protein, 13 aa, Mycobacterium tuberculosis
TYVDGIYEPPQTA

SEQ ID NO: 62386 - protein, 13 aa, Mycobacterium tuberculosis
YVDGIYEPPQTAK

SEQ ID NO: 62387 - protein, 13 aa, Mycobacterium tuberculosis
VDGIYEPPQTAKA

SEQ ID NO: 62388 - protein, 13 aa, Mycobacterium tuberculosis
DGIYEPPQTAKAV

SEQ ID NO: 62389 - protein, 13 aa, Mycobacterium tuberculosis
GIYEPPQTAKAVV

SEQ ID NO: 62390 - protein, 13 aa, Mycobacterium tuberculosis
IYEPPQTAKAVVV

SEQ ID NO: 62391 - protein, 13 aa, Mycobacterium tuberculosis
YEPPQTAKAVVVQ

SEQ ID NO: 62392 - protein, 13 aa, Mycobacterium tuberculosis
EPPQTAKAVVVQS

SEQ ID NO: 62393 - protein, 13 aa, Mycobacterium tuberculosis
PPQTAKAVVVQSV

SEQ ID NO: 62394 - protein, 13 aa, Mycobacterium tuberculosis
PQTAKAVVVQSVP

SEQ ID NO: 62395 - protein, 13 aa, Mycobacterium tuberculosis
QTAKAVVVQSVPE

SEQ ID NO: 62396 - protein, 13 aa, Mycobacterium tuberculosis
TAKAVVVQSVPEP

SEQ ID NO: 62397 - protein, 13 aa, Mycobacterium tuberculosis
AKAVVVQSVPEPK

SEQ ID NO: 62398 - protein, 13 aa, Mycobacterium tuberculosis
KAVVVQSVPEPKL

SEQ ID NO: 62399 - protein, 13 aa, Mycobacterium tuberculosis
AVVVQSVPEPKLF

SEQ ID NO: 62400 - protein, 13 aa, Mycobacterium tuberculosis
VVVQSVPEPKLFT

SEQ ID NO: 62401 - protein, 13 aa, Mycobacterium tuberculosis
VVQSVPEPKLFTA

SEQ ID NO: 62402 - protein, 13 aa, Mycobacterium tuberculosis
VQSVPEPKLFTAA

SEQ ID NO: 62403 - protein, 13 aa, Mycobacterium tuberculosis
QSVPEPKLFTAAA

SEQ ID NO: 62404 - protein, 13 aa, Mycobacterium tuberculosis
SVPEPKLFTAAAV

SEQ ID NO: 62405 - protein, 13 aa, Mycobacterium tuberculosis
VPEPKLFTAAAVE

SEQ ID NO: 62406 - protein, 13 aa, Mycobacterium tuberculosis
PEPKLFTAAAVEP

SEQ ID NO: 62407 - protein, 13 aa, Mycobacterium tuberculosis
EPKLFTAAAVEPD

SEQ ID NO: 62408 - protein, 13 aa, Mycobacterium tuberculosis
PKLFTAAAVEPDP

SEQ ID NO: 62409 - protein, 13 aa, Mycobacterium tuberculosis
KLFTAAAVEPDPG

SEQ ID NO: 62410 - protein, 13 aa, Mycobacterium tuberculosis
LFTAAAVEPDPGT

SEQ ID NO: 62411 - protein, 13 aa, Mycobacterium tuberculosis
FTAAAVEPDPGTV

SEQ ID NO: 62412 - protein, 13 aa, Mycobacterium tuberculosis
TAAAVEPDPGTVI

SEQ ID NO: 62413 - protein, 13 aa, Mycobacterium tuberculosis
AAAVEPDPGTVIA

SEQ ID NO: 62414 - protein, 13 aa, Mycobacterium tuberculosis
AAVEPDPGTVIAD

SEQ ID NO: 62415 - protein, 13 aa, Mycobacterium tuberculosis
AVEPDPGTVIADT

SEQ ID NO: 62416 - protein, 13 aa, Mycobacterium tuberculosis
VEPDPGTVIADTD

SEQ ID NO: 62417 - protein, 13 aa, Mycobacterium tuberculosis
EPDPGTVIADTDE

SEQ ID NO: 62418 - protein, 13 aa, Mycobacterium tuberculosis
PDPGTVIADTDEQ

SEQ ID NO: 62419 - protein, 13 aa, Mycobacterium tuberculosis
DPGTVIADTDEQE

SEQ ID NO: 62420 - protein, 13 aa, Mycobacterium tuberculosis
PGTVIADTDEQEP

SEQ ID NO: 62421 - protein, 13 aa, Mycobacterium tuberculosis
GTVIADTDEQEPA

SEQ ID NO: 62422 - protein, 13 aa, Mycobacterium tuberculosis
TVIADTDEQEPAD

SEQ ID NO: 62423 - protein, 13 aa, Mycobacterium tuberculosis
VIADTDEQEPADP

SEQ ID NO: 62424 - protein, 13 aa, Mycobacterium tuberculosis
IADTDEQEPADPP

SEQ ID NO: 62425 - protein, 13 aa, Mycobacterium tuberculosis
ADTDEQEPADPPR

SEQ ID NO: 62426 - protein, 13 aa, Mycobacterium tuberculosis
DTDEQEPADPPRK

SEQ ID NO: 62427 - protein, 13 aa, Mycobacterium tuberculosis
TDEQEPADPPRKL

SEQ ID NO: 62428 - protein, 13 aa, Mycobacterium tuberculosis
DEQEPADPPRKLI

SEQ ID NO: 62429 - protein, 13 aa, Mycobacterium tuberculosis
EQEPADPPRKLIA

SEQ ID NO: 62430 - protein, 13 aa, Mycobacterium tuberculosis
QEPADPPRKLIAT

SEQ ID NO: 62431 - protein, 13 aa, Mycobacterium tuberculosis
EPADPPRKLIATI

SEQ ID NO: 62432 - protein, 13 aa, Mycobacterium tuberculosis
PADPPRKLIATIG

SEQ ID NO: 62433 - protein, 13 aa, Mycobacterium tuberculosis
ADPPRKLIATIGE

SEQ ID NO: 62434 - protein, 13 aa, Mycobacterium tuberculosis
DPPRKLIATIGEQ

SEQ ID NO: 62435 - protein, 13 aa, Mycobacterium tuberculosis
PPRKLIATIGEQL

SEQ ID NO: 62436 - protein, 13 aa, Mycobacterium tuberculosis
PRKLIATIGEQLA

SEQ ID NO: 62437 - protein, 13 aa, Mycobacterium tuberculosis
RKLIATIGEQLAR

SEQ ID NO: 62438 - protein, 13 aa, Mycobacterium tuberculosis
KLIATIGEQLARY

SEQ ID NO: 62439 - protein, 13 aa, Mycobacterium tuberculosis
LIATIGEQLARYG

SEQ ID NO: 62440 - protein, 13 aa, Mycobacterium tuberculosis
IATIGEQLARYGP

SEQ ID NO: 62441 - protein, 13 aa, Mycobacterium tuberculosis
ATIGEQLARYGPR

SEQ ID NO: 62442 - protein, 13 aa, Mycobacterium tuberculosis
TIGEQLARYGPRA

SEQ ID NO: 62443 - protein, 13 aa, Mycobacterium tuberculosis
IGEQLARYGPRAP

SEQ ID NO: 62444 - protein, 13 aa, Mycobacterium tuberculosis
GEQLARYGPRAPQ

SEQ ID NO: 62445 - protein, 13 aa, Mycobacterium tuberculosis
EQLARYGPRAPQL

SEQ ID NO: 62446 - protein, 13 aa, Mycobacterium tuberculosis
QLARYGPRAPQLW

SEQ ID NO: 62447 - protein, 13 aa, Mycobacterium tuberculosis
LARYGPRAPQLWL

SEQ ID NO: 62448 - protein, 13 aa, Mycobacterium tuberculosis
ARYGPRAPQLWLP

SEQ ID NO: 62449 - protein, 13 aa, Mycobacterium tuberculosis
RYGPRAPQLWLPP

SEQ ID NO: 62450 - protein, 13 aa, Mycobacterium tuberculosis
YGPRAPQLWLPPL

SEQ ID NO: 62451 - protein, 13 aa, Mycobacterium tuberculosis
GPRAPQLWLPPLD

SEQ ID NO: 62452 - protein, 13 aa, Mycobacterium tuberculosis
PRAPQLWLPPLDE

SEQ ID NO: 62453 - protein, 13 aa, Mycobacterium tuberculosis
RAPQLWLPPLDET

SEQ ID NO: 62454 - protein, 13 aa, Mycobacterium tuberculosis
APQLWLPPLDETI

SEQ ID NO: 62455 - protein, 13 aa, Mycobacterium tuberculosis
PQLWLPPLDETIP

SEQ ID NO: 62456 - protein, 13 aa, Mycobacterium tuberculosis
QLWLPPLDETIPL

SEQ ID NO: 62457 - protein, 13 aa, Mycobacterium tuberculosis
LWLPPLDETIPLS

SEQ ID NO: 62458 - protein, 13 aa, Mycobacterium tuberculosis
WLPPLDETIPLSA

SEQ ID NO: 62459 - protein, 13 aa, Mycobacterium tuberculosis
LPPLDETIPLSAA

SEQ ID NO: 62460 - protein, 13 aa, Mycobacterium tuberculosis
PPLDETIPLSAAL

SEQ ID NO: 62461 - protein, 13 aa, Mycobacterium tuberculosis
PLDETIPLSAALA

SEQ ID NO: 62462 - protein, 13 aa, Mycobacterium tuberculosis
LDETIPLSAALAR

SEQ ID NO: 62463 - protein, 13 aa, Mycobacterium tuberculosis
DETIPLSAALARA

SEQ ID NO: 62464 - protein, 13 aa, Mycobacterium tuberculosis
ETIPLSAALARAG

SEQ ID NO: 62465 - protein, 13 aa, Mycobacterium tuberculosis
TIPLSAALARAGV

SEQ ID NO: 62466 - protein, 13 aa, Mycobacterium tuberculosis
IPLSAALARAGVG

SEQ ID NO: 62467 - protein, 13 aa, Mycobacterium tuberculosis
PLSAALARAGVGP

SEQ ID NO: 62468 - protein, 13 aa, Mycobacterium tuberculosis
LSAALARAGVGPR

SEQ ID NO: 62469 - protein, 13 aa, Mycobacterium tuberculosis
SAALARAGVGPRQ

SEQ ID NO: 62470 - protein, 13 aa, Mycobacterium tuberculosis
AALARAGVGPRQW

SEQ ID NO: 62471 - protein, 13 aa, Mycobacterium tuberculosis
ALARAGVGPRQWR

SEQ ID NO: 62472 - protein, 13 aa, Mycobacterium tuberculosis
LARAGVGPRQWRW

SEQ ID NO: 62473 - protein, 13 aa, Mycobacterium tuberculosis
ARAGVGPRQWRWP

SEQ ID NO: 62474 - protein, 13 aa, Mycobacterium tuberculosis
RAGVGPRQWRWPL

SEQ ID NO: 62475 - protein, 13 aa, Mycobacterium tuberculosis
AGVGPRQWRWPLG

SEQ ID NO: 62476 - protein, 13 aa, Mycobacterium tuberculosis
GVGPRQWRWPLGE

SEQ ID NO: 62477 - protein, 13 aa, Mycobacterium tuberculosis
VGPRQWRWPLGEI

SEQ ID NO: 62478 - protein, 13 aa, Mycobacterium tuberculosis
GPRQWRWPLGEID

SEQ ID NO: 62479 - protein, 13 aa, Mycobacterium tuberculosis
PRQWRWPLGEIDR

SEQ ID NO: 62480 - protein, 13 aa, Mycobacterium tuberculosis
RQWRWPLGEIDRP

SEQ ID NO: 62481 - protein, 13 aa, Mycobacterium tuberculosis
QWRWPLGEIDRPF

SEQ ID NO: 62482 - protein, 13 aa, Mycobacterium tuberculosis
WRWPLGEIDRPFE

SEQ ID NO: 62483 - protein, 13 aa, Mycobacterium tuberculosis
RWPLGEIDRPFEM

SEQ ID NO: 62484 - protein, 13 aa, Mycobacterium tuberculosis
WPLGEIDRPFEMR

SEQ ID NO: 62485 - protein, 13 aa, Mycobacterium tuberculosis
PLGEIDRPFEMRR

SEQ ID NO: 62486 - protein, 13 aa, Mycobacterium tuberculosis
LGEIDRPFEMRRD

SEQ ID NO: 62487 - protein, 13 aa, Mycobacterium tuberculosis
GEIDRPFEMRRDP

SEQ ID NO: 62488 - protein, 13 aa, Mycobacterium tuberculosis
EIDRPFEMRRDPL

SEQ ID NO: 62489 - protein, 13 aa, Mycobacterium tuberculosis
IDRPFEMRRDPLV

SEQ ID NO: 62490 - protein, 13 aa, Mycobacterium tuberculosis
DRPFEMRRDPLVF

SEQ ID NO: 62491 - protein, 13 aa, Mycobacterium tuberculosis
RPFEMRRDPLVFD

SEQ ID NO: 62492 - protein, 13 aa, Mycobacterium tuberculosis
PFEMRRDPLVFDA

SEQ ID NO: 62493 - protein, 13 aa, Mycobacterium tuberculosis
FEMRRDPLVFDAR

SEQ ID NO: 62494 - protein, 13 aa, Mycobacterium tuberculosis
EMRRDPLVFDARS

SEQ ID NO: 62495 - protein, 13 aa, Mycobacterium tuberculosis
MRRDPLVFDARSS

SEQ ID NO: 62496 - protein, 13 aa, Mycobacterium tuberculosis
RRDPLVFDARSSA

SEQ ID NO: 62497 - protein, 13 aa, Mycobacterium tuberculosis
RDPLVFDARSSAG

SEQ ID NO: 62498 - protein, 13 aa, Mycobacterium tuberculosis
DPLVFDARSSAGN

SEQ ID NO: 62499 - protein, 13 aa, Mycobacterium tuberculosis
PLVFDARSSAGNM

SEQ ID NO: 62500 - protein, 13 aa, Mycobacterium tuberculosis
LVFDARSSAGNMV

SEQ ID NO: 62501 - protein, 13 aa, Mycobacterium tuberculosis
VFDARSSAGNMVI

SEQ ID NO: 62502 - protein, 13 aa, Mycobacterium tuberculosis
FDARSSAGNMVIH

SEQ ID NO: 62503 - protein, 13 aa, Mycobacterium tuberculosis
DARSSAGNMVIHG

SEQ ID NO: 62504 - protein, 13 aa, Mycobacterium tuberculosis
ARSSAGNMVIHGG

SEQ ID NO: 62505 - protein, 13 aa, Mycobacterium tuberculosis
RSSAGNMVIHGGP

SEQ ID NO: 62506 - protein, 13 aa, Mycobacterium tuberculosis
SSAGNMVIHGGPK

SEQ ID NO: 62507 - protein, 13 aa, Mycobacterium tuberculosis
SAGNMVIHGGPKS

SEQ ID NO: 62508 - protein, 13 aa, Mycobacterium tuberculosis
AGNMVIHGGPKSG

SEQ ID NO: 62509 - protein, 13 aa, Mycobacterium tuberculosis
GNMVIHGGPKSGK

SEQ ID NO: 62510 - protein, 13 aa, Mycobacterium tuberculosis
NMVIHGGPKSGKS

SEQ ID NO: 62511 - protein, 13 aa, Mycobacterium tuberculosis
MVIHGGPKSGKST

SEQ ID NO: 62512 - protein, 13 aa, Mycobacterium tuberculosis
VIHGGPKSGKSTA

SEQ ID NO: 62513 - protein, 13 aa, Mycobacterium tuberculosis
IHGGPKSGKSTAL

SEQ ID NO: 62514 - protein, 13 aa, Mycobacterium tuberculosis
HGGPKSGKSTALQ

SEQ ID NO: 62515 - protein, 13 aa, Mycobacterium tuberculosis
GGPKSGKSTALQT

SEQ ID NO: 62516 - protein, 13 aa, Mycobacterium tuberculosis
GPKSGKSTALQTF

SEQ ID NO: 62517 - protein, 13 aa, Mycobacterium tuberculosis
PKSGKSTALQTFI

SEQ ID NO: 62518 - protein, 13 aa, Mycobacterium tuberculosis
KSGKSTALQTFIL

SEQ ID NO: 62519 - protein, 13 aa, Mycobacterium tuberculosis
SGKSTALQTFILS

SEQ ID NO: 62520 - protein, 13 aa, Mycobacterium tuberculosis
GKSTALQTFILSA

SEQ ID NO: 62521 - protein, 13 aa, Mycobacterium tuberculosis
KSTALQTFILSAA

SEQ ID NO: 62522 - protein, 13 aa, Mycobacterium tuberculosis
STALQTFILSAAS

SEQ ID NO: 62523 - protein, 13 aa, Mycobacterium tuberculosis
TALQTFILSAASL

SEQ ID NO: 62524 - protein, 13 aa, Mycobacterium tuberculosis
ALQTFILSAASLH

SEQ ID NO: 62525 - protein, 13 aa, Mycobacterium tuberculosis
LQTFILSAASLHS

SEQ ID NO: 62526 - protein, 13 aa, Mycobacterium tuberculosis
QTFILSAASLHSP

SEQ ID NO: 62527 - protein, 13 aa, Mycobacterium tuberculosis
TFILSAASLHSPH

SEQ ID NO: 62528 - protein, 13 aa, Mycobacterium tuberculosis
FILSAASLHSPHE

SEQ ID NO: 62529 - protein, 13 aa, Mycobacterium tuberculosis
ILSAASLHSPHEV

SEQ ID NO: 62530 - protein, 13 aa, Mycobacterium tuberculosis
LSAASLHSPHEVS

SEQ ID NO: 62531 - protein, 13 aa, Mycobacterium tuberculosis
SAASLHSPHEVSF

SEQ ID NO: 62532 - protein, 13 aa, Mycobacterium tuberculosis
AASLHSPHEVSFY

SEQ ID NO: 62533 - protein, 13 aa, Mycobacterium tuberculosis
ASLHSPHEVSFYC

SEQ ID NO: 62534 - protein, 13 aa, Mycobacterium tuberculosis
SLHSPHEVSFYCL

SEQ ID NO: 62535 - protein, 13 aa, Mycobacterium tuberculosis
LHSPHEVSFYCLD

SEQ ID NO: 62536 - protein, 13 aa, Mycobacterium tuberculosis
HSPHEVSFYCLDY

SEQ ID NO: 62537 - protein, 13 aa, Mycobacterium tuberculosis
SPHEVSFYCLDYG

SEQ ID NO: 62538 - protein, 13 aa, Mycobacterium tuberculosis
PHEVSFYCLDYGG

SEQ ID NO: 62539 - protein, 13 aa, Mycobacterium tuberculosis
HEVSFYCLDYGGG

SEQ ID NO: 62540 - protein, 13 aa, Mycobacterium tuberculosis
EVSFYCLDYGGGQ

SEQ ID NO: 62541 - protein, 13 aa, Mycobacterium tuberculosis
VSFYCLDYGGGQL

SEQ ID NO: 62542 - protein, 13 aa, Mycobacterium tuberculosis
SFYCLDYGGGQLR

SEQ ID NO: 62543 - protein, 13 aa, Mycobacterium tuberculosis
FYCLDYGGGQLRA

SEQ ID NO: 62544 - protein, 13 aa, Mycobacterium tuberculosis
YCLDYGGGQLRAL

SEQ ID NO: 62545 - protein, 13 aa, Mycobacterium tuberculosis
CLDYGGGQLRALQ

SEQ ID NO: 62546 - protein, 13 aa, Mycobacterium tuberculosis
LDYGGGQLRALQD

SEQ ID NO: 62547 - protein, 13 aa, Mycobacterium tuberculosis
DYGGGQLRALQDL

SEQ ID NO: 62548 - protein, 13 aa, Mycobacterium tuberculosis
YGGGQLRALQDLA

SEQ ID NO: 62549 - protein, 13 aa, Mycobacterium tuberculosis
GGGQLRALQDLAH

SEQ ID NO: 62550 - protein, 13 aa, Mycobacterium tuberculosis
GGQLRALQDLAHV

SEQ ID NO: 62551 - protein, 13 aa, Mycobacterium tuberculosis
GQLRALQDLAHVG

SEQ ID NO: 62552 - protein, 13 aa, Mycobacterium tuberculosis
QLRALQDLAHVGS

SEQ ID NO: 62553 - protein, 13 aa, Mycobacterium tuberculosis
LRALQDLAHVGSV

SEQ ID NO: 62554 - protein, 13 aa, Mycobacterium tuberculosis
RALQDLAHVGSVA

SEQ ID NO: 62555 - protein, 13 aa, Mycobacterium tuberculosis
ALQDLAHVGSVAS

SEQ ID NO: 62556 - protein, 13 aa, Mycobacterium tuberculosis
LQDLAHVGSVASA

SEQ ID NO: 62557 - protein, 13 aa, Mycobacterium tuberculosis
QDLAHVGSVASAL

SEQ ID NO: 62558 - protein, 13 aa, Mycobacterium tuberculosis
DLAHVGSVASALE

SEQ ID NO: 62559 - protein, 13 aa, Mycobacterium tuberculosis
LAHVGSVASALEP

SEQ ID NO: 62560 - protein, 13 aa, Mycobacterium tuberculosis
AHVGSVASALEPE

SEQ ID NO: 62561 - protein, 13 aa, Mycobacterium tuberculosis
HVGSVASALEPER

SEQ ID NO: 62562 - protein, 13 aa, Mycobacterium tuberculosis
VGSVASALEPERI

SEQ ID NO: 62563 - protein, 13 aa, Mycobacterium tuberculosis
GSVASALEPERIR

SEQ ID NO: 62564 - protein, 13 aa, Mycobacterium tuberculosis
SVASALEPERIRR

SEQ ID NO: 62565 - protein, 13 aa, Mycobacterium tuberculosis
VASALEPERIRRT

SEQ ID NO: 62566 - protein, 13 aa, Mycobacterium tuberculosis
ASALEPERIRRTF

SEQ ID NO: 62567 - protein, 13 aa, Mycobacterium tuberculosis
SALEPERIRRTFG

SEQ ID NO: 62568 - protein, 13 aa, Mycobacterium tuberculosis
ALEPERIRRTFGE

SEQ ID NO: 62569 - protein, 13 aa, Mycobacterium tuberculosis
LEPERIRRTFGEL

SEQ ID NO: 62570 - protein, 13 aa, Mycobacterium tuberculosis
EPERIRRTFGELE

SEQ ID NO: 62571 - protein, 13 aa, Mycobacterium tuberculosis
PERIRRTFGELEQ

SEQ ID NO: 62572 - protein, 13 aa, Mycobacterium tuberculosis
ERIRRTFGELEQL

SEQ ID NO: 62573 - protein, 13 aa, Mycobacterium tuberculosis
RIRRTFGELEQLL

SEQ ID NO: 62574 - protein, 13 aa, Mycobacterium tuberculosis
IRRTFGELEQLLL

SEQ ID NO: 62575 - protein, 13 aa, Mycobacterium tuberculosis
RRTFGELEQLLLS

SEQ ID NO: 62576 - protein, 13 aa, Mycobacterium tuberculosis
RTFGELEQLLLSR

SEQ ID NO: 62577 - protein, 13 aa, Mycobacterium tuberculosis
TFGELEQLLLSRQ

SEQ ID NO: 62578 - protein, 13 aa, Mycobacterium tuberculosis
FGELEQLLLSRQQ

SEQ ID NO: 62579 - protein, 13 aa, Mycobacterium tuberculosis
GELEQLLLSRQQR

SEQ ID NO: 62580 - protein, 13 aa, Mycobacterium tuberculosis
ELEQLLLSRQQRE

SEQ ID NO: 62581 - protein, 13 aa, Mycobacterium tuberculosis
LEQLLLSRQQREV

SEQ ID NO: 62582 - protein, 13 aa, Mycobacterium tuberculosis
EQLLLSRQQREVF

SEQ ID NO: 62583 - protein, 13 aa, Mycobacterium tuberculosis
QLLLSRQQREVFR

SEQ ID NO: 62584 - protein, 13 aa, Mycobacterium tuberculosis
LLLSRQQREVFRD

SEQ ID NO: 62585 - protein, 13 aa, Mycobacterium tuberculosis
LLSRQQREVFRDR

SEQ ID NO: 62586 - protein, 13 aa, Mycobacterium tuberculosis
LSRQQREVFRDRG

SEQ ID NO: 62587 - protein, 13 aa, Mycobacterium tuberculosis
SRQQREVFRDRGA

SEQ ID NO: 62588 - protein, 13 aa, Mycobacterium tuberculosis
RQQREVFRDRGAN

SEQ ID NO: 62589 - protein, 13 aa, Mycobacterium tuberculosis
QQREVFRDRGANG

SEQ ID NO: 62590 - protein, 13 aa, Mycobacterium tuberculosis
QREVFRDRGANGS

SEQ ID NO: 62591 - protein, 13 aa, Mycobacterium tuberculosis
REVFRDRGANGST

SEQ ID NO: 62592 - protein, 13 aa, Mycobacterium tuberculosis
EVFRDRGANGSTP

SEQ ID NO: 62593 - protein, 13 aa, Mycobacterium tuberculosis
VFRDRGANGSTPD

SEQ ID NO: 62594 - protein, 13 aa, Mycobacterium tuberculosis
FRDRGANGSTPDD

SEQ ID NO: 62595 - protein, 13 aa, Mycobacterium tuberculosis
RDRGANGSTPDDG

SEQ ID NO: 62596 - protein, 13 aa, Mycobacterium tuberculosis
DRGANGSTPDDGF

SEQ ID NO: 62597 - protein, 13 aa, Mycobacterium tuberculosis
RGANGSTPDDGFG

SEQ ID NO: 62598 - protein, 13 aa, Mycobacterium tuberculosis
GANGSTPDDGFGE

SEQ ID NO: 62599 - protein, 13 aa, Mycobacterium tuberculosis
ANGSTPDDGFGEV

SEQ ID NO: 62600 - protein, 13 aa, Mycobacterium tuberculosis
NGSTPDDGFGEVF

SEQ ID NO: 62601 - protein, 13 aa, Mycobacterium tuberculosis
GSTPDDGFGEVFL

SEQ ID NO: 62602 - protein, 13 aa, Mycobacterium tuberculosis
STPDDGFGEVFLV

SEQ ID NO: 62603 - protein, 13 aa, Mycobacterium tuberculosis
TPDDGFGEVFLVI

SEQ ID NO: 62604 - protein, 13 aa, Mycobacterium tuberculosis
PDDGFGEVFLVID

SEQ ID NO: 62605 - protein, 13 aa, Mycobacterium tuberculosis
DDGFGEVFLVIDN

SEQ ID NO: 62606 - protein, 13 aa, Mycobacterium tuberculosis
DGFGEVFLVIDNL

SEQ ID NO: 62607 - protein, 13 aa, Mycobacterium tuberculosis
GFGEVFLVIDNLY

SEQ ID NO: 62608 - protein, 13 aa, Mycobacterium tuberculosis
FGEVFLVIDNLYG

SEQ ID NO: 62609 - protein, 13 aa, Mycobacterium tuberculosis
GEVFLVIDNLYGF

SEQ ID NO: 62610 - protein, 13 aa, Mycobacterium tuberculosis
EVFLVIDNLYGFG

SEQ ID NO: 62611 - protein, 13 aa, Mycobacterium tuberculosis
VFLVIDNLYGFGR

SEQ ID NO: 62612 - protein, 13 aa, Mycobacterium tuberculosis
FLVIDNLYGFGRD

SEQ ID NO: 62613 - protein, 13 aa, Mycobacterium tuberculosis
LVIDNLYGFGRDN

SEQ ID NO: 62614 - protein, 13 aa, Mycobacterium tuberculosis
VIDNLYGFGRDNT

SEQ ID NO: 62615 - protein, 13 aa, Mycobacterium tuberculosis
IDNLYGFGRDNTD

SEQ ID NO: 62616 - protein, 13 aa, Mycobacterium tuberculosis
DNLYGFGRDNTDQ

SEQ ID NO: 62617 - protein, 13 aa, Mycobacterium tuberculosis
NLYGFGRDNTDQF

SEQ ID NO: 62618 - protein, 13 aa, Mycobacterium tuberculosis
LYGFGRDNTDQFN

SEQ ID NO: 62619 - protein, 13 aa, Mycobacterium tuberculosis
YGFGRDNTDQFNT

SEQ ID NO: 62620 - protein, 13 aa, Mycobacterium tuberculosis
GFGRDNTDQFNTR

SEQ ID NO: 62621 - protein, 13 aa, Mycobacterium tuberculosis
FGRDNTDQFNTRN

SEQ ID NO: 62622 - protein, 13 aa, Mycobacterium tuberculosis
GRDNTDQFNTRNP

SEQ ID NO: 62623 - protein, 13 aa, Mycobacterium tuberculosis
RDNTDQFNTRNPL

SEQ ID NO: 62624 - protein, 13 aa, Mycobacterium tuberculosis
DNTDQFNTRNPLL

SEQ ID NO: 62625 - protein, 13 aa, Mycobacterium tuberculosis
NTDQFNTRNPLLA

SEQ ID NO: 62626 - protein, 13 aa, Mycobacterium tuberculosis
TDQFNTRNPLLAR

SEQ ID NO: 62627 - protein, 13 aa, Mycobacterium tuberculosis
DQFNTRNPLLARV

SEQ ID NO: 62628 - protein, 13 aa, Mycobacterium tuberculosis
QFNTRNPLLARVT

SEQ ID NO: 62629 - protein, 13 aa, Mycobacterium tuberculosis
FNTRNPLLARVTE

SEQ ID NO: 62630 - protein, 13 aa, Mycobacterium tuberculosis
NTRNPLLARVTEL

SEQ ID NO: 62631 - protein, 13 aa, Mycobacterium tuberculosis
TRNPLLARVTELV

SEQ ID NO: 62632 - protein, 13 aa, Mycobacterium tuberculosis
RNPLLARVTELVN

SEQ ID NO: 62633 - protein, 13 aa, Mycobacterium tuberculosis
NPLLARVTELVNV

SEQ ID NO: 62634 - protein, 13 aa, Mycobacterium tuberculosis
PLLARVTELVNVG

SEQ ID NO: 62635 - protein, 13 aa, Mycobacterium tuberculosis
LLARVTELVNVGL

SEQ ID NO: 62636 - protein, 13 aa, Mycobacterium tuberculosis
LARVTELVNVGLA

SEQ ID NO: 62637 - protein, 13 aa, Mycobacterium tuberculosis
ARVTELVNVGLAY

SEQ ID NO: 62638 - protein, 13 aa, Mycobacterium tuberculosis
RVTELVNVGLAYG

SEQ ID NO: 62639 - protein, 13 aa, Mycobacterium tuberculosis
VTELVNVGLAYGI

SEQ ID NO: 62640 - protein, 13 aa, Mycobacterium tuberculosis
TELVNVGLAYGIH

SEQ ID NO: 62641 - protein, 13 aa, Mycobacterium tuberculosis
ELVNVGLAYGIHV

SEQ ID NO: 62642 - protein, 13 aa, Mycobacterium tuberculosis
LVNVGLAYGIHVI

SEQ ID NO: 62643 - protein, 13 aa, Mycobacterium tuberculosis
VNVGLAYGIHVII

SEQ ID NO: 62644 - protein, 13 aa, Mycobacterium tuberculosis
NVGLAYGIHVIIT

SEQ ID NO: 62645 - protein, 13 aa, Mycobacterium tuberculosis
VGLAYGIHVIITT

SEQ ID NO: 62646 - protein, 13 aa, Mycobacterium tuberculosis
GLAYGIHVIITTP

SEQ ID NO: 62647 - protein, 13 aa, Mycobacterium tuberculosis
LAYGIHVIITTPS

SEQ ID NO: 62648 - protein, 13 aa, Mycobacterium tuberculosis
AYGIHVIITTPSW

SEQ ID NO: 62649 - protein, 13 aa, Mycobacterium tuberculosis
YGIHVIITTPSWL

SEQ ID NO: 62650 - protein, 13 aa, Mycobacterium tuberculosis
GIHVIITTPSWLE

SEQ ID NO: 62651 - protein, 13 aa, Mycobacterium tuberculosis
IHVIITTPSWLEV

SEQ ID NO: 62652 - protein, 13 aa, Mycobacterium tuberculosis
HVIITTPSWLEVP

SEQ ID NO: 62653 - protein, 13 aa, Mycobacterium tuberculosis
VIITTPSWLEVPL

SEQ ID NO: 62654 - protein, 13 aa, Mycobacterium tuberculosis
IITTPSWLEVPLA

SEQ ID NO: 62655 - protein, 13 aa, Mycobacterium tuberculosis
ITTPSWLEVPLAM

SEQ ID NO: 62656 - protein, 13 aa, Mycobacterium tuberculosis
TTPSWLEVPLAMR

SEQ ID NO: 62657 - protein, 13 aa, Mycobacterium tuberculosis
TPSWLEVPLAMRD

SEQ ID NO: 62658 - protein, 13 aa, Mycobacterium tuberculosis
PSWLEVPLAMRDG

SEQ ID NO: 62659 - protein, 13 aa, Mycobacterium tuberculosis
SWLEVPLAMRDGL

SEQ ID NO: 62660 - protein, 13 aa, Mycobacterium tuberculosis
WLEVPLAMRDGLG

SEQ ID NO: 62661 - protein, 13 aa, Mycobacterium tuberculosis
LEVPLAMRDGLGL

SEQ ID NO: 62662 - protein, 13 aa, Mycobacterium tuberculosis
EVPLAMRDGLGLR

SEQ ID NO: 62663 - protein, 13 aa, Mycobacterium tuberculosis
VPLAMRDGLGLRL

SEQ ID NO: 62664 - protein, 13 aa, Mycobacterium tuberculosis
PLAMRDGLGLRLE

SEQ ID NO: 62665 - protein, 13 aa, Mycobacterium tuberculosis
LAMRDGLGLRLEL

SEQ ID NO: 62666 - protein, 13 aa, Mycobacterium tuberculosis
AMRDGLGLRLELR

SEQ ID NO: 62667 - protein, 13 aa, Mycobacterium tuberculosis
MRDGLGLRLELRL

SEQ ID NO: 62668 - protein, 13 aa, Mycobacterium tuberculosis
RDGLGLRLELRLH

SEQ ID NO: 62669 - protein, 13 aa, Mycobacterium tuberculosis
DGLGLRLELRLHD

SEQ ID NO: 62670 - protein, 13 aa, Mycobacterium tuberculosis
GLGLRLELRLHDA

SEQ ID NO: 62671 - protein, 13 aa, Mycobacterium tuberculosis
LGLRLELRLHDAR

SEQ ID NO: 62672 - protein, 13 aa, Mycobacterium tuberculosis
GLRLELRLHDARD

SEQ ID NO: 62673 - protein, 13 aa, Mycobacterium tuberculosis
LRLELRLHDARDS

SEQ ID NO: 62674 - protein, 13 aa, Mycobacterium tuberculosis
RLELRLHDARDSN

SEQ ID NO: 62675 - protein, 13 aa, Mycobacterium tuberculosis
LELRLHDARDSNV

SEQ ID NO: 62676 - protein, 13 aa, Mycobacterium tuberculosis
ELRLHDARDSNVR

SEQ ID NO: 62677 - protein, 13 aa, Mycobacterium tuberculosis
LRLHDARDSNVRV

SEQ ID NO: 62678 - protein, 13 aa, Mycobacterium tuberculosis
RLHDARDSNVRVV

SEQ ID NO: 62679 - protein, 13 aa, Mycobacterium tuberculosis
LHDARDSNVRVVG

SEQ ID NO: 62680 - protein, 13 aa, Mycobacterium tuberculosis
HDARDSNVRVVGA

SEQ ID NO: 62681 - protein, 13 aa, Mycobacterium tuberculosis
DARDSNVRVVGAL

SEQ ID NO: 62682 - protein, 13 aa, Mycobacterium tuberculosis
ARDSNVRVVGALR

SEQ ID NO: 62683 - protein, 13 aa, Mycobacterium tuberculosis
RDSNVRVVGALRR

SEQ ID NO: 62684 - protein, 13 aa, Mycobacterium tuberculosis
DSNVRVVGALRRP

SEQ ID NO: 62685 - protein, 13 aa, Mycobacterium tuberculosis
SNVRVVGALRRPA

SEQ ID NO: 62686 - protein, 13 aa, Mycobacterium tuberculosis
NVRVVGALRRPAD

SEQ ID NO: 62687 - protein, 13 aa, Mycobacterium tuberculosis
VRVVGALRRPADA

SEQ ID NO: 62688 - protein, 13 aa, Mycobacterium tuberculosis
RVVGALRRPADAV

SEQ ID NO: 62689 - protein, 13 aa, Mycobacterium tuberculosis
VVGALRRPADAVP

SEQ ID NO: 62690 - protein, 13 aa, Mycobacterium tuberculosis
VGALRRPADAVPH

SEQ ID NO: 62691 - protein, 13 aa, Mycobacterium tuberculosis
GALRRPADAVPHD

SEQ ID NO: 62692 - protein, 13 aa, Mycobacterium tuberculosis
ALRRPADAVPHDQ

SEQ ID NO: 62693 - protein, 13 aa, Mycobacterium tuberculosis
LRRPADAVPHDQP

SEQ ID NO: 62694 - protein, 13 aa, Mycobacterium tuberculosis
RRPADAVPHDQPG

SEQ ID NO: 62695 - protein, 13 aa, Mycobacterium tuberculosis
RPADAVPHDQPGR

SEQ ID NO: 62696 - protein, 13 aa, Mycobacterium tuberculosis
PADAVPHDQPGRG

SEQ ID NO: 62697 - protein, 13 aa, Mycobacterium tuberculosis
ADAVPHDQPGRGL

SEQ ID NO: 62698 - protein, 13 aa, Mycobacterium tuberculosis
DAVPHDQPGRGLT

SEQ ID NO: 62699 - protein, 13 aa, Mycobacterium tuberculosis
AVPHDQPGRGLTM

SEQ ID NO: 62700 - protein, 13 aa, Mycobacterium tuberculosis
VPHDQPGRGLTMA

SEQ ID NO: 62701 - protein, 13 aa, Mycobacterium tuberculosis
PHDQPGRGLTMAA

SEQ ID NO: 62702 - protein, 13 aa, Mycobacterium tuberculosis
HDQPGRGLTMAAE

SEQ ID NO: 62703 - protein, 13 aa, Mycobacterium tuberculosis
DQPGRGLTMAAEH

SEQ ID NO: 62704 - protein, 13 aa, Mycobacterium tuberculosis
QPGRGLTMAAEHF

SEQ ID NO: 62705 - protein, 13 aa, Mycobacterium tuberculosis
PGRGLTMAAEHFL

SEQ ID NO: 62706 - protein, 13 aa, Mycobacterium tuberculosis
GRGLTMAAEHFLF

SEQ ID NO: 62707 - protein, 13 aa, Mycobacterium tuberculosis
RGLTMAAEHFLFA

SEQ ID NO: 62708 - protein, 13 aa, Mycobacterium tuberculosis
GLTMAAEHFLFAA

SEQ ID NO: 62709 - protein, 13 aa, Mycobacterium tuberculosis
LTMAAEHFLFAAP

SEQ ID NO: 62710 - protein, 13 aa, Mycobacterium tuberculosis
TMAAEHFLFAAPE

SEQ ID NO: 62711 - protein, 13 aa, Mycobacterium tuberculosis
MAAEHFLFAAPEL

SEQ ID NO: 62712 - protein, 13 aa, Mycobacterium tuberculosis
AAEHFLFAAPELD

SEQ ID NO: 62713 - protein, 13 aa, Mycobacterium tuberculosis
AEHFLFAAPELDA

SEQ ID NO: 62714 - protein, 13 aa, Mycobacterium tuberculosis
EHFLFAAPELDAQ

SEQ ID NO: 62715 - protein, 13 aa, Mycobacterium tuberculosis
HFLFAAPELDAQT

SEQ ID NO: 62716 - protein, 13 aa, Mycobacterium tuberculosis
FLFAAPELDAQTN

SEQ ID NO: 62717 - protein, 13 aa, Mycobacterium tuberculosis
LFAAPELDAQTNP

SEQ ID NO: 62718 - protein, 13 aa, Mycobacterium tuberculosis
FAAPELDAQTNPV

SEQ ID NO: 62719 - protein, 13 aa, Mycobacterium tuberculosis
AAPELDAQTNPVA

SEQ ID NO: 62720 - protein, 13 aa, Mycobacterium tuberculosis
APELDAQTNPVAA

SEQ ID NO: 62721 - protein, 13 aa, Mycobacterium tuberculosis
PELDAQTNPVAAI

SEQ ID NO: 62722 - protein, 13 aa, Mycobacterium tuberculosis
ELDAQTNPVAAIN

SEQ ID NO: 62723 - protein, 13 aa, Mycobacterium tuberculosis
LDAQTNPVAAINA

SEQ ID NO: 62724 - protein, 13 aa, Mycobacterium tuberculosis
DAQTNPVAAINAR

SEQ ID NO: 62725 - protein, 13 aa, Mycobacterium tuberculosis
AQTNPVAAINARY

SEQ ID NO: 62726 - protein, 13 aa, Mycobacterium tuberculosis
QTNPVAAINARYP

SEQ ID NO: 62727 - protein, 13 aa, Mycobacterium tuberculosis
TNPVAAINARYPG

SEQ ID NO: 62728 - protein, 13 aa, Mycobacterium tuberculosis
NPVAAINARYPGM

SEQ ID NO: 62729 - protein, 13 aa, Mycobacterium tuberculosis
PVAAINARYPGMA

SEQ ID NO: 62730 - protein, 13 aa, Mycobacterium tuberculosis
VAAINARYPGMAA

SEQ ID NO: 62731 - protein, 13 aa, Mycobacterium tuberculosis
AAINARYPGMAAP

SEQ ID NO: 62732 - protein, 13 aa, Mycobacterium tuberculosis
AINARYPGMAAPP

SEQ ID NO: 62733 - protein, 13 aa, Mycobacterium tuberculosis
INARYPGMAAPPV

SEQ ID NO: 62734 - protein, 13 aa, Mycobacterium tuberculosis
NARYPGMAAPPVR

SEQ ID NO: 62735 - protein, 13 aa, Mycobacterium tuberculosis
ARYPGMAAPPVRL

SEQ ID NO: 62736 - protein, 13 aa, Mycobacterium tuberculosis
RYPGMAAPPVRLL

SEQ ID NO: 62737 - protein, 13 aa, Mycobacterium tuberculosis
YPGMAAPPVRLLP

SEQ ID NO: 62738 - protein, 13 aa, Mycobacterium tuberculosis
PGMAAPPVRLLPT

SEQ ID NO: 62739 - protein, 13 aa, Mycobacterium tuberculosis
GMAAPPVRLLPTN

SEQ ID NO: 62740 - protein, 13 aa, Mycobacterium tuberculosis
MAAPPVRLLPTNL

SEQ ID NO: 62741 - protein, 13 aa, Mycobacterium tuberculosis
AAPPVRLLPTNLA

SEQ ID NO: 62742 - protein, 13 aa, Mycobacterium tuberculosis
APPVRLLPTNLAP

SEQ ID NO: 62743 - protein, 13 aa, Mycobacterium tuberculosis
PPVRLLPTNLAPH

SEQ ID NO: 62744 - protein, 13 aa, Mycobacterium tuberculosis
PVRLLPTNLAPHA

SEQ ID NO: 62745 - protein, 13 aa, Mycobacterium tuberculosis
VRLLPTNLAPHAV

SEQ ID NO: 62746 - protein, 13 aa, Mycobacterium tuberculosis
RLLPTNLAPHAVG

SEQ ID NO: 62747 - protein, 13 aa, Mycobacterium tuberculosis
LLPTNLAPHAVGE

SEQ ID NO: 62748 - protein, 13 aa, Mycobacterium tuberculosis
LPTNLAPHAVGEL

SEQ ID NO: 62749 - protein, 13 aa, Mycobacterium tuberculosis
PTNLAPHAVGELY

SEQ ID NO: 62750 - protein, 13 aa, Mycobacterium tuberculosis
TNLAPHAVGELYR

SEQ ID NO: 62751 - protein, 13 aa, Mycobacterium tuberculosis
NLAPHAVGELYRG

SEQ ID NO: 62752 - protein, 13 aa, Mycobacterium tuberculosis
LAPHAVGELYRGP

SEQ ID NO: 62753 - protein, 13 aa, Mycobacterium tuberculosis
APHAVGELYRGPD

SEQ ID NO: 62754 - protein, 13 aa, Mycobacterium tuberculosis
PHAVGELYRGPDQ

SEQ ID NO: 62755 - protein, 13 aa, Mycobacterium tuberculosis
HAVGELYRGPDQL

SEQ ID NO: 62756 - protein, 13 aa, Mycobacterium tuberculosis
AVGELYRGPDQLV

SEQ ID NO: 62757 - protein, 13 aa, Mycobacterium tuberculosis
VGELYRGPDQLVI

SEQ ID NO: 62758 - protein, 13 aa, Mycobacterium tuberculosis
GELYRGPDQLVIG

SEQ ID NO: 62759 - protein, 13 aa, Mycobacterium tuberculosis
ELYRGPDQLVIGQ

SEQ ID NO: 62760 - protein, 13 aa, Mycobacterium tuberculosis
LYRGPDQLVIGQR

SEQ ID NO: 62761 - protein, 13 aa, Mycobacterium tuberculosis
YRGPDQLVIGQRE

SEQ ID NO: 62762 - protein, 13 aa, Mycobacterium tuberculosis
RGPDQLVIGQREE

SEQ ID NO: 62763 - protein, 13 aa, Mycobacterium tuberculosis
GPDQLVIGQREED

SEQ ID NO: 62764 - protein, 13 aa, Mycobacterium tuberculosis
PDQLVIGQREEDL

SEQ ID NO: 62765 - protein, 13 aa, Mycobacterium tuberculosis
DQLVIGQREEDLA

SEQ ID NO: 62766 - protein, 13 aa, Mycobacterium tuberculosis
QLVIGQREEDLAP

SEQ ID NO: 62767 - protein, 13 aa, Mycobacterium tuberculosis
LVIGQREEDLAPV

SEQ ID NO: 62768 - protein, 13 aa, Mycobacterium tuberculosis
VIGQREEDLAPVI

SEQ ID NO: 62769 - protein, 13 aa, Mycobacterium tuberculosis
IGQREEDLAPVIL

SEQ ID NO: 62770 - protein, 13 aa, Mycobacterium tuberculosis
GQREEDLAPVILD

SEQ ID NO: 62771 - protein, 13 aa, Mycobacterium tuberculosis
QREEDLAPVILDL

SEQ ID NO: 62772 - protein, 13 aa, Mycobacterium tuberculosis
REEDLAPVILDLA

SEQ ID NO: 62773 - protein, 13 aa, Mycobacterium tuberculosis
EEDLAPVILDLAA

SEQ ID NO: 62774 - protein, 13 aa, Mycobacterium tuberculosis
EDLAPVILDLAAN

SEQ ID NO: 62775 - protein, 13 aa, Mycobacterium tuberculosis
DLAPVILDLAANP

SEQ ID NO: 62776 - protein, 13 aa, Mycobacterium tuberculosis
LAPVILDLAANPL

SEQ ID NO: 62777 - protein, 13 aa, Mycobacterium tuberculosis
APVILDLAANPLL

SEQ ID NO: 62778 - protein, 13 aa, Mycobacterium tuberculosis
PVILDLAANPLLM

SEQ ID NO: 62779 - protein, 13 aa, Mycobacterium tuberculosis
VILDLAANPLLMV

SEQ ID NO: 62780 - protein, 13 aa, Mycobacterium tuberculosis
ILDLAANPLLMVF

SEQ ID NO: 62781 - protein, 13 aa, Mycobacterium tuberculosis
LDLAANPLLMVFG

SEQ ID NO: 62782 - protein, 13 aa, Mycobacterium tuberculosis
DLAANPLLMVFGD

SEQ ID NO: 62783 - protein, 13 aa, Mycobacterium tuberculosis
LAANPLLMVFGDA

SEQ ID NO: 62784 - protein, 13 aa, Mycobacterium tuberculosis
AANPLLMVFGDAR

SEQ ID NO: 62785 - protein, 13 aa, Mycobacterium tuberculosis
ANPLLMVFGDARS

SEQ ID NO: 62786 - protein, 13 aa, Mycobacterium tuberculosis
NPLLMVFGDARSG

SEQ ID NO: 62787 - protein, 13 aa, Mycobacterium tuberculosis
PLLMVFGDARSGK

SEQ ID NO: 62788 - protein, 13 aa, Mycobacterium tuberculosis
LLMVFGDARSGKT

SEQ ID NO: 62789 - protein, 13 aa, Mycobacterium tuberculosis
LMVFGDARSGKTT

SEQ ID NO: 62790 - protein, 13 aa, Mycobacterium tuberculosis
MVFGDARSGKTTL

SEQ ID NO: 62791 - protein, 13 aa, Mycobacterium tuberculosis
VFGDARSGKTTLL

SEQ ID NO: 62792 - protein, 13 aa, Mycobacterium tuberculosis
FGDARSGKTTLLR

SEQ ID NO: 62793 - protein, 13 aa, Mycobacterium tuberculosis
GDARSGKTTLLRH

SEQ ID NO: 62794 - protein, 13 aa, Mycobacterium tuberculosis
DARSGKTTLLRHI

SEQ ID NO: 62795 - protein, 13 aa, Mycobacterium tuberculosis
ARSGKTTLLRHII

SEQ ID NO: 62796 - protein, 13 aa, Mycobacterium tuberculosis
RSGKTTLLRHIIR

SEQ ID NO: 62797 - protein, 13 aa, Mycobacterium tuberculosis
SGKTTLLRHIIRT

SEQ ID NO: 62798 - protein, 13 aa, Mycobacterium tuberculosis
GKTTLLRHIIRTV

SEQ ID NO: 62799 - protein, 13 aa, Mycobacterium tuberculosis
KTTLLRHIIRTVR

SEQ ID NO: 62800 - protein, 13 aa, Mycobacterium tuberculosis
TTLLRHIIRTVRE

SEQ ID NO: 62801 - protein, 13 aa, Mycobacterium tuberculosis
TLLRHIIRTVREH

SEQ ID NO: 62802 - protein, 13 aa, Mycobacterium tuberculosis
LLRHIIRTVREHS

SEQ ID NO: 62803 - protein, 13 aa, Mycobacterium tuberculosis
LRHIIRTVREHST

SEQ ID NO: 62804 - protein, 13 aa, Mycobacterium tuberculosis
RHIIRTVREHSTA

SEQ ID NO: 62805 - protein, 13 aa, Mycobacterium tuberculosis
HIIRTVREHSTAD

SEQ ID NO: 62806 - protein, 13 aa, Mycobacterium tuberculosis
IIRTVREHSTADR

SEQ ID NO: 62807 - protein, 13 aa, Mycobacterium tuberculosis
IRTVREHSTADRV

SEQ ID NO: 62808 - protein, 13 aa, Mycobacterium tuberculosis
RTVREHSTADRVA

SEQ ID NO: 62809 - protein, 13 aa, Mycobacterium tuberculosis
TVREHSTADRVAF

SEQ ID NO: 62810 - protein, 13 aa, Mycobacterium tuberculosis
VREHSTADRVAFT

SEQ ID NO: 62811 - protein, 13 aa, Mycobacterium tuberculosis
REHSTADRVAFTV

SEQ ID NO: 62812 - protein, 13 aa, Mycobacterium tuberculosis
EHSTADRVAFTVL

SEQ ID NO: 62813 - protein, 13 aa, Mycobacterium tuberculosis
HSTADRVAFTVLD

SEQ ID NO: 62814 - protein, 13 aa, Mycobacterium tuberculosis
STADRVAFTVLDR

SEQ ID NO: 62815 - protein, 13 aa, Mycobacterium tuberculosis
TADRVAFTVLDRR

SEQ ID NO: 62816 - protein, 13 aa, Mycobacterium tuberculosis
ADRVAFTVLDRRL

SEQ ID NO: 62817 - protein, 13 aa, Mycobacterium tuberculosis
DRVAFTVLDRRLH

SEQ ID NO: 62818 - protein, 13 aa, Mycobacterium tuberculosis
RVAFTVLDRRLHL

SEQ ID NO: 62819 - protein, 13 aa, Mycobacterium tuberculosis
VAFTVLDRRLHLV

SEQ ID NO: 62820 - protein, 13 aa, Mycobacterium tuberculosis
AFTVLDRRLHLVD

SEQ ID NO: 62821 - protein, 13 aa, Mycobacterium tuberculosis
FTVLDRRLHLVDE

SEQ ID NO: 62822 - protein, 13 aa, Mycobacterium tuberculosis
TVLDRRLHLVDEP

SEQ ID NO: 62823 - protein, 13 aa, Mycobacterium tuberculosis
VLDRRLHLVDEPL

SEQ ID NO: 62824 - protein, 13 aa, Mycobacterium tuberculosis
LDRRLHLVDEPLF

SEQ ID NO: 62825 - protein, 13 aa, Mycobacterium tuberculosis
DRRLHLVDEPLFP

SEQ ID NO: 62826 - protein, 13 aa, Mycobacterium tuberculosis
RRLHLVDEPLFPD

SEQ ID NO: 62827 - protein, 13 aa, Mycobacterium tuberculosis
RLHLVDEPLFPDN

SEQ ID NO: 62828 - protein, 13 aa, Mycobacterium tuberculosis
LHLVDEPLFPDNE

SEQ ID NO: 62829 - protein, 13 aa, Mycobacterium tuberculosis
HLVDEPLFPDNEY

SEQ ID NO: 62830 - protein, 13 aa, Mycobacterium tuberculosis
LVDEPLFPDNEYT

SEQ ID NO: 62831 - protein, 13 aa, Mycobacterium tuberculosis
VDEPLFPDNEYTA

SEQ ID NO: 62832 - protein, 13 aa, Mycobacterium tuberculosis
DEPLFPDNEYTAN

SEQ ID NO: 62833 - protein, 13 aa, Mycobacterium tuberculosis
EPLFPDNEYTANI

SEQ ID NO: 62834 - protein, 13 aa, Mycobacterium tuberculosis
PLFPDNEYTANID

SEQ ID NO: 62835 - protein, 13 aa, Mycobacterium tuberculosis
LFPDNEYTANIDR

SEQ ID NO: 62836 - protein, 13 aa, Mycobacterium tuberculosis
FPDNEYTANIDRI

SEQ ID NO: 62837 - protein, 13 aa, Mycobacterium tuberculosis
PDNEYTANIDRII

SEQ ID NO: 62838 - protein, 13 aa, Mycobacterium tuberculosis
DNEYTANIDRIIP

SEQ ID NO: 62839 - protein, 13 aa, Mycobacterium tuberculosis
NEYTANIDRIIPA

SEQ ID NO: 62840 - protein, 13 aa, Mycobacterium tuberculosis
EYTANIDRIIPAM

SEQ ID NO: 62841 - protein, 13 aa, Mycobacterium tuberculosis
YTANIDRIIPAML

SEQ ID NO: 62842 - protein, 13 aa, Mycobacterium tuberculosis
TANIDRIIPAMLG

SEQ ID NO: 62843 - protein, 13 aa, Mycobacterium tuberculosis
ANIDRIIPAMLGL

SEQ ID NO: 62844 - protein, 13 aa, Mycobacterium tuberculosis
NIDRIIPAMLGLA

SEQ ID NO: 62845 - protein, 13 aa, Mycobacterium tuberculosis
IDRIIPAMLGLAN

SEQ ID NO: 62846 - protein, 13 aa, Mycobacterium tuberculosis
DRIIPAMLGLANL

SEQ ID NO: 62847 - protein, 13 aa, Mycobacterium tuberculosis
RIIPAMLGLANLI

SEQ ID NO: 62848 - protein, 13 aa, Mycobacterium tuberculosis
IIPAMLGLANLIE

SEQ ID NO: 62849 - protein, 13 aa, Mycobacterium tuberculosis
IPAMLGLANLIEA

SEQ ID NO: 62850 - protein, 13 aa, Mycobacterium tuberculosis
PAMLGLANLIEAR

SEQ ID NO: 62851 - protein, 13 aa, Mycobacterium tuberculosis
AMLGLANLIEARR

SEQ ID NO: 62852 - protein, 13 aa, Mycobacterium tuberculosis
MLGLANLIEARRP

SEQ ID NO: 62853 - protein, 13 aa, Mycobacterium tuberculosis
LGLANLIEARRPP

SEQ ID NO: 62854 - protein, 13 aa, Mycobacterium tuberculosis
GLANLIEARRPPA

SEQ ID NO: 62855 - protein, 13 aa, Mycobacterium tuberculosis
LANLIEARRPPAG

SEQ ID NO: 62856 - protein, 13 aa, Mycobacterium tuberculosis
ANLIEARRPPAGM

SEQ ID NO: 62857 - protein, 13 aa, Mycobacterium tuberculosis
NLIEARRPPAGMS

SEQ ID NO: 62858 - protein, 13 aa, Mycobacterium tuberculosis
LIEARRPPAGMSA

SEQ ID NO: 62859 - protein, 13 aa, Mycobacterium tuberculosis
IEARRPPAGMSAA

SEQ ID NO: 62860 - protein, 13 aa, Mycobacterium tuberculosis
EARRPPAGMSAAE

SEQ ID NO: 62861 - protein, 13 aa, Mycobacterium tuberculosis
ARRPPAGMSAAEL

SEQ ID NO: 62862 - protein, 13 aa, Mycobacterium tuberculosis
RRPPAGMSAAELS

SEQ ID NO: 62863 - protein, 13 aa, Mycobacterium tuberculosis
RPPAGMSAAELSR

SEQ ID NO: 62864 - protein, 13 aa, Mycobacterium tuberculosis
PPAGMSAAELSRW

SEQ ID NO: 62865 - protein, 13 aa, Mycobacterium tuberculosis
PAGMSAAELSRWT

SEQ ID NO: 62866 - protein, 13 aa, Mycobacterium tuberculosis
AGMSAAELSRWTF

SEQ ID NO: 62867 - protein, 13 aa, Mycobacterium tuberculosis
GMSAAELSRWTFA

SEQ ID NO: 62868 - protein, 13 aa, Mycobacterium tuberculosis
MSAAELSRWTFAG

SEQ ID NO: 62869 - protein, 13 aa, Mycobacterium tuberculosis
SAAELSRWTFAGH

SEQ ID NO: 62870 - protein, 13 aa, Mycobacterium tuberculosis
AAELSRWTFAGHT

SEQ ID NO: 62871 - protein, 13 aa, Mycobacterium tuberculosis
AELSRWTFAGHTH

SEQ ID NO: 62872 - protein, 13 aa, Mycobacterium tuberculosis
ELSRWTFAGHTHY

SEQ ID NO: 62873 - protein, 13 aa, Mycobacterium tuberculosis
LSRWTFAGHTHYL

SEQ ID NO: 62874 - protein, 13 aa, Mycobacterium tuberculosis
SRWTFAGHTHYLI

SEQ ID NO: 62875 - protein, 13 aa, Mycobacterium tuberculosis
RWTFAGHTHYLII

SEQ ID NO: 62876 - protein, 13 aa, Mycobacterium tuberculosis
WTFAGHTHYLIID

SEQ ID NO: 62877 - protein, 13 aa, Mycobacterium tuberculosis
TFAGHTHYLIIDD

SEQ ID NO: 62878 - protein, 13 aa, Mycobacterium tuberculosis
FAGHTHYLIIDDV

SEQ ID NO: 62879 - protein, 13 aa, Mycobacterium tuberculosis
AGHTHYLIIDDVD

SEQ ID NO: 62880 - protein, 13 aa, Mycobacterium tuberculosis
GHTHYLIIDDVDQ

SEQ ID NO: 62881 - protein, 13 aa, Mycobacterium tuberculosis
HTHYLIIDDVDQV

SEQ ID NO: 62882 - protein, 13 aa, Mycobacterium tuberculosis
THYLIIDDVDQVP

SEQ ID NO: 62883 - protein, 13 aa, Mycobacterium tuberculosis
HYLIIDDVDQVPD

SEQ ID NO: 62884 - protein, 13 aa, Mycobacterium tuberculosis
YLIIDDVDQVPDS

SEQ ID NO: 62885 - protein, 13 aa, Mycobacterium tuberculosis
LIIDDVDQVPDSP

SEQ ID NO: 62886 - protein, 13 aa, Mycobacterium tuberculosis
IIDDVDQVPDSPA

SEQ ID NO: 62887 - protein, 13 aa, Mycobacterium tuberculosis
IDDVDQVPDSPAM

SEQ ID NO: 62888 - protein, 13 aa, Mycobacterium tuberculosis
DDVDQVPDSPAMT

SEQ ID NO: 62889 - protein, 13 aa, Mycobacterium tuberculosis
DVDQVPDSPAMTG

SEQ ID NO: 62890 - protein, 13 aa, Mycobacterium tuberculosis
VDQVPDSPAMTGP

SEQ ID NO: 62891 - protein, 13 aa, Mycobacterium tuberculosis
DQVPDSPAMTGPY

SEQ ID NO: 62892 - protein, 13 aa, Mycobacterium tuberculosis
QVPDSPAMTGPYI

SEQ ID NO: 62893 - protein, 13 aa, Mycobacterium tuberculosis
VPDSPAMTGPYIG

SEQ ID NO: 62894 - protein, 13 aa, Mycobacterium tuberculosis
PDSPAMTGPYIGQ

SEQ ID NO: 62895 - protein, 13 aa, Mycobacterium tuberculosis
DSPAMTGPYIGQR

SEQ ID NO: 62896 - protein, 13 aa, Mycobacterium tuberculosis
SPAMTGPYIGQRP

SEQ ID NO: 62897 - protein, 13 aa, Mycobacterium tuberculosis
PAMTGPYIGQRPW

SEQ ID NO: 62898 - protein, 13 aa, Mycobacterium tuberculosis
AMTGPYIGQRPWT

SEQ ID NO: 62899 - protein, 13 aa, Mycobacterium tuberculosis
MTGPYIGQRPWTP

SEQ ID NO: 62900 - protein, 13 aa, Mycobacterium tuberculosis
TGPYIGQRPWTPL

SEQ ID NO: 62901 - protein, 13 aa, Mycobacterium tuberculosis
GPYIGQRPWTPLI

SEQ ID NO: 62902 - protein, 13 aa, Mycobacterium tuberculosis
PYIGQRPWTPLIG

SEQ ID NO: 62903 - protein, 13 aa, Mycobacterium tuberculosis
YIGQRPWTPLIGL

SEQ ID NO: 62904 - protein, 13 aa, Mycobacterium tuberculosis
IGQRPWTPLIGLL

SEQ ID NO: 62905 - protein, 13 aa, Mycobacterium tuberculosis
GQRPWTPLIGLLA

SEQ ID NO: 62906 - protein, 13 aa, Mycobacterium tuberculosis
QRPWTPLIGLLAQ

SEQ ID NO: 62907 - protein, 13 aa, Mycobacterium tuberculosis
RPWTPLIGLLAQA

SEQ ID NO: 62908 - protein, 13 aa, Mycobacterium tuberculosis
PWTPLIGLLAQAG

SEQ ID NO: 62909 - protein, 13 aa, Mycobacterium tuberculosis
WTPLIGLLAQAGD

SEQ ID NO: 62910 - protein, 13 aa, Mycobacterium tuberculosis
TPLIGLLAQAGDL

SEQ ID NO: 62911 - protein, 13 aa, Mycobacterium tuberculosis
PLIGLLAQAGDLG

SEQ ID NO: 62912 - protein, 13 aa, Mycobacterium tuberculosis
LIGLLAQAGDLGL

SEQ ID NO: 62913 - protein, 13 aa, Mycobacterium tuberculosis
IGLLAQAGDLGLR

SEQ ID NO: 62914 - protein, 13 aa, Mycobacterium tuberculosis
GLLAQAGDLGLRV

SEQ ID NO: 62915 - protein, 13 aa, Mycobacterium tuberculosis
LLAQAGDLGLRVI

SEQ ID NO: 62916 - protein, 13 aa, Mycobacterium tuberculosis
LAQAGDLGLRVIV

SEQ ID NO: 62917 - protein, 13 aa, Mycobacterium tuberculosis
AQAGDLGLRVIVT

SEQ ID NO: 62918 - protein, 13 aa, Mycobacterium tuberculosis
QAGDLGLRVIVTG

SEQ ID NO: 62919 - protein, 13 aa, Mycobacterium tuberculosis
AGDLGLRVIVTGR

SEQ ID NO: 62920 - protein, 13 aa, Mycobacterium tuberculosis
GDLGLRVIVTGRA

SEQ ID NO: 62921 - protein, 13 aa, Mycobacterium tuberculosis
DLGLRVIVTGRAT

SEQ ID NO: 62922 - protein, 13 aa, Mycobacterium tuberculosis
LGLRVIVTGRATG

SEQ ID NO: 62923 - protein, 13 aa, Mycobacterium tuberculosis
GLRVIVTGRATGS

SEQ ID NO: 62924 - protein, 13 aa, Mycobacterium tuberculosis
LRVIVTGRATGSA

SEQ ID NO: 62925 - protein, 13 aa, Mycobacterium tuberculosis
RVIVTGRATGSAH

SEQ ID NO: 62926 - protein, 13 aa, Mycobacterium tuberculosis
VIVTGRATGSAHL

SEQ ID NO: 62927 - protein, 13 aa, Mycobacterium tuberculosis
IVTGRATGSAHLL

SEQ ID NO: 62928 - protein, 13 aa, Mycobacterium tuberculosis
VTGRATGSAHLLM

SEQ ID NO: 62929 - protein, 13 aa, Mycobacterium tuberculosis
TGRATGSAHLLMT

SEQ ID NO: 62930 - protein, 13 aa, Mycobacterium tuberculosis
GRATGSAHLLMTS

SEQ ID NO: 62931 - protein, 13 aa, Mycobacterium tuberculosis
RATGSAHLLMTSP

SEQ ID NO: 62932 - protein, 13 aa, Mycobacterium tuberculosis
ATGSAHLLMTSPL

SEQ ID NO: 62933 - protein, 13 aa, Mycobacterium tuberculosis
TGSAHLLMTSPLL

SEQ ID NO: 62934 - protein, 13 aa, Mycobacterium tuberculosis
GSAHLLMTSPLLR

SEQ ID NO: 62935 - protein, 13 aa, Mycobacterium tuberculosis
SAHLLMTSPLLRR

SEQ ID NO: 62936 - protein, 13 aa, Mycobacterium tuberculosis
AHLLMTSPLLRRF

SEQ ID NO: 62937 - protein, 13 aa, Mycobacterium tuberculosis
HLLMTSPLLRRFN

SEQ ID NO: 62938 - protein, 13 aa, Mycobacterium tuberculosis
LLMTSPLLRRFND

SEQ ID NO: 62939 - protein, 13 aa, Mycobacterium tuberculosis
LMTSPLLRRFNDL

SEQ ID NO: 62940 - protein, 13 aa, Mycobacterium tuberculosis
MTSPLLRRFNDLQ

SEQ ID NO: 62941 - protein, 13 aa, Mycobacterium tuberculosis
TSPLLRRFNDLQA

SEQ ID NO: 62942 - protein, 13 aa, Mycobacterium tuberculosis
SPLLRRFNDLQAT

SEQ ID NO: 62943 - protein, 13 aa, Mycobacterium tuberculosis
PLLRRFNDLQATT

SEQ ID NO: 62944 - protein, 13 aa, Mycobacterium tuberculosis
LLRRFNDLQATTL

SEQ ID NO: 62945 - protein, 13 aa, Mycobacterium tuberculosis
LRRFNDLQATTLM

SEQ ID NO: 62946 - protein, 13 aa, Mycobacterium tuberculosis
RRFNDLQATTLML

SEQ ID NO: 62947 - protein, 13 aa, Mycobacterium tuberculosis
RFNDLQATTLMLA

SEQ ID NO: 62948 - protein, 13 aa, Mycobacterium tuberculosis
FNDLQATTLMLAG

SEQ ID NO: 62949 - protein, 13 aa, Mycobacterium tuberculosis
NDLQATTLMLAGN

SEQ ID NO: 62950 - protein, 13 aa, Mycobacterium tuberculosis
DLQATTLMLAGNP

SEQ ID NO: 62951 - protein, 13 aa, Mycobacterium tuberculosis
LQATTLMLAGNPA

SEQ ID NO: 62952 - protein, 13 aa, Mycobacterium tuberculosis
QATTLMLAGNPAD

SEQ ID NO: 62953 - protein, 13 aa, Mycobacterium tuberculosis
ATTLMLAGNPADS

SEQ ID NO: 62954 - protein, 13 aa, Mycobacterium tuberculosis
TTLMLAGNPADSG

SEQ ID NO: 62955 - protein, 13 aa, Mycobacterium tuberculosis
TLMLAGNPADSGK

SEQ ID NO: 62956 - protein, 13 aa, Mycobacterium tuberculosis
LMLAGNPADSGKI

SEQ ID NO: 62957 - protein, 13 aa, Mycobacterium tuberculosis
MLAGNPADSGKIR

SEQ ID NO: 62958 - protein, 13 aa, Mycobacterium tuberculosis
LAGNPADSGKIRG

SEQ ID NO: 62959 - protein, 13 aa, Mycobacterium tuberculosis
AGNPADSGKIRGE

SEQ ID NO: 62960 - protein, 13 aa, Mycobacterium tuberculosis
GNPADSGKIRGER

SEQ ID NO: 62961 - protein, 13 aa, Mycobacterium tuberculosis
NPADSGKIRGERF

SEQ ID NO: 62962 - protein, 13 aa, Mycobacterium tuberculosis
PADSGKIRGERFA

SEQ ID NO: 62963 - protein, 13 aa, Mycobacterium tuberculosis
ADSGKIRGERFAR

SEQ ID NO: 62964 - protein, 13 aa, Mycobacterium tuberculosis
DSGKIRGERFARL

SEQ ID NO: 62965 - protein, 13 aa, Mycobacterium tuberculosis
SGKIRGERFARLP

SEQ ID NO: 62966 - protein, 13 aa, Mycobacterium tuberculosis
GKIRGERFARLPA

SEQ ID NO: 62967 - protein, 13 aa, Mycobacterium tuberculosis
KIRGERFARLPAG

SEQ ID NO: 62968 - protein, 13 aa, Mycobacterium tuberculosis
IRGERFARLPAGR

SEQ ID NO: 62969 - protein, 13 aa, Mycobacterium tuberculosis
RGERFARLPAGRA

SEQ ID NO: 62970 - protein, 13 aa, Mycobacterium tuberculosis
GERFARLPAGRAI

SEQ ID NO: 62971 - protein, 13 aa, Mycobacterium tuberculosis
ERFARLPAGRAIL

SEQ ID NO: 62972 - protein, 13 aa, Mycobacterium tuberculosis
RFARLPAGRAILL

SEQ ID NO: 62973 - protein, 13 aa, Mycobacterium tuberculosis
FARLPAGRAILLT

SEQ ID NO: 62974 - protein, 13 aa, Mycobacterium tuberculosis
ARLPAGRAILLTD

SEQ ID NO: 62975 - protein, 13 aa, Mycobacterium tuberculosis
RLPAGRAILLTDS

SEQ ID NO: 62976 - protein, 13 aa, Mycobacterium tuberculosis
LPAGRAILLTDSD

SEQ ID NO: 62977 - protein, 13 aa, Mycobacterium tuberculosis
PAGRAILLTDSDS

SEQ ID NO: 62978 - protein, 13 aa, Mycobacterium tuberculosis
AGRAILLTDSDSP

SEQ ID NO: 62979 - protein, 13 aa, Mycobacterium tuberculosis
GRAILLTDSDSPT

SEQ ID NO: 62980 - protein, 13 aa, Mycobacterium tuberculosis
RAILLTDSDSPTY

SEQ ID NO: 62981 - protein, 13 aa, Mycobacterium tuberculosis
AILLTDSDSPTYV

SEQ ID NO: 62982 - protein, 13 aa, Mycobacterium tuberculosis
ILLTDSDSPTYVQ

SEQ ID NO: 62983 - protein, 13 aa, Mycobacterium tuberculosis
LLTDSDSPTYVQL

SEQ ID NO: 62984 - protein, 13 aa, Mycobacterium tuberculosis
LTDSDSPTYVQLI

SEQ ID NO: 62985 - protein, 13 aa, Mycobacterium tuberculosis
TDSDSPTYVQLIN

SEQ ID NO: 62986 - protein, 13 aa, Mycobacterium tuberculosis
DSDSPTYVQLINP

SEQ ID NO: 62987 - protein, 13 aa, Mycobacterium tuberculosis
SDSPTYVQLINPL

SEQ ID NO: 62988 - protein, 13 aa, Mycobacterium tuberculosis
DSPTYVQLINPLV

SEQ ID NO: 62989 - protein, 13 aa, Mycobacterium tuberculosis
SPTYVQLINPLVD

SEQ ID NO: 62990 - protein, 13 aa, Mycobacterium tuberculosis
PTYVQLINPLVDA

SEQ ID NO: 62991 - protein, 13 aa, Mycobacterium tuberculosis
TYVQLINPLVDAA

SEQ ID NO: 62992 - protein, 13 aa, Mycobacterium tuberculosis
YVQLINPLVDAAA

SEQ ID NO: 62993 - protein, 13 aa, Mycobacterium tuberculosis
VQLINPLVDAAAV

SEQ ID NO: 62994 - protein, 13 aa, Mycobacterium tuberculosis
QLINPLVDAAAVS

SEQ ID NO: 62995 - protein, 13 aa, Mycobacterium tuberculosis
LINPLVDAAAVSG

SEQ ID NO: 62996 - protein, 13 aa, Mycobacterium tuberculosis
INPLVDAAAVSGE

SEQ ID NO: 62997 - protein, 13 aa, Mycobacterium tuberculosis
NPLVDAAAVSGET

SEQ ID NO: 62998 - protein, 13 aa, Mycobacterium tuberculosis
PLVDAAAVSGETQ

SEQ ID NO: 62999 - protein, 13 aa, Mycobacterium tuberculosis
LVDAAAVSGETQQ

SEQ ID NO: 63000 - protein, 13 aa, Mycobacterium tuberculosis
VDAAAVSGETQQK

SEQ ID NO: 63001 - protein, 13 aa, Mycobacterium tuberculosis
DAAAVSGETQQKG

SEQ ID NO: 63002 - protein, 13 aa, Mycobacterium tuberculosis
AAAVSGETQQKGS

SEQ ID NO: 63003 - protein, 13 aa, Mycobacterium tuberculosis
AAVSGETQQKGSQ

SEQ ID NO: 63004 - protein, 13 aa, Mycobacterium tuberculosis
AVSGETQQKGSQS

SEQ ID NO: 63005 - protein, 14 aa, Mycobacterium tuberculosis
MSRLIFEARRRLAP

SEQ ID NO: 63006 - protein, 14 aa, Mycobacterium tuberculosis
SRLIFEARRRLAPP

SEQ ID NO: 63007 - protein, 14 aa, Mycobacterium tuberculosis
RLIFEARRRLAPPS

SEQ ID NO: 63008 - protein, 14 aa, Mycobacterium tuberculosis
LIFEARRRLAPPSS

SEQ ID NO: 63009 - protein, 14 aa, Mycobacterium tuberculosis
IFEARRRLAPPSSH

SEQ ID NO: 63010 - protein, 14 aa, Mycobacterium tuberculosis
FEARRRLAPPSSHQ

SEQ ID NO: 63011 - protein, 14 aa, Mycobacterium tuberculosis
EARRRLAPPSSHQG

SEQ ID NO: 63012 - protein, 14 aa, Mycobacterium tuberculosis
ARRRLAPPSSHQGT

SEQ ID NO: 63013 - protein, 14 aa, Mycobacterium tuberculosis
RRRLAPPSSHQGTI

SEQ ID NO: 63014 - protein, 14 aa, Mycobacterium tuberculosis
RRLAPPSSHQGTII

SEQ ID NO: 63015 - protein, 14 aa, Mycobacterium tuberculosis
RLAPPSSHQGTIII

SEQ ID NO: 63016 - protein, 14 aa, Mycobacterium tuberculosis
LAPPSSHQGTIIIE

SEQ ID NO: 63017 - protein, 14 aa, Mycobacterium tuberculosis
APPSSHQGTIIIEA

SEQ ID NO: 63018 - protein, 14 aa, Mycobacterium tuberculosis
PPSSHQGTIIIEAP

SEQ ID NO: 63019 - protein, 14 aa, Mycobacterium tuberculosis
PSSHQGTIIIEAPP

SEQ ID NO: 63020 - protein, 14 aa, Mycobacterium tuberculosis
SSHQGTIIIEAPPE

SEQ ID NO: 63021 - protein, 14 aa, Mycobacterium tuberculosis
SHQGTIIIEAPPEL

SEQ ID NO: 63022 - protein, 14 aa, Mycobacterium tuberculosis
HQGTIIIEAPPELP

SEQ ID NO: 63023 - protein, 14 aa, Mycobacterium tuberculosis
QGTIIIEAPPELPR

SEQ ID NO: 63024 - protein, 14 aa, Mycobacterium tuberculosis
GTIIIEAPPELPRV

SEQ ID NO: 63025 - protein, 14 aa, Mycobacterium tuberculosis
TIIIEAPPELPRVI

SEQ ID NO: 63026 - protein, 14 aa, Mycobacterium tuberculosis
IIIEAPPELPRVIP

SEQ ID NO: 63027 - protein, 14 aa, Mycobacterium tuberculosis
IIEAPPELPRVIPP

SEQ ID NO: 63028 - protein, 14 aa, Mycobacterium tuberculosis
IEAPPELPRVIPPS

SEQ ID NO: 63029 - protein, 14 aa, Mycobacterium tuberculosis
EAPPELPRVIPPSL

SEQ ID NO: 63030 - protein, 14 aa, Mycobacterium tuberculosis
APPELPRVIPPSLL

SEQ ID NO: 63031 - protein, 14 aa, Mycobacterium tuberculosis
PPELPRVIPPSLLR

SEQ ID NO: 63032 - protein, 14 aa, Mycobacterium tuberculosis
PELPRVIPPSLLRR

SEQ ID NO: 63033 - protein, 14 aa, Mycobacterium tuberculosis
ELPRVIPPSLLRRA

SEQ ID NO: 63034 - protein, 14 aa, Mycobacterium tuberculosis
LPRVIPPSLLRRAL

SEQ ID NO: 63035 - protein, 14 aa, Mycobacterium tuberculosis
PRVIPPSLLRRALP

SEQ ID NO: 63036 - protein, 14 aa, Mycobacterium tuberculosis
RVIPPSLLRRALPY

SEQ ID NO: 63037 - protein, 14 aa, Mycobacterium tuberculosis
VIPPSLLRRALPYL

SEQ ID NO: 63038 - protein, 14 aa, Mycobacterium tuberculosis
IPPSLLRRALPYLI

SEQ ID NO: 63039 - protein, 14 aa, Mycobacterium tuberculosis
PPSLLRRALPYLIG

SEQ ID NO: 63040 - protein, 14 aa, Mycobacterium tuberculosis
PSLLRRALPYLIGI

SEQ ID NO: 63041 - protein, 14 aa, Mycobacterium tuberculosis
SLLRRALPYLIGIL

SEQ ID NO: 63042 - protein, 14 aa, Mycobacterium tuberculosis
LLRRALPYLIGILI

SEQ ID NO: 63043 - protein, 14 aa, Mycobacterium tuberculosis
LRRALPYLIGILIV

SEQ ID NO: 63044 - protein, 14 aa, Mycobacterium tuberculosis
RRALPYLIGILIVG

SEQ ID NO: 63045 - protein, 14 aa, Mycobacterium tuberculosis
RALPYLIGILIVGM

SEQ ID NO: 63046 - protein, 14 aa, Mycobacterium tuberculosis
ALPYLIGILIVGMI

SEQ ID NO: 63047 - protein, 14 aa, Mycobacterium tuberculosis
LPYLIGILIVGMIV

SEQ ID NO: 63048 - protein, 14 aa, Mycobacterium tuberculosis
PYLIGILIVGMIVA

SEQ ID NO: 63049 - protein, 14 aa, Mycobacterium tuberculosis
YLIGILIVGMIVAL

SEQ ID NO: 63050 - protein, 14 aa, Mycobacterium tuberculosis
LIGILIVGMIVALV

SEQ ID NO: 63051 - protein, 14 aa, Mycobacterium tuberculosis
IGILIVGMIVALVA

SEQ ID NO: 63052 - protein, 14 aa, Mycobacterium tuberculosis
GILIVGMIVALVAT

SEQ ID NO: 63053 - protein, 14 aa, Mycobacterium tuberculosis
ILIVGMIVALVATG

SEQ ID NO: 63054 - protein, 14 aa, Mycobacterium tuberculosis
LIVGMIVALVATGM

SEQ ID NO: 63055 - protein, 14 aa, Mycobacterium tuberculosis
IVGMIVALVATGMR

SEQ ID NO: 63056 - protein, 14 aa, Mycobacterium tuberculosis
VGMIVALVATGMRV

SEQ ID NO: 63057 - protein, 14 aa, Mycobacterium tuberculosis
GMIVALVATGMRVI

SEQ ID NO: 63058 - protein, 14 aa, Mycobacterium tuberculosis
MIVALVATGMRVIS

SEQ ID NO: 63059 - protein, 14 aa, Mycobacterium tuberculosis
IVALVATGMRVISP

SEQ ID NO: 63060 - protein, 14 aa, Mycobacterium tuberculosis
VALVATGMRVISPQ

SEQ ID NO: 63061 - protein, 14 aa, Mycobacterium tuberculosis
ALVATGMRVISPQT

SEQ ID NO: 63062 - protein, 14 aa, Mycobacterium tuberculosis
LVATGMRVISPQTL

SEQ ID NO: 63063 - protein, 14 aa, Mycobacterium tuberculosis
VATGMRVISPQTLF

SEQ ID NO: 63064 - protein, 14 aa, Mycobacterium tuberculosis
ATGMRVISPQTLFF

SEQ ID NO: 63065 - protein, 14 aa, Mycobacterium tuberculosis
TGMRVISPQTLFFP

SEQ ID NO: 63066 - protein, 14 aa, Mycobacterium tuberculosis
GMRVISPQTLFFPF

SEQ ID NO: 63067 - protein, 14 aa, Mycobacterium tuberculosis
MRVISPQTLFFPFV

SEQ ID NO: 63068 - protein, 14 aa, Mycobacterium tuberculosis
RVISPQTLFFPFVL

SEQ ID NO: 63069 - protein, 14 aa, Mycobacterium tuberculosis
VISPQTLFFPFVLL

SEQ ID NO: 63070 - protein, 14 aa, Mycobacterium tuberculosis
ISPQTLFFPFVLLL

SEQ ID NO: 63071 - protein, 14 aa, Mycobacterium tuberculosis
SPQTLFFPFVLLLA

SEQ ID NO: 63072 - protein, 14 aa, Mycobacterium tuberculosis
PQTLFFPFVLLLAA

SEQ ID NO: 63073 - protein, 14 aa, Mycobacterium tuberculosis
QTLFFPFVLLLAAT

SEQ ID NO: 63074 - protein, 14 aa, Mycobacterium tuberculosis
TLFFPFVLLLAATA

SEQ ID NO: 63075 - protein, 14 aa, Mycobacterium tuberculosis
LFFPFVLLLAATAL

SEQ ID NO: 63076 - protein, 14 aa, Mycobacterium tuberculosis
FFPFVLLLAATALY

SEQ ID NO: 63077 - protein, 14 aa, Mycobacterium tuberculosis
FPFVLLLAATALYR

SEQ ID NO: 63078 - protein, 14 aa, Mycobacterium tuberculosis
PFVLLLAATALYRG

SEQ ID NO: 63079 - protein, 14 aa, Mycobacterium tuberculosis
FVLLLAATALYRGN

SEQ ID NO: 63080 - protein, 14 aa, Mycobacterium tuberculosis
VLLLAATALYRGND

SEQ ID NO: 63081 - protein, 14 aa, Mycobacterium tuberculosis
LLLAATALYRGNDK

SEQ ID NO: 63082 - protein, 14 aa, Mycobacterium tuberculosis
LLAATALYRGNDKK

SEQ ID NO: 63083 - protein, 14 aa, Mycobacterium tuberculosis
LAATALYRGNDKKM

SEQ ID NO: 63084 - protein, 14 aa, Mycobacterium tuberculosis
AATALYRGNDKKMR

SEQ ID NO: 63085 - protein, 14 aa, Mycobacterium tuberculosis
ATALYRGNDKKMRT

SEQ ID NO: 63086 - protein, 14 aa, Mycobacterium tuberculosis
TALYRGNDKKMRTE

SEQ ID NO: 63087 - protein, 14 aa, Mycobacterium tuberculosis
ALYRGNDKKMRTEE

SEQ ID NO: 63088 - protein, 14 aa, Mycobacterium tuberculosis
LYRGNDKKMRTEEV

SEQ ID NO: 63089 - protein, 14 aa, Mycobacterium tuberculosis
YRGNDKKMRTEEVD

SEQ ID NO: 63090 - protein, 14 aa, Mycobacterium tuberculosis
RGNDKKMRTEEVDA

SEQ ID NO: 63091 - protein, 14 aa, Mycobacterium tuberculosis
GNDKKMRTEEVDAE

SEQ ID NO: 63092 - protein, 14 aa, Mycobacterium tuberculosis
NDKKMRTEEVDAER

SEQ ID NO: 63093 - protein, 14 aa, Mycobacterium tuberculosis
DKKMRTEEVDAERA

SEQ ID NO: 63094 - protein, 14 aa, Mycobacterium tuberculosis
KKMRTEEVDAERAD

SEQ ID NO: 63095 - protein, 14 aa, Mycobacterium tuberculosis
KMRTEEVDAERADY

SEQ ID NO: 63096 - protein, 14 aa, Mycobacterium tuberculosis
MRTEEVDAERADYL

SEQ ID NO: 63097 - protein, 14 aa, Mycobacterium tuberculosis
RTEEVDAERADYLR

SEQ ID NO: 63098 - protein, 14 aa, Mycobacterium tuberculosis
TEEVDAERADYLRY

SEQ ID NO: 63099 - protein, 14 aa, Mycobacterium tuberculosis
EEVDAERADYLRYL

SEQ ID NO: 63100 - protein, 14 aa, Mycobacterium tuberculosis
EVDAERADYLRYLS

SEQ ID NO: 63101 - protein, 14 aa, Mycobacterium tuberculosis
VDAERADYLRYLSV

SEQ ID NO: 63102 - protein, 14 aa, Mycobacterium tuberculosis
DAERADYLRYLSVV

SEQ ID NO: 63103 - protein, 14 aa, Mycobacterium tuberculosis
AERADYLRYLSVVR

SEQ ID NO: 63104 - protein, 14 aa, Mycobacterium tuberculosis
ERADYLRYLSVVRD

SEQ ID NO: 63105 - protein, 14 aa, Mycobacterium tuberculosis
RADYLRYLSVVRDN

SEQ ID NO: 63106 - protein, 14 aa, Mycobacterium tuberculosis
ADYLRYLSVVRDNI

SEQ ID NO: 63107 - protein, 14 aa, Mycobacterium tuberculosis
DYLRYLSVVRDNIR

SEQ ID NO: 63108 - protein, 14 aa, Mycobacterium tuberculosis
YLRYLSVVRDNIRA

SEQ ID NO: 63109 - protein, 14 aa, Mycobacterium tuberculosis
LRYLSVVRDNIRAQ

SEQ ID NO: 63110 - protein, 14 aa, Mycobacterium tuberculosis
RYLSVVRDNIRAQA

SEQ ID NO: 63111 - protein, 14 aa, Mycobacterium tuberculosis
YLSVVRDNIRAQAA

SEQ ID NO: 63112 - protein, 14 aa, Mycobacterium tuberculosis
LSVVRDNIRAQAAE

SEQ ID NO: 63113 - protein, 14 aa, Mycobacterium tuberculosis
SVVRDNIRAQAAEQ

SEQ ID NO: 63114 - protein, 14 aa, Mycobacterium tuberculosis
VVRDNIRAQAAEQR

SEQ ID NO: 63115 - protein, 14 aa, Mycobacterium tuberculosis
VRDNIRAQAAEQRA

SEQ ID NO: 63116 - protein, 14 aa, Mycobacterium tuberculosis
RDNIRAQAAEQRAS

SEQ ID NO: 63117 - protein, 14 aa, Mycobacterium tuberculosis
DNIRAQAAEQRASA

SEQ ID NO: 63118 - protein, 14 aa, Mycobacterium tuberculosis
NIRAQAAEQRASAL

SEQ ID NO: 63119 - protein, 14 aa, Mycobacterium tuberculosis
IRAQAAEQRASALW

SEQ ID NO: 63120 - protein, 14 aa, Mycobacterium tuberculosis
RAQAAEQRASALWS

SEQ ID NO: 63121 - protein, 14 aa, Mycobacterium tuberculosis
AQAAEQRASALWSH

SEQ ID NO: 63122 - protein, 14 aa, Mycobacterium tuberculosis
QAAEQRASALWSHP

SEQ ID NO: 63123 - protein, 14 aa, Mycobacterium tuberculosis
AAEQRASALWSHPD

SEQ ID NO: 63124 - protein, 14 aa, Mycobacterium tuberculosis
AEQRASALWSHPDP

SEQ ID NO: 63125 - protein, 14 aa, Mycobacterium tuberculosis
EQRASALWSHPDPT

SEQ ID NO: 63126 - protein, 14 aa, Mycobacterium tuberculosis
QRASALWSHPDPTA

SEQ ID NO: 63127 - protein, 14 aa, Mycobacterium tuberculosis
RASALWSHPDPTAL

SEQ ID NO: 63128 - protein, 14 aa, Mycobacterium tuberculosis
ASALWSHPDPTALA

SEQ ID NO: 63129 - protein, 14 aa, Mycobacterium tuberculosis
SALWSHPDPTALAS

SEQ ID NO: 63130 - protein, 14 aa, Mycobacterium tuberculosis
ALWSHPDPTALASV

SEQ ID NO: 63131 - protein, 14 aa, Mycobacterium tuberculosis
LWSHPDPTALASVP

SEQ ID NO: 63132 - protein, 14 aa, Mycobacterium tuberculosis
WSHPDPTALASVPG

SEQ ID NO: 63133 - protein, 14 aa, Mycobacterium tuberculosis
SHPDPTALASVPGS

SEQ ID NO: 63134 - protein, 14 aa, Mycobacterium tuberculosis
HPDPTALASVPGSR

SEQ ID NO: 63135 - protein, 14 aa, Mycobacterium tuberculosis
PDPTALASVPGSRR

SEQ ID NO: 63136 - protein, 14 aa, Mycobacterium tuberculosis
DPTALASVPGSRRQ

SEQ ID NO: 63137 - protein, 14 aa, Mycobacterium tuberculosis
PTALASVPGSRRQW

SEQ ID NO: 63138 - protein, 14 aa, Mycobacterium tuberculosis
TALASVPGSRRQWE

SEQ ID NO: 63139 - protein, 14 aa, Mycobacterium tuberculosis
ALASVPGSRRQWER

SEQ ID NO: 63140 - protein, 14 aa, Mycobacterium tuberculosis
LASVPGSRRQWERD

SEQ ID NO: 63141 - protein, 14 aa, Mycobacterium tuberculosis
ASVPGSRRQWERDP

SEQ ID NO: 63142 - protein, 14 aa, Mycobacterium tuberculosis
SVPGSRRQWERDPH

SEQ ID NO: 63143 - protein, 14 aa, Mycobacterium tuberculosis
VPGSRRQWERDPHD

SEQ ID NO: 63144 - protein, 14 aa, Mycobacterium tuberculosis
PGSRRQWERDPHDP

SEQ ID NO: 63145 - protein, 14 aa, Mycobacterium tuberculosis
GSRRQWERDPHDPD

SEQ ID NO: 63146 - protein, 14 aa, Mycobacterium tuberculosis
SRRQWERDPHDPDF

SEQ ID NO: 63147 - protein, 14 aa, Mycobacterium tuberculosis
RRQWERDPHDPDFL

SEQ ID NO: 63148 - protein, 14 aa, Mycobacterium tuberculosis
RQWERDPHDPDFLV

SEQ ID NO: 63149 - protein, 14 aa, Mycobacterium tuberculosis
QWERDPHDPDFLVL

SEQ ID NO: 63150 - protein, 14 aa, Mycobacterium tuberculosis
WERDPHDPDFLVLR

SEQ ID NO: 63151 - protein, 14 aa, Mycobacterium tuberculosis
ERDPHDPDFLVLRA

SEQ ID NO: 63152 - protein, 14 aa, Mycobacterium tuberculosis
RDPHDPDFLVLRAG

SEQ ID NO: 63153 - protein, 14 aa, Mycobacterium tuberculosis
DPHDPDFLVLRAGR

SEQ ID NO: 63154 - protein, 14 aa, Mycobacterium tuberculosis
PHDPDFLVLRAGRH

SEQ ID NO: 63155 - protein, 14 aa, Mycobacterium tuberculosis
HDPDFLVLRAGRHT

SEQ ID NO: 63156 - protein, 14 aa, Mycobacterium tuberculosis
DPDFLVLRAGRHTV

SEQ ID NO: 63157 - protein, 14 aa, Mycobacterium tuberculosis
PDFLVLRAGRHTVP

SEQ ID NO: 63158 - protein, 14 aa, Mycobacterium tuberculosis
DFLVLRAGRHTVPL

SEQ ID NO: 63159 - protein, 14 aa, Mycobacterium tuberculosis
FLVLRAGRHTVPLA

SEQ ID NO: 63160 - protein, 14 aa, Mycobacterium tuberculosis
LVLRAGRHTVPLAT

SEQ ID NO: 63161 - protein, 14 aa, Mycobacterium tuberculosis
VLRAGRHTVPLATT

SEQ ID NO: 63162 - protein, 14 aa, Mycobacterium tuberculosis
LRAGRHTVPLATTL

SEQ ID NO: 63163 - protein, 14 aa, Mycobacterium tuberculosis
RAGRHTVPLATTLR

SEQ ID NO: 63164 - protein, 14 aa, Mycobacterium tuberculosis
AGRHTVPLATTLRV

SEQ ID NO: 63165 - protein, 14 aa, Mycobacterium tuberculosis
GRHTVPLATTLRVN

SEQ ID NO: 63166 - protein, 14 aa, Mycobacterium tuberculosis
RHTVPLATTLRVND

SEQ ID NO: 63167 - protein, 14 aa, Mycobacterium tuberculosis
HTVPLATTLRVNDT

SEQ ID NO: 63168 - protein, 14 aa, Mycobacterium tuberculosis
TVPLATTLRVNDTA

SEQ ID NO: 63169 - protein, 14 aa, Mycobacterium tuberculosis
VPLATTLRVNDTAD

SEQ ID NO: 63170 - protein, 14 aa, Mycobacterium tuberculosis
PLATTLRVNDTADE

SEQ ID NO: 63171 - protein, 14 aa, Mycobacterium tuberculosis
LATTLRVNDTADEI

SEQ ID NO: 63172 - protein, 14 aa, Mycobacterium tuberculosis
ATTLRVNDTADEID

SEQ ID NO: 63173 - protein, 14 aa, Mycobacterium tuberculosis
TTLRVNDTADEIDL

SEQ ID NO: 63174 - protein, 14 aa, Mycobacterium tuberculosis
TLRVNDTADEIDLE

SEQ ID NO: 63175 - protein, 14 aa, Mycobacterium tuberculosis
LRVNDTADEIDLEP

SEQ ID NO: 63176 - protein, 14 aa, Mycobacterium tuberculosis
RVNDTADEIDLEPV

SEQ ID NO: 63177 - protein, 14 aa, Mycobacterium tuberculosis
VNDTADEIDLEPVS

SEQ ID NO: 63178 - protein, 14 aa, Mycobacterium tuberculosis
NDTADEIDLEPVSH

SEQ ID NO: 63179 - protein, 14 aa, Mycobacterium tuberculosis
DTADEIDLEPVSHS

SEQ ID NO: 63180 - protein, 14 aa, Mycobacterium tuberculosis
TADEIDLEPVSHSA

SEQ ID NO: 63181 - protein, 14 aa, Mycobacterium tuberculosis
ADEIDLEPVSHSAL

SEQ ID NO: 63182 - protein, 14 aa, Mycobacterium tuberculosis
DEIDLEPVSHSALR

SEQ ID NO: 63183 - protein, 14 aa, Mycobacterium tuberculosis
EIDLEPVSHSALRS

SEQ ID NO: 63184 - protein, 14 aa, Mycobacterium tuberculosis
IDLEPVSHSALRSL

SEQ ID NO: 63185 - protein, 14 aa, Mycobacterium tuberculosis
DLEPVSHSALRSLL

SEQ ID NO: 63186 - protein, 14 aa, Mycobacterium tuberculosis
LEPVSHSALRSLLD

SEQ ID NO: 63187 - protein, 14 aa, Mycobacterium tuberculosis
EPVSHSALRSLLDT

SEQ ID NO: 63188 - protein, 14 aa, Mycobacterium tuberculosis
PVSHSALRSLLDTQ

SEQ ID NO: 63189 - protein, 14 aa, Mycobacterium tuberculosis
VSHSALRSLLDTQR

SEQ ID NO: 63190 - protein, 14 aa, Mycobacterium tuberculosis
SHSALRSLLDTQRS

SEQ ID NO: 63191 - protein, 14 aa, Mycobacterium tuberculosis
HSALRSLLDTQRSI

SEQ ID NO: 63192 - protein, 14 aa, Mycobacterium tuberculosis
SALRSLLDTQRSIG

SEQ ID NO: 63193 - protein, 14 aa, Mycobacterium tuberculosis
ALRSLLDTQRSIGD

SEQ ID NO: 63194 - protein, 14 aa, Mycobacterium tuberculosis
LRSLLDTQRSIGDV

SEQ ID NO: 63195 - protein, 14 aa, Mycobacterium tuberculosis
RSLLDTQRSIGDVP

SEQ ID NO: 63196 - protein, 14 aa, Mycobacterium tuberculosis
SLLDTQRSIGDVPT

SEQ ID NO: 63197 - protein, 14 aa, Mycobacterium tuberculosis
LLDTQRSIGDVPTG

SEQ ID NO: 63198 - protein, 14 aa, Mycobacterium tuberculosis
LDTQRSIGDVPTGI

SEQ ID NO: 63199 - protein, 14 aa, Mycobacterium tuberculosis
DTQRSIGDVPTGID

SEQ ID NO: 63200 - protein, 14 aa, Mycobacterium tuberculosis
TQRSIGDVPTGIDL

SEQ ID NO: 63201 - protein, 14 aa, Mycobacterium tuberculosis
QRSIGDVPTGIDLT

SEQ ID NO: 63202 - protein, 14 aa, Mycobacterium tuberculosis
RSIGDVPTGIDLTK

SEQ ID NO: 63203 - protein, 14 aa, Mycobacterium tuberculosis
SIGDVPTGIDLTKV

SEQ ID NO: 63204 - protein, 14 aa, Mycobacterium tuberculosis
IGDVPTGIDLTKVS

SEQ ID NO: 63205 - protein, 14 aa, Mycobacterium tuberculosis
GDVPTGIDLTKVSP

SEQ ID NO: 63206 - protein, 14 aa, Mycobacterium tuberculosis
DVPTGIDLTKVSPI

SEQ ID NO: 63207 - protein, 14 aa, Mycobacterium tuberculosis
VPTGIDLTKVSPIT

SEQ ID NO: 63208 - protein, 14 aa, Mycobacterium tuberculosis
PTGIDLTKVSPITV

SEQ ID NO: 63209 - protein, 14 aa, Mycobacterium tuberculosis
TGIDLTKVSPITVL

SEQ ID NO: 63210 - protein, 14 aa, Mycobacterium tuberculosis
GIDLTKVSPITVLG

SEQ ID NO: 63211 - protein, 14 aa, Mycobacterium tuberculosis
IDLTKVSPITVLGE

SEQ ID NO: 63212 - protein, 14 aa, Mycobacterium tuberculosis
DLTKVSPITVLGER

SEQ ID NO: 63213 - protein, 14 aa, Mycobacterium tuberculosis
LTKVSPITVLGERA

SEQ ID NO: 63214 - protein, 14 aa, Mycobacterium tuberculosis
TKVSPITVLGERAQ

SEQ ID NO: 63215 - protein, 14 aa, Mycobacterium tuberculosis
KVSPITVLGERAQV

SEQ ID NO: 63216 - protein, 14 aa, Mycobacterium tuberculosis
VSPITVLGERAQVR

SEQ ID NO: 63217 - protein, 14 aa, Mycobacterium tuberculosis
SPITVLGERAQVRA

SEQ ID NO: 63218 - protein, 14 aa, Mycobacterium tuberculosis
PITVLGERAQVRAV

SEQ ID NO: 63219 - protein, 14 aa, Mycobacterium tuberculosis
ITVLGERAQVRAVL

SEQ ID NO: 63220 - protein, 14 aa, Mycobacterium tuberculosis
TVLGERAQVRAVLR

SEQ ID NO: 63221 - protein, 14 aa, Mycobacterium tuberculosis
VLGERAQVRAVLRA

SEQ ID NO: 63222 - protein, 14 aa, Mycobacterium tuberculosis
LGERAQVRAVLRAW

SEQ ID NO: 63223 - protein, 14 aa, Mycobacterium tuberculosis
GERAQVRAVLRAWI

SEQ ID NO: 63224 - protein, 14 aa, Mycobacterium tuberculosis
ERAQVRAVLRAWIA

SEQ ID NO: 63225 - protein, 14 aa, Mycobacterium tuberculosis
RAQVRAVLRAWIAQ

SEQ ID NO: 63226 - protein, 14 aa, Mycobacterium tuberculosis
AQVRAVLRAWIAQA

SEQ ID NO: 63227 - protein, 14 aa, Mycobacterium tuberculosis
QVRAVLRAWIAQAV

SEQ ID NO: 63228 - protein, 14 aa, Mycobacterium tuberculosis
VRAVLRAWIAQAVT

SEQ ID NO: 63229 - protein, 14 aa, Mycobacterium tuberculosis
RAVLRAWIAQAVTW

SEQ ID NO: 63230 - protein, 14 aa, Mycobacterium tuberculosis
AVLRAWIAQAVTWH

SEQ ID NO: 63231 - protein, 14 aa, Mycobacterium tuberculosis
VLRAWIAQAVTWHD

SEQ ID NO: 63232 - protein, 14 aa, Mycobacterium tuberculosis
LRAWIAQAVTWHDP

SEQ ID NO: 63233 - protein, 14 aa, Mycobacterium tuberculosis
RAWIAQAVTWHDPT

SEQ ID NO: 63234 - protein, 14 aa, Mycobacterium tuberculosis
AWIAQAVTWHDPTV

SEQ ID NO: 63235 - protein, 14 aa, Mycobacterium tuberculosis
WIAQAVTWHDPTVL

SEQ ID NO: 63236 - protein, 14 aa, Mycobacterium tuberculosis
IAQAVTWHDPTVLG

SEQ ID NO: 63237 - protein, 14 aa, Mycobacterium tuberculosis
AQAVTWHDPTVLGV

SEQ ID NO: 63238 - protein, 14 aa, Mycobacterium tuberculosis
QAVTWHDPTVLGVA

SEQ ID NO: 63239 - protein, 14 aa, Mycobacterium tuberculosis
AVTWHDPTVLGVAL

SEQ ID NO: 63240 - protein, 14 aa, Mycobacterium tuberculosis
VTWHDPTVLGVALA

SEQ ID NO: 63241 - protein, 14 aa, Mycobacterium tuberculosis
TWHDPTVLGVALAA

SEQ ID NO: 63242 - protein, 14 aa, Mycobacterium tuberculosis
WHDPTVLGVALAAR

SEQ ID NO: 63243 - protein, 14 aa, Mycobacterium tuberculosis
HDPTVLGVALAARD

SEQ ID NO: 63244 - protein, 14 aa, Mycobacterium tuberculosis
DPTVLGVALAARDL

SEQ ID NO: 63245 - protein, 14 aa, Mycobacterium tuberculosis
PTVLGVALAARDLE

SEQ ID NO: 63246 - protein, 14 aa, Mycobacterium tuberculosis
TVLGVALAARDLEG

SEQ ID NO: 63247 - protein, 14 aa, Mycobacterium tuberculosis
VLGVALAARDLEGR

SEQ ID NO: 63248 - protein, 14 aa, Mycobacterium tuberculosis
LGVALAARDLEGRD

SEQ ID NO: 63249 - protein, 14 aa, Mycobacterium tuberculosis
GVALAARDLEGRDW

SEQ ID NO: 63250 - protein, 14 aa, Mycobacterium tuberculosis
VALAARDLEGRDWN

SEQ ID NO: 63251 - protein, 14 aa, Mycobacterium tuberculosis
ALAARDLEGRDWNW

SEQ ID NO: 63252 - protein, 14 aa, Mycobacterium tuberculosis
LAARDLEGRDWNWL

SEQ ID NO: 63253 - protein, 14 aa, Mycobacterium tuberculosis
AARDLEGRDWNWLK

SEQ ID NO: 63254 - protein, 14 aa, Mycobacterium tuberculosis
ARDLEGRDWNWLKW

SEQ ID NO: 63255 - protein, 14 aa, Mycobacterium tuberculosis
RDLEGRDWNWLKWL

SEQ ID NO: 63256 - protein, 14 aa, Mycobacterium tuberculosis
DLEGRDWNWLKWLP

SEQ ID NO: 63257 - protein, 14 aa, Mycobacterium tuberculosis
LEGRDWNWLKWLPH

SEQ ID NO: 63258 - protein, 14 aa, Mycobacterium tuberculosis
EGRDWNWLKWLPHV

SEQ ID NO: 63259 - protein, 14 aa, Mycobacterium tuberculosis
GRDWNWLKWLPHVD

SEQ ID NO: 63260 - protein, 14 aa, Mycobacterium tuberculosis
RDWNWLKWLPHVDI

SEQ ID NO: 63261 - protein, 14 aa, Mycobacterium tuberculosis
DWNWLKWLPHVDIP

SEQ ID NO: 63262 - protein, 14 aa, Mycobacterium tuberculosis
WNWLKWLPHVDIPG

SEQ ID NO: 63263 - protein, 14 aa, Mycobacterium tuberculosis
NWLKWLPHVDIPGR

SEQ ID NO: 63264 - protein, 14 aa, Mycobacterium tuberculosis
WLKWLPHVDIPGRL

SEQ ID NO: 63265 - protein, 14 aa, Mycobacterium tuberculosis
LKWLPHVDIPGRLD

SEQ ID NO: 63266 - protein, 14 aa, Mycobacterium tuberculosis
KWLPHVDIPGRLDA

SEQ ID NO: 63267 - protein, 14 aa, Mycobacterium tuberculosis
WLPHVDIPGRLDAL

SEQ ID NO: 63268 - protein, 14 aa, Mycobacterium tuberculosis
LPHVDIPGRLDALG

SEQ ID NO: 63269 - protein, 14 aa, Mycobacterium tuberculosis
PHVDIPGRLDALGP

SEQ ID NO: 63270 - protein, 14 aa, Mycobacterium tuberculosis
HVDIPGRLDALGPA

SEQ ID NO: 63271 - protein, 14 aa, Mycobacterium tuberculosis
VDIPGRLDALGPAR

SEQ ID NO: 63272 - protein, 14 aa, Mycobacterium tuberculosis
DIPGRLDALGPARN

SEQ ID NO: 63273 - protein, 14 aa, Mycobacterium tuberculosis
IPGRLDALGPARNL

SEQ ID NO: 63274 - protein, 14 aa, Mycobacterium tuberculosis
PGRLDALGPARNLS

SEQ ID NO: 63275 - protein, 14 aa, Mycobacterium tuberculosis
GRLDALGPARNLST

SEQ ID NO: 63276 - protein, 14 aa, Mycobacterium tuberculosis
RLDALGPARNLSTD

SEQ ID NO: 63277 - protein, 14 aa, Mycobacterium tuberculosis
LDALGPARNLSTDP

SEQ ID NO: 63278 - protein, 14 aa, Mycobacterium tuberculosis
DALGPARNLSTDPD

SEQ ID NO: 63279 - protein, 14 aa, Mycobacterium tuberculosis
ALGPARNLSTDPDE

SEQ ID NO: 63280 - protein, 14 aa, Mycobacterium tuberculosis
LGPARNLSTDPDEL

SEQ ID NO: 63281 - protein, 14 aa, Mycobacterium tuberculosis
GPARNLSTDPDELI

SEQ ID NO: 63282 - protein, 14 aa, Mycobacterium tuberculosis
PARNLSTDPDELIA

SEQ ID NO: 63283 - protein, 14 aa, Mycobacterium tuberculosis
ARNLSTDPDELIAL

SEQ ID NO: 63284 - protein, 14 aa, Mycobacterium tuberculosis
RNLSTDPDELIALL

SEQ ID NO: 63285 - protein, 14 aa, Mycobacterium tuberculosis
NLSTDPDELIALLG

SEQ ID NO: 63286 - protein, 14 aa, Mycobacterium tuberculosis
LSTDPDELIALLGP

SEQ ID NO: 63287 - protein, 14 aa, Mycobacterium tuberculosis
STDPDELIALLGPV

SEQ ID NO: 63288 - protein, 14 aa, Mycobacterium tuberculosis
TDPDELIALLGPVL

SEQ ID NO: 63289 - protein, 14 aa, Mycobacterium tuberculosis
DPDELIALLGPVLA

SEQ ID NO: 63290 - protein, 14 aa, Mycobacterium tuberculosis
PDELIALLGPVLAD

SEQ ID NO: 63291 - protein, 14 aa, Mycobacterium tuberculosis
DELIALLGPVLADR

SEQ ID NO: 63292 - protein, 14 aa, Mycobacterium tuberculosis
ELIALLGPVLADRP

SEQ ID NO: 63293 - protein, 14 aa, Mycobacterium tuberculosis
LIALLGPVLADRPA

SEQ ID NO: 63294 - protein, 14 aa, Mycobacterium tuberculosis
IALLGPVLADRPAF

SEQ ID NO: 63295 - protein, 14 aa, Mycobacterium tuberculosis
ALLGPVLADRPAFT

SEQ ID NO: 63296 - protein, 14 aa, Mycobacterium tuberculosis
LLGPVLADRPAFTG

SEQ ID NO: 63297 - protein, 14 aa, Mycobacterium tuberculosis
LGPVLADRPAFTGQ

SEQ ID NO: 63298 - protein, 14 aa, Mycobacterium tuberculosis
GPVLADRPAFTGQP

SEQ ID NO: 63299 - protein, 14 aa, Mycobacterium tuberculosis
PVLADRPAFTGQPT

SEQ ID NO: 63300 - protein, 14 aa, Mycobacterium tuberculosis
VLADRPAFTGQPTD

SEQ ID NO: 63301 - protein, 14 aa, Mycobacterium tuberculosis
LADRPAFTGQPTDA

SEQ ID NO: 63302 - protein, 14 aa, Mycobacterium tuberculosis
ADRPAFTGQPTDAL

SEQ ID NO: 63303 - protein, 14 aa, Mycobacterium tuberculosis
DRPAFTGQPTDALR

SEQ ID NO: 63304 - protein, 14 aa, Mycobacterium tuberculosis
RPAFTGQPTDALRH

SEQ ID NO: 63305 - protein, 14 aa, Mycobacterium tuberculosis
PAFTGQPTDALRHL

SEQ ID NO: 63306 - protein, 14 aa, Mycobacterium tuberculosis
AFTGQPTDALRHLL

SEQ ID NO: 63307 - protein, 14 aa, Mycobacterium tuberculosis
FTGQPTDALRHLLI

SEQ ID NO: 63308 - protein, 14 aa, Mycobacterium tuberculosis
TGQPTDALRHLLIV

SEQ ID NO: 63309 - protein, 14 aa, Mycobacterium tuberculosis
GQPTDALRHLLIVV

SEQ ID NO: 63310 - protein, 14 aa, Mycobacterium tuberculosis
QPTDALRHLLIVVD

SEQ ID NO: 63311 - protein, 14 aa, Mycobacterium tuberculosis
PTDALRHLLIVVDD

SEQ ID NO: 63312 - protein, 14 aa, Mycobacterium tuberculosis
TDALRHLLIVVDDP

SEQ ID NO: 63313 - protein, 14 aa, Mycobacterium tuberculosis
DALRHLLIVVDDPD

SEQ ID NO: 63314 - protein, 14 aa, Mycobacterium tuberculosis
ALRHLLIVVDDPDY

SEQ ID NO: 63315 - protein, 14 aa, Mycobacterium tuberculosis
LRHLLIVVDDPDYD

SEQ ID NO: 63316 - protein, 14 aa, Mycobacterium tuberculosis
RHLLIVVDDPDYDL

SEQ ID NO: 63317 - protein, 14 aa, Mycobacterium tuberculosis
HLLIVVDDPDYDLG

SEQ ID NO: 63318 - protein, 14 aa, Mycobacterium tuberculosis
LLIVVDDPDYDLGA

SEQ ID NO: 63319 - protein, 14 aa, Mycobacterium tuberculosis
LIVVDDPDYDLGAS

SEQ ID NO: 63320 - protein, 14 aa, Mycobacterium tuberculosis
IVVDDPDYDLGASP

SEQ ID NO: 63321 - protein, 14 aa, Mycobacterium tuberculosis
VVDDPDYDLGASPL

SEQ ID NO: 63322 - protein, 14 aa, Mycobacterium tuberculosis
VDDPDYDLGASPLA

SEQ ID NO: 63323 - protein, 14 aa, Mycobacterium tuberculosis
DDPDYDLGASPLAV

SEQ ID NO: 63324 - protein, 14 aa, Mycobacterium tuberculosis
DPDYDLGASPLAVG

SEQ ID NO: 63325 - protein, 14 aa, Mycobacterium tuberculosis
PDYDLGASPLAVGR

SEQ ID NO: 63326 - protein, 14 aa, Mycobacterium tuberculosis
DYDLGASPLAVGRA

SEQ ID NO: 63327 - protein, 14 aa, Mycobacterium tuberculosis
YDLGASPLAVGRAG

SEQ ID NO: 63328 - protein, 14 aa, Mycobacterium tuberculosis
DLGASPLAVGRAGV

SEQ ID NO: 63329 - protein, 14 aa, Mycobacterium tuberculosis
LGASPLAVGRAGVT

SEQ ID NO: 63330 - protein, 14 aa, Mycobacterium tuberculosis
GASPLAVGRAGVTV

SEQ ID NO: 63331 - protein, 14 aa, Mycobacterium tuberculosis
ASPLAVGRAGVTVV

SEQ ID NO: 63332 - protein, 14 aa, Mycobacterium tuberculosis
SPLAVGRAGVTVVH

SEQ ID NO: 63333 - protein, 14 aa, Mycobacterium tuberculosis
PLAVGRAGVTVVHC

SEQ ID NO: 63334 - protein, 14 aa, Mycobacterium tuberculosis
LAVGRAGVTVVHCS

SEQ ID NO: 63335 - protein, 14 aa, Mycobacterium tuberculosis
AVGRAGVTVVHCSA

SEQ ID NO: 63336 - protein, 14 aa, Mycobacterium tuberculosis
VGRAGVTVVHCSAS

SEQ ID NO: 63337 - protein, 14 aa, Mycobacterium tuberculosis
GRAGVTVVHCSASA

SEQ ID NO: 63338 - protein, 14 aa, Mycobacterium tuberculosis
RAGVTVVHCSASAP

SEQ ID NO: 63339 - protein, 14 aa, Mycobacterium tuberculosis
AGVTVVHCSASAPH

SEQ ID NO: 63340 - protein, 14 aa, Mycobacterium tuberculosis
GVTVVHCSASAPHR

SEQ ID NO: 63341 - protein, 14 aa, Mycobacterium tuberculosis
VTVVHCSASAPHRE

SEQ ID NO: 63342 - protein, 14 aa, Mycobacterium tuberculosis
TVVHCSASAPHREQ

SEQ ID NO: 63343 - protein, 14 aa, Mycobacterium tuberculosis
VVHCSASAPHREQY

SEQ ID NO: 63344 - protein, 14 aa, Mycobacterium tuberculosis
VHCSASAPHREQYS

SEQ ID NO: 63345 - protein, 14 aa, Mycobacterium tuberculosis
HCSASAPHREQYSD

SEQ ID NO: 63346 - protein, 14 aa, Mycobacterium tuberculosis
CSASAPHREQYSDP

SEQ ID NO: 63347 - protein, 14 aa, Mycobacterium tuberculosis
SASAPHREQYSDPE

SEQ ID NO: 63348 - protein, 14 aa, Mycobacterium tuberculosis
ASAPHREQYSDPEK

SEQ ID NO: 63349 - protein, 14 aa, Mycobacterium tuberculosis
SAPHREQYSDPEKP

SEQ ID NO: 63350 - protein, 14 aa, Mycobacterium tuberculosis
APHREQYSDPEKPI

SEQ ID NO: 63351 - protein, 14 aa, Mycobacterium tuberculosis
PHREQYSDPEKPIL

SEQ ID NO: 63352 - protein, 14 aa, Mycobacterium tuberculosis
HREQYSDPEKPILR

SEQ ID NO: 63353 - protein, 14 aa, Mycobacterium tuberculosis
REQYSDPEKPILRV

SEQ ID NO: 63354 - protein, 14 aa, Mycobacterium tuberculosis
EQYSDPEKPILRVA

SEQ ID NO: 63355 - protein, 14 aa, Mycobacterium tuberculosis
QYSDPEKPILRVAH

SEQ ID NO: 63356 - protein, 14 aa, Mycobacterium tuberculosis
YSDPEKPILRVAHG

SEQ ID NO: 63357 - protein, 14 aa, Mycobacterium tuberculosis
SDPEKPILRVAHGA

SEQ ID NO: 63358 - protein, 14 aa, Mycobacterium tuberculosis
DPEKPILRVAHGAI

SEQ ID NO: 63359 - protein, 14 aa, Mycobacterium tuberculosis
PEKPILRVAHGAIE

SEQ ID NO: 63360 - protein, 14 aa, Mycobacterium tuberculosis
EKPILRVAHGAIER

SEQ ID NO: 63361 - protein, 14 aa, Mycobacterium tuberculosis
KPILRVAHGAIERW

SEQ ID NO: 63362 - protein, 14 aa, Mycobacterium tuberculosis
PILRVAHGAIERWQ

SEQ ID NO: 63363 - protein, 14 aa, Mycobacterium tuberculosis
ILRVAHGAIERWQT

SEQ ID NO: 63364 - protein, 14 aa, Mycobacterium tuberculosis
LRVAHGAIERWQTG

SEQ ID NO: 63365 - protein, 14 aa, Mycobacterium tuberculosis
RVAHGAIERWQTGG

SEQ ID NO: 63366 - protein, 14 aa, Mycobacterium tuberculosis
VAHGAIERWQTGGW

SEQ ID NO: 63367 - protein, 14 aa, Mycobacterium tuberculosis
AHGAIERWQTGGWQ

SEQ ID NO: 63368 - protein, 14 aa, Mycobacterium tuberculosis
HGAIERWQTGGWQP

SEQ ID NO: 63369 - protein, 14 aa, Mycobacterium tuberculosis
GAIERWQTGGWQPY

SEQ ID NO: 63370 - protein, 14 aa, Mycobacterium tuberculosis
AIERWQTGGWQPYI

SEQ ID NO: 63371 - protein, 14 aa, Mycobacterium tuberculosis
IERWQTGGWQPYID

SEQ ID NO: 63372 - protein, 14 aa, Mycobacterium tuberculosis
ERWQTGGWQPYIDA

SEQ ID NO: 63373 - protein, 14 aa, Mycobacterium tuberculosis
RWQTGGWQPYIDAA

SEQ ID NO: 63374 - protein, 14 aa, Mycobacterium tuberculosis
WQTGGWQPYIDAAD

SEQ ID NO: 63375 - protein, 14 aa, Mycobacterium tuberculosis
QTGGWQPYIDAADQ

SEQ ID NO: 63376 - protein, 14 aa, Mycobacterium tuberculosis
TGGWQPYIDAADQF

SEQ ID NO: 63377 - protein, 14 aa, Mycobacterium tuberculosis
GGWQPYIDAADQFS

SEQ ID NO: 63378 - protein, 14 aa, Mycobacterium tuberculosis
GWQPYIDAADQFSA

SEQ ID NO: 63379 - protein, 14 aa, Mycobacterium tuberculosis
WQPYIDAADQFSAD

SEQ ID NO: 63380 - protein, 14 aa, Mycobacterium tuberculosis
QPYIDAADQFSADE

SEQ ID NO: 63381 - protein, 14 aa, Mycobacterium tuberculosis
PYIDAADQFSADEA

SEQ ID NO: 63382 - protein, 14 aa, Mycobacterium tuberculosis
YIDAADQFSADEAA

SEQ ID NO: 63383 - protein, 14 aa, Mycobacterium tuberculosis
IDAADQFSADEAAH

SEQ ID NO: 63384 - protein, 14 aa, Mycobacterium tuberculosis
DAADQFSADEAAHL

SEQ ID NO: 63385 - protein, 14 aa, Mycobacterium tuberculosis
AADQFSADEAAHLA

SEQ ID NO: 63386 - protein, 14 aa, Mycobacterium tuberculosis
ADQFSADEAAHLAR

SEQ ID NO: 63387 - protein, 14 aa, Mycobacterium tuberculosis
DQFSADEAAHLARR

SEQ ID NO: 63388 - protein, 14 aa, Mycobacterium tuberculosis
QFSADEAAHLARRL

SEQ ID NO: 63389 - protein, 14 aa, Mycobacterium tuberculosis
FSADEAAHLARRLS

SEQ ID NO: 63390 - protein, 14 aa, Mycobacterium tuberculosis
SADEAAHLARRLSR

SEQ ID NO: 63391 - protein, 14 aa, Mycobacterium tuberculosis
ADEAAHLARRLSRW

SEQ ID NO: 63392 - protein, 14 aa, Mycobacterium tuberculosis
DEAAHLARRLSRWD

SEQ ID NO: 63393 - protein, 14 aa, Mycobacterium tuberculosis
EAAHLARRLSRWDS

SEQ ID NO: 63394 - protein, 14 aa, Mycobacterium tuberculosis
AAHLARRLSRWDSN

SEQ ID NO: 63395 - protein, 14 aa, Mycobacterium tuberculosis
AHLARRLSRWDSNP

SEQ ID NO: 63396 - protein, 14 aa, Mycobacterium tuberculosis
HLARRLSRWDSNPT

SEQ ID NO: 63397 - protein, 14 aa, Mycobacterium tuberculosis
LARRLSRWDSNPTH

SEQ ID NO: 63398 - protein, 14 aa, Mycobacterium tuberculosis
ARRLSRWDSNPTHA

SEQ ID NO: 63399 - protein, 14 aa, Mycobacterium tuberculosis
RRLSRWDSNPTHAG

SEQ ID NO: 63400 - protein, 14 aa, Mycobacterium tuberculosis
RLSRWDSNPTHAGL

SEQ ID NO: 63401 - protein, 14 aa, Mycobacterium tuberculosis
LSRWDSNPTHAGLR

SEQ ID NO: 63402 - protein, 14 aa, Mycobacterium tuberculosis
SRWDSNPTHAGLRS

SEQ ID NO: 63403 - protein, 14 aa, Mycobacterium tuberculosis
RWDSNPTHAGLRSA

SEQ ID NO: 63404 - protein, 14 aa, Mycobacterium tuberculosis
WDSNPTHAGLRSAA

SEQ ID NO: 63405 - protein, 14 aa, Mycobacterium tuberculosis
DSNPTHAGLRSAAT

SEQ ID NO: 63406 - protein, 14 aa, Mycobacterium tuberculosis
SNPTHAGLRSAATR

SEQ ID NO: 63407 - protein, 14 aa, Mycobacterium tuberculosis
NPTHAGLRSAATRG

SEQ ID NO: 63408 - protein, 14 aa, Mycobacterium tuberculosis
PTHAGLRSAATRGA

SEQ ID NO: 63409 - protein, 14 aa, Mycobacterium tuberculosis
THAGLRSAATRGAS

SEQ ID NO: 63410 - protein, 14 aa, Mycobacterium tuberculosis
HAGLRSAATRGASF

SEQ ID NO: 63411 - protein, 14 aa, Mycobacterium tuberculosis
AGLRSAATRGASFT

SEQ ID NO: 63412 - protein, 14 aa, Mycobacterium tuberculosis
GLRSAATRGASFTT

SEQ ID NO: 63413 - protein, 14 aa, Mycobacterium tuberculosis
LRSAATRGASFTTL

SEQ ID NO: 63414 - protein, 14 aa, Mycobacterium tuberculosis
RSAATRGASFTTLL

SEQ ID NO: 63415 - protein, 14 aa, Mycobacterium tuberculosis
SAATRGASFTTLLG

SEQ ID NO: 63416 - protein, 14 aa, Mycobacterium tuberculosis
AATRGASFTTLLGI

SEQ ID NO: 63417 - protein, 14 aa, Mycobacterium tuberculosis
ATRGASFTTLLGIE

SEQ ID NO: 63418 - protein, 14 aa, Mycobacterium tuberculosis
TRGASFTTLLGIED

SEQ ID NO: 63419 - protein, 14 aa, Mycobacterium tuberculosis
RGASFTTLLGIEDA

SEQ ID NO: 63420 - protein, 14 aa, Mycobacterium tuberculosis
GASFTTLLGIEDAS

SEQ ID NO: 63421 - protein, 14 aa, Mycobacterium tuberculosis
ASFTTLLGIEDASR

SEQ ID NO: 63422 - protein, 14 aa, Mycobacterium tuberculosis
SFTTLLGIEDASRL

SEQ ID NO: 63423 - protein, 14 aa, Mycobacterium tuberculosis
FTTLLGIEDASRLD

SEQ ID NO: 63424 - protein, 14 aa, Mycobacterium tuberculosis
TTLLGIEDASRLDV

SEQ ID NO: 63425 - protein, 14 aa, Mycobacterium tuberculosis
TLLGIEDASRLDVP

SEQ ID NO: 63426 - protein, 14 aa, Mycobacterium tuberculosis
LLGIEDASRLDVPA

SEQ ID NO: 63427 - protein, 14 aa, Mycobacterium tuberculosis
LGIEDASRLDVPAL

SEQ ID NO: 63428 - protein, 14 aa, Mycobacterium tuberculosis
GIEDASRLDVPALW

SEQ ID NO: 63429 - protein, 14 aa, Mycobacterium tuberculosis
IEDASRLDVPALWA

SEQ ID NO: 63430 - protein, 14 aa, Mycobacterium tuberculosis
EDASRLDVPALWAP

SEQ ID NO: 63431 - protein, 14 aa, Mycobacterium tuberculosis
DASRLDVPALWAPR

SEQ ID NO: 63432 - protein, 14 aa, Mycobacterium tuberculosis
ASRLDVPALWAPRR

SEQ ID NO: 63433 - protein, 14 aa, Mycobacterium tuberculosis
SRLDVPALWAPRRR

SEQ ID NO: 63434 - protein, 14 aa, Mycobacterium tuberculosis
RLDVPALWAPRRRD

SEQ ID NO: 63435 - protein, 14 aa, Mycobacterium tuberculosis
LDVPALWAPRRRDE

SEQ ID NO: 63436 - protein, 14 aa, Mycobacterium tuberculosis
DVPALWAPRRRDEE

SEQ ID NO: 63437 - protein, 14 aa, Mycobacterium tuberculosis
VPALWAPRRRDEEL

SEQ ID NO: 63438 - protein, 14 aa, Mycobacterium tuberculosis
PALWAPRRRDEELR

SEQ ID NO: 63439 - protein, 14 aa, Mycobacterium tuberculosis
ALWAPRRRDEELRV

SEQ ID NO: 63440 - protein, 14 aa, Mycobacterium tuberculosis
LWAPRRRDEELRVP

SEQ ID NO: 63441 - protein, 14 aa, Mycobacterium tuberculosis
WAPRRRDEELRVPI

SEQ ID NO: 63442 - protein, 14 aa, Mycobacterium tuberculosis
APRRRDEELRVPIG

SEQ ID NO: 63443 - protein, 14 aa, Mycobacterium tuberculosis
PRRRDEELRVPIGV

SEQ ID NO: 63444 - protein, 14 aa, Mycobacterium tuberculosis
RRRDEELRVPIGVT

SEQ ID NO: 63445 - protein, 14 aa, Mycobacterium tuberculosis
RRDEELRVPIGVTG

SEQ ID NO: 63446 - protein, 14 aa, Mycobacterium tuberculosis
RDEELRVPIGVTGT

SEQ ID NO: 63447 - protein, 14 aa, Mycobacterium tuberculosis
DEELRVPIGVTGTG

SEQ ID NO: 63448 - protein, 14 aa, Mycobacterium tuberculosis
EELRVPIGVTGTGE

SEQ ID NO: 63449 - protein, 14 aa, Mycobacterium tuberculosis
ELRVPIGVTGTGEP

SEQ ID NO: 63450 - protein, 14 aa, Mycobacterium tuberculosis
LRVPIGVTGTGEPL

SEQ ID NO: 63451 - protein, 14 aa, Mycobacterium tuberculosis
RVPIGVTGTGEPLM

SEQ ID NO: 63452 - protein, 14 aa, Mycobacterium tuberculosis
VPIGVTGTGEPLMF

SEQ ID NO: 63453 - protein, 14 aa, Mycobacterium tuberculosis
PIGVTGTGEPLMFD

SEQ ID NO: 63454 - protein, 14 aa, Mycobacterium tuberculosis
IGVTGTGEPLMFDL

SEQ ID NO: 63455 - protein, 14 aa, Mycobacterium tuberculosis
GVTGTGEPLMFDLK

SEQ ID NO: 63456 - protein, 14 aa, Mycobacterium tuberculosis
VTGTGEPLMFDLKD

SEQ ID NO: 63457 - protein, 14 aa, Mycobacterium tuberculosis
TGTGEPLMFDLKDE

SEQ ID NO: 63458 - protein, 14 aa, Mycobacterium tuberculosis
GTGEPLMFDLKDEA

SEQ ID NO: 63459 - protein, 14 aa, Mycobacterium tuberculosis
TGEPLMFDLKDEAE

SEQ ID NO: 63460 - protein, 14 aa, Mycobacterium tuberculosis
GEPLMFDLKDEAEG

SEQ ID NO: 63461 - protein, 14 aa, Mycobacterium tuberculosis
EPLMFDLKDEAEGG

SEQ ID NO: 63462 - protein, 14 aa, Mycobacterium tuberculosis
PLMFDLKDEAEGGM

SEQ ID NO: 63463 - protein, 14 aa, Mycobacterium tuberculosis
LMFDLKDEAEGGMG

SEQ ID NO: 63464 - protein, 14 aa, Mycobacterium tuberculosis
MFDLKDEAEGGMGP

SEQ ID NO: 63465 - protein, 14 aa, Mycobacterium tuberculosis
FDLKDEAEGGMGPH

SEQ ID NO: 63466 - protein, 14 aa, Mycobacterium tuberculosis
DLKDEAEGGMGPHG

SEQ ID NO: 63467 - protein, 14 aa, Mycobacterium tuberculosis
LKDEAEGGMGPHGL

SEQ ID NO: 63468 - protein, 14 aa, Mycobacterium tuberculosis
KDEAEGGMGPHGLM

SEQ ID NO: 63469 - protein, 14 aa, Mycobacterium tuberculosis
DEAEGGMGPHGLMI

SEQ ID NO: 63470 - protein, 14 aa, Mycobacterium tuberculosis
EAEGGMGPHGLMIG

SEQ ID NO: 63471 - protein, 14 aa, Mycobacterium tuberculosis
AEGGMGPHGLMIGM

SEQ ID NO: 63472 - protein, 14 aa, Mycobacterium tuberculosis
EGGMGPHGLMIGMT

SEQ ID NO: 63473 - protein, 14 aa, Mycobacterium tuberculosis
GGMGPHGLMIGMTG

SEQ ID NO: 63474 - protein, 14 aa, Mycobacterium tuberculosis
GMGPHGLMIGMTGS

SEQ ID NO: 63475 - protein, 14 aa, Mycobacterium tuberculosis
MGPHGLMIGMTGSG

SEQ ID NO: 63476 - protein, 14 aa, Mycobacterium tuberculosis
GPHGLMIGMTGSGK

SEQ ID NO: 63477 - protein, 14 aa, Mycobacterium tuberculosis
PHGLMIGMTGSGKS

SEQ ID NO: 63478 - protein, 14 aa, Mycobacterium tuberculosis
HGLMIGMTGSGKSQ

SEQ ID NO: 63479 - protein, 14 aa, Mycobacterium tuberculosis
GLMIGMTGSGKSQT

SEQ ID NO: 63480 - protein, 14 aa, Mycobacterium tuberculosis
LMIGMTGSGKSQTL

SEQ ID NO: 63481 - protein, 14 aa, Mycobacterium tuberculosis
MIGMTGSGKSQTLM

SEQ ID NO: 63482 - protein, 14 aa, Mycobacterium tuberculosis
IGMTGSGKSQTLMS

SEQ ID NO: 63483 - protein, 14 aa, Mycobacterium tuberculosis
GMTGSGKSQTLMSI

SEQ ID NO: 63484 - protein, 14 aa, Mycobacterium tuberculosis
MTGSGKSQTLMSIL

SEQ ID NO: 63485 - protein, 14 aa, Mycobacterium tuberculosis
TGSGKSQTLMSILL

SEQ ID NO: 63486 - protein, 14 aa, Mycobacterium tuberculosis
GSGKSQTLMSILLS

SEQ ID NO: 63487 - protein, 14 aa, Mycobacterium tuberculosis
SGKSQTLMSILLSL

SEQ ID NO: 63488 - protein, 14 aa, Mycobacterium tuberculosis
GKSQTLMSILLSLL

SEQ ID NO: 63489 - protein, 14 aa, Mycobacterium tuberculosis
KSQTLMSILLSLLT

SEQ ID NO: 63490 - protein, 14 aa, Mycobacterium tuberculosis
SQTLMSILLSLLTT

SEQ ID NO: 63491 - protein, 14 aa, Mycobacterium tuberculosis
QTLMSILLSLLTTH

SEQ ID NO: 63492 - protein, 14 aa, Mycobacterium tuberculosis
TLMSILLSLLTTHS

SEQ ID NO: 63493 - protein, 14 aa, Mycobacterium tuberculosis
LMSILLSLLTTHSA

SEQ ID NO: 63494 - protein, 14 aa, Mycobacterium tuberculosis
MSILLSLLTTHSAE

SEQ ID NO: 63495 - protein, 14 aa, Mycobacterium tuberculosis
SILLSLLTTHSAER

SEQ ID NO: 63496 - protein, 14 aa, Mycobacterium tuberculosis
ILLSLLTTHSAERL

SEQ ID NO: 63497 - protein, 14 aa, Mycobacterium tuberculosis
LLSLLTTHSAERLI

SEQ ID NO: 63498 - protein, 14 aa, Mycobacterium tuberculosis
LSLLTTHSAERLIV

SEQ ID NO: 63499 - protein, 14 aa, Mycobacterium tuberculosis
SLLTTHSAERLIVI

SEQ ID NO: 63500 - protein, 14 aa, Mycobacterium tuberculosis
LLTTHSAERLIVIY

SEQ ID NO: 63501 - protein, 14 aa, Mycobacterium tuberculosis
LTTHSAERLIVIYA

SEQ ID NO: 63502 - protein, 14 aa, Mycobacterium tuberculosis
TTHSAERLIVIYAD

SEQ ID NO: 63503 - protein, 14 aa, Mycobacterium tuberculosis
THSAERLIVIYADF

SEQ ID NO: 63504 - protein, 14 aa, Mycobacterium tuberculosis
HSAERLIVIYADFK

SEQ ID NO: 63505 - protein, 14 aa, Mycobacterium tuberculosis
SAERLIVIYADFKG

SEQ ID NO: 63506 - protein, 14 aa, Mycobacterium tuberculosis
AERLIVIYADFKGE

SEQ ID NO: 63507 - protein, 14 aa, Mycobacterium tuberculosis
ERLIVIYADFKGEA

SEQ ID NO: 63508 - protein, 14 aa, Mycobacterium tuberculosis
RLIVIYADFKGEAG

SEQ ID NO: 63509 - protein, 14 aa, Mycobacterium tuberculosis
LIVIYADFKGEAGA

SEQ ID NO: 63510 - protein, 14 aa, Mycobacterium tuberculosis
IVIYADFKGEAGAD

SEQ ID NO: 63511 - protein, 14 aa, Mycobacterium tuberculosis
VIYADFKGEAGADS

SEQ ID NO: 63512 - protein, 14 aa, Mycobacterium tuberculosis
IYADFKGEAGADSF

SEQ ID NO: 63513 - protein, 14 aa, Mycobacterium tuberculosis
YADFKGEAGADSFR

SEQ ID NO: 63514 - protein, 14 aa, Mycobacterium tuberculosis
ADFKGEAGADSFRD

SEQ ID NO: 63515 - protein, 14 aa, Mycobacterium tuberculosis
DFKGEAGADSFRDF

SEQ ID NO: 63516 - protein, 14 aa, Mycobacterium tuberculosis
FKGEAGADSFRDFP

SEQ ID NO: 63517 - protein, 14 aa, Mycobacterium tuberculosis
KGEAGADSFRDFPQ

SEQ ID NO: 63518 - protein, 14 aa, Mycobacterium tuberculosis
GEAGADSFRDFPQV

SEQ ID NO: 63519 - protein, 14 aa, Mycobacterium tuberculosis
EAGADSFRDFPQVV

SEQ ID NO: 63520 - protein, 14 aa, Mycobacterium tuberculosis
AGADSFRDFPQVVA

SEQ ID NO: 63521 - protein, 14 aa, Mycobacterium tuberculosis
GADSFRDFPQVVAV

SEQ ID NO: 63522 - protein, 14 aa, Mycobacterium tuberculosis
ADSFRDFPQVVAVI

SEQ ID NO: 63523 - protein, 14 aa, Mycobacterium tuberculosis
DSFRDFPQVVAVIS

SEQ ID NO: 63524 - protein, 14 aa, Mycobacterium tuberculosis
SFRDFPQVVAVISN

SEQ ID NO: 63525 - protein, 14 aa, Mycobacterium tuberculosis
FRDFPQVVAVISNM

SEQ ID NO: 63526 - protein, 14 aa, Mycobacterium tuberculosis
RDFPQVVAVISNMA

SEQ ID NO: 63527 - protein, 14 aa, Mycobacterium tuberculosis
DFPQVVAVISNMAE

SEQ ID NO: 63528 - protein, 14 aa, Mycobacterium tuberculosis
FPQVVAVISNMAEK

SEQ ID NO: 63529 - protein, 14 aa, Mycobacterium tuberculosis
PQVVAVISNMAEKK

SEQ ID NO: 63530 - protein, 14 aa, Mycobacterium tuberculosis
QVVAVISNMAEKKS

SEQ ID NO: 63531 - protein, 14 aa, Mycobacterium tuberculosis
VVAVISNMAEKKSL

SEQ ID NO: 63532 - protein, 14 aa, Mycobacterium tuberculosis
VAVISNMAEKKSLA

SEQ ID NO: 63533 - protein, 14 aa, Mycobacterium tuberculosis
AVISNMAEKKSLAD

SEQ ID NO: 63534 - protein, 14 aa, Mycobacterium tuberculosis
VISNMAEKKSLADR

SEQ ID NO: 63535 - protein, 14 aa, Mycobacterium tuberculosis
ISNMAEKKSLADRF

SEQ ID NO: 63536 - protein, 14 aa, Mycobacterium tuberculosis
SNMAEKKSLADRFA

SEQ ID NO: 63537 - protein, 14 aa, Mycobacterium tuberculosis
NMAEKKSLADRFAD

SEQ ID NO: 63538 - protein, 14 aa, Mycobacterium tuberculosis
MAEKKSLADRFADT

SEQ ID NO: 63539 - protein, 14 aa, Mycobacterium tuberculosis
AEKKSLADRFADTL

SEQ ID NO: 63540 - protein, 14 aa, Mycobacterium tuberculosis
EKKSLADRFADTLR

SEQ ID NO: 63541 - protein, 14 aa, Mycobacterium tuberculosis
KKSLADRFADTLRG

SEQ ID NO: 63542 - protein, 14 aa, Mycobacterium tuberculosis
KSLADRFADTLRGE

SEQ ID NO: 63543 - protein, 14 aa, Mycobacterium tuberculosis
SLADRFADTLRGEV

SEQ ID NO: 63544 - protein, 14 aa, Mycobacterium tuberculosis
LADRFADTLRGEVA

SEQ ID NO: 63545 - protein, 14 aa, Mycobacterium tuberculosis
ADRFADTLRGEVAR

SEQ ID NO: 63546 - protein, 14 aa, Mycobacterium tuberculosis
DRFADTLRGEVARR

SEQ ID NO: 63547 - protein, 14 aa, Mycobacterium tuberculosis
RFADTLRGEVARRE

SEQ ID NO: 63548 - protein, 14 aa, Mycobacterium tuberculosis
FADTLRGEVARREM

SEQ ID NO: 63549 - protein, 14 aa, Mycobacterium tuberculosis
ADTLRGEVARREML

SEQ ID NO: 63550 - protein, 14 aa, Mycobacterium tuberculosis
DTLRGEVARREMLL

SEQ ID NO: 63551 - protein, 14 aa, Mycobacterium tuberculosis
TLRGEVARREMLLR

SEQ ID NO: 63552 - protein, 14 aa, Mycobacterium tuberculosis
LRGEVARREMLLRE

SEQ ID NO: 63553 - protein, 14 aa, Mycobacterium tuberculosis
RGEVARREMLLREA

SEQ ID NO: 63554 - protein, 14 aa, Mycobacterium tuberculosis
GEVARREMLLREAG

SEQ ID NO: 63555 - protein, 14 aa, Mycobacterium tuberculosis
EVARREMLLREAGR

SEQ ID NO: 63556 - protein, 14 aa, Mycobacterium tuberculosis
VARREMLLREAGRK

SEQ ID NO: 63557 - protein, 14 aa, Mycobacterium tuberculosis
ARREMLLREAGRKV

SEQ ID NO: 63558 - protein, 14 aa, Mycobacterium tuberculosis
RREMLLREAGRKVQ

SEQ ID NO: 63559 - protein, 14 aa, Mycobacterium tuberculosis
REMLLREAGRKVQG

SEQ ID NO: 63560 - protein, 14 aa, Mycobacterium tuberculosis
EMLLREAGRKVQGS

SEQ ID NO: 63561 - protein, 14 aa, Mycobacterium tuberculosis
MLLREAGRKVQGSA

SEQ ID NO: 63562 - protein, 14 aa, Mycobacterium tuberculosis
LLREAGRKVQGSAF

SEQ ID NO: 63563 - protein, 14 aa, Mycobacterium tuberculosis
LREAGRKVQGSAFN

SEQ ID NO: 63564 - protein, 14 aa, Mycobacterium tuberculosis
REAGRKVQGSAFNS

SEQ ID NO: 63565 - protein, 14 aa, Mycobacterium tuberculosis
EAGRKVQGSAFNSV

SEQ ID NO: 63566 - protein, 14 aa, Mycobacterium tuberculosis
AGRKVQGSAFNSVL

SEQ ID NO: 63567 - protein, 14 aa, Mycobacterium tuberculosis
GRKVQGSAFNSVLE

SEQ ID NO: 63568 - protein, 14 aa, Mycobacterium tuberculosis
RKVQGSAFNSVLEY

SEQ ID NO: 63569 - protein, 14 aa, Mycobacterium tuberculosis
KVQGSAFNSVLEYE

SEQ ID NO: 63570 - protein, 14 aa, Mycobacterium tuberculosis
VQGSAFNSVLEYEN

SEQ ID NO: 63571 - protein, 14 aa, Mycobacterium tuberculosis
QGSAFNSVLEYENA

SEQ ID NO: 63572 - protein, 14 aa, Mycobacterium tuberculosis
GSAFNSVLEYENAI

SEQ ID NO: 63573 - protein, 14 aa, Mycobacterium tuberculosis
SAFNSVLEYENAIA

SEQ ID NO: 63574 - protein, 14 aa, Mycobacterium tuberculosis
AFNSVLEYENAIAA

SEQ ID NO: 63575 - protein, 14 aa, Mycobacterium tuberculosis
FNSVLEYENAIAAG

SEQ ID NO: 63576 - protein, 14 aa, Mycobacterium tuberculosis
NSVLEYENAIAAGH

SEQ ID NO: 63577 - protein, 14 aa, Mycobacterium tuberculosis
SVLEYENAIAAGHS

SEQ ID NO: 63578 - protein, 14 aa, Mycobacterium tuberculosis
VLEYENAIAAGHSL

SEQ ID NO: 63579 - protein, 14 aa, Mycobacterium tuberculosis
LEYENAIAAGHSLP

SEQ ID NO: 63580 - protein, 14 aa, Mycobacterium tuberculosis
EYENAIAAGHSLPP

SEQ ID NO: 63581 - protein, 14 aa, Mycobacterium tuberculosis
YENAIAAGHSLPPI

SEQ ID NO: 63582 - protein, 14 aa, Mycobacterium tuberculosis
ENAIAAGHSLPPIP

SEQ ID NO: 63583 - protein, 14 aa, Mycobacterium tuberculosis
NAIAAGHSLPPIPT

SEQ ID NO: 63584 - protein, 14 aa, Mycobacterium tuberculosis
AIAAGHSLPPIPTL

SEQ ID NO: 63585 - protein, 14 aa, Mycobacterium tuberculosis
IAAGHSLPPIPTLF

SEQ ID NO: 63586 - protein, 14 aa, Mycobacterium tuberculosis
AAGHSLPPIPTLFV

SEQ ID NO: 63587 - protein, 14 aa, Mycobacterium tuberculosis
AGHSLPPIPTLFVV

SEQ ID NO: 63588 - protein, 14 aa, Mycobacterium tuberculosis
GHSLPPIPTLFVVA

SEQ ID NO: 63589 - protein, 14 aa, Mycobacterium tuberculosis
HSLPPIPTLFVVAD

SEQ ID NO: 63590 - protein, 14 aa, Mycobacterium tuberculosis
SLPPIPTLFVVADE

SEQ ID NO: 63591 - protein, 14 aa, Mycobacterium tuberculosis
LPPIPTLFVVADEF

SEQ ID NO: 63592 - protein, 14 aa, Mycobacterium tuberculosis
PPIPTLFVVADEFT

SEQ ID NO: 63593 - protein, 14 aa, Mycobacterium tuberculosis
PIPTLFVVADEFTL

SEQ ID NO: 63594 - protein, 14 aa, Mycobacterium tuberculosis
IPTLFVVADEFTLM

SEQ ID NO: 63595 - protein, 14 aa, Mycobacterium tuberculosis
PTLFVVADEFTLML

SEQ ID NO: 63596 - protein, 14 aa, Mycobacterium tuberculosis
TLFVVADEFTLMLA

SEQ ID NO: 63597 - protein, 14 aa, Mycobacterium tuberculosis
LFVVADEFTLMLAD

SEQ ID NO: 63598 - protein, 14 aa, Mycobacterium tuberculosis
FVVADEFTLMLADH

SEQ ID NO: 63599 - protein, 14 aa, Mycobacterium tuberculosis
VVADEFTLMLADHP

SEQ ID NO: 63600 - protein, 14 aa, Mycobacterium tuberculosis
VADEFTLMLADHPE

SEQ ID NO: 63601 - protein, 14 aa, Mycobacterium tuberculosis
ADEFTLMLADHPEY

SEQ ID NO: 63602 - protein, 14 aa, Mycobacterium tuberculosis
DEFTLMLADHPEYA

SEQ ID NO: 63603 - protein, 14 aa, Mycobacterium tuberculosis
EFTLMLADHPEYAE

SEQ ID NO: 63604 - protein, 14 aa, Mycobacterium tuberculosis
FTLMLADHPEYAEL

SEQ ID NO: 63605 - protein, 14 aa, Mycobacterium tuberculosis
TLMLADHPEYAELF

SEQ ID NO: 63606 - protein, 14 aa, Mycobacterium tuberculosis
LMLADHPEYAELFD

SEQ ID NO: 63607 - protein, 14 aa, Mycobacterium tuberculosis
MLADHPEYAELFDY

SEQ ID NO: 63608 - protein, 14 aa, Mycobacterium tuberculosis
LADHPEYAELFDYV

SEQ ID NO: 63609 - protein, 14 aa, Mycobacterium tuberculosis
ADHPEYAELFDYVA

SEQ ID NO: 63610 - protein, 14 aa, Mycobacterium tuberculosis
DHPEYAELFDYVAR

SEQ ID NO: 63611 - protein, 14 aa, Mycobacterium tuberculosis
HPEYAELFDYVARK

SEQ ID NO: 63612 - protein, 14 aa, Mycobacterium tuberculosis
PEYAELFDYVARKG

SEQ ID NO: 63613 - protein, 14 aa, Mycobacterium tuberculosis
EYAELFDYVARKGR

SEQ ID NO: 63614 - protein, 14 aa, Mycobacterium tuberculosis
YAELFDYVARKGRS

SEQ ID NO: 63615 - protein, 14 aa, Mycobacterium tuberculosis
AELFDYVARKGRSF

SEQ ID NO: 63616 - protein, 14 aa, Mycobacterium tuberculosis
ELFDYVARKGRSFR

SEQ ID NO: 63617 - protein, 14 aa, Mycobacterium tuberculosis
LFDYVARKGRSFRI

SEQ ID NO: 63618 - protein, 14 aa, Mycobacterium tuberculosis
FDYVARKGRSFRIH

SEQ ID NO: 63619 - protein, 14 aa, Mycobacterium tuberculosis
DYVARKGRSFRIHI

SEQ ID NO: 63620 - protein, 14 aa, Mycobacterium tuberculosis
YVARKGRSFRIHIL

SEQ ID NO: 63621 - protein, 14 aa, Mycobacterium tuberculosis
VARKGRSFRIHILF

SEQ ID NO: 63622 - protein, 14 aa, Mycobacterium tuberculosis
ARKGRSFRIHILFA

SEQ ID NO: 63623 - protein, 14 aa, Mycobacterium tuberculosis
RKGRSFRIHILFAS

SEQ ID NO: 63624 - protein, 14 aa, Mycobacterium tuberculosis
KGRSFRIHILFASQ

SEQ ID NO: 63625 - protein, 14 aa, Mycobacterium tuberculosis
GRSFRIHILFASQT

SEQ ID NO: 63626 - protein, 14 aa, Mycobacterium tuberculosis
RSFRIHILFASQTL

SEQ ID NO: 63627 - protein, 14 aa, Mycobacterium tuberculosis
SFRIHILFASQTLD

SEQ ID NO: 63628 - protein, 14 aa, Mycobacterium tuberculosis
FRIHILFASQTLDV

SEQ ID NO: 63629 - protein, 14 aa, Mycobacterium tuberculosis
RIHILFASQTLDVG

SEQ ID NO: 63630 - protein, 14 aa, Mycobacterium tuberculosis
IHILFASQTLDVGK

SEQ ID NO: 63631 - protein, 14 aa, Mycobacterium tuberculosis
HILFASQTLDVGKI

SEQ ID NO: 63632 - protein, 14 aa, Mycobacterium tuberculosis
ILFASQTLDVGKIK

SEQ ID NO: 63633 - protein, 14 aa, Mycobacterium tuberculosis
LFASQTLDVGKIKD

SEQ ID NO: 63634 - protein, 14 aa, Mycobacterium tuberculosis
FASQTLDVGKIKDI

SEQ ID NO: 63635 - protein, 14 aa, Mycobacterium tuberculosis
ASQTLDVGKIKDID

SEQ ID NO: 63636 - protein, 14 aa, Mycobacterium tuberculosis
SQTLDVGKIKDIDK

SEQ ID NO: 63637 - protein, 14 aa, Mycobacterium tuberculosis
QTLDVGKIKDIDKN

SEQ ID NO: 63638 - protein, 14 aa, Mycobacterium tuberculosis
TLDVGKIKDIDKNT

SEQ ID NO: 63639 - protein, 14 aa, Mycobacterium tuberculosis
LDVGKIKDIDKNTA

SEQ ID NO: 63640 - protein, 14 aa, Mycobacterium tuberculosis
DVGKIKDIDKNTAY

SEQ ID NO: 63641 - protein, 14 aa, Mycobacterium tuberculosis
VGKIKDIDKNTAYR

SEQ ID NO: 63642 - protein, 14 aa, Mycobacterium tuberculosis
GKIKDIDKNTAYRI

SEQ ID NO: 63643 - protein, 14 aa, Mycobacterium tuberculosis
KIKDIDKNTAYRIG

SEQ ID NO: 63644 - protein, 14 aa, Mycobacterium tuberculosis
IKDIDKNTAYRIGL

SEQ ID NO: 63645 - protein, 14 aa, Mycobacterium tuberculosis
KDIDKNTAYRIGLK

SEQ ID NO: 63646 - protein, 14 aa, Mycobacterium tuberculosis
DIDKNTAYRIGLKV

SEQ ID NO: 63647 - protein, 14 aa, Mycobacterium tuberculosis
IDKNTAYRIGLKVA

SEQ ID NO: 63648 - protein, 14 aa, Mycobacterium tuberculosis
DKNTAYRIGLKVAS

SEQ ID NO: 63649 - protein, 14 aa, Mycobacterium tuberculosis
KNTAYRIGLKVASP

SEQ ID NO: 63650 - protein, 14 aa, Mycobacterium tuberculosis
NTAYRIGLKVASPS

SEQ ID NO: 63651 - protein, 14 aa, Mycobacterium tuberculosis
TAYRIGLKVASPSV

SEQ ID NO: 63652 - protein, 14 aa, Mycobacterium tuberculosis
AYRIGLKVASPSVS

SEQ ID NO: 63653 - protein, 14 aa, Mycobacterium tuberculosis
YRIGLKVASPSVSR

SEQ ID NO: 63654 - protein, 14 aa, Mycobacterium tuberculosis
RIGLKVASPSVSRQ

SEQ ID NO: 63655 - protein, 14 aa, Mycobacterium tuberculosis
IGLKVASPSVSRQI

SEQ ID NO: 63656 - protein, 14 aa, Mycobacterium tuberculosis
GLKVASPSVSRQII

SEQ ID NO: 63657 - protein, 14 aa, Mycobacterium tuberculosis
LKVASPSVSRQIIG

SEQ ID NO: 63658 - protein, 14 aa, Mycobacterium tuberculosis
KVASPSVSRQIIGV

SEQ ID NO: 63659 - protein, 14 aa, Mycobacterium tuberculosis
VASPSVSRQIIGVE

SEQ ID NO: 63660 - protein, 14 aa, Mycobacterium tuberculosis
ASPSVSRQIIGVED

SEQ ID NO: 63661 - protein, 14 aa, Mycobacterium tuberculosis
SPSVSRQIIGVEDA

SEQ ID NO: 63662 - protein, 14 aa, Mycobacterium tuberculosis
PSVSRQIIGVEDAY

SEQ ID NO: 63663 - protein, 14 aa, Mycobacterium tuberculosis
SVSRQIIGVEDAYH

SEQ ID NO: 63664 - protein, 14 aa, Mycobacterium tuberculosis
VSRQIIGVEDAYHI

SEQ ID NO: 63665 - protein, 14 aa, Mycobacterium tuberculosis
SRQIIGVEDAYHIE

SEQ ID NO: 63666 - protein, 14 aa, Mycobacterium tuberculosis
RQIIGVEDAYHIES

SEQ ID NO: 63667 - protein, 14 aa, Mycobacterium tuberculosis
QIIGVEDAYHIESG

SEQ ID NO: 63668 - protein, 14 aa, Mycobacterium tuberculosis
IIGVEDAYHIESGK

SEQ ID NO: 63669 - protein, 14 aa, Mycobacterium tuberculosis
IGVEDAYHIESGKE

SEQ ID NO: 63670 - protein, 14 aa, Mycobacterium tuberculosis
GVEDAYHIESGKEH

SEQ ID NO: 63671 - protein, 14 aa, Mycobacterium tuberculosis
VEDAYHIESGKEHK

SEQ ID NO: 63672 - protein, 14 aa, Mycobacterium tuberculosis
EDAYHIESGKEHKG

SEQ ID NO: 63673 - protein, 14 aa, Mycobacterium tuberculosis
DAYHIESGKEHKGV

SEQ ID NO: 63674 - protein, 14 aa, Mycobacterium tuberculosis
AYHIESGKEHKGVG

SEQ ID NO: 63675 - protein, 14 aa, Mycobacterium tuberculosis
YHIESGKEHKGVGF

SEQ ID NO: 63676 - protein, 14 aa, Mycobacterium tuberculosis
HIESGKEHKGVGFL

SEQ ID NO: 63677 - protein, 14 aa, Mycobacterium tuberculosis
IESGKEHKGVGFLV

SEQ ID NO: 63678 - protein, 14 aa, Mycobacterium tuberculosis
ESGKEHKGVGFLVP

SEQ ID NO: 63679 - protein, 14 aa, Mycobacterium tuberculosis
SGKEHKGVGFLVPA

SEQ ID NO: 63680 - protein, 14 aa, Mycobacterium tuberculosis
GKEHKGVGFLVPAP

SEQ ID NO: 63681 - protein, 14 aa, Mycobacterium tuberculosis
KEHKGVGFLVPAPG

SEQ ID NO: 63682 - protein, 14 aa, Mycobacterium tuberculosis
EHKGVGFLVPAPGA

SEQ ID NO: 63683 - protein, 14 aa, Mycobacterium tuberculosis
HKGVGFLVPAPGAT

SEQ ID NO: 63684 - protein, 14 aa, Mycobacterium tuberculosis
KGVGFLVPAPGATP

SEQ ID NO: 63685 - protein, 14 aa, Mycobacterium tuberculosis
GVGFLVPAPGATPI

SEQ ID NO: 63686 - protein, 14 aa, Mycobacterium tuberculosis
VGFLVPAPGATPIR

SEQ ID NO: 63687 - protein, 14 aa, Mycobacterium tuberculosis
GFLVPAPGATPIRF

SEQ ID NO: 63688 - protein, 14 aa, Mycobacterium tuberculosis
FLVPAPGATPIRFR

SEQ ID NO: 63689 - protein, 14 aa, Mycobacterium tuberculosis
LVPAPGATPIRFRS

SEQ ID NO: 63690 - protein, 14 aa, Mycobacterium tuberculosis
VPAPGATPIRFRST

SEQ ID NO: 63691 - protein, 14 aa, Mycobacterium tuberculosis
PAPGATPIRFRSTY

SEQ ID NO: 63692 - protein, 14 aa, Mycobacterium tuberculosis
APGATPIRFRSTYV

SEQ ID NO: 63693 - protein, 14 aa, Mycobacterium tuberculosis
PGATPIRFRSTYVD

SEQ ID NO: 63694 - protein, 14 aa, Mycobacterium tuberculosis
GATPIRFRSTYVDG

SEQ ID NO: 63695 - protein, 14 aa, Mycobacterium tuberculosis
ATPIRFRSTYVDGI

SEQ ID NO: 63696 - protein, 14 aa, Mycobacterium tuberculosis
TPIRFRSTYVDGIY

SEQ ID NO: 63697 - protein, 14 aa, Mycobacterium tuberculosis
PIRFRSTYVDGIYE

SEQ ID NO: 63698 - protein, 14 aa, Mycobacterium tuberculosis
IRFRSTYVDGIYEP

SEQ ID NO: 63699 - protein, 14 aa, Mycobacterium tuberculosis
RFRSTYVDGIYEPP

SEQ ID NO: 63700 - protein, 14 aa, Mycobacterium tuberculosis
FRSTYVDGIYEPPQ

SEQ ID NO: 63701 - protein, 14 aa, Mycobacterium tuberculosis
RSTYVDGIYEPPQT

SEQ ID NO: 63702 - protein, 14 aa, Mycobacterium tuberculosis
STYVDGIYEPPQTA

SEQ ID NO: 63703 - protein, 14 aa, Mycobacterium tuberculosis
TYVDGIYEPPQTAK

SEQ ID NO: 63704 - protein, 14 aa, Mycobacterium tuberculosis
YVDGIYEPPQTAKA

SEQ ID NO: 63705 - protein, 14 aa, Mycobacterium tuberculosis
VDGIYEPPQTAKAV

SEQ ID NO: 63706 - protein, 14 aa, Mycobacterium tuberculosis
DGIYEPPQTAKAVV

SEQ ID NO: 63707 - protein, 14 aa, Mycobacterium tuberculosis
GIYEPPQTAKAVVV

SEQ ID NO: 63708 - protein, 14 aa, Mycobacterium tuberculosis
IYEPPQTAKAVVVQ

SEQ ID NO: 63709 - protein, 14 aa, Mycobacterium tuberculosis
YEPPQTAKAVVVQS

SEQ ID NO: 63710 - protein, 14 aa, Mycobacterium tuberculosis
EPPQTAKAVVVQSV

SEQ ID NO: 63711 - protein, 14 aa, Mycobacterium tuberculosis
PPQTAKAVVVQSVP

SEQ ID NO: 63712 - protein, 14 aa, Mycobacterium tuberculosis
PQTAKAVVVQSVPE

SEQ ID NO: 63713 - protein, 14 aa, Mycobacterium tuberculosis
QTAKAVVVQSVPEP

SEQ ID NO: 63714 - protein, 14 aa, Mycobacterium tuberculosis
TAKAVVVQSVPEPK

SEQ ID NO: 63715 - protein, 14 aa, Mycobacterium tuberculosis
AKAVVVQSVPEPKL

SEQ ID NO: 63716 - protein, 14 aa, Mycobacterium tuberculosis
KAVVVQSVPEPKLF

SEQ ID NO: 63717 - protein, 14 aa, Mycobacterium tuberculosis
AVVVQSVPEPKLFT

SEQ ID NO: 63718 - protein, 14 aa, Mycobacterium tuberculosis
VVVQSVPEPKLFTA

SEQ ID NO: 63719 - protein, 14 aa, Mycobacterium tuberculosis
VVQSVPEPKLFTAA

SEQ ID NO: 63720 - protein, 14 aa, Mycobacterium tuberculosis
VQSVPEPKLFTAAA

SEQ ID NO: 63721 - protein, 14 aa, Mycobacterium tuberculosis
QSVPEPKLFTAAAV

SEQ ID NO: 63722 - protein, 14 aa, Mycobacterium tuberculosis
SVPEPKLFTAAAVE

SEQ ID NO: 63723 - protein, 14 aa, Mycobacterium tuberculosis
VPEPKLFTAAAVEP

SEQ ID NO: 63724 - protein, 14 aa, Mycobacterium tuberculosis
PEPKLFTAAAVEPD

SEQ ID NO: 63725 - protein, 14 aa, Mycobacterium tuberculosis
EPKLFTAAAVEPDP

SEQ ID NO: 63726 - protein, 14 aa, Mycobacterium tuberculosis
PKLFTAAAVEPDPG

SEQ ID NO: 63727 - protein, 14 aa, Mycobacterium tuberculosis
KLFTAAAVEPDPGT

SEQ ID NO: 63728 - protein, 14 aa, Mycobacterium tuberculosis
LFTAAAVEPDPGTV

SEQ ID NO: 63729 - protein, 14 aa, Mycobacterium tuberculosis
FTAAAVEPDPGTVI

SEQ ID NO: 63730 - protein, 14 aa, Mycobacterium tuberculosis
TAAAVEPDPGTVIA

SEQ ID NO: 63731 - protein, 14 aa, Mycobacterium tuberculosis
AAAVEPDPGTVIAD

SEQ ID NO: 63732 - protein, 14 aa, Mycobacterium tuberculosis
AAVEPDPGTVIADT

SEQ ID NO: 63733 - protein, 14 aa, Mycobacterium tuberculosis
AVEPDPGTVIADTD

SEQ ID NO: 63734 - protein, 14 aa, Mycobacterium tuberculosis
VEPDPGTVIADTDE

SEQ ID NO: 63735 - protein, 14 aa, Mycobacterium tuberculosis
EPDPGTVIADTDEQ

SEQ ID NO: 63736 - protein, 14 aa, Mycobacterium tuberculosis
PDPGTVIADTDEQE

SEQ ID NO: 63737 - protein, 14 aa, Mycobacterium tuberculosis
DPGTVIADTDEQEP

SEQ ID NO: 63738 - protein, 14 aa, Mycobacterium tuberculosis
PGTVIADTDEQEPA

SEQ ID NO: 63739 - protein, 14 aa, Mycobacterium tuberculosis
GTVIADTDEQEPAD

SEQ ID NO: 63740 - protein, 14 aa, Mycobacterium tuberculosis
TVIADTDEQEPADP

SEQ ID NO: 63741 - protein, 14 aa, Mycobacterium tuberculosis
VIADTDEQEPADPP

SEQ ID NO: 63742 - protein, 14 aa, Mycobacterium tuberculosis
IADTDEQEPADPPR

SEQ ID NO: 63743 - protein, 14 aa, Mycobacterium tuberculosis
ADTDEQEPADPPRK

SEQ ID NO: 63744 - protein, 14 aa, Mycobacterium tuberculosis
DTDEQEPADPPRKL

SEQ ID NO: 63745 - protein, 14 aa, Mycobacterium tuberculosis
TDEQEPADPPRKLI

SEQ ID NO: 63746 - protein, 14 aa, Mycobacterium tuberculosis
DEQEPADPPRKLIA

SEQ ID NO: 63747 - protein, 14 aa, Mycobacterium tuberculosis
EQEPADPPRKLIAT

SEQ ID NO: 63748 - protein, 14 aa, Mycobacterium tuberculosis
QEPADPPRKLIATI

SEQ ID NO: 63749 - protein, 14 aa, Mycobacterium tuberculosis
EPADPPRKLIATIG

SEQ ID NO: 63750 - protein, 14 aa, Mycobacterium tuberculosis
PADPPRKLIATIGE

SEQ ID NO: 63751 - protein, 14 aa, Mycobacterium tuberculosis
ADPPRKLIATIGEQ

SEQ ID NO: 63752 - protein, 14 aa, Mycobacterium tuberculosis
DPPRKLIATIGEQL

SEQ ID NO: 63753 - protein, 14 aa, Mycobacterium tuberculosis
PPRKLIATIGEQLA

SEQ ID NO: 63754 - protein, 14 aa, Mycobacterium tuberculosis
PRKLIATIGEQLAR

SEQ ID NO: 63755 - protein, 14 aa, Mycobacterium tuberculosis
RKLIATIGEQLARY

SEQ ID NO: 63756 - protein, 14 aa, Mycobacterium tuberculosis
KLIATIGEQLARYG

SEQ ID NO: 63757 - protein, 14 aa, Mycobacterium tuberculosis
LIATIGEQLARYGP

SEQ ID NO: 63758 - protein, 14 aa, Mycobacterium tuberculosis
IATIGEQLARYGPR

SEQ ID NO: 63759 - protein, 14 aa, Mycobacterium tuberculosis
ATIGEQLARYGPRA

SEQ ID NO: 63760 - protein, 14 aa, Mycobacterium tuberculosis
TIGEQLARYGPRAP

SEQ ID NO: 63761 - protein, 14 aa, Mycobacterium tuberculosis
IGEQLARYGPRAPQ

SEQ ID NO: 63762 - protein, 14 aa, Mycobacterium tuberculosis
GEQLARYGPRAPQL

SEQ ID NO: 63763 - protein, 14 aa, Mycobacterium tuberculosis
EQLARYGPRAPQLW

SEQ ID NO: 63764 - protein, 14 aa, Mycobacterium tuberculosis
QLARYGPRAPQLWL

SEQ ID NO: 63765 - protein, 14 aa, Mycobacterium tuberculosis
LARYGPRAPQLWLP

SEQ ID NO: 63766 - protein, 14 aa, Mycobacterium tuberculosis
ARYGPRAPQLWLPP

SEQ ID NO: 63767 - protein, 14 aa, Mycobacterium tuberculosis
RYGPRAPQLWLPPL

SEQ ID NO: 63768 - protein, 14 aa, Mycobacterium tuberculosis
YGPRAPQLWLPPLD

SEQ ID NO: 63769 - protein, 14 aa, Mycobacterium tuberculosis
GPRAPQLWLPPLDE

SEQ ID NO: 63770 - protein, 14 aa, Mycobacterium tuberculosis
PRAPQLWLPPLDET

SEQ ID NO: 63771 - protein, 14 aa, Mycobacterium tuberculosis
RAPQLWLPPLDETI

SEQ ID NO: 63772 - protein, 14 aa, Mycobacterium tuberculosis
APQLWLPPLDETIP

SEQ ID NO: 63773 - protein, 14 aa, Mycobacterium tuberculosis
PQLWLPPLDETIPL

SEQ ID NO: 63774 - protein, 14 aa, Mycobacterium tuberculosis
QLWLPPLDETIPLS

SEQ ID NO: 63775 - protein, 14 aa, Mycobacterium tuberculosis
LWLPPLDETIPLSA

SEQ ID NO: 63776 - protein, 14 aa, Mycobacterium tuberculosis
WLPPLDETIPLSAA

SEQ ID NO: 63777 - protein, 14 aa, Mycobacterium tuberculosis
LPPLDETIPLSAAL

SEQ ID NO: 63778 - protein, 14 aa, Mycobacterium tuberculosis
PPLDETIPLSAALA

SEQ ID NO: 63779 - protein, 14 aa, Mycobacterium tuberculosis
PLDETIPLSAALAR

SEQ ID NO: 63780 - protein, 14 aa, Mycobacterium tuberculosis
LDETIPLSAALARA

SEQ ID NO: 63781 - protein, 14 aa, Mycobacterium tuberculosis
DETIPLSAALARAG

SEQ ID NO: 63782 - protein, 14 aa, Mycobacterium tuberculosis
ETIPLSAALARAGV

SEQ ID NO: 63783 - protein, 14 aa, Mycobacterium tuberculosis
TIPLSAALARAGVG

SEQ ID NO: 63784 - protein, 14 aa, Mycobacterium tuberculosis
IPLSAALARAGVGP

SEQ ID NO: 63785 - protein, 14 aa, Mycobacterium tuberculosis
PLSAALARAGVGPR

SEQ ID NO: 63786 - protein, 14 aa, Mycobacterium tuberculosis
LSAALARAGVGPRQ

SEQ ID NO: 63787 - protein, 14 aa, Mycobacterium tuberculosis
SAALARAGVGPRQW

SEQ ID NO: 63788 - protein, 14 aa, Mycobacterium tuberculosis
AALARAGVGPRQWR

SEQ ID NO: 63789 - protein, 14 aa, Mycobacterium tuberculosis
ALARAGVGPRQWRW

SEQ ID NO: 63790 - protein, 14 aa, Mycobacterium tuberculosis
LARAGVGPRQWRWP

SEQ ID NO: 63791 - protein, 14 aa, Mycobacterium tuberculosis
ARAGVGPRQWRWPL

SEQ ID NO: 63792 - protein, 14 aa, Mycobacterium tuberculosis
RAGVGPRQWRWPLG

SEQ ID NO: 63793 - protein, 14 aa, Mycobacterium tuberculosis
AGVGPRQWRWPLGE

SEQ ID NO: 63794 - protein, 14 aa, Mycobacterium tuberculosis
GVGPRQWRWPLGEI

SEQ ID NO: 63795 - protein, 14 aa, Mycobacterium tuberculosis
VGPRQWRWPLGEID

SEQ ID NO: 63796 - protein, 14 aa, Mycobacterium tuberculosis
GPRQWRWPLGEIDR

SEQ ID NO: 63797 - protein, 14 aa, Mycobacterium tuberculosis
PRQWRWPLGEIDRP

SEQ ID NO: 63798 - protein, 14 aa, Mycobacterium tuberculosis
RQWRWPLGEIDRPF

SEQ ID NO: 63799 - protein, 14 aa, Mycobacterium tuberculosis
QWRWPLGEIDRPFE

SEQ ID NO: 63800 - protein, 14 aa, Mycobacterium tuberculosis
WRWPLGEIDRPFEM

SEQ ID NO: 63801 - protein, 14 aa, Mycobacterium tuberculosis
RWPLGEIDRPFEMR

SEQ ID NO: 63802 - protein, 14 aa, Mycobacterium tuberculosis
WPLGEIDRPFEMRR

SEQ ID NO: 63803 - protein, 14 aa, Mycobacterium tuberculosis
PLGEIDRPFEMRRD

SEQ ID NO: 63804 - protein, 14 aa, Mycobacterium tuberculosis
LGEIDRPFEMRRDP

SEQ ID NO: 63805 - protein, 14 aa, Mycobacterium tuberculosis
GEIDRPFEMRRDPL

SEQ ID NO: 63806 - protein, 14 aa, Mycobacterium tuberculosis
EIDRPFEMRRDPLV

SEQ ID NO: 63807 - protein, 14 aa, Mycobacterium tuberculosis
IDRPFEMRRDPLVF

SEQ ID NO: 63808 - protein, 14 aa, Mycobacterium tuberculosis
DRPFEMRRDPLVFD

SEQ ID NO: 63809 - protein, 14 aa, Mycobacterium tuberculosis
RPFEMRRDPLVFDA

SEQ ID NO: 63810 - protein, 14 aa, Mycobacterium tuberculosis
PFEMRRDPLVFDAR

SEQ ID NO: 63811 - protein, 14 aa, Mycobacterium tuberculosis
FEMRRDPLVFDARS

SEQ ID NO: 63812 - protein, 14 aa, Mycobacterium tuberculosis
EMRRDPLVFDARSS

SEQ ID NO: 63813 - protein, 14 aa, Mycobacterium tuberculosis
MRRDPLVFDARSSA

SEQ ID NO: 63814 - protein, 14 aa, Mycobacterium tuberculosis
RRDPLVFDARSSAG

SEQ ID NO: 63815 - protein, 14 aa, Mycobacterium tuberculosis
RDPLVFDARSSAGN

SEQ ID NO: 63816 - protein, 14 aa, Mycobacterium tuberculosis
DPLVFDARSSAGNM

SEQ ID NO: 63817 - protein, 14 aa, Mycobacterium tuberculosis
PLVFDARSSAGNMV

SEQ ID NO: 63818 - protein, 14 aa, Mycobacterium tuberculosis
LVFDARSSAGNMVI

SEQ ID NO: 63819 - protein, 14 aa, Mycobacterium tuberculosis
VFDARSSAGNMVIH

SEQ ID NO: 63820 - protein, 14 aa, Mycobacterium tuberculosis
FDARSSAGNMVIHG

SEQ ID NO: 63821 - protein, 14 aa, Mycobacterium tuberculosis
DARSSAGNMVIHGG

SEQ ID NO: 63822 - protein, 14 aa, Mycobacterium tuberculosis
ARSSAGNMVIHGGP

SEQ ID NO: 63823 - protein, 14 aa, Mycobacterium tuberculosis
RSSAGNMVIHGGPK

SEQ ID NO: 63824 - protein, 14 aa, Mycobacterium tuberculosis
SSAGNMVIHGGPKS

SEQ ID NO: 63825 - protein, 14 aa, Mycobacterium tuberculosis
SAGNMVIHGGPKSG

SEQ ID NO: 63826 - protein, 14 aa, Mycobacterium tuberculosis
AGNMVIHGGPKSGK

SEQ ID NO: 63827 - protein, 14 aa, Mycobacterium tuberculosis
GNMVIHGGPKSGKS

SEQ ID NO: 63828 - protein, 14 aa, Mycobacterium tuberculosis
NMVIHGGPKSGKST

SEQ ID NO: 63829 - protein, 14 aa, Mycobacterium tuberculosis
MVIHGGPKSGKSTA

SEQ ID NO: 63830 - protein, 14 aa, Mycobacterium tuberculosis
VIHGGPKSGKSTAL

SEQ ID NO: 63831 - protein, 14 aa, Mycobacterium tuberculosis
IHGGPKSGKSTALQ

SEQ ID NO: 63832 - protein, 14 aa, Mycobacterium tuberculosis
HGGPKSGKSTALQT

SEQ ID NO: 63833 - protein, 14 aa, Mycobacterium tuberculosis
GGPKSGKSTALQTF

SEQ ID NO: 63834 - protein, 14 aa, Mycobacterium tuberculosis
GPKSGKSTALQTFI

SEQ ID NO: 63835 - protein, 14 aa, Mycobacterium tuberculosis
PKSGKSTALQTFIL

SEQ ID NO: 63836 - protein, 14 aa, Mycobacterium tuberculosis
KSGKSTALQTFILS

SEQ ID NO: 63837 - protein, 14 aa, Mycobacterium tuberculosis
SGKSTALQTFILSA

SEQ ID NO: 63838 - protein, 14 aa, Mycobacterium tuberculosis
GKSTALQTFILSAA

SEQ ID NO: 63839 - protein, 14 aa, Mycobacterium tuberculosis
KSTALQTFILSAAS

SEQ ID NO: 63840 - protein, 14 aa, Mycobacterium tuberculosis
STALQTFILSAASL

SEQ ID NO: 63841 - protein, 14 aa, Mycobacterium tuberculosis
TALQTFILSAASLH

SEQ ID NO: 63842 - protein, 14 aa, Mycobacterium tuberculosis
ALQTFILSAASLHS

SEQ ID NO: 63843 - protein, 14 aa, Mycobacterium tuberculosis
LQTFILSAASLHSP

SEQ ID NO: 63844 - protein, 14 aa, Mycobacterium tuberculosis
QTFILSAASLHSPH

SEQ ID NO: 63845 - protein, 14 aa, Mycobacterium tuberculosis
TFILSAASLHSPHE

SEQ ID NO: 63846 - protein, 14 aa, Mycobacterium tuberculosis
FILSAASLHSPHEV

SEQ ID NO: 63847 - protein, 14 aa, Mycobacterium tuberculosis
ILSAASLHSPHEVS

SEQ ID NO: 63848 - protein, 14 aa, Mycobacterium tuberculosis
LSAASLHSPHEVSF

SEQ ID NO: 63849 - protein, 14 aa, Mycobacterium tuberculosis
SAASLHSPHEVSFY

SEQ ID NO: 63850 - protein, 14 aa, Mycobacterium tuberculosis
AASLHSPHEVSFYC

SEQ ID NO: 63851 - protein, 14 aa, Mycobacterium tuberculosis
ASLHSPHEVSFYCL

SEQ ID NO: 63852 - protein, 14 aa, Mycobacterium tuberculosis
SLHSPHEVSFYCLD

SEQ ID NO: 63853 - protein, 14 aa, Mycobacterium tuberculosis
LHSPHEVSFYCLDY

SEQ ID NO: 63854 - protein, 14 aa, Mycobacterium tuberculosis
HSPHEVSFYCLDYG

SEQ ID NO: 63855 - protein, 14 aa, Mycobacterium tuberculosis
SPHEVSFYCLDYGG

SEQ ID NO: 63856 - protein, 14 aa, Mycobacterium tuberculosis
PHEVSFYCLDYGGG

SEQ ID NO: 63857 - protein, 14 aa, Mycobacterium tuberculosis
HEVSFYCLDYGGGQ

SEQ ID NO: 63858 - protein, 14 aa, Mycobacterium tuberculosis
EVSFYCLDYGGGQL

SEQ ID NO: 63859 - protein, 14 aa, Mycobacterium tuberculosis
VSFYCLDYGGGQLR

SEQ ID NO: 63860 - protein, 14 aa, Mycobacterium tuberculosis
SFYCLDYGGGQLRA

SEQ ID NO: 63861 - protein, 14 aa, Mycobacterium tuberculosis
FYCLDYGGGQLRAL

SEQ ID NO: 63862 - protein, 14 aa, Mycobacterium tuberculosis
YCLDYGGGQLRALQ

SEQ ID NO: 63863 - protein, 14 aa, Mycobacterium tuberculosis
CLDYGGGQLRALQD

SEQ ID NO: 63864 - protein, 14 aa, Mycobacterium tuberculosis
LDYGGGQLRALQDL

SEQ ID NO: 63865 - protein, 14 aa, Mycobacterium tuberculosis
DYGGGQLRALQDLA

SEQ ID NO: 63866 - protein, 14 aa, Mycobacterium tuberculosis
YGGGQLRALQDLAH

SEQ ID NO: 63867 - protein, 14 aa, Mycobacterium tuberculosis
GGGQLRALQDLAHV

SEQ ID NO: 63868 - protein, 14 aa, Mycobacterium tuberculosis
GGQLRALQDLAHVG

SEQ ID NO: 63869 - protein, 14 aa, Mycobacterium tuberculosis
GQLRALQDLAHVGS

SEQ ID NO: 63870 - protein, 14 aa, Mycobacterium tuberculosis
QLRALQDLAHVGSV

SEQ ID NO: 63871 - protein, 14 aa, Mycobacterium tuberculosis
LRALQDLAHVGSVA

SEQ ID NO: 63872 - protein, 14 aa, Mycobacterium tuberculosis
RALQDLAHVGSVAS

SEQ ID NO: 63873 - protein, 14 aa, Mycobacterium tuberculosis
ALQDLAHVGSVASA

SEQ ID NO: 63874 - protein, 14 aa, Mycobacterium tuberculosis
LQDLAHVGSVASAL

SEQ ID NO: 63875 - protein, 14 aa, Mycobacterium tuberculosis
QDLAHVGSVASALE

SEQ ID NO: 63876 - protein, 14 aa, Mycobacterium tuberculosis
DLAHVGSVASALEP

SEQ ID NO: 63877 - protein, 14 aa, Mycobacterium tuberculosis
LAHVGSVASALEPE

SEQ ID NO: 63878 - protein, 14 aa, Mycobacterium tuberculosis
AHVGSVASALEPER

SEQ ID NO: 63879 - protein, 14 aa, Mycobacterium tuberculosis
HVGSVASALEPERI

SEQ ID NO: 63880 - protein, 14 aa, Mycobacterium tuberculosis
VGSVASALEPERIR

SEQ ID NO: 63881 - protein, 14 aa, Mycobacterium tuberculosis
GSVASALEPERIRR

SEQ ID NO: 63882 - protein, 14 aa, Mycobacterium tuberculosis
SVASALEPERIRRT

SEQ ID NO: 63883 - protein, 14 aa, Mycobacterium tuberculosis
VASALEPERIRRTF

SEQ ID NO: 63884 - protein, 14 aa, Mycobacterium tuberculosis
ASALEPERIRRTFG

SEQ ID NO: 63885 - protein, 14 aa, Mycobacterium tuberculosis
SALEPERIRRTFGE

SEQ ID NO: 63886 - protein, 14 aa, Mycobacterium tuberculosis
ALEPERIRRTFGEL

SEQ ID NO: 63887 - protein, 14 aa, Mycobacterium tuberculosis
LEPERIRRTFGELE

SEQ ID NO: 63888 - protein, 14 aa, Mycobacterium tuberculosis
EPERIRRTFGELEQ

SEQ ID NO: 63889 - protein, 14 aa, Mycobacterium tuberculosis
PERIRRTFGELEQL

SEQ ID NO: 63890 - protein, 14 aa, Mycobacterium tuberculosis
ERIRRTFGELEQLL

SEQ ID NO: 63891 - protein, 14 aa, Mycobacterium tuberculosis
RIRRTFGELEQLLL

SEQ ID NO: 63892 - protein, 14 aa, Mycobacterium tuberculosis
IRRTFGELEQLLLS

SEQ ID NO: 63893 - protein, 14 aa, Mycobacterium tuberculosis
RRTFGELEQLLLSR

SEQ ID NO: 63894 - protein, 14 aa, Mycobacterium tuberculosis
RTFGELEQLLLSRQ

SEQ ID NO: 63895 - protein, 14 aa, Mycobacterium tuberculosis
TFGELEQLLLSRQQ

SEQ ID NO: 63896 - protein, 14 aa, Mycobacterium tuberculosis
FGELEQLLLSRQQR

SEQ ID NO: 63897 - protein, 14 aa, Mycobacterium tuberculosis
GELEQLLLSRQQRE

SEQ ID NO: 63898 - protein, 14 aa, Mycobacterium tuberculosis
ELEQLLLSRQQREV

SEQ ID NO: 63899 - protein, 14 aa, Mycobacterium tuberculosis
LEQLLLSRQQREVF

SEQ ID NO: 63900 - protein, 14 aa, Mycobacterium tuberculosis
EQLLLSRQQREVFR

SEQ ID NO: 63901 - protein, 14 aa, Mycobacterium tuberculosis
QLLLSRQQREVFRD

SEQ ID NO: 63902 - protein, 14 aa, Mycobacterium tuberculosis
LLLSRQQREVFRDR

SEQ ID NO: 63903 - protein, 14 aa, Mycobacterium tuberculosis
LLSRQQREVFRDRG

SEQ ID NO: 63904 - protein, 14 aa, Mycobacterium tuberculosis
LSRQQREVFRDRGA

SEQ ID NO: 63905 - protein, 14 aa, Mycobacterium tuberculosis
SRQQREVFRDRGAN

SEQ ID NO: 63906 - protein, 14 aa, Mycobacterium tuberculosis
RQQREVFRDRGANG

SEQ ID NO: 63907 - protein, 14 aa, Mycobacterium tuberculosis
QQREVFRDRGANGS

SEQ ID NO: 63908 - protein, 14 aa, Mycobacterium tuberculosis
QREVFRDRGANGST

SEQ ID NO: 63909 - protein, 14 aa, Mycobacterium tuberculosis
REVFRDRGANGSTP

SEQ ID NO: 63910 - protein, 14 aa, Mycobacterium tuberculosis
EVFRDRGANGSTPD

SEQ ID NO: 63911 - protein, 14 aa, Mycobacterium tuberculosis
VFRDRGANGSTPDD

SEQ ID NO: 63912 - protein, 14 aa, Mycobacterium tuberculosis
FRDRGANGSTPDDG

SEQ ID NO: 63913 - protein, 14 aa, Mycobacterium tuberculosis
RDRGANGSTPDDGF

SEQ ID NO: 63914 - protein, 14 aa, Mycobacterium tuberculosis
DRGANGSTPDDGFG

SEQ ID NO: 63915 - protein, 14 aa, Mycobacterium tuberculosis
RGANGSTPDDGFGE

SEQ ID NO: 63916 - protein, 14 aa, Mycobacterium tuberculosis
GANGSTPDDGFGEV

SEQ ID NO: 63917 - protein, 14 aa, Mycobacterium tuberculosis
ANGSTPDDGFGEVF

SEQ ID NO: 63918 - protein, 14 aa, Mycobacterium tuberculosis
NGSTPDDGFGEVFL

SEQ ID NO: 63919 - protein, 14 aa, Mycobacterium tuberculosis
GSTPDDGFGEVFLV

SEQ ID NO: 63920 - protein, 14 aa, Mycobacterium tuberculosis
STPDDGFGEVFLVI

SEQ ID NO: 63921 - protein, 14 aa, Mycobacterium tuberculosis
TPDDGFGEVFLVID

SEQ ID NO: 63922 - protein, 14 aa, Mycobacterium tuberculosis
PDDGFGEVFLVIDN

SEQ ID NO: 63923 - protein, 14 aa, Mycobacterium tuberculosis
DDGFGEVFLVIDNL

SEQ ID NO: 63924 - protein, 14 aa, Mycobacterium tuberculosis
DGFGEVFLVIDNLY

SEQ ID NO: 63925 - protein, 14 aa, Mycobacterium tuberculosis
GFGEVFLVIDNLYG

SEQ ID NO: 63926 - protein, 14 aa, Mycobacterium tuberculosis
FGEVFLVIDNLYGF

SEQ ID NO: 63927 - protein, 14 aa, Mycobacterium tuberculosis
GEVFLVIDNLYGFG

SEQ ID NO: 63928 - protein, 14 aa, Mycobacterium tuberculosis
EVFLVIDNLYGFGR

SEQ ID NO: 63929 - protein, 14 aa, Mycobacterium tuberculosis
VFLVIDNLYGFGRD

SEQ ID NO: 63930 - protein, 14 aa, Mycobacterium tuberculosis
FLVIDNLYGFGRDN

SEQ ID NO: 63931 - protein, 14 aa, Mycobacterium tuberculosis
LVIDNLYGFGRDNT

SEQ ID NO: 63932 - protein, 14 aa, Mycobacterium tuberculosis
VIDNLYGFGRDNTD

SEQ ID NO: 63933 - protein, 14 aa, Mycobacterium tuberculosis
IDNLYGFGRDNTDQ

SEQ ID NO: 63934 - protein, 14 aa, Mycobacterium tuberculosis
DNLYGFGRDNTDQF

SEQ ID NO: 63935 - protein, 14 aa, Mycobacterium tuberculosis
NLYGFGRDNTDQFN

SEQ ID NO: 63936 - protein, 14 aa, Mycobacterium tuberculosis
LYGFGRDNTDQFNT

SEQ ID NO: 63937 - protein, 14 aa, Mycobacterium tuberculosis
YGFGRDNTDQFNTR

SEQ ID NO: 63938 - protein, 14 aa, Mycobacterium tuberculosis
GFGRDNTDQFNTRN

SEQ ID NO: 63939 - protein, 14 aa, Mycobacterium tuberculosis
FGRDNTDQFNTRNP

SEQ ID NO: 63940 - protein, 14 aa, Mycobacterium tuberculosis
GRDNTDQFNTRNPL

SEQ ID NO: 63941 - protein, 14 aa, Mycobacterium tuberculosis
RDNTDQFNTRNPLL

SEQ ID NO: 63942 - protein, 14 aa, Mycobacterium tuberculosis
DNTDQFNTRNPLLA

SEQ ID NO: 63943 - protein, 14 aa, Mycobacterium tuberculosis
NTDQFNTRNPLLAR

SEQ ID NO: 63944 - protein, 14 aa, Mycobacterium tuberculosis
TDQFNTRNPLLARV

SEQ ID NO: 63945 - protein, 14 aa, Mycobacterium tuberculosis
DQFNTRNPLLARVT

SEQ ID NO: 63946 - protein, 14 aa, Mycobacterium tuberculosis
QFNTRNPLLARVTE

SEQ ID NO: 63947 - protein, 14 aa, Mycobacterium tuberculosis
FNTRNPLLARVTEL

SEQ ID NO: 63948 - protein, 14 aa, Mycobacterium tuberculosis
NTRNPLLARVTELV

SEQ ID NO: 63949 - protein, 14 aa, Mycobacterium tuberculosis
TRNPLLARVTELVN

SEQ ID NO: 63950 - protein, 14 aa, Mycobacterium tuberculosis
RNPLLARVTELVNV

SEQ ID NO: 63951 - protein, 14 aa, Mycobacterium tuberculosis
NPLLARVTELVNVG

SEQ ID NO: 63952 - protein, 14 aa, Mycobacterium tuberculosis
PLLARVTELVNVGL

SEQ ID NO: 63953 - protein, 14 aa, Mycobacterium tuberculosis
LLARVTELVNVGLA

SEQ ID NO: 63954 - protein, 14 aa, Mycobacterium tuberculosis
LARVTELVNVGLAY

SEQ ID NO: 63955 - protein, 14 aa, Mycobacterium tuberculosis
ARVTELVNVGLAYG

SEQ ID NO: 63956 - protein, 14 aa, Mycobacterium tuberculosis
RVTELVNVGLAYGI

SEQ ID NO: 63957 - protein, 14 aa, Mycobacterium tuberculosis
VTELVNVGLAYGIH

SEQ ID NO: 63958 - protein, 14 aa, Mycobacterium tuberculosis
TELVNVGLAYGIHV

SEQ ID NO: 63959 - protein, 14 aa, Mycobacterium tuberculosis
ELVNVGLAYGIHVI

SEQ ID NO: 63960 - protein, 14 aa, Mycobacterium tuberculosis
LVNVGLAYGIHVII

SEQ ID NO: 63961 - protein, 14 aa, Mycobacterium tuberculosis
VNVGLAYGIHVIIT

SEQ ID NO: 63962 - protein, 14 aa, Mycobacterium tuberculosis
NVGLAYGIHVIITT

SEQ ID NO: 63963 - protein, 14 aa, Mycobacterium tuberculosis
VGLAYGIHVIITTP

SEQ ID NO: 63964 - protein, 14 aa, Mycobacterium tuberculosis
GLAYGIHVIITTPS

SEQ ID NO: 63965 - protein, 14 aa, Mycobacterium tuberculosis
LAYGIHVIITTPSW

SEQ ID NO: 63966 - protein, 14 aa, Mycobacterium tuberculosis
AYGIHVIITTPSWL

SEQ ID NO: 63967 - protein, 14 aa, Mycobacterium tuberculosis
YGIHVIITTPSWLE

SEQ ID NO: 63968 - protein, 14 aa, Mycobacterium tuberculosis
GIHVIITTPSWLEV

SEQ ID NO: 63969 - protein, 14 aa, Mycobacterium tuberculosis
IHVIITTPSWLEVP

SEQ ID NO: 63970 - protein, 14 aa, Mycobacterium tuberculosis
HVIITTPSWLEVPL

SEQ ID NO: 63971 - protein, 14 aa, Mycobacterium tuberculosis
VIITTPSWLEVPLA

SEQ ID NO: 63972 - protein, 14 aa, Mycobacterium tuberculosis
IITTPSWLEVPLAM

SEQ ID NO: 63973 - protein, 14 aa, Mycobacterium tuberculosis
ITTPSWLEVPLAMR

SEQ ID NO: 63974 - protein, 14 aa, Mycobacterium tuberculosis
TTPSWLEVPLAMRD

SEQ ID NO: 63975 - protein, 14 aa, Mycobacterium tuberculosis
TPSWLEVPLAMRDG

SEQ ID NO: 63976 - protein, 14 aa, Mycobacterium tuberculosis
PSWLEVPLAMRDGL

SEQ ID NO: 63977 - protein, 14 aa, Mycobacterium tuberculosis
SWLEVPLAMRDGLG

SEQ ID NO: 63978 - protein, 14 aa, Mycobacterium tuberculosis
WLEVPLAMRDGLGL

SEQ ID NO: 63979 - protein, 14 aa, Mycobacterium tuberculosis
LEVPLAMRDGLGLR

SEQ ID NO: 63980 - protein, 14 aa, Mycobacterium tuberculosis
EVPLAMRDGLGLRL

SEQ ID NO: 63981 - protein, 14 aa, Mycobacterium tuberculosis
VPLAMRDGLGLRLE

SEQ ID NO: 63982 - protein, 14 aa, Mycobacterium tuberculosis
PLAMRDGLGLRLEL

SEQ ID NO: 63983 - protein, 14 aa, Mycobacterium tuberculosis
LAMRDGLGLRLELR

SEQ ID NO: 63984 - protein, 14 aa, Mycobacterium tuberculosis
AMRDGLGLRLELRL

SEQ ID NO: 63985 - protein, 14 aa, Mycobacterium tuberculosis
MRDGLGLRLELRLH

SEQ ID NO: 63986 - protein, 14 aa, Mycobacterium tuberculosis
RDGLGLRLELRLHD

SEQ ID NO: 63987 - protein, 14 aa, Mycobacterium tuberculosis
DGLGLRLELRLHDA

SEQ ID NO: 63988 - protein, 14 aa, Mycobacterium tuberculosis
GLGLRLELRLHDAR

SEQ ID NO: 63989 - protein, 14 aa, Mycobacterium tuberculosis
LGLRLELRLHDARD

SEQ ID NO: 63990 - protein, 14 aa, Mycobacterium tuberculosis
GLRLELRLHDARDS

SEQ ID NO: 63991 - protein, 14 aa, Mycobacterium tuberculosis
LRLELRLHDARDSN

SEQ ID NO: 63992 - protein, 14 aa, Mycobacterium tuberculosis
RLELRLHDARDSNV

SEQ ID NO: 63993 - protein, 14 aa, Mycobacterium tuberculosis
LELRLHDARDSNVR

SEQ ID NO: 63994 - protein, 14 aa, Mycobacterium tuberculosis
ELRLHDARDSNVRV

SEQ ID NO: 63995 - protein, 14 aa, Mycobacterium tuberculosis
LRLHDARDSNVRVV

SEQ ID NO: 63996 - protein, 14 aa, Mycobacterium tuberculosis
RLHDARDSNVRVVG

SEQ ID NO: 63997 - protein, 14 aa, Mycobacterium tuberculosis
LHDARDSNVRVVGA

SEQ ID NO: 63998 - protein, 14 aa, Mycobacterium tuberculosis
HDARDSNVRVVGAL

SEQ ID NO: 63999 - protein, 14 aa, Mycobacterium tuberculosis
DARDSNVRVVGALR

SEQ ID NO: 64000 - protein, 14 aa, Mycobacterium tuberculosis
ARDSNVRVVGALRR

SEQ ID NO: 64001 - protein, 14 aa, Mycobacterium tuberculosis
RDSNVRVVGALRRP

SEQ ID NO: 64002 - protein, 14 aa, Mycobacterium tuberculosis
DSNVRVVGALRRPA

SEQ ID NO: 64003 - protein, 14 aa, Mycobacterium tuberculosis
SNVRVVGALRRPAD

SEQ ID NO: 64004 - protein, 14 aa, Mycobacterium tuberculosis
NVRVVGALRRPADA

SEQ ID NO: 64005 - protein, 14 aa, Mycobacterium tuberculosis
VRVVGALRRPADAV

SEQ ID NO: 64006 - protein, 14 aa, Mycobacterium tuberculosis
RVVGALRRPADAVP

SEQ ID NO: 64007 - protein, 14 aa, Mycobacterium tuberculosis
VVGALRRPADAVPH

SEQ ID NO: 64008 - protein, 14 aa, Mycobacterium tuberculosis
VGALRRPADAVPHD

SEQ ID NO: 64009 - protein, 14 aa, Mycobacterium tuberculosis
GALRRPADAVPHDQ

SEQ ID NO: 64010 - protein, 14 aa, Mycobacterium tuberculosis
ALRRPADAVPHDQP

SEQ ID NO: 64011 - protein, 14 aa, Mycobacterium tuberculosis
LRRPADAVPHDQPG

SEQ ID NO: 64012 - protein, 14 aa, Mycobacterium tuberculosis
RRPADAVPHDQPGR

SEQ ID NO: 64013 - protein, 14 aa, Mycobacterium tuberculosis
RPADAVPHDQPGRG

SEQ ID NO: 64014 - protein, 14 aa, Mycobacterium tuberculosis
PADAVPHDQPGRGL

SEQ ID NO: 64015 - protein, 14 aa, Mycobacterium tuberculosis
ADAVPHDQPGRGLT

SEQ ID NO: 64016 - protein, 14 aa, Mycobacterium tuberculosis
DAVPHDQPGRGLTM

SEQ ID NO: 64017 - protein, 14 aa, Mycobacterium tuberculosis
AVPHDQPGRGLTMA

SEQ ID NO: 64018 - protein, 14 aa, Mycobacterium tuberculosis
VPHDQPGRGLTMAA

SEQ ID NO: 64019 - protein, 14 aa, Mycobacterium tuberculosis
PHDQPGRGLTMAAE

SEQ ID NO: 64020 - protein, 14 aa, Mycobacterium tuberculosis
HDQPGRGLTMAAEH

SEQ ID NO: 64021 - protein, 14 aa, Mycobacterium tuberculosis
DQPGRGLTMAAEHF

SEQ ID NO: 64022 - protein, 14 aa, Mycobacterium tuberculosis
QPGRGLTMAAEHFL

SEQ ID NO: 64023 - protein, 14 aa, Mycobacterium tuberculosis
PGRGLTMAAEHFLF

SEQ ID NO: 64024 - protein, 14 aa, Mycobacterium tuberculosis
GRGLTMAAEHFLFA

SEQ ID NO: 64025 - protein, 14 aa, Mycobacterium tuberculosis
RGLTMAAEHFLFAA

SEQ ID NO: 64026 - protein, 14 aa, Mycobacterium tuberculosis
GLTMAAEHFLFAAP

SEQ ID NO: 64027 - protein, 14 aa, Mycobacterium tuberculosis
LTMAAEHFLFAAPE

SEQ ID NO: 64028 - protein, 14 aa, Mycobacterium tuberculosis
TMAAEHFLFAAPEL

SEQ ID NO: 64029 - protein, 14 aa, Mycobacterium tuberculosis
MAAEHFLFAAPELD

SEQ ID NO: 64030 - protein, 14 aa, Mycobacterium tuberculosis
AAEHFLFAAPELDA

SEQ ID NO: 64031 - protein, 14 aa, Mycobacterium tuberculosis
AEHFLFAAPELDAQ

SEQ ID NO: 64032 - protein, 14 aa, Mycobacterium tuberculosis
EHFLFAAPELDAQT

SEQ ID NO: 64033 - protein, 14 aa, Mycobacterium tuberculosis
HFLFAAPELDAQTN

SEQ ID NO: 64034 - protein, 14 aa, Mycobacterium tuberculosis
FLFAAPELDAQTNP

SEQ ID NO: 64035 - protein, 14 aa, Mycobacterium tuberculosis
LFAAPELDAQTNPV

SEQ ID NO: 64036 - protein, 14 aa, Mycobacterium tuberculosis
FAAPELDAQTNPVA

SEQ ID NO: 64037 - protein, 14 aa, Mycobacterium tuberculosis
AAPELDAQTNPVAA

SEQ ID NO: 64038 - protein, 14 aa, Mycobacterium tuberculosis
APELDAQTNPVAAI

SEQ ID NO: 64039 - protein, 14 aa, Mycobacterium tuberculosis
PELDAQTNPVAAIN

SEQ ID NO: 64040 - protein, 14 aa, Mycobacterium tuberculosis
ELDAQTNPVAAINA

SEQ ID NO: 64041 - protein, 14 aa, Mycobacterium tuberculosis
LDAQTNPVAAINAR

SEQ ID NO: 64042 - protein, 14 aa, Mycobacterium tuberculosis
DAQTNPVAAINARY

SEQ ID NO: 64043 - protein, 14 aa, Mycobacterium tuberculosis
AQTNPVAAINARYP

SEQ ID NO: 64044 - protein, 14 aa, Mycobacterium tuberculosis
QTNPVAAINARYPG

SEQ ID NO: 64045 - protein, 14 aa, Mycobacterium tuberculosis
TNPVAAINARYPGM

SEQ ID NO: 64046 - protein, 14 aa, Mycobacterium tuberculosis
NPVAAINARYPGMA

SEQ ID NO: 64047 - protein, 14 aa, Mycobacterium tuberculosis
PVAAINARYPGMAA

SEQ ID NO: 64048 - protein, 14 aa, Mycobacterium tuberculosis
VAAINARYPGMAAP

SEQ ID NO: 64049 - protein, 14 aa, Mycobacterium tuberculosis
AAINARYPGMAAPP

SEQ ID NO: 64050 - protein, 14 aa, Mycobacterium tuberculosis
AINARYPGMAAPPV

SEQ ID NO: 64051 - protein, 14 aa, Mycobacterium tuberculosis
INARYPGMAAPPVR

SEQ ID NO: 64052 - protein, 14 aa, Mycobacterium tuberculosis
NARYPGMAAPPVRL

SEQ ID NO: 64053 - protein, 14 aa, Mycobacterium tuberculosis
ARYPGMAAPPVRLL

SEQ ID NO: 64054 - protein, 14 aa, Mycobacterium tuberculosis
RYPGMAAPPVRLLP

SEQ ID NO: 64055 - protein, 14 aa, Mycobacterium tuberculosis
YPGMAAPPVRLLPT

SEQ ID NO: 64056 - protein, 14 aa, Mycobacterium tuberculosis
PGMAAPPVRLLPTN

SEQ ID NO: 64057 - protein, 14 aa, Mycobacterium tuberculosis
GMAAPPVRLLPTNL

SEQ ID NO: 64058 - protein, 14 aa, Mycobacterium tuberculosis
MAAPPVRLLPTNLA

SEQ ID NO: 64059 - protein, 14 aa, Mycobacterium tuberculosis
AAPPVRLLPTNLAP

SEQ ID NO: 64060 - protein, 14 aa, Mycobacterium tuberculosis
APPVRLLPTNLAPH

SEQ ID NO: 64061 - protein, 14 aa, Mycobacterium tuberculosis
PPVRLLPTNLAPHA

SEQ ID NO: 64062 - protein, 14 aa, Mycobacterium tuberculosis
PVRLLPTNLAPHAV

SEQ ID NO: 64063 - protein, 14 aa, Mycobacterium tuberculosis
VRLLPTNLAPHAVG

SEQ ID NO: 64064 - protein, 14 aa, Mycobacterium tuberculosis
RLLPTNLAPHAVGE

SEQ ID NO: 64065 - protein, 14 aa, Mycobacterium tuberculosis
LLPTNLAPHAVGEL

SEQ ID NO: 64066 - protein, 14 aa, Mycobacterium tuberculosis
LPTNLAPHAVGELY

SEQ ID NO: 64067 - protein, 14 aa, Mycobacterium tuberculosis
PTNLAPHAVGELYR

SEQ ID NO: 64068 - protein, 14 aa, Mycobacterium tuberculosis
TNLAPHAVGELYRG

SEQ ID NO: 64069 - protein, 14 aa, Mycobacterium tuberculosis
NLAPHAVGELYRGP

SEQ ID NO: 64070 - protein, 14 aa, Mycobacterium tuberculosis
LAPHAVGELYRGPD

SEQ ID NO: 64071 - protein, 14 aa, Mycobacterium tuberculosis
APHAVGELYRGPDQ

SEQ ID NO: 64072 - protein, 14 aa, Mycobacterium tuberculosis
PHAVGELYRGPDQL

SEQ ID NO: 64073 - protein, 14 aa, Mycobacterium tuberculosis
HAVGELYRGPDQLV

SEQ ID NO: 64074 - protein, 14 aa, Mycobacterium tuberculosis
AVGELYRGPDQLVI

SEQ ID NO: 64075 - protein, 14 aa, Mycobacterium tuberculosis
VGELYRGPDQLVIG

SEQ ID NO: 64076 - protein, 14 aa, Mycobacterium tuberculosis
GELYRGPDQLVIGQ

SEQ ID NO: 64077 - protein, 14 aa, Mycobacterium tuberculosis
ELYRGPDQLVIGQR

SEQ ID NO: 64078 - protein, 14 aa, Mycobacterium tuberculosis
LYRGPDQLVIGQRE

SEQ ID NO: 64079 - protein, 14 aa, Mycobacterium tuberculosis
YRGPDQLVIGQREE

SEQ ID NO: 64080 - protein, 14 aa, Mycobacterium tuberculosis
RGPDQLVIGQREED

SEQ ID NO: 64081 - protein, 14 aa, Mycobacterium tuberculosis
GPDQLVIGQREEDL

SEQ ID NO: 64082 - protein, 14 aa, Mycobacterium tuberculosis
PDQLVIGQREEDLA

SEQ ID NO: 64083 - protein, 14 aa, Mycobacterium tuberculosis
DQLVIGQREEDLAP

SEQ ID NO: 64084 - protein, 14 aa, Mycobacterium tuberculosis
QLVIGQREEDLAPV

SEQ ID NO: 64085 - protein, 14 aa, Mycobacterium tuberculosis
LVIGQREEDLAPVI

SEQ ID NO: 64086 - protein, 14 aa, Mycobacterium tuberculosis
VIGQREEDLAPVIL

SEQ ID NO: 64087 - protein, 14 aa, Mycobacterium tuberculosis
IGQREEDLAPVILD

SEQ ID NO: 64088 - protein, 14 aa, Mycobacterium tuberculosis
GQREEDLAPVILDL

SEQ ID NO: 64089 - protein, 14 aa, Mycobacterium tuberculosis
QREEDLAPVILDLA

SEQ ID NO: 64090 - protein, 14 aa, Mycobacterium tuberculosis
REEDLAPVILDLAA

SEQ ID NO: 64091 - protein, 14 aa, Mycobacterium tuberculosis
EEDLAPVILDLAAN

SEQ ID NO: 64092 - protein, 14 aa, Mycobacterium tuberculosis
EDLAPVILDLAANP

SEQ ID NO: 64093 - protein, 14 aa, Mycobacterium tuberculosis
DLAPVILDLAANPL

SEQ ID NO: 64094 - protein, 14 aa, Mycobacterium tuberculosis
LAPVILDLAANPLL

SEQ ID NO: 64095 - protein, 14 aa, Mycobacterium tuberculosis
APVILDLAANPLLM

SEQ ID NO: 64096 - protein, 14 aa, Mycobacterium tuberculosis
PVILDLAANPLLMV

SEQ ID NO: 64097 - protein, 14 aa, Mycobacterium tuberculosis
VILDLAANPLLMVF

SEQ ID NO: 64098 - protein, 14 aa, Mycobacterium tuberculosis
ILDLAANPLLMVFG

SEQ ID NO: 64099 - protein, 14 aa, Mycobacterium tuberculosis
LDLAANPLLMVFGD

SEQ ID NO: 64100 - protein, 14 aa, Mycobacterium tuberculosis
DLAANPLLMVFGDA

SEQ ID NO: 64101 - protein, 14 aa, Mycobacterium tuberculosis
LAANPLLMVFGDAR

SEQ ID NO: 64102 - protein, 14 aa, Mycobacterium tuberculosis
AANPLLMVFGDARS

SEQ ID NO: 64103 - protein, 14 aa, Mycobacterium tuberculosis
ANPLLMVFGDARSG

SEQ ID NO: 64104 - protein, 14 aa, Mycobacterium tuberculosis
NPLLMVFGDARSGK

SEQ ID NO: 64105 - protein, 14 aa, Mycobacterium tuberculosis
PLLMVFGDARSGKT

SEQ ID NO: 64106 - protein, 14 aa, Mycobacterium tuberculosis
LLMVFGDARSGKTT

SEQ ID NO: 64107 - protein, 14 aa, Mycobacterium tuberculosis
LMVFGDARSGKTTL

SEQ ID NO: 64108 - protein, 14 aa, Mycobacterium tuberculosis
MVFGDARSGKTTLL

SEQ ID NO: 64109 - protein, 14 aa, Mycobacterium tuberculosis
VFGDARSGKTTLLR

SEQ ID NO: 64110 - protein, 14 aa, Mycobacterium tuberculosis
FGDARSGKTTLLRH

SEQ ID NO: 64111 - protein, 14 aa, Mycobacterium tuberculosis
GDARSGKTTLLRHI

SEQ ID NO: 64112 - protein, 14 aa, Mycobacterium tuberculosis
DARSGKTTLLRHII

SEQ ID NO: 64113 - protein, 14 aa, Mycobacterium tuberculosis
ARSGKTTLLRHIIR

SEQ ID NO: 64114 - protein, 14 aa, Mycobacterium tuberculosis
RSGKTTLLRHIIRT

SEQ ID NO: 64115 - protein, 14 aa, Mycobacterium tuberculosis
SGKTTLLRHIIRTV

SEQ ID NO: 64116 - protein, 14 aa, Mycobacterium tuberculosis
GKTTLLRHIIRTVR

SEQ ID NO: 64117 - protein, 14 aa, Mycobacterium tuberculosis
KTTLLRHIIRTVRE

SEQ ID NO: 64118 - protein, 14 aa, Mycobacterium tuberculosis
TTLLRHIIRTVREH

SEQ ID NO: 64119 - protein, 14 aa, Mycobacterium tuberculosis
TLLRHIIRTVREHS

SEQ ID NO: 64120 - protein, 14 aa, Mycobacterium tuberculosis
LLRHIIRTVREHST

SEQ ID NO: 64121 - protein, 14 aa, Mycobacterium tuberculosis
LRHIIRTVREHSTA

SEQ ID NO: 64122 - protein, 14 aa, Mycobacterium tuberculosis
RHIIRTVREHSTAD

SEQ ID NO: 64123 - protein, 14 aa, Mycobacterium tuberculosis
HIIRTVREHSTADR

SEQ ID NO: 64124 - protein, 14 aa, Mycobacterium tuberculosis
IIRTVREHSTADRV

SEQ ID NO: 64125 - protein, 14 aa, Mycobacterium tuberculosis
IRTVREHSTADRVA

SEQ ID NO: 64126 - protein, 14 aa, Mycobacterium tuberculosis
RTVREHSTADRVAF

SEQ ID NO: 64127 - protein, 14 aa, Mycobacterium tuberculosis
TVREHSTADRVAFT

SEQ ID NO: 64128 - protein, 14 aa, Mycobacterium tuberculosis
VREHSTADRVAFTV

SEQ ID NO: 64129 - protein, 14 aa, Mycobacterium tuberculosis
REHSTADRVAFTVL

SEQ ID NO: 64130 - protein, 14 aa, Mycobacterium tuberculosis
EHSTADRVAFTVLD

SEQ ID NO: 64131 - protein, 14 aa, Mycobacterium tuberculosis
HSTADRVAFTVLDR

SEQ ID NO: 64132 - protein, 14 aa, Mycobacterium tuberculosis
STADRVAFTVLDRR

SEQ ID NO: 64133 - protein, 14 aa, Mycobacterium tuberculosis
TADRVAFTVLDRRL

SEQ ID NO: 64134 - protein, 14 aa, Mycobacterium tuberculosis
ADRVAFTVLDRRLH

SEQ ID NO: 64135 - protein, 14 aa, Mycobacterium tuberculosis
DRVAFTVLDRRLHL

SEQ ID NO: 64136 - protein, 14 aa, Mycobacterium tuberculosis
RVAFTVLDRRLHLV

SEQ ID NO: 64137 - protein, 14 aa, Mycobacterium tuberculosis
VAFTVLDRRLHLVD

SEQ ID NO: 64138 - protein, 14 aa, Mycobacterium tuberculosis
AFTVLDRRLHLVDE

SEQ ID NO: 64139 - protein, 14 aa, Mycobacterium tuberculosis
FTVLDRRLHLVDEP

SEQ ID NO: 64140 - protein, 14 aa, Mycobacterium tuberculosis
TVLDRRLHLVDEPL

SEQ ID NO: 64141 - protein, 14 aa, Mycobacterium tuberculosis
VLDRRLHLVDEPLF

SEQ ID NO: 64142 - protein, 14 aa, Mycobacterium tuberculosis
LDRRLHLVDEPLFP

SEQ ID NO: 64143 - protein, 14 aa, Mycobacterium tuberculosis
DRRLHLVDEPLFPD

SEQ ID NO: 64144 - protein, 14 aa, Mycobacterium tuberculosis
RRLHLVDEPLFPDN

SEQ ID NO: 64145 - protein, 14 aa, Mycobacterium tuberculosis
RLHLVDEPLFPDNE

SEQ ID NO: 64146 - protein, 14 aa, Mycobacterium tuberculosis
LHLVDEPLFPDNEY

SEQ ID NO: 64147 - protein, 14 aa, Mycobacterium tuberculosis
HLVDEPLFPDNEYT

SEQ ID NO: 64148 - protein, 14 aa, Mycobacterium tuberculosis
LVDEPLFPDNEYTA

SEQ ID NO: 64149 - protein, 14 aa, Mycobacterium tuberculosis
VDEPLFPDNEYTAN

SEQ ID NO: 64150 - protein, 14 aa, Mycobacterium tuberculosis
DEPLFPDNEYTANI

SEQ ID NO: 64151 - protein, 14 aa, Mycobacterium tuberculosis
EPLFPDNEYTANID

SEQ ID NO: 64152 - protein, 14 aa, Mycobacterium tuberculosis
PLFPDNEYTANIDR

SEQ ID NO: 64153 - protein, 14 aa, Mycobacterium tuberculosis
LFPDNEYTANIDRI

SEQ ID NO: 64154 - protein, 14 aa, Mycobacterium tuberculosis
FPDNEYTANIDRII

SEQ ID NO: 64155 - protein, 14 aa, Mycobacterium tuberculosis
PDNEYTANIDRIIP

SEQ ID NO: 64156 - protein, 14 aa, Mycobacterium tuberculosis
DNEYTANIDRIIPA

SEQ ID NO: 64157 - protein, 14 aa, Mycobacterium tuberculosis
NEYTANIDRIIPAM

SEQ ID NO: 64158 - protein, 14 aa, Mycobacterium tuberculosis
EYTANIDRIIPAML

SEQ ID NO: 64159 - protein, 14 aa, Mycobacterium tuberculosis
YTANIDRIIPAMLG

SEQ ID NO: 64160 - protein, 14 aa, Mycobacterium tuberculosis
TANIDRIIPAMLGL

SEQ ID NO: 64161 - protein, 14 aa, Mycobacterium tuberculosis
ANIDRIIPAMLGLA

SEQ ID NO: 64162 - protein, 14 aa, Mycobacterium tuberculosis
NIDRIIPAMLGLAN

SEQ ID NO: 64163 - protein, 14 aa, Mycobacterium tuberculosis
IDRIIPAMLGLANL

SEQ ID NO: 64164 - protein, 14 aa, Mycobacterium tuberculosis
DRIIPAMLGLANLI

SEQ ID NO: 64165 - protein, 14 aa, Mycobacterium tuberculosis
RIIPAMLGLANLIE

SEQ ID NO: 64166 - protein, 14 aa, Mycobacterium tuberculosis
IIPAMLGLANLIEA

SEQ ID NO: 64167 - protein, 14 aa, Mycobacterium tuberculosis
IPAMLGLANLIEAR

SEQ ID NO: 64168 - protein, 14 aa, Mycobacterium tuberculosis
PAMLGLANLIEARR

SEQ ID NO: 64169 - protein, 14 aa, Mycobacterium tuberculosis
AMLGLANLIEARRP

SEQ ID NO: 64170 - protein, 14 aa, Mycobacterium tuberculosis
MLGLANLIEARRPP

SEQ ID NO: 64171 - protein, 14 aa, Mycobacterium tuberculosis
LGLANLIEARRPPA

SEQ ID NO: 64172 - protein, 14 aa, Mycobacterium tuberculosis
GLANLIEARRPPAG

SEQ ID NO: 64173 - protein, 14 aa, Mycobacterium tuberculosis
LANLIEARRPPAGM

SEQ ID NO: 64174 - protein, 14 aa, Mycobacterium tuberculosis
ANLIEARRPPAGMS

SEQ ID NO: 64175 - protein, 14 aa, Mycobacterium tuberculosis
NLIEARRPPAGMSA

SEQ ID NO: 64176 - protein, 14 aa, Mycobacterium tuberculosis
LIEARRPPAGMSAA

SEQ ID NO: 64177 - protein, 14 aa, Mycobacterium tuberculosis
IEARRPPAGMSAAE

SEQ ID NO: 64178 - protein, 14 aa, Mycobacterium tuberculosis
EARRPPAGMSAAEL

SEQ ID NO: 64179 - protein, 14 aa, Mycobacterium tuberculosis
ARRPPAGMSAAELS

SEQ ID NO: 64180 - protein, 14 aa, Mycobacterium tuberculosis
RRPPAGMSAAELSR

SEQ ID NO: 64181 - protein, 14 aa, Mycobacterium tuberculosis
RPPAGMSAAELSRW

SEQ ID NO: 64182 - protein, 14 aa, Mycobacterium tuberculosis
PPAGMSAAELSRWT

SEQ ID NO: 64183 - protein, 14 aa, Mycobacterium tuberculosis
PAGMSAAELSRWTF

SEQ ID NO: 64184 - protein, 14 aa, Mycobacterium tuberculosis
AGMSAAELSRWTFA

SEQ ID NO: 64185 - protein, 14 aa, Mycobacterium tuberculosis
GMSAAELSRWTFAG

SEQ ID NO: 64186 - protein, 14 aa, Mycobacterium tuberculosis
MSAAELSRWTFAGH

SEQ ID NO: 64187 - protein, 14 aa, Mycobacterium tuberculosis
SAAELSRWTFAGHT

SEQ ID NO: 64188 - protein, 14 aa, Mycobacterium tuberculosis
AAELSRWTFAGHTH

SEQ ID NO: 64189 - protein, 14 aa, Mycobacterium tuberculosis
AELSRWTFAGHTHY

SEQ ID NO: 64190 - protein, 14 aa, Mycobacterium tuberculosis
ELSRWTFAGHTHYL

SEQ ID NO: 64191 - protein, 14 aa, Mycobacterium tuberculosis
LSRWTFAGHTHYLI

SEQ ID NO: 64192 - protein, 14 aa, Mycobacterium tuberculosis
SRWTFAGHTHYLII

SEQ ID NO: 64193 - protein, 14 aa, Mycobacterium tuberculosis
RWTFAGHTHYLIID

SEQ ID NO: 64194 - protein, 14 aa, Mycobacterium tuberculosis
WTFAGHTHYLIIDD

SEQ ID NO: 64195 - protein, 14 aa, Mycobacterium tuberculosis
TFAGHTHYLIIDDV

SEQ ID NO: 64196 - protein, 14 aa, Mycobacterium tuberculosis
FAGHTHYLIIDDVD

SEQ ID NO: 64197 - protein, 14 aa, Mycobacterium tuberculosis
AGHTHYLIIDDVDQ

SEQ ID NO: 64198 - protein, 14 aa, Mycobacterium tuberculosis
GHTHYLIIDDVDQV

SEQ ID NO: 64199 - protein, 14 aa, Mycobacterium tuberculosis
HTHYLIIDDVDQVP

SEQ ID NO: 64200 - protein, 14 aa, Mycobacterium tuberculosis
THYLIIDDVDQVPD

SEQ ID NO: 64201 - protein, 14 aa, Mycobacterium tuberculosis
HYLIIDDVDQVPDS

SEQ ID NO: 64202 - protein, 14 aa, Mycobacterium tuberculosis
YLIIDDVDQVPDSP

SEQ ID NO: 64203 - protein, 14 aa, Mycobacterium tuberculosis
LIIDDVDQVPDSPA

SEQ ID NO: 64204 - protein, 14 aa, Mycobacterium tuberculosis
IIDDVDQVPDSPAM

SEQ ID NO: 64205 - protein, 14 aa, Mycobacterium tuberculosis
IDDVDQVPDSPAMT

SEQ ID NO: 64206 - protein, 14 aa, Mycobacterium tuberculosis
DDVDQVPDSPAMTG

SEQ ID NO: 64207 - protein, 14 aa, Mycobacterium tuberculosis
DVDQVPDSPAMTGP

SEQ ID NO: 64208 - protein, 14 aa, Mycobacterium tuberculosis
VDQVPDSPAMTGPY

SEQ ID NO: 64209 - protein, 14 aa, Mycobacterium tuberculosis
DQVPDSPAMTGPYI

SEQ ID NO: 64210 - protein, 14 aa, Mycobacterium tuberculosis
QVPDSPAMTGPYIG

SEQ ID NO: 64211 - protein, 14 aa, Mycobacterium tuberculosis
VPDSPAMTGPYIGQ

SEQ ID NO: 64212 - protein, 14 aa, Mycobacterium tuberculosis
PDSPAMTGPYIGQR

SEQ ID NO: 64213 - protein, 14 aa, Mycobacterium tuberculosis
DSPAMTGPYIGQRP

SEQ ID NO: 64214 - protein, 14 aa, Mycobacterium tuberculosis
SPAMTGPYIGQRPW

SEQ ID NO: 64215 - protein, 14 aa, Mycobacterium tuberculosis
PAMTGPYIGQRPWT

SEQ ID NO: 64216 - protein, 14 aa, Mycobacterium tuberculosis
AMTGPYIGQRPWTP

SEQ ID NO: 64217 - protein, 14 aa, Mycobacterium tuberculosis
MTGPYIGQRPWTPL

SEQ ID NO: 64218 - protein, 14 aa, Mycobacterium tuberculosis
TGPYIGQRPWTPLI

SEQ ID NO: 64219 - protein, 14 aa, Mycobacterium tuberculosis
GPYIGQRPWTPLIG

SEQ ID NO: 64220 - protein, 14 aa, Mycobacterium tuberculosis
PYIGQRPWTPLIGL

SEQ ID NO: 64221 - protein, 14 aa, Mycobacterium tuberculosis
YIGQRPWTPLIGLL

SEQ ID NO: 64222 - protein, 14 aa, Mycobacterium tuberculosis
IGQRPWTPLIGLLA

SEQ ID NO: 64223 - protein, 14 aa, Mycobacterium tuberculosis
GQRPWTPLIGLLAQ

SEQ ID NO: 64224 - protein, 14 aa, Mycobacterium tuberculosis
QRPWTPLIGLLAQA

SEQ ID NO: 64225 - protein, 14 aa, Mycobacterium tuberculosis
RPWTPLIGLLAQAG

SEQ ID NO: 64226 - protein, 14 aa, Mycobacterium tuberculosis
PWTPLIGLLAQAGD

SEQ ID NO: 64227 - protein, 14 aa, Mycobacterium tuberculosis
WTPLIGLLAQAGDL

SEQ ID NO: 64228 - protein, 14 aa, Mycobacterium tuberculosis
TPLIGLLAQAGDLG

SEQ ID NO: 64229 - protein, 14 aa, Mycobacterium tuberculosis
PLIGLLAQAGDLGL

SEQ ID NO: 64230 - protein, 14 aa, Mycobacterium tuberculosis
LIGLLAQAGDLGLR

SEQ ID NO: 64231 - protein, 14 aa, Mycobacterium tuberculosis
IGLLAQAGDLGLRV

SEQ ID NO: 64232 - protein, 14 aa, Mycobacterium tuberculosis
GLLAQAGDLGLRVI

SEQ ID NO: 64233 - protein, 14 aa, Mycobacterium tuberculosis
LLAQAGDLGLRVIV

SEQ ID NO: 64234 - protein, 14 aa, Mycobacterium tuberculosis
LAQAGDLGLRVIVT

SEQ ID NO: 64235 - protein, 14 aa, Mycobacterium tuberculosis
AQAGDLGLRVIVTG

SEQ ID NO: 64236 - protein, 14 aa, Mycobacterium tuberculosis
QAGDLGLRVIVTGR

SEQ ID NO: 64237 - protein, 14 aa, Mycobacterium tuberculosis
AGDLGLRVIVTGRA

SEQ ID NO: 64238 - protein, 14 aa, Mycobacterium tuberculosis
GDLGLRVIVTGRAT

SEQ ID NO: 64239 - protein, 14 aa, Mycobacterium tuberculosis
DLGLRVIVTGRATG

SEQ ID NO: 64240 - protein, 14 aa, Mycobacterium tuberculosis
LGLRVIVTGRATGS

SEQ ID NO: 64241 - protein, 14 aa, Mycobacterium tuberculosis
GLRVIVTGRATGSA

SEQ ID NO: 64242 - protein, 14 aa, Mycobacterium tuberculosis
LRVIVTGRATGSAH

SEQ ID NO: 64243 - protein, 14 aa, Mycobacterium tuberculosis
RVIVTGRATGSAHL

SEQ ID NO: 64244 - protein, 14 aa, Mycobacterium tuberculosis
VIVTGRATGSAHLL

SEQ ID NO: 64245 - protein, 14 aa, Mycobacterium tuberculosis
IVTGRATGSAHLLM

SEQ ID NO: 64246 - protein, 14 aa, Mycobacterium tuberculosis
VTGRATGSAHLLMT

SEQ ID NO: 64247 - protein, 14 aa, Mycobacterium tuberculosis
TGRATGSAHLLMTS

SEQ ID NO: 64248 - protein, 14 aa, Mycobacterium tuberculosis
GRATGSAHLLMTSP

SEQ ID NO: 64249 - protein, 14 aa, Mycobacterium tuberculosis
RATGSAHLLMTSPL

SEQ ID NO: 64250 - protein, 14 aa, Mycobacterium tuberculosis
ATGSAHLLMTSPLL

SEQ ID NO: 64251 - protein, 14 aa, Mycobacterium tuberculosis
TGSAHLLMTSPLLR

SEQ ID NO: 64252 - protein, 14 aa, Mycobacterium tuberculosis
GSAHLLMTSPLLRR

SEQ ID NO: 64253 - protein, 14 aa, Mycobacterium tuberculosis
SAHLLMTSPLLRRF

SEQ ID NO: 64254 - protein, 14 aa, Mycobacterium tuberculosis
AHLLMTSPLLRRFN

SEQ ID NO: 64255 - protein, 14 aa, Mycobacterium tuberculosis
HLLMTSPLLRRFND

SEQ ID NO: 64256 - protein, 14 aa, Mycobacterium tuberculosis
LLMTSPLLRRFNDL

SEQ ID NO: 64257 - protein, 14 aa, Mycobacterium tuberculosis
LMTSPLLRRFNDLQ

SEQ ID NO: 64258 - protein, 14 aa, Mycobacterium tuberculosis
MTSPLLRRFNDLQA

SEQ ID NO: 64259 - protein, 14 aa, Mycobacterium tuberculosis
TSPLLRRFNDLQAT

SEQ ID NO: 64260 - protein, 14 aa, Mycobacterium tuberculosis
SPLLRRFNDLQATT

SEQ ID NO: 64261 - protein, 14 aa, Mycobacterium tuberculosis
PLLRRFNDLQATTL

SEQ ID NO: 64262 - protein, 14 aa, Mycobacterium tuberculosis
LLRRFNDLQATTLM

SEQ ID NO: 64263 - protein, 14 aa, Mycobacterium tuberculosis
LRRFNDLQATTLML

SEQ ID NO: 64264 - protein, 14 aa, Mycobacterium tuberculosis
RRFNDLQATTLMLA

SEQ ID NO: 64265 - protein, 14 aa, Mycobacterium tuberculosis
RFNDLQATTLMLAG

SEQ ID NO: 64266 - protein, 14 aa, Mycobacterium tuberculosis
FNDLQATTLMLAGN

SEQ ID NO: 64267 - protein, 14 aa, Mycobacterium tuberculosis
NDLQATTLMLAGNP

SEQ ID NO: 64268 - protein, 14 aa, Mycobacterium tuberculosis
DLQATTLMLAGNPA

SEQ ID NO: 64269 - protein, 14 aa, Mycobacterium tuberculosis
LQATTLMLAGNPAD

SEQ ID NO: 64270 - protein, 14 aa, Mycobacterium tuberculosis
QATTLMLAGNPADS

SEQ ID NO: 64271 - protein, 14 aa, Mycobacterium tuberculosis
ATTLMLAGNPADSG

SEQ ID NO: 64272 - protein, 14 aa, Mycobacterium tuberculosis
TTLMLAGNPADSGK

SEQ ID NO: 64273 - protein, 14 aa, Mycobacterium tuberculosis
TLMLAGNPADSGKI

SEQ ID NO: 64274 - protein, 14 aa, Mycobacterium tuberculosis
LMLAGNPADSGKIR

SEQ ID NO: 64275 - protein, 14 aa, Mycobacterium tuberculosis
MLAGNPADSGKIRG

SEQ ID NO: 64276 - protein, 14 aa, Mycobacterium tuberculosis
LAGNPADSGKIRGE

SEQ ID NO: 64277 - protein, 14 aa, Mycobacterium tuberculosis
AGNPADSGKIRGER

SEQ ID NO: 64278 - protein, 14 aa, Mycobacterium tuberculosis
GNPADSGKIRGERF

SEQ ID NO: 64279 - protein, 14 aa, Mycobacterium tuberculosis
NPADSGKIRGERFA

SEQ ID NO: 64280 - protein, 14 aa, Mycobacterium tuberculosis
PADSGKIRGERFAR

SEQ ID NO: 64281 - protein, 14 aa, Mycobacterium tuberculosis
ADSGKIRGERFARL

SEQ ID NO: 64282 - protein, 14 aa, Mycobacterium tuberculosis
DSGKIRGERFARLP

SEQ ID NO: 64283 - protein, 14 aa, Mycobacterium tuberculosis
SGKIRGERFARLPA

SEQ ID NO: 64284 - protein, 14 aa, Mycobacterium tuberculosis
GKIRGERFARLPAG

SEQ ID NO: 64285 - protein, 14 aa, Mycobacterium tuberculosis
KIRGERFARLPAGR

SEQ ID NO: 64286 - protein, 14 aa, Mycobacterium tuberculosis
IRGERFARLPAGRA

SEQ ID NO: 64287 - protein, 14 aa, Mycobacterium tuberculosis
RGERFARLPAGRAI

SEQ ID NO: 64288 - protein, 14 aa, Mycobacterium tuberculosis
GERFARLPAGRAIL

SEQ ID NO: 64289 - protein, 14 aa, Mycobacterium tuberculosis
ERFARLPAGRAILL

SEQ ID NO: 64290 - protein, 14 aa, Mycobacterium tuberculosis
RFARLPAGRAILLT

SEQ ID NO: 64291 - protein, 14 aa, Mycobacterium tuberculosis
FARLPAGRAILLTD

SEQ ID NO: 64292 - protein, 14 aa, Mycobacterium tuberculosis
ARLPAGRAILLTDS

SEQ ID NO: 64293 - protein, 14 aa, Mycobacterium tuberculosis
RLPAGRAILLTDSD

SEQ ID NO: 64294 - protein, 14 aa, Mycobacterium tuberculosis
LPAGRAILLTDSDS

SEQ ID NO: 64295 - protein, 14 aa, Mycobacterium tuberculosis
PAGRAILLTDSDSP

SEQ ID NO: 64296 - protein, 14 aa, Mycobacterium tuberculosis
AGRAILLTDSDSPT

SEQ ID NO: 64297 - protein, 14 aa, Mycobacterium tuberculosis
GRAILLTDSDSPTY

SEQ ID NO: 64298 - protein, 14 aa, Mycobacterium tuberculosis
RAILLTDSDSPTYV

SEQ ID NO: 64299 - protein, 14 aa, Mycobacterium tuberculosis
AILLTDSDSPTYVQ

SEQ ID NO: 64300 - protein, 14 aa, Mycobacterium tuberculosis
ILLTDSDSPTYVQL

SEQ ID NO: 64301 - protein, 14 aa, Mycobacterium tuberculosis
LLTDSDSPTYVQLI

SEQ ID NO: 64302 - protein, 14 aa, Mycobacterium tuberculosis
LTDSDSPTYVQLIN

SEQ ID NO: 64303 - protein, 14 aa, Mycobacterium tuberculosis
TDSDSPTYVQLINP

SEQ ID NO: 64304 - protein, 14 aa, Mycobacterium tuberculosis
DSDSPTYVQLINPL

SEQ ID NO: 64305 - protein, 14 aa, Mycobacterium tuberculosis
SDSPTYVQLINPLV

SEQ ID NO: 64306 - protein, 14 aa, Mycobacterium tuberculosis
DSPTYVQLINPLVD

SEQ ID NO: 64307 - protein, 14 aa, Mycobacterium tuberculosis
SPTYVQLINPLVDA

SEQ ID NO: 64308 - protein, 14 aa, Mycobacterium tuberculosis
PTYVQLINPLVDAA

SEQ ID NO: 64309 - protein, 14 aa, Mycobacterium tuberculosis
TYVQLINPLVDAAA

SEQ ID NO: 64310 - protein, 14 aa, Mycobacterium tuberculosis
YVQLINPLVDAAAV

SEQ ID NO: 64311 - protein, 14 aa, Mycobacterium tuberculosis
VQLINPLVDAAAVS

SEQ ID NO: 64312 - protein, 14 aa, Mycobacterium tuberculosis
QLINPLVDAAAVSG

SEQ ID NO: 64313 - protein, 14 aa, Mycobacterium tuberculosis
LINPLVDAAAVSGE

SEQ ID NO: 64314 - protein, 14 aa, Mycobacterium tuberculosis
INPLVDAAAVSGET

SEQ ID NO: 64315 - protein, 14 aa, Mycobacterium tuberculosis
NPLVDAAAVSGETQ

SEQ ID NO: 64316 - protein, 14 aa, Mycobacterium tuberculosis
PLVDAAAVSGETQQ

SEQ ID NO: 64317 - protein, 14 aa, Mycobacterium tuberculosis
LVDAAAVSGETQQK

SEQ ID NO: 64318 - protein, 14 aa, Mycobacterium tuberculosis
VDAAAVSGETQQKG

SEQ ID NO: 64319 - protein, 14 aa, Mycobacterium tuberculosis
DAAAVSGETQQKGS

SEQ ID NO: 64320 - protein, 14 aa, Mycobacterium tuberculosis
AAAVSGETQQKGSQ

SEQ ID NO: 64321 - protein, 14 aa, Mycobacterium tuberculosis
AAVSGETQQKGSQS

SEQ ID NO: 64322 - protein, 15 aa, Mycobacterium tuberculosis
MSRLIFEARRRLAPP

SEQ ID NO: 64323 - protein, 15 aa, Mycobacterium tuberculosis
SRLIFEARRRLAPPS

SEQ ID NO: 64324 - protein, 15 aa, Mycobacterium tuberculosis
RLIFEARRRLAPPSS

SEQ ID NO: 64325 - protein, 15 aa, Mycobacterium tuberculosis
LIFEARRRLAPPSSH

SEQ ID NO: 64326 - protein, 15 aa, Mycobacterium tuberculosis
IFEARRRLAPPSSHQ

SEQ ID NO: 64327 - protein, 15 aa, Mycobacterium tuberculosis
FEARRRLAPPSSHQG

SEQ ID NO: 64328 - protein, 15 aa, Mycobacterium tuberculosis
EARRRLAPPSSHQGT

SEQ ID NO: 64329 - protein, 15 aa, Mycobacterium tuberculosis
ARRRLAPPSSHQGTI

SEQ ID NO: 64330 - protein, 15 aa, Mycobacterium tuberculosis
RRRLAPPSSHQGTII

SEQ ID NO: 64331 - protein, 15 aa, Mycobacterium tuberculosis
RRLAPPSSHQGTIII

SEQ ID NO: 64332 - protein, 15 aa, Mycobacterium tuberculosis
RLAPPSSHQGTIIIE

SEQ ID NO: 64333 - protein, 15 aa, Mycobacterium tuberculosis
LAPPSSHQGTIIIEA

SEQ ID NO: 64334 - protein, 15 aa, Mycobacterium tuberculosis
APPSSHQGTIIIEAP

SEQ ID NO: 64335 - protein, 15 aa, Mycobacterium tuberculosis
PPSSHQGTIIIEAPP

SEQ ID NO: 64336 - protein, 15 aa, Mycobacterium tuberculosis
PSSHQGTIIIEAPPE

SEQ ID NO: 64337 - protein, 15 aa, Mycobacterium tuberculosis
SSHQGTIIIEAPPEL

SEQ ID NO: 64338 - protein, 15 aa, Mycobacterium tuberculosis
SHQGTIIIEAPPELP

SEQ ID NO: 64339 - protein, 15 aa, Mycobacterium tuberculosis
HQGTIIIEAPPELPR

SEQ ID NO: 64340 - protein, 15 aa, Mycobacterium tuberculosis
QGTIIIEAPPELPRV

SEQ ID NO: 64341 - protein, 15 aa, Mycobacterium tuberculosis
GTIIIEAPPELPRVI

SEQ ID NO: 64342 - protein, 15 aa, Mycobacterium tuberculosis
TIIIEAPPELPRVIP

SEQ ID NO: 64343 - protein, 15 aa, Mycobacterium tuberculosis
IIIEAPPELPRVIPP

SEQ ID NO: 64344 - protein, 15 aa, Mycobacterium tuberculosis
IIEAPPELPRVIPPS

SEQ ID NO: 64345 - protein, 15 aa, Mycobacterium tuberculosis
IEAPPELPRVIPPSL

SEQ ID NO: 64346 - protein, 15 aa, Mycobacterium tuberculosis
EAPPELPRVIPPSLL

SEQ ID NO: 64347 - protein, 15 aa, Mycobacterium tuberculosis
APPELPRVIPPSLLR

SEQ ID NO: 64348 - protein, 15 aa, Mycobacterium tuberculosis
PPELPRVIPPSLLRR

SEQ ID NO: 64349 - protein, 15 aa, Mycobacterium tuberculosis
PELPRVIPPSLLRRA

SEQ ID NO: 64350 - protein, 15 aa, Mycobacterium tuberculosis
ELPRVIPPSLLRRAL

SEQ ID NO: 64351 - protein, 15 aa, Mycobacterium tuberculosis
LPRVIPPSLLRRALP

SEQ ID NO: 64352 - protein, 15 aa, Mycobacterium tuberculosis
PRVIPPSLLRRALPY

SEQ ID NO: 64353 - protein, 15 aa, Mycobacterium tuberculosis
RVIPPSLLRRALPYL

SEQ ID NO: 64354 - protein, 15 aa, Mycobacterium tuberculosis
VIPPSLLRRALPYLI

SEQ ID NO: 64355 - protein, 15 aa, Mycobacterium tuberculosis
IPPSLLRRALPYLIG

SEQ ID NO: 64356 - protein, 15 aa, Mycobacterium tuberculosis
PPSLLRRALPYLIGI

SEQ ID NO: 64357 - protein, 15 aa, Mycobacterium tuberculosis
PSLLRRALPYLIGIL

SEQ ID NO: 64358 - protein, 15 aa, Mycobacterium tuberculosis
SLLRRALPYLIGILI

SEQ ID NO: 64359 - protein, 15 aa, Mycobacterium tuberculosis
LLRRALPYLIGILIV

SEQ ID NO: 64360 - protein, 15 aa, Mycobacterium tuberculosis
LRRALPYLIGILIVG

SEQ ID NO: 64361 - protein, 15 aa, Mycobacterium tuberculosis
RRALPYLIGILIVGM

SEQ ID NO: 64362 - protein, 15 aa, Mycobacterium tuberculosis
RALPYLIGILIVGMI

SEQ ID NO: 64363 - protein, 15 aa, Mycobacterium tuberculosis
ALPYLIGILIVGMIV

SEQ ID NO: 64364 - protein, 15 aa, Mycobacterium tuberculosis
LPYLIGILIVGMIVA

SEQ ID NO: 64365 - protein, 15 aa, Mycobacterium tuberculosis
PYLIGILIVGMIVAL

SEQ ID NO: 64366 - protein, 15 aa, Mycobacterium tuberculosis
YLIGILIVGMIVALV

SEQ ID NO: 64367 - protein, 15 aa, Mycobacterium tuberculosis
LIGILIVGMIVALVA

SEQ ID NO: 64368 - protein, 15 aa, Mycobacterium tuberculosis
IGILIVGMIVALVAT

SEQ ID NO: 64369 - protein, 15 aa, Mycobacterium tuberculosis
GILIVGMIVALVATG

SEQ ID NO: 64370 - protein, 15 aa, Mycobacterium tuberculosis
ILIVGMIVALVATGM

SEQ ID NO: 64371 - protein, 15 aa, Mycobacterium tuberculosis
LIVGMIVALVATGMR

SEQ ID NO: 64372 - protein, 15 aa, Mycobacterium tuberculosis
IVGMIVALVATGMRV

SEQ ID NO: 64373 - protein, 15 aa, Mycobacterium tuberculosis
VGMIVALVATGMRVI

SEQ ID NO: 64374 - protein, 15 aa, Mycobacterium tuberculosis
GMIVALVATGMRVIS

SEQ ID NO: 64375 - protein, 15 aa, Mycobacterium tuberculosis
MIVALVATGMRVISP

SEQ ID NO: 64376 - protein, 15 aa, Mycobacterium tuberculosis
IVALVATGMRVISPQ

SEQ ID NO: 64377 - protein, 15 aa, Mycobacterium tuberculosis
VALVATGMRVISPQT

SEQ ID NO: 64378 - protein, 15 aa, Mycobacterium tuberculosis
ALVATGMRVISPQTL

SEQ ID NO: 64379 - protein, 15 aa, Mycobacterium tuberculosis
LVATGMRVISPQTLF

SEQ ID NO: 64380 - protein, 15 aa, Mycobacterium tuberculosis
VATGMRVISPQTLFF

SEQ ID NO: 64381 - protein, 15 aa, Mycobacterium tuberculosis
ATGMRVISPQTLFFP

SEQ ID NO: 64382 - protein, 15 aa, Mycobacterium tuberculosis
TGMRVISPQTLFFPF

SEQ ID NO: 64383 - protein, 15 aa, Mycobacterium tuberculosis
GMRVISPQTLFFPFV

SEQ ID NO: 64384 - protein, 15 aa, Mycobacterium tuberculosis
MRVISPQTLFFPFVL

SEQ ID NO: 64385 - protein, 15 aa, Mycobacterium tuberculosis
RVISPQTLFFPFVLL

SEQ ID NO: 64386 - protein, 15 aa, Mycobacterium tuberculosis
VISPQTLFFPFVLLL

SEQ ID NO: 64387 - protein, 15 aa, Mycobacterium tuberculosis
ISPQTLFFPFVLLLA

SEQ ID NO: 64388 - protein, 15 aa, Mycobacterium tuberculosis
SPQTLFFPFVLLLAA

SEQ ID NO: 64389 - protein, 15 aa, Mycobacterium tuberculosis
PQTLFFPFVLLLAAT

SEQ ID NO: 64390 - protein, 15 aa, Mycobacterium tuberculosis
QTLFFPFVLLLAATA

SEQ ID NO: 64391 - protein, 15 aa, Mycobacterium tuberculosis
TLFFPFVLLLAATAL

SEQ ID NO: 64392 - protein, 15 aa, Mycobacterium tuberculosis
LFFPFVLLLAATALY

SEQ ID NO: 64393 - protein, 15 aa, Mycobacterium tuberculosis
FFPFVLLLAATALYR

SEQ ID NO: 64394 - protein, 15 aa, Mycobacterium tuberculosis
FPFVLLLAATALYRG

SEQ ID NO: 64395 - protein, 15 aa, Mycobacterium tuberculosis
PFVLLLAATALYRGN

SEQ ID NO: 64396 - protein, 15 aa, Mycobacterium tuberculosis
FVLLLAATALYRGND

SEQ ID NO: 64397 - protein, 15 aa, Mycobacterium tuberculosis
VLLLAATALYRGNDK

SEQ ID NO: 64398 - protein, 15 aa, Mycobacterium tuberculosis
LLLAATALYRGNDKK

SEQ ID NO: 64399 - protein, 15 aa, Mycobacterium tuberculosis
LLAATALYRGNDKKM

SEQ ID NO: 64400 - protein, 15 aa, Mycobacterium tuberculosis
LAATALYRGNDKKMR

SEQ ID NO: 64401 - protein, 15 aa, Mycobacterium tuberculosis
AATALYRGNDKKMRT

SEQ ID NO: 64402 - protein, 15 aa, Mycobacterium tuberculosis
ATALYRGNDKKMRTE

SEQ ID NO: 64403 - protein, 15 aa, Mycobacterium tuberculosis
TALYRGNDKKMRTEE

SEQ ID NO: 64404 - protein, 15 aa, Mycobacterium tuberculosis
ALYRGNDKKMRTEEV

SEQ ID NO: 64405 - protein, 15 aa, Mycobacterium tuberculosis
LYRGNDKKMRTEEVD

SEQ ID NO: 64406 - protein, 15 aa, Mycobacterium tuberculosis
YRGNDKKMRTEEVDA

SEQ ID NO: 64407 - protein, 15 aa, Mycobacterium tuberculosis
RGNDKKMRTEEVDAE

SEQ ID NO: 64408 - protein, 15 aa, Mycobacterium tuberculosis
GNDKKMRTEEVDAER

SEQ ID NO: 64409 - protein, 15 aa, Mycobacterium tuberculosis
NDKKMRTEEVDAERA

SEQ ID NO: 64410 - protein, 15 aa, Mycobacterium tuberculosis
DKKMRTEEVDAERAD

SEQ ID NO: 64411 - protein, 15 aa, Mycobacterium tuberculosis
KKMRTEEVDAERADY

SEQ ID NO: 64412 - protein, 15 aa, Mycobacterium tuberculosis
KMRTEEVDAERADYL

SEQ ID NO: 64413 - protein, 15 aa, Mycobacterium tuberculosis
MRTEEVDAERADYLR

SEQ ID NO: 64414 - protein, 15 aa, Mycobacterium tuberculosis
RTEEVDAERADYLRY

SEQ ID NO: 64415 - protein, 15 aa, Mycobacterium tuberculosis
TEEVDAERADYLRYL

SEQ ID NO: 64416 - protein, 15 aa, Mycobacterium tuberculosis
EEVDAERADYLRYLS

SEQ ID NO: 64417 - protein, 15 aa, Mycobacterium tuberculosis
EVDAERADYLRYLSV

SEQ ID NO: 64418 - protein, 15 aa, Mycobacterium tuberculosis
VDAERADYLRYLSVV

SEQ ID NO: 64419 - protein, 15 aa, Mycobacterium tuberculosis
DAERADYLRYLSVVR

SEQ ID NO: 64420 - protein, 15 aa, Mycobacterium tuberculosis
AERADYLRYLSVVRD

SEQ ID NO: 64421 - protein, 15 aa, Mycobacterium tuberculosis
ERADYLRYLSVVRDN

SEQ ID NO: 64422 - protein, 15 aa, Mycobacterium tuberculosis
RADYLRYLSVVRDNI

SEQ ID NO: 64423 - protein, 15 aa, Mycobacterium tuberculosis
ADYLRYLSVVRDNIR

SEQ ID NO: 64424 - protein, 15 aa, Mycobacterium tuberculosis
DYLRYLSVVRDNIRA

SEQ ID NO: 64425 - protein, 15 aa, Mycobacterium tuberculosis
YLRYLSVVRDNIRAQ

SEQ ID NO: 64426 - protein, 15 aa, Mycobacterium tuberculosis
LRYLSVVRDNIRAQA

SEQ ID NO: 64427 - protein, 15 aa, Mycobacterium tuberculosis
RYLSVVRDNIRAQAA

SEQ ID NO: 64428 - protein, 15 aa, Mycobacterium tuberculosis
YLSVVRDNIRAQAAE

SEQ ID NO: 64429 - protein, 15 aa, Mycobacterium tuberculosis
LSVVRDNIRAQAAEQ

SEQ ID NO: 64430 - protein, 15 aa, Mycobacterium tuberculosis
SVVRDNIRAQAAEQR

SEQ ID NO: 64431 - protein, 15 aa, Mycobacterium tuberculosis
VVRDNIRAQAAEQRA

SEQ ID NO: 64432 - protein, 15 aa, Mycobacterium tuberculosis
VRDNIRAQAAEQRAS

SEQ ID NO: 64433 - protein, 15 aa, Mycobacterium tuberculosis
RDNIRAQAAEQRASA

SEQ ID NO: 64434 - protein, 15 aa, Mycobacterium tuberculosis
DNIRAQAAEQRASAL

SEQ ID NO: 64435 - protein, 15 aa, Mycobacterium tuberculosis
NIRAQAAEQRASALW

SEQ ID NO: 64436 - protein, 15 aa, Mycobacterium tuberculosis
IRAQAAEQRASALWS

SEQ ID NO: 64437 - protein, 15 aa, Mycobacterium tuberculosis
RAQAAEQRASALWSH

SEQ ID NO: 64438 - protein, 15 aa, Mycobacterium tuberculosis
AQAAEQRASALWSHP

SEQ ID NO: 64439 - protein, 15 aa, Mycobacterium tuberculosis
QAAEQRASALWSHPD

SEQ ID NO: 64440 - protein, 15 aa, Mycobacterium tuberculosis
AAEQRASALWSHPDP

SEQ ID NO: 64441 - protein, 15 aa, Mycobacterium tuberculosis
AEQRASALWSHPDPT

SEQ ID NO: 64442 - protein, 15 aa, Mycobacterium tuberculosis
EQRASALWSHPDPTA

SEQ ID NO: 64443 - protein, 15 aa, Mycobacterium tuberculosis
QRASALWSHPDPTAL

SEQ ID NO: 64444 - protein, 15 aa, Mycobacterium tuberculosis
RASALWSHPDPTALA

SEQ ID NO: 64445 - protein, 15 aa, Mycobacterium tuberculosis
ASALWSHPDPTALAS

SEQ ID NO: 64446 - protein, 15 aa, Mycobacterium tuberculosis
SALWSHPDPTALASV

SEQ ID NO: 64447 - protein, 15 aa, Mycobacterium tuberculosis
ALWSHPDPTALASVP

SEQ ID NO: 64448 - protein, 15 aa, Mycobacterium tuberculosis
LWSHPDPTALASVPG

SEQ ID NO: 64449 - protein, 15 aa, Mycobacterium tuberculosis
WSHPDPTALASVPGS

SEQ ID NO: 64450 - protein, 15 aa, Mycobacterium tuberculosis
SHPDPTALASVPGSR

SEQ ID NO: 64451 - protein, 15 aa, Mycobacterium tuberculosis
HPDPTALASVPGSRR

SEQ ID NO: 64452 - protein, 15 aa, Mycobacterium tuberculosis
PDPTALASVPGSRRQ

SEQ ID NO: 64453 - protein, 15 aa, Mycobacterium tuberculosis
DPTALASVPGSRRQW

SEQ ID NO: 64454 - protein, 15 aa, Mycobacterium tuberculosis
PTALASVPGSRRQWE

SEQ ID NO: 64455 - protein, 15 aa, Mycobacterium tuberculosis
TALASVPGSRRQWER

SEQ ID NO: 64456 - protein, 15 aa, Mycobacterium tuberculosis
ALASVPGSRRQWERD

SEQ ID NO: 64457 - protein, 15 aa, Mycobacterium tuberculosis
LASVPGSRRQWERDP

SEQ ID NO: 64458 - protein, 15 aa, Mycobacterium tuberculosis
ASVPGSRRQWERDPH

SEQ ID NO: 64459 - protein, 15 aa, Mycobacterium tuberculosis
SVPGSRRQWERDPHD

SEQ ID NO: 64460 - protein, 15 aa, Mycobacterium tuberculosis
VPGSRRQWERDPHDP

SEQ ID NO: 64461 - protein, 15 aa, Mycobacterium tuberculosis
PGSRRQWERDPHDPD

SEQ ID NO: 64462 - protein, 15 aa, Mycobacterium tuberculosis
GSRRQWERDPHDPDF

SEQ ID NO: 64463 - protein, 15 aa, Mycobacterium tuberculosis
SRRQWERDPHDPDFL

SEQ ID NO: 64464 - protein, 15 aa, Mycobacterium tuberculosis
RRQWERDPHDPDFLV

SEQ ID NO: 64465 - protein, 15 aa, Mycobacterium tuberculosis
RQWERDPHDPDFLVL

SEQ ID NO: 64466 - protein, 15 aa, Mycobacterium tuberculosis
QWERDPHDPDFLVLR

SEQ ID NO: 64467 - protein, 15 aa, Mycobacterium tuberculosis
WERDPHDPDFLVLRA

SEQ ID NO: 64468 - protein, 15 aa, Mycobacterium tuberculosis
ERDPHDPDFLVLRAG

SEQ ID NO: 64469 - protein, 15 aa, Mycobacterium tuberculosis
RDPHDPDFLVLRAGR

SEQ ID NO: 64470 - protein, 15 aa, Mycobacterium tuberculosis
DPHDPDFLVLRAGRH

SEQ ID NO: 64471 - protein, 15 aa, Mycobacterium tuberculosis
PHDPDFLVLRAGRHT

SEQ ID NO: 64472 - protein, 15 aa, Mycobacterium tuberculosis
HDPDFLVLRAGRHTV

SEQ ID NO: 64473 - protein, 15 aa, Mycobacterium tuberculosis
DPDFLVLRAGRHTVP

SEQ ID NO: 64474 - protein, 15 aa, Mycobacterium tuberculosis
PDFLVLRAGRHTVPL

SEQ ID NO: 64475 - protein, 15 aa, Mycobacterium tuberculosis
DFLVLRAGRHTVPLA

SEQ ID NO: 64476 - protein, 15 aa, Mycobacterium tuberculosis
FLVLRAGRHTVPLAT

SEQ ID NO: 64477 - protein, 15 aa, Mycobacterium tuberculosis
LVLRAGRHTVPLATT

SEQ ID NO: 64478 - protein, 15 aa, Mycobacterium tuberculosis
VLRAGRHTVPLATTL

SEQ ID NO: 64479 - protein, 15 aa, Mycobacterium tuberculosis
LRAGRHTVPLATTLR

SEQ ID NO: 64480 - protein, 15 aa, Mycobacterium tuberculosis
RAGRHTVPLATTLRV

SEQ ID NO: 64481 - protein, 15 aa, Mycobacterium tuberculosis
AGRHTVPLATTLRVN

SEQ ID NO: 64482 - protein, 15 aa, Mycobacterium tuberculosis
GRHTVPLATTLRVND

SEQ ID NO: 64483 - protein, 15 aa, Mycobacterium tuberculosis
RHTVPLATTLRVNDT

SEQ ID NO: 64484 - protein, 15 aa, Mycobacterium tuberculosis
HTVPLATTLRVNDTA

SEQ ID NO: 64485 - protein, 15 aa, Mycobacterium tuberculosis
TVPLATTLRVNDTAD

SEQ ID NO: 64486 - protein, 15 aa, Mycobacterium tuberculosis
VPLATTLRVNDTADE

SEQ ID NO: 64487 - protein, 15 aa, Mycobacterium tuberculosis
PLATTLRVNDTADEI

SEQ ID NO: 64488 - protein, 15 aa, Mycobacterium tuberculosis
LATTLRVNDTADEID

SEQ ID NO: 64489 - protein, 15 aa, Mycobacterium tuberculosis
ATTLRVNDTADEIDL

SEQ ID NO: 64490 - protein, 15 aa, Mycobacterium tuberculosis
TTLRVNDTADEIDLE

SEQ ID NO: 64491 - protein, 15 aa, Mycobacterium tuberculosis
TLRVNDTADEIDLEP

SEQ ID NO: 64492 - protein, 15 aa, Mycobacterium tuberculosis
LRVNDTADEIDLEPV

SEQ ID NO: 64493 - protein, 15 aa, Mycobacterium tuberculosis
RVNDTADEIDLEPVS

SEQ ID NO: 64494 - protein, 15 aa, Mycobacterium tuberculosis
VNDTADEIDLEPVSH

SEQ ID NO: 64495 - protein, 15 aa, Mycobacterium tuberculosis
NDTADEIDLEPVSHS

SEQ ID NO: 64496 - protein, 15 aa, Mycobacterium tuberculosis
DTADEIDLEPVSHSA

SEQ ID NO: 64497 - protein, 15 aa, Mycobacterium tuberculosis
TADEIDLEPVSHSAL

SEQ ID NO: 64498 - protein, 15 aa, Mycobacterium tuberculosis
ADEIDLEPVSHSALR

SEQ ID NO: 64499 - protein, 15 aa, Mycobacterium tuberculosis
DEIDLEPVSHSALRS

SEQ ID NO: 64500 - protein, 15 aa, Mycobacterium tuberculosis
EIDLEPVSHSALRSL

SEQ ID NO: 64501 - protein, 15 aa, Mycobacterium tuberculosis
IDLEPVSHSALRSLL

SEQ ID NO: 64502 - protein, 15 aa, Mycobacterium tuberculosis
DLEPVSHSALRSLLD

SEQ ID NO: 64503 - protein, 15 aa, Mycobacterium tuberculosis
LEPVSHSALRSLLDT

SEQ ID NO: 64504 - protein, 15 aa, Mycobacterium tuberculosis
EPVSHSALRSLLDTQ

SEQ ID NO: 64505 - protein, 15 aa, Mycobacterium tuberculosis
PVSHSALRSLLDTQR

SEQ ID NO: 64506 - protein, 15 aa, Mycobacterium tuberculosis
VSHSALRSLLDTQRS

SEQ ID NO: 64507 - protein, 15 aa, Mycobacterium tuberculosis
SHSALRSLLDTQRSI

SEQ ID NO: 64508 - protein, 15 aa, Mycobacterium tuberculosis
HSALRSLLDTQRSIG

SEQ ID NO: 64509 - protein, 15 aa, Mycobacterium tuberculosis
SALRSLLDTQRSIGD

SEQ ID NO: 64510 - protein, 15 aa, Mycobacterium tuberculosis
ALRSLLDTQRSIGDV

SEQ ID NO: 64511 - protein, 15 aa, Mycobacterium tuberculosis
LRSLLDTQRSIGDVP

SEQ ID NO: 64512 - protein, 15 aa, Mycobacterium tuberculosis
RSLLDTQRSIGDVPT

SEQ ID NO: 64513 - protein, 15 aa, Mycobacterium tuberculosis
SLLDTQRSIGDVPTG

SEQ ID NO: 64514 - protein, 15 aa, Mycobacterium tuberculosis
LLDTQRSIGDVPTGI

SEQ ID NO: 64515 - protein, 15 aa, Mycobacterium tuberculosis
LDTQRSIGDVPTGID

SEQ ID NO: 64516 - protein, 15 aa, Mycobacterium tuberculosis
DTQRSIGDVPTGIDL

SEQ ID NO: 64517 - protein, 15 aa, Mycobacterium tuberculosis
TQRSIGDVPTGIDLT

SEQ ID NO: 64518 - protein, 15 aa, Mycobacterium tuberculosis
QRSIGDVPTGIDLTK

SEQ ID NO: 64519 - protein, 15 aa, Mycobacterium tuberculosis
RSIGDVPTGIDLTKV

SEQ ID NO: 64520 - protein, 15 aa, Mycobacterium tuberculosis
SIGDVPTGIDLTKVS

SEQ ID NO: 64521 - protein, 15 aa, Mycobacterium tuberculosis
IGDVPTGIDLTKVSP

SEQ ID NO: 64522 - protein, 15 aa, Mycobacterium tuberculosis
GDVPTGIDLTKVSPI

SEQ ID NO: 64523 - protein, 15 aa, Mycobacterium tuberculosis
DVPTGIDLTKVSPIT

SEQ ID NO: 64524 - protein, 15 aa, Mycobacterium tuberculosis
VPTGIDLTKVSPITV

SEQ ID NO: 64525 - protein, 15 aa, Mycobacterium tuberculosis
PTGIDLTKVSPITVL

SEQ ID NO: 64526 - protein, 15 aa, Mycobacterium tuberculosis
TGIDLTKVSPITVLG

SEQ ID NO: 64527 - protein, 15 aa, Mycobacterium tuberculosis
GIDLTKVSPITVLGE

SEQ ID NO: 64528 - protein, 15 aa, Mycobacterium tuberculosis
IDLTKVSPITVLGER

SEQ ID NO: 64529 - protein, 15 aa, Mycobacterium tuberculosis
DLTKVSPITVLGERA

SEQ ID NO: 64530 - protein, 15 aa, Mycobacterium tuberculosis
LTKVSPITVLGERAQ

SEQ ID NO: 64531 - protein, 15 aa, Mycobacterium tuberculosis
TKVSPITVLGERAQV

SEQ ID NO: 64532 - protein, 15 aa, Mycobacterium tuberculosis
KVSPITVLGERAQVR

SEQ ID NO: 64533 - protein, 15 aa, Mycobacterium tuberculosis
VSPITVLGERAQVRA

SEQ ID NO: 64534 - protein, 15 aa, Mycobacterium tuberculosis
SPITVLGERAQVRAV

SEQ ID NO: 64535 - protein, 15 aa, Mycobacterium tuberculosis
PITVLGERAQVRAVL

SEQ ID NO: 64536 - protein, 15 aa, Mycobacterium tuberculosis
ITVLGERAQVRAVLR

SEQ ID NO: 64537 - protein, 15 aa, Mycobacterium tuberculosis
TVLGERAQVRAVLRA

SEQ ID NO: 64538 - protein, 15 aa, Mycobacterium tuberculosis
VLGERAQVRAVLRAW

SEQ ID NO: 64539 - protein, 15 aa, Mycobacterium tuberculosis
LGERAQVRAVLRAWI

SEQ ID NO: 64540 - protein, 15 aa, Mycobacterium tuberculosis
GERAQVRAVLRAWIA

SEQ ID NO: 64541 - protein, 15 aa, Mycobacterium tuberculosis
ERAQVRAVLRAWIAQ

SEQ ID NO: 64542 - protein, 15 aa, Mycobacterium tuberculosis
RAQVRAVLRAWIAQA

SEQ ID NO: 64543 - protein, 15 aa, Mycobacterium tuberculosis
AQVRAVLRAWIAQAV

SEQ ID NO: 64544 - protein, 15 aa, Mycobacterium tuberculosis
QVRAVLRAWIAQAVT

SEQ ID NO: 64545 - protein, 15 aa, Mycobacterium tuberculosis
VRAVLRAWIAQAVTW

SEQ ID NO: 64546 - protein, 15 aa, Mycobacterium tuberculosis
RAVLRAWIAQAVTWH

SEQ ID NO: 64547 - protein, 15 aa, Mycobacterium tuberculosis
AVLRAWIAQAVTWHD

SEQ ID NO: 64548 - protein, 15 aa, Mycobacterium tuberculosis
VLRAWIAQAVTWHDP

SEQ ID NO: 64549 - protein, 15 aa, Mycobacterium tuberculosis
LRAWIAQAVTWHDPT

SEQ ID NO: 64550 - protein, 15 aa, Mycobacterium tuberculosis
RAWIAQAVTWHDPTV

SEQ ID NO: 64551 - protein, 15 aa, Mycobacterium tuberculosis
AWIAQAVTWHDPTVL

SEQ ID NO: 64552 - protein, 15 aa, Mycobacterium tuberculosis
WIAQAVTWHDPTVLG

SEQ ID NO: 64553 - protein, 15 aa, Mycobacterium tuberculosis
IAQAVTWHDPTVLGV

SEQ ID NO: 64554 - protein, 15 aa, Mycobacterium tuberculosis
AQAVTWHDPTVLGVA

SEQ ID NO: 64555 - protein, 15 aa, Mycobacterium tuberculosis
QAVTWHDPTVLGVAL

SEQ ID NO: 64556 - protein, 15 aa, Mycobacterium tuberculosis
AVTWHDPTVLGVALA

SEQ ID NO: 64557 - protein, 15 aa, Mycobacterium tuberculosis
VTWHDPTVLGVALAA

SEQ ID NO: 64558 - protein, 15 aa, Mycobacterium tuberculosis
TWHDPTVLGVALAAR

SEQ ID NO: 64559 - protein, 15 aa, Mycobacterium tuberculosis
WHDPTVLGVALAARD

SEQ ID NO: 64560 - protein, 15 aa, Mycobacterium tuberculosis
HDPTVLGVALAARDL

SEQ ID NO: 64561 - protein, 15 aa, Mycobacterium tuberculosis
DPTVLGVALAARDLE

SEQ ID NO: 64562 - protein, 15 aa, Mycobacterium tuberculosis
PTVLGVALAARDLEG

SEQ ID NO: 64563 - protein, 15 aa, Mycobacterium tuberculosis
TVLGVALAARDLEGR

SEQ ID NO: 64564 - protein, 15 aa, Mycobacterium tuberculosis
VLGVALAARDLEGRD

SEQ ID NO: 64565 - protein, 15 aa, Mycobacterium tuberculosis
LGVALAARDLEGRDW

SEQ ID NO: 64566 - protein, 15 aa, Mycobacterium tuberculosis
GVALAARDLEGRDWN

SEQ ID NO: 64567 - protein, 15 aa, Mycobacterium tuberculosis
VALAARDLEGRDWNW

SEQ ID NO: 64568 - protein, 15 aa, Mycobacterium tuberculosis
ALAARDLEGRDWNWL

SEQ ID NO: 64569 - protein, 15 aa, Mycobacterium tuberculosis
LAARDLEGRDWNWLK

SEQ ID NO: 64570 - protein, 15 aa, Mycobacterium tuberculosis
AARDLEGRDWNWLKW

SEQ ID NO: 64571 - protein, 15 aa, Mycobacterium tuberculosis
ARDLEGRDWNWLKWL

SEQ ID NO: 64572 - protein, 15 aa, Mycobacterium tuberculosis
RDLEGRDWNWLKWLP

SEQ ID NO: 64573 - protein, 15 aa, Mycobacterium tuberculosis
DLEGRDWNWLKWLPH

SEQ ID NO: 64574 - protein, 15 aa, Mycobacterium tuberculosis
LEGRDWNWLKWLPHV

SEQ ID NO: 64575 - protein, 15 aa, Mycobacterium tuberculosis
EGRDWNWLKWLPHVD

SEQ ID NO: 64576 - protein, 15 aa, Mycobacterium tuberculosis
GRDWNWLKWLPHVDI

SEQ ID NO: 64577 - protein, 15 aa, Mycobacterium tuberculosis
RDWNWLKWLPHVDIP

SEQ ID NO: 64578 - protein, 15 aa, Mycobacterium tuberculosis
DWNWLKWLPHVDIPG

SEQ ID NO: 64579 - protein, 15 aa, Mycobacterium tuberculosis
WNWLKWLPHVDIPGR

SEQ ID NO: 64580 - protein, 15 aa, Mycobacterium tuberculosis
NWLKWLPHVDIPGRL

SEQ ID NO: 64581 - protein, 15 aa, Mycobacterium tuberculosis
WLKWLPHVDIPGRLD

SEQ ID NO: 64582 - protein, 15 aa, Mycobacterium tuberculosis
LKWLPHVDIPGRLDA

SEQ ID NO: 64583 - protein, 15 aa, Mycobacterium tuberculosis
KWLPHVDIPGRLDAL

SEQ ID NO: 64584 - protein, 15 aa, Mycobacterium tuberculosis
WLPHVDIPGRLDALG

SEQ ID NO: 64585 - protein, 15 aa, Mycobacterium tuberculosis
LPHVDIPGRLDALGP

SEQ ID NO: 64586 - protein, 15 aa, Mycobacterium tuberculosis
PHVDIPGRLDALGPA

SEQ ID NO: 64587 - protein, 15 aa, Mycobacterium tuberculosis
HVDIPGRLDALGPAR

SEQ ID NO: 64588 - protein, 15 aa, Mycobacterium tuberculosis
VDIPGRLDALGPARN

SEQ ID NO: 64589 - protein, 15 aa, Mycobacterium tuberculosis
DIPGRLDALGPARNL

SEQ ID NO: 64590 - protein, 15 aa, Mycobacterium tuberculosis
IPGRLDALGPARNLS

SEQ ID NO: 64591 - protein, 15 aa, Mycobacterium tuberculosis
PGRLDALGPARNLST

SEQ ID NO: 64592 - protein, 15 aa, Mycobacterium tuberculosis
GRLDALGPARNLSTD

SEQ ID NO: 64593 - protein, 15 aa, Mycobacterium tuberculosis
RLDALGPARNLSTDP

SEQ ID NO: 64594 - protein, 15 aa, Mycobacterium tuberculosis
LDALGPARNLSTDPD

SEQ ID NO: 64595 - protein, 15 aa, Mycobacterium tuberculosis
DALGPARNLSTDPDE

SEQ ID NO: 64596 - protein, 15 aa, Mycobacterium tuberculosis
ALGPARNLSTDPDEL

SEQ ID NO: 64597 - protein, 15 aa, Mycobacterium tuberculosis
LGPARNLSTDPDELI

SEQ ID NO: 64598 - protein, 15 aa, Mycobacterium tuberculosis
GPARNLSTDPDELIA

SEQ ID NO: 64599 - protein, 15 aa, Mycobacterium tuberculosis
PARNLSTDPDELIAL

SEQ ID NO: 64600 - protein, 15 aa, Mycobacterium tuberculosis
ARNLSTDPDELIALL

SEQ ID NO: 64601 - protein, 15 aa, Mycobacterium tuberculosis
RNLSTDPDELIALLG

SEQ ID NO: 64602 - protein, 15 aa, Mycobacterium tuberculosis
NLSTDPDELIALLGP

SEQ ID NO: 64603 - protein, 15 aa, Mycobacterium tuberculosis
LSTDPDELIALLGPV

SEQ ID NO: 64604 - protein, 15 aa, Mycobacterium tuberculosis
STDPDELIALLGPVL

SEQ ID NO: 64605 - protein, 15 aa, Mycobacterium tuberculosis
TDPDELIALLGPVLA

SEQ ID NO: 64606 - protein, 15 aa, Mycobacterium tuberculosis
DPDELIALLGPVLAD

SEQ ID NO: 64607 - protein, 15 aa, Mycobacterium tuberculosis
PDELIALLGPVLADR

SEQ ID NO: 64608 - protein, 15 aa, Mycobacterium tuberculosis
DELIALLGPVLADRP

SEQ ID NO: 64609 - protein, 15 aa, Mycobacterium tuberculosis
ELIALLGPVLADRPA

SEQ ID NO: 64610 - protein, 15 aa, Mycobacterium tuberculosis
LIALLGPVLADRPAF

SEQ ID NO: 64611 - protein, 15 aa, Mycobacterium tuberculosis
IALLGPVLADRPAFT

SEQ ID NO: 64612 - protein, 15 aa, Mycobacterium tuberculosis
ALLGPVLADRPAFTG

SEQ ID NO: 64613 - protein, 15 aa, Mycobacterium tuberculosis
LLGPVLADRPAFTGQ

SEQ ID NO: 64614 - protein, 15 aa, Mycobacterium tuberculosis
LGPVLADRPAFTGQP

SEQ ID NO: 64615 - protein, 15 aa, Mycobacterium tuberculosis
GPVLADRPAFTGQPT

SEQ ID NO: 64616 - protein, 15 aa, Mycobacterium tuberculosis
PVLADRPAFTGQPTD

SEQ ID NO: 64617 - protein, 15 aa, Mycobacterium tuberculosis
VLADRPAFTGQPTDA

SEQ ID NO: 64618 - protein, 15 aa, Mycobacterium tuberculosis
LADRPAFTGQPTDAL

SEQ ID NO: 64619 - protein, 15 aa, Mycobacterium tuberculosis
ADRPAFTGQPTDALR

SEQ ID NO: 64620 - protein, 15 aa, Mycobacterium tuberculosis
DRPAFTGQPTDALRH

SEQ ID NO: 64621 - protein, 15 aa, Mycobacterium tuberculosis
RPAFTGQPTDALRHL

SEQ ID NO: 64622 - protein, 15 aa, Mycobacterium tuberculosis
PAFTGQPTDALRHLL

SEQ ID NO: 64623 - protein, 15 aa, Mycobacterium tuberculosis
AFTGQPTDALRHLLI

SEQ ID NO: 64624 - protein, 15 aa, Mycobacterium tuberculosis
FTGQPTDALRHLLIV

SEQ ID NO: 64625 - protein, 15 aa, Mycobacterium tuberculosis
TGQPTDALRHLLIVV

SEQ ID NO: 64626 - protein, 15 aa, Mycobacterium tuberculosis
GQPTDALRHLLIVVD

SEQ ID NO: 64627 - protein, 15 aa, Mycobacterium tuberculosis
QPTDALRHLLIVVDD

SEQ ID NO: 64628 - protein, 15 aa, Mycobacterium tuberculosis
PTDALRHLLIVVDDP

SEQ ID NO: 64629 - protein, 15 aa, Mycobacterium tuberculosis
TDALRHLLIVVDDPD

SEQ ID NO: 64630 - protein, 15 aa, Mycobacterium tuberculosis
DALRHLLIVVDDPDY

SEQ ID NO: 64631 - protein, 15 aa, Mycobacterium tuberculosis
ALRHLLIVVDDPDYD

SEQ ID NO: 64632 - protein, 15 aa, Mycobacterium tuberculosis
LRHLLIVVDDPDYDL

SEQ ID NO: 64633 - protein, 15 aa, Mycobacterium tuberculosis
RHLLIVVDDPDYDLG

SEQ ID NO: 64634 - protein, 15 aa, Mycobacterium tuberculosis
HLLIVVDDPDYDLGA

SEQ ID NO: 64635 - protein, 15 aa, Mycobacterium tuberculosis
LLIVVDDPDYDLGAS

SEQ ID NO: 64636 - protein, 15 aa, Mycobacterium tuberculosis
LIVVDDPDYDLGASP

SEQ ID NO: 64637 - protein, 15 aa, Mycobacterium tuberculosis
IVVDDPDYDLGASPL

SEQ ID NO: 64638 - protein, 15 aa, Mycobacterium tuberculosis
VVDDPDYDLGASPLA

SEQ ID NO: 64639 - protein, 15 aa, Mycobacterium tuberculosis
VDDPDYDLGASPLAV

SEQ ID NO: 64640 - protein, 15 aa, Mycobacterium tuberculosis
DDPDYDLGASPLAVG

SEQ ID NO: 64641 - protein, 15 aa, Mycobacterium tuberculosis
DPDYDLGASPLAVGR

SEQ ID NO: 64642 - protein, 15 aa, Mycobacterium tuberculosis
PDYDLGASPLAVGRA

SEQ ID NO: 64643 - protein, 15 aa, Mycobacterium tuberculosis
DYDLGASPLAVGRAG

SEQ ID NO: 64644 - protein, 15 aa, Mycobacterium tuberculosis
YDLGASPLAVGRAGV

SEQ ID NO: 64645 - protein, 15 aa, Mycobacterium tuberculosis
DLGASPLAVGRAGVT

SEQ ID NO: 64646 - protein, 15 aa, Mycobacterium tuberculosis
LGASPLAVGRAGVTV

SEQ ID NO: 64647 - protein, 15 aa, Mycobacterium tuberculosis
GASPLAVGRAGVTVV

SEQ ID NO: 64648 - protein, 15 aa, Mycobacterium tuberculosis
ASPLAVGRAGVTVVH

SEQ ID NO: 64649 - protein, 15 aa, Mycobacterium tuberculosis
SPLAVGRAGVTVVHC

SEQ ID NO: 64650 - protein, 15 aa, Mycobacterium tuberculosis
PLAVGRAGVTVVHCS

SEQ ID NO: 64651 - protein, 15 aa, Mycobacterium tuberculosis
LAVGRAGVTVVHCSA

SEQ ID NO: 64652 - protein, 15 aa, Mycobacterium tuberculosis
AVGRAGVTVVHCSAS

SEQ ID NO: 64653 - protein, 15 aa, Mycobacterium tuberculosis
VGRAGVTVVHCSASA

SEQ ID NO: 64654 - protein, 15 aa, Mycobacterium tuberculosis
GRAGVTVVHCSASAP

SEQ ID NO: 64655 - protein, 15 aa, Mycobacterium tuberculosis
RAGVTVVHCSASAPH

SEQ ID NO: 64656 - protein, 15 aa, Mycobacterium tuberculosis
AGVTVVHCSASAPHR

SEQ ID NO: 64657 - protein, 15 aa, Mycobacterium tuberculosis
GVTVVHCSASAPHRE

SEQ ID NO: 64658 - protein, 15 aa, Mycobacterium tuberculosis
VTVVHCSASAPHREQ

SEQ ID NO: 64659 - protein, 15 aa, Mycobacterium tuberculosis
TVVHCSASAPHREQY

SEQ ID NO: 64660 - protein, 15 aa, Mycobacterium tuberculosis
VVHCSASAPHREQYS

SEQ ID NO: 64661 - protein, 15 aa, Mycobacterium tuberculosis
VHCSASAPHREQYSD

SEQ ID NO: 64662 - protein, 15 aa, Mycobacterium tuberculosis
HCSASAPHREQYSDP

SEQ ID NO: 64663 - protein, 15 aa, Mycobacterium tuberculosis
CSASAPHREQYSDPE

SEQ ID NO: 64664 - protein, 15 aa, Mycobacterium tuberculosis
SASAPHREQYSDPEK

SEQ ID NO: 64665 - protein, 15 aa, Mycobacterium tuberculosis
ASAPHREQYSDPEKP

SEQ ID NO: 64666 - protein, 15 aa, Mycobacterium tuberculosis
SAPHREQYSDPEKPI

SEQ ID NO: 64667 - protein, 15 aa, Mycobacterium tuberculosis
APHREQYSDPEKPIL

SEQ ID NO: 64668 - protein, 15 aa, Mycobacterium tuberculosis
PHREQYSDPEKPILR

SEQ ID NO: 64669 - protein, 15 aa, Mycobacterium tuberculosis
HREQYSDPEKPILRV

SEQ ID NO: 64670 - protein, 15 aa, Mycobacterium tuberculosis
REQYSDPEKPILRVA

SEQ ID NO: 64671 - protein, 15 aa, Mycobacterium tuberculosis
EQYSDPEKPILRVAH

SEQ ID NO: 64672 - protein, 15 aa, Mycobacterium tuberculosis
QYSDPEKPILRVAHG

SEQ ID NO: 64673 - protein, 15 aa, Mycobacterium tuberculosis
YSDPEKPILRVAHGA

SEQ ID NO: 64674 - protein, 15 aa, Mycobacterium tuberculosis
SDPEKPILRVAHGAI

SEQ ID NO: 64675 - protein, 15 aa, Mycobacterium tuberculosis
DPEKPILRVAHGAIE

SEQ ID NO: 64676 - protein, 15 aa, Mycobacterium tuberculosis
PEKPILRVAHGAIER

SEQ ID NO: 64677 - protein, 15 aa, Mycobacterium tuberculosis
EKPILRVAHGAIERW

SEQ ID NO: 64678 - protein, 15 aa, Mycobacterium tuberculosis
KPILRVAHGAIERWQ

SEQ ID NO: 64679 - protein, 15 aa, Mycobacterium tuberculosis
PILRVAHGAIERWQT

SEQ ID NO: 64680 - protein, 15 aa, Mycobacterium tuberculosis
ILRVAHGAIERWQTG

SEQ ID NO: 64681 - protein, 15 aa, Mycobacterium tuberculosis
LRVAHGAIERWQTGG

SEQ ID NO: 64682 - protein, 15 aa, Mycobacterium tuberculosis
RVAHGAIERWQTGGW

SEQ ID NO: 64683 - protein, 15 aa, Mycobacterium tuberculosis
VAHGAIERWQTGGWQ

SEQ ID NO: 64684 - protein, 15 aa, Mycobacterium tuberculosis
AHGAIERWQTGGWQP

SEQ ID NO: 64685 - protein, 15 aa, Mycobacterium tuberculosis
HGAIERWQTGGWQPY

SEQ ID NO: 64686 - protein, 15 aa, Mycobacterium tuberculosis
GAIERWQTGGWQPYI

SEQ ID NO: 64687 - protein, 15 aa, Mycobacterium tuberculosis
AIERWQTGGWQPYID

SEQ ID NO: 64688 - protein, 15 aa, Mycobacterium tuberculosis
IERWQTGGWQPYIDA

SEQ ID NO: 64689 - protein, 15 aa, Mycobacterium tuberculosis
ERWQTGGWQPYIDAA

SEQ ID NO: 64690 - protein, 15 aa, Mycobacterium tuberculosis
RWQTGGWQPYIDAAD

SEQ ID NO: 64691 - protein, 15 aa, Mycobacterium tuberculosis
WQTGGWQPYIDAADQ

SEQ ID NO: 64692 - protein, 15 aa, Mycobacterium tuberculosis
QTGGWQPYIDAADQF

SEQ ID NO: 64693 - protein, 15 aa, Mycobacterium tuberculosis
TGGWQPYIDAADQFS

SEQ ID NO: 64694 - protein, 15 aa, Mycobacterium tuberculosis
GGWQPYIDAADQFSA

SEQ ID NO: 64695 - protein, 15 aa, Mycobacterium tuberculosis
GWQPYIDAADQFSAD

SEQ ID NO: 64696 - protein, 15 aa, Mycobacterium tuberculosis
WQPYIDAADQFSADE

SEQ ID NO: 64697 - protein, 15 aa, Mycobacterium tuberculosis
QPYIDAADQFSADEA

SEQ ID NO: 64698 - protein, 15 aa, Mycobacterium tuberculosis
PYIDAADQFSADEAA

SEQ ID NO: 64699 - protein, 15 aa, Mycobacterium tuberculosis
YIDAADQFSADEAAH

SEQ ID NO: 64700 - protein, 15 aa, Mycobacterium tuberculosis
IDAADQFSADEAAHL

SEQ ID NO: 64701 - protein, 15 aa, Mycobacterium tuberculosis
DAADQFSADEAAHLA

SEQ ID NO: 64702 - protein, 15 aa, Mycobacterium tuberculosis
AADQFSADEAAHLAR

SEQ ID NO: 64703 - protein, 15 aa, Mycobacterium tuberculosis
ADQFSADEAAHLARR

SEQ ID NO: 64704 - protein, 15 aa, Mycobacterium tuberculosis
DQFSADEAAHLARRL

SEQ ID NO: 64705 - protein, 15 aa, Mycobacterium tuberculosis
QFSADEAAHLARRLS

SEQ ID NO: 64706 - protein, 15 aa, Mycobacterium tuberculosis
FSADEAAHLARRLSR

SEQ ID NO: 64707 - protein, 15 aa, Mycobacterium tuberculosis
SADEAAHLARRLSRW

SEQ ID NO: 64708 - protein, 15 aa, Mycobacterium tuberculosis
ADEAAHLARRLSRWD

SEQ ID NO: 64709 - protein, 15 aa, Mycobacterium tuberculosis
DEAAHLARRLSRWDS

SEQ ID NO: 64710 - protein, 15 aa, Mycobacterium tuberculosis
EAAHLARRLSRWDSN

SEQ ID NO: 64711 - protein, 15 aa, Mycobacterium tuberculosis
AAHLARRLSRWDSNP

SEQ ID NO: 64712 - protein, 15 aa, Mycobacterium tuberculosis
AHLARRLSRWDSNPT

SEQ ID NO: 64713 - protein, 15 aa, Mycobacterium tuberculosis
HLARRLSRWDSNPTH

SEQ ID NO: 64714 - protein, 15 aa, Mycobacterium tuberculosis
LARRLSRWDSNPTHA

SEQ ID NO: 64715 - protein, 15 aa, Mycobacterium tuberculosis
ARRLSRWDSNPTHAG

SEQ ID NO: 64716 - protein, 15 aa, Mycobacterium tuberculosis
RRLSRWDSNPTHAGL

SEQ ID NO: 64717 - protein, 15 aa, Mycobacterium tuberculosis
RLSRWDSNPTHAGLR

SEQ ID NO: 64718 - protein, 15 aa, Mycobacterium tuberculosis
LSRWDSNPTHAGLRS

SEQ ID NO: 64719 - protein, 15 aa, Mycobacterium tuberculosis
SRWDSNPTHAGLRSA

SEQ ID NO: 64720 - protein, 15 aa, Mycobacterium tuberculosis
RWDSNPTHAGLRSAA

SEQ ID NO: 64721 - protein, 15 aa, Mycobacterium tuberculosis
WDSNPTHAGLRSAAT

SEQ ID NO: 64722 - protein, 15 aa, Mycobacterium tuberculosis
DSNPTHAGLRSAATR

SEQ ID NO: 64723 - protein, 15 aa, Mycobacterium tuberculosis
SNPTHAGLRSAATRG

SEQ ID NO: 64724 - protein, 15 aa, Mycobacterium tuberculosis
NPTHAGLRSAATRGA

SEQ ID NO: 64725 - protein, 15 aa, Mycobacterium tuberculosis
PTHAGLRSAATRGAS

SEQ ID NO: 64726 - protein, 15 aa, Mycobacterium tuberculosis
THAGLRSAATRGASF

SEQ ID NO: 64727 - protein, 15 aa, Mycobacterium tuberculosis
HAGLRSAATRGASFT

SEQ ID NO: 64728 - protein, 15 aa, Mycobacterium tuberculosis
AGLRSAATRGASFTT

SEQ ID NO: 64729 - protein, 15 aa, Mycobacterium tuberculosis
GLRSAATRGASFTTL

SEQ ID NO: 64730 - protein, 15 aa, Mycobacterium tuberculosis
LRSAATRGASFTTLL

SEQ ID NO: 64731 - protein, 15 aa, Mycobacterium tuberculosis
RSAATRGASFTTLLG

SEQ ID NO: 64732 - protein, 15 aa, Mycobacterium tuberculosis
SAATRGASFTTLLGI

SEQ ID NO: 64733 - protein, 15 aa, Mycobacterium tuberculosis
AATRGASFTTLLGIE

SEQ ID NO: 64734 - protein, 15 aa, Mycobacterium tuberculosis
ATRGASFTTLLGIED

SEQ ID NO: 64735 - protein, 15 aa, Mycobacterium tuberculosis
TRGASFTTLLGIEDA

SEQ ID NO: 64736 - protein, 15 aa, Mycobacterium tuberculosis
RGASFTTLLGIEDAS

SEQ ID NO: 64737 - protein, 15 aa, Mycobacterium tuberculosis
GASFTTLLGIEDASR

SEQ ID NO: 64738 - protein, 15 aa, Mycobacterium tuberculosis
ASFTTLLGIEDASRL

SEQ ID NO: 64739 - protein, 15 aa, Mycobacterium tuberculosis
SFTTLLGIEDASRLD

SEQ ID NO: 64740 - protein, 15 aa, Mycobacterium tuberculosis
FTTLLGIEDASRLDV

SEQ ID NO: 64741 - protein, 15 aa, Mycobacterium tuberculosis
TTLLGIEDASRLDVP

SEQ ID NO: 64742 - protein, 15 aa, Mycobacterium tuberculosis
TLLGIEDASRLDVPA

SEQ ID NO: 64743 - protein, 15 aa, Mycobacterium tuberculosis
LLGIEDASRLDVPAL

SEQ ID NO: 64744 - protein, 15 aa, Mycobacterium tuberculosis
LGIEDASRLDVPALW

SEQ ID NO: 64745 - protein, 15 aa, Mycobacterium tuberculosis
GIEDASRLDVPALWA

SEQ ID NO: 64746 - protein, 15 aa, Mycobacterium tuberculosis
IEDASRLDVPALWAP

SEQ ID NO: 64747 - protein, 15 aa, Mycobacterium tuberculosis
EDASRLDVPALWAPR

SEQ ID NO: 64748 - protein, 15 aa, Mycobacterium tuberculosis
DASRLDVPALWAPRR

SEQ ID NO: 64749 - protein, 15 aa, Mycobacterium tuberculosis
ASRLDVPALWAPRRR

SEQ ID NO: 64750 - protein, 15 aa, Mycobacterium tuberculosis
SRLDVPALWAPRRRD

SEQ ID NO: 64751 - protein, 15 aa, Mycobacterium tuberculosis
RLDVPALWAPRRRDE

SEQ ID NO: 64752 - protein, 15 aa, Mycobacterium tuberculosis
LDVPALWAPRRRDEE

SEQ ID NO: 64753 - protein, 15 aa, Mycobacterium tuberculosis
DVPALWAPRRRDEEL

SEQ ID NO: 64754 - protein, 15 aa, Mycobacterium tuberculosis
VPALWAPRRRDEELR

SEQ ID NO: 64755 - protein, 15 aa, Mycobacterium tuberculosis
PALWAPRRRDEELRV

SEQ ID NO: 64756 - protein, 15 aa, Mycobacterium tuberculosis
ALWAPRRRDEELRVP

SEQ ID NO: 64757 - protein, 15 aa, Mycobacterium tuberculosis
LWAPRRRDEELRVPI

SEQ ID NO: 64758 - protein, 15 aa, Mycobacterium tuberculosis
WAPRRRDEELRVPIG

SEQ ID NO: 64759 - protein, 15 aa, Mycobacterium tuberculosis
APRRRDEELRVPIGV

SEQ ID NO: 64760 - protein, 15 aa, Mycobacterium tuberculosis
PRRRDEELRVPIGVT

SEQ ID NO: 64761 - protein, 15 aa, Mycobacterium tuberculosis
RRRDEELRVPIGVTG

SEQ ID NO: 64762 - protein, 15 aa, Mycobacterium tuberculosis
RRDEELRVPIGVTGT

SEQ ID NO: 64763 - protein, 15 aa, Mycobacterium tuberculosis
RDEELRVPIGVTGTG

SEQ ID NO: 64764 - protein, 15 aa, Mycobacterium tuberculosis
DEELRVPIGVTGTGE

SEQ ID NO: 64765 - protein, 15 aa, Mycobacterium tuberculosis
EELRVPIGVTGTGEP

SEQ ID NO: 64766 - protein, 15 aa, Mycobacterium tuberculosis
ELRVPIGVTGTGEPL

SEQ ID NO: 64767 - protein, 15 aa, Mycobacterium tuberculosis
LRVPIGVTGTGEPLM

SEQ ID NO: 64768 - protein, 15 aa, Mycobacterium tuberculosis
RVPIGVTGTGEPLMF

SEQ ID NO: 64769 - protein, 15 aa, Mycobacterium tuberculosis
VPIGVTGTGEPLMFD

SEQ ID NO: 64770 - protein, 15 aa, Mycobacterium tuberculosis
PIGVTGTGEPLMFDL

SEQ ID NO: 64771 - protein, 15 aa, Mycobacterium tuberculosis
IGVTGTGEPLMFDLK

SEQ ID NO: 64772 - protein, 15 aa, Mycobacterium tuberculosis
GVTGTGEPLMFDLKD

SEQ ID NO: 64773 - protein, 15 aa, Mycobacterium tuberculosis
VTGTGEPLMFDLKDE

SEQ ID NO: 64774 - protein, 15 aa, Mycobacterium tuberculosis
TGTGEPLMFDLKDEA

SEQ ID NO: 64775 - protein, 15 aa, Mycobacterium tuberculosis
GTGEPLMFDLKDEAE

SEQ ID NO: 64776 - protein, 15 aa, Mycobacterium tuberculosis
TGEPLMFDLKDEAEG

SEQ ID NO: 64777 - protein, 15 aa, Mycobacterium tuberculosis
GEPLMFDLKDEAEGG

SEQ ID NO: 64778 - protein, 15 aa, Mycobacterium tuberculosis
EPLMFDLKDEAEGGM

SEQ ID NO: 64779 - protein, 15 aa, Mycobacterium tuberculosis
PLMFDLKDEAEGGMG

SEQ ID NO: 64780 - protein, 15 aa, Mycobacterium tuberculosis
LMFDLKDEAEGGMGP

SEQ ID NO: 64781 - protein, 15 aa, Mycobacterium tuberculosis
MFDLKDEAEGGMGPH

SEQ ID NO: 64782 - protein, 15 aa, Mycobacterium tuberculosis
FDLKDEAEGGMGPHG

SEQ ID NO: 64783 - protein, 15 aa, Mycobacterium tuberculosis
DLKDEAEGGMGPHGL

SEQ ID NO: 64784 - protein, 15 aa, Mycobacterium tuberculosis
LKDEAEGGMGPHGLM

SEQ ID NO: 64785 - protein, 15 aa, Mycobacterium tuberculosis
KDEAEGGMGPHGLMI

SEQ ID NO: 64786 - protein, 15 aa, Mycobacterium tuberculosis
DEAEGGMGPHGLMIG

SEQ ID NO: 64787 - protein, 15 aa, Mycobacterium tuberculosis
EAEGGMGPHGLMIGM

SEQ ID NO: 64788 - protein, 15 aa, Mycobacterium tuberculosis
AEGGMGPHGLMIGMT

SEQ ID NO: 64789 - protein, 15 aa, Mycobacterium tuberculosis
EGGMGPHGLMIGMTG

SEQ ID NO: 64790 - protein, 15 aa, Mycobacterium tuberculosis
GGMGPHGLMIGMTGS

SEQ ID NO: 64791 - protein, 15 aa, Mycobacterium tuberculosis
GMGPHGLMIGMTGSG

SEQ ID NO: 64792 - protein, 15 aa, Mycobacterium tuberculosis
MGPHGLMIGMTGSGK

SEQ ID NO: 64793 - protein, 15 aa, Mycobacterium tuberculosis
GPHGLMIGMTGSGKS

SEQ ID NO: 64794 - protein, 15 aa, Mycobacterium tuberculosis
PHGLMIGMTGSGKSQ

SEQ ID NO: 64795 - protein, 15 aa, Mycobacterium tuberculosis
HGLMIGMTGSGKSQT

SEQ ID NO: 64796 - protein, 15 aa, Mycobacterium tuberculosis
GLMIGMTGSGKSQTL

SEQ ID NO: 64797 - protein, 15 aa, Mycobacterium tuberculosis
LMIGMTGSGKSQTLM

SEQ ID NO: 64798 - protein, 15 aa, Mycobacterium tuberculosis
MIGMTGSGKSQTLMS

SEQ ID NO: 64799 - protein, 15 aa, Mycobacterium tuberculosis
IGMTGSGKSQTLMSI

SEQ ID NO: 64800 - protein, 15 aa, Mycobacterium tuberculosis
GMTGSGKSQTLMSIL

SEQ ID NO: 64801 - protein, 15 aa, Mycobacterium tuberculosis
MTGSGKSQTLMSILL

SEQ ID NO: 64802 - protein, 15 aa, Mycobacterium tuberculosis
TGSGKSQTLMSILLS

SEQ ID NO: 64803 - protein, 15 aa, Mycobacterium tuberculosis
GSGKSQTLMSILLSL

SEQ ID NO: 64804 - protein, 15 aa, Mycobacterium tuberculosis
SGKSQTLMSILLSLL

SEQ ID NO: 64805 - protein, 15 aa, Mycobacterium tuberculosis
GKSQTLMSILLSLLT

SEQ ID NO: 64806 - protein, 15 aa, Mycobacterium tuberculosis
KSQTLMSILLSLLTT

SEQ ID NO: 64807 - protein, 15 aa, Mycobacterium tuberculosis
SQTLMSILLSLLTTH

SEQ ID NO: 64808 - protein, 15 aa, Mycobacterium tuberculosis
QTLMSILLSLLTTHS

SEQ ID NO: 64809 - protein, 15 aa, Mycobacterium tuberculosis
TLMSILLSLLTTHSA

SEQ ID NO: 64810 - protein, 15 aa, Mycobacterium tuberculosis
LMSILLSLLTTHSAE

SEQ ID NO: 64811 - protein, 15 aa, Mycobacterium tuberculosis
MSILLSLLTTHSAER

SEQ ID NO: 64812 - protein, 15 aa, Mycobacterium tuberculosis
SILLSLLTTHSAERL

SEQ ID NO: 64813 - protein, 15 aa, Mycobacterium tuberculosis
ILLSLLTTHSAERLI

SEQ ID NO: 64814 - protein, 15 aa, Mycobacterium tuberculosis
LLSLLTTHSAERLIV

SEQ ID NO: 64815 - protein, 15 aa, Mycobacterium tuberculosis
LSLLTTHSAERLIVI

SEQ ID NO: 64816 - protein, 15 aa, Mycobacterium tuberculosis
SLLTTHSAERLIVIY

SEQ ID NO: 64817 - protein, 15 aa, Mycobacterium tuberculosis
LLTTHSAERLIVIYA

SEQ ID NO: 64818 - protein, 15 aa, Mycobacterium tuberculosis
LTTHSAERLIVIYAD

SEQ ID NO: 64819 - protein, 15 aa, Mycobacterium tuberculosis
TTHSAERLIVIYADF

SEQ ID NO: 64820 - protein, 15 aa, Mycobacterium tuberculosis
THSAERLIVIYADFK

SEQ ID NO: 64821 - protein, 15 aa, Mycobacterium tuberculosis
HSAERLIVIYADFKG

SEQ ID NO: 64822 - protein, 15 aa, Mycobacterium tuberculosis
SAERLIVIYADFKGE

SEQ ID NO: 64823 - protein, 15 aa, Mycobacterium tuberculosis
AERLIVIYADFKGEA

SEQ ID NO: 64824 - protein, 15 aa, Mycobacterium tuberculosis
ERLIVIYADFKGEAG

SEQ ID NO: 64825 - protein, 15 aa, Mycobacterium tuberculosis
RLIVIYADFKGEAGA

SEQ ID NO: 64826 - protein, 15 aa, Mycobacterium tuberculosis
LIVIYADFKGEAGAD

SEQ ID NO: 64827 - protein, 15 aa, Mycobacterium tuberculosis
IVIYADFKGEAGADS

SEQ ID NO: 64828 - protein, 15 aa, Mycobacterium tuberculosis
VIYADFKGEAGADSF

SEQ ID NO: 64829 - protein, 15 aa, Mycobacterium tuberculosis
IYADFKGEAGADSFR

SEQ ID NO: 64830 - protein, 15 aa, Mycobacterium tuberculosis
YADFKGEAGADSFRD

SEQ ID NO: 64831 - protein, 15 aa, Mycobacterium tuberculosis
ADFKGEAGADSFRDF

SEQ ID NO: 64832 - protein, 15 aa, Mycobacterium tuberculosis
DFKGEAGADSFRDFP

SEQ ID NO: 64833 - protein, 15 aa, Mycobacterium tuberculosis
FKGEAGADSFRDFPQ

SEQ ID NO: 64834 - protein, 15 aa, Mycobacterium tuberculosis
KGEAGADSFRDFPQV

SEQ ID NO: 64835 - protein, 15 aa, Mycobacterium tuberculosis
GEAGADSFRDFPQVV

SEQ ID NO: 64836 - protein, 15 aa, Mycobacterium tuberculosis
EAGADSFRDFPQVVA

SEQ ID NO: 64837 - protein, 15 aa, Mycobacterium tuberculosis
AGADSFRDFPQVVAV

SEQ ID NO: 64838 - protein, 15 aa, Mycobacterium tuberculosis
GADSFRDFPQVVAVI

SEQ ID NO: 64839 - protein, 15 aa, Mycobacterium tuberculosis
ADSFRDFPQVVAVIS

SEQ ID NO: 64840 - protein, 15 aa, Mycobacterium tuberculosis
DSFRDFPQVVAVISN

SEQ ID NO: 64841 - protein, 15 aa, Mycobacterium tuberculosis
SFRDFPQVVAVISNM

SEQ ID NO: 64842 - protein, 15 aa, Mycobacterium tuberculosis
FRDFPQVVAVISNMA

SEQ ID NO: 64843 - protein, 15 aa, Mycobacterium tuberculosis
RDFPQVVAVISNMAE

SEQ ID NO: 64844 - protein, 15 aa, Mycobacterium tuberculosis
DFPQVVAVISNMAEK

SEQ ID NO: 64845 - protein, 15 aa, Mycobacterium tuberculosis
FPQVVAVISNMAEKK

SEQ ID NO: 64846 - protein, 15 aa, Mycobacterium tuberculosis
PQVVAVISNMAEKKS

SEQ ID NO: 64847 - protein, 15 aa, Mycobacterium tuberculosis
QVVAVISNMAEKKSL

SEQ ID NO: 64848 - protein, 15 aa, Mycobacterium tuberculosis
VVAVISNMAEKKSLA

SEQ ID NO: 64849 - protein, 15 aa, Mycobacterium tuberculosis
VAVISNMAEKKSLAD

SEQ ID NO: 64850 - protein, 15 aa, Mycobacterium tuberculosis
AVISNMAEKKSLADR

SEQ ID NO: 64851 - protein, 15 aa, Mycobacterium tuberculosis
VISNMAEKKSLADRF

SEQ ID NO: 64852 - protein, 15 aa, Mycobacterium tuberculosis
ISNMAEKKSLADRFA

SEQ ID NO: 64853 - protein, 15 aa, Mycobacterium tuberculosis
SNMAEKKSLADRFAD

SEQ ID NO: 64854 - protein, 15 aa, Mycobacterium tuberculosis
NMAEKKSLADRFADT

SEQ ID NO: 64855 - protein, 15 aa, Mycobacterium tuberculosis
MAEKKSLADRFADTL

SEQ ID NO: 64856 - protein, 15 aa, Mycobacterium tuberculosis
AEKKSLADRFADTLR

SEQ ID NO: 64857 - protein, 15 aa, Mycobacterium tuberculosis
EKKSLADRFADTLRG

SEQ ID NO: 64858 - protein, 15 aa, Mycobacterium tuberculosis
KKSLADRFADTLRGE

SEQ ID NO: 64859 - protein, 15 aa, Mycobacterium tuberculosis
KSLADRFADTLRGEV

SEQ ID NO: 64860 - protein, 15 aa, Mycobacterium tuberculosis
SLADRFADTLRGEVA

SEQ ID NO: 64861 - protein, 15 aa, Mycobacterium tuberculosis
LADRFADTLRGEVAR

SEQ ID NO: 64862 - protein, 15 aa, Mycobacterium tuberculosis
ADRFADTLRGEVARR

SEQ ID NO: 64863 - protein, 15 aa, Mycobacterium tuberculosis
DRFADTLRGEVARRE

SEQ ID NO: 64864 - protein, 15 aa, Mycobacterium tuberculosis
RFADTLRGEVARREM

SEQ ID NO: 64865 - protein, 15 aa, Mycobacterium tuberculosis
FADTLRGEVARREML

SEQ ID NO: 64866 - protein, 15 aa, Mycobacterium tuberculosis
ADTLRGEVARREMLL

SEQ ID NO: 64867 - protein, 15 aa, Mycobacterium tuberculosis
DTLRGEVARREMLLR

SEQ ID NO: 64868 - protein, 15 aa, Mycobacterium tuberculosis
TLRGEVARREMLLRE

SEQ ID NO: 64869 - protein, 15 aa, Mycobacterium tuberculosis
LRGEVARREMLLREA

SEQ ID NO: 64870 - protein, 15 aa, Mycobacterium tuberculosis
RGEVARREMLLREAG

SEQ ID NO: 64871 - protein, 15 aa, Mycobacterium tuberculosis
GEVARREMLLREAGR

SEQ ID NO: 64872 - protein, 15 aa, Mycobacterium tuberculosis
EVARREMLLREAGRK

SEQ ID NO: 64873 - protein, 15 aa, Mycobacterium tuberculosis
VARREMLLREAGRKV

SEQ ID NO: 64874 - protein, 15 aa, Mycobacterium tuberculosis
ARREMLLREAGRKVQ

SEQ ID NO: 64875 - protein, 15 aa, Mycobacterium tuberculosis
RREMLLREAGRKVQG

SEQ ID NO: 64876 - protein, 15 aa, Mycobacterium tuberculosis
REMLLREAGRKVQGS

SEQ ID NO: 64877 - protein, 15 aa, Mycobacterium tuberculosis
EMLLREAGRKVQGSA

SEQ ID NO: 64878 - protein, 15 aa, Mycobacterium tuberculosis
MLLREAGRKVQGSAF

SEQ ID NO: 64879 - protein, 15 aa, Mycobacterium tuberculosis
LLREAGRKVQGSAFN

SEQ ID NO: 64880 - protein, 15 aa, Mycobacterium tuberculosis
LREAGRKVQGSAFNS

SEQ ID NO: 64881 - protein, 15 aa, Mycobacterium tuberculosis
REAGRKVQGSAFNSV

SEQ ID NO: 64882 - protein, 15 aa, Mycobacterium tuberculosis
EAGRKVQGSAFNSVL

SEQ ID NO: 64883 - protein, 15 aa, Mycobacterium tuberculosis
AGRKVQGSAFNSVLE

SEQ ID NO: 64884 - protein, 15 aa, Mycobacterium tuberculosis
GRKVQGSAFNSVLEY

SEQ ID NO: 64885 - protein, 15 aa, Mycobacterium tuberculosis
RKVQGSAFNSVLEYE

SEQ ID NO: 64886 - protein, 15 aa, Mycobacterium tuberculosis
KVQGSAFNSVLEYEN

SEQ ID NO: 64887 - protein, 15 aa, Mycobacterium tuberculosis
VQGSAFNSVLEYENA

SEQ ID NO: 64888 - protein, 15 aa, Mycobacterium tuberculosis
QGSAFNSVLEYENAI

SEQ ID NO: 64889 - protein, 15 aa, Mycobacterium tuberculosis
GSAFNSVLEYENAIA

SEQ ID NO: 64890 - protein, 15 aa, Mycobacterium tuberculosis
SAFNSVLEYENAIAA

SEQ ID NO: 64891 - protein, 15 aa, Mycobacterium tuberculosis
AFNSVLEYENAIAAG

SEQ ID NO: 64892 - protein, 15 aa, Mycobacterium tuberculosis
FNSVLEYENAIAAGH

SEQ ID NO: 64893 - protein, 15 aa, Mycobacterium tuberculosis
NSVLEYENAIAAGHS

SEQ ID NO: 64894 - protein, 15 aa, Mycobacterium tuberculosis
SVLEYENAIAAGHSL

SEQ ID NO: 64895 - protein, 15 aa, Mycobacterium tuberculosis
VLEYENAIAAGHSLP

SEQ ID NO: 64896 - protein, 15 aa, Mycobacterium tuberculosis
LEYENAIAAGHSLPP

SEQ ID NO: 64897 - protein, 15 aa, Mycobacterium tuberculosis
EYENAIAAGHSLPPI

SEQ ID NO: 64898 - protein, 15 aa, Mycobacterium tuberculosis
YENAIAAGHSLPPIP

SEQ ID NO: 64899 - protein, 15 aa, Mycobacterium tuberculosis
ENAIAAGHSLPPIPT

SEQ ID NO: 64900 - protein, 15 aa, Mycobacterium tuberculosis
NAIAAGHSLPPIPTL

SEQ ID NO: 64901 - protein, 15 aa, Mycobacterium tuberculosis
AIAAGHSLPPIPTLF

SEQ ID NO: 64902 - protein, 15 aa, Mycobacterium tuberculosis
IAAGHSLPPIPTLFV

SEQ ID NO: 64903 - protein, 15 aa, Mycobacterium tuberculosis
AAGHSLPPIPTLFVV

SEQ ID NO: 64904 - protein, 15 aa, Mycobacterium tuberculosis
AGHSLPPIPTLFVVA

SEQ ID NO: 64905 - protein, 15 aa, Mycobacterium tuberculosis
GHSLPPIPTLFVVAD

SEQ ID NO: 64906 - protein, 15 aa, Mycobacterium tuberculosis
HSLPPIPTLFVVADE

SEQ ID NO: 64907 - protein, 15 aa, Mycobacterium tuberculosis
SLPPIPTLFVVADEF

SEQ ID NO: 64908 - protein, 15 aa, Mycobacterium tuberculosis
LPPIPTLFVVADEFT

SEQ ID NO: 64909 - protein, 15 aa, Mycobacterium tuberculosis
PPIPTLFVVADEFTL

SEQ ID NO: 64910 - protein, 15 aa, Mycobacterium tuberculosis
PIPTLFVVADEFTLM

SEQ ID NO: 64911 - protein, 15 aa, Mycobacterium tuberculosis
IPTLFVVADEFTLML

SEQ ID NO: 64912 - protein, 15 aa, Mycobacterium tuberculosis
PTLFVVADEFTLMLA

SEQ ID NO: 64913 - protein, 15 aa, Mycobacterium tuberculosis
TLFVVADEFTLMLAD

SEQ ID NO: 64914 - protein, 15 aa, Mycobacterium tuberculosis
LFVVADEFTLMLADH

SEQ ID NO: 64915 - protein, 15 aa, Mycobacterium tuberculosis
FVVADEFTLMLADHP

SEQ ID NO: 64916 - protein, 15 aa, Mycobacterium tuberculosis
VVADEFTLMLADHPE

SEQ ID NO: 64917 - protein, 15 aa, Mycobacterium tuberculosis
VADEFTLMLADHPEY

SEQ ID NO: 64918 - protein, 15 aa, Mycobacterium tuberculosis
ADEFTLMLADHPEYA

SEQ ID NO: 64919 - protein, 15 aa, Mycobacterium tuberculosis
DEFTLMLADHPEYAE

SEQ ID NO: 64920 - protein, 15 aa, Mycobacterium tuberculosis
EFTLMLADHPEYAEL

SEQ ID NO: 64921 - protein, 15 aa, Mycobacterium tuberculosis
FTLMLADHPEYAELF

SEQ ID NO: 64922 - protein, 15 aa, Mycobacterium tuberculosis
TLMLADHPEYAELFD

SEQ ID NO: 64923 - protein, 15 aa, Mycobacterium tuberculosis
LMLADHPEYAELFDY

SEQ ID NO: 64924 - protein, 15 aa, Mycobacterium tuberculosis
MLADHPEYAELFDYV

SEQ ID NO: 64925 - protein, 15 aa, Mycobacterium tuberculosis
LADHPEYAELFDYVA

SEQ ID NO: 64926 - protein, 15 aa, Mycobacterium tuberculosis
ADHPEYAELFDYVAR

SEQ ID NO: 64927 - protein, 15 aa, Mycobacterium tuberculosis
DHPEYAELFDYVARK

SEQ ID NO: 64928 - protein, 15 aa, Mycobacterium tuberculosis
HPEYAELFDYVARKG

SEQ ID NO: 64929 - protein, 15 aa, Mycobacterium tuberculosis
PEYAELFDYVARKGR

SEQ ID NO: 64930 - protein, 15 aa, Mycobacterium tuberculosis
EYAELFDYVARKGRS

SEQ ID NO: 64931 - protein, 15 aa, Mycobacterium tuberculosis
YAELFDYVARKGRSF

SEQ ID NO: 64932 - protein, 15 aa, Mycobacterium tuberculosis
AELFDYVARKGRSFR

SEQ ID NO: 64933 - protein, 15 aa, Mycobacterium tuberculosis
ELFDYVARKGRSFRI

SEQ ID NO: 64934 - protein, 15 aa, Mycobacterium tuberculosis
LFDYVARKGRSFRIH

SEQ ID NO: 64935 - protein, 15 aa, Mycobacterium tuberculosis
FDYVARKGRSFRIHI

SEQ ID NO: 64936 - protein, 15 aa, Mycobacterium tuberculosis
DYVARKGRSFRIHIL

SEQ ID NO: 64937 - protein, 15 aa, Mycobacterium tuberculosis
YVARKGRSFRIHILF

SEQ ID NO: 64938 - protein, 15 aa, Mycobacterium tuberculosis
VARKGRSFRIHILFA

SEQ ID NO: 64939 - protein, 15 aa, Mycobacterium tuberculosis
ARKGRSFRIHILFAS

SEQ ID NO: 64940 - protein, 15 aa, Mycobacterium tuberculosis
RKGRSFRIHILFASQ

SEQ ID NO: 64941 - protein, 15 aa, Mycobacterium tuberculosis
KGRSFRIHILFASQT

SEQ ID NO: 64942 - protein, 15 aa, Mycobacterium tuberculosis
GRSFRIHILFASQTL

SEQ ID NO: 64943 - protein, 15 aa, Mycobacterium tuberculosis
RSFRIHILFASQTLD

SEQ ID NO: 64944 - protein, 15 aa, Mycobacterium tuberculosis
SFRIHILFASQTLDV

SEQ ID NO: 64945 - protein, 15 aa, Mycobacterium tuberculosis
FRIHILFASQTLDVG

SEQ ID NO: 64946 - protein, 15 aa, Mycobacterium tuberculosis
RIHILFASQTLDVGK

SEQ ID NO: 64947 - protein, 15 aa, Mycobacterium tuberculosis
IHILFASQTLDVGKI

SEQ ID NO: 64948 - protein, 15 aa, Mycobacterium tuberculosis
HILFASQTLDVGKIK

SEQ ID NO: 64949 - protein, 15 aa, Mycobacterium tuberculosis
ILFASQTLDVGKIKD

SEQ ID NO: 64950 - protein, 15 aa, Mycobacterium tuberculosis
LFASQTLDVGKIKDI

SEQ ID NO: 64951 - protein, 15 aa, Mycobacterium tuberculosis
FASQTLDVGKIKDID

SEQ ID NO: 64952 - protein, 15 aa, Mycobacterium tuberculosis
ASQTLDVGKIKDIDK

SEQ ID NO: 64953 - protein, 15 aa, Mycobacterium tuberculosis
SQTLDVGKIKDIDKN

SEQ ID NO: 64954 - protein, 15 aa, Mycobacterium tuberculosis
QTLDVGKIKDIDKNT

SEQ ID NO: 64955 - protein, 15 aa, Mycobacterium tuberculosis
TLDVGKIKDIDKNTA

SEQ ID NO: 64956 - protein, 15 aa, Mycobacterium tuberculosis
LDVGKIKDIDKNTAY

SEQ ID NO: 64957 - protein, 15 aa, Mycobacterium tuberculosis
DVGKIKDIDKNTAYR

SEQ ID NO: 64958 - protein, 15 aa, Mycobacterium tuberculosis
VGKIKDIDKNTAYRI

SEQ ID NO: 64959 - protein, 15 aa, Mycobacterium tuberculosis
GKIKDIDKNTAYRIG

SEQ ID NO: 64960 - protein, 15 aa, Mycobacterium tuberculosis
KIKDIDKNTAYRIGL

SEQ ID NO: 64961 - protein, 15 aa, Mycobacterium tuberculosis
IKDIDKNTAYRIGLK

SEQ ID NO: 64962 - protein, 15 aa, Mycobacterium tuberculosis
KDIDKNTAYRIGLKV

SEQ ID NO: 64963 - protein, 15 aa, Mycobacterium tuberculosis
DIDKNTAYRIGLKVA

SEQ ID NO: 64964 - protein, 15 aa, Mycobacterium tuberculosis
IDKNTAYRIGLKVAS

SEQ ID NO: 64965 - protein, 15 aa, Mycobacterium tuberculosis
DKNTAYRIGLKVASP

SEQ ID NO: 64966 - protein, 15 aa, Mycobacterium tuberculosis
KNTAYRIGLKVASPS

SEQ ID NO: 64967 - protein, 15 aa, Mycobacterium tuberculosis
NTAYRIGLKVASPSV

SEQ ID NO: 64968 - protein, 15 aa, Mycobacterium tuberculosis
TAYRIGLKVASPSVS

SEQ ID NO: 64969 - protein, 15 aa, Mycobacterium tuberculosis
AYRIGLKVASPSVSR

SEQ ID NO: 64970 - protein, 15 aa, Mycobacterium tuberculosis
YRIGLKVASPSVSRQ

SEQ ID NO: 64971 - protein, 15 aa, Mycobacterium tuberculosis
RIGLKVASPSVSRQI

SEQ ID NO: 64972 - protein, 15 aa, Mycobacterium tuberculosis
IGLKVASPSVSRQII

SEQ ID NO: 64973 - protein, 15 aa, Mycobacterium tuberculosis
GLKVASPSVSRQIIG

SEQ ID NO: 64974 - protein, 15 aa, Mycobacterium tuberculosis
LKVASPSVSRQIIGV

SEQ ID NO: 64975 - protein, 15 aa, Mycobacterium tuberculosis
KVASPSVSRQIIGVE

SEQ ID NO: 64976 - protein, 15 aa, Mycobacterium tuberculosis
VASPSVSRQIIGVED

SEQ ID NO: 64977 - protein, 15 aa, Mycobacterium tuberculosis
ASPSVSRQIIGVEDA

SEQ ID NO: 64978 - protein, 15 aa, Mycobacterium tuberculosis
SPSVSRQIIGVEDAY

SEQ ID NO: 64979 - protein, 15 aa, Mycobacterium tuberculosis
PSVSRQIIGVEDAYH

SEQ ID NO: 64980 - protein, 15 aa, Mycobacterium tuberculosis
SVSRQIIGVEDAYHI

SEQ ID NO: 64981 - protein, 15 aa, Mycobacterium tuberculosis
VSRQIIGVEDAYHIE

SEQ ID NO: 64982 - protein, 15 aa, Mycobacterium tuberculosis
SRQIIGVEDAYHIES

SEQ ID NO: 64983 - protein, 15 aa, Mycobacterium tuberculosis
RQIIGVEDAYHIESG

SEQ ID NO: 64984 - protein, 15 aa, Mycobacterium tuberculosis
QIIGVEDAYHIESGK

SEQ ID NO: 64985 - protein, 15 aa, Mycobacterium tuberculosis
IIGVEDAYHIESGKE

SEQ ID NO: 64986 - protein, 15 aa, Mycobacterium tuberculosis
IGVEDAYHIESGKEH

SEQ ID NO: 64987 - protein, 15 aa, Mycobacterium tuberculosis
GVEDAYHIESGKEHK

SEQ ID NO: 64988 - protein, 15 aa, Mycobacterium tuberculosis
VEDAYHIESGKEHKG

SEQ ID NO: 64989 - protein, 15 aa, Mycobacterium tuberculosis
EDAYHIESGKEHKGV

SEQ ID NO: 64990 - protein, 15 aa, Mycobacterium tuberculosis
DAYHIESGKEHKGVG

SEQ ID NO: 64991 - protein, 15 aa, Mycobacterium tuberculosis
AYHIESGKEHKGVGF

SEQ ID NO: 64992 - protein, 15 aa, Mycobacterium tuberculosis
YHIESGKEHKGVGFL

SEQ ID NO: 64993 - protein, 15 aa, Mycobacterium tuberculosis
HIESGKEHKGVGFLV

SEQ ID NO: 64994 - protein, 15 aa, Mycobacterium tuberculosis
IESGKEHKGVGFLVP

SEQ ID NO: 64995 - protein, 15 aa, Mycobacterium tuberculosis
ESGKEHKGVGFLVPA

SEQ ID NO: 64996 - protein, 15 aa, Mycobacterium tuberculosis
SGKEHKGVGFLVPAP

SEQ ID NO: 64997 - protein, 15 aa, Mycobacterium tuberculosis
GKEHKGVGFLVPAPG

SEQ ID NO: 64998 - protein, 15 aa, Mycobacterium tuberculosis
KEHKGVGFLVPAPGA

SEQ ID NO: 64999 - protein, 15 aa, Mycobacterium tuberculosis
EHKGVGFLVPAPGAT

SEQ ID NO: 65000 - protein, 15 aa, Mycobacterium tuberculosis
HKGVGFLVPAPGATP

SEQ ID NO: 65001 - protein, 15 aa, Mycobacterium tuberculosis
KGVGFLVPAPGATPI

SEQ ID NO: 65002 - protein, 15 aa, Mycobacterium tuberculosis
GVGFLVPAPGATPIR

SEQ ID NO: 65003 - protein, 15 aa, Mycobacterium tuberculosis
VGFLVPAPGATPIRF

SEQ ID NO: 65004 - protein, 15 aa, Mycobacterium tuberculosis
GFLVPAPGATPIRFR

SEQ ID NO: 65005 - protein, 15 aa, Mycobacterium tuberculosis
FLVPAPGATPIRFRS

SEQ ID NO: 65006 - protein, 15 aa, Mycobacterium tuberculosis
LVPAPGATPIRFRST

SEQ ID NO: 65007 - protein, 15 aa, Mycobacterium tuberculosis
VPAPGATPIRFRSTY

SEQ ID NO: 65008 - protein, 15 aa, Mycobacterium tuberculosis
PAPGATPIRFRSTYV

SEQ ID NO: 65009 - protein, 15 aa, Mycobacterium tuberculosis
APGATPIRFRSTYVD

SEQ ID NO: 65010 - protein, 15 aa, Mycobacterium tuberculosis
PGATPIRFRSTYVDG

SEQ ID NO: 65011 - protein, 15 aa, Mycobacterium tuberculosis
GATPIRFRSTYVDGI

SEQ ID NO: 65012 - protein, 15 aa, Mycobacterium tuberculosis
ATPIRFRSTYVDGIY

SEQ ID NO: 65013 - protein, 15 aa, Mycobacterium tuberculosis
TPIRFRSTYVDGIYE

SEQ ID NO: 65014 - protein, 15 aa, Mycobacterium tuberculosis
PIRFRSTYVDGIYEP

SEQ ID NO: 65015 - protein, 15 aa, Mycobacterium tuberculosis
IRFRSTYVDGIYEPP

SEQ ID NO: 65016 - protein, 15 aa, Mycobacterium tuberculosis
RFRSTYVDGIYEPPQ

SEQ ID NO: 65017 - protein, 15 aa, Mycobacterium tuberculosis
FRSTYVDGIYEPPQT

SEQ ID NO: 65018 - protein, 15 aa, Mycobacterium tuberculosis
RSTYVDGIYEPPQTA

SEQ ID NO: 65019 - protein, 15 aa, Mycobacterium tuberculosis
STYVDGIYEPPQTAK

SEQ ID NO: 65020 - protein, 15 aa, Mycobacterium tuberculosis
TYVDGIYEPPQTAKA

SEQ ID NO: 65021 - protein, 15 aa, Mycobacterium tuberculosis
YVDGIYEPPQTAKAV

SEQ ID NO: 65022 - protein, 15 aa, Mycobacterium tuberculosis
VDGIYEPPQTAKAVV

SEQ ID NO: 65023 - protein, 15 aa, Mycobacterium tuberculosis
DGIYEPPQTAKAVVV

SEQ ID NO: 65024 - protein, 15 aa, Mycobacterium tuberculosis
GIYEPPQTAKAVVVQ

SEQ ID NO: 65025 - protein, 15 aa, Mycobacterium tuberculosis
IYEPPQTAKAVVVQS

SEQ ID NO: 65026 - protein, 15 aa, Mycobacterium tuberculosis
YEPPQTAKAVVVQSV

SEQ ID NO: 65027 - protein, 15 aa, Mycobacterium tuberculosis
EPPQTAKAVVVQSVP

SEQ ID NO: 65028 - protein, 15 aa, Mycobacterium tuberculosis
PPQTAKAVVVQSVPE

SEQ ID NO: 65029 - protein, 15 aa, Mycobacterium tuberculosis
PQTAKAVVVQSVPEP

SEQ ID NO: 65030 - protein, 15 aa, Mycobacterium tuberculosis
QTAKAVVVQSVPEPK

SEQ ID NO: 65031 - protein, 15 aa, Mycobacterium tuberculosis
TAKAVVVQSVPEPKL

SEQ ID NO: 65032 - protein, 15 aa, Mycobacterium tuberculosis
AKAVVVQSVPEPKLF

SEQ ID NO: 65033 - protein, 15 aa, Mycobacterium tuberculosis
KAVVVQSVPEPKLFT

SEQ ID NO: 65034 - protein, 15 aa, Mycobacterium tuberculosis
AVVVQSVPEPKLFTA

SEQ ID NO: 65035 - protein, 15 aa, Mycobacterium tuberculosis
VVVQSVPEPKLFTAA

SEQ ID NO: 65036 - protein, 15 aa, Mycobacterium tuberculosis
VVQSVPEPKLFTAAA

SEQ ID NO: 65037 - protein, 15 aa, Mycobacterium tuberculosis
VQSVPEPKLFTAAAV

SEQ ID NO: 65038 - protein, 15 aa, Mycobacterium tuberculosis
QSVPEPKLFTAAAVE

SEQ ID NO: 65039 - protein, 15 aa, Mycobacterium tuberculosis
SVPEPKLFTAAAVEP

SEQ ID NO: 65040 - protein, 15 aa, Mycobacterium tuberculosis
VPEPKLFTAAAVEPD

SEQ ID NO: 65041 - protein, 15 aa, Mycobacterium tuberculosis
PEPKLFTAAAVEPDP

SEQ ID NO: 65042 - protein, 15 aa, Mycobacterium tuberculosis
EPKLFTAAAVEPDPG

SEQ ID NO: 65043 - protein, 15 aa, Mycobacterium tuberculosis
PKLFTAAAVEPDPGT

SEQ ID NO: 65044 - protein, 15 aa, Mycobacterium tuberculosis
KLFTAAAVEPDPGTV

SEQ ID NO: 65045 - protein, 15 aa, Mycobacterium tuberculosis
LFTAAAVEPDPGTVI

SEQ ID NO: 65046 - protein, 15 aa, Mycobacterium tuberculosis
FTAAAVEPDPGTVIA

SEQ ID NO: 65047 - protein, 15 aa, Mycobacterium tuberculosis
TAAAVEPDPGTVIAD

SEQ ID NO: 65048 - protein, 15 aa, Mycobacterium tuberculosis
AAAVEPDPGTVIADT

SEQ ID NO: 65049 - protein, 15 aa, Mycobacterium tuberculosis
AAVEPDPGTVIADTD

SEQ ID NO: 65050 - protein, 15 aa, Mycobacterium tuberculosis
AVEPDPGTVIADTDE

SEQ ID NO: 65051 - protein, 15 aa, Mycobacterium tuberculosis
VEPDPGTVIADTDEQ

SEQ ID NO: 65052 - protein, 15 aa, Mycobacterium tuberculosis
EPDPGTVIADTDEQE

SEQ ID NO: 65053 - protein, 15 aa, Mycobacterium tuberculosis
PDPGTVIADTDEQEP

SEQ ID NO: 65054 - protein, 15 aa, Mycobacterium tuberculosis
DPGTVIADTDEQEPA

SEQ ID NO: 65055 - protein, 15 aa, Mycobacterium tuberculosis
PGTVIADTDEQEPAD

SEQ ID NO: 65056 - protein, 15 aa, Mycobacterium tuberculosis
GTVIADTDEQEPADP

SEQ ID NO: 65057 - protein, 15 aa, Mycobacterium tuberculosis
TVIADTDEQEPADPP

SEQ ID NO: 65058 - protein, 15 aa, Mycobacterium tuberculosis
VIADTDEQEPADPPR

SEQ ID NO: 65059 - protein, 15 aa, Mycobacterium tuberculosis
IADTDEQEPADPPRK

SEQ ID NO: 65060 - protein, 15 aa, Mycobacterium tuberculosis
ADTDEQEPADPPRKL

SEQ ID NO: 65061 - protein, 15 aa, Mycobacterium tuberculosis
DTDEQEPADPPRKLI

SEQ ID NO: 65062 - protein, 15 aa, Mycobacterium tuberculosis
TDEQEPADPPRKLIA

SEQ ID NO: 65063 - protein, 15 aa, Mycobacterium tuberculosis
DEQEPADPPRKLIAT

SEQ ID NO: 65064 - protein, 15 aa, Mycobacterium tuberculosis
EQEPADPPRKLIATI

SEQ ID NO: 65065 - protein, 15 aa, Mycobacterium tuberculosis
QEPADPPRKLIATIG

SEQ ID NO: 65066 - protein, 15 aa, Mycobacterium tuberculosis
EPADPPRKLIATIGE

SEQ ID NO: 65067 - protein, 15 aa, Mycobacterium tuberculosis
PADPPRKLIATIGEQ

SEQ ID NO: 65068 - protein, 15 aa, Mycobacterium tuberculosis
ADPPRKLIATIGEQL

SEQ ID NO: 65069 - protein, 15 aa, Mycobacterium tuberculosis
DPPRKLIATIGEQLA

SEQ ID NO: 65070 - protein, 15 aa, Mycobacterium tuberculosis
PPRKLIATIGEQLAR

SEQ ID NO: 65071 - protein, 15 aa, Mycobacterium tuberculosis
PRKLIATIGEQLARY

SEQ ID NO: 65072 - protein, 15 aa, Mycobacterium tuberculosis
RKLIATIGEQLARYG

SEQ ID NO: 65073 - protein, 15 aa, Mycobacterium tuberculosis
KLIATIGEQLARYGP

SEQ ID NO: 65074 - protein, 15 aa, Mycobacterium tuberculosis
LIATIGEQLARYGPR

SEQ ID NO: 65075 - protein, 15 aa, Mycobacterium tuberculosis
IATIGEQLARYGPRA

SEQ ID NO: 65076 - protein, 15 aa, Mycobacterium tuberculosis
ATIGEQLARYGPRAP

SEQ ID NO: 65077 - protein, 15 aa, Mycobacterium tuberculosis
TIGEQLARYGPRAPQ

SEQ ID NO: 65078 - protein, 15 aa, Mycobacterium tuberculosis
IGEQLARYGPRAPQL

SEQ ID NO: 65079 - protein, 15 aa, Mycobacterium tuberculosis
GEQLARYGPRAPQLW

SEQ ID NO: 65080 - protein, 15 aa, Mycobacterium tuberculosis
EQLARYGPRAPQLWL

SEQ ID NO: 65081 - protein, 15 aa, Mycobacterium tuberculosis
QLARYGPRAPQLWLP

SEQ ID NO: 65082 - protein, 15 aa, Mycobacterium tuberculosis
LARYGPRAPQLWLPP

SEQ ID NO: 65083 - protein, 15 aa, Mycobacterium tuberculosis
ARYGPRAPQLWLPPL

SEQ ID NO: 65084 - protein, 15 aa, Mycobacterium tuberculosis
RYGPRAPQLWLPPLD

SEQ ID NO: 65085 - protein, 15 aa, Mycobacterium tuberculosis
YGPRAPQLWLPPLDE

SEQ ID NO: 65086 - protein, 15 aa, Mycobacterium tuberculosis
GPRAPQLWLPPLDET

SEQ ID NO: 65087 - protein, 15 aa, Mycobacterium tuberculosis
PRAPQLWLPPLDETI

SEQ ID NO: 65088 - protein, 15 aa, Mycobacterium tuberculosis
RAPQLWLPPLDETIP

SEQ ID NO: 65089 - protein, 15 aa, Mycobacterium tuberculosis
APQLWLPPLDETIPL

SEQ ID NO: 65090 - protein, 15 aa, Mycobacterium tuberculosis
PQLWLPPLDETIPLS

SEQ ID NO: 65091 - protein, 15 aa, Mycobacterium tuberculosis
QLWLPPLDETIPLSA

SEQ ID NO: 65092 - protein, 15 aa, Mycobacterium tuberculosis
LWLPPLDETIPLSAA

SEQ ID NO: 65093 - protein, 15 aa, Mycobacterium tuberculosis
WLPPLDETIPLSAAL

SEQ ID NO: 65094 - protein, 15 aa, Mycobacterium tuberculosis
LPPLDETIPLSAALA

SEQ ID NO: 65095 - protein, 15 aa, Mycobacterium tuberculosis
PPLDETIPLSAALAR

SEQ ID NO: 65096 - protein, 15 aa, Mycobacterium tuberculosis
PLDETIPLSAALARA

SEQ ID NO: 65097 - protein, 15 aa, Mycobacterium tuberculosis
LDETIPLSAALARAG

SEQ ID NO: 65098 - protein, 15 aa, Mycobacterium tuberculosis
DETIPLSAALARAGV

SEQ ID NO: 65099 - protein, 15 aa, Mycobacterium tuberculosis
ETIPLSAALARAGVG

SEQ ID NO: 65100 - protein, 15 aa, Mycobacterium tuberculosis
TIPLSAALARAGVGP

SEQ ID NO: 65101 - protein, 15 aa, Mycobacterium tuberculosis
IPLSAALARAGVGPR

SEQ ID NO: 65102 - protein, 15 aa, Mycobacterium tuberculosis
PLSAALARAGVGPRQ

SEQ ID NO: 65103 - protein, 15 aa, Mycobacterium tuberculosis
LSAALARAGVGPRQW

SEQ ID NO: 65104 - protein, 15 aa, Mycobacterium tuberculosis
SAALARAGVGPRQWR

SEQ ID NO: 65105 - protein, 15 aa, Mycobacterium tuberculosis
AALARAGVGPRQWRW

SEQ ID NO: 65106 - protein, 15 aa, Mycobacterium tuberculosis
ALARAGVGPRQWRWP

SEQ ID NO: 65107 - protein, 15 aa, Mycobacterium tuberculosis
LARAGVGPRQWRWPL

SEQ ID NO: 65108 - protein, 15 aa, Mycobacterium tuberculosis
ARAGVGPRQWRWPLG

SEQ ID NO: 65109 - protein, 15 aa, Mycobacterium tuberculosis
RAGVGPRQWRWPLGE

SEQ ID NO: 65110 - protein, 15 aa, Mycobacterium tuberculosis
AGVGPRQWRWPLGEI

SEQ ID NO: 65111 - protein, 15 aa, Mycobacterium tuberculosis
GVGPRQWRWPLGEID

SEQ ID NO: 65112 - protein, 15 aa, Mycobacterium tuberculosis
VGPRQWRWPLGEIDR

SEQ ID NO: 65113 - protein, 15 aa, Mycobacterium tuberculosis
GPRQWRWPLGEIDRP

SEQ ID NO: 65114 - protein, 15 aa, Mycobacterium tuberculosis
PRQWRWPLGEIDRPF

SEQ ID NO: 65115 - protein, 15 aa, Mycobacterium tuberculosis
RQWRWPLGEIDRPFE

SEQ ID NO: 65116 - protein, 15 aa, Mycobacterium tuberculosis
QWRWPLGEIDRPFEM

SEQ ID NO: 65117 - protein, 15 aa, Mycobacterium tuberculosis
WRWPLGEIDRPFEMR

SEQ ID NO: 65118 - protein, 15 aa, Mycobacterium tuberculosis
RWPLGEIDRPFEMRR

SEQ ID NO: 65119 - protein, 15 aa, Mycobacterium tuberculosis
WPLGEIDRPFEMRRD

SEQ ID NO: 65120 - protein, 15 aa, Mycobacterium tuberculosis
PLGEIDRPFEMRRDP

SEQ ID NO: 65121 - protein, 15 aa, Mycobacterium tuberculosis
LGEIDRPFEMRRDPL

SEQ ID NO: 65122 - protein, 15 aa, Mycobacterium tuberculosis
GEIDRPFEMRRDPLV

SEQ ID NO: 65123 - protein, 15 aa, Mycobacterium tuberculosis
EIDRPFEMRRDPLVF

SEQ ID NO: 65124 - protein, 15 aa, Mycobacterium tuberculosis
IDRPFEMRRDPLVFD

SEQ ID NO: 65125 - protein, 15 aa, Mycobacterium tuberculosis
DRPFEMRRDPLVFDA

SEQ ID NO: 65126 - protein, 15 aa, Mycobacterium tuberculosis
RPFEMRRDPLVFDAR

SEQ ID NO: 65127 - protein, 15 aa, Mycobacterium tuberculosis
PFEMRRDPLVFDARS

SEQ ID NO: 65128 - protein, 15 aa, Mycobacterium tuberculosis
FEMRRDPLVFDARSS

SEQ ID NO: 65129 - protein, 15 aa, Mycobacterium tuberculosis
EMRRDPLVFDARSSA

SEQ ID NO: 65130 - protein, 15 aa, Mycobacterium tuberculosis
MRRDPLVFDARSSAG

SEQ ID NO: 65131 - protein, 15 aa, Mycobacterium tuberculosis
RRDPLVFDARSSAGN

SEQ ID NO: 65132 - protein, 15 aa, Mycobacterium tuberculosis
RDPLVFDARSSAGNM

SEQ ID NO: 65133 - protein, 15 aa, Mycobacterium tuberculosis
DPLVFDARSSAGNMV

SEQ ID NO: 65134 - protein, 15 aa, Mycobacterium tuberculosis
PLVFDARSSAGNMVI

SEQ ID NO: 65135 - protein, 15 aa, Mycobacterium tuberculosis
LVFDARSSAGNMVIH

SEQ ID NO: 65136 - protein, 15 aa, Mycobacterium tuberculosis
VFDARSSAGNMVIHG

SEQ ID NO: 65137 - protein, 15 aa, Mycobacterium tuberculosis
FDARSSAGNMVIHGG

SEQ ID NO: 65138 - protein, 15 aa, Mycobacterium tuberculosis
DARSSAGNMVIHGGP

SEQ ID NO: 65139 - protein, 15 aa, Mycobacterium tuberculosis
ARSSAGNMVIHGGPK

SEQ ID NO: 65140 - protein, 15 aa, Mycobacterium tuberculosis
RSSAGNMVIHGGPKS

SEQ ID NO: 65141 - protein, 15 aa, Mycobacterium tuberculosis
SSAGNMVIHGGPKSG

SEQ ID NO: 65142 - protein, 15 aa, Mycobacterium tuberculosis
SAGNMVIHGGPKSGK

SEQ ID NO: 65143 - protein, 15 aa, Mycobacterium tuberculosis
AGNMVIHGGPKSGKS

SEQ ID NO: 65144 - protein, 15 aa, Mycobacterium tuberculosis
GNMVIHGGPKSGKST

SEQ ID NO: 65145 - protein, 15 aa, Mycobacterium tuberculosis
NMVIHGGPKSGKSTA

SEQ ID NO: 65146 - protein, 15 aa, Mycobacterium tuberculosis
MVIHGGPKSGKSTAL

SEQ ID NO: 65147 - protein, 15 aa, Mycobacterium tuberculosis
VIHGGPKSGKSTALQ

SEQ ID NO: 65148 - protein, 15 aa, Mycobacterium tuberculosis
IHGGPKSGKSTALQT

SEQ ID NO: 65149 - protein, 15 aa, Mycobacterium tuberculosis
HGGPKSGKSTALQTF

SEQ ID NO: 65150 - protein, 15 aa, Mycobacterium tuberculosis
GGPKSGKSTALQTFI

SEQ ID NO: 65151 - protein, 15 aa, Mycobacterium tuberculosis
GPKSGKSTALQTFIL

SEQ ID NO: 65152 - protein, 15 aa, Mycobacterium tuberculosis
PKSGKSTALQTFILS

SEQ ID NO: 65153 - protein, 15 aa, Mycobacterium tuberculosis
KSGKSTALQTFILSA

SEQ ID NO: 65154 - protein, 15 aa, Mycobacterium tuberculosis
SGKSTALQTFILSAA

SEQ ID NO: 65155 - protein, 15 aa, Mycobacterium tuberculosis
GKSTALQTFILSAAS

SEQ ID NO: 65156 - protein, 15 aa, Mycobacterium tuberculosis
KSTALQTFILSAASL

SEQ ID NO: 65157 - protein, 15 aa, Mycobacterium tuberculosis
STALQTFILSAASLH

SEQ ID NO: 65158 - protein, 15 aa, Mycobacterium tuberculosis
TALQTFILSAASLHS

SEQ ID NO: 65159 - protein, 15 aa, Mycobacterium tuberculosis
ALQTFILSAASLHSP

SEQ ID NO: 65160 - protein, 15 aa, Mycobacterium tuberculosis
LQTFILSAASLHSPH

SEQ ID NO: 65161 - protein, 15 aa, Mycobacterium tuberculosis
QTFILSAASLHSPHE

SEQ ID NO: 65162 - protein, 15 aa, Mycobacterium tuberculosis
TFILSAASLHSPHEV

SEQ ID NO: 65163 - protein, 15 aa, Mycobacterium tuberculosis
FILSAASLHSPHEVS

SEQ ID NO: 65164 - protein, 15 aa, Mycobacterium tuberculosis
ILSAASLHSPHEVSF

SEQ ID NO: 65165 - protein, 15 aa, Mycobacterium tuberculosis
LSAASLHSPHEVSFY

SEQ ID NO: 65166 - protein, 15 aa, Mycobacterium tuberculosis
SAASLHSPHEVSFYC

SEQ ID NO: 65167 - protein, 15 aa, Mycobacterium tuberculosis
AASLHSPHEVSFYCL

SEQ ID NO: 65168 - protein, 15 aa, Mycobacterium tuberculosis
ASLHSPHEVSFYCLD

SEQ ID NO: 65169 - protein, 15 aa, Mycobacterium tuberculosis
SLHSPHEVSFYCLDY

SEQ ID NO: 65170 - protein, 15 aa, Mycobacterium tuberculosis
LHSPHEVSFYCLDYG

SEQ ID NO: 65171 - protein, 15 aa, Mycobacterium tuberculosis
HSPHEVSFYCLDYGG

SEQ ID NO: 65172 - protein, 15 aa, Mycobacterium tuberculosis
SPHEVSFYCLDYGGG

SEQ ID NO: 65173 - protein, 15 aa, Mycobacterium tuberculosis
PHEVSFYCLDYGGGQ

SEQ ID NO: 65174 - protein, 15 aa, Mycobacterium tuberculosis
HEVSFYCLDYGGGQL

SEQ ID NO: 65175 - protein, 15 aa, Mycobacterium tuberculosis
EVSFYCLDYGGGQLR

SEQ ID NO: 65176 - protein, 15 aa, Mycobacterium tuberculosis
VSFYCLDYGGGQLRA

SEQ ID NO: 65177 - protein, 15 aa, Mycobacterium tuberculosis
SFYCLDYGGGQLRAL

SEQ ID NO: 65178 - protein, 15 aa, Mycobacterium tuberculosis
FYCLDYGGGQLRALQ

SEQ ID NO: 65179 - protein, 15 aa, Mycobacterium tuberculosis
YCLDYGGGQLRALQD

SEQ ID NO: 65180 - protein, 15 aa, Mycobacterium tuberculosis
CLDYGGGQLRALQDL

SEQ ID NO: 65181 - protein, 15 aa, Mycobacterium tuberculosis
LDYGGGQLRALQDLA

SEQ ID NO: 65182 - protein, 15 aa, Mycobacterium tuberculosis
DYGGGQLRALQDLAH

SEQ ID NO: 65183 - protein, 15 aa, Mycobacterium tuberculosis
YGGGQLRALQDLAHV

SEQ ID NO: 65184 - protein, 15 aa, Mycobacterium tuberculosis
GGGQLRALQDLAHVG

SEQ ID NO: 65185 - protein, 15 aa, Mycobacterium tuberculosis
GGQLRALQDLAHVGS

SEQ ID NO: 65186 - protein, 15 aa, Mycobacterium tuberculosis
GQLRALQDLAHVGSV

SEQ ID NO: 65187 - protein, 15 aa, Mycobacterium tuberculosis
QLRALQDLAHVGSVA

SEQ ID NO: 65188 - protein, 15 aa, Mycobacterium tuberculosis
LRALQDLAHVGSVAS

SEQ ID NO: 65189 - protein, 15 aa, Mycobacterium tuberculosis
RALQDLAHVGSVASA

SEQ ID NO: 65190 - protein, 15 aa, Mycobacterium tuberculosis
ALQDLAHVGSVASAL

SEQ ID NO: 65191 - protein, 15 aa, Mycobacterium tuberculosis
LQDLAHVGSVASALE

SEQ ID NO: 65192 - protein, 15 aa, Mycobacterium tuberculosis
QDLAHVGSVASALEP

SEQ ID NO: 65193 - protein, 15 aa, Mycobacterium tuberculosis
DLAHVGSVASALEPE

SEQ ID NO: 65194 - protein, 15 aa, Mycobacterium tuberculosis
LAHVGSVASALEPER

SEQ ID NO: 65195 - protein, 15 aa, Mycobacterium tuberculosis
AHVGSVASALEPERI

SEQ ID NO: 65196 - protein, 15 aa, Mycobacterium tuberculosis
HVGSVASALEPERIR

SEQ ID NO: 65197 - protein, 15 aa, Mycobacterium tuberculosis
VGSVASALEPERIRR

SEQ ID NO: 65198 - protein, 15 aa, Mycobacterium tuberculosis
GSVASALEPERIRRT

SEQ ID NO: 65199 - protein, 15 aa, Mycobacterium tuberculosis
SVASALEPERIRRTF

SEQ ID NO: 65200 - protein, 15 aa, Mycobacterium tuberculosis
VASALEPERIRRTFG

SEQ ID NO: 65201 - protein, 15 aa, Mycobacterium tuberculosis
ASALEPERIRRTFGE

SEQ ID NO: 65202 - protein, 15 aa, Mycobacterium tuberculosis
SALEPERIRRTFGEL

SEQ ID NO: 65203 - protein, 15 aa, Mycobacterium tuberculosis
ALEPERIRRTFGELE

SEQ ID NO: 65204 - protein, 15 aa, Mycobacterium tuberculosis
LEPERIRRTFGELEQ

SEQ ID NO: 65205 - protein, 15 aa, Mycobacterium tuberculosis
EPERIRRTFGELEQL

SEQ ID NO: 65206 - protein, 15 aa, Mycobacterium tuberculosis
PERIRRTFGELEQLL

SEQ ID NO: 65207 - protein, 15 aa, Mycobacterium tuberculosis
ERIRRTFGELEQLLL

SEQ ID NO: 65208 - protein, 15 aa, Mycobacterium tuberculosis
RIRRTFGELEQLLLS

SEQ ID NO: 65209 - protein, 15 aa, Mycobacterium tuberculosis
IRRTFGELEQLLLSR

SEQ ID NO: 65210 - protein, 15 aa, Mycobacterium tuberculosis
RRTFGELEQLLLSRQ

SEQ ID NO: 65211 - protein, 15 aa, Mycobacterium tuberculosis
RTFGELEQLLLSRQQ

SEQ ID NO: 65212 - protein, 15 aa, Mycobacterium tuberculosis
TFGELEQLLLSRQQR

SEQ ID NO: 65213 - protein, 15 aa, Mycobacterium tuberculosis
FGELEQLLLSRQQRE

SEQ ID NO: 65214 - protein, 15 aa, Mycobacterium tuberculosis
GELEQLLLSRQQREV

SEQ ID NO: 65215 - protein, 15 aa, Mycobacterium tuberculosis
ELEQLLLSRQQREVF

SEQ ID NO: 65216 - protein, 15 aa, Mycobacterium tuberculosis
LEQLLLSRQQREVFR

SEQ ID NO: 65217 - protein, 15 aa, Mycobacterium tuberculosis
EQLLLSRQQREVFRD

SEQ ID NO: 65218 - protein, 15 aa, Mycobacterium tuberculosis
QLLLSRQQREVFRDR

SEQ ID NO: 65219 - protein, 15 aa, Mycobacterium tuberculosis
LLLSRQQREVFRDRG

SEQ ID NO: 65220 - protein, 15 aa, Mycobacterium tuberculosis
LLSRQQREVFRDRGA

SEQ ID NO: 65221 - protein, 15 aa, Mycobacterium tuberculosis
LSRQQREVFRDRGAN

SEQ ID NO: 65222 - protein, 15 aa, Mycobacterium tuberculosis
SRQQREVFRDRGANG

SEQ ID NO: 65223 - protein, 15 aa, Mycobacterium tuberculosis
RQQREVFRDRGANGS

SEQ ID NO: 65224 - protein, 15 aa, Mycobacterium tuberculosis
QQREVFRDRGANGST

SEQ ID NO: 65225 - protein, 15 aa, Mycobacterium tuberculosis
QREVFRDRGANGSTP

SEQ ID NO: 65226 - protein, 15 aa, Mycobacterium tuberculosis
REVFRDRGANGSTPD

SEQ ID NO: 65227 - protein, 15 aa, Mycobacterium tuberculosis
EVFRDRGANGSTPDD

SEQ ID NO: 65228 - protein, 15 aa, Mycobacterium tuberculosis
VFRDRGANGSTPDDG

SEQ ID NO: 65229 - protein, 15 aa, Mycobacterium tuberculosis
FRDRGANGSTPDDGF

SEQ ID NO: 65230 - protein, 15 aa, Mycobacterium tuberculosis
RDRGANGSTPDDGFG

SEQ ID NO: 65231 - protein, 15 aa, Mycobacterium tuberculosis
DRGANGSTPDDGFGE

SEQ ID NO: 65232 - protein, 15 aa, Mycobacterium tuberculosis
RGANGSTPDDGFGEV

SEQ ID NO: 65233 - protein, 15 aa, Mycobacterium tuberculosis
GANGSTPDDGFGEVF

SEQ ID NO: 65234 - protein, 15 aa, Mycobacterium tuberculosis
ANGSTPDDGFGEVFL

SEQ ID NO: 65235 - protein, 15 aa, Mycobacterium tuberculosis
NGSTPDDGFGEVFLV

SEQ ID NO: 65236 - protein, 15 aa, Mycobacterium tuberculosis
GSTPDDGFGEVFLVI

SEQ ID NO: 65237 - protein, 15 aa, Mycobacterium tuberculosis
STPDDGFGEVFLVID

SEQ ID NO: 65238 - protein, 15 aa, Mycobacterium tuberculosis
TPDDGFGEVFLVIDN

SEQ ID NO: 65239 - protein, 15 aa, Mycobacterium tuberculosis
PDDGFGEVFLVIDNL

SEQ ID NO: 65240 - protein, 15 aa, Mycobacterium tuberculosis
DDGFGEVFLVIDNLY

SEQ ID NO: 65241 - protein, 15 aa, Mycobacterium tuberculosis
DGFGEVFLVIDNLYG

SEQ ID NO: 65242 - protein, 15 aa, Mycobacterium tuberculosis
GFGEVFLVIDNLYGF

SEQ ID NO: 65243 - protein, 15 aa, Mycobacterium tuberculosis
FGEVFLVIDNLYGFG

SEQ ID NO: 65244 - protein, 15 aa, Mycobacterium tuberculosis
GEVFLVIDNLYGFGR

SEQ ID NO: 65245 - protein, 15 aa, Mycobacterium tuberculosis
EVFLVIDNLYGFGRD

SEQ ID NO: 65246 - protein, 15 aa, Mycobacterium tuberculosis
VFLVIDNLYGFGRDN

SEQ ID NO: 65247 - protein, 15 aa, Mycobacterium tuberculosis
FLVIDNLYGFGRDNT

SEQ ID NO: 65248 - protein, 15 aa, Mycobacterium tuberculosis
LVIDNLYGFGRDNTD

SEQ ID NO: 65249 - protein, 15 aa, Mycobacterium tuberculosis
VIDNLYGFGRDNTDQ

SEQ ID NO: 65250 - protein, 15 aa, Mycobacterium tuberculosis
IDNLYGFGRDNTDQF

SEQ ID NO: 65251 - protein, 15 aa, Mycobacterium tuberculosis
DNLYGFGRDNTDQFN

SEQ ID NO: 65252 - protein, 15 aa, Mycobacterium tuberculosis
NLYGFGRDNTDQFNT

SEQ ID NO: 65253 - protein, 15 aa, Mycobacterium tuberculosis
LYGFGRDNTDQFNTR

SEQ ID NO: 65254 - protein, 15 aa, Mycobacterium tuberculosis
YGFGRDNTDQFNTRN

SEQ ID NO: 65255 - protein, 15 aa, Mycobacterium tuberculosis
GFGRDNTDQFNTRNP

SEQ ID NO: 65256 - protein, 15 aa, Mycobacterium tuberculosis
FGRDNTDQFNTRNPL

SEQ ID NO: 65257 - protein, 15 aa, Mycobacterium tuberculosis
GRDNTDQFNTRNPLL

SEQ ID NO: 65258 - protein, 15 aa, Mycobacterium tuberculosis
RDNTDQFNTRNPLLA

SEQ ID NO: 65259 - protein, 15 aa, Mycobacterium tuberculosis
DNTDQFNTRNPLLAR

SEQ ID NO: 65260 - protein, 15 aa, Mycobacterium tuberculosis
NTDQFNTRNPLLARV

SEQ ID NO: 65261 - protein, 15 aa, Mycobacterium tuberculosis
TDQFNTRNPLLARVT

SEQ ID NO: 65262 - protein, 15 aa, Mycobacterium tuberculosis
DQFNTRNPLLARVTE

SEQ ID NO: 65263 - protein, 15 aa, Mycobacterium tuberculosis
QFNTRNPLLARVTEL

SEQ ID NO: 65264 - protein, 15 aa, Mycobacterium tuberculosis
FNTRNPLLARVTELV

SEQ ID NO: 65265 - protein, 15 aa, Mycobacterium tuberculosis
NTRNPLLARVTELVN

SEQ ID NO: 65266 - protein, 15 aa, Mycobacterium tuberculosis
TRNPLLARVTELVNV

SEQ ID NO: 65267 - protein, 15 aa, Mycobacterium tuberculosis
RNPLLARVTELVNVG

SEQ ID NO: 65268 - protein, 15 aa, Mycobacterium tuberculosis
NPLLARVTELVNVGL

SEQ ID NO: 65269 - protein, 15 aa, Mycobacterium tuberculosis
PLLARVTELVNVGLA

SEQ ID NO: 65270 - protein, 15 aa, Mycobacterium tuberculosis
LLARVTELVNVGLAY

SEQ ID NO: 65271 - protein, 15 aa, Mycobacterium tuberculosis
LARVTELVNVGLAYG

SEQ ID NO: 65272 - protein, 15 aa, Mycobacterium tuberculosis
ARVTELVNVGLAYGI

SEQ ID NO: 65273 - protein, 15 aa, Mycobacterium tuberculosis
RVTELVNVGLAYGIH

SEQ ID NO: 65274 - protein, 15 aa, Mycobacterium tuberculosis
VTELVNVGLAYGIHV

SEQ ID NO: 65275 - protein, 15 aa, Mycobacterium tuberculosis
TELVNVGLAYGIHVI

SEQ ID NO: 65276 - protein, 15 aa, Mycobacterium tuberculosis
ELVNVGLAYGIHVII

SEQ ID NO: 65277 - protein, 15 aa, Mycobacterium tuberculosis
LVNVGLAYGIHVIIT

SEQ ID NO: 65278 - protein, 15 aa, Mycobacterium tuberculosis
VNVGLAYGIHVIITT

SEQ ID NO: 65279 - protein, 15 aa, Mycobacterium tuberculosis
NVGLAYGIHVIITTP

SEQ ID NO: 65280 - protein, 15 aa, Mycobacterium tuberculosis
VGLAYGIHVIITTPS

SEQ ID NO: 65281 - protein, 15 aa, Mycobacterium tuberculosis
GLAYGIHVIITTPSW

SEQ ID NO: 65282 - protein, 15 aa, Mycobacterium tuberculosis
LAYGIHVIITTPSWL

SEQ ID NO: 65283 - protein, 15 aa, Mycobacterium tuberculosis
AYGIHVIITTPSWLE

SEQ ID NO: 65284 - protein, 15 aa, Mycobacterium tuberculosis
YGIHVIITTPSWLEV

SEQ ID NO: 65285 - protein, 15 aa, Mycobacterium tuberculosis
GIHVIITTPSWLEVP

SEQ ID NO: 65286 - protein, 15 aa, Mycobacterium tuberculosis
IHVIITTPSWLEVPL

SEQ ID NO: 65287 - protein, 15 aa, Mycobacterium tuberculosis
HVIITTPSWLEVPLA

SEQ ID NO: 65288 - protein, 15 aa, Mycobacterium tuberculosis
VIITTPSWLEVPLAM

SEQ ID NO: 65289 - protein, 15 aa, Mycobacterium tuberculosis
IITTPSWLEVPLAMR

SEQ ID NO: 65290 - protein, 15 aa, Mycobacterium tuberculosis
ITTPSWLEVPLAMRD

SEQ ID NO: 65291 - protein, 15 aa, Mycobacterium tuberculosis
TTPSWLEVPLAMRDG

SEQ ID NO: 65292 - protein, 15 aa, Mycobacterium tuberculosis
TPSWLEVPLAMRDGL

SEQ ID NO: 65293 - protein, 15 aa, Mycobacterium tuberculosis
PSWLEVPLAMRDGLG

SEQ ID NO: 65294 - protein, 15 aa, Mycobacterium tuberculosis
SWLEVPLAMRDGLGL

SEQ ID NO: 65295 - protein, 15 aa, Mycobacterium tuberculosis
WLEVPLAMRDGLGLR

SEQ ID NO: 65296 - protein, 15 aa, Mycobacterium tuberculosis
LEVPLAMRDGLGLRL

SEQ ID NO: 65297 - protein, 15 aa, Mycobacterium tuberculosis
EVPLAMRDGLGLRLE

SEQ ID NO: 65298 - protein, 15 aa, Mycobacterium tuberculosis
VPLAMRDGLGLRLEL

SEQ ID NO: 65299 - protein, 15 aa, Mycobacterium tuberculosis
PLAMRDGLGLRLELR

SEQ ID NO: 65300 - protein, 15 aa, Mycobacterium tuberculosis
LAMRDGLGLRLELRL

SEQ ID NO: 65301 - protein, 15 aa, Mycobacterium tuberculosis
AMRDGLGLRLELRLH

SEQ ID NO: 65302 - protein, 15 aa, Mycobacterium tuberculosis
MRDGLGLRLELRLHD

SEQ ID NO: 65303 - protein, 15 aa, Mycobacterium tuberculosis
RDGLGLRLELRLHDA

SEQ ID NO: 65304 - protein, 15 aa, Mycobacterium tuberculosis
DGLGLRLELRLHDAR

SEQ ID NO: 65305 - protein, 15 aa, Mycobacterium tuberculosis
GLGLRLELRLHDARD

SEQ ID NO: 65306 - protein, 15 aa, Mycobacterium tuberculosis
LGLRLELRLHDARDS

SEQ ID NO: 65307 - protein, 15 aa, Mycobacterium tuberculosis
GLRLELRLHDARDSN

SEQ ID NO: 65308 - protein, 15 aa, Mycobacterium tuberculosis
LRLELRLHDARDSNV

SEQ ID NO: 65309 - protein, 15 aa, Mycobacterium tuberculosis
RLELRLHDARDSNVR

SEQ ID NO: 65310 - protein, 15 aa, Mycobacterium tuberculosis
LELRLHDARDSNVRV

SEQ ID NO: 65311 - protein, 15 aa, Mycobacterium tuberculosis
ELRLHDARDSNVRVV

SEQ ID NO: 65312 - protein, 15 aa, Mycobacterium tuberculosis
LRLHDARDSNVRVVG

SEQ ID NO: 65313 - protein, 15 aa, Mycobacterium tuberculosis
RLHDARDSNVRVVGA

SEQ ID NO: 65314 - protein, 15 aa, Mycobacterium tuberculosis
LHDARDSNVRVVGAL

SEQ ID NO: 65315 - protein, 15 aa, Mycobacterium tuberculosis
HDARDSNVRVVGALR

SEQ ID NO: 65316 - protein, 15 aa, Mycobacterium tuberculosis
DARDSNVRVVGALRR

SEQ ID NO: 65317 - protein, 15 aa, Mycobacterium tuberculosis
ARDSNVRVVGALRRP

SEQ ID NO: 65318 - protein, 15 aa, Mycobacterium tuberculosis
RDSNVRVVGALRRPA

SEQ ID NO: 65319 - protein, 15 aa, Mycobacterium tuberculosis
DSNVRVVGALRRPAD

SEQ ID NO: 65320 - protein, 15 aa, Mycobacterium tuberculosis
SNVRVVGALRRPADA

SEQ ID NO: 65321 - protein, 15 aa, Mycobacterium tuberculosis
NVRVVGALRRPADAV

SEQ ID NO: 65322 - protein, 15 aa, Mycobacterium tuberculosis
VRVVGALRRPADAVP

SEQ ID NO: 65323 - protein, 15 aa, Mycobacterium tuberculosis
RVVGALRRPADAVPH

SEQ ID NO: 65324 - protein, 15 aa, Mycobacterium tuberculosis
VVGALRRPADAVPHD

SEQ ID NO: 65325 - protein, 15 aa, Mycobacterium tuberculosis
VGALRRPADAVPHDQ

SEQ ID NO: 65326 - protein, 15 aa, Mycobacterium tuberculosis
GALRRPADAVPHDQP

SEQ ID NO: 65327 - protein, 15 aa, Mycobacterium tuberculosis
ALRRPADAVPHDQPG

SEQ ID NO: 65328 - protein, 15 aa, Mycobacterium tuberculosis
LRRPADAVPHDQPGR

SEQ ID NO: 65329 - protein, 15 aa, Mycobacterium tuberculosis
RRPADAVPHDQPGRG

SEQ ID NO: 65330 - protein, 15 aa, Mycobacterium tuberculosis
RPADAVPHDQPGRGL

SEQ ID NO: 65331 - protein, 15 aa, Mycobacterium tuberculosis
PADAVPHDQPGRGLT

SEQ ID NO: 65332 - protein, 15 aa, Mycobacterium tuberculosis
ADAVPHDQPGRGLTM

SEQ ID NO: 65333 - protein, 15 aa, Mycobacterium tuberculosis
DAVPHDQPGRGLTMA

SEQ ID NO: 65334 - protein, 15 aa, Mycobacterium tuberculosis
AVPHDQPGRGLTMAA

SEQ ID NO: 65335 - protein, 15 aa, Mycobacterium tuberculosis
VPHDQPGRGLTMAAE

SEQ ID NO: 65336 - protein, 15 aa, Mycobacterium tuberculosis
PHDQPGRGLTMAAEH

SEQ ID NO: 65337 - protein, 15 aa, Mycobacterium tuberculosis
HDQPGRGLTMAAEHF

SEQ ID NO: 65338 - protein, 15 aa, Mycobacterium tuberculosis
DQPGRGLTMAAEHFL

SEQ ID NO: 65339 - protein, 15 aa, Mycobacterium tuberculosis
QPGRGLTMAAEHFLF

SEQ ID NO: 65340 - protein, 15 aa, Mycobacterium tuberculosis
PGRGLTMAAEHFLFA

SEQ ID NO: 65341 - protein, 15 aa, Mycobacterium tuberculosis
GRGLTMAAEHFLFAA

SEQ ID NO: 65342 - protein, 15 aa, Mycobacterium tuberculosis
RGLTMAAEHFLFAAP

SEQ ID NO: 65343 - protein, 15 aa, Mycobacterium tuberculosis
GLTMAAEHFLFAAPE

SEQ ID NO: 65344 - protein, 15 aa, Mycobacterium tuberculosis
LTMAAEHFLFAAPEL

SEQ ID NO: 65345 - protein, 15 aa, Mycobacterium tuberculosis
TMAAEHFLFAAPELD

SEQ ID NO: 65346 - protein, 15 aa, Mycobacterium tuberculosis
MAAEHFLFAAPELDA

SEQ ID NO: 65347 - protein, 15 aa, Mycobacterium tuberculosis
AAEHFLFAAPELDAQ

SEQ ID NO: 65348 - protein, 15 aa, Mycobacterium tuberculosis
AEHFLFAAPELDAQT

SEQ ID NO: 65349 - protein, 15 aa, Mycobacterium tuberculosis
EHFLFAAPELDAQTN

SEQ ID NO: 65350 - protein, 15 aa, Mycobacterium tuberculosis
HFLFAAPELDAQTNP

SEQ ID NO: 65351 - protein, 15 aa, Mycobacterium tuberculosis
FLFAAPELDAQTNPV

SEQ ID NO: 65352 - protein, 15 aa, Mycobacterium tuberculosis
LFAAPELDAQTNPVA

SEQ ID NO: 65353 - protein, 15 aa, Mycobacterium tuberculosis
FAAPELDAQTNPVAA

SEQ ID NO: 65354 - protein, 15 aa, Mycobacterium tuberculosis
AAPELDAQTNPVAAI

SEQ ID NO: 65355 - protein, 15 aa, Mycobacterium tuberculosis
APELDAQTNPVAAIN

SEQ ID NO: 65356 - protein, 15 aa, Mycobacterium tuberculosis
PELDAQTNPVAAINA

SEQ ID NO: 65357 - protein, 15 aa, Mycobacterium tuberculosis
ELDAQTNPVAAINAR

SEQ ID NO: 65358 - protein, 15 aa, Mycobacterium tuberculosis
LDAQTNPVAAINARY

SEQ ID NO: 65359 - protein, 15 aa, Mycobacterium tuberculosis
DAQTNPVAAINARYP

SEQ ID NO: 65360 - protein, 15 aa, Mycobacterium tuberculosis
AQTNPVAAINARYPG

SEQ ID NO: 65361 - protein, 15 aa, Mycobacterium tuberculosis
QTNPVAAINARYPGM

SEQ ID NO: 65362 - protein, 15 aa, Mycobacterium tuberculosis
TNPVAAINARYPGMA

SEQ ID NO: 65363 - protein, 15 aa, Mycobacterium tuberculosis
NPVAAINARYPGMAA

SEQ ID NO: 65364 - protein, 15 aa, Mycobacterium tuberculosis
PVAAINARYPGMAAP

SEQ ID NO: 65365 - protein, 15 aa, Mycobacterium tuberculosis
VAAINARYPGMAAPP

SEQ ID NO: 65366 - protein, 15 aa, Mycobacterium tuberculosis
AAINARYPGMAAPPV

SEQ ID NO: 65367 - protein, 15 aa, Mycobacterium tuberculosis
AINARYPGMAAPPVR

SEQ ID NO: 65368 - protein, 15 aa, Mycobacterium tuberculosis
INARYPGMAAPPVRL

SEQ ID NO: 65369 - protein, 15 aa, Mycobacterium tuberculosis
NARYPGMAAPPVRLL

SEQ ID NO: 65370 - protein, 15 aa, Mycobacterium tuberculosis
ARYPGMAAPPVRLLP

SEQ ID NO: 65371 - protein, 15 aa, Mycobacterium tuberculosis
RYPGMAAPPVRLLPT

SEQ ID NO: 65372 - protein, 15 aa, Mycobacterium tuberculosis
YPGMAAPPVRLLPTN

SEQ ID NO: 65373 - protein, 15 aa, Mycobacterium tuberculosis
PGMAAPPVRLLPTNL

SEQ ID NO: 65374 - protein, 15 aa, Mycobacterium tuberculosis
GMAAPPVRLLPTNLA

SEQ ID NO: 65375 - protein, 15 aa, Mycobacterium tuberculosis
MAAPPVRLLPTNLAP

SEQ ID NO: 65376 - protein, 15 aa, Mycobacterium tuberculosis
AAPPVRLLPTNLAPH

SEQ ID NO: 65377 - protein, 15 aa, Mycobacterium tuberculosis
APPVRLLPTNLAPHA

SEQ ID NO: 65378 - protein, 15 aa, Mycobacterium tuberculosis
PPVRLLPTNLAPHAV

SEQ ID NO: 65379 - protein, 15 aa, Mycobacterium tuberculosis
PVRLLPTNLAPHAVG

SEQ ID NO: 65380 - protein, 15 aa, Mycobacterium tuberculosis
VRLLPTNLAPHAVGE

SEQ ID NO: 65381 - protein, 15 aa, Mycobacterium tuberculosis
RLLPTNLAPHAVGEL

SEQ ID NO: 65382 - protein, 15 aa, Mycobacterium tuberculosis
LLPTNLAPHAVGELY

SEQ ID NO: 65383 - protein, 15 aa, Mycobacterium tuberculosis
LPTNLAPHAVGELYR

SEQ ID NO: 65384 - protein, 15 aa, Mycobacterium tuberculosis
PTNLAPHAVGELYRG

SEQ ID NO: 65385 - protein, 15 aa, Mycobacterium tuberculosis
TNLAPHAVGELYRGP

SEQ ID NO: 65386 - protein, 15 aa, Mycobacterium tuberculosis
NLAPHAVGELYRGPD

SEQ ID NO: 65387 - protein, 15 aa, Mycobacterium tuberculosis
LAPHAVGELYRGPDQ

SEQ ID NO: 65388 - protein, 15 aa, Mycobacterium tuberculosis
APHAVGELYRGPDQL

SEQ ID NO: 65389 - protein, 15 aa, Mycobacterium tuberculosis
PHAVGELYRGPDQLV

SEQ ID NO: 65390 - protein, 15 aa, Mycobacterium tuberculosis
HAVGELYRGPDQLVI

SEQ ID NO: 65391 - protein, 15 aa, Mycobacterium tuberculosis
AVGELYRGPDQLVIG

SEQ ID NO: 65392 - protein, 15 aa, Mycobacterium tuberculosis
VGELYRGPDQLVIGQ

SEQ ID NO: 65393 - protein, 15 aa, Mycobacterium tuberculosis
GELYRGPDQLVIGQR

SEQ ID NO: 65394 - protein, 15 aa, Mycobacterium tuberculosis
ELYRGPDQLVIGQRE

SEQ ID NO: 65395 - protein, 15 aa, Mycobacterium tuberculosis
LYRGPDQLVIGQREE

SEQ ID NO: 65396 - protein, 15 aa, Mycobacterium tuberculosis
YRGPDQLVIGQREED

SEQ ID NO: 65397 - protein, 15 aa, Mycobacterium tuberculosis
RGPDQLVIGQREEDL

SEQ ID NO: 65398 - protein, 15 aa, Mycobacterium tuberculosis
GPDQLVIGQREEDLA

SEQ ID NO: 65399 - protein, 15 aa, Mycobacterium tuberculosis
PDQLVIGQREEDLAP

SEQ ID NO: 65400 - protein, 15 aa, Mycobacterium tuberculosis
DQLVIGQREEDLAPV

SEQ ID NO: 65401 - protein, 15 aa, Mycobacterium tuberculosis
QLVIGQREEDLAPVI

SEQ ID NO: 65402 - protein, 15 aa, Mycobacterium tuberculosis
LVIGQREEDLAPVIL

SEQ ID NO: 65403 - protein, 15 aa, Mycobacterium tuberculosis
VIGQREEDLAPVILD

SEQ ID NO: 65404 - protein, 15 aa, Mycobacterium tuberculosis
IGQREEDLAPVILDL

SEQ ID NO: 65405 - protein, 15 aa, Mycobacterium tuberculosis
GQREEDLAPVILDLA

SEQ ID NO: 65406 - protein, 15 aa, Mycobacterium tuberculosis
QREEDLAPVILDLAA

SEQ ID NO: 65407 - protein, 15 aa, Mycobacterium tuberculosis
REEDLAPVILDLAAN

SEQ ID NO: 65408 - protein, 15 aa, Mycobacterium tuberculosis
EEDLAPVILDLAANP

SEQ ID NO: 65409 - protein, 15 aa, Mycobacterium tuberculosis
EDLAPVILDLAANPL

SEQ ID NO: 65410 - protein, 15 aa, Mycobacterium tuberculosis
DLAPVILDLAANPLL

SEQ ID NO: 65411 - protein, 15 aa, Mycobacterium tuberculosis
LAPVILDLAANPLLM

SEQ ID NO: 65412 - protein, 15 aa, Mycobacterium tuberculosis
APVILDLAANPLLMV

SEQ ID NO: 65413 - protein, 15 aa, Mycobacterium tuberculosis
PVILDLAANPLLMVF

SEQ ID NO: 65414 - protein, 15 aa, Mycobacterium tuberculosis
VILDLAANPLLMVFG

SEQ ID NO: 65415 - protein, 15 aa, Mycobacterium tuberculosis
ILDLAANPLLMVFGD

SEQ ID NO: 65416 - protein, 15 aa, Mycobacterium tuberculosis
LDLAANPLLMVFGDA

SEQ ID NO: 65417 - protein, 15 aa, Mycobacterium tuberculosis
DLAANPLLMVFGDAR

SEQ ID NO: 65418 - protein, 15 aa, Mycobacterium tuberculosis
LAANPLLMVFGDARS

SEQ ID NO: 65419 - protein, 15 aa, Mycobacterium tuberculosis
AANPLLMVFGDARSG

SEQ ID NO: 65420 - protein, 15 aa, Mycobacterium tuberculosis
ANPLLMVFGDARSGK

SEQ ID NO: 65421 - protein, 15 aa, Mycobacterium tuberculosis
NPLLMVFGDARSGKT

SEQ ID NO: 65422 - protein, 15 aa, Mycobacterium tuberculosis
PLLMVFGDARSGKTT

SEQ ID NO: 65423 - protein, 15 aa, Mycobacterium tuberculosis
LLMVFGDARSGKTTL

SEQ ID NO: 65424 - protein, 15 aa, Mycobacterium tuberculosis
LMVFGDARSGKTTLL

SEQ ID NO: 65425 - protein, 15 aa, Mycobacterium tuberculosis
MVFGDARSGKTTLLR

SEQ ID NO: 65426 - protein, 15 aa, Mycobacterium tuberculosis
VFGDARSGKTTLLRH

SEQ ID NO: 65427 - protein, 15 aa, Mycobacterium tuberculosis
FGDARSGKTTLLRHI

SEQ ID NO: 65428 - protein, 15 aa, Mycobacterium tuberculosis
GDARSGKTTLLRHII

SEQ ID NO: 65429 - protein, 15 aa, Mycobacterium tuberculosis
DARSGKTTLLRHIIR

SEQ ID NO: 65430 - protein, 15 aa, Mycobacterium tuberculosis
ARSGKTTLLRHIIRT

SEQ ID NO: 65431 - protein, 15 aa, Mycobacterium tuberculosis
RSGKTTLLRHIIRTV

SEQ ID NO: 65432 - protein, 15 aa, Mycobacterium tuberculosis
SGKTTLLRHIIRTVR

SEQ ID NO: 65433 - protein, 15 aa, Mycobacterium tuberculosis
GKTTLLRHIIRTVRE

SEQ ID NO: 65434 - protein, 15 aa, Mycobacterium tuberculosis
KTTLLRHIIRTVREH

SEQ ID NO: 65435 - protein, 15 aa, Mycobacterium tuberculosis
TTLLRHIIRTVREHS

SEQ ID NO: 65436 - protein, 15 aa, Mycobacterium tuberculosis
TLLRHIIRTVREHST

SEQ ID NO: 65437 - protein, 15 aa, Mycobacterium tuberculosis
LLRHIIRTVREHSTA

SEQ ID NO: 65438 - protein, 15 aa, Mycobacterium tuberculosis
LRHIIRTVREHSTAD

SEQ ID NO: 65439 - protein, 15 aa, Mycobacterium tuberculosis
RHIIRTVREHSTADR

SEQ ID NO: 65440 - protein, 15 aa, Mycobacterium tuberculosis
HIIRTVREHSTADRV

SEQ ID NO: 65441 - protein, 15 aa, Mycobacterium tuberculosis
IIRTVREHSTADRVA

SEQ ID NO: 65442 - protein, 15 aa, Mycobacterium tuberculosis
IRTVREHSTADRVAF

SEQ ID NO: 65443 - protein, 15 aa, Mycobacterium tuberculosis
RTVREHSTADRVAFT

SEQ ID NO: 65444 - protein, 15 aa, Mycobacterium tuberculosis
TVREHSTADRVAFTV

SEQ ID NO: 65445 - protein, 15 aa, Mycobacterium tuberculosis
VREHSTADRVAFTVL

SEQ ID NO: 65446 - protein, 15 aa, Mycobacterium tuberculosis
REHSTADRVAFTVLD

SEQ ID NO: 65447 - protein, 15 aa, Mycobacterium tuberculosis
EHSTADRVAFTVLDR

SEQ ID NO: 65448 - protein, 15 aa, Mycobacterium tuberculosis
HSTADRVAFTVLDRR

SEQ ID NO: 65449 - protein, 15 aa, Mycobacterium tuberculosis
STADRVAFTVLDRRL

SEQ ID NO: 65450 - protein, 15 aa, Mycobacterium tuberculosis
TADRVAFTVLDRRLH

SEQ ID NO: 65451 - protein, 15 aa, Mycobacterium tuberculosis
ADRVAFTVLDRRLHL

SEQ ID NO: 65452 - protein, 15 aa, Mycobacterium tuberculosis
DRVAFTVLDRRLHLV

SEQ ID NO: 65453 - protein, 15 aa, Mycobacterium tuberculosis
RVAFTVLDRRLHLVD

SEQ ID NO: 65454 - protein, 15 aa, Mycobacterium tuberculosis
VAFTVLDRRLHLVDE

SEQ ID NO: 65455 - protein, 15 aa, Mycobacterium tuberculosis
AFTVLDRRLHLVDEP

SEQ ID NO: 65456 - protein, 15 aa, Mycobacterium tuberculosis
FTVLDRRLHLVDEPL

SEQ ID NO: 65457 - protein, 15 aa, Mycobacterium tuberculosis
TVLDRRLHLVDEPLF

SEQ ID NO: 65458 - protein, 15 aa, Mycobacterium tuberculosis
VLDRRLHLVDEPLFP

SEQ ID NO: 65459 - protein, 15 aa, Mycobacterium tuberculosis
LDRRLHLVDEPLFPD

SEQ ID NO: 65460 - protein, 15 aa, Mycobacterium tuberculosis
DRRLHLVDEPLFPDN

SEQ ID NO: 65461 - protein, 15 aa, Mycobacterium tuberculosis
RRLHLVDEPLFPDNE

SEQ ID NO: 65462 - protein, 15 aa, Mycobacterium tuberculosis
RLHLVDEPLFPDNEY

SEQ ID NO: 65463 - protein, 15 aa, Mycobacterium tuberculosis
LHLVDEPLFPDNEYT

SEQ ID NO: 65464 - protein, 15 aa, Mycobacterium tuberculosis
HLVDEPLFPDNEYTA

SEQ ID NO: 65465 - protein, 15 aa, Mycobacterium tuberculosis
LVDEPLFPDNEYTAN

SEQ ID NO: 65466 - protein, 15 aa, Mycobacterium tuberculosis
VDEPLFPDNEYTANI

SEQ ID NO: 65467 - protein, 15 aa, Mycobacterium tuberculosis
DEPLFPDNEYTANID

SEQ ID NO: 65468 - protein, 15 aa, Mycobacterium tuberculosis
EPLFPDNEYTANIDR

SEQ ID NO: 65469 - protein, 15 aa, Mycobacterium tuberculosis
PLFPDNEYTANIDRI

SEQ ID NO: 65470 - protein, 15 aa, Mycobacterium tuberculosis
LFPDNEYTANIDRII

SEQ ID NO: 65471 - protein, 15 aa, Mycobacterium tuberculosis
FPDNEYTANIDRIIP

SEQ ID NO: 65472 - protein, 15 aa, Mycobacterium tuberculosis
PDNEYTANIDRIIPA

SEQ ID NO: 65473 - protein, 15 aa, Mycobacterium tuberculosis
DNEYTANIDRIIPAM

SEQ ID NO: 65474 - protein, 15 aa, Mycobacterium tuberculosis
NEYTANIDRIIPAML

SEQ ID NO: 65475 - protein, 15 aa, Mycobacterium tuberculosis
EYTANIDRIIPAMLG

SEQ ID NO: 65476 - protein, 15 aa, Mycobacterium tuberculosis
YTANIDRIIPAMLGL

SEQ ID NO: 65477 - protein, 15 aa, Mycobacterium tuberculosis
TANIDRIIPAMLGLA

SEQ ID NO: 65478 - protein, 15 aa, Mycobacterium tuberculosis
ANIDRIIPAMLGLAN

SEQ ID NO: 65479 - protein, 15 aa, Mycobacterium tuberculosis
NIDRIIPAMLGLANL

SEQ ID NO: 65480 - protein, 15 aa, Mycobacterium tuberculosis
IDRIIPAMLGLANLI

SEQ ID NO: 65481 - protein, 15 aa, Mycobacterium tuberculosis
DRIIPAMLGLANLIE

SEQ ID NO: 65482 - protein, 15 aa, Mycobacterium tuberculosis
RIIPAMLGLANLIEA

SEQ ID NO: 65483 - protein, 15 aa, Mycobacterium tuberculosis
IIPAMLGLANLIEAR

SEQ ID NO: 65484 - protein, 15 aa, Mycobacterium tuberculosis
IPAMLGLANLIEARR

SEQ ID NO: 65485 - protein, 15 aa, Mycobacterium tuberculosis
PAMLGLANLIEARRP

SEQ ID NO: 65486 - protein, 15 aa, Mycobacterium tuberculosis
AMLGLANLIEARRPP

SEQ ID NO: 65487 - protein, 15 aa, Mycobacterium tuberculosis
MLGLANLIEARRPPA

SEQ ID NO: 65488 - protein, 15 aa, Mycobacterium tuberculosis
LGLANLIEARRPPAG

SEQ ID NO: 65489 - protein, 15 aa, Mycobacterium tuberculosis
GLANLIEARRPPAGM

SEQ ID NO: 65490 - protein, 15 aa, Mycobacterium tuberculosis
LANLIEARRPPAGMS

SEQ ID NO: 65491 - protein, 15 aa, Mycobacterium tuberculosis
ANLIEARRPPAGMSA

SEQ ID NO: 65492 - protein, 15 aa, Mycobacterium tuberculosis
NLIEARRPPAGMSAA

SEQ ID NO: 65493 - protein, 15 aa, Mycobacterium tuberculosis
LIEARRPPAGMSAAE

SEQ ID NO: 65494 - protein, 15 aa, Mycobacterium tuberculosis
IEARRPPAGMSAAEL

SEQ ID NO: 65495 - protein, 15 aa, Mycobacterium tuberculosis
EARRPPAGMSAAELS

SEQ ID NO: 65496 - protein, 15 aa, Mycobacterium tuberculosis
ARRPPAGMSAAELSR

SEQ ID NO: 65497 - protein, 15 aa, Mycobacterium tuberculosis
RRPPAGMSAAELSRW

SEQ ID NO: 65498 - protein, 15 aa, Mycobacterium tuberculosis
RPPAGMSAAELSRWT

SEQ ID NO: 65499 - protein, 15 aa, Mycobacterium tuberculosis
PPAGMSAAELSRWTF

SEQ ID NO: 65500 - protein, 15 aa, Mycobacterium tuberculosis
PAGMSAAELSRWTFA

SEQ ID NO: 65501 - protein, 15 aa, Mycobacterium tuberculosis
AGMSAAELSRWTFAG

SEQ ID NO: 65502 - protein, 15 aa, Mycobacterium tuberculosis
GMSAAELSRWTFAGH

SEQ ID NO: 65503 - protein, 15 aa, Mycobacterium tuberculosis
MSAAELSRWTFAGHT

SEQ ID NO: 65504 - protein, 15 aa, Mycobacterium tuberculosis
SAAELSRWTFAGHTH

SEQ ID NO: 65505 - protein, 15 aa, Mycobacterium tuberculosis
AAELSRWTFAGHTHY

SEQ ID NO: 65506 - protein, 15 aa, Mycobacterium tuberculosis
AELSRWTFAGHTHYL

SEQ ID NO: 65507 - protein, 15 aa, Mycobacterium tuberculosis
ELSRWTFAGHTHYLI

SEQ ID NO: 65508 - protein, 15 aa, Mycobacterium tuberculosis
LSRWTFAGHTHYLII

SEQ ID NO: 65509 - protein, 15 aa, Mycobacterium tuberculosis
SRWTFAGHTHYLIID

SEQ ID NO: 65510 - protein, 15 aa, Mycobacterium tuberculosis
RWTFAGHTHYLIIDD

SEQ ID NO: 65511 - protein, 15 aa, Mycobacterium tuberculosis
WTFAGHTHYLIIDDV

SEQ ID NO: 65512 - protein, 15 aa, Mycobacterium tuberculosis
TFAGHTHYLIIDDVD

SEQ ID NO: 65513 - protein, 15 aa, Mycobacterium tuberculosis
FAGHTHYLIIDDVDQ

SEQ ID NO: 65514 - protein, 15 aa, Mycobacterium tuberculosis
AGHTHYLIIDDVDQV

SEQ ID NO: 65515 - protein, 15 aa, Mycobacterium tuberculosis
GHTHYLIIDDVDQVP

SEQ ID NO: 65516 - protein, 15 aa, Mycobacterium tuberculosis
HTHYLIIDDVDQVPD

SEQ ID NO: 65517 - protein, 15 aa, Mycobacterium tuberculosis
THYLIIDDVDQVPDS

SEQ ID NO: 65518 - protein, 15 aa, Mycobacterium tuberculosis
HYLIIDDVDQVPDSP

SEQ ID NO: 65519 - protein, 15 aa, Mycobacterium tuberculosis
YLIIDDVDQVPDSPA

SEQ ID NO: 65520 - protein, 15 aa, Mycobacterium tuberculosis
LIIDDVDQVPDSPAM

SEQ ID NO: 65521 - protein, 15 aa, Mycobacterium tuberculosis
IIDDVDQVPDSPAMT

SEQ ID NO: 65522 - protein, 15 aa, Mycobacterium tuberculosis
IDDVDQVPDSPAMTG

SEQ ID NO: 65523 - protein, 15 aa, Mycobacterium tuberculosis
DDVDQVPDSPAMTGP

SEQ ID NO: 65524 - protein, 15 aa, Mycobacterium tuberculosis
DVDQVPDSPAMTGPY

SEQ ID NO: 65525 - protein, 15 aa, Mycobacterium tuberculosis
VDQVPDSPAMTGPYI

SEQ ID NO: 65526 - protein, 15 aa, Mycobacterium tuberculosis
DQVPDSPAMTGPYIG

SEQ ID NO: 65527 - protein, 15 aa, Mycobacterium tuberculosis
QVPDSPAMTGPYIGQ

SEQ ID NO: 65528 - protein, 15 aa, Mycobacterium tuberculosis
VPDSPAMTGPYIGQR

SEQ ID NO: 65529 - protein, 15 aa, Mycobacterium tuberculosis
PDSPAMTGPYIGQRP

SEQ ID NO: 65530 - protein, 15 aa, Mycobacterium tuberculosis
DSPAMTGPYIGQRPW

SEQ ID NO: 65531 - protein, 15 aa, Mycobacterium tuberculosis
SPAMTGPYIGQRPWT

SEQ ID NO: 65532 - protein, 15 aa, Mycobacterium tuberculosis
PAMTGPYIGQRPWTP

SEQ ID NO: 65533 - protein, 15 aa, Mycobacterium tuberculosis
AMTGPYIGQRPWTPL

SEQ ID NO: 65534 - protein, 15 aa, Mycobacterium tuberculosis
MTGPYIGQRPWTPLI

SEQ ID NO: 65535 - protein, 15 aa, Mycobacterium tuberculosis
TGPYIGQRPWTPLIG

SEQ ID NO: 65536 - protein, 15 aa, Mycobacterium tuberculosis
GPYIGQRPWTPLIGL

SEQ ID NO: 65537 - protein, 15 aa, Mycobacterium tuberculosis
PYIGQRPWTPLIGLL

SEQ ID NO: 65538 - protein, 15 aa, Mycobacterium tuberculosis
YIGQRPWTPLIGLLA

SEQ ID NO: 65539 - protein, 15 aa, Mycobacterium tuberculosis
IGQRPWTPLIGLLAQ

SEQ ID NO: 65540 - protein, 15 aa, Mycobacterium tuberculosis
GQRPWTPLIGLLAQA

SEQ ID NO: 65541 - protein, 15 aa, Mycobacterium tuberculosis
QRPWTPLIGLLAQAG

SEQ ID NO: 65542 - protein, 15 aa, Mycobacterium tuberculosis
RPWTPLIGLLAQAGD

SEQ ID NO: 65543 - protein, 15 aa, Mycobacterium tuberculosis
PWTPLIGLLAQAGDL

SEQ ID NO: 65544 - protein, 15 aa, Mycobacterium tuberculosis
WTPLIGLLAQAGDLG

SEQ ID NO: 65545 - protein, 15 aa, Mycobacterium tuberculosis
TPLIGLLAQAGDLGL

SEQ ID NO: 65546 - protein, 15 aa, Mycobacterium tuberculosis
PLIGLLAQAGDLGLR

SEQ ID NO: 65547 - protein, 15 aa, Mycobacterium tuberculosis
LIGLLAQAGDLGLRV

SEQ ID NO: 65548 - protein, 15 aa, Mycobacterium tuberculosis
IGLLAQAGDLGLRVI

SEQ ID NO: 65549 - protein, 15 aa, Mycobacterium tuberculosis
GLLAQAGDLGLRVIV

SEQ ID NO: 65550 - protein, 15 aa, Mycobacterium tuberculosis
LLAQAGDLGLRVIVT

SEQ ID NO: 65551 - protein, 15 aa, Mycobacterium tuberculosis
LAQAGDLGLRVIVTG

SEQ ID NO: 65552 - protein, 15 aa, Mycobacterium tuberculosis
AQAGDLGLRVIVTGR

SEQ ID NO: 65553 - protein, 15 aa, Mycobacterium tuberculosis
QAGDLGLRVIVTGRA

SEQ ID NO: 65554 - protein, 15 aa, Mycobacterium tuberculosis
AGDLGLRVIVTGRAT

SEQ ID NO: 65555 - protein, 15 aa, Mycobacterium tuberculosis
GDLGLRVIVTGRATG

SEQ ID NO: 65556 - protein, 15 aa, Mycobacterium tuberculosis
DLGLRVIVTGRATGS

SEQ ID NO: 65557 - protein, 15 aa, Mycobacterium tuberculosis
LGLRVIVTGRATGSA

SEQ ID NO: 65558 - protein, 15 aa, Mycobacterium tuberculosis
GLRVIVTGRATGSAH

SEQ ID NO: 65559 - protein, 15 aa, Mycobacterium tuberculosis
LRVIVTGRATGSAHL

SEQ ID NO: 65560 - protein, 15 aa, Mycobacterium tuberculosis
RVIVTGRATGSAHLL

SEQ ID NO: 65561 - protein, 15 aa, Mycobacterium tuberculosis
VIVTGRATGSAHLLM

SEQ ID NO: 65562 - protein, 15 aa, Mycobacterium tuberculosis
IVTGRATGSAHLLMT

SEQ ID NO: 65563 - protein, 15 aa, Mycobacterium tuberculosis
VTGRATGSAHLLMTS

SEQ ID NO: 65564 - protein, 15 aa, Mycobacterium tuberculosis
TGRATGSAHLLMTSP

SEQ ID NO: 65565 - protein, 15 aa, Mycobacterium tuberculosis
GRATGSAHLLMTSPL

SEQ ID NO: 65566 - protein, 15 aa, Mycobacterium tuberculosis
RATGSAHLLMTSPLL

SEQ ID NO: 65567 - protein, 15 aa, Mycobacterium tuberculosis
ATGSAHLLMTSPLLR

SEQ ID NO: 65568 - protein, 15 aa, Mycobacterium tuberculosis
TGSAHLLMTSPLLRR

SEQ ID NO: 65569 - protein, 15 aa, Mycobacterium tuberculosis
GSAHLLMTSPLLRRF

SEQ ID NO: 65570 - protein, 15 aa, Mycobacterium tuberculosis
SAHLLMTSPLLRRFN

SEQ ID NO: 65571 - protein, 15 aa, Mycobacterium tuberculosis
AHLLMTSPLLRRFND

SEQ ID NO: 65572 - protein, 15 aa, Mycobacterium tuberculosis
HLLMTSPLLRRFNDL

SEQ ID NO: 65573 - protein, 15 aa, Mycobacterium tuberculosis
LLMTSPLLRRFNDLQ

SEQ ID NO: 65574 - protein, 15 aa, Mycobacterium tuberculosis
LMTSPLLRRFNDLQA

SEQ ID NO: 65575 - protein, 15 aa, Mycobacterium tuberculosis
MTSPLLRRFNDLQAT

SEQ ID NO: 65576 - protein, 15 aa, Mycobacterium tuberculosis
TSPLLRRFNDLQATT

SEQ ID NO: 65577 - protein, 15 aa, Mycobacterium tuberculosis
SPLLRRFNDLQATTL

SEQ ID NO: 65578 - protein, 15 aa, Mycobacterium tuberculosis
PLLRRFNDLQATTLM

SEQ ID NO: 65579 - protein, 15 aa, Mycobacterium tuberculosis
LLRRFNDLQATTLML

SEQ ID NO: 65580 - protein, 15 aa, Mycobacterium tuberculosis
LRRFNDLQATTLMLA

SEQ ID NO: 65581 - protein, 15 aa, Mycobacterium tuberculosis
RRFNDLQATTLMLAG

SEQ ID NO: 65582 - protein, 15 aa, Mycobacterium tuberculosis
RFNDLQATTLMLAGN

SEQ ID NO: 65583 - protein, 15 aa, Mycobacterium tuberculosis
FNDLQATTLMLAGNP

SEQ ID NO: 65584 - protein, 15 aa, Mycobacterium tuberculosis
NDLQATTLMLAGNPA

SEQ ID NO: 65585 - protein, 15 aa, Mycobacterium tuberculosis
DLQATTLMLAGNPAD

SEQ ID NO: 65586 - protein, 15 aa, Mycobacterium tuberculosis
LQATTLMLAGNPADS

SEQ ID NO: 65587 - protein, 15 aa, Mycobacterium tuberculosis
QATTLMLAGNPADSG

SEQ ID NO: 65588 - protein, 15 aa, Mycobacterium tuberculosis
ATTLMLAGNPADSGK

SEQ ID NO: 65589 - protein, 15 aa, Mycobacterium tuberculosis
TTLMLAGNPADSGKI

SEQ ID NO: 65590 - protein, 15 aa, Mycobacterium tuberculosis
TLMLAGNPADSGKIR

SEQ ID NO: 65591 - protein, 15 aa, Mycobacterium tuberculosis
LMLAGNPADSGKIRG

SEQ ID NO: 65592 - protein, 15 aa, Mycobacterium tuberculosis
MLAGNPADSGKIRGE

SEQ ID NO: 65593 - protein, 15 aa, Mycobacterium tuberculosis
LAGNPADSGKIRGER

SEQ ID NO: 65594 - protein, 15 aa, Mycobacterium tuberculosis
AGNPADSGKIRGERF

SEQ ID NO: 65595 - protein, 15 aa, Mycobacterium tuberculosis
GNPADSGKIRGERFA

SEQ ID NO: 65596 - protein, 15 aa, Mycobacterium tuberculosis
NPADSGKIRGERFAR

SEQ ID NO: 65597 - protein, 15 aa, Mycobacterium tuberculosis
PADSGKIRGERFARL

SEQ ID NO: 65598 - protein, 15 aa, Mycobacterium tuberculosis
ADSGKIRGERFARLP

SEQ ID NO: 65599 - protein, 15 aa, Mycobacterium tuberculosis
DSGKIRGERFARLPA

SEQ ID NO: 65600 - protein, 15 aa, Mycobacterium tuberculosis
SGKIRGERFARLPAG

SEQ ID NO: 65601 - protein, 15 aa, Mycobacterium tuberculosis
GKIRGERFARLPAGR

SEQ ID NO: 65602 - protein, 15 aa, Mycobacterium tuberculosis
KIRGERFARLPAGRA

SEQ ID NO: 65603 - protein, 15 aa, Mycobacterium tuberculosis
IRGERFARLPAGRAI

SEQ ID NO: 65604 - protein, 15 aa, Mycobacterium tuberculosis
RGERFARLPAGRAIL

SEQ ID NO: 65605 - protein, 15 aa, Mycobacterium tuberculosis
GERFARLPAGRAILL

SEQ ID NO: 65606 - protein, 15 aa, Mycobacterium tuberculosis
ERFARLPAGRAILLT

SEQ ID NO: 65607 - protein, 15 aa, Mycobacterium tuberculosis
RFARLPAGRAILLTD

SEQ ID NO: 65608 - protein, 15 aa, Mycobacterium tuberculosis
FARLPAGRAILLTDS

SEQ ID NO: 65609 - protein, 15 aa, Mycobacterium tuberculosis
ARLPAGRAILLTDSD

SEQ ID NO: 65610 - protein, 15 aa, Mycobacterium tuberculosis
RLPAGRAILLTDSDS

SEQ ID NO: 65611 - protein, 15 aa, Mycobacterium tuberculosis
LPAGRAILLTDSDSP

SEQ ID NO: 65612 - protein, 15 aa, Mycobacterium tuberculosis
PAGRAILLTDSDSPT

SEQ ID NO: 65613 - protein, 15 aa, Mycobacterium tuberculosis
AGRAILLTDSDSPTY

SEQ ID NO: 65614 - protein, 15 aa, Mycobacterium tuberculosis
GRAILLTDSDSPTYV

SEQ ID NO: 65615 - protein, 15 aa, Mycobacterium tuberculosis
RAILLTDSDSPTYVQ

SEQ ID NO: 65616 - protein, 15 aa, Mycobacterium tuberculosis
AILLTDSDSPTYVQL

SEQ ID NO: 65617 - protein, 15 aa, Mycobacterium tuberculosis
ILLTDSDSPTYVQLI

SEQ ID NO: 65618 - protein, 15 aa, Mycobacterium tuberculosis
LLTDSDSPTYVQLIN

SEQ ID NO: 65619 - protein, 15 aa, Mycobacterium tuberculosis
LTDSDSPTYVQLINP

SEQ ID NO: 65620 - protein, 15 aa, Mycobacterium tuberculosis
TDSDSPTYVQLINPL

SEQ ID NO: 65621 - protein, 15 aa, Mycobacterium tuberculosis
DSDSPTYVQLINPLV

SEQ ID NO: 65622 - protein, 15 aa, Mycobacterium tuberculosis
SDSPTYVQLINPLVD

SEQ ID NO: 65623 - protein, 15 aa, Mycobacterium tuberculosis
DSPTYVQLINPLVDA

SEQ ID NO: 65624 - protein, 15 aa, Mycobacterium tuberculosis
SPTYVQLINPLVDAA

SEQ ID NO: 65625 - protein, 15 aa, Mycobacterium tuberculosis
PTYVQLINPLVDAAA

SEQ ID NO: 65626 - protein, 15 aa, Mycobacterium tuberculosis
TYVQLINPLVDAAAV

SEQ ID NO: 65627 - protein, 15 aa, Mycobacterium tuberculosis
YVQLINPLVDAAAVS

SEQ ID NO: 65628 - protein, 15 aa, Mycobacterium tuberculosis
VQLINPLVDAAAVSG

SEQ ID NO: 65629 - protein, 15 aa, Mycobacterium tuberculosis
QLINPLVDAAAVSGE

SEQ ID NO: 65630 - protein, 15 aa, Mycobacterium tuberculosis
LINPLVDAAAVSGET

SEQ ID NO: 65631 - protein, 15 aa, Mycobacterium tuberculosis
INPLVDAAAVSGETQ

SEQ ID NO: 65632 - protein, 15 aa, Mycobacterium tuberculosis
NPLVDAAAVSGETQQ

SEQ ID NO: 65633 - protein, 15 aa, Mycobacterium tuberculosis
PLVDAAAVSGETQQK

SEQ ID NO: 65634 - protein, 15 aa, Mycobacterium tuberculosis
LVDAAAVSGETQQKG

SEQ ID NO: 65635 - protein, 15 aa, Mycobacterium tuberculosis
VDAAAVSGETQQKGS

SEQ ID NO: 65636 - protein, 15 aa, Mycobacterium tuberculosis
DAAAVSGETQQKGSQ

SEQ ID NO: 65637 - protein, 15 aa, Mycobacterium tuberculosis
AAAVSGETQQKGSQS

SEQ ID NO: 65638 - protein, 16 aa, Mycobacterium tuberculosis
MSRLIFEARRRLAPPS

SEQ ID NO: 65639 - protein, 16 aa, Mycobacterium tuberculosis
SRLIFEARRRLAPPSS

SEQ ID NO: 65640 - protein, 16 aa, Mycobacterium tuberculosis
RLIFEARRRLAPPSSH

SEQ ID NO: 65641 - protein, 16 aa, Mycobacterium tuberculosis
LIFEARRRLAPPSSHQ

SEQ ID NO: 65642 - protein, 16 aa, Mycobacterium tuberculosis
IFEARRRLAPPSSHQG

SEQ ID NO: 65643 - protein, 16 aa, Mycobacterium tuberculosis
FEARRRLAPPSSHQGT

SEQ ID NO: 65644 - protein, 16 aa, Mycobacterium tuberculosis
EARRRLAPPSSHQGTI

SEQ ID NO: 65645 - protein, 16 aa, Mycobacterium tuberculosis
ARRRLAPPSSHQGTII

SEQ ID NO: 65646 - protein, 16 aa, Mycobacterium tuberculosis
RRRLAPPSSHQGTIII

SEQ ID NO: 65647 - protein, 16 aa, Mycobacterium tuberculosis
RRLAPPSSHQGTIIIE

SEQ ID NO: 65648 - protein, 16 aa, Mycobacterium tuberculosis
RLAPPSSHQGTIIIEA

SEQ ID NO: 65649 - protein, 16 aa, Mycobacterium tuberculosis
LAPPSSHQGTIIIEAP

SEQ ID NO: 65650 - protein, 16 aa, Mycobacterium tuberculosis
APPSSHQGTIIIEAPP

SEQ ID NO: 65651 - protein, 16 aa, Mycobacterium tuberculosis
PPSSHQGTIIIEAPPE

SEQ ID NO: 65652 - protein, 16 aa, Mycobacterium tuberculosis
PSSHQGTIIIEAPPEL

SEQ ID NO: 65653 - protein, 16 aa, Mycobacterium tuberculosis
SSHQGTIIIEAPPELP

SEQ ID NO: 65654 - protein, 16 aa, Mycobacterium tuberculosis
SHQGTIIIEAPPELPR

SEQ ID NO: 65655 - protein, 16 aa, Mycobacterium tuberculosis
HQGTIIIEAPPELPRV

SEQ ID NO: 65656 - protein, 16 aa, Mycobacterium tuberculosis
QGTIIIEAPPELPRVI

SEQ ID NO: 65657 - protein, 16 aa, Mycobacterium tuberculosis
GTIIIEAPPELPRVIP

SEQ ID NO: 65658 - protein, 16 aa, Mycobacterium tuberculosis
TIIIEAPPELPRVIPP

SEQ ID NO: 65659 - protein, 16 aa, Mycobacterium tuberculosis
IIIEAPPELPRVIPPS

SEQ ID NO: 65660 - protein, 16 aa, Mycobacterium tuberculosis
IIEAPPELPRVIPPSL

SEQ ID NO: 65661 - protein, 16 aa, Mycobacterium tuberculosis
IEAPPELPRVIPPSLL

SEQ ID NO: 65662 - protein, 16 aa, Mycobacterium tuberculosis
EAPPELPRVIPPSLLR

SEQ ID NO: 65663 - protein, 16 aa, Mycobacterium tuberculosis
APPELPRVIPPSLLRR

SEQ ID NO: 65664 - protein, 16 aa, Mycobacterium tuberculosis
PPELPRVIPPSLLRRA

SEQ ID NO: 65665 - protein, 16 aa, Mycobacterium tuberculosis
PELPRVIPPSLLRRAL

SEQ ID NO: 65666 - protein, 16 aa, Mycobacterium tuberculosis
ELPRVIPPSLLRRALP

SEQ ID NO: 65667 - protein, 16 aa, Mycobacterium tuberculosis
LPRVIPPSLLRRALPY

SEQ ID NO: 65668 - protein, 16 aa, Mycobacterium tuberculosis
PRVIPPSLLRRALPYL

SEQ ID NO: 65669 - protein, 16 aa, Mycobacterium tuberculosis
RVIPPSLLRRALPYLI

SEQ ID NO: 65670 - protein, 16 aa, Mycobacterium tuberculosis
VIPPSLLRRALPYLIG

SEQ ID NO: 65671 - protein, 16 aa, Mycobacterium tuberculosis
IPPSLLRRALPYLIGI

SEQ ID NO: 65672 - protein, 16 aa, Mycobacterium tuberculosis
PPSLLRRALPYLIGIL

SEQ ID NO: 65673 - protein, 16 aa, Mycobacterium tuberculosis
PSLLRRALPYLIGILI

SEQ ID NO: 65674 - protein, 16 aa, Mycobacterium tuberculosis
SLLRRALPYLIGILIV

SEQ ID NO: 65675 - protein, 16 aa, Mycobacterium tuberculosis
LLRRALPYLIGILIVG

SEQ ID NO: 65676 - protein, 16 aa, Mycobacterium tuberculosis
LRRALPYLIGILIVGM

SEQ ID NO: 65677 - protein, 16 aa, Mycobacterium tuberculosis
RRALPYLIGILIVGMI

SEQ ID NO: 65678 - protein, 16 aa, Mycobacterium tuberculosis
RALPYLIGILIVGMIV

SEQ ID NO: 65679 - protein, 16 aa, Mycobacterium tuberculosis
ALPYLIGILIVGMIVA

SEQ ID NO: 65680 - protein, 16 aa, Mycobacterium tuberculosis
LPYLIGILIVGMIVAL

SEQ ID NO: 65681 - protein, 16 aa, Mycobacterium tuberculosis
PYLIGILIVGMIVALV

SEQ ID NO: 65682 - protein, 16 aa, Mycobacterium tuberculosis
YLIGILIVGMIVALVA

SEQ ID NO: 65683 - protein, 16 aa, Mycobacterium tuberculosis
LIGILIVGMIVALVAT

SEQ ID NO: 65684 - protein, 16 aa, Mycobacterium tuberculosis
IGILIVGMIVALVATG

SEQ ID NO: 65685 - protein, 16 aa, Mycobacterium tuberculosis
GILIVGMIVALVATGM

SEQ ID NO: 65686 - protein, 16 aa, Mycobacterium tuberculosis
ILIVGMIVALVATGMR

SEQ ID NO: 65687 - protein, 16 aa, Mycobacterium tuberculosis
LIVGMIVALVATGMRV

SEQ ID NO: 65688 - protein, 16 aa, Mycobacterium tuberculosis
IVGMIVALVATGMRVI

SEQ ID NO: 65689 - protein, 16 aa, Mycobacterium tuberculosis
VGMIVALVATGMRVIS

SEQ ID NO: 65690 - protein, 16 aa, Mycobacterium tuberculosis
GMIVALVATGMRVISP

SEQ ID NO: 65691 - protein, 16 aa, Mycobacterium tuberculosis
MIVALVATGMRVISPQ

SEQ ID NO: 65692 - protein, 16 aa, Mycobacterium tuberculosis
IVALVATGMRVISPQT

SEQ ID NO: 65693 - protein, 16 aa, Mycobacterium tuberculosis
VALVATGMRVISPQTL

SEQ ID NO: 65694 - protein, 16 aa, Mycobacterium tuberculosis
ALVATGMRVISPQTLF

SEQ ID NO: 65695 - protein, 16 aa, Mycobacterium tuberculosis
LVATGMRVISPQTLFF

SEQ ID NO: 65696 - protein, 16 aa, Mycobacterium tuberculosis
VATGMRVISPQTLFFP

SEQ ID NO: 65697 - protein, 16 aa, Mycobacterium tuberculosis
ATGMRVISPQTLFFPF

SEQ ID NO: 65698 - protein, 16 aa, Mycobacterium tuberculosis
TGMRVISPQTLFFPFV

SEQ ID NO: 65699 - protein, 16 aa, Mycobacterium tuberculosis
GMRVISPQTLFFPFVL

SEQ ID NO: 65700 - protein, 16 aa, Mycobacterium tuberculosis
MRVISPQTLFFPFVLL

SEQ ID NO: 65701 - protein, 16 aa, Mycobacterium tuberculosis
RVISPQTLFFPFVLLL

SEQ ID NO: 65702 - protein, 16 aa, Mycobacterium tuberculosis
VISPQTLFFPFVLLLA

SEQ ID NO: 65703 - protein, 16 aa, Mycobacterium tuberculosis
ISPQTLFFPFVLLLAA

SEQ ID NO: 65704 - protein, 16 aa, Mycobacterium tuberculosis
SPQTLFFPFVLLLAAT

SEQ ID NO: 65705 - protein, 16 aa, Mycobacterium tuberculosis
PQTLFFPFVLLLAATA

SEQ ID NO: 65706 - protein, 16 aa, Mycobacterium tuberculosis
QTLFFPFVLLLAATAL

SEQ ID NO: 65707 - protein, 16 aa, Mycobacterium tuberculosis
TLFFPFVLLLAATALY

SEQ ID NO: 65708 - protein, 16 aa, Mycobacterium tuberculosis
LFFPFVLLLAATALYR

SEQ ID NO: 65709 - protein, 16 aa, Mycobacterium tuberculosis
FFPFVLLLAATALYRG

SEQ ID NO: 65710 - protein, 16 aa, Mycobacterium tuberculosis
FPFVLLLAATALYRGN

SEQ ID NO: 65711 - protein, 16 aa, Mycobacterium tuberculosis
PFVLLLAATALYRGND

SEQ ID NO: 65712 - protein, 16 aa, Mycobacterium tuberculosis
FVLLLAATALYRGNDK

SEQ ID NO: 65713 - protein, 16 aa, Mycobacterium tuberculosis
VLLLAATALYRGNDKK

SEQ ID NO: 65714 - protein, 16 aa, Mycobacterium tuberculosis
LLLAATALYRGNDKKM

SEQ ID NO: 65715 - protein, 16 aa, Mycobacterium tuberculosis
LLAATALYRGNDKKMR

SEQ ID NO: 65716 - protein, 16 aa, Mycobacterium tuberculosis
LAATALYRGNDKKMRT

SEQ ID NO: 65717 - protein, 16 aa, Mycobacterium tuberculosis
AATALYRGNDKKMRTE

SEQ ID NO: 65718 - protein, 16 aa, Mycobacterium tuberculosis
ATALYRGNDKKMRTEE

SEQ ID NO: 65719 - protein, 16 aa, Mycobacterium tuberculosis
TALYRGNDKKMRTEEV

SEQ ID NO: 65720 - protein, 16 aa, Mycobacterium tuberculosis
ALYRGNDKKMRTEEVD

SEQ ID NO: 65721 - protein, 16 aa, Mycobacterium tuberculosis
LYRGNDKKMRTEEVDA

SEQ ID NO: 65722 - protein, 16 aa, Mycobacterium tuberculosis
YRGNDKKMRTEEVDAE

SEQ ID NO: 65723 - protein, 16 aa, Mycobacterium tuberculosis
RGNDKKMRTEEVDAER

SEQ ID NO: 65724 - protein, 16 aa, Mycobacterium tuberculosis
GNDKKMRTEEVDAERA

SEQ ID NO: 65725 - protein, 16 aa, Mycobacterium tuberculosis
NDKKMRTEEVDAERAD

SEQ ID NO: 65726 - protein, 16 aa, Mycobacterium tuberculosis
DKKMRTEEVDAERADY

SEQ ID NO: 65727 - protein, 16 aa, Mycobacterium tuberculosis
KKMRTEEVDAERADYL

SEQ ID NO: 65728 - protein, 16 aa, Mycobacterium tuberculosis
KMRTEEVDAERADYLR

SEQ ID NO: 65729 - protein, 16 aa, Mycobacterium tuberculosis
MRTEEVDAERADYLRY

SEQ ID NO: 65730 - protein, 16 aa, Mycobacterium tuberculosis
RTEEVDAERADYLRYL

SEQ ID NO: 65731 - protein, 16 aa, Mycobacterium tuberculosis
TEEVDAERADYLRYLS

SEQ ID NO: 65732 - protein, 16 aa, Mycobacterium tuberculosis
EEVDAERADYLRYLSV

SEQ ID NO: 65733 - protein, 16 aa, Mycobacterium tuberculosis
EVDAERADYLRYLSVV

SEQ ID NO: 65734 - protein, 16 aa, Mycobacterium tuberculosis
VDAERADYLRYLSVVR

SEQ ID NO: 65735 - protein, 16 aa, Mycobacterium tuberculosis
DAERADYLRYLSVVRD

SEQ ID NO: 65736 - protein, 16 aa, Mycobacterium tuberculosis
AERADYLRYLSVVRDN

SEQ ID NO: 65737 - protein, 16 aa, Mycobacterium tuberculosis
ERADYLRYLSVVRDNI

SEQ ID NO: 65738 - protein, 16 aa, Mycobacterium tuberculosis
RADYLRYLSVVRDNIR

SEQ ID NO: 65739 - protein, 16 aa, Mycobacterium tuberculosis
ADYLRYLSVVRDNIRA

SEQ ID NO: 65740 - protein, 16 aa, Mycobacterium tuberculosis
DYLRYLSVVRDNIRAQ

SEQ ID NO: 65741 - protein, 16 aa, Mycobacterium tuberculosis
YLRYLSVVRDNIRAQA

SEQ ID NO: 65742 - protein, 16 aa, Mycobacterium tuberculosis
LRYLSVVRDNIRAQAA

SEQ ID NO: 65743 - protein, 16 aa, Mycobacterium tuberculosis
RYLSVVRDNIRAQAAE

SEQ ID NO: 65744 - protein, 16 aa, Mycobacterium tuberculosis
YLSVVRDNIRAQAAEQ

SEQ ID NO: 65745 - protein, 16 aa, Mycobacterium tuberculosis
LSVVRDNIRAQAAEQR

SEQ ID NO: 65746 - protein, 16 aa, Mycobacterium tuberculosis
SVVRDNIRAQAAEQRA

SEQ ID NO: 65747 - protein, 16 aa, Mycobacterium tuberculosis
VVRDNIRAQAAEQRAS

SEQ ID NO: 65748 - protein, 16 aa, Mycobacterium tuberculosis
VRDNIRAQAAEQRASA

SEQ ID NO: 65749 - protein, 16 aa, Mycobacterium tuberculosis
RDNIRAQAAEQRASAL

SEQ ID NO: 65750 - protein, 16 aa, Mycobacterium tuberculosis
DNIRAQAAEQRASALW

SEQ ID NO: 65751 - protein, 16 aa, Mycobacterium tuberculosis
NIRAQAAEQRASALWS

SEQ ID NO: 65752 - protein, 16 aa, Mycobacterium tuberculosis
IRAQAAEQRASALWSH

SEQ ID NO: 65753 - protein, 16 aa, Mycobacterium tuberculosis
RAQAAEQRASALWSHP

SEQ ID NO: 65754 - protein, 16 aa, Mycobacterium tuberculosis
AQAAEQRASALWSHPD

SEQ ID NO: 65755 - protein, 16 aa, Mycobacterium tuberculosis
QAAEQRASALWSHPDP

SEQ ID NO: 65756 - protein, 16 aa, Mycobacterium tuberculosis
AAEQRASALWSHPDPT

SEQ ID NO: 65757 - protein, 16 aa, Mycobacterium tuberculosis
AEQRASALWSHPDPTA

SEQ ID NO: 65758 - protein, 16 aa, Mycobacterium tuberculosis
EQRASALWSHPDPTAL

SEQ ID NO: 65759 - protein, 16 aa, Mycobacterium tuberculosis
QRASALWSHPDPTALA

SEQ ID NO: 65760 - protein, 16 aa, Mycobacterium tuberculosis
RASALWSHPDPTALAS

SEQ ID NO: 65761 - protein, 16 aa, Mycobacterium tuberculosis
ASALWSHPDPTALASV

SEQ ID NO: 65762 - protein, 16 aa, Mycobacterium tuberculosis
SALWSHPDPTALASVP

SEQ ID NO: 65763 - protein, 16 aa, Mycobacterium tuberculosis
ALWSHPDPTALASVPG

SEQ ID NO: 65764 - protein, 16 aa, Mycobacterium tuberculosis
LWSHPDPTALASVPGS

SEQ ID NO: 65765 - protein, 16 aa, Mycobacterium tuberculosis
WSHPDPTALASVPGSR

SEQ ID NO: 65766 - protein, 16 aa, Mycobacterium tuberculosis
SHPDPTALASVPGSRR

SEQ ID NO: 65767 - protein, 16 aa, Mycobacterium tuberculosis
HPDPTALASVPGSRRQ

SEQ ID NO: 65768 - protein, 16 aa, Mycobacterium tuberculosis
PDPTALASVPGSRRQW

SEQ ID NO: 65769 - protein, 16 aa, Mycobacterium tuberculosis
DPTALASVPGSRRQWE

SEQ ID NO: 65770 - protein, 16 aa, Mycobacterium tuberculosis
PTALASVPGSRRQWER

SEQ ID NO: 65771 - protein, 16 aa, Mycobacterium tuberculosis
TALASVPGSRRQWERD

SEQ ID NO: 65772 - protein, 16 aa, Mycobacterium tuberculosis
ALASVPGSRRQWERDP

SEQ ID NO: 65773 - protein, 16 aa, Mycobacterium tuberculosis
LASVPGSRRQWERDPH

SEQ ID NO: 65774 - protein, 16 aa, Mycobacterium tuberculosis
ASVPGSRRQWERDPHD

SEQ ID NO: 65775 - protein, 16 aa, Mycobacterium tuberculosis
SVPGSRRQWERDPHDP

SEQ ID NO: 65776 - protein, 16 aa, Mycobacterium tuberculosis
VPGSRRQWERDPHDPD

SEQ ID NO: 65777 - protein, 16 aa, Mycobacterium tuberculosis
PGSRRQWERDPHDPDF

SEQ ID NO: 65778 - protein, 16 aa, Mycobacterium tuberculosis
GSRRQWERDPHDPDFL

SEQ ID NO: 65779 - protein, 16 aa, Mycobacterium tuberculosis
SRRQWERDPHDPDFLV

SEQ ID NO: 65780 - protein, 16 aa, Mycobacterium tuberculosis
RRQWERDPHDPDFLVL

SEQ ID NO: 65781 - protein, 16 aa, Mycobacterium tuberculosis
RQWERDPHDPDFLVLR

SEQ ID NO: 65782 - protein, 16 aa, Mycobacterium tuberculosis
QWERDPHDPDFLVLRA

SEQ ID NO: 65783 - protein, 16 aa, Mycobacterium tuberculosis
WERDPHDPDFLVLRAG

SEQ ID NO: 65784 - protein, 16 aa, Mycobacterium tuberculosis
ERDPHDPDFLVLRAGR

SEQ ID NO: 65785 - protein, 16 aa, Mycobacterium tuberculosis
RDPHDPDFLVLRAGRH

SEQ ID NO: 65786 - protein, 16 aa, Mycobacterium tuberculosis
DPHDPDFLVLRAGRHT

SEQ ID NO: 65787 - protein, 16 aa, Mycobacterium tuberculosis
PHDPDFLVLRAGRHTV

SEQ ID NO: 65788 - protein, 16 aa, Mycobacterium tuberculosis
HDPDFLVLRAGRHTVP

SEQ ID NO: 65789 - protein, 16 aa, Mycobacterium tuberculosis
DPDFLVLRAGRHTVPL

SEQ ID NO: 65790 - protein, 16 aa, Mycobacterium tuberculosis
PDFLVLRAGRHTVPLA

SEQ ID NO: 65791 - protein, 16 aa, Mycobacterium tuberculosis
DFLVLRAGRHTVPLAT

SEQ ID NO: 65792 - protein, 16 aa, Mycobacterium tuberculosis
FLVLRAGRHTVPLATT

SEQ ID NO: 65793 - protein, 16 aa, Mycobacterium tuberculosis
LVLRAGRHTVPLATTL

SEQ ID NO: 65794 - protein, 16 aa, Mycobacterium tuberculosis
VLRAGRHTVPLATTLR

SEQ ID NO: 65795 - protein, 16 aa, Mycobacterium tuberculosis
LRAGRHTVPLATTLRV

SEQ ID NO: 65796 - protein, 16 aa, Mycobacterium tuberculosis
RAGRHTVPLATTLRVN

SEQ ID NO: 65797 - protein, 16 aa, Mycobacterium tuberculosis
AGRHTVPLATTLRVND

SEQ ID NO: 65798 - protein, 16 aa, Mycobacterium tuberculosis
GRHTVPLATTLRVNDT

SEQ ID NO: 65799 - protein, 16 aa, Mycobacterium tuberculosis
RHTVPLATTLRVNDTA

SEQ ID NO: 65800 - protein, 16 aa, Mycobacterium tuberculosis
HTVPLATTLRVNDTAD

SEQ ID NO: 65801 - protein, 16 aa, Mycobacterium tuberculosis
TVPLATTLRVNDTADE

SEQ ID NO: 65802 - protein, 16 aa, Mycobacterium tuberculosis
VPLATTLRVNDTADEI

SEQ ID NO: 65803 - protein, 16 aa, Mycobacterium tuberculosis
PLATTLRVNDTADEID

SEQ ID NO: 65804 - protein, 16 aa, Mycobacterium tuberculosis
LATTLRVNDTADEIDL

SEQ ID NO: 65805 - protein, 16 aa, Mycobacterium tuberculosis
ATTLRVNDTADEIDLE

SEQ ID NO: 65806 - protein, 16 aa, Mycobacterium tuberculosis
TTLRVNDTADEIDLEP

SEQ ID NO: 65807 - protein, 16 aa, Mycobacterium tuberculosis
TLRVNDTADEIDLEPV

SEQ ID NO: 65808 - protein, 16 aa, Mycobacterium tuberculosis
LRVNDTADEIDLEPVS

SEQ ID NO: 65809 - protein, 16 aa, Mycobacterium tuberculosis
RVNDTADEIDLEPVSH

SEQ ID NO: 65810 - protein, 16 aa, Mycobacterium tuberculosis
VNDTADEIDLEPVSHS

SEQ ID NO: 65811 - protein, 16 aa, Mycobacterium tuberculosis
NDTADEIDLEPVSHSA

SEQ ID NO: 65812 - protein, 16 aa, Mycobacterium tuberculosis
DTADEIDLEPVSHSAL

SEQ ID NO: 65813 - protein, 16 aa, Mycobacterium tuberculosis
TADEIDLEPVSHSALR

SEQ ID NO: 65814 - protein, 16 aa, Mycobacterium tuberculosis
ADEIDLEPVSHSALRS

SEQ ID NO: 65815 - protein, 16 aa, Mycobacterium tuberculosis
DEIDLEPVSHSALRSL

SEQ ID NO: 65816 - protein, 16 aa, Mycobacterium tuberculosis
EIDLEPVSHSALRSLL

SEQ ID NO: 65817 - protein, 16 aa, Mycobacterium tuberculosis
IDLEPVSHSALRSLLD

SEQ ID NO: 65818 - protein, 16 aa, Mycobacterium tuberculosis
DLEPVSHSALRSLLDT

SEQ ID NO: 65819 - protein, 16 aa, Mycobacterium tuberculosis
LEPVSHSALRSLLDTQ

SEQ ID NO: 65820 - protein, 16 aa, Mycobacterium tuberculosis
EPVSHSALRSLLDTQR

SEQ ID NO: 65821 - protein, 16 aa, Mycobacterium tuberculosis
PVSHSALRSLLDTQRS

SEQ ID NO: 65822 - protein, 16 aa, Mycobacterium tuberculosis
VSHSALRSLLDTQRSI

SEQ ID NO: 65823 - protein, 16 aa, Mycobacterium tuberculosis
SHSALRSLLDTQRSIG

SEQ ID NO: 65824 - protein, 16 aa, Mycobacterium tuberculosis
HSALRSLLDTQRSIGD

SEQ ID NO: 65825 - protein, 16 aa, Mycobacterium tuberculosis
SALRSLLDTQRSIGDV

SEQ ID NO: 65826 - protein, 16 aa, Mycobacterium tuberculosis
ALRSLLDTQRSIGDVP

SEQ ID NO: 65827 - protein, 16 aa, Mycobacterium tuberculosis
LRSLLDTQRSIGDVPT

SEQ ID NO: 65828 - protein, 16 aa, Mycobacterium tuberculosis
RSLLDTQRSIGDVPTG

SEQ ID NO: 65829 - protein, 16 aa, Mycobacterium tuberculosis
SLLDTQRSIGDVPTGI

SEQ ID NO: 65830 - protein, 16 aa, Mycobacterium tuberculosis
LLDTQRSIGDVPTGID

SEQ ID NO: 65831 - protein, 16 aa, Mycobacterium tuberculosis
LDTQRSIGDVPTGIDL

SEQ ID NO: 65832 - protein, 16 aa, Mycobacterium tuberculosis
DTQRSIGDVPTGIDLT

SEQ ID NO: 65833 - protein, 16 aa, Mycobacterium tuberculosis
TQRSIGDVPTGIDLTK

SEQ ID NO: 65834 - protein, 16 aa, Mycobacterium tuberculosis
QRSIGDVPTGIDLTKV

SEQ ID NO: 65835 - protein, 16 aa, Mycobacterium tuberculosis
RSIGDVPTGIDLTKVS

SEQ ID NO: 65836 - protein, 16 aa, Mycobacterium tuberculosis
SIGDVPTGIDLTKVSP

SEQ ID NO: 65837 - protein, 16 aa, Mycobacterium tuberculosis
IGDVPTGIDLTKVSPI

SEQ ID NO: 65838 - protein, 16 aa, Mycobacterium tuberculosis
GDVPTGIDLTKVSPIT

SEQ ID NO: 65839 - protein, 16 aa, Mycobacterium tuberculosis
DVPTGIDLTKVSPITV

SEQ ID NO: 65840 - protein, 16 aa, Mycobacterium tuberculosis
VPTGIDLTKVSPITVL

SEQ ID NO: 65841 - protein, 16 aa, Mycobacterium tuberculosis
PTGIDLTKVSPITVLG

SEQ ID NO: 65842 - protein, 16 aa, Mycobacterium tuberculosis
TGIDLTKVSPITVLGE

SEQ ID NO: 65843 - protein, 16 aa, Mycobacterium tuberculosis
GIDLTKVSPITVLGER

SEQ ID NO: 65844 - protein, 16 aa, Mycobacterium tuberculosis
IDLTKVSPITVLGERA

SEQ ID NO: 65845 - protein, 16 aa, Mycobacterium tuberculosis
DLTKVSPITVLGERAQ

SEQ ID NO: 65846 - protein, 16 aa, Mycobacterium tuberculosis
LTKVSPITVLGERAQV

SEQ ID NO: 65847 - protein, 16 aa, Mycobacterium tuberculosis
TKVSPITVLGERAQVR

SEQ ID NO: 65848 - protein, 16 aa, Mycobacterium tuberculosis
KVSPITVLGERAQVRA

SEQ ID NO: 65849 - protein, 16 aa, Mycobacterium tuberculosis
VSPITVLGERAQVRAV

SEQ ID NO: 65850 - protein, 16 aa, Mycobacterium tuberculosis
SPITVLGERAQVRAVL

SEQ ID NO: 65851 - protein, 16 aa, Mycobacterium tuberculosis
PITVLGERAQVRAVLR

SEQ ID NO: 65852 - protein, 16 aa, Mycobacterium tuberculosis
ITVLGERAQVRAVLRA

SEQ ID NO: 65853 - protein, 16 aa, Mycobacterium tuberculosis
TVLGERAQVRAVLRAW

SEQ ID NO: 65854 - protein, 16 aa, Mycobacterium tuberculosis
VLGERAQVRAVLRAWI

SEQ ID NO: 65855 - protein, 16 aa, Mycobacterium tuberculosis
LGERAQVRAVLRAWIA

SEQ ID NO: 65856 - protein, 16 aa, Mycobacterium tuberculosis
GERAQVRAVLRAWIAQ

SEQ ID NO: 65857 - protein, 16 aa, Mycobacterium tuberculosis
ERAQVRAVLRAWIAQA

SEQ ID NO: 65858 - protein, 16 aa, Mycobacterium tuberculosis
RAQVRAVLRAWIAQAV

SEQ ID NO: 65859 - protein, 16 aa, Mycobacterium tuberculosis
AQVRAVLRAWIAQAVT

SEQ ID NO: 65860 - protein, 16 aa, Mycobacterium tuberculosis
QVRAVLRAWIAQAVTW

SEQ ID NO: 65861 - protein, 16 aa, Mycobacterium tuberculosis
VRAVLRAWIAQAVTWH

SEQ ID NO: 65862 - protein, 16 aa, Mycobacterium tuberculosis
RAVLRAWIAQAVTWHD

SEQ ID NO: 65863 - protein, 16 aa, Mycobacterium tuberculosis
AVLRAWIAQAVTWHDP

SEQ ID NO: 65864 - protein, 16 aa, Mycobacterium tuberculosis
VLRAWIAQAVTWHDPT

SEQ ID NO: 65865 - protein, 16 aa, Mycobacterium tuberculosis
LRAWIAQAVTWHDPTV

SEQ ID NO: 65866 - protein, 16 aa, Mycobacterium tuberculosis
RAWIAQAVTWHDPTVL

SEQ ID NO: 65867 - protein, 16 aa, Mycobacterium tuberculosis
AWIAQAVTWHDPTVLG

SEQ ID NO: 65868 - protein, 16 aa, Mycobacterium tuberculosis
WIAQAVTWHDPTVLGV

SEQ ID NO: 65869 - protein, 16 aa, Mycobacterium tuberculosis
IAQAVTWHDPTVLGVA

SEQ ID NO: 65870 - protein, 16 aa, Mycobacterium tuberculosis
AQAVTWHDPTVLGVAL

SEQ ID NO: 65871 - protein, 16 aa, Mycobacterium tuberculosis
QAVTWHDPTVLGVALA

SEQ ID NO: 65872 - protein, 16 aa, Mycobacterium tuberculosis
AVTWHDPTVLGVALAA

SEQ ID NO: 65873 - protein, 16 aa, Mycobacterium tuberculosis
VTWHDPTVLGVALAAR

SEQ ID NO: 65874 - protein, 16 aa, Mycobacterium tuberculosis
TWHDPTVLGVALAARD

SEQ ID NO: 65875 - protein, 16 aa, Mycobacterium tuberculosis
WHDPTVLGVALAARDL

SEQ ID NO: 65876 - protein, 16 aa, Mycobacterium tuberculosis
HDPTVLGVALAARDLE

SEQ ID NO: 65877 - protein, 16 aa, Mycobacterium tuberculosis
DPTVLGVALAARDLEG

SEQ ID NO: 65878 - protein, 16 aa, Mycobacterium tuberculosis
PTVLGVALAARDLEGR

SEQ ID NO: 65879 - protein, 16 aa, Mycobacterium tuberculosis
TVLGVALAARDLEGRD

SEQ ID NO: 65880 - protein, 16 aa, Mycobacterium tuberculosis
VLGVALAARDLEGRDW

SEQ ID NO: 65881 - protein, 16 aa, Mycobacterium tuberculosis
LGVALAARDLEGRDWN

SEQ ID NO: 65882 - protein, 16 aa, Mycobacterium tuberculosis
GVALAARDLEGRDWNW

SEQ ID NO: 65883 - protein, 16 aa, Mycobacterium tuberculosis
VALAARDLEGRDWNWL

SEQ ID NO: 65884 - protein, 16 aa, Mycobacterium tuberculosis
ALAARDLEGRDWNWLK

SEQ ID NO: 65885 - protein, 16 aa, Mycobacterium tuberculosis
LAARDLEGRDWNWLKW

SEQ ID NO: 65886 - protein, 16 aa, Mycobacterium tuberculosis
AARDLEGRDWNWLKWL

SEQ ID NO: 65887 - protein, 16 aa, Mycobacterium tuberculosis
ARDLEGRDWNWLKWLP

SEQ ID NO: 65888 - protein, 16 aa, Mycobacterium tuberculosis
RDLEGRDWNWLKWLPH

SEQ ID NO: 65889 - protein, 16 aa, Mycobacterium tuberculosis
DLEGRDWNWLKWLPHV

SEQ ID NO: 65890 - protein, 16 aa, Mycobacterium tuberculosis
LEGRDWNWLKWLPHVD

SEQ ID NO: 65891 - protein, 16 aa, Mycobacterium tuberculosis
EGRDWNWLKWLPHVDI

SEQ ID NO: 65892 - protein, 16 aa, Mycobacterium tuberculosis
GRDWNWLKWLPHVDIP

SEQ ID NO: 65893 - protein, 16 aa, Mycobacterium tuberculosis
RDWNWLKWLPHVDIPG

SEQ ID NO: 65894 - protein, 16 aa, Mycobacterium tuberculosis
DWNWLKWLPHVDIPGR

SEQ ID NO: 65895 - protein, 16 aa, Mycobacterium tuberculosis
WNWLKWLPHVDIPGRL

SEQ ID NO: 65896 - protein, 16 aa, Mycobacterium tuberculosis
NWLKWLPHVDIPGRLD

SEQ ID NO: 65897 - protein, 16 aa, Mycobacterium tuberculosis
WLKWLPHVDIPGRLDA

SEQ ID NO: 65898 - protein, 16 aa, Mycobacterium tuberculosis
LKWLPHVDIPGRLDAL

SEQ ID NO: 65899 - protein, 16 aa, Mycobacterium tuberculosis
KWLPHVDIPGRLDALG

SEQ ID NO: 65900 - protein, 16 aa, Mycobacterium tuberculosis
WLPHVDIPGRLDALGP

SEQ ID NO: 65901 - protein, 16 aa, Mycobacterium tuberculosis
LPHVDIPGRLDALGPA

SEQ ID NO: 65902 - protein, 16 aa, Mycobacterium tuberculosis
PHVDIPGRLDALGPAR

SEQ ID NO: 65903 - protein, 16 aa, Mycobacterium tuberculosis
HVDIPGRLDALGPARN

SEQ ID NO: 65904 - protein, 16 aa, Mycobacterium tuberculosis
VDIPGRLDALGPARNL

SEQ ID NO: 65905 - protein, 16 aa, Mycobacterium tuberculosis
DIPGRLDALGPARNLS

SEQ ID NO: 65906 - protein, 16 aa, Mycobacterium tuberculosis
IPGRLDALGPARNLST

SEQ ID NO: 65907 - protein, 16 aa, Mycobacterium tuberculosis
PGRLDALGPARNLSTD

SEQ ID NO: 65908 - protein, 16 aa, Mycobacterium tuberculosis
GRLDALGPARNLSTDP

SEQ ID NO: 65909 - protein, 16 aa, Mycobacterium tuberculosis
RLDALGPARNLSTDPD

SEQ ID NO: 65910 - protein, 16 aa, Mycobacterium tuberculosis
LDALGPARNLSTDPDE

SEQ ID NO: 65911 - protein, 16 aa, Mycobacterium tuberculosis
DALGPARNLSTDPDEL

SEQ ID NO: 65912 - protein, 16 aa, Mycobacterium tuberculosis
ALGPARNLSTDPDELI

SEQ ID NO: 65913 - protein, 16 aa, Mycobacterium tuberculosis
LGPARNLSTDPDELIA

SEQ ID NO: 65914 - protein, 16 aa, Mycobacterium tuberculosis
GPARNLSTDPDELIAL

SEQ ID NO: 65915 - protein, 16 aa, Mycobacterium tuberculosis
PARNLSTDPDELIALL

SEQ ID NO: 65916 - protein, 16 aa, Mycobacterium tuberculosis
ARNLSTDPDELIALLG

SEQ ID NO: 65917 - protein, 16 aa, Mycobacterium tuberculosis
RNLSTDPDELIALLGP

SEQ ID NO: 65918 - protein, 16 aa, Mycobacterium tuberculosis
NLSTDPDELIALLGPV

SEQ ID NO: 65919 - protein, 16 aa, Mycobacterium tuberculosis
LSTDPDELIALLGPVL

SEQ ID NO: 65920 - protein, 16 aa, Mycobacterium tuberculosis
STDPDELIALLGPVLA

SEQ ID NO: 65921 - protein, 16 aa, Mycobacterium tuberculosis
TDPDELIALLGPVLAD

SEQ ID NO: 65922 - protein, 16 aa, Mycobacterium tuberculosis
DPDELIALLGPVLADR

SEQ ID NO: 65923 - protein, 16 aa, Mycobacterium tuberculosis
PDELIALLGPVLADRP

SEQ ID NO: 65924 - protein, 16 aa, Mycobacterium tuberculosis
DELIALLGPVLADRPA

SEQ ID NO: 65925 - protein, 16 aa, Mycobacterium tuberculosis
ELIALLGPVLADRPAF

SEQ ID NO: 65926 - protein, 16 aa, Mycobacterium tuberculosis
LIALLGPVLADRPAFT

SEQ ID NO: 65927 - protein, 16 aa, Mycobacterium tuberculosis
IALLGPVLADRPAFTG

SEQ ID NO: 65928 - protein, 16 aa, Mycobacterium tuberculosis
ALLGPVLADRPAFTGQ

SEQ ID NO: 65929 - protein, 16 aa, Mycobacterium tuberculosis
LLGPVLADRPAFTGQP

SEQ ID NO: 65930 - protein, 16 aa, Mycobacterium tuberculosis
LGPVLADRPAFTGQPT

SEQ ID NO: 65931 - protein, 16 aa, Mycobacterium tuberculosis
GPVLADRPAFTGQPTD

SEQ ID NO: 65932 - protein, 16 aa, Mycobacterium tuberculosis
PVLADRPAFTGQPTDA

SEQ ID NO: 65933 - protein, 16 aa, Mycobacterium tuberculosis
VLADRPAFTGQPTDAL

SEQ ID NO: 65934 - protein, 16 aa, Mycobacterium tuberculosis
LADRPAFTGQPTDALR

SEQ ID NO: 65935 - protein, 16 aa, Mycobacterium tuberculosis
ADRPAFTGQPTDALRH

SEQ ID NO: 65936 - protein, 16 aa, Mycobacterium tuberculosis
DRPAFTGQPTDALRHL

SEQ ID NO: 65937 - protein, 16 aa, Mycobacterium tuberculosis
RPAFTGQPTDALRHLL

SEQ ID NO: 65938 - protein, 16 aa, Mycobacterium tuberculosis
PAFTGQPTDALRHLLI

SEQ ID NO: 65939 - protein, 16 aa, Mycobacterium tuberculosis
AFTGQPTDALRHLLIV

SEQ ID NO: 65940 - protein, 16 aa, Mycobacterium tuberculosis
FTGQPTDALRHLLIVV

SEQ ID NO: 65941 - protein, 16 aa, Mycobacterium tuberculosis
TGQPTDALRHLLIVVD

SEQ ID NO: 65942 - protein, 16 aa, Mycobacterium tuberculosis
GQPTDALRHLLIVVDD

SEQ ID NO: 65943 - protein, 16 aa, Mycobacterium tuberculosis
QPTDALRHLLIVVDDP

SEQ ID NO: 65944 - protein, 16 aa, Mycobacterium tuberculosis
PTDALRHLLIVVDDPD

SEQ ID NO: 65945 - protein, 16 aa, Mycobacterium tuberculosis
TDALRHLLIVVDDPDY

SEQ ID NO: 65946 - protein, 16 aa, Mycobacterium tuberculosis
DALRHLLIVVDDPDYD

SEQ ID NO: 65947 - protein, 16 aa, Mycobacterium tuberculosis
ALRHLLIVVDDPDYDL

SEQ ID NO: 65948 - protein, 16 aa, Mycobacterium tuberculosis
LRHLLIVVDDPDYDLG

SEQ ID NO: 65949 - protein, 16 aa, Mycobacterium tuberculosis
RHLLIVVDDPDYDLGA

SEQ ID NO: 65950 - protein, 16 aa, Mycobacterium tuberculosis
HLLIVVDDPDYDLGAS

SEQ ID NO: 65951 - protein, 16 aa, Mycobacterium tuberculosis
LLIVVDDPDYDLGASP

SEQ ID NO: 65952 - protein, 16 aa, Mycobacterium tuberculosis
LIVVDDPDYDLGASPL

SEQ ID NO: 65953 - protein, 16 aa, Mycobacterium tuberculosis
IVVDDPDYDLGASPLA

SEQ ID NO: 65954 - protein, 16 aa, Mycobacterium tuberculosis
VVDDPDYDLGASPLAV

SEQ ID NO: 65955 - protein, 16 aa, Mycobacterium tuberculosis
VDDPDYDLGASPLAVG

SEQ ID NO: 65956 - protein, 16 aa, Mycobacterium tuberculosis
DDPDYDLGASPLAVGR

SEQ ID NO: 65957 - protein, 16 aa, Mycobacterium tuberculosis
DPDYDLGASPLAVGRA

SEQ ID NO: 65958 - protein, 16 aa, Mycobacterium tuberculosis
PDYDLGASPLAVGRAG

SEQ ID NO: 65959 - protein, 16 aa, Mycobacterium tuberculosis
DYDLGASPLAVGRAGV

SEQ ID NO: 65960 - protein, 16 aa, Mycobacterium tuberculosis
YDLGASPLAVGRAGVT

SEQ ID NO: 65961 - protein, 16 aa, Mycobacterium tuberculosis
DLGASPLAVGRAGVTV

SEQ ID NO: 65962 - protein, 16 aa, Mycobacterium tuberculosis
LGASPLAVGRAGVTVV

SEQ ID NO: 65963 - protein, 16 aa, Mycobacterium tuberculosis
GASPLAVGRAGVTVVH

SEQ ID NO: 65964 - protein, 16 aa, Mycobacterium tuberculosis
ASPLAVGRAGVTVVHC

SEQ ID NO: 65965 - protein, 16 aa, Mycobacterium tuberculosis
SPLAVGRAGVTVVHCS

SEQ ID NO: 65966 - protein, 16 aa, Mycobacterium tuberculosis
PLAVGRAGVTVVHCSA

SEQ ID NO: 65967 - protein, 16 aa, Mycobacterium tuberculosis
LAVGRAGVTVVHCSAS

SEQ ID NO: 65968 - protein, 16 aa, Mycobacterium tuberculosis
AVGRAGVTVVHCSASA

SEQ ID NO: 65969 - protein, 16 aa, Mycobacterium tuberculosis
VGRAGVTVVHCSASAP

SEQ ID NO: 65970 - protein, 16 aa, Mycobacterium tuberculosis
GRAGVTVVHCSASAPH

SEQ ID NO: 65971 - protein, 16 aa, Mycobacterium tuberculosis
RAGVTVVHCSASAPHR

SEQ ID NO: 65972 - protein, 16 aa, Mycobacterium tuberculosis
AGVTVVHCSASAPHRE

SEQ ID NO: 65973 - protein, 16 aa, Mycobacterium tuberculosis
GVTVVHCSASAPHREQ

SEQ ID NO: 65974 - protein, 16 aa, Mycobacterium tuberculosis
VTVVHCSASAPHREQY

SEQ ID NO: 65975 - protein, 16 aa, Mycobacterium tuberculosis
TVVHCSASAPHREQYS

SEQ ID NO: 65976 - protein, 16 aa, Mycobacterium tuberculosis
VVHCSASAPHREQYSD

SEQ ID NO: 65977 - protein, 16 aa, Mycobacterium tuberculosis
VHCSASAPHREQYSDP

SEQ ID NO: 65978 - protein, 16 aa, Mycobacterium tuberculosis
HCSASAPHREQYSDPE

SEQ ID NO: 65979 - protein, 16 aa, Mycobacterium tuberculosis
CSASAPHREQYSDPEK

SEQ ID NO: 65980 - protein, 16 aa, Mycobacterium tuberculosis
SASAPHREQYSDPEKP

SEQ ID NO: 65981 - protein, 16 aa, Mycobacterium tuberculosis
ASAPHREQYSDPEKPI

SEQ ID NO: 65982 - protein, 16 aa, Mycobacterium tuberculosis
SAPHREQYSDPEKPIL

SEQ ID NO: 65983 - protein, 16 aa, Mycobacterium tuberculosis
APHREQYSDPEKPILR

SEQ ID NO: 65984 - protein, 16 aa, Mycobacterium tuberculosis
PHREQYSDPEKPILRV

SEQ ID NO: 65985 - protein, 16 aa, Mycobacterium tuberculosis
HREQYSDPEKPILRVA

SEQ ID NO: 65986 - protein, 16 aa, Mycobacterium tuberculosis
REQYSDPEKPILRVAH

SEQ ID NO: 65987 - protein, 16 aa, Mycobacterium tuberculosis
EQYSDPEKPILRVAHG

SEQ ID NO: 65988 - protein, 16 aa, Mycobacterium tuberculosis
QYSDPEKPILRVAHGA

SEQ ID NO: 65989 - protein, 16 aa, Mycobacterium tuberculosis
YSDPEKPILRVAHGAI

SEQ ID NO: 65990 - protein, 16 aa, Mycobacterium tuberculosis
SDPEKPILRVAHGAIE

SEQ ID NO: 65991 - protein, 16 aa, Mycobacterium tuberculosis
DPEKPILRVAHGAIER

SEQ ID NO: 65992 - protein, 16 aa, Mycobacterium tuberculosis
PEKPILRVAHGAIERW

SEQ ID NO: 65993 - protein, 16 aa, Mycobacterium tuberculosis
EKPILRVAHGAIERWQ

SEQ ID NO: 65994 - protein, 16 aa, Mycobacterium tuberculosis
KPILRVAHGAIERWQT

SEQ ID NO: 65995 - protein, 16 aa, Mycobacterium tuberculosis
PILRVAHGAIERWQTG

SEQ ID NO: 65996 - protein, 16 aa, Mycobacterium tuberculosis
ILRVAHGAIERWQTGG

SEQ ID NO: 65997 - protein, 16 aa, Mycobacterium tuberculosis
LRVAHGAIERWQTGGW

SEQ ID NO: 65998 - protein, 16 aa, Mycobacterium tuberculosis
RVAHGAIERWQTGGWQ

SEQ ID NO: 65999 - protein, 16 aa, Mycobacterium tuberculosis
VAHGAIERWQTGGWQP

SEQ ID NO: 66000 - protein, 16 aa, Mycobacterium tuberculosis
AHGAIERWQTGGWQPY

SEQ ID NO: 66001 - protein, 16 aa, Mycobacterium tuberculosis
HGAIERWQTGGWQPYI

SEQ ID NO: 66002 - protein, 16 aa, Mycobacterium tuberculosis
GAIERWQTGGWQPYID

SEQ ID NO: 66003 - protein, 16 aa, Mycobacterium tuberculosis
AIERWQTGGWQPYIDA

SEQ ID NO: 66004 - protein, 16 aa, Mycobacterium tuberculosis
IERWQTGGWQPYIDAA

SEQ ID NO: 66005 - protein, 16 aa, Mycobacterium tuberculosis
ERWQTGGWQPYIDAAD

SEQ ID NO: 66006 - protein, 16 aa, Mycobacterium tuberculosis
RWQTGGWQPYIDAADQ

SEQ ID NO: 66007 - protein, 16 aa, Mycobacterium tuberculosis
WQTGGWQPYIDAADQF

SEQ ID NO: 66008 - protein, 16 aa, Mycobacterium tuberculosis
QTGGWQPYIDAADQFS

SEQ ID NO: 66009 - protein, 16 aa, Mycobacterium tuberculosis
TGGWQPYIDAADQFSA

SEQ ID NO: 66010 - protein, 16 aa, Mycobacterium tuberculosis
GGWQPYIDAADQFSAD

SEQ ID NO: 66011 - protein, 16 aa, Mycobacterium tuberculosis
GWQPYIDAADQFSADE

SEQ ID NO: 66012 - protein, 16 aa, Mycobacterium tuberculosis
WQPYIDAADQFSADEA

SEQ ID NO: 66013 - protein, 16 aa, Mycobacterium tuberculosis
QPYIDAADQFSADEAA

SEQ ID NO: 66014 - protein, 16 aa, Mycobacterium tuberculosis
PYIDAADQFSADEAAH

SEQ ID NO: 66015 - protein, 16 aa, Mycobacterium tuberculosis
YIDAADQFSADEAAHL

SEQ ID NO: 66016 - protein, 16 aa, Mycobacterium tuberculosis
IDAADQFSADEAAHLA

SEQ ID NO: 66017 - protein, 16 aa, Mycobacterium tuberculosis
DAADQFSADEAAHLAR

SEQ ID NO: 66018 - protein, 16 aa, Mycobacterium tuberculosis
AADQFSADEAAHLARR

SEQ ID NO: 66019 - protein, 16 aa, Mycobacterium tuberculosis
ADQFSADEAAHLARRL

SEQ ID NO: 66020 - protein, 16 aa, Mycobacterium tuberculosis
DQFSADEAAHLARRLS

SEQ ID NO: 66021 - protein, 16 aa, Mycobacterium tuberculosis
QFSADEAAHLARRLSR

SEQ ID NO: 66022 - protein, 16 aa, Mycobacterium tuberculosis
FSADEAAHLARRLSRW

SEQ ID NO: 66023 - protein, 16 aa, Mycobacterium tuberculosis
SADEAAHLARRLSRWD

SEQ ID NO: 66024 - protein, 16 aa, Mycobacterium tuberculosis
ADEAAHLARRLSRWDS

SEQ ID NO: 66025 - protein, 16 aa, Mycobacterium tuberculosis
DEAAHLARRLSRWDSN

SEQ ID NO: 66026 - protein, 16 aa, Mycobacterium tuberculosis
EAAHLARRLSRWDSNP

SEQ ID NO: 66027 - protein, 16 aa, Mycobacterium tuberculosis
AAHLARRLSRWDSNPT

SEQ ID NO: 66028 - protein, 16 aa, Mycobacterium tuberculosis
AHLARRLSRWDSNPTH

SEQ ID NO: 66029 - protein, 16 aa, Mycobacterium tuberculosis
HLARRLSRWDSNPTHA

SEQ ID NO: 66030 - protein, 16 aa, Mycobacterium tuberculosis
LARRLSRWDSNPTHAG

SEQ ID NO: 66031 - protein, 16 aa, Mycobacterium tuberculosis
ARRLSRWDSNPTHAGL

SEQ ID NO: 66032 - protein, 16 aa, Mycobacterium tuberculosis
RRLSRWDSNPTHAGLR

SEQ ID NO: 66033 - protein, 16 aa, Mycobacterium tuberculosis
RLSRWDSNPTHAGLRS

SEQ ID NO: 66034 - protein, 16 aa, Mycobacterium tuberculosis
LSRWDSNPTHAGLRSA

SEQ ID NO: 66035 - protein, 16 aa, Mycobacterium tuberculosis
SRWDSNPTHAGLRSAA

SEQ ID NO: 66036 - protein, 16 aa, Mycobacterium tuberculosis
RWDSNPTHAGLRSAAT

SEQ ID NO: 66037 - protein, 16 aa, Mycobacterium tuberculosis
WDSNPTHAGLRSAATR

SEQ ID NO: 66038 - protein, 16 aa, Mycobacterium tuberculosis
DSNPTHAGLRSAATRG

SEQ ID NO: 66039 - protein, 16 aa, Mycobacterium tuberculosis
SNPTHAGLRSAATRGA

SEQ ID NO: 66040 - protein, 16 aa, Mycobacterium tuberculosis
NPTHAGLRSAATRGAS

SEQ ID NO: 66041 - protein, 16 aa, Mycobacterium tuberculosis
PTHAGLRSAATRGASF

SEQ ID NO: 66042 - protein, 16 aa, Mycobacterium tuberculosis
THAGLRSAATRGASFT

SEQ ID NO: 66043 - protein, 16 aa, Mycobacterium tuberculosis
HAGLRSAATRGASFTT

SEQ ID NO: 66044 - protein, 16 aa, Mycobacterium tuberculosis
AGLRSAATRGASFTTL

SEQ ID NO: 66045 - protein, 16 aa, Mycobacterium tuberculosis
GLRSAATRGASFTTLL

SEQ ID NO: 66046 - protein, 16 aa, Mycobacterium tuberculosis
LRSAATRGASFTTLLG

SEQ ID NO: 66047 - protein, 16 aa, Mycobacterium tuberculosis
RSAATRGASFTTLLGI

SEQ ID NO: 66048 - protein, 16 aa, Mycobacterium tuberculosis
SAATRGASFTTLLGIE

SEQ ID NO: 66049 - protein, 16 aa, Mycobacterium tuberculosis
AATRGASFTTLLGIED

SEQ ID NO: 66050 - protein, 16 aa, Mycobacterium tuberculosis
ATRGASFTTLLGIEDA

SEQ ID NO: 66051 - protein, 16 aa, Mycobacterium tuberculosis
TRGASFTTLLGIEDAS

SEQ ID NO: 66052 - protein, 16 aa, Mycobacterium tuberculosis
RGASFTTLLGIEDASR

SEQ ID NO: 66053 - protein, 16 aa, Mycobacterium tuberculosis
GASFTTLLGIEDASRL

SEQ ID NO: 66054 - protein, 16 aa, Mycobacterium tuberculosis
ASFTTLLGIEDASRLD

SEQ ID NO: 66055 - protein, 16 aa, Mycobacterium tuberculosis
SFTTLLGIEDASRLDV

SEQ ID NO: 66056 - protein, 16 aa, Mycobacterium tuberculosis
FTTLLGIEDASRLDVP

SEQ ID NO: 66057 - protein, 16 aa, Mycobacterium tuberculosis
TTLLGIEDASRLDVPA

SEQ ID NO: 66058 - protein, 16 aa, Mycobacterium tuberculosis
TLLGIEDASRLDVPAL

SEQ ID NO: 66059 - protein, 16 aa, Mycobacterium tuberculosis
LLGIEDASRLDVPALW

SEQ ID NO: 66060 - protein, 16 aa, Mycobacterium tuberculosis
LGIEDASRLDVPALWA

SEQ ID NO: 66061 - protein, 16 aa, Mycobacterium tuberculosis
GIEDASRLDVPALWAP

SEQ ID NO: 66062 - protein, 16 aa, Mycobacterium tuberculosis
IEDASRLDVPALWAPR

SEQ ID NO: 66063 - protein, 16 aa, Mycobacterium tuberculosis
EDASRLDVPALWAPRR

SEQ ID NO: 66064 - protein, 16 aa, Mycobacterium tuberculosis
DASRLDVPALWAPRRR

SEQ ID NO: 66065 - protein, 16 aa, Mycobacterium tuberculosis
ASRLDVPALWAPRRRD

SEQ ID NO: 66066 - protein, 16 aa, Mycobacterium tuberculosis
SRLDVPALWAPRRRDE

SEQ ID NO: 66067 - protein, 16 aa, Mycobacterium tuberculosis
RLDVPALWAPRRRDEE

SEQ ID NO: 66068 - protein, 16 aa, Mycobacterium tuberculosis
LDVPALWAPRRRDEEL

SEQ ID NO: 66069 - protein, 16 aa, Mycobacterium tuberculosis
DVPALWAPRRRDEELR

SEQ ID NO: 66070 - protein, 16 aa, Mycobacterium tuberculosis
VPALWAPRRRDEELRV

SEQ ID NO: 66071 - protein, 16 aa, Mycobacterium tuberculosis
PALWAPRRRDEELRVP

SEQ ID NO: 66072 - protein, 16 aa, Mycobacterium tuberculosis
ALWAPRRRDEELRVPI

SEQ ID NO: 66073 - protein, 16 aa, Mycobacterium tuberculosis
LWAPRRRDEELRVPIG

SEQ ID NO: 66074 - protein, 16 aa, Mycobacterium tuberculosis
WAPRRRDEELRVPIGV

SEQ ID NO: 66075 - protein, 16 aa, Mycobacterium tuberculosis
APRRRDEELRVPIGVT

SEQ ID NO: 66076 - protein, 16 aa, Mycobacterium tuberculosis
PRRRDEELRVPIGVTG

SEQ ID NO: 66077 - protein, 16 aa, Mycobacterium tuberculosis
RRRDEELRVPIGVTGT

SEQ ID NO: 66078 - protein, 16 aa, Mycobacterium tuberculosis
RRDEELRVPIGVTGTG

SEQ ID NO: 66079 - protein, 16 aa, Mycobacterium tuberculosis
RDEELRVPIGVTGTGE

SEQ ID NO: 66080 - protein, 16 aa, Mycobacterium tuberculosis
DEELRVPIGVTGTGEP

SEQ ID NO: 66081 - protein, 16 aa, Mycobacterium tuberculosis
EELRVPIGVTGTGEPL

SEQ ID NO: 66082 - protein, 16 aa, Mycobacterium tuberculosis
ELRVPIGVTGTGEPLM

SEQ ID NO: 66083 - protein, 16 aa, Mycobacterium tuberculosis
LRVPIGVTGTGEPLMF

SEQ ID NO: 66084 - protein, 16 aa, Mycobacterium tuberculosis
RVPIGVTGTGEPLMFD

SEQ ID NO: 66085 - protein, 16 aa, Mycobacterium tuberculosis
VPIGVTGTGEPLMFDL

SEQ ID NO: 66086 - protein, 16 aa, Mycobacterium tuberculosis
PIGVTGTGEPLMFDLK

SEQ ID NO: 66087 - protein, 16 aa, Mycobacterium tuberculosis
IGVTGTGEPLMFDLKD

SEQ ID NO: 66088 - protein, 16 aa, Mycobacterium tuberculosis
GVTGTGEPLMFDLKDE

SEQ ID NO: 66089 - protein, 16 aa, Mycobacterium tuberculosis
VTGTGEPLMFDLKDEA

SEQ ID NO: 66090 - protein, 16 aa, Mycobacterium tuberculosis
TGTGEPLMFDLKDEAE

SEQ ID NO: 66091 - protein, 16 aa, Mycobacterium tuberculosis
GTGEPLMFDLKDEAEG

SEQ ID NO: 66092 - protein, 16 aa, Mycobacterium tuberculosis
TGEPLMFDLKDEAEGG

SEQ ID NO: 66093 - protein, 16 aa, Mycobacterium tuberculosis
GEPLMFDLKDEAEGGM

SEQ ID NO: 66094 - protein, 16 aa, Mycobacterium tuberculosis
EPLMFDLKDEAEGGMG

SEQ ID NO: 66095 - protein, 16 aa, Mycobacterium tuberculosis
PLMFDLKDEAEGGMGP

SEQ ID NO: 66096 - protein, 16 aa, Mycobacterium tuberculosis
LMFDLKDEAEGGMGPH

SEQ ID NO: 66097 - protein, 16 aa, Mycobacterium tuberculosis
MFDLKDEAEGGMGPHG

SEQ ID NO: 66098 - protein, 16 aa, Mycobacterium tuberculosis
FDLKDEAEGGMGPHGL

SEQ ID NO: 66099 - protein, 16 aa, Mycobacterium tuberculosis
DLKDEAEGGMGPHGLM

SEQ ID NO: 66100 - protein, 16 aa, Mycobacterium tuberculosis
LKDEAEGGMGPHGLMI

SEQ ID NO: 66101 - protein, 16 aa, Mycobacterium tuberculosis
KDEAEGGMGPHGLMIG

SEQ ID NO: 66102 - protein, 16 aa, Mycobacterium tuberculosis
DEAEGGMGPHGLMIGM

SEQ ID NO: 66103 - protein, 16 aa, Mycobacterium tuberculosis
EAEGGMGPHGLMIGMT

SEQ ID NO: 66104 - protein, 16 aa, Mycobacterium tuberculosis
AEGGMGPHGLMIGMTG

SEQ ID NO: 66105 - protein, 16 aa, Mycobacterium tuberculosis
EGGMGPHGLMIGMTGS

SEQ ID NO: 66106 - protein, 16 aa, Mycobacterium tuberculosis
GGMGPHGLMIGMTGSG

SEQ ID NO: 66107 - protein, 16 aa, Mycobacterium tuberculosis
GMGPHGLMIGMTGSGK

SEQ ID NO: 66108 - protein, 16 aa, Mycobacterium tuberculosis
MGPHGLMIGMTGSGKS

SEQ ID NO: 66109 - protein, 16 aa, Mycobacterium tuberculosis
GPHGLMIGMTGSGKSQ

SEQ ID NO: 66110 - protein, 16 aa, Mycobacterium tuberculosis
PHGLMIGMTGSGKSQT

SEQ ID NO: 66111 - protein, 16 aa, Mycobacterium tuberculosis
HGLMIGMTGSGKSQTL

SEQ ID NO: 66112 - protein, 16 aa, Mycobacterium tuberculosis
GLMIGMTGSGKSQTLM

SEQ ID NO: 66113 - protein, 16 aa, Mycobacterium tuberculosis
LMIGMTGSGKSQTLMS

SEQ ID NO: 66114 - protein, 16 aa, Mycobacterium tuberculosis
MIGMTGSGKSQTLMSI

SEQ ID NO: 66115 - protein, 16 aa, Mycobacterium tuberculosis
IGMTGSGKSQTLMSIL

SEQ ID NO: 66116 - protein, 16 aa, Mycobacterium tuberculosis
GMTGSGKSQTLMSILL

SEQ ID NO: 66117 - protein, 16 aa, Mycobacterium tuberculosis
MTGSGKSQTLMSILLS

SEQ ID NO: 66118 - protein, 16 aa, Mycobacterium tuberculosis
TGSGKSQTLMSILLSL

SEQ ID NO: 66119 - protein, 16 aa, Mycobacterium tuberculosis
GSGKSQTLMSILLSLL

SEQ ID NO: 66120 - protein, 16 aa, Mycobacterium tuberculosis
SGKSQTLMSILLSLLT

SEQ ID NO: 66121 - protein, 16 aa, Mycobacterium tuberculosis
GKSQTLMSILLSLLTT

SEQ ID NO: 66122 - protein, 16 aa, Mycobacterium tuberculosis
KSQTLMSILLSLLTTH

SEQ ID NO: 66123 - protein, 16 aa, Mycobacterium tuberculosis
SQTLMSILLSLLTTHS

SEQ ID NO: 66124 - protein, 16 aa, Mycobacterium tuberculosis
QTLMSILLSLLTTHSA

SEQ ID NO: 66125 - protein, 16 aa, Mycobacterium tuberculosis
TLMSILLSLLTTHSAE

SEQ ID NO: 66126 - protein, 16 aa, Mycobacterium tuberculosis
LMSILLSLLTTHSAER

SEQ ID NO: 66127 - protein, 16 aa, Mycobacterium tuberculosis
MSILLSLLTTHSAERL

SEQ ID NO: 66128 - protein, 16 aa, Mycobacterium tuberculosis
SILLSLLTTHSAERLI

SEQ ID NO: 66129 - protein, 16 aa, Mycobacterium tuberculosis
ILLSLLTTHSAERLIV

SEQ ID NO: 66130 - protein, 16 aa, Mycobacterium tuberculosis
LLSLLTTHSAERLIVI

SEQ ID NO: 66131 - protein, 16 aa, Mycobacterium tuberculosis
LSLLTTHSAERLIVIY

SEQ ID NO: 66132 - protein, 16 aa, Mycobacterium tuberculosis
SLLTTHSAERLIVIYA

SEQ ID NO: 66133 - protein, 16 aa, Mycobacterium tuberculosis
LLTTHSAERLIVIYAD

SEQ ID NO: 66134 - protein, 16 aa, Mycobacterium tuberculosis
LTTHSAERLIVIYADF

SEQ ID NO: 66135 - protein, 16 aa, Mycobacterium tuberculosis
TTHSAERLIVIYADFK

SEQ ID NO: 66136 - protein, 16 aa, Mycobacterium tuberculosis
THSAERLIVIYADFKG

SEQ ID NO: 66137 - protein, 16 aa, Mycobacterium tuberculosis
HSAERLIVIYADFKGE

SEQ ID NO: 66138 - protein, 16 aa, Mycobacterium tuberculosis
SAERLIVIYADFKGEA

SEQ ID NO: 66139 - protein, 16 aa, Mycobacterium tuberculosis
AERLIVIYADFKGEAG

SEQ ID NO: 66140 - protein, 16 aa, Mycobacterium tuberculosis
ERLIVIYADFKGEAGA

SEQ ID NO: 66141 - protein, 16 aa, Mycobacterium tuberculosis
RLIVIYADFKGEAGAD

SEQ ID NO: 66142 - protein, 16 aa, Mycobacterium tuberculosis
LIVIYADFKGEAGADS

SEQ ID NO: 66143 - protein, 16 aa, Mycobacterium tuberculosis
IVIYADFKGEAGADSF

SEQ ID NO: 66144 - protein, 16 aa, Mycobacterium tuberculosis
VIYADFKGEAGADSFR

SEQ ID NO: 66145 - protein, 16 aa, Mycobacterium tuberculosis
IYADFKGEAGADSFRD

SEQ ID NO: 66146 - protein, 16 aa, Mycobacterium tuberculosis
YADFKGEAGADSFRDF

SEQ ID NO: 66147 - protein, 16 aa, Mycobacterium tuberculosis
ADFKGEAGADSFRDFP

SEQ ID NO: 66148 - protein, 16 aa, Mycobacterium tuberculosis
DFKGEAGADSFRDFPQ

SEQ ID NO: 66149 - protein, 16 aa, Mycobacterium tuberculosis
FKGEAGADSFRDFPQV

SEQ ID NO: 66150 - protein, 16 aa, Mycobacterium tuberculosis
KGEAGADSFRDFPQVV

SEQ ID NO: 66151 - protein, 16 aa, Mycobacterium tuberculosis
GEAGADSFRDFPQVVA

SEQ ID NO: 66152 - protein, 16 aa, Mycobacterium tuberculosis
EAGADSFRDFPQVVAV

SEQ ID NO: 66153 - protein, 16 aa, Mycobacterium tuberculosis
AGADSFRDFPQVVAVI

SEQ ID NO: 66154 - protein, 16 aa, Mycobacterium tuberculosis
GADSFRDFPQVVAVIS

SEQ ID NO: 66155 - protein, 16 aa, Mycobacterium tuberculosis
ADSFRDFPQVVAVISN

SEQ ID NO: 66156 - protein, 16 aa, Mycobacterium tuberculosis
DSFRDFPQVVAVISNM

SEQ ID NO: 66157 - protein, 16 aa, Mycobacterium tuberculosis
SFRDFPQVVAVISNMA

SEQ ID NO: 66158 - protein, 16 aa, Mycobacterium tuberculosis
FRDFPQVVAVISNMAE

SEQ ID NO: 66159 - protein, 16 aa, Mycobacterium tuberculosis
RDFPQVVAVISNMAEK

SEQ ID NO: 66160 - protein, 16 aa, Mycobacterium tuberculosis
DFPQVVAVISNMAEKK

SEQ ID NO: 66161 - protein, 16 aa, Mycobacterium tuberculosis
FPQVVAVISNMAEKKS

SEQ ID NO: 66162 - protein, 16 aa, Mycobacterium tuberculosis
PQVVAVISNMAEKKSL

SEQ ID NO: 66163 - protein, 16 aa, Mycobacterium tuberculosis
QVVAVISNMAEKKSLA

SEQ ID NO: 66164 - protein, 16 aa, Mycobacterium tuberculosis
VVAVISNMAEKKSLAD

SEQ ID NO: 66165 - protein, 16 aa, Mycobacterium tuberculosis
VAVISNMAEKKSLADR

SEQ ID NO: 66166 - protein, 16 aa, Mycobacterium tuberculosis
AVISNMAEKKSLADRF

SEQ ID NO: 66167 - protein, 16 aa, Mycobacterium tuberculosis
VISNMAEKKSLADRFA

SEQ ID NO: 66168 - protein, 16 aa, Mycobacterium tuberculosis
ISNMAEKKSLADRFAD

SEQ ID NO: 66169 - protein, 16 aa, Mycobacterium tuberculosis
SNMAEKKSLADRFADT

SEQ ID NO: 66170 - protein, 16 aa, Mycobacterium tuberculosis
NMAEKKSLADRFADTL

SEQ ID NO: 66171 - protein, 16 aa, Mycobacterium tuberculosis
MAEKKSLADRFADTLR

SEQ ID NO: 66172 - protein, 16 aa, Mycobacterium tuberculosis
AEKKSLADRFADTLRG

SEQ ID NO: 66173 - protein, 16 aa, Mycobacterium tuberculosis
EKKSLADRFADTLRGE

SEQ ID NO: 66174 - protein, 16 aa, Mycobacterium tuberculosis
KKSLADRFADTLRGEV

SEQ ID NO: 66175 - protein, 16 aa, Mycobacterium tuberculosis
KSLADRFADTLRGEVA

SEQ ID NO: 66176 - protein, 16 aa, Mycobacterium tuberculosis
SLADRFADTLRGEVAR

SEQ ID NO: 66177 - protein, 16 aa, Mycobacterium tuberculosis
LADRFADTLRGEVARR

SEQ ID NO: 66178 - protein, 16 aa, Mycobacterium tuberculosis
ADRFADTLRGEVARRE

SEQ ID NO: 66179 - protein, 16 aa, Mycobacterium tuberculosis
DRFADTLRGEVARREM

SEQ ID NO: 66180 - protein, 16 aa, Mycobacterium tuberculosis
RFADTLRGEVARREML

SEQ ID NO: 66181 - protein, 16 aa, Mycobacterium tuberculosis
FADTLRGEVARREMLL

SEQ ID NO: 66182 - protein, 16 aa, Mycobacterium tuberculosis
ADTLRGEVARREMLLR

SEQ ID NO: 66183 - protein, 16 aa, Mycobacterium tuberculosis
DTLRGEVARREMLLRE

SEQ ID NO: 66184 - protein, 16 aa, Mycobacterium tuberculosis
TLRGEVARREMLLREA

SEQ ID NO: 66185 - protein, 16 aa, Mycobacterium tuberculosis
LRGEVARREMLLREAG

SEQ ID NO: 66186 - protein, 16 aa, Mycobacterium tuberculosis
RGEVARREMLLREAGR

SEQ ID NO: 66187 - protein, 16 aa, Mycobacterium tuberculosis
GEVARREMLLREAGRK

SEQ ID NO: 66188 - protein, 16 aa, Mycobacterium tuberculosis
EVARREMLLREAGRKV

SEQ ID NO: 66189 - protein, 16 aa, Mycobacterium tuberculosis
VARREMLLREAGRKVQ

SEQ ID NO: 66190 - protein, 16 aa, Mycobacterium tuberculosis
ARREMLLREAGRKVQG

SEQ ID NO: 66191 - protein, 16 aa, Mycobacterium tuberculosis
RREMLLREAGRKVQGS

SEQ ID NO: 66192 - protein, 16 aa, Mycobacterium tuberculosis
REMLLREAGRKVQGSA

SEQ ID NO: 66193 - protein, 16 aa, Mycobacterium tuberculosis
EMLLREAGRKVQGSAF

SEQ ID NO: 66194 - protein, 16 aa, Mycobacterium tuberculosis
MLLREAGRKVQGSAFN

SEQ ID NO: 66195 - protein, 16 aa, Mycobacterium tuberculosis
LLREAGRKVQGSAFNS

SEQ ID NO: 66196 - protein, 16 aa, Mycobacterium tuberculosis
LREAGRKVQGSAFNSV

SEQ ID NO: 66197 - protein, 16 aa, Mycobacterium tuberculosis
REAGRKVQGSAFNSVL

SEQ ID NO: 66198 - protein, 16 aa, Mycobacterium tuberculosis
EAGRKVQGSAFNSVLE

SEQ ID NO: 66199 - protein, 16 aa, Mycobacterium tuberculosis
AGRKVQGSAFNSVLEY

SEQ ID NO: 66200 - protein, 16 aa, Mycobacterium tuberculosis
GRKVQGSAFNSVLEYE

SEQ ID NO: 66201 - protein, 16 aa, Mycobacterium tuberculosis
RKVQGSAFNSVLEYEN

SEQ ID NO: 66202 - protein, 16 aa, Mycobacterium tuberculosis
KVQGSAFNSVLEYENA

SEQ ID NO: 66203 - protein, 16 aa, Mycobacterium tuberculosis
VQGSAFNSVLEYENAI

SEQ ID NO: 66204 - protein, 16 aa, Mycobacterium tuberculosis
QGSAFNSVLEYENAIA

SEQ ID NO: 66205 - protein, 16 aa, Mycobacterium tuberculosis
GSAFNSVLEYENAIAA

SEQ ID NO: 66206 - protein, 16 aa, Mycobacterium tuberculosis
SAFNSVLEYENAIAAG

SEQ ID NO: 66207 - protein, 16 aa, Mycobacterium tuberculosis
AFNSVLEYENAIAAGH

SEQ ID NO: 66208 - protein, 16 aa, Mycobacterium tuberculosis
FNSVLEYENAIAAGHS

SEQ ID NO: 66209 - protein, 16 aa, Mycobacterium tuberculosis
NSVLEYENAIAAGHSL

SEQ ID NO: 66210 - protein, 16 aa, Mycobacterium tuberculosis
SVLEYENAIAAGHSLP

SEQ ID NO: 66211 - protein, 16 aa, Mycobacterium tuberculosis
VLEYENAIAAGHSLPP

SEQ ID NO: 66212 - protein, 16 aa, Mycobacterium tuberculosis
LEYENAIAAGHSLPPI

SEQ ID NO: 66213 - protein, 16 aa, Mycobacterium tuberculosis
EYENAIAAGHSLPPIP

SEQ ID NO: 66214 - protein, 16 aa, Mycobacterium tuberculosis
YENAIAAGHSLPPIPT

SEQ ID NO: 66215 - protein, 16 aa, Mycobacterium tuberculosis
ENAIAAGHSLPPIPTL

SEQ ID NO: 66216 - protein, 16 aa, Mycobacterium tuberculosis
NAIAAGHSLPPIPTLF

SEQ ID NO: 66217 - protein, 16 aa, Mycobacterium tuberculosis
AIAAGHSLPPIPTLFV

SEQ ID NO: 66218 - protein, 16 aa, Mycobacterium tuberculosis
IAAGHSLPPIPTLFVV

SEQ ID NO: 66219 - protein, 16 aa, Mycobacterium tuberculosis
AAGHSLPPIPTLFVVA

SEQ ID NO: 66220 - protein, 16 aa, Mycobacterium tuberculosis
AGHSLPPIPTLFVVAD

SEQ ID NO: 66221 - protein, 16 aa, Mycobacterium tuberculosis
GHSLPPIPTLFVVADE

SEQ ID NO: 66222 - protein, 16 aa, Mycobacterium tuberculosis
HSLPPIPTLFVVADEF

SEQ ID NO: 66223 - protein, 16 aa, Mycobacterium tuberculosis
SLPPIPTLFVVADEFT

SEQ ID NO: 66224 - protein, 16 aa, Mycobacterium tuberculosis
LPPIPTLFVVADEFTL

SEQ ID NO: 66225 - protein, 16 aa, Mycobacterium tuberculosis
PPIPTLFVVADEFTLM

SEQ ID NO: 66226 - protein, 16 aa, Mycobacterium tuberculosis
PIPTLFVVADEFTLML

SEQ ID NO: 66227 - protein, 16 aa, Mycobacterium tuberculosis
IPTLFVVADEFTLMLA

SEQ ID NO: 66228 - protein, 16 aa, Mycobacterium tuberculosis
PTLFVVADEFTLMLAD

SEQ ID NO: 66229 - protein, 16 aa, Mycobacterium tuberculosis
TLFVVADEFTLMLADH

SEQ ID NO: 66230 - protein, 16 aa, Mycobacterium tuberculosis
LFVVADEFTLMLADHP

SEQ ID NO: 66231 - protein, 16 aa, Mycobacterium tuberculosis
FVVADEFTLMLADHPE

SEQ ID NO: 66232 - protein, 16 aa, Mycobacterium tuberculosis
VVADEFTLMLADHPEY

SEQ ID NO: 66233 - protein, 16 aa, Mycobacterium tuberculosis
VADEFTLMLADHPEYA

SEQ ID NO: 66234 - protein, 16 aa, Mycobacterium tuberculosis
ADEFTLMLADHPEYAE

SEQ ID NO: 66235 - protein, 16 aa, Mycobacterium tuberculosis
DEFTLMLADHPEYAEL

SEQ ID NO: 66236 - protein, 16 aa, Mycobacterium tuberculosis
EFTLMLADHPEYAELF

SEQ ID NO: 66237 - protein, 16 aa, Mycobacterium tuberculosis
FTLMLADHPEYAELFD

SEQ ID NO: 66238 - protein, 16 aa, Mycobacterium tuberculosis
TLMLADHPEYAELFDY

SEQ ID NO: 66239 - protein, 16 aa, Mycobacterium tuberculosis
LMLADHPEYAELFDYV

SEQ ID NO: 66240 - protein, 16 aa, Mycobacterium tuberculosis
MLADHPEYAELFDYVA

SEQ ID NO: 66241 - protein, 16 aa, Mycobacterium tuberculosis
LADHPEYAELFDYVAR

SEQ ID NO: 66242 - protein, 16 aa, Mycobacterium tuberculosis
ADHPEYAELFDYVARK

SEQ ID NO: 66243 - protein, 16 aa, Mycobacterium tuberculosis
DHPEYAELFDYVARKG

SEQ ID NO: 66244 - protein, 16 aa, Mycobacterium tuberculosis
HPEYAELFDYVARKGR

SEQ ID NO: 66245 - protein, 16 aa, Mycobacterium tuberculosis
PEYAELFDYVARKGRS

SEQ ID NO: 66246 - protein, 16 aa, Mycobacterium tuberculosis
EYAELFDYVARKGRSF

SEQ ID NO: 66247 - protein, 16 aa, Mycobacterium tuberculosis
YAELFDYVARKGRSFR

SEQ ID NO: 66248 - protein, 16 aa, Mycobacterium tuberculosis
AELFDYVARKGRSFRI

SEQ ID NO: 66249 - protein, 16 aa, Mycobacterium tuberculosis
ELFDYVARKGRSFRIH

SEQ ID NO: 66250 - protein, 16 aa, Mycobacterium tuberculosis
LFDYVARKGRSFRIHI

SEQ ID NO: 66251 - protein, 16 aa, Mycobacterium tuberculosis
FDYVARKGRSFRIHIL

SEQ ID NO: 66252 - protein, 16 aa, Mycobacterium tuberculosis
DYVARKGRSFRIHILF

SEQ ID NO: 66253 - protein, 16 aa, Mycobacterium tuberculosis
YVARKGRSFRIHILFA

SEQ ID NO: 66254 - protein, 16 aa, Mycobacterium tuberculosis
VARKGRSFRIHILFAS

SEQ ID NO: 66255 - protein, 16 aa, Mycobacterium tuberculosis
ARKGRSFRIHILFASQ

SEQ ID NO: 66256 - protein, 16 aa, Mycobacterium tuberculosis
RKGRSFRIHILFASQT

SEQ ID NO: 66257 - protein, 16 aa, Mycobacterium tuberculosis
KGRSFRIHILFASQTL

SEQ ID NO: 66258 - protein, 16 aa, Mycobacterium tuberculosis
GRSFRIHILFASQTLD

SEQ ID NO: 66259 - protein, 16 aa, Mycobacterium tuberculosis
RSFRIHILFASQTLDV

SEQ ID NO: 66260 - protein, 16 aa, Mycobacterium tuberculosis
SFRIHILFASQTLDVG

SEQ ID NO: 66261 - protein, 16 aa, Mycobacterium tuberculosis
FRIHILFASQTLDVGK

SEQ ID NO: 66262 - protein, 16 aa, Mycobacterium tuberculosis
RIHILFASQTLDVGKI

SEQ ID NO: 66263 - protein, 16 aa, Mycobacterium tuberculosis
IHILFASQTLDVGKIK

SEQ ID NO: 66264 - protein, 16 aa, Mycobacterium tuberculosis
HILFASQTLDVGKIKD

SEQ ID NO: 66265 - protein, 16 aa, Mycobacterium tuberculosis
ILFASQTLDVGKIKDI

SEQ ID NO: 66266 - protein, 16 aa, Mycobacterium tuberculosis
LFASQTLDVGKIKDID

SEQ ID NO: 66267 - protein, 16 aa, Mycobacterium tuberculosis
FASQTLDVGKIKDIDK

SEQ ID NO: 66268 - protein, 16 aa, Mycobacterium tuberculosis
ASQTLDVGKIKDIDKN

SEQ ID NO: 66269 - protein, 16 aa, Mycobacterium tuberculosis
SQTLDVGKIKDIDKNT

SEQ ID NO: 66270 - protein, 16 aa, Mycobacterium tuberculosis
QTLDVGKIKDIDKNTA

SEQ ID NO: 66271 - protein, 16 aa, Mycobacterium tuberculosis
TLDVGKIKDIDKNTAY

SEQ ID NO: 66272 - protein, 16 aa, Mycobacterium tuberculosis
LDVGKIKDIDKNTAYR

SEQ ID NO: 66273 - protein, 16 aa, Mycobacterium tuberculosis
DVGKIKDIDKNTAYRI

SEQ ID NO: 66274 - protein, 16 aa, Mycobacterium tuberculosis
VGKIKDIDKNTAYRIG

SEQ ID NO: 66275 - protein, 16 aa, Mycobacterium tuberculosis
GKIKDIDKNTAYRIGL

SEQ ID NO: 66276 - protein, 16 aa, Mycobacterium tuberculosis
KIKDIDKNTAYRIGLK

SEQ ID NO: 66277 - protein, 16 aa, Mycobacterium tuberculosis
IKDIDKNTAYRIGLKV

SEQ ID NO: 66278 - protein, 16 aa, Mycobacterium tuberculosis
KDIDKNTAYRIGLKVA

SEQ ID NO: 66279 - protein, 16 aa, Mycobacterium tuberculosis
DIDKNTAYRIGLKVAS

SEQ ID NO: 66280 - protein, 16 aa, Mycobacterium tuberculosis
IDKNTAYRIGLKVASP

SEQ ID NO: 66281 - protein, 16 aa, Mycobacterium tuberculosis
DKNTAYRIGLKVASPS

SEQ ID NO: 66282 - protein, 16 aa, Mycobacterium tuberculosis
KNTAYRIGLKVASPSV

SEQ ID NO: 66283 - protein, 16 aa, Mycobacterium tuberculosis
NTAYRIGLKVASPSVS

SEQ ID NO: 66284 - protein, 16 aa, Mycobacterium tuberculosis
TAYRIGLKVASPSVSR

SEQ ID NO: 66285 - protein, 16 aa, Mycobacterium tuberculosis
AYRIGLKVASPSVSRQ

SEQ ID NO: 66286 - protein, 16 aa, Mycobacterium tuberculosis
YRIGLKVASPSVSRQI

SEQ ID NO: 66287 - protein, 16 aa, Mycobacterium tuberculosis
RIGLKVASPSVSRQII

SEQ ID NO: 66288 - protein, 16 aa, Mycobacterium tuberculosis
IGLKVASPSVSRQIIG

SEQ ID NO: 66289 - protein, 16 aa, Mycobacterium tuberculosis
GLKVASPSVSRQIIGV

SEQ ID NO: 66290 - protein, 16 aa, Mycobacterium tuberculosis
LKVASPSVSRQIIGVE

SEQ ID NO: 66291 - protein, 16 aa, Mycobacterium tuberculosis
KVASPSVSRQIIGVED

SEQ ID NO: 66292 - protein, 16 aa, Mycobacterium tuberculosis
VASPSVSRQIIGVEDA

SEQ ID NO: 66293 - protein, 16 aa, Mycobacterium tuberculosis
ASPSVSRQIIGVEDAY

SEQ ID NO: 66294 - protein, 16 aa, Mycobacterium tuberculosis
SPSVSRQIIGVEDAYH

SEQ ID NO: 66295 - protein, 16 aa, Mycobacterium tuberculosis
PSVSRQIIGVEDAYHI

SEQ ID NO: 66296 - protein, 16 aa, Mycobacterium tuberculosis
SVSRQIIGVEDAYHIE

SEQ ID NO: 66297 - protein, 16 aa, Mycobacterium tuberculosis
VSRQIIGVEDAYHIES

SEQ ID NO: 66298 - protein, 16 aa, Mycobacterium tuberculosis
SRQIIGVEDAYHIESG

SEQ ID NO: 66299 - protein, 16 aa, Mycobacterium tuberculosis
RQIIGVEDAYHIESGK

SEQ ID NO: 66300 - protein, 16 aa, Mycobacterium tuberculosis
QIIGVEDAYHIESGKE

SEQ ID NO: 66301 - protein, 16 aa, Mycobacterium tuberculosis
IIGVEDAYHIESGKEH

SEQ ID NO: 66302 - protein, 16 aa, Mycobacterium tuberculosis
IGVEDAYHIESGKEHK

SEQ ID NO: 66303 - protein, 16 aa, Mycobacterium tuberculosis
GVEDAYHIESGKEHKG

SEQ ID NO: 66304 - protein, 16 aa, Mycobacterium tuberculosis
VEDAYHIESGKEHKGV

SEQ ID NO: 66305 - protein, 16 aa, Mycobacterium tuberculosis
EDAYHIESGKEHKGVG

SEQ ID NO: 66306 - protein, 16 aa, Mycobacterium tuberculosis
DAYHIESGKEHKGVGF

SEQ ID NO: 66307 - protein, 16 aa, Mycobacterium tuberculosis
AYHIESGKEHKGVGFL

SEQ ID NO: 66308 - protein, 16 aa, Mycobacterium tuberculosis
YHIESGKEHKGVGFLV

SEQ ID NO: 66309 - protein, 16 aa, Mycobacterium tuberculosis
HIESGKEHKGVGFLVP

SEQ ID NO: 66310 - protein, 16 aa, Mycobacterium tuberculosis
IESGKEHKGVGFLVPA

SEQ ID NO: 66311 - protein, 16 aa, Mycobacterium tuberculosis
ESGKEHKGVGFLVPAP

SEQ ID NO: 66312 - protein, 16 aa, Mycobacterium tuberculosis
SGKEHKGVGFLVPAPG

SEQ ID NO: 66313 - protein, 16 aa, Mycobacterium tuberculosis
GKEHKGVGFLVPAPGA

SEQ ID NO: 66314 - protein, 16 aa, Mycobacterium tuberculosis
KEHKGVGFLVPAPGAT

SEQ ID NO: 66315 - protein, 16 aa, Mycobacterium tuberculosis
EHKGVGFLVPAPGATP

SEQ ID NO: 66316 - protein, 16 aa, Mycobacterium tuberculosis
HKGVGFLVPAPGATPI

SEQ ID NO: 66317 - protein, 16 aa, Mycobacterium tuberculosis
KGVGFLVPAPGATPIR

SEQ ID NO: 66318 - protein, 16 aa, Mycobacterium tuberculosis
GVGFLVPAPGATPIRF

SEQ ID NO: 66319 - protein, 16 aa, Mycobacterium tuberculosis
VGFLVPAPGATPIRFR

SEQ ID NO: 66320 - protein, 16 aa, Mycobacterium tuberculosis
GFLVPAPGATPIRFRS

SEQ ID NO: 66321 - protein, 16 aa, Mycobacterium tuberculosis
FLVPAPGATPIRFRST

SEQ ID NO: 66322 - protein, 16 aa, Mycobacterium tuberculosis
LVPAPGATPIRFRSTY

SEQ ID NO: 66323 - protein, 16 aa, Mycobacterium tuberculosis
VPAPGATPIRFRSTYV

SEQ ID NO: 66324 - protein, 16 aa, Mycobacterium tuberculosis
PAPGATPIRFRSTYVD

SEQ ID NO: 66325 - protein, 16 aa, Mycobacterium tuberculosis
APGATPIRFRSTYVDG

SEQ ID NO: 66326 - protein, 16 aa, Mycobacterium tuberculosis
PGATPIRFRSTYVDGI

SEQ ID NO: 66327 - protein, 16 aa, Mycobacterium tuberculosis
GATPIRFRSTYVDGIY

SEQ ID NO: 66328 - protein, 16 aa, Mycobacterium tuberculosis
ATPIRFRSTYVDGIYE

SEQ ID NO: 66329 - protein, 16 aa, Mycobacterium tuberculosis
TPIRFRSTYVDGIYEP

SEQ ID NO: 66330 - protein, 16 aa, Mycobacterium tuberculosis
PIRFRSTYVDGIYEPP

SEQ ID NO: 66331 - protein, 16 aa, Mycobacterium tuberculosis
IRFRSTYVDGIYEPPQ

SEQ ID NO: 66332 - protein, 16 aa, Mycobacterium tuberculosis
RFRSTYVDGIYEPPQT

SEQ ID NO: 66333 - protein, 16 aa, Mycobacterium tuberculosis
FRSTYVDGIYEPPQTA

SEQ ID NO: 66334 - protein, 16 aa, Mycobacterium tuberculosis
RSTYVDGIYEPPQTAK

SEQ ID NO: 66335 - protein, 16 aa, Mycobacterium tuberculosis
STYVDGIYEPPQTAKA

SEQ ID NO: 66336 - protein, 16 aa, Mycobacterium tuberculosis
TYVDGIYEPPQTAKAV

SEQ ID NO: 66337 - protein, 16 aa, Mycobacterium tuberculosis
YVDGIYEPPQTAKAVV

SEQ ID NO: 66338 - protein, 16 aa, Mycobacterium tuberculosis
VDGIYEPPQTAKAVVV

SEQ ID NO: 66339 - protein, 16 aa, Mycobacterium tuberculosis
DGIYEPPQTAKAVVVQ

SEQ ID NO: 66340 - protein, 16 aa, Mycobacterium tuberculosis
GIYEPPQTAKAVVVQS

SEQ ID NO: 66341 - protein, 16 aa, Mycobacterium tuberculosis
IYEPPQTAKAVVVQSV

SEQ ID NO: 66342 - protein, 16 aa, Mycobacterium tuberculosis
YEPPQTAKAVVVQSVP

SEQ ID NO: 66343 - protein, 16 aa, Mycobacterium tuberculosis
EPPQTAKAVVVQSVPE

SEQ ID NO: 66344 - protein, 16 aa, Mycobacterium tuberculosis
PPQTAKAVVVQSVPEP

SEQ ID NO: 66345 - protein, 16 aa, Mycobacterium tuberculosis
PQTAKAVVVQSVPEPK

SEQ ID NO: 66346 - protein, 16 aa, Mycobacterium tuberculosis
QTAKAVVVQSVPEPKL

SEQ ID NO: 66347 - protein, 16 aa, Mycobacterium tuberculosis
TAKAVVVQSVPEPKLF

SEQ ID NO: 66348 - protein, 16 aa, Mycobacterium tuberculosis
AKAVVVQSVPEPKLFT

SEQ ID NO: 66349 - protein, 16 aa, Mycobacterium tuberculosis
KAVVVQSVPEPKLFTA

SEQ ID NO: 66350 - protein, 16 aa, Mycobacterium tuberculosis
AVVVQSVPEPKLFTAA

SEQ ID NO: 66351 - protein, 16 aa, Mycobacterium tuberculosis
VVVQSVPEPKLFTAAA

SEQ ID NO: 66352 - protein, 16 aa, Mycobacterium tuberculosis
VVQSVPEPKLFTAAAV

SEQ ID NO: 66353 - protein, 16 aa, Mycobacterium tuberculosis
VQSVPEPKLFTAAAVE

SEQ ID NO: 66354 - protein, 16 aa, Mycobacterium tuberculosis
QSVPEPKLFTAAAVEP

SEQ ID NO: 66355 - protein, 16 aa, Mycobacterium tuberculosis
SVPEPKLFTAAAVEPD

SEQ ID NO: 66356 - protein, 16 aa, Mycobacterium tuberculosis
VPEPKLFTAAAVEPDP

SEQ ID NO: 66357 - protein, 16 aa, Mycobacterium tuberculosis
PEPKLFTAAAVEPDPG

SEQ ID NO: 66358 - protein, 16 aa, Mycobacterium tuberculosis
EPKLFTAAAVEPDPGT

SEQ ID NO: 66359 - protein, 16 aa, Mycobacterium tuberculosis
PKLFTAAAVEPDPGTV

SEQ ID NO: 66360 - protein, 16 aa, Mycobacterium tuberculosis
KLFTAAAVEPDPGTVI

SEQ ID NO: 66361 - protein, 16 aa, Mycobacterium tuberculosis
LFTAAAVEPDPGTVIA

SEQ ID NO: 66362 - protein, 16 aa, Mycobacterium tuberculosis
FTAAAVEPDPGTVIAD

SEQ ID NO: 66363 - protein, 16 aa, Mycobacterium tuberculosis
TAAAVEPDPGTVIADT

SEQ ID NO: 66364 - protein, 16 aa, Mycobacterium tuberculosis
AAAVEPDPGTVIADTD

SEQ ID NO: 66365 - protein, 16 aa, Mycobacterium tuberculosis
AAVEPDPGTVIADTDE

SEQ ID NO: 66366 - protein, 16 aa, Mycobacterium tuberculosis
AVEPDPGTVIADTDEQ

SEQ ID NO: 66367 - protein, 16 aa, Mycobacterium tuberculosis
VEPDPGTVIADTDEQE

SEQ ID NO: 66368 - protein, 16 aa, Mycobacterium tuberculosis
EPDPGTVIADTDEQEP

SEQ ID NO: 66369 - protein, 16 aa, Mycobacterium tuberculosis
PDPGTVIADTDEQEPA

SEQ ID NO: 66370 - protein, 16 aa, Mycobacterium tuberculosis
DPGTVIADTDEQEPAD

SEQ ID NO: 66371 - protein, 16 aa, Mycobacterium tuberculosis
PGTVIADTDEQEPADP

SEQ ID NO: 66372 - protein, 16 aa, Mycobacterium tuberculosis
GTVIADTDEQEPADPP

SEQ ID NO: 66373 - protein, 16 aa, Mycobacterium tuberculosis
TVIADTDEQEPADPPR

SEQ ID NO: 66374 - protein, 16 aa, Mycobacterium tuberculosis
VIADTDEQEPADPPRK

SEQ ID NO: 66375 - protein, 16 aa, Mycobacterium tuberculosis
IADTDEQEPADPPRKL

SEQ ID NO: 66376 - protein, 16 aa, Mycobacterium tuberculosis
ADTDEQEPADPPRKLI

SEQ ID NO: 66377 - protein, 16 aa, Mycobacterium tuberculosis
DTDEQEPADPPRKLIA

SEQ ID NO: 66378 - protein, 16 aa, Mycobacterium tuberculosis
TDEQEPADPPRKLIAT

SEQ ID NO: 66379 - protein, 16 aa, Mycobacterium tuberculosis
DEQEPADPPRKLIATI

SEQ ID NO: 66380 - protein, 16 aa, Mycobacterium tuberculosis
EQEPADPPRKLIATIG

SEQ ID NO: 66381 - protein, 16 aa, Mycobacterium tuberculosis
QEPADPPRKLIATIGE

SEQ ID NO: 66382 - protein, 16 aa, Mycobacterium tuberculosis
EPADPPRKLIATIGEQ

SEQ ID NO: 66383 - protein, 16 aa, Mycobacterium tuberculosis
PADPPRKLIATIGEQL

SEQ ID NO: 66384 - protein, 16 aa, Mycobacterium tuberculosis
ADPPRKLIATIGEQLA

SEQ ID NO: 66385 - protein, 16 aa, Mycobacterium tuberculosis
DPPRKLIATIGEQLAR

SEQ ID NO: 66386 - protein, 16 aa, Mycobacterium tuberculosis
PPRKLIATIGEQLARY

SEQ ID NO: 66387 - protein, 16 aa, Mycobacterium tuberculosis
PRKLIATIGEQLARYG

SEQ ID NO: 66388 - protein, 16 aa, Mycobacterium tuberculosis
RKLIATIGEQLARYGP

SEQ ID NO: 66389 - protein, 16 aa, Mycobacterium tuberculosis
KLIATIGEQLARYGPR

SEQ ID NO: 66390 - protein, 16 aa, Mycobacterium tuberculosis
LIATIGEQLARYGPRA

SEQ ID NO: 66391 - protein, 16 aa, Mycobacterium tuberculosis
IATIGEQLARYGPRAP

SEQ ID NO: 66392 - protein, 16 aa, Mycobacterium tuberculosis
ATIGEQLARYGPRAPQ

SEQ ID NO: 66393 - protein, 16 aa, Mycobacterium tuberculosis
TIGEQLARYGPRAPQL

SEQ ID NO: 66394 - protein, 16 aa, Mycobacterium tuberculosis
IGEQLARYGPRAPQLW

SEQ ID NO: 66395 - protein, 16 aa, Mycobacterium tuberculosis
GEQLARYGPRAPQLWL

SEQ ID NO: 66396 - protein, 16 aa, Mycobacterium tuberculosis
EQLARYGPRAPQLWLP

SEQ ID NO: 66397 - protein, 16 aa, Mycobacterium tuberculosis
QLARYGPRAPQLWLPP

SEQ ID NO: 66398 - protein, 16 aa, Mycobacterium tuberculosis
LARYGPRAPQLWLPPL

SEQ ID NO: 66399 - protein, 16 aa, Mycobacterium tuberculosis
ARYGPRAPQLWLPPLD

SEQ ID NO: 66400 - protein, 16 aa, Mycobacterium tuberculosis
RYGPRAPQLWLPPLDE

SEQ ID NO: 66401 - protein, 16 aa, Mycobacterium tuberculosis
YGPRAPQLWLPPLDET

SEQ ID NO: 66402 - protein, 16 aa, Mycobacterium tuberculosis
GPRAPQLWLPPLDETI

SEQ ID NO: 66403 - protein, 16 aa, Mycobacterium tuberculosis
PRAPQLWLPPLDETIP

SEQ ID NO: 66404 - protein, 16 aa, Mycobacterium tuberculosis
RAPQLWLPPLDETIPL

SEQ ID NO: 66405 - protein, 16 aa, Mycobacterium tuberculosis
APQLWLPPLDETIPLS

SEQ ID NO: 66406 - protein, 16 aa, Mycobacterium tuberculosis
PQLWLPPLDETIPLSA

SEQ ID NO: 66407 - protein, 16 aa, Mycobacterium tuberculosis
QLWLPPLDETIPLSAA

SEQ ID NO: 66408 - protein, 16 aa, Mycobacterium tuberculosis
LWLPPLDETIPLSAAL

SEQ ID NO: 66409 - protein, 16 aa, Mycobacterium tuberculosis
WLPPLDETIPLSAALA

SEQ ID NO: 66410 - protein, 16 aa, Mycobacterium tuberculosis
LPPLDETIPLSAALAR

SEQ ID NO: 66411 - protein, 16 aa, Mycobacterium tuberculosis
PPLDETIPLSAALARA

SEQ ID NO: 66412 - protein, 16 aa, Mycobacterium tuberculosis
PLDETIPLSAALARAG

SEQ ID NO: 66413 - protein, 16 aa, Mycobacterium tuberculosis
LDETIPLSAALARAGV

SEQ ID NO: 66414 - protein, 16 aa, Mycobacterium tuberculosis
DETIPLSAALARAGVG

SEQ ID NO: 66415 - protein, 16 aa, Mycobacterium tuberculosis
ETIPLSAALARAGVGP

SEQ ID NO: 66416 - protein, 16 aa, Mycobacterium tuberculosis
TIPLSAALARAGVGPR

SEQ ID NO: 66417 - protein, 16 aa, Mycobacterium tuberculosis
IPLSAALARAGVGPRQ

SEQ ID NO: 66418 - protein, 16 aa, Mycobacterium tuberculosis
PLSAALARAGVGPRQW

SEQ ID NO: 66419 - protein, 16 aa, Mycobacterium tuberculosis
LSAALARAGVGPRQWR

SEQ ID NO: 66420 - protein, 16 aa, Mycobacterium tuberculosis
SAALARAGVGPRQWRW

SEQ ID NO: 66421 - protein, 16 aa, Mycobacterium tuberculosis
AALARAGVGPRQWRWP

SEQ ID NO: 66422 - protein, 16 aa, Mycobacterium tuberculosis
ALARAGVGPRQWRWPL

SEQ ID NO: 66423 - protein, 16 aa, Mycobacterium tuberculosis
LARAGVGPRQWRWPLG

SEQ ID NO: 66424 - protein, 16 aa, Mycobacterium tuberculosis
ARAGVGPRQWRWPLGE

SEQ ID NO: 66425 - protein, 16 aa, Mycobacterium tuberculosis
RAGVGPRQWRWPLGEI

SEQ ID NO: 66426 - protein, 16 aa, Mycobacterium tuberculosis
AGVGPRQWRWPLGEID

SEQ ID NO: 66427 - protein, 16 aa, Mycobacterium tuberculosis
GVGPRQWRWPLGEIDR

SEQ ID NO: 66428 - protein, 16 aa, Mycobacterium tuberculosis
VGPRQWRWPLGEIDRP

SEQ ID NO: 66429 - protein, 16 aa, Mycobacterium tuberculosis
GPRQWRWPLGEIDRPF

SEQ ID NO: 66430 - protein, 16 aa, Mycobacterium tuberculosis
PRQWRWPLGEIDRPFE

SEQ ID NO: 66431 - protein, 16 aa, Mycobacterium tuberculosis
RQWRWPLGEIDRPFEM

SEQ ID NO: 66432 - protein, 16 aa, Mycobacterium tuberculosis
QWRWPLGEIDRPFEMR

SEQ ID NO: 66433 - protein, 16 aa, Mycobacterium tuberculosis
WRWPLGEIDRPFEMRR

SEQ ID NO: 66434 - protein, 16 aa, Mycobacterium tuberculosis
RWPLGEIDRPFEMRRD

SEQ ID NO: 66435 - protein, 16 aa, Mycobacterium tuberculosis
WPLGEIDRPFEMRRDP

SEQ ID NO: 66436 - protein, 16 aa, Mycobacterium tuberculosis
PLGEIDRPFEMRRDPL

SEQ ID NO: 66437 - protein, 16 aa, Mycobacterium tuberculosis
LGEIDRPFEMRRDPLV

SEQ ID NO: 66438 - protein, 16 aa, Mycobacterium tuberculosis
GEIDRPFEMRRDPLVF

SEQ ID NO: 66439 - protein, 16 aa, Mycobacterium tuberculosis
EIDRPFEMRRDPLVFD

SEQ ID NO: 66440 - protein, 16 aa, Mycobacterium tuberculosis
IDRPFEMRRDPLVFDA

SEQ ID NO: 66441 - protein, 16 aa, Mycobacterium tuberculosis
DRPFEMRRDPLVFDAR

SEQ ID NO: 66442 - protein, 16 aa, Mycobacterium tuberculosis
RPFEMRRDPLVFDARS

SEQ ID NO: 66443 - protein, 16 aa, Mycobacterium tuberculosis
PFEMRRDPLVFDARSS

SEQ ID NO: 66444 - protein, 16 aa, Mycobacterium tuberculosis
FEMRRDPLVFDARSSA

SEQ ID NO: 66445 - protein, 16 aa, Mycobacterium tuberculosis
EMRRDPLVFDARSSAG

SEQ ID NO: 66446 - protein, 16 aa, Mycobacterium tuberculosis
MRRDPLVFDARSSAGN

SEQ ID NO: 66447 - protein, 16 aa, Mycobacterium tuberculosis
RRDPLVFDARSSAGNM

SEQ ID NO: 66448 - protein, 16 aa, Mycobacterium tuberculosis
RDPLVFDARSSAGNMV

SEQ ID NO: 66449 - protein, 16 aa, Mycobacterium tuberculosis
DPLVFDARSSAGNMVI

SEQ ID NO: 66450 - protein, 16 aa, Mycobacterium tuberculosis
PLVFDARSSAGNMVIH

SEQ ID NO: 66451 - protein, 16 aa, Mycobacterium tuberculosis
LVFDARSSAGNMVIHG

SEQ ID NO: 66452 - protein, 16 aa, Mycobacterium tuberculosis
VFDARSSAGNMVIHGG

SEQ ID NO: 66453 - protein, 16 aa, Mycobacterium tuberculosis
FDARSSAGNMVIHGGP

SEQ ID NO: 66454 - protein, 16 aa, Mycobacterium tuberculosis
DARSSAGNMVIHGGPK

SEQ ID NO: 66455 - protein, 16 aa, Mycobacterium tuberculosis
ARSSAGNMVIHGGPKS

SEQ ID NO: 66456 - protein, 16 aa, Mycobacterium tuberculosis
RSSAGNMVIHGGPKSG

SEQ ID NO: 66457 - protein, 16 aa, Mycobacterium tuberculosis
SSAGNMVIHGGPKSGK

SEQ ID NO: 66458 - protein, 16 aa, Mycobacterium tuberculosis
SAGNMVIHGGPKSGKS

SEQ ID NO: 66459 - protein, 16 aa, Mycobacterium tuberculosis
AGNMVIHGGPKSGKST

SEQ ID NO: 66460 - protein, 16 aa, Mycobacterium tuberculosis
GNMVIHGGPKSGKSTA

SEQ ID NO: 66461 - protein, 16 aa, Mycobacterium tuberculosis
NMVIHGGPKSGKSTAL

SEQ ID NO: 66462 - protein, 16 aa, Mycobacterium tuberculosis
MVIHGGPKSGKSTALQ

SEQ ID NO: 66463 - protein, 16 aa, Mycobacterium tuberculosis
VIHGGPKSGKSTALQT

SEQ ID NO: 66464 - protein, 16 aa, Mycobacterium tuberculosis
IHGGPKSGKSTALQTF

SEQ ID NO: 66465 - protein, 16 aa, Mycobacterium tuberculosis
HGGPKSGKSTALQTFI

SEQ ID NO: 66466 - protein, 16 aa, Mycobacterium tuberculosis
GGPKSGKSTALQTFIL

SEQ ID NO: 66467 - protein, 16 aa, Mycobacterium tuberculosis
GPKSGKSTALQTFILS

SEQ ID NO: 66468 - protein, 16 aa, Mycobacterium tuberculosis
PKSGKSTALQTFILSA

SEQ ID NO: 66469 - protein, 16 aa, Mycobacterium tuberculosis
KSGKSTALQTFILSAA

SEQ ID NO: 66470 - protein, 16 aa, Mycobacterium tuberculosis
SGKSTALQTFILSAAS

SEQ ID NO: 66471 - protein, 16 aa, Mycobacterium tuberculosis
GKSTALQTFILSAASL

SEQ ID NO: 66472 - protein, 16 aa, Mycobacterium tuberculosis
KSTALQTFILSAASLH

SEQ ID NO: 66473 - protein, 16 aa, Mycobacterium tuberculosis
STALQTFILSAASLHS

SEQ ID NO: 66474 - protein, 16 aa, Mycobacterium tuberculosis
TALQTFILSAASLHSP

SEQ ID NO: 66475 - protein, 16 aa, Mycobacterium tuberculosis
ALQTFILSAASLHSPH

SEQ ID NO: 66476 - protein, 16 aa, Mycobacterium tuberculosis
LQTFILSAASLHSPHE

SEQ ID NO: 66477 - protein, 16 aa, Mycobacterium tuberculosis
QTFILSAASLHSPHEV

SEQ ID NO: 66478 - protein, 16 aa, Mycobacterium tuberculosis
TFILSAASLHSPHEVS

SEQ ID NO: 66479 - protein, 16 aa, Mycobacterium tuberculosis
FILSAASLHSPHEVSF

SEQ ID NO: 66480 - protein, 16 aa, Mycobacterium tuberculosis
ILSAASLHSPHEVSFY

SEQ ID NO: 66481 - protein, 16 aa, Mycobacterium tuberculosis
LSAASLHSPHEVSFYC

SEQ ID NO: 66482 - protein, 16 aa, Mycobacterium tuberculosis
SAASLHSPHEVSFYCL

SEQ ID NO: 66483 - protein, 16 aa, Mycobacterium tuberculosis
AASLHSPHEVSFYCLD

SEQ ID NO: 66484 - protein, 16 aa, Mycobacterium tuberculosis
ASLHSPHEVSFYCLDY

SEQ ID NO: 66485 - protein, 16 aa, Mycobacterium tuberculosis
SLHSPHEVSFYCLDYG

SEQ ID NO: 66486 - protein, 16 aa, Mycobacterium tuberculosis
LHSPHEVSFYCLDYGG

SEQ ID NO: 66487 - protein, 16 aa, Mycobacterium tuberculosis
HSPHEVSFYCLDYGGG

SEQ ID NO: 66488 - protein, 16 aa, Mycobacterium tuberculosis
SPHEVSFYCLDYGGGQ

SEQ ID NO: 66489 - protein, 16 aa, Mycobacterium tuberculosis
PHEVSFYCLDYGGGQL

SEQ ID NO: 66490 - protein, 16 aa, Mycobacterium tuberculosis
HEVSFYCLDYGGGQLR

SEQ ID NO: 66491 - protein, 16 aa, Mycobacterium tuberculosis
EVSFYCLDYGGGQLRA

SEQ ID NO: 66492 - protein, 16 aa, Mycobacterium tuberculosis
VSFYCLDYGGGQLRAL

SEQ ID NO: 66493 - protein, 16 aa, Mycobacterium tuberculosis
SFYCLDYGGGQLRALQ

SEQ ID NO: 66494 - protein, 16 aa, Mycobacterium tuberculosis
FYCLDYGGGQLRALQD

SEQ ID NO: 66495 - protein, 16 aa, Mycobacterium tuberculosis
YCLDYGGGQLRALQDL

SEQ ID NO: 66496 - protein, 16 aa, Mycobacterium tuberculosis
CLDYGGGQLRALQDLA

SEQ ID NO: 66497 - protein, 16 aa, Mycobacterium tuberculosis
LDYGGGQLRALQDLAH

SEQ ID NO: 66498 - protein, 16 aa, Mycobacterium tuberculosis
DYGGGQLRALQDLAHV

SEQ ID NO: 66499 - protein, 16 aa, Mycobacterium tuberculosis
YGGGQLRALQDLAHVG

SEQ ID NO: 66500 - protein, 16 aa, Mycobacterium tuberculosis
GGGQLRALQDLAHVGS

SEQ ID NO: 66501 - protein, 16 aa, Mycobacterium tuberculosis
GGQLRALQDLAHVGSV

SEQ ID NO: 66502 - protein, 16 aa, Mycobacterium tuberculosis
GQLRALQDLAHVGSVA

SEQ ID NO: 66503 - protein, 16 aa, Mycobacterium tuberculosis
QLRALQDLAHVGSVAS

SEQ ID NO: 66504 - protein, 16 aa, Mycobacterium tuberculosis
LRALQDLAHVGSVASA

SEQ ID NO: 66505 - protein, 16 aa, Mycobacterium tuberculosis
RALQDLAHVGSVASAL

SEQ ID NO: 66506 - protein, 16 aa, Mycobacterium tuberculosis
ALQDLAHVGSVASALE

SEQ ID NO: 66507 - protein, 16 aa, Mycobacterium tuberculosis
LQDLAHVGSVASALEP

SEQ ID NO: 66508 - protein, 16 aa, Mycobacterium tuberculosis
QDLAHVGSVASALEPE

SEQ ID NO: 66509 - protein, 16 aa, Mycobacterium tuberculosis
DLAHVGSVASALEPER

SEQ ID NO: 66510 - protein, 16 aa, Mycobacterium tuberculosis
LAHVGSVASALEPERI

SEQ ID NO: 66511 - protein, 16 aa, Mycobacterium tuberculosis
AHVGSVASALEPERIR

SEQ ID NO: 66512 - protein, 16 aa, Mycobacterium tuberculosis
HVGSVASALEPERIRR

SEQ ID NO: 66513 - protein, 16 aa, Mycobacterium tuberculosis
VGSVASALEPERIRRT

SEQ ID NO: 66514 - protein, 16 aa, Mycobacterium tuberculosis
GSVASALEPERIRRTF

SEQ ID NO: 66515 - protein, 16 aa, Mycobacterium tuberculosis
SVASALEPERIRRTFG

SEQ ID NO: 66516 - protein, 16 aa, Mycobacterium tuberculosis
VASALEPERIRRTFGE

SEQ ID NO: 66517 - protein, 16 aa, Mycobacterium tuberculosis
ASALEPERIRRTFGEL

SEQ ID NO: 66518 - protein, 16 aa, Mycobacterium tuberculosis
SALEPERIRRTFGELE

SEQ ID NO: 66519 - protein, 16 aa, Mycobacterium tuberculosis
ALEPERIRRTFGELEQ

SEQ ID NO: 66520 - protein, 16 aa, Mycobacterium tuberculosis
LEPERIRRTFGELEQL

SEQ ID NO: 66521 - protein, 16 aa, Mycobacterium tuberculosis
EPERIRRTFGELEQLL

SEQ ID NO: 66522 - protein, 16 aa, Mycobacterium tuberculosis
PERIRRTFGELEQLLL

SEQ ID NO: 66523 - protein, 16 aa, Mycobacterium tuberculosis
ERIRRTFGELEQLLLS

SEQ ID NO: 66524 - protein, 16 aa, Mycobacterium tuberculosis
RIRRTFGELEQLLLSR

SEQ ID NO: 66525 - protein, 16 aa, Mycobacterium tuberculosis
IRRTFGELEQLLLSRQ

SEQ ID NO: 66526 - protein, 16 aa, Mycobacterium tuberculosis
RRTFGELEQLLLSRQQ

SEQ ID NO: 66527 - protein, 16 aa, Mycobacterium tuberculosis
RTFGELEQLLLSRQQR

SEQ ID NO: 66528 - protein, 16 aa, Mycobacterium tuberculosis
TFGELEQLLLSRQQRE

SEQ ID NO: 66529 - protein, 16 aa, Mycobacterium tuberculosis
FGELEQLLLSRQQREV

SEQ ID NO: 66530 - protein, 16 aa, Mycobacterium tuberculosis
GELEQLLLSRQQREVF

SEQ ID NO: 66531 - protein, 16 aa, Mycobacterium tuberculosis
ELEQLLLSRQQREVFR

SEQ ID NO: 66532 - protein, 16 aa, Mycobacterium tuberculosis
LEQLLLSRQQREVFRD

SEQ ID NO: 66533 - protein, 16 aa, Mycobacterium tuberculosis
EQLLLSRQQREVFRDR

SEQ ID NO: 66534 - protein, 16 aa, Mycobacterium tuberculosis
QLLLSRQQREVFRDRG

SEQ ID NO: 66535 - protein, 16 aa, Mycobacterium tuberculosis
LLLSRQQREVFRDRGA

SEQ ID NO: 66536 - protein, 16 aa, Mycobacterium tuberculosis
LLSRQQREVFRDRGAN

SEQ ID NO: 66537 - protein, 16 aa, Mycobacterium tuberculosis
LSRQQREVFRDRGANG

SEQ ID NO: 66538 - protein, 16 aa, Mycobacterium tuberculosis
SRQQREVFRDRGANGS

SEQ ID NO: 66539 - protein, 16 aa, Mycobacterium tuberculosis
RQQREVFRDRGANGST

SEQ ID NO: 66540 - protein, 16 aa, Mycobacterium tuberculosis
QQREVFRDRGANGSTP

SEQ ID NO: 66541 - protein, 16 aa, Mycobacterium tuberculosis
QREVFRDRGANGSTPD

SEQ ID NO: 66542 - protein, 16 aa, Mycobacterium tuberculosis
REVFRDRGANGSTPDD

SEQ ID NO: 66543 - protein, 16 aa, Mycobacterium tuberculosis
EVFRDRGANGSTPDDG

SEQ ID NO: 66544 - protein, 16 aa, Mycobacterium tuberculosis
VFRDRGANGSTPDDGF

SEQ ID NO: 66545 - protein, 16 aa, Mycobacterium tuberculosis
FRDRGANGSTPDDGFG

SEQ ID NO: 66546 - protein, 16 aa, Mycobacterium tuberculosis
RDRGANGSTPDDGFGE

SEQ ID NO: 66547 - protein, 16 aa, Mycobacterium tuberculosis
DRGANGSTPDDGFGEV

SEQ ID NO: 66548 - protein, 16 aa, Mycobacterium tuberculosis
RGANGSTPDDGFGEVF

SEQ ID NO: 66549 - protein, 16 aa, Mycobacterium tuberculosis
GANGSTPDDGFGEVFL

SEQ ID NO: 66550 - protein, 16 aa, Mycobacterium tuberculosis
ANGSTPDDGFGEVFLV

SEQ ID NO: 66551 - protein, 16 aa, Mycobacterium tuberculosis
NGSTPDDGFGEVFLVI

SEQ ID NO: 66552 - protein, 16 aa, Mycobacterium tuberculosis
GSTPDDGFGEVFLVID

SEQ ID NO: 66553 - protein, 16 aa, Mycobacterium tuberculosis
STPDDGFGEVFLVIDN

SEQ ID NO: 66554 - protein, 16 aa, Mycobacterium tuberculosis
TPDDGFGEVFLVIDNL

SEQ ID NO: 66555 - protein, 16 aa, Mycobacterium tuberculosis
PDDGFGEVFLVIDNLY

SEQ ID NO: 66556 - protein, 16 aa, Mycobacterium tuberculosis
DDGFGEVFLVIDNLYG

SEQ ID NO: 66557 - protein, 16 aa, Mycobacterium tuberculosis
DGFGEVFLVIDNLYGF

SEQ ID NO: 66558 - protein, 16 aa, Mycobacterium tuberculosis
GFGEVFLVIDNLYGFG

SEQ ID NO: 66559 - protein, 16 aa, Mycobacterium tuberculosis
FGEVFLVIDNLYGFGR

SEQ ID NO: 66560 - protein, 16 aa, Mycobacterium tuberculosis
GEVFLVIDNLYGFGRD

SEQ ID NO: 66561 - protein, 16 aa, Mycobacterium tuberculosis
EVFLVIDNLYGFGRDN

SEQ ID NO: 66562 - protein, 16 aa, Mycobacterium tuberculosis
VFLVIDNLYGFGRDNT

SEQ ID NO: 66563 - protein, 16 aa, Mycobacterium tuberculosis
FLVIDNLYGFGRDNTD

SEQ ID NO: 66564 - protein, 16 aa, Mycobacterium tuberculosis
LVIDNLYGFGRDNTDQ

SEQ ID NO: 66565 - protein, 16 aa, Mycobacterium tuberculosis
VIDNLYGFGRDNTDQF

SEQ ID NO: 66566 - protein, 16 aa, Mycobacterium tuberculosis
IDNLYGFGRDNTDQFN

SEQ ID NO: 66567 - protein, 16 aa, Mycobacterium tuberculosis
DNLYGFGRDNTDQFNT

SEQ ID NO: 66568 - protein, 16 aa, Mycobacterium tuberculosis
NLYGFGRDNTDQFNTR

SEQ ID NO: 66569 - protein, 16 aa, Mycobacterium tuberculosis
LYGFGRDNTDQFNTRN

SEQ ID NO: 66570 - protein, 16 aa, Mycobacterium tuberculosis
YGFGRDNTDQFNTRNP

SEQ ID NO: 66571 - protein, 16 aa, Mycobacterium tuberculosis
GFGRDNTDQFNTRNPL

SEQ ID NO: 66572 - protein, 16 aa, Mycobacterium tuberculosis
FGRDNTDQFNTRNPLL

SEQ ID NO: 66573 - protein, 16 aa, Mycobacterium tuberculosis
GRDNTDQFNTRNPLLA

SEQ ID NO: 66574 - protein, 16 aa, Mycobacterium tuberculosis
RDNTDQFNTRNPLLAR

SEQ ID NO: 66575 - protein, 16 aa, Mycobacterium tuberculosis
DNTDQFNTRNPLLARV

SEQ ID NO: 66576 - protein, 16 aa, Mycobacterium tuberculosis
NTDQFNTRNPLLARVT

SEQ ID NO: 66577 - protein, 16 aa, Mycobacterium tuberculosis
TDQFNTRNPLLARVTE

SEQ ID NO: 66578 - protein, 16 aa, Mycobacterium tuberculosis
DQFNTRNPLLARVTEL

SEQ ID NO: 66579 - protein, 16 aa, Mycobacterium tuberculosis
QFNTRNPLLARVTELV

SEQ ID NO: 66580 - protein, 16 aa, Mycobacterium tuberculosis
FNTRNPLLARVTELVN

SEQ ID NO: 66581 - protein, 16 aa, Mycobacterium tuberculosis
NTRNPLLARVTELVNV

SEQ ID NO: 66582 - protein, 16 aa, Mycobacterium tuberculosis
TRNPLLARVTELVNVG

SEQ ID NO: 66583 - protein, 16 aa, Mycobacterium tuberculosis
RNPLLARVTELVNVGL

SEQ ID NO: 66584 - protein, 16 aa, Mycobacterium tuberculosis
NPLLARVTELVNVGLA

SEQ ID NO: 66585 - protein, 16 aa, Mycobacterium tuberculosis
PLLARVTELVNVGLAY

SEQ ID NO: 66586 - protein, 16 aa, Mycobacterium tuberculosis
LLARVTELVNVGLAYG

SEQ ID NO: 66587 - protein, 16 aa, Mycobacterium tuberculosis
LARVTELVNVGLAYGI

SEQ ID NO: 66588 - protein, 16 aa, Mycobacterium tuberculosis
ARVTELVNVGLAYGIH

SEQ ID NO: 66589 - protein, 16 aa, Mycobacterium tuberculosis
RVTELVNVGLAYGIHV

SEQ ID NO: 66590 - protein, 16 aa, Mycobacterium tuberculosis
VTELVNVGLAYGIHVI

SEQ ID NO: 66591 - protein, 16 aa, Mycobacterium tuberculosis
TELVNVGLAYGIHVII

SEQ ID NO: 66592 - protein, 16 aa, Mycobacterium tuberculosis
ELVNVGLAYGIHVIIT

SEQ ID NO: 66593 - protein, 16 aa, Mycobacterium tuberculosis
LVNVGLAYGIHVIITT

SEQ ID NO: 66594 - protein, 16 aa, Mycobacterium tuberculosis
VNVGLAYGIHVIITTP

SEQ ID NO: 66595 - protein, 16 aa, Mycobacterium tuberculosis
NVGLAYGIHVIITTPS

SEQ ID NO: 66596 - protein, 16 aa, Mycobacterium tuberculosis
VGLAYGIHVIITTPSW

SEQ ID NO: 66597 - protein, 16 aa, Mycobacterium tuberculosis
GLAYGIHVIITTPSWL

SEQ ID NO: 66598 - protein, 16 aa, Mycobacterium tuberculosis
LAYGIHVIITTPSWLE

SEQ ID NO: 66599 - protein, 16 aa, Mycobacterium tuberculosis
AYGIHVIITTPSWLEV

SEQ ID NO: 66600 - protein, 16 aa, Mycobacterium tuberculosis
YGIHVIITTPSWLEVP

SEQ ID NO: 66601 - protein, 16 aa, Mycobacterium tuberculosis
GIHVIITTPSWLEVPL

SEQ ID NO: 66602 - protein, 16 aa, Mycobacterium tuberculosis
IHVIITTPSWLEVPLA

SEQ ID NO: 66603 - protein, 16 aa, Mycobacterium tuberculosis
HVIITTPSWLEVPLAM

SEQ ID NO: 66604 - protein, 16 aa, Mycobacterium tuberculosis
VIITTPSWLEVPLAMR

SEQ ID NO: 66605 - protein, 16 aa, Mycobacterium tuberculosis
IITTPSWLEVPLAMRD

SEQ ID NO: 66606 - protein, 16 aa, Mycobacterium tuberculosis
ITTPSWLEVPLAMRDG

SEQ ID NO: 66607 - protein, 16 aa, Mycobacterium tuberculosis
TTPSWLEVPLAMRDGL

SEQ ID NO: 66608 - protein, 16 aa, Mycobacterium tuberculosis
TPSWLEVPLAMRDGLG

SEQ ID NO: 66609 - protein, 16 aa, Mycobacterium tuberculosis
PSWLEVPLAMRDGLGL

SEQ ID NO: 66610 - protein, 16 aa, Mycobacterium tuberculosis
SWLEVPLAMRDGLGLR

SEQ ID NO: 66611 - protein, 16 aa, Mycobacterium tuberculosis
WLEVPLAMRDGLGLRL

SEQ ID NO: 66612 - protein, 16 aa, Mycobacterium tuberculosis
LEVPLAMRDGLGLRLE

SEQ ID NO: 66613 - protein, 16 aa, Mycobacterium tuberculosis
EVPLAMRDGLGLRLEL

SEQ ID NO: 66614 - protein, 16 aa, Mycobacterium tuberculosis
VPLAMRDGLGLRLELR

SEQ ID NO: 66615 - protein, 16 aa, Mycobacterium tuberculosis
PLAMRDGLGLRLELRL

SEQ ID NO: 66616 - protein, 16 aa, Mycobacterium tuberculosis
LAMRDGLGLRLELRLH

SEQ ID NO: 66617 - protein, 16 aa, Mycobacterium tuberculosis
AMRDGLGLRLELRLHD

SEQ ID NO: 66618 - protein, 16 aa, Mycobacterium tuberculosis
MRDGLGLRLELRLHDA

SEQ ID NO: 66619 - protein, 16 aa, Mycobacterium tuberculosis
RDGLGLRLELRLHDAR

SEQ ID NO: 66620 - protein, 16 aa, Mycobacterium tuberculosis
DGLGLRLELRLHDARD

SEQ ID NO: 66621 - protein, 16 aa, Mycobacterium tuberculosis
GLGLRLELRLHDARDS

SEQ ID NO: 66622 - protein, 16 aa, Mycobacterium tuberculosis
LGLRLELRLHDARDSN

SEQ ID NO: 66623 - protein, 16 aa, Mycobacterium tuberculosis
GLRLELRLHDARDSNV

SEQ ID NO: 66624 - protein, 16 aa, Mycobacterium tuberculosis
LRLELRLHDARDSNVR

SEQ ID NO: 66625 - protein, 16 aa, Mycobacterium tuberculosis
RLELRLHDARDSNVRV

SEQ ID NO: 66626 - protein, 16 aa, Mycobacterium tuberculosis
LELRLHDARDSNVRVV

SEQ ID NO: 66627 - protein, 16 aa, Mycobacterium tuberculosis
ELRLHDARDSNVRVVG

SEQ ID NO: 66628 - protein, 16 aa, Mycobacterium tuberculosis
LRLHDARDSNVRVVGA

SEQ ID NO: 66629 - protein, 16 aa, Mycobacterium tuberculosis
RLHDARDSNVRVVGAL

SEQ ID NO: 66630 - protein, 16 aa, Mycobacterium tuberculosis
LHDARDSNVRVVGALR

SEQ ID NO: 66631 - protein, 16 aa, Mycobacterium tuberculosis
HDARDSNVRVVGALRR

SEQ ID NO: 66632 - protein, 16 aa, Mycobacterium tuberculosis
DARDSNVRVVGALRRP

SEQ ID NO: 66633 - protein, 16 aa, Mycobacterium tuberculosis
ARDSNVRVVGALRRPA

SEQ ID NO: 66634 - protein, 16 aa, Mycobacterium tuberculosis
RDSNVRVVGALRRPAD

SEQ ID NO: 66635 - protein, 16 aa, Mycobacterium tuberculosis
DSNVRVVGALRRPADA

SEQ ID NO: 66636 - protein, 16 aa, Mycobacterium tuberculosis
SNVRVVGALRRPADAV

SEQ ID NO: 66637 - protein, 16 aa, Mycobacterium tuberculosis
NVRVVGALRRPADAVP

SEQ ID NO: 66638 - protein, 16 aa, Mycobacterium tuberculosis
VRVVGALRRPADAVPH

SEQ ID NO: 66639 - protein, 16 aa, Mycobacterium tuberculosis
RVVGALRRPADAVPHD

SEQ ID NO: 66640 - protein, 16 aa, Mycobacterium tuberculosis
VVGALRRPADAVPHDQ

SEQ ID NO: 66641 - protein, 16 aa, Mycobacterium tuberculosis
VGALRRPADAVPHDQP

SEQ ID NO: 66642 - protein, 16 aa, Mycobacterium tuberculosis
GALRRPADAVPHDQPG

SEQ ID NO: 66643 - protein, 16 aa, Mycobacterium tuberculosis
ALRRPADAVPHDQPGR

SEQ ID NO: 66644 - protein, 16 aa, Mycobacterium tuberculosis
LRRPADAVPHDQPGRG

SEQ ID NO: 66645 - protein, 16 aa, Mycobacterium tuberculosis
RRPADAVPHDQPGRGL

SEQ ID NO: 66646 - protein, 16 aa, Mycobacterium tuberculosis
RPADAVPHDQPGRGLT

SEQ ID NO: 66647 - protein, 16 aa, Mycobacterium tuberculosis
PADAVPHDQPGRGLTM

SEQ ID NO: 66648 - protein, 16 aa, Mycobacterium tuberculosis
ADAVPHDQPGRGLTMA

SEQ ID NO: 66649 - protein, 16 aa, Mycobacterium tuberculosis
DAVPHDQPGRGLTMAA

SEQ ID NO: 66650 - protein, 16 aa, Mycobacterium tuberculosis
AVPHDQPGRGLTMAAE

SEQ ID NO: 66651 - protein, 16 aa, Mycobacterium tuberculosis
VPHDQPGRGLTMAAEH

SEQ ID NO: 66652 - protein, 16 aa, Mycobacterium tuberculosis
PHDQPGRGLTMAAEHF

SEQ ID NO: 66653 - protein, 16 aa, Mycobacterium tuberculosis
HDQPGRGLTMAAEHFL

SEQ ID NO: 66654 - protein, 16 aa, Mycobacterium tuberculosis
DQPGRGLTMAAEHFLF

SEQ ID NO: 66655 - protein, 16 aa, Mycobacterium tuberculosis
QPGRGLTMAAEHFLFA

SEQ ID NO: 66656 - protein, 16 aa, Mycobacterium tuberculosis
PGRGLTMAAEHFLFAA

SEQ ID NO: 66657 - protein, 16 aa, Mycobacterium tuberculosis
GRGLTMAAEHFLFAAP

SEQ ID NO: 66658 - protein, 16 aa, Mycobacterium tuberculosis
RGLTMAAEHFLFAAPE

SEQ ID NO: 66659 - protein, 16 aa, Mycobacterium tuberculosis
GLTMAAEHFLFAAPEL

SEQ ID NO: 66660 - protein, 16 aa, Mycobacterium tuberculosis
LTMAAEHFLFAAPELD

SEQ ID NO: 66661 - protein, 16 aa, Mycobacterium tuberculosis
TMAAEHFLFAAPELDA

SEQ ID NO: 66662 - protein, 16 aa, Mycobacterium tuberculosis
MAAEHFLFAAPELDAQ

SEQ ID NO: 66663 - protein, 16 aa, Mycobacterium tuberculosis
AAEHFLFAAPELDAQT

SEQ ID NO: 66664 - protein, 16 aa, Mycobacterium tuberculosis
AEHFLFAAPELDAQTN

SEQ ID NO: 66665 - protein, 16 aa, Mycobacterium tuberculosis
EHFLFAAPELDAQTNP

SEQ ID NO: 66666 - protein, 16 aa, Mycobacterium tuberculosis
HFLFAAPELDAQTNPV

SEQ ID NO: 66667 - protein, 16 aa, Mycobacterium tuberculosis
FLFAAPELDAQTNPVA

SEQ ID NO: 66668 - protein, 16 aa, Mycobacterium tuberculosis
LFAAPELDAQTNPVAA

SEQ ID NO: 66669 - protein, 16 aa, Mycobacterium tuberculosis
FAAPELDAQTNPVAAI

SEQ ID NO: 66670 - protein, 16 aa, Mycobacterium tuberculosis
AAPELDAQTNPVAAIN

SEQ ID NO: 66671 - protein, 16 aa, Mycobacterium tuberculosis
APELDAQTNPVAAINA

SEQ ID NO: 66672 - protein, 16 aa, Mycobacterium tuberculosis
PELDAQTNPVAAINAR

SEQ ID NO: 66673 - protein, 16 aa, Mycobacterium tuberculosis
ELDAQTNPVAAINARY

SEQ ID NO: 66674 - protein, 16 aa, Mycobacterium tuberculosis
LDAQTNPVAAINARYP

SEQ ID NO: 66675 - protein, 16 aa, Mycobacterium tuberculosis
DAQTNPVAAINARYPG

SEQ ID NO: 66676 - protein, 16 aa, Mycobacterium tuberculosis
AQTNPVAAINARYPGM

SEQ ID NO: 66677 - protein, 16 aa, Mycobacterium tuberculosis
QTNPVAAINARYPGMA

SEQ ID NO: 66678 - protein, 16 aa, Mycobacterium tuberculosis
TNPVAAINARYPGMAA

SEQ ID NO: 66679 - protein, 16 aa, Mycobacterium tuberculosis
NPVAAINARYPGMAAP

SEQ ID NO: 66680 - protein, 16 aa, Mycobacterium tuberculosis
PVAAINARYPGMAAPP

SEQ ID NO: 66681 - protein, 16 aa, Mycobacterium tuberculosis
VAAINARYPGMAAPPV

SEQ ID NO: 66682 - protein, 16 aa, Mycobacterium tuberculosis
AAINARYPGMAAPPVR

SEQ ID NO: 66683 - protein, 16 aa, Mycobacterium tuberculosis
AINARYPGMAAPPVRL

SEQ ID NO: 66684 - protein, 16 aa, Mycobacterium tuberculosis
INARYPGMAAPPVRLL

SEQ ID NO: 66685 - protein, 16 aa, Mycobacterium tuberculosis
NARYPGMAAPPVRLLP

SEQ ID NO: 66686 - protein, 16 aa, Mycobacterium tuberculosis
ARYPGMAAPPVRLLPT

SEQ ID NO: 66687 - protein, 16 aa, Mycobacterium tuberculosis
RYPGMAAPPVRLLPTN

SEQ ID NO: 66688 - protein, 16 aa, Mycobacterium tuberculosis
YPGMAAPPVRLLPTNL

SEQ ID NO: 66689 - protein, 16 aa, Mycobacterium tuberculosis
PGMAAPPVRLLPTNLA

SEQ ID NO: 66690 - protein, 16 aa, Mycobacterium tuberculosis
GMAAPPVRLLPTNLAP

SEQ ID NO: 66691 - protein, 16 aa, Mycobacterium tuberculosis
MAAPPVRLLPTNLAPH

SEQ ID NO: 66692 - protein, 16 aa, Mycobacterium tuberculosis
AAPPVRLLPTNLAPHA

SEQ ID NO: 66693 - protein, 16 aa, Mycobacterium tuberculosis
APPVRLLPTNLAPHAV

SEQ ID NO: 66694 - protein, 16 aa, Mycobacterium tuberculosis
PPVRLLPTNLAPHAVG

SEQ ID NO: 66695 - protein, 16 aa, Mycobacterium tuberculosis
PVRLLPTNLAPHAVGE

SEQ ID NO: 66696 - protein, 16 aa, Mycobacterium tuberculosis
VRLLPTNLAPHAVGEL

SEQ ID NO: 66697 - protein, 16 aa, Mycobacterium tuberculosis
RLLPTNLAPHAVGELY

SEQ ID NO: 66698 - protein, 16 aa, Mycobacterium tuberculosis
LLPTNLAPHAVGELYR

SEQ ID NO: 66699 - protein, 16 aa, Mycobacterium tuberculosis
LPTNLAPHAVGELYRG

SEQ ID NO: 66700 - protein, 16 aa, Mycobacterium tuberculosis
PTNLAPHAVGELYRGP

SEQ ID NO: 66701 - protein, 16 aa, Mycobacterium tuberculosis
TNLAPHAVGELYRGPD

SEQ ID NO: 66702 - protein, 16 aa, Mycobacterium tuberculosis
NLAPHAVGELYRGPDQ

SEQ ID NO: 66703 - protein, 16 aa, Mycobacterium tuberculosis
LAPHAVGELYRGPDQL

SEQ ID NO: 66704 - protein, 16 aa, Mycobacterium tuberculosis
APHAVGELYRGPDQLV

SEQ ID NO: 66705 - protein, 16 aa, Mycobacterium tuberculosis
PHAVGELYRGPDQLVI

SEQ ID NO: 66706 - protein, 16 aa, Mycobacterium tuberculosis
HAVGELYRGPDQLVIG

SEQ ID NO: 66707 - protein, 16 aa, Mycobacterium tuberculosis
AVGELYRGPDQLVIGQ

SEQ ID NO: 66708 - protein, 16 aa, Mycobacterium tuberculosis
VGELYRGPDQLVIGQR

SEQ ID NO: 66709 - protein, 16 aa, Mycobacterium tuberculosis
GELYRGPDQLVIGQRE

SEQ ID NO: 66710 - protein, 16 aa, Mycobacterium tuberculosis
ELYRGPDQLVIGQREE

SEQ ID NO: 66711 - protein, 16 aa, Mycobacterium tuberculosis
LYRGPDQLVIGQREED

SEQ ID NO: 66712 - protein, 16 aa, Mycobacterium tuberculosis
YRGPDQLVIGQREEDL

SEQ ID NO: 66713 - protein, 16 aa, Mycobacterium tuberculosis
RGPDQLVIGQREEDLA

SEQ ID NO: 66714 - protein, 16 aa, Mycobacterium tuberculosis
GPDQLVIGQREEDLAP

SEQ ID NO: 66715 - protein, 16 aa, Mycobacterium tuberculosis
PDQLVIGQREEDLAPV

SEQ ID NO: 66716 - protein, 16 aa, Mycobacterium tuberculosis
DQLVIGQREEDLAPVI

SEQ ID NO: 66717 - protein, 16 aa, Mycobacterium tuberculosis
QLVIGQREEDLAPVIL

SEQ ID NO: 66718 - protein, 16 aa, Mycobacterium tuberculosis
LVIGQREEDLAPVILD

SEQ ID NO: 66719 - protein, 16 aa, Mycobacterium tuberculosis
VIGQREEDLAPVILDL

SEQ ID NO: 66720 - protein, 16 aa, Mycobacterium tuberculosis
IGQREEDLAPVILDLA

SEQ ID NO: 66721 - protein, 16 aa, Mycobacterium tuberculosis
GQREEDLAPVILDLAA

SEQ ID NO: 66722 - protein, 16 aa, Mycobacterium tuberculosis
QREEDLAPVILDLAAN

SEQ ID NO: 66723 - protein, 16 aa, Mycobacterium tuberculosis
REEDLAPVILDLAANP

SEQ ID NO: 66724 - protein, 16 aa, Mycobacterium tuberculosis
EEDLAPVILDLAANPL

SEQ ID NO: 66725 - protein, 16 aa, Mycobacterium tuberculosis
EDLAPVILDLAANPLL

SEQ ID NO: 66726 - protein, 16 aa, Mycobacterium tuberculosis
DLAPVILDLAANPLLM

SEQ ID NO: 66727 - protein, 16 aa, Mycobacterium tuberculosis
LAPVILDLAANPLLMV

SEQ ID NO: 66728 - protein, 16 aa, Mycobacterium tuberculosis
APVILDLAANPLLMVF

SEQ ID NO: 66729 - protein, 16 aa, Mycobacterium tuberculosis
PVILDLAANPLLMVFG

SEQ ID NO: 66730 - protein, 16 aa, Mycobacterium tuberculosis
VILDLAANPLLMVFGD

SEQ ID NO: 66731 - protein, 16 aa, Mycobacterium tuberculosis
ILDLAANPLLMVFGDA

SEQ ID NO: 66732 - protein, 16 aa, Mycobacterium tuberculosis
LDLAANPLLMVFGDAR

SEQ ID NO: 66733 - protein, 16 aa, Mycobacterium tuberculosis
DLAANPLLMVFGDARS

SEQ ID NO: 66734 - protein, 16 aa, Mycobacterium tuberculosis
LAANPLLMVFGDARSG

SEQ ID NO: 66735 - protein, 16 aa, Mycobacterium tuberculosis
AANPLLMVFGDARSGK

SEQ ID NO: 66736 - protein, 16 aa, Mycobacterium tuberculosis
ANPLLMVFGDARSGKT

SEQ ID NO: 66737 - protein, 16 aa, Mycobacterium tuberculosis
NPLLMVFGDARSGKTT

SEQ ID NO: 66738 - protein, 16 aa, Mycobacterium tuberculosis
PLLMVFGDARSGKTTL

SEQ ID NO: 66739 - protein, 16 aa, Mycobacterium tuberculosis
LLMVFGDARSGKTTLL

SEQ ID NO: 66740 - protein, 16 aa, Mycobacterium tuberculosis
LMVFGDARSGKTTLLR

SEQ ID NO: 66741 - protein, 16 aa, Mycobacterium tuberculosis
MVFGDARSGKTTLLRH

SEQ ID NO: 66742 - protein, 16 aa, Mycobacterium tuberculosis
VFGDARSGKTTLLRHI

SEQ ID NO: 66743 - protein, 16 aa, Mycobacterium tuberculosis
FGDARSGKTTLLRHII

SEQ ID NO: 66744 - protein, 16 aa, Mycobacterium tuberculosis
GDARSGKTTLLRHIIR

SEQ ID NO: 66745 - protein, 16 aa, Mycobacterium tuberculosis
DARSGKTTLLRHIIRT

SEQ ID NO: 66746 - protein, 16 aa, Mycobacterium tuberculosis
ARSGKTTLLRHIIRTV

SEQ ID NO: 66747 - protein, 16 aa, Mycobacterium tuberculosis
RSGKTTLLRHIIRTVR

SEQ ID NO: 66748 - protein, 16 aa, Mycobacterium tuberculosis
SGKTTLLRHIIRTVRE

SEQ ID NO: 66749 - protein, 16 aa, Mycobacterium tuberculosis
GKTTLLRHIIRTVREH

SEQ ID NO: 66750 - protein, 16 aa, Mycobacterium tuberculosis
KTTLLRHIIRTVREHS

SEQ ID NO: 66751 - protein, 16 aa, Mycobacterium tuberculosis
TTLLRHIIRTVREHST

SEQ ID NO: 66752 - protein, 16 aa, Mycobacterium tuberculosis
TLLRHIIRTVREHSTA

SEQ ID NO: 66753 - protein, 16 aa, Mycobacterium tuberculosis
LLRHIIRTVREHSTAD

SEQ ID NO: 66754 - protein, 16 aa, Mycobacterium tuberculosis
LRHIIRTVREHSTADR

SEQ ID NO: 66755 - protein, 16 aa, Mycobacterium tuberculosis
RHIIRTVREHSTADRV

SEQ ID NO: 66756 - protein, 16 aa, Mycobacterium tuberculosis
HIIRTVREHSTADRVA

SEQ ID NO: 66757 - protein, 16 aa, Mycobacterium tuberculosis
IIRTVREHSTADRVAF

SEQ ID NO: 66758 - protein, 16 aa, Mycobacterium tuberculosis
IRTVREHSTADRVAFT

SEQ ID NO: 66759 - protein, 16 aa, Mycobacterium tuberculosis
RTVREHSTADRVAFTV

SEQ ID NO: 66760 - protein, 16 aa, Mycobacterium tuberculosis
TVREHSTADRVAFTVL

SEQ ID NO: 66761 - protein, 16 aa, Mycobacterium tuberculosis
VREHSTADRVAFTVLD

SEQ ID NO: 66762 - protein, 16 aa, Mycobacterium tuberculosis
REHSTADRVAFTVLDR

SEQ ID NO: 66763 - protein, 16 aa, Mycobacterium tuberculosis
EHSTADRVAFTVLDRR

SEQ ID NO: 66764 - protein, 16 aa, Mycobacterium tuberculosis
HSTADRVAFTVLDRRL

SEQ ID NO: 66765 - protein, 16 aa, Mycobacterium tuberculosis
STADRVAFTVLDRRLH

SEQ ID NO: 66766 - protein, 16 aa, Mycobacterium tuberculosis
TADRVAFTVLDRRLHL

SEQ ID NO: 66767 - protein, 16 aa, Mycobacterium tuberculosis
ADRVAFTVLDRRLHLV

SEQ ID NO: 66768 - protein, 16 aa, Mycobacterium tuberculosis
DRVAFTVLDRRLHLVD

SEQ ID NO: 66769 - protein, 16 aa, Mycobacterium tuberculosis
RVAFTVLDRRLHLVDE

SEQ ID NO: 66770 - protein, 16 aa, Mycobacterium tuberculosis
VAFTVLDRRLHLVDEP

SEQ ID NO: 66771 - protein, 16 aa, Mycobacterium tuberculosis
AFTVLDRRLHLVDEPL

SEQ ID NO: 66772 - protein, 16 aa, Mycobacterium tuberculosis
FTVLDRRLHLVDEPLF

SEQ ID NO: 66773 - protein, 16 aa, Mycobacterium tuberculosis
TVLDRRLHLVDEPLFP

SEQ ID NO: 66774 - protein, 16 aa, Mycobacterium tuberculosis
VLDRRLHLVDEPLFPD

SEQ ID NO: 66775 - protein, 16 aa, Mycobacterium tuberculosis
LDRRLHLVDEPLFPDN

SEQ ID NO: 66776 - protein, 16 aa, Mycobacterium tuberculosis
DRRLHLVDEPLFPDNE

SEQ ID NO: 66777 - protein, 16 aa, Mycobacterium tuberculosis
RRLHLVDEPLFPDNEY

SEQ ID NO: 66778 - protein, 16 aa, Mycobacterium tuberculosis
RLHLVDEPLFPDNEYT

SEQ ID NO: 66779 - protein, 16 aa, Mycobacterium tuberculosis
LHLVDEPLFPDNEYTA

SEQ ID NO: 66780 - protein, 16 aa, Mycobacterium tuberculosis
HLVDEPLFPDNEYTAN

SEQ ID NO: 66781 - protein, 16 aa, Mycobacterium tuberculosis
LVDEPLFPDNEYTANI

SEQ ID NO: 66782 - protein, 16 aa, Mycobacterium tuberculosis
VDEPLFPDNEYTANID

SEQ ID NO: 66783 - protein, 16 aa, Mycobacterium tuberculosis
DEPLFPDNEYTANIDR

SEQ ID NO: 66784 - protein, 16 aa, Mycobacterium tuberculosis
EPLFPDNEYTANIDRI

SEQ ID NO: 66785 - protein, 16 aa, Mycobacterium tuberculosis
PLFPDNEYTANIDRII

SEQ ID NO: 66786 - protein, 16 aa, Mycobacterium tuberculosis
LFPDNEYTANIDRIIP

SEQ ID NO: 66787 - protein, 16 aa, Mycobacterium tuberculosis
FPDNEYTANIDRIIPA

SEQ ID NO: 66788 - protein, 16 aa, Mycobacterium tuberculosis
PDNEYTANIDRIIPAM

SEQ ID NO: 66789 - protein, 16 aa, Mycobacterium tuberculosis
DNEYTANIDRIIPAML

SEQ ID NO: 66790 - protein, 16 aa, Mycobacterium tuberculosis
NEYTANIDRIIPAMLG

SEQ ID NO: 66791 - protein, 16 aa, Mycobacterium tuberculosis
EYTANIDRIIPAMLGL

SEQ ID NO: 66792 - protein, 16 aa, Mycobacterium tuberculosis
YTANIDRIIPAMLGLA

SEQ ID NO: 66793 - protein, 16 aa, Mycobacterium tuberculosis
TANIDRIIPAMLGLAN

SEQ ID NO: 66794 - protein, 16 aa, Mycobacterium tuberculosis
ANIDRIIPAMLGLANL

SEQ ID NO: 66795 - protein, 16 aa, Mycobacterium tuberculosis
NIDRIIPAMLGLANLI

SEQ ID NO: 66796 - protein, 16 aa, Mycobacterium tuberculosis
IDRIIPAMLGLANLIE

SEQ ID NO: 66797 - protein, 16 aa, Mycobacterium tuberculosis
DRIIPAMLGLANLIEA

SEQ ID NO: 66798 - protein, 16 aa, Mycobacterium tuberculosis
RIIPAMLGLANLIEAR

SEQ ID NO: 66799 - protein, 16 aa, Mycobacterium tuberculosis
IIPAMLGLANLIEARR

SEQ ID NO: 66800 - protein, 16 aa, Mycobacterium tuberculosis
IPAMLGLANLIEARRP

SEQ ID NO: 66801 - protein, 16 aa, Mycobacterium tuberculosis
PAMLGLANLIEARRPP

SEQ ID NO: 66802 - protein, 16 aa, Mycobacterium tuberculosis
AMLGLANLIEARRPPA

SEQ ID NO: 66803 - protein, 16 aa, Mycobacterium tuberculosis
MLGLANLIEARRPPAG

SEQ ID NO: 66804 - protein, 16 aa, Mycobacterium tuberculosis
LGLANLIEARRPPAGM

SEQ ID NO: 66805 - protein, 16 aa, Mycobacterium tuberculosis
GLANLIEARRPPAGMS

SEQ ID NO: 66806 - protein, 16 aa, Mycobacterium tuberculosis
LANLIEARRPPAGMSA

SEQ ID NO: 66807 - protein, 16 aa, Mycobacterium tuberculosis
ANLIEARRPPAGMSAA

SEQ ID NO: 66808 - protein, 16 aa, Mycobacterium tuberculosis
NLIEARRPPAGMSAAE

SEQ ID NO: 66809 - protein, 16 aa, Mycobacterium tuberculosis
LIEARRPPAGMSAAEL

SEQ ID NO: 66810 - protein, 16 aa, Mycobacterium tuberculosis
IEARRPPAGMSAAELS

SEQ ID NO: 66811 - protein, 16 aa, Mycobacterium tuberculosis
EARRPPAGMSAAELSR

SEQ ID NO: 66812 - protein, 16 aa, Mycobacterium tuberculosis
ARRPPAGMSAAELSRW

SEQ ID NO: 66813 - protein, 16 aa, Mycobacterium tuberculosis
RRPPAGMSAAELSRWT

SEQ ID NO: 66814 - protein, 16 aa, Mycobacterium tuberculosis
RPPAGMSAAELSRWTF

SEQ ID NO: 66815 - protein, 16 aa, Mycobacterium tuberculosis
PPAGMSAAELSRWTFA

SEQ ID NO: 66816 - protein, 16 aa, Mycobacterium tuberculosis
PAGMSAAELSRWTFAG

SEQ ID NO: 66817 - protein, 16 aa, Mycobacterium tuberculosis
AGMSAAELSRWTFAGH

SEQ ID NO: 66818 - protein, 16 aa, Mycobacterium tuberculosis
GMSAAELSRWTFAGHT

SEQ ID NO: 66819 - protein, 16 aa, Mycobacterium tuberculosis
MSAAELSRWTFAGHTH

SEQ ID NO: 66820 - protein, 16 aa, Mycobacterium tuberculosis
SAAELSRWTFAGHTHY

SEQ ID NO: 66821 - protein, 16 aa, Mycobacterium tuberculosis
AAELSRWTFAGHTHYL

SEQ ID NO: 66822 - protein, 16 aa, Mycobacterium tuberculosis
AELSRWTFAGHTHYLI

SEQ ID NO: 66823 - protein, 16 aa, Mycobacterium tuberculosis
ELSRWTFAGHTHYLII

SEQ ID NO: 66824 - protein, 16 aa, Mycobacterium tuberculosis
LSRWTFAGHTHYLIID

SEQ ID NO: 66825 - protein, 16 aa, Mycobacterium tuberculosis
SRWTFAGHTHYLIIDD

SEQ ID NO: 66826 - protein, 16 aa, Mycobacterium tuberculosis
RWTFAGHTHYLIIDDV

SEQ ID NO: 66827 - protein, 16 aa, Mycobacterium tuberculosis
WTFAGHTHYLIIDDVD

SEQ ID NO: 66828 - protein, 16 aa, Mycobacterium tuberculosis
TFAGHTHYLIIDDVDQ

SEQ ID NO: 66829 - protein, 16 aa, Mycobacterium tuberculosis
FAGHTHYLIIDDVDQV

SEQ ID NO: 66830 - protein, 16 aa, Mycobacterium tuberculosis
AGHTHYLIIDDVDQVP

SEQ ID NO: 66831 - protein, 16 aa, Mycobacterium tuberculosis
GHTHYLIIDDVDQVPD

SEQ ID NO: 66832 - protein, 16 aa, Mycobacterium tuberculosis
HTHYLIIDDVDQVPDS

SEQ ID NO: 66833 - protein, 16 aa, Mycobacterium tuberculosis
THYLIIDDVDQVPDSP

SEQ ID NO: 66834 - protein, 16 aa, Mycobacterium tuberculosis
HYLIIDDVDQVPDSPA

SEQ ID NO: 66835 - protein, 16 aa, Mycobacterium tuberculosis
YLIIDDVDQVPDSPAM

SEQ ID NO: 66836 - protein, 16 aa, Mycobacterium tuberculosis
LIIDDVDQVPDSPAMT

SEQ ID NO: 66837 - protein, 16 aa, Mycobacterium tuberculosis
IIDDVDQVPDSPAMTG

SEQ ID NO: 66838 - protein, 16 aa, Mycobacterium tuberculosis
IDDVDQVPDSPAMTGP

SEQ ID NO: 66839 - protein, 16 aa, Mycobacterium tuberculosis
DDVDQVPDSPAMTGPY

SEQ ID NO: 66840 - protein, 16 aa, Mycobacterium tuberculosis
DVDQVPDSPAMTGPYI

SEQ ID NO: 66841 - protein, 16 aa, Mycobacterium tuberculosis
VDQVPDSPAMTGPYIG

SEQ ID NO: 66842 - protein, 16 aa, Mycobacterium tuberculosis
DQVPDSPAMTGPYIGQ

SEQ ID NO: 66843 - protein, 16 aa, Mycobacterium tuberculosis
QVPDSPAMTGPYIGQR

SEQ ID NO: 66844 - protein, 16 aa, Mycobacterium tuberculosis
VPDSPAMTGPYIGQRP

SEQ ID NO: 66845 - protein, 16 aa, Mycobacterium tuberculosis
PDSPAMTGPYIGQRPW

SEQ ID NO: 66846 - protein, 16 aa, Mycobacterium tuberculosis
DSPAMTGPYIGQRPWT

SEQ ID NO: 66847 - protein, 16 aa, Mycobacterium tuberculosis
SPAMTGPYIGQRPWTP

SEQ ID NO: 66848 - protein, 16 aa, Mycobacterium tuberculosis
PAMTGPYIGQRPWTPL

SEQ ID NO: 66849 - protein, 16 aa, Mycobacterium tuberculosis
AMTGPYIGQRPWTPLI

SEQ ID NO: 66850 - protein, 16 aa, Mycobacterium tuberculosis
MTGPYIGQRPWTPLIG

SEQ ID NO: 66851 - protein, 16 aa, Mycobacterium tuberculosis
TGPYIGQRPWTPLIGL

SEQ ID NO: 66852 - protein, 16 aa, Mycobacterium tuberculosis
GPYIGQRPWTPLIGLL

SEQ ID NO: 66853 - protein, 16 aa, Mycobacterium tuberculosis
PYIGQRPWTPLIGLLA

SEQ ID NO: 66854 - protein, 16 aa, Mycobacterium tuberculosis
YIGQRPWTPLIGLLAQ

SEQ ID NO: 66855 - protein, 16 aa, Mycobacterium tuberculosis
IGQRPWTPLIGLLAQA

SEQ ID NO: 66856 - protein, 16 aa, Mycobacterium tuberculosis
GQRPWTPLIGLLAQAG

SEQ ID NO: 66857 - protein, 16 aa, Mycobacterium tuberculosis
QRPWTPLIGLLAQAGD

SEQ ID NO: 66858 - protein, 16 aa, Mycobacterium tuberculosis
RPWTPLIGLLAQAGDL

SEQ ID NO: 66859 - protein, 16 aa, Mycobacterium tuberculosis
PWTPLIGLLAQAGDLG

SEQ ID NO: 66860 - protein, 16 aa, Mycobacterium tuberculosis
WTPLIGLLAQAGDLGL

SEQ ID NO: 66861 - protein, 16 aa, Mycobacterium tuberculosis
TPLIGLLAQAGDLGLR

SEQ ID NO: 66862 - protein, 16 aa, Mycobacterium tuberculosis
PLIGLLAQAGDLGLRV

SEQ ID NO: 66863 - protein, 16 aa, Mycobacterium tuberculosis
LIGLLAQAGDLGLRVI

SEQ ID NO: 66864 - protein, 16 aa, Mycobacterium tuberculosis
IGLLAQAGDLGLRVIV

SEQ ID NO: 66865 - protein, 16 aa, Mycobacterium tuberculosis
GLLAQAGDLGLRVIVT

SEQ ID NO: 66866 - protein, 16 aa, Mycobacterium tuberculosis
LLAQAGDLGLRVIVTG

SEQ ID NO: 66867 - protein, 16 aa, Mycobacterium tuberculosis
LAQAGDLGLRVIVTGR

SEQ ID NO: 66868 - protein, 16 aa, Mycobacterium tuberculosis
AQAGDLGLRVIVTGRA

SEQ ID NO: 66869 - protein, 16 aa, Mycobacterium tuberculosis
QAGDLGLRVIVTGRAT

SEQ ID NO: 66870 - protein, 16 aa, Mycobacterium tuberculosis
AGDLGLRVIVTGRATG

SEQ ID NO: 66871 - protein, 16 aa, Mycobacterium tuberculosis
GDLGLRVIVTGRATGS

SEQ ID NO: 66872 - protein, 16 aa, Mycobacterium tuberculosis
DLGLRVIVTGRATGSA

SEQ ID NO: 66873 - protein, 16 aa, Mycobacterium tuberculosis
LGLRVIVTGRATGSAH

SEQ ID NO: 66874 - protein, 16 aa, Mycobacterium tuberculosis
GLRVIVTGRATGSAHL

SEQ ID NO: 66875 - protein, 16 aa, Mycobacterium tuberculosis
LRVIVTGRATGSAHLL

SEQ ID NO: 66876 - protein, 16 aa, Mycobacterium tuberculosis
RVIVTGRATGSAHLLM

SEQ ID NO: 66877 - protein, 16 aa, Mycobacterium tuberculosis
VIVTGRATGSAHLLMT

SEQ ID NO: 66878 - protein, 16 aa, Mycobacterium tuberculosis
IVTGRATGSAHLLMTS

SEQ ID NO: 66879 - protein, 16 aa, Mycobacterium tuberculosis
VTGRATGSAHLLMTSP

SEQ ID NO: 66880 - protein, 16 aa, Mycobacterium tuberculosis
TGRATGSAHLLMTSPL

SEQ ID NO: 66881 - protein, 16 aa, Mycobacterium tuberculosis
GRATGSAHLLMTSPLL

SEQ ID NO: 66882 - protein, 16 aa, Mycobacterium tuberculosis
RATGSAHLLMTSPLLR

SEQ ID NO: 66883 - protein, 16 aa, Mycobacterium tuberculosis
ATGSAHLLMTSPLLRR

SEQ ID NO: 66884 - protein, 16 aa, Mycobacterium tuberculosis
TGSAHLLMTSPLLRRF

SEQ ID NO: 66885 - protein, 16 aa, Mycobacterium tuberculosis
GSAHLLMTSPLLRRFN

SEQ ID NO: 66886 - protein, 16 aa, Mycobacterium tuberculosis
SAHLLMTSPLLRRFND

SEQ ID NO: 66887 - protein, 16 aa, Mycobacterium tuberculosis
AHLLMTSPLLRRFNDL

SEQ ID NO: 66888 - protein, 16 aa, Mycobacterium tuberculosis
HLLMTSPLLRRFNDLQ

SEQ ID NO: 66889 - protein, 16 aa, Mycobacterium tuberculosis
LLMTSPLLRRFNDLQA

SEQ ID NO: 66890 - protein, 16 aa, Mycobacterium tuberculosis
LMTSPLLRRFNDLQAT

SEQ ID NO: 66891 - protein, 16 aa, Mycobacterium tuberculosis
MTSPLLRRFNDLQATT

SEQ ID NO: 66892 - protein, 16 aa, Mycobacterium tuberculosis
TSPLLRRFNDLQATTL

SEQ ID NO: 66893 - protein, 16 aa, Mycobacterium tuberculosis
SPLLRRFNDLQATTLM

SEQ ID NO: 66894 - protein, 16 aa, Mycobacterium tuberculosis
PLLRRFNDLQATTLML

SEQ ID NO: 66895 - protein, 16 aa, Mycobacterium tuberculosis
LLRRFNDLQATTLMLA

SEQ ID NO: 66896 - protein, 16 aa, Mycobacterium tuberculosis
LRRFNDLQATTLMLAG

SEQ ID NO: 66897 - protein, 16 aa, Mycobacterium tuberculosis
RRFNDLQATTLMLAGN

SEQ ID NO: 66898 - protein, 16 aa, Mycobacterium tuberculosis
RFNDLQATTLMLAGNP

SEQ ID NO: 66899 - protein, 16 aa, Mycobacterium tuberculosis
FNDLQATTLMLAGNPA

SEQ ID NO: 66900 - protein, 16 aa, Mycobacterium tuberculosis
NDLQATTLMLAGNPAD

SEQ ID NO: 66901 - protein, 16 aa, Mycobacterium tuberculosis
DLQATTLMLAGNPADS

SEQ ID NO: 66902 - protein, 16 aa, Mycobacterium tuberculosis
LQATTLMLAGNPADSG

SEQ ID NO: 66903 - protein, 16 aa, Mycobacterium tuberculosis
QATTLMLAGNPADSGK

SEQ ID NO: 66904 - protein, 16 aa, Mycobacterium tuberculosis
ATTLMLAGNPADSGKI

SEQ ID NO: 66905 - protein, 16 aa, Mycobacterium tuberculosis
TTLMLAGNPADSGKIR

SEQ ID NO: 66906 - protein, 16 aa, Mycobacterium tuberculosis
TLMLAGNPADSGKIRG

SEQ ID NO: 66907 - protein, 16 aa, Mycobacterium tuberculosis
LMLAGNPADSGKIRGE

SEQ ID NO: 66908 - protein, 16 aa, Mycobacterium tuberculosis
MLAGNPADSGKIRGER

SEQ ID NO: 66909 - protein, 16 aa, Mycobacterium tuberculosis
LAGNPADSGKIRGERF

SEQ ID NO: 66910 - protein, 16 aa, Mycobacterium tuberculosis
AGNPADSGKIRGERFA

SEQ ID NO: 66911 - protein, 16 aa, Mycobacterium tuberculosis
GNPADSGKIRGERFAR

SEQ ID NO: 66912 - protein, 16 aa, Mycobacterium tuberculosis
NPADSGKIRGERFARL

SEQ ID NO: 66913 - protein, 16 aa, Mycobacterium tuberculosis
PADSGKIRGERFARLP

SEQ ID NO: 66914 - protein, 16 aa, Mycobacterium tuberculosis
ADSGKIRGERFARLPA

SEQ ID NO: 66915 - protein, 16 aa, Mycobacterium tuberculosis
DSGKIRGERFARLPAG

SEQ ID NO: 66916 - protein, 16 aa, Mycobacterium tuberculosis
SGKIRGERFARLPAGR

SEQ ID NO: 66917 - protein, 16 aa, Mycobacterium tuberculosis
GKIRGERFARLPAGRA

SEQ ID NO: 66918 - protein, 16 aa, Mycobacterium tuberculosis
KIRGERFARLPAGRAI

SEQ ID NO: 66919 - protein, 16 aa, Mycobacterium tuberculosis
IRGERFARLPAGRAIL

SEQ ID NO: 66920 - protein, 16 aa, Mycobacterium tuberculosis
RGERFARLPAGRAILL

SEQ ID NO: 66921 - protein, 16 aa, Mycobacterium tuberculosis
GERFARLPAGRAILLT

SEQ ID NO: 66922 - protein, 16 aa, Mycobacterium tuberculosis
ERFARLPAGRAILLTD

SEQ ID NO: 66923 - protein, 16 aa, Mycobacterium tuberculosis
RFARLPAGRAILLTDS

SEQ ID NO: 66924 - protein, 16 aa, Mycobacterium tuberculosis
FARLPAGRAILLTDSD

SEQ ID NO: 66925 - protein, 16 aa, Mycobacterium tuberculosis
ARLPAGRAILLTDSDS

SEQ ID NO: 66926 - protein, 16 aa, Mycobacterium tuberculosis
RLPAGRAILLTDSDSP

SEQ ID NO: 66927 - protein, 16 aa, Mycobacterium tuberculosis
LPAGRAILLTDSDSPT

SEQ ID NO: 66928 - protein, 16 aa, Mycobacterium tuberculosis
PAGRAILLTDSDSPTY

SEQ ID NO: 66929 - protein, 16 aa, Mycobacterium tuberculosis
AGRAILLTDSDSPTYV

SEQ ID NO: 66930 - protein, 16 aa, Mycobacterium tuberculosis
GRAILLTDSDSPTYVQ

SEQ ID NO: 66931 - protein, 16 aa, Mycobacterium tuberculosis
RAILLTDSDSPTYVQL

SEQ ID NO: 66932 - protein, 16 aa, Mycobacterium tuberculosis
AILLTDSDSPTYVQLI

SEQ ID NO: 66933 - protein, 16 aa, Mycobacterium tuberculosis
ILLTDSDSPTYVQLIN

SEQ ID NO: 66934 - protein, 16 aa, Mycobacterium tuberculosis
LLTDSDSPTYVQLINP

SEQ ID NO: 66935 - protein, 16 aa, Mycobacterium tuberculosis
LTDSDSPTYVQLINPL

SEQ ID NO: 66936 - protein, 16 aa, Mycobacterium tuberculosis
TDSDSPTYVQLINPLV

SEQ ID NO: 66937 - protein, 16 aa, Mycobacterium tuberculosis
DSDSPTYVQLINPLVD

SEQ ID NO: 66938 - protein, 16 aa, Mycobacterium tuberculosis
SDSPTYVQLINPLVDA

SEQ ID NO: 66939 - protein, 16 aa, Mycobacterium tuberculosis
DSPTYVQLINPLVDAA

SEQ ID NO: 66940 - protein, 16 aa, Mycobacterium tuberculosis
SPTYVQLINPLVDAAA

SEQ ID NO: 66941 - protein, 16 aa, Mycobacterium tuberculosis
PTYVQLINPLVDAAAV

SEQ ID NO: 66942 - protein, 16 aa, Mycobacterium tuberculosis
TYVQLINPLVDAAAVS

SEQ ID NO: 66943 - protein, 16 aa, Mycobacterium tuberculosis
YVQLINPLVDAAAVSG

SEQ ID NO: 66944 - protein, 16 aa, Mycobacterium tuberculosis
VQLINPLVDAAAVSGE

SEQ ID NO: 66945 - protein, 16 aa, Mycobacterium tuberculosis
QLINPLVDAAAVSGET

SEQ ID NO: 66946 - protein, 16 aa, Mycobacterium tuberculosis
LINPLVDAAAVSGETQ

SEQ ID NO: 66947 - protein, 16 aa, Mycobacterium tuberculosis
INPLVDAAAVSGETQQ

SEQ ID NO: 66948 - protein, 16 aa, Mycobacterium tuberculosis
NPLVDAAAVSGETQQK

SEQ ID NO: 66949 - protein, 16 aa, Mycobacterium tuberculosis
PLVDAAAVSGETQQKG

SEQ ID NO: 66950 - protein, 16 aa, Mycobacterium tuberculosis
LVDAAAVSGETQQKGS

SEQ ID NO: 66951 - protein, 16 aa, Mycobacterium tuberculosis
VDAAAVSGETQQKGSQ

SEQ ID NO: 66952 - protein, 16 aa, Mycobacterium tuberculosis
DAAAVSGETQQKGSQS

SEQ ID NO: 66953 - protein, 13 aa, Mycobacterium tuberculosis
MTLRVVPEGLAAA

SEQ ID NO: 66954 - protein, 13 aa, Mycobacterium tuberculosis
TLRVVPEGLAAAS

SEQ ID NO: 66955 - protein, 13 aa, Mycobacterium tuberculosis
LRVVPEGLAAASA

SEQ ID NO: 66956 - protein, 13 aa, Mycobacterium tuberculosis
RVVPEGLAAASAA

SEQ ID NO: 66957 - protein, 13 aa, Mycobacterium tuberculosis
VVPEGLAAASAAV

SEQ ID NO: 66958 - protein, 13 aa, Mycobacterium tuberculosis
VPEGLAAASAAVE

SEQ ID NO: 66959 - protein, 13 aa, Mycobacterium tuberculosis
PEGLAAASAAVEA

SEQ ID NO: 66960 - protein, 13 aa, Mycobacterium tuberculosis
EGLAAASAAVEAL

SEQ ID NO: 66961 - protein, 13 aa, Mycobacterium tuberculosis
GLAAASAAVEALT

SEQ ID NO: 66962 - protein, 13 aa, Mycobacterium tuberculosis
LAAASAAVEALTA

SEQ ID NO: 66963 - protein, 13 aa, Mycobacterium tuberculosis
AAASAAVEALTAR

SEQ ID NO: 66964 - protein, 13 aa, Mycobacterium tuberculosis
AASAAVEALTARL

SEQ ID NO: 66965 - protein, 13 aa, Mycobacterium tuberculosis
ASAAVEALTARLA

SEQ ID NO: 66966 - protein, 13 aa, Mycobacterium tuberculosis
SAAVEALTARLAA

SEQ ID NO: 66967 - protein, 13 aa, Mycobacterium tuberculosis
AAVEALTARLAAA

SEQ ID NO: 66968 - protein, 13 aa, Mycobacterium tuberculosis
AVEALTARLAAAH

SEQ ID NO: 66969 - protein, 13 aa, Mycobacterium tuberculosis
VEALTARLAAAHA

SEQ ID NO: 66970 - protein, 13 aa, Mycobacterium tuberculosis
EALTARLAAAHAS

SEQ ID NO: 66971 - protein, 13 aa, Mycobacterium tuberculosis
ALTARLAAAHASA

SEQ ID NO: 66972 - protein, 13 aa, Mycobacterium tuberculosis
LTARLAAAHASAA

SEQ ID NO: 66973 - protein, 13 aa, Mycobacterium tuberculosis
TARLAAAHASAAP

SEQ ID NO: 66974 - protein, 13 aa, Mycobacterium tuberculosis
ARLAAAHASAAPV

SEQ ID NO: 66975 - protein, 13 aa, Mycobacterium tuberculosis
RLAAAHASAAPVI

SEQ ID NO: 66976 - protein, 13 aa, Mycobacterium tuberculosis
LAAAHASAAPVIT

SEQ ID NO: 66977 - protein, 13 aa, Mycobacterium tuberculosis
AAAHASAAPVITA

SEQ ID NO: 66978 - protein, 13 aa, Mycobacterium tuberculosis
AAHASAAPVITAV

SEQ ID NO: 66979 - protein, 13 aa, Mycobacterium tuberculosis
AHASAAPVITAVV

SEQ ID NO: 66980 - protein, 13 aa, Mycobacterium tuberculosis
HASAAPVITAVVP

SEQ ID NO: 66981 - protein, 13 aa, Mycobacterium tuberculosis
ASAAPVITAVVPP

SEQ ID NO: 66982 - protein, 13 aa, Mycobacterium tuberculosis
SAAPVITAVVPPA

SEQ ID NO: 66983 - protein, 13 aa, Mycobacterium tuberculosis
AAPVITAVVPPAA

SEQ ID NO: 66984 - protein, 13 aa, Mycobacterium tuberculosis
APVITAVVPPAAD

SEQ ID NO: 66985 - protein, 13 aa, Mycobacterium tuberculosis
PVITAVVPPAADP

SEQ ID NO: 66986 - protein, 13 aa, Mycobacterium tuberculosis
VITAVVPPAADPV

SEQ ID NO: 66987 - protein, 13 aa, Mycobacterium tuberculosis
ITAVVPPAADPVS

SEQ ID NO: 66988 - protein, 13 aa, Mycobacterium tuberculosis
TAVVPPAADPVSL

SEQ ID NO: 66989 - protein, 13 aa, Mycobacterium tuberculosis
AVVPPAADPVSLQ

SEQ ID NO: 66990 - protein, 13 aa, Mycobacterium tuberculosis
VVPPAADPVSLQT

SEQ ID NO: 66991 - protein, 13 aa, Mycobacterium tuberculosis
VPPAADPVSLQTA

SEQ ID NO: 66992 - protein, 13 aa, Mycobacterium tuberculosis
PPAADPVSLQTAA

SEQ ID NO: 66993 - protein, 13 aa, Mycobacterium tuberculosis
PAADPVSLQTAAG

SEQ ID NO: 66994 - protein, 13 aa, Mycobacterium tuberculosis
AADPVSLQTAAGF

SEQ ID NO: 66995 - protein, 13 aa, Mycobacterium tuberculosis
ADPVSLQTAAGFS

SEQ ID NO: 66996 - protein, 13 aa, Mycobacterium tuberculosis
DPVSLQTAAGFSA

SEQ ID NO: 66997 - protein, 13 aa, Mycobacterium tuberculosis
PVSLQTAAGFSAQ

SEQ ID NO: 66998 - protein, 13 aa, Mycobacterium tuberculosis
VSLQTAAGFSAQG

SEQ ID NO: 66999 - protein, 13 aa, Mycobacterium tuberculosis
SLQTAAGFSAQGV

SEQ ID NO: 67000 - protein, 13 aa, Mycobacterium tuberculosis
LQTAAGFSAQGVE

SEQ ID NO: 67001 - protein, 13 aa, Mycobacterium tuberculosis
QTAAGFSAQGVEH

SEQ ID NO: 67002 - protein, 13 aa, Mycobacterium tuberculosis
TAAGFSAQGVEHA

SEQ ID NO: 67003 - protein, 13 aa, Mycobacterium tuberculosis
AAGFSAQGVEHAV

SEQ ID NO: 67004 - protein, 13 aa, Mycobacterium tuberculosis
AGFSAQGVEHAVV

SEQ ID NO: 67005 - protein, 13 aa, Mycobacterium tuberculosis
GFSAQGVEHAVVT

SEQ ID NO: 67006 - protein, 13 aa, Mycobacterium tuberculosis
FSAQGVEHAVVTA

SEQ ID NO: 67007 - protein, 13 aa, Mycobacterium tuberculosis
SAQGVEHAVVTAE

SEQ ID NO: 67008 - protein, 13 aa, Mycobacterium tuberculosis
AQGVEHAVVTAEG

SEQ ID NO: 67009 - protein, 13 aa, Mycobacterium tuberculosis
QGVEHAVVTAEGV

SEQ ID NO: 67010 - protein, 13 aa, Mycobacterium tuberculosis
GVEHAVVTAEGVE

SEQ ID NO: 67011 - protein, 13 aa, Mycobacterium tuberculosis
VEHAVVTAEGVEE

SEQ ID NO: 67012 - protein, 13 aa, Mycobacterium tuberculosis
EHAVVTAEGVEEL

SEQ ID NO: 67013 - protein, 13 aa, Mycobacterium tuberculosis
HAVVTAEGVEELG

SEQ ID NO: 67014 - protein, 13 aa, Mycobacterium tuberculosis
AVVTAEGVEELGR

SEQ ID NO: 67015 - protein, 13 aa, Mycobacterium tuberculosis
VVTAEGVEELGRA

SEQ ID NO: 67016 - protein, 13 aa, Mycobacterium tuberculosis
VTAEGVEELGRAG

SEQ ID NO: 67017 - protein, 13 aa, Mycobacterium tuberculosis
TAEGVEELGRAGV

SEQ ID NO: 67018 - protein, 13 aa, Mycobacterium tuberculosis
AEGVEELGRAGVG

SEQ ID NO: 67019 - protein, 13 aa, Mycobacterium tuberculosis
EGVEELGRAGVGV

SEQ ID NO: 67020 - protein, 13 aa, Mycobacterium tuberculosis
GVEELGRAGVGVG

SEQ ID NO: 67021 - protein, 13 aa, Mycobacterium tuberculosis
VEELGRAGVGVGE

SEQ ID NO: 67022 - protein, 13 aa, Mycobacterium tuberculosis
EELGRAGVGVGES

SEQ ID NO: 67023 - protein, 13 aa, Mycobacterium tuberculosis
ELGRAGVGVGESG

SEQ ID NO: 67024 - protein, 13 aa, Mycobacterium tuberculosis
LGRAGVGVGESGA

SEQ ID NO: 67025 - protein, 13 aa, Mycobacterium tuberculosis
GRAGVGVGESGAS

SEQ ID NO: 67026 - protein, 13 aa, Mycobacterium tuberculosis
RAGVGVGESGASY

SEQ ID NO: 67027 - protein, 13 aa, Mycobacterium tuberculosis
AGVGVGESGASYL

SEQ ID NO: 67028 - protein, 13 aa, Mycobacterium tuberculosis
GVGVGESGASYLA

SEQ ID NO: 67029 - protein, 13 aa, Mycobacterium tuberculosis
VGVGESGASYLAG

SEQ ID NO: 67030 - protein, 13 aa, Mycobacterium tuberculosis
GVGESGASYLAGD

SEQ ID NO: 67031 - protein, 13 aa, Mycobacterium tuberculosis
VGESGASYLAGDA

SEQ ID NO: 67032 - protein, 13 aa, Mycobacterium tuberculosis
GESGASYLAGDAA

SEQ ID NO: 67033 - protein, 13 aa, Mycobacterium tuberculosis
ESGASYLAGDAAA

SEQ ID NO: 67034 - protein, 13 aa, Mycobacterium tuberculosis
SGASYLAGDAAAA

SEQ ID NO: 67035 - protein, 13 aa, Mycobacterium tuberculosis
GASYLAGDAAAAA

SEQ ID NO: 67036 - protein, 13 aa, Mycobacterium tuberculosis
ASYLAGDAAAAAT

SEQ ID NO: 67037 - protein, 13 aa, Mycobacterium tuberculosis
SYLAGDAAAAATY

SEQ ID NO: 67038 - protein, 13 aa, Mycobacterium tuberculosis
YLAGDAAAAATYG

SEQ ID NO: 67039 - protein, 13 aa, Mycobacterium tuberculosis
LAGDAAAAATYGV

SEQ ID NO: 67040 - protein, 13 aa, Mycobacterium tuberculosis
AGDAAAAATYGVV

SEQ ID NO: 67041 - protein, 13 aa, Mycobacterium tuberculosis
GDAAAAATYGVVG

SEQ ID NO: 67042 - protein, 13 aa, Mycobacterium tuberculosis
DAAAAATYGVVGG

SEQ ID NO: 67043 - protein, 14 aa, Mycobacterium tuberculosis
MTLRVVPEGLAAAS

SEQ ID NO: 67044 - protein, 14 aa, Mycobacterium tuberculosis
TLRVVPEGLAAASA

SEQ ID NO: 67045 - protein, 14 aa, Mycobacterium tuberculosis
LRVVPEGLAAASAA

SEQ ID NO: 67046 - protein, 14 aa, Mycobacterium tuberculosis
RVVPEGLAAASAAV

SEQ ID NO: 67047 - protein, 14 aa, Mycobacterium tuberculosis
VVPEGLAAASAAVE

SEQ ID NO: 67048 - protein, 14 aa, Mycobacterium tuberculosis
VPEGLAAASAAVEA

SEQ ID NO: 67049 - protein, 14 aa, Mycobacterium tuberculosis
PEGLAAASAAVEAL

SEQ ID NO: 67050 - protein, 14 aa, Mycobacterium tuberculosis
EGLAAASAAVEALT

SEQ ID NO: 67051 - protein, 14 aa, Mycobacterium tuberculosis
GLAAASAAVEALTA

SEQ ID NO: 67052 - protein, 14 aa, Mycobacterium tuberculosis
LAAASAAVEALTAR

SEQ ID NO: 67053 - protein, 14 aa, Mycobacterium tuberculosis
AAASAAVEALTARL

SEQ ID NO: 67054 - protein, 14 aa, Mycobacterium tuberculosis
AASAAVEALTARLA

SEQ ID NO: 67055 - protein, 14 aa, Mycobacterium tuberculosis
ASAAVEALTARLAA

SEQ ID NO: 67056 - protein, 14 aa, Mycobacterium tuberculosis
SAAVEALTARLAAA

SEQ ID NO: 67057 - protein, 14 aa, Mycobacterium tuberculosis
AAVEALTARLAAAH

SEQ ID NO: 67058 - protein, 14 aa, Mycobacterium tuberculosis
AVEALTARLAAAHA

SEQ ID NO: 67059 - protein, 14 aa, Mycobacterium tuberculosis
VEALTARLAAAHAS

SEQ ID NO: 67060 - protein, 14 aa, Mycobacterium tuberculosis
EALTARLAAAHASA

SEQ ID NO: 67061 - protein, 14 aa, Mycobacterium tuberculosis
ALTARLAAAHASAA

SEQ ID NO: 67062 - protein, 14 aa, Mycobacterium tuberculosis
LTARLAAAHASAAP

SEQ ID NO: 67063 - protein, 14 aa, Mycobacterium tuberculosis
TARLAAAHASAAPV

SEQ ID NO: 67064 - protein, 14 aa, Mycobacterium tuberculosis
ARLAAAHASAAPVI

SEQ ID NO: 67065 - protein, 14 aa, Mycobacterium tuberculosis
RLAAAHASAAPVIT

SEQ ID NO: 67066 - protein, 14 aa, Mycobacterium tuberculosis
LAAAHASAAPVITA

SEQ ID NO: 67067 - protein, 14 aa, Mycobacterium tuberculosis
AAAHASAAPVITAV

SEQ ID NO: 67068 - protein, 14 aa, Mycobacterium tuberculosis
AAHASAAPVITAVV

SEQ ID NO: 67069 - protein, 14 aa, Mycobacterium tuberculosis
AHASAAPVITAVVP

SEQ ID NO: 67070 - protein, 14 aa, Mycobacterium tuberculosis
HASAAPVITAVVPP

SEQ ID NO: 67071 - protein, 14 aa, Mycobacterium tuberculosis
ASAAPVITAVVPPA

SEQ ID NO: 67072 - protein, 14 aa, Mycobacterium tuberculosis
SAAPVITAVVPPAA

SEQ ID NO: 67073 - protein, 14 aa, Mycobacterium tuberculosis
AAPVITAVVPPAAD

SEQ ID NO: 67074 - protein, 14 aa, Mycobacterium tuberculosis
APVITAVVPPAADP

SEQ ID NO: 67075 - protein, 14 aa, Mycobacterium tuberculosis
PVITAVVPPAADPV

SEQ ID NO: 67076 - protein, 14 aa, Mycobacterium tuberculosis
VITAVVPPAADPVS

SEQ ID NO: 67077 - protein, 14 aa, Mycobacterium tuberculosis
ITAVVPPAADPVSL

SEQ ID NO: 67078 - protein, 14 aa, Mycobacterium tuberculosis
TAVVPPAADPVSLQ

SEQ ID NO: 67079 - protein, 14 aa, Mycobacterium tuberculosis
AVVPPAADPVSLQT

SEQ ID NO: 67080 - protein, 14 aa, Mycobacterium tuberculosis
VVPPAADPVSLQTA

SEQ ID NO: 67081 - protein, 14 aa, Mycobacterium tuberculosis
VPPAADPVSLQTAA

SEQ ID NO: 67082 - protein, 14 aa, Mycobacterium tuberculosis
PPAADPVSLQTAAG

SEQ ID NO: 67083 - protein, 14 aa, Mycobacterium tuberculosis
PAADPVSLQTAAGF

SEQ ID NO: 67084 - protein, 14 aa, Mycobacterium tuberculosis
AADPVSLQTAAGFS

SEQ ID NO: 67085 - protein, 14 aa, Mycobacterium tuberculosis
ADPVSLQTAAGFSA

SEQ ID NO: 67086 - protein, 14 aa, Mycobacterium tuberculosis
DPVSLQTAAGFSAQ

SEQ ID NO: 67087 - protein, 14 aa, Mycobacterium tuberculosis
PVSLQTAAGFSAQG

SEQ ID NO: 67088 - protein, 14 aa, Mycobacterium tuberculosis
VSLQTAAGFSAQGV

SEQ ID NO: 67089 - protein, 14 aa, Mycobacterium tuberculosis
SLQTAAGFSAQGVE

SEQ ID NO: 67090 - protein, 14 aa, Mycobacterium tuberculosis
LQTAAGFSAQGVEH

SEQ ID NO: 67091 - protein, 14 aa, Mycobacterium tuberculosis
QTAAGFSAQGVEHA

SEQ ID NO: 67092 - protein, 14 aa, Mycobacterium tuberculosis
TAAGFSAQGVEHAV

SEQ ID NO: 67093 - protein, 14 aa, Mycobacterium tuberculosis
AAGFSAQGVEHAVV

SEQ ID NO: 67094 - protein, 14 aa, Mycobacterium tuberculosis
AGFSAQGVEHAVVT

SEQ ID NO: 67095 - protein, 14 aa, Mycobacterium tuberculosis
GFSAQGVEHAVVTA

SEQ ID NO: 67096 - protein, 14 aa, Mycobacterium tuberculosis
FSAQGVEHAVVTAE

SEQ ID NO: 67097 - protein, 14 aa, Mycobacterium tuberculosis
SAQGVEHAVVTAEG

SEQ ID NO: 67098 - protein, 14 aa, Mycobacterium tuberculosis
AQGVEHAVVTAEGV

SEQ ID NO: 67099 - protein, 14 aa, Mycobacterium tuberculosis
QGVEHAVVTAEGVE

SEQ ID NO: 67100 - protein, 14 aa, Mycobacterium tuberculosis
GVEHAVVTAEGVEE

SEQ ID NO: 67101 - protein, 14 aa, Mycobacterium tuberculosis
VEHAVVTAEGVEEL

SEQ ID NO: 67102 - protein, 14 aa, Mycobacterium tuberculosis
EHAVVTAEGVEELG

SEQ ID NO: 67103 - protein, 14 aa, Mycobacterium tuberculosis
HAVVTAEGVEELGR

SEQ ID NO: 67104 - protein, 14 aa, Mycobacterium tuberculosis
AVVTAEGVEELGRA

SEQ ID NO: 67105 - protein, 14 aa, Mycobacterium tuberculosis
VVTAEGVEELGRAG

SEQ ID NO: 67106 - protein, 14 aa, Mycobacterium tuberculosis
VTAEGVEELGRAGV

SEQ ID NO: 67107 - protein, 14 aa, Mycobacterium tuberculosis
TAEGVEELGRAGVG

SEQ ID NO: 67108 - protein, 14 aa, Mycobacterium tuberculosis
AEGVEELGRAGVGV

SEQ ID NO: 67109 - protein, 14 aa, Mycobacterium tuberculosis
EGVEELGRAGVGVG

SEQ ID NO: 67110 - protein, 14 aa, Mycobacterium tuberculosis
GVEELGRAGVGVGE

SEQ ID NO: 67111 - protein, 14 aa, Mycobacterium tuberculosis
VEELGRAGVGVGES

SEQ ID NO: 67112 - protein, 14 aa, Mycobacterium tuberculosis
EELGRAGVGVGESG

SEQ ID NO: 67113 - protein, 14 aa, Mycobacterium tuberculosis
ELGRAGVGVGESGA

SEQ ID NO: 67114 - protein, 14 aa, Mycobacterium tuberculosis
LGRAGVGVGESGAS

SEQ ID NO: 67115 - protein, 14 aa, Mycobacterium tuberculosis
GRAGVGVGESGASY

SEQ ID NO: 67116 - protein, 14 aa, Mycobacterium tuberculosis
RAGVGVGESGASYL

SEQ ID NO: 67117 - protein, 14 aa, Mycobacterium tuberculosis
AGVGVGESGASYLA

SEQ ID NO: 67118 - protein, 14 aa, Mycobacterium tuberculosis
GVGVGESGASYLAG

SEQ ID NO: 67119 - protein, 14 aa, Mycobacterium tuberculosis
VGVGESGASYLAGD

SEQ ID NO: 67120 - protein, 14 aa, Mycobacterium tuberculosis
GVGESGASYLAGDA

SEQ ID NO: 67121 - protein, 14 aa, Mycobacterium tuberculosis
VGESGASYLAGDAA

SEQ ID NO: 67122 - protein, 14 aa, Mycobacterium tuberculosis
GESGASYLAGDAAA

SEQ ID NO: 67123 - protein, 14 aa, Mycobacterium tuberculosis
ESGASYLAGDAAAA

SEQ ID NO: 67124 - protein, 14 aa, Mycobacterium tuberculosis
SGASYLAGDAAAAA

SEQ ID NO: 67125 - protein, 14 aa, Mycobacterium tuberculosis
GASYLAGDAAAAAT

SEQ ID NO: 67126 - protein, 14 aa, Mycobacterium tuberculosis
ASYLAGDAAAAATY

SEQ ID NO: 67127 - protein, 14 aa, Mycobacterium tuberculosis
SYLAGDAAAAATYG

SEQ ID NO: 67128 - protein, 14 aa, Mycobacterium tuberculosis
YLAGDAAAAATYGV

SEQ ID NO: 67129 - protein, 14 aa, Mycobacterium tuberculosis
LAGDAAAAATYGVV

SEQ ID NO: 67130 - protein, 14 aa, Mycobacterium tuberculosis
AGDAAAAATYGVVG

SEQ ID NO: 67131 - protein, 14 aa, Mycobacterium tuberculosis
GDAAAAATYGVVGG

SEQ ID NO: 67132 - protein, 15 aa, Mycobacterium tuberculosis
MTLRVVPEGLAAASA

SEQ ID NO: 67133 - protein, 15 aa, Mycobacterium tuberculosis
TLRVVPEGLAAASAA

SEQ ID NO: 67134 - protein, 15 aa, Mycobacterium tuberculosis
LRVVPEGLAAASAAV

SEQ ID NO: 67135 - protein, 15 aa, Mycobacterium tuberculosis
RVVPEGLAAASAAVE

SEQ ID NO: 67136 - protein, 15 aa, Mycobacterium tuberculosis
VVPEGLAAASAAVEA

SEQ ID NO: 67137 - protein, 15 aa, Mycobacterium tuberculosis
VPEGLAAASAAVEAL

SEQ ID NO: 67138 - protein, 15 aa, Mycobacterium tuberculosis
PEGLAAASAAVEALT

SEQ ID NO: 67139 - protein, 15 aa, Mycobacterium tuberculosis
EGLAAASAAVEALTA

SEQ ID NO: 67140 - protein, 15 aa, Mycobacterium tuberculosis
GLAAASAAVEALTAR

SEQ ID NO: 67141 - protein, 15 aa, Mycobacterium tuberculosis
LAAASAAVEALTARL

SEQ ID NO: 67142 - protein, 15 aa, Mycobacterium tuberculosis
AAASAAVEALTARLA

SEQ ID NO: 67143 - protein, 15 aa, Mycobacterium tuberculosis
AASAAVEALTARLAA

SEQ ID NO: 67144 - protein, 15 aa, Mycobacterium tuberculosis
ASAAVEALTARLAAA

SEQ ID NO: 67145 - protein, 15 aa, Mycobacterium tuberculosis
SAAVEALTARLAAAH

SEQ ID NO: 67146 - protein, 15 aa, Mycobacterium tuberculosis
AAVEALTARLAAAHA

SEQ ID NO: 67147 - protein, 15 aa, Mycobacterium tuberculosis
AVEALTARLAAAHAS

SEQ ID NO: 67148 - protein, 15 aa, Mycobacterium tuberculosis
VEALTARLAAAHASA

SEQ ID NO: 67149 - protein, 15 aa, Mycobacterium tuberculosis
EALTARLAAAHASAA

SEQ ID NO: 67150 - protein, 15 aa, Mycobacterium tuberculosis
ALTARLAAAHASAAP

SEQ ID NO: 67151 - protein, 15 aa, Mycobacterium tuberculosis
LTARLAAAHASAAPV

SEQ ID NO: 67152 - protein, 15 aa, Mycobacterium tuberculosis
TARLAAAHASAAPVI

SEQ ID NO: 67153 - protein, 15 aa, Mycobacterium tuberculosis
ARLAAAHASAAPVIT

SEQ ID NO: 67154 - protein, 15 aa, Mycobacterium tuberculosis
RLAAAHASAAPVITA

SEQ ID NO: 67155 - protein, 15 aa, Mycobacterium tuberculosis
LAAAHASAAPVITAV

SEQ ID NO: 67156 - protein, 15 aa, Mycobacterium tuberculosis
AAAHASAAPVITAVV

SEQ ID NO: 67157 - protein, 15 aa, Mycobacterium tuberculosis
AAHASAAPVITAVVP

SEQ ID NO: 67158 - protein, 15 aa, Mycobacterium tuberculosis
AHASAAPVITAVVPP

SEQ ID NO: 67159 - protein, 15 aa, Mycobacterium tuberculosis
HASAAPVITAVVPPA

SEQ ID NO: 67160 - protein, 15 aa, Mycobacterium tuberculosis
ASAAPVITAVVPPAA

SEQ ID NO: 67161 - protein, 15 aa, Mycobacterium tuberculosis
SAAPVITAVVPPAAD

SEQ ID NO: 67162 - protein, 15 aa, Mycobacterium tuberculosis
AAPVITAVVPPAADP

SEQ ID NO: 67163 - protein, 15 aa, Mycobacterium tuberculosis
APVITAVVPPAADPV

SEQ ID NO: 67164 - protein, 15 aa, Mycobacterium tuberculosis
PVITAVVPPAADPVS

SEQ ID NO: 67165 - protein, 15 aa, Mycobacterium tuberculosis
VITAVVPPAADPVSL

SEQ ID NO: 67166 - protein, 15 aa, Mycobacterium tuberculosis
ITAVVPPAADPVSLQ

SEQ ID NO: 67167 - protein, 15 aa, Mycobacterium tuberculosis
TAVVPPAADPVSLQT

SEQ ID NO: 67168 - protein, 15 aa, Mycobacterium tuberculosis
AVVPPAADPVSLQTA

SEQ ID NO: 67169 - protein, 15 aa, Mycobacterium tuberculosis
VVPPAADPVSLQTAA

SEQ ID NO: 67170 - protein, 15 aa, Mycobacterium tuberculosis
VPPAADPVSLQTAAG

SEQ ID NO: 67171 - protein, 15 aa, Mycobacterium tuberculosis
PPAADPVSLQTAAGF

SEQ ID NO: 67172 - protein, 15 aa, Mycobacterium tuberculosis
PAADPVSLQTAAGFS

SEQ ID NO: 67173 - protein, 15 aa, Mycobacterium tuberculosis
AADPVSLQTAAGFSA

SEQ ID NO: 67174 - protein, 15 aa, Mycobacterium tuberculosis
ADPVSLQTAAGFSAQ

SEQ ID NO: 67175 - protein, 15 aa, Mycobacterium tuberculosis
DPVSLQTAAGFSAQG

SEQ ID NO: 67176 - protein, 15 aa, Mycobacterium tuberculosis
PVSLQTAAGFSAQGV

SEQ ID NO: 67177 - protein, 15 aa, Mycobacterium tuberculosis
VSLQTAAGFSAQGVE

SEQ ID NO: 67178 - protein, 15 aa, Mycobacterium tuberculosis
SLQTAAGFSAQGVEH

SEQ ID NO: 67179 - protein, 15 aa, Mycobacterium tuberculosis
LQTAAGFSAQGVEHA

SEQ ID NO: 67180 - protein, 15 aa, Mycobacterium tuberculosis
QTAAGFSAQGVEHAV

SEQ ID NO: 67181 - protein, 15 aa, Mycobacterium tuberculosis
TAAGFSAQGVEHAVV

SEQ ID NO: 67182 - protein, 15 aa, Mycobacterium tuberculosis
AAGFSAQGVEHAVVT

SEQ ID NO: 67183 - protein, 15 aa, Mycobacterium tuberculosis
AGFSAQGVEHAVVTA

SEQ ID NO: 67184 - protein, 15 aa, Mycobacterium tuberculosis
GFSAQGVEHAVVTAE

SEQ ID NO: 67185 - protein, 15 aa, Mycobacterium tuberculosis
FSAQGVEHAVVTAEG

SEQ ID NO: 67186 - protein, 15 aa, Mycobacterium tuberculosis
SAQGVEHAVVTAEGV

SEQ ID NO: 67187 - protein, 15 aa, Mycobacterium tuberculosis
AQGVEHAVVTAEGVE

SEQ ID NO: 67188 - protein, 15 aa, Mycobacterium tuberculosis
QGVEHAVVTAEGVEE

SEQ ID NO: 67189 - protein, 15 aa, Mycobacterium tuberculosis
GVEHAVVTAEGVEEL

SEQ ID NO: 67190 - protein, 15 aa, Mycobacterium tuberculosis
VEHAVVTAEGVEELG

SEQ ID NO: 67191 - protein, 15 aa, Mycobacterium tuberculosis
EHAVVTAEGVEELGR

SEQ ID NO: 67192 - protein, 15 aa, Mycobacterium tuberculosis
HAVVTAEGVEELGRA

SEQ ID NO: 67193 - protein, 15 aa, Mycobacterium tuberculosis
AVVTAEGVEELGRAG

SEQ ID NO: 67194 - protein, 15 aa, Mycobacterium tuberculosis
VVTAEGVEELGRAGV

SEQ ID NO: 67195 - protein, 15 aa, Mycobacterium tuberculosis
VTAEGVEELGRAGVG

SEQ ID NO: 67196 - protein, 15 aa, Mycobacterium tuberculosis
TAEGVEELGRAGVGV

SEQ ID NO: 67197 - protein, 15 aa, Mycobacterium tuberculosis
AEGVEELGRAGVGVG

SEQ ID NO: 67198 - protein, 15 aa, Mycobacterium tuberculosis
EGVEELGRAGVGVGE

SEQ ID NO: 67199 - protein, 15 aa, Mycobacterium tuberculosis
GVEELGRAGVGVGES

SEQ ID NO: 67200 - protein, 15 aa, Mycobacterium tuberculosis
VEELGRAGVGVGESG

SEQ ID NO: 67201 - protein, 15 aa, Mycobacterium tuberculosis
EELGRAGVGVGESGA

SEQ ID NO: 67202 - protein, 15 aa, Mycobacterium tuberculosis
ELGRAGVGVGESGAS

SEQ ID NO: 67203 - protein, 15 aa, Mycobacterium tuberculosis
LGRAGVGVGESGASY

SEQ ID NO: 67204 - protein, 15 aa, Mycobacterium tuberculosis
GRAGVGVGESGASYL

SEQ ID NO: 67205 - protein, 15 aa, Mycobacterium tuberculosis
RAGVGVGESGASYLA

SEQ ID NO: 67206 - protein, 15 aa, Mycobacterium tuberculosis
AGVGVGESGASYLAG

SEQ ID NO: 67207 - protein, 15 aa, Mycobacterium tuberculosis
GVGVGESGASYLAGD

SEQ ID NO: 67208 - protein, 15 aa, Mycobacterium tuberculosis
VGVGESGASYLAGDA

SEQ ID NO: 67209 - protein, 15 aa, Mycobacterium tuberculosis
GVGESGASYLAGDAA

SEQ ID NO: 67210 - protein, 15 aa, Mycobacterium tuberculosis
VGESGASYLAGDAAA

SEQ ID NO: 67211 - protein, 15 aa, Mycobacterium tuberculosis
GESGASYLAGDAAAA

SEQ ID NO: 67212 - protein, 15 aa, Mycobacterium tuberculosis
ESGASYLAGDAAAAA

SEQ ID NO: 67213 - protein, 15 aa, Mycobacterium tuberculosis
SGASYLAGDAAAAAT

SEQ ID NO: 67214 - protein, 15 aa, Mycobacterium tuberculosis
GASYLAGDAAAAATY

SEQ ID NO: 67215 - protein, 15 aa, Mycobacterium tuberculosis
ASYLAGDAAAAATYG

SEQ ID NO: 67216 - protein, 15 aa, Mycobacterium tuberculosis
SYLAGDAAAAATYGV

SEQ ID NO: 67217 - protein, 15 aa, Mycobacterium tuberculosis
YLAGDAAAAATYGVV

SEQ ID NO: 67218 - protein, 15 aa, Mycobacterium tuberculosis
LAGDAAAAATYGVVG

SEQ ID NO: 67219 - protein, 15 aa, Mycobacterium tuberculosis
AGDAAAAATYGVVGG

SEQ ID NO: 67220 - protein, 16 aa, Mycobacterium tuberculosis
MTLRVVPEGLAAASAA

SEQ ID NO: 67221 - protein, 16 aa, Mycobacterium tuberculosis
TLRVVPEGLAAASAAV

SEQ ID NO: 67222 - protein, 16 aa, Mycobacterium tuberculosis
LRVVPEGLAAASAAVE

SEQ ID NO: 67223 - protein, 16 aa, Mycobacterium tuberculosis
RVVPEGLAAASAAVEA

SEQ ID NO: 67224 - protein, 16 aa, Mycobacterium tuberculosis
VVPEGLAAASAAVEAL

SEQ ID NO: 67225 - protein, 16 aa, Mycobacterium tuberculosis
VPEGLAAASAAVEALT

SEQ ID NO: 67226 - protein, 16 aa, Mycobacterium tuberculosis
PEGLAAASAAVEALTA

SEQ ID NO: 67227 - protein, 16 aa, Mycobacterium tuberculosis
EGLAAASAAVEALTAR

SEQ ID NO: 67228 - protein, 16 aa, Mycobacterium tuberculosis
GLAAASAAVEALTARL

SEQ ID NO: 67229 - protein, 16 aa, Mycobacterium tuberculosis
LAAASAAVEALTARLA

SEQ ID NO: 67230 - protein, 16 aa, Mycobacterium tuberculosis
AAASAAVEALTARLAA

SEQ ID NO: 67231 - protein, 16 aa, Mycobacterium tuberculosis
AASAAVEALTARLAAA

SEQ ID NO: 67232 - protein, 16 aa, Mycobacterium tuberculosis
ASAAVEALTARLAAAH

SEQ ID NO: 67233 - protein, 16 aa, Mycobacterium tuberculosis
SAAVEALTARLAAAHA

SEQ ID NO: 67234 - protein, 16 aa, Mycobacterium tuberculosis
AAVEALTARLAAAHAS

SEQ ID NO: 67235 - protein, 16 aa, Mycobacterium tuberculosis
AVEALTARLAAAHASA

SEQ ID NO: 67236 - protein, 16 aa, Mycobacterium tuberculosis
VEALTARLAAAHASAA

SEQ ID NO: 67237 - protein, 16 aa, Mycobacterium tuberculosis
EALTARLAAAHASAAP

SEQ ID NO: 67238 - protein, 16 aa, Mycobacterium tuberculosis
ALTARLAAAHASAAPV

SEQ ID NO: 67239 - protein, 16 aa, Mycobacterium tuberculosis
LTARLAAAHASAAPVI

SEQ ID NO: 67240 - protein, 16 aa, Mycobacterium tuberculosis
TARLAAAHASAAPVIT

SEQ ID NO: 67241 - protein, 16 aa, Mycobacterium tuberculosis
ARLAAAHASAAPVITA

SEQ ID NO: 67242 - protein, 16 aa, Mycobacterium tuberculosis
RLAAAHASAAPVITAV

SEQ ID NO: 67243 - protein, 16 aa, Mycobacterium tuberculosis
LAAAHASAAPVITAVV

SEQ ID NO: 67244 - protein, 16 aa, Mycobacterium tuberculosis
AAAHASAAPVITAVVP

SEQ ID NO: 67245 - protein, 16 aa, Mycobacterium tuberculosis
AAHASAAPVITAVVPP

SEQ ID NO: 67246 - protein, 16 aa, Mycobacterium tuberculosis
AHASAAPVITAVVPPA

SEQ ID NO: 67247 - protein, 16 aa, Mycobacterium tuberculosis
HASAAPVITAVVPPAA

SEQ ID NO: 67248 - protein, 16 aa, Mycobacterium tuberculosis
ASAAPVITAVVPPAAD

SEQ ID NO: 67249 - protein, 16 aa, Mycobacterium tuberculosis
SAAPVITAVVPPAADP

SEQ ID NO: 67250 - protein, 16 aa, Mycobacterium tuberculosis
AAPVITAVVPPAADPV

SEQ ID NO: 67251 - protein, 16 aa, Mycobacterium tuberculosis
APVITAVVPPAADPVS

SEQ ID NO: 67252 - protein, 16 aa, Mycobacterium tuberculosis
PVITAVVPPAADPVSL

SEQ ID NO: 67253 - protein, 16 aa, Mycobacterium tuberculosis
VITAVVPPAADPVSLQ

SEQ ID NO: 67254 - protein, 16 aa, Mycobacterium tuberculosis
ITAVVPPAADPVSLQT

SEQ ID NO: 67255 - protein, 16 aa, Mycobacterium tuberculosis
TAVVPPAADPVSLQTA

SEQ ID NO: 67256 - protein, 16 aa, Mycobacterium tuberculosis
AVVPPAADPVSLQTAA

SEQ ID NO: 67257 - protein, 16 aa, Mycobacterium tuberculosis
VVPPAADPVSLQTAAG

SEQ ID NO: 67258 - protein, 16 aa, Mycobacterium tuberculosis
VPPAADPVSLQTAAGF

SEQ ID NO: 67259 - protein, 16 aa, Mycobacterium tuberculosis
PPAADPVSLQTAAGFS

SEQ ID NO: 67260 - protein, 16 aa, Mycobacterium tuberculosis
PAADPVSLQTAAGFSA

SEQ ID NO: 67261 - protein, 16 aa, Mycobacterium tuberculosis
AADPVSLQTAAGFSAQ

SEQ ID NO: 67262 - protein, 16 aa, Mycobacterium tuberculosis
ADPVSLQTAAGFSAQG

SEQ ID NO: 67263 - protein, 16 aa, Mycobacterium tuberculosis
DPVSLQTAAGFSAQGV

SEQ ID NO: 67264 - protein, 16 aa, Mycobacterium tuberculosis
PVSLQTAAGFSAQGVE

SEQ ID NO: 67265 - protein, 16 aa, Mycobacterium tuberculosis
VSLQTAAGFSAQGVEH

SEQ ID NO: 67266 - protein, 16 aa, Mycobacterium tuberculosis
SLQTAAGFSAQGVEHA

SEQ ID NO: 67267 - protein, 16 aa, Mycobacterium tuberculosis
LQTAAGFSAQGVEHAV

SEQ ID NO: 67268 - protein, 16 aa, Mycobacterium tuberculosis
QTAAGFSAQGVEHAVV

SEQ ID NO: 67269 - protein, 16 aa, Mycobacterium tuberculosis
TAAGFSAQGVEHAVVT

SEQ ID NO: 67270 - protein, 16 aa, Mycobacterium tuberculosis
AAGFSAQGVEHAVVTA

SEQ ID NO: 67271 - protein, 16 aa, Mycobacterium tuberculosis
AGFSAQGVEHAVVTAE

SEQ ID NO: 67272 - protein, 16 aa, Mycobacterium tuberculosis
GFSAQGVEHAVVTAEG

SEQ ID NO: 67273 - protein, 16 aa, Mycobacterium tuberculosis
FSAQGVEHAVVTAEGV

SEQ ID NO: 67274 - protein, 16 aa, Mycobacterium tuberculosis
SAQGVEHAVVTAEGVE

SEQ ID NO: 67275 - protein, 16 aa, Mycobacterium tuberculosis
AQGVEHAVVTAEGVEE

SEQ ID NO: 67276 - protein, 16 aa, Mycobacterium tuberculosis
QGVEHAVVTAEGVEEL

SEQ ID NO: 67277 - protein, 16 aa, Mycobacterium tuberculosis
GVEHAVVTAEGVEELG

SEQ ID NO: 67278 - protein, 16 aa, Mycobacterium tuberculosis
VEHAVVTAEGVEELGR

SEQ ID NO: 67279 - protein, 16 aa, Mycobacterium tuberculosis
EHAVVTAEGVEELGRA

SEQ ID NO: 67280 - protein, 16 aa, Mycobacterium tuberculosis
HAVVTAEGVEELGRAG

SEQ ID NO: 67281 - protein, 16 aa, Mycobacterium tuberculosis
AVVTAEGVEELGRAGV

SEQ ID NO: 67282 - protein, 16 aa, Mycobacterium tuberculosis
VVTAEGVEELGRAGVG

SEQ ID NO: 67283 - protein, 16 aa, Mycobacterium tuberculosis
VTAEGVEELGRAGVGV

SEQ ID NO: 67284 - protein, 16 aa, Mycobacterium tuberculosis
TAEGVEELGRAGVGVG

SEQ ID NO: 67285 - protein, 16 aa, Mycobacterium tuberculosis
AEGVEELGRAGVGVGE

SEQ ID NO: 67286 - protein, 16 aa, Mycobacterium tuberculosis
EGVEELGRAGVGVGES

SEQ ID NO: 67287 - protein, 16 aa, Mycobacterium tuberculosis
GVEELGRAGVGVGESG

SEQ ID NO: 67288 - protein, 16 aa, Mycobacterium tuberculosis
VEELGRAGVGVGESGA

SEQ ID NO: 67289 - protein, 16 aa, Mycobacterium tuberculosis
EELGRAGVGVGESGAS

SEQ ID NO: 67290 - protein, 16 aa, Mycobacterium tuberculosis
ELGRAGVGVGESGASY

SEQ ID NO: 67291 - protein, 16 aa, Mycobacterium tuberculosis
LGRAGVGVGESGASYL

SEQ ID NO: 67292 - protein, 16 aa, Mycobacterium tuberculosis
GRAGVGVGESGASYLA

SEQ ID NO: 67293 - protein, 16 aa, Mycobacterium tuberculosis
RAGVGVGESGASYLAG

SEQ ID NO: 67294 - protein, 16 aa, Mycobacterium tuberculosis
AGVGVGESGASYLAGD

SEQ ID NO: 67295 - protein, 16 aa, Mycobacterium tuberculosis
GVGVGESGASYLAGDA

SEQ ID NO: 67296 - protein, 16 aa, Mycobacterium tuberculosis
VGVGESGASYLAGDAA

SEQ ID NO: 67297 - protein, 16 aa, Mycobacterium tuberculosis
GVGESGASYLAGDAAA

SEQ ID NO: 67298 - protein, 16 aa, Mycobacterium tuberculosis
VGESGASYLAGDAAAA

SEQ ID NO: 67299 - protein, 16 aa, Mycobacterium tuberculosis
GESGASYLAGDAAAAA

SEQ ID NO: 67300 - protein, 16 aa, Mycobacterium tuberculosis
ESGASYLAGDAAAAAT

SEQ ID NO: 67301 - protein, 16 aa, Mycobacterium tuberculosis
SGASYLAGDAAAAATY

SEQ ID NO: 67302 - protein, 16 aa, Mycobacterium tuberculosis
GASYLAGDAAAAATYG

SEQ ID NO: 67303 - protein, 16 aa, Mycobacterium tuberculosis
ASYLAGDAAAAATYGV

SEQ ID NO: 67304 - protein, 16 aa, Mycobacterium tuberculosis
SYLAGDAAAAATYGVV

SEQ ID NO: 67305 - protein, 16 aa, Mycobacterium tuberculosis
YLAGDAAAAATYGVVG

SEQ ID NO: 67306 - protein, 16 aa, Mycobacterium tuberculosis
LAGDAAAAATYGVVGG

SEQ ID NO: 67307 - protein, 13 aa, Mycobacterium tuberculosis
MSLLDAHIPQLVA

SEQ ID NO: 67308 - protein, 13 aa, Mycobacterium tuberculosis
SLLDAHIPQLVAS

SEQ ID NO: 67309 - protein, 13 aa, Mycobacterium tuberculosis
LLDAHIPQLVASQ

SEQ ID NO: 67310 - protein, 13 aa, Mycobacterium tuberculosis
LDAHIPQLVASQS

SEQ ID NO: 67311 - protein, 13 aa, Mycobacterium tuberculosis
DAHIPQLVASQSA

SEQ ID NO: 67312 - protein, 13 aa, Mycobacterium tuberculosis
AHIPQLVASQSAF

SEQ ID NO: 67313 - protein, 13 aa, Mycobacterium tuberculosis
HIPQLVASQSAFA

SEQ ID NO: 67314 - protein, 13 aa, Mycobacterium tuberculosis
IPQLVASQSAFAA

SEQ ID NO: 67315 - protein, 13 aa, Mycobacterium tuberculosis
PQLVASQSAFAAK

SEQ ID NO: 67316 - protein, 13 aa, Mycobacterium tuberculosis
QLVASQSAFAAKA

SEQ ID NO: 67317 - protein, 13 aa, Mycobacterium tuberculosis
LVASQSAFAAKAG

SEQ ID NO: 67318 - protein, 13 aa, Mycobacterium tuberculosis
VASQSAFAAKAGL

SEQ ID NO: 67319 - protein, 13 aa, Mycobacterium tuberculosis
ASQSAFAAKAGLM

SEQ ID NO: 67320 - protein, 13 aa, Mycobacterium tuberculosis
SQSAFAAKAGLMR

SEQ ID NO: 67321 - protein, 13 aa, Mycobacterium tuberculosis
QSAFAAKAGLMRH

SEQ ID NO: 67322 - protein, 13 aa, Mycobacterium tuberculosis
SAFAAKAGLMRHT

SEQ ID NO: 67323 - protein, 13 aa, Mycobacterium tuberculosis
AFAAKAGLMRHTI

SEQ ID NO: 67324 - protein, 13 aa, Mycobacterium tuberculosis
FAAKAGLMRHTIG

SEQ ID NO: 67325 - protein, 13 aa, Mycobacterium tuberculosis
AAKAGLMRHTIGQ

SEQ ID NO: 67326 - protein, 13 aa, Mycobacterium tuberculosis
AKAGLMRHTIGQA

SEQ ID NO: 67327 - protein, 13 aa, Mycobacterium tuberculosis
KAGLMRHTIGQAE

SEQ ID NO: 67328 - protein, 13 aa, Mycobacterium tuberculosis
AGLMRHTIGQAEQ

SEQ ID NO: 67329 - protein, 13 aa, Mycobacterium tuberculosis
GLMRHTIGQAEQA

SEQ ID NO: 67330 - protein, 13 aa, Mycobacterium tuberculosis
LMRHTIGQAEQAA

SEQ ID NO: 67331 - protein, 13 aa, Mycobacterium tuberculosis
MRHTIGQAEQAAM

SEQ ID NO: 67332 - protein, 13 aa, Mycobacterium tuberculosis
RHTIGQAEQAAMS

SEQ ID NO: 67333 - protein, 13 aa, Mycobacterium tuberculosis
HTIGQAEQAAMSA

SEQ ID NO: 67334 - protein, 13 aa, Mycobacterium tuberculosis
TIGQAEQAAMSAQ

SEQ ID NO: 67335 - protein, 13 aa, Mycobacterium tuberculosis
IGQAEQAAMSAQA

SEQ ID NO: 67336 - protein, 13 aa, Mycobacterium tuberculosis
GQAEQAAMSAQAF

SEQ ID NO: 67337 - protein, 13 aa, Mycobacterium tuberculosis
QAEQAAMSAQAFH

SEQ ID NO: 67338 - protein, 13 aa, Mycobacterium tuberculosis
AEQAAMSAQAFHQ

SEQ ID NO: 67339 - protein, 13 aa, Mycobacterium tuberculosis
EQAAMSAQAFHQG

SEQ ID NO: 67340 - protein, 13 aa, Mycobacterium tuberculosis
QAAMSAQAFHQGE

SEQ ID NO: 67341 - protein, 13 aa, Mycobacterium tuberculosis
AAMSAQAFHQGES

SEQ ID NO: 67342 - protein, 13 aa, Mycobacterium tuberculosis
AMSAQAFHQGESS

SEQ ID NO: 67343 - protein, 13 aa, Mycobacterium tuberculosis
MSAQAFHQGESSA

SEQ ID NO: 67344 - protein, 13 aa, Mycobacterium tuberculosis
SAQAFHQGESSAA

SEQ ID NO: 67345 - protein, 13 aa, Mycobacterium tuberculosis
AQAFHQGESSAAF

SEQ ID NO: 67346 - protein, 13 aa, Mycobacterium tuberculosis
QAFHQGESSAAFQ

SEQ ID NO: 67347 - protein, 13 aa, Mycobacterium tuberculosis
AFHQGESSAAFQA

SEQ ID NO: 67348 - protein, 13 aa, Mycobacterium tuberculosis
FHQGESSAAFQAA

SEQ ID NO: 67349 - protein, 13 aa, Mycobacterium tuberculosis
HQGESSAAFQAAH

SEQ ID NO: 67350 - protein, 13 aa, Mycobacterium tuberculosis
QGESSAAFQAAHA

SEQ ID NO: 67351 - protein, 13 aa, Mycobacterium tuberculosis
GESSAAFQAAHAR

SEQ ID NO: 67352 - protein, 13 aa, Mycobacterium tuberculosis
ESSAAFQAAHARF

SEQ ID NO: 67353 - protein, 13 aa, Mycobacterium tuberculosis
SSAAFQAAHARFV

SEQ ID NO: 67354 - protein, 13 aa, Mycobacterium tuberculosis
SAAFQAAHARFVA

SEQ ID NO: 67355 - protein, 13 aa, Mycobacterium tuberculosis
AAFQAAHARFVAA

SEQ ID NO: 67356 - protein, 13 aa, Mycobacterium tuberculosis
AFQAAHARFVAAA

SEQ ID NO: 67357 - protein, 13 aa, Mycobacterium tuberculosis
FQAAHARFVAAAA

SEQ ID NO: 67358 - protein, 13 aa, Mycobacterium tuberculosis
QAAHARFVAAAAK

SEQ ID NO: 67359 - protein, 13 aa, Mycobacterium tuberculosis
AAHARFVAAAAKV

SEQ ID NO: 67360 - protein, 13 aa, Mycobacterium tuberculosis
AHARFVAAAAKVN

SEQ ID NO: 67361 - protein, 13 aa, Mycobacterium tuberculosis
HARFVAAAAKVNT

SEQ ID NO: 67362 - protein, 13 aa, Mycobacterium tuberculosis
ARFVAAAAKVNTL

SEQ ID NO: 67363 - protein, 13 aa, Mycobacterium tuberculosis
RFVAAAAKVNTLL

SEQ ID NO: 67364 - protein, 13 aa, Mycobacterium tuberculosis
FVAAAAKVNTLLD

SEQ ID NO: 67365 - protein, 13 aa, Mycobacterium tuberculosis
VAAAAKVNTLLDV

SEQ ID NO: 67366 - protein, 13 aa, Mycobacterium tuberculosis
AAAAKVNTLLDVA

SEQ ID NO: 67367 - protein, 13 aa, Mycobacterium tuberculosis
AAAKVNTLLDVAQ

SEQ ID NO: 67368 - protein, 13 aa, Mycobacterium tuberculosis
AAKVNTLLDVAQA

SEQ ID NO: 67369 - protein, 13 aa, Mycobacterium tuberculosis
AKVNTLLDVAQAN

SEQ ID NO: 67370 - protein, 13 aa, Mycobacterium tuberculosis
KVNTLLDVAQANL

SEQ ID NO: 67371 - protein, 13 aa, Mycobacterium tuberculosis
VNTLLDVAQANLG

SEQ ID NO: 67372 - protein, 13 aa, Mycobacterium tuberculosis
NTLLDVAQANLGE

SEQ ID NO: 67373 - protein, 13 aa, Mycobacterium tuberculosis
TLLDVAQANLGEA

SEQ ID NO: 67374 - protein, 13 aa, Mycobacterium tuberculosis
LLDVAQANLGEAA

SEQ ID NO: 67375 - protein, 13 aa, Mycobacterium tuberculosis
LDVAQANLGEAAG

SEQ ID NO: 67376 - protein, 13 aa, Mycobacterium tuberculosis
DVAQANLGEAAGT

SEQ ID NO: 67377 - protein, 13 aa, Mycobacterium tuberculosis
VAQANLGEAAGTY

SEQ ID NO: 67378 - protein, 13 aa, Mycobacterium tuberculosis
AQANLGEAAGTYV

SEQ ID NO: 67379 - protein, 13 aa, Mycobacterium tuberculosis
QANLGEAAGTYVA

SEQ ID NO: 67380 - protein, 13 aa, Mycobacterium tuberculosis
ANLGEAAGTYVAA

SEQ ID NO: 67381 - protein, 13 aa, Mycobacterium tuberculosis
NLGEAAGTYVAAD

SEQ ID NO: 67382 - protein, 13 aa, Mycobacterium tuberculosis
LGEAAGTYVAADA

SEQ ID NO: 67383 - protein, 13 aa, Mycobacterium tuberculosis
GEAAGTYVAADAA

SEQ ID NO: 67384 - protein, 13 aa, Mycobacterium tuberculosis
EAAGTYVAADAAA

SEQ ID NO: 67385 - protein, 13 aa, Mycobacterium tuberculosis
AAGTYVAADAAAA

SEQ ID NO: 67386 - protein, 13 aa, Mycobacterium tuberculosis
AGTYVAADAAAAS

SEQ ID NO: 67387 - protein, 13 aa, Mycobacterium tuberculosis
GTYVAADAAAAST

SEQ ID NO: 67388 - protein, 13 aa, Mycobacterium tuberculosis
TYVAADAAAASTY

SEQ ID NO: 67389 - protein, 13 aa, Mycobacterium tuberculosis
YVAADAAAASTYT

SEQ ID NO: 67390 - protein, 13 aa, Mycobacterium tuberculosis
VAADAAAASTYTG

SEQ ID NO: 67391 - protein, 13 aa, Mycobacterium tuberculosis
AADAAAASTYTGF

SEQ ID NO: 67392 - protein, 14 aa, Mycobacterium tuberculosis
MSLLDAHIPQLVAS

SEQ ID NO: 67393 - protein, 14 aa, Mycobacterium tuberculosis
SLLDAHIPQLVASQ

SEQ ID NO: 67394 - protein, 14 aa, Mycobacterium tuberculosis
LLDAHIPQLVASQS

SEQ ID NO: 67395 - protein, 14 aa, Mycobacterium tuberculosis
LDAHIPQLVASQSA

SEQ ID NO: 67396 - protein, 14 aa, Mycobacterium tuberculosis
DAHIPQLVASQSAF

SEQ ID NO: 67397 - protein, 14 aa, Mycobacterium tuberculosis
AHIPQLVASQSAFA

SEQ ID NO: 67398 - protein, 14 aa, Mycobacterium tuberculosis
HIPQLVASQSAFAA

SEQ ID NO: 67399 - protein, 14 aa, Mycobacterium tuberculosis
IPQLVASQSAFAAK

SEQ ID NO: 67400 - protein, 14 aa, Mycobacterium tuberculosis
PQLVASQSAFAAKA

SEQ ID NO: 67401 - protein, 14 aa, Mycobacterium tuberculosis
QLVASQSAFAAKAG

SEQ ID NO: 67402 - protein, 14 aa, Mycobacterium tuberculosis
LVASQSAFAAKAGL

SEQ ID NO: 67403 - protein, 14 aa, Mycobacterium tuberculosis
VASQSAFAAKAGLM

SEQ ID NO: 67404 - protein, 14 aa, Mycobacterium tuberculosis
ASQSAFAAKAGLMR

SEQ ID NO: 67405 - protein, 14 aa, Mycobacterium tuberculosis
SQSAFAAKAGLMRH

SEQ ID NO: 67406 - protein, 14 aa, Mycobacterium tuberculosis
QSAFAAKAGLMRHT

SEQ ID NO: 67407 - protein, 14 aa, Mycobacterium tuberculosis
SAFAAKAGLMRHTI

SEQ ID NO: 67408 - protein, 14 aa, Mycobacterium tuberculosis
AFAAKAGLMRHTIG

SEQ ID NO: 67409 - protein, 14 aa, Mycobacterium tuberculosis
FAAKAGLMRHTIGQ

SEQ ID NO: 67410 - protein, 14 aa, Mycobacterium tuberculosis
AAKAGLMRHTIGQA

SEQ ID NO: 67411 - protein, 14 aa, Mycobacterium tuberculosis
AKAGLMRHTIGQAE

SEQ ID NO: 67412 - protein, 14 aa, Mycobacterium tuberculosis
KAGLMRHTIGQAEQ

SEQ ID NO: 67413 - protein, 14 aa, Mycobacterium tuberculosis
AGLMRHTIGQAEQA

SEQ ID NO: 67414 - protein, 14 aa, Mycobacterium tuberculosis
GLMRHTIGQAEQAA

SEQ ID NO: 67415 - protein, 14 aa, Mycobacterium tuberculosis
LMRHTIGQAEQAAM

SEQ ID NO: 67416 - protein, 14 aa, Mycobacterium tuberculosis
MRHTIGQAEQAAMS

SEQ ID NO: 67417 - protein, 14 aa, Mycobacterium tuberculosis
RHTIGQAEQAAMSA

SEQ ID NO: 67418 - protein, 14 aa, Mycobacterium tuberculosis
HTIGQAEQAAMSAQ

SEQ ID NO: 67419 - protein, 14 aa, Mycobacterium tuberculosis
TIGQAEQAAMSAQA

SEQ ID NO: 67420 - protein, 14 aa, Mycobacterium tuberculosis
IGQAEQAAMSAQAF

SEQ ID NO: 67421 - protein, 14 aa, Mycobacterium tuberculosis
GQAEQAAMSAQAFH

SEQ ID NO: 67422 - protein, 14 aa, Mycobacterium tuberculosis
QAEQAAMSAQAFHQ

SEQ ID NO: 67423 - protein, 14 aa, Mycobacterium tuberculosis
AEQAAMSAQAFHQG

SEQ ID NO: 67424 - protein, 14 aa, Mycobacterium tuberculosis
EQAAMSAQAFHQGE

SEQ ID NO: 67425 - protein, 14 aa, Mycobacterium tuberculosis
QAAMSAQAFHQGES

SEQ ID NO: 67426 - protein, 14 aa, Mycobacterium tuberculosis
AAMSAQAFHQGESS

SEQ ID NO: 67427 - protein, 14 aa, Mycobacterium tuberculosis
AMSAQAFHQGESSA

SEQ ID NO: 67428 - protein, 14 aa, Mycobacterium tuberculosis
MSAQAFHQGESSAA

SEQ ID NO: 67429 - protein, 14 aa, Mycobacterium tuberculosis
SAQAFHQGESSAAF

SEQ ID NO: 67430 - protein, 14 aa, Mycobacterium tuberculosis
AQAFHQGESSAAFQ

SEQ ID NO: 67431 - protein, 14 aa, Mycobacterium tuberculosis
QAFHQGESSAAFQA

SEQ ID NO: 67432 - protein, 14 aa, Mycobacterium tuberculosis
AFHQGESSAAFQAA

SEQ ID NO: 67433 - protein, 14 aa, Mycobacterium tuberculosis
FHQGESSAAFQAAH

SEQ ID NO: 67434 - protein, 14 aa, Mycobacterium tuberculosis
HQGESSAAFQAAHA

SEQ ID NO: 67435 - protein, 14 aa, Mycobacterium tuberculosis
QGESSAAFQAAHAR

SEQ ID NO: 67436 - protein, 14 aa, Mycobacterium tuberculosis
GESSAAFQAAHARF

SEQ ID NO: 67437 - protein, 14 aa, Mycobacterium tuberculosis
ESSAAFQAAHARFV

SEQ ID NO: 67438 - protein, 14 aa, Mycobacterium tuberculosis
SSAAFQAAHARFVA

SEQ ID NO: 67439 - protein, 14 aa, Mycobacterium tuberculosis
SAAFQAAHARFVAA

SEQ ID NO: 67440 - protein, 14 aa, Mycobacterium tuberculosis
AAFQAAHARFVAAA

SEQ ID NO: 67441 - protein, 14 aa, Mycobacterium tuberculosis
AFQAAHARFVAAAA

SEQ ID NO: 67442 - protein, 14 aa, Mycobacterium tuberculosis
FQAAHARFVAAAAK

SEQ ID NO: 67443 - protein, 14 aa, Mycobacterium tuberculosis
QAAHARFVAAAAKV

SEQ ID NO: 67444 - protein, 14 aa, Mycobacterium tuberculosis
AAHARFVAAAAKVN

SEQ ID NO: 67445 - protein, 14 aa, Mycobacterium tuberculosis
AHARFVAAAAKVNT

SEQ ID NO: 67446 - protein, 14 aa, Mycobacterium tuberculosis
HARFVAAAAKVNTL

SEQ ID NO: 67447 - protein, 14 aa, Mycobacterium tuberculosis
ARFVAAAAKVNTLL

SEQ ID NO: 67448 - protein, 14 aa, Mycobacterium tuberculosis
RFVAAAAKVNTLLD

SEQ ID NO: 67449 - protein, 14 aa, Mycobacterium tuberculosis
FVAAAAKVNTLLDV

SEQ ID NO: 67450 - protein, 14 aa, Mycobacterium tuberculosis
VAAAAKVNTLLDVA

SEQ ID NO: 67451 - protein, 14 aa, Mycobacterium tuberculosis
AAAAKVNTLLDVAQ

SEQ ID NO: 67452 - protein, 14 aa, Mycobacterium tuberculosis
AAAKVNTLLDVAQA

SEQ ID NO: 67453 - protein, 14 aa, Mycobacterium tuberculosis
AAKVNTLLDVAQAN

SEQ ID NO: 67454 - protein, 14 aa, Mycobacterium tuberculosis
AKVNTLLDVAQANL

SEQ ID NO: 67455 - protein, 14 aa, Mycobacterium tuberculosis
KVNTLLDVAQANLG

SEQ ID NO: 67456 - protein, 14 aa, Mycobacterium tuberculosis
VNTLLDVAQANLGE

SEQ ID NO: 67457 - protein, 14 aa, Mycobacterium tuberculosis
NTLLDVAQANLGEA

SEQ ID NO: 67458 - protein, 14 aa, Mycobacterium tuberculosis
TLLDVAQANLGEAA

SEQ ID NO: 67459 - protein, 14 aa, Mycobacterium tuberculosis
LLDVAQANLGEAAG

SEQ ID NO: 67460 - protein, 14 aa, Mycobacterium tuberculosis
LDVAQANLGEAAGT

SEQ ID NO: 67461 - protein, 14 aa, Mycobacterium tuberculosis
DVAQANLGEAAGTY

SEQ ID NO: 67462 - protein, 14 aa, Mycobacterium tuberculosis
VAQANLGEAAGTYV

SEQ ID NO: 67463 - protein, 14 aa, Mycobacterium tuberculosis
AQANLGEAAGTYVA

SEQ ID NO: 67464 - protein, 14 aa, Mycobacterium tuberculosis
QANLGEAAGTYVAA

SEQ ID NO: 67465 - protein, 14 aa, Mycobacterium tuberculosis
ANLGEAAGTYVAAD

SEQ ID NO: 67466 - protein, 14 aa, Mycobacterium tuberculosis
NLGEAAGTYVAADA

SEQ ID NO: 67467 - protein, 14 aa, Mycobacterium tuberculosis
LGEAAGTYVAADAA

SEQ ID NO: 67468 - protein, 14 aa, Mycobacterium tuberculosis
GEAAGTYVAADAAA

SEQ ID NO: 67469 - protein, 14 aa, Mycobacterium tuberculosis
EAAGTYVAADAAAA

SEQ ID NO: 67470 - protein, 14 aa, Mycobacterium tuberculosis
AAGTYVAADAAAAS

SEQ ID NO: 67471 - protein, 14 aa, Mycobacterium tuberculosis
AGTYVAADAAAAST

SEQ ID NO: 67472 - protein, 14 aa, Mycobacterium tuberculosis
GTYVAADAAAASTY

SEQ ID NO: 67473 - protein, 14 aa, Mycobacterium tuberculosis
TYVAADAAAASTYT

SEQ ID NO: 67474 - protein, 14 aa, Mycobacterium tuberculosis
YVAADAAAASTYTG

SEQ ID NO: 67475 - protein, 14 aa, Mycobacterium tuberculosis
VAADAAAASTYTGF

SEQ ID NO: 67476 - protein, 15 aa, Mycobacterium tuberculosis
MSLLDAHIPQLVASQ

SEQ ID NO: 67477 - protein, 15 aa, Mycobacterium tuberculosis
SLLDAHIPQLVASQS

SEQ ID NO: 67478 - protein, 15 aa, Mycobacterium tuberculosis
LLDAHIPQLVASQSA

SEQ ID NO: 67479 - protein, 15 aa, Mycobacterium tuberculosis
LDAHIPQLVASQSAF

SEQ ID NO: 67480 - protein, 15 aa, Mycobacterium tuberculosis
DAHIPQLVASQSAFA

SEQ ID NO: 67481 - protein, 15 aa, Mycobacterium tuberculosis
AHIPQLVASQSAFAA

SEQ ID NO: 67482 - protein, 15 aa, Mycobacterium tuberculosis
HIPQLVASQSAFAAK

SEQ ID NO: 67483 - protein, 15 aa, Mycobacterium tuberculosis
IPQLVASQSAFAAKA

SEQ ID NO: 67484 - protein, 15 aa, Mycobacterium tuberculosis
PQLVASQSAFAAKAG

SEQ ID NO: 67485 - protein, 15 aa, Mycobacterium tuberculosis
QLVASQSAFAAKAGL

SEQ ID NO: 67486 - protein, 15 aa, Mycobacterium tuberculosis
LVASQSAFAAKAGLM

SEQ ID NO: 67487 - protein, 15 aa, Mycobacterium tuberculosis
VASQSAFAAKAGLMR

SEQ ID NO: 67488 - protein, 15 aa, Mycobacterium tuberculosis
ASQSAFAAKAGLMRH

SEQ ID NO: 67489 - protein, 15 aa, Mycobacterium tuberculosis
SQSAFAAKAGLMRHT

SEQ ID NO: 67490 - protein, 15 aa, Mycobacterium tuberculosis
QSAFAAKAGLMRHTI

SEQ ID NO: 67491 - protein, 15 aa, Mycobacterium tuberculosis
SAFAAKAGLMRHTIG

SEQ ID NO: 67492 - protein, 15 aa, Mycobacterium tuberculosis
AFAAKAGLMRHTIGQ

SEQ ID NO: 67493 - protein, 15 aa, Mycobacterium tuberculosis
FAAKAGLMRHTIGQA

SEQ ID NO: 67494 - protein, 15 aa, Mycobacterium tuberculosis
AAKAGLMRHTIGQAE

SEQ ID NO: 67495 - protein, 15 aa, Mycobacterium tuberculosis
AKAGLMRHTIGQAEQ

SEQ ID NO: 67496 - protein, 15 aa, Mycobacterium tuberculosis
KAGLMRHTIGQAEQA

SEQ ID NO: 67497 - protein, 15 aa, Mycobacterium tuberculosis
AGLMRHTIGQAEQAA

SEQ ID NO: 67498 - protein, 15 aa, Mycobacterium tuberculosis
GLMRHTIGQAEQAAM

SEQ ID NO: 67499 - protein, 15 aa, Mycobacterium tuberculosis
LMRHTIGQAEQAAMS

SEQ ID NO: 67500 - protein, 15 aa, Mycobacterium tuberculosis
MRHTIGQAEQAAMSA

SEQ ID NO: 67501 - protein, 15 aa, Mycobacterium tuberculosis
RHTIGQAEQAAMSAQ

SEQ ID NO: 67502 - protein, 15 aa, Mycobacterium tuberculosis
HTIGQAEQAAMSAQA

SEQ ID NO: 67503 - protein, 15 aa, Mycobacterium tuberculosis
TIGQAEQAAMSAQAF

SEQ ID NO: 67504 - protein, 15 aa, Mycobacterium tuberculosis
IGQAEQAAMSAQAFH

SEQ ID NO: 67505 - protein, 15 aa, Mycobacterium tuberculosis
GQAEQAAMSAQAFHQ

SEQ ID NO: 67506 - protein, 15 aa, Mycobacterium tuberculosis
QAEQAAMSAQAFHQG

SEQ ID NO: 67507 - protein, 15 aa, Mycobacterium tuberculosis
AEQAAMSAQAFHQGE

SEQ ID NO: 67508 - protein, 15 aa, Mycobacterium tuberculosis
EQAAMSAQAFHQGES

SEQ ID NO: 67509 - protein, 15 aa, Mycobacterium tuberculosis
QAAMSAQAFHQGESS

SEQ ID NO: 67510 - protein, 15 aa, Mycobacterium tuberculosis
AAMSAQAFHQGESSA

SEQ ID NO: 67511 - protein, 15 aa, Mycobacterium tuberculosis
AMSAQAFHQGESSAA

SEQ ID NO: 67512 - protein, 15 aa, Mycobacterium tuberculosis
MSAQAFHQGESSAAF

SEQ ID NO: 67513 - protein, 15 aa, Mycobacterium tuberculosis
SAQAFHQGESSAAFQ

SEQ ID NO: 67514 - protein, 15 aa, Mycobacterium tuberculosis
AQAFHQGESSAAFQA

SEQ ID NO: 67515 - protein, 15 aa, Mycobacterium tuberculosis
QAFHQGESSAAFQAA

SEQ ID NO: 67516 - protein, 15 aa, Mycobacterium tuberculosis
AFHQGESSAAFQAAH

SEQ ID NO: 67517 - protein, 15 aa, Mycobacterium tuberculosis
FHQGESSAAFQAAHA

SEQ ID NO: 67518 - protein, 15 aa, Mycobacterium tuberculosis
HQGESSAAFQAAHAR

SEQ ID NO: 67519 - protein, 15 aa, Mycobacterium tuberculosis
QGESSAAFQAAHARF

SEQ ID NO: 67520 - protein, 15 aa, Mycobacterium tuberculosis
GESSAAFQAAHARFV

SEQ ID NO: 67521 - protein, 15 aa, Mycobacterium tuberculosis
ESSAAFQAAHARFVA

SEQ ID NO: 67522 - protein, 15 aa, Mycobacterium tuberculosis
SSAAFQAAHARFVAA

SEQ ID NO: 67523 - protein, 15 aa, Mycobacterium tuberculosis
SAAFQAAHARFVAAA

SEQ ID NO: 67524 - protein, 15 aa, Mycobacterium tuberculosis
AAFQAAHARFVAAAA

SEQ ID NO: 67525 - protein, 15 aa, Mycobacterium tuberculosis
AFQAAHARFVAAAAK

SEQ ID NO: 67526 - protein, 15 aa, Mycobacterium tuberculosis
FQAAHARFVAAAAKV

SEQ ID NO: 67527 - protein, 15 aa, Mycobacterium tuberculosis
QAAHARFVAAAAKVN

SEQ ID NO: 67528 - protein, 15 aa, Mycobacterium tuberculosis
AAHARFVAAAAKVNT

SEQ ID NO: 67529 - protein, 15 aa, Mycobacterium tuberculosis
AHARFVAAAAKVNTL

SEQ ID NO: 67530 - protein, 15 aa, Mycobacterium tuberculosis
HARFVAAAAKVNTLL

SEQ ID NO: 67531 - protein, 15 aa, Mycobacterium tuberculosis
ARFVAAAAKVNTLLD

SEQ ID NO: 67532 - protein, 15 aa, Mycobacterium tuberculosis
RFVAAAAKVNTLLDV

SEQ ID NO: 67533 - protein, 15 aa, Mycobacterium tuberculosis
FVAAAAKVNTLLDVA

SEQ ID NO: 67534 - protein, 15 aa, Mycobacterium tuberculosis
VAAAAKVNTLLDVAQ

SEQ ID NO: 67535 - protein, 15 aa, Mycobacterium tuberculosis
AAAAKVNTLLDVAQA

SEQ ID NO: 67536 - protein, 15 aa, Mycobacterium tuberculosis
AAAKVNTLLDVAQAN

SEQ ID NO: 67537 - protein, 15 aa, Mycobacterium tuberculosis
AAKVNTLLDVAQANL

SEQ ID NO: 67538 - protein, 15 aa, Mycobacterium tuberculosis
AKVNTLLDVAQANLG

SEQ ID NO: 67539 - protein, 15 aa, Mycobacterium tuberculosis
KVNTLLDVAQANLGE

SEQ ID NO: 67540 - protein, 15 aa, Mycobacterium tuberculosis
VNTLLDVAQANLGEA

SEQ ID NO: 67541 - protein, 15 aa, Mycobacterium tuberculosis
NTLLDVAQANLGEAA

SEQ ID NO: 67542 - protein, 15 aa, Mycobacterium tuberculosis
TLLDVAQANLGEAAG

SEQ ID NO: 67543 - protein, 15 aa, Mycobacterium tuberculosis
LLDVAQANLGEAAGT

SEQ ID NO: 67544 - protein, 15 aa, Mycobacterium tuberculosis
LDVAQANLGEAAGTY

SEQ ID NO: 67545 - protein, 15 aa, Mycobacterium tuberculosis
DVAQANLGEAAGTYV

SEQ ID NO: 67546 - protein, 15 aa, Mycobacterium tuberculosis
VAQANLGEAAGTYVA

SEQ ID NO: 67547 - protein, 15 aa, Mycobacterium tuberculosis
AQANLGEAAGTYVAA

SEQ ID NO: 67548 - protein, 15 aa, Mycobacterium tuberculosis
QANLGEAAGTYVAAD

SEQ ID NO: 67549 - protein, 15 aa, Mycobacterium tuberculosis
ANLGEAAGTYVAADA

SEQ ID NO: 67550 - protein, 15 aa, Mycobacterium tuberculosis
NLGEAAGTYVAADAA

SEQ ID NO: 67551 - protein, 15 aa, Mycobacterium tuberculosis
LGEAAGTYVAADAAA

SEQ ID NO: 67552 - protein, 15 aa, Mycobacterium tuberculosis
GEAAGTYVAADAAAA

SEQ ID NO: 67553 - protein, 15 aa, Mycobacterium tuberculosis
EAAGTYVAADAAAAS

SEQ ID NO: 67554 - protein, 15 aa, Mycobacterium tuberculosis
AAGTYVAADAAAAST

SEQ ID NO: 67555 - protein, 15 aa, Mycobacterium tuberculosis
AGTYVAADAAAASTY

SEQ ID NO: 67556 - protein, 15 aa, Mycobacterium tuberculosis
GTYVAADAAAASTYT

SEQ ID NO: 67557 - protein, 15 aa, Mycobacterium tuberculosis
TYVAADAAAASTYTG

SEQ ID NO: 67558 - protein, 15 aa, Mycobacterium tuberculosis
YVAADAAAASTYTGF

SEQ ID NO: 67559 - protein, 16 aa, Mycobacterium tuberculosis
MSLLDAHIPQLVASQS

SEQ ID NO: 67560 - protein, 16 aa, Mycobacterium tuberculosis
SLLDAHIPQLVASQSA

SEQ ID NO: 67561 - protein, 16 aa, Mycobacterium tuberculosis
LLDAHIPQLVASQSAF

SEQ ID NO: 67562 - protein, 16 aa, Mycobacterium tuberculosis
LDAHIPQLVASQSAFA

SEQ ID NO: 67563 - protein, 16 aa, Mycobacterium tuberculosis
DAHIPQLVASQSAFAA

SEQ ID NO: 67564 - protein, 16 aa, Mycobacterium tuberculosis
AHIPQLVASQSAFAAK

SEQ ID NO: 67565 - protein, 16 aa, Mycobacterium tuberculosis
HIPQLVASQSAFAAKA

SEQ ID NO: 67566 - protein, 16 aa, Mycobacterium tuberculosis
IPQLVASQSAFAAKAG

SEQ ID NO: 67567 - protein, 16 aa, Mycobacterium tuberculosis
PQLVASQSAFAAKAGL

SEQ ID NO: 67568 - protein, 16 aa, Mycobacterium tuberculosis
QLVASQSAFAAKAGLM

SEQ ID NO: 67569 - protein, 16 aa, Mycobacterium tuberculosis
LVASQSAFAAKAGLMR

SEQ ID NO: 67570 - protein, 16 aa, Mycobacterium tuberculosis
VASQSAFAAKAGLMRH

SEQ ID NO: 67571 - protein, 16 aa, Mycobacterium tuberculosis
ASQSAFAAKAGLMRHT

SEQ ID NO: 67572 - protein, 16 aa, Mycobacterium tuberculosis
SQSAFAAKAGLMRHTI

SEQ ID NO: 67573 - protein, 16 aa, Mycobacterium tuberculosis
QSAFAAKAGLMRHTIG

SEQ ID NO: 67574 - protein, 16 aa, Mycobacterium tuberculosis
SAFAAKAGLMRHTIGQ

SEQ ID NO: 67575 - protein, 16 aa, Mycobacterium tuberculosis
AFAAKAGLMRHTIGQA

SEQ ID NO: 67576 - protein, 16 aa, Mycobacterium tuberculosis
FAAKAGLMRHTIGQAE

SEQ ID NO: 67577 - protein, 16 aa, Mycobacterium tuberculosis
AAKAGLMRHTIGQAEQ

SEQ ID NO: 67578 - protein, 16 aa, Mycobacterium tuberculosis
AKAGLMRHTIGQAEQA

SEQ ID NO: 67579 - protein, 16 aa, Mycobacterium tuberculosis
KAGLMRHTIGQAEQAA

SEQ ID NO: 67580 - protein, 16 aa, Mycobacterium tuberculosis
AGLMRHTIGQAEQAAM

SEQ ID NO: 67581 - protein, 16 aa, Mycobacterium tuberculosis
GLMRHTIGQAEQAAMS

SEQ ID NO: 67582 - protein, 16 aa, Mycobacterium tuberculosis
LMRHTIGQAEQAAMSA

SEQ ID NO: 67583 - protein, 16 aa, Mycobacterium tuberculosis
MRHTIGQAEQAAMSAQ

SEQ ID NO: 67584 - protein, 16 aa, Mycobacterium tuberculosis
RHTIGQAEQAAMSAQA

SEQ ID NO: 67585 - protein, 16 aa, Mycobacterium tuberculosis
HTIGQAEQAAMSAQAF

SEQ ID NO: 67586 - protein, 16 aa, Mycobacterium tuberculosis
TIGQAEQAAMSAQAFH

SEQ ID NO: 67587 - protein, 16 aa, Mycobacterium tuberculosis
IGQAEQAAMSAQAFHQ

SEQ ID NO: 67588 - protein, 16 aa, Mycobacterium tuberculosis
GQAEQAAMSAQAFHQG

SEQ ID NO: 67589 - protein, 16 aa, Mycobacterium tuberculosis
QAEQAAMSAQAFHQGE

SEQ ID NO: 67590 - protein, 16 aa, Mycobacterium tuberculosis
AEQAAMSAQAFHQGES

SEQ ID NO: 67591 - protein, 16 aa, Mycobacterium tuberculosis
EQAAMSAQAFHQGESS

SEQ ID NO: 67592 - protein, 16 aa, Mycobacterium tuberculosis
QAAMSAQAFHQGESSA

SEQ ID NO: 67593 - protein, 16 aa, Mycobacterium tuberculosis
AAMSAQAFHQGESSAA

SEQ ID NO: 67594 - protein, 16 aa, Mycobacterium tuberculosis
AMSAQAFHQGESSAAF

SEQ ID NO: 67595 - protein, 16 aa, Mycobacterium tuberculosis
MSAQAFHQGESSAAFQ

SEQ ID NO: 67596 - protein, 16 aa, Mycobacterium tuberculosis
SAQAFHQGESSAAFQA

SEQ ID NO: 67597 - protein, 16 aa, Mycobacterium tuberculosis
AQAFHQGESSAAFQAA

SEQ ID NO: 67598 - protein, 16 aa, Mycobacterium tuberculosis
QAFHQGESSAAFQAAH

SEQ ID NO: 67599 - protein, 16 aa, Mycobacterium tuberculosis
AFHQGESSAAFQAAHA

SEQ ID NO: 67600 - protein, 16 aa, Mycobacterium tuberculosis
FHQGESSAAFQAAHAR

SEQ ID NO: 67601 - protein, 16 aa, Mycobacterium tuberculosis
HQGESSAAFQAAHARF

SEQ ID NO: 67602 - protein, 16 aa, Mycobacterium tuberculosis
QGESSAAFQAAHARFV

SEQ ID NO: 67603 - protein, 16 aa, Mycobacterium tuberculosis
GESSAAFQAAHARFVA

SEQ ID NO: 67604 - protein, 16 aa, Mycobacterium tuberculosis
ESSAAFQAAHARFVAA

SEQ ID NO: 67605 - protein, 16 aa, Mycobacterium tuberculosis
SSAAFQAAHARFVAAA

SEQ ID NO: 67606 - protein, 16 aa, Mycobacterium tuberculosis
SAAFQAAHARFVAAAA

SEQ ID NO: 67607 - protein, 16 aa, Mycobacterium tuberculosis
AAFQAAHARFVAAAAK

SEQ ID NO: 67608 - protein, 16 aa, Mycobacterium tuberculosis
AFQAAHARFVAAAAKV

SEQ ID NO: 67609 - protein, 16 aa, Mycobacterium tuberculosis
FQAAHARFVAAAAKVN

SEQ ID NO: 67610 - protein, 16 aa, Mycobacterium tuberculosis
QAAHARFVAAAAKVNT

SEQ ID NO: 67611 - protein, 16 aa, Mycobacterium tuberculosis
AAHARFVAAAAKVNTL

SEQ ID NO: 67612 - protein, 16 aa, Mycobacterium tuberculosis
AHARFVAAAAKVNTLL

SEQ ID NO: 67613 - protein, 16 aa, Mycobacterium tuberculosis
HARFVAAAAKVNTLLD

SEQ ID NO: 67614 - protein, 16 aa, Mycobacterium tuberculosis
ARFVAAAAKVNTLLDV

SEQ ID NO: 67615 - protein, 16 aa, Mycobacterium tuberculosis
RFVAAAAKVNTLLDVA

SEQ ID NO: 67616 - protein, 16 aa, Mycobacterium tuberculosis
FVAAAAKVNTLLDVAQ

SEQ ID NO: 67617 - protein, 16 aa, Mycobacterium tuberculosis
VAAAAKVNTLLDVAQA

SEQ ID NO: 67618 - protein, 16 aa, Mycobacterium tuberculosis
AAAAKVNTLLDVAQAN

SEQ ID NO: 67619 - protein, 16 aa, Mycobacterium tuberculosis
AAAKVNTLLDVAQANL

SEQ ID NO: 67620 - protein, 16 aa, Mycobacterium tuberculosis
AAKVNTLLDVAQANLG

SEQ ID NO: 67621 - protein, 16 aa, Mycobacterium tuberculosis
AKVNTLLDVAQANLGE

SEQ ID NO: 67622 - protein, 16 aa, Mycobacterium tuberculosis
KVNTLLDVAQANLGEA

SEQ ID NO: 67623 - protein, 16 aa, Mycobacterium tuberculosis
VNTLLDVAQANLGEAA

SEQ ID NO: 67624 - protein, 16 aa, Mycobacterium tuberculosis
NTLLDVAQANLGEAAG

SEQ ID NO: 67625 - protein, 16 aa, Mycobacterium tuberculosis
TLLDVAQANLGEAAGT

SEQ ID NO: 67626 - protein, 16 aa, Mycobacterium tuberculosis
LLDVAQANLGEAAGTY

SEQ ID NO: 67627 - protein, 16 aa, Mycobacterium tuberculosis
LDVAQANLGEAAGTYV

SEQ ID NO: 67628 - protein, 16 aa, Mycobacterium tuberculosis
DVAQANLGEAAGTYVA

SEQ ID NO: 67629 - protein, 16 aa, Mycobacterium tuberculosis
VAQANLGEAAGTYVAA

SEQ ID NO: 67630 - protein, 16 aa, Mycobacterium tuberculosis
AQANLGEAAGTYVAAD

SEQ ID NO: 67631 - protein, 16 aa, Mycobacterium tuberculosis
QANLGEAAGTYVAADA

SEQ ID NO: 67632 - protein, 16 aa, Mycobacterium tuberculosis
ANLGEAAGTYVAADAA

SEQ ID NO: 67633 - protein, 16 aa, Mycobacterium tuberculosis
NLGEAAGTYVAADAAA

SEQ ID NO: 67634 - protein, 16 aa, Mycobacterium tuberculosis
LGEAAGTYVAADAAAA

SEQ ID NO: 67635 - protein, 16 aa, Mycobacterium tuberculosis
GEAAGTYVAADAAAAS

SEQ ID NO: 67636 - protein, 16 aa, Mycobacterium tuberculosis
EAAGTYVAADAAAAST

SEQ ID NO: 67637 - protein, 16 aa, Mycobacterium tuberculosis
AAGTYVAADAAAASTY

SEQ ID NO: 67638 - protein, 16 aa, Mycobacterium tuberculosis
AGTYVAADAAAASTYT

SEQ ID NO: 67639 - protein, 16 aa, Mycobacterium tuberculosis
GTYVAADAAAASTYTG

SEQ ID NO: 67640 - protein, 16 aa, Mycobacterium tuberculosis
TYVAADAAAASTYTGF

SEQ ID NO: 67641 - protein, 13 aa, Mycobacterium tuberculosis
MSQIMYNYPAMLG

SEQ ID NO: 67642 - protein, 13 aa, Mycobacterium tuberculosis
SQIMYNYPAMLGH

SEQ ID NO: 67643 - protein, 13 aa, Mycobacterium tuberculosis
QIMYNYPAMLGHA

SEQ ID NO: 67644 - protein, 13 aa, Mycobacterium tuberculosis
IMYNYPAMLGHAG

SEQ ID NO: 67645 - protein, 13 aa, Mycobacterium tuberculosis
MYNYPAMLGHAGD

SEQ ID NO: 67646 - protein, 13 aa, Mycobacterium tuberculosis
YNYPAMLGHAGDM

SEQ ID NO: 67647 - protein, 13 aa, Mycobacterium tuberculosis
NYPAMLGHAGDMA

SEQ ID NO: 67648 - protein, 13 aa, Mycobacterium tuberculosis
YPAMLGHAGDMAG

SEQ ID NO: 67649 - protein, 13 aa, Mycobacterium tuberculosis
PAMLGHAGDMAGY

SEQ ID NO: 67650 - protein, 13 aa, Mycobacterium tuberculosis
AMLGHAGDMAGYA

SEQ ID NO: 67651 - protein, 13 aa, Mycobacterium tuberculosis
MLGHAGDMAGYAG

SEQ ID NO: 67652 - protein, 13 aa, Mycobacterium tuberculosis
LGHAGDMAGYAGT

SEQ ID NO: 67653 - protein, 13 aa, Mycobacterium tuberculosis
GHAGDMAGYAGTL

SEQ ID NO: 67654 - protein, 13 aa, Mycobacterium tuberculosis
HAGDMAGYAGTLQ

SEQ ID NO: 67655 - protein, 13 aa, Mycobacterium tuberculosis
AGDMAGYAGTLQS

SEQ ID NO: 67656 - protein, 13 aa, Mycobacterium tuberculosis
GDMAGYAGTLQSL

SEQ ID NO: 67657 - protein, 13 aa, Mycobacterium tuberculosis
DMAGYAGTLQSLG

SEQ ID NO: 67658 - protein, 13 aa, Mycobacterium tuberculosis
MAGYAGTLQSLGA

SEQ ID NO: 67659 - protein, 13 aa, Mycobacterium tuberculosis
AGYAGTLQSLGAE

SEQ ID NO: 67660 - protein, 13 aa, Mycobacterium tuberculosis
GYAGTLQSLGAEI

SEQ ID NO: 67661 - protein, 13 aa, Mycobacterium tuberculosis
YAGTLQSLGAEIA

SEQ ID NO: 67662 - protein, 13 aa, Mycobacterium tuberculosis
AGTLQSLGAEIAV

SEQ ID NO: 67663 - protein, 13 aa, Mycobacterium tuberculosis
GTLQSLGAEIAVE

SEQ ID NO: 67664 - protein, 13 aa, Mycobacterium tuberculosis
TLQSLGAEIAVEQ

SEQ ID NO: 67665 - protein, 13 aa, Mycobacterium tuberculosis
LQSLGAEIAVEQA

SEQ ID NO: 67666 - protein, 13 aa, Mycobacterium tuberculosis
QSLGAEIAVEQAA

SEQ ID NO: 67667 - protein, 13 aa, Mycobacterium tuberculosis
SLGAEIAVEQAAL

SEQ ID NO: 67668 - protein, 13 aa, Mycobacterium tuberculosis
LGAEIAVEQAALQ

SEQ ID NO: 67669 - protein, 13 aa, Mycobacterium tuberculosis
GAEIAVEQAALQS

SEQ ID NO: 67670 - protein, 13 aa, Mycobacterium tuberculosis
AEIAVEQAALQSA

SEQ ID NO: 67671 - protein, 13 aa, Mycobacterium tuberculosis
EIAVEQAALQSAW

SEQ ID NO: 67672 - protein, 13 aa, Mycobacterium tuberculosis
IAVEQAALQSAWQ

SEQ ID NO: 67673 - protein, 13 aa, Mycobacterium tuberculosis
AVEQAALQSAWQG

SEQ ID NO: 67674 - protein, 13 aa, Mycobacterium tuberculosis
VEQAALQSAWQGD

SEQ ID NO: 67675 - protein, 13 aa, Mycobacterium tuberculosis
EQAALQSAWQGDT

SEQ ID NO: 67676 - protein, 13 aa, Mycobacterium tuberculosis
QAALQSAWQGDTG

SEQ ID NO: 67677 - protein, 13 aa, Mycobacterium tuberculosis
AALQSAWQGDTGI

SEQ ID NO: 67678 - protein, 13 aa, Mycobacterium tuberculosis
ALQSAWQGDTGIT

SEQ ID NO: 67679 - protein, 13 aa, Mycobacterium tuberculosis
LQSAWQGDTGITY

SEQ ID NO: 67680 - protein, 13 aa, Mycobacterium tuberculosis
QSAWQGDTGITYQ

SEQ ID NO: 67681 - protein, 13 aa, Mycobacterium tuberculosis
SAWQGDTGITYQA

SEQ ID NO: 67682 - protein, 13 aa, Mycobacterium tuberculosis
AWQGDTGITYQAW

SEQ ID NO: 67683 - protein, 13 aa, Mycobacterium tuberculosis
WQGDTGITYQAWQ

SEQ ID NO: 67684 - protein, 13 aa, Mycobacterium tuberculosis
QGDTGITYQAWQA

SEQ ID NO: 67685 - protein, 13 aa, Mycobacterium tuberculosis
GDTGITYQAWQAQ

SEQ ID NO: 67686 - protein, 13 aa, Mycobacterium tuberculosis
DTGITYQAWQAQW

SEQ ID NO: 67687 - protein, 13 aa, Mycobacterium tuberculosis
TGITYQAWQAQWN

SEQ ID NO: 67688 - protein, 13 aa, Mycobacterium tuberculosis
GITYQAWQAQWNQ

SEQ ID NO: 67689 - protein, 13 aa, Mycobacterium tuberculosis
ITYQAWQAQWNQA

SEQ ID NO: 67690 - protein, 13 aa, Mycobacterium tuberculosis
TYQAWQAQWNQAM

SEQ ID NO: 67691 - protein, 13 aa, Mycobacterium tuberculosis
YQAWQAQWNQAME

SEQ ID NO: 67692 - protein, 13 aa, Mycobacterium tuberculosis
QAWQAQWNQAMED

SEQ ID NO: 67693 - protein, 13 aa, Mycobacterium tuberculosis
AWQAQWNQAMEDL

SEQ ID NO: 67694 - protein, 13 aa, Mycobacterium tuberculosis
WQAQWNQAMEDLV

SEQ ID NO: 67695 - protein, 13 aa, Mycobacterium tuberculosis
QAQWNQAMEDLVR

SEQ ID NO: 67696 - protein, 13 aa, Mycobacterium tuberculosis
AQWNQAMEDLVRA

SEQ ID NO: 67697 - protein, 13 aa, Mycobacterium tuberculosis
QWNQAMEDLVRAY

SEQ ID NO: 67698 - protein, 13 aa, Mycobacterium tuberculosis
WNQAMEDLVRAYH

SEQ ID NO: 67699 - protein, 13 aa, Mycobacterium tuberculosis
NQAMEDLVRAYHA

SEQ ID NO: 67700 - protein, 13 aa, Mycobacterium tuberculosis
QAMEDLVRAYHAM

SEQ ID NO: 67701 - protein, 13 aa, Mycobacterium tuberculosis
AMEDLVRAYHAMS

SEQ ID NO: 67702 - protein, 13 aa, Mycobacterium tuberculosis
MEDLVRAYHAMSS

SEQ ID NO: 67703 - protein, 13 aa, Mycobacterium tuberculosis
EDLVRAYHAMSST

SEQ ID NO: 67704 - protein, 13 aa, Mycobacterium tuberculosis
DLVRAYHAMSSTH

SEQ ID NO: 67705 - protein, 13 aa, Mycobacterium tuberculosis
LVRAYHAMSSTHE

SEQ ID NO: 67706 - protein, 13 aa, Mycobacterium tuberculosis
VRAYHAMSSTHEA

SEQ ID NO: 67707 - protein, 13 aa, Mycobacterium tuberculosis
RAYHAMSSTHEAN

SEQ ID NO: 67708 - protein, 13 aa, Mycobacterium tuberculosis
AYHAMSSTHEANT

SEQ ID NO: 67709 - protein, 13 aa, Mycobacterium tuberculosis
YHAMSSTHEANTM

SEQ ID NO: 67710 - protein, 13 aa, Mycobacterium tuberculosis
HAMSSTHEANTMA

SEQ ID NO: 67711 - protein, 13 aa, Mycobacterium tuberculosis
AMSSTHEANTMAM

SEQ ID NO: 67712 - protein, 13 aa, Mycobacterium tuberculosis
MSSTHEANTMAMM

SEQ ID NO: 67713 - protein, 13 aa, Mycobacterium tuberculosis
SSTHEANTMAMMA

SEQ ID NO: 67714 - protein, 13 aa, Mycobacterium tuberculosis
STHEANTMAMMAR

SEQ ID NO: 67715 - protein, 13 aa, Mycobacterium tuberculosis
THEANTMAMMARD

SEQ ID NO: 67716 - protein, 13 aa, Mycobacterium tuberculosis
HEANTMAMMARDT

SEQ ID NO: 67717 - protein, 13 aa, Mycobacterium tuberculosis
EANTMAMMARDTA

SEQ ID NO: 67718 - protein, 13 aa, Mycobacterium tuberculosis
ANTMAMMARDTAE

SEQ ID NO: 67719 - protein, 13 aa, Mycobacterium tuberculosis
NTMAMMARDTAEA

SEQ ID NO: 67720 - protein, 13 aa, Mycobacterium tuberculosis
TMAMMARDTAEAA

SEQ ID NO: 67721 - protein, 13 aa, Mycobacterium tuberculosis
MAMMARDTAEAAK

SEQ ID NO: 67722 - protein, 13 aa, Mycobacterium tuberculosis
AMMARDTAEAAKW

SEQ ID NO: 67723 - protein, 13 aa, Mycobacterium tuberculosis
MMARDTAEAAKWG

SEQ ID NO: 67724 - protein, 13 aa, Mycobacterium tuberculosis
MARDTAEAAKWGG

SEQ ID NO: 67725 - protein, 14 aa, Mycobacterium tuberculosis
MSQIMYNYPAMLGH

SEQ ID NO: 67726 - protein, 14 aa, Mycobacterium tuberculosis
SQIMYNYPAMLGHA

SEQ ID NO: 67727 - protein, 14 aa, Mycobacterium tuberculosis
QIMYNYPAMLGHAG

SEQ ID NO: 67728 - protein, 14 aa, Mycobacterium tuberculosis
IMYNYPAMLGHAGD

SEQ ID NO: 67729 - protein, 14 aa, Mycobacterium tuberculosis
MYNYPAMLGHAGDM

SEQ ID NO: 67730 - protein, 14 aa, Mycobacterium tuberculosis
YNYPAMLGHAGDMA

SEQ ID NO: 67731 - protein, 14 aa, Mycobacterium tuberculosis
NYPAMLGHAGDMAG

SEQ ID NO: 67732 - protein, 14 aa, Mycobacterium tuberculosis
YPAMLGHAGDMAGY

SEQ ID NO: 67733 - protein, 14 aa, Mycobacterium tuberculosis
PAMLGHAGDMAGYA

SEQ ID NO: 67734 - protein, 14 aa, Mycobacterium tuberculosis
AMLGHAGDMAGYAG

SEQ ID NO: 67735 - protein, 14 aa, Mycobacterium tuberculosis
MLGHAGDMAGYAGT

SEQ ID NO: 67736 - protein, 14 aa, Mycobacterium tuberculosis
LGHAGDMAGYAGTL

SEQ ID NO: 67737 - protein, 14 aa, Mycobacterium tuberculosis
GHAGDMAGYAGTLQ

SEQ ID NO: 67738 - protein, 14 aa, Mycobacterium tuberculosis
HAGDMAGYAGTLQS

SEQ ID NO: 67739 - protein, 14 aa, Mycobacterium tuberculosis
AGDMAGYAGTLQSL

SEQ ID NO: 67740 - protein, 14 aa, Mycobacterium tuberculosis
GDMAGYAGTLQSLG

SEQ ID NO: 67741 - protein, 14 aa, Mycobacterium tuberculosis
DMAGYAGTLQSLGA

SEQ ID NO: 67742 - protein, 14 aa, Mycobacterium tuberculosis
MAGYAGTLQSLGAE

SEQ ID NO: 67743 - protein, 14 aa, Mycobacterium tuberculosis
AGYAGTLQSLGAEI

SEQ ID NO: 67744 - protein, 14 aa, Mycobacterium tuberculosis
GYAGTLQSLGAEIA

SEQ ID NO: 67745 - protein, 14 aa, Mycobacterium tuberculosis
YAGTLQSLGAEIAV

SEQ ID NO: 67746 - protein, 14 aa, Mycobacterium tuberculosis
AGTLQSLGAEIAVE

SEQ ID NO: 67747 - protein, 14 aa, Mycobacterium tuberculosis
GTLQSLGAEIAVEQ

SEQ ID NO: 67748 - protein, 14 aa, Mycobacterium tuberculosis
TLQSLGAEIAVEQA

SEQ ID NO: 67749 - protein, 14 aa, Mycobacterium tuberculosis
LQSLGAEIAVEQAA

SEQ ID NO: 67750 - protein, 14 aa, Mycobacterium tuberculosis
QSLGAEIAVEQAAL

SEQ ID NO: 67751 - protein, 14 aa, Mycobacterium tuberculosis
SLGAEIAVEQAALQ

SEQ ID NO: 67752 - protein, 14 aa, Mycobacterium tuberculosis
LGAEIAVEQAALQS

SEQ ID NO: 67753 - protein, 14 aa, Mycobacterium tuberculosis
GAEIAVEQAALQSA

SEQ ID NO: 67754 - protein, 14 aa, Mycobacterium tuberculosis
AEIAVEQAALQSAW

SEQ ID NO: 67755 - protein, 14 aa, Mycobacterium tuberculosis
EIAVEQAALQSAWQ

SEQ ID NO: 67756 - protein, 14 aa, Mycobacterium tuberculosis
IAVEQAALQSAWQG

SEQ ID NO: 67757 - protein, 14 aa, Mycobacterium tuberculosis
AVEQAALQSAWQGD

SEQ ID NO: 67758 - protein, 14 aa, Mycobacterium tuberculosis
VEQAALQSAWQGDT

SEQ ID NO: 67759 - protein, 14 aa, Mycobacterium tuberculosis
EQAALQSAWQGDTG

SEQ ID NO: 67760 - protein, 14 aa, Mycobacterium tuberculosis
QAALQSAWQGDTGI

SEQ ID NO: 67761 - protein, 14 aa, Mycobacterium tuberculosis
AALQSAWQGDTGIT

SEQ ID NO: 67762 - protein, 14 aa, Mycobacterium tuberculosis
ALQSAWQGDTGITY

SEQ ID NO: 67763 - protein, 14 aa, Mycobacterium tuberculosis
LQSAWQGDTGITYQ

SEQ ID NO: 67764 - protein, 14 aa, Mycobacterium tuberculosis
QSAWQGDTGITYQA

SEQ ID NO: 67765 - protein, 14 aa, Mycobacterium tuberculosis
SAWQGDTGITYQAW

SEQ ID NO: 67766 - protein, 14 aa, Mycobacterium tuberculosis
AWQGDTGITYQAWQ

SEQ ID NO: 67767 - protein, 14 aa, Mycobacterium tuberculosis
WQGDTGITYQAWQA

SEQ ID NO: 67768 - protein, 14 aa, Mycobacterium tuberculosis
QGDTGITYQAWQAQ

SEQ ID NO: 67769 - protein, 14 aa, Mycobacterium tuberculosis
GDTGITYQAWQAQW

SEQ ID NO: 67770 - protein, 14 aa, Mycobacterium tuberculosis
DTGITYQAWQAQWN

SEQ ID NO: 67771 - protein, 14 aa, Mycobacterium tuberculosis
TGITYQAWQAQWNQ

SEQ ID NO: 67772 - protein, 14 aa, Mycobacterium tuberculosis
GITYQAWQAQWNQA

SEQ ID NO: 67773 - protein, 14 aa, Mycobacterium tuberculosis
ITYQAWQAQWNQAM

SEQ ID NO: 67774 - protein, 14 aa, Mycobacterium tuberculosis
TYQAWQAQWNQAME

SEQ ID NO: 67775 - protein, 14 aa, Mycobacterium tuberculosis
YQAWQAQWNQAMED

SEQ ID NO: 67776 - protein, 14 aa, Mycobacterium tuberculosis
QAWQAQWNQAMEDL

SEQ ID NO: 67777 - protein, 14 aa, Mycobacterium tuberculosis
AWQAQWNQAMEDLV

SEQ ID NO: 67778 - protein, 14 aa, Mycobacterium tuberculosis
WQAQWNQAMEDLVR

SEQ ID NO: 67779 - protein, 14 aa, Mycobacterium tuberculosis
QAQWNQAMEDLVRA

SEQ ID NO: 67780 - protein, 14 aa, Mycobacterium tuberculosis
AQWNQAMEDLVRAY

SEQ ID NO: 67781 - protein, 14 aa, Mycobacterium tuberculosis
QWNQAMEDLVRAYH

SEQ ID NO: 67782 - protein, 14 aa, Mycobacterium tuberculosis
WNQAMEDLVRAYHA

SEQ ID NO: 67783 - protein, 14 aa, Mycobacterium tuberculosis
NQAMEDLVRAYHAM

SEQ ID NO: 67784 - protein, 14 aa, Mycobacterium tuberculosis
QAMEDLVRAYHAMS

SEQ ID NO: 67785 - protein, 14 aa, Mycobacterium tuberculosis
AMEDLVRAYHAMSS

SEQ ID NO: 67786 - protein, 14 aa, Mycobacterium tuberculosis
MEDLVRAYHAMSST

SEQ ID NO: 67787 - protein, 14 aa, Mycobacterium tuberculosis
EDLVRAYHAMSSTH

SEQ ID NO: 67788 - protein, 14 aa, Mycobacterium tuberculosis
DLVRAYHAMSSTHE

SEQ ID NO: 67789 - protein, 14 aa, Mycobacterium tuberculosis
LVRAYHAMSSTHEA

SEQ ID NO: 67790 - protein, 14 aa, Mycobacterium tuberculosis
VRAYHAMSSTHEAN

SEQ ID NO: 67791 - protein, 14 aa, Mycobacterium tuberculosis
RAYHAMSSTHEANT

SEQ ID NO: 67792 - protein, 14 aa, Mycobacterium tuberculosis
AYHAMSSTHEANTM

SEQ ID NO: 67793 - protein, 14 aa, Mycobacterium tuberculosis
YHAMSSTHEANTMA

SEQ ID NO: 67794 - protein, 14 aa, Mycobacterium tuberculosis
HAMSSTHEANTMAM

SEQ ID NO: 67795 - protein, 14 aa, Mycobacterium tuberculosis
AMSSTHEANTMAMM

SEQ ID NO: 67796 - protein, 14 aa, Mycobacterium tuberculosis
MSSTHEANTMAMMA

SEQ ID NO: 67797 - protein, 14 aa, Mycobacterium tuberculosis
SSTHEANTMAMMAR

SEQ ID NO: 67798 - protein, 14 aa, Mycobacterium tuberculosis
STHEANTMAMMARD

SEQ ID NO: 67799 - protein, 14 aa, Mycobacterium tuberculosis
THEANTMAMMARDT

SEQ ID NO: 67800 - protein, 14 aa, Mycobacterium tuberculosis
HEANTMAMMARDTA

SEQ ID NO: 67801 - protein, 14 aa, Mycobacterium tuberculosis
EANTMAMMARDTAE

SEQ ID NO: 67802 - protein, 14 aa, Mycobacterium tuberculosis
ANTMAMMARDTAEA

SEQ ID NO: 67803 - protein, 14 aa, Mycobacterium tuberculosis
NTMAMMARDTAEAA

SEQ ID NO: 67804 - protein, 14 aa, Mycobacterium tuberculosis
TMAMMARDTAEAAK

SEQ ID NO: 67805 - protein, 14 aa, Mycobacterium tuberculosis
MAMMARDTAEAAKW

SEQ ID NO: 67806 - protein, 14 aa, Mycobacterium tuberculosis
AMMARDTAEAAKWG

SEQ ID NO: 67807 - protein, 14 aa, Mycobacterium tuberculosis
MMARDTAEAAKWGG

SEQ ID NO: 67808 - protein, 15 aa, Mycobacterium tuberculosis
MSQIMYNYPAMLGHA

SEQ ID NO: 67809 - protein, 15 aa, Mycobacterium tuberculosis
SQIMYNYPAMLGHAG

SEQ ID NO: 67810 - protein, 15 aa, Mycobacterium tuberculosis
QIMYNYPAMLGHAGD

SEQ ID NO: 67811 - protein, 15 aa, Mycobacterium tuberculosis
IMYNYPAMLGHAGDM

SEQ ID NO: 67812 - protein, 15 aa, Mycobacterium tuberculosis
MYNYPAMLGHAGDMA

SEQ ID NO: 67813 - protein, 15 aa, Mycobacterium tuberculosis
YNYPAMLGHAGDMAG

SEQ ID NO: 67814 - protein, 15 aa, Mycobacterium tuberculosis
NYPAMLGHAGDMAGY

SEQ ID NO: 67815 - protein, 15 aa, Mycobacterium tuberculosis
YPAMLGHAGDMAGYA

SEQ ID NO: 67816 - protein, 15 aa, Mycobacterium tuberculosis
PAMLGHAGDMAGYAG

SEQ ID NO: 67817 - protein, 15 aa, Mycobacterium tuberculosis
AMLGHAGDMAGYAGT

SEQ ID NO: 67818 - protein, 15 aa, Mycobacterium tuberculosis
MLGHAGDMAGYAGTL

SEQ ID NO: 67819 - protein, 15 aa, Mycobacterium tuberculosis
LGHAGDMAGYAGTLQ

SEQ ID NO: 67820 - protein, 15 aa, Mycobacterium tuberculosis
GHAGDMAGYAGTLQS

SEQ ID NO: 67821 - protein, 15 aa, Mycobacterium tuberculosis
HAGDMAGYAGTLQSL

SEQ ID NO: 67822 - protein, 15 aa, Mycobacterium tuberculosis
AGDMAGYAGTLQSLG

SEQ ID NO: 67823 - protein, 15 aa, Mycobacterium tuberculosis
GDMAGYAGTLQSLGA

SEQ ID NO: 67824 - protein, 15 aa, Mycobacterium tuberculosis
DMAGYAGTLQSLGAE

SEQ ID NO: 67825 - protein, 15 aa, Mycobacterium tuberculosis
MAGYAGTLQSLGAEI

SEQ ID NO: 67826 - protein, 15 aa, Mycobacterium tuberculosis
AGYAGTLQSLGAEIA

SEQ ID NO: 67827 - protein, 15 aa, Mycobacterium tuberculosis
GYAGTLQSLGAEIAV

SEQ ID NO: 67828 - protein, 15 aa, Mycobacterium tuberculosis
YAGTLQSLGAEIAVE

SEQ ID NO: 67829 - protein, 15 aa, Mycobacterium tuberculosis
AGTLQSLGAEIAVEQ

SEQ ID NO: 67830 - protein, 15 aa, Mycobacterium tuberculosis
GTLQSLGAEIAVEQA

SEQ ID NO: 67831 - protein, 15 aa, Mycobacterium tuberculosis
TLQSLGAEIAVEQAA

SEQ ID NO: 67832 - protein, 15 aa, Mycobacterium tuberculosis
LQSLGAEIAVEQAAL

SEQ ID NO: 67833 - protein, 15 aa, Mycobacterium tuberculosis
QSLGAEIAVEQAALQ

SEQ ID NO: 67834 - protein, 15 aa, Mycobacterium tuberculosis
SLGAEIAVEQAALQS

SEQ ID NO: 67835 - protein, 15 aa, Mycobacterium tuberculosis
LGAEIAVEQAALQSA

SEQ ID NO: 67836 - protein, 15 aa, Mycobacterium tuberculosis
GAEIAVEQAALQSAW

SEQ ID NO: 67837 - protein, 15 aa, Mycobacterium tuberculosis
AEIAVEQAALQSAWQ

SEQ ID NO: 67838 - protein, 15 aa, Mycobacterium tuberculosis
EIAVEQAALQSAWQG

SEQ ID NO: 67839 - protein, 15 aa, Mycobacterium tuberculosis
IAVEQAALQSAWQGD

SEQ ID NO: 67840 - protein, 15 aa, Mycobacterium tuberculosis
AVEQAALQSAWQGDT

SEQ ID NO: 67841 - protein, 15 aa, Mycobacterium tuberculosis
VEQAALQSAWQGDTG

SEQ ID NO: 67842 - protein, 15 aa, Mycobacterium tuberculosis
EQAALQSAWQGDTGI

SEQ ID NO: 67843 - protein, 15 aa, Mycobacterium tuberculosis
QAALQSAWQGDTGIT

SEQ ID NO: 67844 - protein, 15 aa, Mycobacterium tuberculosis
AALQSAWQGDTGITY

SEQ ID NO: 67845 - protein, 15 aa, Mycobacterium tuberculosis
ALQSAWQGDTGITYQ

SEQ ID NO: 67846 - protein, 15 aa, Mycobacterium tuberculosis
LQSAWQGDTGITYQA

SEQ ID NO: 67847 - protein, 15 aa, Mycobacterium tuberculosis
QSAWQGDTGITYQAW

SEQ ID NO: 67848 - protein, 15 aa, Mycobacterium tuberculosis
SAWQGDTGITYQAWQ

SEQ ID NO: 67849 - protein, 15 aa, Mycobacterium tuberculosis
AWQGDTGITYQAWQA

SEQ ID NO: 67850 - protein, 15 aa, Mycobacterium tuberculosis
WQGDTGITYQAWQAQ

SEQ ID NO: 67851 - protein, 15 aa, Mycobacterium tuberculosis
QGDTGITYQAWQAQW

SEQ ID NO: 67852 - protein, 15 aa, Mycobacterium tuberculosis
GDTGITYQAWQAQWN

SEQ ID NO: 67853 - protein, 15 aa, Mycobacterium tuberculosis
DTGITYQAWQAQWNQ

SEQ ID NO: 67854 - protein, 15 aa, Mycobacterium tuberculosis
TGITYQAWQAQWNQA

SEQ ID NO: 67855 - protein, 15 aa, Mycobacterium tuberculosis
GITYQAWQAQWNQAM

SEQ ID NO: 67856 - protein, 15 aa, Mycobacterium tuberculosis
ITYQAWQAQWNQAME

SEQ ID NO: 67857 - protein, 15 aa, Mycobacterium tuberculosis
TYQAWQAQWNQAMED

SEQ ID NO: 67858 - protein, 15 aa, Mycobacterium tuberculosis
YQAWQAQWNQAMEDL

SEQ ID NO: 67859 - protein, 15 aa, Mycobacterium tuberculosis
QAWQAQWNQAMEDLV

SEQ ID NO: 67860 - protein, 15 aa, Mycobacterium tuberculosis
AWQAQWNQAMEDLVR

SEQ ID NO: 67861 - protein, 15 aa, Mycobacterium tuberculosis
WQAQWNQAMEDLVRA

SEQ ID NO: 67862 - protein, 15 aa, Mycobacterium tuberculosis
QAQWNQAMEDLVRAY

SEQ ID NO: 67863 - protein, 15 aa, Mycobacterium tuberculosis
AQWNQAMEDLVRAYH

SEQ ID NO: 67864 - protein, 15 aa, Mycobacterium tuberculosis
QWNQAMEDLVRAYHA

SEQ ID NO: 67865 - protein, 15 aa, Mycobacterium tuberculosis
WNQAMEDLVRAYHAM

SEQ ID NO: 67866 - protein, 15 aa, Mycobacterium tuberculosis
NQAMEDLVRAYHAMS

SEQ ID NO: 67867 - protein, 15 aa, Mycobacterium tuberculosis
QAMEDLVRAYHAMSS

SEQ ID NO: 67868 - protein, 15 aa, Mycobacterium tuberculosis
AMEDLVRAYHAMSST

SEQ ID NO: 67869 - protein, 15 aa, Mycobacterium tuberculosis
MEDLVRAYHAMSSTH

SEQ ID NO: 67870 - protein, 15 aa, Mycobacterium tuberculosis
EDLVRAYHAMSSTHE

SEQ ID NO: 67871 - protein, 15 aa, Mycobacterium tuberculosis
DLVRAYHAMSSTHEA

SEQ ID NO: 67872 - protein, 15 aa, Mycobacterium tuberculosis
LVRAYHAMSSTHEAN

SEQ ID NO: 67873 - protein, 15 aa, Mycobacterium tuberculosis
VRAYHAMSSTHEANT

SEQ ID NO: 67874 - protein, 15 aa, Mycobacterium tuberculosis
RAYHAMSSTHEANTM

SEQ ID NO: 67875 - protein, 15 aa, Mycobacterium tuberculosis
AYHAMSSTHEANTMA

SEQ ID NO: 67876 - protein, 15 aa, Mycobacterium tuberculosis
YHAMSSTHEANTMAM

SEQ ID NO: 67877 - protein, 15 aa, Mycobacterium tuberculosis
HAMSSTHEANTMAMM

SEQ ID NO: 67878 - protein, 15 aa, Mycobacterium tuberculosis
AMSSTHEANTMAMMA

SEQ ID NO: 67879 - protein, 15 aa, Mycobacterium tuberculosis
MSSTHEANTMAMMAR

SEQ ID NO: 67880 - protein, 15 aa, Mycobacterium tuberculosis
SSTHEANTMAMMARD

SEQ ID NO: 67881 - protein, 15 aa, Mycobacterium tuberculosis
STHEANTMAMMARDT

SEQ ID NO: 67882 - protein, 15 aa, Mycobacterium tuberculosis
THEANTMAMMARDTA

SEQ ID NO: 67883 - protein, 15 aa, Mycobacterium tuberculosis
HEANTMAMMARDTAE

SEQ ID NO: 67884 - protein, 15 aa, Mycobacterium tuberculosis
EANTMAMMARDTAEA

SEQ ID NO: 67885 - protein, 15 aa, Mycobacterium tuberculosis
ANTMAMMARDTAEAA

SEQ ID NO: 67886 - protein, 15 aa, Mycobacterium tuberculosis
NTMAMMARDTAEAAK

SEQ ID NO: 67887 - protein, 15 aa, Mycobacterium tuberculosis
TMAMMARDTAEAAKW

SEQ ID NO: 67888 - protein, 15 aa, Mycobacterium tuberculosis
MAMMARDTAEAAKWG

SEQ ID NO: 67889 - protein, 15 aa, Mycobacterium tuberculosis
AMMARDTAEAAKWGG

SEQ ID NO: 67890 - protein, 16 aa, Mycobacterium tuberculosis
MSQIMYNYPAMLGHAG

SEQ ID NO: 67891 - protein, 16 aa, Mycobacterium tuberculosis
SQIMYNYPAMLGHAGD

SEQ ID NO: 67892 - protein, 16 aa, Mycobacterium tuberculosis
QIMYNYPAMLGHAGDM

SEQ ID NO: 67893 - protein, 16 aa, Mycobacterium tuberculosis
IMYNYPAMLGHAGDMA

SEQ ID NO: 67894 - protein, 16 aa, Mycobacterium tuberculosis
MYNYPAMLGHAGDMAG

SEQ ID NO: 67895 - protein, 16 aa, Mycobacterium tuberculosis
YNYPAMLGHAGDMAGY

SEQ ID NO: 67896 - protein, 16 aa, Mycobacterium tuberculosis
NYPAMLGHAGDMAGYA

SEQ ID NO: 67897 - protein, 16 aa, Mycobacterium tuberculosis
YPAMLGHAGDMAGYAG

SEQ ID NO: 67898 - protein, 16 aa, Mycobacterium tuberculosis
PAMLGHAGDMAGYAGT

SEQ ID NO: 67899 - protein, 16 aa, Mycobacterium tuberculosis
AMLGHAGDMAGYAGTL

SEQ ID NO: 67900 - protein, 16 aa, Mycobacterium tuberculosis
MLGHAGDMAGYAGTLQ

SEQ ID NO: 67901 - protein, 16 aa, Mycobacterium tuberculosis
LGHAGDMAGYAGTLQS

SEQ ID NO: 67902 - protein, 16 aa, Mycobacterium tuberculosis
GHAGDMAGYAGTLQSL

SEQ ID NO: 67903 - protein, 16 aa, Mycobacterium tuberculosis
HAGDMAGYAGTLQSLG

SEQ ID NO: 67904 - protein, 16 aa, Mycobacterium tuberculosis
AGDMAGYAGTLQSLGA

SEQ ID NO: 67905 - protein, 16 aa, Mycobacterium tuberculosis
GDMAGYAGTLQSLGAE

SEQ ID NO: 67906 - protein, 16 aa, Mycobacterium tuberculosis
DMAGYAGTLQSLGAEI

SEQ ID NO: 67907 - protein, 16 aa, Mycobacterium tuberculosis
MAGYAGTLQSLGAEIA

SEQ ID NO: 67908 - protein, 16 aa, Mycobacterium tuberculosis
AGYAGTLQSLGAEIAV

SEQ ID NO: 67909 - protein, 16 aa, Mycobacterium tuberculosis
GYAGTLQSLGAEIAVE

SEQ ID NO: 67910 - protein, 16 aa, Mycobacterium tuberculosis
YAGTLQSLGAEIAVEQ

SEQ ID NO: 67911 - protein, 16 aa, Mycobacterium tuberculosis
AGTLQSLGAEIAVEQA

SEQ ID NO: 67912 - protein, 16 aa, Mycobacterium tuberculosis
GTLQSLGAEIAVEQAA

SEQ ID NO: 67913 - protein, 16 aa, Mycobacterium tuberculosis
TLQSLGAEIAVEQAAL

SEQ ID NO: 67914 - protein, 16 aa, Mycobacterium tuberculosis
LQSLGAEIAVEQAALQ

SEQ ID NO: 67915 - protein, 16 aa, Mycobacterium tuberculosis
QSLGAEIAVEQAALQS

SEQ ID NO: 67916 - protein, 16 aa, Mycobacterium tuberculosis
SLGAEIAVEQAALQSA

SEQ ID NO: 67917 - protein, 16 aa, Mycobacterium tuberculosis
LGAEIAVEQAALQSAW

SEQ ID NO: 67918 - protein, 16 aa, Mycobacterium tuberculosis
GAEIAVEQAALQSAWQ

SEQ ID NO: 67919 - protein, 16 aa, Mycobacterium tuberculosis
AEIAVEQAALQSAWQG

SEQ ID NO: 67920 - protein, 16 aa, Mycobacterium tuberculosis
EIAVEQAALQSAWQGD

SEQ ID NO: 67921 - protein, 16 aa, Mycobacterium tuberculosis
IAVEQAALQSAWQGDT

SEQ ID NO: 67922 - protein, 16 aa, Mycobacterium tuberculosis
AVEQAALQSAWQGDTG

SEQ ID NO: 67923 - protein, 16 aa, Mycobacterium tuberculosis
VEQAALQSAWQGDTGI

SEQ ID NO: 67924 - protein, 16 aa, Mycobacterium tuberculosis
EQAALQSAWQGDTGIT

SEQ ID NO: 67925 - protein, 16 aa, Mycobacterium tuberculosis
QAALQSAWQGDTGITY

SEQ ID NO: 67926 - protein, 16 aa, Mycobacterium tuberculosis
AALQSAWQGDTGITYQ

SEQ ID NO: 67927 - protein, 16 aa, Mycobacterium tuberculosis
ALQSAWQGDTGITYQA

SEQ ID NO: 67928 - protein, 16 aa, Mycobacterium tuberculosis
LQSAWQGDTGITYQAW

SEQ ID NO: 67929 - protein, 16 aa, Mycobacterium tuberculosis
QSAWQGDTGITYQAWQ

SEQ ID NO: 67930 - protein, 16 aa, Mycobacterium tuberculosis
SAWQGDTGITYQAWQA

SEQ ID NO: 67931 - protein, 16 aa, Mycobacterium tuberculosis
AWQGDTGITYQAWQAQ

SEQ ID NO: 67932 - protein, 16 aa, Mycobacterium tuberculosis
WQGDTGITYQAWQAQW

SEQ ID NO: 67933 - protein, 16 aa, Mycobacterium tuberculosis
QGDTGITYQAWQAQWN

SEQ ID NO: 67934 - protein, 16 aa, Mycobacterium tuberculosis
GDTGITYQAWQAQWNQ

SEQ ID NO: 67935 - protein, 16 aa, Mycobacterium tuberculosis
DTGITYQAWQAQWNQA

SEQ ID NO: 67936 - protein, 16 aa, Mycobacterium tuberculosis
TGITYQAWQAQWNQAM

SEQ ID NO: 67937 - protein, 16 aa, Mycobacterium tuberculosis
GITYQAWQAQWNQAME

SEQ ID NO: 67938 - protein, 16 aa, Mycobacterium tuberculosis
ITYQAWQAQWNQAMED

SEQ ID NO: 67939 - protein, 16 aa, Mycobacterium tuberculosis
TYQAWQAQWNQAMEDL

SEQ ID NO: 67940 - protein, 16 aa, Mycobacterium tuberculosis
YQAWQAQWNQAMEDLV

SEQ ID NO: 67941 - protein, 16 aa, Mycobacterium tuberculosis
QAWQAQWNQAMEDLVR

SEQ ID NO: 67942 - protein, 16 aa, Mycobacterium tuberculosis
AWQAQWNQAMEDLVRA

SEQ ID NO: 67943 - protein, 16 aa, Mycobacterium tuberculosis
WQAQWNQAMEDLVRAY

SEQ ID NO: 67944 - protein, 16 aa, Mycobacterium tuberculosis
QAQWNQAMEDLVRAYH

SEQ ID NO: 67945 - protein, 16 aa, Mycobacterium tuberculosis
AQWNQAMEDLVRAYHA

SEQ ID NO: 67946 - protein, 16 aa, Mycobacterium tuberculosis
QWNQAMEDLVRAYHAM

SEQ ID NO: 67947 - protein, 16 aa, Mycobacterium tuberculosis
WNQAMEDLVRAYHAMS

SEQ ID NO: 67948 - protein, 16 aa, Mycobacterium tuberculosis
NQAMEDLVRAYHAMSS

SEQ ID NO: 67949 - protein, 16 aa, Mycobacterium tuberculosis
QAMEDLVRAYHAMSST

SEQ ID NO: 67950 - protein, 16 aa, Mycobacterium tuberculosis
AMEDLVRAYHAMSSTH

SEQ ID NO: 67951 - protein, 16 aa, Mycobacterium tuberculosis
MEDLVRAYHAMSSTHE

SEQ ID NO: 67952 - protein, 16 aa, Mycobacterium tuberculosis
EDLVRAYHAMSSTHEA

SEQ ID NO: 67953 - protein, 16 aa, Mycobacterium tuberculosis
DLVRAYHAMSSTHEAN

SEQ ID NO: 67954 - protein, 16 aa, Mycobacterium tuberculosis
LVRAYHAMSSTHEANT

SEQ ID NO: 67955 - protein, 16 aa, Mycobacterium tuberculosis
VRAYHAMSSTHEANTM

SEQ ID NO: 67956 - protein, 16 aa, Mycobacterium tuberculosis
RAYHAMSSTHEANTMA

SEQ ID NO: 67957 - protein, 16 aa, Mycobacterium tuberculosis
AYHAMSSTHEANTMAM

SEQ ID NO: 67958 - protein, 16 aa, Mycobacterium tuberculosis
YHAMSSTHEANTMAMM

SEQ ID NO: 67959 - protein, 16 aa, Mycobacterium tuberculosis
HAMSSTHEANTMAMMA

SEQ ID NO: 67960 - protein, 16 aa, Mycobacterium tuberculosis
AMSSTHEANTMAMMAR

SEQ ID NO: 67961 - protein, 16 aa, Mycobacterium tuberculosis
MSSTHEANTMAMMARD

SEQ ID NO: 67962 - protein, 16 aa, Mycobacterium tuberculosis
SSTHEANTMAMMARDT

SEQ ID NO: 67963 - protein, 16 aa, Mycobacterium tuberculosis
STHEANTMAMMARDTA

SEQ ID NO: 67964 - protein, 16 aa, Mycobacterium tuberculosis
THEANTMAMMARDTAE

SEQ ID NO: 67965 - protein, 16 aa, Mycobacterium tuberculosis
HEANTMAMMARDTAEA

SEQ ID NO: 67966 - protein, 16 aa, Mycobacterium tuberculosis
EANTMAMMARDTAEAA

SEQ ID NO: 67967 - protein, 16 aa, Mycobacterium tuberculosis
ANTMAMMARDTAEAAK

SEQ ID NO: 67968 - protein, 16 aa, Mycobacterium tuberculosis
NTMAMMARDTAEAAKW

SEQ ID NO: 67969 - protein, 16 aa, Mycobacterium tuberculosis
TMAMMARDTAEAAKWG

SEQ ID NO: 67970 - protein, 16 aa, Mycobacterium tuberculosis
MAMMARDTAEAAKWGG

SEQ ID NO: 67971 - protein, 13 aa, Mycobacterium tuberculosis
MSRLSSILRAGAA

SEQ ID NO: 67972 - protein, 13 aa, Mycobacterium tuberculosis
SRLSSILRAGAAF

SEQ ID NO: 67973 - protein, 13 aa, Mycobacterium tuberculosis
RLSSILRAGAAFL

SEQ ID NO: 67974 - protein, 13 aa, Mycobacterium tuberculosis
LSSILRAGAAFLV

SEQ ID NO: 67975 - protein, 13 aa, Mycobacterium tuberculosis
SSILRAGAAFLVL

SEQ ID NO: 67976 - protein, 13 aa, Mycobacterium tuberculosis
SILRAGAAFLVLG

SEQ ID NO: 67977 - protein, 13 aa, Mycobacterium tuberculosis
ILRAGAAFLVLGI

SEQ ID NO: 67978 - protein, 13 aa, Mycobacterium tuberculosis
LRAGAAFLVLGIA

SEQ ID NO: 67979 - protein, 13 aa, Mycobacterium tuberculosis
RAGAAFLVLGIAA

SEQ ID NO: 67980 - protein, 13 aa, Mycobacterium tuberculosis
AGAAFLVLGIAAA

SEQ ID NO: 67981 - protein, 13 aa, Mycobacterium tuberculosis
GAAFLVLGIAAAT

SEQ ID NO: 67982 - protein, 13 aa, Mycobacterium tuberculosis
AAFLVLGIAAATF

SEQ ID NO: 67983 - protein, 13 aa, Mycobacterium tuberculosis
AFLVLGIAAATFP

SEQ ID NO: 67984 - protein, 13 aa, Mycobacterium tuberculosis
FLVLGIAAATFPQ

SEQ ID NO: 67985 - protein, 13 aa, Mycobacterium tuberculosis
LVLGIAAATFPQS

SEQ ID NO: 67986 - protein, 13 aa, Mycobacterium tuberculosis
VLGIAAATFPQSA

SEQ ID NO: 67987 - protein, 13 aa, Mycobacterium tuberculosis
LGIAAATFPQSAA

SEQ ID NO: 67988 - protein, 13 aa, Mycobacterium tuberculosis
GIAAATFPQSAAA

SEQ ID NO: 67989 - protein, 13 aa, Mycobacterium tuberculosis
IAAATFPQSAAAD

SEQ ID NO: 67990 - protein, 13 aa, Mycobacterium tuberculosis
AAATFPQSAAADS

SEQ ID NO: 67991 - protein, 13 aa, Mycobacterium tuberculosis
AATFPQSAAADST

SEQ ID NO: 67992 - protein, 13 aa, Mycobacterium tuberculosis
ATFPQSAAADSTE

SEQ ID NO: 67993 - protein, 13 aa, Mycobacterium tuberculosis
TFPQSAAADSTED

SEQ ID NO: 67994 - protein, 13 aa, Mycobacterium tuberculosis
FPQSAAADSTEDF

SEQ ID NO: 67995 - protein, 13 aa, Mycobacterium tuberculosis
PQSAAADSTEDFP

SEQ ID NO: 67996 - protein, 13 aa, Mycobacterium tuberculosis
QSAAADSTEDFPI

SEQ ID NO: 67997 - protein, 13 aa, Mycobacterium tuberculosis
SAAADSTEDFPIP

SEQ ID NO: 67998 - protein, 13 aa, Mycobacterium tuberculosis
AAADSTEDFPIPR

SEQ ID NO: 67999 - protein, 13 aa, Mycobacterium tuberculosis
AADSTEDFPIPRR

SEQ ID NO: 68000 - protein, 13 aa, Mycobacterium tuberculosis
ADSTEDFPIPRRM

SEQ ID NO: 68001 - protein, 13 aa, Mycobacterium tuberculosis
DSTEDFPIPRRMI

SEQ ID NO: 68002 - protein, 13 aa, Mycobacterium tuberculosis
STEDFPIPRRMIA

SEQ ID NO: 68003 - protein, 13 aa, Mycobacterium tuberculosis
TEDFPIPRRMIAT

SEQ ID NO: 68004 - protein, 13 aa, Mycobacterium tuberculosis
EDFPIPRRMIATT

SEQ ID NO: 68005 - protein, 13 aa, Mycobacterium tuberculosis
DFPIPRRMIATTC

SEQ ID NO: 68006 - protein, 13 aa, Mycobacterium tuberculosis
FPIPRRMIATTCD

SEQ ID NO: 68007 - protein, 13 aa, Mycobacterium tuberculosis
PIPRRMIATTCDA

SEQ ID NO: 68008 - protein, 13 aa, Mycobacterium tuberculosis
IPRRMIATTCDAE

SEQ ID NO: 68009 - protein, 13 aa, Mycobacterium tuberculosis
PRRMIATTCDAEQ

SEQ ID NO: 68010 - protein, 13 aa, Mycobacterium tuberculosis
RRMIATTCDAEQY

SEQ ID NO: 68011 - protein, 13 aa, Mycobacterium tuberculosis
RMIATTCDAEQYL

SEQ ID NO: 68012 - protein, 13 aa, Mycobacterium tuberculosis
MIATTCDAEQYLA

SEQ ID NO: 68013 - protein, 13 aa, Mycobacterium tuberculosis
IATTCDAEQYLAA

SEQ ID NO: 68014 - protein, 13 aa, Mycobacterium tuberculosis
ATTCDAEQYLAAV

SEQ ID NO: 68015 - protein, 13 aa, Mycobacterium tuberculosis
TTCDAEQYLAAVR

SEQ ID NO: 68016 - protein, 13 aa, Mycobacterium tuberculosis
TCDAEQYLAAVRD

SEQ ID NO: 68017 - protein, 13 aa, Mycobacterium tuberculosis
CDAEQYLAAVRDT

SEQ ID NO: 68018 - protein, 13 aa, Mycobacterium tuberculosis
DAEQYLAAVRDTS

SEQ ID NO: 68019 - protein, 13 aa, Mycobacterium tuberculosis
AEQYLAAVRDTSP

SEQ ID NO: 68020 - protein, 13 aa, Mycobacterium tuberculosis
EQYLAAVRDTSPV

SEQ ID NO: 68021 - protein, 13 aa, Mycobacterium tuberculosis
QYLAAVRDTSPVY

SEQ ID NO: 68022 - protein, 13 aa, Mycobacterium tuberculosis
YLAAVRDTSPVYY

SEQ ID NO: 68023 - protein, 13 aa, Mycobacterium tuberculosis
LAAVRDTSPVYYQ

SEQ ID NO: 68024 - protein, 13 aa, Mycobacterium tuberculosis
AAVRDTSPVYYQR

SEQ ID NO: 68025 - protein, 13 aa, Mycobacterium tuberculosis
AVRDTSPVYYQRY

SEQ ID NO: 68026 - protein, 13 aa, Mycobacterium tuberculosis
VRDTSPVYYQRYM

SEQ ID NO: 68027 - protein, 13 aa, Mycobacterium tuberculosis
RDTSPVYYQRYMI

SEQ ID NO: 68028 - protein, 13 aa, Mycobacterium tuberculosis
DTSPVYYQRYMID

SEQ ID NO: 68029 - protein, 13 aa, Mycobacterium tuberculosis
TSPVYYQRYMIDF

SEQ ID NO: 68030 - protein, 13 aa, Mycobacterium tuberculosis
SPVYYQRYMIDFN

SEQ ID NO: 68031 - protein, 13 aa, Mycobacterium tuberculosis
PVYYQRYMIDFNN

SEQ ID NO: 68032 - protein, 13 aa, Mycobacterium tuberculosis
VYYQRYMIDFNNH

SEQ ID NO: 68033 - protein, 13 aa, Mycobacterium tuberculosis
YYQRYMIDFNNHA

SEQ ID NO: 68034 - protein, 13 aa, Mycobacterium tuberculosis
YQRYMIDFNNHAN

SEQ ID NO: 68035 - protein, 13 aa, Mycobacterium tuberculosis
QRYMIDFNNHANL

SEQ ID NO: 68036 - protein, 13 aa, Mycobacterium tuberculosis
RYMIDFNNHANLQ

SEQ ID NO: 68037 - protein, 13 aa, Mycobacterium tuberculosis
YMIDFNNHANLQQ

SEQ ID NO: 68038 - protein, 13 aa, Mycobacterium tuberculosis
MIDFNNHANLQQA

SEQ ID NO: 68039 - protein, 13 aa, Mycobacterium tuberculosis
IDFNNHANLQQAT

SEQ ID NO: 68040 - protein, 13 aa, Mycobacterium tuberculosis
DFNNHANLQQATI

SEQ ID NO: 68041 - protein, 13 aa, Mycobacterium tuberculosis
FNNHANLQQATIN

SEQ ID NO: 68042 - protein, 13 aa, Mycobacterium tuberculosis
NNHANLQQATINK

SEQ ID NO: 68043 - protein, 13 aa, Mycobacterium tuberculosis
NHANLQQATINKA

SEQ ID NO: 68044 - protein, 13 aa, Mycobacterium tuberculosis
HANLQQATINKAH

SEQ ID NO: 68045 - protein, 13 aa, Mycobacterium tuberculosis
ANLQQATINKAHW

SEQ ID NO: 68046 - protein, 13 aa, Mycobacterium tuberculosis
NLQQATINKAHWF

SEQ ID NO: 68047 - protein, 13 aa, Mycobacterium tuberculosis
LQQATINKAHWFF

SEQ ID NO: 68048 - protein, 13 aa, Mycobacterium tuberculosis
QQATINKAHWFFS

SEQ ID NO: 68049 - protein, 13 aa, Mycobacterium tuberculosis
QATINKAHWFFSL

SEQ ID NO: 68050 - protein, 13 aa, Mycobacterium tuberculosis
ATINKAHWFFSLS

SEQ ID NO: 68051 - protein, 13 aa, Mycobacterium tuberculosis
TINKAHWFFSLSP

SEQ ID NO: 68052 - protein, 13 aa, Mycobacterium tuberculosis
INKAHWFFSLSPA

SEQ ID NO: 68053 - protein, 13 aa, Mycobacterium tuberculosis
NKAHWFFSLSPAE

SEQ ID NO: 68054 - protein, 13 aa, Mycobacterium tuberculosis
KAHWFFSLSPAER

SEQ ID NO: 68055 - protein, 13 aa, Mycobacterium tuberculosis
AHWFFSLSPAERR

SEQ ID NO: 68056 - protein, 13 aa, Mycobacterium tuberculosis
HWFFSLSPAERRD

SEQ ID NO: 68057 - protein, 13 aa, Mycobacterium tuberculosis
WFFSLSPAERRDY

SEQ ID NO: 68058 - protein, 13 aa, Mycobacterium tuberculosis
FFSLSPAERRDYS

SEQ ID NO: 68059 - protein, 13 aa, Mycobacterium tuberculosis
FSLSPAERRDYSE

SEQ ID NO: 68060 - protein, 13 aa, Mycobacterium tuberculosis
SLSPAERRDYSEH

SEQ ID NO: 68061 - protein, 13 aa, Mycobacterium tuberculosis
LSPAERRDYSEHF

SEQ ID NO: 68062 - protein, 13 aa, Mycobacterium tuberculosis
SPAERRDYSEHFY

SEQ ID NO: 68063 - protein, 13 aa, Mycobacterium tuberculosis
PAERRDYSEHFYN

SEQ ID NO: 68064 - protein, 13 aa, Mycobacterium tuberculosis
AERRDYSEHFYNG

SEQ ID NO: 68065 - protein, 13 aa, Mycobacterium tuberculosis
ERRDYSEHFYNGD

SEQ ID NO: 68066 - protein, 13 aa, Mycobacterium tuberculosis
RRDYSEHFYNGDP

SEQ ID NO: 68067 - protein, 13 aa, Mycobacterium tuberculosis
RDYSEHFYNGDPL

SEQ ID NO: 68068 - protein, 13 aa, Mycobacterium tuberculosis
DYSEHFYNGDPLT

SEQ ID NO: 68069 - protein, 13 aa, Mycobacterium tuberculosis
YSEHFYNGDPLTF

SEQ ID NO: 68070 - protein, 13 aa, Mycobacterium tuberculosis
SEHFYNGDPLTFA

SEQ ID NO: 68071 - protein, 13 aa, Mycobacterium tuberculosis
EHFYNGDPLTFAW

SEQ ID NO: 68072 - protein, 13 aa, Mycobacterium tuberculosis
HFYNGDPLTFAWV

SEQ ID NO: 68073 - protein, 13 aa, Mycobacterium tuberculosis
FYNGDPLTFAWVN

SEQ ID NO: 68074 - protein, 13 aa, Mycobacterium tuberculosis
YNGDPLTFAWVNH

SEQ ID NO: 68075 - protein, 13 aa, Mycobacterium tuberculosis
NGDPLTFAWVNHM

SEQ ID NO: 68076 - protein, 13 aa, Mycobacterium tuberculosis
GDPLTFAWVNHMK

SEQ ID NO: 68077 - protein, 13 aa, Mycobacterium tuberculosis
DPLTFAWVNHMKI

SEQ ID NO: 68078 - protein, 13 aa, Mycobacterium tuberculosis
PLTFAWVNHMKIF

SEQ ID NO: 68079 - protein, 13 aa, Mycobacterium tuberculosis
LTFAWVNHMKIFF

SEQ ID NO: 68080 - protein, 13 aa, Mycobacterium tuberculosis
TFAWVNHMKIFFN

SEQ ID NO: 68081 - protein, 13 aa, Mycobacterium tuberculosis
FAWVNHMKIFFNN

SEQ ID NO: 68082 - protein, 13 aa, Mycobacterium tuberculosis
AWVNHMKIFFNNK

SEQ ID NO: 68083 - protein, 13 aa, Mycobacterium tuberculosis
WVNHMKIFFNNKG

SEQ ID NO: 68084 - protein, 13 aa, Mycobacterium tuberculosis
VNHMKIFFNNKGV

SEQ ID NO: 68085 - protein, 13 aa, Mycobacterium tuberculosis
NHMKIFFNNKGVV

SEQ ID NO: 68086 - protein, 13 aa, Mycobacterium tuberculosis
HMKIFFNNKGVVA

SEQ ID NO: 68087 - protein, 13 aa, Mycobacterium tuberculosis
MKIFFNNKGVVAK

SEQ ID NO: 68088 - protein, 13 aa, Mycobacterium tuberculosis
KIFFNNKGVVAKG

SEQ ID NO: 68089 - protein, 13 aa, Mycobacterium tuberculosis
IFFNNKGVVAKGT

SEQ ID NO: 68090 - protein, 13 aa, Mycobacterium tuberculosis
FFNNKGVVAKGTE

SEQ ID NO: 68091 - protein, 13 aa, Mycobacterium tuberculosis
FNNKGVVAKGTEV

SEQ ID NO: 68092 - protein, 13 aa, Mycobacterium tuberculosis
NNKGVVAKGTEVC

SEQ ID NO: 68093 - protein, 13 aa, Mycobacterium tuberculosis
NKGVVAKGTEVCN

SEQ ID NO: 68094 - protein, 13 aa, Mycobacterium tuberculosis
KGVVAKGTEVCNG

SEQ ID NO: 68095 - protein, 13 aa, Mycobacterium tuberculosis
GVVAKGTEVCNGY

SEQ ID NO: 68096 - protein, 13 aa, Mycobacterium tuberculosis
VVAKGTEVCNGYP

SEQ ID NO: 68097 - protein, 13 aa, Mycobacterium tuberculosis
VAKGTEVCNGYPA

SEQ ID NO: 68098 - protein, 13 aa, Mycobacterium tuberculosis
AKGTEVCNGYPAG

SEQ ID NO: 68099 - protein, 13 aa, Mycobacterium tuberculosis
KGTEVCNGYPAGD

SEQ ID NO: 68100 - protein, 13 aa, Mycobacterium tuberculosis
GTEVCNGYPAGDM

SEQ ID NO: 68101 - protein, 13 aa, Mycobacterium tuberculosis
TEVCNGYPAGDMS

SEQ ID NO: 68102 - protein, 13 aa, Mycobacterium tuberculosis
EVCNGYPAGDMSV

SEQ ID NO: 68103 - protein, 13 aa, Mycobacterium tuberculosis
VCNGYPAGDMSVW

SEQ ID NO: 68104 - protein, 13 aa, Mycobacterium tuberculosis
CNGYPAGDMSVWN

SEQ ID NO: 68105 - protein, 13 aa, Mycobacterium tuberculosis
NGYPAGDMSVWNW

SEQ ID NO: 68106 - protein, 13 aa, Mycobacterium tuberculosis
GYPAGDMSVWNWA

SEQ ID NO: 68107 - protein, 14 aa, Mycobacterium tuberculosis
MSRLSSILRAGAAF

SEQ ID NO: 68108 - protein, 14 aa, Mycobacterium tuberculosis
SRLSSILRAGAAFL

SEQ ID NO: 68109 - protein, 14 aa, Mycobacterium tuberculosis
RLSSILRAGAAFLV

SEQ ID NO: 68110 - protein, 14 aa, Mycobacterium tuberculosis
LSSILRAGAAFLVL

SEQ ID NO: 68111 - protein, 14 aa, Mycobacterium tuberculosis
SSILRAGAAFLVLG

SEQ ID NO: 68112 - protein, 14 aa, Mycobacterium tuberculosis
SILRAGAAFLVLGI

SEQ ID NO: 68113 - protein, 14 aa, Mycobacterium tuberculosis
ILRAGAAFLVLGIA

SEQ ID NO: 68114 - protein, 14 aa, Mycobacterium tuberculosis
LRAGAAFLVLGIAA

SEQ ID NO: 68115 - protein, 14 aa, Mycobacterium tuberculosis
RAGAAFLVLGIAAA

SEQ ID NO: 68116 - protein, 14 aa, Mycobacterium tuberculosis
AGAAFLVLGIAAAT

SEQ ID NO: 68117 - protein, 14 aa, Mycobacterium tuberculosis
GAAFLVLGIAAATF

SEQ ID NO: 68118 - protein, 14 aa, Mycobacterium tuberculosis
AAFLVLGIAAATFP

SEQ ID NO: 68119 - protein, 14 aa, Mycobacterium tuberculosis
AFLVLGIAAATFPQ

SEQ ID NO: 68120 - protein, 14 aa, Mycobacterium tuberculosis
FLVLGIAAATFPQS

SEQ ID NO: 68121 - protein, 14 aa, Mycobacterium tuberculosis
LVLGIAAATFPQSA

SEQ ID NO: 68122 - protein, 14 aa, Mycobacterium tuberculosis
VLGIAAATFPQSAA

SEQ ID NO: 68123 - protein, 14 aa, Mycobacterium tuberculosis
LGIAAATFPQSAAA

SEQ ID NO: 68124 - protein, 14 aa, Mycobacterium tuberculosis
GIAAATFPQSAAAD

SEQ ID NO: 68125 - protein, 14 aa, Mycobacterium tuberculosis
IAAATFPQSAAADS

SEQ ID NO: 68126 - protein, 14 aa, Mycobacterium tuberculosis
AAATFPQSAAADST

SEQ ID NO: 68127 - protein, 14 aa, Mycobacterium tuberculosis
AATFPQSAAADSTE

SEQ ID NO: 68128 - protein, 14 aa, Mycobacterium tuberculosis
ATFPQSAAADSTED

SEQ ID NO: 68129 - protein, 14 aa, Mycobacterium tuberculosis
TFPQSAAADSTEDF

SEQ ID NO: 68130 - protein, 14 aa, Mycobacterium tuberculosis
FPQSAAADSTEDFP

SEQ ID NO: 68131 - protein, 14 aa, Mycobacterium tuberculosis
PQSAAADSTEDFPI

SEQ ID NO: 68132 - protein, 14 aa, Mycobacterium tuberculosis
QSAAADSTEDFPIP

SEQ ID NO: 68133 - protein, 14 aa, Mycobacterium tuberculosis
SAAADSTEDFPIPR

SEQ ID NO: 68134 - protein, 14 aa, Mycobacterium tuberculosis
AAADSTEDFPIPRR

SEQ ID NO: 68135 - protein, 14 aa, Mycobacterium tuberculosis
AADSTEDFPIPRRM

SEQ ID NO: 68136 - protein, 14 aa, Mycobacterium tuberculosis
ADSTEDFPIPRRMI

SEQ ID NO: 68137 - protein, 14 aa, Mycobacterium tuberculosis
DSTEDFPIPRRMIA

SEQ ID NO: 68138 - protein, 14 aa, Mycobacterium tuberculosis
STEDFPIPRRMIAT

SEQ ID NO: 68139 - protein, 14 aa, Mycobacterium tuberculosis
TEDFPIPRRMIATT

SEQ ID NO: 68140 - protein, 14 aa, Mycobacterium tuberculosis
EDFPIPRRMIATTC

SEQ ID NO: 68141 - protein, 14 aa, Mycobacterium tuberculosis
DFPIPRRMIATTCD

SEQ ID NO: 68142 - protein, 14 aa, Mycobacterium tuberculosis
FPIPRRMIATTCDA

SEQ ID NO: 68143 - protein, 14 aa, Mycobacterium tuberculosis
PIPRRMIATTCDAE

SEQ ID NO: 68144 - protein, 14 aa, Mycobacterium tuberculosis
IPRRMIATTCDAEQ

SEQ ID NO: 68145 - protein, 14 aa, Mycobacterium tuberculosis
PRRMIATTCDAEQY

SEQ ID NO: 68146 - protein, 14 aa, Mycobacterium tuberculosis
RRMIATTCDAEQYL

SEQ ID NO: 68147 - protein, 14 aa, Mycobacterium tuberculosis
RMIATTCDAEQYLA

SEQ ID NO: 68148 - protein, 14 aa, Mycobacterium tuberculosis
MIATTCDAEQYLAA

SEQ ID NO: 68149 - protein, 14 aa, Mycobacterium tuberculosis
IATTCDAEQYLAAV

SEQ ID NO: 68150 - protein, 14 aa, Mycobacterium tuberculosis
ATTCDAEQYLAAVR

SEQ ID NO: 68151 - protein, 14 aa, Mycobacterium tuberculosis
TTCDAEQYLAAVRD

SEQ ID NO: 68152 - protein, 14 aa, Mycobacterium tuberculosis
TCDAEQYLAAVRDT

SEQ ID NO: 68153 - protein, 14 aa, Mycobacterium tuberculosis
CDAEQYLAAVRDTS

SEQ ID NO: 68154 - protein, 14 aa, Mycobacterium tuberculosis
DAEQYLAAVRDTSP

SEQ ID NO: 68155 - protein, 14 aa, Mycobacterium tuberculosis
AEQYLAAVRDTSPV

SEQ ID NO: 68156 - protein, 14 aa, Mycobacterium tuberculosis
EQYLAAVRDTSPVY

SEQ ID NO: 68157 - protein, 14 aa, Mycobacterium tuberculosis
QYLAAVRDTSPVYY

SEQ ID NO: 68158 - protein, 14 aa, Mycobacterium tuberculosis
YLAAVRDTSPVYYQ

SEQ ID NO: 68159 - protein, 14 aa, Mycobacterium tuberculosis
LAAVRDTSPVYYQR

SEQ ID NO: 68160 - protein, 14 aa, Mycobacterium tuberculosis
AAVRDTSPVYYQRY

SEQ ID NO: 68161 - protein, 14 aa, Mycobacterium tuberculosis
AVRDTSPVYYQRYM

SEQ ID NO: 68162 - protein, 14 aa, Mycobacterium tuberculosis
VRDTSPVYYQRYMI

SEQ ID NO: 68163 - protein, 14 aa, Mycobacterium tuberculosis
RDTSPVYYQRYMID

SEQ ID NO: 68164 - protein, 14 aa, Mycobacterium tuberculosis
DTSPVYYQRYMIDF

SEQ ID NO: 68165 - protein, 14 aa, Mycobacterium tuberculosis
TSPVYYQRYMIDFN

SEQ ID NO: 68166 - protein, 14 aa, Mycobacterium tuberculosis
SPVYYQRYMIDFNN

SEQ ID NO: 68167 - protein, 14 aa, Mycobacterium tuberculosis
PVYYQRYMIDFNNH

SEQ ID NO: 68168 - protein, 14 aa, Mycobacterium tuberculosis
VYYQRYMIDFNNHA

SEQ ID NO: 68169 - protein, 14 aa, Mycobacterium tuberculosis
YYQRYMIDFNNHAN

SEQ ID NO: 68170 - protein, 14 aa, Mycobacterium tuberculosis
YQRYMIDFNNHANL

SEQ ID NO: 68171 - protein, 14 aa, Mycobacterium tuberculosis
QRYMIDFNNHANLQ

SEQ ID NO: 68172 - protein, 14 aa, Mycobacterium tuberculosis
RYMIDFNNHANLQQ

SEQ ID NO: 68173 - protein, 14 aa, Mycobacterium tuberculosis
YMIDFNNHANLQQA

SEQ ID NO: 68174 - protein, 14 aa, Mycobacterium tuberculosis
MIDFNNHANLQQAT

SEQ ID NO: 68175 - protein, 14 aa, Mycobacterium tuberculosis
IDFNNHANLQQATI

SEQ ID NO: 68176 - protein, 14 aa, Mycobacterium tuberculosis
DFNNHANLQQATIN

SEQ ID NO: 68177 - protein, 14 aa, Mycobacterium tuberculosis
FNNHANLQQATINK

SEQ ID NO: 68178 - protein, 14 aa, Mycobacterium tuberculosis
NNHANLQQATINKA

SEQ ID NO: 68179 - protein, 14 aa, Mycobacterium tuberculosis
NHANLQQATINKAH

SEQ ID NO: 68180 - protein, 14 aa, Mycobacterium tuberculosis
HANLQQATINKAHW

SEQ ID NO: 68181 - protein, 14 aa, Mycobacterium tuberculosis
ANLQQATINKAHWF

SEQ ID NO: 68182 - protein, 14 aa, Mycobacterium tuberculosis
NLQQATINKAHWFF

SEQ ID NO: 68183 - protein, 14 aa, Mycobacterium tuberculosis
LQQATINKAHWFFS

SEQ ID NO: 68184 - protein, 14 aa, Mycobacterium tuberculosis
QQATINKAHWFFSL

SEQ ID NO: 68185 - protein, 14 aa, Mycobacterium tuberculosis
QATINKAHWFFSLS

SEQ ID NO: 68186 - protein, 14 aa, Mycobacterium tuberculosis
ATINKAHWFFSLSP

SEQ ID NO: 68187 - protein, 14 aa, Mycobacterium tuberculosis
TINKAHWFFSLSPA

SEQ ID NO: 68188 - protein, 14 aa, Mycobacterium tuberculosis
INKAHWFFSLSPAE

SEQ ID NO: 68189 - protein, 14 aa, Mycobacterium tuberculosis
NKAHWFFSLSPAER

SEQ ID NO: 68190 - protein, 14 aa, Mycobacterium tuberculosis
KAHWFFSLSPAERR

SEQ ID NO: 68191 - protein, 14 aa, Mycobacterium tuberculosis
AHWFFSLSPAERRD

SEQ ID NO: 68192 - protein, 14 aa, Mycobacterium tuberculosis
HWFFSLSPAERRDY

SEQ ID NO: 68193 - protein, 14 aa, Mycobacterium tuberculosis
WFFSLSPAERRDYS

SEQ ID NO: 68194 - protein, 14 aa, Mycobacterium tuberculosis
FFSLSPAERRDYSE

SEQ ID NO: 68195 - protein, 14 aa, Mycobacterium tuberculosis
FSLSPAERRDYSEH

SEQ ID NO: 68196 - protein, 14 aa, Mycobacterium tuberculosis
SLSPAERRDYSEHF

SEQ ID NO: 68197 - protein, 14 aa, Mycobacterium tuberculosis
LSPAERRDYSEHFY

SEQ ID NO: 68198 - protein, 14 aa, Mycobacterium tuberculosis
SPAERRDYSEHFYN

SEQ ID NO: 68199 - protein, 14 aa, Mycobacterium tuberculosis
PAERRDYSEHFYNG

SEQ ID NO: 68200 - protein, 14 aa, Mycobacterium tuberculosis
AERRDYSEHFYNGD

SEQ ID NO: 68201 - protein, 14 aa, Mycobacterium tuberculosis
ERRDYSEHFYNGDP

SEQ ID NO: 68202 - protein, 14 aa, Mycobacterium tuberculosis
RRDYSEHFYNGDPL

SEQ ID NO: 68203 - protein, 14 aa, Mycobacterium tuberculosis
RDYSEHFYNGDPLT

SEQ ID NO: 68204 - protein, 14 aa, Mycobacterium tuberculosis
DYSEHFYNGDPLTF

SEQ ID NO: 68205 - protein, 14 aa, Mycobacterium tuberculosis
YSEHFYNGDPLTFA

SEQ ID NO: 68206 - protein, 14 aa, Mycobacterium tuberculosis
SEHFYNGDPLTFAW

SEQ ID NO: 68207 - protein, 14 aa, Mycobacterium tuberculosis
EHFYNGDPLTFAWV

SEQ ID NO: 68208 - protein, 14 aa, Mycobacterium tuberculosis
HFYNGDPLTFAWVN

SEQ ID NO: 68209 - protein, 14 aa, Mycobacterium tuberculosis
FYNGDPLTFAWVNH

SEQ ID NO: 68210 - protein, 14 aa, Mycobacterium tuberculosis
YNGDPLTFAWVNHM

SEQ ID NO: 68211 - protein, 14 aa, Mycobacterium tuberculosis
NGDPLTFAWVNHMK

SEQ ID NO: 68212 - protein, 14 aa, Mycobacterium tuberculosis
GDPLTFAWVNHMKI

SEQ ID NO: 68213 - protein, 14 aa, Mycobacterium tuberculosis
DPLTFAWVNHMKIF

SEQ ID NO: 68214 - protein, 14 aa, Mycobacterium tuberculosis
PLTFAWVNHMKIFF

SEQ ID NO: 68215 - protein, 14 aa, Mycobacterium tuberculosis
LTFAWVNHMKIFFN

SEQ ID NO: 68216 - protein, 14 aa, Mycobacterium tuberculosis
TFAWVNHMKIFFNN

SEQ ID NO: 68217 - protein, 14 aa, Mycobacterium tuberculosis
FAWVNHMKIFFNNK

SEQ ID NO: 68218 - protein, 14 aa, Mycobacterium tuberculosis
AWVNHMKIFFNNKG

SEQ ID NO: 68219 - protein, 14 aa, Mycobacterium tuberculosis
WVNHMKIFFNNKGV

SEQ ID NO: 68220 - protein, 14 aa, Mycobacterium tuberculosis
VNHMKIFFNNKGVV

SEQ ID NO: 68221 - protein, 14 aa, Mycobacterium tuberculosis
NHMKIFFNNKGVVA

SEQ ID NO: 68222 - protein, 14 aa, Mycobacterium tuberculosis
HMKIFFNNKGVVAK

SEQ ID NO: 68223 - protein, 14 aa, Mycobacterium tuberculosis
MKIFFNNKGVVAKG

SEQ ID NO: 68224 - protein, 14 aa, Mycobacterium tuberculosis
KIFFNNKGVVAKGT

SEQ ID NO: 68225 - protein, 14 aa, Mycobacterium tuberculosis
IFFNNKGVVAKGTE

SEQ ID NO: 68226 - protein, 14 aa, Mycobacterium tuberculosis
FFNNKGVVAKGTEV

SEQ ID NO: 68227 - protein, 14 aa, Mycobacterium tuberculosis
FNNKGVVAKGTEVC

SEQ ID NO: 68228 - protein, 14 aa, Mycobacterium tuberculosis
NNKGVVAKGTEVCN

SEQ ID NO: 68229 - protein, 14 aa, Mycobacterium tuberculosis
NKGVVAKGTEVCNG

SEQ ID NO: 68230 - protein, 14 aa, Mycobacterium tuberculosis
KGVVAKGTEVCNGY

SEQ ID NO: 68231 - protein, 14 aa, Mycobacterium tuberculosis
GVVAKGTEVCNGYP

SEQ ID NO: 68232 - protein, 14 aa, Mycobacterium tuberculosis
VVAKGTEVCNGYPA

SEQ ID NO: 68233 - protein, 14 aa, Mycobacterium tuberculosis
VAKGTEVCNGYPAG

SEQ ID NO: 68234 - protein, 14 aa, Mycobacterium tuberculosis
AKGTEVCNGYPAGD

SEQ ID NO: 68235 - protein, 14 aa, Mycobacterium tuberculosis
KGTEVCNGYPAGDM

SEQ ID NO: 68236 - protein, 14 aa, Mycobacterium tuberculosis
GTEVCNGYPAGDMS

SEQ ID NO: 68237 - protein, 14 aa, Mycobacterium tuberculosis
TEVCNGYPAGDMSV

SEQ ID NO: 68238 - protein, 14 aa, Mycobacterium tuberculosis
EVCNGYPAGDMSVW

SEQ ID NO: 68239 - protein, 14 aa, Mycobacterium tuberculosis
VCNGYPAGDMSVWN

SEQ ID NO: 68240 - protein, 14 aa, Mycobacterium tuberculosis
CNGYPAGDMSVWNW

SEQ ID NO: 68241 - protein, 14 aa, Mycobacterium tuberculosis
NGYPAGDMSVWNWA

SEQ ID NO: 68242 - protein, 15 aa, Mycobacterium tuberculosis
MSRLSSILRAGAAFL

SEQ ID NO: 68243 - protein, 15 aa, Mycobacterium tuberculosis
SRLSSILRAGAAFLV

SEQ ID NO: 68244 - protein, 15 aa, Mycobacterium tuberculosis
RLSSILRAGAAFLVL

SEQ ID NO: 68245 - protein, 15 aa, Mycobacterium tuberculosis
LSSILRAGAAFLVLG

SEQ ID NO: 68246 - protein, 15 aa, Mycobacterium tuberculosis
SSILRAGAAFLVLGI

SEQ ID NO: 68247 - protein, 15 aa, Mycobacterium tuberculosis
SILRAGAAFLVLGIA

SEQ ID NO: 68248 - protein, 15 aa, Mycobacterium tuberculosis
ILRAGAAFLVLGIAA

SEQ ID NO: 68249 - protein, 15 aa, Mycobacterium tuberculosis
LRAGAAFLVLGIAAA

SEQ ID NO: 68250 - protein, 15 aa, Mycobacterium tuberculosis
RAGAAFLVLGIAAAT

SEQ ID NO: 68251 - protein, 15 aa, Mycobacterium tuberculosis
AGAAFLVLGIAAATF

SEQ ID NO: 68252 - protein, 15 aa, Mycobacterium tuberculosis
GAAFLVLGIAAATFP

SEQ ID NO: 68253 - protein, 15 aa, Mycobacterium tuberculosis
AAFLVLGIAAATFPQ

SEQ ID NO: 68254 - protein, 15 aa, Mycobacterium tuberculosis
AFLVLGIAAATFPQS

SEQ ID NO: 68255 - protein, 15 aa, Mycobacterium tuberculosis
FLVLGIAAATFPQSA

SEQ ID NO: 68256 - protein, 15 aa, Mycobacterium tuberculosis
LVLGIAAATFPQSAA

SEQ ID NO: 68257 - protein, 15 aa, Mycobacterium tuberculosis
VLGIAAATFPQSAAA

SEQ ID NO: 68258 - protein, 15 aa, Mycobacterium tuberculosis
LGIAAATFPQSAAAD

SEQ ID NO: 68259 - protein, 15 aa, Mycobacterium tuberculosis
GIAAATFPQSAAADS

SEQ ID NO: 68260 - protein, 15 aa, Mycobacterium tuberculosis
IAAATFPQSAAADST

SEQ ID NO: 68261 - protein, 15 aa, Mycobacterium tuberculosis
AAATFPQSAAADSTE

SEQ ID NO: 68262 - protein, 15 aa, Mycobacterium tuberculosis
AATFPQSAAADSTED

SEQ ID NO: 68263 - protein, 15 aa, Mycobacterium tuberculosis
ATFPQSAAADSTEDF

SEQ ID NO: 68264 - protein, 15 aa, Mycobacterium tuberculosis
TFPQSAAADSTEDFP

SEQ ID NO: 68265 - protein, 15 aa, Mycobacterium tuberculosis
FPQSAAADSTEDFPI

SEQ ID NO: 68266 - protein, 15 aa, Mycobacterium tuberculosis
PQSAAADSTEDFPIP

SEQ ID NO: 68267 - protein, 15 aa, Mycobacterium tuberculosis
QSAAADSTEDFPIPR

SEQ ID NO: 68268 - protein, 15 aa, Mycobacterium tuberculosis
SAAADSTEDFPIPRR

SEQ ID NO: 68269 - protein, 15 aa, Mycobacterium tuberculosis
AAADSTEDFPIPRRM

SEQ ID NO: 68270 - protein, 15 aa, Mycobacterium tuberculosis
AADSTEDFPIPRRMI

SEQ ID NO: 68271 - protein, 15 aa, Mycobacterium tuberculosis
ADSTEDFPIPRRMIA

SEQ ID NO: 68272 - protein, 15 aa, Mycobacterium tuberculosis
DSTEDFPIPRRMIAT

SEQ ID NO: 68273 - protein, 15 aa, Mycobacterium tuberculosis
STEDFPIPRRMIATT

SEQ ID NO: 68274 - protein, 15 aa, Mycobacterium tuberculosis
TEDFPIPRRMIATTC

SEQ ID NO: 68275 - protein, 15 aa, Mycobacterium tuberculosis
EDFPIPRRMIATTCD

SEQ ID NO: 68276 - protein, 15 aa, Mycobacterium tuberculosis
DFPIPRRMIATTCDA

SEQ ID NO: 68277 - protein, 15 aa, Mycobacterium tuberculosis
FPIPRRMIATTCDAE

SEQ ID NO: 68278 - protein, 15 aa, Mycobacterium tuberculosis
PIPRRMIATTCDAEQ

SEQ ID NO: 68279 - protein, 15 aa, Mycobacterium tuberculosis
IPRRMIATTCDAEQY

SEQ ID NO: 68280 - protein, 15 aa, Mycobacterium tuberculosis
PRRMIATTCDAEQYL

SEQ ID NO: 68281 - protein, 15 aa, Mycobacterium tuberculosis
RRMIATTCDAEQYLA

SEQ ID NO: 68282 - protein, 15 aa, Mycobacterium tuberculosis
RMIATTCDAEQYLAA

SEQ ID NO: 68283 - protein, 15 aa, Mycobacterium tuberculosis
MIATTCDAEQYLAAV

SEQ ID NO: 68284 - protein, 15 aa, Mycobacterium tuberculosis
IATTCDAEQYLAAVR

SEQ ID NO: 68285 - protein, 15 aa, Mycobacterium tuberculosis
ATTCDAEQYLAAVRD

SEQ ID NO: 68286 - protein, 15 aa, Mycobacterium tuberculosis
TTCDAEQYLAAVRDT

SEQ ID NO: 68287 - protein, 15 aa, Mycobacterium tuberculosis
TCDAEQYLAAVRDTS

SEQ ID NO: 68288 - protein, 15 aa, Mycobacterium tuberculosis
CDAEQYLAAVRDTSP

SEQ ID NO: 68289 - protein, 15 aa, Mycobacterium tuberculosis
DAEQYLAAVRDTSPV

SEQ ID NO: 68290 - protein, 15 aa, Mycobacterium tuberculosis
AEQYLAAVRDTSPVY

SEQ ID NO: 68291 - protein, 15 aa, Mycobacterium tuberculosis
EQYLAAVRDTSPVYY

SEQ ID NO: 68292 - protein, 15 aa, Mycobacterium tuberculosis
QYLAAVRDTSPVYYQ

SEQ ID NO: 68293 - protein, 15 aa, Mycobacterium tuberculosis
YLAAVRDTSPVYYQR

SEQ ID NO: 68294 - protein, 15 aa, Mycobacterium tuberculosis
LAAVRDTSPVYYQRY

SEQ ID NO: 68295 - protein, 15 aa, Mycobacterium tuberculosis
AAVRDTSPVYYQRYM

SEQ ID NO: 68296 - protein, 15 aa, Mycobacterium tuberculosis
AVRDTSPVYYQRYMI

SEQ ID NO: 68297 - protein, 15 aa, Mycobacterium tuberculosis
VRDTSPVYYQRYMID

SEQ ID NO: 68298 - protein, 15 aa, Mycobacterium tuberculosis
RDTSPVYYQRYMIDF

SEQ ID NO: 68299 - protein, 15 aa, Mycobacterium tuberculosis
DTSPVYYQRYMIDFN

SEQ ID NO: 68300 - protein, 15 aa, Mycobacterium tuberculosis
TSPVYYQRYMIDFNN

SEQ ID NO: 68301 - protein, 15 aa, Mycobacterium tuberculosis
SPVYYQRYMIDFNNH

SEQ ID NO: 68302 - protein, 15 aa, Mycobacterium tuberculosis
PVYYQRYMIDFNNHA

SEQ ID NO: 68303 - protein, 15 aa, Mycobacterium tuberculosis
VYYQRYMIDFNNHAN

SEQ ID NO: 68304 - protein, 15 aa, Mycobacterium tuberculosis
YYQRYMIDFNNHANL

SEQ ID NO: 68305 - protein, 15 aa, Mycobacterium tuberculosis
YQRYMIDFNNHANLQ

SEQ ID NO: 68306 - protein, 15 aa, Mycobacterium tuberculosis
QRYMIDFNNHANLQQ

SEQ ID NO: 68307 - protein, 15 aa, Mycobacterium tuberculosis
RYMIDFNNHANLQQA

SEQ ID NO: 68308 - protein, 15 aa, Mycobacterium tuberculosis
YMIDFNNHANLQQAT

SEQ ID NO: 68309 - protein, 15 aa, Mycobacterium tuberculosis
MIDFNNHANLQQATI

SEQ ID NO: 68310 - protein, 15 aa, Mycobacterium tuberculosis
IDFNNHANLQQATIN

SEQ ID NO: 68311 - protein, 15 aa, Mycobacterium tuberculosis
DFNNHANLQQATINK

SEQ ID NO: 68312 - protein, 15 aa, Mycobacterium tuberculosis
FNNHANLQQATINKA

SEQ ID NO: 68313 - protein, 15 aa, Mycobacterium tuberculosis
NNHANLQQATINKAH

SEQ ID NO: 68314 - protein, 15 aa, Mycobacterium tuberculosis
NHANLQQATINKAHW

SEQ ID NO: 68315 - protein, 15 aa, Mycobacterium tuberculosis
HANLQQATINKAHWF

SEQ ID NO: 68316 - protein, 15 aa, Mycobacterium tuberculosis
ANLQQATINKAHWFF

SEQ ID NO: 68317 - protein, 15 aa, Mycobacterium tuberculosis
NLQQATINKAHWFFS

SEQ ID NO: 68318 - protein, 15 aa, Mycobacterium tuberculosis
LQQATINKAHWFFSL

SEQ ID NO: 68319 - protein, 15 aa, Mycobacterium tuberculosis
QQATINKAHWFFSLS

SEQ ID NO: 68320 - protein, 15 aa, Mycobacterium tuberculosis
QATINKAHWFFSLSP

SEQ ID NO: 68321 - protein, 15 aa, Mycobacterium tuberculosis
ATINKAHWFFSLSPA

SEQ ID NO: 68322 - protein, 15 aa, Mycobacterium tuberculosis
TINKAHWFFSLSPAE

SEQ ID NO: 68323 - protein, 15 aa, Mycobacterium tuberculosis
INKAHWFFSLSPAER

SEQ ID NO: 68324 - protein, 15 aa, Mycobacterium tuberculosis
NKAHWFFSLSPAERR

SEQ ID NO: 68325 - protein, 15 aa, Mycobacterium tuberculosis
KAHWFFSLSPAERRD

SEQ ID NO: 68326 - protein, 15 aa, Mycobacterium tuberculosis
AHWFFSLSPAERRDY

SEQ ID NO: 68327 - protein, 15 aa, Mycobacterium tuberculosis
HWFFSLSPAERRDYS

SEQ ID NO: 68328 - protein, 15 aa, Mycobacterium tuberculosis
WFFSLSPAERRDYSE

SEQ ID NO: 68329 - protein, 15 aa, Mycobacterium tuberculosis
FFSLSPAERRDYSEH

SEQ ID NO: 68330 - protein, 15 aa, Mycobacterium tuberculosis
FSLSPAERRDYSEHF

SEQ ID NO: 68331 - protein, 15 aa, Mycobacterium tuberculosis
SLSPAERRDYSEHFY

SEQ ID NO: 68332 - protein, 15 aa, Mycobacterium tuberculosis
LSPAERRDYSEHFYN

SEQ ID NO: 68333 - protein, 15 aa, Mycobacterium tuberculosis
SPAERRDYSEHFYNG

SEQ ID NO: 68334 - protein, 15 aa, Mycobacterium tuberculosis
PAERRDYSEHFYNGD

SEQ ID NO: 68335 - protein, 15 aa, Mycobacterium tuberculosis
AERRDYSEHFYNGDP

SEQ ID NO: 68336 - protein, 15 aa, Mycobacterium tuberculosis
ERRDYSEHFYNGDPL

SEQ ID NO: 68337 - protein, 15 aa, Mycobacterium tuberculosis
RRDYSEHFYNGDPLT

SEQ ID NO: 68338 - protein, 15 aa, Mycobacterium tuberculosis
RDYSEHFYNGDPLTF

SEQ ID NO: 68339 - protein, 15 aa, Mycobacterium tuberculosis
DYSEHFYNGDPLTFA

SEQ ID NO: 68340 - protein, 15 aa, Mycobacterium tuberculosis
YSEHFYNGDPLTFAW

SEQ ID NO: 68341 - protein, 15 aa, Mycobacterium tuberculosis
SEHFYNGDPLTFAWV

SEQ ID NO: 68342 - protein, 15 aa, Mycobacterium tuberculosis
EHFYNGDPLTFAWVN

SEQ ID NO: 68343 - protein, 15 aa, Mycobacterium tuberculosis
HFYNGDPLTFAWVNH

SEQ ID NO: 68344 - protein, 15 aa, Mycobacterium tuberculosis
FYNGDPLTFAWVNHM

SEQ ID NO: 68345 - protein, 15 aa, Mycobacterium tuberculosis
YNGDPLTFAWVNHMK

SEQ ID NO: 68346 - protein, 15 aa, Mycobacterium tuberculosis
NGDPLTFAWVNHMKI

SEQ ID NO: 68347 - protein, 15 aa, Mycobacterium tuberculosis
GDPLTFAWVNHMKIF

SEQ ID NO: 68348 - protein, 15 aa, Mycobacterium tuberculosis
DPLTFAWVNHMKIFF

SEQ ID NO: 68349 - protein, 15 aa, Mycobacterium tuberculosis
PLTFAWVNHMKIFFN

SEQ ID NO: 68350 - protein, 15 aa, Mycobacterium tuberculosis
LTFAWVNHMKIFFNN

SEQ ID NO: 68351 - protein, 15 aa, Mycobacterium tuberculosis
TFAWVNHMKIFFNNK

SEQ ID NO: 68352 - protein, 15 aa, Mycobacterium tuberculosis
FAWVNHMKIFFNNKG

SEQ ID NO: 68353 - protein, 15 aa, Mycobacterium tuberculosis
AWVNHMKIFFNNKGV

SEQ ID NO: 68354 - protein, 15 aa, Mycobacterium tuberculosis
WVNHMKIFFNNKGVV

SEQ ID NO: 68355 - protein, 15 aa, Mycobacterium tuberculosis
VNHMKIFFNNKGVVA

SEQ ID NO: 68356 - protein, 15 aa, Mycobacterium tuberculosis
NHMKIFFNNKGVVAK

SEQ ID NO: 68357 - protein, 15 aa, Mycobacterium tuberculosis
HMKIFFNNKGVVAKG

SEQ ID NO: 68358 - protein, 15 aa, Mycobacterium tuberculosis
MKIFFNNKGVVAKGT

SEQ ID NO: 68359 - protein, 15 aa, Mycobacterium tuberculosis
KIFFNNKGVVAKGTE

SEQ ID NO: 68360 - protein, 15 aa, Mycobacterium tuberculosis
IFFNNKGVVAKGTEV

SEQ ID NO: 68361 - protein, 15 aa, Mycobacterium tuberculosis
FFNNKGVVAKGTEVC

SEQ ID NO: 68362 - protein, 15 aa, Mycobacterium tuberculosis
FNNKGVVAKGTEVCN

SEQ ID NO: 68363 - protein, 15 aa, Mycobacterium tuberculosis
NNKGVVAKGTEVCNG

SEQ ID NO: 68364 - protein, 15 aa, Mycobacterium tuberculosis
NKGVVAKGTEVCNGY

SEQ ID NO: 68365 - protein, 15 aa, Mycobacterium tuberculosis
KGVVAKGTEVCNGYP

SEQ ID NO: 68366 - protein, 15 aa, Mycobacterium tuberculosis
GVVAKGTEVCNGYPA

SEQ ID NO: 68367 - protein, 15 aa, Mycobacterium tuberculosis
VVAKGTEVCNGYPAG

SEQ ID NO: 68368 - protein, 15 aa, Mycobacterium tuberculosis
VAKGTEVCNGYPAGD

SEQ ID NO: 68369 - protein, 15 aa, Mycobacterium tuberculosis
AKGTEVCNGYPAGDM

SEQ ID NO: 68370 - protein, 15 aa, Mycobacterium tuberculosis
KGTEVCNGYPAGDMS

SEQ ID NO: 68371 - protein, 15 aa, Mycobacterium tuberculosis
GTEVCNGYPAGDMSV

SEQ ID NO: 68372 - protein, 15 aa, Mycobacterium tuberculosis
TEVCNGYPAGDMSVW

SEQ ID NO: 68373 - protein, 15 aa, Mycobacterium tuberculosis
EVCNGYPAGDMSVWN

SEQ ID NO: 68374 - protein, 15 aa, Mycobacterium tuberculosis
VCNGYPAGDMSVWNW

SEQ ID NO: 68375 - protein, 15 aa, Mycobacterium tuberculosis
CNGYPAGDMSVWNWA

SEQ ID NO: 68376 - protein, 16 aa, Mycobacterium tuberculosis
MSRLSSILRAGAAFLV

SEQ ID NO: 68377 - protein, 16 aa, Mycobacterium tuberculosis
SRLSSILRAGAAFLVL

SEQ ID NO: 68378 - protein, 16 aa, Mycobacterium tuberculosis
RLSSILRAGAAFLVLG

SEQ ID NO: 68379 - protein, 16 aa, Mycobacterium tuberculosis
LSSILRAGAAFLVLGI

SEQ ID NO: 68380 - protein, 16 aa, Mycobacterium tuberculosis
SSILRAGAAFLVLGIA

SEQ ID NO: 68381 - protein, 16 aa, Mycobacterium tuberculosis
SILRAGAAFLVLGIAA

SEQ ID NO: 68382 - protein, 16 aa, Mycobacterium tuberculosis
ILRAGAAFLVLGIAAA

SEQ ID NO: 68383 - protein, 16 aa, Mycobacterium tuberculosis
LRAGAAFLVLGIAAAT

SEQ ID NO: 68384 - protein, 16 aa, Mycobacterium tuberculosis
RAGAAFLVLGIAAATF

SEQ ID NO: 68385 - protein, 16 aa, Mycobacterium tuberculosis
AGAAFLVLGIAAATFP

SEQ ID NO: 68386 - protein, 16 aa, Mycobacterium tuberculosis
GAAFLVLGIAAATFPQ

SEQ ID NO: 68387 - protein, 16 aa, Mycobacterium tuberculosis
AAFLVLGIAAATFPQS

SEQ ID NO: 68388 - protein, 16 aa, Mycobacterium tuberculosis
AFLVLGIAAATFPQSA

SEQ ID NO: 68389 - protein, 16 aa, Mycobacterium tuberculosis
FLVLGIAAATFPQSAA

SEQ ID NO: 68390 - protein, 16 aa, Mycobacterium tuberculosis
LVLGIAAATFPQSAAA

SEQ ID NO: 68391 - protein, 16 aa, Mycobacterium tuberculosis
VLGIAAATFPQSAAAD

SEQ ID NO: 68392 - protein, 16 aa, Mycobacterium tuberculosis
LGIAAATFPQSAAADS

SEQ ID NO: 68393 - protein, 16 aa, Mycobacterium tuberculosis
GIAAATFPQSAAADST

SEQ ID NO: 68394 - protein, 16 aa, Mycobacterium tuberculosis
IAAATFPQSAAADSTE

SEQ ID NO: 68395 - protein, 16 aa, Mycobacterium tuberculosis
AAATFPQSAAADSTED

SEQ ID NO: 68396 - protein, 16 aa, Mycobacterium tuberculosis
AATFPQSAAADSTEDF

SEQ ID NO: 68397 - protein, 16 aa, Mycobacterium tuberculosis
ATFPQSAAADSTEDFP

SEQ ID NO: 68398 - protein, 16 aa, Mycobacterium tuberculosis
TFPQSAAADSTEDFPI

SEQ ID NO: 68399 - protein, 16 aa, Mycobacterium tuberculosis
FPQSAAADSTEDFPIP

SEQ ID NO: 68400 - protein, 16 aa, Mycobacterium tuberculosis
PQSAAADSTEDFPIPR

SEQ ID NO: 68401 - protein, 16 aa, Mycobacterium tuberculosis
QSAAADSTEDFPIPRR

SEQ ID NO: 68402 - protein, 16 aa, Mycobacterium tuberculosis
SAAADSTEDFPIPRRM

SEQ ID NO: 68403 - protein, 16 aa, Mycobacterium tuberculosis
AAADSTEDFPIPRRMI

SEQ ID NO: 68404 - protein, 16 aa, Mycobacterium tuberculosis
AADSTEDFPIPRRMIA

SEQ ID NO: 68405 - protein, 16 aa, Mycobacterium tuberculosis
ADSTEDFPIPRRMIAT

SEQ ID NO: 68406 - protein, 16 aa, Mycobacterium tuberculosis
DSTEDFPIPRRMIATT

SEQ ID NO: 68407 - protein, 16 aa, Mycobacterium tuberculosis
STEDFPIPRRMIATTC

SEQ ID NO: 68408 - protein, 16 aa, Mycobacterium tuberculosis
TEDFPIPRRMIATTCD

SEQ ID NO: 68409 - protein, 16 aa, Mycobacterium tuberculosis
EDFPIPRRMIATTCDA

SEQ ID NO: 68410 - protein, 16 aa, Mycobacterium tuberculosis
DFPIPRRMIATTCDAE

SEQ ID NO: 68411 - protein, 16 aa, Mycobacterium tuberculosis
FPIPRRMIATTCDAEQ

SEQ ID NO: 68412 - protein, 16 aa, Mycobacterium tuberculosis
PIPRRMIATTCDAEQY

SEQ ID NO: 68413 - protein, 16 aa, Mycobacterium tuberculosis
IPRRMIATTCDAEQYL

SEQ ID NO: 68414 - protein, 16 aa, Mycobacterium tuberculosis
PRRMIATTCDAEQYLA

SEQ ID NO: 68415 - protein, 16 aa, Mycobacterium tuberculosis
RRMIATTCDAEQYLAA

SEQ ID NO: 68416 - protein, 16 aa, Mycobacterium tuberculosis
RMIATTCDAEQYLAAV

SEQ ID NO: 68417 - protein, 16 aa, Mycobacterium tuberculosis
MIATTCDAEQYLAAVR

SEQ ID NO: 68418 - protein, 16 aa, Mycobacterium tuberculosis
IATTCDAEQYLAAVRD

SEQ ID NO: 68419 - protein, 16 aa, Mycobacterium tuberculosis
ATTCDAEQYLAAVRDT

SEQ ID NO: 68420 - protein, 16 aa, Mycobacterium tuberculosis
TTCDAEQYLAAVRDTS

SEQ ID NO: 68421 - protein, 16 aa, Mycobacterium tuberculosis
TCDAEQYLAAVRDTSP

SEQ ID NO: 68422 - protein, 16 aa, Mycobacterium tuberculosis
CDAEQYLAAVRDTSPV

SEQ ID NO: 68423 - protein, 16 aa, Mycobacterium tuberculosis
DAEQYLAAVRDTSPVY

SEQ ID NO: 68424 - protein, 16 aa, Mycobacterium tuberculosis
AEQYLAAVRDTSPVYY

SEQ ID NO: 68425 - protein, 16 aa, Mycobacterium tuberculosis
EQYLAAVRDTSPVYYQ

SEQ ID NO: 68426 - protein, 16 aa, Mycobacterium tuberculosis
QYLAAVRDTSPVYYQR

SEQ ID NO: 68427 - protein, 16 aa, Mycobacterium tuberculosis
YLAAVRDTSPVYYQRY

SEQ ID NO: 68428 - protein, 16 aa, Mycobacterium tuberculosis
LAAVRDTSPVYYQRYM

SEQ ID NO: 68429 - protein, 16 aa, Mycobacterium tuberculosis
AAVRDTSPVYYQRYMI

SEQ ID NO: 68430 - protein, 16 aa, Mycobacterium tuberculosis
AVRDTSPVYYQRYMID

SEQ ID NO: 68431 - protein, 16 aa, Mycobacterium tuberculosis
VRDTSPVYYQRYMIDF

SEQ ID NO: 68432 - protein, 16 aa, Mycobacterium tuberculosis
RDTSPVYYQRYMIDFN

SEQ ID NO: 68433 - protein, 16 aa, Mycobacterium tuberculosis
DTSPVYYQRYMIDFNN

SEQ ID NO: 68434 - protein, 16 aa, Mycobacterium tuberculosis
TSPVYYQRYMIDFNNH

SEQ ID NO: 68435 - protein, 16 aa, Mycobacterium tuberculosis
SPVYYQRYMIDFNNHA

SEQ ID NO: 68436 - protein, 16 aa, Mycobacterium tuberculosis
PVYYQRYMIDFNNHAN

SEQ ID NO: 68437 - protein, 16 aa, Mycobacterium tuberculosis
VYYQRYMIDFNNHANL

SEQ ID NO: 68438 - protein, 16 aa, Mycobacterium tuberculosis
YYQRYMIDFNNHANLQ

SEQ ID NO: 68439 - protein, 16 aa, Mycobacterium tuberculosis
YQRYMIDFNNHANLQQ

SEQ ID NO: 68440 - protein, 16 aa, Mycobacterium tuberculosis
QRYMIDFNNHANLQQA

SEQ ID NO: 68441 - protein, 16 aa, Mycobacterium tuberculosis
RYMIDFNNHANLQQAT

SEQ ID NO: 68442 - protein, 16 aa, Mycobacterium tuberculosis
YMIDFNNHANLQQATI

SEQ ID NO: 68443 - protein, 16 aa, Mycobacterium tuberculosis
MIDFNNHANLQQATIN

SEQ ID NO: 68444 - protein, 16 aa, Mycobacterium tuberculosis
IDFNNHANLQQATINK

SEQ ID NO: 68445 - protein, 16 aa, Mycobacterium tuberculosis
DFNNHANLQQATINKA

SEQ ID NO: 68446 - protein, 16 aa, Mycobacterium tuberculosis
FNNHANLQQATINKAH

SEQ ID NO: 68447 - protein, 16 aa, Mycobacterium tuberculosis
NNHANLQQATINKAHW

SEQ ID NO: 68448 - protein, 16 aa, Mycobacterium tuberculosis
NHANLQQATINKAHWF

SEQ ID NO: 68449 - protein, 16 aa, Mycobacterium tuberculosis
HANLQQATINKAHWFF

SEQ ID NO: 68450 - protein, 16 aa, Mycobacterium tuberculosis
ANLQQATINKAHWFFS

SEQ ID NO: 68451 - protein, 16 aa, Mycobacterium tuberculosis
NLQQATINKAHWFFSL

SEQ ID NO: 68452 - protein, 16 aa, Mycobacterium tuberculosis
LQQATINKAHWFFSLS

SEQ ID NO: 68453 - protein, 16 aa, Mycobacterium tuberculosis
QQATINKAHWFFSLSP

SEQ ID NO: 68454 - protein, 16 aa, Mycobacterium tuberculosis
QATINKAHWFFSLSPA

SEQ ID NO: 68455 - protein, 16 aa, Mycobacterium tuberculosis
ATINKAHWFFSLSPAE

SEQ ID NO: 68456 - protein, 16 aa, Mycobacterium tuberculosis
TINKAHWFFSLSPAER

SEQ ID NO: 68457 - protein, 16 aa, Mycobacterium tuberculosis
INKAHWFFSLSPAERR

SEQ ID NO: 68458 - protein, 16 aa, Mycobacterium tuberculosis
NKAHWFFSLSPAERRD

SEQ ID NO: 68459 - protein, 16 aa, Mycobacterium tuberculosis
KAHWFFSLSPAERRDY

SEQ ID NO: 68460 - protein, 16 aa, Mycobacterium tuberculosis
AHWFFSLSPAERRDYS

SEQ ID NO: 68461 - protein, 16 aa, Mycobacterium tuberculosis
HWFFSLSPAERRDYSE

SEQ ID NO: 68462 - protein, 16 aa, Mycobacterium tuberculosis
WFFSLSPAERRDYSEH

SEQ ID NO: 68463 - protein, 16 aa, Mycobacterium tuberculosis
FFSLSPAERRDYSEHF

SEQ ID NO: 68464 - protein, 16 aa, Mycobacterium tuberculosis
FSLSPAERRDYSEHFY

SEQ ID NO: 68465 - protein, 16 aa, Mycobacterium tuberculosis
SLSPAERRDYSEHFYN

SEQ ID NO: 68466 - protein, 16 aa, Mycobacterium tuberculosis
LSPAERRDYSEHFYNG

SEQ ID NO: 68467 - protein, 16 aa, Mycobacterium tuberculosis
SPAERRDYSEHFYNGD

SEQ ID NO: 68468 - protein, 16 aa, Mycobacterium tuberculosis
PAERRDYSEHFYNGDP

SEQ ID NO: 68469 - protein, 16 aa, Mycobacterium tuberculosis
AERRDYSEHFYNGDPL

SEQ ID NO: 68470 - protein, 16 aa, Mycobacterium tuberculosis
ERRDYSEHFYNGDPLT

SEQ ID NO: 68471 - protein, 16 aa, Mycobacterium tuberculosis
RRDYSEHFYNGDPLTF

SEQ ID NO: 68472 - protein, 16 aa, Mycobacterium tuberculosis
RDYSEHFYNGDPLTFA

SEQ ID NO: 68473 - protein, 16 aa, Mycobacterium tuberculosis
DYSEHFYNGDPLTFAW

SEQ ID NO: 68474 - protein, 16 aa, Mycobacterium tuberculosis
YSEHFYNGDPLTFAWV

SEQ ID NO: 68475 - protein, 16 aa, Mycobacterium tuberculosis
SEHFYNGDPLTFAWVN

SEQ ID NO: 68476 - protein, 16 aa, Mycobacterium tuberculosis
EHFYNGDPLTFAWVNH

SEQ ID NO: 68477 - protein, 16 aa, Mycobacterium tuberculosis
HFYNGDPLTFAWVNHM

SEQ ID NO: 68478 - protein, 16 aa, Mycobacterium tuberculosis
FYNGDPLTFAWVNHMK

SEQ ID NO: 68479 - protein, 16 aa, Mycobacterium tuberculosis
YNGDPLTFAWVNHMKI

SEQ ID NO: 68480 - protein, 16 aa, Mycobacterium tuberculosis
NGDPLTFAWVNHMKIF

SEQ ID NO: 68481 - protein, 16 aa, Mycobacterium tuberculosis
GDPLTFAWVNHMKIFF

SEQ ID NO: 68482 - protein, 16 aa, Mycobacterium tuberculosis
DPLTFAWVNHMKIFFN

SEQ ID NO: 68483 - protein, 16 aa, Mycobacterium tuberculosis
PLTFAWVNHMKIFFNN

SEQ ID NO: 68484 - protein, 16 aa, Mycobacterium tuberculosis
LTFAWVNHMKIFFNNK

SEQ ID NO: 68485 - protein, 16 aa, Mycobacterium tuberculosis
TFAWVNHMKIFFNNKG

SEQ ID NO: 68486 - protein, 16 aa, Mycobacterium tuberculosis
FAWVNHMKIFFNNKGV

SEQ ID NO: 68487 - protein, 16 aa, Mycobacterium tuberculosis
AWVNHMKIFFNNKGVV

SEQ ID NO: 68488 - protein, 16 aa, Mycobacterium tuberculosis
WVNHMKIFFNNKGVVA

SEQ ID NO: 68489 - protein, 16 aa, Mycobacterium tuberculosis
VNHMKIFFNNKGVVAK

SEQ ID NO: 68490 - protein, 16 aa, Mycobacterium tuberculosis
NHMKIFFNNKGVVAKG

SEQ ID NO: 68491 - protein, 16 aa, Mycobacterium tuberculosis
HMKIFFNNKGVVAKGT

SEQ ID NO: 68492 - protein, 16 aa, Mycobacterium tuberculosis
MKIFFNNKGVVAKGTE

SEQ ID NO: 68493 - protein, 16 aa, Mycobacterium tuberculosis
KIFFNNKGVVAKGTEV

SEQ ID NO: 68494 - protein, 16 aa, Mycobacterium tuberculosis
IFFNNKGVVAKGTEVC

SEQ ID NO: 68495 - protein, 16 aa, Mycobacterium tuberculosis
FFNNKGVVAKGTEVCN

SEQ ID NO: 68496 - protein, 16 aa, Mycobacterium tuberculosis
FNNKGVVAKGTEVCNG

SEQ ID NO: 68497 - protein, 16 aa, Mycobacterium tuberculosis
NNKGVVAKGTEVCNGY

SEQ ID NO: 68498 - protein, 16 aa, Mycobacterium tuberculosis
NKGVVAKGTEVCNGYP

SEQ ID NO: 68499 - protein, 16 aa, Mycobacterium tuberculosis
KGVVAKGTEVCNGYPA

SEQ ID NO: 68500 - protein, 16 aa, Mycobacterium tuberculosis
GVVAKGTEVCNGYPAG

SEQ ID NO: 68501 - protein, 16 aa, Mycobacterium tuberculosis
VVAKGTEVCNGYPAGD

SEQ ID NO: 68502 - protein, 16 aa, Mycobacterium tuberculosis
VAKGTEVCNGYPAGDM

SEQ ID NO: 68503 - protein, 16 aa, Mycobacterium tuberculosis
AKGTEVCNGYPAGDMS

SEQ ID NO: 68504 - protein, 16 aa, Mycobacterium tuberculosis
KGTEVCNGYPAGDMSV

SEQ ID NO: 68505 - protein, 16 aa, Mycobacterium tuberculosis
GTEVCNGYPAGDMSVW

SEQ ID NO: 68506 - protein, 16 aa, Mycobacterium tuberculosis
TEVCNGYPAGDMSVWN

SEQ ID NO: 68507 - protein, 16 aa, Mycobacterium tuberculosis
EVCNGYPAGDMSVWNW

SEQ ID NO: 68508 - protein, 16 aa, Mycobacterium tuberculosis
VCNGYPAGDMSVWNWA

SEQ ID NO: 68509 - protein, 13 aa, Mycobacterium tuberculosis
MTTTIPTSKSACS

SEQ ID NO: 68510 - protein, 13 aa, Mycobacterium tuberculosis
TTTIPTSKSACSV

SEQ ID NO: 68511 - protein, 13 aa, Mycobacterium tuberculosis
TTIPTSKSACSVT

SEQ ID NO: 68512 - protein, 13 aa, Mycobacterium tuberculosis
TIPTSKSACSVTT

SEQ ID NO: 68513 - protein, 13 aa, Mycobacterium tuberculosis
IPTSKSACSVTTR

SEQ ID NO: 68514 - protein, 13 aa, Mycobacterium tuberculosis
PTSKSACSVTTRP

SEQ ID NO: 68515 - protein, 13 aa, Mycobacterium tuberculosis
TSKSACSVTTRPG

SEQ ID NO: 68516 - protein, 13 aa, Mycobacterium tuberculosis
SKSACSVTTRPGN

SEQ ID NO: 68517 - protein, 13 aa, Mycobacterium tuberculosis
KSACSVTTRPGNA

SEQ ID NO: 68518 - protein, 13 aa, Mycobacterium tuberculosis
SACSVTTRPGNAA

SEQ ID NO: 68519 - protein, 13 aa, Mycobacterium tuberculosis
ACSVTTRPGNAAV

SEQ ID NO: 68520 - protein, 13 aa, Mycobacterium tuberculosis
CSVTTRPGNAAVD

SEQ ID NO: 68521 - protein, 13 aa, Mycobacterium tuberculosis
SVTTRPGNAAVDY

SEQ ID NO: 68522 - protein, 13 aa, Mycobacterium tuberculosis
VTTRPGNAAVDYG

SEQ ID NO: 68523 - protein, 13 aa, Mycobacterium tuberculosis
TTRPGNAAVDYGG

SEQ ID NO: 68524 - protein, 13 aa, Mycobacterium tuberculosis
TRPGNAAVDYGGA

SEQ ID NO: 68525 - protein, 13 aa, Mycobacterium tuberculosis
RPGNAAVDYGGAQ

SEQ ID NO: 68526 - protein, 13 aa, Mycobacterium tuberculosis
PGNAAVDYGGAQI

SEQ ID NO: 68527 - protein, 13 aa, Mycobacterium tuberculosis
GNAAVDYGGAQIR

SEQ ID NO: 68528 - protein, 13 aa, Mycobacterium tuberculosis
NAAVDYGGAQIRA

SEQ ID NO: 68529 - protein, 13 aa, Mycobacterium tuberculosis
AAVDYGGAQIRAY

SEQ ID NO: 68530 - protein, 13 aa, Mycobacterium tuberculosis
AVDYGGAQIRAYL

SEQ ID NO: 68531 - protein, 13 aa, Mycobacterium tuberculosis
VDYGGAQIRAYLH

SEQ ID NO: 68532 - protein, 13 aa, Mycobacterium tuberculosis
DYGGAQIRAYLHH

SEQ ID NO: 68533 - protein, 13 aa, Mycobacterium tuberculosis
YGGAQIRAYLHHL

SEQ ID NO: 68534 - protein, 13 aa, Mycobacterium tuberculosis
GGAQIRAYLHHLA

SEQ ID NO: 68535 - protein, 13 aa, Mycobacterium tuberculosis
GAQIRAYLHHLAT

SEQ ID NO: 68536 - protein, 13 aa, Mycobacterium tuberculosis
AQIRAYLHHLATV

SEQ ID NO: 68537 - protein, 13 aa, Mycobacterium tuberculosis
QIRAYLHHLATVV

SEQ ID NO: 68538 - protein, 13 aa, Mycobacterium tuberculosis
IRAYLHHLATVVT

SEQ ID NO: 68539 - protein, 13 aa, Mycobacterium tuberculosis
RAYLHHLATVVTI

SEQ ID NO: 68540 - protein, 13 aa, Mycobacterium tuberculosis
AYLHHLATVVTIR

SEQ ID NO: 68541 - protein, 13 aa, Mycobacterium tuberculosis
YLHHLATVVTIRG

SEQ ID NO: 68542 - protein, 13 aa, Mycobacterium tuberculosis
LHHLATVVTIRGE

SEQ ID NO: 68543 - protein, 13 aa, Mycobacterium tuberculosis
HHLATVVTIRGEI

SEQ ID NO: 68544 - protein, 13 aa, Mycobacterium tuberculosis
HLATVVTIRGEID

SEQ ID NO: 68545 - protein, 13 aa, Mycobacterium tuberculosis
LATVVTIRGEIDA

SEQ ID NO: 68546 - protein, 13 aa, Mycobacterium tuberculosis
ATVVTIRGEIDAA

SEQ ID NO: 68547 - protein, 13 aa, Mycobacterium tuberculosis
TVVTIRGEIDAAN

SEQ ID NO: 68548 - protein, 13 aa, Mycobacterium tuberculosis
VVTIRGEIDAANV

SEQ ID NO: 68549 - protein, 13 aa, Mycobacterium tuberculosis
VTIRGEIDAANVE

SEQ ID NO: 68550 - protein, 13 aa, Mycobacterium tuberculosis
TIRGEIDAANVEQ

SEQ ID NO: 68551 - protein, 13 aa, Mycobacterium tuberculosis
IRGEIDAANVEQI

SEQ ID NO: 68552 - protein, 13 aa, Mycobacterium tuberculosis
RGEIDAANVEQIS

SEQ ID NO: 68553 - protein, 13 aa, Mycobacterium tuberculosis
GEIDAANVEQISE

SEQ ID NO: 68554 - protein, 13 aa, Mycobacterium tuberculosis
EIDAANVEQISEH

SEQ ID NO: 68555 - protein, 13 aa, Mycobacterium tuberculosis
IDAANVEQISEHV

SEQ ID NO: 68556 - protein, 13 aa, Mycobacterium tuberculosis
DAANVEQISEHVR

SEQ ID NO: 68557 - protein, 13 aa, Mycobacterium tuberculosis
AANVEQISEHVRR

SEQ ID NO: 68558 - protein, 13 aa, Mycobacterium tuberculosis
ANVEQISEHVRRF

SEQ ID NO: 68559 - protein, 13 aa, Mycobacterium tuberculosis
NVEQISEHVRRFS

SEQ ID NO: 68560 - protein, 13 aa, Mycobacterium tuberculosis
VEQISEHVRRFSL

SEQ ID NO: 68561 - protein, 13 aa, Mycobacterium tuberculosis
EQISEHVRRFSLG

SEQ ID NO: 68562 - protein, 13 aa, Mycobacterium tuberculosis
QISEHVRRFSLGT

SEQ ID NO: 68563 - protein, 13 aa, Mycobacterium tuberculosis
ISEHVRRFSLGTN

SEQ ID NO: 68564 - protein, 13 aa, Mycobacterium tuberculosis
SEHVRRFSLGTNP

SEQ ID NO: 68565 - protein, 13 aa, Mycobacterium tuberculosis
EHVRRFSLGTNPM

SEQ ID NO: 68566 - protein, 13 aa, Mycobacterium tuberculosis
HVRRFSLGTNPMV

SEQ ID NO: 68567 - protein, 13 aa, Mycobacterium tuberculosis
VRRFSLGTNPMVL

SEQ ID NO: 68568 - protein, 13 aa, Mycobacterium tuberculosis
RRFSLGTNPMVLD

SEQ ID NO: 68569 - protein, 13 aa, Mycobacterium tuberculosis
RFSLGTNPMVLDL

SEQ ID NO: 68570 - protein, 13 aa, Mycobacterium tuberculosis
FSLGTNPMVLDLS

SEQ ID NO: 68571 - protein, 13 aa, Mycobacterium tuberculosis
SLGTNPMVLDLSE

SEQ ID NO: 68572 - protein, 13 aa, Mycobacterium tuberculosis
LGTNPMVLDLSEL

SEQ ID NO: 68573 - protein, 13 aa, Mycobacterium tuberculosis
GTNPMVLDLSELS

SEQ ID NO: 68574 - protein, 13 aa, Mycobacterium tuberculosis
TNPMVLDLSELSH

SEQ ID NO: 68575 - protein, 13 aa, Mycobacterium tuberculosis
NPMVLDLSELSHF

SEQ ID NO: 68576 - protein, 13 aa, Mycobacterium tuberculosis
PMVLDLSELSHFS

SEQ ID NO: 68577 - protein, 13 aa, Mycobacterium tuberculosis
MVLDLSELSHFSG

SEQ ID NO: 68578 - protein, 13 aa, Mycobacterium tuberculosis
VLDLSELSHFSGA

SEQ ID NO: 68579 - protein, 13 aa, Mycobacterium tuberculosis
LDLSELSHFSGAG

SEQ ID NO: 68580 - protein, 13 aa, Mycobacterium tuberculosis
DLSELSHFSGAGI

SEQ ID NO: 68581 - protein, 13 aa, Mycobacterium tuberculosis
LSELSHFSGAGIS

SEQ ID NO: 68582 - protein, 13 aa, Mycobacterium tuberculosis
SELSHFSGAGISL

SEQ ID NO: 68583 - protein, 13 aa, Mycobacterium tuberculosis
ELSHFSGAGISLL

SEQ ID NO: 68584 - protein, 13 aa, Mycobacterium tuberculosis
LSHFSGAGISLLC

SEQ ID NO: 68585 - protein, 13 aa, Mycobacterium tuberculosis
SHFSGAGISLLCI

SEQ ID NO: 68586 - protein, 13 aa, Mycobacterium tuberculosis
HFSGAGISLLCIL

SEQ ID NO: 68587 - protein, 13 aa, Mycobacterium tuberculosis
FSGAGISLLCILD

SEQ ID NO: 68588 - protein, 13 aa, Mycobacterium tuberculosis
SGAGISLLCILDE

SEQ ID NO: 68589 - protein, 13 aa, Mycobacterium tuberculosis
GAGISLLCILDED

SEQ ID NO: 68590 - protein, 13 aa, Mycobacterium tuberculosis
AGISLLCILDEDC

SEQ ID NO: 68591 - protein, 13 aa, Mycobacterium tuberculosis
GISLLCILDEDCR

SEQ ID NO: 68592 - protein, 13 aa, Mycobacterium tuberculosis
ISLLCILDEDCRA

SEQ ID NO: 68593 - protein, 13 aa, Mycobacterium tuberculosis
SLLCILDEDCRAA

SEQ ID NO: 68594 - protein, 13 aa, Mycobacterium tuberculosis
LLCILDEDCRAAG

SEQ ID NO: 68595 - protein, 13 aa, Mycobacterium tuberculosis
LCILDEDCRAAGV

SEQ ID NO: 68596 - protein, 13 aa, Mycobacterium tuberculosis
CILDEDCRAAGVQ

SEQ ID NO: 68597 - protein, 13 aa, Mycobacterium tuberculosis
ILDEDCRAAGVQW

SEQ ID NO: 68598 - protein, 13 aa, Mycobacterium tuberculosis
LDEDCRAAGVQWA

SEQ ID NO: 68599 - protein, 13 aa, Mycobacterium tuberculosis
DEDCRAAGVQWAL

SEQ ID NO: 68600 - protein, 13 aa, Mycobacterium tuberculosis
EDCRAAGVQWALV

SEQ ID NO: 68601 - protein, 13 aa, Mycobacterium tuberculosis
DCRAAGVQWALVA

SEQ ID NO: 68602 - protein, 13 aa, Mycobacterium tuberculosis
CRAAGVQWALVAS

SEQ ID NO: 68603 - protein, 13 aa, Mycobacterium tuberculosis
RAAGVQWALVASP

SEQ ID NO: 68604 - protein, 13 aa, Mycobacterium tuberculosis
AAGVQWALVASPA

SEQ ID NO: 68605 - protein, 13 aa, Mycobacterium tuberculosis
AGVQWALVASPAV

SEQ ID NO: 68606 - protein, 13 aa, Mycobacterium tuberculosis
GVQWALVASPAVV

SEQ ID NO: 68607 - protein, 13 aa, Mycobacterium tuberculosis
VQWALVASPAVVE

SEQ ID NO: 68608 - protein, 13 aa, Mycobacterium tuberculosis
QWALVASPAVVEQ

SEQ ID NO: 68609 - protein, 13 aa, Mycobacterium tuberculosis
WALVASPAVVEQL

SEQ ID NO: 68610 - protein, 13 aa, Mycobacterium tuberculosis
ALVASPAVVEQLG

SEQ ID NO: 68611 - protein, 13 aa, Mycobacterium tuberculosis
LVASPAVVEQLGG

SEQ ID NO: 68612 - protein, 13 aa, Mycobacterium tuberculosis
VASPAVVEQLGGR

SEQ ID NO: 68613 - protein, 13 aa, Mycobacterium tuberculosis
ASPAVVEQLGGRC

SEQ ID NO: 68614 - protein, 13 aa, Mycobacterium tuberculosis
SPAVVEQLGGRCD

SEQ ID NO: 68615 - protein, 13 aa, Mycobacterium tuberculosis
PAVVEQLGGRCDQ

SEQ ID NO: 68616 - protein, 13 aa, Mycobacterium tuberculosis
AVVEQLGGRCDQG

SEQ ID NO: 68617 - protein, 13 aa, Mycobacterium tuberculosis
VVEQLGGRCDQGE

SEQ ID NO: 68618 - protein, 13 aa, Mycobacterium tuberculosis
VEQLGGRCDQGEH

SEQ ID NO: 68619 - protein, 13 aa, Mycobacterium tuberculosis
EQLGGRCDQGEHE

SEQ ID NO: 68620 - protein, 13 aa, Mycobacterium tuberculosis
QLGGRCDQGEHES

SEQ ID NO: 68621 - protein, 13 aa, Mycobacterium tuberculosis
LGGRCDQGEHESM

SEQ ID NO: 68622 - protein, 13 aa, Mycobacterium tuberculosis
GGRCDQGEHESMF

SEQ ID NO: 68623 - protein, 13 aa, Mycobacterium tuberculosis
GRCDQGEHESMFP

SEQ ID NO: 68624 - protein, 13 aa, Mycobacterium tuberculosis
RCDQGEHESMFPM

SEQ ID NO: 68625 - protein, 13 aa, Mycobacterium tuberculosis
CDQGEHESMFPMA

SEQ ID NO: 68626 - protein, 13 aa, Mycobacterium tuberculosis
DQGEHESMFPMAR

SEQ ID NO: 68627 - protein, 13 aa, Mycobacterium tuberculosis
QGEHESMFPMARS

SEQ ID NO: 68628 - protein, 13 aa, Mycobacterium tuberculosis
GEHESMFPMARSV

SEQ ID NO: 68629 - protein, 13 aa, Mycobacterium tuberculosis
EHESMFPMARSVH

SEQ ID NO: 68630 - protein, 13 aa, Mycobacterium tuberculosis
HESMFPMARSVHK

SEQ ID NO: 68631 - protein, 13 aa, Mycobacterium tuberculosis
ESMFPMARSVHKA

SEQ ID NO: 68632 - protein, 13 aa, Mycobacterium tuberculosis
SMFPMARSVHKAL

SEQ ID NO: 68633 - protein, 13 aa, Mycobacterium tuberculosis
MFPMARSVHKALH

SEQ ID NO: 68634 - protein, 13 aa, Mycobacterium tuberculosis
FPMARSVHKALHD

SEQ ID NO: 68635 - protein, 13 aa, Mycobacterium tuberculosis
PMARSVHKALHDL

SEQ ID NO: 68636 - protein, 13 aa, Mycobacterium tuberculosis
MARSVHKALHDLA

SEQ ID NO: 68637 - protein, 13 aa, Mycobacterium tuberculosis
ARSVHKALHDLAD

SEQ ID NO: 68638 - protein, 13 aa, Mycobacterium tuberculosis
RSVHKALHDLADA

SEQ ID NO: 68639 - protein, 13 aa, Mycobacterium tuberculosis
SVHKALHDLADAI

SEQ ID NO: 68640 - protein, 13 aa, Mycobacterium tuberculosis
VHKALHDLADAID

SEQ ID NO: 68641 - protein, 13 aa, Mycobacterium tuberculosis
HKALHDLADAIDR

SEQ ID NO: 68642 - protein, 13 aa, Mycobacterium tuberculosis
KALHDLADAIDRR

SEQ ID NO: 68643 - protein, 13 aa, Mycobacterium tuberculosis
ALHDLADAIDRRR

SEQ ID NO: 68644 - protein, 13 aa, Mycobacterium tuberculosis
LHDLADAIDRRRQ

SEQ ID NO: 68645 - protein, 13 aa, Mycobacterium tuberculosis
HDLADAIDRRRQL

SEQ ID NO: 68646 - protein, 13 aa, Mycobacterium tuberculosis
DLADAIDRRRQLV

SEQ ID NO: 68647 - protein, 13 aa, Mycobacterium tuberculosis
LADAIDRRRQLVL

SEQ ID NO: 68648 - protein, 13 aa, Mycobacterium tuberculosis
ADAIDRRRQLVLP

SEQ ID NO: 68649 - protein, 13 aa, Mycobacterium tuberculosis
DAIDRRRQLVLPL

SEQ ID NO: 68650 - protein, 13 aa, Mycobacterium tuberculosis
AIDRRRQLVLPLI

SEQ ID NO: 68651 - protein, 13 aa, Mycobacterium tuberculosis
IDRRRQLVLPLIS

SEQ ID NO: 68652 - protein, 13 aa, Mycobacterium tuberculosis
DRRRQLVLPLISR

SEQ ID NO: 68653 - protein, 13 aa, Mycobacterium tuberculosis
RRRQLVLPLISRS

SEQ ID NO: 68654 - protein, 13 aa, Mycobacterium tuberculosis
RRQLVLPLISRSA

SEQ ID NO: 68655 - protein, 14 aa, Mycobacterium tuberculosis
MTTTIPTSKSACSV

SEQ ID NO: 68656 - protein, 14 aa, Mycobacterium tuberculosis
TTTIPTSKSACSVT

SEQ ID NO: 68657 - protein, 14 aa, Mycobacterium tuberculosis
TTIPTSKSACSVTT

SEQ ID NO: 68658 - protein, 14 aa, Mycobacterium tuberculosis
TIPTSKSACSVTTR

SEQ ID NO: 68659 - protein, 14 aa, Mycobacterium tuberculosis
IPTSKSACSVTTRP

SEQ ID NO: 68660 - protein, 14 aa, Mycobacterium tuberculosis
PTSKSACSVTTRPG

SEQ ID NO: 68661 - protein, 14 aa, Mycobacterium tuberculosis
TSKSACSVTTRPGN

SEQ ID NO: 68662 - protein, 14 aa, Mycobacterium tuberculosis
SKSACSVTTRPGNA

SEQ ID NO: 68663 - protein, 14 aa, Mycobacterium tuberculosis
KSACSVTTRPGNAA

SEQ ID NO: 68664 - protein, 14 aa, Mycobacterium tuberculosis
SACSVTTRPGNAAV

SEQ ID NO: 68665 - protein, 14 aa, Mycobacterium tuberculosis
ACSVTTRPGNAAVD

SEQ ID NO: 68666 - protein, 14 aa, Mycobacterium tuberculosis
CSVTTRPGNAAVDY

SEQ ID NO: 68667 - protein, 14 aa, Mycobacterium tuberculosis
SVTTRPGNAAVDYG

SEQ ID NO: 68668 - protein, 14 aa, Mycobacterium tuberculosis
VTTRPGNAAVDYGG

SEQ ID NO: 68669 - protein, 14 aa, Mycobacterium tuberculosis
TTRPGNAAVDYGGA

SEQ ID NO: 68670 - protein, 14 aa, Mycobacterium tuberculosis
TRPGNAAVDYGGAQ

SEQ ID NO: 68671 - protein, 14 aa, Mycobacterium tuberculosis
RPGNAAVDYGGAQI

SEQ ID NO: 68672 - protein, 14 aa, Mycobacterium tuberculosis
PGNAAVDYGGAQIR

SEQ ID NO: 68673 - protein, 14 aa, Mycobacterium tuberculosis
GNAAVDYGGAQIRA

SEQ ID NO: 68674 - protein, 14 aa, Mycobacterium tuberculosis
NAAVDYGGAQIRAY

SEQ ID NO: 68675 - protein, 14 aa, Mycobacterium tuberculosis
AAVDYGGAQIRAYL

SEQ ID NO: 68676 - protein, 14 aa, Mycobacterium tuberculosis
AVDYGGAQIRAYLH

SEQ ID NO: 68677 - protein, 14 aa, Mycobacterium tuberculosis
VDYGGAQIRAYLHH

SEQ ID NO: 68678 - protein, 14 aa, Mycobacterium tuberculosis
DYGGAQIRAYLHHL

SEQ ID NO: 68679 - protein, 14 aa, Mycobacterium tuberculosis
YGGAQIRAYLHHLA

SEQ ID NO: 68680 - protein, 14 aa, Mycobacterium tuberculosis
GGAQIRAYLHHLAT

SEQ ID NO: 68681 - protein, 14 aa, Mycobacterium tuberculosis
GAQIRAYLHHLATV

SEQ ID NO: 68682 - protein, 14 aa, Mycobacterium tuberculosis
AQIRAYLHHLATVV

SEQ ID NO: 68683 - protein, 14 aa, Mycobacterium tuberculosis
QIRAYLHHLATVVT

SEQ ID NO: 68684 - protein, 14 aa, Mycobacterium tuberculosis
IRAYLHHLATVVTI

SEQ ID NO: 68685 - protein, 14 aa, Mycobacterium tuberculosis
RAYLHHLATVVTIR

SEQ ID NO: 68686 - protein, 14 aa, Mycobacterium tuberculosis
AYLHHLATVVTIRG

SEQ ID NO: 68687 - protein, 14 aa, Mycobacterium tuberculosis
YLHHLATVVTIRGE

SEQ ID NO: 68688 - protein, 14 aa, Mycobacterium tuberculosis
LHHLATVVTIRGEI

SEQ ID NO: 68689 - protein, 14 aa, Mycobacterium tuberculosis
HHLATVVTIRGEID

SEQ ID NO: 68690 - protein, 14 aa, Mycobacterium tuberculosis
HLATVVTIRGEIDA

SEQ ID NO: 68691 - protein, 14 aa, Mycobacterium tuberculosis
LATVVTIRGEIDAA

SEQ ID NO: 68692 - protein, 14 aa, Mycobacterium tuberculosis
ATVVTIRGEIDAAN

SEQ ID NO: 68693 - protein, 14 aa, Mycobacterium tuberculosis
TVVTIRGEIDAANV

SEQ ID NO: 68694 - protein, 14 aa, Mycobacterium tuberculosis
VVTIRGEIDAANVE

SEQ ID NO: 68695 - protein, 14 aa, Mycobacterium tuberculosis
VTIRGEIDAANVEQ

SEQ ID NO: 68696 - protein, 14 aa, Mycobacterium tuberculosis
TIRGEIDAANVEQI

SEQ ID NO: 68697 - protein, 14 aa, Mycobacterium tuberculosis
IRGEIDAANVEQIS

SEQ ID NO: 68698 - protein, 14 aa, Mycobacterium tuberculosis
RGEIDAANVEQISE

SEQ ID NO: 68699 - protein, 14 aa, Mycobacterium tuberculosis
GEIDAANVEQISEH

SEQ ID NO: 68700 - protein, 14 aa, Mycobacterium tuberculosis
EIDAANVEQISEHV

SEQ ID NO: 68701 - protein, 14 aa, Mycobacterium tuberculosis
IDAANVEQISEHVR

SEQ ID NO: 68702 - protein, 14 aa, Mycobacterium tuberculosis
DAANVEQISEHVRR

SEQ ID NO: 68703 - protein, 14 aa, Mycobacterium tuberculosis
AANVEQISEHVRRF

SEQ ID NO: 68704 - protein, 14 aa, Mycobacterium tuberculosis
ANVEQISEHVRRFS

SEQ ID NO: 68705 - protein, 14 aa, Mycobacterium tuberculosis
NVEQISEHVRRFSL

SEQ ID NO: 68706 - protein, 14 aa, Mycobacterium tuberculosis
VEQISEHVRRFSLG

SEQ ID NO: 68707 - protein, 14 aa, Mycobacterium tuberculosis
EQISEHVRRFSLGT

SEQ ID NO: 68708 - protein, 14 aa, Mycobacterium tuberculosis
QISEHVRRFSLGTN

SEQ ID NO: 68709 - protein, 14 aa, Mycobacterium tuberculosis
ISEHVRRFSLGTNP

SEQ ID NO: 68710 - protein, 14 aa, Mycobacterium tuberculosis
SEHVRRFSLGTNPM

SEQ ID NO: 68711 - protein, 14 aa, Mycobacterium tuberculosis
EHVRRFSLGTNPMV

SEQ ID NO: 68712 - protein, 14 aa, Mycobacterium tuberculosis
HVRRFSLGTNPMVL

SEQ ID NO: 68713 - protein, 14 aa, Mycobacterium tuberculosis
VRRFSLGTNPMVLD

SEQ ID NO: 68714 - protein, 14 aa, Mycobacterium tuberculosis
RRFSLGTNPMVLDL

SEQ ID NO: 68715 - protein, 14 aa, Mycobacterium tuberculosis
RFSLGTNPMVLDLS

SEQ ID NO: 68716 - protein, 14 aa, Mycobacterium tuberculosis
FSLGTNPMVLDLSE

SEQ ID NO: 68717 - protein, 14 aa, Mycobacterium tuberculosis
SLGTNPMVLDLSEL

SEQ ID NO: 68718 - protein, 14 aa, Mycobacterium tuberculosis
LGTNPMVLDLSELS

SEQ ID NO: 68719 - protein, 14 aa, Mycobacterium tuberculosis
GTNPMVLDLSELSH

SEQ ID NO: 68720 - protein, 14 aa, Mycobacterium tuberculosis
TNPMVLDLSELSHF

SEQ ID NO: 68721 - protein, 14 aa, Mycobacterium tuberculosis
NPMVLDLSELSHFS

SEQ ID NO: 68722 - protein, 14 aa, Mycobacterium tuberculosis
PMVLDLSELSHFSG

SEQ ID NO: 68723 - protein, 14 aa, Mycobacterium tuberculosis
MVLDLSELSHFSGA

SEQ ID NO: 68724 - protein, 14 aa, Mycobacterium tuberculosis
VLDLSELSHFSGAG

SEQ ID NO: 68725 - protein, 14 aa, Mycobacterium tuberculosis
LDLSELSHFSGAGI

SEQ ID NO: 68726 - protein, 14 aa, Mycobacterium tuberculosis
DLSELSHFSGAGIS

SEQ ID NO: 68727 - protein, 14 aa, Mycobacterium tuberculosis
LSELSHFSGAGISL

SEQ ID NO: 68728 - protein, 14 aa, Mycobacterium tuberculosis
SELSHFSGAGISLL

SEQ ID NO: 68729 - protein, 14 aa, Mycobacterium tuberculosis
ELSHFSGAGISLLC

SEQ ID NO: 68730 - protein, 14 aa, Mycobacterium tuberculosis
LSHFSGAGISLLCI

SEQ ID NO: 68731 - protein, 14 aa, Mycobacterium tuberculosis
SHFSGAGISLLCIL

SEQ ID NO: 68732 - protein, 14 aa, Mycobacterium tuberculosis
HFSGAGISLLCILD

SEQ ID NO: 68733 - protein, 14 aa, Mycobacterium tuberculosis
FSGAGISLLCILDE

SEQ ID NO: 68734 - protein, 14 aa, Mycobacterium tuberculosis
SGAGISLLCILDED

SEQ ID NO: 68735 - protein, 14 aa, Mycobacterium tuberculosis
GAGISLLCILDEDC

SEQ ID NO: 68736 - protein, 14 aa, Mycobacterium tuberculosis
AGISLLCILDEDCR

SEQ ID NO: 68737 - protein, 14 aa, Mycobacterium tuberculosis
GISLLCILDEDCRA

SEQ ID NO: 68738 - protein, 14 aa, Mycobacterium tuberculosis
ISLLCILDEDCRAA

SEQ ID NO: 68739 - protein, 14 aa, Mycobacterium tuberculosis
SLLCILDEDCRAAG

SEQ ID NO: 68740 - protein, 14 aa, Mycobacterium tuberculosis
LLCILDEDCRAAGV

SEQ ID NO: 68741 - protein, 14 aa, Mycobacterium tuberculosis
LCILDEDCRAAGVQ

SEQ ID NO: 68742 - protein, 14 aa, Mycobacterium tuberculosis
CILDEDCRAAGVQW

SEQ ID NO: 68743 - protein, 14 aa, Mycobacterium tuberculosis
ILDEDCRAAGVQWA

SEQ ID NO: 68744 - protein, 14 aa, Mycobacterium tuberculosis
LDEDCRAAGVQWAL

SEQ ID NO: 68745 - protein, 14 aa, Mycobacterium tuberculosis
DEDCRAAGVQWALV

SEQ ID NO: 68746 - protein, 14 aa, Mycobacterium tuberculosis
EDCRAAGVQWALVA

SEQ ID NO: 68747 - protein, 14 aa, Mycobacterium tuberculosis
DCRAAGVQWALVAS

SEQ ID NO: 68748 - protein, 14 aa, Mycobacterium tuberculosis
CRAAGVQWALVASP

SEQ ID NO: 68749 - protein, 14 aa, Mycobacterium tuberculosis
RAAGVQWALVASPA

SEQ ID NO: 68750 - protein, 14 aa, Mycobacterium tuberculosis
AAGVQWALVASPAV

SEQ ID NO: 68751 - protein, 14 aa, Mycobacterium tuberculosis
AGVQWALVASPAVV

SEQ ID NO: 68752 - protein, 14 aa, Mycobacterium tuberculosis
GVQWALVASPAVVE

SEQ ID NO: 68753 - protein, 14 aa, Mycobacterium tuberculosis
VQWALVASPAVVEQ

SEQ ID NO: 68754 - protein, 14 aa, Mycobacterium tuberculosis
QWALVASPAVVEQL

SEQ ID NO: 68755 - protein, 14 aa, Mycobacterium tuberculosis
WALVASPAVVEQLG

SEQ ID NO: 68756 - protein, 14 aa, Mycobacterium tuberculosis
ALVASPAVVEQLGG

SEQ ID NO: 68757 - protein, 14 aa, Mycobacterium tuberculosis
LVASPAVVEQLGGR

SEQ ID NO: 68758 - protein, 14 aa, Mycobacterium tuberculosis
VASPAVVEQLGGRC

SEQ ID NO: 68759 - protein, 14 aa, Mycobacterium tuberculosis
ASPAVVEQLGGRCD

SEQ ID NO: 68760 - protein, 14 aa, Mycobacterium tuberculosis
SPAVVEQLGGRCDQ

SEQ ID NO: 68761 - protein, 14 aa, Mycobacterium tuberculosis
PAVVEQLGGRCDQG

SEQ ID NO: 68762 - protein, 14 aa, Mycobacterium tuberculosis
AVVEQLGGRCDQGE

SEQ ID NO: 68763 - protein, 14 aa, Mycobacterium tuberculosis
VVEQLGGRCDQGEH

SEQ ID NO: 68764 - protein, 14 aa, Mycobacterium tuberculosis
VEQLGGRCDQGEHE

SEQ ID NO: 68765 - protein, 14 aa, Mycobacterium tuberculosis
EQLGGRCDQGEHES

SEQ ID NO: 68766 - protein, 14 aa, Mycobacterium tuberculosis
QLGGRCDQGEHESM

SEQ ID NO: 68767 - protein, 14 aa, Mycobacterium tuberculosis
LGGRCDQGEHESMF

SEQ ID NO: 68768 - protein, 14 aa, Mycobacterium tuberculosis
GGRCDQGEHESMFP

SEQ ID NO: 68769 - protein, 14 aa, Mycobacterium tuberculosis
GRCDQGEHESMFPM

SEQ ID NO: 68770 - protein, 14 aa, Mycobacterium tuberculosis
RCDQGEHESMFPMA

SEQ ID NO: 68771 - protein, 14 aa, Mycobacterium tuberculosis
CDQGEHESMFPMAR

SEQ ID NO: 68772 - protein, 14 aa, Mycobacterium tuberculosis
DQGEHESMFPMARS

SEQ ID NO: 68773 - protein, 14 aa, Mycobacterium tuberculosis
QGEHESMFPMARSV

SEQ ID NO: 68774 - protein, 14 aa, Mycobacterium tuberculosis
GEHESMFPMARSVH

SEQ ID NO: 68775 - protein, 14 aa, Mycobacterium tuberculosis
EHESMFPMARSVHK

SEQ ID NO: 68776 - protein, 14 aa, Mycobacterium tuberculosis
HESMFPMARSVHKA

SEQ ID NO: 68777 - protein, 14 aa, Mycobacterium tuberculosis
ESMFPMARSVHKAL

SEQ ID NO: 68778 - protein, 14 aa, Mycobacterium tuberculosis
SMFPMARSVHKALH

SEQ ID NO: 68779 - protein, 14 aa, Mycobacterium tuberculosis
MFPMARSVHKALHD

SEQ ID NO: 68780 - protein, 14 aa, Mycobacterium tuberculosis
FPMARSVHKALHDL

SEQ ID NO: 68781 - protein, 14 aa, Mycobacterium tuberculosis
PMARSVHKALHDLA

SEQ ID NO: 68782 - protein, 14 aa, Mycobacterium tuberculosis
MARSVHKALHDLAD

SEQ ID NO: 68783 - protein, 14 aa, Mycobacterium tuberculosis
ARSVHKALHDLADA

SEQ ID NO: 68784 - protein, 14 aa, Mycobacterium tuberculosis
RSVHKALHDLADAI

SEQ ID NO: 68785 - protein, 14 aa, Mycobacterium tuberculosis
SVHKALHDLADAID

SEQ ID NO: 68786 - protein, 14 aa, Mycobacterium tuberculosis
VHKALHDLADAIDR

SEQ ID NO: 68787 - protein, 14 aa, Mycobacterium tuberculosis
HKALHDLADAIDRR

SEQ ID NO: 68788 - protein, 14 aa, Mycobacterium tuberculosis
KALHDLADAIDRRR

SEQ ID NO: 68789 - protein, 14 aa, Mycobacterium tuberculosis
ALHDLADAIDRRRQ

SEQ ID NO: 68790 - protein, 14 aa, Mycobacterium tuberculosis
LHDLADAIDRRRQL

SEQ ID NO: 68791 - protein, 14 aa, Mycobacterium tuberculosis
HDLADAIDRRRQLV

SEQ ID NO: 68792 - protein, 14 aa, Mycobacterium tuberculosis
DLADAIDRRRQLVL

SEQ ID NO: 68793 - protein, 14 aa, Mycobacterium tuberculosis
LADAIDRRRQLVLP

SEQ ID NO: 68794 - protein, 14 aa, Mycobacterium tuberculosis
ADAIDRRRQLVLPL

SEQ ID NO: 68795 - protein, 14 aa, Mycobacterium tuberculosis
DAIDRRRQLVLPLI

SEQ ID NO: 68796 - protein, 14 aa, Mycobacterium tuberculosis
AIDRRRQLVLPLIS

SEQ ID NO: 68797 - protein, 14 aa, Mycobacterium tuberculosis
IDRRRQLVLPLISR

SEQ ID NO: 68798 - protein, 14 aa, Mycobacterium tuberculosis
DRRRQLVLPLISRS

SEQ ID NO: 68799 - protein, 14 aa, Mycobacterium tuberculosis
RRRQLVLPLISRSA

SEQ ID NO: 68800 - protein, 15 aa, Mycobacterium tuberculosis
MTTTIPTSKSACSVT

SEQ ID NO: 68801 - protein, 15 aa, Mycobacterium tuberculosis
TTTIPTSKSACSVTT

SEQ ID NO: 68802 - protein, 15 aa, Mycobacterium tuberculosis
TTIPTSKSACSVTTR

SEQ ID NO: 68803 - protein, 15 aa, Mycobacterium tuberculosis
TIPTSKSACSVTTRP

SEQ ID NO: 68804 - protein, 15 aa, Mycobacterium tuberculosis
IPTSKSACSVTTRPG

SEQ ID NO: 68805 - protein, 15 aa, Mycobacterium tuberculosis
PTSKSACSVTTRPGN

SEQ ID NO: 68806 - protein, 15 aa, Mycobacterium tuberculosis
TSKSACSVTTRPGNA

SEQ ID NO: 68807 - protein, 15 aa, Mycobacterium tuberculosis
SKSACSVTTRPGNAA

SEQ ID NO: 68808 - protein, 15 aa, Mycobacterium tuberculosis
KSACSVTTRPGNAAV

SEQ ID NO: 68809 - protein, 15 aa, Mycobacterium tuberculosis
SACSVTTRPGNAAVD

SEQ ID NO: 68810 - protein, 15 aa, Mycobacterium tuberculosis
ACSVTTRPGNAAVDY

SEQ ID NO: 68811 - protein, 15 aa, Mycobacterium tuberculosis
CSVTTRPGNAAVDYG

SEQ ID NO: 68812 - protein, 15 aa, Mycobacterium tuberculosis
SVTTRPGNAAVDYGG

SEQ ID NO: 68813 - protein, 15 aa, Mycobacterium tuberculosis
VTTRPGNAAVDYGGA

SEQ ID NO: 68814 - protein, 15 aa, Mycobacterium tuberculosis
TTRPGNAAVDYGGAQ

SEQ ID NO: 68815 - protein, 15 aa, Mycobacterium tuberculosis
TRPGNAAVDYGGAQI

SEQ ID NO: 68816 - protein, 15 aa, Mycobacterium tuberculosis
RPGNAAVDYGGAQIR

SEQ ID NO: 68817 - protein, 15 aa, Mycobacterium tuberculosis
PGNAAVDYGGAQIRA

SEQ ID NO: 68818 - protein, 15 aa, Mycobacterium tuberculosis
GNAAVDYGGAQIRAY

SEQ ID NO: 68819 - protein, 15 aa, Mycobacterium tuberculosis
NAAVDYGGAQIRAYL

SEQ ID NO: 68820 - protein, 15 aa, Mycobacterium tuberculosis
AAVDYGGAQIRAYLH

SEQ ID NO: 68821 - protein, 15 aa, Mycobacterium tuberculosis
AVDYGGAQIRAYLHH

SEQ ID NO: 68822 - protein, 15 aa, Mycobacterium tuberculosis
VDYGGAQIRAYLHHL

SEQ ID NO: 68823 - protein, 15 aa, Mycobacterium tuberculosis
DYGGAQIRAYLHHLA

SEQ ID NO: 68824 - protein, 15 aa, Mycobacterium tuberculosis
YGGAQIRAYLHHLAT

SEQ ID NO: 68825 - protein, 15 aa, Mycobacterium tuberculosis
GGAQIRAYLHHLATV

SEQ ID NO: 68826 - protein, 15 aa, Mycobacterium tuberculosis
GAQIRAYLHHLATVV

SEQ ID NO: 68827 - protein, 15 aa, Mycobacterium tuberculosis
AQIRAYLHHLATVVT

SEQ ID NO: 68828 - protein, 15 aa, Mycobacterium tuberculosis
QIRAYLHHLATVVTI

SEQ ID NO: 68829 - protein, 15 aa, Mycobacterium tuberculosis
IRAYLHHLATVVTIR

SEQ ID NO: 68830 - protein, 15 aa, Mycobacterium tuberculosis
RAYLHHLATVVTIRG

SEQ ID NO: 68831 - protein, 15 aa, Mycobacterium tuberculosis
AYLHHLATVVTIRGE

SEQ ID NO: 68832 - protein, 15 aa, Mycobacterium tuberculosis
YLHHLATVVTIRGEI

SEQ ID NO: 68833 - protein, 15 aa, Mycobacterium tuberculosis
LHHLATVVTIRGEID

SEQ ID NO: 68834 - protein, 15 aa, Mycobacterium tuberculosis
HHLATVVTIRGEIDA

SEQ ID NO: 68835 - protein, 15 aa, Mycobacterium tuberculosis
HLATVVTIRGEIDAA

SEQ ID NO: 68836 - protein, 15 aa, Mycobacterium tuberculosis
LATVVTIRGEIDAAN

SEQ ID NO: 68837 - protein, 15 aa, Mycobacterium tuberculosis
ATVVTIRGEIDAANV

SEQ ID NO: 68838 - protein, 15 aa, Mycobacterium tuberculosis
TVVTIRGEIDAANVE

SEQ ID NO: 68839 - protein, 15 aa, Mycobacterium tuberculosis
VVTIRGEIDAANVEQ

SEQ ID NO: 68840 - protein, 15 aa, Mycobacterium tuberculosis
VTIRGEIDAANVEQI

SEQ ID NO: 68841 - protein, 15 aa, Mycobacterium tuberculosis
TIRGEIDAANVEQIS

SEQ ID NO: 68842 - protein, 15 aa, Mycobacterium tuberculosis
IRGEIDAANVEQISE

SEQ ID NO: 68843 - protein, 15 aa, Mycobacterium tuberculosis
RGEIDAANVEQISEH

SEQ ID NO: 68844 - protein, 15 aa, Mycobacterium tuberculosis
GEIDAANVEQISEHV

SEQ ID NO: 68845 - protein, 15 aa, Mycobacterium tuberculosis
EIDAANVEQISEHVR

SEQ ID NO: 68846 - protein, 15 aa, Mycobacterium tuberculosis
IDAANVEQISEHVRR

SEQ ID NO: 68847 - protein, 15 aa, Mycobacterium tuberculosis
DAANVEQISEHVRRF

SEQ ID NO: 68848 - protein, 15 aa, Mycobacterium tuberculosis
AANVEQISEHVRRFS

SEQ ID NO: 68849 - protein, 15 aa, Mycobacterium tuberculosis
ANVEQISEHVRRFSL

SEQ ID NO: 68850 - protein, 15 aa, Mycobacterium tuberculosis
NVEQISEHVRRFSLG

SEQ ID NO: 68851 - protein, 15 aa, Mycobacterium tuberculosis
VEQISEHVRRFSLGT

SEQ ID NO: 68852 - protein, 15 aa, Mycobacterium tuberculosis
EQISEHVRRFSLGTN

SEQ ID NO: 68853 - protein, 15 aa, Mycobacterium tuberculosis
QISEHVRRFSLGTNP

SEQ ID NO: 68854 - protein, 15 aa, Mycobacterium tuberculosis
ISEHVRRFSLGTNPM

SEQ ID NO: 68855 - protein, 15 aa, Mycobacterium tuberculosis
SEHVRRFSLGTNPMV

SEQ ID NO: 68856 - protein, 15 aa, Mycobacterium tuberculosis
EHVRRFSLGTNPMVL

SEQ ID NO: 68857 - protein, 15 aa, Mycobacterium tuberculosis
HVRRFSLGTNPMVLD

SEQ ID NO: 68858 - protein, 15 aa, Mycobacterium tuberculosis
VRRFSLGTNPMVLDL

SEQ ID NO: 68859 - protein, 15 aa, Mycobacterium tuberculosis
RRFSLGTNPMVLDLS

SEQ ID NO: 68860 - protein, 15 aa, Mycobacterium tuberculosis
RFSLGTNPMVLDLSE

SEQ ID NO: 68861 - protein, 15 aa, Mycobacterium tuberculosis
FSLGTNPMVLDLSEL

SEQ ID NO: 68862 - protein, 15 aa, Mycobacterium tuberculosis
SLGTNPMVLDLSELS

SEQ ID NO: 68863 - protein, 15 aa, Mycobacterium tuberculosis
LGTNPMVLDLSELSH

SEQ ID NO: 68864 - protein, 15 aa, Mycobacterium tuberculosis
GTNPMVLDLSELSHF

SEQ ID NO: 68865 - protein, 15 aa, Mycobacterium tuberculosis
TNPMVLDLSELSHFS

SEQ ID NO: 68866 - protein, 15 aa, Mycobacterium tuberculosis
NPMVLDLSELSHFSG

SEQ ID NO: 68867 - protein, 15 aa, Mycobacterium tuberculosis
PMVLDLSELSHFSGA

SEQ ID NO: 68868 - protein, 15 aa, Mycobacterium tuberculosis
MVLDLSELSHFSGAG

SEQ ID NO: 68869 - protein, 15 aa, Mycobacterium tuberculosis
VLDLSELSHFSGAGI

SEQ ID NO: 68870 - protein, 15 aa, Mycobacterium tuberculosis
LDLSELSHFSGAGIS

SEQ ID NO: 68871 - protein, 15 aa, Mycobacterium tuberculosis
DLSELSHFSGAGISL

SEQ ID NO: 68872 - protein, 15 aa, Mycobacterium tuberculosis
LSELSHFSGAGISLL

SEQ ID NO: 68873 - protein, 15 aa, Mycobacterium tuberculosis
SELSHFSGAGISLLC

SEQ ID NO: 68874 - protein, 15 aa, Mycobacterium tuberculosis
ELSHFSGAGISLLCI

SEQ ID NO: 68875 - protein, 15 aa, Mycobacterium tuberculosis
LSHFSGAGISLLCIL

SEQ ID NO: 68876 - protein, 15 aa, Mycobacterium tuberculosis
SHFSGAGISLLCILD

SEQ ID NO: 68877 - protein, 15 aa, Mycobacterium tuberculosis
HFSGAGISLLCILDE

SEQ ID NO: 68878 - protein, 15 aa, Mycobacterium tuberculosis
FSGAGISLLCILDED

SEQ ID NO: 68879 - protein, 15 aa, Mycobacterium tuberculosis
SGAGISLLCILDEDC

SEQ ID NO: 68880 - protein, 15 aa, Mycobacterium tuberculosis
GAGISLLCILDEDCR

SEQ ID NO: 68881 - protein, 15 aa, Mycobacterium tuberculosis
AGISLLCILDEDCRA

SEQ ID NO: 68882 - protein, 15 aa, Mycobacterium tuberculosis
GISLLCILDEDCRAA

SEQ ID NO: 68883 - protein, 15 aa, Mycobacterium tuberculosis
ISLLCILDEDCRAAG

SEQ ID NO: 68884 - protein, 15 aa, Mycobacterium tuberculosis
SLLCILDEDCRAAGV

SEQ ID NO: 68885 - protein, 15 aa, Mycobacterium tuberculosis
LLCILDEDCRAAGVQ

SEQ ID NO: 68886 - protein, 15 aa, Mycobacterium tuberculosis
LCILDEDCRAAGVQW

SEQ ID NO: 68887 - protein, 15 aa, Mycobacterium tuberculosis
CILDEDCRAAGVQWA

SEQ ID NO: 68888 - protein, 15 aa, Mycobacterium tuberculosis
ILDEDCRAAGVQWAL

SEQ ID NO: 68889 - protein, 15 aa, Mycobacterium tuberculosis
LDEDCRAAGVQWALV

SEQ ID NO: 68890 - protein, 15 aa, Mycobacterium tuberculosis
DEDCRAAGVQWALVA

SEQ ID NO: 68891 - protein, 15 aa, Mycobacterium tuberculosis
EDCRAAGVQWALVAS

SEQ ID NO: 68892 - protein, 15 aa, Mycobacterium tuberculosis
DCRAAGVQWALVASP

SEQ ID NO: 68893 - protein, 15 aa, Mycobacterium tuberculosis
CRAAGVQWALVASPA

SEQ ID NO: 68894 - protein, 15 aa, Mycobacterium tuberculosis
RAAGVQWALVASPAV

SEQ ID NO: 68895 - protein, 15 aa, Mycobacterium tuberculosis
AAGVQWALVASPAVV

SEQ ID NO: 68896 - protein, 15 aa, Mycobacterium tuberculosis
AGVQWALVASPAVVE

SEQ ID NO: 68897 - protein, 15 aa, Mycobacterium tuberculosis
GVQWALVASPAVVEQ

SEQ ID NO: 68898 - protein, 15 aa, Mycobacterium tuberculosis
VQWALVASPAVVEQL

SEQ ID NO: 68899 - protein, 15 aa, Mycobacterium tuberculosis
QWALVASPAVVEQLG

SEQ ID NO: 68900 - protein, 15 aa, Mycobacterium tuberculosis
WALVASPAVVEQLGG

SEQ ID NO: 68901 - protein, 15 aa, Mycobacterium tuberculosis
ALVASPAVVEQLGGR

SEQ ID NO: 68902 - protein, 15 aa, Mycobacterium tuberculosis
LVASPAVVEQLGGRC

SEQ ID NO: 68903 - protein, 15 aa, Mycobacterium tuberculosis
VASPAVVEQLGGRCD

SEQ ID NO: 68904 - protein, 15 aa, Mycobacterium tuberculosis
ASPAVVEQLGGRCDQ

SEQ ID NO: 68905 - protein, 15 aa, Mycobacterium tuberculosis
SPAVVEQLGGRCDQG

SEQ ID NO: 68906 - protein, 15 aa, Mycobacterium tuberculosis
PAVVEQLGGRCDQGE

SEQ ID NO: 68907 - protein, 15 aa, Mycobacterium tuberculosis
AVVEQLGGRCDQGEH

SEQ ID NO: 68908 - protein, 15 aa, Mycobacterium tuberculosis
VVEQLGGRCDQGEHE

SEQ ID NO: 68909 - protein, 15 aa, Mycobacterium tuberculosis
VEQLGGRCDQGEHES

SEQ ID NO: 68910 - protein, 15 aa, Mycobacterium tuberculosis
EQLGGRCDQGEHESM

SEQ ID NO: 68911 - protein, 15 aa, Mycobacterium tuberculosis
QLGGRCDQGEHESMF

SEQ ID NO: 68912 - protein, 15 aa, Mycobacterium tuberculosis
LGGRCDQGEHESMFP

SEQ ID NO: 68913 - protein, 15 aa, Mycobacterium tuberculosis
GGRCDQGEHESMFPM

SEQ ID NO: 68914 - protein, 15 aa, Mycobacterium tuberculosis
GRCDQGEHESMFPMA

SEQ ID NO: 68915 - protein, 15 aa, Mycobacterium tuberculosis
RCDQGEHESMFPMAR

SEQ ID NO: 68916 - protein, 15 aa, Mycobacterium tuberculosis
CDQGEHESMFPMARS

SEQ ID NO: 68917 - protein, 15 aa, Mycobacterium tuberculosis
DQGEHESMFPMARSV

SEQ ID NO: 68918 - protein, 15 aa, Mycobacterium tuberculosis
QGEHESMFPMARSVH

SEQ ID NO: 68919 - protein, 15 aa, Mycobacterium tuberculosis
GEHESMFPMARSVHK

SEQ ID NO: 68920 - protein, 15 aa, Mycobacterium tuberculosis
EHESMFPMARSVHKA

SEQ ID NO: 68921 - protein, 15 aa, Mycobacterium tuberculosis
HESMFPMARSVHKAL

SEQ ID NO: 68922 - protein, 15 aa, Mycobacterium tuberculosis
ESMFPMARSVHKALH

SEQ ID NO: 68923 - protein, 15 aa, Mycobacterium tuberculosis
SMFPMARSVHKALHD

SEQ ID NO: 68924 - protein, 15 aa, Mycobacterium tuberculosis
MFPMARSVHKALHDL

SEQ ID NO: 68925 - protein, 15 aa, Mycobacterium tuberculosis
FPMARSVHKALHDLA

SEQ ID NO: 68926 - protein, 15 aa, Mycobacterium tuberculosis
PMARSVHKALHDLAD

SEQ ID NO: 68927 - protein, 15 aa, Mycobacterium tuberculosis
MARSVHKALHDLADA

SEQ ID NO: 68928 - protein, 15 aa, Mycobacterium tuberculosis
ARSVHKALHDLADAI

SEQ ID NO: 68929 - protein, 15 aa, Mycobacterium tuberculosis
RSVHKALHDLADAID

SEQ ID NO: 68930 - protein, 15 aa, Mycobacterium tuberculosis
SVHKALHDLADAIDR

SEQ ID NO: 68931 - protein, 15 aa, Mycobacterium tuberculosis
VHKALHDLADAIDRR

SEQ ID NO: 68932 - protein, 15 aa, Mycobacterium tuberculosis
HKALHDLADAIDRRR

SEQ ID NO: 68933 - protein, 15 aa, Mycobacterium tuberculosis
KALHDLADAIDRRRQ

SEQ ID NO: 68934 - protein, 15 aa, Mycobacterium tuberculosis
ALHDLADAIDRRRQL

SEQ ID NO: 68935 - protein, 15 aa, Mycobacterium tuberculosis
LHDLADAIDRRRQLV

SEQ ID NO: 68936 - protein, 15 aa, Mycobacterium tuberculosis
HDLADAIDRRRQLVL

SEQ ID NO: 68937 - protein, 15 aa, Mycobacterium tuberculosis
DLADAIDRRRQLVLP

SEQ ID NO: 68938 - protein, 15 aa, Mycobacterium tuberculosis
LADAIDRRRQLVLPL

SEQ ID NO: 68939 - protein, 15 aa, Mycobacterium tuberculosis
ADAIDRRRQLVLPLI

SEQ ID NO: 68940 - protein, 15 aa, Mycobacterium tuberculosis
DAIDRRRQLVLPLIS

SEQ ID NO: 68941 - protein, 15 aa, Mycobacterium tuberculosis
AIDRRRQLVLPLISR

SEQ ID NO: 68942 - protein, 15 aa, Mycobacterium tuberculosis
IDRRRQLVLPLISRS

SEQ ID NO: 68943 - protein, 15 aa, Mycobacterium tuberculosis
DRRRQLVLPLISRSA

SEQ ID NO: 68944 - protein, 16 aa, Mycobacterium tuberculosis
MTTTIPTSKSACSVTT

SEQ ID NO: 68945 - protein, 16 aa, Mycobacterium tuberculosis
TTTIPTSKSACSVTTR

SEQ ID NO: 68946 - protein, 16 aa, Mycobacterium tuberculosis
TTIPTSKSACSVTTRP

SEQ ID NO: 68947 - protein, 16 aa, Mycobacterium tuberculosis
TIPTSKSACSVTTRPG

SEQ ID NO: 68948 - protein, 16 aa, Mycobacterium tuberculosis
IPTSKSACSVTTRPGN

SEQ ID NO: 68949 - protein, 16 aa, Mycobacterium tuberculosis
PTSKSACSVTTRPGNA

SEQ ID NO: 68950 - protein, 16 aa, Mycobacterium tuberculosis
TSKSACSVTTRPGNAA

SEQ ID NO: 68951 - protein, 16 aa, Mycobacterium tuberculosis
SKSACSVTTRPGNAAV

SEQ ID NO: 68952 - protein, 16 aa, Mycobacterium tuberculosis
KSACSVTTRPGNAAVD

SEQ ID NO: 68953 - protein, 16 aa, Mycobacterium tuberculosis
SACSVTTRPGNAAVDY

SEQ ID NO: 68954 - protein, 16 aa, Mycobacterium tuberculosis
ACSVTTRPGNAAVDYG

SEQ ID NO: 68955 - protein, 16 aa, Mycobacterium tuberculosis
CSVTTRPGNAAVDYGG

SEQ ID NO: 68956 - protein, 16 aa, Mycobacterium tuberculosis
SVTTRPGNAAVDYGGA

SEQ ID NO: 68957 - protein, 16 aa, Mycobacterium tuberculosis
VTTRPGNAAVDYGGAQ

SEQ ID NO: 68958 - protein, 16 aa, Mycobacterium tuberculosis
TTRPGNAAVDYGGAQI

SEQ ID NO: 68959 - protein, 16 aa, Mycobacterium tuberculosis
TRPGNAAVDYGGAQIR

SEQ ID NO: 68960 - protein, 16 aa, Mycobacterium tuberculosis
RPGNAAVDYGGAQIRA

SEQ ID NO: 68961 - protein, 16 aa, Mycobacterium tuberculosis
PGNAAVDYGGAQIRAY

SEQ ID NO: 68962 - protein, 16 aa, Mycobacterium tuberculosis
GNAAVDYGGAQIRAYL

SEQ ID NO: 68963 - protein, 16 aa, Mycobacterium tuberculosis
NAAVDYGGAQIRAYLH

SEQ ID NO: 68964 - protein, 16 aa, Mycobacterium tuberculosis
AAVDYGGAQIRAYLHH

SEQ ID NO: 68965 - protein, 16 aa, Mycobacterium tuberculosis
AVDYGGAQIRAYLHHL

SEQ ID NO: 68966 - protein, 16 aa, Mycobacterium tuberculosis
VDYGGAQIRAYLHHLA

SEQ ID NO: 68967 - protein, 16 aa, Mycobacterium tuberculosis
DYGGAQIRAYLHHLAT

SEQ ID NO: 68968 - protein, 16 aa, Mycobacterium tuberculosis
YGGAQIRAYLHHLATV

SEQ ID NO: 68969 - protein, 16 aa, Mycobacterium tuberculosis
GGAQIRAYLHHLATVV

SEQ ID NO: 68970 - protein, 16 aa, Mycobacterium tuberculosis
GAQIRAYLHHLATVVT

SEQ ID NO: 68971 - protein, 16 aa, Mycobacterium tuberculosis
AQIRAYLHHLATVVTI

SEQ ID NO: 68972 - protein, 16 aa, Mycobacterium tuberculosis
QIRAYLHHLATVVTIR

SEQ ID NO: 68973 - protein, 16 aa, Mycobacterium tuberculosis
IRAYLHHLATVVTIRG

SEQ ID NO: 68974 - protein, 16 aa, Mycobacterium tuberculosis
RAYLHHLATVVTIRGE

SEQ ID NO: 68975 - protein, 16 aa, Mycobacterium tuberculosis
AYLHHLATVVTIRGEI

SEQ ID NO: 68976 - protein, 16 aa, Mycobacterium tuberculosis
YLHHLATVVTIRGEID

SEQ ID NO: 68977 - protein, 16 aa, Mycobacterium tuberculosis
LHHLATVVTIRGEIDA

SEQ ID NO: 68978 - protein, 16 aa, Mycobacterium tuberculosis
HHLATVVTIRGEIDAA

SEQ ID NO: 68979 - protein, 16 aa, Mycobacterium tuberculosis
HLATVVTIRGEIDAAN

SEQ ID NO: 68980 - protein, 16 aa, Mycobacterium tuberculosis
LATVVTIRGEIDAANV

SEQ ID NO: 68981 - protein, 16 aa, Mycobacterium tuberculosis
ATVVTIRGEIDAANVE

SEQ ID NO: 68982 - protein, 16 aa, Mycobacterium tuberculosis
TVVTIRGEIDAANVEQ

SEQ ID NO: 68983 - protein, 16 aa, Mycobacterium tuberculosis
VVTIRGEIDAANVEQI

SEQ ID NO: 68984 - protein, 16 aa, Mycobacterium tuberculosis
VTIRGEIDAANVEQIS

SEQ ID NO: 68985 - protein, 16 aa, Mycobacterium tuberculosis
TIRGEIDAANVEQISE

SEQ ID NO: 68986 - protein, 16 aa, Mycobacterium tuberculosis
IRGEIDAANVEQISEH

SEQ ID NO: 68987 - protein, 16 aa, Mycobacterium tuberculosis
RGEIDAANVEQISEHV

SEQ ID NO: 68988 - protein, 16 aa, Mycobacterium tuberculosis
GEIDAANVEQISEHVR

SEQ ID NO: 68989 - protein, 16 aa, Mycobacterium tuberculosis
EIDAANVEQISEHVRR

SEQ ID NO: 68990 - protein, 16 aa, Mycobacterium tuberculosis
IDAANVEQISEHVRRF

SEQ ID NO: 68991 - protein, 16 aa, Mycobacterium tuberculosis
DAANVEQISEHVRRFS

SEQ ID NO: 68992 - protein, 16 aa, Mycobacterium tuberculosis
AANVEQISEHVRRFSL

SEQ ID NO: 68993 - protein, 16 aa, Mycobacterium tuberculosis
ANVEQISEHVRRFSLG

SEQ ID NO: 68994 - protein, 16 aa, Mycobacterium tuberculosis
NVEQISEHVRRFSLGT

SEQ ID NO: 68995 - protein, 16 aa, Mycobacterium tuberculosis
VEQISEHVRRFSLGTN

SEQ ID NO: 68996 - protein, 16 aa, Mycobacterium tuberculosis
EQISEHVRRFSLGTNP

SEQ ID NO: 68997 - protein, 16 aa, Mycobacterium tuberculosis
QISEHVRRFSLGTNPM

SEQ ID NO: 68998 - protein, 16 aa, Mycobacterium tuberculosis
ISEHVRRFSLGTNPMV

SEQ ID NO: 68999 - protein, 16 aa, Mycobacterium tuberculosis
SEHVRRFSLGTNPMVL

SEQ ID NO: 69000 - protein, 16 aa, Mycobacterium tuberculosis
EHVRRFSLGTNPMVLD

SEQ ID NO: 69001 - protein, 16 aa, Mycobacterium tuberculosis
HVRRFSLGTNPMVLDL

SEQ ID NO: 69002 - protein, 16 aa, Mycobacterium tuberculosis
VRRFSLGTNPMVLDLS

SEQ ID NO: 69003 - protein, 16 aa, Mycobacterium tuberculosis
RRFSLGTNPMVLDLSE

SEQ ID NO: 69004 - protein, 16 aa, Mycobacterium tuberculosis
RFSLGTNPMVLDLSEL

SEQ ID NO: 69005 - protein, 16 aa, Mycobacterium tuberculosis
FSLGTNPMVLDLSELS

SEQ ID NO: 69006 - protein, 16 aa, Mycobacterium tuberculosis
SLGTNPMVLDLSELSH

SEQ ID NO: 69007 - protein, 16 aa, Mycobacterium tuberculosis
LGTNPMVLDLSELSHF

SEQ ID NO: 69008 - protein, 16 aa, Mycobacterium tuberculosis
GTNPMVLDLSELSHFS

SEQ ID NO: 69009 - protein, 16 aa, Mycobacterium tuberculosis
TNPMVLDLSELSHFSG

SEQ ID NO: 69010 - protein, 16 aa, Mycobacterium tuberculosis
NPMVLDLSELSHFSGA

SEQ ID NO: 69011 - protein, 16 aa, Mycobacterium tuberculosis
PMVLDLSELSHFSGAG

SEQ ID NO: 69012 - protein, 16 aa, Mycobacterium tuberculosis
MVLDLSELSHFSGAGI

SEQ ID NO: 69013 - protein, 16 aa, Mycobacterium tuberculosis
VLDLSELSHFSGAGIS

SEQ ID NO: 69014 - protein, 16 aa, Mycobacterium tuberculosis
LDLSELSHFSGAGISL

SEQ ID NO: 69015 - protein, 16 aa, Mycobacterium tuberculosis
DLSELSHFSGAGISLL

SEQ ID NO: 69016 - protein, 16 aa, Mycobacterium tuberculosis
LSELSHFSGAGISLLC

SEQ ID NO: 69017 - protein, 16 aa, Mycobacterium tuberculosis
SELSHFSGAGISLLCI

SEQ ID NO: 69018 - protein, 16 aa, Mycobacterium tuberculosis
ELSHFSGAGISLLCIL

SEQ ID NO: 69019 - protein, 16 aa, Mycobacterium tuberculosis
LSHFSGAGISLLCILD

SEQ ID NO: 69020 - protein, 16 aa, Mycobacterium tuberculosis
SHFSGAGISLLCILDE

SEQ ID NO: 69021 - protein, 16 aa, Mycobacterium tuberculosis
HFSGAGISLLCILDED

SEQ ID NO: 69022 - protein, 16 aa, Mycobacterium tuberculosis
FSGAGISLLCILDEDC

SEQ ID NO: 69023 - protein, 16 aa, Mycobacterium tuberculosis
SGAGISLLCILDEDCR

SEQ ID NO: 69024 - protein, 16 aa, Mycobacterium tuberculosis
GAGISLLCILDEDCRA

SEQ ID NO: 69025 - protein, 16 aa, Mycobacterium tuberculosis
AGISLLCILDEDCRAA

SEQ ID NO: 69026 - protein, 16 aa, Mycobacterium tuberculosis
GISLLCILDEDCRAAG

SEQ ID NO: 69027 - protein, 16 aa, Mycobacterium tuberculosis
ISLLCILDEDCRAAGV

SEQ ID NO: 69028 - protein, 16 aa, Mycobacterium tuberculosis
SLLCILDEDCRAAGVQ

SEQ ID NO: 69029 - protein, 16 aa, Mycobacterium tuberculosis
LLCILDEDCRAAGVQW

SEQ ID NO: 69030 - protein, 16 aa, Mycobacterium tuberculosis
LCILDEDCRAAGVQWA

SEQ ID NO: 69031 - protein, 16 aa, Mycobacterium tuberculosis
CILDEDCRAAGVQWAL

SEQ ID NO: 69032 - protein, 16 aa, Mycobacterium tuberculosis
ILDEDCRAAGVQWALV

SEQ ID NO: 69033 - protein, 16 aa, Mycobacterium tuberculosis
LDEDCRAAGVQWALVA

SEQ ID NO: 69034 - protein, 16 aa, Mycobacterium tuberculosis
DEDCRAAGVQWALVAS

SEQ ID NO: 69035 - protein, 16 aa, Mycobacterium tuberculosis
EDCRAAGVQWALVASP

SEQ ID NO: 69036 - protein, 16 aa, Mycobacterium tuberculosis
DCRAAGVQWALVASPA

SEQ ID NO: 69037 - protein, 16 aa, Mycobacterium tuberculosis
CRAAGVQWALVASPAV

SEQ ID NO: 69038 - protein, 16 aa, Mycobacterium tuberculosis
RAAGVQWALVASPAVV

SEQ ID NO: 69039 - protein, 16 aa, Mycobacterium tuberculosis
AAGVQWALVASPAVVE

SEQ ID NO: 69040 - protein, 16 aa, Mycobacterium tuberculosis
AGVQWALVASPAVVEQ

SEQ ID NO: 69041 - protein, 16 aa, Mycobacterium tuberculosis
GVQWALVASPAVVEQL

SEQ ID NO: 69042 - protein, 16 aa, Mycobacterium tuberculosis
VQWALVASPAVVEQLG

SEQ ID NO: 69043 - protein, 16 aa, Mycobacterium tuberculosis
QWALVASPAVVEQLGG

SEQ ID NO: 69044 - protein, 16 aa, Mycobacterium tuberculosis
WALVASPAVVEQLGGR

SEQ ID NO: 69045 - protein, 16 aa, Mycobacterium tuberculosis
ALVASPAVVEQLGGRC

SEQ ID NO: 69046 - protein, 16 aa, Mycobacterium tuberculosis
LVASPAVVEQLGGRCD

SEQ ID NO: 69047 - protein, 16 aa, Mycobacterium tuberculosis
VASPAVVEQLGGRCDQ

SEQ ID NO: 69048 - protein, 16 aa, Mycobacterium tuberculosis
ASPAVVEQLGGRCDQG

SEQ ID NO: 69049 - protein, 16 aa, Mycobacterium tuberculosis
SPAVVEQLGGRCDQGE

SEQ ID NO: 69050 - protein, 16 aa, Mycobacterium tuberculosis
PAVVEQLGGRCDQGEH

SEQ ID NO: 69051 - protein, 16 aa, Mycobacterium tuberculosis
AVVEQLGGRCDQGEHE

SEQ ID NO: 69052 - protein, 16 aa, Mycobacterium tuberculosis
VVEQLGGRCDQGEHES

SEQ ID NO: 69053 - protein, 16 aa, Mycobacterium tuberculosis
VEQLGGRCDQGEHESM

SEQ ID NO: 69054 - protein, 16 aa, Mycobacterium tuberculosis
EQLGGRCDQGEHESMF

SEQ ID NO: 69055 - protein, 16 aa, Mycobacterium tuberculosis
QLGGRCDQGEHESMFP

SEQ ID NO: 69056 - protein, 16 aa, Mycobacterium tuberculosis
LGGRCDQGEHESMFPM

SEQ ID NO: 69057 - protein, 16 aa, Mycobacterium tuberculosis
GGRCDQGEHESMFPMA

SEQ ID NO: 69058 - protein, 16 aa, Mycobacterium tuberculosis
GRCDQGEHESMFPMAR

SEQ ID NO: 69059 - protein, 16 aa, Mycobacterium tuberculosis
RCDQGEHESMFPMARS

SEQ ID NO: 69060 - protein, 16 aa, Mycobacterium tuberculosis
CDQGEHESMFPMARSV

SEQ ID NO: 69061 - protein, 16 aa, Mycobacterium tuberculosis
DQGEHESMFPMARSVH

SEQ ID NO: 69062 - protein, 16 aa, Mycobacterium tuberculosis
QGEHESMFPMARSVHK

SEQ ID NO: 69063 - protein, 16 aa, Mycobacterium tuberculosis
GEHESMFPMARSVHKA

SEQ ID NO: 69064 - protein, 16 aa, Mycobacterium tuberculosis
EHESMFPMARSVHKAL

SEQ ID NO: 69065 - protein, 16 aa, Mycobacterium tuberculosis
HESMFPMARSVHKALH

SEQ ID NO: 69066 - protein, 16 aa, Mycobacterium tuberculosis
ESMFPMARSVHKALHD

SEQ ID NO: 69067 - protein, 16 aa, Mycobacterium tuberculosis
SMFPMARSVHKALHDL

SEQ ID NO: 69068 - protein, 16 aa, Mycobacterium tuberculosis
MFPMARSVHKALHDLA

SEQ ID NO: 69069 - protein, 16 aa, Mycobacterium tuberculosis
FPMARSVHKALHDLAD

SEQ ID NO: 69070 - protein, 16 aa, Mycobacterium tuberculosis
PMARSVHKALHDLADA

SEQ ID NO: 69071 - protein, 16 aa, Mycobacterium tuberculosis
MARSVHKALHDLADAI

SEQ ID NO: 69072 - protein, 16 aa, Mycobacterium tuberculosis
ARSVHKALHDLADAID

SEQ ID NO: 69073 - protein, 16 aa, Mycobacterium tuberculosis
RSVHKALHDLADAIDR

SEQ ID NO: 69074 - protein, 16 aa, Mycobacterium tuberculosis
SVHKALHDLADAIDRR

SEQ ID NO: 69075 - protein, 16 aa, Mycobacterium tuberculosis
VHKALHDLADAIDRRR

SEQ ID NO: 69076 - protein, 16 aa, Mycobacterium tuberculosis
HKALHDLADAIDRRRQ

SEQ ID NO: 69077 - protein, 16 aa, Mycobacterium tuberculosis
KALHDLADAIDRRRQL

SEQ ID NO: 69078 - protein, 16 aa, Mycobacterium tuberculosis
ALHDLADAIDRRRQLV

SEQ ID NO: 69079 - protein, 16 aa, Mycobacterium tuberculosis
LHDLADAIDRRRQLVL

SEQ ID NO: 69080 - protein, 16 aa, Mycobacterium tuberculosis
HDLADAIDRRRQLVLP

SEQ ID NO: 69081 - protein, 16 aa, Mycobacterium tuberculosis
DLADAIDRRRQLVLPL

SEQ ID NO: 69082 - protein, 16 aa, Mycobacterium tuberculosis
LADAIDRRRQLVLPLI

SEQ ID NO: 69083 - protein, 16 aa, Mycobacterium tuberculosis
ADAIDRRRQLVLPLIS

SEQ ID NO: 69084 - protein, 16 aa, Mycobacterium tuberculosis
DAIDRRRQLVLPLISR

SEQ ID NO: 69085 - protein, 16 aa, Mycobacterium tuberculosis
AIDRRRQLVLPLISRS

SEQ ID NO: 69086 - protein, 16 aa, Mycobacterium tuberculosis
IDRRRQLVLPLISRSA

SEQ ID NO: 69087 - protein, 13 aa, Mycobacterium tuberculosis
MKAKVGDWLVIKG

SEQ ID NO: 69088 - protein, 13 aa, Mycobacterium tuberculosis
KAKVGDWLVIKGA

SEQ ID NO: 69089 - protein, 13 aa, Mycobacterium tuberculosis
AKVGDWLVIKGAT

SEQ ID NO: 69090 - protein, 13 aa, Mycobacterium tuberculosis
KVGDWLVIKGATI

SEQ ID NO: 69091 - protein, 13 aa, Mycobacterium tuberculosis
VGDWLVIKGATID

SEQ ID NO: 69092 - protein, 13 aa, Mycobacterium tuberculosis
GDWLVIKGATIDQ

SEQ ID NO: 69093 - protein, 13 aa, Mycobacterium tuberculosis
DWLVIKGATIDQP

SEQ ID NO: 69094 - protein, 13 aa, Mycobacterium tuberculosis
WLVIKGATIDQPD

SEQ ID NO: 69095 - protein, 13 aa, Mycobacterium tuberculosis
LVIKGATIDQPDH

SEQ ID NO: 69096 - protein, 13 aa, Mycobacterium tuberculosis
VIKGATIDQPDHR

SEQ ID NO: 69097 - protein, 13 aa, Mycobacterium tuberculosis
IKGATIDQPDHRG

SEQ ID NO: 69098 - protein, 13 aa, Mycobacterium tuberculosis
KGATIDQPDHRGL

SEQ ID NO: 69099 - protein, 13 aa, Mycobacterium tuberculosis
GATIDQPDHRGLI

SEQ ID NO: 69100 - protein, 13 aa, Mycobacterium tuberculosis
ATIDQPDHRGLII

SEQ ID NO: 69101 - protein, 13 aa, Mycobacterium tuberculosis
TIDQPDHRGLIIE

SEQ ID NO: 69102 - protein, 13 aa, Mycobacterium tuberculosis
IDQPDHRGLIIEV

SEQ ID NO: 69103 - protein, 13 aa, Mycobacterium tuberculosis
DQPDHRGLIIEVR

SEQ ID NO: 69104 - protein, 13 aa, Mycobacterium tuberculosis
QPDHRGLIIEVRS

SEQ ID NO: 69105 - protein, 13 aa, Mycobacterium tuberculosis
PDHRGLIIEVRSS

SEQ ID NO: 69106 - protein, 13 aa, Mycobacterium tuberculosis
DHRGLIIEVRSSD

SEQ ID NO: 69107 - protein, 13 aa, Mycobacterium tuberculosis
HRGLIIEVRSSDG

SEQ ID NO: 69108 - protein, 13 aa, Mycobacterium tuberculosis
RGLIIEVRSSDGS

SEQ ID NO: 69109 - protein, 13 aa, Mycobacterium tuberculosis
GLIIEVRSSDGSP

SEQ ID NO: 69110 - protein, 13 aa, Mycobacterium tuberculosis
LIIEVRSSDGSPP

SEQ ID NO: 69111 - protein, 13 aa, Mycobacterium tuberculosis
IIEVRSSDGSPPY

SEQ ID NO: 69112 - protein, 13 aa, Mycobacterium tuberculosis
IEVRSSDGSPPYV

SEQ ID NO: 69113 - protein, 13 aa, Mycobacterium tuberculosis
EVRSSDGSPPYVV

SEQ ID NO: 69114 - protein, 13 aa, Mycobacterium tuberculosis
VRSSDGSPPYVVR

SEQ ID NO: 69115 - protein, 13 aa, Mycobacterium tuberculosis
RSSDGSPPYVVRW

SEQ ID NO: 69116 - protein, 13 aa, Mycobacterium tuberculosis
SSDGSPPYVVRWL

SEQ ID NO: 69117 - protein, 13 aa, Mycobacterium tuberculosis
SDGSPPYVVRWLE

SEQ ID NO: 69118 - protein, 13 aa, Mycobacterium tuberculosis
DGSPPYVVRWLET

SEQ ID NO: 69119 - protein, 13 aa, Mycobacterium tuberculosis
GSPPYVVRWLETD

SEQ ID NO: 69120 - protein, 13 aa, Mycobacterium tuberculosis
SPPYVVRWLETDH

SEQ ID NO: 69121 - protein, 13 aa, Mycobacterium tuberculosis
PPYVVRWLETDHV

SEQ ID NO: 69122 - protein, 13 aa, Mycobacterium tuberculosis
PYVVRWLETDHVA

SEQ ID NO: 69123 - protein, 13 aa, Mycobacterium tuberculosis
YVVRWLETDHVAT

SEQ ID NO: 69124 - protein, 13 aa, Mycobacterium tuberculosis
VVRWLETDHVATV

SEQ ID NO: 69125 - protein, 13 aa, Mycobacterium tuberculosis
VRWLETDHVATVI

SEQ ID NO: 69126 - protein, 13 aa, Mycobacterium tuberculosis
RWLETDHVATVIP

SEQ ID NO: 69127 - protein, 13 aa, Mycobacterium tuberculosis
WLETDHVATVIPG

SEQ ID NO: 69128 - protein, 13 aa, Mycobacterium tuberculosis
LETDHVATVIPGP

SEQ ID NO: 69129 - protein, 13 aa, Mycobacterium tuberculosis
ETDHVATVIPGPD

SEQ ID NO: 69130 - protein, 13 aa, Mycobacterium tuberculosis
TDHVATVIPGPDA

SEQ ID NO: 69131 - protein, 13 aa, Mycobacterium tuberculosis
DHVATVIPGPDAV

SEQ ID NO: 69132 - protein, 13 aa, Mycobacterium tuberculosis
HVATVIPGPDAVV

SEQ ID NO: 69133 - protein, 13 aa, Mycobacterium tuberculosis
VATVIPGPDAVVV

SEQ ID NO: 69134 - protein, 13 aa, Mycobacterium tuberculosis
ATVIPGPDAVVVT

SEQ ID NO: 69135 - protein, 13 aa, Mycobacterium tuberculosis
TVIPGPDAVVVTA

SEQ ID NO: 69136 - protein, 13 aa, Mycobacterium tuberculosis
VIPGPDAVVVTAE

SEQ ID NO: 69137 - protein, 13 aa, Mycobacterium tuberculosis
IPGPDAVVVTAEE

SEQ ID NO: 69138 - protein, 13 aa, Mycobacterium tuberculosis
PGPDAVVVTAEEQ

SEQ ID NO: 69139 - protein, 13 aa, Mycobacterium tuberculosis
GPDAVVVTAEEQN

SEQ ID NO: 69140 - protein, 13 aa, Mycobacterium tuberculosis
PDAVVVTAEEQNA

SEQ ID NO: 69141 - protein, 13 aa, Mycobacterium tuberculosis
DAVVVTAEEQNAA

SEQ ID NO: 69142 - protein, 13 aa, Mycobacterium tuberculosis
AVVVTAEEQNAAD

SEQ ID NO: 69143 - protein, 13 aa, Mycobacterium tuberculosis
VVVTAEEQNAADE

SEQ ID NO: 69144 - protein, 13 aa, Mycobacterium tuberculosis
VVTAEEQNAADER

SEQ ID NO: 69145 - protein, 13 aa, Mycobacterium tuberculosis
VTAEEQNAADERA

SEQ ID NO: 69146 - protein, 13 aa, Mycobacterium tuberculosis
TAEEQNAADERAQ

SEQ ID NO: 69147 - protein, 13 aa, Mycobacterium tuberculosis
AEEQNAADERAQH

SEQ ID NO: 69148 - protein, 13 aa, Mycobacterium tuberculosis
EEQNAADERAQHR

SEQ ID NO: 69149 - protein, 13 aa, Mycobacterium tuberculosis
EQNAADERAQHRF

SEQ ID NO: 69150 - protein, 13 aa, Mycobacterium tuberculosis
QNAADERAQHRFG

SEQ ID NO: 69151 - protein, 13 aa, Mycobacterium tuberculosis
NAADERAQHRFGA

SEQ ID NO: 69152 - protein, 13 aa, Mycobacterium tuberculosis
AADERAQHRFGAV

SEQ ID NO: 69153 - protein, 13 aa, Mycobacterium tuberculosis
ADERAQHRFGAVQ

SEQ ID NO: 69154 - protein, 13 aa, Mycobacterium tuberculosis
DERAQHRFGAVQS

SEQ ID NO: 69155 - protein, 13 aa, Mycobacterium tuberculosis
ERAQHRFGAVQSA

SEQ ID NO: 69156 - protein, 13 aa, Mycobacterium tuberculosis
RAQHRFGAVQSAI

SEQ ID NO: 69157 - protein, 13 aa, Mycobacterium tuberculosis
AQHRFGAVQSAIL

SEQ ID NO: 69158 - protein, 13 aa, Mycobacterium tuberculosis
QHRFGAVQSAILH

SEQ ID NO: 69159 - protein, 13 aa, Mycobacterium tuberculosis
HRFGAVQSAILHA

SEQ ID NO: 69160 - protein, 13 aa, Mycobacterium tuberculosis
RFGAVQSAILHAR

SEQ ID NO: 69161 - protein, 13 aa, Mycobacterium tuberculosis
FGAVQSAILHARG

SEQ ID NO: 69162 - protein, 13 aa, Mycobacterium tuberculosis
GAVQSAILHARGT

SEQ ID NO: 69163 - protein, 14 aa, Mycobacterium tuberculosis
MKAKVGDWLVIKGA

SEQ ID NO: 69164 - protein, 14 aa, Mycobacterium tuberculosis
KAKVGDWLVIKGAT

SEQ ID NO: 69165 - protein, 14 aa, Mycobacterium tuberculosis
AKVGDWLVIKGATI

SEQ ID NO: 69166 - protein, 14 aa, Mycobacterium tuberculosis
KVGDWLVIKGATID

SEQ ID NO: 69167 - protein, 14 aa, Mycobacterium tuberculosis
VGDWLVIKGATIDQ

SEQ ID NO: 69168 - protein, 14 aa, Mycobacterium tuberculosis
GDWLVIKGATIDQP

SEQ ID NO: 69169 - protein, 14 aa, Mycobacterium tuberculosis
DWLVIKGATIDQPD

SEQ ID NO: 69170 - protein, 14 aa, Mycobacterium tuberculosis
WLVIKGATIDQPDH

SEQ ID NO: 69171 - protein, 14 aa, Mycobacterium tuberculosis
LVIKGATIDQPDHR

SEQ ID NO: 69172 - protein, 14 aa, Mycobacterium tuberculosis
VIKGATIDQPDHRG

SEQ ID NO: 69173 - protein, 14 aa, Mycobacterium tuberculosis
IKGATIDQPDHRGL

SEQ ID NO: 69174 - protein, 14 aa, Mycobacterium tuberculosis
KGATIDQPDHRGLI

SEQ ID NO: 69175 - protein, 14 aa, Mycobacterium tuberculosis
GATIDQPDHRGLII

SEQ ID NO: 69176 - protein, 14 aa, Mycobacterium tuberculosis
ATIDQPDHRGLIIE

SEQ ID NO: 69177 - protein, 14 aa, Mycobacterium tuberculosis
TIDQPDHRGLIIEV

SEQ ID NO: 69178 - protein, 14 aa, Mycobacterium tuberculosis
IDQPDHRGLIIEVR

SEQ ID NO: 69179 - protein, 14 aa, Mycobacterium tuberculosis
DQPDHRGLIIEVRS

SEQ ID NO: 69180 - protein, 14 aa, Mycobacterium tuberculosis
QPDHRGLIIEVRSS

SEQ ID NO: 69181 - protein, 14 aa, Mycobacterium tuberculosis
PDHRGLIIEVRSSD

SEQ ID NO: 69182 - protein, 14 aa, Mycobacterium tuberculosis
DHRGLIIEVRSSDG

SEQ ID NO: 69183 - protein, 14 aa, Mycobacterium tuberculosis
HRGLIIEVRSSDGS

SEQ ID NO: 69184 - protein, 14 aa, Mycobacterium tuberculosis
RGLIIEVRSSDGSP

SEQ ID NO: 69185 - protein, 14 aa, Mycobacterium tuberculosis
GLIIEVRSSDGSPP

SEQ ID NO: 69186 - protein, 14 aa, Mycobacterium tuberculosis
LIIEVRSSDGSPPY

SEQ ID NO: 69187 - protein, 14 aa, Mycobacterium tuberculosis
IIEVRSSDGSPPYV

SEQ ID NO: 69188 - protein, 14 aa, Mycobacterium tuberculosis
IEVRSSDGSPPYVV

SEQ ID NO: 69189 - protein, 14 aa, Mycobacterium tuberculosis
EVRSSDGSPPYVVR

SEQ ID NO: 69190 - protein, 14 aa, Mycobacterium tuberculosis
VRSSDGSPPYVVRW

SEQ ID NO: 69191 - protein, 14 aa, Mycobacterium tuberculosis
RSSDGSPPYVVRWL

SEQ ID NO: 69192 - protein, 14 aa, Mycobacterium tuberculosis
SSDGSPPYVVRWLE

SEQ ID NO: 69193 - protein, 14 aa, Mycobacterium tuberculosis
SDGSPPYVVRWLET

SEQ ID NO: 69194 - protein, 14 aa, Mycobacterium tuberculosis
DGSPPYVVRWLETD

SEQ ID NO: 69195 - protein, 14 aa, Mycobacterium tuberculosis
GSPPYVVRWLETDH

SEQ ID NO: 69196 - protein, 14 aa, Mycobacterium tuberculosis
SPPYVVRWLETDHV

SEQ ID NO: 69197 - protein, 14 aa, Mycobacterium tuberculosis
PPYVVRWLETDHVA

SEQ ID NO: 69198 - protein, 14 aa, Mycobacterium tuberculosis
PYVVRWLETDHVAT

SEQ ID NO: 69199 - protein, 14 aa, Mycobacterium tuberculosis
YVVRWLETDHVATV

SEQ ID NO: 69200 - protein, 14 aa, Mycobacterium tuberculosis
VVRWLETDHVATVI

SEQ ID NO: 69201 - protein, 14 aa, Mycobacterium tuberculosis
VRWLETDHVATVIP

SEQ ID NO: 69202 - protein, 14 aa, Mycobacterium tuberculosis
RWLETDHVATVIPG

SEQ ID NO: 69203 - protein, 14 aa, Mycobacterium tuberculosis
WLETDHVATVIPGP

SEQ ID NO: 69204 - protein, 14 aa, Mycobacterium tuberculosis
LETDHVATVIPGPD

SEQ ID NO: 69205 - protein, 14 aa, Mycobacterium tuberculosis
ETDHVATVIPGPDA

SEQ ID NO: 69206 - protein, 14 aa, Mycobacterium tuberculosis
TDHVATVIPGPDAV

SEQ ID NO: 69207 - protein, 14 aa, Mycobacterium tuberculosis
DHVATVIPGPDAVV

SEQ ID NO: 69208 - protein, 14 aa, Mycobacterium tuberculosis
HVATVIPGPDAVVV

SEQ ID NO: 69209 - protein, 14 aa, Mycobacterium tuberculosis
VATVIPGPDAVVVT

SEQ ID NO: 69210 - protein, 14 aa, Mycobacterium tuberculosis
ATVIPGPDAVVVTA

SEQ ID NO: 69211 - protein, 14 aa, Mycobacterium tuberculosis
TVIPGPDAVVVTAE

SEQ ID NO: 69212 - protein, 14 aa, Mycobacterium tuberculosis
VIPGPDAVVVTAEE

SEQ ID NO: 69213 - protein, 14 aa, Mycobacterium tuberculosis
IPGPDAVVVTAEEQ

SEQ ID NO: 69214 - protein, 14 aa, Mycobacterium tuberculosis
PGPDAVVVTAEEQN

SEQ ID NO: 69215 - protein, 14 aa, Mycobacterium tuberculosis
GPDAVVVTAEEQNA

SEQ ID NO: 69216 - protein, 14 aa, Mycobacterium tuberculosis
PDAVVVTAEEQNAA

SEQ ID NO: 69217 - protein, 14 aa, Mycobacterium tuberculosis
DAVVVTAEEQNAAD

SEQ ID NO: 69218 - protein, 14 aa, Mycobacterium tuberculosis
AVVVTAEEQNAADE

SEQ ID NO: 69219 - protein, 14 aa, Mycobacterium tuberculosis
VVVTAEEQNAADER

SEQ ID NO: 69220 - protein, 14 aa, Mycobacterium tuberculosis
VVTAEEQNAADERA

SEQ ID NO: 69221 - protein, 14 aa, Mycobacterium tuberculosis
VTAEEQNAADERAQ

SEQ ID NO: 69222 - protein, 14 aa, Mycobacterium tuberculosis
TAEEQNAADERAQH

SEQ ID NO: 69223 - protein, 14 aa, Mycobacterium tuberculosis
AEEQNAADERAQHR

SEQ ID NO: 69224 - protein, 14 aa, Mycobacterium tuberculosis
EEQNAADERAQHRF

SEQ ID NO: 69225 - protein, 14 aa, Mycobacterium tuberculosis
EQNAADERAQHRFG

SEQ ID NO: 69226 - protein, 14 aa, Mycobacterium tuberculosis
QNAADERAQHRFGA

SEQ ID NO: 69227 - protein, 14 aa, Mycobacterium tuberculosis
NAADERAQHRFGAV

SEQ ID NO: 69228 - protein, 14 aa, Mycobacterium tuberculosis
AADERAQHRFGAVQ

SEQ ID NO: 69229 - protein, 14 aa, Mycobacterium tuberculosis
ADERAQHRFGAVQS

SEQ ID NO: 69230 - protein, 14 aa, Mycobacterium tuberculosis
DERAQHRFGAVQSA

SEQ ID NO: 69231 - protein, 14 aa, Mycobacterium tuberculosis
ERAQHRFGAVQSAI

SEQ ID NO: 69232 - protein, 14 aa, Mycobacterium tuberculosis
RAQHRFGAVQSAIL

SEQ ID NO: 69233 - protein, 14 aa, Mycobacterium tuberculosis
AQHRFGAVQSAILH

SEQ ID NO: 69234 - protein, 14 aa, Mycobacterium tuberculosis
QHRFGAVQSAILHA

SEQ ID NO: 69235 - protein, 14 aa, Mycobacterium tuberculosis
HRFGAVQSAILHAR

SEQ ID NO: 69236 - protein, 14 aa, Mycobacterium tuberculosis
RFGAVQSAILHARG

SEQ ID NO: 69237 - protein, 14 aa, Mycobacterium tuberculosis
FGAVQSAILHARGT

SEQ ID NO: 69238 - protein, 15 aa, Mycobacterium tuberculosis
MKAKVGDWLVIKGAT

SEQ ID NO: 69239 - protein, 15 aa, Mycobacterium tuberculosis
KAKVGDWLVIKGATI

SEQ ID NO: 69240 - protein, 15 aa, Mycobacterium tuberculosis
AKVGDWLVIKGATID

SEQ ID NO: 69241 - protein, 15 aa, Mycobacterium tuberculosis
KVGDWLVIKGATIDQ

SEQ ID NO: 69242 - protein, 15 aa, Mycobacterium tuberculosis
VGDWLVIKGATIDQP

SEQ ID NO: 69243 - protein, 15 aa, Mycobacterium tuberculosis
GDWLVIKGATIDQPD

SEQ ID NO: 69244 - protein, 15 aa, Mycobacterium tuberculosis
DWLVIKGATIDQPDH

SEQ ID NO: 69245 - protein, 15 aa, Mycobacterium tuberculosis
WLVIKGATIDQPDHR

SEQ ID NO: 69246 - protein, 15 aa, Mycobacterium tuberculosis
LVIKGATIDQPDHRG

SEQ ID NO: 69247 - protein, 15 aa, Mycobacterium tuberculosis
VIKGATIDQPDHRGL

SEQ ID NO: 69248 - protein, 15 aa, Mycobacterium tuberculosis
IKGATIDQPDHRGLI

SEQ ID NO: 69249 - protein, 15 aa, Mycobacterium tuberculosis
KGATIDQPDHRGLII

SEQ ID NO: 69250 - protein, 15 aa, Mycobacterium tuberculosis
GATIDQPDHRGLIIE

SEQ ID NO: 69251 - protein, 15 aa, Mycobacterium tuberculosis
ATIDQPDHRGLIIEV

SEQ ID NO: 69252 - protein, 15 aa, Mycobacterium tuberculosis
TIDQPDHRGLIIEVR

SEQ ID NO: 69253 - protein, 15 aa, Mycobacterium tuberculosis
IDQPDHRGLIIEVRS

SEQ ID NO: 69254 - protein, 15 aa, Mycobacterium tuberculosis
DQPDHRGLIIEVRSS

SEQ ID NO: 69255 - protein, 15 aa, Mycobacterium tuberculosis
QPDHRGLIIEVRSSD

SEQ ID NO: 69256 - protein, 15 aa, Mycobacterium tuberculosis
PDHRGLIIEVRSSDG

SEQ ID NO: 69257 - protein, 15 aa, Mycobacterium tuberculosis
DHRGLIIEVRSSDGS

SEQ ID NO: 69258 - protein, 15 aa, Mycobacterium tuberculosis
HRGLIIEVRSSDGSP

SEQ ID NO: 69259 - protein, 15 aa, Mycobacterium tuberculosis
RGLIIEVRSSDGSPP

SEQ ID NO: 69260 - protein, 15 aa, Mycobacterium tuberculosis
GLIIEVRSSDGSPPY

SEQ ID NO: 69261 - protein, 15 aa, Mycobacterium tuberculosis
LIIEVRSSDGSPPYV

SEQ ID NO: 69262 - protein, 15 aa, Mycobacterium tuberculosis
IIEVRSSDGSPPYVV

SEQ ID NO: 69263 - protein, 15 aa, Mycobacterium tuberculosis
IEVRSSDGSPPYVVR

SEQ ID NO: 69264 - protein, 15 aa, Mycobacterium tuberculosis
EVRSSDGSPPYVVRW

SEQ ID NO: 69265 - protein, 15 aa, Mycobacterium tuberculosis
VRSSDGSPPYVVRWL

SEQ ID NO: 69266 - protein, 15 aa, Mycobacterium tuberculosis
RSSDGSPPYVVRWLE

SEQ ID NO: 69267 - protein, 15 aa, Mycobacterium tuberculosis
SSDGSPPYVVRWLET

SEQ ID NO: 69268 - protein, 15 aa, Mycobacterium tuberculosis
SDGSPPYVVRWLETD

SEQ ID NO: 69269 - protein, 15 aa, Mycobacterium tuberculosis
DGSPPYVVRWLETDH

SEQ ID NO: 69270 - protein, 15 aa, Mycobacterium tuberculosis
GSPPYVVRWLETDHV

SEQ ID NO: 69271 - protein, 15 aa, Mycobacterium tuberculosis
SPPYVVRWLETDHVA

SEQ ID NO: 69272 - protein, 15 aa, Mycobacterium tuberculosis
PPYVVRWLETDHVAT

SEQ ID NO: 69273 - protein, 15 aa, Mycobacterium tuberculosis
PYVVRWLETDHVATV

SEQ ID NO: 69274 - protein, 15 aa, Mycobacterium tuberculosis
YVVRWLETDHVATVI

SEQ ID NO: 69275 - protein, 15 aa, Mycobacterium tuberculosis
VVRWLETDHVATVIP

SEQ ID NO: 69276 - protein, 15 aa, Mycobacterium tuberculosis
VRWLETDHVATVIPG

SEQ ID NO: 69277 - protein, 15 aa, Mycobacterium tuberculosis
RWLETDHVATVIPGP

SEQ ID NO: 69278 - protein, 15 aa, Mycobacterium tuberculosis
WLETDHVATVIPGPD

SEQ ID NO: 69279 - protein, 15 aa, Mycobacterium tuberculosis
LETDHVATVIPGPDA

SEQ ID NO: 69280 - protein, 15 aa, Mycobacterium tuberculosis
ETDHVATVIPGPDAV

SEQ ID NO: 69281 - protein, 15 aa, Mycobacterium tuberculosis
TDHVATVIPGPDAVV

SEQ ID NO: 69282 - protein, 15 aa, Mycobacterium tuberculosis
DHVATVIPGPDAVVV

SEQ ID NO: 69283 - protein, 15 aa, Mycobacterium tuberculosis
HVATVIPGPDAVVVT

SEQ ID NO: 69284 - protein, 15 aa, Mycobacterium tuberculosis
VATVIPGPDAVVVTA

SEQ ID NO: 69285 - protein, 15 aa, Mycobacterium tuberculosis
ATVIPGPDAVVVTAE

SEQ ID NO: 69286 - protein, 15 aa, Mycobacterium tuberculosis
TVIPGPDAVVVTAEE

SEQ ID NO: 69287 - protein, 15 aa, Mycobacterium tuberculosis
VIPGPDAVVVTAEEQ

SEQ ID NO: 69288 - protein, 15 aa, Mycobacterium tuberculosis
IPGPDAVVVTAEEQN

SEQ ID NO: 69289 - protein, 15 aa, Mycobacterium tuberculosis
PGPDAVVVTAEEQNA

SEQ ID NO: 69290 - protein, 15 aa, Mycobacterium tuberculosis
GPDAVVVTAEEQNAA

SEQ ID NO: 69291 - protein, 15 aa, Mycobacterium tuberculosis
PDAVVVTAEEQNAAD

SEQ ID NO: 69292 - protein, 15 aa, Mycobacterium tuberculosis
DAVVVTAEEQNAADE

SEQ ID NO: 69293 - protein, 15 aa, Mycobacterium tuberculosis
AVVVTAEEQNAADER

SEQ ID NO: 69294 - protein, 15 aa, Mycobacterium tuberculosis
VVVTAEEQNAADERA

SEQ ID NO: 69295 - protein, 15 aa, Mycobacterium tuberculosis
VVTAEEQNAADERAQ

SEQ ID NO: 69296 - protein, 15 aa, Mycobacterium tuberculosis
VTAEEQNAADERAQH

SEQ ID NO: 69297 - protein, 15 aa, Mycobacterium tuberculosis
TAEEQNAADERAQHR

SEQ ID NO: 69298 - protein, 15 aa, Mycobacterium tuberculosis
AEEQNAADERAQHRF

SEQ ID NO: 69299 - protein, 15 aa, Mycobacterium tuberculosis
EEQNAADERAQHRFG

SEQ ID NO: 69300 - protein, 15 aa, Mycobacterium tuberculosis
EQNAADERAQHRFGA

SEQ ID NO: 69301 - protein, 15 aa, Mycobacterium tuberculosis
QNAADERAQHRFGAV

SEQ ID NO: 69302 - protein, 15 aa, Mycobacterium tuberculosis
NAADERAQHRFGAVQ

SEQ ID NO: 69303 - protein, 15 aa, Mycobacterium tuberculosis
AADERAQHRFGAVQS

SEQ ID NO: 69304 - protein, 15 aa, Mycobacterium tuberculosis
ADERAQHRFGAVQSA

SEQ ID NO: 69305 - protein, 15 aa, Mycobacterium tuberculosis
DERAQHRFGAVQSAI

SEQ ID NO: 69306 - protein, 15 aa, Mycobacterium tuberculosis
ERAQHRFGAVQSAIL

SEQ ID NO: 69307 - protein, 15 aa, Mycobacterium tuberculosis
RAQHRFGAVQSAILH

SEQ ID NO: 69308 - protein, 15 aa, Mycobacterium tuberculosis
AQHRFGAVQSAILHA

SEQ ID NO: 69309 - protein, 15 aa, Mycobacterium tuberculosis
QHRFGAVQSAILHAR

SEQ ID NO: 69310 - protein, 15 aa, Mycobacterium tuberculosis
HRFGAVQSAILHARG

SEQ ID NO: 69311 - protein, 15 aa, Mycobacterium tuberculosis
RFGAVQSAILHARGT

SEQ ID NO: 69312 - protein, 16 aa, Mycobacterium tuberculosis
MKAKVGDWLVIKGATI

SEQ ID NO: 69313 - protein, 16 aa, Mycobacterium tuberculosis
KAKVGDWLVIKGATID

SEQ ID NO: 69314 - protein, 16 aa, Mycobacterium tuberculosis
AKVGDWLVIKGATIDQ

SEQ ID NO: 69315 - protein, 16 aa, Mycobacterium tuberculosis
KVGDWLVIKGATIDQP

SEQ ID NO: 69316 - protein, 16 aa, Mycobacterium tuberculosis
VGDWLVIKGATIDQPD

SEQ ID NO: 69317 - protein, 16 aa, Mycobacterium tuberculosis
GDWLVIKGATIDQPDH

SEQ ID NO: 69318 - protein, 16 aa, Mycobacterium tuberculosis
DWLVIKGATIDQPDHR

SEQ ID NO: 69319 - protein, 16 aa, Mycobacterium tuberculosis
WLVIKGATIDQPDHRG

SEQ ID NO: 69320 - protein, 16 aa, Mycobacterium tuberculosis
LVIKGATIDQPDHRGL

SEQ ID NO: 69321 - protein, 16 aa, Mycobacterium tuberculosis
VIKGATIDQPDHRGLI

SEQ ID NO: 69322 - protein, 16 aa, Mycobacterium tuberculosis
IKGATIDQPDHRGLII

SEQ ID NO: 69323 - protein, 16 aa, Mycobacterium tuberculosis
KGATIDQPDHRGLIIE

SEQ ID NO: 69324 - protein, 16 aa, Mycobacterium tuberculosis
GATIDQPDHRGLIIEV

SEQ ID NO: 69325 - protein, 16 aa, Mycobacterium tuberculosis
ATIDQPDHRGLIIEVR

SEQ ID NO: 69326 - protein, 16 aa, Mycobacterium tuberculosis
TIDQPDHRGLIIEVRS

SEQ ID NO: 69327 - protein, 16 aa, Mycobacterium tuberculosis
IDQPDHRGLIIEVRSS

SEQ ID NO: 69328 - protein, 16 aa, Mycobacterium tuberculosis
DQPDHRGLIIEVRSSD

SEQ ID NO: 69329 - protein, 16 aa, Mycobacterium tuberculosis
QPDHRGLIIEVRSSDG

SEQ ID NO: 69330 - protein, 16 aa, Mycobacterium tuberculosis
PDHRGLIIEVRSSDGS

SEQ ID NO: 69331 - protein, 16 aa, Mycobacterium tuberculosis
DHRGLIIEVRSSDGSP

SEQ ID NO: 69332 - protein, 16 aa, Mycobacterium tuberculosis
HRGLIIEVRSSDGSPP

SEQ ID NO: 69333 - protein, 16 aa, Mycobacterium tuberculosis
RGLIIEVRSSDGSPPY

SEQ ID NO: 69334 - protein, 16 aa, Mycobacterium tuberculosis
GLIIEVRSSDGSPPYV

SEQ ID NO: 69335 - protein, 16 aa, Mycobacterium tuberculosis
LIIEVRSSDGSPPYVV

SEQ ID NO: 69336 - protein, 16 aa, Mycobacterium tuberculosis
IIEVRSSDGSPPYVVR

SEQ ID NO: 69337 - protein, 16 aa, Mycobacterium tuberculosis
IEVRSSDGSPPYVVRW

SEQ ID NO: 69338 - protein, 16 aa, Mycobacterium tuberculosis
EVRSSDGSPPYVVRWL

SEQ ID NO: 69339 - protein, 16 aa, Mycobacterium tuberculosis
VRSSDGSPPYVVRWLE

SEQ ID NO: 69340 - protein, 16 aa, Mycobacterium tuberculosis
RSSDGSPPYVVRWLET

SEQ ID NO: 69341 - protein, 16 aa, Mycobacterium tuberculosis
SSDGSPPYVVRWLETD

SEQ ID NO: 69342 - protein, 16 aa, Mycobacterium tuberculosis
SDGSPPYVVRWLETDH

SEQ ID NO: 69343 - protein, 16 aa, Mycobacterium tuberculosis
DGSPPYVVRWLETDHV

SEQ ID NO: 69344 - protein, 16 aa, Mycobacterium tuberculosis
GSPPYVVRWLETDHVA

SEQ ID NO: 69345 - protein, 16 aa, Mycobacterium tuberculosis
SPPYVVRWLETDHVAT

SEQ ID NO: 69346 - protein, 16 aa, Mycobacterium tuberculosis
PPYVVRWLETDHVATV

SEQ ID NO: 69347 - protein, 16 aa, Mycobacterium tuberculosis
PYVVRWLETDHVATVI

SEQ ID NO: 69348 - protein, 16 aa, Mycobacterium tuberculosis
YVVRWLETDHVATVIP

SEQ ID NO: 69349 - protein, 16 aa, Mycobacterium tuberculosis
VVRWLETDHVATVIPG

SEQ ID NO: 69350 - protein, 16 aa, Mycobacterium tuberculosis
VRWLETDHVATVIPGP

SEQ ID NO: 69351 - protein, 16 aa, Mycobacterium tuberculosis
RWLETDHVATVIPGPD

SEQ ID NO: 69352 - protein, 16 aa, Mycobacterium tuberculosis
WLETDHVATVIPGPDA

SEQ ID NO: 69353 - protein, 16 aa, Mycobacterium tuberculosis
LETDHVATVIPGPDAV

SEQ ID NO: 69354 - protein, 16 aa, Mycobacterium tuberculosis
ETDHVATVIPGPDAVV

SEQ ID NO: 69355 - protein, 16 aa, Mycobacterium tuberculosis
TDHVATVIPGPDAVVV

SEQ ID NO: 69356 - protein, 16 aa, Mycobacterium tuberculosis
DHVATVIPGPDAVVVT

SEQ ID NO: 69357 - protein, 16 aa, Mycobacterium tuberculosis
HVATVIPGPDAVVVTA

SEQ ID NO: 69358 - protein, 16 aa, Mycobacterium tuberculosis
VATVIPGPDAVVVTAE

SEQ ID NO: 69359 - protein, 16 aa, Mycobacterium tuberculosis
ATVIPGPDAVVVTAEE

SEQ ID NO: 69360 - protein, 16 aa, Mycobacterium tuberculosis
TVIPGPDAVVVTAEEQ

SEQ ID NO: 69361 - protein, 16 aa, Mycobacterium tuberculosis
VIPGPDAVVVTAEEQN

SEQ ID NO: 69362 - protein, 16 aa, Mycobacterium tuberculosis
IPGPDAVVVTAEEQNA

SEQ ID NO: 69363 - protein, 16 aa, Mycobacterium tuberculosis
PGPDAVVVTAEEQNAA

SEQ ID NO: 69364 - protein, 16 aa, Mycobacterium tuberculosis
GPDAVVVTAEEQNAAD

SEQ ID NO: 69365 - protein, 16 aa, Mycobacterium tuberculosis
PDAVVVTAEEQNAADE

SEQ ID NO: 69366 - protein, 16 aa, Mycobacterium tuberculosis
DAVVVTAEEQNAADER

SEQ ID NO: 69367 - protein, 16 aa, Mycobacterium tuberculosis
AVVVTAEEQNAADERA

SEQ ID NO: 69368 - protein, 16 aa, Mycobacterium tuberculosis
VVVTAEEQNAADERAQ

SEQ ID NO: 69369 - protein, 16 aa, Mycobacterium tuberculosis
VVTAEEQNAADERAQH

SEQ ID NO: 69370 - protein, 16 aa, Mycobacterium tuberculosis
VTAEEQNAADERAQHR

SEQ ID NO: 69371 - protein, 16 aa, Mycobacterium tuberculosis
TAEEQNAADERAQHRF

SEQ ID NO: 69372 - protein, 16 aa, Mycobacterium tuberculosis
AEEQNAADERAQHRFG

SEQ ID NO: 69373 - protein, 16 aa, Mycobacterium tuberculosis
EEQNAADERAQHRFGA

SEQ ID NO: 69374 - protein, 16 aa, Mycobacterium tuberculosis
EQNAADERAQHRFGAV

SEQ ID NO: 69375 - protein, 16 aa, Mycobacterium tuberculosis
QNAADERAQHRFGAVQ

SEQ ID NO: 69376 - protein, 16 aa, Mycobacterium tuberculosis
NAADERAQHRFGAVQS

SEQ ID NO: 69377 - protein, 16 aa, Mycobacterium tuberculosis
AADERAQHRFGAVQSA

SEQ ID NO: 69378 - protein, 16 aa, Mycobacterium tuberculosis
ADERAQHRFGAVQSAI

SEQ ID NO: 69379 - protein, 16 aa, Mycobacterium tuberculosis
DERAQHRFGAVQSAIL

SEQ ID NO: 69380 - protein, 16 aa, Mycobacterium tuberculosis
ERAQHRFGAVQSAILH

SEQ ID NO: 69381 - protein, 16 aa, Mycobacterium tuberculosis
RAQHRFGAVQSAILHA

SEQ ID NO: 69382 - protein, 16 aa, Mycobacterium tuberculosis
AQHRFGAVQSAILHAR

SEQ ID NO: 69383 - protein, 16 aa, Mycobacterium tuberculosis
QHRFGAVQSAILHARG

SEQ ID NO: 69384 - protein, 16 aa, Mycobacterium tuberculosis
HRFGAVQSAILHARGT

SEQ ID NO: 69385 - protein, 13 aa, Mycobacterium tuberculosis
MSRRAIHSGRAAP

SEQ ID NO: 69386 - protein, 13 aa, Mycobacterium tuberculosis
SRRAIHSGRAAPR

SEQ ID NO: 69387 - protein, 13 aa, Mycobacterium tuberculosis
RRAIHSGRAAPRR

SEQ ID NO: 69388 - protein, 13 aa, Mycobacterium tuberculosis
RAIHSGRAAPRRS

SEQ ID NO: 69389 - protein, 13 aa, Mycobacterium tuberculosis
AIHSGRAAPRRSG

SEQ ID NO: 69390 - protein, 13 aa, Mycobacterium tuberculosis
IHSGRAAPRRSGN

SEQ ID NO: 69391 - protein, 13 aa, Mycobacterium tuberculosis
HSGRAAPRRSGNS

SEQ ID NO: 69392 - protein, 13 aa, Mycobacterium tuberculosis
SGRAAPRRSGNSH

SEQ ID NO: 69393 - protein, 13 aa, Mycobacterium tuberculosis
GRAAPRRSGNSHL

SEQ ID NO: 69394 - protein, 13 aa, Mycobacterium tuberculosis
RAAPRRSGNSHLV

SEQ ID NO: 69395 - protein, 13 aa, Mycobacterium tuberculosis
AAPRRSGNSHLVL

SEQ ID NO: 69396 - protein, 13 aa, Mycobacterium tuberculosis
APRRSGNSHLVLR

SEQ ID NO: 69397 - protein, 13 aa, Mycobacterium tuberculosis
PRRSGNSHLVLRN

SEQ ID NO: 69398 - protein, 13 aa, Mycobacterium tuberculosis
RRSGNSHLVLRNR

SEQ ID NO: 69399 - protein, 13 aa, Mycobacterium tuberculosis
RSGNSHLVLRNRV

SEQ ID NO: 69400 - protein, 13 aa, Mycobacterium tuberculosis
SGNSHLVLRNRVP

SEQ ID NO: 69401 - protein, 13 aa, Mycobacterium tuberculosis
GNSHLVLRNRVPS

SEQ ID NO: 69402 - protein, 13 aa, Mycobacterium tuberculosis
NSHLVLRNRVPSS

SEQ ID NO: 69403 - protein, 13 aa, Mycobacterium tuberculosis
SHLVLRNRVPSSK

SEQ ID NO: 69404 - protein, 13 aa, Mycobacterium tuberculosis
HLVLRNRVPSSKD

SEQ ID NO: 69405 - protein, 13 aa, Mycobacterium tuberculosis
LVLRNRVPSSKDS

SEQ ID NO: 69406 - protein, 13 aa, Mycobacterium tuberculosis
VLRNRVPSSKDSP

SEQ ID NO: 69407 - protein, 13 aa, Mycobacterium tuberculosis
LRNRVPSSKDSPR

SEQ ID NO: 69408 - protein, 13 aa, Mycobacterium tuberculosis
RNRVPSSKDSPRR

SEQ ID NO: 69409 - protein, 13 aa, Mycobacterium tuberculosis
NRVPSSKDSPRRR

SEQ ID NO: 69410 - protein, 13 aa, Mycobacterium tuberculosis
RVPSSKDSPRRRP

SEQ ID NO: 69411 - protein, 13 aa, Mycobacterium tuberculosis
VPSSKDSPRRRPH

SEQ ID NO: 69412 - protein, 13 aa, Mycobacterium tuberculosis
PSSKDSPRRRPHH

SEQ ID NO: 69413 - protein, 13 aa, Mycobacterium tuberculosis
SSKDSPRRRPHHE

SEQ ID NO: 69414 - protein, 13 aa, Mycobacterium tuberculosis
SKDSPRRRPHHEF

SEQ ID NO: 69415 - protein, 13 aa, Mycobacterium tuberculosis
KDSPRRRPHHEFM

SEQ ID NO: 69416 - protein, 13 aa, Mycobacterium tuberculosis
DSPRRRPHHEFMT

SEQ ID NO: 69417 - protein, 13 aa, Mycobacterium tuberculosis
SPRRRPHHEFMTE

SEQ ID NO: 69418 - protein, 13 aa, Mycobacterium tuberculosis
PRRRPHHEFMTES

SEQ ID NO: 69419 - protein, 13 aa, Mycobacterium tuberculosis
RRRPHHEFMTESI

SEQ ID NO: 69420 - protein, 13 aa, Mycobacterium tuberculosis
RRPHHEFMTESIG

SEQ ID NO: 69421 - protein, 13 aa, Mycobacterium tuberculosis
RPHHEFMTESIGE

SEQ ID NO: 69422 - protein, 13 aa, Mycobacterium tuberculosis
PHHEFMTESIGEP

SEQ ID NO: 69423 - protein, 13 aa, Mycobacterium tuberculosis
HHEFMTESIGEPL

SEQ ID NO: 69424 - protein, 13 aa, Mycobacterium tuberculosis
HEFMTESIGEPLS

SEQ ID NO: 69425 - protein, 13 aa, Mycobacterium tuberculosis
EFMTESIGEPLST

SEQ ID NO: 69426 - protein, 13 aa, Mycobacterium tuberculosis
FMTESIGEPLSTN

SEQ ID NO: 69427 - protein, 13 aa, Mycobacterium tuberculosis
MTESIGEPLSTNL

SEQ ID NO: 69428 - protein, 13 aa, Mycobacterium tuberculosis
TESIGEPLSTNLI

SEQ ID NO: 69429 - protein, 13 aa, Mycobacterium tuberculosis
ESIGEPLSTNLIE

SEQ ID NO: 69430 - protein, 13 aa, Mycobacterium tuberculosis
SIGEPLSTNLIER

SEQ ID NO: 69431 - protein, 13 aa, Mycobacterium tuberculosis
IGEPLSTNLIERY

SEQ ID NO: 69432 - protein, 13 aa, Mycobacterium tuberculosis
GEPLSTNLIERYL

SEQ ID NO: 69433 - protein, 13 aa, Mycobacterium tuberculosis
EPLSTNLIERYLR

SEQ ID NO: 69434 - protein, 13 aa, Mycobacterium tuberculosis
PLSTNLIERYLRA

SEQ ID NO: 69435 - protein, 13 aa, Mycobacterium tuberculosis
LSTNLIERYLRAR

SEQ ID NO: 69436 - protein, 13 aa, Mycobacterium tuberculosis
STNLIERYLRARG

SEQ ID NO: 69437 - protein, 13 aa, Mycobacterium tuberculosis
TNLIERYLRARGR

SEQ ID NO: 69438 - protein, 13 aa, Mycobacterium tuberculosis
NLIERYLRARGRR

SEQ ID NO: 69439 - protein, 13 aa, Mycobacterium tuberculosis
LIERYLRARGRRY

SEQ ID NO: 69440 - protein, 13 aa, Mycobacterium tuberculosis
IERYLRARGRRYF

SEQ ID NO: 69441 - protein, 13 aa, Mycobacterium tuberculosis
ERYLRARGRRYFR

SEQ ID NO: 69442 - protein, 13 aa, Mycobacterium tuberculosis
RYLRARGRRYFRG

SEQ ID NO: 69443 - protein, 13 aa, Mycobacterium tuberculosis
YLRARGRRYFRGH

SEQ ID NO: 69444 - protein, 13 aa, Mycobacterium tuberculosis
LRARGRRYFRGHH

SEQ ID NO: 69445 - protein, 13 aa, Mycobacterium tuberculosis
RARGRRYFRGHHD

SEQ ID NO: 69446 - protein, 13 aa, Mycobacterium tuberculosis
ARGRRYFRGHHDA

SEQ ID NO: 69447 - protein, 13 aa, Mycobacterium tuberculosis
RGRRYFRGHHDAE

SEQ ID NO: 69448 - protein, 13 aa, Mycobacterium tuberculosis
GRRYFRGHHDAEF

SEQ ID NO: 69449 - protein, 13 aa, Mycobacterium tuberculosis
RRYFRGHHDAEFF

SEQ ID NO: 69450 - protein, 13 aa, Mycobacterium tuberculosis
RYFRGHHDAEFFF

SEQ ID NO: 69451 - protein, 13 aa, Mycobacterium tuberculosis
YFRGHHDAEFFFV

SEQ ID NO: 69452 - protein, 13 aa, Mycobacterium tuberculosis
FRGHHDAEFFFVA

SEQ ID NO: 69453 - protein, 13 aa, Mycobacterium tuberculosis
RGHHDAEFFFVAN

SEQ ID NO: 69454 - protein, 13 aa, Mycobacterium tuberculosis
GHHDAEFFFVANA

SEQ ID NO: 69455 - protein, 13 aa, Mycobacterium tuberculosis
HHDAEFFFVANAH

SEQ ID NO: 69456 - protein, 13 aa, Mycobacterium tuberculosis
HDAEFFFVANAHL

SEQ ID NO: 69457 - protein, 13 aa, Mycobacterium tuberculosis
DAEFFFVANAHLL

SEQ ID NO: 69458 - protein, 13 aa, Mycobacterium tuberculosis
AEFFFVANAHLLH

SEQ ID NO: 69459 - protein, 13 aa, Mycobacterium tuberculosis
EFFFVANAHLLHV

SEQ ID NO: 69460 - protein, 13 aa, Mycobacterium tuberculosis
FFFVANAHLLHVH

SEQ ID NO: 69461 - protein, 13 aa, Mycobacterium tuberculosis
FFVANAHLLHVHL

SEQ ID NO: 69462 - protein, 13 aa, Mycobacterium tuberculosis
FVANAHLLHVHLE

SEQ ID NO: 69463 - protein, 13 aa, Mycobacterium tuberculosis
VANAHLLHVHLEI

SEQ ID NO: 69464 - protein, 13 aa, Mycobacterium tuberculosis
ANAHLLHVHLEIS

SEQ ID NO: 69465 - protein, 13 aa, Mycobacterium tuberculosis
NAHLLHVHLEISP

SEQ ID NO: 69466 - protein, 13 aa, Mycobacterium tuberculosis
AHLLHVHLEISPA

SEQ ID NO: 69467 - protein, 13 aa, Mycobacterium tuberculosis
HLLHVHLEISPAY

SEQ ID NO: 69468 - protein, 13 aa, Mycobacterium tuberculosis
LLHVHLEISPAYR

SEQ ID NO: 69469 - protein, 13 aa, Mycobacterium tuberculosis
LHVHLEISPAYRD

SEQ ID NO: 69470 - protein, 13 aa, Mycobacterium tuberculosis
HVHLEISPAYRDV

SEQ ID NO: 69471 - protein, 13 aa, Mycobacterium tuberculosis
VHLEISPAYRDVF

SEQ ID NO: 69472 - protein, 13 aa, Mycobacterium tuberculosis
HLEISPAYRDVFT

SEQ ID NO: 69473 - protein, 13 aa, Mycobacterium tuberculosis
LEISPAYRDVFTI

SEQ ID NO: 69474 - protein, 13 aa, Mycobacterium tuberculosis
EISPAYRDVFTIR

SEQ ID NO: 69475 - protein, 13 aa, Mycobacterium tuberculosis
ISPAYRDVFTIRV

SEQ ID NO: 69476 - protein, 13 aa, Mycobacterium tuberculosis
SPAYRDVFTIRVS

SEQ ID NO: 69477 - protein, 13 aa, Mycobacterium tuberculosis
PAYRDVFTIRVSP

SEQ ID NO: 69478 - protein, 13 aa, Mycobacterium tuberculosis
AYRDVFTIRVSPA

SEQ ID NO: 69479 - protein, 13 aa, Mycobacterium tuberculosis
YRDVFTIRVSPAY

SEQ ID NO: 69480 - protein, 13 aa, Mycobacterium tuberculosis
RDVFTIRVSPAYF

SEQ ID NO: 69481 - protein, 13 aa, Mycobacterium tuberculosis
DVFTIRVSPAYFF

SEQ ID NO: 69482 - protein, 13 aa, Mycobacterium tuberculosis
VFTIRVSPAYFFP

SEQ ID NO: 69483 - protein, 13 aa, Mycobacterium tuberculosis
FTIRVSPAYFFPA

SEQ ID NO: 69484 - protein, 13 aa, Mycobacterium tuberculosis
TIRVSPAYFFPAT

SEQ ID NO: 69485 - protein, 13 aa, Mycobacterium tuberculosis
IRVSPAYFFPATD

SEQ ID NO: 69486 - protein, 13 aa, Mycobacterium tuberculosis
RVSPAYFFPATDH

SEQ ID NO: 69487 - protein, 13 aa, Mycobacterium tuberculosis
VSPAYFFPATDHT

SEQ ID NO: 69488 - protein, 13 aa, Mycobacterium tuberculosis
SPAYFFPATDHTR

SEQ ID NO: 69489 - protein, 13 aa, Mycobacterium tuberculosis
PAYFFPATDHTRL

SEQ ID NO: 69490 - protein, 13 aa, Mycobacterium tuberculosis
AYFFPATDHTRLA

SEQ ID NO: 69491 - protein, 13 aa, Mycobacterium tuberculosis
YFFPATDHTRLAE

SEQ ID NO: 69492 - protein, 13 aa, Mycobacterium tuberculosis
FFPATDHTRLAEI

SEQ ID NO: 69493 - protein, 13 aa, Mycobacterium tuberculosis
FPATDHTRLAEIV

SEQ ID NO: 69494 - protein, 13 aa, Mycobacterium tuberculosis
PATDHTRLAEIVN

SEQ ID NO: 69495 - protein, 13 aa, Mycobacterium tuberculosis
ATDHTRLAEIVNA

SEQ ID NO: 69496 - protein, 13 aa, Mycobacterium tuberculosis
TDHTRLAEIVNAW

SEQ ID NO: 69497 - protein, 13 aa, Mycobacterium tuberculosis
DHTRLAEIVNAWN

SEQ ID NO: 69498 - protein, 13 aa, Mycobacterium tuberculosis
HTRLAEIVNAWNL

SEQ ID NO: 69499 - protein, 13 aa, Mycobacterium tuberculosis
TRLAEIVNAWNLQ

SEQ ID NO: 69500 - protein, 13 aa, Mycobacterium tuberculosis
RLAEIVNAWNLQN

SEQ ID NO: 69501 - protein, 13 aa, Mycobacterium tuberculosis
LAEIVNAWNLQNH

SEQ ID NO: 69502 - protein, 13 aa, Mycobacterium tuberculosis
AEIVNAWNLQNHE

SEQ ID NO: 69503 - protein, 13 aa, Mycobacterium tuberculosis
EIVNAWNLQNHEV

SEQ ID NO: 69504 - protein, 13 aa, Mycobacterium tuberculosis
IVNAWNLQNHEVT

SEQ ID NO: 69505 - protein, 13 aa, Mycobacterium tuberculosis
VNAWNLQNHEVTA

SEQ ID NO: 69506 - protein, 13 aa, Mycobacterium tuberculosis
NAWNLQNHEVTAI

SEQ ID NO: 69507 - protein, 13 aa, Mycobacterium tuberculosis
AWNLQNHEVTAIV

SEQ ID NO: 69508 - protein, 13 aa, Mycobacterium tuberculosis
WNLQNHEVTAIVH

SEQ ID NO: 69509 - protein, 13 aa, Mycobacterium tuberculosis
NLQNHEVTAIVHG

SEQ ID NO: 69510 - protein, 13 aa, Mycobacterium tuberculosis
LQNHEVTAIVHGS

SEQ ID NO: 69511 - protein, 13 aa, Mycobacterium tuberculosis
QNHEVTAIVHGSS

SEQ ID NO: 69512 - protein, 13 aa, Mycobacterium tuberculosis
NHEVTAIVHGSSD

SEQ ID NO: 69513 - protein, 13 aa, Mycobacterium tuberculosis
HEVTAIVHGSSDP

SEQ ID NO: 69514 - protein, 13 aa, Mycobacterium tuberculosis
EVTAIVHGSSDPH

SEQ ID NO: 69515 - protein, 13 aa, Mycobacterium tuberculosis
VTAIVHGSSDPHR

SEQ ID NO: 69516 - protein, 13 aa, Mycobacterium tuberculosis
TAIVHGSSDPHRI

SEQ ID NO: 69517 - protein, 13 aa, Mycobacterium tuberculosis
AIVHGSSDPHRIG

SEQ ID NO: 69518 - protein, 13 aa, Mycobacterium tuberculosis
IVHGSSDPHRIGV

SEQ ID NO: 69519 - protein, 13 aa, Mycobacterium tuberculosis
VHGSSDPHRIGVA

SEQ ID NO: 69520 - protein, 13 aa, Mycobacterium tuberculosis
HGSSDPHRIGVAA

SEQ ID NO: 69521 - protein, 13 aa, Mycobacterium tuberculosis
GSSDPHRIGVAAE

SEQ ID NO: 69522 - protein, 13 aa, Mycobacterium tuberculosis
SSDPHRIGVAAER

SEQ ID NO: 69523 - protein, 13 aa, Mycobacterium tuberculosis
SDPHRIGVAAERS

SEQ ID NO: 69524 - protein, 13 aa, Mycobacterium tuberculosis
DPHRIGVAAERSL

SEQ ID NO: 69525 - protein, 13 aa, Mycobacterium tuberculosis
PHRIGVAAERSLI

SEQ ID NO: 69526 - protein, 13 aa, Mycobacterium tuberculosis
HRIGVAAERSLIR

SEQ ID NO: 69527 - protein, 13 aa, Mycobacterium tuberculosis
RIGVAAERSLIRD

SEQ ID NO: 69528 - protein, 13 aa, Mycobacterium tuberculosis
IGVAAERSLIRDR

SEQ ID NO: 69529 - protein, 13 aa, Mycobacterium tuberculosis
GVAAERSLIRDRI

SEQ ID NO: 69530 - protein, 13 aa, Mycobacterium tuberculosis
VAAERSLIRDRIR

SEQ ID NO: 69531 - protein, 13 aa, Mycobacterium tuberculosis
AAERSLIRDRIRF

SEQ ID NO: 69532 - protein, 13 aa, Mycobacterium tuberculosis
AERSLIRDRIRFD

SEQ ID NO: 69533 - protein, 13 aa, Mycobacterium tuberculosis
ERSLIRDRIRFDD

SEQ ID NO: 69534 - protein, 13 aa, Mycobacterium tuberculosis
RSLIRDRIRFDDF

SEQ ID NO: 69535 - protein, 13 aa, Mycobacterium tuberculosis
SLIRDRIRFDDFA

SEQ ID NO: 69536 - protein, 13 aa, Mycobacterium tuberculosis
LIRDRIRFDDFAT

SEQ ID NO: 69537 - protein, 13 aa, Mycobacterium tuberculosis
IRDRIRFDDFATF

SEQ ID NO: 69538 - protein, 13 aa, Mycobacterium tuberculosis
RDRIRFDDFATFV

SEQ ID NO: 69539 - protein, 13 aa, Mycobacterium tuberculosis
DRIRFDDFATFVD

SEQ ID NO: 69540 - protein, 13 aa, Mycobacterium tuberculosis
RIRFDDFATFVDN

SEQ ID NO: 69541 - protein, 13 aa, Mycobacterium tuberculosis
IRFDDFATFVDNA

SEQ ID NO: 69542 - protein, 13 aa, Mycobacterium tuberculosis
RFDDFATFVDNAV

SEQ ID NO: 69543 - protein, 13 aa, Mycobacterium tuberculosis
FDDFATFVDNAVS

SEQ ID NO: 69544 - protein, 13 aa, Mycobacterium tuberculosis
DDFATFVDNAVSA

SEQ ID NO: 69545 - protein, 13 aa, Mycobacterium tuberculosis
DFATFVDNAVSAA

SEQ ID NO: 69546 - protein, 13 aa, Mycobacterium tuberculosis
FATFVDNAVSAAT

SEQ ID NO: 69547 - protein, 13 aa, Mycobacterium tuberculosis
ATFVDNAVSAATE

SEQ ID NO: 69548 - protein, 13 aa, Mycobacterium tuberculosis
TFVDNAVSAATEL

SEQ ID NO: 69549 - protein, 13 aa, Mycobacterium tuberculosis
FVDNAVSAATELF

SEQ ID NO: 69550 - protein, 13 aa, Mycobacterium tuberculosis
VDNAVSAATELFG

SEQ ID NO: 69551 - protein, 13 aa, Mycobacterium tuberculosis
DNAVSAATELFGQ

SEQ ID NO: 69552 - protein, 13 aa, Mycobacterium tuberculosis
NAVSAATELFGQL

SEQ ID NO: 69553 - protein, 13 aa, Mycobacterium tuberculosis
AVSAATELFGQLT

SEQ ID NO: 69554 - protein, 13 aa, Mycobacterium tuberculosis
VSAATELFGQLTA

SEQ ID NO: 69555 - protein, 13 aa, Mycobacterium tuberculosis
SAATELFGQLTAA

SEQ ID NO: 69556 - protein, 13 aa, Mycobacterium tuberculosis
AATELFGQLTAAG

SEQ ID NO: 69557 - protein, 13 aa, Mycobacterium tuberculosis
ATELFGQLTAAGL

SEQ ID NO: 69558 - protein, 13 aa, Mycobacterium tuberculosis
TELFGQLTAAGLP

SEQ ID NO: 69559 - protein, 13 aa, Mycobacterium tuberculosis
ELFGQLTAAGLPP

SEQ ID NO: 69560 - protein, 13 aa, Mycobacterium tuberculosis
LFGQLTAAGLPPT

SEQ ID NO: 69561 - protein, 13 aa, Mycobacterium tuberculosis
FGQLTAAGLPPTA

SEQ ID NO: 69562 - protein, 13 aa, Mycobacterium tuberculosis
GQLTAAGLPPTAT

SEQ ID NO: 69563 - protein, 13 aa, Mycobacterium tuberculosis
QLTAAGLPPTATP

SEQ ID NO: 69564 - protein, 13 aa, Mycobacterium tuberculosis
LTAAGLPPTATPP

SEQ ID NO: 69565 - protein, 13 aa, Mycobacterium tuberculosis
TAAGLPPTATPPL

SEQ ID NO: 69566 - protein, 13 aa, Mycobacterium tuberculosis
AAGLPPTATPPLL

SEQ ID NO: 69567 - protein, 13 aa, Mycobacterium tuberculosis
AGLPPTATPPLLR

SEQ ID NO: 69568 - protein, 13 aa, Mycobacterium tuberculosis
GLPPTATPPLLRD

SEQ ID NO: 69569 - protein, 13 aa, Mycobacterium tuberculosis
LPPTATPPLLRDA

SEQ ID NO: 69570 - protein, 13 aa, Mycobacterium tuberculosis
PPTATPPLLRDAG

SEQ ID NO: 69571 - protein, 14 aa, Mycobacterium tuberculosis
MSRRAIHSGRAAPR

SEQ ID NO: 69572 - protein, 14 aa, Mycobacterium tuberculosis
SRRAIHSGRAAPRR

SEQ ID NO: 69573 - protein, 14 aa, Mycobacterium tuberculosis
RRAIHSGRAAPRRS

SEQ ID NO: 69574 - protein, 14 aa, Mycobacterium tuberculosis
RAIHSGRAAPRRSG

SEQ ID NO: 69575 - protein, 14 aa, Mycobacterium tuberculosis
AIHSGRAAPRRSGN

SEQ ID NO: 69576 - protein, 14 aa, Mycobacterium tuberculosis
IHSGRAAPRRSGNS

SEQ ID NO: 69577 - protein, 14 aa, Mycobacterium tuberculosis
HSGRAAPRRSGNSH

SEQ ID NO: 69578 - protein, 14 aa, Mycobacterium tuberculosis
SGRAAPRRSGNSHL

SEQ ID NO: 69579 - protein, 14 aa, Mycobacterium tuberculosis
GRAAPRRSGNSHLV

SEQ ID NO: 69580 - protein, 14 aa, Mycobacterium tuberculosis
RAAPRRSGNSHLVL

SEQ ID NO: 69581 - protein, 14 aa, Mycobacterium tuberculosis
AAPRRSGNSHLVLR

SEQ ID NO: 69582 - protein, 14 aa, Mycobacterium tuberculosis
APRRSGNSHLVLRN

SEQ ID NO: 69583 - protein, 14 aa, Mycobacterium tuberculosis
PRRSGNSHLVLRNR

SEQ ID NO: 69584 - protein, 14 aa, Mycobacterium tuberculosis
RRSGNSHLVLRNRV

SEQ ID NO: 69585 - protein, 14 aa, Mycobacterium tuberculosis
RSGNSHLVLRNRVP

SEQ ID NO: 69586 - protein, 14 aa, Mycobacterium tuberculosis
SGNSHLVLRNRVPS

SEQ ID NO: 69587 - protein, 14 aa, Mycobacterium tuberculosis
GNSHLVLRNRVPSS

SEQ ID NO: 69588 - protein, 14 aa, Mycobacterium tuberculosis
NSHLVLRNRVPSSK

SEQ ID NO: 69589 - protein, 14 aa, Mycobacterium tuberculosis
SHLVLRNRVPSSKD

SEQ ID NO: 69590 - protein, 14 aa, Mycobacterium tuberculosis
HLVLRNRVPSSKDS

SEQ ID NO: 69591 - protein, 14 aa, Mycobacterium tuberculosis
LVLRNRVPSSKDSP

SEQ ID NO: 69592 - protein, 14 aa, Mycobacterium tuberculosis
VLRNRVPSSKDSPR

SEQ ID NO: 69593 - protein, 14 aa, Mycobacterium tuberculosis
LRNRVPSSKDSPRR

SEQ ID NO: 69594 - protein, 14 aa, Mycobacterium tuberculosis
RNRVPSSKDSPRRR

SEQ ID NO: 69595 - protein, 14 aa, Mycobacterium tuberculosis
NRVPSSKDSPRRRP

SEQ ID NO: 69596 - protein, 14 aa, Mycobacterium tuberculosis
RVPSSKDSPRRRPH

SEQ ID NO: 69597 - protein, 14 aa, Mycobacterium tuberculosis
VPSSKDSPRRRPHH

SEQ ID NO: 69598 - protein, 14 aa, Mycobacterium tuberculosis
PSSKDSPRRRPHHE

SEQ ID NO: 69599 - protein, 14 aa, Mycobacterium tuberculosis
SSKDSPRRRPHHEF

SEQ ID NO: 69600 - protein, 14 aa, Mycobacterium tuberculosis
SKDSPRRRPHHEFM

SEQ ID NO: 69601 - protein, 14 aa, Mycobacterium tuberculosis
KDSPRRRPHHEFMT

SEQ ID NO: 69602 - protein, 14 aa, Mycobacterium tuberculosis
DSPRRRPHHEFMTE

SEQ ID NO: 69603 - protein, 14 aa, Mycobacterium tuberculosis
SPRRRPHHEFMTES

SEQ ID NO: 69604 - protein, 14 aa, Mycobacterium tuberculosis
PRRRPHHEFMTESI

SEQ ID NO: 69605 - protein, 14 aa, Mycobacterium tuberculosis
RRRPHHEFMTESIG

SEQ ID NO: 69606 - protein, 14 aa, Mycobacterium tuberculosis
RRPHHEFMTESIGE

SEQ ID NO: 69607 - protein, 14 aa, Mycobacterium tuberculosis
RPHHEFMTESIGEP

SEQ ID NO: 69608 - protein, 14 aa, Mycobacterium tuberculosis
PHHEFMTESIGEPL

SEQ ID NO: 69609 - protein, 14 aa, Mycobacterium tuberculosis
HHEFMTESIGEPLS

SEQ ID NO: 69610 - protein, 14 aa, Mycobacterium tuberculosis
HEFMTESIGEPLST

SEQ ID NO: 69611 - protein, 14 aa, Mycobacterium tuberculosis
EFMTESIGEPLSTN

SEQ ID NO: 69612 - protein, 14 aa, Mycobacterium tuberculosis
FMTESIGEPLSTNL

SEQ ID NO: 69613 - protein, 14 aa, Mycobacterium tuberculosis
MTESIGEPLSTNLI

SEQ ID NO: 69614 - protein, 14 aa, Mycobacterium tuberculosis
TESIGEPLSTNLIE

SEQ ID NO: 69615 - protein, 14 aa, Mycobacterium tuberculosis
ESIGEPLSTNLIER

SEQ ID NO: 69616 - protein, 14 aa, Mycobacterium tuberculosis
SIGEPLSTNLIERY

SEQ ID NO: 69617 - protein, 14 aa, Mycobacterium tuberculosis
IGEPLSTNLIERYL

SEQ ID NO: 69618 - protein, 14 aa, Mycobacterium tuberculosis
GEPLSTNLIERYLR

SEQ ID NO: 69619 - protein, 14 aa, Mycobacterium tuberculosis
EPLSTNLIERYLRA

SEQ ID NO: 69620 - protein, 14 aa, Mycobacterium tuberculosis
PLSTNLIERYLRAR

SEQ ID NO: 69621 - protein, 14 aa, Mycobacterium tuberculosis
LSTNLIERYLRARG

SEQ ID NO: 69622 - protein, 14 aa, Mycobacterium tuberculosis
STNLIERYLRARGR

SEQ ID NO: 69623 - protein, 14 aa, Mycobacterium tuberculosis
TNLIERYLRARGRR

SEQ ID NO: 69624 - protein, 14 aa, Mycobacterium tuberculosis
NLIERYLRARGRRY

SEQ ID NO: 69625 - protein, 14 aa, Mycobacterium tuberculosis
LIERYLRARGRRYF

SEQ ID NO: 69626 - protein, 14 aa, Mycobacterium tuberculosis
IERYLRARGRRYFR

SEQ ID NO: 69627 - protein, 14 aa, Mycobacterium tuberculosis
ERYLRARGRRYFRG

SEQ ID NO: 69628 - protein, 14 aa, Mycobacterium tuberculosis
RYLRARGRRYFRGH

SEQ ID NO: 69629 - protein, 14 aa, Mycobacterium tuberculosis
YLRARGRRYFRGHH

SEQ ID NO: 69630 - protein, 14 aa, Mycobacterium tuberculosis
LRARGRRYFRGHHD

SEQ ID NO: 69631 - protein, 14 aa, Mycobacterium tuberculosis
RARGRRYFRGHHDA

SEQ ID NO: 69632 - protein, 14 aa, Mycobacterium tuberculosis
ARGRRYFRGHHDAE

SEQ ID NO: 69633 - protein, 14 aa, Mycobacterium tuberculosis
RGRRYFRGHHDAEF

SEQ ID NO: 69634 - protein, 14 aa, Mycobacterium tuberculosis
GRRYFRGHHDAEFF

SEQ ID NO: 69635 - protein, 14 aa, Mycobacterium tuberculosis
RRYFRGHHDAEFFF

SEQ ID NO: 69636 - protein, 14 aa, Mycobacterium tuberculosis
RYFRGHHDAEFFFV

SEQ ID NO: 69637 - protein, 14 aa, Mycobacterium tuberculosis
YFRGHHDAEFFFVA

SEQ ID NO: 69638 - protein, 14 aa, Mycobacterium tuberculosis
FRGHHDAEFFFVAN

SEQ ID NO: 69639 - protein, 14 aa, Mycobacterium tuberculosis
RGHHDAEFFFVANA

SEQ ID NO: 69640 - protein, 14 aa, Mycobacterium tuberculosis
GHHDAEFFFVANAH

SEQ ID NO: 69641 - protein, 14 aa, Mycobacterium tuberculosis
HHDAEFFFVANAHL

SEQ ID NO: 69642 - protein, 14 aa, Mycobacterium tuberculosis
HDAEFFFVANAHLL

SEQ ID NO: 69643 - protein, 14 aa, Mycobacterium tuberculosis
DAEFFFVANAHLLH

SEQ ID NO: 69644 - protein, 14 aa, Mycobacterium tuberculosis
AEFFFVANAHLLHV

SEQ ID NO: 69645 - protein, 14 aa, Mycobacterium tuberculosis
EFFFVANAHLLHVH

SEQ ID NO: 69646 - protein, 14 aa, Mycobacterium tuberculosis
FFFVANAHLLHVHL

SEQ ID NO: 69647 - protein, 14 aa, Mycobacterium tuberculosis
FFVANAHLLHVHLE

SEQ ID NO: 69648 - protein, 14 aa, Mycobacterium tuberculosis
FVANAHLLHVHLEI

SEQ ID NO: 69649 - protein, 14 aa, Mycobacterium tuberculosis
VANAHLLHVHLEIS

SEQ ID NO: 69650 - protein, 14 aa, Mycobacterium tuberculosis
ANAHLLHVHLEISP

SEQ ID NO: 69651 - protein, 14 aa, Mycobacterium tuberculosis
NAHLLHVHLEISPA

SEQ ID NO: 69652 - protein, 14 aa, Mycobacterium tuberculosis
AHLLHVHLEISPAY

SEQ ID NO: 69653 - protein, 14 aa, Mycobacterium tuberculosis
HLLHVHLEISPAYR

SEQ ID NO: 69654 - protein, 14 aa, Mycobacterium tuberculosis
LLHVHLEISPAYRD

SEQ ID NO: 69655 - protein, 14 aa, Mycobacterium tuberculosis
LHVHLEISPAYRDV

SEQ ID NO: 69656 - protein, 14 aa, Mycobacterium tuberculosis
HVHLEISPAYRDVF

SEQ ID NO: 69657 - protein, 14 aa, Mycobacterium tuberculosis
VHLEISPAYRDVFT

SEQ ID NO: 69658 - protein, 14 aa, Mycobacterium tuberculosis
HLEISPAYRDVFTI

SEQ ID NO: 69659 - protein, 14 aa, Mycobacterium tuberculosis
LEISPAYRDVFTIR

SEQ ID NO: 69660 - protein, 14 aa, Mycobacterium tuberculosis
EISPAYRDVFTIRV

SEQ ID NO: 69661 - protein, 14 aa, Mycobacterium tuberculosis
ISPAYRDVFTIRVS

SEQ ID NO: 69662 - protein, 14 aa, Mycobacterium tuberculosis
SPAYRDVFTIRVSP

SEQ ID NO: 69663 - protein, 14 aa, Mycobacterium tuberculosis
PAYRDVFTIRVSPA

SEQ ID NO: 69664 - protein, 14 aa, Mycobacterium tuberculosis
AYRDVFTIRVSPAY

SEQ ID NO: 69665 - protein, 14 aa, Mycobacterium tuberculosis
YRDVFTIRVSPAYF

SEQ ID NO: 69666 - protein, 14 aa, Mycobacterium tuberculosis
RDVFTIRVSPAYFF

SEQ ID NO: 69667 - protein, 14 aa, Mycobacterium tuberculosis
DVFTIRVSPAYFFP

SEQ ID NO: 69668 - protein, 14 aa, Mycobacterium tuberculosis
VFTIRVSPAYFFPA

SEQ ID NO: 69669 - protein, 14 aa, Mycobacterium tuberculosis
FTIRVSPAYFFPAT

SEQ ID NO: 69670 - protein, 14 aa, Mycobacterium tuberculosis
TIRVSPAYFFPATD

SEQ ID NO: 69671 - protein, 14 aa, Mycobacterium tuberculosis
IRVSPAYFFPATDH

SEQ ID NO: 69672 - protein, 14 aa, Mycobacterium tuberculosis
RVSPAYFFPATDHT

SEQ ID NO: 69673 - protein, 14 aa, Mycobacterium tuberculosis
VSPAYFFPATDHTR

SEQ ID NO: 69674 - protein, 14 aa, Mycobacterium tuberculosis
SPAYFFPATDHTRL

SEQ ID NO: 69675 - protein, 14 aa, Mycobacterium tuberculosis
PAYFFPATDHTRLA

SEQ ID NO: 69676 - protein, 14 aa, Mycobacterium tuberculosis
AYFFPATDHTRLAE

SEQ ID NO: 69677 - protein, 14 aa, Mycobacterium tuberculosis
YFFPATDHTRLAEI

SEQ ID NO: 69678 - protein, 14 aa, Mycobacterium tuberculosis
FFPATDHTRLAEIV

SEQ ID NO: 69679 - protein, 14 aa, Mycobacterium tuberculosis
FPATDHTRLAEIVN

SEQ ID NO: 69680 - protein, 14 aa, Mycobacterium tuberculosis
PATDHTRLAEIVNA

SEQ ID NO: 69681 - protein, 14 aa, Mycobacterium tuberculosis
ATDHTRLAEIVNAW

SEQ ID NO: 69682 - protein, 14 aa, Mycobacterium tuberculosis
TDHTRLAEIVNAWN

SEQ ID NO: 69683 - protein, 14 aa, Mycobacterium tuberculosis
DHTRLAEIVNAWNL

SEQ ID NO: 69684 - protein, 14 aa, Mycobacterium tuberculosis
HTRLAEIVNAWNLQ

SEQ ID NO: 69685 - protein, 14 aa, Mycobacterium tuberculosis
TRLAEIVNAWNLQN

SEQ ID NO: 69686 - protein, 14 aa, Mycobacterium tuberculosis
RLAEIVNAWNLQNH

SEQ ID NO: 69687 - protein, 14 aa, Mycobacterium tuberculosis
LAEIVNAWNLQNHE

SEQ ID NO: 69688 - protein, 14 aa, Mycobacterium tuberculosis
AEIVNAWNLQNHEV

SEQ ID NO: 69689 - protein, 14 aa, Mycobacterium tuberculosis
EIVNAWNLQNHEVT

SEQ ID NO: 69690 - protein, 14 aa, Mycobacterium tuberculosis
IVNAWNLQNHEVTA

SEQ ID NO: 69691 - protein, 14 aa, Mycobacterium tuberculosis
VNAWNLQNHEVTAI

SEQ ID NO: 69692 - protein, 14 aa, Mycobacterium tuberculosis
NAWNLQNHEVTAIV

SEQ ID NO: 69693 - protein, 14 aa, Mycobacterium tuberculosis
AWNLQNHEVTAIVH

SEQ ID NO: 69694 - protein, 14 aa, Mycobacterium tuberculosis
WNLQNHEVTAIVHG

SEQ ID NO: 69695 - protein, 14 aa, Mycobacterium tuberculosis
NLQNHEVTAIVHGS

SEQ ID NO: 69696 - protein, 14 aa, Mycobacterium tuberculosis
LQNHEVTAIVHGSS

SEQ ID NO: 69697 - protein, 14 aa, Mycobacterium tuberculosis
QNHEVTAIVHGSSD

SEQ ID NO: 69698 - protein, 14 aa, Mycobacterium tuberculosis
NHEVTAIVHGSSDP

SEQ ID NO: 69699 - protein, 14 aa, Mycobacterium tuberculosis
HEVTAIVHGSSDPH

SEQ ID NO: 69700 - protein, 14 aa, Mycobacterium tuberculosis
EVTAIVHGSSDPHR

SEQ ID NO: 69701 - protein, 14 aa, Mycobacterium tuberculosis
VTAIVHGSSDPHRI

SEQ ID NO: 69702 - protein, 14 aa, Mycobacterium tuberculosis
TAIVHGSSDPHRIG

SEQ ID NO: 69703 - protein, 14 aa, Mycobacterium tuberculosis
AIVHGSSDPHRIGV

SEQ ID NO: 69704 - protein, 14 aa, Mycobacterium tuberculosis
IVHGSSDPHRIGVA

SEQ ID NO: 69705 - protein, 14 aa, Mycobacterium tuberculosis
VHGSSDPHRIGVAA

SEQ ID NO: 69706 - protein, 14 aa, Mycobacterium tuberculosis
HGSSDPHRIGVAAE

SEQ ID NO: 69707 - protein, 14 aa, Mycobacterium tuberculosis
GSSDPHRIGVAAER

SEQ ID NO: 69708 - protein, 14 aa, Mycobacterium tuberculosis
SSDPHRIGVAAERS

SEQ ID NO: 69709 - protein, 14 aa, Mycobacterium tuberculosis
SDPHRIGVAAERSL

SEQ ID NO: 69710 - protein, 14 aa, Mycobacterium tuberculosis
DPHRIGVAAERSLI

SEQ ID NO: 69711 - protein, 14 aa, Mycobacterium tuberculosis
PHRIGVAAERSLIR

SEQ ID NO: 69712 - protein, 14 aa, Mycobacterium tuberculosis
HRIGVAAERSLIRD

SEQ ID NO: 69713 - protein, 14 aa, Mycobacterium tuberculosis
RIGVAAERSLIRDR

SEQ ID NO: 69714 - protein, 14 aa, Mycobacterium tuberculosis
IGVAAERSLIRDRI

SEQ ID NO: 69715 - protein, 14 aa, Mycobacterium tuberculosis
GVAAERSLIRDRIR

SEQ ID NO: 69716 - protein, 14 aa, Mycobacterium tuberculosis
VAAERSLIRDRIRF

SEQ ID NO: 69717 - protein, 14 aa, Mycobacterium tuberculosis
AAERSLIRDRIRFD

SEQ ID NO: 69718 - protein, 14 aa, Mycobacterium tuberculosis
AERSLIRDRIRFDD

SEQ ID NO: 69719 - protein, 14 aa, Mycobacterium tuberculosis
ERSLIRDRIRFDDF

SEQ ID NO: 69720 - protein, 14 aa, Mycobacterium tuberculosis
RSLIRDRIRFDDFA

SEQ ID NO: 69721 - protein, 14 aa, Mycobacterium tuberculosis
SLIRDRIRFDDFAT

SEQ ID NO: 69722 - protein, 14 aa, Mycobacterium tuberculosis
LIRDRIRFDDFATF

SEQ ID NO: 69723 - protein, 14 aa, Mycobacterium tuberculosis
IRDRIRFDDFATFV

SEQ ID NO: 69724 - protein, 14 aa, Mycobacterium tuberculosis
RDRIRFDDFATFVD

SEQ ID NO: 69725 - protein, 14 aa, Mycobacterium tuberculosis
DRIRFDDFATFVDN

SEQ ID NO: 69726 - protein, 14 aa, Mycobacterium tuberculosis
RIRFDDFATFVDNA

SEQ ID NO: 69727 - protein, 14 aa, Mycobacterium tuberculosis
IRFDDFATFVDNAV

SEQ ID NO: 69728 - protein, 14 aa, Mycobacterium tuberculosis
RFDDFATFVDNAVS

SEQ ID NO: 69729 - protein, 14 aa, Mycobacterium tuberculosis
FDDFATFVDNAVSA

SEQ ID NO: 69730 - protein, 14 aa, Mycobacterium tuberculosis
DDFATFVDNAVSAA

SEQ ID NO: 69731 - protein, 14 aa, Mycobacterium tuberculosis
DFATFVDNAVSAAT

SEQ ID NO: 69732 - protein, 14 aa, Mycobacterium tuberculosis
FATFVDNAVSAATE

SEQ ID NO: 69733 - protein, 14 aa, Mycobacterium tuberculosis
ATFVDNAVSAATEL

SEQ ID NO: 69734 - protein, 14 aa, Mycobacterium tuberculosis
TFVDNAVSAATELF

SEQ ID NO: 69735 - protein, 14 aa, Mycobacterium tuberculosis
FVDNAVSAATELFG

SEQ ID NO: 69736 - protein, 14 aa, Mycobacterium tuberculosis
VDNAVSAATELFGQ

SEQ ID NO: 69737 - protein, 14 aa, Mycobacterium tuberculosis
DNAVSAATELFGQL

SEQ ID NO: 69738 - protein, 14 aa, Mycobacterium tuberculosis
NAVSAATELFGQLT

SEQ ID NO: 69739 - protein, 14 aa, Mycobacterium tuberculosis
AVSAATELFGQLTA

SEQ ID NO: 69740 - protein, 14 aa, Mycobacterium tuberculosis
VSAATELFGQLTAA

SEQ ID NO: 69741 - protein, 14 aa, Mycobacterium tuberculosis
SAATELFGQLTAAG

SEQ ID NO: 69742 - protein, 14 aa, Mycobacterium tuberculosis
AATELFGQLTAAGL

SEQ ID NO: 69743 - protein, 14 aa, Mycobacterium tuberculosis
ATELFGQLTAAGLP

SEQ ID NO: 69744 - protein, 14 aa, Mycobacterium tuberculosis
TELFGQLTAAGLPP

SEQ ID NO: 69745 - protein, 14 aa, Mycobacterium tuberculosis
ELFGQLTAAGLPPT

SEQ ID NO: 69746 - protein, 14 aa, Mycobacterium tuberculosis
LFGQLTAAGLPPTA

SEQ ID NO: 69747 - protein, 14 aa, Mycobacterium tuberculosis
FGQLTAAGLPPTAT

SEQ ID NO: 69748 - protein, 14 aa, Mycobacterium tuberculosis
GQLTAAGLPPTATP

SEQ ID NO: 69749 - protein, 14 aa, Mycobacterium tuberculosis
QLTAAGLPPTATPP

SEQ ID NO: 69750 - protein, 14 aa, Mycobacterium tuberculosis
LTAAGLPPTATPPL

SEQ ID NO: 69751 - protein, 14 aa, Mycobacterium tuberculosis
TAAGLPPTATPPLL

SEQ ID NO: 69752 - protein, 14 aa, Mycobacterium tuberculosis
AAGLPPTATPPLLR

SEQ ID NO: 69753 - protein, 14 aa, Mycobacterium tuberculosis
AGLPPTATPPLLRD

SEQ ID NO: 69754 - protein, 14 aa, Mycobacterium tuberculosis
GLPPTATPPLLRDA

SEQ ID NO: 69755 - protein, 14 aa, Mycobacterium tuberculosis
LPPTATPPLLRDAG

SEQ ID NO: 69756 - protein, 15 aa, Mycobacterium tuberculosis
MSRRAIHSGRAAPRR

SEQ ID NO: 69757 - protein, 15 aa, Mycobacterium tuberculosis
SRRAIHSGRAAPRRS

SEQ ID NO: 69758 - protein, 15 aa, Mycobacterium tuberculosis
RRAIHSGRAAPRRSG

SEQ ID NO: 69759 - protein, 15 aa, Mycobacterium tuberculosis
RAIHSGRAAPRRSGN

SEQ ID NO: 69760 - protein, 15 aa, Mycobacterium tuberculosis
AIHSGRAAPRRSGNS

SEQ ID NO: 69761 - protein, 15 aa, Mycobacterium tuberculosis
IHSGRAAPRRSGNSH

SEQ ID NO: 69762 - protein, 15 aa, Mycobacterium tuberculosis
HSGRAAPRRSGNSHL

SEQ ID NO: 69763 - protein, 15 aa, Mycobacterium tuberculosis
SGRAAPRRSGNSHLV

SEQ ID NO: 69764 - protein, 15 aa, Mycobacterium tuberculosis
GRAAPRRSGNSHLVL

SEQ ID NO: 69765 - protein, 15 aa, Mycobacterium tuberculosis
RAAPRRSGNSHLVLR

SEQ ID NO: 69766 - protein, 15 aa, Mycobacterium tuberculosis
AAPRRSGNSHLVLRN

SEQ ID NO: 69767 - protein, 15 aa, Mycobacterium tuberculosis
APRRSGNSHLVLRNR

SEQ ID NO: 69768 - protein, 15 aa, Mycobacterium tuberculosis
PRRSGNSHLVLRNRV

SEQ ID NO: 69769 - protein, 15 aa, Mycobacterium tuberculosis
RRSGNSHLVLRNRVP

SEQ ID NO: 69770 - protein, 15 aa, Mycobacterium tuberculosis
RSGNSHLVLRNRVPS

SEQ ID NO: 69771 - protein, 15 aa, Mycobacterium tuberculosis
SGNSHLVLRNRVPSS

SEQ ID NO: 69772 - protein, 15 aa, Mycobacterium tuberculosis
GNSHLVLRNRVPSSK

SEQ ID NO: 69773 - protein, 15 aa, Mycobacterium tuberculosis
NSHLVLRNRVPSSKD

SEQ ID NO: 69774 - protein, 15 aa, Mycobacterium tuberculosis
SHLVLRNRVPSSKDS

SEQ ID NO: 69775 - protein, 15 aa, Mycobacterium tuberculosis
HLVLRNRVPSSKDSP

SEQ ID NO: 69776 - protein, 15 aa, Mycobacterium tuberculosis
LVLRNRVPSSKDSPR

SEQ ID NO: 69777 - protein, 15 aa, Mycobacterium tuberculosis
VLRNRVPSSKDSPRR

SEQ ID NO: 69778 - protein, 15 aa, Mycobacterium tuberculosis
LRNRVPSSKDSPRRR

SEQ ID NO: 69779 - protein, 15 aa, Mycobacterium tuberculosis
RNRVPSSKDSPRRRP

SEQ ID NO: 69780 - protein, 15 aa, Mycobacterium tuberculosis
NRVPSSKDSPRRRPH

SEQ ID NO: 69781 - protein, 15 aa, Mycobacterium tuberculosis
RVPSSKDSPRRRPHH

SEQ ID NO: 69782 - protein, 15 aa, Mycobacterium tuberculosis
VPSSKDSPRRRPHHE

SEQ ID NO: 69783 - protein, 15 aa, Mycobacterium tuberculosis
PSSKDSPRRRPHHEF

SEQ ID NO: 69784 - protein, 15 aa, Mycobacterium tuberculosis
SSKDSPRRRPHHEFM

SEQ ID NO: 69785 - protein, 15 aa, Mycobacterium tuberculosis
SKDSPRRRPHHEFMT

SEQ ID NO: 69786 - protein, 15 aa, Mycobacterium tuberculosis
KDSPRRRPHHEFMTE

SEQ ID NO: 69787 - protein, 15 aa, Mycobacterium tuberculosis
DSPRRRPHHEFMTES

SEQ ID NO: 69788 - protein, 15 aa, Mycobacterium tuberculosis
SPRRRPHHEFMTESI

SEQ ID NO: 69789 - protein, 15 aa, Mycobacterium tuberculosis
PRRRPHHEFMTESIG

SEQ ID NO: 69790 - protein, 15 aa, Mycobacterium tuberculosis
RRRPHHEFMTESIGE

SEQ ID NO: 69791 - protein, 15 aa, Mycobacterium tuberculosis
RRPHHEFMTESIGEP

SEQ ID NO: 69792 - protein, 15 aa, Mycobacterium tuberculosis
RPHHEFMTESIGEPL

SEQ ID NO: 69793 - protein, 15 aa, Mycobacterium tuberculosis
PHHEFMTESIGEPLS

SEQ ID NO: 69794 - protein, 15 aa, Mycobacterium tuberculosis
HHEFMTESIGEPLST

SEQ ID NO: 69795 - protein, 15 aa, Mycobacterium tuberculosis
HEFMTESIGEPLSTN

SEQ ID NO: 69796 - protein, 15 aa, Mycobacterium tuberculosis
EFMTESIGEPLSTNL

SEQ ID NO: 69797 - protein, 15 aa, Mycobacterium tuberculosis
FMTESIGEPLSTNLI

SEQ ID NO: 69798 - protein, 15 aa, Mycobacterium tuberculosis
MTESIGEPLSTNLIE

SEQ ID NO: 69799 - protein, 15 aa, Mycobacterium tuberculosis
TESIGEPLSTNLIER

SEQ ID NO: 69800 - protein, 15 aa, Mycobacterium tuberculosis
ESIGEPLSTNLIERY

SEQ ID NO: 69801 - protein, 15 aa, Mycobacterium tuberculosis
SIGEPLSTNLIERYL

SEQ ID NO: 69802 - protein, 15 aa, Mycobacterium tuberculosis
IGEPLSTNLIERYLR

SEQ ID NO: 69803 - protein, 15 aa, Mycobacterium tuberculosis
GEPLSTNLIERYLRA

SEQ ID NO: 69804 - protein, 15 aa, Mycobacterium tuberculosis
EPLSTNLIERYLRAR

SEQ ID NO: 69805 - protein, 15 aa, Mycobacterium tuberculosis
PLSTNLIERYLRARG

SEQ ID NO: 69806 - protein, 15 aa, Mycobacterium tuberculosis
LSTNLIERYLRARGR

SEQ ID NO: 69807 - protein, 15 aa, Mycobacterium tuberculosis
STNLIERYLRARGRR

SEQ ID NO: 69808 - protein, 15 aa, Mycobacterium tuberculosis
TNLIERYLRARGRRY

SEQ ID NO: 69809 - protein, 15 aa, Mycobacterium tuberculosis
NLIERYLRARGRRYF

SEQ ID NO: 69810 - protein, 15 aa, Mycobacterium tuberculosis
LIERYLRARGRRYFR

SEQ ID NO: 69811 - protein, 15 aa, Mycobacterium tuberculosis
IERYLRARGRRYFRG

SEQ ID NO: 69812 - protein, 15 aa, Mycobacterium tuberculosis
ERYLRARGRRYFRGH

SEQ ID NO: 69813 - protein, 15 aa, Mycobacterium tuberculosis
RYLRARGRRYFRGHH

SEQ ID NO: 69814 - protein, 15 aa, Mycobacterium tuberculosis
YLRARGRRYFRGHHD

SEQ ID NO: 69815 - protein, 15 aa, Mycobacterium tuberculosis
LRARGRRYFRGHHDA

SEQ ID NO: 69816 - protein, 15 aa, Mycobacterium tuberculosis
RARGRRYFRGHHDAE

SEQ ID NO: 69817 - protein, 15 aa, Mycobacterium tuberculosis
ARGRRYFRGHHDAEF

SEQ ID NO: 69818 - protein, 15 aa, Mycobacterium tuberculosis
RGRRYFRGHHDAEFF

SEQ ID NO: 69819 - protein, 15 aa, Mycobacterium tuberculosis
GRRYFRGHHDAEFFF

SEQ ID NO: 69820 - protein, 15 aa, Mycobacterium tuberculosis
RRYFRGHHDAEFFFV

SEQ ID NO: 69821 - protein, 15 aa, Mycobacterium tuberculosis
RYFRGHHDAEFFFVA

SEQ ID NO: 69822 - protein, 15 aa, Mycobacterium tuberculosis
YFRGHHDAEFFFVAN

SEQ ID NO: 69823 - protein, 15 aa, Mycobacterium tuberculosis
FRGHHDAEFFFVANA

SEQ ID NO: 69824 - protein, 15 aa, Mycobacterium tuberculosis
RGHHDAEFFFVANAH

SEQ ID NO: 69825 - protein, 15 aa, Mycobacterium tuberculosis
GHHDAEFFFVANAHL

SEQ ID NO: 69826 - protein, 15 aa, Mycobacterium tuberculosis
HHDAEFFFVANAHLL

SEQ ID NO: 69827 - protein, 15 aa, Mycobacterium tuberculosis
HDAEFFFVANAHLLH

SEQ ID NO: 69828 - protein, 15 aa, Mycobacterium tuberculosis
DAEFFFVANAHLLHV

SEQ ID NO: 69829 - protein, 15 aa, Mycobacterium tuberculosis
AEFFFVANAHLLHVH

SEQ ID NO: 69830 - protein, 15 aa, Mycobacterium tuberculosis
EFFFVANAHLLHVHL

SEQ ID NO: 69831 - protein, 15 aa, Mycobacterium tuberculosis
FFFVANAHLLHVHLE

SEQ ID NO: 69832 - protein, 15 aa, Mycobacterium tuberculosis
FFVANAHLLHVHLEI

SEQ ID NO: 69833 - protein, 15 aa, Mycobacterium tuberculosis
FVANAHLLHVHLEIS

SEQ ID NO: 69834 - protein, 15 aa, Mycobacterium tuberculosis
VANAHLLHVHLEISP

SEQ ID NO: 69835 - protein, 15 aa, Mycobacterium tuberculosis
ANAHLLHVHLEISPA

SEQ ID NO: 69836 - protein, 15 aa, Mycobacterium tuberculosis
NAHLLHVHLEISPAY

SEQ ID NO: 69837 - protein, 15 aa, Mycobacterium tuberculosis
AHLLHVHLEISPAYR

SEQ ID NO: 69838 - protein, 15 aa, Mycobacterium tuberculosis
HLLHVHLEISPAYRD

SEQ ID NO: 69839 - protein, 15 aa, Mycobacterium tuberculosis
LLHVHLEISPAYRDV

SEQ ID NO: 69840 - protein, 15 aa, Mycobacterium tuberculosis
LHVHLEISPAYRDVF

SEQ ID NO: 69841 - protein, 15 aa, Mycobacterium tuberculosis
HVHLEISPAYRDVFT

SEQ ID NO: 69842 - protein, 15 aa, Mycobacterium tuberculosis
VHLEISPAYRDVFTI

SEQ ID NO: 69843 - protein, 15 aa, Mycobacterium tuberculosis
HLEISPAYRDVFTIR

SEQ ID NO: 69844 - protein, 15 aa, Mycobacterium tuberculosis
LEISPAYRDVFTIRV

SEQ ID NO: 69845 - protein, 15 aa, Mycobacterium tuberculosis
EISPAYRDVFTIRVS

SEQ ID NO: 69846 - protein, 15 aa, Mycobacterium tuberculosis
ISPAYRDVFTIRVSP

SEQ ID NO: 69847 - protein, 15 aa, Mycobacterium tuberculosis
SPAYRDVFTIRVSPA

SEQ ID NO: 69848 - protein, 15 aa, Mycobacterium tuberculosis
PAYRDVFTIRVSPAY

SEQ ID NO: 69849 - protein, 15 aa, Mycobacterium tuberculosis
AYRDVFTIRVSPAYF

SEQ ID NO: 69850 - protein, 15 aa, Mycobacterium tuberculosis
YRDVFTIRVSPAYFF

SEQ ID NO: 69851 - protein, 15 aa, Mycobacterium tuberculosis
RDVFTIRVSPAYFFP

SEQ ID NO: 69852 - protein, 15 aa, Mycobacterium tuberculosis
DVFTIRVSPAYFFPA

SEQ ID NO: 69853 - protein, 15 aa, Mycobacterium tuberculosis
VFTIRVSPAYFFPAT

SEQ ID NO: 69854 - protein, 15 aa, Mycobacterium tuberculosis
FTIRVSPAYFFPATD

SEQ ID NO: 69855 - protein, 15 aa, Mycobacterium tuberculosis
TIRVSPAYFFPATDH

SEQ ID NO: 69856 - protein, 15 aa, Mycobacterium tuberculosis
IRVSPAYFFPATDHT

SEQ ID NO: 69857 - protein, 15 aa, Mycobacterium tuberculosis
RVSPAYFFPATDHTR

SEQ ID NO: 69858 - protein, 15 aa, Mycobacterium tuberculosis
VSPAYFFPATDHTRL

SEQ ID NO: 69859 - protein, 15 aa, Mycobacterium tuberculosis
SPAYFFPATDHTRLA

SEQ ID NO: 69860 - protein, 15 aa, Mycobacterium tuberculosis
PAYFFPATDHTRLAE

SEQ ID NO: 69861 - protein, 15 aa, Mycobacterium tuberculosis
AYFFPATDHTRLAEI

SEQ ID NO: 69862 - protein, 15 aa, Mycobacterium tuberculosis
YFFPATDHTRLAEIV

SEQ ID NO: 69863 - protein, 15 aa, Mycobacterium tuberculosis
FFPATDHTRLAEIVN

SEQ ID NO: 69864 - protein, 15 aa, Mycobacterium tuberculosis
FPATDHTRLAEIVNA

SEQ ID NO: 69865 - protein, 15 aa, Mycobacterium tuberculosis
PATDHTRLAEIVNAW

SEQ ID NO: 69866 - protein, 15 aa, Mycobacterium tuberculosis
ATDHTRLAEIVNAWN

SEQ ID NO: 69867 - protein, 15 aa, Mycobacterium tuberculosis
TDHTRLAEIVNAWNL

SEQ ID NO: 69868 - protein, 15 aa, Mycobacterium tuberculosis
DHTRLAEIVNAWNLQ

SEQ ID NO: 69869 - protein, 15 aa, Mycobacterium tuberculosis
HTRLAEIVNAWNLQN

SEQ ID NO: 69870 - protein, 15 aa, Mycobacterium tuberculosis
TRLAEIVNAWNLQNH

SEQ ID NO: 69871 - protein, 15 aa, Mycobacterium tuberculosis
RLAEIVNAWNLQNHE

SEQ ID NO: 69872 - protein, 15 aa, Mycobacterium tuberculosis
LAEIVNAWNLQNHEV

SEQ ID NO: 69873 - protein, 15 aa, Mycobacterium tuberculosis
AEIVNAWNLQNHEVT

SEQ ID NO: 69874 - protein, 15 aa, Mycobacterium tuberculosis
EIVNAWNLQNHEVTA

SEQ ID NO: 69875 - protein, 15 aa, Mycobacterium tuberculosis
IVNAWNLQNHEVTAI

SEQ ID NO: 69876 - protein, 15 aa, Mycobacterium tuberculosis
VNAWNLQNHEVTAIV

SEQ ID NO: 69877 - protein, 15 aa, Mycobacterium tuberculosis
NAWNLQNHEVTAIVH

SEQ ID NO: 69878 - protein, 15 aa, Mycobacterium tuberculosis
AWNLQNHEVTAIVHG

SEQ ID NO: 69879 - protein, 15 aa, Mycobacterium tuberculosis
WNLQNHEVTAIVHGS

SEQ ID NO: 69880 - protein, 15 aa, Mycobacterium tuberculosis
NLQNHEVTAIVHGSS

SEQ ID NO: 69881 - protein, 15 aa, Mycobacterium tuberculosis
LQNHEVTAIVHGSSD

SEQ ID NO: 69882 - protein, 15 aa, Mycobacterium tuberculosis
QNHEVTAIVHGSSDP

SEQ ID NO: 69883 - protein, 15 aa, Mycobacterium tuberculosis
NHEVTAIVHGSSDPH

SEQ ID NO: 69884 - protein, 15 aa, Mycobacterium tuberculosis
HEVTAIVHGSSDPHR

SEQ ID NO: 69885 - protein, 15 aa, Mycobacterium tuberculosis
EVTAIVHGSSDPHRI

SEQ ID NO: 69886 - protein, 15 aa, Mycobacterium tuberculosis
VTAIVHGSSDPHRIG

SEQ ID NO: 69887 - protein, 15 aa, Mycobacterium tuberculosis
TAIVHGSSDPHRIGV

SEQ ID NO: 69888 - protein, 15 aa, Mycobacterium tuberculosis
AIVHGSSDPHRIGVA

SEQ ID NO: 69889 - protein, 15 aa, Mycobacterium tuberculosis
IVHGSSDPHRIGVAA

SEQ ID NO: 69890 - protein, 15 aa, Mycobacterium tuberculosis
VHGSSDPHRIGVAAE

SEQ ID NO: 69891 - protein, 15 aa, Mycobacterium tuberculosis
HGSSDPHRIGVAAER

SEQ ID NO: 69892 - protein, 15 aa, Mycobacterium tuberculosis
GSSDPHRIGVAAERS

SEQ ID NO: 69893 - protein, 15 aa, Mycobacterium tuberculosis
SSDPHRIGVAAERSL

SEQ ID NO: 69894 - protein, 15 aa, Mycobacterium tuberculosis
SDPHRIGVAAERSLI

SEQ ID NO: 69895 - protein, 15 aa, Mycobacterium tuberculosis
DPHRIGVAAERSLIR

SEQ ID NO: 69896 - protein, 15 aa, Mycobacterium tuberculosis
PHRIGVAAERSLIRD

SEQ ID NO: 69897 - protein, 15 aa, Mycobacterium tuberculosis
HRIGVAAERSLIRDR

SEQ ID NO: 69898 - protein, 15 aa, Mycobacterium tuberculosis
RIGVAAERSLIRDRI

SEQ ID NO: 69899 - protein, 15 aa, Mycobacterium tuberculosis
IGVAAERSLIRDRIR

SEQ ID NO: 69900 - protein, 15 aa, Mycobacterium tuberculosis
GVAAERSLIRDRIRF

SEQ ID NO: 69901 - protein, 15 aa, Mycobacterium tuberculosis
VAAERSLIRDRIRFD

SEQ ID NO: 69902 - protein, 15 aa, Mycobacterium tuberculosis
AAERSLIRDRIRFDD

SEQ ID NO: 69903 - protein, 15 aa, Mycobacterium tuberculosis
AERSLIRDRIRFDDF

SEQ ID NO: 69904 - protein, 15 aa, Mycobacterium tuberculosis
ERSLIRDRIRFDDFA

SEQ ID NO: 69905 - protein, 15 aa, Mycobacterium tuberculosis
RSLIRDRIRFDDFAT

SEQ ID NO: 69906 - protein, 15 aa, Mycobacterium tuberculosis
SLIRDRIRFDDFATF

SEQ ID NO: 69907 - protein, 15 aa, Mycobacterium tuberculosis
LIRDRIRFDDFATFV

SEQ ID NO: 69908 - protein, 15 aa, Mycobacterium tuberculosis
IRDRIRFDDFATFVD

SEQ ID NO: 69909 - protein, 15 aa, Mycobacterium tuberculosis
RDRIRFDDFATFVDN

SEQ ID NO: 69910 - protein, 15 aa, Mycobacterium tuberculosis
DRIRFDDFATFVDNA

SEQ ID NO: 69911 - protein, 15 aa, Mycobacterium tuberculosis
RIRFDDFATFVDNAV

SEQ ID NO: 69912 - protein, 15 aa, Mycobacterium tuberculosis
IRFDDFATFVDNAVS

SEQ ID NO: 69913 - protein, 15 aa, Mycobacterium tuberculosis
RFDDFATFVDNAVSA

SEQ ID NO: 69914 - protein, 15 aa, Mycobacterium tuberculosis
FDDFATFVDNAVSAA

SEQ ID NO: 69915 - protein, 15 aa, Mycobacterium tuberculosis
DDFATFVDNAVSAAT

SEQ ID NO: 69916 - protein, 15 aa, Mycobacterium tuberculosis
DFATFVDNAVSAATE

SEQ ID NO: 69917 - protein, 15 aa, Mycobacterium tuberculosis
FATFVDNAVSAATEL

SEQ ID NO: 69918 - protein, 15 aa, Mycobacterium tuberculosis
ATFVDNAVSAATELF

SEQ ID NO: 69919 - protein, 15 aa, Mycobacterium tuberculosis
TFVDNAVSAATELFG

SEQ ID NO: 69920 - protein, 15 aa, Mycobacterium tuberculosis
FVDNAVSAATELFGQ

SEQ ID NO: 69921 - protein, 15 aa, Mycobacterium tuberculosis
VDNAVSAATELFGQL

SEQ ID NO: 69922 - protein, 15 aa, Mycobacterium tuberculosis
DNAVSAATELFGQLT

SEQ ID NO: 69923 - protein, 15 aa, Mycobacterium tuberculosis
NAVSAATELFGQLTA

SEQ ID NO: 69924 - protein, 15 aa, Mycobacterium tuberculosis
AVSAATELFGQLTAA

SEQ ID NO: 69925 - protein, 15 aa, Mycobacterium tuberculosis
VSAATELFGQLTAAG

SEQ ID NO: 69926 - protein, 15 aa, Mycobacterium tuberculosis
SAATELFGQLTAAGL

SEQ ID NO: 69927 - protein, 15 aa, Mycobacterium tuberculosis
AATELFGQLTAAGLP

SEQ ID NO: 69928 - protein, 15 aa, Mycobacterium tuberculosis
ATELFGQLTAAGLPP

SEQ ID NO: 69929 - protein, 15 aa, Mycobacterium tuberculosis
TELFGQLTAAGLPPT

SEQ ID NO: 69930 - protein, 15 aa, Mycobacterium tuberculosis
ELFGQLTAAGLPPTA

SEQ ID NO: 69931 - protein, 15 aa, Mycobacterium tuberculosis
LFGQLTAAGLPPTAT

SEQ ID NO: 69932 - protein, 15 aa, Mycobacterium tuberculosis
FGQLTAAGLPPTATP

SEQ ID NO: 69933 - protein, 15 aa, Mycobacterium tuberculosis
GQLTAAGLPPTATPP

SEQ ID NO: 69934 - protein, 15 aa, Mycobacterium tuberculosis
QLTAAGLPPTATPPL

SEQ ID NO: 69935 - protein, 15 aa, Mycobacterium tuberculosis
LTAAGLPPTATPPLL

SEQ ID NO: 69936 - protein, 15 aa, Mycobacterium tuberculosis
TAAGLPPTATPPLLR

SEQ ID NO: 69937 - protein, 15 aa, Mycobacterium tuberculosis
AAGLPPTATPPLLRD

SEQ ID NO: 69938 - protein, 15 aa, Mycobacterium tuberculosis
AGLPPTATPPLLRDA

SEQ ID NO: 69939 - protein, 15 aa, Mycobacterium tuberculosis
GLPPTATPPLLRDAG

SEQ ID NO: 69940 - protein, 16 aa, Mycobacterium tuberculosis
MSRRAIHSGRAAPRRS

SEQ ID NO: 69941 - protein, 16 aa, Mycobacterium tuberculosis
SRRAIHSGRAAPRRSG

SEQ ID NO: 69942 - protein, 16 aa, Mycobacterium tuberculosis
RRAIHSGRAAPRRSGN

SEQ ID NO: 69943 - protein, 16 aa, Mycobacterium tuberculosis
RAIHSGRAAPRRSGNS

SEQ ID NO: 69944 - protein, 16 aa, Mycobacterium tuberculosis
AIHSGRAAPRRSGNSH

SEQ ID NO: 69945 - protein, 16 aa, Mycobacterium tuberculosis
IHSGRAAPRRSGNSHL

SEQ ID NO: 69946 - protein, 16 aa, Mycobacterium tuberculosis
HSGRAAPRRSGNSHLV

SEQ ID NO: 69947 - protein, 16 aa, Mycobacterium tuberculosis
SGRAAPRRSGNSHLVL

SEQ ID NO: 69948 - protein, 16 aa, Mycobacterium tuberculosis
GRAAPRRSGNSHLVLR

SEQ ID NO: 69949 - protein, 16 aa, Mycobacterium tuberculosis
RAAPRRSGNSHLVLRN

SEQ ID NO: 69950 - protein, 16 aa, Mycobacterium tuberculosis
AAPRRSGNSHLVLRNR

SEQ ID NO: 69951 - protein, 16 aa, Mycobacterium tuberculosis
APRRSGNSHLVLRNRV

SEQ ID NO: 69952 - protein, 16 aa, Mycobacterium tuberculosis
PRRSGNSHLVLRNRVP

SEQ ID NO: 69953 - protein, 16 aa, Mycobacterium tuberculosis
RRSGNSHLVLRNRVPS

SEQ ID NO: 69954 - protein, 16 aa, Mycobacterium tuberculosis
RSGNSHLVLRNRVPSS

SEQ ID NO: 69955 - protein, 16 aa, Mycobacterium tuberculosis
SGNSHLVLRNRVPSSK

SEQ ID NO: 69956 - protein, 16 aa, Mycobacterium tuberculosis
GNSHLVLRNRVPSSKD

SEQ ID NO: 69957 - protein, 16 aa, Mycobacterium tuberculosis
NSHLVLRNRVPSSKDS

SEQ ID NO: 69958 - protein, 16 aa, Mycobacterium tuberculosis
SHLVLRNRVPSSKDSP

SEQ ID NO: 69959 - protein, 16 aa, Mycobacterium tuberculosis
HLVLRNRVPSSKDSPR

SEQ ID NO: 69960 - protein, 16 aa, Mycobacterium tuberculosis
LVLRNRVPSSKDSPRR

SEQ ID NO: 69961 - protein, 16 aa, Mycobacterium tuberculosis
VLRNRVPSSKDSPRRR

SEQ ID NO: 69962 - protein, 16 aa, Mycobacterium tuberculosis
LRNRVPSSKDSPRRRP

SEQ ID NO: 69963 - protein, 16 aa, Mycobacterium tuberculosis
RNRVPSSKDSPRRRPH

SEQ ID NO: 69964 - protein, 16 aa, Mycobacterium tuberculosis
NRVPSSKDSPRRRPHH

SEQ ID NO: 69965 - protein, 16 aa, Mycobacterium tuberculosis
RVPSSKDSPRRRPHHE

SEQ ID NO: 69966 - protein, 16 aa, Mycobacterium tuberculosis
VPSSKDSPRRRPHHEF

SEQ ID NO: 69967 - protein, 16 aa, Mycobacterium tuberculosis
PSSKDSPRRRPHHEFM

SEQ ID NO: 69968 - protein, 16 aa, Mycobacterium tuberculosis
SSKDSPRRRPHHEFMT

SEQ ID NO: 69969 - protein, 16 aa, Mycobacterium tuberculosis
SKDSPRRRPHHEFMTE

SEQ ID NO: 69970 - protein, 16 aa, Mycobacterium tuberculosis
KDSPRRRPHHEFMTES

SEQ ID NO: 69971 - protein, 16 aa, Mycobacterium tuberculosis
DSPRRRPHHEFMTESI

SEQ ID NO: 69972 - protein, 16 aa, Mycobacterium tuberculosis
SPRRRPHHEFMTESIG

SEQ ID NO: 69973 - protein, 16 aa, Mycobacterium tuberculosis
PRRRPHHEFMTESIGE

SEQ ID NO: 69974 - protein, 16 aa, Mycobacterium tuberculosis
RRRPHHEFMTESIGEP

SEQ ID NO: 69975 - protein, 16 aa, Mycobacterium tuberculosis
RRPHHEFMTESIGEPL

SEQ ID NO: 69976 - protein, 16 aa, Mycobacterium tuberculosis
RPHHEFMTESIGEPLS

SEQ ID NO: 69977 - protein, 16 aa, Mycobacterium tuberculosis
PHHEFMTESIGEPLST

SEQ ID NO: 69978 - protein, 16 aa, Mycobacterium tuberculosis
HHEFMTESIGEPLSTN

SEQ ID NO: 69979 - protein, 16 aa, Mycobacterium tuberculosis
HEFMTESIGEPLSTNL

SEQ ID NO: 69980 - protein, 16 aa, Mycobacterium tuberculosis
EFMTESIGEPLSTNLI

SEQ ID NO: 69981 - protein, 16 aa, Mycobacterium tuberculosis
FMTESIGEPLSTNLIE

SEQ ID NO: 69982 - protein, 16 aa, Mycobacterium tuberculosis
MTESIGEPLSTNLIER

SEQ ID NO: 69983 - protein, 16 aa, Mycobacterium tuberculosis
TESIGEPLSTNLIERY

SEQ ID NO: 69984 - protein, 16 aa, Mycobacterium tuberculosis
ESIGEPLSTNLIERYL

SEQ ID NO: 69985 - protein, 16 aa, Mycobacterium tuberculosis
SIGEPLSTNLIERYLR

SEQ ID NO: 69986 - protein, 16 aa, Mycobacterium tuberculosis
IGEPLSTNLIERYLRA

SEQ ID NO: 69987 - protein, 16 aa, Mycobacterium tuberculosis
GEPLSTNLIERYLRAR

SEQ ID NO: 69988 - protein, 16 aa, Mycobacterium tuberculosis
EPLSTNLIERYLRARG

SEQ ID NO: 69989 - protein, 16 aa, Mycobacterium tuberculosis
PLSTNLIERYLRARGR

SEQ ID NO: 69990 - protein, 16 aa, Mycobacterium tuberculosis
LSTNLIERYLRARGRR

SEQ ID NO: 69991 - protein, 16 aa, Mycobacterium tuberculosis
STNLIERYLRARGRRY

SEQ ID NO: 69992 - protein, 16 aa, Mycobacterium tuberculosis
TNLIERYLRARGRRYF

SEQ ID NO: 69993 - protein, 16 aa, Mycobacterium tuberculosis
NLIERYLRARGRRYFR

SEQ ID NO: 69994 - protein, 16 aa, Mycobacterium tuberculosis
LIERYLRARGRRYFRG

SEQ ID NO: 69995 - protein, 16 aa, Mycobacterium tuberculosis
IERYLRARGRRYFRGH

SEQ ID NO: 69996 - protein, 16 aa, Mycobacterium tuberculosis
ERYLRARGRRYFRGHH

SEQ ID NO: 69997 - protein, 16 aa, Mycobacterium tuberculosis
RYLRARGRRYFRGHHD

SEQ ID NO: 69998 - protein, 16 aa, Mycobacterium tuberculosis
YLRARGRRYFRGHHDA

SEQ ID NO: 69999 - protein, 16 aa, Mycobacterium tuberculosis
LRARGRRYFRGHHDAE

SEQ ID NO: 70000 - protein, 16 aa, Mycobacterium tuberculosis
RARGRRYFRGHHDAEF

SEQ ID NO: 70001 - protein, 16 aa, Mycobacterium tuberculosis
ARGRRYFRGHHDAEFF

SEQ ID NO: 70002 - protein, 16 aa, Mycobacterium tuberculosis
RGRRYFRGHHDAEFFF

SEQ ID NO: 70003 - protein, 16 aa, Mycobacterium tuberculosis
GRRYFRGHHDAEFFFV

SEQ ID NO: 70004 - protein, 16 aa, Mycobacterium tuberculosis
RRYFRGHHDAEFFFVA

SEQ ID NO: 70005 - protein, 16 aa, Mycobacterium tuberculosis
RYFRGHHDAEFFFVAN

SEQ ID NO: 70006 - protein, 16 aa, Mycobacterium tuberculosis
YFRGHHDAEFFFVANA

SEQ ID NO: 70007 - protein, 16 aa, Mycobacterium tuberculosis
FRGHHDAEFFFVANAH

SEQ ID NO: 70008 - protein, 16 aa, Mycobacterium tuberculosis
RGHHDAEFFFVANAHL

SEQ ID NO: 70009 - protein, 16 aa, Mycobacterium tuberculosis
GHHDAEFFFVANAHLL

SEQ ID NO: 70010 - protein, 16 aa, Mycobacterium tuberculosis
HHDAEFFFVANAHLLH

SEQ ID NO: 70011 - protein, 16 aa, Mycobacterium tuberculosis
HDAEFFFVANAHLLHV

SEQ ID NO: 70012 - protein, 16 aa, Mycobacterium tuberculosis
DAEFFFVANAHLLHVH

SEQ ID NO: 70013 - protein, 16 aa, Mycobacterium tuberculosis
AEFFFVANAHLLHVHL

SEQ ID NO: 70014 - protein, 16 aa, Mycobacterium tuberculosis
EFFFVANAHLLHVHLE

SEQ ID NO: 70015 - protein, 16 aa, Mycobacterium tuberculosis
FFFVANAHLLHVHLEI

SEQ ID NO: 70016 - protein, 16 aa, Mycobacterium tuberculosis
FFVANAHLLHVHLEIS

SEQ ID NO: 70017 - protein, 16 aa, Mycobacterium tuberculosis
FVANAHLLHVHLEISP

SEQ ID NO: 70018 - protein, 16 aa, Mycobacterium tuberculosis
VANAHLLHVHLEISPA

SEQ ID NO: 70019 - protein, 16 aa, Mycobacterium tuberculosis
ANAHLLHVHLEISPAY

SEQ ID NO: 70020 - protein, 16 aa, Mycobacterium tuberculosis
NAHLLHVHLEISPAYR

SEQ ID NO: 70021 - protein, 16 aa, Mycobacterium tuberculosis
AHLLHVHLEISPAYRD

SEQ ID NO: 70022 - protein, 16 aa, Mycobacterium tuberculosis
HLLHVHLEISPAYRDV

SEQ ID NO: 70023 - protein, 16 aa, Mycobacterium tuberculosis
LLHVHLEISPAYRDVF

SEQ ID NO: 70024 - protein, 16 aa, Mycobacterium tuberculosis
LHVHLEISPAYRDVFT

SEQ ID NO: 70025 - protein, 16 aa, Mycobacterium tuberculosis
HVHLEISPAYRDVFTI

SEQ ID NO: 70026 - protein, 16 aa, Mycobacterium tuberculosis
VHLEISPAYRDVFTIR

SEQ ID NO: 70027 - protein, 16 aa, Mycobacterium tuberculosis
HLEISPAYRDVFTIRV

SEQ ID NO: 70028 - protein, 16 aa, Mycobacterium tuberculosis
LEISPAYRDVFTIRVS

SEQ ID NO: 70029 - protein, 16 aa, Mycobacterium tuberculosis
EISPAYRDVFTIRVSP

SEQ ID NO: 70030 - protein, 16 aa, Mycobacterium tuberculosis
ISPAYRDVFTIRVSPA

SEQ ID NO: 70031 - protein, 16 aa, Mycobacterium tuberculosis
SPAYRDVFTIRVSPAY

SEQ ID NO: 70032 - protein, 16 aa, Mycobacterium tuberculosis
PAYRDVFTIRVSPAYF

SEQ ID NO: 70033 - protein, 16 aa, Mycobacterium tuberculosis
AYRDVFTIRVSPAYFF

SEQ ID NO: 70034 - protein, 16 aa, Mycobacterium tuberculosis
YRDVFTIRVSPAYFFP

SEQ ID NO: 70035 - protein, 16 aa, Mycobacterium tuberculosis
RDVFTIRVSPAYFFPA

SEQ ID NO: 70036 - protein, 16 aa, Mycobacterium tuberculosis
DVFTIRVSPAYFFPAT

SEQ ID NO: 70037 - protein, 16 aa, Mycobacterium tuberculosis
VFTIRVSPAYFFPATD

SEQ ID NO: 70038 - protein, 16 aa, Mycobacterium tuberculosis
FTIRVSPAYFFPATDH

SEQ ID NO: 70039 - protein, 16 aa, Mycobacterium tuberculosis
TIRVSPAYFFPATDHT

SEQ ID NO: 70040 - protein, 16 aa, Mycobacterium tuberculosis
IRVSPAYFFPATDHTR

SEQ ID NO: 70041 - protein, 16 aa, Mycobacterium tuberculosis
RVSPAYFFPATDHTRL

SEQ ID NO: 70042 - protein, 16 aa, Mycobacterium tuberculosis
VSPAYFFPATDHTRLA

SEQ ID NO: 70043 - protein, 16 aa, Mycobacterium tuberculosis
SPAYFFPATDHTRLAE

SEQ ID NO: 70044 - protein, 16 aa, Mycobacterium tuberculosis
PAYFFPATDHTRLAEI

SEQ ID NO: 70045 - protein, 16 aa, Mycobacterium tuberculosis
AYFFPATDHTRLAEIV

SEQ ID NO: 70046 - protein, 16 aa, Mycobacterium tuberculosis
YFFPATDHTRLAEIVN

SEQ ID NO: 70047 - protein, 16 aa, Mycobacterium tuberculosis
FFPATDHTRLAEIVNA

SEQ ID NO: 70048 - protein, 16 aa, Mycobacterium tuberculosis
FPATDHTRLAEIVNAW

SEQ ID NO: 70049 - protein, 16 aa, Mycobacterium tuberculosis
PATDHTRLAEIVNAWN

SEQ ID NO: 70050 - protein, 16 aa, Mycobacterium tuberculosis
ATDHTRLAEIVNAWNL

SEQ ID NO: 70051 - protein, 16 aa, Mycobacterium tuberculosis
TDHTRLAEIVNAWNLQ

SEQ ID NO: 70052 - protein, 16 aa, Mycobacterium tuberculosis
DHTRLAEIVNAWNLQN

SEQ ID NO: 70053 - protein, 16 aa, Mycobacterium tuberculosis
HTRLAEIVNAWNLQNH

SEQ ID NO: 70054 - protein, 16 aa, Mycobacterium tuberculosis
TRLAEIVNAWNLQNHE

SEQ ID NO: 70055 - protein, 16 aa, Mycobacterium tuberculosis
RLAEIVNAWNLQNHEV

SEQ ID NO: 70056 - protein, 16 aa, Mycobacterium tuberculosis
LAEIVNAWNLQNHEVT

SEQ ID NO: 70057 - protein, 16 aa, Mycobacterium tuberculosis
AEIVNAWNLQNHEVTA

SEQ ID NO: 70058 - protein, 16 aa, Mycobacterium tuberculosis
EIVNAWNLQNHEVTAI

SEQ ID NO: 70059 - protein, 16 aa, Mycobacterium tuberculosis
IVNAWNLQNHEVTAIV

SEQ ID NO: 70060 - protein, 16 aa, Mycobacterium tuberculosis
VNAWNLQNHEVTAIVH

SEQ ID NO: 70061 - protein, 16 aa, Mycobacterium tuberculosis
NAWNLQNHEVTAIVHG

SEQ ID NO: 70062 - protein, 16 aa, Mycobacterium tuberculosis
AWNLQNHEVTAIVHGS

SEQ ID NO: 70063 - protein, 16 aa, Mycobacterium tuberculosis
WNLQNHEVTAIVHGSS

SEQ ID NO: 70064 - protein, 16 aa, Mycobacterium tuberculosis
NLQNHEVTAIVHGSSD

SEQ ID NO: 70065 - protein, 16 aa, Mycobacterium tuberculosis
LQNHEVTAIVHGSSDP

SEQ ID NO: 70066 - protein, 16 aa, Mycobacterium tuberculosis
QNHEVTAIVHGSSDPH

SEQ ID NO: 70067 - protein, 16 aa, Mycobacterium tuberculosis
NHEVTAIVHGSSDPHR

SEQ ID NO: 70068 - protein, 16 aa, Mycobacterium tuberculosis
HEVTAIVHGSSDPHRI

SEQ ID NO: 70069 - protein, 16 aa, Mycobacterium tuberculosis
EVTAIVHGSSDPHRIG

SEQ ID NO: 70070 - protein, 16 aa, Mycobacterium tuberculosis
VTAIVHGSSDPHRIGV

SEQ ID NO: 70071 - protein, 16 aa, Mycobacterium tuberculosis
TAIVHGSSDPHRIGVA

SEQ ID NO: 70072 - protein, 16 aa, Mycobacterium tuberculosis
AIVHGSSDPHRIGVAA

SEQ ID NO: 70073 - protein, 16 aa, Mycobacterium tuberculosis
IVHGSSDPHRIGVAAE

SEQ ID NO: 70074 - protein, 16 aa, Mycobacterium tuberculosis
VHGSSDPHRIGVAAER

SEQ ID NO: 70075 - protein, 16 aa, Mycobacterium tuberculosis
HGSSDPHRIGVAAERS

SEQ ID NO: 70076 - protein, 16 aa, Mycobacterium tuberculosis
GSSDPHRIGVAAERSL

SEQ ID NO: 70077 - protein, 16 aa, Mycobacterium tuberculosis
SSDPHRIGVAAERSLI

SEQ ID NO: 70078 - protein, 16 aa, Mycobacterium tuberculosis
SDPHRIGVAAERSLIR

SEQ ID NO: 70079 - protein, 16 aa, Mycobacterium tuberculosis
DPHRIGVAAERSLIRD

SEQ ID NO: 70080 - protein, 16 aa, Mycobacterium tuberculosis
PHRIGVAAERSLIRDR

SEQ ID NO: 70081 - protein, 16 aa, Mycobacterium tuberculosis
HRIGVAAERSLIRDRI

SEQ ID NO: 70082 - protein, 16 aa, Mycobacterium tuberculosis
RIGVAAERSLIRDRIR

SEQ ID NO: 70083 - protein, 16 aa, Mycobacterium tuberculosis
IGVAAERSLIRDRIRF

SEQ ID NO: 70084 - protein, 16 aa, Mycobacterium tuberculosis
GVAAERSLIRDRIRFD

SEQ ID NO: 70085 - protein, 16 aa, Mycobacterium tuberculosis
VAAERSLIRDRIRFDD

SEQ ID NO: 70086 - protein, 16 aa, Mycobacterium tuberculosis
AAERSLIRDRIRFDDF

SEQ ID NO: 70087 - protein, 16 aa, Mycobacterium tuberculosis
AERSLIRDRIRFDDFA

SEQ ID NO: 70088 - protein, 16 aa, Mycobacterium tuberculosis
ERSLIRDRIRFDDFAT

SEQ ID NO: 70089 - protein, 16 aa, Mycobacterium tuberculosis
RSLIRDRIRFDDFATF

SEQ ID NO: 70090 - protein, 16 aa, Mycobacterium tuberculosis
SLIRDRIRFDDFATFV

SEQ ID NO: 70091 - protein, 16 aa, Mycobacterium tuberculosis
LIRDRIRFDDFATFVD

SEQ ID NO: 70092 - protein, 16 aa, Mycobacterium tuberculosis
IRDRIRFDDFATFVDN

SEQ ID NO: 70093 - protein, 16 aa, Mycobacterium tuberculosis
RDRIRFDDFATFVDNA

SEQ ID NO: 70094 - protein, 16 aa, Mycobacterium tuberculosis
DRIRFDDFATFVDNAV

SEQ ID NO: 70095 - protein, 16 aa, Mycobacterium tuberculosis
RIRFDDFATFVDNAVS

SEQ ID NO: 70096 - protein, 16 aa, Mycobacterium tuberculosis
IRFDDFATFVDNAVSA

SEQ ID NO: 70097 - protein, 16 aa, Mycobacterium tuberculosis
RFDDFATFVDNAVSAA

SEQ ID NO: 70098 - protein, 16 aa, Mycobacterium tuberculosis
FDDFATFVDNAVSAAT

SEQ ID NO: 70099 - protein, 16 aa, Mycobacterium tuberculosis
DDFATFVDNAVSAATE

SEQ ID NO: 70100 - protein, 16 aa, Mycobacterium tuberculosis
DFATFVDNAVSAATEL

SEQ ID NO: 70101 - protein, 16 aa, Mycobacterium tuberculosis
FATFVDNAVSAATELF

SEQ ID NO: 70102 - protein, 16 aa, Mycobacterium tuberculosis
ATFVDNAVSAATELFG

SEQ ID NO: 70103 - protein, 16 aa, Mycobacterium tuberculosis
TFVDNAVSAATELFGQ

SEQ ID NO: 70104 - protein, 16 aa, Mycobacterium tuberculosis
FVDNAVSAATELFGQL

SEQ ID NO: 70105 - protein, 16 aa, Mycobacterium tuberculosis
VDNAVSAATELFGQLT

SEQ ID NO: 70106 - protein, 16 aa, Mycobacterium tuberculosis
DNAVSAATELFGQLTA

SEQ ID NO: 70107 - protein, 16 aa, Mycobacterium tuberculosis
NAVSAATELFGQLTAA

SEQ ID NO: 70108 - protein, 16 aa, Mycobacterium tuberculosis
AVSAATELFGQLTAAG

SEQ ID NO: 70109 - protein, 16 aa, Mycobacterium tuberculosis
VSAATELFGQLTAAGL

SEQ ID NO: 70110 - protein, 16 aa, Mycobacterium tuberculosis
SAATELFGQLTAAGLP

SEQ ID NO: 70111 - protein, 16 aa, Mycobacterium tuberculosis
AATELFGQLTAAGLPP

SEQ ID NO: 70112 - protein, 16 aa, Mycobacterium tuberculosis
ATELFGQLTAAGLPPT

SEQ ID NO: 70113 - protein, 16 aa, Mycobacterium tuberculosis
TELFGQLTAAGLPPTA

SEQ ID NO: 70114 - protein, 16 aa, Mycobacterium tuberculosis
ELFGQLTAAGLPPTAT

SEQ ID NO: 70115 - protein, 16 aa, Mycobacterium tuberculosis
LFGQLTAAGLPPTATP

SEQ ID NO: 70116 - protein, 16 aa, Mycobacterium tuberculosis
FGQLTAAGLPPTATPP

SEQ ID NO: 70117 - protein, 16 aa, Mycobacterium tuberculosis
GQLTAAGLPPTATPPL

SEQ ID NO: 70118 - protein, 16 aa, Mycobacterium tuberculosis
QLTAAGLPPTATPPLL

SEQ ID NO: 70119 - protein, 16 aa, Mycobacterium tuberculosis
LTAAGLPPTATPPLLR

SEQ ID NO: 70120 - protein, 16 aa, Mycobacterium tuberculosis
TAAGLPPTATPPLLRD

SEQ ID NO: 70121 - protein, 16 aa, Mycobacterium tuberculosis
AAGLPPTATPPLLRDA

SEQ ID NO: 70122 - protein, 16 aa, Mycobacterium tuberculosis
AGLPPTATPPLLRDAG

SEQ ID NO: 70123 - protein, 13 aa, Mycobacterium tuberculosis
MHRAGAAVTANVW

SEQ ID NO: 70124 - protein, 13 aa, Mycobacterium tuberculosis
HRAGAAVTANVWC

SEQ ID NO: 70125 - protein, 13 aa, Mycobacterium tuberculosis
RAGAAVTANVWCR

SEQ ID NO: 70126 - protein, 13 aa, Mycobacterium tuberculosis
AGAAVTANVWCRA

SEQ ID NO: 70127 - protein, 13 aa, Mycobacterium tuberculosis
GAAVTANVWCRAG

SEQ ID NO: 70128 - protein, 13 aa, Mycobacterium tuberculosis
AAVTANVWCRAGG

SEQ ID NO: 70129 - protein, 13 aa, Mycobacterium tuberculosis
AVTANVWCRAGGI

SEQ ID NO: 70130 - protein, 13 aa, Mycobacterium tuberculosis
VTANVWCRAGGIR

SEQ ID NO: 70131 - protein, 13 aa, Mycobacterium tuberculosis
TANVWCRAGGIRM

SEQ ID NO: 70132 - protein, 13 aa, Mycobacterium tuberculosis
ANVWCRAGGIRMA

SEQ ID NO: 70133 - protein, 13 aa, Mycobacterium tuberculosis
NVWCRAGGIRMAP

SEQ ID NO: 70134 - protein, 13 aa, Mycobacterium tuberculosis
VWCRAGGIRMAPR

SEQ ID NO: 70135 - protein, 13 aa, Mycobacterium tuberculosis
WCRAGGIRMAPRP

SEQ ID NO: 70136 - protein, 13 aa, Mycobacterium tuberculosis
CRAGGIRMAPRPV

SEQ ID NO: 70137 - protein, 13 aa, Mycobacterium tuberculosis
RAGGIRMAPRPVI

SEQ ID NO: 70138 - protein, 13 aa, Mycobacterium tuberculosis
AGGIRMAPRPVIP

SEQ ID NO: 70139 - protein, 13 aa, Mycobacterium tuberculosis
GGIRMAPRPVIPV

SEQ ID NO: 70140 - protein, 13 aa, Mycobacterium tuberculosis
GIRMAPRPVIPVA

SEQ ID NO: 70141 - protein, 13 aa, Mycobacterium tuberculosis
IRMAPRPVIPVAT

SEQ ID NO: 70142 - protein, 13 aa, Mycobacterium tuberculosis
RMAPRPVIPVATQ

SEQ ID NO: 70143 - protein, 13 aa, Mycobacterium tuberculosis
MAPRPVIPVATQQ

SEQ ID NO: 70144 - protein, 13 aa, Mycobacterium tuberculosis
APRPVIPVATQQR

SEQ ID NO: 70145 - protein, 13 aa, Mycobacterium tuberculosis
PRPVIPVATQQRL

SEQ ID NO: 70146 - protein, 13 aa, Mycobacterium tuberculosis
RPVIPVATQQRLR

SEQ ID NO: 70147 - protein, 13 aa, Mycobacterium tuberculosis
PVIPVATQQRLRR

SEQ ID NO: 70148 - protein, 13 aa, Mycobacterium tuberculosis
VIPVATQQRLRRQ

SEQ ID NO: 70149 - protein, 13 aa, Mycobacterium tuberculosis
IPVATQQRLRRQA

SEQ ID NO: 70150 - protein, 13 aa, Mycobacterium tuberculosis
PVATQQRLRRQAD

SEQ ID NO: 70151 - protein, 13 aa, Mycobacterium tuberculosis
VATQQRLRRQADR

SEQ ID NO: 70152 - protein, 13 aa, Mycobacterium tuberculosis
ATQQRLRRQADRQ

SEQ ID NO: 70153 - protein, 13 aa, Mycobacterium tuberculosis
TQQRLRRQADRQS

SEQ ID NO: 70154 - protein, 13 aa, Mycobacterium tuberculosis
QQRLRRQADRQSL

SEQ ID NO: 70155 - protein, 13 aa, Mycobacterium tuberculosis
QRLRRQADRQSLG

SEQ ID NO: 70156 - protein, 13 aa, Mycobacterium tuberculosis
RLRRQADRQSLGS

SEQ ID NO: 70157 - protein, 13 aa, Mycobacterium tuberculosis
LRRQADRQSLGSS

SEQ ID NO: 70158 - protein, 13 aa, Mycobacterium tuberculosis
RRQADRQSLGSSG

SEQ ID NO: 70159 - protein, 13 aa, Mycobacterium tuberculosis
RQADRQSLGSSGL

SEQ ID NO: 70160 - protein, 13 aa, Mycobacterium tuberculosis
QADRQSLGSSGLP

SEQ ID NO: 70161 - protein, 13 aa, Mycobacterium tuberculosis
ADRQSLGSSGLPA

SEQ ID NO: 70162 - protein, 13 aa, Mycobacterium tuberculosis
DRQSLGSSGLPAL

SEQ ID NO: 70163 - protein, 13 aa, Mycobacterium tuberculosis
RQSLGSSGLPALN

SEQ ID NO: 70164 - protein, 13 aa, Mycobacterium tuberculosis
QSLGSSGLPALNC

SEQ ID NO: 70165 - protein, 13 aa, Mycobacterium tuberculosis
SLGSSGLPALNCT

SEQ ID NO: 70166 - protein, 13 aa, Mycobacterium tuberculosis
LGSSGLPALNCTP

SEQ ID NO: 70167 - protein, 13 aa, Mycobacterium tuberculosis
GSSGLPALNCTPI

SEQ ID NO: 70168 - protein, 13 aa, Mycobacterium tuberculosis
SSGLPALNCTPIR

SEQ ID NO: 70169 - protein, 13 aa, Mycobacterium tuberculosis
SGLPALNCTPIRH

SEQ ID NO: 70170 - protein, 13 aa, Mycobacterium tuberculosis
GLPALNCTPIRHT

SEQ ID NO: 70171 - protein, 13 aa, Mycobacterium tuberculosis
LPALNCTPIRHTI

SEQ ID NO: 70172 - protein, 13 aa, Mycobacterium tuberculosis
PALNCTPIRHTID

SEQ ID NO: 70173 - protein, 13 aa, Mycobacterium tuberculosis
ALNCTPIRHTIDV

SEQ ID NO: 70174 - protein, 13 aa, Mycobacterium tuberculosis
LNCTPIRHTIDVM

SEQ ID NO: 70175 - protein, 13 aa, Mycobacterium tuberculosis
NCTPIRHTIDVMA

SEQ ID NO: 70176 - protein, 13 aa, Mycobacterium tuberculosis
CTPIRHTIDVMAT

SEQ ID NO: 70177 - protein, 13 aa, Mycobacterium tuberculosis
TPIRHTIDVMATK

SEQ ID NO: 70178 - protein, 13 aa, Mycobacterium tuberculosis
PIRHTIDVMATKP

SEQ ID NO: 70179 - protein, 13 aa, Mycobacterium tuberculosis
IRHTIDVMATKPE

SEQ ID NO: 70180 - protein, 13 aa, Mycobacterium tuberculosis
RHTIDVMATKPER

SEQ ID NO: 70181 - protein, 13 aa, Mycobacterium tuberculosis
HTIDVMATKPERK

SEQ ID NO: 70182 - protein, 13 aa, Mycobacterium tuberculosis
TIDVMATKPERKT

SEQ ID NO: 70183 - protein, 13 aa, Mycobacterium tuberculosis
IDVMATKPERKTE

SEQ ID NO: 70184 - protein, 13 aa, Mycobacterium tuberculosis
DVMATKPERKTER

SEQ ID NO: 70185 - protein, 13 aa, Mycobacterium tuberculosis
VMATKPERKTERL

SEQ ID NO: 70186 - protein, 13 aa, Mycobacterium tuberculosis
MATKPERKTERLA

SEQ ID NO: 70187 - protein, 13 aa, Mycobacterium tuberculosis
ATKPERKTERLAA

SEQ ID NO: 70188 - protein, 13 aa, Mycobacterium tuberculosis
TKPERKTERLAAR

SEQ ID NO: 70189 - protein, 13 aa, Mycobacterium tuberculosis
KPERKTERLAARL

SEQ ID NO: 70190 - protein, 13 aa, Mycobacterium tuberculosis
PERKTERLAARLT

SEQ ID NO: 70191 - protein, 13 aa, Mycobacterium tuberculosis
ERKTERLAARLTP

SEQ ID NO: 70192 - protein, 13 aa, Mycobacterium tuberculosis
RKTERLAARLTPE

SEQ ID NO: 70193 - protein, 13 aa, Mycobacterium tuberculosis
KTERLAARLTPEQ

SEQ ID NO: 70194 - protein, 13 aa, Mycobacterium tuberculosis
TERLAARLTPEQD

SEQ ID NO: 70195 - protein, 13 aa, Mycobacterium tuberculosis
ERLAARLTPEQDA

SEQ ID NO: 70196 - protein, 13 aa, Mycobacterium tuberculosis
RLAARLTPEQDAL

SEQ ID NO: 70197 - protein, 13 aa, Mycobacterium tuberculosis
LAARLTPEQDALI

SEQ ID NO: 70198 - protein, 13 aa, Mycobacterium tuberculosis
AARLTPEQDALIR

SEQ ID NO: 70199 - protein, 13 aa, Mycobacterium tuberculosis
ARLTPEQDALIRR

SEQ ID NO: 70200 - protein, 13 aa, Mycobacterium tuberculosis
RLTPEQDALIRRA

SEQ ID NO: 70201 - protein, 13 aa, Mycobacterium tuberculosis
LTPEQDALIRRAA

SEQ ID NO: 70202 - protein, 13 aa, Mycobacterium tuberculosis
TPEQDALIRRAAE

SEQ ID NO: 70203 - protein, 13 aa, Mycobacterium tuberculosis
PEQDALIRRAAEA

SEQ ID NO: 70204 - protein, 13 aa, Mycobacterium tuberculosis
EQDALIRRAAEAE

SEQ ID NO: 70205 - protein, 13 aa, Mycobacterium tuberculosis
QDALIRRAAEAEG

SEQ ID NO: 70206 - protein, 13 aa, Mycobacterium tuberculosis
DALIRRAAEAEGT

SEQ ID NO: 70207 - protein, 13 aa, Mycobacterium tuberculosis
ALIRRAAEAEGTD

SEQ ID NO: 70208 - protein, 13 aa, Mycobacterium tuberculosis
LIRRAAEAEGTDL

SEQ ID NO: 70209 - protein, 13 aa, Mycobacterium tuberculosis
IRRAAEAEGTDLT

SEQ ID NO: 70210 - protein, 13 aa, Mycobacterium tuberculosis
RRAAEAEGTDLTN

SEQ ID NO: 70211 - protein, 13 aa, Mycobacterium tuberculosis
RAAEAEGTDLTNF

SEQ ID NO: 70212 - protein, 13 aa, Mycobacterium tuberculosis
AAEAEGTDLTNFT

SEQ ID NO: 70213 - protein, 13 aa, Mycobacterium tuberculosis
AEAEGTDLTNFTV

SEQ ID NO: 70214 - protein, 13 aa, Mycobacterium tuberculosis
EAEGTDLTNFTVT

SEQ ID NO: 70215 - protein, 13 aa, Mycobacterium tuberculosis
AEGTDLTNFTVTA

SEQ ID NO: 70216 - protein, 13 aa, Mycobacterium tuberculosis
EGTDLTNFTVTAA

SEQ ID NO: 70217 - protein, 13 aa, Mycobacterium tuberculosis
GTDLTNFTVTAAL

SEQ ID NO: 70218 - protein, 13 aa, Mycobacterium tuberculosis
TDLTNFTVTAALA

SEQ ID NO: 70219 - protein, 13 aa, Mycobacterium tuberculosis
DLTNFTVTAALAH

SEQ ID NO: 70220 - protein, 13 aa, Mycobacterium tuberculosis
LTNFTVTAALAHA

SEQ ID NO: 70221 - protein, 13 aa, Mycobacterium tuberculosis
TNFTVTAALAHAR

SEQ ID NO: 70222 - protein, 13 aa, Mycobacterium tuberculosis
NFTVTAALAHARD

SEQ ID NO: 70223 - protein, 13 aa, Mycobacterium tuberculosis
FTVTAALAHARDV

SEQ ID NO: 70224 - protein, 13 aa, Mycobacterium tuberculosis
TVTAALAHARDVL

SEQ ID NO: 70225 - protein, 13 aa, Mycobacterium tuberculosis
VTAALAHARDVLA

SEQ ID NO: 70226 - protein, 13 aa, Mycobacterium tuberculosis
TAALAHARDVLAD

SEQ ID NO: 70227 - protein, 13 aa, Mycobacterium tuberculosis
AALAHARDVLADR

SEQ ID NO: 70228 - protein, 13 aa, Mycobacterium tuberculosis
ALAHARDVLADRR

SEQ ID NO: 70229 - protein, 13 aa, Mycobacterium tuberculosis
LAHARDVLADRRL

SEQ ID NO: 70230 - protein, 13 aa, Mycobacterium tuberculosis
AHARDVLADRRLF

SEQ ID NO: 70231 - protein, 13 aa, Mycobacterium tuberculosis
HARDVLADRRLFV

SEQ ID NO: 70232 - protein, 13 aa, Mycobacterium tuberculosis
ARDVLADRRLFVL

SEQ ID NO: 70233 - protein, 13 aa, Mycobacterium tuberculosis
RDVLADRRLFVLT

SEQ ID NO: 70234 - protein, 13 aa, Mycobacterium tuberculosis
DVLADRRLFVLTD

SEQ ID NO: 70235 - protein, 13 aa, Mycobacterium tuberculosis
VLADRRLFVLTDA

SEQ ID NO: 70236 - protein, 13 aa, Mycobacterium tuberculosis
LADRRLFVLTDAA

SEQ ID NO: 70237 - protein, 13 aa, Mycobacterium tuberculosis
ADRRLFVLTDAAW

SEQ ID NO: 70238 - protein, 13 aa, Mycobacterium tuberculosis
DRRLFVLTDAAWT

SEQ ID NO: 70239 - protein, 13 aa, Mycobacterium tuberculosis
RRLFVLTDAAWTE

SEQ ID NO: 70240 - protein, 13 aa, Mycobacterium tuberculosis
RLFVLTDAAWTEF

SEQ ID NO: 70241 - protein, 13 aa, Mycobacterium tuberculosis
LFVLTDAAWTEFL

SEQ ID NO: 70242 - protein, 13 aa, Mycobacterium tuberculosis
FVLTDAAWTEFLA

SEQ ID NO: 70243 - protein, 13 aa, Mycobacterium tuberculosis
VLTDAAWTEFLAA

SEQ ID NO: 70244 - protein, 13 aa, Mycobacterium tuberculosis
LTDAAWTEFLAAL

SEQ ID NO: 70245 - protein, 13 aa, Mycobacterium tuberculosis
TDAAWTEFLAALD

SEQ ID NO: 70246 - protein, 13 aa, Mycobacterium tuberculosis
DAAWTEFLAALDR

SEQ ID NO: 70247 - protein, 13 aa, Mycobacterium tuberculosis
AAWTEFLAALDRP

SEQ ID NO: 70248 - protein, 13 aa, Mycobacterium tuberculosis
AWTEFLAALDRPV

SEQ ID NO: 70249 - protein, 13 aa, Mycobacterium tuberculosis
WTEFLAALDRPVS

SEQ ID NO: 70250 - protein, 13 aa, Mycobacterium tuberculosis
TEFLAALDRPVSH

SEQ ID NO: 70251 - protein, 13 aa, Mycobacterium tuberculosis
EFLAALDRPVSHK

SEQ ID NO: 70252 - protein, 13 aa, Mycobacterium tuberculosis
FLAALDRPVSHKP

SEQ ID NO: 70253 - protein, 13 aa, Mycobacterium tuberculosis
LAALDRPVSHKPR

SEQ ID NO: 70254 - protein, 13 aa, Mycobacterium tuberculosis
AALDRPVSHKPRL

SEQ ID NO: 70255 - protein, 13 aa, Mycobacterium tuberculosis
ALDRPVSHKPRLE

SEQ ID NO: 70256 - protein, 13 aa, Mycobacterium tuberculosis
LDRPVSHKPRLEK

SEQ ID NO: 70257 - protein, 13 aa, Mycobacterium tuberculosis
DRPVSHKPRLEKL

SEQ ID NO: 70258 - protein, 13 aa, Mycobacterium tuberculosis
RPVSHKPRLEKLF

SEQ ID NO: 70259 - protein, 13 aa, Mycobacterium tuberculosis
PVSHKPRLEKLFA

SEQ ID NO: 70260 - protein, 13 aa, Mycobacterium tuberculosis
VSHKPRLEKLFAA

SEQ ID NO: 70261 - protein, 13 aa, Mycobacterium tuberculosis
SHKPRLEKLFAAR

SEQ ID NO: 70262 - protein, 13 aa, Mycobacterium tuberculosis
HKPRLEKLFAARS

SEQ ID NO: 70263 - protein, 13 aa, Mycobacterium tuberculosis
KPRLEKLFAARSI

SEQ ID NO: 70264 - protein, 13 aa, Mycobacterium tuberculosis
PRLEKLFAARSIF

SEQ ID NO: 70265 - protein, 13 aa, Mycobacterium tuberculosis
RLEKLFAARSIFD

SEQ ID NO: 70266 - protein, 13 aa, Mycobacterium tuberculosis
LEKLFAARSIFDT

SEQ ID NO: 70267 - protein, 13 aa, Mycobacterium tuberculosis
EKLFAARSIFDTE

SEQ ID NO: 70268 - protein, 13 aa, Mycobacterium tuberculosis
KLFAARSIFDTEG

SEQ ID NO: 70269 - protein, 14 aa, Mycobacterium tuberculosis
MHRAGAAVTANVWC

SEQ ID NO: 70270 - protein, 14 aa, Mycobacterium tuberculosis
HRAGAAVTANVWCR

SEQ ID NO: 70271 - protein, 14 aa, Mycobacterium tuberculosis
RAGAAVTANVWCRA

SEQ ID NO: 70272 - protein, 14 aa, Mycobacterium tuberculosis
AGAAVTANVWCRAG

SEQ ID NO: 70273 - protein, 14 aa, Mycobacterium tuberculosis
GAAVTANVWCRAGG

SEQ ID NO: 70274 - protein, 14 aa, Mycobacterium tuberculosis
AAVTANVWCRAGGI

SEQ ID NO: 70275 - protein, 14 aa, Mycobacterium tuberculosis
AVTANVWCRAGGIR

SEQ ID NO: 70276 - protein, 14 aa, Mycobacterium tuberculosis
VTANVWCRAGGIRM

SEQ ID NO: 70277 - protein, 14 aa, Mycobacterium tuberculosis
TANVWCRAGGIRMA

SEQ ID NO: 70278 - protein, 14 aa, Mycobacterium tuberculosis
ANVWCRAGGIRMAP

SEQ ID NO: 70279 - protein, 14 aa, Mycobacterium tuberculosis
NVWCRAGGIRMAPR

SEQ ID NO: 70280 - protein, 14 aa, Mycobacterium tuberculosis
VWCRAGGIRMAPRP

SEQ ID NO: 70281 - protein, 14 aa, Mycobacterium tuberculosis
WCRAGGIRMAPRPV

SEQ ID NO: 70282 - protein, 14 aa, Mycobacterium tuberculosis
CRAGGIRMAPRPVI

SEQ ID NO: 70283 - protein, 14 aa, Mycobacterium tuberculosis
RAGGIRMAPRPVIP

SEQ ID NO: 70284 - protein, 14 aa, Mycobacterium tuberculosis
AGGIRMAPRPVIPV

SEQ ID NO: 70285 - protein, 14 aa, Mycobacterium tuberculosis
GGIRMAPRPVIPVA

SEQ ID NO: 70286 - protein, 14 aa, Mycobacterium tuberculosis
GIRMAPRPVIPVAT

SEQ ID NO: 70287 - protein, 14 aa, Mycobacterium tuberculosis
IRMAPRPVIPVATQ

SEQ ID NO: 70288 - protein, 14 aa, Mycobacterium tuberculosis
RMAPRPVIPVATQQ

SEQ ID NO: 70289 - protein, 14 aa, Mycobacterium tuberculosis
MAPRPVIPVATQQR

SEQ ID NO: 70290 - protein, 14 aa, Mycobacterium tuberculosis
APRPVIPVATQQRL

SEQ ID NO: 70291 - protein, 14 aa, Mycobacterium tuberculosis
PRPVIPVATQQRLR

SEQ ID NO: 70292 - protein, 14 aa, Mycobacterium tuberculosis
RPVIPVATQQRLRR

SEQ ID NO: 70293 - protein, 14 aa, Mycobacterium tuberculosis
PVIPVATQQRLRRQ

SEQ ID NO: 70294 - protein, 14 aa, Mycobacterium tuberculosis
VIPVATQQRLRRQA

SEQ ID NO: 70295 - protein, 14 aa, Mycobacterium tuberculosis
IPVATQQRLRRQAD

SEQ ID NO: 70296 - protein, 14 aa, Mycobacterium tuberculosis
PVATQQRLRRQADR

SEQ ID NO: 70297 - protein, 14 aa, Mycobacterium tuberculosis
VATQQRLRRQADRQ

SEQ ID NO: 70298 - protein, 14 aa, Mycobacterium tuberculosis
ATQQRLRRQADRQS

SEQ ID NO: 70299 - protein, 14 aa, Mycobacterium tuberculosis
TQQRLRRQADRQSL

SEQ ID NO: 70300 - protein, 14 aa, Mycobacterium tuberculosis
QQRLRRQADRQSLG

SEQ ID NO: 70301 - protein, 14 aa, Mycobacterium tuberculosis
QRLRRQADRQSLGS

SEQ ID NO: 70302 - protein, 14 aa, Mycobacterium tuberculosis
RLRRQADRQSLGSS

SEQ ID NO: 70303 - protein, 14 aa, Mycobacterium tuberculosis
LRRQADRQSLGSSG

SEQ ID NO: 70304 - protein, 14 aa, Mycobacterium tuberculosis
RRQADRQSLGSSGL

SEQ ID NO: 70305 - protein, 14 aa, Mycobacterium tuberculosis
RQADRQSLGSSGLP

SEQ ID NO: 70306 - protein, 14 aa, Mycobacterium tuberculosis
QADRQSLGSSGLPA

SEQ ID NO: 70307 - protein, 14 aa, Mycobacterium tuberculosis
ADRQSLGSSGLPAL

SEQ ID NO: 70308 - protein, 14 aa, Mycobacterium tuberculosis
DRQSLGSSGLPALN

SEQ ID NO: 70309 - protein, 14 aa, Mycobacterium tuberculosis
RQSLGSSGLPALNC

SEQ ID NO: 70310 - protein, 14 aa, Mycobacterium tuberculosis
QSLGSSGLPALNCT

SEQ ID NO: 70311 - protein, 14 aa, Mycobacterium tuberculosis
SLGSSGLPALNCTP

SEQ ID NO: 70312 - protein, 14 aa, Mycobacterium tuberculosis
LGSSGLPALNCTPI

SEQ ID NO: 70313 - protein, 14 aa, Mycobacterium tuberculosis
GSSGLPALNCTPIR

SEQ ID NO: 70314 - protein, 14 aa, Mycobacterium tuberculosis
SSGLPALNCTPIRH

SEQ ID NO: 70315 - protein, 14 aa, Mycobacterium tuberculosis
SGLPALNCTPIRHT

SEQ ID NO: 70316 - protein, 14 aa, Mycobacterium tuberculosis
GLPALNCTPIRHTI

SEQ ID NO: 70317 - protein, 14 aa, Mycobacterium tuberculosis
LPALNCTPIRHTID

SEQ ID NO: 70318 - protein, 14 aa, Mycobacterium tuberculosis
PALNCTPIRHTIDV

SEQ ID NO: 70319 - protein, 14 aa, Mycobacterium tuberculosis
ALNCTPIRHTIDVM

SEQ ID NO: 70320 - protein, 14 aa, Mycobacterium tuberculosis
LNCTPIRHTIDVMA

SEQ ID NO: 70321 - protein, 14 aa, Mycobacterium tuberculosis
NCTPIRHTIDVMAT

SEQ ID NO: 70322 - protein, 14 aa, Mycobacterium tuberculosis
CTPIRHTIDVMATK

SEQ ID NO: 70323 - protein, 14 aa, Mycobacterium tuberculosis
TPIRHTIDVMATKP

SEQ ID NO: 70324 - protein, 14 aa, Mycobacterium tuberculosis
PIRHTIDVMATKPE

SEQ ID NO: 70325 - protein, 14 aa, Mycobacterium tuberculosis
IRHTIDVMATKPER

SEQ ID NO: 70326 - protein, 14 aa, Mycobacterium tuberculosis
RHTIDVMATKPERK

SEQ ID NO: 70327 - protein, 14 aa, Mycobacterium tuberculosis
HTIDVMATKPERKT

SEQ ID NO: 70328 - protein, 14 aa, Mycobacterium tuberculosis
TIDVMATKPERKTE

SEQ ID NO: 70329 - protein, 14 aa, Mycobacterium tuberculosis
IDVMATKPERKTER

SEQ ID NO: 70330 - protein, 14 aa, Mycobacterium tuberculosis
DVMATKPERKTERL

SEQ ID NO: 70331 - protein, 14 aa, Mycobacterium tuberculosis
VMATKPERKTERLA

SEQ ID NO: 70332 - protein, 14 aa, Mycobacterium tuberculosis
MATKPERKTERLAA

SEQ ID NO: 70333 - protein, 14 aa, Mycobacterium tuberculosis
ATKPERKTERLAAR

SEQ ID NO: 70334 - protein, 14 aa, Mycobacterium tuberculosis
TKPERKTERLAARL

SEQ ID NO: 70335 - protein, 14 aa, Mycobacterium tuberculosis
KPERKTERLAARLT

SEQ ID NO: 70336 - protein, 14 aa, Mycobacterium tuberculosis
PERKTERLAARLTP

SEQ ID NO: 70337 - protein, 14 aa, Mycobacterium tuberculosis
ERKTERLAARLTPE

SEQ ID NO: 70338 - protein, 14 aa, Mycobacterium tuberculosis
RKTERLAARLTPEQ

SEQ ID NO: 70339 - protein, 14 aa, Mycobacterium tuberculosis
KTERLAARLTPEQD

SEQ ID NO: 70340 - protein, 14 aa, Mycobacterium tuberculosis
TERLAARLTPEQDA

SEQ ID NO: 70341 - protein, 14 aa, Mycobacterium tuberculosis
ERLAARLTPEQDAL

SEQ ID NO: 70342 - protein, 14 aa, Mycobacterium tuberculosis
RLAARLTPEQDALI

SEQ ID NO: 70343 - protein, 14 aa, Mycobacterium tuberculosis
LAARLTPEQDALIR

SEQ ID NO: 70344 - protein, 14 aa, Mycobacterium tuberculosis
AARLTPEQDALIRR

SEQ ID NO: 70345 - protein, 14 aa, Mycobacterium tuberculosis
ARLTPEQDALIRRA

SEQ ID NO: 70346 - protein, 14 aa, Mycobacterium tuberculosis
RLTPEQDALIRRAA

SEQ ID NO: 70347 - protein, 14 aa, Mycobacterium tuberculosis
LTPEQDALIRRAAE

SEQ ID NO: 70348 - protein, 14 aa, Mycobacterium tuberculosis
TPEQDALIRRAAEA

SEQ ID NO: 70349 - protein, 14 aa, Mycobacterium tuberculosis
PEQDALIRRAAEAE

SEQ ID NO: 70350 - protein, 14 aa, Mycobacterium tuberculosis
EQDALIRRAAEAEG

SEQ ID NO: 70351 - protein, 14 aa, Mycobacterium tuberculosis
QDALIRRAAEAEGT

SEQ ID NO: 70352 - protein, 14 aa, Mycobacterium tuberculosis
DALIRRAAEAEGTD

SEQ ID NO: 70353 - protein, 14 aa, Mycobacterium tuberculosis
ALIRRAAEAEGTDL

SEQ ID NO: 70354 - protein, 14 aa, Mycobacterium tuberculosis
LIRRAAEAEGTDLT

SEQ ID NO: 70355 - protein, 14 aa, Mycobacterium tuberculosis
IRRAAEAEGTDLTN

SEQ ID NO: 70356 - protein, 14 aa, Mycobacterium tuberculosis
RRAAEAEGTDLTNF

SEQ ID NO: 70357 - protein, 14 aa, Mycobacterium tuberculosis
RAAEAEGTDLTNFT

SEQ ID NO: 70358 - protein, 14 aa, Mycobacterium tuberculosis
AAEAEGTDLTNFTV

SEQ ID NO: 70359 - protein, 14 aa, Mycobacterium tuberculosis
AEAEGTDLTNFTVT

SEQ ID NO: 70360 - protein, 14 aa, Mycobacterium tuberculosis
EAEGTDLTNFTVTA

SEQ ID NO: 70361 - protein, 14 aa, Mycobacterium tuberculosis
AEGTDLTNFTVTAA

SEQ ID NO: 70362 - protein, 14 aa, Mycobacterium tuberculosis
EGTDLTNFTVTAAL

SEQ ID NO: 70363 - protein, 14 aa, Mycobacterium tuberculosis
GTDLTNFTVTAALA

SEQ ID NO: 70364 - protein, 14 aa, Mycobacterium tuberculosis
TDLTNFTVTAALAH

SEQ ID NO: 70365 - protein, 14 aa, Mycobacterium tuberculosis
DLTNFTVTAALAHA

SEQ ID NO: 70366 - protein, 14 aa, Mycobacterium tuberculosis
LTNFTVTAALAHAR

SEQ ID NO: 70367 - protein, 14 aa, Mycobacterium tuberculosis
TNFTVTAALAHARD

SEQ ID NO: 70368 - protein, 14 aa, Mycobacterium tuberculosis
NFTVTAALAHARDV

SEQ ID NO: 70369 - protein, 14 aa, Mycobacterium tuberculosis
FTVTAALAHARDVL

SEQ ID NO: 70370 - protein, 14 aa, Mycobacterium tuberculosis
TVTAALAHARDVLA

SEQ ID NO: 70371 - protein, 14 aa, Mycobacterium tuberculosis
VTAALAHARDVLAD

SEQ ID NO: 70372 - protein, 14 aa, Mycobacterium tuberculosis
TAALAHARDVLADR

SEQ ID NO: 70373 - protein, 14 aa, Mycobacterium tuberculosis
AALAHARDVLADRR

SEQ ID NO: 70374 - protein, 14 aa, Mycobacterium tuberculosis
ALAHARDVLADRRL

SEQ ID NO: 70375 - protein, 14 aa, Mycobacterium tuberculosis
LAHARDVLADRRLF

SEQ ID NO: 70376 - protein, 14 aa, Mycobacterium tuberculosis
AHARDVLADRRLFV

SEQ ID NO: 70377 - protein, 14 aa, Mycobacterium tuberculosis
HARDVLADRRLFVL

SEQ ID NO: 70378 - protein, 14 aa, Mycobacterium tuberculosis
ARDVLADRRLFVLT

SEQ ID NO: 70379 - protein, 14 aa, Mycobacterium tuberculosis
RDVLADRRLFVLTD

SEQ ID NO: 70380 - protein, 14 aa, Mycobacterium tuberculosis
DVLADRRLFVLTDA

SEQ ID NO: 70381 - protein, 14 aa, Mycobacterium tuberculosis
VLADRRLFVLTDAA

SEQ ID NO: 70382 - protein, 14 aa, Mycobacterium tuberculosis
LADRRLFVLTDAAW

SEQ ID NO: 70383 - protein, 14 aa, Mycobacterium tuberculosis
ADRRLFVLTDAAWT

SEQ ID NO: 70384 - protein, 14 aa, Mycobacterium tuberculosis
DRRLFVLTDAAWTE

SEQ ID NO: 70385 - protein, 14 aa, Mycobacterium tuberculosis
RRLFVLTDAAWTEF

SEQ ID NO: 70386 - protein, 14 aa, Mycobacterium tuberculosis
RLFVLTDAAWTEFL

SEQ ID NO: 70387 - protein, 14 aa, Mycobacterium tuberculosis
LFVLTDAAWTEFLA

SEQ ID NO: 70388 - protein, 14 aa, Mycobacterium tuberculosis
FVLTDAAWTEFLAA

SEQ ID NO: 70389 - protein, 14 aa, Mycobacterium tuberculosis
VLTDAAWTEFLAAL

SEQ ID NO: 70390 - protein, 14 aa, Mycobacterium tuberculosis
LTDAAWTEFLAALD

SEQ ID NO: 70391 - protein, 14 aa, Mycobacterium tuberculosis
TDAAWTEFLAALDR

SEQ ID NO: 70392 - protein, 14 aa, Mycobacterium tuberculosis
DAAWTEFLAALDRP

SEQ ID NO: 70393 - protein, 14 aa, Mycobacterium tuberculosis
AAWTEFLAALDRPV

SEQ ID NO: 70394 - protein, 14 aa, Mycobacterium tuberculosis
AWTEFLAALDRPVS

SEQ ID NO: 70395 - protein, 14 aa, Mycobacterium tuberculosis
WTEFLAALDRPVSH

SEQ ID NO: 70396 - protein, 14 aa, Mycobacterium tuberculosis
TEFLAALDRPVSHK

SEQ ID NO: 70397 - protein, 14 aa, Mycobacterium tuberculosis
EFLAALDRPVSHKP

SEQ ID NO: 70398 - protein, 14 aa, Mycobacterium tuberculosis
FLAALDRPVSHKPR

SEQ ID NO: 70399 - protein, 14 aa, Mycobacterium tuberculosis
LAALDRPVSHKPRL

SEQ ID NO: 70400 - protein, 14 aa, Mycobacterium tuberculosis
AALDRPVSHKPRLE

SEQ ID NO: 70401 - protein, 14 aa, Mycobacterium tuberculosis
ALDRPVSHKPRLEK

SEQ ID NO: 70402 - protein, 14 aa, Mycobacterium tuberculosis
LDRPVSHKPRLEKL

SEQ ID NO: 70403 - protein, 14 aa, Mycobacterium tuberculosis
DRPVSHKPRLEKLF

SEQ ID NO: 70404 - protein, 14 aa, Mycobacterium tuberculosis
RPVSHKPRLEKLFA

SEQ ID NO: 70405 - protein, 14 aa, Mycobacterium tuberculosis
PVSHKPRLEKLFAA

SEQ ID NO: 70406 - protein, 14 aa, Mycobacterium tuberculosis
VSHKPRLEKLFAAR

SEQ ID NO: 70407 - protein, 14 aa, Mycobacterium tuberculosis
SHKPRLEKLFAARS

SEQ ID NO: 70408 - protein, 14 aa, Mycobacterium tuberculosis
HKPRLEKLFAARSI

SEQ ID NO: 70409 - protein, 14 aa, Mycobacterium tuberculosis
KPRLEKLFAARSIF

SEQ ID NO: 70410 - protein, 14 aa, Mycobacterium tuberculosis
PRLEKLFAARSIFD

SEQ ID NO: 70411 - protein, 14 aa, Mycobacterium tuberculosis
RLEKLFAARSIFDT

SEQ ID NO: 70412 - protein, 14 aa, Mycobacterium tuberculosis
LEKLFAARSIFDTE

SEQ ID NO: 70413 - protein, 14 aa, Mycobacterium tuberculosis
EKLFAARSIFDTEG

SEQ ID NO: 70414 - protein, 15 aa, Mycobacterium tuberculosis
MHRAGAAVTANVWCR

SEQ ID NO: 70415 - protein, 15 aa, Mycobacterium tuberculosis
HRAGAAVTANVWCRA

SEQ ID NO: 70416 - protein, 15 aa, Mycobacterium tuberculosis
RAGAAVTANVWCRAG

SEQ ID NO: 70417 - protein, 15 aa, Mycobacterium tuberculosis
AGAAVTANVWCRAGG

SEQ ID NO: 70418 - protein, 15 aa, Mycobacterium tuberculosis
GAAVTANVWCRAGGI

SEQ ID NO: 70419 - protein, 15 aa, Mycobacterium tuberculosis
AAVTANVWCRAGGIR

SEQ ID NO: 70420 - protein, 15 aa, Mycobacterium tuberculosis
AVTANVWCRAGGIRM

SEQ ID NO: 70421 - protein, 15 aa, Mycobacterium tuberculosis
VTANVWCRAGGIRMA

SEQ ID NO: 70422 - protein, 15 aa, Mycobacterium tuberculosis
TANVWCRAGGIRMAP

SEQ ID NO: 70423 - protein, 15 aa, Mycobacterium tuberculosis
ANVWCRAGGIRMAPR

SEQ ID NO: 70424 - protein, 15 aa, Mycobacterium tuberculosis
NVWCRAGGIRMAPRP

SEQ ID NO: 70425 - protein, 15 aa, Mycobacterium tuberculosis
VWCRAGGIRMAPRPV

SEQ ID NO: 70426 - protein, 15 aa, Mycobacterium tuberculosis
WCRAGGIRMAPRPVI

SEQ ID NO: 70427 - protein, 15 aa, Mycobacterium tuberculosis
CRAGGIRMAPRPVIP

SEQ ID NO: 70428 - protein, 15 aa, Mycobacterium tuberculosis
RAGGIRMAPRPVIPV

SEQ ID NO: 70429 - protein, 15 aa, Mycobacterium tuberculosis
AGGIRMAPRPVIPVA

SEQ ID NO: 70430 - protein, 15 aa, Mycobacterium tuberculosis
GGIRMAPRPVIPVAT

SEQ ID NO: 70431 - protein, 15 aa, Mycobacterium tuberculosis
GIRMAPRPVIPVATQ

SEQ ID NO: 70432 - protein, 15 aa, Mycobacterium tuberculosis
IRMAPRPVIPVATQQ

SEQ ID NO: 70433 - protein, 15 aa, Mycobacterium tuberculosis
RMAPRPVIPVATQQR

SEQ ID NO: 70434 - protein, 15 aa, Mycobacterium tuberculosis
MAPRPVIPVATQQRL

SEQ ID NO: 70435 - protein, 15 aa, Mycobacterium tuberculosis
APRPVIPVATQQRLR

SEQ ID NO: 70436 - protein, 15 aa, Mycobacterium tuberculosis
PRPVIPVATQQRLRR

SEQ ID NO: 70437 - protein, 15 aa, Mycobacterium tuberculosis
RPVIPVATQQRLRRQ

SEQ ID NO: 70438 - protein, 15 aa, Mycobacterium tuberculosis
PVIPVATQQRLRRQA

SEQ ID NO: 70439 - protein, 15 aa, Mycobacterium tuberculosis
VIPVATQQRLRRQAD

SEQ ID NO: 70440 - protein, 15 aa, Mycobacterium tuberculosis
IPVATQQRLRRQADR

SEQ ID NO: 70441 - protein, 15 aa, Mycobacterium tuberculosis
PVATQQRLRRQADRQ

SEQ ID NO: 70442 - protein, 15 aa, Mycobacterium tuberculosis
VATQQRLRRQADRQS

SEQ ID NO: 70443 - protein, 15 aa, Mycobacterium tuberculosis
ATQQRLRRQADRQSL

SEQ ID NO: 70444 - protein, 15 aa, Mycobacterium tuberculosis
TQQRLRRQADRQSLG

SEQ ID NO: 70445 - protein, 15 aa, Mycobacterium tuberculosis
QQRLRRQADRQSLGS

SEQ ID NO: 70446 - protein, 15 aa, Mycobacterium tuberculosis
QRLRRQADRQSLGSS

SEQ ID NO: 70447 - protein, 15 aa, Mycobacterium tuberculosis
RLRRQADRQSLGSSG

SEQ ID NO: 70448 - protein, 15 aa, Mycobacterium tuberculosis
LRRQADRQSLGSSGL

SEQ ID NO: 70449 - protein, 15 aa, Mycobacterium tuberculosis
RRQADRQSLGSSGLP

SEQ ID NO: 70450 - protein, 15 aa, Mycobacterium tuberculosis
RQADRQSLGSSGLPA

SEQ ID NO: 70451 - protein, 15 aa, Mycobacterium tuberculosis
QADRQSLGSSGLPAL

SEQ ID NO: 70452 - protein, 15 aa, Mycobacterium tuberculosis
ADRQSLGSSGLPALN

SEQ ID NO: 70453 - protein, 15 aa, Mycobacterium tuberculosis
DRQSLGSSGLPALNC

SEQ ID NO: 70454 - protein, 15 aa, Mycobacterium tuberculosis
RQSLGSSGLPALNCT

SEQ ID NO: 70455 - protein, 15 aa, Mycobacterium tuberculosis
QSLGSSGLPALNCTP

SEQ ID NO: 70456 - protein, 15 aa, Mycobacterium tuberculosis
SLGSSGLPALNCTPI

SEQ ID NO: 70457 - protein, 15 aa, Mycobacterium tuberculosis
LGSSGLPALNCTPIR

SEQ ID NO: 70458 - protein, 15 aa, Mycobacterium tuberculosis
GSSGLPALNCTPIRH

SEQ ID NO: 70459 - protein, 15 aa, Mycobacterium tuberculosis
SSGLPALNCTPIRHT

SEQ ID NO: 70460 - protein, 15 aa, Mycobacterium tuberculosis
SGLPALNCTPIRHTI

SEQ ID NO: 70461 - protein, 15 aa, Mycobacterium tuberculosis
GLPALNCTPIRHTID

SEQ ID NO: 70462 - protein, 15 aa, Mycobacterium tuberculosis
LPALNCTPIRHTIDV

SEQ ID NO: 70463 - protein, 15 aa, Mycobacterium tuberculosis
PALNCTPIRHTIDVM

SEQ ID NO: 70464 - protein, 15 aa, Mycobacterium tuberculosis
ALNCTPIRHTIDVMA

SEQ ID NO: 70465 - protein, 15 aa, Mycobacterium tuberculosis
LNCTPIRHTIDVMAT

SEQ ID NO: 70466 - protein, 15 aa, Mycobacterium tuberculosis
NCTPIRHTIDVMATK

SEQ ID NO: 70467 - protein, 15 aa, Mycobacterium tuberculosis
CTPIRHTIDVMATKP

SEQ ID NO: 70468 - protein, 15 aa, Mycobacterium tuberculosis
TPIRHTIDVMATKPE

SEQ ID NO: 70469 - protein, 15 aa, Mycobacterium tuberculosis
PIRHTIDVMATKPER

SEQ ID NO: 70470 - protein, 15 aa, Mycobacterium tuberculosis
IRHTIDVMATKPERK

SEQ ID NO: 70471 - protein, 15 aa, Mycobacterium tuberculosis
RHTIDVMATKPERKT

SEQ ID NO: 70472 - protein, 15 aa, Mycobacterium tuberculosis
HTIDVMATKPERKTE

SEQ ID NO: 70473 - protein, 15 aa, Mycobacterium tuberculosis
TIDVMATKPERKTER

SEQ ID NO: 70474 - protein, 15 aa, Mycobacterium tuberculosis
IDVMATKPERKTERL

SEQ ID NO: 70475 - protein, 15 aa, Mycobacterium tuberculosis
DVMATKPERKTERLA

SEQ ID NO: 70476 - protein, 15 aa, Mycobacterium tuberculosis
VMATKPERKTERLAA

SEQ ID NO: 70477 - protein, 15 aa, Mycobacterium tuberculosis
MATKPERKTERLAAR

SEQ ID NO: 70478 - protein, 15 aa, Mycobacterium tuberculosis
ATKPERKTERLAARL

SEQ ID NO: 70479 - protein, 15 aa, Mycobacterium tuberculosis
TKPERKTERLAARLT

SEQ ID NO: 70480 - protein, 15 aa, Mycobacterium tuberculosis
KPERKTERLAARLTP

SEQ ID NO: 70481 - protein, 15 aa, Mycobacterium tuberculosis
PERKTERLAARLTPE

SEQ ID NO: 70482 - protein, 15 aa, Mycobacterium tuberculosis
ERKTERLAARLTPEQ

SEQ ID NO: 70483 - protein, 15 aa, Mycobacterium tuberculosis
RKTERLAARLTPEQD

SEQ ID NO: 70484 - protein, 15 aa, Mycobacterium tuberculosis
KTERLAARLTPEQDA

SEQ ID NO: 70485 - protein, 15 aa, Mycobacterium tuberculosis
TERLAARLTPEQDAL

SEQ ID NO: 70486 - protein, 15 aa, Mycobacterium tuberculosis
ERLAARLTPEQDALI

SEQ ID NO: 70487 - protein, 15 aa, Mycobacterium tuberculosis
RLAARLTPEQDALIR

SEQ ID NO: 70488 - protein, 15 aa, Mycobacterium tuberculosis
LAARLTPEQDALIRR

SEQ ID NO: 70489 - protein, 15 aa, Mycobacterium tuberculosis
AARLTPEQDALIRRA

SEQ ID NO: 70490 - protein, 15 aa, Mycobacterium tuberculosis
ARLTPEQDALIRRAA

SEQ ID NO: 70491 - protein, 15 aa, Mycobacterium tuberculosis
RLTPEQDALIRRAAE

SEQ ID NO: 70492 - protein, 15 aa, Mycobacterium tuberculosis
LTPEQDALIRRAAEA

SEQ ID NO: 70493 - protein, 15 aa, Mycobacterium tuberculosis
TPEQDALIRRAAEAE

SEQ ID NO: 70494 - protein, 15 aa, Mycobacterium tuberculosis
PEQDALIRRAAEAEG

SEQ ID NO: 70495 - protein, 15 aa, Mycobacterium tuberculosis
EQDALIRRAAEAEGT

SEQ ID NO: 70496 - protein, 15 aa, Mycobacterium tuberculosis
QDALIRRAAEAEGTD

SEQ ID NO: 70497 - protein, 15 aa, Mycobacterium tuberculosis
DALIRRAAEAEGTDL

SEQ ID NO: 70498 - protein, 15 aa, Mycobacterium tuberculosis
ALIRRAAEAEGTDLT

SEQ ID NO: 70499 - protein, 15 aa, Mycobacterium tuberculosis
LIRRAAEAEGTDLTN

SEQ ID NO: 70500 - protein, 15 aa, Mycobacterium tuberculosis
IRRAAEAEGTDLTNF

SEQ ID NO: 70501 - protein, 15 aa, Mycobacterium tuberculosis
RRAAEAEGTDLTNFT

SEQ ID NO: 70502 - protein, 15 aa, Mycobacterium tuberculosis
RAAEAEGTDLTNFTV

SEQ ID NO: 70503 - protein, 15 aa, Mycobacterium tuberculosis
AAEAEGTDLTNFTVT

SEQ ID NO: 70504 - protein, 15 aa, Mycobacterium tuberculosis
AEAEGTDLTNFTVTA

SEQ ID NO: 70505 - protein, 15 aa, Mycobacterium tuberculosis
EAEGTDLTNFTVTAA

SEQ ID NO: 70506 - protein, 15 aa, Mycobacterium tuberculosis
AEGTDLTNFTVTAAL

SEQ ID NO: 70507 - protein, 15 aa, Mycobacterium tuberculosis
EGTDLTNFTVTAALA

SEQ ID NO: 70508 - protein, 15 aa, Mycobacterium tuberculosis
GTDLTNFTVTAALAH

SEQ ID NO: 70509 - protein, 15 aa, Mycobacterium tuberculosis
TDLTNFTVTAALAHA

SEQ ID NO: 70510 - protein, 15 aa, Mycobacterium tuberculosis
DLTNFTVTAALAHAR

SEQ ID NO: 70511 - protein, 15 aa, Mycobacterium tuberculosis
LTNFTVTAALAHARD

SEQ ID NO: 70512 - protein, 15 aa, Mycobacterium tuberculosis
TNFTVTAALAHARDV

SEQ ID NO: 70513 - protein, 15 aa, Mycobacterium tuberculosis
NFTVTAALAHARDVL

SEQ ID NO: 70514 - protein, 15 aa, Mycobacterium tuberculosis
FTVTAALAHARDVLA

SEQ ID NO: 70515 - protein, 15 aa, Mycobacterium tuberculosis
TVTAALAHARDVLAD

SEQ ID NO: 70516 - protein, 15 aa, Mycobacterium tuberculosis
VTAALAHARDVLADR

SEQ ID NO: 70517 - protein, 15 aa, Mycobacterium tuberculosis
TAALAHARDVLADRR

SEQ ID NO: 70518 - protein, 15 aa, Mycobacterium tuberculosis
AALAHARDVLADRRL

SEQ ID NO: 70519 - protein, 15 aa, Mycobacterium tuberculosis
ALAHARDVLADRRLF

SEQ ID NO: 70520 - protein, 15 aa, Mycobacterium tuberculosis
LAHARDVLADRRLFV

SEQ ID NO: 70521 - protein, 15 aa, Mycobacterium tuberculosis
AHARDVLADRRLFVL

SEQ ID NO: 70522 - protein, 15 aa, Mycobacterium tuberculosis
HARDVLADRRLFVLT

SEQ ID NO: 70523 - protein, 15 aa, Mycobacterium tuberculosis
ARDVLADRRLFVLTD

SEQ ID NO: 70524 - protein, 15 aa, Mycobacterium tuberculosis
RDVLADRRLFVLTDA

SEQ ID NO: 70525 - protein, 15 aa, Mycobacterium tuberculosis
DVLADRRLFVLTDAA

SEQ ID NO: 70526 - protein, 15 aa, Mycobacterium tuberculosis
VLADRRLFVLTDAAW

SEQ ID NO: 70527 - protein, 15 aa, Mycobacterium tuberculosis
LADRRLFVLTDAAWT

SEQ ID NO: 70528 - protein, 15 aa, Mycobacterium tuberculosis
ADRRLFVLTDAAWTE

SEQ ID NO: 70529 - protein, 15 aa, Mycobacterium tuberculosis
DRRLFVLTDAAWTEF

SEQ ID NO: 70530 - protein, 15 aa, Mycobacterium tuberculosis
RRLFVLTDAAWTEFL

SEQ ID NO: 70531 - protein, 15 aa, Mycobacterium tuberculosis
RLFVLTDAAWTEFLA

SEQ ID NO: 70532 - protein, 15 aa, Mycobacterium tuberculosis
LFVLTDAAWTEFLAA

SEQ ID NO: 70533 - protein, 15 aa, Mycobacterium tuberculosis
FVLTDAAWTEFLAAL

SEQ ID NO: 70534 - protein, 15 aa, Mycobacterium tuberculosis
VLTDAAWTEFLAALD

SEQ ID NO: 70535 - protein, 15 aa, Mycobacterium tuberculosis
LTDAAWTEFLAALDR

SEQ ID NO: 70536 - protein, 15 aa, Mycobacterium tuberculosis
TDAAWTEFLAALDRP

SEQ ID NO: 70537 - protein, 15 aa, Mycobacterium tuberculosis
DAAWTEFLAALDRPV

SEQ ID NO: 70538 - protein, 15 aa, Mycobacterium tuberculosis
AAWTEFLAALDRPVS

SEQ ID NO: 70539 - protein, 15 aa, Mycobacterium tuberculosis
AWTEFLAALDRPVSH

SEQ ID NO: 70540 - protein, 15 aa, Mycobacterium tuberculosis
WTEFLAALDRPVSHK

SEQ ID NO: 70541 - protein, 15 aa, Mycobacterium tuberculosis
TEFLAALDRPVSHKP

SEQ ID NO: 70542 - protein, 15 aa, Mycobacterium tuberculosis
EFLAALDRPVSHKPR

SEQ ID NO: 70543 - protein, 15 aa, Mycobacterium tuberculosis
FLAALDRPVSHKPRL

SEQ ID NO: 70544 - protein, 15 aa, Mycobacterium tuberculosis
LAALDRPVSHKPRLE

SEQ ID NO: 70545 - protein, 15 aa, Mycobacterium tuberculosis
AALDRPVSHKPRLEK

SEQ ID NO: 70546 - protein, 15 aa, Mycobacterium tuberculosis
ALDRPVSHKPRLEKL

SEQ ID NO: 70547 - protein, 15 aa, Mycobacterium tuberculosis
LDRPVSHKPRLEKLF

SEQ ID NO: 70548 - protein, 15 aa, Mycobacterium tuberculosis
DRPVSHKPRLEKLFA

SEQ ID NO: 70549 - protein, 15 aa, Mycobacterium tuberculosis
RPVSHKPRLEKLFAA

SEQ ID NO: 70550 - protein, 15 aa, Mycobacterium tuberculosis
PVSHKPRLEKLFAAR

SEQ ID NO: 70551 - protein, 15 aa, Mycobacterium tuberculosis
VSHKPRLEKLFAARS

SEQ ID NO: 70552 - protein, 15 aa, Mycobacterium tuberculosis
SHKPRLEKLFAARSI

SEQ ID NO: 70553 - protein, 15 aa, Mycobacterium tuberculosis
HKPRLEKLFAARSIF

SEQ ID NO: 70554 - protein, 15 aa, Mycobacterium tuberculosis
KPRLEKLFAARSIFD

SEQ ID NO: 70555 - protein, 15 aa, Mycobacterium tuberculosis
PRLEKLFAARSIFDT

SEQ ID NO: 70556 - protein, 15 aa, Mycobacterium tuberculosis
RLEKLFAARSIFDTE

SEQ ID NO: 70557 - protein, 15 aa, Mycobacterium tuberculosis
LEKLFAARSIFDTEG

SEQ ID NO: 70558 - protein, 16 aa, Mycobacterium tuberculosis
MHRAGAAVTANVWCRA

SEQ ID NO: 70559 - protein, 16 aa, Mycobacterium tuberculosis
HRAGAAVTANVWCRAG

SEQ ID NO: 70560 - protein, 16 aa, Mycobacterium tuberculosis
RAGAAVTANVWCRAGG

SEQ ID NO: 70561 - protein, 16 aa, Mycobacterium tuberculosis
AGAAVTANVWCRAGGI

SEQ ID NO: 70562 - protein, 16 aa, Mycobacterium tuberculosis
GAAVTANVWCRAGGIR

SEQ ID NO: 70563 - protein, 16 aa, Mycobacterium tuberculosis
AAVTANVWCRAGGIRM

SEQ ID NO: 70564 - protein, 16 aa, Mycobacterium tuberculosis
AVTANVWCRAGGIRMA

SEQ ID NO: 70565 - protein, 16 aa, Mycobacterium tuberculosis
VTANVWCRAGGIRMAP

SEQ ID NO: 70566 - protein, 16 aa, Mycobacterium tuberculosis
TANVWCRAGGIRMAPR

SEQ ID NO: 70567 - protein, 16 aa, Mycobacterium tuberculosis
ANVWCRAGGIRMAPRP

SEQ ID NO: 70568 - protein, 16 aa, Mycobacterium tuberculosis
NVWCRAGGIRMAPRPV

SEQ ID NO: 70569 - protein, 16 aa, Mycobacterium tuberculosis
VWCRAGGIRMAPRPVI

SEQ ID NO: 70570 - protein, 16 aa, Mycobacterium tuberculosis
WCRAGGIRMAPRPVIP

SEQ ID NO: 70571 - protein, 16 aa, Mycobacterium tuberculosis
CRAGGIRMAPRPVIPV

SEQ ID NO: 70572 - protein, 16 aa, Mycobacterium tuberculosis
RAGGIRMAPRPVIPVA

SEQ ID NO: 70573 - protein, 16 aa, Mycobacterium tuberculosis
AGGIRMAPRPVIPVAT

SEQ ID NO: 70574 - protein, 16 aa, Mycobacterium tuberculosis
GGIRMAPRPVIPVATQ

SEQ ID NO: 70575 - protein, 16 aa, Mycobacterium tuberculosis
GIRMAPRPVIPVATQQ

SEQ ID NO: 70576 - protein, 16 aa, Mycobacterium tuberculosis
IRMAPRPVIPVATQQR

SEQ ID NO: 70577 - protein, 16 aa, Mycobacterium tuberculosis
RMAPRPVIPVATQQRL

SEQ ID NO: 70578 - protein, 16 aa, Mycobacterium tuberculosis
MAPRPVIPVATQQRLR

SEQ ID NO: 70579 - protein, 16 aa, Mycobacterium tuberculosis
APRPVIPVATQQRLRR

SEQ ID NO: 70580 - protein, 16 aa, Mycobacterium tuberculosis
PRPVIPVATQQRLRRQ

SEQ ID NO: 70581 - protein, 16 aa, Mycobacterium tuberculosis
RPVIPVATQQRLRRQA

SEQ ID NO: 70582 - protein, 16 aa, Mycobacterium tuberculosis
PVIPVATQQRLRRQAD

SEQ ID NO: 70583 - protein, 16 aa, Mycobacterium tuberculosis
VIPVATQQRLRRQADR

SEQ ID NO: 70584 - protein, 16 aa, Mycobacterium tuberculosis
IPVATQQRLRRQADRQ

SEQ ID NO: 70585 - protein, 16 aa, Mycobacterium tuberculosis
PVATQQRLRRQADRQS

SEQ ID NO: 70586 - protein, 16 aa, Mycobacterium tuberculosis
VATQQRLRRQADRQSL

SEQ ID NO: 70587 - protein, 16 aa, Mycobacterium tuberculosis
ATQQRLRRQADRQSLG

SEQ ID NO: 70588 - protein, 16 aa, Mycobacterium tuberculosis
TQQRLRRQADRQSLGS

SEQ ID NO: 70589 - protein, 16 aa, Mycobacterium tuberculosis
QQRLRRQADRQSLGSS

SEQ ID NO: 70590 - protein, 16 aa, Mycobacterium tuberculosis
QRLRRQADRQSLGSSG

SEQ ID NO: 70591 - protein, 16 aa, Mycobacterium tuberculosis
RLRRQADRQSLGSSGL

SEQ ID NO: 70592 - protein, 16 aa, Mycobacterium tuberculosis
LRRQADRQSLGSSGLP

SEQ ID NO: 70593 - protein, 16 aa, Mycobacterium tuberculosis
RRQADRQSLGSSGLPA

SEQ ID NO: 70594 - protein, 16 aa, Mycobacterium tuberculosis
RQADRQSLGSSGLPAL

SEQ ID NO: 70595 - protein, 16 aa, Mycobacterium tuberculosis
QADRQSLGSSGLPALN

SEQ ID NO: 70596 - protein, 16 aa, Mycobacterium tuberculosis
ADRQSLGSSGLPALNC

SEQ ID NO: 70597 - protein, 16 aa, Mycobacterium tuberculosis
DRQSLGSSGLPALNCT

SEQ ID NO: 70598 - protein, 16 aa, Mycobacterium tuberculosis
RQSLGSSGLPALNCTP

SEQ ID NO: 70599 - protein, 16 aa, Mycobacterium tuberculosis
QSLGSSGLPALNCTPI

SEQ ID NO: 70600 - protein, 16 aa, Mycobacterium tuberculosis
SLGSSGLPALNCTPIR

SEQ ID NO: 70601 - protein, 16 aa, Mycobacterium tuberculosis
LGSSGLPALNCTPIRH

SEQ ID NO: 70602 - protein, 16 aa, Mycobacterium tuberculosis
GSSGLPALNCTPIRHT

SEQ ID NO: 70603 - protein, 16 aa, Mycobacterium tuberculosis
SSGLPALNCTPIRHTI

SEQ ID NO: 70604 - protein, 16 aa, Mycobacterium tuberculosis
SGLPALNCTPIRHTID

SEQ ID NO: 70605 - protein, 16 aa, Mycobacterium tuberculosis
GLPALNCTPIRHTIDV

SEQ ID NO: 70606 - protein, 16 aa, Mycobacterium tuberculosis
LPALNCTPIRHTIDVM

SEQ ID NO: 70607 - protein, 16 aa, Mycobacterium tuberculosis
PALNCTPIRHTIDVMA

SEQ ID NO: 70608 - protein, 16 aa, Mycobacterium tuberculosis
ALNCTPIRHTIDVMAT

SEQ ID NO: 70609 - protein, 16 aa, Mycobacterium tuberculosis
LNCTPIRHTIDVMATK

SEQ ID NO: 70610 - protein, 16 aa, Mycobacterium tuberculosis
NCTPIRHTIDVMATKP

SEQ ID NO: 70611 - protein, 16 aa, Mycobacterium tuberculosis
CTPIRHTIDVMATKPE

SEQ ID NO: 70612 - protein, 16 aa, Mycobacterium tuberculosis
TPIRHTIDVMATKPER

SEQ ID NO: 70613 - protein, 16 aa, Mycobacterium tuberculosis
PIRHTIDVMATKPERK

SEQ ID NO: 70614 - protein, 16 aa, Mycobacterium tuberculosis
IRHTIDVMATKPERKT

SEQ ID NO: 70615 - protein, 16 aa, Mycobacterium tuberculosis
RHTIDVMATKPERKTE

SEQ ID NO: 70616 - protein, 16 aa, Mycobacterium tuberculosis
HTIDVMATKPERKTER

SEQ ID NO: 70617 - protein, 16 aa, Mycobacterium tuberculosis
TIDVMATKPERKTERL

SEQ ID NO: 70618 - protein, 16 aa, Mycobacterium tuberculosis
IDVMATKPERKTERLA

SEQ ID NO: 70619 - protein, 16 aa, Mycobacterium tuberculosis
DVMATKPERKTERLAA

SEQ ID NO: 70620 - protein, 16 aa, Mycobacterium tuberculosis
VMATKPERKTERLAAR

SEQ ID NO: 70621 - protein, 16 aa, Mycobacterium tuberculosis
MATKPERKTERLAARL

SEQ ID NO: 70622 - protein, 16 aa, Mycobacterium tuberculosis
ATKPERKTERLAARLT

SEQ ID NO: 70623 - protein, 16 aa, Mycobacterium tuberculosis
TKPERKTERLAARLTP

SEQ ID NO: 70624 - protein, 16 aa, Mycobacterium tuberculosis
KPERKTERLAARLTPE

SEQ ID NO: 70625 - protein, 16 aa, Mycobacterium tuberculosis
PERKTERLAARLTPEQ

SEQ ID NO: 70626 - protein, 16 aa, Mycobacterium tuberculosis
ERKTERLAARLTPEQD

SEQ ID NO: 70627 - protein, 16 aa, Mycobacterium tuberculosis
RKTERLAARLTPEQDA

SEQ ID NO: 70628 - protein, 16 aa, Mycobacterium tuberculosis
KTERLAARLTPEQDAL

SEQ ID NO: 70629 - protein, 16 aa, Mycobacterium tuberculosis
TERLAARLTPEQDALI

SEQ ID NO: 70630 - protein, 16 aa, Mycobacterium tuberculosis
ERLAARLTPEQDALIR

SEQ ID NO: 70631 - protein, 16 aa, Mycobacterium tuberculosis
RLAARLTPEQDALIRR

SEQ ID NO: 70632 - protein, 16 aa, Mycobacterium tuberculosis
LAARLTPEQDALIRRA

SEQ ID NO: 70633 - protein, 16 aa, Mycobacterium tuberculosis
AARLTPEQDALIRRAA

SEQ ID NO: 70634 - protein, 16 aa, Mycobacterium tuberculosis
ARLTPEQDALIRRAAE

SEQ ID NO: 70635 - protein, 16 aa, Mycobacterium tuberculosis
RLTPEQDALIRRAAEA

SEQ ID NO: 70636 - protein, 16 aa, Mycobacterium tuberculosis
LTPEQDALIRRAAEAE

SEQ ID NO: 70637 - protein, 16 aa, Mycobacterium tuberculosis
TPEQDALIRRAAEAEG

SEQ ID NO: 70638 - protein, 16 aa, Mycobacterium tuberculosis
PEQDALIRRAAEAEGT

SEQ ID NO: 70639 - protein, 16 aa, Mycobacterium tuberculosis
EQDALIRRAAEAEGTD

SEQ ID NO: 70640 - protein, 16 aa, Mycobacterium tuberculosis
QDALIRRAAEAEGTDL

SEQ ID NO: 70641 - protein, 16 aa, Mycobacterium tuberculosis
DALIRRAAEAEGTDLT

SEQ ID NO: 70642 - protein, 16 aa, Mycobacterium tuberculosis
ALIRRAAEAEGTDLTN

SEQ ID NO: 70643 - protein, 16 aa, Mycobacterium tuberculosis
LIRRAAEAEGTDLTNF

SEQ ID NO: 70644 - protein, 16 aa, Mycobacterium tuberculosis
IRRAAEAEGTDLTNFT

SEQ ID NO: 70645 - protein, 16 aa, Mycobacterium tuberculosis
RRAAEAEGTDLTNFTV

SEQ ID NO: 70646 - protein, 16 aa, Mycobacterium tuberculosis
RAAEAEGTDLTNFTVT

SEQ ID NO: 70647 - protein, 16 aa, Mycobacterium tuberculosis
AAEAEGTDLTNFTVTA

SEQ ID NO: 70648 - protein, 16 aa, Mycobacterium tuberculosis
AEAEGTDLTNFTVTAA

SEQ ID NO: 70649 - protein, 16 aa, Mycobacterium tuberculosis
EAEGTDLTNFTVTAAL

SEQ ID NO: 70650 - protein, 16 aa, Mycobacterium tuberculosis
AEGTDLTNFTVTAALA

SEQ ID NO: 70651 - protein, 16 aa, Mycobacterium tuberculosis
EGTDLTNFTVTAALAH

SEQ ID NO: 70652 - protein, 16 aa, Mycobacterium tuberculosis
GTDLTNFTVTAALAHA

SEQ ID NO: 70653 - protein, 16 aa, Mycobacterium tuberculosis
TDLTNFTVTAALAHAR

SEQ ID NO: 70654 - protein, 16 aa, Mycobacterium tuberculosis
DLTNFTVTAALAHARD

SEQ ID NO: 70655 - protein, 16 aa, Mycobacterium tuberculosis
LTNFTVTAALAHARDV

SEQ ID NO: 70656 - protein, 16 aa, Mycobacterium tuberculosis
TNFTVTAALAHARDVL

SEQ ID NO: 70657 - protein, 16 aa, Mycobacterium tuberculosis
NFTVTAALAHARDVLA

SEQ ID NO: 70658 - protein, 16 aa, Mycobacterium tuberculosis
FTVTAALAHARDVLAD

SEQ ID NO: 70659 - protein, 16 aa, Mycobacterium tuberculosis
TVTAALAHARDVLADR

SEQ ID NO: 70660 - protein, 16 aa, Mycobacterium tuberculosis
VTAALAHARDVLADRR

SEQ ID NO: 70661 - protein, 16 aa, Mycobacterium tuberculosis
TAALAHARDVLADRRL

SEQ ID NO: 70662 - protein, 16 aa, Mycobacterium tuberculosis
AALAHARDVLADRRLF

SEQ ID NO: 70663 - protein, 16 aa, Mycobacterium tuberculosis
ALAHARDVLADRRLFV

SEQ ID NO: 70664 - protein, 16 aa, Mycobacterium tuberculosis
LAHARDVLADRRLFVL

SEQ ID NO: 70665 - protein, 16 aa, Mycobacterium tuberculosis
AHARDVLADRRLFVLT

SEQ ID NO: 70666 - protein, 16 aa, Mycobacterium tuberculosis
HARDVLADRRLFVLTD

SEQ ID NO: 70667 - protein, 16 aa, Mycobacterium tuberculosis
ARDVLADRRLFVLTDA

SEQ ID NO: 70668 - protein, 16 aa, Mycobacterium tuberculosis
RDVLADRRLFVLTDAA

SEQ ID NO: 70669 - protein, 16 aa, Mycobacterium tuberculosis
DVLADRRLFVLTDAAW

SEQ ID NO: 70670 - protein, 16 aa, Mycobacterium tuberculosis
VLADRRLFVLTDAAWT

SEQ ID NO: 70671 - protein, 16 aa, Mycobacterium tuberculosis
LADRRLFVLTDAAWTE

SEQ ID NO: 70672 - protein, 16 aa, Mycobacterium tuberculosis
ADRRLFVLTDAAWTEF

SEQ ID NO: 70673 - protein, 16 aa, Mycobacterium tuberculosis
DRRLFVLTDAAWTEFL

SEQ ID NO: 70674 - protein, 16 aa, Mycobacterium tuberculosis
RRLFVLTDAAWTEFLA

SEQ ID NO: 70675 - protein, 16 aa, Mycobacterium tuberculosis
RLFVLTDAAWTEFLAA

SEQ ID NO: 70676 - protein, 16 aa, Mycobacterium tuberculosis
LFVLTDAAWTEFLAAL

SEQ ID NO: 70677 - protein, 16 aa, Mycobacterium tuberculosis
FVLTDAAWTEFLAALD

SEQ ID NO: 70678 - protein, 16 aa, Mycobacterium tuberculosis
VLTDAAWTEFLAALDR

SEQ ID NO: 70679 - protein, 16 aa, Mycobacterium tuberculosis
LTDAAWTEFLAALDRP

SEQ ID NO: 70680 - protein, 16 aa, Mycobacterium tuberculosis
TDAAWTEFLAALDRPV

SEQ ID NO: 70681 - protein, 16 aa, Mycobacterium tuberculosis
DAAWTEFLAALDRPVS

SEQ ID NO: 70682 - protein, 16 aa, Mycobacterium tuberculosis
AAWTEFLAALDRPVSH

SEQ ID NO: 70683 - protein, 16 aa, Mycobacterium tuberculosis
AWTEFLAALDRPVSHK

SEQ ID NO: 70684 - protein, 16 aa, Mycobacterium tuberculosis
WTEFLAALDRPVSHKP

SEQ ID NO: 70685 - protein, 16 aa, Mycobacterium tuberculosis
TEFLAALDRPVSHKPR

SEQ ID NO: 70686 - protein, 16 aa, Mycobacterium tuberculosis
EFLAALDRPVSHKPRL

SEQ ID NO: 70687 - protein, 16 aa, Mycobacterium tuberculosis
FLAALDRPVSHKPRLE

SEQ ID NO: 70688 - protein, 16 aa, Mycobacterium tuberculosis
LAALDRPVSHKPRLEK

SEQ ID NO: 70689 - protein, 16 aa, Mycobacterium tuberculosis
AALDRPVSHKPRLEKL

SEQ ID NO: 70690 - protein, 16 aa, Mycobacterium tuberculosis
ALDRPVSHKPRLEKLF

SEQ ID NO: 70691 - protein, 16 aa, Mycobacterium tuberculosis
LDRPVSHKPRLEKLFA

SEQ ID NO: 70692 - protein, 16 aa, Mycobacterium tuberculosis
DRPVSHKPRLEKLFAA

SEQ ID NO: 70693 - protein, 16 aa, Mycobacterium tuberculosis
RPVSHKPRLEKLFAAR

SEQ ID NO: 70694 - protein, 16 aa, Mycobacterium tuberculosis
PVSHKPRLEKLFAARS

SEQ ID NO: 70695 - protein, 16 aa, Mycobacterium tuberculosis
VSHKPRLEKLFAARSI

SEQ ID NO: 70696 - protein, 16 aa, Mycobacterium tuberculosis
SHKPRLEKLFAARSIF

SEQ ID NO: 70697 - protein, 16 aa, Mycobacterium tuberculosis
HKPRLEKLFAARSIFD

SEQ ID NO: 70698 - protein, 16 aa, Mycobacterium tuberculosis
KPRLEKLFAARSIFDT

SEQ ID NO: 70699 - protein, 16 aa, Mycobacterium tuberculosis
PRLEKLFAARSIFDTE

SEQ ID NO: 70700 - protein, 16 aa, Mycobacterium tuberculosis
RLEKLFAARSIFDTEG

SEQ ID NO: 70701 - protein, 13 aa, Mycobacterium tuberculosis
MFRTVGDQASLWE

SEQ ID NO: 70702 - protein, 13 aa, Mycobacterium tuberculosis
FRTVGDQASLWES

SEQ ID NO: 70703 - protein, 13 aa, Mycobacterium tuberculosis
RTVGDQASLWESV

SEQ ID NO: 70704 - protein, 13 aa, Mycobacterium tuberculosis
TVGDQASLWESVL

SEQ ID NO: 70705 - protein, 13 aa, Mycobacterium tuberculosis
VGDQASLWESVLP

SEQ ID NO: 70706 - protein, 13 aa, Mycobacterium tuberculosis
GDQASLWESVLPE

SEQ ID NO: 70707 - protein, 13 aa, Mycobacterium tuberculosis
DQASLWESVLPEE

SEQ ID NO: 70708 - protein, 13 aa, Mycobacterium tuberculosis
QASLWESVLPEEL

SEQ ID NO: 70709 - protein, 13 aa, Mycobacterium tuberculosis
ASLWESVLPEELR

SEQ ID NO: 70710 - protein, 13 aa, Mycobacterium tuberculosis
SLWESVLPEELRR

SEQ ID NO: 70711 - protein, 13 aa, Mycobacterium tuberculosis
LWESVLPEELRRL

SEQ ID NO: 70712 - protein, 13 aa, Mycobacterium tuberculosis
WESVLPEELRRLP

SEQ ID NO: 70713 - protein, 13 aa, Mycobacterium tuberculosis
ESVLPEELRRLPE

SEQ ID NO: 70714 - protein, 13 aa, Mycobacterium tuberculosis
SVLPEELRRLPEE

SEQ ID NO: 70715 - protein, 13 aa, Mycobacterium tuberculosis
VLPEELRRLPEEL

SEQ ID NO: 70716 - protein, 13 aa, Mycobacterium tuberculosis
LPEELRRLPEELA

SEQ ID NO: 70717 - protein, 13 aa, Mycobacterium tuberculosis
PEELRRLPEELAR

SEQ ID NO: 70718 - protein, 13 aa, Mycobacterium tuberculosis
EELRRLPEELARV

SEQ ID NO: 70719 - protein, 13 aa, Mycobacterium tuberculosis
ELRRLPEELARVD

SEQ ID NO: 70720 - protein, 13 aa, Mycobacterium tuberculosis
LRRLPEELARVDA

SEQ ID NO: 70721 - protein, 13 aa, Mycobacterium tuberculosis
RRLPEELARVDAL

SEQ ID NO: 70722 - protein, 13 aa, Mycobacterium tuberculosis
RLPEELARVDALL

SEQ ID NO: 70723 - protein, 13 aa, Mycobacterium tuberculosis
LPEELARVDALLD

SEQ ID NO: 70724 - protein, 13 aa, Mycobacterium tuberculosis
PEELARVDALLDD

SEQ ID NO: 70725 - protein, 13 aa, Mycobacterium tuberculosis
EELARVDALLDDS

SEQ ID NO: 70726 - protein, 13 aa, Mycobacterium tuberculosis
ELARVDALLDDSA

SEQ ID NO: 70727 - protein, 13 aa, Mycobacterium tuberculosis
LARVDALLDDSAF

SEQ ID NO: 70728 - protein, 13 aa, Mycobacterium tuberculosis
ARVDALLDDSAFF

SEQ ID NO: 70729 - protein, 13 aa, Mycobacterium tuberculosis
RVDALLDDSAFFC

SEQ ID NO: 70730 - protein, 13 aa, Mycobacterium tuberculosis
VDALLDDSAFFCP

SEQ ID NO: 70731 - protein, 13 aa, Mycobacterium tuberculosis
DALLDDSAFFCPF

SEQ ID NO: 70732 - protein, 13 aa, Mycobacterium tuberculosis
ALLDDSAFFCPFV

SEQ ID NO: 70733 - protein, 13 aa, Mycobacterium tuberculosis
LLDDSAFFCPFVP

SEQ ID NO: 70734 - protein, 13 aa, Mycobacterium tuberculosis
LDDSAFFCPFVPF

SEQ ID NO: 70735 - protein, 13 aa, Mycobacterium tuberculosis
DDSAFFCPFVPFF

SEQ ID NO: 70736 - protein, 13 aa, Mycobacterium tuberculosis
DSAFFCPFVPFFD

SEQ ID NO: 70737 - protein, 13 aa, Mycobacterium tuberculosis
SAFFCPFVPFFDP

SEQ ID NO: 70738 - protein, 13 aa, Mycobacterium tuberculosis
AFFCPFVPFFDPR

SEQ ID NO: 70739 - protein, 13 aa, Mycobacterium tuberculosis
FFCPFVPFFDPRM

SEQ ID NO: 70740 - protein, 13 aa, Mycobacterium tuberculosis
FCPFVPFFDPRMG

SEQ ID NO: 70741 - protein, 13 aa, Mycobacterium tuberculosis
CPFVPFFDPRMGR

SEQ ID NO: 70742 - protein, 13 aa, Mycobacterium tuberculosis
PFVPFFDPRMGRP

SEQ ID NO: 70743 - protein, 13 aa, Mycobacterium tuberculosis
FVPFFDPRMGRPS

SEQ ID NO: 70744 - protein, 13 aa, Mycobacterium tuberculosis
VPFFDPRMGRPSI

SEQ ID NO: 70745 - protein, 13 aa, Mycobacterium tuberculosis
PFFDPRMGRPSIP

SEQ ID NO: 70746 - protein, 13 aa, Mycobacterium tuberculosis
FFDPRMGRPSIPM

SEQ ID NO: 70747 - protein, 13 aa, Mycobacterium tuberculosis
FDPRMGRPSIPME

SEQ ID NO: 70748 - protein, 13 aa, Mycobacterium tuberculosis
DPRMGRPSIPMET

SEQ ID NO: 70749 - protein, 13 aa, Mycobacterium tuberculosis
PRMGRPSIPMETY

SEQ ID NO: 70750 - protein, 13 aa, Mycobacterium tuberculosis
RMGRPSIPMETYL

SEQ ID NO: 70751 - protein, 13 aa, Mycobacterium tuberculosis
MGRPSIPMETYLR

SEQ ID NO: 70752 - protein, 13 aa, Mycobacterium tuberculosis
GRPSIPMETYLRL

SEQ ID NO: 70753 - protein, 13 aa, Mycobacterium tuberculosis
RPSIPMETYLRLM

SEQ ID NO: 70754 - protein, 13 aa, Mycobacterium tuberculosis
PSIPMETYLRLMF

SEQ ID NO: 70755 - protein, 13 aa, Mycobacterium tuberculosis
SIPMETYLRLMFL

SEQ ID NO: 70756 - protein, 13 aa, Mycobacterium tuberculosis
IPMETYLRLMFLK

SEQ ID NO: 70757 - protein, 13 aa, Mycobacterium tuberculosis
PMETYLRLMFLKF

SEQ ID NO: 70758 - protein, 13 aa, Mycobacterium tuberculosis
METYLRLMFLKFR

SEQ ID NO: 70759 - protein, 13 aa, Mycobacterium tuberculosis
ETYLRLMFLKFRY

SEQ ID NO: 70760 - protein, 13 aa, Mycobacterium tuberculosis
TYLRLMFLKFRYR

SEQ ID NO: 70761 - protein, 13 aa, Mycobacterium tuberculosis
YLRLMFLKFRYRL

SEQ ID NO: 70762 - protein, 13 aa, Mycobacterium tuberculosis
LRLMFLKFRYRLG

SEQ ID NO: 70763 - protein, 13 aa, Mycobacterium tuberculosis
RLMFLKFRYRLGY

SEQ ID NO: 70764 - protein, 13 aa, Mycobacterium tuberculosis
LMFLKFRYRLGYE

SEQ ID NO: 70765 - protein, 13 aa, Mycobacterium tuberculosis
MFLKFRYRLGYES

SEQ ID NO: 70766 - protein, 13 aa, Mycobacterium tuberculosis
FLKFRYRLGYESL

SEQ ID NO: 70767 - protein, 13 aa, Mycobacterium tuberculosis
LKFRYRLGYESLC

SEQ ID NO: 70768 - protein, 13 aa, Mycobacterium tuberculosis
KFRYRLGYESLCR

SEQ ID NO: 70769 - protein, 13 aa, Mycobacterium tuberculosis
FRYRLGYESLCRE

SEQ ID NO: 70770 - protein, 13 aa, Mycobacterium tuberculosis
RYRLGYESLCREV

SEQ ID NO: 70771 - protein, 13 aa, Mycobacterium tuberculosis
YRLGYESLCREVT

SEQ ID NO: 70772 - protein, 13 aa, Mycobacterium tuberculosis
RLGYESLCREVTD

SEQ ID NO: 70773 - protein, 13 aa, Mycobacterium tuberculosis
LGYESLCREVTDS

SEQ ID NO: 70774 - protein, 13 aa, Mycobacterium tuberculosis
GYESLCREVTDSI

SEQ ID NO: 70775 - protein, 13 aa, Mycobacterium tuberculosis
YESLCREVTDSIT

SEQ ID NO: 70776 - protein, 13 aa, Mycobacterium tuberculosis
ESLCREVTDSITW

SEQ ID NO: 70777 - protein, 13 aa, Mycobacterium tuberculosis
SLCREVTDSITWR

SEQ ID NO: 70778 - protein, 13 aa, Mycobacterium tuberculosis
LCREVTDSITWRR

SEQ ID NO: 70779 - protein, 13 aa, Mycobacterium tuberculosis
CREVTDSITWRRF

SEQ ID NO: 70780 - protein, 13 aa, Mycobacterium tuberculosis
REVTDSITWRRFC

SEQ ID NO: 70781 - protein, 13 aa, Mycobacterium tuberculosis
EVTDSITWRRFCR

SEQ ID NO: 70782 - protein, 13 aa, Mycobacterium tuberculosis
VTDSITWRRFCRI

SEQ ID NO: 70783 - protein, 13 aa, Mycobacterium tuberculosis
TDSITWRRFCRIP

SEQ ID NO: 70784 - protein, 13 aa, Mycobacterium tuberculosis
DSITWRRFCRIPL

SEQ ID NO: 70785 - protein, 13 aa, Mycobacterium tuberculosis
SITWRRFCRIPLE

SEQ ID NO: 70786 - protein, 13 aa, Mycobacterium tuberculosis
ITWRRFCRIPLEG

SEQ ID NO: 70787 - protein, 13 aa, Mycobacterium tuberculosis
TWRRFCRIPLEGS

SEQ ID NO: 70788 - protein, 13 aa, Mycobacterium tuberculosis
WRRFCRIPLEGSV

SEQ ID NO: 70789 - protein, 13 aa, Mycobacterium tuberculosis
RRFCRIPLEGSVP

SEQ ID NO: 70790 - protein, 13 aa, Mycobacterium tuberculosis
RFCRIPLEGSVPH

SEQ ID NO: 70791 - protein, 13 aa, Mycobacterium tuberculosis
FCRIPLEGSVPHP

SEQ ID NO: 70792 - protein, 13 aa, Mycobacterium tuberculosis
CRIPLEGSVPHPT

SEQ ID NO: 70793 - protein, 13 aa, Mycobacterium tuberculosis
RIPLEGSVPHPTT

SEQ ID NO: 70794 - protein, 13 aa, Mycobacterium tuberculosis
IPLEGSVPHPTTL

SEQ ID NO: 70795 - protein, 13 aa, Mycobacterium tuberculosis
PLEGSVPHPTTLM

SEQ ID NO: 70796 - protein, 13 aa, Mycobacterium tuberculosis
LEGSVPHPTTLMK

SEQ ID NO: 70797 - protein, 13 aa, Mycobacterium tuberculosis
EGSVPHPTTLMKL

SEQ ID NO: 70798 - protein, 13 aa, Mycobacterium tuberculosis
GSVPHPTTLMKLT

SEQ ID NO: 70799 - protein, 13 aa, Mycobacterium tuberculosis
SVPHPTTLMKLTT

SEQ ID NO: 70800 - protein, 13 aa, Mycobacterium tuberculosis
VPHPTTLMKLTTR

SEQ ID NO: 70801 - protein, 13 aa, Mycobacterium tuberculosis
PHPTTLMKLTTRC

SEQ ID NO: 70802 - protein, 13 aa, Mycobacterium tuberculosis
HPTTLMKLTTRCG

SEQ ID NO: 70803 - protein, 13 aa, Mycobacterium tuberculosis
PTTLMKLTTRCGE

SEQ ID NO: 70804 - protein, 13 aa, Mycobacterium tuberculosis
TTLMKLTTRCGED

SEQ ID NO: 70805 - protein, 13 aa, Mycobacterium tuberculosis
TLMKLTTRCGEDA

SEQ ID NO: 70806 - protein, 13 aa, Mycobacterium tuberculosis
LMKLTTRCGEDAV

SEQ ID NO: 70807 - protein, 13 aa, Mycobacterium tuberculosis
MKLTTRCGEDAVA

SEQ ID NO: 70808 - protein, 13 aa, Mycobacterium tuberculosis
KLTTRCGEDAVAG

SEQ ID NO: 70809 - protein, 13 aa, Mycobacterium tuberculosis
LTTRCGEDAVAGL

SEQ ID NO: 70810 - protein, 13 aa, Mycobacterium tuberculosis
TTRCGEDAVAGLN

SEQ ID NO: 70811 - protein, 13 aa, Mycobacterium tuberculosis
TRCGEDAVAGLNE

SEQ ID NO: 70812 - protein, 13 aa, Mycobacterium tuberculosis
RCGEDAVAGLNEA

SEQ ID NO: 70813 - protein, 13 aa, Mycobacterium tuberculosis
CGEDAVAGLNEAL

SEQ ID NO: 70814 - protein, 13 aa, Mycobacterium tuberculosis
GEDAVAGLNEALL

SEQ ID NO: 70815 - protein, 13 aa, Mycobacterium tuberculosis
EDAVAGLNEALLA

SEQ ID NO: 70816 - protein, 13 aa, Mycobacterium tuberculosis
DAVAGLNEALLAK

SEQ ID NO: 70817 - protein, 13 aa, Mycobacterium tuberculosis
AVAGLNEALLAKA

SEQ ID NO: 70818 - protein, 13 aa, Mycobacterium tuberculosis
VAGLNEALLAKAA

SEQ ID NO: 70819 - protein, 13 aa, Mycobacterium tuberculosis
AGLNEALLAKAAS

SEQ ID NO: 70820 - protein, 13 aa, Mycobacterium tuberculosis
GLNEALLAKAASE

SEQ ID NO: 70821 - protein, 13 aa, Mycobacterium tuberculosis
LNEALLAKAASEK

SEQ ID NO: 70822 - protein, 13 aa, Mycobacterium tuberculosis
NEALLAKAASEKL

SEQ ID NO: 70823 - protein, 13 aa, Mycobacterium tuberculosis
EALLAKAASEKLL

SEQ ID NO: 70824 - protein, 13 aa, Mycobacterium tuberculosis
ALLAKAASEKLLR

SEQ ID NO: 70825 - protein, 13 aa, Mycobacterium tuberculosis
LLAKAASEKLLRT

SEQ ID NO: 70826 - protein, 13 aa, Mycobacterium tuberculosis
LAKAASEKLLRTN

SEQ ID NO: 70827 - protein, 13 aa, Mycobacterium tuberculosis
AKAASEKLLRTNK

SEQ ID NO: 70828 - protein, 13 aa, Mycobacterium tuberculosis
KAASEKLLRTNKV

SEQ ID NO: 70829 - protein, 13 aa, Mycobacterium tuberculosis
AASEKLLRTNKVR

SEQ ID NO: 70830 - protein, 13 aa, Mycobacterium tuberculosis
ASEKLLRTNKVRA

SEQ ID NO: 70831 - protein, 13 aa, Mycobacterium tuberculosis
SEKLLRTNKVRAD

SEQ ID NO: 70832 - protein, 13 aa, Mycobacterium tuberculosis
EKLLRTNKVRADT

SEQ ID NO: 70833 - protein, 13 aa, Mycobacterium tuberculosis
KLLRTNKVRADTT

SEQ ID NO: 70834 - protein, 13 aa, Mycobacterium tuberculosis
LLRTNKVRADTTV

SEQ ID NO: 70835 - protein, 13 aa, Mycobacterium tuberculosis
LRTNKVRADTTVV

SEQ ID NO: 70836 - protein, 13 aa, Mycobacterium tuberculosis
RTNKVRADTTVVE

SEQ ID NO: 70837 - protein, 13 aa, Mycobacterium tuberculosis
TNKVRADTTVVEG

SEQ ID NO: 70838 - protein, 13 aa, Mycobacterium tuberculosis
NKVRADTTVVEGD

SEQ ID NO: 70839 - protein, 13 aa, Mycobacterium tuberculosis
KVRADTTVVEGDV

SEQ ID NO: 70840 - protein, 13 aa, Mycobacterium tuberculosis
VRADTTVVEGDVG

SEQ ID NO: 70841 - protein, 13 aa, Mycobacterium tuberculosis
RADTTVVEGDVGY

SEQ ID NO: 70842 - protein, 13 aa, Mycobacterium tuberculosis
ADTTVVEGDVGYP

SEQ ID NO: 70843 - protein, 13 aa, Mycobacterium tuberculosis
DTTVVEGDVGYPT

SEQ ID NO: 70844 - protein, 13 aa, Mycobacterium tuberculosis
TTVVEGDVGYPTD

SEQ ID NO: 70845 - protein, 13 aa, Mycobacterium tuberculosis
TVVEGDVGYPTDT

SEQ ID NO: 70846 - protein, 13 aa, Mycobacterium tuberculosis
VVEGDVGYPTDTG

SEQ ID NO: 70847 - protein, 13 aa, Mycobacterium tuberculosis
VEGDVGYPTDTGL

SEQ ID NO: 70848 - protein, 13 aa, Mycobacterium tuberculosis
EGDVGYPTDTGLL

SEQ ID NO: 70849 - protein, 13 aa, Mycobacterium tuberculosis
GDVGYPTDTGLLA

SEQ ID NO: 70850 - protein, 13 aa, Mycobacterium tuberculosis
DVGYPTDTGLLAK

SEQ ID NO: 70851 - protein, 13 aa, Mycobacterium tuberculosis
VGYPTDTGLLAKA

SEQ ID NO: 70852 - protein, 13 aa, Mycobacterium tuberculosis
GYPTDTGLLAKAV

SEQ ID NO: 70853 - protein, 13 aa, Mycobacterium tuberculosis
YPTDTGLLAKAVG

SEQ ID NO: 70854 - protein, 13 aa, Mycobacterium tuberculosis
PTDTGLLAKAVGS

SEQ ID NO: 70855 - protein, 13 aa, Mycobacterium tuberculosis
TDTGLLAKAVGSM

SEQ ID NO: 70856 - protein, 13 aa, Mycobacterium tuberculosis
DTGLLAKAVGSMA

SEQ ID NO: 70857 - protein, 13 aa, Mycobacterium tuberculosis
TGLLAKAVGSMAR

SEQ ID NO: 70858 - protein, 13 aa, Mycobacterium tuberculosis
GLLAKAVGSMART

SEQ ID NO: 70859 - protein, 13 aa, Mycobacterium tuberculosis
LLAKAVGSMARTV

SEQ ID NO: 70860 - protein, 13 aa, Mycobacterium tuberculosis
LAKAVGSMARTVA

SEQ ID NO: 70861 - protein, 13 aa, Mycobacterium tuberculosis
AKAVGSMARTVAR

SEQ ID NO: 70862 - protein, 13 aa, Mycobacterium tuberculosis
KAVGSMARTVARI

SEQ ID NO: 70863 - protein, 13 aa, Mycobacterium tuberculosis
AVGSMARTVARIK

SEQ ID NO: 70864 - protein, 13 aa, Mycobacterium tuberculosis
VGSMARTVARIKA

SEQ ID NO: 70865 - protein, 13 aa, Mycobacterium tuberculosis
GSMARTVARIKAA

SEQ ID NO: 70866 - protein, 13 aa, Mycobacterium tuberculosis
SMARTVARIKAAD

SEQ ID NO: 70867 - protein, 13 aa, Mycobacterium tuberculosis
MARTVARIKAADA

SEQ ID NO: 70868 - protein, 13 aa, Mycobacterium tuberculosis
ARTVARIKAADAG

SEQ ID NO: 70869 - protein, 13 aa, Mycobacterium tuberculosis
RTVARIKAADAGS

SEQ ID NO: 70870 - protein, 13 aa, Mycobacterium tuberculosis
TVARIKAADAGSA

SEQ ID NO: 70871 - protein, 13 aa, Mycobacterium tuberculosis
VARIKAADAGSAP

SEQ ID NO: 70872 - protein, 13 aa, Mycobacterium tuberculosis
ARIKAADAGSAPL

SEQ ID NO: 70873 - protein, 13 aa, Mycobacterium tuberculosis
RIKAADAGSAPLG

SEQ ID NO: 70874 - protein, 13 aa, Mycobacterium tuberculosis
IKAADAGSAPLGG

SEQ ID NO: 70875 - protein, 13 aa, Mycobacterium tuberculosis
KAADAGSAPLGGS

SEQ ID NO: 70876 - protein, 13 aa, Mycobacterium tuberculosis
AADAGSAPLGGSS

SEQ ID NO: 70877 - protein, 13 aa, Mycobacterium tuberculosis
ADAGSAPLGGSSG

SEQ ID NO: 70878 - protein, 13 aa, Mycobacterium tuberculosis
DAGSAPLGGSSGP

SEQ ID NO: 70879 - protein, 13 aa, Mycobacterium tuberculosis
AGSAPLGGSSGPR

SEQ ID NO: 70880 - protein, 13 aa, Mycobacterium tuberculosis
GSAPLGGSSGPRD

SEQ ID NO: 70881 - protein, 13 aa, Mycobacterium tuberculosis
SAPLGGSSGPRDR

SEQ ID NO: 70882 - protein, 13 aa, Mycobacterium tuberculosis
APLGGSSGPRDRL

SEQ ID NO: 70883 - protein, 13 aa, Mycobacterium tuberculosis
PLGGSSGPRDRLQ

SEQ ID NO: 70884 - protein, 13 aa, Mycobacterium tuberculosis
LGGSSGPRDRLQA

SEQ ID NO: 70885 - protein, 13 aa, Mycobacterium tuberculosis
GGSSGPRDRLQAA

SEQ ID NO: 70886 - protein, 13 aa, Mycobacterium tuberculosis
GSSGPRDRLQAAV

SEQ ID NO: 70887 - protein, 13 aa, Mycobacterium tuberculosis
SSGPRDRLQAAVT

SEQ ID NO: 70888 - protein, 13 aa, Mycobacterium tuberculosis
SGPRDRLQAAVTR

SEQ ID NO: 70889 - protein, 13 aa, Mycobacterium tuberculosis
GPRDRLQAAVTRR

SEQ ID NO: 70890 - protein, 13 aa, Mycobacterium tuberculosis
PRDRLQAAVTRRA

SEQ ID NO: 70891 - protein, 13 aa, Mycobacterium tuberculosis
RDRLQAAVTRRAA

SEQ ID NO: 70892 - protein, 13 aa, Mycobacterium tuberculosis
DRLQAAVTRRAAT

SEQ ID NO: 70893 - protein, 13 aa, Mycobacterium tuberculosis
RLQAAVTRRAATR

SEQ ID NO: 70894 - protein, 13 aa, Mycobacterium tuberculosis
LQAAVTRRAATRS

SEQ ID NO: 70895 - protein, 13 aa, Mycobacterium tuberculosis
QAAVTRRAATRSG

SEQ ID NO: 70896 - protein, 13 aa, Mycobacterium tuberculosis
AAVTRRAATRSGA

SEQ ID NO: 70897 - protein, 13 aa, Mycobacterium tuberculosis
AVTRRAATRSGAG

SEQ ID NO: 70898 - protein, 13 aa, Mycobacterium tuberculosis
VTRRAATRSGAGL

SEQ ID NO: 70899 - protein, 13 aa, Mycobacterium tuberculosis
TRRAATRSGAGLR

SEQ ID NO: 70900 - protein, 13 aa, Mycobacterium tuberculosis
RRAATRSGAGLRA

SEQ ID NO: 70901 - protein, 13 aa, Mycobacterium tuberculosis
RAATRSGAGLRAP

SEQ ID NO: 70902 - protein, 13 aa, Mycobacterium tuberculosis
AATRSGAGLRAPD

SEQ ID NO: 70903 - protein, 13 aa, Mycobacterium tuberculosis
ATRSGAGLRAPDH

SEQ ID NO: 70904 - protein, 13 aa, Mycobacterium tuberculosis
TRSGAGLRAPDHR

SEQ ID NO: 70905 - protein, 13 aa, Mycobacterium tuberculosis
RSGAGLRAPDHRG

SEQ ID NO: 70906 - protein, 13 aa, Mycobacterium tuberculosis
SGAGLRAPDHRGA

SEQ ID NO: 70907 - protein, 13 aa, Mycobacterium tuberculosis
GAGLRAPDHRGAS

SEQ ID NO: 70908 - protein, 13 aa, Mycobacterium tuberculosis
AGLRAPDHRGASR

SEQ ID NO: 70909 - protein, 13 aa, Mycobacterium tuberculosis
GLRAPDHRGASRD

SEQ ID NO: 70910 - protein, 13 aa, Mycobacterium tuberculosis
LRAPDHRGASRDR

SEQ ID NO: 70911 - protein, 13 aa, Mycobacterium tuberculosis
RAPDHRGASRDRR

SEQ ID NO: 70912 - protein, 13 aa, Mycobacterium tuberculosis
APDHRGASRDRRA

SEQ ID NO: 70913 - protein, 13 aa, Mycobacterium tuberculosis
PDHRGASRDRRAG

SEQ ID NO: 70914 - protein, 13 aa, Mycobacterium tuberculosis
DHRGASRDRRAGA

SEQ ID NO: 70915 - protein, 13 aa, Mycobacterium tuberculosis
HRGASRDRRAGAD

SEQ ID NO: 70916 - protein, 13 aa, Mycobacterium tuberculosis
RGASRDRRAGADR

SEQ ID NO: 70917 - protein, 13 aa, Mycobacterium tuberculosis
GASRDRRAGADRG

SEQ ID NO: 70918 - protein, 13 aa, Mycobacterium tuberculosis
ASRDRRAGADRGC

SEQ ID NO: 70919 - protein, 13 aa, Mycobacterium tuberculosis
SRDRRAGADRGCR

SEQ ID NO: 70920 - protein, 13 aa, Mycobacterium tuberculosis
RDRRAGADRGCRG

SEQ ID NO: 70921 - protein, 13 aa, Mycobacterium tuberculosis
DRRAGADRGCRGG

SEQ ID NO: 70922 - protein, 13 aa, Mycobacterium tuberculosis
RRAGADRGCRGGT

SEQ ID NO: 70923 - protein, 14 aa, Mycobacterium tuberculosis
MFRTVGDQASLWES

SEQ ID NO: 70924 - protein, 14 aa, Mycobacterium tuberculosis
FRTVGDQASLWESV

SEQ ID NO: 70925 - protein, 14 aa, Mycobacterium tuberculosis
RTVGDQASLWESVL

SEQ ID NO: 70926 - protein, 14 aa, Mycobacterium tuberculosis
TVGDQASLWESVLP

SEQ ID NO: 70927 - protein, 14 aa, Mycobacterium tuberculosis
VGDQASLWESVLPE

SEQ ID NO: 70928 - protein, 14 aa, Mycobacterium tuberculosis
GDQASLWESVLPEE

SEQ ID NO: 70929 - protein, 14 aa, Mycobacterium tuberculosis
DQASLWESVLPEEL

SEQ ID NO: 70930 - protein, 14 aa, Mycobacterium tuberculosis
QASLWESVLPEELR

SEQ ID NO: 70931 - protein, 14 aa, Mycobacterium tuberculosis
ASLWESVLPEELRR

SEQ ID NO: 70932 - protein, 14 aa, Mycobacterium tuberculosis
SLWESVLPEELRRL

SEQ ID NO: 70933 - protein, 14 aa, Mycobacterium tuberculosis
LWESVLPEELRRLP

SEQ ID NO: 70934 - protein, 14 aa, Mycobacterium tuberculosis
WESVLPEELRRLPE

SEQ ID NO: 70935 - protein, 14 aa, Mycobacterium tuberculosis
ESVLPEELRRLPEE

SEQ ID NO: 70936 - protein, 14 aa, Mycobacterium tuberculosis
SVLPEELRRLPEEL

SEQ ID NO: 70937 - protein, 14 aa, Mycobacterium tuberculosis
VLPEELRRLPEELA

SEQ ID NO: 70938 - protein, 14 aa, Mycobacterium tuberculosis
LPEELRRLPEELAR

SEQ ID NO: 70939 - protein, 14 aa, Mycobacterium tuberculosis
PEELRRLPEELARV

SEQ ID NO: 70940 - protein, 14 aa, Mycobacterium tuberculosis
EELRRLPEELARVD

SEQ ID NO: 70941 - protein, 14 aa, Mycobacterium tuberculosis
ELRRLPEELARVDA

SEQ ID NO: 70942 - protein, 14 aa, Mycobacterium tuberculosis
LRRLPEELARVDAL

SEQ ID NO: 70943 - protein, 14 aa, Mycobacterium tuberculosis
RRLPEELARVDALL

SEQ ID NO: 70944 - protein, 14 aa, Mycobacterium tuberculosis
RLPEELARVDALLD

SEQ ID NO: 70945 - protein, 14 aa, Mycobacterium tuberculosis
LPEELARVDALLDD

SEQ ID NO: 70946 - protein, 14 aa, Mycobacterium tuberculosis
PEELARVDALLDDS

SEQ ID NO: 70947 - protein, 14 aa, Mycobacterium tuberculosis
EELARVDALLDDSA

SEQ ID NO: 70948 - protein, 14 aa, Mycobacterium tuberculosis
ELARVDALLDDSAF

SEQ ID NO: 70949 - protein, 14 aa, Mycobacterium tuberculosis
LARVDALLDDSAFF

SEQ ID NO: 70950 - protein, 14 aa, Mycobacterium tuberculosis
ARVDALLDDSAFFC

SEQ ID NO: 70951 - protein, 14 aa, Mycobacterium tuberculosis
RVDALLDDSAFFCP

SEQ ID NO: 70952 - protein, 14 aa, Mycobacterium tuberculosis
VDALLDDSAFFCPF

SEQ ID NO: 70953 - protein, 14 aa, Mycobacterium tuberculosis
DALLDDSAFFCPFV

SEQ ID NO: 70954 - protein, 14 aa, Mycobacterium tuberculosis
ALLDDSAFFCPFVP

SEQ ID NO: 70955 - protein, 14 aa, Mycobacterium tuberculosis
LLDDSAFFCPFVPF

SEQ ID NO: 70956 - protein, 14 aa, Mycobacterium tuberculosis
LDDSAFFCPFVPFF

SEQ ID NO: 70957 - protein, 14 aa, Mycobacterium tuberculosis
DDSAFFCPFVPFFD

SEQ ID NO: 70958 - protein, 14 aa, Mycobacterium tuberculosis
DSAFFCPFVPFFDP

SEQ ID NO: 70959 - protein, 14 aa, Mycobacterium tuberculosis
SAFFCPFVPFFDPR

SEQ ID NO: 70960 - protein, 14 aa, Mycobacterium tuberculosis
AFFCPFVPFFDPRM

SEQ ID NO: 70961 - protein, 14 aa, Mycobacterium tuberculosis
FFCPFVPFFDPRMG

SEQ ID NO: 70962 - protein, 14 aa, Mycobacterium tuberculosis
FCPFVPFFDPRMGR

SEQ ID NO: 70963 - protein, 14 aa, Mycobacterium tuberculosis
CPFVPFFDPRMGRP

SEQ ID NO: 70964 - protein, 14 aa, Mycobacterium tuberculosis
PFVPFFDPRMGRPS

SEQ ID NO: 70965 - protein, 14 aa, Mycobacterium tuberculosis
FVPFFDPRMGRPSI

SEQ ID NO: 70966 - protein, 14 aa, Mycobacterium tuberculosis
VPFFDPRMGRPSIP

SEQ ID NO: 70967 - protein, 14 aa, Mycobacterium tuberculosis
PFFDPRMGRPSIPM

SEQ ID NO: 70968 - protein, 14 aa, Mycobacterium tuberculosis
FFDPRMGRPSIPME

SEQ ID NO: 70969 - protein, 14 aa, Mycobacterium tuberculosis
FDPRMGRPSIPMET

SEQ ID NO: 70970 - protein, 14 aa, Mycobacterium tuberculosis
DPRMGRPSIPMETY

SEQ ID NO: 70971 - protein, 14 aa, Mycobacterium tuberculosis
PRMGRPSIPMETYL

SEQ ID NO: 70972 - protein, 14 aa, Mycobacterium tuberculosis
RMGRPSIPMETYLR

SEQ ID NO: 70973 - protein, 14 aa, Mycobacterium tuberculosis
MGRPSIPMETYLRL

SEQ ID NO: 70974 - protein, 14 aa, Mycobacterium tuberculosis
GRPSIPMETYLRLM

SEQ ID NO: 70975 - protein, 14 aa, Mycobacterium tuberculosis
RPSIPMETYLRLMF

SEQ ID NO: 70976 - protein, 14 aa, Mycobacterium tuberculosis
PSIPMETYLRLMFL

SEQ ID NO: 70977 - protein, 14 aa, Mycobacterium tuberculosis
SIPMETYLRLMFLK

SEQ ID NO: 70978 - protein, 14 aa, Mycobacterium tuberculosis
IPMETYLRLMFLKF

SEQ ID NO: 70979 - protein, 14 aa, Mycobacterium tuberculosis
PMETYLRLMFLKFR

SEQ ID NO: 70980 - protein, 14 aa, Mycobacterium tuberculosis
METYLRLMFLKFRY

SEQ ID NO: 70981 - protein, 14 aa, Mycobacterium tuberculosis
ETYLRLMFLKFRYR

SEQ ID NO: 70982 - protein, 14 aa, Mycobacterium tuberculosis
TYLRLMFLKFRYRL

SEQ ID NO: 70983 - protein, 14 aa, Mycobacterium tuberculosis
YLRLMFLKFRYRLG

SEQ ID NO: 70984 - protein, 14 aa, Mycobacterium tuberculosis
LRLMFLKFRYRLGY

SEQ ID NO: 70985 - protein, 14 aa, Mycobacterium tuberculosis
RLMFLKFRYRLGYE

SEQ ID NO: 70986 - protein, 14 aa, Mycobacterium tuberculosis
LMFLKFRYRLGYES

SEQ ID NO: 70987 - protein, 14 aa, Mycobacterium tuberculosis
MFLKFRYRLGYESL

SEQ ID NO: 70988 - protein, 14 aa, Mycobacterium tuberculosis
FLKFRYRLGYESLC

SEQ ID NO: 70989 - protein, 14 aa, Mycobacterium tuberculosis
LKFRYRLGYESLCR

SEQ ID NO: 70990 - protein, 14 aa, Mycobacterium tuberculosis
KFRYRLGYESLCRE

SEQ ID NO: 70991 - protein, 14 aa, Mycobacterium tuberculosis
FRYRLGYESLCREV

SEQ ID NO: 70992 - protein, 14 aa, Mycobacterium tuberculosis
RYRLGYESLCREVT

SEQ ID NO: 70993 - protein, 14 aa, Mycobacterium tuberculosis
YRLGYESLCREVTD

SEQ ID NO: 70994 - protein, 14 aa, Mycobacterium tuberculosis
RLGYESLCREVTDS

SEQ ID NO: 70995 - protein, 14 aa, Mycobacterium tuberculosis
LGYESLCREVTDSI

SEQ ID NO: 70996 - protein, 14 aa, Mycobacterium tuberculosis
GYESLCREVTDSIT

SEQ ID NO: 70997 - protein, 14 aa, Mycobacterium tuberculosis
YESLCREVTDSITW

SEQ ID NO: 70998 - protein, 14 aa, Mycobacterium tuberculosis
ESLCREVTDSITWR

SEQ ID NO: 70999 - protein, 14 aa, Mycobacterium tuberculosis
SLCREVTDSITWRR

SEQ ID NO: 71000 - protein, 14 aa, Mycobacterium tuberculosis
LCREVTDSITWRRF

SEQ ID NO: 71001 - protein, 14 aa, Mycobacterium tuberculosis
CREVTDSITWRRFC

SEQ ID NO: 71002 - protein, 14 aa, Mycobacterium tuberculosis
REVTDSITWRRFCR

SEQ ID NO: 71003 - protein, 14 aa, Mycobacterium tuberculosis
EVTDSITWRRFCRI

SEQ ID NO: 71004 - protein, 14 aa, Mycobacterium tuberculosis
VTDSITWRRFCRIP

SEQ ID NO: 71005 - protein, 14 aa, Mycobacterium tuberculosis
TDSITWRRFCRIPL

SEQ ID NO: 71006 - protein, 14 aa, Mycobacterium tuberculosis
DSITWRRFCRIPLE

SEQ ID NO: 71007 - protein, 14 aa, Mycobacterium tuberculosis
SITWRRFCRIPLEG

SEQ ID NO: 71008 - protein, 14 aa, Mycobacterium tuberculosis
ITWRRFCRIPLEGS

SEQ ID NO: 71009 - protein, 14 aa, Mycobacterium tuberculosis
TWRRFCRIPLEGSV

SEQ ID NO: 71010 - protein, 14 aa, Mycobacterium tuberculosis
WRRFCRIPLEGSVP

SEQ ID NO: 71011 - protein, 14 aa, Mycobacterium tuberculosis
RRFCRIPLEGSVPH

SEQ ID NO: 71012 - protein, 14 aa, Mycobacterium tuberculosis
RFCRIPLEGSVPHP

SEQ ID NO: 71013 - protein, 14 aa, Mycobacterium tuberculosis
FCRIPLEGSVPHPT

SEQ ID NO: 71014 - protein, 14 aa, Mycobacterium tuberculosis
CRIPLEGSVPHPTT

SEQ ID NO: 71015 - protein, 14 aa, Mycobacterium tuberculosis
RIPLEGSVPHPTTL

SEQ ID NO: 71016 - protein, 14 aa, Mycobacterium tuberculosis
IPLEGSVPHPTTLM

SEQ ID NO: 71017 - protein, 14 aa, Mycobacterium tuberculosis
PLEGSVPHPTTLMK

SEQ ID NO: 71018 - protein, 14 aa, Mycobacterium tuberculosis
LEGSVPHPTTLMKL

SEQ ID NO: 71019 - protein, 14 aa, Mycobacterium tuberculosis
EGSVPHPTTLMKLT

SEQ ID NO: 71020 - protein, 14 aa, Mycobacterium tuberculosis
GSVPHPTTLMKLTT

SEQ ID NO: 71021 - protein, 14 aa, Mycobacterium tuberculosis
SVPHPTTLMKLTTR

SEQ ID NO: 71022 - protein, 14 aa, Mycobacterium tuberculosis
VPHPTTLMKLTTRC

SEQ ID NO: 71023 - protein, 14 aa, Mycobacterium tuberculosis
PHPTTLMKLTTRCG

SEQ ID NO: 71024 - protein, 14 aa, Mycobacterium tuberculosis
HPTTLMKLTTRCGE

SEQ ID NO: 71025 - protein, 14 aa, Mycobacterium tuberculosis
PTTLMKLTTRCGED

SEQ ID NO: 71026 - protein, 14 aa, Mycobacterium tuberculosis
TTLMKLTTRCGEDA

SEQ ID NO: 71027 - protein, 14 aa, Mycobacterium tuberculosis
TLMKLTTRCGEDAV

SEQ ID NO: 71028 - protein, 14 aa, Mycobacterium tuberculosis
LMKLTTRCGEDAVA

SEQ ID NO: 71029 - protein, 14 aa, Mycobacterium tuberculosis
MKLTTRCGEDAVAG

SEQ ID NO: 71030 - protein, 14 aa, Mycobacterium tuberculosis
KLTTRCGEDAVAGL

SEQ ID NO: 71031 - protein, 14 aa, Mycobacterium tuberculosis
LTTRCGEDAVAGLN

SEQ ID NO: 71032 - protein, 14 aa, Mycobacterium tuberculosis
TTRCGEDAVAGLNE

SEQ ID NO: 71033 - protein, 14 aa, Mycobacterium tuberculosis
TRCGEDAVAGLNEA

SEQ ID NO: 71034 - protein, 14 aa, Mycobacterium tuberculosis
RCGEDAVAGLNEAL

SEQ ID NO: 71035 - protein, 14 aa, Mycobacterium tuberculosis
CGEDAVAGLNEALL

SEQ ID NO: 71036 - protein, 14 aa, Mycobacterium tuberculosis
GEDAVAGLNEALLA

SEQ ID NO: 71037 - protein, 14 aa, Mycobacterium tuberculosis
EDAVAGLNEALLAK

SEQ ID NO: 71038 - protein, 14 aa, Mycobacterium tuberculosis
DAVAGLNEALLAKA

SEQ ID NO: 71039 - protein, 14 aa, Mycobacterium tuberculosis
AVAGLNEALLAKAA

SEQ ID NO: 71040 - protein, 14 aa, Mycobacterium tuberculosis
VAGLNEALLAKAAS

SEQ ID NO: 71041 - protein, 14 aa, Mycobacterium tuberculosis
AGLNEALLAKAASE

SEQ ID NO: 71042 - protein, 14 aa, Mycobacterium tuberculosis
GLNEALLAKAASEK

SEQ ID NO: 71043 - protein, 14 aa, Mycobacterium tuberculosis
LNEALLAKAASEKL

SEQ ID NO: 71044 - protein, 14 aa, Mycobacterium tuberculosis
NEALLAKAASEKLL

SEQ ID NO: 71045 - protein, 14 aa, Mycobacterium tuberculosis
EALLAKAASEKLLR

SEQ ID NO: 71046 - protein, 14 aa, Mycobacterium tuberculosis
ALLAKAASEKLLRT

SEQ ID NO: 71047 - protein, 14 aa, Mycobacterium tuberculosis
LLAKAASEKLLRTN

SEQ ID NO: 71048 - protein, 14 aa, Mycobacterium tuberculosis
LAKAASEKLLRTNK

SEQ ID NO: 71049 - protein, 14 aa, Mycobacterium tuberculosis
AKAASEKLLRTNKV

SEQ ID NO: 71050 - protein, 14 aa, Mycobacterium tuberculosis
KAASEKLLRTNKVR

SEQ ID NO: 71051 - protein, 14 aa, Mycobacterium tuberculosis
AASEKLLRTNKVRA

SEQ ID NO: 71052 - protein, 14 aa, Mycobacterium tuberculosis
ASEKLLRTNKVRAD

SEQ ID NO: 71053 - protein, 14 aa, Mycobacterium tuberculosis
SEKLLRTNKVRADT

SEQ ID NO: 71054 - protein, 14 aa, Mycobacterium tuberculosis
EKLLRTNKVRADTT

SEQ ID NO: 71055 - protein, 14 aa, Mycobacterium tuberculosis
KLLRTNKVRADTTV

SEQ ID NO: 71056 - protein, 14 aa, Mycobacterium tuberculosis
LLRTNKVRADTTVV

SEQ ID NO: 71057 - protein, 14 aa, Mycobacterium tuberculosis
LRTNKVRADTTVVE

SEQ ID NO: 71058 - protein, 14 aa, Mycobacterium tuberculosis
RTNKVRADTTVVEG

SEQ ID NO: 71059 - protein, 14 aa, Mycobacterium tuberculosis
TNKVRADTTVVEGD

SEQ ID NO: 71060 - protein, 14 aa, Mycobacterium tuberculosis
NKVRADTTVVEGDV

SEQ ID NO: 71061 - protein, 14 aa, Mycobacterium tuberculosis
KVRADTTVVEGDVG

SEQ ID NO: 71062 - protein, 14 aa, Mycobacterium tuberculosis
VRADTTVVEGDVGY

SEQ ID NO: 71063 - protein, 14 aa, Mycobacterium tuberculosis
RADTTVVEGDVGYP

SEQ ID NO: 71064 - protein, 14 aa, Mycobacterium tuberculosis
ADTTVVEGDVGYPT

SEQ ID NO: 71065 - protein, 14 aa, Mycobacterium tuberculosis
DTTVVEGDVGYPTD

SEQ ID NO: 71066 - protein, 14 aa, Mycobacterium tuberculosis
TTVVEGDVGYPTDT

SEQ ID NO: 71067 - protein, 14 aa, Mycobacterium tuberculosis
TVVEGDVGYPTDTG

SEQ ID NO: 71068 - protein, 14 aa, Mycobacterium tuberculosis
VVEGDVGYPTDTGL

SEQ ID NO: 71069 - protein, 14 aa, Mycobacterium tuberculosis
VEGDVGYPTDTGLL

SEQ ID NO: 71070 - protein, 14 aa, Mycobacterium tuberculosis
EGDVGYPTDTGLLA

SEQ ID NO: 71071 - protein, 14 aa, Mycobacterium tuberculosis
GDVGYPTDTGLLAK

SEQ ID NO: 71072 - protein, 14 aa, Mycobacterium tuberculosis
DVGYPTDTGLLAKA

SEQ ID NO: 71073 - protein, 14 aa, Mycobacterium tuberculosis
VGYPTDTGLLAKAV

SEQ ID NO: 71074 - protein, 14 aa, Mycobacterium tuberculosis
GYPTDTGLLAKAVG

SEQ ID NO: 71075 - protein, 14 aa, Mycobacterium tuberculosis
YPTDTGLLAKAVGS

SEQ ID NO: 71076 - protein, 14 aa, Mycobacterium tuberculosis
PTDTGLLAKAVGSM

SEQ ID NO: 71077 - protein, 14 aa, Mycobacterium tuberculosis
TDTGLLAKAVGSMA

SEQ ID NO: 71078 - protein, 14 aa, Mycobacterium tuberculosis
DTGLLAKAVGSMAR

SEQ ID NO: 71079 - protein, 14 aa, Mycobacterium tuberculosis
TGLLAKAVGSMART

SEQ ID NO: 71080 - protein, 14 aa, Mycobacterium tuberculosis
GLLAKAVGSMARTV

SEQ ID NO: 71081 - protein, 14 aa, Mycobacterium tuberculosis
LLAKAVGSMARTVA

SEQ ID NO: 71082 - protein, 14 aa, Mycobacterium tuberculosis
LAKAVGSMARTVAR

SEQ ID NO: 71083 - protein, 14 aa, Mycobacterium tuberculosis
AKAVGSMARTVARI

SEQ ID NO: 71084 - protein, 14 aa, Mycobacterium tuberculosis
KAVGSMARTVARIK

SEQ ID NO: 71085 - protein, 14 aa, Mycobacterium tuberculosis
AVGSMARTVARIKA

SEQ ID NO: 71086 - protein, 14 aa, Mycobacterium tuberculosis
VGSMARTVARIKAA

SEQ ID NO: 71087 - protein, 14 aa, Mycobacterium tuberculosis
GSMARTVARIKAAD

SEQ ID NO: 71088 - protein, 14 aa, Mycobacterium tuberculosis
SMARTVARIKAADA

SEQ ID NO: 71089 - protein, 14 aa, Mycobacterium tuberculosis
MARTVARIKAADAG

SEQ ID NO: 71090 - protein, 14 aa, Mycobacterium tuberculosis
ARTVARIKAADAGS

SEQ ID NO: 71091 - protein, 14 aa, Mycobacterium tuberculosis
RTVARIKAADAGSA

SEQ ID NO: 71092 - protein, 14 aa, Mycobacterium tuberculosis
TVARIKAADAGSAP

SEQ ID NO: 71093 - protein, 14 aa, Mycobacterium tuberculosis
VARIKAADAGSAPL

SEQ ID NO: 71094 - protein, 14 aa, Mycobacterium tuberculosis
ARIKAADAGSAPLG

SEQ ID NO: 71095 - protein, 14 aa, Mycobacterium tuberculosis
RIKAADAGSAPLGG

SEQ ID NO: 71096 - protein, 14 aa, Mycobacterium tuberculosis
IKAADAGSAPLGGS

SEQ ID NO: 71097 - protein, 14 aa, Mycobacterium tuberculosis
KAADAGSAPLGGSS

SEQ ID NO: 71098 - protein, 14 aa, Mycobacterium tuberculosis
AADAGSAPLGGSSG

SEQ ID NO: 71099 - protein, 14 aa, Mycobacterium tuberculosis
ADAGSAPLGGSSGP

SEQ ID NO: 71100 - protein, 14 aa, Mycobacterium tuberculosis
DAGSAPLGGSSGPR

SEQ ID NO: 71101 - protein, 14 aa, Mycobacterium tuberculosis
AGSAPLGGSSGPRD

SEQ ID NO: 71102 - protein, 14 aa, Mycobacterium tuberculosis
GSAPLGGSSGPRDR

SEQ ID NO: 71103 - protein, 14 aa, Mycobacterium tuberculosis
SAPLGGSSGPRDRL

SEQ ID NO: 71104 - protein, 14 aa, Mycobacterium tuberculosis
APLGGSSGPRDRLQ

SEQ ID NO: 71105 - protein, 14 aa, Mycobacterium tuberculosis
PLGGSSGPRDRLQA

SEQ ID NO: 71106 - protein, 14 aa, Mycobacterium tuberculosis
LGGSSGPRDRLQAA

SEQ ID NO: 71107 - protein, 14 aa, Mycobacterium tuberculosis
GGSSGPRDRLQAAV

SEQ ID NO: 71108 - protein, 14 aa, Mycobacterium tuberculosis
GSSGPRDRLQAAVT

SEQ ID NO: 71109 - protein, 14 aa, Mycobacterium tuberculosis
SSGPRDRLQAAVTR

SEQ ID NO: 71110 - protein, 14 aa, Mycobacterium tuberculosis
SGPRDRLQAAVTRR

SEQ ID NO: 71111 - protein, 14 aa, Mycobacterium tuberculosis
GPRDRLQAAVTRRA

SEQ ID NO: 71112 - protein, 14 aa, Mycobacterium tuberculosis
PRDRLQAAVTRRAA

SEQ ID NO: 71113 - protein, 14 aa, Mycobacterium tuberculosis
RDRLQAAVTRRAAT

SEQ ID NO: 71114 - protein, 14 aa, Mycobacterium tuberculosis
DRLQAAVTRRAATR

SEQ ID NO: 71115 - protein, 14 aa, Mycobacterium tuberculosis
RLQAAVTRRAATRS

SEQ ID NO: 71116 - protein, 14 aa, Mycobacterium tuberculosis
LQAAVTRRAATRSG

SEQ ID NO: 71117 - protein, 14 aa, Mycobacterium tuberculosis
QAAVTRRAATRSGA

SEQ ID NO: 71118 - protein, 14 aa, Mycobacterium tuberculosis
AAVTRRAATRSGAG

SEQ ID NO: 71119 - protein, 14 aa, Mycobacterium tuberculosis
AVTRRAATRSGAGL

SEQ ID NO: 71120 - protein, 14 aa, Mycobacterium tuberculosis
VTRRAATRSGAGLR

SEQ ID NO: 71121 - protein, 14 aa, Mycobacterium tuberculosis
TRRAATRSGAGLRA

SEQ ID NO: 71122 - protein, 14 aa, Mycobacterium tuberculosis
RRAATRSGAGLRAP

SEQ ID NO: 71123 - protein, 14 aa, Mycobacterium tuberculosis
RAATRSGAGLRAPD

SEQ ID NO: 71124 - protein, 14 aa, Mycobacterium tuberculosis
AATRSGAGLRAPDH

SEQ ID NO: 71125 - protein, 14 aa, Mycobacterium tuberculosis
ATRSGAGLRAPDHR

SEQ ID NO: 71126 - protein, 14 aa, Mycobacterium tuberculosis
TRSGAGLRAPDHRG

SEQ ID NO: 71127 - protein, 14 aa, Mycobacterium tuberculosis
RSGAGLRAPDHRGA

SEQ ID NO: 71128 - protein, 14 aa, Mycobacterium tuberculosis
SGAGLRAPDHRGAS

SEQ ID NO: 71129 - protein, 14 aa, Mycobacterium tuberculosis
GAGLRAPDHRGASR

SEQ ID NO: 71130 - protein, 14 aa, Mycobacterium tuberculosis
AGLRAPDHRGASRD

SEQ ID NO: 71131 - protein, 14 aa, Mycobacterium tuberculosis
GLRAPDHRGASRDR

SEQ ID NO: 71132 - protein, 14 aa, Mycobacterium tuberculosis
LRAPDHRGASRDRR

SEQ ID NO: 71133 - protein, 14 aa, Mycobacterium tuberculosis
RAPDHRGASRDRRA

SEQ ID NO: 71134 - protein, 14 aa, Mycobacterium tuberculosis
APDHRGASRDRRAG

SEQ ID NO: 71135 - protein, 14 aa, Mycobacterium tuberculosis
PDHRGASRDRRAGA

SEQ ID NO: 71136 - protein, 14 aa, Mycobacterium tuberculosis
DHRGASRDRRAGAD

SEQ ID NO: 71137 - protein, 14 aa, Mycobacterium tuberculosis
HRGASRDRRAGADR

SEQ ID NO: 71138 - protein, 14 aa, Mycobacterium tuberculosis
RGASRDRRAGADRG

SEQ ID NO: 71139 - protein, 14 aa, Mycobacterium tuberculosis
GASRDRRAGADRGC

SEQ ID NO: 71140 - protein, 14 aa, Mycobacterium tuberculosis
ASRDRRAGADRGCR

SEQ ID NO: 71141 - protein, 14 aa, Mycobacterium tuberculosis
SRDRRAGADRGCRG

SEQ ID NO: 71142 - protein, 14 aa, Mycobacterium tuberculosis
RDRRAGADRGCRGG

SEQ ID NO: 71143 - protein, 14 aa, Mycobacterium tuberculosis
DRRAGADRGCRGGT

SEQ ID NO: 71144 - protein, 15 aa, Mycobacterium tuberculosis
MFRTVGDQASLWESV

SEQ ID NO: 71145 - protein, 15 aa, Mycobacterium tuberculosis
FRTVGDQASLWESVL

SEQ ID NO: 71146 - protein, 15 aa, Mycobacterium tuberculosis
RTVGDQASLWESVLP

SEQ ID NO: 71147 - protein, 15 aa, Mycobacterium tuberculosis
TVGDQASLWESVLPE

SEQ ID NO: 71148 - protein, 15 aa, Mycobacterium tuberculosis
VGDQASLWESVLPEE

SEQ ID NO: 71149 - protein, 15 aa, Mycobacterium tuberculosis
GDQASLWESVLPEEL

SEQ ID NO: 71150 - protein, 15 aa, Mycobacterium tuberculosis
DQASLWESVLPEELR

SEQ ID NO: 71151 - protein, 15 aa, Mycobacterium tuberculosis
QASLWESVLPEELRR

SEQ ID NO: 71152 - protein, 15 aa, Mycobacterium tuberculosis
ASLWESVLPEELRRL

SEQ ID NO: 71153 - protein, 15 aa, Mycobacterium tuberculosis
SLWESVLPEELRRLP

SEQ ID NO: 71154 - protein, 15 aa, Mycobacterium tuberculosis
LWESVLPEELRRLPE

SEQ ID NO: 71155 - protein, 15 aa, Mycobacterium tuberculosis
WESVLPEELRRLPEE

SEQ ID NO: 71156 - protein, 15 aa, Mycobacterium tuberculosis
ESVLPEELRRLPEEL

SEQ ID NO: 71157 - protein, 15 aa, Mycobacterium tuberculosis
SVLPEELRRLPEELA

SEQ ID NO: 71158 - protein, 15 aa, Mycobacterium tuberculosis
VLPEELRRLPEELAR

SEQ ID NO: 71159 - protein, 15 aa, Mycobacterium tuberculosis
LPEELRRLPEELARV

SEQ ID NO: 71160 - protein, 15 aa, Mycobacterium tuberculosis
PEELRRLPEELARVD

SEQ ID NO: 71161 - protein, 15 aa, Mycobacterium tuberculosis
EELRRLPEELARVDA

SEQ ID NO: 71162 - protein, 15 aa, Mycobacterium tuberculosis
ELRRLPEELARVDAL

SEQ ID NO: 71163 - protein, 15 aa, Mycobacterium tuberculosis
LRRLPEELARVDALL

SEQ ID NO: 71164 - protein, 15 aa, Mycobacterium tuberculosis
RRLPEELARVDALLD

SEQ ID NO: 71165 - protein, 15 aa, Mycobacterium tuberculosis
RLPEELARVDALLDD

SEQ ID NO: 71166 - protein, 15 aa, Mycobacterium tuberculosis
LPEELARVDALLDDS

SEQ ID NO: 71167 - protein, 15 aa, Mycobacterium tuberculosis
PEELARVDALLDDSA

SEQ ID NO: 71168 - protein, 15 aa, Mycobacterium tuberculosis
EELARVDALLDDSAF

SEQ ID NO: 71169 - protein, 15 aa, Mycobacterium tuberculosis
ELARVDALLDDSAFF

SEQ ID NO: 71170 - protein, 15 aa, Mycobacterium tuberculosis
LARVDALLDDSAFFC

SEQ ID NO: 71171 - protein, 15 aa, Mycobacterium tuberculosis
ARVDALLDDSAFFCP

SEQ ID NO: 71172 - protein, 15 aa, Mycobacterium tuberculosis
RVDALLDDSAFFCPF

SEQ ID NO: 71173 - protein, 15 aa, Mycobacterium tuberculosis
VDALLDDSAFFCPFV

SEQ ID NO: 71174 - protein, 15 aa, Mycobacterium tuberculosis
DALLDDSAFFCPFVP

SEQ ID NO: 71175 - protein, 15 aa, Mycobacterium tuberculosis
ALLDDSAFFCPFVPF

SEQ ID NO: 71176 - protein, 15 aa, Mycobacterium tuberculosis
LLDDSAFFCPFVPFF

SEQ ID NO: 71177 - protein, 15 aa, Mycobacterium tuberculosis
LDDSAFFCPFVPFFD

SEQ ID NO: 71178 - protein, 15 aa, Mycobacterium tuberculosis
DDSAFFCPFVPFFDP

SEQ ID NO: 71179 - protein, 15 aa, Mycobacterium tuberculosis
DSAFFCPFVPFFDPR

SEQ ID NO: 71180 - protein, 15 aa, Mycobacterium tuberculosis
SAFFCPFVPFFDPRM

SEQ ID NO: 71181 - protein, 15 aa, Mycobacterium tuberculosis
AFFCPFVPFFDPRMG

SEQ ID NO: 71182 - protein, 15 aa, Mycobacterium tuberculosis
FFCPFVPFFDPRMGR

SEQ ID NO: 71183 - protein, 15 aa, Mycobacterium tuberculosis
FCPFVPFFDPRMGRP

SEQ ID NO: 71184 - protein, 15 aa, Mycobacterium tuberculosis
CPFVPFFDPRMGRPS

SEQ ID NO: 71185 - protein, 15 aa, Mycobacterium tuberculosis
PFVPFFDPRMGRPSI

SEQ ID NO: 71186 - protein, 15 aa, Mycobacterium tuberculosis
FVPFFDPRMGRPSIP

SEQ ID NO: 71187 - protein, 15 aa, Mycobacterium tuberculosis
VPFFDPRMGRPSIPM

SEQ ID NO: 71188 - protein, 15 aa, Mycobacterium tuberculosis
PFFDPRMGRPSIPME

SEQ ID NO: 71189 - protein, 15 aa, Mycobacterium tuberculosis
FFDPRMGRPSIPMET

SEQ ID NO: 71190 - protein, 15 aa, Mycobacterium tuberculosis
FDPRMGRPSIPMETY

SEQ ID NO: 71191 - protein, 15 aa, Mycobacterium tuberculosis
DPRMGRPSIPMETYL

SEQ ID NO: 71192 - protein, 15 aa, Mycobacterium tuberculosis
PRMGRPSIPMETYLR

SEQ ID NO: 71193 - protein, 15 aa, Mycobacterium tuberculosis
RMGRPSIPMETYLRL

SEQ ID NO: 71194 - protein, 15 aa, Mycobacterium tuberculosis
MGRPSIPMETYLRLM

SEQ ID NO: 71195 - protein, 15 aa, Mycobacterium tuberculosis
GRPSIPMETYLRLMF

SEQ ID NO: 71196 - protein, 15 aa, Mycobacterium tuberculosis
RPSIPMETYLRLMFL

SEQ ID NO: 71197 - protein, 15 aa, Mycobacterium tuberculosis
PSIPMETYLRLMFLK

SEQ ID NO: 71198 - protein, 15 aa, Mycobacterium tuberculosis
SIPMETYLRLMFLKF

SEQ ID NO: 71199 - protein, 15 aa, Mycobacterium tuberculosis
IPMETYLRLMFLKFR

SEQ ID NO: 71200 - protein, 15 aa, Mycobacterium tuberculosis
PMETYLRLMFLKFRY

SEQ ID NO: 71201 - protein, 15 aa, Mycobacterium tuberculosis
METYLRLMFLKFRYR

SEQ ID NO: 71202 - protein, 15 aa, Mycobacterium tuberculosis
ETYLRLMFLKFRYRL

SEQ ID NO: 71203 - protein, 15 aa, Mycobacterium tuberculosis
TYLRLMFLKFRYRLG

SEQ ID NO: 71204 - protein, 15 aa, Mycobacterium tuberculosis
YLRLMFLKFRYRLGY

SEQ ID NO: 71205 - protein, 15 aa, Mycobacterium tuberculosis
LRLMFLKFRYRLGYE

SEQ ID NO: 71206 - protein, 15 aa, Mycobacterium tuberculosis
RLMFLKFRYRLGYES

SEQ ID NO: 71207 - protein, 15 aa, Mycobacterium tuberculosis
LMFLKFRYRLGYESL

SEQ ID NO: 71208 - protein, 15 aa, Mycobacterium tuberculosis
MFLKFRYRLGYESLC

SEQ ID NO: 71209 - protein, 15 aa, Mycobacterium tuberculosis
FLKFRYRLGYESLCR

SEQ ID NO: 71210 - protein, 15 aa, Mycobacterium tuberculosis
LKFRYRLGYESLCRE

SEQ ID NO: 71211 - protein, 15 aa, Mycobacterium tuberculosis
KFRYRLGYESLCREV

SEQ ID NO: 71212 - protein, 15 aa, Mycobacterium tuberculosis
FRYRLGYESLCREVT

SEQ ID NO: 71213 - protein, 15 aa, Mycobacterium tuberculosis
RYRLGYESLCREVTD

SEQ ID NO: 71214 - protein, 15 aa, Mycobacterium tuberculosis
YRLGYESLCREVTDS

SEQ ID NO: 71215 - protein, 15 aa, Mycobacterium tuberculosis
RLGYESLCREVTDSI

SEQ ID NO: 71216 - protein, 15 aa, Mycobacterium tuberculosis
LGYESLCREVTDSIT

SEQ ID NO: 71217 - protein, 15 aa, Mycobacterium tuberculosis
GYESLCREVTDSITW

SEQ ID NO: 71218 - protein, 15 aa, Mycobacterium tuberculosis
YESLCREVTDSITWR

SEQ ID NO: 71219 - protein, 15 aa, Mycobacterium tuberculosis
ESLCREVTDSITWRR

SEQ ID NO: 71220 - protein, 15 aa, Mycobacterium tuberculosis
SLCREVTDSITWRRF

SEQ ID NO: 71221 - protein, 15 aa, Mycobacterium tuberculosis
LCREVTDSITWRRFC

SEQ ID NO: 71222 - protein, 15 aa, Mycobacterium tuberculosis
CREVTDSITWRRFCR

SEQ ID NO: 71223 - protein, 15 aa, Mycobacterium tuberculosis
REVTDSITWRRFCRI

SEQ ID NO: 71224 - protein, 15 aa, Mycobacterium tuberculosis
EVTDSITWRRFCRIP

SEQ ID NO: 71225 - protein, 15 aa, Mycobacterium tuberculosis
VTDSITWRRFCRIPL

SEQ ID NO: 71226 - protein, 15 aa, Mycobacterium tuberculosis
TDSITWRRFCRIPLE

SEQ ID NO: 71227 - protein, 15 aa, Mycobacterium tuberculosis
DSITWRRFCRIPLEG

SEQ ID NO: 71228 - protein, 15 aa, Mycobacterium tuberculosis
SITWRRFCRIPLEGS

SEQ ID NO: 71229 - protein, 15 aa, Mycobacterium tuberculosis
ITWRRFCRIPLEGSV

SEQ ID NO: 71230 - protein, 15 aa, Mycobacterium tuberculosis
TWRRFCRIPLEGSVP

SEQ ID NO: 71231 - protein, 15 aa, Mycobacterium tuberculosis
WRRFCRIPLEGSVPH

SEQ ID NO: 71232 - protein, 15 aa, Mycobacterium tuberculosis
RRFCRIPLEGSVPHP

SEQ ID NO: 71233 - protein, 15 aa, Mycobacterium tuberculosis
RFCRIPLEGSVPHPT

SEQ ID NO: 71234 - protein, 15 aa, Mycobacterium tuberculosis
FCRIPLEGSVPHPTT

SEQ ID NO: 71235 - protein, 15 aa, Mycobacterium tuberculosis
CRIPLEGSVPHPTTL

SEQ ID NO: 71236 - protein, 15 aa, Mycobacterium tuberculosis
RIPLEGSVPHPTTLM

SEQ ID NO: 71237 - protein, 15 aa, Mycobacterium tuberculosis
IPLEGSVPHPTTLMK

SEQ ID NO: 71238 - protein, 15 aa, Mycobacterium tuberculosis
PLEGSVPHPTTLMKL

SEQ ID NO: 71239 - protein, 15 aa, Mycobacterium tuberculosis
LEGSVPHPTTLMKLT

SEQ ID NO: 71240 - protein, 15 aa, Mycobacterium tuberculosis
EGSVPHPTTLMKLTT

SEQ ID NO: 71241 - protein, 15 aa, Mycobacterium tuberculosis
GSVPHPTTLMKLTTR

SEQ ID NO: 71242 - protein, 15 aa, Mycobacterium tuberculosis
SVPHPTTLMKLTTRC

SEQ ID NO: 71243 - protein, 15 aa, Mycobacterium tuberculosis
VPHPTTLMKLTTRCG

SEQ ID NO: 71244 - protein, 15 aa, Mycobacterium tuberculosis
PHPTTLMKLTTRCGE

SEQ ID NO: 71245 - protein, 15 aa, Mycobacterium tuberculosis
HPTTLMKLTTRCGED

SEQ ID NO: 71246 - protein, 15 aa, Mycobacterium tuberculosis
PTTLMKLTTRCGEDA

SEQ ID NO: 71247 - protein, 15 aa, Mycobacterium tuberculosis
TTLMKLTTRCGEDAV

SEQ ID NO: 71248 - protein, 15 aa, Mycobacterium tuberculosis
TLMKLTTRCGEDAVA

SEQ ID NO: 71249 - protein, 15 aa, Mycobacterium tuberculosis
LMKLTTRCGEDAVAG

SEQ ID NO: 71250 - protein, 15 aa, Mycobacterium tuberculosis
MKLTTRCGEDAVAGL

SEQ ID NO: 71251 - protein, 15 aa, Mycobacterium tuberculosis
KLTTRCGEDAVAGLN

SEQ ID NO: 71252 - protein, 15 aa, Mycobacterium tuberculosis
LTTRCGEDAVAGLNE

SEQ ID NO: 71253 - protein, 15 aa, Mycobacterium tuberculosis
TTRCGEDAVAGLNEA

SEQ ID NO: 71254 - protein, 15 aa, Mycobacterium tuberculosis
TRCGEDAVAGLNEAL

SEQ ID NO: 71255 - protein, 15 aa, Mycobacterium tuberculosis
RCGEDAVAGLNEALL

SEQ ID NO: 71256 - protein, 15 aa, Mycobacterium tuberculosis
CGEDAVAGLNEALLA

SEQ ID NO: 71257 - protein, 15 aa, Mycobacterium tuberculosis
GEDAVAGLNEALLAK

SEQ ID NO: 71258 - protein, 15 aa, Mycobacterium tuberculosis
EDAVAGLNEALLAKA

SEQ ID NO: 71259 - protein, 15 aa, Mycobacterium tuberculosis
DAVAGLNEALLAKAA

SEQ ID NO: 71260 - protein, 15 aa, Mycobacterium tuberculosis
AVAGLNEALLAKAAS

SEQ ID NO: 71261 - protein, 15 aa, Mycobacterium tuberculosis
VAGLNEALLAKAASE

SEQ ID NO: 71262 - protein, 15 aa, Mycobacterium tuberculosis
AGLNEALLAKAASEK

SEQ ID NO: 71263 - protein, 15 aa, Mycobacterium tuberculosis
GLNEALLAKAASEKL

SEQ ID NO: 71264 - protein, 15 aa, Mycobacterium tuberculosis
LNEALLAKAASEKLL

SEQ ID NO: 71265 - protein, 15 aa, Mycobacterium tuberculosis
NEALLAKAASEKLLR

SEQ ID NO: 71266 - protein, 15 aa, Mycobacterium tuberculosis
EALLAKAASEKLLRT

SEQ ID NO: 71267 - protein, 15 aa, Mycobacterium tuberculosis
ALLAKAASEKLLRTN

SEQ ID NO: 71268 - protein, 15 aa, Mycobacterium tuberculosis
LLAKAASEKLLRTNK

SEQ ID NO: 71269 - protein, 15 aa, Mycobacterium tuberculosis
LAKAASEKLLRTNKV

SEQ ID NO: 71270 - protein, 15 aa, Mycobacterium tuberculosis
AKAASEKLLRTNKVR

SEQ ID NO: 71271 - protein, 15 aa, Mycobacterium tuberculosis
KAASEKLLRTNKVRA

SEQ ID NO: 71272 - protein, 15 aa, Mycobacterium tuberculosis
AASEKLLRTNKVRAD

SEQ ID NO: 71273 - protein, 15 aa, Mycobacterium tuberculosis
ASEKLLRTNKVRADT

SEQ ID NO: 71274 - protein, 15 aa, Mycobacterium tuberculosis
SEKLLRTNKVRADTT

SEQ ID NO: 71275 - protein, 15 aa, Mycobacterium tuberculosis
EKLLRTNKVRADTTV

SEQ ID NO: 71276 - protein, 15 aa, Mycobacterium tuberculosis
KLLRTNKVRADTTVV

SEQ ID NO: 71277 - protein, 15 aa, Mycobacterium tuberculosis
LLRTNKVRADTTVVE

SEQ ID NO: 71278 - protein, 15 aa, Mycobacterium tuberculosis
LRTNKVRADTTVVEG

SEQ ID NO: 71279 - protein, 15 aa, Mycobacterium tuberculosis
RTNKVRADTTVVEGD

SEQ ID NO: 71280 - protein, 15 aa, Mycobacterium tuberculosis
TNKVRADTTVVEGDV

SEQ ID NO: 71281 - protein, 15 aa, Mycobacterium tuberculosis
NKVRADTTVVEGDVG

SEQ ID NO: 71282 - protein, 15 aa, Mycobacterium tuberculosis
KVRADTTVVEGDVGY

SEQ ID NO: 71283 - protein, 15 aa, Mycobacterium tuberculosis
VRADTTVVEGDVGYP

SEQ ID NO: 71284 - protein, 15 aa, Mycobacterium tuberculosis
RADTTVVEGDVGYPT

SEQ ID NO: 71285 - protein, 15 aa, Mycobacterium tuberculosis
ADTTVVEGDVGYPTD

SEQ ID NO: 71286 - protein, 15 aa, Mycobacterium tuberculosis
DTTVVEGDVGYPTDT

SEQ ID NO: 71287 - protein, 15 aa, Mycobacterium tuberculosis
TTVVEGDVGYPTDTG

SEQ ID NO: 71288 - protein, 15 aa, Mycobacterium tuberculosis
TVVEGDVGYPTDTGL

SEQ ID NO: 71289 - protein, 15 aa, Mycobacterium tuberculosis
VVEGDVGYPTDTGLL

SEQ ID NO: 71290 - protein, 15 aa, Mycobacterium tuberculosis
VEGDVGYPTDTGLLA

SEQ ID NO: 71291 - protein, 15 aa, Mycobacterium tuberculosis
EGDVGYPTDTGLLAK

SEQ ID NO: 71292 - protein, 15 aa, Mycobacterium tuberculosis
GDVGYPTDTGLLAKA

SEQ ID NO: 71293 - protein, 15 aa, Mycobacterium tuberculosis
DVGYPTDTGLLAKAV

SEQ ID NO: 71294 - protein, 15 aa, Mycobacterium tuberculosis
VGYPTDTGLLAKAVG

SEQ ID NO: 71295 - protein, 15 aa, Mycobacterium tuberculosis
GYPTDTGLLAKAVGS

SEQ ID NO: 71296 - protein, 15 aa, Mycobacterium tuberculosis
YPTDTGLLAKAVGSM

SEQ ID NO: 71297 - protein, 15 aa, Mycobacterium tuberculosis
PTDTGLLAKAVGSMA

SEQ ID NO: 71298 - protein, 15 aa, Mycobacterium tuberculosis
TDTGLLAKAVGSMAR

SEQ ID NO: 71299 - protein, 15 aa, Mycobacterium tuberculosis
DTGLLAKAVGSMART

SEQ ID NO: 71300 - protein, 15 aa, Mycobacterium tuberculosis
TGLLAKAVGSMARTV

SEQ ID NO: 71301 - protein, 15 aa, Mycobacterium tuberculosis
GLLAKAVGSMARTVA

SEQ ID NO: 71302 - protein, 15 aa, Mycobacterium tuberculosis
LLAKAVGSMARTVAR

SEQ ID NO: 71303 - protein, 15 aa, Mycobacterium tuberculosis
LAKAVGSMARTVARI

SEQ ID NO: 71304 - protein, 15 aa, Mycobacterium tuberculosis
AKAVGSMARTVARIK

SEQ ID NO: 71305 - protein, 15 aa, Mycobacterium tuberculosis
KAVGSMARTVARIKA

SEQ ID NO: 71306 - protein, 15 aa, Mycobacterium tuberculosis
AVGSMARTVARIKAA

SEQ ID NO: 71307 - protein, 15 aa, Mycobacterium tuberculosis
VGSMARTVARIKAAD

SEQ ID NO: 71308 - protein, 15 aa, Mycobacterium tuberculosis
GSMARTVARIKAADA

SEQ ID NO: 71309 - protein, 15 aa, Mycobacterium tuberculosis
SMARTVARIKAADAG

SEQ ID NO: 71310 - protein, 15 aa, Mycobacterium tuberculosis
MARTVARIKAADAGS

SEQ ID NO: 71311 - protein, 15 aa, Mycobacterium tuberculosis
ARTVARIKAADAGSA

SEQ ID NO: 71312 - protein, 15 aa, Mycobacterium tuberculosis
RTVARIKAADAGSAP

SEQ ID NO: 71313 - protein, 15 aa, Mycobacterium tuberculosis
TVARIKAADAGSAPL

SEQ ID NO: 71314 - protein, 15 aa, Mycobacterium tuberculosis
VARIKAADAGSAPLG

SEQ ID NO: 71315 - protein, 15 aa, Mycobacterium tuberculosis
ARIKAADAGSAPLGG

SEQ ID NO: 71316 - protein, 15 aa, Mycobacterium tuberculosis
RIKAADAGSAPLGGS

SEQ ID NO: 71317 - protein, 15 aa, Mycobacterium tuberculosis
IKAADAGSAPLGGSS

SEQ ID NO: 71318 - protein, 15 aa, Mycobacterium tuberculosis
KAADAGSAPLGGSSG

SEQ ID NO: 71319 - protein, 15 aa, Mycobacterium tuberculosis
AADAGSAPLGGSSGP

SEQ ID NO: 71320 - protein, 15 aa, Mycobacterium tuberculosis
ADAGSAPLGGSSGPR

SEQ ID NO: 71321 - protein, 15 aa, Mycobacterium tuberculosis
DAGSAPLGGSSGPRD

SEQ ID NO: 71322 - protein, 15 aa, Mycobacterium tuberculosis
AGSAPLGGSSGPRDR

SEQ ID NO: 71323 - protein, 15 aa, Mycobacterium tuberculosis
GSAPLGGSSGPRDRL

SEQ ID NO: 71324 - protein, 15 aa, Mycobacterium tuberculosis
SAPLGGSSGPRDRLQ

SEQ ID NO: 71325 - protein, 15 aa, Mycobacterium tuberculosis
APLGGSSGPRDRLQA

SEQ ID NO: 71326 - protein, 15 aa, Mycobacterium tuberculosis
PLGGSSGPRDRLQAA

SEQ ID NO: 71327 - protein, 15 aa, Mycobacterium tuberculosis
LGGSSGPRDRLQAAV

SEQ ID NO: 71328 - protein, 15 aa, Mycobacterium tuberculosis
GGSSGPRDRLQAAVT

SEQ ID NO: 71329 - protein, 15 aa, Mycobacterium tuberculosis
GSSGPRDRLQAAVTR

SEQ ID NO: 71330 - protein, 15 aa, Mycobacterium tuberculosis
SSGPRDRLQAAVTRR

SEQ ID NO: 71331 - protein, 15 aa, Mycobacterium tuberculosis
SGPRDRLQAAVTRRA

SEQ ID NO: 71332 - protein, 15 aa, Mycobacterium tuberculosis
GPRDRLQAAVTRRAA

SEQ ID NO: 71333 - protein, 15 aa, Mycobacterium tuberculosis
PRDRLQAAVTRRAAT

SEQ ID NO: 71334 - protein, 15 aa, Mycobacterium tuberculosis
RDRLQAAVTRRAATR

SEQ ID NO: 71335 - protein, 15 aa, Mycobacterium tuberculosis
DRLQAAVTRRAATRS

SEQ ID NO: 71336 - protein, 15 aa, Mycobacterium tuberculosis
RLQAAVTRRAATRSG

SEQ ID NO: 71337 - protein, 15 aa, Mycobacterium tuberculosis
LQAAVTRRAATRSGA

SEQ ID NO: 71338 - protein, 15 aa, Mycobacterium tuberculosis
QAAVTRRAATRSGAG

SEQ ID NO: 71339 - protein, 15 aa, Mycobacterium tuberculosis
AAVTRRAATRSGAGL

SEQ ID NO: 71340 - protein, 15 aa, Mycobacterium tuberculosis
AVTRRAATRSGAGLR

SEQ ID NO: 71341 - protein, 15 aa, Mycobacterium tuberculosis
VTRRAATRSGAGLRA

SEQ ID NO: 71342 - protein, 15 aa, Mycobacterium tuberculosis
TRRAATRSGAGLRAP

SEQ ID NO: 71343 - protein, 15 aa, Mycobacterium tuberculosis
RRAATRSGAGLRAPD

SEQ ID NO: 71344 - protein, 15 aa, Mycobacterium tuberculosis
RAATRSGAGLRAPDH

SEQ ID NO: 71345 - protein, 15 aa, Mycobacterium tuberculosis
AATRSGAGLRAPDHR

SEQ ID NO: 71346 - protein, 15 aa, Mycobacterium tuberculosis
ATRSGAGLRAPDHRG

SEQ ID NO: 71347 - protein, 15 aa, Mycobacterium tuberculosis
TRSGAGLRAPDHRGA

SEQ ID NO: 71348 - protein, 15 aa, Mycobacterium tuberculosis
RSGAGLRAPDHRGAS

SEQ ID NO: 71349 - protein, 15 aa, Mycobacterium tuberculosis
SGAGLRAPDHRGASR

SEQ ID NO: 71350 - protein, 15 aa, Mycobacterium tuberculosis
GAGLRAPDHRGASRD

SEQ ID NO: 71351 - protein, 15 aa, Mycobacterium tuberculosis
AGLRAPDHRGASRDR

SEQ ID NO: 71352 - protein, 15 aa, Mycobacterium tuberculosis
GLRAPDHRGASRDRR

SEQ ID NO: 71353 - protein, 15 aa, Mycobacterium tuberculosis
LRAPDHRGASRDRRA

SEQ ID NO: 71354 - protein, 15 aa, Mycobacterium tuberculosis
RAPDHRGASRDRRAG

SEQ ID NO: 71355 - protein, 15 aa, Mycobacterium tuberculosis
APDHRGASRDRRAGA

SEQ ID NO: 71356 - protein, 15 aa, Mycobacterium tuberculosis
PDHRGASRDRRAGAD

SEQ ID NO: 71357 - protein, 15 aa, Mycobacterium tuberculosis
DHRGASRDRRAGADR

SEQ ID NO: 71358 - protein, 15 aa, Mycobacterium tuberculosis
HRGASRDRRAGADRG

SEQ ID NO: 71359 - protein, 15 aa, Mycobacterium tuberculosis
RGASRDRRAGADRGC

SEQ ID NO: 71360 - protein, 15 aa, Mycobacterium tuberculosis
GASRDRRAGADRGCR

SEQ ID NO: 71361 - protein, 15 aa, Mycobacterium tuberculosis
ASRDRRAGADRGCRG

SEQ ID NO: 71362 - protein, 15 aa, Mycobacterium tuberculosis
SRDRRAGADRGCRGG

SEQ ID NO: 71363 - protein, 15 aa, Mycobacterium tuberculosis
RDRRAGADRGCRGGT

SEQ ID NO: 71364 - protein, 16 aa, Mycobacterium tuberculosis
MFRTVGDQASLWESVL

SEQ ID NO: 71365 - protein, 16 aa, Mycobacterium tuberculosis
FRTVGDQASLWESVLP

SEQ ID NO: 71366 - protein, 16 aa, Mycobacterium tuberculosis
RTVGDQASLWESVLPE

SEQ ID NO: 71367 - protein, 16 aa, Mycobacterium tuberculosis
TVGDQASLWESVLPEE

SEQ ID NO: 71368 - protein, 16 aa, Mycobacterium tuberculosis
VGDQASLWESVLPEEL

SEQ ID NO: 71369 - protein, 16 aa, Mycobacterium tuberculosis
GDQASLWESVLPEELR

SEQ ID NO: 71370 - protein, 16 aa, Mycobacterium tuberculosis
DQASLWESVLPEELRR

SEQ ID NO: 71371 - protein, 16 aa, Mycobacterium tuberculosis
QASLWESVLPEELRRL

SEQ ID NO: 71372 - protein, 16 aa, Mycobacterium tuberculosis
ASLWESVLPEELRRLP

SEQ ID NO: 71373 - protein, 16 aa, Mycobacterium tuberculosis
SLWESVLPEELRRLPE

SEQ ID NO: 71374 - protein, 16 aa, Mycobacterium tuberculosis
LWESVLPEELRRLPEE

SEQ ID NO: 71375 - protein, 16 aa, Mycobacterium tuberculosis
WESVLPEELRRLPEEL

SEQ ID NO: 71376 - protein, 16 aa, Mycobacterium tuberculosis
ESVLPEELRRLPEELA

SEQ ID NO: 71377 - protein, 16 aa, Mycobacterium tuberculosis
SVLPEELRRLPEELAR

SEQ ID NO: 71378 - protein, 16 aa, Mycobacterium tuberculosis
VLPEELRRLPEELARV

SEQ ID NO: 71379 - protein, 16 aa, Mycobacterium tuberculosis
LPEELRRLPEELARVD

SEQ ID NO: 71380 - protein, 16 aa, Mycobacterium tuberculosis
PEELRRLPEELARVDA

SEQ ID NO: 71381 - protein, 16 aa, Mycobacterium tuberculosis
EELRRLPEELARVDAL

SEQ ID NO: 71382 - protein, 16 aa, Mycobacterium tuberculosis
ELRRLPEELARVDALL

SEQ ID NO: 71383 - protein, 16 aa, Mycobacterium tuberculosis
LRRLPEELARVDALLD

SEQ ID NO: 71384 - protein, 16 aa, Mycobacterium tuberculosis
RRLPEELARVDALLDD

SEQ ID NO: 71385 - protein, 16 aa, Mycobacterium tuberculosis
RLPEELARVDALLDDS

SEQ ID NO: 71386 - protein, 16 aa, Mycobacterium tuberculosis
LPEELARVDALLDDSA

SEQ ID NO: 71387 - protein, 16 aa, Mycobacterium tuberculosis
PEELARVDALLDDSAF

SEQ ID NO: 71388 - protein, 16 aa, Mycobacterium tuberculosis
EELARVDALLDDSAFF

SEQ ID NO: 71389 - protein, 16 aa, Mycobacterium tuberculosis
ELARVDALLDDSAFFC

SEQ ID NO: 71390 - protein, 16 aa, Mycobacterium tuberculosis
LARVDALLDDSAFFCP

SEQ ID NO: 71391 - protein, 16 aa, Mycobacterium tuberculosis
ARVDALLDDSAFFCPF

SEQ ID NO: 71392 - protein, 16 aa, Mycobacterium tuberculosis
RVDALLDDSAFFCPFV

SEQ ID NO: 71393 - protein, 16 aa, Mycobacterium tuberculosis
VDALLDDSAFFCPFVP

SEQ ID NO: 71394 - protein, 16 aa, Mycobacterium tuberculosis
DALLDDSAFFCPFVPF

SEQ ID NO: 71395 - protein, 16 aa, Mycobacterium tuberculosis
ALLDDSAFFCPFVPFF

SEQ ID NO: 71396 - protein, 16 aa, Mycobacterium tuberculosis
LLDDSAFFCPFVPFFD

SEQ ID NO: 71397 - protein, 16 aa, Mycobacterium tuberculosis
LDDSAFFCPFVPFFDP

SEQ ID NO: 71398 - protein, 16 aa, Mycobacterium tuberculosis
DDSAFFCPFVPFFDPR

SEQ ID NO: 71399 - protein, 16 aa, Mycobacterium tuberculosis
DSAFFCPFVPFFDPRM

SEQ ID NO: 71400 - protein, 16 aa, Mycobacterium tuberculosis
SAFFCPFVPFFDPRMG

SEQ ID NO: 71401 - protein, 16 aa, Mycobacterium tuberculosis
AFFCPFVPFFDPRMGR

SEQ ID NO: 71402 - protein, 16 aa, Mycobacterium tuberculosis
FFCPFVPFFDPRMGRP

SEQ ID NO: 71403 - protein, 16 aa, Mycobacterium tuberculosis
FCPFVPFFDPRMGRPS

SEQ ID NO: 71404 - protein, 16 aa, Mycobacterium tuberculosis
CPFVPFFDPRMGRPSI

SEQ ID NO: 71405 - protein, 16 aa, Mycobacterium tuberculosis
PFVPFFDPRMGRPSIP

SEQ ID NO: 71406 - protein, 16 aa, Mycobacterium tuberculosis
FVPFFDPRMGRPSIPM

SEQ ID NO: 71407 - protein, 16 aa, Mycobacterium tuberculosis
VPFFDPRMGRPSIPME

SEQ ID NO: 71408 - protein, 16 aa, Mycobacterium tuberculosis
PFFDPRMGRPSIPMET

SEQ ID NO: 71409 - protein, 16 aa, Mycobacterium tuberculosis
FFDPRMGRPSIPMETY

SEQ ID NO: 71410 - protein, 16 aa, Mycobacterium tuberculosis
FDPRMGRPSIPMETYL

SEQ ID NO: 71411 - protein, 16 aa, Mycobacterium tuberculosis
DPRMGRPSIPMETYLR

SEQ ID NO: 71412 - protein, 16 aa, Mycobacterium tuberculosis
PRMGRPSIPMETYLRL

SEQ ID NO: 71413 - protein, 16 aa, Mycobacterium tuberculosis
RMGRPSIPMETYLRLM

SEQ ID NO: 71414 - protein, 16 aa, Mycobacterium tuberculosis
MGRPSIPMETYLRLMF

SEQ ID NO: 71415 - protein, 16 aa, Mycobacterium tuberculosis
GRPSIPMETYLRLMFL

SEQ ID NO: 71416 - protein, 16 aa, Mycobacterium tuberculosis
RPSIPMETYLRLMFLK

SEQ ID NO: 71417 - protein, 16 aa, Mycobacterium tuberculosis
PSIPMETYLRLMFLKF

SEQ ID NO: 71418 - protein, 16 aa, Mycobacterium tuberculosis
SIPMETYLRLMFLKFR

SEQ ID NO: 71419 - protein, 16 aa, Mycobacterium tuberculosis
IPMETYLRLMFLKFRY

SEQ ID NO: 71420 - protein, 16 aa, Mycobacterium tuberculosis
PMETYLRLMFLKFRYR

SEQ ID NO: 71421 - protein, 16 aa, Mycobacterium tuberculosis
METYLRLMFLKFRYRL

SEQ ID NO: 71422 - protein, 16 aa, Mycobacterium tuberculosis
ETYLRLMFLKFRYRLG

SEQ ID NO: 71423 - protein, 16 aa, Mycobacterium tuberculosis
TYLRLMFLKFRYRLGY

SEQ ID NO: 71424 - protein, 16 aa, Mycobacterium tuberculosis
YLRLMFLKFRYRLGYE

SEQ ID NO: 71425 - protein, 16 aa, Mycobacterium tuberculosis
LRLMFLKFRYRLGYES

SEQ ID NO: 71426 - protein, 16 aa, Mycobacterium tuberculosis
RLMFLKFRYRLGYESL

SEQ ID NO: 71427 - protein, 16 aa, Mycobacterium tuberculosis
LMFLKFRYRLGYESLC

SEQ ID NO: 71428 - protein, 16 aa, Mycobacterium tuberculosis
MFLKFRYRLGYESLCR

SEQ ID NO: 71429 - protein, 16 aa, Mycobacterium tuberculosis
FLKFRYRLGYESLCRE

SEQ ID NO: 71430 - protein, 16 aa, Mycobacterium tuberculosis
LKFRYRLGYESLCREV

SEQ ID NO: 71431 - protein, 16 aa, Mycobacterium tuberculosis
KFRYRLGYESLCREVT

SEQ ID NO: 71432 - protein, 16 aa, Mycobacterium tuberculosis
FRYRLGYESLCREVTD

SEQ ID NO: 71433 - protein, 16 aa, Mycobacterium tuberculosis
RYRLGYESLCREVTDS

SEQ ID NO: 71434 - protein, 16 aa, Mycobacterium tuberculosis
YRLGYESLCREVTDSI

SEQ ID NO: 71435 - protein, 16 aa, Mycobacterium tuberculosis
RLGYESLCREVTDSIT

SEQ ID NO: 71436 - protein, 16 aa, Mycobacterium tuberculosis
LGYESLCREVTDSITW

SEQ ID NO: 71437 - protein, 16 aa, Mycobacterium tuberculosis
GYESLCREVTDSITWR

SEQ ID NO: 71438 - protein, 16 aa, Mycobacterium tuberculosis
YESLCREVTDSITWRR

SEQ ID NO: 71439 - protein, 16 aa, Mycobacterium tuberculosis
ESLCREVTDSITWRRF

SEQ ID NO: 71440 - protein, 16 aa, Mycobacterium tuberculosis
SLCREVTDSITWRRFC

SEQ ID NO: 71441 - protein, 16 aa, Mycobacterium tuberculosis
LCREVTDSITWRRFCR

SEQ ID NO: 71442 - protein, 16 aa, Mycobacterium tuberculosis
CREVTDSITWRRFCRI

SEQ ID NO: 71443 - protein, 16 aa, Mycobacterium tuberculosis
REVTDSITWRRFCRIP

SEQ ID NO: 71444 - protein, 16 aa, Mycobacterium tuberculosis
EVTDSITWRRFCRIPL

SEQ ID NO: 71445 - protein, 16 aa, Mycobacterium tuberculosis
VTDSITWRRFCRIPLE

SEQ ID NO: 71446 - protein, 16 aa, Mycobacterium tuberculosis
TDSITWRRFCRIPLEG

SEQ ID NO: 71447 - protein, 16 aa, Mycobacterium tuberculosis
DSITWRRFCRIPLEGS

SEQ ID NO: 71448 - protein, 16 aa, Mycobacterium tuberculosis
SITWRRFCRIPLEGSV

SEQ ID NO: 71449 - protein, 16 aa, Mycobacterium tuberculosis
ITWRRFCRIPLEGSVP

SEQ ID NO: 71450 - protein, 16 aa, Mycobacterium tuberculosis
TWRRFCRIPLEGSVPH

SEQ ID NO: 71451 - protein, 16 aa, Mycobacterium tuberculosis
WRRFCRIPLEGSVPHP

SEQ ID NO: 71452 - protein, 16 aa, Mycobacterium tuberculosis
RRFCRIPLEGSVPHPT

SEQ ID NO: 71453 - protein, 16 aa, Mycobacterium tuberculosis
RFCRIPLEGSVPHPTT

SEQ ID NO: 71454 - protein, 16 aa, Mycobacterium tuberculosis
FCRIPLEGSVPHPTTL

SEQ ID NO: 71455 - protein, 16 aa, Mycobacterium tuberculosis
CRIPLEGSVPHPTTLM

SEQ ID NO: 71456 - protein, 16 aa, Mycobacterium tuberculosis
RIPLEGSVPHPTTLMK

SEQ ID NO: 71457 - protein, 16 aa, Mycobacterium tuberculosis
IPLEGSVPHPTTLMKL

SEQ ID NO: 71458 - protein, 16 aa, Mycobacterium tuberculosis
PLEGSVPHPTTLMKLT

SEQ ID NO: 71459 - protein, 16 aa, Mycobacterium tuberculosis
LEGSVPHPTTLMKLTT

SEQ ID NO: 71460 - protein, 16 aa, Mycobacterium tuberculosis
EGSVPHPTTLMKLTTR

SEQ ID NO: 71461 - protein, 16 aa, Mycobacterium tuberculosis
GSVPHPTTLMKLTTRC

SEQ ID NO: 71462 - protein, 16 aa, Mycobacterium tuberculosis
SVPHPTTLMKLTTRCG

SEQ ID NO: 71463 - protein, 16 aa, Mycobacterium tuberculosis
VPHPTTLMKLTTRCGE

SEQ ID NO: 71464 - protein, 16 aa, Mycobacterium tuberculosis
PHPTTLMKLTTRCGED

SEQ ID NO: 71465 - protein, 16 aa, Mycobacterium tuberculosis
HPTTLMKLTTRCGEDA

SEQ ID NO: 71466 - protein, 16 aa, Mycobacterium tuberculosis
PTTLMKLTTRCGEDAV

SEQ ID NO: 71467 - protein, 16 aa, Mycobacterium tuberculosis
TTLMKLTTRCGEDAVA

SEQ ID NO: 71468 - protein, 16 aa, Mycobacterium tuberculosis
TLMKLTTRCGEDAVAG

SEQ ID NO: 71469 - protein, 16 aa, Mycobacterium tuberculosis
LMKLTTRCGEDAVAGL

SEQ ID NO: 71470 - protein, 16 aa, Mycobacterium tuberculosis
MKLTTRCGEDAVAGLN

SEQ ID NO: 71471 - protein, 16 aa, Mycobacterium tuberculosis
KLTTRCGEDAVAGLNE

SEQ ID NO: 71472 - protein, 16 aa, Mycobacterium tuberculosis
LTTRCGEDAVAGLNEA

SEQ ID NO: 71473 - protein, 16 aa, Mycobacterium tuberculosis
TTRCGEDAVAGLNEAL

SEQ ID NO: 71474 - protein, 16 aa, Mycobacterium tuberculosis
TRCGEDAVAGLNEALL

SEQ ID NO: 71475 - protein, 16 aa, Mycobacterium tuberculosis
RCGEDAVAGLNEALLA

SEQ ID NO: 71476 - protein, 16 aa, Mycobacterium tuberculosis
CGEDAVAGLNEALLAK

SEQ ID NO: 71477 - protein, 16 aa, Mycobacterium tuberculosis
GEDAVAGLNEALLAKA

SEQ ID NO: 71478 - protein, 16 aa, Mycobacterium tuberculosis
EDAVAGLNEALLAKAA

SEQ ID NO: 71479 - protein, 16 aa, Mycobacterium tuberculosis
DAVAGLNEALLAKAAS

SEQ ID NO: 71480 - protein, 16 aa, Mycobacterium tuberculosis
AVAGLNEALLAKAASE

SEQ ID NO: 71481 - protein, 16 aa, Mycobacterium tuberculosis
VAGLNEALLAKAASEK

SEQ ID NO: 71482 - protein, 16 aa, Mycobacterium tuberculosis
AGLNEALLAKAASEKL

SEQ ID NO: 71483 - protein, 16 aa, Mycobacterium tuberculosis
GLNEALLAKAASEKLL

SEQ ID NO: 71484 - protein, 16 aa, Mycobacterium tuberculosis
LNEALLAKAASEKLLR

SEQ ID NO: 71485 - protein, 16 aa, Mycobacterium tuberculosis
NEALLAKAASEKLLRT

SEQ ID NO: 71486 - protein, 16 aa, Mycobacterium tuberculosis
EALLAKAASEKLLRTN

SEQ ID NO: 71487 - protein, 16 aa, Mycobacterium tuberculosis
ALLAKAASEKLLRTNK

SEQ ID NO: 71488 - protein, 16 aa, Mycobacterium tuberculosis
LLAKAASEKLLRTNKV

SEQ ID NO: 71489 - protein, 16 aa, Mycobacterium tuberculosis
LAKAASEKLLRTNKVR

SEQ ID NO: 71490 - protein, 16 aa, Mycobacterium tuberculosis
AKAASEKLLRTNKVRA

SEQ ID NO: 71491 - protein, 16 aa, Mycobacterium tuberculosis
KAASEKLLRTNKVRAD

SEQ ID NO: 71492 - protein, 16 aa, Mycobacterium tuberculosis
AASEKLLRTNKVRADT

SEQ ID NO: 71493 - protein, 16 aa, Mycobacterium tuberculosis
ASEKLLRTNKVRADTT

SEQ ID NO: 71494 - protein, 16 aa, Mycobacterium tuberculosis
SEKLLRTNKVRADTTV

SEQ ID NO: 71495 - protein, 16 aa, Mycobacterium tuberculosis
EKLLRTNKVRADTTVV

SEQ ID NO: 71496 - protein, 16 aa, Mycobacterium tuberculosis
KLLRTNKVRADTTVVE

SEQ ID NO: 71497 - protein, 16 aa, Mycobacterium tuberculosis
LLRTNKVRADTTVVEG

SEQ ID NO: 71498 - protein, 16 aa, Mycobacterium tuberculosis
LRTNKVRADTTVVEGD

SEQ ID NO: 71499 - protein, 16 aa, Mycobacterium tuberculosis
RTNKVRADTTVVEGDV

SEQ ID NO: 71500 - protein, 16 aa, Mycobacterium tuberculosis
TNKVRADTTVVEGDVG

SEQ ID NO: 71501 - protein, 16 aa, Mycobacterium tuberculosis
NKVRADTTVVEGDVGY

SEQ ID NO: 71502 - protein, 16 aa, Mycobacterium tuberculosis
KVRADTTVVEGDVGYP

SEQ ID NO: 71503 - protein, 16 aa, Mycobacterium tuberculosis
VRADTTVVEGDVGYPT

SEQ ID NO: 71504 - protein, 16 aa, Mycobacterium tuberculosis
RADTTVVEGDVGYPTD

SEQ ID NO: 71505 - protein, 16 aa, Mycobacterium tuberculosis
ADTTVVEGDVGYPTDT

SEQ ID NO: 71506 - protein, 16 aa, Mycobacterium tuberculosis
DTTVVEGDVGYPTDTG

SEQ ID NO: 71507 - protein, 16 aa, Mycobacterium tuberculosis
TTVVEGDVGYPTDTGL

SEQ ID NO: 71508 - protein, 16 aa, Mycobacterium tuberculosis
TVVEGDVGYPTDTGLL

SEQ ID NO: 71509 - protein, 16 aa, Mycobacterium tuberculosis
VVEGDVGYPTDTGLLA

SEQ ID NO: 71510 - protein, 16 aa, Mycobacterium tuberculosis
VEGDVGYPTDTGLLAK

SEQ ID NO: 71511 - protein, 16 aa, Mycobacterium tuberculosis
EGDVGYPTDTGLLAKA

SEQ ID NO: 71512 - protein, 16 aa, Mycobacterium tuberculosis
GDVGYPTDTGLLAKAV

SEQ ID NO: 71513 - protein, 16 aa, Mycobacterium tuberculosis
DVGYPTDTGLLAKAVG

SEQ ID NO: 71514 - protein, 16 aa, Mycobacterium tuberculosis
VGYPTDTGLLAKAVGS

SEQ ID NO: 71515 - protein, 16 aa, Mycobacterium tuberculosis
GYPTDTGLLAKAVGSM

SEQ ID NO: 71516 - protein, 16 aa, Mycobacterium tuberculosis
YPTDTGLLAKAVGSMA

SEQ ID NO: 71517 - protein, 16 aa, Mycobacterium tuberculosis
PTDTGLLAKAVGSMAR

SEQ ID NO: 71518 - protein, 16 aa, Mycobacterium tuberculosis
TDTGLLAKAVGSMART

SEQ ID NO: 71519 - protein, 16 aa, Mycobacterium tuberculosis
DTGLLAKAVGSMARTV

SEQ ID NO: 71520 - protein, 16 aa, Mycobacterium tuberculosis
TGLLAKAVGSMARTVA

SEQ ID NO: 71521 - protein, 16 aa, Mycobacterium tuberculosis
GLLAKAVGSMARTVAR

SEQ ID NO: 71522 - protein, 16 aa, Mycobacterium tuberculosis
LLAKAVGSMARTVARI

SEQ ID NO: 71523 - protein, 16 aa, Mycobacterium tuberculosis
LAKAVGSMARTVARIK

SEQ ID NO: 71524 - protein, 16 aa, Mycobacterium tuberculosis
AKAVGSMARTVARIKA

SEQ ID NO: 71525 - protein, 16 aa, Mycobacterium tuberculosis
KAVGSMARTVARIKAA

SEQ ID NO: 71526 - protein, 16 aa, Mycobacterium tuberculosis
AVGSMARTVARIKAAD

SEQ ID NO: 71527 - protein, 16 aa, Mycobacterium tuberculosis
VGSMARTVARIKAADA

SEQ ID NO: 71528 - protein, 16 aa, Mycobacterium tuberculosis
GSMARTVARIKAADAG

SEQ ID NO: 71529 - protein, 16 aa, Mycobacterium tuberculosis
SMARTVARIKAADAGS

SEQ ID NO: 71530 - protein, 16 aa, Mycobacterium tuberculosis
MARTVARIKAADAGSA

SEQ ID NO: 71531 - protein, 16 aa, Mycobacterium tuberculosis
ARTVARIKAADAGSAP

SEQ ID NO: 71532 - protein, 16 aa, Mycobacterium tuberculosis
RTVARIKAADAGSAPL

SEQ ID NO: 71533 - protein, 16 aa, Mycobacterium tuberculosis
TVARIKAADAGSAPLG

SEQ ID NO: 71534 - protein, 16 aa, Mycobacterium tuberculosis
VARIKAADAGSAPLGG

SEQ ID NO: 71535 - protein, 16 aa, Mycobacterium tuberculosis
ARIKAADAGSAPLGGS

SEQ ID NO: 71536 - protein, 16 aa, Mycobacterium tuberculosis
RIKAADAGSAPLGGSS

SEQ ID NO: 71537 - protein, 16 aa, Mycobacterium tuberculosis
IKAADAGSAPLGGSSG

SEQ ID NO: 71538 - protein, 16 aa, Mycobacterium tuberculosis
KAADAGSAPLGGSSGP

SEQ ID NO: 71539 - protein, 16 aa, Mycobacterium tuberculosis
AADAGSAPLGGSSGPR

SEQ ID NO: 71540 - protein, 16 aa, Mycobacterium tuberculosis
ADAGSAPLGGSSGPRD

SEQ ID NO: 71541 - protein, 16 aa, Mycobacterium tuberculosis
DAGSAPLGGSSGPRDR

SEQ ID NO: 71542 - protein, 16 aa, Mycobacterium tuberculosis
AGSAPLGGSSGPRDRL

SEQ ID NO: 71543 - protein, 16 aa, Mycobacterium tuberculosis
GSAPLGGSSGPRDRLQ

SEQ ID NO: 71544 - protein, 16 aa, Mycobacterium tuberculosis
SAPLGGSSGPRDRLQA

SEQ ID NO: 71545 - protein, 16 aa, Mycobacterium tuberculosis
APLGGSSGPRDRLQAA

SEQ ID NO: 71546 - protein, 16 aa, Mycobacterium tuberculosis
PLGGSSGPRDRLQAAV

SEQ ID NO: 71547 - protein, 16 aa, Mycobacterium tuberculosis
LGGSSGPRDRLQAAVT

SEQ ID NO: 71548 - protein, 16 aa, Mycobacterium tuberculosis
GGSSGPRDRLQAAVTR

SEQ ID NO: 71549 - protein, 16 aa, Mycobacterium tuberculosis
GSSGPRDRLQAAVTRR

SEQ ID NO: 71550 - protein, 16 aa, Mycobacterium tuberculosis
SSGPRDRLQAAVTRRA

SEQ ID NO: 71551 - protein, 16 aa, Mycobacterium tuberculosis
SGPRDRLQAAVTRRAA

SEQ ID NO: 71552 - protein, 16 aa, Mycobacterium tuberculosis
GPRDRLQAAVTRRAAT

SEQ ID NO: 71553 - protein, 16 aa, Mycobacterium tuberculosis
PRDRLQAAVTRRAATR

SEQ ID NO: 71554 - protein, 16 aa, Mycobacterium tuberculosis
RDRLQAAVTRRAATRS

SEQ ID NO: 71555 - protein, 16 aa, Mycobacterium tuberculosis
DRLQAAVTRRAATRSG

SEQ ID NO: 71556 - protein, 16 aa, Mycobacterium tuberculosis
RLQAAVTRRAATRSGA

SEQ ID NO: 71557 - protein, 16 aa, Mycobacterium tuberculosis
LQAAVTRRAATRSGAG

SEQ ID NO: 71558 - protein, 16 aa, Mycobacterium tuberculosis
QAAVTRRAATRSGAGL

SEQ ID NO: 71559 - protein, 16 aa, Mycobacterium tuberculosis
AAVTRRAATRSGAGLR

SEQ ID NO: 71560 - protein, 16 aa, Mycobacterium tuberculosis
AVTRRAATRSGAGLRA

SEQ ID NO: 71561 - protein, 16 aa, Mycobacterium tuberculosis
VTRRAATRSGAGLRAP

SEQ ID NO: 71562 - protein, 16 aa, Mycobacterium tuberculosis
TRRAATRSGAGLRAPD

SEQ ID NO: 71563 - protein, 16 aa, Mycobacterium tuberculosis
RRAATRSGAGLRAPDH

SEQ ID NO: 71564 - protein, 16 aa, Mycobacterium tuberculosis
RAATRSGAGLRAPDHR

SEQ ID NO: 71565 - protein, 16 aa, Mycobacterium tuberculosis
AATRSGAGLRAPDHRG

SEQ ID NO: 71566 - protein, 16 aa, Mycobacterium tuberculosis
ATRSGAGLRAPDHRGA

SEQ ID NO: 71567 - protein, 16 aa, Mycobacterium tuberculosis
TRSGAGLRAPDHRGAS

SEQ ID NO: 71568 - protein, 16 aa, Mycobacterium tuberculosis
RSGAGLRAPDHRGASR

SEQ ID NO: 71569 - protein, 16 aa, Mycobacterium tuberculosis
SGAGLRAPDHRGASRD

SEQ ID NO: 71570 - protein, 16 aa, Mycobacterium tuberculosis
GAGLRAPDHRGASRDR

SEQ ID NO: 71571 - protein, 16 aa, Mycobacterium tuberculosis
AGLRAPDHRGASRDRR

SEQ ID NO: 71572 - protein, 16 aa, Mycobacterium tuberculosis
GLRAPDHRGASRDRRA

SEQ ID NO: 71573 - protein, 16 aa, Mycobacterium tuberculosis
LRAPDHRGASRDRRAG

SEQ ID NO: 71574 - protein, 16 aa, Mycobacterium tuberculosis
RAPDHRGASRDRRAGA

SEQ ID NO: 71575 - protein, 16 aa, Mycobacterium tuberculosis
APDHRGASRDRRAGAD

SEQ ID NO: 71576 - protein, 16 aa, Mycobacterium tuberculosis
PDHRGASRDRRAGADR

SEQ ID NO: 71577 - protein, 16 aa, Mycobacterium tuberculosis
DHRGASRDRRAGADRG

SEQ ID NO: 71578 - protein, 16 aa, Mycobacterium tuberculosis
HRGASRDRRAGADRGC

SEQ ID NO: 71579 - protein, 16 aa, Mycobacterium tuberculosis
RGASRDRRAGADRGCR

SEQ ID NO: 71580 - protein, 16 aa, Mycobacterium tuberculosis
GASRDRRAGADRGCRG

SEQ ID NO: 71581 - protein, 16 aa, Mycobacterium tuberculosis
ASRDRRAGADRGCRGG

SEQ ID NO: 71582 - protein, 16 aa, Mycobacterium tuberculosis
SRDRRAGADRGCRGGT

SEQ ID NO: 71583 - protein, 13 aa, Mycobacterium tuberculosis
MTINYQFGDVDAH

SEQ ID NO: 71584 - protein, 13 aa, Mycobacterium tuberculosis
TINYQFGDVDAHG

SEQ ID NO: 71585 - protein, 13 aa, Mycobacterium tuberculosis
INYQFGDVDAHGA

SEQ ID NO: 71586 - protein, 13 aa, Mycobacterium tuberculosis
NYQFGDVDAHGAM

SEQ ID NO: 71587 - protein, 13 aa, Mycobacterium tuberculosis
YQFGDVDAHGAMI

SEQ ID NO: 71588 - protein, 13 aa, Mycobacterium tuberculosis
QFGDVDAHGAMIR

SEQ ID NO: 71589 - protein, 13 aa, Mycobacterium tuberculosis
FGDVDAHGAMIRA

SEQ ID NO: 71590 - protein, 13 aa, Mycobacterium tuberculosis
GDVDAHGAMIRAQ

SEQ ID NO: 71591 - protein, 13 aa, Mycobacterium tuberculosis
DVDAHGAMIRAQA

SEQ ID NO: 71592 - protein, 13 aa, Mycobacterium tuberculosis
VDAHGAMIRAQAG

SEQ ID NO: 71593 - protein, 13 aa, Mycobacterium tuberculosis
DAHGAMIRAQAGS

SEQ ID NO: 71594 - protein, 13 aa, Mycobacterium tuberculosis
AHGAMIRAQAGSL

SEQ ID NO: 71595 - protein, 13 aa, Mycobacterium tuberculosis
HGAMIRAQAGSLE

SEQ ID NO: 71596 - protein, 13 aa, Mycobacterium tuberculosis
GAMIRAQAGSLEA

SEQ ID NO: 71597 - protein, 13 aa, Mycobacterium tuberculosis
AMIRAQAGSLEAE

SEQ ID NO: 71598 - protein, 13 aa, Mycobacterium tuberculosis
MIRAQAGSLEAEH

SEQ ID NO: 71599 - protein, 13 aa, Mycobacterium tuberculosis
IRAQAGSLEAEHQ

SEQ ID NO: 71600 - protein, 13 aa, Mycobacterium tuberculosis
RAQAGSLEAEHQA

SEQ ID NO: 71601 - protein, 13 aa, Mycobacterium tuberculosis
AQAGSLEAEHQAI

SEQ ID NO: 71602 - protein, 13 aa, Mycobacterium tuberculosis
QAGSLEAEHQAII

SEQ ID NO: 71603 - protein, 13 aa, Mycobacterium tuberculosis
AGSLEAEHQAIIS

SEQ ID NO: 71604 - protein, 13 aa, Mycobacterium tuberculosis
GSLEAEHQAIISD

SEQ ID NO: 71605 - protein, 13 aa, Mycobacterium tuberculosis
SLEAEHQAIISDV

SEQ ID NO: 71606 - protein, 13 aa, Mycobacterium tuberculosis
LEAEHQAIISDVL

SEQ ID NO: 71607 - protein, 13 aa, Mycobacterium tuberculosis
EAEHQAIISDVLT

SEQ ID NO: 71608 - protein, 13 aa, Mycobacterium tuberculosis
AEHQAIISDVLTA

SEQ ID NO: 71609 - protein, 13 aa, Mycobacterium tuberculosis
EHQAIISDVLTAS

SEQ ID NO: 71610 - protein, 13 aa, Mycobacterium tuberculosis
HQAIISDVLTASD

SEQ ID NO: 71611 - protein, 13 aa, Mycobacterium tuberculosis
QAIISDVLTASDF

SEQ ID NO: 71612 - protein, 13 aa, Mycobacterium tuberculosis
AIISDVLTASDFW

SEQ ID NO: 71613 - protein, 13 aa, Mycobacterium tuberculosis
IISDVLTASDFWG

SEQ ID NO: 71614 - protein, 13 aa, Mycobacterium tuberculosis
ISDVLTASDFWGG

SEQ ID NO: 71615 - protein, 13 aa, Mycobacterium tuberculosis
SDVLTASDFWGGA

SEQ ID NO: 71616 - protein, 13 aa, Mycobacterium tuberculosis
DVLTASDFWGGAG

SEQ ID NO: 71617 - protein, 13 aa, Mycobacterium tuberculosis
VLTASDFWGGAGS

SEQ ID NO: 71618 - protein, 13 aa, Mycobacterium tuberculosis
LTASDFWGGAGSA

SEQ ID NO: 71619 - protein, 13 aa, Mycobacterium tuberculosis
TASDFWGGAGSAA

SEQ ID NO: 71620 - protein, 13 aa, Mycobacterium tuberculosis
ASDFWGGAGSAAC

SEQ ID NO: 71621 - protein, 13 aa, Mycobacterium tuberculosis
SDFWGGAGSAACQ

SEQ ID NO: 71622 - protein, 13 aa, Mycobacterium tuberculosis
DFWGGAGSAACQG

SEQ ID NO: 71623 - protein, 13 aa, Mycobacterium tuberculosis
FWGGAGSAACQGF

SEQ ID NO: 71624 - protein, 13 aa, Mycobacterium tuberculosis
WGGAGSAACQGFI

SEQ ID NO: 71625 - protein, 13 aa, Mycobacterium tuberculosis
GGAGSAACQGFIT

SEQ ID NO: 71626 - protein, 13 aa, Mycobacterium tuberculosis
GAGSAACQGFITQ

SEQ ID NO: 71627 - protein, 13 aa, Mycobacterium tuberculosis
AGSAACQGFITQL

SEQ ID NO: 71628 - protein, 13 aa, Mycobacterium tuberculosis
GSAACQGFITQLG

SEQ ID NO: 71629 - protein, 13 aa, Mycobacterium tuberculosis
SAACQGFITQLGR

SEQ ID NO: 71630 - protein, 13 aa, Mycobacterium tuberculosis
AACQGFITQLGRN

SEQ ID NO: 71631 - protein, 13 aa, Mycobacterium tuberculosis
ACQGFITQLGRNF

SEQ ID NO: 71632 - protein, 13 aa, Mycobacterium tuberculosis
CQGFITQLGRNFQ

SEQ ID NO: 71633 - protein, 13 aa, Mycobacterium tuberculosis
QGFITQLGRNFQV

SEQ ID NO: 71634 - protein, 13 aa, Mycobacterium tuberculosis
GFITQLGRNFQVI

SEQ ID NO: 71635 - protein, 13 aa, Mycobacterium tuberculosis
FITQLGRNFQVIY

SEQ ID NO: 71636 - protein, 13 aa, Mycobacterium tuberculosis
ITQLGRNFQVIYE

SEQ ID NO: 71637 - protein, 13 aa, Mycobacterium tuberculosis
TQLGRNFQVIYEQ

SEQ ID NO: 71638 - protein, 13 aa, Mycobacterium tuberculosis
QLGRNFQVIYEQA

SEQ ID NO: 71639 - protein, 13 aa, Mycobacterium tuberculosis
LGRNFQVIYEQAN

SEQ ID NO: 71640 - protein, 13 aa, Mycobacterium tuberculosis
GRNFQVIYEQANA

SEQ ID NO: 71641 - protein, 13 aa, Mycobacterium tuberculosis
RNFQVIYEQANAH

SEQ ID NO: 71642 - protein, 13 aa, Mycobacterium tuberculosis
NFQVIYEQANAHG

SEQ ID NO: 71643 - protein, 13 aa, Mycobacterium tuberculosis
FQVIYEQANAHGQ

SEQ ID NO: 71644 - protein, 13 aa, Mycobacterium tuberculosis
QVIYEQANAHGQK

SEQ ID NO: 71645 - protein, 13 aa, Mycobacterium tuberculosis
VIYEQANAHGQKV

SEQ ID NO: 71646 - protein, 13 aa, Mycobacterium tuberculosis
IYEQANAHGQKVQ

SEQ ID NO: 71647 - protein, 13 aa, Mycobacterium tuberculosis
YEQANAHGQKVQA

SEQ ID NO: 71648 - protein, 13 aa, Mycobacterium tuberculosis
EQANAHGQKVQAA

SEQ ID NO: 71649 - protein, 13 aa, Mycobacterium tuberculosis
QANAHGQKVQAAG

SEQ ID NO: 71650 - protein, 13 aa, Mycobacterium tuberculosis
ANAHGQKVQAAGN

SEQ ID NO: 71651 - protein, 13 aa, Mycobacterium tuberculosis
NAHGQKVQAAGNN

SEQ ID NO: 71652 - protein, 13 aa, Mycobacterium tuberculosis
AHGQKVQAAGNNM

SEQ ID NO: 71653 - protein, 13 aa, Mycobacterium tuberculosis
HGQKVQAAGNNMA

SEQ ID NO: 71654 - protein, 13 aa, Mycobacterium tuberculosis
GQKVQAAGNNMAQ

SEQ ID NO: 71655 - protein, 13 aa, Mycobacterium tuberculosis
QKVQAAGNNMAQT

SEQ ID NO: 71656 - protein, 13 aa, Mycobacterium tuberculosis
KVQAAGNNMAQTD

SEQ ID NO: 71657 - protein, 13 aa, Mycobacterium tuberculosis
VQAAGNNMAQTDS

SEQ ID NO: 71658 - protein, 13 aa, Mycobacterium tuberculosis
QAAGNNMAQTDSA

SEQ ID NO: 71659 - protein, 13 aa, Mycobacterium tuberculosis
AAGNNMAQTDSAV

SEQ ID NO: 71660 - protein, 13 aa, Mycobacterium tuberculosis
AGNNMAQTDSAVG

SEQ ID NO: 71661 - protein, 13 aa, Mycobacterium tuberculosis
GNNMAQTDSAVGS

SEQ ID NO: 71662 - protein, 13 aa, Mycobacterium tuberculosis
NNMAQTDSAVGSS

SEQ ID NO: 71663 - protein, 13 aa, Mycobacterium tuberculosis
NMAQTDSAVGSSW

SEQ ID NO: 71664 - protein, 13 aa, Mycobacterium tuberculosis
MAQTDSAVGSSWA

SEQ ID NO: 71665 - protein, 14 aa, Mycobacterium tuberculosis
MTINYQFGDVDAHG

SEQ ID NO: 71666 - protein, 14 aa, Mycobacterium tuberculosis
TINYQFGDVDAHGA

SEQ ID NO: 71667 - protein, 14 aa, Mycobacterium tuberculosis
INYQFGDVDAHGAM

SEQ ID NO: 71668 - protein, 14 aa, Mycobacterium tuberculosis
NYQFGDVDAHGAMI

SEQ ID NO: 71669 - protein, 14 aa, Mycobacterium tuberculosis
YQFGDVDAHGAMIR

SEQ ID NO: 71670 - protein, 14 aa, Mycobacterium tuberculosis
QFGDVDAHGAMIRA

SEQ ID NO: 71671 - protein, 14 aa, Mycobacterium tuberculosis
FGDVDAHGAMIRAQ

SEQ ID NO: 71672 - protein, 14 aa, Mycobacterium tuberculosis
GDVDAHGAMIRAQA

SEQ ID NO: 71673 - protein, 14 aa, Mycobacterium tuberculosis
DVDAHGAMIRAQAG

SEQ ID NO: 71674 - protein, 14 aa, Mycobacterium tuberculosis
VDAHGAMIRAQAGS

SEQ ID NO: 71675 - protein, 14 aa, Mycobacterium tuberculosis
DAHGAMIRAQAGSL

SEQ ID NO: 71676 - protein, 14 aa, Mycobacterium tuberculosis
AHGAMIRAQAGSLE

SEQ ID NO: 71677 - protein, 14 aa, Mycobacterium tuberculosis
HGAMIRAQAGSLEA

SEQ ID NO: 71678 - protein, 14 aa, Mycobacterium tuberculosis
GAMIRAQAGSLEAE

SEQ ID NO: 71679 - protein, 14 aa, Mycobacterium tuberculosis
AMIRAQAGSLEAEH

SEQ ID NO: 71680 - protein, 14 aa, Mycobacterium tuberculosis
MIRAQAGSLEAEHQ

SEQ ID NO: 71681 - protein, 14 aa, Mycobacterium tuberculosis
IRAQAGSLEAEHQA

SEQ ID NO: 71682 - protein, 14 aa, Mycobacterium tuberculosis
RAQAGSLEAEHQAI

SEQ ID NO: 71683 - protein, 14 aa, Mycobacterium tuberculosis
AQAGSLEAEHQAII

SEQ ID NO: 71684 - protein, 14 aa, Mycobacterium tuberculosis
QAGSLEAEHQAIIS

SEQ ID NO: 71685 - protein, 14 aa, Mycobacterium tuberculosis
AGSLEAEHQAIISD

SEQ ID NO: 71686 - protein, 14 aa, Mycobacterium tuberculosis
GSLEAEHQAIISDV

SEQ ID NO: 71687 - protein, 14 aa, Mycobacterium tuberculosis
SLEAEHQAIISDVL

SEQ ID NO: 71688 - protein, 14 aa, Mycobacterium tuberculosis
LEAEHQAIISDVLT

SEQ ID NO: 71689 - protein, 14 aa, Mycobacterium tuberculosis
EAEHQAIISDVLTA

SEQ ID NO: 71690 - protein, 14 aa, Mycobacterium tuberculosis
AEHQAIISDVLTAS

SEQ ID NO: 71691 - protein, 14 aa, Mycobacterium tuberculosis
EHQAIISDVLTASD

SEQ ID NO: 71692 - protein, 14 aa, Mycobacterium tuberculosis
HQAIISDVLTASDF

SEQ ID NO: 71693 - protein, 14 aa, Mycobacterium tuberculosis
QAIISDVLTASDFW

SEQ ID NO: 71694 - protein, 14 aa, Mycobacterium tuberculosis
AIISDVLTASDFWG

SEQ ID NO: 71695 - protein, 14 aa, Mycobacterium tuberculosis
IISDVLTASDFWGG

SEQ ID NO: 71696 - protein, 14 aa, Mycobacterium tuberculosis
ISDVLTASDFWGGA

SEQ ID NO: 71697 - protein, 14 aa, Mycobacterium tuberculosis
SDVLTASDFWGGAG

SEQ ID NO: 71698 - protein, 14 aa, Mycobacterium tuberculosis
DVLTASDFWGGAGS

SEQ ID NO: 71699 - protein, 14 aa, Mycobacterium tuberculosis
VLTASDFWGGAGSA

SEQ ID NO: 71700 - protein, 14 aa, Mycobacterium tuberculosis
LTASDFWGGAGSAA

SEQ ID NO: 71701 - protein, 14 aa, Mycobacterium tuberculosis
TASDFWGGAGSAAC

SEQ ID NO: 71702 - protein, 14 aa, Mycobacterium tuberculosis
ASDFWGGAGSAACQ

SEQ ID NO: 71703 - protein, 14 aa, Mycobacterium tuberculosis
SDFWGGAGSAACQG

SEQ ID NO: 71704 - protein, 14 aa, Mycobacterium tuberculosis
DFWGGAGSAACQGF

SEQ ID NO: 71705 - protein, 14 aa, Mycobacterium tuberculosis
FWGGAGSAACQGFI

SEQ ID NO: 71706 - protein, 14 aa, Mycobacterium tuberculosis
WGGAGSAACQGFIT

SEQ ID NO: 71707 - protein, 14 aa, Mycobacterium tuberculosis
GGAGSAACQGFITQ

SEQ ID NO: 71708 - protein, 14 aa, Mycobacterium tuberculosis
GAGSAACQGFITQL

SEQ ID NO: 71709 - protein, 14 aa, Mycobacterium tuberculosis
AGSAACQGFITQLG

SEQ ID NO: 71710 - protein, 14 aa, Mycobacterium tuberculosis
GSAACQGFITQLGR

SEQ ID NO: 71711 - protein, 14 aa, Mycobacterium tuberculosis
SAACQGFITQLGRN

SEQ ID NO: 71712 - protein, 14 aa, Mycobacterium tuberculosis
AACQGFITQLGRNF

SEQ ID NO: 71713 - protein, 14 aa, Mycobacterium tuberculosis
ACQGFITQLGRNFQ

SEQ ID NO: 71714 - protein, 14 aa, Mycobacterium tuberculosis
CQGFITQLGRNFQV

SEQ ID NO: 71715 - protein, 14 aa, Mycobacterium tuberculosis
QGFITQLGRNFQVI

SEQ ID NO: 71716 - protein, 14 aa, Mycobacterium tuberculosis
GFITQLGRNFQVIY

SEQ ID NO: 71717 - protein, 14 aa, Mycobacterium tuberculosis
FITQLGRNFQVIYE

SEQ ID NO: 71718 - protein, 14 aa, Mycobacterium tuberculosis
ITQLGRNFQVIYEQ

SEQ ID NO: 71719 - protein, 14 aa, Mycobacterium tuberculosis
TQLGRNFQVIYEQA

SEQ ID NO: 71720 - protein, 14 aa, Mycobacterium tuberculosis
QLGRNFQVIYEQAN

SEQ ID NO: 71721 - protein, 14 aa, Mycobacterium tuberculosis
LGRNFQVIYEQANA

SEQ ID NO: 71722 - protein, 14 aa, Mycobacterium tuberculosis
GRNFQVIYEQANAH

SEQ ID NO: 71723 - protein, 14 aa, Mycobacterium tuberculosis
RNFQVIYEQANAHG

SEQ ID NO: 71724 - protein, 14 aa, Mycobacterium tuberculosis
NFQVIYEQANAHGQ

SEQ ID NO: 71725 - protein, 14 aa, Mycobacterium tuberculosis
FQVIYEQANAHGQK

SEQ ID NO: 71726 - protein, 14 aa, Mycobacterium tuberculosis
QVIYEQANAHGQKV

SEQ ID NO: 71727 - protein, 14 aa, Mycobacterium tuberculosis
VIYEQANAHGQKVQ

SEQ ID NO: 71728 - protein, 14 aa, Mycobacterium tuberculosis
IYEQANAHGQKVQA

SEQ ID NO: 71729 - protein, 14 aa, Mycobacterium tuberculosis
YEQANAHGQKVQAA

SEQ ID NO: 71730 - protein, 14 aa, Mycobacterium tuberculosis
EQANAHGQKVQAAG

SEQ ID NO: 71731 - protein, 14 aa, Mycobacterium tuberculosis
QANAHGQKVQAAGN

SEQ ID NO: 71732 - protein, 14 aa, Mycobacterium tuberculosis
ANAHGQKVQAAGNN

SEQ ID NO: 71733 - protein, 14 aa, Mycobacterium tuberculosis
NAHGQKVQAAGNNM

SEQ ID NO: 71734 - protein, 14 aa, Mycobacterium tuberculosis
AHGQKVQAAGNNMA

SEQ ID NO: 71735 - protein, 14 aa, Mycobacterium tuberculosis
HGQKVQAAGNNMAQ

SEQ ID NO: 71736 - protein, 14 aa, Mycobacterium tuberculosis
GQKVQAAGNNMAQT

SEQ ID NO: 71737 - protein, 14 aa, Mycobacterium tuberculosis
QKVQAAGNNMAQTD

SEQ ID NO: 71738 - protein, 14 aa, Mycobacterium tuberculosis
KVQAAGNNMAQTDS

SEQ ID NO: 71739 - protein, 14 aa, Mycobacterium tuberculosis
VQAAGNNMAQTDSA

SEQ ID NO: 71740 - protein, 14 aa, Mycobacterium tuberculosis
QAAGNNMAQTDSAV

SEQ ID NO: 71741 - protein, 14 aa, Mycobacterium tuberculosis
AAGNNMAQTDSAVG

SEQ ID NO: 71742 - protein, 14 aa, Mycobacterium tuberculosis
AGNNMAQTDSAVGS

SEQ ID NO: 71743 - protein, 14 aa, Mycobacterium tuberculosis
GNNMAQTDSAVGSS

SEQ ID NO: 71744 - protein, 14 aa, Mycobacterium tuberculosis
NNMAQTDSAVGSSW

SEQ ID NO: 71745 - protein, 14 aa, Mycobacterium tuberculosis
NMAQTDSAVGSSWA

SEQ ID NO: 71746 - protein, 15 aa, Mycobacterium tuberculosis
MTINYQFGDVDAHGA

SEQ ID NO: 71747 - protein, 15 aa, Mycobacterium tuberculosis
TINYQFGDVDAHGAM

SEQ ID NO: 71748 - protein, 15 aa, Mycobacterium tuberculosis
INYQFGDVDAHGAMI

SEQ ID NO: 71749 - protein, 15 aa, Mycobacterium tuberculosis
NYQFGDVDAHGAMIR

SEQ ID NO: 71750 - protein, 15 aa, Mycobacterium tuberculosis
YQFGDVDAHGAMIRA

SEQ ID NO: 71751 - protein, 15 aa, Mycobacterium tuberculosis
QFGDVDAHGAMIRAQ

SEQ ID NO: 71752 - protein, 15 aa, Mycobacterium tuberculosis
FGDVDAHGAMIRAQA

SEQ ID NO: 71753 - protein, 15 aa, Mycobacterium tuberculosis
GDVDAHGAMIRAQAG

SEQ ID NO: 71754 - protein, 15 aa, Mycobacterium tuberculosis
DVDAHGAMIRAQAGS

SEQ ID NO: 71755 - protein, 15 aa, Mycobacterium tuberculosis
VDAHGAMIRAQAGSL

SEQ ID NO: 71756 - protein, 15 aa, Mycobacterium tuberculosis
DAHGAMIRAQAGSLE

SEQ ID NO: 71757 - protein, 15 aa, Mycobacterium tuberculosis
AHGAMIRAQAGSLEA

SEQ ID NO: 71758 - protein, 15 aa, Mycobacterium tuberculosis
HGAMIRAQAGSLEAE

SEQ ID NO: 71759 - protein, 15 aa, Mycobacterium tuberculosis
GAMIRAQAGSLEAEH

SEQ ID NO: 71760 - protein, 15 aa, Mycobacterium tuberculosis
AMIRAQAGSLEAEHQ

SEQ ID NO: 71761 - protein, 15 aa, Mycobacterium tuberculosis
MIRAQAGSLEAEHQA

SEQ ID NO: 71762 - protein, 15 aa, Mycobacterium tuberculosis
IRAQAGSLEAEHQAI

SEQ ID NO: 71763 - protein, 15 aa, Mycobacterium tuberculosis
RAQAGSLEAEHQAII

SEQ ID NO: 71764 - protein, 15 aa, Mycobacterium tuberculosis
AQAGSLEAEHQAIIS

SEQ ID NO: 71765 - protein, 15 aa, Mycobacterium tuberculosis
QAGSLEAEHQAIISD

SEQ ID NO: 71766 - protein, 15 aa, Mycobacterium tuberculosis
AGSLEAEHQAIISDV

SEQ ID NO: 71767 - protein, 15 aa, Mycobacterium tuberculosis
GSLEAEHQAIISDVL

SEQ ID NO: 71768 - protein, 15 aa, Mycobacterium tuberculosis
SLEAEHQAIISDVLT

SEQ ID NO: 71769 - protein, 15 aa, Mycobacterium tuberculosis
LEAEHQAIISDVLTA

SEQ ID NO: 71770 - protein, 15 aa, Mycobacterium tuberculosis
EAEHQAIISDVLTAS

SEQ ID NO: 71771 - protein, 15 aa, Mycobacterium tuberculosis
AEHQAIISDVLTASD

SEQ ID NO: 71772 - protein, 15 aa, Mycobacterium tuberculosis
EHQAIISDVLTASDF

SEQ ID NO: 71773 - protein, 15 aa, Mycobacterium tuberculosis
HQAIISDVLTASDFW

SEQ ID NO: 71774 - protein, 15 aa, Mycobacterium tuberculosis
QAIISDVLTASDFWG

SEQ ID NO: 71775 - protein, 15 aa, Mycobacterium tuberculosis
AIISDVLTASDFWGG

SEQ ID NO: 71776 - protein, 15 aa, Mycobacterium tuberculosis
IISDVLTASDFWGGA

SEQ ID NO: 71777 - protein, 15 aa, Mycobacterium tuberculosis
ISDVLTASDFWGGAG

SEQ ID NO: 71778 - protein, 15 aa, Mycobacterium tuberculosis
SDVLTASDFWGGAGS

SEQ ID NO: 71779 - protein, 15 aa, Mycobacterium tuberculosis
DVLTASDFWGGAGSA

SEQ ID NO: 71780 - protein, 15 aa, Mycobacterium tuberculosis
VLTASDFWGGAGSAA

SEQ ID NO: 71781 - protein, 15 aa, Mycobacterium tuberculosis
LTASDFWGGAGSAAC

SEQ ID NO: 71782 - protein, 15 aa, Mycobacterium tuberculosis
TASDFWGGAGSAACQ

SEQ ID NO: 71783 - protein, 15 aa, Mycobacterium tuberculosis
ASDFWGGAGSAACQG

SEQ ID NO: 71784 - protein, 15 aa, Mycobacterium tuberculosis
SDFWGGAGSAACQGF

SEQ ID NO: 71785 - protein, 15 aa, Mycobacterium tuberculosis
DFWGGAGSAACQGFI

SEQ ID NO: 71786 - protein, 15 aa, Mycobacterium tuberculosis
FWGGAGSAACQGFIT

SEQ ID NO: 71787 - protein, 15 aa, Mycobacterium tuberculosis
WGGAGSAACQGFITQ

SEQ ID NO: 71788 - protein, 15 aa, Mycobacterium tuberculosis
GGAGSAACQGFITQL

SEQ ID NO: 71789 - protein, 15 aa, Mycobacterium tuberculosis
GAGSAACQGFITQLG

SEQ ID NO: 71790 - protein, 15 aa, Mycobacterium tuberculosis
AGSAACQGFITQLGR

SEQ ID NO: 71791 - protein, 15 aa, Mycobacterium tuberculosis
GSAACQGFITQLGRN

SEQ ID NO: 71792 - protein, 15 aa, Mycobacterium tuberculosis
SAACQGFITQLGRNF

SEQ ID NO: 71793 - protein, 15 aa, Mycobacterium tuberculosis
AACQGFITQLGRNFQ

SEQ ID NO: 71794 - protein, 15 aa, Mycobacterium tuberculosis
ACQGFITQLGRNFQV

SEQ ID NO: 71795 - protein, 15 aa, Mycobacterium tuberculosis
CQGFITQLGRNFQVI

SEQ ID NO: 71796 - protein, 15 aa, Mycobacterium tuberculosis
QGFITQLGRNFQVIY

SEQ ID NO: 71797 - protein, 15 aa, Mycobacterium tuberculosis
GFITQLGRNFQVIYE

SEQ ID NO: 71798 - protein, 15 aa, Mycobacterium tuberculosis
FITQLGRNFQVIYEQ

SEQ ID NO: 71799 - protein, 15 aa, Mycobacterium tuberculosis
ITQLGRNFQVIYEQA

SEQ ID NO: 71800 - protein, 15 aa, Mycobacterium tuberculosis
TQLGRNFQVIYEQAN

SEQ ID NO: 71801 - protein, 15 aa, Mycobacterium tuberculosis
QLGRNFQVIYEQANA

SEQ ID NO: 71802 - protein, 15 aa, Mycobacterium tuberculosis
LGRNFQVIYEQANAH

SEQ ID NO: 71803 - protein, 15 aa, Mycobacterium tuberculosis
GRNFQVIYEQANAHG

SEQ ID NO: 71804 - protein, 15 aa, Mycobacterium tuberculosis
RNFQVIYEQANAHGQ

SEQ ID NO: 71805 - protein, 15 aa, Mycobacterium tuberculosis
NFQVIYEQANAHGQK

SEQ ID NO: 71806 - protein, 15 aa, Mycobacterium tuberculosis
FQVIYEQANAHGQKV

SEQ ID NO: 71807 - protein, 15 aa, Mycobacterium tuberculosis
QVIYEQANAHGQKVQ

SEQ ID NO: 71808 - protein, 15 aa, Mycobacterium tuberculosis
VIYEQANAHGQKVQA

SEQ ID NO: 71809 - protein, 15 aa, Mycobacterium tuberculosis
IYEQANAHGQKVQAA

SEQ ID NO: 71810 - protein, 15 aa, Mycobacterium tuberculosis
YEQANAHGQKVQAAG

SEQ ID NO: 71811 - protein, 15 aa, Mycobacterium tuberculosis
EQANAHGQKVQAAGN

SEQ ID NO: 71812 - protein, 15 aa, Mycobacterium tuberculosis
QANAHGQKVQAAGNN

SEQ ID NO: 71813 - protein, 15 aa, Mycobacterium tuberculosis
ANAHGQKVQAAGNNM

SEQ ID NO: 71814 - protein, 15 aa, Mycobacterium tuberculosis
NAHGQKVQAAGNNMA

SEQ ID NO: 71815 - protein, 15 aa, Mycobacterium tuberculosis
AHGQKVQAAGNNMAQ

SEQ ID NO: 71816 - protein, 15 aa, Mycobacterium tuberculosis
HGQKVQAAGNNMAQT

SEQ ID NO: 71817 - protein, 15 aa, Mycobacterium tuberculosis
GQKVQAAGNNMAQTD

SEQ ID NO: 71818 - protein, 15 aa, Mycobacterium tuberculosis
QKVQAAGNNMAQTDS

SEQ ID NO: 71819 - protein, 15 aa, Mycobacterium tuberculosis
KVQAAGNNMAQTDSA

SEQ ID NO: 71820 - protein, 15 aa, Mycobacterium tuberculosis
VQAAGNNMAQTDSAV

SEQ ID NO: 71821 - protein, 15 aa, Mycobacterium tuberculosis
QAAGNNMAQTDSAVG

SEQ ID NO: 71822 - protein, 15 aa, Mycobacterium tuberculosis
AAGNNMAQTDSAVGS

SEQ ID NO: 71823 - protein, 15 aa, Mycobacterium tuberculosis
AGNNMAQTDSAVGSS

SEQ ID NO: 71824 - protein, 15 aa, Mycobacterium tuberculosis
GNNMAQTDSAVGSSW

SEQ ID NO: 71825 - protein, 15 aa, Mycobacterium tuberculosis
NNMAQTDSAVGSSWA

SEQ ID NO: 71826 - protein, 16 aa, Mycobacterium tuberculosis
MTINYQFGDVDAHGAM

SEQ ID NO: 71827 - protein, 16 aa, Mycobacterium tuberculosis
TINYQFGDVDAHGAMI

SEQ ID NO: 71828 - protein, 16 aa, Mycobacterium tuberculosis
INYQFGDVDAHGAMIR

SEQ ID NO: 71829 - protein, 16 aa, Mycobacterium tuberculosis
NYQFGDVDAHGAMIRA

SEQ ID NO: 71830 - protein, 16 aa, Mycobacterium tuberculosis
YQFGDVDAHGAMIRAQ

SEQ ID NO: 71831 - protein, 16 aa, Mycobacterium tuberculosis
QFGDVDAHGAMIRAQA

SEQ ID NO: 71832 - protein, 16 aa, Mycobacterium tuberculosis
FGDVDAHGAMIRAQAG

SEQ ID NO: 71833 - protein, 16 aa, Mycobacterium tuberculosis
GDVDAHGAMIRAQAGS

SEQ ID NO: 71834 - protein, 16 aa, Mycobacterium tuberculosis
DVDAHGAMIRAQAGSL

SEQ ID NO: 71835 - protein, 16 aa, Mycobacterium tuberculosis
VDAHGAMIRAQAGSLE

SEQ ID NO: 71836 - protein, 16 aa, Mycobacterium tuberculosis
DAHGAMIRAQAGSLEA

SEQ ID NO: 71837 - protein, 16 aa, Mycobacterium tuberculosis
AHGAMIRAQAGSLEAE

SEQ ID NO: 71838 - protein, 16 aa, Mycobacterium tuberculosis
HGAMIRAQAGSLEAEH

SEQ ID NO: 71839 - protein, 16 aa, Mycobacterium tuberculosis
GAMIRAQAGSLEAEHQ

SEQ ID NO: 71840 - protein, 16 aa, Mycobacterium tuberculosis
AMIRAQAGSLEAEHQA

SEQ ID NO: 71841 - protein, 16 aa, Mycobacterium tuberculosis
MIRAQAGSLEAEHQAI

SEQ ID NO: 71842 - protein, 16 aa, Mycobacterium tuberculosis
IRAQAGSLEAEHQAII

SEQ ID NO: 71843 - protein, 16 aa, Mycobacterium tuberculosis
RAQAGSLEAEHQAIIS

SEQ ID NO: 71844 - protein, 16 aa, Mycobacterium tuberculosis
AQAGSLEAEHQAIISD

SEQ ID NO: 71845 - protein, 16 aa, Mycobacterium tuberculosis
QAGSLEAEHQAIISDV

SEQ ID NO: 71846 - protein, 16 aa, Mycobacterium tuberculosis
AGSLEAEHQAIISDVL

SEQ ID NO: 71847 - protein, 16 aa, Mycobacterium tuberculosis
GSLEAEHQAIISDVLT

SEQ ID NO: 71848 - protein, 16 aa, Mycobacterium tuberculosis
SLEAEHQAIISDVLTA

SEQ ID NO: 71849 - protein, 16 aa, Mycobacterium tuberculosis
LEAEHQAIISDVLTAS

SEQ ID NO: 71850 - protein, 16 aa, Mycobacterium tuberculosis
EAEHQAIISDVLTASD

SEQ ID NO: 71851 - protein, 16 aa, Mycobacterium tuberculosis
AEHQAIISDVLTASDF

SEQ ID NO: 71852 - protein, 16 aa, Mycobacterium tuberculosis
EHQAIISDVLTASDFW

SEQ ID NO: 71853 - protein, 16 aa, Mycobacterium tuberculosis
HQAIISDVLTASDFWG

SEQ ID NO: 71854 - protein, 16 aa, Mycobacterium tuberculosis
QAIISDVLTASDFWGG

SEQ ID NO: 71855 - protein, 16 aa, Mycobacterium tuberculosis
AIISDVLTASDFWGGA

SEQ ID NO: 71856 - protein, 16 aa, Mycobacterium tuberculosis
IISDVLTASDFWGGAG

SEQ ID NO: 71857 - protein, 16 aa, Mycobacterium tuberculosis
ISDVLTASDFWGGAGS

SEQ ID NO: 71858 - protein, 16 aa, Mycobacterium tuberculosis
SDVLTASDFWGGAGSA

SEQ ID NO: 71859 - protein, 16 aa, Mycobacterium tuberculosis
DVLTASDFWGGAGSAA

SEQ ID NO: 71860 - protein, 16 aa, Mycobacterium tuberculosis
VLTASDFWGGAGSAAC

SEQ ID NO: 71861 - protein, 16 aa, Mycobacterium tuberculosis
LTASDFWGGAGSAACQ

SEQ ID NO: 71862 - protein, 16 aa, Mycobacterium tuberculosis
TASDFWGGAGSAACQG

SEQ ID NO: 71863 - protein, 16 aa, Mycobacterium tuberculosis
ASDFWGGAGSAACQGF

SEQ ID NO: 71864 - protein, 16 aa, Mycobacterium tuberculosis
SDFWGGAGSAACQGFI

SEQ ID NO: 71865 - protein, 16 aa, Mycobacterium tuberculosis
DFWGGAGSAACQGFIT

SEQ ID NO: 71866 - protein, 16 aa, Mycobacterium tuberculosis
FWGGAGSAACQGFITQ

SEQ ID NO: 71867 - protein, 16 aa, Mycobacterium tuberculosis
WGGAGSAACQGFITQL

SEQ ID NO: 71868 - protein, 16 aa, Mycobacterium tuberculosis
GGAGSAACQGFITQLG

SEQ ID NO: 71869 - protein, 16 aa, Mycobacterium tuberculosis
GAGSAACQGFITQLGR

SEQ ID NO: 71870 - protein, 16 aa, Mycobacterium tuberculosis
AGSAACQGFITQLGRN

SEQ ID NO: 71871 - protein, 16 aa, Mycobacterium tuberculosis
GSAACQGFITQLGRNF

SEQ ID NO: 71872 - protein, 16 aa, Mycobacterium tuberculosis
SAACQGFITQLGRNFQ

SEQ ID NO: 71873 - protein, 16 aa, Mycobacterium tuberculosis
AACQGFITQLGRNFQV

SEQ ID NO: 71874 - protein, 16 aa, Mycobacterium tuberculosis
ACQGFITQLGRNFQVI

SEQ ID NO: 71875 - protein, 16 aa, Mycobacterium tuberculosis
CQGFITQLGRNFQVIY

SEQ ID NO: 71876 - protein, 16 aa, Mycobacterium tuberculosis
QGFITQLGRNFQVIYE

SEQ ID NO: 71877 - protein, 16 aa, Mycobacterium tuberculosis
GFITQLGRNFQVIYEQ

SEQ ID NO: 71878 - protein, 16 aa, Mycobacterium tuberculosis
FITQLGRNFQVIYEQA

SEQ ID NO: 71879 - protein, 16 aa, Mycobacterium tuberculosis
ITQLGRNFQVIYEQAN

SEQ ID NO: 71880 - protein, 16 aa, Mycobacterium tuberculosis
TQLGRNFQVIYEQANA

SEQ ID NO: 71881 - protein, 16 aa, Mycobacterium tuberculosis
QLGRNFQVIYEQANAH

SEQ ID NO: 71882 - protein, 16 aa, Mycobacterium tuberculosis
LGRNFQVIYEQANAHG

SEQ ID NO: 71883 - protein, 16 aa, Mycobacterium tuberculosis
GRNFQVIYEQANAHGQ

SEQ ID NO: 71884 - protein, 16 aa, Mycobacterium tuberculosis
RNFQVIYEQANAHGQK

SEQ ID NO: 71885 - protein, 16 aa, Mycobacterium tuberculosis
NFQVIYEQANAHGQKV

SEQ ID NO: 71886 - protein, 16 aa, Mycobacterium tuberculosis
FQVIYEQANAHGQKVQ

SEQ ID NO: 71887 - protein, 16 aa, Mycobacterium tuberculosis
QVIYEQANAHGQKVQA

SEQ ID NO: 71888 - protein, 16 aa, Mycobacterium tuberculosis
VIYEQANAHGQKVQAA

SEQ ID NO: 71889 - protein, 16 aa, Mycobacterium tuberculosis
IYEQANAHGQKVQAAG

SEQ ID NO: 71890 - protein, 16 aa, Mycobacterium tuberculosis
YEQANAHGQKVQAAGN

SEQ ID NO: 71891 - protein, 16 aa, Mycobacterium tuberculosis
EQANAHGQKVQAAGNN

SEQ ID NO: 71892 - protein, 16 aa, Mycobacterium tuberculosis
QANAHGQKVQAAGNNM

SEQ ID NO: 71893 - protein, 16 aa, Mycobacterium tuberculosis
ANAHGQKVQAAGNNMA

SEQ ID NO: 71894 - protein, 16 aa, Mycobacterium tuberculosis
NAHGQKVQAAGNNMAQ

SEQ ID NO: 71895 - protein, 16 aa, Mycobacterium tuberculosis
AHGQKVQAAGNNMAQT

SEQ ID NO: 71896 - protein, 16 aa, Mycobacterium tuberculosis
HGQKVQAAGNNMAQTD

SEQ ID NO: 71897 - protein, 16 aa, Mycobacterium tuberculosis
GQKVQAAGNNMAQTDS

SEQ ID NO: 71898 - protein, 16 aa, Mycobacterium tuberculosis
QKVQAAGNNMAQTDSA

SEQ ID NO: 71899 - protein, 16 aa, Mycobacterium tuberculosis
KVQAAGNNMAQTDSAV

SEQ ID NO: 71900 - protein, 16 aa, Mycobacterium tuberculosis
VQAAGNNMAQTDSAVG

SEQ ID NO: 71901 - protein, 16 aa, Mycobacterium tuberculosis
QAAGNNMAQTDSAVGS

SEQ ID NO: 71902 - protein, 16 aa, Mycobacterium tuberculosis
AAGNNMAQTDSAVGSS

SEQ ID NO: 71903 - protein, 16 aa, Mycobacterium tuberculosis
AGNNMAQTDSAVGSSW

SEQ ID NO: 71904 - protein, 16 aa, Mycobacterium tuberculosis
GNNMAQTDSAVGSSWA

SEQ ID NO: 71905 - protein, 13 aa, Mycobacterium tuberculosis
MASRFMTDPHAMR

SEQ ID NO: 71906 - protein, 13 aa, Mycobacterium tuberculosis
ASRFMTDPHAMRD

SEQ ID NO: 71907 - protein, 13 aa, Mycobacterium tuberculosis
SRFMTDPHAMRDM

SEQ ID NO: 71908 - protein, 13 aa, Mycobacterium tuberculosis
RFMTDPHAMRDMA

SEQ ID NO: 71909 - protein, 13 aa, Mycobacterium tuberculosis
FMTDPHAMRDMAG

SEQ ID NO: 71910 - protein, 13 aa, Mycobacterium tuberculosis
MTDPHAMRDMAGR

SEQ ID NO: 71911 - protein, 13 aa, Mycobacterium tuberculosis
TDPHAMRDMAGRF

SEQ ID NO: 71912 - protein, 13 aa, Mycobacterium tuberculosis
DPHAMRDMAGRFE

SEQ ID NO: 71913 - protein, 13 aa, Mycobacterium tuberculosis
PHAMRDMAGRFEV

SEQ ID NO: 71914 - protein, 13 aa, Mycobacterium tuberculosis
HAMRDMAGRFEVH

SEQ ID NO: 71915 - protein, 13 aa, Mycobacterium tuberculosis
AMRDMAGRFEVHA

SEQ ID NO: 71916 - protein, 13 aa, Mycobacterium tuberculosis
MRDMAGRFEVHAQ

SEQ ID NO: 71917 - protein, 13 aa, Mycobacterium tuberculosis
RDMAGRFEVHAQT

SEQ ID NO: 71918 - protein, 13 aa, Mycobacterium tuberculosis
DMAGRFEVHAQTV

SEQ ID NO: 71919 - protein, 13 aa, Mycobacterium tuberculosis
MAGRFEVHAQTVE

SEQ ID NO: 71920 - protein, 13 aa, Mycobacterium tuberculosis
AGRFEVHAQTVED

SEQ ID NO: 71921 - protein, 13 aa, Mycobacterium tuberculosis
GRFEVHAQTVEDE

SEQ ID NO: 71922 - protein, 13 aa, Mycobacterium tuberculosis
RFEVHAQTVEDEA

SEQ ID NO: 71923 - protein, 13 aa, Mycobacterium tuberculosis
FEVHAQTVEDEAR

SEQ ID NO: 71924 - protein, 13 aa, Mycobacterium tuberculosis
EVHAQTVEDEARR

SEQ ID NO: 71925 - protein, 13 aa, Mycobacterium tuberculosis
VHAQTVEDEARRM

SEQ ID NO: 71926 - protein, 13 aa, Mycobacterium tuberculosis
HAQTVEDEARRMW

SEQ ID NO: 71927 - protein, 13 aa, Mycobacterium tuberculosis
AQTVEDEARRMWA

SEQ ID NO: 71928 - protein, 13 aa, Mycobacterium tuberculosis
QTVEDEARRMWAS

SEQ ID NO: 71929 - protein, 13 aa, Mycobacterium tuberculosis
TVEDEARRMWASA

SEQ ID NO: 71930 - protein, 13 aa, Mycobacterium tuberculosis
VEDEARRMWASAQ

SEQ ID NO: 71931 - protein, 13 aa, Mycobacterium tuberculosis
EDEARRMWASAQN

SEQ ID NO: 71932 - protein, 13 aa, Mycobacterium tuberculosis
DEARRMWASAQNI

SEQ ID NO: 71933 - protein, 13 aa, Mycobacterium tuberculosis
EARRMWASAQNIS

SEQ ID NO: 71934 - protein, 13 aa, Mycobacterium tuberculosis
ARRMWASAQNISG

SEQ ID NO: 71935 - protein, 13 aa, Mycobacterium tuberculosis
RRMWASAQNISGA

SEQ ID NO: 71936 - protein, 13 aa, Mycobacterium tuberculosis
RMWASAQNISGAG

SEQ ID NO: 71937 - protein, 13 aa, Mycobacterium tuberculosis
MWASAQNISGAGW

SEQ ID NO: 71938 - protein, 13 aa, Mycobacterium tuberculosis
WASAQNISGAGWS

SEQ ID NO: 71939 - protein, 13 aa, Mycobacterium tuberculosis
ASAQNISGAGWSG

SEQ ID NO: 71940 - protein, 13 aa, Mycobacterium tuberculosis
SAQNISGAGWSGM

SEQ ID NO: 71941 - protein, 13 aa, Mycobacterium tuberculosis
AQNISGAGWSGMA

SEQ ID NO: 71942 - protein, 13 aa, Mycobacterium tuberculosis
QNISGAGWSGMAE

SEQ ID NO: 71943 - protein, 13 aa, Mycobacterium tuberculosis
NISGAGWSGMAEA

SEQ ID NO: 71944 - protein, 13 aa, Mycobacterium tuberculosis
ISGAGWSGMAEAT

SEQ ID NO: 71945 - protein, 13 aa, Mycobacterium tuberculosis
SGAGWSGMAEATS

SEQ ID NO: 71946 - protein, 13 aa, Mycobacterium tuberculosis
GAGWSGMAEATSL

SEQ ID NO: 71947 - protein, 13 aa, Mycobacterium tuberculosis
AGWSGMAEATSLD

SEQ ID NO: 71948 - protein, 13 aa, Mycobacterium tuberculosis
GWSGMAEATSLDT

SEQ ID NO: 71949 - protein, 13 aa, Mycobacterium tuberculosis
WSGMAEATSLDTM

SEQ ID NO: 71950 - protein, 13 aa, Mycobacterium tuberculosis
SGMAEATSLDTMT

SEQ ID NO: 71951 - protein, 13 aa, Mycobacterium tuberculosis
GMAEATSLDTMTQ

SEQ ID NO: 71952 - protein, 13 aa, Mycobacterium tuberculosis
MAEATSLDTMTQM

SEQ ID NO: 71953 - protein, 13 aa, Mycobacterium tuberculosis
AEATSLDTMTQMN

SEQ ID NO: 71954 - protein, 13 aa, Mycobacterium tuberculosis
EATSLDTMTQMNQ

SEQ ID NO: 71955 - protein, 13 aa, Mycobacterium tuberculosis
ATSLDTMTQMNQA

SEQ ID NO: 71956 - protein, 13 aa, Mycobacterium tuberculosis
TSLDTMTQMNQAF

SEQ ID NO: 71957 - protein, 13 aa, Mycobacterium tuberculosis
SLDTMTQMNQAFR

SEQ ID NO: 71958 - protein, 13 aa, Mycobacterium tuberculosis
LDTMTQMNQAFRN

SEQ ID NO: 71959 - protein, 13 aa, Mycobacterium tuberculosis
DTMTQMNQAFRNI

SEQ ID NO: 71960 - protein, 13 aa, Mycobacterium tuberculosis
TMTQMNQAFRNIV

SEQ ID NO: 71961 - protein, 13 aa, Mycobacterium tuberculosis
MTQMNQAFRNIVN

SEQ ID NO: 71962 - protein, 13 aa, Mycobacterium tuberculosis
TQMNQAFRNIVNM

SEQ ID NO: 71963 - protein, 13 aa, Mycobacterium tuberculosis
QMNQAFRNIVNML

SEQ ID NO: 71964 - protein, 13 aa, Mycobacterium tuberculosis
MNQAFRNIVNMLH

SEQ ID NO: 71965 - protein, 13 aa, Mycobacterium tuberculosis
NQAFRNIVNMLHG

SEQ ID NO: 71966 - protein, 13 aa, Mycobacterium tuberculosis
QAFRNIVNMLHGV

SEQ ID NO: 71967 - protein, 13 aa, Mycobacterium tuberculosis
AFRNIVNMLHGVR

SEQ ID NO: 71968 - protein, 13 aa, Mycobacterium tuberculosis
FRNIVNMLHGVRD

SEQ ID NO: 71969 - protein, 13 aa, Mycobacterium tuberculosis
RNIVNMLHGVRDG

SEQ ID NO: 71970 - protein, 13 aa, Mycobacterium tuberculosis
NIVNMLHGVRDGL

SEQ ID NO: 71971 - protein, 13 aa, Mycobacterium tuberculosis
IVNMLHGVRDGLV

SEQ ID NO: 71972 - protein, 13 aa, Mycobacterium tuberculosis
VNMLHGVRDGLVR

SEQ ID NO: 71973 - protein, 13 aa, Mycobacterium tuberculosis
NMLHGVRDGLVRD

SEQ ID NO: 71974 - protein, 13 aa, Mycobacterium tuberculosis
MLHGVRDGLVRDA

SEQ ID NO: 71975 - protein, 13 aa, Mycobacterium tuberculosis
LHGVRDGLVRDAN

SEQ ID NO: 71976 - protein, 13 aa, Mycobacterium tuberculosis
HGVRDGLVRDANN

SEQ ID NO: 71977 - protein, 13 aa, Mycobacterium tuberculosis
GVRDGLVRDANNY

SEQ ID NO: 71978 - protein, 13 aa, Mycobacterium tuberculosis
VRDGLVRDANNYE

SEQ ID NO: 71979 - protein, 13 aa, Mycobacterium tuberculosis
RDGLVRDANNYEQ

SEQ ID NO: 71980 - protein, 13 aa, Mycobacterium tuberculosis
DGLVRDANNYEQQ

SEQ ID NO: 71981 - protein, 13 aa, Mycobacterium tuberculosis
GLVRDANNYEQQE

SEQ ID NO: 71982 - protein, 13 aa, Mycobacterium tuberculosis
LVRDANNYEQQEQ

SEQ ID NO: 71983 - protein, 13 aa, Mycobacterium tuberculosis
VRDANNYEQQEQA

SEQ ID NO: 71984 - protein, 13 aa, Mycobacterium tuberculosis
RDANNYEQQEQAS

SEQ ID NO: 71985 - protein, 13 aa, Mycobacterium tuberculosis
DANNYEQQEQASQ

SEQ ID NO: 71986 - protein, 13 aa, Mycobacterium tuberculosis
ANNYEQQEQASQQ

SEQ ID NO: 71987 - protein, 13 aa, Mycobacterium tuberculosis
NNYEQQEQASQQI

SEQ ID NO: 71988 - protein, 13 aa, Mycobacterium tuberculosis
NYEQQEQASQQIL

SEQ ID NO: 71989 - protein, 13 aa, Mycobacterium tuberculosis
YEQQEQASQQILS

SEQ ID NO: 71990 - protein, 13 aa, Mycobacterium tuberculosis
EQQEQASQQILSS

SEQ ID NO: 71991 - protein, 14 aa, Mycobacterium tuberculosis
MASRFMTDPHAMRD

SEQ ID NO: 71992 - protein, 14 aa, Mycobacterium tuberculosis
ASRFMTDPHAMRDM

SEQ ID NO: 71993 - protein, 14 aa, Mycobacterium tuberculosis
SRFMTDPHAMRDMA

SEQ ID NO: 71994 - protein, 14 aa, Mycobacterium tuberculosis
RFMTDPHAMRDMAG

SEQ ID NO: 71995 - protein, 14 aa, Mycobacterium tuberculosis
FMTDPHAMRDMAGR

SEQ ID NO: 71996 - protein, 14 aa, Mycobacterium tuberculosis
MTDPHAMRDMAGRF

SEQ ID NO: 71997 - protein, 14 aa, Mycobacterium tuberculosis
TDPHAMRDMAGRFE

SEQ ID NO: 71998 - protein, 14 aa, Mycobacterium tuberculosis
DPHAMRDMAGRFEV

SEQ ID NO: 71999 - protein, 14 aa, Mycobacterium tuberculosis
PHAMRDMAGRFEVH

SEQ ID NO: 72000 - protein, 14 aa, Mycobacterium tuberculosis
HAMRDMAGRFEVHA

SEQ ID NO: 72001 - protein, 14 aa, Mycobacterium tuberculosis
AMRDMAGRFEVHAQ

SEQ ID NO: 72002 - protein, 14 aa, Mycobacterium tuberculosis
MRDMAGRFEVHAQT

SEQ ID NO: 72003 - protein, 14 aa, Mycobacterium tuberculosis
RDMAGRFEVHAQTV

SEQ ID NO: 72004 - protein, 14 aa, Mycobacterium tuberculosis
DMAGRFEVHAQTVE

SEQ ID NO: 72005 - protein, 14 aa, Mycobacterium tuberculosis
MAGRFEVHAQTVED

SEQ ID NO: 72006 - protein, 14 aa, Mycobacterium tuberculosis
AGRFEVHAQTVEDE

SEQ ID NO: 72007 - protein, 14 aa, Mycobacterium tuberculosis
GRFEVHAQTVEDEA

SEQ ID NO: 72008 - protein, 14 aa, Mycobacterium tuberculosis
RFEVHAQTVEDEAR

SEQ ID NO: 72009 - protein, 14 aa, Mycobacterium tuberculosis
FEVHAQTVEDEARR

SEQ ID NO: 72010 - protein, 14 aa, Mycobacterium tuberculosis
EVHAQTVEDEARRM

SEQ ID NO: 72011 - protein, 14 aa, Mycobacterium tuberculosis
VHAQTVEDEARRMW

SEQ ID NO: 72012 - protein, 14 aa, Mycobacterium tuberculosis
HAQTVEDEARRMWA

SEQ ID NO: 72013 - protein, 14 aa, Mycobacterium tuberculosis
AQTVEDEARRMWAS

SEQ ID NO: 72014 - protein, 14 aa, Mycobacterium tuberculosis
QTVEDEARRMWASA

SEQ ID NO: 72015 - protein, 14 aa, Mycobacterium tuberculosis
TVEDEARRMWASAQ

SEQ ID NO: 72016 - protein, 14 aa, Mycobacterium tuberculosis
VEDEARRMWASAQN

SEQ ID NO: 72017 - protein, 14 aa, Mycobacterium tuberculosis
EDEARRMWASAQNI

SEQ ID NO: 72018 - protein, 14 aa, Mycobacterium tuberculosis
DEARRMWASAQNIS

SEQ ID NO: 72019 - protein, 14 aa, Mycobacterium tuberculosis
EARRMWASAQNISG

SEQ ID NO: 72020 - protein, 14 aa, Mycobacterium tuberculosis
ARRMWASAQNISGA

SEQ ID NO: 72021 - protein, 14 aa, Mycobacterium tuberculosis
RRMWASAQNISGAG

SEQ ID NO: 72022 - protein, 14 aa, Mycobacterium tuberculosis
RMWASAQNISGAGW

SEQ ID NO: 72023 - protein, 14 aa, Mycobacterium tuberculosis
MWASAQNISGAGWS

SEQ ID NO: 72024 - protein, 14 aa, Mycobacterium tuberculosis
WASAQNISGAGWSG

SEQ ID NO: 72025 - protein, 14 aa, Mycobacterium tuberculosis
ASAQNISGAGWSGM

SEQ ID NO: 72026 - protein, 14 aa, Mycobacterium tuberculosis
SAQNISGAGWSGMA

SEQ ID NO: 72027 - protein, 14 aa, Mycobacterium tuberculosis
AQNISGAGWSGMAE

SEQ ID NO: 72028 - protein, 14 aa, Mycobacterium tuberculosis
QNISGAGWSGMAEA

SEQ ID NO: 72029 - protein, 14 aa, Mycobacterium tuberculosis
NISGAGWSGMAEAT

SEQ ID NO: 72030 - protein, 14 aa, Mycobacterium tuberculosis
ISGAGWSGMAEATS

SEQ ID NO: 72031 - protein, 14 aa, Mycobacterium tuberculosis
SGAGWSGMAEATSL

SEQ ID NO: 72032 - protein, 14 aa, Mycobacterium tuberculosis
GAGWSGMAEATSLD

SEQ ID NO: 72033 - protein, 14 aa, Mycobacterium tuberculosis
AGWSGMAEATSLDT

SEQ ID NO: 72034 - protein, 14 aa, Mycobacterium tuberculosis
GWSGMAEATSLDTM

SEQ ID NO: 72035 - protein, 14 aa, Mycobacterium tuberculosis
WSGMAEATSLDTMT

SEQ ID NO: 72036 - protein, 14 aa, Mycobacterium tuberculosis
SGMAEATSLDTMTQ

SEQ ID NO: 72037 - protein, 14 aa, Mycobacterium tuberculosis
GMAEATSLDTMTQM

SEQ ID NO: 72038 - protein, 14 aa, Mycobacterium tuberculosis
MAEATSLDTMTQMN

SEQ ID NO: 72039 - protein, 14 aa, Mycobacterium tuberculosis
AEATSLDTMTQMNQ

SEQ ID NO: 72040 - protein, 14 aa, Mycobacterium tuberculosis
EATSLDTMTQMNQA

SEQ ID NO: 72041 - protein, 14 aa, Mycobacterium tuberculosis
ATSLDTMTQMNQAF

SEQ ID NO: 72042 - protein, 14 aa, Mycobacterium tuberculosis
TSLDTMTQMNQAFR

SEQ ID NO: 72043 - protein, 14 aa, Mycobacterium tuberculosis
SLDTMTQMNQAFRN

SEQ ID NO: 72044 - protein, 14 aa, Mycobacterium tuberculosis
LDTMTQMNQAFRNI

SEQ ID NO: 72045 - protein, 14 aa, Mycobacterium tuberculosis
DTMTQMNQAFRNIV

SEQ ID NO: 72046 - protein, 14 aa, Mycobacterium tuberculosis
TMTQMNQAFRNIVN

SEQ ID NO: 72047 - protein, 14 aa, Mycobacterium tuberculosis
MTQMNQAFRNIVNM

SEQ ID NO: 72048 - protein, 14 aa, Mycobacterium tuberculosis
TQMNQAFRNIVNML

SEQ ID NO: 72049 - protein, 14 aa, Mycobacterium tuberculosis
QMNQAFRNIVNMLH

SEQ ID NO: 72050 - protein, 14 aa, Mycobacterium tuberculosis
MNQAFRNIVNMLHG

SEQ ID NO: 72051 - protein, 14 aa, Mycobacterium tuberculosis
NQAFRNIVNMLHGV

SEQ ID NO: 72052 - protein, 14 aa, Mycobacterium tuberculosis
QAFRNIVNMLHGVR

SEQ ID NO: 72053 - protein, 14 aa, Mycobacterium tuberculosis
AFRNIVNMLHGVRD

SEQ ID NO: 72054 - protein, 14 aa, Mycobacterium tuberculosis
FRNIVNMLHGVRDG

SEQ ID NO: 72055 - protein, 14 aa, Mycobacterium tuberculosis
RNIVNMLHGVRDGL

SEQ ID NO: 72056 - protein, 14 aa, Mycobacterium tuberculosis
NIVNMLHGVRDGLV

SEQ ID NO: 72057 - protein, 14 aa, Mycobacterium tuberculosis
IVNMLHGVRDGLVR

SEQ ID NO: 72058 - protein, 14 aa, Mycobacterium tuberculosis
VNMLHGVRDGLVRD

SEQ ID NO: 72059 - protein, 14 aa, Mycobacterium tuberculosis
NMLHGVRDGLVRDA

SEQ ID NO: 72060 - protein, 14 aa, Mycobacterium tuberculosis
MLHGVRDGLVRDAN

SEQ ID NO: 72061 - protein, 14 aa, Mycobacterium tuberculosis
LHGVRDGLVRDANN

SEQ ID NO: 72062 - protein, 14 aa, Mycobacterium tuberculosis
HGVRDGLVRDANNY

SEQ ID NO: 72063 - protein, 14 aa, Mycobacterium tuberculosis
GVRDGLVRDANNYE

SEQ ID NO: 72064 - protein, 14 aa, Mycobacterium tuberculosis
VRDGLVRDANNYEQ

SEQ ID NO: 72065 - protein, 14 aa, Mycobacterium tuberculosis
RDGLVRDANNYEQQ

SEQ ID NO: 72066 - protein, 14 aa, Mycobacterium tuberculosis
DGLVRDANNYEQQE

SEQ ID NO: 72067 - protein, 14 aa, Mycobacterium tuberculosis
GLVRDANNYEQQEQ

SEQ ID NO: 72068 - protein, 14 aa, Mycobacterium tuberculosis
LVRDANNYEQQEQA

SEQ ID NO: 72069 - protein, 14 aa, Mycobacterium tuberculosis
VRDANNYEQQEQAS

SEQ ID NO: 72070 - protein, 14 aa, Mycobacterium tuberculosis
RDANNYEQQEQASQ

SEQ ID NO: 72071 - protein, 14 aa, Mycobacterium tuberculosis
DANNYEQQEQASQQ

SEQ ID NO: 72072 - protein, 14 aa, Mycobacterium tuberculosis
ANNYEQQEQASQQI

SEQ ID NO: 72073 - protein, 14 aa, Mycobacterium tuberculosis
NNYEQQEQASQQIL

SEQ ID NO: 72074 - protein, 14 aa, Mycobacterium tuberculosis
NYEQQEQASQQILS

SEQ ID NO: 72075 - protein, 14 aa, Mycobacterium tuberculosis
YEQQEQASQQILSS

SEQ ID NO: 72076 - protein, 15 aa, Mycobacterium tuberculosis
MASRFMTDPHAMRDM

SEQ ID NO: 72077 - protein, 15 aa, Mycobacterium tuberculosis
ASRFMTDPHAMRDMA

SEQ ID NO: 72078 - protein, 15 aa, Mycobacterium tuberculosis
SRFMTDPHAMRDMAG

SEQ ID NO: 72079 - protein, 15 aa, Mycobacterium tuberculosis
RFMTDPHAMRDMAGR

SEQ ID NO: 72080 - protein, 15 aa, Mycobacterium tuberculosis
FMTDPHAMRDMAGRF

SEQ ID NO: 72081 - protein, 15 aa, Mycobacterium tuberculosis
MTDPHAMRDMAGRFE

SEQ ID NO: 72082 - protein, 15 aa, Mycobacterium tuberculosis
TDPHAMRDMAGRFEV

SEQ ID NO: 72083 - protein, 15 aa, Mycobacterium tuberculosis
DPHAMRDMAGRFEVH

SEQ ID NO: 72084 - protein, 15 aa, Mycobacterium tuberculosis
PHAMRDMAGRFEVHA

SEQ ID NO: 72085 - protein, 15 aa, Mycobacterium tuberculosis
HAMRDMAGRFEVHAQ

SEQ ID NO: 72086 - protein, 15 aa, Mycobacterium tuberculosis
AMRDMAGRFEVHAQT

SEQ ID NO: 72087 - protein, 15 aa, Mycobacterium tuberculosis
MRDMAGRFEVHAQTV

SEQ ID NO: 72088 - protein, 15 aa, Mycobacterium tuberculosis
RDMAGRFEVHAQTVE

SEQ ID NO: 72089 - protein, 15 aa, Mycobacterium tuberculosis
DMAGRFEVHAQTVED

SEQ ID NO: 72090 - protein, 15 aa, Mycobacterium tuberculosis
MAGRFEVHAQTVEDE

SEQ ID NO: 72091 - protein, 15 aa, Mycobacterium tuberculosis
AGRFEVHAQTVEDEA

SEQ ID NO: 72092 - protein, 15 aa, Mycobacterium tuberculosis
GRFEVHAQTVEDEAR

SEQ ID NO: 72093 - protein, 15 aa, Mycobacterium tuberculosis
RFEVHAQTVEDEARR

SEQ ID NO: 72094 - protein, 15 aa, Mycobacterium tuberculosis
FEVHAQTVEDEARRM

SEQ ID NO: 72095 - protein, 15 aa, Mycobacterium tuberculosis
EVHAQTVEDEARRMW

SEQ ID NO: 72096 - protein, 15 aa, Mycobacterium tuberculosis
VHAQTVEDEARRMWA

SEQ ID NO: 72097 - protein, 15 aa, Mycobacterium tuberculosis
HAQTVEDEARRMWAS

SEQ ID NO: 72098 - protein, 15 aa, Mycobacterium tuberculosis
AQTVEDEARRMWASA

SEQ ID NO: 72099 - protein, 15 aa, Mycobacterium tuberculosis
QTVEDEARRMWASAQ

SEQ ID NO: 72100 - protein, 15 aa, Mycobacterium tuberculosis
TVEDEARRMWASAQN

SEQ ID NO: 72101 - protein, 15 aa, Mycobacterium tuberculosis
VEDEARRMWASAQNI

SEQ ID NO: 72102 - protein, 15 aa, Mycobacterium tuberculosis
EDEARRMWASAQNIS

SEQ ID NO: 72103 - protein, 15 aa, Mycobacterium tuberculosis
DEARRMWASAQNISG

SEQ ID NO: 72104 - protein, 15 aa, Mycobacterium tuberculosis
EARRMWASAQNISGA

SEQ ID NO: 72105 - protein, 15 aa, Mycobacterium tuberculosis
ARRMWASAQNISGAG

SEQ ID NO: 72106 - protein, 15 aa, Mycobacterium tuberculosis
RRMWASAQNISGAGW

SEQ ID NO: 72107 - protein, 15 aa, Mycobacterium tuberculosis
RMWASAQNISGAGWS

SEQ ID NO: 72108 - protein, 15 aa, Mycobacterium tuberculosis
MWASAQNISGAGWSG

SEQ ID NO: 72109 - protein, 15 aa, Mycobacterium tuberculosis
WASAQNISGAGWSGM

SEQ ID NO: 72110 - protein, 15 aa, Mycobacterium tuberculosis
ASAQNISGAGWSGMA

SEQ ID NO: 72111 - protein, 15 aa, Mycobacterium tuberculosis
SAQNISGAGWSGMAE

SEQ ID NO: 72112 - protein, 15 aa, Mycobacterium tuberculosis
AQNISGAGWSGMAEA

SEQ ID NO: 72113 - protein, 15 aa, Mycobacterium tuberculosis
QNISGAGWSGMAEAT

SEQ ID NO: 72114 - protein, 15 aa, Mycobacterium tuberculosis
NISGAGWSGMAEATS

SEQ ID NO: 72115 - protein, 15 aa, Mycobacterium tuberculosis
ISGAGWSGMAEATSL

SEQ ID NO: 72116 - protein, 15 aa, Mycobacterium tuberculosis
SGAGWSGMAEATSLD

SEQ ID NO: 72117 - protein, 15 aa, Mycobacterium tuberculosis
GAGWSGMAEATSLDT

SEQ ID NO: 72118 - protein, 15 aa, Mycobacterium tuberculosis
AGWSGMAEATSLDTM

SEQ ID NO: 72119 - protein, 15 aa, Mycobacterium tuberculosis
GWSGMAEATSLDTMT

SEQ ID NO: 72120 - protein, 15 aa, Mycobacterium tuberculosis
WSGMAEATSLDTMTQ

SEQ ID NO: 72121 - protein, 15 aa, Mycobacterium tuberculosis
SGMAEATSLDTMTQM

SEQ ID NO: 72122 - protein, 15 aa, Mycobacterium tuberculosis
GMAEATSLDTMTQMN

SEQ ID NO: 72123 - protein, 15 aa, Mycobacterium tuberculosis
MAEATSLDTMTQMNQ

SEQ ID NO: 72124 - protein, 15 aa, Mycobacterium tuberculosis
AEATSLDTMTQMNQA

SEQ ID NO: 72125 - protein, 15 aa, Mycobacterium tuberculosis
EATSLDTMTQMNQAF

SEQ ID NO: 72126 - protein, 15 aa, Mycobacterium tuberculosis
ATSLDTMTQMNQAFR

SEQ ID NO: 72127 - protein, 15 aa, Mycobacterium tuberculosis
TSLDTMTQMNQAFRN

SEQ ID NO: 72128 - protein, 15 aa, Mycobacterium tuberculosis
SLDTMTQMNQAFRNI

SEQ ID NO: 72129 - protein, 15 aa, Mycobacterium tuberculosis
LDTMTQMNQAFRNIV

SEQ ID NO: 72130 - protein, 15 aa, Mycobacterium tuberculosis
DTMTQMNQAFRNIVN

SEQ ID NO: 72131 - protein, 15 aa, Mycobacterium tuberculosis
TMTQMNQAFRNIVNM

SEQ ID NO: 72132 - protein, 15 aa, Mycobacterium tuberculosis
MTQMNQAFRNIVNML

SEQ ID NO: 72133 - protein, 15 aa, Mycobacterium tuberculosis
TQMNQAFRNIVNMLH

SEQ ID NO: 72134 - protein, 15 aa, Mycobacterium tuberculosis
QMNQAFRNIVNMLHG

SEQ ID NO: 72135 - protein, 15 aa, Mycobacterium tuberculosis
MNQAFRNIVNMLHGV

SEQ ID NO: 72136 - protein, 15 aa, Mycobacterium tuberculosis
NQAFRNIVNMLHGVR

SEQ ID NO: 72137 - protein, 15 aa, Mycobacterium tuberculosis
QAFRNIVNMLHGVRD

SEQ ID NO: 72138 - protein, 15 aa, Mycobacterium tuberculosis
AFRNIVNMLHGVRDG

SEQ ID NO: 72139 - protein, 15 aa, Mycobacterium tuberculosis
FRNIVNMLHGVRDGL

SEQ ID NO: 72140 - protein, 15 aa, Mycobacterium tuberculosis
RNIVNMLHGVRDGLV

SEQ ID NO: 72141 - protein, 15 aa, Mycobacterium tuberculosis
NIVNMLHGVRDGLVR

SEQ ID NO: 72142 - protein, 15 aa, Mycobacterium tuberculosis
IVNMLHGVRDGLVRD

SEQ ID NO: 72143 - protein, 15 aa, Mycobacterium tuberculosis
VNMLHGVRDGLVRDA

SEQ ID NO: 72144 - protein, 15 aa, Mycobacterium tuberculosis
NMLHGVRDGLVRDAN

SEQ ID NO: 72145 - protein, 15 aa, Mycobacterium tuberculosis
MLHGVRDGLVRDANN

SEQ ID NO: 72146 - protein, 15 aa, Mycobacterium tuberculosis
LHGVRDGLVRDANNY

SEQ ID NO: 72147 - protein, 15 aa, Mycobacterium tuberculosis
HGVRDGLVRDANNYE

SEQ ID NO: 72148 - protein, 15 aa, Mycobacterium tuberculosis
GVRDGLVRDANNYEQ

SEQ ID NO: 72149 - protein, 15 aa, Mycobacterium tuberculosis
VRDGLVRDANNYEQQ

SEQ ID NO: 72150 - protein, 15 aa, Mycobacterium tuberculosis
RDGLVRDANNYEQQE

SEQ ID NO: 72151 - protein, 15 aa, Mycobacterium tuberculosis
DGLVRDANNYEQQEQ

SEQ ID NO: 72152 - protein, 15 aa, Mycobacterium tuberculosis
GLVRDANNYEQQEQA

SEQ ID NO: 72153 - protein, 15 aa, Mycobacterium tuberculosis
LVRDANNYEQQEQAS

SEQ ID NO: 72154 - protein, 15 aa, Mycobacterium tuberculosis
VRDANNYEQQEQASQ

SEQ ID NO: 72155 - protein, 15 aa, Mycobacterium tuberculosis
RDANNYEQQEQASQQ

SEQ ID NO: 72156 - protein, 15 aa, Mycobacterium tuberculosis
DANNYEQQEQASQQI

SEQ ID NO: 72157 - protein, 15 aa, Mycobacterium tuberculosis
ANNYEQQEQASQQIL

SEQ ID NO: 72158 - protein, 15 aa, Mycobacterium tuberculosis
NNYEQQEQASQQILS

SEQ ID NO: 72159 - protein, 15 aa, Mycobacterium tuberculosis
NYEQQEQASQQILSS

SEQ ID NO: 72160 - protein, 16 aa, Mycobacterium tuberculosis
MASRFMTDPHAMRDMA

SEQ ID NO: 72161 - protein, 16 aa, Mycobacterium tuberculosis
ASRFMTDPHAMRDMAG

SEQ ID NO: 72162 - protein, 16 aa, Mycobacterium tuberculosis
SRFMTDPHAMRDMAGR

SEQ ID NO: 72163 - protein, 16 aa, Mycobacterium tuberculosis
RFMTDPHAMRDMAGRF

SEQ ID NO: 72164 - protein, 16 aa, Mycobacterium tuberculosis
FMTDPHAMRDMAGRFE

SEQ ID NO: 72165 - protein, 16 aa, Mycobacterium tuberculosis
MTDPHAMRDMAGRFEV

SEQ ID NO: 72166 - protein, 16 aa, Mycobacterium tuberculosis
TDPHAMRDMAGRFEVH

SEQ ID NO: 72167 - protein, 16 aa, Mycobacterium tuberculosis
DPHAMRDMAGRFEVHA

SEQ ID NO: 72168 - protein, 16 aa, Mycobacterium tuberculosis
PHAMRDMAGRFEVHAQ

SEQ ID NO: 72169 - protein, 16 aa, Mycobacterium tuberculosis
HAMRDMAGRFEVHAQT

SEQ ID NO: 72170 - protein, 16 aa, Mycobacterium tuberculosis
AMRDMAGRFEVHAQTV

SEQ ID NO: 72171 - protein, 16 aa, Mycobacterium tuberculosis
MRDMAGRFEVHAQTVE

SEQ ID NO: 72172 - protein, 16 aa, Mycobacterium tuberculosis
RDMAGRFEVHAQTVED

SEQ ID NO: 72173 - protein, 16 aa, Mycobacterium tuberculosis
DMAGRFEVHAQTVEDE

SEQ ID NO: 72174 - protein, 16 aa, Mycobacterium tuberculosis
MAGRFEVHAQTVEDEA

SEQ ID NO: 72175 - protein, 16 aa, Mycobacterium tuberculosis
AGRFEVHAQTVEDEAR

SEQ ID NO: 72176 - protein, 16 aa, Mycobacterium tuberculosis
GRFEVHAQTVEDEARR

SEQ ID NO: 72177 - protein, 16 aa, Mycobacterium tuberculosis
RFEVHAQTVEDEARRM

SEQ ID NO: 72178 - protein, 16 aa, Mycobacterium tuberculosis
FEVHAQTVEDEARRMW

SEQ ID NO: 72179 - protein, 16 aa, Mycobacterium tuberculosis
EVHAQTVEDEARRMWA

SEQ ID NO: 72180 - protein, 16 aa, Mycobacterium tuberculosis
VHAQTVEDEARRMWAS

SEQ ID NO: 72181 - protein, 16 aa, Mycobacterium tuberculosis
HAQTVEDEARRMWASA

SEQ ID NO: 72182 - protein, 16 aa, Mycobacterium tuberculosis
AQTVEDEARRMWASAQ

SEQ ID NO: 72183 - protein, 16 aa, Mycobacterium tuberculosis
QTVEDEARRMWASAQN

SEQ ID NO: 72184 - protein, 16 aa, Mycobacterium tuberculosis
TVEDEARRMWASAQNI

SEQ ID NO: 72185 - protein, 16 aa, Mycobacterium tuberculosis
VEDEARRMWASAQNIS

SEQ ID NO: 72186 - protein, 16 aa, Mycobacterium tuberculosis
EDEARRMWASAQNISG

SEQ ID NO: 72187 - protein, 16 aa, Mycobacterium tuberculosis
DEARRMWASAQNISGA

SEQ ID NO: 72188 - protein, 16 aa, Mycobacterium tuberculosis
EARRMWASAQNISGAG

SEQ ID NO: 72189 - protein, 16 aa, Mycobacterium tuberculosis
ARRMWASAQNISGAGW

SEQ ID NO: 72190 - protein, 16 aa, Mycobacterium tuberculosis
RRMWASAQNISGAGWS

SEQ ID NO: 72191 - protein, 16 aa, Mycobacterium tuberculosis
RMWASAQNISGAGWSG

SEQ ID NO: 72192 - protein, 16 aa, Mycobacterium tuberculosis
MWASAQNISGAGWSGM

SEQ ID NO: 72193 - protein, 16 aa, Mycobacterium tuberculosis
WASAQNISGAGWSGMA

SEQ ID NO: 72194 - protein, 16 aa, Mycobacterium tuberculosis
ASAQNISGAGWSGMAE

SEQ ID NO: 72195 - protein, 16 aa, Mycobacterium tuberculosis
SAQNISGAGWSGMAEA

SEQ ID NO: 72196 - protein, 16 aa, Mycobacterium tuberculosis
AQNISGAGWSGMAEAT

SEQ ID NO: 72197 - protein, 16 aa, Mycobacterium tuberculosis
QNISGAGWSGMAEATS

SEQ ID NO: 72198 - protein, 16 aa, Mycobacterium tuberculosis
NISGAGWSGMAEATSL

SEQ ID NO: 72199 - protein, 16 aa, Mycobacterium tuberculosis
ISGAGWSGMAEATSLD

SEQ ID NO: 72200 - protein, 16 aa, Mycobacterium tuberculosis
SGAGWSGMAEATSLDT

SEQ ID NO: 72201 - protein, 16 aa, Mycobacterium tuberculosis
GAGWSGMAEATSLDTM

SEQ ID NO: 72202 - protein, 16 aa, Mycobacterium tuberculosis
AGWSGMAEATSLDTMT

SEQ ID NO: 72203 - protein, 16 aa, Mycobacterium tuberculosis
GWSGMAEATSLDTMTQ

SEQ ID NO: 72204 - protein, 16 aa, Mycobacterium tuberculosis
WSGMAEATSLDTMTQM

SEQ ID NO: 72205 - protein, 16 aa, Mycobacterium tuberculosis
SGMAEATSLDTMTQMN

SEQ ID NO: 72206 - protein, 16 aa, Mycobacterium tuberculosis
GMAEATSLDTMTQMNQ

SEQ ID NO: 72207 - protein, 16 aa, Mycobacterium tuberculosis
MAEATSLDTMTQMNQA

SEQ ID NO: 72208 - protein, 16 aa, Mycobacterium tuberculosis
AEATSLDTMTQMNQAF

SEQ ID NO: 72209 - protein, 16 aa, Mycobacterium tuberculosis
EATSLDTMTQMNQAFR

SEQ ID NO: 72210 - protein, 16 aa, Mycobacterium tuberculosis
ATSLDTMTQMNQAFRN

SEQ ID NO: 72211 - protein, 16 aa, Mycobacterium tuberculosis
TSLDTMTQMNQAFRNI

SEQ ID NO: 72212 - protein, 16 aa, Mycobacterium tuberculosis
SLDTMTQMNQAFRNIV

SEQ ID NO: 72213 - protein, 16 aa, Mycobacterium tuberculosis
LDTMTQMNQAFRNIVN

SEQ ID NO: 72214 - protein, 16 aa, Mycobacterium tuberculosis
DTMTQMNQAFRNIVNM

SEQ ID NO: 72215 - protein, 16 aa, Mycobacterium tuberculosis
TMTQMNQAFRNIVNML

SEQ ID NO: 72216 - protein, 16 aa, Mycobacterium tuberculosis
MTQMNQAFRNIVNMLH

SEQ ID NO: 72217 - protein, 16 aa, Mycobacterium tuberculosis
TQMNQAFRNIVNMLHG

SEQ ID NO: 72218 - protein, 16 aa, Mycobacterium tuberculosis
QMNQAFRNIVNMLHGV

SEQ ID NO: 72219 - protein, 16 aa, Mycobacterium tuberculosis
MNQAFRNIVNMLHGVR

SEQ ID NO: 72220 - protein, 16 aa, Mycobacterium tuberculosis
NQAFRNIVNMLHGVRD

SEQ ID NO: 72221 - protein, 16 aa, Mycobacterium tuberculosis
QAFRNIVNMLHGVRDG

SEQ ID NO: 72222 - protein, 16 aa, Mycobacterium tuberculosis
AFRNIVNMLHGVRDGL

SEQ ID NO: 72223 - protein, 16 aa, Mycobacterium tuberculosis
FRNIVNMLHGVRDGLV

SEQ ID NO: 72224 - protein, 16 aa, Mycobacterium tuberculosis
RNIVNMLHGVRDGLVR

SEQ ID NO: 72225 - protein, 16 aa, Mycobacterium tuberculosis
NIVNMLHGVRDGLVRD

SEQ ID NO: 72226 - protein, 16 aa, Mycobacterium tuberculosis
IVNMLHGVRDGLVRDA

SEQ ID NO: 72227 - protein, 16 aa, Mycobacterium tuberculosis
VNMLHGVRDGLVRDAN

SEQ ID NO: 72228 - protein, 16 aa, Mycobacterium tuberculosis
NMLHGVRDGLVRDANN

SEQ ID NO: 72229 - protein, 16 aa, Mycobacterium tuberculosis
MLHGVRDGLVRDANNY

SEQ ID NO: 72230 - protein, 16 aa, Mycobacterium tuberculosis
LHGVRDGLVRDANNYE

SEQ ID NO: 72231 - protein, 16 aa, Mycobacterium tuberculosis
HGVRDGLVRDANNYEQ

SEQ ID NO: 72232 - protein, 16 aa, Mycobacterium tuberculosis
GVRDGLVRDANNYEQQ

SEQ ID NO: 72233 - protein, 16 aa, Mycobacterium tuberculosis
VRDGLVRDANNYEQQE

SEQ ID NO: 72234 - protein, 16 aa, Mycobacterium tuberculosis
RDGLVRDANNYEQQEQ

SEQ ID NO: 72235 - protein, 16 aa, Mycobacterium tuberculosis
DGLVRDANNYEQQEQA

SEQ ID NO: 72236 - protein, 16 aa, Mycobacterium tuberculosis
GLVRDANNYEQQEQAS

SEQ ID NO: 72237 - protein, 16 aa, Mycobacterium tuberculosis
LVRDANNYEQQEQASQ

SEQ ID NO: 72238 - protein, 16 aa, Mycobacterium tuberculosis
VRDANNYEQQEQASQQ

SEQ ID NO: 72239 - protein, 16 aa, Mycobacterium tuberculosis
RDANNYEQQEQASQQI

SEQ ID NO: 72240 - protein, 16 aa, Mycobacterium tuberculosis
DANNYEQQEQASQQIL

SEQ ID NO: 72241 - protein, 16 aa, Mycobacterium tuberculosis
ANNYEQQEQASQQILS

SEQ ID NO: 72242 - protein, 16 aa, Mycobacterium tuberculosis
NNYEQQEQASQQILSS

SEQ ID NO: 72243 - protein, 13 aa, Mycobacterium tuberculosis
MELRDWLRVDVKA

SEQ ID NO: 72244 - protein, 13 aa, Mycobacterium tuberculosis
ELRDWLRVDVKAG

SEQ ID NO: 72245 - protein, 13 aa, Mycobacterium tuberculosis
LRDWLRVDVKAGK

SEQ ID NO: 72246 - protein, 13 aa, Mycobacterium tuberculosis
RDWLRVDVKAGKP

SEQ ID NO: 72247 - protein, 13 aa, Mycobacterium tuberculosis
DWLRVDVKAGKPL

SEQ ID NO: 72248 - protein, 13 aa, Mycobacterium tuberculosis
WLRVDVKAGKPLF

SEQ ID NO: 72249 - protein, 13 aa, Mycobacterium tuberculosis
LRVDVKAGKPLFD

SEQ ID NO: 72250 - protein, 13 aa, Mycobacterium tuberculosis
RVDVKAGKPLFDQ

SEQ ID NO: 72251 - protein, 13 aa, Mycobacterium tuberculosis
VDVKAGKPLFDQL

SEQ ID NO: 72252 - protein, 13 aa, Mycobacterium tuberculosis
DVKAGKPLFDQLR

SEQ ID NO: 72253 - protein, 13 aa, Mycobacterium tuberculosis
VKAGKPLFDQLRT

SEQ ID NO: 72254 - protein, 13 aa, Mycobacterium tuberculosis
KAGKPLFDQLRTQ

SEQ ID NO: 72255 - protein, 13 aa, Mycobacterium tuberculosis
AGKPLFDQLRTQV

SEQ ID NO: 72256 - protein, 13 aa, Mycobacterium tuberculosis
GKPLFDQLRTQVI

SEQ ID NO: 72257 - protein, 13 aa, Mycobacterium tuberculosis
KPLFDQLRTQVID

SEQ ID NO: 72258 - protein, 13 aa, Mycobacterium tuberculosis
PLFDQLRTQVIDG

SEQ ID NO: 72259 - protein, 13 aa, Mycobacterium tuberculosis
LFDQLRTQVIDGV

SEQ ID NO: 72260 - protein, 13 aa, Mycobacterium tuberculosis
FDQLRTQVIDGVR

SEQ ID NO: 72261 - protein, 13 aa, Mycobacterium tuberculosis
DQLRTQVIDGVRA

SEQ ID NO: 72262 - protein, 13 aa, Mycobacterium tuberculosis
QLRTQVIDGVRAG

SEQ ID NO: 72263 - protein, 13 aa, Mycobacterium tuberculosis
LRTQVIDGVRAGA

SEQ ID NO: 72264 - protein, 13 aa, Mycobacterium tuberculosis
RTQVIDGVRAGAL

SEQ ID NO: 72265 - protein, 13 aa, Mycobacterium tuberculosis
TQVIDGVRAGALP

SEQ ID NO: 72266 - protein, 13 aa, Mycobacterium tuberculosis
QVIDGVRAGALPP

SEQ ID NO: 72267 - protein, 13 aa, Mycobacterium tuberculosis
VIDGVRAGALPPG

SEQ ID NO: 72268 - protein, 13 aa, Mycobacterium tuberculosis
IDGVRAGALPPGT

SEQ ID NO: 72269 - protein, 13 aa, Mycobacterium tuberculosis
DGVRAGALPPGTR

SEQ ID NO: 72270 - protein, 13 aa, Mycobacterium tuberculosis
GVRAGALPPGTRL

SEQ ID NO: 72271 - protein, 13 aa, Mycobacterium tuberculosis
VRAGALPPGTRLP

SEQ ID NO: 72272 - protein, 13 aa, Mycobacterium tuberculosis
RAGALPPGTRLPT

SEQ ID NO: 72273 - protein, 13 aa, Mycobacterium tuberculosis
AGALPPGTRLPTV

SEQ ID NO: 72274 - protein, 13 aa, Mycobacterium tuberculosis
GALPPGTRLPTVR

SEQ ID NO: 72275 - protein, 13 aa, Mycobacterium tuberculosis
ALPPGTRLPTVRD

SEQ ID NO: 72276 - protein, 13 aa, Mycobacterium tuberculosis
LPPGTRLPTVRDL

SEQ ID NO: 72277 - protein, 13 aa, Mycobacterium tuberculosis
PPGTRLPTVRDLA

SEQ ID NO: 72278 - protein, 13 aa, Mycobacterium tuberculosis
PGTRLPTVRDLAG

SEQ ID NO: 72279 - protein, 13 aa, Mycobacterium tuberculosis
GTRLPTVRDLAGQ

SEQ ID NO: 72280 - protein, 13 aa, Mycobacterium tuberculosis
TRLPTVRDLAGQL

SEQ ID NO: 72281 - protein, 13 aa, Mycobacterium tuberculosis
RLPTVRDLAGQLG

SEQ ID NO: 72282 - protein, 13 aa, Mycobacterium tuberculosis
LPTVRDLAGQLGV

SEQ ID NO: 72283 - protein, 13 aa, Mycobacterium tuberculosis
PTVRDLAGQLGVA

SEQ ID NO: 72284 - protein, 13 aa, Mycobacterium tuberculosis
TVRDLAGQLGVAA

SEQ ID NO: 72285 - protein, 13 aa, Mycobacterium tuberculosis
VRDLAGQLGVAAN

SEQ ID NO: 72286 - protein, 13 aa, Mycobacterium tuberculosis
RDLAGQLGVAANT

SEQ ID NO: 72287 - protein, 13 aa, Mycobacterium tuberculosis
DLAGQLGVAANTV

SEQ ID NO: 72288 - protein, 13 aa, Mycobacterium tuberculosis
LAGQLGVAANTVA

SEQ ID NO: 72289 - protein, 13 aa, Mycobacterium tuberculosis
AGQLGVAANTVAR

SEQ ID NO: 72290 - protein, 13 aa, Mycobacterium tuberculosis
GQLGVAANTVARA

SEQ ID NO: 72291 - protein, 13 aa, Mycobacterium tuberculosis
QLGVAANTVARAY

SEQ ID NO: 72292 - protein, 13 aa, Mycobacterium tuberculosis
LGVAANTVARAYR

SEQ ID NO: 72293 - protein, 13 aa, Mycobacterium tuberculosis
GVAANTVARAYRE

SEQ ID NO: 72294 - protein, 13 aa, Mycobacterium tuberculosis
VAANTVARAYREL

SEQ ID NO: 72295 - protein, 13 aa, Mycobacterium tuberculosis
AANTVARAYRELE

SEQ ID NO: 72296 - protein, 13 aa, Mycobacterium tuberculosis
ANTVARAYRELES

SEQ ID NO: 72297 - protein, 13 aa, Mycobacterium tuberculosis
NTVARAYRELESA

SEQ ID NO: 72298 - protein, 13 aa, Mycobacterium tuberculosis
TVARAYRELESAA

SEQ ID NO: 72299 - protein, 13 aa, Mycobacterium tuberculosis
VARAYRELESAAI

SEQ ID NO: 72300 - protein, 13 aa, Mycobacterium tuberculosis
ARAYRELESAAIV

SEQ ID NO: 72301 - protein, 13 aa, Mycobacterium tuberculosis
RAYRELESAAIVE

SEQ ID NO: 72302 - protein, 13 aa, Mycobacterium tuberculosis
AYRELESAAIVET

SEQ ID NO: 72303 - protein, 13 aa, Mycobacterium tuberculosis
YRELESAAIVETR

SEQ ID NO: 72304 - protein, 13 aa, Mycobacterium tuberculosis
RELESAAIVETRG

SEQ ID NO: 72305 - protein, 13 aa, Mycobacterium tuberculosis
ELESAAIVETRGR

SEQ ID NO: 72306 - protein, 13 aa, Mycobacterium tuberculosis
LESAAIVETRGRF

SEQ ID NO: 72307 - protein, 13 aa, Mycobacterium tuberculosis
ESAAIVETRGRFG

SEQ ID NO: 72308 - protein, 13 aa, Mycobacterium tuberculosis
SAAIVETRGRFGT

SEQ ID NO: 72309 - protein, 13 aa, Mycobacterium tuberculosis
AAIVETRGRFGTF

SEQ ID NO: 72310 - protein, 13 aa, Mycobacterium tuberculosis
AIVETRGRFGTFI

SEQ ID NO: 72311 - protein, 13 aa, Mycobacterium tuberculosis
IVETRGRFGTFIS

SEQ ID NO: 72312 - protein, 13 aa, Mycobacterium tuberculosis
VETRGRFGTFISR

SEQ ID NO: 72313 - protein, 13 aa, Mycobacterium tuberculosis
ETRGRFGTFISRF

SEQ ID NO: 72314 - protein, 13 aa, Mycobacterium tuberculosis
TRGRFGTFISRFD

SEQ ID NO: 72315 - protein, 13 aa, Mycobacterium tuberculosis
RGRFGTFISRFDP

SEQ ID NO: 72316 - protein, 13 aa, Mycobacterium tuberculosis
GRFGTFISRFDPT

SEQ ID NO: 72317 - protein, 13 aa, Mycobacterium tuberculosis
RFGTFISRFDPTD

SEQ ID NO: 72318 - protein, 13 aa, Mycobacterium tuberculosis
FGTFISRFDPTDA

SEQ ID NO: 72319 - protein, 13 aa, Mycobacterium tuberculosis
GTFISRFDPTDAA

SEQ ID NO: 72320 - protein, 13 aa, Mycobacterium tuberculosis
TFISRFDPTDAAM

SEQ ID NO: 72321 - protein, 13 aa, Mycobacterium tuberculosis
FISRFDPTDAAMA

SEQ ID NO: 72322 - protein, 13 aa, Mycobacterium tuberculosis
ISRFDPTDAAMAA

SEQ ID NO: 72323 - protein, 13 aa, Mycobacterium tuberculosis
SRFDPTDAAMAAA

SEQ ID NO: 72324 - protein, 13 aa, Mycobacterium tuberculosis
RFDPTDAAMAAAA

SEQ ID NO: 72325 - protein, 13 aa, Mycobacterium tuberculosis
FDPTDAAMAAAAK

SEQ ID NO: 72326 - protein, 13 aa, Mycobacterium tuberculosis
DPTDAAMAAAAKE

SEQ ID NO: 72327 - protein, 13 aa, Mycobacterium tuberculosis
PTDAAMAAAAKEY

SEQ ID NO: 72328 - protein, 13 aa, Mycobacterium tuberculosis
TDAAMAAAAKEYV

SEQ ID NO: 72329 - protein, 13 aa, Mycobacterium tuberculosis
DAAMAAAAKEYVG

SEQ ID NO: 72330 - protein, 13 aa, Mycobacterium tuberculosis
AAMAAAAKEYVGV

SEQ ID NO: 72331 - protein, 13 aa, Mycobacterium tuberculosis
AMAAAAKEYVGVA

SEQ ID NO: 72332 - protein, 13 aa, Mycobacterium tuberculosis
MAAAAKEYVGVAR

SEQ ID NO: 72333 - protein, 13 aa, Mycobacterium tuberculosis
AAAAKEYVGVARA

SEQ ID NO: 72334 - protein, 13 aa, Mycobacterium tuberculosis
AAAKEYVGVARAL

SEQ ID NO: 72335 - protein, 13 aa, Mycobacterium tuberculosis
AAKEYVGVARALG

SEQ ID NO: 72336 - protein, 13 aa, Mycobacterium tuberculosis
AKEYVGVARALGL

SEQ ID NO: 72337 - protein, 13 aa, Mycobacterium tuberculosis
KEYVGVARALGLT

SEQ ID NO: 72338 - protein, 13 aa, Mycobacterium tuberculosis
EYVGVARALGLTK

SEQ ID NO: 72339 - protein, 13 aa, Mycobacterium tuberculosis
YVGVARALGLTKS

SEQ ID NO: 72340 - protein, 13 aa, Mycobacterium tuberculosis
VGVARALGLTKSD

SEQ ID NO: 72341 - protein, 13 aa, Mycobacterium tuberculosis
GVARALGLTKSDA

SEQ ID NO: 72342 - protein, 13 aa, Mycobacterium tuberculosis
VARALGLTKSDAM

SEQ ID NO: 72343 - protein, 13 aa, Mycobacterium tuberculosis
ARALGLTKSDAMR

SEQ ID NO: 72344 - protein, 13 aa, Mycobacterium tuberculosis
RALGLTKSDAMRY

SEQ ID NO: 72345 - protein, 13 aa, Mycobacterium tuberculosis
ALGLTKSDAMRYL

SEQ ID NO: 72346 - protein, 13 aa, Mycobacterium tuberculosis
LGLTKSDAMRYLT

SEQ ID NO: 72347 - protein, 13 aa, Mycobacterium tuberculosis
GLTKSDAMRYLTH

SEQ ID NO: 72348 - protein, 13 aa, Mycobacterium tuberculosis
LTKSDAMRYLTHV

SEQ ID NO: 72349 - protein, 13 aa, Mycobacterium tuberculosis
TKSDAMRYLTHVP

SEQ ID NO: 72350 - protein, 13 aa, Mycobacterium tuberculosis
KSDAMRYLTHVPD

SEQ ID NO: 72351 - protein, 13 aa, Mycobacterium tuberculosis
SDAMRYLTHVPDD

SEQ ID NO: 72352 - protein, 14 aa, Mycobacterium tuberculosis
MELRDWLRVDVKAG

SEQ ID NO: 72353 - protein, 14 aa, Mycobacterium tuberculosis
ELRDWLRVDVKAGK

SEQ ID NO: 72354 - protein, 14 aa, Mycobacterium tuberculosis
LRDWLRVDVKAGKP

SEQ ID NO: 72355 - protein, 14 aa, Mycobacterium tuberculosis
RDWLRVDVKAGKPL

SEQ ID NO: 72356 - protein, 14 aa, Mycobacterium tuberculosis
DWLRVDVKAGKPLF

SEQ ID NO: 72357 - protein, 14 aa, Mycobacterium tuberculosis
WLRVDVKAGKPLFD

SEQ ID NO: 72358 - protein, 14 aa, Mycobacterium tuberculosis
LRVDVKAGKPLFDQ

SEQ ID NO: 72359 - protein, 14 aa, Mycobacterium tuberculosis
RVDVKAGKPLFDQL

SEQ ID NO: 72360 - protein, 14 aa, Mycobacterium tuberculosis
VDVKAGKPLFDQLR

SEQ ID NO: 72361 - protein, 14 aa, Mycobacterium tuberculosis
DVKAGKPLFDQLRT

SEQ ID NO: 72362 - protein, 14 aa, Mycobacterium tuberculosis
VKAGKPLFDQLRTQ

SEQ ID NO: 72363 - protein, 14 aa, Mycobacterium tuberculosis
KAGKPLFDQLRTQV

SEQ ID NO: 72364 - protein, 14 aa, Mycobacterium tuberculosis
AGKPLFDQLRTQVI

SEQ ID NO: 72365 - protein, 14 aa, Mycobacterium tuberculosis
GKPLFDQLRTQVID

SEQ ID NO: 72366 - protein, 14 aa, Mycobacterium tuberculosis
KPLFDQLRTQVIDG

SEQ ID NO: 72367 - protein, 14 aa, Mycobacterium tuberculosis
PLFDQLRTQVIDGV

SEQ ID NO: 72368 - protein, 14 aa, Mycobacterium tuberculosis
LFDQLRTQVIDGVR

SEQ ID NO: 72369 - protein, 14 aa, Mycobacterium tuberculosis
FDQLRTQVIDGVRA

SEQ ID NO: 72370 - protein, 14 aa, Mycobacterium tuberculosis
DQLRTQVIDGVRAG

SEQ ID NO: 72371 - protein, 14 aa, Mycobacterium tuberculosis
QLRTQVIDGVRAGA

SEQ ID NO: 72372 - protein, 14 aa, Mycobacterium tuberculosis
LRTQVIDGVRAGAL

SEQ ID NO: 72373 - protein, 14 aa, Mycobacterium tuberculosis
RTQVIDGVRAGALP

SEQ ID NO: 72374 - protein, 14 aa, Mycobacterium tuberculosis
TQVIDGVRAGALPP

SEQ ID NO: 72375 - protein, 14 aa, Mycobacterium tuberculosis
QVIDGVRAGALPPG

SEQ ID NO: 72376 - protein, 14 aa, Mycobacterium tuberculosis
VIDGVRAGALPPGT

SEQ ID NO: 72377 - protein, 14 aa, Mycobacterium tuberculosis
IDGVRAGALPPGTR

SEQ ID NO: 72378 - protein, 14 aa, Mycobacterium tuberculosis
DGVRAGALPPGTRL

SEQ ID NO: 72379 - protein, 14 aa, Mycobacterium tuberculosis
GVRAGALPPGTRLP

SEQ ID NO: 72380 - protein, 14 aa, Mycobacterium tuberculosis
VRAGALPPGTRLPT

SEQ ID NO: 72381 - protein, 14 aa, Mycobacterium tuberculosis
RAGALPPGTRLPTV

SEQ ID NO: 72382 - protein, 14 aa, Mycobacterium tuberculosis
AGALPPGTRLPTVR

SEQ ID NO: 72383 - protein, 14 aa, Mycobacterium tuberculosis
GALPPGTRLPTVRD

SEQ ID NO: 72384 - protein, 14 aa, Mycobacterium tuberculosis
ALPPGTRLPTVRDL

SEQ ID NO: 72385 - protein, 14 aa, Mycobacterium tuberculosis
LPPGTRLPTVRDLA

SEQ ID NO: 72386 - protein, 14 aa, Mycobacterium tuberculosis
PPGTRLPTVRDLAG

SEQ ID NO: 72387 - protein, 14 aa, Mycobacterium tuberculosis
PGTRLPTVRDLAGQ

SEQ ID NO: 72388 - protein, 14 aa, Mycobacterium tuberculosis
GTRLPTVRDLAGQL

SEQ ID NO: 72389 - protein, 14 aa, Mycobacterium tuberculosis
TRLPTVRDLAGQLG

SEQ ID NO: 72390 - protein, 14 aa, Mycobacterium tuberculosis
RLPTVRDLAGQLGV

SEQ ID NO: 72391 - protein, 14 aa, Mycobacterium tuberculosis
LPTVRDLAGQLGVA

SEQ ID NO: 72392 - protein, 14 aa, Mycobacterium tuberculosis
PTVRDLAGQLGVAA

SEQ ID NO: 72393 - protein, 14 aa, Mycobacterium tuberculosis
TVRDLAGQLGVAAN

SEQ ID NO: 72394 - protein, 14 aa, Mycobacterium tuberculosis
VRDLAGQLGVAANT

SEQ ID NO: 72395 - protein, 14 aa, Mycobacterium tuberculosis
RDLAGQLGVAANTV

SEQ ID NO: 72396 - protein, 14 aa, Mycobacterium tuberculosis
DLAGQLGVAANTVA

SEQ ID NO: 72397 - protein, 14 aa, Mycobacterium tuberculosis
LAGQLGVAANTVAR

SEQ ID NO: 72398 - protein, 14 aa, Mycobacterium tuberculosis
AGQLGVAANTVARA

SEQ ID NO: 72399 - protein, 14 aa, Mycobacterium tuberculosis
GQLGVAANTVARAY

SEQ ID NO: 72400 - protein, 14 aa, Mycobacterium tuberculosis
QLGVAANTVARAYR

SEQ ID NO: 72401 - protein, 14 aa, Mycobacterium tuberculosis
LGVAANTVARAYRE

SEQ ID NO: 72402 - protein, 14 aa, Mycobacterium tuberculosis
GVAANTVARAYREL

SEQ ID NO: 72403 - protein, 14 aa, Mycobacterium tuberculosis
VAANTVARAYRELE

SEQ ID NO: 72404 - protein, 14 aa, Mycobacterium tuberculosis
AANTVARAYRELES

SEQ ID NO: 72405 - protein, 14 aa, Mycobacterium tuberculosis
ANTVARAYRELESA

SEQ ID NO: 72406 - protein, 14 aa, Mycobacterium tuberculosis
NTVARAYRELESAA

SEQ ID NO: 72407 - protein, 14 aa, Mycobacterium tuberculosis
TVARAYRELESAAI

SEQ ID NO: 72408 - protein, 14 aa, Mycobacterium tuberculosis
VARAYRELESAAIV

SEQ ID NO: 72409 - protein, 14 aa, Mycobacterium tuberculosis
ARAYRELESAAIVE

SEQ ID NO: 72410 - protein, 14 aa, Mycobacterium tuberculosis
RAYRELESAAIVET

SEQ ID NO: 72411 - protein, 14 aa, Mycobacterium tuberculosis
AYRELESAAIVETR

SEQ ID NO: 72412 - protein, 14 aa, Mycobacterium tuberculosis
YRELESAAIVETRG

SEQ ID NO: 72413 - protein, 14 aa, Mycobacterium tuberculosis
RELESAAIVETRGR

SEQ ID NO: 72414 - protein, 14 aa, Mycobacterium tuberculosis
ELESAAIVETRGRF

SEQ ID NO: 72415 - protein, 14 aa, Mycobacterium tuberculosis
LESAAIVETRGRFG

SEQ ID NO: 72416 - protein, 14 aa, Mycobacterium tuberculosis
ESAAIVETRGRFGT

SEQ ID NO: 72417 - protein, 14 aa, Mycobacterium tuberculosis
SAAIVETRGRFGTF

SEQ ID NO: 72418 - protein, 14 aa, Mycobacterium tuberculosis
AAIVETRGRFGTFI

SEQ ID NO: 72419 - protein, 14 aa, Mycobacterium tuberculosis
AIVETRGRFGTFIS

SEQ ID NO: 72420 - protein, 14 aa, Mycobacterium tuberculosis
IVETRGRFGTFISR

SEQ ID NO: 72421 - protein, 14 aa, Mycobacterium tuberculosis
VETRGRFGTFISRF

SEQ ID NO: 72422 - protein, 14 aa, Mycobacterium tuberculosis
ETRGRFGTFISRFD

SEQ ID NO: 72423 - protein, 14 aa, Mycobacterium tuberculosis
TRGRFGTFISRFDP

SEQ ID NO: 72424 - protein, 14 aa, Mycobacterium tuberculosis
RGRFGTFISRFDPT

SEQ ID NO: 72425 - protein, 14 aa, Mycobacterium tuberculosis
GRFGTFISRFDPTD

SEQ ID NO: 72426 - protein, 14 aa, Mycobacterium tuberculosis
RFGTFISRFDPTDA

SEQ ID NO: 72427 - protein, 14 aa, Mycobacterium tuberculosis
FGTFISRFDPTDAA

SEQ ID NO: 72428 - protein, 14 aa, Mycobacterium tuberculosis
GTFISRFDPTDAAM

SEQ ID NO: 72429 - protein, 14 aa, Mycobacterium tuberculosis
TFISRFDPTDAAMA

SEQ ID NO: 72430 - protein, 14 aa, Mycobacterium tuberculosis
FISRFDPTDAAMAA

SEQ ID NO: 72431 - protein, 14 aa, Mycobacterium tuberculosis
ISRFDPTDAAMAAA

SEQ ID NO: 72432 - protein, 14 aa, Mycobacterium tuberculosis
SRFDPTDAAMAAAA

SEQ ID NO: 72433 - protein, 14 aa, Mycobacterium tuberculosis
RFDPTDAAMAAAAK

SEQ ID NO: 72434 - protein, 14 aa, Mycobacterium tuberculosis
FDPTDAAMAAAAKE

SEQ ID NO: 72435 - protein, 14 aa, Mycobacterium tuberculosis
DPTDAAMAAAAKEY

SEQ ID NO: 72436 - protein, 14 aa, Mycobacterium tuberculosis
PTDAAMAAAAKEYV

SEQ ID NO: 72437 - protein, 14 aa, Mycobacterium tuberculosis
TDAAMAAAAKEYVG

SEQ ID NO: 72438 - protein, 14 aa, Mycobacterium tuberculosis
DAAMAAAAKEYVGV

SEQ ID NO: 72439 - protein, 14 aa, Mycobacterium tuberculosis
AAMAAAAKEYVGVA

SEQ ID NO: 72440 - protein, 14 aa, Mycobacterium tuberculosis
AMAAAAKEYVGVAR

SEQ ID NO: 72441 - protein, 14 aa, Mycobacterium tuberculosis
MAAAAKEYVGVARA

SEQ ID NO: 72442 - protein, 14 aa, Mycobacterium tuberculosis
AAAAKEYVGVARAL

SEQ ID NO: 72443 - protein, 14 aa, Mycobacterium tuberculosis
AAAKEYVGVARALG

SEQ ID NO: 72444 - protein, 14 aa, Mycobacterium tuberculosis
AAKEYVGVARALGL

SEQ ID NO: 72445 - protein, 14 aa, Mycobacterium tuberculosis
AKEYVGVARALGLT

SEQ ID NO: 72446 - protein, 14 aa, Mycobacterium tuberculosis
KEYVGVARALGLTK

SEQ ID NO: 72447 - protein, 14 aa, Mycobacterium tuberculosis
EYVGVARALGLTKS

SEQ ID NO: 72448 - protein, 14 aa, Mycobacterium tuberculosis
YVGVARALGLTKSD

SEQ ID NO: 72449 - protein, 14 aa, Mycobacterium tuberculosis
VGVARALGLTKSDA

SEQ ID NO: 72450 - protein, 14 aa, Mycobacterium tuberculosis
GVARALGLTKSDAM

SEQ ID NO: 72451 - protein, 14 aa, Mycobacterium tuberculosis
VARALGLTKSDAMR

SEQ ID NO: 72452 - protein, 14 aa, Mycobacterium tuberculosis
ARALGLTKSDAMRY

SEQ ID NO: 72453 - protein, 14 aa, Mycobacterium tuberculosis
RALGLTKSDAMRYL

SEQ ID NO: 72454 - protein, 14 aa, Mycobacterium tuberculosis
ALGLTKSDAMRYLT

SEQ ID NO: 72455 - protein, 14 aa, Mycobacterium tuberculosis
LGLTKSDAMRYLTH

SEQ ID NO: 72456 - protein, 14 aa, Mycobacterium tuberculosis
GLTKSDAMRYLTHV

SEQ ID NO: 72457 - protein, 14 aa, Mycobacterium tuberculosis
LTKSDAMRYLTHVP

SEQ ID NO: 72458 - protein, 14 aa, Mycobacterium tuberculosis
TKSDAMRYLTHVPD

SEQ ID NO: 72459 - protein, 14 aa, Mycobacterium tuberculosis
KSDAMRYLTHVPDD

SEQ ID NO: 72460 - protein, 15 aa, Mycobacterium tuberculosis
MELRDWLRVDVKAGK

SEQ ID NO: 72461 - protein, 15 aa, Mycobacterium tuberculosis
ELRDWLRVDVKAGKP

SEQ ID NO: 72462 - protein, 15 aa, Mycobacterium tuberculosis
LRDWLRVDVKAGKPL

SEQ ID NO: 72463 - protein, 15 aa, Mycobacterium tuberculosis
RDWLRVDVKAGKPLF

SEQ ID NO: 72464 - protein, 15 aa, Mycobacterium tuberculosis
DWLRVDVKAGKPLFD

SEQ ID NO: 72465 - protein, 15 aa, Mycobacterium tuberculosis
WLRVDVKAGKPLFDQ

SEQ ID NO: 72466 - protein, 15 aa, Mycobacterium tuberculosis
LRVDVKAGKPLFDQL

SEQ ID NO: 72467 - protein, 15 aa, Mycobacterium tuberculosis
RVDVKAGKPLFDQLR

SEQ ID NO: 72468 - protein, 15 aa, Mycobacterium tuberculosis
VDVKAGKPLFDQLRT

SEQ ID NO: 72469 - protein, 15 aa, Mycobacterium tuberculosis
DVKAGKPLFDQLRTQ

SEQ ID NO: 72470 - protein, 15 aa, Mycobacterium tuberculosis
VKAGKPLFDQLRTQV

SEQ ID NO: 72471 - protein, 15 aa, Mycobacterium tuberculosis
KAGKPLFDQLRTQVI

SEQ ID NO: 72472 - protein, 15 aa, Mycobacterium tuberculosis
AGKPLFDQLRTQVID

SEQ ID NO: 72473 - protein, 15 aa, Mycobacterium tuberculosis
GKPLFDQLRTQVIDG

SEQ ID NO: 72474 - protein, 15 aa, Mycobacterium tuberculosis
KPLFDQLRTQVIDGV

SEQ ID NO: 72475 - protein, 15 aa, Mycobacterium tuberculosis
PLFDQLRTQVIDGVR

SEQ ID NO: 72476 - protein, 15 aa, Mycobacterium tuberculosis
LFDQLRTQVIDGVRA

SEQ ID NO: 72477 - protein, 15 aa, Mycobacterium tuberculosis
FDQLRTQVIDGVRAG

SEQ ID NO: 72478 - protein, 15 aa, Mycobacterium tuberculosis
DQLRTQVIDGVRAGA

SEQ ID NO: 72479 - protein, 15 aa, Mycobacterium tuberculosis
QLRTQVIDGVRAGAL

SEQ ID NO: 72480 - protein, 15 aa, Mycobacterium tuberculosis
LRTQVIDGVRAGALP

SEQ ID NO: 72481 - protein, 15 aa, Mycobacterium tuberculosis
RTQVIDGVRAGALPP

SEQ ID NO: 72482 - protein, 15 aa, Mycobacterium tuberculosis
TQVIDGVRAGALPPG

SEQ ID NO: 72483 - protein, 15 aa, Mycobacterium tuberculosis
QVIDGVRAGALPPGT

SEQ ID NO: 72484 - protein, 15 aa, Mycobacterium tuberculosis
VIDGVRAGALPPGTR

SEQ ID NO: 72485 - protein, 15 aa, Mycobacterium tuberculosis
IDGVRAGALPPGTRL

SEQ ID NO: 72486 - protein, 15 aa, Mycobacterium tuberculosis
DGVRAGALPPGTRLP

SEQ ID NO: 72487 - protein, 15 aa, Mycobacterium tuberculosis
GVRAGALPPGTRLPT

SEQ ID NO: 72488 - protein, 15 aa, Mycobacterium tuberculosis
VRAGALPPGTRLPTV

SEQ ID NO: 72489 - protein, 15 aa, Mycobacterium tuberculosis
RAGALPPGTRLPTVR

SEQ ID NO: 72490 - protein, 15 aa, Mycobacterium tuberculosis
AGALPPGTRLPTVRD

SEQ ID NO: 72491 - protein, 15 aa, Mycobacterium tuberculosis
GALPPGTRLPTVRDL

SEQ ID NO: 72492 - protein, 15 aa, Mycobacterium tuberculosis
ALPPGTRLPTVRDLA

SEQ ID NO: 72493 - protein, 15 aa, Mycobacterium tuberculosis
LPPGTRLPTVRDLAG

SEQ ID NO: 72494 - protein, 15 aa, Mycobacterium tuberculosis
PPGTRLPTVRDLAGQ

SEQ ID NO: 72495 - protein, 15 aa, Mycobacterium tuberculosis
PGTRLPTVRDLAGQL

SEQ ID NO: 72496 - protein, 15 aa, Mycobacterium tuberculosis
GTRLPTVRDLAGQLG

SEQ ID NO: 72497 - protein, 15 aa, Mycobacterium tuberculosis
TRLPTVRDLAGQLGV

SEQ ID NO: 72498 - protein, 15 aa, Mycobacterium tuberculosis
RLPTVRDLAGQLGVA

SEQ ID NO: 72499 - protein, 15 aa, Mycobacterium tuberculosis
LPTVRDLAGQLGVAA

SEQ ID NO: 72500 - protein, 15 aa, Mycobacterium tuberculosis
PTVRDLAGQLGVAAN

SEQ ID NO: 72501 - protein, 15 aa, Mycobacterium tuberculosis
TVRDLAGQLGVAANT

SEQ ID NO: 72502 - protein, 15 aa, Mycobacterium tuberculosis
VRDLAGQLGVAANTV

SEQ ID NO: 72503 - protein, 15 aa, Mycobacterium tuberculosis
RDLAGQLGVAANTVA

SEQ ID NO: 72504 - protein, 15 aa, Mycobacterium tuberculosis
DLAGQLGVAANTVAR

SEQ ID NO: 72505 - protein, 15 aa, Mycobacterium tuberculosis
LAGQLGVAANTVARA

SEQ ID NO: 72506 - protein, 15 aa, Mycobacterium tuberculosis
AGQLGVAANTVARAY

SEQ ID NO: 72507 - protein, 15 aa, Mycobacterium tuberculosis
GQLGVAANTVARAYR

SEQ ID NO: 72508 - protein, 15 aa, Mycobacterium tuberculosis
QLGVAANTVARAYRE

SEQ ID NO: 72509 - protein, 15 aa, Mycobacterium tuberculosis
LGVAANTVARAYREL

SEQ ID NO: 72510 - protein, 15 aa, Mycobacterium tuberculosis
GVAANTVARAYRELE

SEQ ID NO: 72511 - protein, 15 aa, Mycobacterium tuberculosis
VAANTVARAYRELES

SEQ ID NO: 72512 - protein, 15 aa, Mycobacterium tuberculosis
AANTVARAYRELESA

SEQ ID NO: 72513 - protein, 15 aa, Mycobacterium tuberculosis
ANTVARAYRELESAA

SEQ ID NO: 72514 - protein, 15 aa, Mycobacterium tuberculosis
NTVARAYRELESAAI

SEQ ID NO: 72515 - protein, 15 aa, Mycobacterium tuberculosis
TVARAYRELESAAIV

SEQ ID NO: 72516 - protein, 15 aa, Mycobacterium tuberculosis
VARAYRELESAAIVE

SEQ ID NO: 72517 - protein, 15 aa, Mycobacterium tuberculosis
ARAYRELESAAIVET

SEQ ID NO: 72518 - protein, 15 aa, Mycobacterium tuberculosis
RAYRELESAAIVETR

SEQ ID NO: 72519 - protein, 15 aa, Mycobacterium tuberculosis
AYRELESAAIVETRG

SEQ ID NO: 72520 - protein, 15 aa, Mycobacterium tuberculosis
YRELESAAIVETRGR

SEQ ID NO: 72521 - protein, 15 aa, Mycobacterium tuberculosis
RELESAAIVETRGRF

SEQ ID NO: 72522 - protein, 15 aa, Mycobacterium tuberculosis
ELESAAIVETRGRFG

SEQ ID NO: 72523 - protein, 15 aa, Mycobacterium tuberculosis
LESAAIVETRGRFGT

SEQ ID NO: 72524 - protein, 15 aa, Mycobacterium tuberculosis
ESAAIVETRGRFGTF

SEQ ID NO: 72525 - protein, 15 aa, Mycobacterium tuberculosis
SAAIVETRGRFGTFI

SEQ ID NO: 72526 - protein, 15 aa, Mycobacterium tuberculosis
AAIVETRGRFGTFIS

SEQ ID NO: 72527 - protein, 15 aa, Mycobacterium tuberculosis
AIVETRGRFGTFISR

SEQ ID NO: 72528 - protein, 15 aa, Mycobacterium tuberculosis
IVETRGRFGTFISRF

SEQ ID NO: 72529 - protein, 15 aa, Mycobacterium tuberculosis
VETRGRFGTFISRFD

SEQ ID NO: 72530 - protein, 15 aa, Mycobacterium tuberculosis
ETRGRFGTFISRFDP

SEQ ID NO: 72531 - protein, 15 aa, Mycobacterium tuberculosis
TRGRFGTFISRFDPT

SEQ ID NO: 72532 - protein, 15 aa, Mycobacterium tuberculosis
RGRFGTFISRFDPTD

SEQ ID NO: 72533 - protein, 15 aa, Mycobacterium tuberculosis
GRFGTFISRFDPTDA

SEQ ID NO: 72534 - protein, 15 aa, Mycobacterium tuberculosis
RFGTFISRFDPTDAA

SEQ ID NO: 72535 - protein, 15 aa, Mycobacterium tuberculosis
FGTFISRFDPTDAAM

SEQ ID NO: 72536 - protein, 15 aa, Mycobacterium tuberculosis
GTFISRFDPTDAAMA

SEQ ID NO: 72537 - protein, 15 aa, Mycobacterium tuberculosis
TFISRFDPTDAAMAA

SEQ ID NO: 72538 - protein, 15 aa, Mycobacterium tuberculosis
FISRFDPTDAAMAAA

SEQ ID NO: 72539 - protein, 15 aa, Mycobacterium tuberculosis
ISRFDPTDAAMAAAA

SEQ ID NO: 72540 - protein, 15 aa, Mycobacterium tuberculosis
SRFDPTDAAMAAAAK

SEQ ID NO: 72541 - protein, 15 aa, Mycobacterium tuberculosis
RFDPTDAAMAAAAKE

SEQ ID NO: 72542 - protein, 15 aa, Mycobacterium tuberculosis
FDPTDAAMAAAAKEY

SEQ ID NO: 72543 - protein, 15 aa, Mycobacterium tuberculosis
DPTDAAMAAAAKEYV

SEQ ID NO: 72544 - protein, 15 aa, Mycobacterium tuberculosis
PTDAAMAAAAKEYVG

SEQ ID NO: 72545 - protein, 15 aa, Mycobacterium tuberculosis
TDAAMAAAAKEYVGV

SEQ ID NO: 72546 - protein, 15 aa, Mycobacterium tuberculosis
DAAMAAAAKEYVGVA

SEQ ID NO: 72547 - protein, 15 aa, Mycobacterium tuberculosis
AAMAAAAKEYVGVAR

SEQ ID NO: 72548 - protein, 15 aa, Mycobacterium tuberculosis
AMAAAAKEYVGVARA

SEQ ID NO: 72549 - protein, 15 aa, Mycobacterium tuberculosis
MAAAAKEYVGVARAL

SEQ ID NO: 72550 - protein, 15 aa, Mycobacterium tuberculosis
AAAAKEYVGVARALG

SEQ ID NO: 72551 - protein, 15 aa, Mycobacterium tuberculosis
AAAKEYVGVARALGL

SEQ ID NO: 72552 - protein, 15 aa, Mycobacterium tuberculosis
AAKEYVGVARALGLT

SEQ ID NO: 72553 - protein, 15 aa, Mycobacterium tuberculosis
AKEYVGVARALGLTK

SEQ ID NO: 72554 - protein, 15 aa, Mycobacterium tuberculosis
KEYVGVARALGLTKS

SEQ ID NO: 72555 - protein, 15 aa, Mycobacterium tuberculosis
EYVGVARALGLTKSD

SEQ ID NO: 72556 - protein, 15 aa, Mycobacterium tuberculosis
YVGVARALGLTKSDA

SEQ ID NO: 72557 - protein, 15 aa, Mycobacterium tuberculosis
VGVARALGLTKSDAM

SEQ ID NO: 72558 - protein, 15 aa, Mycobacterium tuberculosis
GVARALGLTKSDAMR

SEQ ID NO: 72559 - protein, 15 aa, Mycobacterium tuberculosis
VARALGLTKSDAMRY

SEQ ID NO: 72560 - protein, 15 aa, Mycobacterium tuberculosis
ARALGLTKSDAMRYL

SEQ ID NO: 72561 - protein, 15 aa, Mycobacterium tuberculosis
RALGLTKSDAMRYLT

SEQ ID NO: 72562 - protein, 15 aa, Mycobacterium tuberculosis
ALGLTKSDAMRYLTH

SEQ ID NO: 72563 - protein, 15 aa, Mycobacterium tuberculosis
LGLTKSDAMRYLTHV

SEQ ID NO: 72564 - protein, 15 aa, Mycobacterium tuberculosis
GLTKSDAMRYLTHVP

SEQ ID NO: 72565 - protein, 15 aa, Mycobacterium tuberculosis
LTKSDAMRYLTHVPD

SEQ ID NO: 72566 - protein, 15 aa, Mycobacterium tuberculosis
TKSDAMRYLTHVPDD

SEQ ID NO: 72567 - protein, 16 aa, Mycobacterium tuberculosis
MELRDWLRVDVKAGKP

SEQ ID NO: 72568 - protein, 16 aa, Mycobacterium tuberculosis
ELRDWLRVDVKAGKPL

SEQ ID NO: 72569 - protein, 16 aa, Mycobacterium tuberculosis
LRDWLRVDVKAGKPLF

SEQ ID NO: 72570 - protein, 16 aa, Mycobacterium tuberculosis
RDWLRVDVKAGKPLFD

SEQ ID NO: 72571 - protein, 16 aa, Mycobacterium tuberculosis
DWLRVDVKAGKPLFDQ

SEQ ID NO: 72572 - protein, 16 aa, Mycobacterium tuberculosis
WLRVDVKAGKPLFDQL

SEQ ID NO: 72573 - protein, 16 aa, Mycobacterium tuberculosis
LRVDVKAGKPLFDQLR

SEQ ID NO: 72574 - protein, 16 aa, Mycobacterium tuberculosis
RVDVKAGKPLFDQLRT

SEQ ID NO: 72575 - protein, 16 aa, Mycobacterium tuberculosis
VDVKAGKPLFDQLRTQ

SEQ ID NO: 72576 - protein, 16 aa, Mycobacterium tuberculosis
DVKAGKPLFDQLRTQV

SEQ ID NO: 72577 - protein, 16 aa, Mycobacterium tuberculosis
VKAGKPLFDQLRTQVI

SEQ ID NO: 72578 - protein, 16 aa, Mycobacterium tuberculosis
KAGKPLFDQLRTQVID

SEQ ID NO: 72579 - protein, 16 aa, Mycobacterium tuberculosis
AGKPLFDQLRTQVIDG

SEQ ID NO: 72580 - protein, 16 aa, Mycobacterium tuberculosis
GKPLFDQLRTQVIDGV

SEQ ID NO: 72581 - protein, 16 aa, Mycobacterium tuberculosis
KPLFDQLRTQVIDGVR

SEQ ID NO: 72582 - protein, 16 aa, Mycobacterium tuberculosis
PLFDQLRTQVIDGVRA

SEQ ID NO: 72583 - protein, 16 aa, Mycobacterium tuberculosis
LFDQLRTQVIDGVRAG

SEQ ID NO: 72584 - protein, 16 aa, Mycobacterium tuberculosis
FDQLRTQVIDGVRAGA

SEQ ID NO: 72585 - protein, 16 aa, Mycobacterium tuberculosis
DQLRTQVIDGVRAGAL

SEQ ID NO: 72586 - protein, 16 aa, Mycobacterium tuberculosis
QLRTQVIDGVRAGALP

SEQ ID NO: 72587 - protein, 16 aa, Mycobacterium tuberculosis
LRTQVIDGVRAGALPP

SEQ ID NO: 72588 - protein, 16 aa, Mycobacterium tuberculosis
RTQVIDGVRAGALPPG

SEQ ID NO: 72589 - protein, 16 aa, Mycobacterium tuberculosis
TQVIDGVRAGALPPGT

SEQ ID NO: 72590 - protein, 16 aa, Mycobacterium tuberculosis
QVIDGVRAGALPPGTR

SEQ ID NO: 72591 - protein, 16 aa, Mycobacterium tuberculosis
VIDGVRAGALPPGTRL

SEQ ID NO: 72592 - protein, 16 aa, Mycobacterium tuberculosis
IDGVRAGALPPGTRLP

SEQ ID NO: 72593 - protein, 16 aa, Mycobacterium tuberculosis
DGVRAGALPPGTRLPT

SEQ ID NO: 72594 - protein, 16 aa, Mycobacterium tuberculosis
GVRAGALPPGTRLPTV

SEQ ID NO: 72595 - protein, 16 aa, Mycobacterium tuberculosis
VRAGALPPGTRLPTVR

SEQ ID NO: 72596 - protein, 16 aa, Mycobacterium tuberculosis
RAGALPPGTRLPTVRD

SEQ ID NO: 72597 - protein, 16 aa, Mycobacterium tuberculosis
AGALPPGTRLPTVRDL

SEQ ID NO: 72598 - protein, 16 aa, Mycobacterium tuberculosis
GALPPGTRLPTVRDLA

SEQ ID NO: 72599 - protein, 16 aa, Mycobacterium tuberculosis
ALPPGTRLPTVRDLAG

SEQ ID NO: 72600 - protein, 16 aa, Mycobacterium tuberculosis
LPPGTRLPTVRDLAGQ

SEQ ID NO: 72601 - protein, 16 aa, Mycobacterium tuberculosis
PPGTRLPTVRDLAGQL

SEQ ID NO: 72602 - protein, 16 aa, Mycobacterium tuberculosis
PGTRLPTVRDLAGQLG

SEQ ID NO: 72603 - protein, 16 aa, Mycobacterium tuberculosis
GTRLPTVRDLAGQLGV

SEQ ID NO: 72604 - protein, 16 aa, Mycobacterium tuberculosis
TRLPTVRDLAGQLGVA

SEQ ID NO: 72605 - protein, 16 aa, Mycobacterium tuberculosis
RLPTVRDLAGQLGVAA

SEQ ID NO: 72606 - protein, 16 aa, Mycobacterium tuberculosis
LPTVRDLAGQLGVAAN

SEQ ID NO: 72607 - protein, 16 aa, Mycobacterium tuberculosis
PTVRDLAGQLGVAANT

SEQ ID NO: 72608 - protein, 16 aa, Mycobacterium tuberculosis
TVRDLAGQLGVAANTV

SEQ ID NO: 72609 - protein, 16 aa, Mycobacterium tuberculosis
VRDLAGQLGVAANTVA

SEQ ID NO: 72610 - protein, 16 aa, Mycobacterium tuberculosis
RDLAGQLGVAANTVAR

SEQ ID NO: 72611 - protein, 16 aa, Mycobacterium tuberculosis
DLAGQLGVAANTVARA

SEQ ID NO: 72612 - protein, 16 aa, Mycobacterium tuberculosis
LAGQLGVAANTVARAY

SEQ ID NO: 72613 - protein, 16 aa, Mycobacterium tuberculosis
AGQLGVAANTVARAYR

SEQ ID NO: 72614 - protein, 16 aa, Mycobacterium tuberculosis
GQLGVAANTVARAYRE

SEQ ID NO: 72615 - protein, 16 aa, Mycobacterium tuberculosis
QLGVAANTVARAYREL

SEQ ID NO: 72616 - protein, 16 aa, Mycobacterium tuberculosis
LGVAANTVARAYRELE

SEQ ID NO: 72617 - protein, 16 aa, Mycobacterium tuberculosis
GVAANTVARAYRELES

SEQ ID NO: 72618 - protein, 16 aa, Mycobacterium tuberculosis
VAANTVARAYRELESA

SEQ ID NO: 72619 - protein, 16 aa, Mycobacterium tuberculosis
AANTVARAYRELESAA

SEQ ID NO: 72620 - protein, 16 aa, Mycobacterium tuberculosis
ANTVARAYRELESAAI

SEQ ID NO: 72621 - protein, 16 aa, Mycobacterium tuberculosis
NTVARAYRELESAAIV

SEQ ID NO: 72622 - protein, 16 aa, Mycobacterium tuberculosis
TVARAYRELESAAIVE

SEQ ID NO: 72623 - protein, 16 aa, Mycobacterium tuberculosis
VARAYRELESAAIVET

SEQ ID NO: 72624 - protein, 16 aa, Mycobacterium tuberculosis
ARAYRELESAAIVETR

SEQ ID NO: 72625 - protein, 16 aa, Mycobacterium tuberculosis
RAYRELESAAIVETRG

SEQ ID NO: 72626 - protein, 16 aa, Mycobacterium tuberculosis
AYRELESAAIVETRGR

SEQ ID NO: 72627 - protein, 16 aa, Mycobacterium tuberculosis
YRELESAAIVETRGRF

SEQ ID NO: 72628 - protein, 16 aa, Mycobacterium tuberculosis
RELESAAIVETRGRFG

SEQ ID NO: 72629 - protein, 16 aa, Mycobacterium tuberculosis
ELESAAIVETRGRFGT

SEQ ID NO: 72630 - protein, 16 aa, Mycobacterium tuberculosis
LESAAIVETRGRFGTF

SEQ ID NO: 72631 - protein, 16 aa, Mycobacterium tuberculosis
ESAAIVETRGRFGTFI

SEQ ID NO: 72632 - protein, 16 aa, Mycobacterium tuberculosis
SAAIVETRGRFGTFIS

SEQ ID NO: 72633 - protein, 16 aa, Mycobacterium tuberculosis
AAIVETRGRFGTFISR

SEQ ID NO: 72634 - protein, 16 aa, Mycobacterium tuberculosis
AIVETRGRFGTFISRF

SEQ ID NO: 72635 - protein, 16 aa, Mycobacterium tuberculosis
IVETRGRFGTFISRFD

SEQ ID NO: 72636 - protein, 16 aa, Mycobacterium tuberculosis
VETRGRFGTFISRFDP

SEQ ID NO: 72637 - protein, 16 aa, Mycobacterium tuberculosis
ETRGRFGTFISRFDPT

SEQ ID NO: 72638 - protein, 16 aa, Mycobacterium tuberculosis
TRGRFGTFISRFDPTD

SEQ ID NO: 72639 - protein, 16 aa, Mycobacterium tuberculosis
RGRFGTFISRFDPTDA

SEQ ID NO: 72640 - protein, 16 aa, Mycobacterium tuberculosis
GRFGTFISRFDPTDAA

SEQ ID NO: 72641 - protein, 16 aa, Mycobacterium tuberculosis
RFGTFISRFDPTDAAM

SEQ ID NO: 72642 - protein, 16 aa, Mycobacterium tuberculosis
FGTFISRFDPTDAAMA

SEQ ID NO: 72643 - protein, 16 aa, Mycobacterium tuberculosis
GTFISRFDPTDAAMAA

SEQ ID NO: 72644 - protein, 16 aa, Mycobacterium tuberculosis
TFISRFDPTDAAMAAA

SEQ ID NO: 72645 - protein, 16 aa, Mycobacterium tuberculosis
FISRFDPTDAAMAAAA

SEQ ID NO: 72646 - protein, 16 aa, Mycobacterium tuberculosis
ISRFDPTDAAMAAAAK

SEQ ID NO: 72647 - protein, 16 aa, Mycobacterium tuberculosis
SRFDPTDAAMAAAAKE

SEQ ID NO: 72648 - protein, 16 aa, Mycobacterium tuberculosis
RFDPTDAAMAAAAKEY

SEQ ID NO: 72649 - protein, 16 aa, Mycobacterium tuberculosis
FDPTDAAMAAAAKEYV

SEQ ID NO: 72650 - protein, 16 aa, Mycobacterium tuberculosis
DPTDAAMAAAAKEYVG

SEQ ID NO: 72651 - protein, 16 aa, Mycobacterium tuberculosis
PTDAAMAAAAKEYVGV

SEQ ID NO: 72652 - protein, 16 aa, Mycobacterium tuberculosis
TDAAMAAAAKEYVGVA

SEQ ID NO: 72653 - protein, 16 aa, Mycobacterium tuberculosis
DAAMAAAAKEYVGVAR

SEQ ID NO: 72654 - protein, 16 aa, Mycobacterium tuberculosis
AAMAAAAKEYVGVARA

SEQ ID NO: 72655 - protein, 16 aa, Mycobacterium tuberculosis
AMAAAAKEYVGVARAL

SEQ ID NO: 72656 - protein, 16 aa, Mycobacterium tuberculosis
MAAAAKEYVGVARALG

SEQ ID NO: 72657 - protein, 16 aa, Mycobacterium tuberculosis
AAAAKEYVGVARALGL

SEQ ID NO: 72658 - protein, 16 aa, Mycobacterium tuberculosis
AAAKEYVGVARALGLT

SEQ ID NO: 72659 - protein, 16 aa, Mycobacterium tuberculosis
AAKEYVGVARALGLTK

SEQ ID NO: 72660 - protein, 16 aa, Mycobacterium tuberculosis
AKEYVGVARALGLTKS

SEQ ID NO: 72661 - protein, 16 aa, Mycobacterium tuberculosis
KEYVGVARALGLTKSD

SEQ ID NO: 72662 - protein, 16 aa, Mycobacterium tuberculosis
EYVGVARALGLTKSDA

SEQ ID NO: 72663 - protein, 16 aa, Mycobacterium tuberculosis
YVGVARALGLTKSDAM

SEQ ID NO: 72664 - protein, 16 aa, Mycobacterium tuberculosis
VGVARALGLTKSDAMR

SEQ ID NO: 72665 - protein, 16 aa, Mycobacterium tuberculosis
GVARALGLTKSDAMRY

SEQ ID NO: 72666 - protein, 16 aa, Mycobacterium tuberculosis
VARALGLTKSDAMRYL

SEQ ID NO: 72667 - protein, 16 aa, Mycobacterium tuberculosis
ARALGLTKSDAMRYLT

SEQ ID NO: 72668 - protein, 16 aa, Mycobacterium tuberculosis
RALGLTKSDAMRYLTH

SEQ ID NO: 72669 - protein, 16 aa, Mycobacterium tuberculosis
ALGLTKSDAMRYLTHV

SEQ ID NO: 72670 - protein, 16 aa, Mycobacterium tuberculosis
LGLTKSDAMRYLTHVP

SEQ ID NO: 72671 - protein, 16 aa, Mycobacterium tuberculosis
GLTKSDAMRYLTHVPD

SEQ ID NO: 72672 - protein, 16 aa, Mycobacterium tuberculosis
LTKSDAMRYLTHVPDD

SEQ ID NO: 72673 - protein, 8 aa, Mycobacterium tuberculosis
MSFVMAYP

SEQ ID NO: 72674 - protein, 8 aa, Mycobacterium tuberculosis
SFVMAYPE

SEQ ID NO: 72675 - protein, 8 aa, Mycobacterium tuberculosis
FVMAYPEM

SEQ ID NO: 72676 - protein, 8 aa, Mycobacterium tuberculosis
VMAYPEML

SEQ ID NO: 72677 - protein, 8 aa, Mycobacterium tuberculosis
MAYPEMLA

SEQ ID NO: 72678 - protein, 8 aa, Mycobacterium tuberculosis
AYPEMLAA

SEQ ID NO: 72679 - protein, 8 aa, Mycobacterium tuberculosis
YPEMLAAA

SEQ ID NO: 72680 - protein, 8 aa, Mycobacterium tuberculosis
PEMLAAAA

SEQ ID NO: 72681 - protein, 8 aa, Mycobacterium tuberculosis
EMLAAAAD

SEQ ID NO: 72682 - protein, 8 aa, Mycobacterium tuberculosis
MLAAAADT

SEQ ID NO: 72683 - protein, 8 aa, Mycobacterium tuberculosis
LAAAADTL

SEQ ID NO: 72684 - protein, 8 aa, Mycobacterium tuberculosis
AAAADTLQ

SEQ ID NO: 72685 - protein, 8 aa, Mycobacterium tuberculosis
AAADTLQS

SEQ ID NO: 72686 - protein, 8 aa, Mycobacterium tuberculosis
AADTLQSI

SEQ ID NO: 72687 - protein, 8 aa, Mycobacterium tuberculosis
ADTLQSIG

SEQ ID NO: 72688 - protein, 8 aa, Mycobacterium tuberculosis
DTLQSIGA

SEQ ID NO: 72689 - protein, 8 aa, Mycobacterium tuberculosis
TLQSIGAT

SEQ ID NO: 72690 - protein, 8 aa, Mycobacterium tuberculosis
LQSIGATT

SEQ ID NO: 72691 - protein, 8 aa, Mycobacterium tuberculosis
QSIGATTV

SEQ ID NO: 72692 - protein, 8 aa, Mycobacterium tuberculosis
SIGATTVA

SEQ ID NO: 72693 - protein, 8 aa, Mycobacterium tuberculosis
IGATTVAS

SEQ ID NO: 72694 - protein, 8 aa, Mycobacterium tuberculosis
GATTVASN

SEQ ID NO: 72695 - protein, 8 aa, Mycobacterium tuberculosis
ATTVASNA

SEQ ID NO: 72696 - protein, 8 aa, Mycobacterium tuberculosis
TTVASNAA

SEQ ID NO: 72697 - protein, 8 aa, Mycobacterium tuberculosis
TVASNAAA

SEQ ID NO: 72698 - protein, 8 aa, Mycobacterium tuberculosis
VASNAAAA

SEQ ID NO: 72699 - protein, 8 aa, Mycobacterium tuberculosis
ASNAAAAA

SEQ ID NO: 72700 - protein, 8 aa, Mycobacterium tuberculosis
SNAAAAAP

SEQ ID NO: 72701 - protein, 8 aa, Mycobacterium tuberculosis
NAAAAAPT

SEQ ID NO: 72702 - protein, 8 aa, Mycobacterium tuberculosis
AAAAAPTT

SEQ ID NO: 72703 - protein, 8 aa, Mycobacterium tuberculosis
AAAAPTTG

SEQ ID NO: 72704 - protein, 8 aa, Mycobacterium tuberculosis
AAAPTTGV

SEQ ID NO: 72705 - protein, 8 aa, Mycobacterium tuberculosis
AAPTTGVV

SEQ ID NO: 72706 - protein, 8 aa, Mycobacterium tuberculosis
APTTGVVP

SEQ ID NO: 72707 - protein, 8 aa, Mycobacterium tuberculosis
PTTGVVPP

SEQ ID NO: 72708 - protein, 8 aa, Mycobacterium tuberculosis
TTGVVPPA

SEQ ID NO: 72709 - protein, 8 aa, Mycobacterium tuberculosis
TGVVPPAA

SEQ ID NO: 72710 - protein, 8 aa, Mycobacterium tuberculosis
GVVPPAAD

SEQ ID NO: 72711 - protein, 8 aa, Mycobacterium tuberculosis
VVPPAADE

SEQ ID NO: 72712 - protein, 8 aa, Mycobacterium tuberculosis
VPPAADEV

SEQ ID NO: 72713 - protein, 8 aa, Mycobacterium tuberculosis
PPAADEVS

SEQ ID NO: 72714 - protein, 8 aa, Mycobacterium tuberculosis
PAADEVSA

SEQ ID NO: 72715 - protein, 8 aa, Mycobacterium tuberculosis
AADEVSAL

SEQ ID NO: 72716 - protein, 8 aa, Mycobacterium tuberculosis
ADEVSALT

SEQ ID NO: 72717 - protein, 8 aa, Mycobacterium tuberculosis
DEVSALTA

SEQ ID NO: 72718 - protein, 8 aa, Mycobacterium tuberculosis
EVSALTAA

SEQ ID NO: 72719 - protein, 8 aa, Mycobacterium tuberculosis
VSALTAAH

SEQ ID NO: 72720 - protein, 8 aa, Mycobacterium tuberculosis
SALTAAHF

SEQ ID NO: 72721 - protein, 8 aa, Mycobacterium tuberculosis
ALTAAHFA

SEQ ID NO: 72722 - protein, 8 aa, Mycobacterium tuberculosis
LTAAHFAA

SEQ ID NO: 72723 - protein, 8 aa, Mycobacterium tuberculosis
TAAHFAAH

SEQ ID NO: 72724 - protein, 8 aa, Mycobacterium tuberculosis
AAHFAAHA

SEQ ID NO: 72725 - protein, 8 aa, Mycobacterium tuberculosis
AHFAAHAA

SEQ ID NO: 72726 - protein, 8 aa, Mycobacterium tuberculosis
HFAAHAAM

SEQ ID NO: 72727 - protein, 8 aa, Mycobacterium tuberculosis
FAAHAAMY

SEQ ID NO: 72728 - protein, 8 aa, Mycobacterium tuberculosis
AAHAAMYQ

SEQ ID NO: 72729 - protein, 8 aa, Mycobacterium tuberculosis
AHAAMYQS

SEQ ID NO: 72730 - protein, 8 aa, Mycobacterium tuberculosis
HAAMYQSV

SEQ ID NO: 72731 - protein, 8 aa, Mycobacterium tuberculosis
AAMYQSVS

SEQ ID NO: 72732 - protein, 8 aa, Mycobacterium tuberculosis
AMYQSVSA

SEQ ID NO: 72733 - protein, 8 aa, Mycobacterium tuberculosis
MYQSVSAR

SEQ ID NO: 72734 - protein, 8 aa, Mycobacterium tuberculosis
YQSVSARA

SEQ ID NO: 72735 - protein, 8 aa, Mycobacterium tuberculosis
QSVSARAA

SEQ ID NO: 72736 - protein, 8 aa, Mycobacterium tuberculosis
SVSARAAA

SEQ ID NO: 72737 - protein, 8 aa, Mycobacterium tuberculosis
VSARAAAI

SEQ ID NO: 72738 - protein, 8 aa, Mycobacterium tuberculosis
SARAAAIH

SEQ ID NO: 72739 - protein, 8 aa, Mycobacterium tuberculosis
ARAAAIHD

SEQ ID NO: 72740 - protein, 8 aa, Mycobacterium tuberculosis
RAAAIHDQ

SEQ ID NO: 72741 - protein, 8 aa, Mycobacterium tuberculosis
AAAIHDQF

SEQ ID NO: 72742 - protein, 8 aa, Mycobacterium tuberculosis
AAIHDQFV

SEQ ID NO: 72743 - protein, 8 aa, Mycobacterium tuberculosis
AIHDQFVA

SEQ ID NO: 72744 - protein, 8 aa, Mycobacterium tuberculosis
IHDQFVAT

SEQ ID NO: 72745 - protein, 8 aa, Mycobacterium tuberculosis
HDQFVATL

SEQ ID NO: 72746 - protein, 8 aa, Mycobacterium tuberculosis
DQFVATLA

SEQ ID NO: 72747 - protein, 8 aa, Mycobacterium tuberculosis
QFVATLAS

SEQ ID NO: 72748 - protein, 8 aa, Mycobacterium tuberculosis
FVATLASS

SEQ ID NO: 72749 - protein, 8 aa, Mycobacterium tuberculosis
VATLASSA

SEQ ID NO: 72750 - protein, 8 aa, Mycobacterium tuberculosis
ATLASSAS

SEQ ID NO: 72751 - protein, 8 aa, Mycobacterium tuberculosis
TLASSASS

SEQ ID NO: 72752 - protein, 8 aa, Mycobacterium tuberculosis
LASSASSY

SEQ ID NO: 72753 - protein, 8 aa, Mycobacterium tuberculosis
ASSASSYA

SEQ ID NO: 72754 - protein, 8 aa, Mycobacterium tuberculosis
SSASSYAA

SEQ ID NO: 72755 - protein, 8 aa, Mycobacterium tuberculosis
SASSYAAT

SEQ ID NO: 72756 - protein, 8 aa, Mycobacterium tuberculosis
ASSYAATE

SEQ ID NO: 72757 - protein, 8 aa, Mycobacterium tuberculosis
SSYAATEV

SEQ ID NO: 72758 - protein, 8 aa, Mycobacterium tuberculosis
SYAATEVA

SEQ ID NO: 72759 - protein, 8 aa, Mycobacterium tuberculosis
YAATEVAN

SEQ ID NO: 72760 - protein, 8 aa, Mycobacterium tuberculosis
AATEVANA

SEQ ID NO: 72761 - protein, 8 aa, Mycobacterium tuberculosis
ATEVANAA

SEQ ID NO: 72762 - protein, 8 aa, Mycobacterium tuberculosis
TEVANAAA

SEQ ID NO: 72763 - protein, 8 aa, Mycobacterium tuberculosis
EVANAAAA

SEQ ID NO: 72764 - protein, 8 aa, Mycobacterium tuberculosis
VANAAAAS

SEQ ID NO: 72765 - protein, 9 aa, Mycobacterium tuberculosis
MSFVMAYPE

SEQ ID NO: 72766 - protein, 9 aa, Mycobacterium tuberculosis
SFVMAYPEM

SEQ ID NO: 72767 - protein, 9 aa, Mycobacterium tuberculosis
FVMAYPEML

SEQ ID NO: 72768 - protein, 9 aa, Mycobacterium tuberculosis
VMAYPEMLA

SEQ ID NO: 72769 - protein, 9 aa, Mycobacterium tuberculosis
MAYPEMLAA

SEQ ID NO: 72770 - protein, 9 aa, Mycobacterium tuberculosis
AYPEMLAAA

SEQ ID NO: 72771 - protein, 9 aa, Mycobacterium tuberculosis
YPEMLAAAA

SEQ ID NO: 72772 - protein, 9 aa, Mycobacterium tuberculosis
PEMLAAAAD

SEQ ID NO: 72773 - protein, 9 aa, Mycobacterium tuberculosis
EMLAAAADT

SEQ ID NO: 72774 - protein, 9 aa, Mycobacterium tuberculosis
MLAAAADTL

SEQ ID NO: 72775 - protein, 9 aa, Mycobacterium tuberculosis
LAAAADTLQ

SEQ ID NO: 72776 - protein, 9 aa, Mycobacterium tuberculosis
AAAADTLQS

SEQ ID NO: 72777 - protein, 9 aa, Mycobacterium tuberculosis
AAADTLQSI

SEQ ID NO: 72778 - protein, 9 aa, Mycobacterium tuberculosis
AADTLQSIG

SEQ ID NO: 72779 - protein, 9 aa, Mycobacterium tuberculosis
ADTLQSIGA

SEQ ID NO: 72780 - protein, 9 aa, Mycobacterium tuberculosis
DTLQSIGAT

SEQ ID NO: 72781 - protein, 9 aa, Mycobacterium tuberculosis
TLQSIGATT

SEQ ID NO: 72782 - protein, 9 aa, Mycobacterium tuberculosis
LQSIGATTV

SEQ ID NO: 72783 - protein, 9 aa, Mycobacterium tuberculosis
QSIGATTVA

SEQ ID NO: 72784 - protein, 9 aa, Mycobacterium tuberculosis
SIGATTVAS

SEQ ID NO: 72785 - protein, 9 aa, Mycobacterium tuberculosis
IGATTVASN

SEQ ID NO: 72786 - protein, 9 aa, Mycobacterium tuberculosis
GATTVASNA

SEQ ID NO: 72787 - protein, 9 aa, Mycobacterium tuberculosis
ATTVASNAA

SEQ ID NO: 72788 - protein, 9 aa, Mycobacterium tuberculosis
TTVASNAAA

SEQ ID NO: 72789 - protein, 9 aa, Mycobacterium tuberculosis
TVASNAAAA

SEQ ID NO: 72790 - protein, 9 aa, Mycobacterium tuberculosis
VASNAAAAA

SEQ ID NO: 72791 - protein, 9 aa, Mycobacterium tuberculosis
ASNAAAAAP

SEQ ID NO: 72792 - protein, 9 aa, Mycobacterium tuberculosis
SNAAAAAPT

SEQ ID NO: 72793 - protein, 9 aa, Mycobacterium tuberculosis
NAAAAAPTT

SEQ ID NO: 72794 - protein, 9 aa, Mycobacterium tuberculosis
AAAAAPTTG

SEQ ID NO: 72795 - protein, 9 aa, Mycobacterium tuberculosis
AAAAPTTGV

SEQ ID NO: 72796 - protein, 9 aa, Mycobacterium tuberculosis
AAAPTTGVV

SEQ ID NO: 72797 - protein, 9 aa, Mycobacterium tuberculosis
AAPTTGVVP

SEQ ID NO: 72798 - protein, 9 aa, Mycobacterium tuberculosis
APTTGVVPP

SEQ ID NO: 72799 - protein, 9 aa, Mycobacterium tuberculosis
PTTGVVPPA

SEQ ID NO: 72800 - protein, 9 aa, Mycobacterium tuberculosis
TTGVVPPAA

SEQ ID NO: 72801 - protein, 9 aa, Mycobacterium tuberculosis
TGVVPPAAD

SEQ ID NO: 72802 - protein, 9 aa, Mycobacterium tuberculosis
GVVPPAADE

SEQ ID NO: 72803 - protein, 9 aa, Mycobacterium tuberculosis
VVPPAADEV

SEQ ID NO: 72804 - protein, 9 aa, Mycobacterium tuberculosis
VPPAADEVS

SEQ ID NO: 72805 - protein, 9 aa, Mycobacterium tuberculosis
PPAADEVSA

SEQ ID NO: 72806 - protein, 9 aa, Mycobacterium tuberculosis
PAADEVSAL

SEQ ID NO: 72807 - protein, 9 aa, Mycobacterium tuberculosis
AADEVSALT

SEQ ID NO: 72808 - protein, 9 aa, Mycobacterium tuberculosis
ADEVSALTA

SEQ ID NO: 72809 - protein, 9 aa, Mycobacterium tuberculosis
DEVSALTAA

SEQ ID NO: 72810 - protein, 9 aa, Mycobacterium tuberculosis
EVSALTAAH

SEQ ID NO: 72811 - protein, 9 aa, Mycobacterium tuberculosis
VSALTAAHF

SEQ ID NO: 72812 - protein, 9 aa, Mycobacterium tuberculosis
SALTAAHFA

SEQ ID NO: 72813 - protein, 9 aa, Mycobacterium tuberculosis
ALTAAHFAA

SEQ ID NO: 72814 - protein, 9 aa, Mycobacterium tuberculosis
LTAAHFAAH

SEQ ID NO: 72815 - protein, 9 aa, Mycobacterium tuberculosis
TAAHFAAHA

SEQ ID NO: 72816 - protein, 9 aa, Mycobacterium tuberculosis
AAHFAAHAA

SEQ ID NO: 72817 - protein, 9 aa, Mycobacterium tuberculosis
AHFAAHAAM

SEQ ID NO: 72818 - protein, 9 aa, Mycobacterium tuberculosis
HFAAHAAMY

SEQ ID NO: 72819 - protein, 9 aa, Mycobacterium tuberculosis
FAAHAAMYQ

SEQ ID NO: 72820 - protein, 9 aa, Mycobacterium tuberculosis
AAHAAMYQS

SEQ ID NO: 72821 - protein, 9 aa, Mycobacterium tuberculosis
AHAAMYQSV

SEQ ID NO: 72822 - protein, 9 aa, Mycobacterium tuberculosis
HAAMYQSVS

SEQ ID NO: 72823 - protein, 9 aa, Mycobacterium tuberculosis
AAMYQSVSA

SEQ ID NO: 72824 - protein, 9 aa, Mycobacterium tuberculosis
AMYQSVSAR

SEQ ID NO: 72825 - protein, 9 aa, Mycobacterium tuberculosis
MYQSVSARA

SEQ ID NO: 72826 - protein, 9 aa, Mycobacterium tuberculosis
YQSVSARAA

SEQ ID NO: 72827 - protein, 9 aa, Mycobacterium tuberculosis
QSVSARAAA

SEQ ID NO: 72828 - protein, 9 aa, Mycobacterium tuberculosis
SVSARAAAI

SEQ ID NO: 72829 - protein, 9 aa, Mycobacterium tuberculosis
VSARAAAIH

SEQ ID NO: 72830 - protein, 9 aa, Mycobacterium tuberculosis
SARAAAIHD

SEQ ID NO: 72831 - protein, 9 aa, Mycobacterium tuberculosis
ARAAAIHDQ

SEQ ID NO: 72832 - protein, 9 aa, Mycobacterium tuberculosis
RAAAIHDQF

SEQ ID NO: 72833 - protein, 9 aa, Mycobacterium tuberculosis
AAAIHDQFV

SEQ ID NO: 72834 - protein, 9 aa, Mycobacterium tuberculosis
AAIHDQFVA

SEQ ID NO: 72835 - protein, 9 aa, Mycobacterium tuberculosis
AIHDQFVAT

SEQ ID NO: 72836 - protein, 9 aa, Mycobacterium tuberculosis
IHDQFVATL

SEQ ID NO: 72837 - protein, 9 aa, Mycobacterium tuberculosis
HDQFVATLA

SEQ ID NO: 72838 - protein, 9 aa, Mycobacterium tuberculosis
DQFVATLAS

SEQ ID NO: 72839 - protein, 9 aa, Mycobacterium tuberculosis
QFVATLASS

SEQ ID NO: 72840 - protein, 9 aa, Mycobacterium tuberculosis
FVATLASSA

SEQ ID NO: 72841 - protein, 9 aa, Mycobacterium tuberculosis
VATLASSAS

SEQ ID NO: 72842 - protein, 9 aa, Mycobacterium tuberculosis
ATLASSASS

SEQ ID NO: 72843 - protein, 9 aa, Mycobacterium tuberculosis
TLASSASSY

SEQ ID NO: 72844 - protein, 9 aa, Mycobacterium tuberculosis
LASSASSYA

SEQ ID NO: 72845 - protein, 9 aa, Mycobacterium tuberculosis
ASSASSYAA

SEQ ID NO: 72846 - protein, 9 aa, Mycobacterium tuberculosis
SSASSYAAT

SEQ ID NO: 72847 - protein, 9 aa, Mycobacterium tuberculosis
SASSYAATE

SEQ ID NO: 72848 - protein, 9 aa, Mycobacterium tuberculosis
ASSYAATEV

SEQ ID NO: 72849 - protein, 9 aa, Mycobacterium tuberculosis
SSYAATEVA

SEQ ID NO: 72850 - protein, 9 aa, Mycobacterium tuberculosis
SYAATEVAN

SEQ ID NO: 72851 - protein, 9 aa, Mycobacterium tuberculosis
YAATEVANA

SEQ ID NO: 72852 - protein, 9 aa, Mycobacterium tuberculosis
AATEVANAA

SEQ ID NO: 72853 - protein, 9 aa, Mycobacterium tuberculosis
ATEVANAAA

SEQ ID NO: 72854 - protein, 9 aa, Mycobacterium tuberculosis
TEVANAAAA

SEQ ID NO: 72855 - protein, 9 aa, Mycobacterium tuberculosis
EVANAAAAS

SEQ ID NO: 72856 - protein, 10 aa, Mycobacterium tuberculosis
MSFVMAYPEM

SEQ ID NO: 72857 - protein, 10 aa, Mycobacterium tuberculosis
SFVMAYPEML

SEQ ID NO: 72858 - protein, 10 aa, Mycobacterium tuberculosis
FVMAYPEMLA

SEQ ID NO: 72859 - protein, 10 aa, Mycobacterium tuberculosis
VMAYPEMLAA

SEQ ID NO: 72860 - protein, 10 aa, Mycobacterium tuberculosis
MAYPEMLAAA

SEQ ID NO: 72861 - protein, 10 aa, Mycobacterium tuberculosis
AYPEMLAAAA

SEQ ID NO: 72862 - protein, 10 aa, Mycobacterium tuberculosis
YPEMLAAAAD

SEQ ID NO: 72863 - protein, 10 aa, Mycobacterium tuberculosis
PEMLAAAADT

SEQ ID NO: 72864 - protein, 10 aa, Mycobacterium tuberculosis
EMLAAAADTL

SEQ ID NO: 72865 - protein, 10 aa, Mycobacterium tuberculosis
MLAAAADTLQ

SEQ ID NO: 72866 - protein, 10 aa, Mycobacterium tuberculosis
LAAAADTLQS

SEQ ID NO: 72867 - protein, 10 aa, Mycobacterium tuberculosis
AAAADTLQSI

SEQ ID NO: 72868 - protein, 10 aa, Mycobacterium tuberculosis
AAADTLQSIG

SEQ ID NO: 72869 - protein, 10 aa, Mycobacterium tuberculosis
AADTLQSIGA

SEQ ID NO: 72870 - protein, 10 aa, Mycobacterium tuberculosis
ADTLQSIGAT

SEQ ID NO: 72871 - protein, 10 aa, Mycobacterium tuberculosis
DTLQSIGATT

SEQ ID NO: 72872 - protein, 10 aa, Mycobacterium tuberculosis
TLQSIGATTV

SEQ ID NO: 72873 - protein, 10 aa, Mycobacterium tuberculosis
LQSIGATTVA

SEQ ID NO: 72874 - protein, 10 aa, Mycobacterium tuberculosis
QSIGATTVAS

SEQ ID NO: 72875 - protein, 10 aa, Mycobacterium tuberculosis
SIGATTVASN

SEQ ID NO: 72876 - protein, 10 aa, Mycobacterium tuberculosis
IGATTVASNA

SEQ ID NO: 72877 - protein, 10 aa, Mycobacterium tuberculosis
GATTVASNAA

SEQ ID NO: 72878 - protein, 10 aa, Mycobacterium tuberculosis
ATTVASNAAA

SEQ ID NO: 72879 - protein, 10 aa, Mycobacterium tuberculosis
TTVASNAAAA

SEQ ID NO: 72880 - protein, 10 aa, Mycobacterium tuberculosis
TVASNAAAAA

SEQ ID NO: 72881 - protein, 10 aa, Mycobacterium tuberculosis
VASNAAAAAP

SEQ ID NO: 72882 - protein, 10 aa, Mycobacterium tuberculosis
ASNAAAAAPT

SEQ ID NO: 72883 - protein, 10 aa, Mycobacterium tuberculosis
SNAAAAAPTT

SEQ ID NO: 72884 - protein, 10 aa, Mycobacterium tuberculosis
NAAAAAPTTG

SEQ ID NO: 72885 - protein, 10 aa, Mycobacterium tuberculosis
AAAAAPTTGV

SEQ ID NO: 72886 - protein, 10 aa, Mycobacterium tuberculosis
AAAAPTTGVV

SEQ ID NO: 72887 - protein, 10 aa, Mycobacterium tuberculosis
AAAPTTGVVP

SEQ ID NO: 72888 - protein, 10 aa, Mycobacterium tuberculosis
AAPTTGVVPP

SEQ ID NO: 72889 - protein, 10 aa, Mycobacterium tuberculosis
APTTGVVPPA

SEQ ID NO: 72890 - protein, 10 aa, Mycobacterium tuberculosis
PTTGVVPPAA

SEQ ID NO: 72891 - protein, 10 aa, Mycobacterium tuberculosis
TTGVVPPAAD

SEQ ID NO: 72892 - protein, 10 aa, Mycobacterium tuberculosis
TGVVPPAADE

SEQ ID NO: 72893 - protein, 10 aa, Mycobacterium tuberculosis
GVVPPAADEV

SEQ ID NO: 72894 - protein, 10 aa, Mycobacterium tuberculosis
VVPPAADEVS

SEQ ID NO: 72895 - protein, 10 aa, Mycobacterium tuberculosis
VPPAADEVSA

SEQ ID NO: 72896 - protein, 10 aa, Mycobacterium tuberculosis
PPAADEVSAL

SEQ ID NO: 72897 - protein, 10 aa, Mycobacterium tuberculosis
PAADEVSALT

SEQ ID NO: 72898 - protein, 10 aa, Mycobacterium tuberculosis
AADEVSALTA

SEQ ID NO: 72899 - protein, 10 aa, Mycobacterium tuberculosis
ADEVSALTAA

SEQ ID NO: 72900 - protein, 10 aa, Mycobacterium tuberculosis
DEVSALTAAH

SEQ ID NO: 72901 - protein, 10 aa, Mycobacterium tuberculosis
EVSALTAAHF

SEQ ID NO: 72902 - protein, 10 aa, Mycobacterium tuberculosis
VSALTAAHFA

SEQ ID NO: 72903 - protein, 10 aa, Mycobacterium tuberculosis
SALTAAHFAA

SEQ ID NO: 72904 - protein, 10 aa, Mycobacterium tuberculosis
ALTAAHFAAH

SEQ ID NO: 72905 - protein, 10 aa, Mycobacterium tuberculosis
LTAAHFAAHA

SEQ ID NO: 72906 - protein, 10 aa, Mycobacterium tuberculosis
TAAHFAAHAA

SEQ ID NO: 72907 - protein, 10 aa, Mycobacterium tuberculosis
AAHFAAHAAM

SEQ ID NO: 72908 - protein, 10 aa, Mycobacterium tuberculosis
AHFAAHAAMY

SEQ ID NO: 72909 - protein, 10 aa, Mycobacterium tuberculosis
HFAAHAAMYQ

SEQ ID NO: 72910 - protein, 10 aa, Mycobacterium tuberculosis
FAAHAAMYQS

SEQ ID NO: 72911 - protein, 10 aa, Mycobacterium tuberculosis
AAHAAMYQSV

SEQ ID NO: 72912 - protein, 10 aa, Mycobacterium tuberculosis
AHAAMYQSVS

SEQ ID NO: 72913 - protein, 10 aa, Mycobacterium tuberculosis
HAAMYQSVSA

SEQ ID NO: 72914 - protein, 10 aa, Mycobacterium tuberculosis
AAMYQSVSAR

SEQ ID NO: 72915 - protein, 10 aa, Mycobacterium tuberculosis
AMYQSVSARA

SEQ ID NO: 72916 - protein, 10 aa, Mycobacterium tuberculosis
MYQSVSARAA

SEQ ID NO: 72917 - protein, 10 aa, Mycobacterium tuberculosis
YQSVSARAAA

SEQ ID NO: 72918 - protein, 10 aa, Mycobacterium tuberculosis
QSVSARAAAI

SEQ ID NO: 72919 - protein, 10 aa, Mycobacterium tuberculosis
SVSARAAAIH

SEQ ID NO: 72920 - protein, 10 aa, Mycobacterium tuberculosis
VSARAAAIHD

SEQ ID NO: 72921 - protein, 10 aa, Mycobacterium tuberculosis
SARAAAIHDQ

SEQ ID NO: 72922 - protein, 10 aa, Mycobacterium tuberculosis
ARAAAIHDQF

SEQ ID NO: 72923 - protein, 10 aa, Mycobacterium tuberculosis
RAAAIHDQFV

SEQ ID NO: 72924 - protein, 10 aa, Mycobacterium tuberculosis
AAAIHDQFVA

SEQ ID NO: 72925 - protein, 10 aa, Mycobacterium tuberculosis
AAIHDQFVAT

SEQ ID NO: 72926 - protein, 10 aa, Mycobacterium tuberculosis
AIHDQFVATL

SEQ ID NO: 72927 - protein, 10 aa, Mycobacterium tuberculosis
IHDQFVATLA

SEQ ID NO: 72928 - protein, 10 aa, Mycobacterium tuberculosis
HDQFVATLAS

SEQ ID NO: 72929 - protein, 10 aa, Mycobacterium tuberculosis
DQFVATLASS

SEQ ID NO: 72930 - protein, 10 aa, Mycobacterium tuberculosis
QFVATLASSA

SEQ ID NO: 72931 - protein, 10 aa, Mycobacterium tuberculosis
FVATLASSAS

SEQ ID NO: 72932 - protein, 10 aa, Mycobacterium tuberculosis
VATLASSASS

SEQ ID NO: 72933 - protein, 10 aa, Mycobacterium tuberculosis
ATLASSASSY

SEQ ID NO: 72934 - protein, 10 aa, Mycobacterium tuberculosis
TLASSASSYA

SEQ ID NO: 72935 - protein, 10 aa, Mycobacterium tuberculosis
LASSASSYAA

SEQ ID NO: 72936 - protein, 10 aa, Mycobacterium tuberculosis
ASSASSYAAT

SEQ ID NO: 72937 - protein, 10 aa, Mycobacterium tuberculosis
SSASSYAATE

SEQ ID NO: 72938 - protein, 10 aa, Mycobacterium tuberculosis
SASSYAATEV

SEQ ID NO: 72939 - protein, 10 aa, Mycobacterium tuberculosis
ASSYAATEVA

SEQ ID NO: 72940 - protein, 10 aa, Mycobacterium tuberculosis
SSYAATEVAN

SEQ ID NO: 72941 - protein, 10 aa, Mycobacterium tuberculosis
SYAATEVANA

SEQ ID NO: 72942 - protein, 10 aa, Mycobacterium tuberculosis
YAATEVANAA

SEQ ID NO: 72943 - protein, 10 aa, Mycobacterium tuberculosis
AATEVANAAA

SEQ ID NO: 72944 - protein, 10 aa, Mycobacterium tuberculosis
ATEVANAAAA

SEQ ID NO: 72945 - protein, 10 aa, Mycobacterium tuberculosis
TEVANAAAAS

SEQ ID NO: 72946 - protein, 11 aa, Mycobacterium tuberculosis
MSFVMAYPEML

SEQ ID NO: 72947 - protein, 11 aa, Mycobacterium tuberculosis
SFVMAYPEMLA

SEQ ID NO: 72948 - protein, 11 aa, Mycobacterium tuberculosis
FVMAYPEMLAA

SEQ ID NO: 72949 - protein, 11 aa, Mycobacterium tuberculosis
VMAYPEMLAAA

SEQ ID NO: 72950 - protein, 11 aa, Mycobacterium tuberculosis
MAYPEMLAAAA

SEQ ID NO: 72951 - protein, 11 aa, Mycobacterium tuberculosis
AYPEMLAAAAD

SEQ ID NO: 72952 - protein, 11 aa, Mycobacterium tuberculosis
YPEMLAAAADT

SEQ ID NO: 72953 - protein, 11 aa, Mycobacterium tuberculosis
PEMLAAAADTL

SEQ ID NO: 72954 - protein, 11 aa, Mycobacterium tuberculosis
EMLAAAADTLQ

SEQ ID NO: 72955 - protein, 11 aa, Mycobacterium tuberculosis
MLAAAADTLQS

SEQ ID NO: 72956 - protein, 11 aa, Mycobacterium tuberculosis
LAAAADTLQSI

SEQ ID NO: 72957 - protein, 11 aa, Mycobacterium tuberculosis
AAAADTLQSIG

SEQ ID NO: 72958 - protein, 11 aa, Mycobacterium tuberculosis
AAADTLQSIGA

SEQ ID NO: 72959 - protein, 11 aa, Mycobacterium tuberculosis
AADTLQSIGAT

SEQ ID NO: 72960 - protein, 11 aa, Mycobacterium tuberculosis
ADTLQSIGATT

SEQ ID NO: 72961 - protein, 11 aa, Mycobacterium tuberculosis
DTLQSIGATTV

SEQ ID NO: 72962 - protein, 11 aa, Mycobacterium tuberculosis
TLQSIGATTVA

SEQ ID NO: 72963 - protein, 11 aa, Mycobacterium tuberculosis
LQSIGATTVAS

SEQ ID NO: 72964 - protein, 11 aa, Mycobacterium tuberculosis
QSIGATTVASN

SEQ ID NO: 72965 - protein, 11 aa, Mycobacterium tuberculosis
SIGATTVASNA

SEQ ID NO: 72966 - protein, 11 aa, Mycobacterium tuberculosis
IGATTVASNAA

SEQ ID NO: 72967 - protein, 11 aa, Mycobacterium tuberculosis
GATTVASNAAA

SEQ ID NO: 72968 - protein, 11 aa, Mycobacterium tuberculosis
ATTVASNAAAA

SEQ ID NO: 72969 - protein, 11 aa, Mycobacterium tuberculosis
TTVASNAAAAA

SEQ ID NO: 72970 - protein, 11 aa, Mycobacterium tuberculosis
TVASNAAAAAP

SEQ ID NO: 72971 - protein, 11 aa, Mycobacterium tuberculosis
VASNAAAAAPT

SEQ ID NO: 72972 - protein, 11 aa, Mycobacterium tuberculosis
ASNAAAAAPTT

SEQ ID NO: 72973 - protein, 11 aa, Mycobacterium tuberculosis
SNAAAAAPTTG

SEQ ID NO: 72974 - protein, 11 aa, Mycobacterium tuberculosis
NAAAAAPTTGV

SEQ ID NO: 72975 - protein, 11 aa, Mycobacterium tuberculosis
AAAAAPTTGVV

SEQ ID NO: 72976 - protein, 11 aa, Mycobacterium tuberculosis
AAAAPTTGVVP

SEQ ID NO: 72977 - protein, 11 aa, Mycobacterium tuberculosis
AAAPTTGVVPP

SEQ ID NO: 72978 - protein, 11 aa, Mycobacterium tuberculosis
AAPTTGVVPPA

SEQ ID NO: 72979 - protein, 11 aa, Mycobacterium tuberculosis
APTTGVVPPAA

SEQ ID NO: 72980 - protein, 11 aa, Mycobacterium tuberculosis
PTTGVVPPAAD

SEQ ID NO: 72981 - protein, 11 aa, Mycobacterium tuberculosis
TTGVVPPAADE

SEQ ID NO: 72982 - protein, 11 aa, Mycobacterium tuberculosis
TGVVPPAADEV

SEQ ID NO: 72983 - protein, 11 aa, Mycobacterium tuberculosis
GVVPPAADEVS

SEQ ID NO: 72984 - protein, 11 aa, Mycobacterium tuberculosis
VVPPAADEVSA

SEQ ID NO: 72985 - protein, 11 aa, Mycobacterium tuberculosis
VPPAADEVSAL

SEQ ID NO: 72986 - protein, 11 aa, Mycobacterium tuberculosis
PPAADEVSALT

SEQ ID NO: 72987 - protein, 11 aa, Mycobacterium tuberculosis
PAADEVSALTA

SEQ ID NO: 72988 - protein, 11 aa, Mycobacterium tuberculosis
AADEVSALTAA

SEQ ID NO: 72989 - protein, 11 aa, Mycobacterium tuberculosis
ADEVSALTAAH

SEQ ID NO: 72990 - protein, 11 aa, Mycobacterium tuberculosis
DEVSALTAAHF

SEQ ID NO: 72991 - protein, 11 aa, Mycobacterium tuberculosis
EVSALTAAHFA

SEQ ID NO: 72992 - protein, 11 aa, Mycobacterium tuberculosis
VSALTAAHFAA

SEQ ID NO: 72993 - protein, 11 aa, Mycobacterium tuberculosis
SALTAAHFAAH

SEQ ID NO: 72994 - protein, 11 aa, Mycobacterium tuberculosis
ALTAAHFAAHA

SEQ ID NO: 72995 - protein, 11 aa, Mycobacterium tuberculosis
LTAAHFAAHAA

SEQ ID NO: 72996 - protein, 11 aa, Mycobacterium tuberculosis
TAAHFAAHAAM

SEQ ID NO: 72997 - protein, 11 aa, Mycobacterium tuberculosis
AAHFAAHAAMY

SEQ ID NO: 72998 - protein, 11 aa, Mycobacterium tuberculosis
AHFAAHAAMYQ

SEQ ID NO: 72999 - protein, 11 aa, Mycobacterium tuberculosis
HFAAHAAMYQS

SEQ ID NO: 73000 - protein, 11 aa, Mycobacterium tuberculosis
FAAHAAMYQSV

SEQ ID NO: 73001 - protein, 11 aa, Mycobacterium tuberculosis
AAHAAMYQSVS

SEQ ID NO: 73002 - protein, 11 aa, Mycobacterium tuberculosis
AHAAMYQSVSA

SEQ ID NO: 73003 - protein, 11 aa, Mycobacterium tuberculosis
HAAMYQSVSAR

SEQ ID NO: 73004 - protein, 11 aa, Mycobacterium tuberculosis
AAMYQSVSARA

SEQ ID NO: 73005 - protein, 11 aa, Mycobacterium tuberculosis
AMYQSVSARAA

SEQ ID NO: 73006 - protein, 11 aa, Mycobacterium tuberculosis
MYQSVSARAAA

SEQ ID NO: 73007 - protein, 11 aa, Mycobacterium tuberculosis
YQSVSARAAAI

SEQ ID NO: 73008 - protein, 11 aa, Mycobacterium tuberculosis
QSVSARAAAIH

SEQ ID NO: 73009 - protein, 11 aa, Mycobacterium tuberculosis
SVSARAAAIHD

SEQ ID NO: 73010 - protein, 11 aa, Mycobacterium tuberculosis
VSARAAAIHDQ

SEQ ID NO: 73011 - protein, 11 aa, Mycobacterium tuberculosis
SARAAAIHDQF

SEQ ID NO: 73012 - protein, 11 aa, Mycobacterium tuberculosis
ARAAAIHDQFV

SEQ ID NO: 73013 - protein, 11 aa, Mycobacterium tuberculosis
RAAAIHDQFVA

SEQ ID NO: 73014 - protein, 11 aa, Mycobacterium tuberculosis
AAAIHDQFVAT

SEQ ID NO: 73015 - protein, 11 aa, Mycobacterium tuberculosis
AAIHDQFVATL

SEQ ID NO: 73016 - protein, 11 aa, Mycobacterium tuberculosis
AIHDQFVATLA

SEQ ID NO: 73017 - protein, 11 aa, Mycobacterium tuberculosis
IHDQFVATLAS

SEQ ID NO: 73018 - protein, 11 aa, Mycobacterium tuberculosis
HDQFVATLASS

SEQ ID NO: 73019 - protein, 11 aa, Mycobacterium tuberculosis
DQFVATLASSA

SEQ ID NO: 73020 - protein, 11 aa, Mycobacterium tuberculosis
QFVATLASSAS

SEQ ID NO: 73021 - protein, 11 aa, Mycobacterium tuberculosis
FVATLASSASS

SEQ ID NO: 73022 - protein, 11 aa, Mycobacterium tuberculosis
VATLASSASSY

SEQ ID NO: 73023 - protein, 11 aa, Mycobacterium tuberculosis
ATLASSASSYA

SEQ ID NO: 73024 - protein, 11 aa, Mycobacterium tuberculosis
TLASSASSYAA

SEQ ID NO: 73025 - protein, 11 aa, Mycobacterium tuberculosis
LASSASSYAAT

SEQ ID NO: 73026 - protein, 11 aa, Mycobacterium tuberculosis
ASSASSYAATE

SEQ ID NO: 73027 - protein, 11 aa, Mycobacterium tuberculosis
SSASSYAATEV

SEQ ID NO: 73028 - protein, 11 aa, Mycobacterium tuberculosis
SASSYAATEVA

SEQ ID NO: 73029 - protein, 11 aa, Mycobacterium tuberculosis
ASSYAATEVAN

SEQ ID NO: 73030 - protein, 11 aa, Mycobacterium tuberculosis
SSYAATEVANA

SEQ ID NO: 73031 - protein, 11 aa, Mycobacterium tuberculosis
SYAATEVANAA

SEQ ID NO: 73032 - protein, 11 aa, Mycobacterium tuberculosis
YAATEVANAAA

SEQ ID NO: 73033 - protein, 11 aa, Mycobacterium tuberculosis
AATEVANAAAA

SEQ ID NO: 73034 - protein, 11 aa, Mycobacterium tuberculosis
ATEVANAAAAS

SEQ ID NO: 73035 - protein, 13 aa, Mycobacterium tuberculosis
MASRFMTDPHAMR

SEQ ID NO: 73036 - protein, 13 aa, Mycobacterium tuberculosis
ASRFMTDPHAMRD

SEQ ID NO: 73037 - protein, 13 aa, Mycobacterium tuberculosis
SRFMTDPHAMRDM

SEQ ID NO: 73038 - protein, 13 aa, Mycobacterium tuberculosis
RFMTDPHAMRDMA

SEQ ID NO: 73039 - protein, 13 aa, Mycobacterium tuberculosis
FMTDPHAMRDMAG

SEQ ID NO: 73040 - protein, 13 aa, Mycobacterium tuberculosis
MTDPHAMRDMAGR

SEQ ID NO: 73041 - protein, 13 aa, Mycobacterium tuberculosis
TDPHAMRDMAGRF

SEQ ID NO: 73042 - protein, 13 aa, Mycobacterium tuberculosis
DPHAMRDMAGRFE

SEQ ID NO: 73043 - protein, 13 aa, Mycobacterium tuberculosis
PHAMRDMAGRFEV

SEQ ID NO: 73044 - protein, 13 aa, Mycobacterium tuberculosis
HAMRDMAGRFEVH

SEQ ID NO: 73045 - protein, 13 aa, Mycobacterium tuberculosis
AMRDMAGRFEVHA

SEQ ID NO: 73046 - protein, 13 aa, Mycobacterium tuberculosis
MRDMAGRFEVHAQ

SEQ ID NO: 73047 - protein, 13 aa, Mycobacterium tuberculosis
RDMAGRFEVHAQT

SEQ ID NO: 73048 - protein, 13 aa, Mycobacterium tuberculosis
DMAGRFEVHAQTV

SEQ ID NO: 73049 - protein, 13 aa, Mycobacterium tuberculosis
MAGRFEVHAQTVE

SEQ ID NO: 73050 - protein, 13 aa, Mycobacterium tuberculosis
AGRFEVHAQTVED

SEQ ID NO: 73051 - protein, 13 aa, Mycobacterium tuberculosis
GRFEVHAQTVEDE

SEQ ID NO: 73052 - protein, 13 aa, Mycobacterium tuberculosis
RFEVHAQTVEDEA

SEQ ID NO: 73053 - protein, 13 aa, Mycobacterium tuberculosis
FEVHAQTVEDEAR

SEQ ID NO: 73054 - protein, 13 aa, Mycobacterium tuberculosis
EVHAQTVEDEARR

SEQ ID NO: 73055 - protein, 13 aa, Mycobacterium tuberculosis
VHAQTVEDEARRM

SEQ ID NO: 73056 - protein, 13 aa, Mycobacterium tuberculosis
HAQTVEDEARRMW

SEQ ID NO: 73057 - protein, 13 aa, Mycobacterium tuberculosis
AQTVEDEARRMWA

SEQ ID NO: 73058 - protein, 13 aa, Mycobacterium tuberculosis
QTVEDEARRMWAS

SEQ ID NO: 73059 - protein, 13 aa, Mycobacterium tuberculosis
TVEDEARRMWASA

SEQ ID NO: 73060 - protein, 13 aa, Mycobacterium tuberculosis
VEDEARRMWASAQ

SEQ ID NO: 73061 - protein, 13 aa, Mycobacterium tuberculosis
EDEARRMWASAQN

SEQ ID NO: 73062 - protein, 13 aa, Mycobacterium tuberculosis
DEARRMWASAQNI

SEQ ID NO: 73063 - protein, 13 aa, Mycobacterium tuberculosis
EARRMWASAQNIS

SEQ ID NO: 73064 - protein, 13 aa, Mycobacterium tuberculosis
ARRMWASAQNISG

SEQ ID NO: 73065 - protein, 13 aa, Mycobacterium tuberculosis
RRMWASAQNISGA

SEQ ID NO: 73066 - protein, 13 aa, Mycobacterium tuberculosis
RMWASAQNISGAG

SEQ ID NO: 73067 - protein, 13 aa, Mycobacterium tuberculosis
MWASAQNISGAGW

SEQ ID NO: 73068 - protein, 13 aa, Mycobacterium tuberculosis
WASAQNISGAGWS

SEQ ID NO: 73069 - protein, 13 aa, Mycobacterium tuberculosis
ASAQNISGAGWSG

SEQ ID NO: 73070 - protein, 13 aa, Mycobacterium tuberculosis
SAQNISGAGWSGM

SEQ ID NO: 73071 - protein, 13 aa, Mycobacterium tuberculosis
AQNISGAGWSGMA

SEQ ID NO: 73072 - protein, 13 aa, Mycobacterium tuberculosis
QNISGAGWSGMAE

SEQ ID NO: 73073 - protein, 13 aa, Mycobacterium tuberculosis
NISGAGWSGMAEA

SEQ ID NO: 73074 - protein, 13 aa, Mycobacterium tuberculosis
ISGAGWSGMAEAT

SEQ ID NO: 73075 - protein, 13 aa, Mycobacterium tuberculosis
SGAGWSGMAEATS

SEQ ID NO: 73076 - protein, 13 aa, Mycobacterium tuberculosis
GAGWSGMAEATSL

SEQ ID NO: 73077 - protein, 13 aa, Mycobacterium tuberculosis
AGWSGMAEATSLD

SEQ ID NO: 73078 - protein, 13 aa, Mycobacterium tuberculosis
GWSGMAEATSLDT

SEQ ID NO: 73079 - protein, 13 aa, Mycobacterium tuberculosis
WSGMAEATSLDTM

SEQ ID NO: 73080 - protein, 13 aa, Mycobacterium tuberculosis
SGMAEATSLDTMA

SEQ ID NO: 73081 - protein, 13 aa, Mycobacterium tuberculosis
GMAEATSLDTMAQ

SEQ ID NO: 73082 - protein, 13 aa, Mycobacterium tuberculosis
MAEATSLDTMAQM

SEQ ID NO: 73083 - protein, 13 aa, Mycobacterium tuberculosis
AEATSLDTMAQMN

SEQ ID NO: 73084 - protein, 13 aa, Mycobacterium tuberculosis
EATSLDTMAQMNQ

SEQ ID NO: 73085 - protein, 13 aa, Mycobacterium tuberculosis
ATSLDTMAQMNQA

SEQ ID NO: 73086 - protein, 13 aa, Mycobacterium tuberculosis
TSLDTMAQMNQAF

SEQ ID NO: 73087 - protein, 13 aa, Mycobacterium tuberculosis
SLDTMAQMNQAFR

SEQ ID NO: 73088 - protein, 13 aa, Mycobacterium tuberculosis
LDTMAQMNQAFRN

SEQ ID NO: 73089 - protein, 13 aa, Mycobacterium tuberculosis
DTMAQMNQAFRNI

SEQ ID NO: 73090 - protein, 13 aa, Mycobacterium tuberculosis
TMAQMNQAFRNIV

SEQ ID NO: 73091 - protein, 13 aa, Mycobacterium tuberculosis
MAQMNQAFRNIVN

SEQ ID NO: 73092 - protein, 13 aa, Mycobacterium tuberculosis
AQMNQAFRNIVNM

SEQ ID NO: 73093 - protein, 13 aa, Mycobacterium tuberculosis
QMNQAFRNIVNML

SEQ ID NO: 73094 - protein, 13 aa, Mycobacterium tuberculosis
MNQAFRNIVNMLH

SEQ ID NO: 73095 - protein, 13 aa, Mycobacterium tuberculosis
NQAFRNIVNMLHG

SEQ ID NO: 73096 - protein, 13 aa, Mycobacterium tuberculosis
QAFRNIVNMLHGV

SEQ ID NO: 73097 - protein, 13 aa, Mycobacterium tuberculosis
AFRNIVNMLHGVR

SEQ ID NO: 73098 - protein, 13 aa, Mycobacterium tuberculosis
FRNIVNMLHGVRD

SEQ ID NO: 73099 - protein, 13 aa, Mycobacterium tuberculosis
RNIVNMLHGVRDG

SEQ ID NO: 73100 - protein, 13 aa, Mycobacterium tuberculosis
NIVNMLHGVRDGL

SEQ ID NO: 73101 - protein, 13 aa, Mycobacterium tuberculosis
IVNMLHGVRDGLV

SEQ ID NO: 73102 - protein, 13 aa, Mycobacterium tuberculosis
VNMLHGVRDGLVR

SEQ ID NO: 73103 - protein, 13 aa, Mycobacterium tuberculosis
NMLHGVRDGLVRD

SEQ ID NO: 73104 - protein, 13 aa, Mycobacterium tuberculosis
MLHGVRDGLVRDA

SEQ ID NO: 73105 - protein, 13 aa, Mycobacterium tuberculosis
LHGVRDGLVRDAN

SEQ ID NO: 73106 - protein, 13 aa, Mycobacterium tuberculosis
HGVRDGLVRDANN

SEQ ID NO: 73107 - protein, 13 aa, Mycobacterium tuberculosis
GVRDGLVRDANNY

SEQ ID NO: 73108 - protein, 13 aa, Mycobacterium tuberculosis
VRDGLVRDANNYE

SEQ ID NO: 73109 - protein, 13 aa, Mycobacterium tuberculosis
RDGLVRDANNYEQ

SEQ ID NO: 73110 - protein, 13 aa, Mycobacterium tuberculosis
DGLVRDANNYEQQ

SEQ ID NO: 73111 - protein, 13 aa, Mycobacterium tuberculosis
GLVRDANNYEQQE

SEQ ID NO: 73112 - protein, 13 aa, Mycobacterium tuberculosis
LVRDANNYEQQEQ

SEQ ID NO: 73113 - protein, 13 aa, Mycobacterium tuberculosis
VRDANNYEQQEQA

SEQ ID NO: 73114 - protein, 13 aa, Mycobacterium tuberculosis
RDANNYEQQEQAS

SEQ ID NO: 73115 - protein, 13 aa, Mycobacterium tuberculosis
DANNYEQQEQASQ

SEQ ID NO: 73116 - protein, 13 aa, Mycobacterium tuberculosis
ANNYEQQEQASQQ

SEQ ID NO: 73117 - protein, 13 aa, Mycobacterium tuberculosis
NNYEQQEQASQQI

SEQ ID NO: 73118 - protein, 13 aa, Mycobacterium tuberculosis
NYEQQEQASQQIL

SEQ ID NO: 73119 - protein, 13 aa, Mycobacterium tuberculosis
YEQQEQASQQILS

SEQ ID NO: 73120 - protein, 13 aa, Mycobacterium tuberculosis
EQQEQASQQILSS

SEQ ID NO: 73121 - protein, 14 aa, Mycobacterium tuberculosis
MASRFMTDPHAMRD

SEQ ID NO: 73122 - protein, 14 aa, Mycobacterium tuberculosis
ASRFMTDPHAMRDM

SEQ ID NO: 73123 - protein, 14 aa, Mycobacterium tuberculosis
SRFMTDPHAMRDMA

SEQ ID NO: 73124 - protein, 14 aa, Mycobacterium tuberculosis
RFMTDPHAMRDMAG

SEQ ID NO: 73125 - protein, 14 aa, Mycobacterium tuberculosis
FMTDPHAMRDMAGR

SEQ ID NO: 73126 - protein, 14 aa, Mycobacterium tuberculosis
MTDPHAMRDMAGRF

SEQ ID NO: 73127 - protein, 14 aa, Mycobacterium tuberculosis
TDPHAMRDMAGRFE

SEQ ID NO: 73128 - protein, 14 aa, Mycobacterium tuberculosis
DPHAMRDMAGRFEV

SEQ ID NO: 73129 - protein, 14 aa, Mycobacterium tuberculosis
PHAMRDMAGRFEVH

SEQ ID NO: 73130 - protein, 14 aa, Mycobacterium tuberculosis
HAMRDMAGRFEVHA

SEQ ID NO: 73131 - protein, 14 aa, Mycobacterium tuberculosis
AMRDMAGRFEVHAQ

SEQ ID NO: 73132 - protein, 14 aa, Mycobacterium tuberculosis
MRDMAGRFEVHAQT

SEQ ID NO: 73133 - protein, 14 aa, Mycobacterium tuberculosis
RDMAGRFEVHAQTV

SEQ ID NO: 73134 - protein, 14 aa, Mycobacterium tuberculosis
DMAGRFEVHAQTVE

SEQ ID NO: 73135 - protein, 14 aa, Mycobacterium tuberculosis
MAGRFEVHAQTVED

SEQ ID NO: 73136 - protein, 14 aa, Mycobacterium tuberculosis
AGRFEVHAQTVEDE

SEQ ID NO: 73137 - protein, 14 aa, Mycobacterium tuberculosis
GRFEVHAQTVEDEA

SEQ ID NO: 73138 - protein, 14 aa, Mycobacterium tuberculosis
RFEVHAQTVEDEAR

SEQ ID NO: 73139 - protein, 14 aa, Mycobacterium tuberculosis
FEVHAQTVEDEARR

SEQ ID NO: 73140 - protein, 14 aa, Mycobacterium tuberculosis
EVHAQTVEDEARRM

SEQ ID NO: 73141 - protein, 14 aa, Mycobacterium tuberculosis
VHAQTVEDEARRMW

SEQ ID NO: 73142 - protein, 14 aa, Mycobacterium tuberculosis
HAQTVEDEARRMWA

SEQ ID NO: 73143 - protein, 14 aa, Mycobacterium tuberculosis
AQTVEDEARRMWAS

SEQ ID NO: 73144 - protein, 14 aa, Mycobacterium tuberculosis
QTVEDEARRMWASA

SEQ ID NO: 73145 - protein, 14 aa, Mycobacterium tuberculosis
TVEDEARRMWASAQ

SEQ ID NO: 73146 - protein, 14 aa, Mycobacterium tuberculosis
VEDEARRMWASAQN

SEQ ID NO: 73147 - protein, 14 aa, Mycobacterium tuberculosis
EDEARRMWASAQNI

SEQ ID NO: 73148 - protein, 14 aa, Mycobacterium tuberculosis
DEARRMWASAQNIS

SEQ ID NO: 73149 - protein, 14 aa, Mycobacterium tuberculosis
EARRMWASAQNISG

SEQ ID NO: 73150 - protein, 14 aa, Mycobacterium tuberculosis
ARRMWASAQNISGA

SEQ ID NO: 73151 - protein, 14 aa, Mycobacterium tuberculosis
RRMWASAQNISGAG

SEQ ID NO: 73152 - protein, 14 aa, Mycobacterium tuberculosis
RMWASAQNISGAGW

SEQ ID NO: 73153 - protein, 14 aa, Mycobacterium tuberculosis
MWASAQNISGAGWS

SEQ ID NO: 73154 - protein, 14 aa, Mycobacterium tuberculosis
WASAQNISGAGWSG

SEQ ID NO: 73155 - protein, 14 aa, Mycobacterium tuberculosis
ASAQNISGAGWSGM

SEQ ID NO: 73156 - protein, 14 aa, Mycobacterium tuberculosis
SAQNISGAGWSGMA

SEQ ID NO: 73157 - protein, 14 aa, Mycobacterium tuberculosis
AQNISGAGWSGMAE

SEQ ID NO: 73158 - protein, 14 aa, Mycobacterium tuberculosis
QNISGAGWSGMAEA

SEQ ID NO: 73159 - protein, 14 aa, Mycobacterium tuberculosis
NISGAGWSGMAEAT

SEQ ID NO: 73160 - protein, 14 aa, Mycobacterium tuberculosis
ISGAGWSGMAEATS

SEQ ID NO: 73161 - protein, 14 aa, Mycobacterium tuberculosis
SGAGWSGMAEATSL

SEQ ID NO: 73162 - protein, 14 aa, Mycobacterium tuberculosis
GAGWSGMAEATSLD

SEQ ID NO: 73163 - protein, 14 aa, Mycobacterium tuberculosis
AGWSGMAEATSLDT

SEQ ID NO: 73164 - protein, 14 aa, Mycobacterium tuberculosis
GWSGMAEATSLDTM

SEQ ID NO: 73165 - protein, 14 aa, Mycobacterium tuberculosis
WSGMAEATSLDTMA

SEQ ID NO: 73166 - protein, 14 aa, Mycobacterium tuberculosis
SGMAEATSLDTMAQ

SEQ ID NO: 73167 - protein, 14 aa, Mycobacterium tuberculosis
GMAEATSLDTMAQM

SEQ ID NO: 73168 - protein, 14 aa, Mycobacterium tuberculosis
MAEATSLDTMAQMN

SEQ ID NO: 73169 - protein, 14 aa, Mycobacterium tuberculosis
AEATSLDTMAQMNQ

SEQ ID NO: 73170 - protein, 14 aa, Mycobacterium tuberculosis
EATSLDTMAQMNQA

SEQ ID NO: 73171 - protein, 14 aa, Mycobacterium tuberculosis
ATSLDTMAQMNQAF

SEQ ID NO: 73172 - protein, 14 aa, Mycobacterium tuberculosis
TSLDTMAQMNQAFR

SEQ ID NO: 73173 - protein, 14 aa, Mycobacterium tuberculosis
SLDTMAQMNQAFRN

SEQ ID NO: 73174 - protein, 14 aa, Mycobacterium tuberculosis
LDTMAQMNQAFRNI

SEQ ID NO: 73175 - protein, 14 aa, Mycobacterium tuberculosis
DTMAQMNQAFRNIV

SEQ ID NO: 73176 - protein, 14 aa, Mycobacterium tuberculosis
TMAQMNQAFRNIVN

SEQ ID NO: 73177 - protein, 14 aa, Mycobacterium tuberculosis
MAQMNQAFRNIVNM

SEQ ID NO: 73178 - protein, 14 aa, Mycobacterium tuberculosis
AQMNQAFRNIVNML

SEQ ID NO: 73179 - protein, 14 aa, Mycobacterium tuberculosis
QMNQAFRNIVNMLH

SEQ ID NO: 73180 - protein, 14 aa, Mycobacterium tuberculosis
MNQAFRNIVNMLHG

SEQ ID NO: 73181 - protein, 14 aa, Mycobacterium tuberculosis
NQAFRNIVNMLHGV

SEQ ID NO: 73182 - protein, 14 aa, Mycobacterium tuberculosis
QAFRNIVNMLHGVR

SEQ ID NO: 73183 - protein, 14 aa, Mycobacterium tuberculosis
AFRNIVNMLHGVRD

SEQ ID NO: 73184 - protein, 14 aa, Mycobacterium tuberculosis
FRNIVNMLHGVRDG

SEQ ID NO: 73185 - protein, 14 aa, Mycobacterium tuberculosis
RNIVNMLHGVRDGL

SEQ ID NO: 73186 - protein, 14 aa, Mycobacterium tuberculosis
NIVNMLHGVRDGLV

SEQ ID NO: 73187 - protein, 14 aa, Mycobacterium tuberculosis
IVNMLHGVRDGLVR

SEQ ID NO: 73188 - protein, 14 aa, Mycobacterium tuberculosis
VNMLHGVRDGLVRD

SEQ ID NO: 73189 - protein, 14 aa, Mycobacterium tuberculosis
NMLHGVRDGLVRDA

SEQ ID NO: 73190 - protein, 14 aa, Mycobacterium tuberculosis
MLHGVRDGLVRDAN

SEQ ID NO: 73191 - protein, 14 aa, Mycobacterium tuberculosis
LHGVRDGLVRDANN

SEQ ID NO: 73192 - protein, 14 aa, Mycobacterium tuberculosis
HGVRDGLVRDANNY

SEQ ID NO: 73193 - protein, 14 aa, Mycobacterium tuberculosis
GVRDGLVRDANNYE

SEQ ID NO: 73194 - protein, 14 aa, Mycobacterium tuberculosis
VRDGLVRDANNYEQ

SEQ ID NO: 73195 - protein, 14 aa, Mycobacterium tuberculosis
RDGLVRDANNYEQQ

SEQ ID NO: 73196 - protein, 14 aa, Mycobacterium tuberculosis
DGLVRDANNYEQQE

SEQ ID NO: 73197 - protein, 14 aa, Mycobacterium tuberculosis
GLVRDANNYEQQEQ

SEQ ID NO: 73198 - protein, 14 aa, Mycobacterium tuberculosis
LVRDANNYEQQEQA

SEQ ID NO: 73199 - protein, 14 aa, Mycobacterium tuberculosis
VRDANNYEQQEQAS

SEQ ID NO: 73200 - protein, 14 aa, Mycobacterium tuberculosis
RDANNYEQQEQASQ

SEQ ID NO: 73201 - protein, 14 aa, Mycobacterium tuberculosis
DANNYEQQEQASQQ

SEQ ID NO: 73202 - protein, 14 aa, Mycobacterium tuberculosis
ANNYEQQEQASQQI

SEQ ID NO: 73203 - protein, 14 aa, Mycobacterium tuberculosis
NNYEQQEQASQQIL

SEQ ID NO: 73204 - protein, 14 aa, Mycobacterium tuberculosis
NYEQQEQASQQILS

SEQ ID NO: 73205 - protein, 14 aa, Mycobacterium tuberculosis
YEQQEQASQQILSS

SEQ ID NO: 73206 - protein, 15 aa, Mycobacterium tuberculosis
MASRFMTDPHAMRDM

SEQ ID NO: 73207 - protein, 15 aa, Mycobacterium tuberculosis
ASRFMTDPHAMRDMA

SEQ ID NO: 73208 - protein, 15 aa, Mycobacterium tuberculosis
SRFMTDPHAMRDMAG

SEQ ID NO: 73209 - protein, 15 aa, Mycobacterium tuberculosis
RFMTDPHAMRDMAGR

SEQ ID NO: 73210 - protein, 15 aa, Mycobacterium tuberculosis
FMTDPHAMRDMAGRF

SEQ ID NO: 73211 - protein, 15 aa, Mycobacterium tuberculosis
MTDPHAMRDMAGRFE

SEQ ID NO: 73212 - protein, 15 aa, Mycobacterium tuberculosis
TDPHAMRDMAGRFEV

SEQ ID NO: 73213 - protein, 15 aa, Mycobacterium tuberculosis
DPHAMRDMAGRFEVH

SEQ ID NO: 73214 - protein, 15 aa, Mycobacterium tuberculosis
PHAMRDMAGRFEVHA

SEQ ID NO: 73215 - protein, 15 aa, Mycobacterium tuberculosis
HAMRDMAGRFEVHAQ

SEQ ID NO: 73216 - protein, 15 aa, Mycobacterium tuberculosis
AMRDMAGRFEVHAQT

SEQ ID NO: 73217 - protein, 15 aa, Mycobacterium tuberculosis
MRDMAGRFEVHAQTV

SEQ ID NO: 73218 - protein, 15 aa, Mycobacterium tuberculosis
RDMAGRFEVHAQTVE

SEQ ID NO: 73219 - protein, 15 aa, Mycobacterium tuberculosis
DMAGRFEVHAQTVED

SEQ ID NO: 73220 - protein, 15 aa, Mycobacterium tuberculosis
MAGRFEVHAQTVEDE

SEQ ID NO: 73221 - protein, 15 aa, Mycobacterium tuberculosis
AGRFEVHAQTVEDEA

SEQ ID NO: 73222 - protein, 15 aa, Mycobacterium tuberculosis
GRFEVHAQTVEDEAR

SEQ ID NO: 73223 - protein, 15 aa, Mycobacterium tuberculosis
RFEVHAQTVEDEARR

SEQ ID NO: 73224 - protein, 15 aa, Mycobacterium tuberculosis
FEVHAQTVEDEARRM

SEQ ID NO: 73225 - protein, 15 aa, Mycobacterium tuberculosis
EVHAQTVEDEARRMW

SEQ ID NO: 73226 - protein, 15 aa, Mycobacterium tuberculosis
VHAQTVEDEARRMWA

SEQ ID NO: 73227 - protein, 15 aa, Mycobacterium tuberculosis
HAQTVEDEARRMWAS

SEQ ID NO: 73228 - protein, 15 aa, Mycobacterium tuberculosis
AQTVEDEARRMWASA

SEQ ID NO: 73229 - protein, 15 aa, Mycobacterium tuberculosis
QTVEDEARRMWASAQ

SEQ ID NO: 73230 - protein, 15 aa, Mycobacterium tuberculosis
TVEDEARRMWASAQN

SEQ ID NO: 73231 - protein, 15 aa, Mycobacterium tuberculosis
VEDEARRMWASAQNI

SEQ ID NO: 73232 - protein, 15 aa, Mycobacterium tuberculosis
EDEARRMWASAQNIS

SEQ ID NO: 73233 - protein, 15 aa, Mycobacterium tuberculosis
DEARRMWASAQNISG

SEQ ID NO: 73234 - protein, 15 aa, Mycobacterium tuberculosis
EARRMWASAQNISGA

SEQ ID NO: 73235 - protein, 15 aa, Mycobacterium tuberculosis
ARRMWASAQNISGAG

SEQ ID NO: 73236 - protein, 15 aa, Mycobacterium tuberculosis
RRMWASAQNISGAGW

SEQ ID NO: 73237 - protein, 15 aa, Mycobacterium tuberculosis
RMWASAQNISGAGWS

SEQ ID NO: 73238 - protein, 15 aa, Mycobacterium tuberculosis
MWASAQNISGAGWSG

SEQ ID NO: 73239 - protein, 15 aa, Mycobacterium tuberculosis
WASAQNISGAGWSGM

SEQ ID NO: 73240 - protein, 15 aa, Mycobacterium tuberculosis
ASAQNISGAGWSGMA

SEQ ID NO: 73241 - protein, 15 aa, Mycobacterium tuberculosis
SAQNISGAGWSGMAE

SEQ ID NO: 73242 - protein, 15 aa, Mycobacterium tuberculosis
AQNISGAGWSGMAEA

SEQ ID NO: 73243 - protein, 15 aa, Mycobacterium tuberculosis
QNISGAGWSGMAEAT

SEQ ID NO: 73244 - protein, 15 aa, Mycobacterium tuberculosis
NISGAGWSGMAEATS

SEQ ID NO: 73245 - protein, 15 aa, Mycobacterium tuberculosis
ISGAGWSGMAEATSL

SEQ ID NO: 73246 - protein, 15 aa, Mycobacterium tuberculosis
SGAGWSGMAEATSLD

SEQ ID NO: 73247 - protein, 15 aa, Mycobacterium tuberculosis
GAGWSGMAEATSLDT

SEQ ID NO: 73248 - protein, 15 aa, Mycobacterium tuberculosis
AGWSGMAEATSLDTM

SEQ ID NO: 73249 - protein, 15 aa, Mycobacterium tuberculosis
GWSGMAEATSLDTMA

SEQ ID NO: 73250 - protein, 15 aa, Mycobacterium tuberculosis
WSGMAEATSLDTMAQ

SEQ ID NO: 73251 - protein, 15 aa, Mycobacterium tuberculosis
SGMAEATSLDTMAQM

SEQ ID NO: 73252 - protein, 15 aa, Mycobacterium tuberculosis
GMAEATSLDTMAQMN

SEQ ID NO: 73253 - protein, 15 aa, Mycobacterium tuberculosis
MAEATSLDTMAQMNQ

SEQ ID NO: 73254 - protein, 15 aa, Mycobacterium tuberculosis
AEATSLDTMAQMNQA

SEQ ID NO: 73255 - protein, 15 aa, Mycobacterium tuberculosis
EATSLDTMAQMNQAF

SEQ ID NO: 73256 - protein, 15 aa, Mycobacterium tuberculosis
ATSLDTMAQMNQAFR

SEQ ID NO: 73257 - protein, 15 aa, Mycobacterium tuberculosis
TSLDTMAQMNQAFRN

SEQ ID NO: 73258 - protein, 15 aa, Mycobacterium tuberculosis
SLDTMAQMNQAFRNI

SEQ ID NO: 73259 - protein, 15 aa, Mycobacterium tuberculosis
LDTMAQMNQAFRNIV

SEQ ID NO: 73260 - protein, 15 aa, Mycobacterium tuberculosis
DTMAQMNQAFRNIVN

SEQ ID NO: 73261 - protein, 15 aa, Mycobacterium tuberculosis
TMAQMNQAFRNIVNM

SEQ ID NO: 73262 - protein, 15 aa, Mycobacterium tuberculosis
MAQMNQAFRNIVNML

SEQ ID NO: 73263 - protein, 15 aa, Mycobacterium tuberculosis
AQMNQAFRNIVNMLH

SEQ ID NO: 73264 - protein, 15 aa, Mycobacterium tuberculosis
QMNQAFRNIVNMLHG

SEQ ID NO: 73265 - protein, 15 aa, Mycobacterium tuberculosis
MNQAFRNIVNMLHGV

SEQ ID NO: 73266 - protein, 15 aa, Mycobacterium tuberculosis
NQAFRNIVNMLHGVR

SEQ ID NO: 73267 - protein, 15 aa, Mycobacterium tuberculosis
QAFRNIVNMLHGVRD

SEQ ID NO: 73268 - protein, 15 aa, Mycobacterium tuberculosis
AFRNIVNMLHGVRDG

SEQ ID NO: 73269 - protein, 15 aa, Mycobacterium tuberculosis
FRNIVNMLHGVRDGL

SEQ ID NO: 73270 - protein, 15 aa, Mycobacterium tuberculosis
RNIVNMLHGVRDGLV

SEQ ID NO: 73271 - protein, 15 aa, Mycobacterium tuberculosis
NIVNMLHGVRDGLVR

SEQ ID NO: 73272 - protein, 15 aa, Mycobacterium tuberculosis
IVNMLHGVRDGLVRD

SEQ ID NO: 73273 - protein, 15 aa, Mycobacterium tuberculosis
VNMLHGVRDGLVRDA

SEQ ID NO: 73274 - protein, 15 aa, Mycobacterium tuberculosis
NMLHGVRDGLVRDAN

SEQ ID NO: 73275 - protein, 15 aa, Mycobacterium tuberculosis
MLHGVRDGLVRDANN

SEQ ID NO: 73276 - protein, 15 aa, Mycobacterium tuberculosis
LHGVRDGLVRDANNY

SEQ ID NO: 73277 - protein, 15 aa, Mycobacterium tuberculosis
HGVRDGLVRDANNYE

SEQ ID NO: 73278 - protein, 15 aa, Mycobacterium tuberculosis
GVRDGLVRDANNYEQ

SEQ ID NO: 73279 - protein, 15 aa, Mycobacterium tuberculosis
VRDGLVRDANNYEQQ

SEQ ID NO: 73280 - protein, 15 aa, Mycobacterium tuberculosis
RDGLVRDANNYEQQE

SEQ ID NO: 73281 - protein, 15 aa, Mycobacterium tuberculosis
DGLVRDANNYEQQEQ

SEQ ID NO: 73282 - protein, 15 aa, Mycobacterium tuberculosis
GLVRDANNYEQQEQA

SEQ ID NO: 73283 - protein, 15 aa, Mycobacterium tuberculosis
LVRDANNYEQQEQAS

SEQ ID NO: 73284 - protein, 15 aa, Mycobacterium tuberculosis
VRDANNYEQQEQASQ

SEQ ID NO: 73285 - protein, 15 aa, Mycobacterium tuberculosis
RDANNYEQQEQASQQ

SEQ ID NO: 73286 - protein, 15 aa, Mycobacterium tuberculosis
DANNYEQQEQASQQI

SEQ ID NO: 73287 - protein, 15 aa, Mycobacterium tuberculosis
ANNYEQQEQASQQIL

SEQ ID NO: 73288 - protein, 15 aa, Mycobacterium tuberculosis
NNYEQQEQASQQILS

SEQ ID NO: 73289 - protein, 15 aa, Mycobacterium tuberculosis
NYEQQEQASQQILSS

SEQ ID NO: 73290 - protein, 16 aa, Mycobacterium tuberculosis
MASRFMTDPHAMRDMA

SEQ ID NO: 73291 - protein, 16 aa, Mycobacterium tuberculosis
ASRFMTDPHAMRDMAG

SEQ ID NO: 73292 - protein, 16 aa, Mycobacterium tuberculosis
SRFMTDPHAMRDMAGR

SEQ ID NO: 73293 - protein, 16 aa, Mycobacterium tuberculosis
RFMTDPHAMRDMAGRF

SEQ ID NO: 73294 - protein, 16 aa, Mycobacterium tuberculosis
FMTDPHAMRDMAGRFE

SEQ ID NO: 73295 - protein, 16 aa, Mycobacterium tuberculosis
MTDPHAMRDMAGRFEV

SEQ ID NO: 73296 - protein, 16 aa, Mycobacterium tuberculosis
TDPHAMRDMAGRFEVH

SEQ ID NO: 73297 - protein, 16 aa, Mycobacterium tuberculosis
DPHAMRDMAGRFEVHA

SEQ ID NO: 73298 - protein, 16 aa, Mycobacterium tuberculosis
PHAMRDMAGRFEVHAQ

SEQ ID NO: 73299 - protein, 16 aa, Mycobacterium tuberculosis
HAMRDMAGRFEVHAQT

SEQ ID NO: 73300 - protein, 16 aa, Mycobacterium tuberculosis
AMRDMAGRFEVHAQTV

SEQ ID NO: 73301 - protein, 16 aa, Mycobacterium tuberculosis
MRDMAGRFEVHAQTVE

SEQ ID NO: 73302 - protein, 16 aa, Mycobacterium tuberculosis
RDMAGRFEVHAQTVED

SEQ ID NO: 73303 - protein, 16 aa, Mycobacterium tuberculosis
DMAGRFEVHAQTVEDE

SEQ ID NO: 73304 - protein, 16 aa, Mycobacterium tuberculosis
MAGRFEVHAQTVEDEA

SEQ ID NO: 73305 - protein, 16 aa, Mycobacterium tuberculosis
AGRFEVHAQTVEDEAR

SEQ ID NO: 73306 - protein, 16 aa, Mycobacterium tuberculosis
GRFEVHAQTVEDEARR

SEQ ID NO: 73307 - protein, 16 aa, Mycobacterium tuberculosis
RFEVHAQTVEDEARRM

SEQ ID NO: 73308 - protein, 16 aa, Mycobacterium tuberculosis
FEVHAQTVEDEARRMW

SEQ ID NO: 73309 - protein, 16 aa, Mycobacterium tuberculosis
EVHAQTVEDEARRMWA

SEQ ID NO: 73310 - protein, 16 aa, Mycobacterium tuberculosis
VHAQTVEDEARRMWAS

SEQ ID NO: 73311 - protein, 16 aa, Mycobacterium tuberculosis
HAQTVEDEARRMWASA

SEQ ID NO: 73312 - protein, 16 aa, Mycobacterium tuberculosis
AQTVEDEARRMWASAQ

SEQ ID NO: 73313 - protein, 16 aa, Mycobacterium tuberculosis
QTVEDEARRMWASAQN

SEQ ID NO: 73314 - protein, 16 aa, Mycobacterium tuberculosis
TVEDEARRMWASAQNI

SEQ ID NO: 73315 - protein, 16 aa, Mycobacterium tuberculosis
VEDEARRMWASAQNIS

SEQ ID NO: 73316 - protein, 16 aa, Mycobacterium tuberculosis
EDEARRMWASAQNISG

SEQ ID NO: 73317 - protein, 16 aa, Mycobacterium tuberculosis
DEARRMWASAQNISGA

SEQ ID NO: 73318 - protein, 16 aa, Mycobacterium tuberculosis
EARRMWASAQNISGAG

SEQ ID NO: 73319 - protein, 16 aa, Mycobacterium tuberculosis
ARRMWASAQNISGAGW

SEQ ID NO: 73320 - protein, 16 aa, Mycobacterium tuberculosis
RRMWASAQNISGAGWS

SEQ ID NO: 73321 - protein, 16 aa, Mycobacterium tuberculosis
RMWASAQNISGAGWSG

SEQ ID NO: 73322 - protein, 16 aa, Mycobacterium tuberculosis
MWASAQNISGAGWSGM

SEQ ID NO: 73323 - protein, 16 aa, Mycobacterium tuberculosis
WASAQNISGAGWSGMA

SEQ ID NO: 73324 - protein, 16 aa, Mycobacterium tuberculosis
ASAQNISGAGWSGMAE

SEQ ID NO: 73325 - protein, 16 aa, Mycobacterium tuberculosis
SAQNISGAGWSGMAEA

SEQ ID NO: 73326 - protein, 16 aa, Mycobacterium tuberculosis
AQNISGAGWSGMAEAT

SEQ ID NO: 73327 - protein, 16 aa, Mycobacterium tuberculosis
QNISGAGWSGMAEATS

SEQ ID NO: 73328 - protein, 16 aa, Mycobacterium tuberculosis
NISGAGWSGMAEATSL

SEQ ID NO: 73329 - protein, 16 aa, Mycobacterium tuberculosis
ISGAGWSGMAEATSLD

SEQ ID NO: 73330 - protein, 16 aa, Mycobacterium tuberculosis
SGAGWSGMAEATSLDT

SEQ ID NO: 73331 - protein, 16 aa, Mycobacterium tuberculosis
GAGWSGMAEATSLDTM

SEQ ID NO: 73332 - protein, 16 aa, Mycobacterium tuberculosis
AGWSGMAEATSLDTMA

SEQ ID NO: 73333 - protein, 16 aa, Mycobacterium tuberculosis
GWSGMAEATSLDTMAQ

SEQ ID NO: 73334 - protein, 16 aa, Mycobacterium tuberculosis
WSGMAEATSLDTMAQM

SEQ ID NO: 73335 - protein, 16 aa, Mycobacterium tuberculosis
SGMAEATSLDTMAQMN

SEQ ID NO: 73336 - protein, 16 aa, Mycobacterium tuberculosis
GMAEATSLDTMAQMNQ

SEQ ID NO: 73337 - protein, 16 aa, Mycobacterium tuberculosis
MAEATSLDTMAQMNQA

SEQ ID NO: 73338 - protein, 16 aa, Mycobacterium tuberculosis
AEATSLDTMAQMNQAF

SEQ ID NO: 73339 - protein, 16 aa, Mycobacterium tuberculosis
EATSLDTMAQMNQAFR

SEQ ID NO: 73340 - protein, 16 aa, Mycobacterium tuberculosis
ATSLDTMAQMNQAFRN

SEQ ID NO: 73341 - protein, 16 aa, Mycobacterium tuberculosis
TSLDTMAQMNQAFRNI

SEQ ID NO: 73342 - protein, 16 aa, Mycobacterium tuberculosis
SLDTMAQMNQAFRNIV

SEQ ID NO: 73343 - protein, 16 aa, Mycobacterium tuberculosis
LDTMAQMNQAFRNIVN

SEQ ID NO: 73344 - protein, 16 aa, Mycobacterium tuberculosis
DTMAQMNQAFRNIVNM

SEQ ID NO: 73345 - protein, 16 aa, Mycobacterium tuberculosis
TMAQMNQAFRNIVNML

SEQ ID NO: 73346 - protein, 16 aa, Mycobacterium tuberculosis
MAQMNQAFRNIVNMLH

SEQ ID NO: 73347 - protein, 16 aa, Mycobacterium tuberculosis
AQMNQAFRNIVNMLHG

SEQ ID NO: 73348 - protein, 16 aa, Mycobacterium tuberculosis
QMNQAFRNIVNMLHGV

SEQ ID NO: 73349 - protein, 16 aa, Mycobacterium tuberculosis
MNQAFRNIVNMLHGVR

SEQ ID NO: 73350 - protein, 16 aa, Mycobacterium tuberculosis
NQAFRNIVNMLHGVRD

SEQ ID NO: 73351 - protein, 16 aa, Mycobacterium tuberculosis
QAFRNIVNMLHGVRDG

SEQ ID NO: 73352 - protein, 16 aa, Mycobacterium tuberculosis
AFRNIVNMLHGVRDGL

SEQ ID NO: 73353 - protein, 16 aa, Mycobacterium tuberculosis
FRNIVNMLHGVRDGLV

SEQ ID NO: 73354 - protein, 16 aa, Mycobacterium tuberculosis
RNIVNMLHGVRDGLVR

SEQ ID NO: 73355 - protein, 16 aa, Mycobacterium tuberculosis
NIVNMLHGVRDGLVRD

SEQ ID NO: 73356 - protein, 16 aa, Mycobacterium tuberculosis
IVNMLHGVRDGLVRDA

SEQ ID NO: 73357 - protein, 16 aa, Mycobacterium tuberculosis
VNMLHGVRDGLVRDAN

SEQ ID NO: 73358 - protein, 16 aa, Mycobacterium tuberculosis
NMLHGVRDGLVRDANN

SEQ ID NO: 73359 - protein, 16 aa, Mycobacterium tuberculosis
MLHGVRDGLVRDANNY

SEQ ID NO: 73360 - protein, 16 aa, Mycobacterium tuberculosis
LHGVRDGLVRDANNYE

SEQ ID NO: 73361 - protein, 16 aa, Mycobacterium tuberculosis
HGVRDGLVRDANNYEQ

SEQ ID NO: 73362 - protein, 16 aa, Mycobacterium tuberculosis
GVRDGLVRDANNYEQQ

SEQ ID NO: 73363 - protein, 16 aa, Mycobacterium tuberculosis
VRDGLVRDANNYEQQE

SEQ ID NO: 73364 - protein, 16 aa, Mycobacterium tuberculosis
RDGLVRDANNYEQQEQ

SEQ ID NO: 73365 - protein, 16 aa, Mycobacterium tuberculosis
DGLVRDANNYEQQEQA

SEQ ID NO: 73366 - protein, 16 aa, Mycobacterium tuberculosis
GLVRDANNYEQQEQAS

SEQ ID NO: 73367 - protein, 16 aa, Mycobacterium tuberculosis
LVRDANNYEQQEQASQ

SEQ ID NO: 73368 - protein, 16 aa, Mycobacterium tuberculosis
VRDANNYEQQEQASQQ

SEQ ID NO: 73369 - protein, 16 aa, Mycobacterium tuberculosis
RDANNYEQQEQASQQI

SEQ ID NO: 73370 - protein, 16 aa, Mycobacterium tuberculosis
DANNYEQQEQASQQIL

SEQ ID NO: 73371 - protein, 16 aa, Mycobacterium tuberculosis
ANNYEQQEQASQQILS

SEQ ID NO: 73372 - protein, 16 aa, Mycobacterium tuberculosis
NNYEQQEQASQQILSS

SEQ ID NO: 73373 - protein, 13 aa, Mycobacterium tuberculosis
MTINYQFGDVDAH

SEQ ID NO: 73374 - protein, 13 aa, Mycobacterium tuberculosis
TINYQFGDVDAHG

SEQ ID NO: 73375 - protein, 13 aa, Mycobacterium tuberculosis
INYQFGDVDAHGA

SEQ ID NO: 73376 - protein, 13 aa, Mycobacterium tuberculosis
NYQFGDVDAHGAM

SEQ ID NO: 73377 - protein, 13 aa, Mycobacterium tuberculosis
YQFGDVDAHGAMI

SEQ ID NO: 73378 - protein, 13 aa, Mycobacterium tuberculosis
QFGDVDAHGAMIR

SEQ ID NO: 73379 - protein, 13 aa, Mycobacterium tuberculosis
FGDVDAHGAMIRA

SEQ ID NO: 73380 - protein, 13 aa, Mycobacterium tuberculosis
GDVDAHGAMIRAQ

SEQ ID NO: 73381 - protein, 13 aa, Mycobacterium tuberculosis
DVDAHGAMIRAQA

SEQ ID NO: 73382 - protein, 13 aa, Mycobacterium tuberculosis
VDAHGAMIRAQAG

SEQ ID NO: 73383 - protein, 13 aa, Mycobacterium tuberculosis
DAHGAMIRAQAGS

SEQ ID NO: 73384 - protein, 13 aa, Mycobacterium tuberculosis
AHGAMIRAQAGSL

SEQ ID NO: 73385 - protein, 13 aa, Mycobacterium tuberculosis
HGAMIRAQAGSLE

SEQ ID NO: 73386 - protein, 13 aa, Mycobacterium tuberculosis
GAMIRAQAGSLEA

SEQ ID NO: 73387 - protein, 13 aa, Mycobacterium tuberculosis
AMIRAQAGSLEAE

SEQ ID NO: 73388 - protein, 13 aa, Mycobacterium tuberculosis
MIRAQAGSLEAEH

SEQ ID NO: 73389 - protein, 13 aa, Mycobacterium tuberculosis
IRAQAGSLEAEHQ

SEQ ID NO: 73390 - protein, 13 aa, Mycobacterium tuberculosis
RAQAGSLEAEHQA

SEQ ID NO: 73391 - protein, 13 aa, Mycobacterium tuberculosis
AQAGSLEAEHQAI

SEQ ID NO: 73392 - protein, 13 aa, Mycobacterium tuberculosis
QAGSLEAEHQAII

SEQ ID NO: 73393 - protein, 13 aa, Mycobacterium tuberculosis
AGSLEAEHQAIIS

SEQ ID NO: 73394 - protein, 13 aa, Mycobacterium tuberculosis
GSLEAEHQAIISD

SEQ ID NO: 73395 - protein, 13 aa, Mycobacterium tuberculosis
SLEAEHQAIISDV

SEQ ID NO: 73396 - protein, 13 aa, Mycobacterium tuberculosis
LEAEHQAIISDVL

SEQ ID NO: 73397 - protein, 13 aa, Mycobacterium tuberculosis
EAEHQAIISDVLT

SEQ ID NO: 73398 - protein, 13 aa, Mycobacterium tuberculosis
AEHQAIISDVLTA

SEQ ID NO: 73399 - protein, 13 aa, Mycobacterium tuberculosis
EHQAIISDVLTAS

SEQ ID NO: 73400 - protein, 13 aa, Mycobacterium tuberculosis
HQAIISDVLTASD

SEQ ID NO: 73401 - protein, 13 aa, Mycobacterium tuberculosis
QAIISDVLTASDF

SEQ ID NO: 73402 - protein, 13 aa, Mycobacterium tuberculosis
AIISDVLTASDFW

SEQ ID NO: 73403 - protein, 13 aa, Mycobacterium tuberculosis
IISDVLTASDFWG

SEQ ID NO: 73404 - protein, 13 aa, Mycobacterium tuberculosis
ISDVLTASDFWGG

SEQ ID NO: 73405 - protein, 13 aa, Mycobacterium tuberculosis
SDVLTASDFWGGA

SEQ ID NO: 73406 - protein, 13 aa, Mycobacterium tuberculosis
DVLTASDFWGGAG

SEQ ID NO: 73407 - protein, 13 aa, Mycobacterium tuberculosis
VLTASDFWGGAGS

SEQ ID NO: 73408 - protein, 13 aa, Mycobacterium tuberculosis
LTASDFWGGAGSA

SEQ ID NO: 73409 - protein, 13 aa, Mycobacterium tuberculosis
TASDFWGGAGSAA

SEQ ID NO: 73410 - protein, 13 aa, Mycobacterium tuberculosis
ASDFWGGAGSAAC

SEQ ID NO: 73411 - protein, 13 aa, Mycobacterium tuberculosis
SDFWGGAGSAACQ

SEQ ID NO: 73412 - protein, 13 aa, Mycobacterium tuberculosis
DFWGGAGSAACQG

SEQ ID NO: 73413 - protein, 13 aa, Mycobacterium tuberculosis
FWGGAGSAACQGF

SEQ ID NO: 73414 - protein, 13 aa, Mycobacterium tuberculosis
WGGAGSAACQGFI

SEQ ID NO: 73415 - protein, 13 aa, Mycobacterium tuberculosis
GGAGSAACQGFIT

SEQ ID NO: 73416 - protein, 13 aa, Mycobacterium tuberculosis
GAGSAACQGFITQ

SEQ ID NO: 73417 - protein, 13 aa, Mycobacterium tuberculosis
AGSAACQGFITQL

SEQ ID NO: 73418 - protein, 13 aa, Mycobacterium tuberculosis
GSAACQGFITQLG

SEQ ID NO: 73419 - protein, 13 aa, Mycobacterium tuberculosis
SAACQGFITQLGR

SEQ ID NO: 73420 - protein, 13 aa, Mycobacterium tuberculosis
AACQGFITQLGRN

SEQ ID NO: 73421 - protein, 13 aa, Mycobacterium tuberculosis
ACQGFITQLGRNF

SEQ ID NO: 73422 - protein, 13 aa, Mycobacterium tuberculosis
CQGFITQLGRNFQ

SEQ ID NO: 73423 - protein, 13 aa, Mycobacterium tuberculosis
QGFITQLGRNFQV

SEQ ID NO: 73424 - protein, 13 aa, Mycobacterium tuberculosis
GFITQLGRNFQVI

SEQ ID NO: 73425 - protein, 13 aa, Mycobacterium tuberculosis
FITQLGRNFQVIY

SEQ ID NO: 73426 - protein, 13 aa, Mycobacterium tuberculosis
ITQLGRNFQVIYE

SEQ ID NO: 73427 - protein, 13 aa, Mycobacterium tuberculosis
TQLGRNFQVIYEQ

SEQ ID NO: 73428 - protein, 13 aa, Mycobacterium tuberculosis
QLGRNFQVIYEQA

SEQ ID NO: 73429 - protein, 13 aa, Mycobacterium tuberculosis
LGRNFQVIYEQAN

SEQ ID NO: 73430 - protein, 13 aa, Mycobacterium tuberculosis
GRNFQVIYEQANA

SEQ ID NO: 73431 - protein, 13 aa, Mycobacterium tuberculosis
RNFQVIYEQANAH

SEQ ID NO: 73432 - protein, 13 aa, Mycobacterium tuberculosis
NFQVIYEQANAHG

SEQ ID NO: 73433 - protein, 13 aa, Mycobacterium tuberculosis
FQVIYEQANAHGQ

SEQ ID NO: 73434 - protein, 13 aa, Mycobacterium tuberculosis
QVIYEQANAHGQK

SEQ ID NO: 73435 - protein, 13 aa, Mycobacterium tuberculosis
VIYEQANAHGQKV

SEQ ID NO: 73436 - protein, 13 aa, Mycobacterium tuberculosis
IYEQANAHGQKVQ

SEQ ID NO: 73437 - protein, 13 aa, Mycobacterium tuberculosis
YEQANAHGQKVQA

SEQ ID NO: 73438 - protein, 13 aa, Mycobacterium tuberculosis
EQANAHGQKVQAA

SEQ ID NO: 73439 - protein, 13 aa, Mycobacterium tuberculosis
QANAHGQKVQAAG

SEQ ID NO: 73440 - protein, 13 aa, Mycobacterium tuberculosis
ANAHGQKVQAAGN

SEQ ID NO: 73441 - protein, 13 aa, Mycobacterium tuberculosis
NAHGQKVQAAGNN

SEQ ID NO: 73442 - protein, 13 aa, Mycobacterium tuberculosis
AHGQKVQAAGNNM

SEQ ID NO: 73443 - protein, 13 aa, Mycobacterium tuberculosis
HGQKVQAAGNNMA

SEQ ID NO: 73444 - protein, 13 aa, Mycobacterium tuberculosis
GQKVQAAGNNMAQ

SEQ ID NO: 73445 - protein, 13 aa, Mycobacterium tuberculosis
QKVQAAGNNMAQT

SEQ ID NO: 73446 - protein, 13 aa, Mycobacterium tuberculosis
KVQAAGNNMAQTD

SEQ ID NO: 73447 - protein, 13 aa, Mycobacterium tuberculosis
VQAAGNNMAQTDS

SEQ ID NO: 73448 - protein, 13 aa, Mycobacterium tuberculosis
QAAGNNMAQTDSA

SEQ ID NO: 73449 - protein, 13 aa, Mycobacterium tuberculosis
AAGNNMAQTDSAV

SEQ ID NO: 73450 - protein, 13 aa, Mycobacterium tuberculosis
AGNNMAQTDSAVG

SEQ ID NO: 73451 - protein, 13 aa, Mycobacterium tuberculosis
GNNMAQTDSAVGS

SEQ ID NO: 73452 - protein, 13 aa, Mycobacterium tuberculosis
NNMAQTDSAVGSS

SEQ ID NO: 73453 - protein, 13 aa, Mycobacterium tuberculosis
NMAQTDSAVGSSW

SEQ ID NO: 73454 - protein, 13 aa, Mycobacterium tuberculosis
MAQTDSAVGSSWA

SEQ ID NO: 73455 - protein, 14 aa, Mycobacterium tuberculosis
MTINYQFGDVDAHG

SEQ ID NO: 73456 - protein, 14 aa, Mycobacterium tuberculosis
TINYQFGDVDAHGA

SEQ ID NO: 73457 - protein, 14 aa, Mycobacterium tuberculosis
INYQFGDVDAHGAM

SEQ ID NO: 73458 - protein, 14 aa, Mycobacterium tuberculosis
NYQFGDVDAHGAMI

SEQ ID NO: 73459 - protein, 14 aa, Mycobacterium tuberculosis
YQFGDVDAHGAMIR

SEQ ID NO: 73460 - protein, 14 aa, Mycobacterium tuberculosis
QFGDVDAHGAMIRA

SEQ ID NO: 73461 - protein, 14 aa, Mycobacterium tuberculosis
FGDVDAHGAMIRAQ

SEQ ID NO: 73462 - protein, 14 aa, Mycobacterium tuberculosis
GDVDAHGAMIRAQA

SEQ ID NO: 73463 - protein, 14 aa, Mycobacterium tuberculosis
DVDAHGAMIRAQAG

SEQ ID NO: 73464 - protein, 14 aa, Mycobacterium tuberculosis
VDAHGAMIRAQAGS

SEQ ID NO: 73465 - protein, 14 aa, Mycobacterium tuberculosis
DAHGAMIRAQAGSL

SEQ ID NO: 73466 - protein, 14 aa, Mycobacterium tuberculosis
AHGAMIRAQAGSLE

SEQ ID NO: 73467 - protein, 14 aa, Mycobacterium tuberculosis
HGAMIRAQAGSLEA

SEQ ID NO: 73468 - protein, 14 aa, Mycobacterium tuberculosis
GAMIRAQAGSLEAE

SEQ ID NO: 73469 - protein, 14 aa, Mycobacterium tuberculosis
AMIRAQAGSLEAEH

SEQ ID NO: 73470 - protein, 14 aa, Mycobacterium tuberculosis
MIRAQAGSLEAEHQ

SEQ ID NO: 73471 - protein, 14 aa, Mycobacterium tuberculosis
IRAQAGSLEAEHQA

SEQ ID NO: 73472 - protein, 14 aa, Mycobacterium tuberculosis
RAQAGSLEAEHQAI

SEQ ID NO: 73473 - protein, 14 aa, Mycobacterium tuberculosis
AQAGSLEAEHQAII

SEQ ID NO: 73474 - protein, 14 aa, Mycobacterium tuberculosis
QAGSLEAEHQAIIS

SEQ ID NO: 73475 - protein, 14 aa, Mycobacterium tuberculosis
AGSLEAEHQAIISD

SEQ ID NO: 73476 - protein, 14 aa, Mycobacterium tuberculosis
GSLEAEHQAIISDV

SEQ ID NO: 73477 - protein, 14 aa, Mycobacterium tuberculosis
SLEAEHQAIISDVL

SEQ ID NO: 73478 - protein, 14 aa, Mycobacterium tuberculosis
LEAEHQAIISDVLT

SEQ ID NO: 73479 - protein, 14 aa, Mycobacterium tuberculosis
EAEHQAIISDVLTA

SEQ ID NO: 73480 - protein, 14 aa, Mycobacterium tuberculosis
AEHQAIISDVLTAS

SEQ ID NO: 73481 - protein, 14 aa, Mycobacterium tuberculosis
EHQAIISDVLTASD

SEQ ID NO: 73482 - protein, 14 aa, Mycobacterium tuberculosis
HQAIISDVLTASDF

SEQ ID NO: 73483 - protein, 14 aa, Mycobacterium tuberculosis
QAIISDVLTASDFW

SEQ ID NO: 73484 - protein, 14 aa, Mycobacterium tuberculosis
AIISDVLTASDFWG

SEQ ID NO: 73485 - protein, 14 aa, Mycobacterium tuberculosis
IISDVLTASDFWGG

SEQ ID NO: 73486 - protein, 14 aa, Mycobacterium tuberculosis
ISDVLTASDFWGGA

SEQ ID NO: 73487 - protein, 14 aa, Mycobacterium tuberculosis
SDVLTASDFWGGAG

SEQ ID NO: 73488 - protein, 14 aa, Mycobacterium tuberculosis
DVLTASDFWGGAGS

SEQ ID NO: 73489 - protein, 14 aa, Mycobacterium tuberculosis
VLTASDFWGGAGSA

SEQ ID NO: 73490 - protein, 14 aa, Mycobacterium tuberculosis
LTASDFWGGAGSAA

SEQ ID NO: 73491 - protein, 14 aa, Mycobacterium tuberculosis
TASDFWGGAGSAAC

SEQ ID NO: 73492 - protein, 14 aa, Mycobacterium tuberculosis
ASDFWGGAGSAACQ

SEQ ID NO: 73493 - protein, 14 aa, Mycobacterium tuberculosis
SDFWGGAGSAACQG

SEQ ID NO: 73494 - protein, 14 aa, Mycobacterium tuberculosis
DFWGGAGSAACQGF

SEQ ID NO: 73495 - protein, 14 aa, Mycobacterium tuberculosis
FWGGAGSAACQGFI

SEQ ID NO: 73496 - protein, 14 aa, Mycobacterium tuberculosis
WGGAGSAACQGFIT

SEQ ID NO: 73497 - protein, 14 aa, Mycobacterium tuberculosis
GGAGSAACQGFITQ

SEQ ID NO: 73498 - protein, 14 aa, Mycobacterium tuberculosis
GAGSAACQGFITQL

SEQ ID NO: 73499 - protein, 14 aa, Mycobacterium tuberculosis
AGSAACQGFITQLG

SEQ ID NO: 73500 - protein, 14 aa, Mycobacterium tuberculosis
GSAACQGFITQLGR

SEQ ID NO: 73501 - protein, 14 aa, Mycobacterium tuberculosis
SAACQGFITQLGRN

SEQ ID NO: 73502 - protein, 14 aa, Mycobacterium tuberculosis
AACQGFITQLGRNF

SEQ ID NO: 73503 - protein, 14 aa, Mycobacterium tuberculosis
ACQGFITQLGRNFQ

SEQ ID NO: 73504 - protein, 14 aa, Mycobacterium tuberculosis
CQGFITQLGRNFQV

SEQ ID NO: 73505 - protein, 14 aa, Mycobacterium tuberculosis
QGFITQLGRNFQVI

SEQ ID NO: 73506 - protein, 14 aa, Mycobacterium tuberculosis
GFITQLGRNFQVIY

SEQ ID NO: 73507 - protein, 14 aa, Mycobacterium tuberculosis
FITQLGRNFQVIYE

SEQ ID NO: 73508 - protein, 14 aa, Mycobacterium tuberculosis
ITQLGRNFQVIYEQ

SEQ ID NO: 73509 - protein, 14 aa, Mycobacterium tuberculosis
TQLGRNFQVIYEQA

SEQ ID NO: 73510 - protein, 14 aa, Mycobacterium tuberculosis
QLGRNFQVIYEQAN

SEQ ID NO: 73511 - protein, 14 aa, Mycobacterium tuberculosis
LGRNFQVIYEQANA

SEQ ID NO: 73512 - protein, 14 aa, Mycobacterium tuberculosis
GRNFQVIYEQANAH

SEQ ID NO: 73513 - protein, 14 aa, Mycobacterium tuberculosis
RNFQVIYEQANAHG

SEQ ID NO: 73514 - protein, 14 aa, Mycobacterium tuberculosis
NFQVIYEQANAHGQ

SEQ ID NO: 73515 - protein, 14 aa, Mycobacterium tuberculosis
FQVIYEQANAHGQK

SEQ ID NO: 73516 - protein, 14 aa, Mycobacterium tuberculosis
QVIYEQANAHGQKV

SEQ ID NO: 73517 - protein, 14 aa, Mycobacterium tuberculosis
VIYEQANAHGQKVQ

SEQ ID NO: 73518 - protein, 14 aa, Mycobacterium tuberculosis
IYEQANAHGQKVQA

SEQ ID NO: 73519 - protein, 14 aa, Mycobacterium tuberculosis
YEQANAHGQKVQAA

SEQ ID NO: 73520 - protein, 14 aa, Mycobacterium tuberculosis
EQANAHGQKVQAAG

SEQ ID NO: 73521 - protein, 14 aa, Mycobacterium tuberculosis
QANAHGQKVQAAGN

SEQ ID NO: 73522 - protein, 14 aa, Mycobacterium tuberculosis
ANAHGQKVQAAGNN

SEQ ID NO: 73523 - protein, 14 aa, Mycobacterium tuberculosis
NAHGQKVQAAGNNM

SEQ ID NO: 73524 - protein, 14 aa, Mycobacterium tuberculosis
AHGQKVQAAGNNMA

SEQ ID NO: 73525 - protein, 14 aa, Mycobacterium tuberculosis
HGQKVQAAGNNMAQ

SEQ ID NO: 73526 - protein, 14 aa, Mycobacterium tuberculosis
GQKVQAAGNNMAQT

SEQ ID NO: 73527 - protein, 14 aa, Mycobacterium tuberculosis
QKVQAAGNNMAQTD

SEQ ID NO: 73528 - protein, 14 aa, Mycobacterium tuberculosis
KVQAAGNNMAQTDS

SEQ ID NO: 73529 - protein, 14 aa, Mycobacterium tuberculosis
VQAAGNNMAQTDSA

SEQ ID NO: 73530 - protein, 14 aa, Mycobacterium tuberculosis
QAAGNNMAQTDSAV

SEQ ID NO: 73531 - protein, 14 aa, Mycobacterium tuberculosis
AAGNNMAQTDSAVG

SEQ ID NO: 73532 - protein, 14 aa, Mycobacterium tuberculosis
AGNNMAQTDSAVGS

SEQ ID NO: 73533 - protein, 14 aa, Mycobacterium tuberculosis
GNNMAQTDSAVGSS

SEQ ID NO: 73534 - protein, 14 aa, Mycobacterium tuberculosis
NNMAQTDSAVGSSW

SEQ ID NO: 73535 - protein, 14 aa, Mycobacterium tuberculosis
NMAQTDSAVGSSWA

SEQ ID NO: 73536 - protein, 15 aa, Mycobacterium tuberculosis
MTINYQFGDVDAHGA

SEQ ID NO: 73537 - protein, 15 aa, Mycobacterium tuberculosis
TINYQFGDVDAHGAM

SEQ ID NO: 73538 - protein, 15 aa, Mycobacterium tuberculosis
INYQFGDVDAHGAMI

SEQ ID NO: 73539 - protein, 15 aa, Mycobacterium tuberculosis
NYQFGDVDAHGAMIR

SEQ ID NO: 73540 - protein, 15 aa, Mycobacterium tuberculosis
YQFGDVDAHGAMIRA

SEQ ID NO: 73541 - protein, 15 aa, Mycobacterium tuberculosis
QFGDVDAHGAMIRAQ

SEQ ID NO: 73542 - protein, 15 aa, Mycobacterium tuberculosis
FGDVDAHGAMIRAQA

SEQ ID NO: 73543 - protein, 15 aa, Mycobacterium tuberculosis
GDVDAHGAMIRAQAG

SEQ ID NO: 73544 - protein, 15 aa, Mycobacterium tuberculosis
DVDAHGAMIRAQAGS

SEQ ID NO: 73545 - protein, 15 aa, Mycobacterium tuberculosis
VDAHGAMIRAQAGSL

SEQ ID NO: 73546 - protein, 15 aa, Mycobacterium tuberculosis
DAHGAMIRAQAGSLE

SEQ ID NO: 73547 - protein, 15 aa, Mycobacterium tuberculosis
AHGAMIRAQAGSLEA

SEQ ID NO: 73548 - protein, 15 aa, Mycobacterium tuberculosis
HGAMIRAQAGSLEAE

SEQ ID NO: 73549 - protein, 15 aa, Mycobacterium tuberculosis
GAMIRAQAGSLEAEH

SEQ ID NO: 73550 - protein, 15 aa, Mycobacterium tuberculosis
AMIRAQAGSLEAEHQ

SEQ ID NO: 73551 - protein, 15 aa, Mycobacterium tuberculosis
MIRAQAGSLEAEHQA

SEQ ID NO: 73552 - protein, 15 aa, Mycobacterium tuberculosis
IRAQAGSLEAEHQAI

SEQ ID NO: 73553 - protein, 15 aa, Mycobacterium tuberculosis
RAQAGSLEAEHQAII

SEQ ID NO: 73554 - protein, 15 aa, Mycobacterium tuberculosis
AQAGSLEAEHQAIIS

SEQ ID NO: 73555 - protein, 15 aa, Mycobacterium tuberculosis
QAGSLEAEHQAIISD

SEQ ID NO: 73556 - protein, 15 aa, Mycobacterium tuberculosis
AGSLEAEHQAIISDV

SEQ ID NO: 73557 - protein, 15 aa, Mycobacterium tuberculosis
GSLEAEHQAIISDVL

SEQ ID NO: 73558 - protein, 15 aa, Mycobacterium tuberculosis
SLEAEHQAIISDVLT

SEQ ID NO: 73559 - protein, 15 aa, Mycobacterium tuberculosis
LEAEHQAIISDVLTA

SEQ ID NO: 73560 - protein, 15 aa, Mycobacterium tuberculosis
EAEHQAIISDVLTAS

SEQ ID NO: 73561 - protein, 15 aa, Mycobacterium tuberculosis
AEHQAIISDVLTASD

SEQ ID NO: 73562 - protein, 15 aa, Mycobacterium tuberculosis
EHQAIISDVLTASDF

SEQ ID NO: 73563 - protein, 15 aa, Mycobacterium tuberculosis
HQAIISDVLTASDFW

SEQ ID NO: 73564 - protein, 15 aa, Mycobacterium tuberculosis
QAIISDVLTASDFWG

SEQ ID NO: 73565 - protein, 15 aa, Mycobacterium tuberculosis
AIISDVLTASDFWGG

SEQ ID NO: 73566 - protein, 15 aa, Mycobacterium tuberculosis
IISDVLTASDFWGGA

SEQ ID NO: 73567 - protein, 15 aa, Mycobacterium tuberculosis
ISDVLTASDFWGGAG

SEQ ID NO: 73568 - protein, 15 aa, Mycobacterium tuberculosis
SDVLTASDFWGGAGS

SEQ ID NO: 73569 - protein, 15 aa, Mycobacterium tuberculosis
DVLTASDFWGGAGSA

SEQ ID NO: 73570 - protein, 15 aa, Mycobacterium tuberculosis
VLTASDFWGGAGSAA

SEQ ID NO: 73571 - protein, 15 aa, Mycobacterium tuberculosis
LTASDFWGGAGSAAC

SEQ ID NO: 73572 - protein, 15 aa, Mycobacterium tuberculosis
TASDFWGGAGSAACQ

SEQ ID NO: 73573 - protein, 15 aa, Mycobacterium tuberculosis
ASDFWGGAGSAACQG

SEQ ID NO: 73574 - protein, 15 aa, Mycobacterium tuberculosis
SDFWGGAGSAACQGF

SEQ ID NO: 73575 - protein, 15 aa, Mycobacterium tuberculosis
DFWGGAGSAACQGFI

SEQ ID NO: 73576 - protein, 15 aa, Mycobacterium tuberculosis
FWGGAGSAACQGFIT

SEQ ID NO: 73577 - protein, 15 aa, Mycobacterium tuberculosis
WGGAGSAACQGFITQ

SEQ ID NO: 73578 - protein, 15 aa, Mycobacterium tuberculosis
GGAGSAACQGFITQL

SEQ ID NO: 73579 - protein, 15 aa, Mycobacterium tuberculosis
GAGSAACQGFITQLG

SEQ ID NO: 73580 - protein, 15 aa, Mycobacterium tuberculosis
AGSAACQGFITQLGR

SEQ ID NO: 73581 - protein, 15 aa, Mycobacterium tuberculosis
GSAACQGFITQLGRN

SEQ ID NO: 73582 - protein, 15 aa, Mycobacterium tuberculosis
SAACQGFITQLGRNF

SEQ ID NO: 73583 - protein, 15 aa, Mycobacterium tuberculosis
AACQGFITQLGRNFQ

SEQ ID NO: 73584 - protein, 15 aa, Mycobacterium tuberculosis
ACQGFITQLGRNFQV

SEQ ID NO: 73585 - protein, 15 aa, Mycobacterium tuberculosis
CQGFITQLGRNFQVI

SEQ ID NO: 73586 - protein, 15 aa, Mycobacterium tuberculosis
QGFITQLGRNFQVIY

SEQ ID NO: 73587 - protein, 15 aa, Mycobacterium tuberculosis
GFITQLGRNFQVIYE

SEQ ID NO: 73588 - protein, 15 aa, Mycobacterium tuberculosis
FITQLGRNFQVIYEQ

SEQ ID NO: 73589 - protein, 15 aa, Mycobacterium tuberculosis
ITQLGRNFQVIYEQA

SEQ ID NO: 73590 - protein, 15 aa, Mycobacterium tuberculosis
TQLGRNFQVIYEQAN

SEQ ID NO: 73591 - protein, 15 aa, Mycobacterium tuberculosis
QLGRNFQVIYEQANA

SEQ ID NO: 73592 - protein, 15 aa, Mycobacterium tuberculosis
LGRNFQVIYEQANAH

SEQ ID NO: 73593 - protein, 15 aa, Mycobacterium tuberculosis
GRNFQVIYEQANAHG

SEQ ID NO: 73594 - protein, 15 aa, Mycobacterium tuberculosis
RNFQVIYEQANAHGQ

SEQ ID NO: 73595 - protein, 15 aa, Mycobacterium tuberculosis
NFQVIYEQANAHGQK

SEQ ID NO: 73596 - protein, 15 aa, Mycobacterium tuberculosis
FQVIYEQANAHGQKV

SEQ ID NO: 73597 - protein, 15 aa, Mycobacterium tuberculosis
QVIYEQANAHGQKVQ

SEQ ID NO: 73598 - protein, 15 aa, Mycobacterium tuberculosis
VIYEQANAHGQKVQA

SEQ ID NO: 73599 - protein, 15 aa, Mycobacterium tuberculosis
IYEQANAHGQKVQAA

SEQ ID NO: 73600 - protein, 15 aa, Mycobacterium tuberculosis
YEQANAHGQKVQAAG

SEQ ID NO: 73601 - protein, 15 aa, Mycobacterium tuberculosis
EQANAHGQKVQAAGN

SEQ ID NO: 73602 - protein, 15 aa, Mycobacterium tuberculosis
QANAHGQKVQAAGNN

SEQ ID NO: 73603 - protein, 15 aa, Mycobacterium tuberculosis
ANAHGQKVQAAGNNM

SEQ ID NO: 73604 - protein, 15 aa, Mycobacterium tuberculosis
NAHGQKVQAAGNNMA

SEQ ID NO: 73605 - protein, 15 aa, Mycobacterium tuberculosis
AHGQKVQAAGNNMAQ

SEQ ID NO: 73606 - protein, 15 aa, Mycobacterium tuberculosis
HGQKVQAAGNNMAQT

SEQ ID NO: 73607 - protein, 15 aa, Mycobacterium tuberculosis
GQKVQAAGNNMAQTD

SEQ ID NO: 73608 - protein, 15 aa, Mycobacterium tuberculosis
QKVQAAGNNMAQTDS

SEQ ID NO: 73609 - protein, 15 aa, Mycobacterium tuberculosis
KVQAAGNNMAQTDSA

SEQ ID NO: 73610 - protein, 15 aa, Mycobacterium tuberculosis
VQAAGNNMAQTDSAV

SEQ ID NO: 73611 - protein, 15 aa, Mycobacterium tuberculosis
QAAGNNMAQTDSAVG

SEQ ID NO: 73612 - protein, 15 aa, Mycobacterium tuberculosis
AAGNNMAQTDSAVGS

SEQ ID NO: 73613 - protein, 15 aa, Mycobacterium tuberculosis
AGNNMAQTDSAVGSS

SEQ ID NO: 73614 - protein, 15 aa, Mycobacterium tuberculosis
GNNMAQTDSAVGSSW

SEQ ID NO: 73615 - protein, 15 aa, Mycobacterium tuberculosis
NNMAQTDSAVGSSWA

SEQ ID NO: 73616 - protein, 16 aa, Mycobacterium tuberculosis
MTINYQFGDVDAHGAM

SEQ ID NO: 73617 - protein, 16 aa, Mycobacterium tuberculosis
TINYQFGDVDAHGAMI

SEQ ID NO: 73618 - protein, 16 aa, Mycobacterium tuberculosis
INYQFGDVDAHGAMIR

SEQ ID NO: 73619 - protein, 16 aa, Mycobacterium tuberculosis
NYQFGDVDAHGAMIRA

SEQ ID NO: 73620 - protein, 16 aa, Mycobacterium tuberculosis
YQFGDVDAHGAMIRAQ

SEQ ID NO: 73621 - protein, 16 aa, Mycobacterium tuberculosis
QFGDVDAHGAMIRAQA

SEQ ID NO: 73622 - protein, 16 aa, Mycobacterium tuberculosis
FGDVDAHGAMIRAQAG

SEQ ID NO: 73623 - protein, 16 aa, Mycobacterium tuberculosis
GDVDAHGAMIRAQAGS

SEQ ID NO: 73624 - protein, 16 aa, Mycobacterium tuberculosis
DVDAHGAMIRAQAGSL

SEQ ID NO: 73625 - protein, 16 aa, Mycobacterium tuberculosis
VDAHGAMIRAQAGSLE

SEQ ID NO: 73626 - protein, 16 aa, Mycobacterium tuberculosis
DAHGAMIRAQAGSLEA

SEQ ID NO: 73627 - protein, 16 aa, Mycobacterium tuberculosis
AHGAMIRAQAGSLEAE

SEQ ID NO: 73628 - protein, 16 aa, Mycobacterium tuberculosis
HGAMIRAQAGSLEAEH

SEQ ID NO: 73629 - protein, 16 aa, Mycobacterium tuberculosis
GAMIRAQAGSLEAEHQ

SEQ ID NO: 73630 - protein, 16 aa, Mycobacterium tuberculosis
AMIRAQAGSLEAEHQA

SEQ ID NO: 73631 - protein, 16 aa, Mycobacterium tuberculosis
MIRAQAGSLEAEHQAI

SEQ ID NO: 73632 - protein, 16 aa, Mycobacterium tuberculosis
IRAQAGSLEAEHQAII

SEQ ID NO: 73633 - protein, 16 aa, Mycobacterium tuberculosis
RAQAGSLEAEHQAIIS

SEQ ID NO: 73634 - protein, 16 aa, Mycobacterium tuberculosis
AQAGSLEAEHQAIISD

SEQ ID NO: 73635 - protein, 16 aa, Mycobacterium tuberculosis
QAGSLEAEHQAIISDV

SEQ ID NO: 73636 - protein, 16 aa, Mycobacterium tuberculosis
AGSLEAEHQAIISDVL

SEQ ID NO: 73637 - protein, 16 aa, Mycobacterium tuberculosis
GSLEAEHQAIISDVLT

SEQ ID NO: 73638 - protein, 16 aa, Mycobacterium tuberculosis
SLEAEHQAIISDVLTA

SEQ ID NO: 73639 - protein, 16 aa, Mycobacterium tuberculosis
LEAEHQAIISDVLTAS

SEQ ID NO: 73640 - protein, 16 aa, Mycobacterium tuberculosis
EAEHQAIISDVLTASD

SEQ ID NO: 73641 - protein, 16 aa, Mycobacterium tuberculosis
AEHQAIISDVLTASDF

SEQ ID NO: 73642 - protein, 16 aa, Mycobacterium tuberculosis
EHQAIISDVLTASDFW

SEQ ID NO: 73643 - protein, 16 aa, Mycobacterium tuberculosis
HQAIISDVLTASDFWG

SEQ ID NO: 73644 - protein, 16 aa, Mycobacterium tuberculosis
QAIISDVLTASDFWGG

SEQ ID NO: 73645 - protein, 16 aa, Mycobacterium tuberculosis
AIISDVLTASDFWGGA

SEQ ID NO: 73646 - protein, 16 aa, Mycobacterium tuberculosis
IISDVLTASDFWGGAG

SEQ ID NO: 73647 - protein, 16 aa, Mycobacterium tuberculosis
ISDVLTASDFWGGAGS

SEQ ID NO: 73648 - protein, 16 aa, Mycobacterium tuberculosis
SDVLTASDFWGGAGSA

SEQ ID NO: 73649 - protein, 16 aa, Mycobacterium tuberculosis
DVLTASDFWGGAGSAA

SEQ ID NO: 73650 - protein, 16 aa, Mycobacterium tuberculosis
VLTASDFWGGAGSAAC

SEQ ID NO: 73651 - protein, 16 aa, Mycobacterium tuberculosis
LTASDFWGGAGSAACQ

SEQ ID NO: 73652 - protein, 16 aa, Mycobacterium tuberculosis
TASDFWGGAGSAACQG

SEQ ID NO: 73653 - protein, 16 aa, Mycobacterium tuberculosis
ASDFWGGAGSAACQGF

SEQ ID NO: 73654 - protein, 16 aa, Mycobacterium tuberculosis
SDFWGGAGSAACQGFI

SEQ ID NO: 73655 - protein, 16 aa, Mycobacterium tuberculosis
DFWGGAGSAACQGFIT

SEQ ID NO: 73656 - protein, 16 aa, Mycobacterium tuberculosis
FWGGAGSAACQGFITQ

SEQ ID NO: 73657 - protein, 16 aa, Mycobacterium tuberculosis
WGGAGSAACQGFITQL

SEQ ID NO: 73658 - protein, 16 aa, Mycobacterium tuberculosis
GGAGSAACQGFITQLG

SEQ ID NO: 73659 - protein, 16 aa, Mycobacterium tuberculosis
GAGSAACQGFITQLGR

SEQ ID NO: 73660 - protein, 16 aa, Mycobacterium tuberculosis
AGSAACQGFITQLGRN

SEQ ID NO: 73661 - protein, 16 aa, Mycobacterium tuberculosis
GSAACQGFITQLGRNF

SEQ ID NO: 73662 - protein, 16 aa, Mycobacterium tuberculosis
SAACQGFITQLGRNFQ

SEQ ID NO: 73663 - protein, 16 aa, Mycobacterium tuberculosis
AACQGFITQLGRNFQV

SEQ ID NO: 73664 - protein, 16 aa, Mycobacterium tuberculosis
ACQGFITQLGRNFQVI

SEQ ID NO: 73665 - protein, 16 aa, Mycobacterium tuberculosis
CQGFITQLGRNFQVIY

SEQ ID NO: 73666 - protein, 16 aa, Mycobacterium tuberculosis
QGFITQLGRNFQVIYE

SEQ ID NO: 73667 - protein, 16 aa, Mycobacterium tuberculosis
GFITQLGRNFQVIYEQ

SEQ ID NO: 73668 - protein, 16 aa, Mycobacterium tuberculosis
FITQLGRNFQVIYEQA

SEQ ID NO: 73669 - protein, 16 aa, Mycobacterium tuberculosis
ITQLGRNFQVIYEQAN

SEQ ID NO: 73670 - protein, 16 aa, Mycobacterium tuberculosis
TQLGRNFQVIYEQANA

SEQ ID NO: 73671 - protein, 16 aa, Mycobacterium tuberculosis
QLGRNFQVIYEQANAH

SEQ ID NO: 73672 - protein, 16 aa, Mycobacterium tuberculosis
LGRNFQVIYEQANAHG

SEQ ID NO: 73673 - protein, 16 aa, Mycobacterium tuberculosis
GRNFQVIYEQANAHGQ

SEQ ID NO: 73674 - protein, 16 aa, Mycobacterium tuberculosis
RNFQVIYEQANAHGQK

SEQ ID NO: 73675 - protein, 16 aa, Mycobacterium tuberculosis
NFQVIYEQANAHGQKV

SEQ ID NO: 73676 - protein, 16 aa, Mycobacterium tuberculosis
FQVIYEQANAHGQKVQ

SEQ ID NO: 73677 - protein, 16 aa, Mycobacterium tuberculosis
QVIYEQANAHGQKVQA

SEQ ID NO: 73678 - protein, 16 aa, Mycobacterium tuberculosis
VIYEQANAHGQKVQAA

SEQ ID NO: 73679 - protein, 16 aa, Mycobacterium tuberculosis
IYEQANAHGQKVQAAG

SEQ ID NO: 73680 - protein, 16 aa, Mycobacterium tuberculosis
YEQANAHGQKVQAAGN

SEQ ID NO: 73681 - protein, 16 aa, Mycobacterium tuberculosis
EQANAHGQKVQAAGNN

SEQ ID NO: 73682 - protein, 16 aa, Mycobacterium tuberculosis
QANAHGQKVQAAGNNM

SEQ ID NO: 73683 - protein, 16 aa, Mycobacterium tuberculosis
ANAHGQKVQAAGNNMA

SEQ ID NO: 73684 - protein, 16 aa, Mycobacterium tuberculosis
NAHGQKVQAAGNNMAQ

SEQ ID NO: 73685 - protein, 16 aa, Mycobacterium tuberculosis
AHGQKVQAAGNNMAQT

SEQ ID NO: 73686 - protein, 16 aa, Mycobacterium tuberculosis
HGQKVQAAGNNMAQTD

SEQ ID NO: 73687 - protein, 16 aa, Mycobacterium tuberculosis
GQKVQAAGNNMAQTDS

SEQ ID NO: 73688 - protein, 16 aa, Mycobacterium tuberculosis
QKVQAAGNNMAQTDSA

SEQ ID NO: 73689 - protein, 16 aa, Mycobacterium tuberculosis
KVQAAGNNMAQTDSAV

SEQ ID NO: 73690 - protein, 16 aa, Mycobacterium tuberculosis
VQAAGNNMAQTDSAVG

SEQ ID NO: 73691 - protein, 16 aa, Mycobacterium tuberculosis
QAAGNNMAQTDSAVGS

SEQ ID NO: 73692 - protein, 16 aa, Mycobacterium tuberculosis
AAGNNMAQTDSAVGSS

SEQ ID NO: 73693 - protein, 16 aa, Mycobacterium tuberculosis
AGNNMAQTDSAVGSSW

SEQ ID NO: 73694 - protein, 16 aa, Mycobacterium tuberculosis
GNNMAQTDSAVGSSWA

SEQ ID NO: 73695 - protein, 13 aa, Mycobacterium tuberculosis
MTTAIRRAAGSSY

SEQ ID NO: 73696 - protein, 13 aa, Mycobacterium tuberculosis
TTAIRRAAGSSYF

SEQ ID NO: 73697 - protein, 13 aa, Mycobacterium tuberculosis
TAIRRAAGSSYFR

SEQ ID NO: 73698 - protein, 13 aa, Mycobacterium tuberculosis
AIRRAAGSSYFRN

SEQ ID NO: 73699 - protein, 13 aa, Mycobacterium tuberculosis
IRRAAGSSYFRNP

SEQ ID NO: 73700 - protein, 13 aa, Mycobacterium tuberculosis
RRAAGSSYFRNPW

SEQ ID NO: 73701 - protein, 13 aa, Mycobacterium tuberculosis
RAAGSSYFRNPWP

SEQ ID NO: 73702 - protein, 13 aa, Mycobacterium tuberculosis
AAGSSYFRNPWPA

SEQ ID NO: 73703 - protein, 13 aa, Mycobacterium tuberculosis
AGSSYFRNPWPAL

SEQ ID NO: 73704 - protein, 13 aa, Mycobacterium tuberculosis
GSSYFRNPWPALW

SEQ ID NO: 73705 - protein, 13 aa, Mycobacterium tuberculosis
SSYFRNPWPALWA

SEQ ID NO: 73706 - protein, 13 aa, Mycobacterium tuberculosis
SYFRNPWPALWAM

SEQ ID NO: 73707 - protein, 13 aa, Mycobacterium tuberculosis
YFRNPWPALWAMM

SEQ ID NO: 73708 - protein, 13 aa, Mycobacterium tuberculosis
FRNPWPALWAMMV

SEQ ID NO: 73709 - protein, 13 aa, Mycobacterium tuberculosis
RNPWPALWAMMVG

SEQ ID NO: 73710 - protein, 13 aa, Mycobacterium tuberculosis
NPWPALWAMMVGF

SEQ ID NO: 73711 - protein, 13 aa, Mycobacterium tuberculosis
PWPALWAMMVGFF

SEQ ID NO: 73712 - protein, 13 aa, Mycobacterium tuberculosis
WPALWAMMVGFFM

SEQ ID NO: 73713 - protein, 13 aa, Mycobacterium tuberculosis
PALWAMMVGFFMI

SEQ ID NO: 73714 - protein, 13 aa, Mycobacterium tuberculosis
ALWAMMVGFFMIM

SEQ ID NO: 73715 - protein, 13 aa, Mycobacterium tuberculosis
LWAMMVGFFMIML

SEQ ID NO: 73716 - protein, 13 aa, Mycobacterium tuberculosis
WAMMVGFFMIMLD

SEQ ID NO: 73717 - protein, 13 aa, Mycobacterium tuberculosis
AMMVGFFMIMLDS

SEQ ID NO: 73718 - protein, 13 aa, Mycobacterium tuberculosis
MMVGFFMIMLDST

SEQ ID NO: 73719 - protein, 13 aa, Mycobacterium tuberculosis
MVGFFMIMLDSTV

SEQ ID NO: 73720 - protein, 13 aa, Mycobacterium tuberculosis
VGFFMIMLDSTVV

SEQ ID NO: 73721 - protein, 13 aa, Mycobacterium tuberculosis
GFFMIMLDSTVVA

SEQ ID NO: 73722 - protein, 13 aa, Mycobacterium tuberculosis
FFMIMLDSTVVAI

SEQ ID NO: 73723 - protein, 13 aa, Mycobacterium tuberculosis
FMIMLDSTVVAIA

SEQ ID NO: 73724 - protein, 13 aa, Mycobacterium tuberculosis
MIMLDSTVVAIAN

SEQ ID NO: 73725 - protein, 13 aa, Mycobacterium tuberculosis
IMLDSTVVAIANP

SEQ ID NO: 73726 - protein, 13 aa, Mycobacterium tuberculosis
MLDSTVVAIANPT

SEQ ID NO: 73727 - protein, 13 aa, Mycobacterium tuberculosis
LDSTVVAIANPTI

SEQ ID NO: 73728 - protein, 13 aa, Mycobacterium tuberculosis
DSTVVAIANPTIM

SEQ ID NO: 73729 - protein, 13 aa, Mycobacterium tuberculosis
STVVAIANPTIMA

SEQ ID NO: 73730 - protein, 13 aa, Mycobacterium tuberculosis
TVVAIANPTIMAQ

SEQ ID NO: 73731 - protein, 13 aa, Mycobacterium tuberculosis
VVAIANPTIMAQL

SEQ ID NO: 73732 - protein, 13 aa, Mycobacterium tuberculosis
VAIANPTIMAQLR

SEQ ID NO: 73733 - protein, 13 aa, Mycobacterium tuberculosis
AIANPTIMAQLRI

SEQ ID NO: 73734 - protein, 13 aa, Mycobacterium tuberculosis
IANPTIMAQLRIG

SEQ ID NO: 73735 - protein, 13 aa, Mycobacterium tuberculosis
ANPTIMAQLRIGY

SEQ ID NO: 73736 - protein, 13 aa, Mycobacterium tuberculosis
NPTIMAQLRIGYA

SEQ ID NO: 73737 - protein, 13 aa, Mycobacterium tuberculosis
PTIMAQLRIGYAT

SEQ ID NO: 73738 - protein, 13 aa, Mycobacterium tuberculosis
TIMAQLRIGYATV

SEQ ID NO: 73739 - protein, 13 aa, Mycobacterium tuberculosis
IMAQLRIGYATVV

SEQ ID NO: 73740 - protein, 13 aa, Mycobacterium tuberculosis
MAQLRIGYATVVW

SEQ ID NO: 73741 - protein, 13 aa, Mycobacterium tuberculosis
AQLRIGYATVVWV

SEQ ID NO: 73742 - protein, 13 aa, Mycobacterium tuberculosis
QLRIGYATVVWVT

SEQ ID NO: 73743 - protein, 13 aa, Mycobacterium tuberculosis
LRIGYATVVWVTS

SEQ ID NO: 73744 - protein, 13 aa, Mycobacterium tuberculosis
RIGYATVVWVTSA

SEQ ID NO: 73745 - protein, 13 aa, Mycobacterium tuberculosis
IGYATVVWVTSAY

SEQ ID NO: 73746 - protein, 13 aa, Mycobacterium tuberculosis
GYATVVWVTSAYL

SEQ ID NO: 73747 - protein, 13 aa, Mycobacterium tuberculosis
YATVVWVTSAYLL

SEQ ID NO: 73748 - protein, 13 aa, Mycobacterium tuberculosis
ATVVWVTSAYLLA

SEQ ID NO: 73749 - protein, 13 aa, Mycobacterium tuberculosis
TVVWVTSAYLLAY

SEQ ID NO: 73750 - protein, 13 aa, Mycobacterium tuberculosis
VVWVTSAYLLAYA

SEQ ID NO: 73751 - protein, 13 aa, Mycobacterium tuberculosis
VWVTSAYLLAYAV

SEQ ID NO: 73752 - protein, 13 aa, Mycobacterium tuberculosis
WVTSAYLLAYAVP

SEQ ID NO: 73753 - protein, 13 aa, Mycobacterium tuberculosis
VTSAYLLAYAVPM

SEQ ID NO: 73754 - protein, 13 aa, Mycobacterium tuberculosis
TSAYLLAYAVPML

SEQ ID NO: 73755 - protein, 13 aa, Mycobacterium tuberculosis
SAYLLAYAVPMLV

SEQ ID NO: 73756 - protein, 13 aa, Mycobacterium tuberculosis
AYLLAYAVPMLVA

SEQ ID NO: 73757 - protein, 13 aa, Mycobacterium tuberculosis
YLLAYAVPMLVAG

SEQ ID NO: 73758 - protein, 13 aa, Mycobacterium tuberculosis
LLAYAVPMLVAGR

SEQ ID NO: 73759 - protein, 13 aa, Mycobacterium tuberculosis
LAYAVPMLVAGRL

SEQ ID NO: 73760 - protein, 13 aa, Mycobacterium tuberculosis
AYAVPMLVAGRLG

SEQ ID NO: 73761 - protein, 13 aa, Mycobacterium tuberculosis
YAVPMLVAGRLGD

SEQ ID NO: 73762 - protein, 13 aa, Mycobacterium tuberculosis
AVPMLVAGRLGDR

SEQ ID NO: 73763 - protein, 13 aa, Mycobacterium tuberculosis
VPMLVAGRLGDRF

SEQ ID NO: 73764 - protein, 13 aa, Mycobacterium tuberculosis
PMLVAGRLGDRFG

SEQ ID NO: 73765 - protein, 13 aa, Mycobacterium tuberculosis
MLVAGRLGDRFGP

SEQ ID NO: 73766 - protein, 13 aa, Mycobacterium tuberculosis
LVAGRLGDRFGPK

SEQ ID NO: 73767 - protein, 13 aa, Mycobacterium tuberculosis
VAGRLGDRFGPKN

SEQ ID NO: 73768 - protein, 13 aa, Mycobacterium tuberculosis
AGRLGDRFGPKNL

SEQ ID NO: 73769 - protein, 13 aa, Mycobacterium tuberculosis
GRLGDRFGPKNLY

SEQ ID NO: 73770 - protein, 13 aa, Mycobacterium tuberculosis
RLGDRFGPKNLYL

SEQ ID NO: 73771 - protein, 13 aa, Mycobacterium tuberculosis
LGDRFGPKNLYLI

SEQ ID NO: 73772 - protein, 13 aa, Mycobacterium tuberculosis
GDRFGPKNLYLIG

SEQ ID NO: 73773 - protein, 13 aa, Mycobacterium tuberculosis
DRFGPKNLYLIGL

SEQ ID NO: 73774 - protein, 13 aa, Mycobacterium tuberculosis
RFGPKNLYLIGLG

SEQ ID NO: 73775 - protein, 13 aa, Mycobacterium tuberculosis
FGPKNLYLIGLGV

SEQ ID NO: 73776 - protein, 13 aa, Mycobacterium tuberculosis
GPKNLYLIGLGVF

SEQ ID NO: 73777 - protein, 13 aa, Mycobacterium tuberculosis
PKNLYLIGLGVFT

SEQ ID NO: 73778 - protein, 13 aa, Mycobacterium tuberculosis
KNLYLIGLGVFTV

SEQ ID NO: 73779 - protein, 13 aa, Mycobacterium tuberculosis
NLYLIGLGVFTVA

SEQ ID NO: 73780 - protein, 13 aa, Mycobacterium tuberculosis
LYLIGLGVFTVAS

SEQ ID NO: 73781 - protein, 13 aa, Mycobacterium tuberculosis
YLIGLGVFTVASL

SEQ ID NO: 73782 - protein, 13 aa, Mycobacterium tuberculosis
LIGLGVFTVASLG

SEQ ID NO: 73783 - protein, 13 aa, Mycobacterium tuberculosis
IGLGVFTVASLGC

SEQ ID NO: 73784 - protein, 13 aa, Mycobacterium tuberculosis
GLGVFTVASLGCG

SEQ ID NO: 73785 - protein, 13 aa, Mycobacterium tuberculosis
LGVFTVASLGCGL

SEQ ID NO: 73786 - protein, 13 aa, Mycobacterium tuberculosis
GVFTVASLGCGLS

SEQ ID NO: 73787 - protein, 13 aa, Mycobacterium tuberculosis
VFTVASLGCGLSS

SEQ ID NO: 73788 - protein, 13 aa, Mycobacterium tuberculosis
FTVASLGCGLSSG

SEQ ID NO: 73789 - protein, 13 aa, Mycobacterium tuberculosis
TVASLGCGLSSGA

SEQ ID NO: 73790 - protein, 13 aa, Mycobacterium tuberculosis
VASLGCGLSSGAG

SEQ ID NO: 73791 - protein, 13 aa, Mycobacterium tuberculosis
ASLGCGLSSGAGM

SEQ ID NO: 73792 - protein, 13 aa, Mycobacterium tuberculosis
SLGCGLSSGAGML

SEQ ID NO: 73793 - protein, 13 aa, Mycobacterium tuberculosis
LGCGLSSGAGMLI

SEQ ID NO: 73794 - protein, 13 aa, Mycobacterium tuberculosis
GCGLSSGAGMLIA

SEQ ID NO: 73795 - protein, 13 aa, Mycobacterium tuberculosis
CGLSSGAGMLIAA

SEQ ID NO: 73796 - protein, 13 aa, Mycobacterium tuberculosis
GLSSGAGMLIAAR

SEQ ID NO: 73797 - protein, 13 aa, Mycobacterium tuberculosis
LSSGAGMLIAARV

SEQ ID NO: 73798 - protein, 13 aa, Mycobacterium tuberculosis
SSGAGMLIAARVV

SEQ ID NO: 73799 - protein, 13 aa, Mycobacterium tuberculosis
SGAGMLIAARVVQ

SEQ ID NO: 73800 - protein, 13 aa, Mycobacterium tuberculosis
GAGMLIAARVVQG

SEQ ID NO: 73801 - protein, 13 aa, Mycobacterium tuberculosis
AGMLIAARVVQGV

SEQ ID NO: 73802 - protein, 13 aa, Mycobacterium tuberculosis
GMLIAARVVQGVG

SEQ ID NO: 73803 - protein, 13 aa, Mycobacterium tuberculosis
MLIAARVVQGVGA

SEQ ID NO: 73804 - protein, 13 aa, Mycobacterium tuberculosis
LIAARVVQGVGAG

SEQ ID NO: 73805 - protein, 13 aa, Mycobacterium tuberculosis
IAARVVQGVGAGL

SEQ ID NO: 73806 - protein, 13 aa, Mycobacterium tuberculosis
AARVVQGVGAGLL

SEQ ID NO: 73807 - protein, 13 aa, Mycobacterium tuberculosis
ARVVQGVGAGLLT

SEQ ID NO: 73808 - protein, 13 aa, Mycobacterium tuberculosis
RVVQGVGAGLLTP

SEQ ID NO: 73809 - protein, 13 aa, Mycobacterium tuberculosis
VVQGVGAGLLTPQ

SEQ ID NO: 73810 - protein, 13 aa, Mycobacterium tuberculosis
VQGVGAGLLTPQT

SEQ ID NO: 73811 - protein, 13 aa, Mycobacterium tuberculosis
QGVGAGLLTPQTL

SEQ ID NO: 73812 - protein, 13 aa, Mycobacterium tuberculosis
GVGAGLLTPQTLS

SEQ ID NO: 73813 - protein, 13 aa, Mycobacterium tuberculosis
VGAGLLTPQTLST

SEQ ID NO: 73814 - protein, 13 aa, Mycobacterium tuberculosis
GAGLLTPQTLSTI

SEQ ID NO: 73815 - protein, 13 aa, Mycobacterium tuberculosis
AGLLTPQTLSTIT

SEQ ID NO: 73816 - protein, 13 aa, Mycobacterium tuberculosis
GLLTPQTLSTITR

SEQ ID NO: 73817 - protein, 13 aa, Mycobacterium tuberculosis
LLTPQTLSTITRI

SEQ ID NO: 73818 - protein, 13 aa, Mycobacterium tuberculosis
LTPQTLSTITRIF

SEQ ID NO: 73819 - protein, 13 aa, Mycobacterium tuberculosis
TPQTLSTITRIFP

SEQ ID NO: 73820 - protein, 13 aa, Mycobacterium tuberculosis
PQTLSTITRIFPA

SEQ ID NO: 73821 - protein, 13 aa, Mycobacterium tuberculosis
QTLSTITRIFPAH

SEQ ID NO: 73822 - protein, 13 aa, Mycobacterium tuberculosis
TLSTITRIFPAHR

SEQ ID NO: 73823 - protein, 13 aa, Mycobacterium tuberculosis
LSTITRIFPAHRR

SEQ ID NO: 73824 - protein, 13 aa, Mycobacterium tuberculosis
STITRIFPAHRRG

SEQ ID NO: 73825 - protein, 13 aa, Mycobacterium tuberculosis
TITRIFPAHRRGV

SEQ ID NO: 73826 - protein, 13 aa, Mycobacterium tuberculosis
ITRIFPAHRRGVA

SEQ ID NO: 73827 - protein, 13 aa, Mycobacterium tuberculosis
TRIFPAHRRGVAL

SEQ ID NO: 73828 - protein, 13 aa, Mycobacterium tuberculosis
RIFPAHRRGVALG

SEQ ID NO: 73829 - protein, 13 aa, Mycobacterium tuberculosis
IFPAHRRGVALGA

SEQ ID NO: 73830 - protein, 13 aa, Mycobacterium tuberculosis
FPAHRRGVALGAW

SEQ ID NO: 73831 - protein, 13 aa, Mycobacterium tuberculosis
PAHRRGVALGAWG

SEQ ID NO: 73832 - protein, 13 aa, Mycobacterium tuberculosis
AHRRGVALGAWGT

SEQ ID NO: 73833 - protein, 13 aa, Mycobacterium tuberculosis
HRRGVALGAWGTV

SEQ ID NO: 73834 - protein, 13 aa, Mycobacterium tuberculosis
RRGVALGAWGTVA

SEQ ID NO: 73835 - protein, 13 aa, Mycobacterium tuberculosis
RGVALGAWGTVAS

SEQ ID NO: 73836 - protein, 13 aa, Mycobacterium tuberculosis
GVALGAWGTVASV

SEQ ID NO: 73837 - protein, 13 aa, Mycobacterium tuberculosis
VALGAWGTVASVA

SEQ ID NO: 73838 - protein, 13 aa, Mycobacterium tuberculosis
ALGAWGTVASVAS

SEQ ID NO: 73839 - protein, 13 aa, Mycobacterium tuberculosis
LGAWGTVASVASL

SEQ ID NO: 73840 - protein, 13 aa, Mycobacterium tuberculosis
GAWGTVASVASLV

SEQ ID NO: 73841 - protein, 13 aa, Mycobacterium tuberculosis
AWGTVASVASLVG

SEQ ID NO: 73842 - protein, 13 aa, Mycobacterium tuberculosis
WGTVASVASLVGP

SEQ ID NO: 73843 - protein, 13 aa, Mycobacterium tuberculosis
GTVASVASLVGPL

SEQ ID NO: 73844 - protein, 13 aa, Mycobacterium tuberculosis
TVASVASLVGPLA

SEQ ID NO: 73845 - protein, 13 aa, Mycobacterium tuberculosis
VASVASLVGPLAG

SEQ ID NO: 73846 - protein, 13 aa, Mycobacterium tuberculosis
ASVASLVGPLAGG

SEQ ID NO: 73847 - protein, 13 aa, Mycobacterium tuberculosis
SVASLVGPLAGGA

SEQ ID NO: 73848 - protein, 13 aa, Mycobacterium tuberculosis
VASLVGPLAGGAL

SEQ ID NO: 73849 - protein, 13 aa, Mycobacterium tuberculosis
ASLVGPLAGGALV

SEQ ID NO: 73850 - protein, 13 aa, Mycobacterium tuberculosis
SLVGPLAGGALVD

SEQ ID NO: 73851 - protein, 13 aa, Mycobacterium tuberculosis
LVGPLAGGALVDS

SEQ ID NO: 73852 - protein, 13 aa, Mycobacterium tuberculosis
VGPLAGGALVDSM

SEQ ID NO: 73853 - protein, 13 aa, Mycobacterium tuberculosis
GPLAGGALVDSMG

SEQ ID NO: 73854 - protein, 13 aa, Mycobacterium tuberculosis
PLAGGALVDSMGW

SEQ ID NO: 73855 - protein, 13 aa, Mycobacterium tuberculosis
LAGGALVDSMGWE

SEQ ID NO: 73856 - protein, 13 aa, Mycobacterium tuberculosis
AGGALVDSMGWEW

SEQ ID NO: 73857 - protein, 13 aa, Mycobacterium tuberculosis
GGALVDSMGWEWI

SEQ ID NO: 73858 - protein, 13 aa, Mycobacterium tuberculosis
GALVDSMGWEWIF

SEQ ID NO: 73859 - protein, 13 aa, Mycobacterium tuberculosis
ALVDSMGWEWIFF

SEQ ID NO: 73860 - protein, 13 aa, Mycobacterium tuberculosis
LVDSMGWEWIFFV

SEQ ID NO: 73861 - protein, 13 aa, Mycobacterium tuberculosis
VDSMGWEWIFFVN

SEQ ID NO: 73862 - protein, 13 aa, Mycobacterium tuberculosis
DSMGWEWIFFVNV

SEQ ID NO: 73863 - protein, 13 aa, Mycobacterium tuberculosis
SMGWEWIFFVNVP

SEQ ID NO: 73864 - protein, 13 aa, Mycobacterium tuberculosis
MGWEWIFFVNVPV

SEQ ID NO: 73865 - protein, 13 aa, Mycobacterium tuberculosis
GWEWIFFVNVPVG

SEQ ID NO: 73866 - protein, 13 aa, Mycobacterium tuberculosis
WEWIFFVNVPVGV

SEQ ID NO: 73867 - protein, 13 aa, Mycobacterium tuberculosis
EWIFFVNVPVGVI

SEQ ID NO: 73868 - protein, 13 aa, Mycobacterium tuberculosis
WIFFVNVPVGVIG

SEQ ID NO: 73869 - protein, 13 aa, Mycobacterium tuberculosis
IFFVNVPVGVIGL

SEQ ID NO: 73870 - protein, 13 aa, Mycobacterium tuberculosis
FFVNVPVGVIGLI

SEQ ID NO: 73871 - protein, 13 aa, Mycobacterium tuberculosis
FVNVPVGVIGLIL

SEQ ID NO: 73872 - protein, 13 aa, Mycobacterium tuberculosis
VNVPVGVIGLILA

SEQ ID NO: 73873 - protein, 13 aa, Mycobacterium tuberculosis
NVPVGVIGLILAA

SEQ ID NO: 73874 - protein, 13 aa, Mycobacterium tuberculosis
VPVGVIGLILAAY

SEQ ID NO: 73875 - protein, 13 aa, Mycobacterium tuberculosis
PVGVIGLILAAYL

SEQ ID NO: 73876 - protein, 13 aa, Mycobacterium tuberculosis
VGVIGLILAAYLI

SEQ ID NO: 73877 - protein, 13 aa, Mycobacterium tuberculosis
GVIGLILAAYLIP

SEQ ID NO: 73878 - protein, 13 aa, Mycobacterium tuberculosis
VIGLILAAYLIPA

SEQ ID NO: 73879 - protein, 13 aa, Mycobacterium tuberculosis
IGLILAAYLIPAL

SEQ ID NO: 73880 - protein, 13 aa, Mycobacterium tuberculosis
GLILAAYLIPALP

SEQ ID NO: 73881 - protein, 13 aa, Mycobacterium tuberculosis
LILAAYLIPALPH

SEQ ID NO: 73882 - protein, 13 aa, Mycobacterium tuberculosis
ILAAYLIPALPHH

SEQ ID NO: 73883 - protein, 13 aa, Mycobacterium tuberculosis
LAAYLIPALPHHP

SEQ ID NO: 73884 - protein, 13 aa, Mycobacterium tuberculosis
AAYLIPALPHHPH

SEQ ID NO: 73885 - protein, 13 aa, Mycobacterium tuberculosis
AYLIPALPHHPHR

SEQ ID NO: 73886 - protein, 13 aa, Mycobacterium tuberculosis
YLIPALPHHPHRF

SEQ ID NO: 73887 - protein, 13 aa, Mycobacterium tuberculosis
LIPALPHHPHRFD

SEQ ID NO: 73888 - protein, 13 aa, Mycobacterium tuberculosis
IPALPHHPHRFDW

SEQ ID NO: 73889 - protein, 13 aa, Mycobacterium tuberculosis
PALPHHPHRFDWF

SEQ ID NO: 73890 - protein, 13 aa, Mycobacterium tuberculosis
ALPHHPHRFDWFG

SEQ ID NO: 73891 - protein, 13 aa, Mycobacterium tuberculosis
LPHHPHRFDWFGV

SEQ ID NO: 73892 - protein, 13 aa, Mycobacterium tuberculosis
PHHPHRFDWFGVG

SEQ ID NO: 73893 - protein, 13 aa, Mycobacterium tuberculosis
HHPHRFDWFGVGL

SEQ ID NO: 73894 - protein, 13 aa, Mycobacterium tuberculosis
HPHRFDWFGVGLS

SEQ ID NO: 73895 - protein, 13 aa, Mycobacterium tuberculosis
PHRFDWFGVGLSG

SEQ ID NO: 73896 - protein, 13 aa, Mycobacterium tuberculosis
HRFDWFGVGLSGA

SEQ ID NO: 73897 - protein, 13 aa, Mycobacterium tuberculosis
RFDWFGVGLSGAG

SEQ ID NO: 73898 - protein, 13 aa, Mycobacterium tuberculosis
FDWFGVGLSGAGM

SEQ ID NO: 73899 - protein, 13 aa, Mycobacterium tuberculosis
DWFGVGLSGAGMF

SEQ ID NO: 73900 - protein, 13 aa, Mycobacterium tuberculosis
WFGVGLSGAGMFL

SEQ ID NO: 73901 - protein, 13 aa, Mycobacterium tuberculosis
FGVGLSGAGMFLI

SEQ ID NO: 73902 - protein, 13 aa, Mycobacterium tuberculosis
GVGLSGAGMFLIV

SEQ ID NO: 73903 - protein, 13 aa, Mycobacterium tuberculosis
VGLSGAGMFLIVF

SEQ ID NO: 73904 - protein, 13 aa, Mycobacterium tuberculosis
GLSGAGMFLIVFG

SEQ ID NO: 73905 - protein, 13 aa, Mycobacterium tuberculosis
LSGAGMFLIVFGL

SEQ ID NO: 73906 - protein, 13 aa, Mycobacterium tuberculosis
SGAGMFLIVFGLQ

SEQ ID NO: 73907 - protein, 13 aa, Mycobacterium tuberculosis
GAGMFLIVFGLQQ

SEQ ID NO: 73908 - protein, 13 aa, Mycobacterium tuberculosis
AGMFLIVFGLQQG

SEQ ID NO: 73909 - protein, 13 aa, Mycobacterium tuberculosis
GMFLIVFGLQQGQ

SEQ ID NO: 73910 - protein, 13 aa, Mycobacterium tuberculosis
MFLIVFGLQQGQS

SEQ ID NO: 73911 - protein, 13 aa, Mycobacterium tuberculosis
FLIVFGLQQGQSA

SEQ ID NO: 73912 - protein, 13 aa, Mycobacterium tuberculosis
LIVFGLQQGQSAN

SEQ ID NO: 73913 - protein, 13 aa, Mycobacterium tuberculosis
IVFGLQQGQSANW

SEQ ID NO: 73914 - protein, 13 aa, Mycobacterium tuberculosis
VFGLQQGQSANWQ

SEQ ID NO: 73915 - protein, 13 aa, Mycobacterium tuberculosis
FGLQQGQSANWQP

SEQ ID NO: 73916 - protein, 13 aa, Mycobacterium tuberculosis
GLQQGQSANWQPW

SEQ ID NO: 73917 - protein, 13 aa, Mycobacterium tuberculosis
LQQGQSANWQPWI

SEQ ID NO: 73918 - protein, 13 aa, Mycobacterium tuberculosis
QQGQSANWQPWIW

SEQ ID NO: 73919 - protein, 13 aa, Mycobacterium tuberculosis
QGQSANWQPWIWA

SEQ ID NO: 73920 - protein, 13 aa, Mycobacterium tuberculosis
GQSANWQPWIWAV

SEQ ID NO: 73921 - protein, 13 aa, Mycobacterium tuberculosis
QSANWQPWIWAVI

SEQ ID NO: 73922 - protein, 13 aa, Mycobacterium tuberculosis
SANWQPWIWAVIV

SEQ ID NO: 73923 - protein, 13 aa, Mycobacterium tuberculosis
ANWQPWIWAVIVG

SEQ ID NO: 73924 - protein, 13 aa, Mycobacterium tuberculosis
NWQPWIWAVIVGG

SEQ ID NO: 73925 - protein, 13 aa, Mycobacterium tuberculosis
WQPWIWAVIVGGI

SEQ ID NO: 73926 - protein, 13 aa, Mycobacterium tuberculosis
QPWIWAVIVGGIG

SEQ ID NO: 73927 - protein, 13 aa, Mycobacterium tuberculosis
PWIWAVIVGGIGF

SEQ ID NO: 73928 - protein, 13 aa, Mycobacterium tuberculosis
WIWAVIVGGIGFM

SEQ ID NO: 73929 - protein, 13 aa, Mycobacterium tuberculosis
IWAVIVGGIGFMS

SEQ ID NO: 73930 - protein, 13 aa, Mycobacterium tuberculosis
WAVIVGGIGFMSL

SEQ ID NO: 73931 - protein, 13 aa, Mycobacterium tuberculosis
AVIVGGIGFMSLF

SEQ ID NO: 73932 - protein, 13 aa, Mycobacterium tuberculosis
VIVGGIGFMSLFV

SEQ ID NO: 73933 - protein, 13 aa, Mycobacterium tuberculosis
IVGGIGFMSLFVY

SEQ ID NO: 73934 - protein, 13 aa, Mycobacterium tuberculosis
VGGIGFMSLFVYW

SEQ ID NO: 73935 - protein, 13 aa, Mycobacterium tuberculosis
GGIGFMSLFVYWQ

SEQ ID NO: 73936 - protein, 13 aa, Mycobacterium tuberculosis
GIGFMSLFVYWQA

SEQ ID NO: 73937 - protein, 13 aa, Mycobacterium tuberculosis
IGFMSLFVYWQAR

SEQ ID NO: 73938 - protein, 13 aa, Mycobacterium tuberculosis
GFMSLFVYWQARN

SEQ ID NO: 73939 - protein, 13 aa, Mycobacterium tuberculosis
FMSLFVYWQARNA

SEQ ID NO: 73940 - protein, 13 aa, Mycobacterium tuberculosis
MSLFVYWQARNAR

SEQ ID NO: 73941 - protein, 13 aa, Mycobacterium tuberculosis
SLFVYWQARNARE

SEQ ID NO: 73942 - protein, 13 aa, Mycobacterium tuberculosis
LFVYWQARNAREP

SEQ ID NO: 73943 - protein, 13 aa, Mycobacterium tuberculosis
FVYWQARNAREPL

SEQ ID NO: 73944 - protein, 13 aa, Mycobacterium tuberculosis
VYWQARNAREPLI

SEQ ID NO: 73945 - protein, 13 aa, Mycobacterium tuberculosis
YWQARNAREPLIP

SEQ ID NO: 73946 - protein, 13 aa, Mycobacterium tuberculosis
WQARNAREPLIPL

SEQ ID NO: 73947 - protein, 13 aa, Mycobacterium tuberculosis
QARNAREPLIPLE

SEQ ID NO: 73948 - protein, 13 aa, Mycobacterium tuberculosis
ARNAREPLIPLEV

SEQ ID NO: 73949 - protein, 13 aa, Mycobacterium tuberculosis
RNAREPLIPLEVF

SEQ ID NO: 73950 - protein, 13 aa, Mycobacterium tuberculosis
NAREPLIPLEVFN

SEQ ID NO: 73951 - protein, 13 aa, Mycobacterium tuberculosis
AREPLIPLEVFND

SEQ ID NO: 73952 - protein, 13 aa, Mycobacterium tuberculosis
REPLIPLEVFNDR

SEQ ID NO: 73953 - protein, 13 aa, Mycobacterium tuberculosis
EPLIPLEVFNDRN

SEQ ID NO: 73954 - protein, 13 aa, Mycobacterium tuberculosis
PLIPLEVFNDRNF

SEQ ID NO: 73955 - protein, 13 aa, Mycobacterium tuberculosis
LIPLEVFNDRNFS

SEQ ID NO: 73956 - protein, 13 aa, Mycobacterium tuberculosis
IPLEVFNDRNFSL

SEQ ID NO: 73957 - protein, 13 aa, Mycobacterium tuberculosis
PLEVFNDRNFSLS

SEQ ID NO: 73958 - protein, 13 aa, Mycobacterium tuberculosis
LEVFNDRNFSLSN

SEQ ID NO: 73959 - protein, 13 aa, Mycobacterium tuberculosis
EVFNDRNFSLSNL

SEQ ID NO: 73960 - protein, 13 aa, Mycobacterium tuberculosis
VFNDRNFSLSNLR

SEQ ID NO: 73961 - protein, 13 aa, Mycobacterium tuberculosis
FNDRNFSLSNLRI

SEQ ID NO: 73962 - protein, 13 aa, Mycobacterium tuberculosis
NDRNFSLSNLRIA

SEQ ID NO: 73963 - protein, 13 aa, Mycobacterium tuberculosis
DRNFSLSNLRIAI

SEQ ID NO: 73964 - protein, 13 aa, Mycobacterium tuberculosis
RNFSLSNLRIAII

SEQ ID NO: 73965 - protein, 13 aa, Mycobacterium tuberculosis
NFSLSNLRIAIIA

SEQ ID NO: 73966 - protein, 13 aa, Mycobacterium tuberculosis
FSLSNLRIAIIAF

SEQ ID NO: 73967 - protein, 13 aa, Mycobacterium tuberculosis
SLSNLRIAIIAFA

SEQ ID NO: 73968 - protein, 13 aa, Mycobacterium tuberculosis
LSNLRIAIIAFAG

SEQ ID NO: 73969 - protein, 13 aa, Mycobacterium tuberculosis
SNLRIAIIAFAGT

SEQ ID NO: 73970 - protein, 13 aa, Mycobacterium tuberculosis
NLRIAIIAFAGTG

SEQ ID NO: 73971 - protein, 13 aa, Mycobacterium tuberculosis
LRIAIIAFAGTGM

SEQ ID NO: 73972 - protein, 13 aa, Mycobacterium tuberculosis
RIAIIAFAGTGMM

SEQ ID NO: 73973 - protein, 13 aa, Mycobacterium tuberculosis
IAIIAFAGTGMML

SEQ ID NO: 73974 - protein, 13 aa, Mycobacterium tuberculosis
AIIAFAGTGMMLP

SEQ ID NO: 73975 - protein, 13 aa, Mycobacterium tuberculosis
IIAFAGTGMMLPV

SEQ ID NO: 73976 - protein, 13 aa, Mycobacterium tuberculosis
IAFAGTGMMLPVT

SEQ ID NO: 73977 - protein, 13 aa, Mycobacterium tuberculosis
AFAGTGMMLPVTF

SEQ ID NO: 73978 - protein, 13 aa, Mycobacterium tuberculosis
FAGTGMMLPVTFY

SEQ ID NO: 73979 - protein, 13 aa, Mycobacterium tuberculosis
AGTGMMLPVTFYA

SEQ ID NO: 73980 - protein, 13 aa, Mycobacterium tuberculosis
GTGMMLPVTFYAQ

SEQ ID NO: 73981 - protein, 13 aa, Mycobacterium tuberculosis
TGMMLPVTFYAQA

SEQ ID NO: 73982 - protein, 13 aa, Mycobacterium tuberculosis
GMMLPVTFYAQAV

SEQ ID NO: 73983 - protein, 13 aa, Mycobacterium tuberculosis
MMLPVTFYAQAVC

SEQ ID NO: 73984 - protein, 13 aa, Mycobacterium tuberculosis
MLPVTFYAQAVCG

SEQ ID NO: 73985 - protein, 13 aa, Mycobacterium tuberculosis
LPVTFYAQAVCGL

SEQ ID NO: 73986 - protein, 13 aa, Mycobacterium tuberculosis
PVTFYAQAVCGLS

SEQ ID NO: 73987 - protein, 13 aa, Mycobacterium tuberculosis
VTFYAQAVCGLSP

SEQ ID NO: 73988 - protein, 13 aa, Mycobacterium tuberculosis
TFYAQAVCGLSPT

SEQ ID NO: 73989 - protein, 13 aa, Mycobacterium tuberculosis
FYAQAVCGLSPTH

SEQ ID NO: 73990 - protein, 13 aa, Mycobacterium tuberculosis
YAQAVCGLSPTHT

SEQ ID NO: 73991 - protein, 13 aa, Mycobacterium tuberculosis
AQAVCGLSPTHTA

SEQ ID NO: 73992 - protein, 13 aa, Mycobacterium tuberculosis
QAVCGLSPTHTAV

SEQ ID NO: 73993 - protein, 13 aa, Mycobacterium tuberculosis
AVCGLSPTHTAVL

SEQ ID NO: 73994 - protein, 13 aa, Mycobacterium tuberculosis
VCGLSPTHTAVLF

SEQ ID NO: 73995 - protein, 13 aa, Mycobacterium tuberculosis
CGLSPTHTAVLFA

SEQ ID NO: 73996 - protein, 13 aa, Mycobacterium tuberculosis
GLSPTHTAVLFAP

SEQ ID NO: 73997 - protein, 13 aa, Mycobacterium tuberculosis
LSPTHTAVLFAPT

SEQ ID NO: 73998 - protein, 13 aa, Mycobacterium tuberculosis
SPTHTAVLFAPTA

SEQ ID NO: 73999 - protein, 13 aa, Mycobacterium tuberculosis
PTHTAVLFAPTAI

SEQ ID NO: 74000 - protein, 13 aa, Mycobacterium tuberculosis
THTAVLFAPTAIV

SEQ ID NO: 74001 - protein, 13 aa, Mycobacterium tuberculosis
HTAVLFAPTAIVG

SEQ ID NO: 74002 - protein, 13 aa, Mycobacterium tuberculosis
TAVLFAPTAIVGG

SEQ ID NO: 74003 - protein, 13 aa, Mycobacterium tuberculosis
AVLFAPTAIVGGV

SEQ ID NO: 74004 - protein, 13 aa, Mycobacterium tuberculosis
VLFAPTAIVGGVL

SEQ ID NO: 74005 - protein, 13 aa, Mycobacterium tuberculosis
LFAPTAIVGGVLA

SEQ ID NO: 74006 - protein, 13 aa, Mycobacterium tuberculosis
FAPTAIVGGVLAP

SEQ ID NO: 74007 - protein, 13 aa, Mycobacterium tuberculosis
APTAIVGGVLAPF

SEQ ID NO: 74008 - protein, 13 aa, Mycobacterium tuberculosis
PTAIVGGVLAPFV

SEQ ID NO: 74009 - protein, 13 aa, Mycobacterium tuberculosis
TAIVGGVLAPFVG

SEQ ID NO: 74010 - protein, 13 aa, Mycobacterium tuberculosis
AIVGGVLAPFVGM

SEQ ID NO: 74011 - protein, 13 aa, Mycobacterium tuberculosis
IVGGVLAPFVGMI

SEQ ID NO: 74012 - protein, 13 aa, Mycobacterium tuberculosis
VGGVLAPFVGMII

SEQ ID NO: 74013 - protein, 13 aa, Mycobacterium tuberculosis
GGVLAPFVGMIID

SEQ ID NO: 74014 - protein, 13 aa, Mycobacterium tuberculosis
GVLAPFVGMIIDR

SEQ ID NO: 74015 - protein, 13 aa, Mycobacterium tuberculosis
VLAPFVGMIIDRS

SEQ ID NO: 74016 - protein, 13 aa, Mycobacterium tuberculosis
LAPFVGMIIDRSH

SEQ ID NO: 74017 - protein, 13 aa, Mycobacterium tuberculosis
APFVGMIIDRSHP

SEQ ID NO: 74018 - protein, 13 aa, Mycobacterium tuberculosis
PFVGMIIDRSHPL

SEQ ID NO: 74019 - protein, 13 aa, Mycobacterium tuberculosis
FVGMIIDRSHPLC

SEQ ID NO: 74020 - protein, 13 aa, Mycobacterium tuberculosis
VGMIIDRSHPLCV

SEQ ID NO: 74021 - protein, 13 aa, Mycobacterium tuberculosis
GMIIDRSHPLCVL

SEQ ID NO: 74022 - protein, 13 aa, Mycobacterium tuberculosis
MIIDRSHPLCVLG

SEQ ID NO: 74023 - protein, 13 aa, Mycobacterium tuberculosis
IIDRSHPLCVLGF

SEQ ID NO: 74024 - protein, 13 aa, Mycobacterium tuberculosis
IDRSHPLCVLGFG

SEQ ID NO: 74025 - protein, 13 aa, Mycobacterium tuberculosis
DRSHPLCVLGFGF

SEQ ID NO: 74026 - protein, 13 aa, Mycobacterium tuberculosis
RSHPLCVLGFGFS

SEQ ID NO: 74027 - protein, 13 aa, Mycobacterium tuberculosis
SHPLCVLGFGFSV

SEQ ID NO: 74028 - protein, 13 aa, Mycobacterium tuberculosis
HPLCVLGFGFSVL

SEQ ID NO: 74029 - protein, 13 aa, Mycobacterium tuberculosis
PLCVLGFGFSVLA

SEQ ID NO: 74030 - protein, 13 aa, Mycobacterium tuberculosis
LCVLGFGFSVLAI

SEQ ID NO: 74031 - protein, 13 aa, Mycobacterium tuberculosis
CVLGFGFSVLAIA

SEQ ID NO: 74032 - protein, 13 aa, Mycobacterium tuberculosis
VLGFGFSVLAIAM

SEQ ID NO: 74033 - protein, 13 aa, Mycobacterium tuberculosis
LGFGFSVLAIAMT

SEQ ID NO: 74034 - protein, 13 aa, Mycobacterium tuberculosis
GFGFSVLAIAMTW

SEQ ID NO: 74035 - protein, 13 aa, Mycobacterium tuberculosis
FGFSVLAIAMTWL

SEQ ID NO: 74036 - protein, 13 aa, Mycobacterium tuberculosis
GFSVLAIAMTWLL

SEQ ID NO: 74037 - protein, 13 aa, Mycobacterium tuberculosis
FSVLAIAMTWLLC

SEQ ID NO: 74038 - protein, 13 aa, Mycobacterium tuberculosis
SVLAIAMTWLLCE

SEQ ID NO: 74039 - protein, 13 aa, Mycobacterium tuberculosis
VLAIAMTWLLCEM

SEQ ID NO: 74040 - protein, 13 aa, Mycobacterium tuberculosis
LAIAMTWLLCEMA

SEQ ID NO: 74041 - protein, 13 aa, Mycobacterium tuberculosis
AIAMTWLLCEMAP

SEQ ID NO: 74042 - protein, 13 aa, Mycobacterium tuberculosis
IAMTWLLCEMAPG

SEQ ID NO: 74043 - protein, 13 aa, Mycobacterium tuberculosis
AMTWLLCEMAPGT

SEQ ID NO: 74044 - protein, 13 aa, Mycobacterium tuberculosis
MTWLLCEMAPGTP

SEQ ID NO: 74045 - protein, 13 aa, Mycobacterium tuberculosis
TWLLCEMAPGTPI

SEQ ID NO: 74046 - protein, 13 aa, Mycobacterium tuberculosis
WLLCEMAPGTPIW

SEQ ID NO: 74047 - protein, 13 aa, Mycobacterium tuberculosis
LLCEMAPGTPIWR

SEQ ID NO: 74048 - protein, 13 aa, Mycobacterium tuberculosis
LCEMAPGTPIWRL

SEQ ID NO: 74049 - protein, 13 aa, Mycobacterium tuberculosis
CEMAPGTPIWRLV

SEQ ID NO: 74050 - protein, 13 aa, Mycobacterium tuberculosis
EMAPGTPIWRLVL

SEQ ID NO: 74051 - protein, 13 aa, Mycobacterium tuberculosis
MAPGTPIWRLVLP

SEQ ID NO: 74052 - protein, 13 aa, Mycobacterium tuberculosis
APGTPIWRLVLPF

SEQ ID NO: 74053 - protein, 13 aa, Mycobacterium tuberculosis
PGTPIWRLVLPFI

SEQ ID NO: 74054 - protein, 13 aa, Mycobacterium tuberculosis
GTPIWRLVLPFIA

SEQ ID NO: 74055 - protein, 13 aa, Mycobacterium tuberculosis
TPIWRLVLPFIAL

SEQ ID NO: 74056 - protein, 13 aa, Mycobacterium tuberculosis
PIWRLVLPFIALG

SEQ ID NO: 74057 - protein, 13 aa, Mycobacterium tuberculosis
IWRLVLPFIALGV

SEQ ID NO: 74058 - protein, 13 aa, Mycobacterium tuberculosis
WRLVLPFIALGVA

SEQ ID NO: 74059 - protein, 13 aa, Mycobacterium tuberculosis
RLVLPFIALGVAG

SEQ ID NO: 74060 - protein, 13 aa, Mycobacterium tuberculosis
LVLPFIALGVAGA

SEQ ID NO: 74061 - protein, 13 aa, Mycobacterium tuberculosis
VLPFIALGVAGAF

SEQ ID NO: 74062 - protein, 13 aa, Mycobacterium tuberculosis
LPFIALGVAGAFV

SEQ ID NO: 74063 - protein, 13 aa, Mycobacterium tuberculosis
PFIALGVAGAFVW

SEQ ID NO: 74064 - protein, 13 aa, Mycobacterium tuberculosis
FIALGVAGAFVWS

SEQ ID NO: 74065 - protein, 13 aa, Mycobacterium tuberculosis
IALGVAGAFVWSP

SEQ ID NO: 74066 - protein, 13 aa, Mycobacterium tuberculosis
ALGVAGAFVWSPL

SEQ ID NO: 74067 - protein, 13 aa, Mycobacterium tuberculosis
LGVAGAFVWSPLT

SEQ ID NO: 74068 - protein, 13 aa, Mycobacterium tuberculosis
GVAGAFVWSPLTV

SEQ ID NO: 74069 - protein, 13 aa, Mycobacterium tuberculosis
VAGAFVWSPLTVT

SEQ ID NO: 74070 - protein, 13 aa, Mycobacterium tuberculosis
AGAFVWSPLTVTA

SEQ ID NO: 74071 - protein, 13 aa, Mycobacterium tuberculosis
GAFVWSPLTVTAT

SEQ ID NO: 74072 - protein, 13 aa, Mycobacterium tuberculosis
AFVWSPLTVTATR

SEQ ID NO: 74073 - protein, 13 aa, Mycobacterium tuberculosis
FVWSPLTVTATRN

SEQ ID NO: 74074 - protein, 13 aa, Mycobacterium tuberculosis
VWSPLTVTATRNL

SEQ ID NO: 74075 - protein, 13 aa, Mycobacterium tuberculosis
WSPLTVTATRNLR

SEQ ID NO: 74076 - protein, 13 aa, Mycobacterium tuberculosis
SPLTVTATRNLRP

SEQ ID NO: 74077 - protein, 13 aa, Mycobacterium tuberculosis
PLTVTATRNLRPH

SEQ ID NO: 74078 - protein, 13 aa, Mycobacterium tuberculosis
LTVTATRNLRPHL

SEQ ID NO: 74079 - protein, 13 aa, Mycobacterium tuberculosis
TVTATRNLRPHLA

SEQ ID NO: 74080 - protein, 13 aa, Mycobacterium tuberculosis
VTATRNLRPHLAG

SEQ ID NO: 74081 - protein, 13 aa, Mycobacterium tuberculosis
TATRNLRPHLAGA

SEQ ID NO: 74082 - protein, 13 aa, Mycobacterium tuberculosis
ATRNLRPHLAGAS

SEQ ID NO: 74083 - protein, 13 aa, Mycobacterium tuberculosis
TRNLRPHLAGASS

SEQ ID NO: 74084 - protein, 13 aa, Mycobacterium tuberculosis
RNLRPHLAGASSG

SEQ ID NO: 74085 - protein, 13 aa, Mycobacterium tuberculosis
NLRPHLAGASSGV

SEQ ID NO: 74086 - protein, 13 aa, Mycobacterium tuberculosis
LRPHLAGASSGVF

SEQ ID NO: 74087 - protein, 13 aa, Mycobacterium tuberculosis
RPHLAGASSGVFN

SEQ ID NO: 74088 - protein, 13 aa, Mycobacterium tuberculosis
PHLAGASSGVFNA

SEQ ID NO: 74089 - protein, 13 aa, Mycobacterium tuberculosis
HLAGASSGVFNAV

SEQ ID NO: 74090 - protein, 13 aa, Mycobacterium tuberculosis
LAGASSGVFNAVR

SEQ ID NO: 74091 - protein, 13 aa, Mycobacterium tuberculosis
AGASSGVFNAVRQ

SEQ ID NO: 74092 - protein, 13 aa, Mycobacterium tuberculosis
GASSGVFNAVRQL

SEQ ID NO: 74093 - protein, 13 aa, Mycobacterium tuberculosis
ASSGVFNAVRQLG

SEQ ID NO: 74094 - protein, 13 aa, Mycobacterium tuberculosis
SSGVFNAVRQLGA

SEQ ID NO: 74095 - protein, 13 aa, Mycobacterium tuberculosis
SGVFNAVRQLGAV

SEQ ID NO: 74096 - protein, 13 aa, Mycobacterium tuberculosis
GVFNAVRQLGAVL

SEQ ID NO: 74097 - protein, 13 aa, Mycobacterium tuberculosis
VFNAVRQLGAVLG

SEQ ID NO: 74098 - protein, 13 aa, Mycobacterium tuberculosis
FNAVRQLGAVLGS

SEQ ID NO: 74099 - protein, 13 aa, Mycobacterium tuberculosis
NAVRQLGAVLGSA

SEQ ID NO: 74100 - protein, 13 aa, Mycobacterium tuberculosis
AVRQLGAVLGSAS

SEQ ID NO: 74101 - protein, 13 aa, Mycobacterium tuberculosis
VRQLGAVLGSASM

SEQ ID NO: 74102 - protein, 13 aa, Mycobacterium tuberculosis
RQLGAVLGSASMA

SEQ ID NO: 74103 - protein, 13 aa, Mycobacterium tuberculosis
QLGAVLGSASMAA

SEQ ID NO: 74104 - protein, 13 aa, Mycobacterium tuberculosis
LGAVLGSASMAAF

SEQ ID NO: 74105 - protein, 13 aa, Mycobacterium tuberculosis
GAVLGSASMAAFM

SEQ ID NO: 74106 - protein, 13 aa, Mycobacterium tuberculosis
AVLGSASMAAFMT

SEQ ID NO: 74107 - protein, 13 aa, Mycobacterium tuberculosis
VLGSASMAAFMTS

SEQ ID NO: 74108 - protein, 13 aa, Mycobacterium tuberculosis
LGSASMAAFMTSR

SEQ ID NO: 74109 - protein, 13 aa, Mycobacterium tuberculosis
GSASMAAFMTSRI

SEQ ID NO: 74110 - protein, 13 aa, Mycobacterium tuberculosis
SASMAAFMTSRIA

SEQ ID NO: 74111 - protein, 13 aa, Mycobacterium tuberculosis
ASMAAFMTSRIAA

SEQ ID NO: 74112 - protein, 13 aa, Mycobacterium tuberculosis
SMAAFMTSRIAAE

SEQ ID NO: 74113 - protein, 13 aa, Mycobacterium tuberculosis
MAAFMTSRIAAEM

SEQ ID NO: 74114 - protein, 13 aa, Mycobacterium tuberculosis
AAFMTSRIAAEMP

SEQ ID NO: 74115 - protein, 13 aa, Mycobacterium tuberculosis
AFMTSRIAAEMPG

SEQ ID NO: 74116 - protein, 13 aa, Mycobacterium tuberculosis
FMTSRIAAEMPGG

SEQ ID NO: 74117 - protein, 13 aa, Mycobacterium tuberculosis
MTSRIAAEMPGGV

SEQ ID NO: 74118 - protein, 13 aa, Mycobacterium tuberculosis
TSRIAAEMPGGVD

SEQ ID NO: 74119 - protein, 13 aa, Mycobacterium tuberculosis
SRIAAEMPGGVDA

SEQ ID NO: 74120 - protein, 13 aa, Mycobacterium tuberculosis
RIAAEMPGGVDAL

SEQ ID NO: 74121 - protein, 13 aa, Mycobacterium tuberculosis
IAAEMPGGVDALT

SEQ ID NO: 74122 - protein, 13 aa, Mycobacterium tuberculosis
AAEMPGGVDALTG

SEQ ID NO: 74123 - protein, 13 aa, Mycobacterium tuberculosis
AEMPGGVDALTGP

SEQ ID NO: 74124 - protein, 13 aa, Mycobacterium tuberculosis
EMPGGVDALTGPA

SEQ ID NO: 74125 - protein, 13 aa, Mycobacterium tuberculosis
MPGGVDALTGPAG

SEQ ID NO: 74126 - protein, 13 aa, Mycobacterium tuberculosis
PGGVDALTGPAGQ

SEQ ID NO: 74127 - protein, 13 aa, Mycobacterium tuberculosis
GGVDALTGPAGQD

SEQ ID NO: 74128 - protein, 13 aa, Mycobacterium tuberculosis
GVDALTGPAGQDA

SEQ ID NO: 74129 - protein, 13 aa, Mycobacterium tuberculosis
VDALTGPAGQDAT

SEQ ID NO: 74130 - protein, 13 aa, Mycobacterium tuberculosis
DALTGPAGQDATV

SEQ ID NO: 74131 - protein, 13 aa, Mycobacterium tuberculosis
ALTGPAGQDATVL

SEQ ID NO: 74132 - protein, 13 aa, Mycobacterium tuberculosis
LTGPAGQDATVLQ

SEQ ID NO: 74133 - protein, 13 aa, Mycobacterium tuberculosis
TGPAGQDATVLQL

SEQ ID NO: 74134 - protein, 13 aa, Mycobacterium tuberculosis
GPAGQDATVLQLP

SEQ ID NO: 74135 - protein, 13 aa, Mycobacterium tuberculosis
PAGQDATVLQLPE

SEQ ID NO: 74136 - protein, 13 aa, Mycobacterium tuberculosis
AGQDATVLQLPEF

SEQ ID NO: 74137 - protein, 13 aa, Mycobacterium tuberculosis
GQDATVLQLPEFV

SEQ ID NO: 74138 - protein, 13 aa, Mycobacterium tuberculosis
QDATVLQLPEFVR

SEQ ID NO: 74139 - protein, 13 aa, Mycobacterium tuberculosis
DATVLQLPEFVRE

SEQ ID NO: 74140 - protein, 13 aa, Mycobacterium tuberculosis
ATVLQLPEFVREP

SEQ ID NO: 74141 - protein, 13 aa, Mycobacterium tuberculosis
TVLQLPEFVREPF

SEQ ID NO: 74142 - protein, 13 aa, Mycobacterium tuberculosis
VLQLPEFVREPFA

SEQ ID NO: 74143 - protein, 13 aa, Mycobacterium tuberculosis
LQLPEFVREPFAA

SEQ ID NO: 74144 - protein, 13 aa, Mycobacterium tuberculosis
QLPEFVREPFAAA

SEQ ID NO: 74145 - protein, 13 aa, Mycobacterium tuberculosis
LPEFVREPFAAAM

SEQ ID NO: 74146 - protein, 13 aa, Mycobacterium tuberculosis
PEFVREPFAAAMS

SEQ ID NO: 74147 - protein, 13 aa, Mycobacterium tuberculosis
EFVREPFAAAMSQ

SEQ ID NO: 74148 - protein, 13 aa, Mycobacterium tuberculosis
FVREPFAAAMSQS

SEQ ID NO: 74149 - protein, 13 aa, Mycobacterium tuberculosis
VREPFAAAMSQSM

SEQ ID NO: 74150 - protein, 13 aa, Mycobacterium tuberculosis
REPFAAAMSQSML

SEQ ID NO: 74151 - protein, 13 aa, Mycobacterium tuberculosis
EPFAAAMSQSMLL

SEQ ID NO: 74152 - protein, 13 aa, Mycobacterium tuberculosis
PFAAAMSQSMLLP

SEQ ID NO: 74153 - protein, 13 aa, Mycobacterium tuberculosis
FAAAMSQSMLLPA

SEQ ID NO: 74154 - protein, 13 aa, Mycobacterium tuberculosis
AAAMSQSMLLPAF

SEQ ID NO: 74155 - protein, 13 aa, Mycobacterium tuberculosis
AAMSQSMLLPAFV

SEQ ID NO: 74156 - protein, 13 aa, Mycobacterium tuberculosis
AMSQSMLLPAFVA

SEQ ID NO: 74157 - protein, 13 aa, Mycobacterium tuberculosis
MSQSMLLPAFVAL

SEQ ID NO: 74158 - protein, 13 aa, Mycobacterium tuberculosis
SQSMLLPAFVALF

SEQ ID NO: 74159 - protein, 13 aa, Mycobacterium tuberculosis
QSMLLPAFVALFG

SEQ ID NO: 74160 - protein, 13 aa, Mycobacterium tuberculosis
SMLLPAFVALFGI

SEQ ID NO: 74161 - protein, 13 aa, Mycobacterium tuberculosis
MLLPAFVALFGIV

SEQ ID NO: 74162 - protein, 13 aa, Mycobacterium tuberculosis
LLPAFVALFGIVA

SEQ ID NO: 74163 - protein, 13 aa, Mycobacterium tuberculosis
LPAFVALFGIVAA

SEQ ID NO: 74164 - protein, 13 aa, Mycobacterium tuberculosis
PAFVALFGIVAAL

SEQ ID NO: 74165 - protein, 13 aa, Mycobacterium tuberculosis
AFVALFGIVAALF

SEQ ID NO: 74166 - protein, 13 aa, Mycobacterium tuberculosis
FVALFGIVAALFL

SEQ ID NO: 74167 - protein, 13 aa, Mycobacterium tuberculosis
VALFGIVAALFLV

SEQ ID NO: 74168 - protein, 13 aa, Mycobacterium tuberculosis
ALFGIVAALFLVD

SEQ ID NO: 74169 - protein, 13 aa, Mycobacterium tuberculosis
LFGIVAALFLVDF

SEQ ID NO: 74170 - protein, 13 aa, Mycobacterium tuberculosis
FGIVAALFLVDFT

SEQ ID NO: 74171 - protein, 13 aa, Mycobacterium tuberculosis
GIVAALFLVDFTG

SEQ ID NO: 74172 - protein, 13 aa, Mycobacterium tuberculosis
IVAALFLVDFTGA

SEQ ID NO: 74173 - protein, 13 aa, Mycobacterium tuberculosis
VAALFLVDFTGAA

SEQ ID NO: 74174 - protein, 13 aa, Mycobacterium tuberculosis
AALFLVDFTGAAV

SEQ ID NO: 74175 - protein, 13 aa, Mycobacterium tuberculosis
ALFLVDFTGAAVA

SEQ ID NO: 74176 - protein, 13 aa, Mycobacterium tuberculosis
LFLVDFTGAAVAK

SEQ ID NO: 74177 - protein, 13 aa, Mycobacterium tuberculosis
FLVDFTGAAVAKE

SEQ ID NO: 74178 - protein, 13 aa, Mycobacterium tuberculosis
LVDFTGAAVAKEP

SEQ ID NO: 74179 - protein, 13 aa, Mycobacterium tuberculosis
VDFTGAAVAKEPL

SEQ ID NO: 74180 - protein, 13 aa, Mycobacterium tuberculosis
DFTGAAVAKEPLP

SEQ ID NO: 74181 - protein, 13 aa, Mycobacterium tuberculosis
FTGAAVAKEPLPE

SEQ ID NO: 74182 - protein, 13 aa, Mycobacterium tuberculosis
TGAAVAKEPLPES

SEQ ID NO: 74183 - protein, 13 aa, Mycobacterium tuberculosis
GAAVAKEPLPESD

SEQ ID NO: 74184 - protein, 13 aa, Mycobacterium tuberculosis
AAVAKEPLPESDG

SEQ ID NO: 74185 - protein, 13 aa, Mycobacterium tuberculosis
AVAKEPLPESDGD

SEQ ID NO: 74186 - protein, 13 aa, Mycobacterium tuberculosis
VAKEPLPESDGDA

SEQ ID NO: 74187 - protein, 13 aa, Mycobacterium tuberculosis
AKEPLPESDGDAD

SEQ ID NO: 74188 - protein, 13 aa, Mycobacterium tuberculosis
KEPLPESDGDADD

SEQ ID NO: 74189 - protein, 13 aa, Mycobacterium tuberculosis
EPLPESDGDADDD

SEQ ID NO: 74190 - protein, 13 aa, Mycobacterium tuberculosis
PLPESDGDADDDD

SEQ ID NO: 74191 - protein, 13 aa, Mycobacterium tuberculosis
LPESDGDADDDDY

SEQ ID NO: 74192 - protein, 13 aa, Mycobacterium tuberculosis
PESDGDADDDDYV

SEQ ID NO: 74193 - protein, 13 aa, Mycobacterium tuberculosis
ESDGDADDDDYVE

SEQ ID NO: 74194 - protein, 13 aa, Mycobacterium tuberculosis
SDGDADDDDYVEY

SEQ ID NO: 74195 - protein, 13 aa, Mycobacterium tuberculosis
DGDADDDDYVEYI

SEQ ID NO: 74196 - protein, 13 aa, Mycobacterium tuberculosis
GDADDDDYVEYIL

SEQ ID NO: 74197 - protein, 13 aa, Mycobacterium tuberculosis
DADDDDYVEYILR

SEQ ID NO: 74198 - protein, 13 aa, Mycobacterium tuberculosis
ADDDDYVEYILRR

SEQ ID NO: 74199 - protein, 13 aa, Mycobacterium tuberculosis
DDDDYVEYILRRE

SEQ ID NO: 74200 - protein, 13 aa, Mycobacterium tuberculosis
DDDYVEYILRREP

SEQ ID NO: 74201 - protein, 13 aa, Mycobacterium tuberculosis
DDYVEYILRREPE

SEQ ID NO: 74202 - protein, 13 aa, Mycobacterium tuberculosis
DYVEYILRREPEE

SEQ ID NO: 74203 - protein, 13 aa, Mycobacterium tuberculosis
YVEYILRREPEED

SEQ ID NO: 74204 - protein, 13 aa, Mycobacterium tuberculosis
VEYILRREPEEDC

SEQ ID NO: 74205 - protein, 13 aa, Mycobacterium tuberculosis
EYILRREPEEDCD

SEQ ID NO: 74206 - protein, 13 aa, Mycobacterium tuberculosis
YILRREPEEDCDT

SEQ ID NO: 74207 - protein, 13 aa, Mycobacterium tuberculosis
ILRREPEEDCDTQ

SEQ ID NO: 74208 - protein, 13 aa, Mycobacterium tuberculosis
LRREPEEDCDTQP

SEQ ID NO: 74209 - protein, 13 aa, Mycobacterium tuberculosis
RREPEEDCDTQPL

SEQ ID NO: 74210 - protein, 13 aa, Mycobacterium tuberculosis
REPEEDCDTQPLR

SEQ ID NO: 74211 - protein, 13 aa, Mycobacterium tuberculosis
EPEEDCDTQPLRA

SEQ ID NO: 74212 - protein, 13 aa, Mycobacterium tuberculosis
PEEDCDTQPLRAS

SEQ ID NO: 74213 - protein, 13 aa, Mycobacterium tuberculosis
EEDCDTQPLRASR

SEQ ID NO: 74214 - protein, 13 aa, Mycobacterium tuberculosis
EDCDTQPLRASRP

SEQ ID NO: 74215 - protein, 13 aa, Mycobacterium tuberculosis
DCDTQPLRASRPA

SEQ ID NO: 74216 - protein, 13 aa, Mycobacterium tuberculosis
CDTQPLRASRPAA

SEQ ID NO: 74217 - protein, 13 aa, Mycobacterium tuberculosis
DTQPLRASRPAAA

SEQ ID NO: 74218 - protein, 13 aa, Mycobacterium tuberculosis
TQPLRASRPAAAA

SEQ ID NO: 74219 - protein, 13 aa, Mycobacterium tuberculosis
QPLRASRPAAAAA

SEQ ID NO: 74220 - protein, 13 aa, Mycobacterium tuberculosis
PLRASRPAAAAAS

SEQ ID NO: 74221 - protein, 13 aa, Mycobacterium tuberculosis
LRASRPAAAAASR

SEQ ID NO: 74222 - protein, 13 aa, Mycobacterium tuberculosis
RASRPAAAAASRS

SEQ ID NO: 74223 - protein, 13 aa, Mycobacterium tuberculosis
ASRPAAAAASRSG

SEQ ID NO: 74224 - protein, 13 aa, Mycobacterium tuberculosis
SRPAAAAASRSGA

SEQ ID NO: 74225 - protein, 13 aa, Mycobacterium tuberculosis
RPAAAAASRSGAG

SEQ ID NO: 74226 - protein, 13 aa, Mycobacterium tuberculosis
PAAAAASRSGAGG

SEQ ID NO: 74227 - protein, 13 aa, Mycobacterium tuberculosis
AAAAASRSGAGGP

SEQ ID NO: 74228 - protein, 13 aa, Mycobacterium tuberculosis
AAAASRSGAGGPL

SEQ ID NO: 74229 - protein, 13 aa, Mycobacterium tuberculosis
AAASRSGAGGPLA

SEQ ID NO: 74230 - protein, 13 aa, Mycobacterium tuberculosis
AASRSGAGGPLAV

SEQ ID NO: 74231 - protein, 13 aa, Mycobacterium tuberculosis
ASRSGAGGPLAVS

SEQ ID NO: 74232 - protein, 13 aa, Mycobacterium tuberculosis
SRSGAGGPLAVSW

SEQ ID NO: 74233 - protein, 13 aa, Mycobacterium tuberculosis
RSGAGGPLAVSWS

SEQ ID NO: 74234 - protein, 13 aa, Mycobacterium tuberculosis
SGAGGPLAVSWST

SEQ ID NO: 74235 - protein, 13 aa, Mycobacterium tuberculosis
GAGGPLAVSWSTS

SEQ ID NO: 74236 - protein, 13 aa, Mycobacterium tuberculosis
AGGPLAVSWSTSA

SEQ ID NO: 74237 - protein, 13 aa, Mycobacterium tuberculosis
GGPLAVSWSTSAQ

SEQ ID NO: 74238 - protein, 13 aa, Mycobacterium tuberculosis
GPLAVSWSTSAQG

SEQ ID NO: 74239 - protein, 13 aa, Mycobacterium tuberculosis
PLAVSWSTSAQGM

SEQ ID NO: 74240 - protein, 13 aa, Mycobacterium tuberculosis
LAVSWSTSAQGMP

SEQ ID NO: 74241 - protein, 13 aa, Mycobacterium tuberculosis
AVSWSTSAQGMPP

SEQ ID NO: 74242 - protein, 13 aa, Mycobacterium tuberculosis
VSWSTSAQGMPPG

SEQ ID NO: 74243 - protein, 13 aa, Mycobacterium tuberculosis
SWSTSAQGMPPGP

SEQ ID NO: 74244 - protein, 13 aa, Mycobacterium tuberculosis
WSTSAQGMPPGPP

SEQ ID NO: 74245 - protein, 13 aa, Mycobacterium tuberculosis
STSAQGMPPGPPG

SEQ ID NO: 74246 - protein, 13 aa, Mycobacterium tuberculosis
TSAQGMPPGPPGR

SEQ ID NO: 74247 - protein, 13 aa, Mycobacterium tuberculosis
SAQGMPPGPPGRR

SEQ ID NO: 74248 - protein, 13 aa, Mycobacterium tuberculosis
AQGMPPGPPGRRA

SEQ ID NO: 74249 - protein, 13 aa, Mycobacterium tuberculosis
QGMPPGPPGRRAW

SEQ ID NO: 74250 - protein, 13 aa, Mycobacterium tuberculosis
GMPPGPPGRRAWQ

SEQ ID NO: 74251 - protein, 13 aa, Mycobacterium tuberculosis
MPPGPPGRRAWQA

SEQ ID NO: 74252 - protein, 13 aa, Mycobacterium tuberculosis
PPGPPGRRAWQAD

SEQ ID NO: 74253 - protein, 13 aa, Mycobacterium tuberculosis
PGPPGRRAWQADT

SEQ ID NO: 74254 - protein, 13 aa, Mycobacterium tuberculosis
GPPGRRAWQADTE

SEQ ID NO: 74255 - protein, 13 aa, Mycobacterium tuberculosis
PPGRRAWQADTES

SEQ ID NO: 74256 - protein, 13 aa, Mycobacterium tuberculosis
PGRRAWQADTEST

SEQ ID NO: 74257 - protein, 13 aa, Mycobacterium tuberculosis
GRRAWQADTESTA

SEQ ID NO: 74258 - protein, 13 aa, Mycobacterium tuberculosis
RRAWQADTESTAP

SEQ ID NO: 74259 - protein, 13 aa, Mycobacterium tuberculosis
RAWQADTESTAPS

SEQ ID NO: 74260 - protein, 13 aa, Mycobacterium tuberculosis
AWQADTESTAPSA

SEQ ID NO: 74261 - protein, 13 aa, Mycobacterium tuberculosis
WQADTESTAPSAL

SEQ ID NO: 74262 - protein, 14 aa, Mycobacterium tuberculosis
MTTAIRRAAGSSYF

SEQ ID NO: 74263 - protein, 14 aa, Mycobacterium tuberculosis
TTAIRRAAGSSYFR

SEQ ID NO: 74264 - protein, 14 aa, Mycobacterium tuberculosis
TAIRRAAGSSYFRN

SEQ ID NO: 74265 - protein, 14 aa, Mycobacterium tuberculosis
AIRRAAGSSYFRNP

SEQ ID NO: 74266 - protein, 14 aa, Mycobacterium tuberculosis
IRRAAGSSYFRNPW

SEQ ID NO: 74267 - protein, 14 aa, Mycobacterium tuberculosis
RRAAGSSYFRNPWP

SEQ ID NO: 74268 - protein, 14 aa, Mycobacterium tuberculosis
RAAGSSYFRNPWPA

SEQ ID NO: 74269 - protein, 14 aa, Mycobacterium tuberculosis
AAGSSYFRNPWPAL

SEQ ID NO: 74270 - protein, 14 aa, Mycobacterium tuberculosis
AGSSYFRNPWPALW

SEQ ID NO: 74271 - protein, 14 aa, Mycobacterium tuberculosis
GSSYFRNPWPALWA

SEQ ID NO: 74272 - protein, 14 aa, Mycobacterium tuberculosis
SSYFRNPWPALWAM

SEQ ID NO: 74273 - protein, 14 aa, Mycobacterium tuberculosis
SYFRNPWPALWAMM

SEQ ID NO: 74274 - protein, 14 aa, Mycobacterium tuberculosis
YFRNPWPALWAMMV

SEQ ID NO: 74275 - protein, 14 aa, Mycobacterium tuberculosis
FRNPWPALWAMMVG

SEQ ID NO: 74276 - protein, 14 aa, Mycobacterium tuberculosis
RNPWPALWAMMVGF

SEQ ID NO: 74277 - protein, 14 aa, Mycobacterium tuberculosis
NPWPALWAMMVGFF

SEQ ID NO: 74278 - protein, 14 aa, Mycobacterium tuberculosis
PWPALWAMMVGFFM

SEQ ID NO: 74279 - protein, 14 aa, Mycobacterium tuberculosis
WPALWAMMVGFFMI

SEQ ID NO: 74280 - protein, 14 aa, Mycobacterium tuberculosis
PALWAMMVGFFMIM

SEQ ID NO: 74281 - protein, 14 aa, Mycobacterium tuberculosis
ALWAMMVGFFMIML

SEQ ID NO: 74282 - protein, 14 aa, Mycobacterium tuberculosis
LWAMMVGFFMIMLD

SEQ ID NO: 74283 - protein, 14 aa, Mycobacterium tuberculosis
WAMMVGFFMIMLDS

SEQ ID NO: 74284 - protein, 14 aa, Mycobacterium tuberculosis
AMMVGFFMIMLDST

SEQ ID NO: 74285 - protein, 14 aa, Mycobacterium tuberculosis
MMVGFFMIMLDSTV

SEQ ID NO: 74286 - protein, 14 aa, Mycobacterium tuberculosis
MVGFFMIMLDSTVV

SEQ ID NO: 74287 - protein, 14 aa, Mycobacterium tuberculosis
VGFFMIMLDSTVVA

SEQ ID NO: 74288 - protein, 14 aa, Mycobacterium tuberculosis
GFFMIMLDSTVVAI

SEQ ID NO: 74289 - protein, 14 aa, Mycobacterium tuberculosis
FFMIMLDSTVVAIA

SEQ ID NO: 74290 - protein, 14 aa, Mycobacterium tuberculosis
FMIMLDSTVVAIAN

SEQ ID NO: 74291 - protein, 14 aa, Mycobacterium tuberculosis
MIMLDSTVVAIANP

SEQ ID NO: 74292 - protein, 14 aa, Mycobacterium tuberculosis
IMLDSTVVAIANPT

SEQ ID NO: 74293 - protein, 14 aa, Mycobacterium tuberculosis
MLDSTVVAIANPTI

SEQ ID NO: 74294 - protein, 14 aa, Mycobacterium tuberculosis
LDSTVVAIANPTIM

SEQ ID NO: 74295 - protein, 14 aa, Mycobacterium tuberculosis
DSTVVAIANPTIMA

SEQ ID NO: 74296 - protein, 14 aa, Mycobacterium tuberculosis
STVVAIANPTIMAQ

SEQ ID NO: 74297 - protein, 14 aa, Mycobacterium tuberculosis
TVVAIANPTIMAQL

SEQ ID NO: 74298 - protein, 14 aa, Mycobacterium tuberculosis
VVAIANPTIMAQLR

SEQ ID NO: 74299 - protein, 14 aa, Mycobacterium tuberculosis
VAIANPTIMAQLRI

SEQ ID NO: 74300 - protein, 14 aa, Mycobacterium tuberculosis
AIANPTIMAQLRIG

SEQ ID NO: 74301 - protein, 14 aa, Mycobacterium tuberculosis
IANPTIMAQLRIGY

SEQ ID NO: 74302 - protein, 14 aa, Mycobacterium tuberculosis
ANPTIMAQLRIGYA

SEQ ID NO: 74303 - protein, 14 aa, Mycobacterium tuberculosis
NPTIMAQLRIGYAT

SEQ ID NO: 74304 - protein, 14 aa, Mycobacterium tuberculosis
PTIMAQLRIGYATV

SEQ ID NO: 74305 - protein, 14 aa, Mycobacterium tuberculosis
TIMAQLRIGYATVV

SEQ ID NO: 74306 - protein, 14 aa, Mycobacterium tuberculosis
IMAQLRIGYATVVW

SEQ ID NO: 74307 - protein, 14 aa, Mycobacterium tuberculosis
MAQLRIGYATVVWV

SEQ ID NO: 74308 - protein, 14 aa, Mycobacterium tuberculosis
AQLRIGYATVVWVT

SEQ ID NO: 74309 - protein, 14 aa, Mycobacterium tuberculosis
QLRIGYATVVWVTS

SEQ ID NO: 74310 - protein, 14 aa, Mycobacterium tuberculosis
LRIGYATVVWVTSA

SEQ ID NO: 74311 - protein, 14 aa, Mycobacterium tuberculosis
RIGYATVVWVTSAY

SEQ ID NO: 74312 - protein, 14 aa, Mycobacterium tuberculosis
IGYATVVWVTSAYL

SEQ ID NO: 74313 - protein, 14 aa, Mycobacterium tuberculosis
GYATVVWVTSAYLL

SEQ ID NO: 74314 - protein, 14 aa, Mycobacterium tuberculosis
YATVVWVTSAYLLA

SEQ ID NO: 74315 - protein, 14 aa, Mycobacterium tuberculosis
ATVVWVTSAYLLAY

SEQ ID NO: 74316 - protein, 14 aa, Mycobacterium tuberculosis
TVVWVTSAYLLAYA

SEQ ID NO: 74317 - protein, 14 aa, Mycobacterium tuberculosis
VVWVTSAYLLAYAV

SEQ ID NO: 74318 - protein, 14 aa, Mycobacterium tuberculosis
VWVTSAYLLAYAVP

SEQ ID NO: 74319 - protein, 14 aa, Mycobacterium tuberculosis
WVTSAYLLAYAVPM

SEQ ID NO: 74320 - protein, 14 aa, Mycobacterium tuberculosis
VTSAYLLAYAVPML

SEQ ID NO: 74321 - protein, 14 aa, Mycobacterium tuberculosis
TSAYLLAYAVPMLV

SEQ ID NO: 74322 - protein, 14 aa, Mycobacterium tuberculosis
SAYLLAYAVPMLVA

SEQ ID NO: 74323 - protein, 14 aa, Mycobacterium tuberculosis
AYLLAYAVPMLVAG

SEQ ID NO: 74324 - protein, 14 aa, Mycobacterium tuberculosis
YLLAYAVPMLVAGR

SEQ ID NO: 74325 - protein, 14 aa, Mycobacterium tuberculosis
LLAYAVPMLVAGRL

SEQ ID NO: 74326 - protein, 14 aa, Mycobacterium tuberculosis
LAYAVPMLVAGRLG

SEQ ID NO: 74327 - protein, 14 aa, Mycobacterium tuberculosis
AYAVPMLVAGRLGD

SEQ ID NO: 74328 - protein, 14 aa, Mycobacterium tuberculosis
YAVPMLVAGRLGDR

SEQ ID NO: 74329 - protein, 14 aa, Mycobacterium tuberculosis
AVPMLVAGRLGDRF

SEQ ID NO: 74330 - protein, 14 aa, Mycobacterium tuberculosis
VPMLVAGRLGDRFG

SEQ ID NO: 74331 - protein, 14 aa, Mycobacterium tuberculosis
PMLVAGRLGDRFGP

SEQ ID NO: 74332 - protein, 14 aa, Mycobacterium tuberculosis
MLVAGRLGDRFGPK

SEQ ID NO: 74333 - protein, 14 aa, Mycobacterium tuberculosis
LVAGRLGDRFGPKN

SEQ ID NO: 74334 - protein, 14 aa, Mycobacterium tuberculosis
VAGRLGDRFGPKNL

SEQ ID NO: 74335 - protein, 14 aa, Mycobacterium tuberculosis
AGRLGDRFGPKNLY

SEQ ID NO: 74336 - protein, 14 aa, Mycobacterium tuberculosis
GRLGDRFGPKNLYL

SEQ ID NO: 74337 - protein, 14 aa, Mycobacterium tuberculosis
RLGDRFGPKNLYLI

SEQ ID NO: 74338 - protein, 14 aa, Mycobacterium tuberculosis
LGDRFGPKNLYLIG

SEQ ID NO: 74339 - protein, 14 aa, Mycobacterium tuberculosis
GDRFGPKNLYLIGL

SEQ ID NO: 74340 - protein, 14 aa, Mycobacterium tuberculosis
DRFGPKNLYLIGLG

SEQ ID NO: 74341 - protein, 14 aa, Mycobacterium tuberculosis
RFGPKNLYLIGLGV

SEQ ID NO: 74342 - protein, 14 aa, Mycobacterium tuberculosis
FGPKNLYLIGLGVF

SEQ ID NO: 74343 - protein, 14 aa, Mycobacterium tuberculosis
GPKNLYLIGLGVFT

SEQ ID NO: 74344 - protein, 14 aa, Mycobacterium tuberculosis
PKNLYLIGLGVFTV

SEQ ID NO: 74345 - protein, 14 aa, Mycobacterium tuberculosis
KNLYLIGLGVFTVA

SEQ ID NO: 74346 - protein, 14 aa, Mycobacterium tuberculosis
NLYLIGLGVFTVAS

SEQ ID NO: 74347 - protein, 14 aa, Mycobacterium tuberculosis
LYLIGLGVFTVASL

SEQ ID NO: 74348 - protein, 14 aa, Mycobacterium tuberculosis
YLIGLGVFTVASLG

SEQ ID NO: 74349 - protein, 14 aa, Mycobacterium tuberculosis
LIGLGVFTVASLGC

SEQ ID NO: 74350 - protein, 14 aa, Mycobacterium tuberculosis
IGLGVFTVASLGCG

SEQ ID NO: 74351 - protein, 14 aa, Mycobacterium tuberculosis
GLGVFTVASLGCGL

SEQ ID NO: 74352 - protein, 14 aa, Mycobacterium tuberculosis
LGVFTVASLGCGLS

SEQ ID NO: 74353 - protein, 14 aa, Mycobacterium tuberculosis
GVFTVASLGCGLSS

SEQ ID NO: 74354 - protein, 14 aa, Mycobacterium tuberculosis
VFTVASLGCGLSSG

SEQ ID NO: 74355 - protein, 14 aa, Mycobacterium tuberculosis
FTVASLGCGLSSGA

SEQ ID NO: 74356 - protein, 14 aa, Mycobacterium tuberculosis
TVASLGCGLSSGAG

SEQ ID NO: 74357 - protein, 14 aa, Mycobacterium tuberculosis
VASLGCGLSSGAGM

SEQ ID NO: 74358 - protein, 14 aa, Mycobacterium tuberculosis
ASLGCGLSSGAGML

SEQ ID NO: 74359 - protein, 14 aa, Mycobacterium tuberculosis
SLGCGLSSGAGMLI

SEQ ID NO: 74360 - protein, 14 aa, Mycobacterium tuberculosis
LGCGLSSGAGMLIA

SEQ ID NO: 74361 - protein, 14 aa, Mycobacterium tuberculosis
GCGLSSGAGMLIAA

SEQ ID NO: 74362 - protein, 14 aa, Mycobacterium tuberculosis
CGLSSGAGMLIAAR

SEQ ID NO: 74363 - protein, 14 aa, Mycobacterium tuberculosis
GLSSGAGMLIAARV

SEQ ID NO: 74364 - protein, 14 aa, Mycobacterium tuberculosis
LSSGAGMLIAARVV

SEQ ID NO: 74365 - protein, 14 aa, Mycobacterium tuberculosis
SSGAGMLIAARVVQ

SEQ ID NO: 74366 - protein, 14 aa, Mycobacterium tuberculosis
SGAGMLIAARVVQG

SEQ ID NO: 74367 - protein, 14 aa, Mycobacterium tuberculosis
GAGMLIAARVVQGV

SEQ ID NO: 74368 - protein, 14 aa, Mycobacterium tuberculosis
AGMLIAARVVQGVG

SEQ ID NO: 74369 - protein, 14 aa, Mycobacterium tuberculosis
GMLIAARVVQGVGA

SEQ ID NO: 74370 - protein, 14 aa, Mycobacterium tuberculosis
MLIAARVVQGVGAG

SEQ ID NO: 74371 - protein, 14 aa, Mycobacterium tuberculosis
LIAARVVQGVGAGL

SEQ ID NO: 74372 - protein, 14 aa, Mycobacterium tuberculosis
IAARVVQGVGAGLL

SEQ ID NO: 74373 - protein, 14 aa, Mycobacterium tuberculosis
AARVVQGVGAGLLT

SEQ ID NO: 74374 - protein, 14 aa, Mycobacterium tuberculosis
ARVVQGVGAGLLTP

SEQ ID NO: 74375 - protein, 14 aa, Mycobacterium tuberculosis
RVVQGVGAGLLTPQ

SEQ ID NO: 74376 - protein, 14 aa, Mycobacterium tuberculosis
VVQGVGAGLLTPQT

SEQ ID NO: 74377 - protein, 14 aa, Mycobacterium tuberculosis
VQGVGAGLLTPQTL

SEQ ID NO: 74378 - protein, 14 aa, Mycobacterium tuberculosis
QGVGAGLLTPQTLS

SEQ ID NO: 74379 - protein, 14 aa, Mycobacterium tuberculosis
GVGAGLLTPQTLST

SEQ ID NO: 74380 - protein, 14 aa, Mycobacterium tuberculosis
VGAGLLTPQTLSTI

SEQ ID NO: 74381 - protein, 14 aa, Mycobacterium tuberculosis
GAGLLTPQTLSTIT

SEQ ID NO: 74382 - protein, 14 aa, Mycobacterium tuberculosis
AGLLTPQTLSTITR

SEQ ID NO: 74383 - protein, 14 aa, Mycobacterium tuberculosis
GLLTPQTLSTITRI

SEQ ID NO: 74384 - protein, 14 aa, Mycobacterium tuberculosis
LLTPQTLSTITRIF

SEQ ID NO: 74385 - protein, 14 aa, Mycobacterium tuberculosis
LTPQTLSTITRIFP

SEQ ID NO: 74386 - protein, 14 aa, Mycobacterium tuberculosis
TPQTLSTITRIFPA

SEQ ID NO: 74387 - protein, 14 aa, Mycobacterium tuberculosis
PQTLSTITRIFPAH

SEQ ID NO: 74388 - protein, 14 aa, Mycobacterium tuberculosis
QTLSTITRIFPAHR

SEQ ID NO: 74389 - protein, 14 aa, Mycobacterium tuberculosis
TLSTITRIFPAHRR

SEQ ID NO: 74390 - protein, 14 aa, Mycobacterium tuberculosis
LSTITRIFPAHRRG

SEQ ID NO: 74391 - protein, 14 aa, Mycobacterium tuberculosis
STITRIFPAHRRGV

SEQ ID NO: 74392 - protein, 14 aa, Mycobacterium tuberculosis
TITRIFPAHRRGVA

SEQ ID NO: 74393 - protein, 14 aa, Mycobacterium tuberculosis
ITRIFPAHRRGVAL

SEQ ID NO: 74394 - protein, 14 aa, Mycobacterium tuberculosis
TRIFPAHRRGVALG

SEQ ID NO: 74395 - protein, 14 aa, Mycobacterium tuberculosis
RIFPAHRRGVALGA

SEQ ID NO: 74396 - protein, 14 aa, Mycobacterium tuberculosis
IFPAHRRGVALGAW

SEQ ID NO: 74397 - protein, 14 aa, Mycobacterium tuberculosis
FPAHRRGVALGAWG

SEQ ID NO: 74398 - protein, 14 aa, Mycobacterium tuberculosis
PAHRRGVALGAWGT

SEQ ID NO: 74399 - protein, 14 aa, Mycobacterium tuberculosis
AHRRGVALGAWGTV

SEQ ID NO: 74400 - protein, 14 aa, Mycobacterium tuberculosis
HRRGVALGAWGTVA

SEQ ID NO: 74401 - protein, 14 aa, Mycobacterium tuberculosis
RRGVALGAWGTVAS

SEQ ID NO: 74402 - protein, 14 aa, Mycobacterium tuberculosis
RGVALGAWGTVASV

SEQ ID NO: 74403 - protein, 14 aa, Mycobacterium tuberculosis
GVALGAWGTVASVA

SEQ ID NO: 74404 - protein, 14 aa, Mycobacterium tuberculosis
VALGAWGTVASVAS

SEQ ID NO: 74405 - protein, 14 aa, Mycobacterium tuberculosis
ALGAWGTVASVASL

SEQ ID NO: 74406 - protein, 14 aa, Mycobacterium tuberculosis
LGAWGTVASVASLV

SEQ ID NO: 74407 - protein, 14 aa, Mycobacterium tuberculosis
GAWGTVASVASLVG

SEQ ID NO: 74408 - protein, 14 aa, Mycobacterium tuberculosis
AWGTVASVASLVGP

SEQ ID NO: 74409 - protein, 14 aa, Mycobacterium tuberculosis
WGTVASVASLVGPL

SEQ ID NO: 74410 - protein, 14 aa, Mycobacterium tuberculosis
GTVASVASLVGPLA

SEQ ID NO: 74411 - protein, 14 aa, Mycobacterium tuberculosis
TVASVASLVGPLAG

SEQ ID NO: 74412 - protein, 14 aa, Mycobacterium tuberculosis
VASVASLVGPLAGG

SEQ ID NO: 74413 - protein, 14 aa, Mycobacterium tuberculosis
ASVASLVGPLAGGA

SEQ ID NO: 74414 - protein, 14 aa, Mycobacterium tuberculosis
SVASLVGPLAGGAL

SEQ ID NO: 74415 - protein, 14 aa, Mycobacterium tuberculosis
VASLVGPLAGGALV

SEQ ID NO: 74416 - protein, 14 aa, Mycobacterium tuberculosis
ASLVGPLAGGALVD

SEQ ID NO: 74417 - protein, 14 aa, Mycobacterium tuberculosis
SLVGPLAGGALVDS

SEQ ID NO: 74418 - protein, 14 aa, Mycobacterium tuberculosis
LVGPLAGGALVDSM

SEQ ID NO: 74419 - protein, 14 aa, Mycobacterium tuberculosis
VGPLAGGALVDSMG

SEQ ID NO: 74420 - protein, 14 aa, Mycobacterium tuberculosis
GPLAGGALVDSMGW

SEQ ID NO: 74421 - protein, 14 aa, Mycobacterium tuberculosis
PLAGGALVDSMGWE

SEQ ID NO: 74422 - protein, 14 aa, Mycobacterium tuberculosis
LAGGALVDSMGWEW

SEQ ID NO: 74423 - protein, 14 aa, Mycobacterium tuberculosis
AGGALVDSMGWEWI

SEQ ID NO: 74424 - protein, 14 aa, Mycobacterium tuberculosis
GGALVDSMGWEWIF

SEQ ID NO: 74425 - protein, 14 aa, Mycobacterium tuberculosis
GALVDSMGWEWIFF

SEQ ID NO: 74426 - protein, 14 aa, Mycobacterium tuberculosis
ALVDSMGWEWIFFV

SEQ ID NO: 74427 - protein, 14 aa, Mycobacterium tuberculosis
LVDSMGWEWIFFVN

SEQ ID NO: 74428 - protein, 14 aa, Mycobacterium tuberculosis
VDSMGWEWIFFVNV

SEQ ID NO: 74429 - protein, 14 aa, Mycobacterium tuberculosis
DSMGWEWIFFVNVP

SEQ ID NO: 74430 - protein, 14 aa, Mycobacterium tuberculosis
SMGWEWIFFVNVPV

SEQ ID NO: 74431 - protein, 14 aa, Mycobacterium tuberculosis
MGWEWIFFVNVPVG

SEQ ID NO: 74432 - protein, 14 aa, Mycobacterium tuberculosis
GWEWIFFVNVPVGV

SEQ ID NO: 74433 - protein, 14 aa, Mycobacterium tuberculosis
WEWIFFVNVPVGVI

SEQ ID NO: 74434 - protein, 14 aa, Mycobacterium tuberculosis
EWIFFVNVPVGVIG

SEQ ID NO: 74435 - protein, 14 aa, Mycobacterium tuberculosis
WIFFVNVPVGVIGL

SEQ ID NO: 74436 - protein, 14 aa, Mycobacterium tuberculosis
IFFVNVPVGVIGLI

SEQ ID NO: 74437 - protein, 14 aa, Mycobacterium tuberculosis
FFVNVPVGVIGLIL

SEQ ID NO: 74438 - protein, 14 aa, Mycobacterium tuberculosis
FVNVPVGVIGLILA

SEQ ID NO: 74439 - protein, 14 aa, Mycobacterium tuberculosis
VNVPVGVIGLILAA

SEQ ID NO: 74440 - protein, 14 aa, Mycobacterium tuberculosis
NVPVGVIGLILAAY

SEQ ID NO: 74441 - protein, 14 aa, Mycobacterium tuberculosis
VPVGVIGLILAAYL

SEQ ID NO: 74442 - protein, 14 aa, Mycobacterium tuberculosis
PVGVIGLILAAYLI

SEQ ID NO: 74443 - protein, 14 aa, Mycobacterium tuberculosis
VGVIGLILAAYLIP

SEQ ID NO: 74444 - protein, 14 aa, Mycobacterium tuberculosis
GVIGLILAAYLIPA

SEQ ID NO: 74445 - protein, 14 aa, Mycobacterium tuberculosis
VIGLILAAYLIPAL

SEQ ID NO: 74446 - protein, 14 aa, Mycobacterium tuberculosis
IGLILAAYLIPALP

SEQ ID NO: 74447 - protein, 14 aa, Mycobacterium tuberculosis
GLILAAYLIPALPH

SEQ ID NO: 74448 - protein, 14 aa, Mycobacterium tuberculosis
LILAAYLIPALPHH

SEQ ID NO: 74449 - protein, 14 aa, Mycobacterium tuberculosis
ILAAYLIPALPHHP

SEQ ID NO: 74450 - protein, 14 aa, Mycobacterium tuberculosis
LAAYLIPALPHHPH

SEQ ID NO: 74451 - protein, 14 aa, Mycobacterium tuberculosis
AAYLIPALPHHPHR

SEQ ID NO: 74452 - protein, 14 aa, Mycobacterium tuberculosis
AYLIPALPHHPHRF

SEQ ID NO: 74453 - protein, 14 aa, Mycobacterium tuberculosis
YLIPALPHHPHRFD

SEQ ID NO: 74454 - protein, 14 aa, Mycobacterium tuberculosis
LIPALPHHPHRFDW

SEQ ID NO: 74455 - protein, 14 aa, Mycobacterium tuberculosis
IPALPHHPHRFDWF

SEQ ID NO: 74456 - protein, 14 aa, Mycobacterium tuberculosis
PALPHHPHRFDWFG

SEQ ID NO: 74457 - protein, 14 aa, Mycobacterium tuberculosis
ALPHHPHRFDWFGV

SEQ ID NO: 74458 - protein, 14 aa, Mycobacterium tuberculosis
LPHHPHRFDWFGVG

SEQ ID NO: 74459 - protein, 14 aa, Mycobacterium tuberculosis
PHHPHRFDWFGVGL

SEQ ID NO: 74460 - protein, 14 aa, Mycobacterium tuberculosis
HHPHRFDWFGVGLS

SEQ ID NO: 74461 - protein, 14 aa, Mycobacterium tuberculosis
HPHRFDWFGVGLSG

SEQ ID NO: 74462 - protein, 14 aa, Mycobacterium tuberculosis
PHRFDWFGVGLSGA

SEQ ID NO: 74463 - protein, 14 aa, Mycobacterium tuberculosis
HRFDWFGVGLSGAG

SEQ ID NO: 74464 - protein, 14 aa, Mycobacterium tuberculosis
RFDWFGVGLSGAGM

SEQ ID NO: 74465 - protein, 14 aa, Mycobacterium tuberculosis
FDWFGVGLSGAGMF

SEQ ID NO: 74466 - protein, 14 aa, Mycobacterium tuberculosis
DWFGVGLSGAGMFL

SEQ ID NO: 74467 - protein, 14 aa, Mycobacterium tuberculosis
WFGVGLSGAGMFLI

SEQ ID NO: 74468 - protein, 14 aa, Mycobacterium tuberculosis
FGVGLSGAGMFLIV

SEQ ID NO: 74469 - protein, 14 aa, Mycobacterium tuberculosis
GVGLSGAGMFLIVF

SEQ ID NO: 74470 - protein, 14 aa, Mycobacterium tuberculosis
VGLSGAGMFLIVFG

SEQ ID NO: 74471 - protein, 14 aa, Mycobacterium tuberculosis
GLSGAGMFLIVFGL

SEQ ID NO: 74472 - protein, 14 aa, Mycobacterium tuberculosis
LSGAGMFLIVFGLQ

SEQ ID NO: 74473 - protein, 14 aa, Mycobacterium tuberculosis
SGAGMFLIVFGLQQ

SEQ ID NO: 74474 - protein, 14 aa, Mycobacterium tuberculosis
GAGMFLIVFGLQQG

SEQ ID NO: 74475 - protein, 14 aa, Mycobacterium tuberculosis
AGMFLIVFGLQQGQ

SEQ ID NO: 74476 - protein, 14 aa, Mycobacterium tuberculosis
GMFLIVFGLQQGQS

SEQ ID NO: 74477 - protein, 14 aa, Mycobacterium tuberculosis
MFLIVFGLQQGQSA

SEQ ID NO: 74478 - protein, 14 aa, Mycobacterium tuberculosis
FLIVFGLQQGQSAN

SEQ ID NO: 74479 - protein, 14 aa, Mycobacterium tuberculosis
LIVFGLQQGQSANW

SEQ ID NO: 74480 - protein, 14 aa, Mycobacterium tuberculosis
IVFGLQQGQSANWQ

SEQ ID NO: 74481 - protein, 14 aa, Mycobacterium tuberculosis
VFGLQQGQSANWQP

SEQ ID NO: 74482 - protein, 14 aa, Mycobacterium tuberculosis
FGLQQGQSANWQPW

SEQ ID NO: 74483 - protein, 14 aa, Mycobacterium tuberculosis
GLQQGQSANWQPWI

SEQ ID NO: 74484 - protein, 14 aa, Mycobacterium tuberculosis
LQQGQSANWQPWIW

SEQ ID NO: 74485 - protein, 14 aa, Mycobacterium tuberculosis
QQGQSANWQPWIWA

SEQ ID NO: 74486 - protein, 14 aa, Mycobacterium tuberculosis
QGQSANWQPWIWAV

SEQ ID NO: 74487 - protein, 14 aa, Mycobacterium tuberculosis
GQSANWQPWIWAVI

SEQ ID NO: 74488 - protein, 14 aa, Mycobacterium tuberculosis
QSANWQPWIWAVIV

SEQ ID NO: 74489 - protein, 14 aa, Mycobacterium tuberculosis
SANWQPWIWAVIVG

SEQ ID NO: 74490 - protein, 14 aa, Mycobacterium tuberculosis
ANWQPWIWAVIVGG

SEQ ID NO: 74491 - protein, 14 aa, Mycobacterium tuberculosis
NWQPWIWAVIVGGI

SEQ ID NO: 74492 - protein, 14 aa, Mycobacterium tuberculosis
WQPWIWAVIVGGIG

SEQ ID NO: 74493 - protein, 14 aa, Mycobacterium tuberculosis
QPWIWAVIVGGIGF

SEQ ID NO: 74494 - protein, 14 aa, Mycobacterium tuberculosis
PWIWAVIVGGIGFM

SEQ ID NO: 74495 - protein, 14 aa, Mycobacterium tuberculosis
WIWAVIVGGIGFMS

SEQ ID NO: 74496 - protein, 14 aa, Mycobacterium tuberculosis
IWAVIVGGIGFMSL

SEQ ID NO: 74497 - protein, 14 aa, Mycobacterium tuberculosis
WAVIVGGIGFMSLF

SEQ ID NO: 74498 - protein, 14 aa, Mycobacterium tuberculosis
AVIVGGIGFMSLFV

SEQ ID NO: 74499 - protein, 14 aa, Mycobacterium tuberculosis
VIVGGIGFMSLFVY

SEQ ID NO: 74500 - protein, 14 aa, Mycobacterium tuberculosis
IVGGIGFMSLFVYW

SEQ ID NO: 74501 - protein, 14 aa, Mycobacterium tuberculosis
VGGIGFMSLFVYWQ

SEQ ID NO: 74502 - protein, 14 aa, Mycobacterium tuberculosis
GGIGFMSLFVYWQA

SEQ ID NO: 74503 - protein, 14 aa, Mycobacterium tuberculosis
GIGFMSLFVYWQAR

SEQ ID NO: 74504 - protein, 14 aa, Mycobacterium tuberculosis
IGFMSLFVYWQARN

SEQ ID NO: 74505 - protein, 14 aa, Mycobacterium tuberculosis
GFMSLFVYWQARNA

SEQ ID NO: 74506 - protein, 14 aa, Mycobacterium tuberculosis
FMSLFVYWQARNAR

SEQ ID NO: 74507 - protein, 14 aa, Mycobacterium tuberculosis
MSLFVYWQARNARE

SEQ ID NO: 74508 - protein, 14 aa, Mycobacterium tuberculosis
SLFVYWQARNAREP

SEQ ID NO: 74509 - protein, 14 aa, Mycobacterium tuberculosis
LFVYWQARNAREPL

SEQ ID NO: 74510 - protein, 14 aa, Mycobacterium tuberculosis
FVYWQARNAREPLI

SEQ ID NO: 74511 - protein, 14 aa, Mycobacterium tuberculosis
VYWQARNAREPLIP

SEQ ID NO: 74512 - protein, 14 aa, Mycobacterium tuberculosis
YWQARNAREPLIPL

SEQ ID NO: 74513 - protein, 14 aa, Mycobacterium tuberculosis
WQARNAREPLIPLE

SEQ ID NO: 74514 - protein, 14 aa, Mycobacterium tuberculosis
QARNAREPLIPLEV

SEQ ID NO: 74515 - protein, 14 aa, Mycobacterium tuberculosis
ARNAREPLIPLEVF

SEQ ID NO: 74516 - protein, 14 aa, Mycobacterium tuberculosis
RNAREPLIPLEVFN

SEQ ID NO: 74517 - protein, 14 aa, Mycobacterium tuberculosis
NAREPLIPLEVFND

SEQ ID NO: 74518 - protein, 14 aa, Mycobacterium tuberculosis
AREPLIPLEVFNDR

SEQ ID NO: 74519 - protein, 14 aa, Mycobacterium tuberculosis
REPLIPLEVFNDRN

SEQ ID NO: 74520 - protein, 14 aa, Mycobacterium tuberculosis
EPLIPLEVFNDRNF

SEQ ID NO: 74521 - protein, 14 aa, Mycobacterium tuberculosis
PLIPLEVFNDRNFS

SEQ ID NO: 74522 - protein, 14 aa, Mycobacterium tuberculosis
LIPLEVFNDRNFSL

SEQ ID NO: 74523 - protein, 14 aa, Mycobacterium tuberculosis
IPLEVFNDRNFSLS

SEQ ID NO: 74524 - protein, 14 aa, Mycobacterium tuberculosis
PLEVFNDRNFSLSN

SEQ ID NO: 74525 - protein, 14 aa, Mycobacterium tuberculosis
LEVFNDRNFSLSNL

SEQ ID NO: 74526 - protein, 14 aa, Mycobacterium tuberculosis
EVFNDRNFSLSNLR

SEQ ID NO: 74527 - protein, 14 aa, Mycobacterium tuberculosis
VFNDRNFSLSNLRI

SEQ ID NO: 74528 - protein, 14 aa, Mycobacterium tuberculosis
FNDRNFSLSNLRIA

SEQ ID NO: 74529 - protein, 14 aa, Mycobacterium tuberculosis
NDRNFSLSNLRIAI

SEQ ID NO: 74530 - protein, 14 aa, Mycobacterium tuberculosis
DRNFSLSNLRIAII

SEQ ID NO: 74531 - protein, 14 aa, Mycobacterium tuberculosis
RNFSLSNLRIAIIA

SEQ ID NO: 74532 - protein, 14 aa, Mycobacterium tuberculosis
NFSLSNLRIAIIAF

SEQ ID NO: 74533 - protein, 14 aa, Mycobacterium tuberculosis
FSLSNLRIAIIAFA

SEQ ID NO: 74534 - protein, 14 aa, Mycobacterium tuberculosis
SLSNLRIAIIAFAG

SEQ ID NO: 74535 - protein, 14 aa, Mycobacterium tuberculosis
LSNLRIAIIAFAGT

SEQ ID NO: 74536 - protein, 14 aa, Mycobacterium tuberculosis
SNLRIAIIAFAGTG

SEQ ID NO: 74537 - protein, 14 aa, Mycobacterium tuberculosis
NLRIAIIAFAGTGM

SEQ ID NO: 74538 - protein, 14 aa, Mycobacterium tuberculosis
LRIAIIAFAGTGMM

SEQ ID NO: 74539 - protein, 14 aa, Mycobacterium tuberculosis
RIAIIAFAGTGMML

SEQ ID NO: 74540 - protein, 14 aa, Mycobacterium tuberculosis
IAIIAFAGTGMMLP

SEQ ID NO: 74541 - protein, 14 aa, Mycobacterium tuberculosis
AIIAFAGTGMMLPV

SEQ ID NO: 74542 - protein, 14 aa, Mycobacterium tuberculosis
IIAFAGTGMMLPVT

SEQ ID NO: 74543 - protein, 14 aa, Mycobacterium tuberculosis
IAFAGTGMMLPVTF

SEQ ID NO: 74544 - protein, 14 aa, Mycobacterium tuberculosis
AFAGTGMMLPVTFY

SEQ ID NO: 74545 - protein, 14 aa, Mycobacterium tuberculosis
FAGTGMMLPVTFYA

SEQ ID NO: 74546 - protein, 14 aa, Mycobacterium tuberculosis
AGTGMMLPVTFYAQ

SEQ ID NO: 74547 - protein, 14 aa, Mycobacterium tuberculosis
GTGMMLPVTFYAQA

SEQ ID NO: 74548 - protein, 14 aa, Mycobacterium tuberculosis
TGMMLPVTFYAQAV

SEQ ID NO: 74549 - protein, 14 aa, Mycobacterium tuberculosis
GMMLPVTFYAQAVC

SEQ ID NO: 74550 - protein, 14 aa, Mycobacterium tuberculosis
MMLPVTFYAQAVCG

SEQ ID NO: 74551 - protein, 14 aa, Mycobacterium tuberculosis
MLPVTFYAQAVCGL

SEQ ID NO: 74552 - protein, 14 aa, Mycobacterium tuberculosis
LPVTFYAQAVCGLS

SEQ ID NO: 74553 - protein, 14 aa, Mycobacterium tuberculosis
PVTFYAQAVCGLSP

SEQ ID NO: 74554 - protein, 14 aa, Mycobacterium tuberculosis
VTFYAQAVCGLSPT

SEQ ID NO: 74555 - protein, 14 aa, Mycobacterium tuberculosis
TFYAQAVCGLSPTH

SEQ ID NO: 74556 - protein, 14 aa, Mycobacterium tuberculosis
FYAQAVCGLSPTHT

SEQ ID NO: 74557 - protein, 14 aa, Mycobacterium tuberculosis
YAQAVCGLSPTHTA

SEQ ID NO: 74558 - protein, 14 aa, Mycobacterium tuberculosis
AQAVCGLSPTHTAV

SEQ ID NO: 74559 - protein, 14 aa, Mycobacterium tuberculosis
QAVCGLSPTHTAVL

SEQ ID NO: 74560 - protein, 14 aa, Mycobacterium tuberculosis
AVCGLSPTHTAVLF

SEQ ID NO: 74561 - protein, 14 aa, Mycobacterium tuberculosis
VCGLSPTHTAVLFA

SEQ ID NO: 74562 - protein, 14 aa, Mycobacterium tuberculosis
CGLSPTHTAVLFAP

SEQ ID NO: 74563 - protein, 14 aa, Mycobacterium tuberculosis
GLSPTHTAVLFAPT

SEQ ID NO: 74564 - protein, 14 aa, Mycobacterium tuberculosis
LSPTHTAVLFAPTA

SEQ ID NO: 74565 - protein, 14 aa, Mycobacterium tuberculosis
SPTHTAVLFAPTAI

SEQ ID NO: 74566 - protein, 14 aa, Mycobacterium tuberculosis
PTHTAVLFAPTAIV

SEQ ID NO: 74567 - protein, 14 aa, Mycobacterium tuberculosis
THTAVLFAPTAIVG

SEQ ID NO: 74568 - protein, 14 aa, Mycobacterium tuberculosis
HTAVLFAPTAIVGG

SEQ ID NO: 74569 - protein, 14 aa, Mycobacterium tuberculosis
TAVLFAPTAIVGGV

SEQ ID NO: 74570 - protein, 14 aa, Mycobacterium tuberculosis
AVLFAPTAIVGGVL

SEQ ID NO: 74571 - protein, 14 aa, Mycobacterium tuberculosis
VLFAPTAIVGGVLA

SEQ ID NO: 74572 - protein, 14 aa, Mycobacterium tuberculosis
LFAPTAIVGGVLAP

SEQ ID NO: 74573 - protein, 14 aa, Mycobacterium tuberculosis
FAPTAIVGGVLAPF

SEQ ID NO: 74574 - protein, 14 aa, Mycobacterium tuberculosis
APTAIVGGVLAPFV

SEQ ID NO: 74575 - protein, 14 aa, Mycobacterium tuberculosis
PTAIVGGVLAPFVG

SEQ ID NO: 74576 - protein, 14 aa, Mycobacterium tuberculosis
TAIVGGVLAPFVGM

SEQ ID NO: 74577 - protein, 14 aa, Mycobacterium tuberculosis
AIVGGVLAPFVGMI

SEQ ID NO: 74578 - protein, 14 aa, Mycobacterium tuberculosis
IVGGVLAPFVGMII

SEQ ID NO: 74579 - protein, 14 aa, Mycobacterium tuberculosis
VGGVLAPFVGMIID

SEQ ID NO: 74580 - protein, 14 aa, Mycobacterium tuberculosis
GGVLAPFVGMIIDR

SEQ ID NO: 74581 - protein, 14 aa, Mycobacterium tuberculosis
GVLAPFVGMIIDRS

SEQ ID NO: 74582 - protein, 14 aa, Mycobacterium tuberculosis
VLAPFVGMIIDRSH

SEQ ID NO: 74583 - protein, 14 aa, Mycobacterium tuberculosis
LAPFVGMIIDRSHP

SEQ ID NO: 74584 - protein, 14 aa, Mycobacterium tuberculosis
APFVGMIIDRSHPL

SEQ ID NO: 74585 - protein, 14 aa, Mycobacterium tuberculosis
PFVGMIIDRSHPLC

SEQ ID NO: 74586 - protein, 14 aa, Mycobacterium tuberculosis
FVGMIIDRSHPLCV

SEQ ID NO: 74587 - protein, 14 aa, Mycobacterium tuberculosis
VGMIIDRSHPLCVL

SEQ ID NO: 74588 - protein, 14 aa, Mycobacterium tuberculosis
GMIIDRSHPLCVLG

SEQ ID NO: 74589 - protein, 14 aa, Mycobacterium tuberculosis
MIIDRSHPLCVLGF

SEQ ID NO: 74590 - protein, 14 aa, Mycobacterium tuberculosis
IIDRSHPLCVLGFG

SEQ ID NO: 74591 - protein, 14 aa, Mycobacterium tuberculosis
IDRSHPLCVLGFGF

SEQ ID NO: 74592 - protein, 14 aa, Mycobacterium tuberculosis
DRSHPLCVLGFGFS

SEQ ID NO: 74593 - protein, 14 aa, Mycobacterium tuberculosis
RSHPLCVLGFGFSV

SEQ ID NO: 74594 - protein, 14 aa, Mycobacterium tuberculosis
SHPLCVLGFGFSVL

SEQ ID NO: 74595 - protein, 14 aa, Mycobacterium tuberculosis
HPLCVLGFGFSVLA

SEQ ID NO: 74596 - protein, 14 aa, Mycobacterium tuberculosis
PLCVLGFGFSVLAI

SEQ ID NO: 74597 - protein, 14 aa, Mycobacterium tuberculosis
LCVLGFGFSVLAIA

SEQ ID NO: 74598 - protein, 14 aa, Mycobacterium tuberculosis
CVLGFGFSVLAIAM

SEQ ID NO: 74599 - protein, 14 aa, Mycobacterium tuberculosis
VLGFGFSVLAIAMT

SEQ ID NO: 74600 - protein, 14 aa, Mycobacterium tuberculosis
LGFGFSVLAIAMTW

SEQ ID NO: 74601 - protein, 14 aa, Mycobacterium tuberculosis
GFGFSVLAIAMTWL

SEQ ID NO: 74602 - protein, 14 aa, Mycobacterium tuberculosis
FGFSVLAIAMTWLL

SEQ ID NO: 74603 - protein, 14 aa, Mycobacterium tuberculosis
GFSVLAIAMTWLLC

SEQ ID NO: 74604 - protein, 14 aa, Mycobacterium tuberculosis
FSVLAIAMTWLLCE

SEQ ID NO: 74605 - protein, 14 aa, Mycobacterium tuberculosis
SVLAIAMTWLLCEM

SEQ ID NO: 74606 - protein, 14 aa, Mycobacterium tuberculosis
VLAIAMTWLLCEMA

SEQ ID NO: 74607 - protein, 14 aa, Mycobacterium tuberculosis
LAIAMTWLLCEMAP

SEQ ID NO: 74608 - protein, 14 aa, Mycobacterium tuberculosis
AIAMTWLLCEMAPG

SEQ ID NO: 74609 - protein, 14 aa, Mycobacterium tuberculosis
IAMTWLLCEMAPGT

SEQ ID NO: 74610 - protein, 14 aa, Mycobacterium tuberculosis
AMTWLLCEMAPGTP

SEQ ID NO: 74611 - protein, 14 aa, Mycobacterium tuberculosis
MTWLLCEMAPGTPI

SEQ ID NO: 74612 - protein, 14 aa, Mycobacterium tuberculosis
TWLLCEMAPGTPIW

SEQ ID NO: 74613 - protein, 14 aa, Mycobacterium tuberculosis
WLLCEMAPGTPIWR

SEQ ID NO: 74614 - protein, 14 aa, Mycobacterium tuberculosis
LLCEMAPGTPIWRL

SEQ ID NO: 74615 - protein, 14 aa, Mycobacterium tuberculosis
LCEMAPGTPIWRLV

SEQ ID NO: 74616 - protein, 14 aa, Mycobacterium tuberculosis
CEMAPGTPIWRLVL

SEQ ID NO: 74617 - protein, 14 aa, Mycobacterium tuberculosis
EMAPGTPIWRLVLP

SEQ ID NO: 74618 - protein, 14 aa, Mycobacterium tuberculosis
MAPGTPIWRLVLPF

SEQ ID NO: 74619 - protein, 14 aa, Mycobacterium tuberculosis
APGTPIWRLVLPFI

SEQ ID NO: 74620 - protein, 14 aa, Mycobacterium tuberculosis
PGTPIWRLVLPFIA

SEQ ID NO: 74621 - protein, 14 aa, Mycobacterium tuberculosis
GTPIWRLVLPFIAL

SEQ ID NO: 74622 - protein, 14 aa, Mycobacterium tuberculosis
TPIWRLVLPFIALG

SEQ ID NO: 74623 - protein, 14 aa, Mycobacterium tuberculosis
PIWRLVLPFIALGV

SEQ ID NO: 74624 - protein, 14 aa, Mycobacterium tuberculosis
IWRLVLPFIALGVA

SEQ ID NO: 74625 - protein, 14 aa, Mycobacterium tuberculosis
WRLVLPFIALGVAG

SEQ ID NO: 74626 - protein, 14 aa, Mycobacterium tuberculosis
RLVLPFIALGVAGA

SEQ ID NO: 74627 - protein, 14 aa, Mycobacterium tuberculosis
LVLPFIALGVAGAF

SEQ ID NO: 74628 - protein, 14 aa, Mycobacterium tuberculosis
VLPFIALGVAGAFV

SEQ ID NO: 74629 - protein, 14 aa, Mycobacterium tuberculosis
LPFIALGVAGAFVW

SEQ ID NO: 74630 - protein, 14 aa, Mycobacterium tuberculosis
PFIALGVAGAFVWS

SEQ ID NO: 74631 - protein, 14 aa, Mycobacterium tuberculosis
FIALGVAGAFVWSP

SEQ ID NO: 74632 - protein, 14 aa, Mycobacterium tuberculosis
IALGVAGAFVWSPL

SEQ ID NO: 74633 - protein, 14 aa, Mycobacterium tuberculosis
ALGVAGAFVWSPLT

SEQ ID NO: 74634 - protein, 14 aa, Mycobacterium tuberculosis
LGVAGAFVWSPLTV

SEQ ID NO: 74635 - protein, 14 aa, Mycobacterium tuberculosis
GVAGAFVWSPLTVT

SEQ ID NO: 74636 - protein, 14 aa, Mycobacterium tuberculosis
VAGAFVWSPLTVTA

SEQ ID NO: 74637 - protein, 14 aa, Mycobacterium tuberculosis
AGAFVWSPLTVTAT

SEQ ID NO: 74638 - protein, 14 aa, Mycobacterium tuberculosis
GAFVWSPLTVTATR

SEQ ID NO: 74639 - protein, 14 aa, Mycobacterium tuberculosis
AFVWSPLTVTATRN

SEQ ID NO: 74640 - protein, 14 aa, Mycobacterium tuberculosis
FVWSPLTVTATRNL

SEQ ID NO: 74641 - protein, 14 aa, Mycobacterium tuberculosis
VWSPLTVTATRNLR

SEQ ID NO: 74642 - protein, 14 aa, Mycobacterium tuberculosis
WSPLTVTATRNLRP

SEQ ID NO: 74643 - protein, 14 aa, Mycobacterium tuberculosis
SPLTVTATRNLRPH

SEQ ID NO: 74644 - protein, 14 aa, Mycobacterium tuberculosis
PLTVTATRNLRPHL

SEQ ID NO: 74645 - protein, 14 aa, Mycobacterium tuberculosis
LTVTATRNLRPHLA

SEQ ID NO: 74646 - protein, 14 aa, Mycobacterium tuberculosis
TVTATRNLRPHLAG

SEQ ID NO: 74647 - protein, 14 aa, Mycobacterium tuberculosis
VTATRNLRPHLAGA

SEQ ID NO: 74648 - protein, 14 aa, Mycobacterium tuberculosis
TATRNLRPHLAGAS

SEQ ID NO: 74649 - protein, 14 aa, Mycobacterium tuberculosis
ATRNLRPHLAGASS

SEQ ID NO: 74650 - protein, 14 aa, Mycobacterium tuberculosis
TRNLRPHLAGASSG

SEQ ID NO: 74651 - protein, 14 aa, Mycobacterium tuberculosis
RNLRPHLAGASSGV

SEQ ID NO: 74652 - protein, 14 aa, Mycobacterium tuberculosis
NLRPHLAGASSGVF

SEQ ID NO: 74653 - protein, 14 aa, Mycobacterium tuberculosis
LRPHLAGASSGVFN

SEQ ID NO: 74654 - protein, 14 aa, Mycobacterium tuberculosis
RPHLAGASSGVFNA

SEQ ID NO: 74655 - protein, 14 aa, Mycobacterium tuberculosis
PHLAGASSGVFNAV

SEQ ID NO: 74656 - protein, 14 aa, Mycobacterium tuberculosis
HLAGASSGVFNAVR

SEQ ID NO: 74657 - protein, 14 aa, Mycobacterium tuberculosis
LAGASSGVFNAVRQ

SEQ ID NO: 74658 - protein, 14 aa, Mycobacterium tuberculosis
AGASSGVFNAVRQL

SEQ ID NO: 74659 - protein, 14 aa, Mycobacterium tuberculosis
GASSGVFNAVRQLG

SEQ ID NO: 74660 - protein, 14 aa, Mycobacterium tuberculosis
ASSGVFNAVRQLGA

SEQ ID NO: 74661 - protein, 14 aa, Mycobacterium tuberculosis
SSGVFNAVRQLGAV

SEQ ID NO: 74662 - protein, 14 aa, Mycobacterium tuberculosis
SGVFNAVRQLGAVL

SEQ ID NO: 74663 - protein, 14 aa, Mycobacterium tuberculosis
GVFNAVRQLGAVLG

SEQ ID NO: 74664 - protein, 14 aa, Mycobacterium tuberculosis
VFNAVRQLGAVLGS

SEQ ID NO: 74665 - protein, 14 aa, Mycobacterium tuberculosis
FNAVRQLGAVLGSA

SEQ ID NO: 74666 - protein, 14 aa, Mycobacterium tuberculosis
NAVRQLGAVLGSAS

SEQ ID NO: 74667 - protein, 14 aa, Mycobacterium tuberculosis
AVRQLGAVLGSASM

SEQ ID NO: 74668 - protein, 14 aa, Mycobacterium tuberculosis
VRQLGAVLGSASMA

SEQ ID NO: 74669 - protein, 14 aa, Mycobacterium tuberculosis
RQLGAVLGSASMAA

SEQ ID NO: 74670 - protein, 14 aa, Mycobacterium tuberculosis
QLGAVLGSASMAAF

SEQ ID NO: 74671 - protein, 14 aa, Mycobacterium tuberculosis
LGAVLGSASMAAFM

SEQ ID NO: 74672 - protein, 14 aa, Mycobacterium tuberculosis
GAVLGSASMAAFMT

SEQ ID NO: 74673 - protein, 14 aa, Mycobacterium tuberculosis
AVLGSASMAAFMTS

SEQ ID NO: 74674 - protein, 14 aa, Mycobacterium tuberculosis
VLGSASMAAFMTSR

SEQ ID NO: 74675 - protein, 14 aa, Mycobacterium tuberculosis
LGSASMAAFMTSRI

SEQ ID NO: 74676 - protein, 14 aa, Mycobacterium tuberculosis
GSASMAAFMTSRIA

SEQ ID NO: 74677 - protein, 14 aa, Mycobacterium tuberculosis
SASMAAFMTSRIAA

SEQ ID NO: 74678 - protein, 14 aa, Mycobacterium tuberculosis
ASMAAFMTSRIAAE

SEQ ID NO: 74679 - protein, 14 aa, Mycobacterium tuberculosis
SMAAFMTSRIAAEM

SEQ ID NO: 74680 - protein, 14 aa, Mycobacterium tuberculosis
MAAFMTSRIAAEMP

SEQ ID NO: 74681 - protein, 14 aa, Mycobacterium tuberculosis
AAFMTSRIAAEMPG

SEQ ID NO: 74682 - protein, 14 aa, Mycobacterium tuberculosis
AFMTSRIAAEMPGG

SEQ ID NO: 74683 - protein, 14 aa, Mycobacterium tuberculosis
FMTSRIAAEMPGGV

SEQ ID NO: 74684 - protein, 14 aa, Mycobacterium tuberculosis
MTSRIAAEMPGGVD

SEQ ID NO: 74685 - protein, 14 aa, Mycobacterium tuberculosis
TSRIAAEMPGGVDA

SEQ ID NO: 74686 - protein, 14 aa, Mycobacterium tuberculosis
SRIAAEMPGGVDAL

SEQ ID NO: 74687 - protein, 14 aa, Mycobacterium tuberculosis
RIAAEMPGGVDALT

SEQ ID NO: 74688 - protein, 14 aa, Mycobacterium tuberculosis
IAAEMPGGVDALTG

SEQ ID NO: 74689 - protein, 14 aa, Mycobacterium tuberculosis
AAEMPGGVDALTGP

SEQ ID NO: 74690 - protein, 14 aa, Mycobacterium tuberculosis
AEMPGGVDALTGPA

SEQ ID NO: 74691 - protein, 14 aa, Mycobacterium tuberculosis
EMPGGVDALTGPAG

SEQ ID NO: 74692 - protein, 14 aa, Mycobacterium tuberculosis
MPGGVDALTGPAGQ

SEQ ID NO: 74693 - protein, 14 aa, Mycobacterium tuberculosis
PGGVDALTGPAGQD

SEQ ID NO: 74694 - protein, 14 aa, Mycobacterium tuberculosis
GGVDALTGPAGQDA

SEQ ID NO: 74695 - protein, 14 aa, Mycobacterium tuberculosis
GVDALTGPAGQDAT

SEQ ID NO: 74696 - protein, 14 aa, Mycobacterium tuberculosis
VDALTGPAGQDATV

SEQ ID NO: 74697 - protein, 14 aa, Mycobacterium tuberculosis
DALTGPAGQDATVL

SEQ ID NO: 74698 - protein, 14 aa, Mycobacterium tuberculosis
ALTGPAGQDATVLQ

SEQ ID NO: 74699 - protein, 14 aa, Mycobacterium tuberculosis
LTGPAGQDATVLQL

SEQ ID NO: 74700 - protein, 14 aa, Mycobacterium tuberculosis
TGPAGQDATVLQLP

SEQ ID NO: 74701 - protein, 14 aa, Mycobacterium tuberculosis
GPAGQDATVLQLPE

SEQ ID NO: 74702 - protein, 14 aa, Mycobacterium tuberculosis
PAGQDATVLQLPEF

SEQ ID NO: 74703 - protein, 14 aa, Mycobacterium tuberculosis
AGQDATVLQLPEFV

SEQ ID NO: 74704 - protein, 14 aa, Mycobacterium tuberculosis
GQDATVLQLPEFVR

SEQ ID NO: 74705 - protein, 14 aa, Mycobacterium tuberculosis
QDATVLQLPEFVRE

SEQ ID NO: 74706 - protein, 14 aa, Mycobacterium tuberculosis
DATVLQLPEFVREP

SEQ ID NO: 74707 - protein, 14 aa, Mycobacterium tuberculosis
ATVLQLPEFVREPF

SEQ ID NO: 74708 - protein, 14 aa, Mycobacterium tuberculosis
TVLQLPEFVREPFA

SEQ ID NO: 74709 - protein, 14 aa, Mycobacterium tuberculosis
VLQLPEFVREPFAA

SEQ ID NO: 74710 - protein, 14 aa, Mycobacterium tuberculosis
LQLPEFVREPFAAA

SEQ ID NO: 74711 - protein, 14 aa, Mycobacterium tuberculosis
QLPEFVREPFAAAM

SEQ ID NO: 74712 - protein, 14 aa, Mycobacterium tuberculosis
LPEFVREPFAAAMS

SEQ ID NO: 74713 - protein, 14 aa, Mycobacterium tuberculosis
PEFVREPFAAAMSQ

SEQ ID NO: 74714 - protein, 14 aa, Mycobacterium tuberculosis
EFVREPFAAAMSQS

SEQ ID NO: 74715 - protein, 14 aa, Mycobacterium tuberculosis
FVREPFAAAMSQSM

SEQ ID NO: 74716 - protein, 14 aa, Mycobacterium tuberculosis
VREPFAAAMSQSML

SEQ ID NO: 74717 - protein, 14 aa, Mycobacterium tuberculosis
REPFAAAMSQSMLL

SEQ ID NO: 74718 - protein, 14 aa, Mycobacterium tuberculosis
EPFAAAMSQSMLLP

SEQ ID NO: 74719 - protein, 14 aa, Mycobacterium tuberculosis
PFAAAMSQSMLLPA

SEQ ID NO: 74720 - protein, 14 aa, Mycobacterium tuberculosis
FAAAMSQSMLLPAF

SEQ ID NO: 74721 - protein, 14 aa, Mycobacterium tuberculosis
AAAMSQSMLLPAFV

SEQ ID NO: 74722 - protein, 14 aa, Mycobacterium tuberculosis
AAMSQSMLLPAFVA

SEQ ID NO: 74723 - protein, 14 aa, Mycobacterium tuberculosis
AMSQSMLLPAFVAL

SEQ ID NO: 74724 - protein, 14 aa, Mycobacterium tuberculosis
MSQSMLLPAFVALF

SEQ ID NO: 74725 - protein, 14 aa, Mycobacterium tuberculosis
SQSMLLPAFVALFG

SEQ ID NO: 74726 - protein, 14 aa, Mycobacterium tuberculosis
QSMLLPAFVALFGI

SEQ ID NO: 74727 - protein, 14 aa, Mycobacterium tuberculosis
SMLLPAFVALFGIV

SEQ ID NO: 74728 - protein, 14 aa, Mycobacterium tuberculosis
MLLPAFVALFGIVA

SEQ ID NO: 74729 - protein, 14 aa, Mycobacterium tuberculosis
LLPAFVALFGIVAA

SEQ ID NO: 74730 - protein, 14 aa, Mycobacterium tuberculosis
LPAFVALFGIVAAL

SEQ ID NO: 74731 - protein, 14 aa, Mycobacterium tuberculosis
PAFVALFGIVAALF

SEQ ID NO: 74732 - protein, 14 aa, Mycobacterium tuberculosis
AFVALFGIVAALFL

SEQ ID NO: 74733 - protein, 14 aa, Mycobacterium tuberculosis
FVALFGIVAALFLV

SEQ ID NO: 74734 - protein, 14 aa, Mycobacterium tuberculosis
VALFGIVAALFLVD

SEQ ID NO: 74735 - protein, 14 aa, Mycobacterium tuberculosis
ALFGIVAALFLVDF

SEQ ID NO: 74736 - protein, 14 aa, Mycobacterium tuberculosis
LFGIVAALFLVDFT

SEQ ID NO: 74737 - protein, 14 aa, Mycobacterium tuberculosis
FGIVAALFLVDFTG

SEQ ID NO: 74738 - protein, 14 aa, Mycobacterium tuberculosis
GIVAALFLVDFTGA

SEQ ID NO: 74739 - protein, 14 aa, Mycobacterium tuberculosis
IVAALFLVDFTGAA

SEQ ID NO: 74740 - protein, 14 aa, Mycobacterium tuberculosis
VAALFLVDFTGAAV

SEQ ID NO: 74741 - protein, 14 aa, Mycobacterium tuberculosis
AALFLVDFTGAAVA

SEQ ID NO: 74742 - protein, 14 aa, Mycobacterium tuberculosis
ALFLVDFTGAAVAK

SEQ ID NO: 74743 - protein, 14 aa, Mycobacterium tuberculosis
LFLVDFTGAAVAKE

SEQ ID NO: 74744 - protein, 14 aa, Mycobacterium tuberculosis
FLVDFTGAAVAKEP

SEQ ID NO: 74745 - protein, 14 aa, Mycobacterium tuberculosis
LVDFTGAAVAKEPL

SEQ ID NO: 74746 - protein, 14 aa, Mycobacterium tuberculosis
VDFTGAAVAKEPLP

SEQ ID NO: 74747 - protein, 14 aa, Mycobacterium tuberculosis
DFTGAAVAKEPLPE

SEQ ID NO: 74748 - protein, 14 aa, Mycobacterium tuberculosis
FTGAAVAKEPLPES

SEQ ID NO: 74749 - protein, 14 aa, Mycobacterium tuberculosis
TGAAVAKEPLPESD

SEQ ID NO: 74750 - protein, 14 aa, Mycobacterium tuberculosis
GAAVAKEPLPESDG

SEQ ID NO: 74751 - protein, 14 aa, Mycobacterium tuberculosis
AAVAKEPLPESDGD

SEQ ID NO: 74752 - protein, 14 aa, Mycobacterium tuberculosis
AVAKEPLPESDGDA

SEQ ID NO: 74753 - protein, 14 aa, Mycobacterium tuberculosis
VAKEPLPESDGDAD

SEQ ID NO: 74754 - protein, 14 aa, Mycobacterium tuberculosis
AKEPLPESDGDADD

SEQ ID NO: 74755 - protein, 14 aa, Mycobacterium tuberculosis
KEPLPESDGDADDD

SEQ ID NO: 74756 - protein, 14 aa, Mycobacterium tuberculosis
EPLPESDGDADDDD

SEQ ID NO: 74757 - protein, 14 aa, Mycobacterium tuberculosis
PLPESDGDADDDDY

SEQ ID NO: 74758 - protein, 14 aa, Mycobacterium tuberculosis
LPESDGDADDDDYV

SEQ ID NO: 74759 - protein, 14 aa, Mycobacterium tuberculosis
PESDGDADDDDYVE

SEQ ID NO: 74760 - protein, 14 aa, Mycobacterium tuberculosis
ESDGDADDDDYVEY

SEQ ID NO: 74761 - protein, 14 aa, Mycobacterium tuberculosis
SDGDADDDDYVEYI

SEQ ID NO: 74762 - protein, 14 aa, Mycobacterium tuberculosis
DGDADDDDYVEYIL

SEQ ID NO: 74763 - protein, 14 aa, Mycobacterium tuberculosis
GDADDDDYVEYILR

SEQ ID NO: 74764 - protein, 14 aa, Mycobacterium tuberculosis
DADDDDYVEYILRR

SEQ ID NO: 74765 - protein, 14 aa, Mycobacterium tuberculosis
ADDDDYVEYILRRE

SEQ ID NO: 74766 - protein, 14 aa, Mycobacterium tuberculosis
DDDDYVEYILRREP

SEQ ID NO: 74767 - protein, 14 aa, Mycobacterium tuberculosis
DDDYVEYILRREPE

SEQ ID NO: 74768 - protein, 14 aa, Mycobacterium tuberculosis
DDYVEYILRREPEE

SEQ ID NO: 74769 - protein, 14 aa, Mycobacterium tuberculosis
DYVEYILRREPEED

SEQ ID NO: 74770 - protein, 14 aa, Mycobacterium tuberculosis
YVEYILRREPEEDC

SEQ ID NO: 74771 - protein, 14 aa, Mycobacterium tuberculosis
VEYILRREPEEDCD

SEQ ID NO: 74772 - protein, 14 aa, Mycobacterium tuberculosis
EYILRREPEEDCDT

SEQ ID NO: 74773 - protein, 14 aa, Mycobacterium tuberculosis
YILRREPEEDCDTQ

SEQ ID NO: 74774 - protein, 14 aa, Mycobacterium tuberculosis
ILRREPEEDCDTQP

SEQ ID NO: 74775 - protein, 14 aa, Mycobacterium tuberculosis
LRREPEEDCDTQPL

SEQ ID NO: 74776 - protein, 14 aa, Mycobacterium tuberculosis
RREPEEDCDTQPLR

SEQ ID NO: 74777 - protein, 14 aa, Mycobacterium tuberculosis
REPEEDCDTQPLRA

SEQ ID NO: 74778 - protein, 14 aa, Mycobacterium tuberculosis
EPEEDCDTQPLRAS

SEQ ID NO: 74779 - protein, 14 aa, Mycobacterium tuberculosis
PEEDCDTQPLRASR

SEQ ID NO: 74780 - protein, 14 aa, Mycobacterium tuberculosis
EEDCDTQPLRASRP

SEQ ID NO: 74781 - protein, 14 aa, Mycobacterium tuberculosis
EDCDTQPLRASRPA

SEQ ID NO: 74782 - protein, 14 aa, Mycobacterium tuberculosis
DCDTQPLRASRPAA

SEQ ID NO: 74783 - protein, 14 aa, Mycobacterium tuberculosis
CDTQPLRASRPAAA

SEQ ID NO: 74784 - protein, 14 aa, Mycobacterium tuberculosis
DTQPLRASRPAAAA

SEQ ID NO: 74785 - protein, 14 aa, Mycobacterium tuberculosis
TQPLRASRPAAAAA

SEQ ID NO: 74786 - protein, 14 aa, Mycobacterium tuberculosis
QPLRASRPAAAAAS

SEQ ID NO: 74787 - protein, 14 aa, Mycobacterium tuberculosis
PLRASRPAAAAASR

SEQ ID NO: 74788 - protein, 14 aa, Mycobacterium tuberculosis
LRASRPAAAAASRS

SEQ ID NO: 74789 - protein, 14 aa, Mycobacterium tuberculosis
RASRPAAAAASRSG

SEQ ID NO: 74790 - protein, 14 aa, Mycobacterium tuberculosis
ASRPAAAAASRSGA

SEQ ID NO: 74791 - protein, 14 aa, Mycobacterium tuberculosis
SRPAAAAASRSGAG

SEQ ID NO: 74792 - protein, 14 aa, Mycobacterium tuberculosis
RPAAAAASRSGAGG

SEQ ID NO: 74793 - protein, 14 aa, Mycobacterium tuberculosis
PAAAAASRSGAGGP

SEQ ID NO: 74794 - protein, 14 aa, Mycobacterium tuberculosis
AAAAASRSGAGGPL

SEQ ID NO: 74795 - protein, 14 aa, Mycobacterium tuberculosis
AAAASRSGAGGPLA

SEQ ID NO: 74796 - protein, 14 aa, Mycobacterium tuberculosis
AAASRSGAGGPLAV

SEQ ID NO: 74797 - protein, 14 aa, Mycobacterium tuberculosis
AASRSGAGGPLAVS

SEQ ID NO: 74798 - protein, 14 aa, Mycobacterium tuberculosis
ASRSGAGGPLAVSW

SEQ ID NO: 74799 - protein, 14 aa, Mycobacterium tuberculosis
SRSGAGGPLAVSWS

SEQ ID NO: 74800 - protein, 14 aa, Mycobacterium tuberculosis
RSGAGGPLAVSWST

SEQ ID NO: 74801 - protein, 14 aa, Mycobacterium tuberculosis
SGAGGPLAVSWSTS

SEQ ID NO: 74802 - protein, 14 aa, Mycobacterium tuberculosis
GAGGPLAVSWSTSA

SEQ ID NO: 74803 - protein, 14 aa, Mycobacterium tuberculosis
AGGPLAVSWSTSAQ

SEQ ID NO: 74804 - protein, 14 aa, Mycobacterium tuberculosis
GGPLAVSWSTSAQG

SEQ ID NO: 74805 - protein, 14 aa, Mycobacterium tuberculosis
GPLAVSWSTSAQGM

SEQ ID NO: 74806 - protein, 14 aa, Mycobacterium tuberculosis
PLAVSWSTSAQGMP

SEQ ID NO: 74807 - protein, 14 aa, Mycobacterium tuberculosis
LAVSWSTSAQGMPP

SEQ ID NO: 74808 - protein, 14 aa, Mycobacterium tuberculosis
AVSWSTSAQGMPPG

SEQ ID NO: 74809 - protein, 14 aa, Mycobacterium tuberculosis
VSWSTSAQGMPPGP

SEQ ID NO: 74810 - protein, 14 aa, Mycobacterium tuberculosis
SWSTSAQGMPPGPP

SEQ ID NO: 74811 - protein, 14 aa, Mycobacterium tuberculosis
WSTSAQGMPPGPPG

SEQ ID NO: 74812 - protein, 14 aa, Mycobacterium tuberculosis
STSAQGMPPGPPGR

SEQ ID NO: 74813 - protein, 14 aa, Mycobacterium tuberculosis
TSAQGMPPGPPGRR

SEQ ID NO: 74814 - protein, 14 aa, Mycobacterium tuberculosis
SAQGMPPGPPGRRA

SEQ ID NO: 74815 - protein, 14 aa, Mycobacterium tuberculosis
AQGMPPGPPGRRAW

SEQ ID NO: 74816 - protein, 14 aa, Mycobacterium tuberculosis
QGMPPGPPGRRAWQ

SEQ ID NO: 74817 - protein, 14 aa, Mycobacterium tuberculosis
GMPPGPPGRRAWQA

SEQ ID NO: 74818 - protein, 14 aa, Mycobacterium tuberculosis
MPPGPPGRRAWQAD

SEQ ID NO: 74819 - protein, 14 aa, Mycobacterium tuberculosis
PPGPPGRRAWQADT

SEQ ID NO: 74820 - protein, 14 aa, Mycobacterium tuberculosis
PGPPGRRAWQADTE

SEQ ID NO: 74821 - protein, 14 aa, Mycobacterium tuberculosis
GPPGRRAWQADTES

SEQ ID NO: 74822 - protein, 14 aa, Mycobacterium tuberculosis
PPGRRAWQADTEST

SEQ ID NO: 74823 - protein, 14 aa, Mycobacterium tuberculosis
PGRRAWQADTESTA

SEQ ID NO: 74824 - protein, 14 aa, Mycobacterium tuberculosis
GRRAWQADTESTAP

SEQ ID NO: 74825 - protein, 14 aa, Mycobacterium tuberculosis
RRAWQADTESTAPS

SEQ ID NO: 74826 - protein, 14 aa, Mycobacterium tuberculosis
RAWQADTESTAPSA

SEQ ID NO: 74827 - protein, 15 aa, Mycobacterium tuberculosis
MTTAIRRAAGSSYFR

SEQ ID NO: 74828 - protein, 15 aa, Mycobacterium tuberculosis
TTAIRRAAGSSYFRN

SEQ ID NO: 74829 - protein, 15 aa, Mycobacterium tuberculosis
TAIRRAAGSSYFRNP

SEQ ID NO: 74830 - protein, 15 aa, Mycobacterium tuberculosis
AIRRAAGSSYFRNPW

SEQ ID NO: 74831 - protein, 15 aa, Mycobacterium tuberculosis
IRRAAGSSYFRNPWP

SEQ ID NO: 74832 - protein, 15 aa, Mycobacterium tuberculosis
RRAAGSSYFRNPWPA

SEQ ID NO: 74833 - protein, 15 aa, Mycobacterium tuberculosis
RAAGSSYFRNPWPAL

SEQ ID NO: 74834 - protein, 15 aa, Mycobacterium tuberculosis
AAGSSYFRNPWPALW

SEQ ID NO: 74835 - protein, 15 aa, Mycobacterium tuberculosis
AGSSYFRNPWPALWA

SEQ ID NO: 74836 - protein, 15 aa, Mycobacterium tuberculosis
GSSYFRNPWPALWAM

SEQ ID NO: 74837 - protein, 15 aa, Mycobacterium tuberculosis
SSYFRNPWPALWAMM

SEQ ID NO: 74838 - protein, 15 aa, Mycobacterium tuberculosis
SYFRNPWPALWAMMV

SEQ ID NO: 74839 - protein, 15 aa, Mycobacterium tuberculosis
YFRNPWPALWAMMVG

SEQ ID NO: 74840 - protein, 15 aa, Mycobacterium tuberculosis
FRNPWPALWAMMVGF

SEQ ID NO: 74841 - protein, 15 aa, Mycobacterium tuberculosis
RNPWPALWAMMVGFF

SEQ ID NO: 74842 - protein, 15 aa, Mycobacterium tuberculosis
NPWPALWAMMVGFFM

SEQ ID NO: 74843 - protein, 15 aa, Mycobacterium tuberculosis
PWPALWAMMVGFFMI

SEQ ID NO: 74844 - protein, 15 aa, Mycobacterium tuberculosis
WPALWAMMVGFFMIM

SEQ ID NO: 74845 - protein, 15 aa, Mycobacterium tuberculosis
PALWAMMVGFFMIML

SEQ ID NO: 74846 - protein, 15 aa, Mycobacterium tuberculosis
ALWAMMVGFFMIMLD

SEQ ID NO: 74847 - protein, 15 aa, Mycobacterium tuberculosis
LWAMMVGFFMIMLDS

SEQ ID NO: 74848 - protein, 15 aa, Mycobacterium tuberculosis
WAMMVGFFMIMLDST

SEQ ID NO: 74849 - protein, 15 aa, Mycobacterium tuberculosis
AMMVGFFMIMLDSTV

SEQ ID NO: 74850 - protein, 15 aa, Mycobacterium tuberculosis
MMVGFFMIMLDSTVV

SEQ ID NO: 74851 - protein, 15 aa, Mycobacterium tuberculosis
MVGFFMIMLDSTVVA

SEQ ID NO: 74852 - protein, 15 aa, Mycobacterium tuberculosis
VGFFMIMLDSTVVAI

SEQ ID NO: 74853 - protein, 15 aa, Mycobacterium tuberculosis
GFFMIMLDSTVVAIA

SEQ ID NO: 74854 - protein, 15 aa, Mycobacterium tuberculosis
FFMIMLDSTVVAIAN

SEQ ID NO: 74855 - protein, 15 aa, Mycobacterium tuberculosis
FMIMLDSTVVAIANP

SEQ ID NO: 74856 - protein, 15 aa, Mycobacterium tuberculosis
MIMLDSTVVAIANPT

SEQ ID NO: 74857 - protein, 15 aa, Mycobacterium tuberculosis
IMLDSTVVAIANPTI

SEQ ID NO: 74858 - protein, 15 aa, Mycobacterium tuberculosis
MLDSTVVAIANPTIM

SEQ ID NO: 74859 - protein, 15 aa, Mycobacterium tuberculosis
LDSTVVAIANPTIMA

SEQ ID NO: 74860 - protein, 15 aa, Mycobacterium tuberculosis
DSTVVAIANPTIMAQ

SEQ ID NO: 74861 - protein, 15 aa, Mycobacterium tuberculosis
STVVAIANPTIMAQL

SEQ ID NO: 74862 - protein, 15 aa, Mycobacterium tuberculosis
TVVAIANPTIMAQLR

SEQ ID NO: 74863 - protein, 15 aa, Mycobacterium tuberculosis
VVAIANPTIMAQLRI

SEQ ID NO: 74864 - protein, 15 aa, Mycobacterium tuberculosis
VAIANPTIMAQLRIG

SEQ ID NO: 74865 - protein, 15 aa, Mycobacterium tuberculosis
AIANPTIMAQLRIGY

SEQ ID NO: 74866 - protein, 15 aa, Mycobacterium tuberculosis
IANPTIMAQLRIGYA

SEQ ID NO: 74867 - protein, 15 aa, Mycobacterium tuberculosis
ANPTIMAQLRIGYAT

SEQ ID NO: 74868 - protein, 15 aa, Mycobacterium tuberculosis
NPTIMAQLRIGYATV

SEQ ID NO: 74869 - protein, 15 aa, Mycobacterium tuberculosis
PTIMAQLRIGYATVV

SEQ ID NO: 74870 - protein, 15 aa, Mycobacterium tuberculosis
TIMAQLRIGYATVVW

SEQ ID NO: 74871 - protein, 15 aa, Mycobacterium tuberculosis
IMAQLRIGYATVVWV

SEQ ID NO: 74872 - protein, 15 aa, Mycobacterium tuberculosis
MAQLRIGYATVVWVT

SEQ ID NO: 74873 - protein, 15 aa, Mycobacterium tuberculosis
AQLRIGYATVVWVTS

SEQ ID NO: 74874 - protein, 15 aa, Mycobacterium tuberculosis
QLRIGYATVVWVTSA

SEQ ID NO: 74875 - protein, 15 aa, Mycobacterium tuberculosis
LRIGYATVVWVTSAY

SEQ ID NO: 74876 - protein, 15 aa, Mycobacterium tuberculosis
RIGYATVVWVTSAYL

SEQ ID NO: 74877 - protein, 15 aa, Mycobacterium tuberculosis
IGYATVVWVTSAYLL

SEQ ID NO: 74878 - protein, 15 aa, Mycobacterium tuberculosis
GYATVVWVTSAYLLA

SEQ ID NO: 74879 - protein, 15 aa, Mycobacterium tuberculosis
YATVVWVTSAYLLAY

SEQ ID NO: 74880 - protein, 15 aa, Mycobacterium tuberculosis
ATVVWVTSAYLLAYA

SEQ ID NO: 74881 - protein, 15 aa, Mycobacterium tuberculosis
TVVWVTSAYLLAYAV

SEQ ID NO: 74882 - protein, 15 aa, Mycobacterium tuberculosis
VVWVTSAYLLAYAVP

SEQ ID NO: 74883 - protein, 15 aa, Mycobacterium tuberculosis
VWVTSAYLLAYAVPM

SEQ ID NO: 74884 - protein, 15 aa, Mycobacterium tuberculosis
WVTSAYLLAYAVPML

SEQ ID NO: 74885 - protein, 15 aa, Mycobacterium tuberculosis
VTSAYLLAYAVPMLV

SEQ ID NO: 74886 - protein, 15 aa, Mycobacterium tuberculosis
TSAYLLAYAVPMLVA

SEQ ID NO: 74887 - protein, 15 aa, Mycobacterium tuberculosis
SAYLLAYAVPMLVAG

SEQ ID NO: 74888 - protein, 15 aa, Mycobacterium tuberculosis
AYLLAYAVPMLVAGR

SEQ ID NO: 74889 - protein, 15 aa, Mycobacterium tuberculosis
YLLAYAVPMLVAGRL

SEQ ID NO: 74890 - protein, 15 aa, Mycobacterium tuberculosis
LLAYAVPMLVAGRLG

SEQ ID NO: 74891 - protein, 15 aa, Mycobacterium tuberculosis
LAYAVPMLVAGRLGD

SEQ ID NO: 74892 - protein, 15 aa, Mycobacterium tuberculosis
AYAVPMLVAGRLGDR

SEQ ID NO: 74893 - protein, 15 aa, Mycobacterium tuberculosis
YAVPMLVAGRLGDRF

SEQ ID NO: 74894 - protein, 15 aa, Mycobacterium tuberculosis
AVPMLVAGRLGDRFG

SEQ ID NO: 74895 - protein, 15 aa, Mycobacterium tuberculosis
VPMLVAGRLGDRFGP

SEQ ID NO: 74896 - protein, 15 aa, Mycobacterium tuberculosis
PMLVAGRLGDRFGPK

SEQ ID NO: 74897 - protein, 15 aa, Mycobacterium tuberculosis
MLVAGRLGDRFGPKN

SEQ ID NO: 74898 - protein, 15 aa, Mycobacterium tuberculosis
LVAGRLGDRFGPKNL

SEQ ID NO: 74899 - protein, 15 aa, Mycobacterium tuberculosis
VAGRLGDRFGPKNLY

SEQ ID NO: 74900 - protein, 15 aa, Mycobacterium tuberculosis
AGRLGDRFGPKNLYL

SEQ ID NO: 74901 - protein, 15 aa, Mycobacterium tuberculosis
GRLGDRFGPKNLYLI

SEQ ID NO: 74902 - protein, 15 aa, Mycobacterium tuberculosis
RLGDRFGPKNLYLIG

SEQ ID NO: 74903 - protein, 15 aa, Mycobacterium tuberculosis
LGDRFGPKNLYLIGL

SEQ ID NO: 74904 - protein, 15 aa, Mycobacterium tuberculosis
GDRFGPKNLYLIGLG

SEQ ID NO: 74905 - protein, 15 aa, Mycobacterium tuberculosis
DRFGPKNLYLIGLGV

SEQ ID NO: 74906 - protein, 15 aa, Mycobacterium tuberculosis
RFGPKNLYLIGLGVF

SEQ ID NO: 74907 - protein, 15 aa, Mycobacterium tuberculosis
FGPKNLYLIGLGVFT

SEQ ID NO: 74908 - protein, 15 aa, Mycobacterium tuberculosis
GPKNLYLIGLGVFTV

SEQ ID NO: 74909 - protein, 15 aa, Mycobacterium tuberculosis
PKNLYLIGLGVFTVA

SEQ ID NO: 74910 - protein, 15 aa, Mycobacterium tuberculosis
KNLYLIGLGVFTVAS

SEQ ID NO: 74911 - protein, 15 aa, Mycobacterium tuberculosis
NLYLIGLGVFTVASL

SEQ ID NO: 74912 - protein, 15 aa, Mycobacterium tuberculosis
LYLIGLGVFTVASLG

SEQ ID NO: 74913 - protein, 15 aa, Mycobacterium tuberculosis
YLIGLGVFTVASLGC

SEQ ID NO: 74914 - protein, 15 aa, Mycobacterium tuberculosis
LIGLGVFTVASLGCG

SEQ ID NO: 74915 - protein, 15 aa, Mycobacterium tuberculosis
IGLGVFTVASLGCGL

SEQ ID NO: 74916 - protein, 15 aa, Mycobacterium tuberculosis
GLGVFTVASLGCGLS

SEQ ID NO: 74917 - protein, 15 aa, Mycobacterium tuberculosis
LGVFTVASLGCGLSS

SEQ ID NO: 74918 - protein, 15 aa, Mycobacterium tuberculosis
GVFTVASLGCGLSSG

SEQ ID NO: 74919 - protein, 15 aa, Mycobacterium tuberculosis
VFTVASLGCGLSSGA

SEQ ID NO: 74920 - protein, 15 aa, Mycobacterium tuberculosis
FTVASLGCGLSSGAG

SEQ ID NO: 74921 - protein, 15 aa, Mycobacterium tuberculosis
TVASLGCGLSSGAGM

SEQ ID NO: 74922 - protein, 15 aa, Mycobacterium tuberculosis
VASLGCGLSSGAGML

SEQ ID NO: 74923 - protein, 15 aa, Mycobacterium tuberculosis
ASLGCGLSSGAGMLI

SEQ ID NO: 74924 - protein, 15 aa, Mycobacterium tuberculosis
SLGCGLSSGAGMLIA

SEQ ID NO: 74925 - protein, 15 aa, Mycobacterium tuberculosis
LGCGLSSGAGMLIAA

SEQ ID NO: 74926 - protein, 15 aa, Mycobacterium tuberculosis
GCGLSSGAGMLIAAR

SEQ ID NO: 74927 - protein, 15 aa, Mycobacterium tuberculosis
CGLSSGAGMLIAARV

SEQ ID NO: 74928 - protein, 15 aa, Mycobacterium tuberculosis
GLSSGAGMLIAARVV

SEQ ID NO: 74929 - protein, 15 aa, Mycobacterium tuberculosis
LSSGAGMLIAARVVQ

SEQ ID NO: 74930 - protein, 15 aa, Mycobacterium tuberculosis
SSGAGMLIAARVVQG

SEQ ID NO: 74931 - protein, 15 aa, Mycobacterium tuberculosis
SGAGMLIAARVVQGV

SEQ ID NO: 74932 - protein, 15 aa, Mycobacterium tuberculosis
GAGMLIAARVVQGVG

SEQ ID NO: 74933 - protein, 15 aa, Mycobacterium tuberculosis
AGMLIAARVVQGVGA

SEQ ID NO: 74934 - protein, 15 aa, Mycobacterium tuberculosis
GMLIAARVVQGVGAG

SEQ ID NO: 74935 - protein, 15 aa, Mycobacterium tuberculosis
MLIAARVVQGVGAGL

SEQ ID NO: 74936 - protein, 15 aa, Mycobacterium tuberculosis
LIAARVVQGVGAGLL

SEQ ID NO: 74937 - protein, 15 aa, Mycobacterium tuberculosis
IAARVVQGVGAGLLT

SEQ ID NO: 74938 - protein, 15 aa, Mycobacterium tuberculosis
AARVVQGVGAGLLTP

SEQ ID NO: 74939 - protein, 15 aa, Mycobacterium tuberculosis
ARVVQGVGAGLLTPQ

SEQ ID NO: 74940 - protein, 15 aa, Mycobacterium tuberculosis
RVVQGVGAGLLTPQT

SEQ ID NO: 74941 - protein, 15 aa, Mycobacterium tuberculosis
VVQGVGAGLLTPQTL

SEQ ID NO: 74942 - protein, 15 aa, Mycobacterium tuberculosis
VQGVGAGLLTPQTLS

SEQ ID NO: 74943 - protein, 15 aa, Mycobacterium tuberculosis
QGVGAGLLTPQTLST

SEQ ID NO: 74944 - protein, 15 aa, Mycobacterium tuberculosis
GVGAGLLTPQTLSTI

SEQ ID NO: 74945 - protein, 15 aa, Mycobacterium tuberculosis
VGAGLLTPQTLSTIT

SEQ ID NO: 74946 - protein, 15 aa, Mycobacterium tuberculosis
GAGLLTPQTLSTITR

SEQ ID NO: 74947 - protein, 15 aa, Mycobacterium tuberculosis
AGLLTPQTLSTITRI

SEQ ID NO: 74948 - protein, 15 aa, Mycobacterium tuberculosis
GLLTPQTLSTITRIF

SEQ ID NO: 74949 - protein, 15 aa, Mycobacterium tuberculosis
LLTPQTLSTITRIFP

SEQ ID NO: 74950 - protein, 15 aa, Mycobacterium tuberculosis
LTPQTLSTITRIFPA

SEQ ID NO: 74951 - protein, 15 aa, Mycobacterium tuberculosis
TPQTLSTITRIFPAH

SEQ ID NO: 74952 - protein, 15 aa, Mycobacterium tuberculosis
PQTLSTITRIFPAHR

SEQ ID NO: 74953 - protein, 15 aa, Mycobacterium tuberculosis
QTLSTITRIFPAHRR

SEQ ID NO: 74954 - protein, 15 aa, Mycobacterium tuberculosis
TLSTITRIFPAHRRG

SEQ ID NO: 74955 - protein, 15 aa, Mycobacterium tuberculosis
LSTITRIFPAHRRGV

SEQ ID NO: 74956 - protein, 15 aa, Mycobacterium tuberculosis
STITRIFPAHRRGVA

SEQ ID NO: 74957 - protein, 15 aa, Mycobacterium tuberculosis
TITRIFPAHRRGVAL

SEQ ID NO: 74958 - protein, 15 aa, Mycobacterium tuberculosis
ITRIFPAHRRGVALG

SEQ ID NO: 74959 - protein, 15 aa, Mycobacterium tuberculosis
TRIFPAHRRGVALGA

SEQ ID NO: 74960 - protein, 15 aa, Mycobacterium tuberculosis
RIFPAHRRGVALGAW

SEQ ID NO: 74961 - protein, 15 aa, Mycobacterium tuberculosis
IFPAHRRGVALGAWG

SEQ ID NO: 74962 - protein, 15 aa, Mycobacterium tuberculosis
FPAHRRGVALGAWGT

SEQ ID NO: 74963 - protein, 15 aa, Mycobacterium tuberculosis
PAHRRGVALGAWGTV

SEQ ID NO: 74964 - protein, 15 aa, Mycobacterium tuberculosis
AHRRGVALGAWGTVA

SEQ ID NO: 74965 - protein, 15 aa, Mycobacterium tuberculosis
HRRGVALGAWGTVAS

SEQ ID NO: 74966 - protein, 15 aa, Mycobacterium tuberculosis
RRGVALGAWGTVASV

SEQ ID NO: 74967 - protein, 15 aa, Mycobacterium tuberculosis
RGVALGAWGTVASVA

SEQ ID NO: 74968 - protein, 15 aa, Mycobacterium tuberculosis
GVALGAWGTVASVAS

SEQ ID NO: 74969 - protein, 15 aa, Mycobacterium tuberculosis
VALGAWGTVASVASL

SEQ ID NO: 74970 - protein, 15 aa, Mycobacterium tuberculosis
ALGAWGTVASVASLV

SEQ ID NO: 74971 - protein, 15 aa, Mycobacterium tuberculosis
LGAWGTVASVASLVG

SEQ ID NO: 74972 - protein, 15 aa, Mycobacterium tuberculosis
GAWGTVASVASLVGP

SEQ ID NO: 74973 - protein, 15 aa, Mycobacterium tuberculosis
AWGTVASVASLVGPL

SEQ ID NO: 74974 - protein, 15 aa, Mycobacterium tuberculosis
WGTVASVASLVGPLA

SEQ ID NO: 74975 - protein, 15 aa, Mycobacterium tuberculosis
GTVASVASLVGPLAG

SEQ ID NO: 74976 - protein, 15 aa, Mycobacterium tuberculosis
TVASVASLVGPLAGG

SEQ ID NO: 74977 - protein, 15 aa, Mycobacterium tuberculosis
VASVASLVGPLAGGA

SEQ ID NO: 74978 - protein, 15 aa, Mycobacterium tuberculosis
ASVASLVGPLAGGAL

SEQ ID NO: 74979 - protein, 15 aa, Mycobacterium tuberculosis
SVASLVGPLAGGALV

SEQ ID NO: 74980 - protein, 15 aa, Mycobacterium tuberculosis
VASLVGPLAGGALVD

SEQ ID NO: 74981 - protein, 15 aa, Mycobacterium tuberculosis
ASLVGPLAGGALVDS

SEQ ID NO: 74982 - protein, 15 aa, Mycobacterium tuberculosis
SLVGPLAGGALVDSM

SEQ ID NO: 74983 - protein, 15 aa, Mycobacterium tuberculosis
LVGPLAGGALVDSMG

SEQ ID NO: 74984 - protein, 15 aa, Mycobacterium tuberculosis
VGPLAGGALVDSMGW

SEQ ID NO: 74985 - protein, 15 aa, Mycobacterium tuberculosis
GPLAGGALVDSMGWE

SEQ ID NO: 74986 - protein, 15 aa, Mycobacterium tuberculosis
PLAGGALVDSMGWEW

SEQ ID NO: 74987 - protein, 15 aa, Mycobacterium tuberculosis
LAGGALVDSMGWEWI

SEQ ID NO: 74988 - protein, 15 aa, Mycobacterium tuberculosis
AGGALVDSMGWEWIF

SEQ ID NO: 74989 - protein, 15 aa, Mycobacterium tuberculosis
GGALVDSMGWEWIFF

SEQ ID NO: 74990 - protein, 15 aa, Mycobacterium tuberculosis
GALVDSMGWEWIFFV

SEQ ID NO: 74991 - protein, 15 aa, Mycobacterium tuberculosis
ALVDSMGWEWIFFVN

SEQ ID NO: 74992 - protein, 15 aa, Mycobacterium tuberculosis
LVDSMGWEWIFFVNV

SEQ ID NO: 74993 - protein, 15 aa, Mycobacterium tuberculosis
VDSMGWEWIFFVNVP

SEQ ID NO: 74994 - protein, 15 aa, Mycobacterium tuberculosis
DSMGWEWIFFVNVPV

SEQ ID NO: 74995 - protein, 15 aa, Mycobacterium tuberculosis
SMGWEWIFFVNVPVG

SEQ ID NO: 74996 - protein, 15 aa, Mycobacterium tuberculosis
MGWEWIFFVNVPVGV

SEQ ID NO: 74997 - protein, 15 aa, Mycobacterium tuberculosis
GWEWIFFVNVPVGVI

SEQ ID NO: 74998 - protein, 15 aa, Mycobacterium tuberculosis
WEWIFFVNVPVGVIG

SEQ ID NO: 74999 - protein, 15 aa, Mycobacterium tuberculosis
EWIFFVNVPVGVIGL

SEQ ID NO: 75000 - protein, 15 aa, Mycobacterium tuberculosis
WIFFVNVPVGVIGLI

SEQ ID NO: 75001 - protein, 15 aa, Mycobacterium tuberculosis
IFFVNVPVGVIGLIL

SEQ ID NO: 75002 - protein, 15 aa, Mycobacterium tuberculosis
FFVNVPVGVIGLILA

SEQ ID NO: 75003 - protein, 15 aa, Mycobacterium tuberculosis
FVNVPVGVIGLILAA

SEQ ID NO: 75004 - protein, 15 aa, Mycobacterium tuberculosis
VNVPVGVIGLILAAY

SEQ ID NO: 75005 - protein, 15 aa, Mycobacterium tuberculosis
NVPVGVIGLILAAYL

SEQ ID NO: 75006 - protein, 15 aa, Mycobacterium tuberculosis
VPVGVIGLILAAYLI

SEQ ID NO: 75007 - protein, 15 aa, Mycobacterium tuberculosis
PVGVIGLILAAYLIP

SEQ ID NO: 75008 - protein, 15 aa, Mycobacterium tuberculosis
VGVIGLILAAYLIPA

SEQ ID NO: 75009 - protein, 15 aa, Mycobacterium tuberculosis
GVIGLILAAYLIPAL

SEQ ID NO: 75010 - protein, 15 aa, Mycobacterium tuberculosis
VIGLILAAYLIPALP

SEQ ID NO: 75011 - protein, 15 aa, Mycobacterium tuberculosis
IGLILAAYLIPALPH

SEQ ID NO: 75012 - protein, 15 aa, Mycobacterium tuberculosis
GLILAAYLIPALPHH

SEQ ID NO: 75013 - protein, 15 aa, Mycobacterium tuberculosis
LILAAYLIPALPHHP

SEQ ID NO: 75014 - protein, 15 aa, Mycobacterium tuberculosis
ILAAYLIPALPHHPH

SEQ ID NO: 75015 - protein, 15 aa, Mycobacterium tuberculosis
LAAYLIPALPHHPHR

SEQ ID NO: 75016 - protein, 15 aa, Mycobacterium tuberculosis
AAYLIPALPHHPHRF

SEQ ID NO: 75017 - protein, 15 aa, Mycobacterium tuberculosis
AYLIPALPHHPHRFD

SEQ ID NO: 75018 - protein, 15 aa, Mycobacterium tuberculosis
YLIPALPHHPHRFDW

SEQ ID NO: 75019 - protein, 15 aa, Mycobacterium tuberculosis
LIPALPHHPHRFDWF

SEQ ID NO: 75020 - protein, 15 aa, Mycobacterium tuberculosis
IPALPHHPHRFDWFG

SEQ ID NO: 75021 - protein, 15 aa, Mycobacterium tuberculosis
PALPHHPHRFDWFGV

SEQ ID NO: 75022 - protein, 15 aa, Mycobacterium tuberculosis
ALPHHPHRFDWFGVG

SEQ ID NO: 75023 - protein, 15 aa, Mycobacterium tuberculosis
LPHHPHRFDWFGVGL

SEQ ID NO: 75024 - protein, 15 aa, Mycobacterium tuberculosis
PHHPHRFDWFGVGLS

SEQ ID NO: 75025 - protein, 15 aa, Mycobacterium tuberculosis
HHPHRFDWFGVGLSG

SEQ ID NO: 75026 - protein, 15 aa, Mycobacterium tuberculosis
HPHRFDWFGVGLSGA

SEQ ID NO: 75027 - protein, 15 aa, Mycobacterium tuberculosis
PHRFDWFGVGLSGAG

SEQ ID NO: 75028 - protein, 15 aa, Mycobacterium tuberculosis
HRFDWFGVGLSGAGM

SEQ ID NO: 75029 - protein, 15 aa, Mycobacterium tuberculosis
RFDWFGVGLSGAGMF

SEQ ID NO: 75030 - protein, 15 aa, Mycobacterium tuberculosis
FDWFGVGLSGAGMFL

SEQ ID NO: 75031 - protein, 15 aa, Mycobacterium tuberculosis
DWFGVGLSGAGMFLI

SEQ ID NO: 75032 - protein, 15 aa, Mycobacterium tuberculosis
WFGVGLSGAGMFLIV

SEQ ID NO: 75033 - protein, 15 aa, Mycobacterium tuberculosis
FGVGLSGAGMFLIVF

SEQ ID NO: 75034 - protein, 15 aa, Mycobacterium tuberculosis
GVGLSGAGMFLIVFG

SEQ ID NO: 75035 - protein, 15 aa, Mycobacterium tuberculosis
VGLSGAGMFLIVFGL

SEQ ID NO: 75036 - protein, 15 aa, Mycobacterium tuberculosis
GLSGAGMFLIVFGLQ

SEQ ID NO: 75037 - protein, 15 aa, Mycobacterium tuberculosis
LSGAGMFLIVFGLQQ

SEQ ID NO: 75038 - protein, 15 aa, Mycobacterium tuberculosis
SGAGMFLIVFGLQQG

SEQ ID NO: 75039 - protein, 15 aa, Mycobacterium tuberculosis
GAGMFLIVFGLQQGQ

SEQ ID NO: 75040 - protein, 15 aa, Mycobacterium tuberculosis
AGMFLIVFGLQQGQS

SEQ ID NO: 75041 - protein, 15 aa, Mycobacterium tuberculosis
GMFLIVFGLQQGQSA

SEQ ID NO: 75042 - protein, 15 aa, Mycobacterium tuberculosis
MFLIVFGLQQGQSAN

SEQ ID NO: 75043 - protein, 15 aa, Mycobacterium tuberculosis
FLIVFGLQQGQSANW

SEQ ID NO: 75044 - protein, 15 aa, Mycobacterium tuberculosis
LIVFGLQQGQSANWQ

SEQ ID NO: 75045 - protein, 15 aa, Mycobacterium tuberculosis
IVFGLQQGQSANWQP

SEQ ID NO: 75046 - protein, 15 aa, Mycobacterium tuberculosis
VFGLQQGQSANWQPW

SEQ ID NO: 75047 - protein, 15 aa, Mycobacterium tuberculosis
FGLQQGQSANWQPWI

SEQ ID NO: 75048 - protein, 15 aa, Mycobacterium tuberculosis
GLQQGQSANWQPWIW

SEQ ID NO: 75049 - protein, 15 aa, Mycobacterium tuberculosis
LQQGQSANWQPWIWA

SEQ ID NO: 75050 - protein, 15 aa, Mycobacterium tuberculosis
QQGQSANWQPWIWAV

SEQ ID NO: 75051 - protein, 15 aa, Mycobacterium tuberculosis
QGQSANWQPWIWAVI

SEQ ID NO: 75052 - protein, 15 aa, Mycobacterium tuberculosis
GQSANWQPWIWAVIV

SEQ ID NO: 75053 - protein, 15 aa, Mycobacterium tuberculosis
QSANWQPWIWAVIVG

SEQ ID NO: 75054 - protein, 15 aa, Mycobacterium tuberculosis
SANWQPWIWAVIVGG

SEQ ID NO: 75055 - protein, 15 aa, Mycobacterium tuberculosis
ANWQPWIWAVIVGGI

SEQ ID NO: 75056 - protein, 15 aa, Mycobacterium tuberculosis
NWQPWIWAVIVGGIG

SEQ ID NO: 75057 - protein, 15 aa, Mycobacterium tuberculosis
WQPWIWAVIVGGIGF

SEQ ID NO: 75058 - protein, 15 aa, Mycobacterium tuberculosis
QPWIWAVIVGGIGFM

SEQ ID NO: 75059 - protein, 15 aa, Mycobacterium tuberculosis
PWIWAVIVGGIGFMS

SEQ ID NO: 75060 - protein, 15 aa, Mycobacterium tuberculosis
WIWAVIVGGIGFMSL

SEQ ID NO: 75061 - protein, 15 aa, Mycobacterium tuberculosis
IWAVIVGGIGFMSLF

SEQ ID NO: 75062 - protein, 15 aa, Mycobacterium tuberculosis
WAVIVGGIGFMSLFV

SEQ ID NO: 75063 - protein, 15 aa, Mycobacterium tuberculosis
AVIVGGIGFMSLFVY

SEQ ID NO: 75064 - protein, 15 aa, Mycobacterium tuberculosis
VIVGGIGFMSLFVYW

SEQ ID NO: 75065 - protein, 15 aa, Mycobacterium tuberculosis
IVGGIGFMSLFVYWQ

SEQ ID NO: 75066 - protein, 15 aa, Mycobacterium tuberculosis
VGGIGFMSLFVYWQA

SEQ ID NO: 75067 - protein, 15 aa, Mycobacterium tuberculosis
GGIGFMSLFVYWQAR

SEQ ID NO: 75068 - protein, 15 aa, Mycobacterium tuberculosis
GIGFMSLFVYWQARN

SEQ ID NO: 75069 - protein, 15 aa, Mycobacterium tuberculosis
IGFMSLFVYWQARNA

SEQ ID NO: 75070 - protein, 15 aa, Mycobacterium tuberculosis
GFMSLFVYWQARNAR

SEQ ID NO: 75071 - protein, 15 aa, Mycobacterium tuberculosis
FMSLFVYWQARNARE

SEQ ID NO: 75072 - protein, 15 aa, Mycobacterium tuberculosis
MSLFVYWQARNAREP

SEQ ID NO: 75073 - protein, 15 aa, Mycobacterium tuberculosis
SLFVYWQARNAREPL

SEQ ID NO: 75074 - protein, 15 aa, Mycobacterium tuberculosis
LFVYWQARNAREPLI

SEQ ID NO: 75075 - protein, 15 aa, Mycobacterium tuberculosis
FVYWQARNAREPLIP

SEQ ID NO: 75076 - protein, 15 aa, Mycobacterium tuberculosis
VYWQARNAREPLIPL

SEQ ID NO: 75077 - protein, 15 aa, Mycobacterium tuberculosis
YWQARNAREPLIPLE

SEQ ID NO: 75078 - protein, 15 aa, Mycobacterium tuberculosis
WQARNAREPLIPLEV

SEQ ID NO: 75079 - protein, 15 aa, Mycobacterium tuberculosis
QARNAREPLIPLEVF

SEQ ID NO: 75080 - protein, 15 aa, Mycobacterium tuberculosis
ARNAREPLIPLEVFN

SEQ ID NO: 75081 - protein, 15 aa, Mycobacterium tuberculosis
RNAREPLIPLEVFND

SEQ ID NO: 75082 - protein, 15 aa, Mycobacterium tuberculosis
NAREPLIPLEVFNDR

SEQ ID NO: 75083 - protein, 15 aa, Mycobacterium tuberculosis
AREPLIPLEVFNDRN

SEQ ID NO: 75084 - protein, 15 aa, Mycobacterium tuberculosis
REPLIPLEVFNDRNF

SEQ ID NO: 75085 - protein, 15 aa, Mycobacterium tuberculosis
EPLIPLEVFNDRNFS

SEQ ID NO: 75086 - protein, 15 aa, Mycobacterium tuberculosis
PLIPLEVFNDRNFSL

SEQ ID NO: 75087 - protein, 15 aa, Mycobacterium tuberculosis
LIPLEVFNDRNFSLS

SEQ ID NO: 75088 - protein, 15 aa, Mycobacterium tuberculosis
IPLEVFNDRNFSLSN

SEQ ID NO: 75089 - protein, 15 aa, Mycobacterium tuberculosis
PLEVFNDRNFSLSNL

SEQ ID NO: 75090 - protein, 15 aa, Mycobacterium tuberculosis
LEVFNDRNFSLSNLR

SEQ ID NO: 75091 - protein, 15 aa, Mycobacterium tuberculosis
EVFNDRNFSLSNLRI

SEQ ID NO: 75092 - protein, 15 aa, Mycobacterium tuberculosis
VFNDRNFSLSNLRIA

SEQ ID NO: 75093 - protein, 15 aa, Mycobacterium tuberculosis
FNDRNFSLSNLRIAI

SEQ ID NO: 75094 - protein, 15 aa, Mycobacterium tuberculosis
NDRNFSLSNLRIAII

SEQ ID NO: 75095 - protein, 15 aa, Mycobacterium tuberculosis
DRNFSLSNLRIAIIA

SEQ ID NO: 75096 - protein, 15 aa, Mycobacterium tuberculosis
RNFSLSNLRIAIIAF

SEQ ID NO: 75097 - protein, 15 aa, Mycobacterium tuberculosis
NFSLSNLRIAIIAFA

SEQ ID NO: 75098 - protein, 15 aa, Mycobacterium tuberculosis
FSLSNLRIAIIAFAG

SEQ ID NO: 75099 - protein, 15 aa, Mycobacterium tuberculosis
SLSNLRIAIIAFAGT

SEQ ID NO: 75100 - protein, 15 aa, Mycobacterium tuberculosis
LSNLRIAIIAFAGTG

SEQ ID NO: 75101 - protein, 15 aa, Mycobacterium tuberculosis
SNLRIAIIAFAGTGM

SEQ ID NO: 75102 - protein, 15 aa, Mycobacterium tuberculosis
NLRIAIIAFAGTGMM

SEQ ID NO: 75103 - protein, 15 aa, Mycobacterium tuberculosis
LRIAIIAFAGTGMML

SEQ ID NO: 75104 - protein, 15 aa, Mycobacterium tuberculosis
RIAIIAFAGTGMMLP

SEQ ID NO: 75105 - protein, 15 aa, Mycobacterium tuberculosis
IAIIAFAGTGMMLPV

SEQ ID NO: 75106 - protein, 15 aa, Mycobacterium tuberculosis
AIIAFAGTGMMLPVT

SEQ ID NO: 75107 - protein, 15 aa, Mycobacterium tuberculosis
IIAFAGTGMMLPVTF

SEQ ID NO: 75108 - protein, 15 aa, Mycobacterium tuberculosis
IAFAGTGMMLPVTFY

SEQ ID NO: 75109 - protein, 15 aa, Mycobacterium tuberculosis
AFAGTGMMLPVTFYA

SEQ ID NO: 75110 - protein, 15 aa, Mycobacterium tuberculosis
FAGTGMMLPVTFYAQ

SEQ ID NO: 75111 - protein, 15 aa, Mycobacterium tuberculosis
AGTGMMLPVTFYAQA

SEQ ID NO: 75112 - protein, 15 aa, Mycobacterium tuberculosis
GTGMMLPVTFYAQAV

SEQ ID NO: 75113 - protein, 15 aa, Mycobacterium tuberculosis
TGMMLPVTFYAQAVC

SEQ ID NO: 75114 - protein, 15 aa, Mycobacterium tuberculosis
GMMLPVTFYAQAVCG

SEQ ID NO: 75115 - protein, 15 aa, Mycobacterium tuberculosis
MMLPVTFYAQAVCGL

SEQ ID NO: 75116 - protein, 15 aa, Mycobacterium tuberculosis
MLPVTFYAQAVCGLS

SEQ ID NO: 75117 - protein, 15 aa, Mycobacterium tuberculosis
LPVTFYAQAVCGLSP

SEQ ID NO: 75118 - protein, 15 aa, Mycobacterium tuberculosis
PVTFYAQAVCGLSPT

SEQ ID NO: 75119 - protein, 15 aa, Mycobacterium tuberculosis
VTFYAQAVCGLSPTH

SEQ ID NO: 75120 - protein, 15 aa, Mycobacterium tuberculosis
TFYAQAVCGLSPTHT

SEQ ID NO: 75121 - protein, 15 aa, Mycobacterium tuberculosis
FYAQAVCGLSPTHTA

SEQ ID NO: 75122 - protein, 15 aa, Mycobacterium tuberculosis
YAQAVCGLSPTHTAV

SEQ ID NO: 75123 - protein, 15 aa, Mycobacterium tuberculosis
AQAVCGLSPTHTAVL

SEQ ID NO: 75124 - protein, 15 aa, Mycobacterium tuberculosis
QAVCGLSPTHTAVLF

SEQ ID NO: 75125 - protein, 15 aa, Mycobacterium tuberculosis
AVCGLSPTHTAVLFA

SEQ ID NO: 75126 - protein, 15 aa, Mycobacterium tuberculosis
VCGLSPTHTAVLFAP

SEQ ID NO: 75127 - protein, 15 aa, Mycobacterium tuberculosis
CGLSPTHTAVLFAPT

SEQ ID NO: 75128 - protein, 15 aa, Mycobacterium tuberculosis
GLSPTHTAVLFAPTA

SEQ ID NO: 75129 - protein, 15 aa, Mycobacterium tuberculosis
LSPTHTAVLFAPTAI

SEQ ID NO: 75130 - protein, 15 aa, Mycobacterium tuberculosis
SPTHTAVLFAPTAIV

SEQ ID NO: 75131 - protein, 15 aa, Mycobacterium tuberculosis
PTHTAVLFAPTAIVG

SEQ ID NO: 75132 - protein, 15 aa, Mycobacterium tuberculosis
THTAVLFAPTAIVGG

SEQ ID NO: 75133 - protein, 15 aa, Mycobacterium tuberculosis
HTAVLFAPTAIVGGV

SEQ ID NO: 75134 - protein, 15 aa, Mycobacterium tuberculosis
TAVLFAPTAIVGGVL

SEQ ID NO: 75135 - protein, 15 aa, Mycobacterium tuberculosis
AVLFAPTAIVGGVLA

SEQ ID NO: 75136 - protein, 15 aa, Mycobacterium tuberculosis
VLFAPTAIVGGVLAP

SEQ ID NO: 75137 - protein, 15 aa, Mycobacterium tuberculosis
LFAPTAIVGGVLAPF

SEQ ID NO: 75138 - protein, 15 aa, Mycobacterium tuberculosis
FAPTAIVGGVLAPFV

SEQ ID NO: 75139 - protein, 15 aa, Mycobacterium tuberculosis
APTAIVGGVLAPFVG

SEQ ID NO: 75140 - protein, 15 aa, Mycobacterium tuberculosis
PTAIVGGVLAPFVGM

SEQ ID NO: 75141 - protein, 15 aa, Mycobacterium tuberculosis
TAIVGGVLAPFVGMI

SEQ ID NO: 75142 - protein, 15 aa, Mycobacterium tuberculosis
AIVGGVLAPFVGMII

SEQ ID NO: 75143 - protein, 15 aa, Mycobacterium tuberculosis
IVGGVLAPFVGMIID

SEQ ID NO: 75144 - protein, 15 aa, Mycobacterium tuberculosis
VGGVLAPFVGMIIDR

SEQ ID NO: 75145 - protein, 15 aa, Mycobacterium tuberculosis
GGVLAPFVGMIIDRS

SEQ ID NO: 75146 - protein, 15 aa, Mycobacterium tuberculosis
GVLAPFVGMIIDRSH

SEQ ID NO: 75147 - protein, 15 aa, Mycobacterium tuberculosis
VLAPFVGMIIDRSHP

SEQ ID NO: 75148 - protein, 15 aa, Mycobacterium tuberculosis
LAPFVGMIIDRSHPL

SEQ ID NO: 75149 - protein, 15 aa, Mycobacterium tuberculosis
APFVGMIIDRSHPLC

SEQ ID NO: 75150 - protein, 15 aa, Mycobacterium tuberculosis
PFVGMIIDRSHPLCV

SEQ ID NO: 75151 - protein, 15 aa, Mycobacterium tuberculosis
FVGMIIDRSHPLCVL

SEQ ID NO: 75152 - protein, 15 aa, Mycobacterium tuberculosis
VGMIIDRSHPLCVLG

SEQ ID NO: 75153 - protein, 15 aa, Mycobacterium tuberculosis
GMIIDRSHPLCVLGF

SEQ ID NO: 75154 - protein, 15 aa, Mycobacterium tuberculosis
MIIDRSHPLCVLGFG

SEQ ID NO: 75155 - protein, 15 aa, Mycobacterium tuberculosis
IIDRSHPLCVLGFGF

SEQ ID NO: 75156 - protein, 15 aa, Mycobacterium tuberculosis
IDRSHPLCVLGFGFS

SEQ ID NO: 75157 - protein, 15 aa, Mycobacterium tuberculosis
DRSHPLCVLGFGFSV

SEQ ID NO: 75158 - protein, 15 aa, Mycobacterium tuberculosis
RSHPLCVLGFGFSVL

SEQ ID NO: 75159 - protein, 15 aa, Mycobacterium tuberculosis
SHPLCVLGFGFSVLA

SEQ ID NO: 75160 - protein, 15 aa, Mycobacterium tuberculosis
HPLCVLGFGFSVLAI

SEQ ID NO: 75161 - protein, 15 aa, Mycobacterium tuberculosis
PLCVLGFGFSVLAIA

SEQ ID NO: 75162 - protein, 15 aa, Mycobacterium tuberculosis
LCVLGFGFSVLAIAM

SEQ ID NO: 75163 - protein, 15 aa, Mycobacterium tuberculosis
CVLGFGFSVLAIAMT

SEQ ID NO: 75164 - protein, 15 aa, Mycobacterium tuberculosis
VLGFGFSVLAIAMTW

SEQ ID NO: 75165 - protein, 15 aa, Mycobacterium tuberculosis
LGFGFSVLAIAMTWL

SEQ ID NO: 75166 - protein, 15 aa, Mycobacterium tuberculosis
GFGFSVLAIAMTWLL

SEQ ID NO: 75167 - protein, 15 aa, Mycobacterium tuberculosis
FGFSVLAIAMTWLLC

SEQ ID NO: 75168 - protein, 15 aa, Mycobacterium tuberculosis
GFSVLAIAMTWLLCE

SEQ ID NO: 75169 - protein, 15 aa, Mycobacterium tuberculosis
FSVLAIAMTWLLCEM

SEQ ID NO: 75170 - protein, 15 aa, Mycobacterium tuberculosis
SVLAIAMTWLLCEMA

SEQ ID NO: 75171 - protein, 15 aa, Mycobacterium tuberculosis
VLAIAMTWLLCEMAP

SEQ ID NO: 75172 - protein, 15 aa, Mycobacterium tuberculosis
LAIAMTWLLCEMAPG

SEQ ID NO: 75173 - protein, 15 aa, Mycobacterium tuberculosis
AIAMTWLLCEMAPGT

SEQ ID NO: 75174 - protein, 15 aa, Mycobacterium tuberculosis
IAMTWLLCEMAPGTP

SEQ ID NO: 75175 - protein, 15 aa, Mycobacterium tuberculosis
AMTWLLCEMAPGTPI

SEQ ID NO: 75176 - protein, 15 aa, Mycobacterium tuberculosis
MTWLLCEMAPGTPIW

SEQ ID NO: 75177 - protein, 15 aa, Mycobacterium tuberculosis
TWLLCEMAPGTPIWR

SEQ ID NO: 75178 - protein, 15 aa, Mycobacterium tuberculosis
WLLCEMAPGTPIWRL

SEQ ID NO: 75179 - protein, 15 aa, Mycobacterium tuberculosis
LLCEMAPGTPIWRLV

SEQ ID NO: 75180 - protein, 15 aa, Mycobacterium tuberculosis
LCEMAPGTPIWRLVL

SEQ ID NO: 75181 - protein, 15 aa, Mycobacterium tuberculosis
CEMAPGTPIWRLVLP

SEQ ID NO: 75182 - protein, 15 aa, Mycobacterium tuberculosis
EMAPGTPIWRLVLPF

SEQ ID NO: 75183 - protein, 15 aa, Mycobacterium tuberculosis
MAPGTPIWRLVLPFI

SEQ ID NO: 75184 - protein, 15 aa, Mycobacterium tuberculosis
APGTPIWRLVLPFIA

SEQ ID NO: 75185 - protein, 15 aa, Mycobacterium tuberculosis
PGTPIWRLVLPFIAL

SEQ ID NO: 75186 - protein, 15 aa, Mycobacterium tuberculosis
GTPIWRLVLPFIALG

SEQ ID NO: 75187 - protein, 15 aa, Mycobacterium tuberculosis
TPIWRLVLPFIALGV

SEQ ID NO: 75188 - protein, 15 aa, Mycobacterium tuberculosis
PIWRLVLPFIALGVA

SEQ ID NO: 75189 - protein, 15 aa, Mycobacterium tuberculosis
IWRLVLPFIALGVAG

SEQ ID NO: 75190 - protein, 15 aa, Mycobacterium tuberculosis
WRLVLPFIALGVAGA

SEQ ID NO: 75191 - protein, 15 aa, Mycobacterium tuberculosis
RLVLPFIALGVAGAF

SEQ ID NO: 75192 - protein, 15 aa, Mycobacterium tuberculosis
LVLPFIALGVAGAFV

SEQ ID NO: 75193 - protein, 15 aa, Mycobacterium tuberculosis
VLPFIALGVAGAFVW

SEQ ID NO: 75194 - protein, 15 aa, Mycobacterium tuberculosis
LPFIALGVAGAFVWS

SEQ ID NO: 75195 - protein, 15 aa, Mycobacterium tuberculosis
PFIALGVAGAFVWSP

SEQ ID NO: 75196 - protein, 15 aa, Mycobacterium tuberculosis
FIALGVAGAFVWSPL

SEQ ID NO: 75197 - protein, 15 aa, Mycobacterium tuberculosis
IALGVAGAFVWSPLT

SEQ ID NO: 75198 - protein, 15 aa, Mycobacterium tuberculosis
ALGVAGAFVWSPLTV

SEQ ID NO: 75199 - protein, 15 aa, Mycobacterium tuberculosis
LGVAGAFVWSPLTVT

SEQ ID NO: 75200 - protein, 15 aa, Mycobacterium tuberculosis
GVAGAFVWSPLTVTA

SEQ ID NO: 75201 - protein, 15 aa, Mycobacterium tuberculosis
VAGAFVWSPLTVTAT

SEQ ID NO: 75202 - protein, 15 aa, Mycobacterium tuberculosis
AGAFVWSPLTVTATR

SEQ ID NO: 75203 - protein, 15 aa, Mycobacterium tuberculosis
GAFVWSPLTVTATRN

SEQ ID NO: 75204 - protein, 15 aa, Mycobacterium tuberculosis
AFVWSPLTVTATRNL

SEQ ID NO: 75205 - protein, 15 aa, Mycobacterium tuberculosis
FVWSPLTVTATRNLR

SEQ ID NO: 75206 - protein, 15 aa, Mycobacterium tuberculosis
VWSPLTVTATRNLRP

SEQ ID NO: 75207 - protein, 15 aa, Mycobacterium tuberculosis
WSPLTVTATRNLRPH

SEQ ID NO: 75208 - protein, 15 aa, Mycobacterium tuberculosis
SPLTVTATRNLRPHL

SEQ ID NO: 75209 - protein, 15 aa, Mycobacterium tuberculosis
PLTVTATRNLRPHLA

SEQ ID NO: 75210 - protein, 15 aa, Mycobacterium tuberculosis
LTVTATRNLRPHLAG

SEQ ID NO: 75211 - protein, 15 aa, Mycobacterium tuberculosis
TVTATRNLRPHLAGA

SEQ ID NO: 75212 - protein, 15 aa, Mycobacterium tuberculosis
VTATRNLRPHLAGAS

SEQ ID NO: 75213 - protein, 15 aa, Mycobacterium tuberculosis
TATRNLRPHLAGASS

SEQ ID NO: 75214 - protein, 15 aa, Mycobacterium tuberculosis
ATRNLRPHLAGASSG

SEQ ID NO: 75215 - protein, 15 aa, Mycobacterium tuberculosis
TRNLRPHLAGASSGV

SEQ ID NO: 75216 - protein, 15 aa, Mycobacterium tuberculosis
RNLRPHLAGASSGVF

SEQ ID NO: 75217 - protein, 15 aa, Mycobacterium tuberculosis
NLRPHLAGASSGVFN

SEQ ID NO: 75218 - protein, 15 aa, Mycobacterium tuberculosis
LRPHLAGASSGVFNA

SEQ ID NO: 75219 - protein, 15 aa, Mycobacterium tuberculosis
RPHLAGASSGVFNAV

SEQ ID NO: 75220 - protein, 15 aa, Mycobacterium tuberculosis
PHLAGASSGVFNAVR

SEQ ID NO: 75221 - protein, 15 aa, Mycobacterium tuberculosis
HLAGASSGVFNAVRQ

SEQ ID NO: 75222 - protein, 15 aa, Mycobacterium tuberculosis
LAGASSGVFNAVRQL

SEQ ID NO: 75223 - protein, 15 aa, Mycobacterium tuberculosis
AGASSGVFNAVRQLG

SEQ ID NO: 75224 - protein, 15 aa, Mycobacterium tuberculosis
GASSGVFNAVRQLGA

SEQ ID NO: 75225 - protein, 15 aa, Mycobacterium tuberculosis
ASSGVFNAVRQLGAV

SEQ ID NO: 75226 - protein, 15 aa, Mycobacterium tuberculosis
SSGVFNAVRQLGAVL

SEQ ID NO: 75227 - protein, 15 aa, Mycobacterium tuberculosis
SGVFNAVRQLGAVLG

SEQ ID NO: 75228 - protein, 15 aa, Mycobacterium tuberculosis
GVFNAVRQLGAVLGS

SEQ ID NO: 75229 - protein, 15 aa, Mycobacterium tuberculosis
VFNAVRQLGAVLGSA

SEQ ID NO: 75230 - protein, 15 aa, Mycobacterium tuberculosis
FNAVRQLGAVLGSAS

SEQ ID NO: 75231 - protein, 15 aa, Mycobacterium tuberculosis
NAVRQLGAVLGSASM

SEQ ID NO: 75232 - protein, 15 aa, Mycobacterium tuberculosis
AVRQLGAVLGSASMA

SEQ ID NO: 75233 - protein, 15 aa, Mycobacterium tuberculosis
VRQLGAVLGSASMAA

SEQ ID NO: 75234 - protein, 15 aa, Mycobacterium tuberculosis
RQLGAVLGSASMAAF

SEQ ID NO: 75235 - protein, 15 aa, Mycobacterium tuberculosis
QLGAVLGSASMAAFM

SEQ ID NO: 75236 - protein, 15 aa, Mycobacterium tuberculosis
LGAVLGSASMAAFMT

SEQ ID NO: 75237 - protein, 15 aa, Mycobacterium tuberculosis
GAVLGSASMAAFMTS

SEQ ID NO: 75238 - protein, 15 aa, Mycobacterium tuberculosis
AVLGSASMAAFMTSR

SEQ ID NO: 75239 - protein, 15 aa, Mycobacterium tuberculosis
VLGSASMAAFMTSRI

SEQ ID NO: 75240 - protein, 15 aa, Mycobacterium tuberculosis
LGSASMAAFMTSRIA

SEQ ID NO: 75241 - protein, 15 aa, Mycobacterium tuberculosis
GSASMAAFMTSRIAA

SEQ ID NO: 75242 - protein, 15 aa, Mycobacterium tuberculosis
SASMAAFMTSRIAAE

SEQ ID NO: 75243 - protein, 15 aa, Mycobacterium tuberculosis
ASMAAFMTSRIAAEM

SEQ ID NO: 75244 - protein, 15 aa, Mycobacterium tuberculosis
SMAAFMTSRIAAEMP

SEQ ID NO: 75245 - protein, 15 aa, Mycobacterium tuberculosis
MAAFMTSRIAAEMPG

SEQ ID NO: 75246 - protein, 15 aa, Mycobacterium tuberculosis
AAFMTSRIAAEMPGG

SEQ ID NO: 75247 - protein, 15 aa, Mycobacterium tuberculosis
AFMTSRIAAEMPGGV

SEQ ID NO: 75248 - protein, 15 aa, Mycobacterium tuberculosis
FMTSRIAAEMPGGVD

SEQ ID NO: 75249 - protein, 15 aa, Mycobacterium tuberculosis
MTSRIAAEMPGGVDA

SEQ ID NO: 75250 - protein, 15 aa, Mycobacterium tuberculosis
TSRIAAEMPGGVDAL

SEQ ID NO: 75251 - protein, 15 aa, Mycobacterium tuberculosis
SRIAAEMPGGVDALT

SEQ ID NO: 75252 - protein, 15 aa, Mycobacterium tuberculosis
RIAAEMPGGVDALTG

SEQ ID NO: 75253 - protein, 15 aa, Mycobacterium tuberculosis
IAAEMPGGVDALTGP

SEQ ID NO: 75254 - protein, 15 aa, Mycobacterium tuberculosis
AAEMPGGVDALTGPA

SEQ ID NO: 75255 - protein, 15 aa, Mycobacterium tuberculosis
AEMPGGVDALTGPAG

SEQ ID NO: 75256 - protein, 15 aa, Mycobacterium tuberculosis
EMPGGVDALTGPAGQ

SEQ ID NO: 75257 - protein, 15 aa, Mycobacterium tuberculosis
MPGGVDALTGPAGQD

SEQ ID NO: 75258 - protein, 15 aa, Mycobacterium tuberculosis
PGGVDALTGPAGQDA

SEQ ID NO: 75259 - protein, 15 aa, Mycobacterium tuberculosis
GGVDALTGPAGQDAT

SEQ ID NO: 75260 - protein, 15 aa, Mycobacterium tuberculosis
GVDALTGPAGQDATV

SEQ ID NO: 75261 - protein, 15 aa, Mycobacterium tuberculosis
VDALTGPAGQDATVL

SEQ ID NO: 75262 - protein, 15 aa, Mycobacterium tuberculosis
DALTGPAGQDATVLQ

SEQ ID NO: 75263 - protein, 15 aa, Mycobacterium tuberculosis
ALTGPAGQDATVLQL

SEQ ID NO: 75264 - protein, 15 aa, Mycobacterium tuberculosis
LTGPAGQDATVLQLP

SEQ ID NO: 75265 - protein, 15 aa, Mycobacterium tuberculosis
TGPAGQDATVLQLPE

SEQ ID NO: 75266 - protein, 15 aa, Mycobacterium tuberculosis
GPAGQDATVLQLPEF

SEQ ID NO: 75267 - protein, 15 aa, Mycobacterium tuberculosis
PAGQDATVLQLPEFV

SEQ ID NO: 75268 - protein, 15 aa, Mycobacterium tuberculosis
AGQDATVLQLPEFVR

SEQ ID NO: 75269 - protein, 15 aa, Mycobacterium tuberculosis
GQDATVLQLPEFVRE

SEQ ID NO: 75270 - protein, 15 aa, Mycobacterium tuberculosis
QDATVLQLPEFVREP

SEQ ID NO: 75271 - protein, 15 aa, Mycobacterium tuberculosis
DATVLQLPEFVREPF

SEQ ID NO: 75272 - protein, 15 aa, Mycobacterium tuberculosis
ATVLQLPEFVREPFA

SEQ ID NO: 75273 - protein, 15 aa, Mycobacterium tuberculosis
TVLQLPEFVREPFAA

SEQ ID NO: 75274 - protein, 15 aa, Mycobacterium tuberculosis
VLQLPEFVREPFAAA

SEQ ID NO: 75275 - protein, 15 aa, Mycobacterium tuberculosis
LQLPEFVREPFAAAM

SEQ ID NO: 75276 - protein, 15 aa, Mycobacterium tuberculosis
QLPEFVREPFAAAMS

SEQ ID NO: 75277 - protein, 15 aa, Mycobacterium tuberculosis
LPEFVREPFAAAMSQ

SEQ ID NO: 75278 - protein, 15 aa, Mycobacterium tuberculosis
PEFVREPFAAAMSQS

SEQ ID NO: 75279 - protein, 15 aa, Mycobacterium tuberculosis
EFVREPFAAAMSQSM

SEQ ID NO: 75280 - protein, 15 aa, Mycobacterium tuberculosis
FVREPFAAAMSQSML

SEQ ID NO: 75281 - protein, 15 aa, Mycobacterium tuberculosis
VREPFAAAMSQSMLL

SEQ ID NO: 75282 - protein, 15 aa, Mycobacterium tuberculosis
REPFAAAMSQSMLLP

SEQ ID NO: 75283 - protein, 15 aa, Mycobacterium tuberculosis
EPFAAAMSQSMLLPA

SEQ ID NO: 75284 - protein, 15 aa, Mycobacterium tuberculosis
PFAAAMSQSMLLPAF

SEQ ID NO: 75285 - protein, 15 aa, Mycobacterium tuberculosis
FAAAMSQSMLLPAFV

SEQ ID NO: 75286 - protein, 15 aa, Mycobacterium tuberculosis
AAAMSQSMLLPAFVA

SEQ ID NO: 75287 - protein, 15 aa, Mycobacterium tuberculosis
AAMSQSMLLPAFVAL

SEQ ID NO: 75288 - protein, 15 aa, Mycobacterium tuberculosis
AMSQSMLLPAFVALF

SEQ ID NO: 75289 - protein, 15 aa, Mycobacterium tuberculosis
MSQSMLLPAFVALFG

SEQ ID NO: 75290 - protein, 15 aa, Mycobacterium tuberculosis
SQSMLLPAFVALFGI

SEQ ID NO: 75291 - protein, 15 aa, Mycobacterium tuberculosis
QSMLLPAFVALFGIV

SEQ ID NO: 75292 - protein, 15 aa, Mycobacterium tuberculosis
SMLLPAFVALFGIVA

SEQ ID NO: 75293 - protein, 15 aa, Mycobacterium tuberculosis
MLLPAFVALFGIVAA

SEQ ID NO: 75294 - protein, 15 aa, Mycobacterium tuberculosis
LLPAFVALFGIVAAL

SEQ ID NO: 75295 - protein, 15 aa, Mycobacterium tuberculosis
LPAFVALFGIVAALF

SEQ ID NO: 75296 - protein, 15 aa, Mycobacterium tuberculosis
PAFVALFGIVAALFL

SEQ ID NO: 75297 - protein, 15 aa, Mycobacterium tuberculosis
AFVALFGIVAALFLV

SEQ ID NO: 75298 - protein, 15 aa, Mycobacterium tuberculosis
FVALFGIVAALFLVD

SEQ ID NO: 75299 - protein, 15 aa, Mycobacterium tuberculosis
VALFGIVAALFLVDF

SEQ ID NO: 75300 - protein, 15 aa, Mycobacterium tuberculosis
ALFGIVAALFLVDFT

SEQ ID NO: 75301 - protein, 15 aa, Mycobacterium tuberculosis
LFGIVAALFLVDFTG

SEQ ID NO: 75302 - protein, 15 aa, Mycobacterium tuberculosis
FGIVAALFLVDFTGA

SEQ ID NO: 75303 - protein, 15 aa, Mycobacterium tuberculosis
GIVAALFLVDFTGAA

SEQ ID NO: 75304 - protein, 15 aa, Mycobacterium tuberculosis
IVAALFLVDFTGAAV

SEQ ID NO: 75305 - protein, 15 aa, Mycobacterium tuberculosis
VAALFLVDFTGAAVA

SEQ ID NO: 75306 - protein, 15 aa, Mycobacterium tuberculosis
AALFLVDFTGAAVAK

SEQ ID NO: 75307 - protein, 15 aa, Mycobacterium tuberculosis
ALFLVDFTGAAVAKE

SEQ ID NO: 75308 - protein, 15 aa, Mycobacterium tuberculosis
LFLVDFTGAAVAKEP

SEQ ID NO: 75309 - protein, 15 aa, Mycobacterium tuberculosis
FLVDFTGAAVAKEPL

SEQ ID NO: 75310 - protein, 15 aa, Mycobacterium tuberculosis
LVDFTGAAVAKEPLP

SEQ ID NO: 75311 - protein, 15 aa, Mycobacterium tuberculosis
VDFTGAAVAKEPLPE

SEQ ID NO: 75312 - protein, 15 aa, Mycobacterium tuberculosis
DFTGAAVAKEPLPES

SEQ ID NO: 75313 - protein, 15 aa, Mycobacterium tuberculosis
FTGAAVAKEPLPESD

SEQ ID NO: 75314 - protein, 15 aa, Mycobacterium tuberculosis
TGAAVAKEPLPESDG

SEQ ID NO: 75315 - protein, 15 aa, Mycobacterium tuberculosis
GAAVAKEPLPESDGD

SEQ ID NO: 75316 - protein, 15 aa, Mycobacterium tuberculosis
AAVAKEPLPESDGDA

SEQ ID NO: 75317 - protein, 15 aa, Mycobacterium tuberculosis
AVAKEPLPESDGDAD

SEQ ID NO: 75318 - protein, 15 aa, Mycobacterium tuberculosis
VAKEPLPESDGDADD

SEQ ID NO: 75319 - protein, 15 aa, Mycobacterium tuberculosis
AKEPLPESDGDADDD

SEQ ID NO: 75320 - protein, 15 aa, Mycobacterium tuberculosis
KEPLPESDGDADDDD

SEQ ID NO: 75321 - protein, 15 aa, Mycobacterium tuberculosis
EPLPESDGDADDDDY

SEQ ID NO: 75322 - protein, 15 aa, Mycobacterium tuberculosis
PLPESDGDADDDDYV

SEQ ID NO: 75323 - protein, 15 aa, Mycobacterium tuberculosis
LPESDGDADDDDYVE

SEQ ID NO: 75324 - protein, 15 aa, Mycobacterium tuberculosis
PESDGDADDDDYVEY

SEQ ID NO: 75325 - protein, 15 aa, Mycobacterium tuberculosis
ESDGDADDDDYVEYI

SEQ ID NO: 75326 - protein, 15 aa, Mycobacterium tuberculosis
SDGDADDDDYVEYIL

SEQ ID NO: 75327 - protein, 15 aa, Mycobacterium tuberculosis
DGDADDDDYVEYILR

SEQ ID NO: 75328 - protein, 15 aa, Mycobacterium tuberculosis
GDADDDDYVEYILRR

SEQ ID NO: 75329 - protein, 15 aa, Mycobacterium tuberculosis
DADDDDYVEYILRRE

SEQ ID NO: 75330 - protein, 15 aa, Mycobacterium tuberculosis
ADDDDYVEYILRREP

SEQ ID NO: 75331 - protein, 15 aa, Mycobacterium tuberculosis
DDDDYVEYILRREPE

SEQ ID NO: 75332 - protein, 15 aa, Mycobacterium tuberculosis
DDDYVEYILRREPEE

SEQ ID NO: 75333 - protein, 15 aa, Mycobacterium tuberculosis
DDYVEYILRREPEED

SEQ ID NO: 75334 - protein, 15 aa, Mycobacterium tuberculosis
DYVEYILRREPEEDC

SEQ ID NO: 75335 - protein, 15 aa, Mycobacterium tuberculosis
YVEYILRREPEEDCD

SEQ ID NO: 75336 - protein, 15 aa, Mycobacterium tuberculosis
VEYILRREPEEDCDT

SEQ ID NO: 75337 - protein, 15 aa, Mycobacterium tuberculosis
EYILRREPEEDCDTQ

SEQ ID NO: 75338 - protein, 15 aa, Mycobacterium tuberculosis
YILRREPEEDCDTQP

SEQ ID NO: 75339 - protein, 15 aa, Mycobacterium tuberculosis
ILRREPEEDCDTQPL

SEQ ID NO: 75340 - protein, 15 aa, Mycobacterium tuberculosis
LRREPEEDCDTQPLR

SEQ ID NO: 75341 - protein, 15 aa, Mycobacterium tuberculosis
RREPEEDCDTQPLRA

SEQ ID NO: 75342 - protein, 15 aa, Mycobacterium tuberculosis
REPEEDCDTQPLRAS

SEQ ID NO: 75343 - protein, 15 aa, Mycobacterium tuberculosis
EPEEDCDTQPLRASR

SEQ ID NO: 75344 - protein, 15 aa, Mycobacterium tuberculosis
PEEDCDTQPLRASRP

SEQ ID NO: 75345 - protein, 15 aa, Mycobacterium tuberculosis
EEDCDTQPLRASRPA

SEQ ID NO: 75346 - protein, 15 aa, Mycobacterium tuberculosis
EDCDTQPLRASRPAA

SEQ ID NO: 75347 - protein, 15 aa, Mycobacterium tuberculosis
DCDTQPLRASRPAAA

SEQ ID NO: 75348 - protein, 15 aa, Mycobacterium tuberculosis
CDTQPLRASRPAAAA

SEQ ID NO: 75349 - protein, 15 aa, Mycobacterium tuberculosis
DTQPLRASRPAAAAA

SEQ ID NO: 75350 - protein, 15 aa, Mycobacterium tuberculosis
TQPLRASRPAAAAAS

SEQ ID NO: 75351 - protein, 15 aa, Mycobacterium tuberculosis
QPLRASRPAAAAASR

SEQ ID NO: 75352 - protein, 15 aa, Mycobacterium tuberculosis
PLRASRPAAAAASRS

SEQ ID NO: 75353 - protein, 15 aa, Mycobacterium tuberculosis
LRASRPAAAAASRSG

SEQ ID NO: 75354 - protein, 15 aa, Mycobacterium tuberculosis
RASRPAAAAASRSGA

SEQ ID NO: 75355 - protein, 15 aa, Mycobacterium tuberculosis
ASRPAAAAASRSGAG

SEQ ID NO: 75356 - protein, 15 aa, Mycobacterium tuberculosis
SRPAAAAASRSGAGG

SEQ ID NO: 75357 - protein, 15 aa, Mycobacterium tuberculosis
RPAAAAASRSGAGGP

SEQ ID NO: 75358 - protein, 15 aa, Mycobacterium tuberculosis
PAAAAASRSGAGGPL

SEQ ID NO: 75359 - protein, 15 aa, Mycobacterium tuberculosis
AAAAASRSGAGGPLA

SEQ ID NO: 75360 - protein, 15 aa, Mycobacterium tuberculosis
AAAASRSGAGGPLAV

SEQ ID NO: 75361 - protein, 15 aa, Mycobacterium tuberculosis
AAASRSGAGGPLAVS

SEQ ID NO: 75362 - protein, 15 aa, Mycobacterium tuberculosis
AASRSGAGGPLAVSW

SEQ ID NO: 75363 - protein, 15 aa, Mycobacterium tuberculosis
ASRSGAGGPLAVSWS

SEQ ID NO: 75364 - protein, 15 aa, Mycobacterium tuberculosis
SRSGAGGPLAVSWST

SEQ ID NO: 75365 - protein, 15 aa, Mycobacterium tuberculosis
RSGAGGPLAVSWSTS

SEQ ID NO: 75366 - protein, 15 aa, Mycobacterium tuberculosis
SGAGGPLAVSWSTSA

SEQ ID NO: 75367 - protein, 15 aa, Mycobacterium tuberculosis
GAGGPLAVSWSTSAQ

SEQ ID NO: 75368 - protein, 15 aa, Mycobacterium tuberculosis
AGGPLAVSWSTSAQG

SEQ ID NO: 75369 - protein, 15 aa, Mycobacterium tuberculosis
GGPLAVSWSTSAQGM

SEQ ID NO: 75370 - protein, 15 aa, Mycobacterium tuberculosis
GPLAVSWSTSAQGMP

SEQ ID NO: 75371 - protein, 15 aa, Mycobacterium tuberculosis
PLAVSWSTSAQGMPP

SEQ ID NO: 75372 - protein, 15 aa, Mycobacterium tuberculosis
LAVSWSTSAQGMPPG

SEQ ID NO: 75373 - protein, 15 aa, Mycobacterium tuberculosis
AVSWSTSAQGMPPGP

SEQ ID NO: 75374 - protein, 15 aa, Mycobacterium tuberculosis
VSWSTSAQGMPPGPP

SEQ ID NO: 75375 - protein, 15 aa, Mycobacterium tuberculosis
SWSTSAQGMPPGPPG

SEQ ID NO: 75376 - protein, 15 aa, Mycobacterium tuberculosis
WSTSAQGMPPGPPGR

SEQ ID NO: 75377 - protein, 15 aa, Mycobacterium tuberculosis
STSAQGMPPGPPGRR

SEQ ID NO: 75378 - protein, 15 aa, Mycobacterium tuberculosis
TSAQGMPPGPPGRRA

SEQ ID NO: 75379 - protein, 15 aa, Mycobacterium tuberculosis
SAQGMPPGPPGRRAW

SEQ ID NO: 75380 - protein, 15 aa, Mycobacterium tuberculosis
AQGMPPGPPGRRAWQ

SEQ ID NO: 75381 - protein, 15 aa, Mycobacterium tuberculosis
QGMPPGPPGRRAWQA

SEQ ID NO: 75382 - protein, 15 aa, Mycobacterium tuberculosis
GMPPGPPGRRAWQAD

SEQ ID NO: 75383 - protein, 15 aa, Mycobacterium tuberculosis
MPPGPPGRRAWQADT

SEQ ID NO: 75384 - protein, 15 aa, Mycobacterium tuberculosis
PPGPPGRRAWQADTE

SEQ ID NO: 75385 - protein, 15 aa, Mycobacterium tuberculosis
PGPPGRRAWQADTES

SEQ ID NO: 75386 - protein, 15 aa, Mycobacterium tuberculosis
GPPGRRAWQADTEST

SEQ ID NO: 75387 - protein, 15 aa, Mycobacterium tuberculosis
PPGRRAWQADTESTA

SEQ ID NO: 75388 - protein, 15 aa, Mycobacterium tuberculosis
PGRRAWQADTESTAP

SEQ ID NO: 75389 - protein, 15 aa, Mycobacterium tuberculosis
GRRAWQADTESTAPS

SEQ ID NO: 75390 - protein, 15 aa, Mycobacterium tuberculosis
RRAWQADTESTAPSA

SEQ ID NO: 75391 - protein, 16 aa, Mycobacterium tuberculosis
MTTAIRRAAGSSYFRN

SEQ ID NO: 75392 - protein, 16 aa, Mycobacterium tuberculosis
TTAIRRAAGSSYFRNP

SEQ ID NO: 75393 - protein, 16 aa, Mycobacterium tuberculosis
TAIRRAAGSSYFRNPW

SEQ ID NO: 75394 - protein, 16 aa, Mycobacterium tuberculosis
AIRRAAGSSYFRNPWP

SEQ ID NO: 75395 - protein, 16 aa, Mycobacterium tuberculosis
IRRAAGSSYFRNPWPA

SEQ ID NO: 75396 - protein, 16 aa, Mycobacterium tuberculosis
RRAAGSSYFRNPWPAL

SEQ ID NO: 75397 - protein, 16 aa, Mycobacterium tuberculosis
RAAGSSYFRNPWPALW

SEQ ID NO: 75398 - protein, 16 aa, Mycobacterium tuberculosis
AAGSSYFRNPWPALWA

SEQ ID NO: 75399 - protein, 16 aa, Mycobacterium tuberculosis
AGSSYFRNPWPALWAM

SEQ ID NO: 75400 - protein, 16 aa, Mycobacterium tuberculosis
GSSYFRNPWPALWAMM

SEQ ID NO: 75401 - protein, 16 aa, Mycobacterium tuberculosis
SSYFRNPWPALWAMMV

SEQ ID NO: 75402 - protein, 16 aa, Mycobacterium tuberculosis
SYFRNPWPALWAMMVG

SEQ ID NO: 75403 - protein, 16 aa, Mycobacterium tuberculosis
YFRNPWPALWAMMVGF

SEQ ID NO: 75404 - protein, 16 aa, Mycobacterium tuberculosis
FRNPWPALWAMMVGFF

SEQ ID NO: 75405 - protein, 16 aa, Mycobacterium tuberculosis
RNPWPALWAMMVGFFM

SEQ ID NO: 75406 - protein, 16 aa, Mycobacterium tuberculosis
NPWPALWAMMVGFFMI

SEQ ID NO: 75407 - protein, 16 aa, Mycobacterium tuberculosis
PWPALWAMMVGFFMIM

SEQ ID NO: 75408 - protein, 16 aa, Mycobacterium tuberculosis
WPALWAMMVGFFMIML

SEQ ID NO: 75409 - protein, 16 aa, Mycobacterium tuberculosis
PALWAMMVGFFMIMLD

SEQ ID NO: 75410 - protein, 16 aa, Mycobacterium tuberculosis
ALWAMMVGFFMIMLDS

SEQ ID NO: 75411 - protein, 16 aa, Mycobacterium tuberculosis
LWAMMVGFFMIMLDST

SEQ ID NO: 75412 - protein, 16 aa, Mycobacterium tuberculosis
WAMMVGFFMIMLDSTV

SEQ ID NO: 75413 - protein, 16 aa, Mycobacterium tuberculosis
AMMVGFFMIMLDSTVV

SEQ ID NO: 75414 - protein, 16 aa, Mycobacterium tuberculosis
MMVGFFMIMLDSTVVA

SEQ ID NO: 75415 - protein, 16 aa, Mycobacterium tuberculosis
MVGFFMIMLDSTVVAI

SEQ ID NO: 75416 - protein, 16 aa, Mycobacterium tuberculosis
VGFFMIMLDSTVVAIA

SEQ ID NO: 75417 - protein, 16 aa, Mycobacterium tuberculosis
GFFMIMLDSTVVAIAN

SEQ ID NO: 75418 - protein, 16 aa, Mycobacterium tuberculosis
FFMIMLDSTVVAIANP

SEQ ID NO: 75419 - protein, 16 aa, Mycobacterium tuberculosis
FMIMLDSTVVAIANPT

SEQ ID NO: 75420 - protein, 16 aa, Mycobacterium tuberculosis
MIMLDSTVVAIANPTI

SEQ ID NO: 75421 - protein, 16 aa, Mycobacterium tuberculosis
IMLDSTVVAIANPTIM

SEQ ID NO: 75422 - protein, 16 aa, Mycobacterium tuberculosis
MLDSTVVAIANPTIMA

SEQ ID NO: 75423 - protein, 16 aa, Mycobacterium tuberculosis
LDSTVVAIANPTIMAQ

SEQ ID NO: 75424 - protein, 16 aa, Mycobacterium tuberculosis
DSTVVAIANPTIMAQL

SEQ ID NO: 75425 - protein, 16 aa, Mycobacterium tuberculosis
STVVAIANPTIMAQLR

SEQ ID NO: 75426 - protein, 16 aa, Mycobacterium tuberculosis
TVVAIANPTIMAQLRI

SEQ ID NO: 75427 - protein, 16 aa, Mycobacterium tuberculosis
VVAIANPTIMAQLRIG

SEQ ID NO: 75428 - protein, 16 aa, Mycobacterium tuberculosis
VAIANPTIMAQLRIGY

SEQ ID NO: 75429 - protein, 16 aa, Mycobacterium tuberculosis
AIANPTIMAQLRIGYA

SEQ ID NO: 75430 - protein, 16 aa, Mycobacterium tuberculosis
IANPTIMAQLRIGYAT

SEQ ID NO: 75431 - protein, 16 aa, Mycobacterium tuberculosis
ANPTIMAQLRIGYATV

SEQ ID NO: 75432 - protein, 16 aa, Mycobacterium tuberculosis
NPTIMAQLRIGYATVV

SEQ ID NO: 75433 - protein, 16 aa, Mycobacterium tuberculosis
PTIMAQLRIGYATVVW

SEQ ID NO: 75434 - protein, 16 aa, Mycobacterium tuberculosis
TIMAQLRIGYATVVWV

SEQ ID NO: 75435 - protein, 16 aa, Mycobacterium tuberculosis
IMAQLRIGYATVVWVT

SEQ ID NO: 75436 - protein, 16 aa, Mycobacterium tuberculosis
MAQLRIGYATVVWVTS

SEQ ID NO: 75437 - protein, 16 aa, Mycobacterium tuberculosis
AQLRIGYATVVWVTSA

SEQ ID NO: 75438 - protein, 16 aa, Mycobacterium tuberculosis
QLRIGYATVVWVTSAY

SEQ ID NO: 75439 - protein, 16 aa, Mycobacterium tuberculosis
LRIGYATVVWVTSAYL

SEQ ID NO: 75440 - protein, 16 aa, Mycobacterium tuberculosis
RIGYATVVWVTSAYLL

SEQ ID NO: 75441 - protein, 16 aa, Mycobacterium tuberculosis
IGYATVVWVTSAYLLA

SEQ ID NO: 75442 - protein, 16 aa, Mycobacterium tuberculosis
GYATVVWVTSAYLLAY

SEQ ID NO: 75443 - protein, 16 aa, Mycobacterium tuberculosis
YATVVWVTSAYLLAYA

SEQ ID NO: 75444 - protein, 16 aa, Mycobacterium tuberculosis
ATVVWVTSAYLLAYAV

SEQ ID NO: 75445 - protein, 16 aa, Mycobacterium tuberculosis
TVVWVTSAYLLAYAVP

SEQ ID NO: 75446 - protein, 16 aa, Mycobacterium tuberculosis
VVWVTSAYLLAYAVPM

SEQ ID NO: 75447 - protein, 16 aa, Mycobacterium tuberculosis
VWVTSAYLLAYAVPML

SEQ ID NO: 75448 - protein, 16 aa, Mycobacterium tuberculosis
WVTSAYLLAYAVPMLV

SEQ ID NO: 75449 - protein, 16 aa, Mycobacterium tuberculosis
VTSAYLLAYAVPMLVA

SEQ ID NO: 75450 - protein, 16 aa, Mycobacterium tuberculosis
TSAYLLAYAVPMLVAG

SEQ ID NO: 75451 - protein, 16 aa, Mycobacterium tuberculosis
SAYLLAYAVPMLVAGR

SEQ ID NO: 75452 - protein, 16 aa, Mycobacterium tuberculosis
AYLLAYAVPMLVAGRL

SEQ ID NO: 75453 - protein, 16 aa, Mycobacterium tuberculosis
YLLAYAVPMLVAGRLG

SEQ ID NO: 75454 - protein, 16 aa, Mycobacterium tuberculosis
LLAYAVPMLVAGRLGD

SEQ ID NO: 75455 - protein, 16 aa, Mycobacterium tuberculosis
LAYAVPMLVAGRLGDR

SEQ ID NO: 75456 - protein, 16 aa, Mycobacterium tuberculosis
AYAVPMLVAGRLGDRF

SEQ ID NO: 75457 - protein, 16 aa, Mycobacterium tuberculosis
YAVPMLVAGRLGDRFG

SEQ ID NO: 75458 - protein, 16 aa, Mycobacterium tuberculosis
AVPMLVAGRLGDRFGP

SEQ ID NO: 75459 - protein, 16 aa, Mycobacterium tuberculosis
VPMLVAGRLGDRFGPK

SEQ ID NO: 75460 - protein, 16 aa, Mycobacterium tuberculosis
PMLVAGRLGDRFGPKN

SEQ ID NO: 75461 - protein, 16 aa, Mycobacterium tuberculosis
MLVAGRLGDRFGPKNL

SEQ ID NO: 75462 - protein, 16 aa, Mycobacterium tuberculosis
LVAGRLGDRFGPKNLY

SEQ ID NO: 75463 - protein, 16 aa, Mycobacterium tuberculosis
VAGRLGDRFGPKNLYL

SEQ ID NO: 75464 - protein, 16 aa, Mycobacterium tuberculosis
AGRLGDRFGPKNLYLI

SEQ ID NO: 75465 - protein, 16 aa, Mycobacterium tuberculosis
GRLGDRFGPKNLYLIG

SEQ ID NO: 75466 - protein, 16 aa, Mycobacterium tuberculosis
RLGDRFGPKNLYLIGL

SEQ ID NO: 75467 - protein, 16 aa, Mycobacterium tuberculosis
LGDRFGPKNLYLIGLG

SEQ ID NO: 75468 - protein, 16 aa, Mycobacterium tuberculosis
GDRFGPKNLYLIGLGV

SEQ ID NO: 75469 - protein, 16 aa, Mycobacterium tuberculosis
DRFGPKNLYLIGLGVF

SEQ ID NO: 75470 - protein, 16 aa, Mycobacterium tuberculosis
RFGPKNLYLIGLGVFT

SEQ ID NO: 75471 - protein, 16 aa, Mycobacterium tuberculosis
FGPKNLYLIGLGVFTV

SEQ ID NO: 75472 - protein, 16 aa, Mycobacterium tuberculosis
GPKNLYLIGLGVFTVA

SEQ ID NO: 75473 - protein, 16 aa, Mycobacterium tuberculosis
PKNLYLIGLGVFTVAS

SEQ ID NO: 75474 - protein, 16 aa, Mycobacterium tuberculosis
KNLYLIGLGVFTVASL

SEQ ID NO: 75475 - protein, 16 aa, Mycobacterium tuberculosis
NLYLIGLGVFTVASLG

SEQ ID NO: 75476 - protein, 16 aa, Mycobacterium tuberculosis
LYLIGLGVFTVASLGC

SEQ ID NO: 75477 - protein, 16 aa, Mycobacterium tuberculosis
YLIGLGVFTVASLGCG

SEQ ID NO: 75478 - protein, 16 aa, Mycobacterium tuberculosis
LIGLGVFTVASLGCGL

SEQ ID NO: 75479 - protein, 16 aa, Mycobacterium tuberculosis
IGLGVFTVASLGCGLS

SEQ ID NO: 75480 - protein, 16 aa, Mycobacterium tuberculosis
GLGVFTVASLGCGLSS

SEQ ID NO: 75481 - protein, 16 aa, Mycobacterium tuberculosis
LGVFTVASLGCGLSSG

SEQ ID NO: 75482 - protein, 16 aa, Mycobacterium tuberculosis
GVFTVASLGCGLSSGA

SEQ ID NO: 75483 - protein, 16 aa, Mycobacterium tuberculosis
VFTVASLGCGLSSGAG

SEQ ID NO: 75484 - protein, 16 aa, Mycobacterium tuberculosis
FTVASLGCGLSSGAGM

SEQ ID NO: 75485 - protein, 16 aa, Mycobacterium tuberculosis
TVASLGCGLSSGAGML

SEQ ID NO: 75486 - protein, 16 aa, Mycobacterium tuberculosis
VASLGCGLSSGAGMLI

SEQ ID NO: 75487 - protein, 16 aa, Mycobacterium tuberculosis
ASLGCGLSSGAGMLIA

SEQ ID NO: 75488 - protein, 16 aa, Mycobacterium tuberculosis
SLGCGLSSGAGMLIAA

SEQ ID NO: 75489 - protein, 16 aa, Mycobacterium tuberculosis
LGCGLSSGAGMLIAAR

SEQ ID NO: 75490 - protein, 16 aa, Mycobacterium tuberculosis
GCGLSSGAGMLIAARV

SEQ ID NO: 75491 - protein, 16 aa, Mycobacterium tuberculosis
CGLSSGAGMLIAARVV

SEQ ID NO: 75492 - protein, 16 aa, Mycobacterium tuberculosis
GLSSGAGMLIAARVVQ

SEQ ID NO: 75493 - protein, 16 aa, Mycobacterium tuberculosis
LSSGAGMLIAARVVQG

SEQ ID NO: 75494 - protein, 16 aa, Mycobacterium tuberculosis
SSGAGMLIAARVVQGV

SEQ ID NO: 75495 - protein, 16 aa, Mycobacterium tuberculosis
SGAGMLIAARVVQGVG

SEQ ID NO: 75496 - protein, 16 aa, Mycobacterium tuberculosis
GAGMLIAARVVQGVGA

SEQ ID NO: 75497 - protein, 16 aa, Mycobacterium tuberculosis
AGMLIAARVVQGVGAG

SEQ ID NO: 75498 - protein, 16 aa, Mycobacterium tuberculosis
GMLIAARVVQGVGAGL

SEQ ID NO: 75499 - protein, 16 aa, Mycobacterium tuberculosis
MLIAARVVQGVGAGLL

SEQ ID NO: 75500 - protein, 16 aa, Mycobacterium tuberculosis
LIAARVVQGVGAGLLT

SEQ ID NO: 75501 - protein, 16 aa, Mycobacterium tuberculosis
IAARVVQGVGAGLLTP

SEQ ID NO: 75502 - protein, 16 aa, Mycobacterium tuberculosis
AARVVQGVGAGLLTPQ

SEQ ID NO: 75503 - protein, 16 aa, Mycobacterium tuberculosis
ARVVQGVGAGLLTPQT

SEQ ID NO: 75504 - protein, 16 aa, Mycobacterium tuberculosis
RVVQGVGAGLLTPQTL

SEQ ID NO: 75505 - protein, 16 aa, Mycobacterium tuberculosis
VVQGVGAGLLTPQTLS

SEQ ID NO: 75506 - protein, 16 aa, Mycobacterium tuberculosis
VQGVGAGLLTPQTLST

SEQ ID NO: 75507 - protein, 16 aa, Mycobacterium tuberculosis
QGVGAGLLTPQTLSTI

SEQ ID NO: 75508 - protein, 16 aa, Mycobacterium tuberculosis
GVGAGLLTPQTLSTIT

SEQ ID NO: 75509 - protein, 16 aa, Mycobacterium tuberculosis
VGAGLLTPQTLSTITR

SEQ ID NO: 75510 - protein, 16 aa, Mycobacterium tuberculosis
GAGLLTPQTLSTITRI

SEQ ID NO: 75511 - protein, 16 aa, Mycobacterium tuberculosis
AGLLTPQTLSTITRIF

SEQ ID NO: 75512 - protein, 16 aa, Mycobacterium tuberculosis
GLLTPQTLSTITRIFP

SEQ ID NO: 75513 - protein, 16 aa, Mycobacterium tuberculosis
LLTPQTLSTITRIFPA

SEQ ID NO: 75514 - protein, 16 aa, Mycobacterium tuberculosis
LTPQTLSTITRIFPAH

SEQ ID NO: 75515 - protein, 16 aa, Mycobacterium tuberculosis
TPQTLSTITRIFPAHR

SEQ ID NO: 75516 - protein, 16 aa, Mycobacterium tuberculosis
PQTLSTITRIFPAHRR

SEQ ID NO: 75517 - protein, 16 aa, Mycobacterium tuberculosis
QTLSTITRIFPAHRRG

SEQ ID NO: 75518 - protein, 16 aa, Mycobacterium tuberculosis
TLSTITRIFPAHRRGV

SEQ ID NO: 75519 - protein, 16 aa, Mycobacterium tuberculosis
LSTITRIFPAHRRGVA

SEQ ID NO: 75520 - protein, 16 aa, Mycobacterium tuberculosis
STITRIFPAHRRGVAL

SEQ ID NO: 75521 - protein, 16 aa, Mycobacterium tuberculosis
TITRIFPAHRRGVALG

SEQ ID NO: 75522 - protein, 16 aa, Mycobacterium tuberculosis
ITRIFPAHRRGVALGA

SEQ ID NO: 75523 - protein, 16 aa, Mycobacterium tuberculosis
TRIFPAHRRGVALGAW

SEQ ID NO: 75524 - protein, 16 aa, Mycobacterium tuberculosis
RIFPAHRRGVALGAWG

SEQ ID NO: 75525 - protein, 16 aa, Mycobacterium tuberculosis
IFPAHRRGVALGAWGT

SEQ ID NO: 75526 - protein, 16 aa, Mycobacterium tuberculosis
FPAHRRGVALGAWGTV

SEQ ID NO: 75527 - protein, 16 aa, Mycobacterium tuberculosis
PAHRRGVALGAWGTVA

SEQ ID NO: 75528 - protein, 16 aa, Mycobacterium tuberculosis
AHRRGVALGAWGTVAS

SEQ ID NO: 75529 - protein, 16 aa, Mycobacterium tuberculosis
HRRGVALGAWGTVASV

SEQ ID NO: 75530 - protein, 16 aa, Mycobacterium tuberculosis
RRGVALGAWGTVASVA

SEQ ID NO: 75531 - protein, 16 aa, Mycobacterium tuberculosis
RGVALGAWGTVASVAS

SEQ ID NO: 75532 - protein, 16 aa, Mycobacterium tuberculosis
GVALGAWGTVASVASL

SEQ ID NO: 75533 - protein, 16 aa, Mycobacterium tuberculosis
VALGAWGTVASVASLV

SEQ ID NO: 75534 - protein, 16 aa, Mycobacterium tuberculosis
ALGAWGTVASVASLVG

SEQ ID NO: 75535 - protein, 16 aa, Mycobacterium tuberculosis
LGAWGTVASVASLVGP

SEQ ID NO: 75536 - protein, 16 aa, Mycobacterium tuberculosis
GAWGTVASVASLVGPL

SEQ ID NO: 75537 - protein, 16 aa, Mycobacterium tuberculosis
AWGTVASVASLVGPLA

SEQ ID NO: 75538 - protein, 16 aa, Mycobacterium tuberculosis
WGTVASVASLVGPLAG

SEQ ID NO: 75539 - protein, 16 aa, Mycobacterium tuberculosis
GTVASVASLVGPLAGG

SEQ ID NO: 75540 - protein, 16 aa, Mycobacterium tuberculosis
TVASVASLVGPLAGGA

SEQ ID NO: 75541 - protein, 16 aa, Mycobacterium tuberculosis
VASVASLVGPLAGGAL

SEQ ID NO: 75542 - protein, 16 aa, Mycobacterium tuberculosis
ASVASLVGPLAGGALV

SEQ ID NO: 75543 - protein, 16 aa, Mycobacterium tuberculosis
SVASLVGPLAGGALVD

SEQ ID NO: 75544 - protein, 16 aa, Mycobacterium tuberculosis
VASLVGPLAGGALVDS

SEQ ID NO: 75545 - protein, 16 aa, Mycobacterium tuberculosis
ASLVGPLAGGALVDSM

SEQ ID NO: 75546 - protein, 16 aa, Mycobacterium tuberculosis
SLVGPLAGGALVDSMG

SEQ ID NO: 75547 - protein, 16 aa, Mycobacterium tuberculosis
LVGPLAGGALVDSMGW

SEQ ID NO: 75548 - protein, 16 aa, Mycobacterium tuberculosis
VGPLAGGALVDSMGWE

SEQ ID NO: 75549 - protein, 16 aa, Mycobacterium tuberculosis
GPLAGGALVDSMGWEW

SEQ ID NO: 75550 - protein, 16 aa, Mycobacterium tuberculosis
PLAGGALVDSMGWEWI

SEQ ID NO: 75551 - protein, 16 aa, Mycobacterium tuberculosis
LAGGALVDSMGWEWIF

SEQ ID NO: 75552 - protein, 16 aa, Mycobacterium tuberculosis
AGGALVDSMGWEWIFF

SEQ ID NO: 75553 - protein, 16 aa, Mycobacterium tuberculosis
GGALVDSMGWEWIFFV

SEQ ID NO: 75554 - protein, 16 aa, Mycobacterium tuberculosis
GALVDSMGWEWIFFVN

SEQ ID NO: 75555 - protein, 16 aa, Mycobacterium tuberculosis
ALVDSMGWEWIFFVNV

SEQ ID NO: 75556 - protein, 16 aa, Mycobacterium tuberculosis
LVDSMGWEWIFFVNVP

SEQ ID NO: 75557 - protein, 16 aa, Mycobacterium tuberculosis
VDSMGWEWIFFVNVPV

SEQ ID NO: 75558 - protein, 16 aa, Mycobacterium tuberculosis
DSMGWEWIFFVNVPVG

SEQ ID NO: 75559 - protein, 16 aa, Mycobacterium tuberculosis
SMGWEWIFFVNVPVGV

SEQ ID NO: 75560 - protein, 16 aa, Mycobacterium tuberculosis
MGWEWIFFVNVPVGVI

SEQ ID NO: 75561 - protein, 16 aa, Mycobacterium tuberculosis
GWEWIFFVNVPVGVIG

SEQ ID NO: 75562 - protein, 16 aa, Mycobacterium tuberculosis
WEWIFFVNVPVGVIGL

SEQ ID NO: 75563 - protein, 16 aa, Mycobacterium tuberculosis
EWIFFVNVPVGVIGLI

SEQ ID NO: 75564 - protein, 16 aa, Mycobacterium tuberculosis
WIFFVNVPVGVIGLIL

SEQ ID NO: 75565 - protein, 16 aa, Mycobacterium tuberculosis
IFFVNVPVGVIGLILA

SEQ ID NO: 75566 - protein, 16 aa, Mycobacterium tuberculosis
FFVNVPVGVIGLILAA

SEQ ID NO: 75567 - protein, 16 aa, Mycobacterium tuberculosis
FVNVPVGVIGLILAAY

SEQ ID NO: 75568 - protein, 16 aa, Mycobacterium tuberculosis
VNVPVGVIGLILAAYL

SEQ ID NO: 75569 - protein, 16 aa, Mycobacterium tuberculosis
NVPVGVIGLILAAYLI

SEQ ID NO: 75570 - protein, 16 aa, Mycobacterium tuberculosis
VPVGVIGLILAAYLIP

SEQ ID NO: 75571 - protein, 16 aa, Mycobacterium tuberculosis
PVGVIGLILAAYLIPA

SEQ ID NO: 75572 - protein, 16 aa, Mycobacterium tuberculosis
VGVIGLILAAYLIPAL

SEQ ID NO: 75573 - protein, 16 aa, Mycobacterium tuberculosis
GVIGLILAAYLIPALP

SEQ ID NO: 75574 - protein, 16 aa, Mycobacterium tuberculosis
VIGLILAAYLIPALPH

SEQ ID NO: 75575 - protein, 16 aa, Mycobacterium tuberculosis
IGLILAAYLIPALPHH

SEQ ID NO: 75576 - protein, 16 aa, Mycobacterium tuberculosis
GLILAAYLIPALPHHP

SEQ ID NO: 75577 - protein, 16 aa, Mycobacterium tuberculosis
LILAAYLIPALPHHPH

SEQ ID NO: 75578 - protein, 16 aa, Mycobacterium tuberculosis
ILAAYLIPALPHHPHR

SEQ ID NO: 75579 - protein, 16 aa, Mycobacterium tuberculosis
LAAYLIPALPHHPHRF

SEQ ID NO: 75580 - protein, 16 aa, Mycobacterium tuberculosis
AAYLIPALPHHPHRFD

SEQ ID NO: 75581 - protein, 16 aa, Mycobacterium tuberculosis
AYLIPALPHHPHRFDW

SEQ ID NO: 75582 - protein, 16 aa, Mycobacterium tuberculosis
YLIPALPHHPHRFDWF

SEQ ID NO: 75583 - protein, 16 aa, Mycobacterium tuberculosis
LIPALPHHPHRFDWFG

SEQ ID NO: 75584 - protein, 16 aa, Mycobacterium tuberculosis
IPALPHHPHRFDWFGV

SEQ ID NO: 75585 - protein, 16 aa, Mycobacterium tuberculosis
PALPHHPHRFDWFGVG

SEQ ID NO: 75586 - protein, 16 aa, Mycobacterium tuberculosis
ALPHHPHRFDWFGVGL

SEQ ID NO: 75587 - protein, 16 aa, Mycobacterium tuberculosis
LPHHPHRFDWFGVGLS

SEQ ID NO: 75588 - protein, 16 aa, Mycobacterium tuberculosis
PHHPHRFDWFGVGLSG

SEQ ID NO: 75589 - protein, 16 aa, Mycobacterium tuberculosis
HHPHRFDWFGVGLSGA

SEQ ID NO: 75590 - protein, 16 aa, Mycobacterium tuberculosis
HPHRFDWFGVGLSGAG

SEQ ID NO: 75591 - protein, 16 aa, Mycobacterium tuberculosis
PHRFDWFGVGLSGAGM

SEQ ID NO: 75592 - protein, 16 aa, Mycobacterium tuberculosis
HRFDWFGVGLSGAGMF

SEQ ID NO: 75593 - protein, 16 aa, Mycobacterium tuberculosis
RFDWFGVGLSGAGMFL

SEQ ID NO: 75594 - protein, 16 aa, Mycobacterium tuberculosis
FDWFGVGLSGAGMFLI

SEQ ID NO: 75595 - protein, 16 aa, Mycobacterium tuberculosis
DWFGVGLSGAGMFLIV

SEQ ID NO: 75596 - protein, 16 aa, Mycobacterium tuberculosis
WFGVGLSGAGMFLIVF

SEQ ID NO: 75597 - protein, 16 aa, Mycobacterium tuberculosis
FGVGLSGAGMFLIVFG

SEQ ID NO: 75598 - protein, 16 aa, Mycobacterium tuberculosis
GVGLSGAGMFLIVFGL

SEQ ID NO: 75599 - protein, 16 aa, Mycobacterium tuberculosis
VGLSGAGMFLIVFGLQ

SEQ ID NO: 75600 - protein, 16 aa, Mycobacterium tuberculosis
GLSGAGMFLIVFGLQQ

SEQ ID NO: 75601 - protein, 16 aa, Mycobacterium tuberculosis
LSGAGMFLIVFGLQQG

SEQ ID NO: 75602 - protein, 16 aa, Mycobacterium tuberculosis
SGAGMFLIVFGLQQGQ

SEQ ID NO: 75603 - protein, 16 aa, Mycobacterium tuberculosis
GAGMFLIVFGLQQGQS

SEQ ID NO: 75604 - protein, 16 aa, Mycobacterium tuberculosis
AGMFLIVFGLQQGQSA

SEQ ID NO: 75605 - protein, 16 aa, Mycobacterium tuberculosis
GMFLIVFGLQQGQSAN

SEQ ID NO: 75606 - protein, 16 aa, Mycobacterium tuberculosis
MFLIVFGLQQGQSANW

SEQ ID NO: 75607 - protein, 16 aa, Mycobacterium tuberculosis
FLIVFGLQQGQSANWQ

SEQ ID NO: 75608 - protein, 16 aa, Mycobacterium tuberculosis
LIVFGLQQGQSANWQP

SEQ ID NO: 75609 - protein, 16 aa, Mycobacterium tuberculosis
IVFGLQQGQSANWQPW

SEQ ID NO: 75610 - protein, 16 aa, Mycobacterium tuberculosis
VFGLQQGQSANWQPWI

SEQ ID NO: 75611 - protein, 16 aa, Mycobacterium tuberculosis
FGLQQGQSANWQPWIW

SEQ ID NO: 75612 - protein, 16 aa, Mycobacterium tuberculosis
GLQQGQSANWQPWIWA

SEQ ID NO: 75613 - protein, 16 aa, Mycobacterium tuberculosis
LQQGQSANWQPWIWAV

SEQ ID NO: 75614 - protein, 16 aa, Mycobacterium tuberculosis
QQGQSANWQPWIWAVI

SEQ ID NO: 75615 - protein, 16 aa, Mycobacterium tuberculosis
QGQSANWQPWIWAVIV

SEQ ID NO: 75616 - protein, 16 aa, Mycobacterium tuberculosis
GQSANWQPWIWAVIVG

SEQ ID NO: 75617 - protein, 16 aa, Mycobacterium tuberculosis
QSANWQPWIWAVIVGG

SEQ ID NO: 75618 - protein, 16 aa, Mycobacterium tuberculosis
SANWQPWIWAVIVGGI

SEQ ID NO: 75619 - protein, 16 aa, Mycobacterium tuberculosis
ANWQPWIWAVIVGGIG

SEQ ID NO: 75620 - protein, 16 aa, Mycobacterium tuberculosis
NWQPWIWAVIVGGIGF

SEQ ID NO: 75621 - protein, 16 aa, Mycobacterium tuberculosis
WQPWIWAVIVGGIGFM

SEQ ID NO: 75622 - protein, 16 aa, Mycobacterium tuberculosis
QPWIWAVIVGGIGFMS

SEQ ID NO: 75623 - protein, 16 aa, Mycobacterium tuberculosis
PWIWAVIVGGIGFMSL

SEQ ID NO: 75624 - protein, 16 aa, Mycobacterium tuberculosis
WIWAVIVGGIGFMSLF

SEQ ID NO: 75625 - protein, 16 aa, Mycobacterium tuberculosis
IWAVIVGGIGFMSLFV

SEQ ID NO: 75626 - protein, 16 aa, Mycobacterium tuberculosis
WAVIVGGIGFMSLFVY

SEQ ID NO: 75627 - protein, 16 aa, Mycobacterium tuberculosis
AVIVGGIGFMSLFVYW

SEQ ID NO: 75628 - protein, 16 aa, Mycobacterium tuberculosis
VIVGGIGFMSLFVYWQ

SEQ ID NO: 75629 - protein, 16 aa, Mycobacterium tuberculosis
IVGGIGFMSLFVYWQA

SEQ ID NO: 75630 - protein, 16 aa, Mycobacterium tuberculosis
VGGIGFMSLFVYWQAR

SEQ ID NO: 75631 - protein, 16 aa, Mycobacterium tuberculosis
GGIGFMSLFVYWQARN

SEQ ID NO: 75632 - protein, 16 aa, Mycobacterium tuberculosis
GIGFMSLFVYWQARNA

SEQ ID NO: 75633 - protein, 16 aa, Mycobacterium tuberculosis
IGFMSLFVYWQARNAR

SEQ ID NO: 75634 - protein, 16 aa, Mycobacterium tuberculosis
GFMSLFVYWQARNARE

SEQ ID NO: 75635 - protein, 16 aa, Mycobacterium tuberculosis
FMSLFVYWQARNAREP

SEQ ID NO: 75636 - protein, 16 aa, Mycobacterium tuberculosis
MSLFVYWQARNAREPL

SEQ ID NO: 75637 - protein, 16 aa, Mycobacterium tuberculosis
SLFVYWQARNAREPLI

SEQ ID NO: 75638 - protein, 16 aa, Mycobacterium tuberculosis
LFVYWQARNAREPLIP

SEQ ID NO: 75639 - protein, 16 aa, Mycobacterium tuberculosis
FVYWQARNAREPLIPL

SEQ ID NO: 75640 - protein, 16 aa, Mycobacterium tuberculosis
VYWQARNAREPLIPLE

SEQ ID NO: 75641 - protein, 16 aa, Mycobacterium tuberculosis
YWQARNAREPLIPLEV

SEQ ID NO: 75642 - protein, 16 aa, Mycobacterium tuberculosis
WQARNAREPLIPLEVF

SEQ ID NO: 75643 - protein, 16 aa, Mycobacterium tuberculosis
QARNAREPLIPLEVFN

SEQ ID NO: 75644 - protein, 16 aa, Mycobacterium tuberculosis
ARNAREPLIPLEVFND

SEQ ID NO: 75645 - protein, 16 aa, Mycobacterium tuberculosis
RNAREPLIPLEVFNDR

SEQ ID NO: 75646 - protein, 16 aa, Mycobacterium tuberculosis
NAREPLIPLEVFNDRN

SEQ ID NO: 75647 - protein, 16 aa, Mycobacterium tuberculosis
AREPLIPLEVFNDRNF

SEQ ID NO: 75648 - protein, 16 aa, Mycobacterium tuberculosis
REPLIPLEVFNDRNFS

SEQ ID NO: 75649 - protein, 16 aa, Mycobacterium tuberculosis
EPLIPLEVFNDRNFSL

SEQ ID NO: 75650 - protein, 16 aa, Mycobacterium tuberculosis
PLIPLEVFNDRNFSLS

SEQ ID NO: 75651 - protein, 16 aa, Mycobacterium tuberculosis
LIPLEVFNDRNFSLSN

SEQ ID NO: 75652 - protein, 16 aa, Mycobacterium tuberculosis
IPLEVFNDRNFSLSNL

SEQ ID NO: 75653 - protein, 16 aa, Mycobacterium tuberculosis
PLEVFNDRNFSLSNLR

SEQ ID NO: 75654 - protein, 16 aa, Mycobacterium tuberculosis
LEVFNDRNFSLSNLRI

SEQ ID NO: 75655 - protein, 16 aa, Mycobacterium tuberculosis
EVFNDRNFSLSNLRIA

SEQ ID NO: 75656 - protein, 16 aa, Mycobacterium tuberculosis
VFNDRNFSLSNLRIAI

SEQ ID NO: 75657 - protein, 16 aa, Mycobacterium tuberculosis
FNDRNFSLSNLRIAII

SEQ ID NO: 75658 - protein, 16 aa, Mycobacterium tuberculosis
NDRNFSLSNLRIAIIA

SEQ ID NO: 75659 - protein, 16 aa, Mycobacterium tuberculosis
DRNFSLSNLRIAIIAF

SEQ ID NO: 75660 - protein, 16 aa, Mycobacterium tuberculosis
RNFSLSNLRIAIIAFA

SEQ ID NO: 75661 - protein, 16 aa, Mycobacterium tuberculosis
NFSLSNLRIAIIAFAG

SEQ ID NO: 75662 - protein, 16 aa, Mycobacterium tuberculosis
FSLSNLRIAIIAFAGT

SEQ ID NO: 75663 - protein, 16 aa, Mycobacterium tuberculosis
SLSNLRIAIIAFAGTG

SEQ ID NO: 75664 - protein, 16 aa, Mycobacterium tuberculosis
LSNLRIAIIAFAGTGM

SEQ ID NO: 75665 - protein, 16 aa, Mycobacterium tuberculosis
SNLRIAIIAFAGTGMM

SEQ ID NO: 75666 - protein, 16 aa, Mycobacterium tuberculosis
NLRIAIIAFAGTGMML

SEQ ID NO: 75667 - protein, 16 aa, Mycobacterium tuberculosis
LRIAIIAFAGTGMMLP

SEQ ID NO: 75668 - protein, 16 aa, Mycobacterium tuberculosis
RIAIIAFAGTGMMLPV

SEQ ID NO: 75669 - protein, 16 aa, Mycobacterium tuberculosis
IAIIAFAGTGMMLPVT

SEQ ID NO: 75670 - protein, 16 aa, Mycobacterium tuberculosis
AIIAFAGTGMMLPVTF

SEQ ID NO: 75671 - protein, 16 aa, Mycobacterium tuberculosis
IIAFAGTGMMLPVTFY

SEQ ID NO: 75672 - protein, 16 aa, Mycobacterium tuberculosis
IAFAGTGMMLPVTFYA

SEQ ID NO: 75673 - protein, 16 aa, Mycobacterium tuberculosis
AFAGTGMMLPVTFYAQ

SEQ ID NO: 75674 - protein, 16 aa, Mycobacterium tuberculosis
FAGTGMMLPVTFYAQA

SEQ ID NO: 75675 - protein, 16 aa, Mycobacterium tuberculosis
AGTGMMLPVTFYAQAV

SEQ ID NO: 75676 - protein, 16 aa, Mycobacterium tuberculosis
GTGMMLPVTFYAQAVC

SEQ ID NO: 75677 - protein, 16 aa, Mycobacterium tuberculosis
TGMMLPVTFYAQAVCG

SEQ ID NO: 75678 - protein, 16 aa, Mycobacterium tuberculosis
GMMLPVTFYAQAVCGL

SEQ ID NO: 75679 - protein, 16 aa, Mycobacterium tuberculosis
MMLPVTFYAQAVCGLS

SEQ ID NO: 75680 - protein, 16 aa, Mycobacterium tuberculosis
MLPVTFYAQAVCGLSP

SEQ ID NO: 75681 - protein, 16 aa, Mycobacterium tuberculosis
LPVTFYAQAVCGLSPT

SEQ ID NO: 75682 - protein, 16 aa, Mycobacterium tuberculosis
PVTFYAQAVCGLSPTH

SEQ ID NO: 75683 - protein, 16 aa, Mycobacterium tuberculosis
VTFYAQAVCGLSPTHT

SEQ ID NO: 75684 - protein, 16 aa, Mycobacterium tuberculosis
TFYAQAVCGLSPTHTA

SEQ ID NO: 75685 - protein, 16 aa, Mycobacterium tuberculosis
FYAQAVCGLSPTHTAV

SEQ ID NO: 75686 - protein, 16 aa, Mycobacterium tuberculosis
YAQAVCGLSPTHTAVL

SEQ ID NO: 75687 - protein, 16 aa, Mycobacterium tuberculosis
AQAVCGLSPTHTAVLF

SEQ ID NO: 75688 - protein, 16 aa, Mycobacterium tuberculosis
QAVCGLSPTHTAVLFA

SEQ ID NO: 75689 - protein, 16 aa, Mycobacterium tuberculosis
AVCGLSPTHTAVLFAP

SEQ ID NO: 75690 - protein, 16 aa, Mycobacterium tuberculosis
VCGLSPTHTAVLFAPT

SEQ ID NO: 75691 - protein, 16 aa, Mycobacterium tuberculosis
CGLSPTHTAVLFAPTA

SEQ ID NO: 75692 - protein, 16 aa, Mycobacterium tuberculosis
GLSPTHTAVLFAPTAI

SEQ ID NO: 75693 - protein, 16 aa, Mycobacterium tuberculosis
LSPTHTAVLFAPTAIV

SEQ ID NO: 75694 - protein, 16 aa, Mycobacterium tuberculosis
SPTHTAVLFAPTAIVG

SEQ ID NO: 75695 - protein, 16 aa, Mycobacterium tuberculosis
PTHTAVLFAPTAIVGG

SEQ ID NO: 75696 - protein, 16 aa, Mycobacterium tuberculosis
THTAVLFAPTAIVGGV

SEQ ID NO: 75697 - protein, 16 aa, Mycobacterium tuberculosis
HTAVLFAPTAIVGGVL

SEQ ID NO: 75698 - protein, 16 aa, Mycobacterium tuberculosis
TAVLFAPTAIVGGVLA

SEQ ID NO: 75699 - protein, 16 aa, Mycobacterium tuberculosis
AVLFAPTAIVGGVLAP

SEQ ID NO: 75700 - protein, 16 aa, Mycobacterium tuberculosis
VLFAPTAIVGGVLAPF

SEQ ID NO: 75701 - protein, 16 aa, Mycobacterium tuberculosis
LFAPTAIVGGVLAPFV

SEQ ID NO: 75702 - protein, 16 aa, Mycobacterium tuberculosis
FAPTAIVGGVLAPFVG

SEQ ID NO: 75703 - protein, 16 aa, Mycobacterium tuberculosis
APTAIVGGVLAPFVGM

SEQ ID NO: 75704 - protein, 16 aa, Mycobacterium tuberculosis
PTAIVGGVLAPFVGMI

SEQ ID NO: 75705 - protein, 16 aa, Mycobacterium tuberculosis
TAIVGGVLAPFVGMII

SEQ ID NO: 75706 - protein, 16 aa, Mycobacterium tuberculosis
AIVGGVLAPFVGMIID

SEQ ID NO: 75707 - protein, 16 aa, Mycobacterium tuberculosis
IVGGVLAPFVGMIIDR

SEQ ID NO: 75708 - protein, 16 aa, Mycobacterium tuberculosis
VGGVLAPFVGMIIDRS

SEQ ID NO: 75709 - protein, 16 aa, Mycobacterium tuberculosis
GGVLAPFVGMIIDRSH

SEQ ID NO: 75710 - protein, 16 aa, Mycobacterium tuberculosis
GVLAPFVGMIIDRSHP

SEQ ID NO: 75711 - protein, 16 aa, Mycobacterium tuberculosis
VLAPFVGMIIDRSHPL

SEQ ID NO: 75712 - protein, 16 aa, Mycobacterium tuberculosis
LAPFVGMIIDRSHPLC

SEQ ID NO: 75713 - protein, 16 aa, Mycobacterium tuberculosis
APFVGMIIDRSHPLCV

SEQ ID NO: 75714 - protein, 16 aa, Mycobacterium tuberculosis
PFVGMIIDRSHPLCVL

SEQ ID NO: 75715 - protein, 16 aa, Mycobacterium tuberculosis
FVGMIIDRSHPLCVLG

SEQ ID NO: 75716 - protein, 16 aa, Mycobacterium tuberculosis
VGMIIDRSHPLCVLGF

SEQ ID NO: 75717 - protein, 16 aa, Mycobacterium tuberculosis
GMIIDRSHPLCVLGFG

SEQ ID NO: 75718 - protein, 16 aa, Mycobacterium tuberculosis
MIIDRSHPLCVLGFGF

SEQ ID NO: 75719 - protein, 16 aa, Mycobacterium tuberculosis
IIDRSHPLCVLGFGFS

SEQ ID NO: 75720 - protein, 16 aa, Mycobacterium tuberculosis
IDRSHPLCVLGFGFSV

SEQ ID NO: 75721 - protein, 16 aa, Mycobacterium tuberculosis
DRSHPLCVLGFGFSVL

SEQ ID NO: 75722 - protein, 16 aa, Mycobacterium tuberculosis
RSHPLCVLGFGFSVLA

SEQ ID NO: 75723 - protein, 16 aa, Mycobacterium tuberculosis
SHPLCVLGFGFSVLAI

SEQ ID NO: 75724 - protein, 16 aa, Mycobacterium tuberculosis
HPLCVLGFGFSVLAIA

SEQ ID NO: 75725 - protein, 16 aa, Mycobacterium tuberculosis
PLCVLGFGFSVLAIAM

SEQ ID NO: 75726 - protein, 16 aa, Mycobacterium tuberculosis
LCVLGFGFSVLAIAMT

SEQ ID NO: 75727 - protein, 16 aa, Mycobacterium tuberculosis
CVLGFGFSVLAIAMTW

SEQ ID NO: 75728 - protein, 16 aa, Mycobacterium tuberculosis
VLGFGFSVLAIAMTWL

SEQ ID NO: 75729 - protein, 16 aa, Mycobacterium tuberculosis
LGFGFSVLAIAMTWLL

SEQ ID NO: 75730 - protein, 16 aa, Mycobacterium tuberculosis
GFGFSVLAIAMTWLLC

SEQ ID NO: 75731 - protein, 16 aa, Mycobacterium tuberculosis
FGFSVLAIAMTWLLCE

SEQ ID NO: 75732 - protein, 16 aa, Mycobacterium tuberculosis
GFSVLAIAMTWLLCEM

SEQ ID NO: 75733 - protein, 16 aa, Mycobacterium tuberculosis
FSVLAIAMTWLLCEMA

SEQ ID NO: 75734 - protein, 16 aa, Mycobacterium tuberculosis
SVLAIAMTWLLCEMAP

SEQ ID NO: 75735 - protein, 16 aa, Mycobacterium tuberculosis
VLAIAMTWLLCEMAPG

SEQ ID NO: 75736 - protein, 16 aa, Mycobacterium tuberculosis
LAIAMTWLLCEMAPGT

SEQ ID NO: 75737 - protein, 16 aa, Mycobacterium tuberculosis
AIAMTWLLCEMAPGTP

SEQ ID NO: 75738 - protein, 16 aa, Mycobacterium tuberculosis
IAMTWLLCEMAPGTPI

SEQ ID NO: 75739 - protein, 16 aa, Mycobacterium tuberculosis
AMTWLLCEMAPGTPIW

SEQ ID NO: 75740 - protein, 16 aa, Mycobacterium tuberculosis
MTWLLCEMAPGTPIWR

SEQ ID NO: 75741 - protein, 16 aa, Mycobacterium tuberculosis
TWLLCEMAPGTPIWRL

SEQ ID NO: 75742 - protein, 16 aa, Mycobacterium tuberculosis
WLLCEMAPGTPIWRLV

SEQ ID NO: 75743 - protein, 16 aa, Mycobacterium tuberculosis
LLCEMAPGTPIWRLVL

SEQ ID NO: 75744 - protein, 16 aa, Mycobacterium tuberculosis
LCEMAPGTPIWRLVLP

SEQ ID NO: 75745 - protein, 16 aa, Mycobacterium tuberculosis
CEMAPGTPIWRLVLPF

SEQ ID NO: 75746 - protein, 16 aa, Mycobacterium tuberculosis
EMAPGTPIWRLVLPFI

SEQ ID NO: 75747 - protein, 16 aa, Mycobacterium tuberculosis
MAPGTPIWRLVLPFIA

SEQ ID NO: 75748 - protein, 16 aa, Mycobacterium tuberculosis
APGTPIWRLVLPFIAL

SEQ ID NO: 75749 - protein, 16 aa, Mycobacterium tuberculosis
PGTPIWRLVLPFIALG

SEQ ID NO: 75750 - protein, 16 aa, Mycobacterium tuberculosis
GTPIWRLVLPFIALGV

SEQ ID NO: 75751 - protein, 16 aa, Mycobacterium tuberculosis
TPIWRLVLPFIALGVA

SEQ ID NO: 75752 - protein, 16 aa, Mycobacterium tuberculosis
PIWRLVLPFIALGVAG

SEQ ID NO: 75753 - protein, 16 aa, Mycobacterium tuberculosis
IWRLVLPFIALGVAGA

SEQ ID NO: 75754 - protein, 16 aa, Mycobacterium tuberculosis
WRLVLPFIALGVAGAF

SEQ ID NO: 75755 - protein, 16 aa, Mycobacterium tuberculosis
RLVLPFIALGVAGAFV

SEQ ID NO: 75756 - protein, 16 aa, Mycobacterium tuberculosis
LVLPFIALGVAGAFVW

SEQ ID NO: 75757 - protein, 16 aa, Mycobacterium tuberculosis
VLPFIALGVAGAFVWS

SEQ ID NO: 75758 - protein, 16 aa, Mycobacterium tuberculosis
LPFIALGVAGAFVWSP

SEQ ID NO: 75759 - protein, 16 aa, Mycobacterium tuberculosis
PFIALGVAGAFVWSPL

SEQ ID NO: 75760 - protein, 16 aa, Mycobacterium tuberculosis
FIALGVAGAFVWSPLT

SEQ ID NO: 75761 - protein, 16 aa, Mycobacterium tuberculosis
IALGVAGAFVWSPLTV

SEQ ID NO: 75762 - protein, 16 aa, Mycobacterium tuberculosis
ALGVAGAFVWSPLTVT

SEQ ID NO: 75763 - protein, 16 aa, Mycobacterium tuberculosis
LGVAGAFVWSPLTVTA

SEQ ID NO: 75764 - protein, 16 aa, Mycobacterium tuberculosis
GVAGAFVWSPLTVTAT

SEQ ID NO: 75765 - protein, 16 aa, Mycobacterium tuberculosis
VAGAFVWSPLTVTATR

SEQ ID NO: 75766 - protein, 16 aa, Mycobacterium tuberculosis
AGAFVWSPLTVTATRN

SEQ ID NO: 75767 - protein, 16 aa, Mycobacterium tuberculosis
GAFVWSPLTVTATRNL

SEQ ID NO: 75768 - protein, 16 aa, Mycobacterium tuberculosis
AFVWSPLTVTATRNLR

SEQ ID NO: 75769 - protein, 16 aa, Mycobacterium tuberculosis
FVWSPLTVTATRNLRP

SEQ ID NO: 75770 - protein, 16 aa, Mycobacterium tuberculosis
VWSPLTVTATRNLRPH

SEQ ID NO: 75771 - protein, 16 aa, Mycobacterium tuberculosis
WSPLTVTATRNLRPHL

SEQ ID NO: 75772 - protein, 16 aa, Mycobacterium tuberculosis
SPLTVTATRNLRPHLA

SEQ ID NO: 75773 - protein, 16 aa, Mycobacterium tuberculosis
PLTVTATRNLRPHLAG

SEQ ID NO: 75774 - protein, 16 aa, Mycobacterium tuberculosis
LTVTATRNLRPHLAGA

SEQ ID NO: 75775 - protein, 16 aa, Mycobacterium tuberculosis
TVTATRNLRPHLAGAS

SEQ ID NO: 75776 - protein, 16 aa, Mycobacterium tuberculosis
VTATRNLRPHLAGASS

SEQ ID NO: 75777 - protein, 16 aa, Mycobacterium tuberculosis
TATRNLRPHLAGASSG

SEQ ID NO: 75778 - protein, 16 aa, Mycobacterium tuberculosis
ATRNLRPHLAGASSGV

SEQ ID NO: 75779 - protein, 16 aa, Mycobacterium tuberculosis
TRNLRPHLAGASSGVF

SEQ ID NO: 75780 - protein, 16 aa, Mycobacterium tuberculosis
RNLRPHLAGASSGVFN

SEQ ID NO: 75781 - protein, 16 aa, Mycobacterium tuberculosis
NLRPHLAGASSGVFNA

SEQ ID NO: 75782 - protein, 16 aa, Mycobacterium tuberculosis
LRPHLAGASSGVFNAV

SEQ ID NO: 75783 - protein, 16 aa, Mycobacterium tuberculosis
RPHLAGASSGVFNAVR

SEQ ID NO: 75784 - protein, 16 aa, Mycobacterium tuberculosis
PHLAGASSGVFNAVRQ

SEQ ID NO: 75785 - protein, 16 aa, Mycobacterium tuberculosis
HLAGASSGVFNAVRQL

SEQ ID NO: 75786 - protein, 16 aa, Mycobacterium tuberculosis
LAGASSGVFNAVRQLG

SEQ ID NO: 75787 - protein, 16 aa, Mycobacterium tuberculosis
AGASSGVFNAVRQLGA

SEQ ID NO: 75788 - protein, 16 aa, Mycobacterium tuberculosis
GASSGVFNAVRQLGAV

SEQ ID NO: 75789 - protein, 16 aa, Mycobacterium tuberculosis
ASSGVFNAVRQLGAVL

SEQ ID NO: 75790 - protein, 16 aa, Mycobacterium tuberculosis
SSGVFNAVRQLGAVLG

SEQ ID NO: 75791 - protein, 16 aa, Mycobacterium tuberculosis
SGVFNAVRQLGAVLGS

SEQ ID NO: 75792 - protein, 16 aa, Mycobacterium tuberculosis
GVFNAVRQLGAVLGSA

SEQ ID NO: 75793 - protein, 16 aa, Mycobacterium tuberculosis
VFNAVRQLGAVLGSAS

SEQ ID NO: 75794 - protein, 16 aa, Mycobacterium tuberculosis
FNAVRQLGAVLGSASM

SEQ ID NO: 75795 - protein, 16 aa, Mycobacterium tuberculosis
NAVRQLGAVLGSASMA

SEQ ID NO: 75796 - protein, 16 aa, Mycobacterium tuberculosis
AVRQLGAVLGSASMAA

SEQ ID NO: 75797 - protein, 16 aa, Mycobacterium tuberculosis
VRQLGAVLGSASMAAF

SEQ ID NO: 75798 - protein, 16 aa, Mycobacterium tuberculosis
RQLGAVLGSASMAAFM

SEQ ID NO: 75799 - protein, 16 aa, Mycobacterium tuberculosis
QLGAVLGSASMAAFMT

SEQ ID NO: 75800 - protein, 16 aa, Mycobacterium tuberculosis
LGAVLGSASMAAFMTS

SEQ ID NO: 75801 - protein, 16 aa, Mycobacterium tuberculosis
GAVLGSASMAAFMTSR

SEQ ID NO: 75802 - protein, 16 aa, Mycobacterium tuberculosis
AVLGSASMAAFMTSRI

SEQ ID NO: 75803 - protein, 16 aa, Mycobacterium tuberculosis
VLGSASMAAFMTSRIA

SEQ ID NO: 75804 - protein, 16 aa, Mycobacterium tuberculosis
LGSASMAAFMTSRIAA

SEQ ID NO: 75805 - protein, 16 aa, Mycobacterium tuberculosis
GSASMAAFMTSRIAAE

SEQ ID NO: 75806 - protein, 16 aa, Mycobacterium tuberculosis
SASMAAFMTSRIAAEM

SEQ ID NO: 75807 - protein, 16 aa, Mycobacterium tuberculosis
ASMAAFMTSRIAAEMP

SEQ ID NO: 75808 - protein, 16 aa, Mycobacterium tuberculosis
SMAAFMTSRIAAEMPG

SEQ ID NO: 75809 - protein, 16 aa, Mycobacterium tuberculosis
MAAFMTSRIAAEMPGG

SEQ ID NO: 75810 - protein, 16 aa, Mycobacterium tuberculosis
AAFMTSRIAAEMPGGV

SEQ ID NO: 75811 - protein, 16 aa, Mycobacterium tuberculosis
AFMTSRIAAEMPGGVD

SEQ ID NO: 75812 - protein, 16 aa, Mycobacterium tuberculosis
FMTSRIAAEMPGGVDA

SEQ ID NO: 75813 - protein, 16 aa, Mycobacterium tuberculosis
MTSRIAAEMPGGVDAL

SEQ ID NO: 75814 - protein, 16 aa, Mycobacterium tuberculosis
TSRIAAEMPGGVDALT

SEQ ID NO: 75815 - protein, 16 aa, Mycobacterium tuberculosis
SRIAAEMPGGVDALTG

SEQ ID NO: 75816 - protein, 16 aa, Mycobacterium tuberculosis
RIAAEMPGGVDALTGP

SEQ ID NO: 75817 - protein, 16 aa, Mycobacterium tuberculosis
IAAEMPGGVDALTGPA

SEQ ID NO: 75818 - protein, 16 aa, Mycobacterium tuberculosis
AAEMPGGVDALTGPAG

SEQ ID NO: 75819 - protein, 16 aa, Mycobacterium tuberculosis
AEMPGGVDALTGPAGQ

SEQ ID NO: 75820 - protein, 16 aa, Mycobacterium tuberculosis
EMPGGVDALTGPAGQD

SEQ ID NO: 75821 - protein, 16 aa, Mycobacterium tuberculosis
MPGGVDALTGPAGQDA

SEQ ID NO: 75822 - protein, 16 aa, Mycobacterium tuberculosis
PGGVDALTGPAGQDAT

SEQ ID NO: 75823 - protein, 16 aa, Mycobacterium tuberculosis
GGVDALTGPAGQDATV

SEQ ID NO: 75824 - protein, 16 aa, Mycobacterium tuberculosis
GVDALTGPAGQDATVL

SEQ ID NO: 75825 - protein, 16 aa, Mycobacterium tuberculosis
VDALTGPAGQDATVLQ

SEQ ID NO: 75826 - protein, 16 aa, Mycobacterium tuberculosis
DALTGPAGQDATVLQL

SEQ ID NO: 75827 - protein, 16 aa, Mycobacterium tuberculosis
ALTGPAGQDATVLQLP

SEQ ID NO: 75828 - protein, 16 aa, Mycobacterium tuberculosis
LTGPAGQDATVLQLPE

SEQ ID NO: 75829 - protein, 16 aa, Mycobacterium tuberculosis
TGPAGQDATVLQLPEF

SEQ ID NO: 75830 - protein, 16 aa, Mycobacterium tuberculosis
GPAGQDATVLQLPEFV

SEQ ID NO: 75831 - protein, 16 aa, Mycobacterium tuberculosis
PAGQDATVLQLPEFVR

SEQ ID NO: 75832 - protein, 16 aa, Mycobacterium tuberculosis
AGQDATVLQLPEFVRE

SEQ ID NO: 75833 - protein, 16 aa, Mycobacterium tuberculosis
GQDATVLQLPEFVREP

SEQ ID NO: 75834 - protein, 16 aa, Mycobacterium tuberculosis
QDATVLQLPEFVREPF

SEQ ID NO: 75835 - protein, 16 aa, Mycobacterium tuberculosis
DATVLQLPEFVREPFA

SEQ ID NO: 75836 - protein, 16 aa, Mycobacterium tuberculosis
ATVLQLPEFVREPFAA

SEQ ID NO: 75837 - protein, 16 aa, Mycobacterium tuberculosis
TVLQLPEFVREPFAAA

SEQ ID NO: 75838 - protein, 16 aa, Mycobacterium tuberculosis
VLQLPEFVREPFAAAM

SEQ ID NO: 75839 - protein, 16 aa, Mycobacterium tuberculosis
LQLPEFVREPFAAAMS

SEQ ID NO: 75840 - protein, 16 aa, Mycobacterium tuberculosis
QLPEFVREPFAAAMSQ

SEQ ID NO: 75841 - protein, 16 aa, Mycobacterium tuberculosis
LPEFVREPFAAAMSQS

SEQ ID NO: 75842 - protein, 16 aa, Mycobacterium tuberculosis
PEFVREPFAAAMSQSM

SEQ ID NO: 75843 - protein, 16 aa, Mycobacterium tuberculosis
EFVREPFAAAMSQSML

SEQ ID NO: 75844 - protein, 16 aa, Mycobacterium tuberculosis
FVREPFAAAMSQSMLL

SEQ ID NO: 75845 - protein, 16 aa, Mycobacterium tuberculosis
VREPFAAAMSQSMLLP

SEQ ID NO: 75846 - protein, 16 aa, Mycobacterium tuberculosis
REPFAAAMSQSMLLPA

SEQ ID NO: 75847 - protein, 16 aa, Mycobacterium tuberculosis
EPFAAAMSQSMLLPAF

SEQ ID NO: 75848 - protein, 16 aa, Mycobacterium tuberculosis
PFAAAMSQSMLLPAFV

SEQ ID NO: 75849 - protein, 16 aa, Mycobacterium tuberculosis
FAAAMSQSMLLPAFVA

SEQ ID NO: 75850 - protein, 16 aa, Mycobacterium tuberculosis
AAAMSQSMLLPAFVAL

SEQ ID NO: 75851 - protein, 16 aa, Mycobacterium tuberculosis
AAMSQSMLLPAFVALF

SEQ ID NO: 75852 - protein, 16 aa, Mycobacterium tuberculosis
AMSQSMLLPAFVALFG

SEQ ID NO: 75853 - protein, 16 aa, Mycobacterium tuberculosis
MSQSMLLPAFVALFGI

SEQ ID NO: 75854 - protein, 16 aa, Mycobacterium tuberculosis
SQSMLLPAFVALFGIV

SEQ ID NO: 75855 - protein, 16 aa, Mycobacterium tuberculosis
QSMLLPAFVALFGIVA

SEQ ID NO: 75856 - protein, 16 aa, Mycobacterium tuberculosis
SMLLPAFVALFGIVAA

SEQ ID NO: 75857 - protein, 16 aa, Mycobacterium tuberculosis
MLLPAFVALFGIVAAL

SEQ ID NO: 75858 - protein, 16 aa, Mycobacterium tuberculosis
LLPAFVALFGIVAALF

SEQ ID NO: 75859 - protein, 16 aa, Mycobacterium tuberculosis
LPAFVALFGIVAALFL

SEQ ID NO: 75860 - protein, 16 aa, Mycobacterium tuberculosis
PAFVALFGIVAALFLV

SEQ ID NO: 75861 - protein, 16 aa, Mycobacterium tuberculosis
AFVALFGIVAALFLVD

SEQ ID NO: 75862 - protein, 16 aa, Mycobacterium tuberculosis
FVALFGIVAALFLVDF

SEQ ID NO: 75863 - protein, 16 aa, Mycobacterium tuberculosis
VALFGIVAALFLVDFT

SEQ ID NO: 75864 - protein, 16 aa, Mycobacterium tuberculosis
ALFGIVAALFLVDFTG

SEQ ID NO: 75865 - protein, 16 aa, Mycobacterium tuberculosis
LFGIVAALFLVDFTGA

SEQ ID NO: 75866 - protein, 16 aa, Mycobacterium tuberculosis
FGIVAALFLVDFTGAA

SEQ ID NO: 75867 - protein, 16 aa, Mycobacterium tuberculosis
GIVAALFLVDFTGAAV

SEQ ID NO: 75868 - protein, 16 aa, Mycobacterium tuberculosis
IVAALFLVDFTGAAVA

SEQ ID NO: 75869 - protein, 16 aa, Mycobacterium tuberculosis
VAALFLVDFTGAAVAK

SEQ ID NO: 75870 - protein, 16 aa, Mycobacterium tuberculosis
AALFLVDFTGAAVAKE

SEQ ID NO: 75871 - protein, 16 aa, Mycobacterium tuberculosis
ALFLVDFTGAAVAKEP

SEQ ID NO: 75872 - protein, 16 aa, Mycobacterium tuberculosis
LFLVDFTGAAVAKEPL

SEQ ID NO: 75873 - protein, 16 aa, Mycobacterium tuberculosis
FLVDFTGAAVAKEPLP

SEQ ID NO: 75874 - protein, 16 aa, Mycobacterium tuberculosis
LVDFTGAAVAKEPLPE

SEQ ID NO: 75875 - protein, 16 aa, Mycobacterium tuberculosis
VDFTGAAVAKEPLPES

SEQ ID NO: 75876 - protein, 16 aa, Mycobacterium tuberculosis
DFTGAAVAKEPLPESD

SEQ ID NO: 75877 - protein, 16 aa, Mycobacterium tuberculosis
FTGAAVAKEPLPESDG

SEQ ID NO: 75878 - protein, 16 aa, Mycobacterium tuberculosis
TGAAVAKEPLPESDGD

SEQ ID NO: 75879 - protein, 16 aa, Mycobacterium tuberculosis
GAAVAKEPLPESDGDA

SEQ ID NO: 75880 - protein, 16 aa, Mycobacterium tuberculosis
AAVAKEPLPESDGDAD

SEQ ID NO: 75881 - protein, 16 aa, Mycobacterium tuberculosis
AVAKEPLPESDGDADD

SEQ ID NO: 75882 - protein, 16 aa, Mycobacterium tuberculosis
VAKEPLPESDGDADDD

SEQ ID NO: 75883 - protein, 16 aa, Mycobacterium tuberculosis
AKEPLPESDGDADDDD

SEQ ID NO: 75884 - protein, 16 aa, Mycobacterium tuberculosis
KEPLPESDGDADDDDY

SEQ ID NO: 75885 - protein, 16 aa, Mycobacterium tuberculosis
EPLPESDGDADDDDYV

SEQ ID NO: 75886 - protein, 16 aa, Mycobacterium tuberculosis
PLPESDGDADDDDYVE

SEQ ID NO: 75887 - protein, 16 aa, Mycobacterium tuberculosis
LPESDGDADDDDYVEY

SEQ ID NO: 75888 - protein, 16 aa, Mycobacterium tuberculosis
PESDGDADDDDYVEYI

SEQ ID NO: 75889 - protein, 16 aa, Mycobacterium tuberculosis
ESDGDADDDDYVEYIL

SEQ ID NO: 75890 - protein, 16 aa, Mycobacterium tuberculosis
SDGDADDDDYVEYILR

SEQ ID NO: 75891 - protein, 16 aa, Mycobacterium tuberculosis
DGDADDDDYVEYILRR

SEQ ID NO: 75892 - protein, 16 aa, Mycobacterium tuberculosis
GDADDDDYVEYILRRE

SEQ ID NO: 75893 - protein, 16 aa, Mycobacterium tuberculosis
DADDDDYVEYILRREP

SEQ ID NO: 75894 - protein, 16 aa, Mycobacterium tuberculosis
ADDDDYVEYILRREPE

SEQ ID NO: 75895 - protein, 16 aa, Mycobacterium tuberculosis
DDDDYVEYILRREPEE

SEQ ID NO: 75896 - protein, 16 aa, Mycobacterium tuberculosis
DDDYVEYILRREPEED

SEQ ID NO: 75897 - protein, 16 aa, Mycobacterium tuberculosis
DDYVEYILRREPEEDC

SEQ ID NO: 75898 - protein, 16 aa, Mycobacterium tuberculosis
DYVEYILRREPEEDCD

SEQ ID NO: 75899 - protein, 16 aa, Mycobacterium tuberculosis
YVEYILRREPEEDCDT

SEQ ID NO: 75900 - protein, 16 aa, Mycobacterium tuberculosis
VEYILRREPEEDCDTQ

SEQ ID NO: 75901 - protein, 16 aa, Mycobacterium tuberculosis
EYILRREPEEDCDTQP

SEQ ID NO: 75902 - protein, 16 aa, Mycobacterium tuberculosis
YILRREPEEDCDTQPL

SEQ ID NO: 75903 - protein, 16 aa, Mycobacterium tuberculosis
ILRREPEEDCDTQPLR

SEQ ID NO: 75904 - protein, 16 aa, Mycobacterium tuberculosis
LRREPEEDCDTQPLRA

SEQ ID NO: 75905 - protein, 16 aa, Mycobacterium tuberculosis
RREPEEDCDTQPLRAS

SEQ ID NO: 75906 - protein, 16 aa, Mycobacterium tuberculosis
REPEEDCDTQPLRASR

SEQ ID NO: 75907 - protein, 16 aa, Mycobacterium tuberculosis
EPEEDCDTQPLRASRP

SEQ ID NO: 75908 - protein, 16 aa, Mycobacterium tuberculosis
PEEDCDTQPLRASRPA

SEQ ID NO: 75909 - protein, 16 aa, Mycobacterium tuberculosis
EEDCDTQPLRASRPAA

SEQ ID NO: 75910 - protein, 16 aa, Mycobacterium tuberculosis
EDCDTQPLRASRPAAA

SEQ ID NO: 75911 - protein, 16 aa, Mycobacterium tuberculosis
DCDTQPLRASRPAAAA

SEQ ID NO: 75912 - protein, 16 aa, Mycobacterium tuberculosis
CDTQPLRASRPAAAAA

SEQ ID NO: 75913 - protein, 16 aa, Mycobacterium tuberculosis
DTQPLRASRPAAAAAS

SEQ ID NO: 75914 - protein, 16 aa, Mycobacterium tuberculosis
TQPLRASRPAAAAASR

SEQ ID NO: 75915 - protein, 16 aa, Mycobacterium tuberculosis
QPLRASRPAAAAASRS

SEQ ID NO: 75916 - protein, 16 aa, Mycobacterium tuberculosis
PLRASRPAAAAASRSG

SEQ ID NO: 75917 - protein, 16 aa, Mycobacterium tuberculosis
LRASRPAAAAASRSGA

SEQ ID NO: 75918 - protein, 16 aa, Mycobacterium tuberculosis
RASRPAAAAASRSGAG

SEQ ID NO: 75919 - protein, 16 aa, Mycobacterium tuberculosis
ASRPAAAAASRSGAGG

SEQ ID NO: 75920 - protein, 16 aa, Mycobacterium tuberculosis
SRPAAAAASRSGAGGP

SEQ ID NO: 75921 - protein, 16 aa, Mycobacterium tuberculosis
RPAAAAASRSGAGGPL

SEQ ID NO: 75922 - protein, 16 aa, Mycobacterium tuberculosis
PAAAAASRSGAGGPLA

SEQ ID NO: 75923 - protein, 16 aa, Mycobacterium tuberculosis
AAAAASRSGAGGPLAV

SEQ ID NO: 75924 - protein, 16 aa, Mycobacterium tuberculosis
AAAASRSGAGGPLAVS

SEQ ID NO: 75925 - protein, 16 aa, Mycobacterium tuberculosis
AAASRSGAGGPLAVSW

SEQ ID NO: 75926 - protein, 16 aa, Mycobacterium tuberculosis
AASRSGAGGPLAVSWS

SEQ ID NO: 75927 - protein, 16 aa, Mycobacterium tuberculosis
ASRSGAGGPLAVSWST

SEQ ID NO: 75928 - protein, 16 aa, Mycobacterium tuberculosis
SRSGAGGPLAVSWSTS

SEQ ID NO: 75929 - protein, 16 aa, Mycobacterium tuberculosis
RSGAGGPLAVSWSTSA

SEQ ID NO: 75930 - protein, 16 aa, Mycobacterium tuberculosis
SGAGGPLAVSWSTSAQ

SEQ ID NO: 75931 - protein, 16 aa, Mycobacterium tuberculosis
GAGGPLAVSWSTSAQG

SEQ ID NO: 75932 - protein, 16 aa, Mycobacterium tuberculosis
AGGPLAVSWSTSAQGM

SEQ ID NO: 75933 - protein, 16 aa, Mycobacterium tuberculosis
GGPLAVSWSTSAQGMP

SEQ ID NO: 75934 - protein, 16 aa, Mycobacterium tuberculosis
GPLAVSWSTSAQGMPP

SEQ ID NO: 75935 - protein, 16 aa, Mycobacterium tuberculosis
PLAVSWSTSAQGMPPG

SEQ ID NO: 75936 - protein, 16 aa, Mycobacterium tuberculosis
LAVSWSTSAQGMPPGP

SEQ ID NO: 75937 - protein, 16 aa, Mycobacterium tuberculosis
AVSWSTSAQGMPPGPP

SEQ ID NO: 75938 - protein, 16 aa, Mycobacterium tuberculosis
VSWSTSAQGMPPGPPG

SEQ ID NO: 75939 - protein, 16 aa, Mycobacterium tuberculosis
SWSTSAQGMPPGPPGR

SEQ ID NO: 75940 - protein, 16 aa, Mycobacterium tuberculosis
WSTSAQGMPPGPPGRR

SEQ ID NO: 75941 - protein, 16 aa, Mycobacterium tuberculosis
STSAQGMPPGPPGRRA

SEQ ID NO: 75942 - protein, 16 aa, Mycobacterium tuberculosis
TSAQGMPPGPPGRRAW

SEQ ID NO: 75943 - protein, 16 aa, Mycobacterium tuberculosis
SAQGMPPGPPGRRAWQ

SEQ ID NO: 75944 - protein, 16 aa, Mycobacterium tuberculosis
AQGMPPGPPGRRAWQA

SEQ ID NO: 75945 - protein, 16 aa, Mycobacterium tuberculosis
QGMPPGPPGRRAWQAD

SEQ ID NO: 75946 - protein, 16 aa, Mycobacterium tuberculosis
GMPPGPPGRRAWQADT

SEQ ID NO: 75947 - protein, 16 aa, Mycobacterium tuberculosis
MPPGPPGRRAWQADTE

SEQ ID NO: 75948 - protein, 16 aa, Mycobacterium tuberculosis
PPGPPGRRAWQADTES

SEQ ID NO: 75949 - protein, 16 aa, Mycobacterium tuberculosis
PGPPGRRAWQADTEST

SEQ ID NO: 75950 - protein, 16 aa, Mycobacterium tuberculosis
GPPGRRAWQADTESTA

SEQ ID NO: 75951 - protein, 16 aa, Mycobacterium tuberculosis
PPGRRAWQADTESTAP

SEQ ID NO: 75952 - protein, 16 aa, Mycobacterium tuberculosis
PGRRAWQADTESTAPS

SEQ ID NO: 75953 - protein, 16 aa, Mycobacterium tuberculosis
GRRAWQADTESTAPSA

SEQ ID NO: 75954 - protein, 16 aa, Mycobacterium tuberculosis
RRAWQADTESTAPSAL

SEQ ID NO: 75955 - protein, 13 aa, Mycobacterium tuberculosis
MTVTDDYLANNVD

SEQ ID NO: 75956 - protein, 13 aa, Mycobacterium tuberculosis
TVTDDYLANNVDY

SEQ ID NO: 75957 - protein, 13 aa, Mycobacterium tuberculosis
VTDDYLANNVDYA

SEQ ID NO: 75958 - protein, 13 aa, Mycobacterium tuberculosis
TDDYLANNVDYAS

SEQ ID NO: 75959 - protein, 13 aa, Mycobacterium tuberculosis
DDYLANNVDYASG

SEQ ID NO: 75960 - protein, 13 aa, Mycobacterium tuberculosis
DYLANNVDYASGF

SEQ ID NO: 75961 - protein, 13 aa, Mycobacterium tuberculosis
YLANNVDYASGFK

SEQ ID NO: 75962 - protein, 13 aa, Mycobacterium tuberculosis
LANNVDYASGFKG

SEQ ID NO: 75963 - protein, 13 aa, Mycobacterium tuberculosis
ANNVDYASGFKGP

SEQ ID NO: 75964 - protein, 13 aa, Mycobacterium tuberculosis
NNVDYASGFKGPL

SEQ ID NO: 75965 - protein, 13 aa, Mycobacterium tuberculosis
NVDYASGFKGPLP

SEQ ID NO: 75966 - protein, 13 aa, Mycobacterium tuberculosis
VDYASGFKGPLPM

SEQ ID NO: 75967 - protein, 13 aa, Mycobacterium tuberculosis
DYASGFKGPLPMP

SEQ ID NO: 75968 - protein, 13 aa, Mycobacterium tuberculosis
YASGFKGPLPMPP

SEQ ID NO: 75969 - protein, 13 aa, Mycobacterium tuberculosis
ASGFKGPLPMPPS

SEQ ID NO: 75970 - protein, 13 aa, Mycobacterium tuberculosis
SGFKGPLPMPPSK

SEQ ID NO: 75971 - protein, 13 aa, Mycobacterium tuberculosis
GFKGPLPMPPSKH

SEQ ID NO: 75972 - protein, 13 aa, Mycobacterium tuberculosis
FKGPLPMPPSKHI

SEQ ID NO: 75973 - protein, 13 aa, Mycobacterium tuberculosis
KGPLPMPPSKHIA

SEQ ID NO: 75974 - protein, 13 aa, Mycobacterium tuberculosis
GPLPMPPSKHIAI

SEQ ID NO: 75975 - protein, 13 aa, Mycobacterium tuberculosis
PLPMPPSKHIAIV

SEQ ID NO: 75976 - protein, 13 aa, Mycobacterium tuberculosis
LPMPPSKHIAIVA

SEQ ID NO: 75977 - protein, 13 aa, Mycobacterium tuberculosis
PMPPSKHIAIVAC

SEQ ID NO: 75978 - protein, 13 aa, Mycobacterium tuberculosis
MPPSKHIAIVACM

SEQ ID NO: 75979 - protein, 13 aa, Mycobacterium tuberculosis
PPSKHIAIVACMD

SEQ ID NO: 75980 - protein, 13 aa, Mycobacterium tuberculosis
PSKHIAIVACMDA

SEQ ID NO: 75981 - protein, 13 aa, Mycobacterium tuberculosis
SKHIAIVACMDAR

SEQ ID NO: 75982 - protein, 13 aa, Mycobacterium tuberculosis
KHIAIVACMDARL

SEQ ID NO: 75983 - protein, 13 aa, Mycobacterium tuberculosis
HIAIVACMDARLD

SEQ ID NO: 75984 - protein, 13 aa, Mycobacterium tuberculosis
IAIVACMDARLDV

SEQ ID NO: 75985 - protein, 13 aa, Mycobacterium tuberculosis
AIVACMDARLDVY

SEQ ID NO: 75986 - protein, 13 aa, Mycobacterium tuberculosis
IVACMDARLDVYR

SEQ ID NO: 75987 - protein, 13 aa, Mycobacterium tuberculosis
VACMDARLDVYRM

SEQ ID NO: 75988 - protein, 13 aa, Mycobacterium tuberculosis
ACMDARLDVYRML

SEQ ID NO: 75989 - protein, 13 aa, Mycobacterium tuberculosis
CMDARLDVYRMLG

SEQ ID NO: 75990 - protein, 13 aa, Mycobacterium tuberculosis
MDARLDVYRMLGI

SEQ ID NO: 75991 - protein, 13 aa, Mycobacterium tuberculosis
DARLDVYRMLGIK

SEQ ID NO: 75992 - protein, 13 aa, Mycobacterium tuberculosis
ARLDVYRMLGIKE

SEQ ID NO: 75993 - protein, 13 aa, Mycobacterium tuberculosis
RLDVYRMLGIKEG

SEQ ID NO: 75994 - protein, 13 aa, Mycobacterium tuberculosis
LDVYRMLGIKEGE

SEQ ID NO: 75995 - protein, 13 aa, Mycobacterium tuberculosis
DVYRMLGIKEGEA

SEQ ID NO: 75996 - protein, 13 aa, Mycobacterium tuberculosis
VYRMLGIKEGEAH

SEQ ID NO: 75997 - protein, 13 aa, Mycobacterium tuberculosis
YRMLGIKEGEAHV

SEQ ID NO: 75998 - protein, 13 aa, Mycobacterium tuberculosis
RMLGIKEGEAHVI

SEQ ID NO: 75999 - protein, 13 aa, Mycobacterium tuberculosis
MLGIKEGEAHVIR

SEQ ID NO: 76000 - protein, 13 aa, Mycobacterium tuberculosis
LGIKEGEAHVIRN

SEQ ID NO: 76001 - protein, 13 aa, Mycobacterium tuberculosis
GIKEGEAHVIRNA

SEQ ID NO: 76002 - protein, 13 aa, Mycobacterium tuberculosis
IKEGEAHVIRNAG

SEQ ID NO: 76003 - protein, 13 aa, Mycobacterium tuberculosis
KEGEAHVIRNAGC

SEQ ID NO: 76004 - protein, 13 aa, Mycobacterium tuberculosis
EGEAHVIRNAGCV

SEQ ID NO: 76005 - protein, 13 aa, Mycobacterium tuberculosis
GEAHVIRNAGCVV

SEQ ID NO: 76006 - protein, 13 aa, Mycobacterium tuberculosis
EAHVIRNAGCVVT

SEQ ID NO: 76007 - protein, 13 aa, Mycobacterium tuberculosis
AHVIRNAGCVVTD

SEQ ID NO: 76008 - protein, 13 aa, Mycobacterium tuberculosis
HVIRNAGCVVTDD

SEQ ID NO: 76009 - protein, 13 aa, Mycobacterium tuberculosis
VIRNAGCVVTDDV

SEQ ID NO: 76010 - protein, 13 aa, Mycobacterium tuberculosis
IRNAGCVVTDDVI

SEQ ID NO: 76011 - protein, 13 aa, Mycobacterium tuberculosis
RNAGCVVTDDVIR

SEQ ID NO: 76012 - protein, 13 aa, Mycobacterium tuberculosis
NAGCVVTDDVIRS

SEQ ID NO: 76013 - protein, 13 aa, Mycobacterium tuberculosis
AGCVVTDDVIRSL

SEQ ID NO: 76014 - protein, 13 aa, Mycobacterium tuberculosis
GCVVTDDVIRSLA

SEQ ID NO: 76015 - protein, 13 aa, Mycobacterium tuberculosis
CVVTDDVIRSLAI

SEQ ID NO: 76016 - protein, 13 aa, Mycobacterium tuberculosis
VVTDDVIRSLAIS

SEQ ID NO: 76017 - protein, 13 aa, Mycobacterium tuberculosis
VTDDVIRSLAISQ

SEQ ID NO: 76018 - protein, 13 aa, Mycobacterium tuberculosis
TDDVIRSLAISQR

SEQ ID NO: 76019 - protein, 13 aa, Mycobacterium tuberculosis
DDVIRSLAISQRL

SEQ ID NO: 76020 - protein, 13 aa, Mycobacterium tuberculosis
DVIRSLAISQRLL

SEQ ID NO: 76021 - protein, 13 aa, Mycobacterium tuberculosis
VIRSLAISQRLLG

SEQ ID NO: 76022 - protein, 13 aa, Mycobacterium tuberculosis
IRSLAISQRLLGT

SEQ ID NO: 76023 - protein, 13 aa, Mycobacterium tuberculosis
RSLAISQRLLGTR

SEQ ID NO: 76024 - protein, 13 aa, Mycobacterium tuberculosis
SLAISQRLLGTRE

SEQ ID NO: 76025 - protein, 13 aa, Mycobacterium tuberculosis
LAISQRLLGTREI

SEQ ID NO: 76026 - protein, 13 aa, Mycobacterium tuberculosis
AISQRLLGTREII

SEQ ID NO: 76027 - protein, 13 aa, Mycobacterium tuberculosis
ISQRLLGTREIIL

SEQ ID NO: 76028 - protein, 13 aa, Mycobacterium tuberculosis
SQRLLGTREIILL

SEQ ID NO: 76029 - protein, 13 aa, Mycobacterium tuberculosis
QRLLGTREIILLH

SEQ ID NO: 76030 - protein, 13 aa, Mycobacterium tuberculosis
RLLGTREIILLHH

SEQ ID NO: 76031 - protein, 13 aa, Mycobacterium tuberculosis
LLGTREIILLHHT

SEQ ID NO: 76032 - protein, 13 aa, Mycobacterium tuberculosis
LGTREIILLHHTD

SEQ ID NO: 76033 - protein, 13 aa, Mycobacterium tuberculosis
GTREIILLHHTDC

SEQ ID NO: 76034 - protein, 13 aa, Mycobacterium tuberculosis
TREIILLHHTDCG

SEQ ID NO: 76035 - protein, 13 aa, Mycobacterium tuberculosis
REIILLHHTDCGM

SEQ ID NO: 76036 - protein, 13 aa, Mycobacterium tuberculosis
EIILLHHTDCGML

SEQ ID NO: 76037 - protein, 13 aa, Mycobacterium tuberculosis
IILLHHTDCGMLT

SEQ ID NO: 76038 - protein, 13 aa, Mycobacterium tuberculosis
ILLHHTDCGMLTF

SEQ ID NO: 76039 - protein, 13 aa, Mycobacterium tuberculosis
LLHHTDCGMLTFT

SEQ ID NO: 76040 - protein, 13 aa, Mycobacterium tuberculosis
LHHTDCGMLTFTD

SEQ ID NO: 76041 - protein, 13 aa, Mycobacterium tuberculosis
HHTDCGMLTFTDD

SEQ ID NO: 76042 - protein, 13 aa, Mycobacterium tuberculosis
HTDCGMLTFTDDD

SEQ ID NO: 76043 - protein, 13 aa, Mycobacterium tuberculosis
TDCGMLTFTDDDF

SEQ ID NO: 76044 - protein, 13 aa, Mycobacterium tuberculosis
DCGMLTFTDDDFK

SEQ ID NO: 76045 - protein, 13 aa, Mycobacterium tuberculosis
CGMLTFTDDDFKR

SEQ ID NO: 76046 - protein, 13 aa, Mycobacterium tuberculosis
GMLTFTDDDFKRA

SEQ ID NO: 76047 - protein, 13 aa, Mycobacterium tuberculosis
MLTFTDDDFKRAI

SEQ ID NO: 76048 - protein, 13 aa, Mycobacterium tuberculosis
LTFTDDDFKRAIQ

SEQ ID NO: 76049 - protein, 13 aa, Mycobacterium tuberculosis
TFTDDDFKRAIQD

SEQ ID NO: 76050 - protein, 13 aa, Mycobacterium tuberculosis
FTDDDFKRAIQDE

SEQ ID NO: 76051 - protein, 13 aa, Mycobacterium tuberculosis
TDDDFKRAIQDET

SEQ ID NO: 76052 - protein, 13 aa, Mycobacterium tuberculosis
DDDFKRAIQDETG

SEQ ID NO: 76053 - protein, 13 aa, Mycobacterium tuberculosis
DDFKRAIQDETGI

SEQ ID NO: 76054 - protein, 13 aa, Mycobacterium tuberculosis
DFKRAIQDETGIR

SEQ ID NO: 76055 - protein, 13 aa, Mycobacterium tuberculosis
FKRAIQDETGIRP

SEQ ID NO: 76056 - protein, 13 aa, Mycobacterium tuberculosis
KRAIQDETGIRPT

SEQ ID NO: 76057 - protein, 13 aa, Mycobacterium tuberculosis
RAIQDETGIRPTW

SEQ ID NO: 76058 - protein, 13 aa, Mycobacterium tuberculosis
AIQDETGIRPTWS

SEQ ID NO: 76059 - protein, 13 aa, Mycobacterium tuberculosis
IQDETGIRPTWSP

SEQ ID NO: 76060 - protein, 13 aa, Mycobacterium tuberculosis
QDETGIRPTWSPE

SEQ ID NO: 76061 - protein, 13 aa, Mycobacterium tuberculosis
DETGIRPTWSPES

SEQ ID NO: 76062 - protein, 13 aa, Mycobacterium tuberculosis
ETGIRPTWSPESY

SEQ ID NO: 76063 - protein, 13 aa, Mycobacterium tuberculosis
TGIRPTWSPESYP

SEQ ID NO: 76064 - protein, 13 aa, Mycobacterium tuberculosis
GIRPTWSPESYPD

SEQ ID NO: 76065 - protein, 13 aa, Mycobacterium tuberculosis
IRPTWSPESYPDA

SEQ ID NO: 76066 - protein, 13 aa, Mycobacterium tuberculosis
RPTWSPESYPDAV

SEQ ID NO: 76067 - protein, 13 aa, Mycobacterium tuberculosis
PTWSPESYPDAVE

SEQ ID NO: 76068 - protein, 13 aa, Mycobacterium tuberculosis
TWSPESYPDAVED

SEQ ID NO: 76069 - protein, 13 aa, Mycobacterium tuberculosis
WSPESYPDAVEDV

SEQ ID NO: 76070 - protein, 13 aa, Mycobacterium tuberculosis
SPESYPDAVEDVR

SEQ ID NO: 76071 - protein, 13 aa, Mycobacterium tuberculosis
PESYPDAVEDVRQ

SEQ ID NO: 76072 - protein, 13 aa, Mycobacterium tuberculosis
ESYPDAVEDVRQS

SEQ ID NO: 76073 - protein, 13 aa, Mycobacterium tuberculosis
SYPDAVEDVRQSL

SEQ ID NO: 76074 - protein, 13 aa, Mycobacterium tuberculosis
YPDAVEDVRQSLR

SEQ ID NO: 76075 - protein, 13 aa, Mycobacterium tuberculosis
PDAVEDVRQSLRR

SEQ ID NO: 76076 - protein, 13 aa, Mycobacterium tuberculosis
DAVEDVRQSLRRI

SEQ ID NO: 76077 - protein, 13 aa, Mycobacterium tuberculosis
AVEDVRQSLRRIE

SEQ ID NO: 76078 - protein, 13 aa, Mycobacterium tuberculosis
VEDVRQSLRRIEV

SEQ ID NO: 76079 - protein, 13 aa, Mycobacterium tuberculosis
EDVRQSLRRIEVN

SEQ ID NO: 76080 - protein, 13 aa, Mycobacterium tuberculosis
DVRQSLRRIEVNP

SEQ ID NO: 76081 - protein, 13 aa, Mycobacterium tuberculosis
VRQSLRRIEVNPF

SEQ ID NO: 76082 - protein, 13 aa, Mycobacterium tuberculosis
RQSLRRIEVNPFV

SEQ ID NO: 76083 - protein, 13 aa, Mycobacterium tuberculosis
QSLRRIEVNPFVT

SEQ ID NO: 76084 - protein, 13 aa, Mycobacterium tuberculosis
SLRRIEVNPFVTK

SEQ ID NO: 76085 - protein, 13 aa, Mycobacterium tuberculosis
LRRIEVNPFVTKH

SEQ ID NO: 76086 - protein, 13 aa, Mycobacterium tuberculosis
RRIEVNPFVTKHT

SEQ ID NO: 76087 - protein, 13 aa, Mycobacterium tuberculosis
RIEVNPFVTKHTS

SEQ ID NO: 76088 - protein, 13 aa, Mycobacterium tuberculosis
IEVNPFVTKHTSL

SEQ ID NO: 76089 - protein, 13 aa, Mycobacterium tuberculosis
EVNPFVTKHTSLR

SEQ ID NO: 76090 - protein, 13 aa, Mycobacterium tuberculosis
VNPFVTKHTSLRG

SEQ ID NO: 76091 - protein, 13 aa, Mycobacterium tuberculosis
NPFVTKHTSLRGF

SEQ ID NO: 76092 - protein, 13 aa, Mycobacterium tuberculosis
PFVTKHTSLRGFV

SEQ ID NO: 76093 - protein, 13 aa, Mycobacterium tuberculosis
FVTKHTSLRGFVF

SEQ ID NO: 76094 - protein, 13 aa, Mycobacterium tuberculosis
VTKHTSLRGFVFD

SEQ ID NO: 76095 - protein, 13 aa, Mycobacterium tuberculosis
TKHTSLRGFVFDV

SEQ ID NO: 76096 - protein, 13 aa, Mycobacterium tuberculosis
KHTSLRGFVFDVA

SEQ ID NO: 76097 - protein, 13 aa, Mycobacterium tuberculosis
HTSLRGFVFDVAT

SEQ ID NO: 76098 - protein, 13 aa, Mycobacterium tuberculosis
TSLRGFVFDVATG

SEQ ID NO: 76099 - protein, 13 aa, Mycobacterium tuberculosis
SLRGFVFDVATGK

SEQ ID NO: 76100 - protein, 13 aa, Mycobacterium tuberculosis
LRGFVFDVATGKL

SEQ ID NO: 76101 - protein, 13 aa, Mycobacterium tuberculosis
RGFVFDVATGKLN

SEQ ID NO: 76102 - protein, 13 aa, Mycobacterium tuberculosis
GFVFDVATGKLNE

SEQ ID NO: 76103 - protein, 13 aa, Mycobacterium tuberculosis
FVFDVATGKLNEV

SEQ ID NO: 76104 - protein, 13 aa, Mycobacterium tuberculosis
VFDVATGKLNEVT

SEQ ID NO: 76105 - protein, 13 aa, Mycobacterium tuberculosis
FDVATGKLNEVTP

SEQ ID NO: 76106 - protein, 14 aa, Mycobacterium tuberculosis
MTVTDDYLANNVDY

SEQ ID NO: 76107 - protein, 14 aa, Mycobacterium tuberculosis
TVTDDYLANNVDYA

SEQ ID NO: 76108 - protein, 14 aa, Mycobacterium tuberculosis
VTDDYLANNVDYAS

SEQ ID NO: 76109 - protein, 14 aa, Mycobacterium tuberculosis
TDDYLANNVDYASG

SEQ ID NO: 76110 - protein, 14 aa, Mycobacterium tuberculosis
DDYLANNVDYASGF

SEQ ID NO: 76111 - protein, 14 aa, Mycobacterium tuberculosis
DYLANNVDYASGFK

SEQ ID NO: 76112 - protein, 14 aa, Mycobacterium tuberculosis
YLANNVDYASGFKG

SEQ ID NO: 76113 - protein, 14 aa, Mycobacterium tuberculosis
LANNVDYASGFKGP

SEQ ID NO: 76114 - protein, 14 aa, Mycobacterium tuberculosis
ANNVDYASGFKGPL

SEQ ID NO: 76115 - protein, 14 aa, Mycobacterium tuberculosis
NNVDYASGFKGPLP

SEQ ID NO: 76116 - protein, 14 aa, Mycobacterium tuberculosis
NVDYASGFKGPLPM

SEQ ID NO: 76117 - protein, 14 aa, Mycobacterium tuberculosis
VDYASGFKGPLPMP

SEQ ID NO: 76118 - protein, 14 aa, Mycobacterium tuberculosis
DYASGFKGPLPMPP

SEQ ID NO: 76119 - protein, 14 aa, Mycobacterium tuberculosis
YASGFKGPLPMPPS

SEQ ID NO: 76120 - protein, 14 aa, Mycobacterium tuberculosis
ASGFKGPLPMPPSK

SEQ ID NO: 76121 - protein, 14 aa, Mycobacterium tuberculosis
SGFKGPLPMPPSKH

SEQ ID NO: 76122 - protein, 14 aa, Mycobacterium tuberculosis
GFKGPLPMPPSKHI

SEQ ID NO: 76123 - protein, 14 aa, Mycobacterium tuberculosis
FKGPLPMPPSKHIA

SEQ ID NO: 76124 - protein, 14 aa, Mycobacterium tuberculosis
KGPLPMPPSKHIAI

SEQ ID NO: 76125 - protein, 14 aa, Mycobacterium tuberculosis
GPLPMPPSKHIAIV

SEQ ID NO: 76126 - protein, 14 aa, Mycobacterium tuberculosis
PLPMPPSKHIAIVA

SEQ ID NO: 76127 - protein, 14 aa, Mycobacterium tuberculosis
LPMPPSKHIAIVAC

SEQ ID NO: 76128 - protein, 14 aa, Mycobacterium tuberculosis
PMPPSKHIAIVACM

SEQ ID NO: 76129 - protein, 14 aa, Mycobacterium tuberculosis
MPPSKHIAIVACMD

SEQ ID NO: 76130 - protein, 14 aa, Mycobacterium tuberculosis
PPSKHIAIVACMDA

SEQ ID NO: 76131 - protein, 14 aa, Mycobacterium tuberculosis
PSKHIAIVACMDAR

SEQ ID NO: 76132 - protein, 14 aa, Mycobacterium tuberculosis
SKHIAIVACMDARL

SEQ ID NO: 76133 - protein, 14 aa, Mycobacterium tuberculosis
KHIAIVACMDARLD

SEQ ID NO: 76134 - protein, 14 aa, Mycobacterium tuberculosis
HIAIVACMDARLDV

SEQ ID NO: 76135 - protein, 14 aa, Mycobacterium tuberculosis
IAIVACMDARLDVY

SEQ ID NO: 76136 - protein, 14 aa, Mycobacterium tuberculosis
AIVACMDARLDVYR

SEQ ID NO: 76137 - protein, 14 aa, Mycobacterium tuberculosis
IVACMDARLDVYRM

SEQ ID NO: 76138 - protein, 14 aa, Mycobacterium tuberculosis
VACMDARLDVYRML

SEQ ID NO: 76139 - protein, 14 aa, Mycobacterium tuberculosis
ACMDARLDVYRMLG

SEQ ID NO: 76140 - protein, 14 aa, Mycobacterium tuberculosis
CMDARLDVYRMLGI

SEQ ID NO: 76141 - protein, 14 aa, Mycobacterium tuberculosis
MDARLDVYRMLGIK

SEQ ID NO: 76142 - protein, 14 aa, Mycobacterium tuberculosis
DARLDVYRMLGIKE

SEQ ID NO: 76143 - protein, 14 aa, Mycobacterium tuberculosis
ARLDVYRMLGIKEG

SEQ ID NO: 76144 - protein, 14 aa, Mycobacterium tuberculosis
RLDVYRMLGIKEGE

SEQ ID NO: 76145 - protein, 14 aa, Mycobacterium tuberculosis
LDVYRMLGIKEGEA

SEQ ID NO: 76146 - protein, 14 aa, Mycobacterium tuberculosis
DVYRMLGIKEGEAH

SEQ ID NO: 76147 - protein, 14 aa, Mycobacterium tuberculosis
VYRMLGIKEGEAHV

SEQ ID NO: 76148 - protein, 14 aa, Mycobacterium tuberculosis
YRMLGIKEGEAHVI

SEQ ID NO: 76149 - protein, 14 aa, Mycobacterium tuberculosis
RMLGIKEGEAHVIR

SEQ ID NO: 76150 - protein, 14 aa, Mycobacterium tuberculosis
MLGIKEGEAHVIRN

SEQ ID NO: 76151 - protein, 14 aa, Mycobacterium tuberculosis
LGIKEGEAHVIRNA

SEQ ID NO: 76152 - protein, 14 aa, Mycobacterium tuberculosis
GIKEGEAHVIRNAG

SEQ ID NO: 76153 - protein, 14 aa, Mycobacterium tuberculosis
IKEGEAHVIRNAGC

SEQ ID NO: 76154 - protein, 14 aa, Mycobacterium tuberculosis
KEGEAHVIRNAGCV

SEQ ID NO: 76155 - protein, 14 aa, Mycobacterium tuberculosis
EGEAHVIRNAGCVV

SEQ ID NO: 76156 - protein, 14 aa, Mycobacterium tuberculosis
GEAHVIRNAGCVVT

SEQ ID NO: 76157 - protein, 14 aa, Mycobacterium tuberculosis
EAHVIRNAGCVVTD

SEQ ID NO: 76158 - protein, 14 aa, Mycobacterium tuberculosis
AHVIRNAGCVVTDD

SEQ ID NO: 76159 - protein, 14 aa, Mycobacterium tuberculosis
HVIRNAGCVVTDDV

SEQ ID NO: 76160 - protein, 14 aa, Mycobacterium tuberculosis
VIRNAGCVVTDDVI

SEQ ID NO: 76161 - protein, 14 aa, Mycobacterium tuberculosis
IRNAGCVVTDDVIR

SEQ ID NO: 76162 - protein, 14 aa, Mycobacterium tuberculosis
RNAGCVVTDDVIRS

SEQ ID NO: 76163 - protein, 14 aa, Mycobacterium tuberculosis
NAGCVVTDDVIRSL

SEQ ID NO: 76164 - protein, 14 aa, Mycobacterium tuberculosis
AGCVVTDDVIRSLA

SEQ ID NO: 76165 - protein, 14 aa, Mycobacterium tuberculosis
GCVVTDDVIRSLAI

SEQ ID NO: 76166 - protein, 14 aa, Mycobacterium tuberculosis
CVVTDDVIRSLAIS

SEQ ID NO: 76167 - protein, 14 aa, Mycobacterium tuberculosis
VVTDDVIRSLAISQ

SEQ ID NO: 76168 - protein, 14 aa, Mycobacterium tuberculosis
VTDDVIRSLAISQR

SEQ ID NO: 76169 - protein, 14 aa, Mycobacterium tuberculosis
TDDVIRSLAISQRL

SEQ ID NO: 76170 - protein, 14 aa, Mycobacterium tuberculosis
DDVIRSLAISQRLL

SEQ ID NO: 76171 - protein, 14 aa, Mycobacterium tuberculosis
DVIRSLAISQRLLG

SEQ ID NO: 76172 - protein, 14 aa, Mycobacterium tuberculosis
VIRSLAISQRLLGT

SEQ ID NO: 76173 - protein, 14 aa, Mycobacterium tuberculosis
IRSLAISQRLLGTR

SEQ ID NO: 76174 - protein, 14 aa, Mycobacterium tuberculosis
RSLAISQRLLGTRE

SEQ ID NO: 76175 - protein, 14 aa, Mycobacterium tuberculosis
SLAISQRLLGTREI

SEQ ID NO: 76176 - protein, 14 aa, Mycobacterium tuberculosis
LAISQRLLGTREII

SEQ ID NO: 76177 - protein, 14 aa, Mycobacterium tuberculosis
AISQRLLGTREIIL

SEQ ID NO: 76178 - protein, 14 aa, Mycobacterium tuberculosis
ISQRLLGTREIILL

SEQ ID NO: 76179 - protein, 14 aa, Mycobacterium tuberculosis
SQRLLGTREIILLH

SEQ ID NO: 76180 - protein, 14 aa, Mycobacterium tuberculosis
QRLLGTREIILLHH

SEQ ID NO: 76181 - protein, 14 aa, Mycobacterium tuberculosis
RLLGTREIILLHHT

SEQ ID NO: 76182 - protein, 14 aa, Mycobacterium tuberculosis
LLGTREIILLHHTD

SEQ ID NO: 76183 - protein, 14 aa, Mycobacterium tuberculosis
LGTREIILLHHTDC

SEQ ID NO: 76184 - protein, 14 aa, Mycobacterium tuberculosis
GTREIILLHHTDCG

SEQ ID NO: 76185 - protein, 14 aa, Mycobacterium tuberculosis
TREIILLHHTDCGM

SEQ ID NO: 76186 - protein, 14 aa, Mycobacterium tuberculosis
REIILLHHTDCGML

SEQ ID NO: 76187 - protein, 14 aa, Mycobacterium tuberculosis
EIILLHHTDCGMLT

SEQ ID NO: 76188 - protein, 14 aa, Mycobacterium tuberculosis
IILLHHTDCGMLTF

SEQ ID NO: 76189 - protein, 14 aa, Mycobacterium tuberculosis
ILLHHTDCGMLTFT

SEQ ID NO: 76190 - protein, 14 aa, Mycobacterium tuberculosis
LLHHTDCGMLTFTD

SEQ ID NO: 76191 - protein, 14 aa, Mycobacterium tuberculosis
LHHTDCGMLTFTDD

SEQ ID NO: 76192 - protein, 14 aa, Mycobacterium tuberculosis
HHTDCGMLTFTDDD

SEQ ID NO: 76193 - protein, 14 aa, Mycobacterium tuberculosis
HTDCGMLTFTDDDF

SEQ ID NO: 76194 - protein, 14 aa, Mycobacterium tuberculosis
TDCGMLTFTDDDFK

SEQ ID NO: 76195 - protein, 14 aa, Mycobacterium tuberculosis
DCGMLTFTDDDFKR

SEQ ID NO: 76196 - protein, 14 aa, Mycobacterium tuberculosis
CGMLTFTDDDFKRA

SEQ ID NO: 76197 - protein, 14 aa, Mycobacterium tuberculosis
GMLTFTDDDFKRAI

SEQ ID NO: 76198 - protein, 14 aa, Mycobacterium tuberculosis
MLTFTDDDFKRAIQ

SEQ ID NO: 76199 - protein, 14 aa, Mycobacterium tuberculosis
LTFTDDDFKRAIQD

SEQ ID NO: 76200 - protein, 14 aa, Mycobacterium tuberculosis
TFTDDDFKRAIQDE

SEQ ID NO: 76201 - protein, 14 aa, Mycobacterium tuberculosis
FTDDDFKRAIQDET

SEQ ID NO: 76202 - protein, 14 aa, Mycobacterium tuberculosis
TDDDFKRAIQDETG

SEQ ID NO: 76203 - protein, 14 aa, Mycobacterium tuberculosis
DDDFKRAIQDETGI

SEQ ID NO: 76204 - protein, 14 aa, Mycobacterium tuberculosis
DDFKRAIQDETGIR

SEQ ID NO: 76205 - protein, 14 aa, Mycobacterium tuberculosis
DFKRAIQDETGIRP

SEQ ID NO: 76206 - protein, 14 aa, Mycobacterium tuberculosis
FKRAIQDETGIRPT

SEQ ID NO: 76207 - protein, 14 aa, Mycobacterium tuberculosis
KRAIQDETGIRPTW

SEQ ID NO: 76208 - protein, 14 aa, Mycobacterium tuberculosis
RAIQDETGIRPTWS

SEQ ID NO: 76209 - protein, 14 aa, Mycobacterium tuberculosis
AIQDETGIRPTWSP

SEQ ID NO: 76210 - protein, 14 aa, Mycobacterium tuberculosis
IQDETGIRPTWSPE

SEQ ID NO: 76211 - protein, 14 aa, Mycobacterium tuberculosis
QDETGIRPTWSPES

SEQ ID NO: 76212 - protein, 14 aa, Mycobacterium tuberculosis
DETGIRPTWSPESY

SEQ ID NO: 76213 - protein, 14 aa, Mycobacterium tuberculosis
ETGIRPTWSPESYP

SEQ ID NO: 76214 - protein, 14 aa, Mycobacterium tuberculosis
TGIRPTWSPESYPD

SEQ ID NO: 76215 - protein, 14 aa, Mycobacterium tuberculosis
GIRPTWSPESYPDA

SEQ ID NO: 76216 - protein, 14 aa, Mycobacterium tuberculosis
IRPTWSPESYPDAV

SEQ ID NO: 76217 - protein, 14 aa, Mycobacterium tuberculosis
RPTWSPESYPDAVE

SEQ ID NO: 76218 - protein, 14 aa, Mycobacterium tuberculosis
PTWSPESYPDAVED

SEQ ID NO: 76219 - protein, 14 aa, Mycobacterium tuberculosis
TWSPESYPDAVEDV

SEQ ID NO: 76220 - protein, 14 aa, Mycobacterium tuberculosis
WSPESYPDAVEDVR

SEQ ID NO: 76221 - protein, 14 aa, Mycobacterium tuberculosis
SPESYPDAVEDVRQ

SEQ ID NO: 76222 - protein, 14 aa, Mycobacterium tuberculosis
PESYPDAVEDVRQS

SEQ ID NO: 76223 - protein, 14 aa, Mycobacterium tuberculosis
ESYPDAVEDVRQSL

SEQ ID NO: 76224 - protein, 14 aa, Mycobacterium tuberculosis
SYPDAVEDVRQSLR

SEQ ID NO: 76225 - protein, 14 aa, Mycobacterium tuberculosis
YPDAVEDVRQSLRR

SEQ ID NO: 76226 - protein, 14 aa, Mycobacterium tuberculosis
PDAVEDVRQSLRRI

SEQ ID NO: 76227 - protein, 14 aa, Mycobacterium tuberculosis
DAVEDVRQSLRRIE

SEQ ID NO: 76228 - protein, 14 aa, Mycobacterium tuberculosis
AVEDVRQSLRRIEV

SEQ ID NO: 76229 - protein, 14 aa, Mycobacterium tuberculosis
VEDVRQSLRRIEVN

SEQ ID NO: 76230 - protein, 14 aa, Mycobacterium tuberculosis
EDVRQSLRRIEVNP

SEQ ID NO: 76231 - protein, 14 aa, Mycobacterium tuberculosis
DVRQSLRRIEVNPF

SEQ ID NO: 76232 - protein, 14 aa, Mycobacterium tuberculosis
VRQSLRRIEVNPFV

SEQ ID NO: 76233 - protein, 14 aa, Mycobacterium tuberculosis
RQSLRRIEVNPFVT

SEQ ID NO: 76234 - protein, 14 aa, Mycobacterium tuberculosis
QSLRRIEVNPFVTK

SEQ ID NO: 76235 - protein, 14 aa, Mycobacterium tuberculosis
SLRRIEVNPFVTKH

SEQ ID NO: 76236 - protein, 14 aa, Mycobacterium tuberculosis
LRRIEVNPFVTKHT

SEQ ID NO: 76237 - protein, 14 aa, Mycobacterium tuberculosis
RRIEVNPFVTKHTS

SEQ ID NO: 76238 - protein, 14 aa, Mycobacterium tuberculosis
RIEVNPFVTKHTSL

SEQ ID NO: 76239 - protein, 14 aa, Mycobacterium tuberculosis
IEVNPFVTKHTSLR

SEQ ID NO: 76240 - protein, 14 aa, Mycobacterium tuberculosis
EVNPFVTKHTSLRG

SEQ ID NO: 76241 - protein, 14 aa, Mycobacterium tuberculosis
VNPFVTKHTSLRGF

SEQ ID NO: 76242 - protein, 14 aa, Mycobacterium tuberculosis
NPFVTKHTSLRGFV

SEQ ID NO: 76243 - protein, 14 aa, Mycobacterium tuberculosis
PFVTKHTSLRGFVF

SEQ ID NO: 76244 - protein, 14 aa, Mycobacterium tuberculosis
FVTKHTSLRGFVFD

SEQ ID NO: 76245 - protein, 14 aa, Mycobacterium tuberculosis
VTKHTSLRGFVFDV

SEQ ID NO: 76246 - protein, 14 aa, Mycobacterium tuberculosis
TKHTSLRGFVFDVA

SEQ ID NO: 76247 - protein, 14 aa, Mycobacterium tuberculosis
KHTSLRGFVFDVAT

SEQ ID NO: 76248 - protein, 14 aa, Mycobacterium tuberculosis
HTSLRGFVFDVATG

SEQ ID NO: 76249 - protein, 14 aa, Mycobacterium tuberculosis
TSLRGFVFDVATGK

SEQ ID NO: 76250 - protein, 14 aa, Mycobacterium tuberculosis
SLRGFVFDVATGKL

SEQ ID NO: 76251 - protein, 14 aa, Mycobacterium tuberculosis
LRGFVFDVATGKLN

SEQ ID NO: 76252 - protein, 14 aa, Mycobacterium tuberculosis
RGFVFDVATGKLNE

SEQ ID NO: 76253 - protein, 14 aa, Mycobacterium tuberculosis
GFVFDVATGKLNEV

SEQ ID NO: 76254 - protein, 14 aa, Mycobacterium tuberculosis
FVFDVATGKLNEVT

SEQ ID NO: 76255 - protein, 14 aa, Mycobacterium tuberculosis
VFDVATGKLNEVTP

SEQ ID NO: 76256 - protein, 15 aa, Mycobacterium tuberculosis
MTVTDDYLANNVDYA

SEQ ID NO: 76257 - protein, 15 aa, Mycobacterium tuberculosis
TVTDDYLANNVDYAS

SEQ ID NO: 76258 - protein, 15 aa, Mycobacterium tuberculosis
VTDDYLANNVDYASG

SEQ ID NO: 76259 - protein, 15 aa, Mycobacterium tuberculosis
TDDYLANNVDYASGF

SEQ ID NO: 76260 - protein, 15 aa, Mycobacterium tuberculosis
DDYLANNVDYASGFK

SEQ ID NO: 76261 - protein, 15 aa, Mycobacterium tuberculosis
DYLANNVDYASGFKG

SEQ ID NO: 76262 - protein, 15 aa, Mycobacterium tuberculosis
YLANNVDYASGFKGP

SEQ ID NO: 76263 - protein, 15 aa, Mycobacterium tuberculosis
LANNVDYASGFKGPL

SEQ ID NO: 76264 - protein, 15 aa, Mycobacterium tuberculosis
ANNVDYASGFKGPLP

SEQ ID NO: 76265 - protein, 15 aa, Mycobacterium tuberculosis
NNVDYASGFKGPLPM

SEQ ID NO: 76266 - protein, 15 aa, Mycobacterium tuberculosis
NVDYASGFKGPLPMP

SEQ ID NO: 76267 - protein, 15 aa, Mycobacterium tuberculosis
VDYASGFKGPLPMPP

SEQ ID NO: 76268 - protein, 15 aa, Mycobacterium tuberculosis
DYASGFKGPLPMPPS

SEQ ID NO: 76269 - protein, 15 aa, Mycobacterium tuberculosis
YASGFKGPLPMPPSK

SEQ ID NO: 76270 - protein, 15 aa, Mycobacterium tuberculosis
ASGFKGPLPMPPSKH

SEQ ID NO: 76271 - protein, 15 aa, Mycobacterium tuberculosis
SGFKGPLPMPPSKHI

SEQ ID NO: 76272 - protein, 15 aa, Mycobacterium tuberculosis
GFKGPLPMPPSKHIA

SEQ ID NO: 76273 - protein, 15 aa, Mycobacterium tuberculosis
FKGPLPMPPSKHIAI

SEQ ID NO: 76274 - protein, 15 aa, Mycobacterium tuberculosis
KGPLPMPPSKHIAIV

SEQ ID NO: 76275 - protein, 15 aa, Mycobacterium tuberculosis
GPLPMPPSKHIAIVA

SEQ ID NO: 76276 - protein, 15 aa, Mycobacterium tuberculosis
PLPMPPSKHIAIVAC

SEQ ID NO: 76277 - protein, 15 aa, Mycobacterium tuberculosis
LPMPPSKHIAIVACM

SEQ ID NO: 76278 - protein, 15 aa, Mycobacterium tuberculosis
PMPPSKHIAIVACMD

SEQ ID NO: 76279 - protein, 15 aa, Mycobacterium tuberculosis
MPPSKHIAIVACMDA

SEQ ID NO: 76280 - protein, 15 aa, Mycobacterium tuberculosis
PPSKHIAIVACMDAR

SEQ ID NO: 76281 - protein, 15 aa, Mycobacterium tuberculosis
PSKHIAIVACMDARL

SEQ ID NO: 76282 - protein, 15 aa, Mycobacterium tuberculosis
SKHIAIVACMDARLD

SEQ ID NO: 76283 - protein, 15 aa, Mycobacterium tuberculosis
KHIAIVACMDARLDV

SEQ ID NO: 76284 - protein, 15 aa, Mycobacterium tuberculosis
HIAIVACMDARLDVY

SEQ ID NO: 76285 - protein, 15 aa, Mycobacterium tuberculosis
IAIVACMDARLDVYR

SEQ ID NO: 76286 - protein, 15 aa, Mycobacterium tuberculosis
AIVACMDARLDVYRM

SEQ ID NO: 76287 - protein, 15 aa, Mycobacterium tuberculosis
IVACMDARLDVYRML

SEQ ID NO: 76288 - protein, 15 aa, Mycobacterium tuberculosis
VACMDARLDVYRMLG

SEQ ID NO: 76289 - protein, 15 aa, Mycobacterium tuberculosis
ACMDARLDVYRMLGI

SEQ ID NO: 76290 - protein, 15 aa, Mycobacterium tuberculosis
CMDARLDVYRMLGIK

SEQ ID NO: 76291 - protein, 15 aa, Mycobacterium tuberculosis
MDARLDVYRMLGIKE

SEQ ID NO: 76292 - protein, 15 aa, Mycobacterium tuberculosis
DARLDVYRMLGIKEG

SEQ ID NO: 76293 - protein, 15 aa, Mycobacterium tuberculosis
ARLDVYRMLGIKEGE

SEQ ID NO: 76294 - protein, 15 aa, Mycobacterium tuberculosis
RLDVYRMLGIKEGEA

SEQ ID NO: 76295 - protein, 15 aa, Mycobacterium tuberculosis
LDVYRMLGIKEGEAH

SEQ ID NO: 76296 - protein, 15 aa, Mycobacterium tuberculosis
DVYRMLGIKEGEAHV

SEQ ID NO: 76297 - protein, 15 aa, Mycobacterium tuberculosis
VYRMLGIKEGEAHVI

SEQ ID NO: 76298 - protein, 15 aa, Mycobacterium tuberculosis
YRMLGIKEGEAHVIR

SEQ ID NO: 76299 - protein, 15 aa, Mycobacterium tuberculosis
RMLGIKEGEAHVIRN

SEQ ID NO: 76300 - protein, 15 aa, Mycobacterium tuberculosis
MLGIKEGEAHVIRNA

SEQ ID NO: 76301 - protein, 15 aa, Mycobacterium tuberculosis
LGIKEGEAHVIRNAG

SEQ ID NO: 76302 - protein, 15 aa, Mycobacterium tuberculosis
GIKEGEAHVIRNAGC

SEQ ID NO: 76303 - protein, 15 aa, Mycobacterium tuberculosis
IKEGEAHVIRNAGCV

SEQ ID NO: 76304 - protein, 15 aa, Mycobacterium tuberculosis
KEGEAHVIRNAGCVV

SEQ ID NO: 76305 - protein, 15 aa, Mycobacterium tuberculosis
EGEAHVIRNAGCVVT

SEQ ID NO: 76306 - protein, 15 aa, Mycobacterium tuberculosis
GEAHVIRNAGCVVTD

SEQ ID NO: 76307 - protein, 15 aa, Mycobacterium tuberculosis
EAHVIRNAGCVVTDD

SEQ ID NO: 76308 - protein, 15 aa, Mycobacterium tuberculosis
AHVIRNAGCVVTDDV

SEQ ID NO: 76309 - protein, 15 aa, Mycobacterium tuberculosis
HVIRNAGCVVTDDVI

SEQ ID NO: 76310 - protein, 15 aa, Mycobacterium tuberculosis
VIRNAGCVVTDDVIR

SEQ ID NO: 76311 - protein, 15 aa, Mycobacterium tuberculosis
IRNAGCVVTDDVIRS

SEQ ID NO: 76312 - protein, 15 aa, Mycobacterium tuberculosis
RNAGCVVTDDVIRSL

SEQ ID NO: 76313 - protein, 15 aa, Mycobacterium tuberculosis
NAGCVVTDDVIRSLA

SEQ ID NO: 76314 - protein, 15 aa, Mycobacterium tuberculosis
AGCVVTDDVIRSLAI

SEQ ID NO: 76315 - protein, 15 aa, Mycobacterium tuberculosis
GCVVTDDVIRSLAIS

SEQ ID NO: 76316 - protein, 15 aa, Mycobacterium tuberculosis
CVVTDDVIRSLAISQ

SEQ ID NO: 76317 - protein, 15 aa, Mycobacterium tuberculosis
VVTDDVIRSLAISQR

SEQ ID NO: 76318 - protein, 15 aa, Mycobacterium tuberculosis
VTDDVIRSLAISQRL

SEQ ID NO: 76319 - protein, 15 aa, Mycobacterium tuberculosis
TDDVIRSLAISQRLL

SEQ ID NO: 76320 - protein, 15 aa, Mycobacterium tuberculosis
DDVIRSLAISQRLLG

SEQ ID NO: 76321 - protein, 15 aa, Mycobacterium tuberculosis
DVIRSLAISQRLLGT

SEQ ID NO: 76322 - protein, 15 aa, Mycobacterium tuberculosis
VIRSLAISQRLLGTR

SEQ ID NO: 76323 - protein, 15 aa, Mycobacterium tuberculosis
IRSLAISQRLLGTRE

SEQ ID NO: 76324 - protein, 15 aa, Mycobacterium tuberculosis
RSLAISQRLLGTREI

SEQ ID NO: 76325 - protein, 15 aa, Mycobacterium tuberculosis
SLAISQRLLGTREII

SEQ ID NO: 76326 - protein, 15 aa, Mycobacterium tuberculosis
LAISQRLLGTREIIL

SEQ ID NO: 76327 - protein, 15 aa, Mycobacterium tuberculosis
AISQRLLGTREIILL

SEQ ID NO: 76328 - protein, 15 aa, Mycobacterium tuberculosis
ISQRLLGTREIILLH

SEQ ID NO: 76329 - protein, 15 aa, Mycobacterium tuberculosis
SQRLLGTREIILLHH

SEQ ID NO: 76330 - protein, 15 aa, Mycobacterium tuberculosis
QRLLGTREIILLHHT

SEQ ID NO: 76331 - protein, 15 aa, Mycobacterium tuberculosis
RLLGTREIILLHHTD

SEQ ID NO: 76332 - protein, 15 aa, Mycobacterium tuberculosis
LLGTREIILLHHTDC

SEQ ID NO: 76333 - protein, 15 aa, Mycobacterium tuberculosis
LGTREIILLHHTDCG

SEQ ID NO: 76334 - protein, 15 aa, Mycobacterium tuberculosis
GTREIILLHHTDCGM

SEQ ID NO: 76335 - protein, 15 aa, Mycobacterium tuberculosis
TREIILLHHTDCGML

SEQ ID NO: 76336 - protein, 15 aa, Mycobacterium tuberculosis
REIILLHHTDCGMLT

SEQ ID NO: 76337 - protein, 15 aa, Mycobacterium tuberculosis
EIILLHHTDCGMLTF

SEQ ID NO: 76338 - protein, 15 aa, Mycobacterium tuberculosis
IILLHHTDCGMLTFT

SEQ ID NO: 76339 - protein, 15 aa, Mycobacterium tuberculosis
ILLHHTDCGMLTFTD

SEQ ID NO: 76340 - protein, 15 aa, Mycobacterium tuberculosis
LLHHTDCGMLTFTDD

SEQ ID NO: 76341 - protein, 15 aa, Mycobacterium tuberculosis
LHHTDCGMLTFTDDD

SEQ ID NO: 76342 - protein, 15 aa, Mycobacterium tuberculosis
HHTDCGMLTFTDDDF

SEQ ID NO: 76343 - protein, 15 aa, Mycobacterium tuberculosis
HTDCGMLTFTDDDFK

SEQ ID NO: 76344 - protein, 15 aa, Mycobacterium tuberculosis
TDCGMLTFTDDDFKR

SEQ ID NO: 76345 - protein, 15 aa, Mycobacterium tuberculosis
DCGMLTFTDDDFKRA

SEQ ID NO: 76346 - protein, 15 aa, Mycobacterium tuberculosis
CGMLTFTDDDFKRAI

SEQ ID NO: 76347 - protein, 15 aa, Mycobacterium tuberculosis
GMLTFTDDDFKRAIQ

SEQ ID NO: 76348 - protein, 15 aa, Mycobacterium tuberculosis
MLTFTDDDFKRAIQD

SEQ ID NO: 76349 - protein, 15 aa, Mycobacterium tuberculosis
LTFTDDDFKRAIQDE

SEQ ID NO: 76350 - protein, 15 aa, Mycobacterium tuberculosis
TFTDDDFKRAIQDET

SEQ ID NO: 76351 - protein, 15 aa, Mycobacterium tuberculosis
FTDDDFKRAIQDETG

SEQ ID NO: 76352 - protein, 15 aa, Mycobacterium tuberculosis
TDDDFKRAIQDETGI

SEQ ID NO: 76353 - protein, 15 aa, Mycobacterium tuberculosis
DDDFKRAIQDETGIR

SEQ ID NO: 76354 - protein, 15 aa, Mycobacterium tuberculosis
DDFKRAIQDETGIRP

SEQ ID NO: 76355 - protein, 15 aa, Mycobacterium tuberculosis
DFKRAIQDETGIRPT

SEQ ID NO: 76356 - protein, 15 aa, Mycobacterium tuberculosis
FKRAIQDETGIRPTW

SEQ ID NO: 76357 - protein, 15 aa, Mycobacterium tuberculosis
KRAIQDETGIRPTWS

SEQ ID NO: 76358 - protein, 15 aa, Mycobacterium tuberculosis
RAIQDETGIRPTWSP

SEQ ID NO: 76359 - protein, 15 aa, Mycobacterium tuberculosis
AIQDETGIRPTWSPE

SEQ ID NO: 76360 - protein, 15 aa, Mycobacterium tuberculosis
IQDETGIRPTWSPES

SEQ ID NO: 76361 - protein, 15 aa, Mycobacterium tuberculosis
QDETGIRPTWSPESY

SEQ ID NO: 76362 - protein, 15 aa, Mycobacterium tuberculosis
DETGIRPTWSPESYP

SEQ ID NO: 76363 - protein, 15 aa, Mycobacterium tuberculosis
ETGIRPTWSPESYPD

SEQ ID NO: 76364 - protein, 15 aa, Mycobacterium tuberculosis
TGIRPTWSPESYPDA

SEQ ID NO: 76365 - protein, 15 aa, Mycobacterium tuberculosis
GIRPTWSPESYPDAV

SEQ ID NO: 76366 - protein, 15 aa, Mycobacterium tuberculosis
IRPTWSPESYPDAVE

SEQ ID NO: 76367 - protein, 15 aa, Mycobacterium tuberculosis
RPTWSPESYPDAVED

SEQ ID NO: 76368 - protein, 15 aa, Mycobacterium tuberculosis
PTWSPESYPDAVEDV

SEQ ID NO: 76369 - protein, 15 aa, Mycobacterium tuberculosis
TWSPESYPDAVEDVR

SEQ ID NO: 76370 - protein, 15 aa, Mycobacterium tuberculosis
WSPESYPDAVEDVRQ

SEQ ID NO: 76371 - protein, 15 aa, Mycobacterium tuberculosis
SPESYPDAVEDVRQS

SEQ ID NO: 76372 - protein, 15 aa, Mycobacterium tuberculosis
PESYPDAVEDVRQSL

SEQ ID NO: 76373 - protein, 15 aa, Mycobacterium tuberculosis
ESYPDAVEDVRQSLR

SEQ ID NO: 76374 - protein, 15 aa, Mycobacterium tuberculosis
SYPDAVEDVRQSLRR

SEQ ID NO: 76375 - protein, 15 aa, Mycobacterium tuberculosis
YPDAVEDVRQSLRRI

SEQ ID NO: 76376 - protein, 15 aa, Mycobacterium tuberculosis
PDAVEDVRQSLRRIE

SEQ ID NO: 76377 - protein, 15 aa, Mycobacterium tuberculosis
DAVEDVRQSLRRIEV

SEQ ID NO: 76378 - protein, 15 aa, Mycobacterium tuberculosis
AVEDVRQSLRRIEVN

SEQ ID NO: 76379 - protein, 15 aa, Mycobacterium tuberculosis
VEDVRQSLRRIEVNP

SEQ ID NO: 76380 - protein, 15 aa, Mycobacterium tuberculosis
EDVRQSLRRIEVNPF

SEQ ID NO: 76381 - protein, 15 aa, Mycobacterium tuberculosis
DVRQSLRRIEVNPFV

SEQ ID NO: 76382 - protein, 15 aa, Mycobacterium tuberculosis
VRQSLRRIEVNPFVT

SEQ ID NO: 76383 - protein, 15 aa, Mycobacterium tuberculosis
RQSLRRIEVNPFVTK

SEQ ID NO: 76384 - protein, 15 aa, Mycobacterium tuberculosis
QSLRRIEVNPFVTKH

SEQ ID NO: 76385 - protein, 15 aa, Mycobacterium tuberculosis
SLRRIEVNPFVTKHT

SEQ ID NO: 76386 - protein, 15 aa, Mycobacterium tuberculosis
LRRIEVNPFVTKHTS

SEQ ID NO: 76387 - protein, 15 aa, Mycobacterium tuberculosis
RRIEVNPFVTKHTSL

SEQ ID NO: 76388 - protein, 15 aa, Mycobacterium tuberculosis
RIEVNPFVTKHTSLR

SEQ ID NO: 76389 - protein, 15 aa, Mycobacterium tuberculosis
IEVNPFVTKHTSLRG

SEQ ID NO: 76390 - protein, 15 aa, Mycobacterium tuberculosis
EVNPFVTKHTSLRGF

SEQ ID NO: 76391 - protein, 15 aa, Mycobacterium tuberculosis
VNPFVTKHTSLRGFV

SEQ ID NO: 76392 - protein, 15 aa, Mycobacterium tuberculosis
NPFVTKHTSLRGFVF

SEQ ID NO: 76393 - protein, 15 aa, Mycobacterium tuberculosis
PFVTKHTSLRGFVFD

SEQ ID NO: 76394 - protein, 15 aa, Mycobacterium tuberculosis
FVTKHTSLRGFVFDV

SEQ ID NO: 76395 - protein, 15 aa, Mycobacterium tuberculosis
VTKHTSLRGFVFDVA

SEQ ID NO: 76396 - protein, 15 aa, Mycobacterium tuberculosis
TKHTSLRGFVFDVAT

SEQ ID NO: 76397 - protein, 15 aa, Mycobacterium tuberculosis
KHTSLRGFVFDVATG

SEQ ID NO: 76398 - protein, 15 aa, Mycobacterium tuberculosis
HTSLRGFVFDVATGK

SEQ ID NO: 76399 - protein, 15 aa, Mycobacterium tuberculosis
TSLRGFVFDVATGKL

SEQ ID NO: 76400 - protein, 15 aa, Mycobacterium tuberculosis
SLRGFVFDVATGKLN

SEQ ID NO: 76401 - protein, 15 aa, Mycobacterium tuberculosis
LRGFVFDVATGKLNE

SEQ ID NO: 76402 - protein, 15 aa, Mycobacterium tuberculosis
RGFVFDVATGKLNEV

SEQ ID NO: 76403 - protein, 15 aa, Mycobacterium tuberculosis
GFVFDVATGKLNEVT

SEQ ID NO: 76404 - protein, 15 aa, Mycobacterium tuberculosis
FVFDVATGKLNEVTP

SEQ ID NO: 76405 - protein, 16 aa, Mycobacterium tuberculosis
MTVTDDYLANNVDYAS

SEQ ID NO: 76406 - protein, 16 aa, Mycobacterium tuberculosis
TVTDDYLANNVDYASG

SEQ ID NO: 76407 - protein, 16 aa, Mycobacterium tuberculosis
VTDDYLANNVDYASGF

SEQ ID NO: 76408 - protein, 16 aa, Mycobacterium tuberculosis
TDDYLANNVDYASGFK

SEQ ID NO: 76409 - protein, 16 aa, Mycobacterium tuberculosis
DDYLANNVDYASGFKG

SEQ ID NO: 76410 - protein, 16 aa, Mycobacterium tuberculosis
DYLANNVDYASGFKGP

SEQ ID NO: 76411 - protein, 16 aa, Mycobacterium tuberculosis
YLANNVDYASGFKGPL

SEQ ID NO: 76412 - protein, 16 aa, Mycobacterium tuberculosis
LANNVDYASGFKGPLP

SEQ ID NO: 76413 - protein, 16 aa, Mycobacterium tuberculosis
ANNVDYASGFKGPLPM

SEQ ID NO: 76414 - protein, 16 aa, Mycobacterium tuberculosis
NNVDYASGFKGPLPMP

SEQ ID NO: 76415 - protein, 16 aa, Mycobacterium tuberculosis
NVDYASGFKGPLPMPP

SEQ ID NO: 76416 - protein, 16 aa, Mycobacterium tuberculosis
VDYASGFKGPLPMPPS

SEQ ID NO: 76417 - protein, 16 aa, Mycobacterium tuberculosis
DYASGFKGPLPMPPSK

SEQ ID NO: 76418 - protein, 16 aa, Mycobacterium tuberculosis
YASGFKGPLPMPPSKH

SEQ ID NO: 76419 - protein, 16 aa, Mycobacterium tuberculosis
ASGFKGPLPMPPSKHI

SEQ ID NO: 76420 - protein, 16 aa, Mycobacterium tuberculosis
SGFKGPLPMPPSKHIA

SEQ ID NO: 76421 - protein, 16 aa, Mycobacterium tuberculosis
GFKGPLPMPPSKHIAI

SEQ ID NO: 76422 - protein, 16 aa, Mycobacterium tuberculosis
FKGPLPMPPSKHIAIV

SEQ ID NO: 76423 - protein, 16 aa, Mycobacterium tuberculosis
KGPLPMPPSKHIAIVA

SEQ ID NO: 76424 - protein, 16 aa, Mycobacterium tuberculosis
GPLPMPPSKHIAIVAC

SEQ ID NO: 76425 - protein, 16 aa, Mycobacterium tuberculosis
PLPMPPSKHIAIVACM

SEQ ID NO: 76426 - protein, 16 aa, Mycobacterium tuberculosis
LPMPPSKHIAIVACMD

SEQ ID NO: 76427 - protein, 16 aa, Mycobacterium tuberculosis
PMPPSKHIAIVACMDA

SEQ ID NO: 76428 - protein, 16 aa, Mycobacterium tuberculosis
MPPSKHIAIVACMDAR

SEQ ID NO: 76429 - protein, 16 aa, Mycobacterium tuberculosis
PPSKHIAIVACMDARL

SEQ ID NO: 76430 - protein, 16 aa, Mycobacterium tuberculosis
PSKHIAIVACMDARLD

SEQ ID NO: 76431 - protein, 16 aa, Mycobacterium tuberculosis
SKHIAIVACMDARLDV

SEQ ID NO: 76432 - protein, 16 aa, Mycobacterium tuberculosis
KHIAIVACMDARLDVY

SEQ ID NO: 76433 - protein, 16 aa, Mycobacterium tuberculosis
HIAIVACMDARLDVYR

SEQ ID NO: 76434 - protein, 16 aa, Mycobacterium tuberculosis
IAIVACMDARLDVYRM

SEQ ID NO: 76435 - protein, 16 aa, Mycobacterium tuberculosis
AIVACMDARLDVYRML

SEQ ID NO: 76436 - protein, 16 aa, Mycobacterium tuberculosis
IVACMDARLDVYRMLG

SEQ ID NO: 76437 - protein, 16 aa, Mycobacterium tuberculosis
VACMDARLDVYRMLGI

SEQ ID NO: 76438 - protein, 16 aa, Mycobacterium tuberculosis
ACMDARLDVYRMLGIK

SEQ ID NO: 76439 - protein, 16 aa, Mycobacterium tuberculosis
CMDARLDVYRMLGIKE

SEQ ID NO: 76440 - protein, 16 aa, Mycobacterium tuberculosis
MDARLDVYRMLGIKEG

SEQ ID NO: 76441 - protein, 16 aa, Mycobacterium tuberculosis
DARLDVYRMLGIKEGE

SEQ ID NO: 76442 - protein, 16 aa, Mycobacterium tuberculosis
ARLDVYRMLGIKEGEA

SEQ ID NO: 76443 - protein, 16 aa, Mycobacterium tuberculosis
RLDVYRMLGIKEGEAH

SEQ ID NO: 76444 - protein, 16 aa, Mycobacterium tuberculosis
LDVYRMLGIKEGEAHV

SEQ ID NO: 76445 - protein, 16 aa, Mycobacterium tuberculosis
DVYRMLGIKEGEAHVI

SEQ ID NO: 76446 - protein, 16 aa, Mycobacterium tuberculosis
VYRMLGIKEGEAHVIR

SEQ ID NO: 76447 - protein, 16 aa, Mycobacterium tuberculosis
YRMLGIKEGEAHVIRN

SEQ ID NO: 76448 - protein, 16 aa, Mycobacterium tuberculosis
RMLGIKEGEAHVIRNA

SEQ ID NO: 76449 - protein, 16 aa, Mycobacterium tuberculosis
MLGIKEGEAHVIRNAG

SEQ ID NO: 76450 - protein, 16 aa, Mycobacterium tuberculosis
LGIKEGEAHVIRNAGC

SEQ ID NO: 76451 - protein, 16 aa, Mycobacterium tuberculosis
GIKEGEAHVIRNAGCV

SEQ ID NO: 76452 - protein, 16 aa, Mycobacterium tuberculosis
IKEGEAHVIRNAGCVV

SEQ ID NO: 76453 - protein, 16 aa, Mycobacterium tuberculosis
KEGEAHVIRNAGCVVT

SEQ ID NO: 76454 - protein, 16 aa, Mycobacterium tuberculosis
EGEAHVIRNAGCVVTD

SEQ ID NO: 76455 - protein, 16 aa, Mycobacterium tuberculosis
GEAHVIRNAGCVVTDD

SEQ ID NO: 76456 - protein, 16 aa, Mycobacterium tuberculosis
EAHVIRNAGCVVTDDV

SEQ ID NO: 76457 - protein, 16 aa, Mycobacterium tuberculosis
AHVIRNAGCVVTDDVI

SEQ ID NO: 76458 - protein, 16 aa, Mycobacterium tuberculosis
HVIRNAGCVVTDDVIR

SEQ ID NO: 76459 - protein, 16 aa, Mycobacterium tuberculosis
VIRNAGCVVTDDVIRS

SEQ ID NO: 76460 - protein, 16 aa, Mycobacterium tuberculosis
IRNAGCVVTDDVIRSL

SEQ ID NO: 76461 - protein, 16 aa, Mycobacterium tuberculosis
RNAGCVVTDDVIRSLA

SEQ ID NO: 76462 - protein, 16 aa, Mycobacterium tuberculosis
NAGCVVTDDVIRSLAI

SEQ ID NO: 76463 - protein, 16 aa, Mycobacterium tuberculosis
AGCVVTDDVIRSLAIS

SEQ ID NO: 76464 - protein, 16 aa, Mycobacterium tuberculosis
GCVVTDDVIRSLAISQ

SEQ ID NO: 76465 - protein, 16 aa, Mycobacterium tuberculosis
CVVTDDVIRSLAISQR

SEQ ID NO: 76466 - protein, 16 aa, Mycobacterium tuberculosis
VVTDDVIRSLAISQRL

SEQ ID NO: 76467 - protein, 16 aa, Mycobacterium tuberculosis
VTDDVIRSLAISQRLL

SEQ ID NO: 76468 - protein, 16 aa, Mycobacterium tuberculosis
TDDVIRSLAISQRLLG

SEQ ID NO: 76469 - protein, 16 aa, Mycobacterium tuberculosis
DDVIRSLAISQRLLGT

SEQ ID NO: 76470 - protein, 16 aa, Mycobacterium tuberculosis
DVIRSLAISQRLLGTR

SEQ ID NO: 76471 - protein, 16 aa, Mycobacterium tuberculosis
VIRSLAISQRLLGTRE

SEQ ID NO: 76472 - protein, 16 aa, Mycobacterium tuberculosis
IRSLAISQRLLGTREI

SEQ ID NO: 76473 - protein, 16 aa, Mycobacterium tuberculosis
RSLAISQRLLGTREII

SEQ ID NO: 76474 - protein, 16 aa, Mycobacterium tuberculosis
SLAISQRLLGTREIIL

SEQ ID NO: 76475 - protein, 16 aa, Mycobacterium tuberculosis
LAISQRLLGTREIILL

SEQ ID NO: 76476 - protein, 16 aa, Mycobacterium tuberculosis
AISQRLLGTREIILLH

SEQ ID NO: 76477 - protein, 16 aa, Mycobacterium tuberculosis
ISQRLLGTREIILLHH

SEQ ID NO: 76478 - protein, 16 aa, Mycobacterium tuberculosis
SQRLLGTREIILLHHT

SEQ ID NO: 76479 - protein, 16 aa, Mycobacterium tuberculosis
QRLLGTREIILLHHTD

SEQ ID NO: 76480 - protein, 16 aa, Mycobacterium tuberculosis
RLLGTREIILLHHTDC

SEQ ID NO: 76481 - protein, 16 aa, Mycobacterium tuberculosis
LLGTREIILLHHTDCG

SEQ ID NO: 76482 - protein, 16 aa, Mycobacterium tuberculosis
LGTREIILLHHTDCGM

SEQ ID NO: 76483 - protein, 16 aa, Mycobacterium tuberculosis
GTREIILLHHTDCGML

SEQ ID NO: 76484 - protein, 16 aa, Mycobacterium tuberculosis
TREIILLHHTDCGMLT

SEQ ID NO: 76485 - protein, 16 aa, Mycobacterium tuberculosis
REIILLHHTDCGMLTF

SEQ ID NO: 76486 - protein, 16 aa, Mycobacterium tuberculosis
EIILLHHTDCGMLTFT

SEQ ID NO: 76487 - protein, 16 aa, Mycobacterium tuberculosis
IILLHHTDCGMLTFTD

SEQ ID NO: 76488 - protein, 16 aa, Mycobacterium tuberculosis
ILLHHTDCGMLTFTDD

SEQ ID NO: 76489 - protein, 16 aa, Mycobacterium tuberculosis
LLHHTDCGMLTFTDDD

SEQ ID NO: 76490 - protein, 16 aa, Mycobacterium tuberculosis
LHHTDCGMLTFTDDDF

SEQ ID NO: 76491 - protein, 16 aa, Mycobacterium tuberculosis
HHTDCGMLTFTDDDFK

SEQ ID NO: 76492 - protein, 16 aa, Mycobacterium tuberculosis
HTDCGMLTFTDDDFKR

SEQ ID NO: 76493 - protein, 16 aa, Mycobacterium tuberculosis
TDCGMLTFTDDDFKRA

SEQ ID NO: 76494 - protein, 16 aa, Mycobacterium tuberculosis
DCGMLTFTDDDFKRAI

SEQ ID NO: 76495 - protein, 16 aa, Mycobacterium tuberculosis
CGMLTFTDDDFKRAIQ

SEQ ID NO: 76496 - protein, 16 aa, Mycobacterium tuberculosis
GMLTFTDDDFKRAIQD

SEQ ID NO: 76497 - protein, 16 aa, Mycobacterium tuberculosis
MLTFTDDDFKRAIQDE

SEQ ID NO: 76498 - protein, 16 aa, Mycobacterium tuberculosis
LTFTDDDFKRAIQDET

SEQ ID NO: 76499 - protein, 16 aa, Mycobacterium tuberculosis
TFTDDDFKRAIQDETG

SEQ ID NO: 76500 - protein, 16 aa, Mycobacterium tuberculosis
FTDDDFKRAIQDETGI

SEQ ID NO: 76501 - protein, 16 aa, Mycobacterium tuberculosis
TDDDFKRAIQDETGIR

SEQ ID NO: 76502 - protein, 16 aa, Mycobacterium tuberculosis
DDDFKRAIQDETGIRP

SEQ ID NO: 76503 - protein, 16 aa, Mycobacterium tuberculosis
DDFKRAIQDETGIRPT

SEQ ID NO: 76504 - protein, 16 aa, Mycobacterium tuberculosis
DFKRAIQDETGIRPTW

SEQ ID NO: 76505 - protein, 16 aa, Mycobacterium tuberculosis
FKRAIQDETGIRPTWS

SEQ ID NO: 76506 - protein, 16 aa, Mycobacterium tuberculosis
KRAIQDETGIRPTWSP

SEQ ID NO: 76507 - protein, 16 aa, Mycobacterium tuberculosis
RAIQDETGIRPTWSPE

SEQ ID NO: 76508 - protein, 16 aa, Mycobacterium tuberculosis
AIQDETGIRPTWSPES

SEQ ID NO: 76509 - protein, 16 aa, Mycobacterium tuberculosis
IQDETGIRPTWSPESY

SEQ ID NO: 76510 - protein, 16 aa, Mycobacterium tuberculosis
QDETGIRPTWSPESYP

SEQ ID NO: 76511 - protein, 16 aa, Mycobacterium tuberculosis
DETGIRPTWSPESYPD

SEQ ID NO: 76512 - protein, 16 aa, Mycobacterium tuberculosis
ETGIRPTWSPESYPDA

SEQ ID NO: 76513 - protein, 16 aa, Mycobacterium tuberculosis
TGIRPTWSPESYPDAV

SEQ ID NO: 76514 - protein, 16 aa, Mycobacterium tuberculosis
GIRPTWSPESYPDAVE

SEQ ID NO: 76515 - protein, 16 aa, Mycobacterium tuberculosis
IRPTWSPESYPDAVED

SEQ ID NO: 76516 - protein, 16 aa, Mycobacterium tuberculosis
RPTWSPESYPDAVEDV

SEQ ID NO: 76517 - protein, 16 aa, Mycobacterium tuberculosis
PTWSPESYPDAVEDVR

SEQ ID NO: 76518 - protein, 16 aa, Mycobacterium tuberculosis
TWSPESYPDAVEDVRQ

SEQ ID NO: 76519 - protein, 16 aa, Mycobacterium tuberculosis
WSPESYPDAVEDVRQS

SEQ ID NO: 76520 - protein, 16 aa, Mycobacterium tuberculosis
SPESYPDAVEDVRQSL

SEQ ID NO: 76521 - protein, 16 aa, Mycobacterium tuberculosis
PESYPDAVEDVRQSLR

SEQ ID NO: 76522 - protein, 16 aa, Mycobacterium tuberculosis
ESYPDAVEDVRQSLRR

SEQ ID NO: 76523 - protein, 16 aa, Mycobacterium tuberculosis
SYPDAVEDVRQSLRRI

SEQ ID NO: 76524 - protein, 16 aa, Mycobacterium tuberculosis
YPDAVEDVRQSLRRIE

SEQ ID NO: 76525 - protein, 16 aa, Mycobacterium tuberculosis
PDAVEDVRQSLRRIEV

SEQ ID NO: 76526 - protein, 16 aa, Mycobacterium tuberculosis
DAVEDVRQSLRRIEVN

SEQ ID NO: 76527 - protein, 16 aa, Mycobacterium tuberculosis
AVEDVRQSLRRIEVNP

SEQ ID NO: 76528 - protein, 16 aa, Mycobacterium tuberculosis
VEDVRQSLRRIEVNPF

SEQ ID NO: 76529 - protein, 16 aa, Mycobacterium tuberculosis
EDVRQSLRRIEVNPFV

SEQ ID NO: 76530 - protein, 16 aa, Mycobacterium tuberculosis
DVRQSLRRIEVNPFVT

SEQ ID NO: 76531 - protein, 16 aa, Mycobacterium tuberculosis
VRQSLRRIEVNPFVTK

SEQ ID NO: 76532 - protein, 16 aa, Mycobacterium tuberculosis
RQSLRRIEVNPFVTKH

SEQ ID NO: 76533 - protein, 16 aa, Mycobacterium tuberculosis
QSLRRIEVNPFVTKHT

SEQ ID NO: 76534 - protein, 16 aa, Mycobacterium tuberculosis
SLRRIEVNPFVTKHTS

SEQ ID NO: 76535 - protein, 16 aa, Mycobacterium tuberculosis
LRRIEVNPFVTKHTSL

SEQ ID NO: 76536 - protein, 16 aa, Mycobacterium tuberculosis
RRIEVNPFVTKHTSLR

SEQ ID NO: 76537 - protein, 16 aa, Mycobacterium tuberculosis
RIEVNPFVTKHTSLRG

SEQ ID NO: 76538 - protein, 16 aa, Mycobacterium tuberculosis
IEVNPFVTKHTSLRGF

SEQ ID NO: 76539 - protein, 16 aa, Mycobacterium tuberculosis
EVNPFVTKHTSLRGFV

SEQ ID NO: 76540 - protein, 16 aa, Mycobacterium tuberculosis
VNPFVTKHTSLRGFVF

SEQ ID NO: 76541 - protein, 16 aa, Mycobacterium tuberculosis
NPFVTKHTSLRGFVFD

SEQ ID NO: 76542 - protein, 16 aa, Mycobacterium tuberculosis
PFVTKHTSLRGFVFDV

SEQ ID NO: 76543 - protein, 16 aa, Mycobacterium tuberculosis
FVTKHTSLRGFVFDVA

SEQ ID NO: 76544 - protein, 16 aa, Mycobacterium tuberculosis
VTKHTSLRGFVFDVAT

SEQ ID NO: 76545 - protein, 16 aa, Mycobacterium tuberculosis
TKHTSLRGFVFDVATG

SEQ ID NO: 76546 - protein, 16 aa, Mycobacterium tuberculosis
KHTSLRGFVFDVATGK

SEQ ID NO: 76547 - protein, 16 aa, Mycobacterium tuberculosis
HTSLRGFVFDVATGKL

SEQ ID NO: 76548 - protein, 16 aa, Mycobacterium tuberculosis
TSLRGFVFDVATGKLN

SEQ ID NO: 76549 - protein, 16 aa, Mycobacterium tuberculosis
SLRGFVFDVATGKLNE

SEQ ID NO: 76550 - protein, 16 aa, Mycobacterium tuberculosis
LRGFVFDVATGKLNEV

SEQ ID NO: 76551 - protein, 16 aa, Mycobacterium tuberculosis
RGFVFDVATGKLNEVT

SEQ ID NO: 76552 - protein, 16 aa, Mycobacterium tuberculosis
GFVFDVATGKLNEVTP

SEQ ID NO: 76553 - protein, 13 aa, Mycobacterium tuberculosis
MTLRVVPESLAGA

SEQ ID NO: 76554 - protein, 13 aa, Mycobacterium tuberculosis
TLRVVPESLAGAS

SEQ ID NO: 76555 - protein, 13 aa, Mycobacterium tuberculosis
LRVVPESLAGASA

SEQ ID NO: 76556 - protein, 13 aa, Mycobacterium tuberculosis
RVVPESLAGASAA

SEQ ID NO: 76557 - protein, 13 aa, Mycobacterium tuberculosis
VVPESLAGASAAI

SEQ ID NO: 76558 - protein, 13 aa, Mycobacterium tuberculosis
VPESLAGASAAIE

SEQ ID NO: 76559 - protein, 13 aa, Mycobacterium tuberculosis
PESLAGASAAIEA

SEQ ID NO: 76560 - protein, 13 aa, Mycobacterium tuberculosis
ESLAGASAAIEAV

SEQ ID NO: 76561 - protein, 13 aa, Mycobacterium tuberculosis
SLAGASAAIEAVT

SEQ ID NO: 76562 - protein, 13 aa, Mycobacterium tuberculosis
LAGASAAIEAVTA

SEQ ID NO: 76563 - protein, 13 aa, Mycobacterium tuberculosis
AGASAAIEAVTAR

SEQ ID NO: 76564 - protein, 13 aa, Mycobacterium tuberculosis
GASAAIEAVTARL

SEQ ID NO: 76565 - protein, 13 aa, Mycobacterium tuberculosis
ASAAIEAVTARLA

SEQ ID NO: 76566 - protein, 13 aa, Mycobacterium tuberculosis
SAAIEAVTARLAA

SEQ ID NO: 76567 - protein, 13 aa, Mycobacterium tuberculosis
AAIEAVTARLAAA

SEQ ID NO: 76568 - protein, 13 aa, Mycobacterium tuberculosis
AIEAVTARLAAAH

SEQ ID NO: 76569 - protein, 13 aa, Mycobacterium tuberculosis
IEAVTARLAAAHA

SEQ ID NO: 76570 - protein, 13 aa, Mycobacterium tuberculosis
EAVTARLAAAHAA

SEQ ID NO: 76571 - protein, 13 aa, Mycobacterium tuberculosis
AVTARLAAAHAAA

SEQ ID NO: 76572 - protein, 13 aa, Mycobacterium tuberculosis
VTARLAAAHAAAA

SEQ ID NO: 76573 - protein, 13 aa, Mycobacterium tuberculosis
TARLAAAHAAAAP

SEQ ID NO: 76574 - protein, 13 aa, Mycobacterium tuberculosis
ARLAAAHAAAAPF

SEQ ID NO: 76575 - protein, 13 aa, Mycobacterium tuberculosis
RLAAAHAAAAPFI

SEQ ID NO: 76576 - protein, 13 aa, Mycobacterium tuberculosis
LAAAHAAAAPFIA

SEQ ID NO: 76577 - protein, 13 aa, Mycobacterium tuberculosis
AAAHAAAAPFIAA

SEQ ID NO: 76578 - protein, 13 aa, Mycobacterium tuberculosis
AAHAAAAPFIAAV

SEQ ID NO: 76579 - protein, 13 aa, Mycobacterium tuberculosis
AHAAAAPFIAAVI

SEQ ID NO: 76580 - protein, 13 aa, Mycobacterium tuberculosis
HAAAAPFIAAVIP

SEQ ID NO: 76581 - protein, 13 aa, Mycobacterium tuberculosis
AAAAPFIAAVIPP

SEQ ID NO: 76582 - protein, 13 aa, Mycobacterium tuberculosis
AAAPFIAAVIPPG

SEQ ID NO: 76583 - protein, 13 aa, Mycobacterium tuberculosis
AAPFIAAVIPPGS

SEQ ID NO: 76584 - protein, 13 aa, Mycobacterium tuberculosis
APFIAAVIPPGSD

SEQ ID NO: 76585 - protein, 13 aa, Mycobacterium tuberculosis
PFIAAVIPPGSDS

SEQ ID NO: 76586 - protein, 13 aa, Mycobacterium tuberculosis
FIAAVIPPGSDSV

SEQ ID NO: 76587 - protein, 13 aa, Mycobacterium tuberculosis
IAAVIPPGSDSVS

SEQ ID NO: 76588 - protein, 13 aa, Mycobacterium tuberculosis
AAVIPPGSDSVSV

SEQ ID NO: 76589 - protein, 13 aa, Mycobacterium tuberculosis
AVIPPGSDSVSVC

SEQ ID NO: 76590 - protein, 13 aa, Mycobacterium tuberculosis
VIPPGSDSVSVCN

SEQ ID NO: 76591 - protein, 13 aa, Mycobacterium tuberculosis
IPPGSDSVSVCNA

SEQ ID NO: 76592 - protein, 13 aa, Mycobacterium tuberculosis
PPGSDSVSVCNAV

SEQ ID NO: 76593 - protein, 13 aa, Mycobacterium tuberculosis
PGSDSVSVCNAVE

SEQ ID NO: 76594 - protein, 13 aa, Mycobacterium tuberculosis
GSDSVSVCNAVEF

SEQ ID NO: 76595 - protein, 13 aa, Mycobacterium tuberculosis
SDSVSVCNAVEFS

SEQ ID NO: 76596 - protein, 13 aa, Mycobacterium tuberculosis
DSVSVCNAVEFSV

SEQ ID NO: 76597 - protein, 13 aa, Mycobacterium tuberculosis
SVSVCNAVEFSVH

SEQ ID NO: 76598 - protein, 13 aa, Mycobacterium tuberculosis
VSVCNAVEFSVHG

SEQ ID NO: 76599 - protein, 13 aa, Mycobacterium tuberculosis
SVCNAVEFSVHGS

SEQ ID NO: 76600 - protein, 13 aa, Mycobacterium tuberculosis
VCNAVEFSVHGSQ

SEQ ID NO: 76601 - protein, 13 aa, Mycobacterium tuberculosis
CNAVEFSVHGSQH

SEQ ID NO: 76602 - protein, 13 aa, Mycobacterium tuberculosis
NAVEFSVHGSQHV

SEQ ID NO: 76603 - protein, 13 aa, Mycobacterium tuberculosis
AVEFSVHGSQHVA

SEQ ID NO: 76604 - protein, 13 aa, Mycobacterium tuberculosis
VEFSVHGSQHVAM

SEQ ID NO: 76605 - protein, 13 aa, Mycobacterium tuberculosis
EFSVHGSQHVAMA

SEQ ID NO: 76606 - protein, 13 aa, Mycobacterium tuberculosis
FSVHGSQHVAMAA

SEQ ID NO: 76607 - protein, 13 aa, Mycobacterium tuberculosis
SVHGSQHVAMAAQ

SEQ ID NO: 76608 - protein, 13 aa, Mycobacterium tuberculosis
VHGSQHVAMAAQG

SEQ ID NO: 76609 - protein, 13 aa, Mycobacterium tuberculosis
HGSQHVAMAAQGV

SEQ ID NO: 76610 - protein, 13 aa, Mycobacterium tuberculosis
GSQHVAMAAQGVE

SEQ ID NO: 76611 - protein, 13 aa, Mycobacterium tuberculosis
SQHVAMAAQGVEE

SEQ ID NO: 76612 - protein, 13 aa, Mycobacterium tuberculosis
QHVAMAAQGVEEL

SEQ ID NO: 76613 - protein, 13 aa, Mycobacterium tuberculosis
HVAMAAQGVEELG

SEQ ID NO: 76614 - protein, 13 aa, Mycobacterium tuberculosis
VAMAAQGVEELGR

SEQ ID NO: 76615 - protein, 13 aa, Mycobacterium tuberculosis
AMAAQGVEELGRS

SEQ ID NO: 76616 - protein, 13 aa, Mycobacterium tuberculosis
MAAQGVEELGRSG

SEQ ID NO: 76617 - protein, 13 aa, Mycobacterium tuberculosis
AAQGVEELGRSGV

SEQ ID NO: 76618 - protein, 13 aa, Mycobacterium tuberculosis
AQGVEELGRSGVG

SEQ ID NO: 76619 - protein, 13 aa, Mycobacterium tuberculosis
QGVEELGRSGVGV

SEQ ID NO: 76620 - protein, 13 aa, Mycobacterium tuberculosis
GVEELGRSGVGVA

SEQ ID NO: 76621 - protein, 13 aa, Mycobacterium tuberculosis
VEELGRSGVGVAE

SEQ ID NO: 76622 - protein, 13 aa, Mycobacterium tuberculosis
EELGRSGVGVAES

SEQ ID NO: 76623 - protein, 13 aa, Mycobacterium tuberculosis
ELGRSGVGVAESG

SEQ ID NO: 76624 - protein, 13 aa, Mycobacterium tuberculosis
LGRSGVGVAESGA

SEQ ID NO: 76625 - protein, 13 aa, Mycobacterium tuberculosis
GRSGVGVAESGAS

SEQ ID NO: 76626 - protein, 13 aa, Mycobacterium tuberculosis
RSGVGVAESGASY

SEQ ID NO: 76627 - protein, 13 aa, Mycobacterium tuberculosis
SGVGVAESGASYA

SEQ ID NO: 76628 - protein, 13 aa, Mycobacterium tuberculosis
GVGVAESGASYAA

SEQ ID NO: 76629 - protein, 13 aa, Mycobacterium tuberculosis
VGVAESGASYAAR

SEQ ID NO: 76630 - protein, 13 aa, Mycobacterium tuberculosis
GVAESGASYAARD

SEQ ID NO: 76631 - protein, 13 aa, Mycobacterium tuberculosis
VAESGASYAARDA

SEQ ID NO: 76632 - protein, 13 aa, Mycobacterium tuberculosis
AESGASYAARDAL

SEQ ID NO: 76633 - protein, 13 aa, Mycobacterium tuberculosis
ESGASYAARDALA

SEQ ID NO: 76634 - protein, 13 aa, Mycobacterium tuberculosis
SGASYAARDALAA

SEQ ID NO: 76635 - protein, 13 aa, Mycobacterium tuberculosis
GASYAARDALAAA

SEQ ID NO: 76636 - protein, 13 aa, Mycobacterium tuberculosis
ASYAARDALAAAS

SEQ ID NO: 76637 - protein, 13 aa, Mycobacterium tuberculosis
SYAARDALAAASY

SEQ ID NO: 76638 - protein, 13 aa, Mycobacterium tuberculosis
YAARDALAAASYL

SEQ ID NO: 76639 - protein, 13 aa, Mycobacterium tuberculosis
AARDALAAASYLS

SEQ ID NO: 76640 - protein, 13 aa, Mycobacterium tuberculosis
ARDALAAASYLSG

SEQ ID NO: 76641 - protein, 13 aa, Mycobacterium tuberculosis
RDALAAASYLSGG

SEQ ID NO: 76642 - protein, 13 aa, Mycobacterium tuberculosis
DALAAASYLSGGL

SEQ ID NO: 76643 - protein, 14 aa, Mycobacterium tuberculosis
MTLRVVPESLAGAS

SEQ ID NO: 76644 - protein, 14 aa, Mycobacterium tuberculosis
TLRVVPESLAGASA

SEQ ID NO: 76645 - protein, 14 aa, Mycobacterium tuberculosis
LRVVPESLAGASAA

SEQ ID NO: 76646 - protein, 14 aa, Mycobacterium tuberculosis
RVVPESLAGASAAI

SEQ ID NO: 76647 - protein, 14 aa, Mycobacterium tuberculosis
VVPESLAGASAAIE

SEQ ID NO: 76648 - protein, 14 aa, Mycobacterium tuberculosis
VPESLAGASAAIEA

SEQ ID NO: 76649 - protein, 14 aa, Mycobacterium tuberculosis
PESLAGASAAIEAV

SEQ ID NO: 76650 - protein, 14 aa, Mycobacterium tuberculosis
ESLAGASAAIEAVT

SEQ ID NO: 76651 - protein, 14 aa, Mycobacterium tuberculosis
SLAGASAAIEAVTA

SEQ ID NO: 76652 - protein, 14 aa, Mycobacterium tuberculosis
LAGASAAIEAVTAR

SEQ ID NO: 76653 - protein, 14 aa, Mycobacterium tuberculosis
AGASAAIEAVTARL

SEQ ID NO: 76654 - protein, 14 aa, Mycobacterium tuberculosis
GASAAIEAVTARLA

SEQ ID NO: 76655 - protein, 14 aa, Mycobacterium tuberculosis
ASAAIEAVTARLAA

SEQ ID NO: 76656 - protein, 14 aa, Mycobacterium tuberculosis
SAAIEAVTARLAAA

SEQ ID NO: 76657 - protein, 14 aa, Mycobacterium tuberculosis
AAIEAVTARLAAAH

SEQ ID NO: 76658 - protein, 14 aa, Mycobacterium tuberculosis
AIEAVTARLAAAHA

SEQ ID NO: 76659 - protein, 14 aa, Mycobacterium tuberculosis
IEAVTARLAAAHAA

SEQ ID NO: 76660 - protein, 14 aa, Mycobacterium tuberculosis
EAVTARLAAAHAAA

SEQ ID NO: 76661 - protein, 14 aa, Mycobacterium tuberculosis
AVTARLAAAHAAAA

SEQ ID NO: 76662 - protein, 14 aa, Mycobacterium tuberculosis
VTARLAAAHAAAAP

SEQ ID NO: 76663 - protein, 14 aa, Mycobacterium tuberculosis
TARLAAAHAAAAPF

SEQ ID NO: 76664 - protein, 14 aa, Mycobacterium tuberculosis
ARLAAAHAAAAPFI

SEQ ID NO: 76665 - protein, 14 aa, Mycobacterium tuberculosis
RLAAAHAAAAPFIA

SEQ ID NO: 76666 - protein, 14 aa, Mycobacterium tuberculosis
LAAAHAAAAPFIAA

SEQ ID NO: 76667 - protein, 14 aa, Mycobacterium tuberculosis
AAAHAAAAPFIAAV

SEQ ID NO: 76668 - protein, 14 aa, Mycobacterium tuberculosis
AAHAAAAPFIAAVI

SEQ ID NO: 76669 - protein, 14 aa, Mycobacterium tuberculosis
AHAAAAPFIAAVIP

SEQ ID NO: 76670 - protein, 14 aa, Mycobacterium tuberculosis
HAAAAPFIAAVIPP

SEQ ID NO: 76671 - protein, 14 aa, Mycobacterium tuberculosis
AAAAPFIAAVIPPG

SEQ ID NO: 76672 - protein, 14 aa, Mycobacterium tuberculosis
AAAPFIAAVIPPGS

SEQ ID NO: 76673 - protein, 14 aa, Mycobacterium tuberculosis
AAPFIAAVIPPGSD

SEQ ID NO: 76674 - protein, 14 aa, Mycobacterium tuberculosis
APFIAAVIPPGSDS

SEQ ID NO: 76675 - protein, 14 aa, Mycobacterium tuberculosis
PFIAAVIPPGSDSV

SEQ ID NO: 76676 - protein, 14 aa, Mycobacterium tuberculosis
FIAAVIPPGSDSVS

SEQ ID NO: 76677 - protein, 14 aa, Mycobacterium tuberculosis
IAAVIPPGSDSVSV

SEQ ID NO: 76678 - protein, 14 aa, Mycobacterium tuberculosis
AAVIPPGSDSVSVC

SEQ ID NO: 76679 - protein, 14 aa, Mycobacterium tuberculosis
AVIPPGSDSVSVCN

SEQ ID NO: 76680 - protein, 14 aa, Mycobacterium tuberculosis
VIPPGSDSVSVCNA

SEQ ID NO: 76681 - protein, 14 aa, Mycobacterium tuberculosis
IPPGSDSVSVCNAV

SEQ ID NO: 76682 - protein, 14 aa, Mycobacterium tuberculosis
PPGSDSVSVCNAVE

SEQ ID NO: 76683 - protein, 14 aa, Mycobacterium tuberculosis
PGSDSVSVCNAVEF

SEQ ID NO: 76684 - protein, 14 aa, Mycobacterium tuberculosis
GSDSVSVCNAVEFS

SEQ ID NO: 76685 - protein, 14 aa, Mycobacterium tuberculosis
SDSVSVCNAVEFSV

SEQ ID NO: 76686 - protein, 14 aa, Mycobacterium tuberculosis
DSVSVCNAVEFSVH

SEQ ID NO: 76687 - protein, 14 aa, Mycobacterium tuberculosis
SVSVCNAVEFSVHG

SEQ ID NO: 76688 - protein, 14 aa, Mycobacterium tuberculosis
VSVCNAVEFSVHGS

SEQ ID NO: 76689 - protein, 14 aa, Mycobacterium tuberculosis
SVCNAVEFSVHGSQ

SEQ ID NO: 76690 - protein, 14 aa, Mycobacterium tuberculosis
VCNAVEFSVHGSQH

SEQ ID NO: 76691 - protein, 14 aa, Mycobacterium tuberculosis
CNAVEFSVHGSQHV

SEQ ID NO: 76692 - protein, 14 aa, Mycobacterium tuberculosis
NAVEFSVHGSQHVA

SEQ ID NO: 76693 - protein, 14 aa, Mycobacterium tuberculosis
AVEFSVHGSQHVAM

SEQ ID NO: 76694 - protein, 14 aa, Mycobacterium tuberculosis
VEFSVHGSQHVAMA

SEQ ID NO: 76695 - protein, 14 aa, Mycobacterium tuberculosis
EFSVHGSQHVAMAA

SEQ ID NO: 76696 - protein, 14 aa, Mycobacterium tuberculosis
FSVHGSQHVAMAAQ

SEQ ID NO: 76697 - protein, 14 aa, Mycobacterium tuberculosis
SVHGSQHVAMAAQG

SEQ ID NO: 76698 - protein, 14 aa, Mycobacterium tuberculosis
VHGSQHVAMAAQGV

SEQ ID NO: 76699 - protein, 14 aa, Mycobacterium tuberculosis
HGSQHVAMAAQGVE

SEQ ID NO: 76700 - protein, 14 aa, Mycobacterium tuberculosis
GSQHVAMAAQGVEE

SEQ ID NO: 76701 - protein, 14 aa, Mycobacterium tuberculosis
SQHVAMAAQGVEEL

SEQ ID NO: 76702 - protein, 14 aa, Mycobacterium tuberculosis
QHVAMAAQGVEELG

SEQ ID NO: 76703 - protein, 14 aa, Mycobacterium tuberculosis
HVAMAAQGVEELGR

SEQ ID NO: 76704 - protein, 14 aa, Mycobacterium tuberculosis
VAMAAQGVEELGRS

SEQ ID NO: 76705 - protein, 14 aa, Mycobacterium tuberculosis
AMAAQGVEELGRSG

SEQ ID NO: 76706 - protein, 14 aa, Mycobacterium tuberculosis
MAAQGVEELGRSGV

SEQ ID NO: 76707 - protein, 14 aa, Mycobacterium tuberculosis
AAQGVEELGRSGVG

SEQ ID NO: 76708 - protein, 14 aa, Mycobacterium tuberculosis
AQGVEELGRSGVGV

SEQ ID NO: 76709 - protein, 14 aa, Mycobacterium tuberculosis
QGVEELGRSGVGVA

SEQ ID NO: 76710 - protein, 14 aa, Mycobacterium tuberculosis
GVEELGRSGVGVAE

SEQ ID NO: 76711 - protein, 14 aa, Mycobacterium tuberculosis
VEELGRSGVGVAES

SEQ ID NO: 76712 - protein, 14 aa, Mycobacterium tuberculosis
EELGRSGVGVAESG

SEQ ID NO: 76713 - protein, 14 aa, Mycobacterium tuberculosis
ELGRSGVGVAESGA

SEQ ID NO: 76714 - protein, 14 aa, Mycobacterium tuberculosis
LGRSGVGVAESGAS

SEQ ID NO: 76715 - protein, 14 aa, Mycobacterium tuberculosis
GRSGVGVAESGASY

SEQ ID NO: 76716 - protein, 14 aa, Mycobacterium tuberculosis
RSGVGVAESGASYA

SEQ ID NO: 76717 - protein, 14 aa, Mycobacterium tuberculosis
SGVGVAESGASYAA

SEQ ID NO: 76718 - protein, 14 aa, Mycobacterium tuberculosis
GVGVAESGASYAAR

SEQ ID NO: 76719 - protein, 14 aa, Mycobacterium tuberculosis
VGVAESGASYAARD

SEQ ID NO: 76720 - protein, 14 aa, Mycobacterium tuberculosis
GVAESGASYAARDA

SEQ ID NO: 76721 - protein, 14 aa, Mycobacterium tuberculosis
VAESGASYAARDAL

SEQ ID NO: 76722 - protein, 14 aa, Mycobacterium tuberculosis
AESGASYAARDALA

SEQ ID NO: 76723 - protein, 14 aa, Mycobacterium tuberculosis
ESGASYAARDALAA

SEQ ID NO: 76724 - protein, 14 aa, Mycobacterium tuberculosis
SGASYAARDALAAA

SEQ ID NO: 76725 - protein, 14 aa, Mycobacterium tuberculosis
GASYAARDALAAAS

SEQ ID NO: 76726 - protein, 14 aa, Mycobacterium tuberculosis
ASYAARDALAAASY

SEQ ID NO: 76727 - protein, 14 aa, Mycobacterium tuberculosis
SYAARDALAAASYL

SEQ ID NO: 76728 - protein, 14 aa, Mycobacterium tuberculosis
YAARDALAAASYLS

SEQ ID NO: 76729 - protein, 14 aa, Mycobacterium tuberculosis
AARDALAAASYLSG

SEQ ID NO: 76730 - protein, 14 aa, Mycobacterium tuberculosis
ARDALAAASYLSGG

SEQ ID NO: 76731 - protein, 14 aa, Mycobacterium tuberculosis
RDALAAASYLSGGL

SEQ ID NO: 76732 - protein, 15 aa, Mycobacterium tuberculosis
MTLRVVPESLAGASA

SEQ ID NO: 76733 - protein, 15 aa, Mycobacterium tuberculosis
TLRVVPESLAGASAA

SEQ ID NO: 76734 - protein, 15 aa, Mycobacterium tuberculosis
LRVVPESLAGASAAI

SEQ ID NO: 76735 - protein, 15 aa, Mycobacterium tuberculosis
RVVPESLAGASAAIE

SEQ ID NO: 76736 - protein, 15 aa, Mycobacterium tuberculosis
VVPESLAGASAAIEA

SEQ ID NO: 76737 - protein, 15 aa, Mycobacterium tuberculosis
VPESLAGASAAIEAV

SEQ ID NO: 76738 - protein, 15 aa, Mycobacterium tuberculosis
PESLAGASAAIEAVT

SEQ ID NO: 76739 - protein, 15 aa, Mycobacterium tuberculosis
ESLAGASAAIEAVTA

SEQ ID NO: 76740 - protein, 15 aa, Mycobacterium tuberculosis
SLAGASAAIEAVTAR

SEQ ID NO: 76741 - protein, 15 aa, Mycobacterium tuberculosis
LAGASAAIEAVTARL

SEQ ID NO: 76742 - protein, 15 aa, Mycobacterium tuberculosis
AGASAAIEAVTARLA

SEQ ID NO: 76743 - protein, 15 aa, Mycobacterium tuberculosis
GASAAIEAVTARLAA

SEQ ID NO: 76744 - protein, 15 aa, Mycobacterium tuberculosis
ASAAIEAVTARLAAA

SEQ ID NO: 76745 - protein, 15 aa, Mycobacterium tuberculosis
SAAIEAVTARLAAAH

SEQ ID NO: 76746 - protein, 15 aa, Mycobacterium tuberculosis
AAIEAVTARLAAAHA

SEQ ID NO: 76747 - protein, 15 aa, Mycobacterium tuberculosis
AIEAVTARLAAAHAA

SEQ ID NO: 76748 - protein, 15 aa, Mycobacterium tuberculosis
IEAVTARLAAAHAAA

SEQ ID NO: 76749 - protein, 15 aa, Mycobacterium tuberculosis
EAVTARLAAAHAAAA

SEQ ID NO: 76750 - protein, 15 aa, Mycobacterium tuberculosis
AVTARLAAAHAAAAP

SEQ ID NO: 76751 - protein, 15 aa, Mycobacterium tuberculosis
VTARLAAAHAAAAPF

SEQ ID NO: 76752 - protein, 15 aa, Mycobacterium tuberculosis
TARLAAAHAAAAPFI

SEQ ID NO: 76753 - protein, 15 aa, Mycobacterium tuberculosis
ARLAAAHAAAAPFIA

SEQ ID NO: 76754 - protein, 15 aa, Mycobacterium tuberculosis
RLAAAHAAAAPFIAA

SEQ ID NO: 76755 - protein, 15 aa, Mycobacterium tuberculosis
LAAAHAAAAPFIAAV

SEQ ID NO: 76756 - protein, 15 aa, Mycobacterium tuberculosis
AAAHAAAAPFIAAVI

SEQ ID NO: 76757 - protein, 15 aa, Mycobacterium tuberculosis
AAHAAAAPFIAAVIP

SEQ ID NO: 76758 - protein, 15 aa, Mycobacterium tuberculosis
AHAAAAPFIAAVIPP

SEQ ID NO: 76759 - protein, 15 aa, Mycobacterium tuberculosis
HAAAAPFIAAVIPPG

SEQ ID NO: 76760 - protein, 15 aa, Mycobacterium tuberculosis
AAAAPFIAAVIPPGS

SEQ ID NO: 76761 - protein, 15 aa, Mycobacterium tuberculosis
AAAPFIAAVIPPGSD

SEQ ID NO: 76762 - protein, 15 aa, Mycobacterium tuberculosis
AAPFIAAVIPPGSDS

SEQ ID NO: 76763 - protein, 15 aa, Mycobacterium tuberculosis
APFIAAVIPPGSDSV

SEQ ID NO: 76764 - protein, 15 aa, Mycobacterium tuberculosis
PFIAAVIPPGSDSVS

SEQ ID NO: 76765 - protein, 15 aa, Mycobacterium tuberculosis
FIAAVIPPGSDSVSV

SEQ ID NO: 76766 - protein, 15 aa, Mycobacterium tuberculosis
IAAVIPPGSDSVSVC

SEQ ID NO: 76767 - protein, 15 aa, Mycobacterium tuberculosis
AAVIPPGSDSVSVCN

SEQ ID NO: 76768 - protein, 15 aa, Mycobacterium tuberculosis
AVIPPGSDSVSVCNA

SEQ ID NO: 76769 - protein, 15 aa, Mycobacterium tuberculosis
VIPPGSDSVSVCNAV

SEQ ID NO: 76770 - protein, 15 aa, Mycobacterium tuberculosis
IPPGSDSVSVCNAVE

SEQ ID NO: 76771 - protein, 15 aa, Mycobacterium tuberculosis
PPGSDSVSVCNAVEF

SEQ ID NO: 76772 - protein, 15 aa, Mycobacterium tuberculosis
PGSDSVSVCNAVEFS

SEQ ID NO: 76773 - protein, 15 aa, Mycobacterium tuberculosis
GSDSVSVCNAVEFSV

SEQ ID NO: 76774 - protein, 15 aa, Mycobacterium tuberculosis
SDSVSVCNAVEFSVH

SEQ ID NO: 76775 - protein, 15 aa, Mycobacterium tuberculosis
DSVSVCNAVEFSVHG

SEQ ID NO: 76776 - protein, 15 aa, Mycobacterium tuberculosis
SVSVCNAVEFSVHGS

SEQ ID NO: 76777 - protein, 15 aa, Mycobacterium tuberculosis
VSVCNAVEFSVHGSQ

SEQ ID NO: 76778 - protein, 15 aa, Mycobacterium tuberculosis
SVCNAVEFSVHGSQH

SEQ ID NO: 76779 - protein, 15 aa, Mycobacterium tuberculosis
VCNAVEFSVHGSQHV

SEQ ID NO: 76780 - protein, 15 aa, Mycobacterium tuberculosis
CNAVEFSVHGSQHVA

SEQ ID NO: 76781 - protein, 15 aa, Mycobacterium tuberculosis
NAVEFSVHGSQHVAM

SEQ ID NO: 76782 - protein, 15 aa, Mycobacterium tuberculosis
AVEFSVHGSQHVAMA

SEQ ID NO: 76783 - protein, 15 aa, Mycobacterium tuberculosis
VEFSVHGSQHVAMAA

SEQ ID NO: 76784 - protein, 15 aa, Mycobacterium tuberculosis
EFSVHGSQHVAMAAQ

SEQ ID NO: 76785 - protein, 15 aa, Mycobacterium tuberculosis
FSVHGSQHVAMAAQG

SEQ ID NO: 76786 - protein, 15 aa, Mycobacterium tuberculosis
SVHGSQHVAMAAQGV

SEQ ID NO: 76787 - protein, 15 aa, Mycobacterium tuberculosis
VHGSQHVAMAAQGVE

SEQ ID NO: 76788 - protein, 15 aa, Mycobacterium tuberculosis
HGSQHVAMAAQGVEE

SEQ ID NO: 76789 - protein, 15 aa, Mycobacterium tuberculosis
GSQHVAMAAQGVEEL

SEQ ID NO: 76790 - protein, 15 aa, Mycobacterium tuberculosis
SQHVAMAAQGVEELG

SEQ ID NO: 76791 - protein, 15 aa, Mycobacterium tuberculosis
QHVAMAAQGVEELGR

SEQ ID NO: 76792 - protein, 15 aa, Mycobacterium tuberculosis
HVAMAAQGVEELGRS

SEQ ID NO: 76793 - protein, 15 aa, Mycobacterium tuberculosis
VAMAAQGVEELGRSG

SEQ ID NO: 76794 - protein, 15 aa, Mycobacterium tuberculosis
AMAAQGVEELGRSGV

SEQ ID NO: 76795 - protein, 15 aa, Mycobacterium tuberculosis
MAAQGVEELGRSGVG

SEQ ID NO: 76796 - protein, 15 aa, Mycobacterium tuberculosis
AAQGVEELGRSGVGV

SEQ ID NO: 76797 - protein, 15 aa, Mycobacterium tuberculosis
AQGVEELGRSGVGVA

SEQ ID NO: 76798 - protein, 15 aa, Mycobacterium tuberculosis
QGVEELGRSGVGVAE

SEQ ID NO: 76799 - protein, 15 aa, Mycobacterium tuberculosis
GVEELGRSGVGVAES

SEQ ID NO: 76800 - protein, 15 aa, Mycobacterium tuberculosis
VEELGRSGVGVAESG

SEQ ID NO: 76801 - protein, 15 aa, Mycobacterium tuberculosis
EELGRSGVGVAESGA

SEQ ID NO: 76802 - protein, 15 aa, Mycobacterium tuberculosis
ELGRSGVGVAESGAS

SEQ ID NO: 76803 - protein, 15 aa, Mycobacterium tuberculosis
LGRSGVGVAESGASY

SEQ ID NO: 76804 - protein, 15 aa, Mycobacterium tuberculosis
GRSGVGVAESGASYA

SEQ ID NO: 76805 - protein, 15 aa, Mycobacterium tuberculosis
RSGVGVAESGASYAA

SEQ ID NO: 76806 - protein, 15 aa, Mycobacterium tuberculosis
SGVGVAESGASYAAR

SEQ ID NO: 76807 - protein, 15 aa, Mycobacterium tuberculosis
GVGVAESGASYAARD

SEQ ID NO: 76808 - protein, 15 aa, Mycobacterium tuberculosis
VGVAESGASYAARDA

SEQ ID NO: 76809 - protein, 15 aa, Mycobacterium tuberculosis
GVAESGASYAARDAL

SEQ ID NO: 76810 - protein, 15 aa, Mycobacterium tuberculosis
VAESGASYAARDALA

SEQ ID NO: 76811 - protein, 15 aa, Mycobacterium tuberculosis
AESGASYAARDALAA

SEQ ID NO: 76812 - protein, 15 aa, Mycobacterium tuberculosis
ESGASYAARDALAAA

SEQ ID NO: 76813 - protein, 15 aa, Mycobacterium tuberculosis
SGASYAARDALAAAS

SEQ ID NO: 76814 - protein, 15 aa, Mycobacterium tuberculosis
GASYAARDALAAASY

SEQ ID NO: 76815 - protein, 15 aa, Mycobacterium tuberculosis
ASYAARDALAAASYL

SEQ ID NO: 76816 - protein, 15 aa, Mycobacterium tuberculosis
SYAARDALAAASYLS

SEQ ID NO: 76817 - protein, 15 aa, Mycobacterium tuberculosis
YAARDALAAASYLSG

SEQ ID NO: 76818 - protein, 15 aa, Mycobacterium tuberculosis
AARDALAAASYLSGG

SEQ ID NO: 76819 - protein, 15 aa, Mycobacterium tuberculosis
ARDALAAASYLSGGL

SEQ ID NO: 76820 - protein, 16 aa, Mycobacterium tuberculosis
MTLRVVPESLAGASAA

SEQ ID NO: 76821 - protein, 16 aa, Mycobacterium tuberculosis
TLRVVPESLAGASAAI

SEQ ID NO: 76822 - protein, 16 aa, Mycobacterium tuberculosis
LRVVPESLAGASAAIE

SEQ ID NO: 76823 - protein, 16 aa, Mycobacterium tuberculosis
RVVPESLAGASAAIEA

SEQ ID NO: 76824 - protein, 16 aa, Mycobacterium tuberculosis
VVPESLAGASAAIEAV

SEQ ID NO: 76825 - protein, 16 aa, Mycobacterium tuberculosis
VPESLAGASAAIEAVT

SEQ ID NO: 76826 - protein, 16 aa, Mycobacterium tuberculosis
PESLAGASAAIEAVTA

SEQ ID NO: 76827 - protein, 16 aa, Mycobacterium tuberculosis
ESLAGASAAIEAVTAR

SEQ ID NO: 76828 - protein, 16 aa, Mycobacterium tuberculosis
SLAGASAAIEAVTARL

SEQ ID NO: 76829 - protein, 16 aa, Mycobacterium tuberculosis
LAGASAAIEAVTARLA

SEQ ID NO: 76830 - protein, 16 aa, Mycobacterium tuberculosis
AGASAAIEAVTARLAA

SEQ ID NO: 76831 - protein, 16 aa, Mycobacterium tuberculosis
GASAAIEAVTARLAAA

SEQ ID NO: 76832 - protein, 16 aa, Mycobacterium tuberculosis
ASAAIEAVTARLAAAH

SEQ ID NO: 76833 - protein, 16 aa, Mycobacterium tuberculosis
SAAIEAVTARLAAAHA

SEQ ID NO: 76834 - protein, 16 aa, Mycobacterium tuberculosis
AAIEAVTARLAAAHAA

SEQ ID NO: 76835 - protein, 16 aa, Mycobacterium tuberculosis
AIEAVTARLAAAHAAA

SEQ ID NO: 76836 - protein, 16 aa, Mycobacterium tuberculosis
IEAVTARLAAAHAAAA

SEQ ID NO: 76837 - protein, 16 aa, Mycobacterium tuberculosis
EAVTARLAAAHAAAAP

SEQ ID NO: 76838 - protein, 16 aa, Mycobacterium tuberculosis
AVTARLAAAHAAAAPF

SEQ ID NO: 76839 - protein, 16 aa, Mycobacterium tuberculosis
VTARLAAAHAAAAPFI

SEQ ID NO: 76840 - protein, 16 aa, Mycobacterium tuberculosis
TARLAAAHAAAAPFIA

SEQ ID NO: 76841 - protein, 16 aa, Mycobacterium tuberculosis
ARLAAAHAAAAPFIAA

SEQ ID NO: 76842 - protein, 16 aa, Mycobacterium tuberculosis
RLAAAHAAAAPFIAAV

SEQ ID NO: 76843 - protein, 16 aa, Mycobacterium tuberculosis
LAAAHAAAAPFIAAVI

SEQ ID NO: 76844 - protein, 16 aa, Mycobacterium tuberculosis
AAAHAAAAPFIAAVIP

SEQ ID NO: 76845 - protein, 16 aa, Mycobacterium tuberculosis
AAHAAAAPFIAAVIPP

SEQ ID NO: 76846 - protein, 16 aa, Mycobacterium tuberculosis
AHAAAAPFIAAVIPPG

SEQ ID NO: 76847 - protein, 16 aa, Mycobacterium tuberculosis
HAAAAPFIAAVIPPGS

SEQ ID NO: 76848 - protein, 16 aa, Mycobacterium tuberculosis
AAAAPFIAAVIPPGSD

SEQ ID NO: 76849 - protein, 16 aa, Mycobacterium tuberculosis
AAAPFIAAVIPPGSDS

SEQ ID NO: 76850 - protein, 16 aa, Mycobacterium tuberculosis
AAPFIAAVIPPGSDSV

SEQ ID NO: 76851 - protein, 16 aa, Mycobacterium tuberculosis
APFIAAVIPPGSDSVS

SEQ ID NO: 76852 - protein, 16 aa, Mycobacterium tuberculosis
PFIAAVIPPGSDSVSV

SEQ ID NO: 76853 - protein, 16 aa, Mycobacterium tuberculosis
FIAAVIPPGSDSVSVC

SEQ ID NO: 76854 - protein, 16 aa, Mycobacterium tuberculosis
IAAVIPPGSDSVSVCN

SEQ ID NO: 76855 - protein, 16 aa, Mycobacterium tuberculosis
AAVIPPGSDSVSVCNA

SEQ ID NO: 76856 - protein, 16 aa, Mycobacterium tuberculosis
AVIPPGSDSVSVCNAV

SEQ ID NO: 76857 - protein, 16 aa, Mycobacterium tuberculosis
VIPPGSDSVSVCNAVE

SEQ ID NO: 76858 - protein, 16 aa, Mycobacterium tuberculosis
IPPGSDSVSVCNAVEF

SEQ ID NO: 76859 - protein, 16 aa, Mycobacterium tuberculosis
PPGSDSVSVCNAVEFS

SEQ ID NO: 76860 - protein, 16 aa, Mycobacterium tuberculosis
PGSDSVSVCNAVEFSV

SEQ ID NO: 76861 - protein, 16 aa, Mycobacterium tuberculosis
GSDSVSVCNAVEFSVH

SEQ ID NO: 76862 - protein, 16 aa, Mycobacterium tuberculosis
SDSVSVCNAVEFSVHG

SEQ ID NO: 76863 - protein, 16 aa, Mycobacterium tuberculosis
DSVSVCNAVEFSVHGS

SEQ ID NO: 76864 - protein, 16 aa, Mycobacterium tuberculosis
SVSVCNAVEFSVHGSQ

SEQ ID NO: 76865 - protein, 16 aa, Mycobacterium tuberculosis
VSVCNAVEFSVHGSQH

SEQ ID NO: 76866 - protein, 16 aa, Mycobacterium tuberculosis
SVCNAVEFSVHGSQHV

SEQ ID NO: 76867 - protein, 16 aa, Mycobacterium tuberculosis
VCNAVEFSVHGSQHVA

SEQ ID NO: 76868 - protein, 16 aa, Mycobacterium tuberculosis
CNAVEFSVHGSQHVAM

SEQ ID NO: 76869 - protein, 16 aa, Mycobacterium tuberculosis
NAVEFSVHGSQHVAMA

SEQ ID NO: 76870 - protein, 16 aa, Mycobacterium tuberculosis
AVEFSVHGSQHVAMAA

SEQ ID NO: 76871 - protein, 16 aa, Mycobacterium tuberculosis
VEFSVHGSQHVAMAAQ

SEQ ID NO: 76872 - protein, 16 aa, Mycobacterium tuberculosis
EFSVHGSQHVAMAAQG

SEQ ID NO: 76873 - protein, 16 aa, Mycobacterium tuberculosis
FSVHGSQHVAMAAQGV

SEQ ID NO: 76874 - protein, 16 aa, Mycobacterium tuberculosis
SVHGSQHVAMAAQGVE

SEQ ID NO: 76875 - protein, 16 aa, Mycobacterium tuberculosis
VHGSQHVAMAAQGVEE

SEQ ID NO: 76876 - protein, 16 aa, Mycobacterium tuberculosis
HGSQHVAMAAQGVEEL

SEQ ID NO: 76877 - protein, 16 aa, Mycobacterium tuberculosis
GSQHVAMAAQGVEELG

SEQ ID NO: 76878 - protein, 16 aa, Mycobacterium tuberculosis
SQHVAMAAQGVEELGR

SEQ ID NO: 76879 - protein, 16 aa, Mycobacterium tuberculosis
QHVAMAAQGVEELGRS

SEQ ID NO: 76880 - protein, 16 aa, Mycobacterium tuberculosis
HVAMAAQGVEELGRSG

SEQ ID NO: 76881 - protein, 16 aa, Mycobacterium tuberculosis
VAMAAQGVEELGRSGV

SEQ ID NO: 76882 - protein, 16 aa, Mycobacterium tuberculosis
AMAAQGVEELGRSGVG

SEQ ID NO: 76883 - protein, 16 aa, Mycobacterium tuberculosis
MAAQGVEELGRSGVGV

SEQ ID NO: 76884 - protein, 16 aa, Mycobacterium tuberculosis
AAQGVEELGRSGVGVA

SEQ ID NO: 76885 - protein, 16 aa, Mycobacterium tuberculosis
AQGVEELGRSGVGVAE

SEQ ID NO: 76886 - protein, 16 aa, Mycobacterium tuberculosis
QGVEELGRSGVGVAES

SEQ ID NO: 76887 - protein, 16 aa, Mycobacterium tuberculosis
GVEELGRSGVGVAESG

SEQ ID NO: 76888 - protein, 16 aa, Mycobacterium tuberculosis
VEELGRSGVGVAESGA

SEQ ID NO: 76889 - protein, 16 aa, Mycobacterium tuberculosis
EELGRSGVGVAESGAS

SEQ ID NO: 76890 - protein, 16 aa, Mycobacterium tuberculosis
ELGRSGVGVAESGASY

SEQ ID NO: 76891 - protein, 16 aa, Mycobacterium tuberculosis
LGRSGVGVAESGASYA

SEQ ID NO: 76892 - protein, 16 aa, Mycobacterium tuberculosis
GRSGVGVAESGASYAA

SEQ ID NO: 76893 - protein, 16 aa, Mycobacterium tuberculosis
RSGVGVAESGASYAAR

SEQ ID NO: 76894 - protein, 16 aa, Mycobacterium tuberculosis
SGVGVAESGASYAARD

SEQ ID NO: 76895 - protein, 16 aa, Mycobacterium tuberculosis
GVGVAESGASYAARDA

SEQ ID NO: 76896 - protein, 16 aa, Mycobacterium tuberculosis
VGVAESGASYAARDAL

SEQ ID NO: 76897 - protein, 16 aa, Mycobacterium tuberculosis
GVAESGASYAARDALA

SEQ ID NO: 76898 - protein, 16 aa, Mycobacterium tuberculosis
VAESGASYAARDALAA

SEQ ID NO: 76899 - protein, 16 aa, Mycobacterium tuberculosis
AESGASYAARDALAAA

SEQ ID NO: 76900 - protein, 16 aa, Mycobacterium tuberculosis
ESGASYAARDALAAAS

SEQ ID NO: 76901 - protein, 16 aa, Mycobacterium tuberculosis
SGASYAARDALAAASY

SEQ ID NO: 76902 - protein, 16 aa, Mycobacterium tuberculosis
GASYAARDALAAASYL

SEQ ID NO: 76903 - protein, 16 aa, Mycobacterium tuberculosis
ASYAARDALAAASYLS

SEQ ID NO: 76904 - protein, 16 aa, Mycobacterium tuberculosis
SYAARDALAAASYLSG

SEQ ID NO: 76905 - protein, 16 aa, Mycobacterium tuberculosis
YAARDALAAASYLSGG

SEQ ID NO: 76906 - protein, 16 aa, Mycobacterium tuberculosis
AARDALAAASYLSGGL

SEQ ID NO: 76907 - protein, 13 aa, Mycobacterium tuberculosis
MPHRCAAQVVAGY

SEQ ID NO: 76908 - protein, 13 aa, Mycobacterium tuberculosis
PHRCAAQVVAGYR

SEQ ID NO: 76909 - protein, 13 aa, Mycobacterium tuberculosis
HRCAAQVVAGYRS

SEQ ID NO: 76910 - protein, 13 aa, Mycobacterium tuberculosis
RCAAQVVAGYRST

SEQ ID NO: 76911 - protein, 13 aa, Mycobacterium tuberculosis
CAAQVVAGYRSTV

SEQ ID NO: 76912 - protein, 13 aa, Mycobacterium tuberculosis
AAQVVAGYRSTVS

SEQ ID NO: 76913 - protein, 13 aa, Mycobacterium tuberculosis
AQVVAGYRSTVSL

SEQ ID NO: 76914 - protein, 13 aa, Mycobacterium tuberculosis
QVVAGYRSTVSLV

SEQ ID NO: 76915 - protein, 13 aa, Mycobacterium tuberculosis
VVAGYRSTVSLVL

SEQ ID NO: 76916 - protein, 13 aa, Mycobacterium tuberculosis
VAGYRSTVSLVLV

SEQ ID NO: 76917 - protein, 13 aa, Mycobacterium tuberculosis
AGYRSTVSLVLVE

SEQ ID NO: 76918 - protein, 13 aa, Mycobacterium tuberculosis
GYRSTVSLVLVEH

SEQ ID NO: 76919 - protein, 13 aa, Mycobacterium tuberculosis
YRSTVSLVLVEHP

SEQ ID NO: 76920 - protein, 13 aa, Mycobacterium tuberculosis
RSTVSLVLVEHPR

SEQ ID NO: 76921 - protein, 13 aa, Mycobacterium tuberculosis
STVSLVLVEHPRP

SEQ ID NO: 76922 - protein, 13 aa, Mycobacterium tuberculosis
TVSLVLVEHPRPE

SEQ ID NO: 76923 - protein, 13 aa, Mycobacterium tuberculosis
VSLVLVEHPRPEI

SEQ ID NO: 76924 - protein, 13 aa, Mycobacterium tuberculosis
SLVLVEHPRPEIA

SEQ ID NO: 76925 - protein, 13 aa, Mycobacterium tuberculosis
LVLVEHPRPEIAQ

SEQ ID NO: 76926 - protein, 13 aa, Mycobacterium tuberculosis
VLVEHPRPEIAQI

SEQ ID NO: 76927 - protein, 13 aa, Mycobacterium tuberculosis
LVEHPRPEIAQIT

SEQ ID NO: 76928 - protein, 13 aa, Mycobacterium tuberculosis
VEHPRPEIAQITL

SEQ ID NO: 76929 - protein, 13 aa, Mycobacterium tuberculosis
EHPRPEIAQITLN

SEQ ID NO: 76930 - protein, 13 aa, Mycobacterium tuberculosis
HPRPEIAQITLNR

SEQ ID NO: 76931 - protein, 13 aa, Mycobacterium tuberculosis
PRPEIAQITLNRP

SEQ ID NO: 76932 - protein, 13 aa, Mycobacterium tuberculosis
RPEIAQITLNRPE

SEQ ID NO: 76933 - protein, 13 aa, Mycobacterium tuberculosis
PEIAQITLNRPER

SEQ ID NO: 76934 - protein, 13 aa, Mycobacterium tuberculosis
EIAQITLNRPERM

SEQ ID NO: 76935 - protein, 13 aa, Mycobacterium tuberculosis
IAQITLNRPERMN

SEQ ID NO: 76936 - protein, 13 aa, Mycobacterium tuberculosis
AQITLNRPERMNS

SEQ ID NO: 76937 - protein, 13 aa, Mycobacterium tuberculosis
QITLNRPERMNSM

SEQ ID NO: 76938 - protein, 13 aa, Mycobacterium tuberculosis
ITLNRPERMNSMA

SEQ ID NO: 76939 - protein, 13 aa, Mycobacterium tuberculosis
TLNRPERMNSMAF

SEQ ID NO: 76940 - protein, 13 aa, Mycobacterium tuberculosis
LNRPERMNSMAFD

SEQ ID NO: 76941 - protein, 13 aa, Mycobacterium tuberculosis
NRPERMNSMAFDV

SEQ ID NO: 76942 - protein, 13 aa, Mycobacterium tuberculosis
RPERMNSMAFDVM

SEQ ID NO: 76943 - protein, 13 aa, Mycobacterium tuberculosis
PERMNSMAFDVMV

SEQ ID NO: 76944 - protein, 13 aa, Mycobacterium tuberculosis
ERMNSMAFDVMVP

SEQ ID NO: 76945 - protein, 13 aa, Mycobacterium tuberculosis
RMNSMAFDVMVPL

SEQ ID NO: 76946 - protein, 13 aa, Mycobacterium tuberculosis
MNSMAFDVMVPLK

SEQ ID NO: 76947 - protein, 13 aa, Mycobacterium tuberculosis
NSMAFDVMVPLKE

SEQ ID NO: 76948 - protein, 13 aa, Mycobacterium tuberculosis
SMAFDVMVPLKEA

SEQ ID NO: 76949 - protein, 13 aa, Mycobacterium tuberculosis
MAFDVMVPLKEAL

SEQ ID NO: 76950 - protein, 13 aa, Mycobacterium tuberculosis
AFDVMVPLKEALA

SEQ ID NO: 76951 - protein, 13 aa, Mycobacterium tuberculosis
FDVMVPLKEALAQ

SEQ ID NO: 76952 - protein, 13 aa, Mycobacterium tuberculosis
DVMVPLKEALAQV

SEQ ID NO: 76953 - protein, 13 aa, Mycobacterium tuberculosis
VMVPLKEALAQVS

SEQ ID NO: 76954 - protein, 13 aa, Mycobacterium tuberculosis
MVPLKEALAQVSY

SEQ ID NO: 76955 - protein, 13 aa, Mycobacterium tuberculosis
VPLKEALAQVSYD

SEQ ID NO: 76956 - protein, 13 aa, Mycobacterium tuberculosis
PLKEALAQVSYDN

SEQ ID NO: 76957 - protein, 13 aa, Mycobacterium tuberculosis
LKEALAQVSYDNS

SEQ ID NO: 76958 - protein, 13 aa, Mycobacterium tuberculosis
KEALAQVSYDNSV

SEQ ID NO: 76959 - protein, 13 aa, Mycobacterium tuberculosis
EALAQVSYDNSVR

SEQ ID NO: 76960 - protein, 13 aa, Mycobacterium tuberculosis
ALAQVSYDNSVRV

SEQ ID NO: 76961 - protein, 13 aa, Mycobacterium tuberculosis
LAQVSYDNSVRVV

SEQ ID NO: 76962 - protein, 13 aa, Mycobacterium tuberculosis
AQVSYDNSVRVVV

SEQ ID NO: 76963 - protein, 13 aa, Mycobacterium tuberculosis
QVSYDNSVRVVVL

SEQ ID NO: 76964 - protein, 13 aa, Mycobacterium tuberculosis
VSYDNSVRVVVLT

SEQ ID NO: 76965 - protein, 13 aa, Mycobacterium tuberculosis
SYDNSVRVVVLTG

SEQ ID NO: 76966 - protein, 13 aa, Mycobacterium tuberculosis
YDNSVRVVVLTGA

SEQ ID NO: 76967 - protein, 13 aa, Mycobacterium tuberculosis
DNSVRVVVLTGAG

SEQ ID NO: 76968 - protein, 13 aa, Mycobacterium tuberculosis
NSVRVVVLTGAGR

SEQ ID NO: 76969 - protein, 13 aa, Mycobacterium tuberculosis
SVRVVVLTGAGRG

SEQ ID NO: 76970 - protein, 13 aa, Mycobacterium tuberculosis
VRVVVLTGAGRGF

SEQ ID NO: 76971 - protein, 13 aa, Mycobacterium tuberculosis
RVVVLTGAGRGFS

SEQ ID NO: 76972 - protein, 13 aa, Mycobacterium tuberculosis
VVVLTGAGRGFSP

SEQ ID NO: 76973 - protein, 13 aa, Mycobacterium tuberculosis
VVLTGAGRGFSPG

SEQ ID NO: 76974 - protein, 13 aa, Mycobacterium tuberculosis
VLTGAGRGFSPGA

SEQ ID NO: 76975 - protein, 13 aa, Mycobacterium tuberculosis
LTGAGRGFSPGAD

SEQ ID NO: 76976 - protein, 13 aa, Mycobacterium tuberculosis
TGAGRGFSPGADH

SEQ ID NO: 76977 - protein, 13 aa, Mycobacterium tuberculosis
GAGRGFSPGADHK

SEQ ID NO: 76978 - protein, 13 aa, Mycobacterium tuberculosis
AGRGFSPGADHKS

SEQ ID NO: 76979 - protein, 13 aa, Mycobacterium tuberculosis
GRGFSPGADHKSA

SEQ ID NO: 76980 - protein, 13 aa, Mycobacterium tuberculosis
RGFSPGADHKSAG

SEQ ID NO: 76981 - protein, 13 aa, Mycobacterium tuberculosis
GFSPGADHKSAGV

SEQ ID NO: 76982 - protein, 13 aa, Mycobacterium tuberculosis
FSPGADHKSAGVV

SEQ ID NO: 76983 - protein, 13 aa, Mycobacterium tuberculosis
SPGADHKSAGVVP

SEQ ID NO: 76984 - protein, 13 aa, Mycobacterium tuberculosis
PGADHKSAGVVPH

SEQ ID NO: 76985 - protein, 13 aa, Mycobacterium tuberculosis
GADHKSAGVVPHV

SEQ ID NO: 76986 - protein, 13 aa, Mycobacterium tuberculosis
ADHKSAGVVPHVE

SEQ ID NO: 76987 - protein, 13 aa, Mycobacterium tuberculosis
DHKSAGVVPHVEN

SEQ ID NO: 76988 - protein, 13 aa, Mycobacterium tuberculosis
HKSAGVVPHVENL

SEQ ID NO: 76989 - protein, 13 aa, Mycobacterium tuberculosis
KSAGVVPHVENLT

SEQ ID NO: 76990 - protein, 13 aa, Mycobacterium tuberculosis
SAGVVPHVENLTR

SEQ ID NO: 76991 - protein, 13 aa, Mycobacterium tuberculosis
AGVVPHVENLTRP

SEQ ID NO: 76992 - protein, 13 aa, Mycobacterium tuberculosis
GVVPHVENLTRPT

SEQ ID NO: 76993 - protein, 13 aa, Mycobacterium tuberculosis
VVPHVENLTRPTY

SEQ ID NO: 76994 - protein, 13 aa, Mycobacterium tuberculosis
VPHVENLTRPTYA

SEQ ID NO: 76995 - protein, 13 aa, Mycobacterium tuberculosis
PHVENLTRPTYAL

SEQ ID NO: 76996 - protein, 13 aa, Mycobacterium tuberculosis
HVENLTRPTYALR

SEQ ID NO: 76997 - protein, 13 aa, Mycobacterium tuberculosis
VENLTRPTYALRS

SEQ ID NO: 76998 - protein, 13 aa, Mycobacterium tuberculosis
ENLTRPTYALRSM

SEQ ID NO: 76999 - protein, 13 aa, Mycobacterium tuberculosis
NLTRPTYALRSME

SEQ ID NO: 77000 - protein, 13 aa, Mycobacterium tuberculosis
LTRPTYALRSMEL

SEQ ID NO: 77001 - protein, 13 aa, Mycobacterium tuberculosis
TRPTYALRSMELL

SEQ ID NO: 77002 - protein, 13 aa, Mycobacterium tuberculosis
RPTYALRSMELLD

SEQ ID NO: 77003 - protein, 13 aa, Mycobacterium tuberculosis
PTYALRSMELLDD

SEQ ID NO: 77004 - protein, 13 aa, Mycobacterium tuberculosis
TYALRSMELLDDV

SEQ ID NO: 77005 - protein, 13 aa, Mycobacterium tuberculosis
YALRSMELLDDVI

SEQ ID NO: 77006 - protein, 13 aa, Mycobacterium tuberculosis
ALRSMELLDDVIL

SEQ ID NO: 77007 - protein, 13 aa, Mycobacterium tuberculosis
LRSMELLDDVILM

SEQ ID NO: 77008 - protein, 13 aa, Mycobacterium tuberculosis
RSMELLDDVILML

SEQ ID NO: 77009 - protein, 13 aa, Mycobacterium tuberculosis
SMELLDDVILMLR

SEQ ID NO: 77010 - protein, 13 aa, Mycobacterium tuberculosis
MELLDDVILMLRR

SEQ ID NO: 77011 - protein, 13 aa, Mycobacterium tuberculosis
ELLDDVILMLRRL

SEQ ID NO: 77012 - protein, 13 aa, Mycobacterium tuberculosis
LLDDVILMLRRLH

SEQ ID NO: 77013 - protein, 13 aa, Mycobacterium tuberculosis
LDDVILMLRRLHQ

SEQ ID NO: 77014 - protein, 13 aa, Mycobacterium tuberculosis
DDVILMLRRLHQP

SEQ ID NO: 77015 - protein, 13 aa, Mycobacterium tuberculosis
DVILMLRRLHQPV

SEQ ID NO: 77016 - protein, 13 aa, Mycobacterium tuberculosis
VILMLRRLHQPVI

SEQ ID NO: 77017 - protein, 13 aa, Mycobacterium tuberculosis
ILMLRRLHQPVIA

SEQ ID NO: 77018 - protein, 13 aa, Mycobacterium tuberculosis
LMLRRLHQPVIAA

SEQ ID NO: 77019 - protein, 13 aa, Mycobacterium tuberculosis
MLRRLHQPVIAAV

SEQ ID NO: 77020 - protein, 13 aa, Mycobacterium tuberculosis
LRRLHQPVIAAVN

SEQ ID NO: 77021 - protein, 13 aa, Mycobacterium tuberculosis
RRLHQPVIAAVNG

SEQ ID NO: 77022 - protein, 13 aa, Mycobacterium tuberculosis
RLHQPVIAAVNGP

SEQ ID NO: 77023 - protein, 13 aa, Mycobacterium tuberculosis
LHQPVIAAVNGPA

SEQ ID NO: 77024 - protein, 13 aa, Mycobacterium tuberculosis
HQPVIAAVNGPAI

SEQ ID NO: 77025 - protein, 13 aa, Mycobacterium tuberculosis
QPVIAAVNGPAIG

SEQ ID NO: 77026 - protein, 13 aa, Mycobacterium tuberculosis
PVIAAVNGPAIGG

SEQ ID NO: 77027 - protein, 13 aa, Mycobacterium tuberculosis
VIAAVNGPAIGGG

SEQ ID NO: 77028 - protein, 13 aa, Mycobacterium tuberculosis
IAAVNGPAIGGGL

SEQ ID NO: 77029 - protein, 13 aa, Mycobacterium tuberculosis
AAVNGPAIGGGLC

SEQ ID NO: 77030 - protein, 13 aa, Mycobacterium tuberculosis
AVNGPAIGGGLCL

SEQ ID NO: 77031 - protein, 13 aa, Mycobacterium tuberculosis
VNGPAIGGGLCLA

SEQ ID NO: 77032 - protein, 13 aa, Mycobacterium tuberculosis
NGPAIGGGLCLAL

SEQ ID NO: 77033 - protein, 13 aa, Mycobacterium tuberculosis
GPAIGGGLCLALA

SEQ ID NO: 77034 - protein, 13 aa, Mycobacterium tuberculosis
PAIGGGLCLALAA

SEQ ID NO: 77035 - protein, 13 aa, Mycobacterium tuberculosis
AIGGGLCLALAAD

SEQ ID NO: 77036 - protein, 13 aa, Mycobacterium tuberculosis
IGGGLCLALAADI

SEQ ID NO: 77037 - protein, 13 aa, Mycobacterium tuberculosis
GGGLCLALAADIR

SEQ ID NO: 77038 - protein, 13 aa, Mycobacterium tuberculosis
GGLCLALAADIRV

SEQ ID NO: 77039 - protein, 13 aa, Mycobacterium tuberculosis
GLCLALAADIRVA

SEQ ID NO: 77040 - protein, 13 aa, Mycobacterium tuberculosis
LCLALAADIRVAS

SEQ ID NO: 77041 - protein, 13 aa, Mycobacterium tuberculosis
CLALAADIRVASS

SEQ ID NO: 77042 - protein, 13 aa, Mycobacterium tuberculosis
LALAADIRVASSS

SEQ ID NO: 77043 - protein, 13 aa, Mycobacterium tuberculosis
ALAADIRVASSSA

SEQ ID NO: 77044 - protein, 13 aa, Mycobacterium tuberculosis
LAADIRVASSSAY

SEQ ID NO: 77045 - protein, 13 aa, Mycobacterium tuberculosis
AADIRVASSSAYF

SEQ ID NO: 77046 - protein, 13 aa, Mycobacterium tuberculosis
ADIRVASSSAYFR

SEQ ID NO: 77047 - protein, 13 aa, Mycobacterium tuberculosis
DIRVASSSAYFRA

SEQ ID NO: 77048 - protein, 13 aa, Mycobacterium tuberculosis
IRVASSSAYFRAA

SEQ ID NO: 77049 - protein, 13 aa, Mycobacterium tuberculosis
RVASSSAYFRAAG

SEQ ID NO: 77050 - protein, 13 aa, Mycobacterium tuberculosis
VASSSAYFRAAGI

SEQ ID NO: 77051 - protein, 13 aa, Mycobacterium tuberculosis
ASSSAYFRAAGIN

SEQ ID NO: 77052 - protein, 13 aa, Mycobacterium tuberculosis
SSSAYFRAAGINN

SEQ ID NO: 77053 - protein, 13 aa, Mycobacterium tuberculosis
SSAYFRAAGINNG

SEQ ID NO: 77054 - protein, 13 aa, Mycobacterium tuberculosis
SAYFRAAGINNGL

SEQ ID NO: 77055 - protein, 13 aa, Mycobacterium tuberculosis
AYFRAAGINNGLT

SEQ ID NO: 77056 - protein, 13 aa, Mycobacterium tuberculosis
YFRAAGINNGLTA

SEQ ID NO: 77057 - protein, 13 aa, Mycobacterium tuberculosis
FRAAGINNGLTAS

SEQ ID NO: 77058 - protein, 13 aa, Mycobacterium tuberculosis
RAAGINNGLTASE

SEQ ID NO: 77059 - protein, 13 aa, Mycobacterium tuberculosis
AAGINNGLTASEL

SEQ ID NO: 77060 - protein, 13 aa, Mycobacterium tuberculosis
AGINNGLTASELG

SEQ ID NO: 77061 - protein, 13 aa, Mycobacterium tuberculosis
GINNGLTASELGL

SEQ ID NO: 77062 - protein, 13 aa, Mycobacterium tuberculosis
INNGLTASELGLS

SEQ ID NO: 77063 - protein, 13 aa, Mycobacterium tuberculosis
NNGLTASELGLSY

SEQ ID NO: 77064 - protein, 13 aa, Mycobacterium tuberculosis
NGLTASELGLSYL

SEQ ID NO: 77065 - protein, 13 aa, Mycobacterium tuberculosis
GLTASELGLSYLL

SEQ ID NO: 77066 - protein, 13 aa, Mycobacterium tuberculosis
LTASELGLSYLLP

SEQ ID NO: 77067 - protein, 13 aa, Mycobacterium tuberculosis
TASELGLSYLLPR

SEQ ID NO: 77068 - protein, 13 aa, Mycobacterium tuberculosis
ASELGLSYLLPRA

SEQ ID NO: 77069 - protein, 13 aa, Mycobacterium tuberculosis
SELGLSYLLPRAI

SEQ ID NO: 77070 - protein, 13 aa, Mycobacterium tuberculosis
ELGLSYLLPRAIG

SEQ ID NO: 77071 - protein, 13 aa, Mycobacterium tuberculosis
LGLSYLLPRAIGS

SEQ ID NO: 77072 - protein, 13 aa, Mycobacterium tuberculosis
GLSYLLPRAIGSS

SEQ ID NO: 77073 - protein, 13 aa, Mycobacterium tuberculosis
LSYLLPRAIGSSR

SEQ ID NO: 77074 - protein, 13 aa, Mycobacterium tuberculosis
SYLLPRAIGSSRA

SEQ ID NO: 77075 - protein, 13 aa, Mycobacterium tuberculosis
YLLPRAIGSSRAF

SEQ ID NO: 77076 - protein, 13 aa, Mycobacterium tuberculosis
LLPRAIGSSRAFE

SEQ ID NO: 77077 - protein, 13 aa, Mycobacterium tuberculosis
LPRAIGSSRAFEI

SEQ ID NO: 77078 - protein, 13 aa, Mycobacterium tuberculosis
PRAIGSSRAFEIM

SEQ ID NO: 77079 - protein, 13 aa, Mycobacterium tuberculosis
RAIGSSRAFEIML

SEQ ID NO: 77080 - protein, 13 aa, Mycobacterium tuberculosis
AIGSSRAFEIMLT

SEQ ID NO: 77081 - protein, 13 aa, Mycobacterium tuberculosis
IGSSRAFEIMLTG

SEQ ID NO: 77082 - protein, 13 aa, Mycobacterium tuberculosis
GSSRAFEIMLTGR

SEQ ID NO: 77083 - protein, 13 aa, Mycobacterium tuberculosis
SSRAFEIMLTGRD

SEQ ID NO: 77084 - protein, 13 aa, Mycobacterium tuberculosis
SRAFEIMLTGRDV

SEQ ID NO: 77085 - protein, 13 aa, Mycobacterium tuberculosis
RAFEIMLTGRDVS

SEQ ID NO: 77086 - protein, 13 aa, Mycobacterium tuberculosis
AFEIMLTGRDVSA

SEQ ID NO: 77087 - protein, 13 aa, Mycobacterium tuberculosis
FEIMLTGRDVSAE

SEQ ID NO: 77088 - protein, 13 aa, Mycobacterium tuberculosis
EIMLTGRDVSAEE

SEQ ID NO: 77089 - protein, 13 aa, Mycobacterium tuberculosis
IMLTGRDVSAEEA

SEQ ID NO: 77090 - protein, 13 aa, Mycobacterium tuberculosis
MLTGRDVSAEEAE

SEQ ID NO: 77091 - protein, 13 aa, Mycobacterium tuberculosis
LTGRDVSAEEAER

SEQ ID NO: 77092 - protein, 13 aa, Mycobacterium tuberculosis
TGRDVSAEEAERI

SEQ ID NO: 77093 - protein, 13 aa, Mycobacterium tuberculosis
GRDVSAEEAERIG

SEQ ID NO: 77094 - protein, 13 aa, Mycobacterium tuberculosis
RDVSAEEAERIGL

SEQ ID NO: 77095 - protein, 13 aa, Mycobacterium tuberculosis
DVSAEEAERIGLV

SEQ ID NO: 77096 - protein, 13 aa, Mycobacterium tuberculosis
VSAEEAERIGLVS

SEQ ID NO: 77097 - protein, 13 aa, Mycobacterium tuberculosis
SAEEAERIGLVSR

SEQ ID NO: 77098 - protein, 13 aa, Mycobacterium tuberculosis
AEEAERIGLVSRQ

SEQ ID NO: 77099 - protein, 13 aa, Mycobacterium tuberculosis
EEAERIGLVSRQV

SEQ ID NO: 77100 - protein, 13 aa, Mycobacterium tuberculosis
EAERIGLVSRQVP

SEQ ID NO: 77101 - protein, 13 aa, Mycobacterium tuberculosis
AERIGLVSRQVPD

SEQ ID NO: 77102 - protein, 13 aa, Mycobacterium tuberculosis
ERIGLVSRQVPDE

SEQ ID NO: 77103 - protein, 13 aa, Mycobacterium tuberculosis
RIGLVSRQVPDEQ

SEQ ID NO: 77104 - protein, 13 aa, Mycobacterium tuberculosis
IGLVSRQVPDEQL

SEQ ID NO: 77105 - protein, 13 aa, Mycobacterium tuberculosis
GLVSRQVPDEQLL

SEQ ID NO: 77106 - protein, 13 aa, Mycobacterium tuberculosis
LVSRQVPDEQLLD

SEQ ID NO: 77107 - protein, 13 aa, Mycobacterium tuberculosis
VSRQVPDEQLLDA

SEQ ID NO: 77108 - protein, 13 aa, Mycobacterium tuberculosis
SRQVPDEQLLDAC

SEQ ID NO: 77109 - protein, 13 aa, Mycobacterium tuberculosis
RQVPDEQLLDACY

SEQ ID NO: 77110 - protein, 13 aa, Mycobacterium tuberculosis
QVPDEQLLDACYA

SEQ ID NO: 77111 - protein, 13 aa, Mycobacterium tuberculosis
VPDEQLLDACYAI

SEQ ID NO: 77112 - protein, 13 aa, Mycobacterium tuberculosis
PDEQLLDACYAIA

SEQ ID NO: 77113 - protein, 13 aa, Mycobacterium tuberculosis
DEQLLDACYAIAA

SEQ ID NO: 77114 - protein, 13 aa, Mycobacterium tuberculosis
EQLLDACYAIAAR

SEQ ID NO: 77115 - protein, 13 aa, Mycobacterium tuberculosis
QLLDACYAIAARM

SEQ ID NO: 77116 - protein, 13 aa, Mycobacterium tuberculosis
LLDACYAIAARMA

SEQ ID NO: 77117 - protein, 13 aa, Mycobacterium tuberculosis
LDACYAIAARMAG

SEQ ID NO: 77118 - protein, 13 aa, Mycobacterium tuberculosis
DACYAIAARMAGF

SEQ ID NO: 77119 - protein, 13 aa, Mycobacterium tuberculosis
ACYAIAARMAGFS

SEQ ID NO: 77120 - protein, 13 aa, Mycobacterium tuberculosis
CYAIAARMAGFSR

SEQ ID NO: 77121 - protein, 13 aa, Mycobacterium tuberculosis
YAIAARMAGFSRP

SEQ ID NO: 77122 - protein, 13 aa, Mycobacterium tuberculosis
AIAARMAGFSRPG

SEQ ID NO: 77123 - protein, 13 aa, Mycobacterium tuberculosis
IAARMAGFSRPGI

SEQ ID NO: 77124 - protein, 13 aa, Mycobacterium tuberculosis
AARMAGFSRPGIE

SEQ ID NO: 77125 - protein, 13 aa, Mycobacterium tuberculosis
ARMAGFSRPGIEL

SEQ ID NO: 77126 - protein, 13 aa, Mycobacterium tuberculosis
RMAGFSRPGIELT

SEQ ID NO: 77127 - protein, 13 aa, Mycobacterium tuberculosis
MAGFSRPGIELTK

SEQ ID NO: 77128 - protein, 13 aa, Mycobacterium tuberculosis
AGFSRPGIELTKR

SEQ ID NO: 77129 - protein, 13 aa, Mycobacterium tuberculosis
GFSRPGIELTKRT

SEQ ID NO: 77130 - protein, 13 aa, Mycobacterium tuberculosis
FSRPGIELTKRTL

SEQ ID NO: 77131 - protein, 13 aa, Mycobacterium tuberculosis
SRPGIELTKRTLW

SEQ ID NO: 77132 - protein, 13 aa, Mycobacterium tuberculosis
RPGIELTKRTLWS

SEQ ID NO: 77133 - protein, 13 aa, Mycobacterium tuberculosis
PGIELTKRTLWSG

SEQ ID NO: 77134 - protein, 13 aa, Mycobacterium tuberculosis
GIELTKRTLWSGL

SEQ ID NO: 77135 - protein, 13 aa, Mycobacterium tuberculosis
IELTKRTLWSGLD

SEQ ID NO: 77136 - protein, 13 aa, Mycobacterium tuberculosis
ELTKRTLWSGLDA

SEQ ID NO: 77137 - protein, 13 aa, Mycobacterium tuberculosis
LTKRTLWSGLDAA

SEQ ID NO: 77138 - protein, 13 aa, Mycobacterium tuberculosis
TKRTLWSGLDAAS

SEQ ID NO: 77139 - protein, 13 aa, Mycobacterium tuberculosis
KRTLWSGLDAASL

SEQ ID NO: 77140 - protein, 13 aa, Mycobacterium tuberculosis
RTLWSGLDAASLE

SEQ ID NO: 77141 - protein, 13 aa, Mycobacterium tuberculosis
TLWSGLDAASLEA

SEQ ID NO: 77142 - protein, 13 aa, Mycobacterium tuberculosis
LWSGLDAASLEAH

SEQ ID NO: 77143 - protein, 13 aa, Mycobacterium tuberculosis
WSGLDAASLEAHM

SEQ ID NO: 77144 - protein, 13 aa, Mycobacterium tuberculosis
SGLDAASLEAHMQ

SEQ ID NO: 77145 - protein, 13 aa, Mycobacterium tuberculosis
GLDAASLEAHMQA

SEQ ID NO: 77146 - protein, 13 aa, Mycobacterium tuberculosis
LDAASLEAHMQAE

SEQ ID NO: 77147 - protein, 13 aa, Mycobacterium tuberculosis
DAASLEAHMQAEG

SEQ ID NO: 77148 - protein, 13 aa, Mycobacterium tuberculosis
AASLEAHMQAEGL

SEQ ID NO: 77149 - protein, 13 aa, Mycobacterium tuberculosis
ASLEAHMQAEGLG

SEQ ID NO: 77150 - protein, 13 aa, Mycobacterium tuberculosis
SLEAHMQAEGLGQ

SEQ ID NO: 77151 - protein, 13 aa, Mycobacterium tuberculosis
LEAHMQAEGLGQL

SEQ ID NO: 77152 - protein, 13 aa, Mycobacterium tuberculosis
EAHMQAEGLGQLF

SEQ ID NO: 77153 - protein, 13 aa, Mycobacterium tuberculosis
AHMQAEGLGQLFV

SEQ ID NO: 77154 - protein, 13 aa, Mycobacterium tuberculosis
HMQAEGLGQLFVR

SEQ ID NO: 77155 - protein, 13 aa, Mycobacterium tuberculosis
MQAEGLGQLFVRL

SEQ ID NO: 77156 - protein, 13 aa, Mycobacterium tuberculosis
QAEGLGQLFVRLL

SEQ ID NO: 77157 - protein, 13 aa, Mycobacterium tuberculosis
AEGLGQLFVRLLT

SEQ ID NO: 77158 - protein, 13 aa, Mycobacterium tuberculosis
EGLGQLFVRLLTA

SEQ ID NO: 77159 - protein, 13 aa, Mycobacterium tuberculosis
GLGQLFVRLLTAN

SEQ ID NO: 77160 - protein, 13 aa, Mycobacterium tuberculosis
LGQLFVRLLTANF

SEQ ID NO: 77161 - protein, 13 aa, Mycobacterium tuberculosis
GQLFVRLLTANFE

SEQ ID NO: 77162 - protein, 13 aa, Mycobacterium tuberculosis
QLFVRLLTANFEE

SEQ ID NO: 77163 - protein, 13 aa, Mycobacterium tuberculosis
LFVRLLTANFEEA

SEQ ID NO: 77164 - protein, 13 aa, Mycobacterium tuberculosis
FVRLLTANFEEAV

SEQ ID NO: 77165 - protein, 13 aa, Mycobacterium tuberculosis
VRLLTANFEEAVA

SEQ ID NO: 77166 - protein, 13 aa, Mycobacterium tuberculosis
RLLTANFEEAVAA

SEQ ID NO: 77167 - protein, 13 aa, Mycobacterium tuberculosis
LLTANFEEAVAAR

SEQ ID NO: 77168 - protein, 13 aa, Mycobacterium tuberculosis
LTANFEEAVAARA

SEQ ID NO: 77169 - protein, 13 aa, Mycobacterium tuberculosis
TANFEEAVAARAE

SEQ ID NO: 77170 - protein, 13 aa, Mycobacterium tuberculosis
ANFEEAVAARAEQ

SEQ ID NO: 77171 - protein, 13 aa, Mycobacterium tuberculosis
NFEEAVAARAEQR

SEQ ID NO: 77172 - protein, 13 aa, Mycobacterium tuberculosis
FEEAVAARAEQRA

SEQ ID NO: 77173 - protein, 13 aa, Mycobacterium tuberculosis
EEAVAARAEQRAP

SEQ ID NO: 77174 - protein, 13 aa, Mycobacterium tuberculosis
EAVAARAEQRAPV

SEQ ID NO: 77175 - protein, 13 aa, Mycobacterium tuberculosis
AVAARAEQRAPVF

SEQ ID NO: 77176 - protein, 13 aa, Mycobacterium tuberculosis
VAARAEQRAPVFT

SEQ ID NO: 77177 - protein, 13 aa, Mycobacterium tuberculosis
AARAEQRAPVFTD

SEQ ID NO: 77178 - protein, 13 aa, Mycobacterium tuberculosis
ARAEQRAPVFTDD

SEQ ID NO: 77179 - protein, 13 aa, Mycobacterium tuberculosis
RAEQRAPVFTDDT

SEQ ID NO: 77180 - protein, 14 aa, Mycobacterium tuberculosis
MPHRCAAQVVAGYR

SEQ ID NO: 77181 - protein, 14 aa, Mycobacterium tuberculosis
PHRCAAQVVAGYRS

SEQ ID NO: 77182 - protein, 14 aa, Mycobacterium tuberculosis
HRCAAQVVAGYRST

SEQ ID NO: 77183 - protein, 14 aa, Mycobacterium tuberculosis
RCAAQVVAGYRSTV

SEQ ID NO: 77184 - protein, 14 aa, Mycobacterium tuberculosis
CAAQVVAGYRSTVS

SEQ ID NO: 77185 - protein, 14 aa, Mycobacterium tuberculosis
AAQVVAGYRSTVSL

SEQ ID NO: 77186 - protein, 14 aa, Mycobacterium tuberculosis
AQVVAGYRSTVSLV

SEQ ID NO: 77187 - protein, 14 aa, Mycobacterium tuberculosis
QVVAGYRSTVSLVL

SEQ ID NO: 77188 - protein, 14 aa, Mycobacterium tuberculosis
VVAGYRSTVSLVLV

SEQ ID NO: 77189 - protein, 14 aa, Mycobacterium tuberculosis
VAGYRSTVSLVLVE

SEQ ID NO: 77190 - protein, 14 aa, Mycobacterium tuberculosis
AGYRSTVSLVLVEH

SEQ ID NO: 77191 - protein, 14 aa, Mycobacterium tuberculosis
GYRSTVSLVLVEHP

SEQ ID NO: 77192 - protein, 14 aa, Mycobacterium tuberculosis
YRSTVSLVLVEHPR

SEQ ID NO: 77193 - protein, 14 aa, Mycobacterium tuberculosis
RSTVSLVLVEHPRP

SEQ ID NO: 77194 - protein, 14 aa, Mycobacterium tuberculosis
STVSLVLVEHPRPE

SEQ ID NO: 77195 - protein, 14 aa, Mycobacterium tuberculosis
TVSLVLVEHPRPEI

SEQ ID NO: 77196 - protein, 14 aa, Mycobacterium tuberculosis
VSLVLVEHPRPEIA

SEQ ID NO: 77197 - protein, 14 aa, Mycobacterium tuberculosis
SLVLVEHPRPEIAQ

SEQ ID NO: 77198 - protein, 14 aa, Mycobacterium tuberculosis
LVLVEHPRPEIAQI

SEQ ID NO: 77199 - protein, 14 aa, Mycobacterium tuberculosis
VLVEHPRPEIAQIT

SEQ ID NO: 77200 - protein, 14 aa, Mycobacterium tuberculosis
LVEHPRPEIAQITL

SEQ ID NO: 77201 - protein, 14 aa, Mycobacterium tuberculosis
VEHPRPEIAQITLN

SEQ ID NO: 77202 - protein, 14 aa, Mycobacterium tuberculosis
EHPRPEIAQITLNR

SEQ ID NO: 77203 - protein, 14 aa, Mycobacterium tuberculosis
HPRPEIAQITLNRP

SEQ ID NO: 77204 - protein, 14 aa, Mycobacterium tuberculosis
PRPEIAQITLNRPE

SEQ ID NO: 77205 - protein, 14 aa, Mycobacterium tuberculosis
RPEIAQITLNRPER

SEQ ID NO: 77206 - protein, 14 aa, Mycobacterium tuberculosis
PEIAQITLNRPERM

SEQ ID NO: 77207 - protein, 14 aa, Mycobacterium tuberculosis
EIAQITLNRPERMN

SEQ ID NO: 77208 - protein, 14 aa, Mycobacterium tuberculosis
IAQITLNRPERMNS

SEQ ID NO: 77209 - protein, 14 aa, Mycobacterium tuberculosis
AQITLNRPERMNSM

SEQ ID NO: 77210 - protein, 14 aa, Mycobacterium tuberculosis
QITLNRPERMNSMA

SEQ ID NO: 77211 - protein, 14 aa, Mycobacterium tuberculosis
ITLNRPERMNSMAF

SEQ ID NO: 77212 - protein, 14 aa, Mycobacterium tuberculosis
TLNRPERMNSMAFD

SEQ ID NO: 77213 - protein, 14 aa, Mycobacterium tuberculosis
LNRPERMNSMAFDV

SEQ ID NO: 77214 - protein, 14 aa, Mycobacterium tuberculosis
NRPERMNSMAFDVM

SEQ ID NO: 77215 - protein, 14 aa, Mycobacterium tuberculosis
RPERMNSMAFDVMV

SEQ ID NO: 77216 - protein, 14 aa, Mycobacterium tuberculosis
PERMNSMAFDVMVP

SEQ ID NO: 77217 - protein, 14 aa, Mycobacterium tuberculosis
ERMNSMAFDVMVPL

SEQ ID NO: 77218 - protein, 14 aa, Mycobacterium tuberculosis
RMNSMAFDVMVPLK

SEQ ID NO: 77219 - protein, 14 aa, Mycobacterium tuberculosis
MNSMAFDVMVPLKE

SEQ ID NO: 77220 - protein, 14 aa, Mycobacterium tuberculosis
NSMAFDVMVPLKEA

SEQ ID NO: 77221 - protein, 14 aa, Mycobacterium tuberculosis
SMAFDVMVPLKEAL

SEQ ID NO: 77222 - protein, 14 aa, Mycobacterium tuberculosis
MAFDVMVPLKEALA

SEQ ID NO: 77223 - protein, 14 aa, Mycobacterium tuberculosis
AFDVMVPLKEALAQ

SEQ ID NO: 77224 - protein, 14 aa, Mycobacterium tuberculosis
FDVMVPLKEALAQV

SEQ ID NO: 77225 - protein, 14 aa, Mycobacterium tuberculosis
DVMVPLKEALAQVS

SEQ ID NO: 77226 - protein, 14 aa, Mycobacterium tuberculosis
VMVPLKEALAQVSY

SEQ ID NO: 77227 - protein, 14 aa, Mycobacterium tuberculosis
MVPLKEALAQVSYD

SEQ ID NO: 77228 - protein, 14 aa, Mycobacterium tuberculosis
VPLKEALAQVSYDN

SEQ ID NO: 77229 - protein, 14 aa, Mycobacterium tuberculosis
PLKEALAQVSYDNS

SEQ ID NO: 77230 - protein, 14 aa, Mycobacterium tuberculosis
LKEALAQVSYDNSV

SEQ ID NO: 77231 - protein, 14 aa, Mycobacterium tuberculosis
KEALAQVSYDNSVR

SEQ ID NO: 77232 - protein, 14 aa, Mycobacterium tuberculosis
EALAQVSYDNSVRV

SEQ ID NO: 77233 - protein, 14 aa, Mycobacterium tuberculosis
ALAQVSYDNSVRVV

SEQ ID NO: 77234 - protein, 14 aa, Mycobacterium tuberculosis
LAQVSYDNSVRVVV

SEQ ID NO: 77235 - protein, 14 aa, Mycobacterium tuberculosis
AQVSYDNSVRVVVL

SEQ ID NO: 77236 - protein, 14 aa, Mycobacterium tuberculosis
QVSYDNSVRVVVLT

SEQ ID NO: 77237 - protein, 14 aa, Mycobacterium tuberculosis
VSYDNSVRVVVLTG

SEQ ID NO: 77238 - protein, 14 aa, Mycobacterium tuberculosis
SYDNSVRVVVLTGA

SEQ ID NO: 77239 - protein, 14 aa, Mycobacterium tuberculosis
YDNSVRVVVLTGAG

SEQ ID NO: 77240 - protein, 14 aa, Mycobacterium tuberculosis
DNSVRVVVLTGAGR

SEQ ID NO: 77241 - protein, 14 aa, Mycobacterium tuberculosis
NSVRVVVLTGAGRG

SEQ ID NO: 77242 - protein, 14 aa, Mycobacterium tuberculosis
SVRVVVLTGAGRGF

SEQ ID NO: 77243 - protein, 14 aa, Mycobacterium tuberculosis
VRVVVLTGAGRGFS

SEQ ID NO: 77244 - protein, 14 aa, Mycobacterium tuberculosis
RVVVLTGAGRGFSP

SEQ ID NO: 77245 - protein, 14 aa, Mycobacterium tuberculosis
VVVLTGAGRGFSPG

SEQ ID NO: 77246 - protein, 14 aa, Mycobacterium tuberculosis
VVLTGAGRGFSPGA

SEQ ID NO: 77247 - protein, 14 aa, Mycobacterium tuberculosis
VLTGAGRGFSPGAD

SEQ ID NO: 77248 - protein, 14 aa, Mycobacterium tuberculosis
LTGAGRGFSPGADH

SEQ ID NO: 77249 - protein, 14 aa, Mycobacterium tuberculosis
TGAGRGFSPGADHK

SEQ ID NO: 77250 - protein, 14 aa, Mycobacterium tuberculosis
GAGRGFSPGADHKS

SEQ ID NO: 77251 - protein, 14 aa, Mycobacterium tuberculosis
AGRGFSPGADHKSA

SEQ ID NO: 77252 - protein, 14 aa, Mycobacterium tuberculosis
GRGFSPGADHKSAG

SEQ ID NO: 77253 - protein, 14 aa, Mycobacterium tuberculosis
RGFSPGADHKSAGV

SEQ ID NO: 77254 - protein, 14 aa, Mycobacterium tuberculosis
GFSPGADHKSAGVV

SEQ ID NO: 77255 - protein, 14 aa, Mycobacterium tuberculosis
FSPGADHKSAGVVP

SEQ ID NO: 77256 - protein, 14 aa, Mycobacterium tuberculosis
SPGADHKSAGVVPH

SEQ ID NO: 77257 - protein, 14 aa, Mycobacterium tuberculosis
PGADHKSAGVVPHV

SEQ ID NO: 77258 - protein, 14 aa, Mycobacterium tuberculosis
GADHKSAGVVPHVE

SEQ ID NO: 77259 - protein, 14 aa, Mycobacterium tuberculosis
ADHKSAGVVPHVEN

SEQ ID NO: 77260 - protein, 14 aa, Mycobacterium tuberculosis
DHKSAGVVPHVENL

SEQ ID NO: 77261 - protein, 14 aa, Mycobacterium tuberculosis
HKSAGVVPHVENLT

SEQ ID NO: 77262 - protein, 14 aa, Mycobacterium tuberculosis
KSAGVVPHVENLTR

SEQ ID NO: 77263 - protein, 14 aa, Mycobacterium tuberculosis
SAGVVPHVENLTRP

SEQ ID NO: 77264 - protein, 14 aa, Mycobacterium tuberculosis
AGVVPHVENLTRPT

SEQ ID NO: 77265 - protein, 14 aa, Mycobacterium tuberculosis
GVVPHVENLTRPTY

SEQ ID NO: 77266 - protein, 14 aa, Mycobacterium tuberculosis
VVPHVENLTRPTYA

SEQ ID NO: 77267 - protein, 14 aa, Mycobacterium tuberculosis
VPHVENLTRPTYAL

SEQ ID NO: 77268 - protein, 14 aa, Mycobacterium tuberculosis
PHVENLTRPTYALR

SEQ ID NO: 77269 - protein, 14 aa, Mycobacterium tuberculosis
HVENLTRPTYALRS

SEQ ID NO: 77270 - protein, 14 aa, Mycobacterium tuberculosis
VENLTRPTYALRSM

SEQ ID NO: 77271 - protein, 14 aa, Mycobacterium tuberculosis
ENLTRPTYALRSME

SEQ ID NO: 77272 - protein, 14 aa, Mycobacterium tuberculosis
NLTRPTYALRSMEL

SEQ ID NO: 77273 - protein, 14 aa, Mycobacterium tuberculosis
LTRPTYALRSMELL

SEQ ID NO: 77274 - protein, 14 aa, Mycobacterium tuberculosis
TRPTYALRSMELLD

SEQ ID NO: 77275 - protein, 14 aa, Mycobacterium tuberculosis
RPTYALRSMELLDD

SEQ ID NO: 77276 - protein, 14 aa, Mycobacterium tuberculosis
PTYALRSMELLDDV

SEQ ID NO: 77277 - protein, 14 aa, Mycobacterium tuberculosis
TYALRSMELLDDVI

SEQ ID NO: 77278 - protein, 14 aa, Mycobacterium tuberculosis
YALRSMELLDDVIL

SEQ ID NO: 77279 - protein, 14 aa, Mycobacterium tuberculosis
ALRSMELLDDVILM

SEQ ID NO: 77280 - protein, 14 aa, Mycobacterium tuberculosis
LRSMELLDDVILML

SEQ ID NO: 77281 - protein, 14 aa, Mycobacterium tuberculosis
RSMELLDDVILMLR

SEQ ID NO: 77282 - protein, 14 aa, Mycobacterium tuberculosis
SMELLDDVILMLRR

SEQ ID NO: 77283 - protein, 14 aa, Mycobacterium tuberculosis
MELLDDVILMLRRL

SEQ ID NO: 77284 - protein, 14 aa, Mycobacterium tuberculosis
ELLDDVILMLRRLH

SEQ ID NO: 77285 - protein, 14 aa, Mycobacterium tuberculosis
LLDDVILMLRRLHQ

SEQ ID NO: 77286 - protein, 14 aa, Mycobacterium tuberculosis
LDDVILMLRRLHQP

SEQ ID NO: 77287 - protein, 14 aa, Mycobacterium tuberculosis
DDVILMLRRLHQPV

SEQ ID NO: 77288 - protein, 14 aa, Mycobacterium tuberculosis
DVILMLRRLHQPVI

SEQ ID NO: 77289 - protein, 14 aa, Mycobacterium tuberculosis
VILMLRRLHQPVIA

SEQ ID NO: 77290 - protein, 14 aa, Mycobacterium tuberculosis
ILMLRRLHQPVIAA

SEQ ID NO: 77291 - protein, 14 aa, Mycobacterium tuberculosis
LMLRRLHQPVIAAV

SEQ ID NO: 77292 - protein, 14 aa, Mycobacterium tuberculosis
MLRRLHQPVIAAVN

SEQ ID NO: 77293 - protein, 14 aa, Mycobacterium tuberculosis
LRRLHQPVIAAVNG

SEQ ID NO: 77294 - protein, 14 aa, Mycobacterium tuberculosis
RRLHQPVIAAVNGP

SEQ ID NO: 77295 - protein, 14 aa, Mycobacterium tuberculosis
RLHQPVIAAVNGPA

SEQ ID NO: 77296 - protein, 14 aa, Mycobacterium tuberculosis
LHQPVIAAVNGPAI

SEQ ID NO: 77297 - protein, 14 aa, Mycobacterium tuberculosis
HQPVIAAVNGPAIG

SEQ ID NO: 77298 - protein, 14 aa, Mycobacterium tuberculosis
QPVIAAVNGPAIGG

SEQ ID NO: 77299 - protein, 14 aa, Mycobacterium tuberculosis
PVIAAVNGPAIGGG

SEQ ID NO: 77300 - protein, 14 aa, Mycobacterium tuberculosis
VIAAVNGPAIGGGL

SEQ ID NO: 77301 - protein, 14 aa, Mycobacterium tuberculosis
IAAVNGPAIGGGLC

SEQ ID NO: 77302 - protein, 14 aa, Mycobacterium tuberculosis
AAVNGPAIGGGLCL

SEQ ID NO: 77303 - protein, 14 aa, Mycobacterium tuberculosis
AVNGPAIGGGLCLA

SEQ ID NO: 77304 - protein, 14 aa, Mycobacterium tuberculosis
VNGPAIGGGLCLAL

SEQ ID NO: 77305 - protein, 14 aa, Mycobacterium tuberculosis
NGPAIGGGLCLALA

SEQ ID NO: 77306 - protein, 14 aa, Mycobacterium tuberculosis
GPAIGGGLCLALAA

SEQ ID NO: 77307 - protein, 14 aa, Mycobacterium tuberculosis
PAIGGGLCLALAAD

SEQ ID NO: 77308 - protein, 14 aa, Mycobacterium tuberculosis
AIGGGLCLALAADI

SEQ ID NO: 77309 - protein, 14 aa, Mycobacterium tuberculosis
IGGGLCLALAADIR

SEQ ID NO: 77310 - protein, 14 aa, Mycobacterium tuberculosis
GGGLCLALAADIRV

SEQ ID NO: 77311 - protein, 14 aa, Mycobacterium tuberculosis
GGLCLALAADIRVA

SEQ ID NO: 77312 - protein, 14 aa, Mycobacterium tuberculosis
GLCLALAADIRVAS

SEQ ID NO: 77313 - protein, 14 aa, Mycobacterium tuberculosis
LCLALAADIRVASS

SEQ ID NO: 77314 - protein, 14 aa, Mycobacterium tuberculosis
CLALAADIRVASSS

SEQ ID NO: 77315 - protein, 14 aa, Mycobacterium tuberculosis
LALAADIRVASSSA

SEQ ID NO: 77316 - protein, 14 aa, Mycobacterium tuberculosis
ALAADIRVASSSAY

SEQ ID NO: 77317 - protein, 14 aa, Mycobacterium tuberculosis
LAADIRVASSSAYF

SEQ ID NO: 77318 - protein, 14 aa, Mycobacterium tuberculosis
AADIRVASSSAYFR

SEQ ID NO: 77319 - protein, 14 aa, Mycobacterium tuberculosis
ADIRVASSSAYFRA

SEQ ID NO: 77320 - protein, 14 aa, Mycobacterium tuberculosis
DIRVASSSAYFRAA

SEQ ID NO: 77321 - protein, 14 aa, Mycobacterium tuberculosis
IRVASSSAYFRAAG

SEQ ID NO: 77322 - protein, 14 aa, Mycobacterium tuberculosis
RVASSSAYFRAAGI

SEQ ID NO: 77323 - protein, 14 aa, Mycobacterium tuberculosis
VASSSAYFRAAGIN

SEQ ID NO: 77324 - protein, 14 aa, Mycobacterium tuberculosis
ASSSAYFRAAGINN

SEQ ID NO: 77325 - protein, 14 aa, Mycobacterium tuberculosis
SSSAYFRAAGINNG

SEQ ID NO: 77326 - protein, 14 aa, Mycobacterium tuberculosis
SSAYFRAAGINNGL

SEQ ID NO: 77327 - protein, 14 aa, Mycobacterium tuberculosis
SAYFRAAGINNGLT

SEQ ID NO: 77328 - protein, 14 aa, Mycobacterium tuberculosis
AYFRAAGINNGLTA

SEQ ID NO: 77329 - protein, 14 aa, Mycobacterium tuberculosis
YFRAAGINNGLTAS

SEQ ID NO: 77330 - protein, 14 aa, Mycobacterium tuberculosis
FRAAGINNGLTASE

SEQ ID NO: 77331 - protein, 14 aa, Mycobacterium tuberculosis
RAAGINNGLTASEL

SEQ ID NO: 77332 - protein, 14 aa, Mycobacterium tuberculosis
AAGINNGLTASELG

SEQ ID NO: 77333 - protein, 14 aa, Mycobacterium tuberculosis
AGINNGLTASELGL

SEQ ID NO: 77334 - protein, 14 aa, Mycobacterium tuberculosis
GINNGLTASELGLS

SEQ ID NO: 77335 - protein, 14 aa, Mycobacterium tuberculosis
INNGLTASELGLSY

SEQ ID NO: 77336 - protein, 14 aa, Mycobacterium tuberculosis
NNGLTASELGLSYL

SEQ ID NO: 77337 - protein, 14 aa, Mycobacterium tuberculosis
NGLTASELGLSYLL

SEQ ID NO: 77338 - protein, 14 aa, Mycobacterium tuberculosis
GLTASELGLSYLLP

SEQ ID NO: 77339 - protein, 14 aa, Mycobacterium tuberculosis
LTASELGLSYLLPR

SEQ ID NO: 77340 - protein, 14 aa, Mycobacterium tuberculosis
TASELGLSYLLPRA

SEQ ID NO: 77341 - protein, 14 aa, Mycobacterium tuberculosis
ASELGLSYLLPRAI

SEQ ID NO: 77342 - protein, 14 aa, Mycobacterium tuberculosis
SELGLSYLLPRAIG

SEQ ID NO: 77343 - protein, 14 aa, Mycobacterium tuberculosis
ELGLSYLLPRAIGS

SEQ ID NO: 77344 - protein, 14 aa, Mycobacterium tuberculosis
LGLSYLLPRAIGSS

SEQ ID NO: 77345 - protein, 14 aa, Mycobacterium tuberculosis
GLSYLLPRAIGSSR

SEQ ID NO: 77346 - protein, 14 aa, Mycobacterium tuberculosis
LSYLLPRAIGSSRA

SEQ ID NO: 77347 - protein, 14 aa, Mycobacterium tuberculosis
SYLLPRAIGSSRAF

SEQ ID NO: 77348 - protein, 14 aa, Mycobacterium tuberculosis
YLLPRAIGSSRAFE

SEQ ID NO: 77349 - protein, 14 aa, Mycobacterium tuberculosis
LLPRAIGSSRAFEI

SEQ ID NO: 77350 - protein, 14 aa, Mycobacterium tuberculosis
LPRAIGSSRAFEIM

SEQ ID NO: 77351 - protein, 14 aa, Mycobacterium tuberculosis
PRAIGSSRAFEIML

SEQ ID NO: 77352 - protein, 14 aa, Mycobacterium tuberculosis
RAIGSSRAFEIMLT

SEQ ID NO: 77353 - protein, 14 aa, Mycobacterium tuberculosis
AIGSSRAFEIMLTG

SEQ ID NO: 77354 - protein, 14 aa, Mycobacterium tuberculosis
IGSSRAFEIMLTGR

SEQ ID NO: 77355 - protein, 14 aa, Mycobacterium tuberculosis
GSSRAFEIMLTGRD

SEQ ID NO: 77356 - protein, 14 aa, Mycobacterium tuberculosis
SSRAFEIMLTGRDV

SEQ ID NO: 77357 - protein, 14 aa, Mycobacterium tuberculosis
SRAFEIMLTGRDVS

SEQ ID NO: 77358 - protein, 14 aa, Mycobacterium tuberculosis
RAFEIMLTGRDVSA

SEQ ID NO: 77359 - protein, 14 aa, Mycobacterium tuberculosis
AFEIMLTGRDVSAE

SEQ ID NO: 77360 - protein, 14 aa, Mycobacterium tuberculosis
FEIMLTGRDVSAEE

SEQ ID NO: 77361 - protein, 14 aa, Mycobacterium tuberculosis
EIMLTGRDVSAEEA

SEQ ID NO: 77362 - protein, 14 aa, Mycobacterium tuberculosis
IMLTGRDVSAEEAE

SEQ ID NO: 77363 - protein, 14 aa, Mycobacterium tuberculosis
MLTGRDVSAEEAER

SEQ ID NO: 77364 - protein, 14 aa, Mycobacterium tuberculosis
LTGRDVSAEEAERI

SEQ ID NO: 77365 - protein, 14 aa, Mycobacterium tuberculosis
TGRDVSAEEAERIG

SEQ ID NO: 77366 - protein, 14 aa, Mycobacterium tuberculosis
GRDVSAEEAERIGL

SEQ ID NO: 77367 - protein, 14 aa, Mycobacterium tuberculosis
RDVSAEEAERIGLV

SEQ ID NO: 77368 - protein, 14 aa, Mycobacterium tuberculosis
DVSAEEAERIGLVS

SEQ ID NO: 77369 - protein, 14 aa, Mycobacterium tuberculosis
VSAEEAERIGLVSR

SEQ ID NO: 77370 - protein, 14 aa, Mycobacterium tuberculosis
SAEEAERIGLVSRQ

SEQ ID NO: 77371 - protein, 14 aa, Mycobacterium tuberculosis
AEEAERIGLVSRQV

SEQ ID NO: 77372 - protein, 14 aa, Mycobacterium tuberculosis
EEAERIGLVSRQVP

SEQ ID NO: 77373 - protein, 14 aa, Mycobacterium tuberculosis
EAERIGLVSRQVPD

SEQ ID NO: 77374 - protein, 14 aa, Mycobacterium tuberculosis
AERIGLVSRQVPDE

SEQ ID NO: 77375 - protein, 14 aa, Mycobacterium tuberculosis
ERIGLVSRQVPDEQ

SEQ ID NO: 77376 - protein, 14 aa, Mycobacterium tuberculosis
RIGLVSRQVPDEQL

SEQ ID NO: 77377 - protein, 14 aa, Mycobacterium tuberculosis
IGLVSRQVPDEQLL

SEQ ID NO: 77378 - protein, 14 aa, Mycobacterium tuberculosis
GLVSRQVPDEQLLD

SEQ ID NO: 77379 - protein, 14 aa, Mycobacterium tuberculosis
LVSRQVPDEQLLDA

SEQ ID NO: 77380 - protein, 14 aa, Mycobacterium tuberculosis
VSRQVPDEQLLDAC

SEQ ID NO: 77381 - protein, 14 aa, Mycobacterium tuberculosis
SRQVPDEQLLDACY

SEQ ID NO: 77382 - protein, 14 aa, Mycobacterium tuberculosis
RQVPDEQLLDACYA

SEQ ID NO: 77383 - protein, 14 aa, Mycobacterium tuberculosis
QVPDEQLLDACYAI

SEQ ID NO: 77384 - protein, 14 aa, Mycobacterium tuberculosis
VPDEQLLDACYAIA

SEQ ID NO: 77385 - protein, 14 aa, Mycobacterium tuberculosis
PDEQLLDACYAIAA

SEQ ID NO: 77386 - protein, 14 aa, Mycobacterium tuberculosis
DEQLLDACYAIAAR

SEQ ID NO: 77387 - protein, 14 aa, Mycobacterium tuberculosis
EQLLDACYAIAARM

SEQ ID NO: 77388 - protein, 14 aa, Mycobacterium tuberculosis
QLLDACYAIAARMA

SEQ ID NO: 77389 - protein, 14 aa, Mycobacterium tuberculosis
LLDACYAIAARMAG

SEQ ID NO: 77390 - protein, 14 aa, Mycobacterium tuberculosis
LDACYAIAARMAGF

SEQ ID NO: 77391 - protein, 14 aa, Mycobacterium tuberculosis
DACYAIAARMAGFS

SEQ ID NO: 77392 - protein, 14 aa, Mycobacterium tuberculosis
ACYAIAARMAGFSR

SEQ ID NO: 77393 - protein, 14 aa, Mycobacterium tuberculosis
CYAIAARMAGFSRP

SEQ ID NO: 77394 - protein, 14 aa, Mycobacterium tuberculosis
YAIAARMAGFSRPG

SEQ ID NO: 77395 - protein, 14 aa, Mycobacterium tuberculosis
AIAARMAGFSRPGI

SEQ ID NO: 77396 - protein, 14 aa, Mycobacterium tuberculosis
IAARMAGFSRPGIE

SEQ ID NO: 77397 - protein, 14 aa, Mycobacterium tuberculosis
AARMAGFSRPGIEL

SEQ ID NO: 77398 - protein, 14 aa, Mycobacterium tuberculosis
ARMAGFSRPGIELT

SEQ ID NO: 77399 - protein, 14 aa, Mycobacterium tuberculosis
RMAGFSRPGIELTK

SEQ ID NO: 77400 - protein, 14 aa, Mycobacterium tuberculosis
MAGFSRPGIELTKR

SEQ ID NO: 77401 - protein, 14 aa, Mycobacterium tuberculosis
AGFSRPGIELTKRT

SEQ ID NO: 77402 - protein, 14 aa, Mycobacterium tuberculosis
GFSRPGIELTKRTL

SEQ ID NO: 77403 - protein, 14 aa, Mycobacterium tuberculosis
FSRPGIELTKRTLW

SEQ ID NO: 77404 - protein, 14 aa, Mycobacterium tuberculosis
SRPGIELTKRTLWS

SEQ ID NO: 77405 - protein, 14 aa, Mycobacterium tuberculosis
RPGIELTKRTLWSG

SEQ ID NO: 77406 - protein, 14 aa, Mycobacterium tuberculosis
PGIELTKRTLWSGL

SEQ ID NO: 77407 - protein, 14 aa, Mycobacterium tuberculosis
GIELTKRTLWSGLD

SEQ ID NO: 77408 - protein, 14 aa, Mycobacterium tuberculosis
IELTKRTLWSGLDA

SEQ ID NO: 77409 - protein, 14 aa, Mycobacterium tuberculosis
ELTKRTLWSGLDAA

SEQ ID NO: 77410 - protein, 14 aa, Mycobacterium tuberculosis
LTKRTLWSGLDAAS

SEQ ID NO: 77411 - protein, 14 aa, Mycobacterium tuberculosis
TKRTLWSGLDAASL

SEQ ID NO: 77412 - protein, 14 aa, Mycobacterium tuberculosis
KRTLWSGLDAASLE

SEQ ID NO: 77413 - protein, 14 aa, Mycobacterium tuberculosis
RTLWSGLDAASLEA

SEQ ID NO: 77414 - protein, 14 aa, Mycobacterium tuberculosis
TLWSGLDAASLEAH

SEQ ID NO: 77415 - protein, 14 aa, Mycobacterium tuberculosis
LWSGLDAASLEAHM

SEQ ID NO: 77416 - protein, 14 aa, Mycobacterium tuberculosis
WSGLDAASLEAHMQ

SEQ ID NO: 77417 - protein, 14 aa, Mycobacterium tuberculosis
SGLDAASLEAHMQA

SEQ ID NO: 77418 - protein, 14 aa, Mycobacterium tuberculosis
GLDAASLEAHMQAE

SEQ ID NO: 77419 - protein, 14 aa, Mycobacterium tuberculosis
LDAASLEAHMQAEG

SEQ ID NO: 77420 - protein, 14 aa, Mycobacterium tuberculosis
DAASLEAHMQAEGL

SEQ ID NO: 77421 - protein, 14 aa, Mycobacterium tuberculosis
AASLEAHMQAEGLG

SEQ ID NO: 77422 - protein, 14 aa, Mycobacterium tuberculosis
ASLEAHMQAEGLGQ

SEQ ID NO: 77423 - protein, 14 aa, Mycobacterium tuberculosis
SLEAHMQAEGLGQL

SEQ ID NO: 77424 - protein, 14 aa, Mycobacterium tuberculosis
LEAHMQAEGLGQLF

SEQ ID NO: 77425 - protein, 14 aa, Mycobacterium tuberculosis
EAHMQAEGLGQLFV

SEQ ID NO: 77426 - protein, 14 aa, Mycobacterium tuberculosis
AHMQAEGLGQLFVR

SEQ ID NO: 77427 - protein, 14 aa, Mycobacterium tuberculosis
HMQAEGLGQLFVRL

SEQ ID NO: 77428 - protein, 14 aa, Mycobacterium tuberculosis
MQAEGLGQLFVRLL

SEQ ID NO: 77429 - protein, 14 aa, Mycobacterium tuberculosis
QAEGLGQLFVRLLT

SEQ ID NO: 77430 - protein, 14 aa, Mycobacterium tuberculosis
AEGLGQLFVRLLTA

SEQ ID NO: 77431 - protein, 14 aa, Mycobacterium tuberculosis
EGLGQLFVRLLTAN

SEQ ID NO: 77432 - protein, 14 aa, Mycobacterium tuberculosis
GLGQLFVRLLTANF

SEQ ID NO: 77433 - protein, 14 aa, Mycobacterium tuberculosis
LGQLFVRLLTANFE

SEQ ID NO: 77434 - protein, 14 aa, Mycobacterium tuberculosis
GQLFVRLLTANFEE

SEQ ID NO: 77435 - protein, 14 aa, Mycobacterium tuberculosis
QLFVRLLTANFEEA

SEQ ID NO: 77436 - protein, 14 aa, Mycobacterium tuberculosis
LFVRLLTANFEEAV

SEQ ID NO: 77437 - protein, 14 aa, Mycobacterium tuberculosis
FVRLLTANFEEAVA

SEQ ID NO: 77438 - protein, 14 aa, Mycobacterium tuberculosis
VRLLTANFEEAVAA

SEQ ID NO: 77439 - protein, 14 aa, Mycobacterium tuberculosis
RLLTANFEEAVAAR

SEQ ID NO: 77440 - protein, 14 aa, Mycobacterium tuberculosis
LLTANFEEAVAARA

SEQ ID NO: 77441 - protein, 14 aa, Mycobacterium tuberculosis
LTANFEEAVAARAE

SEQ ID NO: 77442 - protein, 14 aa, Mycobacterium tuberculosis
TANFEEAVAARAEQ

SEQ ID NO: 77443 - protein, 14 aa, Mycobacterium tuberculosis
ANFEEAVAARAEQR

SEQ ID NO: 77444 - protein, 14 aa, Mycobacterium tuberculosis
NFEEAVAARAEQRA

SEQ ID NO: 77445 - protein, 14 aa, Mycobacterium tuberculosis
FEEAVAARAEQRAP

SEQ ID NO: 77446 - protein, 14 aa, Mycobacterium tuberculosis
EEAVAARAEQRAPV

SEQ ID NO: 77447 - protein, 14 aa, Mycobacterium tuberculosis
EAVAARAEQRAPVF

SEQ ID NO: 77448 - protein, 14 aa, Mycobacterium tuberculosis
AVAARAEQRAPVFT

SEQ ID NO: 77449 - protein, 14 aa, Mycobacterium tuberculosis
VAARAEQRAPVFTD

SEQ ID NO: 77450 - protein, 14 aa, Mycobacterium tuberculosis
AARAEQRAPVFTDD

SEQ ID NO: 77451 - protein, 14 aa, Mycobacterium tuberculosis
ARAEQRAPVFTDDT

SEQ ID NO: 77452 - protein, 15 aa, Mycobacterium tuberculosis
MPHRCAAQVVAGYRS

SEQ ID NO: 77453 - protein, 15 aa, Mycobacterium tuberculosis
PHRCAAQVVAGYRST

SEQ ID NO: 77454 - protein, 15 aa, Mycobacterium tuberculosis
HRCAAQVVAGYRSTV

SEQ ID NO: 77455 - protein, 15 aa, Mycobacterium tuberculosis
RCAAQVVAGYRSTVS

SEQ ID NO: 77456 - protein, 15 aa, Mycobacterium tuberculosis
CAAQVVAGYRSTVSL

SEQ ID NO: 77457 - protein, 15 aa, Mycobacterium tuberculosis
AAQVVAGYRSTVSLV

SEQ ID NO: 77458 - protein, 15 aa, Mycobacterium tuberculosis
AQVVAGYRSTVSLVL

SEQ ID NO: 77459 - protein, 15 aa, Mycobacterium tuberculosis
QVVAGYRSTVSLVLV

SEQ ID NO: 77460 - protein, 15 aa, Mycobacterium tuberculosis
VVAGYRSTVSLVLVE

SEQ ID NO: 77461 - protein, 15 aa, Mycobacterium tuberculosis
VAGYRSTVSLVLVEH

SEQ ID NO: 77462 - protein, 15 aa, Mycobacterium tuberculosis
AGYRSTVSLVLVEHP

SEQ ID NO: 77463 - protein, 15 aa, Mycobacterium tuberculosis
GYRSTVSLVLVEHPR

SEQ ID NO: 77464 - protein, 15 aa, Mycobacterium tuberculosis
YRSTVSLVLVEHPRP

SEQ ID NO: 77465 - protein, 15 aa, Mycobacterium tuberculosis
RSTVSLVLVEHPRPE

SEQ ID NO: 77466 - protein, 15 aa, Mycobacterium tuberculosis
STVSLVLVEHPRPEI

SEQ ID NO: 77467 - protein, 15 aa, Mycobacterium tuberculosis
TVSLVLVEHPRPEIA

SEQ ID NO: 77468 - protein, 15 aa, Mycobacterium tuberculosis
VSLVLVEHPRPEIAQ

SEQ ID NO: 77469 - protein, 15 aa, Mycobacterium tuberculosis
SLVLVEHPRPEIAQI

SEQ ID NO: 77470 - protein, 15 aa, Mycobacterium tuberculosis
LVLVEHPRPEIAQIT

SEQ ID NO: 77471 - protein, 15 aa, Mycobacterium tuberculosis
VLVEHPRPEIAQITL

SEQ ID NO: 77472 - protein, 15 aa, Mycobacterium tuberculosis
LVEHPRPEIAQITLN

SEQ ID NO: 77473 - protein, 15 aa, Mycobacterium tuberculosis
VEHPRPEIAQITLNR

SEQ ID NO: 77474 - protein, 15 aa, Mycobacterium tuberculosis
EHPRPEIAQITLNRP

SEQ ID NO: 77475 - protein, 15 aa, Mycobacterium tuberculosis
HPRPEIAQITLNRPE

SEQ ID NO: 77476 - protein, 15 aa, Mycobacterium tuberculosis
PRPEIAQITLNRPER

SEQ ID NO: 77477 - protein, 15 aa, Mycobacterium tuberculosis
RPEIAQITLNRPERM

SEQ ID NO: 77478 - protein, 15 aa, Mycobacterium tuberculosis
PEIAQITLNRPERMN

SEQ ID NO: 77479 - protein, 15 aa, Mycobacterium tuberculosis
EIAQITLNRPERMNS

SEQ ID NO: 77480 - protein, 15 aa, Mycobacterium tuberculosis
IAQITLNRPERMNSM

SEQ ID NO: 77481 - protein, 15 aa, Mycobacterium tuberculosis
AQITLNRPERMNSMA

SEQ ID NO: 77482 - protein, 15 aa, Mycobacterium tuberculosis
QITLNRPERMNSMAF

SEQ ID NO: 77483 - protein, 15 aa, Mycobacterium tuberculosis
ITLNRPERMNSMAFD

SEQ ID NO: 77484 - protein, 15 aa, Mycobacterium tuberculosis
TLNRPERMNSMAFDV

SEQ ID NO: 77485 - protein, 15 aa, Mycobacterium tuberculosis
LNRPERMNSMAFDVM

SEQ ID NO: 77486 - protein, 15 aa, Mycobacterium tuberculosis
NRPERMNSMAFDVMV

SEQ ID NO: 77487 - protein, 15 aa, Mycobacterium tuberculosis
RPERMNSMAFDVMVP

SEQ ID NO: 77488 - protein, 15 aa, Mycobacterium tuberculosis
PERMNSMAFDVMVPL

SEQ ID NO: 77489 - protein, 15 aa, Mycobacterium tuberculosis
ERMNSMAFDVMVPLK

SEQ ID NO: 77490 - protein, 15 aa, Mycobacterium tuberculosis
RMNSMAFDVMVPLKE

SEQ ID NO: 77491 - protein, 15 aa, Mycobacterium tuberculosis
MNSMAFDVMVPLKEA

SEQ ID NO: 77492 - protein, 15 aa, Mycobacterium tuberculosis
NSMAFDVMVPLKEAL

SEQ ID NO: 77493 - protein, 15 aa, Mycobacterium tuberculosis
SMAFDVMVPLKEALA

SEQ ID NO: 77494 - protein, 15 aa, Mycobacterium tuberculosis
MAFDVMVPLKEALAQ

SEQ ID NO: 77495 - protein, 15 aa, Mycobacterium tuberculosis
AFDVMVPLKEALAQV

SEQ ID NO: 77496 - protein, 15 aa, Mycobacterium tuberculosis
FDVMVPLKEALAQVS

SEQ ID NO: 77497 - protein, 15 aa, Mycobacterium tuberculosis
DVMVPLKEALAQVSY

SEQ ID NO: 77498 - protein, 15 aa, Mycobacterium tuberculosis
VMVPLKEALAQVSYD

SEQ ID NO: 77499 - protein, 15 aa, Mycobacterium tuberculosis
MVPLKEALAQVSYDN

SEQ ID NO: 77500 - protein, 15 aa, Mycobacterium tuberculosis
VPLKEALAQVSYDNS

SEQ ID NO: 77501 - protein, 15 aa, Mycobacterium tuberculosis
PLKEALAQVSYDNSV

SEQ ID NO: 77502 - protein, 15 aa, Mycobacterium tuberculosis
LKEALAQVSYDNSVR

SEQ ID NO: 77503 - protein, 15 aa, Mycobacterium tuberculosis
KEALAQVSYDNSVRV

SEQ ID NO: 77504 - protein, 15 aa, Mycobacterium tuberculosis
EALAQVSYDNSVRVV

SEQ ID NO: 77505 - protein, 15 aa, Mycobacterium tuberculosis
ALAQVSYDNSVRVVV

SEQ ID NO: 77506 - protein, 15 aa, Mycobacterium tuberculosis
LAQVSYDNSVRVVVL

SEQ ID NO: 77507 - protein, 15 aa, Mycobacterium tuberculosis
AQVSYDNSVRVVVLT

SEQ ID NO: 77508 - protein, 15 aa, Mycobacterium tuberculosis
QVSYDNSVRVVVLTG

SEQ ID NO: 77509 - protein, 15 aa, Mycobacterium tuberculosis
VSYDNSVRVVVLTGA

SEQ ID NO: 77510 - protein, 15 aa, Mycobacterium tuberculosis
SYDNSVRVVVLTGAG

SEQ ID NO: 77511 - protein, 15 aa, Mycobacterium tuberculosis
YDNSVRVVVLTGAGR

SEQ ID NO: 77512 - protein, 15 aa, Mycobacterium tuberculosis
DNSVRVVVLTGAGRG

SEQ ID NO: 77513 - protein, 15 aa, Mycobacterium tuberculosis
NSVRVVVLTGAGRGF

SEQ ID NO: 77514 - protein, 15 aa, Mycobacterium tuberculosis
SVRVVVLTGAGRGFS

SEQ ID NO: 77515 - protein, 15 aa, Mycobacterium tuberculosis
VRVVVLTGAGRGFSP

SEQ ID NO: 77516 - protein, 15 aa, Mycobacterium tuberculosis
RVVVLTGAGRGFSPG

SEQ ID NO: 77517 - protein, 15 aa, Mycobacterium tuberculosis
VVVLTGAGRGFSPGA

SEQ ID NO: 77518 - protein, 15 aa, Mycobacterium tuberculosis
VVLTGAGRGFSPGAD

SEQ ID NO: 77519 - protein, 15 aa, Mycobacterium tuberculosis
VLTGAGRGFSPGADH

SEQ ID NO: 77520 - protein, 15 aa, Mycobacterium tuberculosis
LTGAGRGFSPGADHK

SEQ ID NO: 77521 - protein, 15 aa, Mycobacterium tuberculosis
TGAGRGFSPGADHKS

SEQ ID NO: 77522 - protein, 15 aa, Mycobacterium tuberculosis
GAGRGFSPGADHKSA

SEQ ID NO: 77523 - protein, 15 aa, Mycobacterium tuberculosis
AGRGFSPGADHKSAG

SEQ ID NO: 77524 - protein, 15 aa, Mycobacterium tuberculosis
GRGFSPGADHKSAGV

SEQ ID NO: 77525 - protein, 15 aa, Mycobacterium tuberculosis
RGFSPGADHKSAGVV

SEQ ID NO: 77526 - protein, 15 aa, Mycobacterium tuberculosis
GFSPGADHKSAGVVP

SEQ ID NO: 77527 - protein, 15 aa, Mycobacterium tuberculosis
FSPGADHKSAGVVPH

SEQ ID NO: 77528 - protein, 15 aa, Mycobacterium tuberculosis
SPGADHKSAGVVPHV

SEQ ID NO: 77529 - protein, 15 aa, Mycobacterium tuberculosis
PGADHKSAGVVPHVE

SEQ ID NO: 77530 - protein, 15 aa, Mycobacterium tuberculosis
GADHKSAGVVPHVEN

SEQ ID NO: 77531 - protein, 15 aa, Mycobacterium tuberculosis
ADHKSAGVVPHVENL

SEQ ID NO: 77532 - protein, 15 aa, Mycobacterium tuberculosis
DHKSAGVVPHVENLT

SEQ ID NO: 77533 - protein, 15 aa, Mycobacterium tuberculosis
HKSAGVVPHVENLTR

SEQ ID NO: 77534 - protein, 15 aa, Mycobacterium tuberculosis
KSAGVVPHVENLTRP

SEQ ID NO: 77535 - protein, 15 aa, Mycobacterium tuberculosis
SAGVVPHVENLTRPT

SEQ ID NO: 77536 - protein, 15 aa, Mycobacterium tuberculosis
AGVVPHVENLTRPTY

SEQ ID NO: 77537 - protein, 15 aa, Mycobacterium tuberculosis
GVVPHVENLTRPTYA

SEQ ID NO: 77538 - protein, 15 aa, Mycobacterium tuberculosis
VVPHVENLTRPTYAL

SEQ ID NO: 77539 - protein, 15 aa, Mycobacterium tuberculosis
VPHVENLTRPTYALR

SEQ ID NO: 77540 - protein, 15 aa, Mycobacterium tuberculosis
PHVENLTRPTYALRS

SEQ ID NO: 77541 - protein, 15 aa, Mycobacterium tuberculosis
HVENLTRPTYALRSM

SEQ ID NO: 77542 - protein, 15 aa, Mycobacterium tuberculosis
VENLTRPTYALRSME

SEQ ID NO: 77543 - protein, 15 aa, Mycobacterium tuberculosis
ENLTRPTYALRSMEL

SEQ ID NO: 77544 - protein, 15 aa, Mycobacterium tuberculosis
NLTRPTYALRSMELL

SEQ ID NO: 77545 - protein, 15 aa, Mycobacterium tuberculosis
LTRPTYALRSMELLD

SEQ ID NO: 77546 - protein, 15 aa, Mycobacterium tuberculosis
TRPTYALRSMELLDD

SEQ ID NO: 77547 - protein, 15 aa, Mycobacterium tuberculosis
RPTYALRSMELLDDV

SEQ ID NO: 77548 - protein, 15 aa, Mycobacterium tuberculosis
PTYALRSMELLDDVI

SEQ ID NO: 77549 - protein, 15 aa, Mycobacterium tuberculosis
TYALRSMELLDDVIL

SEQ ID NO: 77550 - protein, 15 aa, Mycobacterium tuberculosis
YALRSMELLDDVILM

SEQ ID NO: 77551 - protein, 15 aa, Mycobacterium tuberculosis
ALRSMELLDDVILML

SEQ ID NO: 77552 - protein, 15 aa, Mycobacterium tuberculosis
LRSMELLDDVILMLR

SEQ ID NO: 77553 - protein, 15 aa, Mycobacterium tuberculosis
RSMELLDDVILMLRR

SEQ ID NO: 77554 - protein, 15 aa, Mycobacterium tuberculosis
SMELLDDVILMLRRL

SEQ ID NO: 77555 - protein, 15 aa, Mycobacterium tuberculosis
MELLDDVILMLRRLH

SEQ ID NO: 77556 - protein, 15 aa, Mycobacterium tuberculosis
ELLDDVILMLRRLHQ

SEQ ID NO: 77557 - protein, 15 aa, Mycobacterium tuberculosis
LLDDVILMLRRLHQP

SEQ ID NO: 77558 - protein, 15 aa, Mycobacterium tuberculosis
LDDVILMLRRLHQPV

SEQ ID NO: 77559 - protein, 15 aa, Mycobacterium tuberculosis
DDVILMLRRLHQPVI

SEQ ID NO: 77560 - protein, 15 aa, Mycobacterium tuberculosis
DVILMLRRLHQPVIA

SEQ ID NO: 77561 - protein, 15 aa, Mycobacterium tuberculosis
VILMLRRLHQPVIAA

SEQ ID NO: 77562 - protein, 15 aa, Mycobacterium tuberculosis
ILMLRRLHQPVIAAV

SEQ ID NO: 77563 - protein, 15 aa, Mycobacterium tuberculosis
LMLRRLHQPVIAAVN

SEQ ID NO: 77564 - protein, 15 aa, Mycobacterium tuberculosis
MLRRLHQPVIAAVNG

SEQ ID NO: 77565 - protein, 15 aa, Mycobacterium tuberculosis
LRRLHQPVIAAVNGP

SEQ ID NO: 77566 - protein, 15 aa, Mycobacterium tuberculosis
RRLHQPVIAAVNGPA

SEQ ID NO: 77567 - protein, 15 aa, Mycobacterium tuberculosis
RLHQPVIAAVNGPAI

SEQ ID NO: 77568 - protein, 15 aa, Mycobacterium tuberculosis
LHQPVIAAVNGPAIG

SEQ ID NO: 77569 - protein, 15 aa, Mycobacterium tuberculosis
HQPVIAAVNGPAIGG

SEQ ID NO: 77570 - protein, 15 aa, Mycobacterium tuberculosis
QPVIAAVNGPAIGGG

SEQ ID NO: 77571 - protein, 15 aa, Mycobacterium tuberculosis
PVIAAVNGPAIGGGL

SEQ ID NO: 77572 - protein, 15 aa, Mycobacterium tuberculosis
VIAAVNGPAIGGGLC

SEQ ID NO: 77573 - protein, 15 aa, Mycobacterium tuberculosis
IAAVNGPAIGGGLCL

SEQ ID NO: 77574 - protein, 15 aa, Mycobacterium tuberculosis
AAVNGPAIGGGLCLA

SEQ ID NO: 77575 - protein, 15 aa, Mycobacterium tuberculosis
AVNGPAIGGGLCLAL

SEQ ID NO: 77576 - protein, 15 aa, Mycobacterium tuberculosis
VNGPAIGGGLCLALA

SEQ ID NO: 77577 - protein, 15 aa, Mycobacterium tuberculosis
NGPAIGGGLCLALAA

SEQ ID NO: 77578 - protein, 15 aa, Mycobacterium tuberculosis
GPAIGGGLCLALAAD

SEQ ID NO: 77579 - protein, 15 aa, Mycobacterium tuberculosis
PAIGGGLCLALAADI

SEQ ID NO: 77580 - protein, 15 aa, Mycobacterium tuberculosis
AIGGGLCLALAADIR

SEQ ID NO: 77581 - protein, 15 aa, Mycobacterium tuberculosis
IGGGLCLALAADIRV

SEQ ID NO: 77582 - protein, 15 aa, Mycobacterium tuberculosis
GGGLCLALAADIRVA

SEQ ID NO: 77583 - protein, 15 aa, Mycobacterium tuberculosis
GGLCLALAADIRVAS

SEQ ID NO: 77584 - protein, 15 aa, Mycobacterium tuberculosis
GLCLALAADIRVASS

SEQ ID NO: 77585 - protein, 15 aa, Mycobacterium tuberculosis
LCLALAADIRVASSS

SEQ ID NO: 77586 - protein, 15 aa, Mycobacterium tuberculosis
CLALAADIRVASSSA

SEQ ID NO: 77587 - protein, 15 aa, Mycobacterium tuberculosis
LALAADIRVASSSAY

SEQ ID NO: 77588 - protein, 15 aa, Mycobacterium tuberculosis
ALAADIRVASSSAYF

SEQ ID NO: 77589 - protein, 15 aa, Mycobacterium tuberculosis
LAADIRVASSSAYFR

SEQ ID NO: 77590 - protein, 15 aa, Mycobacterium tuberculosis
AADIRVASSSAYFRA

SEQ ID NO: 77591 - protein, 15 aa, Mycobacterium tuberculosis
ADIRVASSSAYFRAA

SEQ ID NO: 77592 - protein, 15 aa, Mycobacterium tuberculosis
DIRVASSSAYFRAAG

SEQ ID NO: 77593 - protein, 15 aa, Mycobacterium tuberculosis
IRVASSSAYFRAAGI

SEQ ID NO: 77594 - protein, 15 aa, Mycobacterium tuberculosis
RVASSSAYFRAAGIN

SEQ ID NO: 77595 - protein, 15 aa, Mycobacterium tuberculosis
VASSSAYFRAAGINN

SEQ ID NO: 77596 - protein, 15 aa, Mycobacterium tuberculosis
ASSSAYFRAAGINNG

SEQ ID NO: 77597 - protein, 15 aa, Mycobacterium tuberculosis
SSSAYFRAAGINNGL

SEQ ID NO: 77598 - protein, 15 aa, Mycobacterium tuberculosis
SSAYFRAAGINNGLT

SEQ ID NO: 77599 - protein, 15 aa, Mycobacterium tuberculosis
SAYFRAAGINNGLTA

SEQ ID NO: 77600 - protein, 15 aa, Mycobacterium tuberculosis
AYFRAAGINNGLTAS

SEQ ID NO: 77601 - protein, 15 aa, Mycobacterium tuberculosis
YFRAAGINNGLTASE

SEQ ID NO: 77602 - protein, 15 aa, Mycobacterium tuberculosis
FRAAGINNGLTASEL

SEQ ID NO: 77603 - protein, 15 aa, Mycobacterium tuberculosis
RAAGINNGLTASELG

SEQ ID NO: 77604 - protein, 15 aa, Mycobacterium tuberculosis
AAGINNGLTASELGL

SEQ ID NO: 77605 - protein, 15 aa, Mycobacterium tuberculosis
AGINNGLTASELGLS

SEQ ID NO: 77606 - protein, 15 aa, Mycobacterium tuberculosis
GINNGLTASELGLSY

SEQ ID NO: 77607 - protein, 15 aa, Mycobacterium tuberculosis
INNGLTASELGLSYL

SEQ ID NO: 77608 - protein, 15 aa, Mycobacterium tuberculosis
NNGLTASELGLSYLL

SEQ ID NO: 77609 - protein, 15 aa, Mycobacterium tuberculosis
NGLTASELGLSYLLP

SEQ ID NO: 77610 - protein, 15 aa, Mycobacterium tuberculosis
GLTASELGLSYLLPR

SEQ ID NO: 77611 - protein, 15 aa, Mycobacterium tuberculosis
LTASELGLSYLLPRA

SEQ ID NO: 77612 - protein, 15 aa, Mycobacterium tuberculosis
TASELGLSYLLPRAI

SEQ ID NO: 77613 - protein, 15 aa, Mycobacterium tuberculosis
ASELGLSYLLPRAIG

SEQ ID NO: 77614 - protein, 15 aa, Mycobacterium tuberculosis
SELGLSYLLPRAIGS

SEQ ID NO: 77615 - protein, 15 aa, Mycobacterium tuberculosis
ELGLSYLLPRAIGSS

SEQ ID NO: 77616 - protein, 15 aa, Mycobacterium tuberculosis
LGLSYLLPRAIGSSR

SEQ ID NO: 77617 - protein, 15 aa, Mycobacterium tuberculosis
GLSYLLPRAIGSSRA

SEQ ID NO: 77618 - protein, 15 aa, Mycobacterium tuberculosis
LSYLLPRAIGSSRAF

SEQ ID NO: 77619 - protein, 15 aa, Mycobacterium tuberculosis
SYLLPRAIGSSRAFE

SEQ ID NO: 77620 - protein, 15 aa, Mycobacterium tuberculosis
YLLPRAIGSSRAFEI

SEQ ID NO: 77621 - protein, 15 aa, Mycobacterium tuberculosis
LLPRAIGSSRAFEIM

SEQ ID NO: 77622 - protein, 15 aa, Mycobacterium tuberculosis
LPRAIGSSRAFEIML

SEQ ID NO: 77623 - protein, 15 aa, Mycobacterium tuberculosis
PRAIGSSRAFEIMLT

SEQ ID NO: 77624 - protein, 15 aa, Mycobacterium tuberculosis
RAIGSSRAFEIMLTG

SEQ ID NO: 77625 - protein, 15 aa, Mycobacterium tuberculosis
AIGSSRAFEIMLTGR

SEQ ID NO: 77626 - protein, 15 aa, Mycobacterium tuberculosis
IGSSRAFEIMLTGRD

SEQ ID NO: 77627 - protein, 15 aa, Mycobacterium tuberculosis
GSSRAFEIMLTGRDV

SEQ ID NO: 77628 - protein, 15 aa, Mycobacterium tuberculosis
SSRAFEIMLTGRDVS

SEQ ID NO: 77629 - protein, 15 aa, Mycobacterium tuberculosis
SRAFEIMLTGRDVSA

SEQ ID NO: 77630 - protein, 15 aa, Mycobacterium tuberculosis
RAFEIMLTGRDVSAE

SEQ ID NO: 77631 - protein, 15 aa, Mycobacterium tuberculosis
AFEIMLTGRDVSAEE

SEQ ID NO: 77632 - protein, 15 aa, Mycobacterium tuberculosis
FEIMLTGRDVSAEEA

SEQ ID NO: 77633 - protein, 15 aa, Mycobacterium tuberculosis
EIMLTGRDVSAEEAE

SEQ ID NO: 77634 - protein, 15 aa, Mycobacterium tuberculosis
IMLTGRDVSAEEAER

SEQ ID NO: 77635 - protein, 15 aa, Mycobacterium tuberculosis
MLTGRDVSAEEAERI

SEQ ID NO: 77636 - protein, 15 aa, Mycobacterium tuberculosis
LTGRDVSAEEAERIG

SEQ ID NO: 77637 - protein, 15 aa, Mycobacterium tuberculosis
TGRDVSAEEAERIGL

SEQ ID NO: 77638 - protein, 15 aa, Mycobacterium tuberculosis
GRDVSAEEAERIGLV

SEQ ID NO: 77639 - protein, 15 aa, Mycobacterium tuberculosis
RDVSAEEAERIGLVS

SEQ ID NO: 77640 - protein, 15 aa, Mycobacterium tuberculosis
DVSAEEAERIGLVSR

SEQ ID NO: 77641 - protein, 15 aa, Mycobacterium tuberculosis
VSAEEAERIGLVSRQ

SEQ ID NO: 77642 - protein, 15 aa, Mycobacterium tuberculosis
SAEEAERIGLVSRQV

SEQ ID NO: 77643 - protein, 15 aa, Mycobacterium tuberculosis
AEEAERIGLVSRQVP

SEQ ID NO: 77644 - protein, 15 aa, Mycobacterium tuberculosis
EEAERIGLVSRQVPD

SEQ ID NO: 77645 - protein, 15 aa, Mycobacterium tuberculosis
EAERIGLVSRQVPDE

SEQ ID NO: 77646 - protein, 15 aa, Mycobacterium tuberculosis
AERIGLVSRQVPDEQ

SEQ ID NO: 77647 - protein, 15 aa, Mycobacterium tuberculosis
ERIGLVSRQVPDEQL

SEQ ID NO: 77648 - protein, 15 aa, Mycobacterium tuberculosis
RIGLVSRQVPDEQLL

SEQ ID NO: 77649 - protein, 15 aa, Mycobacterium tuberculosis
IGLVSRQVPDEQLLD

SEQ ID NO: 77650 - protein, 15 aa, Mycobacterium tuberculosis
GLVSRQVPDEQLLDA

SEQ ID NO: 77651 - protein, 15 aa, Mycobacterium tuberculosis
LVSRQVPDEQLLDAC

SEQ ID NO: 77652 - protein, 15 aa, Mycobacterium tuberculosis
VSRQVPDEQLLDACY

SEQ ID NO: 77653 - protein, 15 aa, Mycobacterium tuberculosis
SRQVPDEQLLDACYA

SEQ ID NO: 77654 - protein, 15 aa, Mycobacterium tuberculosis
RQVPDEQLLDACYAI

SEQ ID NO: 77655 - protein, 15 aa, Mycobacterium tuberculosis
QVPDEQLLDACYAIA

SEQ ID NO: 77656 - protein, 15 aa, Mycobacterium tuberculosis
VPDEQLLDACYAIAA

SEQ ID NO: 77657 - protein, 15 aa, Mycobacterium tuberculosis
PDEQLLDACYAIAAR

SEQ ID NO: 77658 - protein, 15 aa, Mycobacterium tuberculosis
DEQLLDACYAIAARM

SEQ ID NO: 77659 - protein, 15 aa, Mycobacterium tuberculosis
EQLLDACYAIAARMA

SEQ ID NO: 77660 - protein, 15 aa, Mycobacterium tuberculosis
QLLDACYAIAARMAG

SEQ ID NO: 77661 - protein, 15 aa, Mycobacterium tuberculosis
LLDACYAIAARMAGF

SEQ ID NO: 77662 - protein, 15 aa, Mycobacterium tuberculosis
LDACYAIAARMAGFS

SEQ ID NO: 77663 - protein, 15 aa, Mycobacterium tuberculosis
DACYAIAARMAGFSR

SEQ ID NO: 77664 - protein, 15 aa, Mycobacterium tuberculosis
ACYAIAARMAGFSRP

SEQ ID NO: 77665 - protein, 15 aa, Mycobacterium tuberculosis
CYAIAARMAGFSRPG

SEQ ID NO: 77666 - protein, 15 aa, Mycobacterium tuberculosis
YAIAARMAGFSRPGI

SEQ ID NO: 77667 - protein, 15 aa, Mycobacterium tuberculosis
AIAARMAGFSRPGIE

SEQ ID NO: 77668 - protein, 15 aa, Mycobacterium tuberculosis
IAARMAGFSRPGIEL

SEQ ID NO: 77669 - protein, 15 aa, Mycobacterium tuberculosis
AARMAGFSRPGIELT

SEQ ID NO: 77670 - protein, 15 aa, Mycobacterium tuberculosis
ARMAGFSRPGIELTK

SEQ ID NO: 77671 - protein, 15 aa, Mycobacterium tuberculosis
RMAGFSRPGIELTKR

SEQ ID NO: 77672 - protein, 15 aa, Mycobacterium tuberculosis
MAGFSRPGIELTKRT

SEQ ID NO: 77673 - protein, 15 aa, Mycobacterium tuberculosis
AGFSRPGIELTKRTL

SEQ ID NO: 77674 - protein, 15 aa, Mycobacterium tuberculosis
GFSRPGIELTKRTLW

SEQ ID NO: 77675 - protein, 15 aa, Mycobacterium tuberculosis
FSRPGIELTKRTLWS

SEQ ID NO: 77676 - protein, 15 aa, Mycobacterium tuberculosis
SRPGIELTKRTLWSG

SEQ ID NO: 77677 - protein, 15 aa, Mycobacterium tuberculosis
RPGIELTKRTLWSGL

SEQ ID NO: 77678 - protein, 15 aa, Mycobacterium tuberculosis
PGIELTKRTLWSGLD

SEQ ID NO: 77679 - protein, 15 aa, Mycobacterium tuberculosis
GIELTKRTLWSGLDA

SEQ ID NO: 77680 - protein, 15 aa, Mycobacterium tuberculosis
IELTKRTLWSGLDAA

SEQ ID NO: 77681 - protein, 15 aa, Mycobacterium tuberculosis
ELTKRTLWSGLDAAS

SEQ ID NO: 77682 - protein, 15 aa, Mycobacterium tuberculosis
LTKRTLWSGLDAASL

SEQ ID NO: 77683 - protein, 15 aa, Mycobacterium tuberculosis
TKRTLWSGLDAASLE

SEQ ID NO: 77684 - protein, 15 aa, Mycobacterium tuberculosis
KRTLWSGLDAASLEA

SEQ ID NO: 77685 - protein, 15 aa, Mycobacterium tuberculosis
RTLWSGLDAASLEAH

SEQ ID NO: 77686 - protein, 15 aa, Mycobacterium tuberculosis
TLWSGLDAASLEAHM

SEQ ID NO: 77687 - protein, 15 aa, Mycobacterium tuberculosis
LWSGLDAASLEAHMQ

SEQ ID NO: 77688 - protein, 15 aa, Mycobacterium tuberculosis
WSGLDAASLEAHMQA

SEQ ID NO: 77689 - protein, 15 aa, Mycobacterium tuberculosis
SGLDAASLEAHMQAE

SEQ ID NO: 77690 - protein, 15 aa, Mycobacterium tuberculosis
GLDAASLEAHMQAEG

SEQ ID NO: 77691 - protein, 15 aa, Mycobacterium tuberculosis
LDAASLEAHMQAEGL

SEQ ID NO: 77692 - protein, 15 aa, Mycobacterium tuberculosis
DAASLEAHMQAEGLG

SEQ ID NO: 77693 - protein, 15 aa, Mycobacterium tuberculosis
AASLEAHMQAEGLGQ

SEQ ID NO: 77694 - protein, 15 aa, Mycobacterium tuberculosis
ASLEAHMQAEGLGQL

SEQ ID NO: 77695 - protein, 15 aa, Mycobacterium tuberculosis
SLEAHMQAEGLGQLF

SEQ ID NO: 77696 - protein, 15 aa, Mycobacterium tuberculosis
LEAHMQAEGLGQLFV

SEQ ID NO: 77697 - protein, 15 aa, Mycobacterium tuberculosis
EAHMQAEGLGQLFVR

SEQ ID NO: 77698 - protein, 15 aa, Mycobacterium tuberculosis
AHMQAEGLGQLFVRL

SEQ ID NO: 77699 - protein, 15 aa, Mycobacterium tuberculosis
HMQAEGLGQLFVRLL

SEQ ID NO: 77700 - protein, 15 aa, Mycobacterium tuberculosis
MQAEGLGQLFVRLLT

SEQ ID NO: 77701 - protein, 15 aa, Mycobacterium tuberculosis
QAEGLGQLFVRLLTA

SEQ ID NO: 77702 - protein, 15 aa, Mycobacterium tuberculosis
AEGLGQLFVRLLTAN

SEQ ID NO: 77703 - protein, 15 aa, Mycobacterium tuberculosis
EGLGQLFVRLLTANF

SEQ ID NO: 77704 - protein, 15 aa, Mycobacterium tuberculosis
GLGQLFVRLLTANFE

SEQ ID NO: 77705 - protein, 15 aa, Mycobacterium tuberculosis
LGQLFVRLLTANFEE

SEQ ID NO: 77706 - protein, 15 aa, Mycobacterium tuberculosis
GQLFVRLLTANFEEA

SEQ ID NO: 77707 - protein, 15 aa, Mycobacterium tuberculosis
QLFVRLLTANFEEAV

SEQ ID NO: 77708 - protein, 15 aa, Mycobacterium tuberculosis
LFVRLLTANFEEAVA

SEQ ID NO: 77709 - protein, 15 aa, Mycobacterium tuberculosis
FVRLLTANFEEAVAA

SEQ ID NO: 77710 - protein, 15 aa, Mycobacterium tuberculosis
VRLLTANFEEAVAAR

SEQ ID NO: 77711 - protein, 15 aa, Mycobacterium tuberculosis
RLLTANFEEAVAARA

SEQ ID NO: 77712 - protein, 15 aa, Mycobacterium tuberculosis
LLTANFEEAVAARAE

SEQ ID NO: 77713 - protein, 15 aa, Mycobacterium tuberculosis
LTANFEEAVAARAEQ

SEQ ID NO: 77714 - protein, 15 aa, Mycobacterium tuberculosis
TANFEEAVAARAEQR

SEQ ID NO: 77715 - protein, 15 aa, Mycobacterium tuberculosis
ANFEEAVAARAEQRA

SEQ ID NO: 77716 - protein, 15 aa, Mycobacterium tuberculosis
NFEEAVAARAEQRAP

SEQ ID NO: 77717 - protein, 15 aa, Mycobacterium tuberculosis
FEEAVAARAEQRAPV

SEQ ID NO: 77718 - protein, 15 aa, Mycobacterium tuberculosis
EEAVAARAEQRAPVF

SEQ ID NO: 77719 - protein, 15 aa, Mycobacterium tuberculosis
EAVAARAEQRAPVFT

SEQ ID NO: 77720 - protein, 15 aa, Mycobacterium tuberculosis
AVAARAEQRAPVFTD

SEQ ID NO: 77721 - protein, 15 aa, Mycobacterium tuberculosis
VAARAEQRAPVFTDD

SEQ ID NO: 77722 - protein, 15 aa, Mycobacterium tuberculosis
AARAEQRAPVFTDDT

SEQ ID NO: 77723 - protein, 16 aa, Mycobacterium tuberculosis
MPHRCAAQVVAGYRST

SEQ ID NO: 77724 - protein, 16 aa, Mycobacterium tuberculosis
PHRCAAQVVAGYRSTV

SEQ ID NO: 77725 - protein, 16 aa, Mycobacterium tuberculosis
HRCAAQVVAGYRSTVS

SEQ ID NO: 77726 - protein, 16 aa, Mycobacterium tuberculosis
RCAAQVVAGYRSTVSL

SEQ ID NO: 77727 - protein, 16 aa, Mycobacterium tuberculosis
CAAQVVAGYRSTVSLV

SEQ ID NO: 77728 - protein, 16 aa, Mycobacterium tuberculosis
AAQVVAGYRSTVSLVL

SEQ ID NO: 77729 - protein, 16 aa, Mycobacterium tuberculosis
AQVVAGYRSTVSLVLV

SEQ ID NO: 77730 - protein, 16 aa, Mycobacterium tuberculosis
QVVAGYRSTVSLVLVE

SEQ ID NO: 77731 - protein, 16 aa, Mycobacterium tuberculosis
VVAGYRSTVSLVLVEH

SEQ ID NO: 77732 - protein, 16 aa, Mycobacterium tuberculosis
VAGYRSTVSLVLVEHP

SEQ ID NO: 77733 - protein, 16 aa, Mycobacterium tuberculosis
AGYRSTVSLVLVEHPR

SEQ ID NO: 77734 - protein, 16 aa, Mycobacterium tuberculosis
GYRSTVSLVLVEHPRP

SEQ ID NO: 77735 - protein, 16 aa, Mycobacterium tuberculosis
YRSTVSLVLVEHPRPE

SEQ ID NO: 77736 - protein, 16 aa, Mycobacterium tuberculosis
RSTVSLVLVEHPRPEI

SEQ ID NO: 77737 - protein, 16 aa, Mycobacterium tuberculosis
STVSLVLVEHPRPEIA

SEQ ID NO: 77738 - protein, 16 aa, Mycobacterium tuberculosis
TVSLVLVEHPRPEIAQ

SEQ ID NO: 77739 - protein, 16 aa, Mycobacterium tuberculosis
VSLVLVEHPRPEIAQI

SEQ ID NO: 77740 - protein, 16 aa, Mycobacterium tuberculosis
SLVLVEHPRPEIAQIT

SEQ ID NO: 77741 - protein, 16 aa, Mycobacterium tuberculosis
LVLVEHPRPEIAQITL

SEQ ID NO: 77742 - protein, 16 aa, Mycobacterium tuberculosis
VLVEHPRPEIAQITLN

SEQ ID NO: 77743 - protein, 16 aa, Mycobacterium tuberculosis
LVEHPRPEIAQITLNR

SEQ ID NO: 77744 - protein, 16 aa, Mycobacterium tuberculosis
VEHPRPEIAQITLNRP

SEQ ID NO: 77745 - protein, 16 aa, Mycobacterium tuberculosis
EHPRPEIAQITLNRPE

SEQ ID NO: 77746 - protein, 16 aa, Mycobacterium tuberculosis
HPRPEIAQITLNRPER

SEQ ID NO: 77747 - protein, 16 aa, Mycobacterium tuberculosis
PRPEIAQITLNRPERM

SEQ ID NO: 77748 - protein, 16 aa, Mycobacterium tuberculosis
RPEIAQITLNRPERMN

SEQ ID NO: 77749 - protein, 16 aa, Mycobacterium tuberculosis
PEIAQITLNRPERMNS

SEQ ID NO: 77750 - protein, 16 aa, Mycobacterium tuberculosis
EIAQITLNRPERMNSM

SEQ ID NO: 77751 - protein, 16 aa, Mycobacterium tuberculosis
IAQITLNRPERMNSMA

SEQ ID NO: 77752 - protein, 16 aa, Mycobacterium tuberculosis
AQITLNRPERMNSMAF

SEQ ID NO: 77753 - protein, 16 aa, Mycobacterium tuberculosis
QITLNRPERMNSMAFD

SEQ ID NO: 77754 - protein, 16 aa, Mycobacterium tuberculosis
ITLNRPERMNSMAFDV

SEQ ID NO: 77755 - protein, 16 aa, Mycobacterium tuberculosis
TLNRPERMNSMAFDVM

SEQ ID NO: 77756 - protein, 16 aa, Mycobacterium tuberculosis
LNRPERMNSMAFDVMV

SEQ ID NO: 77757 - protein, 16 aa, Mycobacterium tuberculosis
NRPERMNSMAFDVMVP

SEQ ID NO: 77758 - protein, 16 aa, Mycobacterium tuberculosis
RPERMNSMAFDVMVPL

SEQ ID NO: 77759 - protein, 16 aa, Mycobacterium tuberculosis
PERMNSMAFDVMVPLK

SEQ ID NO: 77760 - protein, 16 aa, Mycobacterium tuberculosis
ERMNSMAFDVMVPLKE

SEQ ID NO: 77761 - protein, 16 aa, Mycobacterium tuberculosis
RMNSMAFDVMVPLKEA

SEQ ID NO: 77762 - protein, 16 aa, Mycobacterium tuberculosis
MNSMAFDVMVPLKEAL

SEQ ID NO: 77763 - protein, 16 aa, Mycobacterium tuberculosis
NSMAFDVMVPLKEALA

SEQ ID NO: 77764 - protein, 16 aa, Mycobacterium tuberculosis
SMAFDVMVPLKEALAQ

SEQ ID NO: 77765 - protein, 16 aa, Mycobacterium tuberculosis
MAFDVMVPLKEALAQV

SEQ ID NO: 77766 - protein, 16 aa, Mycobacterium tuberculosis
AFDVMVPLKEALAQVS

SEQ ID NO: 77767 - protein, 16 aa, Mycobacterium tuberculosis
FDVMVPLKEALAQVSY

SEQ ID NO: 77768 - protein, 16 aa, Mycobacterium tuberculosis
DVMVPLKEALAQVSYD

SEQ ID NO: 77769 - protein, 16 aa, Mycobacterium tuberculosis
VMVPLKEALAQVSYDN

SEQ ID NO: 77770 - protein, 16 aa, Mycobacterium tuberculosis
MVPLKEALAQVSYDNS

SEQ ID NO: 77771 - protein, 16 aa, Mycobacterium tuberculosis
VPLKEALAQVSYDNSV

SEQ ID NO: 77772 - protein, 16 aa, Mycobacterium tuberculosis
PLKEALAQVSYDNSVR

SEQ ID NO: 77773 - protein, 16 aa, Mycobacterium tuberculosis
LKEALAQVSYDNSVRV

SEQ ID NO: 77774 - protein, 16 aa, Mycobacterium tuberculosis
KEALAQVSYDNSVRVV

SEQ ID NO: 77775 - protein, 16 aa, Mycobacterium tuberculosis
EALAQVSYDNSVRVVV

SEQ ID NO: 77776 - protein, 16 aa, Mycobacterium tuberculosis
ALAQVSYDNSVRVVVL

SEQ ID NO: 77777 - protein, 16 aa, Mycobacterium tuberculosis
LAQVSYDNSVRVVVLT

SEQ ID NO: 77778 - protein, 16 aa, Mycobacterium tuberculosis
AQVSYDNSVRVVVLTG

SEQ ID NO: 77779 - protein, 16 aa, Mycobacterium tuberculosis
QVSYDNSVRVVVLTGA

SEQ ID NO: 77780 - protein, 16 aa, Mycobacterium tuberculosis
VSYDNSVRVVVLTGAG

SEQ ID NO: 77781 - protein, 16 aa, Mycobacterium tuberculosis
SYDNSVRVVVLTGAGR

SEQ ID NO: 77782 - protein, 16 aa, Mycobacterium tuberculosis
YDNSVRVVVLTGAGRG

SEQ ID NO: 77783 - protein, 16 aa, Mycobacterium tuberculosis
DNSVRVVVLTGAGRGF

SEQ ID NO: 77784 - protein, 16 aa, Mycobacterium tuberculosis
NSVRVVVLTGAGRGFS

SEQ ID NO: 77785 - protein, 16 aa, Mycobacterium tuberculosis
SVRVVVLTGAGRGFSP

SEQ ID NO: 77786 - protein, 16 aa, Mycobacterium tuberculosis
VRVVVLTGAGRGFSPG

SEQ ID NO: 77787 - protein, 16 aa, Mycobacterium tuberculosis
RVVVLTGAGRGFSPGA

SEQ ID NO: 77788 - protein, 16 aa, Mycobacterium tuberculosis
VVVLTGAGRGFSPGAD

SEQ ID NO: 77789 - protein, 16 aa, Mycobacterium tuberculosis
VVLTGAGRGFSPGADH

SEQ ID NO: 77790 - protein, 16 aa, Mycobacterium tuberculosis
VLTGAGRGFSPGADHK

SEQ ID NO: 77791 - protein, 16 aa, Mycobacterium tuberculosis
LTGAGRGFSPGADHKS

SEQ ID NO: 77792 - protein, 16 aa, Mycobacterium tuberculosis
TGAGRGFSPGADHKSA

SEQ ID NO: 77793 - protein, 16 aa, Mycobacterium tuberculosis
GAGRGFSPGADHKSAG

SEQ ID NO: 77794 - protein, 16 aa, Mycobacterium tuberculosis
AGRGFSPGADHKSAGV

SEQ ID NO: 77795 - protein, 16 aa, Mycobacterium tuberculosis
GRGFSPGADHKSAGVV

SEQ ID NO: 77796 - protein, 16 aa, Mycobacterium tuberculosis
RGFSPGADHKSAGVVP

SEQ ID NO: 77797 - protein, 16 aa, Mycobacterium tuberculosis
GFSPGADHKSAGVVPH

SEQ ID NO: 77798 - protein, 16 aa, Mycobacterium tuberculosis
FSPGADHKSAGVVPHV

SEQ ID NO: 77799 - protein, 16 aa, Mycobacterium tuberculosis
SPGADHKSAGVVPHVE

SEQ ID NO: 77800 - protein, 16 aa, Mycobacterium tuberculosis
PGADHKSAGVVPHVEN

SEQ ID NO: 77801 - protein, 16 aa, Mycobacterium tuberculosis
GADHKSAGVVPHVENL

SEQ ID NO: 77802 - protein, 16 aa, Mycobacterium tuberculosis
ADHKSAGVVPHVENLT

SEQ ID NO: 77803 - protein, 16 aa, Mycobacterium tuberculosis
DHKSAGVVPHVENLTR

SEQ ID NO: 77804 - protein, 16 aa, Mycobacterium tuberculosis
HKSAGVVPHVENLTRP

SEQ ID NO: 77805 - protein, 16 aa, Mycobacterium tuberculosis
KSAGVVPHVENLTRPT

SEQ ID NO: 77806 - protein, 16 aa, Mycobacterium tuberculosis
SAGVVPHVENLTRPTY

SEQ ID NO: 77807 - protein, 16 aa, Mycobacterium tuberculosis
AGVVPHVENLTRPTYA

SEQ ID NO: 77808 - protein, 16 aa, Mycobacterium tuberculosis
GVVPHVENLTRPTYAL

SEQ ID NO: 77809 - protein, 16 aa, Mycobacterium tuberculosis
VVPHVENLTRPTYALR

SEQ ID NO: 77810 - protein, 16 aa, Mycobacterium tuberculosis
VPHVENLTRPTYALRS

SEQ ID NO: 77811 - protein, 16 aa, Mycobacterium tuberculosis
PHVENLTRPTYALRSM

SEQ ID NO: 77812 - protein, 16 aa, Mycobacterium tuberculosis
HVENLTRPTYALRSME

SEQ ID NO: 77813 - protein, 16 aa, Mycobacterium tuberculosis
VENLTRPTYALRSMEL

SEQ ID NO: 77814 - protein, 16 aa, Mycobacterium tuberculosis
ENLTRPTYALRSMELL

SEQ ID NO: 77815 - protein, 16 aa, Mycobacterium tuberculosis
NLTRPTYALRSMELLD

SEQ ID NO: 77816 - protein, 16 aa, Mycobacterium tuberculosis
LTRPTYALRSMELLDD

SEQ ID NO: 77817 - protein, 16 aa, Mycobacterium tuberculosis
TRPTYALRSMELLDDV

SEQ ID NO: 77818 - protein, 16 aa, Mycobacterium tuberculosis
RPTYALRSMELLDDVI

SEQ ID NO: 77819 - protein, 16 aa, Mycobacterium tuberculosis
PTYALRSMELLDDVIL

SEQ ID NO: 77820 - protein, 16 aa, Mycobacterium tuberculosis
TYALRSMELLDDVILM

SEQ ID NO: 77821 - protein, 16 aa, Mycobacterium tuberculosis
YALRSMELLDDVILML

SEQ ID NO: 77822 - protein, 16 aa, Mycobacterium tuberculosis
ALRSMELLDDVILMLR

SEQ ID NO: 77823 - protein, 16 aa, Mycobacterium tuberculosis
LRSMELLDDVILMLRR

SEQ ID NO: 77824 - protein, 16 aa, Mycobacterium tuberculosis
RSMELLDDVILMLRRL

SEQ ID NO: 77825 - protein, 16 aa, Mycobacterium tuberculosis
SMELLDDVILMLRRLH

SEQ ID NO: 77826 - protein, 16 aa, Mycobacterium tuberculosis
MELLDDVILMLRRLHQ

SEQ ID NO: 77827 - protein, 16 aa, Mycobacterium tuberculosis
ELLDDVILMLRRLHQP

SEQ ID NO: 77828 - protein, 16 aa, Mycobacterium tuberculosis
LLDDVILMLRRLHQPV

SEQ ID NO: 77829 - protein, 16 aa, Mycobacterium tuberculosis
LDDVILMLRRLHQPVI

SEQ ID NO: 77830 - protein, 16 aa, Mycobacterium tuberculosis
DDVILMLRRLHQPVIA

SEQ ID NO: 77831 - protein, 16 aa, Mycobacterium tuberculosis
DVILMLRRLHQPVIAA

SEQ ID NO: 77832 - protein, 16 aa, Mycobacterium tuberculosis
VILMLRRLHQPVIAAV

SEQ ID NO: 77833 - protein, 16 aa, Mycobacterium tuberculosis
ILMLRRLHQPVIAAVN

SEQ ID NO: 77834 - protein, 16 aa, Mycobacterium tuberculosis
LMLRRLHQPVIAAVNG

SEQ ID NO: 77835 - protein, 16 aa, Mycobacterium tuberculosis
MLRRLHQPVIAAVNGP

SEQ ID NO: 77836 - protein, 16 aa, Mycobacterium tuberculosis
LRRLHQPVIAAVNGPA

SEQ ID NO: 77837 - protein, 16 aa, Mycobacterium tuberculosis
RRLHQPVIAAVNGPAI

SEQ ID NO: 77838 - protein, 16 aa, Mycobacterium tuberculosis
RLHQPVIAAVNGPAIG

SEQ ID NO: 77839 - protein, 16 aa, Mycobacterium tuberculosis
LHQPVIAAVNGPAIGG

SEQ ID NO: 77840 - protein, 16 aa, Mycobacterium tuberculosis
HQPVIAAVNGPAIGGG

SEQ ID NO: 77841 - protein, 16 aa, Mycobacterium tuberculosis
QPVIAAVNGPAIGGGL

SEQ ID NO: 77842 - protein, 16 aa, Mycobacterium tuberculosis
PVIAAVNGPAIGGGLC

SEQ ID NO: 77843 - protein, 16 aa, Mycobacterium tuberculosis
VIAAVNGPAIGGGLCL

SEQ ID NO: 77844 - protein, 16 aa, Mycobacterium tuberculosis
IAAVNGPAIGGGLCLA

SEQ ID NO: 77845 - protein, 16 aa, Mycobacterium tuberculosis
AAVNGPAIGGGLCLAL

SEQ ID NO: 77846 - protein, 16 aa, Mycobacterium tuberculosis
AVNGPAIGGGLCLALA

SEQ ID NO: 77847 - protein, 16 aa, Mycobacterium tuberculosis
VNGPAIGGGLCLALAA

SEQ ID NO: 77848 - protein, 16 aa, Mycobacterium tuberculosis
NGPAIGGGLCLALAAD

SEQ ID NO: 77849 - protein, 16 aa, Mycobacterium tuberculosis
GPAIGGGLCLALAADI

SEQ ID NO: 77850 - protein, 16 aa, Mycobacterium tuberculosis
PAIGGGLCLALAADIR

SEQ ID NO: 77851 - protein, 16 aa, Mycobacterium tuberculosis
AIGGGLCLALAADIRV

SEQ ID NO: 77852 - protein, 16 aa, Mycobacterium tuberculosis
IGGGLCLALAADIRVA

SEQ ID NO: 77853 - protein, 16 aa, Mycobacterium tuberculosis
GGGLCLALAADIRVAS

SEQ ID NO: 77854 - protein, 16 aa, Mycobacterium tuberculosis
GGLCLALAADIRVASS

SEQ ID NO: 77855 - protein, 16 aa, Mycobacterium tuberculosis
GLCLALAADIRVASSS

SEQ ID NO: 77856 - protein, 16 aa, Mycobacterium tuberculosis
LCLALAADIRVASSSA

SEQ ID NO: 77857 - protein, 16 aa, Mycobacterium tuberculosis
CLALAADIRVASSSAY

SEQ ID NO: 77858 - protein, 16 aa, Mycobacterium tuberculosis
LALAADIRVASSSAYF

SEQ ID NO: 77859 - protein, 16 aa, Mycobacterium tuberculosis
ALAADIRVASSSAYFR

SEQ ID NO: 77860 - protein, 16 aa, Mycobacterium tuberculosis
LAADIRVASSSAYFRA

SEQ ID NO: 77861 - protein, 16 aa, Mycobacterium tuberculosis
AADIRVASSSAYFRAA

SEQ ID NO: 77862 - protein, 16 aa, Mycobacterium tuberculosis
ADIRVASSSAYFRAAG

SEQ ID NO: 77863 - protein, 16 aa, Mycobacterium tuberculosis
DIRVASSSAYFRAAGI

SEQ ID NO: 77864 - protein, 16 aa, Mycobacterium tuberculosis
IRVASSSAYFRAAGIN

SEQ ID NO: 77865 - protein, 16 aa, Mycobacterium tuberculosis
RVASSSAYFRAAGINN

SEQ ID NO: 77866 - protein, 16 aa, Mycobacterium tuberculosis
VASSSAYFRAAGINNG

SEQ ID NO: 77867 - protein, 16 aa, Mycobacterium tuberculosis
ASSSAYFRAAGINNGL

SEQ ID NO: 77868 - protein, 16 aa, Mycobacterium tuberculosis
SSSAYFRAAGINNGLT

SEQ ID NO: 77869 - protein, 16 aa, Mycobacterium tuberculosis
SSAYFRAAGINNGLTA

SEQ ID NO: 77870 - protein, 16 aa, Mycobacterium tuberculosis
SAYFRAAGINNGLTAS

SEQ ID NO: 77871 - protein, 16 aa, Mycobacterium tuberculosis
AYFRAAGINNGLTASE

SEQ ID NO: 77872 - protein, 16 aa, Mycobacterium tuberculosis
YFRAAGINNGLTASEL

SEQ ID NO: 77873 - protein, 16 aa, Mycobacterium tuberculosis
FRAAGINNGLTASELG

SEQ ID NO: 77874 - protein, 16 aa, Mycobacterium tuberculosis
RAAGINNGLTASELGL

SEQ ID NO: 77875 - protein, 16 aa, Mycobacterium tuberculosis
AAGINNGLTASELGLS

SEQ ID NO: 77876 - protein, 16 aa, Mycobacterium tuberculosis
AGINNGLTASELGLSY

SEQ ID NO: 77877 - protein, 16 aa, Mycobacterium tuberculosis
GINNGLTASELGLSYL

SEQ ID NO: 77878 - protein, 16 aa, Mycobacterium tuberculosis
INNGLTASELGLSYLL

SEQ ID NO: 77879 - protein, 16 aa, Mycobacterium tuberculosis
NNGLTASELGLSYLLP

SEQ ID NO: 77880 - protein, 16 aa, Mycobacterium tuberculosis
NGLTASELGLSYLLPR

SEQ ID NO: 77881 - protein, 16 aa, Mycobacterium tuberculosis
GLTASELGLSYLLPRA

SEQ ID NO: 77882 - protein, 16 aa, Mycobacterium tuberculosis
LTASELGLSYLLPRAI

SEQ ID NO: 77883 - protein, 16 aa, Mycobacterium tuberculosis
TASELGLSYLLPRAIG

SEQ ID NO: 77884 - protein, 16 aa, Mycobacterium tuberculosis
ASELGLSYLLPRAIGS

SEQ ID NO: 77885 - protein, 16 aa, Mycobacterium tuberculosis
SELGLSYLLPRAIGSS

SEQ ID NO: 77886 - protein, 16 aa, Mycobacterium tuberculosis
ELGLSYLLPRAIGSSR

SEQ ID NO: 77887 - protein, 16 aa, Mycobacterium tuberculosis
LGLSYLLPRAIGSSRA

SEQ ID NO: 77888 - protein, 16 aa, Mycobacterium tuberculosis
GLSYLLPRAIGSSRAF

SEQ ID NO: 77889 - protein, 16 aa, Mycobacterium tuberculosis
LSYLLPRAIGSSRAFE

SEQ ID NO: 77890 - protein, 16 aa, Mycobacterium tuberculosis
SYLLPRAIGSSRAFEI

SEQ ID NO: 77891 - protein, 16 aa, Mycobacterium tuberculosis
YLLPRAIGSSRAFEIM

SEQ ID NO: 77892 - protein, 16 aa, Mycobacterium tuberculosis
LLPRAIGSSRAFEIML

SEQ ID NO: 77893 - protein, 16 aa, Mycobacterium tuberculosis
LPRAIGSSRAFEIMLT

SEQ ID NO: 77894 - protein, 16 aa, Mycobacterium tuberculosis
PRAIGSSRAFEIMLTG

SEQ ID NO: 77895 - protein, 16 aa, Mycobacterium tuberculosis
RAIGSSRAFEIMLTGR

SEQ ID NO: 77896 - protein, 16 aa, Mycobacterium tuberculosis
AIGSSRAFEIMLTGRD

SEQ ID NO: 77897 - protein, 16 aa, Mycobacterium tuberculosis
IGSSRAFEIMLTGRDV

SEQ ID NO: 77898 - protein, 16 aa, Mycobacterium tuberculosis
GSSRAFEIMLTGRDVS

SEQ ID NO: 77899 - protein, 16 aa, Mycobacterium tuberculosis
SSRAFEIMLTGRDVSA

SEQ ID NO: 77900 - protein, 16 aa, Mycobacterium tuberculosis
SRAFEIMLTGRDVSAE

SEQ ID NO: 77901 - protein, 16 aa, Mycobacterium tuberculosis
RAFEIMLTGRDVSAEE

SEQ ID NO: 77902 - protein, 16 aa, Mycobacterium tuberculosis
AFEIMLTGRDVSAEEA

SEQ ID NO: 77903 - protein, 16 aa, Mycobacterium tuberculosis
FEIMLTGRDVSAEEAE

SEQ ID NO: 77904 - protein, 16 aa, Mycobacterium tuberculosis
EIMLTGRDVSAEEAER

SEQ ID NO: 77905 - protein, 16 aa, Mycobacterium tuberculosis
IMLTGRDVSAEEAERI

SEQ ID NO: 77906 - protein, 16 aa, Mycobacterium tuberculosis
MLTGRDVSAEEAERIG

SEQ ID NO: 77907 - protein, 16 aa, Mycobacterium tuberculosis
LTGRDVSAEEAERIGL

SEQ ID NO: 77908 - protein, 16 aa, Mycobacterium tuberculosis
TGRDVSAEEAERIGLV

SEQ ID NO: 77909 - protein, 16 aa, Mycobacterium tuberculosis
GRDVSAEEAERIGLVS

SEQ ID NO: 77910 - protein, 16 aa, Mycobacterium tuberculosis
RDVSAEEAERIGLVSR

SEQ ID NO: 77911 - protein, 16 aa, Mycobacterium tuberculosis
DVSAEEAERIGLVSRQ

SEQ ID NO: 77912 - protein, 16 aa, Mycobacterium tuberculosis
VSAEEAERIGLVSRQV

SEQ ID NO: 77913 - protein, 16 aa, Mycobacterium tuberculosis
SAEEAERIGLVSRQVP

SEQ ID NO: 77914 - protein, 16 aa, Mycobacterium tuberculosis
AEEAERIGLVSRQVPD

SEQ ID NO: 77915 - protein, 16 aa, Mycobacterium tuberculosis
EEAERIGLVSRQVPDE

SEQ ID NO: 77916 - protein, 16 aa, Mycobacterium tuberculosis
EAERIGLVSRQVPDEQ

SEQ ID NO: 77917 - protein, 16 aa, Mycobacterium tuberculosis
AERIGLVSRQVPDEQL

SEQ ID NO: 77918 - protein, 16 aa, Mycobacterium tuberculosis
ERIGLVSRQVPDEQLL

SEQ ID NO: 77919 - protein, 16 aa, Mycobacterium tuberculosis
RIGLVSRQVPDEQLLD

SEQ ID NO: 77920 - protein, 16 aa, Mycobacterium tuberculosis
IGLVSRQVPDEQLLDA

SEQ ID NO: 77921 - protein, 16 aa, Mycobacterium tuberculosis
GLVSRQVPDEQLLDAC

SEQ ID NO: 77922 - protein, 16 aa, Mycobacterium tuberculosis
LVSRQVPDEQLLDACY

SEQ ID NO: 77923 - protein, 16 aa, Mycobacterium tuberculosis
VSRQVPDEQLLDACYA

SEQ ID NO: 77924 - protein, 16 aa, Mycobacterium tuberculosis
SRQVPDEQLLDACYAI

SEQ ID NO: 77925 - protein, 16 aa, Mycobacterium tuberculosis
RQVPDEQLLDACYAIA

SEQ ID NO: 77926 - protein, 16 aa, Mycobacterium tuberculosis
QVPDEQLLDACYAIAA

SEQ ID NO: 77927 - protein, 16 aa, Mycobacterium tuberculosis
VPDEQLLDACYAIAAR

SEQ ID NO: 77928 - protein, 16 aa, Mycobacterium tuberculosis
PDEQLLDACYAIAARM

SEQ ID NO: 77929 - protein, 16 aa, Mycobacterium tuberculosis
DEQLLDACYAIAARMA

SEQ ID NO: 77930 - protein, 16 aa, Mycobacterium tuberculosis
EQLLDACYAIAARMAG

SEQ ID NO: 77931 - protein, 16 aa, Mycobacterium tuberculosis
QLLDACYAIAARMAGF

SEQ ID NO: 77932 - protein, 16 aa, Mycobacterium tuberculosis
LLDACYAIAARMAGFS

SEQ ID NO: 77933 - protein, 16 aa, Mycobacterium tuberculosis
LDACYAIAARMAGFSR

SEQ ID NO: 77934 - protein, 16 aa, Mycobacterium tuberculosis
DACYAIAARMAGFSRP

SEQ ID NO: 77935 - protein, 16 aa, Mycobacterium tuberculosis
ACYAIAARMAGFSRPG

SEQ ID NO: 77936 - protein, 16 aa, Mycobacterium tuberculosis
CYAIAARMAGFSRPGI

SEQ ID NO: 77937 - protein, 16 aa, Mycobacterium tuberculosis
YAIAARMAGFSRPGIE

SEQ ID NO: 77938 - protein, 16 aa, Mycobacterium tuberculosis
AIAARMAGFSRPGIEL

SEQ ID NO: 77939 - protein, 16 aa, Mycobacterium tuberculosis
IAARMAGFSRPGIELT

SEQ ID NO: 77940 - protein, 16 aa, Mycobacterium tuberculosis
AARMAGFSRPGIELTK

SEQ ID NO: 77941 - protein, 16 aa, Mycobacterium tuberculosis
ARMAGFSRPGIELTKR

SEQ ID NO: 77942 - protein, 16 aa, Mycobacterium tuberculosis
RMAGFSRPGIELTKRT

SEQ ID NO: 77943 - protein, 16 aa, Mycobacterium tuberculosis
MAGFSRPGIELTKRTL

SEQ ID NO: 77944 - protein, 16 aa, Mycobacterium tuberculosis
AGFSRPGIELTKRTLW

SEQ ID NO: 77945 - protein, 16 aa, Mycobacterium tuberculosis
GFSRPGIELTKRTLWS

SEQ ID NO: 77946 - protein, 16 aa, Mycobacterium tuberculosis
FSRPGIELTKRTLWSG

SEQ ID NO: 77947 - protein, 16 aa, Mycobacterium tuberculosis
SRPGIELTKRTLWSGL

SEQ ID NO: 77948 - protein, 16 aa, Mycobacterium tuberculosis
RPGIELTKRTLWSGLD

SEQ ID NO: 77949 - protein, 16 aa, Mycobacterium tuberculosis
PGIELTKRTLWSGLDA

SEQ ID NO: 77950 - protein, 16 aa, Mycobacterium tuberculosis
GIELTKRTLWSGLDAA

SEQ ID NO: 77951 - protein, 16 aa, Mycobacterium tuberculosis
IELTKRTLWSGLDAAS

SEQ ID NO: 77952 - protein, 16 aa, Mycobacterium tuberculosis
ELTKRTLWSGLDAASL

SEQ ID NO: 77953 - protein, 16 aa, Mycobacterium tuberculosis
LTKRTLWSGLDAASLE

SEQ ID NO: 77954 - protein, 16 aa, Mycobacterium tuberculosis
TKRTLWSGLDAASLEA

SEQ ID NO: 77955 - protein, 16 aa, Mycobacterium tuberculosis
KRTLWSGLDAASLEAH

SEQ ID NO: 77956 - protein, 16 aa, Mycobacterium tuberculosis
RTLWSGLDAASLEAHM

SEQ ID NO: 77957 - protein, 16 aa, Mycobacterium tuberculosis
TLWSGLDAASLEAHMQ

SEQ ID NO: 77958 - protein, 16 aa, Mycobacterium tuberculosis
LWSGLDAASLEAHMQA

SEQ ID NO: 77959 - protein, 16 aa, Mycobacterium tuberculosis
WSGLDAASLEAHMQAE

SEQ ID NO: 77960 - protein, 16 aa, Mycobacterium tuberculosis
SGLDAASLEAHMQAEG

SEQ ID NO: 77961 - protein, 16 aa, Mycobacterium tuberculosis
GLDAASLEAHMQAEGL

SEQ ID NO: 77962 - protein, 16 aa, Mycobacterium tuberculosis
LDAASLEAHMQAEGLG

SEQ ID NO: 77963 - protein, 16 aa, Mycobacterium tuberculosis
DAASLEAHMQAEGLGQ

SEQ ID NO: 77964 - protein, 16 aa, Mycobacterium tuberculosis
AASLEAHMQAEGLGQL

SEQ ID NO: 77965 - protein, 16 aa, Mycobacterium tuberculosis
ASLEAHMQAEGLGQLF

SEQ ID NO: 77966 - protein, 16 aa, Mycobacterium tuberculosis
SLEAHMQAEGLGQLFV

SEQ ID NO: 77967 - protein, 16 aa, Mycobacterium tuberculosis
LEAHMQAEGLGQLFVR

SEQ ID NO: 77968 - protein, 16 aa, Mycobacterium tuberculosis
EAHMQAEGLGQLFVRL

SEQ ID NO: 77969 - protein, 16 aa, Mycobacterium tuberculosis
AHMQAEGLGQLFVRLL

SEQ ID NO: 77970 - protein, 16 aa, Mycobacterium tuberculosis
HMQAEGLGQLFVRLLT

SEQ ID NO: 77971 - protein, 16 aa, Mycobacterium tuberculosis
MQAEGLGQLFVRLLTA

SEQ ID NO: 77972 - protein, 16 aa, Mycobacterium tuberculosis
QAEGLGQLFVRLLTAN

SEQ ID NO: 77973 - protein, 16 aa, Mycobacterium tuberculosis
AEGLGQLFVRLLTANF

SEQ ID NO: 77974 - protein, 16 aa, Mycobacterium tuberculosis
EGLGQLFVRLLTANFE

SEQ ID NO: 77975 - protein, 16 aa, Mycobacterium tuberculosis
GLGQLFVRLLTANFEE

SEQ ID NO: 77976 - protein, 16 aa, Mycobacterium tuberculosis
LGQLFVRLLTANFEEA

SEQ ID NO: 77977 - protein, 16 aa, Mycobacterium tuberculosis
GQLFVRLLTANFEEAV

SEQ ID NO: 77978 - protein, 16 aa, Mycobacterium tuberculosis
QLFVRLLTANFEEAVA

SEQ ID NO: 77979 - protein, 16 aa, Mycobacterium tuberculosis
LFVRLLTANFEEAVAA

SEQ ID NO: 77980 - protein, 16 aa, Mycobacterium tuberculosis
FVRLLTANFEEAVAAR

SEQ ID NO: 77981 - protein, 16 aa, Mycobacterium tuberculosis
VRLLTANFEEAVAARA

SEQ ID NO: 77982 - protein, 16 aa, Mycobacterium tuberculosis
RLLTANFEEAVAARAE

SEQ ID NO: 77983 - protein, 16 aa, Mycobacterium tuberculosis
LLTANFEEAVAARAEQ

SEQ ID NO: 77984 - protein, 16 aa, Mycobacterium tuberculosis
LTANFEEAVAARAEQR

SEQ ID NO: 77985 - protein, 16 aa, Mycobacterium tuberculosis
TANFEEAVAARAEQRA

SEQ ID NO: 77986 - protein, 16 aa, Mycobacterium tuberculosis
ANFEEAVAARAEQRAP

SEQ ID NO: 77987 - protein, 16 aa, Mycobacterium tuberculosis
NFEEAVAARAEQRAPV

SEQ ID NO: 77988 - protein, 16 aa, Mycobacterium tuberculosis
FEEAVAARAEQRAPVF

SEQ ID NO: 77989 - protein, 16 aa, Mycobacterium tuberculosis
EEAVAARAEQRAPVFT

SEQ ID NO: 77990 - protein, 16 aa, Mycobacterium tuberculosis
EAVAARAEQRAPVFTD

SEQ ID NO: 77991 - protein, 16 aa, Mycobacterium tuberculosis
AVAARAEQRAPVFTDD

SEQ ID NO: 77992 - protein, 16 aa, Mycobacterium tuberculosis
VAARAEQRAPVFTDDT

SEQ ID NO: 77993 - protein, 13 aa, Mycobacterium tuberculosis
MTAQHNIVVIGGG

SEQ ID NO: 77994 - protein, 13 aa, Mycobacterium tuberculosis
TAQHNIVVIGGGG

SEQ ID NO: 77995 - protein, 13 aa, Mycobacterium tuberculosis
AQHNIVVIGGGGA

SEQ ID NO: 77996 - protein, 13 aa, Mycobacterium tuberculosis
QHNIVVIGGGGAG

SEQ ID NO: 77997 - protein, 13 aa, Mycobacterium tuberculosis
HNIVVIGGGGAGL

SEQ ID NO: 77998 - protein, 13 aa, Mycobacterium tuberculosis
NIVVIGGGGAGLR

SEQ ID NO: 77999 - protein, 13 aa, Mycobacterium tuberculosis
IVVIGGGGAGLRA

SEQ ID NO: 78000 - protein, 13 aa, Mycobacterium tuberculosis
VVIGGGGAGLRAA

SEQ ID NO: 78001 - protein, 13 aa, Mycobacterium tuberculosis
VIGGGGAGLRAAI

SEQ ID NO: 78002 - protein, 13 aa, Mycobacterium tuberculosis
IGGGGAGLRAAIA

SEQ ID NO: 78003 - protein, 13 aa, Mycobacterium tuberculosis
GGGGAGLRAAIAI

SEQ ID NO: 78004 - protein, 13 aa, Mycobacterium tuberculosis
GGGAGLRAAIAIA

SEQ ID NO: 78005 - protein, 13 aa, Mycobacterium tuberculosis
GGAGLRAAIAIAE

SEQ ID NO: 78006 - protein, 13 aa, Mycobacterium tuberculosis
GAGLRAAIAIAET

SEQ ID NO: 78007 - protein, 13 aa, Mycobacterium tuberculosis
AGLRAAIAIAETN

SEQ ID NO: 78008 - protein, 13 aa, Mycobacterium tuberculosis
GLRAAIAIAETNP

SEQ ID NO: 78009 - protein, 13 aa, Mycobacterium tuberculosis
LRAAIAIAETNPH

SEQ ID NO: 78010 - protein, 13 aa, Mycobacterium tuberculosis
RAAIAIAETNPHL

SEQ ID NO: 78011 - protein, 13 aa, Mycobacterium tuberculosis
AAIAIAETNPHLD

SEQ ID NO: 78012 - protein, 13 aa, Mycobacterium tuberculosis
AIAIAETNPHLDV

SEQ ID NO: 78013 - protein, 13 aa, Mycobacterium tuberculosis
IAIAETNPHLDVA

SEQ ID NO: 78014 - protein, 13 aa, Mycobacterium tuberculosis
AIAETNPHLDVAI

SEQ ID NO: 78015 - protein, 13 aa, Mycobacterium tuberculosis
IAETNPHLDVAIV

SEQ ID NO: 78016 - protein, 13 aa, Mycobacterium tuberculosis
AETNPHLDVAIVS

SEQ ID NO: 78017 - protein, 13 aa, Mycobacterium tuberculosis
ETNPHLDVAIVSK

SEQ ID NO: 78018 - protein, 13 aa, Mycobacterium tuberculosis
TNPHLDVAIVSKV

SEQ ID NO: 78019 - protein, 13 aa, Mycobacterium tuberculosis
NPHLDVAIVSKVY

SEQ ID NO: 78020 - protein, 13 aa, Mycobacterium tuberculosis
PHLDVAIVSKVYP

SEQ ID NO: 78021 - protein, 13 aa, Mycobacterium tuberculosis
HLDVAIVSKVYPM

SEQ ID NO: 78022 - protein, 13 aa, Mycobacterium tuberculosis
LDVAIVSKVYPMR

SEQ ID NO: 78023 - protein, 13 aa, Mycobacterium tuberculosis
DVAIVSKVYPMRS

SEQ ID NO: 78024 - protein, 13 aa, Mycobacterium tuberculosis
VAIVSKVYPMRSH

SEQ ID NO: 78025 - protein, 13 aa, Mycobacterium tuberculosis
AIVSKVYPMRSHT

SEQ ID NO: 78026 - protein, 13 aa, Mycobacterium tuberculosis
IVSKVYPMRSHTV

SEQ ID NO: 78027 - protein, 13 aa, Mycobacterium tuberculosis
VSKVYPMRSHTVS

SEQ ID NO: 78028 - protein, 13 aa, Mycobacterium tuberculosis
SKVYPMRSHTVSA

SEQ ID NO: 78029 - protein, 13 aa, Mycobacterium tuberculosis
KVYPMRSHTVSAE

SEQ ID NO: 78030 - protein, 13 aa, Mycobacterium tuberculosis
VYPMRSHTVSAEG

SEQ ID NO: 78031 - protein, 13 aa, Mycobacterium tuberculosis
YPMRSHTVSAEGG

SEQ ID NO: 78032 - protein, 13 aa, Mycobacterium tuberculosis
PMRSHTVSAEGGA

SEQ ID NO: 78033 - protein, 13 aa, Mycobacterium tuberculosis
MRSHTVSAEGGAA

SEQ ID NO: 78034 - protein, 13 aa, Mycobacterium tuberculosis
RSHTVSAEGGAAA

SEQ ID NO: 78035 - protein, 13 aa, Mycobacterium tuberculosis
SHTVSAEGGAAAV

SEQ ID NO: 78036 - protein, 13 aa, Mycobacterium tuberculosis
HTVSAEGGAAAVT

SEQ ID NO: 78037 - protein, 13 aa, Mycobacterium tuberculosis
TVSAEGGAAAVTG

SEQ ID NO: 78038 - protein, 13 aa, Mycobacterium tuberculosis
VSAEGGAAAVTGD

SEQ ID NO: 78039 - protein, 13 aa, Mycobacterium tuberculosis
SAEGGAAAVTGDD

SEQ ID NO: 78040 - protein, 13 aa, Mycobacterium tuberculosis
AEGGAAAVTGDDD

SEQ ID NO: 78041 - protein, 13 aa, Mycobacterium tuberculosis
EGGAAAVTGDDDS

SEQ ID NO: 78042 - protein, 13 aa, Mycobacterium tuberculosis
GGAAAVTGDDDSL

SEQ ID NO: 78043 - protein, 13 aa, Mycobacterium tuberculosis
GAAAVTGDDDSLD

SEQ ID NO: 78044 - protein, 13 aa, Mycobacterium tuberculosis
AAAVTGDDDSLDE

SEQ ID NO: 78045 - protein, 13 aa, Mycobacterium tuberculosis
AAVTGDDDSLDEH

SEQ ID NO: 78046 - protein, 13 aa, Mycobacterium tuberculosis
AVTGDDDSLDEHA

SEQ ID NO: 78047 - protein, 13 aa, Mycobacterium tuberculosis
VTGDDDSLDEHAH

SEQ ID NO: 78048 - protein, 13 aa, Mycobacterium tuberculosis
TGDDDSLDEHAHD

SEQ ID NO: 78049 - protein, 13 aa, Mycobacterium tuberculosis
GDDDSLDEHAHDT

SEQ ID NO: 78050 - protein, 13 aa, Mycobacterium tuberculosis
DDDSLDEHAHDTV

SEQ ID NO: 78051 - protein, 13 aa, Mycobacterium tuberculosis
DDSLDEHAHDTVS

SEQ ID NO: 78052 - protein, 13 aa, Mycobacterium tuberculosis
DSLDEHAHDTVSG

SEQ ID NO: 78053 - protein, 13 aa, Mycobacterium tuberculosis
SLDEHAHDTVSGG

SEQ ID NO: 78054 - protein, 13 aa, Mycobacterium tuberculosis
LDEHAHDTVSGGD

SEQ ID NO: 78055 - protein, 13 aa, Mycobacterium tuberculosis
DEHAHDTVSGGDW

SEQ ID NO: 78056 - protein, 13 aa, Mycobacterium tuberculosis
EHAHDTVSGGDWL

SEQ ID NO: 78057 - protein, 13 aa, Mycobacterium tuberculosis
HAHDTVSGGDWLC

SEQ ID NO: 78058 - protein, 13 aa, Mycobacterium tuberculosis
AHDTVSGGDWLCD

SEQ ID NO: 78059 - protein, 13 aa, Mycobacterium tuberculosis
HDTVSGGDWLCDQ

SEQ ID NO: 78060 - protein, 13 aa, Mycobacterium tuberculosis
DTVSGGDWLCDQD

SEQ ID NO: 78061 - protein, 13 aa, Mycobacterium tuberculosis
TVSGGDWLCDQDA

SEQ ID NO: 78062 - protein, 13 aa, Mycobacterium tuberculosis
VSGGDWLCDQDAV

SEQ ID NO: 78063 - protein, 13 aa, Mycobacterium tuberculosis
SGGDWLCDQDAVE

SEQ ID NO: 78064 - protein, 13 aa, Mycobacterium tuberculosis
GGDWLCDQDAVEA

SEQ ID NO: 78065 - protein, 13 aa, Mycobacterium tuberculosis
GDWLCDQDAVEAF

SEQ ID NO: 78066 - protein, 13 aa, Mycobacterium tuberculosis
DWLCDQDAVEAFV

SEQ ID NO: 78067 - protein, 13 aa, Mycobacterium tuberculosis
WLCDQDAVEAFVA

SEQ ID NO: 78068 - protein, 13 aa, Mycobacterium tuberculosis
LCDQDAVEAFVAE

SEQ ID NO: 78069 - protein, 13 aa, Mycobacterium tuberculosis
CDQDAVEAFVAEA

SEQ ID NO: 78070 - protein, 13 aa, Mycobacterium tuberculosis
DQDAVEAFVAEAP

SEQ ID NO: 78071 - protein, 13 aa, Mycobacterium tuberculosis
QDAVEAFVAEAPK

SEQ ID NO: 78072 - protein, 13 aa, Mycobacterium tuberculosis
DAVEAFVAEAPKE

SEQ ID NO: 78073 - protein, 13 aa, Mycobacterium tuberculosis
AVEAFVAEAPKEL

SEQ ID NO: 78074 - protein, 13 aa, Mycobacterium tuberculosis
VEAFVAEAPKELV

SEQ ID NO: 78075 - protein, 13 aa, Mycobacterium tuberculosis
EAFVAEAPKELVQ

SEQ ID NO: 78076 - protein, 13 aa, Mycobacterium tuberculosis
AFVAEAPKELVQL

SEQ ID NO: 78077 - protein, 13 aa, Mycobacterium tuberculosis
FVAEAPKELVQLE

SEQ ID NO: 78078 - protein, 13 aa, Mycobacterium tuberculosis
VAEAPKELVQLEH

SEQ ID NO: 78079 - protein, 13 aa, Mycobacterium tuberculosis
AEAPKELVQLEHW

SEQ ID NO: 78080 - protein, 13 aa, Mycobacterium tuberculosis
EAPKELVQLEHWG

SEQ ID NO: 78081 - protein, 13 aa, Mycobacterium tuberculosis
APKELVQLEHWGC

SEQ ID NO: 78082 - protein, 13 aa, Mycobacterium tuberculosis
PKELVQLEHWGCP

SEQ ID NO: 78083 - protein, 13 aa, Mycobacterium tuberculosis
KELVQLEHWGCPW

SEQ ID NO: 78084 - protein, 13 aa, Mycobacterium tuberculosis
ELVQLEHWGCPWS

SEQ ID NO: 78085 - protein, 13 aa, Mycobacterium tuberculosis
LVQLEHWGCPWSR

SEQ ID NO: 78086 - protein, 13 aa, Mycobacterium tuberculosis
VQLEHWGCPWSRK

SEQ ID NO: 78087 - protein, 13 aa, Mycobacterium tuberculosis
QLEHWGCPWSRKP

SEQ ID NO: 78088 - protein, 13 aa, Mycobacterium tuberculosis
LEHWGCPWSRKPD

SEQ ID NO: 78089 - protein, 13 aa, Mycobacterium tuberculosis
EHWGCPWSRKPDG

SEQ ID NO: 78090 - protein, 13 aa, Mycobacterium tuberculosis
HWGCPWSRKPDGR

SEQ ID NO: 78091 - protein, 13 aa, Mycobacterium tuberculosis
WGCPWSRKPDGRV

SEQ ID NO: 78092 - protein, 13 aa, Mycobacterium tuberculosis
GCPWSRKPDGRVA

SEQ ID NO: 78093 - protein, 13 aa, Mycobacterium tuberculosis
CPWSRKPDGRVAV

SEQ ID NO: 78094 - protein, 13 aa, Mycobacterium tuberculosis
PWSRKPDGRVAVR

SEQ ID NO: 78095 - protein, 13 aa, Mycobacterium tuberculosis
WSRKPDGRVAVRP

SEQ ID NO: 78096 - protein, 13 aa, Mycobacterium tuberculosis
SRKPDGRVAVRPF

SEQ ID NO: 78097 - protein, 13 aa, Mycobacterium tuberculosis
RKPDGRVAVRPFG

SEQ ID NO: 78098 - protein, 13 aa, Mycobacterium tuberculosis
KPDGRVAVRPFGG

SEQ ID NO: 78099 - protein, 13 aa, Mycobacterium tuberculosis
PDGRVAVRPFGGM

SEQ ID NO: 78100 - protein, 13 aa, Mycobacterium tuberculosis
DGRVAVRPFGGMK

SEQ ID NO: 78101 - protein, 13 aa, Mycobacterium tuberculosis
GRVAVRPFGGMKK

SEQ ID NO: 78102 - protein, 13 aa, Mycobacterium tuberculosis
RVAVRPFGGMKKL

SEQ ID NO: 78103 - protein, 13 aa, Mycobacterium tuberculosis
VAVRPFGGMKKLR

SEQ ID NO: 78104 - protein, 13 aa, Mycobacterium tuberculosis
AVRPFGGMKKLRT

SEQ ID NO: 78105 - protein, 13 aa, Mycobacterium tuberculosis
VRPFGGMKKLRTW

SEQ ID NO: 78106 - protein, 13 aa, Mycobacterium tuberculosis
RPFGGMKKLRTWF

SEQ ID NO: 78107 - protein, 13 aa, Mycobacterium tuberculosis
PFGGMKKLRTWFA

SEQ ID NO: 78108 - protein, 13 aa, Mycobacterium tuberculosis
FGGMKKLRTWFAA

SEQ ID NO: 78109 - protein, 13 aa, Mycobacterium tuberculosis
GGMKKLRTWFAAD

SEQ ID NO: 78110 - protein, 13 aa, Mycobacterium tuberculosis
GMKKLRTWFAADK

SEQ ID NO: 78111 - protein, 13 aa, Mycobacterium tuberculosis
MKKLRTWFAADKT

SEQ ID NO: 78112 - protein, 13 aa, Mycobacterium tuberculosis
KKLRTWFAADKTG

SEQ ID NO: 78113 - protein, 13 aa, Mycobacterium tuberculosis
KLRTWFAADKTGF

SEQ ID NO: 78114 - protein, 13 aa, Mycobacterium tuberculosis
LRTWFAADKTGFH

SEQ ID NO: 78115 - protein, 13 aa, Mycobacterium tuberculosis
RTWFAADKTGFHL

SEQ ID NO: 78116 - protein, 13 aa, Mycobacterium tuberculosis
TWFAADKTGFHLL

SEQ ID NO: 78117 - protein, 13 aa, Mycobacterium tuberculosis
WFAADKTGFHLLH

SEQ ID NO: 78118 - protein, 13 aa, Mycobacterium tuberculosis
FAADKTGFHLLHT

SEQ ID NO: 78119 - protein, 13 aa, Mycobacterium tuberculosis
AADKTGFHLLHTL

SEQ ID NO: 78120 - protein, 13 aa, Mycobacterium tuberculosis
ADKTGFHLLHTLF

SEQ ID NO: 78121 - protein, 13 aa, Mycobacterium tuberculosis
DKTGFHLLHTLFQ

SEQ ID NO: 78122 - protein, 13 aa, Mycobacterium tuberculosis
KTGFHLLHTLFQR

SEQ ID NO: 78123 - protein, 13 aa, Mycobacterium tuberculosis
TGFHLLHTLFQRL

SEQ ID NO: 78124 - protein, 13 aa, Mycobacterium tuberculosis
GFHLLHTLFQRLL

SEQ ID NO: 78125 - protein, 13 aa, Mycobacterium tuberculosis
FHLLHTLFQRLLT

SEQ ID NO: 78126 - protein, 13 aa, Mycobacterium tuberculosis
HLLHTLFQRLLTY

SEQ ID NO: 78127 - protein, 13 aa, Mycobacterium tuberculosis
LLHTLFQRLLTYS

SEQ ID NO: 78128 - protein, 13 aa, Mycobacterium tuberculosis
LHTLFQRLLTYSD

SEQ ID NO: 78129 - protein, 13 aa, Mycobacterium tuberculosis
HTLFQRLLTYSDV

SEQ ID NO: 78130 - protein, 13 aa, Mycobacterium tuberculosis
TLFQRLLTYSDVM

SEQ ID NO: 78131 - protein, 13 aa, Mycobacterium tuberculosis
LFQRLLTYSDVMR

SEQ ID NO: 78132 - protein, 13 aa, Mycobacterium tuberculosis
FQRLLTYSDVMRY

SEQ ID NO: 78133 - protein, 13 aa, Mycobacterium tuberculosis
QRLLTYSDVMRYD

SEQ ID NO: 78134 - protein, 13 aa, Mycobacterium tuberculosis
RLLTYSDVMRYDE

SEQ ID NO: 78135 - protein, 13 aa, Mycobacterium tuberculosis
LLTYSDVMRYDEW

SEQ ID NO: 78136 - protein, 13 aa, Mycobacterium tuberculosis
LTYSDVMRYDEWF

SEQ ID NO: 78137 - protein, 13 aa, Mycobacterium tuberculosis
TYSDVMRYDEWFA

SEQ ID NO: 78138 - protein, 13 aa, Mycobacterium tuberculosis
YSDVMRYDEWFAT

SEQ ID NO: 78139 - protein, 13 aa, Mycobacterium tuberculosis
SDVMRYDEWFATT

SEQ ID NO: 78140 - protein, 13 aa, Mycobacterium tuberculosis
DVMRYDEWFATTL

SEQ ID NO: 78141 - protein, 13 aa, Mycobacterium tuberculosis
VMRYDEWFATTLL

SEQ ID NO: 78142 - protein, 13 aa, Mycobacterium tuberculosis
MRYDEWFATTLLV

SEQ ID NO: 78143 - protein, 13 aa, Mycobacterium tuberculosis
RYDEWFATTLLVD

SEQ ID NO: 78144 - protein, 13 aa, Mycobacterium tuberculosis
YDEWFATTLLVDD

SEQ ID NO: 78145 - protein, 13 aa, Mycobacterium tuberculosis
DEWFATTLLVDDG

SEQ ID NO: 78146 - protein, 13 aa, Mycobacterium tuberculosis
EWFATTLLVDDGR

SEQ ID NO: 78147 - protein, 13 aa, Mycobacterium tuberculosis
WFATTLLVDDGRV

SEQ ID NO: 78148 - protein, 13 aa, Mycobacterium tuberculosis
FATTLLVDDGRVC

SEQ ID NO: 78149 - protein, 13 aa, Mycobacterium tuberculosis
ATTLLVDDGRVCG

SEQ ID NO: 78150 - protein, 13 aa, Mycobacterium tuberculosis
TTLLVDDGRVCGL

SEQ ID NO: 78151 - protein, 13 aa, Mycobacterium tuberculosis
TLLVDDGRVCGLV

SEQ ID NO: 78152 - protein, 13 aa, Mycobacterium tuberculosis
LLVDDGRVCGLVA

SEQ ID NO: 78153 - protein, 13 aa, Mycobacterium tuberculosis
LVDDGRVCGLVAI

SEQ ID NO: 78154 - protein, 13 aa, Mycobacterium tuberculosis
VDDGRVCGLVAIE

SEQ ID NO: 78155 - protein, 13 aa, Mycobacterium tuberculosis
DDGRVCGLVAIEL

SEQ ID NO: 78156 - protein, 13 aa, Mycobacterium tuberculosis
DGRVCGLVAIELA

SEQ ID NO: 78157 - protein, 13 aa, Mycobacterium tuberculosis
GRVCGLVAIELAT

SEQ ID NO: 78158 - protein, 13 aa, Mycobacterium tuberculosis
RVCGLVAIELATG

SEQ ID NO: 78159 - protein, 13 aa, Mycobacterium tuberculosis
VCGLVAIELATGR

SEQ ID NO: 78160 - protein, 13 aa, Mycobacterium tuberculosis
CGLVAIELATGRI

SEQ ID NO: 78161 - protein, 13 aa, Mycobacterium tuberculosis
GLVAIELATGRIE

SEQ ID NO: 78162 - protein, 13 aa, Mycobacterium tuberculosis
LVAIELATGRIET

SEQ ID NO: 78163 - protein, 13 aa, Mycobacterium tuberculosis
VAIELATGRIETI

SEQ ID NO: 78164 - protein, 13 aa, Mycobacterium tuberculosis
AIELATGRIETIL

SEQ ID NO: 78165 - protein, 13 aa, Mycobacterium tuberculosis
IELATGRIETILA

SEQ ID NO: 78166 - protein, 13 aa, Mycobacterium tuberculosis
ELATGRIETILAD

SEQ ID NO: 78167 - protein, 13 aa, Mycobacterium tuberculosis
LATGRIETILADA

SEQ ID NO: 78168 - protein, 13 aa, Mycobacterium tuberculosis
ATGRIETILADAV

SEQ ID NO: 78169 - protein, 13 aa, Mycobacterium tuberculosis
TGRIETILADAVI

SEQ ID NO: 78170 - protein, 13 aa, Mycobacterium tuberculosis
GRIETILADAVIL

SEQ ID NO: 78171 - protein, 13 aa, Mycobacterium tuberculosis
RIETILADAVILC

SEQ ID NO: 78172 - protein, 13 aa, Mycobacterium tuberculosis
IETILADAVILCT

SEQ ID NO: 78173 - protein, 13 aa, Mycobacterium tuberculosis
ETILADAVILCTG

SEQ ID NO: 78174 - protein, 13 aa, Mycobacterium tuberculosis
TILADAVILCTGG

SEQ ID NO: 78175 - protein, 13 aa, Mycobacterium tuberculosis
ILADAVILCTGGC

SEQ ID NO: 78176 - protein, 13 aa, Mycobacterium tuberculosis
LADAVILCTGGCG

SEQ ID NO: 78177 - protein, 13 aa, Mycobacterium tuberculosis
ADAVILCTGGCGR

SEQ ID NO: 78178 - protein, 13 aa, Mycobacterium tuberculosis
DAVILCTGGCGRV

SEQ ID NO: 78179 - protein, 13 aa, Mycobacterium tuberculosis
AVILCTGGCGRVF

SEQ ID NO: 78180 - protein, 13 aa, Mycobacterium tuberculosis
VILCTGGCGRVFP

SEQ ID NO: 78181 - protein, 13 aa, Mycobacterium tuberculosis
ILCTGGCGRVFPF

SEQ ID NO: 78182 - protein, 13 aa, Mycobacterium tuberculosis
LCTGGCGRVFPFT

SEQ ID NO: 78183 - protein, 13 aa, Mycobacterium tuberculosis
CTGGCGRVFPFTT

SEQ ID NO: 78184 - protein, 13 aa, Mycobacterium tuberculosis
TGGCGRVFPFTTN

SEQ ID NO: 78185 - protein, 13 aa, Mycobacterium tuberculosis
GGCGRVFPFTTNA

SEQ ID NO: 78186 - protein, 13 aa, Mycobacterium tuberculosis
GCGRVFPFTTNAN

SEQ ID NO: 78187 - protein, 13 aa, Mycobacterium tuberculosis
CGRVFPFTTNANI

SEQ ID NO: 78188 - protein, 13 aa, Mycobacterium tuberculosis
GRVFPFTTNANIK

SEQ ID NO: 78189 - protein, 13 aa, Mycobacterium tuberculosis
RVFPFTTNANIKT

SEQ ID NO: 78190 - protein, 13 aa, Mycobacterium tuberculosis
VFPFTTNANIKTG

SEQ ID NO: 78191 - protein, 13 aa, Mycobacterium tuberculosis
FPFTTNANIKTGD

SEQ ID NO: 78192 - protein, 13 aa, Mycobacterium tuberculosis
PFTTNANIKTGDG

SEQ ID NO: 78193 - protein, 13 aa, Mycobacterium tuberculosis
FTTNANIKTGDGM

SEQ ID NO: 78194 - protein, 13 aa, Mycobacterium tuberculosis
TTNANIKTGDGMA

SEQ ID NO: 78195 - protein, 13 aa, Mycobacterium tuberculosis
TNANIKTGDGMAL

SEQ ID NO: 78196 - protein, 13 aa, Mycobacterium tuberculosis
NANIKTGDGMALA

SEQ ID NO: 78197 - protein, 13 aa, Mycobacterium tuberculosis
ANIKTGDGMALAF

SEQ ID NO: 78198 - protein, 13 aa, Mycobacterium tuberculosis
NIKTGDGMALAFR

SEQ ID NO: 78199 - protein, 13 aa, Mycobacterium tuberculosis
IKTGDGMALAFRA

SEQ ID NO: 78200 - protein, 13 aa, Mycobacterium tuberculosis
KTGDGMALAFRAG

SEQ ID NO: 78201 - protein, 13 aa, Mycobacterium tuberculosis
TGDGMALAFRAGA

SEQ ID NO: 78202 - protein, 13 aa, Mycobacterium tuberculosis
GDGMALAFRAGAP

SEQ ID NO: 78203 - protein, 13 aa, Mycobacterium tuberculosis
DGMALAFRAGAPL

SEQ ID NO: 78204 - protein, 13 aa, Mycobacterium tuberculosis
GMALAFRAGAPLK

SEQ ID NO: 78205 - protein, 13 aa, Mycobacterium tuberculosis
MALAFRAGAPLKD

SEQ ID NO: 78206 - protein, 13 aa, Mycobacterium tuberculosis
ALAFRAGAPLKDM

SEQ ID NO: 78207 - protein, 13 aa, Mycobacterium tuberculosis
LAFRAGAPLKDME

SEQ ID NO: 78208 - protein, 13 aa, Mycobacterium tuberculosis
AFRAGAPLKDMEF

SEQ ID NO: 78209 - protein, 13 aa, Mycobacterium tuberculosis
FRAGAPLKDMEFV

SEQ ID NO: 78210 - protein, 13 aa, Mycobacterium tuberculosis
RAGAPLKDMEFVQ

SEQ ID NO: 78211 - protein, 13 aa, Mycobacterium tuberculosis
AGAPLKDMEFVQY

SEQ ID NO: 78212 - protein, 13 aa, Mycobacterium tuberculosis
GAPLKDMEFVQYH

SEQ ID NO: 78213 - protein, 13 aa, Mycobacterium tuberculosis
APLKDMEFVQYHP

SEQ ID NO: 78214 - protein, 13 aa, Mycobacterium tuberculosis
PLKDMEFVQYHPT

SEQ ID NO: 78215 - protein, 13 aa, Mycobacterium tuberculosis
LKDMEFVQYHPTG

SEQ ID NO: 78216 - protein, 13 aa, Mycobacterium tuberculosis
KDMEFVQYHPTGL

SEQ ID NO: 78217 - protein, 13 aa, Mycobacterium tuberculosis
DMEFVQYHPTGLP

SEQ ID NO: 78218 - protein, 13 aa, Mycobacterium tuberculosis
MEFVQYHPTGLPF

SEQ ID NO: 78219 - protein, 13 aa, Mycobacterium tuberculosis
EFVQYHPTGLPFT

SEQ ID NO: 78220 - protein, 13 aa, Mycobacterium tuberculosis
FVQYHPTGLPFTG

SEQ ID NO: 78221 - protein, 13 aa, Mycobacterium tuberculosis
VQYHPTGLPFTGI

SEQ ID NO: 78222 - protein, 13 aa, Mycobacterium tuberculosis
QYHPTGLPFTGIL

SEQ ID NO: 78223 - protein, 13 aa, Mycobacterium tuberculosis
YHPTGLPFTGILI

SEQ ID NO: 78224 - protein, 13 aa, Mycobacterium tuberculosis
HPTGLPFTGILIT

SEQ ID NO: 78225 - protein, 13 aa, Mycobacterium tuberculosis
PTGLPFTGILITE

SEQ ID NO: 78226 - protein, 13 aa, Mycobacterium tuberculosis
TGLPFTGILITEA

SEQ ID NO: 78227 - protein, 13 aa, Mycobacterium tuberculosis
GLPFTGILITEAA

SEQ ID NO: 78228 - protein, 13 aa, Mycobacterium tuberculosis
LPFTGILITEAAR

SEQ ID NO: 78229 - protein, 13 aa, Mycobacterium tuberculosis
PFTGILITEAARA

SEQ ID NO: 78230 - protein, 13 aa, Mycobacterium tuberculosis
FTGILITEAARAE

SEQ ID NO: 78231 - protein, 13 aa, Mycobacterium tuberculosis
TGILITEAARAEG

SEQ ID NO: 78232 - protein, 13 aa, Mycobacterium tuberculosis
GILITEAARAEGG

SEQ ID NO: 78233 - protein, 13 aa, Mycobacterium tuberculosis
ILITEAARAEGGW

SEQ ID NO: 78234 - protein, 13 aa, Mycobacterium tuberculosis
LITEAARAEGGWL

SEQ ID NO: 78235 - protein, 13 aa, Mycobacterium tuberculosis
ITEAARAEGGWLL

SEQ ID NO: 78236 - protein, 13 aa, Mycobacterium tuberculosis
TEAARAEGGWLLN

SEQ ID NO: 78237 - protein, 13 aa, Mycobacterium tuberculosis
EAARAEGGWLLNK

SEQ ID NO: 78238 - protein, 13 aa, Mycobacterium tuberculosis
AARAEGGWLLNKD

SEQ ID NO: 78239 - protein, 13 aa, Mycobacterium tuberculosis
ARAEGGWLLNKDG

SEQ ID NO: 78240 - protein, 13 aa, Mycobacterium tuberculosis
RAEGGWLLNKDGY

SEQ ID NO: 78241 - protein, 13 aa, Mycobacterium tuberculosis
AEGGWLLNKDGYR

SEQ ID NO: 78242 - protein, 13 aa, Mycobacterium tuberculosis
EGGWLLNKDGYRY

SEQ ID NO: 78243 - protein, 13 aa, Mycobacterium tuberculosis
GGWLLNKDGYRYL

SEQ ID NO: 78244 - protein, 13 aa, Mycobacterium tuberculosis
GWLLNKDGYRYLQ

SEQ ID NO: 78245 - protein, 13 aa, Mycobacterium tuberculosis
WLLNKDGYRYLQD

SEQ ID NO: 78246 - protein, 13 aa, Mycobacterium tuberculosis
LLNKDGYRYLQDY

SEQ ID NO: 78247 - protein, 13 aa, Mycobacterium tuberculosis
LNKDGYRYLQDYD

SEQ ID NO: 78248 - protein, 13 aa, Mycobacterium tuberculosis
NKDGYRYLQDYDL

SEQ ID NO: 78249 - protein, 13 aa, Mycobacterium tuberculosis
KDGYRYLQDYDLG

SEQ ID NO: 78250 - protein, 13 aa, Mycobacterium tuberculosis
DGYRYLQDYDLGK

SEQ ID NO: 78251 - protein, 13 aa, Mycobacterium tuberculosis
GYRYLQDYDLGKP

SEQ ID NO: 78252 - protein, 13 aa, Mycobacterium tuberculosis
YRYLQDYDLGKPT

SEQ ID NO: 78253 - protein, 13 aa, Mycobacterium tuberculosis
RYLQDYDLGKPTP

SEQ ID NO: 78254 - protein, 13 aa, Mycobacterium tuberculosis
YLQDYDLGKPTPE

SEQ ID NO: 78255 - protein, 13 aa, Mycobacterium tuberculosis
LQDYDLGKPTPEP

SEQ ID NO: 78256 - protein, 13 aa, Mycobacterium tuberculosis
QDYDLGKPTPEPR

SEQ ID NO: 78257 - protein, 13 aa, Mycobacterium tuberculosis
DYDLGKPTPEPRL

SEQ ID NO: 78258 - protein, 13 aa, Mycobacterium tuberculosis
YDLGKPTPEPRLR

SEQ ID NO: 78259 - protein, 13 aa, Mycobacterium tuberculosis
DLGKPTPEPRLRS

SEQ ID NO: 78260 - protein, 13 aa, Mycobacterium tuberculosis
LGKPTPEPRLRSM

SEQ ID NO: 78261 - protein, 13 aa, Mycobacterium tuberculosis
GKPTPEPRLRSME

SEQ ID NO: 78262 - protein, 13 aa, Mycobacterium tuberculosis
KPTPEPRLRSMEL

SEQ ID NO: 78263 - protein, 13 aa, Mycobacterium tuberculosis
PTPEPRLRSMELG

SEQ ID NO: 78264 - protein, 13 aa, Mycobacterium tuberculosis
TPEPRLRSMELGP

SEQ ID NO: 78265 - protein, 13 aa, Mycobacterium tuberculosis
PEPRLRSMELGPR

SEQ ID NO: 78266 - protein, 13 aa, Mycobacterium tuberculosis
EPRLRSMELGPRD

SEQ ID NO: 78267 - protein, 13 aa, Mycobacterium tuberculosis
PRLRSMELGPRDR

SEQ ID NO: 78268 - protein, 13 aa, Mycobacterium tuberculosis
RLRSMELGPRDRL

SEQ ID NO: 78269 - protein, 13 aa, Mycobacterium tuberculosis
LRSMELGPRDRLS

SEQ ID NO: 78270 - protein, 13 aa, Mycobacterium tuberculosis
RSMELGPRDRLSQ

SEQ ID NO: 78271 - protein, 13 aa, Mycobacterium tuberculosis
SMELGPRDRLSQA

SEQ ID NO: 78272 - protein, 13 aa, Mycobacterium tuberculosis
MELGPRDRLSQAF

SEQ ID NO: 78273 - protein, 13 aa, Mycobacterium tuberculosis
ELGPRDRLSQAFV

SEQ ID NO: 78274 - protein, 13 aa, Mycobacterium tuberculosis
LGPRDRLSQAFVH

SEQ ID NO: 78275 - protein, 13 aa, Mycobacterium tuberculosis
GPRDRLSQAFVHE

SEQ ID NO: 78276 - protein, 13 aa, Mycobacterium tuberculosis
PRDRLSQAFVHEH

SEQ ID NO: 78277 - protein, 13 aa, Mycobacterium tuberculosis
RDRLSQAFVHEHN

SEQ ID NO: 78278 - protein, 13 aa, Mycobacterium tuberculosis
DRLSQAFVHEHNK

SEQ ID NO: 78279 - protein, 13 aa, Mycobacterium tuberculosis
RLSQAFVHEHNKG

SEQ ID NO: 78280 - protein, 13 aa, Mycobacterium tuberculosis
LSQAFVHEHNKGR

SEQ ID NO: 78281 - protein, 13 aa, Mycobacterium tuberculosis
SQAFVHEHNKGRT

SEQ ID NO: 78282 - protein, 13 aa, Mycobacterium tuberculosis
QAFVHEHNKGRTV

SEQ ID NO: 78283 - protein, 13 aa, Mycobacterium tuberculosis
AFVHEHNKGRTVD

SEQ ID NO: 78284 - protein, 13 aa, Mycobacterium tuberculosis
FVHEHNKGRTVDT

SEQ ID NO: 78285 - protein, 13 aa, Mycobacterium tuberculosis
VHEHNKGRTVDTP

SEQ ID NO: 78286 - protein, 13 aa, Mycobacterium tuberculosis
HEHNKGRTVDTPY

SEQ ID NO: 78287 - protein, 13 aa, Mycobacterium tuberculosis
EHNKGRTVDTPYG

SEQ ID NO: 78288 - protein, 13 aa, Mycobacterium tuberculosis
HNKGRTVDTPYGP

SEQ ID NO: 78289 - protein, 13 aa, Mycobacterium tuberculosis
NKGRTVDTPYGPV

SEQ ID NO: 78290 - protein, 13 aa, Mycobacterium tuberculosis
KGRTVDTPYGPVV

SEQ ID NO: 78291 - protein, 13 aa, Mycobacterium tuberculosis
GRTVDTPYGPVVY

SEQ ID NO: 78292 - protein, 13 aa, Mycobacterium tuberculosis
RTVDTPYGPVVYL

SEQ ID NO: 78293 - protein, 13 aa, Mycobacterium tuberculosis
TVDTPYGPVVYLD

SEQ ID NO: 78294 - protein, 13 aa, Mycobacterium tuberculosis
VDTPYGPVVYLDL

SEQ ID NO: 78295 - protein, 13 aa, Mycobacterium tuberculosis
DTPYGPVVYLDLR

SEQ ID NO: 78296 - protein, 13 aa, Mycobacterium tuberculosis
TPYGPVVYLDLRH

SEQ ID NO: 78297 - protein, 13 aa, Mycobacterium tuberculosis
PYGPVVYLDLRHL

SEQ ID NO: 78298 - protein, 13 aa, Mycobacterium tuberculosis
YGPVVYLDLRHLG

SEQ ID NO: 78299 - protein, 13 aa, Mycobacterium tuberculosis
GPVVYLDLRHLGA

SEQ ID NO: 78300 - protein, 13 aa, Mycobacterium tuberculosis
PVVYLDLRHLGAD

SEQ ID NO: 78301 - protein, 13 aa, Mycobacterium tuberculosis
VVYLDLRHLGADL

SEQ ID NO: 78302 - protein, 13 aa, Mycobacterium tuberculosis
VYLDLRHLGADLI

SEQ ID NO: 78303 - protein, 13 aa, Mycobacterium tuberculosis
YLDLRHLGADLID

SEQ ID NO: 78304 - protein, 13 aa, Mycobacterium tuberculosis
LDLRHLGADLIDA

SEQ ID NO: 78305 - protein, 13 aa, Mycobacterium tuberculosis
DLRHLGADLIDAK

SEQ ID NO: 78306 - protein, 13 aa, Mycobacterium tuberculosis
LRHLGADLIDAKL

SEQ ID NO: 78307 - protein, 13 aa, Mycobacterium tuberculosis
RHLGADLIDAKLP

SEQ ID NO: 78308 - protein, 13 aa, Mycobacterium tuberculosis
HLGADLIDAKLPF

SEQ ID NO: 78309 - protein, 13 aa, Mycobacterium tuberculosis
LGADLIDAKLPFV

SEQ ID NO: 78310 - protein, 13 aa, Mycobacterium tuberculosis
GADLIDAKLPFVR

SEQ ID NO: 78311 - protein, 13 aa, Mycobacterium tuberculosis
ADLIDAKLPFVRE

SEQ ID NO: 78312 - protein, 13 aa, Mycobacterium tuberculosis
DLIDAKLPFVREL

SEQ ID NO: 78313 - protein, 13 aa, Mycobacterium tuberculosis
LIDAKLPFVRELC

SEQ ID NO: 78314 - protein, 13 aa, Mycobacterium tuberculosis
IDAKLPFVRELCR

SEQ ID NO: 78315 - protein, 13 aa, Mycobacterium tuberculosis
DAKLPFVRELCRD

SEQ ID NO: 78316 - protein, 13 aa, Mycobacterium tuberculosis
AKLPFVRELCRDY

SEQ ID NO: 78317 - protein, 13 aa, Mycobacterium tuberculosis
KLPFVRELCRDYQ

SEQ ID NO: 78318 - protein, 13 aa, Mycobacterium tuberculosis
LPFVRELCRDYQH

SEQ ID NO: 78319 - protein, 13 aa, Mycobacterium tuberculosis
PFVRELCRDYQHI

SEQ ID NO: 78320 - protein, 13 aa, Mycobacterium tuberculosis
FVRELCRDYQHID

SEQ ID NO: 78321 - protein, 13 aa, Mycobacterium tuberculosis
VRELCRDYQHIDP

SEQ ID NO: 78322 - protein, 13 aa, Mycobacterium tuberculosis
RELCRDYQHIDPV

SEQ ID NO: 78323 - protein, 13 aa, Mycobacterium tuberculosis
ELCRDYQHIDPVV

SEQ ID NO: 78324 - protein, 13 aa, Mycobacterium tuberculosis
LCRDYQHIDPVVE

SEQ ID NO: 78325 - protein, 13 aa, Mycobacterium tuberculosis
CRDYQHIDPVVEL

SEQ ID NO: 78326 - protein, 13 aa, Mycobacterium tuberculosis
RDYQHIDPVVELV

SEQ ID NO: 78327 - protein, 13 aa, Mycobacterium tuberculosis
DYQHIDPVVELVP

SEQ ID NO: 78328 - protein, 13 aa, Mycobacterium tuberculosis
YQHIDPVVELVPV

SEQ ID NO: 78329 - protein, 13 aa, Mycobacterium tuberculosis
QHIDPVVELVPVR

SEQ ID NO: 78330 - protein, 13 aa, Mycobacterium tuberculosis
HIDPVVELVPVRP

SEQ ID NO: 78331 - protein, 13 aa, Mycobacterium tuberculosis
IDPVVELVPVRPV

SEQ ID NO: 78332 - protein, 13 aa, Mycobacterium tuberculosis
DPVVELVPVRPVV

SEQ ID NO: 78333 - protein, 13 aa, Mycobacterium tuberculosis
PVVELVPVRPVVH

SEQ ID NO: 78334 - protein, 13 aa, Mycobacterium tuberculosis
VVELVPVRPVVHY

SEQ ID NO: 78335 - protein, 13 aa, Mycobacterium tuberculosis
VELVPVRPVVHYM

SEQ ID NO: 78336 - protein, 13 aa, Mycobacterium tuberculosis
ELVPVRPVVHYMM

SEQ ID NO: 78337 - protein, 13 aa, Mycobacterium tuberculosis
LVPVRPVVHYMMG

SEQ ID NO: 78338 - protein, 13 aa, Mycobacterium tuberculosis
VPVRPVVHYMMGG

SEQ ID NO: 78339 - protein, 13 aa, Mycobacterium tuberculosis
PVRPVVHYMMGGV

SEQ ID NO: 78340 - protein, 13 aa, Mycobacterium tuberculosis
VRPVVHYMMGGVH

SEQ ID NO: 78341 - protein, 13 aa, Mycobacterium tuberculosis
RPVVHYMMGGVHT

SEQ ID NO: 78342 - protein, 13 aa, Mycobacterium tuberculosis
PVVHYMMGGVHTD

SEQ ID NO: 78343 - protein, 13 aa, Mycobacterium tuberculosis
VVHYMMGGVHTDI

SEQ ID NO: 78344 - protein, 13 aa, Mycobacterium tuberculosis
VHYMMGGVHTDIN

SEQ ID NO: 78345 - protein, 13 aa, Mycobacterium tuberculosis
HYMMGGVHTDING

SEQ ID NO: 78346 - protein, 13 aa, Mycobacterium tuberculosis
YMMGGVHTDINGA

SEQ ID NO: 78347 - protein, 13 aa, Mycobacterium tuberculosis
MMGGVHTDINGAT

SEQ ID NO: 78348 - protein, 13 aa, Mycobacterium tuberculosis
MGGVHTDINGATT

SEQ ID NO: 78349 - protein, 13 aa, Mycobacterium tuberculosis
GGVHTDINGATTL

SEQ ID NO: 78350 - protein, 13 aa, Mycobacterium tuberculosis
GVHTDINGATTLP

SEQ ID NO: 78351 - protein, 13 aa, Mycobacterium tuberculosis
VHTDINGATTLPG

SEQ ID NO: 78352 - protein, 13 aa, Mycobacterium tuberculosis
HTDINGATTLPGL

SEQ ID NO: 78353 - protein, 13 aa, Mycobacterium tuberculosis
TDINGATTLPGLY

SEQ ID NO: 78354 - protein, 13 aa, Mycobacterium tuberculosis
DINGATTLPGLYA

SEQ ID NO: 78355 - protein, 13 aa, Mycobacterium tuberculosis
INGATTLPGLYAA

SEQ ID NO: 78356 - protein, 13 aa, Mycobacterium tuberculosis
NGATTLPGLYAAG

SEQ ID NO: 78357 - protein, 13 aa, Mycobacterium tuberculosis
GATTLPGLYAAGE

SEQ ID NO: 78358 - protein, 13 aa, Mycobacterium tuberculosis
ATTLPGLYAAGET

SEQ ID NO: 78359 - protein, 13 aa, Mycobacterium tuberculosis
TTLPGLYAAGETA

SEQ ID NO: 78360 - protein, 13 aa, Mycobacterium tuberculosis
TLPGLYAAGETAC

SEQ ID NO: 78361 - protein, 13 aa, Mycobacterium tuberculosis
LPGLYAAGETACV

SEQ ID NO: 78362 - protein, 13 aa, Mycobacterium tuberculosis
PGLYAAGETACVS

SEQ ID NO: 78363 - protein, 13 aa, Mycobacterium tuberculosis
GLYAAGETACVSI

SEQ ID NO: 78364 - protein, 13 aa, Mycobacterium tuberculosis
LYAAGETACVSIN

SEQ ID NO: 78365 - protein, 13 aa, Mycobacterium tuberculosis
YAAGETACVSING

SEQ ID NO: 78366 - protein, 13 aa, Mycobacterium tuberculosis
AAGETACVSINGA

SEQ ID NO: 78367 - protein, 13 aa, Mycobacterium tuberculosis
AGETACVSINGAN

SEQ ID NO: 78368 - protein, 13 aa, Mycobacterium tuberculosis
GETACVSINGANR

SEQ ID NO: 78369 - protein, 13 aa, Mycobacterium tuberculosis
ETACVSINGANRL

SEQ ID NO: 78370 - protein, 13 aa, Mycobacterium tuberculosis
TACVSINGANRLG

SEQ ID NO: 78371 - protein, 13 aa, Mycobacterium tuberculosis
ACVSINGANRLGS

SEQ ID NO: 78372 - protein, 13 aa, Mycobacterium tuberculosis
CVSINGANRLGSN

SEQ ID NO: 78373 - protein, 13 aa, Mycobacterium tuberculosis
VSINGANRLGSNS

SEQ ID NO: 78374 - protein, 13 aa, Mycobacterium tuberculosis
SINGANRLGSNSL

SEQ ID NO: 78375 - protein, 13 aa, Mycobacterium tuberculosis
INGANRLGSNSLP

SEQ ID NO: 78376 - protein, 13 aa, Mycobacterium tuberculosis
NGANRLGSNSLPE

SEQ ID NO: 78377 - protein, 13 aa, Mycobacterium tuberculosis
GANRLGSNSLPEL

SEQ ID NO: 78378 - protein, 13 aa, Mycobacterium tuberculosis
ANRLGSNSLPELL

SEQ ID NO: 78379 - protein, 13 aa, Mycobacterium tuberculosis
NRLGSNSLPELLV

SEQ ID NO: 78380 - protein, 13 aa, Mycobacterium tuberculosis
RLGSNSLPELLVF

SEQ ID NO: 78381 - protein, 13 aa, Mycobacterium tuberculosis
LGSNSLPELLVFG

SEQ ID NO: 78382 - protein, 13 aa, Mycobacterium tuberculosis
GSNSLPELLVFGA

SEQ ID NO: 78383 - protein, 13 aa, Mycobacterium tuberculosis
SNSLPELLVFGAR

SEQ ID NO: 78384 - protein, 13 aa, Mycobacterium tuberculosis
NSLPELLVFGARA

SEQ ID NO: 78385 - protein, 13 aa, Mycobacterium tuberculosis
SLPELLVFGARAG

SEQ ID NO: 78386 - protein, 13 aa, Mycobacterium tuberculosis
LPELLVFGARAGR

SEQ ID NO: 78387 - protein, 13 aa, Mycobacterium tuberculosis
PELLVFGARAGRA

SEQ ID NO: 78388 - protein, 13 aa, Mycobacterium tuberculosis
ELLVFGARAGRAA

SEQ ID NO: 78389 - protein, 13 aa, Mycobacterium tuberculosis
LLVFGARAGRAAA

SEQ ID NO: 78390 - protein, 13 aa, Mycobacterium tuberculosis
LVFGARAGRAAAD

SEQ ID NO: 78391 - protein, 13 aa, Mycobacterium tuberculosis
VFGARAGRAAADY

SEQ ID NO: 78392 - protein, 13 aa, Mycobacterium tuberculosis
FGARAGRAAADYA

SEQ ID NO: 78393 - protein, 13 aa, Mycobacterium tuberculosis
GARAGRAAADYAA

SEQ ID NO: 78394 - protein, 13 aa, Mycobacterium tuberculosis
ARAGRAAADYAAR

SEQ ID NO: 78395 - protein, 13 aa, Mycobacterium tuberculosis
RAGRAAADYAARH

SEQ ID NO: 78396 - protein, 13 aa, Mycobacterium tuberculosis
AGRAAADYAARHQ

SEQ ID NO: 78397 - protein, 13 aa, Mycobacterium tuberculosis
GRAAADYAARHQK

SEQ ID NO: 78398 - protein, 13 aa, Mycobacterium tuberculosis
RAAADYAARHQKS

SEQ ID NO: 78399 - protein, 13 aa, Mycobacterium tuberculosis
AAADYAARHQKSD

SEQ ID NO: 78400 - protein, 13 aa, Mycobacterium tuberculosis
AADYAARHQKSDR

SEQ ID NO: 78401 - protein, 13 aa, Mycobacterium tuberculosis
ADYAARHQKSDRG

SEQ ID NO: 78402 - protein, 13 aa, Mycobacterium tuberculosis
DYAARHQKSDRGP

SEQ ID NO: 78403 - protein, 13 aa, Mycobacterium tuberculosis
YAARHQKSDRGPS

SEQ ID NO: 78404 - protein, 13 aa, Mycobacterium tuberculosis
AARHQKSDRGPSS

SEQ ID NO: 78405 - protein, 13 aa, Mycobacterium tuberculosis
ARHQKSDRGPSSA

SEQ ID NO: 78406 - protein, 13 aa, Mycobacterium tuberculosis
RHQKSDRGPSSAV

SEQ ID NO: 78407 - protein, 13 aa, Mycobacterium tuberculosis
HQKSDRGPSSAVR

SEQ ID NO: 78408 - protein, 13 aa, Mycobacterium tuberculosis
QKSDRGPSSAVRA

SEQ ID NO: 78409 - protein, 13 aa, Mycobacterium tuberculosis
KSDRGPSSAVRAQ

SEQ ID NO: 78410 - protein, 13 aa, Mycobacterium tuberculosis
SDRGPSSAVRAQA

SEQ ID NO: 78411 - protein, 13 aa, Mycobacterium tuberculosis
DRGPSSAVRAQAR

SEQ ID NO: 78412 - protein, 13 aa, Mycobacterium tuberculosis
RGPSSAVRAQART

SEQ ID NO: 78413 - protein, 13 aa, Mycobacterium tuberculosis
GPSSAVRAQARTE

SEQ ID NO: 78414 - protein, 13 aa, Mycobacterium tuberculosis
PSSAVRAQARTEA

SEQ ID NO: 78415 - protein, 13 aa, Mycobacterium tuberculosis
SSAVRAQARTEAL

SEQ ID NO: 78416 - protein, 13 aa, Mycobacterium tuberculosis
SAVRAQARTEALR

SEQ ID NO: 78417 - protein, 13 aa, Mycobacterium tuberculosis
AVRAQARTEALRL

SEQ ID NO: 78418 - protein, 13 aa, Mycobacterium tuberculosis
VRAQARTEALRLE

SEQ ID NO: 78419 - protein, 13 aa, Mycobacterium tuberculosis
RAQARTEALRLER

SEQ ID NO: 78420 - protein, 13 aa, Mycobacterium tuberculosis
AQARTEALRLERE

SEQ ID NO: 78421 - protein, 13 aa, Mycobacterium tuberculosis
QARTEALRLEREL

SEQ ID NO: 78422 - protein, 13 aa, Mycobacterium tuberculosis
ARTEALRLERELS

SEQ ID NO: 78423 - protein, 13 aa, Mycobacterium tuberculosis
RTEALRLERELSR

SEQ ID NO: 78424 - protein, 13 aa, Mycobacterium tuberculosis
TEALRLERELSRH

SEQ ID NO: 78425 - protein, 13 aa, Mycobacterium tuberculosis
EALRLERELSRHG

SEQ ID NO: 78426 - protein, 13 aa, Mycobacterium tuberculosis
ALRLERELSRHGQ

SEQ ID NO: 78427 - protein, 13 aa, Mycobacterium tuberculosis
LRLERELSRHGQG

SEQ ID NO: 78428 - protein, 13 aa, Mycobacterium tuberculosis
RLERELSRHGQGG

SEQ ID NO: 78429 - protein, 13 aa, Mycobacterium tuberculosis
LERELSRHGQGGE

SEQ ID NO: 78430 - protein, 13 aa, Mycobacterium tuberculosis
ERELSRHGQGGER

SEQ ID NO: 78431 - protein, 13 aa, Mycobacterium tuberculosis
RELSRHGQGGERI

SEQ ID NO: 78432 - protein, 13 aa, Mycobacterium tuberculosis
ELSRHGQGGERIA

SEQ ID NO: 78433 - protein, 13 aa, Mycobacterium tuberculosis
LSRHGQGGERIAD

SEQ ID NO: 78434 - protein, 13 aa, Mycobacterium tuberculosis
SRHGQGGERIADI

SEQ ID NO: 78435 - protein, 13 aa, Mycobacterium tuberculosis
RHGQGGERIADIR

SEQ ID NO: 78436 - protein, 13 aa, Mycobacterium tuberculosis
HGQGGERIADIRA

SEQ ID NO: 78437 - protein, 13 aa, Mycobacterium tuberculosis
GQGGERIADIRAD

SEQ ID NO: 78438 - protein, 13 aa, Mycobacterium tuberculosis
QGGERIADIRADM

SEQ ID NO: 78439 - protein, 13 aa, Mycobacterium tuberculosis
GGERIADIRADMQ

SEQ ID NO: 78440 - protein, 13 aa, Mycobacterium tuberculosis
GERIADIRADMQA

SEQ ID NO: 78441 - protein, 13 aa, Mycobacterium tuberculosis
ERIADIRADMQAT

SEQ ID NO: 78442 - protein, 13 aa, Mycobacterium tuberculosis
RIADIRADMQATL

SEQ ID NO: 78443 - protein, 13 aa, Mycobacterium tuberculosis
IADIRADMQATLE

SEQ ID NO: 78444 - protein, 13 aa, Mycobacterium tuberculosis
ADIRADMQATLES

SEQ ID NO: 78445 - protein, 13 aa, Mycobacterium tuberculosis
DIRADMQATLESA

SEQ ID NO: 78446 - protein, 13 aa, Mycobacterium tuberculosis
IRADMQATLESAA

SEQ ID NO: 78447 - protein, 13 aa, Mycobacterium tuberculosis
RADMQATLESAAG

SEQ ID NO: 78448 - protein, 13 aa, Mycobacterium tuberculosis
ADMQATLESAAGI

SEQ ID NO: 78449 - protein, 13 aa, Mycobacterium tuberculosis
DMQATLESAAGIY

SEQ ID NO: 78450 - protein, 13 aa, Mycobacterium tuberculosis
MQATLESAAGIYR

SEQ ID NO: 78451 - protein, 13 aa, Mycobacterium tuberculosis
QATLESAAGIYRD

SEQ ID NO: 78452 - protein, 13 aa, Mycobacterium tuberculosis
ATLESAAGIYRDG

SEQ ID NO: 78453 - protein, 13 aa, Mycobacterium tuberculosis
TLESAAGIYRDGP

SEQ ID NO: 78454 - protein, 13 aa, Mycobacterium tuberculosis
LESAAGIYRDGPT

SEQ ID NO: 78455 - protein, 13 aa, Mycobacterium tuberculosis
ESAAGIYRDGPTL

SEQ ID NO: 78456 - protein, 13 aa, Mycobacterium tuberculosis
SAAGIYRDGPTLT

SEQ ID NO: 78457 - protein, 13 aa, Mycobacterium tuberculosis
AAGIYRDGPTLTK

SEQ ID NO: 78458 - protein, 13 aa, Mycobacterium tuberculosis
AGIYRDGPTLTKA

SEQ ID NO: 78459 - protein, 13 aa, Mycobacterium tuberculosis
GIYRDGPTLTKAV

SEQ ID NO: 78460 - protein, 13 aa, Mycobacterium tuberculosis
IYRDGPTLTKAVE

SEQ ID NO: 78461 - protein, 13 aa, Mycobacterium tuberculosis
YRDGPTLTKAVEE

SEQ ID NO: 78462 - protein, 13 aa, Mycobacterium tuberculosis
RDGPTLTKAVEEI

SEQ ID NO: 78463 - protein, 13 aa, Mycobacterium tuberculosis
DGPTLTKAVEEIR

SEQ ID NO: 78464 - protein, 13 aa, Mycobacterium tuberculosis
GPTLTKAVEEIRV

SEQ ID NO: 78465 - protein, 13 aa, Mycobacterium tuberculosis
PTLTKAVEEIRVL

SEQ ID NO: 78466 - protein, 13 aa, Mycobacterium tuberculosis
TLTKAVEEIRVLQ

SEQ ID NO: 78467 - protein, 13 aa, Mycobacterium tuberculosis
LTKAVEEIRVLQE

SEQ ID NO: 78468 - protein, 13 aa, Mycobacterium tuberculosis
TKAVEEIRVLQER

SEQ ID NO: 78469 - protein, 13 aa, Mycobacterium tuberculosis
KAVEEIRVLQERF

SEQ ID NO: 78470 - protein, 13 aa, Mycobacterium tuberculosis
AVEEIRVLQERFA

SEQ ID NO: 78471 - protein, 13 aa, Mycobacterium tuberculosis
VEEIRVLQERFAT

SEQ ID NO: 78472 - protein, 13 aa, Mycobacterium tuberculosis
EEIRVLQERFATA

SEQ ID NO: 78473 - protein, 13 aa, Mycobacterium tuberculosis
EIRVLQERFATAG

SEQ ID NO: 78474 - protein, 13 aa, Mycobacterium tuberculosis
IRVLQERFATAGI

SEQ ID NO: 78475 - protein, 13 aa, Mycobacterium tuberculosis
RVLQERFATAGID

SEQ ID NO: 78476 - protein, 13 aa, Mycobacterium tuberculosis
VLQERFATAGIDD

SEQ ID NO: 78477 - protein, 13 aa, Mycobacterium tuberculosis
LQERFATAGIDDH

SEQ ID NO: 78478 - protein, 13 aa, Mycobacterium tuberculosis
QERFATAGIDDHS

SEQ ID NO: 78479 - protein, 13 aa, Mycobacterium tuberculosis
ERFATAGIDDHSR

SEQ ID NO: 78480 - protein, 13 aa, Mycobacterium tuberculosis
RFATAGIDDHSRT

SEQ ID NO: 78481 - protein, 13 aa, Mycobacterium tuberculosis
FATAGIDDHSRTF

SEQ ID NO: 78482 - protein, 13 aa, Mycobacterium tuberculosis
ATAGIDDHSRTFN

SEQ ID NO: 78483 - protein, 13 aa, Mycobacterium tuberculosis
TAGIDDHSRTFNT

SEQ ID NO: 78484 - protein, 13 aa, Mycobacterium tuberculosis
AGIDDHSRTFNTE

SEQ ID NO: 78485 - protein, 13 aa, Mycobacterium tuberculosis
GIDDHSRTFNTEL

SEQ ID NO: 78486 - protein, 13 aa, Mycobacterium tuberculosis
IDDHSRTFNTELT

SEQ ID NO: 78487 - protein, 13 aa, Mycobacterium tuberculosis
DDHSRTFNTELTA

SEQ ID NO: 78488 - protein, 13 aa, Mycobacterium tuberculosis
DHSRTFNTELTAL

SEQ ID NO: 78489 - protein, 13 aa, Mycobacterium tuberculosis
HSRTFNTELTALL

SEQ ID NO: 78490 - protein, 13 aa, Mycobacterium tuberculosis
SRTFNTELTALLE

SEQ ID NO: 78491 - protein, 13 aa, Mycobacterium tuberculosis
RTFNTELTALLEL

SEQ ID NO: 78492 - protein, 13 aa, Mycobacterium tuberculosis
TFNTELTALLELS

SEQ ID NO: 78493 - protein, 13 aa, Mycobacterium tuberculosis
FNTELTALLELSG

SEQ ID NO: 78494 - protein, 13 aa, Mycobacterium tuberculosis
NTELTALLELSGM

SEQ ID NO: 78495 - protein, 13 aa, Mycobacterium tuberculosis
TELTALLELSGML

SEQ ID NO: 78496 - protein, 13 aa, Mycobacterium tuberculosis
ELTALLELSGMLD

SEQ ID NO: 78497 - protein, 13 aa, Mycobacterium tuberculosis
LTALLELSGMLDV

SEQ ID NO: 78498 - protein, 13 aa, Mycobacterium tuberculosis
TALLELSGMLDVA

SEQ ID NO: 78499 - protein, 13 aa, Mycobacterium tuberculosis
ALLELSGMLDVAL

SEQ ID NO: 78500 - protein, 13 aa, Mycobacterium tuberculosis
LLELSGMLDVALA

SEQ ID NO: 78501 - protein, 13 aa, Mycobacterium tuberculosis
LELSGMLDVALAI

SEQ ID NO: 78502 - protein, 13 aa, Mycobacterium tuberculosis
ELSGMLDVALAIV

SEQ ID NO: 78503 - protein, 13 aa, Mycobacterium tuberculosis
LSGMLDVALAIVE

SEQ ID NO: 78504 - protein, 13 aa, Mycobacterium tuberculosis
SGMLDVALAIVES

SEQ ID NO: 78505 - protein, 13 aa, Mycobacterium tuberculosis
GMLDVALAIVESG

SEQ ID NO: 78506 - protein, 13 aa, Mycobacterium tuberculosis
MLDVALAIVESGL

SEQ ID NO: 78507 - protein, 13 aa, Mycobacterium tuberculosis
LDVALAIVESGLR

SEQ ID NO: 78508 - protein, 13 aa, Mycobacterium tuberculosis
DVALAIVESGLRR

SEQ ID NO: 78509 - protein, 13 aa, Mycobacterium tuberculosis
VALAIVESGLRRE

SEQ ID NO: 78510 - protein, 13 aa, Mycobacterium tuberculosis
ALAIVESGLRREE

SEQ ID NO: 78511 - protein, 13 aa, Mycobacterium tuberculosis
LAIVESGLRREES

SEQ ID NO: 78512 - protein, 13 aa, Mycobacterium tuberculosis
AIVESGLRREESR

SEQ ID NO: 78513 - protein, 13 aa, Mycobacterium tuberculosis
IVESGLRREESRG

SEQ ID NO: 78514 - protein, 13 aa, Mycobacterium tuberculosis
VESGLRREESRGA

SEQ ID NO: 78515 - protein, 13 aa, Mycobacterium tuberculosis
ESGLRREESRGAH

SEQ ID NO: 78516 - protein, 13 aa, Mycobacterium tuberculosis
SGLRREESRGAHQ

SEQ ID NO: 78517 - protein, 13 aa, Mycobacterium tuberculosis
GLRREESRGAHQR

SEQ ID NO: 78518 - protein, 13 aa, Mycobacterium tuberculosis
LRREESRGAHQRT

SEQ ID NO: 78519 - protein, 13 aa, Mycobacterium tuberculosis
RREESRGAHQRTD

SEQ ID NO: 78520 - protein, 13 aa, Mycobacterium tuberculosis
REESRGAHQRTDF

SEQ ID NO: 78521 - protein, 13 aa, Mycobacterium tuberculosis
EESRGAHQRTDFP

SEQ ID NO: 78522 - protein, 13 aa, Mycobacterium tuberculosis
ESRGAHQRTDFPN

SEQ ID NO: 78523 - protein, 13 aa, Mycobacterium tuberculosis
SRGAHQRTDFPNR

SEQ ID NO: 78524 - protein, 13 aa, Mycobacterium tuberculosis
RGAHQRTDFPNRD

SEQ ID NO: 78525 - protein, 13 aa, Mycobacterium tuberculosis
GAHQRTDFPNRDD

SEQ ID NO: 78526 - protein, 13 aa, Mycobacterium tuberculosis
AHQRTDFPNRDDE

SEQ ID NO: 78527 - protein, 13 aa, Mycobacterium tuberculosis
HQRTDFPNRDDEH

SEQ ID NO: 78528 - protein, 13 aa, Mycobacterium tuberculosis
QRTDFPNRDDEHF

SEQ ID NO: 78529 - protein, 13 aa, Mycobacterium tuberculosis
RTDFPNRDDEHFL

SEQ ID NO: 78530 - protein, 13 aa, Mycobacterium tuberculosis
TDFPNRDDEHFLA

SEQ ID NO: 78531 - protein, 13 aa, Mycobacterium tuberculosis
DFPNRDDEHFLAH

SEQ ID NO: 78532 - protein, 13 aa, Mycobacterium tuberculosis
FPNRDDEHFLAHT

SEQ ID NO: 78533 - protein, 13 aa, Mycobacterium tuberculosis
PNRDDEHFLAHTL

SEQ ID NO: 78534 - protein, 13 aa, Mycobacterium tuberculosis
NRDDEHFLAHTLV

SEQ ID NO: 78535 - protein, 13 aa, Mycobacterium tuberculosis
RDDEHFLAHTLVH

SEQ ID NO: 78536 - protein, 13 aa, Mycobacterium tuberculosis
DDEHFLAHTLVHR

SEQ ID NO: 78537 - protein, 13 aa, Mycobacterium tuberculosis
DEHFLAHTLVHRE

SEQ ID NO: 78538 - protein, 13 aa, Mycobacterium tuberculosis
EHFLAHTLVHRES

SEQ ID NO: 78539 - protein, 13 aa, Mycobacterium tuberculosis
HFLAHTLVHRESD

SEQ ID NO: 78540 - protein, 13 aa, Mycobacterium tuberculosis
FLAHTLVHRESDG

SEQ ID NO: 78541 - protein, 13 aa, Mycobacterium tuberculosis
LAHTLVHRESDGT

SEQ ID NO: 78542 - protein, 13 aa, Mycobacterium tuberculosis
AHTLVHRESDGTL

SEQ ID NO: 78543 - protein, 13 aa, Mycobacterium tuberculosis
HTLVHRESDGTLR

SEQ ID NO: 78544 - protein, 13 aa, Mycobacterium tuberculosis
TLVHRESDGTLRV

SEQ ID NO: 78545 - protein, 13 aa, Mycobacterium tuberculosis
LVHRESDGTLRVG

SEQ ID NO: 78546 - protein, 13 aa, Mycobacterium tuberculosis
VHRESDGTLRVGY

SEQ ID NO: 78547 - protein, 13 aa, Mycobacterium tuberculosis
HRESDGTLRVGYL

SEQ ID NO: 78548 - protein, 13 aa, Mycobacterium tuberculosis
RESDGTLRVGYLP

SEQ ID NO: 78549 - protein, 13 aa, Mycobacterium tuberculosis
ESDGTLRVGYLPV

SEQ ID NO: 78550 - protein, 13 aa, Mycobacterium tuberculosis
SDGTLRVGYLPVT

SEQ ID NO: 78551 - protein, 13 aa, Mycobacterium tuberculosis
DGTLRVGYLPVTI

SEQ ID NO: 78552 - protein, 13 aa, Mycobacterium tuberculosis
GTLRVGYLPVTIT

SEQ ID NO: 78553 - protein, 13 aa, Mycobacterium tuberculosis
TLRVGYLPVTITR

SEQ ID NO: 78554 - protein, 13 aa, Mycobacterium tuberculosis
LRVGYLPVTITRW

SEQ ID NO: 78555 - protein, 13 aa, Mycobacterium tuberculosis
RVGYLPVTITRWP

SEQ ID NO: 78556 - protein, 13 aa, Mycobacterium tuberculosis
VGYLPVTITRWPP

SEQ ID NO: 78557 - protein, 13 aa, Mycobacterium tuberculosis
GYLPVTITRWPPG

SEQ ID NO: 78558 - protein, 13 aa, Mycobacterium tuberculosis
YLPVTITRWPPGE

SEQ ID NO: 78559 - protein, 13 aa, Mycobacterium tuberculosis
LPVTITRWPPGER

SEQ ID NO: 78560 - protein, 13 aa, Mycobacterium tuberculosis
PVTITRWPPGERV

SEQ ID NO: 78561 - protein, 13 aa, Mycobacterium tuberculosis
VTITRWPPGERVY

SEQ ID NO: 78562 - protein, 13 aa, Mycobacterium tuberculosis
TITRWPPGERVYG

SEQ ID NO: 78563 - protein, 13 aa, Mycobacterium tuberculosis
ITRWPPGERVYGR

SEQ ID NO: 78564 - protein, 14 aa, Mycobacterium tuberculosis
MTAQHNIVVIGGGG

SEQ ID NO: 78565 - protein, 14 aa, Mycobacterium tuberculosis
TAQHNIVVIGGGGA

SEQ ID NO: 78566 - protein, 14 aa, Mycobacterium tuberculosis
AQHNIVVIGGGGAG

SEQ ID NO: 78567 - protein, 14 aa, Mycobacterium tuberculosis
QHNIVVIGGGGAGL

SEQ ID NO: 78568 - protein, 14 aa, Mycobacterium tuberculosis
HNIVVIGGGGAGLR

SEQ ID NO: 78569 - protein, 14 aa, Mycobacterium tuberculosis
NIVVIGGGGAGLRA

SEQ ID NO: 78570 - protein, 14 aa, Mycobacterium tuberculosis
IVVIGGGGAGLRAA

SEQ ID NO: 78571 - protein, 14 aa, Mycobacterium tuberculosis
VVIGGGGAGLRAAI

SEQ ID NO: 78572 - protein, 14 aa, Mycobacterium tuberculosis
VIGGGGAGLRAAIA

SEQ ID NO: 78573 - protein, 14 aa, Mycobacterium tuberculosis
IGGGGAGLRAAIAI

SEQ ID NO: 78574 - protein, 14 aa, Mycobacterium tuberculosis
GGGGAGLRAAIAIA

SEQ ID NO: 78575 - protein, 14 aa, Mycobacterium tuberculosis
GGGAGLRAAIAIAE

SEQ ID NO: 78576 - protein, 14 aa, Mycobacterium tuberculosis
GGAGLRAAIAIAET

SEQ ID NO: 78577 - protein, 14 aa, Mycobacterium tuberculosis
GAGLRAAIAIAETN

SEQ ID NO: 78578 - protein, 14 aa, Mycobacterium tuberculosis
AGLRAAIAIAETNP

SEQ ID NO: 78579 - protein, 14 aa, Mycobacterium tuberculosis
GLRAAIAIAETNPH

SEQ ID NO: 78580 - protein, 14 aa, Mycobacterium tuberculosis
LRAAIAIAETNPHL

SEQ ID NO: 78581 - protein, 14 aa, Mycobacterium tuberculosis
RAAIAIAETNPHLD

SEQ ID NO: 78582 - protein, 14 aa, Mycobacterium tuberculosis
AAIAIAETNPHLDV

SEQ ID NO: 78583 - protein, 14 aa, Mycobacterium tuberculosis
AIAIAETNPHLDVA

SEQ ID NO: 78584 - protein, 14 aa, Mycobacterium tuberculosis
IAIAETNPHLDVAI

SEQ ID NO: 78585 - protein, 14 aa, Mycobacterium tuberculosis
AIAETNPHLDVAIV

SEQ ID NO: 78586 - protein, 14 aa, Mycobacterium tuberculosis
IAETNPHLDVAIVS

SEQ ID NO: 78587 - protein, 14 aa, Mycobacterium tuberculosis
AETNPHLDVAIVSK

SEQ ID NO: 78588 - protein, 14 aa, Mycobacterium tuberculosis
ETNPHLDVAIVSKV

SEQ ID NO: 78589 - protein, 14 aa, Mycobacterium tuberculosis
TNPHLDVAIVSKVY

SEQ ID NO: 78590 - protein, 14 aa, Mycobacterium tuberculosis
NPHLDVAIVSKVYP

SEQ ID NO: 78591 - protein, 14 aa, Mycobacterium tuberculosis
PHLDVAIVSKVYPM

SEQ ID NO: 78592 - protein, 14 aa, Mycobacterium tuberculosis
HLDVAIVSKVYPMR

SEQ ID NO: 78593 - protein, 14 aa, Mycobacterium tuberculosis
LDVAIVSKVYPMRS

SEQ ID NO: 78594 - protein, 14 aa, Mycobacterium tuberculosis
DVAIVSKVYPMRSH

SEQ ID NO: 78595 - protein, 14 aa, Mycobacterium tuberculosis
VAIVSKVYPMRSHT

SEQ ID NO: 78596 - protein, 14 aa, Mycobacterium tuberculosis
AIVSKVYPMRSHTV

SEQ ID NO: 78597 - protein, 14 aa, Mycobacterium tuberculosis
IVSKVYPMRSHTVS

SEQ ID NO: 78598 - protein, 14 aa, Mycobacterium tuberculosis
VSKVYPMRSHTVSA

SEQ ID NO: 78599 - protein, 14 aa, Mycobacterium tuberculosis
SKVYPMRSHTVSAE

SEQ ID NO: 78600 - protein, 14 aa, Mycobacterium tuberculosis
KVYPMRSHTVSAEG

SEQ ID NO: 78601 - protein, 14 aa, Mycobacterium tuberculosis
VYPMRSHTVSAEGG

SEQ ID NO: 78602 - protein, 14 aa, Mycobacterium tuberculosis
YPMRSHTVSAEGGA

SEQ ID NO: 78603 - protein, 14 aa, Mycobacterium tuberculosis
PMRSHTVSAEGGAA

SEQ ID NO: 78604 - protein, 14 aa, Mycobacterium tuberculosis
MRSHTVSAEGGAAA

SEQ ID NO: 78605 - protein, 14 aa, Mycobacterium tuberculosis
RSHTVSAEGGAAAV

SEQ ID NO: 78606 - protein, 14 aa, Mycobacterium tuberculosis
SHTVSAEGGAAAVT

SEQ ID NO: 78607 - protein, 14 aa, Mycobacterium tuberculosis
HTVSAEGGAAAVTG

SEQ ID NO: 78608 - protein, 14 aa, Mycobacterium tuberculosis
TVSAEGGAAAVTGD

SEQ ID NO: 78609 - protein, 14 aa, Mycobacterium tuberculosis
VSAEGGAAAVTGDD

SEQ ID NO: 78610 - protein, 14 aa, Mycobacterium tuberculosis
SAEGGAAAVTGDDD

SEQ ID NO: 78611 - protein, 14 aa, Mycobacterium tuberculosis
AEGGAAAVTGDDDS

SEQ ID NO: 78612 - protein, 14 aa, Mycobacterium tuberculosis
EGGAAAVTGDDDSL

SEQ ID NO: 78613 - protein, 14 aa, Mycobacterium tuberculosis
GGAAAVTGDDDSLD

SEQ ID NO: 78614 - protein, 14 aa, Mycobacterium tuberculosis
GAAAVTGDDDSLDE

SEQ ID NO: 78615 - protein, 14 aa, Mycobacterium tuberculosis
AAAVTGDDDSLDEH

SEQ ID NO: 78616 - protein, 14 aa, Mycobacterium tuberculosis
AAVTGDDDSLDEHA

SEQ ID NO: 78617 - protein, 14 aa, Mycobacterium tuberculosis
AVTGDDDSLDEHAH

SEQ ID NO: 78618 - protein, 14 aa, Mycobacterium tuberculosis
VTGDDDSLDEHAHD

SEQ ID NO: 78619 - protein, 14 aa, Mycobacterium tuberculosis
TGDDDSLDEHAHDT

SEQ ID NO: 78620 - protein, 14 aa, Mycobacterium tuberculosis
GDDDSLDEHAHDTV

SEQ ID NO: 78621 - protein, 14 aa, Mycobacterium tuberculosis
DDDSLDEHAHDTVS

SEQ ID NO: 78622 - protein, 14 aa, Mycobacterium tuberculosis
DDSLDEHAHDTVSG

SEQ ID NO: 78623 - protein, 14 aa, Mycobacterium tuberculosis
DSLDEHAHDTVSGG

SEQ ID NO: 78624 - protein, 14 aa, Mycobacterium tuberculosis
SLDEHAHDTVSGGD

SEQ ID NO: 78625 - protein, 14 aa, Mycobacterium tuberculosis
LDEHAHDTVSGGDW

SEQ ID NO: 78626 - protein, 14 aa, Mycobacterium tuberculosis
DEHAHDTVSGGDWL

SEQ ID NO: 78627 - protein, 14 aa, Mycobacterium tuberculosis
EHAHDTVSGGDWLC

SEQ ID NO: 78628 - protein, 14 aa, Mycobacterium tuberculosis
HAHDTVSGGDWLCD

SEQ ID NO: 78629 - protein, 14 aa, Mycobacterium tuberculosis
AHDTVSGGDWLCDQ

SEQ ID NO: 78630 - protein, 14 aa, Mycobacterium tuberculosis
HDTVSGGDWLCDQD

SEQ ID NO: 78631 - protein, 14 aa, Mycobacterium tuberculosis
DTVSGGDWLCDQDA

SEQ ID NO: 78632 - protein, 14 aa, Mycobacterium tuberculosis
TVSGGDWLCDQDAV

SEQ ID NO: 78633 - protein, 14 aa, Mycobacterium tuberculosis
VSGGDWLCDQDAVE

SEQ ID NO: 78634 - protein, 14 aa, Mycobacterium tuberculosis
SGGDWLCDQDAVEA

SEQ ID NO: 78635 - protein, 14 aa, Mycobacterium tuberculosis
GGDWLCDQDAVEAF

SEQ ID NO: 78636 - protein, 14 aa, Mycobacterium tuberculosis
GDWLCDQDAVEAFV

SEQ ID NO: 78637 - protein, 14 aa, Mycobacterium tuberculosis
DWLCDQDAVEAFVA

SEQ ID NO: 78638 - protein, 14 aa, Mycobacterium tuberculosis
WLCDQDAVEAFVAE

SEQ ID NO: 78639 - protein, 14 aa, Mycobacterium tuberculosis
LCDQDAVEAFVAEA

SEQ ID NO: 78640 - protein, 14 aa, Mycobacterium tuberculosis
CDQDAVEAFVAEAP

SEQ ID NO: 78641 - protein, 14 aa, Mycobacterium tuberculosis
DQDAVEAFVAEAPK

SEQ ID NO: 78642 - protein, 14 aa, Mycobacterium tuberculosis
QDAVEAFVAEAPKE

SEQ ID NO: 78643 - protein, 14 aa, Mycobacterium tuberculosis
DAVEAFVAEAPKEL

SEQ ID NO: 78644 - protein, 14 aa, Mycobacterium tuberculosis
AVEAFVAEAPKELV

SEQ ID NO: 78645 - protein, 14 aa, Mycobacterium tuberculosis
VEAFVAEAPKELVQ

SEQ ID NO: 78646 - protein, 14 aa, Mycobacterium tuberculosis
EAFVAEAPKELVQL

SEQ ID NO: 78647 - protein, 14 aa, Mycobacterium tuberculosis
AFVAEAPKELVQLE

SEQ ID NO: 78648 - protein, 14 aa, Mycobacterium tuberculosis
FVAEAPKELVQLEH

SEQ ID NO: 78649 - protein, 14 aa, Mycobacterium tuberculosis
VAEAPKELVQLEHW

SEQ ID NO: 78650 - protein, 14 aa, Mycobacterium tuberculosis
AEAPKELVQLEHWG

SEQ ID NO: 78651 - protein, 14 aa, Mycobacterium tuberculosis
EAPKELVQLEHWGC

SEQ ID NO: 78652 - protein, 14 aa, Mycobacterium tuberculosis
APKELVQLEHWGCP

SEQ ID NO: 78653 - protein, 14 aa, Mycobacterium tuberculosis
PKELVQLEHWGCPW

SEQ ID NO: 78654 - protein, 14 aa, Mycobacterium tuberculosis
KELVQLEHWGCPWS

SEQ ID NO: 78655 - protein, 14 aa, Mycobacterium tuberculosis
ELVQLEHWGCPWSR

SEQ ID NO: 78656 - protein, 14 aa, Mycobacterium tuberculosis
LVQLEHWGCPWSRK

SEQ ID NO: 78657 - protein, 14 aa, Mycobacterium tuberculosis
VQLEHWGCPWSRKP

SEQ ID NO: 78658 - protein, 14 aa, Mycobacterium tuberculosis
QLEHWGCPWSRKPD

SEQ ID NO: 78659 - protein, 14 aa, Mycobacterium tuberculosis
LEHWGCPWSRKPDG

SEQ ID NO: 78660 - protein, 14 aa, Mycobacterium tuberculosis
EHWGCPWSRKPDGR

SEQ ID NO: 78661 - protein, 14 aa, Mycobacterium tuberculosis
HWGCPWSRKPDGRV

SEQ ID NO: 78662 - protein, 14 aa, Mycobacterium tuberculosis
WGCPWSRKPDGRVA

SEQ ID NO: 78663 - protein, 14 aa, Mycobacterium tuberculosis
GCPWSRKPDGRVAV

SEQ ID NO: 78664 - protein, 14 aa, Mycobacterium tuberculosis
CPWSRKPDGRVAVR

SEQ ID NO: 78665 - protein, 14 aa, Mycobacterium tuberculosis
PWSRKPDGRVAVRP

SEQ ID NO: 78666 - protein, 14 aa, Mycobacterium tuberculosis
WSRKPDGRVAVRPF

SEQ ID NO: 78667 - protein, 14 aa, Mycobacterium tuberculosis
SRKPDGRVAVRPFG

SEQ ID NO: 78668 - protein, 14 aa, Mycobacterium tuberculosis
RKPDGRVAVRPFGG

SEQ ID NO: 78669 - protein, 14 aa, Mycobacterium tuberculosis
KPDGRVAVRPFGGM

SEQ ID NO: 78670 - protein, 14 aa, Mycobacterium tuberculosis
PDGRVAVRPFGGMK

SEQ ID NO: 78671 - protein, 14 aa, Mycobacterium tuberculosis
DGRVAVRPFGGMKK

SEQ ID NO: 78672 - protein, 14 aa, Mycobacterium tuberculosis
GRVAVRPFGGMKKL

SEQ ID NO: 78673 - protein, 14 aa, Mycobacterium tuberculosis
RVAVRPFGGMKKLR

SEQ ID NO: 78674 - protein, 14 aa, Mycobacterium tuberculosis
VAVRPFGGMKKLRT

SEQ ID NO: 78675 - protein, 14 aa, Mycobacterium tuberculosis
AVRPFGGMKKLRTW

SEQ ID NO: 78676 - protein, 14 aa, Mycobacterium tuberculosis
VRPFGGMKKLRTWF

SEQ ID NO: 78677 - protein, 14 aa, Mycobacterium tuberculosis
RPFGGMKKLRTWFA

SEQ ID NO: 78678 - protein, 14 aa, Mycobacterium tuberculosis
PFGGMKKLRTWFAA

SEQ ID NO: 78679 - protein, 14 aa, Mycobacterium tuberculosis
FGGMKKLRTWFAAD

SEQ ID NO: 78680 - protein, 14 aa, Mycobacterium tuberculosis
GGMKKLRTWFAADK

SEQ ID NO: 78681 - protein, 14 aa, Mycobacterium tuberculosis
GMKKLRTWFAADKT

SEQ ID NO: 78682 - protein, 14 aa, Mycobacterium tuberculosis
MKKLRTWFAADKTG

SEQ ID NO: 78683 - protein, 14 aa, Mycobacterium tuberculosis
KKLRTWFAADKTGF

SEQ ID NO: 78684 - protein, 14 aa, Mycobacterium tuberculosis
KLRTWFAADKTGFH

SEQ ID NO: 78685 - protein, 14 aa, Mycobacterium tuberculosis
LRTWFAADKTGFHL

SEQ ID NO: 78686 - protein, 14 aa, Mycobacterium tuberculosis
RTWFAADKTGFHLL

SEQ ID NO: 78687 - protein, 14 aa, Mycobacterium tuberculosis
TWFAADKTGFHLLH

SEQ ID NO: 78688 - protein, 14 aa, Mycobacterium tuberculosis
WFAADKTGFHLLHT

SEQ ID NO: 78689 - protein, 14 aa, Mycobacterium tuberculosis
FAADKTGFHLLHTL

SEQ ID NO: 78690 - protein, 14 aa, Mycobacterium tuberculosis
AADKTGFHLLHTLF

SEQ ID NO: 78691 - protein, 14 aa, Mycobacterium tuberculosis
ADKTGFHLLHTLFQ

SEQ ID NO: 78692 - protein, 14 aa, Mycobacterium tuberculosis
DKTGFHLLHTLFQR

SEQ ID NO: 78693 - protein, 14 aa, Mycobacterium tuberculosis
KTGFHLLHTLFQRL

SEQ ID NO: 78694 - protein, 14 aa, Mycobacterium tuberculosis
TGFHLLHTLFQRLL

SEQ ID NO: 78695 - protein, 14 aa, Mycobacterium tuberculosis
GFHLLHTLFQRLLT

SEQ ID NO: 78696 - protein, 14 aa, Mycobacterium tuberculosis
FHLLHTLFQRLLTY

SEQ ID NO: 78697 - protein, 14 aa, Mycobacterium tuberculosis
HLLHTLFQRLLTYS

SEQ ID NO: 78698 - protein, 14 aa, Mycobacterium tuberculosis
LLHTLFQRLLTYSD

SEQ ID NO: 78699 - protein, 14 aa, Mycobacterium tuberculosis
LHTLFQRLLTYSDV

SEQ ID NO: 78700 - protein, 14 aa, Mycobacterium tuberculosis
HTLFQRLLTYSDVM

SEQ ID NO: 78701 - protein, 14 aa, Mycobacterium tuberculosis
TLFQRLLTYSDVMR

SEQ ID NO: 78702 - protein, 14 aa, Mycobacterium tuberculosis
LFQRLLTYSDVMRY

SEQ ID NO: 78703 - protein, 14 aa, Mycobacterium tuberculosis
FQRLLTYSDVMRYD

SEQ ID NO: 78704 - protein, 14 aa, Mycobacterium tuberculosis
QRLLTYSDVMRYDE

SEQ ID NO: 78705 - protein, 14 aa, Mycobacterium tuberculosis
RLLTYSDVMRYDEW

SEQ ID NO: 78706 - protein, 14 aa, Mycobacterium tuberculosis
LLTYSDVMRYDEWF

SEQ ID NO: 78707 - protein, 14 aa, Mycobacterium tuberculosis
LTYSDVMRYDEWFA

SEQ ID NO: 78708 - protein, 14 aa, Mycobacterium tuberculosis
TYSDVMRYDEWFAT

SEQ ID NO: 78709 - protein, 14 aa, Mycobacterium tuberculosis
YSDVMRYDEWFATT

SEQ ID NO: 78710 - protein, 14 aa, Mycobacterium tuberculosis
SDVMRYDEWFATTL

SEQ ID NO: 78711 - protein, 14 aa, Mycobacterium tuberculosis
DVMRYDEWFATTLL

SEQ ID NO: 78712 - protein, 14 aa, Mycobacterium tuberculosis
VMRYDEWFATTLLV

SEQ ID NO: 78713 - protein, 14 aa, Mycobacterium tuberculosis
MRYDEWFATTLLVD

SEQ ID NO: 78714 - protein, 14 aa, Mycobacterium tuberculosis
RYDEWFATTLLVDD

SEQ ID NO: 78715 - protein, 14 aa, Mycobacterium tuberculosis
YDEWFATTLLVDDG

SEQ ID NO: 78716 - protein, 14 aa, Mycobacterium tuberculosis
DEWFATTLLVDDGR

SEQ ID NO: 78717 - protein, 14 aa, Mycobacterium tuberculosis
EWFATTLLVDDGRV

SEQ ID NO: 78718 - protein, 14 aa, Mycobacterium tuberculosis
WFATTLLVDDGRVC

SEQ ID NO: 78719 - protein, 14 aa, Mycobacterium tuberculosis
FATTLLVDDGRVCG

SEQ ID NO: 78720 - protein, 14 aa, Mycobacterium tuberculosis
ATTLLVDDGRVCGL

SEQ ID NO: 78721 - protein, 14 aa, Mycobacterium tuberculosis
TTLLVDDGRVCGLV

SEQ ID NO: 78722 - protein, 14 aa, Mycobacterium tuberculosis
TLLVDDGRVCGLVA

SEQ ID NO: 78723 - protein, 14 aa, Mycobacterium tuberculosis
LLVDDGRVCGLVAI

SEQ ID NO: 78724 - protein, 14 aa, Mycobacterium tuberculosis
LVDDGRVCGLVAIE

SEQ ID NO: 78725 - protein, 14 aa, Mycobacterium tuberculosis
VDDGRVCGLVAIEL

SEQ ID NO: 78726 - protein, 14 aa, Mycobacterium tuberculosis
DDGRVCGLVAIELA

SEQ ID NO: 78727 - protein, 14 aa, Mycobacterium tuberculosis
DGRVCGLVAIELAT

SEQ ID NO: 78728 - protein, 14 aa, Mycobacterium tuberculosis
GRVCGLVAIELATG

SEQ ID NO: 78729 - protein, 14 aa, Mycobacterium tuberculosis
RVCGLVAIELATGR

SEQ ID NO: 78730 - protein, 14 aa, Mycobacterium tuberculosis
VCGLVAIELATGRI

SEQ ID NO: 78731 - protein, 14 aa, Mycobacterium tuberculosis
CGLVAIELATGRIE

SEQ ID NO: 78732 - protein, 14 aa, Mycobacterium tuberculosis
GLVAIELATGRIET

SEQ ID NO: 78733 - protein, 14 aa, Mycobacterium tuberculosis
LVAIELATGRIETI

SEQ ID NO: 78734 - protein, 14 aa, Mycobacterium tuberculosis
VAIELATGRIETIL

SEQ ID NO: 78735 - protein, 14 aa, Mycobacterium tuberculosis
AIELATGRIETILA

SEQ ID NO: 78736 - protein, 14 aa, Mycobacterium tuberculosis
IELATGRIETILAD

SEQ ID NO: 78737 - protein, 14 aa, Mycobacterium tuberculosis
ELATGRIETILADA

SEQ ID NO: 78738 - protein, 14 aa, Mycobacterium tuberculosis
LATGRIETILADAV

SEQ ID NO: 78739 - protein, 14 aa, Mycobacterium tuberculosis
ATGRIETILADAVI

SEQ ID NO: 78740 - protein, 14 aa, Mycobacterium tuberculosis
TGRIETILADAVIL

SEQ ID NO: 78741 - protein, 14 aa, Mycobacterium tuberculosis
GRIETILADAVILC

SEQ ID NO: 78742 - protein, 14 aa, Mycobacterium tuberculosis
RIETILADAVILCT

SEQ ID NO: 78743 - protein, 14 aa, Mycobacterium tuberculosis
IETILADAVILCTG

SEQ ID NO: 78744 - protein, 14 aa, Mycobacterium tuberculosis
ETILADAVILCTGG

SEQ ID NO: 78745 - protein, 14 aa, Mycobacterium tuberculosis
TILADAVILCTGGC

SEQ ID NO: 78746 - protein, 14 aa, Mycobacterium tuberculosis
ILADAVILCTGGCG

SEQ ID NO: 78747 - protein, 14 aa, Mycobacterium tuberculosis
LADAVILCTGGCGR

SEQ ID NO: 78748 - protein, 14 aa, Mycobacterium tuberculosis
ADAVILCTGGCGRV

SEQ ID NO: 78749 - protein, 14 aa, Mycobacterium tuberculosis
DAVILCTGGCGRVF

SEQ ID NO: 78750 - protein, 14 aa, Mycobacterium tuberculosis
AVILCTGGCGRVFP

SEQ ID NO: 78751 - protein, 14 aa, Mycobacterium tuberculosis
VILCTGGCGRVFPF

SEQ ID NO: 78752 - protein, 14 aa, Mycobacterium tuberculosis
ILCTGGCGRVFPFT

SEQ ID NO: 78753 - protein, 14 aa, Mycobacterium tuberculosis
LCTGGCGRVFPFTT

SEQ ID NO: 78754 - protein, 14 aa, Mycobacterium tuberculosis
CTGGCGRVFPFTTN

SEQ ID NO: 78755 - protein, 14 aa, Mycobacterium tuberculosis
TGGCGRVFPFTTNA

SEQ ID NO: 78756 - protein, 14 aa, Mycobacterium tuberculosis
GGCGRVFPFTTNAN

SEQ ID NO: 78757 - protein, 14 aa, Mycobacterium tuberculosis
GCGRVFPFTTNANI

SEQ ID NO: 78758 - protein, 14 aa, Mycobacterium tuberculosis
CGRVFPFTTNANIK

SEQ ID NO: 78759 - protein, 14 aa, Mycobacterium tuberculosis
GRVFPFTTNANIKT

SEQ ID NO: 78760 - protein, 14 aa, Mycobacterium tuberculosis
RVFPFTTNANIKTG

SEQ ID NO: 78761 - protein, 14 aa, Mycobacterium tuberculosis
VFPFTTNANIKTGD

SEQ ID NO: 78762 - protein, 14 aa, Mycobacterium tuberculosis
FPFTTNANIKTGDG

SEQ ID NO: 78763 - protein, 14 aa, Mycobacterium tuberculosis
PFTTNANIKTGDGM

SEQ ID NO: 78764 - protein, 14 aa, Mycobacterium tuberculosis
FTTNANIKTGDGMA

SEQ ID NO: 78765 - protein, 14 aa, Mycobacterium tuberculosis
TTNANIKTGDGMAL

SEQ ID NO: 78766 - protein, 14 aa, Mycobacterium tuberculosis
TNANIKTGDGMALA

SEQ ID NO: 78767 - protein, 14 aa, Mycobacterium tuberculosis
NANIKTGDGMALAF

SEQ ID NO: 78768 - protein, 14 aa, Mycobacterium tuberculosis
ANIKTGDGMALAFR

SEQ ID NO: 78769 - protein, 14 aa, Mycobacterium tuberculosis
NIKTGDGMALAFRA

SEQ ID NO: 78770 - protein, 14 aa, Mycobacterium tuberculosis
IKTGDGMALAFRAG

SEQ ID NO: 78771 - protein, 14 aa, Mycobacterium tuberculosis
KTGDGMALAFRAGA

SEQ ID NO: 78772 - protein, 14 aa, Mycobacterium tuberculosis
TGDGMALAFRAGAP

SEQ ID NO: 78773 - protein, 14 aa, Mycobacterium tuberculosis
GDGMALAFRAGAPL

SEQ ID NO: 78774 - protein, 14 aa, Mycobacterium tuberculosis
DGMALAFRAGAPLK

SEQ ID NO: 78775 - protein, 14 aa, Mycobacterium tuberculosis
GMALAFRAGAPLKD

SEQ ID NO: 78776 - protein, 14 aa, Mycobacterium tuberculosis
MALAFRAGAPLKDM

SEQ ID NO: 78777 - protein, 14 aa, Mycobacterium tuberculosis
ALAFRAGAPLKDME

SEQ ID NO: 78778 - protein, 14 aa, Mycobacterium tuberculosis
LAFRAGAPLKDMEF

SEQ ID NO: 78779 - protein, 14 aa, Mycobacterium tuberculosis
AFRAGAPLKDMEFV

SEQ ID NO: 78780 - protein, 14 aa, Mycobacterium tuberculosis
FRAGAPLKDMEFVQ

SEQ ID NO: 78781 - protein, 14 aa, Mycobacterium tuberculosis
RAGAPLKDMEFVQY

SEQ ID NO: 78782 - protein, 14 aa, Mycobacterium tuberculosis
AGAPLKDMEFVQYH

SEQ ID NO: 78783 - protein, 14 aa, Mycobacterium tuberculosis
GAPLKDMEFVQYHP

SEQ ID NO: 78784 - protein, 14 aa, Mycobacterium tuberculosis
APLKDMEFVQYHPT

SEQ ID NO: 78785 - protein, 14 aa, Mycobacterium tuberculosis
PLKDMEFVQYHPTG

SEQ ID NO: 78786 - protein, 14 aa, Mycobacterium tuberculosis
LKDMEFVQYHPTGL

SEQ ID NO: 78787 - protein, 14 aa, Mycobacterium tuberculosis
KDMEFVQYHPTGLP

SEQ ID NO: 78788 - protein, 14 aa, Mycobacterium tuberculosis
DMEFVQYHPTGLPF

SEQ ID NO: 78789 - protein, 14 aa, Mycobacterium tuberculosis
MEFVQYHPTGLPFT

SEQ ID NO: 78790 - protein, 14 aa, Mycobacterium tuberculosis
EFVQYHPTGLPFTG

SEQ ID NO: 78791 - protein, 14 aa, Mycobacterium tuberculosis
FVQYHPTGLPFTGI

SEQ ID NO: 78792 - protein, 14 aa, Mycobacterium tuberculosis
VQYHPTGLPFTGIL

SEQ ID NO: 78793 - protein, 14 aa, Mycobacterium tuberculosis
QYHPTGLPFTGILI

SEQ ID NO: 78794 - protein, 14 aa, Mycobacterium tuberculosis
YHPTGLPFTGILIT

SEQ ID NO: 78795 - protein, 14 aa, Mycobacterium tuberculosis
HPTGLPFTGILITE

SEQ ID NO: 78796 - protein, 14 aa, Mycobacterium tuberculosis
PTGLPFTGILITEA

SEQ ID NO: 78797 - protein, 14 aa, Mycobacterium tuberculosis
TGLPFTGILITEAA

SEQ ID NO: 78798 - protein, 14 aa, Mycobacterium tuberculosis
GLPFTGILITEAAR

SEQ ID NO: 78799 - protein, 14 aa, Mycobacterium tuberculosis
LPFTGILITEAARA

SEQ ID NO: 78800 - protein, 14 aa, Mycobacterium tuberculosis
PFTGILITEAARAE

SEQ ID NO: 78801 - protein, 14 aa, Mycobacterium tuberculosis
FTGILITEAARAEG

SEQ ID NO: 78802 - protein, 14 aa, Mycobacterium tuberculosis
TGILITEAARAEGG

SEQ ID NO: 78803 - protein, 14 aa, Mycobacterium tuberculosis
GILITEAARAEGGW

SEQ ID NO: 78804 - protein, 14 aa, Mycobacterium tuberculosis
ILITEAARAEGGWL

SEQ ID NO: 78805 - protein, 14 aa, Mycobacterium tuberculosis
LITEAARAEGGWLL

SEQ ID NO: 78806 - protein, 14 aa, Mycobacterium tuberculosis
ITEAARAEGGWLLN

SEQ ID NO: 78807 - protein, 14 aa, Mycobacterium tuberculosis
TEAARAEGGWLLNK

SEQ ID NO: 78808 - protein, 14 aa, Mycobacterium tuberculosis
EAARAEGGWLLNKD

SEQ ID NO: 78809 - protein, 14 aa, Mycobacterium tuberculosis
AARAEGGWLLNKDG

SEQ ID NO: 78810 - protein, 14 aa, Mycobacterium tuberculosis
ARAEGGWLLNKDGY

SEQ ID NO: 78811 - protein, 14 aa, Mycobacterium tuberculosis
RAEGGWLLNKDGYR

SEQ ID NO: 78812 - protein, 14 aa, Mycobacterium tuberculosis
AEGGWLLNKDGYRY

SEQ ID NO: 78813 - protein, 14 aa, Mycobacterium tuberculosis
EGGWLLNKDGYRYL

SEQ ID NO: 78814 - protein, 14 aa, Mycobacterium tuberculosis
GGWLLNKDGYRYLQ

SEQ ID NO: 78815 - protein, 14 aa, Mycobacterium tuberculosis
GWLLNKDGYRYLQD

SEQ ID NO: 78816 - protein, 14 aa, Mycobacterium tuberculosis
WLLNKDGYRYLQDY

SEQ ID NO: 78817 - protein, 14 aa, Mycobacterium tuberculosis
LLNKDGYRYLQDYD

SEQ ID NO: 78818 - protein, 14 aa, Mycobacterium tuberculosis
LNKDGYRYLQDYDL

SEQ ID NO: 78819 - protein, 14 aa, Mycobacterium tuberculosis
NKDGYRYLQDYDLG

SEQ ID NO: 78820 - protein, 14 aa, Mycobacterium tuberculosis
KDGYRYLQDYDLGK

SEQ ID NO: 78821 - protein, 14 aa, Mycobacterium tuberculosis
DGYRYLQDYDLGKP

SEQ ID NO: 78822 - protein, 14 aa, Mycobacterium tuberculosis
GYRYLQDYDLGKPT

SEQ ID NO: 78823 - protein, 14 aa, Mycobacterium tuberculosis
YRYLQDYDLGKPTP

SEQ ID NO: 78824 - protein, 14 aa, Mycobacterium tuberculosis
RYLQDYDLGKPTPE

SEQ ID NO: 78825 - protein, 14 aa, Mycobacterium tuberculosis
YLQDYDLGKPTPEP

SEQ ID NO: 78826 - protein, 14 aa, Mycobacterium tuberculosis
LQDYDLGKPTPEPR

SEQ ID NO: 78827 - protein, 14 aa, Mycobacterium tuberculosis
QDYDLGKPTPEPRL

SEQ ID NO: 78828 - protein, 14 aa, Mycobacterium tuberculosis
DYDLGKPTPEPRLR

SEQ ID NO: 78829 - protein, 14 aa, Mycobacterium tuberculosis
YDLGKPTPEPRLRS

SEQ ID NO: 78830 - protein, 14 aa, Mycobacterium tuberculosis
DLGKPTPEPRLRSM

SEQ ID NO: 78831 - protein, 14 aa, Mycobacterium tuberculosis
LGKPTPEPRLRSME

SEQ ID NO: 78832 - protein, 14 aa, Mycobacterium tuberculosis
GKPTPEPRLRSMEL

SEQ ID NO: 78833 - protein, 14 aa, Mycobacterium tuberculosis
KPTPEPRLRSMELG

SEQ ID NO: 78834 - protein, 14 aa, Mycobacterium tuberculosis
PTPEPRLRSMELGP

SEQ ID NO: 78835 - protein, 14 aa, Mycobacterium tuberculosis
TPEPRLRSMELGPR

SEQ ID NO: 78836 - protein, 14 aa, Mycobacterium tuberculosis
PEPRLRSMELGPRD

SEQ ID NO: 78837 - protein, 14 aa, Mycobacterium tuberculosis
EPRLRSMELGPRDR

SEQ ID NO: 78838 - protein, 14 aa, Mycobacterium tuberculosis
PRLRSMELGPRDRL

SEQ ID NO: 78839 - protein, 14 aa, Mycobacterium tuberculosis
RLRSMELGPRDRLS

SEQ ID NO: 78840 - protein, 14 aa, Mycobacterium tuberculosis
LRSMELGPRDRLSQ

SEQ ID NO: 78841 - protein, 14 aa, Mycobacterium tuberculosis
RSMELGPRDRLSQA

SEQ ID NO: 78842 - protein, 14 aa, Mycobacterium tuberculosis
SMELGPRDRLSQAF

SEQ ID NO: 78843 - protein, 14 aa, Mycobacterium tuberculosis
MELGPRDRLSQAFV

SEQ ID NO: 78844 - protein, 14 aa, Mycobacterium tuberculosis
ELGPRDRLSQAFVH

SEQ ID NO: 78845 - protein, 14 aa, Mycobacterium tuberculosis
LGPRDRLSQAFVHE

SEQ ID NO: 78846 - protein, 14 aa, Mycobacterium tuberculosis
GPRDRLSQAFVHEH

SEQ ID NO: 78847 - protein, 14 aa, Mycobacterium tuberculosis
PRDRLSQAFVHEHN

SEQ ID NO: 78848 - protein, 14 aa, Mycobacterium tuberculosis
RDRLSQAFVHEHNK

SEQ ID NO: 78849 - protein, 14 aa, Mycobacterium tuberculosis
DRLSQAFVHEHNKG

SEQ ID NO: 78850 - protein, 14 aa, Mycobacterium tuberculosis
RLSQAFVHEHNKGR

SEQ ID NO: 78851 - protein, 14 aa, Mycobacterium tuberculosis
LSQAFVHEHNKGRT

SEQ ID NO: 78852 - protein, 14 aa, Mycobacterium tuberculosis
SQAFVHEHNKGRTV

SEQ ID NO: 78853 - protein, 14 aa, Mycobacterium tuberculosis
QAFVHEHNKGRTVD

SEQ ID NO: 78854 - protein, 14 aa, Mycobacterium tuberculosis
AFVHEHNKGRTVDT

SEQ ID NO: 78855 - protein, 14 aa, Mycobacterium tuberculosis
FVHEHNKGRTVDTP

SEQ ID NO: 78856 - protein, 14 aa, Mycobacterium tuberculosis
VHEHNKGRTVDTPY

SEQ ID NO: 78857 - protein, 14 aa, Mycobacterium tuberculosis
HEHNKGRTVDTPYG

SEQ ID NO: 78858 - protein, 14 aa, Mycobacterium tuberculosis
EHNKGRTVDTPYGP

SEQ ID NO: 78859 - protein, 14 aa, Mycobacterium tuberculosis
HNKGRTVDTPYGPV

SEQ ID NO: 78860 - protein, 14 aa, Mycobacterium tuberculosis
NKGRTVDTPYGPVV

SEQ ID NO: 78861 - protein, 14 aa, Mycobacterium tuberculosis
KGRTVDTPYGPVVY

SEQ ID NO: 78862 - protein, 14 aa, Mycobacterium tuberculosis
GRTVDTPYGPVVYL

SEQ ID NO: 78863 - protein, 14 aa, Mycobacterium tuberculosis
RTVDTPYGPVVYLD

SEQ ID NO: 78864 - protein, 14 aa, Mycobacterium tuberculosis
TVDTPYGPVVYLDL

SEQ ID NO: 78865 - protein, 14 aa, Mycobacterium tuberculosis
VDTPYGPVVYLDLR

SEQ ID NO: 78866 - protein, 14 aa, Mycobacterium tuberculosis
DTPYGPVVYLDLRH

SEQ ID NO: 78867 - protein, 14 aa, Mycobacterium tuberculosis
TPYGPVVYLDLRHL

SEQ ID NO: 78868 - protein, 14 aa, Mycobacterium tuberculosis
PYGPVVYLDLRHLG

SEQ ID NO: 78869 - protein, 14 aa, Mycobacterium tuberculosis
YGPVVYLDLRHLGA

SEQ ID NO: 78870 - protein, 14 aa, Mycobacterium tuberculosis
GPVVYLDLRHLGAD

SEQ ID NO: 78871 - protein, 14 aa, Mycobacterium tuberculosis
PVVYLDLRHLGADL

SEQ ID NO: 78872 - protein, 14 aa, Mycobacterium tuberculosis
VVYLDLRHLGADLI

SEQ ID NO: 78873 - protein, 14 aa, Mycobacterium tuberculosis
VYLDLRHLGADLID

SEQ ID NO: 78874 - protein, 14 aa, Mycobacterium tuberculosis
YLDLRHLGADLIDA

SEQ ID NO: 78875 - protein, 14 aa, Mycobacterium tuberculosis
LDLRHLGADLIDAK

SEQ ID NO: 78876 - protein, 14 aa, Mycobacterium tuberculosis
DLRHLGADLIDAKL

SEQ ID NO: 78877 - protein, 14 aa, Mycobacterium tuberculosis
LRHLGADLIDAKLP

SEQ ID NO: 78878 - protein, 14 aa, Mycobacterium tuberculosis
RHLGADLIDAKLPF

SEQ ID NO: 78879 - protein, 14 aa, Mycobacterium tuberculosis
HLGADLIDAKLPFV

SEQ ID NO: 78880 - protein, 14 aa, Mycobacterium tuberculosis
LGADLIDAKLPFVR

SEQ ID NO: 78881 - protein, 14 aa, Mycobacterium tuberculosis
GADLIDAKLPFVRE

SEQ ID NO: 78882 - protein, 14 aa, Mycobacterium tuberculosis
ADLIDAKLPFVREL

SEQ ID NO: 78883 - protein, 14 aa, Mycobacterium tuberculosis
DLIDAKLPFVRELC

SEQ ID NO: 78884 - protein, 14 aa, Mycobacterium tuberculosis
LIDAKLPFVRELCR

SEQ ID NO: 78885 - protein, 14 aa, Mycobacterium tuberculosis
IDAKLPFVRELCRD

SEQ ID NO: 78886 - protein, 14 aa, Mycobacterium tuberculosis
DAKLPFVRELCRDY

SEQ ID NO: 78887 - protein, 14 aa, Mycobacterium tuberculosis
AKLPFVRELCRDYQ

SEQ ID NO: 78888 - protein, 14 aa, Mycobacterium tuberculosis
KLPFVRELCRDYQH

SEQ ID NO: 78889 - protein, 14 aa, Mycobacterium tuberculosis
LPFVRELCRDYQHI

SEQ ID NO: 78890 - protein, 14 aa, Mycobacterium tuberculosis
PFVRELCRDYQHID

SEQ ID NO: 78891 - protein, 14 aa, Mycobacterium tuberculosis
FVRELCRDYQHIDP

SEQ ID NO: 78892 - protein, 14 aa, Mycobacterium tuberculosis
VRELCRDYQHIDPV

SEQ ID NO: 78893 - protein, 14 aa, Mycobacterium tuberculosis
RELCRDYQHIDPVV

SEQ ID NO: 78894 - protein, 14 aa, Mycobacterium tuberculosis
ELCRDYQHIDPVVE

SEQ ID NO: 78895 - protein, 14 aa, Mycobacterium tuberculosis
LCRDYQHIDPVVEL

SEQ ID NO: 78896 - protein, 14 aa, Mycobacterium tuberculosis
CRDYQHIDPVVELV

SEQ ID NO: 78897 - protein, 14 aa, Mycobacterium tuberculosis
RDYQHIDPVVELVP

SEQ ID NO: 78898 - protein, 14 aa, Mycobacterium tuberculosis
DYQHIDPVVELVPV

SEQ ID NO: 78899 - protein, 14 aa, Mycobacterium tuberculosis
YQHIDPVVELVPVR

SEQ ID NO: 78900 - protein, 14 aa, Mycobacterium tuberculosis
QHIDPVVELVPVRP

SEQ ID NO: 78901 - protein, 14 aa, Mycobacterium tuberculosis
HIDPVVELVPVRPV

SEQ ID NO: 78902 - protein, 14 aa, Mycobacterium tuberculosis
IDPVVELVPVRPVV

SEQ ID NO: 78903 - protein, 14 aa, Mycobacterium tuberculosis
DPVVELVPVRPVVH

SEQ ID NO: 78904 - protein, 14 aa, Mycobacterium tuberculosis
PVVELVPVRPVVHY

SEQ ID NO: 78905 - protein, 14 aa, Mycobacterium tuberculosis
VVELVPVRPVVHYM

SEQ ID NO: 78906 - protein, 14 aa, Mycobacterium tuberculosis
VELVPVRPVVHYMM

SEQ ID NO: 78907 - protein, 14 aa, Mycobacterium tuberculosis
ELVPVRPVVHYMMG

SEQ ID NO: 78908 - protein, 14 aa, Mycobacterium tuberculosis
LVPVRPVVHYMMGG

SEQ ID NO: 78909 - protein, 14 aa, Mycobacterium tuberculosis
VPVRPVVHYMMGGV

SEQ ID NO: 78910 - protein, 14 aa, Mycobacterium tuberculosis
PVRPVVHYMMGGVH

SEQ ID NO: 78911 - protein, 14 aa, Mycobacterium tuberculosis
VRPVVHYMMGGVHT

SEQ ID NO: 78912 - protein, 14 aa, Mycobacterium tuberculosis
RPVVHYMMGGVHTD

SEQ ID NO: 78913 - protein, 14 aa, Mycobacterium tuberculosis
PVVHYMMGGVHTDI

SEQ ID NO: 78914 - protein, 14 aa, Mycobacterium tuberculosis
VVHYMMGGVHTDIN

SEQ ID NO: 78915 - protein, 14 aa, Mycobacterium tuberculosis
VHYMMGGVHTDING

SEQ ID NO: 78916 - protein, 14 aa, Mycobacterium tuberculosis
HYMMGGVHTDINGA

SEQ ID NO: 78917 - protein, 14 aa, Mycobacterium tuberculosis
YMMGGVHTDINGAT

SEQ ID NO: 78918 - protein, 14 aa, Mycobacterium tuberculosis
MMGGVHTDINGATT

SEQ ID NO: 78919 - protein, 14 aa, Mycobacterium tuberculosis
MGGVHTDINGATTL

SEQ ID NO: 78920 - protein, 14 aa, Mycobacterium tuberculosis
GGVHTDINGATTLP

SEQ ID NO: 78921 - protein, 14 aa, Mycobacterium tuberculosis
GVHTDINGATTLPG

SEQ ID NO: 78922 - protein, 14 aa, Mycobacterium tuberculosis
VHTDINGATTLPGL

SEQ ID NO: 78923 - protein, 14 aa, Mycobacterium tuberculosis
HTDINGATTLPGLY

SEQ ID NO: 78924 - protein, 14 aa, Mycobacterium tuberculosis
TDINGATTLPGLYA

SEQ ID NO: 78925 - protein, 14 aa, Mycobacterium tuberculosis
DINGATTLPGLYAA

SEQ ID NO: 78926 - protein, 14 aa, Mycobacterium tuberculosis
INGATTLPGLYAAG

SEQ ID NO: 78927 - protein, 14 aa, Mycobacterium tuberculosis
NGATTLPGLYAAGE

SEQ ID NO: 78928 - protein, 14 aa, Mycobacterium tuberculosis
GATTLPGLYAAGET

SEQ ID NO: 78929 - protein, 14 aa, Mycobacterium tuberculosis
ATTLPGLYAAGETA

SEQ ID NO: 78930 - protein, 14 aa, Mycobacterium tuberculosis
TTLPGLYAAGETAC

SEQ ID NO: 78931 - protein, 14 aa, Mycobacterium tuberculosis
TLPGLYAAGETACV

SEQ ID NO: 78932 - protein, 14 aa, Mycobacterium tuberculosis
LPGLYAAGETACVS

SEQ ID NO: 78933 - protein, 14 aa, Mycobacterium tuberculosis
PGLYAAGETACVSI

SEQ ID NO: 78934 - protein, 14 aa, Mycobacterium tuberculosis
GLYAAGETACVSIN

SEQ ID NO: 78935 - protein, 14 aa, Mycobacterium tuberculosis
LYAAGETACVSING

SEQ ID NO: 78936 - protein, 14 aa, Mycobacterium tuberculosis
YAAGETACVSINGA

SEQ ID NO: 78937 - protein, 14 aa, Mycobacterium tuberculosis
AAGETACVSINGAN

SEQ ID NO: 78938 - protein, 14 aa, Mycobacterium tuberculosis
AGETACVSINGANR

SEQ ID NO: 78939 - protein, 14 aa, Mycobacterium tuberculosis
GETACVSINGANRL

SEQ ID NO: 78940 - protein, 14 aa, Mycobacterium tuberculosis
ETACVSINGANRLG

SEQ ID NO: 78941 - protein, 14 aa, Mycobacterium tuberculosis
TACVSINGANRLGS

SEQ ID NO: 78942 - protein, 14 aa, Mycobacterium tuberculosis
ACVSINGANRLGSN

SEQ ID NO: 78943 - protein, 14 aa, Mycobacterium tuberculosis
CVSINGANRLGSNS

SEQ ID NO: 78944 - protein, 14 aa, Mycobacterium tuberculosis
VSINGANRLGSNSL

SEQ ID NO: 78945 - protein, 14 aa, Mycobacterium tuberculosis
SINGANRLGSNSLP

SEQ ID NO: 78946 - protein, 14 aa, Mycobacterium tuberculosis
INGANRLGSNSLPE

SEQ ID NO: 78947 - protein, 14 aa, Mycobacterium tuberculosis
NGANRLGSNSLPEL

SEQ ID NO: 78948 - protein, 14 aa, Mycobacterium tuberculosis
GANRLGSNSLPELL

SEQ ID NO: 78949 - protein, 14 aa, Mycobacterium tuberculosis
ANRLGSNSLPELLV

SEQ ID NO: 78950 - protein, 14 aa, Mycobacterium tuberculosis
NRLGSNSLPELLVF

SEQ ID NO: 78951 - protein, 14 aa, Mycobacterium tuberculosis
RLGSNSLPELLVFG

SEQ ID NO: 78952 - protein, 14 aa, Mycobacterium tuberculosis
LGSNSLPELLVFGA

SEQ ID NO: 78953 - protein, 14 aa, Mycobacterium tuberculosis
GSNSLPELLVFGAR

SEQ ID NO: 78954 - protein, 14 aa, Mycobacterium tuberculosis
SNSLPELLVFGARA

SEQ ID NO: 78955 - protein, 14 aa, Mycobacterium tuberculosis
NSLPELLVFGARAG

SEQ ID NO: 78956 - protein, 14 aa, Mycobacterium tuberculosis
SLPELLVFGARAGR

SEQ ID NO: 78957 - protein, 14 aa, Mycobacterium tuberculosis
LPELLVFGARAGRA

SEQ ID NO: 78958 - protein, 14 aa, Mycobacterium tuberculosis
PELLVFGARAGRAA

SEQ ID NO: 78959 - protein, 14 aa, Mycobacterium tuberculosis
ELLVFGARAGRAAA

SEQ ID NO: 78960 - protein, 14 aa, Mycobacterium tuberculosis
LLVFGARAGRAAAD

SEQ ID NO: 78961 - protein, 14 aa, Mycobacterium tuberculosis
LVFGARAGRAAADY

SEQ ID NO: 78962 - protein, 14 aa, Mycobacterium tuberculosis
VFGARAGRAAADYA

SEQ ID NO: 78963 - protein, 14 aa, Mycobacterium tuberculosis
FGARAGRAAADYAA

SEQ ID NO: 78964 - protein, 14 aa, Mycobacterium tuberculosis
GARAGRAAADYAAR

SEQ ID NO: 78965 - protein, 14 aa, Mycobacterium tuberculosis
ARAGRAAADYAARH

SEQ ID NO: 78966 - protein, 14 aa, Mycobacterium tuberculosis
RAGRAAADYAARHQ

SEQ ID NO: 78967 - protein, 14 aa, Mycobacterium tuberculosis
AGRAAADYAARHQK

SEQ ID NO: 78968 - protein, 14 aa, Mycobacterium tuberculosis
GRAAADYAARHQKS

SEQ ID NO: 78969 - protein, 14 aa, Mycobacterium tuberculosis
RAAADYAARHQKSD

SEQ ID NO: 78970 - protein, 14 aa, Mycobacterium tuberculosis
AAADYAARHQKSDR

SEQ ID NO: 78971 - protein, 14 aa, Mycobacterium tuberculosis
AADYAARHQKSDRG

SEQ ID NO: 78972 - protein, 14 aa, Mycobacterium tuberculosis
ADYAARHQKSDRGP

SEQ ID NO: 78973 - protein, 14 aa, Mycobacterium tuberculosis
DYAARHQKSDRGPS

SEQ ID NO: 78974 - protein, 14 aa, Mycobacterium tuberculosis
YAARHQKSDRGPSS

SEQ ID NO: 78975 - protein, 14 aa, Mycobacterium tuberculosis
AARHQKSDRGPSSA

SEQ ID NO: 78976 - protein, 14 aa, Mycobacterium tuberculosis
ARHQKSDRGPSSAV

SEQ ID NO: 78977 - protein, 14 aa, Mycobacterium tuberculosis
RHQKSDRGPSSAVR

SEQ ID NO: 78978 - protein, 14 aa, Mycobacterium tuberculosis
HQKSDRGPSSAVRA

SEQ ID NO: 78979 - protein, 14 aa, Mycobacterium tuberculosis
QKSDRGPSSAVRAQ

SEQ ID NO: 78980 - protein, 14 aa, Mycobacterium tuberculosis
KSDRGPSSAVRAQA

SEQ ID NO: 78981 - protein, 14 aa, Mycobacterium tuberculosis
SDRGPSSAVRAQAR

SEQ ID NO: 78982 - protein, 14 aa, Mycobacterium tuberculosis
DRGPSSAVRAQART

SEQ ID NO: 78983 - protein, 14 aa, Mycobacterium tuberculosis
RGPSSAVRAQARTE

SEQ ID NO: 78984 - protein, 14 aa, Mycobacterium tuberculosis
GPSSAVRAQARTEA

SEQ ID NO: 78985 - protein, 14 aa, Mycobacterium tuberculosis
PSSAVRAQARTEAL

SEQ ID NO: 78986 - protein, 14 aa, Mycobacterium tuberculosis
SSAVRAQARTEALR

SEQ ID NO: 78987 - protein, 14 aa, Mycobacterium tuberculosis
SAVRAQARTEALRL

SEQ ID NO: 78988 - protein, 14 aa, Mycobacterium tuberculosis
AVRAQARTEALRLE

SEQ ID NO: 78989 - protein, 14 aa, Mycobacterium tuberculosis
VRAQARTEALRLER

SEQ ID NO: 78990 - protein, 14 aa, Mycobacterium tuberculosis
RAQARTEALRLERE

SEQ ID NO: 78991 - protein, 14 aa, Mycobacterium tuberculosis
AQARTEALRLEREL

SEQ ID NO: 78992 - protein, 14 aa, Mycobacterium tuberculosis
QARTEALRLERELS

SEQ ID NO: 78993 - protein, 14 aa, Mycobacterium tuberculosis
ARTEALRLERELSR

SEQ ID NO: 78994 - protein, 14 aa, Mycobacterium tuberculosis
RTEALRLERELSRH

SEQ ID NO: 78995 - protein, 14 aa, Mycobacterium tuberculosis
TEALRLERELSRHG

SEQ ID NO: 78996 - protein, 14 aa, Mycobacterium tuberculosis
EALRLERELSRHGQ

SEQ ID NO: 78997 - protein, 14 aa, Mycobacterium tuberculosis
ALRLERELSRHGQG

SEQ ID NO: 78998 - protein, 14 aa, Mycobacterium tuberculosis
LRLERELSRHGQGG

SEQ ID NO: 78999 - protein, 14 aa, Mycobacterium tuberculosis
RLERELSRHGQGGE

SEQ ID NO: 79000 - protein, 14 aa, Mycobacterium tuberculosis
LERELSRHGQGGER

SEQ ID NO: 79001 - protein, 14 aa, Mycobacterium tuberculosis
ERELSRHGQGGERI

SEQ ID NO: 79002 - protein, 14 aa, Mycobacterium tuberculosis
RELSRHGQGGERIA

SEQ ID NO: 79003 - protein, 14 aa, Mycobacterium tuberculosis
ELSRHGQGGERIAD

SEQ ID NO: 79004 - protein, 14 aa, Mycobacterium tuberculosis
LSRHGQGGERIADI

SEQ ID NO: 79005 - protein, 14 aa, Mycobacterium tuberculosis
SRHGQGGERIADIR

SEQ ID NO: 79006 - protein, 14 aa, Mycobacterium tuberculosis
RHGQGGERIADIRA

SEQ ID NO: 79007 - protein, 14 aa, Mycobacterium tuberculosis
HGQGGERIADIRAD

SEQ ID NO: 79008 - protein, 14 aa, Mycobacterium tuberculosis
GQGGERIADIRADM

SEQ ID NO: 79009 - protein, 14 aa, Mycobacterium tuberculosis
QGGERIADIRADMQ

SEQ ID NO: 79010 - protein, 14 aa, Mycobacterium tuberculosis
GGERIADIRADMQA

SEQ ID NO: 79011 - protein, 14 aa, Mycobacterium tuberculosis
GERIADIRADMQAT

SEQ ID NO: 79012 - protein, 14 aa, Mycobacterium tuberculosis
ERIADIRADMQATL

SEQ ID NO: 79013 - protein, 14 aa, Mycobacterium tuberculosis
RIADIRADMQATLE

SEQ ID NO: 79014 - protein, 14 aa, Mycobacterium tuberculosis
IADIRADMQATLES

SEQ ID NO: 79015 - protein, 14 aa, Mycobacterium tuberculosis
ADIRADMQATLESA

SEQ ID NO: 79016 - protein, 14 aa, Mycobacterium tuberculosis
DIRADMQATLESAA

SEQ ID NO: 79017 - protein, 14 aa, Mycobacterium tuberculosis
IRADMQATLESAAG

SEQ ID NO: 79018 - protein, 14 aa, Mycobacterium tuberculosis
RADMQATLESAAGI

SEQ ID NO: 79019 - protein, 14 aa, Mycobacterium tuberculosis
ADMQATLESAAGIY

SEQ ID NO: 79020 - protein, 14 aa, Mycobacterium tuberculosis
DMQATLESAAGIYR

SEQ ID NO: 79021 - protein, 14 aa, Mycobacterium tuberculosis
MQATLESAAGIYRD

SEQ ID NO: 79022 - protein, 14 aa, Mycobacterium tuberculosis
QATLESAAGIYRDG

SEQ ID NO: 79023 - protein, 14 aa, Mycobacterium tuberculosis
ATLESAAGIYRDGP

SEQ ID NO: 79024 - protein, 14 aa, Mycobacterium tuberculosis
TLESAAGIYRDGPT

SEQ ID NO: 79025 - protein, 14 aa, Mycobacterium tuberculosis
LESAAGIYRDGPTL

SEQ ID NO: 79026 - protein, 14 aa, Mycobacterium tuberculosis
ESAAGIYRDGPTLT

SEQ ID NO: 79027 - protein, 14 aa, Mycobacterium tuberculosis
SAAGIYRDGPTLTK

SEQ ID NO: 79028 - protein, 14 aa, Mycobacterium tuberculosis
AAGIYRDGPTLTKA

SEQ ID NO: 79029 - protein, 14 aa, Mycobacterium tuberculosis
AGIYRDGPTLTKAV

SEQ ID NO: 79030 - protein, 14 aa, Mycobacterium tuberculosis
GIYRDGPTLTKAVE

SEQ ID NO: 79031 - protein, 14 aa, Mycobacterium tuberculosis
IYRDGPTLTKAVEE

SEQ ID NO: 79032 - protein, 14 aa, Mycobacterium tuberculosis
YRDGPTLTKAVEEI

SEQ ID NO: 79033 - protein, 14 aa, Mycobacterium tuberculosis
RDGPTLTKAVEEIR

SEQ ID NO: 79034 - protein, 14 aa, Mycobacterium tuberculosis
DGPTLTKAVEEIRV

SEQ ID NO: 79035 - protein, 14 aa, Mycobacterium tuberculosis
GPTLTKAVEEIRVL

SEQ ID NO: 79036 - protein, 14 aa, Mycobacterium tuberculosis
PTLTKAVEEIRVLQ

SEQ ID NO: 79037 - protein, 14 aa, Mycobacterium tuberculosis
TLTKAVEEIRVLQE

SEQ ID NO: 79038 - protein, 14 aa, Mycobacterium tuberculosis
LTKAVEEIRVLQER

SEQ ID NO: 79039 - protein, 14 aa, Mycobacterium tuberculosis
TKAVEEIRVLQERF

SEQ ID NO: 79040 - protein, 14 aa, Mycobacterium tuberculosis
KAVEEIRVLQERFA

SEQ ID NO: 79041 - protein, 14 aa, Mycobacterium tuberculosis
AVEEIRVLQERFAT

SEQ ID NO: 79042 - protein, 14 aa, Mycobacterium tuberculosis
VEEIRVLQERFATA

SEQ ID NO: 79043 - protein, 14 aa, Mycobacterium tuberculosis
EEIRVLQERFATAG

SEQ ID NO: 79044 - protein, 14 aa, Mycobacterium tuberculosis
EIRVLQERFATAGI

SEQ ID NO: 79045 - protein, 14 aa, Mycobacterium tuberculosis
IRVLQERFATAGID

SEQ ID NO: 79046 - protein, 14 aa, Mycobacterium tuberculosis
RVLQERFATAGIDD

SEQ ID NO: 79047 - protein, 14 aa, Mycobacterium tuberculosis
VLQERFATAGIDDH

SEQ ID NO: 79048 - protein, 14 aa, Mycobacterium tuberculosis
LQERFATAGIDDHS

SEQ ID NO: 79049 - protein, 14 aa, Mycobacterium tuberculosis
QERFATAGIDDHSR

SEQ ID NO: 79050 - protein, 14 aa, Mycobacterium tuberculosis
ERFATAGIDDHSRT

SEQ ID NO: 79051 - protein, 14 aa, Mycobacterium tuberculosis
RFATAGIDDHSRTF

SEQ ID NO: 79052 - protein, 14 aa, Mycobacterium tuberculosis
FATAGIDDHSRTFN

SEQ ID NO: 79053 - protein, 14 aa, Mycobacterium tuberculosis
ATAGIDDHSRTFNT

SEQ ID NO: 79054 - protein, 14 aa, Mycobacterium tuberculosis
TAGIDDHSRTFNTE

SEQ ID NO: 79055 - protein, 14 aa, Mycobacterium tuberculosis
AGIDDHSRTFNTEL

SEQ ID NO: 79056 - protein, 14 aa, Mycobacterium tuberculosis
GIDDHSRTFNTELT

SEQ ID NO: 79057 - protein, 14 aa, Mycobacterium tuberculosis
IDDHSRTFNTELTA

SEQ ID NO: 79058 - protein, 14 aa, Mycobacterium tuberculosis
DDHSRTFNTELTAL

SEQ ID NO: 79059 - protein, 14 aa, Mycobacterium tuberculosis
DHSRTFNTELTALL

SEQ ID NO: 79060 - protein, 14 aa, Mycobacterium tuberculosis
HSRTFNTELTALLE

SEQ ID NO: 79061 - protein, 14 aa, Mycobacterium tuberculosis
SRTFNTELTALLEL

SEQ ID NO: 79062 - protein, 14 aa, Mycobacterium tuberculosis
RTFNTELTALLELS

SEQ ID NO: 79063 - protein, 14 aa, Mycobacterium tuberculosis
TFNTELTALLELSG

SEQ ID NO: 79064 - protein, 14 aa, Mycobacterium tuberculosis
FNTELTALLELSGM

SEQ ID NO: 79065 - protein, 14 aa, Mycobacterium tuberculosis
NTELTALLELSGML

SEQ ID NO: 79066 - protein, 14 aa, Mycobacterium tuberculosis
TELTALLELSGMLD

SEQ ID NO: 79067 - protein, 14 aa, Mycobacterium tuberculosis
ELTALLELSGMLDV

SEQ ID NO: 79068 - protein, 14 aa, Mycobacterium tuberculosis
LTALLELSGMLDVA

SEQ ID NO: 79069 - protein, 14 aa, Mycobacterium tuberculosis
TALLELSGMLDVAL

SEQ ID NO: 79070 - protein, 14 aa, Mycobacterium tuberculosis
ALLELSGMLDVALA

SEQ ID NO: 79071 - protein, 14 aa, Mycobacterium tuberculosis
LLELSGMLDVALAI

SEQ ID NO: 79072 - protein, 14 aa, Mycobacterium tuberculosis
LELSGMLDVALAIV

SEQ ID NO: 79073 - protein, 14 aa, Mycobacterium tuberculosis
ELSGMLDVALAIVE

SEQ ID NO: 79074 - protein, 14 aa, Mycobacterium tuberculosis
LSGMLDVALAIVES

SEQ ID NO: 79075 - protein, 14 aa, Mycobacterium tuberculosis
SGMLDVALAIVESG

SEQ ID NO: 79076 - protein, 14 aa, Mycobacterium tuberculosis
GMLDVALAIVESGL

SEQ ID NO: 79077 - protein, 14 aa, Mycobacterium tuberculosis
MLDVALAIVESGLR

SEQ ID NO: 79078 - protein, 14 aa, Mycobacterium tuberculosis
LDVALAIVESGLRR

SEQ ID NO: 79079 - protein, 14 aa, Mycobacterium tuberculosis
DVALAIVESGLRRE

SEQ ID NO: 79080 - protein, 14 aa, Mycobacterium tuberculosis
VALAIVESGLRREE

SEQ ID NO: 79081 - protein, 14 aa, Mycobacterium tuberculosis
ALAIVESGLRREES

SEQ ID NO: 79082 - protein, 14 aa, Mycobacterium tuberculosis
LAIVESGLRREESR

SEQ ID NO: 79083 - protein, 14 aa, Mycobacterium tuberculosis
AIVESGLRREESRG

SEQ ID NO: 79084 - protein, 14 aa, Mycobacterium tuberculosis
IVESGLRREESRGA

SEQ ID NO: 79085 - protein, 14 aa, Mycobacterium tuberculosis
VESGLRREESRGAH

SEQ ID NO: 79086 - protein, 14 aa, Mycobacterium tuberculosis
ESGLRREESRGAHQ

SEQ ID NO: 79087 - protein, 14 aa, Mycobacterium tuberculosis
SGLRREESRGAHQR

SEQ ID NO: 79088 - protein, 14 aa, Mycobacterium tuberculosis
GLRREESRGAHQRT

SEQ ID NO: 79089 - protein, 14 aa, Mycobacterium tuberculosis
LRREESRGAHQRTD

SEQ ID NO: 79090 - protein, 14 aa, Mycobacterium tuberculosis
RREESRGAHQRTDF

SEQ ID NO: 79091 - protein, 14 aa, Mycobacterium tuberculosis
REESRGAHQRTDFP

SEQ ID NO: 79092 - protein, 14 aa, Mycobacterium tuberculosis
EESRGAHQRTDFPN

SEQ ID NO: 79093 - protein, 14 aa, Mycobacterium tuberculosis
ESRGAHQRTDFPNR

SEQ ID NO: 79094 - protein, 14 aa, Mycobacterium tuberculosis
SRGAHQRTDFPNRD

SEQ ID NO: 79095 - protein, 14 aa, Mycobacterium tuberculosis
RGAHQRTDFPNRDD

SEQ ID NO: 79096 - protein, 14 aa, Mycobacterium tuberculosis
GAHQRTDFPNRDDE

SEQ ID NO: 79097 - protein, 14 aa, Mycobacterium tuberculosis
AHQRTDFPNRDDEH

SEQ ID NO: 79098 - protein, 14 aa, Mycobacterium tuberculosis
HQRTDFPNRDDEHF

SEQ ID NO: 79099 - protein, 14 aa, Mycobacterium tuberculosis
QRTDFPNRDDEHFL

SEQ ID NO: 79100 - protein, 14 aa, Mycobacterium tuberculosis
RTDFPNRDDEHFLA

SEQ ID NO: 79101 - protein, 14 aa, Mycobacterium tuberculosis
TDFPNRDDEHFLAH

SEQ ID NO: 79102 - protein, 14 aa, Mycobacterium tuberculosis
DFPNRDDEHFLAHT

SEQ ID NO: 79103 - protein, 14 aa, Mycobacterium tuberculosis
FPNRDDEHFLAHTL

SEQ ID NO: 79104 - protein, 14 aa, Mycobacterium tuberculosis
PNRDDEHFLAHTLV

SEQ ID NO: 79105 - protein, 14 aa, Mycobacterium tuberculosis
NRDDEHFLAHTLVH

SEQ ID NO: 79106 - protein, 14 aa, Mycobacterium tuberculosis
RDDEHFLAHTLVHR

SEQ ID NO: 79107 - protein, 14 aa, Mycobacterium tuberculosis
DDEHFLAHTLVHRE

SEQ ID NO: 79108 - protein, 14 aa, Mycobacterium tuberculosis
DEHFLAHTLVHRES

SEQ ID NO: 79109 - protein, 14 aa, Mycobacterium tuberculosis
EHFLAHTLVHRESD

SEQ ID NO: 79110 - protein, 14 aa, Mycobacterium tuberculosis
HFLAHTLVHRESDG

SEQ ID NO: 79111 - protein, 14 aa, Mycobacterium tuberculosis
FLAHTLVHRESDGT

SEQ ID NO: 79112 - protein, 14 aa, Mycobacterium tuberculosis
LAHTLVHRESDGTL

SEQ ID NO: 79113 - protein, 14 aa, Mycobacterium tuberculosis
AHTLVHRESDGTLR

SEQ ID NO: 79114 - protein, 14 aa, Mycobacterium tuberculosis
HTLVHRESDGTLRV

SEQ ID NO: 79115 - protein, 14 aa, Mycobacterium tuberculosis
TLVHRESDGTLRVG

SEQ ID NO: 79116 - protein, 14 aa, Mycobacterium tuberculosis
LVHRESDGTLRVGY

SEQ ID NO: 79117 - protein, 14 aa, Mycobacterium tuberculosis
VHRESDGTLRVGYL

SEQ ID NO: 79118 - protein, 14 aa, Mycobacterium tuberculosis
HRESDGTLRVGYLP

SEQ ID NO: 79119 - protein, 14 aa, Mycobacterium tuberculosis
RESDGTLRVGYLPV

SEQ ID NO: 79120 - protein, 14 aa, Mycobacterium tuberculosis
ESDGTLRVGYLPVT

SEQ ID NO: 79121 - protein, 14 aa, Mycobacterium tuberculosis
SDGTLRVGYLPVTI

SEQ ID NO: 79122 - protein, 14 aa, Mycobacterium tuberculosis
DGTLRVGYLPVTIT

SEQ ID NO: 79123 - protein, 14 aa, Mycobacterium tuberculosis
GTLRVGYLPVTITR

SEQ ID NO: 79124 - protein, 14 aa, Mycobacterium tuberculosis
TLRVGYLPVTITRW

SEQ ID NO: 79125 - protein, 14 aa, Mycobacterium tuberculosis
LRVGYLPVTITRWP

SEQ ID NO: 79126 - protein, 14 aa, Mycobacterium tuberculosis
RVGYLPVTITRWPP

SEQ ID NO: 79127 - protein, 14 aa, Mycobacterium tuberculosis
VGYLPVTITRWPPG

SEQ ID NO: 79128 - protein, 14 aa, Mycobacterium tuberculosis
GYLPVTITRWPPGE

SEQ ID NO: 79129 - protein, 14 aa, Mycobacterium tuberculosis
YLPVTITRWPPGER

SEQ ID NO: 79130 - protein, 14 aa, Mycobacterium tuberculosis
LPVTITRWPPGERV

SEQ ID NO: 79131 - protein, 14 aa, Mycobacterium tuberculosis
PVTITRWPPGERVY

SEQ ID NO: 79132 - protein, 14 aa, Mycobacterium tuberculosis
VTITRWPPGERVYG

SEQ ID NO: 79133 - protein, 14 aa, Mycobacterium tuberculosis
TITRWPPGERVYGR

SEQ ID NO: 79134 - protein, 15 aa, Mycobacterium tuberculosis
MTAQHNIVVIGGGGA

SEQ ID NO: 79135 - protein, 15 aa, Mycobacterium tuberculosis
TAQHNIVVIGGGGAG

SEQ ID NO: 79136 - protein, 15 aa, Mycobacterium tuberculosis
AQHNIVVIGGGGAGL

SEQ ID NO: 79137 - protein, 15 aa, Mycobacterium tuberculosis
QHNIVVIGGGGAGLR

SEQ ID NO: 79138 - protein, 15 aa, Mycobacterium tuberculosis
HNIVVIGGGGAGLRA

SEQ ID NO: 79139 - protein, 15 aa, Mycobacterium tuberculosis
NIVVIGGGGAGLRAA

SEQ ID NO: 79140 - protein, 15 aa, Mycobacterium tuberculosis
IVVIGGGGAGLRAAI

SEQ ID NO: 79141 - protein, 15 aa, Mycobacterium tuberculosis
VVIGGGGAGLRAAIA

SEQ ID NO: 79142 - protein, 15 aa, Mycobacterium tuberculosis
VIGGGGAGLRAAIAI

SEQ ID NO: 79143 - protein, 15 aa, Mycobacterium tuberculosis
IGGGGAGLRAAIAIA

SEQ ID NO: 79144 - protein, 15 aa, Mycobacterium tuberculosis
GGGGAGLRAAIAIAE

SEQ ID NO: 79145 - protein, 15 aa, Mycobacterium tuberculosis
GGGAGLRAAIAIAET

SEQ ID NO: 79146 - protein, 15 aa, Mycobacterium tuberculosis
GGAGLRAAIAIAETN

SEQ ID NO: 79147 - protein, 15 aa, Mycobacterium tuberculosis
GAGLRAAIAIAETNP

SEQ ID NO: 79148 - protein, 15 aa, Mycobacterium tuberculosis
AGLRAAIAIAETNPH

SEQ ID NO: 79149 - protein, 15 aa, Mycobacterium tuberculosis
GLRAAIAIAETNPHL

SEQ ID NO: 79150 - protein, 15 aa, Mycobacterium tuberculosis
LRAAIAIAETNPHLD

SEQ ID NO: 79151 - protein, 15 aa, Mycobacterium tuberculosis
RAAIAIAETNPHLDV

SEQ ID NO: 79152 - protein, 15 aa, Mycobacterium tuberculosis
AAIAIAETNPHLDVA

SEQ ID NO: 79153 - protein, 15 aa, Mycobacterium tuberculosis
AIAIAETNPHLDVAI

SEQ ID NO: 79154 - protein, 15 aa, Mycobacterium tuberculosis
IAIAETNPHLDVAIV

SEQ ID NO: 79155 - protein, 15 aa, Mycobacterium tuberculosis
AIAETNPHLDVAIVS

SEQ ID NO: 79156 - protein, 15 aa, Mycobacterium tuberculosis
IAETNPHLDVAIVSK

SEQ ID NO: 79157 - protein, 15 aa, Mycobacterium tuberculosis
AETNPHLDVAIVSKV

SEQ ID NO: 79158 - protein, 15 aa, Mycobacterium tuberculosis
ETNPHLDVAIVSKVY

SEQ ID NO: 79159 - protein, 15 aa, Mycobacterium tuberculosis
TNPHLDVAIVSKVYP

SEQ ID NO: 79160 - protein, 15 aa, Mycobacterium tuberculosis
NPHLDVAIVSKVYPM

SEQ ID NO: 79161 - protein, 15 aa, Mycobacterium tuberculosis
PHLDVAIVSKVYPMR

SEQ ID NO: 79162 - protein, 15 aa, Mycobacterium tuberculosis
HLDVAIVSKVYPMRS

SEQ ID NO: 79163 - protein, 15 aa, Mycobacterium tuberculosis
LDVAIVSKVYPMRSH

SEQ ID NO: 79164 - protein, 15 aa, Mycobacterium tuberculosis
DVAIVSKVYPMRSHT

SEQ ID NO: 79165 - protein, 15 aa, Mycobacterium tuberculosis
VAIVSKVYPMRSHTV

SEQ ID NO: 79166 - protein, 15 aa, Mycobacterium tuberculosis
AIVSKVYPMRSHTVS

SEQ ID NO: 79167 - protein, 15 aa, Mycobacterium tuberculosis
IVSKVYPMRSHTVSA

SEQ ID NO: 79168 - protein, 15 aa, Mycobacterium tuberculosis
VSKVYPMRSHTVSAE

SEQ ID NO: 79169 - protein, 15 aa, Mycobacterium tuberculosis
SKVYPMRSHTVSAEG

SEQ ID NO: 79170 - protein, 15 aa, Mycobacterium tuberculosis
KVYPMRSHTVSAEGG

SEQ ID NO: 79171 - protein, 15 aa, Mycobacterium tuberculosis
VYPMRSHTVSAEGGA

SEQ ID NO: 79172 - protein, 15 aa, Mycobacterium tuberculosis
YPMRSHTVSAEGGAA

SEQ ID NO: 79173 - protein, 15 aa, Mycobacterium tuberculosis
PMRSHTVSAEGGAAA

SEQ ID NO: 79174 - protein, 15 aa, Mycobacterium tuberculosis
MRSHTVSAEGGAAAV

SEQ ID NO: 79175 - protein, 15 aa, Mycobacterium tuberculosis
RSHTVSAEGGAAAVT

SEQ ID NO: 79176 - protein, 15 aa, Mycobacterium tuberculosis
SHTVSAEGGAAAVTG

SEQ ID NO: 79177 - protein, 15 aa, Mycobacterium tuberculosis
HTVSAEGGAAAVTGD

SEQ ID NO: 79178 - protein, 15 aa, Mycobacterium tuberculosis
TVSAEGGAAAVTGDD

SEQ ID NO: 79179 - protein, 15 aa, Mycobacterium tuberculosis
VSAEGGAAAVTGDDD

SEQ ID NO: 79180 - protein, 15 aa, Mycobacterium tuberculosis
SAEGGAAAVTGDDDS

SEQ ID NO: 79181 - protein, 15 aa, Mycobacterium tuberculosis
AEGGAAAVTGDDDSL

SEQ ID NO: 79182 - protein, 15 aa, Mycobacterium tuberculosis
EGGAAAVTGDDDSLD

SEQ ID NO: 79183 - protein, 15 aa, Mycobacterium tuberculosis
GGAAAVTGDDDSLDE

SEQ ID NO: 79184 - protein, 15 aa, Mycobacterium tuberculosis
GAAAVTGDDDSLDEH

SEQ ID NO: 79185 - protein, 15 aa, Mycobacterium tuberculosis
AAAVTGDDDSLDEHA

SEQ ID NO: 79186 - protein, 15 aa, Mycobacterium tuberculosis
AAVTGDDDSLDEHAH

SEQ ID NO: 79187 - protein, 15 aa, Mycobacterium tuberculosis
AVTGDDDSLDEHAHD

SEQ ID NO: 79188 - protein, 15 aa, Mycobacterium tuberculosis
VTGDDDSLDEHAHDT

SEQ ID NO: 79189 - protein, 15 aa, Mycobacterium tuberculosis
TGDDDSLDEHAHDTV

SEQ ID NO: 79190 - protein, 15 aa, Mycobacterium tuberculosis
GDDDSLDEHAHDTVS

SEQ ID NO: 79191 - protein, 15 aa, Mycobacterium tuberculosis
DDDSLDEHAHDTVSG

SEQ ID NO: 79192 - protein, 15 aa, Mycobacterium tuberculosis
DDSLDEHAHDTVSGG

SEQ ID NO: 79193 - protein, 15 aa, Mycobacterium tuberculosis
DSLDEHAHDTVSGGD

SEQ ID NO: 79194 - protein, 15 aa, Mycobacterium tuberculosis
SLDEHAHDTVSGGDW

SEQ ID NO: 79195 - protein, 15 aa, Mycobacterium tuberculosis
LDEHAHDTVSGGDWL

SEQ ID NO: 79196 - protein, 15 aa, Mycobacterium tuberculosis
DEHAHDTVSGGDWLC

SEQ ID NO: 79197 - protein, 15 aa, Mycobacterium tuberculosis
EHAHDTVSGGDWLCD

SEQ ID NO: 79198 - protein, 15 aa, Mycobacterium tuberculosis
HAHDTVSGGDWLCDQ

SEQ ID NO: 79199 - protein, 15 aa, Mycobacterium tuberculosis
AHDTVSGGDWLCDQD

SEQ ID NO: 79200 - protein, 15 aa, Mycobacterium tuberculosis
HDTVSGGDWLCDQDA

SEQ ID NO: 79201 - protein, 15 aa, Mycobacterium tuberculosis
DTVSGGDWLCDQDAV

SEQ ID NO: 79202 - protein, 15 aa, Mycobacterium tuberculosis
TVSGGDWLCDQDAVE

SEQ ID NO: 79203 - protein, 15 aa, Mycobacterium tuberculosis
VSGGDWLCDQDAVEA

SEQ ID NO: 79204 - protein, 15 aa, Mycobacterium tuberculosis
SGGDWLCDQDAVEAF

SEQ ID NO: 79205 - protein, 15 aa, Mycobacterium tuberculosis
GGDWLCDQDAVEAFV

SEQ ID NO: 79206 - protein, 15 aa, Mycobacterium tuberculosis
GDWLCDQDAVEAFVA

SEQ ID NO: 79207 - protein, 15 aa, Mycobacterium tuberculosis
DWLCDQDAVEAFVAE

SEQ ID NO: 79208 - protein, 15 aa, Mycobacterium tuberculosis
WLCDQDAVEAFVAEA

SEQ ID NO: 79209 - protein, 15 aa, Mycobacterium tuberculosis
LCDQDAVEAFVAEAP

SEQ ID NO: 79210 - protein, 15 aa, Mycobacterium tuberculosis
CDQDAVEAFVAEAPK

SEQ ID NO: 79211 - protein, 15 aa, Mycobacterium tuberculosis
DQDAVEAFVAEAPKE

SEQ ID NO: 79212 - protein, 15 aa, Mycobacterium tuberculosis
QDAVEAFVAEAPKEL

SEQ ID NO: 79213 - protein, 15 aa, Mycobacterium tuberculosis
DAVEAFVAEAPKELV

SEQ ID NO: 79214 - protein, 15 aa, Mycobacterium tuberculosis
AVEAFVAEAPKELVQ

SEQ ID NO: 79215 - protein, 15 aa, Mycobacterium tuberculosis
VEAFVAEAPKELVQL

SEQ ID NO: 79216 - protein, 15 aa, Mycobacterium tuberculosis
EAFVAEAPKELVQLE

SEQ ID NO: 79217 - protein, 15 aa, Mycobacterium tuberculosis
AFVAEAPKELVQLEH

SEQ ID NO: 79218 - protein, 15 aa, Mycobacterium tuberculosis
FVAEAPKELVQLEHW

SEQ ID NO: 79219 - protein, 15 aa, Mycobacterium tuberculosis
VAEAPKELVQLEHWG

SEQ ID NO: 79220 - protein, 15 aa, Mycobacterium tuberculosis
AEAPKELVQLEHWGC

SEQ ID NO: 79221 - protein, 15 aa, Mycobacterium tuberculosis
EAPKELVQLEHWGCP

SEQ ID NO: 79222 - protein, 15 aa, Mycobacterium tuberculosis
APKELVQLEHWGCPW

SEQ ID NO: 79223 - protein, 15 aa, Mycobacterium tuberculosis
PKELVQLEHWGCPWS

SEQ ID NO: 79224 - protein, 15 aa, Mycobacterium tuberculosis
KELVQLEHWGCPWSR

SEQ ID NO: 79225 - protein, 15 aa, Mycobacterium tuberculosis
ELVQLEHWGCPWSRK

SEQ ID NO: 79226 - protein, 15 aa, Mycobacterium tuberculosis
LVQLEHWGCPWSRKP

SEQ ID NO: 79227 - protein, 15 aa, Mycobacterium tuberculosis
VQLEHWGCPWSRKPD

SEQ ID NO: 79228 - protein, 15 aa, Mycobacterium tuberculosis
QLEHWGCPWSRKPDG

SEQ ID NO: 79229 - protein, 15 aa, Mycobacterium tuberculosis
LEHWGCPWSRKPDGR

SEQ ID NO: 79230 - protein, 15 aa, Mycobacterium tuberculosis
EHWGCPWSRKPDGRV

SEQ ID NO: 79231 - protein, 15 aa, Mycobacterium tuberculosis
HWGCPWSRKPDGRVA

SEQ ID NO: 79232 - protein, 15 aa, Mycobacterium tuberculosis
WGCPWSRKPDGRVAV

SEQ ID NO: 79233 - protein, 15 aa, Mycobacterium tuberculosis
GCPWSRKPDGRVAVR

SEQ ID NO: 79234 - protein, 15 aa, Mycobacterium tuberculosis
CPWSRKPDGRVAVRP

SEQ ID NO: 79235 - protein, 15 aa, Mycobacterium tuberculosis
PWSRKPDGRVAVRPF

SEQ ID NO: 79236 - protein, 15 aa, Mycobacterium tuberculosis
WSRKPDGRVAVRPFG

SEQ ID NO: 79237 - protein, 15 aa, Mycobacterium tuberculosis
SRKPDGRVAVRPFGG

SEQ ID NO: 79238 - protein, 15 aa, Mycobacterium tuberculosis
RKPDGRVAVRPFGGM

SEQ ID NO: 79239 - protein, 15 aa, Mycobacterium tuberculosis
KPDGRVAVRPFGGMK

SEQ ID NO: 79240 - protein, 15 aa, Mycobacterium tuberculosis
PDGRVAVRPFGGMKK

SEQ ID NO: 79241 - protein, 15 aa, Mycobacterium tuberculosis
DGRVAVRPFGGMKKL

SEQ ID NO: 79242 - protein, 15 aa, Mycobacterium tuberculosis
GRVAVRPFGGMKKLR

SEQ ID NO: 79243 - protein, 15 aa, Mycobacterium tuberculosis
RVAVRPFGGMKKLRT

SEQ ID NO: 79244 - protein, 15 aa, Mycobacterium tuberculosis
VAVRPFGGMKKLRTW

SEQ ID NO: 79245 - protein, 15 aa, Mycobacterium tuberculosis
AVRPFGGMKKLRTWF

SEQ ID NO: 79246 - protein, 15 aa, Mycobacterium tuberculosis
VRPFGGMKKLRTWFA

SEQ ID NO: 79247 - protein, 15 aa, Mycobacterium tuberculosis
RPFGGMKKLRTWFAA

SEQ ID NO: 79248 - protein, 15 aa, Mycobacterium tuberculosis
PFGGMKKLRTWFAAD

SEQ ID NO: 79249 - protein, 15 aa, Mycobacterium tuberculosis
FGGMKKLRTWFAADK

SEQ ID NO: 79250 - protein, 15 aa, Mycobacterium tuberculosis
GGMKKLRTWFAADKT

SEQ ID NO: 79251 - protein, 15 aa, Mycobacterium tuberculosis
GMKKLRTWFAADKTG

SEQ ID NO: 79252 - protein, 15 aa, Mycobacterium tuberculosis
MKKLRTWFAADKTGF

SEQ ID NO: 79253 - protein, 15 aa, Mycobacterium tuberculosis
KKLRTWFAADKTGFH

SEQ ID NO: 79254 - protein, 15 aa, Mycobacterium tuberculosis
KLRTWFAADKTGFHL

SEQ ID NO: 79255 - protein, 15 aa, Mycobacterium tuberculosis
LRTWFAADKTGFHLL

SEQ ID NO: 79256 - protein, 15 aa, Mycobacterium tuberculosis
RTWFAADKTGFHLLH

SEQ ID NO: 79257 - protein, 15 aa, Mycobacterium tuberculosis
TWFAADKTGFHLLHT

SEQ ID NO: 79258 - protein, 15 aa, Mycobacterium tuberculosis
WFAADKTGFHLLHTL

SEQ ID NO: 79259 - protein, 15 aa, Mycobacterium tuberculosis
FAADKTGFHLLHTLF

SEQ ID NO: 79260 - protein, 15 aa, Mycobacterium tuberculosis
AADKTGFHLLHTLFQ

SEQ ID NO: 79261 - protein, 15 aa, Mycobacterium tuberculosis
ADKTGFHLLHTLFQR

SEQ ID NO: 79262 - protein, 15 aa, Mycobacterium tuberculosis
DKTGFHLLHTLFQRL

SEQ ID NO: 79263 - protein, 15 aa, Mycobacterium tuberculosis
KTGFHLLHTLFQRLL

SEQ ID NO: 79264 - protein, 15 aa, Mycobacterium tuberculosis
TGFHLLHTLFQRLLT

SEQ ID NO: 79265 - protein, 15 aa, Mycobacterium tuberculosis
GFHLLHTLFQRLLTY

SEQ ID NO: 79266 - protein, 15 aa, Mycobacterium tuberculosis
FHLLHTLFQRLLTYS

SEQ ID NO: 79267 - protein, 15 aa, Mycobacterium tuberculosis
HLLHTLFQRLLTYSD

SEQ ID NO: 79268 - protein, 15 aa, Mycobacterium tuberculosis
LLHTLFQRLLTYSDV

SEQ ID NO: 79269 - protein, 15 aa, Mycobacterium tuberculosis
LHTLFQRLLTYSDVM

SEQ ID NO: 79270 - protein, 15 aa, Mycobacterium tuberculosis
HTLFQRLLTYSDVMR

SEQ ID NO: 79271 - protein, 15 aa, Mycobacterium tuberculosis
TLFQRLLTYSDVMRY

SEQ ID NO: 79272 - protein, 15 aa, Mycobacterium tuberculosis
LFQRLLTYSDVMRYD

SEQ ID NO: 79273 - protein, 15 aa, Mycobacterium tuberculosis
FQRLLTYSDVMRYDE

SEQ ID NO: 79274 - protein, 15 aa, Mycobacterium tuberculosis
QRLLTYSDVMRYDEW

SEQ ID NO: 79275 - protein, 15 aa, Mycobacterium tuberculosis
RLLTYSDVMRYDEWF

SEQ ID NO: 79276 - protein, 15 aa, Mycobacterium tuberculosis
LLTYSDVMRYDEWFA

SEQ ID NO: 79277 - protein, 15 aa, Mycobacterium tuberculosis
LTYSDVMRYDEWFAT

SEQ ID NO: 79278 - protein, 15 aa, Mycobacterium tuberculosis
TYSDVMRYDEWFATT

SEQ ID NO: 79279 - protein, 15 aa, Mycobacterium tuberculosis
YSDVMRYDEWFATTL

SEQ ID NO: 79280 - protein, 15 aa, Mycobacterium tuberculosis
SDVMRYDEWFATTLL

SEQ ID NO: 79281 - protein, 15 aa, Mycobacterium tuberculosis
DVMRYDEWFATTLLV

SEQ ID NO: 79282 - protein, 15 aa, Mycobacterium tuberculosis
VMRYDEWFATTLLVD

SEQ ID NO: 79283 - protein, 15 aa, Mycobacterium tuberculosis
MRYDEWFATTLLVDD

SEQ ID NO: 79284 - protein, 15 aa, Mycobacterium tuberculosis
RYDEWFATTLLVDDG

SEQ ID NO: 79285 - protein, 15 aa, Mycobacterium tuberculosis
YDEWFATTLLVDDGR

SEQ ID NO: 79286 - protein, 15 aa, Mycobacterium tuberculosis
DEWFATTLLVDDGRV

SEQ ID NO: 79287 - protein, 15 aa, Mycobacterium tuberculosis
EWFATTLLVDDGRVC

SEQ ID NO: 79288 - protein, 15 aa, Mycobacterium tuberculosis
WFATTLLVDDGRVCG

SEQ ID NO: 79289 - protein, 15 aa, Mycobacterium tuberculosis
FATTLLVDDGRVCGL

SEQ ID NO: 79290 - protein, 15 aa, Mycobacterium tuberculosis
ATTLLVDDGRVCGLV

SEQ ID NO: 79291 - protein, 15 aa, Mycobacterium tuberculosis
TTLLVDDGRVCGLVA

SEQ ID NO: 79292 - protein, 15 aa, Mycobacterium tuberculosis
TLLVDDGRVCGLVAI

SEQ ID NO: 79293 - protein, 15 aa, Mycobacterium tuberculosis
LLVDDGRVCGLVAIE

SEQ ID NO: 79294 - protein, 15 aa, Mycobacterium tuberculosis
LVDDGRVCGLVAIEL

SEQ ID NO: 79295 - protein, 15 aa, Mycobacterium tuberculosis
VDDGRVCGLVAIELA

SEQ ID NO: 79296 - protein, 15 aa, Mycobacterium tuberculosis
DDGRVCGLVAIELAT

SEQ ID NO: 79297 - protein, 15 aa, Mycobacterium tuberculosis
DGRVCGLVAIELATG

SEQ ID NO: 79298 - protein, 15 aa, Mycobacterium tuberculosis
GRVCGLVAIELATGR

SEQ ID NO: 79299 - protein, 15 aa, Mycobacterium tuberculosis
RVCGLVAIELATGRI

SEQ ID NO: 79300 - protein, 15 aa, Mycobacterium tuberculosis
VCGLVAIELATGRIE

SEQ ID NO: 79301 - protein, 15 aa, Mycobacterium tuberculosis
CGLVAIELATGRIET

SEQ ID NO: 79302 - protein, 15 aa, Mycobacterium tuberculosis
GLVAIELATGRIETI

SEQ ID NO: 79303 - protein, 15 aa, Mycobacterium tuberculosis
LVAIELATGRIETIL

SEQ ID NO: 79304 - protein, 15 aa, Mycobacterium tuberculosis
VAIELATGRIETILA

SEQ ID NO: 79305 - protein, 15 aa, Mycobacterium tuberculosis
AIELATGRIETILAD

SEQ ID NO: 79306 - protein, 15 aa, Mycobacterium tuberculosis
IELATGRIETILADA

SEQ ID NO: 79307 - protein, 15 aa, Mycobacterium tuberculosis
ELATGRIETILADAV

SEQ ID NO: 79308 - protein, 15 aa, Mycobacterium tuberculosis
LATGRIETILADAVI

SEQ ID NO: 79309 - protein, 15 aa, Mycobacterium tuberculosis
ATGRIETILADAVIL

SEQ ID NO: 79310 - protein, 15 aa, Mycobacterium tuberculosis
TGRIETILADAVILC

SEQ ID NO: 79311 - protein, 15 aa, Mycobacterium tuberculosis
GRIETILADAVILCT

SEQ ID NO: 79312 - protein, 15 aa, Mycobacterium tuberculosis
RIETILADAVILCTG

SEQ ID NO: 79313 - protein, 15 aa, Mycobacterium tuberculosis
IETILADAVILCTGG

SEQ ID NO: 79314 - protein, 15 aa, Mycobacterium tuberculosis
ETILADAVILCTGGC

SEQ ID NO: 79315 - protein, 15 aa, Mycobacterium tuberculosis
TILADAVILCTGGCG

SEQ ID NO: 79316 - protein, 15 aa, Mycobacterium tuberculosis
ILADAVILCTGGCGR

SEQ ID NO: 79317 - protein, 15 aa, Mycobacterium tuberculosis
LADAVILCTGGCGRV

SEQ ID NO: 79318 - protein, 15 aa, Mycobacterium tuberculosis
ADAVILCTGGCGRVF

SEQ ID NO: 79319 - protein, 15 aa, Mycobacterium tuberculosis
DAVILCTGGCGRVFP

SEQ ID NO: 79320 - protein, 15 aa, Mycobacterium tuberculosis
AVILCTGGCGRVFPF

SEQ ID NO: 79321 - protein, 15 aa, Mycobacterium tuberculosis
VILCTGGCGRVFPFT

SEQ ID NO: 79322 - protein, 15 aa, Mycobacterium tuberculosis
ILCTGGCGRVFPFTT

SEQ ID NO: 79323 - protein, 15 aa, Mycobacterium tuberculosis
LCTGGCGRVFPFTTN

SEQ ID NO: 79324 - protein, 15 aa, Mycobacterium tuberculosis
CTGGCGRVFPFTTNA

SEQ ID NO: 79325 - protein, 15 aa, Mycobacterium tuberculosis
TGGCGRVFPFTTNAN

SEQ ID NO: 79326 - protein, 15 aa, Mycobacterium tuberculosis
GGCGRVFPFTTNANI

SEQ ID NO: 79327 - protein, 15 aa, Mycobacterium tuberculosis
GCGRVFPFTTNANIK

SEQ ID NO: 79328 - protein, 15 aa, Mycobacterium tuberculosis
CGRVFPFTTNANIKT

SEQ ID NO: 79329 - protein, 15 aa, Mycobacterium tuberculosis
GRVFPFTTNANIKTG

SEQ ID NO: 79330 - protein, 15 aa, Mycobacterium tuberculosis
RVFPFTTNANIKTGD

SEQ ID NO: 79331 - protein, 15 aa, Mycobacterium tuberculosis
VFPFTTNANIKTGDG

SEQ ID NO: 79332 - protein, 15 aa, Mycobacterium tuberculosis
FPFTTNANIKTGDGM

SEQ ID NO: 79333 - protein, 15 aa, Mycobacterium tuberculosis
PFTTNANIKTGDGMA

SEQ ID NO: 79334 - protein, 15 aa, Mycobacterium tuberculosis
FTTNANIKTGDGMAL

SEQ ID NO: 79335 - protein, 15 aa, Mycobacterium tuberculosis
TTNANIKTGDGMALA

SEQ ID NO: 79336 - protein, 15 aa, Mycobacterium tuberculosis
TNANIKTGDGMALAF

SEQ ID NO: 79337 - protein, 15 aa, Mycobacterium tuberculosis
NANIKTGDGMALAFR

SEQ ID NO: 79338 - protein, 15 aa, Mycobacterium tuberculosis
ANIKTGDGMALAFRA

SEQ ID NO: 79339 - protein, 15 aa, Mycobacterium tuberculosis
NIKTGDGMALAFRAG

SEQ ID NO: 79340 - protein, 15 aa, Mycobacterium tuberculosis
IKTGDGMALAFRAGA

SEQ ID NO: 79341 - protein, 15 aa, Mycobacterium tuberculosis
KTGDGMALAFRAGAP

SEQ ID NO: 79342 - protein, 15 aa, Mycobacterium tuberculosis
TGDGMALAFRAGAPL

SEQ ID NO: 79343 - protein, 15 aa, Mycobacterium tuberculosis
GDGMALAFRAGAPLK

SEQ ID NO: 79344 - protein, 15 aa, Mycobacterium tuberculosis
DGMALAFRAGAPLKD

SEQ ID NO: 79345 - protein, 15 aa, Mycobacterium tuberculosis
GMALAFRAGAPLKDM

SEQ ID NO: 79346 - protein, 15 aa, Mycobacterium tuberculosis
MALAFRAGAPLKDME

SEQ ID NO: 79347 - protein, 15 aa, Mycobacterium tuberculosis
ALAFRAGAPLKDMEF

SEQ ID NO: 79348 - protein, 15 aa, Mycobacterium tuberculosis
LAFRAGAPLKDMEFV

SEQ ID NO: 79349 - protein, 15 aa, Mycobacterium tuberculosis
AFRAGAPLKDMEFVQ

SEQ ID NO: 79350 - protein, 15 aa, Mycobacterium tuberculosis
FRAGAPLKDMEFVQY

SEQ ID NO: 79351 - protein, 15 aa, Mycobacterium tuberculosis
RAGAPLKDMEFVQYH

SEQ ID NO: 79352 - protein, 15 aa, Mycobacterium tuberculosis
AGAPLKDMEFVQYHP

SEQ ID NO: 79353 - protein, 15 aa, Mycobacterium tuberculosis
GAPLKDMEFVQYHPT

SEQ ID NO: 79354 - protein, 15 aa, Mycobacterium tuberculosis
APLKDMEFVQYHPTG

SEQ ID NO: 79355 - protein, 15 aa, Mycobacterium tuberculosis
PLKDMEFVQYHPTGL

SEQ ID NO: 79356 - protein, 15 aa, Mycobacterium tuberculosis
LKDMEFVQYHPTGLP

SEQ ID NO: 79357 - protein, 15 aa, Mycobacterium tuberculosis
KDMEFVQYHPTGLPF

SEQ ID NO: 79358 - protein, 15 aa, Mycobacterium tuberculosis
DMEFVQYHPTGLPFT

SEQ ID NO: 79359 - protein, 15 aa, Mycobacterium tuberculosis
MEFVQYHPTGLPFTG

SEQ ID NO: 79360 - protein, 15 aa, Mycobacterium tuberculosis
EFVQYHPTGLPFTGI

SEQ ID NO: 79361 - protein, 15 aa, Mycobacterium tuberculosis
FVQYHPTGLPFTGIL

SEQ ID NO: 79362 - protein, 15 aa, Mycobacterium tuberculosis
VQYHPTGLPFTGILI

SEQ ID NO: 79363 - protein, 15 aa, Mycobacterium tuberculosis
QYHPTGLPFTGILIT

SEQ ID NO: 79364 - protein, 15 aa, Mycobacterium tuberculosis
YHPTGLPFTGILITE

SEQ ID NO: 79365 - protein, 15 aa, Mycobacterium tuberculosis
HPTGLPFTGILITEA

SEQ ID NO: 79366 - protein, 15 aa, Mycobacterium tuberculosis
PTGLPFTGILITEAA

SEQ ID NO: 79367 - protein, 15 aa, Mycobacterium tuberculosis
TGLPFTGILITEAAR

SEQ ID NO: 79368 - protein, 15 aa, Mycobacterium tuberculosis
GLPFTGILITEAARA

SEQ ID NO: 79369 - protein, 15 aa, Mycobacterium tuberculosis
LPFTGILITEAARAE

SEQ ID NO: 79370 - protein, 15 aa, Mycobacterium tuberculosis
PFTGILITEAARAEG

SEQ ID NO: 79371 - protein, 15 aa, Mycobacterium tuberculosis
FTGILITEAARAEGG

SEQ ID NO: 79372 - protein, 15 aa, Mycobacterium tuberculosis
TGILITEAARAEGGW

SEQ ID NO: 79373 - protein, 15 aa, Mycobacterium tuberculosis
GILITEAARAEGGWL

SEQ ID NO: 79374 - protein, 15 aa, Mycobacterium tuberculosis
ILITEAARAEGGWLL

SEQ ID NO: 79375 - protein, 15 aa, Mycobacterium tuberculosis
LITEAARAEGGWLLN

SEQ ID NO: 79376 - protein, 15 aa, Mycobacterium tuberculosis
ITEAARAEGGWLLNK

SEQ ID NO: 79377 - protein, 15 aa, Mycobacterium tuberculosis
TEAARAEGGWLLNKD

SEQ ID NO: 79378 - protein, 15 aa, Mycobacterium tuberculosis
EAARAEGGWLLNKDG

SEQ ID NO: 79379 - protein, 15 aa, Mycobacterium tuberculosis
AARAEGGWLLNKDGY

SEQ ID NO: 79380 - protein, 15 aa, Mycobacterium tuberculosis
ARAEGGWLLNKDGYR

SEQ ID NO: 79381 - protein, 15 aa, Mycobacterium tuberculosis
RAEGGWLLNKDGYRY

SEQ ID NO: 79382 - protein, 15 aa, Mycobacterium tuberculosis
AEGGWLLNKDGYRYL

SEQ ID NO: 79383 - protein, 15 aa, Mycobacterium tuberculosis
EGGWLLNKDGYRYLQ

SEQ ID NO: 79384 - protein, 15 aa, Mycobacterium tuberculosis
GGWLLNKDGYRYLQD

SEQ ID NO: 79385 - protein, 15 aa, Mycobacterium tuberculosis
GWLLNKDGYRYLQDY

SEQ ID NO: 79386 - protein, 15 aa, Mycobacterium tuberculosis
WLLNKDGYRYLQDYD

SEQ ID NO: 79387 - protein, 15 aa, Mycobacterium tuberculosis
LLNKDGYRYLQDYDL

SEQ ID NO: 79388 - protein, 15 aa, Mycobacterium tuberculosis
LNKDGYRYLQDYDLG

SEQ ID NO: 79389 - protein, 15 aa, Mycobacterium tuberculosis
NKDGYRYLQDYDLGK

SEQ ID NO: 79390 - protein, 15 aa, Mycobacterium tuberculosis
KDGYRYLQDYDLGKP

SEQ ID NO: 79391 - protein, 15 aa, Mycobacterium tuberculosis
DGYRYLQDYDLGKPT

SEQ ID NO: 79392 - protein, 15 aa, Mycobacterium tuberculosis
GYRYLQDYDLGKPTP

SEQ ID NO: 79393 - protein, 15 aa, Mycobacterium tuberculosis
YRYLQDYDLGKPTPE

SEQ ID NO: 79394 - protein, 15 aa, Mycobacterium tuberculosis
RYLQDYDLGKPTPEP

SEQ ID NO: 79395 - protein, 15 aa, Mycobacterium tuberculosis
YLQDYDLGKPTPEPR

SEQ ID NO: 79396 - protein, 15 aa, Mycobacterium tuberculosis
LQDYDLGKPTPEPRL

SEQ ID NO: 79397 - protein, 15 aa, Mycobacterium tuberculosis
QDYDLGKPTPEPRLR

SEQ ID NO: 79398 - protein, 15 aa, Mycobacterium tuberculosis
DYDLGKPTPEPRLRS

SEQ ID NO: 79399 - protein, 15 aa, Mycobacterium tuberculosis
YDLGKPTPEPRLRSM

SEQ ID NO: 79400 - protein, 15 aa, Mycobacterium tuberculosis
DLGKPTPEPRLRSME

SEQ ID NO: 79401 - protein, 15 aa, Mycobacterium tuberculosis
LGKPTPEPRLRSMEL

SEQ ID NO: 79402 - protein, 15 aa, Mycobacterium tuberculosis
GKPTPEPRLRSMELG

SEQ ID NO: 79403 - protein, 15 aa, Mycobacterium tuberculosis
KPTPEPRLRSMELGP

SEQ ID NO: 79404 - protein, 15 aa, Mycobacterium tuberculosis
PTPEPRLRSMELGPR

SEQ ID NO: 79405 - protein, 15 aa, Mycobacterium tuberculosis
TPEPRLRSMELGPRD

SEQ ID NO: 79406 - protein, 15 aa, Mycobacterium tuberculosis
PEPRLRSMELGPRDR

SEQ ID NO: 79407 - protein, 15 aa, Mycobacterium tuberculosis
EPRLRSMELGPRDRL

SEQ ID NO: 79408 - protein, 15 aa, Mycobacterium tuberculosis
PRLRSMELGPRDRLS

SEQ ID NO: 79409 - protein, 15 aa, Mycobacterium tuberculosis
RLRSMELGPRDRLSQ

SEQ ID NO: 79410 - protein, 15 aa, Mycobacterium tuberculosis
LRSMELGPRDRLSQA

SEQ ID NO: 79411 - protein, 15 aa, Mycobacterium tuberculosis
RSMELGPRDRLSQAF

SEQ ID NO: 79412 - protein, 15 aa, Mycobacterium tuberculosis
SMELGPRDRLSQAFV

SEQ ID NO: 79413 - protein, 15 aa, Mycobacterium tuberculosis
MELGPRDRLSQAFVH

SEQ ID NO: 79414 - protein, 15 aa, Mycobacterium tuberculosis
ELGPRDRLSQAFVHE

SEQ ID NO: 79415 - protein, 15 aa, Mycobacterium tuberculosis
LGPRDRLSQAFVHEH

SEQ ID NO: 79416 - protein, 15 aa, Mycobacterium tuberculosis
GPRDRLSQAFVHEHN

SEQ ID NO: 79417 - protein, 15 aa, Mycobacterium tuberculosis
PRDRLSQAFVHEHNK

SEQ ID NO: 79418 - protein, 15 aa, Mycobacterium tuberculosis
RDRLSQAFVHEHNKG

SEQ ID NO: 79419 - protein, 15 aa, Mycobacterium tuberculosis
DRLSQAFVHEHNKGR

SEQ ID NO: 79420 - protein, 15 aa, Mycobacterium tuberculosis
RLSQAFVHEHNKGRT

SEQ ID NO: 79421 - protein, 15 aa, Mycobacterium tuberculosis
LSQAFVHEHNKGRTV

SEQ ID NO: 79422 - protein, 15 aa, Mycobacterium tuberculosis
SQAFVHEHNKGRTVD

SEQ ID NO: 79423 - protein, 15 aa, Mycobacterium tuberculosis
QAFVHEHNKGRTVDT

SEQ ID NO: 79424 - protein, 15 aa, Mycobacterium tuberculosis
AFVHEHNKGRTVDTP

SEQ ID NO: 79425 - protein, 15 aa, Mycobacterium tuberculosis
FVHEHNKGRTVDTPY

SEQ ID NO: 79426 - protein, 15 aa, Mycobacterium tuberculosis
VHEHNKGRTVDTPYG

SEQ ID NO: 79427 - protein, 15 aa, Mycobacterium tuberculosis
HEHNKGRTVDTPYGP

SEQ ID NO: 79428 - protein, 15 aa, Mycobacterium tuberculosis
EHNKGRTVDTPYGPV

SEQ ID NO: 79429 - protein, 15 aa, Mycobacterium tuberculosis
HNKGRTVDTPYGPVV

SEQ ID NO: 79430 - protein, 15 aa, Mycobacterium tuberculosis
NKGRTVDTPYGPVVY

SEQ ID NO: 79431 - protein, 15 aa, Mycobacterium tuberculosis
KGRTVDTPYGPVVYL

SEQ ID NO: 79432 - protein, 15 aa, Mycobacterium tuberculosis
GRTVDTPYGPVVYLD

SEQ ID NO: 79433 - protein, 15 aa, Mycobacterium tuberculosis
RTVDTPYGPVVYLDL

SEQ ID NO: 79434 - protein, 15 aa, Mycobacterium tuberculosis
TVDTPYGPVVYLDLR

SEQ ID NO: 79435 - protein, 15 aa, Mycobacterium tuberculosis
VDTPYGPVVYLDLRH

SEQ ID NO: 79436 - protein, 15 aa, Mycobacterium tuberculosis
DTPYGPVVYLDLRHL

SEQ ID NO: 79437 - protein, 15 aa, Mycobacterium tuberculosis
TPYGPVVYLDLRHLG

SEQ ID NO: 79438 - protein, 15 aa, Mycobacterium tuberculosis
PYGPVVYLDLRHLGA

SEQ ID NO: 79439 - protein, 15 aa, Mycobacterium tuberculosis
YGPVVYLDLRHLGAD

SEQ ID NO: 79440 - protein, 15 aa, Mycobacterium tuberculosis
GPVVYLDLRHLGADL

SEQ ID NO: 79441 - protein, 15 aa, Mycobacterium tuberculosis
PVVYLDLRHLGADLI

SEQ ID NO: 79442 - protein, 15 aa, Mycobacterium tuberculosis
VVYLDLRHLGADLID

SEQ ID NO: 79443 - protein, 15 aa, Mycobacterium tuberculosis
VYLDLRHLGADLIDA

SEQ ID NO: 79444 - protein, 15 aa, Mycobacterium tuberculosis
YLDLRHLGADLIDAK

SEQ ID NO: 79445 - protein, 15 aa, Mycobacterium tuberculosis
LDLRHLGADLIDAKL

SEQ ID NO: 79446 - protein, 15 aa, Mycobacterium tuberculosis
DLRHLGADLIDAKLP

SEQ ID NO: 79447 - protein, 15 aa, Mycobacterium tuberculosis
LRHLGADLIDAKLPF

SEQ ID NO: 79448 - protein, 15 aa, Mycobacterium tuberculosis
RHLGADLIDAKLPFV

SEQ ID NO: 79449 - protein, 15 aa, Mycobacterium tuberculosis
HLGADLIDAKLPFVR

SEQ ID NO: 79450 - protein, 15 aa, Mycobacterium tuberculosis
LGADLIDAKLPFVRE

SEQ ID NO: 79451 - protein, 15 aa, Mycobacterium tuberculosis
GADLIDAKLPFVREL

SEQ ID NO: 79452 - protein, 15 aa, Mycobacterium tuberculosis
ADLIDAKLPFVRELC

SEQ ID NO: 79453 - protein, 15 aa, Mycobacterium tuberculosis
DLIDAKLPFVRELCR

SEQ ID NO: 79454 - protein, 15 aa, Mycobacterium tuberculosis
LIDAKLPFVRELCRD

SEQ ID NO: 79455 - protein, 15 aa, Mycobacterium tuberculosis
IDAKLPFVRELCRDY

SEQ ID NO: 79456 - protein, 15 aa, Mycobacterium tuberculosis
DAKLPFVRELCRDYQ

SEQ ID NO: 79457 - protein, 15 aa, Mycobacterium tuberculosis
AKLPFVRELCRDYQH

SEQ ID NO: 79458 - protein, 15 aa, Mycobacterium tuberculosis
KLPFVRELCRDYQHI

SEQ ID NO: 79459 - protein, 15 aa, Mycobacterium tuberculosis
LPFVRELCRDYQHID

SEQ ID NO: 79460 - protein, 15 aa, Mycobacterium tuberculosis
PFVRELCRDYQHIDP

SEQ ID NO: 79461 - protein, 15 aa, Mycobacterium tuberculosis
FVRELCRDYQHIDPV

SEQ ID NO: 79462 - protein, 15 aa, Mycobacterium tuberculosis
VRELCRDYQHIDPVV

SEQ ID NO: 79463 - protein, 15 aa, Mycobacterium tuberculosis
RELCRDYQHIDPVVE

SEQ ID NO: 79464 - protein, 15 aa, Mycobacterium tuberculosis
ELCRDYQHIDPVVEL

SEQ ID NO: 79465 - protein, 15 aa, Mycobacterium tuberculosis
LCRDYQHIDPVVELV

SEQ ID NO: 79466 - protein, 15 aa, Mycobacterium tuberculosis
CRDYQHIDPVVELVP

SEQ ID NO: 79467 - protein, 15 aa, Mycobacterium tuberculosis
RDYQHIDPVVELVPV

SEQ ID NO: 79468 - protein, 15 aa, Mycobacterium tuberculosis
DYQHIDPVVELVPVR

SEQ ID NO: 79469 - protein, 15 aa, Mycobacterium tuberculosis
YQHIDPVVELVPVRP

SEQ ID NO: 79470 - protein, 15 aa, Mycobacterium tuberculosis
QHIDPVVELVPVRPV

SEQ ID NO: 79471 - protein, 15 aa, Mycobacterium tuberculosis
HIDPVVELVPVRPVV

SEQ ID NO: 79472 - protein, 15 aa, Mycobacterium tuberculosis
IDPVVELVPVRPVVH

SEQ ID NO: 79473 - protein, 15 aa, Mycobacterium tuberculosis
DPVVELVPVRPVVHY

SEQ ID NO: 79474 - protein, 15 aa, Mycobacterium tuberculosis
PVVELVPVRPVVHYM

SEQ ID NO: 79475 - protein, 15 aa, Mycobacterium tuberculosis
VVELVPVRPVVHYMM

SEQ ID NO: 79476 - protein, 15 aa, Mycobacterium tuberculosis
VELVPVRPVVHYMMG

SEQ ID NO: 79477 - protein, 15 aa, Mycobacterium tuberculosis
ELVPVRPVVHYMMGG

SEQ ID NO: 79478 - protein, 15 aa, Mycobacterium tuberculosis
LVPVRPVVHYMMGGV

SEQ ID NO: 79479 - protein, 15 aa, Mycobacterium tuberculosis
VPVRPVVHYMMGGVH

SEQ ID NO: 79480 - protein, 15 aa, Mycobacterium tuberculosis
PVRPVVHYMMGGVHT

SEQ ID NO: 79481 - protein, 15 aa, Mycobacterium tuberculosis
VRPVVHYMMGGVHTD

SEQ ID NO: 79482 - protein, 15 aa, Mycobacterium tuberculosis
RPVVHYMMGGVHTDI

SEQ ID NO: 79483 - protein, 15 aa, Mycobacterium tuberculosis
PVVHYMMGGVHTDIN

SEQ ID NO: 79484 - protein, 15 aa, Mycobacterium tuberculosis
VVHYMMGGVHTDING

SEQ ID NO: 79485 - protein, 15 aa, Mycobacterium tuberculosis
VHYMMGGVHTDINGA

SEQ ID NO: 79486 - protein, 15 aa, Mycobacterium tuberculosis
HYMMGGVHTDINGAT

SEQ ID NO: 79487 - protein, 15 aa, Mycobacterium tuberculosis
YMMGGVHTDINGATT

SEQ ID NO: 79488 - protein, 15 aa, Mycobacterium tuberculosis
MMGGVHTDINGATTL

SEQ ID NO: 79489 - protein, 15 aa, Mycobacterium tuberculosis
MGGVHTDINGATTLP

SEQ ID NO: 79490 - protein, 15 aa, Mycobacterium tuberculosis
GGVHTDINGATTLPG

SEQ ID NO: 79491 - protein, 15 aa, Mycobacterium tuberculosis
GVHTDINGATTLPGL

SEQ ID NO: 79492 - protein, 15 aa, Mycobacterium tuberculosis
VHTDINGATTLPGLY

SEQ ID NO: 79493 - protein, 15 aa, Mycobacterium tuberculosis
HTDINGATTLPGLYA

SEQ ID NO: 79494 - protein, 15 aa, Mycobacterium tuberculosis
TDINGATTLPGLYAA

SEQ ID NO: 79495 - protein, 15 aa, Mycobacterium tuberculosis
DINGATTLPGLYAAG

SEQ ID NO: 79496 - protein, 15 aa, Mycobacterium tuberculosis
INGATTLPGLYAAGE

SEQ ID NO: 79497 - protein, 15 aa, Mycobacterium tuberculosis
NGATTLPGLYAAGET

SEQ ID NO: 79498 - protein, 15 aa, Mycobacterium tuberculosis
GATTLPGLYAAGETA

SEQ ID NO: 79499 - protein, 15 aa, Mycobacterium tuberculosis
ATTLPGLYAAGETAC

SEQ ID NO: 79500 - protein, 15 aa, Mycobacterium tuberculosis
TTLPGLYAAGETACV

SEQ ID NO: 79501 - protein, 15 aa, Mycobacterium tuberculosis
TLPGLYAAGETACVS

SEQ ID NO: 79502 - protein, 15 aa, Mycobacterium tuberculosis
LPGLYAAGETACVSI

SEQ ID NO: 79503 - protein, 15 aa, Mycobacterium tuberculosis
PGLYAAGETACVSIN

SEQ ID NO: 79504 - protein, 15 aa, Mycobacterium tuberculosis
GLYAAGETACVSING

SEQ ID NO: 79505 - protein, 15 aa, Mycobacterium tuberculosis
LYAAGETACVSINGA

SEQ ID NO: 79506 - protein, 15 aa, Mycobacterium tuberculosis
YAAGETACVSINGAN

SEQ ID NO: 79507 - protein, 15 aa, Mycobacterium tuberculosis
AAGETACVSINGANR

SEQ ID NO: 79508 - protein, 15 aa, Mycobacterium tuberculosis
AGETACVSINGANRL

SEQ ID NO: 79509 - protein, 15 aa, Mycobacterium tuberculosis
GETACVSINGANRLG

SEQ ID NO: 79510 - protein, 15 aa, Mycobacterium tuberculosis
ETACVSINGANRLGS

SEQ ID NO: 79511 - protein, 15 aa, Mycobacterium tuberculosis
TACVSINGANRLGSN

SEQ ID NO: 79512 - protein, 15 aa, Mycobacterium tuberculosis
ACVSINGANRLGSNS

SEQ ID NO: 79513 - protein, 15 aa, Mycobacterium tuberculosis
CVSINGANRLGSNSL

SEQ ID NO: 79514 - protein, 15 aa, Mycobacterium tuberculosis
VSINGANRLGSNSLP

SEQ ID NO: 79515 - protein, 15 aa, Mycobacterium tuberculosis
SINGANRLGSNSLPE

SEQ ID NO: 79516 - protein, 15 aa, Mycobacterium tuberculosis
INGANRLGSNSLPEL

SEQ ID NO: 79517 - protein, 15 aa, Mycobacterium tuberculosis
NGANRLGSNSLPELL

SEQ ID NO: 79518 - protein, 15 aa, Mycobacterium tuberculosis
GANRLGSNSLPELLV

SEQ ID NO: 79519 - protein, 15 aa, Mycobacterium tuberculosis
ANRLGSNSLPELLVF

SEQ ID NO: 79520 - protein, 15 aa, Mycobacterium tuberculosis
NRLGSNSLPELLVFG

SEQ ID NO: 79521 - protein, 15 aa, Mycobacterium tuberculosis
RLGSNSLPELLVFGA

SEQ ID NO: 79522 - protein, 15 aa, Mycobacterium tuberculosis
LGSNSLPELLVFGAR

SEQ ID NO: 79523 - protein, 15 aa, Mycobacterium tuberculosis
GSNSLPELLVFGARA

SEQ ID NO: 79524 - protein, 15 aa, Mycobacterium tuberculosis
SNSLPELLVFGARAG

SEQ ID NO: 79525 - protein, 15 aa, Mycobacterium tuberculosis
NSLPELLVFGARAGR

SEQ ID NO: 79526 - protein, 15 aa, Mycobacterium tuberculosis
SLPELLVFGARAGRA

SEQ ID NO: 79527 - protein, 15 aa, Mycobacterium tuberculosis
LPELLVFGARAGRAA

SEQ ID NO: 79528 - protein, 15 aa, Mycobacterium tuberculosis
PELLVFGARAGRAAA

SEQ ID NO: 79529 - protein, 15 aa, Mycobacterium tuberculosis
ELLVFGARAGRAAAD

SEQ ID NO: 79530 - protein, 15 aa, Mycobacterium tuberculosis
LLVFGARAGRAAADY

SEQ ID NO: 79531 - protein, 15 aa, Mycobacterium tuberculosis
LVFGARAGRAAADYA

SEQ ID NO: 79532 - protein, 15 aa, Mycobacterium tuberculosis
VFGARAGRAAADYAA

SEQ ID NO: 79533 - protein, 15 aa, Mycobacterium tuberculosis
FGARAGRAAADYAAR

SEQ ID NO: 79534 - protein, 15 aa, Mycobacterium tuberculosis
GARAGRAAADYAARH

SEQ ID NO: 79535 - protein, 15 aa, Mycobacterium tuberculosis
ARAGRAAADYAARHQ

SEQ ID NO: 79536 - protein, 15 aa, Mycobacterium tuberculosis
RAGRAAADYAARHQK

SEQ ID NO: 79537 - protein, 15 aa, Mycobacterium tuberculosis
AGRAAADYAARHQKS

SEQ ID NO: 79538 - protein, 15 aa, Mycobacterium tuberculosis
GRAAADYAARHQKSD

SEQ ID NO: 79539 - protein, 15 aa, Mycobacterium tuberculosis
RAAADYAARHQKSDR

SEQ ID NO: 79540 - protein, 15 aa, Mycobacterium tuberculosis
AAADYAARHQKSDRG

SEQ ID NO: 79541 - protein, 15 aa, Mycobacterium tuberculosis
AADYAARHQKSDRGP

SEQ ID NO: 79542 - protein, 15 aa, Mycobacterium tuberculosis
ADYAARHQKSDRGPS

SEQ ID NO: 79543 - protein, 15 aa, Mycobacterium tuberculosis
DYAARHQKSDRGPSS

SEQ ID NO: 79544 - protein, 15 aa, Mycobacterium tuberculosis
YAARHQKSDRGPSSA

SEQ ID NO: 79545 - protein, 15 aa, Mycobacterium tuberculosis
AARHQKSDRGPSSAV

SEQ ID NO: 79546 - protein, 15 aa, Mycobacterium tuberculosis
ARHQKSDRGPSSAVR

SEQ ID NO: 79547 - protein, 15 aa, Mycobacterium tuberculosis
RHQKSDRGPSSAVRA

SEQ ID NO: 79548 - protein, 15 aa, Mycobacterium tuberculosis
HQKSDRGPSSAVRAQ

SEQ ID NO: 79549 - protein, 15 aa, Mycobacterium tuberculosis
QKSDRGPSSAVRAQA

SEQ ID NO: 79550 - protein, 15 aa, Mycobacterium tuberculosis
KSDRGPSSAVRAQAR

SEQ ID NO: 79551 - protein, 15 aa, Mycobacterium tuberculosis
SDRGPSSAVRAQART

SEQ ID NO: 79552 - protein, 15 aa, Mycobacterium tuberculosis
DRGPSSAVRAQARTE

SEQ ID NO: 79553 - protein, 15 aa, Mycobacterium tuberculosis
RGPSSAVRAQARTEA

SEQ ID NO: 79554 - protein, 15 aa, Mycobacterium tuberculosis
GPSSAVRAQARTEAL

SEQ ID NO: 79555 - protein, 15 aa, Mycobacterium tuberculosis
PSSAVRAQARTEALR

SEQ ID NO: 79556 - protein, 15 aa, Mycobacterium tuberculosis
SSAVRAQARTEALRL

SEQ ID NO: 79557 - protein, 15 aa, Mycobacterium tuberculosis
SAVRAQARTEALRLE

SEQ ID NO: 79558 - protein, 15 aa, Mycobacterium tuberculosis
AVRAQARTEALRLER

SEQ ID NO: 79559 - protein, 15 aa, Mycobacterium tuberculosis
VRAQARTEALRLERE

SEQ ID NO: 79560 - protein, 15 aa, Mycobacterium tuberculosis
RAQARTEALRLEREL

SEQ ID NO: 79561 - protein, 15 aa, Mycobacterium tuberculosis
AQARTEALRLERELS

SEQ ID NO: 79562 - protein, 15 aa, Mycobacterium tuberculosis
QARTEALRLERELSR

SEQ ID NO: 79563 - protein, 15 aa, Mycobacterium tuberculosis
ARTEALRLERELSRH

SEQ ID NO: 79564 - protein, 15 aa, Mycobacterium tuberculosis
RTEALRLERELSRHG

SEQ ID NO: 79565 - protein, 15 aa, Mycobacterium tuberculosis
TEALRLERELSRHGQ

SEQ ID NO: 79566 - protein, 15 aa, Mycobacterium tuberculosis
EALRLERELSRHGQG

SEQ ID NO: 79567 - protein, 15 aa, Mycobacterium tuberculosis
ALRLERELSRHGQGG

SEQ ID NO: 79568 - protein, 15 aa, Mycobacterium tuberculosis
LRLERELSRHGQGGE

SEQ ID NO: 79569 - protein, 15 aa, Mycobacterium tuberculosis
RLERELSRHGQGGER

SEQ ID NO: 79570 - protein, 15 aa, Mycobacterium tuberculosis
LERELSRHGQGGERI

SEQ ID NO: 79571 - protein, 15 aa, Mycobacterium tuberculosis
ERELSRHGQGGERIA

SEQ ID NO: 79572 - protein, 15 aa, Mycobacterium tuberculosis
RELSRHGQGGERIAD

SEQ ID NO: 79573 - protein, 15 aa, Mycobacterium tuberculosis
ELSRHGQGGERIADI

SEQ ID NO: 79574 - protein, 15 aa, Mycobacterium tuberculosis
LSRHGQGGERIADIR

SEQ ID NO: 79575 - protein, 15 aa, Mycobacterium tuberculosis
SRHGQGGERIADIRA

SEQ ID NO: 79576 - protein, 15 aa, Mycobacterium tuberculosis
RHGQGGERIADIRAD

SEQ ID NO: 79577 - protein, 15 aa, Mycobacterium tuberculosis
HGQGGERIADIRADM

SEQ ID NO: 79578 - protein, 15 aa, Mycobacterium tuberculosis
GQGGERIADIRADMQ

SEQ ID NO: 79579 - protein, 15 aa, Mycobacterium tuberculosis
QGGERIADIRADMQA

SEQ ID NO: 79580 - protein, 15 aa, Mycobacterium tuberculosis
GGERIADIRADMQAT

SEQ ID NO: 79581 - protein, 15 aa, Mycobacterium tuberculosis
GERIADIRADMQATL

SEQ ID NO: 79582 - protein, 15 aa, Mycobacterium tuberculosis
ERIADIRADMQATLE

SEQ ID NO: 79583 - protein, 15 aa, Mycobacterium tuberculosis
RIADIRADMQATLES

SEQ ID NO: 79584 - protein, 15 aa, Mycobacterium tuberculosis
IADIRADMQATLESA

SEQ ID NO: 79585 - protein, 15 aa, Mycobacterium tuberculosis
ADIRADMQATLESAA

SEQ ID NO: 79586 - protein, 15 aa, Mycobacterium tuberculosis
DIRADMQATLESAAG

SEQ ID NO: 79587 - protein, 15 aa, Mycobacterium tuberculosis
IRADMQATLESAAGI

SEQ ID NO: 79588 - protein, 15 aa, Mycobacterium tuberculosis
RADMQATLESAAGIY

SEQ ID NO: 79589 - protein, 15 aa, Mycobacterium tuberculosis
ADMQATLESAAGIYR

SEQ ID NO: 79590 - protein, 15 aa, Mycobacterium tuberculosis
DMQATLESAAGIYRD

SEQ ID NO: 79591 - protein, 15 aa, Mycobacterium tuberculosis
MQATLESAAGIYRDG

SEQ ID NO: 79592 - protein, 15 aa, Mycobacterium tuberculosis
QATLESAAGIYRDGP

SEQ ID NO: 79593 - protein, 15 aa, Mycobacterium tuberculosis
ATLESAAGIYRDGPT

SEQ ID NO: 79594 - protein, 15 aa, Mycobacterium tuberculosis
TLESAAGIYRDGPTL

SEQ ID NO: 79595 - protein, 15 aa, Mycobacterium tuberculosis
LESAAGIYRDGPTLT

SEQ ID NO: 79596 - protein, 15 aa, Mycobacterium tuberculosis
ESAAGIYRDGPTLTK

SEQ ID NO: 79597 - protein, 15 aa, Mycobacterium tuberculosis
SAAGIYRDGPTLTKA

SEQ ID NO: 79598 - protein, 15 aa, Mycobacterium tuberculosis
AAGIYRDGPTLTKAV

SEQ ID NO: 79599 - protein, 15 aa, Mycobacterium tuberculosis
AGIYRDGPTLTKAVE

SEQ ID NO: 79600 - protein, 15 aa, Mycobacterium tuberculosis
GIYRDGPTLTKAVEE

SEQ ID NO: 79601 - protein, 15 aa, Mycobacterium tuberculosis
IYRDGPTLTKAVEEI

SEQ ID NO: 79602 - protein, 15 aa, Mycobacterium tuberculosis
YRDGPTLTKAVEEIR

SEQ ID NO: 79603 - protein, 15 aa, Mycobacterium tuberculosis
RDGPTLTKAVEEIRV

SEQ ID NO: 79604 - protein, 15 aa, Mycobacterium tuberculosis
DGPTLTKAVEEIRVL

SEQ ID NO: 79605 - protein, 15 aa, Mycobacterium tuberculosis
GPTLTKAVEEIRVLQ

SEQ ID NO: 79606 - protein, 15 aa, Mycobacterium tuberculosis
PTLTKAVEEIRVLQE

SEQ ID NO: 79607 - protein, 15 aa, Mycobacterium tuberculosis
TLTKAVEEIRVLQER

SEQ ID NO: 79608 - protein, 15 aa, Mycobacterium tuberculosis
LTKAVEEIRVLQERF

SEQ ID NO: 79609 - protein, 15 aa, Mycobacterium tuberculosis
TKAVEEIRVLQERFA

SEQ ID NO: 79610 - protein, 15 aa, Mycobacterium tuberculosis
KAVEEIRVLQERFAT

SEQ ID NO: 79611 - protein, 15 aa, Mycobacterium tuberculosis
AVEEIRVLQERFATA

SEQ ID NO: 79612 - protein, 15 aa, Mycobacterium tuberculosis
VEEIRVLQERFATAG

SEQ ID NO: 79613 - protein, 15 aa, Mycobacterium tuberculosis
EEIRVLQERFATAGI

SEQ ID NO: 79614 - protein, 15 aa, Mycobacterium tuberculosis
EIRVLQERFATAGID

SEQ ID NO: 79615 - protein, 15 aa, Mycobacterium tuberculosis
IRVLQERFATAGIDD

SEQ ID NO: 79616 - protein, 15 aa, Mycobacterium tuberculosis
RVLQERFATAGIDDH

SEQ ID NO: 79617 - protein, 15 aa, Mycobacterium tuberculosis
VLQERFATAGIDDHS

SEQ ID NO: 79618 - protein, 15 aa, Mycobacterium tuberculosis
LQERFATAGIDDHSR

SEQ ID NO: 79619 - protein, 15 aa, Mycobacterium tuberculosis
QERFATAGIDDHSRT

SEQ ID NO: 79620 - protein, 15 aa, Mycobacterium tuberculosis
ERFATAGIDDHSRTF

SEQ ID NO: 79621 - protein, 15 aa, Mycobacterium tuberculosis
RFATAGIDDHSRTFN

SEQ ID NO: 79622 - protein, 15 aa, Mycobacterium tuberculosis
FATAGIDDHSRTFNT

SEQ ID NO: 79623 - protein, 15 aa, Mycobacterium tuberculosis
ATAGIDDHSRTFNTE

SEQ ID NO: 79624 - protein, 15 aa, Mycobacterium tuberculosis
TAGIDDHSRTFNTEL

SEQ ID NO: 79625 - protein, 15 aa, Mycobacterium tuberculosis
AGIDDHSRTFNTELT

SEQ ID NO: 79626 - protein, 15 aa, Mycobacterium tuberculosis
GIDDHSRTFNTELTA

SEQ ID NO: 79627 - protein, 15 aa, Mycobacterium tuberculosis
IDDHSRTFNTELTAL

SEQ ID NO: 79628 - protein, 15 aa, Mycobacterium tuberculosis
DDHSRTFNTELTALL

SEQ ID NO: 79629 - protein, 15 aa, Mycobacterium tuberculosis
DHSRTFNTELTALLE

SEQ ID NO: 79630 - protein, 15 aa, Mycobacterium tuberculosis
HSRTFNTELTALLEL

SEQ ID NO: 79631 - protein, 15 aa, Mycobacterium tuberculosis
SRTFNTELTALLELS

SEQ ID NO: 79632 - protein, 15 aa, Mycobacterium tuberculosis
RTFNTELTALLELSG

SEQ ID NO: 79633 - protein, 15 aa, Mycobacterium tuberculosis
TFNTELTALLELSGM

SEQ ID NO: 79634 - protein, 15 aa, Mycobacterium tuberculosis
FNTELTALLELSGML

SEQ ID NO: 79635 - protein, 15 aa, Mycobacterium tuberculosis
NTELTALLELSGMLD

SEQ ID NO: 79636 - protein, 15 aa, Mycobacterium tuberculosis
TELTALLELSGMLDV

SEQ ID NO: 79637 - protein, 15 aa, Mycobacterium tuberculosis
ELTALLELSGMLDVA

SEQ ID NO: 79638 - protein, 15 aa, Mycobacterium tuberculosis
LTALLELSGMLDVAL

SEQ ID NO: 79639 - protein, 15 aa, Mycobacterium tuberculosis
TALLELSGMLDVALA

SEQ ID NO: 79640 - protein, 15 aa, Mycobacterium tuberculosis
ALLELSGMLDVALAI

SEQ ID NO: 79641 - protein, 15 aa, Mycobacterium tuberculosis
LLELSGMLDVALAIV

SEQ ID NO: 79642 - protein, 15 aa, Mycobacterium tuberculosis
LELSGMLDVALAIVE

SEQ ID NO: 79643 - protein, 15 aa, Mycobacterium tuberculosis
ELSGMLDVALAIVES

SEQ ID NO: 79644 - protein, 15 aa, Mycobacterium tuberculosis
LSGMLDVALAIVESG

SEQ ID NO: 79645 - protein, 15 aa, Mycobacterium tuberculosis
SGMLDVALAIVESGL

SEQ ID NO: 79646 - protein, 15 aa, Mycobacterium tuberculosis
GMLDVALAIVESGLR

SEQ ID NO: 79647 - protein, 15 aa, Mycobacterium tuberculosis
MLDVALAIVESGLRR

SEQ ID NO: 79648 - protein, 15 aa, Mycobacterium tuberculosis
LDVALAIVESGLRRE

SEQ ID NO: 79649 - protein, 15 aa, Mycobacterium tuberculosis
DVALAIVESGLRREE

SEQ ID NO: 79650 - protein, 15 aa, Mycobacterium tuberculosis
VALAIVESGLRREES

SEQ ID NO: 79651 - protein, 15 aa, Mycobacterium tuberculosis
ALAIVESGLRREESR

SEQ ID NO: 79652 - protein, 15 aa, Mycobacterium tuberculosis
LAIVESGLRREESRG

SEQ ID NO: 79653 - protein, 15 aa, Mycobacterium tuberculosis
AIVESGLRREESRGA

SEQ ID NO: 79654 - protein, 15 aa, Mycobacterium tuberculosis
IVESGLRREESRGAH

SEQ ID NO: 79655 - protein, 15 aa, Mycobacterium tuberculosis
VESGLRREESRGAHQ

SEQ ID NO: 79656 - protein, 15 aa, Mycobacterium tuberculosis
ESGLRREESRGAHQR

SEQ ID NO: 79657 - protein, 15 aa, Mycobacterium tuberculosis
SGLRREESRGAHQRT

SEQ ID NO: 79658 - protein, 15 aa, Mycobacterium tuberculosis
GLRREESRGAHQRTD

SEQ ID NO: 79659 - protein, 15 aa, Mycobacterium tuberculosis
LRREESRGAHQRTDF

SEQ ID NO: 79660 - protein, 15 aa, Mycobacterium tuberculosis
RREESRGAHQRTDFP

SEQ ID NO: 79661 - protein, 15 aa, Mycobacterium tuberculosis
REESRGAHQRTDFPN

SEQ ID NO: 79662 - protein, 15 aa, Mycobacterium tuberculosis
EESRGAHQRTDFPNR

SEQ ID NO: 79663 - protein, 15 aa, Mycobacterium tuberculosis
ESRGAHQRTDFPNRD

SEQ ID NO: 79664 - protein, 15 aa, Mycobacterium tuberculosis
SRGAHQRTDFPNRDD

SEQ ID NO: 79665 - protein, 15 aa, Mycobacterium tuberculosis
RGAHQRTDFPNRDDE

SEQ ID NO: 79666 - protein, 15 aa, Mycobacterium tuberculosis
GAHQRTDFPNRDDEH

SEQ ID NO: 79667 - protein, 15 aa, Mycobacterium tuberculosis
AHQRTDFPNRDDEHF

SEQ ID NO: 79668 - protein, 15 aa, Mycobacterium tuberculosis
HQRTDFPNRDDEHFL

SEQ ID NO: 79669 - protein, 15 aa, Mycobacterium tuberculosis
QRTDFPNRDDEHFLA

SEQ ID NO: 79670 - protein, 15 aa, Mycobacterium tuberculosis
RTDFPNRDDEHFLAH

SEQ ID NO: 79671 - protein, 15 aa, Mycobacterium tuberculosis
TDFPNRDDEHFLAHT

SEQ ID NO: 79672 - protein, 15 aa, Mycobacterium tuberculosis
DFPNRDDEHFLAHTL

SEQ ID NO: 79673 - protein, 15 aa, Mycobacterium tuberculosis
FPNRDDEHFLAHTLV

SEQ ID NO: 79674 - protein, 15 aa, Mycobacterium tuberculosis
PNRDDEHFLAHTLVH

SEQ ID NO: 79675 - protein, 15 aa, Mycobacterium tuberculosis
NRDDEHFLAHTLVHR

SEQ ID NO: 79676 - protein, 15 aa, Mycobacterium tuberculosis
RDDEHFLAHTLVHRE

SEQ ID NO: 79677 - protein, 15 aa, Mycobacterium tuberculosis
DDEHFLAHTLVHRES

SEQ ID NO: 79678 - protein, 15 aa, Mycobacterium tuberculosis
DEHFLAHTLVHRESD

SEQ ID NO: 79679 - protein, 15 aa, Mycobacterium tuberculosis
EHFLAHTLVHRESDG

SEQ ID NO: 79680 - protein, 15 aa, Mycobacterium tuberculosis
HFLAHTLVHRESDGT

SEQ ID NO: 79681 - protein, 15 aa, Mycobacterium tuberculosis
FLAHTLVHRESDGTL

SEQ ID NO: 79682 - protein, 15 aa, Mycobacterium tuberculosis
LAHTLVHRESDGTLR

SEQ ID NO: 79683 - protein, 15 aa, Mycobacterium tuberculosis
AHTLVHRESDGTLRV

SEQ ID NO: 79684 - protein, 15 aa, Mycobacterium tuberculosis
HTLVHRESDGTLRVG

SEQ ID NO: 79685 - protein, 15 aa, Mycobacterium tuberculosis
TLVHRESDGTLRVGY

SEQ ID NO: 79686 - protein, 15 aa, Mycobacterium tuberculosis
LVHRESDGTLRVGYL

SEQ ID NO: 79687 - protein, 15 aa, Mycobacterium tuberculosis
VHRESDGTLRVGYLP

SEQ ID NO: 79688 - protein, 15 aa, Mycobacterium tuberculosis
HRESDGTLRVGYLPV

SEQ ID NO: 79689 - protein, 15 aa, Mycobacterium tuberculosis
RESDGTLRVGYLPVT

SEQ ID NO: 79690 - protein, 15 aa, Mycobacterium tuberculosis
ESDGTLRVGYLPVTI

SEQ ID NO: 79691 - protein, 15 aa, Mycobacterium tuberculosis
SDGTLRVGYLPVTIT

SEQ ID NO: 79692 - protein, 15 aa, Mycobacterium tuberculosis
DGTLRVGYLPVTITR

SEQ ID NO: 79693 - protein, 15 aa, Mycobacterium tuberculosis
GTLRVGYLPVTITRW

SEQ ID NO: 79694 - protein, 15 aa, Mycobacterium tuberculosis
TLRVGYLPVTITRWP

SEQ ID NO: 79695 - protein, 15 aa, Mycobacterium tuberculosis
LRVGYLPVTITRWPP

SEQ ID NO: 79696 - protein, 15 aa, Mycobacterium tuberculosis
RVGYLPVTITRWPPG

SEQ ID NO: 79697 - protein, 15 aa, Mycobacterium tuberculosis
VGYLPVTITRWPPGE

SEQ ID NO: 79698 - protein, 15 aa, Mycobacterium tuberculosis
GYLPVTITRWPPGER

SEQ ID NO: 79699 - protein, 15 aa, Mycobacterium tuberculosis
YLPVTITRWPPGERV

SEQ ID NO: 79700 - protein, 15 aa, Mycobacterium tuberculosis
LPVTITRWPPGERVY

SEQ ID NO: 79701 - protein, 15 aa, Mycobacterium tuberculosis
PVTITRWPPGERVYG

SEQ ID NO: 79702 - protein, 15 aa, Mycobacterium tuberculosis
VTITRWPPGERVYGR

SEQ ID NO: 79703 - protein, 16 aa, Mycobacterium tuberculosis
MTAQHNIVVIGGGGAG

SEQ ID NO: 79704 - protein, 16 aa, Mycobacterium tuberculosis
TAQHNIVVIGGGGAGL

SEQ ID NO: 79705 - protein, 16 aa, Mycobacterium tuberculosis
AQHNIVVIGGGGAGLR

SEQ ID NO: 79706 - protein, 16 aa, Mycobacterium tuberculosis
QHNIVVIGGGGAGLRA

SEQ ID NO: 79707 - protein, 16 aa, Mycobacterium tuberculosis
HNIVVIGGGGAGLRAA

SEQ ID NO: 79708 - protein, 16 aa, Mycobacterium tuberculosis
NIVVIGGGGAGLRAAI

SEQ ID NO: 79709 - protein, 16 aa, Mycobacterium tuberculosis
IVVIGGGGAGLRAAIA

SEQ ID NO: 79710 - protein, 16 aa, Mycobacterium tuberculosis
VVIGGGGAGLRAAIAI

SEQ ID NO: 79711 - protein, 16 aa, Mycobacterium tuberculosis
VIGGGGAGLRAAIAIA

SEQ ID NO: 79712 - protein, 16 aa, Mycobacterium tuberculosis
IGGGGAGLRAAIAIAE

SEQ ID NO: 79713 - protein, 16 aa, Mycobacterium tuberculosis
GGGGAGLRAAIAIAET

SEQ ID NO: 79714 - protein, 16 aa, Mycobacterium tuberculosis
GGGAGLRAAIAIAETN

SEQ ID NO: 79715 - protein, 16 aa, Mycobacterium tuberculosis
GGAGLRAAIAIAETNP

SEQ ID NO: 79716 - protein, 16 aa, Mycobacterium tuberculosis
GAGLRAAIAIAETNPH

SEQ ID NO: 79717 - protein, 16 aa, Mycobacterium tuberculosis
AGLRAAIAIAETNPHL

SEQ ID NO: 79718 - protein, 16 aa, Mycobacterium tuberculosis
GLRAAIAIAETNPHLD

SEQ ID NO: 79719 - protein, 16 aa, Mycobacterium tuberculosis
LRAAIAIAETNPHLDV

SEQ ID NO: 79720 - protein, 16 aa, Mycobacterium tuberculosis
RAAIAIAETNPHLDVA

SEQ ID NO: 79721 - protein, 16 aa, Mycobacterium tuberculosis
AAIAIAETNPHLDVAI

SEQ ID NO: 79722 - protein, 16 aa, Mycobacterium tuberculosis
AIAIAETNPHLDVAIV

SEQ ID NO: 79723 - protein, 16 aa, Mycobacterium tuberculosis
IAIAETNPHLDVAIVS

SEQ ID NO: 79724 - protein, 16 aa, Mycobacterium tuberculosis
AIAETNPHLDVAIVSK

SEQ ID NO: 79725 - protein, 16 aa, Mycobacterium tuberculosis
IAETNPHLDVAIVSKV

SEQ ID NO: 79726 - protein, 16 aa, Mycobacterium tuberculosis
AETNPHLDVAIVSKVY

SEQ ID NO: 79727 - protein, 16 aa, Mycobacterium tuberculosis
ETNPHLDVAIVSKVYP

SEQ ID NO: 79728 - protein, 16 aa, Mycobacterium tuberculosis
TNPHLDVAIVSKVYPM

SEQ ID NO: 79729 - protein, 16 aa, Mycobacterium tuberculosis
NPHLDVAIVSKVYPMR

SEQ ID NO: 79730 - protein, 16 aa, Mycobacterium tuberculosis
PHLDVAIVSKVYPMRS

SEQ ID NO: 79731 - protein, 16 aa, Mycobacterium tuberculosis
HLDVAIVSKVYPMRSH

SEQ ID NO: 79732 - protein, 16 aa, Mycobacterium tuberculosis
LDVAIVSKVYPMRSHT

SEQ ID NO: 79733 - protein, 16 aa, Mycobacterium tuberculosis
DVAIVSKVYPMRSHTV

SEQ ID NO: 79734 - protein, 16 aa, Mycobacterium tuberculosis
VAIVSKVYPMRSHTVS

SEQ ID NO: 79735 - protein, 16 aa, Mycobacterium tuberculosis
AIVSKVYPMRSHTVSA

SEQ ID NO: 79736 - protein, 16 aa, Mycobacterium tuberculosis
IVSKVYPMRSHTVSAE

SEQ ID NO: 79737 - protein, 16 aa, Mycobacterium tuberculosis
VSKVYPMRSHTVSAEG

SEQ ID NO: 79738 - protein, 16 aa, Mycobacterium tuberculosis
SKVYPMRSHTVSAEGG

SEQ ID NO: 79739 - protein, 16 aa, Mycobacterium tuberculosis
KVYPMRSHTVSAEGGA

SEQ ID NO: 79740 - protein, 16 aa, Mycobacterium tuberculosis
VYPMRSHTVSAEGGAA

SEQ ID NO: 79741 - protein, 16 aa, Mycobacterium tuberculosis
YPMRSHTVSAEGGAAA

SEQ ID NO: 79742 - protein, 16 aa, Mycobacterium tuberculosis
PMRSHTVSAEGGAAAV

SEQ ID NO: 79743 - protein, 16 aa, Mycobacterium tuberculosis
MRSHTVSAEGGAAAVT

SEQ ID NO: 79744 - protein, 16 aa, Mycobacterium tuberculosis
RSHTVSAEGGAAAVTG

SEQ ID NO: 79745 - protein, 16 aa, Mycobacterium tuberculosis
SHTVSAEGGAAAVTGD

SEQ ID NO: 79746 - protein, 16 aa, Mycobacterium tuberculosis
HTVSAEGGAAAVTGDD

SEQ ID NO: 79747 - protein, 16 aa, Mycobacterium tuberculosis
TVSAEGGAAAVTGDDD

SEQ ID NO: 79748 - protein, 16 aa, Mycobacterium tuberculosis
VSAEGGAAAVTGDDDS

SEQ ID NO: 79749 - protein, 16 aa, Mycobacterium tuberculosis
SAEGGAAAVTGDDDSL

SEQ ID NO: 79750 - protein, 16 aa, Mycobacterium tuberculosis
AEGGAAAVTGDDDSLD

SEQ ID NO: 79751 - protein, 16 aa, Mycobacterium tuberculosis
EGGAAAVTGDDDSLDE

SEQ ID NO: 79752 - protein, 16 aa, Mycobacterium tuberculosis
GGAAAVTGDDDSLDEH

SEQ ID NO: 79753 - protein, 16 aa, Mycobacterium tuberculosis
GAAAVTGDDDSLDEHA

SEQ ID NO: 79754 - protein, 16 aa, Mycobacterium tuberculosis
AAAVTGDDDSLDEHAH

SEQ ID NO: 79755 - protein, 16 aa, Mycobacterium tuberculosis
AAVTGDDDSLDEHAHD

SEQ ID NO: 79756 - protein, 16 aa, Mycobacterium tuberculosis
AVTGDDDSLDEHAHDT

SEQ ID NO: 79757 - protein, 16 aa, Mycobacterium tuberculosis
VTGDDDSLDEHAHDTV

SEQ ID NO: 79758 - protein, 16 aa, Mycobacterium tuberculosis
TGDDDSLDEHAHDTVS

SEQ ID NO: 79759 - protein, 16 aa, Mycobacterium tuberculosis
GDDDSLDEHAHDTVSG

SEQ ID NO: 79760 - protein, 16 aa, Mycobacterium tuberculosis
DDDSLDEHAHDTVSGG

SEQ ID NO: 79761 - protein, 16 aa, Mycobacterium tuberculosis
DDSLDEHAHDTVSGGD

SEQ ID NO: 79762 - protein, 16 aa, Mycobacterium tuberculosis
DSLDEHAHDTVSGGDW

SEQ ID NO: 79763 - protein, 16 aa, Mycobacterium tuberculosis
SLDEHAHDTVSGGDWL

SEQ ID NO: 79764 - protein, 16 aa, Mycobacterium tuberculosis
LDEHAHDTVSGGDWLC

SEQ ID NO: 79765 - protein, 16 aa, Mycobacterium tuberculosis
DEHAHDTVSGGDWLCD

SEQ ID NO: 79766 - protein, 16 aa, Mycobacterium tuberculosis
EHAHDTVSGGDWLCDQ

SEQ ID NO: 79767 - protein, 16 aa, Mycobacterium tuberculosis
HAHDTVSGGDWLCDQD

SEQ ID NO: 79768 - protein, 16 aa, Mycobacterium tuberculosis
AHDTVSGGDWLCDQDA

SEQ ID NO: 79769 - protein, 16 aa, Mycobacterium tuberculosis
HDTVSGGDWLCDQDAV

SEQ ID NO: 79770 - protein, 16 aa, Mycobacterium tuberculosis
DTVSGGDWLCDQDAVE

SEQ ID NO: 79771 - protein, 16 aa, Mycobacterium tuberculosis
TVSGGDWLCDQDAVEA

SEQ ID NO: 79772 - protein, 16 aa, Mycobacterium tuberculosis
VSGGDWLCDQDAVEAF

SEQ ID NO: 79773 - protein, 16 aa, Mycobacterium tuberculosis
SGGDWLCDQDAVEAFV

SEQ ID NO: 79774 - protein, 16 aa, Mycobacterium tuberculosis
GGDWLCDQDAVEAFVA

SEQ ID NO: 79775 - protein, 16 aa, Mycobacterium tuberculosis
GDWLCDQDAVEAFVAE

SEQ ID NO: 79776 - protein, 16 aa, Mycobacterium tuberculosis
DWLCDQDAVEAFVAEA

SEQ ID NO: 79777 - protein, 16 aa, Mycobacterium tuberculosis
WLCDQDAVEAFVAEAP

SEQ ID NO: 79778 - protein, 16 aa, Mycobacterium tuberculosis
LCDQDAVEAFVAEAPK

SEQ ID NO: 79779 - protein, 16 aa, Mycobacterium tuberculosis
CDQDAVEAFVAEAPKE

SEQ ID NO: 79780 - protein, 16 aa, Mycobacterium tuberculosis
DQDAVEAFVAEAPKEL

SEQ ID NO: 79781 - protein, 16 aa, Mycobacterium tuberculosis
QDAVEAFVAEAPKELV

SEQ ID NO: 79782 - protein, 16 aa, Mycobacterium tuberculosis
DAVEAFVAEAPKELVQ

SEQ ID NO: 79783 - protein, 16 aa, Mycobacterium tuberculosis
AVEAFVAEAPKELVQL

SEQ ID NO: 79784 - protein, 16 aa, Mycobacterium tuberculosis
VEAFVAEAPKELVQLE

SEQ ID NO: 79785 - protein, 16 aa, Mycobacterium tuberculosis
EAFVAEAPKELVQLEH

SEQ ID NO: 79786 - protein, 16 aa, Mycobacterium tuberculosis
AFVAEAPKELVQLEHW

SEQ ID NO: 79787 - protein, 16 aa, Mycobacterium tuberculosis
FVAEAPKELVQLEHWG

SEQ ID NO: 79788 - protein, 16 aa, Mycobacterium tuberculosis
VAEAPKELVQLEHWGC

SEQ ID NO: 79789 - protein, 16 aa, Mycobacterium tuberculosis
AEAPKELVQLEHWGCP

SEQ ID NO: 79790 - protein, 16 aa, Mycobacterium tuberculosis
EAPKELVQLEHWGCPW

SEQ ID NO: 79791 - protein, 16 aa, Mycobacterium tuberculosis
APKELVQLEHWGCPWS

SEQ ID NO: 79792 - protein, 16 aa, Mycobacterium tuberculosis
PKELVQLEHWGCPWSR

SEQ ID NO: 79793 - protein, 16 aa, Mycobacterium tuberculosis
KELVQLEHWGCPWSRK

SEQ ID NO: 79794 - protein, 16 aa, Mycobacterium tuberculosis
ELVQLEHWGCPWSRKP

SEQ ID NO: 79795 - protein, 16 aa, Mycobacterium tuberculosis
LVQLEHWGCPWSRKPD

SEQ ID NO: 79796 - protein, 16 aa, Mycobacterium tuberculosis
VQLEHWGCPWSRKPDG

SEQ ID NO: 79797 - protein, 16 aa, Mycobacterium tuberculosis
QLEHWGCPWSRKPDGR

SEQ ID NO: 79798 - protein, 16 aa, Mycobacterium tuberculosis
LEHWGCPWSRKPDGRV

SEQ ID NO: 79799 - protein, 16 aa, Mycobacterium tuberculosis
EHWGCPWSRKPDGRVA

SEQ ID NO: 79800 - protein, 16 aa, Mycobacterium tuberculosis
HWGCPWSRKPDGRVAV

SEQ ID NO: 79801 - protein, 16 aa, Mycobacterium tuberculosis
WGCPWSRKPDGRVAVR

SEQ ID NO: 79802 - protein, 16 aa, Mycobacterium tuberculosis
GCPWSRKPDGRVAVRP

SEQ ID NO: 79803 - protein, 16 aa, Mycobacterium tuberculosis
CPWSRKPDGRVAVRPF

SEQ ID NO: 79804 - protein, 16 aa, Mycobacterium tuberculosis
PWSRKPDGRVAVRPFG

SEQ ID NO: 79805 - protein, 16 aa, Mycobacterium tuberculosis
WSRKPDGRVAVRPFGG

SEQ ID NO: 79806 - protein, 16 aa, Mycobacterium tuberculosis
SRKPDGRVAVRPFGGM

SEQ ID NO: 79807 - protein, 16 aa, Mycobacterium tuberculosis
RKPDGRVAVRPFGGMK

SEQ ID NO: 79808 - protein, 16 aa, Mycobacterium tuberculosis
KPDGRVAVRPFGGMKK

SEQ ID NO: 79809 - protein, 16 aa, Mycobacterium tuberculosis
PDGRVAVRPFGGMKKL

SEQ ID NO: 79810 - protein, 16 aa, Mycobacterium tuberculosis
DGRVAVRPFGGMKKLR

SEQ ID NO: 79811 - protein, 16 aa, Mycobacterium tuberculosis
GRVAVRPFGGMKKLRT

SEQ ID NO: 79812 - protein, 16 aa, Mycobacterium tuberculosis
RVAVRPFGGMKKLRTW

SEQ ID NO: 79813 - protein, 16 aa, Mycobacterium tuberculosis
VAVRPFGGMKKLRTWF

SEQ ID NO: 79814 - protein, 16 aa, Mycobacterium tuberculosis
AVRPFGGMKKLRTWFA

SEQ ID NO: 79815 - protein, 16 aa, Mycobacterium tuberculosis
VRPFGGMKKLRTWFAA

SEQ ID NO: 79816 - protein, 16 aa, Mycobacterium tuberculosis
RPFGGMKKLRTWFAAD

SEQ ID NO: 79817 - protein, 16 aa, Mycobacterium tuberculosis
PFGGMKKLRTWFAADK

SEQ ID NO: 79818 - protein, 16 aa, Mycobacterium tuberculosis
FGGMKKLRTWFAADKT

SEQ ID NO: 79819 - protein, 16 aa, Mycobacterium tuberculosis
GGMKKLRTWFAADKTG

SEQ ID NO: 79820 - protein, 16 aa, Mycobacterium tuberculosis
GMKKLRTWFAADKTGF

SEQ ID NO: 79821 - protein, 16 aa, Mycobacterium tuberculosis
MKKLRTWFAADKTGFH

SEQ ID NO: 79822 - protein, 16 aa, Mycobacterium tuberculosis
KKLRTWFAADKTGFHL

SEQ ID NO: 79823 - protein, 16 aa, Mycobacterium tuberculosis
KLRTWFAADKTGFHLL

SEQ ID NO: 79824 - protein, 16 aa, Mycobacterium tuberculosis
LRTWFAADKTGFHLLH

SEQ ID NO: 79825 - protein, 16 aa, Mycobacterium tuberculosis
RTWFAADKTGFHLLHT

SEQ ID NO: 79826 - protein, 16 aa, Mycobacterium tuberculosis
TWFAADKTGFHLLHTL

SEQ ID NO: 79827 - protein, 16 aa, Mycobacterium tuberculosis
WFAADKTGFHLLHTLF

SEQ ID NO: 79828 - protein, 16 aa, Mycobacterium tuberculosis
FAADKTGFHLLHTLFQ

SEQ ID NO: 79829 - protein, 16 aa, Mycobacterium tuberculosis
AADKTGFHLLHTLFQR

SEQ ID NO: 79830 - protein, 16 aa, Mycobacterium tuberculosis
ADKTGFHLLHTLFQRL

SEQ ID NO: 79831 - protein, 16 aa, Mycobacterium tuberculosis
DKTGFHLLHTLFQRLL

SEQ ID NO: 79832 - protein, 16 aa, Mycobacterium tuberculosis
KTGFHLLHTLFQRLLT

SEQ ID NO: 79833 - protein, 16 aa, Mycobacterium tuberculosis
TGFHLLHTLFQRLLTY

SEQ ID NO: 79834 - protein, 16 aa, Mycobacterium tuberculosis
GFHLLHTLFQRLLTYS

SEQ ID NO: 79835 - protein, 16 aa, Mycobacterium tuberculosis
FHLLHTLFQRLLTYSD

SEQ ID NO: 79836 - protein, 16 aa, Mycobacterium tuberculosis
HLLHTLFQRLLTYSDV

SEQ ID NO: 79837 - protein, 16 aa, Mycobacterium tuberculosis
LLHTLFQRLLTYSDVM

SEQ ID NO: 79838 - protein, 16 aa, Mycobacterium tuberculosis
LHTLFQRLLTYSDVMR

SEQ ID NO: 79839 - protein, 16 aa, Mycobacterium tuberculosis
HTLFQRLLTYSDVMRY

SEQ ID NO: 79840 - protein, 16 aa, Mycobacterium tuberculosis
TLFQRLLTYSDVMRYD

SEQ ID NO: 79841 - protein, 16 aa, Mycobacterium tuberculosis
LFQRLLTYSDVMRYDE

SEQ ID NO: 79842 - protein, 16 aa, Mycobacterium tuberculosis
FQRLLTYSDVMRYDEW

SEQ ID NO: 79843 - protein, 16 aa, Mycobacterium tuberculosis
QRLLTYSDVMRYDEWF

SEQ ID NO: 79844 - protein, 16 aa, Mycobacterium tuberculosis
RLLTYSDVMRYDEWFA

SEQ ID NO: 79845 - protein, 16 aa, Mycobacterium tuberculosis
LLTYSDVMRYDEWFAT

SEQ ID NO: 79846 - protein, 16 aa, Mycobacterium tuberculosis
LTYSDVMRYDEWFATT

SEQ ID NO: 79847 - protein, 16 aa, Mycobacterium tuberculosis
TYSDVMRYDEWFATTL

SEQ ID NO: 79848 - protein, 16 aa, Mycobacterium tuberculosis
YSDVMRYDEWFATTLL

SEQ ID NO: 79849 - protein, 16 aa, Mycobacterium tuberculosis
SDVMRYDEWFATTLLV

SEQ ID NO: 79850 - protein, 16 aa, Mycobacterium tuberculosis
DVMRYDEWFATTLLVD

SEQ ID NO: 79851 - protein, 16 aa, Mycobacterium tuberculosis
VMRYDEWFATTLLVDD

SEQ ID NO: 79852 - protein, 16 aa, Mycobacterium tuberculosis
MRYDEWFATTLLVDDG

SEQ ID NO: 79853 - protein, 16 aa, Mycobacterium tuberculosis
RYDEWFATTLLVDDGR

SEQ ID NO: 79854 - protein, 16 aa, Mycobacterium tuberculosis
YDEWFATTLLVDDGRV

SEQ ID NO: 79855 - protein, 16 aa, Mycobacterium tuberculosis
DEWFATTLLVDDGRVC

SEQ ID NO: 79856 - protein, 16 aa, Mycobacterium tuberculosis
EWFATTLLVDDGRVCG

SEQ ID NO: 79857 - protein, 16 aa, Mycobacterium tuberculosis
WFATTLLVDDGRVCGL

SEQ ID NO: 79858 - protein, 16 aa, Mycobacterium tuberculosis
FATTLLVDDGRVCGLV

SEQ ID NO: 79859 - protein, 16 aa, Mycobacterium tuberculosis
ATTLLVDDGRVCGLVA

SEQ ID NO: 79860 - protein, 16 aa, Mycobacterium tuberculosis
TTLLVDDGRVCGLVAI

SEQ ID NO: 79861 - protein, 16 aa, Mycobacterium tuberculosis
TLLVDDGRVCGLVAIE

SEQ ID NO: 79862 - protein, 16 aa, Mycobacterium tuberculosis
LLVDDGRVCGLVAIEL

SEQ ID NO: 79863 - protein, 16 aa, Mycobacterium tuberculosis
LVDDGRVCGLVAIELA

SEQ ID NO: 79864 - protein, 16 aa, Mycobacterium tuberculosis
VDDGRVCGLVAIELAT

SEQ ID NO: 79865 - protein, 16 aa, Mycobacterium tuberculosis
DDGRVCGLVAIELATG

SEQ ID NO: 79866 - protein, 16 aa, Mycobacterium tuberculosis
DGRVCGLVAIELATGR

SEQ ID NO: 79867 - protein, 16 aa, Mycobacterium tuberculosis
GRVCGLVAIELATGRI

SEQ ID NO: 79868 - protein, 16 aa, Mycobacterium tuberculosis
RVCGLVAIELATGRIE

SEQ ID NO: 79869 - protein, 16 aa, Mycobacterium tuberculosis
VCGLVAIELATGRIET

SEQ ID NO: 79870 - protein, 16 aa, Mycobacterium tuberculosis
CGLVAIELATGRIETI

SEQ ID NO: 79871 - protein, 16 aa, Mycobacterium tuberculosis
GLVAIELATGRIETIL

SEQ ID NO: 79872 - protein, 16 aa, Mycobacterium tuberculosis
LVAIELATGRIETILA

SEQ ID NO: 79873 - protein, 16 aa, Mycobacterium tuberculosis
VAIELATGRIETILAD

SEQ ID NO: 79874 - protein, 16 aa, Mycobacterium tuberculosis
AIELATGRIETILADA

SEQ ID NO: 79875 - protein, 16 aa, Mycobacterium tuberculosis
IELATGRIETILADAV

SEQ ID NO: 79876 - protein, 16 aa, Mycobacterium tuberculosis
ELATGRIETILADAVI

SEQ ID NO: 79877 - protein, 16 aa, Mycobacterium tuberculosis
LATGRIETILADAVIL

SEQ ID NO: 79878 - protein, 16 aa, Mycobacterium tuberculosis
ATGRIETILADAVILC

SEQ ID NO: 79879 - protein, 16 aa, Mycobacterium tuberculosis
TGRIETILADAVILCT

SEQ ID NO: 79880 - protein, 16 aa, Mycobacterium tuberculosis
GRIETILADAVILCTG

SEQ ID NO: 79881 - protein, 16 aa, Mycobacterium tuberculosis
RIETILADAVILCTGG

SEQ ID NO: 79882 - protein, 16 aa, Mycobacterium tuberculosis
IETILADAVILCTGGC

SEQ ID NO: 79883 - protein, 16 aa, Mycobacterium tuberculosis
ETILADAVILCTGGCG

SEQ ID NO: 79884 - protein, 16 aa, Mycobacterium tuberculosis
TILADAVILCTGGCGR

SEQ ID NO: 79885 - protein, 16 aa, Mycobacterium tuberculosis
ILADAVILCTGGCGRV

SEQ ID NO: 79886 - protein, 16 aa, Mycobacterium tuberculosis
LADAVILCTGGCGRVF

SEQ ID NO: 79887 - protein, 16 aa, Mycobacterium tuberculosis
ADAVILCTGGCGRVFP

SEQ ID NO: 79888 - protein, 16 aa, Mycobacterium tuberculosis
DAVILCTGGCGRVFPF

SEQ ID NO: 79889 - protein, 16 aa, Mycobacterium tuberculosis
AVILCTGGCGRVFPFT

SEQ ID NO: 79890 - protein, 16 aa, Mycobacterium tuberculosis
VILCTGGCGRVFPFTT

SEQ ID NO: 79891 - protein, 16 aa, Mycobacterium tuberculosis
ILCTGGCGRVFPFTTN

SEQ ID NO: 79892 - protein, 16 aa, Mycobacterium tuberculosis
LCTGGCGRVFPFTTNA

SEQ ID NO: 79893 - protein, 16 aa, Mycobacterium tuberculosis
CTGGCGRVFPFTTNAN

SEQ ID NO: 79894 - protein, 16 aa, Mycobacterium tuberculosis
TGGCGRVFPFTTNANI

SEQ ID NO: 79895 - protein, 16 aa, Mycobacterium tuberculosis
GGCGRVFPFTTNANIK

SEQ ID NO: 79896 - protein, 16 aa, Mycobacterium tuberculosis
GCGRVFPFTTNANIKT

SEQ ID NO: 79897 - protein, 16 aa, Mycobacterium tuberculosis
CGRVFPFTTNANIKTG

SEQ ID NO: 79898 - protein, 16 aa, Mycobacterium tuberculosis
GRVFPFTTNANIKTGD

SEQ ID NO: 79899 - protein, 16 aa, Mycobacterium tuberculosis
RVFPFTTNANIKTGDG

SEQ ID NO: 79900 - protein, 16 aa, Mycobacterium tuberculosis
VFPFTTNANIKTGDGM

SEQ ID NO: 79901 - protein, 16 aa, Mycobacterium tuberculosis
FPFTTNANIKTGDGMA

SEQ ID NO: 79902 - protein, 16 aa, Mycobacterium tuberculosis
PFTTNANIKTGDGMAL

SEQ ID NO: 79903 - protein, 16 aa, Mycobacterium tuberculosis
FTTNANIKTGDGMALA

SEQ ID NO: 79904 - protein, 16 aa, Mycobacterium tuberculosis
TTNANIKTGDGMALAF

SEQ ID NO: 79905 - protein, 16 aa, Mycobacterium tuberculosis
TNANIKTGDGMALAFR

SEQ ID NO: 79906 - protein, 16 aa, Mycobacterium tuberculosis
NANIKTGDGMALAFRA

SEQ ID NO: 79907 - protein, 16 aa, Mycobacterium tuberculosis
ANIKTGDGMALAFRAG

SEQ ID NO: 79908 - protein, 16 aa, Mycobacterium tuberculosis
NIKTGDGMALAFRAGA

SEQ ID NO: 79909 - protein, 16 aa, Mycobacterium tuberculosis
IKTGDGMALAFRAGAP

SEQ ID NO: 79910 - protein, 16 aa, Mycobacterium tuberculosis
KTGDGMALAFRAGAPL

SEQ ID NO: 79911 - protein, 16 aa, Mycobacterium tuberculosis
TGDGMALAFRAGAPLK

SEQ ID NO: 79912 - protein, 16 aa, Mycobacterium tuberculosis
GDGMALAFRAGAPLKD

SEQ ID NO: 79913 - protein, 16 aa, Mycobacterium tuberculosis
DGMALAFRAGAPLKDM

SEQ ID NO: 79914 - protein, 16 aa, Mycobacterium tuberculosis
GMALAFRAGAPLKDME

SEQ ID NO: 79915 - protein, 16 aa, Mycobacterium tuberculosis
MALAFRAGAPLKDMEF

SEQ ID NO: 79916 - protein, 16 aa, Mycobacterium tuberculosis
ALAFRAGAPLKDMEFV

SEQ ID NO: 79917 - protein, 16 aa, Mycobacterium tuberculosis
LAFRAGAPLKDMEFVQ

SEQ ID NO: 79918 - protein, 16 aa, Mycobacterium tuberculosis
AFRAGAPLKDMEFVQY

SEQ ID NO: 79919 - protein, 16 aa, Mycobacterium tuberculosis
FRAGAPLKDMEFVQYH

SEQ ID NO: 79920 - protein, 16 aa, Mycobacterium tuberculosis
RAGAPLKDMEFVQYHP

SEQ ID NO: 79921 - protein, 16 aa, Mycobacterium tuberculosis
AGAPLKDMEFVQYHPT

SEQ ID NO: 79922 - protein, 16 aa, Mycobacterium tuberculosis
GAPLKDMEFVQYHPTG

SEQ ID NO: 79923 - protein, 16 aa, Mycobacterium tuberculosis
APLKDMEFVQYHPTGL

SEQ ID NO: 79924 - protein, 16 aa, Mycobacterium tuberculosis
PLKDMEFVQYHPTGLP

SEQ ID NO: 79925 - protein, 16 aa, Mycobacterium tuberculosis
LKDMEFVQYHPTGLPF

SEQ ID NO: 79926 - protein, 16 aa, Mycobacterium tuberculosis
KDMEFVQYHPTGLPFT

SEQ ID NO: 79927 - protein, 16 aa, Mycobacterium tuberculosis
DMEFVQYHPTGLPFTG

SEQ ID NO: 79928 - protein, 16 aa, Mycobacterium tuberculosis
MEFVQYHPTGLPFTGI

SEQ ID NO: 79929 - protein, 16 aa, Mycobacterium tuberculosis
EFVQYHPTGLPFTGIL

SEQ ID NO: 79930 - protein, 16 aa, Mycobacterium tuberculosis
FVQYHPTGLPFTGILI

SEQ ID NO: 79931 - protein, 16 aa, Mycobacterium tuberculosis
VQYHPTGLPFTGILIT

SEQ ID NO: 79932 - protein, 16 aa, Mycobacterium tuberculosis
QYHPTGLPFTGILITE

SEQ ID NO: 79933 - protein, 16 aa, Mycobacterium tuberculosis
YHPTGLPFTGILITEA

SEQ ID NO: 79934 - protein, 16 aa, Mycobacterium tuberculosis
HPTGLPFTGILITEAA

SEQ ID NO: 79935 - protein, 16 aa, Mycobacterium tuberculosis
PTGLPFTGILITEAAR

SEQ ID NO: 79936 - protein, 16 aa, Mycobacterium tuberculosis
TGLPFTGILITEAARA

SEQ ID NO: 79937 - protein, 16 aa, Mycobacterium tuberculosis
GLPFTGILITEAARAE

SEQ ID NO: 79938 - protein, 16 aa, Mycobacterium tuberculosis
LPFTGILITEAARAEG

SEQ ID NO: 79939 - protein, 16 aa, Mycobacterium tuberculosis
PFTGILITEAARAEGG

SEQ ID NO: 79940 - protein, 16 aa, Mycobacterium tuberculosis
FTGILITEAARAEGGW

SEQ ID NO: 79941 - protein, 16 aa, Mycobacterium tuberculosis
TGILITEAARAEGGWL

SEQ ID NO: 79942 - protein, 16 aa, Mycobacterium tuberculosis
GILITEAARAEGGWLL

SEQ ID NO: 79943 - protein, 16 aa, Mycobacterium tuberculosis
ILITEAARAEGGWLLN

SEQ ID NO: 79944 - protein, 16 aa, Mycobacterium tuberculosis
LITEAARAEGGWLLNK

SEQ ID NO: 79945 - protein, 16 aa, Mycobacterium tuberculosis
ITEAARAEGGWLLNKD

SEQ ID NO: 79946 - protein, 16 aa, Mycobacterium tuberculosis
TEAARAEGGWLLNKDG

SEQ ID NO: 79947 - protein, 16 aa, Mycobacterium tuberculosis
EAARAEGGWLLNKDGY

SEQ ID NO: 79948 - protein, 16 aa, Mycobacterium tuberculosis
AARAEGGWLLNKDGYR

SEQ ID NO: 79949 - protein, 16 aa, Mycobacterium tuberculosis
ARAEGGWLLNKDGYRY

SEQ ID NO: 79950 - protein, 16 aa, Mycobacterium tuberculosis
RAEGGWLLNKDGYRYL

SEQ ID NO: 79951 - protein, 16 aa, Mycobacterium tuberculosis
AEGGWLLNKDGYRYLQ

SEQ ID NO: 79952 - protein, 16 aa, Mycobacterium tuberculosis
EGGWLLNKDGYRYLQD

SEQ ID NO: 79953 - protein, 16 aa, Mycobacterium tuberculosis
GGWLLNKDGYRYLQDY

SEQ ID NO: 79954 - protein, 16 aa, Mycobacterium tuberculosis
GWLLNKDGYRYLQDYD

SEQ ID NO: 79955 - protein, 16 aa, Mycobacterium tuberculosis
WLLNKDGYRYLQDYDL

SEQ ID NO: 79956 - protein, 16 aa, Mycobacterium tuberculosis
LLNKDGYRYLQDYDLG

SEQ ID NO: 79957 - protein, 16 aa, Mycobacterium tuberculosis
LNKDGYRYLQDYDLGK

SEQ ID NO: 79958 - protein, 16 aa, Mycobacterium tuberculosis
NKDGYRYLQDYDLGKP

SEQ ID NO: 79959 - protein, 16 aa, Mycobacterium tuberculosis
KDGYRYLQDYDLGKPT

SEQ ID NO: 79960 - protein, 16 aa, Mycobacterium tuberculosis
DGYRYLQDYDLGKPTP

SEQ ID NO: 79961 - protein, 16 aa, Mycobacterium tuberculosis
GYRYLQDYDLGKPTPE

SEQ ID NO: 79962 - protein, 16 aa, Mycobacterium tuberculosis
YRYLQDYDLGKPTPEP

SEQ ID NO: 79963 - protein, 16 aa, Mycobacterium tuberculosis
RYLQDYDLGKPTPEPR

SEQ ID NO: 79964 - protein, 16 aa, Mycobacterium tuberculosis
YLQDYDLGKPTPEPRL

SEQ ID NO: 79965 - protein, 16 aa, Mycobacterium tuberculosis
LQDYDLGKPTPEPRLR

SEQ ID NO: 79966 - protein, 16 aa, Mycobacterium tuberculosis
QDYDLGKPTPEPRLRS

SEQ ID NO: 79967 - protein, 16 aa, Mycobacterium tuberculosis
DYDLGKPTPEPRLRSM

SEQ ID NO: 79968 - protein, 16 aa, Mycobacterium tuberculosis
YDLGKPTPEPRLRSME

SEQ ID NO: 79969 - protein, 16 aa, Mycobacterium tuberculosis
DLGKPTPEPRLRSMEL

SEQ ID NO: 79970 - protein, 16 aa, Mycobacterium tuberculosis
LGKPTPEPRLRSMELG

SEQ ID NO: 79971 - protein, 16 aa, Mycobacterium tuberculosis
GKPTPEPRLRSMELGP

SEQ ID NO: 79972 - protein, 16 aa, Mycobacterium tuberculosis
KPTPEPRLRSMELGPR

SEQ ID NO: 79973 - protein, 16 aa, Mycobacterium tuberculosis
PTPEPRLRSMELGPRD

SEQ ID NO: 79974 - protein, 16 aa, Mycobacterium tuberculosis
TPEPRLRSMELGPRDR

SEQ ID NO: 79975 - protein, 16 aa, Mycobacterium tuberculosis
PEPRLRSMELGPRDRL

SEQ ID NO: 79976 - protein, 16 aa, Mycobacterium tuberculosis
EPRLRSMELGPRDRLS

SEQ ID NO: 79977 - protein, 16 aa, Mycobacterium tuberculosis
PRLRSMELGPRDRLSQ

SEQ ID NO: 79978 - protein, 16 aa, Mycobacterium tuberculosis
RLRSMELGPRDRLSQA

SEQ ID NO: 79979 - protein, 16 aa, Mycobacterium tuberculosis
LRSMELGPRDRLSQAF

SEQ ID NO: 79980 - protein, 16 aa, Mycobacterium tuberculosis
RSMELGPRDRLSQAFV

SEQ ID NO: 79981 - protein, 16 aa, Mycobacterium tuberculosis
SMELGPRDRLSQAFVH

SEQ ID NO: 79982 - protein, 16 aa, Mycobacterium tuberculosis
MELGPRDRLSQAFVHE

SEQ ID NO: 79983 - protein, 16 aa, Mycobacterium tuberculosis
ELGPRDRLSQAFVHEH

SEQ ID NO: 79984 - protein, 16 aa, Mycobacterium tuberculosis
LGPRDRLSQAFVHEHN

SEQ ID NO: 79985 - protein, 16 aa, Mycobacterium tuberculosis
GPRDRLSQAFVHEHNK

SEQ ID NO: 79986 - protein, 16 aa, Mycobacterium tuberculosis
PRDRLSQAFVHEHNKG

SEQ ID NO: 79987 - protein, 16 aa, Mycobacterium tuberculosis
RDRLSQAFVHEHNKGR

SEQ ID NO: 79988 - protein, 16 aa, Mycobacterium tuberculosis
DRLSQAFVHEHNKGRT

SEQ ID NO: 79989 - protein, 16 aa, Mycobacterium tuberculosis
RLSQAFVHEHNKGRTV

SEQ ID NO: 79990 - protein, 16 aa, Mycobacterium tuberculosis
LSQAFVHEHNKGRTVD

SEQ ID NO: 79991 - protein, 16 aa, Mycobacterium tuberculosis
SQAFVHEHNKGRTVDT

SEQ ID NO: 79992 - protein, 16 aa, Mycobacterium tuberculosis
QAFVHEHNKGRTVDTP

SEQ ID NO: 79993 - protein, 16 aa, Mycobacterium tuberculosis
AFVHEHNKGRTVDTPY

SEQ ID NO: 79994 - protein, 16 aa, Mycobacterium tuberculosis
FVHEHNKGRTVDTPYG

SEQ ID NO: 79995 - protein, 16 aa, Mycobacterium tuberculosis
VHEHNKGRTVDTPYGP

SEQ ID NO: 79996 - protein, 16 aa, Mycobacterium tuberculosis
HEHNKGRTVDTPYGPV

SEQ ID NO: 79997 - protein, 16 aa, Mycobacterium tuberculosis
EHNKGRTVDTPYGPVV

SEQ ID NO: 79998 - protein, 16 aa, Mycobacterium tuberculosis
HNKGRTVDTPYGPVVY

SEQ ID NO: 79999 - protein, 16 aa, Mycobacterium tuberculosis
NKGRTVDTPYGPVVYL

SEQ ID NO: 80000 - protein, 16 aa, Mycobacterium tuberculosis
KGRTVDTPYGPVVYLD

SEQ ID NO: 80001 - protein, 16 aa, Mycobacterium tuberculosis
GRTVDTPYGPVVYLDL

SEQ ID NO: 80002 - protein, 16 aa, Mycobacterium tuberculosis
RTVDTPYGPVVYLDLR

SEQ ID NO: 80003 - protein, 16 aa, Mycobacterium tuberculosis
TVDTPYGPVVYLDLRH

SEQ ID NO: 80004 - protein, 16 aa, Mycobacterium tuberculosis
VDTPYGPVVYLDLRHL

SEQ ID NO: 80005 - protein, 16 aa, Mycobacterium tuberculosis
DTPYGPVVYLDLRHLG

SEQ ID NO: 80006 - protein, 16 aa, Mycobacterium tuberculosis
TPYGPVVYLDLRHLGA

SEQ ID NO: 80007 - protein, 16 aa, Mycobacterium tuberculosis
PYGPVVYLDLRHLGAD

SEQ ID NO: 80008 - protein, 16 aa, Mycobacterium tuberculosis
YGPVVYLDLRHLGADL

SEQ ID NO: 80009 - protein, 16 aa, Mycobacterium tuberculosis
GPVVYLDLRHLGADLI

SEQ ID NO: 80010 - protein, 16 aa, Mycobacterium tuberculosis
PVVYLDLRHLGADLID

SEQ ID NO: 80011 - protein, 16 aa, Mycobacterium tuberculosis
VVYLDLRHLGADLIDA

SEQ ID NO: 80012 - protein, 16 aa, Mycobacterium tuberculosis
VYLDLRHLGADLIDAK

SEQ ID NO: 80013 - protein, 16 aa, Mycobacterium tuberculosis
YLDLRHLGADLIDAKL

SEQ ID NO: 80014 - protein, 16 aa, Mycobacterium tuberculosis
LDLRHLGADLIDAKLP

SEQ ID NO: 80015 - protein, 16 aa, Mycobacterium tuberculosis
DLRHLGADLIDAKLPF

SEQ ID NO: 80016 - protein, 16 aa, Mycobacterium tuberculosis
LRHLGADLIDAKLPFV

SEQ ID NO: 80017 - protein, 16 aa, Mycobacterium tuberculosis
RHLGADLIDAKLPFVR

SEQ ID NO: 80018 - protein, 16 aa, Mycobacterium tuberculosis
HLGADLIDAKLPFVRE

SEQ ID NO: 80019 - protein, 16 aa, Mycobacterium tuberculosis
LGADLIDAKLPFVREL

SEQ ID NO: 80020 - protein, 16 aa, Mycobacterium tuberculosis
GADLIDAKLPFVRELC

SEQ ID NO: 80021 - protein, 16 aa, Mycobacterium tuberculosis
ADLIDAKLPFVRELCR

SEQ ID NO: 80022 - protein, 16 aa, Mycobacterium tuberculosis
DLIDAKLPFVRELCRD

SEQ ID NO: 80023 - protein, 16 aa, Mycobacterium tuberculosis
LIDAKLPFVRELCRDY

SEQ ID NO: 80024 - protein, 16 aa, Mycobacterium tuberculosis
IDAKLPFVRELCRDYQ

SEQ ID NO: 80025 - protein, 16 aa, Mycobacterium tuberculosis
DAKLPFVRELCRDYQH

SEQ ID NO: 80026 - protein, 16 aa, Mycobacterium tuberculosis
AKLPFVRELCRDYQHI

SEQ ID NO: 80027 - protein, 16 aa, Mycobacterium tuberculosis
KLPFVRELCRDYQHID

SEQ ID NO: 80028 - protein, 16 aa, Mycobacterium tuberculosis
LPFVRELCRDYQHIDP

SEQ ID NO: 80029 - protein, 16 aa, Mycobacterium tuberculosis
PFVRELCRDYQHIDPV

SEQ ID NO: 80030 - protein, 16 aa, Mycobacterium tuberculosis
FVRELCRDYQHIDPVV

SEQ ID NO: 80031 - protein, 16 aa, Mycobacterium tuberculosis
VRELCRDYQHIDPVVE

SEQ ID NO: 80032 - protein, 16 aa, Mycobacterium tuberculosis
RELCRDYQHIDPVVEL

SEQ ID NO: 80033 - protein, 16 aa, Mycobacterium tuberculosis
ELCRDYQHIDPVVELV

SEQ ID NO: 80034 - protein, 16 aa, Mycobacterium tuberculosis
LCRDYQHIDPVVELVP

SEQ ID NO: 80035 - protein, 16 aa, Mycobacterium tuberculosis
CRDYQHIDPVVELVPV

SEQ ID NO: 80036 - protein, 16 aa, Mycobacterium tuberculosis
RDYQHIDPVVELVPVR

SEQ ID NO: 80037 - protein, 16 aa, Mycobacterium tuberculosis
DYQHIDPVVELVPVRP

SEQ ID NO: 80038 - protein, 16 aa, Mycobacterium tuberculosis
YQHIDPVVELVPVRPV

SEQ ID NO: 80039 - protein, 16 aa, Mycobacterium tuberculosis
QHIDPVVELVPVRPVV

SEQ ID NO: 80040 - protein, 16 aa, Mycobacterium tuberculosis
HIDPVVELVPVRPVVH

SEQ ID NO: 80041 - protein, 16 aa, Mycobacterium tuberculosis
IDPVVELVPVRPVVHY

SEQ ID NO: 80042 - protein, 16 aa, Mycobacterium tuberculosis
DPVVELVPVRPVVHYM

SEQ ID NO: 80043 - protein, 16 aa, Mycobacterium tuberculosis
PVVELVPVRPVVHYMM

SEQ ID NO: 80044 - protein, 16 aa, Mycobacterium tuberculosis
VVELVPVRPVVHYMMG

SEQ ID NO: 80045 - protein, 16 aa, Mycobacterium tuberculosis
VELVPVRPVVHYMMGG

SEQ ID NO: 80046 - protein, 16 aa, Mycobacterium tuberculosis
ELVPVRPVVHYMMGGV

SEQ ID NO: 80047 - protein, 16 aa, Mycobacterium tuberculosis
LVPVRPVVHYMMGGVH

SEQ ID NO: 80048 - protein, 16 aa, Mycobacterium tuberculosis
VPVRPVVHYMMGGVHT

SEQ ID NO: 80049 - protein, 16 aa, Mycobacterium tuberculosis
PVRPVVHYMMGGVHTD

SEQ ID NO: 80050 - protein, 16 aa, Mycobacterium tuberculosis
VRPVVHYMMGGVHTDI

SEQ ID NO: 80051 - protein, 16 aa, Mycobacterium tuberculosis
RPVVHYMMGGVHTDIN

SEQ ID NO: 80052 - protein, 16 aa, Mycobacterium tuberculosis
PVVHYMMGGVHTDING

SEQ ID NO: 80053 - protein, 16 aa, Mycobacterium tuberculosis
VVHYMMGGVHTDINGA

SEQ ID NO: 80054 - protein, 16 aa, Mycobacterium tuberculosis
VHYMMGGVHTDINGAT

SEQ ID NO: 80055 - protein, 16 aa, Mycobacterium tuberculosis
HYMMGGVHTDINGATT

SEQ ID NO: 80056 - protein, 16 aa, Mycobacterium tuberculosis
YMMGGVHTDINGATTL

SEQ ID NO: 80057 - protein, 16 aa, Mycobacterium tuberculosis
MMGGVHTDINGATTLP

SEQ ID NO: 80058 - protein, 16 aa, Mycobacterium tuberculosis
MGGVHTDINGATTLPG

SEQ ID NO: 80059 - protein, 16 aa, Mycobacterium tuberculosis
GGVHTDINGATTLPGL

SEQ ID NO: 80060 - protein, 16 aa, Mycobacterium tuberculosis
GVHTDINGATTLPGLY

SEQ ID NO: 80061 - protein, 16 aa, Mycobacterium tuberculosis
VHTDINGATTLPGLYA

SEQ ID NO: 80062 - protein, 16 aa, Mycobacterium tuberculosis
HTDINGATTLPGLYAA

SEQ ID NO: 80063 - protein, 16 aa, Mycobacterium tuberculosis
TDINGATTLPGLYAAG

SEQ ID NO: 80064 - protein, 16 aa, Mycobacterium tuberculosis
DINGATTLPGLYAAGE

SEQ ID NO: 80065 - protein, 16 aa, Mycobacterium tuberculosis
INGATTLPGLYAAGET

SEQ ID NO: 80066 - protein, 16 aa, Mycobacterium tuberculosis
NGATTLPGLYAAGETA

SEQ ID NO: 80067 - protein, 16 aa, Mycobacterium tuberculosis
GATTLPGLYAAGETAC

SEQ ID NO: 80068 - protein, 16 aa, Mycobacterium tuberculosis
ATTLPGLYAAGETACV

SEQ ID NO: 80069 - protein, 16 aa, Mycobacterium tuberculosis
TTLPGLYAAGETACVS

SEQ ID NO: 80070 - protein, 16 aa, Mycobacterium tuberculosis
TLPGLYAAGETACVSI

SEQ ID NO: 80071 - protein, 16 aa, Mycobacterium tuberculosis
LPGLYAAGETACVSIN

SEQ ID NO: 80072 - protein, 16 aa, Mycobacterium tuberculosis
PGLYAAGETACVSING

SEQ ID NO: 80073 - protein, 16 aa, Mycobacterium tuberculosis
GLYAAGETACVSINGA

SEQ ID NO: 80074 - protein, 16 aa, Mycobacterium tuberculosis
LYAAGETACVSINGAN

SEQ ID NO: 80075 - protein, 16 aa, Mycobacterium tuberculosis
YAAGETACVSINGANR

SEQ ID NO: 80076 - protein, 16 aa, Mycobacterium tuberculosis
AAGETACVSINGANRL

SEQ ID NO: 80077 - protein, 16 aa, Mycobacterium tuberculosis
AGETACVSINGANRLG

SEQ ID NO: 80078 - protein, 16 aa, Mycobacterium tuberculosis
GETACVSINGANRLGS

SEQ ID NO: 80079 - protein, 16 aa, Mycobacterium tuberculosis
ETACVSINGANRLGSN

SEQ ID NO: 80080 - protein, 16 aa, Mycobacterium tuberculosis
TACVSINGANRLGSNS

SEQ ID NO: 80081 - protein, 16 aa, Mycobacterium tuberculosis
ACVSINGANRLGSNSL

SEQ ID NO: 80082 - protein, 16 aa, Mycobacterium tuberculosis
CVSINGANRLGSNSLP

SEQ ID NO: 80083 - protein, 16 aa, Mycobacterium tuberculosis
VSINGANRLGSNSLPE

SEQ ID NO: 80084 - protein, 16 aa, Mycobacterium tuberculosis
SINGANRLGSNSLPEL

SEQ ID NO: 80085 - protein, 16 aa, Mycobacterium tuberculosis
INGANRLGSNSLPELL

SEQ ID NO: 80086 - protein, 16 aa, Mycobacterium tuberculosis
NGANRLGSNSLPELLV

SEQ ID NO: 80087 - protein, 16 aa, Mycobacterium tuberculosis
GANRLGSNSLPELLVF

SEQ ID NO: 80088 - protein, 16 aa, Mycobacterium tuberculosis
ANRLGSNSLPELLVFG

SEQ ID NO: 80089 - protein, 16 aa, Mycobacterium tuberculosis
NRLGSNSLPELLVFGA

SEQ ID NO: 80090 - protein, 16 aa, Mycobacterium tuberculosis
RLGSNSLPELLVFGAR

SEQ ID NO: 80091 - protein, 16 aa, Mycobacterium tuberculosis
LGSNSLPELLVFGARA

SEQ ID NO: 80092 - protein, 16 aa, Mycobacterium tuberculosis
GSNSLPELLVFGARAG

SEQ ID NO: 80093 - protein, 16 aa, Mycobacterium tuberculosis
SNSLPELLVFGARAGR

SEQ ID NO: 80094 - protein, 16 aa, Mycobacterium tuberculosis
NSLPELLVFGARAGRA

SEQ ID NO: 80095 - protein, 16 aa, Mycobacterium tuberculosis
SLPELLVFGARAGRAA

SEQ ID NO: 80096 - protein, 16 aa, Mycobacterium tuberculosis
LPELLVFGARAGRAAA

SEQ ID NO: 80097 - protein, 16 aa, Mycobacterium tuberculosis
PELLVFGARAGRAAAD

SEQ ID NO: 80098 - protein, 16 aa, Mycobacterium tuberculosis
ELLVFGARAGRAAADY

SEQ ID NO: 80099 - protein, 16 aa, Mycobacterium tuberculosis
LLVFGARAGRAAADYA

SEQ ID NO: 80100 - protein, 16 aa, Mycobacterium tuberculosis
LVFGARAGRAAADYAA

SEQ ID NO: 80101 - protein, 16 aa, Mycobacterium tuberculosis
VFGARAGRAAADYAAR

SEQ ID NO: 80102 - protein, 16 aa, Mycobacterium tuberculosis
FGARAGRAAADYAARH

SEQ ID NO: 80103 - protein, 16 aa, Mycobacterium tuberculosis
GARAGRAAADYAARHQ

SEQ ID NO: 80104 - protein, 16 aa, Mycobacterium tuberculosis
ARAGRAAADYAARHQK

SEQ ID NO: 80105 - protein, 16 aa, Mycobacterium tuberculosis
RAGRAAADYAARHQKS

SEQ ID NO: 80106 - protein, 16 aa, Mycobacterium tuberculosis
AGRAAADYAARHQKSD

SEQ ID NO: 80107 - protein, 16 aa, Mycobacterium tuberculosis
GRAAADYAARHQKSDR

SEQ ID NO: 80108 - protein, 16 aa, Mycobacterium tuberculosis
RAAADYAARHQKSDRG

SEQ ID NO: 80109 - protein, 16 aa, Mycobacterium tuberculosis
AAADYAARHQKSDRGP

SEQ ID NO: 80110 - protein, 16 aa, Mycobacterium tuberculosis
AADYAARHQKSDRGPS

SEQ ID NO: 80111 - protein, 16 aa, Mycobacterium tuberculosis
ADYAARHQKSDRGPSS

SEQ ID NO: 80112 - protein, 16 aa, Mycobacterium tuberculosis
DYAARHQKSDRGPSSA

SEQ ID NO: 80113 - protein, 16 aa, Mycobacterium tuberculosis
YAARHQKSDRGPSSAV

SEQ ID NO: 80114 - protein, 16 aa, Mycobacterium tuberculosis
AARHQKSDRGPSSAVR

SEQ ID NO: 80115 - protein, 16 aa, Mycobacterium tuberculosis
ARHQKSDRGPSSAVRA

SEQ ID NO: 80116 - protein, 16 aa, Mycobacterium tuberculosis
RHQKSDRGPSSAVRAQ

SEQ ID NO: 80117 - protein, 16 aa, Mycobacterium tuberculosis
HQKSDRGPSSAVRAQA

SEQ ID NO: 80118 - protein, 16 aa, Mycobacterium tuberculosis
QKSDRGPSSAVRAQAR

SEQ ID NO: 80119 - protein, 16 aa, Mycobacterium tuberculosis
KSDRGPSSAVRAQART

SEQ ID NO: 80120 - protein, 16 aa, Mycobacterium tuberculosis
SDRGPSSAVRAQARTE

SEQ ID NO: 80121 - protein, 16 aa, Mycobacterium tuberculosis
DRGPSSAVRAQARTEA

SEQ ID NO: 80122 - protein, 16 aa, Mycobacterium tuberculosis
RGPSSAVRAQARTEAL

SEQ ID NO: 80123 - protein, 16 aa, Mycobacterium tuberculosis
GPSSAVRAQARTEALR

SEQ ID NO: 80124 - protein, 16 aa, Mycobacterium tuberculosis
PSSAVRAQARTEALRL

SEQ ID NO: 80125 - protein, 16 aa, Mycobacterium tuberculosis
SSAVRAQARTEALRLE

SEQ ID NO: 80126 - protein, 16 aa, Mycobacterium tuberculosis
SAVRAQARTEALRLER

SEQ ID NO: 80127 - protein, 16 aa, Mycobacterium tuberculosis
AVRAQARTEALRLERE

SEQ ID NO: 80128 - protein, 16 aa, Mycobacterium tuberculosis
VRAQARTEALRLEREL

SEQ ID NO: 80129 - protein, 16 aa, Mycobacterium tuberculosis
RAQARTEALRLERELS

SEQ ID NO: 80130 - protein, 16 aa, Mycobacterium tuberculosis
AQARTEALRLERELSR

SEQ ID NO: 80131 - protein, 16 aa, Mycobacterium tuberculosis
QARTEALRLERELSRH

SEQ ID NO: 80132 - protein, 16 aa, Mycobacterium tuberculosis
ARTEALRLERELSRHG

SEQ ID NO: 80133 - protein, 16 aa, Mycobacterium tuberculosis
RTEALRLERELSRHGQ

SEQ ID NO: 80134 - protein, 16 aa, Mycobacterium tuberculosis
TEALRLERELSRHGQG

SEQ ID NO: 80135 - protein, 16 aa, Mycobacterium tuberculosis
EALRLERELSRHGQGG

SEQ ID NO: 80136 - protein, 16 aa, Mycobacterium tuberculosis
ALRLERELSRHGQGGE

SEQ ID NO: 80137 - protein, 16 aa, Mycobacterium tuberculosis
LRLERELSRHGQGGER

SEQ ID NO: 80138 - protein, 16 aa, Mycobacterium tuberculosis
RLERELSRHGQGGERI

SEQ ID NO: 80139 - protein, 16 aa, Mycobacterium tuberculosis
LERELSRHGQGGERIA

SEQ ID NO: 80140 - protein, 16 aa, Mycobacterium tuberculosis
ERELSRHGQGGERIAD

SEQ ID NO: 80141 - protein, 16 aa, Mycobacterium tuberculosis
RELSRHGQGGERIADI

SEQ ID NO: 80142 - protein, 16 aa, Mycobacterium tuberculosis
ELSRHGQGGERIADIR

SEQ ID NO: 80143 - protein, 16 aa, Mycobacterium tuberculosis
LSRHGQGGERIADIRA

SEQ ID NO: 80144 - protein, 16 aa, Mycobacterium tuberculosis
SRHGQGGERIADIRAD

SEQ ID NO: 80145 - protein, 16 aa, Mycobacterium tuberculosis
RHGQGGERIADIRADM

SEQ ID NO: 80146 - protein, 16 aa, Mycobacterium tuberculosis
HGQGGERIADIRADMQ

SEQ ID NO: 80147 - protein, 16 aa, Mycobacterium tuberculosis
GQGGERIADIRADMQA

SEQ ID NO: 80148 - protein, 16 aa, Mycobacterium tuberculosis
QGGERIADIRADMQAT

SEQ ID NO: 80149 - protein, 16 aa, Mycobacterium tuberculosis
GGERIADIRADMQATL

SEQ ID NO: 80150 - protein, 16 aa, Mycobacterium tuberculosis
GERIADIRADMQATLE

SEQ ID NO: 80151 - protein, 16 aa, Mycobacterium tuberculosis
ERIADIRADMQATLES

SEQ ID NO: 80152 - protein, 16 aa, Mycobacterium tuberculosis
RIADIRADMQATLESA

SEQ ID NO: 80153 - protein, 16 aa, Mycobacterium tuberculosis
IADIRADMQATLESAA

SEQ ID NO: 80154 - protein, 16 aa, Mycobacterium tuberculosis
ADIRADMQATLESAAG

SEQ ID NO: 80155 - protein, 16 aa, Mycobacterium tuberculosis
DIRADMQATLESAAGI

SEQ ID NO: 80156 - protein, 16 aa, Mycobacterium tuberculosis
IRADMQATLESAAGIY

SEQ ID NO: 80157 - protein, 16 aa, Mycobacterium tuberculosis
RADMQATLESAAGIYR

SEQ ID NO: 80158 - protein, 16 aa, Mycobacterium tuberculosis
ADMQATLESAAGIYRD

SEQ ID NO: 80159 - protein, 16 aa, Mycobacterium tuberculosis
DMQATLESAAGIYRDG

SEQ ID NO: 80160 - protein, 16 aa, Mycobacterium tuberculosis
MQATLESAAGIYRDGP

SEQ ID NO: 80161 - protein, 16 aa, Mycobacterium tuberculosis
QATLESAAGIYRDGPT

SEQ ID NO: 80162 - protein, 16 aa, Mycobacterium tuberculosis
ATLESAAGIYRDGPTL

SEQ ID NO: 80163 - protein, 16 aa, Mycobacterium tuberculosis
TLESAAGIYRDGPTLT

SEQ ID NO: 80164 - protein, 16 aa, Mycobacterium tuberculosis
LESAAGIYRDGPTLTK

SEQ ID NO: 80165 - protein, 16 aa, Mycobacterium tuberculosis
ESAAGIYRDGPTLTKA

SEQ ID NO: 80166 - protein, 16 aa, Mycobacterium tuberculosis
SAAGIYRDGPTLTKAV

SEQ ID NO: 80167 - protein, 16 aa, Mycobacterium tuberculosis
AAGIYRDGPTLTKAVE

SEQ ID NO: 80168 - protein, 16 aa, Mycobacterium tuberculosis
AGIYRDGPTLTKAVEE

SEQ ID NO: 80169 - protein, 16 aa, Mycobacterium tuberculosis
GIYRDGPTLTKAVEEI

SEQ ID NO: 80170 - protein, 16 aa, Mycobacterium tuberculosis
IYRDGPTLTKAVEEIR

SEQ ID NO: 80171 - protein, 16 aa, Mycobacterium tuberculosis
YRDGPTLTKAVEEIRV

SEQ ID NO: 80172 - protein, 16 aa, Mycobacterium tuberculosis
RDGPTLTKAVEEIRVL

SEQ ID NO: 80173 - protein, 16 aa, Mycobacterium tuberculosis
DGPTLTKAVEEIRVLQ

SEQ ID NO: 80174 - protein, 16 aa, Mycobacterium tuberculosis
GPTLTKAVEEIRVLQE

SEQ ID NO: 80175 - protein, 16 aa, Mycobacterium tuberculosis
PTLTKAVEEIRVLQER

SEQ ID NO: 80176 - protein, 16 aa, Mycobacterium tuberculosis
TLTKAVEEIRVLQERF

SEQ ID NO: 80177 - protein, 16 aa, Mycobacterium tuberculosis
LTKAVEEIRVLQERFA

SEQ ID NO: 80178 - protein, 16 aa, Mycobacterium tuberculosis
TKAVEEIRVLQERFAT

SEQ ID NO: 80179 - protein, 16 aa, Mycobacterium tuberculosis
KAVEEIRVLQERFATA

SEQ ID NO: 80180 - protein, 16 aa, Mycobacterium tuberculosis
AVEEIRVLQERFATAG

SEQ ID NO: 80181 - protein, 16 aa, Mycobacterium tuberculosis
VEEIRVLQERFATAGI

SEQ ID NO: 80182 - protein, 16 aa, Mycobacterium tuberculosis
EEIRVLQERFATAGID

SEQ ID NO: 80183 - protein, 16 aa, Mycobacterium tuberculosis
EIRVLQERFATAGIDD

SEQ ID NO: 80184 - protein, 16 aa, Mycobacterium tuberculosis
IRVLQERFATAGIDDH

SEQ ID NO: 80185 - protein, 16 aa, Mycobacterium tuberculosis
RVLQERFATAGIDDHS

SEQ ID NO: 80186 - protein, 16 aa, Mycobacterium tuberculosis
VLQERFATAGIDDHSR

SEQ ID NO: 80187 - protein, 16 aa, Mycobacterium tuberculosis
LQERFATAGIDDHSRT

SEQ ID NO: 80188 - protein, 16 aa, Mycobacterium tuberculosis
QERFATAGIDDHSRTF

SEQ ID NO: 80189 - protein, 16 aa, Mycobacterium tuberculosis
ERFATAGIDDHSRTFN

SEQ ID NO: 80190 - protein, 16 aa, Mycobacterium tuberculosis
RFATAGIDDHSRTFNT

SEQ ID NO: 80191 - protein, 16 aa, Mycobacterium tuberculosis
FATAGIDDHSRTFNTE

SEQ ID NO: 80192 - protein, 16 aa, Mycobacterium tuberculosis
ATAGIDDHSRTFNTEL

SEQ ID NO: 80193 - protein, 16 aa, Mycobacterium tuberculosis
TAGIDDHSRTFNTELT

SEQ ID NO: 80194 - protein, 16 aa, Mycobacterium tuberculosis
AGIDDHSRTFNTELTA

SEQ ID NO: 80195 - protein, 16 aa, Mycobacterium tuberculosis
GIDDHSRTFNTELTAL

SEQ ID NO: 80196 - protein, 16 aa, Mycobacterium tuberculosis
IDDHSRTFNTELTALL

SEQ ID NO: 80197 - protein, 16 aa, Mycobacterium tuberculosis
DDHSRTFNTELTALLE

SEQ ID NO: 80198 - protein, 16 aa, Mycobacterium tuberculosis
DHSRTFNTELTALLEL

SEQ ID NO: 80199 - protein, 16 aa, Mycobacterium tuberculosis
HSRTFNTELTALLELS

SEQ ID NO: 80200 - protein, 16 aa, Mycobacterium tuberculosis
SRTFNTELTALLELSG

SEQ ID NO: 80201 - protein, 16 aa, Mycobacterium tuberculosis
RTFNTELTALLELSGM

SEQ ID NO: 80202 - protein, 16 aa, Mycobacterium tuberculosis
TFNTELTALLELSGML

SEQ ID NO: 80203 - protein, 16 aa, Mycobacterium tuberculosis
FNTELTALLELSGMLD

SEQ ID NO: 80204 - protein, 16 aa, Mycobacterium tuberculosis
NTELTALLELSGMLDV

SEQ ID NO: 80205 - protein, 16 aa, Mycobacterium tuberculosis
TELTALLELSGMLDVA

SEQ ID NO: 80206 - protein, 16 aa, Mycobacterium tuberculosis
ELTALLELSGMLDVAL

SEQ ID NO: 80207 - protein, 16 aa, Mycobacterium tuberculosis
LTALLELSGMLDVALA

SEQ ID NO: 80208 - protein, 16 aa, Mycobacterium tuberculosis
TALLELSGMLDVALAI

SEQ ID NO: 80209 - protein, 16 aa, Mycobacterium tuberculosis
ALLELSGMLDVALAIV

SEQ ID NO: 80210 - protein, 16 aa, Mycobacterium tuberculosis
LLELSGMLDVALAIVE

SEQ ID NO: 80211 - protein, 16 aa, Mycobacterium tuberculosis
LELSGMLDVALAIVES

SEQ ID NO: 80212 - protein, 16 aa, Mycobacterium tuberculosis
ELSGMLDVALAIVESG

SEQ ID NO: 80213 - protein, 16 aa, Mycobacterium tuberculosis
LSGMLDVALAIVESGL

SEQ ID NO: 80214 - protein, 16 aa, Mycobacterium tuberculosis
SGMLDVALAIVESGLR

SEQ ID NO: 80215 - protein, 16 aa, Mycobacterium tuberculosis
GMLDVALAIVESGLRR

SEQ ID NO: 80216 - protein, 16 aa, Mycobacterium tuberculosis
MLDVALAIVESGLRRE

SEQ ID NO: 80217 - protein, 16 aa, Mycobacterium tuberculosis
LDVALAIVESGLRREE

SEQ ID NO: 80218 - protein, 16 aa, Mycobacterium tuberculosis
DVALAIVESGLRREES

SEQ ID NO: 80219 - protein, 16 aa, Mycobacterium tuberculosis
VALAIVESGLRREESR

SEQ ID NO: 80220 - protein, 16 aa, Mycobacterium tuberculosis
ALAIVESGLRREESRG

SEQ ID NO: 80221 - protein, 16 aa, Mycobacterium tuberculosis
LAIVESGLRREESRGA

SEQ ID NO: 80222 - protein, 16 aa, Mycobacterium tuberculosis
AIVESGLRREESRGAH

SEQ ID NO: 80223 - protein, 16 aa, Mycobacterium tuberculosis
IVESGLRREESRGAHQ

SEQ ID NO: 80224 - protein, 16 aa, Mycobacterium tuberculosis
VESGLRREESRGAHQR

SEQ ID NO: 80225 - protein, 16 aa, Mycobacterium tuberculosis
ESGLRREESRGAHQRT

SEQ ID NO: 80226 - protein, 16 aa, Mycobacterium tuberculosis
SGLRREESRGAHQRTD

SEQ ID NO: 80227 - protein, 16 aa, Mycobacterium tuberculosis
GLRREESRGAHQRTDF

SEQ ID NO: 80228 - protein, 16 aa, Mycobacterium tuberculosis
LRREESRGAHQRTDFP

SEQ ID NO: 80229 - protein, 16 aa, Mycobacterium tuberculosis
RREESRGAHQRTDFPN

SEQ ID NO: 80230 - protein, 16 aa, Mycobacterium tuberculosis
REESRGAHQRTDFPNR

SEQ ID NO: 80231 - protein, 16 aa, Mycobacterium tuberculosis
EESRGAHQRTDFPNRD

SEQ ID NO: 80232 - protein, 16 aa, Mycobacterium tuberculosis
ESRGAHQRTDFPNRDD

SEQ ID NO: 80233 - protein, 16 aa, Mycobacterium tuberculosis
SRGAHQRTDFPNRDDE

SEQ ID NO: 80234 - protein, 16 aa, Mycobacterium tuberculosis
RGAHQRTDFPNRDDEH

SEQ ID NO: 80235 - protein, 16 aa, Mycobacterium tuberculosis
GAHQRTDFPNRDDEHF

SEQ ID NO: 80236 - protein, 16 aa, Mycobacterium tuberculosis
AHQRTDFPNRDDEHFL

SEQ ID NO: 80237 - protein, 16 aa, Mycobacterium tuberculosis
HQRTDFPNRDDEHFLA

SEQ ID NO: 80238 - protein, 16 aa, Mycobacterium tuberculosis
QRTDFPNRDDEHFLAH

SEQ ID NO: 80239 - protein, 16 aa, Mycobacterium tuberculosis
RTDFPNRDDEHFLAHT

SEQ ID NO: 80240 - protein, 16 aa, Mycobacterium tuberculosis
TDFPNRDDEHFLAHTL

SEQ ID NO: 80241 - protein, 16 aa, Mycobacterium tuberculosis
DFPNRDDEHFLAHTLV

SEQ ID NO: 80242 - protein, 16 aa, Mycobacterium tuberculosis
FPNRDDEHFLAHTLVH

SEQ ID NO: 80243 - protein, 16 aa, Mycobacterium tuberculosis
PNRDDEHFLAHTLVHR

SEQ ID NO: 80244 - protein, 16 aa, Mycobacterium tuberculosis
NRDDEHFLAHTLVHRE

SEQ ID NO: 80245 - protein, 16 aa, Mycobacterium tuberculosis
RDDEHFLAHTLVHRES

SEQ ID NO: 80246 - protein, 16 aa, Mycobacterium tuberculosis
DDEHFLAHTLVHRESD

SEQ ID NO: 80247 - protein, 16 aa, Mycobacterium tuberculosis
DEHFLAHTLVHRESDG

SEQ ID NO: 80248 - protein, 16 aa, Mycobacterium tuberculosis
EHFLAHTLVHRESDGT

SEQ ID NO: 80249 - protein, 16 aa, Mycobacterium tuberculosis
HFLAHTLVHRESDGTL

SEQ ID NO: 80250 - protein, 16 aa, Mycobacterium tuberculosis
FLAHTLVHRESDGTLR

SEQ ID NO: 80251 - protein, 16 aa, Mycobacterium tuberculosis
LAHTLVHRESDGTLRV

SEQ ID NO: 80252 - protein, 16 aa, Mycobacterium tuberculosis
AHTLVHRESDGTLRVG

SEQ ID NO: 80253 - protein, 16 aa, Mycobacterium tuberculosis
HTLVHRESDGTLRVGY

SEQ ID NO: 80254 - protein, 16 aa, Mycobacterium tuberculosis
TLVHRESDGTLRVGYL

SEQ ID NO: 80255 - protein, 16 aa, Mycobacterium tuberculosis
LVHRESDGTLRVGYLP

SEQ ID NO: 80256 - protein, 16 aa, Mycobacterium tuberculosis
VHRESDGTLRVGYLPV

SEQ ID NO: 80257 - protein, 16 aa, Mycobacterium tuberculosis
HRESDGTLRVGYLPVT

SEQ ID NO: 80258 - protein, 16 aa, Mycobacterium tuberculosis
RESDGTLRVGYLPVTI

SEQ ID NO: 80259 - protein, 16 aa, Mycobacterium tuberculosis
ESDGTLRVGYLPVTIT

SEQ ID NO: 80260 - protein, 16 aa, Mycobacterium tuberculosis
SDGTLRVGYLPVTITR

SEQ ID NO: 80261 - protein, 16 aa, Mycobacterium tuberculosis
DGTLRVGYLPVTITRW

SEQ ID NO: 80262 - protein, 16 aa, Mycobacterium tuberculosis
GTLRVGYLPVTITRWP

SEQ ID NO: 80263 - protein, 16 aa, Mycobacterium tuberculosis
TLRVGYLPVTITRWPP

SEQ ID NO: 80264 - protein, 16 aa, Mycobacterium tuberculosis
LRVGYLPVTITRWPPG

SEQ ID NO: 80265 - protein, 16 aa, Mycobacterium tuberculosis
RVGYLPVTITRWPPGE

SEQ ID NO: 80266 - protein, 16 aa, Mycobacterium tuberculosis
VGYLPVTITRWPPGER

SEQ ID NO: 80267 - protein, 16 aa, Mycobacterium tuberculosis
GYLPVTITRWPPGERV

SEQ ID NO: 80268 - protein, 16 aa, Mycobacterium tuberculosis
YLPVTITRWPPGERVY

SEQ ID NO: 80269 - protein, 16 aa, Mycobacterium tuberculosis
LPVTITRWPPGERVYG

SEQ ID NO: 80270 - protein, 16 aa, Mycobacterium tuberculosis
PVTITRWPPGERVYGR

SEQ ID NO: 80271 - protein, 13 aa, Mycobacterium tuberculosis
MSVIAGVFGALPP

SEQ ID NO: 80272 - protein, 13 aa, Mycobacterium tuberculosis
SVIAGVFGALPPY

SEQ ID NO: 80273 - protein, 13 aa, Mycobacterium tuberculosis
VIAGVFGALPPYR

SEQ ID NO: 80274 - protein, 13 aa, Mycobacterium tuberculosis
IAGVFGALPPYRY

SEQ ID NO: 80275 - protein, 13 aa, Mycobacterium tuberculosis
AGVFGALPPYRYS

SEQ ID NO: 80276 - protein, 13 aa, Mycobacterium tuberculosis
GVFGALPPYRYSQ

SEQ ID NO: 80277 - protein, 13 aa, Mycobacterium tuberculosis
VFGALPPYRYSQR

SEQ ID NO: 80278 - protein, 13 aa, Mycobacterium tuberculosis
FGALPPYRYSQRE

SEQ ID NO: 80279 - protein, 13 aa, Mycobacterium tuberculosis
GALPPYRYSQREL

SEQ ID NO: 80280 - protein, 13 aa, Mycobacterium tuberculosis
ALPPYRYSQRELT

SEQ ID NO: 80281 - protein, 13 aa, Mycobacterium tuberculosis
LPPYRYSQRELTD

SEQ ID NO: 80282 - protein, 13 aa, Mycobacterium tuberculosis
PPYRYSQRELTDS

SEQ ID NO: 80283 - protein, 13 aa, Mycobacterium tuberculosis
PYRYSQRELTDSF

SEQ ID NO: 80284 - protein, 13 aa, Mycobacterium tuberculosis
YRYSQRELTDSFV

SEQ ID NO: 80285 - protein, 13 aa, Mycobacterium tuberculosis
RYSQRELTDSFVS

SEQ ID NO: 80286 - protein, 13 aa, Mycobacterium tuberculosis
YSQRELTDSFVSI

SEQ ID NO: 80287 - protein, 13 aa, Mycobacterium tuberculosis
SQRELTDSFVSIP

SEQ ID NO: 80288 - protein, 13 aa, Mycobacterium tuberculosis
QRELTDSFVSIPD

SEQ ID NO: 80289 - protein, 13 aa, Mycobacterium tuberculosis
RELTDSFVSIPDF

SEQ ID NO: 80290 - protein, 13 aa, Mycobacterium tuberculosis
ELTDSFVSIPDFE

SEQ ID NO: 80291 - protein, 13 aa, Mycobacterium tuberculosis
LTDSFVSIPDFEG

SEQ ID NO: 80292 - protein, 13 aa, Mycobacterium tuberculosis
TDSFVSIPDFEGY

SEQ ID NO: 80293 - protein, 13 aa, Mycobacterium tuberculosis
DSFVSIPDFEGYE

SEQ ID NO: 80294 - protein, 13 aa, Mycobacterium tuberculosis
SFVSIPDFEGYED

SEQ ID NO: 80295 - protein, 13 aa, Mycobacterium tuberculosis
FVSIPDFEGYEDI

SEQ ID NO: 80296 - protein, 13 aa, Mycobacterium tuberculosis
VSIPDFEGYEDIV

SEQ ID NO: 80297 - protein, 13 aa, Mycobacterium tuberculosis
SIPDFEGYEDIVR

SEQ ID NO: 80298 - protein, 13 aa, Mycobacterium tuberculosis
IPDFEGYEDIVRQ

SEQ ID NO: 80299 - protein, 13 aa, Mycobacterium tuberculosis
PDFEGYEDIVRQL

SEQ ID NO: 80300 - protein, 13 aa, Mycobacterium tuberculosis
DFEGYEDIVRQLH

SEQ ID NO: 80301 - protein, 13 aa, Mycobacterium tuberculosis
FEGYEDIVRQLHA

SEQ ID NO: 80302 - protein, 13 aa, Mycobacterium tuberculosis
EGYEDIVRQLHAS

SEQ ID NO: 80303 - protein, 13 aa, Mycobacterium tuberculosis
GYEDIVRQLHASA

SEQ ID NO: 80304 - protein, 13 aa, Mycobacterium tuberculosis
YEDIVRQLHASAK

SEQ ID NO: 80305 - protein, 13 aa, Mycobacterium tuberculosis
EDIVRQLHASAKV

SEQ ID NO: 80306 - protein, 13 aa, Mycobacterium tuberculosis
DIVRQLHASAKVN

SEQ ID NO: 80307 - protein, 13 aa, Mycobacterium tuberculosis
IVRQLHASAKVNS

SEQ ID NO: 80308 - protein, 13 aa, Mycobacterium tuberculosis
VRQLHASAKVNSR

SEQ ID NO: 80309 - protein, 13 aa, Mycobacterium tuberculosis
RQLHASAKVNSRH

SEQ ID NO: 80310 - protein, 13 aa, Mycobacterium tuberculosis
QLHASAKVNSRHL

SEQ ID NO: 80311 - protein, 13 aa, Mycobacterium tuberculosis
LHASAKVNSRHLV

SEQ ID NO: 80312 - protein, 13 aa, Mycobacterium tuberculosis
HASAKVNSRHLVL

SEQ ID NO: 80313 - protein, 13 aa, Mycobacterium tuberculosis
ASAKVNSRHLVLP

SEQ ID NO: 80314 - protein, 13 aa, Mycobacterium tuberculosis
SAKVNSRHLVLPL

SEQ ID NO: 80315 - protein, 13 aa, Mycobacterium tuberculosis
AKVNSRHLVLPLE

SEQ ID NO: 80316 - protein, 13 aa, Mycobacterium tuberculosis
KVNSRHLVLPLEK

SEQ ID NO: 80317 - protein, 13 aa, Mycobacterium tuberculosis
VNSRHLVLPLEKY

SEQ ID NO: 80318 - protein, 13 aa, Mycobacterium tuberculosis
NSRHLVLPLEKYP

SEQ ID NO: 80319 - protein, 13 aa, Mycobacterium tuberculosis
SRHLVLPLEKYPK

SEQ ID NO: 80320 - protein, 13 aa, Mycobacterium tuberculosis
RHLVLPLEKYPKL

SEQ ID NO: 80321 - protein, 13 aa, Mycobacterium tuberculosis
HLVLPLEKYPKLT

SEQ ID NO: 80322 - protein, 13 aa, Mycobacterium tuberculosis
LVLPLEKYPKLTD

SEQ ID NO: 80323 - protein, 13 aa, Mycobacterium tuberculosis
VLPLEKYPKLTDF

SEQ ID NO: 80324 - protein, 13 aa, Mycobacterium tuberculosis
LPLEKYPKLTDFG

SEQ ID NO: 80325 - protein, 13 aa, Mycobacterium tuberculosis
PLEKYPKLTDFGE

SEQ ID NO: 80326 - protein, 13 aa, Mycobacterium tuberculosis
LEKYPKLTDFGEA

SEQ ID NO: 80327 - protein, 13 aa, Mycobacterium tuberculosis
EKYPKLTDFGEAN

SEQ ID NO: 80328 - protein, 13 aa, Mycobacterium tuberculosis
KYPKLTDFGEANK

SEQ ID NO: 80329 - protein, 13 aa, Mycobacterium tuberculosis
YPKLTDFGEANKI

SEQ ID NO: 80330 - protein, 13 aa, Mycobacterium tuberculosis
PKLTDFGEANKIF

SEQ ID NO: 80331 - protein, 13 aa, Mycobacterium tuberculosis
KLTDFGEANKIFI

SEQ ID NO: 80332 - protein, 13 aa, Mycobacterium tuberculosis
LTDFGEANKIFIE

SEQ ID NO: 80333 - protein, 13 aa, Mycobacterium tuberculosis
TDFGEANKIFIEK

SEQ ID NO: 80334 - protein, 13 aa, Mycobacterium tuberculosis
DFGEANKIFIEKA

SEQ ID NO: 80335 - protein, 13 aa, Mycobacterium tuberculosis
FGEANKIFIEKAV

SEQ ID NO: 80336 - protein, 13 aa, Mycobacterium tuberculosis
GEANKIFIEKAVD

SEQ ID NO: 80337 - protein, 13 aa, Mycobacterium tuberculosis
EANKIFIEKAVDL

SEQ ID NO: 80338 - protein, 13 aa, Mycobacterium tuberculosis
ANKIFIEKAVDLG

SEQ ID NO: 80339 - protein, 13 aa, Mycobacterium tuberculosis
NKIFIEKAVDLGV

SEQ ID NO: 80340 - protein, 13 aa, Mycobacterium tuberculosis
KIFIEKAVDLGVQ

SEQ ID NO: 80341 - protein, 13 aa, Mycobacterium tuberculosis
IFIEKAVDLGVQA

SEQ ID NO: 80342 - protein, 13 aa, Mycobacterium tuberculosis
FIEKAVDLGVQAL

SEQ ID NO: 80343 - protein, 13 aa, Mycobacterium tuberculosis
IEKAVDLGVQALA

SEQ ID NO: 80344 - protein, 13 aa, Mycobacterium tuberculosis
EKAVDLGVQALAG

SEQ ID NO: 80345 - protein, 13 aa, Mycobacterium tuberculosis
KAVDLGVQALAGA

SEQ ID NO: 80346 - protein, 13 aa, Mycobacterium tuberculosis
AVDLGVQALAGAL

SEQ ID NO: 80347 - protein, 13 aa, Mycobacterium tuberculosis
VDLGVQALAGALD

SEQ ID NO: 80348 - protein, 13 aa, Mycobacterium tuberculosis
DLGVQALAGALDE

SEQ ID NO: 80349 - protein, 13 aa, Mycobacterium tuberculosis
LGVQALAGALDES

SEQ ID NO: 80350 - protein, 13 aa, Mycobacterium tuberculosis
GVQALAGALDESG

SEQ ID NO: 80351 - protein, 13 aa, Mycobacterium tuberculosis
VQALAGALDESGL

SEQ ID NO: 80352 - protein, 13 aa, Mycobacterium tuberculosis
QALAGALDESGLR

SEQ ID NO: 80353 - protein, 13 aa, Mycobacterium tuberculosis
ALAGALDESGLRP

SEQ ID NO: 80354 - protein, 13 aa, Mycobacterium tuberculosis
LAGALDESGLRPE

SEQ ID NO: 80355 - protein, 13 aa, Mycobacterium tuberculosis
AGALDESGLRPED

SEQ ID NO: 80356 - protein, 13 aa, Mycobacterium tuberculosis
GALDESGLRPEDL

SEQ ID NO: 80357 - protein, 13 aa, Mycobacterium tuberculosis
ALDESGLRPEDLD

SEQ ID NO: 80358 - protein, 13 aa, Mycobacterium tuberculosis
LDESGLRPEDLDV

SEQ ID NO: 80359 - protein, 13 aa, Mycobacterium tuberculosis
DESGLRPEDLDVL

SEQ ID NO: 80360 - protein, 13 aa, Mycobacterium tuberculosis
ESGLRPEDLDVLI

SEQ ID NO: 80361 - protein, 13 aa, Mycobacterium tuberculosis
SGLRPEDLDVLIT

SEQ ID NO: 80362 - protein, 13 aa, Mycobacterium tuberculosis
GLRPEDLDVLITA

SEQ ID NO: 80363 - protein, 13 aa, Mycobacterium tuberculosis
LRPEDLDVLITAT

SEQ ID NO: 80364 - protein, 13 aa, Mycobacterium tuberculosis
RPEDLDVLITATV

SEQ ID NO: 80365 - protein, 13 aa, Mycobacterium tuberculosis
PEDLDVLITATVT

SEQ ID NO: 80366 - protein, 13 aa, Mycobacterium tuberculosis
EDLDVLITATVTG

SEQ ID NO: 80367 - protein, 13 aa, Mycobacterium tuberculosis
DLDVLITATVTGL

SEQ ID NO: 80368 - protein, 13 aa, Mycobacterium tuberculosis
LDVLITATVTGLA

SEQ ID NO: 80369 - protein, 13 aa, Mycobacterium tuberculosis
DVLITATVTGLAV

SEQ ID NO: 80370 - protein, 13 aa, Mycobacterium tuberculosis
VLITATVTGLAVP

SEQ ID NO: 80371 - protein, 13 aa, Mycobacterium tuberculosis
LITATVTGLAVPS

SEQ ID NO: 80372 - protein, 13 aa, Mycobacterium tuberculosis
ITATVTGLAVPSL

SEQ ID NO: 80373 - protein, 13 aa, Mycobacterium tuberculosis
TATVTGLAVPSLD

SEQ ID NO: 80374 - protein, 13 aa, Mycobacterium tuberculosis
ATVTGLAVPSLDA

SEQ ID NO: 80375 - protein, 13 aa, Mycobacterium tuberculosis
TVTGLAVPSLDAR

SEQ ID NO: 80376 - protein, 13 aa, Mycobacterium tuberculosis
VTGLAVPSLDARI

SEQ ID NO: 80377 - protein, 13 aa, Mycobacterium tuberculosis
TGLAVPSLDARIA

SEQ ID NO: 80378 - protein, 13 aa, Mycobacterium tuberculosis
GLAVPSLDARIAG

SEQ ID NO: 80379 - protein, 13 aa, Mycobacterium tuberculosis
LAVPSLDARIAGR

SEQ ID NO: 80380 - protein, 13 aa, Mycobacterium tuberculosis
AVPSLDARIAGRL

SEQ ID NO: 80381 - protein, 13 aa, Mycobacterium tuberculosis
VPSLDARIAGRLG

SEQ ID NO: 80382 - protein, 13 aa, Mycobacterium tuberculosis
PSLDARIAGRLGL

SEQ ID NO: 80383 - protein, 13 aa, Mycobacterium tuberculosis
SLDARIAGRLGLR

SEQ ID NO: 80384 - protein, 13 aa, Mycobacterium tuberculosis
LDARIAGRLGLRA

SEQ ID NO: 80385 - protein, 13 aa, Mycobacterium tuberculosis
DARIAGRLGLRAD

SEQ ID NO: 80386 - protein, 13 aa, Mycobacterium tuberculosis
ARIAGRLGLRADV

SEQ ID NO: 80387 - protein, 13 aa, Mycobacterium tuberculosis
RIAGRLGLRADVR

SEQ ID NO: 80388 - protein, 13 aa, Mycobacterium tuberculosis
IAGRLGLRADVRR

SEQ ID NO: 80389 - protein, 13 aa, Mycobacterium tuberculosis
AGRLGLRADVRRV

SEQ ID NO: 80390 - protein, 13 aa, Mycobacterium tuberculosis
GRLGLRADVRRVP

SEQ ID NO: 80391 - protein, 13 aa, Mycobacterium tuberculosis
RLGLRADVRRVPL

SEQ ID NO: 80392 - protein, 13 aa, Mycobacterium tuberculosis
LGLRADVRRVPLF

SEQ ID NO: 80393 - protein, 13 aa, Mycobacterium tuberculosis
GLRADVRRVPLFG

SEQ ID NO: 80394 - protein, 13 aa, Mycobacterium tuberculosis
LRADVRRVPLFGL

SEQ ID NO: 80395 - protein, 13 aa, Mycobacterium tuberculosis
RADVRRVPLFGLG

SEQ ID NO: 80396 - protein, 13 aa, Mycobacterium tuberculosis
ADVRRVPLFGLGC

SEQ ID NO: 80397 - protein, 13 aa, Mycobacterium tuberculosis
DVRRVPLFGLGCV

SEQ ID NO: 80398 - protein, 13 aa, Mycobacterium tuberculosis
VRRVPLFGLGCVA

SEQ ID NO: 80399 - protein, 13 aa, Mycobacterium tuberculosis
RRVPLFGLGCVAG

SEQ ID NO: 80400 - protein, 13 aa, Mycobacterium tuberculosis
RVPLFGLGCVAGA

SEQ ID NO: 80401 - protein, 13 aa, Mycobacterium tuberculosis
VPLFGLGCVAGAA

SEQ ID NO: 80402 - protein, 13 aa, Mycobacterium tuberculosis
PLFGLGCVAGAAG

SEQ ID NO: 80403 - protein, 13 aa, Mycobacterium tuberculosis
LFGLGCVAGAAGV

SEQ ID NO: 80404 - protein, 13 aa, Mycobacterium tuberculosis
FGLGCVAGAAGVA

SEQ ID NO: 80405 - protein, 13 aa, Mycobacterium tuberculosis
GLGCVAGAAGVAR

SEQ ID NO: 80406 - protein, 13 aa, Mycobacterium tuberculosis
LGCVAGAAGVARL

SEQ ID NO: 80407 - protein, 13 aa, Mycobacterium tuberculosis
GCVAGAAGVARLH

SEQ ID NO: 80408 - protein, 13 aa, Mycobacterium tuberculosis
CVAGAAGVARLHD

SEQ ID NO: 80409 - protein, 13 aa, Mycobacterium tuberculosis
VAGAAGVARLHDY

SEQ ID NO: 80410 - protein, 13 aa, Mycobacterium tuberculosis
AGAAGVARLHDYL

SEQ ID NO: 80411 - protein, 13 aa, Mycobacterium tuberculosis
GAAGVARLHDYLR

SEQ ID NO: 80412 - protein, 13 aa, Mycobacterium tuberculosis
AAGVARLHDYLRG

SEQ ID NO: 80413 - protein, 13 aa, Mycobacterium tuberculosis
AGVARLHDYLRGA

SEQ ID NO: 80414 - protein, 13 aa, Mycobacterium tuberculosis
GVARLHDYLRGAP

SEQ ID NO: 80415 - protein, 13 aa, Mycobacterium tuberculosis
VARLHDYLRGAPD

SEQ ID NO: 80416 - protein, 13 aa, Mycobacterium tuberculosis
ARLHDYLRGAPDG

SEQ ID NO: 80417 - protein, 13 aa, Mycobacterium tuberculosis
RLHDYLRGAPDGV

SEQ ID NO: 80418 - protein, 13 aa, Mycobacterium tuberculosis
LHDYLRGAPDGVA

SEQ ID NO: 80419 - protein, 13 aa, Mycobacterium tuberculosis
HDYLRGAPDGVAA

SEQ ID NO: 80420 - protein, 13 aa, Mycobacterium tuberculosis
DYLRGAPDGVAAL

SEQ ID NO: 80421 - protein, 13 aa, Mycobacterium tuberculosis
YLRGAPDGVAALV

SEQ ID NO: 80422 - protein, 13 aa, Mycobacterium tuberculosis
LRGAPDGVAALVS

SEQ ID NO: 80423 - protein, 13 aa, Mycobacterium tuberculosis
RGAPDGVAALVSV

SEQ ID NO: 80424 - protein, 13 aa, Mycobacterium tuberculosis
GAPDGVAALVSVE

SEQ ID NO: 80425 - protein, 13 aa, Mycobacterium tuberculosis
APDGVAALVSVEL

SEQ ID NO: 80426 - protein, 13 aa, Mycobacterium tuberculosis
PDGVAALVSVELC

SEQ ID NO: 80427 - protein, 13 aa, Mycobacterium tuberculosis
DGVAALVSVELCS

SEQ ID NO: 80428 - protein, 13 aa, Mycobacterium tuberculosis
GVAALVSVELCSL

SEQ ID NO: 80429 - protein, 13 aa, Mycobacterium tuberculosis
VAALVSVELCSLT

SEQ ID NO: 80430 - protein, 13 aa, Mycobacterium tuberculosis
AALVSVELCSLTY

SEQ ID NO: 80431 - protein, 13 aa, Mycobacterium tuberculosis
ALVSVELCSLTYP

SEQ ID NO: 80432 - protein, 13 aa, Mycobacterium tuberculosis
LVSVELCSLTYPG

SEQ ID NO: 80433 - protein, 13 aa, Mycobacterium tuberculosis
VSVELCSLTYPGY

SEQ ID NO: 80434 - protein, 13 aa, Mycobacterium tuberculosis
SVELCSLTYPGYK

SEQ ID NO: 80435 - protein, 13 aa, Mycobacterium tuberculosis
VELCSLTYPGYKP

SEQ ID NO: 80436 - protein, 13 aa, Mycobacterium tuberculosis
ELCSLTYPGYKPT

SEQ ID NO: 80437 - protein, 13 aa, Mycobacterium tuberculosis
LCSLTYPGYKPTL

SEQ ID NO: 80438 - protein, 13 aa, Mycobacterium tuberculosis
CSLTYPGYKPTLP

SEQ ID NO: 80439 - protein, 13 aa, Mycobacterium tuberculosis
SLTYPGYKPTLPG

SEQ ID NO: 80440 - protein, 13 aa, Mycobacterium tuberculosis
LTYPGYKPTLPGL

SEQ ID NO: 80441 - protein, 13 aa, Mycobacterium tuberculosis
TYPGYKPTLPGLV

SEQ ID NO: 80442 - protein, 13 aa, Mycobacterium tuberculosis
YPGYKPTLPGLVG

SEQ ID NO: 80443 - protein, 13 aa, Mycobacterium tuberculosis
PGYKPTLPGLVGS

SEQ ID NO: 80444 - protein, 13 aa, Mycobacterium tuberculosis
GYKPTLPGLVGSA

SEQ ID NO: 80445 - protein, 13 aa, Mycobacterium tuberculosis
YKPTLPGLVGSAL

SEQ ID NO: 80446 - protein, 13 aa, Mycobacterium tuberculosis
KPTLPGLVGSALF

SEQ ID NO: 80447 - protein, 13 aa, Mycobacterium tuberculosis
PTLPGLVGSALFA

SEQ ID NO: 80448 - protein, 13 aa, Mycobacterium tuberculosis
TLPGLVGSALFAD

SEQ ID NO: 80449 - protein, 13 aa, Mycobacterium tuberculosis
LPGLVGSALFADG

SEQ ID NO: 80450 - protein, 13 aa, Mycobacterium tuberculosis
PGLVGSALFADGA

SEQ ID NO: 80451 - protein, 13 aa, Mycobacterium tuberculosis
GLVGSALFADGAA

SEQ ID NO: 80452 - protein, 13 aa, Mycobacterium tuberculosis
LVGSALFADGAAA

SEQ ID NO: 80453 - protein, 13 aa, Mycobacterium tuberculosis
VGSALFADGAAAV

SEQ ID NO: 80454 - protein, 13 aa, Mycobacterium tuberculosis
GSALFADGAAAVV

SEQ ID NO: 80455 - protein, 13 aa, Mycobacterium tuberculosis
SALFADGAAAVVA

SEQ ID NO: 80456 - protein, 13 aa, Mycobacterium tuberculosis
ALFADGAAAVVAA

SEQ ID NO: 80457 - protein, 13 aa, Mycobacterium tuberculosis
LFADGAAAVVAAG

SEQ ID NO: 80458 - protein, 13 aa, Mycobacterium tuberculosis
FADGAAAVVAAGV

SEQ ID NO: 80459 - protein, 13 aa, Mycobacterium tuberculosis
ADGAAAVVAAGVK

SEQ ID NO: 80460 - protein, 13 aa, Mycobacterium tuberculosis
DGAAAVVAAGVKR

SEQ ID NO: 80461 - protein, 13 aa, Mycobacterium tuberculosis
GAAAVVAAGVKRA

SEQ ID NO: 80462 - protein, 13 aa, Mycobacterium tuberculosis
AAAVVAAGVKRAQ

SEQ ID NO: 80463 - protein, 13 aa, Mycobacterium tuberculosis
AAVVAAGVKRAQD

SEQ ID NO: 80464 - protein, 13 aa, Mycobacterium tuberculosis
AVVAAGVKRAQDI

SEQ ID NO: 80465 - protein, 13 aa, Mycobacterium tuberculosis
VVAAGVKRAQDIG

SEQ ID NO: 80466 - protein, 13 aa, Mycobacterium tuberculosis
VAAGVKRAQDIGA

SEQ ID NO: 80467 - protein, 13 aa, Mycobacterium tuberculosis
AAGVKRAQDIGAD

SEQ ID NO: 80468 - protein, 13 aa, Mycobacterium tuberculosis
AGVKRAQDIGADG

SEQ ID NO: 80469 - protein, 13 aa, Mycobacterium tuberculosis
GVKRAQDIGADGP

SEQ ID NO: 80470 - protein, 13 aa, Mycobacterium tuberculosis
VKRAQDIGADGPD

SEQ ID NO: 80471 - protein, 13 aa, Mycobacterium tuberculosis
KRAQDIGADGPDI

SEQ ID NO: 80472 - protein, 13 aa, Mycobacterium tuberculosis
RAQDIGADGPDIL

SEQ ID NO: 80473 - protein, 13 aa, Mycobacterium tuberculosis
AQDIGADGPDILD

SEQ ID NO: 80474 - protein, 13 aa, Mycobacterium tuberculosis
QDIGADGPDILDS

SEQ ID NO: 80475 - protein, 13 aa, Mycobacterium tuberculosis
DIGADGPDILDSR

SEQ ID NO: 80476 - protein, 13 aa, Mycobacterium tuberculosis
IGADGPDILDSRS

SEQ ID NO: 80477 - protein, 13 aa, Mycobacterium tuberculosis
GADGPDILDSRSH

SEQ ID NO: 80478 - protein, 13 aa, Mycobacterium tuberculosis
ADGPDILDSRSHL

SEQ ID NO: 80479 - protein, 13 aa, Mycobacterium tuberculosis
DGPDILDSRSHLY

SEQ ID NO: 80480 - protein, 13 aa, Mycobacterium tuberculosis
GPDILDSRSHLYP

SEQ ID NO: 80481 - protein, 13 aa, Mycobacterium tuberculosis
PDILDSRSHLYPD

SEQ ID NO: 80482 - protein, 13 aa, Mycobacterium tuberculosis
DILDSRSHLYPDS

SEQ ID NO: 80483 - protein, 13 aa, Mycobacterium tuberculosis
ILDSRSHLYPDSL

SEQ ID NO: 80484 - protein, 13 aa, Mycobacterium tuberculosis
LDSRSHLYPDSLR

SEQ ID NO: 80485 - protein, 13 aa, Mycobacterium tuberculosis
DSRSHLYPDSLRT

SEQ ID NO: 80486 - protein, 13 aa, Mycobacterium tuberculosis
SRSHLYPDSLRTM

SEQ ID NO: 80487 - protein, 13 aa, Mycobacterium tuberculosis
RSHLYPDSLRTMG

SEQ ID NO: 80488 - protein, 13 aa, Mycobacterium tuberculosis
SHLYPDSLRTMGY

SEQ ID NO: 80489 - protein, 13 aa, Mycobacterium tuberculosis
HLYPDSLRTMGYD

SEQ ID NO: 80490 - protein, 13 aa, Mycobacterium tuberculosis
LYPDSLRTMGYDV

SEQ ID NO: 80491 - protein, 13 aa, Mycobacterium tuberculosis
YPDSLRTMGYDVG

SEQ ID NO: 80492 - protein, 13 aa, Mycobacterium tuberculosis
PDSLRTMGYDVGS

SEQ ID NO: 80493 - protein, 13 aa, Mycobacterium tuberculosis
DSLRTMGYDVGSA

SEQ ID NO: 80494 - protein, 13 aa, Mycobacterium tuberculosis
SLRTMGYDVGSAG

SEQ ID NO: 80495 - protein, 13 aa, Mycobacterium tuberculosis
LRTMGYDVGSAGF

SEQ ID NO: 80496 - protein, 13 aa, Mycobacterium tuberculosis
RTMGYDVGSAGFE

SEQ ID NO: 80497 - protein, 13 aa, Mycobacterium tuberculosis
TMGYDVGSAGFEL

SEQ ID NO: 80498 - protein, 13 aa, Mycobacterium tuberculosis
MGYDVGSAGFELV

SEQ ID NO: 80499 - protein, 13 aa, Mycobacterium tuberculosis
GYDVGSAGFELVL

SEQ ID NO: 80500 - protein, 13 aa, Mycobacterium tuberculosis
YDVGSAGFELVLS

SEQ ID NO: 80501 - protein, 13 aa, Mycobacterium tuberculosis
DVGSAGFELVLSR

SEQ ID NO: 80502 - protein, 13 aa, Mycobacterium tuberculosis
VGSAGFELVLSRD

SEQ ID NO: 80503 - protein, 13 aa, Mycobacterium tuberculosis
GSAGFELVLSRDL

SEQ ID NO: 80504 - protein, 13 aa, Mycobacterium tuberculosis
SAGFELVLSRDLA

SEQ ID NO: 80505 - protein, 13 aa, Mycobacterium tuberculosis
AGFELVLSRDLAA

SEQ ID NO: 80506 - protein, 13 aa, Mycobacterium tuberculosis
GFELVLSRDLAAV

SEQ ID NO: 80507 - protein, 13 aa, Mycobacterium tuberculosis
FELVLSRDLAAVV

SEQ ID NO: 80508 - protein, 13 aa, Mycobacterium tuberculosis
ELVLSRDLAAVVE

SEQ ID NO: 80509 - protein, 13 aa, Mycobacterium tuberculosis
LVLSRDLAAVVEQ

SEQ ID NO: 80510 - protein, 13 aa, Mycobacterium tuberculosis
VLSRDLAAVVEQY

SEQ ID NO: 80511 - protein, 13 aa, Mycobacterium tuberculosis
LSRDLAAVVEQYL

SEQ ID NO: 80512 - protein, 13 aa, Mycobacterium tuberculosis
SRDLAAVVEQYLG

SEQ ID NO: 80513 - protein, 13 aa, Mycobacterium tuberculosis
RDLAAVVEQYLGN

SEQ ID NO: 80514 - protein, 13 aa, Mycobacterium tuberculosis
DLAAVVEQYLGND

SEQ ID NO: 80515 - protein, 13 aa, Mycobacterium tuberculosis
LAAVVEQYLGNDV

SEQ ID NO: 80516 - protein, 13 aa, Mycobacterium tuberculosis
AAVVEQYLGNDVT

SEQ ID NO: 80517 - protein, 13 aa, Mycobacterium tuberculosis
AVVEQYLGNDVTT

SEQ ID NO: 80518 - protein, 13 aa, Mycobacterium tuberculosis
VVEQYLGNDVTTF

SEQ ID NO: 80519 - protein, 13 aa, Mycobacterium tuberculosis
VEQYLGNDVTTFL

SEQ ID NO: 80520 - protein, 13 aa, Mycobacterium tuberculosis
EQYLGNDVTTFLA

SEQ ID NO: 80521 - protein, 13 aa, Mycobacterium tuberculosis
QYLGNDVTTFLAS

SEQ ID NO: 80522 - protein, 13 aa, Mycobacterium tuberculosis
YLGNDVTTFLASH

SEQ ID NO: 80523 - protein, 13 aa, Mycobacterium tuberculosis
LGNDVTTFLASHG

SEQ ID NO: 80524 - protein, 13 aa, Mycobacterium tuberculosis
GNDVTTFLASHGL

SEQ ID NO: 80525 - protein, 13 aa, Mycobacterium tuberculosis
NDVTTFLASHGLS

SEQ ID NO: 80526 - protein, 13 aa, Mycobacterium tuberculosis
DVTTFLASHGLST

SEQ ID NO: 80527 - protein, 13 aa, Mycobacterium tuberculosis
VTTFLASHGLSTT

SEQ ID NO: 80528 - protein, 13 aa, Mycobacterium tuberculosis
TTFLASHGLSTTD

SEQ ID NO: 80529 - protein, 13 aa, Mycobacterium tuberculosis
TFLASHGLSTTDV

SEQ ID NO: 80530 - protein, 13 aa, Mycobacterium tuberculosis
FLASHGLSTTDVG

SEQ ID NO: 80531 - protein, 13 aa, Mycobacterium tuberculosis
LASHGLSTTDVGA

SEQ ID NO: 80532 - protein, 13 aa, Mycobacterium tuberculosis
ASHGLSTTDVGAW

SEQ ID NO: 80533 - protein, 13 aa, Mycobacterium tuberculosis
SHGLSTTDVGAWV

SEQ ID NO: 80534 - protein, 13 aa, Mycobacterium tuberculosis
HGLSTTDVGAWVT

SEQ ID NO: 80535 - protein, 13 aa, Mycobacterium tuberculosis
GLSTTDVGAWVTH

SEQ ID NO: 80536 - protein, 13 aa, Mycobacterium tuberculosis
LSTTDVGAWVTHP

SEQ ID NO: 80537 - protein, 13 aa, Mycobacterium tuberculosis
STTDVGAWVTHPG

SEQ ID NO: 80538 - protein, 13 aa, Mycobacterium tuberculosis
TTDVGAWVTHPGG

SEQ ID NO: 80539 - protein, 13 aa, Mycobacterium tuberculosis
TDVGAWVTHPGGP

SEQ ID NO: 80540 - protein, 13 aa, Mycobacterium tuberculosis
DVGAWVTHPGGPK

SEQ ID NO: 80541 - protein, 13 aa, Mycobacterium tuberculosis
VGAWVTHPGGPKI

SEQ ID NO: 80542 - protein, 13 aa, Mycobacterium tuberculosis
GAWVTHPGGPKII

SEQ ID NO: 80543 - protein, 13 aa, Mycobacterium tuberculosis
AWVTHPGGPKIIN

SEQ ID NO: 80544 - protein, 13 aa, Mycobacterium tuberculosis
WVTHPGGPKIINA

SEQ ID NO: 80545 - protein, 13 aa, Mycobacterium tuberculosis
VTHPGGPKIINAI

SEQ ID NO: 80546 - protein, 13 aa, Mycobacterium tuberculosis
THPGGPKIINAIT

SEQ ID NO: 80547 - protein, 13 aa, Mycobacterium tuberculosis
HPGGPKIINAITE

SEQ ID NO: 80548 - protein, 13 aa, Mycobacterium tuberculosis
PGGPKIINAITET

SEQ ID NO: 80549 - protein, 13 aa, Mycobacterium tuberculosis
GGPKIINAITETL

SEQ ID NO: 80550 - protein, 13 aa, Mycobacterium tuberculosis
GPKIINAITETLD

SEQ ID NO: 80551 - protein, 13 aa, Mycobacterium tuberculosis
PKIINAITETLDL

SEQ ID NO: 80552 - protein, 13 aa, Mycobacterium tuberculosis
KIINAITETLDLS

SEQ ID NO: 80553 - protein, 13 aa, Mycobacterium tuberculosis
IINAITETLDLSP

SEQ ID NO: 80554 - protein, 13 aa, Mycobacterium tuberculosis
INAITETLDLSPQ

SEQ ID NO: 80555 - protein, 13 aa, Mycobacterium tuberculosis
NAITETLDLSPQA

SEQ ID NO: 80556 - protein, 13 aa, Mycobacterium tuberculosis
AITETLDLSPQAL

SEQ ID NO: 80557 - protein, 13 aa, Mycobacterium tuberculosis
ITETLDLSPQALE

SEQ ID NO: 80558 - protein, 13 aa, Mycobacterium tuberculosis
TETLDLSPQALEL

SEQ ID NO: 80559 - protein, 13 aa, Mycobacterium tuberculosis
ETLDLSPQALELT

SEQ ID NO: 80560 - protein, 13 aa, Mycobacterium tuberculosis
TLDLSPQALELTW

SEQ ID NO: 80561 - protein, 13 aa, Mycobacterium tuberculosis
LDLSPQALELTWR

SEQ ID NO: 80562 - protein, 13 aa, Mycobacterium tuberculosis
DLSPQALELTWRS

SEQ ID NO: 80563 - protein, 13 aa, Mycobacterium tuberculosis
LSPQALELTWRSL

SEQ ID NO: 80564 - protein, 13 aa, Mycobacterium tuberculosis
SPQALELTWRSLG

SEQ ID NO: 80565 - protein, 13 aa, Mycobacterium tuberculosis
PQALELTWRSLGE

SEQ ID NO: 80566 - protein, 13 aa, Mycobacterium tuberculosis
QALELTWRSLGEI

SEQ ID NO: 80567 - protein, 13 aa, Mycobacterium tuberculosis
ALELTWRSLGEIG

SEQ ID NO: 80568 - protein, 13 aa, Mycobacterium tuberculosis
LELTWRSLGEIGN

SEQ ID NO: 80569 - protein, 13 aa, Mycobacterium tuberculosis
ELTWRSLGEIGNL

SEQ ID NO: 80570 - protein, 13 aa, Mycobacterium tuberculosis
LTWRSLGEIGNLS

SEQ ID NO: 80571 - protein, 13 aa, Mycobacterium tuberculosis
TWRSLGEIGNLSS

SEQ ID NO: 80572 - protein, 13 aa, Mycobacterium tuberculosis
WRSLGEIGNLSSA

SEQ ID NO: 80573 - protein, 13 aa, Mycobacterium tuberculosis
RSLGEIGNLSSAS

SEQ ID NO: 80574 - protein, 13 aa, Mycobacterium tuberculosis
SLGEIGNLSSASV

SEQ ID NO: 80575 - protein, 13 aa, Mycobacterium tuberculosis
LGEIGNLSSASVL

SEQ ID NO: 80576 - protein, 13 aa, Mycobacterium tuberculosis
GEIGNLSSASVLH

SEQ ID NO: 80577 - protein, 13 aa, Mycobacterium tuberculosis
EIGNLSSASVLHV

SEQ ID NO: 80578 - protein, 13 aa, Mycobacterium tuberculosis
IGNLSSASVLHVL

SEQ ID NO: 80579 - protein, 13 aa, Mycobacterium tuberculosis
GNLSSASVLHVLR

SEQ ID NO: 80580 - protein, 13 aa, Mycobacterium tuberculosis
NLSSASVLHVLRD

SEQ ID NO: 80581 - protein, 13 aa, Mycobacterium tuberculosis
LSSASVLHVLRDT

SEQ ID NO: 80582 - protein, 13 aa, Mycobacterium tuberculosis
SSASVLHVLRDTI

SEQ ID NO: 80583 - protein, 13 aa, Mycobacterium tuberculosis
SASVLHVLRDTIA

SEQ ID NO: 80584 - protein, 13 aa, Mycobacterium tuberculosis
ASVLHVLRDTIAK

SEQ ID NO: 80585 - protein, 13 aa, Mycobacterium tuberculosis
SVLHVLRDTIAKP

SEQ ID NO: 80586 - protein, 13 aa, Mycobacterium tuberculosis
VLHVLRDTIAKPP

SEQ ID NO: 80587 - protein, 13 aa, Mycobacterium tuberculosis
LHVLRDTIAKPPP

SEQ ID NO: 80588 - protein, 13 aa, Mycobacterium tuberculosis
HVLRDTIAKPPPS

SEQ ID NO: 80589 - protein, 13 aa, Mycobacterium tuberculosis
VLRDTIAKPPPSG

SEQ ID NO: 80590 - protein, 13 aa, Mycobacterium tuberculosis
LRDTIAKPPPSGS

SEQ ID NO: 80591 - protein, 13 aa, Mycobacterium tuberculosis
RDTIAKPPPSGSP

SEQ ID NO: 80592 - protein, 13 aa, Mycobacterium tuberculosis
DTIAKPPPSGSPG

SEQ ID NO: 80593 - protein, 13 aa, Mycobacterium tuberculosis
TIAKPPPSGSPGL

SEQ ID NO: 80594 - protein, 13 aa, Mycobacterium tuberculosis
IAKPPPSGSPGLM

SEQ ID NO: 80595 - protein, 13 aa, Mycobacterium tuberculosis
AKPPPSGSPGLMI

SEQ ID NO: 80596 - protein, 13 aa, Mycobacterium tuberculosis
KPPPSGSPGLMIA

SEQ ID NO: 80597 - protein, 13 aa, Mycobacterium tuberculosis
PPPSGSPGLMIAM

SEQ ID NO: 80598 - protein, 13 aa, Mycobacterium tuberculosis
PPSGSPGLMIAMG

SEQ ID NO: 80599 - protein, 13 aa, Mycobacterium tuberculosis
PSGSPGLMIAMGP

SEQ ID NO: 80600 - protein, 13 aa, Mycobacterium tuberculosis
SGSPGLMIAMGPG

SEQ ID NO: 80601 - protein, 13 aa, Mycobacterium tuberculosis
GSPGLMIAMGPGF

SEQ ID NO: 80602 - protein, 13 aa, Mycobacterium tuberculosis
SPGLMIAMGPGFC

SEQ ID NO: 80603 - protein, 13 aa, Mycobacterium tuberculosis
PGLMIAMGPGFCS

SEQ ID NO: 80604 - protein, 13 aa, Mycobacterium tuberculosis
GLMIAMGPGFCSE

SEQ ID NO: 80605 - protein, 13 aa, Mycobacterium tuberculosis
LMIAMGPGFCSEL

SEQ ID NO: 80606 - protein, 13 aa, Mycobacterium tuberculosis
MIAMGPGFCSELV

SEQ ID NO: 80607 - protein, 13 aa, Mycobacterium tuberculosis
IAMGPGFCSELVL

SEQ ID NO: 80608 - protein, 13 aa, Mycobacterium tuberculosis
AMGPGFCSELVLL

SEQ ID NO: 80609 - protein, 13 aa, Mycobacterium tuberculosis
MGPGFCSELVLLR

SEQ ID NO: 80610 - protein, 13 aa, Mycobacterium tuberculosis
GPGFCSELVLLRW

SEQ ID NO: 80611 - protein, 13 aa, Mycobacterium tuberculosis
PGFCSELVLLRWH

SEQ ID NO: 80612 - protein, 14 aa, Mycobacterium tuberculosis
MSVIAGVFGALPPY

SEQ ID NO: 80613 - protein, 14 aa, Mycobacterium tuberculosis
SVIAGVFGALPPYR

SEQ ID NO: 80614 - protein, 14 aa, Mycobacterium tuberculosis
VIAGVFGALPPYRY

SEQ ID NO: 80615 - protein, 14 aa, Mycobacterium tuberculosis
IAGVFGALPPYRYS

SEQ ID NO: 80616 - protein, 14 aa, Mycobacterium tuberculosis
AGVFGALPPYRYSQ

SEQ ID NO: 80617 - protein, 14 aa, Mycobacterium tuberculosis
GVFGALPPYRYSQR

SEQ ID NO: 80618 - protein, 14 aa, Mycobacterium tuberculosis
VFGALPPYRYSQRE

SEQ ID NO: 80619 - protein, 14 aa, Mycobacterium tuberculosis
FGALPPYRYSQREL

SEQ ID NO: 80620 - protein, 14 aa, Mycobacterium tuberculosis
GALPPYRYSQRELT

SEQ ID NO: 80621 - protein, 14 aa, Mycobacterium tuberculosis
ALPPYRYSQRELTD

SEQ ID NO: 80622 - protein, 14 aa, Mycobacterium tuberculosis
LPPYRYSQRELTDS

SEQ ID NO: 80623 - protein, 14 aa, Mycobacterium tuberculosis
PPYRYSQRELTDSF

SEQ ID NO: 80624 - protein, 14 aa, Mycobacterium tuberculosis
PYRYSQRELTDSFV

SEQ ID NO: 80625 - protein, 14 aa, Mycobacterium tuberculosis
YRYSQRELTDSFVS

SEQ ID NO: 80626 - protein, 14 aa, Mycobacterium tuberculosis
RYSQRELTDSFVSI

SEQ ID NO: 80627 - protein, 14 aa, Mycobacterium tuberculosis
YSQRELTDSFVSIP

SEQ ID NO: 80628 - protein, 14 aa, Mycobacterium tuberculosis
SQRELTDSFVSIPD

SEQ ID NO: 80629 - protein, 14 aa, Mycobacterium tuberculosis
QRELTDSFVSIPDF

SEQ ID NO: 80630 - protein, 14 aa, Mycobacterium tuberculosis
RELTDSFVSIPDFE

SEQ ID NO: 80631 - protein, 14 aa, Mycobacterium tuberculosis
ELTDSFVSIPDFEG

SEQ ID NO: 80632 - protein, 14 aa, Mycobacterium tuberculosis
LTDSFVSIPDFEGY

SEQ ID NO: 80633 - protein, 14 aa, Mycobacterium tuberculosis
TDSFVSIPDFEGYE

SEQ ID NO: 80634 - protein, 14 aa, Mycobacterium tuberculosis
DSFVSIPDFEGYED

SEQ ID NO: 80635 - protein, 14 aa, Mycobacterium tuberculosis
SFVSIPDFEGYEDI

SEQ ID NO: 80636 - protein, 14 aa, Mycobacterium tuberculosis
FVSIPDFEGYEDIV

SEQ ID NO: 80637 - protein, 14 aa, Mycobacterium tuberculosis
VSIPDFEGYEDIVR

SEQ ID NO: 80638 - protein, 14 aa, Mycobacterium tuberculosis
SIPDFEGYEDIVRQ

SEQ ID NO: 80639 - protein, 14 aa, Mycobacterium tuberculosis
IPDFEGYEDIVRQL

SEQ ID NO: 80640 - protein, 14 aa, Mycobacterium tuberculosis
PDFEGYEDIVRQLH

SEQ ID NO: 80641 - protein, 14 aa, Mycobacterium tuberculosis
DFEGYEDIVRQLHA

SEQ ID NO: 80642 - protein, 14 aa, Mycobacterium tuberculosis
FEGYEDIVRQLHAS

SEQ ID NO: 80643 - protein, 14 aa, Mycobacterium tuberculosis
EGYEDIVRQLHASA

SEQ ID NO: 80644 - protein, 14 aa, Mycobacterium tuberculosis
GYEDIVRQLHASAK

SEQ ID NO: 80645 - protein, 14 aa, Mycobacterium tuberculosis
YEDIVRQLHASAKV

SEQ ID NO: 80646 - protein, 14 aa, Mycobacterium tuberculosis
EDIVRQLHASAKVN

SEQ ID NO: 80647 - protein, 14 aa, Mycobacterium tuberculosis
DIVRQLHASAKVNS

SEQ ID NO: 80648 - protein, 14 aa, Mycobacterium tuberculosis
IVRQLHASAKVNSR

SEQ ID NO: 80649 - protein, 14 aa, Mycobacterium tuberculosis
VRQLHASAKVNSRH

SEQ ID NO: 80650 - protein, 14 aa, Mycobacterium tuberculosis
RQLHASAKVNSRHL

SEQ ID NO: 80651 - protein, 14 aa, Mycobacterium tuberculosis
QLHASAKVNSRHLV

SEQ ID NO: 80652 - protein, 14 aa, Mycobacterium tuberculosis
LHASAKVNSRHLVL

SEQ ID NO: 80653 - protein, 14 aa, Mycobacterium tuberculosis
HASAKVNSRHLVLP

SEQ ID NO: 80654 - protein, 14 aa, Mycobacterium tuberculosis
ASAKVNSRHLVLPL

SEQ ID NO: 80655 - protein, 14 aa, Mycobacterium tuberculosis
SAKVNSRHLVLPLE

SEQ ID NO: 80656 - protein, 14 aa, Mycobacterium tuberculosis
AKVNSRHLVLPLEK

SEQ ID NO: 80657 - protein, 14 aa, Mycobacterium tuberculosis
KVNSRHLVLPLEKY

SEQ ID NO: 80658 - protein, 14 aa, Mycobacterium tuberculosis
VNSRHLVLPLEKYP

SEQ ID NO: 80659 - protein, 14 aa, Mycobacterium tuberculosis
NSRHLVLPLEKYPK

SEQ ID NO: 80660 - protein, 14 aa, Mycobacterium tuberculosis
SRHLVLPLEKYPKL

SEQ ID NO: 80661 - protein, 14 aa, Mycobacterium tuberculosis
RHLVLPLEKYPKLT

SEQ ID NO: 80662 - protein, 14 aa, Mycobacterium tuberculosis
HLVLPLEKYPKLTD

SEQ ID NO: 80663 - protein, 14 aa, Mycobacterium tuberculosis
LVLPLEKYPKLTDF

SEQ ID NO: 80664 - protein, 14 aa, Mycobacterium tuberculosis
VLPLEKYPKLTDFG

SEQ ID NO: 80665 - protein, 14 aa, Mycobacterium tuberculosis
LPLEKYPKLTDFGE

SEQ ID NO: 80666 - protein, 14 aa, Mycobacterium tuberculosis
PLEKYPKLTDFGEA

SEQ ID NO: 80667 - protein, 14 aa, Mycobacterium tuberculosis
LEKYPKLTDFGEAN

SEQ ID NO: 80668 - protein, 14 aa, Mycobacterium tuberculosis
EKYPKLTDFGEANK

SEQ ID NO: 80669 - protein, 14 aa, Mycobacterium tuberculosis
KYPKLTDFGEANKI

SEQ ID NO: 80670 - protein, 14 aa, Mycobacterium tuberculosis
YPKLTDFGEANKIF

SEQ ID NO: 80671 - protein, 14 aa, Mycobacterium tuberculosis
PKLTDFGEANKIFI

SEQ ID NO: 80672 - protein, 14 aa, Mycobacterium tuberculosis
KLTDFGEANKIFIE

SEQ ID NO: 80673 - protein, 14 aa, Mycobacterium tuberculosis
LTDFGEANKIFIEK

SEQ ID NO: 80674 - protein, 14 aa, Mycobacterium tuberculosis
TDFGEANKIFIEKA

SEQ ID NO: 80675 - protein, 14 aa, Mycobacterium tuberculosis
DFGEANKIFIEKAV

SEQ ID NO: 80676 - protein, 14 aa, Mycobacterium tuberculosis
FGEANKIFIEKAVD

SEQ ID NO: 80677 - protein, 14 aa, Mycobacterium tuberculosis
GEANKIFIEKAVDL

SEQ ID NO: 80678 - protein, 14 aa, Mycobacterium tuberculosis
EANKIFIEKAVDLG

SEQ ID NO: 80679 - protein, 14 aa, Mycobacterium tuberculosis
ANKIFIEKAVDLGV

SEQ ID NO: 80680 - protein, 14 aa, Mycobacterium tuberculosis
NKIFIEKAVDLGVQ

SEQ ID NO: 80681 - protein, 14 aa, Mycobacterium tuberculosis
KIFIEKAVDLGVQA

SEQ ID NO: 80682 - protein, 14 aa, Mycobacterium tuberculosis
IFIEKAVDLGVQAL

SEQ ID NO: 80683 - protein, 14 aa, Mycobacterium tuberculosis
FIEKAVDLGVQALA

SEQ ID NO: 80684 - protein, 14 aa, Mycobacterium tuberculosis
IEKAVDLGVQALAG

SEQ ID NO: 80685 - protein, 14 aa, Mycobacterium tuberculosis
EKAVDLGVQALAGA

SEQ ID NO: 80686 - protein, 14 aa, Mycobacterium tuberculosis
KAVDLGVQALAGAL

SEQ ID NO: 80687 - protein, 14 aa, Mycobacterium tuberculosis
AVDLGVQALAGALD

SEQ ID NO: 80688 - protein, 14 aa, Mycobacterium tuberculosis
VDLGVQALAGALDE

SEQ ID NO: 80689 - protein, 14 aa, Mycobacterium tuberculosis
DLGVQALAGALDES

SEQ ID NO: 80690 - protein, 14 aa, Mycobacterium tuberculosis
LGVQALAGALDESG

SEQ ID NO: 80691 - protein, 14 aa, Mycobacterium tuberculosis
GVQALAGALDESGL

SEQ ID NO: 80692 - protein, 14 aa, Mycobacterium tuberculosis
VQALAGALDESGLR

SEQ ID NO: 80693 - protein, 14 aa, Mycobacterium tuberculosis
QALAGALDESGLRP

SEQ ID NO: 80694 - protein, 14 aa, Mycobacterium tuberculosis
ALAGALDESGLRPE

SEQ ID NO: 80695 - protein, 14 aa, Mycobacterium tuberculosis
LAGALDESGLRPED

SEQ ID NO: 80696 - protein, 14 aa, Mycobacterium tuberculosis
AGALDESGLRPEDL

SEQ ID NO: 80697 - protein, 14 aa, Mycobacterium tuberculosis
GALDESGLRPEDLD

SEQ ID NO: 80698 - protein, 14 aa, Mycobacterium tuberculosis
ALDESGLRPEDLDV

SEQ ID NO: 80699 - protein, 14 aa, Mycobacterium tuberculosis
LDESGLRPEDLDVL

SEQ ID NO: 80700 - protein, 14 aa, Mycobacterium tuberculosis
DESGLRPEDLDVLI

SEQ ID NO: 80701 - protein, 14 aa, Mycobacterium tuberculosis
ESGLRPEDLDVLIT

SEQ ID NO: 80702 - protein, 14 aa, Mycobacterium tuberculosis
SGLRPEDLDVLITA

SEQ ID NO: 80703 - protein, 14 aa, Mycobacterium tuberculosis
GLRPEDLDVLITAT

SEQ ID NO: 80704 - protein, 14 aa, Mycobacterium tuberculosis
LRPEDLDVLITATV

SEQ ID NO: 80705 - protein, 14 aa, Mycobacterium tuberculosis
RPEDLDVLITATVT

SEQ ID NO: 80706 - protein, 14 aa, Mycobacterium tuberculosis
PEDLDVLITATVTG

SEQ ID NO: 80707 - protein, 14 aa, Mycobacterium tuberculosis
EDLDVLITATVTGL

SEQ ID NO: 80708 - protein, 14 aa, Mycobacterium tuberculosis
DLDVLITATVTGLA

SEQ ID NO: 80709 - protein, 14 aa, Mycobacterium tuberculosis
LDVLITATVTGLAV

SEQ ID NO: 80710 - protein, 14 aa, Mycobacterium tuberculosis
DVLITATVTGLAVP

SEQ ID NO: 80711 - protein, 14 aa, Mycobacterium tuberculosis
VLITATVTGLAVPS

SEQ ID NO: 80712 - protein, 14 aa, Mycobacterium tuberculosis
LITATVTGLAVPSL

SEQ ID NO: 80713 - protein, 14 aa, Mycobacterium tuberculosis
ITATVTGLAVPSLD

SEQ ID NO: 80714 - protein, 14 aa, Mycobacterium tuberculosis
TATVTGLAVPSLDA

SEQ ID NO: 80715 - protein, 14 aa, Mycobacterium tuberculosis
ATVTGLAVPSLDAR

SEQ ID NO: 80716 - protein, 14 aa, Mycobacterium tuberculosis
TVTGLAVPSLDARI

SEQ ID NO: 80717 - protein, 14 aa, Mycobacterium tuberculosis
VTGLAVPSLDARIA

SEQ ID NO: 80718 - protein, 14 aa, Mycobacterium tuberculosis
TGLAVPSLDARIAG

SEQ ID NO: 80719 - protein, 14 aa, Mycobacterium tuberculosis
GLAVPSLDARIAGR

SEQ ID NO: 80720 - protein, 14 aa, Mycobacterium tuberculosis
LAVPSLDARIAGRL

SEQ ID NO: 80721 - protein, 14 aa, Mycobacterium tuberculosis
AVPSLDARIAGRLG

SEQ ID NO: 80722 - protein, 14 aa, Mycobacterium tuberculosis
VPSLDARIAGRLGL

SEQ ID NO: 80723 - protein, 14 aa, Mycobacterium tuberculosis
PSLDARIAGRLGLR

SEQ ID NO: 80724 - protein, 14 aa, Mycobacterium tuberculosis
SLDARIAGRLGLRA

SEQ ID NO: 80725 - protein, 14 aa, Mycobacterium tuberculosis
LDARIAGRLGLRAD

SEQ ID NO: 80726 - protein, 14 aa, Mycobacterium tuberculosis
DARIAGRLGLRADV

SEQ ID NO: 80727 - protein, 14 aa, Mycobacterium tuberculosis
ARIAGRLGLRADVR

SEQ ID NO: 80728 - protein, 14 aa, Mycobacterium tuberculosis
RIAGRLGLRADVRR

SEQ ID NO: 80729 - protein, 14 aa, Mycobacterium tuberculosis
IAGRLGLRADVRRV

SEQ ID NO: 80730 - protein, 14 aa, Mycobacterium tuberculosis
AGRLGLRADVRRVP

SEQ ID NO: 80731 - protein, 14 aa, Mycobacterium tuberculosis
GRLGLRADVRRVPL

SEQ ID NO: 80732 - protein, 14 aa, Mycobacterium tuberculosis
RLGLRADVRRVPLF

SEQ ID NO: 80733 - protein, 14 aa, Mycobacterium tuberculosis
LGLRADVRRVPLFG

SEQ ID NO: 80734 - protein, 14 aa, Mycobacterium tuberculosis
GLRADVRRVPLFGL

SEQ ID NO: 80735 - protein, 14 aa, Mycobacterium tuberculosis
LRADVRRVPLFGLG

SEQ ID NO: 80736 - protein, 14 aa, Mycobacterium tuberculosis
RADVRRVPLFGLGC

SEQ ID NO: 80737 - protein, 14 aa, Mycobacterium tuberculosis
ADVRRVPLFGLGCV

SEQ ID NO: 80738 - protein, 14 aa, Mycobacterium tuberculosis
DVRRVPLFGLGCVA

SEQ ID NO: 80739 - protein, 14 aa, Mycobacterium tuberculosis
VRRVPLFGLGCVAG

SEQ ID NO: 80740 - protein, 14 aa, Mycobacterium tuberculosis
RRVPLFGLGCVAGA

SEQ ID NO: 80741 - protein, 14 aa, Mycobacterium tuberculosis
RVPLFGLGCVAGAA

SEQ ID NO: 80742 - protein, 14 aa, Mycobacterium tuberculosis
VPLFGLGCVAGAAG

SEQ ID NO: 80743 - protein, 14 aa, Mycobacterium tuberculosis
PLFGLGCVAGAAGV

SEQ ID NO: 80744 - protein, 14 aa, Mycobacterium tuberculosis
LFGLGCVAGAAGVA

SEQ ID NO: 80745 - protein, 14 aa, Mycobacterium tuberculosis
FGLGCVAGAAGVAR

SEQ ID NO: 80746 - protein, 14 aa, Mycobacterium tuberculosis
GLGCVAGAAGVARL

SEQ ID NO: 80747 - protein, 14 aa, Mycobacterium tuberculosis
LGCVAGAAGVARLH

SEQ ID NO: 80748 - protein, 14 aa, Mycobacterium tuberculosis
GCVAGAAGVARLHD

SEQ ID NO: 80749 - protein, 14 aa, Mycobacterium tuberculosis
CVAGAAGVARLHDY

SEQ ID NO: 80750 - protein, 14 aa, Mycobacterium tuberculosis
VAGAAGVARLHDYL

SEQ ID NO: 80751 - protein, 14 aa, Mycobacterium tuberculosis
AGAAGVARLHDYLR

SEQ ID NO: 80752 - protein, 14 aa, Mycobacterium tuberculosis
GAAGVARLHDYLRG

SEQ ID NO: 80753 - protein, 14 aa, Mycobacterium tuberculosis
AAGVARLHDYLRGA

SEQ ID NO: 80754 - protein, 14 aa, Mycobacterium tuberculosis
AGVARLHDYLRGAP

SEQ ID NO: 80755 - protein, 14 aa, Mycobacterium tuberculosis
GVARLHDYLRGAPD

SEQ ID NO: 80756 - protein, 14 aa, Mycobacterium tuberculosis
VARLHDYLRGAPDG

SEQ ID NO: 80757 - protein, 14 aa, Mycobacterium tuberculosis
ARLHDYLRGAPDGV

SEQ ID NO: 80758 - protein, 14 aa, Mycobacterium tuberculosis
RLHDYLRGAPDGVA

SEQ ID NO: 80759 - protein, 14 aa, Mycobacterium tuberculosis
LHDYLRGAPDGVAA

SEQ ID NO: 80760 - protein, 14 aa, Mycobacterium tuberculosis
HDYLRGAPDGVAAL

SEQ ID NO: 80761 - protein, 14 aa, Mycobacterium tuberculosis
DYLRGAPDGVAALV

SEQ ID NO: 80762 - protein, 14 aa, Mycobacterium tuberculosis
YLRGAPDGVAALVS

SEQ ID NO: 80763 - protein, 14 aa, Mycobacterium tuberculosis
LRGAPDGVAALVSV

SEQ ID NO: 80764 - protein, 14 aa, Mycobacterium tuberculosis
RGAPDGVAALVSVE

SEQ ID NO: 80765 - protein, 14 aa, Mycobacterium tuberculosis
GAPDGVAALVSVEL

SEQ ID NO: 80766 - protein, 14 aa, Mycobacterium tuberculosis
APDGVAALVSVELC

SEQ ID NO: 80767 - protein, 14 aa, Mycobacterium tuberculosis
PDGVAALVSVELCS

SEQ ID NO: 80768 - protein, 14 aa, Mycobacterium tuberculosis
DGVAALVSVELCSL

SEQ ID NO: 80769 - protein, 14 aa, Mycobacterium tuberculosis
GVAALVSVELCSLT

SEQ ID NO: 80770 - protein, 14 aa, Mycobacterium tuberculosis
VAALVSVELCSLTY

SEQ ID NO: 80771 - protein, 14 aa, Mycobacterium tuberculosis
AALVSVELCSLTYP

SEQ ID NO: 80772 - protein, 14 aa, Mycobacterium tuberculosis
ALVSVELCSLTYPG

SEQ ID NO: 80773 - protein, 14 aa, Mycobacterium tuberculosis
LVSVELCSLTYPGY

SEQ ID NO: 80774 - protein, 14 aa, Mycobacterium tuberculosis
VSVELCSLTYPGYK

SEQ ID NO: 80775 - protein, 14 aa, Mycobacterium tuberculosis
SVELCSLTYPGYKP

SEQ ID NO: 80776 - protein, 14 aa, Mycobacterium tuberculosis
VELCSLTYPGYKPT

SEQ ID NO: 80777 - protein, 14 aa, Mycobacterium tuberculosis
ELCSLTYPGYKPTL

SEQ ID NO: 80778 - protein, 14 aa, Mycobacterium tuberculosis
LCSLTYPGYKPTLP

SEQ ID NO: 80779 - protein, 14 aa, Mycobacterium tuberculosis
CSLTYPGYKPTLPG

SEQ ID NO: 80780 - protein, 14 aa, Mycobacterium tuberculosis
SLTYPGYKPTLPGL

SEQ ID NO: 80781 - protein, 14 aa, Mycobacterium tuberculosis
LTYPGYKPTLPGLV

SEQ ID NO: 80782 - protein, 14 aa, Mycobacterium tuberculosis
TYPGYKPTLPGLVG

SEQ ID NO: 80783 - protein, 14 aa, Mycobacterium tuberculosis
YPGYKPTLPGLVGS

SEQ ID NO: 80784 - protein, 14 aa, Mycobacterium tuberculosis
PGYKPTLPGLVGSA

SEQ ID NO: 80785 - protein, 14 aa, Mycobacterium tuberculosis
GYKPTLPGLVGSAL

SEQ ID NO: 80786 - protein, 14 aa, Mycobacterium tuberculosis
YKPTLPGLVGSALF

SEQ ID NO: 80787 - protein, 14 aa, Mycobacterium tuberculosis
KPTLPGLVGSALFA

SEQ ID NO: 80788 - protein, 14 aa, Mycobacterium tuberculosis
PTLPGLVGSALFAD

SEQ ID NO: 80789 - protein, 14 aa, Mycobacterium tuberculosis
TLPGLVGSALFADG

SEQ ID NO: 80790 - protein, 14 aa, Mycobacterium tuberculosis
LPGLVGSALFADGA

SEQ ID NO: 80791 - protein, 14 aa, Mycobacterium tuberculosis
PGLVGSALFADGAA

SEQ ID NO: 80792 - protein, 14 aa, Mycobacterium tuberculosis
GLVGSALFADGAAA

SEQ ID NO: 80793 - protein, 14 aa, Mycobacterium tuberculosis
LVGSALFADGAAAV

SEQ ID NO: 80794 - protein, 14 aa, Mycobacterium tuberculosis
VGSALFADGAAAVV

SEQ ID NO: 80795 - protein, 14 aa, Mycobacterium tuberculosis
GSALFADGAAAVVA

SEQ ID NO: 80796 - protein, 14 aa, Mycobacterium tuberculosis
SALFADGAAAVVAA

SEQ ID NO: 80797 - protein, 14 aa, Mycobacterium tuberculosis
ALFADGAAAVVAAG

SEQ ID NO: 80798 - protein, 14 aa, Mycobacterium tuberculosis
LFADGAAAVVAAGV

SEQ ID NO: 80799 - protein, 14 aa, Mycobacterium tuberculosis
FADGAAAVVAAGVK

SEQ ID NO: 80800 - protein, 14 aa, Mycobacterium tuberculosis
ADGAAAVVAAGVKR

SEQ ID NO: 80801 - protein, 14 aa, Mycobacterium tuberculosis
DGAAAVVAAGVKRA

SEQ ID NO: 80802 - protein, 14 aa, Mycobacterium tuberculosis
GAAAVVAAGVKRAQ

SEQ ID NO: 80803 - protein, 14 aa, Mycobacterium tuberculosis
AAAVVAAGVKRAQD

SEQ ID NO: 80804 - protein, 14 aa, Mycobacterium tuberculosis
AAVVAAGVKRAQDI

SEQ ID NO: 80805 - protein, 14 aa, Mycobacterium tuberculosis
AVVAAGVKRAQDIG

SEQ ID NO: 80806 - protein, 14 aa, Mycobacterium tuberculosis
VVAAGVKRAQDIGA

SEQ ID NO: 80807 - protein, 14 aa, Mycobacterium tuberculosis
VAAGVKRAQDIGAD

SEQ ID NO: 80808 - protein, 14 aa, Mycobacterium tuberculosis
AAGVKRAQDIGADG

SEQ ID NO: 80809 - protein, 14 aa, Mycobacterium tuberculosis
AGVKRAQDIGADGP

SEQ ID NO: 80810 - protein, 14 aa, Mycobacterium tuberculosis
GVKRAQDIGADGPD

SEQ ID NO: 80811 - protein, 14 aa, Mycobacterium tuberculosis
VKRAQDIGADGPDI

SEQ ID NO: 80812 - protein, 14 aa, Mycobacterium tuberculosis
KRAQDIGADGPDIL

SEQ ID NO: 80813 - protein, 14 aa, Mycobacterium tuberculosis
RAQDIGADGPDILD

SEQ ID NO: 80814 - protein, 14 aa, Mycobacterium tuberculosis
AQDIGADGPDILDS

SEQ ID NO: 80815 - protein, 14 aa, Mycobacterium tuberculosis
QDIGADGPDILDSR

SEQ ID NO: 80816 - protein, 14 aa, Mycobacterium tuberculosis
DIGADGPDILDSRS

SEQ ID NO: 80817 - protein, 14 aa, Mycobacterium tuberculosis
IGADGPDILDSRSH

SEQ ID NO: 80818 - protein, 14 aa, Mycobacterium tuberculosis
GADGPDILDSRSHL

SEQ ID NO: 80819 - protein, 14 aa, Mycobacterium tuberculosis
ADGPDILDSRSHLY

SEQ ID NO: 80820 - protein, 14 aa, Mycobacterium tuberculosis
DGPDILDSRSHLYP

SEQ ID NO: 80821 - protein, 14 aa, Mycobacterium tuberculosis
GPDILDSRSHLYPD

SEQ ID NO: 80822 - protein, 14 aa, Mycobacterium tuberculosis
PDILDSRSHLYPDS

SEQ ID NO: 80823 - protein, 14 aa, Mycobacterium tuberculosis
DILDSRSHLYPDSL

SEQ ID NO: 80824 - protein, 14 aa, Mycobacterium tuberculosis
ILDSRSHLYPDSLR

SEQ ID NO: 80825 - protein, 14 aa, Mycobacterium tuberculosis
LDSRSHLYPDSLRT

SEQ ID NO: 80826 - protein, 14 aa, Mycobacterium tuberculosis
DSRSHLYPDSLRTM

SEQ ID NO: 80827 - protein, 14 aa, Mycobacterium tuberculosis
SRSHLYPDSLRTMG

SEQ ID NO: 80828 - protein, 14 aa, Mycobacterium tuberculosis
RSHLYPDSLRTMGY

SEQ ID NO: 80829 - protein, 14 aa, Mycobacterium tuberculosis
SHLYPDSLRTMGYD

SEQ ID NO: 80830 - protein, 14 aa, Mycobacterium tuberculosis
HLYPDSLRTMGYDV

SEQ ID NO: 80831 - protein, 14 aa, Mycobacterium tuberculosis
LYPDSLRTMGYDVG

SEQ ID NO: 80832 - protein, 14 aa, Mycobacterium tuberculosis
YPDSLRTMGYDVGS

SEQ ID NO: 80833 - protein, 14 aa, Mycobacterium tuberculosis
PDSLRTMGYDVGSA

SEQ ID NO: 80834 - protein, 14 aa, Mycobacterium tuberculosis
DSLRTMGYDVGSAG

SEQ ID NO: 80835 - protein, 14 aa, Mycobacterium tuberculosis
SLRTMGYDVGSAGF

SEQ ID NO: 80836 - protein, 14 aa, Mycobacterium tuberculosis
LRTMGYDVGSAGFE

SEQ ID NO: 80837 - protein, 14 aa, Mycobacterium tuberculosis
RTMGYDVGSAGFEL

SEQ ID NO: 80838 - protein, 14 aa, Mycobacterium tuberculosis
TMGYDVGSAGFELV

SEQ ID NO: 80839 - protein, 14 aa, Mycobacterium tuberculosis
MGYDVGSAGFELVL

SEQ ID NO: 80840 - protein, 14 aa, Mycobacterium tuberculosis
GYDVGSAGFELVLS

SEQ ID NO: 80841 - protein, 14 aa, Mycobacterium tuberculosis
YDVGSAGFELVLSR

SEQ ID NO: 80842 - protein, 14 aa, Mycobacterium tuberculosis
DVGSAGFELVLSRD

SEQ ID NO: 80843 - protein, 14 aa, Mycobacterium tuberculosis
VGSAGFELVLSRDL

SEQ ID NO: 80844 - protein, 14 aa, Mycobacterium tuberculosis
GSAGFELVLSRDLA

SEQ ID NO: 80845 - protein, 14 aa, Mycobacterium tuberculosis
SAGFELVLSRDLAA

SEQ ID NO: 80846 - protein, 14 aa, Mycobacterium tuberculosis
AGFELVLSRDLAAV

SEQ ID NO: 80847 - protein, 14 aa, Mycobacterium tuberculosis
GFELVLSRDLAAVV

SEQ ID NO: 80848 - protein, 14 aa, Mycobacterium tuberculosis
FELVLSRDLAAVVE

SEQ ID NO: 80849 - protein, 14 aa, Mycobacterium tuberculosis
ELVLSRDLAAVVEQ

SEQ ID NO: 80850 - protein, 14 aa, Mycobacterium tuberculosis
LVLSRDLAAVVEQY

SEQ ID NO: 80851 - protein, 14 aa, Mycobacterium tuberculosis
VLSRDLAAVVEQYL

SEQ ID NO: 80852 - protein, 14 aa, Mycobacterium tuberculosis
LSRDLAAVVEQYLG

SEQ ID NO: 80853 - protein, 14 aa, Mycobacterium tuberculosis
SRDLAAVVEQYLGN

SEQ ID NO: 80854 - protein, 14 aa, Mycobacterium tuberculosis
RDLAAVVEQYLGND

SEQ ID NO: 80855 - protein, 14 aa, Mycobacterium tuberculosis
DLAAVVEQYLGNDV

SEQ ID NO: 80856 - protein, 14 aa, Mycobacterium tuberculosis
LAAVVEQYLGNDVT

SEQ ID NO: 80857 - protein, 14 aa, Mycobacterium tuberculosis
AAVVEQYLGNDVTT

SEQ ID NO: 80858 - protein, 14 aa, Mycobacterium tuberculosis
AVVEQYLGNDVTTF

SEQ ID NO: 80859 - protein, 14 aa, Mycobacterium tuberculosis
VVEQYLGNDVTTFL

SEQ ID NO: 80860 - protein, 14 aa, Mycobacterium tuberculosis
VEQYLGNDVTTFLA

SEQ ID NO: 80861 - protein, 14 aa, Mycobacterium tuberculosis
EQYLGNDVTTFLAS

SEQ ID NO: 80862 - protein, 14 aa, Mycobacterium tuberculosis
QYLGNDVTTFLASH

SEQ ID NO: 80863 - protein, 14 aa, Mycobacterium tuberculosis
YLGNDVTTFLASHG

SEQ ID NO: 80864 - protein, 14 aa, Mycobacterium tuberculosis
LGNDVTTFLASHGL

SEQ ID NO: 80865 - protein, 14 aa, Mycobacterium tuberculosis
GNDVTTFLASHGLS

SEQ ID NO: 80866 - protein, 14 aa, Mycobacterium tuberculosis
NDVTTFLASHGLST

SEQ ID NO: 80867 - protein, 14 aa, Mycobacterium tuberculosis
DVTTFLASHGLSTT

SEQ ID NO: 80868 - protein, 14 aa, Mycobacterium tuberculosis
VTTFLASHGLSTTD

SEQ ID NO: 80869 - protein, 14 aa, Mycobacterium tuberculosis
TTFLASHGLSTTDV

SEQ ID NO: 80870 - protein, 14 aa, Mycobacterium tuberculosis
TFLASHGLSTTDVG

SEQ ID NO: 80871 - protein, 14 aa, Mycobacterium tuberculosis
FLASHGLSTTDVGA

SEQ ID NO: 80872 - protein, 14 aa, Mycobacterium tuberculosis
LASHGLSTTDVGAW

SEQ ID NO: 80873 - protein, 14 aa, Mycobacterium tuberculosis
ASHGLSTTDVGAWV

SEQ ID NO: 80874 - protein, 14 aa, Mycobacterium tuberculosis
SHGLSTTDVGAWVT

SEQ ID NO: 80875 - protein, 14 aa, Mycobacterium tuberculosis
HGLSTTDVGAWVTH

SEQ ID NO: 80876 - protein, 14 aa, Mycobacterium tuberculosis
GLSTTDVGAWVTHP

SEQ ID NO: 80877 - protein, 14 aa, Mycobacterium tuberculosis
LSTTDVGAWVTHPG

SEQ ID NO: 80878 - protein, 14 aa, Mycobacterium tuberculosis
STTDVGAWVTHPGG

SEQ ID NO: 80879 - protein, 14 aa, Mycobacterium tuberculosis
TTDVGAWVTHPGGP

SEQ ID NO: 80880 - protein, 14 aa, Mycobacterium tuberculosis
TDVGAWVTHPGGPK

SEQ ID NO: 80881 - protein, 14 aa, Mycobacterium tuberculosis
DVGAWVTHPGGPKI

SEQ ID NO: 80882 - protein, 14 aa, Mycobacterium tuberculosis
VGAWVTHPGGPKII

SEQ ID NO: 80883 - protein, 14 aa, Mycobacterium tuberculosis
GAWVTHPGGPKIIN

SEQ ID NO: 80884 - protein, 14 aa, Mycobacterium tuberculosis
AWVTHPGGPKIINA

SEQ ID NO: 80885 - protein, 14 aa, Mycobacterium tuberculosis
WVTHPGGPKIINAI

SEQ ID NO: 80886 - protein, 14 aa, Mycobacterium tuberculosis
VTHPGGPKIINAIT

SEQ ID NO: 80887 - protein, 14 aa, Mycobacterium tuberculosis
THPGGPKIINAITE

SEQ ID NO: 80888 - protein, 14 aa, Mycobacterium tuberculosis
HPGGPKIINAITET

SEQ ID NO: 80889 - protein, 14 aa, Mycobacterium tuberculosis
PGGPKIINAITETL

SEQ ID NO: 80890 - protein, 14 aa, Mycobacterium tuberculosis
GGPKIINAITETLD

SEQ ID NO: 80891 - protein, 14 aa, Mycobacterium tuberculosis
GPKIINAITETLDL

SEQ ID NO: 80892 - protein, 14 aa, Mycobacterium tuberculosis
PKIINAITETLDLS

SEQ ID NO: 80893 - protein, 14 aa, Mycobacterium tuberculosis
KIINAITETLDLSP

SEQ ID NO: 80894 - protein, 14 aa, Mycobacterium tuberculosis
IINAITETLDLSPQ

SEQ ID NO: 80895 - protein, 14 aa, Mycobacterium tuberculosis
INAITETLDLSPQA

SEQ ID NO: 80896 - protein, 14 aa, Mycobacterium tuberculosis
NAITETLDLSPQAL

SEQ ID NO: 80897 - protein, 14 aa, Mycobacterium tuberculosis
AITETLDLSPQALE

SEQ ID NO: 80898 - protein, 14 aa, Mycobacterium tuberculosis
ITETLDLSPQALEL

SEQ ID NO: 80899 - protein, 14 aa, Mycobacterium tuberculosis
TETLDLSPQALELT

SEQ ID NO: 80900 - protein, 14 aa, Mycobacterium tuberculosis
ETLDLSPQALELTW

SEQ ID NO: 80901 - protein, 14 aa, Mycobacterium tuberculosis
TLDLSPQALELTWR

SEQ ID NO: 80902 - protein, 14 aa, Mycobacterium tuberculosis
LDLSPQALELTWRS

SEQ ID NO: 80903 - protein, 14 aa, Mycobacterium tuberculosis
DLSPQALELTWRSL

SEQ ID NO: 80904 - protein, 14 aa, Mycobacterium tuberculosis
LSPQALELTWRSLG

SEQ ID NO: 80905 - protein, 14 aa, Mycobacterium tuberculosis
SPQALELTWRSLGE

SEQ ID NO: 80906 - protein, 14 aa, Mycobacterium tuberculosis
PQALELTWRSLGEI

SEQ ID NO: 80907 - protein, 14 aa, Mycobacterium tuberculosis
QALELTWRSLGEIG

SEQ ID NO: 80908 - protein, 14 aa, Mycobacterium tuberculosis
ALELTWRSLGEIGN

SEQ ID NO: 80909 - protein, 14 aa, Mycobacterium tuberculosis
LELTWRSLGEIGNL

SEQ ID NO: 80910 - protein, 14 aa, Mycobacterium tuberculosis
ELTWRSLGEIGNLS

SEQ ID NO: 80911 - protein, 14 aa, Mycobacterium tuberculosis
LTWRSLGEIGNLSS

SEQ ID NO: 80912 - protein, 14 aa, Mycobacterium tuberculosis
TWRSLGEIGNLSSA

SEQ ID NO: 80913 - protein, 14 aa, Mycobacterium tuberculosis
WRSLGEIGNLSSAS

SEQ ID NO: 80914 - protein, 14 aa, Mycobacterium tuberculosis
RSLGEIGNLSSASV

SEQ ID NO: 80915 - protein, 14 aa, Mycobacterium tuberculosis
SLGEIGNLSSASVL

SEQ ID NO: 80916 - protein, 14 aa, Mycobacterium tuberculosis
LGEIGNLSSASVLH

SEQ ID NO: 80917 - protein, 14 aa, Mycobacterium tuberculosis
GEIGNLSSASVLHV

SEQ ID NO: 80918 - protein, 14 aa, Mycobacterium tuberculosis
EIGNLSSASVLHVL

SEQ ID NO: 80919 - protein, 14 aa, Mycobacterium tuberculosis
IGNLSSASVLHVLR

SEQ ID NO: 80920 - protein, 14 aa, Mycobacterium tuberculosis
GNLSSASVLHVLRD

SEQ ID NO: 80921 - protein, 14 aa, Mycobacterium tuberculosis
NLSSASVLHVLRDT

SEQ ID NO: 80922 - protein, 14 aa, Mycobacterium tuberculosis
LSSASVLHVLRDTI

SEQ ID NO: 80923 - protein, 14 aa, Mycobacterium tuberculosis
SSASVLHVLRDTIA

SEQ ID NO: 80924 - protein, 14 aa, Mycobacterium tuberculosis
SASVLHVLRDTIAK

SEQ ID NO: 80925 - protein, 14 aa, Mycobacterium tuberculosis
ASVLHVLRDTIAKP

SEQ ID NO: 80926 - protein, 14 aa, Mycobacterium tuberculosis
SVLHVLRDTIAKPP

SEQ ID NO: 80927 - protein, 14 aa, Mycobacterium tuberculosis
VLHVLRDTIAKPPP

SEQ ID NO: 80928 - protein, 14 aa, Mycobacterium tuberculosis
LHVLRDTIAKPPPS

SEQ ID NO: 80929 - protein, 14 aa, Mycobacterium tuberculosis
HVLRDTIAKPPPSG

SEQ ID NO: 80930 - protein, 14 aa, Mycobacterium tuberculosis
VLRDTIAKPPPSGS

SEQ ID NO: 80931 - protein, 14 aa, Mycobacterium tuberculosis
LRDTIAKPPPSGSP

SEQ ID NO: 80932 - protein, 14 aa, Mycobacterium tuberculosis
RDTIAKPPPSGSPG

SEQ ID NO: 80933 - protein, 14 aa, Mycobacterium tuberculosis
DTIAKPPPSGSPGL

SEQ ID NO: 80934 - protein, 14 aa, Mycobacterium tuberculosis
TIAKPPPSGSPGLM

SEQ ID NO: 80935 - protein, 14 aa, Mycobacterium tuberculosis
IAKPPPSGSPGLMI

SEQ ID NO: 80936 - protein, 14 aa, Mycobacterium tuberculosis
AKPPPSGSPGLMIA

SEQ ID NO: 80937 - protein, 14 aa, Mycobacterium tuberculosis
KPPPSGSPGLMIAM

SEQ ID NO: 80938 - protein, 14 aa, Mycobacterium tuberculosis
PPPSGSPGLMIAMG

SEQ ID NO: 80939 - protein, 14 aa, Mycobacterium tuberculosis
PPSGSPGLMIAMGP

SEQ ID NO: 80940 - protein, 14 aa, Mycobacterium tuberculosis
PSGSPGLMIAMGPG

SEQ ID NO: 80941 - protein, 14 aa, Mycobacterium tuberculosis
SGSPGLMIAMGPGF

SEQ ID NO: 80942 - protein, 14 aa, Mycobacterium tuberculosis
GSPGLMIAMGPGFC

SEQ ID NO: 80943 - protein, 14 aa, Mycobacterium tuberculosis
SPGLMIAMGPGFCS

SEQ ID NO: 80944 - protein, 14 aa, Mycobacterium tuberculosis
PGLMIAMGPGFCSE

SEQ ID NO: 80945 - protein, 14 aa, Mycobacterium tuberculosis
GLMIAMGPGFCSEL

SEQ ID NO: 80946 - protein, 14 aa, Mycobacterium tuberculosis
LMIAMGPGFCSELV

SEQ ID NO: 80947 - protein, 14 aa, Mycobacterium tuberculosis
MIAMGPGFCSELVL

SEQ ID NO: 80948 - protein, 14 aa, Mycobacterium tuberculosis
IAMGPGFCSELVLL

SEQ ID NO: 80949 - protein, 14 aa, Mycobacterium tuberculosis
AMGPGFCSELVLLR

SEQ ID NO: 80950 - protein, 14 aa, Mycobacterium tuberculosis
MGPGFCSELVLLRW

SEQ ID NO: 80951 - protein, 14 aa, Mycobacterium tuberculosis
GPGFCSELVLLRWH

SEQ ID NO: 80952 - protein, 15 aa, Mycobacterium tuberculosis
MSVIAGVFGALPPYR

SEQ ID NO: 80953 - protein, 15 aa, Mycobacterium tuberculosis
SVIAGVFGALPPYRY

SEQ ID NO: 80954 - protein, 15 aa, Mycobacterium tuberculosis
VIAGVFGALPPYRYS

SEQ ID NO: 80955 - protein, 15 aa, Mycobacterium tuberculosis
IAGVFGALPPYRYSQ

SEQ ID NO: 80956 - protein, 15 aa, Mycobacterium tuberculosis
AGVFGALPPYRYSQR

SEQ ID NO: 80957 - protein, 15 aa, Mycobacterium tuberculosis
GVFGALPPYRYSQRE

SEQ ID NO: 80958 - protein, 15 aa, Mycobacterium tuberculosis
VFGALPPYRYSQREL

SEQ ID NO: 80959 - protein, 15 aa, Mycobacterium tuberculosis
FGALPPYRYSQRELT

SEQ ID NO: 80960 - protein, 15 aa, Mycobacterium tuberculosis
GALPPYRYSQRELTD

SEQ ID NO: 80961 - protein, 15 aa, Mycobacterium tuberculosis
ALPPYRYSQRELTDS

SEQ ID NO: 80962 - protein, 15 aa, Mycobacterium tuberculosis
LPPYRYSQRELTDSF

SEQ ID NO: 80963 - protein, 15 aa, Mycobacterium tuberculosis
PPYRYSQRELTDSFV

SEQ ID NO: 80964 - protein, 15 aa, Mycobacterium tuberculosis
PYRYSQRELTDSFVS

SEQ ID NO: 80965 - protein, 15 aa, Mycobacterium tuberculosis
YRYSQRELTDSFVSI

SEQ ID NO: 80966 - protein, 15 aa, Mycobacterium tuberculosis
RYSQRELTDSFVSIP

SEQ ID NO: 80967 - protein, 15 aa, Mycobacterium tuberculosis
YSQRELTDSFVSIPD

SEQ ID NO: 80968 - protein, 15 aa, Mycobacterium tuberculosis
SQRELTDSFVSIPDF

SEQ ID NO: 80969 - protein, 15 aa, Mycobacterium tuberculosis
QRELTDSFVSIPDFE

SEQ ID NO: 80970 - protein, 15 aa, Mycobacterium tuberculosis
RELTDSFVSIPDFEG

SEQ ID NO: 80971 - protein, 15 aa, Mycobacterium tuberculosis
ELTDSFVSIPDFEGY

SEQ ID NO: 80972 - protein, 15 aa, Mycobacterium tuberculosis
LTDSFVSIPDFEGYE

SEQ ID NO: 80973 - protein, 15 aa, Mycobacterium tuberculosis
TDSFVSIPDFEGYED

SEQ ID NO: 80974 - protein, 15 aa, Mycobacterium tuberculosis
DSFVSIPDFEGYEDI

SEQ ID NO: 80975 - protein, 15 aa, Mycobacterium tuberculosis
SFVSIPDFEGYEDIV

SEQ ID NO: 80976 - protein, 15 aa, Mycobacterium tuberculosis
FVSIPDFEGYEDIVR

SEQ ID NO: 80977 - protein, 15 aa, Mycobacterium tuberculosis
VSIPDFEGYEDIVRQ

SEQ ID NO: 80978 - protein, 15 aa, Mycobacterium tuberculosis
SIPDFEGYEDIVRQL

SEQ ID NO: 80979 - protein, 15 aa, Mycobacterium tuberculosis
IPDFEGYEDIVRQLH

SEQ ID NO: 80980 - protein, 15 aa, Mycobacterium tuberculosis
PDFEGYEDIVRQLHA

SEQ ID NO: 80981 - protein, 15 aa, Mycobacterium tuberculosis
DFEGYEDIVRQLHAS

SEQ ID NO: 80982 - protein, 15 aa, Mycobacterium tuberculosis
FEGYEDIVRQLHASA

SEQ ID NO: 80983 - protein, 15 aa, Mycobacterium tuberculosis
EGYEDIVRQLHASAK

SEQ ID NO: 80984 - protein, 15 aa, Mycobacterium tuberculosis
GYEDIVRQLHASAKV

SEQ ID NO: 80985 - protein, 15 aa, Mycobacterium tuberculosis
YEDIVRQLHASAKVN

SEQ ID NO: 80986 - protein, 15 aa, Mycobacterium tuberculosis
EDIVRQLHASAKVNS

SEQ ID NO: 80987 - protein, 15 aa, Mycobacterium tuberculosis
DIVRQLHASAKVNSR

SEQ ID NO: 80988 - protein, 15 aa, Mycobacterium tuberculosis
IVRQLHASAKVNSRH

SEQ ID NO: 80989 - protein, 15 aa, Mycobacterium tuberculosis
VRQLHASAKVNSRHL

SEQ ID NO: 80990 - protein, 15 aa, Mycobacterium tuberculosis
RQLHASAKVNSRHLV

SEQ ID NO: 80991 - protein, 15 aa, Mycobacterium tuberculosis
QLHASAKVNSRHLVL

SEQ ID NO: 80992 - protein, 15 aa, Mycobacterium tuberculosis
LHASAKVNSRHLVLP

SEQ ID NO: 80993 - protein, 15 aa, Mycobacterium tuberculosis
HASAKVNSRHLVLPL

SEQ ID NO: 80994 - protein, 15 aa, Mycobacterium tuberculosis
ASAKVNSRHLVLPLE

SEQ ID NO: 80995 - protein, 15 aa, Mycobacterium tuberculosis
SAKVNSRHLVLPLEK

SEQ ID NO: 80996 - protein, 15 aa, Mycobacterium tuberculosis
AKVNSRHLVLPLEKY

SEQ ID NO: 80997 - protein, 15 aa, Mycobacterium tuberculosis
KVNSRHLVLPLEKYP

SEQ ID NO: 80998 - protein, 15 aa, Mycobacterium tuberculosis
VNSRHLVLPLEKYPK

SEQ ID NO: 80999 - protein, 15 aa, Mycobacterium tuberculosis
NSRHLVLPLEKYPKL

SEQ ID NO: 81000 - protein, 15 aa, Mycobacterium tuberculosis
SRHLVLPLEKYPKLT

SEQ ID NO: 81001 - protein, 15 aa, Mycobacterium tuberculosis
RHLVLPLEKYPKLTD

SEQ ID NO: 81002 - protein, 15 aa, Mycobacterium tuberculosis
HLVLPLEKYPKLTDF

SEQ ID NO: 81003 - protein, 15 aa, Mycobacterium tuberculosis
LVLPLEKYPKLTDFG

SEQ ID NO: 81004 - protein, 15 aa, Mycobacterium tuberculosis
VLPLEKYPKLTDFGE

SEQ ID NO: 81005 - protein, 15 aa, Mycobacterium tuberculosis
LPLEKYPKLTDFGEA

SEQ ID NO: 81006 - protein, 15 aa, Mycobacterium tuberculosis
PLEKYPKLTDFGEAN

SEQ ID NO: 81007 - protein, 15 aa, Mycobacterium tuberculosis
LEKYPKLTDFGEANK

SEQ ID NO: 81008 - protein, 15 aa, Mycobacterium tuberculosis
EKYPKLTDFGEANKI

SEQ ID NO: 81009 - protein, 15 aa, Mycobacterium tuberculosis
KYPKLTDFGEANKIF

SEQ ID NO: 81010 - protein, 15 aa, Mycobacterium tuberculosis
YPKLTDFGEANKIFI

SEQ ID NO: 81011 - protein, 15 aa, Mycobacterium tuberculosis
PKLTDFGEANKIFIE

SEQ ID NO: 81012 - protein, 15 aa, Mycobacterium tuberculosis
KLTDFGEANKIFIEK

SEQ ID NO: 81013 - protein, 15 aa, Mycobacterium tuberculosis
LTDFGEANKIFIEKA

SEQ ID NO: 81014 - protein, 15 aa, Mycobacterium tuberculosis
TDFGEANKIFIEKAV

SEQ ID NO: 81015 - protein, 15 aa, Mycobacterium tuberculosis
DFGEANKIFIEKAVD

SEQ ID NO: 81016 - protein, 15 aa, Mycobacterium tuberculosis
FGEANKIFIEKAVDL

SEQ ID NO: 81017 - protein, 15 aa, Mycobacterium tuberculosis
GEANKIFIEKAVDLG

SEQ ID NO: 81018 - protein, 15 aa, Mycobacterium tuberculosis
EANKIFIEKAVDLGV

SEQ ID NO: 81019 - protein, 15 aa, Mycobacterium tuberculosis
ANKIFIEKAVDLGVQ

SEQ ID NO: 81020 - protein, 15 aa, Mycobacterium tuberculosis
NKIFIEKAVDLGVQA

SEQ ID NO: 81021 - protein, 15 aa, Mycobacterium tuberculosis
KIFIEKAVDLGVQAL

SEQ ID NO: 81022 - protein, 15 aa, Mycobacterium tuberculosis
IFIEKAVDLGVQALA

SEQ ID NO: 81023 - protein, 15 aa, Mycobacterium tuberculosis
FIEKAVDLGVQALAG

SEQ ID NO: 81024 - protein, 15 aa, Mycobacterium tuberculosis
IEKAVDLGVQALAGA

SEQ ID NO: 81025 - protein, 15 aa, Mycobacterium tuberculosis
EKAVDLGVQALAGAL

SEQ ID NO: 81026 - protein, 15 aa, Mycobacterium tuberculosis
KAVDLGVQALAGALD

SEQ ID NO: 81027 - protein, 15 aa, Mycobacterium tuberculosis
AVDLGVQALAGALDE

SEQ ID NO: 81028 - protein, 15 aa, Mycobacterium tuberculosis
VDLGVQALAGALDES

SEQ ID NO: 81029 - protein, 15 aa, Mycobacterium tuberculosis
DLGVQALAGALDESG

SEQ ID NO: 81030 - protein, 15 aa, Mycobacterium tuberculosis
LGVQALAGALDESGL

SEQ ID NO: 81031 - protein, 15 aa, Mycobacterium tuberculosis
GVQALAGALDESGLR

SEQ ID NO: 81032 - protein, 15 aa, Mycobacterium tuberculosis
VQALAGALDESGLRP

SEQ ID NO: 81033 - protein, 15 aa, Mycobacterium tuberculosis
QALAGALDESGLRPE

SEQ ID NO: 81034 - protein, 15 aa, Mycobacterium tuberculosis
ALAGALDESGLRPED

SEQ ID NO: 81035 - protein, 15 aa, Mycobacterium tuberculosis
LAGALDESGLRPEDL

SEQ ID NO: 81036 - protein, 15 aa, Mycobacterium tuberculosis
AGALDESGLRPEDLD

SEQ ID NO: 81037 - protein, 15 aa, Mycobacterium tuberculosis
GALDESGLRPEDLDV

SEQ ID NO: 81038 - protein, 15 aa, Mycobacterium tuberculosis
ALDESGLRPEDLDVL

SEQ ID NO: 81039 - protein, 15 aa, Mycobacterium tuberculosis
LDESGLRPEDLDVLI

SEQ ID NO: 81040 - protein, 15 aa, Mycobacterium tuberculosis
DESGLRPEDLDVLIT

SEQ ID NO: 81041 - protein, 15 aa, Mycobacterium tuberculosis
ESGLRPEDLDVLITA

SEQ ID NO: 81042 - protein, 15 aa, Mycobacterium tuberculosis
SGLRPEDLDVLITAT

SEQ ID NO: 81043 - protein, 15 aa, Mycobacterium tuberculosis
GLRPEDLDVLITATV

SEQ ID NO: 81044 - protein, 15 aa, Mycobacterium tuberculosis
LRPEDLDVLITATVT

SEQ ID NO: 81045 - protein, 15 aa, Mycobacterium tuberculosis
RPEDLDVLITATVTG

SEQ ID NO: 81046 - protein, 15 aa, Mycobacterium tuberculosis
PEDLDVLITATVTGL

SEQ ID NO: 81047 - protein, 15 aa, Mycobacterium tuberculosis
EDLDVLITATVTGLA

SEQ ID NO: 81048 - protein, 15 aa, Mycobacterium tuberculosis
DLDVLITATVTGLAV

SEQ ID NO: 81049 - protein, 15 aa, Mycobacterium tuberculosis
LDVLITATVTGLAVP

SEQ ID NO: 81050 - protein, 15 aa, Mycobacterium tuberculosis
DVLITATVTGLAVPS

SEQ ID NO: 81051 - protein, 15 aa, Mycobacterium tuberculosis
VLITATVTGLAVPSL

SEQ ID NO: 81052 - protein, 15 aa, Mycobacterium tuberculosis
LITATVTGLAVPSLD

SEQ ID NO: 81053 - protein, 15 aa, Mycobacterium tuberculosis
ITATVTGLAVPSLDA

SEQ ID NO: 81054 - protein, 15 aa, Mycobacterium tuberculosis
TATVTGLAVPSLDAR

SEQ ID NO: 81055 - protein, 15 aa, Mycobacterium tuberculosis
ATVTGLAVPSLDARI

SEQ ID NO: 81056 - protein, 15 aa, Mycobacterium tuberculosis
TVTGLAVPSLDARIA

SEQ ID NO: 81057 - protein, 15 aa, Mycobacterium tuberculosis
VTGLAVPSLDARIAG

SEQ ID NO: 81058 - protein, 15 aa, Mycobacterium tuberculosis
TGLAVPSLDARIAGR

SEQ ID NO: 81059 - protein, 15 aa, Mycobacterium tuberculosis
GLAVPSLDARIAGRL

SEQ ID NO: 81060 - protein, 15 aa, Mycobacterium tuberculosis
LAVPSLDARIAGRLG

SEQ ID NO: 81061 - protein, 15 aa, Mycobacterium tuberculosis
AVPSLDARIAGRLGL

SEQ ID NO: 81062 - protein, 15 aa, Mycobacterium tuberculosis
VPSLDARIAGRLGLR

SEQ ID NO: 81063 - protein, 15 aa, Mycobacterium tuberculosis
PSLDARIAGRLGLRA

SEQ ID NO: 81064 - protein, 15 aa, Mycobacterium tuberculosis
SLDARIAGRLGLRAD

SEQ ID NO: 81065 - protein, 15 aa, Mycobacterium tuberculosis
LDARIAGRLGLRADV

SEQ ID NO: 81066 - protein, 15 aa, Mycobacterium tuberculosis
DARIAGRLGLRADVR

SEQ ID NO: 81067 - protein, 15 aa, Mycobacterium tuberculosis
ARIAGRLGLRADVRR

SEQ ID NO: 81068 - protein, 15 aa, Mycobacterium tuberculosis
RIAGRLGLRADVRRV

SEQ ID NO: 81069 - protein, 15 aa, Mycobacterium tuberculosis
IAGRLGLRADVRRVP

SEQ ID NO: 81070 - protein, 15 aa, Mycobacterium tuberculosis
AGRLGLRADVRRVPL

SEQ ID NO: 81071 - protein, 15 aa, Mycobacterium tuberculosis
GRLGLRADVRRVPLF

SEQ ID NO: 81072 - protein, 15 aa, Mycobacterium tuberculosis
RLGLRADVRRVPLFG

SEQ ID NO: 81073 - protein, 15 aa, Mycobacterium tuberculosis
LGLRADVRRVPLFGL

SEQ ID NO: 81074 - protein, 15 aa, Mycobacterium tuberculosis
GLRADVRRVPLFGLG

SEQ ID NO: 81075 - protein, 15 aa, Mycobacterium tuberculosis
LRADVRRVPLFGLGC

SEQ ID NO: 81076 - protein, 15 aa, Mycobacterium tuberculosis
RADVRRVPLFGLGCV

SEQ ID NO: 81077 - protein, 15 aa, Mycobacterium tuberculosis
ADVRRVPLFGLGCVA

SEQ ID NO: 81078 - protein, 15 aa, Mycobacterium tuberculosis
DVRRVPLFGLGCVAG

SEQ ID NO: 81079 - protein, 15 aa, Mycobacterium tuberculosis
VRRVPLFGLGCVAGA

SEQ ID NO: 81080 - protein, 15 aa, Mycobacterium tuberculosis
RRVPLFGLGCVAGAA

SEQ ID NO: 81081 - protein, 15 aa, Mycobacterium tuberculosis
RVPLFGLGCVAGAAG

SEQ ID NO: 81082 - protein, 15 aa, Mycobacterium tuberculosis
VPLFGLGCVAGAAGV

SEQ ID NO: 81083 - protein, 15 aa, Mycobacterium tuberculosis
PLFGLGCVAGAAGVA

SEQ ID NO: 81084 - protein, 15 aa, Mycobacterium tuberculosis
LFGLGCVAGAAGVAR

SEQ ID NO: 81085 - protein, 15 aa, Mycobacterium tuberculosis
FGLGCVAGAAGVARL

SEQ ID NO: 81086 - protein, 15 aa, Mycobacterium tuberculosis
GLGCVAGAAGVARLH

SEQ ID NO: 81087 - protein, 15 aa, Mycobacterium tuberculosis
LGCVAGAAGVARLHD

SEQ ID NO: 81088 - protein, 15 aa, Mycobacterium tuberculosis
GCVAGAAGVARLHDY

SEQ ID NO: 81089 - protein, 15 aa, Mycobacterium tuberculosis
CVAGAAGVARLHDYL

SEQ ID NO: 81090 - protein, 15 aa, Mycobacterium tuberculosis
VAGAAGVARLHDYLR

SEQ ID NO: 81091 - protein, 15 aa, Mycobacterium tuberculosis
AGAAGVARLHDYLRG

SEQ ID NO: 81092 - protein, 15 aa, Mycobacterium tuberculosis
GAAGVARLHDYLRGA

SEQ ID NO: 81093 - protein, 15 aa, Mycobacterium tuberculosis
AAGVARLHDYLRGAP

SEQ ID NO: 81094 - protein, 15 aa, Mycobacterium tuberculosis
AGVARLHDYLRGAPD

SEQ ID NO: 81095 - protein, 15 aa, Mycobacterium tuberculosis
GVARLHDYLRGAPDG

SEQ ID NO: 81096 - protein, 15 aa, Mycobacterium tuberculosis
VARLHDYLRGAPDGV

SEQ ID NO: 81097 - protein, 15 aa, Mycobacterium tuberculosis
ARLHDYLRGAPDGVA

SEQ ID NO: 81098 - protein, 15 aa, Mycobacterium tuberculosis
RLHDYLRGAPDGVAA

SEQ ID NO: 81099 - protein, 15 aa, Mycobacterium tuberculosis
LHDYLRGAPDGVAAL

SEQ ID NO: 81100 - protein, 15 aa, Mycobacterium tuberculosis
HDYLRGAPDGVAALV

SEQ ID NO: 81101 - protein, 15 aa, Mycobacterium tuberculosis
DYLRGAPDGVAALVS

SEQ ID NO: 81102 - protein, 15 aa, Mycobacterium tuberculosis
YLRGAPDGVAALVSV

SEQ ID NO: 81103 - protein, 15 aa, Mycobacterium tuberculosis
LRGAPDGVAALVSVE

SEQ ID NO: 81104 - protein, 15 aa, Mycobacterium tuberculosis
RGAPDGVAALVSVEL

SEQ ID NO: 81105 - protein, 15 aa, Mycobacterium tuberculosis
GAPDGVAALVSVELC

SEQ ID NO: 81106 - protein, 15 aa, Mycobacterium tuberculosis
APDGVAALVSVELCS

SEQ ID NO: 81107 - protein, 15 aa, Mycobacterium tuberculosis
PDGVAALVSVELCSL

SEQ ID NO: 81108 - protein, 15 aa, Mycobacterium tuberculosis
DGVAALVSVELCSLT

SEQ ID NO: 81109 - protein, 15 aa, Mycobacterium tuberculosis
GVAALVSVELCSLTY

SEQ ID NO: 81110 - protein, 15 aa, Mycobacterium tuberculosis
VAALVSVELCSLTYP

SEQ ID NO: 81111 - protein, 15 aa, Mycobacterium tuberculosis
AALVSVELCSLTYPG

SEQ ID NO: 81112 - protein, 15 aa, Mycobacterium tuberculosis
ALVSVELCSLTYPGY

SEQ ID NO: 81113 - protein, 15 aa, Mycobacterium tuberculosis
LVSVELCSLTYPGYK

SEQ ID NO: 81114 - protein, 15 aa, Mycobacterium tuberculosis
VSVELCSLTYPGYKP

SEQ ID NO: 81115 - protein, 15 aa, Mycobacterium tuberculosis
SVELCSLTYPGYKPT

SEQ ID NO: 81116 - protein, 15 aa, Mycobacterium tuberculosis
VELCSLTYPGYKPTL

SEQ ID NO: 81117 - protein, 15 aa, Mycobacterium tuberculosis
ELCSLTYPGYKPTLP

SEQ ID NO: 81118 - protein, 15 aa, Mycobacterium tuberculosis
LCSLTYPGYKPTLPG

SEQ ID NO: 81119 - protein, 15 aa, Mycobacterium tuberculosis
CSLTYPGYKPTLPGL

SEQ ID NO: 81120 - protein, 15 aa, Mycobacterium tuberculosis
SLTYPGYKPTLPGLV

SEQ ID NO: 81121 - protein, 15 aa, Mycobacterium tuberculosis
LTYPGYKPTLPGLVG

SEQ ID NO: 81122 - protein, 15 aa, Mycobacterium tuberculosis
TYPGYKPTLPGLVGS

SEQ ID NO: 81123 - protein, 15 aa, Mycobacterium tuberculosis
YPGYKPTLPGLVGSA

SEQ ID NO: 81124 - protein, 15 aa, Mycobacterium tuberculosis
PGYKPTLPGLVGSAL

SEQ ID NO: 81125 - protein, 15 aa, Mycobacterium tuberculosis
GYKPTLPGLVGSALF

SEQ ID NO: 81126 - protein, 15 aa, Mycobacterium tuberculosis
YKPTLPGLVGSALFA

SEQ ID NO: 81127 - protein, 15 aa, Mycobacterium tuberculosis
KPTLPGLVGSALFAD

SEQ ID NO: 81128 - protein, 15 aa, Mycobacterium tuberculosis
PTLPGLVGSALFADG

SEQ ID NO: 81129 - protein, 15 aa, Mycobacterium tuberculosis
TLPGLVGSALFADGA

SEQ ID NO: 81130 - protein, 15 aa, Mycobacterium tuberculosis
LPGLVGSALFADGAA

SEQ ID NO: 81131 - protein, 15 aa, Mycobacterium tuberculosis
PGLVGSALFADGAAA

SEQ ID NO: 81132 - protein, 15 aa, Mycobacterium tuberculosis
GLVGSALFADGAAAV

SEQ ID NO: 81133 - protein, 15 aa, Mycobacterium tuberculosis
LVGSALFADGAAAVV

SEQ ID NO: 81134 - protein, 15 aa, Mycobacterium tuberculosis
VGSALFADGAAAVVA

SEQ ID NO: 81135 - protein, 15 aa, Mycobacterium tuberculosis
GSALFADGAAAVVAA

SEQ ID NO: 81136 - protein, 15 aa, Mycobacterium tuberculosis
SALFADGAAAVVAAG

SEQ ID NO: 81137 - protein, 15 aa, Mycobacterium tuberculosis
ALFADGAAAVVAAGV

SEQ ID NO: 81138 - protein, 15 aa, Mycobacterium tuberculosis
LFADGAAAVVAAGVK

SEQ ID NO: 81139 - protein, 15 aa, Mycobacterium tuberculosis
FADGAAAVVAAGVKR

SEQ ID NO: 81140 - protein, 15 aa, Mycobacterium tuberculosis
ADGAAAVVAAGVKRA

SEQ ID NO: 81141 - protein, 15 aa, Mycobacterium tuberculosis
DGAAAVVAAGVKRAQ

SEQ ID NO: 81142 - protein, 15 aa, Mycobacterium tuberculosis
GAAAVVAAGVKRAQD

SEQ ID NO: 81143 - protein, 15 aa, Mycobacterium tuberculosis
AAAVVAAGVKRAQDI

SEQ ID NO: 81144 - protein, 15 aa, Mycobacterium tuberculosis
AAVVAAGVKRAQDIG

SEQ ID NO: 81145 - protein, 15 aa, Mycobacterium tuberculosis
AVVAAGVKRAQDIGA

SEQ ID NO: 81146 - protein, 15 aa, Mycobacterium tuberculosis
VVAAGVKRAQDIGAD

SEQ ID NO: 81147 - protein, 15 aa, Mycobacterium tuberculosis
VAAGVKRAQDIGADG

SEQ ID NO: 81148 - protein, 15 aa, Mycobacterium tuberculosis
AAGVKRAQDIGADGP

SEQ ID NO: 81149 - protein, 15 aa, Mycobacterium tuberculosis
AGVKRAQDIGADGPD

SEQ ID NO: 81150 - protein, 15 aa, Mycobacterium tuberculosis
GVKRAQDIGADGPDI

SEQ ID NO: 81151 - protein, 15 aa, Mycobacterium tuberculosis
VKRAQDIGADGPDIL

SEQ ID NO: 81152 - protein, 15 aa, Mycobacterium tuberculosis
KRAQDIGADGPDILD

SEQ ID NO: 81153 - protein, 15 aa, Mycobacterium tuberculosis
RAQDIGADGPDILDS

SEQ ID NO: 81154 - protein, 15 aa, Mycobacterium tuberculosis
AQDIGADGPDILDSR

SEQ ID NO: 81155 - protein, 15 aa, Mycobacterium tuberculosis
QDIGADGPDILDSRS

SEQ ID NO: 81156 - protein, 15 aa, Mycobacterium tuberculosis
DIGADGPDILDSRSH

SEQ ID NO: 81157 - protein, 15 aa, Mycobacterium tuberculosis
IGADGPDILDSRSHL

SEQ ID NO: 81158 - protein, 15 aa, Mycobacterium tuberculosis
GADGPDILDSRSHLY

SEQ ID NO: 81159 - protein, 15 aa, Mycobacterium tuberculosis
ADGPDILDSRSHLYP

SEQ ID NO: 81160 - protein, 15 aa, Mycobacterium tuberculosis
DGPDILDSRSHLYPD

SEQ ID NO: 81161 - protein, 15 aa, Mycobacterium tuberculosis
GPDILDSRSHLYPDS

SEQ ID NO: 81162 - protein, 15 aa, Mycobacterium tuberculosis
PDILDSRSHLYPDSL

SEQ ID NO: 81163 - protein, 15 aa, Mycobacterium tuberculosis
DILDSRSHLYPDSLR

SEQ ID NO: 81164 - protein, 15 aa, Mycobacterium tuberculosis
ILDSRSHLYPDSLRT

SEQ ID NO: 81165 - protein, 15 aa, Mycobacterium tuberculosis
LDSRSHLYPDSLRTM

SEQ ID NO: 81166 - protein, 15 aa, Mycobacterium tuberculosis
DSRSHLYPDSLRTMG

SEQ ID NO: 81167 - protein, 15 aa, Mycobacterium tuberculosis
SRSHLYPDSLRTMGY

SEQ ID NO: 81168 - protein, 15 aa, Mycobacterium tuberculosis
RSHLYPDSLRTMGYD

SEQ ID NO: 81169 - protein, 15 aa, Mycobacterium tuberculosis
SHLYPDSLRTMGYDV

SEQ ID NO: 81170 - protein, 15 aa, Mycobacterium tuberculosis
HLYPDSLRTMGYDVG

SEQ ID NO: 81171 - protein, 15 aa, Mycobacterium tuberculosis
LYPDSLRTMGYDVGS

SEQ ID NO: 81172 - protein, 15 aa, Mycobacterium tuberculosis
YPDSLRTMGYDVGSA

SEQ ID NO: 81173 - protein, 15 aa, Mycobacterium tuberculosis
PDSLRTMGYDVGSAG

SEQ ID NO: 81174 - protein, 15 aa, Mycobacterium tuberculosis
DSLRTMGYDVGSAGF

SEQ ID NO: 81175 - protein, 15 aa, Mycobacterium tuberculosis
SLRTMGYDVGSAGFE

SEQ ID NO: 81176 - protein, 15 aa, Mycobacterium tuberculosis
LRTMGYDVGSAGFEL

SEQ ID NO: 81177 - protein, 15 aa, Mycobacterium tuberculosis
RTMGYDVGSAGFELV

SEQ ID NO: 81178 - protein, 15 aa, Mycobacterium tuberculosis
TMGYDVGSAGFELVL

SEQ ID NO: 81179 - protein, 15 aa, Mycobacterium tuberculosis
MGYDVGSAGFELVLS

SEQ ID NO: 81180 - protein, 15 aa, Mycobacterium tuberculosis
GYDVGSAGFELVLSR

SEQ ID NO: 81181 - protein, 15 aa, Mycobacterium tuberculosis
YDVGSAGFELVLSRD

SEQ ID NO: 81182 - protein, 15 aa, Mycobacterium tuberculosis
DVGSAGFELVLSRDL

SEQ ID NO: 81183 - protein, 15 aa, Mycobacterium tuberculosis
VGSAGFELVLSRDLA

SEQ ID NO: 81184 - protein, 15 aa, Mycobacterium tuberculosis
GSAGFELVLSRDLAA

SEQ ID NO: 81185 - protein, 15 aa, Mycobacterium tuberculosis
SAGFELVLSRDLAAV

SEQ ID NO: 81186 - protein, 15 aa, Mycobacterium tuberculosis
AGFELVLSRDLAAVV

SEQ ID NO: 81187 - protein, 15 aa, Mycobacterium tuberculosis
GFELVLSRDLAAVVE

SEQ ID NO: 81188 - protein, 15 aa, Mycobacterium tuberculosis
FELVLSRDLAAVVEQ

SEQ ID NO: 81189 - protein, 15 aa, Mycobacterium tuberculosis
ELVLSRDLAAVVEQY

SEQ ID NO: 81190 - protein, 15 aa, Mycobacterium tuberculosis
LVLSRDLAAVVEQYL

SEQ ID NO: 81191 - protein, 15 aa, Mycobacterium tuberculosis
VLSRDLAAVVEQYLG

SEQ ID NO: 81192 - protein, 15 aa, Mycobacterium tuberculosis
LSRDLAAVVEQYLGN

SEQ ID NO: 81193 - protein, 15 aa, Mycobacterium tuberculosis
SRDLAAVVEQYLGND

SEQ ID NO: 81194 - protein, 15 aa, Mycobacterium tuberculosis
RDLAAVVEQYLGNDV

SEQ ID NO: 81195 - protein, 15 aa, Mycobacterium tuberculosis
DLAAVVEQYLGNDVT

SEQ ID NO: 81196 - protein, 15 aa, Mycobacterium tuberculosis
LAAVVEQYLGNDVTT

SEQ ID NO: 81197 - protein, 15 aa, Mycobacterium tuberculosis
AAVVEQYLGNDVTTF

SEQ ID NO: 81198 - protein, 15 aa, Mycobacterium tuberculosis
AVVEQYLGNDVTTFL

SEQ ID NO: 81199 - protein, 15 aa, Mycobacterium tuberculosis
VVEQYLGNDVTTFLA

SEQ ID NO: 81200 - protein, 15 aa, Mycobacterium tuberculosis
VEQYLGNDVTTFLAS

SEQ ID NO: 81201 - protein, 15 aa, Mycobacterium tuberculosis
EQYLGNDVTTFLASH

SEQ ID NO: 81202 - protein, 15 aa, Mycobacterium tuberculosis
QYLGNDVTTFLASHG

SEQ ID NO: 81203 - protein, 15 aa, Mycobacterium tuberculosis
YLGNDVTTFLASHGL

SEQ ID NO: 81204 - protein, 15 aa, Mycobacterium tuberculosis
LGNDVTTFLASHGLS

SEQ ID NO: 81205 - protein, 15 aa, Mycobacterium tuberculosis
GNDVTTFLASHGLST

SEQ ID NO: 81206 - protein, 15 aa, Mycobacterium tuberculosis
NDVTTFLASHGLSTT

SEQ ID NO: 81207 - protein, 15 aa, Mycobacterium tuberculosis
DVTTFLASHGLSTTD

SEQ ID NO: 81208 - protein, 15 aa, Mycobacterium tuberculosis
VTTFLASHGLSTTDV

SEQ ID NO: 81209 - protein, 15 aa, Mycobacterium tuberculosis
TTFLASHGLSTTDVG

SEQ ID NO: 81210 - protein, 15 aa, Mycobacterium tuberculosis
TFLASHGLSTTDVGA

SEQ ID NO: 81211 - protein, 15 aa, Mycobacterium tuberculosis
FLASHGLSTTDVGAW

SEQ ID NO: 81212 - protein, 15 aa, Mycobacterium tuberculosis
LASHGLSTTDVGAWV

SEQ ID NO: 81213 - protein, 15 aa, Mycobacterium tuberculosis
ASHGLSTTDVGAWVT

SEQ ID NO: 81214 - protein, 15 aa, Mycobacterium tuberculosis
SHGLSTTDVGAWVTH

SEQ ID NO: 81215 - protein, 15 aa, Mycobacterium tuberculosis
HGLSTTDVGAWVTHP

SEQ ID NO: 81216 - protein, 15 aa, Mycobacterium tuberculosis
GLSTTDVGAWVTHPG

SEQ ID NO: 81217 - protein, 15 aa, Mycobacterium tuberculosis
LSTTDVGAWVTHPGG

SEQ ID NO: 81218 - protein, 15 aa, Mycobacterium tuberculosis
STTDVGAWVTHPGGP

SEQ ID NO: 81219 - protein, 15 aa, Mycobacterium tuberculosis
TTDVGAWVTHPGGPK

SEQ ID NO: 81220 - protein, 15 aa, Mycobacterium tuberculosis
TDVGAWVTHPGGPKI

SEQ ID NO: 81221 - protein, 15 aa, Mycobacterium tuberculosis
DVGAWVTHPGGPKII

SEQ ID NO: 81222 - protein, 15 aa, Mycobacterium tuberculosis
VGAWVTHPGGPKIIN

SEQ ID NO: 81223 - protein, 15 aa, Mycobacterium tuberculosis
GAWVTHPGGPKIINA

SEQ ID NO: 81224 - protein, 15 aa, Mycobacterium tuberculosis
AWVTHPGGPKIINAI

SEQ ID NO: 81225 - protein, 15 aa, Mycobacterium tuberculosis
WVTHPGGPKIINAIT

SEQ ID NO: 81226 - protein, 15 aa, Mycobacterium tuberculosis
VTHPGGPKIINAITE

SEQ ID NO: 81227 - protein, 15 aa, Mycobacterium tuberculosis
THPGGPKIINAITET

SEQ ID NO: 81228 - protein, 15 aa, Mycobacterium tuberculosis
HPGGPKIINAITETL

SEQ ID NO: 81229 - protein, 15 aa, Mycobacterium tuberculosis
PGGPKIINAITETLD

SEQ ID NO: 81230 - protein, 15 aa, Mycobacterium tuberculosis
GGPKIINAITETLDL

SEQ ID NO: 81231 - protein, 15 aa, Mycobacterium tuberculosis
GPKIINAITETLDLS

SEQ ID NO: 81232 - protein, 15 aa, Mycobacterium tuberculosis
PKIINAITETLDLSP

SEQ ID NO: 81233 - protein, 15 aa, Mycobacterium tuberculosis
KIINAITETLDLSPQ

SEQ ID NO: 81234 - protein, 15 aa, Mycobacterium tuberculosis
IINAITETLDLSPQA

SEQ ID NO: 81235 - protein, 15 aa, Mycobacterium tuberculosis
INAITETLDLSPQAL

SEQ ID NO: 81236 - protein, 15 aa, Mycobacterium tuberculosis
NAITETLDLSPQALE

SEQ ID NO: 81237 - protein, 15 aa, Mycobacterium tuberculosis
AITETLDLSPQALEL

SEQ ID NO: 81238 - protein, 15 aa, Mycobacterium tuberculosis
ITETLDLSPQALELT

SEQ ID NO: 81239 - protein, 15 aa, Mycobacterium tuberculosis
TETLDLSPQALELTW

SEQ ID NO: 81240 - protein, 15 aa, Mycobacterium tuberculosis
ETLDLSPQALELTWR

SEQ ID NO: 81241 - protein, 15 aa, Mycobacterium tuberculosis
TLDLSPQALELTWRS

SEQ ID NO: 81242 - protein, 15 aa, Mycobacterium tuberculosis
LDLSPQALELTWRSL

SEQ ID NO: 81243 - protein, 15 aa, Mycobacterium tuberculosis
DLSPQALELTWRSLG

SEQ ID NO: 81244 - protein, 15 aa, Mycobacterium tuberculosis
LSPQALELTWRSLGE

SEQ ID NO: 81245 - protein, 15 aa, Mycobacterium tuberculosis
SPQALELTWRSLGEI

SEQ ID NO: 81246 - protein, 15 aa, Mycobacterium tuberculosis
PQALELTWRSLGEIG

SEQ ID NO: 81247 - protein, 15 aa, Mycobacterium tuberculosis
QALELTWRSLGEIGN

SEQ ID NO: 81248 - protein, 15 aa, Mycobacterium tuberculosis
ALELTWRSLGEIGNL

SEQ ID NO: 81249 - protein, 15 aa, Mycobacterium tuberculosis
LELTWRSLGEIGNLS

SEQ ID NO: 81250 - protein, 15 aa, Mycobacterium tuberculosis
ELTWRSLGEIGNLSS

SEQ ID NO: 81251 - protein, 15 aa, Mycobacterium tuberculosis
LTWRSLGEIGNLSSA

SEQ ID NO: 81252 - protein, 15 aa, Mycobacterium tuberculosis
TWRSLGEIGNLSSAS

SEQ ID NO: 81253 - protein, 15 aa, Mycobacterium tuberculosis
WRSLGEIGNLSSASV

SEQ ID NO: 81254 - protein, 15 aa, Mycobacterium tuberculosis
RSLGEIGNLSSASVL

SEQ ID NO: 81255 - protein, 15 aa, Mycobacterium tuberculosis
SLGEIGNLSSASVLH

SEQ ID NO: 81256 - protein, 15 aa, Mycobacterium tuberculosis
LGEIGNLSSASVLHV

SEQ ID NO: 81257 - protein, 15 aa, Mycobacterium tuberculosis
GEIGNLSSASVLHVL

SEQ ID NO: 81258 - protein, 15 aa, Mycobacterium tuberculosis
EIGNLSSASVLHVLR

SEQ ID NO: 81259 - protein, 15 aa, Mycobacterium tuberculosis
IGNLSSASVLHVLRD

SEQ ID NO: 81260 - protein, 15 aa, Mycobacterium tuberculosis
GNLSSASVLHVLRDT

SEQ ID NO: 81261 - protein, 15 aa, Mycobacterium tuberculosis
NLSSASVLHVLRDTI

SEQ ID NO: 81262 - protein, 15 aa, Mycobacterium tuberculosis
LSSASVLHVLRDTIA

SEQ ID NO: 81263 - protein, 15 aa, Mycobacterium tuberculosis
SSASVLHVLRDTIAK

SEQ ID NO: 81264 - protein, 15 aa, Mycobacterium tuberculosis
SASVLHVLRDTIAKP

SEQ ID NO: 81265 - protein, 15 aa, Mycobacterium tuberculosis
ASVLHVLRDTIAKPP

SEQ ID NO: 81266 - protein, 15 aa, Mycobacterium tuberculosis
SVLHVLRDTIAKPPP

SEQ ID NO: 81267 - protein, 15 aa, Mycobacterium tuberculosis
VLHVLRDTIAKPPPS

SEQ ID NO: 81268 - protein, 15 aa, Mycobacterium tuberculosis
LHVLRDTIAKPPPSG

SEQ ID NO: 81269 - protein, 15 aa, Mycobacterium tuberculosis
HVLRDTIAKPPPSGS

SEQ ID NO: 81270 - protein, 15 aa, Mycobacterium tuberculosis
VLRDTIAKPPPSGSP

SEQ ID NO: 81271 - protein, 15 aa, Mycobacterium tuberculosis
LRDTIAKPPPSGSPG

SEQ ID NO: 81272 - protein, 15 aa, Mycobacterium tuberculosis
RDTIAKPPPSGSPGL

SEQ ID NO: 81273 - protein, 15 aa, Mycobacterium tuberculosis
DTIAKPPPSGSPGLM

SEQ ID NO: 81274 - protein, 15 aa, Mycobacterium tuberculosis
TIAKPPPSGSPGLMI

SEQ ID NO: 81275 - protein, 15 aa, Mycobacterium tuberculosis
IAKPPPSGSPGLMIA

SEQ ID NO: 81276 - protein, 15 aa, Mycobacterium tuberculosis
AKPPPSGSPGLMIAM

SEQ ID NO: 81277 - protein, 15 aa, Mycobacterium tuberculosis
KPPPSGSPGLMIAMG

SEQ ID NO: 81278 - protein, 15 aa, Mycobacterium tuberculosis
PPPSGSPGLMIAMGP

SEQ ID NO: 81279 - protein, 15 aa, Mycobacterium tuberculosis
PPSGSPGLMIAMGPG

SEQ ID NO: 81280 - protein, 15 aa, Mycobacterium tuberculosis
PSGSPGLMIAMGPGF

SEQ ID NO: 81281 - protein, 15 aa, Mycobacterium tuberculosis
SGSPGLMIAMGPGFC

SEQ ID NO: 81282 - protein, 15 aa, Mycobacterium tuberculosis
GSPGLMIAMGPGFCS

SEQ ID NO: 81283 - protein, 15 aa, Mycobacterium tuberculosis
SPGLMIAMGPGFCSE

SEQ ID NO: 81284 - protein, 15 aa, Mycobacterium tuberculosis
PGLMIAMGPGFCSEL

SEQ ID NO: 81285 - protein, 15 aa, Mycobacterium tuberculosis
GLMIAMGPGFCSELV

SEQ ID NO: 81286 - protein, 15 aa, Mycobacterium tuberculosis
LMIAMGPGFCSELVL

SEQ ID NO: 81287 - protein, 15 aa, Mycobacterium tuberculosis
MIAMGPGFCSELVLL

SEQ ID NO: 81288 - protein, 15 aa, Mycobacterium tuberculosis
IAMGPGFCSELVLLR

SEQ ID NO: 81289 - protein, 15 aa, Mycobacterium tuberculosis
AMGPGFCSELVLLRW

SEQ ID NO: 81290 - protein, 15 aa, Mycobacterium tuberculosis
MGPGFCSELVLLRWH

SEQ ID NO: 81291 - protein, 16 aa, Mycobacterium tuberculosis
MSVIAGVFGALPPYRY

SEQ ID NO: 81292 - protein, 16 aa, Mycobacterium tuberculosis
SVIAGVFGALPPYRYS

SEQ ID NO: 81293 - protein, 16 aa, Mycobacterium tuberculosis
VIAGVFGALPPYRYSQ

SEQ ID NO: 81294 - protein, 16 aa, Mycobacterium tuberculosis
IAGVFGALPPYRYSQR

SEQ ID NO: 81295 - protein, 16 aa, Mycobacterium tuberculosis
AGVFGALPPYRYSQRE

SEQ ID NO: 81296 - protein, 16 aa, Mycobacterium tuberculosis
GVFGALPPYRYSQREL

SEQ ID NO: 81297 - protein, 16 aa, Mycobacterium tuberculosis
VFGALPPYRYSQRELT

SEQ ID NO: 81298 - protein, 16 aa, Mycobacterium tuberculosis
FGALPPYRYSQRELTD

SEQ ID NO: 81299 - protein, 16 aa, Mycobacterium tuberculosis
GALPPYRYSQRELTDS

SEQ ID NO: 81300 - protein, 16 aa, Mycobacterium tuberculosis
ALPPYRYSQRELTDSF

SEQ ID NO: 81301 - protein, 16 aa, Mycobacterium tuberculosis
LPPYRYSQRELTDSFV

SEQ ID NO: 81302 - protein, 16 aa, Mycobacterium tuberculosis
PPYRYSQRELTDSFVS

SEQ ID NO: 81303 - protein, 16 aa, Mycobacterium tuberculosis
PYRYSQRELTDSFVSI

SEQ ID NO: 81304 - protein, 16 aa, Mycobacterium tuberculosis
YRYSQRELTDSFVSIP

SEQ ID NO: 81305 - protein, 16 aa, Mycobacterium tuberculosis
RYSQRELTDSFVSIPD

SEQ ID NO: 81306 - protein, 16 aa, Mycobacterium tuberculosis
YSQRELTDSFVSIPDF

SEQ ID NO: 81307 - protein, 16 aa, Mycobacterium tuberculosis
SQRELTDSFVSIPDFE

SEQ ID NO: 81308 - protein, 16 aa, Mycobacterium tuberculosis
QRELTDSFVSIPDFEG

SEQ ID NO: 81309 - protein, 16 aa, Mycobacterium tuberculosis
RELTDSFVSIPDFEGY

SEQ ID NO: 81310 - protein, 16 aa, Mycobacterium tuberculosis
ELTDSFVSIPDFEGYE

SEQ ID NO: 81311 - protein, 16 aa, Mycobacterium tuberculosis
LTDSFVSIPDFEGYED

SEQ ID NO: 81312 - protein, 16 aa, Mycobacterium tuberculosis
TDSFVSIPDFEGYEDI

SEQ ID NO: 81313 - protein, 16 aa, Mycobacterium tuberculosis
DSFVSIPDFEGYEDIV

SEQ ID NO: 81314 - protein, 16 aa, Mycobacterium tuberculosis
SFVSIPDFEGYEDIVR

SEQ ID NO: 81315 - protein, 16 aa, Mycobacterium tuberculosis
FVSIPDFEGYEDIVRQ

SEQ ID NO: 81316 - protein, 16 aa, Mycobacterium tuberculosis
VSIPDFEGYEDIVRQL

SEQ ID NO: 81317 - protein, 16 aa, Mycobacterium tuberculosis
SIPDFEGYEDIVRQLH

SEQ ID NO: 81318 - protein, 16 aa, Mycobacterium tuberculosis
IPDFEGYEDIVRQLHA

SEQ ID NO: 81319 - protein, 16 aa, Mycobacterium tuberculosis
PDFEGYEDIVRQLHAS

SEQ ID NO: 81320 - protein, 16 aa, Mycobacterium tuberculosis
DFEGYEDIVRQLHASA

SEQ ID NO: 81321 - protein, 16 aa, Mycobacterium tuberculosis
FEGYEDIVRQLHASAK

SEQ ID NO: 81322 - protein, 16 aa, Mycobacterium tuberculosis
EGYEDIVRQLHASAKV

SEQ ID NO: 81323 - protein, 16 aa, Mycobacterium tuberculosis
GYEDIVRQLHASAKVN

SEQ ID NO: 81324 - protein, 16 aa, Mycobacterium tuberculosis
YEDIVRQLHASAKVNS

SEQ ID NO: 81325 - protein, 16 aa, Mycobacterium tuberculosis
EDIVRQLHASAKVNSR

SEQ ID NO: 81326 - protein, 16 aa, Mycobacterium tuberculosis
DIVRQLHASAKVNSRH

SEQ ID NO: 81327 - protein, 16 aa, Mycobacterium tuberculosis
IVRQLHASAKVNSRHL

SEQ ID NO: 81328 - protein, 16 aa, Mycobacterium tuberculosis
VRQLHASAKVNSRHLV

SEQ ID NO: 81329 - protein, 16 aa, Mycobacterium tuberculosis
RQLHASAKVNSRHLVL

SEQ ID NO: 81330 - protein, 16 aa, Mycobacterium tuberculosis
QLHASAKVNSRHLVLP

SEQ ID NO: 81331 - protein, 16 aa, Mycobacterium tuberculosis
LHASAKVNSRHLVLPL

SEQ ID NO: 81332 - protein, 16 aa, Mycobacterium tuberculosis
HASAKVNSRHLVLPLE

SEQ ID NO: 81333 - protein, 16 aa, Mycobacterium tuberculosis
ASAKVNSRHLVLPLEK

SEQ ID NO: 81334 - protein, 16 aa, Mycobacterium tuberculosis
SAKVNSRHLVLPLEKY

SEQ ID NO: 81335 - protein, 16 aa, Mycobacterium tuberculosis
AKVNSRHLVLPLEKYP

SEQ ID NO: 81336 - protein, 16 aa, Mycobacterium tuberculosis
KVNSRHLVLPLEKYPK

SEQ ID NO: 81337 - protein, 16 aa, Mycobacterium tuberculosis
VNSRHLVLPLEKYPKL

SEQ ID NO: 81338 - protein, 16 aa, Mycobacterium tuberculosis
NSRHLVLPLEKYPKLT

SEQ ID NO: 81339 - protein, 16 aa, Mycobacterium tuberculosis
SRHLVLPLEKYPKLTD

SEQ ID NO: 81340 - protein, 16 aa, Mycobacterium tuberculosis
RHLVLPLEKYPKLTDF

SEQ ID NO: 81341 - protein, 16 aa, Mycobacterium tuberculosis
HLVLPLEKYPKLTDFG

SEQ ID NO: 81342 - protein, 16 aa, Mycobacterium tuberculosis
LVLPLEKYPKLTDFGE

SEQ ID NO: 81343 - protein, 16 aa, Mycobacterium tuberculosis
VLPLEKYPKLTDFGEA

SEQ ID NO: 81344 - protein, 16 aa, Mycobacterium tuberculosis
LPLEKYPKLTDFGEAN

SEQ ID NO: 81345 - protein, 16 aa, Mycobacterium tuberculosis
PLEKYPKLTDFGEANK

SEQ ID NO: 81346 - protein, 16 aa, Mycobacterium tuberculosis
LEKYPKLTDFGEANKI

SEQ ID NO: 81347 - protein, 16 aa, Mycobacterium tuberculosis
EKYPKLTDFGEANKIF

SEQ ID NO: 81348 - protein, 16 aa, Mycobacterium tuberculosis
KYPKLTDFGEANKIFI

SEQ ID NO: 81349 - protein, 16 aa, Mycobacterium tuberculosis
YPKLTDFGEANKIFIE

SEQ ID NO: 81350 - protein, 16 aa, Mycobacterium tuberculosis
PKLTDFGEANKIFIEK

SEQ ID NO: 81351 - protein, 16 aa, Mycobacterium tuberculosis
KLTDFGEANKIFIEKA

SEQ ID NO: 81352 - protein, 16 aa, Mycobacterium tuberculosis
LTDFGEANKIFIEKAV

SEQ ID NO: 81353 - protein, 16 aa, Mycobacterium tuberculosis
TDFGEANKIFIEKAVD

SEQ ID NO: 81354 - protein, 16 aa, Mycobacterium tuberculosis
DFGEANKIFIEKAVDL

SEQ ID NO: 81355 - protein, 16 aa, Mycobacterium tuberculosis
FGEANKIFIEKAVDLG

SEQ ID NO: 81356 - protein, 16 aa, Mycobacterium tuberculosis
GEANKIFIEKAVDLGV

SEQ ID NO: 81357 - protein, 16 aa, Mycobacterium tuberculosis
EANKIFIEKAVDLGVQ

SEQ ID NO: 81358 - protein, 16 aa, Mycobacterium tuberculosis
ANKIFIEKAVDLGVQA

SEQ ID NO: 81359 - protein, 16 aa, Mycobacterium tuberculosis
NKIFIEKAVDLGVQAL

SEQ ID NO: 81360 - protein, 16 aa, Mycobacterium tuberculosis
KIFIEKAVDLGVQALA

SEQ ID NO: 81361 - protein, 16 aa, Mycobacterium tuberculosis
IFIEKAVDLGVQALAG

SEQ ID NO: 81362 - protein, 16 aa, Mycobacterium tuberculosis
FIEKAVDLGVQALAGA

SEQ ID NO: 81363 - protein, 16 aa, Mycobacterium tuberculosis
IEKAVDLGVQALAGAL

SEQ ID NO: 81364 - protein, 16 aa, Mycobacterium tuberculosis
EKAVDLGVQALAGALD

SEQ ID NO: 81365 - protein, 16 aa, Mycobacterium tuberculosis
KAVDLGVQALAGALDE

SEQ ID NO: 81366 - protein, 16 aa, Mycobacterium tuberculosis
AVDLGVQALAGALDES

SEQ ID NO: 81367 - protein, 16 aa, Mycobacterium tuberculosis
VDLGVQALAGALDESG

SEQ ID NO: 81368 - protein, 16 aa, Mycobacterium tuberculosis
DLGVQALAGALDESGL

SEQ ID NO: 81369 - protein, 16 aa, Mycobacterium tuberculosis
LGVQALAGALDESGLR

SEQ ID NO: 81370 - protein, 16 aa, Mycobacterium tuberculosis
GVQALAGALDESGLRP

SEQ ID NO: 81371 - protein, 16 aa, Mycobacterium tuberculosis
VQALAGALDESGLRPE

SEQ ID NO: 81372 - protein, 16 aa, Mycobacterium tuberculosis
QALAGALDESGLRPED

SEQ ID NO: 81373 - protein, 16 aa, Mycobacterium tuberculosis
ALAGALDESGLRPEDL

SEQ ID NO: 81374 - protein, 16 aa, Mycobacterium tuberculosis
LAGALDESGLRPEDLD

SEQ ID NO: 81375 - protein, 16 aa, Mycobacterium tuberculosis
AGALDESGLRPEDLDV

SEQ ID NO: 81376 - protein, 16 aa, Mycobacterium tuberculosis
GALDESGLRPEDLDVL

SEQ ID NO: 81377 - protein, 16 aa, Mycobacterium tuberculosis
ALDESGLRPEDLDVLI

SEQ ID NO: 81378 - protein, 16 aa, Mycobacterium tuberculosis
LDESGLRPEDLDVLIT

SEQ ID NO: 81379 - protein, 16 aa, Mycobacterium tuberculosis
DESGLRPEDLDVLITA

SEQ ID NO: 81380 - protein, 16 aa, Mycobacterium tuberculosis
ESGLRPEDLDVLITAT

SEQ ID NO: 81381 - protein, 16 aa, Mycobacterium tuberculosis
SGLRPEDLDVLITATV

SEQ ID NO: 81382 - protein, 16 aa, Mycobacterium tuberculosis
GLRPEDLDVLITATVT

SEQ ID NO: 81383 - protein, 16 aa, Mycobacterium tuberculosis
LRPEDLDVLITATVTG

SEQ ID NO: 81384 - protein, 16 aa, Mycobacterium tuberculosis
RPEDLDVLITATVTGL

SEQ ID NO: 81385 - protein, 16 aa, Mycobacterium tuberculosis
PEDLDVLITATVTGLA

SEQ ID NO: 81386 - protein, 16 aa, Mycobacterium tuberculosis
EDLDVLITATVTGLAV

SEQ ID NO: 81387 - protein, 16 aa, Mycobacterium tuberculosis
DLDVLITATVTGLAVP

SEQ ID NO: 81388 - protein, 16 aa, Mycobacterium tuberculosis
LDVLITATVTGLAVPS

SEQ ID NO: 81389 - protein, 16 aa, Mycobacterium tuberculosis
DVLITATVTGLAVPSL

SEQ ID NO: 81390 - protein, 16 aa, Mycobacterium tuberculosis
VLITATVTGLAVPSLD

SEQ ID NO: 81391 - protein, 16 aa, Mycobacterium tuberculosis
LITATVTGLAVPSLDA

SEQ ID NO: 81392 - protein, 16 aa, Mycobacterium tuberculosis
ITATVTGLAVPSLDAR

SEQ ID NO: 81393 - protein, 16 aa, Mycobacterium tuberculosis
TATVTGLAVPSLDARI

SEQ ID NO: 81394 - protein, 16 aa, Mycobacterium tuberculosis
ATVTGLAVPSLDARIA

SEQ ID NO: 81395 - protein, 16 aa, Mycobacterium tuberculosis
TVTGLAVPSLDARIAG

SEQ ID NO: 81396 - protein, 16 aa, Mycobacterium tuberculosis
VTGLAVPSLDARIAGR

SEQ ID NO: 81397 - protein, 16 aa, Mycobacterium tuberculosis
TGLAVPSLDARIAGRL

SEQ ID NO: 81398 - protein, 16 aa, Mycobacterium tuberculosis
GLAVPSLDARIAGRLG

SEQ ID NO: 81399 - protein, 16 aa, Mycobacterium tuberculosis
LAVPSLDARIAGRLGL

SEQ ID NO: 81400 - protein, 16 aa, Mycobacterium tuberculosis
AVPSLDARIAGRLGLR

SEQ ID NO: 81401 - protein, 16 aa, Mycobacterium tuberculosis
VPSLDARIAGRLGLRA

SEQ ID NO: 81402 - protein, 16 aa, Mycobacterium tuberculosis
PSLDARIAGRLGLRAD

SEQ ID NO: 81403 - protein, 16 aa, Mycobacterium tuberculosis
SLDARIAGRLGLRADV

SEQ ID NO: 81404 - protein, 16 aa, Mycobacterium tuberculosis
LDARIAGRLGLRADVR

SEQ ID NO: 81405 - protein, 16 aa, Mycobacterium tuberculosis
DARIAGRLGLRADVRR

SEQ ID NO: 81406 - protein, 16 aa, Mycobacterium tuberculosis
ARIAGRLGLRADVRRV

SEQ ID NO: 81407 - protein, 16 aa, Mycobacterium tuberculosis
RIAGRLGLRADVRRVP

SEQ ID NO: 81408 - protein, 16 aa, Mycobacterium tuberculosis
IAGRLGLRADVRRVPL

SEQ ID NO: 81409 - protein, 16 aa, Mycobacterium tuberculosis
AGRLGLRADVRRVPLF

SEQ ID NO: 81410 - protein, 16 aa, Mycobacterium tuberculosis
GRLGLRADVRRVPLFG

SEQ ID NO: 81411 - protein, 16 aa, Mycobacterium tuberculosis
RLGLRADVRRVPLFGL

SEQ ID NO: 81412 - protein, 16 aa, Mycobacterium tuberculosis
LGLRADVRRVPLFGLG

SEQ ID NO: 81413 - protein, 16 aa, Mycobacterium tuberculosis
GLRADVRRVPLFGLGC

SEQ ID NO: 81414 - protein, 16 aa, Mycobacterium tuberculosis
LRADVRRVPLFGLGCV

SEQ ID NO: 81415 - protein, 16 aa, Mycobacterium tuberculosis
RADVRRVPLFGLGCVA

SEQ ID NO: 81416 - protein, 16 aa, Mycobacterium tuberculosis
ADVRRVPLFGLGCVAG

SEQ ID NO: 81417 - protein, 16 aa, Mycobacterium tuberculosis
DVRRVPLFGLGCVAGA

SEQ ID NO: 81418 - protein, 16 aa, Mycobacterium tuberculosis
VRRVPLFGLGCVAGAA

SEQ ID NO: 81419 - protein, 16 aa, Mycobacterium tuberculosis
RRVPLFGLGCVAGAAG

SEQ ID NO: 81420 - protein, 16 aa, Mycobacterium tuberculosis
RVPLFGLGCVAGAAGV

SEQ ID NO: 81421 - protein, 16 aa, Mycobacterium tuberculosis
VPLFGLGCVAGAAGVA

SEQ ID NO: 81422 - protein, 16 aa, Mycobacterium tuberculosis
PLFGLGCVAGAAGVAR

SEQ ID NO: 81423 - protein, 16 aa, Mycobacterium tuberculosis
LFGLGCVAGAAGVARL

SEQ ID NO: 81424 - protein, 16 aa, Mycobacterium tuberculosis
FGLGCVAGAAGVARLH

SEQ ID NO: 81425 - protein, 16 aa, Mycobacterium tuberculosis
GLGCVAGAAGVARLHD

SEQ ID NO: 81426 - protein, 16 aa, Mycobacterium tuberculosis
LGCVAGAAGVARLHDY

SEQ ID NO: 81427 - protein, 16 aa, Mycobacterium tuberculosis
GCVAGAAGVARLHDYL

SEQ ID NO: 81428 - protein, 16 aa, Mycobacterium tuberculosis
CVAGAAGVARLHDYLR

SEQ ID NO: 81429 - protein, 16 aa, Mycobacterium tuberculosis
VAGAAGVARLHDYLRG

SEQ ID NO: 81430 - protein, 16 aa, Mycobacterium tuberculosis
AGAAGVARLHDYLRGA

SEQ ID NO: 81431 - protein, 16 aa, Mycobacterium tuberculosis
GAAGVARLHDYLRGAP

SEQ ID NO: 81432 - protein, 16 aa, Mycobacterium tuberculosis
AAGVARLHDYLRGAPD

SEQ ID NO: 81433 - protein, 16 aa, Mycobacterium tuberculosis
AGVARLHDYLRGAPDG

SEQ ID NO: 81434 - protein, 16 aa, Mycobacterium tuberculosis
GVARLHDYLRGAPDGV

SEQ ID NO: 81435 - protein, 16 aa, Mycobacterium tuberculosis
VARLHDYLRGAPDGVA

SEQ ID NO: 81436 - protein, 16 aa, Mycobacterium tuberculosis
ARLHDYLRGAPDGVAA

SEQ ID NO: 81437 - protein, 16 aa, Mycobacterium tuberculosis
RLHDYLRGAPDGVAAL

SEQ ID NO: 81438 - protein, 16 aa, Mycobacterium tuberculosis
LHDYLRGAPDGVAALV

SEQ ID NO: 81439 - protein, 16 aa, Mycobacterium tuberculosis
HDYLRGAPDGVAALVS

SEQ ID NO: 81440 - protein, 16 aa, Mycobacterium tuberculosis
DYLRGAPDGVAALVSV

SEQ ID NO: 81441 - protein, 16 aa, Mycobacterium tuberculosis
YLRGAPDGVAALVSVE

SEQ ID NO: 81442 - protein, 16 aa, Mycobacterium tuberculosis
LRGAPDGVAALVSVEL

SEQ ID NO: 81443 - protein, 16 aa, Mycobacterium tuberculosis
RGAPDGVAALVSVELC

SEQ ID NO: 81444 - protein, 16 aa, Mycobacterium tuberculosis
GAPDGVAALVSVELCS

SEQ ID NO: 81445 - protein, 16 aa, Mycobacterium tuberculosis
APDGVAALVSVELCSL

SEQ ID NO: 81446 - protein, 16 aa, Mycobacterium tuberculosis
PDGVAALVSVELCSLT

SEQ ID NO: 81447 - protein, 16 aa, Mycobacterium tuberculosis
DGVAALVSVELCSLTY

SEQ ID NO: 81448 - protein, 16 aa, Mycobacterium tuberculosis
GVAALVSVELCSLTYP

SEQ ID NO: 81449 - protein, 16 aa, Mycobacterium tuberculosis
VAALVSVELCSLTYPG

SEQ ID NO: 81450 - protein, 16 aa, Mycobacterium tuberculosis
AALVSVELCSLTYPGY

SEQ ID NO: 81451 - protein, 16 aa, Mycobacterium tuberculosis
ALVSVELCSLTYPGYK

SEQ ID NO: 81452 - protein, 16 aa, Mycobacterium tuberculosis
LVSVELCSLTYPGYKP

SEQ ID NO: 81453 - protein, 16 aa, Mycobacterium tuberculosis
VSVELCSLTYPGYKPT

SEQ ID NO: 81454 - protein, 16 aa, Mycobacterium tuberculosis
SVELCSLTYPGYKPTL

SEQ ID NO: 81455 - protein, 16 aa, Mycobacterium tuberculosis
VELCSLTYPGYKPTLP

SEQ ID NO: 81456 - protein, 16 aa, Mycobacterium tuberculosis
ELCSLTYPGYKPTLPG

SEQ ID NO: 81457 - protein, 16 aa, Mycobacterium tuberculosis
LCSLTYPGYKPTLPGL

SEQ ID NO: 81458 - protein, 16 aa, Mycobacterium tuberculosis
CSLTYPGYKPTLPGLV

SEQ ID NO: 81459 - protein, 16 aa, Mycobacterium tuberculosis
SLTYPGYKPTLPGLVG

SEQ ID NO: 81460 - protein, 16 aa, Mycobacterium tuberculosis
LTYPGYKPTLPGLVGS

SEQ ID NO: 81461 - protein, 16 aa, Mycobacterium tuberculosis
TYPGYKPTLPGLVGSA

SEQ ID NO: 81462 - protein, 16 aa, Mycobacterium tuberculosis
YPGYKPTLPGLVGSAL

SEQ ID NO: 81463 - protein, 16 aa, Mycobacterium tuberculosis
PGYKPTLPGLVGSALF

SEQ ID NO: 81464 - protein, 16 aa, Mycobacterium tuberculosis
GYKPTLPGLVGSALFA

SEQ ID NO: 81465 - protein, 16 aa, Mycobacterium tuberculosis
YKPTLPGLVGSALFAD

SEQ ID NO: 81466 - protein, 16 aa, Mycobacterium tuberculosis
KPTLPGLVGSALFADG

SEQ ID NO: 81467 - protein, 16 aa, Mycobacterium tuberculosis
PTLPGLVGSALFADGA

SEQ ID NO: 81468 - protein, 16 aa, Mycobacterium tuberculosis
TLPGLVGSALFADGAA

SEQ ID NO: 81469 - protein, 16 aa, Mycobacterium tuberculosis
LPGLVGSALFADGAAA

SEQ ID NO: 81470 - protein, 16 aa, Mycobacterium tuberculosis
PGLVGSALFADGAAAV

SEQ ID NO: 81471 - protein, 16 aa, Mycobacterium tuberculosis
GLVGSALFADGAAAVV

SEQ ID NO: 81472 - protein, 16 aa, Mycobacterium tuberculosis
LVGSALFADGAAAVVA

SEQ ID NO: 81473 - protein, 16 aa, Mycobacterium tuberculosis
VGSALFADGAAAVVAA

SEQ ID NO: 81474 - protein, 16 aa, Mycobacterium tuberculosis
GSALFADGAAAVVAAG

SEQ ID NO: 81475 - protein, 16 aa, Mycobacterium tuberculosis
SALFADGAAAVVAAGV

SEQ ID NO: 81476 - protein, 16 aa, Mycobacterium tuberculosis
ALFADGAAAVVAAGVK

SEQ ID NO: 81477 - protein, 16 aa, Mycobacterium tuberculosis
LFADGAAAVVAAGVKR

SEQ ID NO: 81478 - protein, 16 aa, Mycobacterium tuberculosis
FADGAAAVVAAGVKRA

SEQ ID NO: 81479 - protein, 16 aa, Mycobacterium tuberculosis
ADGAAAVVAAGVKRAQ

SEQ ID NO: 81480 - protein, 16 aa, Mycobacterium tuberculosis
DGAAAVVAAGVKRAQD

SEQ ID NO: 81481 - protein, 16 aa, Mycobacterium tuberculosis
GAAAVVAAGVKRAQDI

SEQ ID NO: 81482 - protein, 16 aa, Mycobacterium tuberculosis
AAAVVAAGVKRAQDIG

SEQ ID NO: 81483 - protein, 16 aa, Mycobacterium tuberculosis
AAVVAAGVKRAQDIGA

SEQ ID NO: 81484 - protein, 16 aa, Mycobacterium tuberculosis
AVVAAGVKRAQDIGAD

SEQ ID NO: 81485 - protein, 16 aa, Mycobacterium tuberculosis
VVAAGVKRAQDIGADG

SEQ ID NO: 81486 - protein, 16 aa, Mycobacterium tuberculosis
VAAGVKRAQDIGADGP

SEQ ID NO: 81487 - protein, 16 aa, Mycobacterium tuberculosis
AAGVKRAQDIGADGPD

SEQ ID NO: 81488 - protein, 16 aa, Mycobacterium tuberculosis
AGVKRAQDIGADGPDI

SEQ ID NO: 81489 - protein, 16 aa, Mycobacterium tuberculosis
GVKRAQDIGADGPDIL

SEQ ID NO: 81490 - protein, 16 aa, Mycobacterium tuberculosis
VKRAQDIGADGPDILD

SEQ ID NO: 81491 - protein, 16 aa, Mycobacterium tuberculosis
KRAQDIGADGPDILDS

SEQ ID NO: 81492 - protein, 16 aa, Mycobacterium tuberculosis
RAQDIGADGPDILDSR

SEQ ID NO: 81493 - protein, 16 aa, Mycobacterium tuberculosis
AQDIGADGPDILDSRS

SEQ ID NO: 81494 - protein, 16 aa, Mycobacterium tuberculosis
QDIGADGPDILDSRSH

SEQ ID NO: 81495 - protein, 16 aa, Mycobacterium tuberculosis
DIGADGPDILDSRSHL

SEQ ID NO: 81496 - protein, 16 aa, Mycobacterium tuberculosis
IGADGPDILDSRSHLY

SEQ ID NO: 81497 - protein, 16 aa, Mycobacterium tuberculosis
GADGPDILDSRSHLYP

SEQ ID NO: 81498 - protein, 16 aa, Mycobacterium tuberculosis
ADGPDILDSRSHLYPD

SEQ ID NO: 81499 - protein, 16 aa, Mycobacterium tuberculosis
DGPDILDSRSHLYPDS

SEQ ID NO: 81500 - protein, 16 aa, Mycobacterium tuberculosis
GPDILDSRSHLYPDSL

SEQ ID NO: 81501 - protein, 16 aa, Mycobacterium tuberculosis
PDILDSRSHLYPDSLR

SEQ ID NO: 81502 - protein, 16 aa, Mycobacterium tuberculosis
DILDSRSHLYPDSLRT

SEQ ID NO: 81503 - protein, 16 aa, Mycobacterium tuberculosis
ILDSRSHLYPDSLRTM

SEQ ID NO: 81504 - protein, 16 aa, Mycobacterium tuberculosis
LDSRSHLYPDSLRTMG

SEQ ID NO: 81505 - protein, 16 aa, Mycobacterium tuberculosis
DSRSHLYPDSLRTMGY

SEQ ID NO: 81506 - protein, 16 aa, Mycobacterium tuberculosis
SRSHLYPDSLRTMGYD

SEQ ID NO: 81507 - protein, 16 aa, Mycobacterium tuberculosis
RSHLYPDSLRTMGYDV

SEQ ID NO: 81508 - protein, 16 aa, Mycobacterium tuberculosis
SHLYPDSLRTMGYDVG

SEQ ID NO: 81509 - protein, 16 aa, Mycobacterium tuberculosis
HLYPDSLRTMGYDVGS

SEQ ID NO: 81510 - protein, 16 aa, Mycobacterium tuberculosis
LYPDSLRTMGYDVGSA

SEQ ID NO: 81511 - protein, 16 aa, Mycobacterium tuberculosis
YPDSLRTMGYDVGSAG

SEQ ID NO: 81512 - protein, 16 aa, Mycobacterium tuberculosis
PDSLRTMGYDVGSAGF

SEQ ID NO: 81513 - protein, 16 aa, Mycobacterium tuberculosis
DSLRTMGYDVGSAGFE

SEQ ID NO: 81514 - protein, 16 aa, Mycobacterium tuberculosis
SLRTMGYDVGSAGFEL

SEQ ID NO: 81515 - protein, 16 aa, Mycobacterium tuberculosis
LRTMGYDVGSAGFELV

SEQ ID NO: 81516 - protein, 16 aa, Mycobacterium tuberculosis
RTMGYDVGSAGFELVL

SEQ ID NO: 81517 - protein, 16 aa, Mycobacterium tuberculosis
TMGYDVGSAGFELVLS

SEQ ID NO: 81518 - protein, 16 aa, Mycobacterium tuberculosis
MGYDVGSAGFELVLSR

SEQ ID NO: 81519 - protein, 16 aa, Mycobacterium tuberculosis
GYDVGSAGFELVLSRD

SEQ ID NO: 81520 - protein, 16 aa, Mycobacterium tuberculosis
YDVGSAGFELVLSRDL

SEQ ID NO: 81521 - protein, 16 aa, Mycobacterium tuberculosis
DVGSAGFELVLSRDLA

SEQ ID NO: 81522 - protein, 16 aa, Mycobacterium tuberculosis
VGSAGFELVLSRDLAA

SEQ ID NO: 81523 - protein, 16 aa, Mycobacterium tuberculosis
GSAGFELVLSRDLAAV

SEQ ID NO: 81524 - protein, 16 aa, Mycobacterium tuberculosis
SAGFELVLSRDLAAVV

SEQ ID NO: 81525 - protein, 16 aa, Mycobacterium tuberculosis
AGFELVLSRDLAAVVE

SEQ ID NO: 81526 - protein, 16 aa, Mycobacterium tuberculosis
GFELVLSRDLAAVVEQ

SEQ ID NO: 81527 - protein, 16 aa, Mycobacterium tuberculosis
FELVLSRDLAAVVEQY

SEQ ID NO: 81528 - protein, 16 aa, Mycobacterium tuberculosis
ELVLSRDLAAVVEQYL

SEQ ID NO: 81529 - protein, 16 aa, Mycobacterium tuberculosis
LVLSRDLAAVVEQYLG

SEQ ID NO: 81530 - protein, 16 aa, Mycobacterium tuberculosis
VLSRDLAAVVEQYLGN

SEQ ID NO: 81531 - protein, 16 aa, Mycobacterium tuberculosis
LSRDLAAVVEQYLGND

SEQ ID NO: 81532 - protein, 16 aa, Mycobacterium tuberculosis
SRDLAAVVEQYLGNDV

SEQ ID NO: 81533 - protein, 16 aa, Mycobacterium tuberculosis
RDLAAVVEQYLGNDVT

SEQ ID NO: 81534 - protein, 16 aa, Mycobacterium tuberculosis
DLAAVVEQYLGNDVTT

SEQ ID NO: 81535 - protein, 16 aa, Mycobacterium tuberculosis
LAAVVEQYLGNDVTTF

SEQ ID NO: 81536 - protein, 16 aa, Mycobacterium tuberculosis
AAVVEQYLGNDVTTFL

SEQ ID NO: 81537 - protein, 16 aa, Mycobacterium tuberculosis
AVVEQYLGNDVTTFLA

SEQ ID NO: 81538 - protein, 16 aa, Mycobacterium tuberculosis
VVEQYLGNDVTTFLAS

SEQ ID NO: 81539 - protein, 16 aa, Mycobacterium tuberculosis
VEQYLGNDVTTFLASH

SEQ ID NO: 81540 - protein, 16 aa, Mycobacterium tuberculosis
EQYLGNDVTTFLASHG

SEQ ID NO: 81541 - protein, 16 aa, Mycobacterium tuberculosis
QYLGNDVTTFLASHGL

SEQ ID NO: 81542 - protein, 16 aa, Mycobacterium tuberculosis
YLGNDVTTFLASHGLS

SEQ ID NO: 81543 - protein, 16 aa, Mycobacterium tuberculosis
LGNDVTTFLASHGLST

SEQ ID NO: 81544 - protein, 16 aa, Mycobacterium tuberculosis
GNDVTTFLASHGLSTT

SEQ ID NO: 81545 - protein, 16 aa, Mycobacterium tuberculosis
NDVTTFLASHGLSTTD

SEQ ID NO: 81546 - protein, 16 aa, Mycobacterium tuberculosis
DVTTFLASHGLSTTDV

SEQ ID NO: 81547 - protein, 16 aa, Mycobacterium tuberculosis
VTTFLASHGLSTTDVG

SEQ ID NO: 81548 - protein, 16 aa, Mycobacterium tuberculosis
TTFLASHGLSTTDVGA

SEQ ID NO: 81549 - protein, 16 aa, Mycobacterium tuberculosis
TFLASHGLSTTDVGAW

SEQ ID NO: 81550 - protein, 16 aa, Mycobacterium tuberculosis
FLASHGLSTTDVGAWV

SEQ ID NO: 81551 - protein, 16 aa, Mycobacterium tuberculosis
LASHGLSTTDVGAWVT

SEQ ID NO: 81552 - protein, 16 aa, Mycobacterium tuberculosis
ASHGLSTTDVGAWVTH

SEQ ID NO: 81553 - protein, 16 aa, Mycobacterium tuberculosis
SHGLSTTDVGAWVTHP

SEQ ID NO: 81554 - protein, 16 aa, Mycobacterium tuberculosis
HGLSTTDVGAWVTHPG

SEQ ID NO: 81555 - protein, 16 aa, Mycobacterium tuberculosis
GLSTTDVGAWVTHPGG

SEQ ID NO: 81556 - protein, 16 aa, Mycobacterium tuberculosis
LSTTDVGAWVTHPGGP

SEQ ID NO: 81557 - protein, 16 aa, Mycobacterium tuberculosis
STTDVGAWVTHPGGPK

SEQ ID NO: 81558 - protein, 16 aa, Mycobacterium tuberculosis
TTDVGAWVTHPGGPKI

SEQ ID NO: 81559 - protein, 16 aa, Mycobacterium tuberculosis
TDVGAWVTHPGGPKII

SEQ ID NO: 81560 - protein, 16 aa, Mycobacterium tuberculosis
DVGAWVTHPGGPKIIN

SEQ ID NO: 81561 - protein, 16 aa, Mycobacterium tuberculosis
VGAWVTHPGGPKIINA

SEQ ID NO: 81562 - protein, 16 aa, Mycobacterium tuberculosis
GAWVTHPGGPKIINAI

SEQ ID NO: 81563 - protein, 16 aa, Mycobacterium tuberculosis
AWVTHPGGPKIINAIT

SEQ ID NO: 81564 - protein, 16 aa, Mycobacterium tuberculosis
WVTHPGGPKIINAITE

SEQ ID NO: 81565 - protein, 16 aa, Mycobacterium tuberculosis
VTHPGGPKIINAITET

SEQ ID NO: 81566 - protein, 16 aa, Mycobacterium tuberculosis
THPGGPKIINAITETL

SEQ ID NO: 81567 - protein, 16 aa, Mycobacterium tuberculosis
HPGGPKIINAITETLD

SEQ ID NO: 81568 - protein, 16 aa, Mycobacterium tuberculosis
PGGPKIINAITETLDL

SEQ ID NO: 81569 - protein, 16 aa, Mycobacterium tuberculosis
GGPKIINAITETLDLS

SEQ ID NO: 81570 - protein, 16 aa, Mycobacterium tuberculosis
GPKIINAITETLDLSP

SEQ ID NO: 81571 - protein, 16 aa, Mycobacterium tuberculosis
PKIINAITETLDLSPQ

SEQ ID NO: 81572 - protein, 16 aa, Mycobacterium tuberculosis
KIINAITETLDLSPQA

SEQ ID NO: 81573 - protein, 16 aa, Mycobacterium tuberculosis
IINAITETLDLSPQAL

SEQ ID NO: 81574 - protein, 16 aa, Mycobacterium tuberculosis
INAITETLDLSPQALE

SEQ ID NO: 81575 - protein, 16 aa, Mycobacterium tuberculosis
NAITETLDLSPQALEL

SEQ ID NO: 81576 - protein, 16 aa, Mycobacterium tuberculosis
AITETLDLSPQALELT

SEQ ID NO: 81577 - protein, 16 aa, Mycobacterium tuberculosis
ITETLDLSPQALELTW

SEQ ID NO: 81578 - protein, 16 aa, Mycobacterium tuberculosis
TETLDLSPQALELTWR

SEQ ID NO: 81579 - protein, 16 aa, Mycobacterium tuberculosis
ETLDLSPQALELTWRS

SEQ ID NO: 81580 - protein, 16 aa, Mycobacterium tuberculosis
TLDLSPQALELTWRSL

SEQ ID NO: 81581 - protein, 16 aa, Mycobacterium tuberculosis
LDLSPQALELTWRSLG

SEQ ID NO: 81582 - protein, 16 aa, Mycobacterium tuberculosis
DLSPQALELTWRSLGE

SEQ ID NO: 81583 - protein, 16 aa, Mycobacterium tuberculosis
LSPQALELTWRSLGEI

SEQ ID NO: 81584 - protein, 16 aa, Mycobacterium tuberculosis
SPQALELTWRSLGEIG

SEQ ID NO: 81585 - protein, 16 aa, Mycobacterium tuberculosis
PQALELTWRSLGEIGN

SEQ ID NO: 81586 - protein, 16 aa, Mycobacterium tuberculosis
QALELTWRSLGEIGNL

SEQ ID NO: 81587 - protein, 16 aa, Mycobacterium tuberculosis
ALELTWRSLGEIGNLS

SEQ ID NO: 81588 - protein, 16 aa, Mycobacterium tuberculosis
LELTWRSLGEIGNLSS

SEQ ID NO: 81589 - protein, 16 aa, Mycobacterium tuberculosis
ELTWRSLGEIGNLSSA

SEQ ID NO: 81590 - protein, 16 aa, Mycobacterium tuberculosis
LTWRSLGEIGNLSSAS

SEQ ID NO: 81591 - protein, 16 aa, Mycobacterium tuberculosis
TWRSLGEIGNLSSASV

SEQ ID NO: 81592 - protein, 16 aa, Mycobacterium tuberculosis
WRSLGEIGNLSSASVL

SEQ ID NO: 81593 - protein, 16 aa, Mycobacterium tuberculosis
RSLGEIGNLSSASVLH

SEQ ID NO: 81594 - protein, 16 aa, Mycobacterium tuberculosis
SLGEIGNLSSASVLHV

SEQ ID NO: 81595 - protein, 16 aa, Mycobacterium tuberculosis
LGEIGNLSSASVLHVL

SEQ ID NO: 81596 - protein, 16 aa, Mycobacterium tuberculosis
GEIGNLSSASVLHVLR

SEQ ID NO: 81597 - protein, 16 aa, Mycobacterium tuberculosis
EIGNLSSASVLHVLRD

SEQ ID NO: 81598 - protein, 16 aa, Mycobacterium tuberculosis
IGNLSSASVLHVLRDT

SEQ ID NO: 81599 - protein, 16 aa, Mycobacterium tuberculosis
GNLSSASVLHVLRDTI

SEQ ID NO: 81600 - protein, 16 aa, Mycobacterium tuberculosis
NLSSASVLHVLRDTIA

SEQ ID NO: 81601 - protein, 16 aa, Mycobacterium tuberculosis
LSSASVLHVLRDTIAK

SEQ ID NO: 81602 - protein, 16 aa, Mycobacterium tuberculosis
SSASVLHVLRDTIAKP

SEQ ID NO: 81603 - protein, 16 aa, Mycobacterium tuberculosis
SASVLHVLRDTIAKPP

SEQ ID NO: 81604 - protein, 16 aa, Mycobacterium tuberculosis
ASVLHVLRDTIAKPPP

SEQ ID NO: 81605 - protein, 16 aa, Mycobacterium tuberculosis
SVLHVLRDTIAKPPPS

SEQ ID NO: 81606 - protein, 16 aa, Mycobacterium tuberculosis
VLHVLRDTIAKPPPSG

SEQ ID NO: 81607 - protein, 16 aa, Mycobacterium tuberculosis
LHVLRDTIAKPPPSGS

SEQ ID NO: 81608 - protein, 16 aa, Mycobacterium tuberculosis
HVLRDTIAKPPPSGSP

SEQ ID NO: 81609 - protein, 16 aa, Mycobacterium tuberculosis
VLRDTIAKPPPSGSPG

SEQ ID NO: 81610 - protein, 16 aa, Mycobacterium tuberculosis
LRDTIAKPPPSGSPGL

SEQ ID NO: 81611 - protein, 16 aa, Mycobacterium tuberculosis
RDTIAKPPPSGSPGLM

SEQ ID NO: 81612 - protein, 16 aa, Mycobacterium tuberculosis
DTIAKPPPSGSPGLMI

SEQ ID NO: 81613 - protein, 16 aa, Mycobacterium tuberculosis
TIAKPPPSGSPGLMIA

SEQ ID NO: 81614 - protein, 16 aa, Mycobacterium tuberculosis
IAKPPPSGSPGLMIAM

SEQ ID NO: 81615 - protein, 16 aa, Mycobacterium tuberculosis
AKPPPSGSPGLMIAMG

SEQ ID NO: 81616 - protein, 16 aa, Mycobacterium tuberculosis
KPPPSGSPGLMIAMGP

SEQ ID NO: 81617 - protein, 16 aa, Mycobacterium tuberculosis
PPPSGSPGLMIAMGPG

SEQ ID NO: 81618 - protein, 16 aa, Mycobacterium tuberculosis
PPSGSPGLMIAMGPGF

SEQ ID NO: 81619 - protein, 16 aa, Mycobacterium tuberculosis
PSGSPGLMIAMGPGFC

SEQ ID NO: 81620 - protein, 16 aa, Mycobacterium tuberculosis
SGSPGLMIAMGPGFCS

SEQ ID NO: 81621 - protein, 16 aa, Mycobacterium tuberculosis
GSPGLMIAMGPGFCSE

SEQ ID NO: 81622 - protein, 16 aa, Mycobacterium tuberculosis
SPGLMIAMGPGFCSEL

SEQ ID NO: 81623 - protein, 16 aa, Mycobacterium tuberculosis
PGLMIAMGPGFCSELV

SEQ ID NO: 81624 - protein, 16 aa, Mycobacterium tuberculosis
GLMIAMGPGFCSELVL

SEQ ID NO: 81625 - protein, 16 aa, Mycobacterium tuberculosis
LMIAMGPGFCSELVLL

SEQ ID NO: 81626 - protein, 16 aa, Mycobacterium tuberculosis
MIAMGPGFCSELVLLR

SEQ ID NO: 81627 - protein, 16 aa, Mycobacterium tuberculosis
IAMGPGFCSELVLLRW

SEQ ID NO: 81628 - protein, 16 aa, Mycobacterium tuberculosis
AMGPGFCSELVLLRWH

SEQ ID NO: 81629 - protein, 13 aa, Mycobacterium tuberculosis
MATRFMTDPHAMR

SEQ ID NO: 81630 - protein, 13 aa, Mycobacterium tuberculosis
ATRFMTDPHAMRD

SEQ ID NO: 81631 - protein, 13 aa, Mycobacterium tuberculosis
TRFMTDPHAMRDM

SEQ ID NO: 81632 - protein, 13 aa, Mycobacterium tuberculosis
RFMTDPHAMRDMA

SEQ ID NO: 81633 - protein, 13 aa, Mycobacterium tuberculosis
FMTDPHAMRDMAG

SEQ ID NO: 81634 - protein, 13 aa, Mycobacterium tuberculosis
MTDPHAMRDMAGR

SEQ ID NO: 81635 - protein, 13 aa, Mycobacterium tuberculosis
TDPHAMRDMAGRF

SEQ ID NO: 81636 - protein, 13 aa, Mycobacterium tuberculosis
DPHAMRDMAGRFE

SEQ ID NO: 81637 - protein, 13 aa, Mycobacterium tuberculosis
PHAMRDMAGRFEV

SEQ ID NO: 81638 - protein, 13 aa, Mycobacterium tuberculosis
HAMRDMAGRFEVH

SEQ ID NO: 81639 - protein, 13 aa, Mycobacterium tuberculosis
AMRDMAGRFEVHA

SEQ ID NO: 81640 - protein, 13 aa, Mycobacterium tuberculosis
MRDMAGRFEVHAQ

SEQ ID NO: 81641 - protein, 13 aa, Mycobacterium tuberculosis
RDMAGRFEVHAQT

SEQ ID NO: 81642 - protein, 13 aa, Mycobacterium tuberculosis
DMAGRFEVHAQTV

SEQ ID NO: 81643 - protein, 13 aa, Mycobacterium tuberculosis
MAGRFEVHAQTVE

SEQ ID NO: 81644 - protein, 13 aa, Mycobacterium tuberculosis
AGRFEVHAQTVED

SEQ ID NO: 81645 - protein, 13 aa, Mycobacterium tuberculosis
GRFEVHAQTVEDE

SEQ ID NO: 81646 - protein, 13 aa, Mycobacterium tuberculosis
RFEVHAQTVEDEA

SEQ ID NO: 81647 - protein, 13 aa, Mycobacterium tuberculosis
FEVHAQTVEDEAR

SEQ ID NO: 81648 - protein, 13 aa, Mycobacterium tuberculosis
EVHAQTVEDEARR

SEQ ID NO: 81649 - protein, 13 aa, Mycobacterium tuberculosis
VHAQTVEDEARRM

SEQ ID NO: 81650 - protein, 13 aa, Mycobacterium tuberculosis
HAQTVEDEARRMW

SEQ ID NO: 81651 - protein, 13 aa, Mycobacterium tuberculosis
AQTVEDEARRMWA

SEQ ID NO: 81652 - protein, 13 aa, Mycobacterium tuberculosis
QTVEDEARRMWAS

SEQ ID NO: 81653 - protein, 13 aa, Mycobacterium tuberculosis
TVEDEARRMWASA

SEQ ID NO: 81654 - protein, 13 aa, Mycobacterium tuberculosis
VEDEARRMWASAQ

SEQ ID NO: 81655 - protein, 13 aa, Mycobacterium tuberculosis
EDEARRMWASAQN

SEQ ID NO: 81656 - protein, 13 aa, Mycobacterium tuberculosis
DEARRMWASAQNI

SEQ ID NO: 81657 - protein, 13 aa, Mycobacterium tuberculosis
EARRMWASAQNIS

SEQ ID NO: 81658 - protein, 13 aa, Mycobacterium tuberculosis
ARRMWASAQNISG

SEQ ID NO: 81659 - protein, 13 aa, Mycobacterium tuberculosis
RRMWASAQNISGA

SEQ ID NO: 81660 - protein, 13 aa, Mycobacterium tuberculosis
RMWASAQNISGAG

SEQ ID NO: 81661 - protein, 13 aa, Mycobacterium tuberculosis
MWASAQNISGAGW

SEQ ID NO: 81662 - protein, 13 aa, Mycobacterium tuberculosis
WASAQNISGAGWS

SEQ ID NO: 81663 - protein, 13 aa, Mycobacterium tuberculosis
ASAQNISGAGWSG

SEQ ID NO: 81664 - protein, 13 aa, Mycobacterium tuberculosis
SAQNISGAGWSGM

SEQ ID NO: 81665 - protein, 13 aa, Mycobacterium tuberculosis
AQNISGAGWSGMA

SEQ ID NO: 81666 - protein, 13 aa, Mycobacterium tuberculosis
QNISGAGWSGMAE

SEQ ID NO: 81667 - protein, 13 aa, Mycobacterium tuberculosis
NISGAGWSGMAEA

SEQ ID NO: 81668 - protein, 13 aa, Mycobacterium tuberculosis
ISGAGWSGMAEAT

SEQ ID NO: 81669 - protein, 13 aa, Mycobacterium tuberculosis
SGAGWSGMAEATS

SEQ ID NO: 81670 - protein, 13 aa, Mycobacterium tuberculosis
GAGWSGMAEATSL

SEQ ID NO: 81671 - protein, 13 aa, Mycobacterium tuberculosis
AGWSGMAEATSLD

SEQ ID NO: 81672 - protein, 13 aa, Mycobacterium tuberculosis
GWSGMAEATSLDT

SEQ ID NO: 81673 - protein, 13 aa, Mycobacterium tuberculosis
WSGMAEATSLDTM

SEQ ID NO: 81674 - protein, 13 aa, Mycobacterium tuberculosis
SGMAEATSLDTMA

SEQ ID NO: 81675 - protein, 13 aa, Mycobacterium tuberculosis
GMAEATSLDTMAQ

SEQ ID NO: 81676 - protein, 13 aa, Mycobacterium tuberculosis
MAEATSLDTMAQM

SEQ ID NO: 81677 - protein, 13 aa, Mycobacterium tuberculosis
AEATSLDTMAQMN

SEQ ID NO: 81678 - protein, 13 aa, Mycobacterium tuberculosis
EATSLDTMAQMNQ

SEQ ID NO: 81679 - protein, 13 aa, Mycobacterium tuberculosis
ATSLDTMAQMNQA

SEQ ID NO: 81680 - protein, 13 aa, Mycobacterium tuberculosis
TSLDTMAQMNQAF

SEQ ID NO: 81681 - protein, 13 aa, Mycobacterium tuberculosis
SLDTMAQMNQAFR

SEQ ID NO: 81682 - protein, 13 aa, Mycobacterium tuberculosis
LDTMAQMNQAFRN

SEQ ID NO: 81683 - protein, 13 aa, Mycobacterium tuberculosis
DTMAQMNQAFRNI

SEQ ID NO: 81684 - protein, 13 aa, Mycobacterium tuberculosis
TMAQMNQAFRNIV

SEQ ID NO: 81685 - protein, 13 aa, Mycobacterium tuberculosis
MAQMNQAFRNIVN

SEQ ID NO: 81686 - protein, 13 aa, Mycobacterium tuberculosis
AQMNQAFRNIVNM

SEQ ID NO: 81687 - protein, 13 aa, Mycobacterium tuberculosis
QMNQAFRNIVNML

SEQ ID NO: 81688 - protein, 13 aa, Mycobacterium tuberculosis
MNQAFRNIVNMLH

SEQ ID NO: 81689 - protein, 13 aa, Mycobacterium tuberculosis
NQAFRNIVNMLHG

SEQ ID NO: 81690 - protein, 13 aa, Mycobacterium tuberculosis
QAFRNIVNMLHGV

SEQ ID NO: 81691 - protein, 13 aa, Mycobacterium tuberculosis
AFRNIVNMLHGVR

SEQ ID NO: 81692 - protein, 13 aa, Mycobacterium tuberculosis
FRNIVNMLHGVRD

SEQ ID NO: 81693 - protein, 13 aa, Mycobacterium tuberculosis
RNIVNMLHGVRDG

SEQ ID NO: 81694 - protein, 13 aa, Mycobacterium tuberculosis
NIVNMLHGVRDGL

SEQ ID NO: 81695 - protein, 13 aa, Mycobacterium tuberculosis
IVNMLHGVRDGLV

SEQ ID NO: 81696 - protein, 13 aa, Mycobacterium tuberculosis
VNMLHGVRDGLVR

SEQ ID NO: 81697 - protein, 13 aa, Mycobacterium tuberculosis
NMLHGVRDGLVRD

SEQ ID NO: 81698 - protein, 13 aa, Mycobacterium tuberculosis
MLHGVRDGLVRDA

SEQ ID NO: 81699 - protein, 13 aa, Mycobacterium tuberculosis
LHGVRDGLVRDAN

SEQ ID NO: 81700 - protein, 13 aa, Mycobacterium tuberculosis
HGVRDGLVRDANN

SEQ ID NO: 81701 - protein, 13 aa, Mycobacterium tuberculosis
GVRDGLVRDANNY

SEQ ID NO: 81702 - protein, 13 aa, Mycobacterium tuberculosis
VRDGLVRDANNYE

SEQ ID NO: 81703 - protein, 13 aa, Mycobacterium tuberculosis
RDGLVRDANNYEQ

SEQ ID NO: 81704 - protein, 13 aa, Mycobacterium tuberculosis
DGLVRDANNYEQQ

SEQ ID NO: 81705 - protein, 13 aa, Mycobacterium tuberculosis
GLVRDANNYEQQE

SEQ ID NO: 81706 - protein, 13 aa, Mycobacterium tuberculosis
LVRDANNYEQQEQ

SEQ ID NO: 81707 - protein, 13 aa, Mycobacterium tuberculosis
VRDANNYEQQEQA

SEQ ID NO: 81708 - protein, 13 aa, Mycobacterium tuberculosis
RDANNYEQQEQAS

SEQ ID NO: 81709 - protein, 13 aa, Mycobacterium tuberculosis
DANNYEQQEQASQ

SEQ ID NO: 81710 - protein, 13 aa, Mycobacterium tuberculosis
ANNYEQQEQASQQ

SEQ ID NO: 81711 - protein, 13 aa, Mycobacterium tuberculosis
NNYEQQEQASQQI

SEQ ID NO: 81712 - protein, 13 aa, Mycobacterium tuberculosis
NYEQQEQASQQIL

SEQ ID NO: 81713 - protein, 13 aa, Mycobacterium tuberculosis
YEQQEQASQQILS

SEQ ID NO: 81714 - protein, 13 aa, Mycobacterium tuberculosis
EQQEQASQQILSS

SEQ ID NO: 81715 - protein, 14 aa, Mycobacterium tuberculosis
MATRFMTDPHAMRD

SEQ ID NO: 81716 - protein, 14 aa, Mycobacterium tuberculosis
ATRFMTDPHAMRDM

SEQ ID NO: 81717 - protein, 14 aa, Mycobacterium tuberculosis
TRFMTDPHAMRDMA

SEQ ID NO: 81718 - protein, 14 aa, Mycobacterium tuberculosis
RFMTDPHAMRDMAG

SEQ ID NO: 81719 - protein, 14 aa, Mycobacterium tuberculosis
FMTDPHAMRDMAGR

SEQ ID NO: 81720 - protein, 14 aa, Mycobacterium tuberculosis
MTDPHAMRDMAGRF

SEQ ID NO: 81721 - protein, 14 aa, Mycobacterium tuberculosis
TDPHAMRDMAGRFE

SEQ ID NO: 81722 - protein, 14 aa, Mycobacterium tuberculosis
DPHAMRDMAGRFEV

SEQ ID NO: 81723 - protein, 14 aa, Mycobacterium tuberculosis
PHAMRDMAGRFEVH

SEQ ID NO: 81724 - protein, 14 aa, Mycobacterium tuberculosis
HAMRDMAGRFEVHA

SEQ ID NO: 81725 - protein, 14 aa, Mycobacterium tuberculosis
AMRDMAGRFEVHAQ

SEQ ID NO: 81726 - protein, 14 aa, Mycobacterium tuberculosis
MRDMAGRFEVHAQT

SEQ ID NO: 81727 - protein, 14 aa, Mycobacterium tuberculosis
RDMAGRFEVHAQTV

SEQ ID NO: 81728 - protein, 14 aa, Mycobacterium tuberculosis
DMAGRFEVHAQTVE

SEQ ID NO: 81729 - protein, 14 aa, Mycobacterium tuberculosis
MAGRFEVHAQTVED

SEQ ID NO: 81730 - protein, 14 aa, Mycobacterium tuberculosis
AGRFEVHAQTVEDE

SEQ ID NO: 81731 - protein, 14 aa, Mycobacterium tuberculosis
GRFEVHAQTVEDEA

SEQ ID NO: 81732 - protein, 14 aa, Mycobacterium tuberculosis
RFEVHAQTVEDEAR

SEQ ID NO: 81733 - protein, 14 aa, Mycobacterium tuberculosis
FEVHAQTVEDEARR

SEQ ID NO: 81734 - protein, 14 aa, Mycobacterium tuberculosis
EVHAQTVEDEARRM

SEQ ID NO: 81735 - protein, 14 aa, Mycobacterium tuberculosis
VHAQTVEDEARRMW

SEQ ID NO: 81736 - protein, 14 aa, Mycobacterium tuberculosis
HAQTVEDEARRMWA

SEQ ID NO: 81737 - protein, 14 aa, Mycobacterium tuberculosis
AQTVEDEARRMWAS

SEQ ID NO: 81738 - protein, 14 aa, Mycobacterium tuberculosis
QTVEDEARRMWASA

SEQ ID NO: 81739 - protein, 14 aa, Mycobacterium tuberculosis
TVEDEARRMWASAQ

SEQ ID NO: 81740 - protein, 14 aa, Mycobacterium tuberculosis
VEDEARRMWASAQN

SEQ ID NO: 81741 - protein, 14 aa, Mycobacterium tuberculosis
EDEARRMWASAQNI

SEQ ID NO: 81742 - protein, 14 aa, Mycobacterium tuberculosis
DEARRMWASAQNIS

SEQ ID NO: 81743 - protein, 14 aa, Mycobacterium tuberculosis
EARRMWASAQNISG

SEQ ID NO: 81744 - protein, 14 aa, Mycobacterium tuberculosis
ARRMWASAQNISGA

SEQ ID NO: 81745 - protein, 14 aa, Mycobacterium tuberculosis
RRMWASAQNISGAG

SEQ ID NO: 81746 - protein, 14 aa, Mycobacterium tuberculosis
RMWASAQNISGAGW

SEQ ID NO: 81747 - protein, 14 aa, Mycobacterium tuberculosis
MWASAQNISGAGWS

SEQ ID NO: 81748 - protein, 14 aa, Mycobacterium tuberculosis
WASAQNISGAGWSG

SEQ ID NO: 81749 - protein, 14 aa, Mycobacterium tuberculosis
ASAQNISGAGWSGM

SEQ ID NO: 81750 - protein, 14 aa, Mycobacterium tuberculosis
SAQNISGAGWSGMA

SEQ ID NO: 81751 - protein, 14 aa, Mycobacterium tuberculosis
AQNISGAGWSGMAE

SEQ ID NO: 81752 - protein, 14 aa, Mycobacterium tuberculosis
QNISGAGWSGMAEA

SEQ ID NO: 81753 - protein, 14 aa, Mycobacterium tuberculosis
NISGAGWSGMAEAT

SEQ ID NO: 81754 - protein, 14 aa, Mycobacterium tuberculosis
ISGAGWSGMAEATS

SEQ ID NO: 81755 - protein, 14 aa, Mycobacterium tuberculosis
SGAGWSGMAEATSL

SEQ ID NO: 81756 - protein, 14 aa, Mycobacterium tuberculosis
GAGWSGMAEATSLD

SEQ ID NO: 81757 - protein, 14 aa, Mycobacterium tuberculosis
AGWSGMAEATSLDT

SEQ ID NO: 81758 - protein, 14 aa, Mycobacterium tuberculosis
GWSGMAEATSLDTM

SEQ ID NO: 81759 - protein, 14 aa, Mycobacterium tuberculosis
WSGMAEATSLDTMA

SEQ ID NO: 81760 - protein, 14 aa, Mycobacterium tuberculosis
SGMAEATSLDTMAQ

SEQ ID NO: 81761 - protein, 14 aa, Mycobacterium tuberculosis
GMAEATSLDTMAQM

SEQ ID NO: 81762 - protein, 14 aa, Mycobacterium tuberculosis
MAEATSLDTMAQMN

SEQ ID NO: 81763 - protein, 14 aa, Mycobacterium tuberculosis
AEATSLDTMAQMNQ

SEQ ID NO: 81764 - protein, 14 aa, Mycobacterium tuberculosis
EATSLDTMAQMNQA

SEQ ID NO: 81765 - protein, 14 aa, Mycobacterium tuberculosis
ATSLDTMAQMNQAF

SEQ ID NO: 81766 - protein, 14 aa, Mycobacterium tuberculosis
TSLDTMAQMNQAFR

SEQ ID NO: 81767 - protein, 14 aa, Mycobacterium tuberculosis
SLDTMAQMNQAFRN

SEQ ID NO: 81768 - protein, 14 aa, Mycobacterium tuberculosis
LDTMAQMNQAFRNI

SEQ ID NO: 81769 - protein, 14 aa, Mycobacterium tuberculosis
DTMAQMNQAFRNIV

SEQ ID NO: 81770 - protein, 14 aa, Mycobacterium tuberculosis
TMAQMNQAFRNIVN

SEQ ID NO: 81771 - protein, 14 aa, Mycobacterium tuberculosis
MAQMNQAFRNIVNM

SEQ ID NO: 81772 - protein, 14 aa, Mycobacterium tuberculosis
AQMNQAFRNIVNML

SEQ ID NO: 81773 - protein, 14 aa, Mycobacterium tuberculosis
QMNQAFRNIVNMLH

SEQ ID NO: 81774 - protein, 14 aa, Mycobacterium tuberculosis
MNQAFRNIVNMLHG

SEQ ID NO: 81775 - protein, 14 aa, Mycobacterium tuberculosis
NQAFRNIVNMLHGV

SEQ ID NO: 81776 - protein, 14 aa, Mycobacterium tuberculosis
QAFRNIVNMLHGVR

SEQ ID NO: 81777 - protein, 14 aa, Mycobacterium tuberculosis
AFRNIVNMLHGVRD

SEQ ID NO: 81778 - protein, 14 aa, Mycobacterium tuberculosis
FRNIVNMLHGVRDG

SEQ ID NO: 81779 - protein, 14 aa, Mycobacterium tuberculosis
RNIVNMLHGVRDGL

SEQ ID NO: 81780 - protein, 14 aa, Mycobacterium tuberculosis
NIVNMLHGVRDGLV

SEQ ID NO: 81781 - protein, 14 aa, Mycobacterium tuberculosis
IVNMLHGVRDGLVR

SEQ ID NO: 81782 - protein, 14 aa, Mycobacterium tuberculosis
VNMLHGVRDGLVRD

SEQ ID NO: 81783 - protein, 14 aa, Mycobacterium tuberculosis
NMLHGVRDGLVRDA

SEQ ID NO: 81784 - protein, 14 aa, Mycobacterium tuberculosis
MLHGVRDGLVRDAN

SEQ ID NO: 81785 - protein, 14 aa, Mycobacterium tuberculosis
LHGVRDGLVRDANN

SEQ ID NO: 81786 - protein, 14 aa, Mycobacterium tuberculosis
HGVRDGLVRDANNY

SEQ ID NO: 81787 - protein, 14 aa, Mycobacterium tuberculosis
GVRDGLVRDANNYE

SEQ ID NO: 81788 - protein, 14 aa, Mycobacterium tuberculosis
VRDGLVRDANNYEQ

SEQ ID NO: 81789 - protein, 14 aa, Mycobacterium tuberculosis
RDGLVRDANNYEQQ

SEQ ID NO: 81790 - protein, 14 aa, Mycobacterium tuberculosis
DGLVRDANNYEQQE

SEQ ID NO: 81791 - protein, 14 aa, Mycobacterium tuberculosis
GLVRDANNYEQQEQ

SEQ ID NO: 81792 - protein, 14 aa, Mycobacterium tuberculosis
LVRDANNYEQQEQA

SEQ ID NO: 81793 - protein, 14 aa, Mycobacterium tuberculosis
VRDANNYEQQEQAS

SEQ ID NO: 81794 - protein, 14 aa, Mycobacterium tuberculosis
RDANNYEQQEQASQ

SEQ ID NO: 81795 - protein, 14 aa, Mycobacterium tuberculosis
DANNYEQQEQASQQ

SEQ ID NO: 81796 - protein, 14 aa, Mycobacterium tuberculosis
ANNYEQQEQASQQI

SEQ ID NO: 81797 - protein, 14 aa, Mycobacterium tuberculosis
NNYEQQEQASQQIL

SEQ ID NO: 81798 - protein, 14 aa, Mycobacterium tuberculosis
NYEQQEQASQQILS

SEQ ID NO: 81799 - protein, 14 aa, Mycobacterium tuberculosis
YEQQEQASQQILSS

SEQ ID NO: 81800 - protein, 15 aa, Mycobacterium tuberculosis
MATRFMTDPHAMRDM

SEQ ID NO: 81801 - protein, 15 aa, Mycobacterium tuberculosis
ATRFMTDPHAMRDMA

SEQ ID NO: 81802 - protein, 15 aa, Mycobacterium tuberculosis
TRFMTDPHAMRDMAG

SEQ ID NO: 81803 - protein, 15 aa, Mycobacterium tuberculosis
RFMTDPHAMRDMAGR

SEQ ID NO: 81804 - protein, 15 aa, Mycobacterium tuberculosis
FMTDPHAMRDMAGRF

SEQ ID NO: 81805 - protein, 15 aa, Mycobacterium tuberculosis
MTDPHAMRDMAGRFE

SEQ ID NO: 81806 - protein, 15 aa, Mycobacterium tuberculosis
TDPHAMRDMAGRFEV

SEQ ID NO: 81807 - protein, 15 aa, Mycobacterium tuberculosis
DPHAMRDMAGRFEVH

SEQ ID NO: 81808 - protein, 15 aa, Mycobacterium tuberculosis
PHAMRDMAGRFEVHA

SEQ ID NO: 81809 - protein, 15 aa, Mycobacterium tuberculosis
HAMRDMAGRFEVHAQ

SEQ ID NO: 81810 - protein, 15 aa, Mycobacterium tuberculosis
AMRDMAGRFEVHAQT

SEQ ID NO: 81811 - protein, 15 aa, Mycobacterium tuberculosis
MRDMAGRFEVHAQTV

SEQ ID NO: 81812 - protein, 15 aa, Mycobacterium tuberculosis
RDMAGRFEVHAQTVE

SEQ ID NO: 81813 - protein, 15 aa, Mycobacterium tuberculosis
DMAGRFEVHAQTVED

SEQ ID NO: 81814 - protein, 15 aa, Mycobacterium tuberculosis
MAGRFEVHAQTVEDE

SEQ ID NO: 81815 - protein, 15 aa, Mycobacterium tuberculosis
AGRFEVHAQTVEDEA

SEQ ID NO: 81816 - protein, 15 aa, Mycobacterium tuberculosis
GRFEVHAQTVEDEAR

SEQ ID NO: 81817 - protein, 15 aa, Mycobacterium tuberculosis
RFEVHAQTVEDEARR

SEQ ID NO: 81818 - protein, 15 aa, Mycobacterium tuberculosis
FEVHAQTVEDEARRM

SEQ ID NO: 81819 - protein, 15 aa, Mycobacterium tuberculosis
EVHAQTVEDEARRMW

SEQ ID NO: 81820 - protein, 15 aa, Mycobacterium tuberculosis
VHAQTVEDEARRMWA

SEQ ID NO: 81821 - protein, 15 aa, Mycobacterium tuberculosis
HAQTVEDEARRMWAS

SEQ ID NO: 81822 - protein, 15 aa, Mycobacterium tuberculosis
AQTVEDEARRMWASA

SEQ ID NO: 81823 - protein, 15 aa, Mycobacterium tuberculosis
QTVEDEARRMWASAQ

SEQ ID NO: 81824 - protein, 15 aa, Mycobacterium tuberculosis
TVEDEARRMWASAQN

SEQ ID NO: 81825 - protein, 15 aa, Mycobacterium tuberculosis
VEDEARRMWASAQNI

SEQ ID NO: 81826 - protein, 15 aa, Mycobacterium tuberculosis
EDEARRMWASAQNIS

SEQ ID NO: 81827 - protein, 15 aa, Mycobacterium tuberculosis
DEARRMWASAQNISG

SEQ ID NO: 81828 - protein, 15 aa, Mycobacterium tuberculosis
EARRMWASAQNISGA

SEQ ID NO: 81829 - protein, 15 aa, Mycobacterium tuberculosis
ARRMWASAQNISGAG

SEQ ID NO: 81830 - protein, 15 aa, Mycobacterium tuberculosis
RRMWASAQNISGAGW

SEQ ID NO: 81831 - protein, 15 aa, Mycobacterium tuberculosis
RMWASAQNISGAGWS

SEQ ID NO: 81832 - protein, 15 aa, Mycobacterium tuberculosis
MWASAQNISGAGWSG

SEQ ID NO: 81833 - protein, 15 aa, Mycobacterium tuberculosis
WASAQNISGAGWSGM

SEQ ID NO: 81834 - protein, 15 aa, Mycobacterium tuberculosis
ASAQNISGAGWSGMA

SEQ ID NO: 81835 - protein, 15 aa, Mycobacterium tuberculosis
SAQNISGAGWSGMAE

SEQ ID NO: 81836 - protein, 15 aa, Mycobacterium tuberculosis
AQNISGAGWSGMAEA

SEQ ID NO: 81837 - protein, 15 aa, Mycobacterium tuberculosis
QNISGAGWSGMAEAT

SEQ ID NO: 81838 - protein, 15 aa, Mycobacterium tuberculosis
NISGAGWSGMAEATS

SEQ ID NO: 81839 - protein, 15 aa, Mycobacterium tuberculosis
ISGAGWSGMAEATSL

SEQ ID NO: 81840 - protein, 15 aa, Mycobacterium tuberculosis
SGAGWSGMAEATSLD

SEQ ID NO: 81841 - protein, 15 aa, Mycobacterium tuberculosis
GAGWSGMAEATSLDT

SEQ ID NO: 81842 - protein, 15 aa, Mycobacterium tuberculosis
AGWSGMAEATSLDTM

SEQ ID NO: 81843 - protein, 15 aa, Mycobacterium tuberculosis
GWSGMAEATSLDTMA

SEQ ID NO: 81844 - protein, 15 aa, Mycobacterium tuberculosis
WSGMAEATSLDTMAQ

SEQ ID NO: 81845 - protein, 15 aa, Mycobacterium tuberculosis
SGMAEATSLDTMAQM

SEQ ID NO: 81846 - protein, 15 aa, Mycobacterium tuberculosis
GMAEATSLDTMAQMN

SEQ ID NO: 81847 - protein, 15 aa, Mycobacterium tuberculosis
MAEATSLDTMAQMNQ

SEQ ID NO: 81848 - protein, 15 aa, Mycobacterium tuberculosis
AEATSLDTMAQMNQA

SEQ ID NO: 81849 - protein, 15 aa, Mycobacterium tuberculosis
EATSLDTMAQMNQAF

SEQ ID NO: 81850 - protein, 15 aa, Mycobacterium tuberculosis
ATSLDTMAQMNQAFR

SEQ ID NO: 81851 - protein, 15 aa, Mycobacterium tuberculosis
TSLDTMAQMNQAFRN

SEQ ID NO: 81852 - protein, 15 aa, Mycobacterium tuberculosis
SLDTMAQMNQAFRNI

SEQ ID NO: 81853 - protein, 15 aa, Mycobacterium tuberculosis
LDTMAQMNQAFRNIV

SEQ ID NO: 81854 - protein, 15 aa, Mycobacterium tuberculosis
DTMAQMNQAFRNIVN

SEQ ID NO: 81855 - protein, 15 aa, Mycobacterium tuberculosis
TMAQMNQAFRNIVNM

SEQ ID NO: 81856 - protein, 15 aa, Mycobacterium tuberculosis
MAQMNQAFRNIVNML

SEQ ID NO: 81857 - protein, 15 aa, Mycobacterium tuberculosis
AQMNQAFRNIVNMLH

SEQ ID NO: 81858 - protein, 15 aa, Mycobacterium tuberculosis
QMNQAFRNIVNMLHG

SEQ ID NO: 81859 - protein, 15 aa, Mycobacterium tuberculosis
MNQAFRNIVNMLHGV

SEQ ID NO: 81860 - protein, 15 aa, Mycobacterium tuberculosis
NQAFRNIVNMLHGVR

SEQ ID NO: 81861 - protein, 15 aa, Mycobacterium tuberculosis
QAFRNIVNMLHGVRD

SEQ ID NO: 81862 - protein, 15 aa, Mycobacterium tuberculosis
AFRNIVNMLHGVRDG

SEQ ID NO: 81863 - protein, 15 aa, Mycobacterium tuberculosis
FRNIVNMLHGVRDGL

SEQ ID NO: 81864 - protein, 15 aa, Mycobacterium tuberculosis
RNIVNMLHGVRDGLV

SEQ ID NO: 81865 - protein, 15 aa, Mycobacterium tuberculosis
NIVNMLHGVRDGLVR

SEQ ID NO: 81866 - protein, 15 aa, Mycobacterium tuberculosis
IVNMLHGVRDGLVRD

SEQ ID NO: 81867 - protein, 15 aa, Mycobacterium tuberculosis
VNMLHGVRDGLVRDA

SEQ ID NO: 81868 - protein, 15 aa, Mycobacterium tuberculosis
NMLHGVRDGLVRDAN

SEQ ID NO: 81869 - protein, 15 aa, Mycobacterium tuberculosis
MLHGVRDGLVRDANN

SEQ ID NO: 81870 - protein, 15 aa, Mycobacterium tuberculosis
LHGVRDGLVRDANNY

SEQ ID NO: 81871 - protein, 15 aa, Mycobacterium tuberculosis
HGVRDGLVRDANNYE

SEQ ID NO: 81872 - protein, 15 aa, Mycobacterium tuberculosis
GVRDGLVRDANNYEQ

SEQ ID NO: 81873 - protein, 15 aa, Mycobacterium tuberculosis
VRDGLVRDANNYEQQ

SEQ ID NO: 81874 - protein, 15 aa, Mycobacterium tuberculosis
RDGLVRDANNYEQQE

SEQ ID NO: 81875 - protein, 15 aa, Mycobacterium tuberculosis
DGLVRDANNYEQQEQ

SEQ ID NO: 81876 - protein, 15 aa, Mycobacterium tuberculosis
GLVRDANNYEQQEQA

SEQ ID NO: 81877 - protein, 15 aa, Mycobacterium tuberculosis
LVRDANNYEQQEQAS

SEQ ID NO: 81878 - protein, 15 aa, Mycobacterium tuberculosis
VRDANNYEQQEQASQ

SEQ ID NO: 81879 - protein, 15 aa, Mycobacterium tuberculosis
RDANNYEQQEQASQQ

SEQ ID NO: 81880 - protein, 15 aa, Mycobacterium tuberculosis
DANNYEQQEQASQQI

SEQ ID NO: 81881 - protein, 15 aa, Mycobacterium tuberculosis
ANNYEQQEQASQQIL

SEQ ID NO: 81882 - protein, 15 aa, Mycobacterium tuberculosis
NNYEQQEQASQQILS

SEQ ID NO: 81883 - protein, 15 aa, Mycobacterium tuberculosis
NYEQQEQASQQILSS

SEQ ID NO: 81884 - protein, 16 aa, Mycobacterium tuberculosis
MATRFMTDPHAMRDMA

SEQ ID NO: 81885 - protein, 16 aa, Mycobacterium tuberculosis
ATRFMTDPHAMRDMAG

SEQ ID NO: 81886 - protein, 16 aa, Mycobacterium tuberculosis
TRFMTDPHAMRDMAGR

SEQ ID NO: 81887 - protein, 16 aa, Mycobacterium tuberculosis
RFMTDPHAMRDMAGRF

SEQ ID NO: 81888 - protein, 16 aa, Mycobacterium tuberculosis
FMTDPHAMRDMAGRFE

SEQ ID NO: 81889 - protein, 16 aa, Mycobacterium tuberculosis
MTDPHAMRDMAGRFEV

SEQ ID NO: 81890 - protein, 16 aa, Mycobacterium tuberculosis
TDPHAMRDMAGRFEVH

SEQ ID NO: 81891 - protein, 16 aa, Mycobacterium tuberculosis
DPHAMRDMAGRFEVHA

SEQ ID NO: 81892 - protein, 16 aa, Mycobacterium tuberculosis
PHAMRDMAGRFEVHAQ

SEQ ID NO: 81893 - protein, 16 aa, Mycobacterium tuberculosis
HAMRDMAGRFEVHAQT

SEQ ID NO: 81894 - protein, 16 aa, Mycobacterium tuberculosis
AMRDMAGRFEVHAQTV

SEQ ID NO: 81895 - protein, 16 aa, Mycobacterium tuberculosis
MRDMAGRFEVHAQTVE

SEQ ID NO: 81896 - protein, 16 aa, Mycobacterium tuberculosis
RDMAGRFEVHAQTVED

SEQ ID NO: 81897 - protein, 16 aa, Mycobacterium tuberculosis
DMAGRFEVHAQTVEDE

SEQ ID NO: 81898 - protein, 16 aa, Mycobacterium tuberculosis
MAGRFEVHAQTVEDEA

SEQ ID NO: 81899 - protein, 16 aa, Mycobacterium tuberculosis
AGRFEVHAQTVEDEAR

SEQ ID NO: 81900 - protein, 16 aa, Mycobacterium tuberculosis
GRFEVHAQTVEDEARR

SEQ ID NO: 81901 - protein, 16 aa, Mycobacterium tuberculosis
RFEVHAQTVEDEARRM

SEQ ID NO: 81902 - protein, 16 aa, Mycobacterium tuberculosis
FEVHAQTVEDEARRMW

SEQ ID NO: 81903 - protein, 16 aa, Mycobacterium tuberculosis
EVHAQTVEDEARRMWA

SEQ ID NO: 81904 - protein, 16 aa, Mycobacterium tuberculosis
VHAQTVEDEARRMWAS

SEQ ID NO: 81905 - protein, 16 aa, Mycobacterium tuberculosis
HAQTVEDEARRMWASA

SEQ ID NO: 81906 - protein, 16 aa, Mycobacterium tuberculosis
AQTVEDEARRMWASAQ

SEQ ID NO: 81907 - protein, 16 aa, Mycobacterium tuberculosis
QTVEDEARRMWASAQN

SEQ ID NO: 81908 - protein, 16 aa, Mycobacterium tuberculosis
TVEDEARRMWASAQNI

SEQ ID NO: 81909 - protein, 16 aa, Mycobacterium tuberculosis
VEDEARRMWASAQNIS

SEQ ID NO: 81910 - protein, 16 aa, Mycobacterium tuberculosis
EDEARRMWASAQNISG

SEQ ID NO: 81911 - protein, 16 aa, Mycobacterium tuberculosis
DEARRMWASAQNISGA

SEQ ID NO: 81912 - protein, 16 aa, Mycobacterium tuberculosis
EARRMWASAQNISGAG

SEQ ID NO: 81913 - protein, 16 aa, Mycobacterium tuberculosis
ARRMWASAQNISGAGW

SEQ ID NO: 81914 - protein, 16 aa, Mycobacterium tuberculosis
RRMWASAQNISGAGWS

SEQ ID NO: 81915 - protein, 16 aa, Mycobacterium tuberculosis
RMWASAQNISGAGWSG

SEQ ID NO: 81916 - protein, 16 aa, Mycobacterium tuberculosis
MWASAQNISGAGWSGM

SEQ ID NO: 81917 - protein, 16 aa, Mycobacterium tuberculosis
WASAQNISGAGWSGMA

SEQ ID NO: 81918 - protein, 16 aa, Mycobacterium tuberculosis
ASAQNISGAGWSGMAE

SEQ ID NO: 81919 - protein, 16 aa, Mycobacterium tuberculosis
SAQNISGAGWSGMAEA

SEQ ID NO: 81920 - protein, 16 aa, Mycobacterium tuberculosis
AQNISGAGWSGMAEAT

SEQ ID NO: 81921 - protein, 16 aa, Mycobacterium tuberculosis
QNISGAGWSGMAEATS

SEQ ID NO: 81922 - protein, 16 aa, Mycobacterium tuberculosis
NISGAGWSGMAEATSL

SEQ ID NO: 81923 - protein, 16 aa, Mycobacterium tuberculosis
ISGAGWSGMAEATSLD

SEQ ID NO: 81924 - protein, 16 aa, Mycobacterium tuberculosis
SGAGWSGMAEATSLDT

SEQ ID NO: 81925 - protein, 16 aa, Mycobacterium tuberculosis
GAGWSGMAEATSLDTM

SEQ ID NO: 81926 - protein, 16 aa, Mycobacterium tuberculosis
AGWSGMAEATSLDTMA

SEQ ID NO: 81927 - protein, 16 aa, Mycobacterium tuberculosis
GWSGMAEATSLDTMAQ

SEQ ID NO: 81928 - protein, 16 aa, Mycobacterium tuberculosis
WSGMAEATSLDTMAQM

SEQ ID NO: 81929 - protein, 16 aa, Mycobacterium tuberculosis
SGMAEATSLDTMAQMN

SEQ ID NO: 81930 - protein, 16 aa, Mycobacterium tuberculosis
GMAEATSLDTMAQMNQ

SEQ ID NO: 81931 - protein, 16 aa, Mycobacterium tuberculosis
MAEATSLDTMAQMNQA

SEQ ID NO: 81932 - protein, 16 aa, Mycobacterium tuberculosis
AEATSLDTMAQMNQAF

SEQ ID NO: 81933 - protein, 16 aa, Mycobacterium tuberculosis
EATSLDTMAQMNQAFR

SEQ ID NO: 81934 - protein, 16 aa, Mycobacterium tuberculosis
ATSLDTMAQMNQAFRN

SEQ ID NO: 81935 - protein, 16 aa, Mycobacterium tuberculosis
TSLDTMAQMNQAFRNI

SEQ ID NO: 81936 - protein, 16 aa, Mycobacterium tuberculosis
SLDTMAQMNQAFRNIV

SEQ ID NO: 81937 - protein, 16 aa, Mycobacterium tuberculosis
LDTMAQMNQAFRNIVN

SEQ ID NO: 81938 - protein, 16 aa, Mycobacterium tuberculosis
DTMAQMNQAFRNIVNM

SEQ ID NO: 81939 - protein, 16 aa, Mycobacterium tuberculosis
TMAQMNQAFRNIVNML

SEQ ID NO: 81940 - protein, 16 aa, Mycobacterium tuberculosis
MAQMNQAFRNIVNMLH

SEQ ID NO: 81941 - protein, 16 aa, Mycobacterium tuberculosis
AQMNQAFRNIVNMLHG

SEQ ID NO: 81942 - protein, 16 aa, Mycobacterium tuberculosis
QMNQAFRNIVNMLHGV

SEQ ID NO: 81943 - protein, 16 aa, Mycobacterium tuberculosis
MNQAFRNIVNMLHGVR

SEQ ID NO: 81944 - protein, 16 aa, Mycobacterium tuberculosis
NQAFRNIVNMLHGVRD

SEQ ID NO: 81945 - protein, 16 aa, Mycobacterium tuberculosis
QAFRNIVNMLHGVRDG

SEQ ID NO: 81946 - protein, 16 aa, Mycobacterium tuberculosis
AFRNIVNMLHGVRDGL

SEQ ID NO: 81947 - protein, 16 aa, Mycobacterium tuberculosis
FRNIVNMLHGVRDGLV

SEQ ID NO: 81948 - protein, 16 aa, Mycobacterium tuberculosis
RNIVNMLHGVRDGLVR

SEQ ID NO: 81949 - protein, 16 aa, Mycobacterium tuberculosis
NIVNMLHGVRDGLVRD

SEQ ID NO: 81950 - protein, 16 aa, Mycobacterium tuberculosis
IVNMLHGVRDGLVRDA

SEQ ID NO: 81951 - protein, 16 aa, Mycobacterium tuberculosis
VNMLHGVRDGLVRDAN

SEQ ID NO: 81952 - protein, 16 aa, Mycobacterium tuberculosis
NMLHGVRDGLVRDANN

SEQ ID NO: 81953 - protein, 16 aa, Mycobacterium tuberculosis
MLHGVRDGLVRDANNY

SEQ ID NO: 81954 - protein, 16 aa, Mycobacterium tuberculosis
LHGVRDGLVRDANNYE

SEQ ID NO: 81955 - protein, 16 aa, Mycobacterium tuberculosis
HGVRDGLVRDANNYEQ

SEQ ID NO: 81956 - protein, 16 aa, Mycobacterium tuberculosis
GVRDGLVRDANNYEQQ

SEQ ID NO: 81957 - protein, 16 aa, Mycobacterium tuberculosis
VRDGLVRDANNYEQQE

SEQ ID NO: 81958 - protein, 16 aa, Mycobacterium tuberculosis
RDGLVRDANNYEQQEQ

SEQ ID NO: 81959 - protein, 16 aa, Mycobacterium tuberculosis
DGLVRDANNYEQQEQA

SEQ ID NO: 81960 - protein, 16 aa, Mycobacterium tuberculosis
GLVRDANNYEQQEQAS

SEQ ID NO: 81961 - protein, 16 aa, Mycobacterium tuberculosis
LVRDANNYEQQEQASQ

SEQ ID NO: 81962 - protein, 16 aa, Mycobacterium tuberculosis
VRDANNYEQQEQASQQ

SEQ ID NO: 81963 - protein, 16 aa, Mycobacterium tuberculosis
RDANNYEQQEQASQQI

SEQ ID NO: 81964 - protein, 16 aa, Mycobacterium tuberculosis
DANNYEQQEQASQQIL

SEQ ID NO: 81965 - protein, 16 aa, Mycobacterium tuberculosis
ANNYEQQEQASQQILS

SEQ ID NO: 81966 - protein, 16 aa, Mycobacterium tuberculosis
NNYEQQEQASQQILSS

SEQ ID NO: 81967 - protein, 13 aa, Mycobacterium tuberculosis
MTINYQFGDVDAH

SEQ ID NO: 81968 - protein, 13 aa, Mycobacterium tuberculosis
TINYQFGDVDAHG

SEQ ID NO: 81969 - protein, 13 aa, Mycobacterium tuberculosis
INYQFGDVDAHGA

SEQ ID NO: 81970 - protein, 13 aa, Mycobacterium tuberculosis
NYQFGDVDAHGAM

SEQ ID NO: 81971 - protein, 13 aa, Mycobacterium tuberculosis
YQFGDVDAHGAMI

SEQ ID NO: 81972 - protein, 13 aa, Mycobacterium tuberculosis
QFGDVDAHGAMIR

SEQ ID NO: 81973 - protein, 13 aa, Mycobacterium tuberculosis
FGDVDAHGAMIRA

SEQ ID NO: 81974 - protein, 13 aa, Mycobacterium tuberculosis
GDVDAHGAMIRAQ

SEQ ID NO: 81975 - protein, 13 aa, Mycobacterium tuberculosis
DVDAHGAMIRAQA

SEQ ID NO: 81976 - protein, 13 aa, Mycobacterium tuberculosis
VDAHGAMIRAQAA

SEQ ID NO: 81977 - protein, 13 aa, Mycobacterium tuberculosis
DAHGAMIRAQAAS

SEQ ID NO: 81978 - protein, 13 aa, Mycobacterium tuberculosis
AHGAMIRAQAASL

SEQ ID NO: 81979 - protein, 13 aa, Mycobacterium tuberculosis
HGAMIRAQAASLE

SEQ ID NO: 81980 - protein, 13 aa, Mycobacterium tuberculosis
GAMIRAQAASLEA

SEQ ID NO: 81981 - protein, 13 aa, Mycobacterium tuberculosis
AMIRAQAASLEAE

SEQ ID NO: 81982 - protein, 13 aa, Mycobacterium tuberculosis
MIRAQAASLEAEH

SEQ ID NO: 81983 - protein, 13 aa, Mycobacterium tuberculosis
IRAQAASLEAEHQ

SEQ ID NO: 81984 - protein, 13 aa, Mycobacterium tuberculosis
RAQAASLEAEHQA

SEQ ID NO: 81985 - protein, 13 aa, Mycobacterium tuberculosis
AQAASLEAEHQAI

SEQ ID NO: 81986 - protein, 13 aa, Mycobacterium tuberculosis
QAASLEAEHQAIV

SEQ ID NO: 81987 - protein, 13 aa, Mycobacterium tuberculosis
AASLEAEHQAIVR

SEQ ID NO: 81988 - protein, 13 aa, Mycobacterium tuberculosis
ASLEAEHQAIVRD

SEQ ID NO: 81989 - protein, 13 aa, Mycobacterium tuberculosis
SLEAEHQAIVRDV

SEQ ID NO: 81990 - protein, 13 aa, Mycobacterium tuberculosis
LEAEHQAIVRDVL

SEQ ID NO: 81991 - protein, 13 aa, Mycobacterium tuberculosis
EAEHQAIVRDVLA

SEQ ID NO: 81992 - protein, 13 aa, Mycobacterium tuberculosis
AEHQAIVRDVLAA

SEQ ID NO: 81993 - protein, 13 aa, Mycobacterium tuberculosis
EHQAIVRDVLAAG

SEQ ID NO: 81994 - protein, 13 aa, Mycobacterium tuberculosis
HQAIVRDVLAAGD

SEQ ID NO: 81995 - protein, 13 aa, Mycobacterium tuberculosis
QAIVRDVLAAGDF

SEQ ID NO: 81996 - protein, 13 aa, Mycobacterium tuberculosis
AIVRDVLAAGDFW

SEQ ID NO: 81997 - protein, 13 aa, Mycobacterium tuberculosis
IVRDVLAAGDFWG

SEQ ID NO: 81998 - protein, 13 aa, Mycobacterium tuberculosis
VRDVLAAGDFWGG

SEQ ID NO: 81999 - protein, 13 aa, Mycobacterium tuberculosis
RDVLAAGDFWGGA

SEQ ID NO: 82000 - protein, 13 aa, Mycobacterium tuberculosis
DVLAAGDFWGGAG

SEQ ID NO: 82001 - protein, 13 aa, Mycobacterium tuberculosis
VLAAGDFWGGAGS

SEQ ID NO: 82002 - protein, 13 aa, Mycobacterium tuberculosis
LAAGDFWGGAGSV

SEQ ID NO: 82003 - protein, 13 aa, Mycobacterium tuberculosis
AAGDFWGGAGSVA

SEQ ID NO: 82004 - protein, 13 aa, Mycobacterium tuberculosis
AGDFWGGAGSVAC

SEQ ID NO: 82005 - protein, 13 aa, Mycobacterium tuberculosis
GDFWGGAGSVACQ

SEQ ID NO: 82006 - protein, 13 aa, Mycobacterium tuberculosis
DFWGGAGSVACQE

SEQ ID NO: 82007 - protein, 13 aa, Mycobacterium tuberculosis
FWGGAGSVACQEF

SEQ ID NO: 82008 - protein, 13 aa, Mycobacterium tuberculosis
WGGAGSVACQEFI

SEQ ID NO: 82009 - protein, 13 aa, Mycobacterium tuberculosis
GGAGSVACQEFIT

SEQ ID NO: 82010 - protein, 13 aa, Mycobacterium tuberculosis
GAGSVACQEFITQ

SEQ ID NO: 82011 - protein, 13 aa, Mycobacterium tuberculosis
AGSVACQEFITQL

SEQ ID NO: 82012 - protein, 13 aa, Mycobacterium tuberculosis
GSVACQEFITQLG

SEQ ID NO: 82013 - protein, 13 aa, Mycobacterium tuberculosis
SVACQEFITQLGR

SEQ ID NO: 82014 - protein, 13 aa, Mycobacterium tuberculosis
VACQEFITQLGRN

SEQ ID NO: 82015 - protein, 13 aa, Mycobacterium tuberculosis
ACQEFITQLGRNF

SEQ ID NO: 82016 - protein, 13 aa, Mycobacterium tuberculosis
CQEFITQLGRNFQ

SEQ ID NO: 82017 - protein, 13 aa, Mycobacterium tuberculosis
QEFITQLGRNFQV

SEQ ID NO: 82018 - protein, 13 aa, Mycobacterium tuberculosis
EFITQLGRNFQVI

SEQ ID NO: 82019 - protein, 13 aa, Mycobacterium tuberculosis
FITQLGRNFQVIY

SEQ ID NO: 82020 - protein, 13 aa, Mycobacterium tuberculosis
ITQLGRNFQVIYE

SEQ ID NO: 82021 - protein, 13 aa, Mycobacterium tuberculosis
TQLGRNFQVIYEQ

SEQ ID NO: 82022 - protein, 13 aa, Mycobacterium tuberculosis
QLGRNFQVIYEQA

SEQ ID NO: 82023 - protein, 13 aa, Mycobacterium tuberculosis
LGRNFQVIYEQAN

SEQ ID NO: 82024 - protein, 13 aa, Mycobacterium tuberculosis
GRNFQVIYEQANA

SEQ ID NO: 82025 - protein, 13 aa, Mycobacterium tuberculosis
RNFQVIYEQANAH

SEQ ID NO: 82026 - protein, 13 aa, Mycobacterium tuberculosis
NFQVIYEQANAHG

SEQ ID NO: 82027 - protein, 13 aa, Mycobacterium tuberculosis
FQVIYEQANAHGQ

SEQ ID NO: 82028 - protein, 13 aa, Mycobacterium tuberculosis
QVIYEQANAHGQK

SEQ ID NO: 82029 - protein, 13 aa, Mycobacterium tuberculosis
VIYEQANAHGQKV

SEQ ID NO: 82030 - protein, 13 aa, Mycobacterium tuberculosis
IYEQANAHGQKVQ

SEQ ID NO: 82031 - protein, 13 aa, Mycobacterium tuberculosis
YEQANAHGQKVQA

SEQ ID NO: 82032 - protein, 13 aa, Mycobacterium tuberculosis
EQANAHGQKVQAA

SEQ ID NO: 82033 - protein, 13 aa, Mycobacterium tuberculosis
QANAHGQKVQAAG

SEQ ID NO: 82034 - protein, 13 aa, Mycobacterium tuberculosis
ANAHGQKVQAAGN

SEQ ID NO: 82035 - protein, 13 aa, Mycobacterium tuberculosis
NAHGQKVQAAGNN

SEQ ID NO: 82036 - protein, 13 aa, Mycobacterium tuberculosis
AHGQKVQAAGNNM

SEQ ID NO: 82037 - protein, 13 aa, Mycobacterium tuberculosis
HGQKVQAAGNNMA

SEQ ID NO: 82038 - protein, 13 aa, Mycobacterium tuberculosis
GQKVQAAGNNMAQ

SEQ ID NO: 82039 - protein, 13 aa, Mycobacterium tuberculosis
QKVQAAGNNMAQT

SEQ ID NO: 82040 - protein, 13 aa, Mycobacterium tuberculosis
KVQAAGNNMAQTD

SEQ ID NO: 82041 - protein, 13 aa, Mycobacterium tuberculosis
VQAAGNNMAQTDS

SEQ ID NO: 82042 - protein, 13 aa, Mycobacterium tuberculosis
QAAGNNMAQTDSA

SEQ ID NO: 82043 - protein, 13 aa, Mycobacterium tuberculosis
AAGNNMAQTDSAV

SEQ ID NO: 82044 - protein, 13 aa, Mycobacterium tuberculosis
AGNNMAQTDSAVG

SEQ ID NO: 82045 - protein, 13 aa, Mycobacterium tuberculosis
GNNMAQTDSAVGS

SEQ ID NO: 82046 - protein, 13 aa, Mycobacterium tuberculosis
NNMAQTDSAVGSS

SEQ ID NO: 82047 - protein, 13 aa, Mycobacterium tuberculosis
NMAQTDSAVGSSW

SEQ ID NO: 82048 - protein, 13 aa, Mycobacterium tuberculosis
MAQTDSAVGSSWA

SEQ ID NO: 82049 - protein, 14 aa, Mycobacterium tuberculosis
MTINYQFGDVDAHG

SEQ ID NO: 82050 - protein, 14 aa, Mycobacterium tuberculosis
TINYQFGDVDAHGA

SEQ ID NO: 82051 - protein, 14 aa, Mycobacterium tuberculosis
INYQFGDVDAHGAM

SEQ ID NO: 82052 - protein, 14 aa, Mycobacterium tuberculosis
NYQFGDVDAHGAMI

SEQ ID NO: 82053 - protein, 14 aa, Mycobacterium tuberculosis
YQFGDVDAHGAMIR

SEQ ID NO: 82054 - protein, 14 aa, Mycobacterium tuberculosis
QFGDVDAHGAMIRA

SEQ ID NO: 82055 - protein, 14 aa, Mycobacterium tuberculosis
FGDVDAHGAMIRAQ

SEQ ID NO: 82056 - protein, 14 aa, Mycobacterium tuberculosis
GDVDAHGAMIRAQA

SEQ ID NO: 82057 - protein, 14 aa, Mycobacterium tuberculosis
DVDAHGAMIRAQAA

SEQ ID NO: 82058 - protein, 14 aa, Mycobacterium tuberculosis
VDAHGAMIRAQAAS

SEQ ID NO: 82059 - protein, 14 aa, Mycobacterium tuberculosis
DAHGAMIRAQAASL

SEQ ID NO: 82060 - protein, 14 aa, Mycobacterium tuberculosis
AHGAMIRAQAASLE

SEQ ID NO: 82061 - protein, 14 aa, Mycobacterium tuberculosis
HGAMIRAQAASLEA

SEQ ID NO: 82062 - protein, 14 aa, Mycobacterium tuberculosis
GAMIRAQAASLEAE

SEQ ID NO: 82063 - protein, 14 aa, Mycobacterium tuberculosis
AMIRAQAASLEAEH

SEQ ID NO: 82064 - protein, 14 aa, Mycobacterium tuberculosis
MIRAQAASLEAEHQ

SEQ ID NO: 82065 - protein, 14 aa, Mycobacterium tuberculosis
IRAQAASLEAEHQA

SEQ ID NO: 82066 - protein, 14 aa, Mycobacterium tuberculosis
RAQAASLEAEHQAI

SEQ ID NO: 82067 - protein, 14 aa, Mycobacterium tuberculosis
AQAASLEAEHQAIV

SEQ ID NO: 82068 - protein, 14 aa, Mycobacterium tuberculosis
QAASLEAEHQAIVR

SEQ ID NO: 82069 - protein, 14 aa, Mycobacterium tuberculosis
AASLEAEHQAIVRD

SEQ ID NO: 82070 - protein, 14 aa, Mycobacterium tuberculosis
ASLEAEHQAIVRDV

SEQ ID NO: 82071 - protein, 14 aa, Mycobacterium tuberculosis
SLEAEHQAIVRDVL

SEQ ID NO: 82072 - protein, 14 aa, Mycobacterium tuberculosis
LEAEHQAIVRDVLA

SEQ ID NO: 82073 - protein, 14 aa, Mycobacterium tuberculosis
EAEHQAIVRDVLAA

SEQ ID NO: 82074 - protein, 14 aa, Mycobacterium tuberculosis
AEHQAIVRDVLAAG

SEQ ID NO: 82075 - protein, 14 aa, Mycobacterium tuberculosis
EHQAIVRDVLAAGD

SEQ ID NO: 82076 - protein, 14 aa, Mycobacterium tuberculosis
HQAIVRDVLAAGDF

SEQ ID NO: 82077 - protein, 14 aa, Mycobacterium tuberculosis
QAIVRDVLAAGDFW

SEQ ID NO: 82078 - protein, 14 aa, Mycobacterium tuberculosis
AIVRDVLAAGDFWG

SEQ ID NO: 82079 - protein, 14 aa, Mycobacterium tuberculosis
IVRDVLAAGDFWGG

SEQ ID NO: 82080 - protein, 14 aa, Mycobacterium tuberculosis
VRDVLAAGDFWGGA

SEQ ID NO: 82081 - protein, 14 aa, Mycobacterium tuberculosis
RDVLAAGDFWGGAG

SEQ ID NO: 82082 - protein, 14 aa, Mycobacterium tuberculosis
DVLAAGDFWGGAGS

SEQ ID NO: 82083 - protein, 14 aa, Mycobacterium tuberculosis
VLAAGDFWGGAGSV

SEQ ID NO: 82084 - protein, 14 aa, Mycobacterium tuberculosis
LAAGDFWGGAGSVA

SEQ ID NO: 82085 - protein, 14 aa, Mycobacterium tuberculosis
AAGDFWGGAGSVAC

SEQ ID NO: 82086 - protein, 14 aa, Mycobacterium tuberculosis
AGDFWGGAGSVACQ

SEQ ID NO: 82087 - protein, 14 aa, Mycobacterium tuberculosis
GDFWGGAGSVACQE

SEQ ID NO: 82088 - protein, 14 aa, Mycobacterium tuberculosis
DFWGGAGSVACQEF

SEQ ID NO: 82089 - protein, 14 aa, Mycobacterium tuberculosis
FWGGAGSVACQEFI

SEQ ID NO: 82090 - protein, 14 aa, Mycobacterium tuberculosis
WGGAGSVACQEFIT

SEQ ID NO: 82091 - protein, 14 aa, Mycobacterium tuberculosis
GGAGSVACQEFITQ

SEQ ID NO: 82092 - protein, 14 aa, Mycobacterium tuberculosis
GAGSVACQEFITQL

SEQ ID NO: 82093 - protein, 14 aa, Mycobacterium tuberculosis
AGSVACQEFITQLG

SEQ ID NO: 82094 - protein, 14 aa, Mycobacterium tuberculosis
GSVACQEFITQLGR

SEQ ID NO: 82095 - protein, 14 aa, Mycobacterium tuberculosis
SVACQEFITQLGRN

SEQ ID NO: 82096 - protein, 14 aa, Mycobacterium tuberculosis
VACQEFITQLGRNF

SEQ ID NO: 82097 - protein, 14 aa, Mycobacterium tuberculosis
ACQEFITQLGRNFQ

SEQ ID NO: 82098 - protein, 14 aa, Mycobacterium tuberculosis
CQEFITQLGRNFQV

SEQ ID NO: 82099 - protein, 14 aa, Mycobacterium tuberculosis
QEFITQLGRNFQVI

SEQ ID NO: 82100 - protein, 14 aa, Mycobacterium tuberculosis
EFITQLGRNFQVIY

SEQ ID NO: 82101 - protein, 14 aa, Mycobacterium tuberculosis
FITQLGRNFQVIYE

SEQ ID NO: 82102 - protein, 14 aa, Mycobacterium tuberculosis
ITQLGRNFQVIYEQ

SEQ ID NO: 82103 - protein, 14 aa, Mycobacterium tuberculosis
TQLGRNFQVIYEQA

SEQ ID NO: 82104 - protein, 14 aa, Mycobacterium tuberculosis
QLGRNFQVIYEQAN

SEQ ID NO: 82105 - protein, 14 aa, Mycobacterium tuberculosis
LGRNFQVIYEQANA

SEQ ID NO: 82106 - protein, 14 aa, Mycobacterium tuberculosis
GRNFQVIYEQANAH

SEQ ID NO: 82107 - protein, 14 aa, Mycobacterium tuberculosis
RNFQVIYEQANAHG

SEQ ID NO: 82108 - protein, 14 aa, Mycobacterium tuberculosis
NFQVIYEQANAHGQ

SEQ ID NO: 82109 - protein, 14 aa, Mycobacterium tuberculosis
FQVIYEQANAHGQK

SEQ ID NO: 82110 - protein, 14 aa, Mycobacterium tuberculosis
QVIYEQANAHGQKV

SEQ ID NO: 82111 - protein, 14 aa, Mycobacterium tuberculosis
VIYEQANAHGQKVQ

SEQ ID NO: 82112 - protein, 14 aa, Mycobacterium tuberculosis
IYEQANAHGQKVQA

SEQ ID NO: 82113 - protein, 14 aa, Mycobacterium tuberculosis
YEQANAHGQKVQAA

SEQ ID NO: 82114 - protein, 14 aa, Mycobacterium tuberculosis
EQANAHGQKVQAAG

SEQ ID NO: 82115 - protein, 14 aa, Mycobacterium tuberculosis
QANAHGQKVQAAGN

SEQ ID NO: 82116 - protein, 14 aa, Mycobacterium tuberculosis
ANAHGQKVQAAGNN

SEQ ID NO: 82117 - protein, 14 aa, Mycobacterium tuberculosis
NAHGQKVQAAGNNM

SEQ ID NO: 82118 - protein, 14 aa, Mycobacterium tuberculosis
AHGQKVQAAGNNMA

SEQ ID NO: 82119 - protein, 14 aa, Mycobacterium tuberculosis
HGQKVQAAGNNMAQ

SEQ ID NO: 82120 - protein, 14 aa, Mycobacterium tuberculosis
GQKVQAAGNNMAQT

SEQ ID NO: 82121 - protein, 14 aa, Mycobacterium tuberculosis
QKVQAAGNNMAQTD

SEQ ID NO: 82122 - protein, 14 aa, Mycobacterium tuberculosis
KVQAAGNNMAQTDS

SEQ ID NO: 82123 - protein, 14 aa, Mycobacterium tuberculosis
VQAAGNNMAQTDSA

SEQ ID NO: 82124 - protein, 14 aa, Mycobacterium tuberculosis
QAAGNNMAQTDSAV

SEQ ID NO: 82125 - protein, 14 aa, Mycobacterium tuberculosis
AAGNNMAQTDSAVG

SEQ ID NO: 82126 - protein, 14 aa, Mycobacterium tuberculosis
AGNNMAQTDSAVGS

SEQ ID NO: 82127 - protein, 14 aa, Mycobacterium tuberculosis
GNNMAQTDSAVGSS

SEQ ID NO: 82128 - protein, 14 aa, Mycobacterium tuberculosis
NNMAQTDSAVGSSW

SEQ ID NO: 82129 - protein, 14 aa, Mycobacterium tuberculosis
NMAQTDSAVGSSWA

SEQ ID NO: 82130 - protein, 15 aa, Mycobacterium tuberculosis
MTINYQFGDVDAHGA

SEQ ID NO: 82131 - protein, 15 aa, Mycobacterium tuberculosis
TINYQFGDVDAHGAM

SEQ ID NO: 82132 - protein, 15 aa, Mycobacterium tuberculosis
INYQFGDVDAHGAMI

SEQ ID NO: 82133 - protein, 15 aa, Mycobacterium tuberculosis
NYQFGDVDAHGAMIR

SEQ ID NO: 82134 - protein, 15 aa, Mycobacterium tuberculosis
YQFGDVDAHGAMIRA

SEQ ID NO: 82135 - protein, 15 aa, Mycobacterium tuberculosis
QFGDVDAHGAMIRAQ

SEQ ID NO: 82136 - protein, 15 aa, Mycobacterium tuberculosis
FGDVDAHGAMIRAQA

SEQ ID NO: 82137 - protein, 15 aa, Mycobacterium tuberculosis
GDVDAHGAMIRAQAA

SEQ ID NO: 82138 - protein, 15 aa, Mycobacterium tuberculosis
DVDAHGAMIRAQAAS

SEQ ID NO: 82139 - protein, 15 aa, Mycobacterium tuberculosis
VDAHGAMIRAQAASL

SEQ ID NO: 82140 - protein, 15 aa, Mycobacterium tuberculosis
DAHGAMIRAQAASLE

SEQ ID NO: 82141 - protein, 15 aa, Mycobacterium tuberculosis
AHGAMIRAQAASLEA

SEQ ID NO: 82142 - protein, 15 aa, Mycobacterium tuberculosis
HGAMIRAQAASLEAE

SEQ ID NO: 82143 - protein, 15 aa, Mycobacterium tuberculosis
GAMIRAQAASLEAEH

SEQ ID NO: 82144 - protein, 15 aa, Mycobacterium tuberculosis
AMIRAQAASLEAEHQ

SEQ ID NO: 82145 - protein, 15 aa, Mycobacterium tuberculosis
MIRAQAASLEAEHQA

SEQ ID NO: 82146 - protein, 15 aa, Mycobacterium tuberculosis
IRAQAASLEAEHQAI

SEQ ID NO: 82147 - protein, 15 aa, Mycobacterium tuberculosis
RAQAASLEAEHQAIV

SEQ ID NO: 82148 - protein, 15 aa, Mycobacterium tuberculosis
AQAASLEAEHQAIVR

SEQ ID NO: 82149 - protein, 15 aa, Mycobacterium tuberculosis
QAASLEAEHQAIVRD

SEQ ID NO: 82150 - protein, 15 aa, Mycobacterium tuberculosis
AASLEAEHQAIVRDV

SEQ ID NO: 82151 - protein, 15 aa, Mycobacterium tuberculosis
ASLEAEHQAIVRDVL

SEQ ID NO: 82152 - protein, 15 aa, Mycobacterium tuberculosis
SLEAEHQAIVRDVLA

SEQ ID NO: 82153 - protein, 15 aa, Mycobacterium tuberculosis
LEAEHQAIVRDVLAA

SEQ ID NO: 82154 - protein, 15 aa, Mycobacterium tuberculosis
EAEHQAIVRDVLAAG

SEQ ID NO: 82155 - protein, 15 aa, Mycobacterium tuberculosis
AEHQAIVRDVLAAGD

SEQ ID NO: 82156 - protein, 15 aa, Mycobacterium tuberculosis
EHQAIVRDVLAAGDF

SEQ ID NO: 82157 - protein, 15 aa, Mycobacterium tuberculosis
HQAIVRDVLAAGDFW

SEQ ID NO: 82158 - protein, 15 aa, Mycobacterium tuberculosis
QAIVRDVLAAGDFWG

SEQ ID NO: 82159 - protein, 15 aa, Mycobacterium tuberculosis
AIVRDVLAAGDFWGG

SEQ ID NO: 82160 - protein, 15 aa, Mycobacterium tuberculosis
IVRDVLAAGDFWGGA

SEQ ID NO: 82161 - protein, 15 aa, Mycobacterium tuberculosis
VRDVLAAGDFWGGAG

SEQ ID NO: 82162 - protein, 15 aa, Mycobacterium tuberculosis
RDVLAAGDFWGGAGS

SEQ ID NO: 82163 - protein, 15 aa, Mycobacterium tuberculosis
DVLAAGDFWGGAGSV

SEQ ID NO: 82164 - protein, 15 aa, Mycobacterium tuberculosis
VLAAGDFWGGAGSVA

SEQ ID NO: 82165 - protein, 15 aa, Mycobacterium tuberculosis
LAAGDFWGGAGSVAC

SEQ ID NO: 82166 - protein, 15 aa, Mycobacterium tuberculosis
AAGDFWGGAGSVACQ

SEQ ID NO: 82167 - protein, 15 aa, Mycobacterium tuberculosis
AGDFWGGAGSVACQE

SEQ ID NO: 82168 - protein, 15 aa, Mycobacterium tuberculosis
GDFWGGAGSVACQEF

SEQ ID NO: 82169 - protein, 15 aa, Mycobacterium tuberculosis
DFWGGAGSVACQEFI

SEQ ID NO: 82170 - protein, 15 aa, Mycobacterium tuberculosis
FWGGAGSVACQEFIT

SEQ ID NO: 82171 - protein, 15 aa, Mycobacterium tuberculosis
WGGAGSVACQEFITQ

SEQ ID NO: 82172 - protein, 15 aa, Mycobacterium tuberculosis
GGAGSVACQEFITQL

SEQ ID NO: 82173 - protein, 15 aa, Mycobacterium tuberculosis
GAGSVACQEFITQLG

SEQ ID NO: 82174 - protein, 15 aa, Mycobacterium tuberculosis
AGSVACQEFITQLGR

SEQ ID NO: 82175 - protein, 15 aa, Mycobacterium tuberculosis
GSVACQEFITQLGRN

SEQ ID NO: 82176 - protein, 15 aa, Mycobacterium tuberculosis
SVACQEFITQLGRNF

SEQ ID NO: 82177 - protein, 15 aa, Mycobacterium tuberculosis
VACQEFITQLGRNFQ

SEQ ID NO: 82178 - protein, 15 aa, Mycobacterium tuberculosis
ACQEFITQLGRNFQV

SEQ ID NO: 82179 - protein, 15 aa, Mycobacterium tuberculosis
CQEFITQLGRNFQVI

SEQ ID NO: 82180 - protein, 15 aa, Mycobacterium tuberculosis
QEFITQLGRNFQVIY

SEQ ID NO: 82181 - protein, 15 aa, Mycobacterium tuberculosis
EFITQLGRNFQVIYE

SEQ ID NO: 82182 - protein, 15 aa, Mycobacterium tuberculosis
FITQLGRNFQVIYEQ

SEQ ID NO: 82183 - protein, 15 aa, Mycobacterium tuberculosis
ITQLGRNFQVIYEQA

SEQ ID NO: 82184 - protein, 15 aa, Mycobacterium tuberculosis
TQLGRNFQVIYEQAN

SEQ ID NO: 82185 - protein, 15 aa, Mycobacterium tuberculosis
QLGRNFQVIYEQANA

SEQ ID NO: 82186 - protein, 15 aa, Mycobacterium tuberculosis
LGRNFQVIYEQANAH

SEQ ID NO: 82187 - protein, 15 aa, Mycobacterium tuberculosis
GRNFQVIYEQANAHG

SEQ ID NO: 82188 - protein, 15 aa, Mycobacterium tuberculosis
RNFQVIYEQANAHGQ

SEQ ID NO: 82189 - protein, 15 aa, Mycobacterium tuberculosis
NFQVIYEQANAHGQK

SEQ ID NO: 82190 - protein, 15 aa, Mycobacterium tuberculosis
FQVIYEQANAHGQKV

SEQ ID NO: 82191 - protein, 15 aa, Mycobacterium tuberculosis
QVIYEQANAHGQKVQ

SEQ ID NO: 82192 - protein, 15 aa, Mycobacterium tuberculosis
VIYEQANAHGQKVQA

SEQ ID NO: 82193 - protein, 15 aa, Mycobacterium tuberculosis
IYEQANAHGQKVQAA

SEQ ID NO: 82194 - protein, 15 aa, Mycobacterium tuberculosis
YEQANAHGQKVQAAG

SEQ ID NO: 82195 - protein, 15 aa, Mycobacterium tuberculosis
EQANAHGQKVQAAGN

SEQ ID NO: 82196 - protein, 15 aa, Mycobacterium tuberculosis
QANAHGQKVQAAGNN

SEQ ID NO: 82197 - protein, 15 aa, Mycobacterium tuberculosis
ANAHGQKVQAAGNNM

SEQ ID NO: 82198 - protein, 15 aa, Mycobacterium tuberculosis
NAHGQKVQAAGNNMA

SEQ ID NO: 82199 - protein, 15 aa, Mycobacterium tuberculosis
AHGQKVQAAGNNMAQ

SEQ ID NO: 82200 - protein, 15 aa, Mycobacterium tuberculosis
HGQKVQAAGNNMAQT

SEQ ID NO: 82201 - protein, 15 aa, Mycobacterium tuberculosis
GQKVQAAGNNMAQTD

SEQ ID NO: 82202 - protein, 15 aa, Mycobacterium tuberculosis
QKVQAAGNNMAQTDS

SEQ ID NO: 82203 - protein, 15 aa, Mycobacterium tuberculosis
KVQAAGNNMAQTDSA

SEQ ID NO: 82204 - protein, 15 aa, Mycobacterium tuberculosis
VQAAGNNMAQTDSAV

SEQ ID NO: 82205 - protein, 15 aa, Mycobacterium tuberculosis
QAAGNNMAQTDSAVG

SEQ ID NO: 82206 - protein, 15 aa, Mycobacterium tuberculosis
AAGNNMAQTDSAVGS

SEQ ID NO: 82207 - protein, 15 aa, Mycobacterium tuberculosis
AGNNMAQTDSAVGSS

SEQ ID NO: 82208 - protein, 15 aa, Mycobacterium tuberculosis
GNNMAQTDSAVGSSW

SEQ ID NO: 82209 - protein, 15 aa, Mycobacterium tuberculosis
NNMAQTDSAVGSSWA

SEQ ID NO: 82210 - protein, 16 aa, Mycobacterium tuberculosis
MTINYQFGDVDAHGAM

SEQ ID NO: 82211 - protein, 16 aa, Mycobacterium tuberculosis
TINYQFGDVDAHGAMI

SEQ ID NO: 82212 - protein, 16 aa, Mycobacterium tuberculosis
INYQFGDVDAHGAMIR

SEQ ID NO: 82213 - protein, 16 aa, Mycobacterium tuberculosis
NYQFGDVDAHGAMIRA

SEQ ID NO: 82214 - protein, 16 aa, Mycobacterium tuberculosis
YQFGDVDAHGAMIRAQ

SEQ ID NO: 82215 - protein, 16 aa, Mycobacterium tuberculosis
QFGDVDAHGAMIRAQA

SEQ ID NO: 82216 - protein, 16 aa, Mycobacterium tuberculosis
FGDVDAHGAMIRAQAA

SEQ ID NO: 82217 - protein, 16 aa, Mycobacterium tuberculosis
GDVDAHGAMIRAQAAS

SEQ ID NO: 82218 - protein, 16 aa, Mycobacterium tuberculosis
DVDAHGAMIRAQAASL

SEQ ID NO: 82219 - protein, 16 aa, Mycobacterium tuberculosis
VDAHGAMIRAQAASLE

SEQ ID NO: 82220 - protein, 16 aa, Mycobacterium tuberculosis
DAHGAMIRAQAASLEA

SEQ ID NO: 82221 - protein, 16 aa, Mycobacterium tuberculosis
AHGAMIRAQAASLEAE

SEQ ID NO: 82222 - protein, 16 aa, Mycobacterium tuberculosis
HGAMIRAQAASLEAEH

SEQ ID NO: 82223 - protein, 16 aa, Mycobacterium tuberculosis
GAMIRAQAASLEAEHQ

SEQ ID NO: 82224 - protein, 16 aa, Mycobacterium tuberculosis
AMIRAQAASLEAEHQA

SEQ ID NO: 82225 - protein, 16 aa, Mycobacterium tuberculosis
MIRAQAASLEAEHQAI

SEQ ID NO: 82226 - protein, 16 aa, Mycobacterium tuberculosis
IRAQAASLEAEHQAIV

SEQ ID NO: 82227 - protein, 16 aa, Mycobacterium tuberculosis
RAQAASLEAEHQAIVR

SEQ ID NO: 82228 - protein, 16 aa, Mycobacterium tuberculosis
AQAASLEAEHQAIVRD

SEQ ID NO: 82229 - protein, 16 aa, Mycobacterium tuberculosis
QAASLEAEHQAIVRDV

SEQ ID NO: 82230 - protein, 16 aa, Mycobacterium tuberculosis
AASLEAEHQAIVRDVL

SEQ ID NO: 82231 - protein, 16 aa, Mycobacterium tuberculosis
ASLEAEHQAIVRDVLA

SEQ ID NO: 82232 - protein, 16 aa, Mycobacterium tuberculosis
SLEAEHQAIVRDVLAA

SEQ ID NO: 82233 - protein, 16 aa, Mycobacterium tuberculosis
LEAEHQAIVRDVLAAG

SEQ ID NO: 82234 - protein, 16 aa, Mycobacterium tuberculosis
EAEHQAIVRDVLAAGD

SEQ ID NO: 82235 - protein, 16 aa, Mycobacterium tuberculosis
AEHQAIVRDVLAAGDF

SEQ ID NO: 82236 - protein, 16 aa, Mycobacterium tuberculosis
EHQAIVRDVLAAGDFW

SEQ ID NO: 82237 - protein, 16 aa, Mycobacterium tuberculosis
HQAIVRDVLAAGDFWG

SEQ ID NO: 82238 - protein, 16 aa, Mycobacterium tuberculosis
QAIVRDVLAAGDFWGG

SEQ ID NO: 82239 - protein, 16 aa, Mycobacterium tuberculosis
AIVRDVLAAGDFWGGA

SEQ ID NO: 82240 - protein, 16 aa, Mycobacterium tuberculosis
IVRDVLAAGDFWGGAG

SEQ ID NO: 82241 - protein, 16 aa, Mycobacterium tuberculosis
VRDVLAAGDFWGGAGS

SEQ ID NO: 82242 - protein, 16 aa, Mycobacterium tuberculosis
RDVLAAGDFWGGAGSV

SEQ ID NO: 82243 - protein, 16 aa, Mycobacterium tuberculosis
DVLAAGDFWGGAGSVA

SEQ ID NO: 82244 - protein, 16 aa, Mycobacterium tuberculosis
VLAAGDFWGGAGSVAC

SEQ ID NO: 82245 - protein, 16 aa, Mycobacterium tuberculosis
LAAGDFWGGAGSVACQ

SEQ ID NO: 82246 - protein, 16 aa, Mycobacterium tuberculosis
AAGDFWGGAGSVACQE

SEQ ID NO: 82247 - protein, 16 aa, Mycobacterium tuberculosis
AGDFWGGAGSVACQEF

SEQ ID NO: 82248 - protein, 16 aa, Mycobacterium tuberculosis
GDFWGGAGSVACQEFI

SEQ ID NO: 82249 - protein, 16 aa, Mycobacterium tuberculosis
DFWGGAGSVACQEFIT

SEQ ID NO: 82250 - protein, 16 aa, Mycobacterium tuberculosis
FWGGAGSVACQEFITQ

SEQ ID NO: 82251 - protein, 16 aa, Mycobacterium tuberculosis
WGGAGSVACQEFITQL

SEQ ID NO: 82252 - protein, 16 aa, Mycobacterium tuberculosis
GGAGSVACQEFITQLG

SEQ ID NO: 82253 - protein, 16 aa, Mycobacterium tuberculosis
GAGSVACQEFITQLGR

SEQ ID NO: 82254 - protein, 16 aa, Mycobacterium tuberculosis
AGSVACQEFITQLGRN

SEQ ID NO: 82255 - protein, 16 aa, Mycobacterium tuberculosis
GSVACQEFITQLGRNF

SEQ ID NO: 82256 - protein, 16 aa, Mycobacterium tuberculosis
SVACQEFITQLGRNFQ

SEQ ID NO: 82257 - protein, 16 aa, Mycobacterium tuberculosis
VACQEFITQLGRNFQV

SEQ ID NO: 82258 - protein, 16 aa, Mycobacterium tuberculosis
ACQEFITQLGRNFQVI

SEQ ID NO: 82259 - protein, 16 aa, Mycobacterium tuberculosis
CQEFITQLGRNFQVIY

SEQ ID NO: 82260 - protein, 16 aa, Mycobacterium tuberculosis
QEFITQLGRNFQVIYE

SEQ ID NO: 82261 - protein, 16 aa, Mycobacterium tuberculosis
EFITQLGRNFQVIYEQ

SEQ ID NO: 82262 - protein, 16 aa, Mycobacterium tuberculosis
FITQLGRNFQVIYEQA

SEQ ID NO: 82263 - protein, 16 aa, Mycobacterium tuberculosis
ITQLGRNFQVIYEQAN

SEQ ID NO: 82264 - protein, 16 aa, Mycobacterium tuberculosis
TQLGRNFQVIYEQANA

SEQ ID NO: 82265 - protein, 16 aa, Mycobacterium tuberculosis
QLGRNFQVIYEQANAH

SEQ ID NO: 82266 - protein, 16 aa, Mycobacterium tuberculosis
LGRNFQVIYEQANAHG

SEQ ID NO: 82267 - protein, 16 aa, Mycobacterium tuberculosis
GRNFQVIYEQANAHGQ

SEQ ID NO: 82268 - protein, 16 aa, Mycobacterium tuberculosis
RNFQVIYEQANAHGQK

SEQ ID NO: 82269 - protein, 16 aa, Mycobacterium tuberculosis
NFQVIYEQANAHGQKV

SEQ ID NO: 82270 - protein, 16 aa, Mycobacterium tuberculosis
FQVIYEQANAHGQKVQ

SEQ ID NO: 82271 - protein, 16 aa, Mycobacterium tuberculosis
QVIYEQANAHGQKVQA

SEQ ID NO: 82272 - protein, 16 aa, Mycobacterium tuberculosis
VIYEQANAHGQKVQAA

SEQ ID NO: 82273 - protein, 16 aa, Mycobacterium tuberculosis
IYEQANAHGQKVQAAG

SEQ ID NO: 82274 - protein, 16 aa, Mycobacterium tuberculosis
YEQANAHGQKVQAAGN

SEQ ID NO: 82275 - protein, 16 aa, Mycobacterium tuberculosis
EQANAHGQKVQAAGNN

SEQ ID NO: 82276 - protein, 16 aa, Mycobacterium tuberculosis
QANAHGQKVQAAGNNM

SEQ ID NO: 82277 - protein, 16 aa, Mycobacterium tuberculosis
ANAHGQKVQAAGNNMA

SEQ ID NO: 82278 - protein, 16 aa, Mycobacterium tuberculosis
NAHGQKVQAAGNNMAQ

SEQ ID NO: 82279 - protein, 16 aa, Mycobacterium tuberculosis
AHGQKVQAAGNNMAQT

SEQ ID NO: 82280 - protein, 16 aa, Mycobacterium tuberculosis
HGQKVQAAGNNMAQTD

SEQ ID NO: 82281 - protein, 16 aa, Mycobacterium tuberculosis
GQKVQAAGNNMAQTDS

SEQ ID NO: 82282 - protein, 16 aa, Mycobacterium tuberculosis
QKVQAAGNNMAQTDSA

SEQ ID NO: 82283 - protein, 16 aa, Mycobacterium tuberculosis
KVQAAGNNMAQTDSAV

SEQ ID NO: 82284 - protein, 16 aa, Mycobacterium tuberculosis
VQAAGNNMAQTDSAVG

SEQ ID NO: 82285 - protein, 16 aa, Mycobacterium tuberculosis
QAAGNNMAQTDSAVGS

SEQ ID NO: 82286 - protein, 16 aa, Mycobacterium tuberculosis
AAGNNMAQTDSAVGSS

SEQ ID NO: 82287 - protein, 16 aa, Mycobacterium tuberculosis
AGNNMAQTDSAVGSSW

SEQ ID NO: 82288 - protein, 16 aa, Mycobacterium tuberculosis
GNNMAQTDSAVGSSWA

SEQ ID NO: 82289 - protein, 13 aa, Mycobacterium tuberculosis
MDFGLQPPEITSG

SEQ ID NO: 82290 - protein, 13 aa, Mycobacterium tuberculosis
DFGLQPPEITSGE

SEQ ID NO: 82291 - protein, 13 aa, Mycobacterium tuberculosis
FGLQPPEITSGEM

SEQ ID NO: 82292 - protein, 13 aa, Mycobacterium tuberculosis
GLQPPEITSGEMY

SEQ ID NO: 82293 - protein, 13 aa, Mycobacterium tuberculosis
LQPPEITSGEMYL

SEQ ID NO: 82294 - protein, 13 aa, Mycobacterium tuberculosis
QPPEITSGEMYLG

SEQ ID NO: 82295 - protein, 13 aa, Mycobacterium tuberculosis
PPEITSGEMYLGP

SEQ ID NO: 82296 - protein, 13 aa, Mycobacterium tuberculosis
PEITSGEMYLGPG

SEQ ID NO: 82297 - protein, 13 aa, Mycobacterium tuberculosis
EITSGEMYLGPGA

SEQ ID NO: 82298 - protein, 13 aa, Mycobacterium tuberculosis
ITSGEMYLGPGAG

SEQ ID NO: 82299 - protein, 13 aa, Mycobacterium tuberculosis
TSGEMYLGPGAGP

SEQ ID NO: 82300 - protein, 13 aa, Mycobacterium tuberculosis
SGEMYLGPGAGPM

SEQ ID NO: 82301 - protein, 13 aa, Mycobacterium tuberculosis
GEMYLGPGAGPML

SEQ ID NO: 82302 - protein, 13 aa, Mycobacterium tuberculosis
EMYLGPGAGPMLA

SEQ ID NO: 82303 - protein, 13 aa, Mycobacterium tuberculosis
MYLGPGAGPMLAA

SEQ ID NO: 82304 - protein, 13 aa, Mycobacterium tuberculosis
YLGPGAGPMLAAA

SEQ ID NO: 82305 - protein, 13 aa, Mycobacterium tuberculosis
LGPGAGPMLAAAV

SEQ ID NO: 82306 - protein, 13 aa, Mycobacterium tuberculosis
GPGAGPMLAAAVA

SEQ ID NO: 82307 - protein, 13 aa, Mycobacterium tuberculosis
PGAGPMLAAAVAW

SEQ ID NO: 82308 - protein, 13 aa, Mycobacterium tuberculosis
GAGPMLAAAVAWD

SEQ ID NO: 82309 - protein, 13 aa, Mycobacterium tuberculosis
AGPMLAAAVAWDG

SEQ ID NO: 82310 - protein, 13 aa, Mycobacterium tuberculosis
GPMLAAAVAWDGL

SEQ ID NO: 82311 - protein, 13 aa, Mycobacterium tuberculosis
PMLAAAVAWDGLA

SEQ ID NO: 82312 - protein, 13 aa, Mycobacterium tuberculosis
MLAAAVAWDGLAA

SEQ ID NO: 82313 - protein, 13 aa, Mycobacterium tuberculosis
LAAAVAWDGLAAE

SEQ ID NO: 82314 - protein, 13 aa, Mycobacterium tuberculosis
AAAVAWDGLAAEL

SEQ ID NO: 82315 - protein, 13 aa, Mycobacterium tuberculosis
AAVAWDGLAAELQ

SEQ ID NO: 82316 - protein, 13 aa, Mycobacterium tuberculosis
AVAWDGLAAELQS

SEQ ID NO: 82317 - protein, 13 aa, Mycobacterium tuberculosis
VAWDGLAAELQSM

SEQ ID NO: 82318 - protein, 13 aa, Mycobacterium tuberculosis
AWDGLAAELQSMA

SEQ ID NO: 82319 - protein, 13 aa, Mycobacterium tuberculosis
WDGLAAELQSMAA

SEQ ID NO: 82320 - protein, 13 aa, Mycobacterium tuberculosis
DGLAAELQSMAAS

SEQ ID NO: 82321 - protein, 13 aa, Mycobacterium tuberculosis
GLAAELQSMAASY

SEQ ID NO: 82322 - protein, 13 aa, Mycobacterium tuberculosis
LAAELQSMAASYA

SEQ ID NO: 82323 - protein, 13 aa, Mycobacterium tuberculosis
AAELQSMAASYAS

SEQ ID NO: 82324 - protein, 13 aa, Mycobacterium tuberculosis
AELQSMAASYASI

SEQ ID NO: 82325 - protein, 13 aa, Mycobacterium tuberculosis
ELQSMAASYASIV

SEQ ID NO: 82326 - protein, 13 aa, Mycobacterium tuberculosis
LQSMAASYASIVE

SEQ ID NO: 82327 - protein, 13 aa, Mycobacterium tuberculosis
QSMAASYASIVEG

SEQ ID NO: 82328 - protein, 13 aa, Mycobacterium tuberculosis
SMAASYASIVEGM

SEQ ID NO: 82329 - protein, 13 aa, Mycobacterium tuberculosis
MAASYASIVEGMA

SEQ ID NO: 82330 - protein, 13 aa, Mycobacterium tuberculosis
AASYASIVEGMAS

SEQ ID NO: 82331 - protein, 13 aa, Mycobacterium tuberculosis
ASYASIVEGMASE

SEQ ID NO: 82332 - protein, 13 aa, Mycobacterium tuberculosis
SYASIVEGMASES

SEQ ID NO: 82333 - protein, 13 aa, Mycobacterium tuberculosis
YASIVEGMASESW

SEQ ID NO: 82334 - protein, 13 aa, Mycobacterium tuberculosis
ASIVEGMASESWL

SEQ ID NO: 82335 - protein, 13 aa, Mycobacterium tuberculosis
SIVEGMASESWLG

SEQ ID NO: 82336 - protein, 13 aa, Mycobacterium tuberculosis
IVEGMASESWLGP

SEQ ID NO: 82337 - protein, 13 aa, Mycobacterium tuberculosis
VEGMASESWLGPS

SEQ ID NO: 82338 - protein, 13 aa, Mycobacterium tuberculosis
EGMASESWLGPSS

SEQ ID NO: 82339 - protein, 13 aa, Mycobacterium tuberculosis
GMASESWLGPSSA

SEQ ID NO: 82340 - protein, 13 aa, Mycobacterium tuberculosis
MASESWLGPSSAG

SEQ ID NO: 82341 - protein, 13 aa, Mycobacterium tuberculosis
ASESWLGPSSAGM

SEQ ID NO: 82342 - protein, 13 aa, Mycobacterium tuberculosis
SESWLGPSSAGMA

SEQ ID NO: 82343 - protein, 13 aa, Mycobacterium tuberculosis
ESWLGPSSAGMAA

SEQ ID NO: 82344 - protein, 13 aa, Mycobacterium tuberculosis
SWLGPSSAGMAAA

SEQ ID NO: 82345 - protein, 13 aa, Mycobacterium tuberculosis
WLGPSSAGMAAAA

SEQ ID NO: 82346 - protein, 13 aa, Mycobacterium tuberculosis
LGPSSAGMAAAAA

SEQ ID NO: 82347 - protein, 13 aa, Mycobacterium tuberculosis
GPSSAGMAAAAAP

SEQ ID NO: 82348 - protein, 13 aa, Mycobacterium tuberculosis
PSSAGMAAAAAPY

SEQ ID NO: 82349 - protein, 13 aa, Mycobacterium tuberculosis
SSAGMAAAAAPYV

SEQ ID NO: 82350 - protein, 13 aa, Mycobacterium tuberculosis
SAGMAAAAAPYVT

SEQ ID NO: 82351 - protein, 13 aa, Mycobacterium tuberculosis
AGMAAAAAPYVTW

SEQ ID NO: 82352 - protein, 13 aa, Mycobacterium tuberculosis
GMAAAAAPYVTWM

SEQ ID NO: 82353 - protein, 13 aa, Mycobacterium tuberculosis
MAAAAAPYVTWMS

SEQ ID NO: 82354 - protein, 13 aa, Mycobacterium tuberculosis
AAAAAPYVTWMSG

SEQ ID NO: 82355 - protein, 13 aa, Mycobacterium tuberculosis
AAAAPYVTWMSGT

SEQ ID NO: 82356 - protein, 13 aa, Mycobacterium tuberculosis
AAAPYVTWMSGTS

SEQ ID NO: 82357 - protein, 13 aa, Mycobacterium tuberculosis
AAPYVTWMSGTSA

SEQ ID NO: 82358 - protein, 13 aa, Mycobacterium tuberculosis
APYVTWMSGTSAQ

SEQ ID NO: 82359 - protein, 13 aa, Mycobacterium tuberculosis
PYVTWMSGTSAQA

SEQ ID NO: 82360 - protein, 13 aa, Mycobacterium tuberculosis
YVTWMSGTSAQAK

SEQ ID NO: 82361 - protein, 13 aa, Mycobacterium tuberculosis
VTWMSGTSAQAKA

SEQ ID NO: 82362 - protein, 13 aa, Mycobacterium tuberculosis
TWMSGTSAQAKAA

SEQ ID NO: 82363 - protein, 13 aa, Mycobacterium tuberculosis
WMSGTSAQAKAAA

SEQ ID NO: 82364 - protein, 13 aa, Mycobacterium tuberculosis
MSGTSAQAKAAAD

SEQ ID NO: 82365 - protein, 13 aa, Mycobacterium tuberculosis
SGTSAQAKAAADQ

SEQ ID NO: 82366 - protein, 13 aa, Mycobacterium tuberculosis
GTSAQAKAAADQA

SEQ ID NO: 82367 - protein, 13 aa, Mycobacterium tuberculosis
TSAQAKAAADQAR

SEQ ID NO: 82368 - protein, 13 aa, Mycobacterium tuberculosis
SAQAKAAADQARA

SEQ ID NO: 82369 - protein, 13 aa, Mycobacterium tuberculosis
AQAKAAADQARAA

SEQ ID NO: 82370 - protein, 13 aa, Mycobacterium tuberculosis
QAKAAADQARAAV

SEQ ID NO: 82371 - protein, 13 aa, Mycobacterium tuberculosis
AKAAADQARAAVV

SEQ ID NO: 82372 - protein, 13 aa, Mycobacterium tuberculosis
KAAADQARAAVVA

SEQ ID NO: 82373 - protein, 13 aa, Mycobacterium tuberculosis
AAADQARAAVVAY

SEQ ID NO: 82374 - protein, 13 aa, Mycobacterium tuberculosis
AADQARAAVVAYE

SEQ ID NO: 82375 - protein, 13 aa, Mycobacterium tuberculosis
ADQARAAVVAYET

SEQ ID NO: 82376 - protein, 13 aa, Mycobacterium tuberculosis
DQARAAVVAYETA

SEQ ID NO: 82377 - protein, 13 aa, Mycobacterium tuberculosis
QARAAVVAYETAF

SEQ ID NO: 82378 - protein, 13 aa, Mycobacterium tuberculosis
ARAAVVAYETAFA

SEQ ID NO: 82379 - protein, 13 aa, Mycobacterium tuberculosis
RAAVVAYETAFAA

SEQ ID NO: 82380 - protein, 13 aa, Mycobacterium tuberculosis
AAVVAYETAFAAV

SEQ ID NO: 82381 - protein, 13 aa, Mycobacterium tuberculosis
AVVAYETAFAAVV

SEQ ID NO: 82382 - protein, 13 aa, Mycobacterium tuberculosis
VVAYETAFAAVVP

SEQ ID NO: 82383 - protein, 13 aa, Mycobacterium tuberculosis
VAYETAFAAVVPP

SEQ ID NO: 82384 - protein, 13 aa, Mycobacterium tuberculosis
AYETAFAAVVPPP

SEQ ID NO: 82385 - protein, 13 aa, Mycobacterium tuberculosis
YETAFAAVVPPPQ

SEQ ID NO: 82386 - protein, 13 aa, Mycobacterium tuberculosis
ETAFAAVVPPPQI

SEQ ID NO: 82387 - protein, 13 aa, Mycobacterium tuberculosis
TAFAAVVPPPQIA

SEQ ID NO: 82388 - protein, 13 aa, Mycobacterium tuberculosis
AFAAVVPPPQIAA

SEQ ID NO: 82389 - protein, 13 aa, Mycobacterium tuberculosis
FAAVVPPPQIAAN

SEQ ID NO: 82390 - protein, 13 aa, Mycobacterium tuberculosis
AAVVPPPQIAANR

SEQ ID NO: 82391 - protein, 13 aa, Mycobacterium tuberculosis
AVVPPPQIAANRS

SEQ ID NO: 82392 - protein, 13 aa, Mycobacterium tuberculosis
VVPPPQIAANRSQ

SEQ ID NO: 82393 - protein, 13 aa, Mycobacterium tuberculosis
VPPPQIAANRSQL

SEQ ID NO: 82394 - protein, 13 aa, Mycobacterium tuberculosis
PPPQIAANRSQLI

SEQ ID NO: 82395 - protein, 13 aa, Mycobacterium tuberculosis
PPQIAANRSQLIS

SEQ ID NO: 82396 - protein, 13 aa, Mycobacterium tuberculosis
PQIAANRSQLISL

SEQ ID NO: 82397 - protein, 13 aa, Mycobacterium tuberculosis
QIAANRSQLISLV

SEQ ID NO: 82398 - protein, 13 aa, Mycobacterium tuberculosis
IAANRSQLISLVA

SEQ ID NO: 82399 - protein, 13 aa, Mycobacterium tuberculosis
AANRSQLISLVAT

SEQ ID NO: 82400 - protein, 13 aa, Mycobacterium tuberculosis
ANRSQLISLVATN

SEQ ID NO: 82401 - protein, 13 aa, Mycobacterium tuberculosis
NRSQLISLVATNI

SEQ ID NO: 82402 - protein, 13 aa, Mycobacterium tuberculosis
RSQLISLVATNIF

SEQ ID NO: 82403 - protein, 13 aa, Mycobacterium tuberculosis
SQLISLVATNIFG

SEQ ID NO: 82404 - protein, 13 aa, Mycobacterium tuberculosis
QLISLVATNIFGQ

SEQ ID NO: 82405 - protein, 13 aa, Mycobacterium tuberculosis
LISLVATNIFGQN

SEQ ID NO: 82406 - protein, 13 aa, Mycobacterium tuberculosis
ISLVATNIFGQNT

SEQ ID NO: 82407 - protein, 13 aa, Mycobacterium tuberculosis
SLVATNIFGQNTA

SEQ ID NO: 82408 - protein, 13 aa, Mycobacterium tuberculosis
LVATNIFGQNTAA

SEQ ID NO: 82409 - protein, 13 aa, Mycobacterium tuberculosis
VATNIFGQNTAAI

SEQ ID NO: 82410 - protein, 13 aa, Mycobacterium tuberculosis
ATNIFGQNTAAIA

SEQ ID NO: 82411 - protein, 13 aa, Mycobacterium tuberculosis
TNIFGQNTAAIAA

SEQ ID NO: 82412 - protein, 13 aa, Mycobacterium tuberculosis
NIFGQNTAAIAAT

SEQ ID NO: 82413 - protein, 13 aa, Mycobacterium tuberculosis
IFGQNTAAIAATE

SEQ ID NO: 82414 - protein, 13 aa, Mycobacterium tuberculosis
FGQNTAAIAATEA

SEQ ID NO: 82415 - protein, 13 aa, Mycobacterium tuberculosis
GQNTAAIAATEAE

SEQ ID NO: 82416 - protein, 13 aa, Mycobacterium tuberculosis
QNTAAIAATEAEY

SEQ ID NO: 82417 - protein, 13 aa, Mycobacterium tuberculosis
NTAAIAATEAEYG

SEQ ID NO: 82418 - protein, 13 aa, Mycobacterium tuberculosis
TAAIAATEAEYGE

SEQ ID NO: 82419 - protein, 13 aa, Mycobacterium tuberculosis
AAIAATEAEYGEM

SEQ ID NO: 82420 - protein, 13 aa, Mycobacterium tuberculosis
AIAATEAEYGEMW

SEQ ID NO: 82421 - protein, 13 aa, Mycobacterium tuberculosis
IAATEAEYGEMWA

SEQ ID NO: 82422 - protein, 13 aa, Mycobacterium tuberculosis
AATEAEYGEMWAQ

SEQ ID NO: 82423 - protein, 13 aa, Mycobacterium tuberculosis
ATEAEYGEMWAQD

SEQ ID NO: 82424 - protein, 13 aa, Mycobacterium tuberculosis
TEAEYGEMWAQDT

SEQ ID NO: 82425 - protein, 13 aa, Mycobacterium tuberculosis
EAEYGEMWAQDTM

SEQ ID NO: 82426 - protein, 13 aa, Mycobacterium tuberculosis
AEYGEMWAQDTMA

SEQ ID NO: 82427 - protein, 13 aa, Mycobacterium tuberculosis
EYGEMWAQDTMAM

SEQ ID NO: 82428 - protein, 13 aa, Mycobacterium tuberculosis
YGEMWAQDTMAMF

SEQ ID NO: 82429 - protein, 13 aa, Mycobacterium tuberculosis
GEMWAQDTMAMFG

SEQ ID NO: 82430 - protein, 13 aa, Mycobacterium tuberculosis
EMWAQDTMAMFGY

SEQ ID NO: 82431 - protein, 13 aa, Mycobacterium tuberculosis
MWAQDTMAMFGYA

SEQ ID NO: 82432 - protein, 13 aa, Mycobacterium tuberculosis
WAQDTMAMFGYAS

SEQ ID NO: 82433 - protein, 13 aa, Mycobacterium tuberculosis
AQDTMAMFGYASS

SEQ ID NO: 82434 - protein, 13 aa, Mycobacterium tuberculosis
QDTMAMFGYASSS

SEQ ID NO: 82435 - protein, 13 aa, Mycobacterium tuberculosis
DTMAMFGYASSSA

SEQ ID NO: 82436 - protein, 13 aa, Mycobacterium tuberculosis
TMAMFGYASSSAT

SEQ ID NO: 82437 - protein, 13 aa, Mycobacterium tuberculosis
MAMFGYASSSATA

SEQ ID NO: 82438 - protein, 13 aa, Mycobacterium tuberculosis
AMFGYASSSATAS

SEQ ID NO: 82439 - protein, 13 aa, Mycobacterium tuberculosis
MFGYASSSATASR

SEQ ID NO: 82440 - protein, 13 aa, Mycobacterium tuberculosis
FGYASSSATASRL

SEQ ID NO: 82441 - protein, 13 aa, Mycobacterium tuberculosis
GYASSSATASRLT

SEQ ID NO: 82442 - protein, 13 aa, Mycobacterium tuberculosis
YASSSATASRLTP

SEQ ID NO: 82443 - protein, 13 aa, Mycobacterium tuberculosis
ASSSATASRLTPF

SEQ ID NO: 82444 - protein, 13 aa, Mycobacterium tuberculosis
SSSATASRLTPFT

SEQ ID NO: 82445 - protein, 13 aa, Mycobacterium tuberculosis
SSATASRLTPFTA

SEQ ID NO: 82446 - protein, 13 aa, Mycobacterium tuberculosis
SATASRLTPFTAP

SEQ ID NO: 82447 - protein, 13 aa, Mycobacterium tuberculosis
ATASRLTPFTAPP

SEQ ID NO: 82448 - protein, 13 aa, Mycobacterium tuberculosis
TASRLTPFTAPPQ

SEQ ID NO: 82449 - protein, 13 aa, Mycobacterium tuberculosis
ASRLTPFTAPPQT

SEQ ID NO: 82450 - protein, 13 aa, Mycobacterium tuberculosis
SRLTPFTAPPQTT

SEQ ID NO: 82451 - protein, 13 aa, Mycobacterium tuberculosis
RLTPFTAPPQTTN

SEQ ID NO: 82452 - protein, 13 aa, Mycobacterium tuberculosis
LTPFTAPPQTTNP

SEQ ID NO: 82453 - protein, 13 aa, Mycobacterium tuberculosis
TPFTAPPQTTNPS

SEQ ID NO: 82454 - protein, 13 aa, Mycobacterium tuberculosis
PFTAPPQTTNPSG

SEQ ID NO: 82455 - protein, 13 aa, Mycobacterium tuberculosis
FTAPPQTTNPSGL

SEQ ID NO: 82456 - protein, 13 aa, Mycobacterium tuberculosis
TAPPQTTNPSGLA

SEQ ID NO: 82457 - protein, 13 aa, Mycobacterium tuberculosis
APPQTTNPSGLAG

SEQ ID NO: 82458 - protein, 13 aa, Mycobacterium tuberculosis
PPQTTNPSGLAGQ

SEQ ID NO: 82459 - protein, 13 aa, Mycobacterium tuberculosis
PQTTNPSGLAGQA

SEQ ID NO: 82460 - protein, 13 aa, Mycobacterium tuberculosis
QTTNPSGLAGQAA

SEQ ID NO: 82461 - protein, 13 aa, Mycobacterium tuberculosis
TTNPSGLAGQAAA

SEQ ID NO: 82462 - protein, 13 aa, Mycobacterium tuberculosis
TNPSGLAGQAAAT

SEQ ID NO: 82463 - protein, 13 aa, Mycobacterium tuberculosis
NPSGLAGQAAATG

SEQ ID NO: 82464 - protein, 13 aa, Mycobacterium tuberculosis
PSGLAGQAAATGQ

SEQ ID NO: 82465 - protein, 13 aa, Mycobacterium tuberculosis
SGLAGQAAATGQA

SEQ ID NO: 82466 - protein, 13 aa, Mycobacterium tuberculosis
GLAGQAAATGQAT

SEQ ID NO: 82467 - protein, 13 aa, Mycobacterium tuberculosis
LAGQAAATGQATA

SEQ ID NO: 82468 - protein, 13 aa, Mycobacterium tuberculosis
AGQAAATGQATAL

SEQ ID NO: 82469 - protein, 13 aa, Mycobacterium tuberculosis
GQAAATGQATALA

SEQ ID NO: 82470 - protein, 13 aa, Mycobacterium tuberculosis
QAAATGQATALAS

SEQ ID NO: 82471 - protein, 13 aa, Mycobacterium tuberculosis
AAATGQATALASG

SEQ ID NO: 82472 - protein, 13 aa, Mycobacterium tuberculosis
AATGQATALASGT

SEQ ID NO: 82473 - protein, 13 aa, Mycobacterium tuberculosis
ATGQATALASGTN

SEQ ID NO: 82474 - protein, 13 aa, Mycobacterium tuberculosis
TGQATALASGTNA

SEQ ID NO: 82475 - protein, 13 aa, Mycobacterium tuberculosis
GQATALASGTNAV

SEQ ID NO: 82476 - protein, 13 aa, Mycobacterium tuberculosis
QATALASGTNAVT

SEQ ID NO: 82477 - protein, 13 aa, Mycobacterium tuberculosis
ATALASGTNAVTT

SEQ ID NO: 82478 - protein, 13 aa, Mycobacterium tuberculosis
TALASGTNAVTTA

SEQ ID NO: 82479 - protein, 13 aa, Mycobacterium tuberculosis
ALASGTNAVTTAL

SEQ ID NO: 82480 - protein, 13 aa, Mycobacterium tuberculosis
LASGTNAVTTALS

SEQ ID NO: 82481 - protein, 13 aa, Mycobacterium tuberculosis
ASGTNAVTTALSS

SEQ ID NO: 82482 - protein, 13 aa, Mycobacterium tuberculosis
SGTNAVTTALSSA

SEQ ID NO: 82483 - protein, 13 aa, Mycobacterium tuberculosis
GTNAVTTALSSAA

SEQ ID NO: 82484 - protein, 13 aa, Mycobacterium tuberculosis
TNAVTTALSSAAA

SEQ ID NO: 82485 - protein, 13 aa, Mycobacterium tuberculosis
NAVTTALSSAAAQ

SEQ ID NO: 82486 - protein, 13 aa, Mycobacterium tuberculosis
AVTTALSSAAAQF

SEQ ID NO: 82487 - protein, 13 aa, Mycobacterium tuberculosis
VTTALSSAAAQFP

SEQ ID NO: 82488 - protein, 13 aa, Mycobacterium tuberculosis
TTALSSAAAQFPF

SEQ ID NO: 82489 - protein, 13 aa, Mycobacterium tuberculosis
TALSSAAAQFPFD

SEQ ID NO: 82490 - protein, 13 aa, Mycobacterium tuberculosis
ALSSAAAQFPFDI

SEQ ID NO: 82491 - protein, 13 aa, Mycobacterium tuberculosis
LSSAAAQFPFDII

SEQ ID NO: 82492 - protein, 13 aa, Mycobacterium tuberculosis
SSAAAQFPFDIIP

SEQ ID NO: 82493 - protein, 13 aa, Mycobacterium tuberculosis
SAAAQFPFDIIPT

SEQ ID NO: 82494 - protein, 13 aa, Mycobacterium tuberculosis
AAAQFPFDIIPTL

SEQ ID NO: 82495 - protein, 13 aa, Mycobacterium tuberculosis
AAQFPFDIIPTLL

SEQ ID NO: 82496 - protein, 13 aa, Mycobacterium tuberculosis
AQFPFDIIPTLLQ

SEQ ID NO: 82497 - protein, 13 aa, Mycobacterium tuberculosis
QFPFDIIPTLLQG

SEQ ID NO: 82498 - protein, 13 aa, Mycobacterium tuberculosis
FPFDIIPTLLQGL

SEQ ID NO: 82499 - protein, 13 aa, Mycobacterium tuberculosis
PFDIIPTLLQGLA

SEQ ID NO: 82500 - protein, 13 aa, Mycobacterium tuberculosis
FDIIPTLLQGLAT

SEQ ID NO: 82501 - protein, 13 aa, Mycobacterium tuberculosis
DIIPTLLQGLATL

SEQ ID NO: 82502 - protein, 13 aa, Mycobacterium tuberculosis
IIPTLLQGLATLS

SEQ ID NO: 82503 - protein, 13 aa, Mycobacterium tuberculosis
IPTLLQGLATLST

SEQ ID NO: 82504 - protein, 13 aa, Mycobacterium tuberculosis
PTLLQGLATLSTQ

SEQ ID NO: 82505 - protein, 13 aa, Mycobacterium tuberculosis
TLLQGLATLSTQY

SEQ ID NO: 82506 - protein, 13 aa, Mycobacterium tuberculosis
LLQGLATLSTQYT

SEQ ID NO: 82507 - protein, 13 aa, Mycobacterium tuberculosis
LQGLATLSTQYTQ

SEQ ID NO: 82508 - protein, 13 aa, Mycobacterium tuberculosis
QGLATLSTQYTQL

SEQ ID NO: 82509 - protein, 13 aa, Mycobacterium tuberculosis
GLATLSTQYTQLM

SEQ ID NO: 82510 - protein, 13 aa, Mycobacterium tuberculosis
LATLSTQYTQLMG

SEQ ID NO: 82511 - protein, 13 aa, Mycobacterium tuberculosis
ATLSTQYTQLMGQ

SEQ ID NO: 82512 - protein, 13 aa, Mycobacterium tuberculosis
TLSTQYTQLMGQL

SEQ ID NO: 82513 - protein, 13 aa, Mycobacterium tuberculosis
LSTQYTQLMGQLI

SEQ ID NO: 82514 - protein, 13 aa, Mycobacterium tuberculosis
STQYTQLMGQLIN

SEQ ID NO: 82515 - protein, 13 aa, Mycobacterium tuberculosis
TQYTQLMGQLINA

SEQ ID NO: 82516 - protein, 13 aa, Mycobacterium tuberculosis
QYTQLMGQLINAI

SEQ ID NO: 82517 - protein, 13 aa, Mycobacterium tuberculosis
YTQLMGQLINAIF

SEQ ID NO: 82518 - protein, 13 aa, Mycobacterium tuberculosis
TQLMGQLINAIFG

SEQ ID NO: 82519 - protein, 13 aa, Mycobacterium tuberculosis
QLMGQLINAIFGP

SEQ ID NO: 82520 - protein, 13 aa, Mycobacterium tuberculosis
LMGQLINAIFGPT

SEQ ID NO: 82521 - protein, 13 aa, Mycobacterium tuberculosis
MGQLINAIFGPTG

SEQ ID NO: 82522 - protein, 13 aa, Mycobacterium tuberculosis
GQLINAIFGPTGA

SEQ ID NO: 82523 - protein, 13 aa, Mycobacterium tuberculosis
QLINAIFGPTGAT

SEQ ID NO: 82524 - protein, 13 aa, Mycobacterium tuberculosis
LINAIFGPTGATT

SEQ ID NO: 82525 - protein, 13 aa, Mycobacterium tuberculosis
INAIFGPTGATTY

SEQ ID NO: 82526 - protein, 13 aa, Mycobacterium tuberculosis
NAIFGPTGATTYQ

SEQ ID NO: 82527 - protein, 13 aa, Mycobacterium tuberculosis
AIFGPTGATTYQN

SEQ ID NO: 82528 - protein, 13 aa, Mycobacterium tuberculosis
IFGPTGATTYQNV

SEQ ID NO: 82529 - protein, 13 aa, Mycobacterium tuberculosis
FGPTGATTYQNVF

SEQ ID NO: 82530 - protein, 13 aa, Mycobacterium tuberculosis
GPTGATTYQNVFV

SEQ ID NO: 82531 - protein, 13 aa, Mycobacterium tuberculosis
PTGATTYQNVFVT

SEQ ID NO: 82532 - protein, 13 aa, Mycobacterium tuberculosis
TGATTYQNVFVTA

SEQ ID NO: 82533 - protein, 13 aa, Mycobacterium tuberculosis
GATTYQNVFVTAA

SEQ ID NO: 82534 - protein, 13 aa, Mycobacterium tuberculosis
ATTYQNVFVTAAN

SEQ ID NO: 82535 - protein, 13 aa, Mycobacterium tuberculosis
TTYQNVFVTAANV

SEQ ID NO: 82536 - protein, 13 aa, Mycobacterium tuberculosis
TYQNVFVTAANVT

SEQ ID NO: 82537 - protein, 13 aa, Mycobacterium tuberculosis
YQNVFVTAANVTK

SEQ ID NO: 82538 - protein, 13 aa, Mycobacterium tuberculosis
QNVFVTAANVTKF

SEQ ID NO: 82539 - protein, 13 aa, Mycobacterium tuberculosis
NVFVTAANVTKFS

SEQ ID NO: 82540 - protein, 13 aa, Mycobacterium tuberculosis
VFVTAANVTKFST

SEQ ID NO: 82541 - protein, 13 aa, Mycobacterium tuberculosis
FVTAANVTKFSTW

SEQ ID NO: 82542 - protein, 13 aa, Mycobacterium tuberculosis
VTAANVTKFSTWA

SEQ ID NO: 82543 - protein, 13 aa, Mycobacterium tuberculosis
TAANVTKFSTWAN

SEQ ID NO: 82544 - protein, 13 aa, Mycobacterium tuberculosis
AANVTKFSTWAND

SEQ ID NO: 82545 - protein, 13 aa, Mycobacterium tuberculosis
ANVTKFSTWANDA

SEQ ID NO: 82546 - protein, 13 aa, Mycobacterium tuberculosis
NVTKFSTWANDAM

SEQ ID NO: 82547 - protein, 13 aa, Mycobacterium tuberculosis
VTKFSTWANDAMS

SEQ ID NO: 82548 - protein, 13 aa, Mycobacterium tuberculosis
TKFSTWANDAMSA

SEQ ID NO: 82549 - protein, 13 aa, Mycobacterium tuberculosis
KFSTWANDAMSAP

SEQ ID NO: 82550 - protein, 13 aa, Mycobacterium tuberculosis
FSTWANDAMSAPN

SEQ ID NO: 82551 - protein, 13 aa, Mycobacterium tuberculosis
STWANDAMSAPNL

SEQ ID NO: 82552 - protein, 13 aa, Mycobacterium tuberculosis
TWANDAMSAPNLG

SEQ ID NO: 82553 - protein, 13 aa, Mycobacterium tuberculosis
WANDAMSAPNLGM

SEQ ID NO: 82554 - protein, 13 aa, Mycobacterium tuberculosis
ANDAMSAPNLGMT

SEQ ID NO: 82555 - protein, 13 aa, Mycobacterium tuberculosis
NDAMSAPNLGMTE

SEQ ID NO: 82556 - protein, 13 aa, Mycobacterium tuberculosis
DAMSAPNLGMTEF

SEQ ID NO: 82557 - protein, 13 aa, Mycobacterium tuberculosis
AMSAPNLGMTEFK

SEQ ID NO: 82558 - protein, 13 aa, Mycobacterium tuberculosis
MSAPNLGMTEFKV

SEQ ID NO: 82559 - protein, 13 aa, Mycobacterium tuberculosis
SAPNLGMTEFKVF

SEQ ID NO: 82560 - protein, 13 aa, Mycobacterium tuberculosis
APNLGMTEFKVFW

SEQ ID NO: 82561 - protein, 13 aa, Mycobacterium tuberculosis
PNLGMTEFKVFWQ

SEQ ID NO: 82562 - protein, 13 aa, Mycobacterium tuberculosis
NLGMTEFKVFWQP

SEQ ID NO: 82563 - protein, 13 aa, Mycobacterium tuberculosis
LGMTEFKVFWQPP

SEQ ID NO: 82564 - protein, 13 aa, Mycobacterium tuberculosis
GMTEFKVFWQPPP

SEQ ID NO: 82565 - protein, 13 aa, Mycobacterium tuberculosis
MTEFKVFWQPPPA

SEQ ID NO: 82566 - protein, 13 aa, Mycobacterium tuberculosis
TEFKVFWQPPPAP

SEQ ID NO: 82567 - protein, 13 aa, Mycobacterium tuberculosis
EFKVFWQPPPAPE

SEQ ID NO: 82568 - protein, 13 aa, Mycobacterium tuberculosis
FKVFWQPPPAPEI

SEQ ID NO: 82569 - protein, 13 aa, Mycobacterium tuberculosis
KVFWQPPPAPEIP

SEQ ID NO: 82570 - protein, 13 aa, Mycobacterium tuberculosis
VFWQPPPAPEIPK

SEQ ID NO: 82571 - protein, 13 aa, Mycobacterium tuberculosis
FWQPPPAPEIPKS

SEQ ID NO: 82572 - protein, 13 aa, Mycobacterium tuberculosis
WQPPPAPEIPKSS

SEQ ID NO: 82573 - protein, 13 aa, Mycobacterium tuberculosis
QPPPAPEIPKSSL

SEQ ID NO: 82574 - protein, 13 aa, Mycobacterium tuberculosis
PPPAPEIPKSSLG

SEQ ID NO: 82575 - protein, 13 aa, Mycobacterium tuberculosis
PPAPEIPKSSLGA

SEQ ID NO: 82576 - protein, 13 aa, Mycobacterium tuberculosis
PAPEIPKSSLGAG

SEQ ID NO: 82577 - protein, 13 aa, Mycobacterium tuberculosis
APEIPKSSLGAGL

SEQ ID NO: 82578 - protein, 13 aa, Mycobacterium tuberculosis
PEIPKSSLGAGLG

SEQ ID NO: 82579 - protein, 13 aa, Mycobacterium tuberculosis
EIPKSSLGAGLGL

SEQ ID NO: 82580 - protein, 13 aa, Mycobacterium tuberculosis
IPKSSLGAGLGLR

SEQ ID NO: 82581 - protein, 13 aa, Mycobacterium tuberculosis
PKSSLGAGLGLRS

SEQ ID NO: 82582 - protein, 13 aa, Mycobacterium tuberculosis
KSSLGAGLGLRSG

SEQ ID NO: 82583 - protein, 13 aa, Mycobacterium tuberculosis
SSLGAGLGLRSGL

SEQ ID NO: 82584 - protein, 13 aa, Mycobacterium tuberculosis
SLGAGLGLRSGLS

SEQ ID NO: 82585 - protein, 13 aa, Mycobacterium tuberculosis
LGAGLGLRSGLSA

SEQ ID NO: 82586 - protein, 13 aa, Mycobacterium tuberculosis
GAGLGLRSGLSAG

SEQ ID NO: 82587 - protein, 13 aa, Mycobacterium tuberculosis
AGLGLRSGLSAGL

SEQ ID NO: 82588 - protein, 13 aa, Mycobacterium tuberculosis
GLGLRSGLSAGLA

SEQ ID NO: 82589 - protein, 13 aa, Mycobacterium tuberculosis
LGLRSGLSAGLAH

SEQ ID NO: 82590 - protein, 13 aa, Mycobacterium tuberculosis
GLRSGLSAGLAHA

SEQ ID NO: 82591 - protein, 13 aa, Mycobacterium tuberculosis
LRSGLSAGLAHAA

SEQ ID NO: 82592 - protein, 13 aa, Mycobacterium tuberculosis
RSGLSAGLAHAAS

SEQ ID NO: 82593 - protein, 13 aa, Mycobacterium tuberculosis
SGLSAGLAHAASA

SEQ ID NO: 82594 - protein, 13 aa, Mycobacterium tuberculosis
GLSAGLAHAASAG

SEQ ID NO: 82595 - protein, 13 aa, Mycobacterium tuberculosis
LSAGLAHAASAGL

SEQ ID NO: 82596 - protein, 13 aa, Mycobacterium tuberculosis
SAGLAHAASAGLG

SEQ ID NO: 82597 - protein, 13 aa, Mycobacterium tuberculosis
AGLAHAASAGLGQ

SEQ ID NO: 82598 - protein, 13 aa, Mycobacterium tuberculosis
GLAHAASAGLGQA

SEQ ID NO: 82599 - protein, 13 aa, Mycobacterium tuberculosis
LAHAASAGLGQAN

SEQ ID NO: 82600 - protein, 13 aa, Mycobacterium tuberculosis
AHAASAGLGQANL

SEQ ID NO: 82601 - protein, 13 aa, Mycobacterium tuberculosis
HAASAGLGQANLV

SEQ ID NO: 82602 - protein, 13 aa, Mycobacterium tuberculosis
AASAGLGQANLVG

SEQ ID NO: 82603 - protein, 13 aa, Mycobacterium tuberculosis
ASAGLGQANLVGD

SEQ ID NO: 82604 - protein, 13 aa, Mycobacterium tuberculosis
SAGLGQANLVGDL

SEQ ID NO: 82605 - protein, 13 aa, Mycobacterium tuberculosis
AGLGQANLVGDLS

SEQ ID NO: 82606 - protein, 13 aa, Mycobacterium tuberculosis
GLGQANLVGDLSV

SEQ ID NO: 82607 - protein, 13 aa, Mycobacterium tuberculosis
LGQANLVGDLSVP

SEQ ID NO: 82608 - protein, 13 aa, Mycobacterium tuberculosis
GQANLVGDLSVPP

SEQ ID NO: 82609 - protein, 13 aa, Mycobacterium tuberculosis
QANLVGDLSVPPS

SEQ ID NO: 82610 - protein, 13 aa, Mycobacterium tuberculosis
ANLVGDLSVPPSW

SEQ ID NO: 82611 - protein, 13 aa, Mycobacterium tuberculosis
NLVGDLSVPPSWA

SEQ ID NO: 82612 - protein, 13 aa, Mycobacterium tuberculosis
LVGDLSVPPSWAS

SEQ ID NO: 82613 - protein, 13 aa, Mycobacterium tuberculosis
VGDLSVPPSWASA

SEQ ID NO: 82614 - protein, 13 aa, Mycobacterium tuberculosis
GDLSVPPSWASAT

SEQ ID NO: 82615 - protein, 13 aa, Mycobacterium tuberculosis
DLSVPPSWASATP

SEQ ID NO: 82616 - protein, 13 aa, Mycobacterium tuberculosis
LSVPPSWASATPA

SEQ ID NO: 82617 - protein, 13 aa, Mycobacterium tuberculosis
SVPPSWASATPAV

SEQ ID NO: 82618 - protein, 13 aa, Mycobacterium tuberculosis
VPPSWASATPAVR

SEQ ID NO: 82619 - protein, 13 aa, Mycobacterium tuberculosis
PPSWASATPAVRL

SEQ ID NO: 82620 - protein, 13 aa, Mycobacterium tuberculosis
PSWASATPAVRLV

SEQ ID NO: 82621 - protein, 13 aa, Mycobacterium tuberculosis
SWASATPAVRLVA

SEQ ID NO: 82622 - protein, 13 aa, Mycobacterium tuberculosis
WASATPAVRLVAN

SEQ ID NO: 82623 - protein, 13 aa, Mycobacterium tuberculosis
ASATPAVRLVANT

SEQ ID NO: 82624 - protein, 13 aa, Mycobacterium tuberculosis
SATPAVRLVANTL

SEQ ID NO: 82625 - protein, 13 aa, Mycobacterium tuberculosis
ATPAVRLVANTLP

SEQ ID NO: 82626 - protein, 13 aa, Mycobacterium tuberculosis
TPAVRLVANTLPA

SEQ ID NO: 82627 - protein, 13 aa, Mycobacterium tuberculosis
PAVRLVANTLPAT

SEQ ID NO: 82628 - protein, 13 aa, Mycobacterium tuberculosis
AVRLVANTLPATS

SEQ ID NO: 82629 - protein, 13 aa, Mycobacterium tuberculosis
VRLVANTLPATSL

SEQ ID NO: 82630 - protein, 13 aa, Mycobacterium tuberculosis
RLVANTLPATSLA

SEQ ID NO: 82631 - protein, 13 aa, Mycobacterium tuberculosis
LVANTLPATSLAA

SEQ ID NO: 82632 - protein, 13 aa, Mycobacterium tuberculosis
VANTLPATSLAAA

SEQ ID NO: 82633 - protein, 13 aa, Mycobacterium tuberculosis
ANTLPATSLAAAP

SEQ ID NO: 82634 - protein, 13 aa, Mycobacterium tuberculosis
NTLPATSLAAAPA

SEQ ID NO: 82635 - protein, 13 aa, Mycobacterium tuberculosis
TLPATSLAAAPAT

SEQ ID NO: 82636 - protein, 13 aa, Mycobacterium tuberculosis
LPATSLAAAPATQ

SEQ ID NO: 82637 - protein, 13 aa, Mycobacterium tuberculosis
PATSLAAAPATQI

SEQ ID NO: 82638 - protein, 13 aa, Mycobacterium tuberculosis
ATSLAAAPATQIP

SEQ ID NO: 82639 - protein, 13 aa, Mycobacterium tuberculosis
TSLAAAPATQIPA

SEQ ID NO: 82640 - protein, 13 aa, Mycobacterium tuberculosis
SLAAAPATQIPAN

SEQ ID NO: 82641 - protein, 13 aa, Mycobacterium tuberculosis
LAAAPATQIPANL

SEQ ID NO: 82642 - protein, 13 aa, Mycobacterium tuberculosis
AAAPATQIPANLL

SEQ ID NO: 82643 - protein, 13 aa, Mycobacterium tuberculosis
AAPATQIPANLLG

SEQ ID NO: 82644 - protein, 13 aa, Mycobacterium tuberculosis
APATQIPANLLGQ

SEQ ID NO: 82645 - protein, 13 aa, Mycobacterium tuberculosis
PATQIPANLLGQM

SEQ ID NO: 82646 - protein, 13 aa, Mycobacterium tuberculosis
ATQIPANLLGQMA

SEQ ID NO: 82647 - protein, 13 aa, Mycobacterium tuberculosis
TQIPANLLGQMAL

SEQ ID NO: 82648 - protein, 13 aa, Mycobacterium tuberculosis
QIPANLLGQMALG

SEQ ID NO: 82649 - protein, 13 aa, Mycobacterium tuberculosis
IPANLLGQMALGS

SEQ ID NO: 82650 - protein, 13 aa, Mycobacterium tuberculosis
PANLLGQMALGSM

SEQ ID NO: 82651 - protein, 13 aa, Mycobacterium tuberculosis
ANLLGQMALGSMT

SEQ ID NO: 82652 - protein, 13 aa, Mycobacterium tuberculosis
NLLGQMALGSMTG

SEQ ID NO: 82653 - protein, 13 aa, Mycobacterium tuberculosis
LLGQMALGSMTGG

SEQ ID NO: 82654 - protein, 13 aa, Mycobacterium tuberculosis
LGQMALGSMTGGA

SEQ ID NO: 82655 - protein, 13 aa, Mycobacterium tuberculosis
GQMALGSMTGGAL

SEQ ID NO: 82656 - protein, 13 aa, Mycobacterium tuberculosis
QMALGSMTGGALG

SEQ ID NO: 82657 - protein, 13 aa, Mycobacterium tuberculosis
MALGSMTGGALGA

SEQ ID NO: 82658 - protein, 13 aa, Mycobacterium tuberculosis
ALGSMTGGALGAA

SEQ ID NO: 82659 - protein, 13 aa, Mycobacterium tuberculosis
LGSMTGGALGAAA

SEQ ID NO: 82660 - protein, 13 aa, Mycobacterium tuberculosis
GSMTGGALGAAAP

SEQ ID NO: 82661 - protein, 13 aa, Mycobacterium tuberculosis
SMTGGALGAAAPA

SEQ ID NO: 82662 - protein, 13 aa, Mycobacterium tuberculosis
MTGGALGAAAPAI

SEQ ID NO: 82663 - protein, 13 aa, Mycobacterium tuberculosis
TGGALGAAAPAIY

SEQ ID NO: 82664 - protein, 13 aa, Mycobacterium tuberculosis
GGALGAAAPAIYT

SEQ ID NO: 82665 - protein, 13 aa, Mycobacterium tuberculosis
GALGAAAPAIYTG

SEQ ID NO: 82666 - protein, 13 aa, Mycobacterium tuberculosis
ALGAAAPAIYTGS

SEQ ID NO: 82667 - protein, 13 aa, Mycobacterium tuberculosis
LGAAAPAIYTGSG

SEQ ID NO: 82668 - protein, 13 aa, Mycobacterium tuberculosis
GAAAPAIYTGSGA

SEQ ID NO: 82669 - protein, 13 aa, Mycobacterium tuberculosis
AAAPAIYTGSGAR

SEQ ID NO: 82670 - protein, 13 aa, Mycobacterium tuberculosis
AAPAIYTGSGARA

SEQ ID NO: 82671 - protein, 13 aa, Mycobacterium tuberculosis
APAIYTGSGARAR

SEQ ID NO: 82672 - protein, 13 aa, Mycobacterium tuberculosis
PAIYTGSGARARA

SEQ ID NO: 82673 - protein, 13 aa, Mycobacterium tuberculosis
AIYTGSGARARAN

SEQ ID NO: 82674 - protein, 13 aa, Mycobacterium tuberculosis
IYTGSGARARANG

SEQ ID NO: 82675 - protein, 13 aa, Mycobacterium tuberculosis
YTGSGARARANGG

SEQ ID NO: 82676 - protein, 13 aa, Mycobacterium tuberculosis
TGSGARARANGGT

SEQ ID NO: 82677 - protein, 13 aa, Mycobacterium tuberculosis
GSGARARANGGTP

SEQ ID NO: 82678 - protein, 13 aa, Mycobacterium tuberculosis
SGARARANGGTPS

SEQ ID NO: 82679 - protein, 13 aa, Mycobacterium tuberculosis
GARARANGGTPSA

SEQ ID NO: 82680 - protein, 13 aa, Mycobacterium tuberculosis
ARARANGGTPSAE

SEQ ID NO: 82681 - protein, 13 aa, Mycobacterium tuberculosis
RARANGGTPSAEP

SEQ ID NO: 82682 - protein, 13 aa, Mycobacterium tuberculosis
ARANGGTPSAEPV

SEQ ID NO: 82683 - protein, 13 aa, Mycobacterium tuberculosis
RANGGTPSAEPVK

SEQ ID NO: 82684 - protein, 13 aa, Mycobacterium tuberculosis
ANGGTPSAEPVKL

SEQ ID NO: 82685 - protein, 13 aa, Mycobacterium tuberculosis
NGGTPSAEPVKLE

SEQ ID NO: 82686 - protein, 13 aa, Mycobacterium tuberculosis
GGTPSAEPVKLEA

SEQ ID NO: 82687 - protein, 13 aa, Mycobacterium tuberculosis
GTPSAEPVKLEAV

SEQ ID NO: 82688 - protein, 13 aa, Mycobacterium tuberculosis
TPSAEPVKLEAVI

SEQ ID NO: 82689 - protein, 13 aa, Mycobacterium tuberculosis
PSAEPVKLEAVIA

SEQ ID NO: 82690 - protein, 13 aa, Mycobacterium tuberculosis
SAEPVKLEAVIAQ

SEQ ID NO: 82691 - protein, 13 aa, Mycobacterium tuberculosis
AEPVKLEAVIAQL

SEQ ID NO: 82692 - protein, 13 aa, Mycobacterium tuberculosis
EPVKLEAVIAQLQ

SEQ ID NO: 82693 - protein, 13 aa, Mycobacterium tuberculosis
PVKLEAVIAQLQK

SEQ ID NO: 82694 - protein, 13 aa, Mycobacterium tuberculosis
VKLEAVIAQLQKQ

SEQ ID NO: 82695 - protein, 13 aa, Mycobacterium tuberculosis
KLEAVIAQLQKQP

SEQ ID NO: 82696 - protein, 13 aa, Mycobacterium tuberculosis
LEAVIAQLQKQPD

SEQ ID NO: 82697 - protein, 13 aa, Mycobacterium tuberculosis
EAVIAQLQKQPDA

SEQ ID NO: 82698 - protein, 13 aa, Mycobacterium tuberculosis
AVIAQLQKQPDAV

SEQ ID NO: 82699 - protein, 13 aa, Mycobacterium tuberculosis
VIAQLQKQPDAVR

SEQ ID NO: 82700 - protein, 13 aa, Mycobacterium tuberculosis
IAQLQKQPDAVRH

SEQ ID NO: 82701 - protein, 13 aa, Mycobacterium tuberculosis
AQLQKQPDAVRHW

SEQ ID NO: 82702 - protein, 13 aa, Mycobacterium tuberculosis
QLQKQPDAVRHWN

SEQ ID NO: 82703 - protein, 13 aa, Mycobacterium tuberculosis
LQKQPDAVRHWNV

SEQ ID NO: 82704 - protein, 13 aa, Mycobacterium tuberculosis
QKQPDAVRHWNVD

SEQ ID NO: 82705 - protein, 13 aa, Mycobacterium tuberculosis
KQPDAVRHWNVDK

SEQ ID NO: 82706 - protein, 13 aa, Mycobacterium tuberculosis
QPDAVRHWNVDKA

SEQ ID NO: 82707 - protein, 13 aa, Mycobacterium tuberculosis
PDAVRHWNVDKAD

SEQ ID NO: 82708 - protein, 13 aa, Mycobacterium tuberculosis
DAVRHWNVDKADL

SEQ ID NO: 82709 - protein, 13 aa, Mycobacterium tuberculosis
AVRHWNVDKADLD

SEQ ID NO: 82710 - protein, 13 aa, Mycobacterium tuberculosis
VRHWNVDKADLDG

SEQ ID NO: 82711 - protein, 13 aa, Mycobacterium tuberculosis
RHWNVDKADLDGL

SEQ ID NO: 82712 - protein, 13 aa, Mycobacterium tuberculosis
HWNVDKADLDGLL

SEQ ID NO: 82713 - protein, 13 aa, Mycobacterium tuberculosis
WNVDKADLDGLLD

SEQ ID NO: 82714 - protein, 13 aa, Mycobacterium tuberculosis
NVDKADLDGLLDR

SEQ ID NO: 82715 - protein, 13 aa, Mycobacterium tuberculosis
VDKADLDGLLDRL

SEQ ID NO: 82716 - protein, 13 aa, Mycobacterium tuberculosis
DKADLDGLLDRLS

SEQ ID NO: 82717 - protein, 13 aa, Mycobacterium tuberculosis
KADLDGLLDRLSK

SEQ ID NO: 82718 - protein, 13 aa, Mycobacterium tuberculosis
ADLDGLLDRLSKQ

SEQ ID NO: 82719 - protein, 13 aa, Mycobacterium tuberculosis
DLDGLLDRLSKQP

SEQ ID NO: 82720 - protein, 13 aa, Mycobacterium tuberculosis
LDGLLDRLSKQPG

SEQ ID NO: 82721 - protein, 13 aa, Mycobacterium tuberculosis
DGLLDRLSKQPGI

SEQ ID NO: 82722 - protein, 13 aa, Mycobacterium tuberculosis
GLLDRLSKQPGIH

SEQ ID NO: 82723 - protein, 13 aa, Mycobacterium tuberculosis
LLDRLSKQPGIHA

SEQ ID NO: 82724 - protein, 13 aa, Mycobacterium tuberculosis
LDRLSKQPGIHAV

SEQ ID NO: 82725 - protein, 13 aa, Mycobacterium tuberculosis
DRLSKQPGIHAVH

SEQ ID NO: 82726 - protein, 13 aa, Mycobacterium tuberculosis
RLSKQPGIHAVHV

SEQ ID NO: 82727 - protein, 13 aa, Mycobacterium tuberculosis
LSKQPGIHAVHVS

SEQ ID NO: 82728 - protein, 13 aa, Mycobacterium tuberculosis
SKQPGIHAVHVSN

SEQ ID NO: 82729 - protein, 13 aa, Mycobacterium tuberculosis
KQPGIHAVHVSNG

SEQ ID NO: 82730 - protein, 13 aa, Mycobacterium tuberculosis
QPGIHAVHVSNGD

SEQ ID NO: 82731 - protein, 13 aa, Mycobacterium tuberculosis
PGIHAVHVSNGDK

SEQ ID NO: 82732 - protein, 13 aa, Mycobacterium tuberculosis
GIHAVHVSNGDKP

SEQ ID NO: 82733 - protein, 13 aa, Mycobacterium tuberculosis
IHAVHVSNGDKPK

SEQ ID NO: 82734 - protein, 13 aa, Mycobacterium tuberculosis
HAVHVSNGDKPKV

SEQ ID NO: 82735 - protein, 13 aa, Mycobacterium tuberculosis
AVHVSNGDKPKVA

SEQ ID NO: 82736 - protein, 13 aa, Mycobacterium tuberculosis
VHVSNGDKPKVAL

SEQ ID NO: 82737 - protein, 13 aa, Mycobacterium tuberculosis
HVSNGDKPKVALP

SEQ ID NO: 82738 - protein, 13 aa, Mycobacterium tuberculosis
VSNGDKPKVALPD

SEQ ID NO: 82739 - protein, 13 aa, Mycobacterium tuberculosis
SNGDKPKVALPDT

SEQ ID NO: 82740 - protein, 13 aa, Mycobacterium tuberculosis
NGDKPKVALPDTQ

SEQ ID NO: 82741 - protein, 13 aa, Mycobacterium tuberculosis
GDKPKVALPDTQL

SEQ ID NO: 82742 - protein, 13 aa, Mycobacterium tuberculosis
DKPKVALPDTQLG

SEQ ID NO: 82743 - protein, 13 aa, Mycobacterium tuberculosis
KPKVALPDTQLGS

SEQ ID NO: 82744 - protein, 13 aa, Mycobacterium tuberculosis
PKVALPDTQLGSH

SEQ ID NO: 82745 - protein, 14 aa, Mycobacterium tuberculosis
MDFGLQPPEITSGE

SEQ ID NO: 82746 - protein, 14 aa, Mycobacterium tuberculosis
DFGLQPPEITSGEM

SEQ ID NO: 82747 - protein, 14 aa, Mycobacterium tuberculosis
FGLQPPEITSGEMY

SEQ ID NO: 82748 - protein, 14 aa, Mycobacterium tuberculosis
GLQPPEITSGEMYL

SEQ ID NO: 82749 - protein, 14 aa, Mycobacterium tuberculosis
LQPPEITSGEMYLG

SEQ ID NO: 82750 - protein, 14 aa, Mycobacterium tuberculosis
QPPEITSGEMYLGP

SEQ ID NO: 82751 - protein, 14 aa, Mycobacterium tuberculosis
PPEITSGEMYLGPG

SEQ ID NO: 82752 - protein, 14 aa, Mycobacterium tuberculosis
PEITSGEMYLGPGA

SEQ ID NO: 82753 - protein, 14 aa, Mycobacterium tuberculosis
EITSGEMYLGPGAG

SEQ ID NO: 82754 - protein, 14 aa, Mycobacterium tuberculosis
ITSGEMYLGPGAGP

SEQ ID NO: 82755 - protein, 14 aa, Mycobacterium tuberculosis
TSGEMYLGPGAGPM

SEQ ID NO: 82756 - protein, 14 aa, Mycobacterium tuberculosis
SGEMYLGPGAGPML

SEQ ID NO: 82757 - protein, 14 aa, Mycobacterium tuberculosis
GEMYLGPGAGPMLA

SEQ ID NO: 82758 - protein, 14 aa, Mycobacterium tuberculosis
EMYLGPGAGPMLAA

SEQ ID NO: 82759 - protein, 14 aa, Mycobacterium tuberculosis
MYLGPGAGPMLAAA

SEQ ID NO: 82760 - protein, 14 aa, Mycobacterium tuberculosis
YLGPGAGPMLAAAV

SEQ ID NO: 82761 - protein, 14 aa, Mycobacterium tuberculosis
LGPGAGPMLAAAVA

SEQ ID NO: 82762 - protein, 14 aa, Mycobacterium tuberculosis
GPGAGPMLAAAVAW

SEQ ID NO: 82763 - protein, 14 aa, Mycobacterium tuberculosis
PGAGPMLAAAVAWD

SEQ ID NO: 82764 - protein, 14 aa, Mycobacterium tuberculosis
GAGPMLAAAVAWDG

SEQ ID NO: 82765 - protein, 14 aa, Mycobacterium tuberculosis
AGPMLAAAVAWDGL

SEQ ID NO: 82766 - protein, 14 aa, Mycobacterium tuberculosis
GPMLAAAVAWDGLA

SEQ ID NO: 82767 - protein, 14 aa, Mycobacterium tuberculosis
PMLAAAVAWDGLAA

SEQ ID NO: 82768 - protein, 14 aa, Mycobacterium tuberculosis
MLAAAVAWDGLAAE

SEQ ID NO: 82769 - protein, 14 aa, Mycobacterium tuberculosis
LAAAVAWDGLAAEL

SEQ ID NO: 82770 - protein, 14 aa, Mycobacterium tuberculosis
AAAVAWDGLAAELQ

SEQ ID NO: 82771 - protein, 14 aa, Mycobacterium tuberculosis
AAVAWDGLAAELQS

SEQ ID NO: 82772 - protein, 14 aa, Mycobacterium tuberculosis
AVAWDGLAAELQSM

SEQ ID NO: 82773 - protein, 14 aa, Mycobacterium tuberculosis
VAWDGLAAELQSMA

SEQ ID NO: 82774 - protein, 14 aa, Mycobacterium tuberculosis
AWDGLAAELQSMAA

SEQ ID NO: 82775 - protein, 14 aa, Mycobacterium tuberculosis
WDGLAAELQSMAAS

SEQ ID NO: 82776 - protein, 14 aa, Mycobacterium tuberculosis
DGLAAELQSMAASY

SEQ ID NO: 82777 - protein, 14 aa, Mycobacterium tuberculosis
GLAAELQSMAASYA

SEQ ID NO: 82778 - protein, 14 aa, Mycobacterium tuberculosis
LAAELQSMAASYAS

SEQ ID NO: 82779 - protein, 14 aa, Mycobacterium tuberculosis
AAELQSMAASYASI

SEQ ID NO: 82780 - protein, 14 aa, Mycobacterium tuberculosis
AELQSMAASYASIV

SEQ ID NO: 82781 - protein, 14 aa, Mycobacterium tuberculosis
ELQSMAASYASIVE

SEQ ID NO: 82782 - protein, 14 aa, Mycobacterium tuberculosis
LQSMAASYASIVEG

SEQ ID NO: 82783 - protein, 14 aa, Mycobacterium tuberculosis
QSMAASYASIVEGM

SEQ ID NO: 82784 - protein, 14 aa, Mycobacterium tuberculosis
SMAASYASIVEGMA

SEQ ID NO: 82785 - protein, 14 aa, Mycobacterium tuberculosis
MAASYASIVEGMAS

SEQ ID NO: 82786 - protein, 14 aa, Mycobacterium tuberculosis
AASYASIVEGMASE

SEQ ID NO: 82787 - protein, 14 aa, Mycobacterium tuberculosis
ASYASIVEGMASES

SEQ ID NO: 82788 - protein, 14 aa, Mycobacterium tuberculosis
SYASIVEGMASESW

SEQ ID NO: 82789 - protein, 14 aa, Mycobacterium tuberculosis
YASIVEGMASESWL

SEQ ID NO: 82790 - protein, 14 aa, Mycobacterium tuberculosis
ASIVEGMASESWLG

SEQ ID NO: 82791 - protein, 14 aa, Mycobacterium tuberculosis
SIVEGMASESWLGP

SEQ ID NO: 82792 - protein, 14 aa, Mycobacterium tuberculosis
IVEGMASESWLGPS

SEQ ID NO: 82793 - protein, 14 aa, Mycobacterium tuberculosis
VEGMASESWLGPSS

SEQ ID NO: 82794 - protein, 14 aa, Mycobacterium tuberculosis
EGMASESWLGPSSA

SEQ ID NO: 82795 - protein, 14 aa, Mycobacterium tuberculosis
GMASESWLGPSSAG

SEQ ID NO: 82796 - protein, 14 aa, Mycobacterium tuberculosis
MASESWLGPSSAGM

SEQ ID NO: 82797 - protein, 14 aa, Mycobacterium tuberculosis
ASESWLGPSSAGMA

SEQ ID NO: 82798 - protein, 14 aa, Mycobacterium tuberculosis
SESWLGPSSAGMAA

SEQ ID NO: 82799 - protein, 14 aa, Mycobacterium tuberculosis
ESWLGPSSAGMAAA

SEQ ID NO: 82800 - protein, 14 aa, Mycobacterium tuberculosis
SWLGPSSAGMAAAA

SEQ ID NO: 82801 - protein, 14 aa, Mycobacterium tuberculosis
WLGPSSAGMAAAAA

SEQ ID NO: 82802 - protein, 14 aa, Mycobacterium tuberculosis
LGPSSAGMAAAAAP

SEQ ID NO: 82803 - protein, 14 aa, Mycobacterium tuberculosis
GPSSAGMAAAAAPY

SEQ ID NO: 82804 - protein, 14 aa, Mycobacterium tuberculosis
PSSAGMAAAAAPYV

SEQ ID NO: 82805 - protein, 14 aa, Mycobacterium tuberculosis
SSAGMAAAAAPYVT

SEQ ID NO: 82806 - protein, 14 aa, Mycobacterium tuberculosis
SAGMAAAAAPYVTW

SEQ ID NO: 82807 - protein, 14 aa, Mycobacterium tuberculosis
AGMAAAAAPYVTWM

SEQ ID NO: 82808 - protein, 14 aa, Mycobacterium tuberculosis
GMAAAAAPYVTWMS

SEQ ID NO: 82809 - protein, 14 aa, Mycobacterium tuberculosis
MAAAAAPYVTWMSG

SEQ ID NO: 82810 - protein, 14 aa, Mycobacterium tuberculosis
AAAAAPYVTWMSGT

SEQ ID NO: 82811 - protein, 14 aa, Mycobacterium tuberculosis
AAAAPYVTWMSGTS

SEQ ID NO: 82812 - protein, 14 aa, Mycobacterium tuberculosis
AAAPYVTWMSGTSA

SEQ ID NO: 82813 - protein, 14 aa, Mycobacterium tuberculosis
AAPYVTWMSGTSAQ

SEQ ID NO: 82814 - protein, 14 aa, Mycobacterium tuberculosis
APYVTWMSGTSAQA

SEQ ID NO: 82815 - protein, 14 aa, Mycobacterium tuberculosis
PYVTWMSGTSAQAK

SEQ ID NO: 82816 - protein, 14 aa, Mycobacterium tuberculosis
YVTWMSGTSAQAKA

SEQ ID NO: 82817 - protein, 14 aa, Mycobacterium tuberculosis
VTWMSGTSAQAKAA

SEQ ID NO: 82818 - protein, 14 aa, Mycobacterium tuberculosis
TWMSGTSAQAKAAA

SEQ ID NO: 82819 - protein, 14 aa, Mycobacterium tuberculosis
WMSGTSAQAKAAAD

SEQ ID NO: 82820 - protein, 14 aa, Mycobacterium tuberculosis
MSGTSAQAKAAADQ

SEQ ID NO: 82821 - protein, 14 aa, Mycobacterium tuberculosis
SGTSAQAKAAADQA

SEQ ID NO: 82822 - protein, 14 aa, Mycobacterium tuberculosis
GTSAQAKAAADQAR

SEQ ID NO: 82823 - protein, 14 aa, Mycobacterium tuberculosis
TSAQAKAAADQARA

SEQ ID NO: 82824 - protein, 14 aa, Mycobacterium tuberculosis
SAQAKAAADQARAA

SEQ ID NO: 82825 - protein, 14 aa, Mycobacterium tuberculosis
AQAKAAADQARAAV

SEQ ID NO: 82826 - protein, 14 aa, Mycobacterium tuberculosis
QAKAAADQARAAVV

SEQ ID NO: 82827 - protein, 14 aa, Mycobacterium tuberculosis
AKAAADQARAAVVA

SEQ ID NO: 82828 - protein, 14 aa, Mycobacterium tuberculosis
KAAADQARAAVVAY

SEQ ID NO: 82829 - protein, 14 aa, Mycobacterium tuberculosis
AAADQARAAVVAYE

SEQ ID NO: 82830 - protein, 14 aa, Mycobacterium tuberculosis
AADQARAAVVAYET

SEQ ID NO: 82831 - protein, 14 aa, Mycobacterium tuberculosis
ADQARAAVVAYETA

SEQ ID NO: 82832 - protein, 14 aa, Mycobacterium tuberculosis
DQARAAVVAYETAF

SEQ ID NO: 82833 - protein, 14 aa, Mycobacterium tuberculosis
QARAAVVAYETAFA

SEQ ID NO: 82834 - protein, 14 aa, Mycobacterium tuberculosis
ARAAVVAYETAFAA

SEQ ID NO: 82835 - protein, 14 aa, Mycobacterium tuberculosis
RAAVVAYETAFAAV

SEQ ID NO: 82836 - protein, 14 aa, Mycobacterium tuberculosis
AAVVAYETAFAAVV

SEQ ID NO: 82837 - protein, 14 aa, Mycobacterium tuberculosis
AVVAYETAFAAVVP

SEQ ID NO: 82838 - protein, 14 aa, Mycobacterium tuberculosis
VVAYETAFAAVVPP

SEQ ID NO: 82839 - protein, 14 aa, Mycobacterium tuberculosis
VAYETAFAAVVPPP

SEQ ID NO: 82840 - protein, 14 aa, Mycobacterium tuberculosis
AYETAFAAVVPPPQ

SEQ ID NO: 82841 - protein, 14 aa, Mycobacterium tuberculosis
YETAFAAVVPPPQI

SEQ ID NO: 82842 - protein, 14 aa, Mycobacterium tuberculosis
ETAFAAVVPPPQIA

SEQ ID NO: 82843 - protein, 14 aa, Mycobacterium tuberculosis
TAFAAVVPPPQIAA

SEQ ID NO: 82844 - protein, 14 aa, Mycobacterium tuberculosis
AFAAVVPPPQIAAN

SEQ ID NO: 82845 - protein, 14 aa, Mycobacterium tuberculosis
FAAVVPPPQIAANR

SEQ ID NO: 82846 - protein, 14 aa, Mycobacterium tuberculosis
AAVVPPPQIAANRS

SEQ ID NO: 82847 - protein, 14 aa, Mycobacterium tuberculosis
AVVPPPQIAANRSQ

SEQ ID NO: 82848 - protein, 14 aa, Mycobacterium tuberculosis
VVPPPQIAANRSQL

SEQ ID NO: 82849 - protein, 14 aa, Mycobacterium tuberculosis
VPPPQIAANRSQLI

SEQ ID NO: 82850 - protein, 14 aa, Mycobacterium tuberculosis
PPPQIAANRSQLIS

SEQ ID NO: 82851 - protein, 14 aa, Mycobacterium tuberculosis
PPQIAANRSQLISL

SEQ ID NO: 82852 - protein, 14 aa, Mycobacterium tuberculosis
PQIAANRSQLISLV

SEQ ID NO: 82853 - protein, 14 aa, Mycobacterium tuberculosis
QIAANRSQLISLVA

SEQ ID NO: 82854 - protein, 14 aa, Mycobacterium tuberculosis
IAANRSQLISLVAT

SEQ ID NO: 82855 - protein, 14 aa, Mycobacterium tuberculosis
AANRSQLISLVATN

SEQ ID NO: 82856 - protein, 14 aa, Mycobacterium tuberculosis
ANRSQLISLVATNI

SEQ ID NO: 82857 - protein, 14 aa, Mycobacterium tuberculosis
NRSQLISLVATNIF

SEQ ID NO: 82858 - protein, 14 aa, Mycobacterium tuberculosis
RSQLISLVATNIFG

SEQ ID NO: 82859 - protein, 14 aa, Mycobacterium tuberculosis
SQLISLVATNIFGQ

SEQ ID NO: 82860 - protein, 14 aa, Mycobacterium tuberculosis
QLISLVATNIFGQN

SEQ ID NO: 82861 - protein, 14 aa, Mycobacterium tuberculosis
LISLVATNIFGQNT

SEQ ID NO: 82862 - protein, 14 aa, Mycobacterium tuberculosis
ISLVATNIFGQNTA

SEQ ID NO: 82863 - protein, 14 aa, Mycobacterium tuberculosis
SLVATNIFGQNTAA

SEQ ID NO: 82864 - protein, 14 aa, Mycobacterium tuberculosis
LVATNIFGQNTAAI

SEQ ID NO: 82865 - protein, 14 aa, Mycobacterium tuberculosis
VATNIFGQNTAAIA

SEQ ID NO: 82866 - protein, 14 aa, Mycobacterium tuberculosis
ATNIFGQNTAAIAA

SEQ ID NO: 82867 - protein, 14 aa, Mycobacterium tuberculosis
TNIFGQNTAAIAAT

SEQ ID NO: 82868 - protein, 14 aa, Mycobacterium tuberculosis
NIFGQNTAAIAATE

SEQ ID NO: 82869 - protein, 14 aa, Mycobacterium tuberculosis
IFGQNTAAIAATEA

SEQ ID NO: 82870 - protein, 14 aa, Mycobacterium tuberculosis
FGQNTAAIAATEAE

SEQ ID NO: 82871 - protein, 14 aa, Mycobacterium tuberculosis
GQNTAAIAATEAEY

SEQ ID NO: 82872 - protein, 14 aa, Mycobacterium tuberculosis
QNTAAIAATEAEYG

SEQ ID NO: 82873 - protein, 14 aa, Mycobacterium tuberculosis
NTAAIAATEAEYGE

SEQ ID NO: 82874 - protein, 14 aa, Mycobacterium tuberculosis
TAAIAATEAEYGEM

SEQ ID NO: 82875 - protein, 14 aa, Mycobacterium tuberculosis
AAIAATEAEYGEMW

SEQ ID NO: 82876 - protein, 14 aa, Mycobacterium tuberculosis
AIAATEAEYGEMWA

SEQ ID NO: 82877 - protein, 14 aa, Mycobacterium tuberculosis
IAATEAEYGEMWAQ

SEQ ID NO: 82878 - protein, 14 aa, Mycobacterium tuberculosis
AATEAEYGEMWAQD

SEQ ID NO: 82879 - protein, 14 aa, Mycobacterium tuberculosis
ATEAEYGEMWAQDT

SEQ ID NO: 82880 - protein, 14 aa, Mycobacterium tuberculosis
TEAEYGEMWAQDTM

SEQ ID NO: 82881 - protein, 14 aa, Mycobacterium tuberculosis
EAEYGEMWAQDTMA

SEQ ID NO: 82882 - protein, 14 aa, Mycobacterium tuberculosis
AEYGEMWAQDTMAM

SEQ ID NO: 82883 - protein, 14 aa, Mycobacterium tuberculosis
EYGEMWAQDTMAMF

SEQ ID NO: 82884 - protein, 14 aa, Mycobacterium tuberculosis
YGEMWAQDTMAMFG

SEQ ID NO: 82885 - protein, 14 aa, Mycobacterium tuberculosis
GEMWAQDTMAMFGY

SEQ ID NO: 82886 - protein, 14 aa, Mycobacterium tuberculosis
EMWAQDTMAMFGYA

SEQ ID NO: 82887 - protein, 14 aa, Mycobacterium tuberculosis
MWAQDTMAMFGYAS

SEQ ID NO: 82888 - protein, 14 aa, Mycobacterium tuberculosis
WAQDTMAMFGYASS

SEQ ID NO: 82889 - protein, 14 aa, Mycobacterium tuberculosis
AQDTMAMFGYASSS

SEQ ID NO: 82890 - protein, 14 aa, Mycobacterium tuberculosis
QDTMAMFGYASSSA

SEQ ID NO: 82891 - protein, 14 aa, Mycobacterium tuberculosis
DTMAMFGYASSSAT

SEQ ID NO: 82892 - protein, 14 aa, Mycobacterium tuberculosis
TMAMFGYASSSATA

SEQ ID NO: 82893 - protein, 14 aa, Mycobacterium tuberculosis
MAMFGYASSSATAS

SEQ ID NO: 82894 - protein, 14 aa, Mycobacterium tuberculosis
AMFGYASSSATASR

SEQ ID NO: 82895 - protein, 14 aa, Mycobacterium tuberculosis
MFGYASSSATASRL

SEQ ID NO: 82896 - protein, 14 aa, Mycobacterium tuberculosis
FGYASSSATASRLT

SEQ ID NO: 82897 - protein, 14 aa, Mycobacterium tuberculosis
GYASSSATASRLTP

SEQ ID NO: 82898 - protein, 14 aa, Mycobacterium tuberculosis
YASSSATASRLTPF

SEQ ID NO: 82899 - protein, 14 aa, Mycobacterium tuberculosis
ASSSATASRLTPFT

SEQ ID NO: 82900 - protein, 14 aa, Mycobacterium tuberculosis
SSSATASRLTPFTA

SEQ ID NO: 82901 - protein, 14 aa, Mycobacterium tuberculosis
SSATASRLTPFTAP

SEQ ID NO: 82902 - protein, 14 aa, Mycobacterium tuberculosis
SATASRLTPFTAPP

SEQ ID NO: 82903 - protein, 14 aa, Mycobacterium tuberculosis
ATASRLTPFTAPPQ

SEQ ID NO: 82904 - protein, 14 aa, Mycobacterium tuberculosis
TASRLTPFTAPPQT

SEQ ID NO: 82905 - protein, 14 aa, Mycobacterium tuberculosis
ASRLTPFTAPPQTT

SEQ ID NO: 82906 - protein, 14 aa, Mycobacterium tuberculosis
SRLTPFTAPPQTTN

SEQ ID NO: 82907 - protein, 14 aa, Mycobacterium tuberculosis
RLTPFTAPPQTTNP

SEQ ID NO: 82908 - protein, 14 aa, Mycobacterium tuberculosis
LTPFTAPPQTTNPS

SEQ ID NO: 82909 - protein, 14 aa, Mycobacterium tuberculosis
TPFTAPPQTTNPSG

SEQ ID NO: 82910 - protein, 14 aa, Mycobacterium tuberculosis
PFTAPPQTTNPSGL

SEQ ID NO: 82911 - protein, 14 aa, Mycobacterium tuberculosis
FTAPPQTTNPSGLA

SEQ ID NO: 82912 - protein, 14 aa, Mycobacterium tuberculosis
TAPPQTTNPSGLAG

SEQ ID NO: 82913 - protein, 14 aa, Mycobacterium tuberculosis
APPQTTNPSGLAGQ

SEQ ID NO: 82914 - protein, 14 aa, Mycobacterium tuberculosis
PPQTTNPSGLAGQA

SEQ ID NO: 82915 - protein, 14 aa, Mycobacterium tuberculosis
PQTTNPSGLAGQAA

SEQ ID NO: 82916 - protein, 14 aa, Mycobacterium tuberculosis
QTTNPSGLAGQAAA

SEQ ID NO: 82917 - protein, 14 aa, Mycobacterium tuberculosis
TTNPSGLAGQAAAT

SEQ ID NO: 82918 - protein, 14 aa, Mycobacterium tuberculosis
TNPSGLAGQAAATG

SEQ ID NO: 82919 - protein, 14 aa, Mycobacterium tuberculosis
NPSGLAGQAAATGQ

SEQ ID NO: 82920 - protein, 14 aa, Mycobacterium tuberculosis
PSGLAGQAAATGQA

SEQ ID NO: 82921 - protein, 14 aa, Mycobacterium tuberculosis
SGLAGQAAATGQAT

SEQ ID NO: 82922 - protein, 14 aa, Mycobacterium tuberculosis
GLAGQAAATGQATA

SEQ ID NO: 82923 - protein, 14 aa, Mycobacterium tuberculosis
LAGQAAATGQATAL

SEQ ID NO: 82924 - protein, 14 aa, Mycobacterium tuberculosis
AGQAAATGQATALA

SEQ ID NO: 82925 - protein, 14 aa, Mycobacterium tuberculosis
GQAAATGQATALAS

SEQ ID NO: 82926 - protein, 14 aa, Mycobacterium tuberculosis
QAAATGQATALASG

SEQ ID NO: 82927 - protein, 14 aa, Mycobacterium tuberculosis
AAATGQATALASGT

SEQ ID NO: 82928 - protein, 14 aa, Mycobacterium tuberculosis
AATGQATALASGTN

SEQ ID NO: 82929 - protein, 14 aa, Mycobacterium tuberculosis
ATGQATALASGTNA

SEQ ID NO: 82930 - protein, 14 aa, Mycobacterium tuberculosis
TGQATALASGTNAV

SEQ ID NO: 82931 - protein, 14 aa, Mycobacterium tuberculosis
GQATALASGTNAVT

SEQ ID NO: 82932 - protein, 14 aa, Mycobacterium tuberculosis
QATALASGTNAVTT

SEQ ID NO: 82933 - protein, 14 aa, Mycobacterium tuberculosis
ATALASGTNAVTTA

SEQ ID NO: 82934 - protein, 14 aa, Mycobacterium tuberculosis
TALASGTNAVTTAL

SEQ ID NO: 82935 - protein, 14 aa, Mycobacterium tuberculosis
ALASGTNAVTTALS

SEQ ID NO: 82936 - protein, 14 aa, Mycobacterium tuberculosis
LASGTNAVTTALSS

SEQ ID NO: 82937 - protein, 14 aa, Mycobacterium tuberculosis
ASGTNAVTTALSSA

SEQ ID NO: 82938 - protein, 14 aa, Mycobacterium tuberculosis
SGTNAVTTALSSAA

SEQ ID NO: 82939 - protein, 14 aa, Mycobacterium tuberculosis
GTNAVTTALSSAAA

SEQ ID NO: 82940 - protein, 14 aa, Mycobacterium tuberculosis
TNAVTTALSSAAAQ

SEQ ID NO: 82941 - protein, 14 aa, Mycobacterium tuberculosis
NAVTTALSSAAAQF

SEQ ID NO: 82942 - protein, 14 aa, Mycobacterium tuberculosis
AVTTALSSAAAQFP

SEQ ID NO: 82943 - protein, 14 aa, Mycobacterium tuberculosis
VTTALSSAAAQFPF

SEQ ID NO: 82944 - protein, 14 aa, Mycobacterium tuberculosis
TTALSSAAAQFPFD

SEQ ID NO: 82945 - protein, 14 aa, Mycobacterium tuberculosis
TALSSAAAQFPFDI

SEQ ID NO: 82946 - protein, 14 aa, Mycobacterium tuberculosis
ALSSAAAQFPFDII

SEQ ID NO: 82947 - protein, 14 aa, Mycobacterium tuberculosis
LSSAAAQFPFDIIP

SEQ ID NO: 82948 - protein, 14 aa, Mycobacterium tuberculosis
SSAAAQFPFDIIPT

SEQ ID NO: 82949 - protein, 14 aa, Mycobacterium tuberculosis
SAAAQFPFDIIPTL

SEQ ID NO: 82950 - protein, 14 aa, Mycobacterium tuberculosis
AAAQFPFDIIPTLL

SEQ ID NO: 82951 - protein, 14 aa, Mycobacterium tuberculosis
AAQFPFDIIPTLLQ

SEQ ID NO: 82952 - protein, 14 aa, Mycobacterium tuberculosis
AQFPFDIIPTLLQG

SEQ ID NO: 82953 - protein, 14 aa, Mycobacterium tuberculosis
QFPFDIIPTLLQGL

SEQ ID NO: 82954 - protein, 14 aa, Mycobacterium tuberculosis
FPFDIIPTLLQGLA

SEQ ID NO: 82955 - protein, 14 aa, Mycobacterium tuberculosis
PFDIIPTLLQGLAT

SEQ ID NO: 82956 - protein, 14 aa, Mycobacterium tuberculosis
FDIIPTLLQGLATL

SEQ ID NO: 82957 - protein, 14 aa, Mycobacterium tuberculosis
DIIPTLLQGLATLS

SEQ ID NO: 82958 - protein, 14 aa, Mycobacterium tuberculosis
IIPTLLQGLATLST

SEQ ID NO: 82959 - protein, 14 aa, Mycobacterium tuberculosis
IPTLLQGLATLSTQ

SEQ ID NO: 82960 - protein, 14 aa, Mycobacterium tuberculosis
PTLLQGLATLSTQY

SEQ ID NO: 82961 - protein, 14 aa, Mycobacterium tuberculosis
TLLQGLATLSTQYT

SEQ ID NO: 82962 - protein, 14 aa, Mycobacterium tuberculosis
LLQGLATLSTQYTQ

SEQ ID NO: 82963 - protein, 14 aa, Mycobacterium tuberculosis
LQGLATLSTQYTQL

SEQ ID NO: 82964 - protein, 14 aa, Mycobacterium tuberculosis
QGLATLSTQYTQLM

SEQ ID NO: 82965 - protein, 14 aa, Mycobacterium tuberculosis
GLATLSTQYTQLMG

SEQ ID NO: 82966 - protein, 14 aa, Mycobacterium tuberculosis
LATLSTQYTQLMGQ

SEQ ID NO: 82967 - protein, 14 aa, Mycobacterium tuberculosis
ATLSTQYTQLMGQL

SEQ ID NO: 82968 - protein, 14 aa, Mycobacterium tuberculosis
TLSTQYTQLMGQLI

SEQ ID NO: 82969 - protein, 14 aa, Mycobacterium tuberculosis
LSTQYTQLMGQLIN

SEQ ID NO: 82970 - protein, 14 aa, Mycobacterium tuberculosis
STQYTQLMGQLINA

SEQ ID NO: 82971 - protein, 14 aa, Mycobacterium tuberculosis
TQYTQLMGQLINAI

SEQ ID NO: 82972 - protein, 14 aa, Mycobacterium tuberculosis
QYTQLMGQLINAIF

SEQ ID NO: 82973 - protein, 14 aa, Mycobacterium tuberculosis
YTQLMGQLINAIFG

SEQ ID NO: 82974 - protein, 14 aa, Mycobacterium tuberculosis
TQLMGQLINAIFGP

SEQ ID NO: 82975 - protein, 14 aa, Mycobacterium tuberculosis
QLMGQLINAIFGPT

SEQ ID NO: 82976 - protein, 14 aa, Mycobacterium tuberculosis
LMGQLINAIFGPTG

SEQ ID NO: 82977 - protein, 14 aa, Mycobacterium tuberculosis
MGQLINAIFGPTGA

SEQ ID NO: 82978 - protein, 14 aa, Mycobacterium tuberculosis
GQLINAIFGPTGAT

SEQ ID NO: 82979 - protein, 14 aa, Mycobacterium tuberculosis
QLINAIFGPTGATT

SEQ ID NO: 82980 - protein, 14 aa, Mycobacterium tuberculosis
LINAIFGPTGATTY

SEQ ID NO: 82981 - protein, 14 aa, Mycobacterium tuberculosis
INAIFGPTGATTYQ

SEQ ID NO: 82982 - protein, 14 aa, Mycobacterium tuberculosis
NAIFGPTGATTYQN

SEQ ID NO: 82983 - protein, 14 aa, Mycobacterium tuberculosis
AIFGPTGATTYQNV

SEQ ID NO: 82984 - protein, 14 aa, Mycobacterium tuberculosis
IFGPTGATTYQNVF

SEQ ID NO: 82985 - protein, 14 aa, Mycobacterium tuberculosis
FGPTGATTYQNVFV

SEQ ID NO: 82986 - protein, 14 aa, Mycobacterium tuberculosis
GPTGATTYQNVFVT

SEQ ID NO: 82987 - protein, 14 aa, Mycobacterium tuberculosis
PTGATTYQNVFVTA

SEQ ID NO: 82988 - protein, 14 aa, Mycobacterium tuberculosis
TGATTYQNVFVTAA

SEQ ID NO: 82989 - protein, 14 aa, Mycobacterium tuberculosis
GATTYQNVFVTAAN

SEQ ID NO: 82990 - protein, 14 aa, Mycobacterium tuberculosis
ATTYQNVFVTAANV

SEQ ID NO: 82991 - protein, 14 aa, Mycobacterium tuberculosis
TTYQNVFVTAANVT

SEQ ID NO: 82992 - protein, 14 aa, Mycobacterium tuberculosis
TYQNVFVTAANVTK

SEQ ID NO: 82993 - protein, 14 aa, Mycobacterium tuberculosis
YQNVFVTAANVTKF

SEQ ID NO: 82994 - protein, 14 aa, Mycobacterium tuberculosis
QNVFVTAANVTKFS

SEQ ID NO: 82995 - protein, 14 aa, Mycobacterium tuberculosis
NVFVTAANVTKFST

SEQ ID NO: 82996 - protein, 14 aa, Mycobacterium tuberculosis
VFVTAANVTKFSTW

SEQ ID NO: 82997 - protein, 14 aa, Mycobacterium tuberculosis
FVTAANVTKFSTWA

SEQ ID NO: 82998 - protein, 14 aa, Mycobacterium tuberculosis
VTAANVTKFSTWAN

SEQ ID NO: 82999 - protein, 14 aa, Mycobacterium tuberculosis
TAANVTKFSTWAND

SEQ ID NO: 83000 - protein, 14 aa, Mycobacterium tuberculosis
AANVTKFSTWANDA

SEQ ID NO: 83001 - protein, 14 aa, Mycobacterium tuberculosis
ANVTKFSTWANDAM

SEQ ID NO: 83002 - protein, 14 aa, Mycobacterium tuberculosis
NVTKFSTWANDAMS

SEQ ID NO: 83003 - protein, 14 aa, Mycobacterium tuberculosis
VTKFSTWANDAMSA

SEQ ID NO: 83004 - protein, 14 aa, Mycobacterium tuberculosis
TKFSTWANDAMSAP

SEQ ID NO: 83005 - protein, 14 aa, Mycobacterium tuberculosis
KFSTWANDAMSAPN

SEQ ID NO: 83006 - protein, 14 aa, Mycobacterium tuberculosis
FSTWANDAMSAPNL

SEQ ID NO: 83007 - protein, 14 aa, Mycobacterium tuberculosis
STWANDAMSAPNLG

SEQ ID NO: 83008 - protein, 14 aa, Mycobacterium tuberculosis
TWANDAMSAPNLGM

SEQ ID NO: 83009 - protein, 14 aa, Mycobacterium tuberculosis
WANDAMSAPNLGMT

SEQ ID NO: 83010 - protein, 14 aa, Mycobacterium tuberculosis
ANDAMSAPNLGMTE

SEQ ID NO: 83011 - protein, 14 aa, Mycobacterium tuberculosis
NDAMSAPNLGMTEF

SEQ ID NO: 83012 - protein, 14 aa, Mycobacterium tuberculosis
DAMSAPNLGMTEFK

SEQ ID NO: 83013 - protein, 14 aa, Mycobacterium tuberculosis
AMSAPNLGMTEFKV

SEQ ID NO: 83014 - protein, 14 aa, Mycobacterium tuberculosis
MSAPNLGMTEFKVF

SEQ ID NO: 83015 - protein, 14 aa, Mycobacterium tuberculosis
SAPNLGMTEFKVFW

SEQ ID NO: 83016 - protein, 14 aa, Mycobacterium tuberculosis
APNLGMTEFKVFWQ

SEQ ID NO: 83017 - protein, 14 aa, Mycobacterium tuberculosis
PNLGMTEFKVFWQP

SEQ ID NO: 83018 - protein, 14 aa, Mycobacterium tuberculosis
NLGMTEFKVFWQPP

SEQ ID NO: 83019 - protein, 14 aa, Mycobacterium tuberculosis
LGMTEFKVFWQPPP

SEQ ID NO: 83020 - protein, 14 aa, Mycobacterium tuberculosis
GMTEFKVFWQPPPA

SEQ ID NO: 83021 - protein, 14 aa, Mycobacterium tuberculosis
MTEFKVFWQPPPAP

SEQ ID NO: 83022 - protein, 14 aa, Mycobacterium tuberculosis
TEFKVFWQPPPAPE

SEQ ID NO: 83023 - protein, 14 aa, Mycobacterium tuberculosis
EFKVFWQPPPAPEI

SEQ ID NO: 83024 - protein, 14 aa, Mycobacterium tuberculosis
FKVFWQPPPAPEIP

SEQ ID NO: 83025 - protein, 14 aa, Mycobacterium tuberculosis
KVFWQPPPAPEIPK

SEQ ID NO: 83026 - protein, 14 aa, Mycobacterium tuberculosis
VFWQPPPAPEIPKS

SEQ ID NO: 83027 - protein, 14 aa, Mycobacterium tuberculosis
FWQPPPAPEIPKSS

SEQ ID NO: 83028 - protein, 14 aa, Mycobacterium tuberculosis
WQPPPAPEIPKSSL

SEQ ID NO: 83029 - protein, 14 aa, Mycobacterium tuberculosis
QPPPAPEIPKSSLG

SEQ ID NO: 83030 - protein, 14 aa, Mycobacterium tuberculosis
PPPAPEIPKSSLGA

SEQ ID NO: 83031 - protein, 14 aa, Mycobacterium tuberculosis
PPAPEIPKSSLGAG

SEQ ID NO: 83032 - protein, 14 aa, Mycobacterium tuberculosis
PAPEIPKSSLGAGL

SEQ ID NO: 83033 - protein, 14 aa, Mycobacterium tuberculosis
APEIPKSSLGAGLG

SEQ ID NO: 83034 - protein, 14 aa, Mycobacterium tuberculosis
PEIPKSSLGAGLGL

SEQ ID NO: 83035 - protein, 14 aa, Mycobacterium tuberculosis
EIPKSSLGAGLGLR

SEQ ID NO: 83036 - protein, 14 aa, Mycobacterium tuberculosis
IPKSSLGAGLGLRS

SEQ ID NO: 83037 - protein, 14 aa, Mycobacterium tuberculosis
PKSSLGAGLGLRSG

SEQ ID NO: 83038 - protein, 14 aa, Mycobacterium tuberculosis
KSSLGAGLGLRSGL

SEQ ID NO: 83039 - protein, 14 aa, Mycobacterium tuberculosis
SSLGAGLGLRSGLS

SEQ ID NO: 83040 - protein, 14 aa, Mycobacterium tuberculosis
SLGAGLGLRSGLSA

SEQ ID NO: 83041 - protein, 14 aa, Mycobacterium tuberculosis
LGAGLGLRSGLSAG

SEQ ID NO: 83042 - protein, 14 aa, Mycobacterium tuberculosis
GAGLGLRSGLSAGL

SEQ ID NO: 83043 - protein, 14 aa, Mycobacterium tuberculosis
AGLGLRSGLSAGLA

SEQ ID NO: 83044 - protein, 14 aa, Mycobacterium tuberculosis
GLGLRSGLSAGLAH

SEQ ID NO: 83045 - protein, 14 aa, Mycobacterium tuberculosis
LGLRSGLSAGLAHA

SEQ ID NO: 83046 - protein, 14 aa, Mycobacterium tuberculosis
GLRSGLSAGLAHAA

SEQ ID NO: 83047 - protein, 14 aa, Mycobacterium tuberculosis
LRSGLSAGLAHAAS

SEQ ID NO: 83048 - protein, 14 aa, Mycobacterium tuberculosis
RSGLSAGLAHAASA

SEQ ID NO: 83049 - protein, 14 aa, Mycobacterium tuberculosis
SGLSAGLAHAASAG

SEQ ID NO: 83050 - protein, 14 aa, Mycobacterium tuberculosis
GLSAGLAHAASAGL

SEQ ID NO: 83051 - protein, 14 aa, Mycobacterium tuberculosis
LSAGLAHAASAGLG

SEQ ID NO: 83052 - protein, 14 aa, Mycobacterium tuberculosis
SAGLAHAASAGLGQ

SEQ ID NO: 83053 - protein, 14 aa, Mycobacterium tuberculosis
AGLAHAASAGLGQA

SEQ ID NO: 83054 - protein, 14 aa, Mycobacterium tuberculosis
GLAHAASAGLGQAN

SEQ ID NO: 83055 - protein, 14 aa, Mycobacterium tuberculosis
LAHAASAGLGQANL

SEQ ID NO: 83056 - protein, 14 aa, Mycobacterium tuberculosis
AHAASAGLGQANLV

SEQ ID NO: 83057 - protein, 14 aa, Mycobacterium tuberculosis
HAASAGLGQANLVG

SEQ ID NO: 83058 - protein, 14 aa, Mycobacterium tuberculosis
AASAGLGQANLVGD

SEQ ID NO: 83059 - protein, 14 aa, Mycobacterium tuberculosis
ASAGLGQANLVGDL

SEQ ID NO: 83060 - protein, 14 aa, Mycobacterium tuberculosis
SAGLGQANLVGDLS

SEQ ID NO: 83061 - protein, 14 aa, Mycobacterium tuberculosis
AGLGQANLVGDLSV

SEQ ID NO: 83062 - protein, 14 aa, Mycobacterium tuberculosis
GLGQANLVGDLSVP

SEQ ID NO: 83063 - protein, 14 aa, Mycobacterium tuberculosis
LGQANLVGDLSVPP

SEQ ID NO: 83064 - protein, 14 aa, Mycobacterium tuberculosis
GQANLVGDLSVPPS

SEQ ID NO: 83065 - protein, 14 aa, Mycobacterium tuberculosis
QANLVGDLSVPPSW

SEQ ID NO: 83066 - protein, 14 aa, Mycobacterium tuberculosis
ANLVGDLSVPPSWA

SEQ ID NO: 83067 - protein, 14 aa, Mycobacterium tuberculosis
NLVGDLSVPPSWAS

SEQ ID NO: 83068 - protein, 14 aa, Mycobacterium tuberculosis
LVGDLSVPPSWASA

SEQ ID NO: 83069 - protein, 14 aa, Mycobacterium tuberculosis
VGDLSVPPSWASAT

SEQ ID NO: 83070 - protein, 14 aa, Mycobacterium tuberculosis
GDLSVPPSWASATP

SEQ ID NO: 83071 - protein, 14 aa, Mycobacterium tuberculosis
DLSVPPSWASATPA

SEQ ID NO: 83072 - protein, 14 aa, Mycobacterium tuberculosis
LSVPPSWASATPAV

SEQ ID NO: 83073 - protein, 14 aa, Mycobacterium tuberculosis
SVPPSWASATPAVR

SEQ ID NO: 83074 - protein, 14 aa, Mycobacterium tuberculosis
VPPSWASATPAVRL

SEQ ID NO: 83075 - protein, 14 aa, Mycobacterium tuberculosis
PPSWASATPAVRLV

SEQ ID NO: 83076 - protein, 14 aa, Mycobacterium tuberculosis
PSWASATPAVRLVA

SEQ ID NO: 83077 - protein, 14 aa, Mycobacterium tuberculosis
SWASATPAVRLVAN

SEQ ID NO: 83078 - protein, 14 aa, Mycobacterium tuberculosis
WASATPAVRLVANT

SEQ ID NO: 83079 - protein, 14 aa, Mycobacterium tuberculosis
ASATPAVRLVANTL

SEQ ID NO: 83080 - protein, 14 aa, Mycobacterium tuberculosis
SATPAVRLVANTLP

SEQ ID NO: 83081 - protein, 14 aa, Mycobacterium tuberculosis
ATPAVRLVANTLPA

SEQ ID NO: 83082 - protein, 14 aa, Mycobacterium tuberculosis
TPAVRLVANTLPAT

SEQ ID NO: 83083 - protein, 14 aa, Mycobacterium tuberculosis
PAVRLVANTLPATS

SEQ ID NO: 83084 - protein, 14 aa, Mycobacterium tuberculosis
AVRLVANTLPATSL

SEQ ID NO: 83085 - protein, 14 aa, Mycobacterium tuberculosis
VRLVANTLPATSLA

SEQ ID NO: 83086 - protein, 14 aa, Mycobacterium tuberculosis
RLVANTLPATSLAA

SEQ ID NO: 83087 - protein, 14 aa, Mycobacterium tuberculosis
LVANTLPATSLAAA

SEQ ID NO: 83088 - protein, 14 aa, Mycobacterium tuberculosis
VANTLPATSLAAAP

SEQ ID NO: 83089 - protein, 14 aa, Mycobacterium tuberculosis
ANTLPATSLAAAPA

SEQ ID NO: 83090 - protein, 14 aa, Mycobacterium tuberculosis
NTLPATSLAAAPAT

SEQ ID NO: 83091 - protein, 14 aa, Mycobacterium tuberculosis
TLPATSLAAAPATQ

SEQ ID NO: 83092 - protein, 14 aa, Mycobacterium tuberculosis
LPATSLAAAPATQI

SEQ ID NO: 83093 - protein, 14 aa, Mycobacterium tuberculosis
PATSLAAAPATQIP

SEQ ID NO: 83094 - protein, 14 aa, Mycobacterium tuberculosis
ATSLAAAPATQIPA

SEQ ID NO: 83095 - protein, 14 aa, Mycobacterium tuberculosis
TSLAAAPATQIPAN

SEQ ID NO: 83096 - protein, 14 aa, Mycobacterium tuberculosis
SLAAAPATQIPANL

SEQ ID NO: 83097 - protein, 14 aa, Mycobacterium tuberculosis
LAAAPATQIPANLL

SEQ ID NO: 83098 - protein, 14 aa, Mycobacterium tuberculosis
AAAPATQIPANLLG

SEQ ID NO: 83099 - protein, 14 aa, Mycobacterium tuberculosis
AAPATQIPANLLGQ

SEQ ID NO: 83100 - protein, 14 aa, Mycobacterium tuberculosis
APATQIPANLLGQM

SEQ ID NO: 83101 - protein, 14 aa, Mycobacterium tuberculosis
PATQIPANLLGQMA

SEQ ID NO: 83102 - protein, 14 aa, Mycobacterium tuberculosis
ATQIPANLLGQMAL

SEQ ID NO: 83103 - protein, 14 aa, Mycobacterium tuberculosis
TQIPANLLGQMALG

SEQ ID NO: 83104 - protein, 14 aa, Mycobacterium tuberculosis
QIPANLLGQMALGS

SEQ ID NO: 83105 - protein, 14 aa, Mycobacterium tuberculosis
IPANLLGQMALGSM

SEQ ID NO: 83106 - protein, 14 aa, Mycobacterium tuberculosis
PANLLGQMALGSMT

SEQ ID NO: 83107 - protein, 14 aa, Mycobacterium tuberculosis
ANLLGQMALGSMTG

SEQ ID NO: 83108 - protein, 14 aa, Mycobacterium tuberculosis
NLLGQMALGSMTGG

SEQ ID NO: 83109 - protein, 14 aa, Mycobacterium tuberculosis
LLGQMALGSMTGGA

SEQ ID NO: 83110 - protein, 14 aa, Mycobacterium tuberculosis
LGQMALGSMTGGAL

SEQ ID NO: 83111 - protein, 14 aa, Mycobacterium tuberculosis
GQMALGSMTGGALG

SEQ ID NO: 83112 - protein, 14 aa, Mycobacterium tuberculosis
QMALGSMTGGALGA

SEQ ID NO: 83113 - protein, 14 aa, Mycobacterium tuberculosis
MALGSMTGGALGAA

SEQ ID NO: 83114 - protein, 14 aa, Mycobacterium tuberculosis
ALGSMTGGALGAAA

SEQ ID NO: 83115 - protein, 14 aa, Mycobacterium tuberculosis
LGSMTGGALGAAAP

SEQ ID NO: 83116 - protein, 14 aa, Mycobacterium tuberculosis
GSMTGGALGAAAPA

SEQ ID NO: 83117 - protein, 14 aa, Mycobacterium tuberculosis
SMTGGALGAAAPAI

SEQ ID NO: 83118 - protein, 14 aa, Mycobacterium tuberculosis
MTGGALGAAAPAIY

SEQ ID NO: 83119 - protein, 14 aa, Mycobacterium tuberculosis
TGGALGAAAPAIYT

SEQ ID NO: 83120 - protein, 14 aa, Mycobacterium tuberculosis
GGALGAAAPAIYTG

SEQ ID NO: 83121 - protein, 14 aa, Mycobacterium tuberculosis
GALGAAAPAIYTGS

SEQ ID NO: 83122 - protein, 14 aa, Mycobacterium tuberculosis
ALGAAAPAIYTGSG

SEQ ID NO: 83123 - protein, 14 aa, Mycobacterium tuberculosis
LGAAAPAIYTGSGA

SEQ ID NO: 83124 - protein, 14 aa, Mycobacterium tuberculosis
GAAAPAIYTGSGAR

SEQ ID NO: 83125 - protein, 14 aa, Mycobacterium tuberculosis
AAAPAIYTGSGARA

SEQ ID NO: 83126 - protein, 14 aa, Mycobacterium tuberculosis
AAPAIYTGSGARAR

SEQ ID NO: 83127 - protein, 14 aa, Mycobacterium tuberculosis
APAIYTGSGARARA

SEQ ID NO: 83128 - protein, 14 aa, Mycobacterium tuberculosis
PAIYTGSGARARAN

SEQ ID NO: 83129 - protein, 14 aa, Mycobacterium tuberculosis
AIYTGSGARARANG

SEQ ID NO: 83130 - protein, 14 aa, Mycobacterium tuberculosis
IYTGSGARARANGG

SEQ ID NO: 83131 - protein, 14 aa, Mycobacterium tuberculosis
YTGSGARARANGGT

SEQ ID NO: 83132 - protein, 14 aa, Mycobacterium tuberculosis
TGSGARARANGGTP

SEQ ID NO: 83133 - protein, 14 aa, Mycobacterium tuberculosis
GSGARARANGGTPS

SEQ ID NO: 83134 - protein, 14 aa, Mycobacterium tuberculosis
SGARARANGGTPSA

SEQ ID NO: 83135 - protein, 14 aa, Mycobacterium tuberculosis
GARARANGGTPSAE

SEQ ID NO: 83136 - protein, 14 aa, Mycobacterium tuberculosis
ARARANGGTPSAEP

SEQ ID NO: 83137 - protein, 14 aa, Mycobacterium tuberculosis
RARANGGTPSAEPV

SEQ ID NO: 83138 - protein, 14 aa, Mycobacterium tuberculosis
ARANGGTPSAEPVK

SEQ ID NO: 83139 - protein, 14 aa, Mycobacterium tuberculosis
RANGGTPSAEPVKL

SEQ ID NO: 83140 - protein, 14 aa, Mycobacterium tuberculosis
ANGGTPSAEPVKLE

SEQ ID NO: 83141 - protein, 14 aa, Mycobacterium tuberculosis
NGGTPSAEPVKLEA

SEQ ID NO: 83142 - protein, 14 aa, Mycobacterium tuberculosis
GGTPSAEPVKLEAV

SEQ ID NO: 83143 - protein, 14 aa, Mycobacterium tuberculosis
GTPSAEPVKLEAVI

SEQ ID NO: 83144 - protein, 14 aa, Mycobacterium tuberculosis
TPSAEPVKLEAVIA

SEQ ID NO: 83145 - protein, 14 aa, Mycobacterium tuberculosis
PSAEPVKLEAVIAQ

SEQ ID NO: 83146 - protein, 14 aa, Mycobacterium tuberculosis
SAEPVKLEAVIAQL

SEQ ID NO: 83147 - protein, 14 aa, Mycobacterium tuberculosis
AEPVKLEAVIAQLQ

SEQ ID NO: 83148 - protein, 14 aa, Mycobacterium tuberculosis
EPVKLEAVIAQLQK

SEQ ID NO: 83149 - protein, 14 aa, Mycobacterium tuberculosis
PVKLEAVIAQLQKQ

SEQ ID NO: 83150 - protein, 14 aa, Mycobacterium tuberculosis
VKLEAVIAQLQKQP

SEQ ID NO: 83151 - protein, 14 aa, Mycobacterium tuberculosis
KLEAVIAQLQKQPD

SEQ ID NO: 83152 - protein, 14 aa, Mycobacterium tuberculosis
LEAVIAQLQKQPDA

SEQ ID NO: 83153 - protein, 14 aa, Mycobacterium tuberculosis
EAVIAQLQKQPDAV

SEQ ID NO: 83154 - protein, 14 aa, Mycobacterium tuberculosis
AVIAQLQKQPDAVR

SEQ ID NO: 83155 - protein, 14 aa, Mycobacterium tuberculosis
VIAQLQKQPDAVRH

SEQ ID NO: 83156 - protein, 14 aa, Mycobacterium tuberculosis
IAQLQKQPDAVRHW

SEQ ID NO: 83157 - protein, 14 aa, Mycobacterium tuberculosis
AQLQKQPDAVRHWN

SEQ ID NO: 83158 - protein, 14 aa, Mycobacterium tuberculosis
QLQKQPDAVRHWNV

SEQ ID NO: 83159 - protein, 14 aa, Mycobacterium tuberculosis
LQKQPDAVRHWNVD

SEQ ID NO: 83160 - protein, 14 aa, Mycobacterium tuberculosis
QKQPDAVRHWNVDK

SEQ ID NO: 83161 - protein, 14 aa, Mycobacterium tuberculosis
KQPDAVRHWNVDKA

SEQ ID NO: 83162 - protein, 14 aa, Mycobacterium tuberculosis
QPDAVRHWNVDKAD

SEQ ID NO: 83163 - protein, 14 aa, Mycobacterium tuberculosis
PDAVRHWNVDKADL

SEQ ID NO: 83164 - protein, 14 aa, Mycobacterium tuberculosis
DAVRHWNVDKADLD

SEQ ID NO: 83165 - protein, 14 aa, Mycobacterium tuberculosis
AVRHWNVDKADLDG

SEQ ID NO: 83166 - protein, 14 aa, Mycobacterium tuberculosis
VRHWNVDKADLDGL

SEQ ID NO: 83167 - protein, 14 aa, Mycobacterium tuberculosis
RHWNVDKADLDGLL

SEQ ID NO: 83168 - protein, 14 aa, Mycobacterium tuberculosis
HWNVDKADLDGLLD

SEQ ID NO: 83169 - protein, 14 aa, Mycobacterium tuberculosis
WNVDKADLDGLLDR

SEQ ID NO: 83170 - protein, 14 aa, Mycobacterium tuberculosis
NVDKADLDGLLDRL

SEQ ID NO: 83171 - protein, 14 aa, Mycobacterium tuberculosis
VDKADLDGLLDRLS

SEQ ID NO: 83172 - protein, 14 aa, Mycobacterium tuberculosis
DKADLDGLLDRLSK

SEQ ID NO: 83173 - protein, 14 aa, Mycobacterium tuberculosis
KADLDGLLDRLSKQ

SEQ ID NO: 83174 - protein, 14 aa, Mycobacterium tuberculosis
ADLDGLLDRLSKQP

SEQ ID NO: 83175 - protein, 14 aa, Mycobacterium tuberculosis
DLDGLLDRLSKQPG

SEQ ID NO: 83176 - protein, 14 aa, Mycobacterium tuberculosis
LDGLLDRLSKQPGI

SEQ ID NO: 83177 - protein, 14 aa, Mycobacterium tuberculosis
DGLLDRLSKQPGIH

SEQ ID NO: 83178 - protein, 14 aa, Mycobacterium tuberculosis
GLLDRLSKQPGIHA

SEQ ID NO: 83179 - protein, 14 aa, Mycobacterium tuberculosis
LLDRLSKQPGIHAV

SEQ ID NO: 83180 - protein, 14 aa, Mycobacterium tuberculosis
LDRLSKQPGIHAVH

SEQ ID NO: 83181 - protein, 14 aa, Mycobacterium tuberculosis
DRLSKQPGIHAVHV

SEQ ID NO: 83182 - protein, 14 aa, Mycobacterium tuberculosis
RLSKQPGIHAVHVS

SEQ ID NO: 83183 - protein, 14 aa, Mycobacterium tuberculosis
LSKQPGIHAVHVSN

SEQ ID NO: 83184 - protein, 14 aa, Mycobacterium tuberculosis
SKQPGIHAVHVSNG

SEQ ID NO: 83185 - protein, 14 aa, Mycobacterium tuberculosis
KQPGIHAVHVSNGD

SEQ ID NO: 83186 - protein, 14 aa, Mycobacterium tuberculosis
QPGIHAVHVSNGDK

SEQ ID NO: 83187 - protein, 14 aa, Mycobacterium tuberculosis
PGIHAVHVSNGDKP

SEQ ID NO: 83188 - protein, 14 aa, Mycobacterium tuberculosis
GIHAVHVSNGDKPK

SEQ ID NO: 83189 - protein, 14 aa, Mycobacterium tuberculosis
IHAVHVSNGDKPKV

SEQ ID NO: 83190 - protein, 14 aa, Mycobacterium tuberculosis
HAVHVSNGDKPKVA

SEQ ID NO: 83191 - protein, 14 aa, Mycobacterium tuberculosis
AVHVSNGDKPKVAL

SEQ ID NO: 83192 - protein, 14 aa, Mycobacterium tuberculosis
VHVSNGDKPKVALP

SEQ ID NO: 83193 - protein, 14 aa, Mycobacterium tuberculosis
HVSNGDKPKVALPD

SEQ ID NO: 83194 - protein, 14 aa, Mycobacterium tuberculosis
VSNGDKPKVALPDT

SEQ ID NO: 83195 - protein, 14 aa, Mycobacterium tuberculosis
SNGDKPKVALPDTQ

SEQ ID NO: 83196 - protein, 14 aa, Mycobacterium tuberculosis
NGDKPKVALPDTQL

SEQ ID NO: 83197 - protein, 14 aa, Mycobacterium tuberculosis
GDKPKVALPDTQLG

SEQ ID NO: 83198 - protein, 14 aa, Mycobacterium tuberculosis
DKPKVALPDTQLGS

SEQ ID NO: 83199 - protein, 14 aa, Mycobacterium tuberculosis
KPKVALPDTQLGSH

SEQ ID NO: 83200 - protein, 15 aa, Mycobacterium tuberculosis
MDFGLQPPEITSGEM

SEQ ID NO: 83201 - protein, 15 aa, Mycobacterium tuberculosis
DFGLQPPEITSGEMY

SEQ ID NO: 83202 - protein, 15 aa, Mycobacterium tuberculosis
FGLQPPEITSGEMYL

SEQ ID NO: 83203 - protein, 15 aa, Mycobacterium tuberculosis
GLQPPEITSGEMYLG

SEQ ID NO: 83204 - protein, 15 aa, Mycobacterium tuberculosis
LQPPEITSGEMYLGP

SEQ ID NO: 83205 - protein, 15 aa, Mycobacterium tuberculosis
QPPEITSGEMYLGPG

SEQ ID NO: 83206 - protein, 15 aa, Mycobacterium tuberculosis
PPEITSGEMYLGPGA

SEQ ID NO: 83207 - protein, 15 aa, Mycobacterium tuberculosis
PEITSGEMYLGPGAG

SEQ ID NO: 83208 - protein, 15 aa, Mycobacterium tuberculosis
EITSGEMYLGPGAGP

SEQ ID NO: 83209 - protein, 15 aa, Mycobacterium tuberculosis
ITSGEMYLGPGAGPM

SEQ ID NO: 83210 - protein, 15 aa, Mycobacterium tuberculosis
TSGEMYLGPGAGPML

SEQ ID NO: 83211 - protein, 15 aa, Mycobacterium tuberculosis
SGEMYLGPGAGPMLA

SEQ ID NO: 83212 - protein, 15 aa, Mycobacterium tuberculosis
GEMYLGPGAGPMLAA

SEQ ID NO: 83213 - protein, 15 aa, Mycobacterium tuberculosis
EMYLGPGAGPMLAAA

SEQ ID NO: 83214 - protein, 15 aa, Mycobacterium tuberculosis
MYLGPGAGPMLAAAV

SEQ ID NO: 83215 - protein, 15 aa, Mycobacterium tuberculosis
YLGPGAGPMLAAAVA

SEQ ID NO: 83216 - protein, 15 aa, Mycobacterium tuberculosis
LGPGAGPMLAAAVAW

SEQ ID NO: 83217 - protein, 15 aa, Mycobacterium tuberculosis
GPGAGPMLAAAVAWD

SEQ ID NO: 83218 - protein, 15 aa, Mycobacterium tuberculosis
PGAGPMLAAAVAWDG

SEQ ID NO: 83219 - protein, 15 aa, Mycobacterium tuberculosis
GAGPMLAAAVAWDGL

SEQ ID NO: 83220 - protein, 15 aa, Mycobacterium tuberculosis
AGPMLAAAVAWDGLA

SEQ ID NO: 83221 - protein, 15 aa, Mycobacterium tuberculosis
GPMLAAAVAWDGLAA

SEQ ID NO: 83222 - protein, 15 aa, Mycobacterium tuberculosis
PMLAAAVAWDGLAAE

SEQ ID NO: 83223 - protein, 15 aa, Mycobacterium tuberculosis
MLAAAVAWDGLAAEL

SEQ ID NO: 83224 - protein, 15 aa, Mycobacterium tuberculosis
LAAAVAWDGLAAELQ

SEQ ID NO: 83225 - protein, 15 aa, Mycobacterium tuberculosis
AAAVAWDGLAAELQS

SEQ ID NO: 83226 - protein, 15 aa, Mycobacterium tuberculosis
AAVAWDGLAAELQSM

SEQ ID NO: 83227 - protein, 15 aa, Mycobacterium tuberculosis
AVAWDGLAAELQSMA

SEQ ID NO: 83228 - protein, 15 aa, Mycobacterium tuberculosis
VAWDGLAAELQSMAA

SEQ ID NO: 83229 - protein, 15 aa, Mycobacterium tuberculosis
AWDGLAAELQSMAAS

SEQ ID NO: 83230 - protein, 15 aa, Mycobacterium tuberculosis
WDGLAAELQSMAASY

SEQ ID NO: 83231 - protein, 15 aa, Mycobacterium tuberculosis
DGLAAELQSMAASYA

SEQ ID NO: 83232 - protein, 15 aa, Mycobacterium tuberculosis
GLAAELQSMAASYAS

SEQ ID NO: 83233 - protein, 15 aa, Mycobacterium tuberculosis
LAAELQSMAASYASI

SEQ ID NO: 83234 - protein, 15 aa, Mycobacterium tuberculosis
AAELQSMAASYASIV

SEQ ID NO: 83235 - protein, 15 aa, Mycobacterium tuberculosis
AELQSMAASYASIVE

SEQ ID NO: 83236 - protein, 15 aa, Mycobacterium tuberculosis
ELQSMAASYASIVEG

SEQ ID NO: 83237 - protein, 15 aa, Mycobacterium tuberculosis
LQSMAASYASIVEGM

SEQ ID NO: 83238 - protein, 15 aa, Mycobacterium tuberculosis
QSMAASYASIVEGMA

SEQ ID NO: 83239 - protein, 15 aa, Mycobacterium tuberculosis
SMAASYASIVEGMAS

SEQ ID NO: 83240 - protein, 15 aa, Mycobacterium tuberculosis
MAASYASIVEGMASE

SEQ ID NO: 83241 - protein, 15 aa, Mycobacterium tuberculosis
AASYASIVEGMASES

SEQ ID NO: 83242 - protein, 15 aa, Mycobacterium tuberculosis
ASYASIVEGMASESW

SEQ ID NO: 83243 - protein, 15 aa, Mycobacterium tuberculosis
SYASIVEGMASESWL

SEQ ID NO: 83244 - protein, 15 aa, Mycobacterium tuberculosis
YASIVEGMASESWLG

SEQ ID NO: 83245 - protein, 15 aa, Mycobacterium tuberculosis
ASIVEGMASESWLGP

SEQ ID NO: 83246 - protein, 15 aa, Mycobacterium tuberculosis
SIVEGMASESWLGPS

SEQ ID NO: 83247 - protein, 15 aa, Mycobacterium tuberculosis
IVEGMASESWLGPSS

SEQ ID NO: 83248 - protein, 15 aa, Mycobacterium tuberculosis
VEGMASESWLGPSSA

SEQ ID NO: 83249 - protein, 15 aa, Mycobacterium tuberculosis
EGMASESWLGPSSAG

SEQ ID NO: 83250 - protein, 15 aa, Mycobacterium tuberculosis
GMASESWLGPSSAGM

SEQ ID NO: 83251 - protein, 15 aa, Mycobacterium tuberculosis
MASESWLGPSSAGMA

SEQ ID NO: 83252 - protein, 15 aa, Mycobacterium tuberculosis
ASESWLGPSSAGMAA

SEQ ID NO: 83253 - protein, 15 aa, Mycobacterium tuberculosis
SESWLGPSSAGMAAA

SEQ ID NO: 83254 - protein, 15 aa, Mycobacterium tuberculosis
ESWLGPSSAGMAAAA

SEQ ID NO: 83255 - protein, 15 aa, Mycobacterium tuberculosis
SWLGPSSAGMAAAAA

SEQ ID NO: 83256 - protein, 15 aa, Mycobacterium tuberculosis
WLGPSSAGMAAAAAP

SEQ ID NO: 83257 - protein, 15 aa, Mycobacterium tuberculosis
LGPSSAGMAAAAAPY

SEQ ID NO: 83258 - protein, 15 aa, Mycobacterium tuberculosis
GPSSAGMAAAAAPYV

SEQ ID NO: 83259 - protein, 15 aa, Mycobacterium tuberculosis
PSSAGMAAAAAPYVT

SEQ ID NO: 83260 - protein, 15 aa, Mycobacterium tuberculosis
SSAGMAAAAAPYVTW

SEQ ID NO: 83261 - protein, 15 aa, Mycobacterium tuberculosis
SAGMAAAAAPYVTWM

SEQ ID NO: 83262 - protein, 15 aa, Mycobacterium tuberculosis
AGMAAAAAPYVTWMS

SEQ ID NO: 83263 - protein, 15 aa, Mycobacterium tuberculosis
GMAAAAAPYVTWMSG

SEQ ID NO: 83264 - protein, 15 aa, Mycobacterium tuberculosis
MAAAAAPYVTWMSGT

SEQ ID NO: 83265 - protein, 15 aa, Mycobacterium tuberculosis
AAAAAPYVTWMSGTS

SEQ ID NO: 83266 - protein, 15 aa, Mycobacterium tuberculosis
AAAAPYVTWMSGTSA

SEQ ID NO: 83267 - protein, 15 aa, Mycobacterium tuberculosis
AAAPYVTWMSGTSAQ

SEQ ID NO: 83268 - protein, 15 aa, Mycobacterium tuberculosis
AAPYVTWMSGTSAQA

SEQ ID NO: 83269 - protein, 15 aa, Mycobacterium tuberculosis
APYVTWMSGTSAQAK

SEQ ID NO: 83270 - protein, 15 aa, Mycobacterium tuberculosis
PYVTWMSGTSAQAKA

SEQ ID NO: 83271 - protein, 15 aa, Mycobacterium tuberculosis
YVTWMSGTSAQAKAA

SEQ ID NO: 83272 - protein, 15 aa, Mycobacterium tuberculosis
VTWMSGTSAQAKAAA

SEQ ID NO: 83273 - protein, 15 aa, Mycobacterium tuberculosis
TWMSGTSAQAKAAAD

SEQ ID NO: 83274 - protein, 15 aa, Mycobacterium tuberculosis
WMSGTSAQAKAAADQ

SEQ ID NO: 83275 - protein, 15 aa, Mycobacterium tuberculosis
MSGTSAQAKAAADQA

SEQ ID NO: 83276 - protein, 15 aa, Mycobacterium tuberculosis
SGTSAQAKAAADQAR

SEQ ID NO: 83277 - protein, 15 aa, Mycobacterium tuberculosis
GTSAQAKAAADQARA

SEQ ID NO: 83278 - protein, 15 aa, Mycobacterium tuberculosis
TSAQAKAAADQARAA

SEQ ID NO: 83279 - protein, 15 aa, Mycobacterium tuberculosis
SAQAKAAADQARAAV

SEQ ID NO: 83280 - protein, 15 aa, Mycobacterium tuberculosis
AQAKAAADQARAAVV

SEQ ID NO: 83281 - protein, 15 aa, Mycobacterium tuberculosis
QAKAAADQARAAVVA

SEQ ID NO: 83282 - protein, 15 aa, Mycobacterium tuberculosis
AKAAADQARAAVVAY

SEQ ID NO: 83283 - protein, 15 aa, Mycobacterium tuberculosis
KAAADQARAAVVAYE

SEQ ID NO: 83284 - protein, 15 aa, Mycobacterium tuberculosis
AAADQARAAVVAYET

SEQ ID NO: 83285 - protein, 15 aa, Mycobacterium tuberculosis
AADQARAAVVAYETA

SEQ ID NO: 83286 - protein, 15 aa, Mycobacterium tuberculosis
ADQARAAVVAYETAF

SEQ ID NO: 83287 - protein, 15 aa, Mycobacterium tuberculosis
DQARAAVVAYETAFA

SEQ ID NO: 83288 - protein, 15 aa, Mycobacterium tuberculosis
QARAAVVAYETAFAA

SEQ ID NO: 83289 - protein, 15 aa, Mycobacterium tuberculosis
ARAAVVAYETAFAAV

SEQ ID NO: 83290 - protein, 15 aa, Mycobacterium tuberculosis
RAAVVAYETAFAAVV

SEQ ID NO: 83291 - protein, 15 aa, Mycobacterium tuberculosis
AAVVAYETAFAAVVP

SEQ ID NO: 83292 - protein, 15 aa, Mycobacterium tuberculosis
AVVAYETAFAAVVPP

SEQ ID NO: 83293 - protein, 15 aa, Mycobacterium tuberculosis
VVAYETAFAAVVPPP

SEQ ID NO: 83294 - protein, 15 aa, Mycobacterium tuberculosis
VAYETAFAAVVPPPQ

SEQ ID NO: 83295 - protein, 15 aa, Mycobacterium tuberculosis
AYETAFAAVVPPPQI

SEQ ID NO: 83296 - protein, 15 aa, Mycobacterium tuberculosis
YETAFAAVVPPPQIA

SEQ ID NO: 83297 - protein, 15 aa, Mycobacterium tuberculosis
ETAFAAVVPPPQIAA

SEQ ID NO: 83298 - protein, 15 aa, Mycobacterium tuberculosis
TAFAAVVPPPQIAAN

SEQ ID NO: 83299 - protein, 15 aa, Mycobacterium tuberculosis
AFAAVVPPPQIAANR

SEQ ID NO: 83300 - protein, 15 aa, Mycobacterium tuberculosis
FAAVVPPPQIAANRS

SEQ ID NO: 83301 - protein, 15 aa, Mycobacterium tuberculosis
AAVVPPPQIAANRSQ

SEQ ID NO: 83302 - protein, 15 aa, Mycobacterium tuberculosis
AVVPPPQIAANRSQL

SEQ ID NO: 83303 - protein, 15 aa, Mycobacterium tuberculosis
VVPPPQIAANRSQLI

SEQ ID NO: 83304 - protein, 15 aa, Mycobacterium tuberculosis
VPPPQIAANRSQLIS

SEQ ID NO: 83305 - protein, 15 aa, Mycobacterium tuberculosis
PPPQIAANRSQLISL

SEQ ID NO: 83306 - protein, 15 aa, Mycobacterium tuberculosis
PPQIAANRSQLISLV

SEQ ID NO: 83307 - protein, 15 aa, Mycobacterium tuberculosis
PQIAANRSQLISLVA

SEQ ID NO: 83308 - protein, 15 aa, Mycobacterium tuberculosis
QIAANRSQLISLVAT

SEQ ID NO: 83309 - protein, 15 aa, Mycobacterium tuberculosis
IAANRSQLISLVATN

SEQ ID NO: 83310 - protein, 15 aa, Mycobacterium tuberculosis
AANRSQLISLVATNI

SEQ ID NO: 83311 - protein, 15 aa, Mycobacterium tuberculosis
ANRSQLISLVATNIF

SEQ ID NO: 83312 - protein, 15 aa, Mycobacterium tuberculosis
NRSQLISLVATNIFG

SEQ ID NO: 83313 - protein, 15 aa, Mycobacterium tuberculosis
RSQLISLVATNIFGQ

SEQ ID NO: 83314 - protein, 15 aa, Mycobacterium tuberculosis
SQLISLVATNIFGQN

SEQ ID NO: 83315 - protein, 15 aa, Mycobacterium tuberculosis
QLISLVATNIFGQNT

SEQ ID NO: 83316 - protein, 15 aa, Mycobacterium tuberculosis
LISLVATNIFGQNTA

SEQ ID NO: 83317 - protein, 15 aa, Mycobacterium tuberculosis
ISLVATNIFGQNTAA

SEQ ID NO: 83318 - protein, 15 aa, Mycobacterium tuberculosis
SLVATNIFGQNTAAI

SEQ ID NO: 83319 - protein, 15 aa, Mycobacterium tuberculosis
LVATNIFGQNTAAIA

SEQ ID NO: 83320 - protein, 15 aa, Mycobacterium tuberculosis
VATNIFGQNTAAIAA

SEQ ID NO: 83321 - protein, 15 aa, Mycobacterium tuberculosis
ATNIFGQNTAAIAAT

SEQ ID NO: 83322 - protein, 15 aa, Mycobacterium tuberculosis
TNIFGQNTAAIAATE

SEQ ID NO: 83323 - protein, 15 aa, Mycobacterium tuberculosis
NIFGQNTAAIAATEA

SEQ ID NO: 83324 - protein, 15 aa, Mycobacterium tuberculosis
IFGQNTAAIAATEAE

SEQ ID NO: 83325 - protein, 15 aa, Mycobacterium tuberculosis
FGQNTAAIAATEAEY

SEQ ID NO: 83326 - protein, 15 aa, Mycobacterium tuberculosis
GQNTAAIAATEAEYG

SEQ ID NO: 83327 - protein, 15 aa, Mycobacterium tuberculosis
QNTAAIAATEAEYGE

SEQ ID NO: 83328 - protein, 15 aa, Mycobacterium tuberculosis
NTAAIAATEAEYGEM

SEQ ID NO: 83329 - protein, 15 aa, Mycobacterium tuberculosis
TAAIAATEAEYGEMW

SEQ ID NO: 83330 - protein, 15 aa, Mycobacterium tuberculosis
AAIAATEAEYGEMWA

SEQ ID NO: 83331 - protein, 15 aa, Mycobacterium tuberculosis
AIAATEAEYGEMWAQ

SEQ ID NO: 83332 - protein, 15 aa, Mycobacterium tuberculosis
IAATEAEYGEMWAQD

SEQ ID NO: 83333 - protein, 15 aa, Mycobacterium tuberculosis
AATEAEYGEMWAQDT

SEQ ID NO: 83334 - protein, 15 aa, Mycobacterium tuberculosis
ATEAEYGEMWAQDTM

SEQ ID NO: 83335 - protein, 15 aa, Mycobacterium tuberculosis
TEAEYGEMWAQDTMA

SEQ ID NO: 83336 - protein, 15 aa, Mycobacterium tuberculosis
EAEYGEMWAQDTMAM

SEQ ID NO: 83337 - protein, 15 aa, Mycobacterium tuberculosis
AEYGEMWAQDTMAMF

SEQ ID NO: 83338 - protein, 15 aa, Mycobacterium tuberculosis
EYGEMWAQDTMAMFG

SEQ ID NO: 83339 - protein, 15 aa, Mycobacterium tuberculosis
YGEMWAQDTMAMFGY

SEQ ID NO: 83340 - protein, 15 aa, Mycobacterium tuberculosis
GEMWAQDTMAMFGYA

SEQ ID NO: 83341 - protein, 15 aa, Mycobacterium tuberculosis
EMWAQDTMAMFGYAS

SEQ ID NO: 83342 - protein, 15 aa, Mycobacterium tuberculosis
MWAQDTMAMFGYASS

SEQ ID NO: 83343 - protein, 15 aa, Mycobacterium tuberculosis
WAQDTMAMFGYASSS

SEQ ID NO: 83344 - protein, 15 aa, Mycobacterium tuberculosis
AQDTMAMFGYASSSA

SEQ ID NO: 83345 - protein, 15 aa, Mycobacterium tuberculosis
QDTMAMFGYASSSAT

SEQ ID NO: 83346 - protein, 15 aa, Mycobacterium tuberculosis
DTMAMFGYASSSATA

SEQ ID NO: 83347 - protein, 15 aa, Mycobacterium tuberculosis
TMAMFGYASSSATAS

SEQ ID NO: 83348 - protein, 15 aa, Mycobacterium tuberculosis
MAMFGYASSSATASR

SEQ ID NO: 83349 - protein, 15 aa, Mycobacterium tuberculosis
AMFGYASSSATASRL

SEQ ID NO: 83350 - protein, 15 aa, Mycobacterium tuberculosis
MFGYASSSATASRLT

SEQ ID NO: 83351 - protein, 15 aa, Mycobacterium tuberculosis
FGYASSSATASRLTP

SEQ ID NO: 83352 - protein, 15 aa, Mycobacterium tuberculosis
GYASSSATASRLTPF

SEQ ID NO: 83353 - protein, 15 aa, Mycobacterium tuberculosis
YASSSATASRLTPFT

SEQ ID NO: 83354 - protein, 15 aa, Mycobacterium tuberculosis
ASSSATASRLTPFTA

SEQ ID NO: 83355 - protein, 15 aa, Mycobacterium tuberculosis
SSSATASRLTPFTAP

SEQ ID NO: 83356 - protein, 15 aa, Mycobacterium tuberculosis
SSATASRLTPFTAPP

SEQ ID NO: 83357 - protein, 15 aa, Mycobacterium tuberculosis
SATASRLTPFTAPPQ

SEQ ID NO: 83358 - protein, 15 aa, Mycobacterium tuberculosis
ATASRLTPFTAPPQT

SEQ ID NO: 83359 - protein, 15 aa, Mycobacterium tuberculosis
TASRLTPFTAPPQTT

SEQ ID NO: 83360 - protein, 15 aa, Mycobacterium tuberculosis
ASRLTPFTAPPQTTN

SEQ ID NO: 83361 - protein, 15 aa, Mycobacterium tuberculosis
SRLTPFTAPPQTTNP

SEQ ID NO: 83362 - protein, 15 aa, Mycobacterium tuberculosis
RLTPFTAPPQTTNPS

SEQ ID NO: 83363 - protein, 15 aa, Mycobacterium tuberculosis
LTPFTAPPQTTNPSG

SEQ ID NO: 83364 - protein, 15 aa, Mycobacterium tuberculosis
TPFTAPPQTTNPSGL

SEQ ID NO: 83365 - protein, 15 aa, Mycobacterium tuberculosis
PFTAPPQTTNPSGLA

SEQ ID NO: 83366 - protein, 15 aa, Mycobacterium tuberculosis
FTAPPQTTNPSGLAG

SEQ ID NO: 83367 - protein, 15 aa, Mycobacterium tuberculosis
TAPPQTTNPSGLAGQ

SEQ ID NO: 83368 - protein, 15 aa, Mycobacterium tuberculosis
APPQTTNPSGLAGQA

SEQ ID NO: 83369 - protein, 15 aa, Mycobacterium tuberculosis
PPQTTNPSGLAGQAA

SEQ ID NO: 83370 - protein, 15 aa, Mycobacterium tuberculosis
PQTTNPSGLAGQAAA

SEQ ID NO: 83371 - protein, 15 aa, Mycobacterium tuberculosis
QTTNPSGLAGQAAAT

SEQ ID NO: 83372 - protein, 15 aa, Mycobacterium tuberculosis
TTNPSGLAGQAAATG

SEQ ID NO: 83373 - protein, 15 aa, Mycobacterium tuberculosis
TNPSGLAGQAAATGQ

SEQ ID NO: 83374 - protein, 15 aa, Mycobacterium tuberculosis
NPSGLAGQAAATGQA

SEQ ID NO: 83375 - protein, 15 aa, Mycobacterium tuberculosis
PSGLAGQAAATGQAT

SEQ ID NO: 83376 - protein, 15 aa, Mycobacterium tuberculosis
SGLAGQAAATGQATA

SEQ ID NO: 83377 - protein, 15 aa, Mycobacterium tuberculosis
GLAGQAAATGQATAL

SEQ ID NO: 83378 - protein, 15 aa, Mycobacterium tuberculosis
LAGQAAATGQATALA

SEQ ID NO: 83379 - protein, 15 aa, Mycobacterium tuberculosis
AGQAAATGQATALAS

SEQ ID NO: 83380 - protein, 15 aa, Mycobacterium tuberculosis
GQAAATGQATALASG

SEQ ID NO: 83381 - protein, 15 aa, Mycobacterium tuberculosis
QAAATGQATALASGT

SEQ ID NO: 83382 - protein, 15 aa, Mycobacterium tuberculosis
AAATGQATALASGTN

SEQ ID NO: 83383 - protein, 15 aa, Mycobacterium tuberculosis
AATGQATALASGTNA

SEQ ID NO: 83384 - protein, 15 aa, Mycobacterium tuberculosis
ATGQATALASGTNAV

SEQ ID NO: 83385 - protein, 15 aa, Mycobacterium tuberculosis
TGQATALASGTNAVT

SEQ ID NO: 83386 - protein, 15 aa, Mycobacterium tuberculosis
GQATALASGTNAVTT

SEQ ID NO: 83387 - protein, 15 aa, Mycobacterium tuberculosis
QATALASGTNAVTTA

SEQ ID NO: 83388 - protein, 15 aa, Mycobacterium tuberculosis
ATALASGTNAVTTAL

SEQ ID NO: 83389 - protein, 15 aa, Mycobacterium tuberculosis
TALASGTNAVTTALS

SEQ ID NO: 83390 - protein, 15 aa, Mycobacterium tuberculosis
ALASGTNAVTTALSS

SEQ ID NO: 83391 - protein, 15 aa, Mycobacterium tuberculosis
LASGTNAVTTALSSA

SEQ ID NO: 83392 - protein, 15 aa, Mycobacterium tuberculosis
ASGTNAVTTALSSAA

SEQ ID NO: 83393 - protein, 15 aa, Mycobacterium tuberculosis
SGTNAVTTALSSAAA

SEQ ID NO: 83394 - protein, 15 aa, Mycobacterium tuberculosis
GTNAVTTALSSAAAQ

SEQ ID NO: 83395 - protein, 15 aa, Mycobacterium tuberculosis
TNAVTTALSSAAAQF

SEQ ID NO: 83396 - protein, 15 aa, Mycobacterium tuberculosis
NAVTTALSSAAAQFP

SEQ ID NO: 83397 - protein, 15 aa, Mycobacterium tuberculosis
AVTTALSSAAAQFPF

SEQ ID NO: 83398 - protein, 15 aa, Mycobacterium tuberculosis
VTTALSSAAAQFPFD

SEQ ID NO: 83399 - protein, 15 aa, Mycobacterium tuberculosis
TTALSSAAAQFPFDI

SEQ ID NO: 83400 - protein, 15 aa, Mycobacterium tuberculosis
TALSSAAAQFPFDII

SEQ ID NO: 83401 - protein, 15 aa, Mycobacterium tuberculosis
ALSSAAAQFPFDIIP

SEQ ID NO: 83402 - protein, 15 aa, Mycobacterium tuberculosis
LSSAAAQFPFDIIPT

SEQ ID NO: 83403 - protein, 15 aa, Mycobacterium tuberculosis
SSAAAQFPFDIIPTL

SEQ ID NO: 83404 - protein, 15 aa, Mycobacterium tuberculosis
SAAAQFPFDIIPTLL

SEQ ID NO: 83405 - protein, 15 aa, Mycobacterium tuberculosis
AAAQFPFDIIPTLLQ

SEQ ID NO: 83406 - protein, 15 aa, Mycobacterium tuberculosis
AAQFPFDIIPTLLQG

SEQ ID NO: 83407 - protein, 15 aa, Mycobacterium tuberculosis
AQFPFDIIPTLLQGL

SEQ ID NO: 83408 - protein, 15 aa, Mycobacterium tuberculosis
QFPFDIIPTLLQGLA

SEQ ID NO: 83409 - protein, 15 aa, Mycobacterium tuberculosis
FPFDIIPTLLQGLAT

SEQ ID NO: 83410 - protein, 15 aa, Mycobacterium tuberculosis
PFDIIPTLLQGLATL

SEQ ID NO: 83411 - protein, 15 aa, Mycobacterium tuberculosis
FDIIPTLLQGLATLS

SEQ ID NO: 83412 - protein, 15 aa, Mycobacterium tuberculosis
DIIPTLLQGLATLST

SEQ ID NO: 83413 - protein, 15 aa, Mycobacterium tuberculosis
IIPTLLQGLATLSTQ

SEQ ID NO: 83414 - protein, 15 aa, Mycobacterium tuberculosis
IPTLLQGLATLSTQY

SEQ ID NO: 83415 - protein, 15 aa, Mycobacterium tuberculosis
PTLLQGLATLSTQYT

SEQ ID NO: 83416 - protein, 15 aa, Mycobacterium tuberculosis
TLLQGLATLSTQYTQ

SEQ ID NO: 83417 - protein, 15 aa, Mycobacterium tuberculosis
LLQGLATLSTQYTQL

SEQ ID NO: 83418 - protein, 15 aa, Mycobacterium tuberculosis
LQGLATLSTQYTQLM

SEQ ID NO: 83419 - protein, 15 aa, Mycobacterium tuberculosis
QGLATLSTQYTQLMG

SEQ ID NO: 83420 - protein, 15 aa, Mycobacterium tuberculosis
GLATLSTQYTQLMGQ

SEQ ID NO: 83421 - protein, 15 aa, Mycobacterium tuberculosis
LATLSTQYTQLMGQL

SEQ ID NO: 83422 - protein, 15 aa, Mycobacterium tuberculosis
ATLSTQYTQLMGQLI

SEQ ID NO: 83423 - protein, 15 aa, Mycobacterium tuberculosis
TLSTQYTQLMGQLIN

SEQ ID NO: 83424 - protein, 15 aa, Mycobacterium tuberculosis
LSTQYTQLMGQLINA

SEQ ID NO: 83425 - protein, 15 aa, Mycobacterium tuberculosis
STQYTQLMGQLINAI

SEQ ID NO: 83426 - protein, 15 aa, Mycobacterium tuberculosis
TQYTQLMGQLINAIF

SEQ ID NO: 83427 - protein, 15 aa, Mycobacterium tuberculosis
QYTQLMGQLINAIFG

SEQ ID NO: 83428 - protein, 15 aa, Mycobacterium tuberculosis
YTQLMGQLINAIFGP

SEQ ID NO: 83429 - protein, 15 aa, Mycobacterium tuberculosis
TQLMGQLINAIFGPT

SEQ ID NO: 83430 - protein, 15 aa, Mycobacterium tuberculosis
QLMGQLINAIFGPTG

SEQ ID NO: 83431 - protein, 15 aa, Mycobacterium tuberculosis
LMGQLINAIFGPTGA

SEQ ID NO: 83432 - protein, 15 aa, Mycobacterium tuberculosis
MGQLINAIFGPTGAT

SEQ ID NO: 83433 - protein, 15 aa, Mycobacterium tuberculosis
GQLINAIFGPTGATT

SEQ ID NO: 83434 - protein, 15 aa, Mycobacterium tuberculosis
QLINAIFGPTGATTY

SEQ ID NO: 83435 - protein, 15 aa, Mycobacterium tuberculosis
LINAIFGPTGATTYQ

SEQ ID NO: 83436 - protein, 15 aa, Mycobacterium tuberculosis
INAIFGPTGATTYQN

SEQ ID NO: 83437 - protein, 15 aa, Mycobacterium tuberculosis
NAIFGPTGATTYQNV

SEQ ID NO: 83438 - protein, 15 aa, Mycobacterium tuberculosis
AIFGPTGATTYQNVF

SEQ ID NO: 83439 - protein, 15 aa, Mycobacterium tuberculosis
IFGPTGATTYQNVFV

SEQ ID NO: 83440 - protein, 15 aa, Mycobacterium tuberculosis
FGPTGATTYQNVFVT

SEQ ID NO: 83441 - protein, 15 aa, Mycobacterium tuberculosis
GPTGATTYQNVFVTA

SEQ ID NO: 83442 - protein, 15 aa, Mycobacterium tuberculosis
PTGATTYQNVFVTAA

SEQ ID NO: 83443 - protein, 15 aa, Mycobacterium tuberculosis
TGATTYQNVFVTAAN

SEQ ID NO: 83444 - protein, 15 aa, Mycobacterium tuberculosis
GATTYQNVFVTAANV

SEQ ID NO: 83445 - protein, 15 aa, Mycobacterium tuberculosis
ATTYQNVFVTAANVT

SEQ ID NO: 83446 - protein, 15 aa, Mycobacterium tuberculosis
TTYQNVFVTAANVTK

SEQ ID NO: 83447 - protein, 15 aa, Mycobacterium tuberculosis
TYQNVFVTAANVTKF

SEQ ID NO: 83448 - protein, 15 aa, Mycobacterium tuberculosis
YQNVFVTAANVTKFS

SEQ ID NO: 83449 - protein, 15 aa, Mycobacterium tuberculosis
QNVFVTAANVTKFST

SEQ ID NO: 83450 - protein, 15 aa, Mycobacterium tuberculosis
NVFVTAANVTKFSTW

SEQ ID NO: 83451 - protein, 15 aa, Mycobacterium tuberculosis
VFVTAANVTKFSTWA

SEQ ID NO: 83452 - protein, 15 aa, Mycobacterium tuberculosis
FVTAANVTKFSTWAN

SEQ ID NO: 83453 - protein, 15 aa, Mycobacterium tuberculosis
VTAANVTKFSTWAND

SEQ ID NO: 83454 - protein, 15 aa, Mycobacterium tuberculosis
TAANVTKFSTWANDA

SEQ ID NO: 83455 - protein, 15 aa, Mycobacterium tuberculosis
AANVTKFSTWANDAM

SEQ ID NO: 83456 - protein, 15 aa, Mycobacterium tuberculosis
ANVTKFSTWANDAMS

SEQ ID NO: 83457 - protein, 15 aa, Mycobacterium tuberculosis
NVTKFSTWANDAMSA

SEQ ID NO: 83458 - protein, 15 aa, Mycobacterium tuberculosis
VTKFSTWANDAMSAP

SEQ ID NO: 83459 - protein, 15 aa, Mycobacterium tuberculosis
TKFSTWANDAMSAPN

SEQ ID NO: 83460 - protein, 15 aa, Mycobacterium tuberculosis
KFSTWANDAMSAPNL

SEQ ID NO: 83461 - protein, 15 aa, Mycobacterium tuberculosis
FSTWANDAMSAPNLG

SEQ ID NO: 83462 - protein, 15 aa, Mycobacterium tuberculosis
STWANDAMSAPNLGM

SEQ ID NO: 83463 - protein, 15 aa, Mycobacterium tuberculosis
TWANDAMSAPNLGMT

SEQ ID NO: 83464 - protein, 15 aa, Mycobacterium tuberculosis
WANDAMSAPNLGMTE

SEQ ID NO: 83465 - protein, 15 aa, Mycobacterium tuberculosis
ANDAMSAPNLGMTEF

SEQ ID NO: 83466 - protein, 15 aa, Mycobacterium tuberculosis
NDAMSAPNLGMTEFK

SEQ ID NO: 83467 - protein, 15 aa, Mycobacterium tuberculosis
DAMSAPNLGMTEFKV

SEQ ID NO: 83468 - protein, 15 aa, Mycobacterium tuberculosis
AMSAPNLGMTEFKVF

SEQ ID NO: 83469 - protein, 15 aa, Mycobacterium tuberculosis
MSAPNLGMTEFKVFW

SEQ ID NO: 83470 - protein, 15 aa, Mycobacterium tuberculosis
SAPNLGMTEFKVFWQ

SEQ ID NO: 83471 - protein, 15 aa, Mycobacterium tuberculosis
APNLGMTEFKVFWQP

SEQ ID NO: 83472 - protein, 15 aa, Mycobacterium tuberculosis
PNLGMTEFKVFWQPP

SEQ ID NO: 83473 - protein, 15 aa, Mycobacterium tuberculosis
NLGMTEFKVFWQPPP

SEQ ID NO: 83474 - protein, 15 aa, Mycobacterium tuberculosis
LGMTEFKVFWQPPPA

SEQ ID NO: 83475 - protein, 15 aa, Mycobacterium tuberculosis
GMTEFKVFWQPPPAP

SEQ ID NO: 83476 - protein, 15 aa, Mycobacterium tuberculosis
MTEFKVFWQPPPAPE

SEQ ID NO: 83477 - protein, 15 aa, Mycobacterium tuberculosis
TEFKVFWQPPPAPEI

SEQ ID NO: 83478 - protein, 15 aa, Mycobacterium tuberculosis
EFKVFWQPPPAPEIP

SEQ ID NO: 83479 - protein, 15 aa, Mycobacterium tuberculosis
FKVFWQPPPAPEIPK

SEQ ID NO: 83480 - protein, 15 aa, Mycobacterium tuberculosis
KVFWQPPPAPEIPKS

SEQ ID NO: 83481 - protein, 15 aa, Mycobacterium tuberculosis
VFWQPPPAPEIPKSS

SEQ ID NO: 83482 - protein, 15 aa, Mycobacterium tuberculosis
FWQPPPAPEIPKSSL

SEQ ID NO: 83483 - protein, 15 aa, Mycobacterium tuberculosis
WQPPPAPEIPKSSLG

SEQ ID NO: 83484 - protein, 15 aa, Mycobacterium tuberculosis
QPPPAPEIPKSSLGA

SEQ ID NO: 83485 - protein, 15 aa, Mycobacterium tuberculosis
PPPAPEIPKSSLGAG

SEQ ID NO: 83486 - protein, 15 aa, Mycobacterium tuberculosis
PPAPEIPKSSLGAGL

SEQ ID NO: 83487 - protein, 15 aa, Mycobacterium tuberculosis
PAPEIPKSSLGAGLG

SEQ ID NO: 83488 - protein, 15 aa, Mycobacterium tuberculosis
APEIPKSSLGAGLGL

SEQ ID NO: 83489 - protein, 15 aa, Mycobacterium tuberculosis
PEIPKSSLGAGLGLR

SEQ ID NO: 83490 - protein, 15 aa, Mycobacterium tuberculosis
EIPKSSLGAGLGLRS

SEQ ID NO: 83491 - protein, 15 aa, Mycobacterium tuberculosis
IPKSSLGAGLGLRSG

SEQ ID NO: 83492 - protein, 15 aa, Mycobacterium tuberculosis
PKSSLGAGLGLRSGL

SEQ ID NO: 83493 - protein, 15 aa, Mycobacterium tuberculosis
KSSLGAGLGLRSGLS

SEQ ID NO: 83494 - protein, 15 aa, Mycobacterium tuberculosis
SSLGAGLGLRSGLSA

SEQ ID NO: 83495 - protein, 15 aa, Mycobacterium tuberculosis
SLGAGLGLRSGLSAG

SEQ ID NO: 83496 - protein, 15 aa, Mycobacterium tuberculosis
LGAGLGLRSGLSAGL

SEQ ID NO: 83497 - protein, 15 aa, Mycobacterium tuberculosis
GAGLGLRSGLSAGLA

SEQ ID NO: 83498 - protein, 15 aa, Mycobacterium tuberculosis
AGLGLRSGLSAGLAH

SEQ ID NO: 83499 - protein, 15 aa, Mycobacterium tuberculosis
GLGLRSGLSAGLAHA

SEQ ID NO: 83500 - protein, 15 aa, Mycobacterium tuberculosis
LGLRSGLSAGLAHAA

SEQ ID NO: 83501 - protein, 15 aa, Mycobacterium tuberculosis
GLRSGLSAGLAHAAS

SEQ ID NO: 83502 - protein, 15 aa, Mycobacterium tuberculosis
LRSGLSAGLAHAASA

SEQ ID NO: 83503 - protein, 15 aa, Mycobacterium tuberculosis
RSGLSAGLAHAASAG

SEQ ID NO: 83504 - protein, 15 aa, Mycobacterium tuberculosis
SGLSAGLAHAASAGL

SEQ ID NO: 83505 - protein, 15 aa, Mycobacterium tuberculosis
GLSAGLAHAASAGLG

SEQ ID NO: 83506 - protein, 15 aa, Mycobacterium tuberculosis
LSAGLAHAASAGLGQ

SEQ ID NO: 83507 - protein, 15 aa, Mycobacterium tuberculosis
SAGLAHAASAGLGQA

SEQ ID NO: 83508 - protein, 15 aa, Mycobacterium tuberculosis
AGLAHAASAGLGQAN

SEQ ID NO: 83509 - protein, 15 aa, Mycobacterium tuberculosis
GLAHAASAGLGQANL

SEQ ID NO: 83510 - protein, 15 aa, Mycobacterium tuberculosis
LAHAASAGLGQANLV

SEQ ID NO: 83511 - protein, 15 aa, Mycobacterium tuberculosis
AHAASAGLGQANLVG

SEQ ID NO: 83512 - protein, 15 aa, Mycobacterium tuberculosis
HAASAGLGQANLVGD

SEQ ID NO: 83513 - protein, 15 aa, Mycobacterium tuberculosis
AASAGLGQANLVGDL

SEQ ID NO: 83514 - protein, 15 aa, Mycobacterium tuberculosis
ASAGLGQANLVGDLS

SEQ ID NO: 83515 - protein, 15 aa, Mycobacterium tuberculosis
SAGLGQANLVGDLSV

SEQ ID NO: 83516 - protein, 15 aa, Mycobacterium tuberculosis
AGLGQANLVGDLSVP

SEQ ID NO: 83517 - protein, 15 aa, Mycobacterium tuberculosis
GLGQANLVGDLSVPP

SEQ ID NO: 83518 - protein, 15 aa, Mycobacterium tuberculosis
LGQANLVGDLSVPPS

SEQ ID NO: 83519 - protein, 15 aa, Mycobacterium tuberculosis
GQANLVGDLSVPPSW

SEQ ID NO: 83520 - protein, 15 aa, Mycobacterium tuberculosis
QANLVGDLSVPPSWA

SEQ ID NO: 83521 - protein, 15 aa, Mycobacterium tuberculosis
ANLVGDLSVPPSWAS

SEQ ID NO: 83522 - protein, 15 aa, Mycobacterium tuberculosis
NLVGDLSVPPSWASA

SEQ ID NO: 83523 - protein, 15 aa, Mycobacterium tuberculosis
LVGDLSVPPSWASAT

SEQ ID NO: 83524 - protein, 15 aa, Mycobacterium tuberculosis
VGDLSVPPSWASATP

SEQ ID NO: 83525 - protein, 15 aa, Mycobacterium tuberculosis
GDLSVPPSWASATPA

SEQ ID NO: 83526 - protein, 15 aa, Mycobacterium tuberculosis
DLSVPPSWASATPAV

SEQ ID NO: 83527 - protein, 15 aa, Mycobacterium tuberculosis
LSVPPSWASATPAVR

SEQ ID NO: 83528 - protein, 15 aa, Mycobacterium tuberculosis
SVPPSWASATPAVRL

SEQ ID NO: 83529 - protein, 15 aa, Mycobacterium tuberculosis
VPPSWASATPAVRLV

SEQ ID NO: 83530 - protein, 15 aa, Mycobacterium tuberculosis
PPSWASATPAVRLVA

SEQ ID NO: 83531 - protein, 15 aa, Mycobacterium tuberculosis
PSWASATPAVRLVAN

SEQ ID NO: 83532 - protein, 15 aa, Mycobacterium tuberculosis
SWASATPAVRLVANT

SEQ ID NO: 83533 - protein, 15 aa, Mycobacterium tuberculosis
WASATPAVRLVANTL

SEQ ID NO: 83534 - protein, 15 aa, Mycobacterium tuberculosis
ASATPAVRLVANTLP

SEQ ID NO: 83535 - protein, 15 aa, Mycobacterium tuberculosis
SATPAVRLVANTLPA

SEQ ID NO: 83536 - protein, 15 aa, Mycobacterium tuberculosis
ATPAVRLVANTLPAT

SEQ ID NO: 83537 - protein, 15 aa, Mycobacterium tuberculosis
TPAVRLVANTLPATS

SEQ ID NO: 83538 - protein, 15 aa, Mycobacterium tuberculosis
PAVRLVANTLPATSL

SEQ ID NO: 83539 - protein, 15 aa, Mycobacterium tuberculosis
AVRLVANTLPATSLA

SEQ ID NO: 83540 - protein, 15 aa, Mycobacterium tuberculosis
VRLVANTLPATSLAA

SEQ ID NO: 83541 - protein, 15 aa, Mycobacterium tuberculosis
RLVANTLPATSLAAA

SEQ ID NO: 83542 - protein, 15 aa, Mycobacterium tuberculosis
LVANTLPATSLAAAP

SEQ ID NO: 83543 - protein, 15 aa, Mycobacterium tuberculosis
VANTLPATSLAAAPA

SEQ ID NO: 83544 - protein, 15 aa, Mycobacterium tuberculosis
ANTLPATSLAAAPAT

SEQ ID NO: 83545 - protein, 15 aa, Mycobacterium tuberculosis
NTLPATSLAAAPATQ

SEQ ID NO: 83546 - protein, 15 aa, Mycobacterium tuberculosis
TLPATSLAAAPATQI

SEQ ID NO: 83547 - protein, 15 aa, Mycobacterium tuberculosis
LPATSLAAAPATQIP

SEQ ID NO: 83548 - protein, 15 aa, Mycobacterium tuberculosis
PATSLAAAPATQIPA

SEQ ID NO: 83549 - protein, 15 aa, Mycobacterium tuberculosis
ATSLAAAPATQIPAN

SEQ ID NO: 83550 - protein, 15 aa, Mycobacterium tuberculosis
TSLAAAPATQIPANL

SEQ ID NO: 83551 - protein, 15 aa, Mycobacterium tuberculosis
SLAAAPATQIPANLL

SEQ ID NO: 83552 - protein, 15 aa, Mycobacterium tuberculosis
LAAAPATQIPANLLG

SEQ ID NO: 83553 - protein, 15 aa, Mycobacterium tuberculosis
AAAPATQIPANLLGQ

SEQ ID NO: 83554 - protein, 15 aa, Mycobacterium tuberculosis
AAPATQIPANLLGQM

SEQ ID NO: 83555 - protein, 15 aa, Mycobacterium tuberculosis
APATQIPANLLGQMA

SEQ ID NO: 83556 - protein, 15 aa, Mycobacterium tuberculosis
PATQIPANLLGQMAL

SEQ ID NO: 83557 - protein, 15 aa, Mycobacterium tuberculosis
ATQIPANLLGQMALG

SEQ ID NO: 83558 - protein, 15 aa, Mycobacterium tuberculosis
TQIPANLLGQMALGS

SEQ ID NO: 83559 - protein, 15 aa, Mycobacterium tuberculosis
QIPANLLGQMALGSM

SEQ ID NO: 83560 - protein, 15 aa, Mycobacterium tuberculosis
IPANLLGQMALGSMT

SEQ ID NO: 83561 - protein, 15 aa, Mycobacterium tuberculosis
PANLLGQMALGSMTG

SEQ ID NO: 83562 - protein, 15 aa, Mycobacterium tuberculosis
ANLLGQMALGSMTGG

SEQ ID NO: 83563 - protein, 15 aa, Mycobacterium tuberculosis
NLLGQMALGSMTGGA

SEQ ID NO: 83564 - protein, 15 aa, Mycobacterium tuberculosis
LLGQMALGSMTGGAL

SEQ ID NO: 83565 - protein, 15 aa, Mycobacterium tuberculosis
LGQMALGSMTGGALG

SEQ ID NO: 83566 - protein, 15 aa, Mycobacterium tuberculosis
GQMALGSMTGGALGA

SEQ ID NO: 83567 - protein, 15 aa, Mycobacterium tuberculosis
QMALGSMTGGALGAA

SEQ ID NO: 83568 - protein, 15 aa, Mycobacterium tuberculosis
MALGSMTGGALGAAA

SEQ ID NO: 83569 - protein, 15 aa, Mycobacterium tuberculosis
ALGSMTGGALGAAAP

SEQ ID NO: 83570 - protein, 15 aa, Mycobacterium tuberculosis
LGSMTGGALGAAAPA

SEQ ID NO: 83571 - protein, 15 aa, Mycobacterium tuberculosis
GSMTGGALGAAAPAI

SEQ ID NO: 83572 - protein, 15 aa, Mycobacterium tuberculosis
SMTGGALGAAAPAIY

SEQ ID NO: 83573 - protein, 15 aa, Mycobacterium tuberculosis
MTGGALGAAAPAIYT

SEQ ID NO: 83574 - protein, 15 aa, Mycobacterium tuberculosis
TGGALGAAAPAIYTG

SEQ ID NO: 83575 - protein, 15 aa, Mycobacterium tuberculosis
GGALGAAAPAIYTGS

SEQ ID NO: 83576 - protein, 15 aa, Mycobacterium tuberculosis
GALGAAAPAIYTGSG

SEQ ID NO: 83577 - protein, 15 aa, Mycobacterium tuberculosis
ALGAAAPAIYTGSGA

SEQ ID NO: 83578 - protein, 15 aa, Mycobacterium tuberculosis
LGAAAPAIYTGSGAR

SEQ ID NO: 83579 - protein, 15 aa, Mycobacterium tuberculosis
GAAAPAIYTGSGARA

SEQ ID NO: 83580 - protein, 15 aa, Mycobacterium tuberculosis
AAAPAIYTGSGARAR

SEQ ID NO: 83581 - protein, 15 aa, Mycobacterium tuberculosis
AAPAIYTGSGARARA

SEQ ID NO: 83582 - protein, 15 aa, Mycobacterium tuberculosis
APAIYTGSGARARAN

SEQ ID NO: 83583 - protein, 15 aa, Mycobacterium tuberculosis
PAIYTGSGARARANG

SEQ ID NO: 83584 - protein, 15 aa, Mycobacterium tuberculosis
AIYTGSGARARANGG

SEQ ID NO: 83585 - protein, 15 aa, Mycobacterium tuberculosis
IYTGSGARARANGGT

SEQ ID NO: 83586 - protein, 15 aa, Mycobacterium tuberculosis
YTGSGARARANGGTP

SEQ ID NO: 83587 - protein, 15 aa, Mycobacterium tuberculosis
TGSGARARANGGTPS

SEQ ID NO: 83588 - protein, 15 aa, Mycobacterium tuberculosis
GSGARARANGGTPSA

SEQ ID NO: 83589 - protein, 15 aa, Mycobacterium tuberculosis
SGARARANGGTPSAE

SEQ ID NO: 83590 - protein, 15 aa, Mycobacterium tuberculosis
GARARANGGTPSAEP

SEQ ID NO: 83591 - protein, 15 aa, Mycobacterium tuberculosis
ARARANGGTPSAEPV

SEQ ID NO: 83592 - protein, 15 aa, Mycobacterium tuberculosis
RARANGGTPSAEPVK

SEQ ID NO: 83593 - protein, 15 aa, Mycobacterium tuberculosis
ARANGGTPSAEPVKL

SEQ ID NO: 83594 - protein, 15 aa, Mycobacterium tuberculosis
RANGGTPSAEPVKLE

SEQ ID NO: 83595 - protein, 15 aa, Mycobacterium tuberculosis
ANGGTPSAEPVKLEA

SEQ ID NO: 83596 - protein, 15 aa, Mycobacterium tuberculosis
NGGTPSAEPVKLEAV

SEQ ID NO: 83597 - protein, 15 aa, Mycobacterium tuberculosis
GGTPSAEPVKLEAVI

SEQ ID NO: 83598 - protein, 15 aa, Mycobacterium tuberculosis
GTPSAEPVKLEAVIA

SEQ ID NO: 83599 - protein, 15 aa, Mycobacterium tuberculosis
TPSAEPVKLEAVIAQ

SEQ ID NO: 83600 - protein, 15 aa, Mycobacterium tuberculosis
PSAEPVKLEAVIAQL

SEQ ID NO: 83601 - protein, 15 aa, Mycobacterium tuberculosis
SAEPVKLEAVIAQLQ

SEQ ID NO: 83602 - protein, 15 aa, Mycobacterium tuberculosis
AEPVKLEAVIAQLQK

SEQ ID NO: 83603 - protein, 15 aa, Mycobacterium tuberculosis
EPVKLEAVIAQLQKQ

SEQ ID NO: 83604 - protein, 15 aa, Mycobacterium tuberculosis
PVKLEAVIAQLQKQP

SEQ ID NO: 83605 - protein, 15 aa, Mycobacterium tuberculosis
VKLEAVIAQLQKQPD

SEQ ID NO: 83606 - protein, 15 aa, Mycobacterium tuberculosis
KLEAVIAQLQKQPDA

SEQ ID NO: 83607 - protein, 15 aa, Mycobacterium tuberculosis
LEAVIAQLQKQPDAV

SEQ ID NO: 83608 - protein, 15 aa, Mycobacterium tuberculosis
EAVIAQLQKQPDAVR

SEQ ID NO: 83609 - protein, 15 aa, Mycobacterium tuberculosis
AVIAQLQKQPDAVRH

SEQ ID NO: 83610 - protein, 15 aa, Mycobacterium tuberculosis
VIAQLQKQPDAVRHW

SEQ ID NO: 83611 - protein, 15 aa, Mycobacterium tuberculosis
IAQLQKQPDAVRHWN

SEQ ID NO: 83612 - protein, 15 aa, Mycobacterium tuberculosis
AQLQKQPDAVRHWNV

SEQ ID NO: 83613 - protein, 15 aa, Mycobacterium tuberculosis
QLQKQPDAVRHWNVD

SEQ ID NO: 83614 - protein, 15 aa, Mycobacterium tuberculosis
LQKQPDAVRHWNVDK

SEQ ID NO: 83615 - protein, 15 aa, Mycobacterium tuberculosis
QKQPDAVRHWNVDKA

SEQ ID NO: 83616 - protein, 15 aa, Mycobacterium tuberculosis
KQPDAVRHWNVDKAD

SEQ ID NO: 83617 - protein, 15 aa, Mycobacterium tuberculosis
QPDAVRHWNVDKADL

SEQ ID NO: 83618 - protein, 15 aa, Mycobacterium tuberculosis
PDAVRHWNVDKADLD

SEQ ID NO: 83619 - protein, 15 aa, Mycobacterium tuberculosis
DAVRHWNVDKADLDG

SEQ ID NO: 83620 - protein, 15 aa, Mycobacterium tuberculosis
AVRHWNVDKADLDGL

SEQ ID NO: 83621 - protein, 15 aa, Mycobacterium tuberculosis
VRHWNVDKADLDGLL

SEQ ID NO: 83622 - protein, 15 aa, Mycobacterium tuberculosis
RHWNVDKADLDGLLD

SEQ ID NO: 83623 - protein, 15 aa, Mycobacterium tuberculosis
HWNVDKADLDGLLDR

SEQ ID NO: 83624 - protein, 15 aa, Mycobacterium tuberculosis
WNVDKADLDGLLDRL

SEQ ID NO: 83625 - protein, 15 aa, Mycobacterium tuberculosis
NVDKADLDGLLDRLS

SEQ ID NO: 83626 - protein, 15 aa, Mycobacterium tuberculosis
VDKADLDGLLDRLSK

SEQ ID NO: 83627 - protein, 15 aa, Mycobacterium tuberculosis
DKADLDGLLDRLSKQ

SEQ ID NO: 83628 - protein, 15 aa, Mycobacterium tuberculosis
KADLDGLLDRLSKQP

SEQ ID NO: 83629 - protein, 15 aa, Mycobacterium tuberculosis
ADLDGLLDRLSKQPG

SEQ ID NO: 83630 - protein, 15 aa, Mycobacterium tuberculosis
DLDGLLDRLSKQPGI

SEQ ID NO: 83631 - protein, 15 aa, Mycobacterium tuberculosis
LDGLLDRLSKQPGIH

SEQ ID NO: 83632 - protein, 15 aa, Mycobacterium tuberculosis
DGLLDRLSKQPGIHA

SEQ ID NO: 83633 - protein, 15 aa, Mycobacterium tuberculosis
GLLDRLSKQPGIHAV

SEQ ID NO: 83634 - protein, 15 aa, Mycobacterium tuberculosis
LLDRLSKQPGIHAVH

SEQ ID NO: 83635 - protein, 15 aa, Mycobacterium tuberculosis
LDRLSKQPGIHAVHV

SEQ ID NO: 83636 - protein, 15 aa, Mycobacterium tuberculosis
DRLSKQPGIHAVHVS

SEQ ID NO: 83637 - protein, 15 aa, Mycobacterium tuberculosis
RLSKQPGIHAVHVSN

SEQ ID NO: 83638 - protein, 15 aa, Mycobacterium tuberculosis
LSKQPGIHAVHVSNG

SEQ ID NO: 83639 - protein, 15 aa, Mycobacterium tuberculosis
SKQPGIHAVHVSNGD

SEQ ID NO: 83640 - protein, 15 aa, Mycobacterium tuberculosis
KQPGIHAVHVSNGDK

SEQ ID NO: 83641 - protein, 15 aa, Mycobacterium tuberculosis
QPGIHAVHVSNGDKP

SEQ ID NO: 83642 - protein, 15 aa, Mycobacterium tuberculosis
PGIHAVHVSNGDKPK

SEQ ID NO: 83643 - protein, 15 aa, Mycobacterium tuberculosis
GIHAVHVSNGDKPKV

SEQ ID NO: 83644 - protein, 15 aa, Mycobacterium tuberculosis
IHAVHVSNGDKPKVA

SEQ ID NO: 83645 - protein, 15 aa, Mycobacterium tuberculosis
HAVHVSNGDKPKVAL

SEQ ID NO: 83646 - protein, 15 aa, Mycobacterium tuberculosis
AVHVSNGDKPKVALP

SEQ ID NO: 83647 - protein, 15 aa, Mycobacterium tuberculosis
VHVSNGDKPKVALPD

SEQ ID NO: 83648 - protein, 15 aa, Mycobacterium tuberculosis
HVSNGDKPKVALPDT

SEQ ID NO: 83649 - protein, 15 aa, Mycobacterium tuberculosis
VSNGDKPKVALPDTQ

SEQ ID NO: 83650 - protein, 15 aa, Mycobacterium tuberculosis
SNGDKPKVALPDTQL

SEQ ID NO: 83651 - protein, 15 aa, Mycobacterium tuberculosis
NGDKPKVALPDTQLG

SEQ ID NO: 83652 - protein, 15 aa, Mycobacterium tuberculosis
GDKPKVALPDTQLGS

SEQ ID NO: 83653 - protein, 15 aa, Mycobacterium tuberculosis
DKPKVALPDTQLGSH

SEQ ID NO: 83654 - protein, 16 aa, Mycobacterium tuberculosis
MDFGLQPPEITSGEMY

SEQ ID NO: 83655 - protein, 16 aa, Mycobacterium tuberculosis
DFGLQPPEITSGEMYL

SEQ ID NO: 83656 - protein, 16 aa, Mycobacterium tuberculosis
FGLQPPEITSGEMYLG

SEQ ID NO: 83657 - protein, 16 aa, Mycobacterium tuberculosis
GLQPPEITSGEMYLGP

SEQ ID NO: 83658 - protein, 16 aa, Mycobacterium tuberculosis
LQPPEITSGEMYLGPG

SEQ ID NO: 83659 - protein, 16 aa, Mycobacterium tuberculosis
QPPEITSGEMYLGPGA

SEQ ID NO: 83660 - protein, 16 aa, Mycobacterium tuberculosis
PPEITSGEMYLGPGAG

SEQ ID NO: 83661 - protein, 16 aa, Mycobacterium tuberculosis
PEITSGEMYLGPGAGP

SEQ ID NO: 83662 - protein, 16 aa, Mycobacterium tuberculosis
EITSGEMYLGPGAGPM

SEQ ID NO: 83663 - protein, 16 aa, Mycobacterium tuberculosis
ITSGEMYLGPGAGPML

SEQ ID NO: 83664 - protein, 16 aa, Mycobacterium tuberculosis
TSGEMYLGPGAGPMLA

SEQ ID NO: 83665 - protein, 16 aa, Mycobacterium tuberculosis
SGEMYLGPGAGPMLAA

SEQ ID NO: 83666 - protein, 16 aa, Mycobacterium tuberculosis
GEMYLGPGAGPMLAAA

SEQ ID NO: 83667 - protein, 16 aa, Mycobacterium tuberculosis
EMYLGPGAGPMLAAAV

SEQ ID NO: 83668 - protein, 16 aa, Mycobacterium tuberculosis
MYLGPGAGPMLAAAVA

SEQ ID NO: 83669 - protein, 16 aa, Mycobacterium tuberculosis
YLGPGAGPMLAAAVAW

SEQ ID NO: 83670 - protein, 16 aa, Mycobacterium tuberculosis
LGPGAGPMLAAAVAWD

SEQ ID NO: 83671 - protein, 16 aa, Mycobacterium tuberculosis
GPGAGPMLAAAVAWDG

SEQ ID NO: 83672 - protein, 16 aa, Mycobacterium tuberculosis
PGAGPMLAAAVAWDGL

SEQ ID NO: 83673 - protein, 16 aa, Mycobacterium tuberculosis
GAGPMLAAAVAWDGLA

SEQ ID NO: 83674 - protein, 16 aa, Mycobacterium tuberculosis
AGPMLAAAVAWDGLAA

SEQ ID NO: 83675 - protein, 16 aa, Mycobacterium tuberculosis
GPMLAAAVAWDGLAAE

SEQ ID NO: 83676 - protein, 16 aa, Mycobacterium tuberculosis
PMLAAAVAWDGLAAEL

SEQ ID NO: 83677 - protein, 16 aa, Mycobacterium tuberculosis
MLAAAVAWDGLAAELQ

SEQ ID NO: 83678 - protein, 16 aa, Mycobacterium tuberculosis
LAAAVAWDGLAAELQS

SEQ ID NO: 83679 - protein, 16 aa, Mycobacterium tuberculosis
AAAVAWDGLAAELQSM

SEQ ID NO: 83680 - protein, 16 aa, Mycobacterium tuberculosis
AAVAWDGLAAELQSMA

SEQ ID NO: 83681 - protein, 16 aa, Mycobacterium tuberculosis
AVAWDGLAAELQSMAA

SEQ ID NO: 83682 - protein, 16 aa, Mycobacterium tuberculosis
VAWDGLAAELQSMAAS

SEQ ID NO: 83683 - protein, 16 aa, Mycobacterium tuberculosis
AWDGLAAELQSMAASY

SEQ ID NO: 83684 - protein, 16 aa, Mycobacterium tuberculosis
WDGLAAELQSMAASYA

SEQ ID NO: 83685 - protein, 16 aa, Mycobacterium tuberculosis
DGLAAELQSMAASYAS

SEQ ID NO: 83686 - protein, 16 aa, Mycobacterium tuberculosis
GLAAELQSMAASYASI

SEQ ID NO: 83687 - protein, 16 aa, Mycobacterium tuberculosis
LAAELQSMAASYASIV

SEQ ID NO: 83688 - protein, 16 aa, Mycobacterium tuberculosis
AAELQSMAASYASIVE

SEQ ID NO: 83689 - protein, 16 aa, Mycobacterium tuberculosis
AELQSMAASYASIVEG

SEQ ID NO: 83690 - protein, 16 aa, Mycobacterium tuberculosis
ELQSMAASYASIVEGM

SEQ ID NO: 83691 - protein, 16 aa, Mycobacterium tuberculosis
LQSMAASYASIVEGMA

SEQ ID NO: 83692 - protein, 16 aa, Mycobacterium tuberculosis
QSMAASYASIVEGMAS

SEQ ID NO: 83693 - protein, 16 aa, Mycobacterium tuberculosis
SMAASYASIVEGMASE

SEQ ID NO: 83694 - protein, 16 aa, Mycobacterium tuberculosis
MAASYASIVEGMASES

SEQ ID NO: 83695 - protein, 16 aa, Mycobacterium tuberculosis
AASYASIVEGMASESW

SEQ ID NO: 83696 - protein, 16 aa, Mycobacterium tuberculosis
ASYASIVEGMASESWL

SEQ ID NO: 83697 - protein, 16 aa, Mycobacterium tuberculosis
SYASIVEGMASESWLG

SEQ ID NO: 83698 - protein, 16 aa, Mycobacterium tuberculosis
YASIVEGMASESWLGP

SEQ ID NO: 83699 - protein, 16 aa, Mycobacterium tuberculosis
ASIVEGMASESWLGPS

SEQ ID NO: 83700 - protein, 16 aa, Mycobacterium tuberculosis
SIVEGMASESWLGPSS

SEQ ID NO: 83701 - protein, 16 aa, Mycobacterium tuberculosis
IVEGMASESWLGPSSA

SEQ ID NO: 83702 - protein, 16 aa, Mycobacterium tuberculosis
VEGMASESWLGPSSAG

SEQ ID NO: 83703 - protein, 16 aa, Mycobacterium tuberculosis
EGMASESWLGPSSAGM

SEQ ID NO: 83704 - protein, 16 aa, Mycobacterium tuberculosis
GMASESWLGPSSAGMA

SEQ ID NO: 83705 - protein, 16 aa, Mycobacterium tuberculosis
MASESWLGPSSAGMAA

SEQ ID NO: 83706 - protein, 16 aa, Mycobacterium tuberculosis
ASESWLGPSSAGMAAA

SEQ ID NO: 83707 - protein, 16 aa, Mycobacterium tuberculosis
SESWLGPSSAGMAAAA

SEQ ID NO: 83708 - protein, 16 aa, Mycobacterium tuberculosis
ESWLGPSSAGMAAAAA

SEQ ID NO: 83709 - protein, 16 aa, Mycobacterium tuberculosis
SWLGPSSAGMAAAAAP

SEQ ID NO: 83710 - protein, 16 aa, Mycobacterium tuberculosis
WLGPSSAGMAAAAAPY

SEQ ID NO: 83711 - protein, 16 aa, Mycobacterium tuberculosis
LGPSSAGMAAAAAPYV

SEQ ID NO: 83712 - protein, 16 aa, Mycobacterium tuberculosis
GPSSAGMAAAAAPYVT

SEQ ID NO: 83713 - protein, 16 aa, Mycobacterium tuberculosis
PSSAGMAAAAAPYVTW

SEQ ID NO: 83714 - protein, 16 aa, Mycobacterium tuberculosis
SSAGMAAAAAPYVTWM

SEQ ID NO: 83715 - protein, 16 aa, Mycobacterium tuberculosis
SAGMAAAAAPYVTWMS

SEQ ID NO: 83716 - protein, 16 aa, Mycobacterium tuberculosis
AGMAAAAAPYVTWMSG

SEQ ID NO: 83717 - protein, 16 aa, Mycobacterium tuberculosis
GMAAAAAPYVTWMSGT

SEQ ID NO: 83718 - protein, 16 aa, Mycobacterium tuberculosis
MAAAAAPYVTWMSGTS

SEQ ID NO: 83719 - protein, 16 aa, Mycobacterium tuberculosis
AAAAAPYVTWMSGTSA

SEQ ID NO: 83720 - protein, 16 aa, Mycobacterium tuberculosis
AAAAPYVTWMSGTSAQ

SEQ ID NO: 83721 - protein, 16 aa, Mycobacterium tuberculosis
AAAPYVTWMSGTSAQA

SEQ ID NO: 83722 - protein, 16 aa, Mycobacterium tuberculosis
AAPYVTWMSGTSAQAK

SEQ ID NO: 83723 - protein, 16 aa, Mycobacterium tuberculosis
APYVTWMSGTSAQAKA

SEQ ID NO: 83724 - protein, 16 aa, Mycobacterium tuberculosis
PYVTWMSGTSAQAKAA

SEQ ID NO: 83725 - protein, 16 aa, Mycobacterium tuberculosis
YVTWMSGTSAQAKAAA

SEQ ID NO: 83726 - protein, 16 aa, Mycobacterium tuberculosis
VTWMSGTSAQAKAAAD

SEQ ID NO: 83727 - protein, 16 aa, Mycobacterium tuberculosis
TWMSGTSAQAKAAADQ

SEQ ID NO: 83728 - protein, 16 aa, Mycobacterium tuberculosis
WMSGTSAQAKAAADQA

SEQ ID NO: 83729 - protein, 16 aa, Mycobacterium tuberculosis
MSGTSAQAKAAADQAR

SEQ ID NO: 83730 - protein, 16 aa, Mycobacterium tuberculosis
SGTSAQAKAAADQARA

SEQ ID NO: 83731 - protein, 16 aa, Mycobacterium tuberculosis
GTSAQAKAAADQARAA

SEQ ID NO: 83732 - protein, 16 aa, Mycobacterium tuberculosis
TSAQAKAAADQARAAV

SEQ ID NO: 83733 - protein, 16 aa, Mycobacterium tuberculosis
SAQAKAAADQARAAVV

SEQ ID NO: 83734 - protein, 16 aa, Mycobacterium tuberculosis
AQAKAAADQARAAVVA

SEQ ID NO: 83735 - protein, 16 aa, Mycobacterium tuberculosis
QAKAAADQARAAVVAY

SEQ ID NO: 83736 - protein, 16 aa, Mycobacterium tuberculosis
AKAAADQARAAVVAYE

SEQ ID NO: 83737 - protein, 16 aa, Mycobacterium tuberculosis
KAAADQARAAVVAYET

SEQ ID NO: 83738 - protein, 16 aa, Mycobacterium tuberculosis
AAADQARAAVVAYETA

SEQ ID NO: 83739 - protein, 16 aa, Mycobacterium tuberculosis
AADQARAAVVAYETAF

SEQ ID NO: 83740 - protein, 16 aa, Mycobacterium tuberculosis
ADQARAAVVAYETAFA

SEQ ID NO: 83741 - protein, 16 aa, Mycobacterium tuberculosis
DQARAAVVAYETAFAA

SEQ ID NO: 83742 - protein, 16 aa, Mycobacterium tuberculosis
QARAAVVAYETAFAAV

SEQ ID NO: 83743 - protein, 16 aa, Mycobacterium tuberculosis
ARAAVVAYETAFAAVV

SEQ ID NO: 83744 - protein, 16 aa, Mycobacterium tuberculosis
RAAVVAYETAFAAVVP

SEQ ID NO: 83745 - protein, 16 aa, Mycobacterium tuberculosis
AAVVAYETAFAAVVPP

SEQ ID NO: 83746 - protein, 16 aa, Mycobacterium tuberculosis
AVVAYETAFAAVVPPP

SEQ ID NO: 83747 - protein, 16 aa, Mycobacterium tuberculosis
VVAYETAFAAVVPPPQ

SEQ ID NO: 83748 - protein, 16 aa, Mycobacterium tuberculosis
VAYETAFAAVVPPPQI

SEQ ID NO: 83749 - protein, 16 aa, Mycobacterium tuberculosis
AYETAFAAVVPPPQIA

SEQ ID NO: 83750 - protein, 16 aa, Mycobacterium tuberculosis
YETAFAAVVPPPQIAA

SEQ ID NO: 83751 - protein, 16 aa, Mycobacterium tuberculosis
ETAFAAVVPPPQIAAN

SEQ ID NO: 83752 - protein, 16 aa, Mycobacterium tuberculosis
TAFAAVVPPPQIAANR

SEQ ID NO: 83753 - protein, 16 aa, Mycobacterium tuberculosis
AFAAVVPPPQIAANRS

SEQ ID NO: 83754 - protein, 16 aa, Mycobacterium tuberculosis
FAAVVPPPQIAANRSQ

SEQ ID NO: 83755 - protein, 16 aa, Mycobacterium tuberculosis
AAVVPPPQIAANRSQL

SEQ ID NO: 83756 - protein, 16 aa, Mycobacterium tuberculosis
AVVPPPQIAANRSQLI

SEQ ID NO: 83757 - protein, 16 aa, Mycobacterium tuberculosis
VVPPPQIAANRSQLIS

SEQ ID NO: 83758 - protein, 16 aa, Mycobacterium tuberculosis
VPPPQIAANRSQLISL

SEQ ID NO: 83759 - protein, 16 aa, Mycobacterium tuberculosis
PPPQIAANRSQLISLV

SEQ ID NO: 83760 - protein, 16 aa, Mycobacterium tuberculosis
PPQIAANRSQLISLVA

SEQ ID NO: 83761 - protein, 16 aa, Mycobacterium tuberculosis
PQIAANRSQLISLVAT

SEQ ID NO: 83762 - protein, 16 aa, Mycobacterium tuberculosis
QIAANRSQLISLVATN

SEQ ID NO: 83763 - protein, 16 aa, Mycobacterium tuberculosis
IAANRSQLISLVATNI

SEQ ID NO: 83764 - protein, 16 aa, Mycobacterium tuberculosis
AANRSQLISLVATNIF

SEQ ID NO: 83765 - protein, 16 aa, Mycobacterium tuberculosis
ANRSQLISLVATNIFG

SEQ ID NO: 83766 - protein, 16 aa, Mycobacterium tuberculosis
NRSQLISLVATNIFGQ

SEQ ID NO: 83767 - protein, 16 aa, Mycobacterium tuberculosis
RSQLISLVATNIFGQN

SEQ ID NO: 83768 - protein, 16 aa, Mycobacterium tuberculosis
SQLISLVATNIFGQNT

SEQ ID NO: 83769 - protein, 16 aa, Mycobacterium tuberculosis
QLISLVATNIFGQNTA

SEQ ID NO: 83770 - protein, 16 aa, Mycobacterium tuberculosis
LISLVATNIFGQNTAA

SEQ ID NO: 83771 - protein, 16 aa, Mycobacterium tuberculosis
ISLVATNIFGQNTAAI

SEQ ID NO: 83772 - protein, 16 aa, Mycobacterium tuberculosis
SLVATNIFGQNTAAIA

SEQ ID NO: 83773 - protein, 16 aa, Mycobacterium tuberculosis
LVATNIFGQNTAAIAA

SEQ ID NO: 83774 - protein, 16 aa, Mycobacterium tuberculosis
VATNIFGQNTAAIAAT

SEQ ID NO: 83775 - protein, 16 aa, Mycobacterium tuberculosis
ATNIFGQNTAAIAATE

SEQ ID NO: 83776 - protein, 16 aa, Mycobacterium tuberculosis
TNIFGQNTAAIAATEA

SEQ ID NO: 83777 - protein, 16 aa, Mycobacterium tuberculosis
NIFGQNTAAIAATEAE

SEQ ID NO: 83778 - protein, 16 aa, Mycobacterium tuberculosis
IFGQNTAAIAATEAEY

SEQ ID NO: 83779 - protein, 16 aa, Mycobacterium tuberculosis
FGQNTAAIAATEAEYG

SEQ ID NO: 83780 - protein, 16 aa, Mycobacterium tuberculosis
GQNTAAIAATEAEYGE

SEQ ID NO: 83781 - protein, 16 aa, Mycobacterium tuberculosis
QNTAAIAATEAEYGEM

SEQ ID NO: 83782 - protein, 16 aa, Mycobacterium tuberculosis
NTAAIAATEAEYGEMW

SEQ ID NO: 83783 - protein, 16 aa, Mycobacterium tuberculosis
TAAIAATEAEYGEMWA

SEQ ID NO: 83784 - protein, 16 aa, Mycobacterium tuberculosis
AAIAATEAEYGEMWAQ

SEQ ID NO: 83785 - protein, 16 aa, Mycobacterium tuberculosis
AIAATEAEYGEMWAQD

SEQ ID NO: 83786 - protein, 16 aa, Mycobacterium tuberculosis
IAATEAEYGEMWAQDT

SEQ ID NO: 83787 - protein, 16 aa, Mycobacterium tuberculosis
AATEAEYGEMWAQDTM

SEQ ID NO: 83788 - protein, 16 aa, Mycobacterium tuberculosis
ATEAEYGEMWAQDTMA

SEQ ID NO: 83789 - protein, 16 aa, Mycobacterium tuberculosis
TEAEYGEMWAQDTMAM

SEQ ID NO: 83790 - protein, 16 aa, Mycobacterium tuberculosis
EAEYGEMWAQDTMAMF

SEQ ID NO: 83791 - protein, 16 aa, Mycobacterium tuberculosis
AEYGEMWAQDTMAMFG

SEQ ID NO: 83792 - protein, 16 aa, Mycobacterium tuberculosis
EYGEMWAQDTMAMFGY

SEQ ID NO: 83793 - protein, 16 aa, Mycobacterium tuberculosis
YGEMWAQDTMAMFGYA

SEQ ID NO: 83794 - protein, 16 aa, Mycobacterium tuberculosis
GEMWAQDTMAMFGYAS

SEQ ID NO: 83795 - protein, 16 aa, Mycobacterium tuberculosis
EMWAQDTMAMFGYASS

SEQ ID NO: 83796 - protein, 16 aa, Mycobacterium tuberculosis
MWAQDTMAMFGYASSS

SEQ ID NO: 83797 - protein, 16 aa, Mycobacterium tuberculosis
WAQDTMAMFGYASSSA

SEQ ID NO: 83798 - protein, 16 aa, Mycobacterium tuberculosis
AQDTMAMFGYASSSAT

SEQ ID NO: 83799 - protein, 16 aa, Mycobacterium tuberculosis
QDTMAMFGYASSSATA

SEQ ID NO: 83800 - protein, 16 aa, Mycobacterium tuberculosis
DTMAMFGYASSSATAS

SEQ ID NO: 83801 - protein, 16 aa, Mycobacterium tuberculosis
TMAMFGYASSSATASR

SEQ ID NO: 83802 - protein, 16 aa, Mycobacterium tuberculosis
MAMFGYASSSATASRL

SEQ ID NO: 83803 - protein, 16 aa, Mycobacterium tuberculosis
AMFGYASSSATASRLT

SEQ ID NO: 83804 - protein, 16 aa, Mycobacterium tuberculosis
MFGYASSSATASRLTP

SEQ ID NO: 83805 - protein, 16 aa, Mycobacterium tuberculosis
FGYASSSATASRLTPF

SEQ ID NO: 83806 - protein, 16 aa, Mycobacterium tuberculosis
GYASSSATASRLTPFT

SEQ ID NO: 83807 - protein, 16 aa, Mycobacterium tuberculosis
YASSSATASRLTPFTA

SEQ ID NO: 83808 - protein, 16 aa, Mycobacterium tuberculosis
ASSSATASRLTPFTAP

SEQ ID NO: 83809 - protein, 16 aa, Mycobacterium tuberculosis
SSSATASRLTPFTAPP

SEQ ID NO: 83810 - protein, 16 aa, Mycobacterium tuberculosis
SSATASRLTPFTAPPQ

SEQ ID NO: 83811 - protein, 16 aa, Mycobacterium tuberculosis
SATASRLTPFTAPPQT

SEQ ID NO: 83812 - protein, 16 aa, Mycobacterium tuberculosis
ATASRLTPFTAPPQTT

SEQ ID NO: 83813 - protein, 16 aa, Mycobacterium tuberculosis
TASRLTPFTAPPQTTN

SEQ ID NO: 83814 - protein, 16 aa, Mycobacterium tuberculosis
ASRLTPFTAPPQTTNP

SEQ ID NO: 83815 - protein, 16 aa, Mycobacterium tuberculosis
SRLTPFTAPPQTTNPS

SEQ ID NO: 83816 - protein, 16 aa, Mycobacterium tuberculosis
RLTPFTAPPQTTNPSG

SEQ ID NO: 83817 - protein, 16 aa, Mycobacterium tuberculosis
LTPFTAPPQTTNPSGL

SEQ ID NO: 83818 - protein, 16 aa, Mycobacterium tuberculosis
TPFTAPPQTTNPSGLA

SEQ ID NO: 83819 - protein, 16 aa, Mycobacterium tuberculosis
PFTAPPQTTNPSGLAG

SEQ ID NO: 83820 - protein, 16 aa, Mycobacterium tuberculosis
FTAPPQTTNPSGLAGQ

SEQ ID NO: 83821 - protein, 16 aa, Mycobacterium tuberculosis
TAPPQTTNPSGLAGQA

SEQ ID NO: 83822 - protein, 16 aa, Mycobacterium tuberculosis
APPQTTNPSGLAGQAA

SEQ ID NO: 83823 - protein, 16 aa, Mycobacterium tuberculosis
PPQTTNPSGLAGQAAA

SEQ ID NO: 83824 - protein, 16 aa, Mycobacterium tuberculosis
PQTTNPSGLAGQAAAT

SEQ ID NO: 83825 - protein, 16 aa, Mycobacterium tuberculosis
QTTNPSGLAGQAAATG

SEQ ID NO: 83826 - protein, 16 aa, Mycobacterium tuberculosis
TTNPSGLAGQAAATGQ

SEQ ID NO: 83827 - protein, 16 aa, Mycobacterium tuberculosis
TNPSGLAGQAAATGQA

SEQ ID NO: 83828 - protein, 16 aa, Mycobacterium tuberculosis
NPSGLAGQAAATGQAT

SEQ ID NO: 83829 - protein, 16 aa, Mycobacterium tuberculosis
PSGLAGQAAATGQATA

SEQ ID NO: 83830 - protein, 16 aa, Mycobacterium tuberculosis
SGLAGQAAATGQATAL

SEQ ID NO: 83831 - protein, 16 aa, Mycobacterium tuberculosis
GLAGQAAATGQATALA

SEQ ID NO: 83832 - protein, 16 aa, Mycobacterium tuberculosis
LAGQAAATGQATALAS

SEQ ID NO: 83833 - protein, 16 aa, Mycobacterium tuberculosis
AGQAAATGQATALASG

SEQ ID NO: 83834 - protein, 16 aa, Mycobacterium tuberculosis
GQAAATGQATALASGT

SEQ ID NO: 83835 - protein, 16 aa, Mycobacterium tuberculosis
QAAATGQATALASGTN

SEQ ID NO: 83836 - protein, 16 aa, Mycobacterium tuberculosis
AAATGQATALASGTNA

SEQ ID NO: 83837 - protein, 16 aa, Mycobacterium tuberculosis
AATGQATALASGTNAV

SEQ ID NO: 83838 - protein, 16 aa, Mycobacterium tuberculosis
ATGQATALASGTNAVT

SEQ ID NO: 83839 - protein, 16 aa, Mycobacterium tuberculosis
TGQATALASGTNAVTT

SEQ ID NO: 83840 - protein, 16 aa, Mycobacterium tuberculosis
GQATALASGTNAVTTA

SEQ ID NO: 83841 - protein, 16 aa, Mycobacterium tuberculosis
QATALASGTNAVTTAL

SEQ ID NO: 83842 - protein, 16 aa, Mycobacterium tuberculosis
ATALASGTNAVTTALS

SEQ ID NO: 83843 - protein, 16 aa, Mycobacterium tuberculosis
TALASGTNAVTTALSS

SEQ ID NO: 83844 - protein, 16 aa, Mycobacterium tuberculosis
ALASGTNAVTTALSSA

SEQ ID NO: 83845 - protein, 16 aa, Mycobacterium tuberculosis
LASGTNAVTTALSSAA

SEQ ID NO: 83846 - protein, 16 aa, Mycobacterium tuberculosis
ASGTNAVTTALSSAAA

SEQ ID NO: 83847 - protein, 16 aa, Mycobacterium tuberculosis
SGTNAVTTALSSAAAQ

SEQ ID NO: 83848 - protein, 16 aa, Mycobacterium tuberculosis
GTNAVTTALSSAAAQF

SEQ ID NO: 83849 - protein, 16 aa, Mycobacterium tuberculosis
TNAVTTALSSAAAQFP

SEQ ID NO: 83850 - protein, 16 aa, Mycobacterium tuberculosis
NAVTTALSSAAAQFPF

SEQ ID NO: 83851 - protein, 16 aa, Mycobacterium tuberculosis
AVTTALSSAAAQFPFD

SEQ ID NO: 83852 - protein, 16 aa, Mycobacterium tuberculosis
VTTALSSAAAQFPFDI

SEQ ID NO: 83853 - protein, 16 aa, Mycobacterium tuberculosis
TTALSSAAAQFPFDII

SEQ ID NO: 83854 - protein, 16 aa, Mycobacterium tuberculosis
TALSSAAAQFPFDIIP

SEQ ID NO: 83855 - protein, 16 aa, Mycobacterium tuberculosis
ALSSAAAQFPFDIIPT

SEQ ID NO: 83856 - protein, 16 aa, Mycobacterium tuberculosis
LSSAAAQFPFDIIPTL

SEQ ID NO: 83857 - protein, 16 aa, Mycobacterium tuberculosis
SSAAAQFPFDIIPTLL

SEQ ID NO: 83858 - protein, 16 aa, Mycobacterium tuberculosis
SAAAQFPFDIIPTLLQ

SEQ ID NO: 83859 - protein, 16 aa, Mycobacterium tuberculosis
AAAQFPFDIIPTLLQG

SEQ ID NO: 83860 - protein, 16 aa, Mycobacterium tuberculosis
AAQFPFDIIPTLLQGL

SEQ ID NO: 83861 - protein, 16 aa, Mycobacterium tuberculosis
AQFPFDIIPTLLQGLA

SEQ ID NO: 83862 - protein, 16 aa, Mycobacterium tuberculosis
QFPFDIIPTLLQGLAT

SEQ ID NO: 83863 - protein, 16 aa, Mycobacterium tuberculosis
FPFDIIPTLLQGLATL

SEQ ID NO: 83864 - protein, 16 aa, Mycobacterium tuberculosis
PFDIIPTLLQGLATLS

SEQ ID NO: 83865 - protein, 16 aa, Mycobacterium tuberculosis
FDIIPTLLQGLATLST

SEQ ID NO: 83866 - protein, 16 aa, Mycobacterium tuberculosis
DIIPTLLQGLATLSTQ

SEQ ID NO: 83867 - protein, 16 aa, Mycobacterium tuberculosis
IIPTLLQGLATLSTQY

SEQ ID NO: 83868 - protein, 16 aa, Mycobacterium tuberculosis
IPTLLQGLATLSTQYT

SEQ ID NO: 83869 - protein, 16 aa, Mycobacterium tuberculosis
PTLLQGLATLSTQYTQ

SEQ ID NO: 83870 - protein, 16 aa, Mycobacterium tuberculosis
TLLQGLATLSTQYTQL

SEQ ID NO: 83871 - protein, 16 aa, Mycobacterium tuberculosis
LLQGLATLSTQYTQLM

SEQ ID NO: 83872 - protein, 16 aa, Mycobacterium tuberculosis
LQGLATLSTQYTQLMG

SEQ ID NO: 83873 - protein, 16 aa, Mycobacterium tuberculosis
QGLATLSTQYTQLMGQ

SEQ ID NO: 83874 - protein, 16 aa, Mycobacterium tuberculosis
GLATLSTQYTQLMGQL

SEQ ID NO: 83875 - protein, 16 aa, Mycobacterium tuberculosis
LATLSTQYTQLMGQLI

SEQ ID NO: 83876 - protein, 16 aa, Mycobacterium tuberculosis
ATLSTQYTQLMGQLIN

SEQ ID NO: 83877 - protein, 16 aa, Mycobacterium tuberculosis
TLSTQYTQLMGQLINA

SEQ ID NO: 83878 - protein, 16 aa, Mycobacterium tuberculosis
LSTQYTQLMGQLINAI

SEQ ID NO: 83879 - protein, 16 aa, Mycobacterium tuberculosis
STQYTQLMGQLINAIF

SEQ ID NO: 83880 - protein, 16 aa, Mycobacterium tuberculosis
TQYTQLMGQLINAIFG

SEQ ID NO: 83881 - protein, 16 aa, Mycobacterium tuberculosis
QYTQLMGQLINAIFGP

SEQ ID NO: 83882 - protein, 16 aa, Mycobacterium tuberculosis
YTQLMGQLINAIFGPT

SEQ ID NO: 83883 - protein, 16 aa, Mycobacterium tuberculosis
TQLMGQLINAIFGPTG

SEQ ID NO: 83884 - protein, 16 aa, Mycobacterium tuberculosis
QLMGQLINAIFGPTGA

SEQ ID NO: 83885 - protein, 16 aa, Mycobacterium tuberculosis
LMGQLINAIFGPTGAT

SEQ ID NO: 83886 - protein, 16 aa, Mycobacterium tuberculosis
MGQLINAIFGPTGATT

SEQ ID NO: 83887 - protein, 16 aa, Mycobacterium tuberculosis
GQLINAIFGPTGATTY

SEQ ID NO: 83888 - protein, 16 aa, Mycobacterium tuberculosis
QLINAIFGPTGATTYQ

SEQ ID NO: 83889 - protein, 16 aa, Mycobacterium tuberculosis
LINAIFGPTGATTYQN

SEQ ID NO: 83890 - protein, 16 aa, Mycobacterium tuberculosis
INAIFGPTGATTYQNV

SEQ ID NO: 83891 - protein, 16 aa, Mycobacterium tuberculosis
NAIFGPTGATTYQNVF

SEQ ID NO: 83892 - protein, 16 aa, Mycobacterium tuberculosis
AIFGPTGATTYQNVFV

SEQ ID NO: 83893 - protein, 16 aa, Mycobacterium tuberculosis
IFGPTGATTYQNVFVT

SEQ ID NO: 83894 - protein, 16 aa, Mycobacterium tuberculosis
FGPTGATTYQNVFVTA

SEQ ID NO: 83895 - protein, 16 aa, Mycobacterium tuberculosis
GPTGATTYQNVFVTAA

SEQ ID NO: 83896 - protein, 16 aa, Mycobacterium tuberculosis
PTGATTYQNVFVTAAN

SEQ ID NO: 83897 - protein, 16 aa, Mycobacterium tuberculosis
TGATTYQNVFVTAANV

SEQ ID NO: 83898 - protein, 16 aa, Mycobacterium tuberculosis
GATTYQNVFVTAANVT

SEQ ID NO: 83899 - protein, 16 aa, Mycobacterium tuberculosis
ATTYQNVFVTAANVTK

SEQ ID NO: 83900 - protein, 16 aa, Mycobacterium tuberculosis
TTYQNVFVTAANVTKF

SEQ ID NO: 83901 - protein, 16 aa, Mycobacterium tuberculosis
TYQNVFVTAANVTKFS

SEQ ID NO: 83902 - protein, 16 aa, Mycobacterium tuberculosis
YQNVFVTAANVTKFST

SEQ ID NO: 83903 - protein, 16 aa, Mycobacterium tuberculosis
QNVFVTAANVTKFSTW

SEQ ID NO: 83904 - protein, 16 aa, Mycobacterium tuberculosis
NVFVTAANVTKFSTWA

SEQ ID NO: 83905 - protein, 16 aa, Mycobacterium tuberculosis
VFVTAANVTKFSTWAN

SEQ ID NO: 83906 - protein, 16 aa, Mycobacterium tuberculosis
FVTAANVTKFSTWAND

SEQ ID NO: 83907 - protein, 16 aa, Mycobacterium tuberculosis
VTAANVTKFSTWANDA

SEQ ID NO: 83908 - protein, 16 aa, Mycobacterium tuberculosis
TAANVTKFSTWANDAM

SEQ ID NO: 83909 - protein, 16 aa, Mycobacterium tuberculosis
AANVTKFSTWANDAMS

SEQ ID NO: 83910 - protein, 16 aa, Mycobacterium tuberculosis
ANVTKFSTWANDAMSA

SEQ ID NO: 83911 - protein, 16 aa, Mycobacterium tuberculosis
NVTKFSTWANDAMSAP

SEQ ID NO: 83912 - protein, 16 aa, Mycobacterium tuberculosis
VTKFSTWANDAMSAPN

SEQ ID NO: 83913 - protein, 16 aa, Mycobacterium tuberculosis
TKFSTWANDAMSAPNL

SEQ ID NO: 83914 - protein, 16 aa, Mycobacterium tuberculosis
KFSTWANDAMSAPNLG

SEQ ID NO: 83915 - protein, 16 aa, Mycobacterium tuberculosis
FSTWANDAMSAPNLGM

SEQ ID NO: 83916 - protein, 16 aa, Mycobacterium tuberculosis
STWANDAMSAPNLGMT

SEQ ID NO: 83917 - protein, 16 aa, Mycobacterium tuberculosis
TWANDAMSAPNLGMTE

SEQ ID NO: 83918 - protein, 16 aa, Mycobacterium tuberculosis
WANDAMSAPNLGMTEF

SEQ ID NO: 83919 - protein, 16 aa, Mycobacterium tuberculosis
ANDAMSAPNLGMTEFK

SEQ ID NO: 83920 - protein, 16 aa, Mycobacterium tuberculosis
NDAMSAPNLGMTEFKV

SEQ ID NO: 83921 - protein, 16 aa, Mycobacterium tuberculosis
DAMSAPNLGMTEFKVF

SEQ ID NO: 83922 - protein, 16 aa, Mycobacterium tuberculosis
AMSAPNLGMTEFKVFW

SEQ ID NO: 83923 - protein, 16 aa, Mycobacterium tuberculosis
MSAPNLGMTEFKVFWQ

SEQ ID NO: 83924 - protein, 16 aa, Mycobacterium tuberculosis
SAPNLGMTEFKVFWQP

SEQ ID NO: 83925 - protein, 16 aa, Mycobacterium tuberculosis
APNLGMTEFKVFWQPP

SEQ ID NO: 83926 - protein, 16 aa, Mycobacterium tuberculosis
PNLGMTEFKVFWQPPP

SEQ ID NO: 83927 - protein, 16 aa, Mycobacterium tuberculosis
NLGMTEFKVFWQPPPA

SEQ ID NO: 83928 - protein, 16 aa, Mycobacterium tuberculosis
LGMTEFKVFWQPPPAP

SEQ ID NO: 83929 - protein, 16 aa, Mycobacterium tuberculosis
GMTEFKVFWQPPPAPE

SEQ ID NO: 83930 - protein, 16 aa, Mycobacterium tuberculosis
MTEFKVFWQPPPAPEI

SEQ ID NO: 83931 - protein, 16 aa, Mycobacterium tuberculosis
TEFKVFWQPPPAPEIP

SEQ ID NO: 83932 - protein, 16 aa, Mycobacterium tuberculosis
EFKVFWQPPPAPEIPK

SEQ ID NO: 83933 - protein, 16 aa, Mycobacterium tuberculosis
FKVFWQPPPAPEIPKS

SEQ ID NO: 83934 - protein, 16 aa, Mycobacterium tuberculosis
KVFWQPPPAPEIPKSS

SEQ ID NO: 83935 - protein, 16 aa, Mycobacterium tuberculosis
VFWQPPPAPEIPKSSL

SEQ ID NO: 83936 - protein, 16 aa, Mycobacterium tuberculosis
FWQPPPAPEIPKSSLG

SEQ ID NO: 83937 - protein, 16 aa, Mycobacterium tuberculosis
WQPPPAPEIPKSSLGA

SEQ ID NO: 83938 - protein, 16 aa, Mycobacterium tuberculosis
QPPPAPEIPKSSLGAG

SEQ ID NO: 83939 - protein, 16 aa, Mycobacterium tuberculosis
PPPAPEIPKSSLGAGL

SEQ ID NO: 83940 - protein, 16 aa, Mycobacterium tuberculosis
PPAPEIPKSSLGAGLG

SEQ ID NO: 83941 - protein, 16 aa, Mycobacterium tuberculosis
PAPEIPKSSLGAGLGL

SEQ ID NO: 83942 - protein, 16 aa, Mycobacterium tuberculosis
APEIPKSSLGAGLGLR

SEQ ID NO: 83943 - protein, 16 aa, Mycobacterium tuberculosis
PEIPKSSLGAGLGLRS

SEQ ID NO: 83944 - protein, 16 aa, Mycobacterium tuberculosis
EIPKSSLGAGLGLRSG

SEQ ID NO: 83945 - protein, 16 aa, Mycobacterium tuberculosis
IPKSSLGAGLGLRSGL

SEQ ID NO: 83946 - protein, 16 aa, Mycobacterium tuberculosis
PKSSLGAGLGLRSGLS

SEQ ID NO: 83947 - protein, 16 aa, Mycobacterium tuberculosis
KSSLGAGLGLRSGLSA

SEQ ID NO: 83948 - protein, 16 aa, Mycobacterium tuberculosis
SSLGAGLGLRSGLSAG

SEQ ID NO: 83949 - protein, 16 aa, Mycobacterium tuberculosis
SLGAGLGLRSGLSAGL

SEQ ID NO: 83950 - protein, 16 aa, Mycobacterium tuberculosis
LGAGLGLRSGLSAGLA

SEQ ID NO: 83951 - protein, 16 aa, Mycobacterium tuberculosis
GAGLGLRSGLSAGLAH

SEQ ID NO: 83952 - protein, 16 aa, Mycobacterium tuberculosis
AGLGLRSGLSAGLAHA

SEQ ID NO: 83953 - protein, 16 aa, Mycobacterium tuberculosis
GLGLRSGLSAGLAHAA

SEQ ID NO: 83954 - protein, 16 aa, Mycobacterium tuberculosis
LGLRSGLSAGLAHAAS

SEQ ID NO: 83955 - protein, 16 aa, Mycobacterium tuberculosis
GLRSGLSAGLAHAASA

SEQ ID NO: 83956 - protein, 16 aa, Mycobacterium tuberculosis
LRSGLSAGLAHAASAG

SEQ ID NO: 83957 - protein, 16 aa, Mycobacterium tuberculosis
RSGLSAGLAHAASAGL

SEQ ID NO: 83958 - protein, 16 aa, Mycobacterium tuberculosis
SGLSAGLAHAASAGLG

SEQ ID NO: 83959 - protein, 16 aa, Mycobacterium tuberculosis
GLSAGLAHAASAGLGQ

SEQ ID NO: 83960 - protein, 16 aa, Mycobacterium tuberculosis
LSAGLAHAASAGLGQA

SEQ ID NO: 83961 - protein, 16 aa, Mycobacterium tuberculosis
SAGLAHAASAGLGQAN

SEQ ID NO: 83962 - protein, 16 aa, Mycobacterium tuberculosis
AGLAHAASAGLGQANL

SEQ ID NO: 83963 - protein, 16 aa, Mycobacterium tuberculosis
GLAHAASAGLGQANLV

SEQ ID NO: 83964 - protein, 16 aa, Mycobacterium tuberculosis
LAHAASAGLGQANLVG

SEQ ID NO: 83965 - protein, 16 aa, Mycobacterium tuberculosis
AHAASAGLGQANLVGD

SEQ ID NO: 83966 - protein, 16 aa, Mycobacterium tuberculosis
HAASAGLGQANLVGDL

SEQ ID NO: 83967 - protein, 16 aa, Mycobacterium tuberculosis
AASAGLGQANLVGDLS

SEQ ID NO: 83968 - protein, 16 aa, Mycobacterium tuberculosis
ASAGLGQANLVGDLSV

SEQ ID NO: 83969 - protein, 16 aa, Mycobacterium tuberculosis
SAGLGQANLVGDLSVP

SEQ ID NO: 83970 - protein, 16 aa, Mycobacterium tuberculosis
AGLGQANLVGDLSVPP

SEQ ID NO: 83971 - protein, 16 aa, Mycobacterium tuberculosis
GLGQANLVGDLSVPPS

SEQ ID NO: 83972 - protein, 16 aa, Mycobacterium tuberculosis
LGQANLVGDLSVPPSW

SEQ ID NO: 83973 - protein, 16 aa, Mycobacterium tuberculosis
GQANLVGDLSVPPSWA

SEQ ID NO: 83974 - protein, 16 aa, Mycobacterium tuberculosis
QANLVGDLSVPPSWAS

SEQ ID NO: 83975 - protein, 16 aa, Mycobacterium tuberculosis
ANLVGDLSVPPSWASA

SEQ ID NO: 83976 - protein, 16 aa, Mycobacterium tuberculosis
NLVGDLSVPPSWASAT

SEQ ID NO: 83977 - protein, 16 aa, Mycobacterium tuberculosis
LVGDLSVPPSWASATP

SEQ ID NO: 83978 - protein, 16 aa, Mycobacterium tuberculosis
VGDLSVPPSWASATPA

SEQ ID NO: 83979 - protein, 16 aa, Mycobacterium tuberculosis
GDLSVPPSWASATPAV

SEQ ID NO: 83980 - protein, 16 aa, Mycobacterium tuberculosis
DLSVPPSWASATPAVR

SEQ ID NO: 83981 - protein, 16 aa, Mycobacterium tuberculosis
LSVPPSWASATPAVRL

SEQ ID NO: 83982 - protein, 16 aa, Mycobacterium tuberculosis
SVPPSWASATPAVRLV

SEQ ID NO: 83983 - protein, 16 aa, Mycobacterium tuberculosis
VPPSWASATPAVRLVA

SEQ ID NO: 83984 - protein, 16 aa, Mycobacterium tuberculosis
PPSWASATPAVRLVAN

SEQ ID NO: 83985 - protein, 16 aa, Mycobacterium tuberculosis
PSWASATPAVRLVANT

SEQ ID NO: 83986 - protein, 16 aa, Mycobacterium tuberculosis
SWASATPAVRLVANTL

SEQ ID NO: 83987 - protein, 16 aa, Mycobacterium tuberculosis
WASATPAVRLVANTLP

SEQ ID NO: 83988 - protein, 16 aa, Mycobacterium tuberculosis
ASATPAVRLVANTLPA

SEQ ID NO: 83989 - protein, 16 aa, Mycobacterium tuberculosis
SATPAVRLVANTLPAT

SEQ ID NO: 83990 - protein, 16 aa, Mycobacterium tuberculosis
ATPAVRLVANTLPATS

SEQ ID NO: 83991 - protein, 16 aa, Mycobacterium tuberculosis
TPAVRLVANTLPATSL

SEQ ID NO: 83992 - protein, 16 aa, Mycobacterium tuberculosis
PAVRLVANTLPATSLA

SEQ ID NO: 83993 - protein, 16 aa, Mycobacterium tuberculosis
AVRLVANTLPATSLAA

SEQ ID NO: 83994 - protein, 16 aa, Mycobacterium tuberculosis
VRLVANTLPATSLAAA

SEQ ID NO: 83995 - protein, 16 aa, Mycobacterium tuberculosis
RLVANTLPATSLAAAP

SEQ ID NO: 83996 - protein, 16 aa, Mycobacterium tuberculosis
LVANTLPATSLAAAPA

SEQ ID NO: 83997 - protein, 16 aa, Mycobacterium tuberculosis
VANTLPATSLAAAPAT

SEQ ID NO: 83998 - protein, 16 aa, Mycobacterium tuberculosis
ANTLPATSLAAAPATQ

SEQ ID NO: 83999 - protein, 16 aa, Mycobacterium tuberculosis
NTLPATSLAAAPATQI

SEQ ID NO: 84000 - protein, 16 aa, Mycobacterium tuberculosis
TLPATSLAAAPATQIP

SEQ ID NO: 84001 - protein, 16 aa, Mycobacterium tuberculosis
LPATSLAAAPATQIPA

SEQ ID NO: 84002 - protein, 16 aa, Mycobacterium tuberculosis
PATSLAAAPATQIPAN

SEQ ID NO: 84003 - protein, 16 aa, Mycobacterium tuberculosis
ATSLAAAPATQIPANL

SEQ ID NO: 84004 - protein, 16 aa, Mycobacterium tuberculosis
TSLAAAPATQIPANLL

SEQ ID NO: 84005 - protein, 16 aa, Mycobacterium tuberculosis
SLAAAPATQIPANLLG

SEQ ID NO: 84006 - protein, 16 aa, Mycobacterium tuberculosis
LAAAPATQIPANLLGQ

SEQ ID NO: 84007 - protein, 16 aa, Mycobacterium tuberculosis
AAAPATQIPANLLGQM

SEQ ID NO: 84008 - protein, 16 aa, Mycobacterium tuberculosis
AAPATQIPANLLGQMA

SEQ ID NO: 84009 - protein, 16 aa, Mycobacterium tuberculosis
APATQIPANLLGQMAL

SEQ ID NO: 84010 - protein, 16 aa, Mycobacterium tuberculosis
PATQIPANLLGQMALG

SEQ ID NO: 84011 - protein, 16 aa, Mycobacterium tuberculosis
ATQIPANLLGQMALGS

SEQ ID NO: 84012 - protein, 16 aa, Mycobacterium tuberculosis
TQIPANLLGQMALGSM

SEQ ID NO: 84013 - protein, 16 aa, Mycobacterium tuberculosis
QIPANLLGQMALGSMT

SEQ ID NO: 84014 - protein, 16 aa, Mycobacterium tuberculosis
IPANLLGQMALGSMTG

SEQ ID NO: 84015 - protein, 16 aa, Mycobacterium tuberculosis
PANLLGQMALGSMTGG

SEQ ID NO: 84016 - protein, 16 aa, Mycobacterium tuberculosis
ANLLGQMALGSMTGGA

SEQ ID NO: 84017 - protein, 16 aa, Mycobacterium tuberculosis
NLLGQMALGSMTGGAL

SEQ ID NO: 84018 - protein, 16 aa, Mycobacterium tuberculosis
LLGQMALGSMTGGALG

SEQ ID NO: 84019 - protein, 16 aa, Mycobacterium tuberculosis
LGQMALGSMTGGALGA

SEQ ID NO: 84020 - protein, 16 aa, Mycobacterium tuberculosis
GQMALGSMTGGALGAA

SEQ ID NO: 84021 - protein, 16 aa, Mycobacterium tuberculosis
QMALGSMTGGALGAAA

SEQ ID NO: 84022 - protein, 16 aa, Mycobacterium tuberculosis
MALGSMTGGALGAAAP

SEQ ID NO: 84023 - protein, 16 aa, Mycobacterium tuberculosis
ALGSMTGGALGAAAPA

SEQ ID NO: 84024 - protein, 16 aa, Mycobacterium tuberculosis
LGSMTGGALGAAAPAI

SEQ ID NO: 84025 - protein, 16 aa, Mycobacterium tuberculosis
GSMTGGALGAAAPAIY

SEQ ID NO: 84026 - protein, 16 aa, Mycobacterium tuberculosis
SMTGGALGAAAPAIYT

SEQ ID NO: 84027 - protein, 16 aa, Mycobacterium tuberculosis
MTGGALGAAAPAIYTG

SEQ ID NO: 84028 - protein, 16 aa, Mycobacterium tuberculosis
TGGALGAAAPAIYTGS

SEQ ID NO: 84029 - protein, 16 aa, Mycobacterium tuberculosis
GGALGAAAPAIYTGSG

SEQ ID NO: 84030 - protein, 16 aa, Mycobacterium tuberculosis
GALGAAAPAIYTGSGA

SEQ ID NO: 84031 - protein, 16 aa, Mycobacterium tuberculosis
ALGAAAPAIYTGSGAR

SEQ ID NO: 84032 - protein, 16 aa, Mycobacterium tuberculosis
LGAAAPAIYTGSGARA

SEQ ID NO: 84033 - protein, 16 aa, Mycobacterium tuberculosis
GAAAPAIYTGSGARAR

SEQ ID NO: 84034 - protein, 16 aa, Mycobacterium tuberculosis
AAAPAIYTGSGARARA

SEQ ID NO: 84035 - protein, 16 aa, Mycobacterium tuberculosis
AAPAIYTGSGARARAN

SEQ ID NO: 84036 - protein, 16 aa, Mycobacterium tuberculosis
APAIYTGSGARARANG

SEQ ID NO: 84037 - protein, 16 aa, Mycobacterium tuberculosis
PAIYTGSGARARANGG

SEQ ID NO: 84038 - protein, 16 aa, Mycobacterium tuberculosis
AIYTGSGARARANGGT

SEQ ID NO: 84039 - protein, 16 aa, Mycobacterium tuberculosis
IYTGSGARARANGGTP

SEQ ID NO: 84040 - protein, 16 aa, Mycobacterium tuberculosis
YTGSGARARANGGTPS

SEQ ID NO: 84041 - protein, 16 aa, Mycobacterium tuberculosis
TGSGARARANGGTPSA

SEQ ID NO: 84042 - protein, 16 aa, Mycobacterium tuberculosis
GSGARARANGGTPSAE

SEQ ID NO: 84043 - protein, 16 aa, Mycobacterium tuberculosis
SGARARANGGTPSAEP

SEQ ID NO: 84044 - protein, 16 aa, Mycobacterium tuberculosis
GARARANGGTPSAEPV

SEQ ID NO: 84045 - protein, 16 aa, Mycobacterium tuberculosis
ARARANGGTPSAEPVK

SEQ ID NO: 84046 - protein, 16 aa, Mycobacterium tuberculosis
RARANGGTPSAEPVKL

SEQ ID NO: 84047 - protein, 16 aa, Mycobacterium tuberculosis
ARANGGTPSAEPVKLE

SEQ ID NO: 84048 - protein, 16 aa, Mycobacterium tuberculosis
RANGGTPSAEPVKLEA

SEQ ID NO: 84049 - protein, 16 aa, Mycobacterium tuberculosis
ANGGTPSAEPVKLEAV

SEQ ID NO: 84050 - protein, 16 aa, Mycobacterium tuberculosis
NGGTPSAEPVKLEAVI

SEQ ID NO: 84051 - protein, 16 aa, Mycobacterium tuberculosis
GGTPSAEPVKLEAVIA

SEQ ID NO: 84052 - protein, 16 aa, Mycobacterium tuberculosis
GTPSAEPVKLEAVIAQ

SEQ ID NO: 84053 - protein, 16 aa, Mycobacterium tuberculosis
TPSAEPVKLEAVIAQL

SEQ ID NO: 84054 - protein, 16 aa, Mycobacterium tuberculosis
PSAEPVKLEAVIAQLQ

SEQ ID NO: 84055 - protein, 16 aa, Mycobacterium tuberculosis
SAEPVKLEAVIAQLQK

SEQ ID NO: 84056 - protein, 16 aa, Mycobacterium tuberculosis
AEPVKLEAVIAQLQKQ

SEQ ID NO: 84057 - protein, 16 aa, Mycobacterium tuberculosis
EPVKLEAVIAQLQKQP

SEQ ID NO: 84058 - protein, 16 aa, Mycobacterium tuberculosis
PVKLEAVIAQLQKQPD

SEQ ID NO: 84059 - protein, 16 aa, Mycobacterium tuberculosis
VKLEAVIAQLQKQPDA

SEQ ID NO: 84060 - protein, 16 aa, Mycobacterium tuberculosis
KLEAVIAQLQKQPDAV

SEQ ID NO: 84061 - protein, 16 aa, Mycobacterium tuberculosis
LEAVIAQLQKQPDAVR

SEQ ID NO: 84062 - protein, 16 aa, Mycobacterium tuberculosis
EAVIAQLQKQPDAVRH

SEQ ID NO: 84063 - protein, 16 aa, Mycobacterium tuberculosis
AVIAQLQKQPDAVRHW

SEQ ID NO: 84064 - protein, 16 aa, Mycobacterium tuberculosis
VIAQLQKQPDAVRHWN

SEQ ID NO: 84065 - protein, 16 aa, Mycobacterium tuberculosis
IAQLQKQPDAVRHWNV

SEQ ID NO: 84066 - protein, 16 aa, Mycobacterium tuberculosis
AQLQKQPDAVRHWNVD

SEQ ID NO: 84067 - protein, 16 aa, Mycobacterium tuberculosis
QLQKQPDAVRHWNVDK

SEQ ID NO: 84068 - protein, 16 aa, Mycobacterium tuberculosis
LQKQPDAVRHWNVDKA

SEQ ID NO: 84069 - protein, 16 aa, Mycobacterium tuberculosis
QKQPDAVRHWNVDKAD

SEQ ID NO: 84070 - protein, 16 aa, Mycobacterium tuberculosis
KQPDAVRHWNVDKADL

SEQ ID NO: 84071 - protein, 16 aa, Mycobacterium tuberculosis
QPDAVRHWNVDKADLD

SEQ ID NO: 84072 - protein, 16 aa, Mycobacterium tuberculosis
PDAVRHWNVDKADLDG

SEQ ID NO: 84073 - protein, 16 aa, Mycobacterium tuberculosis
DAVRHWNVDKADLDGL

SEQ ID NO: 84074 - protein, 16 aa, Mycobacterium tuberculosis
AVRHWNVDKADLDGLL

SEQ ID NO: 84075 - protein, 16 aa, Mycobacterium tuberculosis
VRHWNVDKADLDGLLD

SEQ ID NO: 84076 - protein, 16 aa, Mycobacterium tuberculosis
RHWNVDKADLDGLLDR

SEQ ID NO: 84077 - protein, 16 aa, Mycobacterium tuberculosis
HWNVDKADLDGLLDRL

SEQ ID NO: 84078 - protein, 16 aa, Mycobacterium tuberculosis
WNVDKADLDGLLDRLS

SEQ ID NO: 84079 - protein, 16 aa, Mycobacterium tuberculosis
NVDKADLDGLLDRLSK

SEQ ID NO: 84080 - protein, 16 aa, Mycobacterium tuberculosis
VDKADLDGLLDRLSKQ

SEQ ID NO: 84081 - protein, 16 aa, Mycobacterium tuberculosis
DKADLDGLLDRLSKQP

SEQ ID NO: 84082 - protein, 16 aa, Mycobacterium tuberculosis
KADLDGLLDRLSKQPG

SEQ ID NO: 84083 - protein, 16 aa, Mycobacterium tuberculosis
ADLDGLLDRLSKQPGI

SEQ ID NO: 84084 - protein, 16 aa, Mycobacterium tuberculosis
DLDGLLDRLSKQPGIH

SEQ ID NO: 84085 - protein, 16 aa, Mycobacterium tuberculosis
LDGLLDRLSKQPGIHA

SEQ ID NO: 84086 - protein, 16 aa, Mycobacterium tuberculosis
DGLLDRLSKQPGIHAV

SEQ ID NO: 84087 - protein, 16 aa, Mycobacterium tuberculosis
GLLDRLSKQPGIHAVH

SEQ ID NO: 84088 - protein, 16 aa, Mycobacterium tuberculosis
LLDRLSKQPGIHAVHV

SEQ ID NO: 84089 - protein, 16 aa, Mycobacterium tuberculosis
LDRLSKQPGIHAVHVS

SEQ ID NO: 84090 - protein, 16 aa, Mycobacterium tuberculosis
DRLSKQPGIHAVHVSN

SEQ ID NO: 84091 - protein, 16 aa, Mycobacterium tuberculosis
RLSKQPGIHAVHVSNG

SEQ ID NO: 84092 - protein, 16 aa, Mycobacterium tuberculosis
LSKQPGIHAVHVSNGD

SEQ ID NO: 84093 - protein, 16 aa, Mycobacterium tuberculosis
SKQPGIHAVHVSNGDK

SEQ ID NO: 84094 - protein, 16 aa, Mycobacterium tuberculosis
KQPGIHAVHVSNGDKP

SEQ ID NO: 84095 - protein, 16 aa, Mycobacterium tuberculosis
QPGIHAVHVSNGDKPK

SEQ ID NO: 84096 - protein, 16 aa, Mycobacterium tuberculosis
PGIHAVHVSNGDKPKV

SEQ ID NO: 84097 - protein, 16 aa, Mycobacterium tuberculosis
GIHAVHVSNGDKPKVA

SEQ ID NO: 84098 - protein, 16 aa, Mycobacterium tuberculosis
IHAVHVSNGDKPKVAL

SEQ ID NO: 84099 - protein, 16 aa, Mycobacterium tuberculosis
HAVHVSNGDKPKVALP

SEQ ID NO: 84100 - protein, 16 aa, Mycobacterium tuberculosis
AVHVSNGDKPKVALPD

SEQ ID NO: 84101 - protein, 16 aa, Mycobacterium tuberculosis
VHVSNGDKPKVALPDT

SEQ ID NO: 84102 - protein, 16 aa, Mycobacterium tuberculosis
HVSNGDKPKVALPDTQ

SEQ ID NO: 84103 - protein, 16 aa, Mycobacterium tuberculosis
VSNGDKPKVALPDTQL

SEQ ID NO: 84104 - protein, 16 aa, Mycobacterium tuberculosis
SNGDKPKVALPDTQLG

SEQ ID NO: 84105 - protein, 16 aa, Mycobacterium tuberculosis
NGDKPKVALPDTQLGS

SEQ ID NO: 84106 - protein, 16 aa, Mycobacterium tuberculosis
GDKPKVALPDTQLGSH

SEQ ID NO: 84107 - protein, 13 aa, Mycobacterium tuberculosis
MAAGSGGGTVGLV

SEQ ID NO: 84108 - protein, 13 aa, Mycobacterium tuberculosis
AAGSGGGTVGLVL

SEQ ID NO: 84109 - protein, 13 aa, Mycobacterium tuberculosis
AGSGGGTVGLVLP

SEQ ID NO: 84110 - protein, 13 aa, Mycobacterium tuberculosis
GSGGGTVGLVLPR

SEQ ID NO: 84111 - protein, 13 aa, Mycobacterium tuberculosis
SGGGTVGLVLPRV

SEQ ID NO: 84112 - protein, 13 aa, Mycobacterium tuberculosis
GGGTVGLVLPRVA

SEQ ID NO: 84113 - protein, 13 aa, Mycobacterium tuberculosis
GGTVGLVLPRVAS

SEQ ID NO: 84114 - protein, 13 aa, Mycobacterium tuberculosis
GTVGLVLPRVASL

SEQ ID NO: 84115 - protein, 13 aa, Mycobacterium tuberculosis
TVGLVLPRVASLS

SEQ ID NO: 84116 - protein, 13 aa, Mycobacterium tuberculosis
VGLVLPRVASLSG

SEQ ID NO: 84117 - protein, 13 aa, Mycobacterium tuberculosis
GLVLPRVASLSGL

SEQ ID NO: 84118 - protein, 13 aa, Mycobacterium tuberculosis
LVLPRVASLSGLD

SEQ ID NO: 84119 - protein, 13 aa, Mycobacterium tuberculosis
VLPRVASLSGLDG

SEQ ID NO: 84120 - protein, 13 aa, Mycobacterium tuberculosis
LPRVASLSGLDGA

SEQ ID NO: 84121 - protein, 13 aa, Mycobacterium tuberculosis
PRVASLSGLDGAP

SEQ ID NO: 84122 - protein, 13 aa, Mycobacterium tuberculosis
RVASLSGLDGAPT

SEQ ID NO: 84123 - protein, 13 aa, Mycobacterium tuberculosis
VASLSGLDGAPTV

SEQ ID NO: 84124 - protein, 13 aa, Mycobacterium tuberculosis
ASLSGLDGAPTVP

SEQ ID NO: 84125 - protein, 13 aa, Mycobacterium tuberculosis
SLSGLDGAPTVPE

SEQ ID NO: 84126 - protein, 13 aa, Mycobacterium tuberculosis
LSGLDGAPTVPEG

SEQ ID NO: 84127 - protein, 13 aa, Mycobacterium tuberculosis
SGLDGAPTVPEGS

SEQ ID NO: 84128 - protein, 13 aa, Mycobacterium tuberculosis
GLDGAPTVPEGSD

SEQ ID NO: 84129 - protein, 13 aa, Mycobacterium tuberculosis
LDGAPTVPEGSDK

SEQ ID NO: 84130 - protein, 13 aa, Mycobacterium tuberculosis
DGAPTVPEGSDKA

SEQ ID NO: 84131 - protein, 13 aa, Mycobacterium tuberculosis
GAPTVPEGSDKAL

SEQ ID NO: 84132 - protein, 13 aa, Mycobacterium tuberculosis
APTVPEGSDKALM

SEQ ID NO: 84133 - protein, 13 aa, Mycobacterium tuberculosis
PTVPEGSDKALMH

SEQ ID NO: 84134 - protein, 13 aa, Mycobacterium tuberculosis
TVPEGSDKALMHL

SEQ ID NO: 84135 - protein, 13 aa, Mycobacterium tuberculosis
VPEGSDKALMHLG

SEQ ID NO: 84136 - protein, 13 aa, Mycobacterium tuberculosis
PEGSDKALMHLGD

SEQ ID NO: 84137 - protein, 13 aa, Mycobacterium tuberculosis
EGSDKALMHLGDP

SEQ ID NO: 84138 - protein, 13 aa, Mycobacterium tuberculosis
GSDKALMHLGDPP

SEQ ID NO: 84139 - protein, 13 aa, Mycobacterium tuberculosis
SDKALMHLGDPPR

SEQ ID NO: 84140 - protein, 13 aa, Mycobacterium tuberculosis
DKALMHLGDPPRR

SEQ ID NO: 84141 - protein, 13 aa, Mycobacterium tuberculosis
KALMHLGDPPRRC

SEQ ID NO: 84142 - protein, 13 aa, Mycobacterium tuberculosis
ALMHLGDPPRRCD

SEQ ID NO: 84143 - protein, 13 aa, Mycobacterium tuberculosis
LMHLGDPPRRCDT

SEQ ID NO: 84144 - protein, 13 aa, Mycobacterium tuberculosis
MHLGDPPRRCDTH

SEQ ID NO: 84145 - protein, 13 aa, Mycobacterium tuberculosis
HLGDPPRRCDTHP

SEQ ID NO: 84146 - protein, 13 aa, Mycobacterium tuberculosis
LGDPPRRCDTHPD

SEQ ID NO: 84147 - protein, 13 aa, Mycobacterium tuberculosis
GDPPRRCDTHPDG

SEQ ID NO: 84148 - protein, 13 aa, Mycobacterium tuberculosis
DPPRRCDTHPDGT

SEQ ID NO: 84149 - protein, 13 aa, Mycobacterium tuberculosis
PPRRCDTHPDGTS

SEQ ID NO: 84150 - protein, 13 aa, Mycobacterium tuberculosis
PRRCDTHPDGTSS

SEQ ID NO: 84151 - protein, 13 aa, Mycobacterium tuberculosis
RRCDTHPDGTSSA

SEQ ID NO: 84152 - protein, 13 aa, Mycobacterium tuberculosis
RCDTHPDGTSSAA

SEQ ID NO: 84153 - protein, 13 aa, Mycobacterium tuberculosis
CDTHPDGTSSAAA

SEQ ID NO: 84154 - protein, 13 aa, Mycobacterium tuberculosis
DTHPDGTSSAAAA

SEQ ID NO: 84155 - protein, 13 aa, Mycobacterium tuberculosis
THPDGTSSAAAAL

SEQ ID NO: 84156 - protein, 13 aa, Mycobacterium tuberculosis
HPDGTSSAAAALV

SEQ ID NO: 84157 - protein, 13 aa, Mycobacterium tuberculosis
PDGTSSAAAALVL

SEQ ID NO: 84158 - protein, 13 aa, Mycobacterium tuberculosis
DGTSSAAAALVLR

SEQ ID NO: 84159 - protein, 13 aa, Mycobacterium tuberculosis
GTSSAAAALVLRR

SEQ ID NO: 84160 - protein, 13 aa, Mycobacterium tuberculosis
TSSAAAALVLRRI

SEQ ID NO: 84161 - protein, 13 aa, Mycobacterium tuberculosis
SSAAAALVLRRID

SEQ ID NO: 84162 - protein, 13 aa, Mycobacterium tuberculosis
SAAAALVLRRIDV

SEQ ID NO: 84163 - protein, 13 aa, Mycobacterium tuberculosis
AAAALVLRRIDVH

SEQ ID NO: 84164 - protein, 13 aa, Mycobacterium tuberculosis
AAALVLRRIDVHP

SEQ ID NO: 84165 - protein, 13 aa, Mycobacterium tuberculosis
AALVLRRIDVHPL

SEQ ID NO: 84166 - protein, 13 aa, Mycobacterium tuberculosis
ALVLRRIDVHPLL

SEQ ID NO: 84167 - protein, 13 aa, Mycobacterium tuberculosis
LVLRRIDVHPLLT

SEQ ID NO: 84168 - protein, 13 aa, Mycobacterium tuberculosis
VLRRIDVHPLLTG

SEQ ID NO: 84169 - protein, 13 aa, Mycobacterium tuberculosis
LRRIDVHPLLTGL

SEQ ID NO: 84170 - protein, 13 aa, Mycobacterium tuberculosis
RRIDVHPLLTGLG

SEQ ID NO: 84171 - protein, 13 aa, Mycobacterium tuberculosis
RIDVHPLLTGLGR

SEQ ID NO: 84172 - protein, 13 aa, Mycobacterium tuberculosis
IDVHPLLTGLGRG

SEQ ID NO: 84173 - protein, 13 aa, Mycobacterium tuberculosis
DVHPLLTGLGRGR

SEQ ID NO: 84174 - protein, 13 aa, Mycobacterium tuberculosis
VHPLLTGLGRGRQ

SEQ ID NO: 84175 - protein, 13 aa, Mycobacterium tuberculosis
HPLLTGLGRGRQT

SEQ ID NO: 84176 - protein, 13 aa, Mycobacterium tuberculosis
PLLTGLGRGRQTV

SEQ ID NO: 84177 - protein, 13 aa, Mycobacterium tuberculosis
LLTGLGRGRQTVS

SEQ ID NO: 84178 - protein, 13 aa, Mycobacterium tuberculosis
LTGLGRGRQTVSL

SEQ ID NO: 84179 - protein, 13 aa, Mycobacterium tuberculosis
TGLGRGRQTVSLR

SEQ ID NO: 84180 - protein, 13 aa, Mycobacterium tuberculosis
GLGRGRQTVSLRN

SEQ ID NO: 84181 - protein, 13 aa, Mycobacterium tuberculosis
LGRGRQTVSLRNG

SEQ ID NO: 84182 - protein, 13 aa, Mycobacterium tuberculosis
GRGRQTVSLRNGH

SEQ ID NO: 84183 - protein, 13 aa, Mycobacterium tuberculosis
RGRQTVSLRNGHL

SEQ ID NO: 84184 - protein, 13 aa, Mycobacterium tuberculosis
GRQTVSLRNGHLV

SEQ ID NO: 84185 - protein, 13 aa, Mycobacterium tuberculosis
RQTVSLRNGHLVA

SEQ ID NO: 84186 - protein, 13 aa, Mycobacterium tuberculosis
QTVSLRNGHLVAT

SEQ ID NO: 84187 - protein, 13 aa, Mycobacterium tuberculosis
TVSLRNGHLVATA

SEQ ID NO: 84188 - protein, 13 aa, Mycobacterium tuberculosis
VSLRNGHLVATAN

SEQ ID NO: 84189 - protein, 13 aa, Mycobacterium tuberculosis
SLRNGHLVATANR

SEQ ID NO: 84190 - protein, 13 aa, Mycobacterium tuberculosis
LRNGHLVATANRA

SEQ ID NO: 84191 - protein, 13 aa, Mycobacterium tuberculosis
RNGHLVATANRAI

SEQ ID NO: 84192 - protein, 13 aa, Mycobacterium tuberculosis
NGHLVATANRAIL

SEQ ID NO: 84193 - protein, 13 aa, Mycobacterium tuberculosis
GHLVATANRAILS

SEQ ID NO: 84194 - protein, 13 aa, Mycobacterium tuberculosis
HLVATANRAILSR

SEQ ID NO: 84195 - protein, 13 aa, Mycobacterium tuberculosis
LVATANRAILSRR

SEQ ID NO: 84196 - protein, 13 aa, Mycobacterium tuberculosis
VATANRAILSRRR

SEQ ID NO: 84197 - protein, 13 aa, Mycobacterium tuberculosis
ATANRAILSRRRS

SEQ ID NO: 84198 - protein, 13 aa, Mycobacterium tuberculosis
TANRAILSRRRSR

SEQ ID NO: 84199 - protein, 13 aa, Mycobacterium tuberculosis
ANRAILSRRRSRL

SEQ ID NO: 84200 - protein, 13 aa, Mycobacterium tuberculosis
NRAILSRRRSRLT

SEQ ID NO: 84201 - protein, 13 aa, Mycobacterium tuberculosis
RAILSRRRSRLTR

SEQ ID NO: 84202 - protein, 13 aa, Mycobacterium tuberculosis
AILSRRRSRLTRG

SEQ ID NO: 84203 - protein, 13 aa, Mycobacterium tuberculosis
ILSRRRSRLTRGR

SEQ ID NO: 84204 - protein, 13 aa, Mycobacterium tuberculosis
LSRRRSRLTRGRS

SEQ ID NO: 84205 - protein, 13 aa, Mycobacterium tuberculosis
SRRRSRLTRGRSF

SEQ ID NO: 84206 - protein, 13 aa, Mycobacterium tuberculosis
RRRSRLTRGRSFT

SEQ ID NO: 84207 - protein, 13 aa, Mycobacterium tuberculosis
RRSRLTRGRSFTS

SEQ ID NO: 84208 - protein, 13 aa, Mycobacterium tuberculosis
RSRLTRGRSFTSH

SEQ ID NO: 84209 - protein, 13 aa, Mycobacterium tuberculosis
SRLTRGRSFTSHL

SEQ ID NO: 84210 - protein, 13 aa, Mycobacterium tuberculosis
RLTRGRSFTSHLI

SEQ ID NO: 84211 - protein, 13 aa, Mycobacterium tuberculosis
LTRGRSFTSHLIT

SEQ ID NO: 84212 - protein, 13 aa, Mycobacterium tuberculosis
TRGRSFTSHLITS

SEQ ID NO: 84213 - protein, 13 aa, Mycobacterium tuberculosis
RGRSFTSHLITSC

SEQ ID NO: 84214 - protein, 13 aa, Mycobacterium tuberculosis
GRSFTSHLITSCP

SEQ ID NO: 84215 - protein, 13 aa, Mycobacterium tuberculosis
RSFTSHLITSCPR

SEQ ID NO: 84216 - protein, 13 aa, Mycobacterium tuberculosis
SFTSHLITSCPRL

SEQ ID NO: 84217 - protein, 13 aa, Mycobacterium tuberculosis
FTSHLITSCPRLD

SEQ ID NO: 84218 - protein, 13 aa, Mycobacterium tuberculosis
TSHLITSCPRLDD

SEQ ID NO: 84219 - protein, 13 aa, Mycobacterium tuberculosis
SHLITSCPRLDDH

SEQ ID NO: 84220 - protein, 13 aa, Mycobacterium tuberculosis
HLITSCPRLDDHQ

SEQ ID NO: 84221 - protein, 13 aa, Mycobacterium tuberculosis
LITSCPRLDDHQH

SEQ ID NO: 84222 - protein, 13 aa, Mycobacterium tuberculosis
ITSCPRLDDHQHR

SEQ ID NO: 84223 - protein, 13 aa, Mycobacterium tuberculosis
TSCPRLDDHQHRH

SEQ ID NO: 84224 - protein, 13 aa, Mycobacterium tuberculosis
SCPRLDDHQHRHP

SEQ ID NO: 84225 - protein, 13 aa, Mycobacterium tuberculosis
CPRLDDHQHRHPT

SEQ ID NO: 84226 - protein, 13 aa, Mycobacterium tuberculosis
PRLDDHQHRHPTR

SEQ ID NO: 84227 - protein, 13 aa, Mycobacterium tuberculosis
RLDDHQHRHPTRC

SEQ ID NO: 84228 - protein, 13 aa, Mycobacterium tuberculosis
LDDHQHRHPTRCR

SEQ ID NO: 84229 - protein, 13 aa, Mycobacterium tuberculosis
DDHQHRHPTRCRA

SEQ ID NO: 84230 - protein, 13 aa, Mycobacterium tuberculosis
DHQHRHPTRCRAE

SEQ ID NO: 84231 - protein, 13 aa, Mycobacterium tuberculosis
HQHRHPTRCRAEH

SEQ ID NO: 84232 - protein, 13 aa, Mycobacterium tuberculosis
QHRHPTRCRAEHA

SEQ ID NO: 84233 - protein, 13 aa, Mycobacterium tuberculosis
HRHPTRCRAEHAG

SEQ ID NO: 84234 - protein, 13 aa, Mycobacterium tuberculosis
RHPTRCRAEHAGC

SEQ ID NO: 84235 - protein, 13 aa, Mycobacterium tuberculosis
HPTRCRAEHAGCT

SEQ ID NO: 84236 - protein, 13 aa, Mycobacterium tuberculosis
PTRCRAEHAGCTV

SEQ ID NO: 84237 - protein, 13 aa, Mycobacterium tuberculosis
TRCRAEHAGCTVA

SEQ ID NO: 84238 - protein, 13 aa, Mycobacterium tuberculosis
RCRAEHAGCTVAT

SEQ ID NO: 84239 - protein, 13 aa, Mycobacterium tuberculosis
CRAEHAGCTVATC

SEQ ID NO: 84240 - protein, 13 aa, Mycobacterium tuberculosis
RAEHAGCTVATCI

SEQ ID NO: 84241 - protein, 13 aa, Mycobacterium tuberculosis
AEHAGCTVATCIP

SEQ ID NO: 84242 - protein, 13 aa, Mycobacterium tuberculosis
EHAGCTVATCIPN

SEQ ID NO: 84243 - protein, 13 aa, Mycobacterium tuberculosis
HAGCTVATCIPNA

SEQ ID NO: 84244 - protein, 13 aa, Mycobacterium tuberculosis
AGCTVATCIPNAH

SEQ ID NO: 84245 - protein, 13 aa, Mycobacterium tuberculosis
GCTVATCIPNAHD

SEQ ID NO: 84246 - protein, 13 aa, Mycobacterium tuberculosis
CTVATCIPNAHDP

SEQ ID NO: 84247 - protein, 13 aa, Mycobacterium tuberculosis
TVATCIPNAHDPA

SEQ ID NO: 84248 - protein, 13 aa, Mycobacterium tuberculosis
VATCIPNAHDPAP

SEQ ID NO: 84249 - protein, 13 aa, Mycobacterium tuberculosis
ATCIPNAHDPAPG

SEQ ID NO: 84250 - protein, 13 aa, Mycobacterium tuberculosis
TCIPNAHDPAPGH

SEQ ID NO: 84251 - protein, 13 aa, Mycobacterium tuberculosis
CIPNAHDPAPGHQ

SEQ ID NO: 84252 - protein, 13 aa, Mycobacterium tuberculosis
IPNAHDPAPGHQT

SEQ ID NO: 84253 - protein, 13 aa, Mycobacterium tuberculosis
PNAHDPAPGHQTP

SEQ ID NO: 84254 - protein, 13 aa, Mycobacterium tuberculosis
NAHDPAPGHQTPR

SEQ ID NO: 84255 - protein, 13 aa, Mycobacterium tuberculosis
AHDPAPGHQTPRW

SEQ ID NO: 84256 - protein, 13 aa, Mycobacterium tuberculosis
HDPAPGHQTPRWG

SEQ ID NO: 84257 - protein, 13 aa, Mycobacterium tuberculosis
DPAPGHQTPRWGP

SEQ ID NO: 84258 - protein, 13 aa, Mycobacterium tuberculosis
PAPGHQTPRWGPF

SEQ ID NO: 84259 - protein, 13 aa, Mycobacterium tuberculosis
APGHQTPRWGPFR

SEQ ID NO: 84260 - protein, 13 aa, Mycobacterium tuberculosis
PGHQTPRWGPFRL

SEQ ID NO: 84261 - protein, 13 aa, Mycobacterium tuberculosis
GHQTPRWGPFRLK

SEQ ID NO: 84262 - protein, 13 aa, Mycobacterium tuberculosis
HQTPRWGPFRLKP

SEQ ID NO: 84263 - protein, 13 aa, Mycobacterium tuberculosis
QTPRWGPFRLKPA

SEQ ID NO: 84264 - protein, 13 aa, Mycobacterium tuberculosis
TPRWGPFRLKPAY

SEQ ID NO: 84265 - protein, 13 aa, Mycobacterium tuberculosis
PRWGPFRLKPAYT

SEQ ID NO: 84266 - protein, 13 aa, Mycobacterium tuberculosis
RWGPFRLKPAYTR

SEQ ID NO: 84267 - protein, 13 aa, Mycobacterium tuberculosis
WGPFRLKPAYTRI

SEQ ID NO: 84268 - protein, 14 aa, Mycobacterium tuberculosis
MAAGSGGGTVGLVL

SEQ ID NO: 84269 - protein, 14 aa, Mycobacterium tuberculosis
AAGSGGGTVGLVLP

SEQ ID NO: 84270 - protein, 14 aa, Mycobacterium tuberculosis
AGSGGGTVGLVLPR

SEQ ID NO: 84271 - protein, 14 aa, Mycobacterium tuberculosis
GSGGGTVGLVLPRV

SEQ ID NO: 84272 - protein, 14 aa, Mycobacterium tuberculosis
SGGGTVGLVLPRVA

SEQ ID NO: 84273 - protein, 14 aa, Mycobacterium tuberculosis
GGGTVGLVLPRVAS

SEQ ID NO: 84274 - protein, 14 aa, Mycobacterium tuberculosis
GGTVGLVLPRVASL

SEQ ID NO: 84275 - protein, 14 aa, Mycobacterium tuberculosis
GTVGLVLPRVASLS

SEQ ID NO: 84276 - protein, 14 aa, Mycobacterium tuberculosis
TVGLVLPRVASLSG

SEQ ID NO: 84277 - protein, 14 aa, Mycobacterium tuberculosis
VGLVLPRVASLSGL

SEQ ID NO: 84278 - protein, 14 aa, Mycobacterium tuberculosis
GLVLPRVASLSGLD

SEQ ID NO: 84279 - protein, 14 aa, Mycobacterium tuberculosis
LVLPRVASLSGLDG

SEQ ID NO: 84280 - protein, 14 aa, Mycobacterium tuberculosis
VLPRVASLSGLDGA

SEQ ID NO: 84281 - protein, 14 aa, Mycobacterium tuberculosis
LPRVASLSGLDGAP

SEQ ID NO: 84282 - protein, 14 aa, Mycobacterium tuberculosis
PRVASLSGLDGAPT

SEQ ID NO: 84283 - protein, 14 aa, Mycobacterium tuberculosis
RVASLSGLDGAPTV

SEQ ID NO: 84284 - protein, 14 aa, Mycobacterium tuberculosis
VASLSGLDGAPTVP

SEQ ID NO: 84285 - protein, 14 aa, Mycobacterium tuberculosis
ASLSGLDGAPTVPE

SEQ ID NO: 84286 - protein, 14 aa, Mycobacterium tuberculosis
SLSGLDGAPTVPEG

SEQ ID NO: 84287 - protein, 14 aa, Mycobacterium tuberculosis
LSGLDGAPTVPEGS

SEQ ID NO: 84288 - protein, 14 aa, Mycobacterium tuberculosis
SGLDGAPTVPEGSD

SEQ ID NO: 84289 - protein, 14 aa, Mycobacterium tuberculosis
GLDGAPTVPEGSDK

SEQ ID NO: 84290 - protein, 14 aa, Mycobacterium tuberculosis
LDGAPTVPEGSDKA

SEQ ID NO: 84291 - protein, 14 aa, Mycobacterium tuberculosis
DGAPTVPEGSDKAL

SEQ ID NO: 84292 - protein, 14 aa, Mycobacterium tuberculosis
GAPTVPEGSDKALM

SEQ ID NO: 84293 - protein, 14 aa, Mycobacterium tuberculosis
APTVPEGSDKALMH

SEQ ID NO: 84294 - protein, 14 aa, Mycobacterium tuberculosis
PTVPEGSDKALMHL

SEQ ID NO: 84295 - protein, 14 aa, Mycobacterium tuberculosis
TVPEGSDKALMHLG

SEQ ID NO: 84296 - protein, 14 aa, Mycobacterium tuberculosis
VPEGSDKALMHLGD

SEQ ID NO: 84297 - protein, 14 aa, Mycobacterium tuberculosis
PEGSDKALMHLGDP

SEQ ID NO: 84298 - protein, 14 aa, Mycobacterium tuberculosis
EGSDKALMHLGDPP

SEQ ID NO: 84299 - protein, 14 aa, Mycobacterium tuberculosis
GSDKALMHLGDPPR

SEQ ID NO: 84300 - protein, 14 aa, Mycobacterium tuberculosis
SDKALMHLGDPPRR

SEQ ID NO: 84301 - protein, 14 aa, Mycobacterium tuberculosis
DKALMHLGDPPRRC

SEQ ID NO: 84302 - protein, 14 aa, Mycobacterium tuberculosis
KALMHLGDPPRRCD

SEQ ID NO: 84303 - protein, 14 aa, Mycobacterium tuberculosis
ALMHLGDPPRRCDT

SEQ ID NO: 84304 - protein, 14 aa, Mycobacterium tuberculosis
LMHLGDPPRRCDTH

SEQ ID NO: 84305 - protein, 14 aa, Mycobacterium tuberculosis
MHLGDPPRRCDTHP

SEQ ID NO: 84306 - protein, 14 aa, Mycobacterium tuberculosis
HLGDPPRRCDTHPD

SEQ ID NO: 84307 - protein, 14 aa, Mycobacterium tuberculosis
LGDPPRRCDTHPDG

SEQ ID NO: 84308 - protein, 14 aa, Mycobacterium tuberculosis
GDPPRRCDTHPDGT

SEQ ID NO: 84309 - protein, 14 aa, Mycobacterium tuberculosis
DPPRRCDTHPDGTS

SEQ ID NO: 84310 - protein, 14 aa, Mycobacterium tuberculosis
PPRRCDTHPDGTSS

SEQ ID NO: 84311 - protein, 14 aa, Mycobacterium tuberculosis
PRRCDTHPDGTSSA

SEQ ID NO: 84312 - protein, 14 aa, Mycobacterium tuberculosis
RRCDTHPDGTSSAA

SEQ ID NO: 84313 - protein, 14 aa, Mycobacterium tuberculosis
RCDTHPDGTSSAAA

SEQ ID NO: 84314 - protein, 14 aa, Mycobacterium tuberculosis
CDTHPDGTSSAAAA

SEQ ID NO: 84315 - protein, 14 aa, Mycobacterium tuberculosis
DTHPDGTSSAAAAL

SEQ ID NO: 84316 - protein, 14 aa, Mycobacterium tuberculosis
THPDGTSSAAAALV

SEQ ID NO: 84317 - protein, 14 aa, Mycobacterium tuberculosis
HPDGTSSAAAALVL

SEQ ID NO: 84318 - protein, 14 aa, Mycobacterium tuberculosis
PDGTSSAAAALVLR

SEQ ID NO: 84319 - protein, 14 aa, Mycobacterium tuberculosis
DGTSSAAAALVLRR

SEQ ID NO: 84320 - protein, 14 aa, Mycobacterium tuberculosis
GTSSAAAALVLRRI

SEQ ID NO: 84321 - protein, 14 aa, Mycobacterium tuberculosis
TSSAAAALVLRRID

SEQ ID NO: 84322 - protein, 14 aa, Mycobacterium tuberculosis
SSAAAALVLRRIDV

SEQ ID NO: 84323 - protein, 14 aa, Mycobacterium tuberculosis
SAAAALVLRRIDVH

SEQ ID NO: 84324 - protein, 14 aa, Mycobacterium tuberculosis
AAAALVLRRIDVHP

SEQ ID NO: 84325 - protein, 14 aa, Mycobacterium tuberculosis
AAALVLRRIDVHPL

SEQ ID NO: 84326 - protein, 14 aa, Mycobacterium tuberculosis
AALVLRRIDVHPLL

SEQ ID NO: 84327 - protein, 14 aa, Mycobacterium tuberculosis
ALVLRRIDVHPLLT

SEQ ID NO: 84328 - protein, 14 aa, Mycobacterium tuberculosis
LVLRRIDVHPLLTG

SEQ ID NO: 84329 - protein, 14 aa, Mycobacterium tuberculosis
VLRRIDVHPLLTGL

SEQ ID NO: 84330 - protein, 14 aa, Mycobacterium tuberculosis
LRRIDVHPLLTGLG

SEQ ID NO: 84331 - protein, 14 aa, Mycobacterium tuberculosis
RRIDVHPLLTGLGR

SEQ ID NO: 84332 - protein, 14 aa, Mycobacterium tuberculosis
RIDVHPLLTGLGRG

SEQ ID NO: 84333 - protein, 14 aa, Mycobacterium tuberculosis
IDVHPLLTGLGRGR

SEQ ID NO: 84334 - protein, 14 aa, Mycobacterium tuberculosis
DVHPLLTGLGRGRQ

SEQ ID NO: 84335 - protein, 14 aa, Mycobacterium tuberculosis
VHPLLTGLGRGRQT

SEQ ID NO: 84336 - protein, 14 aa, Mycobacterium tuberculosis
HPLLTGLGRGRQTV

SEQ ID NO: 84337 - protein, 14 aa, Mycobacterium tuberculosis
PLLTGLGRGRQTVS

SEQ ID NO: 84338 - protein, 14 aa, Mycobacterium tuberculosis
LLTGLGRGRQTVSL

SEQ ID NO: 84339 - protein, 14 aa, Mycobacterium tuberculosis
LTGLGRGRQTVSLR

SEQ ID NO: 84340 - protein, 14 aa, Mycobacterium tuberculosis
TGLGRGRQTVSLRN

SEQ ID NO: 84341 - protein, 14 aa, Mycobacterium tuberculosis
GLGRGRQTVSLRNG

SEQ ID NO: 84342 - protein, 14 aa, Mycobacterium tuberculosis
LGRGRQTVSLRNGH

SEQ ID NO: 84343 - protein, 14 aa, Mycobacterium tuberculosis
GRGRQTVSLRNGHL

SEQ ID NO: 84344 - protein, 14 aa, Mycobacterium tuberculosis
RGRQTVSLRNGHLV

SEQ ID NO: 84345 - protein, 14 aa, Mycobacterium tuberculosis
GRQTVSLRNGHLVA

SEQ ID NO: 84346 - protein, 14 aa, Mycobacterium tuberculosis
RQTVSLRNGHLVAT

SEQ ID NO: 84347 - protein, 14 aa, Mycobacterium tuberculosis
QTVSLRNGHLVATA

SEQ ID NO: 84348 - protein, 14 aa, Mycobacterium tuberculosis
TVSLRNGHLVATAN

SEQ ID NO: 84349 - protein, 14 aa, Mycobacterium tuberculosis
VSLRNGHLVATANR

SEQ ID NO: 84350 - protein, 14 aa, Mycobacterium tuberculosis
SLRNGHLVATANRA

SEQ ID NO: 84351 - protein, 14 aa, Mycobacterium tuberculosis
LRNGHLVATANRAI

SEQ ID NO: 84352 - protein, 14 aa, Mycobacterium tuberculosis
RNGHLVATANRAIL

SEQ ID NO: 84353 - protein, 14 aa, Mycobacterium tuberculosis
NGHLVATANRAILS

SEQ ID NO: 84354 - protein, 14 aa, Mycobacterium tuberculosis
GHLVATANRAILSR

SEQ ID NO: 84355 - protein, 14 aa, Mycobacterium tuberculosis
HLVATANRAILSRR

SEQ ID NO: 84356 - protein, 14 aa, Mycobacterium tuberculosis
LVATANRAILSRRR

SEQ ID NO: 84357 - protein, 14 aa, Mycobacterium tuberculosis
VATANRAILSRRRS

SEQ ID NO: 84358 - protein, 14 aa, Mycobacterium tuberculosis
ATANRAILSRRRSR

SEQ ID NO: 84359 - protein, 14 aa, Mycobacterium tuberculosis
TANRAILSRRRSRL

SEQ ID NO: 84360 - protein, 14 aa, Mycobacterium tuberculosis
ANRAILSRRRSRLT

SEQ ID NO: 84361 - protein, 14 aa, Mycobacterium tuberculosis
NRAILSRRRSRLTR

SEQ ID NO: 84362 - protein, 14 aa, Mycobacterium tuberculosis
RAILSRRRSRLTRG

SEQ ID NO: 84363 - protein, 14 aa, Mycobacterium tuberculosis
AILSRRRSRLTRGR

SEQ ID NO: 84364 - protein, 14 aa, Mycobacterium tuberculosis
ILSRRRSRLTRGRS

SEQ ID NO: 84365 - protein, 14 aa, Mycobacterium tuberculosis
LSRRRSRLTRGRSF

SEQ ID NO: 84366 - protein, 14 aa, Mycobacterium tuberculosis
SRRRSRLTRGRSFT

SEQ ID NO: 84367 - protein, 14 aa, Mycobacterium tuberculosis
RRRSRLTRGRSFTS

SEQ ID NO: 84368 - protein, 14 aa, Mycobacterium tuberculosis
RRSRLTRGRSFTSH

SEQ ID NO: 84369 - protein, 14 aa, Mycobacterium tuberculosis
RSRLTRGRSFTSHL

SEQ ID NO: 84370 - protein, 14 aa, Mycobacterium tuberculosis
SRLTRGRSFTSHLI

SEQ ID NO: 84371 - protein, 14 aa, Mycobacterium tuberculosis
RLTRGRSFTSHLIT

SEQ ID NO: 84372 - protein, 14 aa, Mycobacterium tuberculosis
LTRGRSFTSHLITS

SEQ ID NO: 84373 - protein, 14 aa, Mycobacterium tuberculosis
TRGRSFTSHLITSC

SEQ ID NO: 84374 - protein, 14 aa, Mycobacterium tuberculosis
RGRSFTSHLITSCP

SEQ ID NO: 84375 - protein, 14 aa, Mycobacterium tuberculosis
GRSFTSHLITSCPR

SEQ ID NO: 84376 - protein, 14 aa, Mycobacterium tuberculosis
RSFTSHLITSCPRL

SEQ ID NO: 84377 - protein, 14 aa, Mycobacterium tuberculosis
SFTSHLITSCPRLD

SEQ ID NO: 84378 - protein, 14 aa, Mycobacterium tuberculosis
FTSHLITSCPRLDD

SEQ ID NO: 84379 - protein, 14 aa, Mycobacterium tuberculosis
TSHLITSCPRLDDH

SEQ ID NO: 84380 - protein, 14 aa, Mycobacterium tuberculosis
SHLITSCPRLDDHQ

SEQ ID NO: 84381 - protein, 14 aa, Mycobacterium tuberculosis
HLITSCPRLDDHQH

SEQ ID NO: 84382 - protein, 14 aa, Mycobacterium tuberculosis
LITSCPRLDDHQHR

SEQ ID NO: 84383 - protein, 14 aa, Mycobacterium tuberculosis
ITSCPRLDDHQHRH

SEQ ID NO: 84384 - protein, 14 aa, Mycobacterium tuberculosis
TSCPRLDDHQHRHP

SEQ ID NO: 84385 - protein, 14 aa, Mycobacterium tuberculosis
SCPRLDDHQHRHPT

SEQ ID NO: 84386 - protein, 14 aa, Mycobacterium tuberculosis
CPRLDDHQHRHPTR

SEQ ID NO: 84387 - protein, 14 aa, Mycobacterium tuberculosis
PRLDDHQHRHPTRC

SEQ ID NO: 84388 - protein, 14 aa, Mycobacterium tuberculosis
RLDDHQHRHPTRCR

SEQ ID NO: 84389 - protein, 14 aa, Mycobacterium tuberculosis
LDDHQHRHPTRCRA

SEQ ID NO: 84390 - protein, 14 aa, Mycobacterium tuberculosis
DDHQHRHPTRCRAE

SEQ ID NO: 84391 - protein, 14 aa, Mycobacterium tuberculosis
DHQHRHPTRCRAEH

SEQ ID NO: 84392 - protein, 14 aa, Mycobacterium tuberculosis
HQHRHPTRCRAEHA

SEQ ID NO: 84393 - protein, 14 aa, Mycobacterium tuberculosis
QHRHPTRCRAEHAG

SEQ ID NO: 84394 - protein, 14 aa, Mycobacterium tuberculosis
HRHPTRCRAEHAGC

SEQ ID NO: 84395 - protein, 14 aa, Mycobacterium tuberculosis
RHPTRCRAEHAGCT

SEQ ID NO: 84396 - protein, 14 aa, Mycobacterium tuberculosis
HPTRCRAEHAGCTV

SEQ ID NO: 84397 - protein, 14 aa, Mycobacterium tuberculosis
PTRCRAEHAGCTVA

SEQ ID NO: 84398 - protein, 14 aa, Mycobacterium tuberculosis
TRCRAEHAGCTVAT

SEQ ID NO: 84399 - protein, 14 aa, Mycobacterium tuberculosis
RCRAEHAGCTVATC

SEQ ID NO: 84400 - protein, 14 aa, Mycobacterium tuberculosis
CRAEHAGCTVATCI

SEQ ID NO: 84401 - protein, 14 aa, Mycobacterium tuberculosis
RAEHAGCTVATCIP

SEQ ID NO: 84402 - protein, 14 aa, Mycobacterium tuberculosis
AEHAGCTVATCIPN

SEQ ID NO: 84403 - protein, 14 aa, Mycobacterium tuberculosis
EHAGCTVATCIPNA

SEQ ID NO: 84404 - protein, 14 aa, Mycobacterium tuberculosis
HAGCTVATCIPNAH

SEQ ID NO: 84405 - protein, 14 aa, Mycobacterium tuberculosis
AGCTVATCIPNAHD

SEQ ID NO: 84406 - protein, 14 aa, Mycobacterium tuberculosis
GCTVATCIPNAHDP

SEQ ID NO: 84407 - protein, 14 aa, Mycobacterium tuberculosis
CTVATCIPNAHDPA

SEQ ID NO: 84408 - protein, 14 aa, Mycobacterium tuberculosis
TVATCIPNAHDPAP

SEQ ID NO: 84409 - protein, 14 aa, Mycobacterium tuberculosis
VATCIPNAHDPAPG

SEQ ID NO: 84410 - protein, 14 aa, Mycobacterium tuberculosis
ATCIPNAHDPAPGH

SEQ ID NO: 84411 - protein, 14 aa, Mycobacterium tuberculosis
TCIPNAHDPAPGHQ

SEQ ID NO: 84412 - protein, 14 aa, Mycobacterium tuberculosis
CIPNAHDPAPGHQT

SEQ ID NO: 84413 - protein, 14 aa, Mycobacterium tuberculosis
IPNAHDPAPGHQTP

SEQ ID NO: 84414 - protein, 14 aa, Mycobacterium tuberculosis
PNAHDPAPGHQTPR

SEQ ID NO: 84415 - protein, 14 aa, Mycobacterium tuberculosis
NAHDPAPGHQTPRW

SEQ ID NO: 84416 - protein, 14 aa, Mycobacterium tuberculosis
AHDPAPGHQTPRWG

SEQ ID NO: 84417 - protein, 14 aa, Mycobacterium tuberculosis
HDPAPGHQTPRWGP

SEQ ID NO: 84418 - protein, 14 aa, Mycobacterium tuberculosis
DPAPGHQTPRWGPF

SEQ ID NO: 84419 - protein, 14 aa, Mycobacterium tuberculosis
PAPGHQTPRWGPFR

SEQ ID NO: 84420 - protein, 14 aa, Mycobacterium tuberculosis
APGHQTPRWGPFRL

SEQ ID NO: 84421 - protein, 14 aa, Mycobacterium tuberculosis
PGHQTPRWGPFRLK

SEQ ID NO: 84422 - protein, 14 aa, Mycobacterium tuberculosis
GHQTPRWGPFRLKP

SEQ ID NO: 84423 - protein, 14 aa, Mycobacterium tuberculosis
HQTPRWGPFRLKPA

SEQ ID NO: 84424 - protein, 14 aa, Mycobacterium tuberculosis
QTPRWGPFRLKPAY

SEQ ID NO: 84425 - protein, 14 aa, Mycobacterium tuberculosis
TPRWGPFRLKPAYT

SEQ ID NO: 84426 - protein, 14 aa, Mycobacterium tuberculosis
PRWGPFRLKPAYTR

SEQ ID NO: 84427 - protein, 15 aa, Mycobacterium tuberculosis
MAAGSGGGTVGLVLP

SEQ ID NO: 84428 - protein, 15 aa, Mycobacterium tuberculosis
AAGSGGGTVGLVLPR

SEQ ID NO: 84429 - protein, 15 aa, Mycobacterium tuberculosis
AGSGGGTVGLVLPRV

SEQ ID NO: 84430 - protein, 15 aa, Mycobacterium tuberculosis
GSGGGTVGLVLPRVA

SEQ ID NO: 84431 - protein, 15 aa, Mycobacterium tuberculosis
SGGGTVGLVLPRVAS

SEQ ID NO: 84432 - protein, 15 aa, Mycobacterium tuberculosis
GGGTVGLVLPRVASL

SEQ ID NO: 84433 - protein, 15 aa, Mycobacterium tuberculosis
GGTVGLVLPRVASLS

SEQ ID NO: 84434 - protein, 15 aa, Mycobacterium tuberculosis
GTVGLVLPRVASLSG

SEQ ID NO: 84435 - protein, 15 aa, Mycobacterium tuberculosis
TVGLVLPRVASLSGL

SEQ ID NO: 84436 - protein, 15 aa, Mycobacterium tuberculosis
VGLVLPRVASLSGLD

SEQ ID NO: 84437 - protein, 15 aa, Mycobacterium tuberculosis
GLVLPRVASLSGLDG

SEQ ID NO: 84438 - protein, 15 aa, Mycobacterium tuberculosis
LVLPRVASLSGLDGA

SEQ ID NO: 84439 - protein, 15 aa, Mycobacterium tuberculosis
VLPRVASLSGLDGAP

SEQ ID NO: 84440 - protein, 15 aa, Mycobacterium tuberculosis
LPRVASLSGLDGAPT

SEQ ID NO: 84441 - protein, 15 aa, Mycobacterium tuberculosis
PRVASLSGLDGAPTV

SEQ ID NO: 84442 - protein, 15 aa, Mycobacterium tuberculosis
RVASLSGLDGAPTVP

SEQ ID NO: 84443 - protein, 15 aa, Mycobacterium tuberculosis
VASLSGLDGAPTVPE

SEQ ID NO: 84444 - protein, 15 aa, Mycobacterium tuberculosis
ASLSGLDGAPTVPEG

SEQ ID NO: 84445 - protein, 15 aa, Mycobacterium tuberculosis
SLSGLDGAPTVPEGS

SEQ ID NO: 84446 - protein, 15 aa, Mycobacterium tuberculosis
LSGLDGAPTVPEGSD

SEQ ID NO: 84447 - protein, 15 aa, Mycobacterium tuberculosis
SGLDGAPTVPEGSDK

SEQ ID NO: 84448 - protein, 15 aa, Mycobacterium tuberculosis
GLDGAPTVPEGSDKA

SEQ ID NO: 84449 - protein, 15 aa, Mycobacterium tuberculosis
LDGAPTVPEGSDKAL

SEQ ID NO: 84450 - protein, 15 aa, Mycobacterium tuberculosis
DGAPTVPEGSDKALM

SEQ ID NO: 84451 - protein, 15 aa, Mycobacterium tuberculosis
GAPTVPEGSDKALMH

SEQ ID NO: 84452 - protein, 15 aa, Mycobacterium tuberculosis
APTVPEGSDKALMHL

SEQ ID NO: 84453 - protein, 15 aa, Mycobacterium tuberculosis
PTVPEGSDKALMHLG

SEQ ID NO: 84454 - protein, 15 aa, Mycobacterium tuberculosis
TVPEGSDKALMHLGD

SEQ ID NO: 84455 - protein, 15 aa, Mycobacterium tuberculosis
VPEGSDKALMHLGDP

SEQ ID NO: 84456 - protein, 15 aa, Mycobacterium tuberculosis
PEGSDKALMHLGDPP

SEQ ID NO: 84457 - protein, 15 aa, Mycobacterium tuberculosis
EGSDKALMHLGDPPR

SEQ ID NO: 84458 - protein, 15 aa, Mycobacterium tuberculosis
GSDKALMHLGDPPRR

SEQ ID NO: 84459 - protein, 15 aa, Mycobacterium tuberculosis
SDKALMHLGDPPRRC

SEQ ID NO: 84460 - protein, 15 aa, Mycobacterium tuberculosis
DKALMHLGDPPRRCD

SEQ ID NO: 84461 - protein, 15 aa, Mycobacterium tuberculosis
KALMHLGDPPRRCDT

SEQ ID NO: 84462 - protein, 15 aa, Mycobacterium tuberculosis
ALMHLGDPPRRCDTH

SEQ ID NO: 84463 - protein, 15 aa, Mycobacterium tuberculosis
LMHLGDPPRRCDTHP

SEQ ID NO: 84464 - protein, 15 aa, Mycobacterium tuberculosis
MHLGDPPRRCDTHPD

SEQ ID NO: 84465 - protein, 15 aa, Mycobacterium tuberculosis
HLGDPPRRCDTHPDG

SEQ ID NO: 84466 - protein, 15 aa, Mycobacterium tuberculosis
LGDPPRRCDTHPDGT

SEQ ID NO: 84467 - protein, 15 aa, Mycobacterium tuberculosis
GDPPRRCDTHPDGTS

SEQ ID NO: 84468 - protein, 15 aa, Mycobacterium tuberculosis
DPPRRCDTHPDGTSS

SEQ ID NO: 84469 - protein, 15 aa, Mycobacterium tuberculosis
PPRRCDTHPDGTSSA

SEQ ID NO: 84470 - protein, 15 aa, Mycobacterium tuberculosis
PRRCDTHPDGTSSAA

SEQ ID NO: 84471 - protein, 15 aa, Mycobacterium tuberculosis
RRCDTHPDGTSSAAA

SEQ ID NO: 84472 - protein, 15 aa, Mycobacterium tuberculosis
RCDTHPDGTSSAAAA

SEQ ID NO: 84473 - protein, 15 aa, Mycobacterium tuberculosis
CDTHPDGTSSAAAAL

SEQ ID NO: 84474 - protein, 15 aa, Mycobacterium tuberculosis
DTHPDGTSSAAAALV

SEQ ID NO: 84475 - protein, 15 aa, Mycobacterium tuberculosis
THPDGTSSAAAALVL

SEQ ID NO: 84476 - protein, 15 aa, Mycobacterium tuberculosis
HPDGTSSAAAALVLR

SEQ ID NO: 84477 - protein, 15 aa, Mycobacterium tuberculosis
PDGTSSAAAALVLRR

SEQ ID NO: 84478 - protein, 15 aa, Mycobacterium tuberculosis
DGTSSAAAALVLRRI

SEQ ID NO: 84479 - protein, 15 aa, Mycobacterium tuberculosis
GTSSAAAALVLRRID

SEQ ID NO: 84480 - protein, 15 aa, Mycobacterium tuberculosis
TSSAAAALVLRRIDV

SEQ ID NO: 84481 - protein, 15 aa, Mycobacterium tuberculosis
SSAAAALVLRRIDVH

SEQ ID NO: 84482 - protein, 15 aa, Mycobacterium tuberculosis
SAAAALVLRRIDVHP

SEQ ID NO: 84483 - protein, 15 aa, Mycobacterium tuberculosis
AAAALVLRRIDVHPL

SEQ ID NO: 84484 - protein, 15 aa, Mycobacterium tuberculosis
AAALVLRRIDVHPLL

SEQ ID NO: 84485 - protein, 15 aa, Mycobacterium tuberculosis
AALVLRRIDVHPLLT

SEQ ID NO: 84486 - protein, 15 aa, Mycobacterium tuberculosis
ALVLRRIDVHPLLTG

SEQ ID NO: 84487 - protein, 15 aa, Mycobacterium tuberculosis
LVLRRIDVHPLLTGL

SEQ ID NO: 84488 - protein, 15 aa, Mycobacterium tuberculosis
VLRRIDVHPLLTGLG

SEQ ID NO: 84489 - protein, 15 aa, Mycobacterium tuberculosis
LRRIDVHPLLTGLGR

SEQ ID NO: 84490 - protein, 15 aa, Mycobacterium tuberculosis
RRIDVHPLLTGLGRG

SEQ ID NO: 84491 - protein, 15 aa, Mycobacterium tuberculosis
RIDVHPLLTGLGRGR

SEQ ID NO: 84492 - protein, 15 aa, Mycobacterium tuberculosis
IDVHPLLTGLGRGRQ

SEQ ID NO: 84493 - protein, 15 aa, Mycobacterium tuberculosis
DVHPLLTGLGRGRQT

SEQ ID NO: 84494 - protein, 15 aa, Mycobacterium tuberculosis
VHPLLTGLGRGRQTV

SEQ ID NO: 84495 - protein, 15 aa, Mycobacterium tuberculosis
HPLLTGLGRGRQTVS

SEQ ID NO: 84496 - protein, 15 aa, Mycobacterium tuberculosis
PLLTGLGRGRQTVSL

SEQ ID NO: 84497 - protein, 15 aa, Mycobacterium tuberculosis
LLTGLGRGRQTVSLR

SEQ ID NO: 84498 - protein, 15 aa, Mycobacterium tuberculosis
LTGLGRGRQTVSLRN

SEQ ID NO: 84499 - protein, 15 aa, Mycobacterium tuberculosis
TGLGRGRQTVSLRNG

SEQ ID NO: 84500 - protein, 15 aa, Mycobacterium tuberculosis
GLGRGRQTVSLRNGH

SEQ ID NO: 84501 - protein, 15 aa, Mycobacterium tuberculosis
LGRGRQTVSLRNGHL

SEQ ID NO: 84502 - protein, 15 aa, Mycobacterium tuberculosis
GRGRQTVSLRNGHLV

SEQ ID NO: 84503 - protein, 15 aa, Mycobacterium tuberculosis
RGRQTVSLRNGHLVA

SEQ ID NO: 84504 - protein, 15 aa, Mycobacterium tuberculosis
GRQTVSLRNGHLVAT

SEQ ID NO: 84505 - protein, 15 aa, Mycobacterium tuberculosis
RQTVSLRNGHLVATA

SEQ ID NO: 84506 - protein, 15 aa, Mycobacterium tuberculosis
QTVSLRNGHLVATAN

SEQ ID NO: 84507 - protein, 15 aa, Mycobacterium tuberculosis
TVSLRNGHLVATANR

SEQ ID NO: 84508 - protein, 15 aa, Mycobacterium tuberculosis
VSLRNGHLVATANRA

SEQ ID NO: 84509 - protein, 15 aa, Mycobacterium tuberculosis
SLRNGHLVATANRAI

SEQ ID NO: 84510 - protein, 15 aa, Mycobacterium tuberculosis
LRNGHLVATANRAIL

SEQ ID NO: 84511 - protein, 15 aa, Mycobacterium tuberculosis
RNGHLVATANRAILS

SEQ ID NO: 84512 - protein, 15 aa, Mycobacterium tuberculosis
NGHLVATANRAILSR

SEQ ID NO: 84513 - protein, 15 aa, Mycobacterium tuberculosis
GHLVATANRAILSRR

SEQ ID NO: 84514 - protein, 15 aa, Mycobacterium tuberculosis
HLVATANRAILSRRR

SEQ ID NO: 84515 - protein, 15 aa, Mycobacterium tuberculosis
LVATANRAILSRRRS

SEQ ID NO: 84516 - protein, 15 aa, Mycobacterium tuberculosis
VATANRAILSRRRSR

SEQ ID NO: 84517 - protein, 15 aa, Mycobacterium tuberculosis
ATANRAILSRRRSRL

SEQ ID NO: 84518 - protein, 15 aa, Mycobacterium tuberculosis
TANRAILSRRRSRLT

SEQ ID NO: 84519 - protein, 15 aa, Mycobacterium tuberculosis
ANRAILSRRRSRLTR

SEQ ID NO: 84520 - protein, 15 aa, Mycobacterium tuberculosis
NRAILSRRRSRLTRG

SEQ ID NO: 84521 - protein, 15 aa, Mycobacterium tuberculosis
RAILSRRRSRLTRGR

SEQ ID NO: 84522 - protein, 15 aa, Mycobacterium tuberculosis
AILSRRRSRLTRGRS

SEQ ID NO: 84523 - protein, 15 aa, Mycobacterium tuberculosis
ILSRRRSRLTRGRSF

SEQ ID NO: 84524 - protein, 15 aa, Mycobacterium tuberculosis
LSRRRSRLTRGRSFT

SEQ ID NO: 84525 - protein, 15 aa, Mycobacterium tuberculosis
SRRRSRLTRGRSFTS

SEQ ID NO: 84526 - protein, 15 aa, Mycobacterium tuberculosis
RRRSRLTRGRSFTSH

SEQ ID NO: 84527 - protein, 15 aa, Mycobacterium tuberculosis
RRSRLTRGRSFTSHL

SEQ ID NO: 84528 - protein, 15 aa, Mycobacterium tuberculosis
RSRLTRGRSFTSHLI

SEQ ID NO: 84529 - protein, 15 aa, Mycobacterium tuberculosis
SRLTRGRSFTSHLIT

SEQ ID NO: 84530 - protein, 15 aa, Mycobacterium tuberculosis
RLTRGRSFTSHLITS

SEQ ID NO: 84531 - protein, 15 aa, Mycobacterium tuberculosis
LTRGRSFTSHLITSC

SEQ ID NO: 84532 - protein, 15 aa, Mycobacterium tuberculosis
TRGRSFTSHLITSCP

SEQ ID NO: 84533 - protein, 15 aa, Mycobacterium tuberculosis
RGRSFTSHLITSCPR

SEQ ID NO: 84534 - protein, 15 aa, Mycobacterium tuberculosis
GRSFTSHLITSCPRL

SEQ ID NO: 84535 - protein, 15 aa, Mycobacterium tuberculosis
RSFTSHLITSCPRLD

SEQ ID NO: 84536 - protein, 15 aa, Mycobacterium tuberculosis
SFTSHLITSCPRLDD

SEQ ID NO: 84537 - protein, 15 aa, Mycobacterium tuberculosis
FTSHLITSCPRLDDH

SEQ ID NO: 84538 - protein, 15 aa, Mycobacterium tuberculosis
TSHLITSCPRLDDHQ

SEQ ID NO: 84539 - protein, 15 aa, Mycobacterium tuberculosis
SHLITSCPRLDDHQH

SEQ ID NO: 84540 - protein, 15 aa, Mycobacterium tuberculosis
HLITSCPRLDDHQHR

SEQ ID NO: 84541 - protein, 15 aa, Mycobacterium tuberculosis
LITSCPRLDDHQHRH

SEQ ID NO: 84542 - protein, 15 aa, Mycobacterium tuberculosis
ITSCPRLDDHQHRHP

SEQ ID NO: 84543 - protein, 15 aa, Mycobacterium tuberculosis
TSCPRLDDHQHRHPT

SEQ ID NO: 84544 - protein, 15 aa, Mycobacterium tuberculosis
SCPRLDDHQHRHPTR

SEQ ID NO: 84545 - protein, 15 aa, Mycobacterium tuberculosis
CPRLDDHQHRHPTRC

SEQ ID NO: 84546 - protein, 15 aa, Mycobacterium tuberculosis
PRLDDHQHRHPTRCR

SEQ ID NO: 84547 - protein, 15 aa, Mycobacterium tuberculosis
RLDDHQHRHPTRCRA

SEQ ID NO: 84548 - protein, 15 aa, Mycobacterium tuberculosis
LDDHQHRHPTRCRAE

SEQ ID NO: 84549 - protein, 15 aa, Mycobacterium tuberculosis
DDHQHRHPTRCRAEH

SEQ ID NO: 84550 - protein, 15 aa, Mycobacterium tuberculosis
DHQHRHPTRCRAEHA

SEQ ID NO: 84551 - protein, 15 aa, Mycobacterium tuberculosis
HQHRHPTRCRAEHAG

SEQ ID NO: 84552 - protein, 15 aa, Mycobacterium tuberculosis
QHRHPTRCRAEHAGC

SEQ ID NO: 84553 - protein, 15 aa, Mycobacterium tuberculosis
HRHPTRCRAEHAGCT

SEQ ID NO: 84554 - protein, 15 aa, Mycobacterium tuberculosis
RHPTRCRAEHAGCTV

SEQ ID NO: 84555 - protein, 15 aa, Mycobacterium tuberculosis
HPTRCRAEHAGCTVA

SEQ ID NO: 84556 - protein, 15 aa, Mycobacterium tuberculosis
PTRCRAEHAGCTVAT

SEQ ID NO: 84557 - protein, 15 aa, Mycobacterium tuberculosis
TRCRAEHAGCTVATC

SEQ ID NO: 84558 - protein, 15 aa, Mycobacterium tuberculosis
RCRAEHAGCTVATCI

SEQ ID NO: 84559 - protein, 15 aa, Mycobacterium tuberculosis
CRAEHAGCTVATCIP

SEQ ID NO: 84560 - protein, 15 aa, Mycobacterium tuberculosis
RAEHAGCTVATCIPN

SEQ ID NO: 84561 - protein, 15 aa, Mycobacterium tuberculosis
AEHAGCTVATCIPNA

SEQ ID NO: 84562 - protein, 15 aa, Mycobacterium tuberculosis
EHAGCTVATCIPNAH

SEQ ID NO: 84563 - protein, 15 aa, Mycobacterium tuberculosis
HAGCTVATCIPNAHD

SEQ ID NO: 84564 - protein, 15 aa, Mycobacterium tuberculosis
AGCTVATCIPNAHDP

SEQ ID NO: 84565 - protein, 15 aa, Mycobacterium tuberculosis
GCTVATCIPNAHDPA

SEQ ID NO: 84566 - protein, 15 aa, Mycobacterium tuberculosis
CTVATCIPNAHDPAP

SEQ ID NO: 84567 - protein, 15 aa, Mycobacterium tuberculosis
TVATCIPNAHDPAPG

SEQ ID NO: 84568 - protein, 15 aa, Mycobacterium tuberculosis
VATCIPNAHDPAPGH

SEQ ID NO: 84569 - protein, 15 aa, Mycobacterium tuberculosis
ATCIPNAHDPAPGHQ

SEQ ID NO: 84570 - protein, 15 aa, Mycobacterium tuberculosis
TCIPNAHDPAPGHQT

SEQ ID NO: 84571 - protein, 15 aa, Mycobacterium tuberculosis
CIPNAHDPAPGHQTP

SEQ ID NO: 84572 - protein, 15 aa, Mycobacterium tuberculosis
IPNAHDPAPGHQTPR

SEQ ID NO: 84573 - protein, 15 aa, Mycobacterium tuberculosis
PNAHDPAPGHQTPRW

SEQ ID NO: 84574 - protein, 15 aa, Mycobacterium tuberculosis
NAHDPAPGHQTPRWG

SEQ ID NO: 84575 - protein, 15 aa, Mycobacterium tuberculosis
AHDPAPGHQTPRWGP

SEQ ID NO: 84576 - protein, 15 aa, Mycobacterium tuberculosis
HDPAPGHQTPRWGPF

SEQ ID NO: 84577 - protein, 15 aa, Mycobacterium tuberculosis
DPAPGHQTPRWGPFR

SEQ ID NO: 84578 - protein, 15 aa, Mycobacterium tuberculosis
PAPGHQTPRWGPFRL

SEQ ID NO: 84579 - protein, 15 aa, Mycobacterium tuberculosis
APGHQTPRWGPFRLK

SEQ ID NO: 84580 - protein, 15 aa, Mycobacterium tuberculosis
PGHQTPRWGPFRLKP

SEQ ID NO: 84581 - protein, 15 aa, Mycobacterium tuberculosis
GHQTPRWGPFRLKPA

SEQ ID NO: 84582 - protein, 15 aa, Mycobacterium tuberculosis
HQTPRWGPFRLKPAY

SEQ ID NO: 84583 - protein, 15 aa, Mycobacterium tuberculosis
QTPRWGPFRLKPAYT

SEQ ID NO: 84584 - protein, 15 aa, Mycobacterium tuberculosis
TPRWGPFRLKPAYTR

SEQ ID NO: 84585 - protein, 16 aa, Mycobacterium tuberculosis
MAAGSGGGTVGLVLPR

SEQ ID NO: 84586 - protein, 16 aa, Mycobacterium tuberculosis
AAGSGGGTVGLVLPRV

SEQ ID NO: 84587 - protein, 16 aa, Mycobacterium tuberculosis
AGSGGGTVGLVLPRVA

SEQ ID NO: 84588 - protein, 16 aa, Mycobacterium tuberculosis
GSGGGTVGLVLPRVAS

SEQ ID NO: 84589 - protein, 16 aa, Mycobacterium tuberculosis
SGGGTVGLVLPRVASL

SEQ ID NO: 84590 - protein, 16 aa, Mycobacterium tuberculosis
GGGTVGLVLPRVASLS

SEQ ID NO: 84591 - protein, 16 aa, Mycobacterium tuberculosis
GGTVGLVLPRVASLSG

SEQ ID NO: 84592 - protein, 16 aa, Mycobacterium tuberculosis
GTVGLVLPRVASLSGL

SEQ ID NO: 84593 - protein, 16 aa, Mycobacterium tuberculosis
TVGLVLPRVASLSGLD

SEQ ID NO: 84594 - protein, 16 aa, Mycobacterium tuberculosis
VGLVLPRVASLSGLDG

SEQ ID NO: 84595 - protein, 16 aa, Mycobacterium tuberculosis
GLVLPRVASLSGLDGA

SEQ ID NO: 84596 - protein, 16 aa, Mycobacterium tuberculosis
LVLPRVASLSGLDGAP

SEQ ID NO: 84597 - protein, 16 aa, Mycobacterium tuberculosis
VLPRVASLSGLDGAPT

SEQ ID NO: 84598 - protein, 16 aa, Mycobacterium tuberculosis
LPRVASLSGLDGAPTV

SEQ ID NO: 84599 - protein, 16 aa, Mycobacterium tuberculosis
PRVASLSGLDGAPTVP

SEQ ID NO: 84600 - protein, 16 aa, Mycobacterium tuberculosis
RVASLSGLDGAPTVPE

SEQ ID NO: 84601 - protein, 16 aa, Mycobacterium tuberculosis
VASLSGLDGAPTVPEG

SEQ ID NO: 84602 - protein, 16 aa, Mycobacterium tuberculosis
ASLSGLDGAPTVPEGS

SEQ ID NO: 84603 - protein, 16 aa, Mycobacterium tuberculosis
SLSGLDGAPTVPEGSD

SEQ ID NO: 84604 - protein, 16 aa, Mycobacterium tuberculosis
LSGLDGAPTVPEGSDK

SEQ ID NO: 84605 - protein, 16 aa, Mycobacterium tuberculosis
SGLDGAPTVPEGSDKA

SEQ ID NO: 84606 - protein, 16 aa, Mycobacterium tuberculosis
GLDGAPTVPEGSDKAL

SEQ ID NO: 84607 - protein, 16 aa, Mycobacterium tuberculosis
LDGAPTVPEGSDKALM

SEQ ID NO: 84608 - protein, 16 aa, Mycobacterium tuberculosis
DGAPTVPEGSDKALMH

SEQ ID NO: 84609 - protein, 16 aa, Mycobacterium tuberculosis
GAPTVPEGSDKALMHL

SEQ ID NO: 84610 - protein, 16 aa, Mycobacterium tuberculosis
APTVPEGSDKALMHLG

SEQ ID NO: 84611 - protein, 16 aa, Mycobacterium tuberculosis
PTVPEGSDKALMHLGD

SEQ ID NO: 84612 - protein, 16 aa, Mycobacterium tuberculosis
TVPEGSDKALMHLGDP

SEQ ID NO: 84613 - protein, 16 aa, Mycobacterium tuberculosis
VPEGSDKALMHLGDPP

SEQ ID NO: 84614 - protein, 16 aa, Mycobacterium tuberculosis
PEGSDKALMHLGDPPR

SEQ ID NO: 84615 - protein, 16 aa, Mycobacterium tuberculosis
EGSDKALMHLGDPPRR

SEQ ID NO: 84616 - protein, 16 aa, Mycobacterium tuberculosis
GSDKALMHLGDPPRRC

SEQ ID NO: 84617 - protein, 16 aa, Mycobacterium tuberculosis
SDKALMHLGDPPRRCD

SEQ ID NO: 84618 - protein, 16 aa, Mycobacterium tuberculosis
DKALMHLGDPPRRCDT

SEQ ID NO: 84619 - protein, 16 aa, Mycobacterium tuberculosis
KALMHLGDPPRRCDTH

SEQ ID NO: 84620 - protein, 16 aa, Mycobacterium tuberculosis
ALMHLGDPPRRCDTHP

SEQ ID NO: 84621 - protein, 16 aa, Mycobacterium tuberculosis
LMHLGDPPRRCDTHPD

SEQ ID NO: 84622 - protein, 16 aa, Mycobacterium tuberculosis
MHLGDPPRRCDTHPDG

SEQ ID NO: 84623 - protein, 16 aa, Mycobacterium tuberculosis
HLGDPPRRCDTHPDGT

SEQ ID NO: 84624 - protein, 16 aa, Mycobacterium tuberculosis
LGDPPRRCDTHPDGTS

SEQ ID NO: 84625 - protein, 16 aa, Mycobacterium tuberculosis
GDPPRRCDTHPDGTSS

SEQ ID NO: 84626 - protein, 16 aa, Mycobacterium tuberculosis
DPPRRCDTHPDGTSSA

SEQ ID NO: 84627 - protein, 16 aa, Mycobacterium tuberculosis
PPRRCDTHPDGTSSAA

SEQ ID NO: 84628 - protein, 16 aa, Mycobacterium tuberculosis
PRRCDTHPDGTSSAAA

SEQ ID NO: 84629 - protein, 16 aa, Mycobacterium tuberculosis
RRCDTHPDGTSSAAAA

SEQ ID NO: 84630 - protein, 16 aa, Mycobacterium tuberculosis
RCDTHPDGTSSAAAAL

SEQ ID NO: 84631 - protein, 16 aa, Mycobacterium tuberculosis
CDTHPDGTSSAAAALV

SEQ ID NO: 84632 - protein, 16 aa, Mycobacterium tuberculosis
DTHPDGTSSAAAALVL

SEQ ID NO: 84633 - protein, 16 aa, Mycobacterium tuberculosis
THPDGTSSAAAALVLR

SEQ ID NO: 84634 - protein, 16 aa, Mycobacterium tuberculosis
HPDGTSSAAAALVLRR

SEQ ID NO: 84635 - protein, 16 aa, Mycobacterium tuberculosis
PDGTSSAAAALVLRRI

SEQ ID NO: 84636 - protein, 16 aa, Mycobacterium tuberculosis
DGTSSAAAALVLRRID

SEQ ID NO: 84637 - protein, 16 aa, Mycobacterium tuberculosis
GTSSAAAALVLRRIDV

SEQ ID NO: 84638 - protein, 16 aa, Mycobacterium tuberculosis
TSSAAAALVLRRIDVH

SEQ ID NO: 84639 - protein, 16 aa, Mycobacterium tuberculosis
SSAAAALVLRRIDVHP

SEQ ID NO: 84640 - protein, 16 aa, Mycobacterium tuberculosis
SAAAALVLRRIDVHPL

SEQ ID NO: 84641 - protein, 16 aa, Mycobacterium tuberculosis
AAAALVLRRIDVHPLL

SEQ ID NO: 84642 - protein, 16 aa, Mycobacterium tuberculosis
AAALVLRRIDVHPLLT

SEQ ID NO: 84643 - protein, 16 aa, Mycobacterium tuberculosis
AALVLRRIDVHPLLTG

SEQ ID NO: 84644 - protein, 16 aa, Mycobacterium tuberculosis
ALVLRRIDVHPLLTGL

SEQ ID NO: 84645 - protein, 16 aa, Mycobacterium tuberculosis
LVLRRIDVHPLLTGLG

SEQ ID NO: 84646 - protein, 16 aa, Mycobacterium tuberculosis
VLRRIDVHPLLTGLGR

SEQ ID NO: 84647 - protein, 16 aa, Mycobacterium tuberculosis
LRRIDVHPLLTGLGRG

SEQ ID NO: 84648 - protein, 16 aa, Mycobacterium tuberculosis
RRIDVHPLLTGLGRGR

SEQ ID NO: 84649 - protein, 16 aa, Mycobacterium tuberculosis
RIDVHPLLTGLGRGRQ

SEQ ID NO: 84650 - protein, 16 aa, Mycobacterium tuberculosis
IDVHPLLTGLGRGRQT

SEQ ID NO: 84651 - protein, 16 aa, Mycobacterium tuberculosis
DVHPLLTGLGRGRQTV

SEQ ID NO: 84652 - protein, 16 aa, Mycobacterium tuberculosis
VHPLLTGLGRGRQTVS

SEQ ID NO: 84653 - protein, 16 aa, Mycobacterium tuberculosis
HPLLTGLGRGRQTVSL

SEQ ID NO: 84654 - protein, 16 aa, Mycobacterium tuberculosis
PLLTGLGRGRQTVSLR

SEQ ID NO: 84655 - protein, 16 aa, Mycobacterium tuberculosis
LLTGLGRGRQTVSLRN

SEQ ID NO: 84656 - protein, 16 aa, Mycobacterium tuberculosis
LTGLGRGRQTVSLRNG

SEQ ID NO: 84657 - protein, 16 aa, Mycobacterium tuberculosis
TGLGRGRQTVSLRNGH

SEQ ID NO: 84658 - protein, 16 aa, Mycobacterium tuberculosis
GLGRGRQTVSLRNGHL

SEQ ID NO: 84659 - protein, 16 aa, Mycobacterium tuberculosis
LGRGRQTVSLRNGHLV

SEQ ID NO: 84660 - protein, 16 aa, Mycobacterium tuberculosis
GRGRQTVSLRNGHLVA

SEQ ID NO: 84661 - protein, 16 aa, Mycobacterium tuberculosis
RGRQTVSLRNGHLVAT

SEQ ID NO: 84662 - protein, 16 aa, Mycobacterium tuberculosis
GRQTVSLRNGHLVATA

SEQ ID NO: 84663 - protein, 16 aa, Mycobacterium tuberculosis
RQTVSLRNGHLVATAN

SEQ ID NO: 84664 - protein, 16 aa, Mycobacterium tuberculosis
QTVSLRNGHLVATANR

SEQ ID NO: 84665 - protein, 16 aa, Mycobacterium tuberculosis
TVSLRNGHLVATANRA

SEQ ID NO: 84666 - protein, 16 aa, Mycobacterium tuberculosis
VSLRNGHLVATANRAI

SEQ ID NO: 84667 - protein, 16 aa, Mycobacterium tuberculosis
SLRNGHLVATANRAIL

SEQ ID NO: 84668 - protein, 16 aa, Mycobacterium tuberculosis
LRNGHLVATANRAILS

SEQ ID NO: 84669 - protein, 16 aa, Mycobacterium tuberculosis
RNGHLVATANRAILSR

SEQ ID NO: 84670 - protein, 16 aa, Mycobacterium tuberculosis
NGHLVATANRAILSRR

SEQ ID NO: 84671 - protein, 16 aa, Mycobacterium tuberculosis
GHLVATANRAILSRRR

SEQ ID NO: 84672 - protein, 16 aa, Mycobacterium tuberculosis
HLVATANRAILSRRRS

SEQ ID NO: 84673 - protein, 16 aa, Mycobacterium tuberculosis
LVATANRAILSRRRSR

SEQ ID NO: 84674 - protein, 16 aa, Mycobacterium tuberculosis
VATANRAILSRRRSRL

SEQ ID NO: 84675 - protein, 16 aa, Mycobacterium tuberculosis
ATANRAILSRRRSRLT

SEQ ID NO: 84676 - protein, 16 aa, Mycobacterium tuberculosis
TANRAILSRRRSRLTR

SEQ ID NO: 84677 - protein, 16 aa, Mycobacterium tuberculosis
ANRAILSRRRSRLTRG

SEQ ID NO: 84678 - protein, 16 aa, Mycobacterium tuberculosis
NRAILSRRRSRLTRGR

SEQ ID NO: 84679 - protein, 16 aa, Mycobacterium tuberculosis
RAILSRRRSRLTRGRS

SEQ ID NO: 84680 - protein, 16 aa, Mycobacterium tuberculosis
AILSRRRSRLTRGRSF

SEQ ID NO: 84681 - protein, 16 aa, Mycobacterium tuberculosis
ILSRRRSRLTRGRSFT

SEQ ID NO: 84682 - protein, 16 aa, Mycobacterium tuberculosis
LSRRRSRLTRGRSFTS

SEQ ID NO: 84683 - protein, 16 aa, Mycobacterium tuberculosis
SRRRSRLTRGRSFTSH

SEQ ID NO: 84684 - protein, 16 aa, Mycobacterium tuberculosis
RRRSRLTRGRSFTSHL

SEQ ID NO: 84685 - protein, 16 aa, Mycobacterium tuberculosis
RRSRLTRGRSFTSHLI

SEQ ID NO: 84686 - protein, 16 aa, Mycobacterium tuberculosis
RSRLTRGRSFTSHLIT

SEQ ID NO: 84687 - protein, 16 aa, Mycobacterium tuberculosis
SRLTRGRSFTSHLITS

SEQ ID NO: 84688 - protein, 16 aa, Mycobacterium tuberculosis
RLTRGRSFTSHLITSC

SEQ ID NO: 84689 - protein, 16 aa, Mycobacterium tuberculosis
LTRGRSFTSHLITSCP

SEQ ID NO: 84690 - protein, 16 aa, Mycobacterium tuberculosis
TRGRSFTSHLITSCPR

SEQ ID NO: 84691 - protein, 16 aa, Mycobacterium tuberculosis
RGRSFTSHLITSCPRL

SEQ ID NO: 84692 - protein, 16 aa, Mycobacterium tuberculosis
GRSFTSHLITSCPRLD

SEQ ID NO: 84693 - protein, 16 aa, Mycobacterium tuberculosis
RSFTSHLITSCPRLDD

SEQ ID NO: 84694 - protein, 16 aa, Mycobacterium tuberculosis
SFTSHLITSCPRLDDH

SEQ ID NO: 84695 - protein, 16 aa, Mycobacterium tuberculosis
FTSHLITSCPRLDDHQ

SEQ ID NO: 84696 - protein, 16 aa, Mycobacterium tuberculosis
TSHLITSCPRLDDHQH

SEQ ID NO: 84697 - protein, 16 aa, Mycobacterium tuberculosis
SHLITSCPRLDDHQHR

SEQ ID NO: 84698 - protein, 16 aa, Mycobacterium tuberculosis
HLITSCPRLDDHQHRH

SEQ ID NO: 84699 - protein, 16 aa, Mycobacterium tuberculosis
LITSCPRLDDHQHRHP

SEQ ID NO: 84700 - protein, 16 aa, Mycobacterium tuberculosis
ITSCPRLDDHQHRHPT

SEQ ID NO: 84701 - protein, 16 aa, Mycobacterium tuberculosis
TSCPRLDDHQHRHPTR

SEQ ID NO: 84702 - protein, 16 aa, Mycobacterium tuberculosis
SCPRLDDHQHRHPTRC

SEQ ID NO: 84703 - protein, 16 aa, Mycobacterium tuberculosis
CPRLDDHQHRHPTRCR

SEQ ID NO: 84704 - protein, 16 aa, Mycobacterium tuberculosis
PRLDDHQHRHPTRCRA

SEQ ID NO: 84705 - protein, 16 aa, Mycobacterium tuberculosis
RLDDHQHRHPTRCRAE

SEQ ID NO: 84706 - protein, 16 aa, Mycobacterium tuberculosis
LDDHQHRHPTRCRAEH

SEQ ID NO: 84707 - protein, 16 aa, Mycobacterium tuberculosis
DDHQHRHPTRCRAEHA

SEQ ID NO: 84708 - protein, 16 aa, Mycobacterium tuberculosis
DHQHRHPTRCRAEHAG

SEQ ID NO: 84709 - protein, 16 aa, Mycobacterium tuberculosis
HQHRHPTRCRAEHAGC

SEQ ID NO: 84710 - protein, 16 aa, Mycobacterium tuberculosis
QHRHPTRCRAEHAGCT

SEQ ID NO: 84711 - protein, 16 aa, Mycobacterium tuberculosis
HRHPTRCRAEHAGCTV

SEQ ID NO: 84712 - protein, 16 aa, Mycobacterium tuberculosis
RHPTRCRAEHAGCTVA

SEQ ID NO: 84713 - protein, 16 aa, Mycobacterium tuberculosis
HPTRCRAEHAGCTVAT

SEQ ID NO: 84714 - protein, 16 aa, Mycobacterium tuberculosis
PTRCRAEHAGCTVATC

SEQ ID NO: 84715 - protein, 16 aa, Mycobacterium tuberculosis
TRCRAEHAGCTVATCI

SEQ ID NO: 84716 - protein, 16 aa, Mycobacterium tuberculosis
RCRAEHAGCTVATCIP

SEQ ID NO: 84717 - protein, 16 aa, Mycobacterium tuberculosis
CRAEHAGCTVATCIPN

SEQ ID NO: 84718 - protein, 16 aa, Mycobacterium tuberculosis
RAEHAGCTVATCIPNA

SEQ ID NO: 84719 - protein, 16 aa, Mycobacterium tuberculosis
AEHAGCTVATCIPNAH

SEQ ID NO: 84720 - protein, 16 aa, Mycobacterium tuberculosis
EHAGCTVATCIPNAHD

SEQ ID NO: 84721 - protein, 16 aa, Mycobacterium tuberculosis
HAGCTVATCIPNAHDP

SEQ ID NO: 84722 - protein, 16 aa, Mycobacterium tuberculosis
AGCTVATCIPNAHDPA

SEQ ID NO: 84723 - protein, 16 aa, Mycobacterium tuberculosis
GCTVATCIPNAHDPAP

SEQ ID NO: 84724 - protein, 16 aa, Mycobacterium tuberculosis
CTVATCIPNAHDPAPG

SEQ ID NO: 84725 - protein, 16 aa, Mycobacterium tuberculosis
TVATCIPNAHDPAPGH

SEQ ID NO: 84726 - protein, 16 aa, Mycobacterium tuberculosis
VATCIPNAHDPAPGHQ

SEQ ID NO: 84727 - protein, 16 aa, Mycobacterium tuberculosis
ATCIPNAHDPAPGHQT

SEQ ID NO: 84728 - protein, 16 aa, Mycobacterium tuberculosis
TCIPNAHDPAPGHQTP

SEQ ID NO: 84729 - protein, 16 aa, Mycobacterium tuberculosis
CIPNAHDPAPGHQTPR

SEQ ID NO: 84730 - protein, 16 aa, Mycobacterium tuberculosis
IPNAHDPAPGHQTPRW

SEQ ID NO: 84731 - protein, 16 aa, Mycobacterium tuberculosis
PNAHDPAPGHQTPRWG

SEQ ID NO: 84732 - protein, 16 aa, Mycobacterium tuberculosis
NAHDPAPGHQTPRWGP

SEQ ID NO: 84733 - protein, 16 aa, Mycobacterium tuberculosis
AHDPAPGHQTPRWGPF

SEQ ID NO: 84734 - protein, 16 aa, Mycobacterium tuberculosis
HDPAPGHQTPRWGPFR

SEQ ID NO: 84735 - protein, 16 aa, Mycobacterium tuberculosis
DPAPGHQTPRWGPFRL

SEQ ID NO: 84736 - protein, 16 aa, Mycobacterium tuberculosis
PAPGHQTPRWGPFRLK

SEQ ID NO: 84737 - protein, 16 aa, Mycobacterium tuberculosis
APGHQTPRWGPFRLKP

SEQ ID NO: 84738 - protein, 16 aa, Mycobacterium tuberculosis
PGHQTPRWGPFRLKPA

SEQ ID NO: 84739 - protein, 16 aa, Mycobacterium tuberculosis
GHQTPRWGPFRLKPAY

SEQ ID NO: 84740 - protein, 16 aa, Mycobacterium tuberculosis
HQTPRWGPFRLKPAYT

SEQ ID NO: 84741 - protein, 16 aa, Mycobacterium tuberculosis
QTPRWGPFRLKPAYTR

SEQ ID NO: 84742 - protein, 16 aa, Mycobacterium tuberculosis
TPRWGPFRLKPAYTRI

SEQ ID NO: 84743 - protein, 13 aa, Mycobacterium tuberculosis
MPSGWVSHRLGGS

SEQ ID NO: 84744 - protein, 13 aa, Mycobacterium tuberculosis
PSGWVSHRLGGSP

SEQ ID NO: 84745 - protein, 13 aa, Mycobacterium tuberculosis
SGWVSHRLGGSPK

SEQ ID NO: 84746 - protein, 13 aa, Mycobacterium tuberculosis
GWVSHRLGGSPKC

SEQ ID NO: 84747 - protein, 13 aa, Mycobacterium tuberculosis
WVSHRLGGSPKCI

SEQ ID NO: 84748 - protein, 13 aa, Mycobacterium tuberculosis
VSHRLGGSPKCIS

SEQ ID NO: 84749 - protein, 13 aa, Mycobacterium tuberculosis
SHRLGGSPKCISA

SEQ ID NO: 84750 - protein, 13 aa, Mycobacterium tuberculosis
HRLGGSPKCISAL

SEQ ID NO: 84751 - protein, 13 aa, Mycobacterium tuberculosis
RLGGSPKCISALS

SEQ ID NO: 84752 - protein, 13 aa, Mycobacterium tuberculosis
LGGSPKCISALSL

SEQ ID NO: 84753 - protein, 13 aa, Mycobacterium tuberculosis
GGSPKCISALSLP

SEQ ID NO: 84754 - protein, 13 aa, Mycobacterium tuberculosis
GSPKCISALSLPS

SEQ ID NO: 84755 - protein, 13 aa, Mycobacterium tuberculosis
SPKCISALSLPSG

SEQ ID NO: 84756 - protein, 13 aa, Mycobacterium tuberculosis
PKCISALSLPSGT

SEQ ID NO: 84757 - protein, 13 aa, Mycobacterium tuberculosis
KCISALSLPSGTV

SEQ ID NO: 84758 - protein, 13 aa, Mycobacterium tuberculosis
CISALSLPSGTVG

SEQ ID NO: 84759 - protein, 13 aa, Mycobacterium tuberculosis
ISALSLPSGTVGA

SEQ ID NO: 84760 - protein, 13 aa, Mycobacterium tuberculosis
SALSLPSGTVGAP

SEQ ID NO: 84761 - protein, 13 aa, Mycobacterium tuberculosis
ALSLPSGTVGAPS

SEQ ID NO: 84762 - protein, 13 aa, Mycobacterium tuberculosis
LSLPSGTVGAPSK

SEQ ID NO: 84763 - protein, 13 aa, Mycobacterium tuberculosis
SLPSGTVGAPSKP

SEQ ID NO: 84764 - protein, 13 aa, Mycobacterium tuberculosis
LPSGTVGAPSKPD

SEQ ID NO: 84765 - protein, 13 aa, Mycobacterium tuberculosis
PSGTVGAPSKPDN

SEQ ID NO: 84766 - protein, 13 aa, Mycobacterium tuberculosis
SGTVGAPSKPDND

SEQ ID NO: 84767 - protein, 13 aa, Mycobacterium tuberculosis
GTVGAPSKPDNDA

SEQ ID NO: 84768 - protein, 13 aa, Mycobacterium tuberculosis
TVGAPSKPDNDAT

SEQ ID NO: 84769 - protein, 13 aa, Mycobacterium tuberculosis
VGAPSKPDNDATR

SEQ ID NO: 84770 - protein, 13 aa, Mycobacterium tuberculosis
GAPSKPDNDATRG

SEQ ID NO: 84771 - protein, 13 aa, Mycobacterium tuberculosis
APSKPDNDATRGR

SEQ ID NO: 84772 - protein, 13 aa, Mycobacterium tuberculosis
PSKPDNDATRGRT

SEQ ID NO: 84773 - protein, 13 aa, Mycobacterium tuberculosis
SKPDNDATRGRTR

SEQ ID NO: 84774 - protein, 13 aa, Mycobacterium tuberculosis
KPDNDATRGRTRP

SEQ ID NO: 84775 - protein, 13 aa, Mycobacterium tuberculosis
PDNDATRGRTRPT

SEQ ID NO: 84776 - protein, 13 aa, Mycobacterium tuberculosis
DNDATRGRTRPTV

SEQ ID NO: 84777 - protein, 13 aa, Mycobacterium tuberculosis
NDATRGRTRPTVP

SEQ ID NO: 84778 - protein, 13 aa, Mycobacterium tuberculosis
DATRGRTRPTVPP

SEQ ID NO: 84779 - protein, 13 aa, Mycobacterium tuberculosis
ATRGRTRPTVPPP

SEQ ID NO: 84780 - protein, 13 aa, Mycobacterium tuberculosis
TRGRTRPTVPPPD

SEQ ID NO: 84781 - protein, 13 aa, Mycobacterium tuberculosis
RGRTRPTVPPPDP

SEQ ID NO: 84782 - protein, 13 aa, Mycobacterium tuberculosis
GRTRPTVPPPDPA

SEQ ID NO: 84783 - protein, 13 aa, Mycobacterium tuberculosis
RTRPTVPPPDPAA

SEQ ID NO: 84784 - protein, 13 aa, Mycobacterium tuberculosis
TRPTVPPPDPAAM

SEQ ID NO: 84785 - protein, 13 aa, Mycobacterium tuberculosis
RPTVPPPDPAAMG

SEQ ID NO: 84786 - protein, 13 aa, Mycobacterium tuberculosis
PTVPPPDPAAMGT

SEQ ID NO: 84787 - protein, 13 aa, Mycobacterium tuberculosis
TVPPPDPAAMGTW

SEQ ID NO: 84788 - protein, 13 aa, Mycobacterium tuberculosis
VPPPDPAAMGTWK

SEQ ID NO: 84789 - protein, 13 aa, Mycobacterium tuberculosis
PPPDPAAMGTWKF

SEQ ID NO: 84790 - protein, 13 aa, Mycobacterium tuberculosis
PPDPAAMGTWKFF

SEQ ID NO: 84791 - protein, 13 aa, Mycobacterium tuberculosis
PDPAAMGTWKFFR

SEQ ID NO: 84792 - protein, 13 aa, Mycobacterium tuberculosis
DPAAMGTWKFFRA

SEQ ID NO: 84793 - protein, 13 aa, Mycobacterium tuberculosis
PAAMGTWKFFRAS

SEQ ID NO: 84794 - protein, 13 aa, Mycobacterium tuberculosis
AAMGTWKFFRASV

SEQ ID NO: 84795 - protein, 13 aa, Mycobacterium tuberculosis
AMGTWKFFRASVD

SEQ ID NO: 84796 - protein, 13 aa, Mycobacterium tuberculosis
MGTWKFFRASVDG

SEQ ID NO: 84797 - protein, 13 aa, Mycobacterium tuberculosis
GTWKFFRASVDGR

SEQ ID NO: 84798 - protein, 13 aa, Mycobacterium tuberculosis
TWKFFRASVDGRP

SEQ ID NO: 84799 - protein, 13 aa, Mycobacterium tuberculosis
WKFFRASVDGRPV

SEQ ID NO: 84800 - protein, 13 aa, Mycobacterium tuberculosis
KFFRASVDGRPVF

SEQ ID NO: 84801 - protein, 13 aa, Mycobacterium tuberculosis
FFRASVDGRPVFK

SEQ ID NO: 84802 - protein, 13 aa, Mycobacterium tuberculosis
FRASVDGRPVFKK

SEQ ID NO: 84803 - protein, 13 aa, Mycobacterium tuberculosis
RASVDGRPVFKKE

SEQ ID NO: 84804 - protein, 13 aa, Mycobacterium tuberculosis
ASVDGRPVFKKEF

SEQ ID NO: 84805 - protein, 13 aa, Mycobacterium tuberculosis
SVDGRPVFKKEFD

SEQ ID NO: 84806 - protein, 13 aa, Mycobacterium tuberculosis
VDGRPVFKKEFDK

SEQ ID NO: 84807 - protein, 13 aa, Mycobacterium tuberculosis
DGRPVFKKEFDKL

SEQ ID NO: 84808 - protein, 13 aa, Mycobacterium tuberculosis
GRPVFKKEFDKLP

SEQ ID NO: 84809 - protein, 13 aa, Mycobacterium tuberculosis
RPVFKKEFDKLPD

SEQ ID NO: 84810 - protein, 13 aa, Mycobacterium tuberculosis
PVFKKEFDKLPDQ

SEQ ID NO: 84811 - protein, 13 aa, Mycobacterium tuberculosis
VFKKEFDKLPDQA

SEQ ID NO: 84812 - protein, 13 aa, Mycobacterium tuberculosis
FKKEFDKLPDQAR

SEQ ID NO: 84813 - protein, 13 aa, Mycobacterium tuberculosis
KKEFDKLPDQARA

SEQ ID NO: 84814 - protein, 13 aa, Mycobacterium tuberculosis
KEFDKLPDQARAA

SEQ ID NO: 84815 - protein, 13 aa, Mycobacterium tuberculosis
EFDKLPDQARAAL

SEQ ID NO: 84816 - protein, 13 aa, Mycobacterium tuberculosis
FDKLPDQARAALI

SEQ ID NO: 84817 - protein, 13 aa, Mycobacterium tuberculosis
DKLPDQARAALIV

SEQ ID NO: 84818 - protein, 13 aa, Mycobacterium tuberculosis
KLPDQARAALIVL

SEQ ID NO: 84819 - protein, 13 aa, Mycobacterium tuberculosis
LPDQARAALIVLM

SEQ ID NO: 84820 - protein, 13 aa, Mycobacterium tuberculosis
PDQARAALIVLMQ

SEQ ID NO: 84821 - protein, 13 aa, Mycobacterium tuberculosis
DQARAALIVLMQR

SEQ ID NO: 84822 - protein, 13 aa, Mycobacterium tuberculosis
QARAALIVLMQRY

SEQ ID NO: 84823 - protein, 13 aa, Mycobacterium tuberculosis
ARAALIVLMQRYL

SEQ ID NO: 84824 - protein, 13 aa, Mycobacterium tuberculosis
RAALIVLMQRYLV

SEQ ID NO: 84825 - protein, 13 aa, Mycobacterium tuberculosis
AALIVLMQRYLVG

SEQ ID NO: 84826 - protein, 13 aa, Mycobacterium tuberculosis
ALIVLMQRYLVGD

SEQ ID NO: 84827 - protein, 13 aa, Mycobacterium tuberculosis
LIVLMQRYLVGDL

SEQ ID NO: 84828 - protein, 13 aa, Mycobacterium tuberculosis
IVLMQRYLVGDLA

SEQ ID NO: 84829 - protein, 13 aa, Mycobacterium tuberculosis
VLMQRYLVGDLAA

SEQ ID NO: 84830 - protein, 13 aa, Mycobacterium tuberculosis
LMQRYLVGDLAAG

SEQ ID NO: 84831 - protein, 13 aa, Mycobacterium tuberculosis
MQRYLVGDLAAGS

SEQ ID NO: 84832 - protein, 13 aa, Mycobacterium tuberculosis
QRYLVGDLAAGSI

SEQ ID NO: 84833 - protein, 13 aa, Mycobacterium tuberculosis
RYLVGDLAAGSIK

SEQ ID NO: 84834 - protein, 13 aa, Mycobacterium tuberculosis
YLVGDLAAGSIKP

SEQ ID NO: 84835 - protein, 13 aa, Mycobacterium tuberculosis
LVGDLAAGSIKPI

SEQ ID NO: 84836 - protein, 13 aa, Mycobacterium tuberculosis
VGDLAAGSIKPIR

SEQ ID NO: 84837 - protein, 13 aa, Mycobacterium tuberculosis
GDLAAGSIKPIRG

SEQ ID NO: 84838 - protein, 13 aa, Mycobacterium tuberculosis
DLAAGSIKPIRGD

SEQ ID NO: 84839 - protein, 13 aa, Mycobacterium tuberculosis
LAAGSIKPIRGDI

SEQ ID NO: 84840 - protein, 13 aa, Mycobacterium tuberculosis
AAGSIKPIRGDIL

SEQ ID NO: 84841 - protein, 13 aa, Mycobacterium tuberculosis
AGSIKPIRGDILE

SEQ ID NO: 84842 - protein, 13 aa, Mycobacterium tuberculosis
GSIKPIRGDILEL

SEQ ID NO: 84843 - protein, 13 aa, Mycobacterium tuberculosis
SIKPIRGDILELR

SEQ ID NO: 84844 - protein, 13 aa, Mycobacterium tuberculosis
IKPIRGDILELRW

SEQ ID NO: 84845 - protein, 13 aa, Mycobacterium tuberculosis
KPIRGDILELRWH

SEQ ID NO: 84846 - protein, 13 aa, Mycobacterium tuberculosis
PIRGDILELRWHE

SEQ ID NO: 84847 - protein, 13 aa, Mycobacterium tuberculosis
IRGDILELRWHEA

SEQ ID NO: 84848 - protein, 13 aa, Mycobacterium tuberculosis
RGDILELRWHEAN

SEQ ID NO: 84849 - protein, 13 aa, Mycobacterium tuberculosis
GDILELRWHEANN

SEQ ID NO: 84850 - protein, 13 aa, Mycobacterium tuberculosis
DILELRWHEANNH

SEQ ID NO: 84851 - protein, 13 aa, Mycobacterium tuberculosis
ILELRWHEANNHF

SEQ ID NO: 84852 - protein, 13 aa, Mycobacterium tuberculosis
LELRWHEANNHFR

SEQ ID NO: 84853 - protein, 13 aa, Mycobacterium tuberculosis
ELRWHEANNHFRV

SEQ ID NO: 84854 - protein, 13 aa, Mycobacterium tuberculosis
LRWHEANNHFRVL

SEQ ID NO: 84855 - protein, 13 aa, Mycobacterium tuberculosis
RWHEANNHFRVLF

SEQ ID NO: 84856 - protein, 13 aa, Mycobacterium tuberculosis
WHEANNHFRVLFF

SEQ ID NO: 84857 - protein, 13 aa, Mycobacterium tuberculosis
HEANNHFRVLFFR

SEQ ID NO: 84858 - protein, 13 aa, Mycobacterium tuberculosis
EANNHFRVLFFRW

SEQ ID NO: 84859 - protein, 13 aa, Mycobacterium tuberculosis
ANNHFRVLFFRWG

SEQ ID NO: 84860 - protein, 13 aa, Mycobacterium tuberculosis
NNHFRVLFFRWGQ

SEQ ID NO: 84861 - protein, 13 aa, Mycobacterium tuberculosis
NHFRVLFFRWGQH

SEQ ID NO: 84862 - protein, 13 aa, Mycobacterium tuberculosis
HFRVLFFRWGQHP

SEQ ID NO: 84863 - protein, 13 aa, Mycobacterium tuberculosis
FRVLFFRWGQHPV

SEQ ID NO: 84864 - protein, 13 aa, Mycobacterium tuberculosis
RVLFFRWGQHPVA

SEQ ID NO: 84865 - protein, 13 aa, Mycobacterium tuberculosis
VLFFRWGQHPVAL

SEQ ID NO: 84866 - protein, 13 aa, Mycobacterium tuberculosis
LFFRWGQHPVALT

SEQ ID NO: 84867 - protein, 13 aa, Mycobacterium tuberculosis
FFRWGQHPVALTA

SEQ ID NO: 84868 - protein, 13 aa, Mycobacterium tuberculosis
FRWGQHPVALTAF

SEQ ID NO: 84869 - protein, 13 aa, Mycobacterium tuberculosis
RWGQHPVALTAFY

SEQ ID NO: 84870 - protein, 13 aa, Mycobacterium tuberculosis
WGQHPVALTAFYK

SEQ ID NO: 84871 - protein, 13 aa, Mycobacterium tuberculosis
GQHPVALTAFYKN

SEQ ID NO: 84872 - protein, 13 aa, Mycobacterium tuberculosis
QHPVALTAFYKNQ

SEQ ID NO: 84873 - protein, 13 aa, Mycobacterium tuberculosis
HPVALTAFYKNQQ

SEQ ID NO: 84874 - protein, 13 aa, Mycobacterium tuberculosis
PVALTAFYKNQQK

SEQ ID NO: 84875 - protein, 13 aa, Mycobacterium tuberculosis
VALTAFYKNQQKT

SEQ ID NO: 84876 - protein, 13 aa, Mycobacterium tuberculosis
ALTAFYKNQQKTP

SEQ ID NO: 84877 - protein, 13 aa, Mycobacterium tuberculosis
LTAFYKNQQKTPK

SEQ ID NO: 84878 - protein, 13 aa, Mycobacterium tuberculosis
TAFYKNQQKTPKT

SEQ ID NO: 84879 - protein, 13 aa, Mycobacterium tuberculosis
AFYKNQQKTPKTK

SEQ ID NO: 84880 - protein, 13 aa, Mycobacterium tuberculosis
FYKNQQKTPKTKI

SEQ ID NO: 84881 - protein, 13 aa, Mycobacterium tuberculosis
YKNQQKTPKTKIE

SEQ ID NO: 84882 - protein, 13 aa, Mycobacterium tuberculosis
KNQQKTPKTKIET

SEQ ID NO: 84883 - protein, 13 aa, Mycobacterium tuberculosis
NQQKTPKTKIETA

SEQ ID NO: 84884 - protein, 13 aa, Mycobacterium tuberculosis
QQKTPKTKIETAL

SEQ ID NO: 84885 - protein, 13 aa, Mycobacterium tuberculosis
QKTPKTKIETALD

SEQ ID NO: 84886 - protein, 13 aa, Mycobacterium tuberculosis
KTPKTKIETALDR

SEQ ID NO: 84887 - protein, 13 aa, Mycobacterium tuberculosis
TPKTKIETALDRQ

SEQ ID NO: 84888 - protein, 13 aa, Mycobacterium tuberculosis
PKTKIETALDRQK

SEQ ID NO: 84889 - protein, 13 aa, Mycobacterium tuberculosis
KTKIETALDRQKI

SEQ ID NO: 84890 - protein, 13 aa, Mycobacterium tuberculosis
TKIETALDRQKIW

SEQ ID NO: 84891 - protein, 13 aa, Mycobacterium tuberculosis
KIETALDRQKIWK

SEQ ID NO: 84892 - protein, 13 aa, Mycobacterium tuberculosis
IETALDRQKIWKR

SEQ ID NO: 84893 - protein, 13 aa, Mycobacterium tuberculosis
ETALDRQKIWKRA

SEQ ID NO: 84894 - protein, 13 aa, Mycobacterium tuberculosis
TALDRQKIWKRAF

SEQ ID NO: 84895 - protein, 13 aa, Mycobacterium tuberculosis
ALDRQKIWKRAFG

SEQ ID NO: 84896 - protein, 13 aa, Mycobacterium tuberculosis
LDRQKIWKRAFGD

SEQ ID NO: 84897 - protein, 13 aa, Mycobacterium tuberculosis
DRQKIWKRAFGDT

SEQ ID NO: 84898 - protein, 13 aa, Mycobacterium tuberculosis
RQKIWKRAFGDTP

SEQ ID NO: 84899 - protein, 13 aa, Mycobacterium tuberculosis
QKIWKRAFGDTPP

SEQ ID NO: 84900 - protein, 13 aa, Mycobacterium tuberculosis
KIWKRAFGDTPPI

SEQ ID NO: 84901 - protein, 14 aa, Mycobacterium tuberculosis
MPSGWVSHRLGGSP

SEQ ID NO: 84902 - protein, 14 aa, Mycobacterium tuberculosis
PSGWVSHRLGGSPK

SEQ ID NO: 84903 - protein, 14 aa, Mycobacterium tuberculosis
SGWVSHRLGGSPKC

SEQ ID NO: 84904 - protein, 14 aa, Mycobacterium tuberculosis
GWVSHRLGGSPKCI

SEQ ID NO: 84905 - protein, 14 aa, Mycobacterium tuberculosis
WVSHRLGGSPKCIS

SEQ ID NO: 84906 - protein, 14 aa, Mycobacterium tuberculosis
VSHRLGGSPKCISA

SEQ ID NO: 84907 - protein, 14 aa, Mycobacterium tuberculosis
SHRLGGSPKCISAL

SEQ ID NO: 84908 - protein, 14 aa, Mycobacterium tuberculosis
HRLGGSPKCISALS

SEQ ID NO: 84909 - protein, 14 aa, Mycobacterium tuberculosis
RLGGSPKCISALSL

SEQ ID NO: 84910 - protein, 14 aa, Mycobacterium tuberculosis
LGGSPKCISALSLP

SEQ ID NO: 84911 - protein, 14 aa, Mycobacterium tuberculosis
GGSPKCISALSLPS

SEQ ID NO: 84912 - protein, 14 aa, Mycobacterium tuberculosis
GSPKCISALSLPSG

SEQ ID NO: 84913 - protein, 14 aa, Mycobacterium tuberculosis
SPKCISALSLPSGT

SEQ ID NO: 84914 - protein, 14 aa, Mycobacterium tuberculosis
PKCISALSLPSGTV

SEQ ID NO: 84915 - protein, 14 aa, Mycobacterium tuberculosis
KCISALSLPSGTVG

SEQ ID NO: 84916 - protein, 14 aa, Mycobacterium tuberculosis
CISALSLPSGTVGA

SEQ ID NO: 84917 - protein, 14 aa, Mycobacterium tuberculosis
ISALSLPSGTVGAP

SEQ ID NO: 84918 - protein, 14 aa, Mycobacterium tuberculosis
SALSLPSGTVGAPS

SEQ ID NO: 84919 - protein, 14 aa, Mycobacterium tuberculosis
ALSLPSGTVGAPSK

SEQ ID NO: 84920 - protein, 14 aa, Mycobacterium tuberculosis
LSLPSGTVGAPSKP

SEQ ID NO: 84921 - protein, 14 aa, Mycobacterium tuberculosis
SLPSGTVGAPSKPD

SEQ ID NO: 84922 - protein, 14 aa, Mycobacterium tuberculosis
LPSGTVGAPSKPDN

SEQ ID NO: 84923 - protein, 14 aa, Mycobacterium tuberculosis
PSGTVGAPSKPDND

SEQ ID NO: 84924 - protein, 14 aa, Mycobacterium tuberculosis
SGTVGAPSKPDNDA

SEQ ID NO: 84925 - protein, 14 aa, Mycobacterium tuberculosis
GTVGAPSKPDNDAT

SEQ ID NO: 84926 - protein, 14 aa, Mycobacterium tuberculosis
TVGAPSKPDNDATR

SEQ ID NO: 84927 - protein, 14 aa, Mycobacterium tuberculosis
VGAPSKPDNDATRG

SEQ ID NO: 84928 - protein, 14 aa, Mycobacterium tuberculosis
GAPSKPDNDATRGR

SEQ ID NO: 84929 - protein, 14 aa, Mycobacterium tuberculosis
APSKPDNDATRGRT

SEQ ID NO: 84930 - protein, 14 aa, Mycobacterium tuberculosis
PSKPDNDATRGRTR

SEQ ID NO: 84931 - protein, 14 aa, Mycobacterium tuberculosis
SKPDNDATRGRTRP

SEQ ID NO: 84932 - protein, 14 aa, Mycobacterium tuberculosis
KPDNDATRGRTRPT

SEQ ID NO: 84933 - protein, 14 aa, Mycobacterium tuberculosis
PDNDATRGRTRPTV

SEQ ID NO: 84934 - protein, 14 aa, Mycobacterium tuberculosis
DNDATRGRTRPTVP

SEQ ID NO: 84935 - protein, 14 aa, Mycobacterium tuberculosis
NDATRGRTRPTVPP

SEQ ID NO: 84936 - protein, 14 aa, Mycobacterium tuberculosis
DATRGRTRPTVPPP

SEQ ID NO: 84937 - protein, 14 aa, Mycobacterium tuberculosis
ATRGRTRPTVPPPD

SEQ ID NO: 84938 - protein, 14 aa, Mycobacterium tuberculosis
TRGRTRPTVPPPDP

SEQ ID NO: 84939 - protein, 14 aa, Mycobacterium tuberculosis
RGRTRPTVPPPDPA

SEQ ID NO: 84940 - protein, 14 aa, Mycobacterium tuberculosis
GRTRPTVPPPDPAA

SEQ ID NO: 84941 - protein, 14 aa, Mycobacterium tuberculosis
RTRPTVPPPDPAAM

SEQ ID NO: 84942 - protein, 14 aa, Mycobacterium tuberculosis
TRPTVPPPDPAAMG

SEQ ID NO: 84943 - protein, 14 aa, Mycobacterium tuberculosis
RPTVPPPDPAAMGT

SEQ ID NO: 84944 - protein, 14 aa, Mycobacterium tuberculosis
PTVPPPDPAAMGTW

SEQ ID NO: 84945 - protein, 14 aa, Mycobacterium tuberculosis
TVPPPDPAAMGTWK

SEQ ID NO: 84946 - protein, 14 aa, Mycobacterium tuberculosis
VPPPDPAAMGTWKF

SEQ ID NO: 84947 - protein, 14 aa, Mycobacterium tuberculosis
PPPDPAAMGTWKFF

SEQ ID NO: 84948 - protein, 14 aa, Mycobacterium tuberculosis
PPDPAAMGTWKFFR

SEQ ID NO: 84949 - protein, 14 aa, Mycobacterium tuberculosis
PDPAAMGTWKFFRA

SEQ ID NO: 84950 - protein, 14 aa, Mycobacterium tuberculosis
DPAAMGTWKFFRAS

SEQ ID NO: 84951 - protein, 14 aa, Mycobacterium tuberculosis
PAAMGTWKFFRASV

SEQ ID NO: 84952 - protein, 14 aa, Mycobacterium tuberculosis
AAMGTWKFFRASVD

SEQ ID NO: 84953 - protein, 14 aa, Mycobacterium tuberculosis
AMGTWKFFRASVDG

SEQ ID NO: 84954 - protein, 14 aa, Mycobacterium tuberculosis
MGTWKFFRASVDGR

SEQ ID NO: 84955 - protein, 14 aa, Mycobacterium tuberculosis
GTWKFFRASVDGRP

SEQ ID NO: 84956 - protein, 14 aa, Mycobacterium tuberculosis
TWKFFRASVDGRPV

SEQ ID NO: 84957 - protein, 14 aa, Mycobacterium tuberculosis
WKFFRASVDGRPVF

SEQ ID NO: 84958 - protein, 14 aa, Mycobacterium tuberculosis
KFFRASVDGRPVFK

SEQ ID NO: 84959 - protein, 14 aa, Mycobacterium tuberculosis
FFRASVDGRPVFKK

SEQ ID NO: 84960 - protein, 14 aa, Mycobacterium tuberculosis
FRASVDGRPVFKKE

SEQ ID NO: 84961 - protein, 14 aa, Mycobacterium tuberculosis
RASVDGRPVFKKEF

SEQ ID NO: 84962 - protein, 14 aa, Mycobacterium tuberculosis
ASVDGRPVFKKEFD

SEQ ID NO: 84963 - protein, 14 aa, Mycobacterium tuberculosis
SVDGRPVFKKEFDK

SEQ ID NO: 84964 - protein, 14 aa, Mycobacterium tuberculosis
VDGRPVFKKEFDKL

SEQ ID NO: 84965 - protein, 14 aa, Mycobacterium tuberculosis
DGRPVFKKEFDKLP

SEQ ID NO: 84966 - protein, 14 aa, Mycobacterium tuberculosis
GRPVFKKEFDKLPD

SEQ ID NO: 84967 - protein, 14 aa, Mycobacterium tuberculosis
RPVFKKEFDKLPDQ

SEQ ID NO: 84968 - protein, 14 aa, Mycobacterium tuberculosis
PVFKKEFDKLPDQA

SEQ ID NO: 84969 - protein, 14 aa, Mycobacterium tuberculosis
VFKKEFDKLPDQAR

SEQ ID NO: 84970 - protein, 14 aa, Mycobacterium tuberculosis
FKKEFDKLPDQARA

SEQ ID NO: 84971 - protein, 14 aa, Mycobacterium tuberculosis
KKEFDKLPDQARAA

SEQ ID NO: 84972 - protein, 14 aa, Mycobacterium tuberculosis
KEFDKLPDQARAAL

SEQ ID NO: 84973 - protein, 14 aa, Mycobacterium tuberculosis
EFDKLPDQARAALI

SEQ ID NO: 84974 - protein, 14 aa, Mycobacterium tuberculosis
FDKLPDQARAALIV

SEQ ID NO: 84975 - protein, 14 aa, Mycobacterium tuberculosis
DKLPDQARAALIVL

SEQ ID NO: 84976 - protein, 14 aa, Mycobacterium tuberculosis
KLPDQARAALIVLM

SEQ ID NO: 84977 - protein, 14 aa, Mycobacterium tuberculosis
LPDQARAALIVLMQ

SEQ ID NO: 84978 - protein, 14 aa, Mycobacterium tuberculosis
PDQARAALIVLMQR

SEQ ID NO: 84979 - protein, 14 aa, Mycobacterium tuberculosis
DQARAALIVLMQRY

SEQ ID NO: 84980 - protein, 14 aa, Mycobacterium tuberculosis
QARAALIVLMQRYL

SEQ ID NO: 84981 - protein, 14 aa, Mycobacterium tuberculosis
ARAALIVLMQRYLV
